United States Patent 8,877,916 (PROMOTER, PROMOTER CONTROL ELEMENTS, AND COMBINATIONS, AND USES THEREOF) - sequence listing, part 23

SEQ ID NO: 61857 - DNA, 11 bp, Unknown
  misc_feature (1)..( 11): Matrix.003 file - promoters60/5662739
aagaagaaaaa

SEQ ID NO: 61858 - DNA, 8 bp, Unknown
  misc_feature (1)..( 8): Matrix.003 file - promoters60/5662749
catatttt

SEQ ID NO: 61859 - DNA, 11 bp, Unknown
  misc_feature (1)..( 11): Matrix.003 file - promoters60/5662749
actactaaaaa

SEQ ID NO: 61860 - DNA, 10 bp, Unknown
  misc_feature (1)..( 10): Matrix.003 file - promoters60/5662749
taaaataaga

SEQ ID NO: 61861 - DNA, 9 bp, Unknown
  misc_feature (1)..( 9): Matrix.003 file - promoters60/5662749
ctttgtttc

SEQ ID NO: 61862 - DNA, 8 bp, Unknown
  misc_feature (1)..( 8): Matrix.003 file - promoters60/5662749
aaagtctt

SEQ ID NO: 61863 - DNA, 8 bp, Unknown
  misc_feature (1)..( 8): Matrix.003 file - promoters60/5662749
aaaattct

SEQ ID NO: 61864 - DNA, 8 bp, Unknown
  misc_feature (1)..( 8): Matrix.003 file - promoters60/5662749
tataaata

SEQ ID NO: 61865 - DNA, 8 bp, Unknown
  misc_feature (1)..( 8): Matrix.003 file - promoters60/5662763
ttttaata

SEQ ID NO: 61866 - DNA, 7 bp, Unknown
  misc_feature (1)..( 7): Matrix.003 file - promoters60/5662763
aatcaat

SEQ ID NO: 61867 - DNA, 13 bp, Unknown
  misc_feature (1)..( 13): Matrix.003 file - promoters60/5662763
tgttatgtggtgt

SEQ ID NO: 61868 - DNA, 7 bp, Unknown
  misc_feature (1)..( 7): Matrix.003 file - promoters60/5662763
attcgca

SEQ ID NO: 61869 - DNA, 9 bp, Unknown
  misc_feature (1)..( 9): Matrix.003 file - promoters60/5662763
tttgttttt

SEQ ID NO: 61870 - DNA, 7 bp, Unknown
  misc_feature (1)..( 7): Matrix.003 file - promoters60/5662763
tttgttt

SEQ ID NO: 61871 - DNA, 9 bp, Unknown
  misc_feature (1)..( 9): Matrix.003 file - promoters60/5662763
atgaatttg

SEQ ID NO: 61872 - DNA, 7 bp, Unknown
  misc_feature (1)..( 7): Matrix.003 file - promoters60/5662763
aatatgt

SEQ ID NO: 61873 - DNA, 6 bp, Unknown
  misc_feature (1)..( 6): Matrix.003 file - promoters60/5662763
ggtgtt

SEQ ID NO: 61874 - DNA, 7 bp, Unknown
  misc_feature (1)..( 7): Matrix.003 file - promoters60/5662763
ataattt

SEQ ID NO: 61875 - DNA, 6 bp, Unknown
  misc_feature (1)..( 6): Matrix.003 file - promoters60/5662763
ttattt

SEQ ID NO: 61876 - DNA, 9 bp, Unknown
  misc_feature (1)..( 9): Matrix.003 file - promoters60/5662763
tttctgttt

SEQ ID NO: 61877 - DNA, 6 bp, Unknown
  misc_feature (1)..( 6): Matrix.003 file - promoters60/5662763
tttcag

SEQ ID NO: 61878 - DNA, 7 bp, Unknown
  misc_feature (1)..( 7): Matrix.003 file - promoters60/5662763
aacaaaa

SEQ ID NO: 61879 - DNA, 8 bp, Unknown
  misc_feature (1)..( 8): Matrix.003 file - promoters60/5662763
taacaaaa

SEQ ID NO: 61880 - DNA, 7 bp, Unknown
  misc_feature (1)..( 7): Matrix.003 file - promoters60/5662763
tttttct

SEQ ID NO: 61881 - DNA, 7 bp, Unknown
  misc_feature (1)..( 7): Matrix.003 file - promoters60/5662763
aaaattg

SEQ ID NO: 61882 - DNA, 9 bp, Unknown
  misc_feature (1)..( 9): Matrix.003 file - promoters60/5662763
ggttcgatt

SEQ ID NO: 61883 - DNA, 7 bp, Unknown
  misc_feature (1)..( 7): Matrix.003 file - promoters60/5662763
caaagtc

SEQ ID NO: 61884 - DNA, 11 bp, Unknown
  misc_feature (1)..( 11): Matrix.003 file - promoters60/5662765
agaaaaaaaat

SEQ ID NO: 61885 - DNA, 9 bp, Unknown
  misc_feature (1)..( 9): Matrix.003 file - promoters60/5662765
tttattaaa

SEQ ID NO: 61886 - DNA, 10 bp, Unknown
  misc_feature (1)..( 10): Matrix.003 file - promoters60/5662765
aggcccatat

SEQ ID NO: 61887 - DNA, 11 bp, Unknown
  misc_feature (1)..( 11): Matrix.003 file - promoters60/5662765
atttttattaa

SEQ ID NO: 61888 - DNA, 7 bp, Unknown
  misc_feature (1)..( 7): Matrix.003 file - promoters60/5662769
aataaaa

SEQ ID NO: 61889 - DNA, 8 bp, Unknown
  misc_feature (1)..( 8): Matrix.003 file - promoters60/5662769
ctttttaa

SEQ ID NO: 61890 - DNA, 7 bp, Unknown
  misc_feature (1)..( 7): Matrix.003 file - promoters60/5662769
aaaaaga

SEQ ID NO: 61891 - DNA, 8 bp, Unknown
  misc_feature (1)..( 8): Matrix.003 file - promoters60/5662769
ataaaaaa

SEQ ID NO: 61892 - DNA, 11 bp, Unknown
  misc_feature (1)..( 11): Matrix.003 file - promoters60/5662769
tattatcataa

SEQ ID NO: 61893 - DNA, 11 bp, Unknown
  misc_feature (1)..( 11): Matrix.003 file - promoters60/5662769
tttctaactcc

SEQ ID NO: 61894 - DNA, 9 bp, Unknown
  misc_feature (1)..( 9): Matrix.003 file - promoters60/5662769
ttaaaaaaa

SEQ ID NO: 61895 - DNA, 8 bp, Unknown
  misc_feature (1)..( 8): Matrix.003 file - promoters60/5662771
tgagatga

SEQ ID NO: 61896 - DNA, 6 bp, Unknown
  misc_feature (1)..( 6): Matrix.003 file - promoters60/5662771
ttttat

SEQ ID NO: 61897 - DNA, 8 bp, Unknown
  misc_feature (1)..( 8): Matrix.003 file - promoters60/5662771
gaatattt

SEQ ID NO: 61898 - DNA, 9 bp, Unknown
  misc_feature (1)..( 9): Matrix.003 file - promoters60/5662771
cccaaacca

SEQ ID NO: 61899 - DNA, 11 bp, Unknown
  misc_feature (1)..( 11): Matrix.003 file - promoters60/5662771
aatttcgtttg

SEQ ID NO: 61900 - DNA, 7 bp, Unknown
  misc_feature (1)..( 7): Matrix.003 file - promoters60/5662771
attattg

SEQ ID NO: 61901 - DNA, 6 bp, Unknown
  misc_feature (1)..( 6): Matrix.003 file - promoters60/5662771
cacatt

SEQ ID NO: 61902 - DNA, 9 bp, Unknown
  misc_feature (1)..( 9): Matrix.003 file - promoters60/5662771
atcccaatt

SEQ ID NO: 61903 - DNA, 8 bp, Unknown
  misc_feature (1)..( 8): Matrix.003 file - promoters60/5662771
taactttt

SEQ ID NO: 61904 - DNA, 8 bp, Unknown
  misc_feature (1)..( 8): Matrix.003 file - promoters60/5662771
ttttattt

SEQ ID NO: 61905 - DNA, 8 bp, Unknown
  misc_feature (1)..( 8): Matrix.003 file - promoters60/5662771
tttctttt

SEQ ID NO: 61906 - DNA, 8 bp, Unknown
  misc_feature (1)..( 8): Matrix.003 file - promoters60/5662771
tttgctca

SEQ ID NO: 61907 - DNA, 6 bp, Unknown
  misc_feature (1)..( 6): Matrix.003 file - promoters60/5662771
aatatt

SEQ ID NO: 61908 - DNA, 7 bp, Unknown
  misc_feature (1)..( 7): Matrix.003 file - promoters60/5662779
aaaagat

SEQ ID NO: 61909 - DNA, 7 bp, Unknown
  misc_feature (1)..( 7): Matrix.003 file - promoters60/5662779
ttagttt

SEQ ID NO: 61910 - DNA, 9 bp, Unknown
  misc_feature (1)..( 9): Matrix.003 file - promoters60/5662779
tttgcagaa

SEQ ID NO: 61911 - DNA, 11 bp, Unknown
  misc_feature (1)..( 11): Matrix.003 file - promoters60/5662779
agtcaaagaaa

SEQ ID NO: 61912 - DNA, 9 bp, Unknown
  misc_feature (1)..( 9): Matrix.003 file - promoters60/5662779
ttaatataa

SEQ ID NO: 61913 - DNA, 8 bp, Unknown
  misc_feature (1)..( 8): Matrix.003 file - promoters60/5662779
gatgtaac

SEQ ID NO: 61914 - DNA, 7 bp, Unknown
  misc_feature (1)..( 7): Matrix.003 file - promoters60/5662779
aatatgt

SEQ ID NO: 61915 - DNA, 13 bp, Unknown
  misc_feature (1)..( 13): Matrix.003 file - promoters60/5662779
tgcaaaagagaca

SEQ ID NO: 61916 - DNA, 6 bp, Unknown
  misc_feature (1)..( 6): Matrix.003 file - promoters60/5662779
ttttga

SEQ ID NO: 61917 - DNA, 6 bp, Unknown
  misc_feature (1)..( 6): Matrix.003 file - promoters60/5662779
cttgcc

SEQ ID NO: 61918 - DNA, 7 bp, Unknown
  misc_feature (1)..( 7): Matrix.003 file - promoters60/5662779
ctcctgc

SEQ ID NO: 61919 - DNA, 6 bp, Unknown
  misc_feature (1)..( 6): Matrix.003 file - promoters60/5662785
aatgtg

SEQ ID NO: 61920 - DNA, 6 bp, Unknown
  misc_feature (1)..( 6): Matrix.003 file - promoters60/5662785
ttctta

SEQ ID NO: 61921 - DNA, 7 bp, Unknown
  misc_feature (1)..( 7): Matrix.003 file - promoters60/5662785
gattaaa

SEQ ID NO: 61922 - DNA, 8 bp, Unknown
  misc_feature (1)..( 8): Matrix.003 file - promoters60/5662785
tttgggcc

SEQ ID NO: 61923 - DNA, 8 bp, Unknown
  misc_feature (1)..( 8): Matrix.003 file - promoters60/5662785
tctcttgg

SEQ ID NO: 61924 - DNA, 7 bp, Unknown
  misc_feature (1)..( 7): Matrix.003 file - promoters60/5662785
ataattt

SEQ ID NO: 61925 - DNA, 6 bp, Unknown
  misc_feature (1)..( 6): Matrix.003 file - promoters60/5662785
tgattt

SEQ ID NO: 61926 - DNA, 8 bp, Unknown
  misc_feature (1)..( 8): Matrix.003 file - promoters60/5662785
tttccttt

SEQ ID NO: 61927 - DNA, 7 bp, Unknown
  misc_feature (1)..( 7): Matrix.003 file - promoters60/5662785
atctttg

SEQ ID NO: 61928 - DNA, 6 bp, Unknown
  misc_feature (1)..( 6): Matrix.003 file - promoters60/5662785
tttgat

SEQ ID NO: 61929 - DNA, 6 bp, Unknown
  misc_feature (1)..( 6): Matrix.003 file - promoters60/5662785
attctt

SEQ ID NO: 61930 - DNA, 8 bp, Unknown
  misc_feature (1)..( 8): Matrix.003 file - promoters60/5662785
tttatctt

SEQ ID NO: 61931 - DNA, 6 bp, Unknown
  misc_feature (1)..( 6): Matrix.003 file - promoters60/5662785
ttatat

SEQ ID NO: 61932 - DNA, 8 bp, Unknown
  misc_feature (1)..( 8): Matrix.003 file - promoters60/5662785
atatatct

SEQ ID NO: 61933 - DNA, 7 bp, Unknown
  misc_feature (1)..( 7): Matrix.003 file - promoters60/5662785
cttagtt

SEQ ID NO: 61934 - DNA, 7 bp, Unknown
  misc_feature (1)..( 7): Matrix.003 file - promoters60/5662785
gttattt

SEQ ID NO: 61935 - DNA, 13 bp, Unknown
  misc_feature (1)..( 13): Matrix.003 file - promoters60/5662799
aaacaaatttgcc

SEQ ID NO: 61936 - DNA, 8 bp, Unknown
  misc_feature (1)..( 8): Matrix.003 file - promoters60/5662809
tttgttat

SEQ ID NO: 61937 - DNA, 6 bp, Unknown
  misc_feature (1)..( 6): Matrix.003 file - promoters60/5662809
ataaaa

SEQ ID NO: 61938 - DNA, 13 bp, Unknown
  misc_feature (1)..( 13): Matrix.003 file - promoters60/5662809
attatttaaaact

SEQ ID NO: 61939 - DNA, 11 bp, Unknown
  misc_feature (1)..( 11): Matrix.003 file - promoters60/5662809
ttaaagttcaa

SEQ ID NO: 61940 - DNA, 7 bp, Unknown
  misc_feature (1)..( 7): Matrix.003 file - promoters60/5662809
aatattt

SEQ ID NO: 61941 - DNA, 7 bp, Unknown
  misc_feature (1)..( 7): Matrix.003 file - promoters60/5662809
tttcttt

SEQ ID NO: 61942 - DNA, 6 bp, Unknown
  misc_feature (1)..( 6): Matrix.003 file - promoters60/5662809
cagaca

SEQ ID NO: 61943 - DNA, 6 bp, Unknown
  misc_feature (1)..( 6): Matrix.003 file - promoters60/5662809
tttttt

SEQ ID NO: 61944 - DNA, 6 bp, Unknown
  misc_feature (1)..( 6): Matrix.003 file - promoters60/5662809
ctttta

SEQ ID NO: 61945 - DNA, 6 bp, Unknown
  misc_feature (1)..( 6): Matrix.003 file - promoters60/5662809
caaaaa

SEQ ID NO: 61946 - DNA, 11 bp, Unknown
  misc_feature (1)..( 11): Matrix.003 file - promoters60/5662809
aaacaacaaat

SEQ ID NO: 61947 - DNA, 7 bp, Unknown
  misc_feature (1)..( 7): Matrix.003 file - promoters60/5662809
ctattta

SEQ ID NO: 61948 - DNA, 7 bp, Unknown
  misc_feature (1)..( 7): Matrix.003 file - promoters60/5662809
ttttctt

SEQ ID NO: 61949 - DNA, 6 bp, Unknown
  misc_feature (1)..( 6): Matrix.003 file - promoters60/5662809
tttatt

SEQ ID NO: 61950 - DNA, 8 bp, Unknown
  misc_feature (1)..( 8): Matrix.003 file - promoters60/5662809
ctaattaa

SEQ ID NO: 61951 - DNA, 6 bp, Unknown
  misc_feature (1)..( 6): Matrix.003 file - promoters60/5662809
aataaa

SEQ ID NO: 61952 - DNA, 7 bp, Unknown
  misc_feature (1)..( 7): Matrix.003 file - promoters60/5662809
tttgtta

SEQ ID NO: 61953 - DNA, 7 bp, Unknown
  misc_feature (1)..( 7): Matrix.003 file - promoters60/5662809
aaagaaa

SEQ ID NO: 61954 - DNA, 7 bp, Unknown
  misc_feature (1)..( 7): Matrix.003 file - promoters60/5662809
cgcgttt

SEQ ID NO: 61955 - DNA, 8 bp, Unknown
  misc_feature (1)..( 8): Matrix.003 file - promoters60/5662828
aaatcctc

SEQ ID NO: 61956 - DNA, 7 bp, Unknown
  misc_feature (1)..( 7): Matrix.003 file - promoters60/5662828
aatatct

SEQ ID NO: 61957 - DNA, 7 bp, Unknown
  misc_feature (1)..( 7): Matrix.003 file - promoters60/5662828
tttataa

SEQ ID NO: 61958 - DNA, 6 bp, Unknown
  misc_feature (1)..( 6): Matrix.003 file - promoters60/5662828
ttgtta

SEQ ID NO: 61959 - DNA, 7 bp, Unknown
  misc_feature (1)..( 7): Matrix.003 file - promoters60/5662828
ttttgat

SEQ ID NO: 61960 - DNA, 8 bp, Unknown
  misc_feature (1)..( 8): Matrix.003 file - promoters60/5662828
agaccctt

SEQ ID NO: 61961 - DNA, 6 bp, Unknown
  misc_feature (1)..( 6): Matrix.003 file - promoters60/5662828
ttgaga

SEQ ID NO: 61962 - DNA, 7 bp, Unknown
  misc_feature (1)..( 7): Matrix.003 file - promoters60/5662828
taaattg

SEQ ID NO: 61963 - DNA, 6 bp, Unknown
  misc_feature (1)..( 6): Matrix.003 file - promoters60/5662828
ttttaa

SEQ ID NO: 61964 - DNA, 6 bp, Unknown
  misc_feature (1)..( 6): Matrix.003 file - promoters60/5662828
atacct

SEQ ID NO: 61965 - DNA, 6 bp, Unknown
  misc_feature (1)..( 6): Matrix.003 file - promoters60/5662828
ataatt

SEQ ID NO: 61966 - DNA, 6 bp, Unknown
  misc_feature (1)..( 6): Matrix.003 file - promoters60/5662828
ctacgt

SEQ ID NO: 61967 - DNA, 6 bp, Unknown
  misc_feature (1)..( 6): Matrix.003 file - promoters60/5662828
gttgat

SEQ ID NO: 61968 - DNA, 8 bp, Unknown
  misc_feature (1)..( 8): Matrix.003 file - promoters60/5662828
aatatctc

SEQ ID NO: 61969 - DNA, 6 bp, Unknown
  misc_feature (1)..( 6): Matrix.003 file - promoters60/5662828
gggttt

SEQ ID NO: 61970 - DNA, 6 bp, Unknown
  misc_feature (1)..( 6): Matrix.003 file - promoters60/5662828
acaaat

SEQ ID NO: 61971 - DNA, 7 bp, Unknown
  misc_feature (1)..( 7): Matrix.003 file - promoters60/5662828
tctaaaa

SEQ ID NO: 61972 - DNA, 6 bp, Unknown
  misc_feature (1)..( 6): Matrix.003 file - promoters60/5662828
aatgtc

SEQ ID NO: 61973 - DNA, 7 bp, Unknown
  misc_feature (1)..( 7): Matrix.003 file - promoters60/5662828
aatctac

SEQ ID NO: 61974 - DNA, 7 bp, Unknown
  misc_feature (1)..( 7): Matrix.003 file - promoters60/5662835
tttatga

SEQ ID NO: 61975 - DNA, 7 bp, Unknown
  misc_feature (1)..( 7): Matrix.003 file - promoters60/5662835
actattg

SEQ ID NO: 61976 - DNA, 6 bp, Unknown
  misc_feature (1)..( 6): Matrix.003 file - promoters60/5662835
taacca

SEQ ID NO: 61977 - DNA, 6 bp, Unknown
  misc_feature (1)..( 6): Matrix.003 file - promoters60/5662835
gatgag

SEQ ID NO: 61978 - DNA, 6 bp, Unknown
  misc_feature (1)..( 6): Matrix.003 file - promoters60/5662835
ttggaa

SEQ ID NO: 61979 - DNA, 8 bp, Unknown
  misc_feature (1)..( 8): Matrix.003 file - promoters60/5662835
acaaattt

SEQ ID NO: 61980 - DNA, 7 bp, Unknown
  misc_feature (1)..( 7): Matrix.003 file - promoters60/5662835
ttgactt

SEQ ID NO: 61981 - DNA, 8 bp, Unknown
  misc_feature (1)..( 8): Matrix.003 file - promoters60/5662835
ttgattta

SEQ ID NO: 61982 - DNA, 6 bp, Unknown
  misc_feature (1)..( 6): Matrix.003 file - promoters60/5662835
aaacaa

SEQ ID NO: 61983 - DNA, 6 bp, Unknown
  misc_feature (1)..( 6): Matrix.003 file - promoters60/5662835
acacgt

SEQ ID NO: 61984 - DNA, 6 bp, Unknown
  misc_feature (1)..( 6): Matrix.003 file - promoters60/5662835
ttaacc

SEQ ID NO: 61985 - DNA, 7 bp, Unknown
  misc_feature (1)..( 7): Matrix.003 file - promoters60/5662835
tttggaa

SEQ ID NO: 61986 - DNA, 6 bp, Unknown
  misc_feature (1)..( 6): Matrix.003 file - promoters60/5662835
aatttg

SEQ ID NO: 61987 - DNA, 7 bp, Unknown
  misc_feature (1)..( 7): Matrix.003 file - promoters60/5662835
attaatt

SEQ ID NO: 61988 - DNA, 6 bp, Unknown
  misc_feature (1)..( 6): Matrix.003 file - promoters60/5662835
ttaaaa

SEQ ID NO: 61989 - DNA, 8 bp, Unknown
  misc_feature (1)..( 8): Matrix.003 file - promoters60/5662893
aaaataaa

SEQ ID NO: 61990 - DNA, 9 bp, Unknown
  misc_feature (1)..( 9): Matrix.003 file - promoters60/5662895
aattaaaac

SEQ ID NO: 61991 - DNA, 8 bp, Unknown
  misc_feature (1)..( 8): Matrix.003 file - promoters60/5662895
ttttgttt

SEQ ID NO: 61992 - DNA, 7 bp, Unknown
  misc_feature (1)..( 7): Matrix.003 file - promoters60/5662895
cattttt

SEQ ID NO: 61993 - DNA, 6 bp, Unknown
  misc_feature (1)..( 6): Matrix.003 file - promoters60/5662895
taaatt

SEQ ID NO: 61994 - DNA, 6 bp, Unknown
  misc_feature (1)..( 6): Matrix.003 file - promoters60/5662895
ttctta

SEQ ID NO: 61995 - DNA, 8 bp, Unknown
  misc_feature (1)..( 8): Matrix.003 file - promoters60/5662895
aaaatttt

SEQ ID NO: 61996 - DNA, 7 bp, Unknown
  misc_feature (1)..( 7): Matrix.003 file - promoters60/5662895
caacttc

SEQ ID NO: 61997 - DNA, 6 bp, Unknown
  misc_feature (1)..( 6): Matrix.003 file - promoters60/5662895
tgattc

SEQ ID NO: 61998 - DNA, 6 bp, Unknown
  misc_feature (1)..( 6): Matrix.003 file - promoters60/5662895
aaaaac

SEQ ID NO: 61999 - DNA, 6 bp, Unknown
  misc_feature (1)..( 6): Matrix.003 file - promoters60/5662895
tttatt

SEQ ID NO: 62000 - DNA, 9 bp, Unknown
  misc_feature (1)..( 9): Matrix.003 file - promoters60/5662895
tttacataa

SEQ ID NO: 62001 - DNA, 7 bp, Unknown
  misc_feature (1)..( 7): Matrix.003 file - promoters60/5662895
agaagaa

SEQ ID NO: 62002 - DNA, 9 bp, Unknown
  misc_feature (1)..( 9): Matrix.003 file - promoters60/5662895
tgtggattt

SEQ ID NO: 62003 - DNA, 6 bp, Unknown
  misc_feature (1)..( 6): Matrix.003 file - promoters60/5662895
tcgaat

SEQ ID NO: 62004 - DNA, 7 bp, Unknown
  misc_feature (1)..( 7): Matrix.003 file - promoters60/5662895
cataaaa

SEQ ID NO: 62005 - DNA, 7 bp, Unknown
  misc_feature (1)..( 7): Matrix.003 file - promoters60/5662895
aatcgga

SEQ ID NO: 62006 - DNA, 7 bp, Unknown
  misc_feature (1)..( 7): Matrix.003 file - promoters60/5662895
ttcagat

SEQ ID NO: 62007 - DNA, 6 bp, Unknown
  misc_feature (1)..( 6): Matrix.003 file - promoters60/5662895
ctgtaa

SEQ ID NO: 62008 - DNA, 6 bp, Unknown
  misc_feature (1)..( 6): Matrix.003 file - promoters60/5662895
aaaatg

SEQ ID NO: 62009 - DNA, 8 bp, Unknown
  misc_feature (1)..( 8): Matrix.003 file - promoters60/5662895
ttatctaa

SEQ ID NO: 62010 - DNA, 7 bp, Unknown
  misc_feature (1)..( 7): Matrix.003 file - promoters60/5662895
ttatctt

SEQ ID NO: 62011 - DNA, 6 bp, Unknown
  misc_feature (1)..( 6): Matrix.003 file - promoters60/5662895
attttt

SEQ ID NO: 62012 - DNA, 13 bp, Unknown
  misc_feature (1)..( 13): Matrix.003 file - promoters60/5662914
ttatttaaaaaca

SEQ ID NO: 62013 - DNA, 11 bp, Unknown
  misc_feature (1)..( 11): Matrix.003 file - promoters60/5662914
aattaaaaaaa

SEQ ID NO: 62014 - DNA, 7 bp, Unknown
  misc_feature (1)..( 7): Matrix.003 file - promoters60/5662921
tttctta

SEQ ID NO: 62015 - DNA, 6 bp, Unknown
  misc_feature (1)..( 6): Matrix.003 file - promoters60/5662921
aatgtt

SEQ ID NO: 62016 - DNA, 9 bp, Unknown
  misc_feature (1)..( 9): Matrix.003 file - promoters60/5662921
taatttcaa

SEQ ID NO: 62017 - DNA, 8 bp, Unknown
  misc_feature (1)..( 8): Matrix.003 file - promoters60/5662921
tggcgtgt

SEQ ID NO: 62018 - DNA, 8 bp, Unknown
  misc_feature (1)..( 8): Matrix.003 file - promoters60/5662921
aaatttta

SEQ ID NO: 62019 - DNA, 8 bp, Unknown
  misc_feature (1)..( 8): Matrix.003 file - promoters60/5662921
tatataaa

SEQ ID NO: 62020 - DNA, 7 bp, Unknown
  misc_feature (1)..( 7): Matrix.003 file - promoters60/5662921
aataatt

SEQ ID NO: 62021 - DNA, 7 bp, Unknown
  misc_feature (1)..( 7): Matrix.003 file - promoters60/5662921
taaaaaa

SEQ ID NO: 62022 - DNA, 6 bp, Unknown
  misc_feature (1)..( 6): Matrix.003 file - promoters60/5662921
gttcaa

SEQ ID NO: 62023 - DNA, 6 bp, Unknown
  misc_feature (1)..( 6): Matrix.003 file - promoters60/5662921
ttttgg

SEQ ID NO: 62024 - DNA, 8 bp, Unknown
  misc_feature (1)..( 8): Matrix.003 file - promoters60/5662921
ttggtttt

SEQ ID NO: 62025 - DNA, 8 bp, Unknown
  misc_feature (1)..( 8): Matrix.003 file - promoters60/5662921
aaaaaaaa

SEQ ID NO: 62026 - DNA, 8 bp, Unknown
  misc_feature (1)..( 8): Matrix.003 file - promoters60/5662921
atacacaa

SEQ ID NO: 62027 - DNA, 7 bp, Unknown
  misc_feature (1)..( 7): Matrix.003 file - promoters60/5662921
attataa

SEQ ID NO: 62028 - DNA, 7 bp, Unknown
  misc_feature (1)..( 7): Matrix.003 file - promoters60/5662921
gtccttt

SEQ ID NO: 62029 - DNA, 6 bp, Unknown
  misc_feature (1)..( 6): Matrix.003 file - promoters60/5662921
ttaaaa

SEQ ID NO: 62030 - DNA, 6 bp, Unknown
  misc_feature (1)..( 6): Matrix.003 file - promoters60/5662921
gaataa

SEQ ID NO: 62031 - DNA, 6 bp, Unknown
  misc_feature (1)..( 6): Matrix.003 file - promoters60/5662921
gagaga

SEQ ID NO: 62032 - DNA, 9 bp, Unknown
  misc_feature (1)..( 9): Matrix.003 file - promoters60/5662945
gaatgtgaa

SEQ ID NO: 62033 - DNA, 7 bp, Unknown
  misc_feature (1)..( 7): Matrix.003 file - promoters60/5662945
ccaagaa

SEQ ID NO: 62034 - DNA, 6 bp, Unknown
  misc_feature (1)..( 6): Matrix.003 file - promoters60/5662945
tttcct

SEQ ID NO: 62035 - DNA, 7 bp, Unknown
  misc_feature (1)..( 7): Matrix.003 file - promoters60/5662945
agaatct

SEQ ID NO: 62036 - DNA, 8 bp, Unknown
  misc_feature (1)..( 8): Matrix.003 file - promoters60/5662945
ttgcagaa

SEQ ID NO: 62037 - DNA, 6 bp, Unknown
  misc_feature (1)..( 6): Matrix.003 file - promoters60/5662945
caaaac

SEQ ID NO: 62038 - DNA, 8 bp, Unknown
  misc_feature (1)..( 8): Matrix.003 file - promoters60/5662945
attgtttg

SEQ ID NO: 62039 - DNA, 7 bp, Unknown
  misc_feature (1)..( 7): Matrix.003 file - promoters60/5662945
caaatga

SEQ ID NO: 62040 - DNA, 8 bp, Unknown
  misc_feature (1)..( 8): Matrix.003 file - promoters60/5662945
acacgtgg

SEQ ID NO: 62041 - DNA, 6 bp, Unknown
  misc_feature (1)..( 6): Matrix.003 file - promoters60/5662945
ttgttt

SEQ ID NO: 62042 - DNA, 6 bp, Unknown
  misc_feature (1)..( 6): Matrix.003 file - promoters60/5662945
tttctt

SEQ ID NO: 62043 - DNA, 10 bp, Unknown
  misc_feature (1)..( 10): Matrix.003 file - promoters60/5662945
gtcatattga

SEQ ID NO: 62044 - DNA, 6 bp, Unknown
  misc_feature (1)..( 6): Matrix.003 file - promoters60/5662945
aattga

SEQ ID NO: 62045 - DNA, 6 bp, Unknown
  misc_feature (1)..( 6): Matrix.003 file - promoters60/5662945
ctacct

SEQ ID NO: 62046 - DNA, 9 bp, Unknown
  misc_feature (1)..( 9): Matrix.003 file - promoters60/5662945
acgtaaccg

SEQ ID NO: 62047 - DNA, 6 bp, Unknown
  misc_feature (1)..( 6): Matrix.003 file - promoters60/5662948
ggaacc

SEQ ID NO: 62048 - DNA, 10 bp, Unknown
  misc_feature (1)..( 10): Matrix.003 file - promoters60/5662948
tatcactgca

SEQ ID NO: 62049 - DNA, 7 bp, Unknown
  misc_feature (1)..( 7): Matrix.003 file - promoters60/5662948
tgtcgtt

SEQ ID NO: 62050 - DNA, 6 bp, Unknown
  misc_feature (1)..( 6): Matrix.003 file - promoters60/5662948
aagata

SEQ ID NO: 62051 - DNA, 10 bp, Unknown
  misc_feature (1)..( 10): Matrix.003 file - promoters60/5662948
tacgatcatc

SEQ ID NO: 62052 - DNA, 7 bp, Unknown
  misc_feature (1)..( 7): Matrix.003 file - promoters60/5662948
tctggta

SEQ ID NO: 62053 - DNA, 7 bp, Unknown
  misc_feature (1)..( 7): Matrix.003 file - promoters60/5662948
tttcttg

SEQ ID NO: 62054 - DNA, 6 bp, Unknown
  misc_feature (1)..( 6): Matrix.003 file - promoters60/5662948
tccatt

SEQ ID NO: 62055 - DNA, 9 bp, Unknown
  misc_feature (1)..( 9): Matrix.003 file - promoters60/5662948
tttattgtt

SEQ ID NO: 62056 - DNA, 7 bp, Unknown
  misc_feature (1)..( 7): Matrix.003 file - promoters60/5662948
caagatt

SEQ ID NO: 62057 - DNA, 7 bp, Unknown
  misc_feature (1)..( 7): Matrix.003 file - promoters60/5662948
acaagtt

SEQ ID NO: 62058 - DNA, 10 bp, Unknown
  misc_feature (1)..( 10): Matrix.003 file - promoters60/5662967
taaaaattct

SEQ ID NO: 62059 - DNA, 11 bp, Unknown
  misc_feature (1)..( 11): Matrix.003 file - promoters60/5662967
caaagatgagt

SEQ ID NO: 62060 - DNA, 9 bp, Unknown
  misc_feature (1)..( 9): Matrix.003 file - promoters60/5662967
aaaaataat

SEQ ID NO: 62061 - DNA, 10 bp, Unknown
  misc_feature (1)..( 10): Matrix.003 file - promoters60/5662967
aaataaaatt

SEQ ID NO: 62062 - DNA, 9 bp, Unknown
  misc_feature (1)..( 9): Matrix.003 file - promoters60/5662967
ttaaaaaaa

SEQ ID NO: 62063 - DNA, 12 bp, Unknown
  misc_feature (1)..( 12): Matrix.003 file - promoters60/5662967
taatattattat

SEQ ID NO: 62064 - DNA, 7 bp, Unknown
  misc_feature (1)..( 7): Matrix.003 file - promoters60/5662967
tttattt

SEQ ID NO: 62065 - DNA, 13 bp, Unknown
  misc_feature (1)..( 13): Matrix.003 file - promoters60/5662967
gattaaaatacaa

SEQ ID NO: 62066 - DNA, 11 bp, Unknown
  misc_feature (1)..( 11): Matrix.003 file - promoters60/5662967
aaaaaactaat

SEQ ID NO: 62067 - DNA, 7 bp, Unknown
  misc_feature (1)..( 7): Matrix.003 file - promoters60/5662977
gttcctt

SEQ ID NO: 62068 - DNA, 8 bp, Unknown
  misc_feature (1)..( 8): Matrix.003 file - promoters60/5662977
aaatgtta

SEQ ID NO: 62069 - DNA, 7 bp, Unknown
  misc_feature (1)..( 7): Matrix.003 file - promoters60/5662977
gttgatt

SEQ ID NO: 62070 - DNA, 8 bp, Unknown
  misc_feature (1)..( 8): Matrix.003 file - promoters60/5662977
cgacatgt

SEQ ID NO: 62071 - DNA, 6 bp, Unknown
  misc_feature (1)..( 6): Matrix.003 file - promoters60/5662977
acatgt

SEQ ID NO: 62072 - DNA, 6 bp, Unknown
  misc_feature (1)..( 6): Matrix.003 file - promoters60/5662992
tatttc

SEQ ID NO: 62073 - DNA, 6 bp, Unknown
  misc_feature (1)..( 6): Matrix.003 file - promoters60/5662992
acattt

SEQ ID NO: 62074 - DNA, 9 bp, Unknown
  misc_feature (1)..( 9): Matrix.003 file - promoters60/5662992
atttatata

SEQ ID NO: 62075 - DNA, 8 bp, Unknown
  misc_feature (1)..( 8): Matrix.003 file - promoters60/5662992
atatataa

SEQ ID NO: 62076 - DNA, 7 bp, Unknown
  misc_feature (1)..( 7): Matrix.003 file - promoters60/5662992
ttcgttt

SEQ ID NO: 62077 - DNA, 8 bp, Unknown
  misc_feature (1)..( 8): Matrix.003 file - promoters60/5662992
attttaaa

SEQ ID NO: 62078 - DNA, 10 bp, Unknown
  misc_feature (1)..( 10): Matrix.003 file - promoters60/5662992
aacaaattta

SEQ ID NO: 62079 - DNA, 6 bp, Unknown
  misc_feature (1)..( 6): Matrix.003 file - promoters60/5662992
atataa

SEQ ID NO: 62080 - DNA, 10 bp, Unknown
  misc_feature (1)..( 10): Matrix.003 file - promoters60/5662992
aattattttc

SEQ ID NO: 62081 - DNA, 6 bp, Unknown
  misc_feature (1)..( 6): Matrix.003 file - promoters60/5662992
tttggt

SEQ ID NO: 62082 - DNA, 7 bp, Unknown
  misc_feature (1)..( 7): Matrix.003 file - promoters60/5662992
tctaaaa

SEQ ID NO: 62083 - DNA, 6 bp, Unknown
  misc_feature (1)..( 6): Matrix.003 file - promoters60/5662992
gtaact

SEQ ID NO: 62084 - DNA, 6 bp, Unknown
  misc_feature (1)..( 6): Matrix.003 file - promoters60/5662992
cgaaaa

SEQ ID NO: 62085 - DNA, 7 bp, Unknown
  misc_feature (1)..( 7): Matrix.003 file - promoters60/5662992
aaaatat

SEQ ID NO: 62086 - DNA, 6 bp, Unknown
  misc_feature (1)..( 6): Matrix.003 file - promoters60/5662992
tatttt

SEQ ID NO: 62087 - DNA, 7 bp, Unknown
  misc_feature (1)..( 7): Matrix.003 file - promoters60/5662992
tttccta

SEQ ID NO: 62088 - DNA, 10 bp, Unknown
  misc_feature (1)..( 10): Matrix.003 file - promoters60/5662992
taattagaaa

SEQ ID NO: 62089 - DNA, 6 bp, Unknown
  misc_feature (1)..( 6): Matrix.003 file - promoters60/5662992
aaacat

SEQ ID NO: 62090 - DNA, 9 bp, Unknown
  misc_feature (1)..( 9): Matrix.003 file - promoters60/5662999
tagacaatg

SEQ ID NO: 62091 - DNA, 7 bp, Unknown
  misc_feature (1)..( 7): Matrix.003 file - promoters60/5662999
gatgttg

SEQ ID NO: 62092 - DNA, 7 bp, Unknown
  misc_feature (1)..( 7): Matrix.003 file - promoters60/5662999
ctgcttc

SEQ ID NO: 62093 - DNA, 7 bp, Unknown
  misc_feature (1)..( 7): Matrix.003 file - promoters60/5662999
ctgaatc

SEQ ID NO: 62094 - DNA, 7 bp, Unknown
  misc_feature (1)..( 7): Matrix.003 file - promoters60/5662999
tgtatag

SEQ ID NO: 62095 - DNA, 7 bp, Unknown
  misc_feature (1)..( 7): Matrix.003 file - promoters60/5662999
aataagt

SEQ ID NO: 62096 - DNA, 7 bp, Unknown
  misc_feature (1)..( 7): Matrix.003 file - promoters60/5662999
caaaaga

SEQ ID NO: 62097 - DNA, 7 bp, Unknown
  misc_feature (1)..( 7): Matrix.003 file - promoters60/5662999
ctcctca

SEQ ID NO: 62098 - DNA, 6 bp, Unknown
  misc_feature (1)..( 6): Matrix.003 file - promoters60/5662999
atataa

SEQ ID NO: 62099 - DNA, 6 bp, Unknown
  misc_feature (1)..( 6): Matrix.003 file - promoters60/5662999
aatctg

SEQ ID NO: 62100 - DNA, 7 bp, Unknown
  misc_feature (1)..( 7): Matrix.003 file - promoters60/5662999
tttttaa

SEQ ID NO: 62101 - DNA, 8 bp, Unknown
  misc_feature (1)..( 8): Matrix.003 file - promoters60/5662999
acaattta

SEQ ID NO: 62102 - DNA, 7 bp, Unknown
  misc_feature (1)..( 7): Matrix.003 file - promoters60/5662999
caagaaa

SEQ ID NO: 62103 - DNA, 9 bp, Unknown
  misc_feature (1)..( 9): Matrix.003 file - promoters60/5662999
aaaagagta

SEQ ID NO: 62104 - DNA, 6 bp, Unknown
  misc_feature (1)..( 6): Matrix.003 file - promoters60/5662999
ttttgt

SEQ ID NO: 62105 - DNA, 8 bp, Unknown
  misc_feature (1)..( 8): Matrix.003 file - promoters60/5662999
attgcata

SEQ ID NO: 62106 - DNA, 7 bp, Unknown
  misc_feature (1)..( 7): Matrix.003 file - promoters60/5662999
tggagtg

SEQ ID NO: 62107 - DNA, 6 bp, Unknown
  misc_feature (1)..( 6): Matrix.003 file - promoters60/5662999
catatt

SEQ ID NO: 62108 - DNA, 6 bp, Unknown
  misc_feature (1)..( 6): Matrix.003 file - promoters60/5662999
tttact

SEQ ID NO: 62109 - DNA, 6 bp, Unknown
  misc_feature (1)..( 6): Matrix.003 file - promoters60/5662999
ttttgt

SEQ ID NO: 62110 - DNA, 10 bp, Unknown
  misc_feature (1)..( 10): Matrix.003 file - promoters60/5662999
agttaatctc

SEQ ID NO: 62111 - DNA, 12 bp, Unknown
  misc_feature (1)..( 12): Matrix.003 file - promoters60/5663003
acctcttttccg

SEQ ID NO: 62112 - DNA, 8 bp, Unknown
  misc_feature (1)..( 8): Matrix.003 file - promoters60/5663003
aaaaacaa

SEQ ID NO: 62113 - DNA, 12 bp, Unknown
  misc_feature (1)..( 12): Matrix.003 file - promoters60/5663003
aaataattgtat

SEQ ID NO: 62114 - DNA, 10 bp, Unknown
  misc_feature (1)..( 10): Matrix.003 file - promoters60/5663003
gaaatagatt

SEQ ID NO: 62115 - DNA, 11 bp, Unknown
  misc_feature (1)..( 11): Matrix.003 file - promoters60/5663003
ttacttaaatt

SEQ ID NO: 62116 - DNA, 7 bp, Unknown
  misc_feature (1)..( 7): Matrix.003 file - promoters60/5663034
ttcaaaa

SEQ ID NO: 62117 - DNA, 14 bp, Unknown
  misc_feature (1)..( 14): Matrix.003 file - promoters60/5663034
aactcattttctta

SEQ ID NO: 62118 - DNA, 8 bp, Unknown
  misc_feature (1)..( 8): Matrix.003 file - promoters60/5663034
aatttata

SEQ ID NO: 62119 - DNA, 8 bp, Unknown
  misc_feature (1)..( 8): Matrix.003 file - promoters60/5663034
caatatta

SEQ ID NO: 62120 - DNA, 7 bp, Unknown
  misc_feature (1)..( 7): Matrix.003 file - promoters60/5663034
tagattt

SEQ ID NO: 62121 - DNA, 6 bp, Unknown
  misc_feature (1)..( 6): Matrix.003 file - promoters60/5663034
gttttt

SEQ ID NO: 62122 - DNA, 9 bp, Unknown
  misc_feature (1)..( 9): Matrix.003 file - promoters60/5663034
aagaaacaa

SEQ ID NO: 62123 - DNA, 8 bp, Unknown
  misc_feature (1)..( 8): Matrix.003 file - promoters60/5663034
attttgtt

SEQ ID NO: 62124 - DNA, 8 bp, Unknown
  misc_feature (1)..( 8): Matrix.003 file - promoters60/5663034
aaaaatat

SEQ ID NO: 62125 - DNA, 6 bp, Unknown
  misc_feature (1)..( 6): Matrix.003 file - promoters60/5663034
attatt

SEQ ID NO: 62126 - DNA, 7 bp, Unknown
  misc_feature (1)..( 7): Matrix.003 file - promoters60/5663034
tcaaatc

SEQ ID NO: 62127 - DNA, 7 bp, Unknown
  misc_feature (1)..( 7): Matrix.003 file - promoters60/5663034
atgtcta

SEQ ID NO: 62128 - DNA, 6 bp, Unknown
  misc_feature (1)..( 6): Matrix.003 file - promoters60/5663034
agctaa

SEQ ID NO: 62129 - DNA, 7 bp, Unknown
  misc_feature (1)..( 7): Matrix.003 file - promoters60/5663034
cttaaga

SEQ ID NO: 62130 - DNA, 6 bp, Unknown
  misc_feature (1)..( 6): Matrix.003 file - promoters60/5663034
ttttat

SEQ ID NO: 62131 - DNA, 6 bp, Unknown
  misc_feature (1)..( 6): Matrix.003 file - promoters60/5663034
ttgcaa

SEQ ID NO: 62132 - DNA, 7 bp, Unknown
  misc_feature (1)..( 7): Matrix.003 file - promoters60/5663034
aatctta

SEQ ID NO: 62133 - DNA, 6 bp, Unknown
  misc_feature (1)..( 6): Matrix.003 file - promoters60/5663034
atttat

SEQ ID NO: 62134 - DNA, 9 bp, Unknown
  misc_feature (1)..( 9): Matrix.003 file - promoters60/5663034
cctactaaa

SEQ ID NO: 62135 - DNA, 6 bp, Unknown
  misc_feature (1)..( 6): Matrix.003 file - promoters60/5663050
attctc

SEQ ID NO: 62136 - DNA, 8 bp, Unknown
  misc_feature (1)..( 8): Matrix.003 file - promoters60/5663050
ctcaaatt

SEQ ID NO: 62137 - DNA, 7 bp, Unknown
  misc_feature (1)..( 7): Matrix.003 file - promoters60/5663050
tacaaaa

SEQ ID NO: 62138 - DNA, 7 bp, Unknown
  misc_feature (1)..( 7): Matrix.003 file - promoters60/5663050
aaaaagg

SEQ ID NO: 62139 - DNA, 6 bp, Unknown
  misc_feature (1)..( 6): Matrix.003 file - promoters60/5663050
tattta

SEQ ID NO: 62140 - DNA, 6 bp, Unknown
  misc_feature (1)..( 6): Matrix.003 file - promoters60/5663050
cttcaa

SEQ ID NO: 62141 - DNA, 6 bp, Unknown
  misc_feature (1)..( 6): Matrix.003 file - promoters60/5663050
tcttac

SEQ ID NO: 62142 - DNA, 6 bp, Unknown
  misc_feature (1)..( 6): Matrix.003 file - promoters60/5663050
tgataa

SEQ ID NO: 62143 - DNA, 7 bp, Unknown
  misc_feature (1)..( 7): Matrix.003 file - promoters60/5663050
ttaagtt

SEQ ID NO: 62144 - DNA, 8 bp, Unknown
  misc_feature (1)..( 8): Matrix.003 file - promoters60/5663050
tatagttg

SEQ ID NO: 62145 - DNA, 6 bp, Unknown
  misc_feature (1)..( 6): Matrix.003 file - promoters60/5663050
gaaaaa

SEQ ID NO: 62146 - DNA, 8 bp, Unknown
  misc_feature (1)..( 8): Matrix.003 file - promoters60/5663050
tgtataga

SEQ ID NO: 62147 - DNA, 7 bp, Unknown
  misc_feature (1)..( 7): Matrix.003 file - promoters60/5663050
aaaaata

SEQ ID NO: 62148 - DNA, 7 bp, Unknown
  misc_feature (1)..( 7): Matrix.003 file - promoters60/5663050
ataatat

SEQ ID NO: 62149 - DNA, 7 bp, Unknown
  misc_feature (1)..( 7): Matrix.003 file - promoters60/5663050
aaacgct

SEQ ID NO: 62150 - DNA, 9 bp, Unknown
  misc_feature (1)..( 9): Matrix.003 file - promoters60/5663050
aaaagaaaa

SEQ ID NO: 62151 - DNA, 7 bp, Unknown
  misc_feature (1)..( 7): Matrix.003 file - promoters60/5663050
ctggaat

SEQ ID NO: 62152 - DNA, 7 bp, Unknown
  misc_feature (1)..( 7): Matrix.003 file - promoters60/5663050
aaaactt

SEQ ID NO: 62153 - DNA, 8 bp, Unknown
  misc_feature (1)..( 8): Matrix.003 file - promoters60/5663050
cttaatta

SEQ ID NO: 62154 - DNA, 7 bp, Unknown
  misc_feature (1)..( 7): Matrix.003 file - promoters60/5663050
cacatat

SEQ ID NO: 62155 - DNA, 7 bp, Unknown
  misc_feature (1)..( 7): Matrix.003 file - promoters60/5663069
taaaaat

SEQ ID NO: 62156 - DNA, 6 bp, Unknown
  misc_feature (1)..( 6): Matrix.003 file - promoters60/5663069
cgagtt

SEQ ID NO: 62157 - DNA, 6 bp, Unknown
  misc_feature (1)..( 6): Matrix.003 file - promoters60/5663069
aaaact

SEQ ID NO: 62158 - DNA, 6 bp, Unknown
  misc_feature (1)..( 6): Matrix.003 file - promoters60/5663069
ttcgta

SEQ ID NO: 62159 - DNA, 9 bp, Unknown
  misc_feature (1)..( 9): Matrix.003 file - promoters60/5663069
tggacaatg

SEQ ID NO: 62160 - DNA, 8 bp, Unknown
  misc_feature (1)..( 8): Matrix.003 file - promoters60/5663069
atttcaag

SEQ ID NO: 62161 - DNA, 10 bp, Unknown
  misc_feature (1)..( 10): Matrix.003 file - promoters60/5663069
gtcaaaaaat

SEQ ID NO: 62162 - DNA, 6 bp, Unknown
  misc_feature (1)..( 6): Matrix.003 file - promoters60/5663069
taaatg

SEQ ID NO: 62163 - DNA, 9 bp, Unknown
  misc_feature (1)..( 9): Matrix.003 file - promoters60/5663069
taaaaacca

SEQ ID NO: 62164 - DNA, 7 bp, Unknown
  misc_feature (1)..( 7): Matrix.003 file - promoters60/5663069
aaccaat

SEQ ID NO: 62165 - DNA, 6 bp, Unknown
  misc_feature (1)..( 6): Matrix.003 file - promoters60/5663069
aaatcc

SEQ ID NO: 62166 - DNA, 7 bp, Unknown
  misc_feature (1)..( 7): Matrix.003 file - promoters60/5663069
atccaaa

SEQ ID NO: 62167 - DNA, 8 bp, Unknown
  misc_feature (1)..( 8): Matrix.003 file - promoters60/5663069
aaaaaata

SEQ ID NO: 62168 - DNA, 7 bp, Unknown
  misc_feature (1)..( 7): Matrix.003 file - promoters60/5663069
attctat

SEQ ID NO: 62169 - DNA, 11 bp, Unknown
  misc_feature (1)..( 11): Matrix.003 file - promoters60/5663069
ttttcgaaaaa

SEQ ID NO: 62170 - DNA, 6 bp, Unknown
  misc_feature (1)..( 6): Matrix.003 file - promoters60/5663069
tataaa

SEQ ID NO: 62171 - DNA, 13 bp, Unknown
  misc_feature (1)..( 13): Matrix.003 file - promoters60/5663138
aaaaacaaaataa

SEQ ID NO: 62172 - DNA, 10 bp, Unknown
  misc_feature (1)..( 10): Matrix.003 file - promoters60/5663138
gaaatcaaaa

SEQ ID NO: 62173 - DNA, 9 bp, Unknown
  misc_feature (1)..( 9): Matrix.003 file - promoters60/5663138
agatttccg

SEQ ID NO: 62174 - DNA, 12 bp, Unknown
  misc_feature (1)..( 12): Matrix.003 file - promoters60/5663138
gaaaaagaaaaa

SEQ ID NO: 62175 - DNA, 8 bp, Unknown
  misc_feature (1)..( 8): Matrix.003 file - promoters60/5663138
aaataaca

SEQ ID NO: 62176 - DNA, 8 bp, Unknown
  misc_feature (1)..( 8): Matrix.003 file - promoters60/5663138
aaaatttg

SEQ ID NO: 62177 - DNA, 10 bp, Unknown
  misc_feature (1)..( 10): Matrix.003 file - promoters60/5663142
taaaaatgaa

SEQ ID NO: 62178 - DNA, 8 bp, Unknown
  misc_feature (1)..( 8): Matrix.003 file - promoters60/5663142
aataatga

SEQ ID NO: 62179 - DNA, 14 bp, Unknown
  misc_feature (1)..( 14): Matrix.003 file - promoters60/5663142
acttataatataat

SEQ ID NO: 62180 - DNA, 9 bp, Unknown
  misc_feature (1)..( 9): Matrix.003 file - promoters60/5663142
aaatataat

SEQ ID NO: 62181 - DNA, 9 bp, Unknown
  misc_feature (1)..( 9): Matrix.003 file - promoters60/5663142
aaaatatat

SEQ ID NO: 62182 - DNA, 11 bp, Unknown
  misc_feature (1)..( 11): Matrix.003 file - promoters60/5663142
agaaaatcaat

SEQ ID NO: 62183 - DNA, 10 bp, Unknown
  misc_feature (1)..( 10): Matrix.003 file - promoters60/5663142
ttttatcaaa

SEQ ID NO: 62184 - DNA, 11 bp, Unknown
  misc_feature (1)..( 11): Matrix.003 file - promoters60/5663142
tcaatcaaatg

SEQ ID NO: 62185 - DNA, 11 bp, Unknown
  misc_feature (1)..( 11): Matrix.003 file - promoters60/5663142
agacataataa

SEQ ID NO: 62186 - DNA, 8 bp, Unknown
  misc_feature (1)..( 8): Matrix.003 file - promoters60/5663142
tcatataa

SEQ ID NO: 62187 - DNA, 8 bp, Unknown
  misc_feature (1)..( 8): Matrix.003 file - promoters60/5663142
aaatcttg

SEQ ID NO: 62188 - DNA, 8 bp, Unknown
  misc_feature (1)..( 8): Matrix.003 file - promoters60/5663142
tttcaaat

SEQ ID NO: 62189 - DNA, 7 bp, Unknown
  misc_feature (1)..( 7): Matrix.003 file - promoters60/5663142
aattttt

SEQ ID NO: 62190 - DNA, 8 bp, Unknown
  misc_feature (1)..( 8): Matrix.003 file - promoters60/5663142
atttgttt

SEQ ID NO: 62191 - DNA, 6 bp, Unknown
  misc_feature (1)..( 6): Matrix.003 file - promoters60/5663151
caattt

SEQ ID NO: 62192 - DNA, 8 bp, Unknown
  misc_feature (1)..( 8): Matrix.003 file - promoters60/5663151
agaatcca

SEQ ID NO: 62193 - DNA, 10 bp, Unknown
  misc_feature (1)..( 10): Matrix.003 file - promoters60/5663151
aagaaatgat

SEQ ID NO: 62194 - DNA, 8 bp, Unknown
  misc_feature (1)..( 8): Matrix.003 file - promoters60/5663151
aataaaac

SEQ ID NO: 62195 - DNA, 6 bp, Unknown
  misc_feature (1)..( 6): Matrix.003 file - promoters60/5663151
ccaaaa

SEQ ID NO: 62196 - DNA, 9 bp, Unknown
  misc_feature (1)..( 9): Matrix.003 file - promoters60/5663151
caaacccaa

SEQ ID NO: 62197 - DNA, 6 bp, Unknown
  misc_feature (1)..( 6): Matrix.003 file - promoters60/5663151
aagaat

SEQ ID NO: 62198 - DNA, 7 bp, Unknown
  misc_feature (1)..( 7): Matrix.003 file - promoters60/5663151
aaactga

SEQ ID NO: 62199 - DNA, 7 bp, Unknown
  misc_feature (1)..( 7): Matrix.003 file - promoters60/5663151
attatct

SEQ ID NO: 62200 - DNA, 6 bp, Unknown
  misc_feature (1)..( 6): Matrix.003 file - promoters60/5663151
caagaa

SEQ ID NO: 62201 - DNA, 7 bp, Unknown
  misc_feature (1)..( 7): Matrix.003 file - promoters60/5663151
tttaggt

SEQ ID NO: 62202 - DNA, 6 bp, Unknown
  misc_feature (1)..( 6): Matrix.003 file - promoters60/5663151
ttcagt

SEQ ID NO: 62203 - DNA, 8 bp, Unknown
  misc_feature (1)..( 8): Matrix.003 file - promoters60/5663154
tttacttt

SEQ ID NO: 62204 - DNA, 6 bp, Unknown
  misc_feature (1)..( 6): Matrix.003 file - promoters60/5663154
ttattt

SEQ ID NO: 62205 - DNA, 8 bp, Unknown
  misc_feature (1)..( 8): Matrix.003 file - promoters60/5663154
ttttattc

SEQ ID NO: 62206 - DNA, 8 bp, Unknown
  misc_feature (1)..( 8): Matrix.003 file - promoters60/5663154
attctttt

SEQ ID NO: 62207 - DNA, 6 bp, Unknown
  misc_feature (1)..( 6): Matrix.003 file - promoters60/5663154
agtttg

SEQ ID NO: 62208 - DNA, 7 bp, Unknown
  misc_feature (1)..( 7): Matrix.003 file - promoters60/5663154
ttcataa

SEQ ID NO: 62209 - DNA, 8 bp, Unknown
  misc_feature (1)..( 8): Matrix.003 file - promoters60/5663154
aaatataa

SEQ ID NO: 62210 - DNA, 8 bp, Unknown
  misc_feature (1)..( 8): Matrix.003 file - promoters60/5663154
acgtcgaa

SEQ ID NO: 62211 - DNA, 6 bp, Unknown
  misc_feature (1)..( 6): Matrix.003 file - promoters60/5663154
aaaaca

SEQ ID NO: 62212 - DNA, 7 bp, Unknown
  misc_feature (1)..( 7): Matrix.003 file - promoters60/5663154
tttactc

SEQ ID NO: 62213 - DNA, 6 bp, Unknown
  misc_feature (1)..( 6): Matrix.003 file - promoters60/5663154
ttttat

SEQ ID NO: 62214 - DNA, 7 bp, Unknown
  misc_feature (1)..( 7): Matrix.003 file - promoters60/5663154
actaatt

SEQ ID NO: 62215 - DNA, 9 bp, Unknown
  misc_feature (1)..( 9): Matrix.003 file - promoters60/5663154
ttgattaaa

SEQ ID NO: 62216 - DNA, 6 bp, Unknown
  misc_feature (1)..( 6): Matrix.003 file - promoters60/5663154
tggata

SEQ ID NO: 62217 - DNA, 7 bp, Unknown
  misc_feature (1)..( 7): Matrix.003 file - promoters60/5663154
ttggata

SEQ ID NO: 62218 - DNA, 7 bp, Unknown
  misc_feature (1)..( 7): Matrix.003 file - promoters60/5663154
taaaaaa

SEQ ID NO: 62219 - DNA, 7 bp, Unknown
  misc_feature (1)..( 7): Matrix.003 file - promoters60/5663154
acgaact

SEQ ID NO: 62220 - DNA, 7 bp, Unknown
  misc_feature (1)..( 7): Matrix.003 file - promoters60/5663154
tatctcg

SEQ ID NO: 62221 - DNA, 8 bp, Unknown
  misc_feature (1)..( 8): Matrix.003 file - promoters60/5663154
atttgcac

SEQ ID NO: 62222 - DNA, 7 bp, Unknown
  misc_feature (1)..( 7): Matrix.003 file - promoters60/5663154
ttaatat

SEQ ID NO: 62223 - DNA, 6 bp, Unknown
  misc_feature (1)..( 6): Matrix.003 file - promoters60/5663154
aatata

SEQ ID NO: 62224 - DNA, 6 bp, Unknown
  misc_feature (1)..( 6): Matrix.003 file - promoters60/5663182
aaataa

SEQ ID NO: 62225 - DNA, 7 bp, Unknown
  misc_feature (1)..( 7): Matrix.003 file - promoters60/5663182
aatctaa

SEQ ID NO: 62226 - DNA, 8 bp, Unknown
  misc_feature (1)..( 8): Matrix.003 file - promoters60/5663182
atatatac

SEQ ID NO: 62227 - DNA, 8 bp, Unknown
  misc_feature (1)..( 8): Matrix.003 file - promoters60/5663182
aatcagtg

SEQ ID NO: 62228 - DNA, 8 bp, Unknown
  misc_feature (1)..( 8): Matrix.003 file - promoters60/5663182
aaataaat

SEQ ID NO: 62229 - DNA, 7 bp, Unknown
  misc_feature (1)..( 7): Matrix.003 file - promoters60/5663182
ataaaac

SEQ ID NO: 62230 - DNA, 8 bp, Unknown
  misc_feature (1)..( 8): Matrix.003 file - promoters60/5663182
aacaaaaa

SEQ ID NO: 62231 - DNA, 6 bp, Unknown
  misc_feature (1)..( 6): Matrix.003 file - promoters60/5663182
aaaaga

SEQ ID NO: 62232 - DNA, 7 bp, Unknown
  misc_feature (1)..( 7): Matrix.003 file - promoters60/5663182
atcatgt

SEQ ID NO: 62233 - DNA, 6 bp, Unknown
  misc_feature (1)..( 6): Matrix.003 file - promoters60/5663182
gagtcc

SEQ ID NO: 62234 - DNA, 9 bp, Unknown
  misc_feature (1)..( 9): Matrix.003 file - promoters60/5663182
tttcggttc

SEQ ID NO: 62235 - DNA, 6 bp, Unknown
  misc_feature (1)..( 6): Matrix.003 file - promoters60/5663182
tcttta

SEQ ID NO: 62236 - DNA, 6 bp, Unknown
  misc_feature (1)..( 6): Matrix.003 file - promoters60/5663182
tccctt

SEQ ID NO: 62237 - DNA, 11 bp, Unknown
  misc_feature (1)..( 11): Matrix.003 file - promoters60/5663221
gtttttgttgc

SEQ ID NO: 62238 - DNA, 5 bp, Unknown
  misc_feature (1)..( 5): Matrix.003 file - promoters60/5663221
aattt

SEQ ID NO: 62239 - DNA, 12 bp, Unknown
  misc_feature (1)..( 12): Matrix.003 file - promoters60/5663221
agagatttagaa

SEQ ID NO: 62240 - DNA, 11 bp, Unknown
  misc_feature (1)..( 11): Matrix.003 file - promoters60/5663224
cttttaaaata

SEQ ID NO: 62241 - DNA, 7 bp, Unknown
  misc_feature (1)..( 7): Matrix.003 file - promoters60/5663224
gaattat

SEQ ID NO: 62242 - DNA, 8 bp, Unknown
  misc_feature (1)..( 8): Matrix.003 file - promoters60/5663234
aaaccttg

SEQ ID NO: 62243 - DNA, 10 bp, Unknown
  misc_feature (1)..( 10): Matrix.003 file - promoters60/5663234
catatatata

SEQ ID NO: 62244 - DNA, 8 bp, Unknown
  misc_feature (1)..( 8): Matrix.003 file - promoters60/5663234
cattttcg

SEQ ID NO: 62245 - DNA, 10 bp, Unknown
  misc_feature (1)..( 10): Matrix.003 file - promoters60/5663234
cataaaagat

SEQ ID NO: 62246 - DNA, 8 bp, Unknown
  misc_feature (1)..( 8): Matrix.003 file - promoters60/5663234
ataaaaaa

SEQ ID NO: 62247 - DNA, 14 bp, Unknown
  misc_feature (1)..( 14): Matrix.003 file - promoters60/5663234
tgatggtattgact

SEQ ID NO: 62248 - DNA, 8 bp, Unknown
  misc_feature (1)..( 8): Matrix.003 file - promoters60/5663234
ttatatat

SEQ ID NO: 62249 - DNA, 7 bp, Unknown
  misc_feature (1)..( 7): Matrix.003 file - promoters60/5663234
taaagtt

SEQ ID NO: 62250 - DNA, 7 bp, Unknown
  misc_feature (1)..( 7): Matrix.003 file - promoters60/5663234
aaatttg

SEQ ID NO: 62251 - DNA, 7 bp, Unknown
  misc_feature (1)..( 7): Matrix.003 file - promoters60/5663234
atttatt

SEQ ID NO: 62252 - DNA, 7 bp, Unknown
  misc_feature (1)..( 7): Matrix.003 file - promoters60/5663234
tatttaa

SEQ ID NO: 62253 - DNA, 8 bp, Unknown
  misc_feature (1)..( 8): Matrix.003 file - promoters60/5663281
aaccattt

SEQ ID NO: 62254 - DNA, 8 bp, Unknown
  misc_feature (1)..( 8): Matrix.003 file - promoters60/5663281
aataaaat

SEQ ID NO: 62255 - DNA, 11 bp, Unknown
  misc_feature (1)..( 11): Matrix.003 file - promoters60/5663281
aattaatattt

SEQ ID NO: 62256 - DNA, 7 bp, Unknown
  misc_feature (1)..( 7): Matrix.003 file - promoters60/5663281
ttatttt

SEQ ID NO: 62257 - DNA, 6 bp, Unknown
  misc_feature (1)..( 6): Matrix.003 file - promoters60/5663281
taacat

SEQ ID NO: 62258 - DNA, 7 bp, Unknown
  misc_feature (1)..( 7): Matrix.003 file - promoters60/5663281
aatgtga

SEQ ID NO: 62259 - DNA, 8 bp, Unknown
  misc_feature (1)..( 8): Matrix.003 file - promoters60/5663281
aaaaaaaa

SEQ ID NO: 62260 - DNA, 8 bp, Unknown
  misc_feature (1)..( 8): Matrix.003 file - promoters60/5663281
atttgatt

SEQ ID NO: 62261 - DNA, 10 bp, Unknown
  misc_feature (1)..( 10): Matrix.003 file - promoters60/5663281
aaaaaaactt

SEQ ID NO: 62262 - DNA, 6 bp, Unknown
  misc_feature (1)..( 6): Matrix.003 file - promoters60/5663281
tatatt

SEQ ID NO: 62263 - DNA, 8 bp, Unknown
  misc_feature (1)..( 8): Matrix.003 file - promoters60/5663281
acataacg

SEQ ID NO: 62264 - DNA, 7 bp, Unknown
  misc_feature (1)..( 7): Matrix.003 file - promoters60/5663281
cattttt

SEQ ID NO: 62265 - DNA, 6 bp, Unknown
  misc_feature (1)..( 6): Matrix.003 file - promoters60/5663281
tagagt

SEQ ID NO: 62266 - DNA, 7 bp, Unknown
  misc_feature (1)..( 7): Matrix.003 file - promoters60/5663281
aaaccct

SEQ ID NO: 62267 - DNA, 7 bp, Unknown
  misc_feature (1)..( 7): Matrix.003 file - promoters60/5663281
gtgttta

SEQ ID NO: 62268 - DNA, 6 bp, Unknown
  misc_feature (1)..( 6): Matrix.003 file - promoters60/5663281
taaaca

SEQ ID NO: 62269 - DNA, 6 bp, Unknown
  misc_feature (1)..( 6): Matrix.003 file - promoters60/5663281
aagata

SEQ ID NO: 62270 - DNA, 8 bp, Unknown
  misc_feature (1)..( 8): Matrix.003 file - promoters60/5663327
cagatttc

SEQ ID NO: 62271 - DNA, 9 bp, Unknown
  misc_feature (1)..( 9): Matrix.003 file - promoters60/5663327
tgtttgaaa

SEQ ID NO: 62272 - DNA, 6 bp, Unknown
  misc_feature (1)..( 6): Matrix.003 file - promoters60/5663327
gaataa

SEQ ID NO: 62273 - DNA, 10 bp, Unknown
  misc_feature (1)..( 10): Matrix.003 file - promoters60/5663327
acattttttt

SEQ ID NO: 62274 - DNA, 7 bp, Unknown
  misc_feature (1)..( 7): Matrix.003 file - promoters60/5663327
aaatatt

SEQ ID NO: 62275 - DNA, 9 bp, Unknown
  misc_feature (1)..( 9): Matrix.003 file - promoters60/5663327
tgtatgaaa

SEQ ID NO: 62276 - DNA, 6 bp, Unknown
  misc_feature (1)..( 6): Matrix.003 file - promoters60/5663327
aatata

SEQ ID NO: 62277 - DNA, 7 bp, Unknown
  misc_feature (1)..( 7): Matrix.003 file - promoters60/5663327
attttaa

SEQ ID NO: 62278 - DNA, 8 bp, Unknown
  misc_feature (1)..( 8): Matrix.003 file - promoters60/5663327
aatcgatc

SEQ ID NO: 62279 - DNA, 6 bp, Unknown
  misc_feature (1)..( 6): Matrix.003 file - promoters60/5663327
aaaaat

SEQ ID NO: 62280 - DNA, 10 bp, Unknown
  misc_feature (1)..( 10): Matrix.003 file - promoters60/5663327
ctctgcaatt

SEQ ID NO: 62281 - DNA, 8 bp, Unknown
  misc_feature (1)..( 8): Matrix.003 file - promoters60/5663327
taaaacga

SEQ ID NO: 62282 - DNA, 6 bp, Unknown
  misc_feature (1)..( 6): Matrix.003 file - promoters60/5663327
ttaatc

SEQ ID NO: 62283 - DNA, 12 bp, Unknown
  misc_feature (1)..( 12): Matrix.003 file - promoters60/5663327
ttaaaatcacat

SEQ ID NO: 62284 - DNA, 14 bp, Unknown
  misc_feature (1)..( 14): Matrix.003 file - promoters60/5663327
tataagtttgatat

SEQ ID NO: 62285 - DNA, 10 bp, Unknown
  misc_feature (1)..( 10): Matrix.003 file - promoters60/5663327
aaactaattt

SEQ ID NO: 62286 - DNA, 9 bp, Unknown
  misc_feature (1)..( 9): Matrix.003 file - promoters60/5663327
tttcttttc

SEQ ID NO: 62287 - DNA, 10 bp, Unknown
  misc_feature (1)..( 10): Matrix.003 file - promoters60/5663327
tttaaatttt

SEQ ID NO: 62288 - DNA, 6 bp, Unknown
  misc_feature (1)..( 6): Matrix.003 file - promoters60/5663327
caaaat

SEQ ID NO: 62289 - DNA, 13 bp, Unknown
  misc_feature (1)..( 13): Matrix.003 file - promoters60/5663327
tttaaaaataaat

SEQ ID NO: 62290 - DNA, 7 bp, Unknown
  misc_feature (1)..( 7): Matrix.003 file - promoters60/5663327
aatcaaa

SEQ ID NO: 62291 - DNA, 8 bp, Unknown
  misc_feature (1)..( 8): Matrix.003 file - promoters60/5663333
catgaata

SEQ ID NO: 62292 - DNA, 7 bp, Unknown
  misc_feature (1)..( 7): Matrix.003 file - promoters60/5663333
cgatcat

SEQ ID NO: 62293 - DNA, 7 bp, Unknown
  misc_feature (1)..( 7): Matrix.003 file - promoters60/5663333
agaaatt

SEQ ID NO: 62294 - DNA, 7 bp, Unknown
  misc_feature (1)..( 7): Matrix.003 file - promoters60/5663333
taaactt

SEQ ID NO: 62295 - DNA, 13 bp, Unknown
  misc_feature (1)..( 13): Matrix.003 file - promoters60/5663358
ataaattattctc

SEQ ID NO: 62296 - DNA, 9 bp, Unknown
  misc_feature (1)..( 9): Matrix.003 file - promoters60/5663358
agaaatgaa

SEQ ID NO: 62297 - DNA, 9 bp, Unknown
  misc_feature (1)..( 9): Matrix.003 file - promoters60/5663358
tataaaata

SEQ ID NO: 62298 - DNA, 8 bp, Unknown
  misc_feature (1)..( 8): Matrix.003 file - promoters60/5663370
acacacaa

SEQ ID NO: 62299 - DNA, 8 bp, Unknown
  misc_feature (1)..( 8): Matrix.003 file - promoters60/5663370
caaaacaa

SEQ ID NO: 62300 - DNA, 8 bp, Unknown
  misc_feature (1)..( 8): Matrix.003 file - promoters60/5663370
aaataatt

SEQ ID NO: 62301 - DNA, 6 bp, Unknown
  misc_feature (1)..( 6): Matrix.003 file - promoters60/5663370
aaaacg

SEQ ID NO: 62302 - DNA, 9 bp, Unknown
  misc_feature (1)..( 9): Matrix.003 file - promoters60/5663370
aatattggt

SEQ ID NO: 62303 - DNA, 7 bp, Unknown
  misc_feature (1)..( 7): Matrix.003 file - promoters60/5663370
attgcaa

SEQ ID NO: 62304 - DNA, 8 bp, Unknown
  misc_feature (1)..( 8): Matrix.003 file - promoters60/5663370
tggagtta

SEQ ID NO: 62305 - DNA, 9 bp, Unknown
  misc_feature (1)..( 9): Matrix.003 file - promoters60/5663370
tggtaatta

SEQ ID NO: 62306 - DNA, 7 bp, Unknown
  misc_feature (1)..( 7): Matrix.003 file - promoters60/5663370
gagagga

SEQ ID NO: 62307 - DNA, 7 bp, Unknown
  misc_feature (1)..( 7): Matrix.003 file - promoters60/5663370
acaagaa

SEQ ID NO: 62308 - DNA, 6 bp, Unknown
  misc_feature (1)..( 6): Matrix.003 file - promoters60/5663370
ctaaaa

SEQ ID NO: 62309 - DNA, 10 bp, Unknown
  misc_feature (1)..( 10): Matrix.003 file - promoters60/5663370
aaaacaacca

SEQ ID NO: 62310 - DNA, 6 bp, Unknown
  misc_feature (1)..( 6): Matrix.003 file - promoters60/5663370
aaaaat

SEQ ID NO: 62311 - DNA, 8 bp, Unknown
  misc_feature (1)..( 8): Matrix.003 file - promoters60/5663370
tctgtata

SEQ ID NO: 62312 - DNA, 9 bp, Unknown
  misc_feature (1)..( 9): Matrix.003 file - promoters60/5663370
ataaatttc

SEQ ID NO: 62313 - DNA, 8 bp, Unknown
  misc_feature (1)..( 8): Matrix.003 file - promoters60/5663370
ttcaacat

SEQ ID NO: 62314 - DNA, 7 bp, Unknown
  misc_feature (1)..( 7): Matrix.003 file - promoters60/5663370
catctct

SEQ ID NO: 62315 - DNA, 6 bp, Unknown
  misc_feature (1)..( 6): Matrix.003 file - promoters60/5663370
atgagc

SEQ ID NO: 62316 - DNA, 6 bp, Unknown
  misc_feature (1)..( 6): Matrix.003 file - promoters60/5663370
taaaac

SEQ ID NO: 62317 - DNA, 10 bp, Unknown
  misc_feature (1)..( 10): Matrix.003 file - promoters60/5663370
ttcaattttt

SEQ ID NO: 62318 - DNA, 6 bp, Unknown
  misc_feature (1)..( 6): Matrix.003 file - promoters60/5663370
atgaga

SEQ ID NO: 62319 - DNA, 6 bp, Unknown
  misc_feature (1)..( 6): Matrix.003 file - promoters60/5663370
gaggaa

SEQ ID NO: 62320 - DNA, 8 bp, Unknown
  misc_feature (1)..( 8): Matrix.003 file - promoters60/5663370
actcttca

SEQ ID NO: 62321 - DNA, 7 bp, Unknown
  misc_feature (1)..( 7): Matrix.003 file - promoters60/5663370
caaaata

SEQ ID NO: 62322 - DNA, 8 bp, Unknown
  misc_feature (1)..( 8): Matrix.003 file - promoters60/5663374
agacattt

SEQ ID NO: 62323 - DNA, 13 bp, Unknown
  misc_feature (1)..( 13): Matrix.003 file - promoters60/5663374
aaataaaataaat

SEQ ID NO: 62324 - DNA, 9 bp, Unknown
  misc_feature (1)..( 9): Matrix.003 file - promoters60/5663374
ttcccacta

SEQ ID NO: 62325 - DNA, 9 bp, Unknown
  misc_feature (1)..( 9): Matrix.003 file - promoters60/5663374
aaaccagaa

SEQ ID NO: 62326 - DNA, 6 bp, Unknown
  misc_feature (1)..( 6): Matrix.003 file - promoters60/5663374
atttcc

SEQ ID NO: 62327 - DNA, 6 bp, Unknown
  misc_feature (1)..( 6): Matrix.003 file - promoters60/5663374
atatgg

SEQ ID NO: 62328 - DNA, 6 bp, Unknown
  misc_feature (1)..( 6): Matrix.003 file - promoters60/5663374
aagata

SEQ ID NO: 62329 - DNA, 7 bp, Unknown
  misc_feature (1)..( 7): Matrix.003 file - promoters60/5663374
attgtta

SEQ ID NO: 62330 - DNA, 7 bp, Unknown
  misc_feature (1)..( 7): Matrix.003 file - promoters60/5663374
aactaaa

SEQ ID NO: 62331 - DNA, 6 bp, Unknown
  misc_feature (1)..( 6): Matrix.003 file - promoters60/5663374
atctat

SEQ ID NO: 62332 - DNA, 6 bp, Unknown
  misc_feature (1)..( 6): Matrix.003 file - promoters60/5663374
aataaa

SEQ ID NO: 62333 - DNA, 6 bp, Unknown
  misc_feature (1)..( 6): Matrix.003 file - promoters60/5663374
agtaaa

SEQ ID NO: 62334 - DNA, 7 bp, Unknown
  misc_feature (1)..( 7): Matrix.003 file - promoters60/5663374
aatcggg

SEQ ID NO: 62335 - DNA, 8 bp, Unknown
  misc_feature (1)..( 8): Matrix.003 file - promoters60/5663374
gaaacaaa

SEQ ID NO: 62336 - DNA, 9 bp, Unknown
  misc_feature (1)..( 9): Matrix.003 file - promoters60/5663374
aaagaaaag

SEQ ID NO: 62337 - DNA, 7 bp, Unknown
  misc_feature (1)..( 7): Matrix.003 file - promoters60/5663374
gtatata

SEQ ID NO: 62338 - DNA, 7 bp, Unknown
  misc_feature (1)..( 7): Matrix.003 file - promoters60/5663418
aatcaca

SEQ ID NO: 62339 - DNA, 7 bp, Unknown
  misc_feature (1)..( 7): Matrix.003 file - promoters60/5663418
tctttat

SEQ ID NO: 62340 - DNA, 7 bp, Unknown
  misc_feature (1)..( 7): Matrix.003 file - promoters60/5663418
gaaaaaa

SEQ ID NO: 62341 - DNA, 6 bp, Unknown
  misc_feature (1)..( 6): Matrix.003 file - promoters60/5663418
aaagaa

SEQ ID NO: 62342 - DNA, 6 bp, Unknown
  misc_feature (1)..( 6): Matrix.003 file - promoters60/5663418
ttgctc

SEQ ID NO: 62343 - DNA, 7 bp, Unknown
  misc_feature (1)..( 7): Matrix.003 file - promoters60/5663418
acttgga

SEQ ID NO: 62344 - DNA, 14 bp, Unknown
  misc_feature (1)..( 14): Matrix.003 file - promoters60/5663418
ggtctattctaaat

SEQ ID NO: 62345 - DNA, 7 bp, Unknown
  misc_feature (1)..( 7): Matrix.003 file - promoters60/5663418
tttaatt

SEQ ID NO: 62346 - DNA, 8 bp, Unknown
  misc_feature (1)..( 8): Matrix.003 file - promoters60/5663418
tctgattt

SEQ ID NO: 62347 - DNA, 6 bp, Unknown
  misc_feature (1)..( 6): Matrix.003 file - promoters60/5663418
ttttct

SEQ ID NO: 62348 - DNA, 9 bp, Unknown
  misc_feature (1)..( 9): Matrix.003 file - promoters60/5663418
tgagttgat

SEQ ID NO: 62349 - DNA, 6 bp, Unknown
  misc_feature (1)..( 6): Matrix.003 file - promoters60/5663418
cttttt

SEQ ID NO: 62350 - DNA, 8 bp, Unknown
  misc_feature (1)..( 8): Matrix.003 file - promoters60/5663418
ttgaattt

SEQ ID NO: 62351 - DNA, 8 bp, Unknown
  misc_feature (1)..( 8): Matrix.003 file - promoters60/5663418
tcaataca

SEQ ID NO: 62352 - DNA, 6 bp, Unknown
  misc_feature (1)..( 6): Matrix.003 file - promoters60/5663418
acaaat

SEQ ID NO: 62353 - DNA, 11 bp, Unknown
  misc_feature (1)..( 11): Matrix.003 file - promoters60/5663418
accaaatattg

SEQ ID NO: 62354 - DNA, 7 bp, Unknown
  misc_feature (1)..( 7): Matrix.003 file - promoters60/5663418
tttatgt

SEQ ID NO: 62355 - DNA, 6 bp, Unknown
  misc_feature (1)..( 6): Matrix.003 file - promoters60/5663418
agactt

SEQ ID NO: 62356 - DNA, 7 bp, Unknown
  misc_feature (1)..( 7): Matrix.003 file - promoters60/5663418
agaagct

SEQ ID NO: 62357 - DNA, 7 bp, Unknown
  misc_feature (1)..( 7): Matrix.003 file - promoters60/5663418
tataaaa

SEQ ID NO: 62358 - DNA, 10 bp, Unknown
  misc_feature (1)..( 10): Matrix.003 file - promoters60/5663433
ggcttagatt

SEQ ID NO: 62359 - DNA, 6 bp, Unknown
  misc_feature (1)..( 6): Matrix.003 file - promoters60/5663433
tttttt

SEQ ID NO: 62360 - DNA, 6 bp, Unknown
  misc_feature (1)..( 6): Matrix.003 file - promoters60/5663433
aaatat

SEQ ID NO: 62361 - DNA, 8 bp, Unknown
  misc_feature (1)..( 8): Matrix.003 file - promoters60/5663433
aaatatca

SEQ ID NO: 62362 - DNA, 6 bp, Unknown
  misc_feature (1)..( 6): Matrix.003 file - promoters60/5663433
acacat

SEQ ID NO: 62363 - DNA, 7 bp, Unknown
  misc_feature (1)..( 7): Matrix.003 file - promoters60/5663433
atgatta

SEQ ID NO: 62364 - DNA, 8 bp, Unknown
  misc_feature (1)..( 8): Matrix.003 file - promoters60/5663433
aatgggcc

SEQ ID NO: 62365 - DNA, 7 bp, Unknown
  misc_feature (1)..( 7): Matrix.003 file - promoters60/5663433
atgatat

SEQ ID NO: 62366 - DNA, 6 bp, Unknown
  misc_feature (1)..( 6): Matrix.003 file - promoters60/5663433
ttttaa

SEQ ID NO: 62367 - DNA, 7 bp, Unknown
  misc_feature (1)..( 7): Matrix.003 file - promoters60/5663433
tttgaga

SEQ ID NO: 62368 - DNA, 7 bp, Unknown
  misc_feature (1)..( 7): Matrix.003 file - promoters60/5663433
gtaaaat

SEQ ID NO: 62369 - DNA, 7 bp, Unknown
  misc_feature (1)..( 7): Matrix.003 file - promoters60/5663440
aaaagaa

SEQ ID NO: 62370 - DNA, 10 bp, Unknown
  misc_feature (1)..( 10): Matrix.003 file - promoters60/5663440
tctcttctct

SEQ ID NO: 62371 - DNA, 7 bp, Unknown
  misc_feature (1)..( 7): Matrix.003 file - promoters60/5663440
aagcaaa

SEQ ID NO: 62372 - DNA, 9 bp, Unknown
  misc_feature (1)..( 9): Matrix.003 file - promoters60/5663440
ttatattta

SEQ ID NO: 62373 - DNA, 9 bp, Unknown
  misc_feature (1)..( 9): Matrix.003 file - promoters60/5663474
taaagatgt

SEQ ID NO: 62374 - DNA, 8 bp, Unknown
  misc_feature (1)..( 8): Matrix.003 file - promoters60/5663474
ttgtgtta

SEQ ID NO: 62375 - DNA, 6 bp, Unknown
  misc_feature (1)..( 6): Matrix.003 file - promoters60/5663474
gttttt

SEQ ID NO: 62376 - DNA, 7 bp, Unknown
  misc_feature (1)..( 7): Matrix.003 file - promoters60/5663474
aatacaa

SEQ ID NO: 62377 - DNA, 7 bp, Unknown
  misc_feature (1)..( 7): Matrix.003 file - promoters60/5663474
aagaaag

SEQ ID NO: 62378 - DNA, 9 bp, Unknown
  misc_feature (1)..( 9): Matrix.003 file - promoters60/5663474
tctaatgaa

SEQ ID NO: 62379 - DNA, 7 bp, Unknown
  misc_feature (1)..( 7): Matrix.003 file - promoters60/5663474
tgaagaa

SEQ ID NO: 62380 - DNA, 9 bp, Unknown
  misc_feature (1)..( 9): Matrix.003 file - promoters60/5663474
tcaaaaaga

SEQ ID NO: 62381 - DNA, 7 bp, Unknown
  misc_feature (1)..( 7): Matrix.003 file - promoters60/5663474
tgtgttg

SEQ ID NO: 62382 - DNA, 6 bp, Unknown
  misc_feature (1)..( 6): Matrix.003 file - promoters60/5663474
atctcc

SEQ ID NO: 62383 - DNA, 7 bp, Unknown
  misc_feature (1)..( 7): Matrix.003 file - promoters60/5663474
gttggat

SEQ ID NO: 62384 - DNA, 7 bp, Unknown
  misc_feature (1)..( 7): Matrix.003 file - promoters60/5663474
catataa

SEQ ID NO: 62385 - DNA, 9 bp, Unknown
  misc_feature (1)..( 9): Matrix.003 file - promoters60/5663474
tcttataat

SEQ ID NO: 62386 - DNA, 8 bp, Unknown
  misc_feature (1)..( 8): Matrix.003 file - promoters60/5663478
caagcttt

SEQ ID NO: 62387 - DNA, 11 bp, Unknown
  misc_feature (1)..( 11): Matrix.003 file - promoters60/5663478
aaaatcataat

SEQ ID NO: 62388 - DNA, 10 bp, Unknown
  misc_feature (1)..( 10): Matrix.003 file - promoters60/5663478
tgattagtaa

SEQ ID NO: 62389 - DNA, 8 bp, Unknown
  misc_feature (1)..( 8): Matrix.003 file - promoters60/5663478
tttcttaa

SEQ ID NO: 62390 - DNA, 10 bp, Unknown
  misc_feature (1)..( 10): Matrix.003 file - promoters60/5663478
ctcaaacttg

SEQ ID NO: 62391 - DNA, 6 bp, Unknown
  misc_feature (1)..( 6): Matrix.003 file - promoters60/5663502
aaaaaa

SEQ ID NO: 62392 - DNA, 11 bp, Unknown
  misc_feature (1)..( 11): Matrix.003 file - promoters60/5663502
atttatcgaat

SEQ ID NO: 62393 - DNA, 7 bp, Unknown
  misc_feature (1)..( 7): Matrix.003 file - promoters60/5663502
caccgaa

SEQ ID NO: 62394 - DNA, 6 bp, Unknown
  misc_feature (1)..( 6): Matrix.003 file - promoters60/5663502
actttt

SEQ ID NO: 62395 - DNA, 6 bp, Unknown
  misc_feature (1)..( 6): Matrix.003 file - promoters60/5663502
ttttac

SEQ ID NO: 62396 - DNA, 6 bp, Unknown
  misc_feature (1)..( 6): Matrix.003 file - promoters60/5663502
tcttgt

SEQ ID NO: 62397 - DNA, 7 bp, Unknown
  misc_feature (1)..( 7): Matrix.003 file - promoters60/5663502
attcttc

SEQ ID NO: 62398 - DNA, 14 bp, Unknown
  misc_feature (1)..( 14): Matrix.003 file - promoters60/5663502
tcatttttttttgt

SEQ ID NO: 62399 - DNA, 10 bp, Unknown
  misc_feature (1)..( 10): Matrix.003 file - promoters60/5663502
aatttttttt

SEQ ID NO: 62400 - DNA, 10 bp, Unknown
  misc_feature (1)..( 10): Matrix.003 file - promoters60/5663502
aaacacatct

SEQ ID NO: 62401 - DNA, 9 bp, Unknown
  misc_feature (1)..( 9): Matrix.003 file - promoters60/5663502
catttcttt

SEQ ID NO: 62402 - DNA, 8 bp, Unknown
  misc_feature (1)..( 8): Matrix.003 file - promoters60/5663502
aattatat

SEQ ID NO: 62403 - DNA, 6 bp, Unknown
  misc_feature (1)..( 6): Matrix.003 file - promoters60/5663502
attctt

SEQ ID NO: 62404 - DNA, 6 bp, Unknown
  misc_feature (1)..( 6): Matrix.003 file - promoters60/5663502
aaatca

SEQ ID NO: 62405 - DNA, 7 bp, Unknown
  misc_feature (1)..( 7): Matrix.003 file - promoters60/5663502
ttaactt

SEQ ID NO: 62406 - DNA, 6 bp, Unknown
  misc_feature (1)..( 6): Matrix.003 file - promoters60/5663502
ttcaaa

SEQ ID NO: 62407 - DNA, 6 bp, Unknown
  misc_feature (1)..( 6): Matrix.003 file - promoters60/5663502
gtttct

SEQ ID NO: 62408 - DNA, 7 bp, Unknown
  misc_feature (1)..( 7): Matrix.003 file - promoters60/5663502
ttaaatt

SEQ ID NO: 62409 - DNA, 7 bp, Unknown
  misc_feature (1)..( 7): Matrix.003 file - promoters60/5663502
atatctt

SEQ ID NO: 62410 - DNA, 10 bp, Unknown
  misc_feature (1)..( 10): Matrix.003 file - promoters60/5663502
ttttaacctc

SEQ ID NO: 62411 - DNA, 8 bp, Unknown
  misc_feature (1)..( 8): Matrix.003 file - promoters60/5663577
gtacgaat

SEQ ID NO: 62412 - DNA, 8 bp, Unknown
  misc_feature (1)..( 8): Matrix.003 file - promoters60/5663577
atttcatt

SEQ ID NO: 62413 - DNA, 6 bp, Unknown
  misc_feature (1)..( 6): Matrix.003 file - promoters60/5663585
atcaaa

SEQ ID NO: 62414 - DNA, 12 bp, Unknown
  misc_feature (1)..( 12): Matrix.003 file - promoters60/5663585
attcttaaattt

SEQ ID NO: 62415 - DNA, 6 bp, Unknown
  misc_feature (1)..( 6): Matrix.003 file - promoters60/5663585
ccaaat

SEQ ID NO: 62416 - DNA, 6 bp, Unknown
  misc_feature (1)..( 6): Matrix.003 file - promoters60/5663585
attatt

SEQ ID NO: 62417 - DNA, 9 bp, Unknown
  misc_feature (1)..( 9): Matrix.003 file - promoters60/5663585
tattcaaac

SEQ ID NO: 62418 - DNA, 6 bp, Unknown
  misc_feature (1)..( 6): Matrix.003 file - promoters60/5663585
atttgg

SEQ ID NO: 62419 - DNA, 8 bp, Unknown
  misc_feature (1)..( 8): Matrix.003 file - promoters60/5663585
taacaagc

SEQ ID NO: 62420 - DNA, 8 bp, Unknown
  misc_feature (1)..( 8): Matrix.003 file - promoters60/5663585
ctttataa

SEQ ID NO: 62421 - DNA, 7 bp, Unknown
  misc_feature (1)..( 7): Matrix.003 file - promoters60/5663585
gtgaaaa

SEQ ID NO: 62422 - DNA, 6 bp, Unknown
  misc_feature (1)..( 6): Matrix.003 file - promoters60/5663585
agacaa

SEQ ID NO: 62423 - DNA, 6 bp, Unknown
  misc_feature (1)..( 6): Matrix.003 file - promoters60/5663585
ttctta

SEQ ID NO: 62424 - DNA, 8 bp, Unknown
  misc_feature (1)..( 8): Matrix.003 file - promoters60/5663585
ataaacaa

SEQ ID NO: 62425 - DNA, 7 bp, Unknown
  misc_feature (1)..( 7): Matrix.003 file - promoters60/5663585
aaatcca

SEQ ID NO: 62426 - DNA, 7 bp, Unknown
  misc_feature (1)..( 7): Matrix.003 file - promoters60/5663585
attattc

SEQ ID NO: 62427 - DNA, 7 bp, Unknown
  misc_feature (1)..( 7): Matrix.003 file - promoters60/5663585
atgatat

SEQ ID NO: 62428 - DNA, 7 bp, Unknown
  misc_feature (1)..( 7): Matrix.003 file - promoters60/5663585
aatattt

SEQ ID NO: 62429 - DNA, 8 bp, Unknown
  misc_feature (1)..( 8): Matrix.003 file - promoters60/5663585
aaagcttt

SEQ ID NO: 62430 - DNA, 7 bp, Unknown
  misc_feature (1)..( 7): Matrix.003 file - promoters60/5663585
acaaatt

SEQ ID NO: 62431 - DNA, 6 bp, Unknown
  misc_feature (1)..( 6): Matrix.003 file - promoters60/5663585
cacata

SEQ ID NO: 62432 - DNA, 6 bp, Unknown
  misc_feature (1)..( 6): Matrix.003 file - promoters60/5663585
aagttt

SEQ ID NO: 62433 - DNA, 6 bp, Unknown
  misc_feature (1)..( 6): Matrix.003 file - promoters60/5663585
ataaat

SEQ ID NO: 62434 - DNA, 8 bp, Unknown
  misc_feature (1)..( 8): Matrix.003 file - promoters60/5663585
attgtaat

SEQ ID NO: 62435 - DNA, 8 bp, Unknown
  misc_feature (1)..( 8): Matrix.003 file - promoters60/5663585
aattatac

SEQ ID NO: 62436 - DNA, 6 bp, Unknown
  misc_feature (1)..( 6): Matrix.003 file - promoters60/5663585
gtaaaa

SEQ ID NO: 62437 - DNA, 7 bp, Unknown
  misc_feature (1)..( 7): Matrix.003 file - promoters60/5663585
tttctat

SEQ ID NO: 62438 - DNA, 10 bp, Unknown
  misc_feature (1)..( 10): Matrix.003 file - promoters60/5663585
tataaaagtt

SEQ ID NO: 62439 - DNA, 9 bp, Unknown
  misc_feature (1)..( 9): Matrix.003 file - promoters60/5663595
gacaaaata

SEQ ID NO: 62440 - DNA, 6 bp, Unknown
  misc_feature (1)..( 6): Matrix.003 file - promoters60/5663595
aatact

SEQ ID NO: 62441 - DNA, 8 bp, Unknown
  misc_feature (1)..( 8): Matrix.003 file - promoters60/5663595
ttttattt

SEQ ID NO: 62442 - DNA, 7 bp, Unknown
  misc_feature (1)..( 7): Matrix.003 file - promoters60/5663595
tttgtct

SEQ ID NO: 62443 - DNA, 7 bp, Unknown
  misc_feature (1)..( 7): Matrix.003 file - promoters60/5663595
tttagtt

SEQ ID NO: 62444 - DNA, 8 bp, Unknown
  misc_feature (1)..( 8): Matrix.003 file - promoters60/5663595
tttacttg

SEQ ID NO: 62445 - DNA, 7 bp, Unknown
  misc_feature (1)..( 7): Matrix.003 file - promoters60/5663595
tttcttt

SEQ ID NO: 62446 - DNA, 8 bp, Unknown
  misc_feature (1)..( 8): Matrix.003 file - promoters60/5663595
tcagttta

SEQ ID NO: 62447 - DNA, 6 bp, Unknown
  misc_feature (1)..( 6): Matrix.003 file - promoters60/5663595
ttttca

SEQ ID NO: 62448 - DNA, 7 bp, Unknown
  misc_feature (1)..( 7): Matrix.003 file - promoters60/5663595
atttggt

SEQ ID NO: 62449 - DNA, 7 bp, Unknown
  misc_feature (1)..( 7): Matrix.003 file - promoters60/5663595
aaaatct

SEQ ID NO: 62450 - DNA, 15 bp, Unknown
  misc_feature (1)..( 15): Matrix.003 file - promoters60/5663595
actaaaatccaaaat

SEQ ID NO: 62451 - DNA, 6 bp, Unknown
  misc_feature (1)..( 6): Matrix.003 file - promoters60/5663595
ttttct

SEQ ID NO: 62452 - DNA, 9 bp, Unknown
  misc_feature (1)..( 9): Matrix.003 file - promoters60/5663595
aaaatgaat

SEQ ID NO: 62453 - DNA, 6 bp, Unknown
  misc_feature (1)..( 6): Matrix.003 file - promoters60/5663595
tctttt

SEQ ID NO: 62454 - DNA, 10 bp, Unknown
  misc_feature (1)..( 10): Matrix.003 file - promoters60/5663595
tttcattttt

SEQ ID NO: 62455 - DNA, 6 bp, Unknown
  misc_feature (1)..( 6): Matrix.003 file - promoters60/5663595
tttaac

SEQ ID NO: 62456 - DNA, 7 bp, Unknown
  misc_feature (1)..( 7): Matrix.003 file - promoters60/5663595
gacataa

SEQ ID NO: 62457 - DNA, 8 bp, Unknown
  misc_feature (1)..( 8): Matrix.003 file - promoters60/5663595
ttccaaaa

SEQ ID NO: 62458 - DNA, 6 bp, Unknown
  misc_feature (1)..( 6): Matrix.003 file - promoters60/5663595
aaaatt

SEQ ID NO: 62459 - DNA, 6 bp, Unknown
  misc_feature (1)..( 6): Matrix.003 file - promoters60/5663595
aattaa

SEQ ID NO: 62460 - DNA, 8 bp, Unknown
  misc_feature (1)..( 8): Matrix.003 file - promoters60/5663595
aaaaaatt

SEQ ID NO: 62461 - DNA, 6 bp, Unknown
  misc_feature (1)..( 6): Matrix.003 file - promoters60/5663614
aatttg

SEQ ID NO: 62462 - DNA, 7 bp, Unknown
  misc_feature (1)..( 7): Matrix.003 file - promoters60/5663614
cttataa

SEQ ID NO: 62463 - DNA, 6 bp, Unknown
  misc_feature (1)..( 6): Matrix.003 file - promoters60/5663614
aataat

SEQ ID NO: 62464 - DNA, 9 bp, Unknown
  misc_feature (1)..( 9): Matrix.003 file - promoters60/5663614
aaaacaatt

SEQ ID NO: 62465 - DNA, 6 bp, Unknown
  misc_feature (1)..( 6): Matrix.003 file - promoters60/5663614
agcaaa

SEQ ID NO: 62466 - DNA, 7 bp, Unknown
  misc_feature (1)..( 7): Matrix.003 file - promoters60/5663614
aaccaaa

SEQ ID NO: 62467 - DNA, 12 bp, Unknown
  misc_feature (1)..( 12): Matrix.003 file - promoters60/5663614
aaaataaatcaa

SEQ ID NO: 62468 - DNA, 6 bp, Unknown
  misc_feature (1)..( 6): Matrix.003 file - promoters60/5663614
ttcatt

SEQ ID NO: 62469 - DNA, 9 bp, Unknown
  misc_feature (1)..( 9): Matrix.003 file - promoters60/5663614
atacaattt

SEQ ID NO: 62470 - DNA, 8 bp, Unknown
  misc_feature (1)..( 8): Matrix.003 file - promoters60/5663614
aaacttta

SEQ ID NO: 62471 - DNA, 13 bp, Unknown
  misc_feature (1)..( 13): Matrix.003 file - promoters60/5663614
atcttcttacttt

SEQ ID NO: 62472 - DNA, 6 bp, Unknown
  misc_feature (1)..( 6): Matrix.003 file - promoters60/5663614
aaaata

SEQ ID NO: 62473 - DNA, 6 bp, Unknown
  misc_feature (1)..( 6): Matrix.003 file - promoters60/5663614
tggtct

SEQ ID NO: 62474 - DNA, 6 bp, Unknown
  misc_feature (1)..( 6): Matrix.003 file - promoters60/5663614
cccaaa

SEQ ID NO: 62475 - DNA, 11 bp, Unknown
  misc_feature (1)..( 11): Matrix.003 file - promoters60/5663614
caaaaggacca

SEQ ID NO: 62476 - DNA, 6 bp, Unknown
  misc_feature (1)..( 6): Matrix.003 file - promoters60/5663614
tcagat

SEQ ID NO: 62477 - DNA, 7 bp, Unknown
  misc_feature (1)..( 7): Matrix.003 file - promoters60/5663614
tttgttt

SEQ ID NO: 62478 - DNA, 6 bp, Unknown
  misc_feature (1)..( 6): Matrix.003 file - promoters60/5663614
ttctta

SEQ ID NO: 62479 - DNA, 7 bp, Unknown
  misc_feature (1)..( 7): Matrix.003 file - promoters60/5663614
aaaataa

SEQ ID NO: 62480 - DNA, 6 bp, Unknown
  misc_feature (1)..( 6): Matrix.003 file - promoters60/5663614
caatat

SEQ ID NO: 62481 - DNA, 8 bp, Unknown
  misc_feature (1)..( 8): Matrix.003 file - promoters60/5663614
tattaata

SEQ ID NO: 62482 - DNA, 8 bp, Unknown
  misc_feature (1)..( 8): Matrix.003 file - promoters60/5663614
tttggccc

SEQ ID NO: 62483 - DNA, 7 bp, Unknown
  misc_feature (1)..( 7): Matrix.003 file - promoters60/5663614
caaaatt

SEQ ID NO: 62484 - DNA, 7 bp, Unknown
  misc_feature (1)..( 7): Matrix.003 file - promoters60/5663614
aatattt

SEQ ID NO: 62485 - DNA, 8 bp, Unknown
  misc_feature (1)..( 8): Matrix.003 file - promoters60/5663625
atgtttat

SEQ ID NO: 62486 - DNA, 11 bp, Unknown
  misc_feature (1)..( 11): Matrix.003 file - promoters60/5663625
tttttattttc

SEQ ID NO: 62487 - DNA, 6 bp, Unknown
  misc_feature (1)..( 6): Matrix.003 file - promoters60/5663625
tattat

SEQ ID NO: 62488 - DNA, 7 bp, Unknown
  misc_feature (1)..( 7): Matrix.003 file - promoters60/5663625
aaataat

SEQ ID NO: 62489 - DNA, 11 bp, Unknown
  misc_feature (1)..( 11): Matrix.003 file - promoters60/5663625
gattttttata

SEQ ID NO: 62490 - DNA, 12 bp, Unknown
  misc_feature (1)..( 12): Matrix.003 file - promoters60/5663625
atttataaaatt

SEQ ID NO: 62491 - DNA, 7 bp, Unknown
  misc_feature (1)..( 7): Matrix.003 file - promoters60/5663698
tgcataa

SEQ ID NO: 62492 - DNA, 9 bp, Unknown
  misc_feature (1)..( 9): Matrix.003 file - promoters60/5663698
tcaaaaact

SEQ ID NO: 62493 - DNA, 7 bp, Unknown
  misc_feature (1)..( 7): Matrix.003 file - promoters60/5663698
aacaaat

SEQ ID NO: 62494 - DNA, 6 bp, Unknown
  misc_feature (1)..( 6): Matrix.003 file - promoters60/5663698
ttttaa

SEQ ID NO: 62495 - DNA, 6 bp, Unknown
  misc_feature (1)..( 6): Matrix.003 file - promoters60/5663698
ccaatt

SEQ ID NO: 62496 - DNA, 9 bp, Unknown
  misc_feature (1)..( 9): Matrix.003 file - promoters60/5663698
tataatgaa

SEQ ID NO: 62497 - DNA, 8 bp, Unknown
  misc_feature (1)..( 8): Matrix.003 file - promoters60/5663698
agtgatca

SEQ ID NO: 62498 - DNA, 10 bp, Unknown
  misc_feature (1)..( 10): Matrix.003 file - promoters60/5663698
cttacaattt

SEQ ID NO: 62499 - DNA, 6 bp, Unknown
  misc_feature (1)..( 6): Matrix.003 file - promoters60/5663698
tttgta

SEQ ID NO: 62500 - DNA, 6 bp, Unknown
  misc_feature (1)..( 6): Matrix.003 file - promoters60/5663698
aatata

SEQ ID NO: 62501 - DNA, 6 bp, Unknown
  misc_feature (1)..( 6): Matrix.003 file - promoters60/5663698
aatggt

SEQ ID NO: 62502 - DNA, 8 bp, Unknown
  misc_feature (1)..( 8): Matrix.003 file - promoters60/5663698
tcaaattt

SEQ ID NO: 62503 - DNA, 7 bp, Unknown
  misc_feature (1)..( 7): Matrix.003 file - promoters60/5663698
aagaaca

SEQ ID NO: 62504 - DNA, 7 bp, Unknown
  misc_feature (1)..( 7): Matrix.003 file - promoters60/5663698
gttagtg

SEQ ID NO: 62505 - DNA, 6 bp, Unknown
  misc_feature (1)..( 6): Matrix.003 file - promoters60/5663698
ttttgc

SEQ ID NO: 62506 - DNA, 9 bp, Unknown
  misc_feature (1)..( 9): Matrix.003 file - promoters60/5663698
tgagaattt

SEQ ID NO: 62507 - DNA, 9 bp, Unknown
  misc_feature (1)..( 9): Matrix.003 file - promoters60/5663698
gatgttgta

SEQ ID NO: 62508 - DNA, 8 bp, Unknown
  misc_feature (1)..( 8): Matrix.003 file - promoters60/5663698
tctatctg

SEQ ID NO: 62509 - DNA, 11 bp, Unknown
  misc_feature (1)..( 11): Matrix.003 file - promoters60/5663706
aaaaattctaa

SEQ ID NO: 62510 - DNA, 7 bp, Unknown
  misc_feature (1)..( 7): Matrix.003 file - promoters60/5663706
aaaattc

SEQ ID NO: 62511 - DNA, 8 bp, Unknown
  misc_feature (1)..( 8): Matrix.003 file - promoters60/5663706
gtaggtag

SEQ ID NO: 62512 - DNA, 13 bp, Unknown
  misc_feature (1)..( 13): Matrix.003 file - promoters60/5663706
gttttatttaata

SEQ ID NO: 62513 - DNA, 7 bp, Unknown
  misc_feature (1)..( 7): Matrix.003 file - promoters60/5663706
gtaaaaa

SEQ ID NO: 62514 - DNA, 10 bp, Unknown
  misc_feature (1)..( 10): Matrix.003 file - promoters60/5663706
ttatattctt

SEQ ID NO: 62515 - DNA, 7 bp, Unknown
  misc_feature (1)..( 7): Matrix.003 file - promoters60/5663706
aaattaa

SEQ ID NO: 62516 - DNA, 11 bp, Unknown
  misc_feature (1)..( 11): Matrix.003 file - promoters60/5663706
ttgaatatttc

SEQ ID NO: 62517 - DNA, 7 bp, Unknown
  misc_feature (1)..( 7): Matrix.003 file - promoters60/5663706
acactta

SEQ ID NO: 62518 - DNA, 10 bp, Unknown
  misc_feature (1)..( 10): Matrix.003 file - promoters60/5663706
taattaattt

SEQ ID NO: 62519 - DNA, 8 bp, Unknown
  misc_feature (1)..( 8): Matrix.003 file - promoters60/5663710
catgaata

SEQ ID NO: 62520 - DNA, 10 bp, Unknown
  misc_feature (1)..( 10): Matrix.003 file - promoters60/5663710
agataatctt

SEQ ID NO: 62521 - DNA, 11 bp, Unknown
  misc_feature (1)..( 11): Matrix.003 file - promoters60/5663710
ataaaattgaa

SEQ ID NO: 62522 - DNA, 9 bp, Unknown
  misc_feature (1)..( 9): Matrix.003 file - promoters60/5663744
gttttactt

SEQ ID NO: 62523 - DNA, 8 bp, Unknown
  misc_feature (1)..( 8): Matrix.003 file - promoters60/5663744
ctagtgat

SEQ ID NO: 62524 - DNA, 8 bp, Unknown
  misc_feature (1)..( 8): Matrix.003 file - promoters60/5663744
aaacatgg

SEQ ID NO: 62525 - DNA, 9 bp, Unknown
  misc_feature (1)..( 9): Matrix.003 file - promoters60/5663744
gtatagatt

SEQ ID NO: 62526 - DNA, 8 bp, Unknown
  misc_feature (1)..( 8): Matrix.003 file - promoters60/5663744
gatacgtg

SEQ ID NO: 62527 - DNA, 10 bp, Unknown
  misc_feature (1)..( 10): Matrix.003 file - promoters60/5663744
gaactagata

SEQ ID NO: 62528 - DNA, 6 bp, Unknown
  misc_feature (1)..( 6): Matrix.003 file - promoters60/5663744
ttgatt

SEQ ID NO: 62529 - DNA, 9 bp, Unknown
  misc_feature (1)..( 9): Matrix.003 file - promoters60/5663744
taacttttt

SEQ ID NO: 62530 - DNA, 7 bp, Unknown
  misc_feature (1)..( 7): Matrix.003 file - promoters60/5663744
ataaaga

SEQ ID NO: 62531 - DNA, 7 bp, Unknown
  misc_feature (1)..( 7): Matrix.003 file - promoters60/5663744
tccagaa

SEQ ID NO: 62532 - DNA, 8 bp, Unknown
  misc_feature (1)..( 8): Matrix.003 file - promoters60/5663744
aatcaaag

SEQ ID NO: 62533 - DNA, 7 bp, Unknown
  misc_feature (1)..( 7): Matrix.003 file - promoters60/5663744
aaacaca

SEQ ID NO: 62534 - DNA, 7 bp, Unknown
  misc_feature (1)..( 7): Matrix.003 file - promoters60/5663744
aaagatc

SEQ ID NO: 62535 - DNA, 7 bp, Unknown
  misc_feature (1)..( 7): Matrix.003 file - promoters60/5663744
aaacaaa

SEQ ID NO: 62536 - DNA, 7 bp, Unknown
  misc_feature (1)..( 7): Matrix.003 file - promoters60/5663748
tttttat

SEQ ID NO: 62537 - DNA, 6 bp, Unknown
  misc_feature (1)..( 6): Matrix.003 file - promoters60/5663748
agaaat

SEQ ID NO: 62538 - DNA, 7 bp, Unknown
  misc_feature (1)..( 7): Matrix.003 file - promoters60/5663748
tttatct

SEQ ID NO: 62539 - DNA, 8 bp, Unknown
  misc_feature (1)..( 8): Matrix.003 file - promoters60/5663748
ctttactt

SEQ ID NO: 62540 - DNA, 8 bp, Unknown
  misc_feature (1)..( 8): Matrix.003 file - promoters60/5663748
aaaaataa

SEQ ID NO: 62541 - DNA, 7 bp, Unknown
  misc_feature (1)..( 7): Matrix.003 file - promoters60/5663748
aaacaaa

SEQ ID NO: 62542 - DNA, 9 bp, Unknown
  misc_feature (1)..( 9): Matrix.003 file - promoters60/5663748
aagaaaata

SEQ ID NO: 62543 - DNA, 7 bp, Unknown
  misc_feature (1)..( 7): Matrix.003 file - promoters60/5663748
aaatttt

SEQ ID NO: 62544 - DNA, 8 bp, Unknown
  misc_feature (1)..( 8): Matrix.003 file - promoters60/5663758
catttttt

SEQ ID NO: 62545 - DNA, 10 bp, Unknown
  misc_feature (1)..( 10): Matrix.003 file - promoters60/5663758
ctaaaattat

SEQ ID NO: 62546 - DNA, 7 bp, Unknown
  misc_feature (1)..( 7): Matrix.003 file - promoters60/5663758
ttttttt

SEQ ID NO: 62547 - DNA, 9 bp, Unknown
  misc_feature (1)..( 9): Matrix.003 file - promoters60/5663758
tcaaaatta

SEQ ID NO: 62548 - DNA, 8 bp, Unknown
  misc_feature (1)..( 8): Matrix.003 file - promoters60/5663758
ttgtgttt

SEQ ID NO: 62549 - DNA, 10 bp, Unknown
  misc_feature (1)..( 10): Matrix.003 file - promoters60/5663758
ctaaaataat

SEQ ID NO: 62550 - DNA, 9 bp, Unknown
  misc_feature (1)..( 9): Matrix.003 file - promoters60/5663758
atctaaaaa

SEQ ID NO: 62551 - DNA, 7 bp, Unknown
  misc_feature (1)..( 7): Matrix.003 file - promoters60/5663785
aaaataa

SEQ ID NO: 62552 - DNA, 5 bp, Unknown
  misc_feature (1)..( 5): Matrix.003 file - promoters60/5663785
taaaa

SEQ ID NO: 62553 - DNA, 9 bp, Unknown
  misc_feature (1)..( 9): Matrix.003 file - promoters60/5663785
ctgttattt

SEQ ID NO: 62554 - DNA, 8 bp, Unknown
  misc_feature (1)..( 8): Matrix.003 file - promoters60/5663785
aaaattaa

SEQ ID NO: 62555 - DNA, 10 bp, Unknown
  misc_feature (1)..( 10): Matrix.003 file - promoters60/5663785
taaatagaaa

SEQ ID NO: 62556 - DNA, 9 bp, Unknown
  misc_feature (1)..( 9): Matrix.003 file - promoters60/5663785
aaaataaaa

SEQ ID NO: 62557 - DNA, 11 bp, Unknown
  misc_feature (1)..( 11): Matrix.003 file - promoters60/5663785
tataaccaaaa

SEQ ID NO: 62558 - DNA, 8 bp, Unknown
  misc_feature (1)..( 8): Matrix.003 file - promoters60/5663805
tttgtata

SEQ ID NO: 62559 - DNA, 13 bp, Unknown
  misc_feature (1)..( 13): Matrix.003 file - promoters60/5663805
tcacaataaaaat

SEQ ID NO: 62560 - DNA, 14 bp, Unknown
  misc_feature (1)..( 14): Matrix.003 file - promoters60/5663805
acttataataaata

SEQ ID NO: 62561 - DNA, 10 bp, Unknown
  misc_feature (1)..( 10): Matrix.003 file - promoters60/5663805
ggtttttgta

SEQ ID NO: 62562 - DNA, 14 bp, Unknown
  misc_feature (1)..( 14): Matrix.003 file - promoters60/5663805
acatataataaaaa

SEQ ID NO: 62563 - DNA, 10 bp, Unknown
  misc_feature (1)..( 10): Matrix.003 file - promoters60/5663805
atataataaa

SEQ ID NO: 62564 - DNA, 10 bp, Unknown
  misc_feature (1)..( 10): Matrix.003 file - promoters60/5663805
aaataatgaa

SEQ ID NO: 62565 - DNA, 14 bp, Unknown
  misc_feature (1)..( 14): Matrix.003 file - promoters60/5663805
acttataatataat

SEQ ID NO: 62566 - DNA, 11 bp, Unknown
  misc_feature (1)..( 11): Matrix.003 file - promoters60/5663805
tcctattatat

SEQ ID NO: 62567 - DNA, 6 bp, Unknown
  misc_feature (1)..( 6): Matrix.003 file - promoters60/5663820
ttatca

SEQ ID NO: 62568 - DNA, 8 bp, Unknown
  misc_feature (1)..( 8): Matrix.003 file - promoters60/5663820
ttttattt

SEQ ID NO: 62569 - DNA, 8 bp, Unknown
  misc_feature (1)..( 8): Matrix.003 file - promoters60/5663820
cctacttt

SEQ ID NO: 62570 - DNA, 7 bp, Unknown
  misc_feature (1)..( 7): Matrix.003 file - promoters60/5663820
tttggtt

SEQ ID NO: 62571 - DNA, 7 bp, Unknown
  misc_feature (1)..( 7): Matrix.003 file - promoters60/5663820
tttctct

SEQ ID NO: 62572 - DNA, 6 bp, Unknown
  misc_feature (1)..( 6): Matrix.003 file - promoters60/5663820
cactta

SEQ ID NO: 62573 - DNA, 6 bp, Unknown
  misc_feature (1)..( 6): Matrix.003 file - promoters60/5663820
gaaagt

SEQ ID NO: 62574 - DNA, 9 bp, Unknown
  misc_feature (1)..( 9): Matrix.003 file - promoters60/5663820
ttgggatcc

SEQ ID NO: 62575 - DNA, 8 bp, Unknown
  misc_feature (1)..( 8): Matrix.003 file - promoters60/5663820
tatgtgtg

SEQ ID NO: 62576 - DNA, 6 bp, Unknown
  misc_feature (1)..( 6): Matrix.003 file - promoters60/5663820
ttttca

SEQ ID NO: 62577 - DNA, 7 bp, Unknown
  misc_feature (1)..( 7): Matrix.003 file - promoters60/5663820
gttcaaa

SEQ ID NO: 62578 - DNA, 7 bp, Unknown
  misc_feature (1)..( 7): Matrix.003 file - promoters60/5663820
gcaatga

SEQ ID NO: 62579 - DNA, 6 bp, Unknown
  misc_feature (1)..( 6): Matrix.003 file - promoters60/5663820
tgtttt

SEQ ID NO: 62580 - DNA, 6 bp, Unknown
  misc_feature (1)..( 6): Matrix.003 file - promoters60/5663820
accttc

SEQ ID NO: 62581 - DNA, 6 bp, Unknown
  misc_feature (1)..( 6): Matrix.003 file - promoters60/5663820
tctttt

SEQ ID NO: 62582 - DNA, 7 bp, Unknown
  misc_feature (1)..( 7): Matrix.003 file - promoters60/5663820
cttgatt

SEQ ID NO: 62583 - DNA, 7 bp, Unknown
  misc_feature (1)..( 7): Matrix.003 file - promoters60/5663820
aatataa

SEQ ID NO: 62584 - DNA, 7 bp, Unknown
  misc_feature (1)..( 7): Matrix.003 file - promoters60/5663820
tatcttt

SEQ ID NO: 62585 - DNA, 7 bp, Unknown
  misc_feature (1)..( 7): Matrix.003 file - promoters60/5663820
tttcttt

SEQ ID NO: 62586 - DNA, 7 bp, Unknown
  misc_feature (1)..( 7): Matrix.003 file - promoters60/5663820
aataaac

SEQ ID NO: 62587 - DNA, 8 bp, Unknown
  misc_feature (1)..( 8): Matrix.003 file - promoters60/5663820
ccgtgtta

SEQ ID NO: 62588 - DNA, 11 bp, Unknown
  misc_feature (1)..( 11): Matrix.003 file - promoters60/5663862
caaaagaaaat

SEQ ID NO: 62589 - DNA, 9 bp, Unknown
  misc_feature (1)..( 9): Matrix.003 file - promoters60/5663862
taacgaaat

SEQ ID NO: 62590 - DNA, 7 bp, Unknown
  misc_feature (1)..( 7): Matrix.003 file - promoters60/5663862
caaaacc

SEQ ID NO: 62591 - DNA, 9 bp, Unknown
  misc_feature (1)..( 9): Matrix.003 file - promoters60/5663934
catataaaa

SEQ ID NO: 62592 - DNA, 7 bp, Unknown
  misc_feature (1)..( 7): Matrix.003 file - promoters60/5663934
tttgttt

SEQ ID NO: 62593 - DNA, 10 bp, Unknown
  misc_feature (1)..( 10): Matrix.003 file - promoters60/5663942
gagagatttt

SEQ ID NO: 62594 - DNA, 7 bp, Unknown
  misc_feature (1)..( 7): Matrix.003 file - promoters60/5663942
attaggg

SEQ ID NO: 62595 - DNA, 7 bp, Unknown
  misc_feature (1)..( 7): Matrix.003 file - promoters60/5663942
tttagat

SEQ ID NO: 62596 - DNA, 9 bp, Unknown
  misc_feature (1)..( 9): Matrix.003 file - promoters60/5663942
gagaagaaa

SEQ ID NO: 62597 - DNA, 6 bp, Unknown
  misc_feature (1)..( 6): Matrix.003 file - promoters60/5663942
agtgag

SEQ ID NO: 62598 - DNA, 6 bp, Unknown
  misc_feature (1)..( 6): Matrix.003 file - promoters60/5663942
gagaga

SEQ ID NO: 62599 - DNA, 7 bp, Unknown
  misc_feature (1)..( 7): Matrix.003 file - promoters60/5663942
taaataa

SEQ ID NO: 62600 - DNA, 6 bp, Unknown
  misc_feature (1)..( 6): Matrix.003 file - promoters60/5663942
tcaccg

SEQ ID NO: 62601 - DNA, 6 bp, Unknown
  misc_feature (1)..( 6): Matrix.003 file - promoters60/5663942
aggaga

SEQ ID NO: 62602 - DNA, 7 bp, Unknown
  misc_feature (1)..( 7): Matrix.003 file - promoters60/5663942
acgacca

SEQ ID NO: 62603 - DNA, 6 bp, Unknown
  misc_feature (1)..( 6): Matrix.003 file - promoters60/5663942
agagaa

SEQ ID NO: 62604 - DNA, 6 bp, Unknown
  misc_feature (1)..( 6): Matrix.003 file - promoters60/5663942
tgcaaa

SEQ ID NO: 62605 - DNA, 7 bp, Unknown
  misc_feature (1)..( 7): Matrix.003 file - promoters60/5663942
caattaa

SEQ ID NO: 62606 - DNA, 9 bp, Unknown
  misc_feature (1)..( 9): Matrix.003 file - promoters60/5663942
caatccacg

SEQ ID NO: 62607 - DNA, 7 bp, Unknown
  misc_feature (1)..( 7): Matrix.003 file - promoters60/5663942
agtattg

SEQ ID NO: 62608 - DNA, 7 bp, Unknown
  misc_feature (1)..( 7): Matrix.003 file - promoters60/5663942
tatgaaa

SEQ ID NO: 62609 - DNA, 8 bp, Unknown
  misc_feature (1)..( 8): Matrix.003 file - promoters60/5663942
ttatatat

SEQ ID NO: 62610 - DNA, 6 bp, Unknown
  misc_feature (1)..( 6): Matrix.003 file - promoters60/5663942
actcac

SEQ ID NO: 62611 - DNA, 6 bp, Unknown
  misc_feature (1)..( 6): Matrix.003 file - promoters60/5663942
gagaat

SEQ ID NO: 62612 - DNA, 9 bp, Unknown
  misc_feature (1)..( 9): Matrix.003 file - promoters60/5663942
cagatttca

SEQ ID NO: 62613 - DNA, 7 bp, Unknown
  misc_feature (1)..( 7): Matrix.003 file - promoters60/5663942
aaaatat

SEQ ID NO: 62614 - DNA, 6 bp, Unknown
  misc_feature (1)..( 6): Matrix.003 file - promoters60/5663942
ataaaa

SEQ ID NO: 62615 - DNA, 7 bp, Unknown
  misc_feature (1)..( 7): Matrix.003 file - promoters60/5663942
gttgata

SEQ ID NO: 62616 - DNA, 8 bp, Unknown
  misc_feature (1)..( 8): Matrix.003 file - promoters60/5663946
taaagaaa

SEQ ID NO: 62617 - DNA, 8 bp, Unknown
  misc_feature (1)..( 8): Matrix.003 file - promoters60/5663946
ttttcttc

SEQ ID NO: 62618 - DNA, 10 bp, Unknown
  misc_feature (1)..( 10): Matrix.003 file - promoters60/5663950
tagaaaaatt

SEQ ID NO: 62619 - DNA, 11 bp, Unknown
  misc_feature (1)..( 11): Matrix.003 file - promoters60/5663950
acctttttata

SEQ ID NO: 62620 - DNA, 12 bp, Unknown
  misc_feature (1)..( 12): Matrix.003 file - promoters60/5663950
attatcttcaat

SEQ ID NO: 62621 - DNA, 9 bp, Unknown
  misc_feature (1)..( 9): Matrix.003 file - promoters60/5663954
aattcttag

SEQ ID NO: 62622 - DNA, 6 bp, Unknown
  misc_feature (1)..( 6): Matrix.003 file - promoters60/5663962
gcagta

SEQ ID NO: 62623 - DNA, 7 bp, Unknown
  misc_feature (1)..( 7): Matrix.003 file - promoters60/5663962
accagca

SEQ ID NO: 62624 - DNA, 6 bp, Unknown
  misc_feature (1)..( 6): Matrix.003 file - promoters60/5663962
aaccga

SEQ ID NO: 62625 - DNA, 6 bp, Unknown
  misc_feature (1)..( 6): Matrix.003 file - promoters60/5663962
aaccgg

SEQ ID NO: 62626 - DNA, 7 bp, Unknown
  misc_feature (1)..( 7): Matrix.003 file - promoters60/5663962
gatacca

SEQ ID NO: 62627 - DNA, 9 bp, Unknown
  misc_feature (1)..( 9): Matrix.003 file - promoters60/5663962
ctccgccga

SEQ ID NO: 62628 - DNA, 7 bp, Unknown
  misc_feature (1)..( 7): Matrix.003 file - promoters60/5663962
tcataat

SEQ ID NO: 62629 - DNA, 6 bp, Unknown
  misc_feature (1)..( 6): Matrix.003 file - promoters60/5663962
attgtt

SEQ ID NO: 62630 - DNA, 9 bp, Unknown
  misc_feature (1)..( 9): Matrix.003 file - promoters60/5663970
aaaatttca

SEQ ID NO: 62631 - DNA, 10 bp, Unknown
  misc_feature (1)..( 10): Matrix.003 file - promoters60/5663970
tctgaatttc

SEQ ID NO: 62632 - DNA, 13 bp, Unknown
  misc_feature (1)..( 13): Matrix.003 file - promoters60/5663970
aggataattgata

SEQ ID NO: 62633 - DNA, 7 bp, Unknown
  misc_feature (1)..( 7): Matrix.003 file - promoters60/5663985
tgtttaa

SEQ ID NO: 62634 - DNA, 8 bp, Unknown
  misc_feature (1)..( 8): Matrix.003 file - promoters60/5663985
gttaactt

SEQ ID NO: 62635 - DNA, 8 bp, Unknown
  misc_feature (1)..( 8): Matrix.003 file - promoters60/5663985
tattttga

SEQ ID NO: 62636 - DNA, 8 bp, Unknown
  misc_feature (1)..( 8): Matrix.003 file - promoters60/5663985
ttagtgtt

SEQ ID NO: 62637 - DNA, 15 bp, Unknown
  misc_feature (1)..( 15): Matrix.003 file - promoters60/5663985
aatcaaggagcaatt

SEQ ID NO: 62638 - DNA, 7 bp, Unknown
  misc_feature (1)..( 7): Matrix.003 file - promoters60/5663985
gatacag

SEQ ID NO: 62639 - DNA, 6 bp, Unknown
  misc_feature (1)..( 6): Matrix.003 file - promoters60/5663985
ttcagc

SEQ ID NO: 62640 - DNA, 6 bp, Unknown
  misc_feature (1)..( 6): Matrix.003 file - promoters60/5663985
tcttgt

SEQ ID NO: 62641 - DNA, 6 bp, Unknown
  misc_feature (1)..( 6): Matrix.003 file - promoters60/5663985
cttctt

SEQ ID NO: 62642 - DNA, 6 bp, Unknown
  misc_feature (1)..( 6): Matrix.003 file - promoters60/5663985
caaaaa

SEQ ID NO: 62643 - DNA, 7 bp, Unknown
  misc_feature (1)..( 7): Matrix.003 file - promoters60/5663985
tatgggc

SEQ ID NO: 62644 - DNA, 6 bp, Unknown
  misc_feature (1)..( 6): Matrix.003 file - promoters60/5663985
gggctt

SEQ ID NO: 62645 - DNA, 9 bp, Unknown
  misc_feature (1)..( 9): Matrix.003 file - promoters60/5663985
ttttggtta

SEQ ID NO: 62646 - DNA, 6 bp, Unknown
  misc_feature (1)..( 6): Matrix.003 file - promoters60/5663985
tttttg

SEQ ID NO: 62647 - DNA, 9 bp, Unknown
  misc_feature (1)..( 9): Matrix.003 file - promoters60/5663985
tttcaaaag

SEQ ID NO: 62648 - DNA, 7 bp, Unknown
  misc_feature (1)..( 7): Matrix.003 file - promoters60/5663985
aagagaa

SEQ ID NO: 62649 - DNA, 10 bp, Unknown
  misc_feature (1)..( 10): Matrix.003 file - promoters60/5663996
tcaaaactta

SEQ ID NO: 62650 - DNA, 7 bp, Unknown
  misc_feature (1)..( 7): Matrix.003 file - promoters60/5663996
taagaac

SEQ ID NO: 62651 - DNA, 7 bp, Unknown
  misc_feature (1)..( 7): Matrix.003 file - promoters60/5664022
aacttaa

SEQ ID NO: 62652 - DNA, 6 bp, Unknown
  misc_feature (1)..( 6): Matrix.003 file - promoters60/5664022
caaaac

SEQ ID NO: 62653 - DNA, 6 bp, Unknown
  misc_feature (1)..( 6): Matrix.003 file - promoters60/5664022
ttcaaa

SEQ ID NO: 62654 - DNA, 8 bp, Unknown
  misc_feature (1)..( 8): Matrix.003 file - promoters60/5664022
ttgtaaca

SEQ ID NO: 62655 - DNA, 6 bp, Unknown
  misc_feature (1)..( 6): Matrix.003 file - promoters60/5664022
cttttc

SEQ ID NO: 62656 - DNA, 8 bp, Unknown
  misc_feature (1)..( 8): Matrix.003 file - promoters60/5664022
aataaaaa

SEQ ID NO: 62657 - DNA, 9 bp, Unknown
  misc_feature (1)..( 9): Matrix.003 file - promoters60/5664022
acccaaaaa

SEQ ID NO: 62658 - DNA, 7 bp, Unknown
  misc_feature (1)..( 7): Matrix.003 file - promoters60/5664022
ctagcaa

SEQ ID NO: 62659 - DNA, 7 bp, Unknown
  misc_feature (1)..( 7): Matrix.003 file - promoters60/5664022
taaaccc

SEQ ID NO: 62660 - DNA, 7 bp, Unknown
  misc_feature (1)..( 7): Matrix.003 file - promoters60/5664022
ataactt

SEQ ID NO: 62661 - DNA, 7 bp, Unknown
  misc_feature (1)..( 7): Matrix.003 file - promoters60/5664022
attggaa

SEQ ID NO: 62662 - DNA, 7 bp, Unknown
  misc_feature (1)..( 7): Matrix.003 file - promoters60/5664022
tactaaa

SEQ ID NO: 62663 - DNA, 9 bp, Unknown
  misc_feature (1)..( 9): Matrix.003 file - promoters60/5664060
acaaataat

SEQ ID NO: 62664 - DNA, 8 bp, Unknown
  misc_feature (1)..( 8): Matrix.003 file - promoters60/5664060
attggatt

SEQ ID NO: 62665 - DNA, 9 bp, Unknown
  misc_feature (1)..( 9): Matrix.003 file - promoters60/5664060
atttgtcta

SEQ ID NO: 62666 - DNA, 8 bp, Unknown
  misc_feature (1)..( 8): Matrix.003 file - promoters60/5664060
aaatgtca

SEQ ID NO: 62667 - DNA, 7 bp, Unknown
  misc_feature (1)..( 7): Matrix.003 file - promoters60/5664060
tgaaaac

SEQ ID NO: 62668 - DNA, 6 bp, Unknown
  misc_feature (1)..( 6): Matrix.003 file - promoters60/5664072
tagaaa

SEQ ID NO: 62669 - DNA, 7 bp, Unknown
  misc_feature (1)..( 7): Matrix.003 file - promoters60/5664072
ataatga

SEQ ID NO: 62670 - DNA, 7 bp, Unknown
  misc_feature (1)..( 7): Matrix.003 file - promoters60/5664072
taaaaat

SEQ ID NO: 62671 - DNA, 6 bp, Unknown
  misc_feature (1)..( 6): Matrix.003 file - promoters60/5664072
aaacag

SEQ ID NO: 62672 - DNA, 8 bp, Unknown
  misc_feature (1)..( 8): Matrix.003 file - promoters60/5664072
ctctattt

SEQ ID NO: 62673 - DNA, 7 bp, Unknown
  misc_feature (1)..( 7): Matrix.003 file - promoters60/5664072
attcttt

SEQ ID NO: 62674 - DNA, 10 bp, Unknown
  misc_feature (1)..( 10): Matrix.003 file - promoters60/5664072
tagcatttat

SEQ ID NO: 62675 - DNA, 6 bp, Unknown
  misc_feature (1)..( 6): Matrix.003 file - promoters60/5664072
aaagaa

SEQ ID NO: 62676 - DNA, 7 bp, Unknown
  misc_feature (1)..( 7): Matrix.003 file - promoters60/5664072
tagagaa

SEQ ID NO: 62677 - DNA, 7 bp, Unknown
  misc_feature (1)..( 7): Matrix.003 file - promoters60/5664072
aaggaga

SEQ ID NO: 62678 - DNA, 7 bp, Unknown
  misc_feature (1)..( 7): Matrix.003 file - promoters60/5664072
aaagaag

SEQ ID NO: 62679 - DNA, 6 bp, Unknown
  misc_feature (1)..( 6): Matrix.003 file - promoters60/5664072
caaaag

SEQ ID NO: 62680 - DNA, 6 bp, Unknown
  misc_feature (1)..( 6): Matrix.003 file - promoters60/5664072
caacac

SEQ ID NO: 62681 - DNA, 6 bp, Unknown
  misc_feature (1)..( 6): Matrix.003 file - promoters60/5664072
ttgaag

SEQ ID NO: 62682 - DNA, 11 bp, Unknown
  misc_feature (1)..( 11): Matrix.003 file - promoters60/5664080
attgtctcgta

SEQ ID NO: 62683 - DNA, 8 bp, Unknown
  misc_feature (1)..( 8): Matrix.003 file - promoters60/5664080
acttaaaa

SEQ ID NO: 62684 - DNA, 8 bp, Unknown
  misc_feature (1)..( 8): Matrix.003 file - promoters60/5664080
caatttac

SEQ ID NO: 62685 - DNA, 7 bp, Unknown
  misc_feature (1)..( 7): Matrix.003 file - promoters60/5664080
tgaagaa

SEQ ID NO: 62686 - DNA, 8 bp, Unknown
  misc_feature (1)..( 8): Matrix.003 file - promoters60/5664080
gaaacttt

SEQ ID NO: 62687 - DNA, 12 bp, Unknown
  misc_feature (1)..( 12): Matrix.003 file - promoters60/5664080
tttacagcatgc

SEQ ID NO: 62688 - DNA, 6 bp, Unknown
  misc_feature (1)..( 6): Matrix.003 file - promoters60/5664080
tgcttc

SEQ ID NO: 62689 - DNA, 6 bp, Unknown
  misc_feature (1)..( 6): Matrix.003 file - promoters60/5664080
tcagtt

SEQ ID NO: 62690 - DNA, 10 bp, Unknown
  misc_feature (1)..( 10): Matrix.003 file - promoters60/5664080
aaagtgagtg

SEQ ID NO: 62691 - DNA, 10 bp, Unknown
  misc_feature (1)..( 10): Matrix.003 file - promoters60/5664080
aggataaagt

SEQ ID NO: 62692 - DNA, 7 bp, Unknown
  misc_feature (1)..( 7): Matrix.003 file - promoters60/5664080
gaatggt

SEQ ID NO: 62693 - DNA, 7 bp, Unknown
  misc_feature (1)..( 7): Matrix.003 file - promoters60/5664080
gaaaccc

SEQ ID NO: 62694 - DNA, 12 bp, Unknown
  misc_feature (1)..( 12): Matrix.003 file - promoters60/5664084
gaaaagcaaaac

SEQ ID NO: 62695 - DNA, 8 bp, Unknown
  misc_feature (1)..( 8): Matrix.003 file - promoters60/5664084
aaagttaa

SEQ ID NO: 62696 - DNA, 9 bp, Unknown
  misc_feature (1)..( 9): Matrix.003 file - promoters60/5664084
ttaaatttt

SEQ ID NO: 62697 - DNA, 7 bp, Unknown
  misc_feature (1)..( 7): Matrix.003 file - promoters60/5664084
cttattg

SEQ ID NO: 62698 - DNA, 7 bp, Unknown
  misc_feature (1)..( 7): Matrix.003 file - promoters60/5664084
aaaaatc

SEQ ID NO: 62699 - DNA, 6 bp, Unknown
  misc_feature (1)..( 6): Matrix.003 file - promoters60/5664084
aacaca

SEQ ID NO: 62700 - DNA, 10 bp, Unknown
  misc_feature (1)..( 10): Matrix.003 file - promoters60/5664084
agaaaacgaa

SEQ ID NO: 62701 - DNA, 6 bp, Unknown
  misc_feature (1)..( 6): Matrix.003 file - promoters60/5664084
ccaacc

SEQ ID NO: 62702 - DNA, 7 bp, Unknown
  misc_feature (1)..( 7): Matrix.003 file - promoters60/5664084
aaaaatt

SEQ ID NO: 62703 - DNA, 6 bp, Unknown
  misc_feature (1)..( 6): Matrix.003 file - promoters60/5664084
atataa

SEQ ID NO: 62704 - DNA, 7 bp, Unknown
  misc_feature (1)..( 7): Matrix.003 file - promoters60/5664084
ccagaaa

SEQ ID NO: 62705 - DNA, 7 bp, Unknown
  misc_feature (1)..( 7): Matrix.003 file - promoters60/5664084
tcgattt

SEQ ID NO: 62706 - DNA, 7 bp, Unknown
  misc_feature (1)..( 7): Matrix.003 file - promoters60/5664084
attataa

SEQ ID NO: 62707 - DNA, 8 bp, Unknown
  misc_feature (1)..( 8): Matrix.003 file - promoters60/5664126
attataca

SEQ ID NO: 62708 - DNA, 8 bp, Unknown
  misc_feature (1)..( 8): Matrix.003 file - promoters60/5664126
aaatatat

SEQ ID NO: 62709 - DNA, 7 bp, Unknown
  misc_feature (1)..( 7): Matrix.003 file - promoters60/5664126
aacgtaa

SEQ ID NO: 62710 - DNA, 7 bp, Unknown
  misc_feature (1)..( 7): Matrix.003 file - promoters60/5664126
attggaa

SEQ ID NO: 62711 - DNA, 6 bp, Unknown
  misc_feature (1)..( 6): Matrix.003 file - promoters60/5664126
attttt

SEQ ID NO: 62712 - DNA, 8 bp, Unknown
  misc_feature (1)..( 8): Matrix.003 file - promoters60/5664126
acacacac

SEQ ID NO: 62713 - DNA, 6 bp, Unknown
  misc_feature (1)..( 6): Matrix.003 file - promoters60/5664126
tcaaaa

SEQ ID NO: 62714 - DNA, 6 bp, Unknown
  misc_feature (1)..( 6): Matrix.003 file - promoters60/5664126
acataa

SEQ ID NO: 62715 - DNA, 6 bp, Unknown
  misc_feature (1)..( 6): Matrix.003 file - promoters60/5664126
aattga

SEQ ID NO: 62716 - DNA, 9 bp, Unknown
  misc_feature (1)..( 9): Matrix.003 file - promoters60/5664126
aacaaaaat

SEQ ID NO: 62717 - DNA, 9 bp, Unknown
  misc_feature (1)..( 9): Matrix.003 file - promoters60/5664126
aaacccttt

SEQ ID NO: 62718 - DNA, 6 bp, Unknown
  misc_feature (1)..( 6): Matrix.003 file - promoters60/5664126
gaaaat

SEQ ID NO: 62719 - DNA, 7 bp, Unknown
  misc_feature (1)..( 7): Matrix.003 file - promoters60/5664126
tttgttc

SEQ ID NO: 62720 - DNA, 8 bp, Unknown
  misc_feature (1)..( 8): Matrix.003 file - promoters60/5664126
tttaggtc

SEQ ID NO: 62721 - DNA, 7 bp, Unknown
  misc_feature (1)..( 7): Matrix.003 file - promoters60/5664126
agaaaat

SEQ ID NO: 62722 - DNA, 14 bp, Unknown
  misc_feature (1)..( 14): Matrix.003 file - promoters60/5664126
taattcagaaaaat

SEQ ID NO: 62723 - DNA, 6 bp, Unknown
  misc_feature (1)..( 6): Matrix.003 file - promoters60/5664126
aatata

SEQ ID NO: 62724 - DNA, 6 bp, Unknown
  misc_feature (1)..( 6): Matrix.003 file - promoters60/5664126
aaaatt

SEQ ID NO: 62725 - DNA, 7 bp, Unknown
  misc_feature (1)..( 7): Matrix.003 file - promoters60/5664126
aacagaa

SEQ ID NO: 62726 - DNA, 6 bp, Unknown
  misc_feature (1)..( 6): Matrix.003 file - promoters60/5664126
tgtaat

SEQ ID NO: 62727 - DNA, 7 bp, Unknown
  misc_feature (1)..( 7): Matrix.003 file - promoters60/5664126
tttattt

SEQ ID NO: 62728 - DNA, 12 bp, Unknown
  misc_feature (1)..( 12): Matrix.003 file - promoters60/5664126
aaaagaaaaaac

SEQ ID NO: 62729 - DNA, 8 bp, Unknown
  misc_feature (1)..( 8): Matrix.003 file - promoters60/5664126
aatgttct

SEQ ID NO: 62730 - DNA, 8 bp, Unknown
  misc_feature (1)..( 8): Matrix.003 file - promoters60/5664126
taatttgt

SEQ ID NO: 62731 - DNA, 6 bp, Unknown
  misc_feature (1)..( 6): Matrix.003 file - promoters60/5664126
atgggc

SEQ ID NO: 62732 - DNA, 6 bp, Unknown
  misc_feature (1)..( 6): Matrix.003 file - promoters60/5664126
ggccca

SEQ ID NO: 62733 - DNA, 7 bp, Unknown
  misc_feature (1)..( 7): Matrix.003 file - promoters60/5664133
tcacaaa

SEQ ID NO: 62734 - DNA, 9 bp, Unknown
  misc_feature (1)..( 9): Matrix.003 file - promoters60/5664133
aattaagtt

SEQ ID NO: 62735 - DNA, 8 bp, Unknown
  misc_feature (1)..( 8): Matrix.003 file - promoters60/5664133
cacaaaac

SEQ ID NO: 62736 - DNA, 8 bp, Unknown
  misc_feature (1)..( 8): Matrix.003 file - promoters60/5664133
caaacaaa

SEQ ID NO: 62737 - DNA, 8 bp, Unknown
  misc_feature (1)..( 8): Matrix.003 file - promoters60/5664133
caaacata

SEQ ID NO: 62738 - DNA, 9 bp, Unknown
  misc_feature (1)..( 9): Matrix.003 file - promoters60/5664133
tcacaaaac

SEQ ID NO: 62739 - DNA, 9 bp, Unknown
  misc_feature (1)..( 9): Matrix.003 file - promoters60/5664133
ataaacatg

SEQ ID NO: 62740 - DNA, 11 bp, Unknown
  misc_feature (1)..( 11): Matrix.003 file - promoters60/5664141
ataaaaacaaa

SEQ ID NO: 62741 - DNA, 10 bp, Unknown
  misc_feature (1)..( 10): Matrix.003 file - promoters60/5664141
gatttgtttt

SEQ ID NO: 62742 - DNA, 11 bp, Unknown
  misc_feature (1)..( 11): Matrix.003 file - promoters60/5664141
aacaattaaaa

SEQ ID NO: 62743 - DNA, 12 bp, Unknown
  misc_feature (1)..( 12): Matrix.003 file - promoters60/5664141
atgaatttttaa

SEQ ID NO: 62744 - DNA, 13 bp, Unknown
  misc_feature (1)..( 13): Matrix.003 file - promoters60/5664141
atgtataaaaaca

SEQ ID NO: 62745 - DNA, 11 bp, Unknown
  misc_feature (1)..( 11): Matrix.003 file - promoters60/5664153
aagttatatat

SEQ ID NO: 62746 - DNA, 7 bp, Unknown
  misc_feature (1)..( 7): Matrix.003 file - promoters60/5664153
tttcaaa

SEQ ID NO: 62747 - DNA, 6 bp, Unknown
  misc_feature (1)..( 6): Matrix.003 file - promoters60/5664153
ttagtt

SEQ ID NO: 62748 - DNA, 10 bp, Unknown
  misc_feature (1)..( 10): Matrix.003 file - promoters60/5664153
gaaccaaagt

SEQ ID NO: 62749 - DNA, 7 bp, Unknown
  misc_feature (1)..( 7): Matrix.003 file - promoters60/5664153
aacacac

SEQ ID NO: 62750 - DNA, 6 bp, Unknown
  misc_feature (1)..( 6): Matrix.003 file - promoters60/5664153
aacatt

SEQ ID NO: 62751 - DNA, 8 bp, Unknown
  misc_feature (1)..( 8): Matrix.003 file - promoters60/5664153
gtgagttc

SEQ ID NO: 62752 - DNA, 7 bp, Unknown
  misc_feature (1)..( 7): Matrix.003 file - promoters60/5664153
ttaattt

SEQ ID NO: 62753 - DNA, 7 bp, Unknown
  misc_feature (1)..( 7): Matrix.003 file - promoters60/5664153
tgactct

SEQ ID NO: 62754 - DNA, 8 bp, Unknown
  misc_feature (1)..( 8): Matrix.003 file - promoters60/5664153
gtactaaa

SEQ ID NO: 62755 - DNA, 7 bp, Unknown
  misc_feature (1)..( 7): Matrix.003 file - promoters60/5664153
ttcgtat

SEQ ID NO: 62756 - DNA, 6 bp, Unknown
  misc_feature (1)..( 6): Matrix.003 file - promoters60/5664153
cagaag

SEQ ID NO: 62757 - DNA, 7 bp, Unknown
  misc_feature (1)..( 7): Matrix.003 file - promoters60/5664153
aagaaat

SEQ ID NO: 62758 - DNA, 7 bp, Unknown
  misc_feature (1)..( 7): Matrix.003 file - promoters60/5664153
ccaaaaa

SEQ ID NO: 62759 - DNA, 7 bp, Unknown
  misc_feature (1)..( 7): Matrix.003 file - promoters60/5664170
cataatt

SEQ ID NO: 62760 - DNA, 7 bp, Unknown
  misc_feature (1)..( 7): Matrix.003 file - promoters60/5664170
atttttg

SEQ ID NO: 62761 - DNA, 9 bp, Unknown
  misc_feature (1)..( 9): Matrix.003 file - promoters60/5664182
cattttctt

SEQ ID NO: 62762 - DNA, 7 bp, Unknown
  misc_feature (1)..( 7): Matrix.003 file - promoters60/5664182
ttgggct

SEQ ID NO: 62763 - DNA, 8 bp, Unknown
  misc_feature (1)..( 8): Matrix.003 file - promoters60/5664216
taaaacaa

SEQ ID NO: 62764 - DNA, 8 bp, Unknown
  misc_feature (1)..( 8): Matrix.003 file - promoters60/5664216
tataaata

SEQ ID NO: 62765 - DNA, 9 bp, Unknown
  misc_feature (1)..( 9): Matrix.003 file - promoters60/5664222
ttggtcaaa

SEQ ID NO: 62766 - DNA, 7 bp, Unknown
  misc_feature (1)..( 7): Matrix.003 file - promoters60/5664222
aaaccaa

SEQ ID NO: 62767 - DNA, 9 bp, Unknown
  misc_feature (1)..( 9): Matrix.003 file - promoters60/5664222
agaaccaaa

SEQ ID NO: 62768 - DNA, 7 bp, Unknown
  misc_feature (1)..( 7): Matrix.003 file - promoters60/5664222
caaacac

SEQ ID NO: 62769 - DNA, 6 bp, Unknown
  misc_feature (1)..( 6): Matrix.003 file - promoters60/5664222
tatcta

SEQ ID NO: 62770 - DNA, 8 bp, Unknown
  misc_feature (1)..( 8): Matrix.003 file - promoters60/5664222
gaaactca

SEQ ID NO: 62771 - DNA, 9 bp, Unknown
  misc_feature (1)..( 9): Matrix.003 file - promoters60/5664222
attcacttt

SEQ ID NO: 62772 - DNA, 8 bp, Unknown
  misc_feature (1)..( 8): Matrix.003 file - promoters60/5664222
acccgttt

SEQ ID NO: 62773 - DNA, 7 bp, Unknown
  misc_feature (1)..( 7): Matrix.003 file - promoters60/5664222
tcataat

SEQ ID NO: 62774 - DNA, 6 bp, Unknown
  misc_feature (1)..( 6): Matrix.003 file - promoters60/5664222
attgtt

SEQ ID NO: 62775 - DNA, 9 bp, Unknown
  misc_feature (1)..( 9): Matrix.003 file - promoters60/5664263
tgaatgatt

SEQ ID NO: 62776 - DNA, 7 bp, Unknown
  misc_feature (1)..( 7): Matrix.003 file - promoters60/5664268
gagacga

SEQ ID NO: 62777 - DNA, 7 bp, Unknown
  misc_feature (1)..( 7): Matrix.003 file - promoters60/5664268
gtaacat

SEQ ID NO: 62778 - DNA, 7 bp, Unknown
  misc_feature (1)..( 7): Matrix.003 file - promoters60/5664268
aacgatg

SEQ ID NO: 62779 - DNA, 8 bp, Unknown
  misc_feature (1)..( 8): Matrix.003 file - promoters60/5664268
gtgtgaac

SEQ ID NO: 62780 - DNA, 7 bp, Unknown
  misc_feature (1)..( 7): Matrix.003 file - promoters60/5664268
ctatatt

SEQ ID NO: 62781 - DNA, 9 bp, Unknown
  misc_feature (1)..( 9): Matrix.003 file - promoters60/5664268
ataaaccaa

SEQ ID NO: 62782 - DNA, 6 bp, Unknown
  misc_feature (1)..( 6): Matrix.003 file - promoters60/5664268
atttaa

SEQ ID NO: 62783 - DNA, 6 bp, Unknown
  misc_feature (1)..( 6): Matrix.003 file - promoters60/5664268
gatttg

SEQ ID NO: 62784 - DNA, 7 bp, Unknown
  misc_feature (1)..( 7): Matrix.003 file - promoters60/5664268
caaatcg

SEQ ID NO: 62785 - DNA, 9 bp, Unknown
  misc_feature (1)..( 9): Matrix.003 file - promoters60/5664268
gataccaac

SEQ ID NO: 62786 - DNA, 6 bp, Unknown
  misc_feature (1)..( 6): Matrix.003 file - promoters60/5664268
gaacta

SEQ ID NO: 62787 - DNA, 7 bp, Unknown
  misc_feature (1)..( 7): Matrix.003 file - promoters60/5664268
tcataat

SEQ ID NO: 62788 - DNA, 6 bp, Unknown
  misc_feature (1)..( 6): Matrix.003 file - promoters60/5664268
attgtt

SEQ ID NO: 62789 - DNA, 6 bp, Unknown
  misc_feature (1)..( 6): Matrix.003 file - promoters60/5664290
aatttt

SEQ ID NO: 62790 - DNA, 6 bp, Unknown
  misc_feature (1)..( 6): Matrix.003 file - promoters60/5664290
aacgaa

SEQ ID NO: 62791 - DNA, 8 bp, Unknown
  misc_feature (1)..( 8): Matrix.003 file - promoters60/5664290
tatgcttt

SEQ ID NO: 62792 - DNA, 8 bp, Unknown
  misc_feature (1)..( 8): Matrix.003 file - promoters60/5664290
ttaccaaa

SEQ ID NO: 62793 - DNA, 7 bp, Unknown
  misc_feature (1)..( 7): Matrix.003 file - promoters60/5664290
attctca

SEQ ID NO: 62794 - DNA, 8 bp, Unknown
  misc_feature (1)..( 8): Matrix.003 file - promoters60/5664290
tggaatcc

SEQ ID NO: 62795 - DNA, 7 bp, Unknown
  misc_feature (1)..( 7): Matrix.003 file - promoters60/5664290
atcatgc

SEQ ID NO: 62796 - DNA, 8 bp, Unknown
  misc_feature (1)..( 8): Matrix.003 file - promoters60/5664294
aaaatcga

SEQ ID NO: 62797 - DNA, 8 bp, Unknown
  misc_feature (1)..( 8): Matrix.003 file - promoters60/5664294
gataaaaa

SEQ ID NO: 62798 - DNA, 10 bp, Unknown
  misc_feature (1)..( 10): Matrix.003 file - promoters60/5664294
actttataat

SEQ ID NO: 62799 - DNA, 10 bp, Unknown
  misc_feature (1)..( 10): Matrix.003 file - promoters60/5664298
tacaaaaata

SEQ ID NO: 62800 - DNA, 7 bp, Unknown
  misc_feature (1)..( 7): Matrix.003 file - promoters60/5664302
tggttat

SEQ ID NO: 62801 - DNA, 8 bp, Unknown
  misc_feature (1)..( 8): Matrix.003 file - promoters60/5664302
caaaagga

SEQ ID NO: 62802 - DNA, 10 bp, Unknown
  misc_feature (1)..( 10): Matrix.003 file - promoters60/5664302
agcaggaaga

SEQ ID NO: 62803 - DNA, 7 bp, Unknown
  misc_feature (1)..( 7): Matrix.003 file - promoters60/5664302
tataaat

SEQ ID NO: 62804 - DNA, 7 bp, Unknown
  misc_feature (1)..( 7): Matrix.003 file - promoters60/5664302
ttggaaa

SEQ ID NO: 62805 - DNA, 6 bp, Unknown
  misc_feature (1)..( 6): Matrix.003 file - promoters60/5664302
aaataa

SEQ ID NO: 62806 - DNA, 6 bp, Unknown
  misc_feature (1)..( 6): Matrix.003 file - promoters60/5664302
ttaaaa

SEQ ID NO: 62807 - DNA, 10 bp, Unknown
  misc_feature (1)..( 10): Matrix.003 file - promoters60/5664302
accttaaaaa

SEQ ID NO: 62808 - DNA, 7 bp, Unknown
  misc_feature (1)..( 7): Matrix.003 file - promoters60/5664302
aaaacct

SEQ ID NO: 62809 - DNA, 6 bp, Unknown
  misc_feature (1)..( 6): Matrix.003 file - promoters60/5664302
ttaaaa

SEQ ID NO: 62810 - DNA, 8 bp, Unknown
  misc_feature (1)..( 8): Matrix.003 file - promoters60/5664302
aaaataaa

SEQ ID NO: 62811 - DNA, 7 bp, Unknown
  misc_feature (1)..( 7): Matrix.003 file - promoters60/5664302
aaaccta

SEQ ID NO: 62812 - DNA, 11 bp, Unknown
  misc_feature (1)..( 11): Matrix.003 file - promoters60/5664302
ataaaccaaaa

SEQ ID NO: 62813 - DNA, 6 bp, Unknown
  misc_feature (1)..( 6): Matrix.003 file - promoters60/5664302
aaaata

SEQ ID NO: 62814 - DNA, 6 bp, Unknown
  misc_feature (1)..( 6): Matrix.003 file - promoters60/5664302
ccaaaa

SEQ ID NO: 62815 - DNA, 6 bp, Unknown
  misc_feature (1)..( 6): Matrix.003 file - promoters60/5664302
ccaaaa

SEQ ID NO: 62816 - DNA, 7 bp, Unknown
  misc_feature (1)..( 7): Matrix.003 file - promoters60/5664302
aaaatca

SEQ ID NO: 62817 - DNA, 7 bp, Unknown
  misc_feature (1)..( 7): Matrix.003 file - promoters60/5664302
tcataaa

SEQ ID NO: 62818 - DNA, 10 bp, Unknown
  misc_feature (1)..( 10): Matrix.003 file - promoters60/5664302
caaaaattca

SEQ ID NO: 62819 - DNA, 8 bp, Unknown
  misc_feature (1)..( 8): Matrix.003 file - promoters60/5664302
tgtaatat

SEQ ID NO: 62820 - DNA, 7 bp, Unknown
  misc_feature (1)..( 7): Matrix.003 file - promoters60/5664302
aattggt

SEQ ID NO: 62821 - DNA, 6 bp, Unknown
  misc_feature (1)..( 6): Matrix.003 file - promoters60/5664302
ggttat

SEQ ID NO: 62822 - DNA, 7 bp, Unknown
  misc_feature (1)..( 7): Matrix.003 file - promoters60/5664302
ggaagat

SEQ ID NO: 62823 - DNA, 6 bp, Unknown
  misc_feature (1)..( 6): Matrix.003 file - promoters60/5664311
aaaaag

SEQ ID NO: 62824 - DNA, 8 bp, Unknown
  misc_feature (1)..( 8): Matrix.003 file - promoters60/5664311
caaaacaa

SEQ ID NO: 62825 - DNA, 14 bp, Unknown
  misc_feature (1)..( 14): Matrix.003 file - promoters60/5664311
actatcaaagaaag

SEQ ID NO: 62826 - DNA, 8 bp, Unknown
  misc_feature (1)..( 8): Matrix.003 file - promoters60/5664329
aaataaaa

SEQ ID NO: 62827 - DNA, 9 bp, Unknown
  misc_feature (1)..( 9): Matrix.003 file - promoters60/5664329
gtctctttc

SEQ ID NO: 62828 - DNA, 7 bp, Unknown
  misc_feature (1)..( 7): Matrix.003 file - promoters60/5664329
tttttgt

SEQ ID NO: 62829 - DNA, 6 bp, Unknown
  misc_feature (1)..( 6): Matrix.003 file - promoters60/5664329
aaaaaa

SEQ ID NO: 62830 - DNA, 6 bp, Unknown
  misc_feature (1)..( 6): Matrix.003 file - promoters60/5664329
taaaaa

SEQ ID NO: 62831 - DNA, 9 bp, Unknown
  misc_feature (1)..( 9): Matrix.003 file - promoters60/5664329
acaaatttt

SEQ ID NO: 62832 - DNA, 10 bp, Unknown
  misc_feature (1)..( 10): Matrix.003 file - promoters60/5664329
aaaaagaaat

SEQ ID NO: 62833 - DNA, 8 bp, Unknown
  misc_feature (1)..( 8): Matrix.003 file - promoters60/5664329
attacaag

SEQ ID NO: 62834 - DNA, 7 bp, Unknown
  misc_feature (1)..( 7): Matrix.003 file - promoters60/5664329
aaacaaa

SEQ ID NO: 62835 - DNA, 6 bp, Unknown
  misc_feature (1)..( 6): Matrix.003 file - promoters60/5664329
tgtaca

SEQ ID NO: 62836 - DNA, 6 bp, Unknown
  misc_feature (1)..( 6): Matrix.003 file - promoters60/5664329
ataaaa

SEQ ID NO: 62837 - DNA, 8 bp, Unknown
  misc_feature (1)..( 8): Matrix.003 file - promoters60/5664329
agatatct

SEQ ID NO: 62838 - DNA, 8 bp, Unknown
  misc_feature (1)..( 8): Matrix.003 file - promoters60/5664329
tttaatag

SEQ ID NO: 62839 - DNA, 9 bp, Unknown
  misc_feature (1)..( 9): Matrix.003 file - promoters60/5664329
atataataa

SEQ ID NO: 62840 - DNA, 6 bp, Unknown
  misc_feature (1)..( 6): Matrix.003 file - promoters60/5664329
ttttaa

SEQ ID NO: 62841 - DNA, 6 bp, Unknown
  misc_feature (1)..( 6): Matrix.003 file - promoters60/5664329
cttcca

SEQ ID NO: 62842 - DNA, 6 bp, Unknown
  misc_feature (1)..( 6): Matrix.003 file - promoters60/5664329
aaaaat

SEQ ID NO: 62843 - DNA, 7 bp, Unknown
  misc_feature (1)..( 7): Matrix.003 file - promoters60/5664341
ttccctt

SEQ ID NO: 62844 - DNA, 6 bp, Unknown
  misc_feature (1)..( 6): Matrix.003 file - promoters60/5664341
ctttct

SEQ ID NO: 62845 - DNA, 6 bp, Unknown
  misc_feature (1)..( 6): Matrix.003 file - promoters60/5664341
ttctct

SEQ ID NO: 62846 - DNA, 6 bp, Unknown
  misc_feature (1)..( 6): Matrix.003 file - promoters60/5664341
ttctat

SEQ ID NO: 62847 - DNA, 7 bp, Unknown
  misc_feature (1)..( 7): Matrix.003 file - promoters60/5664341
tatctat

SEQ ID NO: 62848 - DNA, 7 bp, Unknown
  misc_feature (1)..( 7): Matrix.003 file - promoters60/5664341
atagtgt

SEQ ID NO: 62849 - DNA, 6 bp, Unknown
  misc_feature (1)..( 6): Matrix.003 file - promoters60/5664341
aacttg

SEQ ID NO: 62850 - DNA, 6 bp, Unknown
  misc_feature (1)..( 6): Matrix.003 file - promoters60/5664341
tcatat

SEQ ID NO: 62851 - DNA, 7 bp, Unknown
  misc_feature (1)..( 7): Matrix.003 file - promoters60/5664341
ttacgta

SEQ ID NO: 62852 - DNA, 7 bp, Unknown
  misc_feature (1)..( 7): Matrix.003 file - promoters60/5664341
ctgatta

SEQ ID NO: 62853 - DNA, 6 bp, Unknown
  misc_feature (1)..( 6): Matrix.003 file - promoters60/5664341
atcatt

SEQ ID NO: 62854 - DNA, 11 bp, Unknown
  misc_feature (1)..( 11): Matrix.003 file - promoters60/5664341
ttactgaagtt

SEQ ID NO: 62855 - DNA, 7 bp, Unknown
  misc_feature (1)..( 7): Matrix.003 file - promoters60/5664341
tttccat

SEQ ID NO: 62856 - DNA, 8 bp, Unknown
  misc_feature (1)..( 8): Matrix.003 file - promoters60/5664341
atctcgtg

SEQ ID NO: 62857 - DNA, 10 bp, Unknown
  misc_feature (1)..( 10): Matrix.003 file - promoters60/5664362
gaatccaaag

SEQ ID NO: 62858 - DNA, 8 bp, Unknown
  misc_feature (1)..( 8): Matrix.003 file - promoters60/5664402
aatttttt

SEQ ID NO: 62859 - DNA, 7 bp, Unknown
  misc_feature (1)..( 7): Matrix.003 file - promoters60/5664402
tattttt

SEQ ID NO: 62860 - DNA, 7 bp, Unknown
  misc_feature (1)..( 7): Matrix.003 file - promoters60/5664402
ccaaatt

SEQ ID NO: 62861 - DNA, 6 bp, Unknown
  misc_feature (1)..( 6): Matrix.003 file - promoters60/5664402
gaaaca

SEQ ID NO: 62862 - DNA, 6 bp, Unknown
  misc_feature (1)..( 6): Matrix.003 file - promoters60/5664402
acaaac

SEQ ID NO: 62863 - DNA, 8 bp, Unknown
  misc_feature (1)..( 8): Matrix.003 file - promoters60/5664402
aaaaaaaa

SEQ ID NO: 62864 - DNA, 12 bp, Unknown
  misc_feature (1)..( 12): Matrix.003 file - promoters60/5664402
aaaattaaattt

SEQ ID NO: 62865 - DNA, 6 bp, Unknown
  misc_feature (1)..( 6): Matrix.003 file - promoters60/5664402
tgaaaa

SEQ ID NO: 62866 - DNA, 8 bp, Unknown
  misc_feature (1)..( 8): Matrix.003 file - promoters60/5664402
acgtctct

SEQ ID NO: 62867 - DNA, 7 bp, Unknown
  misc_feature (1)..( 7): Matrix.003 file - promoters60/5664402
tcatgtt

SEQ ID NO: 62868 - DNA, 7 bp, Unknown
  misc_feature (1)..( 7): Matrix.003 file - promoters60/5664402
aaaactt

SEQ ID NO: 62869 - DNA, 7 bp, Unknown
  misc_feature (1)..( 7): Matrix.003 file - promoters60/5664402
ccactat

SEQ ID NO: 62870 - DNA, 6 bp, Unknown
  misc_feature (1)..( 6): Matrix.003 file - promoters60/5664402
aaattg

SEQ ID NO: 62871 - DNA, 7 bp, Unknown
  misc_feature (1)..( 7): Matrix.003 file - promoters60/5664402
agaagaa

SEQ ID NO: 62872 - DNA, 8 bp, Unknown
  misc_feature (1)..( 8): Matrix.003 file - promoters60/5664402
tttctttt

SEQ ID NO: 62873 - DNA, 6 bp, Unknown
  misc_feature (1)..( 6): Matrix.003 file - promoters60/5664402
tcacca

SEQ ID NO: 62874 - DNA, 7 bp, Unknown
  misc_feature (1)..( 7): Matrix.003 file - promoters60/5664402
tttgagc

SEQ ID NO: 62875 - DNA, 8 bp, Unknown
  misc_feature (1)..( 8): Matrix.003 file - promoters60/5664402
atatacta

SEQ ID NO: 62876 - DNA, 7 bp, Unknown
  misc_feature (1)..( 7): Matrix.003 file - promoters60/5664402
ggtctga

SEQ ID NO: 62877 - DNA, 8 bp, Unknown
  misc_feature (1)..( 8): Matrix.003 file - promoters60/5664465
attaattc

SEQ ID NO: 62878 - DNA, 9 bp, Unknown
  misc_feature (1)..( 9): Matrix.003 file - promoters60/5664465
ataaaaaaa

SEQ ID NO: 62879 - DNA, 10 bp, Unknown
  misc_feature (1)..( 10): Matrix.003 file - promoters60/5664465
attaattgta

SEQ ID NO: 62880 - DNA, 11 bp, Unknown
  misc_feature (1)..( 11): Matrix.003 file - promoters60/5664465
cagagacagca

SEQ ID NO: 62881 - DNA, 10 bp, Unknown
  misc_feature (1)..( 10): Matrix.003 file - promoters60/5664465
caatattata

SEQ ID NO: 62882 - DNA, 8 bp, Unknown
  misc_feature (1)..( 8): Matrix.003 file - promoters60/5664480
taaaatat

SEQ ID NO: 62883 - DNA, 9 bp, Unknown
  misc_feature (1)..( 9): Matrix.003 file - promoters60/5664480
ttatttgga

SEQ ID NO: 62884 - DNA, 8 bp, Unknown
  misc_feature (1)..( 8): Matrix.003 file - promoters60/5664480
atctagtt

SEQ ID NO: 62885 - DNA, 7 bp, Unknown
  misc_feature (1)..( 7): Matrix.003 file - promoters60/5664480
tataaat

SEQ ID NO: 62886 - DNA, 11 bp, Unknown
  misc_feature (1)..( 11): Matrix.003 file - promoters60/5664480
cgaaactggtc

SEQ ID NO: 62887 - DNA, 8 bp, Unknown
  misc_feature (1)..( 8): Matrix.003 file - promoters60/5664480
gaactcat

SEQ ID NO: 62888 - DNA, 9 bp, Unknown
  misc_feature (1)..( 9): Matrix.003 file - promoters60/5664480
ttaaatgaa

SEQ ID NO: 62889 - DNA, 7 bp, Unknown
  misc_feature (1)..( 7): Matrix.003 file - promoters60/5664480
agaagaa

SEQ ID NO: 62890 - DNA, 6 bp, Unknown
  misc_feature (1)..( 6): Matrix.003 file - promoters60/5664480
gtgtaa

SEQ ID NO: 62891 - DNA, 9 bp, Unknown
  misc_feature (1)..( 9): Matrix.003 file - promoters60/5664480
aaacaaaaa

SEQ ID NO: 62892 - DNA, 7 bp, Unknown
  misc_feature (1)..( 7): Matrix.003 file - promoters60/5664480
ctaatct

SEQ ID NO: 62893 - DNA, 6 bp, Unknown
  misc_feature (1)..( 6): Matrix.003 file - promoters60/5664480
aacaga

SEQ ID NO: 62894 - DNA, 6 bp, Unknown
  misc_feature (1)..( 6): Matrix.003 file - promoters60/5664480
agcaat

SEQ ID NO: 62895 - DNA, 9 bp, Unknown
  misc_feature (1)..( 9): Matrix.003 file - promoters60/5664488
ttacgaaag

SEQ ID NO: 62896 - DNA, 7 bp, Unknown
  misc_feature (1)..( 7): Matrix.003 file - promoters60/5664488
acaaaga

SEQ ID NO: 62897 - DNA, 7 bp, Unknown
  misc_feature (1)..( 7): Matrix.003 file - promoters60/5664488
tatatat

SEQ ID NO: 62898 - DNA, 6 bp, Unknown
  misc_feature (1)..( 6): Matrix.003 file - promoters60/5664488
tcataa

SEQ ID NO: 62899 - DNA, 6 bp, Unknown
  misc_feature (1)..( 6): Matrix.003 file - promoters60/5664488
catttc

SEQ ID NO: 62900 - DNA, 7 bp, Unknown
  misc_feature (1)..( 7): Matrix.003 file - promoters60/5664488
catatgt

SEQ ID NO: 62901 - DNA, 6 bp, Unknown
  misc_feature (1)..( 6): Matrix.003 file - promoters60/5664488
caagtc

SEQ ID NO: 62902 - DNA, 9 bp, Unknown
  misc_feature (1)..( 9): Matrix.003 file - promoters60/5664488
attaaatat

SEQ ID NO: 62903 - DNA, 7 bp, Unknown
  misc_feature (1)..( 7): Matrix.003 file - promoters60/5664488
gatacat

SEQ ID NO: 62904 - DNA, 8 bp, Unknown
  misc_feature (1)..( 8): Matrix.003 file - promoters60/5664488
gtcgatct

SEQ ID NO: 62905 - DNA, 6 bp, Unknown
  misc_feature (1)..( 6): Matrix.003 file - promoters60/5664488
taaact

SEQ ID NO: 62906 - DNA, 8 bp, Unknown
  misc_feature (1)..( 8): Matrix.003 file - promoters60/5664488
aatggtgt

SEQ ID NO: 62907 - DNA, 6 bp, Unknown
  misc_feature (1)..( 6): Matrix.003 file - promoters60/5664488
aatgtt

SEQ ID NO: 62908 - DNA, 7 bp, Unknown
  misc_feature (1)..( 7): Matrix.003 file - promoters60/5664488
tgtacat

SEQ ID NO: 62909 - DNA, 6 bp, Unknown
  misc_feature (1)..( 6): Matrix.003 file - promoters60/5664488
tatgag

SEQ ID NO: 62910 - DNA, 8 bp, Unknown
  misc_feature (1)..( 8): Matrix.003 file - promoters60/5664488
gatgtttc

SEQ ID NO: 62911 - DNA, 9 bp, Unknown
  misc_feature (1)..( 9): Matrix.003 file - promoters60/5664517
tttatgaaa

SEQ ID NO: 62912 - DNA, 10 bp, Unknown
  misc_feature (1)..( 10): Matrix.003 file - promoters60/5664517
taaaattaaa

SEQ ID NO: 62913 - DNA, 6 bp, Unknown
  misc_feature (1)..( 6): Matrix.003 file - promoters60/5664633
atttta

SEQ ID NO: 62914 - DNA, 10 bp, Unknown
  misc_feature (1)..( 10): Matrix.003 file - promoters60/5664633
aaaaggaaaa

SEQ ID NO: 62915 - DNA, 8 bp, Unknown
  misc_feature (1)..( 8): Matrix.003 file - promoters60/5664633
gcaaaaat

SEQ ID NO: 62916 - DNA, 6 bp, Unknown
  misc_feature (1)..( 6): Matrix.003 file - promoters60/5664633
tatttt

SEQ ID NO: 62917 - DNA, 6 bp, Unknown
  misc_feature (1)..( 6): Matrix.003 file - promoters60/5664633
ttttca

SEQ ID NO: 62918 - DNA, 6 bp, Unknown
  misc_feature (1)..( 6): Matrix.003 file - promoters60/5664633
tttttt

SEQ ID NO: 62919 - DNA, 8 bp, Unknown
  misc_feature (1)..( 8): Matrix.003 file - promoters60/5664633
attaatta

SEQ ID NO: 62920 - DNA, 6 bp, Unknown
  misc_feature (1)..( 6): Matrix.003 file - promoters60/5664633
tttttc

SEQ ID NO: 62921 - DNA, 9 bp, Unknown
  misc_feature (1)..( 9): Matrix.003 file - promoters60/5664633
aatcactat

SEQ ID NO: 62922 - DNA, 8 bp, Unknown
  misc_feature (1)..( 8): Matrix.003 file - promoters60/5664633
tatatgtt

SEQ ID NO: 62923 - DNA, 8 bp, Unknown
  misc_feature (1)..( 8): Matrix.003 file - promoters60/5664633
tttcattt

SEQ ID NO: 62924 - DNA, 8 bp, Unknown
  misc_feature (1)..( 8): Matrix.003 file - promoters60/5664633
aaaattaa

SEQ ID NO: 62925 - DNA, 8 bp, Unknown
  misc_feature (1)..( 8): Matrix.003 file - promoters60/5664633
tacgaaaa

SEQ ID NO: 62926 - DNA, 6 bp, Unknown
  misc_feature (1)..( 6): Matrix.003 file - promoters60/5664633
atttta

SEQ ID NO: 62927 - DNA, 7 bp, Unknown
  misc_feature (1)..( 7): Matrix.003 file - promoters60/5664633
agaataa

SEQ ID NO: 62928 - DNA, 6 bp, Unknown
  misc_feature (1)..( 6): Matrix.003 file - promoters60/5664633
aagttg

SEQ ID NO: 62929 - DNA, 7 bp, Unknown
  misc_feature (1)..( 7): Matrix.003 file - promoters60/5664633
tttgaaa

SEQ ID NO: 62930 - DNA, 7 bp, Unknown
  misc_feature (1)..( 7): Matrix.003 file - promoters60/5664633
taagaaa

SEQ ID NO: 62931 - DNA, 7 bp, Unknown
  misc_feature (1)..( 7): Matrix.003 file - promoters60/5664633
ttgggaa

SEQ ID NO: 62932 - DNA, 13 bp, Unknown
  misc_feature (1)..( 13): Matrix.003 file - promoters60/5664633
tccgatttatttt

SEQ ID NO: 62933 - DNA, 6 bp, Unknown
  misc_feature (1)..( 6): Matrix.003 file - promoters60/5664633
agtttt

SEQ ID NO: 62934 - DNA, 7 bp, Unknown
  misc_feature (1)..( 7): Matrix.003 file - promoters60/5664633
gaagaaa

SEQ ID NO: 62935 - DNA, 6 bp, Unknown
  misc_feature (1)..( 6): Matrix.003 file - promoters60/5664633
ttgaat

SEQ ID NO: 62936 - DNA, 7 bp, Unknown
  misc_feature (1)..( 7): Matrix.003 file - promoters60/5664633
aaaatta

SEQ ID NO: 62937 - DNA, 7 bp, Unknown
  misc_feature (1)..( 7): Matrix.003 file - promoters60/5664633
tttccgc

SEQ ID NO: 62938 - DNA, 9 bp, Unknown
  misc_feature (1)..( 9): Matrix.003 file - promoters60/5664633
aaaaaaaaa

SEQ ID NO: 62939 - DNA, 6 bp, Unknown
  misc_feature (1)..( 6): Matrix.003 file - promoters60/5664633
aaatca

SEQ ID NO: 62940 - DNA, 9 bp, Unknown
  misc_feature (1)..( 9): Matrix.003 file - promoters60/5664657
aaaattgaa

SEQ ID NO: 62941 - DNA, 8 bp, Unknown
  misc_feature (1)..( 8): Matrix.003 file - promoters60/5664657
ctttaaaa

SEQ ID NO: 62942 - DNA, 8 bp, Unknown
  misc_feature (1)..( 8): Matrix.003 file - promoters60/5664657
aaattaca

SEQ ID NO: 62943 - DNA, 11 bp, Unknown
  misc_feature (1)..( 11): Matrix.003 file - promoters60/5664657
atttgtttgaa

SEQ ID NO: 62944 - DNA, 12 bp, Unknown
  misc_feature (1)..( 12): Matrix.003 file - promoters60/5664703
ctttttgtatat

SEQ ID NO: 62945 - DNA, 6 bp, Unknown
  misc_feature (1)..( 6): Matrix.003 file - promoters60/5664703
attgaa

SEQ ID NO: 62946 - DNA, 6 bp, Unknown
  misc_feature (1)..( 6): Matrix.003 file - promoters60/5664703
tgaaca

SEQ ID NO: 62947 - DNA, 7 bp, Unknown
  misc_feature (1)..( 7): Matrix.003 file - promoters60/5664703
tctacga

SEQ ID NO: 62948 - DNA, 7 bp, Unknown
  misc_feature (1)..( 7): Matrix.003 file - promoters60/5664703
aggattt

SEQ ID NO: 62949 - DNA, 10 bp, Unknown
  misc_feature (1)..( 10): Matrix.003 file - promoters60/5664703
gcaggagatg

SEQ ID NO: 62950 - DNA, 8 bp, Unknown
  misc_feature (1)..( 8): Matrix.003 file - promoters60/5664703
tctgaatt

SEQ ID NO: 62951 - DNA, 6 bp, Unknown
  misc_feature (1)..( 6): Matrix.003 file - promoters60/5664703
aatcta

SEQ ID NO: 62952 - DNA, 6 bp, Unknown
  misc_feature (1)..( 6): Matrix.003 file - promoters60/5664703
catcaa

SEQ ID NO: 62953 - DNA, 8 bp, Unknown
  misc_feature (1)..( 8): Matrix.003 file - promoters60/5664703
gattcgtg

SEQ ID NO: 62954 - DNA, 7 bp, Unknown
  misc_feature (1)..( 7): Matrix.003 file - promoters60/5664703
cacggtc

SEQ ID NO: 62955 - DNA, 6 bp, Unknown
  misc_feature (1)..( 6): Matrix.003 file - promoters60/5664703
ggttta

SEQ ID NO: 62956 - DNA, 6 bp, Unknown
  misc_feature (1)..( 6): Matrix.003 file - promoters60/5664703
ttgact

SEQ ID NO: 62957 - DNA, 6 bp, Unknown
  misc_feature (1)..( 6): Matrix.003 file - promoters60/5664703
ggctgt

SEQ ID NO: 62958 - DNA, 8 bp, Unknown
  misc_feature (1)..( 8): Matrix.003 file - promoters60/5664734
aaattagt

SEQ ID NO: 62959 - DNA, 6 bp, Unknown
  misc_feature (1)..( 6): Matrix.003 file - promoters60/5664734
atctta

SEQ ID NO: 62960 - DNA, 6 bp, Unknown
  misc_feature (1)..( 6): Matrix.003 file - promoters60/5664734
tgatgt

SEQ ID NO: 62961 - DNA, 9 bp, Unknown
  misc_feature (1)..( 9): Matrix.003 file - promoters60/5664734
gtgagagga

SEQ ID NO: 62962 - DNA, 6 bp, Unknown
  misc_feature (1)..( 6): Matrix.003 file - promoters60/5664734
cggtga

SEQ ID NO: 62963 - DNA, 6 bp, Unknown
  misc_feature (1)..( 6): Matrix.003 file - promoters60/5664734
cggtgg

SEQ ID NO: 62964 - DNA, 6 bp, Unknown
  misc_feature (1)..( 6): Matrix.003 file - promoters60/5664734
gagaaa

SEQ ID NO: 62965 - DNA, 6 bp, Unknown
  misc_feature (1)..( 6): Matrix.003 file - promoters60/5664734
aaacta

SEQ ID NO: 62966 - DNA, 6 bp, Unknown
  misc_feature (1)..( 6): Matrix.003 file - promoters60/5664734
atgatc

SEQ ID NO: 62967 - DNA, 7 bp, Unknown
  misc_feature (1)..( 7): Matrix.003 file - promoters60/5664734
caaatta

SEQ ID NO: 62968 - DNA, 6 bp, Unknown
  misc_feature (1)..( 6): Matrix.003 file - promoters60/5664734
gacgtg

SEQ ID NO: 62969 - DNA, 6 bp, Unknown
  misc_feature (1)..( 6): Matrix.003 file - promoters60/5664806
atgaaa

SEQ ID NO: 62970 - DNA, 10 bp, Unknown
  misc_feature (1)..( 10): Matrix.003 file - promoters60/5664806
aaggaaaaaa

SEQ ID NO: 62971 - DNA, 7 bp, Unknown
  misc_feature (1)..( 7): Matrix.003 file - promoters60/5664806
aacatga

SEQ ID NO: 62972 - DNA, 11 bp, Unknown
  misc_feature (1)..( 11): Matrix.003 file - promoters60/5664806
accaagaaaac

SEQ ID NO: 62973 - DNA, 6 bp, Unknown
  misc_feature (1)..( 6): Matrix.003 file - promoters60/5664806
ttttca

SEQ ID NO: 62974 - DNA, 10 bp, Unknown
  misc_feature (1)..( 10): Matrix.003 file - promoters60/5664806
taatagcaat

SEQ ID NO: 62975 - DNA, 8 bp, Unknown
  misc_feature (1)..( 8): Matrix.003 file - promoters60/5664806
attattat

SEQ ID NO: 62976 - DNA, 7 bp, Unknown
  misc_feature (1)..( 7): Matrix.003 file - promoters60/5664806
ttgtgga

SEQ ID NO: 62977 - DNA, 11 bp, Unknown
  misc_feature (1)..( 11): Matrix.003 file - promoters60/5664806
tcttatttttt

SEQ ID NO: 62978 - DNA, 7 bp, Unknown
  misc_feature (1)..( 7): Matrix.003 file - promoters60/5664806
atgcatt

SEQ ID NO: 62979 - DNA, 7 bp, Unknown
  misc_feature (1)..( 7): Matrix.003 file - promoters60/5664806
aatgaac

SEQ ID NO: 62980 - DNA, 7 bp, Unknown
  misc_feature (1)..( 7): Matrix.003 file - promoters60/5664806
aaaagaa

SEQ ID NO: 62981 - DNA, 7 bp, Unknown
  misc_feature (1)..( 7): Matrix.003 file - promoters60/5664806
tttaatt

SEQ ID NO: 62982 - DNA, 7 bp, Unknown
  misc_feature (1)..( 7): Matrix.003 file - promoters60/5664806
ttggcta

SEQ ID NO: 62983 - DNA, 7 bp, Unknown
  misc_feature (1)..( 7): Matrix.003 file - promoters60/5664806
ataaata

SEQ ID NO: 62984 - DNA, 7 bp, Unknown
  misc_feature (1)..( 7): Matrix.003 file - promoters60/5664806
taatatt

SEQ ID NO: 62985 - DNA, 7 bp, Unknown
  misc_feature (1)..( 7): Matrix.003 file - promoters60/5664806
acaatat

SEQ ID NO: 62986 - DNA, 7 bp, Unknown
  misc_feature (1)..( 7): Matrix.003 file - promoters60/5664806
tgggttt

SEQ ID NO: 62987 - DNA, 8 bp, Unknown
  misc_feature (1)..( 8): Matrix.003 file - promoters60/5664806
acaactga

SEQ ID NO: 62988 - DNA, 6 bp, Unknown
  misc_feature (1)..( 6): Matrix.003 file - promoters60/5664806
tgtttt

SEQ ID NO: 62989 - DNA, 7 bp, Unknown
  misc_feature (1)..( 7): Matrix.003 file - promoters60/5664806
atgggag

SEQ ID NO: 62990 - DNA, 6 bp, Unknown
  misc_feature (1)..( 6): Matrix.003 file - promoters60/5664806
ctatct

SEQ ID NO: 62991 - DNA, 7 bp, Unknown
  misc_feature (1)..( 7): Matrix.003 file - promoters60/5664814
aaaaaaa

SEQ ID NO: 62992 - DNA, 11 bp, Unknown
  misc_feature (1)..( 11): Matrix.003 file - promoters60/5664814
attttcataaa

SEQ ID NO: 62993 - DNA, 10 bp, Unknown
  misc_feature (1)..( 10): Matrix.003 file - promoters60/5664814
agttaataaa

SEQ ID NO: 62994 - DNA, 9 bp, Unknown
  misc_feature (1)..( 9): Matrix.003 file - promoters60/5664814
aacaattga

SEQ ID NO: 62995 - DNA, 7 bp, Unknown
  misc_feature (1)..( 7): Matrix.003 file - promoters60/5664814
aaaaaag

SEQ ID NO: 62996 - DNA, 12 bp, Unknown
  misc_feature (1)..( 12): Matrix.003 file - promoters60/5664814
tctcaaaatcaa

SEQ ID NO: 62997 - DNA, 12 bp, Unknown
  misc_feature (1)..( 12): Matrix.003 file - promoters60/5664873
gtctcctataaa

SEQ ID NO: 62998 - DNA, 15 bp, Unknown
  misc_feature (1)..( 15): Matrix.003 file - promoters60/5664873
tataacccaaaatta

SEQ ID NO: 62999 - DNA, 8 bp, Unknown
  misc_feature (1)..( 8): Matrix.003 file - promoters60/5664942
cataacag

SEQ ID NO: 63000 - DNA, 6 bp, Unknown
  misc_feature (1)..( 6): Matrix.003 file - promoters60/5664942
aactta

SEQ ID NO: 63001 - DNA, 6 bp, Unknown
  misc_feature (1)..( 6): Matrix.003 file - promoters60/5664942
ctttct

SEQ ID NO: 63002 - DNA, 6 bp, Unknown
  misc_feature (1)..( 6): Matrix.003 file - promoters60/5664942
aaaatc

SEQ ID NO: 63003 - DNA, 6 bp, Unknown
  misc_feature (1)..( 6): Matrix.003 file - promoters60/5664942
aataat

SEQ ID NO: 63004 - DNA, 6 bp, Unknown
  misc_feature (1)..( 6): Matrix.003 file - promoters60/5664942
acatct

SEQ ID NO: 63005 - DNA, 6 bp, Unknown
  misc_feature (1)..( 6): Matrix.003 file - promoters60/5664942
tataag

SEQ ID NO: 63006 - DNA, 8 bp, Unknown
  misc_feature (1)..( 8): Matrix.003 file - promoters60/5664942
tacatttc

SEQ ID NO: 63007 - DNA, 7 bp, Unknown
  misc_feature (1)..( 7): Matrix.003 file - promoters60/5664942
atacata

SEQ ID NO: 63008 - DNA, 6 bp, Unknown
  misc_feature (1)..( 6): Matrix.003 file - promoters60/5664942
cttcat

SEQ ID NO: 63009 - DNA, 7 bp, Unknown
  misc_feature (1)..( 7): Matrix.003 file - promoters60/5664942
tttctat

SEQ ID NO: 63010 - DNA, 7 bp, Unknown
  misc_feature (1)..( 7): Matrix.003 file - promoters60/5665083
tcgacaa

SEQ ID NO: 63011 - DNA, 7 bp, Unknown
  misc_feature (1)..( 7): Matrix.003 file - promoters60/5665083
gttttta

SEQ ID NO: 63012 - DNA, 7 bp, Unknown
  misc_feature (1)..( 7): Matrix.003 file - promoters60/5665083
gaaacac

SEQ ID NO: 63013 - DNA, 8 bp, Unknown
  misc_feature (1)..( 8): Matrix.003 file - promoters60/5665083
tctctatt

SEQ ID NO: 63014 - DNA, 6 bp, Unknown
  misc_feature (1)..( 6): Matrix.003 file - promoters60/5665083
taaaaa

SEQ ID NO: 63015 - DNA, 8 bp, Unknown
  misc_feature (1)..( 8): Matrix.003 file - promoters60/5665083
tggactgt

SEQ ID NO: 63016 - DNA, 7 bp, Unknown
  misc_feature (1)..( 7): Matrix.003 file - promoters60/5665083
atcctat

SEQ ID NO: 63017 - DNA, 6 bp, Unknown
  misc_feature (1)..( 6): Matrix.003 file - promoters60/5665083
tgaacc

SEQ ID NO: 63018 - DNA, 6 bp, Unknown
  misc_feature (1)..( 6): Matrix.003 file - promoters60/5665083
ttacat

SEQ ID NO: 63019 - DNA, 7 bp, Unknown
  misc_feature (1)..( 7): Matrix.003 file - promoters60/5665083
gtgattt

SEQ ID NO: 63020 - DNA, 10 bp, Unknown
  misc_feature (1)..( 10): Matrix.003 file - promoters60/5665083
ttttgaatct

SEQ ID NO: 63021 - DNA, 7 bp, Unknown
  misc_feature (1)..( 7): Matrix.003 file - promoters60/5665083
tataatc

SEQ ID NO: 63022 - DNA, 6 bp, Unknown
  misc_feature (1)..( 6): Matrix.003 file - promoters60/5665083
atattg

SEQ ID NO: 63023 - DNA, 7 bp, Unknown
  misc_feature (1)..( 7): Matrix.003 file - promoters60/5665083
tatagtt

SEQ ID NO: 63024 - DNA, 11 bp, Unknown
  misc_feature (1)..( 11): Matrix.003 file - promoters60/5665083
aaacttcatct

SEQ ID NO: 63025 - DNA, 7 bp, Unknown
  misc_feature (1)..( 7): Matrix.003 file - promoters60/5665083
tatatgt

SEQ ID NO: 63026 - DNA, 7 bp, Unknown
  misc_feature (1)..( 7): Matrix.003 file - promoters60/5665083
taagatt

SEQ ID NO: 63027 - DNA, 7 bp, Unknown
  misc_feature (1)..( 7): Matrix.003 file - promoters60/5665083
tggatat

SEQ ID NO: 63028 - DNA, 15 bp, Unknown
  misc_feature (1)..( 15): Matrix.003 file - promoters60/5665140
gaaagttcaattaat

SEQ ID NO: 63029 - DNA, 11 bp, Unknown
  misc_feature (1)..( 11): Matrix.003 file - promoters60/5665140
tttaacataga

SEQ ID NO: 63030 - DNA, 10 bp, Unknown
  misc_feature (1)..( 10): Matrix.003 file - promoters60/5665140
attaaatgtt

SEQ ID NO: 63031 - DNA, 10 bp, Unknown
  misc_feature (1)..( 10): Matrix.003 file - promoters60/5665140
ttaaatgtta

SEQ ID NO: 63032 - DNA, 8 bp, Unknown
  misc_feature (1)..( 8): Matrix.003 file - promoters60/5665140
acaaaaaa

SEQ ID NO: 63033 - DNA, 8 bp, Unknown
  misc_feature (1)..( 8): Matrix.003 file - promoters60/5665140
aaaacaaa

SEQ ID NO: 63034 - DNA, 8 bp, Unknown
  misc_feature (1)..( 8): Matrix.003 file - promoters60/5665140
aataaata

SEQ ID NO: 63035 - DNA, 8 bp, Unknown
  misc_feature (1)..( 8): Matrix.003 file - promoters60/5665140
aaacatag

SEQ ID NO: 63036 - DNA, 13 bp, Unknown
  misc_feature (1)..( 13): Matrix.003 file - promoters60/5665140
aaaacaataaatt

SEQ ID NO: 63037 - DNA, 10 bp, Unknown
  misc_feature (1)..( 10): Matrix.003 file - promoters60/5665140
tataattacg

SEQ ID NO: 63038 - DNA, 10 bp, Unknown
  misc_feature (1)..( 10): Matrix.003 file - promoters60/5665140
catacaattc

SEQ ID NO: 63039 - DNA, 9 bp, Unknown
  misc_feature (1)..( 9): Matrix.003 file - promoters60/5665140
aatttaatt

SEQ ID NO: 63040 - DNA, 16 bp, Unknown
  misc_feature (1)..( 16): Matrix.003 file - promoters60/5665140
taatttaaatcataaa

SEQ ID NO: 63041 - DNA, 10 bp, Unknown
  misc_feature (1)..( 10): Matrix.003 file - promoters60/5665140
aaaaaacaat

SEQ ID NO: 63042 - DNA, 8 bp, Unknown
  misc_feature (1)..( 8): Matrix.003 file - promoters60/5665234
caaaaaaa

SEQ ID NO: 63043 - DNA, 10 bp, Unknown
  misc_feature (1)..( 10): Matrix.003 file - promoters60/5665283
ttttaaaaga

SEQ ID NO: 63044 - DNA, 7 bp, Unknown
  misc_feature (1)..( 7): Matrix.003 file - promoters60/5665283
caataat

SEQ ID NO: 63045 - DNA, 7 bp, Unknown
  misc_feature (1)..( 7): Matrix.003 file - promoters60/5665283
attattg

SEQ ID NO: 63046 - DNA, 7 bp, Unknown
  misc_feature (1)..( 7): Matrix.003 file - promoters60/5665283
cacaaag

SEQ ID NO: 63047 - DNA, 6 bp, Unknown
  misc_feature (1)..( 6): Matrix.003 file - promoters60/5665283
taccct

SEQ ID NO: 63048 - DNA, 10 bp, Unknown
  misc_feature (1)..( 10): Matrix.003 file - promoters60/5665283
attacttttt

SEQ ID NO: 63049 - DNA, 7 bp, Unknown
  misc_feature (1)..( 7): Matrix.003 file - promoters60/5665283
gatatat

SEQ ID NO: 63050 - DNA, 6 bp, Unknown
  misc_feature (1)..( 6): Matrix.003 file - promoters60/5665283
caaaag

SEQ ID NO: 63051 - DNA, 7 bp, Unknown
  misc_feature (1)..( 7): Matrix.003 file - promoters60/5665283
ttgagtt

SEQ ID NO: 63052 - DNA, 7 bp, Unknown
  misc_feature (1)..( 7): Matrix.003 file - promoters60/5665283
atagcta

SEQ ID NO: 63053 - DNA, 10 bp, Unknown
  misc_feature (1)..( 10): Matrix.003 file - promoters60/5665283
actatatata

SEQ ID NO: 63054 - DNA, 8 bp, Unknown
  misc_feature (1)..( 8): Matrix.003 file - promoters60/5665283
acatagga

SEQ ID NO: 63055 - DNA, 6 bp, Unknown
  misc_feature (1)..( 6): Matrix.003 file - promoters60/5665283
tatttt

SEQ ID NO: 63056 - DNA, 13 bp, Unknown
  misc_feature (1)..( 13): Matrix.003 file - promoters60/5665283
attggatacatat

SEQ ID NO: 63057 - DNA, 6 bp, Unknown
  misc_feature (1)..( 6): Matrix.003 file - promoters60/5665283
gaacat

SEQ ID NO: 63058 - DNA, 6 bp, Unknown
  misc_feature (1)..( 6): Matrix.003 file - promoters60/5665283
tttata

SEQ ID NO: 63059 - DNA, 8 bp, Unknown
  misc_feature (1)..( 8): Matrix.003 file - promoters60/5665283
aatcttta

SEQ ID NO: 63060 - DNA, 6 bp, Unknown
  misc_feature (1)..( 6): Matrix.003 file - promoters60/5665283
ttaata

SEQ ID NO: 63061 - DNA, 7 bp, Unknown
  misc_feature (1)..( 7): Matrix.003 file - promoters60/5665283
taacgct

SEQ ID NO: 63062 - DNA, 6 bp, Unknown
  misc_feature (1)..( 6): Matrix.003 file - promoters60/5665283
aacaac

SEQ ID NO: 63063 - DNA, 8 bp, Unknown
  misc_feature (1)..( 8): Matrix.003 file - promoters60/5665283
gtaataat

SEQ ID NO: 63064 - DNA, 7 bp, Unknown
  misc_feature (1)..( 7): Matrix.003 file - promoters60/5665314
aaacaaa

SEQ ID NO: 63065 - DNA, 7 bp, Unknown
  misc_feature (1)..( 7): Matrix.003 file - promoters60/5665314
aaaagaa

SEQ ID NO: 63066 - DNA, 6 bp, Unknown
  misc_feature (1)..( 6): Matrix.003 file - promoters60/5665314
gacaaa

SEQ ID NO: 63067 - DNA, 8 bp, Unknown
  misc_feature (1)..( 8): Matrix.003 file - promoters60/5665314
tttattat

SEQ ID NO: 63068 - DNA, 7 bp, Unknown
  misc_feature (1)..( 7): Matrix.003 file - promoters60/5665314
aacagaa

SEQ ID NO: 63069 - DNA, 8 bp, Unknown
  misc_feature (1)..( 8): Matrix.003 file - promoters60/5665314
ttttgagt

SEQ ID NO: 63070 - DNA, 7 bp, Unknown
  misc_feature (1)..( 7): Matrix.003 file - promoters60/5665314
tgtatct

SEQ ID NO: 63071 - DNA, 6 bp, Unknown
  misc_feature (1)..( 6): Matrix.003 file - promoters60/5665314
taataa

SEQ ID NO: 63072 - DNA, 8 bp, Unknown
  misc_feature (1)..( 8): Matrix.003 file - promoters60/5665314
taaaggag

SEQ ID NO: 63073 - DNA, 6 bp, Unknown
  misc_feature (1)..( 6): Matrix.003 file - promoters60/5665314
ttcctg

SEQ ID NO: 63074 - DNA, 10 bp, Unknown
  misc_feature (1)..( 10): Matrix.003 file - promoters60/5665314
gggtttatga

SEQ ID NO: 63075 - DNA, 8 bp, Unknown
  misc_feature (1)..( 8): Matrix.003 file - promoters60/5665314
tggaagaa

SEQ ID NO: 63076 - DNA, 6 bp, Unknown
  misc_feature (1)..( 6): Matrix.003 file - promoters60/5665314
acctgt

SEQ ID NO: 63077 - DNA, 6 bp, Unknown
  misc_feature (1)..( 6): Matrix.003 file - promoters60/5665314
cacaag

SEQ ID NO: 63078 - DNA, 7 bp, Unknown
  misc_feature (1)..( 7): Matrix.003 file - promoters60/5665314
gaagctt

SEQ ID NO: 63079 - DNA, 9 bp, Unknown
  misc_feature (1)..( 9): Matrix.003 file - promoters60/5665326
aatgaatat

SEQ ID NO: 63080 - DNA, 13 bp, Unknown
  misc_feature (1)..( 13): Matrix.003 file - promoters60/5665326
ttataataaatag

SEQ ID NO: 63081 - DNA, 8 bp, Unknown
  misc_feature (1)..( 8): Matrix.003 file - promoters60/5665326
aaatatat

SEQ ID NO: 63082 - DNA, 8 bp, Unknown
  misc_feature (1)..( 8): Matrix.003 file - promoters60/5665326
aaattaat

SEQ ID NO: 63083 - DNA, 9 bp, Unknown
  misc_feature (1)..( 9): Matrix.003 file - promoters60/5665326
ctttatata

SEQ ID NO: 63084 - DNA, 9 bp, Unknown
  misc_feature (1)..( 9): Matrix.003 file - promoters60/5665326
atactttac

SEQ ID NO: 63085 - DNA, 9 bp, Unknown
  misc_feature (1)..( 9): Matrix.003 file - promoters60/5665326
tttattgat

SEQ ID NO: 63086 - DNA, 9 bp, Unknown
  misc_feature (1)..( 9): Matrix.003 file - promoters60/5665326
aatttattt

SEQ ID NO: 63087 - DNA, 9 bp, Unknown
  misc_feature (1)..( 9): Matrix.003 file - promoters60/5665326
cattttttt

SEQ ID NO: 63088 - DNA, 8 bp, Unknown
  misc_feature (1)..( 8): Matrix.003 file - promoters60/5665343
ttttttta

SEQ ID NO: 63089 - DNA, 8 bp, Unknown
  misc_feature (1)..( 8): Matrix.003 file - promoters60/5665343
tttaagtt

SEQ ID NO: 63090 - DNA, 8 bp, Unknown
  misc_feature (1)..( 8): Matrix.003 file - promoters60/5665343
acttcttt

SEQ ID NO: 63091 - DNA, 7 bp, Unknown
  misc_feature (1)..( 7): Matrix.003 file - promoters60/5665343
ttgtttc

SEQ ID NO: 63092 - DNA, 13 bp, Unknown
  misc_feature (1)..( 13): Matrix.003 file - promoters60/5665343
ctaaaaactatga

SEQ ID NO: 63093 - DNA, 7 bp, Unknown
  misc_feature (1)..( 7): Matrix.003 file - promoters60/5665343
gaagaaa

SEQ ID NO: 63094 - DNA, 8 bp, Unknown
  misc_feature (1)..( 8): Matrix.003 file - promoters60/5665343
ttatttta

SEQ ID NO: 63095 - DNA, 7 bp, Unknown
  misc_feature (1)..( 7): Matrix.003 file - promoters60/5665351
gcatttc

SEQ ID NO: 63096 - DNA, 8 bp, Unknown
  misc_feature (1)..( 8): Matrix.003 file - promoters60/5665351
caaatgga

SEQ ID NO: 63097 - DNA, 6 bp, Unknown
  misc_feature (1)..( 6): Matrix.003 file - promoters60/5665351
accatt

SEQ ID NO: 63098 - DNA, 6 bp, Unknown
  misc_feature (1)..( 6): Matrix.003 file - promoters60/5665351
atcttt

SEQ ID NO: 63099 - DNA, 7 bp, Unknown
  misc_feature (1)..( 7): Matrix.003 file - promoters60/5665351
tgaaatt

SEQ ID NO: 63100 - DNA, 9 bp, Unknown
  misc_feature (1)..( 9): Matrix.003 file - promoters60/5665351
cttcttctc

SEQ ID NO: 63101 - DNA, 6 bp, Unknown
  misc_feature (1)..( 6): Matrix.003 file - promoters60/5665351
tattat

SEQ ID NO: 63102 - DNA, 7 bp, Unknown
  misc_feature (1)..( 7): Matrix.003 file - promoters60/5665351
tatatga

SEQ ID NO: 63103 - DNA, 6 bp, Unknown
  misc_feature (1)..( 6): Matrix.003 file - promoters60/5665351
atcaac

SEQ ID NO: 63104 - DNA, 8 bp, Unknown
  misc_feature (1)..( 8): Matrix.003 file - promoters60/5665351
cgaaacca

SEQ ID NO: 63105 - DNA, 7 bp, Unknown
  misc_feature (1)..( 7): Matrix.003 file - promoters60/5665351
aggaatc

SEQ ID NO: 63106 - DNA, 6 bp, Unknown
  misc_feature (1)..( 6): Matrix.003 file - promoters60/5665351
cttctt

SEQ ID NO: 63107 - DNA, 9 bp, Unknown
  misc_feature (1)..( 9): Matrix.003 file - promoters60/5665351
aagattgtt

SEQ ID NO: 63108 - DNA, 6 bp, Unknown
  misc_feature (1)..( 6): Matrix.003 file - promoters60/5665351
tgatct

SEQ ID NO: 63109 - DNA, 7 bp, Unknown
  misc_feature (1)..( 7): Matrix.003 file - promoters60/5665351
tggtaat

SEQ ID NO: 63110 - DNA, 6 bp, Unknown
  misc_feature (1)..( 6): Matrix.003 file - promoters60/5665359
aattct

SEQ ID NO: 63111 - DNA, 7 bp, Unknown
  misc_feature (1)..( 7): Matrix.003 file - promoters60/5665359
aaaaatt

SEQ ID NO: 63112 - DNA, 7 bp, Unknown
  misc_feature (1)..( 7): Matrix.003 file - promoters60/5665359
tttgaga

SEQ ID NO: 63113 - DNA, 6 bp, Unknown
  misc_feature (1)..( 6): Matrix.003 file - promoters60/5665359
gaactt

SEQ ID NO: 63114 - DNA, 7 bp, Unknown
  misc_feature (1)..( 7): Matrix.003 file - promoters60/5665359
gagaaaa

SEQ ID NO: 63115 - DNA, 5 bp, Unknown
  misc_feature (1)..( 5): Matrix.003 file - promoters60/5665359
gttta

SEQ ID NO: 63116 - DNA, 6 bp, Unknown
  misc_feature (1)..( 6): Matrix.003 file - promoters60/5665359
tattgt

SEQ ID NO: 63117 - DNA, 9 bp, Unknown
  misc_feature (1)..( 9): Matrix.003 file - promoters60/5665359
attgttttg

SEQ ID NO: 63118 - DNA, 8 bp, Unknown
  misc_feature (1)..( 8): Matrix.003 file - promoters60/5665359
aaaatata

SEQ ID NO: 63119 - DNA, 6 bp, Unknown
  misc_feature (1)..( 6): Matrix.003 file - promoters60/5665359
ttaatt

SEQ ID NO: 63120 - DNA, 6 bp, Unknown
  misc_feature (1)..( 6): Matrix.003 file - promoters60/5665359
cagaag

SEQ ID NO: 63121 - DNA, 7 bp, Unknown
  misc_feature (1)..( 7): Matrix.003 file - promoters60/5665359
aatctct

SEQ ID NO: 63122 - DNA, 10 bp, Unknown
  misc_feature (1)..( 10): Matrix.003 file - promoters60/5665359
aaagatttct

SEQ ID NO: 63123 - DNA, 6 bp, Unknown
  misc_feature (1)..( 6): Matrix.003 file - promoters60/5665359
actttg

SEQ ID NO: 63124 - DNA, 6 bp, Unknown
  misc_feature (1)..( 6): Matrix.003 file - promoters60/5665359
tttatt

SEQ ID NO: 63125 - DNA, 8 bp, Unknown
  misc_feature (1)..( 8): Matrix.003 file - promoters60/5665359
taaaattt

SEQ ID NO: 63126 - DNA, 6 bp, Unknown
  misc_feature (1)..( 6): Matrix.003 file - promoters60/5665359
gtatca

SEQ ID NO: 63127 - DNA, 8 bp, Unknown
  misc_feature (1)..( 8): Matrix.003 file - promoters60/5665367
tcgctgaa

SEQ ID NO: 63128 - DNA, 7 bp, Unknown
  misc_feature (1)..( 7): Matrix.003 file - promoters60/5665367
aaataaa

SEQ ID NO: 63129 - DNA, 8 bp, Unknown
  misc_feature (1)..( 8): Matrix.003 file - promoters60/5665367
tatgactt

SEQ ID NO: 63130 - DNA, 7 bp, Unknown
  misc_feature (1)..( 7): Matrix.003 file - promoters60/5665367
ggaaaaa

SEQ ID NO: 63131 - DNA, 8 bp, Unknown
  misc_feature (1)..( 8): Matrix.003 file - promoters60/5665367
tatatata

SEQ ID NO: 63132 - DNA, 9 bp, Unknown
  misc_feature (1)..( 9): Matrix.003 file - promoters60/5665367
taagagttt

SEQ ID NO: 63133 - DNA, 8 bp, Unknown
  misc_feature (1)..( 8): Matrix.003 file - promoters60/5665367
aggaattc

SEQ ID NO: 63134 - DNA, 7 bp, Unknown
  misc_feature (1)..( 7): Matrix.003 file - promoters60/5665367
actatcg

SEQ ID NO: 63135 - DNA, 7 bp, Unknown
  misc_feature (1)..( 7): Matrix.003 file - promoters60/5665367
taaaatg

SEQ ID NO: 63136 - DNA, 7 bp, Unknown
  misc_feature (1)..( 7): Matrix.003 file - promoters60/5665367
aaaatag

SEQ ID NO: 63137 - DNA, 9 bp, Unknown
  misc_feature (1)..( 9): Matrix.003 file - promoters60/5665367
attctattt

SEQ ID NO: 63138 - DNA, 7 bp, Unknown
  misc_feature (1)..( 7): Matrix.003 file - promoters60/5665367
ttagata

SEQ ID NO: 63139 - DNA, 7 bp, Unknown
  misc_feature (1)..( 7): Matrix.003 file - promoters60/5665367
ttagttc

SEQ ID NO: 63140 - DNA, 7 bp, Unknown
  misc_feature (1)..( 7): Matrix.003 file - promoters60/5665367
acaaaat

SEQ ID NO: 63141 - DNA, 6 bp, Unknown
  misc_feature (1)..( 6): Matrix.003 file - promoters60/5665367
aaaata

SEQ ID NO: 63142 - DNA, 7 bp, Unknown
  misc_feature (1)..( 7): Matrix.003 file - promoters60/5665367
aaacgaa

SEQ ID NO: 63143 - DNA, 6 bp, Unknown
  misc_feature (1)..( 6): Matrix.003 file - promoters60/5665367
taaaaa

SEQ ID NO: 63144 - DNA, 7 bp, Unknown
  misc_feature (1)..( 7): Matrix.003 file - promoters60/5665367
ggtgaga

SEQ ID NO: 63145 - DNA, 6 bp, Unknown
  misc_feature (1)..( 6): Matrix.003 file - promoters60/5665367
gagaaa

SEQ ID NO: 63146 - DNA, 7 bp, Unknown
  misc_feature (1)..( 7): Matrix.003 file - promoters60/5665374
taaaaca

SEQ ID NO: 63147 - DNA, 8 bp, Unknown
  misc_feature (1)..( 8): Matrix.003 file - promoters60/5665374
ttatcaaa

SEQ ID NO: 63148 - DNA, 7 bp, Unknown
  misc_feature (1)..( 7): Matrix.003 file - promoters60/5665374
tacagct

SEQ ID NO: 63149 - DNA, 6 bp, Unknown
  misc_feature (1)..( 6): Matrix.003 file - promoters60/5665374
ccacta

SEQ ID NO: 63150 - DNA, 10 bp, Unknown
  misc_feature (1)..( 10): Matrix.003 file - promoters60/5665374
actatctaaa

SEQ ID NO: 63151 - DNA, 7 bp, Unknown
  misc_feature (1)..( 7): Matrix.003 file - promoters60/5665374
aaaatta

SEQ ID NO: 63152 - DNA, 7 bp, Unknown
  misc_feature (1)..( 7): Matrix.003 file - promoters60/5665374
aatggac

SEQ ID NO: 63153 - DNA, 7 bp, Unknown
  misc_feature (1)..( 7): Matrix.003 file - promoters60/5665374
aataaat

SEQ ID NO: 63154 - DNA, 7 bp, Unknown
  misc_feature (1)..( 7): Matrix.003 file - promoters60/5665374
tatatga

SEQ ID NO: 63155 - DNA, 7 bp, Unknown
  misc_feature (1)..( 7): Matrix.003 file - promoters60/5665374
aaaccaa

SEQ ID NO: 63156 - DNA, 6 bp, Unknown
  misc_feature (1)..( 6): Matrix.003 file - promoters60/5665374
tttttg

SEQ ID NO: 63157 - DNA, 8 bp, Unknown
  misc_feature (1)..( 8): Matrix.003 file - promoters60/5665374
aataacca

SEQ ID NO: 63158 - DNA, 6 bp, Unknown
  misc_feature (1)..( 6): Matrix.003 file - promoters60/5665374
aaatca

SEQ ID NO: 63159 - DNA, 6 bp, Unknown
  misc_feature (1)..( 6): Matrix.003 file - promoters60/5665374
ccaaaa

SEQ ID NO: 63160 - DNA, 8 bp, Unknown
  misc_feature (1)..( 8): Matrix.003 file - promoters60/5665374
tattgaac

SEQ ID NO: 63161 - DNA, 6 bp, Unknown
  misc_feature (1)..( 6): Matrix.003 file - promoters60/5665374
ttattg

SEQ ID NO: 63162 - DNA, 8 bp, Unknown
  misc_feature (1)..( 8): Matrix.003 file - promoters60/5665374
attgtcaa

SEQ ID NO: 63163 - DNA, 9 bp, Unknown
  misc_feature (1)..( 9): Matrix.003 file - promoters60/5665374
gaaaaaatg

SEQ ID NO: 63164 - DNA, 6 bp, Unknown
  misc_feature (1)..( 6): Matrix.003 file - promoters60/5665374
taaaag

SEQ ID NO: 63165 - DNA, 8 bp, Unknown
  misc_feature (1)..( 8): Matrix.003 file - promoters60/5665374
agcctcac

SEQ ID NO: 63166 - DNA, 7 bp, Unknown
  misc_feature (1)..( 7): Matrix.003 file - promoters60/5665404
agatgtg

SEQ ID NO: 63167 - DNA, 9 bp, Unknown
  misc_feature (1)..( 9): Matrix.003 file - promoters60/5665404
ttcgtcctt

SEQ ID NO: 63168 - DNA, 7 bp, Unknown
  misc_feature (1)..( 7): Matrix.003 file - promoters60/5665404
ttgcttt

SEQ ID NO: 63169 - DNA, 10 bp, Unknown
  misc_feature (1)..( 10): Matrix.003 file - promoters60/5665404
aaataaaata

SEQ ID NO: 63170 - DNA, 10 bp, Unknown
  misc_feature (1)..( 10): Matrix.003 file - promoters60/5665404
agttaaaaca

SEQ ID NO: 63171 - DNA, 10 bp, Unknown
  misc_feature (1)..( 10): Matrix.003 file - promoters60/5665404
aaccctaaag

SEQ ID NO: 63172 - DNA, 6 bp, Unknown
  misc_feature (1)..( 6): Matrix.003 file - promoters60/5665404
aaaaat

SEQ ID NO: 63173 - DNA, 6 bp, Unknown
  misc_feature (1)..( 6): Matrix.003 file - promoters60/5665404
gcctac

SEQ ID NO: 63174 - DNA, 9 bp, Unknown
  misc_feature (1)..( 9): Matrix.003 file - promoters60/5665404
aaacattgt

SEQ ID NO: 63175 - DNA, 6 bp, Unknown
  misc_feature (1)..( 6): Matrix.003 file - promoters60/5665404
ctattg

SEQ ID NO: 63176 - DNA, 7 bp, Unknown
  misc_feature (1)..( 7): Matrix.003 file - promoters60/5665404
aaacaaa

SEQ ID NO: 63177 - DNA, 7 bp, Unknown
  misc_feature (1)..( 7): Matrix.003 file - promoters60/5665404
aaacttt

SEQ ID NO: 63178 - DNA, 6 bp, Unknown
  misc_feature (1)..( 6): Matrix.003 file - promoters60/5665404
agtaaa

SEQ ID NO: 63179 - DNA, 7 bp, Unknown
  misc_feature (1)..( 7): Matrix.003 file - promoters60/5665404
aatcggg

SEQ ID NO: 63180 - DNA, 8 bp, Unknown
  misc_feature (1)..( 8): Matrix.003 file - promoters60/5665404
gaaacaaa

SEQ ID NO: 63181 - DNA, 10 bp, Unknown
  misc_feature (1)..( 10): Matrix.003 file - promoters60/5665404
ggaaaagaaa

SEQ ID NO: 63182 - DNA, 7 bp, Unknown
  misc_feature (1)..( 7): Matrix.003 file - promoters60/5665404
cccacta

SEQ ID NO: 63183 - DNA, 9 bp, Unknown
  misc_feature (1)..( 9): Matrix.003 file - promoters60/5665404
aaagaaaag

SEQ ID NO: 63184 - DNA, 7 bp, Unknown
  misc_feature (1)..( 7): Matrix.003 file - promoters60/5665404
gtatata

SEQ ID NO: 63185 - DNA, 7 bp, Unknown
  misc_feature (1)..( 7): Matrix.003 file - promoters60/5665420
aaaatat

SEQ ID NO: 63186 - DNA, 8 bp, Unknown
  misc_feature (1)..( 8): Matrix.003 file - promoters60/5665420
caacgaaa

SEQ ID NO: 63187 - DNA, 7 bp, Unknown
  misc_feature (1)..( 7): Matrix.003 file - promoters60/5665420
tatcata

SEQ ID NO: 63188 - DNA, 6 bp, Unknown
  misc_feature (1)..( 6): Matrix.003 file - promoters60/5665420
atttta

SEQ ID NO: 63189 - DNA, 6 bp, Unknown
  misc_feature (1)..( 6): Matrix.003 file - promoters60/5665420
gacggt

SEQ ID NO: 63190 - DNA, 9 bp, Unknown
  misc_feature (1)..( 9): Matrix.003 file - promoters60/5665420
aaatgaaaa

SEQ ID NO: 63191 - DNA, 10 bp, Unknown
  misc_feature (1)..( 10): Matrix.003 file - promoters60/5665420
tgtgaattaa

SEQ ID NO: 63192 - DNA, 8 bp, Unknown
  misc_feature (1)..( 8): Matrix.003 file - promoters60/5665420
taataaag

SEQ ID NO: 63193 - DNA, 7 bp, Unknown
  misc_feature (1)..( 7): Matrix.003 file - promoters60/5665420
tctcttt

SEQ ID NO: 63194 - DNA, 7 bp, Unknown
  misc_feature (1)..( 7): Matrix.003 file - promoters60/5665420
tttgagt

SEQ ID NO: 63195 - DNA, 9 bp, Unknown
  misc_feature (1)..( 9): Matrix.003 file - promoters60/5665420
ttaaaatag

SEQ ID NO: 63196 - DNA, 9 bp, Unknown
  misc_feature (1)..( 9): Matrix.003 file - promoters60/5665420
ataaattaa

SEQ ID NO: 63197 - DNA, 6 bp, Unknown
  misc_feature (1)..( 6): Matrix.003 file - promoters60/5665420
atatat

SEQ ID NO: 63198 - DNA, 8 bp, Unknown
  misc_feature (1)..( 8): Matrix.003 file - promoters60/5665420
aacggaaa

SEQ ID NO: 63199 - DNA, 6 bp, Unknown
  misc_feature (1)..( 6): Matrix.003 file - promoters60/5665420
tcataa

SEQ ID NO: 63200 - DNA, 7 bp, Unknown
  misc_feature (1)..( 7): Matrix.003 file - promoters60/5665420
ttatttc

SEQ ID NO: 63201 - DNA, 7 bp, Unknown
  misc_feature (1)..( 7): Matrix.003 file - promoters60/5665420
taaaaca

SEQ ID NO: 63202 - DNA, 7 bp, Unknown
  misc_feature (1)..( 7): Matrix.003 file - promoters60/5665420
aaaacaa

SEQ ID NO: 63203 - DNA, 7 bp, Unknown
  misc_feature (1)..( 7): Matrix.003 file - promoters60/5665420
tgtatat

SEQ ID NO: 63204 - DNA, 6 bp, Unknown
  misc_feature (1)..( 6): Matrix.003 file - promoters60/5665420
ttatca

SEQ ID NO: 63205 - DNA, 6 bp, Unknown
  misc_feature (1)..( 6): Matrix.003 file - promoters60/5665420
atttat

SEQ ID NO: 63206 - DNA, 8 bp, Unknown
  misc_feature (1)..( 8): Matrix.003 file - promoters60/5665420
gtgataaa

SEQ ID NO: 63207 - DNA, 7 bp, Unknown
  misc_feature (1)..( 7): Matrix.003 file - promoters60/5665420
gaaaata

SEQ ID NO: 63208 - DNA, 6 bp, Unknown
  misc_feature (1)..( 6): Matrix.003 file - promoters60/5665420
cagaaa

SEQ ID NO: 63209 - DNA, 10 bp, Unknown
  misc_feature (1)..( 10): Matrix.003 file - promoters60/5665420
ttaacaagta

SEQ ID NO: 63210 - DNA, 6 bp, Unknown
  misc_feature (1)..( 6): Matrix.003 file - promoters60/5665420
aagcaa

SEQ ID NO: 63211 - DNA, 14 bp, Unknown
  misc_feature (1)..( 14): Matrix.003 file - promoters60/5665436
aataattatattaa

SEQ ID NO: 63212 - DNA, 14 bp, Unknown
  misc_feature (1)..( 14): Matrix.003 file - promoters60/5665436
aattttttctttat

SEQ ID NO: 63213 - DNA, 10 bp, Unknown
  misc_feature (1)..( 10): Matrix.003 file - promoters60/5665436
aatattaaaa

SEQ ID NO: 63214 - DNA, 12 bp, Unknown
  misc_feature (1)..( 12): Matrix.003 file - promoters60/5665507
caagaaaacaaa

SEQ ID NO: 63215 - DNA, 10 bp, Unknown
  misc_feature (1)..( 10): Matrix.003 file - promoters60/5665796
tattaatgtt

SEQ ID NO: 63216 - DNA, 10 bp, Unknown
  misc_feature (1)..( 10): Matrix.003 file - promoters60/5665796
attgataaat

SEQ ID NO: 63217 - DNA, 12 bp, Unknown
  misc_feature (1)..( 12): Matrix.003 file - promoters60/5665796
taataaattcat

SEQ ID NO: 63218 - DNA, 6 bp, Unknown
  misc_feature (1)..( 6): Matrix.003 file - promoters60/5666614
gaataa

SEQ ID NO: 63219 - DNA, 7 bp, Unknown
  misc_feature (1)..( 7): Matrix.003 file - promoters60/5666614
atggaat

SEQ ID NO: 63220 - DNA, 7 bp, Unknown
  misc_feature (1)..( 7): Matrix.003 file - promoters60/5666614
ttaaaaa

SEQ ID NO: 63221 - DNA, 6 bp, Unknown
  misc_feature (1)..( 6): Matrix.003 file - promoters60/5666614
caaggg

SEQ ID NO: 63222 - DNA, 7 bp, Unknown
  misc_feature (1)..( 7): Matrix.003 file - promoters60/5666614
gtttaac

SEQ ID NO: 63223 - DNA, 8 bp, Unknown
  misc_feature (1)..( 8): Matrix.003 file - promoters60/5666614
taatttcg

SEQ ID NO: 63224 - DNA, 6 bp, Unknown
  misc_feature (1)..( 6): Matrix.003 file - promoters60/5666614
caacaa

SEQ ID NO: 63225 - DNA, 6 bp, Unknown
  misc_feature (1)..( 6): Matrix.003 file - promoters60/5666614
ccacaa

SEQ ID NO: 63226 - DNA, 9 bp, Unknown
  misc_feature (1)..( 9): Matrix.003 file - promoters60/5666614
agaagtagc

SEQ ID NO: 63227 - DNA, 8 bp, Unknown
  misc_feature (1)..( 8): Matrix.003 file - promoters60/5666614
acaacaga

SEQ ID NO: 63228 - DNA, 8 bp, Unknown
  misc_feature (1)..( 8): Matrix.003 file - promoters60/5666614
ttgcttac

SEQ ID NO: 63229 - DNA, 7 bp, Unknown
  misc_feature (1)..( 7): Matrix.003 file - promoters60/5666614
tttctct

SEQ ID NO: 63230 - DNA, 6 bp, Unknown
  misc_feature (1)..( 6): Matrix.003 file - promoters60/5666614
tatttt

SEQ ID NO: 63231 - DNA, 9 bp, Unknown
  misc_feature (1)..( 9): Matrix.003 file - promoters60/5666614
gacaaatac

SEQ ID NO: 63232 - DNA, 6 bp, Unknown
  misc_feature (1)..( 6): Matrix.003 file - promoters60/5666614
caattt

SEQ ID NO: 63233 - DNA, 8 bp, Unknown
  misc_feature (1)..( 8): Matrix.003 file - promoters60/5667152
cggtataa

SEQ ID NO: 63234 - DNA, 8 bp, Unknown
  misc_feature (1)..( 8): Matrix.003 file - promoters60/5667152
aaaaaatc

SEQ ID NO: 63235 - DNA, 8 bp, Unknown
  misc_feature (1)..( 8): Matrix.003 file - promoters60/5667152
acaaaatt

SEQ ID NO: 63236 - DNA, 7 bp, Unknown
  misc_feature (1)..( 7): Matrix.003 file - promoters60/5667152
agaaatg

SEQ ID NO: 63237 - DNA, 7 bp, Unknown
  misc_feature (1)..( 7): Matrix.003 file - promoters60/5667152
agtgaag

SEQ ID NO: 63238 - DNA, 8 bp, Unknown
  misc_feature (1)..( 8): Matrix.003 file - promoters60/5667152
tggtctgt

SEQ ID NO: 63239 - DNA, 7 bp, Unknown
  misc_feature (1)..( 7): Matrix.003 file - promoters60/5667152
ttattcg

SEQ ID NO: 63240 - DNA, 7 bp, Unknown
  misc_feature (1)..( 7): Matrix.003 file - promoters60/5667152
ttgaatc

SEQ ID NO: 63241 - DNA, 9 bp, Unknown
  misc_feature (1)..( 9): Matrix.003 file - promoters60/5667152
atcaaattt

SEQ ID NO: 63242 - DNA, 7 bp, Unknown
  misc_feature (1)..( 7): Matrix.003 file - promoters60/5667152
tttcttc

SEQ ID NO: 63243 - DNA, 6 bp, Unknown
  misc_feature (1)..( 6): Matrix.003 file - promoters60/5667152
gttgta

SEQ ID NO: 63244 - DNA, 7 bp, Unknown
  misc_feature (1)..( 7): Matrix.003 file - promoters60/5667152
gaccaga

SEQ ID NO: 63245 - DNA, 7 bp, Unknown
  misc_feature (1)..( 7): Matrix.003 file - promoters60/5667570
aatgaat

SEQ ID NO: 63246 - DNA, 7 bp, Unknown
  misc_feature (1)..( 7): Matrix.003 file - promoters60/5667570
ataatta

SEQ ID NO: 63247 - DNA, 7 bp, Unknown
  misc_feature (1)..( 7): Matrix.003 file - promoters60/5667570
ttaaaga

SEQ ID NO: 63248 - DNA, 7 bp, Unknown
  misc_feature (1)..( 7): Matrix.003 file - promoters60/5667570
aaaatta

SEQ ID NO: 63249 - DNA, 8 bp, Unknown
  misc_feature (1)..( 8): Matrix.003 file - promoters60/5667570
tatttaat

SEQ ID NO: 63250 - DNA, 9 bp, Unknown
  misc_feature (1)..( 9): Matrix.003 file - promoters60/5667570
tttaaaata

SEQ ID NO: 63251 - DNA, 6 bp, Unknown
  misc_feature (1)..( 6): Matrix.003 file - promoters60/5667570
taataa

SEQ ID NO: 63252 - DNA, 7 bp, Unknown
  misc_feature (1)..( 7): Matrix.003 file - promoters60/5667570
aaaaaag

SEQ ID NO: 63253 - DNA, 8 bp, Unknown
  misc_feature (1)..( 8): Matrix.003 file - promoters60/5667570
aaacaaat

SEQ ID NO: 63254 - DNA, 8 bp, Unknown
  misc_feature (1)..( 8): Matrix.003 file - promoters60/5667570
ataagaaa

SEQ ID NO: 63255 - DNA, 11 bp, Unknown
  misc_feature (1)..( 11): Matrix.003 file - promoters60/5667570
caaaataaaaa

SEQ ID NO: 63256 - DNA, 9 bp, Unknown
  misc_feature (1)..( 9): Matrix.003 file - promoters60/5667570
tggtgtttt

SEQ ID NO: 63257 - DNA, 11 bp, Unknown
  misc_feature (1)..( 11): Matrix.003 file - promoters60/5667570
tatatataaac

SEQ ID NO: 63258 - DNA, 7 bp, Unknown
  misc_feature (1)..( 7): Matrix.003 file - promoters60/5667570
ttcccaa

SEQ ID NO: 63259 - DNA, 6 bp, Unknown
  misc_feature (1)..( 6): Matrix.003 file - promoters60/5667570
ctgttg

SEQ ID NO: 63260 - DNA, 7 bp, Unknown
  misc_feature (1)..( 7): Matrix.003 file - promoters60/5667570
ttgaaat

SEQ ID NO: 63261 - DNA, 6 bp, Unknown
  misc_feature (1)..( 6): Matrix.003 file - promoters60/5667570
aaatta

SEQ ID NO: 63262 - DNA, 7 bp, Unknown
  misc_feature (1)..( 7): Matrix.003 file - promoters60/5667570
cttattt

SEQ ID NO: 63263 - DNA, 8 bp, Unknown
  misc_feature (1)..( 8): Matrix.003 file - promoters60/5667570
tttcaaaa

SEQ ID NO: 63264 - DNA, 7 bp, Unknown
  misc_feature (1)..( 7): Matrix.003 file - promoters60/5667570
aaattta

SEQ ID NO: 63265 - DNA, 7 bp, Unknown
  misc_feature (1)..( 7): Matrix.003 file - promoters60/5667570
acccaaa

SEQ ID NO: 63266 - DNA, 6 bp, Unknown
  misc_feature (1)..( 6): Matrix.003 file - promoters60/5667570
tctcat

SEQ ID NO: 63267 - DNA, 7 bp, Unknown
  misc_feature (1)..( 7): Matrix.003 file - promoters60/5667570
ttgccaa

SEQ ID NO: 63268 - DNA, 6 bp, Unknown
  misc_feature (1)..( 6): Matrix.003 file - promoters60/5667570
tttatt

SEQ ID NO: 63269 - DNA, 6 bp, Unknown
  misc_feature (1)..( 6): Matrix.003 file - promoters60/5667570
taattt

SEQ ID NO: 63270 - DNA, 7 bp, Unknown
  misc_feature (1)..( 7): Matrix.003 file - promoters60/5667570
aaaaagg

SEQ ID NO: 63271 - DNA, 7 bp, Unknown
  misc_feature (1)..( 7): Matrix.003 file - promoters60/5667570
gctaaaa

SEQ ID NO: 63272 - DNA, 8 bp, Unknown
  misc_feature (1)..( 8): Matrix.003 file - promoters60/5667588
caataatt

SEQ ID NO: 63273 - DNA, 9 bp, Unknown
  misc_feature (1)..( 9): Matrix.003 file - promoters60/5667588
attattatt

SEQ ID NO: 63274 - DNA, 10 bp, Unknown
  misc_feature (1)..( 10): Matrix.003 file - promoters60/5667588
tatctaagtg

SEQ ID NO: 63275 - DNA, 6 bp, Unknown
  misc_feature (1)..( 6): Matrix.003 file - promoters60/5667588
ttaaca

SEQ ID NO: 63276 - DNA, 8 bp, Unknown
  misc_feature (1)..( 8): Matrix.003 file - promoters60/5667588
cctaccac

SEQ ID NO: 63277 - DNA, 8 bp, Unknown
  misc_feature (1)..( 8): Matrix.003 file - promoters60/5667588
actatata

SEQ ID NO: 63278 - DNA, 8 bp, Unknown
  misc_feature (1)..( 8): Matrix.003 file - promoters60/5667588
ttattttt

SEQ ID NO: 63279 - DNA, 6 bp, Unknown
  misc_feature (1)..( 6): Matrix.003 file - promoters60/5667588
aattat

SEQ ID NO: 63280 - DNA, 6 bp, Unknown
  misc_feature (1)..( 6): Matrix.003 file - promoters60/5667588
gagttt

SEQ ID NO: 63281 - DNA, 6 bp, Unknown
  misc_feature (1)..( 6): Matrix.003 file - promoters60/5667588
attttt

SEQ ID NO: 63282 - DNA, 7 bp, Unknown
  misc_feature (1)..( 7): Matrix.003 file - promoters60/5667588
tttttat

SEQ ID NO: 63283 - DNA, 9 bp, Unknown
  misc_feature (1)..( 9): Matrix.003 file - promoters60/5667588
aaaaatatc

SEQ ID NO: 63284 - DNA, 6 bp, Unknown
  misc_feature (1)..( 6): Matrix.003 file - promoters60/5667588
acacca

SEQ ID NO: 63285 - DNA, 6 bp, Unknown
  misc_feature (1)..( 6): Matrix.003 file - promoters60/5667588
tcaaga

SEQ ID NO: 63286 - DNA, 6 bp, Unknown
  misc_feature (1)..( 6): Matrix.003 file - promoters60/5667588
atagcc

SEQ ID NO: 63287 - DNA, 6 bp, Unknown
  misc_feature (1)..( 6): Matrix.003 file - promoters60/5667588
aaaaat

SEQ ID NO: 63288 - DNA, 7 bp, Unknown
  misc_feature (1)..( 7): Matrix.003 file - promoters60/5667588
aatagta

SEQ ID NO: 63289 - DNA, 6 bp, Unknown
  misc_feature (1)..( 6): Matrix.003 file - promoters60/5667588
taaagg

SEQ ID NO: 63290 - DNA, 9 bp, Unknown
  misc_feature (1)..( 9): Matrix.003 file - promoters60/5667588
aaaaatgaa

SEQ ID NO: 63291 - DNA, 9 bp, Unknown
  misc_feature (1)..( 9): Matrix.003 file - promoters60/5667588
aaaacattt

SEQ ID NO: 63292 - DNA, 9 bp, Unknown
  misc_feature (1)..( 9): Matrix.003 file - promoters60/5667588
tcacgaaaa

SEQ ID NO: 63293 - DNA, 7 bp, Unknown
  misc_feature (1)..( 7): Matrix.003 file - promoters60/5667588
ttccgaa

SEQ ID NO: 63294 - DNA, 7 bp, Unknown
  misc_feature (1)..( 7): Matrix.003 file - promoters60/5667685
attgatt

SEQ ID NO: 63295 - DNA, 10 bp, Unknown
  misc_feature (1)..( 10): Matrix.003 file - promoters60/5667685
ttgtaaccaa

SEQ ID NO: 63296 - DNA, 8 bp, Unknown
  misc_feature (1)..( 8): Matrix.003 file - promoters60/5667685
ctagaatt

SEQ ID NO: 63297 - DNA, 6 bp, Unknown
  misc_feature (1)..( 6): Matrix.003 file - promoters60/5667685
atcttc

SEQ ID NO: 63298 - DNA, 8 bp, Unknown
  misc_feature (1)..( 8): Matrix.003 file - promoters60/5667685
tttcgaaa

SEQ ID NO: 63299 - DNA, 6 bp, Unknown
  misc_feature (1)..( 6): Matrix.003 file - promoters60/5667685
tcactt

SEQ ID NO: 63300 - DNA, 6 bp, Unknown
  misc_feature (1)..( 6): Matrix.003 file - promoters60/5667685
aaaaat

SEQ ID NO: 63301 - DNA, 8 bp, Unknown
  misc_feature (1)..( 8): Matrix.003 file - promoters60/5667685
ttttttca

SEQ ID NO: 63302 - DNA, 6 bp, Unknown
  misc_feature (1)..( 6): Matrix.003 file - promoters60/5667685
tttaat

SEQ ID NO: 63303 - DNA, 10 bp, Unknown
  misc_feature (1)..( 10): Matrix.003 file - promoters60/5667685
accaaaaatg

SEQ ID NO: 63304 - DNA, 6 bp, Unknown
  misc_feature (1)..( 6): Matrix.003 file - promoters60/5667685
acaaaa

SEQ ID NO: 63305 - DNA, 6 bp, Unknown
  misc_feature (1)..( 6): Matrix.003 file - promoters60/5667685
aataaa

SEQ ID NO: 63306 - DNA, 7 bp, Unknown
  misc_feature (1)..( 7): Matrix.003 file - promoters60/5667685
taaaaat

SEQ ID NO: 63307 - DNA, 6 bp, Unknown
  misc_feature (1)..( 6): Matrix.003 file - promoters60/5667685
actaac

SEQ ID NO: 63308 - DNA, 8 bp, Unknown
  misc_feature (1)..( 8): Matrix.003 file - promoters60/5667685
tgaaacta

SEQ ID NO: 63309 - DNA, 6 bp, Unknown
  misc_feature (1)..( 6): Matrix.003 file - promoters60/5667685
aaatct

SEQ ID NO: 63310 - DNA, 7 bp, Unknown
  misc_feature (1)..( 7): Matrix.003 file - promoters60/5667685
cttaaat

SEQ ID NO: 63311 - DNA, 9 bp, Unknown
  misc_feature (1)..( 9): Matrix.003 file - promoters60/5667685
aactttttt

SEQ ID NO: 63312 - DNA, 7 bp, Unknown
  misc_feature (1)..( 7): Matrix.003 file - promoters60/5667685
ataaaat

SEQ ID NO: 63313 - DNA, 6 bp, Unknown
  misc_feature (1)..( 6): Matrix.003 file - promoters60/5667685
cttttt

SEQ ID NO: 63314 - DNA, 7 bp, Unknown
  misc_feature (1)..( 7): Matrix.003 file - promoters60/5667685
taaacca

SEQ ID NO: 63315 - DNA, 7 bp, Unknown
  misc_feature (1)..( 7): Matrix.003 file - promoters60/5667685
aagttaa

SEQ ID NO: 63316 - DNA, 6 bp, Unknown
  misc_feature (1)..( 6): Matrix.003 file - promoters60/5667685
tgaaaa

SEQ ID NO: 63317 - DNA, 8 bp, Unknown
  misc_feature (1)..( 8): Matrix.003 file - promoters60/5667685
gatgcaag

SEQ ID NO: 63318 - DNA, 9 bp, Unknown
  misc_feature (1)..( 9): Matrix.003 file - promoters60/5667720
taatttttt

SEQ ID NO: 63319 - DNA, 11 bp, Unknown
  misc_feature (1)..( 11): Matrix.003 file - promoters60/5667720
taaaatttact

SEQ ID NO: 63320 - DNA, 8 bp, Unknown
  misc_feature (1)..( 8): Matrix.003 file - promoters60/5667720
attttttt

SEQ ID NO: 63321 - DNA, 10 bp, Unknown
  misc_feature (1)..( 10): Matrix.003 file - promoters60/5667720
ctataaatat

SEQ ID NO: 63322 - DNA, 8 bp, Unknown
  misc_feature (1)..( 8): Matrix.003 file - promoters60/5667737
ctacaaag

SEQ ID NO: 63323 - DNA, 14 bp, Unknown
  misc_feature (1)..( 14): Matrix.003 file - promoters60/5667737
ctacaaagaccaaa

SEQ ID NO: 63324 - DNA, 6 bp, Unknown
  misc_feature (1)..( 6): Matrix.003 file - promoters60/5667741
gtttct

SEQ ID NO: 63325 - DNA, 6 bp, Unknown
  misc_feature (1)..( 6): Matrix.003 file - promoters60/5667741
tctgtt

SEQ ID NO: 63326 - DNA, 7 bp, Unknown
  misc_feature (1)..( 7): Matrix.003 file - promoters60/5667741
ttcttca

SEQ ID NO: 63327 - DNA, 9 bp, Unknown
  misc_feature (1)..( 9): Matrix.003 file - promoters60/5667741
ctgctatat

SEQ ID NO: 63328 - DNA, 7 bp, Unknown
  misc_feature (1)..( 7): Matrix.003 file - promoters60/5667741
ttcattt

SEQ ID NO: 63329 - DNA, 9 bp, Unknown
  misc_feature (1)..( 9): Matrix.003 file - promoters60/5667741
gttcttctt

SEQ ID NO: 63330 - DNA, 7 bp, Unknown
  misc_feature (1)..( 7): Matrix.003 file - promoters60/5667741
gaaaaaa

SEQ ID NO: 63331 - DNA, 7 bp, Unknown
  misc_feature (1)..( 7): Matrix.003 file - promoters60/5667741
gctgctg

SEQ ID NO: 63332 - DNA, 6 bp, Unknown
  misc_feature (1)..( 6): Matrix.003 file - promoters60/5667741
tgttct

SEQ ID NO: 63333 - DNA, 9 bp, Unknown
  misc_feature (1)..( 9): Matrix.003 file - promoters60/5667741
tttaactct

SEQ ID NO: 63334 - DNA, 8 bp, Unknown
  misc_feature (1)..( 8): Matrix.003 file - promoters60/5667741
gtctacga

SEQ ID NO: 63335 - DNA, 8 bp, Unknown
  misc_feature (1)..( 8): Matrix.003 file - promoters60/5667741
aatcaagt

SEQ ID NO: 63336 - DNA, 9 bp, Unknown
  misc_feature (1)..( 9): Matrix.003 file - promoters60/5667741
tgggcccat

SEQ ID NO: 63337 - DNA, 6 bp, Unknown
  misc_feature (1)..( 6): Matrix.003 file - promoters60/5667741
cgtcct

SEQ ID NO: 63338 - DNA, 9 bp, Unknown
  misc_feature (1)..( 9): Matrix.003 file - promoters60/5667741
ttttgtgtt

SEQ ID NO: 63339 - DNA, 7 bp, Unknown
  misc_feature (1)..( 7): Matrix.003 file - promoters60/5667741
ttttgag

SEQ ID NO: 63340 - DNA, 6 bp, Unknown
  misc_feature (1)..( 6): Matrix.003 file - promoters60/5667766
ttacta

SEQ ID NO: 63341 - DNA, 9 bp, Unknown
  misc_feature (1)..( 9): Matrix.003 file - promoters60/5667766
tttgtaaaa

SEQ ID NO: 63342 - DNA, 8 bp, Unknown
  misc_feature (1)..( 8): Matrix.003 file - promoters60/5667766
aaaaccat

SEQ ID NO: 63343 - DNA, 6 bp, Unknown
  misc_feature (1)..( 6): Matrix.003 file - promoters60/5667766
atctct

SEQ ID NO: 63344 - DNA, 8 bp, Unknown
  misc_feature (1)..( 8): Matrix.003 file - promoters60/5667766
gatattaa

SEQ ID NO: 63345 - DNA, 6 bp, Unknown
  misc_feature (1)..( 6): Matrix.003 file - promoters60/5667766
atattc

SEQ ID NO: 63346 - DNA, 8 bp, Unknown
  misc_feature (1)..( 8): Matrix.003 file - promoters60/5667766
cattcgga

SEQ ID NO: 63347 - DNA, 7 bp, Unknown
  misc_feature (1)..( 7): Matrix.003 file - promoters60/5667766
accataa

SEQ ID NO: 63348 - DNA, 7 bp, Unknown
  misc_feature (1)..( 7): Matrix.003 file - promoters60/5667766
caacaaa

SEQ ID NO: 63349 - DNA, 6 bp, Unknown
  misc_feature (1)..( 6): Matrix.003 file - promoters60/5667766
gaatgg

SEQ ID NO: 63350 - DNA, 9 bp, Unknown
  misc_feature (1)..( 9): Matrix.003 file - promoters60/5667766
attgttgtt

SEQ ID NO: 63351 - DNA, 6 bp, Unknown
  misc_feature (1)..( 6): Matrix.003 file - promoters60/5667766
cgaaac

SEQ ID NO: 63352 - DNA, 7 bp, Unknown
  misc_feature (1)..( 7): Matrix.003 file - promoters60/5667766
aaaactt

SEQ ID NO: 63353 - DNA, 7 bp, Unknown
  misc_feature (1)..( 7): Matrix.003 file - promoters60/5667785
actaatt

SEQ ID NO: 63354 - DNA, 6 bp, Unknown
  misc_feature (1)..( 6): Matrix.003 file - promoters60/5667785
caaaaa

SEQ ID NO: 63355 - DNA, 8 bp, Unknown
  misc_feature (1)..( 8): Matrix.003 file - promoters60/5667785
aaaaatat

SEQ ID NO: 63356 - DNA, 7 bp, Unknown
  misc_feature (1)..( 7): Matrix.003 file - promoters60/5667785
aaacata

SEQ ID NO: 63357 - DNA, 7 bp, Unknown
  misc_feature (1)..( 7): Matrix.003 file - promoters60/5667785
attaatg

SEQ ID NO: 63358 - DNA, 7 bp, Unknown
  misc_feature (1)..( 7): Matrix.003 file - promoters60/5667785
ttccaaa

SEQ ID NO: 63359 - DNA, 6 bp, Unknown
  misc_feature (1)..( 6): Matrix.003 file - promoters60/5667785
ccaaac

SEQ ID NO: 63360 - DNA, 6 bp, Unknown
  misc_feature (1)..( 6): Matrix.003 file - promoters60/5667785
ggtttt

SEQ ID NO: 63361 - DNA, 6 bp, Unknown
  misc_feature (1)..( 6): Matrix.003 file - promoters60/5667785
ttaatt

SEQ ID NO: 63362 - DNA, 8 bp, Unknown
  misc_feature (1)..( 8): Matrix.003 file - promoters60/5667785
gttagtat

SEQ ID NO: 63363 - DNA, 6 bp, Unknown
  misc_feature (1)..( 6): Matrix.003 file - promoters60/5667785
ttggcg

SEQ ID NO: 63364 - DNA, 7 bp, Unknown
  misc_feature (1)..( 7): Matrix.003 file - promoters60/5667785
atattta

SEQ ID NO: 63365 - DNA, 10 bp, Unknown
  misc_feature (1)..( 10): Matrix.003 file - promoters60/5667814
gaacaaaaaa

SEQ ID NO: 63366 - DNA, 11 bp, Unknown
  misc_feature (1)..( 11): Matrix.003 file - promoters60/5667814
aaattgaaaaa

SEQ ID NO: 63367 - DNA, 8 bp, Unknown
  misc_feature (1)..( 8): Matrix.003 file - promoters60/5667814
caaaaaac

SEQ ID NO: 63368 - DNA, 11 bp, Unknown
  misc_feature (1)..( 11): Matrix.003 file - promoters60/5667822
caattttgtct

SEQ ID NO: 63369 - DNA, 8 bp, Unknown
  misc_feature (1)..( 8): Matrix.003 file - promoters60/5667822
atttttac

SEQ ID NO: 63370 - DNA, 10 bp, Unknown
  misc_feature (1)..( 10): Matrix.003 file - promoters60/5667822
ataaattaaa

SEQ ID NO: 63371 - DNA, 11 bp, Unknown
  misc_feature (1)..( 11): Matrix.003 file - promoters60/5667822
aaaatttatta

SEQ ID NO: 63372 - DNA, 10 bp, Unknown
  misc_feature (1)..( 10): Matrix.003 file - promoters60/5667822
gtatattttg

SEQ ID NO: 63373 - DNA, 10 bp, Unknown
  misc_feature (1)..( 10): Matrix.003 file - promoters60/5667822
tctgttagat

SEQ ID NO: 63374 - DNA, 10 bp, Unknown
  misc_feature (1)..( 10): Matrix.003 file - promoters60/5667822
tataaaaaaa

SEQ ID NO: 63375 - DNA, 7 bp, Unknown
  misc_feature (1)..( 7): Matrix.003 file - promoters60/5667822
tataaaa

SEQ ID NO: 63376 - DNA, 11 bp, Unknown
  misc_feature (1)..( 11): Matrix.003 file - promoters60/5667822
atttattttgt

SEQ ID NO: 63377 - DNA, 9 bp, Unknown
  misc_feature (1)..( 9): Matrix.003 file - promoters60/5667822
attgacttt

SEQ ID NO: 63378 - DNA, 9 bp, Unknown
  misc_feature (1)..( 9): Matrix.003 file - promoters60/5667822
ttattttaa

SEQ ID NO: 63379 - DNA, 9 bp, Unknown
  misc_feature (1)..( 9): Matrix.003 file - promoters60/5667849
aaaaatttt

SEQ ID NO: 63380 - DNA, 12 bp, Unknown
  misc_feature (1)..( 12): Matrix.003 file - promoters60/5667849
atcaataagttt

SEQ ID NO: 63381 - DNA, 10 bp, Unknown
  misc_feature (1)..( 10): Matrix.003 file - promoters60/5667849
ttatatataa

SEQ ID NO: 63382 - DNA, 8 bp, Unknown
  misc_feature (1)..( 8): Matrix.003 file - promoters60/5668073
tttgattg

SEQ ID NO: 63383 - DNA, 6 bp, Unknown
  misc_feature (1)..( 6): Matrix.003 file - promoters60/5668085
acacca

SEQ ID NO: 63384 - DNA, 6 bp, Unknown
  misc_feature (1)..( 6): Matrix.003 file - promoters60/5668085
gcatgg

SEQ ID NO: 63385 - DNA, 6 bp, Unknown
  misc_feature (1)..( 6): Matrix.003 file - promoters60/5668085
tggtat

SEQ ID NO: 63386 - DNA, 6 bp, Unknown
  misc_feature (1)..( 6): Matrix.003 file - promoters60/5668085
acaata

SEQ ID NO: 63387 - DNA, 6 bp, Unknown
  misc_feature (1)..( 6): Matrix.003 file - promoters60/5668085
gttgtg

SEQ ID NO: 63388 - DNA, 7 bp, Unknown
  misc_feature (1)..( 7): Matrix.003 file - promoters60/5668085
tgtggat

SEQ ID NO: 63389 - DNA, 8 bp, Unknown
  misc_feature (1)..( 8): Matrix.003 file - promoters60/5668085
tttagctt

SEQ ID NO: 63390 - DNA, 6 bp, Unknown
  misc_feature (1)..( 6): Matrix.003 file - promoters60/5668085
gaatta

SEQ ID NO: 63391 - DNA, 6 bp, Unknown
  misc_feature (1)..( 6): Matrix.003 file - promoters60/5668085
gcggaa

SEQ ID NO: 63392 - DNA, 6 bp, Unknown
  misc_feature (1)..( 6): Matrix.003 file - promoters60/5668085
aaagaa

SEQ ID NO: 63393 - DNA, 7 bp, Unknown
  misc_feature (1)..( 7): Matrix.003 file - promoters60/5668085
tatcttc

SEQ ID NO: 63394 - DNA, 6 bp, Unknown
  misc_feature (1)..( 6): Matrix.003 file - promoters60/5668085
tccttg

SEQ ID NO: 63395 - DNA, 7 bp, Unknown
  misc_feature (1)..( 7): Matrix.003 file - promoters60/5668085
gatatat

SEQ ID NO: 63396 - DNA, 9 bp, Unknown
  misc_feature (1)..( 9): Matrix.003 file - promoters60/5668101
tataatttg

SEQ ID NO: 63397 - DNA, 6 bp, Unknown
  misc_feature (1)..( 6): Matrix.003 file - promoters60/5668101
attcat

SEQ ID NO: 63398 - DNA, 7 bp, Unknown
  misc_feature (1)..( 7): Matrix.003 file - promoters60/5668101
ttacaat

SEQ ID NO: 63399 - DNA, 7 bp, Unknown
  misc_feature (1)..( 7): Matrix.003 file - promoters60/5668101
aatatat

SEQ ID NO: 63400 - DNA, 8 bp, Unknown
  misc_feature (1)..( 8): Matrix.003 file - promoters60/5668101
tttatgtt

SEQ ID NO: 63401 - DNA, 6 bp, Unknown
  misc_feature (1)..( 6): Matrix.003 file - promoters60/5668101
taagtt

SEQ ID NO: 63402 - DNA, 12 bp, Unknown
  misc_feature (1)..( 12): Matrix.003 file - promoters60/5668101
cttgtaaccaca

SEQ ID NO: 63403 - DNA, 6 bp, Unknown
  misc_feature (1)..( 6): Matrix.003 file - promoters60/5668101
ttaata

SEQ ID NO: 63404 - DNA, 7 bp, Unknown
  misc_feature (1)..( 7): Matrix.003 file - promoters60/5668101
tatatgt

SEQ ID NO: 63405 - DNA, 9 bp, Unknown
  misc_feature (1)..( 9): Matrix.003 file - promoters60/5668101
ctaaaaaac

SEQ ID NO: 63406 - DNA, 6 bp, Unknown
  misc_feature (1)..( 6): Matrix.003 file - promoters60/5668101
aaaaat

SEQ ID NO: 63407 - DNA, 6 bp, Unknown
  misc_feature (1)..( 6): Matrix.003 file - promoters60/5668101
atacaa

SEQ ID NO: 63408 - DNA, 6 bp, Unknown
  misc_feature (1)..( 6): Matrix.003 file - promoters60/5668101
gttttt

SEQ ID NO: 63409 - DNA, 7 bp, Unknown
  misc_feature (1)..( 7): Matrix.003 file - promoters60/5668101
tttttag

SEQ ID NO: 63410 - DNA, 6 bp, Unknown
  misc_feature (1)..( 6): Matrix.003 file - promoters60/5668101
aaagaa

SEQ ID NO: 63411 - DNA, 7 bp, Unknown
  misc_feature (1)..( 7): Matrix.003 file - promoters60/5668101
aaaaata

SEQ ID NO: 63412 - DNA, 6 bp, Unknown
  misc_feature (1)..( 6): Matrix.003 file - promoters60/5668101
atcaaa

SEQ ID NO: 63413 - DNA, 8 bp, Unknown
  misc_feature (1)..( 8): Matrix.003 file - promoters60/5668101
atcagatt

SEQ ID NO: 63414 - DNA, 6 bp, Unknown
  misc_feature (1)..( 6): Matrix.003 file - promoters60/5668101
atgtca

SEQ ID NO: 63415 - DNA, 7 bp, Unknown
  misc_feature (1)..( 7): Matrix.003 file - promoters60/5668101
tgactct

SEQ ID NO: 63416 - DNA, 7 bp, Unknown
  misc_feature (1)..( 7): Matrix.003 file - promoters60/5668101
ttgcaaa

SEQ ID NO: 63417 - DNA, 6 bp, Unknown
  misc_feature (1)..( 6): Matrix.003 file - promoters60/5668101
atatct

SEQ ID NO: 63418 - DNA, 6 bp, Unknown
  misc_feature (1)..( 6): Matrix.003 file - promoters60/5668101
ttattt

SEQ ID NO: 63419 - DNA, 7 bp, Unknown
  misc_feature (1)..( 7): Matrix.003 file - promoters60/5668101
ttgatta

SEQ ID NO: 63420 - DNA, 10 bp, Unknown
  misc_feature (1)..( 10): Matrix.003 file - promoters60/5668111
tgaaaaatcg

SEQ ID NO: 63421 - DNA, 7 bp, Unknown
  misc_feature (1)..( 7): Matrix.003 file - promoters60/5668111
aaatcaa

SEQ ID NO: 63422 - DNA, 8 bp, Unknown
  misc_feature (1)..( 8): Matrix.003 file - promoters60/5668111
tttatatt

SEQ ID NO: 63423 - DNA, 9 bp, Unknown
  misc_feature (1)..( 9): Matrix.003 file - promoters60/5668111
aaaaaccct

SEQ ID NO: 63424 - DNA, 8 bp, Unknown
  misc_feature (1)..( 8): Matrix.003 file - promoters60/5668111
tcacaaaa

SEQ ID NO: 63425 - DNA, 9 bp, Unknown
  misc_feature (1)..( 9): Matrix.003 file - promoters60/5668111
gaaaaatca

SEQ ID NO: 63426 - DNA, 9 bp, Unknown
  misc_feature (1)..( 9): Matrix.003 file - promoters60/5668294
tgacaaaaa

SEQ ID NO: 63427 - DNA, 11 bp, Unknown
  misc_feature (1)..( 11): Matrix.003 file - promoters60/5668294
acgaaattaat

SEQ ID NO: 63428 - DNA, 13 bp, Unknown
  misc_feature (1)..( 13): Matrix.003 file - promoters60/5668294
atagaagaaaaaa

SEQ ID NO: 63429 - DNA, 10 bp, Unknown
  misc_feature (1)..( 10): Matrix.003 file - promoters60/5668294
aacacaaaag

SEQ ID NO: 63430 - DNA, 10 bp, Unknown
  misc_feature (1)..( 10): Matrix.003 file - promoters60/5668317
aagaaattaa

SEQ ID NO: 63431 - DNA, 8 bp, Unknown
  misc_feature (1)..( 8): Matrix.003 file - promoters60/5668317
gaaacttt

SEQ ID NO: 63432 - DNA, 8 bp, Unknown
  misc_feature (1)..( 8): Matrix.003 file - promoters60/5668317
tttgcttc

SEQ ID NO: 63433 - DNA, 7 bp, Unknown
  misc_feature (1)..( 7): Matrix.003 file - promoters60/5668317
gtgtgtg

SEQ ID NO: 63434 - DNA, 7 bp, Unknown
  misc_feature (1)..( 7): Matrix.003 file - promoters60/5668317
gaaaaaa

SEQ ID NO: 63435 - DNA, 12 bp, Unknown
  misc_feature (1)..( 12): Matrix.003 file - promoters60/5668317
gaaaaaaagaaa

SEQ ID NO: 63436 - DNA, 9 bp, Unknown
  misc_feature (1)..( 9): Matrix.003 file - promoters60/5668325
gatgattca

SEQ ID NO: 63437 - DNA, 6 bp, Unknown
  misc_feature (1)..( 6): Matrix.003 file - promoters60/5668325
tcaaat

SEQ ID NO: 63438 - DNA, 7 bp, Unknown
  misc_feature (1)..( 7): Matrix.003 file - promoters60/5668325
tggattt

SEQ ID NO: 63439 - DNA, 7 bp, Unknown
  misc_feature (1)..( 7): Matrix.003 file - promoters60/5668325
tgcagag

SEQ ID NO: 63440 - DNA, 7 bp, Unknown
  misc_feature (1)..( 7): Matrix.003 file - promoters60/5668325
ataaatt

SEQ ID NO: 63441 - DNA, 8 bp, Unknown
  misc_feature (1)..( 8): Matrix.003 file - promoters60/5668325
tttggatt

SEQ ID NO: 63442 - DNA, 6 bp, Unknown
  misc_feature (1)..( 6): Matrix.003 file - promoters60/5668325
aagatt

SEQ ID NO: 63443 - DNA, 6 bp, Unknown
  misc_feature (1)..( 6): Matrix.003 file - promoters60/5668325
ggtgaa

SEQ ID NO: 63444 - DNA, 7 bp, Unknown
  misc_feature (1)..( 7): Matrix.003 file - promoters60/5668325
tttgata

SEQ ID NO: 63445 - DNA, 6 bp, Unknown
  misc_feature (1)..( 6): Matrix.003 file - promoters60/5668325
gaaagt

SEQ ID NO: 63446 - DNA, 9 bp, Unknown
  misc_feature (1)..( 9): Matrix.003 file - promoters60/5668325
tttgaccag

SEQ ID NO: 63447 - DNA, 15 bp, Unknown
  misc_feature (1)..( 15): Matrix.003 file - promoters60/5668329
caaaatatataaaca

SEQ ID NO: 63448 - DNA, 11 bp, Unknown
  misc_feature (1)..( 11): Matrix.003 file - promoters60/5668352
agtaatataaa

SEQ ID NO: 63449 - DNA, 7 bp, Unknown
  misc_feature (1)..( 7): Matrix.003 file - promoters60/5668352
gaaaaaa

SEQ ID NO: 63450 - DNA, 11 bp, Unknown
  misc_feature (1)..( 11): Matrix.003 file - promoters60/5668352
tttctttaact

SEQ ID NO: 63451 - DNA, 8 bp, Unknown
  misc_feature (1)..( 8): Matrix.003 file - promoters60/5668359
atggattt

SEQ ID NO: 63452 - DNA, 6 bp, Unknown
  misc_feature (1)..( 6): Matrix.003 file - promoters60/5668359
ggtgtt

SEQ ID NO: 63453 - DNA, 9 bp, Unknown
  misc_feature (1)..( 9): Matrix.003 file - promoters60/5668359
agaacagaa

SEQ ID NO: 63454 - DNA, 11 bp, Unknown
  misc_feature (1)..( 11): Matrix.003 file - promoters60/5668359
agtatccagtt

SEQ ID NO: 63455 - DNA, 7 bp, Unknown
  misc_feature (1)..( 7): Matrix.003 file - promoters60/5668359
tgcaaat

SEQ ID NO: 63456 - DNA, 13 bp, Unknown
  misc_feature (1)..( 13): Matrix.003 file - promoters60/5668359
ttgaatcaaaatt

SEQ ID NO: 63457 - DNA, 6 bp, Unknown
  misc_feature (1)..( 6): Matrix.003 file - promoters60/5668359
aagatt

SEQ ID NO: 63458 - DNA, 6 bp, Unknown
  misc_feature (1)..( 6): Matrix.003 file - promoters60/5668359
ttggtt

SEQ ID NO: 63459 - DNA, 6 bp, Unknown
  misc_feature (1)..( 6): Matrix.003 file - promoters60/5668359
ttaacc

SEQ ID NO: 63460 - DNA, 7 bp, Unknown
  misc_feature (1)..( 7): Matrix.003 file - promoters60/5668359
ctcactc

SEQ ID NO: 63461 - DNA, 6 bp, Unknown
  misc_feature (1)..( 6): Matrix.003 file - promoters60/5668359
atttct

SEQ ID NO: 63462 - DNA, 13 bp, Unknown
  misc_feature (1)..( 13): Matrix.003 file - promoters60/5668367
gagaaccaaatta

SEQ ID NO: 63463 - DNA, 9 bp, Unknown
  misc_feature (1)..( 9): Matrix.003 file - promoters60/5668367
ttttctaaa

SEQ ID NO: 63464 - DNA, 9 bp, Unknown
  misc_feature (1)..( 9): Matrix.003 file - promoters60/5668367
acaatttag

SEQ ID NO: 63465 - DNA, 9 bp, Unknown
  misc_feature (1)..( 9): Matrix.003 file - promoters60/5668367
gaaaaattt

SEQ ID NO: 63466 - DNA, 7 bp, Unknown
  misc_feature (1)..( 7): Matrix.003 file - promoters60/5668367
catgatc

SEQ ID NO: 63467 - DNA, 7 bp, Unknown
  misc_feature (1)..( 7): Matrix.003 file - promoters60/5668367
tgagttt

SEQ ID NO: 63468 - DNA, 7 bp, Unknown
  misc_feature (1)..( 7): Matrix.003 file - promoters60/5668367
aatatag

SEQ ID NO: 63469 - DNA, 6 bp, Unknown
  misc_feature (1)..( 6): Matrix.003 file - promoters60/5668367
ataata

SEQ ID NO: 63470 - DNA, 9 bp, Unknown
  misc_feature (1)..( 9): Matrix.003 file - promoters60/5668367
tccaaaaac

SEQ ID NO: 63471 - DNA, 11 bp, Unknown
  misc_feature (1)..( 11): Matrix.003 file - promoters60/5668367
ataaatacatc

SEQ ID NO: 63472 - DNA, 9 bp, Unknown
  misc_feature (1)..( 9): Matrix.003 file - promoters60/5668367
attattttc

SEQ ID NO: 63473 - DNA, 7 bp, Unknown
  misc_feature (1)..( 7): Matrix.003 file - promoters60/5668367
tatatat

SEQ ID NO: 63474 - DNA, 8 bp, Unknown
  misc_feature (1)..( 8): Matrix.003 file - promoters60/5668367
ttttatat

SEQ ID NO: 63475 - DNA, 7 bp, Unknown
  misc_feature (1)..( 7): Matrix.003 file - promoters60/5668367
ataatat

SEQ ID NO: 63476 - DNA, 14 bp, Unknown
  misc_feature (1)..( 14): Matrix.003 file - promoters60/5668367
tttttataacattt

SEQ ID NO: 63477 - DNA, 8 bp, Unknown
  misc_feature (1)..( 8): Matrix.003 file - promoters60/5668367
ttttattt

SEQ ID NO: 63478 - DNA, 7 bp, Unknown
  misc_feature (1)..( 7): Matrix.003 file - promoters60/5668367
tttaagc

SEQ ID NO: 63479 - DNA, 8 bp, Unknown
  misc_feature (1)..( 8): Matrix.003 file - promoters60/5668367
tttcatga

SEQ ID NO: 63480 - DNA, 8 bp, Unknown
  misc_feature (1)..( 8): Matrix.003 file - promoters60/5668367
attattga

SEQ ID NO: 63481 - DNA, 9 bp, Unknown
  misc_feature (1)..( 9): Matrix.003 file - promoters60/5668367
taagtaatt

SEQ ID NO: 63482 - DNA, 7 bp, Unknown
  misc_feature (1)..( 7): Matrix.003 file - promoters60/5668367
acagaaa

SEQ ID NO: 63483 - DNA, 6 bp, Unknown
  misc_feature (1)..( 6): Matrix.003 file - promoters60/5668367
attctt

SEQ ID NO: 63484 - DNA, 7 bp, Unknown
  misc_feature (1)..( 7): Matrix.003 file - promoters60/5668367
aaactat

SEQ ID NO: 63485 - DNA, 7 bp, Unknown
  misc_feature (1)..( 7): Matrix.003 file - promoters60/5668367
agatttt

SEQ ID NO: 63486 - DNA, 6 bp, Unknown
  misc_feature (1)..( 6): Matrix.003 file - promoters60/5668367
atttta

SEQ ID NO: 63487 - DNA, 7 bp, Unknown
  misc_feature (1)..( 7): Matrix.003 file - promoters60/5668367
ttaaaat

SEQ ID NO: 63488 - DNA, 6 bp, Unknown
  misc_feature (1)..( 6): Matrix.003 file - promoters60/5668367
gttttc

SEQ ID NO: 63489 - DNA, 6 bp, Unknown
  misc_feature (1)..( 6): Matrix.003 file - promoters60/5668367
aaaatt

SEQ ID NO: 63490 - DNA, 7 bp, Unknown
  misc_feature (1)..( 7): Matrix.003 file - promoters60/5668367
attgaat

SEQ ID NO: 63491 - DNA, 6 bp, Unknown
  misc_feature (1)..( 6): Matrix.003 file - promoters60/5668367
actttt

SEQ ID NO: 63492 - DNA, 8 bp, Unknown
  misc_feature (1)..( 8): Matrix.003 file - promoters60/5668367
aaacaaaa

SEQ ID NO: 63493 - DNA, 8 bp, Unknown
  misc_feature (1)..( 8): Matrix.003 file - promoters60/5668367
gaaagaca

SEQ ID NO: 63494 - DNA, 7 bp, Unknown
  misc_feature (1)..( 7): Matrix.003 file - promoters60/5668367
aaaagtc

SEQ ID NO: 63495 - DNA, 8 bp, Unknown
  misc_feature (1)..( 8): Matrix.003 file - promoters60/5668367
aaggaaga

SEQ ID NO: 63496 - DNA, 27 bp, Unknown
  misc_feature (1)..( 27): Matrix.003 file - promoters60/5668367
gtcaacaaacgatggctatacaacaag

SEQ ID NO: 63497 - DNA, 8 bp, Unknown
  misc_feature (1)..( 8): Matrix.003 file - promoters60/5668375
ttttgaaa

SEQ ID NO: 63498 - DNA, 9 bp, Unknown
  misc_feature (1)..( 9): Matrix.003 file - promoters60/5668375
tttttcttc

SEQ ID NO: 63499 - DNA, 15 bp, Unknown
  misc_feature (1)..( 15): Matrix.003 file - promoters60/5668427
tttggggtttgcttc

SEQ ID NO: 63500 - DNA, 9 bp, Unknown
  misc_feature (1)..( 9): Matrix.003 file - promoters60/5668427
taatctgat

SEQ ID NO: 63501 - DNA, 7 bp, Unknown
  misc_feature (1)..( 7): Matrix.003 file - promoters60/5668427
tacatta

SEQ ID NO: 63502 - DNA, 8 bp, Unknown
  misc_feature (1)..( 8): Matrix.003 file - promoters60/5668427
tcaggttg

SEQ ID NO: 63503 - DNA, 10 bp, Unknown
  misc_feature (1)..( 10): Matrix.003 file - promoters60/5668435
tatataaata

SEQ ID NO: 63504 - DNA, 9 bp, Unknown
  misc_feature (1)..( 9): Matrix.003 file - promoters60/5668454
acttaatta

SEQ ID NO: 63505 - DNA, 11 bp, Unknown
  misc_feature (1)..( 11): Matrix.003 file - promoters60/5668454
aaataaattct

SEQ ID NO: 63506 - DNA, 7 bp, Unknown
  misc_feature (1)..( 7): Matrix.003 file - promoters60/5668454
ttctaaa

SEQ ID NO: 63507 - DNA, 6 bp, Unknown
  misc_feature (1)..( 6): Matrix.003 file - promoters60/5668457
aaccct

SEQ ID NO: 63508 - DNA, 6 bp, Unknown
  misc_feature (1)..( 6): Matrix.003 file - promoters60/5668457
gaattt

SEQ ID NO: 63509 - DNA, 8 bp, Unknown
  misc_feature (1)..( 8): Matrix.003 file - promoters60/5668457
acataagt

SEQ ID NO: 63510 - DNA, 6 bp, Unknown
  misc_feature (1)..( 6): Matrix.003 file - promoters60/5668457
aaaaaa

SEQ ID NO: 63511 - DNA, 7 bp, Unknown
  misc_feature (1)..( 7): Matrix.003 file - promoters60/5668457
gttacta

SEQ ID NO: 63512 - DNA, 6 bp, Unknown
  misc_feature (1)..( 6): Matrix.003 file - promoters60/5668457
caaatt

SEQ ID NO: 63513 - DNA, 6 bp, Unknown
  misc_feature (1)..( 6): Matrix.003 file - promoters60/5668457
tattac

SEQ ID NO: 63514 - DNA, 6 bp, Unknown
  misc_feature (1)..( 6): Matrix.003 file - promoters60/5668457
aaaact

SEQ ID NO: 63515 - DNA, 6 bp, Unknown
  misc_feature (1)..( 6): Matrix.003 file - promoters60/5668457
ttttgg

SEQ ID NO: 63516 - DNA, 6 bp, Unknown
  misc_feature (1)..( 6): Matrix.003 file - promoters60/5668457
ggcttc

SEQ ID NO: 63517 - DNA, 8 bp, Unknown
  misc_feature (1)..( 8): Matrix.003 file - promoters60/5668457
tttatata

SEQ ID NO: 63518 - DNA, 6 bp, Unknown
  misc_feature (1)..( 6): Matrix.003 file - promoters60/5668457
ggttga

SEQ ID NO: 63519 - DNA, 6 bp, Unknown
  misc_feature (1)..( 6): Matrix.003 file - promoters60/5668457
atgcaa

SEQ ID NO: 63520 - DNA, 9 bp, Unknown
  misc_feature (1)..( 9): Matrix.003 file - promoters60/5668457
atggttact

SEQ ID NO: 63521 - DNA, 9 bp, Unknown
  misc_feature (1)..( 9): Matrix.003 file - promoters60/5668457
agcccaaag

SEQ ID NO: 63522 - DNA, 11 bp, Unknown
  misc_feature (1)..( 11): Matrix.003 file - promoters60/5668469
tccatcattta

SEQ ID NO: 63523 - DNA, 9 bp, Unknown
  misc_feature (1)..( 9): Matrix.003 file - promoters60/5668469
aataactta

SEQ ID NO: 63524 - DNA, 10 bp, Unknown
  misc_feature (1)..( 10): Matrix.003 file - promoters60/5668469
caataaaaaa

SEQ ID NO: 63525 - DNA, 7 bp, Unknown
  misc_feature (1)..( 7): Matrix.003 file - promoters60/5668469
tttgtta

SEQ ID NO: 63526 - DNA, 8 bp, Unknown
  misc_feature (1)..( 8): Matrix.003 file - promoters60/5668469
aaaattaa

SEQ ID NO: 63527 - DNA, 7 bp, Unknown
  misc_feature (1)..( 7): Matrix.003 file - promoters60/5668473
cacttta

SEQ ID NO: 63528 - DNA, 8 bp, Unknown
  misc_feature (1)..( 8): Matrix.003 file - promoters60/5668473
aaaatcac

SEQ ID NO: 63529 - DNA, 6 bp, Unknown
  misc_feature (1)..( 6): Matrix.003 file - promoters60/5668473
atttgg

SEQ ID NO: 63530 - DNA, 6 bp, Unknown
  misc_feature (1)..( 6): Matrix.003 file - promoters60/5668473
aaaact

SEQ ID NO: 63531 - DNA, 6 bp, Unknown
  misc_feature (1)..( 6): Matrix.003 file - promoters60/5668473
cgtggc

SEQ ID NO: 63532 - DNA, 7 bp, Unknown
  misc_feature (1)..( 7): Matrix.003 file - promoters60/5668473
agtatgt

SEQ ID NO: 63533 - DNA, 8 bp, Unknown
  misc_feature (1)..( 8): Matrix.003 file - promoters60/5668473
taagactc

SEQ ID NO: 63534 - DNA, 7 bp, Unknown
  misc_feature (1)..( 7): Matrix.003 file - promoters60/5668473
tttagag

SEQ ID NO: 63535 - DNA, 6 bp, Unknown
  misc_feature (1)..( 6): Matrix.003 file - promoters60/5668473
aacgtt

SEQ ID NO: 63536 - DNA, 6 bp, Unknown
  misc_feature (1)..( 6): Matrix.003 file - promoters60/5668473
ggatca

SEQ ID NO: 63537 - DNA, 6 bp, Unknown
  misc_feature (1)..( 6): Matrix.003 file - promoters60/5668473
actaaa

SEQ ID NO: 63538 - DNA, 6 bp, Unknown
  misc_feature (1)..( 6): Matrix.003 file - promoters60/5668473
aaaatt

SEQ ID NO: 63539 - DNA, 7 bp, Unknown
  misc_feature (1)..( 7): Matrix.003 file - promoters60/5668473
aatctta

SEQ ID NO: 63540 - DNA, 6 bp, Unknown
  misc_feature (1)..( 6): Matrix.003 file - promoters60/5668473
ttaaaa

SEQ ID NO: 63541 - DNA, 7 bp, Unknown
  misc_feature (1)..( 7): Matrix.003 file - promoters60/5668473
aatataa

SEQ ID NO: 63542 - DNA, 10 bp, Unknown
  misc_feature (1)..( 10): Matrix.003 file - promoters60/5668473
ttttaaactt

SEQ ID NO: 63543 - DNA, 6 bp, Unknown
  misc_feature (1)..( 6): Matrix.003 file - promoters60/5668473
aagccc

SEQ ID NO: 63544 - DNA, 9 bp, Unknown
  misc_feature (1)..( 9): Matrix.003 file - promoters60/5668493
aaatattta

SEQ ID NO: 63545 - DNA, 5 bp, Unknown
  misc_feature (1)..( 5): Matrix.003 file - promoters60/5668493
caaaa

SEQ ID NO: 63546 - DNA, 9 bp, Unknown
  misc_feature (1)..( 9): Matrix.003 file - promoters60/5668505
cttatttta

SEQ ID NO: 63547 - DNA, 12 bp, Unknown
  misc_feature (1)..( 12): Matrix.003 file - promoters60/5668505
tatgataataaa

SEQ ID NO: 63548 - DNA, 9 bp, Unknown
  misc_feature (1)..( 9): Matrix.003 file - promoters60/5668505
taagaatat

SEQ ID NO: 63549 - DNA, 8 bp, Unknown
  misc_feature (1)..( 8): Matrix.003 file - promoters60/5668505
atttgttt

SEQ ID NO: 63550 - DNA, 11 bp, Unknown
  misc_feature (1)..( 11): Matrix.003 file - promoters60/5668505
ttgcaatttta

SEQ ID NO: 63551 - DNA, 7 bp, Unknown
  misc_feature (1)..( 7): Matrix.003 file - promoters60/5668505
atatttt

SEQ ID NO: 63552 - DNA, 9 bp, Unknown
  misc_feature (1)..( 9): Matrix.003 file - promoters60/5668505
aaagaatat

SEQ ID NO: 63553 - DNA, 10 bp, Unknown
  misc_feature (1)..( 10): Matrix.003 file - promoters60/5668505
ggatataaat

SEQ ID NO: 63554 - DNA, 8 bp, Unknown
  misc_feature (1)..( 8): Matrix.003 file - promoters60/5668505
aaattgtc

SEQ ID NO: 63555 - DNA, 8 bp, Unknown
  misc_feature (1)..( 8): Matrix.003 file - promoters60/5668505
aataaaac

SEQ ID NO: 63556 - DNA, 9 bp, Unknown
  misc_feature (1)..( 9): Matrix.003 file - promoters60/5668509
aaaaaataa

SEQ ID NO: 63557 - DNA, 11 bp, Unknown
  misc_feature (1)..( 11): Matrix.003 file - promoters60/5668509
aaattaataaa

SEQ ID NO: 63558 - DNA, 7 bp, Unknown
  misc_feature (1)..( 7): Matrix.003 file - promoters60/5668509
aaaaaaa

SEQ ID NO: 63559 - DNA, 13 bp, Unknown
  misc_feature (1)..( 13): Matrix.003 file - promoters60/5668509
aatttgaataaaa

SEQ ID NO: 63560 - DNA, 10 bp, Unknown
  misc_feature (1)..( 10): Matrix.003 file - promoters60/5668509
tcacaaaaaa

SEQ ID NO: 63561 - DNA, 9 bp, Unknown
  misc_feature (1)..( 9): Matrix.003 file - promoters60/5668509
agattattt

SEQ ID NO: 63562 - DNA, 12 bp, Unknown
  misc_feature (1)..( 12): Matrix.003 file - promoters60/5668509
cccttataaata

SEQ ID NO: 63563 - DNA, 7 bp, Unknown
  misc_feature (1)..( 7): Matrix.003 file - promoters60/5668509
taaaaat

SEQ ID NO: 63564 - DNA, 11 bp, Unknown
  misc_feature (1)..( 11): Matrix.003 file - promoters60/5668509
cgccttataaa

SEQ ID NO: 63565 - DNA, 8 bp, Unknown
  misc_feature (1)..( 8): Matrix.003 file - promoters60/5668529
ccgtatct

SEQ ID NO: 63566 - DNA, 11 bp, Unknown
  misc_feature (1)..( 11): Matrix.003 file - promoters60/5668529
aaaagttgact

SEQ ID NO: 63567 - DNA, 10 bp, Unknown
  misc_feature (1)..( 10): Matrix.003 file - promoters60/5668529
ttattatgtt

SEQ ID NO: 63568 - DNA, 15 bp, Unknown
  misc_feature (1)..( 15): Matrix.003 file - promoters60/5668529
tcttttctctatata

SEQ ID NO: 63569 - DNA, 8 bp, Unknown
  misc_feature (1)..( 8): Matrix.003 file - promoters60/5668529
aaaaataa

SEQ ID NO: 63570 - DNA, 10 bp, Unknown
  misc_feature (1)..( 10): Matrix.003 file - promoters60/5668529
aacaagtata

SEQ ID NO: 63571 - DNA, 11 bp, Unknown
  misc_feature (1)..( 11): Matrix.003 file - promoters60/5668529
acaccataatt

SEQ ID NO: 63572 - DNA, 8 bp, Unknown
  misc_feature (1)..( 8): Matrix.003 file - promoters60/5668529
caaatatt

SEQ ID NO: 63573 - DNA, 10 bp, Unknown
  misc_feature (1)..( 10): Matrix.003 file - promoters60/5668533
ttcataaata

SEQ ID NO: 63574 - DNA, 12 bp, Unknown
  misc_feature (1)..( 12): Matrix.003 file - promoters60/5668537
caatattttctc

SEQ ID NO: 63575 - DNA, 11 bp, Unknown
  misc_feature (1)..( 11): Matrix.003 file - promoters60/5668537
ttttctaaaat

SEQ ID NO: 63576 - DNA, 7 bp, Unknown
  misc_feature (1)..( 7): Matrix.003 file - promoters60/5668537
ataattc

SEQ ID NO: 63577 - DNA, 9 bp, Unknown
  misc_feature (1)..( 9): Matrix.003 file - promoters60/5668537
tatttttac

SEQ ID NO: 63578 - DNA, 8 bp, Unknown
  misc_feature (1)..( 8): Matrix.003 file - promoters60/5668537
actgtatt

SEQ ID NO: 63579 - DNA, 8 bp, Unknown
  misc_feature (1)..( 8): Matrix.003 file - promoters60/5668537
tactcaat

SEQ ID NO: 63580 - DNA, 7 bp, Unknown
  misc_feature (1)..( 7): Matrix.003 file - promoters60/5668537
gtacata

SEQ ID NO: 63581 - DNA, 6 bp, Unknown
  misc_feature (1)..( 6): Matrix.003 file - promoters60/5668537
ttctta

SEQ ID NO: 63582 - DNA, 7 bp, Unknown
  misc_feature (1)..( 7): Matrix.003 file - promoters60/5668537
tgtcaat

SEQ ID NO: 63583 - DNA, 6 bp, Unknown
  misc_feature (1)..( 6): Matrix.003 file - promoters60/5668537
tttcct

SEQ ID NO: 63584 - DNA, 6 bp, Unknown
  misc_feature (1)..( 6): Matrix.003 file - promoters60/5668537
ctacat

SEQ ID NO: 63585 - DNA, 8 bp, Unknown
  misc_feature (1)..( 8): Matrix.003 file - promoters60/5668537
gaaacgac

SEQ ID NO: 63586 - DNA, 12 bp, Unknown
  misc_feature (1)..( 12): Matrix.003 file - promoters60/5668537
tagaattactaa

SEQ ID NO: 63587 - DNA, 7 bp, Unknown
  misc_feature (1)..( 7): Matrix.003 file - promoters60/5668537
taataat

SEQ ID NO: 63588 - DNA, 6 bp, Unknown
  misc_feature (1)..( 6): Matrix.003 file - promoters60/5668537
aatttt

SEQ ID NO: 63589 - DNA, 7 bp, Unknown
  misc_feature (1)..( 7): Matrix.003 file - promoters60/5668537
tatacaa

SEQ ID NO: 63590 - DNA, 7 bp, Unknown
  misc_feature (1)..( 7): Matrix.003 file - promoters60/5668537
tataatt

SEQ ID NO: 63591 - DNA, 6 bp, Unknown
  misc_feature (1)..( 6): Matrix.003 file - promoters60/5668537
aaaaaa

SEQ ID NO: 63592 - DNA, 8 bp, Unknown
  misc_feature (1)..( 8): Matrix.003 file - promoters60/5668537
taaatttc

SEQ ID NO: 63593 - DNA, 7 bp, Unknown
  misc_feature (1)..( 7): Matrix.003 file - promoters60/5668537
aagagaa

SEQ ID NO: 63594 - DNA, 8 bp, Unknown
  misc_feature (1)..( 8): Matrix.003 file - promoters60/5668537
atggcttg

SEQ ID NO: 63595 - DNA, 8 bp, Unknown
  misc_feature (1)..( 8): Matrix.003 file - promoters60/5668541
cttccatg

SEQ ID NO: 63596 - DNA, 6 bp, Unknown
  misc_feature (1)..( 6): Matrix.003 file - promoters60/5668541
ataatc

SEQ ID NO: 63597 - DNA, 6 bp, Unknown
  misc_feature (1)..( 6): Matrix.003 file - promoters60/5668541
aatttg

SEQ ID NO: 63598 - DNA, 8 bp, Unknown
  misc_feature (1)..( 8): Matrix.003 file - promoters60/5668541
cactgact

SEQ ID NO: 63599 - DNA, 7 bp, Unknown
  misc_feature (1)..( 7): Matrix.003 file - promoters60/5668541
tccaaaa

SEQ ID NO: 63600 - DNA, 7 bp, Unknown
  misc_feature (1)..( 7): Matrix.003 file - promoters60/5668541
ctcaaga

SEQ ID NO: 63601 - DNA, 6 bp, Unknown
  misc_feature (1)..( 6): Matrix.003 file - promoters60/5668541
aaaaaa

SEQ ID NO: 63602 - DNA, 7 bp, Unknown
  misc_feature (1)..( 7): Matrix.003 file - promoters60/5668541
tttaaaa

SEQ ID NO: 63603 - DNA, 8 bp, Unknown
  misc_feature (1)..( 8): Matrix.003 file - promoters60/5668541
ttgaattt

SEQ ID NO: 63604 - DNA, 6 bp, Unknown
  misc_feature (1)..( 6): Matrix.003 file - promoters60/5668541
ttttgg

SEQ ID NO: 63605 - DNA, 7 bp, Unknown
  misc_feature (1)..( 7): Matrix.003 file - promoters60/5668541
tttgttt

SEQ ID NO: 63606 - DNA, 6 bp, Unknown
  misc_feature (1)..( 6): Matrix.003 file - promoters60/5668541
tactgc

SEQ ID NO: 63607 - DNA, 6 bp, Unknown
  misc_feature (1)..( 6): Matrix.003 file - promoters60/5668541
gatctg

SEQ ID NO: 63608 - DNA, 6 bp, Unknown
  misc_feature (1)..( 6): Matrix.003 file - promoters60/5668541
tgaatt

SEQ ID NO: 63609 - DNA, 6 bp, Unknown
  misc_feature (1)..( 6): Matrix.003 file - promoters60/5668541
aaccga

SEQ ID NO: 63610 - DNA, 7 bp, Unknown
  misc_feature (1)..( 7): Matrix.003 file - promoters60/5668541
cgtcaga

SEQ ID NO: 63611 - DNA, 6 bp, Unknown
  misc_feature (1)..( 6): Matrix.003 file - promoters60/5668541
cagact

SEQ ID NO: 63612 - DNA, 6 bp, Unknown
  misc_feature (1)..( 6): Matrix.003 file - promoters60/5668541
tggttt

SEQ ID NO: 63613 - DNA, 7 bp, Unknown
  misc_feature (1)..( 7): Matrix.003 file - promoters60/5668541
agaatgt

SEQ ID NO: 63614 - DNA, 10 bp, Unknown
  misc_feature (1)..( 10): Matrix.003 file - promoters60/5668547
atgtggctga

SEQ ID NO: 63615 - DNA, 9 bp, Unknown
  misc_feature (1)..( 9): Matrix.003 file - promoters60/5668547
gtgtcctct

SEQ ID NO: 63616 - DNA, 7 bp, Unknown
  misc_feature (1)..( 7): Matrix.003 file - promoters60/5668547
ttttctt

SEQ ID NO: 63617 - DNA, 8 bp, Unknown
  misc_feature (1)..( 8): Matrix.003 file - promoters60/5668547
tgtttcta

SEQ ID NO: 63618 - DNA, 7 bp, Unknown
  misc_feature (1)..( 7): Matrix.003 file - promoters60/5668547
acgtgga

SEQ ID NO: 63619 - DNA, 7 bp, Unknown
  misc_feature (1)..( 7): Matrix.003 file - promoters60/5668547
gctgaaa

SEQ ID NO: 63620 - DNA, 13 bp, Unknown
  misc_feature (1)..( 13): Matrix.003 file - promoters60/5668566
ttcctttcttaat

SEQ ID NO: 63621 - DNA, 11 bp, Unknown
  misc_feature (1)..( 11): Matrix.003 file - promoters60/5668566
cctttcttaat

SEQ ID NO: 63622 - DNA, 6 bp, Unknown
  misc_feature (1)..( 6): Matrix.003 file - promoters60/5668566
aaatta

SEQ ID NO: 63623 - DNA, 6 bp, Unknown
  misc_feature (1)..( 6): Matrix.003 file - promoters60/5668566
aattag

SEQ ID NO: 63624 - DNA, 6 bp, Unknown
  misc_feature (1)..( 6): Matrix.003 file - promoters60/5668566
tgcaaa

SEQ ID NO: 63625 - DNA, 7 bp, Unknown
  misc_feature (1)..( 7): Matrix.003 file - promoters60/5668566
attaaaa

SEQ ID NO: 63626 - DNA, 8 bp, Unknown
  misc_feature (1)..( 8): Matrix.003 file - promoters60/5668566
agtaacac

SEQ ID NO: 63627 - DNA, 7 bp, Unknown
  misc_feature (1)..( 7): Matrix.003 file - promoters60/5668566
atatagt

SEQ ID NO: 63628 - DNA, 7 bp, Unknown
  misc_feature (1)..( 7): Matrix.003 file - promoters60/5668566
tttaata

SEQ ID NO: 63629 - DNA, 6 bp, Unknown
  misc_feature (1)..( 6): Matrix.003 file - promoters60/5668566
ttaatt

SEQ ID NO: 63630 - DNA, 7 bp, Unknown
  misc_feature (1)..( 7): Matrix.003 file - promoters60/5668566
aatcatt

SEQ ID NO: 63631 - DNA, 6 bp, Unknown
  misc_feature (1)..( 6): Matrix.003 file - promoters60/5668566
gcttta

SEQ ID NO: 63632 - DNA, 8 bp, Unknown
  misc_feature (1)..( 8): Matrix.003 file - promoters60/5668566
ggtcataa

SEQ ID NO: 63633 - DNA, 7 bp, Unknown
  misc_feature (1)..( 7): Matrix.003 file - promoters60/5668566
gttatct

SEQ ID NO: 63634 - DNA, 9 bp, Unknown
  misc_feature (1)..( 9): Matrix.003 file - promoters60/5668592
tgagctgtt

SEQ ID NO: 63635 - DNA, 8 bp, Unknown
  misc_feature (1)..( 8): Matrix.003 file - promoters60/5668592
attacttc

SEQ ID NO: 63636 - DNA, 7 bp, Unknown
  misc_feature (1)..( 7): Matrix.003 file - promoters60/5668592
agcaaat

SEQ ID NO: 63637 - DNA, 9 bp, Unknown
  misc_feature (1)..( 9): Matrix.003 file - promoters60/5668592
aaaaaagct

SEQ ID NO: 63638 - DNA, 7 bp, Unknown
  misc_feature (1)..( 7): Matrix.003 file - promoters60/5668592
taaaggg

SEQ ID NO: 63639 - DNA, 6 bp, Unknown
  misc_feature (1)..( 6): Matrix.003 file - promoters60/5668592
tgtctc

SEQ ID NO: 63640 - DNA, 6 bp, Unknown
  misc_feature (1)..( 6): Matrix.003 file - promoters60/5668592
cctctg

SEQ ID NO: 63641 - DNA, 7 bp, Unknown
  misc_feature (1)..( 7): Matrix.003 file - promoters60/5668592
gtgacat

SEQ ID NO: 63642 - DNA, 7 bp, Unknown
  misc_feature (1)..( 7): Matrix.003 file - promoters60/5668592
taacaat

SEQ ID NO: 63643 - DNA, 6 bp, Unknown
  misc_feature (1)..( 6): Matrix.003 file - promoters60/5668592
tgtttc

SEQ ID NO: 63644 - DNA, 6 bp, Unknown
  misc_feature (1)..( 6): Matrix.003 file - promoters60/5668592
ggtccc

SEQ ID NO: 63645 - DNA, 6 bp, Unknown
  misc_feature (1)..( 6): Matrix.003 file - promoters60/5668592
tattat

SEQ ID NO: 63646 - DNA, 7 bp, Unknown
  misc_feature (1)..( 7): Matrix.003 file - promoters60/5668592
tacatat

SEQ ID NO: 63647 - DNA, 6 bp, Unknown
  misc_feature (1)..( 6): Matrix.003 file - promoters60/5668592
attctt

SEQ ID NO: 63648 - DNA, 10 bp, Unknown
  misc_feature (1)..( 10): Matrix.003 file - promoters60/5668592
taataaaaat

SEQ ID NO: 63649 - DNA, 8 bp, Unknown
  misc_feature (1)..( 8): Matrix.003 file - promoters60/5668592
caaaacta

SEQ ID NO: 63650 - DNA, 6 bp, Unknown
  misc_feature (1)..( 6): Matrix.003 file - promoters60/5668592
aacttc

SEQ ID NO: 63651 - DNA, 7 bp, Unknown
  misc_feature (1)..( 7): Matrix.003 file - promoters60/5668592
tcaaggt

SEQ ID NO: 63652 - DNA, 7 bp, Unknown
  misc_feature (1)..( 7): Matrix.003 file - promoters60/5668592
attatga

SEQ ID NO: 63653 - DNA, 8 bp, Unknown
  misc_feature (1)..( 8): Matrix.003 file - promoters60/5668629
aaaaatga

SEQ ID NO: 63654 - DNA, 13 bp, Unknown
  misc_feature (1)..( 13): Matrix.003 file - promoters60/5668629
cacgtataaaatg

SEQ ID NO: 63655 - DNA, 11 bp, Unknown
  misc_feature (1)..( 11): Matrix.003 file - promoters60/5668629
tcaattttata

SEQ ID NO: 63656 - DNA, 8 bp, Unknown
  misc_feature (1)..( 8): Matrix.003 file - promoters60/5668629
atataata

SEQ ID NO: 63657 - DNA, 10 bp, Unknown
  misc_feature (1)..( 10): Matrix.003 file - promoters60/5668629
tcaattttat

SEQ ID NO: 63658 - DNA, 9 bp, Unknown
  misc_feature (1)..( 9): Matrix.003 file - promoters60/5668629
caattttat

SEQ ID NO: 63659 - DNA, 7 bp, Unknown
  misc_feature (1)..( 7): Matrix.003 file - promoters60/5668629
ctttaaa

SEQ ID NO: 63660 - DNA, 8 bp, Unknown
  misc_feature (1)..( 8): Matrix.003 file - promoters60/5668629
tatttcaa

SEQ ID NO: 63661 - DNA, 10 bp, Unknown
  misc_feature (1)..( 10): Matrix.003 file - promoters60/5668748
aaccaaaaaa

SEQ ID NO: 63662 - DNA, 14 bp, Unknown
  misc_feature (1)..( 14): Matrix.003 file - promoters60/5668748
acaataaaatgata

SEQ ID NO: 63663 - DNA, 8 bp, Unknown
  misc_feature (1)..( 8): Matrix.003 file - promoters60/5668748
aaaaaata

SEQ ID NO: 63664 - DNA, 9 bp, Unknown
  misc_feature (1)..( 9): Matrix.003 file - promoters60/5668748
tgataaaat

SEQ ID NO: 63665 - DNA, 9 bp, Unknown
  misc_feature (1)..( 9): Matrix.003 file - promoters60/5668748
aaaaatata

SEQ ID NO: 63666 - DNA, 10 bp, Unknown
  misc_feature (1)..( 10): Matrix.003 file - promoters60/5668748
tatttttcct

SEQ ID NO: 63667 - DNA, 8 bp, Unknown
  misc_feature (1)..( 8): Matrix.003 file - promoters60/5668818
ataattta

SEQ ID NO: 63668 - DNA, 10 bp, Unknown
  misc_feature (1)..( 10): Matrix.003 file - promoters60/5668818
tcataattta

SEQ ID NO: 63669 - DNA, 9 bp, Unknown
  misc_feature (1)..( 9): Matrix.003 file - promoters60/5668818
agttttatt

SEQ ID NO: 63670 - DNA, 8 bp, Unknown
  misc_feature (1)..( 8): Matrix.003 file - promoters60/5668818
tatattca

SEQ ID NO: 63671 - DNA, 10 bp, Unknown
  misc_feature (1)..( 10): Matrix.003 file - promoters60/5668818
ctcatatata

SEQ ID NO: 63672 - DNA, 12 bp, Unknown
  misc_feature (1)..( 12): Matrix.003 file - promoters60/5668818
aattaaacaaaa

SEQ ID NO: 63673 - DNA, 9 bp, Unknown
  misc_feature (1)..( 9): Matrix.003 file - promoters60/5668818
attttattt

SEQ ID NO: 63674 - DNA, 10 bp, Unknown
  misc_feature (1)..( 10): Matrix.003 file - promoters60/5668818
atttattttt

SEQ ID NO: 63675 - DNA, 11 bp, Unknown
  misc_feature (1)..( 11): Matrix.003 file - promoters60/5668818
ttaaggattaa

SEQ ID NO: 63676 - DNA, 8 bp, Unknown
  misc_feature (1)..( 8): Matrix.003 file - promoters60/5668836
ctttccga

SEQ ID NO: 63677 - DNA, 9 bp, Unknown
  misc_feature (1)..( 9): Matrix.003 file - promoters60/5668836
aaatttaag

SEQ ID NO: 63678 - DNA, 7 bp, Unknown
  misc_feature (1)..( 7): Matrix.003 file - promoters60/5668836
attttat

SEQ ID NO: 63679 - DNA, 9 bp, Unknown
  misc_feature (1)..( 9): Matrix.003 file - promoters60/5668836
aaaattaaa

SEQ ID NO: 63680 - DNA, 9 bp, Unknown
  misc_feature (1)..( 9): Matrix.003 file - promoters60/5668836
taaaaattt

SEQ ID NO: 63681 - DNA, 9 bp, Unknown
  misc_feature (1)..( 9): Matrix.003 file - promoters60/5668836
aagtaacca

SEQ ID NO: 63682 - DNA, 7 bp, Unknown
  misc_feature (1)..( 7): Matrix.003 file - promoters60/5668836
aaactaa

SEQ ID NO: 63683 - DNA, 6 bp, Unknown
  misc_feature (1)..( 6): Matrix.003 file - promoters60/5668836
ataatg

SEQ ID NO: 63684 - DNA, 7 bp, Unknown
  misc_feature (1)..( 7): Matrix.003 file - promoters60/5668836
tattaaa

SEQ ID NO: 63685 - DNA, 7 bp, Unknown
  misc_feature (1)..( 7): Matrix.003 file - promoters60/5668836
cgaaaat

SEQ ID NO: 63686 - DNA, 6 bp, Unknown
  misc_feature (1)..( 6): Matrix.003 file - promoters60/5668836
atattt

SEQ ID NO: 63687 - DNA, 7 bp, Unknown
  misc_feature (1)..( 7): Matrix.003 file - promoters60/5668836
tttagca

SEQ ID NO: 63688 - DNA, 7 bp, Unknown
  misc_feature (1)..( 7): Matrix.003 file - promoters60/5668836
tcactta

SEQ ID NO: 63689 - DNA, 9 bp, Unknown
  misc_feature (1)..( 9): Matrix.003 file - promoters60/5668860
gtgaagatt

SEQ ID NO: 63690 - DNA, 8 bp, Unknown
  misc_feature (1)..( 8): Matrix.003 file - promoters60/5668860
catagatt

SEQ ID NO: 63691 - DNA, 6 bp, Unknown
  misc_feature (1)..( 6): Matrix.003 file - promoters60/5668860
taaatt

SEQ ID NO: 63692 - DNA, 7 bp, Unknown
  misc_feature (1)..( 7): Matrix.003 file - promoters60/5668860
tttaaat

SEQ ID NO: 63693 - DNA, 8 bp, Unknown
  misc_feature (1)..( 8): Matrix.003 file - promoters60/5668860
tttgattt

SEQ ID NO: 63694 - DNA, 8 bp, Unknown
  misc_feature (1)..( 8): Matrix.003 file - promoters60/5668860
ataaagat

SEQ ID NO: 63695 - DNA, 8 bp, Unknown
  misc_feature (1)..( 8): Matrix.003 file - promoters60/5668860
gataataa

SEQ ID NO: 63696 - DNA, 7 bp, Unknown
  misc_feature (1)..( 7): Matrix.003 file - promoters60/5668860
aatagtt

SEQ ID NO: 63697 - DNA, 6 bp, Unknown
  misc_feature (1)..( 6): Matrix.003 file - promoters60/5668860
aatact

SEQ ID NO: 63698 - DNA, 6 bp, Unknown
  misc_feature (1)..( 6): Matrix.003 file - promoters60/5668860
gaagaa

SEQ ID NO: 63699 - DNA, 6 bp, Unknown
  misc_feature (1)..( 6): Matrix.003 file - promoters60/5668860
ttgcaa

SEQ ID NO: 63700 - DNA, 6 bp, Unknown
  misc_feature (1)..( 6): Matrix.003 file - promoters60/5668860
aaaaaa

SEQ ID NO: 63701 - DNA, 6 bp, Unknown
  misc_feature (1)..( 6): Matrix.003 file - promoters60/5668860
tctcta

SEQ ID NO: 63702 - DNA, 7 bp, Unknown
  misc_feature (1)..( 7): Matrix.003 file - promoters60/5668860
agtattc

SEQ ID NO: 63703 - DNA, 7 bp, Unknown
  misc_feature (1)..( 7): Matrix.003 file - promoters60/5668860
aaaagaa

SEQ ID NO: 63704 - DNA, 7 bp, Unknown
  misc_feature (1)..( 7): Matrix.003 file - promoters60/5668860
aatattg

SEQ ID NO: 63705 - DNA, 7 bp, Unknown
  misc_feature (1)..( 7): Matrix.003 file - promoters60/5668860
tttgtgt

SEQ ID NO: 63706 - DNA, 6 bp, Unknown
  misc_feature (1)..( 6): Matrix.003 file - promoters60/5668860
gctttt

SEQ ID NO: 63707 - DNA, 6 bp, Unknown
  misc_feature (1)..( 6): Matrix.003 file - promoters60/5668860
aattta

SEQ ID NO: 63708 - DNA, 7 bp, Unknown
  misc_feature (1)..( 7): Matrix.003 file - promoters60/5668882
tttctta

SEQ ID NO: 63709 - DNA, 7 bp, Unknown
  misc_feature (1)..( 7): Matrix.003 file - promoters60/5668882
tttaatc

SEQ ID NO: 63710 - DNA, 7 bp, Unknown
  misc_feature (1)..( 7): Matrix.003 file - promoters60/5668882
aaaacat

SEQ ID NO: 63711 - DNA, 8 bp, Unknown
  misc_feature (1)..( 8): Matrix.003 file - promoters60/5668882
ataagaaa

SEQ ID NO: 63712 - DNA, 9 bp, Unknown
  misc_feature (1)..( 9): Matrix.003 file - promoters60/5668882
cttacatgt

SEQ ID NO: 63713 - DNA, 9 bp, Unknown
  misc_feature (1)..( 9): Matrix.003 file - promoters60/5668882
ctagttatt

SEQ ID NO: 63714 - DNA, 7 bp, Unknown
  misc_feature (1)..( 7): Matrix.003 file - promoters60/5668882
tttaatt

SEQ ID NO: 63715 - DNA, 6 bp, Unknown
  misc_feature (1)..( 6): Matrix.003 file - promoters60/5668882
atatat

SEQ ID NO: 63716 - DNA, 6 bp, Unknown
  misc_feature (1)..( 6): Matrix.003 file - promoters60/5668882
atatta

SEQ ID NO: 63717 - DNA, 8 bp, Unknown
  misc_feature (1)..( 8): Matrix.003 file - promoters60/5668882
acgacaaa

SEQ ID NO: 63718 - DNA, 8 bp, Unknown
  misc_feature (1)..( 8): Matrix.003 file - promoters60/5668882
atttattt

SEQ ID NO: 63719 - DNA, 7 bp, Unknown
  misc_feature (1)..( 7): Matrix.003 file - promoters60/5668882
tgtttaa

SEQ ID NO: 63720 - DNA, 8 bp, Unknown
  misc_feature (1)..( 8): Matrix.003 file - promoters60/5668882
tatcttct

SEQ ID NO: 63721 - DNA, 7 bp, Unknown
  misc_feature (1)..( 7): Matrix.003 file - promoters60/5668882
taggtta

SEQ ID NO: 63722 - DNA, 9 bp, Unknown
  misc_feature (1)..( 9): Matrix.003 file - promoters60/5668882
aaagtcaaa

SEQ ID NO: 63723 - DNA, 7 bp, Unknown
  misc_feature (1)..( 7): Matrix.003 file - promoters60/5668882
catcaaa

SEQ ID NO: 63724 - DNA, 8 bp, Unknown
  misc_feature (1)..( 8): Matrix.003 file - promoters60/5668882
gaagccca

SEQ ID NO: 63725 - DNA, 8 bp, Unknown
  misc_feature (1)..( 8): Matrix.003 file - promoters60/5668897
taaaaaat

SEQ ID NO: 63726 - DNA, 6 bp, Unknown
  misc_feature (1)..( 6): Matrix.003 file - promoters60/5668903
ataata

SEQ ID NO: 63727 - DNA, 8 bp, Unknown
  misc_feature (1)..( 8): Matrix.003 file - promoters60/5668903
agaatttg

SEQ ID NO: 63728 - DNA, 9 bp, Unknown
  misc_feature (1)..( 9): Matrix.003 file - promoters60/5668903
tttaatttg

SEQ ID NO: 63729 - DNA, 7 bp, Unknown
  misc_feature (1)..( 7): Matrix.003 file - promoters60/5668903
aaaaaat

SEQ ID NO: 63730 - DNA, 8 bp, Unknown
  misc_feature (1)..( 8): Matrix.003 file - promoters60/5668903
tggcacta

SEQ ID NO: 63731 - DNA, 6 bp, Unknown
  misc_feature (1)..( 6): Matrix.003 file - promoters60/5668903
aaacga

SEQ ID NO: 63732 - DNA, 9 bp, Unknown
  misc_feature (1)..( 9): Matrix.003 file - promoters60/5668903
ataataaaa

SEQ ID NO: 63733 - DNA, 11 bp, Unknown
  misc_feature (1)..( 11): Matrix.003 file - promoters60/5668903
aaaaaaaaaaa

SEQ ID NO: 63734 - DNA, 7 bp, Unknown
  misc_feature (1)..( 7): Matrix.003 file - promoters60/5668903
ttatata

SEQ ID NO: 63735 - DNA, 9 bp, Unknown
  misc_feature (1)..( 9): Matrix.003 file - promoters60/5668903
cttccacaa

SEQ ID NO: 63736 - DNA, 7 bp, Unknown
  misc_feature (1)..( 7): Matrix.003 file - promoters60/5668903
tatcatt

SEQ ID NO: 63737 - DNA, 7 bp, Unknown
  misc_feature (1)..( 7): Matrix.003 file - promoters60/5668903
ttagatc

SEQ ID NO: 63738 - DNA, 6 bp, Unknown
  misc_feature (1)..( 6): Matrix.003 file - promoters60/5668903
catttg

SEQ ID NO: 63739 - DNA, 7 bp, Unknown
  misc_feature (1)..( 7): Matrix.003 file - promoters60/5668926
taatttt

SEQ ID NO: 63740 - DNA, 7 bp, Unknown
  misc_feature (1)..( 7): Matrix.003 file - promoters60/5668926
gtagaaa

SEQ ID NO: 63741 - DNA, 9 bp, Unknown
  misc_feature (1)..( 9): Matrix.003 file - promoters60/5668926
ctaaagtct

SEQ ID NO: 63742 - DNA, 6 bp, Unknown
  misc_feature (1)..( 6): Matrix.003 file - promoters60/5668926
tttggt

SEQ ID NO: 63743 - DNA, 9 bp, Unknown
  misc_feature (1)..( 9): Matrix.003 file - promoters60/5668926
aatgaatat

SEQ ID NO: 63744 - DNA, 6 bp, Unknown
  misc_feature (1)..( 6): Matrix.003 file - promoters60/5668926
atataa

SEQ ID NO: 63745 - DNA, 8 bp, Unknown
  misc_feature (1)..( 8): Matrix.003 file - promoters60/5668926
catttaaa

SEQ ID NO: 63746 - DNA, 7 bp, Unknown
  misc_feature (1)..( 7): Matrix.003 file - promoters60/5668926
tttgaat

SEQ ID NO: 63747 - DNA, 12 bp, Unknown
  misc_feature (1)..( 12): Matrix.003 file - promoters60/5668926
aaaaatgtgaaa

SEQ ID NO: 63748 - DNA, 7 bp, Unknown
  misc_feature (1)..( 7): Matrix.003 file - promoters60/5668926
aatctaa

SEQ ID NO: 63749 - DNA, 10 bp, Unknown
  misc_feature (1)..( 10): Matrix.003 file - promoters60/5668926
ccaattttaa

SEQ ID NO: 63750 - DNA, 8 bp, Unknown
  misc_feature (1)..( 8): Matrix.003 file - promoters60/5668926
aatagaaa

SEQ ID NO: 63751 - DNA, 9 bp, Unknown
  misc_feature (1)..( 9): Matrix.003 file - promoters60/5668926
tataaaata

SEQ ID NO: 63752 - DNA, 6 bp, Unknown
  misc_feature (1)..( 6): Matrix.003 file - promoters60/5668926
cccaaa

SEQ ID NO: 63753 - DNA, 6 bp, Unknown
  misc_feature (1)..( 6): Matrix.003 file - promoters60/5668926
attttt

SEQ ID NO: 63754 - DNA, 8 bp, Unknown
  misc_feature (1)..( 8): Matrix.003 file - promoters60/5668926
ttttaata

SEQ ID NO: 63755 - DNA, 10 bp, Unknown
  misc_feature (1)..( 10): Matrix.003 file - promoters60/5668926
tatctgagaa

SEQ ID NO: 63756 - DNA, 10 bp, Unknown
  misc_feature (1)..( 10): Matrix.003 file - promoters60/5668926
agtctatata

SEQ ID NO: 63757 - DNA, 7 bp, Unknown
  misc_feature (1)..( 7): Matrix.003 file - promoters60/5668926
tgaaatg

SEQ ID NO: 63758 - DNA, 6 bp, Unknown
  misc_feature (1)..( 6): Matrix.003 file - promoters60/5668926
aacatt

SEQ ID NO: 63759 - DNA, 7 bp, Unknown
  misc_feature (1)..( 7): Matrix.003 file - promoters60/5668926
tctcttt

SEQ ID NO: 63760 - DNA, 8 bp, Unknown
  misc_feature (1)..( 8): Matrix.003 file - promoters60/5668926
cttcctct

SEQ ID NO: 63761 - DNA, 8 bp, Unknown
  misc_feature (1)..( 8): Matrix.003 file - promoters60/5668951
caaaacaa

SEQ ID NO: 63762 - DNA, 8 bp, Unknown
  misc_feature (1)..( 8): Matrix.003 file - promoters60/5668951
attcaatt

SEQ ID NO: 63763 - DNA, 7 bp, Unknown
  misc_feature (1)..( 7): Matrix.003 file - promoters60/5668951
cttatct

SEQ ID NO: 63764 - DNA, 15 bp, Unknown
  misc_feature (1)..( 15): Matrix.003 file - promoters60/5668951
acaaaaataaatcac

SEQ ID NO: 63765 - DNA, 9 bp, Unknown
  misc_feature (1)..( 9): Matrix.003 file - promoters60/5668974
atctttttt

SEQ ID NO: 63766 - DNA, 9 bp, Unknown
  misc_feature (1)..( 9): Matrix.003 file - promoters60/5668974
aaattttat

SEQ ID NO: 63767 - DNA, 12 bp, Unknown
  misc_feature (1)..( 12): Matrix.003 file - promoters60/5668974
atcaaaatattt

SEQ ID NO: 63768 - DNA, 9 bp, Unknown
  misc_feature (1)..( 9): Matrix.003 file - promoters60/5668974
agcaaatta

SEQ ID NO: 63769 - DNA, 13 bp, Unknown
  misc_feature (1)..( 13): Matrix.003 file - promoters60/5668974
aaataacaaaata

SEQ ID NO: 63770 - DNA, 11 bp, Unknown
  misc_feature (1)..( 11): Matrix.003 file - promoters60/5668990
tagagtttgat

SEQ ID NO: 63771 - DNA, 9 bp, Unknown
  misc_feature (1)..( 9): Matrix.003 file - promoters60/5668990
tcgtagtat

SEQ ID NO: 63772 - DNA, 7 bp, Unknown
  misc_feature (1)..( 7): Matrix.003 file - promoters60/5669010
ctcatga

SEQ ID NO: 63773 - DNA, 7 bp, Unknown
  misc_feature (1)..( 7): Matrix.003 file - promoters60/5669010
aagaaaa

SEQ ID NO: 63774 - DNA, 8 bp, Unknown
  misc_feature (1)..( 8): Matrix.003 file - promoters60/5669010
atgaaaat

SEQ ID NO: 63775 - DNA, 6 bp, Unknown
  misc_feature (1)..( 6): Matrix.003 file - promoters60/5669010
tgttac

SEQ ID NO: 63776 - DNA, 8 bp, Unknown
  misc_feature (1)..( 8): Matrix.003 file - promoters60/5669010
tttataaa

SEQ ID NO: 63777 - DNA, 7 bp, Unknown
  misc_feature (1)..( 7): Matrix.003 file - promoters60/5669010
cccatct

SEQ ID NO: 63778 - DNA, 7 bp, Unknown
  misc_feature (1)..( 7): Matrix.003 file - promoters60/5669010
tgtctat

SEQ ID NO: 63779 - DNA, 7 bp, Unknown
  misc_feature (1)..( 7): Matrix.003 file - promoters60/5669010
ttgcttg

SEQ ID NO: 63780 - DNA, 6 bp, Unknown
  misc_feature (1)..( 6): Matrix.003 file - promoters60/5669010
tgattt

SEQ ID NO: 63781 - DNA, 6 bp, Unknown
  misc_feature (1)..( 6): Matrix.003 file - promoters60/5669010
ttgtgt

SEQ ID NO: 63782 - DNA, 6 bp, Unknown
  misc_feature (1)..( 6): Matrix.003 file - promoters60/5669010
tcttct

SEQ ID NO: 63783 - DNA, 8 bp, Unknown
  misc_feature (1)..( 8): Matrix.003 file - promoters60/5669013
aaatatct

SEQ ID NO: 63784 - DNA, 9 bp, Unknown
  misc_feature (1)..( 9): Matrix.003 file - promoters60/5669013
atattatat

SEQ ID NO: 63785 - DNA, 7 bp, Unknown
  misc_feature (1)..( 7): Matrix.003 file - promoters60/5669508
tttgttt

SEQ ID NO: 63786 - DNA, 7 bp, Unknown
  misc_feature (1)..( 7): Matrix.003 file - promoters60/5669546
gttcctt

SEQ ID NO: 63787 - DNA, 8 bp, Unknown
  misc_feature (1)..( 8): Matrix.003 file - promoters60/5669546
aaatgtta

SEQ ID NO: 63788 - DNA, 7 bp, Unknown
  misc_feature (1)..( 7): Matrix.003 file - promoters60/5669546
gttgatt

SEQ ID NO: 63789 - DNA, 8 bp, Unknown
  misc_feature (1)..( 8): Matrix.003 file - promoters60/5669546
cgacatgt

SEQ ID NO: 63790 - DNA, 6 bp, Unknown
  misc_feature (1)..( 6): Matrix.003 file - promoters60/5669546
acatgt

SEQ ID NO: 63791 - DNA, 8 bp, Unknown
  misc_feature (1)..( 8): Matrix.003 file - promoters60/5670300
caaaaaaa

SEQ ID NO: 63792 - DNA, 6 bp, Unknown
  misc_feature (1)..( 6): Matrix.003 file - promoters60/5670300
aaaaca

SEQ ID NO: 63793 - DNA, 8 bp, Unknown
  misc_feature (1)..( 8): Matrix.003 file - promoters60/5670300
gaaataaa

SEQ ID NO: 63794 - DNA, 7 bp, Unknown
  misc_feature (1)..( 7): Matrix.003 file - promoters60/5670300
caaattt

SEQ ID NO: 63795 - DNA, 6 bp, Unknown
  misc_feature (1)..( 6): Matrix.003 file - promoters60/5670300
ttaaaa

SEQ ID NO: 63796 - DNA, 6 bp, Unknown
  misc_feature (1)..( 6): Matrix.003 file - promoters60/5670300
gtaacg

SEQ ID NO: 63797 - DNA, 7 bp, Unknown
  misc_feature (1)..( 7): Matrix.003 file - promoters60/5670300
gtggtta

SEQ ID NO: 63798 - DNA, 10 bp, Unknown
  misc_feature (1)..( 10): Matrix.003 file - promoters60/5670300
tacgtgtcaa

SEQ ID NO: 63799 - DNA, 20 bp, Unknown
  misc_feature (1)..( 20): Matrix.003 file - promoters60/5670300
ttggctattgcttcaccgcc

SEQ ID NO: 63800 - DNA, 16 bp, Unknown
  misc_feature (1)..( 16): Matrix.003 file - promoters60/5670300
gaccgagtcgtcctcg

SEQ ID NO: 63801 - DNA, 19 bp, Unknown
  misc_feature (1)..( 19): Matrix.003 file - promoters60/5670300
ttcttcttctataaatcaa

SEQ ID NO: 63802 - DNA, 6 bp, Unknown
  misc_feature (1)..( 6): Matrix.003 file - promoters60/5670300
gcttct

SEQ ID NO: 63803 - DNA, 8 bp, Unknown
  misc_feature (1)..( 8): Matrix.003 file - promoters60/5670300
ttctggcc

SEQ ID NO: 63804 - DNA, 7 bp, Unknown
  misc_feature (1)..( 7): Matrix.003 file - promoters60/5670300
tacatat

SEQ ID NO: 63805 - DNA, 15 bp, Unknown
  misc_feature (1)..( 15): Matrix.003 file - promoters60/5670300
cgccttagctttctc

SEQ ID NO: 63806 - DNA, 6 bp, Unknown
  misc_feature (1)..( 6): Matrix.003 file - promoters60/5670300
tttttt

SEQ ID NO: 63807 - DNA, 9 bp, Unknown
  misc_feature (1)..( 9): Matrix.003 file - promoters60/5670300
acaaaaagg

SEQ ID NO: 63808 - DNA, 7 bp, Unknown
  misc_feature (1)..( 7): Matrix.003 file - promoters60/5670300
acgaaga

SEQ ID NO: 63809 - DNA, 6 bp, Unknown
  misc_feature (1)..( 6): Matrix.003 file - promoters60/5670300
gttcaa

SEQ ID NO: 63810 - DNA, 6 bp, Unknown
  misc_feature (1)..( 6): Matrix.003 file - promoters60/5670300
gtatat

SEQ ID NO: 63811 - DNA, 9 bp, Unknown
  misc_feature (1)..( 9): Matrix.003 file - promoters60/5670300
atctaatga

SEQ ID NO: 63812 - DNA, 6 bp, Unknown
  misc_feature (1)..( 6): Matrix.003 file - promoters60/5670300
tcagta

SEQ ID NO: 63813 - DNA, 6 bp, Unknown
  misc_feature (1)..( 6): Matrix.003 file - promoters60/5670300
aacaac

SEQ ID NO: 63814 - DNA, 15 bp, Unknown
  misc_feature (1)..( 15): Matrix.003 file - promoters60/5670300
aatacccaaagagct

SEQ ID NO: 63815 - DNA, 7 bp, Unknown
  misc_feature (1)..( 7): Matrix.003 file - promoters60/5670680
tatgttc

SEQ ID NO: 63816 - DNA, 7 bp, Unknown
  misc_feature (1)..( 7): Matrix.003 file - promoters60/5670680
gttctag

SEQ ID NO: 63817 - DNA, 8 bp, Unknown
  misc_feature (1)..( 8): Matrix.003 file - promoters60/5670680
ataagata

SEQ ID NO: 63818 - DNA, 6 bp, Unknown
  misc_feature (1)..( 6): Matrix.003 file - promoters60/5670680
ttttaa

SEQ ID NO: 63819 - DNA, 8 bp, Unknown
  misc_feature (1)..( 8): Matrix.003 file - promoters60/5670680
aaaaaatg

SEQ ID NO: 63820 - DNA, 6 bp, Unknown
  misc_feature (1)..( 6): Matrix.003 file - promoters60/5670680
agaaat

SEQ ID NO: 63821 - DNA, 7 bp, Unknown
  misc_feature (1)..( 7): Matrix.003 file - promoters60/5670680
ataagat

SEQ ID NO: 63822 - DNA, 9 bp, Unknown
  misc_feature (1)..( 9): Matrix.003 file - promoters60/5670680
caagacaat

SEQ ID NO: 63823 - DNA, 6 bp, Unknown
  misc_feature (1)..( 6): Matrix.003 file - promoters60/5670680
atagta

SEQ ID NO: 63824 - DNA, 6 bp, Unknown
  misc_feature (1)..( 6): Matrix.003 file - promoters60/5670680
gaaaaa

SEQ ID NO: 63825 - DNA, 8 bp, Unknown
  misc_feature (1)..( 8): Matrix.003 file - promoters60/5670680
tgaaggtg

SEQ ID NO: 63826 - DNA, 8 bp, Unknown
  misc_feature (1)..( 8): Matrix.003 file - promoters60/5670680
aaatattt

SEQ ID NO: 63827 - DNA, 9 bp, Unknown
  misc_feature (1)..( 9): Matrix.003 file - promoters60/5670680
caagctcta

SEQ ID NO: 63828 - DNA, 8 bp, Unknown
  misc_feature (1)..( 8): Matrix.003 file - promoters60/5670680
attttcat

SEQ ID NO: 63829 - DNA, 8 bp, Unknown
  misc_feature (1)..( 8): Matrix.003 file - promoters60/5670680
attttttt

SEQ ID NO: 63830 - DNA, 6 bp, Unknown
  misc_feature (1)..( 6): Matrix.003 file - promoters60/5670680
tcatat

SEQ ID NO: 63831 - DNA, 6 bp, Unknown
  misc_feature (1)..( 6): Matrix.003 file - promoters60/5670680
agaaaa

SEQ ID NO: 63832 - DNA, 6 bp, Unknown
  misc_feature (1)..( 6): Matrix.003 file - promoters60/5670680
tttcaa

SEQ ID NO: 63833 - DNA, 8 bp, Unknown
  misc_feature (1)..( 8): Matrix.003 file - promoters60/5670680
atcaaaat

SEQ ID NO: 63834 - DNA, 8 bp, Unknown
  misc_feature (1)..( 8): Matrix.003 file - promoters60/5670784
attaacaa

SEQ ID NO: 63835 - DNA, 7 bp, Unknown
  misc_feature (1)..( 7): Matrix.003 file - promoters60/5670784
aagaaag

SEQ ID NO: 63836 - DNA, 8 bp, Unknown
  misc_feature (1)..( 8): Matrix.003 file - promoters60/5670784
agaggttc

SEQ ID NO: 63837 - DNA, 7 bp, Unknown
  misc_feature (1)..( 7): Matrix.003 file - promoters60/5670784
actggtg

SEQ ID NO: 63838 - DNA, 6 bp, Unknown
  misc_feature (1)..( 6): Matrix.003 file - promoters60/5670784
catcaa

SEQ ID NO: 63839 - DNA, 6 bp, Unknown
  misc_feature (1)..( 6): Matrix.003 file - promoters60/5670784
tatgat

SEQ ID NO: 63840 - DNA, 9 bp, Unknown
  misc_feature (1)..( 9): Matrix.003 file - promoters60/5670784
aatccaaac

SEQ ID NO: 63841 - DNA, 9 bp, Unknown
  misc_feature (1)..( 9): Matrix.003 file - promoters60/5670784
tttaaaagc

SEQ ID NO: 63842 - DNA, 7 bp, Unknown
  misc_feature (1)..( 7): Matrix.003 file - promoters60/5670784
aaactga

SEQ ID NO: 63843 - DNA, 8 bp, Unknown
  misc_feature (1)..( 8): Matrix.003 file - promoters60/5670784
atttattt

SEQ ID NO: 63844 - DNA, 8 bp, Unknown
  misc_feature (1)..( 8): Matrix.003 file - promoters60/5670784
aatagtta

SEQ ID NO: 63845 - DNA, 9 bp, Unknown
  misc_feature (1)..( 9): Matrix.003 file - promoters60/5670784
gttttcgct

SEQ ID NO: 63846 - DNA, 6 bp, Unknown
  misc_feature (1)..( 6): Matrix.003 file - promoters60/5670784
ttaaca

SEQ ID NO: 63847 - DNA, 6 bp, Unknown
  misc_feature (1)..( 6): Matrix.003 file - promoters60/5670784
agatta

SEQ ID NO: 63848 - DNA, 7 bp, Unknown
  misc_feature (1)..( 7): Matrix.003 file - promoters60/5670784
atcaagc

SEQ ID NO: 63849 - DNA, 7 bp, Unknown
  misc_feature (1)..( 7): Matrix.003 file - promoters60/5670784
gtaaacc

SEQ ID NO: 63850 - DNA, 6 bp, Unknown
  misc_feature (1)..( 6): Matrix.003 file - promoters60/5670784
ctgatt

SEQ ID NO: 63851 - DNA, 9 bp, Unknown
  misc_feature (1)..( 9): Matrix.003 file - promoters60/5670809
tgacaaaaa

SEQ ID NO: 63852 - DNA, 8 bp, Unknown
  misc_feature (1)..( 8): Matrix.003 file - promoters60/5670809
agaagagc

SEQ ID NO: 63853 - DNA, 9 bp, Unknown
  misc_feature (1)..( 9): Matrix.003 file - promoters60/5670809
taaaaactt

SEQ ID NO: 63854 - DNA, 8 bp, Unknown
  misc_feature (1)..( 8): Matrix.003 file - promoters60/5670809
gcatgtga

SEQ ID NO: 63855 - DNA, 11 bp, Unknown
  misc_feature (1)..( 11): Matrix.003 file - promoters60/5671204
ctatttaaaag

SEQ ID NO: 63856 - DNA, 8 bp, Unknown
  misc_feature (1)..( 8): Matrix.003 file - promoters60/5671204
acacaaaa

SEQ ID NO: 63857 - DNA, 10 bp, Unknown
  misc_feature (1)..( 10): Matrix.003 file - promoters60/5671204
aacacaaaaa

SEQ ID NO: 63858 - DNA, 13 bp, Unknown
  misc_feature (1)..( 13): Matrix.003 file - promoters60/5671318
tatataaaaagcc

SEQ ID NO: 63859 - DNA, 11 bp, Unknown
  misc_feature (1)..( 11): Matrix.003 file - promoters60/5671318
ctatataaaaa

SEQ ID NO: 63860 - DNA, 13 bp, Unknown
  misc_feature (1)..( 13): Matrix.003 file - promoters60/5671318
taaattatataat

SEQ ID NO: 63861 - DNA, 9 bp, Unknown
  misc_feature (1)..( 9): Matrix.003 file - promoters60/5671338
tgaaatttt

SEQ ID NO: 63862 - DNA, 10 bp, Unknown
  misc_feature (1)..( 10): Matrix.003 file - promoters60/5671338
tttaatgaat

SEQ ID NO: 63863 - DNA, 10 bp, Unknown
  misc_feature (1)..( 10): Matrix.003 file - promoters60/5671338
tatgttaaaa

SEQ ID NO: 63864 - DNA, 8 bp, Unknown
  misc_feature (1)..( 8): Matrix.003 file - promoters60/5671338
aaaaaatt

SEQ ID NO: 63865 - DNA, 10 bp, Unknown
  misc_feature (1)..( 10): Matrix.003 file - promoters60/5671338
gtaaatgtaa

SEQ ID NO: 63866 - DNA, 8 bp, Unknown
  misc_feature (1)..( 8): Matrix.003 file - promoters60/5671338
attttgga

SEQ ID NO: 63867 - DNA, 9 bp, Unknown
  misc_feature (1)..( 9): Matrix.003 file - promoters60/5671347
cattgttta

SEQ ID NO: 63868 - DNA, 7 bp, Unknown
  misc_feature (1)..( 7): Matrix.003 file - promoters60/5671710
taaaaag

SEQ ID NO: 63869 - DNA, 10 bp, Unknown
  misc_feature (1)..( 10): Matrix.003 file - promoters60/5671710
gatttacaat

SEQ ID NO: 63870 - DNA, 9 bp, Unknown
  misc_feature (1)..( 9): Matrix.003 file - promoters60/5671955
taattttac

SEQ ID NO: 63871 - DNA, 6 bp, Unknown
  misc_feature (1)..( 6): Matrix.003 file - promoters60/5671955
cagaca

SEQ ID NO: 63872 - DNA, 10 bp, Unknown
  misc_feature (1)..( 10): Matrix.003 file - promoters60/5671955
caattaaaaa

SEQ ID NO: 63873 - DNA, 7 bp, Unknown
  misc_feature (1)..( 7): Matrix.003 file - promoters60/5671955
atgcgtc

SEQ ID NO: 63874 - DNA, 6 bp, Unknown
  misc_feature (1)..( 6): Matrix.003 file - promoters60/5671955
ctcaga

SEQ ID NO: 63875 - DNA, 7 bp, Unknown
  misc_feature (1)..( 7): Matrix.003 file - promoters60/5671955
attttaa

SEQ ID NO: 63876 - DNA, 6 bp, Unknown
  misc_feature (1)..( 6): Matrix.003 file - promoters60/5671955
tttctt

SEQ ID NO: 63877 - DNA, 6 bp, Unknown
  misc_feature (1)..( 6): Matrix.003 file - promoters60/5671955
gaaaaa

SEQ ID NO: 63878 - DNA, 8 bp, Unknown
  misc_feature (1)..( 8): Matrix.003 file - promoters60/5671955
aataataa

SEQ ID NO: 63879 - DNA, 6 bp, Unknown
  misc_feature (1)..( 6): Matrix.003 file - promoters60/5671955
aaagga

SEQ ID NO: 63880 - DNA, 7 bp, Unknown
  misc_feature (1)..( 7): Matrix.003 file - promoters60/5671955
aacaaag

SEQ ID NO: 63881 - DNA, 8 bp, Unknown
  misc_feature (1)..( 8): Matrix.003 file - promoters60/5671955
atttattt

SEQ ID NO: 63882 - DNA, 11 bp, Unknown
  misc_feature (1)..( 11): Matrix.003 file - promoters60/5671955
tactgtattag

SEQ ID NO: 63883 - DNA, 6 bp, Unknown
  misc_feature (1)..( 6): Matrix.003 file - promoters60/5671955
tataat

SEQ ID NO: 63884 - DNA, 8 bp, Unknown
  misc_feature (1)..( 8): Matrix.003 file - promoters60/5671955
taatatta

SEQ ID NO: 63885 - DNA, 9 bp, Unknown
  misc_feature (1)..( 9): Matrix.003 file - promoters60/5672093
caaaaaaaa

SEQ ID NO: 63886 - DNA, 11 bp, Unknown
  misc_feature (1)..( 11): Matrix.003 file - promoters60/5672093
aaaaagggcca

SEQ ID NO: 63887 - DNA, 8 bp, Unknown
  misc_feature (1)..( 8): Matrix.003 file - promoters60/5672093
actatcaa

SEQ ID NO: 63888 - DNA, 9 bp, Unknown
  misc_feature (1)..( 9): Matrix.003 file - promoters60/5672842
atatataaa

SEQ ID NO: 63889 - DNA, 10 bp, Unknown
  misc_feature (1)..( 10): Matrix.003 file - promoters60/5672842
attagtgatt

SEQ ID NO: 63890 - DNA, 8 bp, Unknown
  misc_feature (1)..( 8): Matrix.003 file - promoters60/5673124
ccaataag

SEQ ID NO: 63891 - DNA, 8 bp, Unknown
  misc_feature (1)..( 8): Matrix.003 file - promoters60/5673124
acgttatg

SEQ ID NO: 63892 - DNA, 10 bp, Unknown
  misc_feature (1)..( 10): Matrix.003 file - promoters60/5673124
ggtttatttt

SEQ ID NO: 63893 - DNA, 13 bp, Unknown
  misc_feature (1)..( 13): Matrix.003 file - promoters60/5673124
tttgattccatgt

SEQ ID NO: 63894 - DNA, 9 bp, Unknown
  misc_feature (1)..( 9): Matrix.003 file - promoters60/5673124
aacttgttg

SEQ ID NO: 63895 - DNA, 11 bp, Unknown
  misc_feature (1)..( 11): Matrix.003 file - promoters60/5673650
aattgttactt

SEQ ID NO: 63896 - DNA, 4 bp, Unknown
  misc_feature (1)..( 4): Matrix.003 file - promoters60/5673674
aaat

SEQ ID NO: 63897 - DNA, 8 bp, Unknown
  misc_feature (1)..( 8): Matrix.003 file - promoters60/5673674
aaagaaga

SEQ ID NO: 63898 - DNA, 10 bp, Unknown
  misc_feature (1)..( 10): Matrix.003 file - promoters60/5673674
atgaaagaaa

SEQ ID NO: 63899 - DNA, 6 bp, Unknown
  misc_feature (1)..( 6): Matrix.003 file - promoters60/5673674
aataaa

SEQ ID NO: 63900 - DNA, 9 bp, Unknown
  misc_feature (1)..( 9): Matrix.003 file - promoters60/5673674
gatgtgatt

SEQ ID NO: 63901 - DNA, 9 bp, Unknown
  misc_feature (1)..( 9): Matrix.003 file - promoters60/5673674
ttatcaaac

SEQ ID NO: 63902 - DNA, 12 bp, Unknown
  misc_feature (1)..( 12): Matrix.003 file - promoters60/5673674
ttcttcttttaa

SEQ ID NO: 63903 - DNA, 8 bp, Unknown
  misc_feature (1)..( 8): Matrix.003 file - promoters60/5674194
aaataaat

SEQ ID NO: 63904 - DNA, 7 bp, Unknown
  misc_feature (1)..( 7): Matrix.003 file - promoters60/5674530
acaaata

SEQ ID NO: 63905 - DNA, 9 bp, Unknown
  misc_feature (1)..( 9): Matrix.003 file - promoters60/5674530
ttagtaaca

SEQ ID NO: 63906 - DNA, 6 bp, Unknown
  misc_feature (1)..( 6): Matrix.003 file - promoters60/5674530
aaaaat

SEQ ID NO: 63907 - DNA, 8 bp, Unknown
  misc_feature (1)..( 8): Matrix.003 file - promoters60/5674530
tctaaaat

SEQ ID NO: 63908 - DNA, 6 bp, Unknown
  misc_feature (1)..( 6): Matrix.003 file - promoters60/5674530
aacaca

SEQ ID NO: 63909 - DNA, 8 bp, Unknown
  misc_feature (1)..( 8): Matrix.003 file - promoters60/5674530
acacctgt

SEQ ID NO: 63910 - DNA, 8 bp, Unknown
  misc_feature (1)..( 8): Matrix.003 file - promoters60/5674530
aaaaaaaa

SEQ ID NO: 63911 - DNA, 8 bp, Unknown
  misc_feature (1)..( 8): Matrix.003 file - promoters60/5674530
atgaagtt

SEQ ID NO: 63912 - DNA, 9 bp, Unknown
  misc_feature (1)..( 9): Matrix.003 file - promoters60/5674530
ccaaataaa

SEQ ID NO: 63913 - DNA, 6 bp, Unknown
  misc_feature (1)..( 6): Matrix.003 file - promoters60/5674530
catgaa

SEQ ID NO: 63914 - DNA, 8 bp, Unknown
  misc_feature (1)..( 8): Matrix.003 file - promoters60/5674530
acttaaat

SEQ ID NO: 63915 - DNA, 9 bp, Unknown
  misc_feature (1)..( 9): Matrix.003 file - promoters60/5674530
aaaaaggag

SEQ ID NO: 63916 - DNA, 7 bp, Unknown
  misc_feature (1)..( 7): Matrix.003 file - promoters60/5674530
aagcaaa

SEQ ID NO: 63917 - DNA, 8 bp, Unknown
  misc_feature (1)..( 8): Matrix.003 file - promoters60/5674530
tgtctaca

SEQ ID NO: 63918 - DNA, 7 bp, Unknown
  misc_feature (1)..( 7): Matrix.003 file - promoters60/5674530
tagaaaa

SEQ ID NO: 63919 - DNA, 6 bp, Unknown
  misc_feature (1)..( 6): Matrix.003 file - promoters60/5674530
aaatca

SEQ ID NO: 63920 - DNA, 9 bp, Unknown
  misc_feature (1)..( 9): Matrix.003 file - promoters60/5674530
caaacaaaa

SEQ ID NO: 63921 - DNA, 9 bp, Unknown
  misc_feature (1)..( 9): Matrix.003 file - promoters60/5674626
gattaccaa

SEQ ID NO: 63922 - DNA, 7 bp, Unknown
  misc_feature (1)..( 7): Matrix.003 file - promoters60/5674626
gaagatg

SEQ ID NO: 63923 - DNA, 6 bp, Unknown
  misc_feature (1)..( 6): Matrix.003 file - promoters60/5674626
ttaaaa

SEQ ID NO: 63924 - DNA, 7 bp, Unknown
  misc_feature (1)..( 7): Matrix.003 file - promoters60/5674626
aaaatca

SEQ ID NO: 63925 - DNA, 6 bp, Unknown
  misc_feature (1)..( 6): Matrix.003 file - promoters60/5674626
atatgt

SEQ ID NO: 63926 - DNA, 6 bp, Unknown
  misc_feature (1)..( 6): Matrix.003 file - promoters60/5674626
ttgaag

SEQ ID NO: 63927 - DNA, 7 bp, Unknown
  misc_feature (1)..( 7): Matrix.003 file - promoters60/5674626
gaaattg

SEQ ID NO: 63928 - DNA, 6 bp, Unknown
  misc_feature (1)..( 6): Matrix.003 file - promoters60/5674626
tgatat

SEQ ID NO: 63929 - DNA, 6 bp, Unknown
  misc_feature (1)..( 6): Matrix.003 file - promoters60/5674626
atataa

SEQ ID NO: 63930 - DNA, 6 bp, Unknown
  misc_feature (1)..( 6): Matrix.003 file - promoters60/5674626
tatttt

SEQ ID NO: 63931 - DNA, 7 bp, Unknown
  misc_feature (1)..( 7): Matrix.003 file - promoters60/5674626
tttattg

SEQ ID NO: 63932 - DNA, 6 bp, Unknown
  misc_feature (1)..( 6): Matrix.003 file - promoters60/5674626
aatatt

SEQ ID NO: 63933 - DNA, 7 bp, Unknown
  misc_feature (1)..( 7): Matrix.003 file - promoters60/5674626
aataaat

SEQ ID NO: 63934 - DNA, 7 bp, Unknown
  misc_feature (1)..( 7): Matrix.003 file - promoters60/5674626
ttaaaag

SEQ ID NO: 63935 - DNA, 6 bp, Unknown
  misc_feature (1)..( 6): Matrix.003 file - promoters60/5674626
ttggat

SEQ ID NO: 63936 - DNA, 7 bp, Unknown
  misc_feature (1)..( 7): Matrix.003 file - promoters60/5674626
attccca

SEQ ID NO: 63937 - DNA, 6 bp, Unknown
  misc_feature (1)..( 6): Matrix.003 file - promoters60/5674626
atccaa

SEQ ID NO: 63938 - DNA, 7 bp, Unknown
  misc_feature (1)..( 7): Matrix.003 file - promoters60/5674626
attaccg

SEQ ID NO: 63939 - DNA, 7 bp, Unknown
  misc_feature (1)..( 7): Matrix.003 file - promoters60/5674626
gctaaaa

SEQ ID NO: 63940 - DNA, 7 bp, Unknown
  misc_feature (1)..( 7): Matrix.003 file - promoters60/5674626
aaggatt

SEQ ID NO: 63941 - DNA, 9 bp, Unknown
  misc_feature (1)..( 9): Matrix.003 file - promoters60/5674666
aaaagaaat

SEQ ID NO: 63942 - DNA, 8 bp, Unknown
  misc_feature (1)..( 8): Matrix.003 file - promoters60/5674666
aaaagaaa

SEQ ID NO: 63943 - DNA, 10 bp, Unknown
  misc_feature (1)..( 10): Matrix.003 file - promoters60/5674666
agacaaaaga

SEQ ID NO: 63944 - DNA, 9 bp, Unknown
  misc_feature (1)..( 9): Matrix.003 file - promoters60/5674666
tatataaaa

SEQ ID NO: 63945 - DNA, 7 bp, Unknown
  misc_feature (1)..( 7): Matrix.003 file - promoters60/5675330
caacaga

SEQ ID NO: 63946 - DNA, 10 bp, Unknown
  misc_feature (1)..( 10): Matrix.003 file - promoters60/5675330
tttgtggtaa

SEQ ID NO: 63947 - DNA, 6 bp, Unknown
  misc_feature (1)..( 6): Matrix.003 file - promoters60/5675330
catgtt

SEQ ID NO: 63948 - DNA, 6 bp, Unknown
  misc_feature (1)..( 6): Matrix.003 file - promoters60/5675330
attgag

SEQ ID NO: 63949 - DNA, 7 bp, Unknown
  misc_feature (1)..( 7): Matrix.003 file - promoters60/5675330
taccgga

SEQ ID NO: 63950 - DNA, 8 bp, Unknown
  misc_feature (1)..( 8): Matrix.003 file - promoters60/5675330
aaacagtt

SEQ ID NO: 63951 - DNA, 8 bp, Unknown
  misc_feature (1)..( 8): Matrix.003 file - promoters60/5675330
tcaagaag

SEQ ID NO: 63952 - DNA, 6 bp, Unknown
  misc_feature (1)..( 6): Matrix.003 file - promoters60/5675330
atctgc

SEQ ID NO: 63953 - DNA, 6 bp, Unknown
  misc_feature (1)..( 6): Matrix.003 file - promoters60/5675330
tttagt

SEQ ID NO: 63954 - DNA, 7 bp, Unknown
  misc_feature (1)..( 7): Matrix.003 file - promoters60/5675330
atgattt

SEQ ID NO: 63955 - DNA, 7 bp, Unknown
  misc_feature (1)..( 7): Matrix.003 file - promoters60/5675330
gaagttg

SEQ ID NO: 63956 - DNA, 6 bp, Unknown
  misc_feature (1)..( 6): Matrix.003 file - promoters60/5675330
tgttat

SEQ ID NO: 63957 - DNA, 6 bp, Unknown
  misc_feature (1)..( 6): Matrix.003 file - promoters60/5675330
aatatc

SEQ ID NO: 63958 - DNA, 8 bp, Unknown
  misc_feature (1)..( 8): Matrix.003 file - promoters60/5675330
tgttggaa

SEQ ID NO: 63959 - DNA, 6 bp, Unknown
  misc_feature (1)..( 6): Matrix.003 file - promoters60/5675330
ggaaaa

SEQ ID NO: 63960 - DNA, 7 bp, Unknown
  misc_feature (1)..( 7): Matrix.003 file - promoters60/5675330
aaatgtt

SEQ ID NO: 63961 - DNA, 11 bp, Unknown
  misc_feature (1)..( 11): Matrix.003 file - promoters60/5675628
aacacaaatta

SEQ ID NO: 63962 - DNA, 12 bp, Unknown
  misc_feature (1)..( 12): Matrix.003 file - promoters60/5675628
tgttccatggct

SEQ ID NO: 63963 - DNA, 7 bp, Unknown
  misc_feature (1)..( 7): Matrix.003 file - promoters60/5675628
tctttgt

SEQ ID NO: 63964 - DNA, 8 bp, Unknown
  misc_feature (1)..( 8): Matrix.003 file - promoters60/5676027
ttttttat

SEQ ID NO: 63965 - DNA, 9 bp, Unknown
  misc_feature (1)..( 9): Matrix.003 file - promoters60/5676027
taatttcaa

SEQ ID NO: 63966 - DNA, 8 bp, Unknown
  misc_feature (1)..( 8): Matrix.003 file - promoters60/5676027
aaatttta

SEQ ID NO: 63967 - DNA, 13 bp, Unknown
  misc_feature (1)..( 13): Matrix.003 file - promoters60/5676027
caagtatataaat

SEQ ID NO: 63968 - DNA, 8 bp, Unknown
  misc_feature (1)..( 8): Matrix.003 file - promoters60/5676027
caattatt

SEQ ID NO: 63969 - DNA, 8 bp, Unknown
  misc_feature (1)..( 8): Matrix.003 file - promoters60/5676027
atttatat

SEQ ID NO: 63970 - DNA, 11 bp, Unknown
  misc_feature (1)..( 11): Matrix.003 file - promoters60/5676160
aagtaaatttt

SEQ ID NO: 63971 - DNA, 11 bp, Unknown
  misc_feature (1)..( 11): Matrix.003 file - promoters60/5676160
atcatatataa

SEQ ID NO: 63972 - DNA, 6 bp, Unknown
  misc_feature (1)..( 6): Matrix.003 file - promoters60/5676521
tcttct

SEQ ID NO: 63973 - DNA, 9 bp, Unknown
  misc_feature (1)..( 9): Matrix.003 file - promoters60/5676521
aaaaaagaa

SEQ ID NO: 63974 - DNA, 8 bp, Unknown
  misc_feature (1)..( 8): Matrix.003 file - promoters60/5676521
ttgatttg

SEQ ID NO: 63975 - DNA, 8 bp, Unknown
  misc_feature (1)..( 8): Matrix.003 file - promoters60/5676521
tcttatag

SEQ ID NO: 63976 - DNA, 7 bp, Unknown
  misc_feature (1)..( 7): Matrix.003 file - promoters60/5676521
ttacttc

SEQ ID NO: 63977 - DNA, 6 bp, Unknown
  misc_feature (1)..( 6): Matrix.003 file - promoters60/5676521
gtgaaa

SEQ ID NO: 63978 - DNA, 7 bp, Unknown
  misc_feature (1)..( 7): Matrix.003 file - promoters60/5676521
aaaagaa

SEQ ID NO: 63979 - DNA, 7 bp, Unknown
  misc_feature (1)..( 7): Matrix.003 file - promoters60/5676521
aaaccca

SEQ ID NO: 63980 - DNA, 7 bp, Unknown
  misc_feature (1)..( 7): Matrix.003 file - promoters60/5676521
ccgaaaa

SEQ ID NO: 63981 - DNA, 6 bp, Unknown
  misc_feature (1)..( 6): Matrix.003 file - promoters60/5676521
ttgtga

SEQ ID NO: 63982 - DNA, 6 bp, Unknown
  misc_feature (1)..( 6): Matrix.003 file - promoters60/5676521
gagatc

SEQ ID NO: 63983 - DNA, 6 bp, Unknown
  misc_feature (1)..( 6): Matrix.003 file - promoters60/5676521
gtgttt

SEQ ID NO: 63984 - DNA, 8 bp, Unknown
  misc_feature (1)..( 8): Matrix.003 file - promoters60/5676521
cttattat

SEQ ID NO: 63985 - DNA, 10 bp, Unknown
  misc_feature (1)..( 10): Matrix.003 file - promoters60/5676521
gatcttcttc

SEQ ID NO: 63986 - DNA, 9 bp, Unknown
  misc_feature (1)..( 9): Matrix.003 file - promoters60/5676647
aacctatta

SEQ ID NO: 63987 - DNA, 6 bp, Unknown
  misc_feature (1)..( 6): Matrix.003 file - promoters60/5676647
cgactg

SEQ ID NO: 63988 - DNA, 7 bp, Unknown
  misc_feature (1)..( 7): Matrix.003 file - promoters60/5676647
tttattt

SEQ ID NO: 63989 - DNA, 6 bp, Unknown
  misc_feature (1)..( 6): Matrix.003 file - promoters60/5676647
tatttt

SEQ ID NO: 63990 - DNA, 7 bp, Unknown
  misc_feature (1)..( 7): Matrix.003 file - promoters60/5676647
aaagtga

SEQ ID NO: 63991 - DNA, 10 bp, Unknown
  misc_feature (1)..( 10): Matrix.003 file - promoters60/5676647
gaatatcttt

SEQ ID NO: 63992 - DNA, 7 bp, Unknown
  misc_feature (1)..( 7): Matrix.003 file - promoters60/5676647
aagaggt

SEQ ID NO: 63993 - DNA, 7 bp, Unknown
  misc_feature (1)..( 7): Matrix.003 file - promoters60/5676647
cttatta

SEQ ID NO: 63994 - DNA, 9 bp, Unknown
  misc_feature (1)..( 9): Matrix.003 file - promoters60/5676647
taaaaatga

SEQ ID NO: 63995 - DNA, 6 bp, Unknown
  misc_feature (1)..( 6): Matrix.003 file - promoters60/5676647
aggaaa

SEQ ID NO: 63996 - DNA, 6 bp, Unknown
  misc_feature (1)..( 6): Matrix.003 file - promoters60/5676647
gacaac

SEQ ID NO: 63997 - DNA, 7 bp, Unknown
  misc_feature (1)..( 7): Matrix.003 file - promoters60/5676647
aatcatc

SEQ ID NO: 63998 - DNA, 7 bp, Unknown
  misc_feature (1)..( 7): Matrix.003 file - promoters60/5677029
attgtaa

SEQ ID NO: 63999 - DNA, 10 bp, Unknown
  misc_feature (1)..( 10): Matrix.003 file - promoters60/5677029
taaaagttaa

SEQ ID NO: 64000 - DNA, 8 bp, Unknown
  misc_feature (1)..( 8): Matrix.003 file - promoters60/5677029
taaatgaa

SEQ ID NO: 64001 - DNA, 9 bp, Unknown
  misc_feature (1)..( 9): Matrix.003 file - promoters60/5677029
gattataaa

SEQ ID NO: 64002 - DNA, 7 bp, Unknown
  misc_feature (1)..( 7): Matrix.003 file - promoters60/5677029
attataa

SEQ ID NO: 64003 - DNA, 11 bp, Unknown
  misc_feature (1)..( 11): Matrix.003 file - promoters60/5677029
attgtatattt

SEQ ID NO: 64004 - DNA, 8 bp, Unknown
  misc_feature (1)..( 8): Matrix.003 file - promoters60/5677029
aagtatat

SEQ ID NO: 64005 - DNA, 6 bp, Unknown
  misc_feature (1)..( 6): Matrix.003 file - promoters60/5677230
tgtgga

SEQ ID NO: 64006 - DNA, 6 bp, Unknown
  misc_feature (1)..( 6): Matrix.003 file - promoters60/5677230
gacatt

SEQ ID NO: 64007 - DNA, 7 bp, Unknown
  misc_feature (1)..( 7): Matrix.003 file - promoters60/5677230
aagtaaa

SEQ ID NO: 64008 - DNA, 6 bp, Unknown
  misc_feature (1)..( 6): Matrix.003 file - promoters60/5677230
tttgga

SEQ ID NO: 64009 - DNA, 7 bp, Unknown
  misc_feature (1)..( 7): Matrix.003 file - promoters60/5677230
aaaatat

SEQ ID NO: 64010 - DNA, 6 bp, Unknown
  misc_feature (1)..( 6): Matrix.003 file - promoters60/5677230
agaatt

SEQ ID NO: 64011 - DNA, 7 bp, Unknown
  misc_feature (1)..( 7): Matrix.003 file - promoters60/5677230
tttcgaa

SEQ ID NO: 64012 - DNA, 6 bp, Unknown
  misc_feature (1)..( 6): Matrix.003 file - promoters60/5677230
tttgtt

SEQ ID NO: 64013 - DNA, 6 bp, Unknown
  misc_feature (1)..( 6): Matrix.003 file - promoters60/5677230
accgtc

SEQ ID NO: 64014 - DNA, 7 bp, Unknown
  misc_feature (1)..( 7): Matrix.003 file - promoters60/5677230
aatcggg

SEQ ID NO: 64015 - DNA, 8 bp, Unknown
  misc_feature (1)..( 8): Matrix.003 file - promoters60/5677230
gaaacaaa

SEQ ID NO: 64016 - DNA, 10 bp, Unknown
  misc_feature (1)..( 10): Matrix.003 file - promoters60/5677230
ggaaaagaaa

SEQ ID NO: 64017 - DNA, 7 bp, Unknown
  misc_feature (1)..( 7): Matrix.003 file - promoters60/5677230
cccacta

SEQ ID NO: 64018 - DNA, 9 bp, Unknown
  misc_feature (1)..( 9): Matrix.003 file - promoters60/5677230
aaagaaaag

SEQ ID NO: 64019 - DNA, 7 bp, Unknown
  misc_feature (1)..( 7): Matrix.003 file - promoters60/5677230
gtatata

SEQ ID NO: 64020 - DNA, 11 bp, Unknown
  misc_feature (1)..( 11): Matrix.003 file - promoters60/5677240
taagttgttgt

SEQ ID NO: 64021 - DNA, 7 bp, Unknown
  misc_feature (1)..( 7): Matrix.003 file - promoters60/5677240
tacaaaa

SEQ ID NO: 64022 - DNA, 8 bp, Unknown
  misc_feature (1)..( 8): Matrix.003 file - promoters60/5677240
aaaaggaa

SEQ ID NO: 64023 - DNA, 8 bp, Unknown
  misc_feature (1)..( 8): Matrix.003 file - promoters60/5677240
aaaatcaa

SEQ ID NO: 64024 - DNA, 6 bp, Unknown
  misc_feature (1)..( 6): Matrix.003 file - promoters60/5677240
tcatct

SEQ ID NO: 64025 - DNA, 7 bp, Unknown
  misc_feature (1)..( 7): Matrix.003 file - promoters60/5677240
gttttgg

SEQ ID NO: 64026 - DNA, 9 bp, Unknown
  misc_feature (1)..( 9): Matrix.003 file - promoters60/5677240
taaaaattt

SEQ ID NO: 64027 - DNA, 6 bp, Unknown
  misc_feature (1)..( 6): Matrix.003 file - promoters60/5677240
ttatta

SEQ ID NO: 64028 - DNA, 8 bp, Unknown
  misc_feature (1)..( 8): Matrix.003 file - promoters60/5677240
aaaataag

SEQ ID NO: 64029 - DNA, 6 bp, Unknown
  misc_feature (1)..( 6): Matrix.003 file - promoters60/5677240
atagat

SEQ ID NO: 64030 - DNA, 7 bp, Unknown
  misc_feature (1)..( 7): Matrix.003 file - promoters60/5677240
agagata

SEQ ID NO: 64031 - DNA, 6 bp, Unknown
  misc_feature (1)..( 6): Matrix.003 file - promoters60/5677240
taagat

SEQ ID NO: 64032 - DNA, 6 bp, Unknown
  misc_feature (1)..( 6): Matrix.003 file - promoters60/5677240
aaagaa

SEQ ID NO: 64033 - DNA, 12 bp, Unknown
  misc_feature (1)..( 12): Matrix.003 file - promoters60/5677240
aaaaacaaaaca

SEQ ID NO: 64034 - DNA, 6 bp, Unknown
  misc_feature (1)..( 6): Matrix.003 file - promoters60/5677240
aaaaat

SEQ ID NO: 64035 - DNA, 6 bp, Unknown
  misc_feature (1)..( 6): Matrix.003 file - promoters60/5677240
taaccc

SEQ ID NO: 64036 - DNA, 9 bp, Unknown
  misc_feature (1)..( 9): Matrix.003 file - promoters60/5677274
attatttta

SEQ ID NO: 64037 - DNA, 8 bp, Unknown
  misc_feature (1)..( 8): Matrix.003 file - promoters60/5677274
acatttag

SEQ ID NO: 64038 - DNA, 10 bp, Unknown
  misc_feature (1)..( 10): Matrix.003 file - promoters60/5677274
tcaaaatttg

SEQ ID NO: 64039 - DNA, 11 bp, Unknown
  misc_feature (1)..( 11): Matrix.003 file - promoters60/5677274
atcttagaatt

SEQ ID NO: 64040 - DNA, 9 bp, Unknown
  misc_feature (1)..( 9): Matrix.003 file - promoters60/5677274
agatattta

SEQ ID NO: 64041 - DNA, 11 bp, Unknown
  misc_feature (1)..( 11): Matrix.003 file - promoters60/5677274
tgaaacataaa

SEQ ID NO: 64042 - DNA, 9 bp, Unknown
  misc_feature (1)..( 9): Matrix.003 file - promoters60/5677286
tctcaaact

SEQ ID NO: 64043 - DNA, 8 bp, Unknown
  misc_feature (1)..( 8): Matrix.003 file - promoters60/5677286
gagcaaaa

SEQ ID NO: 64044 - DNA, 6 bp, Unknown
  misc_feature (1)..( 6): Matrix.003 file - promoters60/5677333
ttgtca

SEQ ID NO: 64045 - DNA, 9 bp, Unknown
  misc_feature (1)..( 9): Matrix.003 file - promoters60/5677333
agagttctg

SEQ ID NO: 64046 - DNA, 8 bp, Unknown
  misc_feature (1)..( 8): Matrix.003 file - promoters60/5677333
ctgtacaa

SEQ ID NO: 64047 - DNA, 6 bp, Unknown
  misc_feature (1)..( 6): Matrix.003 file - promoters60/5677333
ccaaga

SEQ ID NO: 64048 - DNA, 6 bp, Unknown
  misc_feature (1)..( 6): Matrix.003 file - promoters60/5677333
ggttga

SEQ ID NO: 64049 - DNA, 9 bp, Unknown
  misc_feature (1)..( 9): Matrix.003 file - promoters60/5677344
ccaaaataa

SEQ ID NO: 64050 - DNA, 9 bp, Unknown
  misc_feature (1)..( 9): Matrix.003 file - promoters60/5677344
taaaattac

SEQ ID NO: 64051 - DNA, 7 bp, Unknown
  misc_feature (1)..( 7): Matrix.003 file - promoters60/5677344
attttaa

SEQ ID NO: 64052 - DNA, 13 bp, Unknown
  misc_feature (1)..( 13): Matrix.003 file - promoters60/5677344
aataaaaaaagaa

SEQ ID NO: 64053 - DNA, 10 bp, Unknown
  misc_feature (1)..( 10): Matrix.003 file - promoters60/5677344
caaaaataaa

SEQ ID NO: 64054 - DNA, 8 bp, Unknown
  misc_feature (1)..( 8): Matrix.003 file - promoters60/5677344
tttatata

SEQ ID NO: 64055 - DNA, 7 bp, Unknown
  misc_feature (1)..( 7): Matrix.003 file - promoters60/5677484
attaaat

SEQ ID NO: 64056 - DNA, 8 bp, Unknown
  misc_feature (1)..( 8): Matrix.003 file - promoters60/5677484
tgaaaaaa

SEQ ID NO: 64057 - DNA, 8 bp, Unknown
  misc_feature (1)..( 8): Matrix.003 file - promoters60/5677484
attcttta

SEQ ID NO: 64058 - DNA, 9 bp, Unknown
  misc_feature (1)..( 9): Matrix.003 file - promoters60/5677484
tcatattta

SEQ ID NO: 64059 - DNA, 7 bp, Unknown
  misc_feature (1)..( 7): Matrix.003 file - promoters60/5677484
aaaataa

SEQ ID NO: 64060 - DNA, 6 bp, Unknown
  misc_feature (1)..( 6): Matrix.003 file - promoters60/5677484
ttaatt

SEQ ID NO: 64061 - DNA, 8 bp, Unknown
  misc_feature (1)..( 8): Matrix.003 file - promoters60/5677484
atgaaata

SEQ ID NO: 64062 - DNA, 6 bp, Unknown
  misc_feature (1)..( 6): Matrix.003 file - promoters60/5677484
ataaat

SEQ ID NO: 64063 - DNA, 6 bp, Unknown
  misc_feature (1)..( 6): Matrix.003 file - promoters60/5677484
taaatt

SEQ ID NO: 64064 - DNA, 6 bp, Unknown
  misc_feature (1)..( 6): Matrix.003 file - promoters60/5677484
ttatta

SEQ ID NO: 64065 - DNA, 8 bp, Unknown
  misc_feature (1)..( 8): Matrix.003 file - promoters60/5677484
taaaatat

SEQ ID NO: 64066 - DNA, 6 bp, Unknown
  misc_feature (1)..( 6): Matrix.003 file - promoters60/5677484
aacttt

SEQ ID NO: 64067 - DNA, 9 bp, Unknown
  misc_feature (1)..( 9): Matrix.003 file - promoters60/5677484
aaaaagtaa

SEQ ID NO: 64068 - DNA, 6 bp, Unknown
  misc_feature (1)..( 6): Matrix.003 file - promoters60/5677484
tttaaa

SEQ ID NO: 64069 - DNA, 13 bp, Unknown
  misc_feature (1)..( 13): Matrix.003 file - promoters60/5677484
ttttgcactattt

SEQ ID NO: 64070 - DNA, 7 bp, Unknown
  misc_feature (1)..( 7): Matrix.003 file - promoters60/5677484
aacgtaa

SEQ ID NO: 64071 - DNA, 6 bp, Unknown
  misc_feature (1)..( 6): Matrix.003 file - promoters60/5677484
tgggcc

SEQ ID NO: 64072 - DNA, 7 bp, Unknown
  misc_feature (1)..( 7): Matrix.003 file - promoters60/5677484
tctcgaa

SEQ ID NO: 64073 - DNA, 8 bp, Unknown
  misc_feature (1)..( 8): Matrix.003 file - promoters60/5677484
tttcattt

SEQ ID NO: 64074 - DNA, 7 bp, Unknown
  misc_feature (1)..( 7): Matrix.003 file - promoters60/5677484
aataata

SEQ ID NO: 64075 - DNA, 6 bp, Unknown
  misc_feature (1)..( 6): Matrix.003 file - promoters60/5677484
tatttg

SEQ ID NO: 64076 - DNA, 7 bp, Unknown
  misc_feature (1)..( 7): Matrix.003 file - promoters60/5677484
caaaatt

SEQ ID NO: 64077 - DNA, 7 bp, Unknown
  misc_feature (1)..( 7): Matrix.003 file - promoters60/5680986
ttttcag

SEQ ID NO: 64078 - DNA, 6 bp, Unknown
  misc_feature (1)..( 6): Matrix.003 file - promoters60/5681068
cgtgga

SEQ ID NO: 64079 - DNA, 7 bp, Unknown
  misc_feature (1)..( 7): Matrix.003 file - promoters60/5681068
gctgaaa

SEQ ID NO: 64080 - DNA, 6 bp, Unknown
  misc_feature (1)..( 6): Matrix.003 file - promoters60/5681068
attcaa

SEQ ID NO: 64081 - DNA, 9 bp, Unknown
  misc_feature (1)..( 9): Matrix.003 file - promoters60/5681068
tttggattt

SEQ ID NO: 64082 - DNA, 8 bp, Unknown
  misc_feature (1)..( 8): Matrix.003 file - promoters60/5681068
cacaccgt

SEQ ID NO: 64083 - DNA, 7 bp, Unknown
  misc_feature (1)..( 7): Matrix.003 file - promoters60/5681068
gtgaatt

SEQ ID NO: 64084 - DNA, 6 bp, Unknown
  misc_feature (1)..( 6): Matrix.003 file - promoters60/5681068
ccgttg

SEQ ID NO: 64085 - DNA, 6 bp, Unknown
  misc_feature (1)..( 6): Matrix.003 file - promoters60/5681068
atcgta

SEQ ID NO: 64086 - DNA, 6 bp, Unknown
  misc_feature (1)..( 6): Matrix.003 file - promoters60/5681068
agtcga

SEQ ID NO: 64087 - DNA, 9 bp, Unknown
  misc_feature (1)..( 9): Matrix.003 file - promoters60/5681068
gtgtcctct

SEQ ID NO: 64088 - DNA, 6 bp, Unknown
  misc_feature (1)..( 6): Matrix.003 file - promoters60/5681068
aaccgt

SEQ ID NO: 64089 - DNA, 7 bp, Unknown
  misc_feature (1)..( 7): Matrix.003 file - promoters60/5681068
aatacaa

SEQ ID NO: 64090 - DNA, 7 bp, Unknown
  misc_feature (1)..( 7): Matrix.003 file - promoters60/5681068
agaaagg

SEQ ID NO: 64091 - DNA, 7 bp, Unknown
  misc_feature (1)..( 7): Matrix.003 file - promoters60/5681068
ttgaaga

SEQ ID NO: 64092 - DNA, 7 bp, Unknown
  misc_feature (1)..( 7): Matrix.003 file - promoters60/5681068
cgtggat

SEQ ID NO: 64093 - DNA, 7 bp, Unknown
  misc_feature (1)..( 7): Matrix.003 file - promoters60/5681068
catcgag

SEQ ID NO: 64094 - DNA, 6 bp, Unknown
  misc_feature (1)..( 6): Matrix.003 file - promoters60/5681068
atcgga

SEQ ID NO: 64095 - DNA, 8 bp, Unknown
  misc_feature (1)..( 8): Matrix.003 file - promoters60/5681068
gtaagttt

SEQ ID NO: 64096 - DNA, 7 bp, Unknown
  misc_feature (1)..( 7): Matrix.003 file - promoters60/5681068
ctaaaca

SEQ ID NO: 64097 - DNA, 6 bp, Unknown
  misc_feature (1)..( 6): Matrix.003 file - promoters60/5681157
acacaa

SEQ ID NO: 64098 - DNA, 10 bp, Unknown
  misc_feature (1)..( 10): Matrix.003 file - promoters60/5681157
accttaaaaa

SEQ ID NO: 64099 - DNA, 8 bp, Unknown
  misc_feature (1)..( 8): Matrix.003 file - promoters60/5681157
ctacaaaa

SEQ ID NO: 64100 - DNA, 7 bp, Unknown
  misc_feature (1)..( 7): Matrix.003 file - promoters60/5681157
aaataaa

SEQ ID NO: 64101 - DNA, 6 bp, Unknown
  misc_feature (1)..( 6): Matrix.003 file - promoters60/5681157
ttaaaa

SEQ ID NO: 64102 - DNA, 8 bp, Unknown
  misc_feature (1)..( 8): Matrix.003 file - promoters60/5681157
taaaccat

SEQ ID NO: 64103 - DNA, 12 bp, Unknown
  misc_feature (1)..( 12): Matrix.003 file - promoters60/5681157
ataaaccaaaaa

SEQ ID NO: 64104 - DNA, 7 bp, Unknown
  misc_feature (1)..( 7): Matrix.003 file - promoters60/5681157
tcaaatt

SEQ ID NO: 64105 - DNA, 9 bp, Unknown
  misc_feature (1)..( 9): Matrix.003 file - promoters60/5681157
attaccaat

SEQ ID NO: 64106 - DNA, 6 bp, Unknown
  misc_feature (1)..( 6): Matrix.003 file - promoters60/5681157
ggatcc

SEQ ID NO: 64107 - DNA, 7 bp, Unknown
  misc_feature (1)..( 7): Matrix.003 file - promoters60/5681157
tataaat

SEQ ID NO: 64108 - DNA, 7 bp, Unknown
  misc_feature (1)..( 7): Matrix.003 file - promoters60/5681157
ttggaaa

SEQ ID NO: 64109 - DNA, 6 bp, Unknown
  misc_feature (1)..( 6): Matrix.003 file - promoters60/5681157
aaataa

SEQ ID NO: 64110 - DNA, 6 bp, Unknown
  misc_feature (1)..( 6): Matrix.003 file - promoters60/5681157
ttaaaa

SEQ ID NO: 64111 - DNA, 7 bp, Unknown
  misc_feature (1)..( 7): Matrix.003 file - promoters60/5681157
aaaacct

SEQ ID NO: 64112 - DNA, 6 bp, Unknown
  misc_feature (1)..( 6): Matrix.003 file - promoters60/5681157
ttaaaa

SEQ ID NO: 64113 - DNA, 7 bp, Unknown
  misc_feature (1)..( 7): Matrix.003 file - promoters60/5681157
aaaccta

SEQ ID NO: 64114 - DNA, 9 bp, Unknown
  misc_feature (1)..( 9): Matrix.003 file - promoters60/5681157
aaaataaac

SEQ ID NO: 64115 - DNA, 6 bp, Unknown
  misc_feature (1)..( 6): Matrix.003 file - promoters60/5681157
ccaaaa

SEQ ID NO: 64116 - DNA, 6 bp, Unknown
  misc_feature (1)..( 6): Matrix.003 file - promoters60/5681157
ccaaaa

SEQ ID NO: 64117 - DNA, 7 bp, Unknown
  misc_feature (1)..( 7): Matrix.003 file - promoters60/5681157
aaaatca

SEQ ID NO: 64118 - DNA, 7 bp, Unknown
  misc_feature (1)..( 7): Matrix.003 file - promoters60/5681157
tcataaa

SEQ ID NO: 64119 - DNA, 10 bp, Unknown
  misc_feature (1)..( 10): Matrix.003 file - promoters60/5681157
caaaaattca

SEQ ID NO: 64120 - DNA, 10 bp, Unknown
  misc_feature (1)..( 10): Matrix.003 file - promoters60/5681157
tttgtaatat

SEQ ID NO: 64121 - DNA, 7 bp, Unknown
  misc_feature (1)..( 7): Matrix.003 file - promoters60/5681157
aattggt

SEQ ID NO: 64122 - DNA, 6 bp, Unknown
  misc_feature (1)..( 6): Matrix.003 file - promoters60/5681157
atatga

SEQ ID NO: 64123 - DNA, 15 bp, Unknown
  misc_feature (1)..( 15): Matrix.003 file - promoters60/5681157
ttttctttcttttcc

SEQ ID NO: 64124 - DNA, 7 bp, Unknown
  misc_feature (1)..( 7): Matrix.003 file - promoters60/5681157
acacaat

SEQ ID NO: 64125 - DNA, 7 bp, Unknown
  misc_feature (1)..( 7): Matrix.003 file - promoters60/5681157
caaaaat

SEQ ID NO: 64126 - DNA, 6 bp, Unknown
  misc_feature (1)..( 6): Matrix.003 file - promoters60/5681157
gttttt

SEQ ID NO: 64127 - DNA, 7 bp, Unknown
  misc_feature (1)..( 7): Matrix.003 file - promoters60/5681157
tattatt

SEQ ID NO: 64128 - DNA, 9 bp, Unknown
  misc_feature (1)..( 9): Matrix.003 file - promoters60/5681157
tcatacttt

SEQ ID NO: 64129 - DNA, 8 bp, Unknown
  misc_feature (1)..( 8): Matrix.003 file - promoters60/5681157
gttaaatc

SEQ ID NO: 64130 - DNA, 9 bp, Unknown
  misc_feature (1)..( 9): Matrix.003 file - promoters60/5753942
tacattgta

SEQ ID NO: 64131 - DNA, 9 bp, Unknown
  misc_feature (1)..( 9): Matrix.003 file - promoters60/5753942
caaacaaaa

SEQ ID NO: 64132 - DNA, 8 bp, Unknown
  misc_feature (1)..( 8): Matrix.003 file - promoters60/5753942
atttaggc

SEQ ID NO: 64133 - DNA, 8 bp, Unknown
  misc_feature (1)..( 8): Matrix.003 file - promoters60/5753942
aatttggg

SEQ ID NO: 64134 - DNA, 11 bp, Unknown
  misc_feature (1)..( 11): Matrix.003 file - promoters60/5753942
tttgggttttt

SEQ ID NO: 64135 - DNA, 12 bp, Unknown
  misc_feature (1)..( 12): Matrix.003 file - promoters60/5754134
gaaatctggatg

SEQ ID NO: 64136 - DNA, 8 bp, Unknown
  misc_feature (1)..( 8): Matrix.003 file - promoters60/5754265
tttaatct

SEQ ID NO: 64137 - DNA, 10 bp, Unknown
  misc_feature (1)..( 10): Matrix.003 file - promoters60/5754265
aaataacttt

SEQ ID NO: 64138 - DNA, 7 bp, Unknown
  misc_feature (1)..( 7): Matrix.003 file - promoters60/5754269
aatttac

SEQ ID NO: 64139 - DNA, 9 bp, Unknown
  misc_feature (1)..( 9): Matrix.003 file - promoters60/5754269
aaatgtgaa

SEQ ID NO: 64140 - DNA, 8 bp, Unknown
  misc_feature (1)..( 8): Matrix.003 file - promoters60/5754273
aaaaacta

SEQ ID NO: 64141 - DNA, 13 bp, Unknown
  misc_feature (1)..( 13): Matrix.003 file - promoters60/5754273
aaggcccaataaa

SEQ ID NO: 64142 - DNA, 13 bp, Unknown
  misc_feature (1)..( 13): Matrix.003 file - promoters60/5754273
ttaaaaaaataca

SEQ ID NO: 64143 - DNA, 11 bp, Unknown
  misc_feature (1)..( 11): Matrix.003 file - promoters60/5754273
ttcaaaaaata

SEQ ID NO: 64144 - DNA, 9 bp, Unknown
  misc_feature (1)..( 9): Matrix.003 file - promoters60/5754276
aattgatga

SEQ ID NO: 64145 - DNA, 7 bp, Unknown
  misc_feature (1)..( 7): Matrix.003 file - promoters60/5754276
ataaatc

SEQ ID NO: 64146 - DNA, 8 bp, Unknown
  misc_feature (1)..( 8): Matrix.003 file - promoters60/5754276
atgaataa

SEQ ID NO: 64147 - DNA, 7 bp, Unknown
  misc_feature (1)..( 7): Matrix.003 file - promoters60/5754276
ctaattg

SEQ ID NO: 64148 - DNA, 6 bp, Unknown
  misc_feature (1)..( 6): Matrix.003 file - promoters60/5754276
tagcta

SEQ ID NO: 64149 - DNA, 7 bp, Unknown
  misc_feature (1)..( 7): Matrix.003 file - promoters60/5754276
tcaattt

SEQ ID NO: 64150 - DNA, 6 bp, Unknown
  misc_feature (1)..( 6): Matrix.003 file - promoters60/5754276
atctcg

SEQ ID NO: 64151 - DNA, 6 bp, Unknown
  misc_feature (1)..( 6): Matrix.003 file - promoters60/5754276
ctaaat

SEQ ID NO: 64152 - DNA, 9 bp, Unknown
  misc_feature (1)..( 9): Matrix.003 file - promoters60/5754276
aattaaaaa

SEQ ID NO: 64153 - DNA, 9 bp, Unknown
  misc_feature (1)..( 9): Matrix.003 file - promoters60/5754276
cttttgtat

SEQ ID NO: 64154 - DNA, 6 bp, Unknown
  misc_feature (1)..( 6): Matrix.003 file - promoters60/5754276
aaaaga

SEQ ID NO: 64155 - DNA, 6 bp, Unknown
  misc_feature (1)..( 6): Matrix.003 file - promoters60/5754276
aataat

SEQ ID NO: 64156 - DNA, 8 bp, Unknown
  misc_feature (1)..( 8): Matrix.003 file - promoters60/5754276
aaacatgt

SEQ ID NO: 64157 - DNA, 9 bp, Unknown
  misc_feature (1)..( 9): Matrix.003 file - promoters60/5754276
tttatttga

SEQ ID NO: 64158 - DNA, 6 bp, Unknown
  misc_feature (1)..( 6): Matrix.003 file - promoters60/5754276
actatt

SEQ ID NO: 64159 - DNA, 8 bp, Unknown
  misc_feature (1)..( 8): Matrix.003 file - promoters60/5754276
tctcttat

SEQ ID NO: 64160 - DNA, 6 bp, Unknown
  misc_feature (1)..( 6): Matrix.003 file - promoters60/5754276
tttgta

SEQ ID NO: 64161 - DNA, 6 bp, Unknown
  misc_feature (1)..( 6): Matrix.003 file - promoters60/5754276
tcactc

SEQ ID NO: 64162 - DNA, 10 bp, Unknown
  misc_feature (1)..( 10): Matrix.003 file - promoters60/5754280
ttaaatataa

SEQ ID NO: 64163 - DNA, 11 bp, Unknown
  misc_feature (1)..( 11): Matrix.003 file - promoters60/5754419
ttaaaataata

SEQ ID NO: 64164 - DNA, 9 bp, Unknown
  misc_feature (1)..( 9): Matrix.003 file - promoters60/5754419
agttctctc

SEQ ID NO: 64165 - DNA, 8 bp, Unknown
  misc_feature (1)..( 8): Matrix.003 file - promoters60/5754419
aaataatt

SEQ ID NO: 64166 - DNA, 7 bp, Unknown
  misc_feature (1)..( 7): Matrix.003 file - promoters60/5754461
gaattca

SEQ ID NO: 64167 - DNA, 11 bp, Unknown
  misc_feature (1)..( 11): Matrix.003 file - promoters60/5754461
cacaaaataat

SEQ ID NO: 64168 - DNA, 7 bp, Unknown
  misc_feature (1)..( 7): Matrix.003 file - promoters60/5755107
gtgtttc

SEQ ID NO: 64169 - DNA, 7 bp, Unknown
  misc_feature (1)..( 7): Matrix.003 file - promoters60/5755107
ggttttg

SEQ ID NO: 64170 - DNA, 6 bp, Unknown
  misc_feature (1)..( 6): Matrix.003 file - promoters60/5755107
attgga

SEQ ID NO: 64171 - DNA, 11 bp, Unknown
  misc_feature (1)..( 11): Matrix.003 file - promoters60/5755107
acaattaagcc

SEQ ID NO: 64172 - DNA, 7 bp, Unknown
  misc_feature (1)..( 7): Matrix.003 file - promoters60/5755107
tttcata

SEQ ID NO: 64173 - DNA, 7 bp, Unknown
  misc_feature (1)..( 7): Matrix.003 file - promoters60/5755107
aaacaat

SEQ ID NO: 64174 - DNA, 7 bp, Unknown
  misc_feature (1)..( 7): Matrix.003 file - promoters60/5755846
atttgat

SEQ ID NO: 64175 - DNA, 9 bp, Unknown
  misc_feature (1)..( 9): Matrix.003 file - promoters60/5755846
aatgttgat

SEQ ID NO: 64176 - DNA, 13 bp, Unknown
  misc_feature (1)..( 13): Matrix.003 file - promoters60/5755846
ttctaaaacataa

SEQ ID NO: 64177 - DNA, 16 bp, Unknown
  misc_feature (1)..( 16): Matrix.003 file - promoters60/5755846
aaaagttttatgttta

SEQ ID NO: 64178 - DNA, 9 bp, Unknown
  misc_feature (1)..( 9): Matrix.003 file - promoters60/5755846
aaatttaat

SEQ ID NO: 64179 - DNA, 11 bp, Unknown
  misc_feature (1)..( 11): Matrix.003 file - promoters60/5755846
ttttggtattg

SEQ ID NO: 64180 - DNA, 10 bp, Unknown
  misc_feature (1)..( 10): Matrix.003 file - promoters60/5755846
tgtttaacat

SEQ ID NO: 64181 - DNA, 9 bp, Unknown
  misc_feature (1)..( 9): Matrix.003 file - promoters60/5756166
aaagtgtaa

SEQ ID NO: 64182 - DNA, 12 bp, Unknown
  misc_feature (1)..( 12): Matrix.003 file - promoters60/5756166
gttacaatgttt

SEQ ID NO: 64183 - DNA, 8 bp, Unknown
  misc_feature (1)..( 8): Matrix.003 file - promoters60/5756166
tttcaatt

SEQ ID NO: 64184 - DNA, 10 bp, Unknown
  misc_feature (1)..( 10): Matrix.003 file - promoters60/5756166
attcatttta

SEQ ID NO: 64185 - DNA, 9 bp, Unknown
  misc_feature (1)..( 9): Matrix.003 file - promoters60/5756166
tcctcttaa

SEQ ID NO: 64186 - DNA, 6 bp, Unknown
  misc_feature (1)..( 6): Matrix.003 file - promoters60/5756489
ttcaaa

SEQ ID NO: 64187 - DNA, 8 bp, Unknown
  misc_feature (1)..( 8): Matrix.003 file - promoters60/5756489
gttcattt

SEQ ID NO: 64188 - DNA, 8 bp, Unknown
  misc_feature (1)..( 8): Matrix.003 file - promoters60/5756489
ctcatccc

SEQ ID NO: 64189 - DNA, 6 bp, Unknown
  misc_feature (1)..( 6): Matrix.003 file - promoters60/5756489
actaat

SEQ ID NO: 64190 - DNA, 6 bp, Unknown
  misc_feature (1)..( 6): Matrix.003 file - promoters60/5756489
atttac

SEQ ID NO: 64191 - DNA, 6 bp, Unknown
  misc_feature (1)..( 6): Matrix.003 file - promoters60/5756489
gttatc

SEQ ID NO: 64192 - DNA, 7 bp, Unknown
  misc_feature (1)..( 7): Matrix.003 file - promoters60/5756489
attgtaa

SEQ ID NO: 64193 - DNA, 6 bp, Unknown
  misc_feature (1)..( 6): Matrix.003 file - promoters60/5756489
tgtaat

SEQ ID NO: 64194 - DNA, 6 bp, Unknown
  misc_feature (1)..( 6): Matrix.003 file - promoters60/5756489
atacaa

SEQ ID NO: 64195 - DNA, 6 bp, Unknown
  misc_feature (1)..( 6): Matrix.003 file - promoters60/5756489
tttaca

SEQ ID NO: 64196 - DNA, 7 bp, Unknown
  misc_feature (1)..( 7): Matrix.003 file - promoters60/5756489
aaaatct

SEQ ID NO: 64197 - DNA, 7 bp, Unknown
  misc_feature (1)..( 7): Matrix.003 file - promoters60/5756489
actaaac

SEQ ID NO: 64198 - DNA, 7 bp, Unknown
  misc_feature (1)..( 7): Matrix.003 file - promoters60/5756489
ccaaata

SEQ ID NO: 64199 - DNA, 6 bp, Unknown
  misc_feature (1)..( 6): Matrix.003 file - promoters60/5756489
ttattc

SEQ ID NO: 64200 - DNA, 11 bp, Unknown
  misc_feature (1)..( 11): Matrix.003 file - promoters60/5758021
tcttaggattt

SEQ ID NO: 64201 - DNA, 11 bp, Unknown
  misc_feature (1)..( 11): Matrix.003 file - promoters60/5758021
gttcaaaaaaa

SEQ ID NO: 64202 - DNA, 7 bp, Unknown
  misc_feature (1)..( 7): Matrix.003 file - promoters60/5758021
atgggcc

SEQ ID NO: 64203 - DNA, 11 bp, Unknown
  misc_feature (1)..( 11): Matrix.003 file - promoters60/5758021
aaaattttttt

SEQ ID NO: 64204 - DNA, 6 bp, Unknown
  misc_feature (1)..( 6): Matrix.003 file - promoters60/5759305
aatact

SEQ ID NO: 64205 - DNA, 8 bp, Unknown
  misc_feature (1)..( 8): Matrix.003 file - promoters60/5759305
atatataa

SEQ ID NO: 64206 - DNA, 11 bp, Unknown
  misc_feature (1)..( 11): Matrix.003 file - promoters60/5759305
tttctttattt

SEQ ID NO: 64207 - DNA, 7 bp, Unknown
  misc_feature (1)..( 7): Matrix.003 file - promoters60/5759305
attatca

SEQ ID NO: 64208 - DNA, 7 bp, Unknown
  misc_feature (1)..( 7): Matrix.003 file - promoters60/5759305
tagaaaa

SEQ ID NO: 64209 - DNA, 7 bp, Unknown
  misc_feature (1)..( 7): Matrix.003 file - promoters60/5759305
atggatg

SEQ ID NO: 64210 - DNA, 12 bp, Unknown
  misc_feature (1)..( 12): Matrix.003 file - promoters60/5759305
taaggcaaattt

SEQ ID NO: 64211 - DNA, 8 bp, Unknown
  misc_feature (1)..( 8): Matrix.003 file - promoters60/5759305
tattaaaa

SEQ ID NO: 64212 - DNA, 10 bp, Unknown
  misc_feature (1)..( 10): Matrix.003 file - promoters60/5759305
tttatacaat

SEQ ID NO: 64213 - DNA, 6 bp, Unknown
  misc_feature (1)..( 6): Matrix.003 file - promoters60/5759305
agaaaa

SEQ ID NO: 64214 - DNA, 8 bp, Unknown
  misc_feature (1)..( 8): Matrix.003 file - promoters60/5759305
aaaaaata

SEQ ID NO: 64215 - DNA, 6 bp, Unknown
  misc_feature (1)..( 6): Matrix.003 file - promoters60/5759305
ctaaac

SEQ ID NO: 64216 - DNA, 6 bp, Unknown
  misc_feature (1)..( 6): Matrix.003 file - promoters60/5759305
caaaat

SEQ ID NO: 64217 - DNA, 6 bp, Unknown
  misc_feature (1)..( 6): Matrix.003 file - promoters60/5759305
ccatac

SEQ ID NO: 64218 - DNA, 6 bp, Unknown
  misc_feature (1)..( 6): Matrix.003 file - promoters60/5759305
cacgtg

SEQ ID NO: 64219 - DNA, 8 bp, Unknown
  misc_feature (1)..( 8): Matrix.003 file - promoters60/5759305
atgccagc

SEQ ID NO: 64220 - DNA, 7 bp, Unknown
  misc_feature (1)..( 7): Matrix.003 file - promoters60/5759305
gtgagat

SEQ ID NO: 64221 - DNA, 7 bp, Unknown
  misc_feature (1)..( 7): Matrix.003 file - promoters60/5759305
gaagaga

SEQ ID NO: 64222 - DNA, 9 bp, Unknown
  misc_feature (1)..( 9): Matrix.003 file - promoters60/5773091
ttttgttgt

SEQ ID NO: 64223 - DNA, 10 bp, Unknown
  misc_feature (1)..( 10): Matrix.003 file - promoters60/5773091
atataaagat

SEQ ID NO: 64224 - DNA, 9 bp, Unknown
  misc_feature (1)..( 9): Matrix.003 file - promoters60/5773759
cttttttta

SEQ ID NO: 64225 - DNA, 8 bp, Unknown
  misc_feature (1)..( 8): Matrix.003 file - promoters60/5773759
aatcgcat

SEQ ID NO: 64226 - DNA, 9 bp, Unknown
  misc_feature (1)..( 9): Matrix.003 file - promoters60/5773759
aaattttaa

SEQ ID NO: 64227 - DNA, 12 bp, Unknown
  misc_feature (1)..( 12): Matrix.003 file - promoters60/5773759
tttagcaataag

SEQ ID NO: 64228 - DNA, 8 bp, Unknown
  misc_feature (1)..( 8): Matrix.003 file - promoters60/5773772
gatctttt

SEQ ID NO: 64229 - DNA, 9 bp, Unknown
  misc_feature (1)..( 9): Matrix.003 file - promoters60/5773772
aattacatt

SEQ ID NO: 64230 - DNA, 6 bp, Unknown
  misc_feature (1)..( 6): Matrix.003 file - promoters60/5773772
attttt

SEQ ID NO: 64231 - DNA, 11 bp, Unknown
  misc_feature (1)..( 11): Matrix.003 file - promoters60/5773772
ttgattcacat

SEQ ID NO: 64232 - DNA, 8 bp, Unknown
  misc_feature (1)..( 8): Matrix.003 file - promoters60/5774545
tcttcact

SEQ ID NO: 64233 - DNA, 6 bp, Unknown
  misc_feature (1)..( 6): Matrix.003 file - promoters60/5774545
tctaat

SEQ ID NO: 64234 - DNA, 6 bp, Unknown
  misc_feature (1)..( 6): Matrix.003 file - promoters60/5774545
acaagt

SEQ ID NO: 64235 - DNA, 7 bp, Unknown
  misc_feature (1)..( 7): Matrix.003 file - promoters60/5774545
aatccgc

SEQ ID NO: 64236 - DNA, 10 bp, Unknown
  misc_feature (1)..( 10): Matrix.003 file - promoters60/5774545
tgagcttgat

SEQ ID NO: 64237 - DNA, 6 bp, Unknown
  misc_feature (1)..( 6): Matrix.003 file - promoters60/5774545
tcaaaa

SEQ ID NO: 64238 - DNA, 6 bp, Unknown
  misc_feature (1)..( 6): Matrix.003 file - promoters60/5774545
aaaacc

SEQ ID NO: 64239 - DNA, 8 bp, Unknown
  misc_feature (1)..( 8): Matrix.003 file - promoters60/5774545
tattatat

SEQ ID NO: 64240 - DNA, 8 bp, Unknown
  misc_feature (1)..( 8): Matrix.003 file - promoters60/5774545
tttataaa

SEQ ID NO: 64241 - DNA, 8 bp, Unknown
  misc_feature (1)..( 8): Matrix.003 file - promoters60/5774545
tctacgtc

SEQ ID NO: 64242 - DNA, 7 bp, Unknown
  misc_feature (1)..( 7): Matrix.003 file - promoters60/5774545
tcaccac

SEQ ID NO: 64243 - DNA, 7 bp, Unknown
  misc_feature (1)..( 7): Matrix.003 file - promoters60/5774545
aatgtat

SEQ ID NO: 64244 - DNA, 6 bp, Unknown
  misc_feature (1)..( 6): Matrix.003 file - promoters60/5774545
tgtctt

SEQ ID NO: 64245 - DNA, 8 bp, Unknown
  misc_feature (1)..( 8): Matrix.003 file - promoters60/5774545
atcaatgt

SEQ ID NO: 64246 - DNA, 7 bp, Unknown
  misc_feature (1)..( 7): Matrix.003 file - promoters60/5776417
ttttagt

SEQ ID NO: 64247 - DNA, 11 bp, Unknown
  misc_feature (1)..( 11): Matrix.003 file - promoters60/5776417
tttagtttttg

SEQ ID NO: 64248 - DNA, 10 bp, Unknown
  misc_feature (1)..( 10): Matrix.003 file - promoters60/5776417
tttatttttg

SEQ ID NO: 64249 - DNA, 12 bp, Unknown
  misc_feature (1)..( 12): Matrix.003 file - promoters60/5776425
aaataattgtat

SEQ ID NO: 64250 - DNA, 10 bp, Unknown
  misc_feature (1)..( 10): Matrix.003 file - promoters60/5776425
gaaatagatt

SEQ ID NO: 64251 - DNA, 11 bp, Unknown
  misc_feature (1)..( 11): Matrix.003 file - promoters60/5776425
ttacttaaatt

SEQ ID NO: 64252 - DNA, 9 bp, Unknown
  misc_feature (1)..( 9): Matrix.003 file - promoters60/5776545
tttttattt

SEQ ID NO: 64253 - DNA, 14 bp, Unknown
  misc_feature (1)..( 14): Matrix.003 file - promoters60/5776545
atgttaacaaaaca

SEQ ID NO: 64254 - DNA, 10 bp, Unknown
  misc_feature (1)..( 10): Matrix.003 file - promoters60/5776545
aaaataaatt

SEQ ID NO: 64255 - DNA, 11 bp, Unknown
  misc_feature (1)..( 11): Matrix.003 file - promoters60/5776545
tataaaaataa

SEQ ID NO: 64256 - DNA, 9 bp, Unknown
  misc_feature (1)..( 9): Matrix.003 file - promoters60/5776545
ttgatataa

SEQ ID NO: 64257 - DNA, 9 bp, Unknown
  misc_feature (1)..( 9): Matrix.003 file - promoters60/5776545
ctttttaaa

SEQ ID NO: 64258 - DNA, 10 bp, Unknown
  misc_feature (1)..( 10): Matrix.003 file - promoters50/1006957
caaactaggc

SEQ ID NO: 64259 - DNA, 8 bp, Unknown
  misc_feature (1)..( 8): Matrix.003 file - promoters50/1006957
gaaaggag

SEQ ID NO: 64260 - DNA, 9 bp, Unknown
  misc_feature (1)..( 9): Matrix.003 file - promoters50/1006965
cttgaagat

SEQ ID NO: 64261 - DNA, 7 bp, Unknown
  misc_feature (1)..( 7): Matrix.003 file - promoters50/1006965
aaaaatc

SEQ ID NO: 64262 - DNA, 10 bp, Unknown
  misc_feature (1)..( 10): Matrix.003 file - promoters50/1007014
actaaaaaag

SEQ ID NO: 64263 - DNA, 15 bp, Unknown
  misc_feature (1)..( 15): Matrix.003 file - promoters50/1007030
tagaatatatagagt

SEQ ID NO: 64264 - DNA, 13 bp, Unknown
  misc_feature (1)..( 13): Matrix.003 file - promoters50/1007030
atataatataata

SEQ ID NO: 64265 - DNA, 13 bp, Unknown
  misc_feature (1)..( 13): Matrix.003 file - promoters50/1007030
tataaatagtaaa

SEQ ID NO: 64266 - DNA, 10 bp, Unknown
  misc_feature (1)..( 10): Matrix.003 file - promoters50/1007030
aatctgaaaa

SEQ ID NO: 64267 - DNA, 11 bp, Unknown
  misc_feature (1)..( 11): Matrix.003 file - promoters50/1007030
tatcaaaaata

SEQ ID NO: 64268 - DNA, 10 bp, Unknown
  misc_feature (1)..( 10): Matrix.003 file - promoters50/1007030
ctttataaaa

SEQ ID NO: 64269 - DNA, 8 bp, Unknown
  misc_feature (1)..( 8): Matrix.003 file - promoters50/1007030
ctaaaaat

SEQ ID NO: 64270 - DNA, 8 bp, Unknown
  misc_feature (1)..( 8): Matrix.003 file - promoters50/1007030
taaaaaaa

SEQ ID NO: 64271 - DNA, 8 bp, Unknown
  misc_feature (1)..( 8): Matrix.003 file - promoters50/1007058
ggtatgat

SEQ ID NO: 64272 - DNA, 9 bp, Unknown
  misc_feature (1)..( 9): Matrix.003 file - promoters50/1007092
atatttttt

SEQ ID NO: 64273 - DNA, 8 bp, Unknown
  misc_feature (1)..( 8): Matrix.003 file - promoters50/1007092
aattgatt

SEQ ID NO: 64274 - DNA, 10 bp, Unknown
  misc_feature (1)..( 10): Matrix.003 file - promoters50/1007139
tttcaacaaa

SEQ ID NO: 64275 - DNA, 9 bp, Unknown
  misc_feature (1)..( 9): Matrix.003 file - promoters50/1007139
aaagttcag

SEQ ID NO: 64276 - DNA, 11 bp, Unknown
  misc_feature (1)..( 11): Matrix.003 file - promoters50/1007139
taaatatatgt

SEQ ID NO: 64277 - DNA, 10 bp, Unknown
  misc_feature (1)..( 10): Matrix.003 file - promoters50/1007152
attttgatta

SEQ ID NO: 64278 - DNA, 11 bp, Unknown
  misc_feature (1)..( 11): Matrix.003 file - promoters50/1007152
ttcttcaaaaa

SEQ ID NO: 64279 - DNA, 10 bp, Unknown
  misc_feature (1)..( 10): Matrix.003 file - promoters50/1007152
tcttcaaaaa

SEQ ID NO: 64280 - DNA, 6 bp, Unknown
  misc_feature (1)..( 6): Matrix.003 file - promoters50/1007187
aatttt

SEQ ID NO: 64281 - DNA, 9 bp, Unknown
  misc_feature (1)..( 9): Matrix.003 file - promoters50/1007187
aatttattt

SEQ ID NO: 64282 - DNA, 9 bp, Unknown
  misc_feature (1)..( 9): Matrix.003 file - promoters50/1007187
aatattttt

SEQ ID NO: 64283 - DNA, 9 bp, Unknown
  misc_feature (1)..( 9): Matrix.003 file - promoters50/1007187
tgttaatct

SEQ ID NO: 64284 - DNA, 7 bp, Unknown
  misc_feature (1)..( 7): Matrix.003 file - promoters50/1007187
tttttct

SEQ ID NO: 64285 - DNA, 8 bp, Unknown
  misc_feature (1)..( 8): Matrix.003 file - promoters50/1007258
attaatta

SEQ ID NO: 64286 - DNA, 7 bp, Unknown
  misc_feature (1)..( 7): Matrix.003 file - promoters50/1007258
atttaca

SEQ ID NO: 64287 - DNA, 7 bp, Unknown
  misc_feature (1)..( 7): Matrix.003 file - promoters50/1007258
gtttaat

SEQ ID NO: 64288 - DNA, 11 bp, Unknown
  misc_feature (1)..( 11): Matrix.003 file - promoters50/1007258
gttctaaataa

SEQ ID NO: 64289 - DNA, 7 bp, Unknown
  misc_feature (1)..( 7): Matrix.003 file - promoters50/1007258
tttttgt

SEQ ID NO: 64290 - DNA, 6 bp, Unknown
  misc_feature (1)..( 6): Matrix.003 file - promoters50/1007258
ttttta

SEQ ID NO: 64291 - DNA, 10 bp, Unknown
  misc_feature (1)..( 10): Matrix.003 file - promoters50/1007258
ttacattttt

SEQ ID NO: 64292 - DNA, 8 bp, Unknown
  misc_feature (1)..( 8): Matrix.003 file - promoters50/1007258
ttttgttt

SEQ ID NO: 64293 - DNA, 10 bp, Unknown
  misc_feature (1)..( 10): Matrix.003 file - promoters50/1007269
taaacgtttt

SEQ ID NO: 64294 - DNA, 12 bp, Unknown
  misc_feature (1)..( 12): Matrix.003 file - promoters50/1007269
taaattttaaaa

SEQ ID NO: 64295 - DNA, 11 bp, Unknown
  misc_feature (1)..( 11): Matrix.003 file - promoters50/1007269
cttagtatttt

SEQ ID NO: 64296 - DNA, 8 bp, Unknown
  misc_feature (1)..( 8): Matrix.003 file - promoters50/1007269
taaaaaag

SEQ ID NO: 64297 - DNA, 10 bp, Unknown
  misc_feature (1)..( 10): Matrix.003 file - promoters50/1007273
tggaaaagat

SEQ ID NO: 64298 - DNA, 8 bp, Unknown
  misc_feature (1)..( 8): Matrix.003 file - promoters50/1007273
cttgaatc

SEQ ID NO: 64299 - DNA, 8 bp, Unknown
  misc_feature (1)..( 8): Matrix.003 file - promoters50/1007286
attttgtt

SEQ ID NO: 64300 - DNA, 14 bp, Unknown
  misc_feature (1)..( 14): Matrix.003 file - promoters50/1007286
aactcattttctta

SEQ ID NO: 64301 - DNA, 8 bp, Unknown
  misc_feature (1)..( 8): Matrix.003 file - promoters50/1007286
aatttata

SEQ ID NO: 64302 - DNA, 9 bp, Unknown
  misc_feature (1)..( 9): Matrix.003 file - promoters50/1007289
aatgaatta

SEQ ID NO: 64303 - DNA, 9 bp, Unknown
  misc_feature (1)..( 9): Matrix.003 file - promoters50/1007289
aataatata

SEQ ID NO: 64304 - DNA, 14 bp, Unknown
  misc_feature (1)..( 14): Matrix.003 file - promoters50/1007289
atatcaattttttt

SEQ ID NO: 64305 - DNA, 10 bp, Unknown
  misc_feature (1)..( 10): Matrix.003 file - promoters50/1007289
aattaaataa

SEQ ID NO: 64306 - DNA, 7 bp, Unknown
  misc_feature (1)..( 7): Matrix.003 file - promoters50/1007289
aaataaa

SEQ ID NO: 64307 - DNA, 9 bp, Unknown
  misc_feature (1)..( 9): Matrix.003 file - promoters50/1007289
aattataaa

SEQ ID NO: 64308 - DNA, 8 bp, Unknown
  misc_feature (1)..( 8): Matrix.003 file - promoters50/1007370
caataatt

SEQ ID NO: 64309 - DNA, 8 bp, Unknown
  misc_feature (1)..( 8): Matrix.003 file - promoters50/1007554
tataacaa

SEQ ID NO: 64310 - DNA, 6 bp, Unknown
  misc_feature (1)..( 6): Matrix.003 file - promoters50/1007554
tttaat

SEQ ID NO: 64311 - DNA, 7 bp, Unknown
  misc_feature (1)..( 7): Matrix.003 file - promoters50/1007554
aaattat

SEQ ID NO: 64312 - DNA, 11 bp, Unknown
  misc_feature (1)..( 11): Matrix.003 file - promoters50/1007554
atataataata

SEQ ID NO: 64313 - DNA, 10 bp, Unknown
  misc_feature (1)..( 10): Matrix.003 file - promoters50/1007576
ctggaaaatg

SEQ ID NO: 64314 - DNA, 16 bp, Unknown
  misc_feature (1)..( 16): Matrix.003 file - promoters50/1007639
ttattgagtaaaacat

SEQ ID NO: 64315 - DNA, 10 bp, Unknown
  misc_feature (1)..( 10): Matrix.003 file - promoters50/1007639
ataaaaacaa

SEQ ID NO: 64316 - DNA, 15 bp, Unknown
  misc_feature (1)..( 15): Matrix.003 file - promoters50/1007639
ttacagaaatataaa

SEQ ID NO: 64317 - DNA, 13 bp, Unknown
  misc_feature (1)..( 13): Matrix.003 file - promoters50/1007639
agtgtttgctgac

SEQ ID NO: 64318 - DNA, 9 bp, Unknown
  misc_feature (1)..( 9): Matrix.003 file - promoters50/1007639
agtttgata

SEQ ID NO: 64319 - DNA, 14 bp, Unknown
  misc_feature (1)..( 14): Matrix.003 file - promoters50/1007639
atatcatttgaatt

SEQ ID NO: 64320 - DNA, 6 bp, Unknown
  misc_feature (1)..( 6): Matrix.003 file - promoters50/1007639
aaaaac

SEQ ID NO: 64321 - DNA, 12 bp, Unknown
  misc_feature (1)..( 12): Matrix.003 file - promoters50/1007675
aataaatgggaa

SEQ ID NO: 64322 - DNA, 6 bp, Unknown
  misc_feature (1)..( 6): Matrix.003 file - promoters50/1007675
taaaaa

SEQ ID NO: 64323 - DNA, 9 bp, Unknown
  misc_feature (1)..( 9): Matrix.003 file - promoters50/1007675
ctaaaaaaa

SEQ ID NO: 64324 - DNA, 9 bp, Unknown
  misc_feature (1)..( 9): Matrix.003 file - promoters50/1007675
tatataaaa

SEQ ID NO: 64325 - DNA, 6 bp, Unknown
  misc_feature (1)..( 6): Matrix.003 file - promoters50/1007731
atttac

SEQ ID NO: 64326 - DNA, 12 bp, Unknown
  misc_feature (1)..( 12): Matrix.003 file - promoters50/1007756
aacctgtttatt

SEQ ID NO: 64327 - DNA, 8 bp, Unknown
  misc_feature (1)..( 8): Matrix.003 file - promoters50/1007773
gaaaaagg

SEQ ID NO: 64328 - DNA, 9 bp, Unknown
  misc_feature (1)..( 9): Matrix.003 file - promoters50/1007791
attgtttat

SEQ ID NO: 64329 - DNA, 9 bp, Unknown
  misc_feature (1)..( 9): Matrix.003 file - promoters50/1007791
ttgctttct

SEQ ID NO: 64330 - DNA, 10 bp, Unknown
  misc_feature (1)..( 10): Matrix.003 file - promoters50/1007791
caatgttgaa

SEQ ID NO: 64331 - DNA, 10 bp, Unknown
  misc_feature (1)..( 10): Matrix.003 file - promoters50/1007791
aacaactttt

SEQ ID NO: 64332 - DNA, 7 bp, Unknown
  misc_feature (1)..( 7): Matrix.003 file - promoters50/1007791
aaagttt

SEQ ID NO: 64333 - DNA, 8 bp, Unknown
  misc_feature (1)..( 8): Matrix.003 file - promoters50/1007791
gttttgtg

SEQ ID NO: 64334 - DNA, 12 bp, Unknown
  misc_feature (1)..( 12): Matrix.003 file - promoters50/1007795
actatttaaatt

SEQ ID NO: 64335 - DNA, 10 bp, Unknown
  misc_feature (1)..( 10): Matrix.003 file - promoters50/1007795
agaaaattta

SEQ ID NO: 64336 - DNA, 8 bp, Unknown
  misc_feature (1)..( 8): Matrix.003 file - promoters50/1007795
aaaaataa

SEQ ID NO: 64337 - DNA, 12 bp, Unknown
  misc_feature (1)..( 12): Matrix.003 file - promoters50/1007795
gtatatgatttt

SEQ ID NO: 64338 - DNA, 10 bp, Unknown
  misc_feature (1)..( 10): Matrix.003 file - promoters50/1007795
tttataaaat

SEQ ID NO: 64339 - DNA, 13 bp, Unknown
  misc_feature (1)..( 13): Matrix.003 file - promoters50/1007795
gattttatattga

SEQ ID NO: 64340 - DNA, 13 bp, Unknown
  misc_feature (1)..( 13): Matrix.003 file - promoters50/1007795
attaattttattt

SEQ ID NO: 64341 - DNA, 9 bp, Unknown
  misc_feature (1)..( 9): Matrix.003 file - promoters50/1007795
aaaaaattt

SEQ ID NO: 64342 - DNA, 11 bp, Unknown
  misc_feature (1)..( 11): Matrix.003 file - promoters50/1007795
aaaataaacaa

SEQ ID NO: 64343 - DNA, 10 bp, Unknown
  misc_feature (1)..( 10): Matrix.003 file - promoters50/1007795
tttataattt

SEQ ID NO: 64344 - DNA, 12 bp, Unknown
  misc_feature (1)..( 12): Matrix.003 file - promoters50/1007802
gataaaatttgt

SEQ ID NO: 64345 - DNA, 12 bp, Unknown
  misc_feature (1)..( 12): Matrix.003 file - promoters50/1007831
gttaaataatta

SEQ ID NO: 64346 - DNA, 9 bp, Unknown
  misc_feature (1)..( 9): Matrix.003 file - promoters50/1007831
aaccttttt

SEQ ID NO: 64347 - DNA, 12 bp, Unknown
  misc_feature (1)..( 12): Matrix.003 file - promoters50/1007831
cttaaaaaaaga

SEQ ID NO: 64348 - DNA, 11 bp, Unknown
  misc_feature (1)..( 11): Matrix.003 file - promoters50/1007967
acaatttgaaa

SEQ ID NO: 64349 - DNA, 9 bp, Unknown
  misc_feature (1)..( 9): Matrix.003 file - promoters50/1008070
cttatatat

SEQ ID NO: 64350 - DNA, 7 bp, Unknown
  misc_feature (1)..( 7): Matrix.003 file - promoters50/1008070
atttcta

SEQ ID NO: 64351 - DNA, 9 bp, Unknown
  misc_feature (1)..( 9): Matrix.003 file - promoters50/1008070
caaatataa

SEQ ID NO: 64352 - DNA, 9 bp, Unknown
  misc_feature (1)..( 9): Matrix.003 file - promoters50/1008070
caaaaaaaa

SEQ ID NO: 64353 - DNA, 9 bp, Unknown
  misc_feature (1)..( 9): Matrix.003 file - promoters50/1008070
aaactgaat

SEQ ID NO: 64354 - DNA, 14 bp, Unknown
  misc_feature (1)..( 14): Matrix.003 file - promoters50/1008109
gtttcataattaaa

SEQ ID NO: 64355 - DNA, 12 bp, Unknown
  misc_feature (1)..( 12): Matrix.003 file - promoters50/1008148
tgaataaaaata

SEQ ID NO: 64356 - DNA, 8 bp, Unknown
  misc_feature (1)..( 8): Matrix.003 file - promoters50/1008183
ctttcagg

SEQ ID NO: 64357 - DNA, 10 bp, Unknown
  misc_feature (1)..( 10): Matrix.003 file - promoters50/1008218
aaatgtatgt

SEQ ID NO: 64358 - DNA, 10 bp, Unknown
  misc_feature (1)..( 10): Matrix.003 file - promoters50/1008218
tggttcataa

SEQ ID NO: 64359 - DNA, 13 bp, Unknown
  misc_feature (1)..( 13): Matrix.003 file - promoters50/1008226
ttaaaaacaaaaa

SEQ ID NO: 64360 - DNA, 8 bp, Unknown
  misc_feature (1)..( 8): Matrix.003 file - promoters50/1008226
ttaaaaac

SEQ ID NO: 64361 - DNA, 12 bp, Unknown
  misc_feature (1)..( 12): Matrix.003 file - promoters50/1008226
aataaatatgtc

SEQ ID NO: 64362 - DNA, 9 bp, Unknown
  misc_feature (1)..( 9): Matrix.003 file - promoters50/1008319
aaaaaaaca

SEQ ID NO: 64363 - DNA, 10 bp, Unknown
  misc_feature (1)..( 10): Matrix.003 file - promoters50/1008319
tttatattct

SEQ ID NO: 64364 - DNA, 12 bp, Unknown
  misc_feature (1)..( 12): Matrix.003 file - promoters50/1008324
gatatgttttgg

SEQ ID NO: 64365 - DNA, 9 bp, Unknown
  misc_feature (1)..( 9): Matrix.003 file - promoters50/1008334
tttaagagt

SEQ ID NO: 64366 - DNA, 7 bp, Unknown
  misc_feature (1)..( 7): Matrix.003 file - promoters50/1008397
gctttta

SEQ ID NO: 64367 - DNA, 8 bp, Unknown
  misc_feature (1)..( 8): Matrix.003 file - promoters50/1008397
gaatatta

SEQ ID NO: 64368 - DNA, 8 bp, Unknown
  misc_feature (1)..( 8): Matrix.003 file - promoters50/1008397
ttatcaaa

SEQ ID NO: 64369 - DNA, 10 bp, Unknown
  misc_feature (1)..( 10): Matrix.003 file - promoters50/1008397
caaaaatttg

SEQ ID NO: 64370 - DNA, 8 bp, Unknown
  misc_feature (1)..( 8): Matrix.003 file - promoters50/1008425
cttttgaa

SEQ ID NO: 64371 - DNA, 10 bp, Unknown
  misc_feature (1)..( 10): Matrix.003 file - promoters50/1008425
caaatacatt

SEQ ID NO: 64372 - DNA, 10 bp, Unknown
  misc_feature (1)..( 10): Matrix.003 file - promoters50/1008432
gtaaatggtt

SEQ ID NO: 64373 - DNA, 13 bp, Unknown
  misc_feature (1)..( 13): Matrix.003 file - promoters50/1008432
ctgttttattaaa

SEQ ID NO: 64374 - DNA, 13 bp, Unknown
  misc_feature (1)..( 13): Matrix.003 file - promoters50/1008432
tttttataaaatt

SEQ ID NO: 64375 - DNA, 8 bp, Unknown
  misc_feature (1)..( 8): Matrix.003 file - promoters50/1008443
gataaaaa

SEQ ID NO: 64376 - DNA, 11 bp, Unknown
  misc_feature (1)..( 11): Matrix.003 file - promoters50/1008443
tattcaaaaaa

SEQ ID NO: 64377 - DNA, 7 bp, Unknown
  misc_feature (1)..( 7): Matrix.003 file - promoters50/1008487
caattac

SEQ ID NO: 64378 - DNA, 9 bp, Unknown
  misc_feature (1)..( 9): Matrix.003 file - promoters50/1008491
aaaataaaa

SEQ ID NO: 64379 - DNA, 7 bp, Unknown
  misc_feature (1)..( 7): Matrix.003 file - promoters50/1008491
taaaact

SEQ ID NO: 64380 - DNA, 7 bp, Unknown
  misc_feature (1)..( 7): Matrix.003 file - promoters50/1008534
gattttg

SEQ ID NO: 64381 - DNA, 6 bp, Unknown
  misc_feature (1)..( 6): Matrix.003 file - promoters50/1008573
tttatt

SEQ ID NO: 64382 - DNA, 11 bp, Unknown
  misc_feature (1)..( 11): Matrix.003 file - promoters50/1008573
cttattatgtt

SEQ ID NO: 64383 - DNA, 14 bp, Unknown
  misc_feature (1)..( 14): Matrix.003 file - promoters50/1008573
tttaaaatatagtt

SEQ ID NO: 64384 - DNA, 9 bp, Unknown
  misc_feature (1)..( 9): Matrix.003 file - promoters50/1008673
tgtttttat

SEQ ID NO: 64385 - DNA, 6 bp, Unknown
  misc_feature (1)..( 6): Matrix.003 file - promoters50/1008732
aaaaaa

SEQ ID NO: 64386 - DNA, 8 bp, Unknown
  misc_feature (1)..( 8): Matrix.003 file - promoters50/1008732
aaaaataa

SEQ ID NO: 64387 - DNA, 8 bp, Unknown
  misc_feature (1)..( 8): Matrix.003 file - promoters50/1008759
atcatttt

SEQ ID NO: 64388 - DNA, 9 bp, Unknown
  misc_feature (1)..( 9): Matrix.003 file - promoters50/1008769
gtaaactca

SEQ ID NO: 64389 - DNA, 11 bp, Unknown
  misc_feature (1)..( 11): Matrix.003 file - promoters50/1008769
atgaatctttt

SEQ ID NO: 64390 - DNA, 7 bp, Unknown
  misc_feature (1)..( 7): Matrix.003 file - promoters50/1008769
aattttt

SEQ ID NO: 64391 - DNA, 10 bp, Unknown
  misc_feature (1)..( 10): Matrix.003 file - promoters50/1008769
taagtaaact

SEQ ID NO: 64392 - DNA, 8 bp, Unknown
  misc_feature (1)..( 8): Matrix.003 file - promoters50/1008769
atggttta

SEQ ID NO: 64393 - DNA, 11 bp, Unknown
  misc_feature (1)..( 11): Matrix.003 file - promoters50/1008787
gcataaaaaat

SEQ ID NO: 64394 - DNA, 11 bp, Unknown
  misc_feature (1)..( 11): Matrix.003 file - promoters50/1008791
taacggtagaa

SEQ ID NO: 64395 - DNA, 10 bp, Unknown
  misc_feature (1)..( 10): Matrix.003 file - promoters50/1008791
aacccatctc

SEQ ID NO: 64396 - DNA, 11 bp, Unknown
  misc_feature (1)..( 11): Matrix.003 file - promoters50/1008808
gaaaatgatta

SEQ ID NO: 64397 - DNA, 6 bp, Unknown
  misc_feature (1)..( 6): Matrix.003 file - promoters50/1008813
ttcaaa

SEQ ID NO: 64398 - DNA, 10 bp, Unknown
  misc_feature (1)..( 10): Matrix.003 file - promoters50/1008813
aaaaaaatat

SEQ ID NO: 64399 - DNA, 13 bp, Unknown
  misc_feature (1)..( 13): Matrix.003 file - promoters50/1008816
cgattaataaaaa

SEQ ID NO: 64400 - DNA, 10 bp, Unknown
  misc_feature (1)..( 10): Matrix.003 file - promoters50/1008816
atatttttta

SEQ ID NO: 64401 - DNA, 10 bp, Unknown
  misc_feature (1)..( 10): Matrix.003 file - promoters50/1008836
atattttttt

SEQ ID NO: 64402 - DNA, 11 bp, Unknown
  misc_feature (1)..( 11): Matrix.003 file - promoters50/1008836
atcaaaagaaa

SEQ ID NO: 64403 - DNA, 11 bp, Unknown
  misc_feature (1)..( 11): Matrix.003 file - promoters50/1008836
aaaaaaaaaat

SEQ ID NO: 64404 - DNA, 10 bp, Unknown
  misc_feature (1)..( 10): Matrix.003 file - promoters50/1008836
ttaaaattaa

SEQ ID NO: 64405 - DNA, 13 bp, Unknown
  misc_feature (1)..( 13): Matrix.003 file - promoters50/1008836
aaattatttataa

SEQ ID NO: 64406 - DNA, 8 bp, Unknown
  misc_feature (1)..( 8): Matrix.003 file - promoters50/1008836
atatttat

SEQ ID NO: 64407 - DNA, 9 bp, Unknown
  misc_feature (1)..( 9): Matrix.003 file - promoters50/1008836
tacaaatta

SEQ ID NO: 64408 - DNA, 8 bp, Unknown
  misc_feature (1)..( 8): Matrix.003 file - promoters50/1008836
tatataaa

SEQ ID NO: 64409 - DNA, 13 bp, Unknown
  misc_feature (1)..( 13): Matrix.003 file - promoters50/1008836
aaatttggaaaat

SEQ ID NO: 64410 - DNA, 10 bp, Unknown
  misc_feature (1)..( 10): Matrix.003 file - promoters50/1008836
atttttatta

SEQ ID NO: 64411 - DNA, 9 bp, Unknown
  misc_feature (1)..( 9): Matrix.003 file - promoters50/1008836
ttttaaaaa

SEQ ID NO: 64412 - DNA, 11 bp, Unknown
  misc_feature (1)..( 11): Matrix.003 file - promoters50/1008836
agtttaaaata

SEQ ID NO: 64413 - DNA, 8 bp, Unknown
  misc_feature (1)..( 8): Matrix.003 file - promoters50/1008889
attttttt

SEQ ID NO: 64414 - DNA, 8 bp, Unknown
  misc_feature (1)..( 8): Matrix.003 file - promoters50/1008889
taaattat

SEQ ID NO: 64415 - DNA, 11 bp, Unknown
  misc_feature (1)..( 11): Matrix.003 file - promoters50/1009030
actcatgtaat

SEQ ID NO: 64416 - DNA, 12 bp, Unknown
  misc_feature (1)..( 12): Matrix.003 file - promoters50/1009030
atggacctaaat

SEQ ID NO: 64417 - DNA, 11 bp, Unknown
  misc_feature (1)..( 11): Matrix.003 file - promoters50/1009053
tatattttttt

SEQ ID NO: 64418 - DNA, 10 bp, Unknown
  misc_feature (1)..( 10): Matrix.003 file - promoters50/1009053
atttttttaa

SEQ ID NO: 64419 - DNA, 12 bp, Unknown
  misc_feature (1)..( 12): Matrix.003 file - promoters50/1009068
aaaaattattga

SEQ ID NO: 64420 - DNA, 8 bp, Unknown
  misc_feature (1)..( 8): Matrix.003 file - promoters50/1009068
aaaaccaa

SEQ ID NO: 64421 - DNA, 9 bp, Unknown
  misc_feature (1)..( 9): Matrix.003 file - promoters50/1009068
aaaatatac

SEQ ID NO: 64422 - DNA, 7 bp, Unknown
  misc_feature (1)..( 7): Matrix.003 file - promoters50/1009086
caaattg

SEQ ID NO: 64423 - DNA, 11 bp, Unknown
  misc_feature (1)..( 11): Matrix.003 file - promoters50/1009086
aataaatttga

SEQ ID NO: 64424 - DNA, 10 bp, Unknown
  misc_feature (1)..( 10): Matrix.003 file - promoters50/1009086
ataaaacaaa

SEQ ID NO: 64425 - DNA, 13 bp, Unknown
  misc_feature (1)..( 13): Matrix.003 file - promoters50/1009112
tataaaccaatta

SEQ ID NO: 64426 - DNA, 4 bp, Unknown
  misc_feature (1)..( 4): Matrix.003 file - promoters50/1009112
taac

SEQ ID NO: 64427 - DNA, 10 bp, Unknown
  misc_feature (1)..( 10): Matrix.003 file - promoters50/1009112
atttcattta

SEQ ID NO: 64428 - DNA, 10 bp, Unknown
  misc_feature (1)..( 10): Matrix.003 file - promoters50/1009112
ttaaaaagta

SEQ ID NO: 64429 - DNA, 12 bp, Unknown
  misc_feature (1)..( 12): Matrix.003 file - promoters50/1009112
gttaaattaaaa

SEQ ID NO: 64430 - DNA, 8 bp, Unknown
  misc_feature (1)..( 8): Matrix.003 file - promoters50/1009112
aataaaac

SEQ ID NO: 64431 - DNA, 9 bp, Unknown
  misc_feature (1)..( 9): Matrix.003 file - promoters50/1009112
atttgaaat

SEQ ID NO: 64432 - DNA, 14 bp, Unknown
  misc_feature (1)..( 14): Matrix.003 file - promoters50/1009112
ataaaccaataatg

SEQ ID NO: 64433 - DNA, 8 bp, Unknown
  misc_feature (1)..( 8): Matrix.003 file - promoters50/1009112
aatattaa

SEQ ID NO: 64434 - DNA, 9 bp, Unknown
  misc_feature (1)..( 9): Matrix.003 file - promoters50/1009112
taaaacgta

SEQ ID NO: 64435 - DNA, 9 bp, Unknown
  misc_feature (1)..( 9): Matrix.003 file - promoters50/1009112
gaagaatta

SEQ ID NO: 64436 - DNA, 11 bp, Unknown
  misc_feature (1)..( 11): Matrix.003 file - promoters50/1009136
ataattcaatt

SEQ ID NO: 64437 - DNA, 10 bp, Unknown
  misc_feature (1)..( 10): Matrix.003 file - promoters50/1009136
aatttatata

SEQ ID NO: 64438 - DNA, 6 bp, Unknown
  misc_feature (1)..( 6): Matrix.003 file - promoters50/1009136
atataa

SEQ ID NO: 64439 - DNA, 11 bp, Unknown
  misc_feature (1)..( 11): Matrix.003 file - promoters50/1009136
ttaatcatatt

SEQ ID NO: 64440 - DNA, 9 bp, Unknown
  misc_feature (1)..( 9): Matrix.003 file - promoters50/1009136
taaattata

SEQ ID NO: 64441 - DNA, 11 bp, Unknown
  misc_feature (1)..( 11): Matrix.003 file - promoters50/1009136
gaaatataatt

SEQ ID NO: 64442 - DNA, 12 bp, Unknown
  misc_feature (1)..( 12): Matrix.003 file - promoters50/1009136
aaaaatatatca

SEQ ID NO: 64443 - DNA, 13 bp, Unknown
  misc_feature (1)..( 13): Matrix.003 file - promoters50/1009136
atctatataaata

SEQ ID NO: 64444 - DNA, 12 bp, Unknown
  misc_feature (1)..( 12): Matrix.003 file - promoters50/1009142
aaaagtgaaatg

SEQ ID NO: 64445 - DNA, 14 bp, Unknown
  misc_feature (1)..( 14): Matrix.003 file - promoters50/1009142
tgtatgctaagaca

SEQ ID NO: 64446 - DNA, 13 bp, Unknown
  misc_feature (1)..( 13): Matrix.003 file - promoters50/1009142
ctgaattatgtta

SEQ ID NO: 64447 - DNA, 7 bp, Unknown
  misc_feature (1)..( 7): Matrix.003 file - promoters50/1009169
atataaa

SEQ ID NO: 64448 - DNA, 7 bp, Unknown
  misc_feature (1)..( 7): Matrix.003 file - promoters50/1009207
tatcaat

SEQ ID NO: 64449 - DNA, 10 bp, Unknown
  misc_feature (1)..( 10): Matrix.003 file - promoters50/1009207
taaaacatta

SEQ ID NO: 64450 - DNA, 9 bp, Unknown
  misc_feature (1)..( 9): Matrix.003 file - promoters50/1009207
aaaaattat

SEQ ID NO: 64451 - DNA, 11 bp, Unknown
  misc_feature (1)..( 11): Matrix.003 file - promoters50/1009211
cactataaata

SEQ ID NO: 64452 - DNA, 11 bp, Unknown
  misc_feature (1)..( 11): Matrix.003 file - promoters50/1009211
caaataattca

SEQ ID NO: 64453 - DNA, 13 bp, Unknown
  misc_feature (1)..( 13): Matrix.003 file - promoters50/1009258
tgattattctctc

SEQ ID NO: 64454 - DNA, 7 bp, Unknown
  misc_feature (1)..( 7): Matrix.003 file - promoters50/1009276
caaaaat

SEQ ID NO: 64455 - DNA, 9 bp, Unknown
  misc_feature (1)..( 9): Matrix.003 file - promoters50/1009276
atttaccaa

SEQ ID NO: 64456 - DNA, 7 bp, Unknown
  misc_feature (1)..( 7): Matrix.003 file - promoters50/1009276
ttcaaaa

SEQ ID NO: 64457 - DNA, 9 bp, Unknown
  misc_feature (1)..( 9): Matrix.003 file - promoters50/1009276
aaaattgac

SEQ ID NO: 64458 - DNA, 9 bp, Unknown
  misc_feature (1)..( 9): Matrix.003 file - promoters50/1009335
tatgattct

SEQ ID NO: 64459 - DNA, 10 bp, Unknown
  misc_feature (1)..( 10): Matrix.003 file - promoters50/1009335
acctttaacc

SEQ ID NO: 64460 - DNA, 8 bp, Unknown
  misc_feature (1)..( 8): Matrix.003 file - promoters50/1009335
agtaaatg

SEQ ID NO: 64461 - DNA, 10 bp, Unknown
  misc_feature (1)..( 10): Matrix.003 file - promoters50/1009335
tataagttaa

SEQ ID NO: 64462 - DNA, 12 bp, Unknown
  misc_feature (1)..( 12): Matrix.003 file - promoters50/1009335
cttattagttaa

SEQ ID NO: 64463 - DNA, 7 bp, Unknown
  misc_feature (1)..( 7): Matrix.003 file - promoters50/1009354
gattctt

SEQ ID NO: 64464 - DNA, 8 bp, Unknown
  misc_feature (1)..( 8): Matrix.003 file - promoters50/1009354
taagaact

SEQ ID NO: 64465 - DNA, 9 bp, Unknown
  misc_feature (1)..( 9): Matrix.003 file - promoters50/1009426
ctattatta

SEQ ID NO: 64466 - DNA, 7 bp, Unknown
  misc_feature (1)..( 7): Matrix.003 file - promoters50/1009426
tctcttg

SEQ ID NO: 64467 - DNA, 10 bp, Unknown
  misc_feature (1)..( 10): Matrix.003 file - promoters50/1009426
tttctatata

SEQ ID NO: 64468 - DNA, 10 bp, Unknown
  misc_feature (1)..( 10): Matrix.003 file - promoters50/1009430
aatattttaa

SEQ ID NO: 64469 - DNA, 10 bp, Unknown
  misc_feature (1)..( 10): Matrix.003 file - promoters50/1009430
atcttaaata

SEQ ID NO: 64470 - DNA, 10 bp, Unknown
  misc_feature (1)..( 10): Matrix.003 file - promoters50/1009430
agaaaatttc

SEQ ID NO: 64471 - DNA, 11 bp, Unknown
  misc_feature (1)..( 11): Matrix.003 file - promoters50/1009430
taataattata

SEQ ID NO: 64472 - DNA, 7 bp, Unknown
  misc_feature (1)..( 7): Matrix.003 file - promoters50/1009437
ctagaat

SEQ ID NO: 64473 - DNA, 8 bp, Unknown
  misc_feature (1)..( 8): Matrix.003 file - promoters50/1009437
tttgattt

SEQ ID NO: 64474 - DNA, 7 bp, Unknown
  misc_feature (1)..( 7): Matrix.003 file - promoters50/1009437
ctttttt

SEQ ID NO: 64475 - DNA, 7 bp, Unknown
  misc_feature (1)..( 7): Matrix.003 file - promoters50/1009437
tttcttt

SEQ ID NO: 64476 - DNA, 10 bp, Unknown
  misc_feature (1)..( 10): Matrix.003 file - promoters50/1009520
gcatatataa

SEQ ID NO: 64477 - DNA, 9 bp, Unknown
  misc_feature (1)..( 9): Matrix.003 file - promoters50/1009528
gtttatccc

SEQ ID NO: 64478 - DNA, 6 bp, Unknown
  misc_feature (1)..( 6): Matrix.003 file - promoters50/1009528
acatac

SEQ ID NO: 64479 - DNA, 12 bp, Unknown
  misc_feature (1)..( 12): Matrix.003 file - promoters50/1009616
aaatattaacac

SEQ ID NO: 64480 - DNA, 11 bp, Unknown
  misc_feature (1)..( 11): Matrix.003 file - promoters50/1009616
aaactaaaaaa

SEQ ID NO: 64481 - DNA, 10 bp, Unknown
  misc_feature (1)..( 10): Matrix.003 file - promoters50/1009616
ctaaacaaaa

SEQ ID NO: 64482 - DNA, 11 bp, Unknown
  misc_feature (1)..( 11): Matrix.003 file - promoters50/1009616
ttaataattta

SEQ ID NO: 64483 - DNA, 8 bp, Unknown
  misc_feature (1)..( 8): Matrix.003 file - promoters50/1009654
aataaatc

SEQ ID NO: 64484 - DNA, 7 bp, Unknown
  misc_feature (1)..( 7): Matrix.003 file - promoters50/1009654
aactaaa

SEQ ID NO: 64485 - DNA, 7 bp, Unknown
  misc_feature (1)..( 7): Matrix.003 file - promoters50/1009654
taaaaga

SEQ ID NO: 64486 - DNA, 10 bp, Unknown
  misc_feature (1)..( 10): Matrix.003 file - promoters50/1009654
aaaaaaagaa

SEQ ID NO: 64487 - DNA, 8 bp, Unknown
  misc_feature (1)..( 8): Matrix.003 file - promoters50/1009654
atttgaat

SEQ ID NO: 64488 - DNA, 6 bp, Unknown
  misc_feature (1)..( 6): Matrix.003 file - promoters50/1009654
aaattt

SEQ ID NO: 64489 - DNA, 8 bp, Unknown
  misc_feature (1)..( 8): Matrix.003 file - promoters50/1009654
ggactaaa

SEQ ID NO: 64490 - DNA, 7 bp, Unknown
  misc_feature (1)..( 7): Matrix.003 file - promoters50/1009654
ataaaag

SEQ ID NO: 64491 - DNA, 8 bp, Unknown
  misc_feature (1)..( 8): Matrix.003 file - promoters50/1009686
attaagtc

SEQ ID NO: 64492 - DNA, 12 bp, Unknown
  misc_feature (1)..( 12): Matrix.003 file - promoters50/1009693
atatcaaaaaaa

SEQ ID NO: 64493 - DNA, 11 bp, Unknown
  misc_feature (1)..( 11): Matrix.003 file - promoters50/1009693
caagaaatatt

SEQ ID NO: 64494 - DNA, 8 bp, Unknown
  misc_feature (1)..( 8): Matrix.003 file - promoters50/1009693
aaagttgt

SEQ ID NO: 64495 - DNA, 8 bp, Unknown
  misc_feature (1)..( 8): Matrix.003 file - promoters50/1009693
aattaaat

SEQ ID NO: 64496 - DNA, 11 bp, Unknown
  misc_feature (1)..( 11): Matrix.003 file - promoters50/1009693
ttaaattatat

SEQ ID NO: 64497 - DNA, 8 bp, Unknown
  misc_feature (1)..( 8): Matrix.003 file - promoters50/1009693
caaaaaaa

SEQ ID NO: 64498 - DNA, 7 bp, Unknown
  misc_feature (1)..( 7): Matrix.003 file - promoters50/1009752
taacaat

SEQ ID NO: 64499 - DNA, 8 bp, Unknown
  misc_feature (1)..( 8): Matrix.003 file - promoters50/1009754
agataatt

SEQ ID NO: 64500 - DNA, 11 bp, Unknown
  misc_feature (1)..( 11): Matrix.003 file - promoters50/1009780
tttttacaaaa

SEQ ID NO: 64501 - DNA, 11 bp, Unknown
  misc_feature (1)..( 11): Matrix.003 file - promoters50/1009780
tgataaaaagt

SEQ ID NO: 64502 - DNA, 7 bp, Unknown
  misc_feature (1)..( 7): Matrix.003 file - promoters50/1009780
ttctaat

SEQ ID NO: 64503 - DNA, 7 bp, Unknown
  misc_feature (1)..( 7): Matrix.003 file - promoters50/1009822
cttctct

SEQ ID NO: 64504 - DNA, 6 bp, Unknown
  misc_feature (1)..( 6): Matrix.003 file - promoters50/1009822
ttctca

SEQ ID NO: 64505 - DNA, 8 bp, Unknown
  misc_feature (1)..( 8): Matrix.003 file - promoters50/1009822
cttctcca

SEQ ID NO: 64506 - DNA, 10 bp, Unknown
  misc_feature (1)..( 10): Matrix.003 file - promoters50/1009854
aaagaaaaaa

SEQ ID NO: 64507 - DNA, 12 bp, Unknown
  misc_feature (1)..( 12): Matrix.003 file - promoters50/1009854
tgaaagaaaaaa

SEQ ID NO: 64508 - DNA, 11 bp, Unknown
  misc_feature (1)..( 11): Matrix.003 file - promoters50/1009854
aaaaaataatc

SEQ ID NO: 64509 - DNA, 8 bp, Unknown
  misc_feature (1)..( 8): Matrix.003 file - promoters50/1009861
attataat

SEQ ID NO: 64510 - DNA, 13 bp, Unknown
  misc_feature (1)..( 13): Matrix.003 file - promoters50/1009861
cattatacatatt

SEQ ID NO: 64511 - DNA, 10 bp, Unknown
  misc_feature (1)..( 10): Matrix.003 file - promoters50/1009861
ttataattaa

SEQ ID NO: 64512 - DNA, 9 bp, Unknown
  misc_feature (1)..( 9): Matrix.003 file - promoters50/1009861
taaaaataa

SEQ ID NO: 64513 - DNA, 9 bp, Unknown
  misc_feature (1)..( 9): Matrix.003 file - promoters50/1009875
tttcaaaaa

SEQ ID NO: 64514 - DNA, 9 bp, Unknown
  misc_feature (1)..( 9): Matrix.003 file - promoters50/1009875
attcaacat

SEQ ID NO: 64515 - DNA, 13 bp, Unknown
  misc_feature (1)..( 13): Matrix.003 file - promoters50/1009875
aagcaacaaaaag

SEQ ID NO: 64516 - DNA, 10 bp, Unknown
  misc_feature (1)..( 10): Matrix.003 file - promoters50/1009875
caacaaaaag

SEQ ID NO: 64517 - DNA, 10 bp, Unknown
  misc_feature (1)..( 10): Matrix.003 file - promoters50/1009875
aacgtcaaaa

SEQ ID NO: 64518 - DNA, 9 bp, Unknown
  misc_feature (1)..( 9): Matrix.003 file - promoters50/1009875
cattatttt

SEQ ID NO: 64519 - DNA, 11 bp, Unknown
  misc_feature (1)..( 11): Matrix.003 file - promoters50/1009910
ataattttttt

SEQ ID NO: 64520 - DNA, 9 bp, Unknown
  misc_feature (1)..( 9): Matrix.003 file - promoters50/1009910
caattttta

SEQ ID NO: 64521 - DNA, 14 bp, Unknown
  misc_feature (1)..( 14): Matrix.003 file - promoters50/1009910
cttaaaaaattaga

SEQ ID NO: 64522 - DNA, 11 bp, Unknown
  misc_feature (1)..( 11): Matrix.003 file - promoters50/1009910
aaaattaaata

SEQ ID NO: 64523 - DNA, 10 bp, Unknown
  misc_feature (1)..( 10): Matrix.003 file - promoters50/1009910
tatttaaatg

SEQ ID NO: 64524 - DNA, 14 bp, Unknown
  misc_feature (1)..( 14): Matrix.003 file - promoters50/1009910
aataaaataacaaa

SEQ ID NO: 64525 - DNA, 9 bp, Unknown
  misc_feature (1)..( 9): Matrix.003 file - promoters50/1009930
tcatatctg

SEQ ID NO: 64526 - DNA, 8 bp, Unknown
  misc_feature (1)..( 8): Matrix.003 file - promoters50/1009930
tttaaatt

SEQ ID NO: 64527 - DNA, 7 bp, Unknown
  misc_feature (1)..( 7): Matrix.003 file - promoters50/1009930
aaacact

SEQ ID NO: 64528 - DNA, 9 bp, Unknown
  misc_feature (1)..( 9): Matrix.003 file - promoters50/1009930
aatttattt

SEQ ID NO: 64529 - DNA, 9 bp, Unknown
  misc_feature (1)..( 9): Matrix.003 file - promoters50/1009930
ttacattag

SEQ ID NO: 64530 - DNA, 8 bp, Unknown
  misc_feature (1)..( 8): Matrix.003 file - promoters50/1009930
ttatgatc

SEQ ID NO: 64531 - DNA, 6 bp, Unknown
  misc_feature (1)..( 6): Matrix.003 file - promoters50/1009930
caaata

SEQ ID NO: 64532 - DNA, 9 bp, Unknown
  misc_feature (1)..( 9): Matrix.003 file - promoters50/1009941
aaaattatc

SEQ ID NO: 64533 - DNA, 7 bp, Unknown
  misc_feature (1)..( 7): Matrix.003 file - promoters50/1009955
tggaaag

SEQ ID NO: 64534 - DNA, 6 bp, Unknown
  misc_feature (1)..( 6): Matrix.003 file - promoters50/1009955
cttctg

SEQ ID NO: 64535 - DNA, 11 bp, Unknown
  misc_feature (1)..( 11): Matrix.003 file - promoters50/1009999
aattgttttgt

SEQ ID NO: 64536 - DNA, 15 bp, Unknown
  misc_feature (1)..( 15): Matrix.003 file - promoters50/1009999
aagataaaaagaaaa

SEQ ID NO: 64537 - DNA, 10 bp, Unknown
  misc_feature (1)..( 10): Matrix.003 file - promoters50/1009999
gtgtacaaaa

SEQ ID NO: 64538 - DNA, 12 bp, Unknown
  misc_feature (1)..( 12): Matrix.003 file - promoters50/1009999
aaagaaaaaaag

SEQ ID NO: 64539 - DNA, 10 bp, Unknown
  misc_feature (1)..( 10): Matrix.003 file - promoters50/1009999
gcactaaata

SEQ ID NO: 64540 - DNA, 11 bp, Unknown
  misc_feature (1)..( 11): Matrix.003 file - promoters50/1009999
atcgatagata

SEQ ID NO: 64541 - DNA, 7 bp, Unknown
  misc_feature (1)..( 7): Matrix.003 file - promoters50/1010019
caaaaac

SEQ ID NO: 64542 - DNA, 8 bp, Unknown
  misc_feature (1)..( 8): Matrix.003 file - promoters50/1010025
atatcttc

SEQ ID NO: 64543 - DNA, 9 bp, Unknown
  misc_feature (1)..( 9): Matrix.003 file - promoters50/1010055
aaacaaatt

SEQ ID NO: 64544 - DNA, 11 bp, Unknown
  misc_feature (1)..( 11): Matrix.003 file - promoters50/1010055
aaattatttta

SEQ ID NO: 64545 - DNA, 8 bp, Unknown
  misc_feature (1)..( 8): Matrix.003 file - promoters50/1010055
tcaacaat

SEQ ID NO: 64546 - DNA, 7 bp, Unknown
  misc_feature (1)..( 7): Matrix.003 file - promoters50/1010055
aaaataa

SEQ ID NO: 64547 - DNA, 11 bp, Unknown
  misc_feature (1)..( 11): Matrix.003 file - promoters50/1010055
aatatttcgtt

SEQ ID NO: 64548 - DNA, 9 bp, Unknown
  misc_feature (1)..( 9): Matrix.003 file - promoters50/1010065
taaacaaat

SEQ ID NO: 64549 - DNA, 8 bp, Unknown
  misc_feature (1)..( 8): Matrix.003 file - promoters50/1010065
atttttta

SEQ ID NO: 64550 - DNA, 9 bp, Unknown
  misc_feature (1)..( 9): Matrix.003 file - promoters50/1010065
tataaaaaa

SEQ ID NO: 64551 - DNA, 10 bp, Unknown
  misc_feature (1)..( 10): Matrix.003 file - promoters50/1010065
acacaaaaca

SEQ ID NO: 64552 - DNA, 8 bp, Unknown
  misc_feature (1)..( 8): Matrix.003 file - promoters50/1010065
attacaaa

SEQ ID NO: 64553 - DNA, 10 bp, Unknown
  misc_feature (1)..( 10): Matrix.003 file - promoters50/1010068
tattcggcta

SEQ ID NO: 64554 - DNA, 16 bp, Unknown
  misc_feature (1)..( 16): Matrix.003 file - promoters50/1010094
aacatacaagaaacac

SEQ ID NO: 64555 - DNA, 11 bp, Unknown
  misc_feature (1)..( 11): Matrix.003 file - promoters50/1010094
taacttttgat

SEQ ID NO: 64556 - DNA, 8 bp, Unknown
  misc_feature (1)..( 8): Matrix.003 file - promoters50/1010094
ataataaa

SEQ ID NO: 64557 - DNA, 10 bp, Unknown
  misc_feature (1)..( 10): Matrix.003 file - promoters50/1010094
taacatttga

SEQ ID NO: 64558 - DNA, 7 bp, Unknown
  misc_feature (1)..( 7): Matrix.003 file - promoters50/1010094
aaaaatt

SEQ ID NO: 64559 - DNA, 9 bp, Unknown
  misc_feature (1)..( 9): Matrix.003 file - promoters50/1010094
gatatgata

SEQ ID NO: 64560 - DNA, 11 bp, Unknown
  misc_feature (1)..( 11): Matrix.003 file - promoters50/1010094
tagacaaaaca

SEQ ID NO: 64561 - DNA, 12 bp, Unknown
  misc_feature (1)..( 12): Matrix.003 file - promoters50/1010094
acacaaaaacga

SEQ ID NO: 64562 - DNA, 10 bp, Unknown
  misc_feature (1)..( 10): Matrix.003 file - promoters50/1010115
attctaaagt

SEQ ID NO: 64563 - DNA, 11 bp, Unknown
  misc_feature (1)..( 11): Matrix.003 file - promoters50/1010115
tcgataataca

SEQ ID NO: 64564 - DNA, 7 bp, Unknown
  misc_feature (1)..( 7): Matrix.003 file - promoters50/1010163
gagaaac

SEQ ID NO: 64565 - DNA, 12 bp, Unknown
  misc_feature (1)..( 12): Matrix.003 file - promoters50/1010170
aaattttcttct

SEQ ID NO: 64566 - DNA, 8 bp, Unknown
  misc_feature (1)..( 8): Matrix.003 file - promoters50/1010170
tttgcata

SEQ ID NO: 64567 - DNA, 9 bp, Unknown
  misc_feature (1)..( 9): Matrix.003 file - promoters50/1010201
tacaaaaat

SEQ ID NO: 64568 - DNA, 9 bp, Unknown
  misc_feature (1)..( 9): Matrix.003 file - promoters50/1010209
acacacatg

SEQ ID NO: 64569 - DNA, 13 bp, Unknown
  misc_feature (1)..( 13): Matrix.003 file - promoters50/1010209
aaacaaatttatt

SEQ ID NO: 64570 - DNA, 10 bp, Unknown
  misc_feature (1)..( 10): Matrix.003 file - promoters50/1010346
tataaaaaag

SEQ ID NO: 64571 - DNA, 6 bp, Unknown
  misc_feature (1)..( 6): Matrix.003 file - promoters50/1010346
atttat

SEQ ID NO: 64572 - DNA, 9 bp, Unknown
  misc_feature (1)..( 9): Matrix.003 file - promoters50/1010346
aaaaaaagt

SEQ ID NO: 64573 - DNA, 9 bp, Unknown
  misc_feature (1)..( 9): Matrix.003 file - promoters50/1010357
ttttatatt

SEQ ID NO: 64574 - DNA, 9 bp, Unknown
  misc_feature (1)..( 9): Matrix.003 file - promoters50/1010357
cgtgaattc

SEQ ID NO: 64575 - DNA, 7 bp, Unknown
  misc_feature (1)..( 7): Matrix.003 file - promoters50/1010357
ataaaaa

SEQ ID NO: 64576 - DNA, 10 bp, Unknown
  misc_feature (1)..( 10): Matrix.003 file - promoters50/1010367
atttatgttg

SEQ ID NO: 64577 - DNA, 10 bp, Unknown
  misc_feature (1)..( 10): Matrix.003 file - promoters50/1010367
atttaaaaac

SEQ ID NO: 64578 - DNA, 9 bp, Unknown
  misc_feature (1)..( 9): Matrix.003 file - promoters50/1010367
tacaaaaaa

SEQ ID NO: 64579 - DNA, 13 bp, Unknown
  misc_feature (1)..( 13): Matrix.003 file - promoters50/1010367
aaaccaaataaca

SEQ ID NO: 64580 - DNA, 8 bp, Unknown
  misc_feature (1)..( 8): Matrix.003 file - promoters50/1010367
caaaaatt

SEQ ID NO: 64581 - DNA, 11 bp, Unknown
  misc_feature (1)..( 11): Matrix.003 file - promoters50/1010367
aacgacaaaaa

SEQ ID NO: 64582 - DNA, 9 bp, Unknown
  misc_feature (1)..( 9): Matrix.003 file - promoters50/1010367
caaaaaata

SEQ ID NO: 64583 - DNA, 8 bp, Unknown
  misc_feature (1)..( 8): Matrix.003 file - promoters50/1010367
caaaaaat

SEQ ID NO: 64584 - DNA, 11 bp, Unknown
  misc_feature (1)..( 11): Matrix.003 file - promoters50/1010367
aaaatgaatta

SEQ ID NO: 64585 - DNA, 11 bp, Unknown
  misc_feature (1)..( 11): Matrix.003 file - promoters50/1010373
ataatttacat

SEQ ID NO: 64586 - DNA, 8 bp, Unknown
  misc_feature (1)..( 8): Matrix.003 file - promoters50/1010411
aataattg

SEQ ID NO: 64587 - DNA, 9 bp, Unknown
  misc_feature (1)..( 9): Matrix.003 file - promoters50/1010411
tatgtttgc

SEQ ID NO: 64588 - DNA, 8 bp, Unknown
  misc_feature (1)..( 8): Matrix.003 file - promoters50/1010411
aaagtgaa

SEQ ID NO: 64589 - DNA, 10 bp, Unknown
  misc_feature (1)..( 10): Matrix.003 file - promoters50/1010411
gtaattgatg

SEQ ID NO: 64590 - DNA, 12 bp, Unknown
  misc_feature (1)..( 12): Matrix.003 file - promoters50/1010411
tagaattattaa

SEQ ID NO: 64591 - DNA, 8 bp, Unknown
  misc_feature (1)..( 8): Matrix.003 file - promoters50/1010411
aatctttt

SEQ ID NO: 64592 - DNA, 12 bp, Unknown
  misc_feature (1)..( 12): Matrix.003 file - promoters50/1010411
gttttctacaat

SEQ ID NO: 64593 - DNA, 11 bp, Unknown
  misc_feature (1)..( 11): Matrix.003 file - promoters50/1010418
ccagaagagaa

SEQ ID NO: 64594 - DNA, 8 bp, Unknown
  misc_feature (1)..( 8): Matrix.003 file - promoters50/1010418
ggaaagaa

SEQ ID NO: 64595 - DNA, 7 bp, Unknown
  misc_feature (1)..( 7): Matrix.003 file - promoters50/1010418
tagtgat

SEQ ID NO: 64596 - DNA, 8 bp, Unknown
  misc_feature (1)..( 8): Matrix.003 file - promoters50/1010418
ggcctaat

SEQ ID NO: 64597 - DNA, 10 bp, Unknown
  misc_feature (1)..( 10): Matrix.003 file - promoters50/1010425
aatgaaaaac

SEQ ID NO: 64598 - DNA, 10 bp, Unknown
  misc_feature (1)..( 10): Matrix.003 file - promoters50/1010425
taaaattaga

SEQ ID NO: 64599 - DNA, 9 bp, Unknown
  misc_feature (1)..( 9): Matrix.003 file - promoters50/1010429
ttcattaat

SEQ ID NO: 64600 - DNA, 6 bp, Unknown
  misc_feature (1)..( 6): Matrix.003 file - promoters50/1010429
aaaaaa

SEQ ID NO: 64601 - DNA, 10 bp, Unknown
  misc_feature (1)..( 10): Matrix.003 file - promoters50/1010429
ttatataaat

SEQ ID NO: 64602 - DNA, 11 bp, Unknown
  misc_feature (1)..( 11): Matrix.003 file - promoters50/1010431
tattaaactta

SEQ ID NO: 64603 - DNA, 11 bp, Unknown
  misc_feature (1)..( 11): Matrix.003 file - promoters50/1010491
taataaagaaa

SEQ ID NO: 64604 - DNA, 9 bp, Unknown
  misc_feature (1)..( 9): Matrix.003 file - promoters50/1010491
catgctttt

SEQ ID NO: 64605 - DNA, 9 bp, Unknown
  misc_feature (1)..( 9): Matrix.003 file - promoters50/1010524
acaaacgtt

SEQ ID NO: 64606 - DNA, 8 bp, Unknown
  misc_feature (1)..( 8): Matrix.003 file - promoters50/1010524
gaacaaat

SEQ ID NO: 64607 - DNA, 10 bp, Unknown
  misc_feature (1)..( 10): Matrix.003 file - promoters50/1010524
tattttgaaa

SEQ ID NO: 64608 - DNA, 7 bp, Unknown
  misc_feature (1)..( 7): Matrix.003 file - promoters50/1010524
atatttt

SEQ ID NO: 64609 - DNA, 7 bp, Unknown
  misc_feature (1)..( 7): Matrix.003 file - promoters50/1010524
aaaattt

SEQ ID NO: 64610 - DNA, 7 bp, Unknown
  misc_feature (1)..( 7): Matrix.003 file - promoters50/1010524
tacttgt

SEQ ID NO: 64611 - DNA, 11 bp, Unknown
  misc_feature (1)..( 11): Matrix.003 file - promoters50/1010524
aaatttatcat

SEQ ID NO: 64612 - DNA, 9 bp, Unknown
  misc_feature (1)..( 9): Matrix.003 file - promoters50/1010536
tcaaataga

SEQ ID NO: 64613 - DNA, 10 bp, Unknown
  misc_feature (1)..( 10): Matrix.003 file - promoters50/1010562
catattttta

SEQ ID NO: 64614 - DNA, 11 bp, Unknown
  misc_feature (1)..( 11): Matrix.003 file - promoters50/1010562
actaaagaaaa

SEQ ID NO: 64615 - DNA, 32 bp, Unknown
  misc_feature (1)..( 32): Matrix.003 file - promoters50/1010571
ccttgctttttgtaccaaataataaagaaaat

SEQ ID NO: 64616 - DNA, 10 bp, Unknown
  misc_feature (1)..( 10): Matrix.003 file - promoters50/1010594
aaattgaaac

SEQ ID NO: 64617 - DNA, 9 bp, Unknown
  misc_feature (1)..( 9): Matrix.003 file - promoters50/1010625
tttattttc

SEQ ID NO: 64618 - DNA, 12 bp, Unknown
  misc_feature (1)..( 12): Matrix.003 file - promoters50/1010625
aaaatataaatc

SEQ ID NO: 64619 - DNA, 7 bp, Unknown
  misc_feature (1)..( 7): Matrix.003 file - promoters50/1010625
cataaaa

SEQ ID NO: 64620 - DNA, 9 bp, Unknown
  misc_feature (1)..( 9): Matrix.003 file - promoters50/1010625
ataaacttt

SEQ ID NO: 64621 - DNA, 8 bp, Unknown
  misc_feature (1)..( 8): Matrix.003 file - promoters50/1010625
catgaaat

SEQ ID NO: 64622 - DNA, 11 bp, Unknown
  misc_feature (1)..( 11): Matrix.003 file - promoters50/1010677
ttttcttttat

SEQ ID NO: 64623 - DNA, 11 bp, Unknown
  misc_feature (1)..( 11): Matrix.003 file - promoters50/1010693
ttttaattaat

SEQ ID NO: 64624 - DNA, 13 bp, Unknown
  misc_feature (1)..( 13): Matrix.003 file - promoters50/1010693
gcttttaatttta

SEQ ID NO: 64625 - DNA, 10 bp, Unknown
  misc_feature (1)..( 10): Matrix.003 file - promoters50/1010693
aaaactaaaa

SEQ ID NO: 64626 - DNA, 9 bp, Unknown
  misc_feature (1)..( 9): Matrix.003 file - promoters50/1010710
aattatttt

SEQ ID NO: 64627 - DNA, 11 bp, Unknown
  misc_feature (1)..( 11): Matrix.003 file - promoters50/1010747
ctttggaataa

SEQ ID NO: 64628 - DNA, 9 bp, Unknown
  misc_feature (1)..( 9): Matrix.003 file - promoters50/1010747
gataattta

SEQ ID NO: 64629 - DNA, 14 bp, Unknown
  misc_feature (1)..( 14): Matrix.003 file - promoters50/1010747
aaataactacaaat

SEQ ID NO: 64630 - DNA, 10 bp, Unknown
  misc_feature (1)..( 10): Matrix.003 file - promoters50/1010747
aaaatttatt

SEQ ID NO: 64631 - DNA, 10 bp, Unknown
  misc_feature (1)..( 10): Matrix.003 file - promoters50/1010747
caaaatttat

SEQ ID NO: 64632 - DNA, 9 bp, Unknown
  misc_feature (1)..( 9): Matrix.003 file - promoters50/1010747
tatttagaa

SEQ ID NO: 64633 - DNA, 11 bp, Unknown
  misc_feature (1)..( 11): Matrix.003 file - promoters50/1010770
aaataaattga

SEQ ID NO: 64634 - DNA, 13 bp, Unknown
  misc_feature (1)..( 13): Matrix.003 file - promoters50/1010770
atttgtttaactt

SEQ ID NO: 64635 - DNA, 11 bp, Unknown
  misc_feature (1)..( 11): Matrix.003 file - promoters50/1010815
ccatataaaaa

SEQ ID NO: 64636 - DNA, 12 bp, Unknown
  misc_feature (1)..( 12): Matrix.003 file - promoters50/1010819
ttctaaaagaat

SEQ ID NO: 64637 - DNA, 13 bp, Unknown
  misc_feature (1)..( 13): Matrix.003 file - promoters50/1010836
aaaataaatagaa

SEQ ID NO: 64638 - DNA, 9 bp, Unknown
  misc_feature (1)..( 9): Matrix.003 file - promoters50/1010836
cgaaaaata

SEQ ID NO: 64639 - DNA, 8 bp, Unknown
  misc_feature (1)..( 8): Matrix.003 file - promoters50/1010902
aatgaatt

SEQ ID NO: 64640 - DNA, 8 bp, Unknown
  misc_feature (1)..( 8): Matrix.003 file - promoters50/1010902
atgaaaaa

SEQ ID NO: 64641 - DNA, 8 bp, Unknown
  misc_feature (1)..( 8): Matrix.003 file - promoters50/1010902
taaacaca

SEQ ID NO: 64642 - DNA, 8 bp, Unknown
  misc_feature (1)..( 8): Matrix.003 file - promoters50/1010971
tattatta

SEQ ID NO: 64643 - DNA, 8 bp, Unknown
  misc_feature (1)..( 8): Matrix.003 file - promoters50/1010971
ttttcatt

SEQ ID NO: 64644 - DNA, 9 bp, Unknown
  misc_feature (1)..( 9): Matrix.003 file - promoters50/1010971
aattaaatc

SEQ ID NO: 64645 - DNA, 8 bp, Unknown
  misc_feature (1)..( 8): Matrix.003 file - promoters50/1010971
cctccttg

SEQ ID NO: 64646 - DNA, 12 bp, Unknown
  misc_feature (1)..( 12): Matrix.003 file - promoters50/1010971
aatcatttgaac

SEQ ID NO: 64647 - DNA, 8 bp, Unknown
  misc_feature (1)..( 8): Matrix.003 file - promoters50/1010971
atttgttt

SEQ ID NO: 64648 - DNA, 8 bp, Unknown
  misc_feature (1)..( 8): Matrix.003 file - promoters50/1010971
tctccttt

SEQ ID NO: 64649 - DNA, 13 bp, Unknown
  misc_feature (1)..( 13): Matrix.003 file - promoters50/1010971
atcaaaacctcct

SEQ ID NO: 64650 - DNA, 12 bp, Unknown
  misc_feature (1)..( 12): Matrix.003 file - promoters50/1010993
tacatacacaaa

SEQ ID NO: 64651 - DNA, 9 bp, Unknown
  misc_feature (1)..( 9): Matrix.003 file - promoters50/1010993
tattaaaaa

SEQ ID NO: 64652 - DNA, 10 bp, Unknown
  misc_feature (1)..( 10): Matrix.003 file - promoters50/1010993
tatagaattt

SEQ ID NO: 64653 - DNA, 11 bp, Unknown
  misc_feature (1)..( 11): Matrix.003 file - promoters50/1010993
aatgacaaaat

SEQ ID NO: 64654 - DNA, 9 bp, Unknown
  misc_feature (1)..( 9): Matrix.003 file - promoters50/1011036
aatttgttt

SEQ ID NO: 64655 - DNA, 9 bp, Unknown
  misc_feature (1)..( 9): Matrix.003 file - promoters50/1011036
taatttgtt

SEQ ID NO: 64656 - DNA, 7 bp, Unknown
  misc_feature (1)..( 7): Matrix.003 file - promoters50/1011036
agaaaaa

SEQ ID NO: 64657 - DNA, 8 bp, Unknown
  misc_feature (1)..( 8): Matrix.003 file - promoters50/1011036
attttttt

SEQ ID NO: 64658 - DNA, 8 bp, Unknown
  misc_feature (1)..( 8): Matrix.003 file - promoters50/1011041
ttgaagaa

SEQ ID NO: 64659 - DNA, 15 bp, Unknown
  misc_feature (1)..( 15): Matrix.003 file - promoters50/1011041
ataagaaaaatttaa

SEQ ID NO: 64660 - DNA, 9 bp, Unknown
  misc_feature (1)..( 9): Matrix.003 file - promoters50/1011085
tgaaagaat

SEQ ID NO: 64661 - DNA, 8 bp, Unknown
  misc_feature (1)..( 8): Matrix.003 file - promoters50/1011085
gatgtatt

SEQ ID NO: 64662 - DNA, 8 bp, Unknown
  misc_feature (1)..( 8): Matrix.003 file - promoters50/1011108
tatttttt

SEQ ID NO: 64663 - DNA, 9 bp, Unknown
  misc_feature (1)..( 9): Matrix.003 file - promoters50/1011108
ttttgattc

SEQ ID NO: 64664 - DNA, 12 bp, Unknown
  misc_feature (1)..( 12): Matrix.003 file - promoters50/1011212
acatttatttta

SEQ ID NO: 64665 - DNA, 7 bp, Unknown
  misc_feature (1)..( 7): Matrix.003 file - promoters50/1011212
taatttt

SEQ ID NO: 64666 - DNA, 9 bp, Unknown
  misc_feature (1)..( 9): Matrix.003 file - promoters50/1011250
cataaacca

SEQ ID NO: 64667 - DNA, 9 bp, Unknown
  misc_feature (1)..( 9): Matrix.003 file - promoters50/1011250
attaaccaa

SEQ ID NO: 64668 - DNA, 11 bp, Unknown
  misc_feature (1)..( 11): Matrix.003 file - promoters50/1011250
ttactaaaaat

SEQ ID NO: 64669 - DNA, 7 bp, Unknown
  misc_feature (1)..( 7): Matrix.003 file - promoters50/1011250
tttgatt

SEQ ID NO: 64670 - DNA, 5 bp, Unknown
  misc_feature (1)..( 5): Matrix.003 file - promoters50/1011250
attaa

SEQ ID NO: 64671 - DNA, 7 bp, Unknown
  misc_feature (1)..( 7): Matrix.003 file - promoters50/1011250
taattaa

SEQ ID NO: 64672 - DNA, 11 bp, Unknown
  misc_feature (1)..( 11): Matrix.003 file - promoters50/1011258
cagaaaacaaa

SEQ ID NO: 64673 - DNA, 11 bp, Unknown
  misc_feature (1)..( 11): Matrix.003 file - promoters50/1011258
ccttccttctt

SEQ ID NO: 64674 - DNA, 9 bp, Unknown
  misc_feature (1)..( 9): Matrix.003 file - promoters50/1011303
tcaaaaact

SEQ ID NO: 64675 - DNA, 8 bp, Unknown
  misc_feature (1)..( 8): Matrix.003 file - promoters50/1011337
gtctaatt

SEQ ID NO: 64676 - DNA, 11 bp, Unknown
  misc_feature (1)..( 11): Matrix.003 file - promoters50/1011358
cgatacttgtc

SEQ ID NO: 64677 - DNA, 10 bp, Unknown
  misc_feature (1)..( 10): Matrix.003 file - promoters50/1011358
aagaactcat

SEQ ID NO: 64678 - DNA, 12 bp, Unknown
  misc_feature (1)..( 12): Matrix.003 file - promoters50/1011358
ttaaatgaagat

SEQ ID NO: 64679 - DNA, 10 bp, Unknown
  misc_feature (1)..( 10): Matrix.003 file - promoters50/1011358
tgtggtccat

SEQ ID NO: 64680 - DNA, 9 bp, Unknown
  misc_feature (1)..( 9): Matrix.003 file - promoters50/1011358
aaagaaaaa

SEQ ID NO: 64681 - DNA, 8 bp, Unknown
  misc_feature (1)..( 8): Matrix.003 file - promoters50/1011485
tcaaatca

SEQ ID NO: 64682 - DNA, 8 bp, Unknown
  misc_feature (1)..( 8): Matrix.003 file - promoters50/1011512
gaaaaaaa

SEQ ID NO: 64683 - DNA, 10 bp, Unknown
  misc_feature (1)..( 10): Matrix.003 file - promoters50/1011512
acaaataaac

SEQ ID NO: 64684 - DNA, 7 bp, Unknown
  misc_feature (1)..( 7): Matrix.003 file - promoters50/1011512
gaaaaaa

SEQ ID NO: 64685 - DNA, 8 bp, Unknown
  misc_feature (1)..( 8): Matrix.003 file - promoters50/1011516
caatgaga

SEQ ID NO: 64686 - DNA, 10 bp, Unknown
  misc_feature (1)..( 10): Matrix.003 file - promoters50/1011516
ctatattaat

SEQ ID NO: 64687 - DNA, 12 bp, Unknown
  misc_feature (1)..( 12): Matrix.003 file - promoters50/1011556
gtttaattcgta

SEQ ID NO: 64688 - DNA, 10 bp, Unknown
  misc_feature (1)..( 10): Matrix.003 file - promoters50/1011560
acttgcctct

SEQ ID NO: 64689 - DNA, 10 bp, Unknown
  misc_feature (1)..( 10): Matrix.003 file - promoters50/1011585
aaatcaaacc

SEQ ID NO: 64690 - DNA, 7 bp, Unknown
  misc_feature (1)..( 7): Matrix.003 file - promoters50/1011707
tttcttc

SEQ ID NO: 64691 - DNA, 6 bp, Unknown
  misc_feature (1)..( 6): Matrix.003 file - promoters50/1011707
agtgtg

SEQ ID NO: 64692 - DNA, 8 bp, Unknown
  misc_feature (1)..( 8): Matrix.003 file - promoters50/1011780
aattgttt

SEQ ID NO: 64693 - DNA, 14 bp, Unknown
  misc_feature (1)..( 14): Matrix.003 file - promoters50/1011780
taattttgctaatg

SEQ ID NO: 64694 - DNA, 10 bp, Unknown
  misc_feature (1)..( 10): Matrix.003 file - promoters50/1011780
ttacaaaaat

SEQ ID NO: 64695 - DNA, 8 bp, Unknown
  misc_feature (1)..( 8): Matrix.003 file - promoters50/1011862
ctaaaaac

SEQ ID NO: 64696 - DNA, 10 bp, Unknown
  misc_feature (1)..( 10): Matrix.003 file - promoters50/1011862
cagtttcatt

SEQ ID NO: 64697 - DNA, 10 bp, Unknown
  misc_feature (1)..( 10): Matrix.003 file - promoters50/1011862
caattttgtt

SEQ ID NO: 64698 - DNA, 9 bp, Unknown
  misc_feature (1)..( 9): Matrix.003 file - promoters50/1011862
gagaaaaga

SEQ ID NO: 64699 - DNA, 10 bp, Unknown
  misc_feature (1)..( 10): Matrix.003 file - promoters50/1011862
tttcgtttat

SEQ ID NO: 64700 - DNA, 9 bp, Unknown
  misc_feature (1)..( 9): Matrix.003 file - promoters50/1011900
cccatatcc

SEQ ID NO: 64701 - DNA, 9 bp, Unknown
  misc_feature (1)..( 9): Matrix.003 file - promoters50/1011923
ttaacttca

SEQ ID NO: 64702 - DNA, 11 bp, Unknown
  misc_feature (1)..( 11): Matrix.003 file - promoters50/1011923
tcatttaattt

SEQ ID NO: 64703 - DNA, 12 bp, Unknown
  misc_feature (1)..( 12): Matrix.003 file - promoters50/1011972
agtttttgatat

SEQ ID NO: 64704 - DNA, 11 bp, Unknown
  misc_feature (1)..( 11): Matrix.003 file - promoters50/1011972
aaaaatatatt

SEQ ID NO: 64705 - DNA, 13 bp, Unknown
  misc_feature (1)..( 13): Matrix.003 file - promoters50/1011972
atactaatcaaat

SEQ ID NO: 64706 - DNA, 9 bp, Unknown
  misc_feature (1)..( 9): Matrix.003 file - promoters50/1011972
tctactata

SEQ ID NO: 64707 - DNA, 10 bp, Unknown
  misc_feature (1)..( 10): Matrix.003 file - promoters50/1011972
tatatataaa

SEQ ID NO: 64708 - DNA, 14 bp, Unknown
  misc_feature (1)..( 14): Matrix.003 file - promoters50/1012052
aaaaaattagattt

SEQ ID NO: 64709 - DNA, 7 bp, Unknown
  misc_feature (1)..( 7): Matrix.003 file - promoters50/1012060
cttcttt

SEQ ID NO: 64710 - DNA, 8 bp, Unknown
  misc_feature (1)..( 8): Matrix.003 file - promoters50/1012060
tttgattt

SEQ ID NO: 64711 - DNA, 10 bp, Unknown
  misc_feature (1)..( 10): Matrix.003 file - promoters50/1012060
gacaagtttc

SEQ ID NO: 64712 - DNA, 11 bp, Unknown
  misc_feature (1)..( 11): Matrix.003 file - promoters50/1012074
atttaataaca

SEQ ID NO: 64713 - DNA, 12 bp, Unknown
  misc_feature (1)..( 12): Matrix.003 file - promoters50/1012078
gttataattttt

SEQ ID NO: 64714 - DNA, 11 bp, Unknown
  misc_feature (1)..( 11): Matrix.003 file - promoters50/1012078
tcttgttatat

SEQ ID NO: 64715 - DNA, 9 bp, Unknown
  misc_feature (1)..( 9): Matrix.003 file - promoters50/1012088
atgatttat

SEQ ID NO: 64716 - DNA, 14 bp, Unknown
  misc_feature (1)..( 14): Matrix.003 file - promoters50/1012088
ttgtttctatgaag

SEQ ID NO: 64717 - DNA, 9 bp, Unknown
  misc_feature (1)..( 9): Matrix.003 file - promoters50/1012088
aaaatatat

SEQ ID NO: 64718 - DNA, 12 bp, Unknown
  misc_feature (1)..( 12): Matrix.003 file - promoters50/1012088
ccaacaaaaatc

SEQ ID NO: 64719 - DNA, 10 bp, Unknown
  misc_feature (1)..( 10): Matrix.003 file - promoters50/1012088
aaaatatata

SEQ ID NO: 64720 - DNA, 12 bp, Unknown
  misc_feature (1)..( 12): Matrix.003 file - promoters50/1012088
tatttaaaaaaa

SEQ ID NO: 64721 - DNA, 10 bp, Unknown
  misc_feature (1)..( 10): Matrix.003 file - promoters50/1012088
atttgtatta

SEQ ID NO: 64722 - DNA, 11 bp, Unknown
  misc_feature (1)..( 11): Matrix.003 file - promoters50/1012110
acataattaag

SEQ ID NO: 64723 - DNA, 9 bp, Unknown
  misc_feature (1)..( 9): Matrix.003 file - promoters50/1012110
taaataaaa

SEQ ID NO: 64724 - DNA, 8 bp, Unknown
  misc_feature (1)..( 8): Matrix.003 file - promoters50/1012118
aattattt

SEQ ID NO: 64725 - DNA, 11 bp, Unknown
  misc_feature (1)..( 11): Matrix.003 file - promoters50/1012118
tgaaaaataat

SEQ ID NO: 64726 - DNA, 8 bp, Unknown
  misc_feature (1)..( 8): Matrix.003 file - promoters50/1012118
gatattcg

SEQ ID NO: 64727 - DNA, 14 bp, Unknown
  misc_feature (1)..( 14): Matrix.003 file - promoters50/1012128
gttcaaaacccaca

SEQ ID NO: 64728 - DNA, 9 bp, Unknown
  misc_feature (1)..( 9): Matrix.003 file - promoters50/1012128
aagaagaat

SEQ ID NO: 64729 - DNA, 14 bp, Unknown
  misc_feature (1)..( 14): Matrix.003 file - promoters50/1012128
aagcccatttaatt

SEQ ID NO: 64730 - DNA, 12 bp, Unknown
  misc_feature (1)..( 12): Matrix.003 file - promoters50/1012128
gaatataaaaaa

SEQ ID NO: 64731 - DNA, 9 bp, Unknown
  misc_feature (1)..( 9): Matrix.003 file - promoters50/1012132
gaaacttag

SEQ ID NO: 64732 - DNA, 9 bp, Unknown
  misc_feature (1)..( 9): Matrix.003 file - promoters50/1012132
tttcaaatg

SEQ ID NO: 64733 - DNA, 11 bp, Unknown
  misc_feature (1)..( 11): Matrix.003 file - promoters50/1012132
ttaaaataaac

SEQ ID NO: 64734 - DNA, 12 bp, Unknown
  misc_feature (1)..( 12): Matrix.003 file - promoters50/1012132
aaaaataaattt

SEQ ID NO: 64735 - DNA, 11 bp, Unknown
  misc_feature (1)..( 11): Matrix.003 file - promoters50/1012132
ttaattttcga

SEQ ID NO: 64736 - DNA, 10 bp, Unknown
  misc_feature (1)..( 10): Matrix.003 file - promoters50/1012132
aaaaaatcta

SEQ ID NO: 64737 - DNA, 8 bp, Unknown
  misc_feature (1)..( 8): Matrix.003 file - promoters50/1012132
ttcttcat

SEQ ID NO: 64738 - DNA, 12 bp, Unknown
  misc_feature (1)..( 12): Matrix.003 file - promoters50/1012132
aaaaataaattt

SEQ ID NO: 64739 - DNA, 8 bp, Unknown
  misc_feature (1)..( 8): Matrix.003 file - promoters50/1012132
tttatata

SEQ ID NO: 64740 - DNA, 12 bp, Unknown
  misc_feature (1)..( 12): Matrix.003 file - promoters50/1012132
taaattttatat

SEQ ID NO: 64741 - DNA, 11 bp, Unknown
  misc_feature (1)..( 11): Matrix.003 file - promoters50/1012132
ataaataataa

SEQ ID NO: 64742 - DNA, 8 bp, Unknown
  misc_feature (1)..( 8): Matrix.003 file - promoters50/1012194
taaaaaat

SEQ ID NO: 64743 - DNA, 10 bp, Unknown
  misc_feature (1)..( 10): Matrix.003 file - promoters50/1012194
atatttaact

SEQ ID NO: 64744 - DNA, 9 bp, Unknown
  misc_feature (1)..( 9): Matrix.003 file - promoters50/1012194
ttacttatg

SEQ ID NO: 64745 - DNA, 9 bp, Unknown
  misc_feature (1)..( 9): Matrix.003 file - promoters50/1012205
attataaaa

SEQ ID NO: 64746 - DNA, 9 bp, Unknown
  misc_feature (1)..( 9): Matrix.003 file - promoters50/1012205
atgacaaaa

SEQ ID NO: 64747 - DNA, 8 bp, Unknown
  misc_feature (1)..( 8): Matrix.003 file - promoters50/1012205
gttttatt

SEQ ID NO: 64748 - DNA, 7 bp, Unknown
  misc_feature (1)..( 7): Matrix.003 file - promoters50/1012205
taataaa

SEQ ID NO: 64749 - DNA, 9 bp, Unknown
  misc_feature (1)..( 9): Matrix.003 file - promoters50/1012205
ttaccgtag

SEQ ID NO: 64750 - DNA, 9 bp, Unknown
  misc_feature (1)..( 9): Matrix.003 file - promoters50/1012205
agtttatat

SEQ ID NO: 64751 - DNA, 8 bp, Unknown
  misc_feature (1)..( 8): Matrix.003 file - promoters50/1012205
aaatttga

SEQ ID NO: 64752 - DNA, 9 bp, Unknown
  misc_feature (1)..( 9): Matrix.003 file - promoters50/1012205
aaattttat

SEQ ID NO: 64753 - DNA, 8 bp, Unknown
  misc_feature (1)..( 8): Matrix.003 file - promoters50/1012205
aaaactaa

SEQ ID NO: 64754 - DNA, 7 bp, Unknown
  misc_feature (1)..( 7): Matrix.003 file - promoters50/1012219
aaacaaa

SEQ ID NO: 64755 - DNA, 8 bp, Unknown
  misc_feature (1)..( 8): Matrix.003 file - promoters50/1012219
aaatttat

SEQ ID NO: 64756 - DNA, 8 bp, Unknown
  misc_feature (1)..( 8): Matrix.003 file - promoters50/1012219
catgtatt

SEQ ID NO: 64757 - DNA, 11 bp, Unknown
  misc_feature (1)..( 11): Matrix.003 file - promoters50/1012219
agatttggatt

SEQ ID NO: 64758 - DNA, 11 bp, Unknown
  misc_feature (1)..( 11): Matrix.003 file - promoters50/1012219
ataaaatttta

SEQ ID NO: 64759 - DNA, 8 bp, Unknown
  misc_feature (1)..( 8): Matrix.003 file - promoters50/1012219
aaattata

SEQ ID NO: 64760 - DNA, 7 bp, Unknown
  misc_feature (1)..( 7): Matrix.003 file - promoters50/1012245
ttttggt

SEQ ID NO: 64761 - DNA, 10 bp, Unknown
  misc_feature (1)..( 10): Matrix.003 file - promoters50/1012311
cttgtcagat

SEQ ID NO: 64762 - DNA, 9 bp, Unknown
  misc_feature (1)..( 9): Matrix.003 file - promoters50/1012311
atgtctcag

SEQ ID NO: 64763 - DNA, 38 bp, Unknown
  misc_feature (1)..( 38): Matrix.003 file - promoters50/1012311
attcatacccacatgatcatgtcttctcaccacaagtt

SEQ ID NO: 64764 - DNA, 38 bp, Unknown
  misc_feature (1)..( 38): Matrix.003 file - promoters50/1012311
attcatacccacatgatcatgtcttctcacaacacaac

SEQ ID NO: 64765 - DNA, 17 bp, Unknown
  misc_feature (1)..( 17): Matrix.003 file - promoters50/1012311
tatagtccacaagttga

SEQ ID NO: 64766 - DNA, 15 bp, Unknown
  misc_feature (1)..( 15): Matrix.003 file - promoters50/1012311
gacataattgattac

SEQ ID NO: 64767 - DNA, 15 bp, Unknown
  misc_feature (1)..( 15): Matrix.003 file - promoters50/1012311
aacttgggaccctta

SEQ ID NO: 64768 - DNA, 34 bp, Unknown
  misc_feature (1)..( 34): Matrix.003 file - promoters50/1012311
aacctaatagtttctccttctatataatgaaaca

SEQ ID NO: 64769 - DNA, 13 bp, Unknown
  misc_feature (1)..( 13): Matrix.003 file - promoters50/1012311
catcaacagcctc

SEQ ID NO: 64770 - DNA, 16 bp, Unknown
  misc_feature (1)..( 16): Matrix.003 file - promoters50/1012311
attcttcaataatgtc

SEQ ID NO: 64771 - DNA, 27 bp, Unknown
  misc_feature (1)..( 27): Matrix.003 file - promoters50/1012311
tcttgtcatataaacgtccatatagga

SEQ ID NO: 64772 - DNA, 10 bp, Unknown
  misc_feature (1)..( 10): Matrix.003 file - promoters50/1012311
atatatgttt

SEQ ID NO: 64773 - DNA, 8 bp, Unknown
  misc_feature (1)..( 8): Matrix.003 file - promoters50/1012311
ataagttg

SEQ ID NO: 64774 - DNA, 10 bp, Unknown
  misc_feature (1)..( 10): Matrix.003 file - promoters50/1012349
caactataaa

SEQ ID NO: 64775 - DNA, 12 bp, Unknown
  misc_feature (1)..( 12): Matrix.003 file - promoters50/1012349
aaacgtttgtta

SEQ ID NO: 64776 - DNA, 12 bp, Unknown
  misc_feature (1)..( 12): Matrix.003 file - promoters50/1012388
taaaagtttaaa

SEQ ID NO: 64777 - DNA, 12 bp, Unknown
  misc_feature (1)..( 12): Matrix.003 file - promoters50/1012397
ttaatttattta

SEQ ID NO: 64778 - DNA, 8 bp, Unknown
  misc_feature (1)..( 8): Matrix.003 file - promoters50/1012397
aatttatt

SEQ ID NO: 64779 - DNA, 15 bp, Unknown
  misc_feature (1)..( 15): Matrix.003 file - promoters50/1012397
aatttcttttctatt

SEQ ID NO: 64780 - DNA, 8 bp, Unknown
  misc_feature (1)..( 8): Matrix.003 file - promoters50/1012397
aaaacaaa

SEQ ID NO: 64781 - DNA, 8 bp, Unknown
  misc_feature (1)..( 8): Matrix.003 file - promoters50/1012397
aattaaac

SEQ ID NO: 64782 - DNA, 7 bp, Unknown
  misc_feature (1)..( 7): Matrix.003 file - promoters50/1012403
atgtttc

SEQ ID NO: 64783 - DNA, 11 bp, Unknown
  misc_feature (1)..( 11): Matrix.003 file - promoters50/1012403
cttttgttaaa

SEQ ID NO: 64784 - DNA, 10 bp, Unknown
  misc_feature (1)..( 10): Matrix.003 file - promoters50/1012403
tgtaagaaaa

SEQ ID NO: 64785 - DNA, 8 bp, Unknown
  misc_feature (1)..( 8): Matrix.003 file - promoters50/1012403
ttttatta

SEQ ID NO: 64786 - DNA, 11 bp, Unknown
  misc_feature (1)..( 11): Matrix.003 file - promoters50/1012403
tttagaaaata

SEQ ID NO: 64787 - DNA, 11 bp, Unknown
  misc_feature (1)..( 11): Matrix.003 file - promoters50/1012403
attttttgaat

SEQ ID NO: 64788 - DNA, 12 bp, Unknown
  misc_feature (1)..( 12): Matrix.003 file - promoters50/1012403
tttgaaatcaaa

SEQ ID NO: 64789 - DNA, 16 bp, Unknown
  misc_feature (1)..( 16): Matrix.003 file - promoters50/1012407
taattttaataataaa

SEQ ID NO: 64790 - DNA, 14 bp, Unknown
  misc_feature (1)..( 14): Matrix.003 file - promoters50/1012442
ataagatttacaaa

SEQ ID NO: 64791 - DNA, 8 bp, Unknown
  misc_feature (1)..( 8): Matrix.003 file - promoters50/1012442
aagaaatt

SEQ ID NO: 64792 - DNA, 7 bp, Unknown
  misc_feature (1)..( 7): Matrix.003 file - promoters50/1012442
agatata

SEQ ID NO: 64793 - DNA, 6 bp, Unknown
  misc_feature (1)..( 6): Matrix.003 file - promoters50/1012442
aaataa

SEQ ID NO: 64794 - DNA, 7 bp, Unknown
  misc_feature (1)..( 7): Matrix.003 file - promoters50/1012442
tttttaa

SEQ ID NO: 64795 - DNA, 12 bp, Unknown
  misc_feature (1)..( 12): Matrix.003 file - promoters50/1012442
aaaaacaaaaca

SEQ ID NO: 64796 - DNA, 5 bp, Unknown
  misc_feature (1)..( 5): Matrix.003 file - promoters50/1012561
gaaat

SEQ ID NO: 64797 - DNA, 11 bp, Unknown
  misc_feature (1)..( 11): Matrix.003 file - promoters50/1012561
aatttttgtgt

SEQ ID NO: 64798 - DNA, 9 bp, Unknown
  misc_feature (1)..( 9): Matrix.003 file - promoters50/1012561
atcattttt

SEQ ID NO: 64799 - DNA, 10 bp, Unknown
  misc_feature (1)..( 10): Matrix.003 file - promoters50/1012561
tttctttttt

SEQ ID NO: 64800 - DNA, 10 bp, Unknown
  misc_feature (1)..( 10): Matrix.003 file - promoters50/1012561
aaaaaattat

SEQ ID NO: 64801 - DNA, 9 bp, Unknown
  misc_feature (1)..( 9): Matrix.003 file - promoters50/1012568
attcttctt

SEQ ID NO: 64802 - DNA, 9 bp, Unknown
  misc_feature (1)..( 9): Matrix.003 file - promoters50/1012568
tttaatttt

SEQ ID NO: 64803 - DNA, 6 bp, Unknown
  misc_feature (1)..( 6): Matrix.003 file - promoters50/1012568
ttttta

SEQ ID NO: 64804 - DNA, 7 bp, Unknown
  misc_feature (1)..( 7): Matrix.003 file - promoters50/1012568
tttagta

SEQ ID NO: 64805 - DNA, 6 bp, Unknown
  misc_feature (1)..( 6): Matrix.003 file - promoters50/1012580
cttata

SEQ ID NO: 64806 - DNA, 11 bp, Unknown
  misc_feature (1)..( 11): Matrix.003 file - promoters50/1012620
ataatttgagt

SEQ ID NO: 64807 - DNA, 10 bp, Unknown
  misc_feature (1)..( 10): Matrix.003 file - promoters50/1012620
aatttataaa

SEQ ID NO: 64808 - DNA, 10 bp, Unknown
  misc_feature (1)..( 10): Matrix.003 file - promoters50/1012620
agaaaaaaga

SEQ ID NO: 64809 - DNA, 9 bp, Unknown
  misc_feature (1)..( 9): Matrix.003 file - promoters50/1012620
acttataaa

SEQ ID NO: 64810 - DNA, 8 bp, Unknown
  misc_feature (1)..( 8): Matrix.003 file - promoters50/1012620
aggaggaa

SEQ ID NO: 64811 - DNA, 9 bp, Unknown
  misc_feature (1)..( 9): Matrix.003 file - promoters50/1012620
taatgaaat

SEQ ID NO: 64812 - DNA, 8 bp, Unknown
  misc_feature (1)..( 8): Matrix.003 file - promoters50/1012620
gttacaac

SEQ ID NO: 64813 - DNA, 10 bp, Unknown
  misc_feature (1)..( 10): Matrix.003 file - promoters50/1012659
atgaaaaaat

SEQ ID NO: 64814 - DNA, 10 bp, Unknown
  misc_feature (1)..( 10): Matrix.003 file - promoters50/1012659
tcactttgaa

SEQ ID NO: 64815 - DNA, 10 bp, Unknown
  misc_feature (1)..( 10): Matrix.003 file - promoters50/1012659
tttctttatc

SEQ ID NO: 64816 - DNA, 11 bp, Unknown
  misc_feature (1)..( 11): Matrix.003 file - promoters50/1012720
aaatgttttga

SEQ ID NO: 64817 - DNA, 9 bp, Unknown
  misc_feature (1)..( 9): Matrix.003 file - promoters50/1012720
tgttaaaat

SEQ ID NO: 64818 - DNA, 6 bp, Unknown
  misc_feature (1)..( 6): Matrix.003 file - promoters50/1012720
atattg

SEQ ID NO: 64819 - DNA, 10 bp, Unknown
  misc_feature (1)..( 10): Matrix.003 file - promoters50/1012757
tataataata

SEQ ID NO: 64820 - DNA, 12 bp, Unknown
  misc_feature (1)..( 12): Matrix.003 file - promoters50/1012757
atatattaatgt

SEQ ID NO: 64821 - DNA, 9 bp, Unknown
  misc_feature (1)..( 9): Matrix.003 file - promoters50/1012761
taaaaaaaa

SEQ ID NO: 64822 - DNA, 7 bp, Unknown
  misc_feature (1)..( 7): Matrix.003 file - promoters50/1012761
aaataaa

SEQ ID NO: 64823 - DNA, 7 bp, Unknown
  misc_feature (1)..( 7): Matrix.003 file - promoters50/1012761
aaagaaa

SEQ ID NO: 64824 - DNA, 7 bp, Unknown
  misc_feature (1)..( 7): Matrix.003 file - promoters50/1012761
gatttga

SEQ ID NO: 64825 - DNA, 9 bp, Unknown
  misc_feature (1)..( 9): Matrix.003 file - promoters50/1012761
taaccaaga

SEQ ID NO: 64826 - DNA, 8 bp, Unknown
  misc_feature (1)..( 8): Matrix.003 file - promoters50/1012791
aaacaaaa

SEQ ID NO: 64827 - DNA, 8 bp, Unknown
  misc_feature (1)..( 8): Matrix.003 file - promoters50/1012791
aataaaca

SEQ ID NO: 64828 - DNA, 6 bp, Unknown
  misc_feature (1)..( 6): Matrix.003 file - promoters50/1012791
ttttta

SEQ ID NO: 64829 - DNA, 11 bp, Unknown
  misc_feature (1)..( 11): Matrix.003 file - promoters50/1012791
aaaaaacaaat

SEQ ID NO: 64830 - DNA, 9 bp, Unknown
  misc_feature (1)..( 9): Matrix.003 file - promoters50/1012791
ttctttttt

SEQ ID NO: 64831 - DNA, 9 bp, Unknown
  misc_feature (1)..( 9): Matrix.003 file - promoters50/1012791
ttttaaaaa

SEQ ID NO: 64832 - DNA, 9 bp, Unknown
  misc_feature (1)..( 9): Matrix.003 file - promoters50/1012791
tttattttc

SEQ ID NO: 64833 - DNA, 8 bp, Unknown
  misc_feature (1)..( 8): Matrix.003 file - promoters50/1012791
gaaaatga

SEQ ID NO: 64834 - DNA, 8 bp, Unknown
  misc_feature (1)..( 8): Matrix.003 file - promoters50/1012795
ttatgaaa

SEQ ID NO: 64835 - DNA, 8 bp, Unknown
  misc_feature (1)..( 8): Matrix.003 file - promoters50/1012795
tttggtta

SEQ ID NO: 64836 - DNA, 8 bp, Unknown
  misc_feature (1)..( 8): Matrix.003 file - promoters50/1012803
caagaaaa

SEQ ID NO: 64837 - DNA, 7 bp, Unknown
  misc_feature (1)..( 7): Matrix.003 file - promoters50/1012803
cataata

SEQ ID NO: 64838 - DNA, 7 bp, Unknown
  misc_feature (1)..( 7): Matrix.003 file - promoters50/1012803
aaataaa

SEQ ID NO: 64839 - DNA, 8 bp, Unknown
  misc_feature (1)..( 8): Matrix.003 file - promoters50/1012803
cacaaagt

SEQ ID NO: 64840 - DNA, 10 bp, Unknown
  misc_feature (1)..( 10): Matrix.003 file - promoters50/1012803
ggatattaaa

SEQ ID NO: 64841 - DNA, 8 bp, Unknown
  misc_feature (1)..( 8): Matrix.003 file - promoters50/1012811
tgttgatt

SEQ ID NO: 64842 - DNA, 7 bp, Unknown
  misc_feature (1)..( 7): Matrix.003 file - promoters50/1012811
aaattaa

SEQ ID NO: 64843 - DNA, 8 bp, Unknown
  misc_feature (1)..( 8): Matrix.003 file - promoters50/1012811
aattcaca

SEQ ID NO: 64844 - DNA, 8 bp, Unknown
  misc_feature (1)..( 8): Matrix.003 file - promoters50/1012811
taaaaaca

SEQ ID NO: 64845 - DNA, 9 bp, Unknown
  misc_feature (1)..( 9): Matrix.003 file - promoters50/1012811
aaaataaat

SEQ ID NO: 64846 - DNA, 9 bp, Unknown
  misc_feature (1)..( 9): Matrix.003 file - promoters50/1012811
gttttatta

SEQ ID NO: 64847 - DNA, 8 bp, Unknown
  misc_feature (1)..( 8): Matrix.003 file - promoters50/1012811
tgttttaa

SEQ ID NO: 64848 - DNA, 9 bp, Unknown
  misc_feature (1)..( 9): Matrix.003 file - promoters50/1012811
aatagtata

SEQ ID NO: 64849 - DNA, 7 bp, Unknown
  misc_feature (1)..( 7): Matrix.003 file - promoters50/1012811
aaaaaac

SEQ ID NO: 64850 - DNA, 7 bp, Unknown
  misc_feature (1)..( 7): Matrix.003 file - promoters50/1012811
atttaaa

SEQ ID NO: 64851 - DNA, 8 bp, Unknown
  misc_feature (1)..( 8): Matrix.003 file - promoters50/1012811
gtattaaa

SEQ ID NO: 64852 - DNA, 8 bp, Unknown
  misc_feature (1)..( 8): Matrix.003 file - promoters50/1012835
cttacaca

SEQ ID NO: 64853 - DNA, 10 bp, Unknown
  misc_feature (1)..( 10): Matrix.003 file - promoters50/1012883
ttacaaaaaa

SEQ ID NO: 64854 - DNA, 9 bp, Unknown
  misc_feature (1)..( 9): Matrix.003 file - promoters50/1012883
gaataaatt

SEQ ID NO: 64855 - DNA, 13 bp, Unknown
  misc_feature (1)..( 13): Matrix.003 file - promoters50/1012906
aaaaatatgtttg

SEQ ID NO: 64856 - DNA, 9 bp, Unknown
  misc_feature (1)..( 9): Matrix.003 file - promoters50/1012906
aaaaactta

SEQ ID NO: 64857 - DNA, 12 bp, Unknown
  misc_feature (1)..( 12): Matrix.003 file - promoters50/1012906
taatttatatat

SEQ ID NO: 64858 - DNA, 7 bp, Unknown
  misc_feature (1)..( 7): Matrix.003 file - promoters50/1012906
aaaatca

SEQ ID NO: 64859 - DNA, 22 bp, Unknown
  misc_feature (1)..( 22): Matrix.003 file - promoters50/1012906
tttgaaatattataataaatat

SEQ ID NO: 64860 - DNA, 21 bp, Unknown
  misc_feature (1)..( 21): Matrix.003 file - promoters50/1012906
gtcaatattataaataaattt

SEQ ID NO: 64861 - DNA, 11 bp, Unknown
  misc_feature (1)..( 11): Matrix.003 file - promoters50/1012906
aattgatataa

SEQ ID NO: 64862 - DNA, 14 bp, Unknown
  misc_feature (1)..( 14): Matrix.003 file - promoters50/1012906
gaagaattgatata

SEQ ID NO: 64863 - DNA, 13 bp, Unknown
  misc_feature (1)..( 13): Matrix.003 file - promoters50/1012906
ttttaaattcatt

SEQ ID NO: 64864 - DNA, 16 bp, Unknown
  misc_feature (1)..( 16): Matrix.003 file - promoters50/1012943
aaaaatgttcaaaatt

SEQ ID NO: 64865 - DNA, 7 bp, Unknown
  misc_feature (1)..( 7): Matrix.003 file - promoters50/1012947
acaaaag

SEQ ID NO: 64866 - DNA, 7 bp, Unknown
  misc_feature (1)..( 7): Matrix.003 file - promoters50/1012947
aactatt

SEQ ID NO: 64867 - DNA, 11 bp, Unknown
  misc_feature (1)..( 11): Matrix.003 file - promoters50/1012947
agttattaatc

SEQ ID NO: 64868 - DNA, 11 bp, Unknown
  misc_feature (1)..( 11): Matrix.003 file - promoters50/1012955
ttaattaagtt

SEQ ID NO: 64869 - DNA, 12 bp, Unknown
  misc_feature (1)..( 12): Matrix.003 file - promoters50/1012955
gatatcttataa

SEQ ID NO: 64870 - DNA, 10 bp, Unknown
  misc_feature (1)..( 10): Matrix.003 file - promoters50/1012964
taacaagaat

SEQ ID NO: 64871 - DNA, 9 bp, Unknown
  misc_feature (1)..( 9): Matrix.003 file - promoters50/1012964
tatctcaaa

SEQ ID NO: 64872 - DNA, 8 bp, Unknown
  misc_feature (1)..( 8): Matrix.003 file - promoters50/1012984
atttgtga

SEQ ID NO: 64873 - DNA, 8 bp, Unknown
  misc_feature (1)..( 8): Matrix.003 file - promoters50/1012984
atataaaa

SEQ ID NO: 64874 - DNA, 13 bp, Unknown
  misc_feature (1)..( 13): Matrix.003 file - promoters50/1012984
aattagtttatga

SEQ ID NO: 64875 - DNA, 8 bp, Unknown
  misc_feature (1)..( 8): Matrix.003 file - promoters50/1012988
caaatcga

SEQ ID NO: 64876 - DNA, 9 bp, Unknown
  misc_feature (1)..( 9): Matrix.003 file - promoters50/1012988
tttaaaccg

SEQ ID NO: 64877 - DNA, 9 bp, Unknown
  misc_feature (1)..( 9): Matrix.003 file - promoters50/1012988
attcatcag

SEQ ID NO: 64878 - DNA, 9 bp, Unknown
  misc_feature (1)..( 9): Matrix.003 file - promoters50/1012998
taaaagaag

SEQ ID NO: 64879 - DNA, 12 bp, Unknown
  misc_feature (1)..( 12): Matrix.003 file - promoters50/1012998
cactttctctct

SEQ ID NO: 64880 - DNA, 8 bp, Unknown
  misc_feature (1)..( 8): Matrix.003 file - promoters50/1012998
ttttaatt

SEQ ID NO: 64881 - DNA, 8 bp, Unknown
  misc_feature (1)..( 8): Matrix.003 file - promoters50/1012998
aaaaaaaa

SEQ ID NO: 64882 - DNA, 11 bp, Unknown
  misc_feature (1)..( 11): Matrix.003 file - promoters50/1012998
taaaagaagaa

SEQ ID NO: 64883 - DNA, 8 bp, Unknown
  misc_feature (1)..( 8): Matrix.003 file - promoters50/1012998
tataaata

SEQ ID NO: 64884 - DNA, 13 bp, Unknown
  misc_feature (1)..( 13): Matrix.003 file - promoters50/1013013
agtaattaatcac

SEQ ID NO: 64885 - DNA, 9 bp, Unknown
  misc_feature (1)..( 9): Matrix.003 file - promoters50/1013013
tttattaaa

SEQ ID NO: 64886 - DNA, 12 bp, Unknown
  misc_feature (1)..( 12): Matrix.003 file - promoters50/1013013
aaaagttcatct

SEQ ID NO: 64887 - DNA, 8 bp, Unknown
  misc_feature (1)..( 8): Matrix.003 file - promoters50/1013013
ctgttttt

SEQ ID NO: 64888 - DNA, 8 bp, Unknown
  misc_feature (1)..( 8): Matrix.003 file - promoters50/1013016
agaaatga

SEQ ID NO: 64889 - DNA, 10 bp, Unknown
  misc_feature (1)..( 10): Matrix.003 file - promoters50/1013016
gatcaattga

SEQ ID NO: 64890 - DNA, 13 bp, Unknown
  misc_feature (1)..( 13): Matrix.003 file - promoters50/1013016
aaagacattatat

SEQ ID NO: 64891 - DNA, 8 bp, Unknown
  misc_feature (1)..( 8): Matrix.003 file - promoters50/1013016
gaacagaa

SEQ ID NO: 64892 - DNA, 8 bp, Unknown
  misc_feature (1)..( 8): Matrix.003 file - promoters50/1013016
ttcaaata

SEQ ID NO: 64893 - DNA, 24 bp, Unknown
  misc_feature (1)..( 24): Matrix.003 file - promoters50/1013128
acgtttgataaaaatataaaaatc

SEQ ID NO: 64894 - DNA, 11 bp, Unknown
  misc_feature (1)..( 11): Matrix.003 file - promoters50/1013128
agaaaaaaaag

SEQ ID NO: 64895 - DNA, 11 bp, Unknown
  misc_feature (1)..( 11): Matrix.003 file - promoters50/1013131
taaaataatcc

SEQ ID NO: 64896 - DNA, 10 bp, Unknown
  misc_feature (1)..( 10): Matrix.003 file - promoters50/1013131
tttagattta

SEQ ID NO: 64897 - DNA, 4 bp, Unknown
  misc_feature (1)..( 4): Matrix.003 file - promoters50/1013131
aaat

SEQ ID NO: 64898 - DNA, 9 bp, Unknown
  misc_feature (1)..( 9): Matrix.003 file - promoters50/1013131
tgaataaaa

SEQ ID NO: 64899 - DNA, 12 bp, Unknown
  misc_feature (1)..( 12): Matrix.003 file - promoters50/1013208
cttcttttgtag

SEQ ID NO: 64900 - DNA, 10 bp, Unknown
  misc_feature (1)..( 10): Matrix.003 file - promoters50/1013208
gtttaataaa

SEQ ID NO: 64901 - DNA, 9 bp, Unknown
  misc_feature (1)..( 9): Matrix.003 file - promoters50/1013208
atttttttg

SEQ ID NO: 64902 - DNA, 11 bp, Unknown
  misc_feature (1)..( 11): Matrix.003 file - promoters50/1013208
aaaataattta

SEQ ID NO: 64903 - DNA, 10 bp, Unknown
  misc_feature (1)..( 10): Matrix.003 file - promoters50/1013242
aagtaaagat

SEQ ID NO: 64904 - DNA, 12 bp, Unknown
  misc_feature (1)..( 12): Matrix.003 file - promoters50/1013242
tgtataaaaaga

SEQ ID NO: 64905 - DNA, 11 bp, Unknown
  misc_feature (1)..( 11): Matrix.003 file - promoters50/1013242
aatccaaaata

SEQ ID NO: 64906 - DNA, 9 bp, Unknown
  misc_feature (1)..( 9): Matrix.003 file - promoters50/1013274
aatagaaaa

SEQ ID NO: 64907 - DNA, 13 bp, Unknown
  misc_feature (1)..( 13): Matrix.003 file - promoters50/1013274
attttctttttta

SEQ ID NO: 64908 - DNA, 9 bp, Unknown
  misc_feature (1)..( 9): Matrix.003 file - promoters50/1013274
attttgatt

SEQ ID NO: 64909 - DNA, 11 bp, Unknown
  misc_feature (1)..( 11): Matrix.003 file - promoters50/1013274
cattttttttt

SEQ ID NO: 64910 - DNA, 7 bp, Unknown
  misc_feature (1)..( 7): Matrix.003 file - promoters50/1013274
aacttaa

SEQ ID NO: 64911 - DNA, 10 bp, Unknown
  misc_feature (1)..( 10): Matrix.003 file - promoters50/1013274
tattttcatt

SEQ ID NO: 64912 - DNA, 13 bp, Unknown
  misc_feature (1)..( 13): Matrix.003 file - promoters50/1013274
ttatctatttttc

SEQ ID NO: 64913 - DNA, 8 bp, Unknown
  misc_feature (1)..( 8): Matrix.003 file - promoters50/1013310
taaatata

SEQ ID NO: 64914 - DNA, 11 bp, Unknown
  misc_feature (1)..( 11): Matrix.003 file - promoters50/1013314
aaatattttta

SEQ ID NO: 64915 - DNA, 13 bp, Unknown
  misc_feature (1)..( 13): Matrix.003 file - promoters50/1013314
aaatatttttatt

SEQ ID NO: 64916 - DNA, 12 bp, Unknown
  misc_feature (1)..( 12): Matrix.003 file - promoters50/1013314
aataaaagaatt

SEQ ID NO: 64917 - DNA, 6 bp, Unknown
  misc_feature (1)..( 6): Matrix.003 file - promoters50/1013314
ataaat

SEQ ID NO: 64918 - DNA, 12 bp, Unknown
  misc_feature (1)..( 12): Matrix.003 file - promoters50/1013314
ttttgaaatttt

SEQ ID NO: 64919 - DNA, 10 bp, Unknown
  misc_feature (1)..( 10): Matrix.003 file - promoters50/1013341
taaattattt

SEQ ID NO: 64920 - DNA, 11 bp, Unknown
  misc_feature (1)..( 11): Matrix.003 file - promoters50/1013341
taaataaaacc

SEQ ID NO: 64921 - DNA, 12 bp, Unknown
  misc_feature (1)..( 12): Matrix.003 file - promoters50/1013427
ttcctattttaa

SEQ ID NO: 64922 - DNA, 10 bp, Unknown
  misc_feature (1)..( 10): Matrix.003 file - promoters50/1013427
ttcaatttca

SEQ ID NO: 64923 - DNA, 10 bp, Unknown
  misc_feature (1)..( 10): Matrix.003 file - promoters50/1013441
tataaatgag

SEQ ID NO: 64924 - DNA, 13 bp, Unknown
  misc_feature (1)..( 13): Matrix.003 file - promoters50/1013441
attagattttttt

SEQ ID NO: 64925 - DNA, 10 bp, Unknown
  misc_feature (1)..( 10): Matrix.003 file - promoters50/1013441
agattttgtg

SEQ ID NO: 64926 - DNA, 8 bp, Unknown
  misc_feature (1)..( 8): Matrix.003 file - promoters50/1013441
aattttat

SEQ ID NO: 64927 - DNA, 7 bp, Unknown
  misc_feature (1)..( 7): Matrix.003 file - promoters50/1013529
aaacaaa

SEQ ID NO: 64928 - DNA, 8 bp, Unknown
  misc_feature (1)..( 8): Matrix.003 file - promoters50/1013611
ttttatta

SEQ ID NO: 64929 - DNA, 10 bp, Unknown
  misc_feature (1)..( 10): Matrix.003 file - promoters50/1013611
ataaaacaaa

SEQ ID NO: 64930 - DNA, 6 bp, Unknown
  misc_feature (1)..( 6): Matrix.003 file - promoters50/1013611
aattag

SEQ ID NO: 64931 - DNA, 10 bp, Unknown
  misc_feature (1)..( 10): Matrix.003 file - promoters50/1013611
aaacaaaaaa

SEQ ID NO: 64932 - DNA, 12 bp, Unknown
  misc_feature (1)..( 12): Matrix.003 file - promoters50/1013629
aaacggtttctt

SEQ ID NO: 64933 - DNA, 11 bp, Unknown
  misc_feature (1)..( 11): Matrix.003 file - promoters50/1013629
tcttttcttta

SEQ ID NO: 64934 - DNA, 13 bp, Unknown
  misc_feature (1)..( 13): Matrix.003 file - promoters50/1013641
caattttgatatt

SEQ ID NO: 64935 - DNA, 7 bp, Unknown
  misc_feature (1)..( 7): Matrix.003 file - promoters50/1013641
acaaaac

SEQ ID NO: 64936 - DNA, 9 bp, Unknown
  misc_feature (1)..( 9): Matrix.003 file - promoters50/1013641
tcttgtctt

SEQ ID NO: 64937 - DNA, 8 bp, Unknown
  misc_feature (1)..( 8): Matrix.003 file - promoters50/1013641
ctcttttt

SEQ ID NO: 64938 - DNA, 9 bp, Unknown
  misc_feature (1)..( 9): Matrix.003 file - promoters50/1013645
cttgtatat

SEQ ID NO: 64939 - DNA, 9 bp, Unknown
  misc_feature (1)..( 9): Matrix.003 file - promoters50/1013665
atatttttt

SEQ ID NO: 64940 - DNA, 8 bp, Unknown
  misc_feature (1)..( 8): Matrix.003 file - promoters50/1013674
ttttgttt

SEQ ID NO: 64941 - DNA, 12 bp, Unknown
  misc_feature (1)..( 12): Matrix.003 file - promoters50/1013674
tttttgtttcaa

SEQ ID NO: 64942 - DNA, 8 bp, Unknown
  misc_feature (1)..( 8): Matrix.003 file - promoters50/1013674
ttaaaaat

SEQ ID NO: 64943 - DNA, 8 bp, Unknown
  misc_feature (1)..( 8): Matrix.003 file - promoters50/1013674
cttaaaat

SEQ ID NO: 64944 - DNA, 7 bp, Unknown
  misc_feature (1)..( 7): Matrix.003 file - promoters50/1013674
aacaaaa

SEQ ID NO: 64945 - DNA, 6 bp, Unknown
  misc_feature (1)..( 6): Matrix.003 file - promoters50/1013678
caaatt

SEQ ID NO: 64946 - DNA, 8 bp, Unknown
  misc_feature (1)..( 8): Matrix.003 file - promoters50/1013678
aaacgatt

SEQ ID NO: 64947 - DNA, 6 bp, Unknown
  misc_feature (1)..( 6): Matrix.003 file - promoters50/1013678
ttaaat

SEQ ID NO: 64948 - DNA, 11 bp, Unknown
  misc_feature (1)..( 11): Matrix.003 file - promoters50/1013678
agaatgagatc

SEQ ID NO: 64949 - DNA, 6 bp, Unknown
  misc_feature (1)..( 6): Matrix.003 file - promoters50/1013678
tagctt

SEQ ID NO: 64950 - DNA, 9 bp, Unknown
  misc_feature (1)..( 9): Matrix.003 file - promoters50/1013678
gcagagaag

SEQ ID NO: 64951 - DNA, 9 bp, Unknown
  misc_feature (1)..( 9): Matrix.003 file - promoters50/1013710
gtaatgagt

SEQ ID NO: 64952 - DNA, 8 bp, Unknown
  misc_feature (1)..( 8): Matrix.003 file - promoters50/1013710
gtgatttg

SEQ ID NO: 64953 - DNA, 10 bp, Unknown
  misc_feature (1)..( 10): Matrix.003 file - promoters50/1013710
cttgaataac

SEQ ID NO: 64954 - DNA, 12 bp, Unknown
  misc_feature (1)..( 12): Matrix.003 file - promoters50/1013714
ctatataatacc

SEQ ID NO: 64955 - DNA, 13 bp, Unknown
  misc_feature (1)..( 13): Matrix.003 file - promoters50/1013714
ataatttttttat

SEQ ID NO: 64956 - DNA, 10 bp, Unknown
  misc_feature (1)..( 10): Matrix.003 file - promoters50/1013714
gtaatttttt

SEQ ID NO: 64957 - DNA, 10 bp, Unknown
  misc_feature (1)..( 10): Matrix.003 file - promoters50/1013764
tattgtgtct

SEQ ID NO: 64958 - DNA, 8 bp, Unknown
  misc_feature (1)..( 8): Matrix.003 file - promoters50/1013764
taccaatc

SEQ ID NO: 64959 - DNA, 7 bp, Unknown
  misc_feature (1)..( 7): Matrix.003 file - promoters50/1013764
gtttcta

SEQ ID NO: 64960 - DNA, 8 bp, Unknown
  misc_feature (1)..( 8): Matrix.003 file - promoters50/1013764
tagtaaaa

SEQ ID NO: 64961 - DNA, 7 bp, Unknown
  misc_feature (1)..( 7): Matrix.003 file - promoters50/1013764
atatctg

SEQ ID NO: 64962 - DNA, 11 bp, Unknown
  misc_feature (1)..( 11): Matrix.003 file - promoters50/1013764
acttgtctcct

SEQ ID NO: 64963 - DNA, 9 bp, Unknown
  misc_feature (1)..( 9): Matrix.003 file - promoters50/1013764
tttaatgat

SEQ ID NO: 64964 - DNA, 7 bp, Unknown
  misc_feature (1)..( 7): Matrix.003 file - promoters50/1013764
aatggtt

SEQ ID NO: 64965 - DNA, 6 bp, Unknown
  misc_feature (1)..( 6): Matrix.003 file - promoters50/1013772
aagatt

SEQ ID NO: 64966 - DNA, 13 bp, Unknown
  misc_feature (1)..( 13): Matrix.003 file - promoters50/1013786
ttaagttttacga

SEQ ID NO: 64967 - DNA, 9 bp, Unknown
  misc_feature (1)..( 9): Matrix.003 file - promoters50/1013786
ttaagttta

SEQ ID NO: 64968 - DNA, 9 bp, Unknown
  misc_feature (1)..( 9): Matrix.003 file - promoters50/1013786
ataatttta

SEQ ID NO: 64969 - DNA, 13 bp, Unknown
  misc_feature (1)..( 13): Matrix.003 file - promoters50/1013792
tttttcatattag

SEQ ID NO: 64970 - DNA, 11 bp, Unknown
  misc_feature (1)..( 11): Matrix.003 file - promoters50/1013792
gaacaattaca

SEQ ID NO: 64971 - DNA, 9 bp, Unknown
  misc_feature (1)..( 9): Matrix.003 file - promoters50/1013796
taagttgtt

SEQ ID NO: 64972 - DNA, 8 bp, Unknown
  misc_feature (1)..( 8): Matrix.003 file - promoters50/1013796
gttttaga

SEQ ID NO: 64973 - DNA, 11 bp, Unknown
  misc_feature (1)..( 11): Matrix.003 file - promoters50/1013796
tgaataaaaaa

SEQ ID NO: 64974 - DNA, 6 bp, Unknown
  misc_feature (1)..( 6): Matrix.003 file - promoters50/1013796
aagata

SEQ ID NO: 64975 - DNA, 10 bp, Unknown
  misc_feature (1)..( 10): Matrix.003 file - promoters50/1013796
tttttaaatt

SEQ ID NO: 64976 - DNA, 8 bp, Unknown
  misc_feature (1)..( 8): Matrix.003 file - promoters50/1013796
taaaccaa

SEQ ID NO: 64977 - DNA, 9 bp, Unknown
  misc_feature (1)..( 9): Matrix.003 file - promoters50/1013796
taaggtttt

SEQ ID NO: 64978 - DNA, 12 bp, Unknown
  misc_feature (1)..( 12): Matrix.003 file - promoters50/1013796
cgttttaaaaat

SEQ ID NO: 64979 - DNA, 13 bp, Unknown
  misc_feature (1)..( 13): Matrix.003 file - promoters50/1013805
tgagattacttac

SEQ ID NO: 64980 - DNA, 11 bp, Unknown
  misc_feature (1)..( 11): Matrix.003 file - promoters50/1013805
ttaaattagta

SEQ ID NO: 64981 - DNA, 9 bp, Unknown
  misc_feature (1)..( 9): Matrix.003 file - promoters50/1013805
ttaataact

SEQ ID NO: 64982 - DNA, 10 bp, Unknown
  misc_feature (1)..( 10): Matrix.003 file - promoters50/1013805
tgaaataact

SEQ ID NO: 64983 - DNA, 9 bp, Unknown
  misc_feature (1)..( 9): Matrix.003 file - promoters50/1013850
aaattcttt

SEQ ID NO: 64984 - DNA, 8 bp, Unknown
  misc_feature (1)..( 8): Matrix.003 file - promoters50/1013878
tataatat

SEQ ID NO: 64985 - DNA, 15 bp, Unknown
  misc_feature (1)..( 15): Matrix.003 file - promoters50/1013878
aagaaaaaaaaattg

SEQ ID NO: 64986 - DNA, 11 bp, Unknown
  misc_feature (1)..( 11): Matrix.003 file - promoters50/1013878
agaaaaaaaaa

SEQ ID NO: 64987 - DNA, 12 bp, Unknown
  misc_feature (1)..( 12): Matrix.003 file - promoters50/1013878
aaaatataataa

SEQ ID NO: 64988 - DNA, 8 bp, Unknown
  misc_feature (1)..( 8): Matrix.003 file - promoters50/1013878
aaaaaaaa

SEQ ID NO: 64989 - DNA, 11 bp, Unknown
  misc_feature (1)..( 11): Matrix.003 file - promoters50/1013893
aagaaatttgt

SEQ ID NO: 64990 - DNA, 6 bp, Unknown
  misc_feature (1)..( 6): Matrix.003 file - promoters50/1013893
taagaa

SEQ ID NO: 64991 - DNA, 10 bp, Unknown
  misc_feature (1)..( 10): Matrix.003 file - promoters50/1013904
attctaataa

SEQ ID NO: 64992 - DNA, 9 bp, Unknown
  misc_feature (1)..( 9): Matrix.003 file - promoters50/1013904
caatatttt

SEQ ID NO: 64993 - DNA, 9 bp, Unknown
  misc_feature (1)..( 9): Matrix.003 file - promoters50/1013907
taaaaattg

SEQ ID NO: 64994 - DNA, 9 bp, Unknown
  misc_feature (1)..( 9): Matrix.003 file - promoters50/1013907
aaccattaa

SEQ ID NO: 64995 - DNA, 10 bp, Unknown
  misc_feature (1)..( 10): Matrix.003 file - promoters50/1013907
tttataaaaa

SEQ ID NO: 64996 - DNA, 8 bp, Unknown
  misc_feature (1)..( 8): Matrix.003 file - promoters50/1013907
tttaaaat

SEQ ID NO: 64997 - DNA, 12 bp, Unknown
  misc_feature (1)..( 12): Matrix.003 file - promoters50/1013923
aacaattttggt

SEQ ID NO: 64998 - DNA, 14 bp, Unknown
  misc_feature (1)..( 14): Matrix.003 file - promoters50/1013923
acatgtaaatatat

SEQ ID NO: 64999 - DNA, 10 bp, Unknown
  misc_feature (1)..( 10): Matrix.003 file - promoters50/1013923
aaaattcaca

SEQ ID NO: 65000 - DNA, 10 bp, Unknown
  misc_feature (1)..( 10): Matrix.003 file - promoters50/1013923
gataatattt

SEQ ID NO: 65001 - DNA, 9 bp, Unknown
  misc_feature (1)..( 9): Matrix.003 file - promoters50/1013931
gaaaaattg

SEQ ID NO: 65002 - DNA, 10 bp, Unknown
  misc_feature (1)..( 10): Matrix.003 file - promoters50/1013931
atctctggtg

SEQ ID NO: 65003 - DNA, 9 bp, Unknown
  misc_feature (1)..( 9): Matrix.003 file - promoters50/1013931
agaagcata

SEQ ID NO: 65004 - DNA, 8 bp, Unknown
  misc_feature (1)..( 8): Matrix.003 file - promoters50/1013931
ttagactt

SEQ ID NO: 65005 - DNA, 8 bp, Unknown
  misc_feature (1)..( 8): Matrix.003 file - promoters50/1013931
ttttattt

SEQ ID NO: 65006 - DNA, 9 bp, Unknown
  misc_feature (1)..( 9): Matrix.003 file - promoters50/1013931
aaagttcca

SEQ ID NO: 65007 - DNA, 8 bp, Unknown
  misc_feature (1)..( 8): Matrix.003 file - promoters50/1013931
tttattca

SEQ ID NO: 65008 - DNA, 10 bp, Unknown
  misc_feature (1)..( 10): Matrix.003 file - promoters50/1013957
ataaaaattt

SEQ ID NO: 65009 - DNA, 14 bp, Unknown
  misc_feature (1)..( 14): Matrix.003 file - promoters50/1013957
atctaattatctaa

SEQ ID NO: 65010 - DNA, 12 bp, Unknown
  misc_feature (1)..( 12): Matrix.003 file - promoters50/1013957
cttttctttggt

SEQ ID NO: 65011 - DNA, 13 bp, Unknown
  misc_feature (1)..( 13): Matrix.003 file - promoters50/1014010
taaactttaaagt

SEQ ID NO: 65012 - DNA, 9 bp, Unknown
  misc_feature (1)..( 9): Matrix.003 file - promoters50/1014010
aaacaaaaa

SEQ ID NO: 65013 - DNA, 8 bp, Unknown
  misc_feature (1)..( 8): Matrix.003 file - promoters50/1014010
ttataaaa

SEQ ID NO: 65014 - DNA, 12 bp, Unknown
  misc_feature (1)..( 12): Matrix.003 file - promoters50/1014010
aattagaattac

SEQ ID NO: 65015 - DNA, 7 bp, Unknown
  misc_feature (1)..( 7): Matrix.003 file - promoters50/1014010
aaaaaat

SEQ ID NO: 65016 - DNA, 10 bp, Unknown
  misc_feature (1)..( 10): Matrix.003 file - promoters50/1014010
ataattattt

SEQ ID NO: 65017 - DNA, 12 bp, Unknown
  misc_feature (1)..( 12): Matrix.003 file - promoters50/1014010
gaataataatta

SEQ ID NO: 65018 - DNA, 8 bp, Unknown
  misc_feature (1)..( 8): Matrix.003 file - promoters50/1014117
ttttgttc

SEQ ID NO: 65019 - DNA, 9 bp, Unknown
  misc_feature (1)..( 9): Matrix.003 file - promoters50/1014125
ataatgtga

SEQ ID NO: 65020 - DNA, 7 bp, Unknown
  misc_feature (1)..( 7): Matrix.003 file - promoters50/1014176
tttaaaa

SEQ ID NO: 65021 - DNA, 9 bp, Unknown
  misc_feature (1)..( 9): Matrix.003 file - promoters50/1014180
ttttaatag

SEQ ID NO: 65022 - DNA, 9 bp, Unknown
  misc_feature (1)..( 9): Matrix.003 file - promoters50/1014180
aattaattc

SEQ ID NO: 65023 - DNA, 8 bp, Unknown
  misc_feature (1)..( 8): Matrix.003 file - promoters50/1014259
atgaaaaa

SEQ ID NO: 65024 - DNA, 9 bp, Unknown
  misc_feature (1)..( 9): Matrix.003 file - promoters50/1014259
gtaataaca

SEQ ID NO: 65025 - DNA, 8 bp, Unknown
  misc_feature (1)..( 8): Matrix.003 file - promoters50/1014259
aatatata

SEQ ID NO: 65026 - DNA, 9 bp, Unknown
  misc_feature (1)..( 9): Matrix.003 file - promoters50/1014259
ttcgttttc

SEQ ID NO: 65027 - DNA, 8 bp, Unknown
  misc_feature (1)..( 8): Matrix.003 file - promoters50/1014259
tctattta

SEQ ID NO: 65028 - DNA, 8 bp, Unknown
  misc_feature (1)..( 8): Matrix.003 file - promoters50/1014259
tataaaaa

SEQ ID NO: 65029 - DNA, 15 bp, Unknown
  misc_feature (1)..( 15): Matrix.003 file - promoters50/1014259
taaaaactaatgggc

SEQ ID NO: 65030 - DNA, 10 bp, Unknown
  misc_feature (1)..( 10): Matrix.003 file - promoters50/1014259
acaataaaag

SEQ ID NO: 65031 - DNA, 7 bp, Unknown
  misc_feature (1)..( 7): Matrix.003 file - promoters50/1014387
tgaaata

SEQ ID NO: 65032 - DNA, 9 bp, Unknown
  misc_feature (1)..( 9): Matrix.003 file - promoters50/1014406
aaaaaaaaa

SEQ ID NO: 65033 - DNA, 10 bp, Unknown
  misc_feature (1)..( 10): Matrix.003 file - promoters50/1014452
tatataaata

SEQ ID NO: 65034 - DNA, 10 bp, Unknown
  misc_feature (1)..( 10): Matrix.003 file - promoters50/1014452
tcaatattta

SEQ ID NO: 65035 - DNA, 11 bp, Unknown
  misc_feature (1)..( 11): Matrix.003 file - promoters50/1014452
aattaaaaaaa

SEQ ID NO: 65036 - DNA, 21 bp, Unknown
  misc_feature (1)..( 21): Matrix.003 file - promoters50/1014452
atctttatcgtacataacaat

SEQ ID NO: 65037 - DNA, 13 bp, Unknown
  misc_feature (1)..( 13): Matrix.003 file - promoters50/1014452
aatacaaaattat

SEQ ID NO: 65038 - DNA, 12 bp, Unknown
  misc_feature (1)..( 12): Matrix.003 file - promoters50/1014452
caatatttactc

SEQ ID NO: 65039 - DNA, 7 bp, Unknown
  misc_feature (1)..( 7): Matrix.003 file - promoters50/1014452
taaatat

SEQ ID NO: 65040 - DNA, 9 bp, Unknown
  misc_feature (1)..( 9): Matrix.003 file - promoters50/1014509
ttttatctt

SEQ ID NO: 65041 - DNA, 15 bp, Unknown
  misc_feature (1)..( 15): Matrix.003 file - promoters50/1014525
ttaaataattattta

SEQ ID NO: 65042 - DNA, 11 bp, Unknown
  misc_feature (1)..( 11): Matrix.003 file - promoters50/1014525
aaagtcatata

SEQ ID NO: 65043 - DNA, 10 bp, Unknown
  misc_feature (1)..( 10): Matrix.003 file - promoters50/1014525
gtatatatac

SEQ ID NO: 65044 - DNA, 10 bp, Unknown
  misc_feature (1)..( 10): Matrix.003 file - promoters50/1014525
ttatataaat

SEQ ID NO: 65045 - DNA, 4 bp, Unknown
  misc_feature (1)..( 4): Matrix.003 file - promoters50/1014525
tata

SEQ ID NO: 65046 - DNA, 9 bp, Unknown
  misc_feature (1)..( 9): Matrix.003 file - promoters50/1014525
atatccaaa

SEQ ID NO: 65047 - DNA, 10 bp, Unknown
  misc_feature (1)..( 10): Matrix.003 file - promoters50/1014525
attaattgag

SEQ ID NO: 65048 - DNA, 6 bp, Unknown
  misc_feature (1)..( 6): Matrix.003 file - promoters50/1014573
tttttt

SEQ ID NO: 65049 - DNA, 8 bp, Unknown
  misc_feature (1)..( 8): Matrix.003 file - promoters50/1014573
aagattta

SEQ ID NO: 65050 - DNA, 7 bp, Unknown
  misc_feature (1)..( 7): Matrix.003 file - promoters50/1014611
aattgta

SEQ ID NO: 65051 - DNA, 8 bp, Unknown
  misc_feature (1)..( 8): Matrix.003 file - promoters50/1014611
caaaaata

SEQ ID NO: 65052 - DNA, 9 bp, Unknown
  misc_feature (1)..( 9): Matrix.003 file - promoters50/1014611
gtaatattt

SEQ ID NO: 65053 - DNA, 7 bp, Unknown
  misc_feature (1)..( 7): Matrix.003 file - promoters50/1014611
ttatttt

SEQ ID NO: 65054 - DNA, 8 bp, Unknown
  misc_feature (1)..( 8): Matrix.003 file - promoters50/1014611
ataaatta

SEQ ID NO: 65055 - DNA, 10 bp, Unknown
  misc_feature (1)..( 10): Matrix.003 file - promoters50/1014611
taatattata

SEQ ID NO: 65056 - DNA, 12 bp, Unknown
  misc_feature (1)..( 12): Matrix.003 file - promoters50/1014611
aaattaaaacac

SEQ ID NO: 65057 - DNA, 9 bp, Unknown
  misc_feature (1)..( 9): Matrix.003 file - promoters50/1014611
caaaaaaaa

SEQ ID NO: 65058 - DNA, 13 bp, Unknown
  misc_feature (1)..( 13): Matrix.003 file - promoters50/1014611
ctttgaaaaaaaa

SEQ ID NO: 65059 - DNA, 9 bp, Unknown
  misc_feature (1)..( 9): Matrix.003 file - promoters50/1014611
gcctattta

SEQ ID NO: 65060 - DNA, 9 bp, Unknown
  misc_feature (1)..( 9): Matrix.003 file - promoters50/1014611
aaaaaattt

SEQ ID NO: 65061 - DNA, 7 bp, Unknown
  misc_feature (1)..( 7): Matrix.003 file - promoters50/1014611
tttgaaa

SEQ ID NO: 65062 - DNA, 8 bp, Unknown
  misc_feature (1)..( 8): Matrix.003 file - promoters50/1014631
aaaactct

SEQ ID NO: 65063 - DNA, 9 bp, Unknown
  misc_feature (1)..( 9): Matrix.003 file - promoters50/1014631
ttggtttct

SEQ ID NO: 65064 - DNA, 9 bp, Unknown
  misc_feature (1)..( 9): Matrix.003 file - promoters50/1014631
ttccttaaa

SEQ ID NO: 65065 - DNA, 11 bp, Unknown
  misc_feature (1)..( 11): Matrix.003 file - promoters50/1014631
gattttgttta

SEQ ID NO: 65066 - DNA, 9 bp, Unknown
  misc_feature (1)..( 9): Matrix.003 file - promoters50/1014649
attctttac

SEQ ID NO: 65067 - DNA, 8 bp, Unknown
  misc_feature (1)..( 8): Matrix.003 file - promoters50/1014649
acatatgt

SEQ ID NO: 65068 - DNA, 9 bp, Unknown
  misc_feature (1)..( 9): Matrix.003 file - promoters50/1014649
atttattta

SEQ ID NO: 65069 - DNA, 8 bp, Unknown
  misc_feature (1)..( 8): Matrix.003 file - promoters50/1014649
tctttttt

SEQ ID NO: 65070 - DNA, 9 bp, Unknown
  misc_feature (1)..( 9): Matrix.003 file - promoters50/1014662
atataataa

SEQ ID NO: 65071 - DNA, 11 bp, Unknown
  misc_feature (1)..( 11): Matrix.003 file - promoters50/1014662
tcaatcaaaag

SEQ ID NO: 65072 - DNA, 9 bp, Unknown
  misc_feature (1)..( 9): Matrix.003 file - promoters50/1014662
ccaaaaatg

SEQ ID NO: 65073 - DNA, 10 bp, Unknown
  misc_feature (1)..( 10): Matrix.003 file - promoters50/1014662
ttgtatcaac

SEQ ID NO: 65074 - DNA, 14 bp, Unknown
  misc_feature (1)..( 14): Matrix.003 file - promoters50/1014662
acatataataaatt

SEQ ID NO: 65075 - DNA, 11 bp, Unknown
  misc_feature (1)..( 11): Matrix.003 file - promoters50/1014662
agaaaatcaat

SEQ ID NO: 65076 - DNA, 10 bp, Unknown
  misc_feature (1)..( 10): Matrix.003 file - promoters50/1014662
taattttgtt

SEQ ID NO: 65077 - DNA, 8 bp, Unknown
  misc_feature (1)..( 8): Matrix.003 file - promoters50/1014678
aaactcga

SEQ ID NO: 65078 - DNA, 10 bp, Unknown
  misc_feature (1)..( 10): Matrix.003 file - promoters50/1014678
aaaacaaatc

SEQ ID NO: 65079 - DNA, 7 bp, Unknown
  misc_feature (1)..( 7): Matrix.003 file - promoters50/1014678
ttaatgc

SEQ ID NO: 65080 - DNA, 10 bp, Unknown
  misc_feature (1)..( 10): Matrix.003 file - promoters50/1014681
aattaaacat

SEQ ID NO: 65081 - DNA, 11 bp, Unknown
  misc_feature (1)..( 11): Matrix.003 file - promoters50/1014681
aaatgttgttg

SEQ ID NO: 65082 - DNA, 9 bp, Unknown
  misc_feature (1)..( 9): Matrix.003 file - promoters50/1014689
tgttcattt

SEQ ID NO: 65083 - DNA, 13 bp, Unknown
  misc_feature (1)..( 13): Matrix.003 file - promoters50/1014689
ctgagctagaagg

SEQ ID NO: 65084 - DNA, 9 bp, Unknown
  misc_feature (1)..( 9): Matrix.003 file - promoters50/1014689
aaaaatgtt

SEQ ID NO: 65085 - DNA, 12 bp, Unknown
  misc_feature (1)..( 12): Matrix.003 file - promoters50/1014693
ttttttataaag

SEQ ID NO: 65086 - DNA, 6 bp, Unknown
  misc_feature (1)..( 6): Matrix.003 file - promoters50/1014693
attgat

SEQ ID NO: 65087 - DNA, 10 bp, Unknown
  misc_feature (1)..( 10): Matrix.003 file - promoters50/1014693
aaagcttctc

SEQ ID NO: 65088 - DNA, 11 bp, Unknown
  misc_feature (1)..( 11): Matrix.003 file - promoters50/1014748
aaataaaaaca

SEQ ID NO: 65089 - DNA, 14 bp, Unknown
  misc_feature (1)..( 14): Matrix.003 file - promoters50/1014771
atttctatcaaata

SEQ ID NO: 65090 - DNA, 12 bp, Unknown
  misc_feature (1)..( 12): Matrix.003 file - promoters50/1014771
ctaaaatcttaa

SEQ ID NO: 65091 - DNA, 10 bp, Unknown
  misc_feature (1)..( 10): Matrix.003 file - promoters50/1014771
acttaaaaaa

SEQ ID NO: 65092 - DNA, 9 bp, Unknown
  misc_feature (1)..( 9): Matrix.003 file - promoters50/1014771
tttttctta

SEQ ID NO: 65093 - DNA, 12 bp, Unknown
  misc_feature (1)..( 12): Matrix.003 file - promoters50/1014771
gatttattttta

SEQ ID NO: 65094 - DNA, 11 bp, Unknown
  misc_feature (1)..( 11): Matrix.003 file - promoters50/1014771
tacttgaattg

SEQ ID NO: 65095 - DNA, 8 bp, Unknown
  misc_feature (1)..( 8): Matrix.003 file - promoters50/1014771
aaaaaagc

SEQ ID NO: 65096 - DNA, 9 bp, Unknown
  misc_feature (1)..( 9): Matrix.003 file - promoters50/1014778
aaaatcgaa

SEQ ID NO: 65097 - DNA, 12 bp, Unknown
  misc_feature (1)..( 12): Matrix.003 file - promoters50/1014778
agcttttgattc

SEQ ID NO: 65098 - DNA, 15 bp, Unknown
  misc_feature (1)..( 15): Matrix.003 file - promoters50/1014815
tttaatagcttttaa

SEQ ID NO: 65099 - DNA, 9 bp, Unknown
  misc_feature (1)..( 9): Matrix.003 file - promoters50/1014815
aatttaaat

SEQ ID NO: 65100 - DNA, 10 bp, Unknown
  misc_feature (1)..( 10): Matrix.003 file - promoters50/1014815
taaaagaaaa

SEQ ID NO: 65101 - DNA, 10 bp, Unknown
  misc_feature (1)..( 10): Matrix.003 file - promoters50/1014823
gacaaaaatt

SEQ ID NO: 65102 - DNA, 12 bp, Unknown
  misc_feature (1)..( 12): Matrix.003 file - promoters50/1014823
gagcaaaaccca

SEQ ID NO: 65103 - DNA, 8 bp, Unknown
  misc_feature (1)..( 8): Matrix.003 file - promoters50/1014823
ttattttt

SEQ ID NO: 65104 - DNA, 10 bp, Unknown
  misc_feature (1)..( 10): Matrix.003 file - promoters50/1014823
ttttaatttg

SEQ ID NO: 65105 - DNA, 9 bp, Unknown
  misc_feature (1)..( 9): Matrix.003 file - promoters50/1014823
gattttgat

SEQ ID NO: 65106 - DNA, 8 bp, Unknown
  misc_feature (1)..( 8): Matrix.003 file - promoters50/1014823
ttaaaata

SEQ ID NO: 65107 - DNA, 10 bp, Unknown
  misc_feature (1)..( 10): Matrix.003 file - promoters50/1014823
agtttaatta

SEQ ID NO: 65108 - DNA, 9 bp, Unknown
  misc_feature (1)..( 9): Matrix.003 file - promoters50/1014823
ttcgacttg

SEQ ID NO: 65109 - DNA, 7 bp, Unknown
  misc_feature (1)..( 7): Matrix.003 file - promoters50/1014823
acatttt

SEQ ID NO: 65110 - DNA, 7 bp, Unknown
  misc_feature (1)..( 7): Matrix.003 file - promoters50/1014895
gaataga

SEQ ID NO: 65111 - DNA, 7 bp, Unknown
  misc_feature (1)..( 7): Matrix.003 file - promoters50/1014907
tattttc

SEQ ID NO: 65112 - DNA, 4 bp, Unknown
  misc_feature (1)..( 4): Matrix.003 file - promoters50/1014907
tatt

SEQ ID NO: 65113 - DNA, 9 bp, Unknown
  misc_feature (1)..( 9): Matrix.003 file - promoters50/1014907
aataatcct

SEQ ID NO: 65114 - DNA, 9 bp, Unknown
  misc_feature (1)..( 9): Matrix.003 file - promoters50/1014907
aaaataatc

SEQ ID NO: 65115 - DNA, 7 bp, Unknown
  misc_feature (1)..( 7): Matrix.003 file - promoters50/1014926
ccttcct

SEQ ID NO: 65116 - DNA, 9 bp, Unknown
  misc_feature (1)..( 9): Matrix.003 file - promoters50/1014926
tattgttaa

SEQ ID NO: 65117 - DNA, 8 bp, Unknown
  misc_feature (1)..( 8): Matrix.003 file - promoters50/1014926
taataaat

SEQ ID NO: 65118 - DNA, 7 bp, Unknown
  misc_feature (1)..( 7): Matrix.003 file - promoters50/1014926
gatgggc

SEQ ID NO: 65119 - DNA, 8 bp, Unknown
  misc_feature (1)..( 8): Matrix.003 file - promoters50/1014926
aaataagg

SEQ ID NO: 65120 - DNA, 6 bp, Unknown
  misc_feature (1)..( 6): Matrix.003 file - promoters50/1014926
aagttg

SEQ ID NO: 65121 - DNA, 11 bp, Unknown
  misc_feature (1)..( 11): Matrix.003 file - promoters50/1014926
aaacctaaata

SEQ ID NO: 65122 - DNA, 8 bp, Unknown
  misc_feature (1)..( 8): Matrix.003 file - promoters50/1014981
ggaataaa

SEQ ID NO: 65123 - DNA, 8 bp, Unknown
  misc_feature (1)..( 8): Matrix.003 file - promoters50/1014989
ttttgaaa

SEQ ID NO: 65124 - DNA, 10 bp, Unknown
  misc_feature (1)..( 10): Matrix.003 file - promoters50/1014989
caactaattt

SEQ ID NO: 65125 - DNA, 9 bp, Unknown
  misc_feature (1)..( 9): Matrix.003 file - promoters50/1014989
acattcaat

SEQ ID NO: 65126 - DNA, 8 bp, Unknown
  misc_feature (1)..( 8): Matrix.003 file - promoters50/1014989
aatatttc

SEQ ID NO: 65127 - DNA, 10 bp, Unknown
  misc_feature (1)..( 10): Matrix.003 file - promoters50/1014989
acatattaaa

SEQ ID NO: 65128 - DNA, 7 bp, Unknown
  misc_feature (1)..( 7): Matrix.003 file - promoters50/1014989
atatttc

SEQ ID NO: 65129 - DNA, 13 bp, Unknown
  misc_feature (1)..( 13): Matrix.003 file - promoters50/1015014
atataaatatata

SEQ ID NO: 65130 - DNA, 13 bp, Unknown
  misc_feature (1)..( 13): Matrix.003 file - promoters50/1015033
ttaataaaacctt

SEQ ID NO: 65131 - DNA, 9 bp, Unknown
  misc_feature (1)..( 9): Matrix.003 file - promoters50/1015064
attttagtt

SEQ ID NO: 65132 - DNA, 8 bp, Unknown
  misc_feature (1)..( 8): Matrix.003 file - promoters50/1015064
tattaatg

SEQ ID NO: 65133 - DNA, 7 bp, Unknown
  misc_feature (1)..( 7): Matrix.003 file - promoters50/1015064
aatattt

SEQ ID NO: 65134 - DNA, 8 bp, Unknown
  misc_feature (1)..( 8): Matrix.003 file - promoters50/1015064
tttagttt

SEQ ID NO: 65135 - DNA, 9 bp, Unknown
  misc_feature (1)..( 9): Matrix.003 file - promoters50/1015064
tgaaaccaa

SEQ ID NO: 65136 - DNA, 7 bp, Unknown
  misc_feature (1)..( 7): Matrix.003 file - promoters50/1015064
ttttgat

SEQ ID NO: 65137 - DNA, 9 bp, Unknown
  misc_feature (1)..( 9): Matrix.003 file - promoters50/1015064
aatatattt

SEQ ID NO: 65138 - DNA, 11 bp, Unknown
  misc_feature (1)..( 11): Matrix.003 file - promoters50/1015064
tacgtaacaat

SEQ ID NO: 65139 - DNA, 10 bp, Unknown
  misc_feature (1)..( 10): Matrix.003 file - promoters50/1015092
tgtcgaaaat

SEQ ID NO: 65140 - DNA, 8 bp, Unknown
  misc_feature (1)..( 8): Matrix.003 file - promoters50/1015116
atttgtct

SEQ ID NO: 65141 - DNA, 7 bp, Unknown
  misc_feature (1)..( 7): Matrix.003 file - promoters50/1015116
ttctttg

SEQ ID NO: 65142 - DNA, 9 bp, Unknown
  misc_feature (1)..( 9): Matrix.003 file - promoters50/1015116
aaatatata

SEQ ID NO: 65143 - DNA, 8 bp, Unknown
  misc_feature (1)..( 8): Matrix.003 file - promoters50/1015116
ttttgttg

SEQ ID NO: 65144 - DNA, 9 bp, Unknown
  misc_feature (1)..( 9): Matrix.003 file - promoters50/1015116
aatttactt

SEQ ID NO: 65145 - DNA, 9 bp, Unknown
  misc_feature (1)..( 9): Matrix.003 file - promoters50/1015116
tttttgttt

SEQ ID NO: 65146 - DNA, 8 bp, Unknown
  misc_feature (1)..( 8): Matrix.003 file - promoters50/1015167
gaaaaaat

SEQ ID NO: 65147 - DNA, 8 bp, Unknown
  misc_feature (1)..( 8): Matrix.003 file - promoters50/1015167
tgaaatca

SEQ ID NO: 65148 - DNA, 12 bp, Unknown
  misc_feature (1)..( 12): Matrix.003 file - promoters50/1015179
aaactcttatat

SEQ ID NO: 65149 - DNA, 13 bp, Unknown
  misc_feature (1)..( 13): Matrix.003 file - promoters50/1015179
caaattcatatta

SEQ ID NO: 65150 - DNA, 10 bp, Unknown
  misc_feature (1)..( 10): Matrix.003 file - promoters50/1015179
aaacagagca

SEQ ID NO: 65151 - DNA, 11 bp, Unknown
  misc_feature (1)..( 11): Matrix.003 file - promoters50/1015179
ttttgaaaaga

SEQ ID NO: 65152 - DNA, 8 bp, Unknown
  misc_feature (1)..( 8): Matrix.003 file - promoters50/1015210
ttatcctt

SEQ ID NO: 65153 - DNA, 12 bp, Unknown
  misc_feature (1)..( 12): Matrix.003 file - promoters50/1015210
aaatgcttagta

SEQ ID NO: 65154 - DNA, 13 bp, Unknown
  misc_feature (1)..( 13): Matrix.003 file - promoters50/1015214
tttatgtaaaaag

SEQ ID NO: 65155 - DNA, 9 bp, Unknown
  misc_feature (1)..( 9): Matrix.003 file - promoters50/1015214
tgaaacaaa

SEQ ID NO: 65156 - DNA, 7 bp, Unknown
  misc_feature (1)..( 7): Matrix.003 file - promoters50/1015247
ttcttct

SEQ ID NO: 65157 - DNA, 9 bp, Unknown
  misc_feature (1)..( 9): Matrix.003 file - promoters50/1015247
aaaacaaaa

SEQ ID NO: 65158 - DNA, 10 bp, Unknown
  misc_feature (1)..( 10): Matrix.003 file - promoters50/1015247
attaaaggaa

SEQ ID NO: 65159 - DNA, 7 bp, Unknown
  misc_feature (1)..( 7): Matrix.003 file - promoters50/1015264
tcatttg

SEQ ID NO: 65160 - DNA, 9 bp, Unknown
  misc_feature (1)..( 9): Matrix.003 file - promoters50/1015264
taatttaaa

SEQ ID NO: 65161 - DNA, 10 bp, Unknown
  misc_feature (1)..( 10): Matrix.003 file - promoters50/1015264
ttaaaaaatt

SEQ ID NO: 65162 - DNA, 8 bp, Unknown
  misc_feature (1)..( 8): Matrix.003 file - promoters50/1015264
ctaattaa

SEQ ID NO: 65163 - DNA, 7 bp, Unknown
  misc_feature (1)..( 7): Matrix.003 file - promoters50/1015264
tttatta

SEQ ID NO: 65164 - DNA, 8 bp, Unknown
  misc_feature (1)..( 8): Matrix.003 file - promoters50/1015264
tttattag

SEQ ID NO: 65165 - DNA, 7 bp, Unknown
  misc_feature (1)..( 7): Matrix.003 file - promoters50/1015264
tactaaa

SEQ ID NO: 65166 - DNA, 7 bp, Unknown
  misc_feature (1)..( 7): Matrix.003 file - promoters50/1015264
tttgttt

SEQ ID NO: 65167 - DNA, 11 bp, Unknown
  misc_feature (1)..( 11): Matrix.003 file - promoters50/1015264
tttgtatgatt

SEQ ID NO: 65168 - DNA, 8 bp, Unknown
  misc_feature (1)..( 8): Matrix.003 file - promoters50/1015375
tattctcg

SEQ ID NO: 65169 - DNA, 7 bp, Unknown
  misc_feature (1)..( 7): Matrix.003 file - promoters50/1015427
taatttg

SEQ ID NO: 65170 - DNA, 8 bp, Unknown
  misc_feature (1)..( 8): Matrix.003 file - promoters50/1015427
agaaaaat

SEQ ID NO: 65171 - DNA, 8 bp, Unknown
  misc_feature (1)..( 8): Matrix.003 file - promoters50/1015516
tgatgcca

SEQ ID NO: 65172 - DNA, 9 bp, Unknown
  misc_feature (1)..( 9): Matrix.003 file - promoters50/1015524
catttatta

SEQ ID NO: 65173 - DNA, 17 bp, Unknown
  misc_feature (1)..( 17): Matrix.003 file - promoters50/1015524
cagatatagataaatta

SEQ ID NO: 65174 - DNA, 7 bp, Unknown
  misc_feature (1)..( 7): Matrix.003 file - promoters50/1015524
atataaa

SEQ ID NO: 65175 - DNA, 10 bp, Unknown
  misc_feature (1)..( 10): Matrix.003 file - promoters50/1015524
caaatacatt

SEQ ID NO: 65176 - DNA, 10 bp, Unknown
  misc_feature (1)..( 10): Matrix.003 file - promoters50/1015524
attgtttctg

SEQ ID NO: 65177 - DNA, 10 bp, Unknown
  misc_feature (1)..( 10): Matrix.003 file - promoters50/1015537
ctaatttaag

SEQ ID NO: 65178 - DNA, 9 bp, Unknown
  misc_feature (1)..( 9): Matrix.003 file - promoters50/1015537
aaatttaaa

SEQ ID NO: 65179 - DNA, 9 bp, Unknown
  misc_feature (1)..( 9): Matrix.003 file - promoters50/1015537
aaaatttaa

SEQ ID NO: 65180 - DNA, 9 bp, Unknown
  misc_feature (1)..( 9): Matrix.003 file - promoters50/1015537
acaaaatat

SEQ ID NO: 65181 - DNA, 9 bp, Unknown
  misc_feature (1)..( 9): Matrix.003 file - promoters50/1015537
aactaaaat

SEQ ID NO: 65182 - DNA, 12 bp, Unknown
  misc_feature (1)..( 12): Matrix.003 file - promoters50/1015537
cacacaaaagct

SEQ ID NO: 65183 - DNA, 8 bp, Unknown
  misc_feature (1)..( 8): Matrix.003 file - promoters50/1015537
taaaaata

SEQ ID NO: 65184 - DNA, 8 bp, Unknown
  misc_feature (1)..( 8): Matrix.003 file - promoters50/1015541
aatatatt

SEQ ID NO: 65185 - DNA, 11 bp, Unknown
  misc_feature (1)..( 11): Matrix.003 file - promoters50/1015541
ctattttcttc

SEQ ID NO: 65186 - DNA, 6 bp, Unknown
  misc_feature (1)..( 6): Matrix.003 file - promoters50/1015597
aaatct

SEQ ID NO: 65187 - DNA, 7 bp, Unknown
  misc_feature (1)..( 7): Matrix.003 file - promoters50/1015597
taaaaag

SEQ ID NO: 65188 - DNA, 8 bp, Unknown
  misc_feature (1)..( 8): Matrix.003 file - promoters50/1015606
acaagcga

SEQ ID NO: 65189 - DNA, 10 bp, Unknown
  misc_feature (1)..( 10): Matrix.003 file - promoters50/1015606
aatttgtttg

SEQ ID NO: 65190 - DNA, 12 bp, Unknown
  misc_feature (1)..( 12): Matrix.003 file - promoters50/1015637
taaaaaattaat

SEQ ID NO: 65191 - DNA, 10 bp, Unknown
  misc_feature (1)..( 10): Matrix.003 file - promoters50/1015637
gaaaagtaaa

SEQ ID NO: 65192 - DNA, 11 bp, Unknown
  misc_feature (1)..( 11): Matrix.003 file - promoters50/1015661
caaaaacaaaa

SEQ ID NO: 65193 - DNA, 12 bp, Unknown
  misc_feature (1)..( 12): Matrix.003 file - promoters50/1015661
acattataatat

SEQ ID NO: 65194 - DNA, 7 bp, Unknown
  misc_feature (1)..( 7): Matrix.003 file - promoters50/1015661
gtatatc

SEQ ID NO: 65195 - DNA, 8 bp, Unknown
  misc_feature (1)..( 8): Matrix.003 file - promoters50/1015676
ttttgaaa

SEQ ID NO: 65196 - DNA, 7 bp, Unknown
  misc_feature (1)..( 7): Matrix.003 file - promoters50/1015676
tattttc

SEQ ID NO: 65197 - DNA, 13 bp, Unknown
  misc_feature (1)..( 13): Matrix.003 file - promoters50/1015676
attatatcaacat

SEQ ID NO: 65198 - DNA, 8 bp, Unknown
  misc_feature (1)..( 8): Matrix.003 file - promoters50/1015676
ttaaaaca

SEQ ID NO: 65199 - DNA, 8 bp, Unknown
  misc_feature (1)..( 8): Matrix.003 file - promoters50/1015676
gtttcaaa

SEQ ID NO: 65200 - DNA, 9 bp, Unknown
  misc_feature (1)..( 9): Matrix.003 file - promoters50/1015700
atttcgatc

SEQ ID NO: 65201 - DNA, 8 bp, Unknown
  misc_feature (1)..( 8): Matrix.003 file - promoters50/1015726
caatttga

SEQ ID NO: 65202 - DNA, 10 bp, Unknown
  misc_feature (1)..( 10): Matrix.003 file - promoters50/1015726
gagtaaaaca

SEQ ID NO: 65203 - DNA, 13 bp, Unknown
  misc_feature (1)..( 13): Matrix.003 file - promoters50/1015748
attttaaatttat

SEQ ID NO: 65204 - DNA, 12 bp, Unknown
  misc_feature (1)..( 12): Matrix.003 file - promoters50/1015748
ttaacagaaaac

SEQ ID NO: 65205 - DNA, 7 bp, Unknown
  misc_feature (1)..( 7): Matrix.003 file - promoters50/1015752
gcaaaag

SEQ ID NO: 65206 - DNA, 10 bp, Unknown
  misc_feature (1)..( 10): Matrix.003 file - promoters50/1015752
aataaatgat

SEQ ID NO: 65207 - DNA, 9 bp, Unknown
  misc_feature (1)..( 9): Matrix.003 file - promoters50/1015763
ctaatgttt

SEQ ID NO: 65208 - DNA, 10 bp, Unknown
  misc_feature (1)..( 10): Matrix.003 file - promoters50/1015844
ttcgaaatca

SEQ ID NO: 65209 - DNA, 7 bp, Unknown
  misc_feature (1)..( 7): Matrix.003 file - promoters50/1015901
tatttgt

SEQ ID NO: 65210 - DNA, 10 bp, Unknown
  misc_feature (1)..( 10): Matrix.003 file - promoters50/1015901
taaacataca

SEQ ID NO: 65211 - DNA, 13 bp, Unknown
  misc_feature (1)..( 13): Matrix.003 file - promoters50/1015901
ccaaatttatcat

SEQ ID NO: 65212 - DNA, 11 bp, Unknown
  misc_feature (1)..( 11): Matrix.003 file - promoters50/1016056
aataaaataaa

SEQ ID NO: 65213 - DNA, 11 bp, Unknown
  misc_feature (1)..( 11): Matrix.003 file - promoters50/1016056
aataaaaactt

SEQ ID NO: 65214 - DNA, 6 bp, Unknown
  misc_feature (1)..( 6): Matrix.003 file - promoters50/1016063
aaatca

SEQ ID NO: 65215 - DNA, 6 bp, Unknown
  misc_feature (1)..( 6): Matrix.003 file - promoters50/1016066
acatgt

SEQ ID NO: 65216 - DNA, 9 bp, Unknown
  misc_feature (1)..( 9): Matrix.003 file - promoters50/1016066
tattattaa

SEQ ID NO: 65217 - DNA, 14 bp, Unknown
  misc_feature (1)..( 14): Matrix.003 file - promoters50/1016066
aaatacaaaaaaaa

SEQ ID NO: 65218 - DNA, 12 bp, Unknown
  misc_feature (1)..( 12): Matrix.003 file - promoters50/1016066
aaaaaaaagaaa

SEQ ID NO: 65219 - DNA, 14 bp, Unknown
  misc_feature (1)..( 14): Matrix.003 file - promoters50/1016094
cactgtgattgaat

SEQ ID NO: 65220 - DNA, 9 bp, Unknown
  misc_feature (1)..( 9): Matrix.003 file - promoters50/1016094
gaaaaaaaa

SEQ ID NO: 65221 - DNA, 8 bp, Unknown
  misc_feature (1)..( 8): Matrix.003 file - promoters50/1016133
ataacatt

SEQ ID NO: 65222 - DNA, 10 bp, Unknown
  misc_feature (1)..( 10): Matrix.003 file - promoters50/1016133
gtatatcaaa

SEQ ID NO: 65223 - DNA, 12 bp, Unknown
  misc_feature (1)..( 12): Matrix.003 file - promoters50/1016133
tatctttttctt

SEQ ID NO: 65224 - DNA, 7 bp, Unknown
  misc_feature (1)..( 7): Matrix.003 file - promoters50/1016133
tatttta

SEQ ID NO: 65225 - DNA, 10 bp, Unknown
  misc_feature (1)..( 10): Matrix.003 file - promoters50/1016133
aaaatattac

SEQ ID NO: 65226 - DNA, 8 bp, Unknown
  misc_feature (1)..( 8): Matrix.003 file - promoters50/1016133
aaatatat

SEQ ID NO: 65227 - DNA, 9 bp, Unknown
  misc_feature (1)..( 9): Matrix.003 file - promoters50/1016165
taaacaaaa

SEQ ID NO: 65228 - DNA, 13 bp, Unknown
  misc_feature (1)..( 13): Matrix.003 file - promoters50/1016165
aaattactaatgt

SEQ ID NO: 65229 - DNA, 14 bp, Unknown
  misc_feature (1)..( 14): Matrix.003 file - promoters50/1016176
aaaaataaaagctg

SEQ ID NO: 65230 - DNA, 6 bp, Unknown
  misc_feature (1)..( 6): Matrix.003 file - promoters50/1016176
cagaaa

SEQ ID NO: 65231 - DNA, 8 bp, Unknown
  misc_feature (1)..( 8): Matrix.003 file - promoters50/1016223
aaaacaac

SEQ ID NO: 65232 - DNA, 13 bp, Unknown
  misc_feature (1)..( 13): Matrix.003 file - promoters50/1016226
agatccgaaaatt

SEQ ID NO: 65233 - DNA, 9 bp, Unknown
  misc_feature (1)..( 9): Matrix.003 file - promoters50/1016226
gcaatgtct

SEQ ID NO: 65234 - DNA, 9 bp, Unknown
  misc_feature (1)..( 9): Matrix.003 file - promoters50/1016238
gatgatttt

SEQ ID NO: 65235 - DNA, 8 bp, Unknown
  misc_feature (1)..( 8): Matrix.003 file - promoters50/1016238
ccaatttt

SEQ ID NO: 65236 - DNA, 12 bp, Unknown
  misc_feature (1)..( 12): Matrix.003 file - promoters50/1016246
gatgtcgagaga

SEQ ID NO: 65237 - DNA, 10 bp, Unknown
  misc_feature (1)..( 10): Matrix.003 file - promoters50/1016246
gtgagaaaga

SEQ ID NO: 65238 - DNA, 12 bp, Unknown
  misc_feature (1)..( 12): Matrix.003 file - promoters50/1016250
aattttacatat

SEQ ID NO: 65239 - DNA, 12 bp, Unknown
  misc_feature (1)..( 12): Matrix.003 file - promoters50/1016250
aacattaaaaaa

SEQ ID NO: 65240 - DNA, 12 bp, Unknown
  misc_feature (1)..( 12): Matrix.003 file - promoters50/1016250
tttctataaact

SEQ ID NO: 65241 - DNA, 10 bp, Unknown
  misc_feature (1)..( 10): Matrix.003 file - promoters50/1016261
attaataaat

SEQ ID NO: 65242 - DNA, 7 bp, Unknown
  misc_feature (1)..( 7): Matrix.003 file - promoters50/1016261
aaaaaaa

SEQ ID NO: 65243 - DNA, 8 bp, Unknown
  misc_feature (1)..( 8): Matrix.003 file - promoters50/1016261
tatataaa

SEQ ID NO: 65244 - DNA, 11 bp, Unknown
  misc_feature (1)..( 11): Matrix.003 file - promoters50/1016268
ggattttctaa

SEQ ID NO: 65245 - DNA, 9 bp, Unknown
  misc_feature (1)..( 9): Matrix.003 file - promoters50/1016268
ttaaattct

SEQ ID NO: 65246 - DNA, 8 bp, Unknown
  misc_feature (1)..( 8): Matrix.003 file - promoters50/1016268
gaataaac

SEQ ID NO: 65247 - DNA, 7 bp, Unknown
  misc_feature (1)..( 7): Matrix.003 file - promoters50/1016268
aatacaa

SEQ ID NO: 65248 - DNA, 9 bp, Unknown
  misc_feature (1)..( 9): Matrix.003 file - promoters50/1016268
aagacaaaa

SEQ ID NO: 65249 - DNA, 8 bp, Unknown
  misc_feature (1)..( 8): Matrix.003 file - promoters50/1016268
ctctcttc

SEQ ID NO: 65250 - DNA, 10 bp, Unknown
  misc_feature (1)..( 10): Matrix.003 file - promoters50/1016268
aaaaattcaa

SEQ ID NO: 65251 - DNA, 6 bp, Unknown
  misc_feature (1)..( 6): Matrix.003 file - promoters50/1016268
ttaata

SEQ ID NO: 65252 - DNA, 9 bp, Unknown
  misc_feature (1)..( 9): Matrix.003 file - promoters50/1016268
ttttaggaa

SEQ ID NO: 65253 - DNA, 8 bp, Unknown
  misc_feature (1)..( 8): Matrix.003 file - promoters50/1016268
aaaatatt

SEQ ID NO: 65254 - DNA, 8 bp, Unknown
  misc_feature (1)..( 8): Matrix.003 file - promoters50/1016268
cgtttgat

SEQ ID NO: 65255 - DNA, 9 bp, Unknown
  misc_feature (1)..( 9): Matrix.003 file - promoters50/1016268
aaatatata

SEQ ID NO: 65256 - DNA, 6 bp, Unknown
  misc_feature (1)..( 6): Matrix.003 file - promoters50/1016268
aaataa

SEQ ID NO: 65257 - DNA, 8 bp, Unknown
  misc_feature (1)..( 8): Matrix.003 file - promoters50/1016268
aattattg

SEQ ID NO: 65258 - DNA, 8 bp, Unknown
  misc_feature (1)..( 8): Matrix.003 file - promoters50/1016268
tttccttg

SEQ ID NO: 65259 - DNA, 8 bp, Unknown
  misc_feature (1)..( 8): Matrix.003 file - promoters50/1016268
tataataa

SEQ ID NO: 65260 - DNA, 7 bp, Unknown
  misc_feature (1)..( 7): Matrix.003 file - promoters50/1016268
aaaatat

SEQ ID NO: 65261 - DNA, 8 bp, Unknown
  misc_feature (1)..( 8): Matrix.003 file - promoters50/1016278
taattatt

SEQ ID NO: 65262 - DNA, 9 bp, Unknown
  misc_feature (1)..( 9): Matrix.003 file - promoters50/1016278
tttactgat

SEQ ID NO: 65263 - DNA, 8 bp, Unknown
  misc_feature (1)..( 8): Matrix.003 file - promoters50/1016368
gagaatcg

SEQ ID NO: 65264 - DNA, 11 bp, Unknown
  misc_feature (1)..( 11): Matrix.003 file - promoters50/1016368
tcataatttgt

SEQ ID NO: 65265 - DNA, 12 bp, Unknown
  misc_feature (1)..( 12): Matrix.003 file - promoters50/1016368
aaataaaaaaca

SEQ ID NO: 65266 - DNA, 10 bp, Unknown
  misc_feature (1)..( 10): Matrix.003 file - promoters50/1016368
actatataat

SEQ ID NO: 65267 - DNA, 11 bp, Unknown
  misc_feature (1)..( 11): Matrix.003 file - promoters50/1016382
ttttaatatat

SEQ ID NO: 65268 - DNA, 9 bp, Unknown
  misc_feature (1)..( 9): Matrix.003 file - promoters50/1016418
cataattta

SEQ ID NO: 65269 - DNA, 13 bp, Unknown
  misc_feature (1)..( 13): Matrix.003 file - promoters50/1016418
tcattaatcaatg

SEQ ID NO: 65270 - DNA, 13 bp, Unknown
  misc_feature (1)..( 13): Matrix.003 file - promoters50/1016418
attatttgttgat

SEQ ID NO: 65271 - DNA, 9 bp, Unknown
  misc_feature (1)..( 9): Matrix.003 file - promoters50/1016426
gaaagttaa

SEQ ID NO: 65272 - DNA, 6 bp, Unknown
  misc_feature (1)..( 6): Matrix.003 file - promoters50/1016426
aatttt

SEQ ID NO: 65273 - DNA, 8 bp, Unknown
  misc_feature (1)..( 8): Matrix.003 file - promoters50/1016426
tttaaatt

SEQ ID NO: 65274 - DNA, 11 bp, Unknown
  misc_feature (1)..( 11): Matrix.003 file - promoters50/1016426
ttatacctaaa

SEQ ID NO: 65275 - DNA, 8 bp, Unknown
  misc_feature (1)..( 8): Matrix.003 file - promoters50/1016426
tttcttcc

SEQ ID NO: 65276 - DNA, 11 bp, Unknown
  misc_feature (1)..( 11): Matrix.003 file - promoters50/1016468
ttcaatttttt

SEQ ID NO: 65277 - DNA, 11 bp, Unknown
  misc_feature (1)..( 11): Matrix.003 file - promoters50/1016468
ataaaaaaaca

SEQ ID NO: 65278 - DNA, 9 bp, Unknown
  misc_feature (1)..( 9): Matrix.003 file - promoters50/1016468
tggccaaaa

SEQ ID NO: 65279 - DNA, 15 bp, Unknown
  misc_feature (1)..( 15): Matrix.003 file - promoters50/1016514
ttttccgaaatagtt

SEQ ID NO: 65280 - DNA, 9 bp, Unknown
  misc_feature (1)..( 9): Matrix.003 file - promoters50/1016514
taagaaaat

SEQ ID NO: 65281 - DNA, 7 bp, Unknown
  misc_feature (1)..( 7): Matrix.003 file - promoters50/1016525
tttttta

SEQ ID NO: 65282 - DNA, 8 bp, Unknown
  misc_feature (1)..( 8): Matrix.003 file - promoters50/1016525
caataaac

SEQ ID NO: 65283 - DNA, 11 bp, Unknown
  misc_feature (1)..( 11): Matrix.003 file - promoters50/1016525
agaaaaacttg

SEQ ID NO: 65284 - DNA, 6 bp, Unknown
  misc_feature (1)..( 6): Matrix.003 file - promoters50/1016525
caataa

SEQ ID NO: 65285 - DNA, 9 bp, Unknown
  misc_feature (1)..( 9): Matrix.003 file - promoters50/1016525
cagaaaaaa

SEQ ID NO: 65286 - DNA, 8 bp, Unknown
  misc_feature (1)..( 8): Matrix.003 file - promoters50/1016525
attctaaa

SEQ ID NO: 65287 - DNA, 10 bp, Unknown
  misc_feature (1)..( 10): Matrix.003 file - promoters50/1016525
aaaacaaatt

SEQ ID NO: 65288 - DNA, 9 bp, Unknown
  misc_feature (1)..( 9): Matrix.003 file - promoters50/1016525
aaataataa

SEQ ID NO: 65289 - DNA, 6 bp, Unknown
  misc_feature (1)..( 6): Matrix.003 file - promoters50/1016624
cttctt

SEQ ID NO: 65290 - DNA, 8 bp, Unknown
  misc_feature (1)..( 8): Matrix.003 file - promoters50/1016643
ttcatcta

SEQ ID NO: 65291 - DNA, 13 bp, Unknown
  misc_feature (1)..( 13): Matrix.003 file - promoters50/1016665
ccaaatatatcat

SEQ ID NO: 65292 - DNA, 10 bp, Unknown
  misc_feature (1)..( 10): Matrix.003 file - promoters50/1016692
gaaacttata

SEQ ID NO: 65293 - DNA, 10 bp, Unknown
  misc_feature (1)..( 10): Matrix.003 file - promoters50/1016692
aaaataagtt

SEQ ID NO: 65294 - DNA, 6 bp, Unknown
  misc_feature (1)..( 6): Matrix.003 file - promoters50/1016729
ttcata

SEQ ID NO: 65295 - DNA, 7 bp, Unknown
  misc_feature (1)..( 7): Matrix.003 file - promoters50/1016729
agcaaca

SEQ ID NO: 65296 - DNA, 9 bp, Unknown
  misc_feature (1)..( 9): Matrix.003 file - promoters50/1016729
agcaacaat

SEQ ID NO: 65297 - DNA, 12 bp, Unknown
  misc_feature (1)..( 12): Matrix.003 file - promoters50/1016767
taataaatttag

SEQ ID NO: 65298 - DNA, 10 bp, Unknown
  misc_feature (1)..( 10): Matrix.003 file - promoters50/1016767
ccaaatttct

SEQ ID NO: 65299 - DNA, 9 bp, Unknown
  misc_feature (1)..( 9): Matrix.003 file - promoters50/1016771
attgttcct

SEQ ID NO: 65300 - DNA, 12 bp, Unknown
  misc_feature (1)..( 12): Matrix.003 file - promoters50/1016771
ctctactttatt

SEQ ID NO: 65301 - DNA, 11 bp, Unknown
  misc_feature (1)..( 11): Matrix.003 file - promoters50/1016814
aaaacttttat

SEQ ID NO: 65302 - DNA, 9 bp, Unknown
  misc_feature (1)..( 9): Matrix.003 file - promoters50/1016814
aattttatg

SEQ ID NO: 65303 - DNA, 8 bp, Unknown
  misc_feature (1)..( 8): Matrix.003 file - promoters50/1016854
aatcttat

SEQ ID NO: 65304 - DNA, 11 bp, Unknown
  misc_feature (1)..( 11): Matrix.003 file - promoters50/1016881
ttgtaattaat

SEQ ID NO: 65305 - DNA, 8 bp, Unknown
  misc_feature (1)..( 8): Matrix.003 file - promoters50/1016881
attcattt

SEQ ID NO: 65306 - DNA, 7 bp, Unknown
  misc_feature (1)..( 7): Matrix.003 file - promoters50/1016881
gtttatt

SEQ ID NO: 65307 - DNA, 9 bp, Unknown
  misc_feature (1)..( 9): Matrix.003 file - promoters50/1016881
ttaactttt

SEQ ID NO: 65308 - DNA, 9 bp, Unknown
  misc_feature (1)..( 9): Matrix.003 file - promoters50/1016881
attattata

SEQ ID NO: 65309 - DNA, 7 bp, Unknown
  misc_feature (1)..( 7): Matrix.003 file - promoters50/1016881
aacatct

SEQ ID NO: 65310 - DNA, 11 bp, Unknown
  misc_feature (1)..( 11): Matrix.003 file - promoters50/1016915
caataaaataa

SEQ ID NO: 65311 - DNA, 8 bp, Unknown
  misc_feature (1)..( 8): Matrix.003 file - promoters50/1016915
aaaataag

SEQ ID NO: 65312 - DNA, 8 bp, Unknown
  misc_feature (1)..( 8): Matrix.003 file - promoters50/1016915
agatatat

SEQ ID NO: 65313 - DNA, 8 bp, Unknown
  misc_feature (1)..( 8): Matrix.003 file - promoters50/1016915
caaaaaat

SEQ ID NO: 65314 - DNA, 7 bp, Unknown
  misc_feature (1)..( 7): Matrix.003 file - promoters50/1016931
taaacaa

SEQ ID NO: 65315 - DNA, 10 bp, Unknown
  misc_feature (1)..( 10): Matrix.003 file - promoters50/1016931
cttatagatc

SEQ ID NO: 65316 - DNA, 9 bp, Unknown
  misc_feature (1)..( 9): Matrix.003 file - promoters50/1016931
aaatctttt

SEQ ID NO: 65317 - DNA, 7 bp, Unknown
  misc_feature (1)..( 7): Matrix.003 file - promoters50/1016931
gatatat

SEQ ID NO: 65318 - DNA, 7 bp, Unknown
  misc_feature (1)..( 7): Matrix.003 file - promoters50/1016931
atatcta

SEQ ID NO: 65319 - DNA, 10 bp, Unknown
  misc_feature (1)..( 10): Matrix.003 file - promoters50/1016931
attattgttt

SEQ ID NO: 65320 - DNA, 6 bp, Unknown
  misc_feature (1)..( 6): Matrix.003 file - promoters50/1016931
ttatct

SEQ ID NO: 65321 - DNA, 7 bp, Unknown
  misc_feature (1)..( 7): Matrix.003 file - promoters50/1016931
acaaaag

SEQ ID NO: 65322 - DNA, 12 bp, Unknown
  misc_feature (1)..( 12): Matrix.003 file - promoters50/1016931
tgataaatattt

SEQ ID NO: 65323 - DNA, 8 bp, Unknown
  misc_feature (1)..( 8): Matrix.003 file - promoters50/1016936
gttttaat

SEQ ID NO: 65324 - DNA, 9 bp, Unknown
  misc_feature (1)..( 9): Matrix.003 file - promoters50/1016936
cattttcta

SEQ ID NO: 65325 - DNA, 8 bp, Unknown
  misc_feature (1)..( 8): Matrix.003 file - promoters50/1016936
atatattt

SEQ ID NO: 65326 - DNA, 7 bp, Unknown
  misc_feature (1)..( 7): Matrix.003 file - promoters50/1016951
agatttt

SEQ ID NO: 65327 - DNA, 7 bp, Unknown
  misc_feature (1)..( 7): Matrix.003 file - promoters50/1016951
caaacac

SEQ ID NO: 65328 - DNA, 7 bp, Unknown
  misc_feature (1)..( 7): Matrix.003 file - promoters50/1016951
ttaaata

SEQ ID NO: 65329 - DNA, 7 bp, Unknown
  misc_feature (1)..( 7): Matrix.003 file - promoters50/1016951
atatata

SEQ ID NO: 65330 - DNA, 7 bp, Unknown
  misc_feature (1)..( 7): Matrix.003 file - promoters50/1016951
aattttt

SEQ ID NO: 65331 - DNA, 7 bp, Unknown
  misc_feature (1)..( 7): Matrix.003 file - promoters50/1016951
aacataa

SEQ ID NO: 65332 - DNA, 8 bp, Unknown
  misc_feature (1)..( 8): Matrix.003 file - promoters50/1016951
atacataa

SEQ ID NO: 65333 - DNA, 14 bp, Unknown
  misc_feature (1)..( 14): Matrix.003 file - promoters50/1017020
ttgaatcaaaatat

SEQ ID NO: 65334 - DNA, 8 bp, Unknown
  misc_feature (1)..( 8): Matrix.003 file - promoters50/1017020
ttaatagc

SEQ ID NO: 65335 - DNA, 7 bp, Unknown
  misc_feature (1)..( 7): Matrix.003 file - promoters50/1017020
aaaacat

SEQ ID NO: 65336 - DNA, 10 bp, Unknown
  misc_feature (1)..( 10): Matrix.003 file - promoters50/1017020
ctatactttg

SEQ ID NO: 65337 - DNA, 6 bp, Unknown
  misc_feature (1)..( 6): Matrix.003 file - promoters50/1017041
aagttt

SEQ ID NO: 65338 - DNA, 8 bp, Unknown
  misc_feature (1)..( 8): Matrix.003 file - promoters50/1017046
taatattt

SEQ ID NO: 65339 - DNA, 8 bp, Unknown
  misc_feature (1)..( 8): Matrix.003 file - promoters50/1017046
aatacttt

SEQ ID NO: 65340 - DNA, 9 bp, Unknown
  misc_feature (1)..( 9): Matrix.003 file - promoters50/1017046
cctttttta

SEQ ID NO: 65341 - DNA, 8 bp, Unknown
  misc_feature (1)..( 8): Matrix.003 file - promoters50/1017046
taaatttc

SEQ ID NO: 65342 - DNA, 14 bp, Unknown
  misc_feature (1)..( 14): Matrix.003 file - promoters50/1017046
ttaacaatttattt

SEQ ID NO: 65343 - DNA, 10 bp, Unknown
  misc_feature (1)..( 10): Matrix.003 file - promoters50/1017046
atgggttgga

SEQ ID NO: 65344 - DNA, 9 bp, Unknown
  misc_feature (1)..( 9): Matrix.003 file - promoters50/1017050
atgattaca

SEQ ID NO: 65345 - DNA, 11 bp, Unknown
  misc_feature (1)..( 11): Matrix.003 file - promoters50/1017050
tagattgatat

SEQ ID NO: 65346 - DNA, 8 bp, Unknown
  misc_feature (1)..( 8): Matrix.003 file - promoters50/1017109
ttatttac

SEQ ID NO: 65347 - DNA, 11 bp, Unknown
  misc_feature (1)..( 11): Matrix.003 file - promoters50/1017113
taaaatgaaaa

SEQ ID NO: 65348 - DNA, 9 bp, Unknown
  misc_feature (1)..( 9): Matrix.003 file - promoters50/1017113
tcaaaatac

SEQ ID NO: 65349 - DNA, 9 bp, Unknown
  misc_feature (1)..( 9): Matrix.003 file - promoters50/1017113
ttttatgtt

SEQ ID NO: 65350 - DNA, 14 bp, Unknown
  misc_feature (1)..( 14): Matrix.003 file - promoters50/1017113
ttaaggccgtatgt

SEQ ID NO: 65351 - DNA, 12 bp, Unknown
  misc_feature (1)..( 12): Matrix.003 file - promoters50/1017113
gaaagaaaatat

SEQ ID NO: 65352 - DNA, 10 bp, Unknown
  misc_feature (1)..( 10): Matrix.003 file - promoters50/1017113
attttgtttt

SEQ ID NO: 65353 - DNA, 11 bp, Unknown
  misc_feature (1)..( 11): Matrix.003 file - promoters50/1017113
aatataagata

SEQ ID NO: 65354 - DNA, 8 bp, Unknown
  misc_feature (1)..( 8): Matrix.003 file - promoters50/1017113
ttttattt

SEQ ID NO: 65355 - DNA, 9 bp, Unknown
  misc_feature (1)..( 9): Matrix.003 file - promoters50/1017131
attaataaa

SEQ ID NO: 65356 - DNA, 13 bp, Unknown
  misc_feature (1)..( 13): Matrix.003 file - promoters50/1017131
attggataaaaga

SEQ ID NO: 65357 - DNA, 10 bp, Unknown
  misc_feature (1)..( 10): Matrix.003 file - promoters50/1017131
acaaaaaaag

SEQ ID NO: 65358 - DNA, 9 bp, Unknown
  misc_feature (1)..( 9): Matrix.003 file - promoters50/1017189
aagattgat

SEQ ID NO: 65359 - DNA, 6 bp, Unknown
  misc_feature (1)..( 6): Matrix.003 file - promoters50/1017189
ttttgt

SEQ ID NO: 65360 - DNA, 9 bp, Unknown
  misc_feature (1)..( 9): Matrix.003 file - promoters50/1017189
atgttatgt

SEQ ID NO: 65361 - DNA, 9 bp, Unknown
  misc_feature (1)..( 9): Matrix.003 file - promoters50/1017189
ttttgtttt

SEQ ID NO: 65362 - DNA, 9 bp, Unknown
  misc_feature (1)..( 9): Matrix.003 file - promoters50/1017282
tctaacaac

SEQ ID NO: 65363 - DNA, 10 bp, Unknown
  misc_feature (1)..( 10): Matrix.003 file - promoters50/1017286
caatatgtga

SEQ ID NO: 65364 - DNA, 9 bp, Unknown
  misc_feature (1)..( 9): Matrix.003 file - promoters50/1017316
aaaatttga

SEQ ID NO: 65365 - DNA, 10 bp, Unknown
  misc_feature (1)..( 10): Matrix.003 file - promoters50/1017316
agaaaatcat

SEQ ID NO: 65366 - DNA, 8 bp, Unknown
  misc_feature (1)..( 8): Matrix.003 file - promoters50/1017316
tttgtctg

SEQ ID NO: 65367 - DNA, 9 bp, Unknown
  misc_feature (1)..( 9): Matrix.003 file - promoters50/1017316
aaattaatt

SEQ ID NO: 65368 - DNA, 11 bp, Unknown
  misc_feature (1)..( 11): Matrix.003 file - promoters50/1017316
atgggcctata

SEQ ID NO: 65369 - DNA, 9 bp, Unknown
  misc_feature (1)..( 9): Matrix.003 file - promoters50/1017316
tttttactt

SEQ ID NO: 65370 - DNA, 7 bp, Unknown
  misc_feature (1)..( 7): Matrix.003 file - promoters50/1017316
ttacttt

SEQ ID NO: 65371 - DNA, 9 bp, Unknown
  misc_feature (1)..( 9): Matrix.003 file - promoters50/1017316
atgtttcaa

SEQ ID NO: 65372 - DNA, 10 bp, Unknown
  misc_feature (1)..( 10): Matrix.003 file - promoters50/1017354
aaaattcgat

SEQ ID NO: 65373 - DNA, 11 bp, Unknown
  misc_feature (1)..( 11): Matrix.003 file - promoters50/1017358
aatcaaaaaag

SEQ ID NO: 65374 - DNA, 11 bp, Unknown
  misc_feature (1)..( 11): Matrix.003 file - promoters50/1017358
ccttatatata

SEQ ID NO: 65375 - DNA, 11 bp, Unknown
  misc_feature (1)..( 11): Matrix.003 file - promoters50/1017434
aagataaagaa

SEQ ID NO: 65376 - DNA, 10 bp, Unknown
  misc_feature (1)..( 10): Matrix.003 file - promoters50/1017434
cctttttatt

SEQ ID NO: 65377 - DNA, 7 bp, Unknown
  misc_feature (1)..( 7): Matrix.003 file - promoters50/1017542
caattca

SEQ ID NO: 65378 - DNA, 7 bp, Unknown
  misc_feature (1)..( 7): Matrix.003 file - promoters50/1017552
ttagaac

SEQ ID NO: 65379 - DNA, 10 bp, Unknown
  misc_feature (1)..( 10): Matrix.003 file - promoters50/1017552
agaattataa

SEQ ID NO: 65380 - DNA, 8 bp, Unknown
  misc_feature (1)..( 8): Matrix.003 file - promoters50/1017552
aggaaaaa

SEQ ID NO: 65381 - DNA, 7 bp, Unknown
  misc_feature (1)..( 7): Matrix.003 file - promoters50/1017552
aaaaaat

SEQ ID NO: 65382 - DNA, 11 bp, Unknown
  misc_feature (1)..( 11): Matrix.003 file - promoters50/1017562
atataatacta

SEQ ID NO: 65383 - DNA, 10 bp, Unknown
  misc_feature (1)..( 10): Matrix.003 file - promoters50/1017562
tatatatact

SEQ ID NO: 65384 - DNA, 10 bp, Unknown
  misc_feature (1)..( 10): Matrix.003 file - promoters50/1017562
atataatact

SEQ ID NO: 65385 - DNA, 11 bp, Unknown
  misc_feature (1)..( 11): Matrix.003 file - promoters50/1017562
aataatcaaac

SEQ ID NO: 65386 - DNA, 9 bp, Unknown
  misc_feature (1)..( 9): Matrix.003 file - promoters50/1017562
aaatataaa

SEQ ID NO: 65387 - DNA, 13 bp, Unknown
  misc_feature (1)..( 13): Matrix.003 file - promoters50/1017562
tatatatatctac

SEQ ID NO: 65388 - DNA, 8 bp, Unknown
  misc_feature (1)..( 8): Matrix.003 file - promoters50/1017562
agaataaa

SEQ ID NO: 65389 - DNA, 9 bp, Unknown
  misc_feature (1)..( 9): Matrix.003 file - promoters50/1017568
ttaatttag

SEQ ID NO: 65390 - DNA, 15 bp, Unknown
  misc_feature (1)..( 15): Matrix.003 file - promoters50/1017568
tttaatctgaaaaac

SEQ ID NO: 65391 - DNA, 8 bp, Unknown
  misc_feature (1)..( 8): Matrix.003 file - promoters50/1017593
ttgtttta

SEQ ID NO: 65392 - DNA, 8 bp, Unknown
  misc_feature (1)..( 8): Matrix.003 file - promoters50/1017596
tttgtttt

SEQ ID NO: 65393 - DNA, 8 bp, Unknown
  misc_feature (1)..( 8): Matrix.003 file - promoters50/1017596
tatttaac

SEQ ID NO: 65394 - DNA, 8 bp, Unknown
  misc_feature (1)..( 8): Matrix.003 file - promoters50/1017596
cttatgag

SEQ ID NO: 65395 - DNA, 14 bp, Unknown
  misc_feature (1)..( 14): Matrix.003 file - promoters50/1017618
tatcctataaataa

SEQ ID NO: 65396 - DNA, 12 bp, Unknown
  misc_feature (1)..( 12): Matrix.003 file - promoters50/1017618
cctataaataaa

SEQ ID NO: 65397 - DNA, 10 bp, Unknown
  misc_feature (1)..( 10): Matrix.003 file - promoters50/1017618
aaaataaaac

SEQ ID NO: 65398 - DNA, 12 bp, Unknown
  misc_feature (1)..( 12): Matrix.003 file - promoters50/1017626
tcaataacaaaa

SEQ ID NO: 65399 - DNA, 9 bp, Unknown
  misc_feature (1)..( 9): Matrix.003 file - promoters50/1017626
ttttataaa

SEQ ID NO: 65400 - DNA, 7 bp, Unknown
  misc_feature (1)..( 7): Matrix.003 file - promoters50/1017626
tctctct

SEQ ID NO: 65401 - DNA, 9 bp, Unknown
  misc_feature (1)..( 9): Matrix.003 file - promoters50/1017626
caaattgga

SEQ ID NO: 65402 - DNA, 8 bp, Unknown
  misc_feature (1)..( 8): Matrix.003 file - promoters50/1017626
aaatagta

SEQ ID NO: 65403 - DNA, 11 bp, Unknown
  misc_feature (1)..( 11): Matrix.003 file - promoters50/1017626
gcctatataaa

SEQ ID NO: 65404 - DNA, 10 bp, Unknown
  misc_feature (1)..( 10): Matrix.003 file - promoters50/1017626
gcctatataa

SEQ ID NO: 65405 - DNA, 8 bp, Unknown
  misc_feature (1)..( 8): Matrix.003 file - promoters50/1017626
aaacgaat

SEQ ID NO: 65406 - DNA, 8 bp, Unknown
  misc_feature (1)..( 8): Matrix.003 file - promoters50/1017626
ttaataac

SEQ ID NO: 65407 - DNA, 11 bp, Unknown
  misc_feature (1)..( 11): Matrix.003 file - promoters50/1017649
gaaataaaaag

SEQ ID NO: 65408 - DNA, 12 bp, Unknown
  misc_feature (1)..( 12): Matrix.003 file - promoters50/1017681
aaaagactaaaa

SEQ ID NO: 65409 - DNA, 8 bp, Unknown
  misc_feature (1)..( 8): Matrix.003 file - promoters50/1017693
aatatagt

SEQ ID NO: 65410 - DNA, 8 bp, Unknown
  misc_feature (1)..( 8): Matrix.003 file - promoters50/1017693
atttgtat

SEQ ID NO: 65411 - DNA, 9 bp, Unknown
  misc_feature (1)..( 9): Matrix.003 file - promoters50/1017693
atgtttttg

SEQ ID NO: 65412 - DNA, 8 bp, Unknown
  misc_feature (1)..( 8): Matrix.003 file - promoters50/1017693
aaaaacaa

SEQ ID NO: 65413 - DNA, 20 bp, Unknown
  misc_feature (1)..( 20): Matrix.003 file - promoters50/1017802
aaagttgctacaaattatag

SEQ ID NO: 65414 - DNA, 22 bp, Unknown
  misc_feature (1)..( 22): Matrix.003 file - promoters50/1017802
tcttttctgattttgtttctca

SEQ ID NO: 65415 - DNA, 7 bp, Unknown
  misc_feature (1)..( 7): Matrix.003 file - promoters50/1017802
aaatata

SEQ ID NO: 65416 - DNA, 8 bp, Unknown
  misc_feature (1)..( 8): Matrix.003 file - promoters50/1017802
gataaaat

SEQ ID NO: 65417 - DNA, 6 bp, Unknown
  misc_feature (1)..( 6): Matrix.003 file - promoters50/1017802
atagga

SEQ ID NO: 65418 - DNA, 8 bp, Unknown
  misc_feature (1)..( 8): Matrix.003 file - promoters50/1017802
ataaaatt

SEQ ID NO: 65419 - DNA, 12 bp, Unknown
  misc_feature (1)..( 12): Matrix.003 file - promoters50/1017802
aaaaaataaaaa

SEQ ID NO: 65420 - DNA, 10 bp, Unknown
  misc_feature (1)..( 10): Matrix.003 file - promoters50/1017883
aaagaaacat

SEQ ID NO: 65421 - DNA, 12 bp, Unknown
  misc_feature (1)..( 12): Matrix.003 file - promoters50/1017883
tccctttataaa

SEQ ID NO: 65422 - DNA, 8 bp, Unknown
  misc_feature (1)..( 8): Matrix.003 file - promoters50/1017883
tttattta

SEQ ID NO: 65423 - DNA, 12 bp, Unknown
  misc_feature (1)..( 12): Matrix.003 file - promoters50/1017883
aaaaaaaatgtt

SEQ ID NO: 65424 - DNA, 9 bp, Unknown
  misc_feature (1)..( 9): Matrix.003 file - promoters50/1017887
tttaaataa

SEQ ID NO: 65425 - DNA, 10 bp, Unknown
  misc_feature (1)..( 10): Matrix.003 file - promoters50/1017887
ttttattttt

SEQ ID NO: 65426 - DNA, 9 bp, Unknown
  misc_feature (1)..( 9): Matrix.003 file - promoters50/1017887
cattatatt

SEQ ID NO: 65427 - DNA, 12 bp, Unknown
  misc_feature (1)..( 12): Matrix.003 file - promoters50/1017887
actctcatgcat

SEQ ID NO: 65428 - DNA, 9 bp, Unknown
  misc_feature (1)..( 9): Matrix.003 file - promoters50/1017887
gatcaatgg

SEQ ID NO: 65429 - DNA, 11 bp, Unknown
  misc_feature (1)..( 11): Matrix.003 file - promoters50/1017964
aaagtataaaa

SEQ ID NO: 65430 - DNA, 9 bp, Unknown
  misc_feature (1)..( 9): Matrix.003 file - promoters50/1018052
atcaatttt

SEQ ID NO: 65431 - DNA, 13 bp, Unknown
  misc_feature (1)..( 13): Matrix.003 file - promoters50/1018052
atgattgttttaa

SEQ ID NO: 65432 - DNA, 9 bp, Unknown
  misc_feature (1)..( 9): Matrix.003 file - promoters50/1018052
aatgtttta

SEQ ID NO: 65433 - DNA, 16 bp, Unknown
  misc_feature (1)..( 16): Matrix.003 file - promoters50/1018077
cataaaatcattatat

SEQ ID NO: 65434 - DNA, 9 bp, Unknown
  misc_feature (1)..( 9): Matrix.003 file - promoters50/1018077
agtatctcc

SEQ ID NO: 65435 - DNA, 10 bp, Unknown
  misc_feature (1)..( 10): Matrix.003 file - promoters50/1018077
tcaaacaaaa

SEQ ID NO: 65436 - DNA, 7 bp, Unknown
  misc_feature (1)..( 7): Matrix.003 file - promoters50/1018077
actgttt

SEQ ID NO: 65437 - DNA, 10 bp, Unknown
  misc_feature (1)..( 10): Matrix.003 file - promoters50/1018085
aaataatttt

SEQ ID NO: 65438 - DNA, 8 bp, Unknown
  misc_feature (1)..( 8): Matrix.003 file - promoters50/1018085
gttttaag

SEQ ID NO: 65439 - DNA, 10 bp, Unknown
  misc_feature (1)..( 10): Matrix.003 file - promoters50/1018085
gagaataaag

SEQ ID NO: 65440 - DNA, 9 bp, Unknown
  misc_feature (1)..( 9): Matrix.003 file - promoters50/1018151
ggttattat

SEQ ID NO: 65441 - DNA, 7 bp, Unknown
  misc_feature (1)..( 7): Matrix.003 file - promoters50/1018151
atttaaa

SEQ ID NO: 65442 - DNA, 12 bp, Unknown
  misc_feature (1)..( 12): Matrix.003 file - promoters50/1018151
ggtctatataag

SEQ ID NO: 65443 - DNA, 8 bp, Unknown
  misc_feature (1)..( 8): Matrix.003 file - promoters50/1018151
taaaataa

SEQ ID NO: 65444 - DNA, 4 bp, Unknown
  misc_feature (1)..( 4): Matrix.003 file - promoters50/1018155
tttt

SEQ ID NO: 65445 - DNA, 11 bp, Unknown
  misc_feature (1)..( 11): Matrix.003 file - promoters50/1018155
aaattaaaaaa

SEQ ID NO: 65446 - DNA, 9 bp, Unknown
  misc_feature (1)..( 9): Matrix.003 file - promoters50/1018155
ccaaaaaaa

SEQ ID NO: 65447 - DNA, 9 bp, Unknown
  misc_feature (1)..( 9): Matrix.003 file - promoters50/1018155
tttaaataa

SEQ ID NO: 65448 - DNA, 11 bp, Unknown
  misc_feature (1)..( 11): Matrix.003 file - promoters50/1018155
aataaaaactg

SEQ ID NO: 65449 - DNA, 13 bp, Unknown
  misc_feature (1)..( 13): Matrix.003 file - promoters50/1018155
ttaattttttaca

SEQ ID NO: 65450 - DNA, 9 bp, Unknown
  misc_feature (1)..( 9): Matrix.003 file - promoters50/1018159
gaaatcgaa

SEQ ID NO: 65451 - DNA, 8 bp, Unknown
  misc_feature (1)..( 8): Matrix.003 file - promoters50/1018159
ataaattc

SEQ ID NO: 65452 - DNA, 12 bp, Unknown
  misc_feature (1)..( 12): Matrix.003 file - promoters50/1018163
ctcatgaaaaaa

SEQ ID NO: 65453 - DNA, 13 bp, Unknown
  misc_feature (1)..( 13): Matrix.003 file - promoters50/1018190
atcatttttttat

SEQ ID NO: 65454 - DNA, 9 bp, Unknown
  misc_feature (1)..( 9): Matrix.003 file - promoters50/1018206
aaatgatcc

SEQ ID NO: 65455 - DNA, 8 bp, Unknown
  misc_feature (1)..( 8): Matrix.003 file - promoters50/1018206
aaatgatc

SEQ ID NO: 65456 - DNA, 15 bp, Unknown
  misc_feature (1)..( 15): Matrix.003 file - promoters50/1018206
tgaaaaaaaaagaaa

SEQ ID NO: 65457 - DNA, 12 bp, Unknown
  misc_feature (1)..( 12): Matrix.003 file - promoters50/1018206
aaaaaaaaaaaa

SEQ ID NO: 65458 - DNA, 10 bp, Unknown
  misc_feature (1)..( 10): Matrix.003 file - promoters50/1018213
tattgtatat

SEQ ID NO: 65459 - DNA, 8 bp, Unknown
  misc_feature (1)..( 8): Matrix.003 file - promoters50/1018213
ttttttaa

SEQ ID NO: 65460 - DNA, 8 bp, Unknown
  misc_feature (1)..( 8): Matrix.003 file - promoters50/1018213
taaaaaat

SEQ ID NO: 65461 - DNA, 8 bp, Unknown
  misc_feature (1)..( 8): Matrix.003 file - promoters50/1018213
agaaattg

SEQ ID NO: 65462 - DNA, 8 bp, Unknown
  misc_feature (1)..( 8): Matrix.003 file - promoters50/1018213
aatttttt

SEQ ID NO: 65463 - DNA, 11 bp, Unknown
  misc_feature (1)..( 11): Matrix.003 file - promoters50/1018213
agacaaaaata

SEQ ID NO: 65464 - DNA, 11 bp, Unknown
  misc_feature (1)..( 11): Matrix.003 file - promoters50/1018217
ataaaaaaata

SEQ ID NO: 65465 - DNA, 8 bp, Unknown
  misc_feature (1)..( 8): Matrix.003 file - promoters50/1018217
aaaaaaaa

SEQ ID NO: 65466 - DNA, 8 bp, Unknown
  misc_feature (1)..( 8): Matrix.003 file - promoters50/1018217
tcaaatct

SEQ ID NO: 65467 - DNA, 12 bp, Unknown
  misc_feature (1)..( 12): Matrix.003 file - promoters50/1018220
tgttgtaagttt

SEQ ID NO: 65468 - DNA, 9 bp, Unknown
  misc_feature (1)..( 9): Matrix.003 file - promoters50/1018220
tcattttta

SEQ ID NO: 65469 - DNA, 10 bp, Unknown
  misc_feature (1)..( 10): Matrix.003 file - promoters50/1018220
atcaaatgca

SEQ ID NO: 65470 - DNA, 8 bp, Unknown
  misc_feature (1)..( 8): Matrix.003 file - promoters50/1018220
aagtaaac

SEQ ID NO: 65471 - DNA, 7 bp, Unknown
  misc_feature (1)..( 7): Matrix.003 file - promoters50/1018220
tagatag

SEQ ID NO: 65472 - DNA, 11 bp, Unknown
  misc_feature (1)..( 11): Matrix.003 file - promoters50/1018220
tttaagaaacg

SEQ ID NO: 65473 - DNA, 9 bp, Unknown
  misc_feature (1)..( 9): Matrix.003 file - promoters50/1018220
tcagaaaat

SEQ ID NO: 65474 - DNA, 10 bp, Unknown
  misc_feature (1)..( 10): Matrix.003 file - promoters50/1018276
taatttgtat

SEQ ID NO: 65475 - DNA, 5 bp, Unknown
  misc_feature (1)..( 5): Matrix.003 file - promoters50/1018276
ttttg

SEQ ID NO: 65476 - DNA, 6 bp, Unknown
  misc_feature (1)..( 6): Matrix.003 file - promoters50/1018382
aaaaaa

SEQ ID NO: 65477 - DNA, 10 bp, Unknown
  misc_feature (1)..( 10): Matrix.003 file - promoters50/1018382
aaaatattgt

SEQ ID NO: 65478 - DNA, 13 bp, Unknown
  misc_feature (1)..( 13): Matrix.003 file - promoters50/1018382
aaatttgtatttt

SEQ ID NO: 65479 - DNA, 9 bp, Unknown
  misc_feature (1)..( 9): Matrix.003 file - promoters50/1018382
ttttactat

SEQ ID NO: 65480 - DNA, 13 bp, Unknown
  misc_feature (1)..( 13): Matrix.003 file - promoters50/1018382
gatgttaaaaaaa

SEQ ID NO: 65481 - DNA, 8 bp, Unknown
  misc_feature (1)..( 8): Matrix.003 file - promoters50/1018391
acctaaat

SEQ ID NO: 65482 - DNA, 12 bp, Unknown
  misc_feature (1)..( 12): Matrix.003 file - promoters50/1018454
cacattttctat

SEQ ID NO: 65483 - DNA, 9 bp, Unknown
  misc_feature (1)..( 9): Matrix.003 file - promoters50/1018454
agaaaaata

SEQ ID NO: 65484 - DNA, 12 bp, Unknown
  misc_feature (1)..( 12): Matrix.003 file - promoters50/1018472
aaattttcaaat

SEQ ID NO: 65485 - DNA, 6 bp, Unknown
  misc_feature (1)..( 6): Matrix.003 file - promoters50/1018472
aaaaaa

SEQ ID NO: 65486 - DNA, 6 bp, Unknown
  misc_feature (1)..( 6): Matrix.003 file - promoters50/1018472
taaatt

SEQ ID NO: 65487 - DNA, 8 bp, Unknown
  misc_feature (1)..( 8): Matrix.003 file - promoters50/1018472
acaaaatt

SEQ ID NO: 65488 - DNA, 7 bp, Unknown
  misc_feature (1)..( 7): Matrix.003 file - promoters50/1018472
ctcaatt

SEQ ID NO: 65489 - DNA, 9 bp, Unknown
  misc_feature (1)..( 9): Matrix.003 file - promoters50/1018472
agatatttt

SEQ ID NO: 65490 - DNA, 7 bp, Unknown
  misc_feature (1)..( 7): Matrix.003 file - promoters50/1018472
ataaata

SEQ ID NO: 65491 - DNA, 8 bp, Unknown
  misc_feature (1)..( 8): Matrix.003 file - promoters50/1018523
taaaaatt

SEQ ID NO: 65492 - DNA, 10 bp, Unknown
  misc_feature (1)..( 10): Matrix.003 file - promoters50/1018523
agttaaaaaa

SEQ ID NO: 65493 - DNA, 10 bp, Unknown
  misc_feature (1)..( 10): Matrix.003 file - promoters50/1018523
tacaaaaaaa

SEQ ID NO: 65494 - DNA, 7 bp, Unknown
  misc_feature (1)..( 7): Matrix.003 file - promoters50/1018523
aaaaaat

SEQ ID NO: 65495 - DNA, 10 bp, Unknown
  misc_feature (1)..( 10): Matrix.003 file - promoters50/1018523
attaatatat

SEQ ID NO: 65496 - DNA, 15 bp, Unknown
  misc_feature (1)..( 15): Matrix.003 file - promoters50/1018523
taaaacaaatattga

SEQ ID NO: 65497 - DNA, 10 bp, Unknown
  misc_feature (1)..( 10): Matrix.003 file - promoters50/1018523
aataatatta

SEQ ID NO: 65498 - DNA, 11 bp, Unknown
  misc_feature (1)..( 11): Matrix.003 file - promoters50/1018523
ttacaaaaaaa

SEQ ID NO: 65499 - DNA, 10 bp, Unknown
  misc_feature (1)..( 10): Matrix.003 file - promoters50/1018523
aatgatatac

SEQ ID NO: 65500 - DNA, 8 bp, Unknown
  misc_feature (1)..( 8): Matrix.003 file - promoters50/1018523
tatatata

SEQ ID NO: 65501 - DNA, 14 bp, Unknown
  misc_feature (1)..( 14): Matrix.003 file - promoters50/1018529
atttatttaaaaat

SEQ ID NO: 65502 - DNA, 14 bp, Unknown
  misc_feature (1)..( 14): Matrix.003 file - promoters50/1018536
tatatttgttaaac

SEQ ID NO: 65503 - DNA, 11 bp, Unknown
  misc_feature (1)..( 11): Matrix.003 file - promoters50/1018536
atatttataat

SEQ ID NO: 65504 - DNA, 12 bp, Unknown
  misc_feature (1)..( 12): Matrix.003 file - promoters50/1018536
tatataaaaaaa

SEQ ID NO: 65505 - DNA, 11 bp, Unknown
  misc_feature (1)..( 11): Matrix.003 file - promoters50/1018536
attgatgaaga

SEQ ID NO: 65506 - DNA, 15 bp, Unknown
  misc_feature (1)..( 15): Matrix.003 file - promoters50/1018536
taaattttaaaaata

SEQ ID NO: 65507 - DNA, 9 bp, Unknown
  misc_feature (1)..( 9): Matrix.003 file - promoters50/1018536
ctaatgtaa

SEQ ID NO: 65508 - DNA, 12 bp, Unknown
  misc_feature (1)..( 12): Matrix.003 file - promoters50/1018536
ataaaaatatca

SEQ ID NO: 65509 - DNA, 12 bp, Unknown
  misc_feature (1)..( 12): Matrix.003 file - promoters50/1018536
aatataatttag

SEQ ID NO: 65510 - DNA, 12 bp, Unknown
  misc_feature (1)..( 12): Matrix.003 file - promoters50/1018691
gaaaaaggcaaa

SEQ ID NO: 65511 - DNA, 7 bp, Unknown
  misc_feature (1)..( 7): Matrix.003 file - promoters50/1018691
tacattt

SEQ ID NO: 65512 - DNA, 10 bp, Unknown
  misc_feature (1)..( 10): Matrix.003 file - promoters50/1018698
aatcgaaaag

SEQ ID NO: 65513 - DNA, 10 bp, Unknown
  misc_feature (1)..( 10): Matrix.003 file - promoters50/1018743
gtccttgtcg

SEQ ID NO: 65514 - DNA, 8 bp, Unknown
  misc_feature (1)..( 8): Matrix.003 file - promoters50/1018755
aactgctt

SEQ ID NO: 65515 - DNA, 11 bp, Unknown
  misc_feature (1)..( 11): Matrix.003 file - promoters50/1018755
tttttatttac

SEQ ID NO: 65516 - DNA, 15 bp, Unknown
  misc_feature (1)..( 15): Matrix.003 file - promoters50/1018770
gacataaattttttt

SEQ ID NO: 65517 - DNA, 15 bp, Unknown
  misc_feature (1)..( 15): Matrix.003 file - promoters50/1018770
ccaaaactttttgat

SEQ ID NO: 65518 - DNA, 11 bp, Unknown
  misc_feature (1)..( 11): Matrix.003 file - promoters50/1018783
tttataatatt

SEQ ID NO: 65519 - DNA, 9 bp, Unknown
  misc_feature (1)..( 9): Matrix.003 file - promoters50/1018783
aaaaataat

SEQ ID NO: 65520 - DNA, 16 bp, Unknown
  misc_feature (1)..( 16): Matrix.003 file - promoters50/1018783
actcaataatttaaat

SEQ ID NO: 65521 - DNA, 7 bp, Unknown
  misc_feature (1)..( 7): Matrix.003 file - promoters50/1018786
tattttt

SEQ ID NO: 65522 - DNA, 8 bp, Unknown
  misc_feature (1)..( 8): Matrix.003 file - promoters50/1018786
cttattat

SEQ ID NO: 65523 - DNA, 10 bp, Unknown
  misc_feature (1)..( 10): Matrix.003 file - promoters50/1018786
attggttggt

SEQ ID NO: 65524 - DNA, 9 bp, Unknown
  misc_feature (1)..( 9): Matrix.003 file - promoters50/1018835
gtttcaata

SEQ ID NO: 65525 - DNA, 8 bp, Unknown
  misc_feature (1)..( 8): Matrix.003 file - promoters50/1018835
gaaatgcg

SEQ ID NO: 65526 - DNA, 8 bp, Unknown
  misc_feature (1)..( 8): Matrix.003 file - promoters50/1018890
ttaatatt

SEQ ID NO: 65527 - DNA, 7 bp, Unknown
  misc_feature (1)..( 7): Matrix.003 file - promoters50/1018890
aaaaatg

SEQ ID NO: 65528 - DNA, 8 bp, Unknown
  misc_feature (1)..( 8): Matrix.003 file - promoters50/1018890
attattga

SEQ ID NO: 65529 - DNA, 7 bp, Unknown
  misc_feature (1)..( 7): Matrix.003 file - promoters50/1018890
aaaataa

SEQ ID NO: 65530 - DNA, 9 bp, Unknown
  misc_feature (1)..( 9): Matrix.003 file - promoters50/1018890
aaataaatt

SEQ ID NO: 65531 - DNA, 9 bp, Unknown
  misc_feature (1)..( 9): Matrix.003 file - promoters50/1018890
ctatatata

SEQ ID NO: 65532 - DNA, 8 bp, Unknown
  misc_feature (1)..( 8): Matrix.003 file - promoters50/1018890
aatttatt

SEQ ID NO: 65533 - DNA, 8 bp, Unknown
  misc_feature (1)..( 8): Matrix.003 file - promoters50/1018890
actagttc

SEQ ID NO: 65534 - DNA, 11 bp, Unknown
  misc_feature (1)..( 11): Matrix.003 file - promoters50/1018890
gcaattttatt

SEQ ID NO: 65535 - DNA, 13 bp, Unknown
  misc_feature (1)..( 13): Matrix.003 file - promoters50/1018890
ggtggaacatgaa

SEQ ID NO: 65536 - DNA, 8 bp, Unknown
  misc_feature (1)..( 8): Matrix.003 file - promoters50/1018890
gcatccaa

SEQ ID NO: 65537 - DNA, 7 bp, Unknown
  misc_feature (1)..( 7): Matrix.003 file - promoters50/1018890
atacata

SEQ ID NO: 65538 - DNA, 11 bp, Unknown
  misc_feature (1)..( 11): Matrix.003 file - promoters50/1018920
ctaatttcaca

SEQ ID NO: 65539 - DNA, 7 bp, Unknown
  misc_feature (1)..( 7): Matrix.003 file - promoters50/1018956
aaaagaa

SEQ ID NO: 65540 - DNA, 11 bp, Unknown
  misc_feature (1)..( 11): Matrix.003 file - promoters50/1018973
aataagttata

SEQ ID NO: 65541 - DNA, 11 bp, Unknown
  misc_feature (1)..( 11): Matrix.003 file - promoters50/1018973
ctataaataaa

SEQ ID NO: 65542 - DNA, 11 bp, Unknown
  misc_feature (1)..( 11): Matrix.003 file - promoters50/1018973
atatttttaaa

SEQ ID NO: 65543 - DNA, 10 bp, Unknown
  misc_feature (1)..( 10): Matrix.003 file - promoters50/1018973
aatttgttat

SEQ ID NO: 65544 - DNA, 10 bp, Unknown
  misc_feature (1)..( 10): Matrix.003 file - promoters50/1019024
atttatttat

SEQ ID NO: 65545 - DNA, 12 bp, Unknown
  misc_feature (1)..( 12): Matrix.003 file - promoters50/1019030
taaattttgaaa

SEQ ID NO: 65546 - DNA, 10 bp, Unknown
  misc_feature (1)..( 10): Matrix.003 file - promoters50/1019030
ttacaaaata

SEQ ID NO: 65547 - DNA, 11 bp, Unknown
  misc_feature (1)..( 11): Matrix.003 file - promoters50/1019030
tcaaagaaaaa

SEQ ID NO: 65548 - DNA, 7 bp, Unknown
  misc_feature (1)..( 7): Matrix.003 file - promoters50/1019030
attttag

SEQ ID NO: 65549 - DNA, 7 bp, Unknown
  misc_feature (1)..( 7): Matrix.003 file - promoters50/1019030
ataaaaa

SEQ ID NO: 65550 - DNA, 9 bp, Unknown
  misc_feature (1)..( 9): Matrix.003 file - promoters50/1019030
aaaacaaaa

SEQ ID NO: 65551 - DNA, 8 bp, Unknown
  misc_feature (1)..( 8): Matrix.003 file - promoters50/1019030
tattttag

SEQ ID NO: 65552 - DNA, 7 bp, Unknown
  misc_feature (1)..( 7): Matrix.003 file - promoters50/1019030
ataaaaa

SEQ ID NO: 65553 - DNA, 8 bp, Unknown
  misc_feature (1)..( 8): Matrix.003 file - promoters50/1019030
aaaacatg

SEQ ID NO: 65554 - DNA, 8 bp, Unknown
  misc_feature (1)..( 8): Matrix.003 file - promoters50/1019030
tattataa

SEQ ID NO: 65555 - DNA, 8 bp, Unknown
  misc_feature (1)..( 8): Matrix.003 file - promoters50/1019030
aattatag

SEQ ID NO: 65556 - DNA, 6 bp, Unknown
  misc_feature (1)..( 6): Matrix.003 file - promoters50/1019030
ataaaa

SEQ ID NO: 65557 - DNA, 7 bp, Unknown
  misc_feature (1)..( 7): Matrix.003 file - promoters50/1019030
tgtataa

SEQ ID NO: 65558 - DNA, 9 bp, Unknown
  misc_feature (1)..( 9): Matrix.003 file - promoters50/1019030
aaaataaaa

SEQ ID NO: 65559 - DNA, 11 bp, Unknown
  misc_feature (1)..( 11): Matrix.003 file - promoters50/1019048
cgatgatataa

SEQ ID NO: 65560 - DNA, 12 bp, Unknown
  misc_feature (1)..( 12): Matrix.003 file - promoters50/1019048
ttttaacgaaaa

SEQ ID NO: 65561 - DNA, 8 bp, Unknown
  misc_feature (1)..( 8): Matrix.003 file - promoters50/1019052
catatgtt

SEQ ID NO: 65562 - DNA, 7 bp, Unknown
  misc_feature (1)..( 7): Matrix.003 file - promoters50/1019052
ttataaa

SEQ ID NO: 65563 - DNA, 10 bp, Unknown
  misc_feature (1)..( 10): Matrix.003 file - promoters50/1019052
ttaacagaga

SEQ ID NO: 65564 - DNA, 9 bp, Unknown
  misc_feature (1)..( 9): Matrix.003 file - promoters50/1019067
aaaaaaatg

SEQ ID NO: 65565 - DNA, 10 bp, Unknown
  misc_feature (1)..( 10): Matrix.003 file - promoters50/1019067
tatatatata

SEQ ID NO: 65566 - DNA, 10 bp, Unknown
  misc_feature (1)..( 10): Matrix.003 file - promoters50/1019067
aatccaatta

SEQ ID NO: 65567 - DNA, 10 bp, Unknown
  misc_feature (1)..( 10): Matrix.003 file - promoters50/1019067
taaaagaaaa

SEQ ID NO: 65568 - DNA, 11 bp, Unknown
  misc_feature (1)..( 11): Matrix.003 file - promoters50/1019105
gctacgaaaat

SEQ ID NO: 65569 - DNA, 10 bp, Unknown
  misc_feature (1)..( 10): Matrix.003 file - promoters50/1019105
gcaacgaaaa

SEQ ID NO: 65570 - DNA, 8 bp, Unknown
  misc_feature (1)..( 8): Matrix.003 file - promoters50/1019111
ataagata

SEQ ID NO: 65571 - DNA, 7 bp, Unknown
  misc_feature (1)..( 7): Matrix.003 file - promoters50/1019111
gttttag

SEQ ID NO: 65572 - DNA, 11 bp, Unknown
  misc_feature (1)..( 11): Matrix.003 file - promoters50/1019111
ttatattttag

SEQ ID NO: 65573 - DNA, 8 bp, Unknown
  misc_feature (1)..( 8): Matrix.003 file - promoters50/1019111
attttttt

SEQ ID NO: 65574 - DNA, 15 bp, Unknown
  misc_feature (1)..( 15): Matrix.003 file - promoters50/1019111
ttttatttatttcaa

SEQ ID NO: 65575 - DNA, 7 bp, Unknown
  misc_feature (1)..( 7): Matrix.003 file - promoters50/1019253
tttcttc

SEQ ID NO: 65576 - DNA, 9 bp, Unknown
  misc_feature (1)..( 9): Matrix.003 file - promoters50/1019253
tattatttc

SEQ ID NO: 65577 - DNA, 11 bp, Unknown
  misc_feature (1)..( 11): Matrix.003 file - promoters50/1019253
attaaagaaaa

SEQ ID NO: 65578 - DNA, 9 bp, Unknown
  misc_feature (1)..( 9): Matrix.003 file - promoters50/1019253
tttttcttt

SEQ ID NO: 65579 - DNA, 11 bp, Unknown
  misc_feature (1)..( 11): Matrix.003 file - promoters50/1019253
attaaagaaaa

SEQ ID NO: 65580 - DNA, 12 bp, Unknown
  misc_feature (1)..( 12): Matrix.003 file - promoters50/1019257
agatttttaatt

SEQ ID NO: 65581 - DNA, 10 bp, Unknown
  misc_feature (1)..( 10): Matrix.003 file - promoters50/1019257
atttgactta

SEQ ID NO: 65582 - DNA, 15 bp, Unknown
  misc_feature (1)..( 15): Matrix.003 file - promoters50/1019257
aggattttgttatta

SEQ ID NO: 65583 - DNA, 8 bp, Unknown
  misc_feature (1)..( 8): Matrix.003 file - promoters50/1019260
aaaacctg

SEQ ID NO: 65584 - DNA, 10 bp, Unknown
  misc_feature (1)..( 10): Matrix.003 file - promoters50/1019260
gttatgcttt

SEQ ID NO: 65585 - DNA, 11 bp, Unknown
  misc_feature (1)..( 11): Matrix.003 file - promoters50/1019287
tatcaaaaaca

SEQ ID NO: 65586 - DNA, 12 bp, Unknown
  misc_feature (1)..( 12): Matrix.003 file - promoters50/1019287
gaaatattttta

SEQ ID NO: 65587 - DNA, 11 bp, Unknown
  misc_feature (1)..( 11): Matrix.003 file - promoters50/1019287
acaaaagataa

SEQ ID NO: 65588 - DNA, 12 bp, Unknown
  misc_feature (1)..( 12): Matrix.003 file - promoters50/1019494
aattaacttttt

SEQ ID NO: 65589 - DNA, 7 bp, Unknown
  misc_feature (1)..( 7): Matrix.003 file - promoters50/1019494
atatata

SEQ ID NO: 65590 - DNA, 10 bp, Unknown
  misc_feature (1)..( 10): Matrix.003 file - promoters50/1019498
gcggtaacta

SEQ ID NO: 65591 - DNA, 15 bp, Unknown
  misc_feature (1)..( 15): Matrix.003 file - promoters50/1019498
caaagtataataaac

SEQ ID NO: 65592 - DNA, 9 bp, Unknown
  misc_feature (1)..( 9): Matrix.003 file - promoters50/1019498
cttatttaa

SEQ ID NO: 65593 - DNA, 8 bp, Unknown
  misc_feature (1)..( 8): Matrix.003 file - promoters50/1019498
atatatgt

SEQ ID NO: 65594 - DNA, 10 bp, Unknown
  misc_feature (1)..( 10): Matrix.003 file - promoters50/1019498
aatcatgtat

SEQ ID NO: 65595 - DNA, 12 bp, Unknown
  misc_feature (1)..( 12): Matrix.003 file - promoters50/1019498
agtataataaac

SEQ ID NO: 65596 - DNA, 8 bp, Unknown
  misc_feature (1)..( 8): Matrix.003 file - promoters50/1019498
ctttttca

SEQ ID NO: 65597 - DNA, 9 bp, Unknown
  misc_feature (1)..( 9): Matrix.003 file - promoters50/1019524
gaatgtaga

SEQ ID NO: 65598 - DNA, 9 bp, Unknown
  misc_feature (1)..( 9): Matrix.003 file - promoters50/1019537
tgtattttt

SEQ ID NO: 65599 - DNA, 10 bp, Unknown
  misc_feature (1)..( 10): Matrix.003 file - promoters50/1019537
aatagataga

SEQ ID NO: 65600 - DNA, 8 bp, Unknown
  misc_feature (1)..( 8): Matrix.003 file - promoters50/1019537
tatataaa

SEQ ID NO: 65601 - DNA, 10 bp, Unknown
  misc_feature (1)..( 10): Matrix.003 file - promoters50/1019537
agtgaatgaa

SEQ ID NO: 65602 - DNA, 8 bp, Unknown
  misc_feature (1)..( 8): Matrix.003 file - promoters50/1019545
atatactc

SEQ ID NO: 65603 - DNA, 8 bp, Unknown
  misc_feature (1)..( 8): Matrix.003 file - promoters50/1019545
gaagcaga

SEQ ID NO: 65604 - DNA, 7 bp, Unknown
  misc_feature (1)..( 7): Matrix.003 file - promoters50/1019545
ttttatt

SEQ ID NO: 65605 - DNA, 10 bp, Unknown
  misc_feature (1)..( 10): Matrix.003 file - promoters50/1019545
atagtataga

SEQ ID NO: 65606 - DNA, 10 bp, Unknown
  misc_feature (1)..( 10): Matrix.003 file - promoters50/1019545
ataatataat

SEQ ID NO: 65607 - DNA, 10 bp, Unknown
  misc_feature (1)..( 10): Matrix.003 file - promoters50/1019559
taaagtaaag

SEQ ID NO: 65608 - DNA, 11 bp, Unknown
  misc_feature (1)..( 11): Matrix.003 file - promoters50/1019559
aaaagttgcag

SEQ ID NO: 65609 - DNA, 10 bp, Unknown
  misc_feature (1)..( 10): Matrix.003 file - promoters50/1019559
aattttgaaa

SEQ ID NO: 65610 - DNA, 11 bp, Unknown
  misc_feature (1)..( 11): Matrix.003 file - promoters50/1019559
ggagaaagaaa

SEQ ID NO: 65611 - DNA, 9 bp, Unknown
  misc_feature (1)..( 9): Matrix.003 file - promoters50/1019559
ttcttagct

SEQ ID NO: 65612 - DNA, 8 bp, Unknown
  misc_feature (1)..( 8): Matrix.003 file - promoters50/1019559
gaaagatt

SEQ ID NO: 65613 - DNA, 15 bp, Unknown
  misc_feature (1)..( 15): Matrix.003 file - promoters50/1019604
tctcaactatataaa

SEQ ID NO: 65614 - DNA, 13 bp, Unknown
  misc_feature (1)..( 13): Matrix.003 file - promoters50/1019604
tgtctaaaaataa

SEQ ID NO: 65615 - DNA, 9 bp, Unknown
  misc_feature (1)..( 9): Matrix.003 file - promoters50/1019604
acaagacat

SEQ ID NO: 65616 - DNA, 8 bp, Unknown
  misc_feature (1)..( 8): Matrix.003 file - promoters50/1019659
gttctatt

SEQ ID NO: 65617 - DNA, 8 bp, Unknown
  misc_feature (1)..( 8): Matrix.003 file - promoters50/1019659
tttatttt

SEQ ID NO: 65618 - DNA, 8 bp, Unknown
  misc_feature (1)..( 8): Matrix.003 file - promoters50/1019663
gttttgaa

SEQ ID NO: 65619 - DNA, 10 bp, Unknown
  misc_feature (1)..( 10): Matrix.003 file - promoters50/1019663
aacatacaac

SEQ ID NO: 65620 - DNA, 9 bp, Unknown
  misc_feature (1)..( 9): Matrix.003 file - promoters50/1019663
ttttgaaat

SEQ ID NO: 65621 - DNA, 7 bp, Unknown
  misc_feature (1)..( 7): Matrix.003 file - promoters50/1019663
ttttgaa

SEQ ID NO: 65622 - DNA, 7 bp, Unknown
  misc_feature (1)..( 7): Matrix.003 file - promoters50/1019663
cttatat

SEQ ID NO: 65623 - DNA, 8 bp, Unknown
  misc_feature (1)..( 8): Matrix.003 file - promoters50/1019695
atttgtta

SEQ ID NO: 65624 - DNA, 9 bp, Unknown
  misc_feature (1)..( 9): Matrix.003 file - promoters50/1019695
gttgatgga

SEQ ID NO: 65625 - DNA, 8 bp, Unknown
  misc_feature (1)..( 8): Matrix.003 file - promoters50/1019695
ttttcaac

SEQ ID NO: 65626 - DNA, 11 bp, Unknown
  misc_feature (1)..( 11): Matrix.003 file - promoters50/1019734
aaaataagttt

SEQ ID NO: 65627 - DNA, 10 bp, Unknown
  misc_feature (1)..( 10): Matrix.003 file - promoters50/1019746
gaattgattc

SEQ ID NO: 65628 - DNA, 10 bp, Unknown
  misc_feature (1)..( 10): Matrix.003 file - promoters50/1019746
taaggcccaa

SEQ ID NO: 65629 - DNA, 12 bp, Unknown
  misc_feature (1)..( 12): Matrix.003 file - promoters50/1019746
agtatgttatat

SEQ ID NO: 65630 - DNA, 7 bp, Unknown
  misc_feature (1)..( 7): Matrix.003 file - promoters50/1019764
tttgttt

SEQ ID NO: 65631 - DNA, 9 bp, Unknown
  misc_feature (1)..( 9): Matrix.003 file - promoters50/1019764
agatgtatt

SEQ ID NO: 65632 - DNA, 11 bp, Unknown
  misc_feature (1)..( 11): Matrix.003 file - promoters50/1019776
ataatttgttt

SEQ ID NO: 65633 - DNA, 9 bp, Unknown
  misc_feature (1)..( 9): Matrix.003 file - promoters50/1019776
gtatataaa

SEQ ID NO: 65634 - DNA, 9 bp, Unknown
  misc_feature (1)..( 9): Matrix.003 file - promoters50/1019776
aaagtaaag

SEQ ID NO: 65635 - DNA, 8 bp, Unknown
  misc_feature (1)..( 8): Matrix.003 file - promoters50/1019776
ttaattca

SEQ ID NO: 65636 - DNA, 10 bp, Unknown
  misc_feature (1)..( 10): Matrix.003 file - promoters50/1019907
ttttcactaa

SEQ ID NO: 65637 - DNA, 11 bp, Unknown
  misc_feature (1)..( 11): Matrix.003 file - promoters50/1019907
tcacaaactta

SEQ ID NO: 65638 - DNA, 8 bp, Unknown
  misc_feature (1)..( 8): Matrix.003 file - promoters50/1019907
atataatt

SEQ ID NO: 65639 - DNA, 7 bp, Unknown
  misc_feature (1)..( 7): Matrix.003 file - promoters50/1019915
aactaga

SEQ ID NO: 65640 - DNA, 8 bp, Unknown
  misc_feature (1)..( 8): Matrix.003 file - promoters50/1019915
tgtcaaat

SEQ ID NO: 65641 - DNA, 10 bp, Unknown
  misc_feature (1)..( 10): Matrix.003 file - promoters50/1019915
ttaagaaaaa

SEQ ID NO: 65642 - DNA, 8 bp, Unknown
  misc_feature (1)..( 8): Matrix.003 file - promoters50/1019915
ctaaaaac

SEQ ID NO: 65643 - DNA, 8 bp, Unknown
  misc_feature (1)..( 8): Matrix.003 file - promoters50/1019915
aaaataaa

SEQ ID NO: 65644 - DNA, 8 bp, Unknown
  misc_feature (1)..( 8): Matrix.003 file - promoters50/1019915
tttttagt

SEQ ID NO: 65645 - DNA, 12 bp, Unknown
  misc_feature (1)..( 12): Matrix.003 file - promoters50/1019915
ataaaaccatta

SEQ ID NO: 65646 - DNA, 10 bp, Unknown
  misc_feature (1)..( 10): Matrix.003 file - promoters50/1019915
ttatattgat

SEQ ID NO: 65647 - DNA, 16 bp, Unknown
  misc_feature (1)..( 16): Matrix.003 file - promoters50/1019928
ataactttataattat

SEQ ID NO: 65648 - DNA, 13 bp, Unknown
  misc_feature (1)..( 13): Matrix.003 file - promoters50/1019928
aaattatattgtt

SEQ ID NO: 65649 - DNA, 13 bp, Unknown
  misc_feature (1)..( 13): Matrix.003 file - promoters50/1019928
aattttaaaattt

SEQ ID NO: 65650 - DNA, 8 bp, Unknown
  misc_feature (1)..( 8): Matrix.003 file - promoters50/1019928
ctataaaa

SEQ ID NO: 65651 - DNA, 11 bp, Unknown
  misc_feature (1)..( 11): Matrix.003 file - promoters50/1019928
atataaataac

SEQ ID NO: 65652 - DNA, 9 bp, Unknown
  misc_feature (1)..( 9): Matrix.003 file - promoters50/1019928
agaaaattt

SEQ ID NO: 65653 - DNA, 10 bp, Unknown
  misc_feature (1)..( 10): Matrix.003 file - promoters50/1019979
ataaaatatg

SEQ ID NO: 65654 - DNA, 8 bp, Unknown
  misc_feature (1)..( 8): Matrix.003 file - promoters50/1020005
tctaaaac

SEQ ID NO: 65655 - DNA, 11 bp, Unknown
  misc_feature (1)..( 11): Matrix.003 file - promoters50/1020005
aagaaaaaagg

SEQ ID NO: 65656 - DNA, 7 bp, Unknown
  misc_feature (1)..( 7): Matrix.003 file - promoters50/1020019
agttttt

SEQ ID NO: 65657 - DNA, 9 bp, Unknown
  misc_feature (1)..( 9): Matrix.003 file - promoters50/1020019
tttttaatc

SEQ ID NO: 65658 - DNA, 9 bp, Unknown
  misc_feature (1)..( 9): Matrix.003 file - promoters50/1020019
atatatttt

SEQ ID NO: 65659 - DNA, 8 bp, Unknown
  misc_feature (1)..( 8): Matrix.003 file - promoters50/1020019
agacaaac

SEQ ID NO: 65660 - DNA, 8 bp, Unknown
  misc_feature (1)..( 8): Matrix.003 file - promoters50/1020019
gacattta

SEQ ID NO: 65661 - DNA, 9 bp, Unknown
  misc_feature (1)..( 9): Matrix.003 file - promoters50/1020019
ataatatat

SEQ ID NO: 65662 - DNA, 12 bp, Unknown
  misc_feature (1)..( 12): Matrix.003 file - promoters50/1020019
tattgacaaaat

SEQ ID NO: 65663 - DNA, 8 bp, Unknown
  misc_feature (1)..( 8): Matrix.003 file - promoters50/1020019
cattaaaa

SEQ ID NO: 65664 - DNA, 11 bp, Unknown
  misc_feature (1)..( 11): Matrix.003 file - promoters50/1020023
aattttatata

SEQ ID NO: 65665 - DNA, 12 bp, Unknown
  misc_feature (1)..( 12): Matrix.003 file - promoters50/1020023
tcctataaatat

SEQ ID NO: 65666 - DNA, 14 bp, Unknown
  misc_feature (1)..( 14): Matrix.003 file - promoters50/1020023
accataattaaatt

SEQ ID NO: 65667 - DNA, 12 bp, Unknown
  misc_feature (1)..( 12): Matrix.003 file - promoters50/1020023
gattttatgtat

SEQ ID NO: 65668 - DNA, 10 bp, Unknown
  misc_feature (1)..( 10): Matrix.003 file - promoters50/1020046
atcttaataa

SEQ ID NO: 65669 - DNA, 8 bp, Unknown
  misc_feature (1)..( 8): Matrix.003 file - promoters50/1020046
tttataaa

SEQ ID NO: 65670 - DNA, 9 bp, Unknown
  misc_feature (1)..( 9): Matrix.003 file - promoters50/1020046
aatttatat

SEQ ID NO: 65671 - DNA, 14 bp, Unknown
  misc_feature (1)..( 14): Matrix.003 file - promoters50/1020046
taataaaaaacaaa

SEQ ID NO: 65672 - DNA, 10 bp, Unknown
  misc_feature (1)..( 10): Matrix.003 file - promoters50/1020046
aaaaaattta

SEQ ID NO: 65673 - DNA, 10 bp, Unknown
  misc_feature (1)..( 10): Matrix.003 file - promoters50/1020046
tttataaaca

SEQ ID NO: 65674 - DNA, 13 bp, Unknown
  misc_feature (1)..( 13): Matrix.003 file - promoters50/1020046
tttcaaaattgag

SEQ ID NO: 65675 - DNA, 11 bp, Unknown
  misc_feature (1)..( 11): Matrix.003 file - promoters50/1020046
aacaaaatata

SEQ ID NO: 65676 - DNA, 12 bp, Unknown
  misc_feature (1)..( 12): Matrix.003 file - promoters50/1020046
aataaaaaataa

SEQ ID NO: 65677 - DNA, 8 bp, Unknown
  misc_feature (1)..( 8): Matrix.003 file - promoters50/1020145
atttgaat

SEQ ID NO: 65678 - DNA, 9 bp, Unknown
  misc_feature (1)..( 9): Matrix.003 file - promoters50/1020208
caataaatg

SEQ ID NO: 65679 - DNA, 12 bp, Unknown
  misc_feature (1)..( 12): Matrix.003 file - promoters50/1020208
actgatgaatgt

SEQ ID NO: 65680 - DNA, 9 bp, Unknown
  misc_feature (1)..( 9): Matrix.003 file - promoters50/1020223
tttgtagtg

SEQ ID NO: 65681 - DNA, 8 bp, Unknown
  misc_feature (1)..( 8): Matrix.003 file - promoters50/1020223
gatttgtt

SEQ ID NO: 65682 - DNA, 8 bp, Unknown
  misc_feature (1)..( 8): Matrix.003 file - promoters50/1020223
tgatttgt

SEQ ID NO: 65683 - DNA, 12 bp, Unknown
  misc_feature (1)..( 12): Matrix.003 file - promoters50/1020223
gatttgttcaat

SEQ ID NO: 65684 - DNA, 7 bp, Unknown
  misc_feature (1)..( 7): Matrix.003 file - promoters50/1020223
gtttgtt

SEQ ID NO: 65685 - DNA, 8 bp, Unknown
  misc_feature (1)..( 8): Matrix.003 file - promoters50/1020223
atcatatt

SEQ ID NO: 65686 - DNA, 8 bp, Unknown
  misc_feature (1)..( 8): Matrix.003 file - promoters50/1020265
atgactta

SEQ ID NO: 65687 - DNA, 7 bp, Unknown
  misc_feature (1)..( 7): Matrix.003 file - promoters50/1020265
attgtgt

SEQ ID NO: 65688 - DNA, 8 bp, Unknown
  misc_feature (1)..( 8): Matrix.003 file - promoters50/1020265
attattct

SEQ ID NO: 65689 - DNA, 8 bp, Unknown
  misc_feature (1)..( 8): Matrix.003 file - promoters50/1020265
tgaagaaa

SEQ ID NO: 65690 - DNA, 8 bp, Unknown
  misc_feature (1)..( 8): Matrix.003 file - promoters50/1020272
gcggcaac

SEQ ID NO: 65691 - DNA, 8 bp, Unknown
  misc_feature (1)..( 8): Matrix.003 file - promoters50/1020272
aaacgttt

SEQ ID NO: 65692 - DNA, 7 bp, Unknown
  misc_feature (1)..( 7): Matrix.003 file - promoters50/1020272
tttattt

SEQ ID NO: 65693 - DNA, 11 bp, Unknown
  misc_feature (1)..( 11): Matrix.003 file - promoters50/1020272
gcggtaactaa

SEQ ID NO: 65694 - DNA, 9 bp, Unknown
  misc_feature (1)..( 9): Matrix.003 file - promoters50/1020272
ttgagattg

SEQ ID NO: 65695 - DNA, 11 bp, Unknown
  misc_feature (1)..( 11): Matrix.003 file - promoters50/1020274
aaatttaaaaa

SEQ ID NO: 65696 - DNA, 11 bp, Unknown
  misc_feature (1)..( 11): Matrix.003 file - promoters50/1020274
aaagaataaaa

SEQ ID NO: 65697 - DNA, 15 bp, Unknown
  misc_feature (1)..( 15): Matrix.003 file - promoters50/1020274
tgaaaataacaacaa

SEQ ID NO: 65698 - DNA, 9 bp, Unknown
  misc_feature (1)..( 9): Matrix.003 file - promoters50/1020274
tattaatat

SEQ ID NO: 65699 - DNA, 16 bp, Unknown
  misc_feature (1)..( 16): Matrix.003 file - promoters50/1020274
aaagtaacaacaaata

SEQ ID NO: 65700 - DNA, 9 bp, Unknown
  misc_feature (1)..( 9): Matrix.003 file - promoters50/1020274
aatatttaa

SEQ ID NO: 65701 - DNA, 9 bp, Unknown
  misc_feature (1)..( 9): Matrix.003 file - promoters50/1020274
tatttaatt

SEQ ID NO: 65702 - DNA, 7 bp, Unknown
  misc_feature (1)..( 7): Matrix.003 file - promoters50/1020313
tgtttat

SEQ ID NO: 65703 - DNA, 11 bp, Unknown
  misc_feature (1)..( 11): Matrix.003 file - promoters50/1020313
ataacgtcatc

SEQ ID NO: 65704 - DNA, 11 bp, Unknown
  misc_feature (1)..( 11): Matrix.003 file - promoters50/1020362
ccccaaacaaa

SEQ ID NO: 65705 - DNA, 7 bp, Unknown
  misc_feature (1)..( 7): Matrix.003 file - promoters50/1020362
attgtgg

SEQ ID NO: 65706 - DNA, 7 bp, Unknown
  misc_feature (1)..( 7): Matrix.003 file - promoters50/1020362
atgtaag

SEQ ID NO: 65707 - DNA, 8 bp, Unknown
  misc_feature (1)..( 8): Matrix.003 file - promoters50/1020362
caaatctc

SEQ ID NO: 65708 - DNA, 12 bp, Unknown
  misc_feature (1)..( 12): Matrix.003 file - promoters50/1020364
tgataaataaat

SEQ ID NO: 65709 - DNA, 12 bp, Unknown
  misc_feature (1)..( 12): Matrix.003 file - promoters50/1020364
aactaaaaaatt

SEQ ID NO: 65710 - DNA, 9 bp, Unknown
  misc_feature (1)..( 9): Matrix.003 file - promoters50/1020430
tatatatac

SEQ ID NO: 65711 - DNA, 11 bp, Unknown
  misc_feature (1)..( 11): Matrix.003 file - promoters50/1020430
taaacaaatgg

SEQ ID NO: 65712 - DNA, 9 bp, Unknown
  misc_feature (1)..( 9): Matrix.003 file - promoters50/1020430
aaaacaaaa

SEQ ID NO: 65713 - DNA, 9 bp, Unknown
  misc_feature (1)..( 9): Matrix.003 file - promoters50/1020430
tcacaaatt

SEQ ID NO: 65714 - DNA, 10 bp, Unknown
  misc_feature (1)..( 10): Matrix.003 file - promoters50/1020508
acaacattaa

SEQ ID NO: 65715 - DNA, 10 bp, Unknown
  misc_feature (1)..( 10): Matrix.003 file - promoters50/1020512
atctaatata

SEQ ID NO: 65716 - DNA, 12 bp, Unknown
  misc_feature (1)..( 12): Matrix.003 file - promoters50/1020512
aaaataaaaaaa

SEQ ID NO: 65717 - DNA, 12 bp, Unknown
  misc_feature (1)..( 12): Matrix.003 file - promoters50/1020512
atataaaaaaaa

SEQ ID NO: 65718 - DNA, 6 bp, Unknown
  misc_feature (1)..( 6): Matrix.003 file - promoters50/1020535
gaaaat

SEQ ID NO: 65719 - DNA, 10 bp, Unknown
  misc_feature (1)..( 10): Matrix.003 file - promoters50/1020535
tgagaaaatt

SEQ ID NO: 65720 - DNA, 13 bp, Unknown
  misc_feature (1)..( 13): Matrix.003 file - promoters50/1020543
caaaaatgtaaat

SEQ ID NO: 65721 - DNA, 8 bp, Unknown
  misc_feature (1)..( 8): Matrix.003 file - promoters50/1020543
gaaaaaaa

SEQ ID NO: 65722 - DNA, 8 bp, Unknown
  misc_feature (1)..( 8): Matrix.003 file - promoters50/1020543
tttcatgt

SEQ ID NO: 65723 - DNA, 12 bp, Unknown
  misc_feature (1)..( 12): Matrix.003 file - promoters50/1020543
aaaaaagaagaa

SEQ ID NO: 65724 - DNA, 9 bp, Unknown
  misc_feature (1)..( 9): Matrix.003 file - promoters50/1020557
ttactacta

SEQ ID NO: 65725 - DNA, 11 bp, Unknown
  misc_feature (1)..( 11): Matrix.003 file - promoters50/1020596
tatggaaatta

SEQ ID NO: 65726 - DNA, 8 bp, Unknown
  misc_feature (1)..( 8): Matrix.003 file - promoters50/1020596
cataaata

SEQ ID NO: 65727 - DNA, 12 bp, Unknown
  misc_feature (1)..( 12): Matrix.003 file - promoters50/1020619
tttaaatacata

SEQ ID NO: 65728 - DNA, 8 bp, Unknown
  misc_feature (1)..( 8): Matrix.003 file - promoters50/1020619
atctattt

SEQ ID NO: 65729 - DNA, 9 bp, Unknown
  misc_feature (1)..( 9): Matrix.003 file - promoters50/1020634
ccaaaatca

SEQ ID NO: 65730 - DNA, 11 bp, Unknown
  misc_feature (1)..( 11): Matrix.003 file - promoters50/1020634
agtttaaaata

SEQ ID NO: 65731 - DNA, 11 bp, Unknown
  misc_feature (1)..( 11): Matrix.003 file - promoters50/1020646
aataatttata

SEQ ID NO: 65732 - DNA, 11 bp, Unknown
  misc_feature (1)..( 11): Matrix.003 file - promoters50/1020666
aaaataaatct

SEQ ID NO: 65733 - DNA, 7 bp, Unknown
  misc_feature (1)..( 7): Matrix.003 file - promoters50/1020666
caacaaa

SEQ ID NO: 65734 - DNA, 14 bp, Unknown
  misc_feature (1)..( 14): Matrix.003 file - promoters50/1020666
aactaatactttga

SEQ ID NO: 65735 - DNA, 7 bp, Unknown
  misc_feature (1)..( 7): Matrix.003 file - promoters50/1020666
tattaaa

SEQ ID NO: 65736 - DNA, 11 bp, Unknown
  misc_feature (1)..( 11): Matrix.003 file - promoters50/1020666
gatttactttt

SEQ ID NO: 65737 - DNA, 8 bp, Unknown
  misc_feature (1)..( 8): Matrix.003 file - promoters50/1020680
tttgagtg

SEQ ID NO: 65738 - DNA, 10 bp, Unknown
  misc_feature (1)..( 10): Matrix.003 file - promoters50/1020680
gttaaacaaa

SEQ ID NO: 65739 - DNA, 11 bp, Unknown
  misc_feature (1)..( 11): Matrix.003 file - promoters50/1020690
aattgatttta

SEQ ID NO: 65740 - DNA, 9 bp, Unknown
  misc_feature (1)..( 9): Matrix.003 file - promoters50/1020690
attgaatat

SEQ ID NO: 65741 - DNA, 8 bp, Unknown
  misc_feature (1)..( 8): Matrix.003 file - promoters50/1020697
aaattaaa

SEQ ID NO: 65742 - DNA, 17 bp, Unknown
  misc_feature (1)..( 17): Matrix.003 file - promoters50/1020697
attaattattaatgata

SEQ ID NO: 65743 - DNA, 7 bp, Unknown
  misc_feature (1)..( 7): Matrix.003 file - promoters50/1020697
agagcat

SEQ ID NO: 65744 - DNA, 8 bp, Unknown
  misc_feature (1)..( 8): Matrix.003 file - promoters50/1020697
ctaattag

SEQ ID NO: 65745 - DNA, 11 bp, Unknown
  misc_feature (1)..( 11): Matrix.003 file - promoters50/1020697
taattaaattt

SEQ ID NO: 65746 - DNA, 9 bp, Unknown
  misc_feature (1)..( 9): Matrix.003 file - promoters50/1020697
taaaaaaga

SEQ ID NO: 65747 - DNA, 7 bp, Unknown
  misc_feature (1)..( 7): Matrix.003 file - promoters50/1020697
tttaaat

SEQ ID NO: 65748 - DNA, 9 bp, Unknown
  misc_feature (1)..( 9): Matrix.003 file - promoters50/1020697
agagagaag

SEQ ID NO: 65749 - DNA, 12 bp, Unknown
  misc_feature (1)..( 12): Matrix.003 file - promoters50/1020701
ataaattaatgt

SEQ ID NO: 65750 - DNA, 8 bp, Unknown
  misc_feature (1)..( 8): Matrix.003 file - promoters50/1020701
taataatt

SEQ ID NO: 65751 - DNA, 7 bp, Unknown
  misc_feature (1)..( 7): Matrix.003 file - promoters50/1020713
taagtta

SEQ ID NO: 65752 - DNA, 5 bp, Unknown
  misc_feature (1)..( 5): Matrix.003 file - promoters50/1020713
agaaa

SEQ ID NO: 65753 - DNA, 7 bp, Unknown
  misc_feature (1)..( 7): Matrix.003 file - promoters50/1020713
gaaattt

SEQ ID NO: 65754 - DNA, 8 bp, Unknown
  misc_feature (1)..( 8): Matrix.003 file - promoters50/1020713
gttagtta

SEQ ID NO: 65755 - DNA, 8 bp, Unknown
  misc_feature (1)..( 8): Matrix.003 file - promoters50/1020713
ataagagg

SEQ ID NO: 65756 - DNA, 9 bp, Unknown
  misc_feature (1)..( 9): Matrix.003 file - promoters50/1020713
aggcccatt

SEQ ID NO: 65757 - DNA, 7 bp, Unknown
  misc_feature (1)..( 7): Matrix.003 file - promoters50/1020730
taattta

SEQ ID NO: 65758 - DNA, 11 bp, Unknown
  misc_feature (1)..( 11): Matrix.003 file - promoters50/1020730
attaatctctt

SEQ ID NO: 65759 - DNA, 10 bp, Unknown
  misc_feature (1)..( 10): Matrix.003 file - promoters50/1020730
aaaataattt

SEQ ID NO: 65760 - DNA, 11 bp, Unknown
  misc_feature (1)..( 11): Matrix.003 file - promoters50/1020730
ttgtctgaata

SEQ ID NO: 65761 - DNA, 8 bp, Unknown
  misc_feature (1)..( 8): Matrix.003 file - promoters50/1020730
gtagaaaa

SEQ ID NO: 65762 - DNA, 12 bp, Unknown
  misc_feature (1)..( 12): Matrix.003 file - promoters50/1020786
aaatttatgtcg

SEQ ID NO: 65763 - DNA, 12 bp, Unknown
  misc_feature (1)..( 12): Matrix.003 file - promoters50/1020786
ttaacaaattaa

SEQ ID NO: 65764 - DNA, 11 bp, Unknown
  misc_feature (1)..( 11): Matrix.003 file - promoters50/1020786
tctctatataa

SEQ ID NO: 65765 - DNA, 16 bp, Unknown
  misc_feature (1)..( 16): Matrix.003 file - promoters50/1020786
ttataatgcaaaaaat

SEQ ID NO: 65766 - DNA, 14 bp, Unknown
  misc_feature (1)..( 14): Matrix.003 file - promoters50/1020786
aacaacaaaacatg

SEQ ID NO: 65767 - DNA, 8 bp, Unknown
  misc_feature (1)..( 8): Matrix.003 file - promoters50/1020786
caaaaata

SEQ ID NO: 65768 - DNA, 9 bp, Unknown
  misc_feature (1)..( 9): Matrix.003 file - promoters50/1020786
caaaaataa

SEQ ID NO: 65769 - DNA, 8 bp, Unknown
  misc_feature (1)..( 8): Matrix.003 file - promoters50/1020786
agatataa

SEQ ID NO: 65770 - DNA, 13 bp, Unknown
  misc_feature (1)..( 13): Matrix.003 file - promoters50/1020818
ataatttttcctt

SEQ ID NO: 65771 - DNA, 9 bp, Unknown
  misc_feature (1)..( 9): Matrix.003 file - promoters50/1020818
caaaaattt

SEQ ID NO: 65772 - DNA, 10 bp, Unknown
  misc_feature (1)..( 10): Matrix.003 file - promoters50/1020818
taaaaaagaa

SEQ ID NO: 65773 - DNA, 9 bp, Unknown
  misc_feature (1)..( 9): Matrix.003 file - promoters50/1020818
gtcaaaaaa

SEQ ID NO: 65774 - DNA, 8 bp, Unknown
  misc_feature (1)..( 8): Matrix.003 file - promoters50/1020834
agaatacc

SEQ ID NO: 65775 - DNA, 7 bp, Unknown
  misc_feature (1)..( 7): Matrix.003 file - promoters50/1020838
gaaagaa

SEQ ID NO: 65776 - DNA, 8 bp, Unknown
  misc_feature (1)..( 8): Matrix.003 file - promoters50/1020838
cttttgaa

SEQ ID NO: 65777 - DNA, 8 bp, Unknown
  misc_feature (1)..( 8): Matrix.003 file - promoters50/1020838
atttttaa

SEQ ID NO: 65778 - DNA, 7 bp, Unknown
  misc_feature (1)..( 7): Matrix.003 file - promoters50/1020838
aataaaa

SEQ ID NO: 65779 - DNA, 8 bp, Unknown
  misc_feature (1)..( 8): Matrix.003 file - promoters50/1020842
taaaagga

SEQ ID NO: 65780 - DNA, 10 bp, Unknown
  misc_feature (1)..( 10): Matrix.003 file - promoters50/1020842
tcatcaattt

SEQ ID NO: 65781 - DNA, 8 bp, Unknown
  misc_feature (1)..( 8): Matrix.003 file - promoters50/1020842
taaaaatt

SEQ ID NO: 65782 - DNA, 8 bp, Unknown
  misc_feature (1)..( 8): Matrix.003 file - promoters50/1020842
aaaattct

SEQ ID NO: 65783 - DNA, 8 bp, Unknown
  misc_feature (1)..( 8): Matrix.003 file - promoters50/1020842
gaaacaaa

SEQ ID NO: 65784 - DNA, 8 bp, Unknown
  misc_feature (1)..( 8): Matrix.003 file - promoters50/1020848
aaatttgt

SEQ ID NO: 65785 - DNA, 8 bp, Unknown
  misc_feature (1)..( 8): Matrix.003 file - promoters50/1020848
ctacattt

SEQ ID NO: 65786 - DNA, 12 bp, Unknown
  misc_feature (1)..( 12): Matrix.003 file - promoters50/1020863
aaacaaatgtgt

SEQ ID NO: 65787 - DNA, 9 bp, Unknown
  misc_feature (1)..( 9): Matrix.003 file - promoters50/1020863
atattatta

SEQ ID NO: 65788 - DNA, 11 bp, Unknown
  misc_feature (1)..( 11): Matrix.003 file - promoters50/1020863
gattaaaagac

SEQ ID NO: 65789 - DNA, 10 bp, Unknown
  misc_feature (1)..( 10): Matrix.003 file - promoters50/1020863
gtacaatact

SEQ ID NO: 65790 - DNA, 6 bp, Unknown
  misc_feature (1)..( 6): Matrix.003 file - promoters50/1020863
aatgaa

SEQ ID NO: 65791 - DNA, 12 bp, Unknown
  misc_feature (1)..( 12): Matrix.003 file - promoters50/1020863
ttttatttctca

SEQ ID NO: 65792 - DNA, 14 bp, Unknown
  misc_feature (1)..( 14): Matrix.003 file - promoters50/1020892
cgaacaagtagaag

SEQ ID NO: 65793 - DNA, 14 bp, Unknown
  misc_feature (1)..( 14): Matrix.003 file - promoters50/1020892
aattactgaagaat

SEQ ID NO: 65794 - DNA, 9 bp, Unknown
  misc_feature (1)..( 9): Matrix.003 file - promoters50/1020940
aaaaattaa

SEQ ID NO: 65795 - DNA, 10 bp, Unknown
  misc_feature (1)..( 10): Matrix.003 file - promoters50/1020940
tatataatag

SEQ ID NO: 65796 - DNA, 9 bp, Unknown
  misc_feature (1)..( 9): Matrix.003 file - promoters50/1020940
aaataaaat

SEQ ID NO: 65797 - DNA, 8 bp, Unknown
  misc_feature (1)..( 8): Matrix.003 file - promoters50/1020940
acaaaaat

SEQ ID NO: 65798 - DNA, 12 bp, Unknown
  misc_feature (1)..( 12): Matrix.003 file - promoters50/1020940
taagaatttttt

SEQ ID NO: 65799 - DNA, 12 bp, Unknown
  misc_feature (1)..( 12): Matrix.003 file - promoters50/1020940
ataatttcttat

SEQ ID NO: 65800 - DNA, 9 bp, Unknown
  misc_feature (1)..( 9): Matrix.003 file - promoters50/1020940
aacaatctc

SEQ ID NO: 65801 - DNA, 13 bp, Unknown
  misc_feature (1)..( 13): Matrix.003 file - promoters50/1020940
tgattgtcagtaa

SEQ ID NO: 65802 - DNA, 6 bp, Unknown
  misc_feature (1)..( 6): Matrix.003 file - promoters50/1020940
gatttt

SEQ ID NO: 65803 - DNA, 10 bp, Unknown
  misc_feature (1)..( 10): Matrix.003 file - promoters50/1020940
atttttacat

SEQ ID NO: 65804 - DNA, 9 bp, Unknown
  misc_feature (1)..( 9): Matrix.003 file - promoters50/1020940
agttttgat

SEQ ID NO: 65805 - DNA, 12 bp, Unknown
  misc_feature (1)..( 12): Matrix.003 file - promoters50/1020968
gtaatttaaaat

SEQ ID NO: 65806 - DNA, 15 bp, Unknown
  misc_feature (1)..( 15): Matrix.003 file - promoters50/1020968
catattaaactttta

SEQ ID NO: 65807 - DNA, 11 bp, Unknown
  misc_feature (1)..( 11): Matrix.003 file - promoters50/1020968
attataaatta

SEQ ID NO: 65808 - DNA, 9 bp, Unknown
  misc_feature (1)..( 9): Matrix.003 file - promoters50/1020968
gaaaataaa

SEQ ID NO: 65809 - DNA, 10 bp, Unknown
  misc_feature (1)..( 10): Matrix.003 file - promoters50/1020968
tttaaaatat

SEQ ID NO: 65810 - DNA, 8 bp, Unknown
  misc_feature (1)..( 8): Matrix.003 file - promoters50/1021047
tatgattt

SEQ ID NO: 65811 - DNA, 11 bp, Unknown
  misc_feature (1)..( 11): Matrix.003 file - promoters50/1021047
ataagtagttt

SEQ ID NO: 65812 - DNA, 12 bp, Unknown
  misc_feature (1)..( 12): Matrix.003 file - promoters50/1021047
caagaatataaa

SEQ ID NO: 65813 - DNA, 12 bp, Unknown
  misc_feature (1)..( 12): Matrix.003 file - promoters50/1021047
aagtatataaat

SEQ ID NO: 65814 - DNA, 8 bp, Unknown
  misc_feature (1)..( 8): Matrix.003 file - promoters50/1021079
agataaaa

SEQ ID NO: 65815 - DNA, 12 bp, Unknown
  misc_feature (1)..( 12): Matrix.003 file - promoters50/1021079
attttgatacaa

SEQ ID NO: 65816 - DNA, 11 bp, Unknown
  misc_feature (1)..( 11): Matrix.003 file - promoters50/1021104
tgttctaaatt

SEQ ID NO: 65817 - DNA, 9 bp, Unknown
  misc_feature (1)..( 9): Matrix.003 file - promoters50/1021136
ataaaaata

SEQ ID NO: 65818 - DNA, 7 bp, Unknown
  misc_feature (1)..( 7): Matrix.003 file - promoters50/1021136
gtttgtt

SEQ ID NO: 65819 - DNA, 8 bp, Unknown
  misc_feature (1)..( 8): Matrix.003 file - promoters50/1021136
aaagaaaa

SEQ ID NO: 65820 - DNA, 11 bp, Unknown
  misc_feature (1)..( 11): Matrix.003 file - promoters50/1021136
tctttgaattt

SEQ ID NO: 65821 - DNA, 8 bp, Unknown
  misc_feature (1)..( 8): Matrix.003 file - promoters50/1021136
aaaaaata

SEQ ID NO: 65822 - DNA, 7 bp, Unknown
  misc_feature (1)..( 7): Matrix.003 file - promoters50/1021148
ataataa

SEQ ID NO: 65823 - DNA, 11 bp, Unknown
  misc_feature (1)..( 11): Matrix.003 file - promoters50/1021148
acatttgtaaa

SEQ ID NO: 65824 - DNA, 11 bp, Unknown
  misc_feature (1)..( 11): Matrix.003 file - promoters50/1021148
caaaaaaattt

SEQ ID NO: 65825 - DNA, 9 bp, Unknown
  misc_feature (1)..( 9): Matrix.003 file - promoters50/1021148
agaaaaaaa

SEQ ID NO: 65826 - DNA, 8 bp, Unknown
  misc_feature (1)..( 8): Matrix.003 file - promoters50/1021148
attttaca

SEQ ID NO: 65827 - DNA, 8 bp, Unknown
  misc_feature (1)..( 8): Matrix.003 file - promoters50/1021148
aaaaataa

SEQ ID NO: 65828 - DNA, 9 bp, Unknown
  misc_feature (1)..( 9): Matrix.003 file - promoters50/1021148
ttttattta

SEQ ID NO: 65829 - DNA, 15 bp, Unknown
  misc_feature (1)..( 15): Matrix.003 file - promoters50/1021148
ataatttttatcaac

SEQ ID NO: 65830 - DNA, 13 bp, Unknown
  misc_feature (1)..( 13): Matrix.003 file - promoters50/1021218
agtgaaaacataa

SEQ ID NO: 65831 - DNA, 16 bp, Unknown
  misc_feature (1)..( 16): Matrix.003 file - promoters50/1021218
aaaacaacgccatcat

SEQ ID NO: 65832 - DNA, 10 bp, Unknown
  misc_feature (1)..( 10): Matrix.003 file - promoters50/1021239
caaaaacaaa

SEQ ID NO: 65833 - DNA, 8 bp, Unknown
  misc_feature (1)..( 8): Matrix.003 file - promoters50/1021239
ttcaatga

SEQ ID NO: 65834 - DNA, 7 bp, Unknown
  misc_feature (1)..( 7): Matrix.003 file - promoters50/1021239
cacttaa

SEQ ID NO: 65835 - DNA, 11 bp, Unknown
  misc_feature (1)..( 11): Matrix.003 file - promoters50/1021242
aaaaaatgtga

SEQ ID NO: 65836 - DNA, 11 bp, Unknown
  misc_feature (1)..( 11): Matrix.003 file - promoters50/1021323
tagaaaaataa

SEQ ID NO: 65837 - DNA, 10 bp, Unknown
  misc_feature (1)..( 10): Matrix.003 file - promoters50/1021323
cgaaaaaaag

SEQ ID NO: 65838 - DNA, 10 bp, Unknown
  misc_feature (1)..( 10): Matrix.003 file - promoters50/1021323
atgatttggt

SEQ ID NO: 65839 - DNA, 9 bp, Unknown
  misc_feature (1)..( 9): Matrix.003 file - promoters50/1021334
atagaaaag

SEQ ID NO: 65840 - DNA, 11 bp, Unknown
  misc_feature (1)..( 11): Matrix.003 file - promoters50/1021334
tattttttgtt

SEQ ID NO: 65841 - DNA, 7 bp, Unknown
  misc_feature (1)..( 7): Matrix.003 file - promoters50/1021334
aaaatga

SEQ ID NO: 65842 - DNA, 8 bp, Unknown
  misc_feature (1)..( 8): Matrix.003 file - promoters50/1021334
aagaaatg

SEQ ID NO: 65843 - DNA, 7 bp, Unknown
  misc_feature (1)..( 7): Matrix.003 file - promoters50/1021334
tgtggac

SEQ ID NO: 65844 - DNA, 11 bp, Unknown
  misc_feature (1)..( 11): Matrix.003 file - promoters50/1021334
aattttgtgtt

SEQ ID NO: 65845 - DNA, 9 bp, Unknown
  misc_feature (1)..( 9): Matrix.003 file - promoters50/1021419
attaaatgc

SEQ ID NO: 65846 - DNA, 10 bp, Unknown
  misc_feature (1)..( 10): Matrix.003 file - promoters50/1021438
ttttgtttgt

SEQ ID NO: 65847 - DNA, 13 bp, Unknown
  misc_feature (1)..( 13): Matrix.003 file - promoters50/1021445
agtattaaagttt

SEQ ID NO: 65848 - DNA, 11 bp, Unknown
  misc_feature (1)..( 11): Matrix.003 file - promoters50/1021445
acttaaaaaag

SEQ ID NO: 65849 - DNA, 10 bp, Unknown
  misc_feature (1)..( 10): Matrix.003 file - promoters50/1021445
aaaagaaatt

SEQ ID NO: 65850 - DNA, 9 bp, Unknown
  misc_feature (1)..( 9): Matrix.003 file - promoters50/1021445
aaaacaaat

SEQ ID NO: 65851 - DNA, 12 bp, Unknown
  misc_feature (1)..( 12): Matrix.003 file - promoters50/1021445
atataaaagctt

SEQ ID NO: 65852 - DNA, 11 bp, Unknown
  misc_feature (1)..( 11): Matrix.003 file - promoters50/1021445
cactaaaaaag

SEQ ID NO: 65853 - DNA, 9 bp, Unknown
  misc_feature (1)..( 9): Matrix.003 file - promoters50/1021549
gattcattc

SEQ ID NO: 65854 - DNA, 12 bp, Unknown
  misc_feature (1)..( 12): Matrix.003 file - promoters50/1021549
aaagcccaatag

SEQ ID NO: 65855 - DNA, 8 bp, Unknown
  misc_feature (1)..( 8): Matrix.003 file - promoters50/1021645
cttccatg

SEQ ID NO: 65856 - DNA, 9 bp, Unknown
  misc_feature (1)..( 9): Matrix.003 file - promoters50/1021645
tttgcaatt

SEQ ID NO: 65857 - DNA, 7 bp, Unknown
  misc_feature (1)..( 7): Matrix.003 file - promoters50/1021719
atttatt

SEQ ID NO: 65858 - DNA, 9 bp, Unknown
  misc_feature (1)..( 9): Matrix.003 file - promoters50/1021772
aaatctata

SEQ ID NO: 65859 - DNA, 10 bp, Unknown
  misc_feature (1)..( 10): Matrix.003 file - promoters50/1021772
tatataaaaa

SEQ ID NO: 65860 - DNA, 10 bp, Unknown
  misc_feature (1)..( 10): Matrix.003 file - promoters50/1021772
caataaaagt

SEQ ID NO: 65861 - DNA, 14 bp, Unknown
  misc_feature (1)..( 14): Matrix.003 file - promoters50/1021833
agatcttttgatta

SEQ ID NO: 65862 - DNA, 10 bp, Unknown
  misc_feature (1)..( 10): Matrix.003 file - promoters50/1021833
gtttgattta

SEQ ID NO: 65863 - DNA, 10 bp, Unknown
  misc_feature (1)..( 10): Matrix.003 file - promoters50/1021840
aaataataaa

SEQ ID NO: 65864 - DNA, 9 bp, Unknown
  misc_feature (1)..( 9): Matrix.003 file - promoters50/1021840
tatttattt

SEQ ID NO: 65865 - DNA, 13 bp, Unknown
  misc_feature (1)..( 13): Matrix.003 file - promoters50/1021840
acaaaaattataa

SEQ ID NO: 65866 - DNA, 7 bp, Unknown
  misc_feature (1)..( 7): Matrix.003 file - promoters50/1021862
tattgta

SEQ ID NO: 65867 - DNA, 14 bp, Unknown
  misc_feature (1)..( 14): Matrix.003 file - promoters50/1021862
catttaaattttaa

SEQ ID NO: 65868 - DNA, 10 bp, Unknown
  misc_feature (1)..( 10): Matrix.003 file - promoters50/1021862
ataattttaa

SEQ ID NO: 65869 - DNA, 8 bp, Unknown
  misc_feature (1)..( 8): Matrix.003 file - promoters50/1021862
aaataaat

SEQ ID NO: 65870 - DNA, 9 bp, Unknown
  misc_feature (1)..( 9): Matrix.003 file - promoters50/1021862
gtaaaatgt

SEQ ID NO: 65871 - DNA, 10 bp, Unknown
  misc_feature (1)..( 10): Matrix.003 file - promoters50/1021862
gacaaaataa

SEQ ID NO: 65872 - DNA, 10 bp, Unknown
  misc_feature (1)..( 10): Matrix.003 file - promoters50/1021870
aatcaaaatt

SEQ ID NO: 65873 - DNA, 9 bp, Unknown
  misc_feature (1)..( 9): Matrix.003 file - promoters50/1021870
acataatta

SEQ ID NO: 65874 - DNA, 12 bp, Unknown
  misc_feature (1)..( 12): Matrix.003 file - promoters50/1021870
caattttattat

SEQ ID NO: 65875 - DNA, 10 bp, Unknown
  misc_feature (1)..( 10): Matrix.003 file - promoters50/1021870
tttaaatata

SEQ ID NO: 65876 - DNA, 10 bp, Unknown
  misc_feature (1)..( 10): Matrix.003 file - promoters50/1021870
ttaacaaaca

SEQ ID NO: 65877 - DNA, 9 bp, Unknown
  misc_feature (1)..( 9): Matrix.003 file - promoters50/1021870
aatttaaat

SEQ ID NO: 65878 - DNA, 6 bp, Unknown
  misc_feature (1)..( 6): Matrix.003 file - promoters50/1021935
ttttgt

SEQ ID NO: 65879 - DNA, 9 bp, Unknown
  misc_feature (1)..( 9): Matrix.003 file - promoters50/1021935
gtgttcaga

SEQ ID NO: 65880 - DNA, 12 bp, Unknown
  misc_feature (1)..( 12): Matrix.003 file - promoters50/1021968
tcaataatttta

SEQ ID NO: 65881 - DNA, 7 bp, Unknown
  misc_feature (1)..( 7): Matrix.003 file - promoters50/1021968
tagtttt

SEQ ID NO: 65882 - DNA, 8 bp, Unknown
  misc_feature (1)..( 8): Matrix.003 file - promoters50/1021968
aaaaaaaa

SEQ ID NO: 65883 - DNA, 11 bp, Unknown
  misc_feature (1)..( 11): Matrix.003 file - promoters50/1021968
atgtttacaaa

SEQ ID NO: 65884 - DNA, 9 bp, Unknown
  misc_feature (1)..( 9): Matrix.003 file - promoters50/1021976
gtagagaag

SEQ ID NO: 65885 - DNA, 12 bp, Unknown
  misc_feature (1)..( 12): Matrix.003 file - promoters50/1022005
taaatcaaatct

SEQ ID NO: 65886 - DNA, 11 bp, Unknown
  misc_feature (1)..( 11): Matrix.003 file - promoters50/1022005
aataaaaactc

SEQ ID NO: 65887 - DNA, 10 bp, Unknown
  misc_feature (1)..( 10): Matrix.003 file - promoters50/1022014
cttctttatt

SEQ ID NO: 65888 - DNA, 7 bp, Unknown
  misc_feature (1)..( 7): Matrix.003 file - promoters50/1022014
tttgaaa

SEQ ID NO: 65889 - DNA, 8 bp, Unknown
  misc_feature (1)..( 8): Matrix.003 file - promoters50/1022014
gtcaaaat

SEQ ID NO: 65890 - DNA, 11 bp, Unknown
  misc_feature (1)..( 11): Matrix.003 file - promoters50/1022059
gattaggtcat

SEQ ID NO: 65891 - DNA, 9 bp, Unknown
  misc_feature (1)..( 9): Matrix.003 file - promoters50/1022088
ctaattgtt

SEQ ID NO: 65892 - DNA, 8 bp, Unknown
  misc_feature (1)..( 8): Matrix.003 file - promoters50/1022088
caaaaaag

SEQ ID NO: 65893 - DNA, 11 bp, Unknown
  misc_feature (1)..( 11): Matrix.003 file - promoters50/1022088
ttatgatttga

SEQ ID NO: 65894 - DNA, 9 bp, Unknown
  misc_feature (1)..( 9): Matrix.003 file - promoters50/1022088
aaaaaattg

SEQ ID NO: 65895 - DNA, 9 bp, Unknown
  misc_feature (1)..( 9): Matrix.003 file - promoters50/1022088
aaattgaat

SEQ ID NO: 65896 - DNA, 11 bp, Unknown
  misc_feature (1)..( 11): Matrix.003 file - promoters50/1022088
tacaaaataaa

SEQ ID NO: 65897 - DNA, 8 bp, Unknown
  misc_feature (1)..( 8): Matrix.003 file - promoters50/1022111
ttatttaa

SEQ ID NO: 65898 - DNA, 8 bp, Unknown
  misc_feature (1)..( 8): Matrix.003 file - promoters50/1022127
caaacgat

SEQ ID NO: 65899 - DNA, 8 bp, Unknown
  misc_feature (1)..( 8): Matrix.003 file - promoters50/1022127
caaagaaa

SEQ ID NO: 65900 - DNA, 12 bp, Unknown
  misc_feature (1)..( 12): Matrix.003 file - promoters50/1022131
atttaaaacaaa

SEQ ID NO: 65901 - DNA, 9 bp, Unknown
  misc_feature (1)..( 9): Matrix.003 file - promoters50/1022131
ttaaaaaaa

SEQ ID NO: 65902 - DNA, 9 bp, Unknown
  misc_feature (1)..( 9): Matrix.003 file - promoters50/1022182
tgctaaatt

SEQ ID NO: 65903 - DNA, 9 bp, Unknown
  misc_feature (1)..( 9): Matrix.003 file - promoters50/1022182
tggctgttt

SEQ ID NO: 65904 - DNA, 10 bp, Unknown
  misc_feature (1)..( 10): Matrix.003 file - promoters50/1022182
aatttaattc

SEQ ID NO: 65905 - DNA, 10 bp, Unknown
  misc_feature (1)..( 10): Matrix.003 file - promoters50/1022182
tagttttctg

SEQ ID NO: 65906 - DNA, 8 bp, Unknown
  misc_feature (1)..( 8): Matrix.003 file - promoters50/1022182
ggaatctg

SEQ ID NO: 65907 - DNA, 8 bp, Unknown
  misc_feature (1)..( 8): Matrix.003 file - promoters50/1022192
ttgtttag

SEQ ID NO: 65908 - DNA, 8 bp, Unknown
  misc_feature (1)..( 8): Matrix.003 file - promoters50/1022192
tcatagtt

SEQ ID NO: 65909 - DNA, 10 bp, Unknown
  misc_feature (1)..( 10): Matrix.003 file - promoters50/1022192
cttatgaaat

SEQ ID NO: 65910 - DNA, 13 bp, Unknown
  misc_feature (1)..( 13): Matrix.003 file - promoters50/1022192
ggacttatgaaat

SEQ ID NO: 65911 - DNA, 10 bp, Unknown
  misc_feature (1)..( 10): Matrix.003 file - promoters50/1022192
actttttaaa

SEQ ID NO: 65912 - DNA, 11 bp, Unknown
  misc_feature (1)..( 11): Matrix.003 file - promoters50/1022192
tttcttactaa

SEQ ID NO: 65913 - DNA, 10 bp, Unknown
  misc_feature (1)..( 10): Matrix.003 file - promoters50/1022192
cttttgaaat

SEQ ID NO: 65914 - DNA, 11 bp, Unknown
  misc_feature (1)..( 11): Matrix.003 file - promoters50/1022227
tttgcagtttc

SEQ ID NO: 65915 - DNA, 12 bp, Unknown
  misc_feature (1)..( 12): Matrix.003 file - promoters50/1022242
agcatatatgta

SEQ ID NO: 65916 - DNA, 6 bp, Unknown
  misc_feature (1)..( 6): Matrix.003 file - promoters50/1022242
acataa

SEQ ID NO: 65917 - DNA, 11 bp, Unknown
  misc_feature (1)..( 11): Matrix.003 file - promoters50/1022242
tctaaagcatt

SEQ ID NO: 65918 - DNA, 8 bp, Unknown
  misc_feature (1)..( 8): Matrix.003 file - promoters50/1022252
taaaaatt

SEQ ID NO: 65919 - DNA, 8 bp, Unknown
  misc_feature (1)..( 8): Matrix.003 file - promoters50/1022252
aaaaaatt

SEQ ID NO: 65920 - DNA, 7 bp, Unknown
  misc_feature (1)..( 7): Matrix.003 file - promoters50/1022252
aaaatta

SEQ ID NO: 65921 - DNA, 11 bp, Unknown
  misc_feature (1)..( 11): Matrix.003 file - promoters50/1022256
aaatattaaat

SEQ ID NO: 65922 - DNA, 10 bp, Unknown
  misc_feature (1)..( 10): Matrix.003 file - promoters50/1022256
agataatgag

SEQ ID NO: 65923 - DNA, 8 bp, Unknown
  misc_feature (1)..( 8): Matrix.003 file - promoters50/1022256
ttttatca

SEQ ID NO: 65924 - DNA, 9 bp, Unknown
  misc_feature (1)..( 9): Matrix.003 file - promoters50/1022256
tatataaat

SEQ ID NO: 65925 - DNA, 7 bp, Unknown
  misc_feature (1)..( 7): Matrix.003 file - promoters50/1022256
aaaagaa

SEQ ID NO: 65926 - DNA, 7 bp, Unknown
  misc_feature (1)..( 7): Matrix.003 file - promoters50/1022256
aaaacta

SEQ ID NO: 65927 - DNA, 10 bp, Unknown
  misc_feature (1)..( 10): Matrix.003 file - promoters50/1022264
aaagatttat

SEQ ID NO: 65928 - DNA, 9 bp, Unknown
  misc_feature (1)..( 9): Matrix.003 file - promoters50/1022264
gctcatttt

SEQ ID NO: 65929 - DNA, 15 bp, Unknown
  misc_feature (1)..( 15): Matrix.003 file - promoters50/1022264
attttttgttatcaa

SEQ ID NO: 65930 - DNA, 9 bp, Unknown
  misc_feature (1)..( 9): Matrix.003 file - promoters50/1022264
tttgttaat

SEQ ID NO: 65931 - DNA, 7 bp, Unknown
  misc_feature (1)..( 7): Matrix.003 file - promoters50/1022264
taaaatt

SEQ ID NO: 65932 - DNA, 10 bp, Unknown
  misc_feature (1)..( 10): Matrix.003 file - promoters50/1022264
aaagttttat

SEQ ID NO: 65933 - DNA, 9 bp, Unknown
  misc_feature (1)..( 9): Matrix.003 file - promoters50/1022268
ctccgccga

SEQ ID NO: 65934 - DNA, 12 bp, Unknown
  misc_feature (1)..( 12): Matrix.003 file - promoters50/1022292
aatgaataaaaa

SEQ ID NO: 65935 - DNA, 11 bp, Unknown
  misc_feature (1)..( 11): Matrix.003 file - promoters50/1022292
aaaaacaaaaa

SEQ ID NO: 65936 - DNA, 7 bp, Unknown
  misc_feature (1)..( 7): Matrix.003 file - promoters50/1022292
aaataaa

SEQ ID NO: 65937 - DNA, 9 bp, Unknown
  misc_feature (1)..( 9): Matrix.003 file - promoters50/1022292
aaaagaata

SEQ ID NO: 65938 - DNA, 8 bp, Unknown
  misc_feature (1)..( 8): Matrix.003 file - promoters50/1022296
aatttatt

SEQ ID NO: 65939 - DNA, 11 bp, Unknown
  misc_feature (1)..( 11): Matrix.003 file - promoters50/1022370
caactatatat

SEQ ID NO: 65940 - DNA, 8 bp, Unknown
  misc_feature (1)..( 8): Matrix.003 file - promoters50/1022383
attgccat

SEQ ID NO: 65941 - DNA, 9 bp, Unknown
  misc_feature (1)..( 9): Matrix.003 file - promoters50/1022383
caaaatgaa

SEQ ID NO: 65942 - DNA, 7 bp, Unknown
  misc_feature (1)..( 7): Matrix.003 file - promoters50/1022383
agatctc

SEQ ID NO: 65943 - DNA, 8 bp, Unknown
  misc_feature (1)..( 8): Matrix.003 file - promoters50/1022383
ctttttgc

SEQ ID NO: 65944 - DNA, 9 bp, Unknown
  misc_feature (1)..( 9): Matrix.003 file - promoters50/1022383
atttccatg

SEQ ID NO: 65945 - DNA, 11 bp, Unknown
  misc_feature (1)..( 11): Matrix.003 file - promoters50/1022389
gcttcaatttt

SEQ ID NO: 65946 - DNA, 8 bp, Unknown
  misc_feature (1)..( 8): Matrix.003 file - promoters50/1022389
aaatatta

SEQ ID NO: 65947 - DNA, 8 bp, Unknown
  misc_feature (1)..( 8): Matrix.003 file - promoters50/1022401
taaaaata

SEQ ID NO: 65948 - DNA, 8 bp, Unknown
  misc_feature (1)..( 8): Matrix.003 file - promoters50/1022401
ataaaaaa

SEQ ID NO: 65949 - DNA, 9 bp, Unknown
  misc_feature (1)..( 9): Matrix.003 file - promoters50/1022401
aaatataaa

SEQ ID NO: 65950 - DNA, 10 bp, Unknown
  misc_feature (1)..( 10): Matrix.003 file - promoters50/1022401
ttatttaata

SEQ ID NO: 65951 - DNA, 11 bp, Unknown
  misc_feature (1)..( 11): Matrix.003 file - promoters50/1022401
tcatttttaat

SEQ ID NO: 65952 - DNA, 11 bp, Unknown
  misc_feature (1)..( 11): Matrix.003 file - promoters50/1022401
ttataaaaagt

SEQ ID NO: 65953 - DNA, 11 bp, Unknown
  misc_feature (1)..( 11): Matrix.003 file - promoters50/1022401
tatcaaagaat

SEQ ID NO: 65954 - DNA, 9 bp, Unknown
  misc_feature (1)..( 9): Matrix.003 file - promoters50/1022434
agattatcg

SEQ ID NO: 65955 - DNA, 12 bp, Unknown
  misc_feature (1)..( 12): Matrix.003 file - promoters50/1022441
aattgattattt

SEQ ID NO: 65956 - DNA, 7 bp, Unknown
  misc_feature (1)..( 7): Matrix.003 file - promoters50/1022527
tgtgaag

SEQ ID NO: 65957 - DNA, 7 bp, Unknown
  misc_feature (1)..( 7): Matrix.003 file - promoters50/1022527
tatgaaa

SEQ ID NO: 65958 - DNA, 11 bp, Unknown
  misc_feature (1)..( 11): Matrix.003 file - promoters50/1022527
aataaaataaa

SEQ ID NO: 65959 - DNA, 8 bp, Unknown
  misc_feature (1)..( 8): Matrix.003 file - promoters50/1022527
ataaaact

SEQ ID NO: 65960 - DNA, 10 bp, Unknown
  misc_feature (1)..( 10): Matrix.003 file - promoters50/1022527
aatgtctaat

SEQ ID NO: 65961 - DNA, 11 bp, Unknown
  misc_feature (1)..( 11): Matrix.003 file - promoters50/1022546
aagatttaatt

SEQ ID NO: 65962 - DNA, 8 bp, Unknown
  misc_feature (1)..( 8): Matrix.003 file - promoters50/1022546
caaccaat

SEQ ID NO: 65963 - DNA, 13 bp, Unknown
  misc_feature (1)..( 13): Matrix.003 file - promoters50/1022546
gttaatctcaaaa

SEQ ID NO: 65964 - DNA, 8 bp, Unknown
  misc_feature (1)..( 8): Matrix.003 file - promoters50/1022546
tttccgtg

SEQ ID NO: 65965 - DNA, 7 bp, Unknown
  misc_feature (1)..( 7): Matrix.003 file - promoters50/1022546
taaaaaa

SEQ ID NO: 65966 - DNA, 9 bp, Unknown
  misc_feature (1)..( 9): Matrix.003 file - promoters50/1022546
ttctcttta

SEQ ID NO: 65967 - DNA, 9 bp, Unknown
  misc_feature (1)..( 9): Matrix.003 file - promoters50/1022561
caaaaaaga

SEQ ID NO: 65968 - DNA, 9 bp, Unknown
  misc_feature (1)..( 9): Matrix.003 file - promoters50/1022561
caaaaaaga

SEQ ID NO: 65969 - DNA, 8 bp, Unknown
  misc_feature (1)..( 8): Matrix.003 file - promoters50/1022578
aaggaaaa

SEQ ID NO: 65970 - DNA, 9 bp, Unknown
  misc_feature (1)..( 9): Matrix.003 file - promoters50/1022586
aaacatttc

SEQ ID NO: 65971 - DNA, 8 bp, Unknown
  misc_feature (1)..( 8): Matrix.003 file - promoters50/1022586
tataaata

SEQ ID NO: 65972 - DNA, 7 bp, Unknown
  misc_feature (1)..( 7): Matrix.003 file - promoters50/1022586
tttaata

SEQ ID NO: 65973 - DNA, 7 bp, Unknown
  misc_feature (1)..( 7): Matrix.003 file - promoters50/1022586
aaaattc

SEQ ID NO: 65974 - DNA, 7 bp, Unknown
  misc_feature (1)..( 7): Matrix.003 file - promoters50/1022586
tttgtag

SEQ ID NO: 65975 - DNA, 9 bp, Unknown
  misc_feature (1)..( 9): Matrix.003 file - promoters50/1022586
accaaaaaa

SEQ ID NO: 65976 - DNA, 7 bp, Unknown
  misc_feature (1)..( 7): Matrix.003 file - promoters50/1022594
aaaacta

SEQ ID NO: 65977 - DNA, 9 bp, Unknown
  misc_feature (1)..( 9): Matrix.003 file - promoters50/1022594
actaaataa

SEQ ID NO: 65978 - DNA, 9 bp, Unknown
  misc_feature (1)..( 9): Matrix.003 file - promoters50/1022594
aatagaaaa

SEQ ID NO: 65979 - DNA, 14 bp, Unknown
  misc_feature (1)..( 14): Matrix.003 file - promoters50/1022610
aaaaatgtaaataa

SEQ ID NO: 65980 - DNA, 10 bp, Unknown
  misc_feature (1)..( 10): Matrix.003 file - promoters50/1022662
aatattttat

SEQ ID NO: 65981 - DNA, 11 bp, Unknown
  misc_feature (1)..( 11): Matrix.003 file - promoters50/1022687
atttattttga

SEQ ID NO: 65982 - DNA, 20 bp, Unknown
  misc_feature (1)..( 20): Matrix.003 file - promoters50/1022687
agagattttaatttgaatag

SEQ ID NO: 65983 - DNA, 9 bp, Unknown
  misc_feature (1)..( 9): Matrix.003 file - promoters50/1022687
atttttatt

SEQ ID NO: 65984 - DNA, 9 bp, Unknown
  misc_feature (1)..( 9): Matrix.003 file - promoters50/1022687
tttgagttc

SEQ ID NO: 65985 - DNA, 13 bp, Unknown
  misc_feature (1)..( 13): Matrix.003 file - promoters50/1022687
tattccttttgta

SEQ ID NO: 65986 - DNA, 8 bp, Unknown
  misc_feature (1)..( 8): Matrix.003 file - promoters50/1022687
atttgaat

SEQ ID NO: 65987 - DNA, 8 bp, Unknown
  misc_feature (1)..( 8): Matrix.003 file - promoters50/1022728
agtaaaga

SEQ ID NO: 65988 - DNA, 8 bp, Unknown
  misc_feature (1)..( 8): Matrix.003 file - promoters50/1022728
gatttttt

SEQ ID NO: 65989 - DNA, 7 bp, Unknown
  misc_feature (1)..( 7): Matrix.003 file - promoters50/1022728
aaaaact

SEQ ID NO: 65990 - DNA, 7 bp, Unknown
  misc_feature (1)..( 7): Matrix.003 file - promoters50/1022728
agaaaga

SEQ ID NO: 65991 - DNA, 11 bp, Unknown
  misc_feature (1)..( 11): Matrix.003 file - promoters50/1022728
caattataata

SEQ ID NO: 65992 - DNA, 9 bp, Unknown
  misc_feature (1)..( 9): Matrix.003 file - promoters50/1022728
aagaaaata

SEQ ID NO: 65993 - DNA, 7 bp, Unknown
  misc_feature (1)..( 7): Matrix.003 file - promoters50/1022742
cgttttt

SEQ ID NO: 65994 - DNA, 8 bp, Unknown
  misc_feature (1)..( 8): Matrix.003 file - promoters50/1022742
ttttgaat

SEQ ID NO: 65995 - DNA, 9 bp, Unknown
  misc_feature (1)..( 9): Matrix.003 file - promoters50/1022742
aaaaaagaa

SEQ ID NO: 65996 - DNA, 9 bp, Unknown
  misc_feature (1)..( 9): Matrix.003 file - promoters50/1022748
aaaagtttt

SEQ ID NO: 65997 - DNA, 13 bp, Unknown
  misc_feature (1)..( 13): Matrix.003 file - promoters50/1022748
tattaaaaaaggg

SEQ ID NO: 65998 - DNA, 13 bp, Unknown
  misc_feature (1)..( 13): Matrix.003 file - promoters50/1022748
atagttaaaaaat

SEQ ID NO: 65999 - DNA, 9 bp, Unknown
  misc_feature (1)..( 9): Matrix.003 file - promoters50/1022748
ataaataaa

SEQ ID NO: 66000 - DNA, 10 bp, Unknown
  misc_feature (1)..( 10): Matrix.003 file - promoters50/1022785
gcaaaagaag

SEQ ID NO: 66001 - DNA, 7 bp, Unknown
  misc_feature (1)..( 7): Matrix.003 file - promoters50/1022785
gtaagag

SEQ ID NO: 66002 - DNA, 14 bp, Unknown
  misc_feature (1)..( 14): Matrix.003 file - promoters50/1022785
ttgataaaaccaaa

SEQ ID NO: 66003 - DNA, 11 bp, Unknown
  misc_feature (1)..( 11): Matrix.003 file - promoters50/1022793
caattaggttt

SEQ ID NO: 66004 - DNA, 11 bp, Unknown
  misc_feature (1)..( 11): Matrix.003 file - promoters50/1022814
tataaataata

SEQ ID NO: 66005 - DNA, 9 bp, Unknown
  misc_feature (1)..( 9): Matrix.003 file - promoters50/1022814
ataaaaata

SEQ ID NO: 66006 - DNA, 10 bp, Unknown
  misc_feature (1)..( 10): Matrix.003 file - promoters50/1022824
ataaactaaa

SEQ ID NO: 66007 - DNA, 12 bp, Unknown
  misc_feature (1)..( 12): Matrix.003 file - promoters50/1022824
cccttttaagtt

SEQ ID NO: 66008 - DNA, 9 bp, Unknown
  misc_feature (1)..( 9): Matrix.003 file - promoters50/1022824
aaactaaat

SEQ ID NO: 66009 - DNA, 9 bp, Unknown
  misc_feature (1)..( 9): Matrix.003 file - promoters50/1022932
cttaatttc

SEQ ID NO: 66010 - DNA, 9 bp, Unknown
  misc_feature (1)..( 9): Matrix.003 file - promoters50/1022979
taacatttt

SEQ ID NO: 66011 - DNA, 9 bp, Unknown
  misc_feature (1)..( 9): Matrix.003 file - promoters50/1022979
tttttctct

SEQ ID NO: 66012 - DNA, 9 bp, Unknown
  misc_feature (1)..( 9): Matrix.003 file - promoters50/1022983
atttattat

SEQ ID NO: 66013 - DNA, 6 bp, Unknown
  misc_feature (1)..( 6): Matrix.003 file - promoters50/1022987
agtctt

SEQ ID NO: 66014 - DNA, 7 bp, Unknown
  misc_feature (1)..( 7): Matrix.003 file - promoters50/1023029
cgtatat

SEQ ID NO: 66015 - DNA, 9 bp, Unknown
  misc_feature (1)..( 9): Matrix.003 file - promoters50/1023029
ataggttac

SEQ ID NO: 66016 - DNA, 9 bp, Unknown
  misc_feature (1)..( 9): Matrix.003 file - promoters50/1023029
gatatttta

SEQ ID NO: 66017 - DNA, 11 bp, Unknown
  misc_feature (1)..( 11): Matrix.003 file - promoters50/1023029
aagtatatgaa

SEQ ID NO: 66018 - DNA, 9 bp, Unknown
  misc_feature (1)..( 9): Matrix.003 file - promoters50/1023029
caatataaa

SEQ ID NO: 66019 - DNA, 10 bp, Unknown
  misc_feature (1)..( 10): Matrix.003 file - promoters50/1023029
tttactcaat

SEQ ID NO: 66020 - DNA, 8 bp, Unknown
  misc_feature (1)..( 8): Matrix.003 file - promoters50/1023029
aagcatat

SEQ ID NO: 66021 - DNA, 8 bp, Unknown
  misc_feature (1)..( 8): Matrix.003 file - promoters50/1023029
tttatatt

SEQ ID NO: 66022 - DNA, 9 bp, Unknown
  misc_feature (1)..( 9): Matrix.003 file - promoters50/1023037
gggtatata

SEQ ID NO: 66023 - DNA, 11 bp, Unknown
  misc_feature (1)..( 11): Matrix.003 file - promoters50/1023037
acagtttataa

SEQ ID NO: 66024 - DNA, 9 bp, Unknown
  misc_feature (1)..( 9): Matrix.003 file - promoters50/1023037
aaattcact

SEQ ID NO: 66025 - DNA, 11 bp, Unknown
  misc_feature (1)..( 11): Matrix.003 file - promoters50/1023062
ctaaaaaaatc

SEQ ID NO: 66026 - DNA, 10 bp, Unknown
  misc_feature (1)..( 10): Matrix.003 file - promoters50/1023062
ttttcttatc

SEQ ID NO: 66027 - DNA, 8 bp, Unknown
  misc_feature (1)..( 8): Matrix.003 file - promoters50/1023079
tttgtttg

SEQ ID NO: 66028 - DNA, 13 bp, Unknown
  misc_feature (1)..( 13): Matrix.003 file - promoters50/1023079
gatttaattcaat

SEQ ID NO: 66029 - DNA, 11 bp, Unknown
  misc_feature (1)..( 11): Matrix.003 file - promoters50/1023089
atacaaaaatt

SEQ ID NO: 66030 - DNA, 11 bp, Unknown
  misc_feature (1)..( 11): Matrix.003 file - promoters50/1023089
gattaatactt

SEQ ID NO: 66031 - DNA, 10 bp, Unknown
  misc_feature (1)..( 10): Matrix.003 file - promoters50/1023089
ataaattctt

SEQ ID NO: 66032 - DNA, 12 bp, Unknown
  misc_feature (1)..( 12): Matrix.003 file - promoters50/1023089
ataaatttgata

SEQ ID NO: 66033 - DNA, 9 bp, Unknown
  misc_feature (1)..( 9): Matrix.003 file - promoters50/1023089
ataaaaaat

SEQ ID NO: 66034 - DNA, 16 bp, Unknown
  misc_feature (1)..( 16): Matrix.003 file - promoters50/1023124
attttcaaaaaaaaaa

SEQ ID NO: 66035 - DNA, 9 bp, Unknown
  misc_feature (1)..( 9): Matrix.003 file - promoters50/1023128
tatataaaa

SEQ ID NO: 66036 - DNA, 7 bp, Unknown
  misc_feature (1)..( 7): Matrix.003 file - promoters50/1023143
tattatg

SEQ ID NO: 66037 - DNA, 7 bp, Unknown
  misc_feature (1)..( 7): Matrix.003 file - promoters50/1023155
attcaaa

SEQ ID NO: 66038 - DNA, 10 bp, Unknown
  misc_feature (1)..( 10): Matrix.003 file - promoters50/1023155
tttctccata

SEQ ID NO: 66039 - DNA, 9 bp, Unknown
  misc_feature (1)..( 9): Matrix.003 file - promoters50/1023185
aatgaactt

SEQ ID NO: 66040 - DNA, 8 bp, Unknown
  misc_feature (1)..( 8): Matrix.003 file - promoters50/1023185
acacattt

SEQ ID NO: 66041 - DNA, 8 bp, Unknown
  misc_feature (1)..( 8): Matrix.003 file - promoters50/1023210
ttcttgcc

SEQ ID NO: 66042 - DNA, 10 bp, Unknown
  misc_feature (1)..( 10): Matrix.003 file - promoters50/1023210
tacgtgtcaa

SEQ ID NO: 66043 - DNA, 20 bp, Unknown
  misc_feature (1)..( 20): Matrix.003 file - promoters50/1023210
ttggctattgcttcaccgcc

SEQ ID NO: 66044 - DNA, 15 bp, Unknown
  misc_feature (1)..( 15): Matrix.003 file - promoters50/1023210
cgccttagctttctc

SEQ ID NO: 66045 - DNA, 22 bp, Unknown
  misc_feature (1)..( 22): Matrix.003 file - promoters50/1023210
gaccgagtcgtcctcgtctttt

SEQ ID NO: 66046 - DNA, 9 bp, Unknown
  misc_feature (1)..( 9): Matrix.003 file - promoters50/1023210
caaaaaaac

SEQ ID NO: 66047 - DNA, 6 bp, Unknown
  misc_feature (1)..( 6): Matrix.003 file - promoters50/1023210
aaaaca

SEQ ID NO: 66048 - DNA, 18 bp, Unknown
  misc_feature (1)..( 18): Matrix.003 file - promoters50/1023210
ttcttcttctataaatca

SEQ ID NO: 66049 - DNA, 10 bp, Unknown
  misc_feature (1)..( 10): Matrix.003 file - promoters50/1023221
acaagtagaa

SEQ ID NO: 66050 - DNA, 12 bp, Unknown
  misc_feature (1)..( 12): Matrix.003 file - promoters50/1023237
ttttggttcttt

SEQ ID NO: 66051 - DNA, 13 bp, Unknown
  misc_feature (1)..( 13): Matrix.003 file - promoters50/1023237
gagaaaattggtt

SEQ ID NO: 66052 - DNA, 14 bp, Unknown
  misc_feature (1)..( 14): Matrix.003 file - promoters50/1023237
aaatggttttgatt

SEQ ID NO: 66053 - DNA, 7 bp, Unknown
  misc_feature (1)..( 7): Matrix.003 file - promoters50/1023237
tttttaa

SEQ ID NO: 66054 - DNA, 8 bp, Unknown
  misc_feature (1)..( 8): Matrix.003 file - promoters50/1023270
cagttttg

SEQ ID NO: 66055 - DNA, 8 bp, Unknown
  misc_feature (1)..( 8): Matrix.003 file - promoters50/1023270
atataatt

SEQ ID NO: 66056 - DNA, 9 bp, Unknown
  misc_feature (1)..( 9): Matrix.003 file - promoters50/1023270
tttgaactc

SEQ ID NO: 66057 - DNA, 8 bp, Unknown
  misc_feature (1)..( 8): Matrix.003 file - promoters50/1023297
ttttctct

SEQ ID NO: 66058 - DNA, 10 bp, Unknown
  misc_feature (1)..( 10): Matrix.003 file - promoters50/1023299
ctataaacac

SEQ ID NO: 66059 - DNA, 8 bp, Unknown
  misc_feature (1)..( 8): Matrix.003 file - promoters50/1023324
atttaaaa

SEQ ID NO: 66060 - DNA, 7 bp, Unknown
  misc_feature (1)..( 7): Matrix.003 file - promoters50/1023324
ataaatt

SEQ ID NO: 66061 - DNA, 10 bp, Unknown
  misc_feature (1)..( 10): Matrix.003 file - promoters50/1023339
aaagaacatg

SEQ ID NO: 66062 - DNA, 14 bp, Unknown
  misc_feature (1)..( 14): Matrix.003 file - promoters50/1023397
ttcttttttgtttt

SEQ ID NO: 66063 - DNA, 8 bp, Unknown
  misc_feature (1)..( 8): Matrix.003 file - promoters50/1023397
taaattat

SEQ ID NO: 66064 - DNA, 12 bp, Unknown
  misc_feature (1)..( 12): Matrix.003 file - promoters50/1023397
cttttttttggt

SEQ ID NO: 66065 - DNA, 10 bp, Unknown
  misc_feature (1)..( 10): Matrix.003 file - promoters50/1023407
ataatacaca

SEQ ID NO: 66066 - DNA, 9 bp, Unknown
  misc_feature (1)..( 9): Matrix.003 file - promoters50/1023407
aggtttctc

SEQ ID NO: 66067 - DNA, 8 bp, Unknown
  misc_feature (1)..( 8): Matrix.003 file - promoters50/1023426
tcagaatt

SEQ ID NO: 66068 - DNA, 8 bp, Unknown
  misc_feature (1)..( 8): Matrix.003 file - promoters50/1023426
atttaatt

SEQ ID NO: 66069 - DNA, 12 bp, Unknown
  misc_feature (1)..( 12): Matrix.003 file - promoters50/1023432
acagcatttttg

SEQ ID NO: 66070 - DNA, 10 bp, Unknown
  misc_feature (1)..( 10): Matrix.003 file - promoters50/1023432
aaatttaatt

SEQ ID NO: 66071 - DNA, 11 bp, Unknown
  misc_feature (1)..( 11): Matrix.003 file - promoters50/1023432
aacgaaaaata

SEQ ID NO: 66072 - DNA, 12 bp, Unknown
  misc_feature (1)..( 12): Matrix.003 file - promoters50/1023453
agaaaagaaaaa

SEQ ID NO: 66073 - DNA, 10 bp, Unknown
  misc_feature (1)..( 10): Matrix.003 file - promoters50/1023453
gtttcaatct

SEQ ID NO: 66074 - DNA, 9 bp, Unknown
  misc_feature (1)..( 9): Matrix.003 file - promoters50/1023453
caaatgtta

SEQ ID NO: 66075 - DNA, 9 bp, Unknown
  misc_feature (1)..( 9): Matrix.003 file - promoters50/1023579
taatatcat

SEQ ID NO: 66076 - DNA, 10 bp, Unknown
  misc_feature (1)..( 10): Matrix.003 file - promoters50/1023579
aaataatcat

SEQ ID NO: 66077 - DNA, 9 bp, Unknown
  misc_feature (1)..( 9): Matrix.003 file - promoters50/1023583
gtttttata

SEQ ID NO: 66078 - DNA, 9 bp, Unknown
  misc_feature (1)..( 9): Matrix.003 file - promoters50/1023583
atcgtcttc

SEQ ID NO: 66079 - DNA, 10 bp, Unknown
  misc_feature (1)..( 10): Matrix.003 file - promoters50/1023583
acaaaagaaa

SEQ ID NO: 66080 - DNA, 11 bp, Unknown
  misc_feature (1)..( 11): Matrix.003 file - promoters50/1023583
agagtttataa

SEQ ID NO: 66081 - DNA, 9 bp, Unknown
  misc_feature (1)..( 9): Matrix.003 file - promoters50/1023594
agaaaaatt

SEQ ID NO: 66082 - DNA, 10 bp, Unknown
  misc_feature (1)..( 10): Matrix.003 file - promoters50/1023594
ttaaagaaat

SEQ ID NO: 66083 - DNA, 9 bp, Unknown
  misc_feature (1)..( 9): Matrix.003 file - promoters50/1023594
ccaaaaaca

SEQ ID NO: 66084 - DNA, 10 bp, Unknown
  misc_feature (1)..( 10): Matrix.003 file - promoters50/1023594
taattattat

SEQ ID NO: 66085 - DNA, 11 bp, Unknown
  misc_feature (1)..( 11): Matrix.003 file - promoters50/1023594
tcaactaatca

SEQ ID NO: 66086 - DNA, 12 bp, Unknown
  misc_feature (1)..( 12): Matrix.003 file - promoters50/1023594
tttgaattttaa

SEQ ID NO: 66087 - DNA, 9 bp, Unknown
  misc_feature (1)..( 9): Matrix.003 file - promoters50/1023594
ttaaacaat

SEQ ID NO: 66088 - DNA, 12 bp, Unknown
  misc_feature (1)..( 12): Matrix.003 file - promoters50/1023594
aaacaatagaaa

SEQ ID NO: 66089 - DNA, 9 bp, Unknown
  misc_feature (1)..( 9): Matrix.003 file - promoters50/1023594
caaaacaaa

SEQ ID NO: 66090 - DNA, 10 bp, Unknown
  misc_feature (1)..( 10): Matrix.003 file - promoters50/1023594
atgataaaat

SEQ ID NO: 66091 - DNA, 9 bp, Unknown
  misc_feature (1)..( 9): Matrix.003 file - promoters50/1023594
tattattaa

SEQ ID NO: 66092 - DNA, 14 bp, Unknown
  misc_feature (1)..( 14): Matrix.003 file - promoters50/1023619
aatgaaaaagttaa

SEQ ID NO: 66093 - DNA, 8 bp, Unknown
  misc_feature (1)..( 8): Matrix.003 file - promoters50/1023619
aattgatt

SEQ ID NO: 66094 - DNA, 12 bp, Unknown
  misc_feature (1)..( 12): Matrix.003 file - promoters50/1023619
gttgaatctgac

SEQ ID NO: 66095 - DNA, 11 bp, Unknown
  misc_feature (1)..( 11): Matrix.003 file - promoters50/1023634
aaaaattgtga

SEQ ID NO: 66096 - DNA, 16 bp, Unknown
  misc_feature (1)..( 16): Matrix.003 file - promoters50/1023634
tatttaaaaaaaaata

SEQ ID NO: 66097 - DNA, 8 bp, Unknown
  misc_feature (1)..( 8): Matrix.003 file - promoters50/1023681
aaatgaaa

SEQ ID NO: 66098 - DNA, 9 bp, Unknown
  misc_feature (1)..( 9): Matrix.003 file - promoters50/1023698
aagcaaaaa

SEQ ID NO: 66099 - DNA, 8 bp, Unknown
  misc_feature (1)..( 8): Matrix.003 file - promoters50/1023698
ctttattt

SEQ ID NO: 66100 - DNA, 10 bp, Unknown
  misc_feature (1)..( 10): Matrix.003 file - promoters50/1023698
taaaaaataa

SEQ ID NO: 66101 - DNA, 10 bp, Unknown
  misc_feature (1)..( 10): Matrix.003 file - promoters50/1023698
acattattgt

SEQ ID NO: 66102 - DNA, 7 bp, Unknown
  misc_feature (1)..( 7): Matrix.003 file - promoters50/1023747
ataaatc

SEQ ID NO: 66103 - DNA, 7 bp, Unknown
  misc_feature (1)..( 7): Matrix.003 file - promoters50/1023747
aattata

SEQ ID NO: 66104 - DNA, 8 bp, Unknown
  misc_feature (1)..( 8): Matrix.003 file - promoters50/1023747
aaatcatt

SEQ ID NO: 66105 - DNA, 10 bp, Unknown
  misc_feature (1)..( 10): Matrix.003 file - promoters50/1023782
agaaaagaaa

SEQ ID NO: 66106 - DNA, 7 bp, Unknown
  misc_feature (1)..( 7): Matrix.003 file - promoters50/1023782
agtttgg

SEQ ID NO: 66107 - DNA, 7 bp, Unknown
  misc_feature (1)..( 7): Matrix.003 file - promoters50/1023786
ctaattt

SEQ ID NO: 66108 - DNA, 18 bp, Unknown
  misc_feature (1)..( 18): Matrix.003 file - promoters50/1023851
aaaccatagttttgacat

SEQ ID NO: 66109 - DNA, 21 bp, Unknown
  misc_feature (1)..( 21): Matrix.003 file - promoters50/1023851
aaaaaccaaaaataccgtaat

SEQ ID NO: 66110 - DNA, 8 bp, Unknown
  misc_feature (1)..( 8): Matrix.003 file - promoters50/1023851
caaaacaa

SEQ ID NO: 66111 - DNA, 10 bp, Unknown
  misc_feature (1)..( 10): Matrix.003 file - promoters50/1023891
cattgaatta

SEQ ID NO: 66112 - DNA, 13 bp, Unknown
  misc_feature (1)..( 13): Matrix.003 file - promoters50/1023891
aaaattttaaaga

SEQ ID NO: 66113 - DNA, 13 bp, Unknown
  misc_feature (1)..( 13): Matrix.003 file - promoters50/1023963
agaacacataaaa

SEQ ID NO: 66114 - DNA, 6 bp, Unknown
  misc_feature (1)..( 6): Matrix.003 file - promoters50/1023963
acatta

SEQ ID NO: 66115 - DNA, 8 bp, Unknown
  misc_feature (1)..( 8): Matrix.003 file - promoters50/1024003
ttttatct

SEQ ID NO: 66116 - DNA, 7 bp, Unknown
  misc_feature (1)..( 7): Matrix.003 file - promoters50/1024015
tacatac

SEQ ID NO: 66117 - DNA, 10 bp, Unknown
  misc_feature (1)..( 10): Matrix.003 file - promoters50/1024045
aatttgagac

SEQ ID NO: 66118 - DNA, 9 bp, Unknown
  misc_feature (1)..( 9): Matrix.003 file - promoters50/1024045
aaatttggg

SEQ ID NO: 66119 - DNA, 8 bp, Unknown
  misc_feature (1)..( 8): Matrix.003 file - promoters50/1024045
aagaaata

SEQ ID NO: 66120 - DNA, 7 bp, Unknown
  misc_feature (1)..( 7): Matrix.003 file - promoters50/1024045
aattaat

SEQ ID NO: 66121 - DNA, 6 bp, Unknown
  misc_feature (1)..( 6): Matrix.003 file - promoters50/1024045
taatta

SEQ ID NO: 66122 - DNA, 13 bp, Unknown
  misc_feature (1)..( 13): Matrix.003 file - promoters50/1024126
agattgaaaatga

SEQ ID NO: 66123 - DNA, 10 bp, Unknown
  misc_feature (1)..( 10): Matrix.003 file - promoters50/1024126
tcagataaaa

SEQ ID NO: 66124 - DNA, 11 bp, Unknown
  misc_feature (1)..( 11): Matrix.003 file - promoters50/1024126
aattaaaaaaa

SEQ ID NO: 66125 - DNA, 10 bp, Unknown
  misc_feature (1)..( 10): Matrix.003 file - promoters50/1024126
gaaaaattct

SEQ ID NO: 66126 - DNA, 8 bp, Unknown
  misc_feature (1)..( 8): Matrix.003 file - promoters50/1024126
aaacaaat

SEQ ID NO: 66127 - DNA, 8 bp, Unknown
  misc_feature (1)..( 8): Matrix.003 file - promoters50/1024130
ttgtcaac

SEQ ID NO: 66128 - DNA, 12 bp, Unknown
  misc_feature (1)..( 12): Matrix.003 file - promoters50/1024166
attaaaaaaaaa

SEQ ID NO: 66129 - DNA, 13 bp, Unknown
  misc_feature (1)..( 13): Matrix.003 file - promoters50/1024166
aattatgtattgt

SEQ ID NO: 66130 - DNA, 10 bp, Unknown
  misc_feature (1)..( 10): Matrix.003 file - promoters50/1024189
actttacatt

SEQ ID NO: 66131 - DNA, 8 bp, Unknown
  misc_feature (1)..( 8): Matrix.003 file - promoters50/1024189
atataata

SEQ ID NO: 66132 - DNA, 10 bp, Unknown
  misc_feature (1)..( 10): Matrix.003 file - promoters50/1024189
ataaaaaata

SEQ ID NO: 66133 - DNA, 12 bp, Unknown
  misc_feature (1)..( 12): Matrix.003 file - promoters50/1024189
aataaaaaatta

SEQ ID NO: 66134 - DNA, 11 bp, Unknown
  misc_feature (1)..( 11): Matrix.003 file - promoters50/1024189
tttattgattt

SEQ ID NO: 66135 - DNA, 13 bp, Unknown
  misc_feature (1)..( 13): Matrix.003 file - promoters50/1024189
attaattttattt

SEQ ID NO: 66136 - DNA, 14 bp, Unknown
  misc_feature (1)..( 14): Matrix.003 file - promoters50/1024199
attaatgaatttta

SEQ ID NO: 66137 - DNA, 16 bp, Unknown
  misc_feature (1)..( 16): Matrix.003 file - promoters50/1024199
tttataaacacactat

SEQ ID NO: 66138 - DNA, 10 bp, Unknown
  misc_feature (1)..( 10): Matrix.003 file - promoters50/1024199
aacaattatt

SEQ ID NO: 66139 - DNA, 7 bp, Unknown
  misc_feature (1)..( 7): Matrix.003 file - promoters50/1024203
aaatgtc

SEQ ID NO: 66140 - DNA, 13 bp, Unknown
  misc_feature (1)..( 13): Matrix.003 file - promoters50/1024206
atgttattgatat

SEQ ID NO: 66141 - DNA, 9 bp, Unknown
  misc_feature (1)..( 9): Matrix.003 file - promoters50/1024206
tggttatgt

SEQ ID NO: 66142 - DNA, 11 bp, Unknown
  misc_feature (1)..( 11): Matrix.003 file - promoters50/1024214
gctgatattaa

SEQ ID NO: 66143 - DNA, 12 bp, Unknown
  misc_feature (1)..( 12): Matrix.003 file - promoters50/1024214
gtcaaattgttg

SEQ ID NO: 66144 - DNA, 13 bp, Unknown
  misc_feature (1)..( 13): Matrix.003 file - promoters50/1024214
aaattgattttag

SEQ ID NO: 66145 - DNA, 13 bp, Unknown
  misc_feature (1)..( 13): Matrix.003 file - promoters50/1024214
aattgattaaaga

SEQ ID NO: 66146 - DNA, 6 bp, Unknown
  misc_feature (1)..( 6): Matrix.003 file - promoters50/1024236
aataat

SEQ ID NO: 66147 - DNA, 15 bp, Unknown
  misc_feature (1)..( 15): Matrix.003 file - promoters50/1024236
aaaccctagacttgg

SEQ ID NO: 66148 - DNA, 8 bp, Unknown
  misc_feature (1)..( 8): Matrix.003 file - promoters50/1024236
taaaaaaa

SEQ ID NO: 66149 - DNA, 13 bp, Unknown
  misc_feature (1)..( 13): Matrix.003 file - promoters50/1024236
taaaatatttata

SEQ ID NO: 66150 - DNA, 8 bp, Unknown
  misc_feature (1)..( 8): Matrix.003 file - promoters50/1024247
aactttgc

SEQ ID NO: 66151 - DNA, 11 bp, Unknown
  misc_feature (1)..( 11): Matrix.003 file - promoters50/1024247
acatctctctt

SEQ ID NO: 66152 - DNA, 9 bp, Unknown
  misc_feature (1)..( 9): Matrix.003 file - promoters50/1024247
gcaaagaaa

SEQ ID NO: 66153 - DNA, 8 bp, Unknown
  misc_feature (1)..( 8): Matrix.003 file - promoters50/1024247
tctttttc

SEQ ID NO: 66154 - DNA, 11 bp, Unknown
  misc_feature (1)..( 11): Matrix.003 file - promoters50/1024247
taacataaaga

SEQ ID NO: 66155 - DNA, 8 bp, Unknown
  misc_feature (1)..( 8): Matrix.003 file - promoters50/1024251
caaataaa

SEQ ID NO: 66156 - DNA, 7 bp, Unknown
  misc_feature (1)..( 7): Matrix.003 file - promoters50/1024251
attttat

SEQ ID NO: 66157 - DNA, 9 bp, Unknown
  misc_feature (1)..( 9): Matrix.003 file - promoters50/1024251
acaacaata

SEQ ID NO: 66158 - DNA, 8 bp, Unknown
  misc_feature (1)..( 8): Matrix.003 file - promoters50/1024251
taaattaa

SEQ ID NO: 66159 - DNA, 9 bp, Unknown
  misc_feature (1)..( 9): Matrix.003 file - promoters50/1024257
attctaaaa

SEQ ID NO: 66160 - DNA, 9 bp, Unknown
  misc_feature (1)..( 9): Matrix.003 file - promoters50/1024277
taaacaaaa

SEQ ID NO: 66161 - DNA, 7 bp, Unknown
  misc_feature (1)..( 7): Matrix.003 file - promoters50/1024277
ttctaat

SEQ ID NO: 66162 - DNA, 7 bp, Unknown
  misc_feature (1)..( 7): Matrix.003 file - promoters50/1024288
gattttt

SEQ ID NO: 66163 - DNA, 11 bp, Unknown
  misc_feature (1)..( 11): Matrix.003 file - promoters50/1024288
aacaaaaaata

SEQ ID NO: 66164 - DNA, 7 bp, Unknown
  misc_feature (1)..( 7): Matrix.003 file - promoters50/1024288
aagatat

SEQ ID NO: 66165 - DNA, 9 bp, Unknown
  misc_feature (1)..( 9): Matrix.003 file - promoters50/1024288
tcaaagaat

SEQ ID NO: 66166 - DNA, 9 bp, Unknown
  misc_feature (1)..( 9): Matrix.003 file - promoters50/1024355
tttgattta

SEQ ID NO: 66167 - DNA, 10 bp, Unknown
  misc_feature (1)..( 10): Matrix.003 file - promoters50/1024355
ctatactatg

SEQ ID NO: 66168 - DNA, 10 bp, Unknown
  misc_feature (1)..( 10): Matrix.003 file - promoters50/1024367
ataagtttaa

SEQ ID NO: 66169 - DNA, 9 bp, Unknown
  misc_feature (1)..( 9): Matrix.003 file - promoters50/1024367
aaaataaaa

SEQ ID NO: 66170 - DNA, 10 bp, Unknown
  misc_feature (1)..( 10): Matrix.003 file - promoters50/1024367
tatatataat

SEQ ID NO: 66171 - DNA, 8 bp, Unknown
  misc_feature (1)..( 8): Matrix.003 file - promoters50/1024367
ataaaaaa

SEQ ID NO: 66172 - DNA, 8 bp, Unknown
  misc_feature (1)..( 8): Matrix.003 file - promoters50/1024367
aattttta

SEQ ID NO: 66173 - DNA, 11 bp, Unknown
  misc_feature (1)..( 11): Matrix.003 file - promoters50/1024367
gattgattttc

SEQ ID NO: 66174 - DNA, 9 bp, Unknown
  misc_feature (1)..( 9): Matrix.003 file - promoters50/1024367
atttttaat

SEQ ID NO: 66175 - DNA, 8 bp, Unknown
  misc_feature (1)..( 8): Matrix.003 file - promoters50/1024375
aatttgta

SEQ ID NO: 66176 - DNA, 8 bp, Unknown
  misc_feature (1)..( 8): Matrix.003 file - promoters50/1024375
aataaaaa

SEQ ID NO: 66177 - DNA, 8 bp, Unknown
  misc_feature (1)..( 8): Matrix.003 file - promoters50/1024408
tttgttaa

SEQ ID NO: 66178 - DNA, 8 bp, Unknown
  misc_feature (1)..( 8): Matrix.003 file - promoters50/1024408
actataat

SEQ ID NO: 66179 - DNA, 12 bp, Unknown
  misc_feature (1)..( 12): Matrix.003 file - promoters50/1024420
ataaaaaaaaaa

SEQ ID NO: 66180 - DNA, 15 bp, Unknown
  misc_feature (1)..( 15): Matrix.003 file - promoters50/1024431
caaaatataatttaa

SEQ ID NO: 66181 - DNA, 13 bp, Unknown
  misc_feature (1)..( 13): Matrix.003 file - promoters50/1024431
tatattttcttag

SEQ ID NO: 66182 - DNA, 12 bp, Unknown
  misc_feature (1)..( 12): Matrix.003 file - promoters50/1024431
gaaataaatcac

SEQ ID NO: 66183 - DNA, 9 bp, Unknown
  misc_feature (1)..( 9): Matrix.003 file - promoters50/1024454
aaacagaaa

SEQ ID NO: 66184 - DNA, 10 bp, Unknown
  misc_feature (1)..( 10): Matrix.003 file - promoters50/1024470
ggaaggagaa

SEQ ID NO: 66185 - DNA, 7 bp, Unknown
  misc_feature (1)..( 7): Matrix.003 file - promoters50/1024470
tttttaa

SEQ ID NO: 66186 - DNA, 7 bp, Unknown
  misc_feature (1)..( 7): Matrix.003 file - promoters50/1024470
tttaaac

SEQ ID NO: 66187 - DNA, 9 bp, Unknown
  misc_feature (1)..( 9): Matrix.003 file - promoters50/1024470
taaatttaa

SEQ ID NO: 66188 - DNA, 9 bp, Unknown
  misc_feature (1)..( 9): Matrix.003 file - promoters50/1024470
attttctta

SEQ ID NO: 66189 - DNA, 11 bp, Unknown
  misc_feature (1)..( 11): Matrix.003 file - promoters50/1024470
tttaaaaagga

SEQ ID NO: 66190 - DNA, 6 bp, Unknown
  misc_feature (1)..( 6): Matrix.003 file - promoters50/1024470
aaattg

SEQ ID NO: 66191 - DNA, 12 bp, Unknown
  misc_feature (1)..( 12): Matrix.003 file - promoters50/1024499
attaactaaaaa

SEQ ID NO: 66192 - DNA, 11 bp, Unknown
  misc_feature (1)..( 11): Matrix.003 file - promoters50/1024499
aacattttaat

SEQ ID NO: 66193 - DNA, 16 bp, Unknown
  misc_feature (1)..( 16): Matrix.003 file - promoters50/1024499
agtataaaatattttt

SEQ ID NO: 66194 - DNA, 11 bp, Unknown
  misc_feature (1)..( 11): Matrix.003 file - promoters50/1024499
tatataaataa

SEQ ID NO: 66195 - DNA, 14 bp, Unknown
  misc_feature (1)..( 14): Matrix.003 file - promoters50/1024499
attaaatttttaat

SEQ ID NO: 66196 - DNA, 17 bp, Unknown
  misc_feature (1)..( 17): Matrix.003 file - promoters50/1024499
ttaaattaacagtataa

SEQ ID NO: 66197 - DNA, 13 bp, Unknown
  misc_feature (1)..( 13): Matrix.003 file - promoters50/1024499
taaaatatttttt

SEQ ID NO: 66198 - DNA, 11 bp, Unknown
  misc_feature (1)..( 11): Matrix.003 file - promoters50/1024499
aatatttttat

SEQ ID NO: 66199 - DNA, 7 bp, Unknown
  misc_feature (1)..( 7): Matrix.003 file - promoters50/1024499
aatcaat

SEQ ID NO: 66200 - DNA, 12 bp, Unknown
  misc_feature (1)..( 12): Matrix.003 file - promoters50/1024499
aatcaatttttt

SEQ ID NO: 66201 - DNA, 13 bp, Unknown
  misc_feature (1)..( 13): Matrix.003 file - promoters50/1024499
tttattaatttga

SEQ ID NO: 66202 - DNA, 11 bp, Unknown
  misc_feature (1)..( 11): Matrix.003 file - promoters50/1024499
ttttattaact

SEQ ID NO: 66203 - DNA, 9 bp, Unknown
  misc_feature (1)..( 9): Matrix.003 file - promoters50/1024550
aaaatctgg

SEQ ID NO: 66204 - DNA, 10 bp, Unknown
  misc_feature (1)..( 10): Matrix.003 file - promoters50/1024570
atgaaaaacc

SEQ ID NO: 66205 - DNA, 7 bp, Unknown
  misc_feature (1)..( 7): Matrix.003 file - promoters50/1024603
atatata

SEQ ID NO: 66206 - DNA, 7 bp, Unknown
  misc_feature (1)..( 7): Matrix.003 file - promoters50/1024603
taacatg

SEQ ID NO: 66207 - DNA, 12 bp, Unknown
  misc_feature (1)..( 12): Matrix.003 file - promoters50/1024603
aattttccacaa

SEQ ID NO: 66208 - DNA, 12 bp, Unknown
  misc_feature (1)..( 12): Matrix.003 file - promoters50/1024603
tattagatatca

SEQ ID NO: 66209 - DNA, 8 bp, Unknown
  misc_feature (1)..( 8): Matrix.003 file - promoters50/1024603
agattaga

SEQ ID NO: 66210 - DNA, 9 bp, Unknown
  misc_feature (1)..( 9): Matrix.003 file - promoters50/1024603
aaattgtgt

SEQ ID NO: 66211 - DNA, 10 bp, Unknown
  misc_feature (1)..( 10): Matrix.003 file - promoters50/1024611
tcaaaagagc

SEQ ID NO: 66212 - DNA, 9 bp, Unknown
  misc_feature (1)..( 9): Matrix.003 file - promoters50/1024639
gtaaaaatt

SEQ ID NO: 66213 - DNA, 7 bp, Unknown
  misc_feature (1)..( 7): Matrix.003 file - promoters50/1024639
taataaa

SEQ ID NO: 66214 - DNA, 6 bp, Unknown
  misc_feature (1)..( 6): Matrix.003 file - promoters50/1024639
tttaaa

SEQ ID NO: 66215 - DNA, 10 bp, Unknown
  misc_feature (1)..( 10): Matrix.003 file - promoters50/1024639
ttatcttaaa

SEQ ID NO: 66216 - DNA, 9 bp, Unknown
  misc_feature (1)..( 9): Matrix.003 file - promoters50/1024639
tgatttttt

SEQ ID NO: 66217 - DNA, 7 bp, Unknown
  misc_feature (1)..( 7): Matrix.003 file - promoters50/1024639
taattat

SEQ ID NO: 66218 - DNA, 8 bp, Unknown
  misc_feature (1)..( 8): Matrix.003 file - promoters50/1024639
actaattt

SEQ ID NO: 66219 - DNA, 12 bp, Unknown
  misc_feature (1)..( 12): Matrix.003 file - promoters50/1024662
aaataagaaaat

SEQ ID NO: 66220 - DNA, 9 bp, Unknown
  misc_feature (1)..( 9): Matrix.003 file - promoters50/1024713
gaaatttgc

SEQ ID NO: 66221 - DNA, 11 bp, Unknown
  misc_feature (1)..( 11): Matrix.003 file - promoters50/1024713
gaaatttgctt

SEQ ID NO: 66222 - DNA, 10 bp, Unknown
  misc_feature (1)..( 10): Matrix.003 file - promoters50/1024713
aaatttgttt

SEQ ID NO: 66223 - DNA, 8 bp, Unknown
  misc_feature (1)..( 8): Matrix.003 file - promoters50/1024713
catatttt

SEQ ID NO: 66224 - DNA, 13 bp, Unknown
  misc_feature (1)..( 13): Matrix.003 file - promoters50/1024713
tttaaaactaaaa

SEQ ID NO: 66225 - DNA, 13 bp, Unknown
  misc_feature (1)..( 13): Matrix.003 file - promoters50/1024756
taaaagtcaaaaa

SEQ ID NO: 66226 - DNA, 7 bp, Unknown
  misc_feature (1)..( 7): Matrix.003 file - promoters50/1024783
atttttt

SEQ ID NO: 66227 - DNA, 8 bp, Unknown
  misc_feature (1)..( 8): Matrix.003 file - promoters50/1024783
cttttttt

SEQ ID NO: 66228 - DNA, 7 bp, Unknown
  misc_feature (1)..( 7): Matrix.003 file - promoters50/1024787
aaaattc

SEQ ID NO: 66229 - DNA, 8 bp, Unknown
  misc_feature (1)..( 8): Matrix.003 file - promoters50/1024787
acagtttc

SEQ ID NO: 66230 - DNA, 7 bp, Unknown
  misc_feature (1)..( 7): Matrix.003 file - promoters50/1024787
tgttttt

SEQ ID NO: 66231 - DNA, 8 bp, Unknown
  misc_feature (1)..( 8): Matrix.003 file - promoters50/1024787
gggcttta

SEQ ID NO: 66232 - DNA, 9 bp, Unknown
  misc_feature (1)..( 9): Matrix.003 file - promoters50/1024787
aattctctt

SEQ ID NO: 66233 - DNA, 8 bp, Unknown
  misc_feature (1)..( 8): Matrix.003 file - promoters50/1024787
ttttctta

SEQ ID NO: 66234 - DNA, 8 bp, Unknown
  misc_feature (1)..( 8): Matrix.003 file - promoters50/1024821
ttcctttg

SEQ ID NO: 66235 - DNA, 10 bp, Unknown
  misc_feature (1)..( 10): Matrix.003 file - promoters50/1024821
aagaagaagc

SEQ ID NO: 66236 - DNA, 9 bp, Unknown
  misc_feature (1)..( 9): Matrix.003 file - promoters50/1024837
tctttggat

SEQ ID NO: 66237 - DNA, 12 bp, Unknown
  misc_feature (1)..( 12): Matrix.003 file - promoters50/1024837
aaattaaaaaat

SEQ ID NO: 66238 - DNA, 11 bp, Unknown
  misc_feature (1)..( 11): Matrix.003 file - promoters50/1024837
atcaaataatc

SEQ ID NO: 66239 - DNA, 8 bp, Unknown
  misc_feature (1)..( 8): Matrix.003 file - promoters50/1024837
aaatattg

SEQ ID NO: 66240 - DNA, 7 bp, Unknown
  misc_feature (1)..( 7): Matrix.003 file - promoters50/1024840
cataaga

SEQ ID NO: 66241 - DNA, 8 bp, Unknown
  misc_feature (1)..( 8): Matrix.003 file - promoters50/1024840
aaaaagaa

SEQ ID NO: 66242 - DNA, 9 bp, Unknown
  misc_feature (1)..( 9): Matrix.003 file - promoters50/1024840
agaaaaaag

SEQ ID NO: 66243 - DNA, 7 bp, Unknown
  misc_feature (1)..( 7): Matrix.003 file - promoters50/1024840
taataat

SEQ ID NO: 66244 - DNA, 11 bp, Unknown
  misc_feature (1)..( 11): Matrix.003 file - promoters50/1024853
ctactataaaa

SEQ ID NO: 66245 - DNA, 11 bp, Unknown
  misc_feature (1)..( 11): Matrix.003 file - promoters50/1024872
aataactaaaa

SEQ ID NO: 66246 - DNA, 7 bp, Unknown
  misc_feature (1)..( 7): Matrix.003 file - promoters50/1024872
aatcttt

SEQ ID NO: 66247 - DNA, 9 bp, Unknown
  misc_feature (1)..( 9): Matrix.003 file - promoters50/1024872
tatttatta

SEQ ID NO: 66248 - DNA, 11 bp, Unknown
  misc_feature (1)..( 11): Matrix.003 file - promoters50/1024872
aaagaaaaaaa

SEQ ID NO: 66249 - DNA, 11 bp, Unknown
  misc_feature (1)..( 11): Matrix.003 file - promoters50/1024872
taaaataagtt

SEQ ID NO: 66250 - DNA, 11 bp, Unknown
  misc_feature (1)..( 11): Matrix.003 file - promoters50/1024872
aaagaaaaaca

SEQ ID NO: 66251 - DNA, 10 bp, Unknown
  misc_feature (1)..( 10): Matrix.003 file - promoters50/1024889
aaaatttaaa

SEQ ID NO: 66252 - DNA, 3 bp, Unknown
  misc_feature (1)..( 3): Matrix.003 file - promoters50/1024889
ttt

SEQ ID NO: 66253 - DNA, 7 bp, Unknown
  misc_feature (1)..( 7): Matrix.003 file - promoters50/1024889
aaaaaaa

SEQ ID NO: 66254 - DNA, 10 bp, Unknown
  misc_feature (1)..( 10): Matrix.003 file - promoters50/1024889
tggtaataaa

SEQ ID NO: 66255 - DNA, 10 bp, Unknown
  misc_feature (1)..( 10): Matrix.003 file - promoters50/1024905
caaaaagaaa

SEQ ID NO: 66256 - DNA, 7 bp, Unknown
  misc_feature (1)..( 7): Matrix.003 file - promoters50/1024924
ttaattt

SEQ ID NO: 66257 - DNA, 10 bp, Unknown
  misc_feature (1)..( 10): Matrix.003 file - promoters50/1024924
tttggcatct

SEQ ID NO: 66258 - DNA, 7 bp, Unknown
  misc_feature (1)..( 7): Matrix.003 file - promoters50/1024924
tttatta

SEQ ID NO: 66259 - DNA, 8 bp, Unknown
  misc_feature (1)..( 8): Matrix.003 file - promoters50/1024924
atatatat

SEQ ID NO: 66260 - DNA, 7 bp, Unknown
  misc_feature (1)..( 7): Matrix.003 file - promoters50/1024924
tctaatt

SEQ ID NO: 66261 - DNA, 9 bp, Unknown
  misc_feature (1)..( 9): Matrix.003 file - promoters50/1024924
cattaaatt

SEQ ID NO: 66262 - DNA, 8 bp, Unknown
  misc_feature (1)..( 8): Matrix.003 file - promoters50/1024924
aattcaaa

SEQ ID NO: 66263 - DNA, 7 bp, Unknown
  misc_feature (1)..( 7): Matrix.003 file - promoters50/1024924
aatttga

SEQ ID NO: 66264 - DNA, 7 bp, Unknown
  misc_feature (1)..( 7): Matrix.003 file - promoters50/1024924
aaactat

SEQ ID NO: 66265 - DNA, 8 bp, Unknown
  misc_feature (1)..( 8): Matrix.003 file - promoters50/1024958
caattatt

SEQ ID NO: 66266 - DNA, 8 bp, Unknown
  misc_feature (1)..( 8): Matrix.003 file - promoters50/1024958
tgattaaa

SEQ ID NO: 66267 - DNA, 8 bp, Unknown
  misc_feature (1)..( 8): Matrix.003 file - promoters50/1024958
gaaaaagc

SEQ ID NO: 66268 - DNA, 8 bp, Unknown
  misc_feature (1)..( 8): Matrix.003 file - promoters50/1024958
gaataaaa

SEQ ID NO: 66269 - DNA, 7 bp, Unknown
  misc_feature (1)..( 7): Matrix.003 file - promoters50/1024958
aaagttg

SEQ ID NO: 66270 - DNA, 8 bp, Unknown
  misc_feature (1)..( 8): Matrix.003 file - promoters50/1024958
gatatttg

SEQ ID NO: 66271 - DNA, 7 bp, Unknown
  misc_feature (1)..( 7): Matrix.003 file - promoters50/1024961
aaacaat

SEQ ID NO: 66272 - DNA, 14 bp, Unknown
  misc_feature (1)..( 14): Matrix.003 file - promoters50/1024961
cttggttttgcttg

SEQ ID NO: 66273 - DNA, 7 bp, Unknown
  misc_feature (1)..( 7): Matrix.003 file - promoters50/1024961
aaaaaag

SEQ ID NO: 66274 - DNA, 8 bp, Unknown
  misc_feature (1)..( 8): Matrix.003 file - promoters50/1024961
aaataaat

SEQ ID NO: 66275 - DNA, 11 bp, Unknown
  misc_feature (1)..( 11): Matrix.003 file - promoters50/1025028
aattaatcaaa

SEQ ID NO: 66276 - DNA, 8 bp, Unknown
  misc_feature (1)..( 8): Matrix.003 file - promoters50/1025028
atatatta

SEQ ID NO: 66277 - DNA, 7 bp, Unknown
  misc_feature (1)..( 7): Matrix.003 file - promoters50/1025028
aatttta

SEQ ID NO: 66278 - DNA, 9 bp, Unknown
  misc_feature (1)..( 9): Matrix.003 file - promoters50/1025028
agtcaaagt

SEQ ID NO: 66279 - DNA, 9 bp, Unknown
  misc_feature (1)..( 9): Matrix.003 file - promoters50/1025053
ctagtctat

SEQ ID NO: 66280 - DNA, 15 bp, Unknown
  misc_feature (1)..( 15): Matrix.003 file - promoters50/1025087
tttgaaaatcggagt

SEQ ID NO: 66281 - DNA, 13 bp, Unknown
  misc_feature (1)..( 13): Matrix.003 file - promoters50/1025100
gataaaaaaaata

SEQ ID NO: 66282 - DNA, 8 bp, Unknown
  misc_feature (1)..( 8): Matrix.003 file - promoters50/1025100
acaatttt

SEQ ID NO: 66283 - DNA, 9 bp, Unknown
  misc_feature (1)..( 9): Matrix.003 file - promoters50/1025113
tttaaaaaa

SEQ ID NO: 66284 - DNA, 12 bp, Unknown
  misc_feature (1)..( 12): Matrix.003 file - promoters50/1025113
gaaaatatatat

SEQ ID NO: 66285 - DNA, 9 bp, Unknown
  misc_feature (1)..( 9): Matrix.003 file - promoters50/1025113
atatagctt

SEQ ID NO: 66286 - DNA, 9 bp, Unknown
  misc_feature (1)..( 9): Matrix.003 file - promoters50/1025117
ttttattat

SEQ ID NO: 66287 - DNA, 14 bp, Unknown
  misc_feature (1)..( 14): Matrix.003 file - promoters50/1025117
ttatttaatatttt

SEQ ID NO: 66288 - DNA, 11 bp, Unknown
  misc_feature (1)..( 11): Matrix.003 file - promoters50/1025117
atagagtttgc

SEQ ID NO: 66289 - DNA, 9 bp, Unknown
  misc_feature (1)..( 9): Matrix.003 file - promoters50/1025117
ttattaaaa

SEQ ID NO: 66290 - DNA, 7 bp, Unknown
  misc_feature (1)..( 7): Matrix.003 file - promoters50/1025178
ccaaatg

SEQ ID NO: 66291 - DNA, 13 bp, Unknown
  misc_feature (1)..( 13): Matrix.003 file - promoters50/1025178
aaggtatccgagc

SEQ ID NO: 66292 - DNA, 9 bp, Unknown
  misc_feature (1)..( 9): Matrix.003 file - promoters50/1025185
aagaagaaa

SEQ ID NO: 66293 - DNA, 11 bp, Unknown
  misc_feature (1)..( 11): Matrix.003 file - promoters50/1025185
aatttttgata

SEQ ID NO: 66294 - DNA, 9 bp, Unknown
  misc_feature (1)..( 9): Matrix.003 file - promoters50/1025185
ttttatcat

SEQ ID NO: 66295 - DNA, 10 bp, Unknown
  misc_feature (1)..( 10): Matrix.003 file - promoters50/1025194
acaatatttc

SEQ ID NO: 66296 - DNA, 8 bp, Unknown
  misc_feature (1)..( 8): Matrix.003 file - promoters50/1025194
acaaataa

SEQ ID NO: 66297 - DNA, 8 bp, Unknown
  misc_feature (1)..( 8): Matrix.003 file - promoters50/1025202
atttctgt

SEQ ID NO: 66298 - DNA, 7 bp, Unknown
  misc_feature (1)..( 7): Matrix.003 file - promoters50/1025202
cttaatt

SEQ ID NO: 66299 - DNA, 13 bp, Unknown
  misc_feature (1)..( 13): Matrix.003 file - promoters50/1025211
tataaaatatata

SEQ ID NO: 66300 - DNA, 12 bp, Unknown
  misc_feature (1)..( 12): Matrix.003 file - promoters50/1025211
atataattattt

SEQ ID NO: 66301 - DNA, 12 bp, Unknown
  misc_feature (1)..( 12): Matrix.003 file - promoters50/1025211
gtttatttctta

SEQ ID NO: 66302 - DNA, 14 bp, Unknown
  misc_feature (1)..( 14): Matrix.003 file - promoters50/1025211
taaaaaattaaata

SEQ ID NO: 66303 - DNA, 9 bp, Unknown
  misc_feature (1)..( 9): Matrix.003 file - promoters50/1025233
acagaatct

SEQ ID NO: 66304 - DNA, 8 bp, Unknown
  misc_feature (1)..( 8): Matrix.003 file - promoters50/1025233
attttttt

SEQ ID NO: 66305 - DNA, 7 bp, Unknown
  misc_feature (1)..( 7): Matrix.003 file - promoters50/1025262
tcagatt

SEQ ID NO: 66306 - DNA, 8 bp, Unknown
  misc_feature (1)..( 8): Matrix.003 file - promoters50/1025262
atatgtaa

SEQ ID NO: 66307 - DNA, 6 bp, Unknown
  misc_feature (1)..( 6): Matrix.003 file - promoters50/1025262
agaaaa

SEQ ID NO: 66308 - DNA, 10 bp, Unknown
  misc_feature (1)..( 10): Matrix.003 file - promoters50/1025288
tgataaataa

SEQ ID NO: 66309 - DNA, 8 bp, Unknown
  misc_feature (1)..( 8): Matrix.003 file - promoters50/1025288
tttgatca

SEQ ID NO: 66310 - DNA, 12 bp, Unknown
  misc_feature (1)..( 12): Matrix.003 file - promoters50/1025288
gttggtcaaatc

SEQ ID NO: 66311 - DNA, 9 bp, Unknown
  misc_feature (1)..( 9): Matrix.003 file - promoters50/1025288
taaatatga

SEQ ID NO: 66312 - DNA, 6 bp, Unknown
  misc_feature (1)..( 6): Matrix.003 file - promoters50/1025288
ttattt

SEQ ID NO: 66313 - DNA, 8 bp, Unknown
  misc_feature (1)..( 8): Matrix.003 file - promoters50/1025288
tttaaaag

SEQ ID NO: 66314 - DNA, 8 bp, Unknown
  misc_feature (1)..( 8): Matrix.003 file - promoters50/1025288
ctatttct

SEQ ID NO: 66315 - DNA, 8 bp, Unknown
  misc_feature (1)..( 8): Matrix.003 file - promoters50/1025288
aaatggag

SEQ ID NO: 66316 - DNA, 12 bp, Unknown
  misc_feature (1)..( 12): Matrix.003 file - promoters50/1025288
ctgaatttattt

SEQ ID NO: 66317 - DNA, 7 bp, Unknown
  misc_feature (1)..( 7): Matrix.003 file - promoters50/1025322
aaattag

SEQ ID NO: 66318 - DNA, 8 bp, Unknown
  misc_feature (1)..( 8): Matrix.003 file - promoters50/1025322
tttctttc

SEQ ID NO: 66319 - DNA, 7 bp, Unknown
  misc_feature (1)..( 7): Matrix.003 file - promoters50/1025340
aagttaa

SEQ ID NO: 66320 - DNA, 6 bp, Unknown
  misc_feature (1)..( 6): Matrix.003 file - promoters50/1025340
tatata

SEQ ID NO: 66321 - DNA, 11 bp, Unknown
  misc_feature (1)..( 11): Matrix.003 file - promoters50/1025348
ctagtttcttt

SEQ ID NO: 66322 - DNA, 10 bp, Unknown
  misc_feature (1)..( 10): Matrix.003 file - promoters50/1025348
gaaaaacgtt

SEQ ID NO: 66323 - DNA, 12 bp, Unknown
  misc_feature (1)..( 12): Matrix.003 file - promoters50/1025348
ataattttttat

SEQ ID NO: 66324 - DNA, 10 bp, Unknown
  misc_feature (1)..( 10): Matrix.003 file - promoters50/1025348
cttcccttta

SEQ ID NO: 66325 - DNA, 8 bp, Unknown
  misc_feature (1)..( 8): Matrix.003 file - promoters50/1025348
tttatttc

SEQ ID NO: 66326 - DNA, 7 bp, Unknown
  misc_feature (1)..( 7): Matrix.003 file - promoters50/1025348
cttttaa

SEQ ID NO: 66327 - DNA, 7 bp, Unknown
  misc_feature (1)..( 7): Matrix.003 file - promoters50/1025348
taaaaac

SEQ ID NO: 66328 - DNA, 7 bp, Unknown
  misc_feature (1)..( 7): Matrix.003 file - promoters50/1025372
gttgaaa

SEQ ID NO: 66329 - DNA, 8 bp, Unknown
  misc_feature (1)..( 8): Matrix.003 file - promoters50/1025372
tatatttt

SEQ ID NO: 66330 - DNA, 9 bp, Unknown
  misc_feature (1)..( 9): Matrix.003 file - promoters50/1025372
tcatctgat

SEQ ID NO: 66331 - DNA, 9 bp, Unknown
  misc_feature (1)..( 9): Matrix.003 file - promoters50/1025372
catcattat

SEQ ID NO: 66332 - DNA, 7 bp, Unknown
  misc_feature (1)..( 7): Matrix.003 file - promoters50/1025372
tttttgt

SEQ ID NO: 66333 - DNA, 7 bp, Unknown
  misc_feature (1)..( 7): Matrix.003 file - promoters50/1025372
ttttata

SEQ ID NO: 66334 - DNA, 10 bp, Unknown
  misc_feature (1)..( 10): Matrix.003 file - promoters50/1025443
agaaaataca

SEQ ID NO: 66335 - DNA, 12 bp, Unknown
  misc_feature (1)..( 12): Matrix.003 file - promoters50/1025443
taaaaatacaaa

SEQ ID NO: 66336 - DNA, 10 bp, Unknown
  misc_feature (1)..( 10): Matrix.003 file - promoters50/1025443
gttgggaaat

SEQ ID NO: 66337 - DNA, 12 bp, Unknown
  misc_feature (1)..( 12): Matrix.003 file - promoters50/1025443
ctttatttctta

SEQ ID NO: 66338 - DNA, 10 bp, Unknown
  misc_feature (1)..( 10): Matrix.003 file - promoters50/1025468
gtaaatatat

SEQ ID NO: 66339 - DNA, 11 bp, Unknown
  misc_feature (1)..( 11): Matrix.003 file - promoters50/1025468
aaaaaaaacat

SEQ ID NO: 66340 - DNA, 8 bp, Unknown
  misc_feature (1)..( 8): Matrix.003 file - promoters50/1025471
attaaaaa

SEQ ID NO: 66341 - DNA, 10 bp, Unknown
  misc_feature (1)..( 10): Matrix.003 file - promoters50/1025491
tattgctaaa

SEQ ID NO: 66342 - DNA, 10 bp, Unknown
  misc_feature (1)..( 10): Matrix.003 file - promoters50/1025491
acaatttttt

SEQ ID NO: 66343 - DNA, 7 bp, Unknown
  misc_feature (1)..( 7): Matrix.003 file - promoters50/1025491
attatat

SEQ ID NO: 66344 - DNA, 12 bp, Unknown
  misc_feature (1)..( 12): Matrix.003 file - promoters50/1025491
tagaatcaaaat

SEQ ID NO: 66345 - DNA, 6 bp, Unknown
  misc_feature (1)..( 6): Matrix.003 file - promoters50/1025511
taaata

SEQ ID NO: 66346 - DNA, 11 bp, Unknown
  misc_feature (1)..( 11): Matrix.003 file - promoters50/1025515
gtttgagtata

SEQ ID NO: 66347 - DNA, 9 bp, Unknown
  misc_feature (1)..( 9): Matrix.003 file - promoters50/1025515
ctgttttac

SEQ ID NO: 66348 - DNA, 8 bp, Unknown
  misc_feature (1)..( 8): Matrix.003 file - promoters50/1025540
ttgtttta

SEQ ID NO: 66349 - DNA, 9 bp, Unknown
  misc_feature (1)..( 9): Matrix.003 file - promoters50/1025642
aaaaatatt

SEQ ID NO: 66350 - DNA, 13 bp, Unknown
  misc_feature (1)..( 13): Matrix.003 file - promoters50/1025642
ttttaaaaatcta

SEQ ID NO: 66351 - DNA, 13 bp, Unknown
  misc_feature (1)..( 13): Matrix.003 file - promoters50/1025642
gaaataataatta

SEQ ID NO: 66352 - DNA, 11 bp, Unknown
  misc_feature (1)..( 11): Matrix.003 file - promoters50/1025642
atttttaaatg

SEQ ID NO: 66353 - DNA, 12 bp, Unknown
  misc_feature (1)..( 12): Matrix.003 file - promoters50/1025642
acatcataatta

SEQ ID NO: 66354 - DNA, 17 bp, Unknown
  misc_feature (1)..( 17): Matrix.003 file - promoters50/1025642
tttctaaaaagatatat

SEQ ID NO: 66355 - DNA, 9 bp, Unknown
  misc_feature (1)..( 9): Matrix.003 file - promoters50/1025683
agaacatta

SEQ ID NO: 66356 - DNA, 10 bp, Unknown
  misc_feature (1)..( 10): Matrix.003 file - promoters50/1025683
ctatatataa

SEQ ID NO: 66357 - DNA, 13 bp, Unknown
  misc_feature (1)..( 13): Matrix.003 file - promoters50/1025683
gattattaataat

SEQ ID NO: 66358 - DNA, 6 bp, Unknown
  misc_feature (1)..( 6): Matrix.003 file - promoters50/1025729
tatata

SEQ ID NO: 66359 - DNA, 13 bp, Unknown
  misc_feature (1)..( 13): Matrix.003 file - promoters50/1025744
attttgaatattc

SEQ ID NO: 66360 - DNA, 12 bp, Unknown
  misc_feature (1)..( 12): Matrix.003 file - promoters50/1025744
atttaaaacata

SEQ ID NO: 66361 - DNA, 13 bp, Unknown
  misc_feature (1)..( 13): Matrix.003 file - promoters50/1025791
cattaatttcctc

SEQ ID NO: 66362 - DNA, 16 bp, Unknown
  misc_feature (1)..( 16): Matrix.003 file - promoters50/1025791
agaagaagagcatttt

SEQ ID NO: 66363 - DNA, 9 bp, Unknown
  misc_feature (1)..( 9): Matrix.003 file - promoters50/1025883
ctcactaag

SEQ ID NO: 66364 - DNA, 8 bp, Unknown
  misc_feature (1)..( 8): Matrix.003 file - promoters50/1025883
ccagaagg

SEQ ID NO: 66365 - DNA, 7 bp, Unknown
  misc_feature (1)..( 7): Matrix.003 file - promoters50/1026000
ttgaaaa

SEQ ID NO: 66366 - DNA, 8 bp, Unknown
  misc_feature (1)..( 8): Matrix.003 file - promoters50/1026000
tttcaaat

SEQ ID NO: 66367 - DNA, 9 bp, Unknown
  misc_feature (1)..( 9): Matrix.003 file - promoters50/1026000
atggatact

SEQ ID NO: 66368 - DNA, 8 bp, Unknown
  misc_feature (1)..( 8): Matrix.003 file - promoters50/1026000
gaaggagc

SEQ ID NO: 66369 - DNA, 7 bp, Unknown
  misc_feature (1)..( 7): Matrix.003 file - promoters50/1026000
taaagag

SEQ ID NO: 66370 - DNA, 10 bp, Unknown
  misc_feature (1)..( 10): Matrix.003 file - promoters50/1026014
aaatgatttt

SEQ ID NO: 66371 - DNA, 12 bp, Unknown
  misc_feature (1)..( 12): Matrix.003 file - promoters50/1026014
ttatgtcaaatt

SEQ ID NO: 66372 - DNA, 15 bp, Unknown
  misc_feature (1)..( 15): Matrix.003 file - promoters50/1026014
ccaaaaaaaaataaa

SEQ ID NO: 66373 - DNA, 10 bp, Unknown
  misc_feature (1)..( 10): Matrix.003 file - promoters50/1026014
tttttataat

SEQ ID NO: 66374 - DNA, 13 bp, Unknown
  misc_feature (1)..( 13): Matrix.003 file - promoters50/1026014
ctttaaaaatatc

SEQ ID NO: 66375 - DNA, 7 bp, Unknown
  misc_feature (1)..( 7): Matrix.003 file - promoters50/1026039
attattt

SEQ ID NO: 66376 - DNA, 7 bp, Unknown
  misc_feature (1)..( 7): Matrix.003 file - promoters50/1026039
cattata

SEQ ID NO: 66377 - DNA, 8 bp, Unknown
  misc_feature (1)..( 8): Matrix.003 file - promoters50/1026160
caaaaaac

SEQ ID NO: 66378 - DNA, 13 bp, Unknown
  misc_feature (1)..( 13): Matrix.003 file - promoters50/1026160
aataaaaagtttt

SEQ ID NO: 66379 - DNA, 7 bp, Unknown
  misc_feature (1)..( 7): Matrix.003 file - promoters50/1026235
ttttaaa

SEQ ID NO: 66380 - DNA, 10 bp, Unknown
  misc_feature (1)..( 10): Matrix.003 file - promoters50/1026235
aaattcttca

SEQ ID NO: 66381 - DNA, 10 bp, Unknown
  misc_feature (1)..( 10): Matrix.003 file - promoters50/1026412
caaaagaaac

SEQ ID NO: 66382 - DNA, 9 bp, Unknown
  misc_feature (1)..( 9): Matrix.003 file - promoters50/1026416
ttttggtga

SEQ ID NO: 66383 - DNA, 6 bp, Unknown
  misc_feature (1)..( 6): Matrix.003 file - promoters50/1026416
aaagaa

SEQ ID NO: 66384 - DNA, 7 bp, Unknown
  misc_feature (1)..( 7): Matrix.003 file - promoters50/1026416
atttaaa

SEQ ID NO: 66385 - DNA, 11 bp, Unknown
  misc_feature (1)..( 11): Matrix.003 file - promoters50/1026416
aaaaacaaaga

SEQ ID NO: 66386 - DNA, 9 bp, Unknown
  misc_feature (1)..( 9): Matrix.003 file - promoters50/1026419
gaaaaaagt

SEQ ID NO: 66387 - DNA, 9 bp, Unknown
  misc_feature (1)..( 9): Matrix.003 file - promoters50/1026419
ttgggtcat

SEQ ID NO: 66388 - DNA, 9 bp, Unknown
  misc_feature (1)..( 9): Matrix.003 file - promoters50/1026439
aaattacag

SEQ ID NO: 66389 - DNA, 8 bp, Unknown
  misc_feature (1)..( 8): Matrix.003 file - promoters50/1026514
catcaaat

SEQ ID NO: 66390 - DNA, 14 bp, Unknown
  misc_feature (1)..( 14): Matrix.003 file - promoters50/1026514
aaagttgaataatt

SEQ ID NO: 66391 - DNA, 8 bp, Unknown
  misc_feature (1)..( 8): Matrix.003 file - promoters50/1026514
cattcatg

SEQ ID NO: 66392 - DNA, 11 bp, Unknown
  misc_feature (1)..( 11): Matrix.003 file - promoters50/1026514
tacaaaattaa

SEQ ID NO: 66393 - DNA, 10 bp, Unknown
  misc_feature (1)..( 10): Matrix.003 file - promoters50/1026514
ttttataaat

SEQ ID NO: 66394 - DNA, 7 bp, Unknown
  misc_feature (1)..( 7): Matrix.003 file - promoters50/1026514
attgata

SEQ ID NO: 66395 - DNA, 9 bp, Unknown
  misc_feature (1)..( 9): Matrix.003 file - promoters50/1026514
aaaaaccca

SEQ ID NO: 66396 - DNA, 7 bp, Unknown
  misc_feature (1)..( 7): Matrix.003 file - promoters50/1026514
caccaaa

SEQ ID NO: 66397 - DNA, 9 bp, Unknown
  misc_feature (1)..( 9): Matrix.003 file - promoters50/1026540
aatctttaa

SEQ ID NO: 66398 - DNA, 10 bp, Unknown
  misc_feature (1)..( 10): Matrix.003 file - promoters50/1026540
ttaaaataga

SEQ ID NO: 66399 - DNA, 10 bp, Unknown
  misc_feature (1)..( 10): Matrix.003 file - promoters50/1026544
gagatttttt

SEQ ID NO: 66400 - DNA, 11 bp, Unknown
  misc_feature (1)..( 11): Matrix.003 file - promoters50/1026544
aaaaataagaa

SEQ ID NO: 66401 - DNA, 9 bp, Unknown
  misc_feature (1)..( 9): Matrix.003 file - promoters50/1026544
atagaaaat

SEQ ID NO: 66402 - DNA, 8 bp, Unknown
  misc_feature (1)..( 8): Matrix.003 file - promoters50/1026544
ggcccaat

SEQ ID NO: 66403 - DNA, 10 bp, Unknown
  misc_feature (1)..( 10): Matrix.003 file - promoters50/1026544
aaaaaaataa

SEQ ID NO: 66404 - DNA, 10 bp, Unknown
  misc_feature (1)..( 10): Matrix.003 file - promoters50/1026551
ttaatttata

SEQ ID NO: 66405 - DNA, 11 bp, Unknown
  misc_feature (1)..( 11): Matrix.003 file - promoters50/1026551
aagtataaaat

SEQ ID NO: 66406 - DNA, 17 bp, Unknown
  misc_feature (1)..( 17): Matrix.003 file - promoters50/1026551
taaaggatgatggacca

SEQ ID NO: 66407 - DNA, 20 bp, Unknown
  misc_feature (1)..( 20): Matrix.003 file - promoters50/1026551
tacacataaataacgtggtc

SEQ ID NO: 66408 - DNA, 23 bp, Unknown
  misc_feature (1)..( 23): Matrix.003 file - promoters50/1026551
cgtttaccaaaataaagaaaata

SEQ ID NO: 66409 - DNA, 6 bp, Unknown
  misc_feature (1)..( 6): Matrix.003 file - promoters50/1026551
atttta

SEQ ID NO: 66410 - DNA, 8 bp, Unknown
  misc_feature (1)..( 8): Matrix.003 file - promoters50/1026562
aaagtctt

SEQ ID NO: 66411 - DNA, 10 bp, Unknown
  misc_feature (1)..( 10): Matrix.003 file - promoters50/1026562
aatcaattgc

SEQ ID NO: 66412 - DNA, 8 bp, Unknown
  misc_feature (1)..( 8): Matrix.003 file - promoters50/1026562
tttcgtat

SEQ ID NO: 66413 - DNA, 8 bp, Unknown
  misc_feature (1)..( 8): Matrix.003 file - promoters50/1026562
acaaatgg

SEQ ID NO: 66414 - DNA, 8 bp, Unknown
  misc_feature (1)..( 8): Matrix.003 file - promoters50/1026562
aatattag

SEQ ID NO: 66415 - DNA, 7 bp, Unknown
  misc_feature (1)..( 7): Matrix.003 file - promoters50/1026562
aatataa

SEQ ID NO: 66416 - DNA, 8 bp, Unknown
  misc_feature (1)..( 8): Matrix.003 file - promoters50/1026562
ttccattc

SEQ ID NO: 66417 - DNA, 8 bp, Unknown
  misc_feature (1)..( 8): Matrix.003 file - promoters50/1026565
tgaagaaa

SEQ ID NO: 66418 - DNA, 8 bp, Unknown
  misc_feature (1)..( 8): Matrix.003 file - promoters50/1026565
agacatga

SEQ ID NO: 66419 - DNA, 9 bp, Unknown
  misc_feature (1)..( 9): Matrix.003 file - promoters50/1026565
caaacaaaa

SEQ ID NO: 66420 - DNA, 8 bp, Unknown
  misc_feature (1)..( 8): Matrix.003 file - promoters50/1026574
attttttt

SEQ ID NO: 66421 - DNA, 7 bp, Unknown
  misc_feature (1)..( 7): Matrix.003 file - promoters50/1026574
gaaaaaa

SEQ ID NO: 66422 - DNA, 8 bp, Unknown
  misc_feature (1)..( 8): Matrix.003 file - promoters50/1026574
acattata

SEQ ID NO: 66423 - DNA, 9 bp, Unknown
  misc_feature (1)..( 9): Matrix.003 file - promoters50/1026574
tatacgttt

SEQ ID NO: 66424 - DNA, 8 bp, Unknown
  misc_feature (1)..( 8): Matrix.003 file - promoters50/1026574
tggatttt

SEQ ID NO: 66425 - DNA, 8 bp, Unknown
  misc_feature (1)..( 8): Matrix.003 file - promoters50/1026578
taaaagat

SEQ ID NO: 66426 - DNA, 10 bp, Unknown
  misc_feature (1)..( 10): Matrix.003 file - promoters50/1026618
aaataaatat

SEQ ID NO: 66427 - DNA, 13 bp, Unknown
  misc_feature (1)..( 13): Matrix.003 file - promoters50/1026618
aaatttaaaaaaa

SEQ ID NO: 66428 - DNA, 8 bp, Unknown
  misc_feature (1)..( 8): Matrix.003 file - promoters50/1026667
atatttta

SEQ ID NO: 66429 - DNA, 9 bp, Unknown
  misc_feature (1)..( 9): Matrix.003 file - promoters50/1026667
gcttatgga

SEQ ID NO: 66430 - DNA, 11 bp, Unknown
  misc_feature (1)..( 11): Matrix.003 file - promoters50/1026705
aattttaatga

SEQ ID NO: 66431 - DNA, 8 bp, Unknown
  misc_feature (1)..( 8): Matrix.003 file - promoters50/1026705
ttttcatt

SEQ ID NO: 66432 - DNA, 10 bp, Unknown
  misc_feature (1)..( 10): Matrix.003 file - promoters50/1026742
ctcttactgt

SEQ ID NO: 66433 - DNA, 9 bp, Unknown
  misc_feature (1)..( 9): Matrix.003 file - promoters50/1026822
acaaaatag

SEQ ID NO: 66434 - DNA, 8 bp, Unknown
  misc_feature (1)..( 8): Matrix.003 file - promoters50/1026822
taatacat

SEQ ID NO: 66435 - DNA, 8 bp, Unknown
  misc_feature (1)..( 8): Matrix.003 file - promoters50/1026861
ttatataa

SEQ ID NO: 66436 - DNA, 9 bp, Unknown
  misc_feature (1)..( 9): Matrix.003 file - promoters50/1026880
ttttgatta

SEQ ID NO: 66437 - DNA, 11 bp, Unknown
  misc_feature (1)..( 11): Matrix.003 file - promoters50/1026931
ttataaagaaa

SEQ ID NO: 66438 - DNA, 7 bp, Unknown
  misc_feature (1)..( 7): Matrix.003 file - promoters50/1026931
tatattt

SEQ ID NO: 66439 - DNA, 13 bp, Unknown
  misc_feature (1)..( 13): Matrix.003 file - promoters50/1026976
ttgaataaaaatt

SEQ ID NO: 66440 - DNA, 13 bp, Unknown
  misc_feature (1)..( 13): Matrix.003 file - promoters50/1026976
gaatttgctaaaa

SEQ ID NO: 66441 - DNA, 8 bp, Unknown
  misc_feature (1)..( 8): Matrix.003 file - promoters50/1026987
tatttaag

SEQ ID NO: 66442 - DNA, 9 bp, Unknown
  misc_feature (1)..( 9): Matrix.003 file - promoters50/1026987
tatataaac

SEQ ID NO: 66443 - DNA, 9 bp, Unknown
  misc_feature (1)..( 9): Matrix.003 file - promoters50/1026987
tgatttttt

SEQ ID NO: 66444 - DNA, 8 bp, Unknown
  misc_feature (1)..( 8): Matrix.003 file - promoters50/1026991
cataaaaa

SEQ ID NO: 66445 - DNA, 9 bp, Unknown
  misc_feature (1)..( 9): Matrix.003 file - promoters50/1026991
aaaattaga

SEQ ID NO: 66446 - DNA, 7 bp, Unknown
  misc_feature (1)..( 7): Matrix.003 file - promoters50/1026991
taaattg

SEQ ID NO: 66447 - DNA, 11 bp, Unknown
  misc_feature (1)..( 11): Matrix.003 file - promoters50/1027032
atttaattata

SEQ ID NO: 66448 - DNA, 14 bp, Unknown
  misc_feature (1)..( 14): Matrix.003 file - promoters50/1027032
ccatcaaaatgatt

SEQ ID NO: 66449 - DNA, 10 bp, Unknown
  misc_feature (1)..( 10): Matrix.003 file - promoters50/1027032
tatggaatta

SEQ ID NO: 66450 - DNA, 8 bp, Unknown
  misc_feature (1)..( 8): Matrix.003 file - promoters50/1027040
gattttta

SEQ ID NO: 66451 - DNA, 9 bp, Unknown
  misc_feature (1)..( 9): Matrix.003 file - promoters50/1027040
tcaaagaat

SEQ ID NO: 66452 - DNA, 12 bp, Unknown
  misc_feature (1)..( 12): Matrix.003 file - promoters50/1027040
aaaaaaacaaaa

SEQ ID NO: 66453 - DNA, 10 bp, Unknown
  misc_feature (1)..( 10): Matrix.003 file - promoters50/1027040
tcaagatatg

SEQ ID NO: 66454 - DNA, 10 bp, Unknown
  misc_feature (1)..( 10): Matrix.003 file - promoters50/1027040
tttgattttt

SEQ ID NO: 66455 - DNA, 11 bp, Unknown
  misc_feature (1)..( 11): Matrix.003 file - promoters50/1027064
tatagttaaaa

SEQ ID NO: 66456 - DNA, 9 bp, Unknown
  misc_feature (1)..( 9): Matrix.003 file - promoters50/1027064
tggttatgt

SEQ ID NO: 66457 - DNA, 10 bp, Unknown
  misc_feature (1)..( 10): Matrix.003 file - promoters50/1027108
gttaaaacaa

SEQ ID NO: 66458 - DNA, 10 bp, Unknown
  misc_feature (1)..( 10): Matrix.003 file - promoters50/1027121
attataataa

SEQ ID NO: 66459 - DNA, 9 bp, Unknown
  misc_feature (1)..( 9): Matrix.003 file - promoters50/1027125
atttgtaaa

SEQ ID NO: 66460 - DNA, 8 bp, Unknown
  misc_feature (1)..( 8): Matrix.003 file - promoters50/1027156
atacaata

SEQ ID NO: 66461 - DNA, 9 bp, Unknown
  misc_feature (1)..( 9): Matrix.003 file - promoters50/1027156
aaagtaaac

SEQ ID NO: 66462 - DNA, 10 bp, Unknown
  misc_feature (1)..( 10): Matrix.003 file - promoters50/1027156
aaaataagtt

SEQ ID NO: 66463 - DNA, 9 bp, Unknown
  misc_feature (1)..( 9): Matrix.003 file - promoters50/1027156
caaaaacta

SEQ ID NO: 66464 - DNA, 15 bp, Unknown
  misc_feature (1)..( 15): Matrix.003 file - promoters50/1027171
tatattttcttattg

SEQ ID NO: 66465 - DNA, 11 bp, Unknown
  misc_feature (1)..( 11): Matrix.003 file - promoters50/1027171
tagaaaaacca

SEQ ID NO: 66466 - DNA, 12 bp, Unknown
  misc_feature (1)..( 12): Matrix.003 file - promoters50/1027171
aaaataaatcac

SEQ ID NO: 66467 - DNA, 14 bp, Unknown
  misc_feature (1)..( 14): Matrix.003 file - promoters50/1027171
caaaacattaatct

SEQ ID NO: 66468 - DNA, 11 bp, Unknown
  misc_feature (1)..( 11): Matrix.003 file - promoters50/1027171
aaaacttaaaa

SEQ ID NO: 66469 - DNA, 10 bp, Unknown
  misc_feature (1)..( 10): Matrix.003 file - promoters50/1027175
gttttgacca

SEQ ID NO: 66470 - DNA, 11 bp, Unknown
  misc_feature (1)..( 11): Matrix.003 file - promoters50/1027175
tattatgtggc

SEQ ID NO: 66471 - DNA, 11 bp, Unknown
  misc_feature (1)..( 11): Matrix.003 file - promoters50/1027175
tcttttttttt

SEQ ID NO: 66472 - DNA, 8 bp, Unknown
  misc_feature (1)..( 8): Matrix.003 file - promoters50/1027189
taaaaaaa

SEQ ID NO: 66473 - DNA, 7 bp, Unknown
  misc_feature (1)..( 7): Matrix.003 file - promoters50/1027189
aaacaaa

SEQ ID NO: 66474 - DNA, 9 bp, Unknown
  misc_feature (1)..( 9): Matrix.003 file - promoters50/1027189
tatacatat

SEQ ID NO: 66475 - DNA, 10 bp, Unknown
  misc_feature (1)..( 10): Matrix.003 file - promoters50/1027189
aaatatgata

SEQ ID NO: 66476 - DNA, 6 bp, Unknown
  misc_feature (1)..( 6): Matrix.003 file - promoters50/1027189
tatgag

SEQ ID NO: 66477 - DNA, 6 bp, Unknown
  misc_feature (1)..( 6): Matrix.003 file - promoters50/1027201
gatgaa

SEQ ID NO: 66478 - DNA, 9 bp, Unknown
  misc_feature (1)..( 9): Matrix.003 file - promoters50/1027201
aagctcgat

SEQ ID NO: 66479 - DNA, 7 bp, Unknown
  misc_feature (1)..( 7): Matrix.003 file - promoters50/1027201
aaaaaat

SEQ ID NO: 66480 - DNA, 8 bp, Unknown
  misc_feature (1)..( 8): Matrix.003 file - promoters50/1027204
aaataatg

SEQ ID NO: 66481 - DNA, 8 bp, Unknown
  misc_feature (1)..( 8): Matrix.003 file - promoters50/1027204
aaaattta

SEQ ID NO: 66482 - DNA, 8 bp, Unknown
  misc_feature (1)..( 8): Matrix.003 file - promoters50/1027204
aaaaaaat

SEQ ID NO: 66483 - DNA, 13 bp, Unknown
  misc_feature (1)..( 13): Matrix.003 file - promoters50/1027204
aaataaaaagatt

SEQ ID NO: 66484 - DNA, 8 bp, Unknown
  misc_feature (1)..( 8): Matrix.003 file - promoters50/1027204
atatatat

SEQ ID NO: 66485 - DNA, 10 bp, Unknown
  misc_feature (1)..( 10): Matrix.003 file - promoters50/1027204
taaaaaaatt

SEQ ID NO: 66486 - DNA, 8 bp, Unknown
  misc_feature (1)..( 8): Matrix.003 file - promoters50/1027204
gagagatc

SEQ ID NO: 66487 - DNA, 7 bp, Unknown
  misc_feature (1)..( 7): Matrix.003 file - promoters50/1027204
taacgaa

SEQ ID NO: 66488 - DNA, 7 bp, Unknown
  misc_feature (1)..( 7): Matrix.003 file - promoters50/1027204
aaaatta

SEQ ID NO: 66489 - DNA, 10 bp, Unknown
  misc_feature (1)..( 10): Matrix.003 file - promoters50/1027212
atattaaaaa

SEQ ID NO: 66490 - DNA, 8 bp, Unknown
  misc_feature (1)..( 8): Matrix.003 file - promoters50/1027212
gaatgcat

SEQ ID NO: 66491 - DNA, 10 bp, Unknown
  misc_feature (1)..( 10): Matrix.003 file - promoters50/1027212
tgtctaaaaa

SEQ ID NO: 66492 - DNA, 8 bp, Unknown
  misc_feature (1)..( 8): Matrix.003 file - promoters50/1027212
actatata

SEQ ID NO: 66493 - DNA, 8 bp, Unknown
  misc_feature (1)..( 8): Matrix.003 file - promoters50/1027212
ttttaaat

SEQ ID NO: 66494 - DNA, 9 bp, Unknown
  misc_feature (1)..( 9): Matrix.003 file - promoters50/1027212
atttaaaaa

SEQ ID NO: 66495 - DNA, 5 bp, Unknown
  misc_feature (1)..( 5): Matrix.003 file - promoters50/1027212
aaaaa

SEQ ID NO: 66496 - DNA, 7 bp, Unknown
  misc_feature (1)..( 7): Matrix.003 file - promoters50/1027212
taaaatt

SEQ ID NO: 66497 - DNA, 8 bp, Unknown
  misc_feature (1)..( 8): Matrix.003 file - promoters50/1027212
caaaaaaa

SEQ ID NO: 66498 - DNA, 4 bp, Unknown
  misc_feature (1)..( 4): Matrix.003 file - promoters50/1027212
aaaa

SEQ ID NO: 66499 - DNA, 7 bp, Unknown
  misc_feature (1)..( 7): Matrix.003 file - promoters50/1027237
gaacaag

SEQ ID NO: 66500 - DNA, 12 bp, Unknown
  misc_feature (1)..( 12): Matrix.003 file - promoters50/1027237
tctaatatataa

SEQ ID NO: 66501 - DNA, 10 bp, Unknown
  misc_feature (1)..( 10): Matrix.003 file - promoters50/1027237
tttatctctt

SEQ ID NO: 66502 - DNA, 11 bp, Unknown
  misc_feature (1)..( 11): Matrix.003 file - promoters50/1027237
tatatttgagt

SEQ ID NO: 66503 - DNA, 9 bp, Unknown
  misc_feature (1)..( 9): Matrix.003 file - promoters50/1027237
gaagaagaa

SEQ ID NO: 66504 - DNA, 9 bp, Unknown
  misc_feature (1)..( 9): Matrix.003 file - promoters50/1027237
tattatttt

SEQ ID NO: 66505 - DNA, 9 bp, Unknown
  misc_feature (1)..( 9): Matrix.003 file - promoters50/1027240
aatcaaaag

SEQ ID NO: 66506 - DNA, 11 bp, Unknown
  misc_feature (1)..( 11): Matrix.003 file - promoters50/1027240
tcaaaaatata

SEQ ID NO: 66507 - DNA, 13 bp, Unknown
  misc_feature (1)..( 13): Matrix.003 file - promoters50/1027240
ctaacccaaaaat

SEQ ID NO: 66508 - DNA, 6 bp, Unknown
  misc_feature (1)..( 6): Matrix.003 file - promoters50/1027240
aaaaaa

SEQ ID NO: 66509 - DNA, 9 bp, Unknown
  misc_feature (1)..( 9): Matrix.003 file - promoters50/1027240
tttaaaata

SEQ ID NO: 66510 - DNA, 8 bp, Unknown
  misc_feature (1)..( 8): Matrix.003 file - promoters50/1027240
tttaaaat

SEQ ID NO: 66511 - DNA, 9 bp, Unknown
  misc_feature (1)..( 9): Matrix.003 file - promoters50/1027240
ccaaaaaat

SEQ ID NO: 66512 - DNA, 10 bp, Unknown
  misc_feature (1)..( 10): Matrix.003 file - promoters50/1027243
ttatactatt

SEQ ID NO: 66513 - DNA, 11 bp, Unknown
  misc_feature (1)..( 11): Matrix.004 file - promoters50/1027346
ttaaatttttt

SEQ ID NO: 66514 - DNA, 9 bp, Unknown
  misc_feature (1)..( 9): Matrix.004 file - promoters50/1027346
ttacatgtt

SEQ ID NO: 66515 - DNA, 13 bp, Unknown
  misc_feature (1)..( 13): Matrix.004 file - promoters50/1027346
aataaaataataa

SEQ ID NO: 66516 - DNA, 9 bp, Unknown
  misc_feature (1)..( 9): Matrix.004 file - promoters50/1027346
tttcataat

SEQ ID NO: 66517 - DNA, 8 bp, Unknown
  misc_feature (1)..( 8): Matrix.004 file - promoters50/1027346
cataaaat

SEQ ID NO: 66518 - DNA, 8 bp, Unknown
  misc_feature (1)..( 8): Matrix.004 file - promoters50/1027346
tgttattt

SEQ ID NO: 66519 - DNA, 8 bp, Unknown
  misc_feature (1)..( 8): Matrix.004 file - promoters50/1027346
atttataa

SEQ ID NO: 66520 - DNA, 8 bp, Unknown
  misc_feature (1)..( 8): Matrix.004 file - promoters50/1027346
aatgaaat

SEQ ID NO: 66521 - DNA, 8 bp, Unknown
  misc_feature (1)..( 8): Matrix.004 file - promoters50/1027346
attcaact

SEQ ID NO: 66522 - DNA, 7 bp, Unknown
  misc_feature (1)..( 7): Matrix.004 file - promoters50/1027346
atgtaaa

SEQ ID NO: 66523 - DNA, 7 bp, Unknown
  misc_feature (1)..( 7): Matrix.004 file - promoters50/1027350
aatattt

SEQ ID NO: 66524 - DNA, 11 bp, Unknown
  misc_feature (1)..( 11): Matrix.004 file - promoters50/1027350
aaacaaaatta

SEQ ID NO: 66525 - DNA, 14 bp, Unknown
  misc_feature (1)..( 14): Matrix.004 file - promoters50/1027350
aaagtatttatact

SEQ ID NO: 66526 - DNA, 8 bp, Unknown
  misc_feature (1)..( 8): Matrix.004 file - promoters50/1027378
attccaaa

SEQ ID NO: 66527 - DNA, 14 bp, Unknown
  misc_feature (1)..( 14): Matrix.004 file - promoters50/1027378
gttgaatcaatatc

SEQ ID NO: 66528 - DNA, 11 bp, Unknown
  misc_feature (1)..( 11): Matrix.004 file - promoters50/1027399
ttgtatcaata

SEQ ID NO: 66529 - DNA, 12 bp, Unknown
  misc_feature (1)..( 12): Matrix.004 file - promoters50/1027399
ataatatattct

SEQ ID NO: 66530 - DNA, 11 bp, Unknown
  misc_feature (1)..( 11): Matrix.004 file - promoters50/1027399
atatatagtat

SEQ ID NO: 66531 - DNA, 10 bp, Unknown
  misc_feature (1)..( 10): Matrix.004 file - promoters50/1027406
agaaatatat

SEQ ID NO: 66532 - DNA, 9 bp, Unknown
  misc_feature (1)..( 9): Matrix.004 file - promoters50/1027406
ttttaaaaa

SEQ ID NO: 66533 - DNA, 9 bp, Unknown
  misc_feature (1)..( 9): Matrix.004 file - promoters50/1027406
ttttttgaa

SEQ ID NO: 66534 - DNA, 8 bp, Unknown
  misc_feature (1)..( 8): Matrix.004 file - promoters50/1027406
atttttta

SEQ ID NO: 66535 - DNA, 15 bp, Unknown
  misc_feature (1)..( 15): Matrix.004 file - promoters50/1027406
tttagaaaatgggat

SEQ ID NO: 66536 - DNA, 12 bp, Unknown
  misc_feature (1)..( 12): Matrix.004 file - promoters50/1027406
aactataaaata

SEQ ID NO: 66537 - DNA, 7 bp, Unknown
  misc_feature (1)..( 7): Matrix.004 file - promoters50/1027406
ttataac

SEQ ID NO: 66538 - DNA, 12 bp, Unknown
  misc_feature (1)..( 12): Matrix.004 file - promoters50/1027452
acaaattttttt

SEQ ID NO: 66539 - DNA, 11 bp, Unknown
  misc_feature (1)..( 11): Matrix.004 file - promoters50/1027456
taatttcgtaa

SEQ ID NO: 66540 - DNA, 9 bp, Unknown
  misc_feature (1)..( 9): Matrix.004 file - promoters50/1027456
taaatttct

SEQ ID NO: 66541 - DNA, 10 bp, Unknown
  misc_feature (1)..( 10): Matrix.004 file - promoters50/1027460
taaaaacaat

SEQ ID NO: 66542 - DNA, 13 bp, Unknown
  misc_feature (1)..( 13): Matrix.004 file - promoters50/1027460
acaaaaatatatc

SEQ ID NO: 66543 - DNA, 11 bp, Unknown
  misc_feature (1)..( 11): Matrix.004 file - promoters50/1027460
aaaaataaaat

SEQ ID NO: 66544 - DNA, 12 bp, Unknown
  misc_feature (1)..( 12): Matrix.004 file - promoters50/1027467
accaaaaataat

SEQ ID NO: 66545 - DNA, 7 bp, Unknown
  misc_feature (1)..( 7): Matrix.004 file - promoters50/1027467
tgtaaaa

SEQ ID NO: 66546 - DNA, 8 bp, Unknown
  misc_feature (1)..( 8): Matrix.004 file - promoters50/1027492
tgtaaaaa

SEQ ID NO: 66547 - DNA, 19 bp, Unknown
  misc_feature (1)..( 19): Matrix.004 file - promoters50/1027523
ccttatataaaatcccatt

SEQ ID NO: 66548 - DNA, 10 bp, Unknown
  misc_feature (1)..( 10): Matrix.004 file - promoters50/1027590
ttttcatata

SEQ ID NO: 66549 - DNA, 10 bp, Unknown
  misc_feature (1)..( 10): Matrix.004 file - promoters50/1027590
gattcttttt

SEQ ID NO: 66550 - DNA, 13 bp, Unknown
  misc_feature (1)..( 13): Matrix.004 file - promoters50/1027596
aatttttgtatga

SEQ ID NO: 66551 - DNA, 9 bp, Unknown
  misc_feature (1)..( 9): Matrix.004 file - promoters50/1027596
ttactttct

SEQ ID NO: 66552 - DNA, 10 bp, Unknown
  misc_feature (1)..( 10): Matrix.004 file - promoters50/1027652
aatttgaaaa

SEQ ID NO: 66553 - DNA, 10 bp, Unknown
  misc_feature (1)..( 10): Matrix.004 file - promoters50/1027652
atcaattaat

SEQ ID NO: 66554 - DNA, 8 bp, Unknown
  misc_feature (1)..( 8): Matrix.004 file - promoters50/1027652
ttaagaaa

SEQ ID NO: 66555 - DNA, 12 bp, Unknown
  misc_feature (1)..( 12): Matrix.004 file - promoters50/1027652
acaaaatctcta

SEQ ID NO: 66556 - DNA, 11 bp, Unknown
  misc_feature (1)..( 11): Matrix.004 file - promoters50/1027725
aaaaattaaga

SEQ ID NO: 66557 - DNA, 6 bp, Unknown
  misc_feature (1)..( 6): Matrix.004 file - promoters50/1027725
ttgatt

SEQ ID NO: 66558 - DNA, 5 bp, Unknown
  misc_feature (1)..( 5): Matrix.004 file - promoters50/1027760
atagt

SEQ ID NO: 66559 - DNA, 14 bp, Unknown
  misc_feature (1)..( 14): Matrix.004 file - promoters50/1027760
ataaatgaaattac

SEQ ID NO: 66560 - DNA, 12 bp, Unknown
  misc_feature (1)..( 12): Matrix.004 file - promoters50/1027760
atatcatttttt

SEQ ID NO: 66561 - DNA, 14 bp, Unknown
  misc_feature (1)..( 14): Matrix.004 file - promoters50/1027762
aataagttactaat

SEQ ID NO: 66562 - DNA, 8 bp, Unknown
  misc_feature (1)..( 8): Matrix.004 file - promoters50/1027762
ttgttttg

SEQ ID NO: 66563 - DNA, 8 bp, Unknown
  misc_feature (1)..( 8): Matrix.004 file - promoters50/1027762
aataaaaa

SEQ ID NO: 66564 - DNA, 7 bp, Unknown
  misc_feature (1)..( 7): Matrix.004 file - promoters50/1027765
agtaaaa

SEQ ID NO: 66565 - DNA, 8 bp, Unknown
  misc_feature (1)..( 8): Matrix.004 file - promoters50/1027765
aaatacaa

SEQ ID NO: 66566 - DNA, 11 bp, Unknown
  misc_feature (1)..( 11): Matrix.004 file - promoters50/1027850
aattaaaaaat

SEQ ID NO: 66567 - DNA, 7 bp, Unknown
  misc_feature (1)..( 7): Matrix.004 file - promoters50/1027869
attgctt

SEQ ID NO: 66568 - DNA, 8 bp, Unknown
  misc_feature (1)..( 8): Matrix.004 file - promoters50/1027869
atcctttt

SEQ ID NO: 66569 - DNA, 8 bp, Unknown
  misc_feature (1)..( 8): Matrix.004 file - promoters50/1027873
attttatt

SEQ ID NO: 66570 - DNA, 7 bp, Unknown
  misc_feature (1)..( 7): Matrix.004 file - promoters50/1027873
ttttggt

SEQ ID NO: 66571 - DNA, 11 bp, Unknown
  misc_feature (1)..( 11): Matrix.004 file - promoters50/1027873
accaaaatcat

SEQ ID NO: 66572 - DNA, 7 bp, Unknown
  misc_feature (1)..( 7): Matrix.004 file - promoters50/1027873
attaaca

SEQ ID NO: 66573 - DNA, 13 bp, Unknown
  misc_feature (1)..( 13): Matrix.004 file - promoters50/1027877
aatgtatttttgt

SEQ ID NO: 66574 - DNA, 9 bp, Unknown
  misc_feature (1)..( 9): Matrix.004 file - promoters50/1027877
atcaagaaa

SEQ ID NO: 66575 - DNA, 8 bp, Unknown
  misc_feature (1)..( 8): Matrix.004 file - promoters50/1027885
caagaatt

SEQ ID NO: 66576 - DNA, 8 bp, Unknown
  misc_feature (1)..( 8): Matrix.004 file - promoters50/1027885
aaattctt

SEQ ID NO: 66577 - DNA, 7 bp, Unknown
  misc_feature (1)..( 7): Matrix.004 file - promoters50/1027914
tttgaaa

SEQ ID NO: 66578 - DNA, 7 bp, Unknown
  misc_feature (1)..( 7): Matrix.004 file - promoters50/1027914
ttgatta

SEQ ID NO: 66579 - DNA, 8 bp, Unknown
  misc_feature (1)..( 8): Matrix.004 file - promoters50/1027914
tctattct

SEQ ID NO: 66580 - DNA, 11 bp, Unknown
  misc_feature (1)..( 11): Matrix.004 file - promoters50/1027928
tatataataac

SEQ ID NO: 66581 - DNA, 12 bp, Unknown
  misc_feature (1)..( 12): Matrix.004 file - promoters50/1027928
ataaatttagta

SEQ ID NO: 66582 - DNA, 16 bp, Unknown
  misc_feature (1)..( 16): Matrix.004 file - promoters50/1027928
ttttaatttttttata

SEQ ID NO: 66583 - DNA, 6 bp, Unknown
  misc_feature (1)..( 6): Matrix.004 file - promoters50/1027928
tataaa

SEQ ID NO: 66584 - DNA, 9 bp, Unknown
  misc_feature (1)..( 9): Matrix.004 file - promoters50/1027928
tttttttta

SEQ ID NO: 66585 - DNA, 7 bp, Unknown
  misc_feature (1)..( 7): Matrix.004 file - promoters50/1027943
aataaaa

SEQ ID NO: 66586 - DNA, 9 bp, Unknown
  misc_feature (1)..( 9): Matrix.004 file - promoters50/1027970
agagaaaga

SEQ ID NO: 66587 - DNA, 8 bp, Unknown
  misc_feature (1)..( 8): Matrix.004 file - promoters50/1027982
taagattc

SEQ ID NO: 66588 - DNA, 10 bp, Unknown
  misc_feature (1)..( 10): Matrix.004 file - promoters50/1027982
aaattttttt

SEQ ID NO: 66589 - DNA, 6 bp, Unknown
  misc_feature (1)..( 6): Matrix.004 file - promoters50/1027982
atatat

SEQ ID NO: 66590 - DNA, 14 bp, Unknown
  misc_feature (1)..( 14): Matrix.004 file - promoters50/1027982
ttaaaataaataaa

SEQ ID NO: 66591 - DNA, 7 bp, Unknown
  misc_feature (1)..( 7): Matrix.004 file - promoters50/1027990
aaatatt

SEQ ID NO: 66592 - DNA, 9 bp, Unknown
  misc_feature (1)..( 9): Matrix.004 file - promoters50/1027990
tgtttaatt

SEQ ID NO: 66593 - DNA, 9 bp, Unknown
  misc_feature (1)..( 9): Matrix.004 file - promoters50/1028042
aagattttg

SEQ ID NO: 66594 - DNA, 7 bp, Unknown
  misc_feature (1)..( 7): Matrix.004 file - promoters50/1028042
acatgtt

SEQ ID NO: 66595 - DNA, 7 bp, Unknown
  misc_feature (1)..( 7): Matrix.004 file - promoters50/1028042
aatgtaa

SEQ ID NO: 66596 - DNA, 13 bp, Unknown
  misc_feature (1)..( 13): Matrix.004 file - promoters50/1028042
cagaaaagaaaaa

SEQ ID NO: 66597 - DNA, 8 bp, Unknown
  misc_feature (1)..( 8): Matrix.004 file - promoters50/1028042
agacgaaa

SEQ ID NO: 66598 - DNA, 12 bp, Unknown
  misc_feature (1)..( 12): Matrix.004 file - promoters50/1028049
agatcaattaac

SEQ ID NO: 66599 - DNA, 8 bp, Unknown
  misc_feature (1)..( 8): Matrix.004 file - promoters50/1028049
atttattg

SEQ ID NO: 66600 - DNA, 9 bp, Unknown
  misc_feature (1)..( 9): Matrix.004 file - promoters50/1028049
aatgttgaa

SEQ ID NO: 66601 - DNA, 10 bp, Unknown
  misc_feature (1)..( 10): Matrix.004 file - promoters50/1028049
atgaatcaat

SEQ ID NO: 66602 - DNA, 9 bp, Unknown
  misc_feature (1)..( 9): Matrix.004 file - promoters50/1028049
ggttataat

SEQ ID NO: 66603 - DNA, 10 bp, Unknown
  misc_feature (1)..( 10): Matrix.004 file - promoters50/1028084
cgattttgtt

SEQ ID NO: 66604 - DNA, 12 bp, Unknown
  misc_feature (1)..( 12): Matrix.004 file - promoters50/1028084
gaaattttattt

SEQ ID NO: 66605 - DNA, 11 bp, Unknown
  misc_feature (1)..( 11): Matrix.004 file - promoters50/1028095
ataacaatttt

SEQ ID NO: 66606 - DNA, 17 bp, Unknown
  misc_feature (1)..( 17): Matrix.004 file - promoters50/1028095
taatatgataaaattat

SEQ ID NO: 66607 - DNA, 13 bp, Unknown
  misc_feature (1)..( 13): Matrix.004 file - promoters50/1028095
taattttatttat

SEQ ID NO: 66608 - DNA, 16 bp, Unknown
  misc_feature (1)..( 16): Matrix.004 file - promoters50/1028095
ttgatataaaattata

SEQ ID NO: 66609 - DNA, 10 bp, Unknown
  misc_feature (1)..( 10): Matrix.004 file - promoters50/1028151
aatttgtttg

SEQ ID NO: 66610 - DNA, 9 bp, Unknown
  misc_feature (1)..( 9): Matrix.004 file - promoters50/1028177
tgattattt

SEQ ID NO: 66611 - DNA, 12 bp, Unknown
  misc_feature (1)..( 12): Matrix.004 file - promoters50/1028216
tcttctatcttt

SEQ ID NO: 66612 - DNA, 8 bp, Unknown
  misc_feature (1)..( 8): Matrix.004 file - promoters50/1028224
ttcttttt

SEQ ID NO: 66613 - DNA, 8 bp, Unknown
  misc_feature (1)..( 8): Matrix.004 file - promoters50/1028224
taatcagt

SEQ ID NO: 66614 - DNA, 8 bp, Unknown
  misc_feature (1)..( 8): Matrix.004 file - promoters50/1028224
atgtttat

SEQ ID NO: 66615 - DNA, 8 bp, Unknown
  misc_feature (1)..( 8): Matrix.004 file - promoters50/1028238
ttatgttt

SEQ ID NO: 66616 - DNA, 7 bp, Unknown
  misc_feature (1)..( 7): Matrix.004 file - promoters50/1028238
ctatata

SEQ ID NO: 66617 - DNA, 9 bp, Unknown
  misc_feature (1)..( 9): Matrix.004 file - promoters50/1028238
ttatatatg

SEQ ID NO: 66618 - DNA, 7 bp, Unknown
  misc_feature (1)..( 7): Matrix.004 file - promoters50/1028241
atatata

SEQ ID NO: 66619 - DNA, 8 bp, Unknown
  misc_feature (1)..( 8): Matrix.004 file - promoters50/1028241
attaaatt

SEQ ID NO: 66620 - DNA, 8 bp, Unknown
  misc_feature (1)..( 8): Matrix.004 file - promoters50/1028241
cattaaaa

SEQ ID NO: 66621 - DNA, 7 bp, Unknown
  misc_feature (1)..( 7): Matrix.004 file - promoters50/1028243
ttgttta

SEQ ID NO: 66622 - DNA, 11 bp, Unknown
  misc_feature (1)..( 11): Matrix.004 file - promoters50/1028243
aaaataaatta

SEQ ID NO: 66623 - DNA, 12 bp, Unknown
  misc_feature (1)..( 12): Matrix.004 file - promoters50/1028304
gtattatttcct

SEQ ID NO: 66624 - DNA, 11 bp, Unknown
  misc_feature (1)..( 11): Matrix.004 file - promoters50/1028304
aaacatttttt

SEQ ID NO: 66625 - DNA, 12 bp, Unknown
  misc_feature (1)..( 12): Matrix.004 file - promoters50/1028304
aaaaattttgca

SEQ ID NO: 66626 - DNA, 10 bp, Unknown
  misc_feature (1)..( 10): Matrix.004 file - promoters50/1028318
agaaaaacat

SEQ ID NO: 66627 - DNA, 11 bp, Unknown
  misc_feature (1)..( 11): Matrix.004 file - promoters50/1028318
ttttcaagaag

SEQ ID NO: 66628 - DNA, 10 bp, Unknown
  misc_feature (1)..( 10): Matrix.004 file - promoters50/1028318
ttcttaaaga

SEQ ID NO: 66629 - DNA, 12 bp, Unknown
  misc_feature (1)..( 12): Matrix.004 file - promoters50/1028318
aattaataaaaa

SEQ ID NO: 66630 - DNA, 10 bp, Unknown
  misc_feature (1)..( 10): Matrix.004 file - promoters50/1028331
gaaagtttaa

SEQ ID NO: 66631 - DNA, 10 bp, Unknown
  misc_feature (1)..( 10): Matrix.004 file - promoters50/1028331
caaaagagaa

SEQ ID NO: 66632 - DNA, 10 bp, Unknown
  misc_feature (1)..( 10): Matrix.004 file - promoters50/1028352
tgaagacgga

SEQ ID NO: 66633 - DNA, 8 bp, Unknown
  misc_feature (1)..( 8): Matrix.004 file - promoters50/1028352
aaaaaatt

SEQ ID NO: 66634 - DNA, 11 bp, Unknown
  misc_feature (1)..( 11): Matrix.004 file - promoters50/1028352
aaaaaacaaaa

SEQ ID NO: 66635 - DNA, 7 bp, Unknown
  misc_feature (1)..( 7): Matrix.004 file - promoters50/1028352
aaacacc

SEQ ID NO: 66636 - DNA, 8 bp, Unknown
  misc_feature (1)..( 8): Matrix.004 file - promoters50/1028352
aaaaaccg

SEQ ID NO: 66637 - DNA, 7 bp, Unknown
  misc_feature (1)..( 7): Matrix.004 file - promoters50/1028352
caaacac

SEQ ID NO: 66638 - DNA, 9 bp, Unknown
  misc_feature (1)..( 9): Matrix.004 file - promoters50/1028355
gaaactaaa

SEQ ID NO: 66639 - DNA, 18 bp, Unknown
  misc_feature (1)..( 18): Matrix.004 file - promoters50/1028355
attgtattatttattatt

SEQ ID NO: 66640 - DNA, 10 bp, Unknown
  misc_feature (1)..( 10): Matrix.004 file - promoters50/1028368
tatcaaatat

SEQ ID NO: 66641 - DNA, 9 bp, Unknown
  misc_feature (1)..( 9): Matrix.004 file - promoters50/1028368
attgttttc

SEQ ID NO: 66642 - DNA, 10 bp, Unknown
  misc_feature (1)..( 10): Matrix.004 file - promoters50/1028368
aaaatatata

SEQ ID NO: 66643 - DNA, 13 bp, Unknown
  misc_feature (1)..( 13): Matrix.004 file - promoters50/1028382
caaaagttttgat

SEQ ID NO: 66644 - DNA, 8 bp, Unknown
  misc_feature (1)..( 8): Matrix.004 file - promoters50/1028382
tgaagaaa

SEQ ID NO: 66645 - DNA, 8 bp, Unknown
  misc_feature (1)..( 8): Matrix.004 file - promoters50/1028402
ttggtgtt

SEQ ID NO: 66646 - DNA, 8 bp, Unknown
  misc_feature (1)..( 8): Matrix.004 file - promoters50/1028402
aaaaatgc

SEQ ID NO: 66647 - DNA, 11 bp, Unknown
  misc_feature (1)..( 11): Matrix.004 file - promoters50/1028413
ccaaagtcaac

SEQ ID NO: 66648 - DNA, 13 bp, Unknown
  misc_feature (1)..( 13): Matrix.004 file - promoters50/1028459
ttaaatttttaaa

SEQ ID NO: 66649 - DNA, 8 bp, Unknown
  misc_feature (1)..( 8): Matrix.004 file - promoters50/1028459
gtttattc

SEQ ID NO: 66650 - DNA, 9 bp, Unknown
  misc_feature (1)..( 9): Matrix.004 file - promoters50/1028459
attttggca

SEQ ID NO: 66651 - DNA, 9 bp, Unknown
  misc_feature (1)..( 9): Matrix.004 file - promoters50/1028459
taacaaatc

SEQ ID NO: 66652 - DNA, 9 bp, Unknown
  misc_feature (1)..( 9): Matrix.004 file - promoters50/1028470
cgttttgac

SEQ ID NO: 66653 - DNA, 12 bp, Unknown
  misc_feature (1)..( 12): Matrix.004 file - promoters50/1028470
ttactagatacg

SEQ ID NO: 66654 - DNA, 8 bp, Unknown
  misc_feature (1)..( 8): Matrix.004 file - promoters50/1028545
gaaataga

SEQ ID NO: 66655 - DNA, 15 bp, Unknown
  misc_feature (1)..( 15): Matrix.004 file - promoters50/1028545
ttattttaaaattgg

SEQ ID NO: 66656 - DNA, 9 bp, Unknown
  misc_feature (1)..( 9): Matrix.004 file - promoters50/1028590
ctaatttca

SEQ ID NO: 66657 - DNA, 8 bp, Unknown
  misc_feature (1)..( 8): Matrix.004 file - promoters50/1028623
aatgattg

SEQ ID NO: 66658 - DNA, 7 bp, Unknown
  misc_feature (1)..( 7): Matrix.004 file - promoters50/1028623
taagctc

SEQ ID NO: 66659 - DNA, 8 bp, Unknown
  misc_feature (1)..( 8): Matrix.004 file - promoters50/1028629
aaaacagc

SEQ ID NO: 66660 - DNA, 8 bp, Unknown
  misc_feature (1)..( 8): Matrix.004 file - promoters50/1028629
attgttga

SEQ ID NO: 66661 - DNA, 7 bp, Unknown
  misc_feature (1)..( 7): Matrix.004 file - promoters50/1028674
caattat

SEQ ID NO: 66662 - DNA, 9 bp, Unknown
  misc_feature (1)..( 9): Matrix.004 file - promoters50/1028674
ttaaaataa

SEQ ID NO: 66663 - DNA, 12 bp, Unknown
  misc_feature (1)..( 12): Matrix.004 file - promoters50/1028674
aaaatatttaaa

SEQ ID NO: 66664 - DNA, 6 bp, Unknown
  misc_feature (1)..( 6): Matrix.004 file - promoters50/1028674
atttaa

SEQ ID NO: 66665 - DNA, 10 bp, Unknown
  misc_feature (1)..( 10): Matrix.004 file - promoters50/1028674
acaattaatt

SEQ ID NO: 66666 - DNA, 6 bp, Unknown
  misc_feature (1)..( 6): Matrix.004 file - promoters50/1028674
aaataa

SEQ ID NO: 66667 - DNA, 8 bp, Unknown
  misc_feature (1)..( 8): Matrix.004 file - promoters50/1028682
attcaaat

SEQ ID NO: 66668 - DNA, 10 bp, Unknown
  misc_feature (1)..( 10): Matrix.004 file - promoters50/1028763
aaccatatta

SEQ ID NO: 66669 - DNA, 10 bp, Unknown
  misc_feature (1)..( 10): Matrix.004 file - promoters50/1028785
ctaaactaaa

SEQ ID NO: 66670 - DNA, 7 bp, Unknown
  misc_feature (1)..( 7): Matrix.004 file - promoters50/1028785
acatttt

SEQ ID NO: 66671 - DNA, 7 bp, Unknown
  misc_feature (1)..( 7): Matrix.004 file - promoters50/1028793
attacca

SEQ ID NO: 66672 - DNA, 7 bp, Unknown
  misc_feature (1)..( 7): Matrix.004 file - promoters50/1028826
ttttaaa

SEQ ID NO: 66673 - DNA, 8 bp, Unknown
  misc_feature (1)..( 8): Matrix.004 file - promoters50/1028826
aaacgttt

SEQ ID NO: 66674 - DNA, 11 bp, Unknown
  misc_feature (1)..( 11): Matrix.004 file - promoters50/1028826
tgattaatttt

SEQ ID NO: 66675 - DNA, 9 bp, Unknown
  misc_feature (1)..( 9): Matrix.004 file - promoters50/1028826
taattaaaa

SEQ ID NO: 66676 - DNA, 13 bp, Unknown
  misc_feature (1)..( 13): Matrix.004 file - promoters50/1028835
aatgttttttaaa

SEQ ID NO: 66677 - DNA, 10 bp, Unknown
  misc_feature (1)..( 10): Matrix.004 file - promoters50/1028835
ttttattaat

SEQ ID NO: 66678 - DNA, 13 bp, Unknown
  misc_feature (1)..( 13): Matrix.004 file - promoters50/1028851
tttatgaatacta

SEQ ID NO: 66679 - DNA, 11 bp, Unknown
  misc_feature (1)..( 11): Matrix.004 file - promoters50/1028851
tatatcaacca

SEQ ID NO: 66680 - DNA, 9 bp, Unknown
  misc_feature (1)..( 9): Matrix.004 file - promoters50/1028851
acaaatttt

SEQ ID NO: 66681 - DNA, 9 bp, Unknown
  misc_feature (1)..( 9): Matrix.004 file - promoters50/1028851
tcaaatttt

SEQ ID NO: 66682 - DNA, 6 bp, Unknown
  misc_feature (1)..( 6): Matrix.004 file - promoters50/1028859
acatta

SEQ ID NO: 66683 - DNA, 11 bp, Unknown
  misc_feature (1)..( 11): Matrix.004 file - promoters50/1028859
aaagatatatt

SEQ ID NO: 66684 - DNA, 15 bp, Unknown
  misc_feature (1)..( 15): Matrix.004 file - promoters50/1028859
attaaagtttaatta

SEQ ID NO: 66685 - DNA, 9 bp, Unknown
  misc_feature (1)..( 9): Matrix.004 file - promoters50/1028863
tctcttttt

SEQ ID NO: 66686 - DNA, 11 bp, Unknown
  misc_feature (1)..( 11): Matrix.004 file - promoters50/1028863
caatatgtgta

SEQ ID NO: 66687 - DNA, 12 bp, Unknown
  misc_feature (1)..( 12): Matrix.004 file - promoters50/1028866
ataaaaaaattc

SEQ ID NO: 66688 - DNA, 10 bp, Unknown
  misc_feature (1)..( 10): Matrix.004 file - promoters50/1028908
gatgcaaatt

SEQ ID NO: 66689 - DNA, 11 bp, Unknown
  misc_feature (1)..( 11): Matrix.004 file - promoters50/1028908
acaaatacgaa

SEQ ID NO: 66690 - DNA, 12 bp, Unknown
  misc_feature (1)..( 12): Matrix.004 file - promoters50/1028937
aatggttaatca

SEQ ID NO: 66691 - DNA, 11 bp, Unknown
  misc_feature (1)..( 11): Matrix.004 file - promoters50/1028937
ttaataataat

SEQ ID NO: 66692 - DNA, 10 bp, Unknown
  misc_feature (1)..( 10): Matrix.004 file - promoters50/1028937
taattatata

SEQ ID NO: 66693 - DNA, 13 bp, Unknown
  misc_feature (1)..( 13): Matrix.004 file - promoters50/1028937
acataaaaaataa

SEQ ID NO: 66694 - DNA, 7 bp, Unknown
  misc_feature (1)..( 7): Matrix.004 file - promoters50/1028937
aaaacaa

SEQ ID NO: 66695 - DNA, 10 bp, Unknown
  misc_feature (1)..( 10): Matrix.004 file - promoters50/1028937
aacctatttt

SEQ ID NO: 66696 - DNA, 10 bp, Unknown
  misc_feature (1)..( 10): Matrix.004 file - promoters50/1028937
ttaattttat

SEQ ID NO: 66697 - DNA, 9 bp, Unknown
  misc_feature (1)..( 9): Matrix.004 file - promoters50/1028937
atatattta

SEQ ID NO: 66698 - DNA, 10 bp, Unknown
  misc_feature (1)..( 10): Matrix.004 file - promoters50/1028955
gatatatttt

SEQ ID NO: 66699 - DNA, 8 bp, Unknown
  misc_feature (1)..( 8): Matrix.004 file - promoters50/1028955
ataaaatg

SEQ ID NO: 66700 - DNA, 8 bp, Unknown
  misc_feature (1)..( 8): Matrix.004 file - promoters50/1028955
atttacaa

SEQ ID NO: 66701 - DNA, 10 bp, Unknown
  misc_feature (1)..( 10): Matrix.004 file - promoters50/1028963
aaagataaat

SEQ ID NO: 66702 - DNA, 10 bp, Unknown
  misc_feature (1)..( 10): Matrix.004 file - promoters50/1028963
aaataaaata

SEQ ID NO: 66703 - DNA, 8 bp, Unknown
  misc_feature (1)..( 8): Matrix.004 file - promoters50/1028984
tatcttct

SEQ ID NO: 66704 - DNA, 7 bp, Unknown
  misc_feature (1)..( 7): Matrix.004 file - promoters50/1029005
taaaatg

SEQ ID NO: 66705 - DNA, 9 bp, Unknown
  misc_feature (1)..( 9): Matrix.004 file - promoters50/1029085
aaatttttt

SEQ ID NO: 66706 - DNA, 13 bp, Unknown
  misc_feature (1)..( 13): Matrix.004 file - promoters50/1029085
tattaaagaaaag

SEQ ID NO: 66707 - DNA, 13 bp, Unknown
  misc_feature (1)..( 13): Matrix.004 file - promoters50/1029089
tgactaatttttg

SEQ ID NO: 66708 - DNA, 9 bp, Unknown
  misc_feature (1)..( 9): Matrix.004 file - promoters50/1029089
tcaatatat

SEQ ID NO: 66709 - DNA, 7 bp, Unknown
  misc_feature (1)..( 7): Matrix.004 file - promoters50/1029089
gttaaaa

SEQ ID NO: 66710 - DNA, 9 bp, Unknown
  misc_feature (1)..( 9): Matrix.004 file - promoters50/1029089
aaaaaataa

SEQ ID NO: 66711 - DNA, 9 bp, Unknown
  misc_feature (1)..( 9): Matrix.004 file - promoters50/1029089
aaaataaaa

SEQ ID NO: 66712 - DNA, 9 bp, Unknown
  misc_feature (1)..( 9): Matrix.004 file - promoters50/1029309
tttcaatat

SEQ ID NO: 66713 - DNA, 9 bp, Unknown
  misc_feature (1)..( 9): Matrix.004 file - promoters50/1029309
tgtgactca

SEQ ID NO: 66714 - DNA, 8 bp, Unknown
  misc_feature (1)..( 8): Matrix.004 file - promoters50/1029315
ttgatgaa

SEQ ID NO: 66715 - DNA, 11 bp, Unknown
  misc_feature (1)..( 11): Matrix.004 file - promoters50/1029315
aggatttgatc

SEQ ID NO: 66716 - DNA, 12 bp, Unknown
  misc_feature (1)..( 12): Matrix.004 file - promoters50/1029315
aacaatccacgc

SEQ ID NO: 66717 - DNA, 9 bp, Unknown
  misc_feature (1)..( 9): Matrix.004 file - promoters50/1029315
ccaatataa

SEQ ID NO: 66718 - DNA, 11 bp, Unknown
  misc_feature (1)..( 11): Matrix.004 file - promoters50/1029349
agaaaaagtaa

SEQ ID NO: 66719 - DNA, 7 bp, Unknown
  misc_feature (1)..( 7): Matrix.004 file - promoters50/1029349
tatgaat

SEQ ID NO: 66720 - DNA, 8 bp, Unknown
  misc_feature (1)..( 8): Matrix.004 file - promoters50/1029395
ctaaaaac

SEQ ID NO: 66721 - DNA, 9 bp, Unknown
  misc_feature (1)..( 9): Matrix.004 file - promoters50/1029395
aattgatga

SEQ ID NO: 66722 - DNA, 9 bp, Unknown
  misc_feature (1)..( 9): Matrix.004 file - promoters50/1029395
tttatttga

SEQ ID NO: 66723 - DNA, 10 bp, Unknown
  misc_feature (1)..( 10): Matrix.004 file - promoters50/1029395
tttaaagttt

SEQ ID NO: 66724 - DNA, 9 bp, Unknown
  misc_feature (1)..( 9): Matrix.004 file - promoters50/1029395
aaaagatta

SEQ ID NO: 66725 - DNA, 15 bp, Unknown
  misc_feature (1)..( 15): Matrix.004 file - promoters50/1029433
attgtatcttattac

SEQ ID NO: 66726 - DNA, 9 bp, Unknown
  misc_feature (1)..( 9): Matrix.004 file - promoters50/1029444
tattataaa

SEQ ID NO: 66727 - DNA, 11 bp, Unknown
  misc_feature (1)..( 11): Matrix.004 file - promoters50/1029444
aaaattttgat

SEQ ID NO: 66728 - DNA, 8 bp, Unknown
  misc_feature (1)..( 8): Matrix.004 file - promoters50/1029444
tataattt

SEQ ID NO: 66729 - DNA, 10 bp, Unknown
  misc_feature (1)..( 10): Matrix.004 file - promoters50/1029543
actaaaaaaa

SEQ ID NO: 66730 - DNA, 8 bp, Unknown
  misc_feature (1)..( 8): Matrix.004 file - promoters50/1029543
tttattat

SEQ ID NO: 66731 - DNA, 8 bp, Unknown
  misc_feature (1)..( 8): Matrix.004 file - promoters50/1029576
attacttc

SEQ ID NO: 66732 - DNA, 9 bp, Unknown
  misc_feature (1)..( 9): Matrix.004 file - promoters50/1029576
tttaacatt

SEQ ID NO: 66733 - DNA, 11 bp, Unknown
  misc_feature (1)..( 11): Matrix.004 file - promoters50/1029576
tttaacattct

SEQ ID NO: 66734 - DNA, 7 bp, Unknown
  misc_feature (1)..( 7): Matrix.004 file - promoters50/1029576
aaaaatt

SEQ ID NO: 66735 - DNA, 13 bp, Unknown
  misc_feature (1)..( 13): Matrix.004 file - promoters50/1029576
gagagatgtattt

SEQ ID NO: 66736 - DNA, 7 bp, Unknown
  misc_feature (1)..( 7): Matrix.004 file - promoters50/1029576
ataaaaa

SEQ ID NO: 66737 - DNA, 8 bp, Unknown
  misc_feature (1)..( 8): Matrix.004 file - promoters50/1029590
tatttgag

SEQ ID NO: 66738 - DNA, 7 bp, Unknown
  misc_feature (1)..( 7): Matrix.004 file - promoters50/1029590
atctgat

SEQ ID NO: 66739 - DNA, 9 bp, Unknown
  misc_feature (1)..( 9): Matrix.004 file - promoters50/1029636
ttttcctaa

SEQ ID NO: 66740 - DNA, 15 bp, Unknown
  misc_feature (1)..( 15): Matrix.004 file - promoters50/1029636
attgttataaaaaaa

SEQ ID NO: 66741 - DNA, 12 bp, Unknown
  misc_feature (1)..( 12): Matrix.004 file - promoters50/1029636
gttcggttcgat

SEQ ID NO: 66742 - DNA, 11 bp, Unknown
  misc_feature (1)..( 11): Matrix.004 file - promoters50/1029791
aataaatttat

SEQ ID NO: 66743 - DNA, 7 bp, Unknown
  misc_feature (1)..( 7): Matrix.004 file - promoters50/1029794
gaacaat

SEQ ID NO: 66744 - DNA, 8 bp, Unknown
  misc_feature (1)..( 8): Matrix.004 file - promoters50/1029837
ttaataaa

SEQ ID NO: 66745 - DNA, 10 bp, Unknown
  misc_feature (1)..( 10): Matrix.004 file - promoters50/1029837
aataatatac

SEQ ID NO: 66746 - DNA, 10 bp, Unknown
  misc_feature (1)..( 10): Matrix.004 file - promoters50/1029841
aagttttgtg

SEQ ID NO: 66747 - DNA, 11 bp, Unknown
  misc_feature (1)..( 11): Matrix.004 file - promoters50/1029892
cttaaataatc

SEQ ID NO: 66748 - DNA, 9 bp, Unknown
  misc_feature (1)..( 9): Matrix.004 file - promoters50/1029908
gaagaagaa

SEQ ID NO: 66749 - DNA, 11 bp, Unknown
  misc_feature (1)..( 11): Matrix.004 file - promoters50/1029908
aaaaaagattt

SEQ ID NO: 66750 - DNA, 9 bp, Unknown
  misc_feature (1)..( 9): Matrix.004 file - promoters50/1029952
ttaatatat

SEQ ID NO: 66751 - DNA, 9 bp, Unknown
  misc_feature (1)..( 9): Matrix.004 file - promoters50/1029952
cttatatac

SEQ ID NO: 66752 - DNA, 11 bp, Unknown
  misc_feature (1)..( 11): Matrix.004 file - promoters50/1029952
tcaagaaaaaa

SEQ ID NO: 66753 - DNA, 10 bp, Unknown
  misc_feature (1)..( 10): Matrix.004 file - promoters50/1030069
aataggccca

SEQ ID NO: 66754 - DNA, 8 bp, Unknown
  misc_feature (1)..( 8): Matrix.004 file - promoters50/1030069
aataataa

SEQ ID NO: 66755 - DNA, 7 bp, Unknown
  misc_feature (1)..( 7): Matrix.004 file - promoters50/1030069
aataata

SEQ ID NO: 66756 - DNA, 8 bp, Unknown
  misc_feature (1)..( 8): Matrix.004 file - promoters50/1030126
aatagtgg

SEQ ID NO: 66757 - DNA, 10 bp, Unknown
  misc_feature (1)..( 10): Matrix.004 file - promoters50/1030126
taatcaaaaa

SEQ ID NO: 66758 - DNA, 19 bp, Unknown
  misc_feature (1)..( 19): Matrix.004 file - promoters50/1030126
aaataaatttttgaattta

SEQ ID NO: 66759 - DNA, 11 bp, Unknown
  misc_feature (1)..( 11): Matrix.004 file - promoters50/1030126
aaatgtatgat

SEQ ID NO: 66760 - DNA, 7 bp, Unknown
  misc_feature (1)..( 7): Matrix.004 file - promoters50/1030126
taatcaa

SEQ ID NO: 66761 - DNA, 9 bp, Unknown
  misc_feature (1)..( 9): Matrix.004 file - promoters50/1030126
attattata

SEQ ID NO: 66762 - DNA, 9 bp, Unknown
  misc_feature (1)..( 9): Matrix.004 file - promoters50/1030139
aaacaaaat

SEQ ID NO: 66763 - DNA, 9 bp, Unknown
  misc_feature (1)..( 9): Matrix.004 file - promoters50/1030139
ataagaaac

SEQ ID NO: 66764 - DNA, 10 bp, Unknown
  misc_feature (1)..( 10): Matrix.004 file - promoters50/1030157
tgattagtaa

SEQ ID NO: 66765 - DNA, 10 bp, Unknown
  misc_feature (1)..( 10): Matrix.004 file - promoters50/1030192
tgaaatatca

SEQ ID NO: 66766 - DNA, 8 bp, Unknown
  misc_feature (1)..( 8): Matrix.004 file - promoters50/1030223
ttgtttta

SEQ ID NO: 66767 - DNA, 16 bp, Unknown
  misc_feature (1)..( 16): Matrix.004 file - promoters50/1030223
tataatactctgatac

SEQ ID NO: 66768 - DNA, 26 bp, Unknown
  misc_feature (1)..( 26): Matrix.004 file - promoters50/1030223
tgtgataaatttcctttaactttact

SEQ ID NO: 66769 - DNA, 15 bp, Unknown
  misc_feature (1)..( 15): Matrix.004 file - promoters50/1030223
ttttgataaaatatt

SEQ ID NO: 66770 - DNA, 9 bp, Unknown
  misc_feature (1)..( 9): Matrix.004 file - promoters50/1030223
ttcgtttct

SEQ ID NO: 66771 - DNA, 16 bp, Unknown
  misc_feature (1)..( 16): Matrix.004 file - promoters50/1030223
cgtttctataaataga

SEQ ID NO: 66772 - DNA, 10 bp, Unknown
  misc_feature (1)..( 10): Matrix.004 file - promoters50/1030231
aaatttgatc

SEQ ID NO: 66773 - DNA, 9 bp, Unknown
  misc_feature (1)..( 9): Matrix.004 file - promoters50/1030242
cgaaaattg

SEQ ID NO: 66774 - DNA, 8 bp, Unknown
  misc_feature (1)..( 8): Matrix.004 file - promoters50/1030242
caattatt

SEQ ID NO: 66775 - DNA, 8 bp, Unknown
  misc_feature (1)..( 8): Matrix.004 file - promoters50/1030283
taaaaaac

SEQ ID NO: 66776 - DNA, 13 bp, Unknown
  misc_feature (1)..( 13): Matrix.004 file - promoters50/1030312
aaaatttttacct

SEQ ID NO: 66777 - DNA, 12 bp, Unknown
  misc_feature (1)..( 12): Matrix.004 file - promoters50/1030312
caggttctgaga

SEQ ID NO: 66778 - DNA, 9 bp, Unknown
  misc_feature (1)..( 9): Matrix.004 file - promoters50/1030321
gatctcaga

SEQ ID NO: 66779 - DNA, 8 bp, Unknown
  misc_feature (1)..( 8): Matrix.004 file - promoters50/1030324
gatgttgt

SEQ ID NO: 66780 - DNA, 19 bp, Unknown
  misc_feature (1)..( 19): Matrix.004 file - promoters50/1030324
aatatataaatcccttaaa

SEQ ID NO: 66781 - DNA, 14 bp, Unknown
  misc_feature (1)..( 14): Matrix.004 file - promoters50/1030324
tctatgaatcatgt

SEQ ID NO: 66782 - DNA, 12 bp, Unknown
  misc_feature (1)..( 12): Matrix.004 file - promoters50/1030324
tttataaaacac

SEQ ID NO: 66783 - DNA, 14 bp, Unknown
  misc_feature (1)..( 14): Matrix.004 file - promoters50/1030329
gatcataatttagc

SEQ ID NO: 66784 - DNA, 9 bp, Unknown
  misc_feature (1)..( 9): Matrix.004 file - promoters50/1030329
tttagaaaa

SEQ ID NO: 66785 - DNA, 8 bp, Unknown
  misc_feature (1)..( 8): Matrix.004 file - promoters50/1030336
tttgaaac

SEQ ID NO: 66786 - DNA, 6 bp, Unknown
  misc_feature (1)..( 6): Matrix.004 file - promoters50/1030336
aggaaa

SEQ ID NO: 66787 - DNA, 9 bp, Unknown
  misc_feature (1)..( 9): Matrix.004 file - promoters50/1030336
ccagaagaa

SEQ ID NO: 66788 - DNA, 8 bp, Unknown
  misc_feature (1)..( 8): Matrix.004 file - promoters50/1030336
aagagatt

SEQ ID NO: 66789 - DNA, 10 bp, Unknown
  misc_feature (1)..( 10): Matrix.004 file - promoters50/1030336
aatccttcaa

SEQ ID NO: 66790 - DNA, 9 bp, Unknown
  misc_feature (1)..( 9): Matrix.004 file - promoters50/1030410
ttgagaatg

SEQ ID NO: 66791 - DNA, 8 bp, Unknown
  misc_feature (1)..( 8): Matrix.004 file - promoters50/1030428
cttttttc

SEQ ID NO: 66792 - DNA, 7 bp, Unknown
  misc_feature (1)..( 7): Matrix.004 file - promoters50/1030481
tataaag

SEQ ID NO: 66793 - DNA, 8 bp, Unknown
  misc_feature (1)..( 8): Matrix.004 file - promoters50/1030481
caataaaa

SEQ ID NO: 66794 - DNA, 7 bp, Unknown
  misc_feature (1)..( 7): Matrix.004 file - promoters50/1030481
caagaaa

SEQ ID NO: 66795 - DNA, 11 bp, Unknown
  misc_feature (1)..( 11): Matrix.004 file - promoters50/1030481
aattaacagaa

SEQ ID NO: 66796 - DNA, 8 bp, Unknown
  misc_feature (1)..( 8): Matrix.004 file - promoters50/1030481
tctcatga

SEQ ID NO: 66797 - DNA, 8 bp, Unknown
  misc_feature (1)..( 8): Matrix.004 file - promoters50/1030481
gacgatat

SEQ ID NO: 66798 - DNA, 9 bp, Unknown
  misc_feature (1)..( 9): Matrix.004 file - promoters50/1030481
actcatctt

SEQ ID NO: 66799 - DNA, 9 bp, Unknown
  misc_feature (1)..( 9): Matrix.004 file - promoters50/1030519
ctcacccat

SEQ ID NO: 66800 - DNA, 10 bp, Unknown
  misc_feature (1)..( 10): Matrix.004 file - promoters50/1030519
aagaacaaaa

SEQ ID NO: 66801 - DNA, 8 bp, Unknown
  misc_feature (1)..( 8): Matrix.004 file - promoters50/1030519
aaaacaaa

SEQ ID NO: 66802 - DNA, 9 bp, Unknown
  misc_feature (1)..( 9): Matrix.004 file - promoters50/1030519
attcttatc

SEQ ID NO: 66803 - DNA, 8 bp, Unknown
  misc_feature (1)..( 8): Matrix.004 file - promoters50/1030528
aaagcttg

SEQ ID NO: 66804 - DNA, 10 bp, Unknown
  misc_feature (1)..( 10): Matrix.004 file - promoters50/1030528
ttattaaaaa

SEQ ID NO: 66805 - DNA, 10 bp, Unknown
  misc_feature (1)..( 10): Matrix.004 file - promoters50/1030528
aataataata

SEQ ID NO: 66806 - DNA, 12 bp, Unknown
  misc_feature (1)..( 12): Matrix.004 file - promoters50/1030528
gttaattttatt

SEQ ID NO: 66807 - DNA, 12 bp, Unknown
  misc_feature (1)..( 12): Matrix.004 file - promoters50/1030528
taaatgattaaa

SEQ ID NO: 66808 - DNA, 13 bp, Unknown
  misc_feature (1)..( 13): Matrix.004 file - promoters50/1030528
gtataaattatat

SEQ ID NO: 66809 - DNA, 10 bp, Unknown
  misc_feature (1)..( 10): Matrix.004 file - promoters50/1030528
aaaattgtta

SEQ ID NO: 66810 - DNA, 13 bp, Unknown
  misc_feature (1)..( 13): Matrix.004 file - promoters50/1030530
ttatcaaaagaat

SEQ ID NO: 66811 - DNA, 9 bp, Unknown
  misc_feature (1)..( 9): Matrix.004 file - promoters50/1030530
tgaaaaaaa

SEQ ID NO: 66812 - DNA, 11 bp, Unknown
  misc_feature (1)..( 11): Matrix.004 file - promoters50/1030581
ggaaaaaaaaa

SEQ ID NO: 66813 - DNA, 9 bp, Unknown
  misc_feature (1)..( 9): Matrix.004 file - promoters50/1030581
gaagtgtaa

SEQ ID NO: 66814 - DNA, 10 bp, Unknown
  misc_feature (1)..( 10): Matrix.004 file - promoters50/1030591
acaaaaatca

SEQ ID NO: 66815 - DNA, 8 bp, Unknown
  misc_feature (1)..( 8): Matrix.004 file - promoters50/1030591
gttattgg

SEQ ID NO: 66816 - DNA, 8 bp, Unknown
  misc_feature (1)..( 8): Matrix.004 file - promoters50/1030605
aaatagat

SEQ ID NO: 66817 - DNA, 14 bp, Unknown
  misc_feature (1)..( 14): Matrix.004 file - promoters50/1030605
attttgaaatcatg

SEQ ID NO: 66818 - DNA, 11 bp, Unknown
  misc_feature (1)..( 11): Matrix.004 file - promoters50/1030605
aaaaaaatatt

SEQ ID NO: 66819 - DNA, 11 bp, Unknown
  misc_feature (1)..( 11): Matrix.004 file - promoters50/1030605
aaaatatattt

SEQ ID NO: 66820 - DNA, 7 bp, Unknown
  misc_feature (1)..( 7): Matrix.004 file - promoters50/1030605
aaaaaaa

SEQ ID NO: 66821 - DNA, 14 bp, Unknown
  misc_feature (1)..( 14): Matrix.004 file - promoters50/1030605
atattgaaataatg

SEQ ID NO: 66822 - DNA, 13 bp, Unknown
  misc_feature (1)..( 13): Matrix.004 file - promoters50/1030616
acaaataaattaa

SEQ ID NO: 66823 - DNA, 8 bp, Unknown
  misc_feature (1)..( 8): Matrix.004 file - promoters50/1030616
gaaaatat

SEQ ID NO: 66824 - DNA, 11 bp, Unknown
  misc_feature (1)..( 11): Matrix.004 file - promoters50/1030616
atgtaaaatat

SEQ ID NO: 66825 - DNA, 13 bp, Unknown
  misc_feature (1)..( 13): Matrix.004 file - promoters50/1030616
aaaaatttaattt

SEQ ID NO: 66826 - DNA, 8 bp, Unknown
  misc_feature (1)..( 8): Matrix.004 file - promoters50/1030616
aataaaag

SEQ ID NO: 66827 - DNA, 13 bp, Unknown
  misc_feature (1)..( 13): Matrix.004 file - promoters50/1030715
atataattaaacg

SEQ ID NO: 66828 - DNA, 11 bp, Unknown
  misc_feature (1)..( 11): Matrix.004 file - promoters50/1030715
atatatttcaa

SEQ ID NO: 66829 - DNA, 10 bp, Unknown
  misc_feature (1)..( 10): Matrix.004 file - promoters50/1030757
ttcttaaaga

SEQ ID NO: 66830 - DNA, 11 bp, Unknown
  misc_feature (1)..( 11): Matrix.004 file - promoters50/1030757
caaatacattt

SEQ ID NO: 66831 - DNA, 9 bp, Unknown
  misc_feature (1)..( 9): Matrix.004 file - promoters50/1030757
caatttatt

SEQ ID NO: 66832 - DNA, 12 bp, Unknown
  misc_feature (1)..( 12): Matrix.004 file - promoters50/1030757
aacacttttata

SEQ ID NO: 66833 - DNA, 10 bp, Unknown
  misc_feature (1)..( 10): Matrix.004 file - promoters50/1030771
acggatatag

SEQ ID NO: 66834 - DNA, 9 bp, Unknown
  misc_feature (1)..( 9): Matrix.004 file - promoters50/1030771
tgaaaaaaa

SEQ ID NO: 66835 - DNA, 8 bp, Unknown
  misc_feature (1)..( 8): Matrix.004 file - promoters50/1030803
aaaaaaaa

SEQ ID NO: 66836 - DNA, 9 bp, Unknown
  misc_feature (1)..( 9): Matrix.004 file - promoters50/1030821
tcggtgaag

SEQ ID NO: 66837 - DNA, 14 bp, Unknown
  misc_feature (1)..( 14): Matrix.004 file - promoters50/1030821
aaacaatgtactga

SEQ ID NO: 66838 - DNA, 9 bp, Unknown
  misc_feature (1)..( 9): Matrix.004 file - promoters50/1030821
ctatccaaa

SEQ ID NO: 66839 - DNA, 10 bp, Unknown
  misc_feature (1)..( 10): Matrix.004 file - promoters50/1030916
atattgttgc

SEQ ID NO: 66840 - DNA, 13 bp, Unknown
  misc_feature (1)..( 13): Matrix.004 file - promoters50/1030916
aattcaaaatcat

SEQ ID NO: 66841 - DNA, 10 bp, Unknown
  misc_feature (1)..( 10): Matrix.004 file - promoters50/1030916
gtttgctttt

SEQ ID NO: 66842 - DNA, 12 bp, Unknown
  misc_feature (1)..( 12): Matrix.004 file - promoters50/1030916
gttaattgttgt

SEQ ID NO: 66843 - DNA, 8 bp, Unknown
  misc_feature (1)..( 8): Matrix.004 file - promoters50/1030916
tcaaaata

SEQ ID NO: 66844 - DNA, 12 bp, Unknown
  misc_feature (1)..( 12): Matrix.004 file - promoters50/1030918
attaattgttgt

SEQ ID NO: 66845 - DNA, 8 bp, Unknown
  misc_feature (1)..( 8): Matrix.004 file - promoters50/1030933
tttattga

SEQ ID NO: 66846 - DNA, 14 bp, Unknown
  misc_feature (1)..( 14): Matrix.004 file - promoters50/1030940
agaagatactaaaa

SEQ ID NO: 66847 - DNA, 9 bp, Unknown
  misc_feature (1)..( 9): Matrix.004 file - promoters50/1030940
tcaaatgat

SEQ ID NO: 66848 - DNA, 11 bp, Unknown
  misc_feature (1)..( 11): Matrix.004 file - promoters50/1030940
aaaaatatgtt

SEQ ID NO: 66849 - DNA, 10 bp, Unknown
  misc_feature (1)..( 10): Matrix.004 file - promoters50/1030940
aaaaaagaaa

SEQ ID NO: 66850 - DNA, 10 bp, Unknown
  misc_feature (1)..( 10): Matrix.004 file - promoters50/1030940
aaagaaatat

SEQ ID NO: 66851 - DNA, 17 bp, Unknown
  misc_feature (1)..( 17): Matrix.004 file - promoters50/1030940
ctaaattttatttgatc

SEQ ID NO: 66852 - DNA, 9 bp, Unknown
  misc_feature (1)..( 9): Matrix.004 file - promoters50/1030956
aaactttta

SEQ ID NO: 66853 - DNA, 9 bp, Unknown
  misc_feature (1)..( 9): Matrix.004 file - promoters50/1030956
ttttttact

SEQ ID NO: 66854 - DNA, 9 bp, Unknown
  misc_feature (1)..( 9): Matrix.004 file - promoters50/1030956
aaatcaaat

SEQ ID NO: 66855 - DNA, 12 bp, Unknown
  misc_feature (1)..( 12): Matrix.004 file - promoters50/1030956
aattatgacaat

SEQ ID NO: 66856 - DNA, 12 bp, Unknown
  misc_feature (1)..( 12): Matrix.004 file - promoters50/1030956
ccaactaaggca

SEQ ID NO: 66857 - DNA, 7 bp, Unknown
  misc_feature (1)..( 7): Matrix.004 file - promoters50/1030956
aataaaa

SEQ ID NO: 66858 - DNA, 7 bp, Unknown
  misc_feature (1)..( 7): Matrix.004 file - promoters50/1030956
aatataa

SEQ ID NO: 66859 - DNA, 8 bp, Unknown
  misc_feature (1)..( 8): Matrix.004 file - promoters50/1031035
aaaacaaa

SEQ ID NO: 66860 - DNA, 10 bp, Unknown
  misc_feature (1)..( 10): Matrix.004 file - promoters50/1031035
acaaacaaaa

SEQ ID NO: 66861 - DNA, 8 bp, Unknown
  misc_feature (1)..( 8): Matrix.004 file - promoters50/1031035
ttttgatt

SEQ ID NO: 66862 - DNA, 7 bp, Unknown
  misc_feature (1)..( 7): Matrix.004 file - promoters50/1031045
acaaaaa

SEQ ID NO: 66863 - DNA, 9 bp, Unknown
  misc_feature (1)..( 9): Matrix.004 file - promoters50/1031045
acatttaaa

SEQ ID NO: 66864 - DNA, 8 bp, Unknown
  misc_feature (1)..( 8): Matrix.004 file - promoters50/1031048
ttccaaaa

SEQ ID NO: 66865 - DNA, 9 bp, Unknown
  misc_feature (1)..( 9): Matrix.004 file - promoters50/1031052
aaaattaaa

SEQ ID NO: 66866 - DNA, 10 bp, Unknown
  misc_feature (1)..( 10): Matrix.004 file - promoters50/1031052
ttgataaaaa

SEQ ID NO: 66867 - DNA, 16 bp, Unknown
  misc_feature (1)..( 16): Matrix.004 file - promoters50/1031070
catcttctaaaattca

SEQ ID NO: 66868 - DNA, 9 bp, Unknown
  misc_feature (1)..( 9): Matrix.004 file - promoters50/1031070
ttgatttgt

SEQ ID NO: 66869 - DNA, 11 bp, Unknown
  misc_feature (1)..( 11): Matrix.004 file - promoters50/1031070
tttaaagatat

SEQ ID NO: 66870 - DNA, 8 bp, Unknown
  misc_feature (1)..( 8): Matrix.004 file - promoters50/1031074
gtttttct

SEQ ID NO: 66871 - DNA, 7 bp, Unknown
  misc_feature (1)..( 7): Matrix.004 file - promoters50/1031084
taataaa

SEQ ID NO: 66872 - DNA, 9 bp, Unknown
  misc_feature (1)..( 9): Matrix.004 file - promoters50/1031084
tagagaatg

SEQ ID NO: 66873 - DNA, 8 bp, Unknown
  misc_feature (1)..( 8): Matrix.004 file - promoters50/1031084
taataagt

SEQ ID NO: 66874 - DNA, 12 bp, Unknown
  misc_feature (1)..( 12): Matrix.004 file - promoters50/1031084
aaaatagaaaaa

SEQ ID NO: 66875 - DNA, 7 bp, Unknown
  misc_feature (1)..( 7): Matrix.004 file - promoters50/1031084
atcaaaa

SEQ ID NO: 66876 - DNA, 7 bp, Unknown
  misc_feature (1)..( 7): Matrix.004 file - promoters50/1031084
tcaaaag

SEQ ID NO: 66877 - DNA, 7 bp, Unknown
  misc_feature (1)..( 7): Matrix.004 file - promoters50/1031084
attaaaa

SEQ ID NO: 66878 - DNA, 7 bp, Unknown
  misc_feature (1)..( 7): Matrix.004 file - promoters50/1031084
taaacca

SEQ ID NO: 66879 - DNA, 9 bp, Unknown
  misc_feature (1)..( 9): Matrix.004 file - promoters50/1031103
acaagcagt

SEQ ID NO: 66880 - DNA, 12 bp, Unknown
  misc_feature (1)..( 12): Matrix.004 file - promoters50/1031198
tgtgttatttca

SEQ ID NO: 66881 - DNA, 8 bp, Unknown
  misc_feature (1)..( 8): Matrix.004 file - promoters50/1031198
ttactaaa

SEQ ID NO: 66882 - DNA, 11 bp, Unknown
  misc_feature (1)..( 11): Matrix.004 file - promoters50/1031198
tcaaatgaaat

SEQ ID NO: 66883 - DNA, 7 bp, Unknown
  misc_feature (1)..( 7): Matrix.004 file - promoters50/1031198
aatttgt

SEQ ID NO: 66884 - DNA, 9 bp, Unknown
  misc_feature (1)..( 9): Matrix.004 file - promoters50/1031198
tttgaatat

SEQ ID NO: 66885 - DNA, 14 bp, Unknown
  misc_feature (1)..( 14): Matrix.004 file - promoters50/1031198
ataagttattaatc

SEQ ID NO: 66886 - DNA, 11 bp, Unknown
  misc_feature (1)..( 11): Matrix.004 file - promoters50/1031198
agttattaaac

SEQ ID NO: 66887 - DNA, 8 bp, Unknown
  misc_feature (1)..( 8): Matrix.004 file - promoters50/1031198
taagatta

SEQ ID NO: 66888 - DNA, 9 bp, Unknown
  misc_feature (1)..( 9): Matrix.004 file - promoters50/1031198
ctaacaaga

SEQ ID NO: 66889 - DNA, 8 bp, Unknown
  misc_feature (1)..( 8): Matrix.004 file - promoters50/1031198
aaaagttt

SEQ ID NO: 66890 - DNA, 10 bp, Unknown
  misc_feature (1)..( 10): Matrix.004 file - promoters50/1031198
agttattcat

SEQ ID NO: 66891 - DNA, 11 bp, Unknown
  misc_feature (1)..( 11): Matrix.004 file - promoters50/1031198
aaaacttcatc

SEQ ID NO: 66892 - DNA, 8 bp, Unknown
  misc_feature (1)..( 8): Matrix.004 file - promoters50/1031208
attttttt

SEQ ID NO: 66893 - DNA, 7 bp, Unknown
  misc_feature (1)..( 7): Matrix.004 file - promoters50/1031208
ttttgtt

SEQ ID NO: 66894 - DNA, 7 bp, Unknown
  misc_feature (1)..( 7): Matrix.004 file - promoters50/1031208
ttatttg

SEQ ID NO: 66895 - DNA, 10 bp, Unknown
  misc_feature (1)..( 10): Matrix.004 file - promoters50/1031208
ttattctcta

SEQ ID NO: 66896 - DNA, 11 bp, Unknown
  misc_feature (1)..( 11): Matrix.004 file - promoters50/1031208
aaaagtaaaaa

SEQ ID NO: 66897 - DNA, 8 bp, Unknown
  misc_feature (1)..( 8): Matrix.004 file - promoters50/1031208
aatttttt

SEQ ID NO: 66898 - DNA, 10 bp, Unknown
  misc_feature (1)..( 10): Matrix.004 file - promoters50/1031225
tcaattaaaa

SEQ ID NO: 66899 - DNA, 7 bp, Unknown
  misc_feature (1)..( 7): Matrix.004 file - promoters50/1031225
ttttgat

SEQ ID NO: 66900 - DNA, 10 bp, Unknown
  misc_feature (1)..( 10): Matrix.004 file - promoters50/1031267
gattatctac

SEQ ID NO: 66901 - DNA, 9 bp, Unknown
  misc_feature (1)..( 9): Matrix.004 file - promoters50/1031267
tttactttt

SEQ ID NO: 66902 - DNA, 7 bp, Unknown
  misc_feature (1)..( 7): Matrix.004 file - promoters50/1031267
gtttcat

SEQ ID NO: 66903 - DNA, 12 bp, Unknown
  misc_feature (1)..( 12): Matrix.004 file - promoters50/1031267
aaaaattttaat

SEQ ID NO: 66904 - DNA, 13 bp, Unknown
  misc_feature (1)..( 13): Matrix.004 file - promoters50/1031267
ttaaacaaaagaa

SEQ ID NO: 66905 - DNA, 14 bp, Unknown
  misc_feature (1)..( 14): Matrix.004 file - promoters50/1031267
tataacaaaaaaat

SEQ ID NO: 66906 - DNA, 15 bp, Unknown
  misc_feature (1)..( 15): Matrix.004 file - promoters50/1031267
cacaaattttatttt

SEQ ID NO: 66907 - DNA, 14 bp, Unknown
  misc_feature (1)..( 14): Matrix.004 file - promoters50/1031267
caaacttttacttt

SEQ ID NO: 66908 - DNA, 11 bp, Unknown
  misc_feature (1)..( 11): Matrix.004 file - promoters50/1031299
aaacttttatt

SEQ ID NO: 66909 - DNA, 7 bp, Unknown
  misc_feature (1)..( 7): Matrix.004 file - promoters50/1031299
taaacat

SEQ ID NO: 66910 - DNA, 16 bp, Unknown
  misc_feature (1)..( 16): Matrix.004 file - promoters50/1031299
ttaatttaactgataa

SEQ ID NO: 66911 - DNA, 8 bp, Unknown
  misc_feature (1)..( 8): Matrix.004 file - promoters50/1031299
agatttta

SEQ ID NO: 66912 - DNA, 8 bp, Unknown
  misc_feature (1)..( 8): Matrix.004 file - promoters50/1031299
aaatatat

SEQ ID NO: 66913 - DNA, 10 bp, Unknown
  misc_feature (1)..( 10): Matrix.004 file - promoters50/1031299
acaattttta

SEQ ID NO: 66914 - DNA, 8 bp, Unknown
  misc_feature (1)..( 8): Matrix.004 file - promoters50/1031299
tttaaaat

SEQ ID NO: 66915 - DNA, 7 bp, Unknown
  misc_feature (1)..( 7): Matrix.004 file - promoters50/1031299
aatgtta

SEQ ID NO: 66916 - DNA, 14 bp, Unknown
  misc_feature (1)..( 14): Matrix.004 file - promoters50/1031299
taatttaaaataaa

SEQ ID NO: 66917 - DNA, 8 bp, Unknown
  misc_feature (1)..( 8): Matrix.004 file - promoters50/1031332
tataaata

SEQ ID NO: 66918 - DNA, 8 bp, Unknown
  misc_feature (1)..( 8): Matrix.004 file - promoters50/1031332
acatatgt

SEQ ID NO: 66919 - DNA, 7 bp, Unknown
  misc_feature (1)..( 7): Matrix.004 file - promoters50/1031332
cattttc

SEQ ID NO: 66920 - DNA, 8 bp, Unknown
  misc_feature (1)..( 8): Matrix.004 file - promoters50/1031336
aagtataa

SEQ ID NO: 66921 - DNA, 7 bp, Unknown
  misc_feature (1)..( 7): Matrix.004 file - promoters50/1031336
ttcttct

SEQ ID NO: 66922 - DNA, 10 bp, Unknown
  misc_feature (1)..( 10): Matrix.004 file - promoters50/1031336
aaaacaaaaa

SEQ ID NO: 66923 - DNA, 10 bp, Unknown
  misc_feature (1)..( 10): Matrix.004 file - promoters50/1031344
attaaaggaa

SEQ ID NO: 66924 - DNA, 9 bp, Unknown
  misc_feature (1)..( 9): Matrix.004 file - promoters50/1031344
taattatta

SEQ ID NO: 66925 - DNA, 7 bp, Unknown
  misc_feature (1)..( 7): Matrix.004 file - promoters50/1031344
aaaattg

SEQ ID NO: 66926 - DNA, 9 bp, Unknown
  misc_feature (1)..( 9): Matrix.004 file - promoters50/1031344
ctaataaaa

SEQ ID NO: 66927 - DNA, 14 bp, Unknown
  misc_feature (1)..( 14): Matrix.004 file - promoters50/1031344
gtgaaattcatttg

SEQ ID NO: 66928 - DNA, 11 bp, Unknown
  misc_feature (1)..( 11): Matrix.004 file - promoters50/1031344
aaaactattta

SEQ ID NO: 66929 - DNA, 8 bp, Unknown
  misc_feature (1)..( 8): Matrix.004 file - promoters50/1031368
ataaaaag

SEQ ID NO: 66930 - DNA, 10 bp, Unknown
  misc_feature (1)..( 10): Matrix.004 file - promoters50/1031368
ttcgtagaca

SEQ ID NO: 66931 - DNA, 7 bp, Unknown
  misc_feature (1)..( 7): Matrix.004 file - promoters50/1031368
tgactat

SEQ ID NO: 66932 - DNA, 9 bp, Unknown
  misc_feature (1)..( 9): Matrix.004 file - promoters50/1031386
cataaattt

SEQ ID NO: 66933 - DNA, 8 bp, Unknown
  misc_feature (1)..( 8): Matrix.004 file - promoters50/1031390
tatataaa

SEQ ID NO: 66934 - DNA, 15 bp, Unknown
  misc_feature (1)..( 15): Matrix.004 file - promoters50/1031390
tcaagaaaatttttt

SEQ ID NO: 66935 - DNA, 11 bp, Unknown
  misc_feature (1)..( 11): Matrix.004 file - promoters50/1031390
taagttttcaa

SEQ ID NO: 66936 - DNA, 14 bp, Unknown
  misc_feature (1)..( 14): Matrix.004 file - promoters50/1031429
taaaaacatttgaa

SEQ ID NO: 66937 - DNA, 13 bp, Unknown
  misc_feature (1)..( 13): Matrix.004 file - promoters50/1031429
ctttcgaccaata

SEQ ID NO: 66938 - DNA, 8 bp, Unknown
  misc_feature (1)..( 8): Matrix.004 file - promoters50/1031429
aaaaaaaa

SEQ ID NO: 66939 - DNA, 9 bp, Unknown
  misc_feature (1)..( 9): Matrix.004 file - promoters50/1031429
aatacaaat

SEQ ID NO: 66940 - DNA, 8 bp, Unknown
  misc_feature (1)..( 8): Matrix.004 file - promoters50/1031429
taatgatt

SEQ ID NO: 66941 - DNA, 10 bp, Unknown
  misc_feature (1)..( 10): Matrix.004 file - promoters50/1031429
atcattctaa

SEQ ID NO: 66942 - DNA, 10 bp, Unknown
  misc_feature (1)..( 10): Matrix.004 file - promoters50/1031484
caatctttta

SEQ ID NO: 66943 - DNA, 8 bp, Unknown
  misc_feature (1)..( 8): Matrix.004 file - promoters50/1031484
aaaataaa

SEQ ID NO: 66944 - DNA, 6 bp, Unknown
  misc_feature (1)..( 6): Matrix.004 file - promoters50/1031484
aataaa

SEQ ID NO: 66945 - DNA, 7 bp, Unknown
  misc_feature (1)..( 7): Matrix.004 file - promoters50/1031484
aataaaa

SEQ ID NO: 66946 - DNA, 7 bp, Unknown
  misc_feature (1)..( 7): Matrix.004 file - promoters50/1031488
aaagaaa

SEQ ID NO: 66947 - DNA, 12 bp, Unknown
  misc_feature (1)..( 12): Matrix.004 file - promoters50/1031488
gataaaaataca

SEQ ID NO: 66948 - DNA, 9 bp, Unknown
  misc_feature (1)..( 9): Matrix.004 file - promoters50/1031563
caacaaaca

SEQ ID NO: 66949 - DNA, 7 bp, Unknown
  misc_feature (1)..( 7): Matrix.004 file - promoters50/1031563
caaaagt

SEQ ID NO: 66950 - DNA, 8 bp, Unknown
  misc_feature (1)..( 8): Matrix.004 file - promoters50/1031563
acttaaac

SEQ ID NO: 66951 - DNA, 8 bp, Unknown
  misc_feature (1)..( 8): Matrix.004 file - promoters50/1031576
ctaaagag

SEQ ID NO: 66952 - DNA, 7 bp, Unknown
  misc_feature (1)..( 7): Matrix.004 file - promoters50/1031576
aaaaata

SEQ ID NO: 66953 - DNA, 9 bp, Unknown
  misc_feature (1)..( 9): Matrix.004 file - promoters50/1031576
ataaactca

SEQ ID NO: 66954 - DNA, 9 bp, Unknown
  misc_feature (1)..( 9): Matrix.004 file - promoters50/1031576
acaataaac

SEQ ID NO: 66955 - DNA, 8 bp, Unknown
  misc_feature (1)..( 8): Matrix.004 file - promoters50/1031576
acaataaa

SEQ ID NO: 66956 - DNA, 10 bp, Unknown
  misc_feature (1)..( 10): Matrix.004 file - promoters50/1031576
catctctaag

SEQ ID NO: 66957 - DNA, 8 bp, Unknown
  misc_feature (1)..( 8): Matrix.004 file - promoters50/1031638
acaacaaa

SEQ ID NO: 66958 - DNA, 9 bp, Unknown
  misc_feature (1)..( 9): Matrix.004 file - promoters50/1031638
aatcaaaac

SEQ ID NO: 66959 - DNA, 7 bp, Unknown
  misc_feature (1)..( 7): Matrix.004 file - promoters50/1031638
aaaacaa

SEQ ID NO: 66960 - DNA, 8 bp, Unknown
  misc_feature (1)..( 8): Matrix.004 file - promoters50/1031638
aaaacaaa

SEQ ID NO: 66961 - DNA, 9 bp, Unknown
  misc_feature (1)..( 9): Matrix.004 file - promoters50/1031638
ttttttaaa

SEQ ID NO: 66962 - DNA, 7 bp, Unknown
  misc_feature (1)..( 7): Matrix.004 file - promoters50/1031638
gtaaaat

SEQ ID NO: 66963 - DNA, 8 bp, Unknown
  misc_feature (1)..( 8): Matrix.004 file - promoters50/1031638
aatatata

SEQ ID NO: 66964 - DNA, 9 bp, Unknown
  misc_feature (1)..( 9): Matrix.004 file - promoters50/1031638
ttaaaaata

SEQ ID NO: 66965 - DNA, 9 bp, Unknown
  misc_feature (1)..( 9): Matrix.004 file - promoters50/1031638
ttaaaaata

SEQ ID NO: 66966 - DNA, 8 bp, Unknown
  misc_feature (1)..( 8): Matrix.004 file - promoters50/1031638
aatatttt

SEQ ID NO: 66967 - DNA, 6 bp, Unknown
  misc_feature (1)..( 6): Matrix.004 file - promoters50/1031638
ttcaaa

SEQ ID NO: 66968 - DNA, 7 bp, Unknown
  misc_feature (1)..( 7): Matrix.004 file - promoters50/1031638
tccaaaa

SEQ ID NO: 66969 - DNA, 10 bp, Unknown
  misc_feature (1)..( 10): Matrix.004 file - promoters50/1031638
attaatgttc

SEQ ID NO: 66970 - DNA, 7 bp, Unknown
  misc_feature (1)..( 7): Matrix.004 file - promoters50/1031638
cccacga

SEQ ID NO: 66971 - DNA, 8 bp, Unknown
  misc_feature (1)..( 8): Matrix.004 file - promoters50/1031638
aaattata

SEQ ID NO: 66972 - DNA, 10 bp, Unknown
  misc_feature (1)..( 10): Matrix.004 file - promoters50/1031638
aaatatttaa

SEQ ID NO: 66973 - DNA, 9 bp, Unknown
  misc_feature (1)..( 9): Matrix.004 file - promoters50/1031642
attttgtaa

SEQ ID NO: 66974 - DNA, 9 bp, Unknown
  misc_feature (1)..( 9): Matrix.004 file - promoters50/1031642
gtcaaaaaa

SEQ ID NO: 66975 - DNA, 12 bp, Unknown
  misc_feature (1)..( 12): Matrix.004 file - promoters50/1031646
gttcggctaaaa

SEQ ID NO: 66976 - DNA, 9 bp, Unknown
  misc_feature (1)..( 9): Matrix.004 file - promoters50/1031646
acaaaatta

SEQ ID NO: 66977 - DNA, 8 bp, Unknown
  misc_feature (1)..( 8): Matrix.004 file - promoters50/1031646
aaaaccca

SEQ ID NO: 66978 - DNA, 9 bp, Unknown
  misc_feature (1)..( 9): Matrix.004 file - promoters50/1031706
aattgataa

SEQ ID NO: 66979 - DNA, 12 bp, Unknown
  misc_feature (1)..( 12): Matrix.004 file - promoters50/1031706
attttaatattt

SEQ ID NO: 66980 - DNA, 14 bp, Unknown
  misc_feature (1)..( 14): Matrix.004 file - promoters50/1031706
tcctatatatataa

SEQ ID NO: 66981 - DNA, 8 bp, Unknown
  misc_feature (1)..( 8): Matrix.004 file - promoters50/1031706
tttaattt

SEQ ID NO: 66982 - DNA, 10 bp, Unknown
  misc_feature (1)..( 10): Matrix.004 file - promoters50/1031706
taagaaactt

SEQ ID NO: 66983 - DNA, 5 bp, Unknown
  misc_feature (1)..( 5): Matrix.004 file - promoters50/1031706
tattt

SEQ ID NO: 66984 - DNA, 12 bp, Unknown
  misc_feature (1)..( 12): Matrix.004 file - promoters50/1031706
aaagaacaaaac

SEQ ID NO: 66985 - DNA, 10 bp, Unknown
  misc_feature (1)..( 10): Matrix.004 file - promoters50/1031752
caaaacaaac

SEQ ID NO: 66986 - DNA, 12 bp, Unknown
  misc_feature (1)..( 12): Matrix.004 file - promoters50/1031752
tttacttaataa

SEQ ID NO: 66987 - DNA, 8 bp, Unknown
  misc_feature (1)..( 8): Matrix.004 file - promoters50/1031752
ttcaagag

SEQ ID NO: 66988 - DNA, 9 bp, Unknown
  misc_feature (1)..( 9): Matrix.004 file - promoters50/1031777
ttttatctt

SEQ ID NO: 66989 - DNA, 9 bp, Unknown
  misc_feature (1)..( 9): Matrix.004 file - promoters50/1031781
aagaaaata

SEQ ID NO: 66990 - DNA, 8 bp, Unknown
  misc_feature (1)..( 8): Matrix.004 file - promoters50/1031781
atatttat

SEQ ID NO: 66991 - DNA, 7 bp, Unknown
  misc_feature (1)..( 7): Matrix.004 file - promoters50/1031781
atttatt

SEQ ID NO: 66992 - DNA, 7 bp, Unknown
  misc_feature (1)..( 7): Matrix.004 file - promoters50/1031781
gaaagaa

SEQ ID NO: 66993 - DNA, 8 bp, Unknown
  misc_feature (1)..( 8): Matrix.004 file - promoters50/1031781
tagaatgc

SEQ ID NO: 66994 - DNA, 8 bp, Unknown
  misc_feature (1)..( 8): Matrix.004 file - promoters50/1031799
attaaaaa

SEQ ID NO: 66995 - DNA, 11 bp, Unknown
  misc_feature (1)..( 11): Matrix.004 file - promoters50/1031799
ttttttagtta

SEQ ID NO: 66996 - DNA, 7 bp, Unknown
  misc_feature (1)..( 7): Matrix.004 file - promoters50/1031806
tttcttt

SEQ ID NO: 66997 - DNA, 10 bp, Unknown
  misc_feature (1)..( 10): Matrix.004 file - promoters50/1031806
acttttgttt

SEQ ID NO: 66998 - DNA, 7 bp, Unknown
  misc_feature (1)..( 7): Matrix.004 file - promoters50/1031806
attagaa

SEQ ID NO: 66999 - DNA, 13 bp, Unknown
  misc_feature (1)..( 13): Matrix.004 file - promoters50/1031806
tgaatttttctga

SEQ ID NO: 67000 - DNA, 16 bp, Unknown
  misc_feature (1)..( 16): Matrix.004 file - promoters50/1032149
gaagaaataacagtaa

SEQ ID NO: 67001 - DNA, 7 bp, Unknown
  misc_feature (1)..( 7): Matrix.004 file - promoters50/1032149
tatagtt

SEQ ID NO: 67002 - DNA, 12 bp, Unknown
  misc_feature (1)..( 12): Matrix.004 file - promoters50/1032149
agtgattaatca

SEQ ID NO: 67003 - DNA, 11 bp, Unknown
  misc_feature (1)..( 11): Matrix.004 file - promoters50/1032149
agttattaatc

SEQ ID NO: 67004 - DNA, 7 bp, Unknown
  misc_feature (1)..( 7): Matrix.004 file - promoters50/1032149
attttac

SEQ ID NO: 67005 - DNA, 10 bp, Unknown
  misc_feature (1)..( 10): Matrix.004 file - promoters50/1032149
aacaattaaa

SEQ ID NO: 67006 - DNA, 9 bp, Unknown
  misc_feature (1)..( 9): Matrix.004 file - promoters50/1032149
tatgaaaaa

SEQ ID NO: 67007 - DNA, 8 bp, Unknown
  misc_feature (1)..( 8): Matrix.004 file - promoters50/1032149
atatatgt

SEQ ID NO: 67008 - DNA, 13 bp, Unknown
  misc_feature (1)..( 13): Matrix.004 file - promoters50/1032149
aaattatttttaa

SEQ ID NO: 67009 - DNA, 8 bp, Unknown
  misc_feature (1)..( 8): Matrix.004 file - promoters50/1032149
aaatattt

SEQ ID NO: 67010 - DNA, 9 bp, Unknown
  misc_feature (1)..( 9): Matrix.004 file - promoters50/1032149
tttattaaa

SEQ ID NO: 67011 - DNA, 12 bp, Unknown
  misc_feature (1)..( 12): Matrix.004 file - promoters50/1032149
aaaactttaatt

SEQ ID NO: 67012 - DNA, 8 bp, Unknown
  misc_feature (1)..( 8): Matrix.004 file - promoters50/1032160
ttcttttt

SEQ ID NO: 67013 - DNA, 12 bp, Unknown
  misc_feature (1)..( 12): Matrix.004 file - promoters50/1032160
aattttacgatt

SEQ ID NO: 67014 - DNA, 14 bp, Unknown
  misc_feature (1)..( 14): Matrix.004 file - promoters50/1032160
caaagagacataac

SEQ ID NO: 67015 - DNA, 12 bp, Unknown
  misc_feature (1)..( 12): Matrix.004 file - promoters50/1032266
tattaaaaaaat

SEQ ID NO: 67016 - DNA, 12 bp, Unknown
  misc_feature (1)..( 12): Matrix.004 file - promoters50/1032266
agtgtttggtgt

SEQ ID NO: 67017 - DNA, 10 bp, Unknown
  misc_feature (1)..( 10): Matrix.004 file - promoters50/1032274
atattttcaa

SEQ ID NO: 67018 - DNA, 11 bp, Unknown
  misc_feature (1)..( 11): Matrix.004 file - promoters50/1032274
ttatatgtaat

SEQ ID NO: 67019 - DNA, 10 bp, Unknown
  misc_feature (1)..( 10): Matrix.004 file - promoters50/1032291
taatttgata

SEQ ID NO: 67020 - DNA, 7 bp, Unknown
  misc_feature (1)..( 7): Matrix.004 file - promoters50/1032313
atttgtt

SEQ ID NO: 67021 - DNA, 13 bp, Unknown
  misc_feature (1)..( 13): Matrix.004 file - promoters50/1032313
taaaaaagtgtta

SEQ ID NO: 67022 - DNA, 15 bp, Unknown
  misc_feature (1)..( 15): Matrix.004 file - promoters50/1032313
caacttcaaaaaaaa

SEQ ID NO: 67023 - DNA, 14 bp, Unknown
  misc_feature (1)..( 14): Matrix.004 file - promoters50/1032316
gtcttccaaaaaat

SEQ ID NO: 67024 - DNA, 13 bp, Unknown
  misc_feature (1)..( 13): Matrix.004 file - promoters50/1032381
gttctttaatttg

SEQ ID NO: 67025 - DNA, 8 bp, Unknown
  misc_feature (1)..( 8): Matrix.004 file - promoters50/1032381
tttacttt

SEQ ID NO: 67026 - DNA, 10 bp, Unknown
  misc_feature (1)..( 10): Matrix.004 file - promoters50/1032381
aaattaaaaa

SEQ ID NO: 67027 - DNA, 14 bp, Unknown
  misc_feature (1)..( 14): Matrix.004 file - promoters50/1032381
actcactataaaaa

SEQ ID NO: 67028 - DNA, 11 bp, Unknown
  misc_feature (1)..( 11): Matrix.004 file - promoters50/1032381
tttttttactt

SEQ ID NO: 67029 - DNA, 10 bp, Unknown
  misc_feature (1)..( 10): Matrix.004 file - promoters50/1032381
caaaaagtat

SEQ ID NO: 67030 - DNA, 8 bp, Unknown
  misc_feature (1)..( 8): Matrix.004 file - promoters50/1032381
tgtttttg

SEQ ID NO: 67031 - DNA, 11 bp, Unknown
  misc_feature (1)..( 11): Matrix.004 file - promoters50/1032389
tatgtaaatta

SEQ ID NO: 67032 - DNA, 11 bp, Unknown
  misc_feature (1)..( 11): Matrix.004 file - promoters50/1032389
ttttgtttcat

SEQ ID NO: 67033 - DNA, 10 bp, Unknown
  misc_feature (1)..( 10): Matrix.004 file - promoters50/1032400
aattttgttt

SEQ ID NO: 67034 - DNA, 8 bp, Unknown
  misc_feature (1)..( 8): Matrix.004 file - promoters50/1032436
aattgatt

SEQ ID NO: 67035 - DNA, 10 bp, Unknown
  misc_feature (1)..( 10): Matrix.004 file - promoters50/1032436
aatactcaaa

SEQ ID NO: 67036 - DNA, 7 bp, Unknown
  misc_feature (1)..( 7): Matrix.004 file - promoters50/1032436
attattt

SEQ ID NO: 67037 - DNA, 14 bp, Unknown
  misc_feature (1)..( 14): Matrix.004 file - promoters50/1032436
tcaaatgaagaaaa

SEQ ID NO: 67038 - DNA, 9 bp, Unknown
  misc_feature (1)..( 9): Matrix.004 file - promoters50/1032436
aataatgtt

SEQ ID NO: 67039 - DNA, 8 bp, Unknown
  misc_feature (1)..( 8): Matrix.004 file - promoters50/1032498
acttttca

SEQ ID NO: 67040 - DNA, 9 bp, Unknown
  misc_feature (1)..( 9): Matrix.004 file - promoters50/1032498
aatataaaa

SEQ ID NO: 67041 - DNA, 10 bp, Unknown
  misc_feature (1)..( 10): Matrix.004 file - promoters50/1032614
gagttggata

SEQ ID NO: 67042 - DNA, 10 bp, Unknown
  misc_feature (1)..( 10): Matrix.004 file - promoters50/1032668
tcttgaagct

SEQ ID NO: 67043 - DNA, 8 bp, Unknown
  misc_feature (1)..( 8): Matrix.004 file - promoters50/1032668
ttttttat

SEQ ID NO: 67044 - DNA, 15 bp, Unknown
  misc_feature (1)..( 15): Matrix.004 file - promoters50/1032676
agaaaatttagacca

SEQ ID NO: 67045 - DNA, 10 bp, Unknown
  misc_feature (1)..( 10): Matrix.004 file - promoters50/1032676
agatattaat

SEQ ID NO: 67046 - DNA, 7 bp, Unknown
  misc_feature (1)..( 7): Matrix.004 file - promoters50/1032676
aaaaaaa

SEQ ID NO: 67047 - DNA, 13 bp, Unknown
  misc_feature (1)..( 13): Matrix.004 file - promoters50/1032678
ttattaataaaag

SEQ ID NO: 67048 - DNA, 9 bp, Unknown
  misc_feature (1)..( 9): Matrix.004 file - promoters50/1032698
gaaaaacct

SEQ ID NO: 67049 - DNA, 9 bp, Unknown
  misc_feature (1)..( 9): Matrix.004 file - promoters50/1032698
tattttttt

SEQ ID NO: 67050 - DNA, 10 bp, Unknown
  misc_feature (1)..( 10): Matrix.004 file - promoters50/1032698
aaaaatagat

SEQ ID NO: 67051 - DNA, 11 bp, Unknown
  misc_feature (1)..( 11): Matrix.004 file - promoters50/1032698
ttttgaactta

SEQ ID NO: 67052 - DNA, 14 bp, Unknown
  misc_feature (1)..( 14): Matrix.004 file - promoters50/1032698
aatttaattttatg

SEQ ID NO: 67053 - DNA, 11 bp, Unknown
  misc_feature (1)..( 11): Matrix.004 file - promoters50/1032698
aatcaaaaaaa

SEQ ID NO: 67054 - DNA, 8 bp, Unknown
  misc_feature (1)..( 8): Matrix.004 file - promoters50/1032698
aatacaaa

SEQ ID NO: 67055 - DNA, 12 bp, Unknown
  misc_feature (1)..( 12): Matrix.004 file - promoters50/1032698
aataaaaaatag

SEQ ID NO: 67056 - DNA, 11 bp, Unknown
  misc_feature (1)..( 11): Matrix.004 file - promoters50/1032713
ttataaaaata

SEQ ID NO: 67057 - DNA, 9 bp, Unknown
  misc_feature (1)..( 9): Matrix.004 file - promoters50/1032713
aaaagccaa

SEQ ID NO: 67058 - DNA, 7 bp, Unknown
  misc_feature (1)..( 7): Matrix.004 file - promoters50/1032713
caaaata

SEQ ID NO: 67059 - DNA, 10 bp, Unknown
  misc_feature (1)..( 10): Matrix.004 file - promoters50/1032713
attacttact

SEQ ID NO: 67060 - DNA, 9 bp, Unknown
  misc_feature (1)..( 9): Matrix.004 file - promoters50/1032730
tttgaaaca

SEQ ID NO: 67061 - DNA, 10 bp, Unknown
  misc_feature (1)..( 10): Matrix.004 file - promoters50/1032730
gataatttca

SEQ ID NO: 67062 - DNA, 7 bp, Unknown
  misc_feature (1)..( 7): Matrix.004 file - promoters50/1032752
atttaga

SEQ ID NO: 67063 - DNA, 9 bp, Unknown
  misc_feature (1)..( 9): Matrix.004 file - promoters50/1032752
aatttataa

SEQ ID NO: 67064 - DNA, 10 bp, Unknown
  misc_feature (1)..( 10): Matrix.004 file - promoters50/1032752
catgtataag

SEQ ID NO: 67065 - DNA, 13 bp, Unknown
  misc_feature (1)..( 13): Matrix.004 file - promoters50/1032756
aaaaaatatctat

SEQ ID NO: 67066 - DNA, 9 bp, Unknown
  misc_feature (1)..( 9): Matrix.004 file - promoters50/1032756
tttactttt

SEQ ID NO: 67067 - DNA, 5 bp, Unknown
  misc_feature (1)..( 5): Matrix.004 file - promoters50/1032756
tcaat

SEQ ID NO: 67068 - DNA, 10 bp, Unknown
  misc_feature (1)..( 10): Matrix.004 file - promoters50/1032756
tcgataatta

SEQ ID NO: 67069 - DNA, 9 bp, Unknown
  misc_feature (1)..( 9): Matrix.004 file - promoters50/1032756
atctaatat

SEQ ID NO: 67070 - DNA, 10 bp, Unknown
  misc_feature (1)..( 10): Matrix.004 file - promoters50/1032756
tttgaaactt

SEQ ID NO: 67071 - DNA, 6 bp, Unknown
  misc_feature (1)..( 6): Matrix.004 file - promoters50/1032788
ttttat

SEQ ID NO: 67072 - DNA, 8 bp, Unknown
  misc_feature (1)..( 8): Matrix.004 file - promoters50/1032788
ttataaaa

SEQ ID NO: 67073 - DNA, 10 bp, Unknown
  misc_feature (1)..( 10): Matrix.004 file - promoters50/1032788
tacaaaaaaa

SEQ ID NO: 67074 - DNA, 9 bp, Unknown
  misc_feature (1)..( 9): Matrix.004 file - promoters50/1032788
gaaaaaata

SEQ ID NO: 67075 - DNA, 11 bp, Unknown
  misc_feature (1)..( 11): Matrix.004 file - promoters50/1032788
acttatttttt

SEQ ID NO: 67076 - DNA, 10 bp, Unknown
  misc_feature (1)..( 10): Matrix.004 file - promoters50/1032788
aaagaaaaat

SEQ ID NO: 67077 - DNA, 10 bp, Unknown
  misc_feature (1)..( 10): Matrix.004 file - promoters50/1032788
attttattta

SEQ ID NO: 67078 - DNA, 12 bp, Unknown
  misc_feature (1)..( 12): Matrix.004 file - promoters50/1032788
taacaattctat

SEQ ID NO: 67079 - DNA, 14 bp, Unknown
  misc_feature (1)..( 14): Matrix.004 file - promoters50/1032788
aacaaatttaatta

SEQ ID NO: 67080 - DNA, 10 bp, Unknown
  misc_feature (1)..( 10): Matrix.004 file - promoters50/1032788
tatatatata

SEQ ID NO: 67081 - DNA, 8 bp, Unknown
  misc_feature (1)..( 8): Matrix.004 file - promoters50/1032788
taataata

SEQ ID NO: 67082 - DNA, 9 bp, Unknown
  misc_feature (1)..( 9): Matrix.004 file - promoters50/1032815
aaaataaat

SEQ ID NO: 67083 - DNA, 10 bp, Unknown
  misc_feature (1)..( 10): Matrix.004 file - promoters50/1032844
gaagtttcta

SEQ ID NO: 67084 - DNA, 13 bp, Unknown
  misc_feature (1)..( 13): Matrix.004 file - promoters50/1032884
attataatttcat

SEQ ID NO: 67085 - DNA, 9 bp, Unknown
  misc_feature (1)..( 9): Matrix.004 file - promoters50/1032884
agatgagaa

SEQ ID NO: 67086 - DNA, 6 bp, Unknown
  misc_feature (1)..( 6): Matrix.004 file - promoters50/1032884
ataatt

SEQ ID NO: 67087 - DNA, 8 bp, Unknown
  misc_feature (1)..( 8): Matrix.004 file - promoters50/1032884
gtattatg

SEQ ID NO: 67088 - DNA, 8 bp, Unknown
  misc_feature (1)..( 8): Matrix.004 file - promoters50/1032884
tgaagaag

SEQ ID NO: 67089 - DNA, 9 bp, Unknown
  misc_feature (1)..( 9): Matrix.004 file - promoters50/1032884
gatctctct

SEQ ID NO: 67090 - DNA, 11 bp, Unknown
  misc_feature (1)..( 11): Matrix.004 file - promoters50/1032884
tacacttttta

SEQ ID NO: 67091 - DNA, 8 bp, Unknown
  misc_feature (1)..( 8): Matrix.004 file - promoters50/1032897
atgtaatt

SEQ ID NO: 67092 - DNA, 8 bp, Unknown
  misc_feature (1)..( 8): Matrix.004 file - promoters50/1032897
gaaaaaag

SEQ ID NO: 67093 - DNA, 10 bp, Unknown
  misc_feature (1)..( 10): Matrix.004 file - promoters50/1032929
ttatttctta

SEQ ID NO: 67094 - DNA, 8 bp, Unknown
  misc_feature (1)..( 8): Matrix.004 file - promoters50/1032940
ataattat

SEQ ID NO: 67095 - DNA, 12 bp, Unknown
  misc_feature (1)..( 12): Matrix.004 file - promoters50/1032940
tttaatgtttga

SEQ ID NO: 67096 - DNA, 8 bp, Unknown
  misc_feature (1)..( 8): Matrix.004 file - promoters50/1032940
caaaattt

SEQ ID NO: 67097 - DNA, 10 bp, Unknown
  misc_feature (1)..( 10): Matrix.004 file - promoters50/1032940
ttcaaaattt

SEQ ID NO: 67098 - DNA, 10 bp, Unknown
  misc_feature (1)..( 10): Matrix.004 file - promoters50/1032996
acacaataaa

SEQ ID NO: 67099 - DNA, 7 bp, Unknown
  misc_feature (1)..( 7): Matrix.004 file - promoters50/1032996
attttaa

SEQ ID NO: 67100 - DNA, 12 bp, Unknown
  misc_feature (1)..( 12): Matrix.004 file - promoters50/1032996
tatatcatattt

SEQ ID NO: 67101 - DNA, 8 bp, Unknown
  misc_feature (1)..( 8): Matrix.004 file - promoters50/1033013
tcatattt

SEQ ID NO: 67102 - DNA, 10 bp, Unknown
  misc_feature (1)..( 10): Matrix.004 file - promoters50/1033013
agaaaatcga

SEQ ID NO: 67103 - DNA, 11 bp, Unknown
  misc_feature (1)..( 11): Matrix.004 file - promoters50/1033176
tttgagaaaag

SEQ ID NO: 67104 - DNA, 6 bp, Unknown
  misc_feature (1)..( 6): Matrix.004 file - promoters50/1033176
aacaag

SEQ ID NO: 67105 - DNA, 6 bp, Unknown
  misc_feature (1)..( 6): Matrix.004 file - promoters50/1033176
ttaaaa

SEQ ID NO: 67106 - DNA, 8 bp, Unknown
  misc_feature (1)..( 8): Matrix.004 file - promoters50/1033176
taaattta

SEQ ID NO: 67107 - DNA, 17 bp, Unknown
  misc_feature (1)..( 17): Matrix.004 file - promoters50/1033176
aaatcatctcaatgcca

SEQ ID NO: 67108 - DNA, 7 bp, Unknown
  misc_feature (1)..( 7): Matrix.004 file - promoters50/1033176
tttctca

SEQ ID NO: 67109 - DNA, 7 bp, Unknown
  misc_feature (1)..( 7): Matrix.004 file - promoters50/1033176
cgtttga

SEQ ID NO: 67110 - DNA, 8 bp, Unknown
  misc_feature (1)..( 8): Matrix.004 file - promoters50/1033176
aattaagc

SEQ ID NO: 67111 - DNA, 10 bp, Unknown
  misc_feature (1)..( 10): Matrix.004 file - promoters50/1033184
gattgatgaa

SEQ ID NO: 67112 - DNA, 13 bp, Unknown
  misc_feature (1)..( 13): Matrix.004 file - promoters50/1033184
gaattattttctt

SEQ ID NO: 67113 - DNA, 12 bp, Unknown
  misc_feature (1)..( 12): Matrix.004 file - promoters50/1033184
caaaaaaaatta

SEQ ID NO: 67114 - DNA, 10 bp, Unknown
  misc_feature (1)..( 10): Matrix.004 file - promoters50/1033184
tttgttaaaa

SEQ ID NO: 67115 - DNA, 9 bp, Unknown
  misc_feature (1)..( 9): Matrix.004 file - promoters50/1033194
tttaaattt

SEQ ID NO: 67116 - DNA, 7 bp, Unknown
  misc_feature (1)..( 7): Matrix.004 file - promoters50/1033217
aaaatgt

SEQ ID NO: 67117 - DNA, 9 bp, Unknown
  misc_feature (1)..( 9): Matrix.004 file - promoters50/1033262
tgattattt

SEQ ID NO: 67118 - DNA, 5 bp, Unknown
  misc_feature (1)..( 5): Matrix.004 file - promoters50/1033340
tgatt

SEQ ID NO: 67119 - DNA, 9 bp, Unknown
  misc_feature (1)..( 9): Matrix.004 file - promoters50/1033340
tgatcaaca

SEQ ID NO: 67120 - DNA, 7 bp, Unknown
  misc_feature (1)..( 7): Matrix.004 file - promoters50/1033360
atctttt

SEQ ID NO: 67121 - DNA, 8 bp, Unknown
  misc_feature (1)..( 8): Matrix.004 file - promoters50/1033408
attgattt

SEQ ID NO: 67122 - DNA, 10 bp, Unknown
  misc_feature (1)..( 10): Matrix.004 file - promoters50/1033408
aattgaactt

SEQ ID NO: 67123 - DNA, 8 bp, Unknown
  misc_feature (1)..( 8): Matrix.004 file - promoters50/1033430
tatataaa

SEQ ID NO: 67124 - DNA, 9 bp, Unknown
  misc_feature (1)..( 9): Matrix.004 file - promoters50/1033540
attgaaatc

SEQ ID NO: 67125 - DNA, 7 bp, Unknown
  misc_feature (1)..( 7): Matrix.004 file - promoters50/1033540
ttatttt

SEQ ID NO: 67126 - DNA, 10 bp, Unknown
  misc_feature (1)..( 10): Matrix.004 file - promoters50/1033540
acaaaattat

SEQ ID NO: 67127 - DNA, 7 bp, Unknown
  misc_feature (1)..( 7): Matrix.004 file - promoters50/1033540
cttttcc

SEQ ID NO: 67128 - DNA, 12 bp, Unknown
  misc_feature (1)..( 12): Matrix.004 file - promoters50/1033596
cacaacacctga

SEQ ID NO: 67129 - DNA, 9 bp, Unknown
  misc_feature (1)..( 9): Matrix.004 file - promoters50/1033679
tgaatctgc

SEQ ID NO: 67130 - DNA, 11 bp, Unknown
  misc_feature (1)..( 11): Matrix.004 file - promoters50/1033679
tcttcttgtat

SEQ ID NO: 67131 - DNA, 12 bp, Unknown
  misc_feature (1)..( 12): Matrix.004 file - promoters50/1033716
acataaagtaaa

SEQ ID NO: 67132 - DNA, 10 bp, Unknown
  misc_feature (1)..( 10): Matrix.004 file - promoters50/1033723
aagattctag

SEQ ID NO: 67133 - DNA, 8 bp, Unknown
  misc_feature (1)..( 8): Matrix.004 file - promoters50/1033781
atgaagaa

SEQ ID NO: 67134 - DNA, 8 bp, Unknown
  misc_feature (1)..( 8): Matrix.004 file - promoters50/1033781
ttcttaat

SEQ ID NO: 67135 - DNA, 9 bp, Unknown
  misc_feature (1)..( 9): Matrix.004 file - promoters50/1033781
catgaattg

SEQ ID NO: 67136 - DNA, 7 bp, Unknown
  misc_feature (1)..( 7): Matrix.004 file - promoters50/1033781
aagaaac

SEQ ID NO: 67137 - DNA, 8 bp, Unknown
  misc_feature (1)..( 8): Matrix.004 file - promoters50/1033837
aataaaaa

SEQ ID NO: 67138 - DNA, 11 bp, Unknown
  misc_feature (1)..( 11): Matrix.004 file - promoters50/1033837
ttttattggtt

SEQ ID NO: 67139 - DNA, 9 bp, Unknown
  misc_feature (1)..( 9): Matrix.004 file - promoters50/1033837
aaaaaaaaa

SEQ ID NO: 67140 - DNA, 13 bp, Unknown
  misc_feature (1)..( 13): Matrix.004 file - promoters50/1033849
cataatgggacca

SEQ ID NO: 67141 - DNA, 7 bp, Unknown
  misc_feature (1)..( 7): Matrix.004 file - promoters50/1033865
caaaaag

SEQ ID NO: 67142 - DNA, 11 bp, Unknown
  misc_feature (1)..( 11): Matrix.004 file - promoters50/1033865
tttttacattt

SEQ ID NO: 67143 - DNA, 13 bp, Unknown
  misc_feature (1)..( 13): Matrix.004 file - promoters50/1033869
gatagataaaatt

SEQ ID NO: 67144 - DNA, 8 bp, Unknown
  misc_feature (1)..( 8): Matrix.004 file - promoters50/1034030
ttcttttt

SEQ ID NO: 67145 - DNA, 11 bp, Unknown
  misc_feature (1)..( 11): Matrix.004 file - promoters50/1034030
gaaaaaaacca

SEQ ID NO: 67146 - DNA, 10 bp, Unknown
  misc_feature (1)..( 10): Matrix.004 file - promoters50/1034066
tataaaaact

SEQ ID NO: 67147 - DNA, 8 bp, Unknown
  misc_feature (1)..( 8): Matrix.004 file - promoters50/1034066
gaacagag

SEQ ID NO: 67148 - DNA, 11 bp, Unknown
  misc_feature (1)..( 11): Matrix.004 file - promoters50/1034066
aatgtttgaat

SEQ ID NO: 67149 - DNA, 7 bp, Unknown
  misc_feature (1)..( 7): Matrix.004 file - promoters50/1034066
taaaaaa

SEQ ID NO: 67150 - DNA, 10 bp, Unknown
  misc_feature (1)..( 10): Matrix.004 file - promoters50/1034066
aagagttgcg

SEQ ID NO: 67151 - DNA, 15 bp, Unknown
  misc_feature (1)..( 15): Matrix.004 file - promoters50/1034066
aaccaaactccaaaa

SEQ ID NO: 67152 - DNA, 8 bp, Unknown
  misc_feature (1)..( 8): Matrix.004 file - promoters50/1034137
tttataaa

SEQ ID NO: 67153 - DNA, 16 bp, Unknown
  misc_feature (1)..( 16): Matrix.004 file - promoters50/1034145
agactttaagacttat

SEQ ID NO: 67154 - DNA, 9 bp, Unknown
  misc_feature (1)..( 9): Matrix.004 file - promoters50/1034188
gtaataagt

SEQ ID NO: 67155 - DNA, 9 bp, Unknown
  misc_feature (1)..( 9): Matrix.004 file - promoters50/1034188
gcccattta

SEQ ID NO: 67156 - DNA, 7 bp, Unknown
  misc_feature (1)..( 7): Matrix.004 file - promoters50/1034212
atttttt

SEQ ID NO: 67157 - DNA, 7 bp, Unknown
  misc_feature (1)..( 7): Matrix.004 file - promoters50/1034306
aatatag

SEQ ID NO: 67158 - DNA, 11 bp, Unknown
  misc_feature (1)..( 11): Matrix.004 file - promoters50/1034306
aaaaataaata

SEQ ID NO: 67159 - DNA, 8 bp, Unknown
  misc_feature (1)..( 8): Matrix.004 file - promoters50/1034306
aaagaaat

SEQ ID NO: 67160 - DNA, 10 bp, Unknown
  misc_feature (1)..( 10): Matrix.004 file - promoters50/1034306
cagaattaaa

SEQ ID NO: 67161 - DNA, 9 bp, Unknown
  misc_feature (1)..( 9): Matrix.004 file - promoters50/1034306
attttaaca

SEQ ID NO: 67162 - DNA, 11 bp, Unknown
  misc_feature (1)..( 11): Matrix.004 file - promoters50/1034322
tgttagaaaaa

SEQ ID NO: 67163 - DNA, 24 bp, Unknown
  misc_feature (1)..( 24): Matrix.004 file - promoters50/1034322
tatcattgttctctagactcaaaa

SEQ ID NO: 67164 - DNA, 10 bp, Unknown
  misc_feature (1)..( 10): Matrix.004 file - promoters50/1034322
tatataaaca

SEQ ID NO: 67165 - DNA, 9 bp, Unknown
  misc_feature (1)..( 9): Matrix.004 file - promoters50/1034322
aagtttaag

SEQ ID NO: 67166 - DNA, 8 bp, Unknown
  misc_feature (1)..( 8): Matrix.004 file - promoters50/1034349
aaaaatag

SEQ ID NO: 67167 - DNA, 12 bp, Unknown
  misc_feature (1)..( 12): Matrix.004 file - promoters50/1034349
acatatatatat

SEQ ID NO: 67168 - DNA, 9 bp, Unknown
  misc_feature (1)..( 9): Matrix.004 file - promoters50/1034349
aatataact

SEQ ID NO: 67169 - DNA, 8 bp, Unknown
  misc_feature (1)..( 8): Matrix.004 file - promoters50/1034349
atttaata

SEQ ID NO: 67170 - DNA, 7 bp, Unknown
  misc_feature (1)..( 7): Matrix.004 file - promoters50/1034353
taacaaa

SEQ ID NO: 67171 - DNA, 13 bp, Unknown
  misc_feature (1)..( 13): Matrix.004 file - promoters50/1034463
taaatattttgtt

SEQ ID NO: 67172 - DNA, 9 bp, Unknown
  misc_feature (1)..( 9): Matrix.004 file - promoters50/1034497
taatatttt

SEQ ID NO: 67173 - DNA, 8 bp, Unknown
  misc_feature (1)..( 8): Matrix.004 file - promoters50/1034497
ctttattt

SEQ ID NO: 67174 - DNA, 7 bp, Unknown
  misc_feature (1)..( 7): Matrix.004 file - promoters50/1034497
aaatatt

SEQ ID NO: 67175 - DNA, 8 bp, Unknown
  misc_feature (1)..( 8): Matrix.004 file - promoters50/1034497
attaaata

SEQ ID NO: 67176 - DNA, 12 bp, Unknown
  misc_feature (1)..( 12): Matrix.004 file - promoters50/1034497
atttaatcgatt

SEQ ID NO: 67177 - DNA, 9 bp, Unknown
  misc_feature (1)..( 9): Matrix.004 file - promoters50/1034652
agattttaa

SEQ ID NO: 67178 - DNA, 10 bp, Unknown
  misc_feature (1)..( 10): Matrix.004 file - promoters50/1034692
tcttcttctg

SEQ ID NO: 67179 - DNA, 9 bp, Unknown
  misc_feature (1)..( 9): Matrix.004 file - promoters50/1034692
aaaatcaac

SEQ ID NO: 67180 - DNA, 8 bp, Unknown
  misc_feature (1)..( 8): Matrix.004 file - promoters50/1034692
aaaaggaa

SEQ ID NO: 67181 - DNA, 6 bp, Unknown
  misc_feature (1)..( 6): Matrix.004 file - promoters50/1034834
ttactt

SEQ ID NO: 67182 - DNA, 10 bp, Unknown
  misc_feature (1)..( 10): Matrix.004 file - promoters50/1034834
ttttattata

SEQ ID NO: 67183 - DNA, 11 bp, Unknown
  misc_feature (1)..( 11): Matrix.004 file - promoters50/1034837
atatatataaa

SEQ ID NO: 67184 - DNA, 12 bp, Unknown
  misc_feature (1)..( 12): Matrix.004 file - promoters50/1034837
aaaaaatttaca

SEQ ID NO: 67185 - DNA, 11 bp, Unknown
  misc_feature (1)..( 11): Matrix.004 file - promoters50/1034837
caaaaatttac

SEQ ID NO: 67186 - DNA, 8 bp, Unknown
  misc_feature (1)..( 8): Matrix.004 file - promoters50/1034841
aaaaaaaa

SEQ ID NO: 67187 - DNA, 8 bp, Unknown
  misc_feature (1)..( 8): Matrix.004 file - promoters50/1034841
ttgaaatg

SEQ ID NO: 67188 - DNA, 9 bp, Unknown
  misc_feature (1)..( 9): Matrix.004 file - promoters50/1034841
ttgattatt

SEQ ID NO: 67189 - DNA, 7 bp, Unknown
  misc_feature (1)..( 7): Matrix.004 file - promoters50/1034841
aatgaaa

SEQ ID NO: 67190 - DNA, 8 bp, Unknown
  misc_feature (1)..( 8): Matrix.004 file - promoters50/1034841
taaattat

SEQ ID NO: 67191 - DNA, 11 bp, Unknown
  misc_feature (1)..( 11): Matrix.004 file - promoters50/1034870
caacttaaaag

SEQ ID NO: 67192 - DNA, 15 bp, Unknown
  misc_feature (1)..( 15): Matrix.004 file - promoters50/1034870
aatagagtaatgaaa

SEQ ID NO: 67193 - DNA, 11 bp, Unknown
  misc_feature (1)..( 11): Matrix.004 file - promoters50/1034870
ataataatttt

SEQ ID NO: 67194 - DNA, 24 bp, Unknown
  misc_feature (1)..( 24): Matrix.004 file - promoters50/1034870
gagattataattttgctaaaaatt

SEQ ID NO: 67195 - DNA, 13 bp, Unknown
  misc_feature (1)..( 13): Matrix.004 file - promoters50/1034870
cttaaatcaatat

SEQ ID NO: 67196 - DNA, 8 bp, Unknown
  misc_feature (1)..( 8): Matrix.004 file - promoters50/1034962
gttaaata

SEQ ID NO: 67197 - DNA, 8 bp, Unknown
  misc_feature (1)..( 8): Matrix.004 file - promoters50/1034962
attttttt

SEQ ID NO: 67198 - DNA, 9 bp, Unknown
  misc_feature (1)..( 9): Matrix.004 file - promoters50/1034970
caatcattt

SEQ ID NO: 67199 - DNA, 11 bp, Unknown
  misc_feature (1)..( 11): Matrix.004 file - promoters50/1034970
agagaaatggt

SEQ ID NO: 67200 - DNA, 7 bp, Unknown
  misc_feature (1)..( 7): Matrix.004 file - promoters50/1034970
tttcttt

SEQ ID NO: 67201 - DNA, 7 bp, Unknown
  misc_feature (1)..( 7): Matrix.004 file - promoters50/1034982
attgact

SEQ ID NO: 67202 - DNA, 8 bp, Unknown
  misc_feature (1)..( 8): Matrix.004 file - promoters50/1034982
ttcttagt

SEQ ID NO: 67203 - DNA, 7 bp, Unknown
  misc_feature (1)..( 7): Matrix.004 file - promoters50/1034982
gtagatt

SEQ ID NO: 67204 - DNA, 9 bp, Unknown
  misc_feature (1)..( 9): Matrix.004 file - promoters50/1034982
tttaatcag

SEQ ID NO: 67205 - DNA, 8 bp, Unknown
  misc_feature (1)..( 8): Matrix.004 file - promoters50/1035027
aaagaatt

SEQ ID NO: 67206 - DNA, 8 bp, Unknown
  misc_feature (1)..( 8): Matrix.004 file - promoters50/1035027
gtatataa

SEQ ID NO: 67207 - DNA, 13 bp, Unknown
  misc_feature (1)..( 13): Matrix.004 file - promoters50/1035083
aatttaataacat

SEQ ID NO: 67208 - DNA, 10 bp, Unknown
  misc_feature (1)..( 10): Matrix.004 file - promoters50/1035083
atatttataa

SEQ ID NO: 67209 - DNA, 9 bp, Unknown
  misc_feature (1)..( 9): Matrix.004 file - promoters50/1035083
ctataaaaa

SEQ ID NO: 67210 - DNA, 13 bp, Unknown
  misc_feature (1)..( 13): Matrix.004 file - promoters50/1035083
aattttaattaat

SEQ ID NO: 67211 - DNA, 10 bp, Unknown
  misc_feature (1)..( 10): Matrix.004 file - promoters50/1035083
tttttataag

SEQ ID NO: 67212 - DNA, 17 bp, Unknown
  misc_feature (1)..( 17): Matrix.004 file - promoters50/1035083
taaattttaaaataatt

SEQ ID NO: 67213 - DNA, 20 bp, Unknown
  misc_feature (1)..( 20): Matrix.004 file - promoters50/1035097
taaattctaaaaaaattatt

SEQ ID NO: 67214 - DNA, 9 bp, Unknown
  misc_feature (1)..( 9): Matrix.004 file - promoters50/1035117
gaaaaaatt

SEQ ID NO: 67215 - DNA, 10 bp, Unknown
  misc_feature (1)..( 10): Matrix.004 file - promoters50/1035117
tattttttat

SEQ ID NO: 67216 - DNA, 9 bp, Unknown
  misc_feature (1)..( 9): Matrix.004 file - promoters50/1035117
tcttttata

SEQ ID NO: 67217 - DNA, 11 bp, Unknown
  misc_feature (1)..( 11): Matrix.004 file - promoters50/1035117
atttgttatta

SEQ ID NO: 67218 - DNA, 11 bp, Unknown
  misc_feature (1)..( 11): Matrix.004 file - promoters50/1035117
caaaaaaacaa

SEQ ID NO: 67219 - DNA, 13 bp, Unknown
  misc_feature (1)..( 13): Matrix.004 file - promoters50/1035155
cttctttaaatta

SEQ ID NO: 67220 - DNA, 10 bp, Unknown
  misc_feature (1)..( 10): Matrix.004 file - promoters50/1035155
aaaaattatt

SEQ ID NO: 67221 - DNA, 9 bp, Unknown
  misc_feature (1)..( 9): Matrix.004 file - promoters50/1035155
ttttaattt

SEQ ID NO: 67222 - DNA, 7 bp, Unknown
  misc_feature (1)..( 7): Matrix.004 file - promoters50/1035155
tatgtag

SEQ ID NO: 67223 - DNA, 10 bp, Unknown
  misc_feature (1)..( 10): Matrix.004 file - promoters50/1035160
aaaacaaaat

SEQ ID NO: 67224 - DNA, 10 bp, Unknown
  misc_feature (1)..( 10): Matrix.004 file - promoters50/1035172
ttaatttaat

SEQ ID NO: 67225 - DNA, 8 bp, Unknown
  misc_feature (1)..( 8): Matrix.004 file - promoters50/1035172
aaaaataa

SEQ ID NO: 67226 - DNA, 13 bp, Unknown
  misc_feature (1)..( 13): Matrix.004 file - promoters50/1035194
tcttttctctata

SEQ ID NO: 67227 - DNA, 8 bp, Unknown
  misc_feature (1)..( 8): Matrix.004 file - promoters50/1035267
aaaataaa

SEQ ID NO: 67228 - DNA, 8 bp, Unknown
  misc_feature (1)..( 8): Matrix.004 file - promoters50/1035267
tcaaataa

SEQ ID NO: 67229 - DNA, 5 bp, Unknown
  misc_feature (1)..( 5): Matrix.004 file - promoters50/1035306
ccaca

SEQ ID NO: 67230 - DNA, 13 bp, Unknown
  misc_feature (1)..( 13): Matrix.004 file - promoters50/1035306
cgcatattaaaaa

SEQ ID NO: 67231 - DNA, 13 bp, Unknown
  misc_feature (1)..( 13): Matrix.004 file - promoters50/1035306
aatcattaaaaaa

SEQ ID NO: 67232 - DNA, 11 bp, Unknown
  misc_feature (1)..( 11): Matrix.004 file - promoters50/1035312
aaatttataaa

SEQ ID NO: 67233 - DNA, 10 bp, Unknown
  misc_feature (1)..( 10): Matrix.004 file - promoters50/1035312
taaatcaaaa

SEQ ID NO: 67234 - DNA, 12 bp, Unknown
  misc_feature (1)..( 12): Matrix.004 file - promoters50/1035312
attaggcccaaa

SEQ ID NO: 67235 - DNA, 8 bp, Unknown
  misc_feature (1)..( 8): Matrix.004 file - promoters50/1035315
atttgata

SEQ ID NO: 67236 - DNA, 8 bp, Unknown
  misc_feature (1)..( 8): Matrix.004 file - promoters50/1035507
aattgatt

SEQ ID NO: 67237 - DNA, 11 bp, Unknown
  misc_feature (1)..( 11): Matrix.004 file - promoters50/1035507
tttcatatttt

SEQ ID NO: 67238 - DNA, 11 bp, Unknown
  misc_feature (1)..( 11): Matrix.004 file - promoters50/1035507
gtgatgaatca

SEQ ID NO: 67239 - DNA, 8 bp, Unknown
  misc_feature (1)..( 8): Matrix.004 file - promoters50/1035507
cataaaaa

SEQ ID NO: 67240 - DNA, 8 bp, Unknown
  misc_feature (1)..( 8): Matrix.004 file - promoters50/1035632
acaaattg

SEQ ID NO: 67241 - DNA, 11 bp, Unknown
  misc_feature (1)..( 11): Matrix.004 file - promoters50/1035636
atataaagaaa

SEQ ID NO: 67242 - DNA, 12 bp, Unknown
  misc_feature (1)..( 12): Matrix.004 file - promoters50/1035636
atgataaaacag

SEQ ID NO: 67243 - DNA, 10 bp, Unknown
  misc_feature (1)..( 10): Matrix.004 file - promoters50/1035636
gagtttgaat

SEQ ID NO: 67244 - DNA, 9 bp, Unknown
  misc_feature (1)..( 9): Matrix.004 file - promoters50/1035636
aaaataaaa

SEQ ID NO: 67245 - DNA, 8 bp, Unknown
  misc_feature (1)..( 8): Matrix.004 file - promoters50/1035636
cttttttt

SEQ ID NO: 67246 - DNA, 9 bp, Unknown
  misc_feature (1)..( 9): Matrix.004 file - promoters50/1035636
aatttattt

SEQ ID NO: 67247 - DNA, 9 bp, Unknown
  misc_feature (1)..( 9): Matrix.004 file - promoters50/1035636
aaaaaatgt

SEQ ID NO: 67248 - DNA, 8 bp, Unknown
  misc_feature (1)..( 8): Matrix.004 file - promoters50/1035636
gatcaaaa

SEQ ID NO: 67249 - DNA, 7 bp, Unknown
  misc_feature (1)..( 7): Matrix.004 file - promoters50/1035636
ttacaac

SEQ ID NO: 67250 - DNA, 9 bp, Unknown
  misc_feature (1)..( 9): Matrix.004 file - promoters50/1035636
ataaaagaa

SEQ ID NO: 67251 - DNA, 8 bp, Unknown
  misc_feature (1)..( 8): Matrix.004 file - promoters50/1035651
agaataaa

SEQ ID NO: 67252 - DNA, 9 bp, Unknown
  misc_feature (1)..( 9): Matrix.004 file - promoters50/1035651
tttcttctc

SEQ ID NO: 67253 - DNA, 10 bp, Unknown
  misc_feature (1)..( 10): Matrix.004 file - promoters50/1035665
gatggttcac

SEQ ID NO: 67254 - DNA, 8 bp, Unknown
  misc_feature (1)..( 8): Matrix.004 file - promoters50/1035665
taatttat

SEQ ID NO: 67255 - DNA, 9 bp, Unknown
  misc_feature (1)..( 9): Matrix.004 file - promoters50/1035665
acatcttaa

SEQ ID NO: 67256 - DNA, 12 bp, Unknown
  misc_feature (1)..( 12): Matrix.004 file - promoters50/1375217
atgcatttaaaa

SEQ ID NO: 67257 - DNA, 10 bp, Unknown
  misc_feature (1)..( 10): Matrix.004 file - promoters50/1375217
atatttgttt

SEQ ID NO: 67258 - DNA, 6 bp, Unknown
  misc_feature (1)..( 6): Matrix.004 file - promoters50/1375217
ataatc

SEQ ID NO: 67259 - DNA, 9 bp, Unknown
  misc_feature (1)..( 9): Matrix.004 file - promoters50/1375217
aaagttaaa

SEQ ID NO: 67260 - DNA, 6 bp, Unknown
  misc_feature (1)..( 6): Matrix.004 file - promoters50/1375252
ataaaa

SEQ ID NO: 67261 - DNA, 15 bp, Unknown
  misc_feature (1)..( 15): Matrix.004 file - promoters50/1375255
ttcttgatttaaacc

SEQ ID NO: 67262 - DNA, 10 bp, Unknown
  misc_feature (1)..( 10): Matrix.004 file - promoters50/1375305
gtttaaaaag

SEQ ID NO: 67263 - DNA, 10 bp, Unknown
  misc_feature (1)..( 10): Matrix.004 file - promoters50/1375305
attggataat

SEQ ID NO: 67264 - DNA, 8 bp, Unknown
  misc_feature (1)..( 8): Matrix.004 file - promoters50/1375347
caaagaaa

SEQ ID NO: 67265 - DNA, 7 bp, Unknown
  misc_feature (1)..( 7): Matrix.004 file - promoters50/1375456
tcatata

SEQ ID NO: 67266 - DNA, 9 bp, Unknown
  misc_feature (1)..( 9): Matrix.004 file - promoters50/1375456
ttggaacaa

SEQ ID NO: 67267 - DNA, 9 bp, Unknown
  misc_feature (1)..( 9): Matrix.004 file - promoters50/1375456
agaaagaaa

SEQ ID NO: 67268 - DNA, 10 bp, Unknown
  misc_feature (1)..( 10): Matrix.004 file - promoters50/1375456
agaaaagaaa

SEQ ID NO: 67269 - DNA, 11 bp, Unknown
  misc_feature (1)..( 11): Matrix.004 file - promoters50/1375471
gaaatataata

SEQ ID NO: 67270 - DNA, 12 bp, Unknown
  misc_feature (1)..( 12): Matrix.004 file - promoters50/1375474
tacaaaataaaa

SEQ ID NO: 67271 - DNA, 10 bp, Unknown
  misc_feature (1)..( 10): Matrix.004 file - promoters50/1375474
cactttcttc

SEQ ID NO: 67272 - DNA, 10 bp, Unknown
  misc_feature (1)..( 10): Matrix.004 file - promoters50/1375547
aaacctaaat

SEQ ID NO: 67273 - DNA, 7 bp, Unknown
  misc_feature (1)..( 7): Matrix.004 file - promoters50/1375615
ctttatt

SEQ ID NO: 67274 - DNA, 8 bp, Unknown
  misc_feature (1)..( 8): Matrix.004 file - promoters50/1375615
atcatatt

SEQ ID NO: 67275 - DNA, 7 bp, Unknown
  misc_feature (1)..( 7): Matrix.004 file - promoters50/1375615
gatttgt

SEQ ID NO: 67276 - DNA, 12 bp, Unknown
  misc_feature (1)..( 12): Matrix.004 file - promoters50/1375615
agtttgttcaat

SEQ ID NO: 67277 - DNA, 7 bp, Unknown
  misc_feature (1)..( 7): Matrix.004 file - promoters50/1375615
tgtttgt

SEQ ID NO: 67278 - DNA, 7 bp, Unknown
  misc_feature (1)..( 7): Matrix.004 file - promoters50/1375615
gtttgtt

SEQ ID NO: 67279 - DNA, 9 bp, Unknown
  misc_feature (1)..( 9): Matrix.004 file - promoters50/1375634
tttgtagtg

SEQ ID NO: 67280 - DNA, 14 bp, Unknown
  misc_feature (1)..( 14): Matrix.004 file - promoters50/1375642
aaagtaagcatatt

SEQ ID NO: 67281 - DNA, 8 bp, Unknown
  misc_feature (1)..( 8): Matrix.004 file - promoters50/1375642
ttataaat

SEQ ID NO: 67282 - DNA, 11 bp, Unknown
  misc_feature (1)..( 11): Matrix.004 file - promoters50/1375642
ctctataaaat

SEQ ID NO: 67283 - DNA, 8 bp, Unknown
  misc_feature (1)..( 8): Matrix.004 file - promoters50/1375642
attaaaat

SEQ ID NO: 67284 - DNA, 8 bp, Unknown
  misc_feature (1)..( 8): Matrix.004 file - promoters50/1375642
aaagaatt

SEQ ID NO: 67285 - DNA, 7 bp, Unknown
  misc_feature (1)..( 7): Matrix.004 file - promoters50/1375675
aggaaaa

SEQ ID NO: 67286 - DNA, 8 bp, Unknown
  misc_feature (1)..( 8): Matrix.004 file - promoters50/1375793
aatcctaa

SEQ ID NO: 67287 - DNA, 9 bp, Unknown
  misc_feature (1)..( 9): Matrix.004 file - promoters50/1375801
tgtttgttt

SEQ ID NO: 67288 - DNA, 9 bp, Unknown
  misc_feature (1)..( 9): Matrix.004 file - promoters50/1375801
tttgtgatt

SEQ ID NO: 67289 - DNA, 9 bp, Unknown
  misc_feature (1)..( 9): Matrix.004 file - promoters50/1375801
aaaccaaat

SEQ ID NO: 67290 - DNA, 9 bp, Unknown
  misc_feature (1)..( 9): Matrix.004 file - promoters50/1375832
ttttatgtc

SEQ ID NO: 67291 - DNA, 9 bp, Unknown
  misc_feature (1)..( 9): Matrix.004 file - promoters50/1375832
ccaagaaaa

SEQ ID NO: 67292 - DNA, 8 bp, Unknown
  misc_feature (1)..( 8): Matrix.004 file - promoters50/1375832
agaaattt

SEQ ID NO: 67293 - DNA, 7 bp, Unknown
  misc_feature (1)..( 7): Matrix.004 file - promoters50/1375832
aaataaa

SEQ ID NO: 67294 - DNA, 8 bp, Unknown
  misc_feature (1)..( 8): Matrix.004 file - promoters50/1375832
caaataaa

SEQ ID NO: 67295 - DNA, 8 bp, Unknown
  misc_feature (1)..( 8): Matrix.004 file - promoters50/1375832
ataataat

SEQ ID NO: 67296 - DNA, 8 bp, Unknown
  misc_feature (1)..( 8): Matrix.004 file - promoters50/1375838
gaaagaat

SEQ ID NO: 67297 - DNA, 9 bp, Unknown
  misc_feature (1)..( 9): Matrix.004 file - promoters50/1375957
taaacataa

SEQ ID NO: 67298 - DNA, 8 bp, Unknown
  misc_feature (1)..( 8): Matrix.004 file - promoters50/1375957
attttttg

SEQ ID NO: 67299 - DNA, 11 bp, Unknown
  misc_feature (1)..( 11): Matrix.004 file - promoters50/1375957
aataaactata

SEQ ID NO: 67300 - DNA, 8 bp, Unknown
  misc_feature (1)..( 8): Matrix.004 file - promoters50/1375957
acaaaata

SEQ ID NO: 67301 - DNA, 10 bp, Unknown
  misc_feature (1)..( 10): Matrix.004 file - promoters50/1375957
tataaattta

SEQ ID NO: 67302 - DNA, 17 bp, Unknown
  misc_feature (1)..( 17): Matrix.004 file - promoters50/1375957
ttatgacatttaaaaaa

SEQ ID NO: 67303 - DNA, 12 bp, Unknown
  misc_feature (1)..( 12): Matrix.004 file - promoters50/1375988
attaaatgttta

SEQ ID NO: 67304 - DNA, 13 bp, Unknown
  misc_feature (1)..( 13): Matrix.004 file - promoters50/1375995
taaaaattttaac

SEQ ID NO: 67305 - DNA, 8 bp, Unknown
  misc_feature (1)..( 8): Matrix.004 file - promoters50/1375995
agtaatta

SEQ ID NO: 67306 - DNA, 8 bp, Unknown
  misc_feature (1)..( 8): Matrix.004 file - promoters50/1375995
ttaaaaaa

SEQ ID NO: 67307 - DNA, 6 bp, Unknown
  misc_feature (1)..( 6): Matrix.004 file - promoters50/1375995
taataa

SEQ ID NO: 67308 - DNA, 10 bp, Unknown
  misc_feature (1)..( 10): Matrix.004 file - promoters50/1376069
aataataata

SEQ ID NO: 67309 - DNA, 10 bp, Unknown
  misc_feature (1)..( 10): Matrix.004 file - promoters50/1376069
taatctaatt

SEQ ID NO: 67310 - DNA, 8 bp, Unknown
  misc_feature (1)..( 8): Matrix.004 file - promoters50/1376069
agaataaa

SEQ ID NO: 67311 - DNA, 9 bp, Unknown
  misc_feature (1)..( 9): Matrix.004 file - promoters50/1376069
aaagaataa

SEQ ID NO: 67312 - DNA, 7 bp, Unknown
  misc_feature (1)..( 7): Matrix.004 file - promoters50/1376069
aaacttt

SEQ ID NO: 67313 - DNA, 7 bp, Unknown
  misc_feature (1)..( 7): Matrix.004 file - promoters50/1376069
taatcta

SEQ ID NO: 67314 - DNA, 7 bp, Unknown
  misc_feature (1)..( 7): Matrix.004 file - promoters50/1376069
attcttt

SEQ ID NO: 67315 - DNA, 8 bp, Unknown
  misc_feature (1)..( 8): Matrix.004 file - promoters50/1376069
attgtgaa

SEQ ID NO: 67316 - DNA, 8 bp, Unknown
  misc_feature (1)..( 8): Matrix.004 file - promoters50/1376340
taataaaa

SEQ ID NO: 67317 - DNA, 6 bp, Unknown
  misc_feature (1)..( 6): Matrix.004 file - promoters50/1376361
aaaaat

SEQ ID NO: 67318 - DNA, 10 bp, Unknown
  misc_feature (1)..( 10): Matrix.004 file - promoters50/1376455
taatactatt

SEQ ID NO: 67319 - DNA, 11 bp, Unknown
  misc_feature (1)..( 11): Matrix.004 file - promoters50/1376455
aaaaataaacg

SEQ ID NO: 67320 - DNA, 10 bp, Unknown
  misc_feature (1)..( 10): Matrix.004 file - promoters50/1376455
ttgaacaaac

SEQ ID NO: 67321 - DNA, 7 bp, Unknown
  misc_feature (1)..( 7): Matrix.004 file - promoters50/1376455
tgaatta

SEQ ID NO: 67322 - DNA, 10 bp, Unknown
  misc_feature (1)..( 10): Matrix.004 file - promoters50/1376490
tagaaaatga

SEQ ID NO: 67323 - DNA, 11 bp, Unknown
  misc_feature (1)..( 11): Matrix.004 file - promoters50/1376490
aaataaattaa

SEQ ID NO: 67324 - DNA, 10 bp, Unknown
  misc_feature (1)..( 10): Matrix.004 file - promoters50/1376559
aatagattaa

SEQ ID NO: 67325 - DNA, 10 bp, Unknown
  misc_feature (1)..( 10): Matrix.004 file - promoters50/1376650
gcagaggaag

SEQ ID NO: 67326 - DNA, 12 bp, Unknown
  misc_feature (1)..( 12): Matrix.004 file - promoters50/1376726
aaataaaataaa

SEQ ID NO: 67327 - DNA, 8 bp, Unknown
  misc_feature (1)..( 8): Matrix.004 file - promoters50/1376726
tattttct

SEQ ID NO: 67328 - DNA, 8 bp, Unknown
  misc_feature (1)..( 8): Matrix.004 file - promoters50/1376726
taaaaatc

SEQ ID NO: 67329 - DNA, 9 bp, Unknown
  misc_feature (1)..( 9): Matrix.004 file - promoters50/1376733
attagaaaa

SEQ ID NO: 67330 - DNA, 10 bp, Unknown
  misc_feature (1)..( 10): Matrix.004 file - promoters50/1376733
actttttcta

SEQ ID NO: 67331 - DNA, 9 bp, Unknown
  misc_feature (1)..( 9): Matrix.004 file - promoters50/1376733
aaaattgtc

SEQ ID NO: 67332 - DNA, 7 bp, Unknown
  misc_feature (1)..( 7): Matrix.004 file - promoters50/1376737
tattttc

SEQ ID NO: 67333 - DNA, 8 bp, Unknown
  misc_feature (1)..( 8): Matrix.004 file - promoters50/1376737
ggtttatt

SEQ ID NO: 67334 - DNA, 8 bp, Unknown
  misc_feature (1)..( 8): Matrix.004 file - promoters50/1376737
ctacaaaa

SEQ ID NO: 67335 - DNA, 10 bp, Unknown
  misc_feature (1)..( 10): Matrix.004 file - promoters50/1376859
taaagcaaaa

SEQ ID NO: 67336 - DNA, 8 bp, Unknown
  misc_feature (1)..( 8): Matrix.004 file - promoters50/1376881
atcattta

SEQ ID NO: 67337 - DNA, 10 bp, Unknown
  misc_feature (1)..( 10): Matrix.004 file - promoters50/1376881
gaaacaaaaa

SEQ ID NO: 67338 - DNA, 6 bp, Unknown
  misc_feature (1)..( 6): Matrix.004 file - promoters50/1376958
agtaaa

SEQ ID NO: 67339 - DNA, 11 bp, Unknown
  misc_feature (1)..( 11): Matrix.004 file - promoters50/1376958
aatcatacaaa

SEQ ID NO: 67340 - DNA, 10 bp, Unknown
  misc_feature (1)..( 10): Matrix.004 file - promoters50/1376980
acacattaag

SEQ ID NO: 67341 - DNA, 7 bp, Unknown
  misc_feature (1)..( 7): Matrix.004 file - promoters50/1376980
aaaattt

SEQ ID NO: 67342 - DNA, 8 bp, Unknown
  misc_feature (1)..( 8): Matrix.004 file - promoters50/1376980
tatataaa

SEQ ID NO: 67343 - DNA, 7 bp, Unknown
  misc_feature (1)..( 7): Matrix.004 file - promoters50/1376992
attaaat

SEQ ID NO: 67344 - DNA, 12 bp, Unknown
  misc_feature (1)..( 12): Matrix.004 file - promoters50/1376992
atattaatcatt

SEQ ID NO: 67345 - DNA, 7 bp, Unknown
  misc_feature (1)..( 7): Matrix.004 file - promoters50/1376992
attaaat

SEQ ID NO: 67346 - DNA, 7 bp, Unknown
  misc_feature (1)..( 7): Matrix.004 file - promoters50/1376992
gttaaat

SEQ ID NO: 67347 - DNA, 7 bp, Unknown
  misc_feature (1)..( 7): Matrix.004 file - promoters50/1376992
aaataaa

SEQ ID NO: 67348 - DNA, 10 bp, Unknown
  misc_feature (1)..( 10): Matrix.004 file - promoters50/1377007
aaacataact

SEQ ID NO: 67349 - DNA, 8 bp, Unknown
  misc_feature (1)..( 8): Matrix.004 file - promoters50/1377007
ctaaatga

SEQ ID NO: 67350 - DNA, 12 bp, Unknown
  misc_feature (1)..( 12): Matrix.004 file - promoters50/1377007
ctcaatgtcttt

SEQ ID NO: 67351 - DNA, 7 bp, Unknown
  misc_feature (1)..( 7): Matrix.004 file - promoters50/1377007
gtttgaa

SEQ ID NO: 67352 - DNA, 8 bp, Unknown
  misc_feature (1)..( 8): Matrix.004 file - promoters50/1377007
tcaaaatt

SEQ ID NO: 67353 - DNA, 10 bp, Unknown
  misc_feature (1)..( 10): Matrix.004 file - promoters50/1377007
tttgaatcaa

SEQ ID NO: 67354 - DNA, 9 bp, Unknown
  misc_feature (1)..( 9): Matrix.004 file - promoters50/1377045
tttattact

SEQ ID NO: 67355 - DNA, 11 bp, Unknown
  misc_feature (1)..( 11): Matrix.004 file - promoters50/1377045
attcaaccaaa

SEQ ID NO: 67356 - DNA, 7 bp, Unknown
  misc_feature (1)..( 7): Matrix.004 file - promoters50/1377045
aaaaaaa

SEQ ID NO: 67357 - DNA, 6 bp, Unknown
  misc_feature (1)..( 6): Matrix.004 file - promoters50/1377139
aaaaaa

SEQ ID NO: 67358 - DNA, 10 bp, Unknown
  misc_feature (1)..( 10): Matrix.004 file - promoters50/1377192
tcaagttaaa

SEQ ID NO: 67359 - DNA, 15 bp, Unknown
  misc_feature (1)..( 15): Matrix.004 file - promoters50/1377192
tttattcaaccgatt

SEQ ID NO: 67360 - DNA, 12 bp, Unknown
  misc_feature (1)..( 12): Matrix.004 file - promoters50/1377192
tcattttcacat

SEQ ID NO: 67361 - DNA, 13 bp, Unknown
  misc_feature (1)..( 13): Matrix.004 file - promoters50/1377197
ttttcaaaagctt

SEQ ID NO: 67362 - DNA, 9 bp, Unknown
  misc_feature (1)..( 9): Matrix.004 file - promoters50/1377249
aaaaagaag

SEQ ID NO: 67363 - DNA, 8 bp, Unknown
  misc_feature (1)..( 8): Matrix.004 file - promoters50/1377268
taaataac

SEQ ID NO: 67364 - DNA, 10 bp, Unknown
  misc_feature (1)..( 10): Matrix.004 file - promoters50/1377268
aaactacaac

SEQ ID NO: 67365 - DNA, 10 bp, Unknown
  misc_feature (1)..( 10): Matrix.004 file - promoters50/1377268
aaacgtgaaa

SEQ ID NO: 67366 - DNA, 9 bp, Unknown
  misc_feature (1)..( 9): Matrix.004 file - promoters50/1377268
aactattta

SEQ ID NO: 67367 - DNA, 8 bp, Unknown
  misc_feature (1)..( 8): Matrix.004 file - promoters50/1377268
caacttat

SEQ ID NO: 67368 - DNA, 11 bp, Unknown
  misc_feature (1)..( 11): Matrix.004 file - promoters50/1377268
tatatataaag

SEQ ID NO: 67369 - DNA, 9 bp, Unknown
  misc_feature (1)..( 9): Matrix.004 file - promoters50/1377417
acttgtata

SEQ ID NO: 67370 - DNA, 8 bp, Unknown
  misc_feature (1)..( 8): Matrix.004 file - promoters50/1377472
caaaaaca

SEQ ID NO: 67371 - DNA, 12 bp, Unknown
  misc_feature (1)..( 12): Matrix.004 file - promoters50/1377472
cttgtttcaaga

SEQ ID NO: 67372 - DNA, 12 bp, Unknown
  misc_feature (1)..( 12): Matrix.004 file - promoters50/1377506
agattatttatt

SEQ ID NO: 67373 - DNA, 10 bp, Unknown
  misc_feature (1)..( 10): Matrix.004 file - promoters50/1377506
gaatatgtaa

SEQ ID NO: 67374 - DNA, 6 bp, Unknown
  misc_feature (1)..( 6): Matrix.004 file - promoters50/1377506
tcttcc

SEQ ID NO: 67375 - DNA, 8 bp, Unknown
  misc_feature (1)..( 8): Matrix.004 file - promoters50/1377506
tcttctcc

SEQ ID NO: 67376 - DNA, 8 bp, Unknown
  misc_feature (1)..( 8): Matrix.004 file - promoters50/1377522
tctggttt

SEQ ID NO: 67377 - DNA, 9 bp, Unknown
  misc_feature (1)..( 9): Matrix.004 file - promoters50/1377522
tgatatctc

SEQ ID NO: 67378 - DNA, 8 bp, Unknown
  misc_feature (1)..( 8): Matrix.004 file - promoters50/1377540
cgacatgt

SEQ ID NO: 67379 - DNA, 9 bp, Unknown
  misc_feature (1)..( 9): Matrix.004 file - promoters50/1377540
caaaattct

SEQ ID NO: 67380 - DNA, 10 bp, Unknown
  misc_feature (1)..( 10): Matrix.004 file - promoters50/1377540
atatttttgt

SEQ ID NO: 67381 - DNA, 10 bp, Unknown
  misc_feature (1)..( 10): Matrix.004 file - promoters50/1377564
gattaaataa

SEQ ID NO: 67382 - DNA, 7 bp, Unknown
  misc_feature (1)..( 7): Matrix.004 file - promoters50/1377564
attttac

SEQ ID NO: 67383 - DNA, 9 bp, Unknown
  misc_feature (1)..( 9): Matrix.004 file - promoters50/1377564
aagtaataa

SEQ ID NO: 67384 - DNA, 7 bp, Unknown
  misc_feature (1)..( 7): Matrix.004 file - promoters50/1377564
caaaatc

SEQ ID NO: 67385 - DNA, 8 bp, Unknown
  misc_feature (1)..( 8): Matrix.004 file - promoters50/1377564
ttatgtct

SEQ ID NO: 67386 - DNA, 7 bp, Unknown
  misc_feature (1)..( 7): Matrix.004 file - promoters50/1377613
gatcgat

SEQ ID NO: 67387 - DNA, 8 bp, Unknown
  misc_feature (1)..( 8): Matrix.004 file - promoters50/1377613
caaacata

SEQ ID NO: 67388 - DNA, 9 bp, Unknown
  misc_feature (1)..( 9): Matrix.004 file - promoters50/1377613
tacaaaaaa

SEQ ID NO: 67389 - DNA, 9 bp, Unknown
  misc_feature (1)..( 9): Matrix.004 file - promoters50/1377613
aaaaataaa

SEQ ID NO: 67390 - DNA, 9 bp, Unknown
  misc_feature (1)..( 9): Matrix.004 file - promoters50/1377613
tataaaacc

SEQ ID NO: 67391 - DNA, 9 bp, Unknown
  misc_feature (1)..( 9): Matrix.004 file - promoters50/1377642
tataaaacc

SEQ ID NO: 67392 - DNA, 8 bp, Unknown
  misc_feature (1)..( 8): Matrix.004 file - promoters50/1377642
atttattt

SEQ ID NO: 67393 - DNA, 11 bp, Unknown
  misc_feature (1)..( 11): Matrix.004 file - promoters50/1377642
tatcaaaacaa

SEQ ID NO: 67394 - DNA, 8 bp, Unknown
  misc_feature (1)..( 8): Matrix.004 file - promoters50/1377642
aaacttta

SEQ ID NO: 67395 - DNA, 13 bp, Unknown
  misc_feature (1)..( 13): Matrix.004 file - promoters50/1377642
aaatataataaca

SEQ ID NO: 67396 - DNA, 10 bp, Unknown
  misc_feature (1)..( 10): Matrix.004 file - promoters50/1377642
tgattttgtt

SEQ ID NO: 67397 - DNA, 11 bp, Unknown
  misc_feature (1)..( 11): Matrix.004 file - promoters50/1377642
ataagaatatg

SEQ ID NO: 67398 - DNA, 9 bp, Unknown
  misc_feature (1)..( 9): Matrix.004 file - promoters50/1377642
ataaaaaat

SEQ ID NO: 67399 - DNA, 10 bp, Unknown
  misc_feature (1)..( 10): Matrix.004 file - promoters50/1377664
ttttatcaaa

SEQ ID NO: 67400 - DNA, 9 bp, Unknown
  misc_feature (1)..( 9): Matrix.004 file - promoters50/1377664
gttcatagc

SEQ ID NO: 67401 - DNA, 8 bp, Unknown
  misc_feature (1)..( 8): Matrix.004 file - promoters50/1377664
aaaaaaag

SEQ ID NO: 67402 - DNA, 11 bp, Unknown
  misc_feature (1)..( 11): Matrix.004 file - promoters50/1377664
ctaaaaataat

SEQ ID NO: 67403 - DNA, 9 bp, Unknown
  misc_feature (1)..( 9): Matrix.004 file - promoters50/1377680
aaaaaaatg

SEQ ID NO: 67404 - DNA, 10 bp, Unknown
  misc_feature (1)..( 10): Matrix.004 file - promoters50/1377680
aaatcatatt

SEQ ID NO: 67405 - DNA, 11 bp, Unknown
  misc_feature (1)..( 11): Matrix.004 file - promoters50/1377687
gtaataaatac

SEQ ID NO: 67406 - DNA, 15 bp, Unknown
  misc_feature (1)..( 15): Matrix.004 file - promoters50/1377687
acaaaaataaatcac

SEQ ID NO: 67407 - DNA, 8 bp, Unknown
  misc_feature (1)..( 8): Matrix.004 file - promoters50/1377687
aaaacaat

SEQ ID NO: 67408 - DNA, 7 bp, Unknown
  misc_feature (1)..( 7): Matrix.004 file - promoters50/1377714
cttatct

SEQ ID NO: 67409 - DNA, 15 bp, Unknown
  misc_feature (1)..( 15): Matrix.004 file - promoters50/1377714
gttattaattttttg

SEQ ID NO: 67410 - DNA, 11 bp, Unknown
  misc_feature (1)..( 11): Matrix.004 file - promoters50/1377718
atcttgataat

SEQ ID NO: 67411 - DNA, 10 bp, Unknown
  misc_feature (1)..( 10): Matrix.004 file - promoters50/1377734
taaatttgct

SEQ ID NO: 67412 - DNA, 7 bp, Unknown
  misc_feature (1)..( 7): Matrix.004 file - promoters50/1377740
ttgactc

SEQ ID NO: 67413 - DNA, 7 bp, Unknown
  misc_feature (1)..( 7): Matrix.004 file - promoters50/1377740
taaaatg

SEQ ID NO: 67414 - DNA, 11 bp, Unknown
  misc_feature (1)..( 11): Matrix.004 file - promoters50/1377740
cacataattaa

SEQ ID NO: 67415 - DNA, 11 bp, Unknown
  misc_feature (1)..( 11): Matrix.004 file - promoters50/1377740
ctgtcataatc

SEQ ID NO: 67416 - DNA, 9 bp, Unknown
  misc_feature (1)..( 9): Matrix.004 file - promoters50/1377835
ttaaaaaat

SEQ ID NO: 67417 - DNA, 7 bp, Unknown
  misc_feature (1)..( 7): Matrix.004 file - promoters50/1377835
aaaagat

SEQ ID NO: 67418 - DNA, 10 bp, Unknown
  misc_feature (1)..( 10): Matrix.004 file - promoters50/1377835
tttttcttcc

SEQ ID NO: 67419 - DNA, 10 bp, Unknown
  misc_feature (1)..( 10): Matrix.004 file - promoters50/1377835
gtaaaaattt

SEQ ID NO: 67420 - DNA, 11 bp, Unknown
  misc_feature (1)..( 11): Matrix.004 file - promoters50/1377835
caaactaattt

SEQ ID NO: 67421 - DNA, 12 bp, Unknown
  misc_feature (1)..( 12): Matrix.004 file - promoters50/1377835
agaaaacaaaat

SEQ ID NO: 67422 - DNA, 8 bp, Unknown
  misc_feature (1)..( 8): Matrix.004 file - promoters50/1377835
acaaaaca

SEQ ID NO: 67423 - DNA, 19 bp, Unknown
  misc_feature (1)..( 19): Matrix.004 file - promoters50/1377835
tttaattggtcaaaagaaa

SEQ ID NO: 67424 - DNA, 7 bp, Unknown
  misc_feature (1)..( 7): Matrix.004 file - promoters50/1377835
ccactaa

SEQ ID NO: 67425 - DNA, 9 bp, Unknown
  misc_feature (1)..( 9): Matrix.004 file - promoters50/1377835
agataaaaa

SEQ ID NO: 67426 - DNA, 9 bp, Unknown
  misc_feature (1)..( 9): Matrix.004 file - promoters50/1377847
cttattttt

SEQ ID NO: 67427 - DNA, 6 bp, Unknown
  misc_feature (1)..( 6): Matrix.004 file - promoters50/1377847
aaaacc

SEQ ID NO: 67428 - DNA, 10 bp, Unknown
  misc_feature (1)..( 10): Matrix.004 file - promoters50/1377847
attctcttaa

SEQ ID NO: 67429 - DNA, 6 bp, Unknown
  misc_feature (1)..( 6): Matrix.004 file - promoters50/1377847
aaaatc

SEQ ID NO: 67430 - DNA, 12 bp, Unknown
  misc_feature (1)..( 12): Matrix.004 file - promoters50/1377847
taataaagaaga

SEQ ID NO: 67431 - DNA, 12 bp, Unknown
  misc_feature (1)..( 12): Matrix.004 file - promoters50/1377893
acctttataaat

SEQ ID NO: 67432 - DNA, 6 bp, Unknown
  misc_feature (1)..( 6): Matrix.004 file - promoters50/1377929
attaaa

SEQ ID NO: 67433 - DNA, 11 bp, Unknown
  misc_feature (1)..( 11): Matrix.004 file - promoters50/1378049
ttacttaataa

SEQ ID NO: 67434 - DNA, 12 bp, Unknown
  misc_feature (1)..( 12): Matrix.004 file - promoters50/1378049
aaacaaatcttt

SEQ ID NO: 67435 - DNA, 8 bp, Unknown
  misc_feature (1)..( 8): Matrix.004 file - promoters50/1378049
aaaattaa

SEQ ID NO: 67436 - DNA, 6 bp, Unknown
  misc_feature (1)..( 6): Matrix.004 file - promoters50/1378049
gtaata

SEQ ID NO: 67437 - DNA, 12 bp, Unknown
  misc_feature (1)..( 12): Matrix.004 file - promoters50/1378049
tcaactttgaga

SEQ ID NO: 67438 - DNA, 10 bp, Unknown
  misc_feature (1)..( 10): Matrix.004 file - promoters50/1378049
aaatgatata

SEQ ID NO: 67439 - DNA, 7 bp, Unknown
  misc_feature (1)..( 7): Matrix.004 file - promoters50/1378061
aataata

SEQ ID NO: 67440 - DNA, 9 bp, Unknown
  misc_feature (1)..( 9): Matrix.004 file - promoters50/1378061
tttattttc

SEQ ID NO: 67441 - DNA, 9 bp, Unknown
  misc_feature (1)..( 9): Matrix.004 file - promoters50/1378061
atgtatatt

SEQ ID NO: 67442 - DNA, 10 bp, Unknown
  misc_feature (1)..( 10): Matrix.004 file - promoters50/1378061
tattaaattt

SEQ ID NO: 67443 - DNA, 9 bp, Unknown
  misc_feature (1)..( 9): Matrix.004 file - promoters50/1378061
aaccatata

SEQ ID NO: 67444 - DNA, 9 bp, Unknown
  misc_feature (1)..( 9): Matrix.004 file - promoters50/1378061
aacatttat

SEQ ID NO: 67445 - DNA, 14 bp, Unknown
  misc_feature (1)..( 14): Matrix.004 file - promoters50/1378078
gtgaaattcatttg

SEQ ID NO: 67446 - DNA, 9 bp, Unknown
  misc_feature (1)..( 9): Matrix.004 file - promoters50/1378088
taatttttg

SEQ ID NO: 67447 - DNA, 9 bp, Unknown
  misc_feature (1)..( 9): Matrix.004 file - promoters50/1378088
aaaaattat

SEQ ID NO: 67448 - DNA, 12 bp, Unknown
  misc_feature (1)..( 12): Matrix.004 file - promoters50/1378088
gaaaaattcttt

SEQ ID NO: 67449 - DNA, 9 bp, Unknown
  misc_feature (1)..( 9): Matrix.004 file - promoters50/1378088
aaaaacatt

SEQ ID NO: 67450 - DNA, 11 bp, Unknown
  misc_feature (1)..( 11): Matrix.004 file - promoters50/1378088
tcaaaattaaa

SEQ ID NO: 67451 - DNA, 10 bp, Unknown
  misc_feature (1)..( 10): Matrix.004 file - promoters50/1378088
taaaatttta

SEQ ID NO: 67452 - DNA, 10 bp, Unknown
  misc_feature (1)..( 10): Matrix.004 file - promoters50/1378088
actttataat

SEQ ID NO: 67453 - DNA, 10 bp, Unknown
  misc_feature (1)..( 10): Matrix.004 file - promoters50/1378088
gttaaaaaat

SEQ ID NO: 67454 - DNA, 12 bp, Unknown
  misc_feature (1)..( 12): Matrix.004 file - promoters50/1378088
taaaaatacaaa

SEQ ID NO: 67455 - DNA, 9 bp, Unknown
  misc_feature (1)..( 9): Matrix.004 file - promoters50/1378088
aattaatag

SEQ ID NO: 67456 - DNA, 13 bp, Unknown
  misc_feature (1)..( 13): Matrix.004 file - promoters50/1378287
ttataaaaagata

SEQ ID NO: 67457 - DNA, 18 bp, Unknown
  misc_feature (1)..( 18): Matrix.004 file - promoters50/1378333
taaatttaaaaaaccata

SEQ ID NO: 67458 - DNA, 7 bp, Unknown
  misc_feature (1)..( 7): Matrix.004 file - promoters50/1378357
gctgaaa

SEQ ID NO: 67459 - DNA, 9 bp, Unknown
  misc_feature (1)..( 9): Matrix.004 file - promoters50/1378393
gaggaagaa

SEQ ID NO: 67460 - DNA, 12 bp, Unknown
  misc_feature (1)..( 12): Matrix.004 file - promoters50/1378393
aagaaaagaaaa

SEQ ID NO: 67461 - DNA, 8 bp, Unknown
  misc_feature (1)..( 8): Matrix.004 file - promoters50/1378400
aaaaataa

SEQ ID NO: 67462 - DNA, 8 bp, Unknown
  misc_feature (1)..( 8): Matrix.004 file - promoters50/1378400
gaaaagaa

SEQ ID NO: 67463 - DNA, 13 bp, Unknown
  misc_feature (1)..( 13): Matrix.004 file - promoters50/1378400
agagagagaagag

SEQ ID NO: 67464 - DNA, 8 bp, Unknown
  misc_feature (1)..( 8): Matrix.004 file - promoters50/1378458
gaagagaa

SEQ ID NO: 67465 - DNA, 8 bp, Unknown
  misc_feature (1)..( 8): Matrix.004 file - promoters50/1378528
aaagaaaa

SEQ ID NO: 67466 - DNA, 13 bp, Unknown
  misc_feature (1)..( 13): Matrix.004 file - promoters50/1378528
tcttttaaataaa

SEQ ID NO: 67467 - DNA, 13 bp, Unknown
  misc_feature (1)..( 13): Matrix.004 file - promoters50/1378528
taataatgaaaaa

SEQ ID NO: 67468 - DNA, 10 bp, Unknown
  misc_feature (1)..( 10): Matrix.004 file - promoters50/1378528
aaataatttt

SEQ ID NO: 67469 - DNA, 11 bp, Unknown
  misc_feature (1)..( 11): Matrix.004 file - promoters50/1378528
ataatttaatt

SEQ ID NO: 67470 - DNA, 9 bp, Unknown
  misc_feature (1)..( 9): Matrix.004 file - promoters50/1378558
aattttcta

SEQ ID NO: 67471 - DNA, 10 bp, Unknown
  misc_feature (1)..( 10): Matrix.004 file - promoters50/1378558
attttgtttt

SEQ ID NO: 67472 - DNA, 9 bp, Unknown
  misc_feature (1)..( 9): Matrix.004 file - promoters50/1378577
gtattttta

SEQ ID NO: 67473 - DNA, 10 bp, Unknown
  misc_feature (1)..( 10): Matrix.004 file - promoters50/1378592
ttagcttctt

SEQ ID NO: 67474 - DNA, 13 bp, Unknown
  misc_feature (1)..( 13): Matrix.004 file - promoters50/1378592
gaatattaaagat

SEQ ID NO: 67475 - DNA, 11 bp, Unknown
  misc_feature (1)..( 11): Matrix.004 file - promoters50/1378622
taactttacta

SEQ ID NO: 67476 - DNA, 10 bp, Unknown
  misc_feature (1)..( 10): Matrix.004 file - promoters50/1378622
gataaaattt

SEQ ID NO: 67477 - DNA, 10 bp, Unknown
  misc_feature (1)..( 10): Matrix.004 file - promoters50/1378622
gttataatta

SEQ ID NO: 67478 - DNA, 6 bp, Unknown
  misc_feature (1)..( 6): Matrix.004 file - promoters50/1378622
ataaaa

SEQ ID NO: 67479 - DNA, 9 bp, Unknown
  misc_feature (1)..( 9): Matrix.004 file - promoters50/1378622
tcaaataaa

SEQ ID NO: 67480 - DNA, 7 bp, Unknown
  misc_feature (1)..( 7): Matrix.004 file - promoters50/1378622
agataaa

SEQ ID NO: 67481 - DNA, 13 bp, Unknown
  misc_feature (1)..( 13): Matrix.004 file - promoters50/1378636
ttgcatcaatatt

SEQ ID NO: 67482 - DNA, 7 bp, Unknown
  misc_feature (1)..( 7): Matrix.004 file - promoters50/1378636
tttactt

SEQ ID NO: 67483 - DNA, 8 bp, Unknown
  misc_feature (1)..( 8): Matrix.004 file - promoters50/1378636
tcaaattt

SEQ ID NO: 67484 - DNA, 7 bp, Unknown
  misc_feature (1)..( 7): Matrix.004 file - promoters50/1378636
tgaaaaa

SEQ ID NO: 67485 - DNA, 8 bp, Unknown
  misc_feature (1)..( 8): Matrix.004 file - promoters50/1378692
aaaagaaa

SEQ ID NO: 67486 - DNA, 10 bp, Unknown
  misc_feature (1)..( 10): Matrix.004 file - promoters50/1378788
tgatttataa

SEQ ID NO: 67487 - DNA, 7 bp, Unknown
  misc_feature (1)..( 7): Matrix.004 file - promoters50/1378788
attgaac

SEQ ID NO: 67488 - DNA, 10 bp, Unknown
  misc_feature (1)..( 10): Matrix.004 file - promoters50/1378788
aatttactaa

SEQ ID NO: 67489 - DNA, 9 bp, Unknown
  misc_feature (1)..( 9): Matrix.004 file - promoters50/1378788
cgtgtgttt

SEQ ID NO: 67490 - DNA, 12 bp, Unknown
  misc_feature (1)..( 12): Matrix.004 file - promoters50/1378800
tttataatttat

SEQ ID NO: 67491 - DNA, 8 bp, Unknown
  misc_feature (1)..( 8): Matrix.004 file - promoters50/1378800
gtttcttt

SEQ ID NO: 67492 - DNA, 7 bp, Unknown
  misc_feature (1)..( 7): Matrix.004 file - promoters50/1378800
ctttctt

SEQ ID NO: 67493 - DNA, 8 bp, Unknown
  misc_feature (1)..( 8): Matrix.004 file - promoters50/1378800
cataaaaa

SEQ ID NO: 67494 - DNA, 6 bp, Unknown
  misc_feature (1)..( 6): Matrix.004 file - promoters50/1378800
gttttt

SEQ ID NO: 67495 - DNA, 10 bp, Unknown
  misc_feature (1)..( 10): Matrix.004 file - promoters50/1378823
atttttttta

SEQ ID NO: 67496 - DNA, 8 bp, Unknown
  misc_feature (1)..( 8): Matrix.004 file - promoters50/1378823
ttatatct

SEQ ID NO: 67497 - DNA, 9 bp, Unknown
  misc_feature (1)..( 9): Matrix.004 file - promoters50/1378876
tatcatttt

SEQ ID NO: 67498 - DNA, 9 bp, Unknown
  misc_feature (1)..( 9): Matrix.004 file - promoters50/1378876
tgtatggct

SEQ ID NO: 67499 - DNA, 8 bp, Unknown
  misc_feature (1)..( 8): Matrix.004 file - promoters50/1378888
aagaaagt

SEQ ID NO: 67500 - DNA, 11 bp, Unknown
  misc_feature (1)..( 11): Matrix.004 file - promoters50/1378888
caagtatctga

SEQ ID NO: 67501 - DNA, 8 bp, Unknown
  misc_feature (1)..( 8): Matrix.004 file - promoters50/1379005
atatttgt

SEQ ID NO: 67502 - DNA, 9 bp, Unknown
  misc_feature (1)..( 9): Matrix.004 file - promoters50/1379005
atacactta

SEQ ID NO: 67503 - DNA, 7 bp, Unknown
  misc_feature (1)..( 7): Matrix.004 file - promoters50/1379014
attttac

SEQ ID NO: 67504 - DNA, 7 bp, Unknown
  misc_feature (1)..( 7): Matrix.004 file - promoters50/1379014
catgcaa

SEQ ID NO: 67505 - DNA, 8 bp, Unknown
  misc_feature (1)..( 8): Matrix.004 file - promoters50/1379037
aatttaaa

SEQ ID NO: 67506 - DNA, 11 bp, Unknown
  misc_feature (1)..( 11): Matrix.004 file - promoters50/1379037
ttcaaataaaa

SEQ ID NO: 67507 - DNA, 10 bp, Unknown
  misc_feature (1)..( 10): Matrix.004 file - promoters50/1379037
ccaaaatagt

SEQ ID NO: 67508 - DNA, 9 bp, Unknown
  misc_feature (1)..( 9): Matrix.004 file - promoters50/1379037
aagaaaaaa

SEQ ID NO: 67509 - DNA, 11 bp, Unknown
  misc_feature (1)..( 11): Matrix.004 file - promoters50/1379037
aaaaaactcaa

SEQ ID NO: 67510 - DNA, 12 bp, Unknown
  misc_feature (1)..( 12): Matrix.004 file - promoters50/1379037
aaataaatggaa

SEQ ID NO: 67511 - DNA, 8 bp, Unknown
  misc_feature (1)..( 8): Matrix.004 file - promoters50/1379037
gacaaaaa

SEQ ID NO: 67512 - DNA, 9 bp, Unknown
  misc_feature (1)..( 9): Matrix.004 file - promoters50/1379037
aaagtaaag

SEQ ID NO: 67513 - DNA, 9 bp, Unknown
  misc_feature (1)..( 9): Matrix.004 file - promoters50/1379037
agaaagaaa

SEQ ID NO: 67514 - DNA, 11 bp, Unknown
  misc_feature (1)..( 11): Matrix.004 file - promoters50/1379037
agaaaagaaaa

SEQ ID NO: 67515 - DNA, 10 bp, Unknown
  misc_feature (1)..( 10): Matrix.004 file - promoters50/1379043
aaataaaata

SEQ ID NO: 67516 - DNA, 9 bp, Unknown
  misc_feature (1)..( 9): Matrix.004 file - promoters50/1379050
gtatatata

SEQ ID NO: 67517 - DNA, 11 bp, Unknown
  misc_feature (1)..( 11): Matrix.004 file - promoters50/1379050
tgaatgaaaaa

SEQ ID NO: 67518 - DNA, 9 bp, Unknown
  misc_feature (1)..( 9): Matrix.004 file - promoters50/1379075
aatgaaaat

SEQ ID NO: 67519 - DNA, 9 bp, Unknown
  misc_feature (1)..( 9): Matrix.004 file - promoters50/1379075
aaaattaaa

SEQ ID NO: 67520 - DNA, 11 bp, Unknown
  misc_feature (1)..( 11): Matrix.004 file - promoters50/1379075
atttaaaatta

SEQ ID NO: 67521 - DNA, 10 bp, Unknown
  misc_feature (1)..( 10): Matrix.004 file - promoters50/1379075
acaataaaca

SEQ ID NO: 67522 - DNA, 10 bp, Unknown
  misc_feature (1)..( 10): Matrix.004 file - promoters50/1379075
cttttaaata

SEQ ID NO: 67523 - DNA, 15 bp, Unknown
  misc_feature (1)..( 15): Matrix.004 file - promoters50/1379075
tttttaattgtcaaa

SEQ ID NO: 67524 - DNA, 11 bp, Unknown
  misc_feature (1)..( 11): Matrix.004 file - promoters50/1379075
ttctttttcta

SEQ ID NO: 67525 - DNA, 11 bp, Unknown
  misc_feature (1)..( 11): Matrix.004 file - promoters50/1379141
tgcatttatat

SEQ ID NO: 67526 - DNA, 7 bp, Unknown
  misc_feature (1)..( 7): Matrix.004 file - promoters50/1379141
ataaaat

SEQ ID NO: 67527 - DNA, 8 bp, Unknown
  misc_feature (1)..( 8): Matrix.004 file - promoters50/1379166
aagttgat

SEQ ID NO: 67528 - DNA, 9 bp, Unknown
  misc_feature (1)..( 9): Matrix.004 file - promoters50/1379166
tctaaataa

SEQ ID NO: 67529 - DNA, 7 bp, Unknown
  misc_feature (1)..( 7): Matrix.004 file - promoters50/1379166
agaagag

SEQ ID NO: 67530 - DNA, 8 bp, Unknown
  misc_feature (1)..( 8): Matrix.004 file - promoters50/1379166
atcgagaa

SEQ ID NO: 67531 - DNA, 8 bp, Unknown
  misc_feature (1)..( 8): Matrix.004 file - promoters50/1379166
taaaccaa

SEQ ID NO: 67532 - DNA, 11 bp, Unknown
  misc_feature (1)..( 11): Matrix.004 file - promoters50/1379166
gagagtaaaaa

SEQ ID NO: 67533 - DNA, 8 bp, Unknown
  misc_feature (1)..( 8): Matrix.004 file - promoters50/1379166
gaaagaag

SEQ ID NO: 67534 - DNA, 9 bp, Unknown
  misc_feature (1)..( 9): Matrix.004 file - promoters50/1379201
aacccaaaa

SEQ ID NO: 67535 - DNA, 9 bp, Unknown
  misc_feature (1)..( 9): Matrix.004 file - promoters50/1379201
caaatttgc

SEQ ID NO: 67536 - DNA, 10 bp, Unknown
  misc_feature (1)..( 10): Matrix.004 file - promoters50/1379201
caaatttgtt

SEQ ID NO: 67537 - DNA, 11 bp, Unknown
  misc_feature (1)..( 11): Matrix.004 file - promoters50/1379201
gaaaaacacac

SEQ ID NO: 67538 - DNA, 6 bp, Unknown
  misc_feature (1)..( 6): Matrix.004 file - promoters50/1379201
tatatt

SEQ ID NO: 67539 - DNA, 9 bp, Unknown
  misc_feature (1)..( 9): Matrix.004 file - promoters50/1379201
acataatta

SEQ ID NO: 67540 - DNA, 8 bp, Unknown
  misc_feature (1)..( 8): Matrix.004 file - promoters50/1379213
aacaaaaa

SEQ ID NO: 67541 - DNA, 6 bp, Unknown
  misc_feature (1)..( 6): Matrix.004 file - promoters50/1379229
atattt

SEQ ID NO: 67542 - DNA, 9 bp, Unknown
  misc_feature (1)..( 9): Matrix.004 file - promoters50/1379229
gaaaaaaaa

SEQ ID NO: 67543 - DNA, 8 bp, Unknown
  misc_feature (1)..( 8): Matrix.004 file - promoters50/1379229
taaaagaa

SEQ ID NO: 67544 - DNA, 7 bp, Unknown
  misc_feature (1)..( 7): Matrix.004 file - promoters50/1379239
aaaaaca

SEQ ID NO: 67545 - DNA, 8 bp, Unknown
  misc_feature (1)..( 8): Matrix.004 file - promoters50/1379239
aaaacaaa

SEQ ID NO: 67546 - DNA, 9 bp, Unknown
  misc_feature (1)..( 9): Matrix.004 file - promoters50/1379239
aaattaaac

SEQ ID NO: 67547 - DNA, 9 bp, Unknown
  misc_feature (1)..( 9): Matrix.004 file - promoters50/1379295
tataaaaac

SEQ ID NO: 67548 - DNA, 12 bp, Unknown
  misc_feature (1)..( 12): Matrix.004 file - promoters50/1379313
aaaaaagaaaaa

SEQ ID NO: 67549 - DNA, 7 bp, Unknown
  misc_feature (1)..( 7): Matrix.004 file - promoters50/1379362
atcaaac

SEQ ID NO: 67550 - DNA, 9 bp, Unknown
  misc_feature (1)..( 9): Matrix.004 file - promoters50/1379362
ataatttaa

SEQ ID NO: 67551 - DNA, 8 bp, Unknown
  misc_feature (1)..( 8): Matrix.004 file - promoters50/1379362
aaaaataa

SEQ ID NO: 67552 - DNA, 7 bp, Unknown
  misc_feature (1)..( 7): Matrix.004 file - promoters50/1379366
aatatat

SEQ ID NO: 67553 - DNA, 8 bp, Unknown
  misc_feature (1)..( 8): Matrix.004 file - promoters50/1379366
ttaaaaaa

SEQ ID NO: 67554 - DNA, 7 bp, Unknown
  misc_feature (1)..( 7): Matrix.004 file - promoters50/1379366
agagaaa

SEQ ID NO: 67555 - DNA, 8 bp, Unknown
  misc_feature (1)..( 8): Matrix.004 file - promoters50/1379366
acgatgaa

SEQ ID NO: 67556 - DNA, 7 bp, Unknown
  misc_feature (1)..( 7): Matrix.004 file - promoters50/1379366
agatgaa

SEQ ID NO: 67557 - DNA, 8 bp, Unknown
  misc_feature (1)..( 8): Matrix.004 file - promoters50/1379366
tctacaca

SEQ ID NO: 67558 - DNA, 9 bp, Unknown
  misc_feature (1)..( 9): Matrix.004 file - promoters50/1379450
tgtctcatt

SEQ ID NO: 67559 - DNA, 10 bp, Unknown
  misc_feature (1)..( 10): Matrix.004 file - promoters50/1379450
agaggaagaa

SEQ ID NO: 67560 - DNA, 11 bp, Unknown
  misc_feature (1)..( 11): Matrix.004 file - promoters50/1379496
gagaaagaaag

SEQ ID NO: 67561 - DNA, 9 bp, Unknown
  misc_feature (1)..( 9): Matrix.004 file - promoters50/1379496
actaaattt

SEQ ID NO: 67562 - DNA, 13 bp, Unknown
  misc_feature (1)..( 13): Matrix.004 file - promoters50/1379496
gatttttctaata

SEQ ID NO: 67563 - DNA, 9 bp, Unknown
  misc_feature (1)..( 9): Matrix.004 file - promoters50/1379496
taaaaatta

SEQ ID NO: 67564 - DNA, 11 bp, Unknown
  misc_feature (1)..( 11): Matrix.004 file - promoters50/1379496
aataaaaatgt

SEQ ID NO: 67565 - DNA, 10 bp, Unknown
  misc_feature (1)..( 10): Matrix.004 file - promoters50/1379496
aattttcata

SEQ ID NO: 67566 - DNA, 11 bp, Unknown
  misc_feature (1)..( 11): Matrix.004 file - promoters50/1379586
ttaaattattc

SEQ ID NO: 67567 - DNA, 10 bp, Unknown
  misc_feature (1)..( 10): Matrix.004 file - promoters50/1379607
aatatacaat

SEQ ID NO: 67568 - DNA, 18 bp, Unknown
  misc_feature (1)..( 18): Matrix.004 file - promoters50/1379691
tatattcaatattttata

SEQ ID NO: 67569 - DNA, 8 bp, Unknown
  misc_feature (1)..( 8): Matrix.004 file - promoters50/1379691
cttttaag

SEQ ID NO: 67570 - DNA, 6 bp, Unknown
  misc_feature (1)..( 6): Matrix.004 file - promoters50/1379691
aattaa

SEQ ID NO: 67571 - DNA, 9 bp, Unknown
  misc_feature (1)..( 9): Matrix.004 file - promoters50/1379719
tcataagaa

SEQ ID NO: 67572 - DNA, 10 bp, Unknown
  misc_feature (1)..( 10): Matrix.004 file - promoters50/1379777
gatttgtggt

SEQ ID NO: 67573 - DNA, 9 bp, Unknown
  misc_feature (1)..( 9): Matrix.004 file - promoters50/1379893
tgacacaac

SEQ ID NO: 67574 - DNA, 9 bp, Unknown
  misc_feature (1)..( 9): Matrix.004 file - promoters50/1379893
aatttcatc

SEQ ID NO: 67575 - DNA, 8 bp, Unknown
  misc_feature (1)..( 8): Matrix.004 file - promoters50/1379916
tttgtatt

SEQ ID NO: 67576 - DNA, 8 bp, Unknown
  misc_feature (1)..( 8): Matrix.004 file - promoters50/1379916
tttgttct

SEQ ID NO: 67577 - DNA, 10 bp, Unknown
  misc_feature (1)..( 10): Matrix.004 file - promoters50/1379916
tataataaaa

SEQ ID NO: 67578 - DNA, 8 bp, Unknown
  misc_feature (1)..( 8): Matrix.004 file - promoters50/1379916
gttttttg

SEQ ID NO: 67579 - DNA, 10 bp, Unknown
  misc_feature (1)..( 10): Matrix.004 file - promoters50/1379916
tctttttcga

SEQ ID NO: 67580 - DNA, 9 bp, Unknown
  misc_feature (1)..( 9): Matrix.004 file - promoters50/1379928
aattgtttt

SEQ ID NO: 67581 - DNA, 8 bp, Unknown
  misc_feature (1)..( 8): Matrix.004 file - promoters50/1379981
aaaacaaa

SEQ ID NO: 67582 - DNA, 8 bp, Unknown
  misc_feature (1)..( 8): Matrix.004 file - promoters50/1379981
ttttttaa

SEQ ID NO: 67583 - DNA, 9 bp, Unknown
  misc_feature (1)..( 9): Matrix.004 file - promoters50/1379981
taaattaaa

SEQ ID NO: 67584 - DNA, 8 bp, Unknown
  misc_feature (1)..( 8): Matrix.004 file - promoters50/1379981
ttaaaaag

SEQ ID NO: 67585 - DNA, 10 bp, Unknown
  misc_feature (1)..( 10): Matrix.004 file - promoters50/1380020
cttaaataat

SEQ ID NO: 67586 - DNA, 9 bp, Unknown
  misc_feature (1)..( 9): Matrix.004 file - promoters50/1380085
acaaattga

SEQ ID NO: 67587 - DNA, 12 bp, Unknown
  misc_feature (1)..( 12): Matrix.004 file - promoters50/1380135
aatttttgaatg

SEQ ID NO: 67588 - DNA, 8 bp, Unknown
  misc_feature (1)..( 8): Matrix.004 file - promoters50/1380135
aacaatat

SEQ ID NO: 67589 - DNA, 8 bp, Unknown
  misc_feature (1)..( 8): Matrix.004 file - promoters50/1380135
aattatat

SEQ ID NO: 67590 - DNA, 9 bp, Unknown
  misc_feature (1)..( 9): Matrix.004 file - promoters50/1380163
gaagaaaaa

SEQ ID NO: 67591 - DNA, 8 bp, Unknown
  misc_feature (1)..( 8): Matrix.004 file - promoters50/1380163
caataatt

SEQ ID NO: 67592 - DNA, 8 bp, Unknown
  misc_feature (1)..( 8): Matrix.004 file - promoters50/1380224
taaaacca

SEQ ID NO: 67593 - DNA, 7 bp, Unknown
  misc_feature (1)..( 7): Matrix.004 file - promoters50/1380309
atcattt

SEQ ID NO: 67594 - DNA, 11 bp, Unknown
  misc_feature (1)..( 11): Matrix.004 file - promoters50/1380309
tacttaaactt

SEQ ID NO: 67595 - DNA, 9 bp, Unknown
  misc_feature (1)..( 9): Matrix.004 file - promoters50/1380309
aacataaat

SEQ ID NO: 67596 - DNA, 12 bp, Unknown
  misc_feature (1)..( 12): Matrix.004 file - promoters50/1380389
aaaaataaaaaa

SEQ ID NO: 67597 - DNA, 8 bp, Unknown
  misc_feature (1)..( 8): Matrix.004 file - promoters50/1380389
taaatcaa

SEQ ID NO: 67598 - DNA, 11 bp, Unknown
  misc_feature (1)..( 11): Matrix.004 file - promoters50/1380389
atcttttcaat

SEQ ID NO: 67599 - DNA, 11 bp, Unknown
  misc_feature (1)..( 11): Matrix.004 file - promoters50/1380389
caaaaatatga

SEQ ID NO: 67600 - DNA, 10 bp, Unknown
  misc_feature (1)..( 10): Matrix.004 file - promoters50/1380418
caataaatca

SEQ ID NO: 67601 - DNA, 12 bp, Unknown
  misc_feature (1)..( 12): Matrix.004 file - promoters50/1380418
actttttcataa

SEQ ID NO: 67602 - DNA, 8 bp, Unknown
  misc_feature (1)..( 8): Matrix.004 file - promoters50/1380424
ttttctag

SEQ ID NO: 67603 - DNA, 7 bp, Unknown
  misc_feature (1)..( 7): Matrix.004 file - promoters50/1380424
attccaa

SEQ ID NO: 67604 - DNA, 7 bp, Unknown
  misc_feature (1)..( 7): Matrix.004 file - promoters50/1380437
tgaaatt

SEQ ID NO: 67605 - DNA, 7 bp, Unknown
  misc_feature (1)..( 7): Matrix.004 file - promoters50/1380437
aacaaaa

SEQ ID NO: 67606 - DNA, 9 bp, Unknown
  misc_feature (1)..( 9): Matrix.004 file - promoters50/1380519
aaagaaaag

SEQ ID NO: 67607 - DNA, 9 bp, Unknown
  misc_feature (1)..( 9): Matrix.004 file - promoters50/1380519
tctcaaact

SEQ ID NO: 67608 - DNA, 8 bp, Unknown
  misc_feature (1)..( 8): Matrix.004 file - promoters50/1380708
gagcaaaa

SEQ ID NO: 67609 - DNA, 7 bp, Unknown
  misc_feature (1)..( 7): Matrix.004 file - promoters50/1380708
aattttt

SEQ ID NO: 67610 - DNA, 11 bp, Unknown
  misc_feature (1)..( 11): Matrix.004 file - promoters50/1380708
taaaatttttt

SEQ ID NO: 67611 - DNA, 9 bp, Unknown
  misc_feature (1)..( 9): Matrix.004 file - promoters50/1380738
tttattcag

SEQ ID NO: 67612 - DNA, 13 bp, Unknown
  misc_feature (1)..( 13): Matrix.004 file - promoters50/1380738
ttaaattataaaa

SEQ ID NO: 67613 - DNA, 13 bp, Unknown
  misc_feature (1)..( 13): Matrix.004 file - promoters50/1380738
tgtaattaaaaac

SEQ ID NO: 67614 - DNA, 14 bp, Unknown
  misc_feature (1)..( 14): Matrix.004 file - promoters50/1380738
tattttttactaaa

SEQ ID NO: 67615 - DNA, 11 bp, Unknown
  misc_feature (1)..( 11): Matrix.004 file - promoters50/1380797
tttaaatgtat

SEQ ID NO: 67616 - DNA, 8 bp, Unknown
  misc_feature (1)..( 8): Matrix.004 file - promoters50/1380797
attatgga

SEQ ID NO: 67617 - DNA, 7 bp, Unknown
  misc_feature (1)..( 7): Matrix.004 file - promoters50/1380797
aatgaat

SEQ ID NO: 67618 - DNA, 7 bp, Unknown
  misc_feature (1)..( 7): Matrix.004 file - promoters50/1380849
aaaaagt

SEQ ID NO: 67619 - DNA, 12 bp, Unknown
  misc_feature (1)..( 12): Matrix.004 file - promoters50/1380849
cttatttttctt

SEQ ID NO: 67620 - DNA, 16 bp, Unknown
  misc_feature (1)..( 16): Matrix.004 file - promoters50/1380849
tgattaatctttgaga

SEQ ID NO: 67621 - DNA, 9 bp, Unknown
  misc_feature (1)..( 9): Matrix.004 file - promoters50/1380849
aaatctttt

SEQ ID NO: 67622 - DNA, 9 bp, Unknown
  misc_feature (1)..( 9): Matrix.004 file - promoters50/1380849
aattaatta

SEQ ID NO: 67623 - DNA, 10 bp, Unknown
  misc_feature (1)..( 10): Matrix.004 file - promoters50/1380947
tttttagatc

SEQ ID NO: 67624 - DNA, 7 bp, Unknown
  misc_feature (1)..( 7): Matrix.004 file - promoters50/1380963
gatcgaa

SEQ ID NO: 67625 - DNA, 10 bp, Unknown
  misc_feature (1)..( 10): Matrix.004 file - promoters50/1380963
tattatataa

SEQ ID NO: 67626 - DNA, 7 bp, Unknown
  misc_feature (1)..( 7): Matrix.004 file - promoters50/1380963
tatataa

SEQ ID NO: 67627 - DNA, 12 bp, Unknown
  misc_feature (1)..( 12): Matrix.004 file - promoters50/1380963
tataattaatgc

SEQ ID NO: 67628 - DNA, 11 bp, Unknown
  misc_feature (1)..( 11): Matrix.004 file - promoters50/1381002
ccaaccaattg

SEQ ID NO: 67629 - DNA, 14 bp, Unknown
  misc_feature (1)..( 14): Matrix.004 file - promoters50/1381002
tatgaaacttactt

SEQ ID NO: 67630 - DNA, 13 bp, Unknown
  misc_feature (1)..( 13): Matrix.004 file - promoters50/1381033
gaataaaataaag

SEQ ID NO: 67631 - DNA, 11 bp, Unknown
  misc_feature (1)..( 11): Matrix.004 file - promoters50/1381097
ttataaatatc

SEQ ID NO: 67632 - DNA, 12 bp, Unknown
  misc_feature (1)..( 12): Matrix.004 file - promoters50/1381097
taaggcaaattt

SEQ ID NO: 67633 - DNA, 9 bp, Unknown
  misc_feature (1)..( 9): Matrix.004 file - promoters50/1381097
tattgaaat

SEQ ID NO: 67634 - DNA, 10 bp, Unknown
  misc_feature (1)..( 10): Matrix.004 file - promoters50/1381097
tttatataat

SEQ ID NO: 67635 - DNA, 9 bp, Unknown
  misc_feature (1)..( 9): Matrix.004 file - promoters50/1381097
agaaaaaat

SEQ ID NO: 67636 - DNA, 9 bp, Unknown
  misc_feature (1)..( 9): Matrix.004 file - promoters50/1381097
gaaaaaata

SEQ ID NO: 67637 - DNA, 13 bp, Unknown
  misc_feature (1)..( 13): Matrix.004 file - promoters50/1381097
ttgatttttaaat

SEQ ID NO: 67638 - DNA, 15 bp, Unknown
  misc_feature (1)..( 15): Matrix.004 file - promoters50/1381097
tttggatatgtattt

SEQ ID NO: 67639 - DNA, 9 bp, Unknown
  misc_feature (1)..( 9): Matrix.004 file - promoters50/1381119
ccaaacttt

SEQ ID NO: 67640 - DNA, 13 bp, Unknown
  misc_feature (1)..( 13): Matrix.004 file - promoters50/1381119
ttaattttaaata

SEQ ID NO: 67641 - DNA, 10 bp, Unknown
  misc_feature (1)..( 10): Matrix.004 file - promoters50/1381119
tttactattt

SEQ ID NO: 67642 - DNA, 8 bp, Unknown
  misc_feature (1)..( 8): Matrix.004 file - promoters50/1381119
tattttta

SEQ ID NO: 67643 - DNA, 9 bp, Unknown
  misc_feature (1)..( 9): Matrix.004 file - promoters50/1381119
tttttaatt

SEQ ID NO: 67644 - DNA, 10 bp, Unknown
  misc_feature (1)..( 10): Matrix.004 file - promoters50/1381155
tttcatttat

SEQ ID NO: 67645 - DNA, 9 bp, Unknown
  misc_feature (1)..( 9): Matrix.004 file - promoters50/1381187
tttctactt

SEQ ID NO: 67646 - DNA, 13 bp, Unknown
  misc_feature (1)..( 13): Matrix.004 file - promoters50/1381187
aattatacattat

SEQ ID NO: 67647 - DNA, 7 bp, Unknown
  misc_feature (1)..( 7): Matrix.004 file - promoters50/1381187
tttctca

SEQ ID NO: 67648 - DNA, 8 bp, Unknown
  misc_feature (1)..( 8): Matrix.004 file - promoters50/1381187
aaagacat

SEQ ID NO: 67649 - DNA, 7 bp, Unknown
  misc_feature (1)..( 7): Matrix.004 file - promoters50/1381187
tgaataa

SEQ ID NO: 67650 - DNA, 9 bp, Unknown
  misc_feature (1)..( 9): Matrix.004 file - promoters50/1381187
ctcactttt

SEQ ID NO: 67651 - DNA, 8 bp, Unknown
  misc_feature (1)..( 8): Matrix.004 file - promoters50/1381187
taaattaa

SEQ ID NO: 67652 - DNA, 9 bp, Unknown
  misc_feature (1)..( 9): Matrix.004 file - promoters50/1381187
tttggtttc

SEQ ID NO: 67653 - DNA, 8 bp, Unknown
  misc_feature (1)..( 8): Matrix.004 file - promoters50/1381195
tttagttt

SEQ ID NO: 67654 - DNA, 7 bp, Unknown
  misc_feature (1)..( 7): Matrix.004 file - promoters50/1381321
taaatgg

SEQ ID NO: 67655 - DNA, 14 bp, Unknown
  misc_feature (1)..( 14): Matrix.004 file - promoters50/1381334
tcaaagagaaattc

SEQ ID NO: 67656 - DNA, 8 bp, Unknown
  misc_feature (1)..( 8): Matrix.004 file - promoters50/1381342
ttaaattg

SEQ ID NO: 67657 - DNA, 8 bp, Unknown
  misc_feature (1)..( 8): Matrix.004 file - promoters50/1381342
ttactttc

SEQ ID NO: 67658 - DNA, 9 bp, Unknown
  misc_feature (1)..( 9): Matrix.004 file - promoters50/1381387
tttttctca

SEQ ID NO: 67659 - DNA, 13 bp, Unknown
  misc_feature (1)..( 13): Matrix.004 file - promoters50/1381457
aatatgatttaac

SEQ ID NO: 67660 - DNA, 8 bp, Unknown
  misc_feature (1)..( 8): Matrix.004 file - promoters50/1381481
aggctatg

SEQ ID NO: 67661 - DNA, 11 bp, Unknown
  misc_feature (1)..( 11): Matrix.004 file - promoters50/1381481
aaaacataaat

SEQ ID NO: 67662 - DNA, 6 bp, Unknown
  misc_feature (1)..( 6): Matrix.004 file - promoters50/1381491
tttcga

SEQ ID NO: 67663 - DNA, 8 bp, Unknown
  misc_feature (1)..( 8): Matrix.004 file - promoters50/1381491
acatttaa

SEQ ID NO: 67664 - DNA, 8 bp, Unknown
  misc_feature (1)..( 8): Matrix.004 file - promoters50/1381491
aaacacaa

SEQ ID NO: 67665 - DNA, 11 bp, Unknown
  misc_feature (1)..( 11): Matrix.004 file - promoters50/1381491
gaagcaaaacc

SEQ ID NO: 67666 - DNA, 10 bp, Unknown
  misc_feature (1)..( 10): Matrix.004 file - promoters50/1381491
aaaaaaacac

SEQ ID NO: 67667 - DNA, 8 bp, Unknown
  misc_feature (1)..( 8): Matrix.004 file - promoters50/1381491
attgaatt

SEQ ID NO: 67668 - DNA, 14 bp, Unknown
  misc_feature (1)..( 14): Matrix.004 file - promoters50/1381491
tctctcttatataa

SEQ ID NO: 67669 - DNA, 8 bp, Unknown
  misc_feature (1)..( 8): Matrix.004 file - promoters50/1381491
acatttaa

SEQ ID NO: 67670 - DNA, 7 bp, Unknown
  misc_feature (1)..( 7): Matrix.004 file - promoters50/1381491
gttttat

SEQ ID NO: 67671 - DNA, 9 bp, Unknown
  misc_feature (1)..( 9): Matrix.004 file - promoters50/1381537
aaagaaaat

SEQ ID NO: 67672 - DNA, 9 bp, Unknown
  misc_feature (1)..( 9): Matrix.004 file - promoters50/1381537
taaaacaaa

SEQ ID NO: 67673 - DNA, 11 bp, Unknown
  misc_feature (1)..( 11): Matrix.004 file - promoters50/1381537
aaaatccttta

SEQ ID NO: 67674 - DNA, 8 bp, Unknown
  misc_feature (1)..( 8): Matrix.004 file - promoters50/1381563
ttttgttt

SEQ ID NO: 67675 - DNA, 13 bp, Unknown
  misc_feature (1)..( 13): Matrix.004 file - promoters50/1381563
tgaatctgataaa

SEQ ID NO: 67676 - DNA, 12 bp, Unknown
  misc_feature (1)..( 12): Matrix.004 file - promoters50/1381563
ctttagaaaaaa

SEQ ID NO: 67677 - DNA, 11 bp, Unknown
  misc_feature (1)..( 11): Matrix.004 file - promoters50/1381563
aatttaaaatg

SEQ ID NO: 67678 - DNA, 12 bp, Unknown
  misc_feature (1)..( 12): Matrix.004 file - promoters50/1381563
ttcttaaaaatc

SEQ ID NO: 67679 - DNA, 9 bp, Unknown
  misc_feature (1)..( 9): Matrix.004 file - promoters50/1381579
caaacatta

SEQ ID NO: 67680 - DNA, 13 bp, Unknown
  misc_feature (1)..( 13): Matrix.004 file - promoters50/1381579
aagccaattagaa

SEQ ID NO: 67681 - DNA, 8 bp, Unknown
  misc_feature (1)..( 8): Matrix.004 file - promoters50/1381647
ttttctat

SEQ ID NO: 67682 - DNA, 12 bp, Unknown
  misc_feature (1)..( 12): Matrix.004 file - promoters50/1381704
ataagtctgaat

SEQ ID NO: 67683 - DNA, 11 bp, Unknown
  misc_feature (1)..( 11): Matrix.004 file - promoters50/1381704
gtaataaaaaa

SEQ ID NO: 67684 - DNA, 8 bp, Unknown
  misc_feature (1)..( 8): Matrix.004 file - promoters50/1381818
aaaaacta

SEQ ID NO: 67685 - DNA, 12 bp, Unknown
  misc_feature (1)..( 12): Matrix.004 file - promoters50/1381818
aaaataaactta

SEQ ID NO: 67686 - DNA, 12 bp, Unknown
  misc_feature (1)..( 12): Matrix.004 file - promoters50/1381818
tataaaaaatga

SEQ ID NO: 67687 - DNA, 9 bp, Unknown
  misc_feature (1)..( 9): Matrix.004 file - promoters50/1381818
aaaaaaaac

SEQ ID NO: 67688 - DNA, 7 bp, Unknown
  misc_feature (1)..( 7): Matrix.004 file - promoters50/1381818
aaaaaaa

SEQ ID NO: 67689 - DNA, 11 bp, Unknown
  misc_feature (1)..( 11): Matrix.004 file - promoters50/1381896
catattattat

SEQ ID NO: 67690 - DNA, 12 bp, Unknown
  misc_feature (1)..( 12): Matrix.004 file - promoters50/1381903
gaagatatttac

SEQ ID NO: 67691 - DNA, 8 bp, Unknown
  misc_feature (1)..( 8): Matrix.004 file - promoters50/1381903
catagatt

SEQ ID NO: 67692 - DNA, 11 bp, Unknown
  misc_feature (1)..( 11): Matrix.004 file - promoters50/1381903
aactaaatagt

SEQ ID NO: 67693 - DNA, 7 bp, Unknown
  misc_feature (1)..( 7): Matrix.004 file - promoters50/1381903
ctaaatt

SEQ ID NO: 67694 - DNA, 8 bp, Unknown
  misc_feature (1)..( 8): Matrix.004 file - promoters50/1381903
tttgattt

SEQ ID NO: 67695 - DNA, 8 bp, Unknown
  misc_feature (1)..( 8): Matrix.004 file - promoters50/1381911
atgaaata

SEQ ID NO: 67696 - DNA, 8 bp, Unknown
  misc_feature (1)..( 8): Matrix.004 file - promoters50/1381911
taatattg

SEQ ID NO: 67697 - DNA, 8 bp, Unknown
  misc_feature (1)..( 8): Matrix.004 file - promoters50/1381911
aaatgaaa

SEQ ID NO: 67698 - DNA, 8 bp, Unknown
  misc_feature (1)..( 8): Matrix.004 file - promoters50/1381911
ttattact

SEQ ID NO: 67699 - DNA, 8 bp, Unknown
  misc_feature (1)..( 8): Matrix.004 file - promoters50/1381915
catattaa

SEQ ID NO: 67700 - DNA, 8 bp, Unknown
  misc_feature (1)..( 8): Matrix.004 file - promoters50/1381915
ccactaag

SEQ ID NO: 67701 - DNA, 8 bp, Unknown
  misc_feature (1)..( 8): Matrix.004 file - promoters50/1381926
tcctattt

SEQ ID NO: 67702 - DNA, 10 bp, Unknown
  misc_feature (1)..( 10): Matrix.004 file - promoters50/1382033
attattgatt

SEQ ID NO: 67703 - DNA, 9 bp, Unknown
  misc_feature (1)..( 9): Matrix.004 file - promoters50/1382033
tttgttttt

SEQ ID NO: 67704 - DNA, 9 bp, Unknown
  misc_feature (1)..( 9): Matrix.004 file - promoters50/1382084
caaattgga

SEQ ID NO: 67705 - DNA, 11 bp, Unknown
  misc_feature (1)..( 11): Matrix.004 file - promoters50/1382084
tttgcaattat

SEQ ID NO: 67706 - DNA, 8 bp, Unknown
  misc_feature (1)..( 8): Matrix.004 file - promoters50/1382119
atttaatg

SEQ ID NO: 67707 - DNA, 12 bp, Unknown
  misc_feature (1)..( 12): Matrix.004 file - promoters50/1382119
tataaattaaag

SEQ ID NO: 67708 - DNA, 11 bp, Unknown
  misc_feature (1)..( 11): Matrix.004 file - promoters50/1382119
aaatatataaa

SEQ ID NO: 67709 - DNA, 9 bp, Unknown
  misc_feature (1)..( 9): Matrix.004 file - promoters50/1382128
aaataaaaa

SEQ ID NO: 67710 - DNA, 7 bp, Unknown
  misc_feature (1)..( 7): Matrix.004 file - promoters50/1382134
aaaaaat

SEQ ID NO: 67711 - DNA, 15 bp, Unknown
  misc_feature (1)..( 15): Matrix.004 file - promoters50/1382134
aattatgatatttaa

SEQ ID NO: 67712 - DNA, 12 bp, Unknown
  misc_feature (1)..( 12): Matrix.004 file - promoters50/1382134
aataaaccataa

SEQ ID NO: 67713 - DNA, 8 bp, Unknown
  misc_feature (1)..( 8): Matrix.004 file - promoters50/1382134
taatattt

SEQ ID NO: 67714 - DNA, 12 bp, Unknown
  misc_feature (1)..( 12): Matrix.004 file - promoters50/1382134
taacacttttta

SEQ ID NO: 67715 - DNA, 8 bp, Unknown
  misc_feature (1)..( 8): Matrix.004 file - promoters50/1382134
aaatttaa

SEQ ID NO: 67716 - DNA, 12 bp, Unknown
  misc_feature (1)..( 12): Matrix.004 file - promoters50/1382202
gttttatatttt

SEQ ID NO: 67717 - DNA, 12 bp, Unknown
  misc_feature (1)..( 12): Matrix.004 file - promoters50/1382202
cagatcaaacaa

SEQ ID NO: 67718 - DNA, 8 bp, Unknown
  misc_feature (1)..( 8): Matrix.004 file - promoters50/1382202
tgaaagca

SEQ ID NO: 67719 - DNA, 9 bp, Unknown
  misc_feature (1)..( 9): Matrix.004 file - promoters50/1382202
caattactt

SEQ ID NO: 67720 - DNA, 9 bp, Unknown
  misc_feature (1)..( 9): Matrix.004 file - promoters50/1382215
gaagatatg

SEQ ID NO: 67721 - DNA, 10 bp, Unknown
  misc_feature (1)..( 10): Matrix.004 file - promoters50/1382215
acatgtttca

SEQ ID NO: 67722 - DNA, 8 bp, Unknown
  misc_feature (1)..( 8): Matrix.004 file - promoters50/1382281
aaataaaa

SEQ ID NO: 67723 - DNA, 9 bp, Unknown
  misc_feature (1)..( 9): Matrix.004 file - promoters50/1382281
taaatgaat

SEQ ID NO: 67724 - DNA, 12 bp, Unknown
  misc_feature (1)..( 12): Matrix.004 file - promoters50/1382281
tagtgtttaaaa

SEQ ID NO: 67725 - DNA, 9 bp, Unknown
  misc_feature (1)..( 9): Matrix.004 file - promoters50/1382281
aaaataaat

SEQ ID NO: 67726 - DNA, 6 bp, Unknown
  misc_feature (1)..( 6): Matrix.004 file - promoters50/1382281
taaatg

SEQ ID NO: 67727 - DNA, 11 bp, Unknown
  misc_feature (1)..( 11): Matrix.004 file - promoters50/1382302
ttttcgaaaaa

SEQ ID NO: 67728 - DNA, 9 bp, Unknown
  misc_feature (1)..( 9): Matrix.004 file - promoters50/1382302
taataaagt

SEQ ID NO: 67729 - DNA, 12 bp, Unknown
  misc_feature (1)..( 12): Matrix.004 file - promoters50/1382347
ttaaaaatacaa

SEQ ID NO: 67730 - DNA, 8 bp, Unknown
  misc_feature (1)..( 8): Matrix.004 file - promoters50/1382347
ttttgatt

SEQ ID NO: 67731 - DNA, 8 bp, Unknown
  misc_feature (1)..( 8): Matrix.004 file - promoters50/1382347
ctatcaaa

SEQ ID NO: 67732 - DNA, 9 bp, Unknown
  misc_feature (1)..( 9): Matrix.004 file - promoters50/1382347
cttgattgt

SEQ ID NO: 67733 - DNA, 9 bp, Unknown
  misc_feature (1)..( 9): Matrix.004 file - promoters50/1382347
tctatatat

SEQ ID NO: 67734 - DNA, 8 bp, Unknown
  misc_feature (1)..( 8): Matrix.004 file - promoters50/1382347
cttctctt

SEQ ID NO: 67735 - DNA, 7 bp, Unknown
  misc_feature (1)..( 7): Matrix.004 file - promoters50/1382347
taaattt

SEQ ID NO: 67736 - DNA, 7 bp, Unknown
  misc_feature (1)..( 7): Matrix.004 file - promoters50/1382347
tattttt

SEQ ID NO: 67737 - DNA, 8 bp, Unknown
  misc_feature (1)..( 8): Matrix.004 file - promoters50/1382347
tgttttgt

SEQ ID NO: 67738 - DNA, 10 bp, Unknown
  misc_feature (1)..( 10): Matrix.004 file - promoters50/1382347
aacaaaaacg

SEQ ID NO: 67739 - DNA, 7 bp, Unknown
  misc_feature (1)..( 7): Matrix.004 file - promoters50/1382347
aatataa

SEQ ID NO: 67740 - DNA, 8 bp, Unknown
  misc_feature (1)..( 8): Matrix.004 file - promoters50/1382347
taaccatt

SEQ ID NO: 67741 - DNA, 7 bp, Unknown
  misc_feature (1)..( 7): Matrix.004 file - promoters50/1382505
ttaacca

SEQ ID NO: 67742 - DNA, 8 bp, Unknown
  misc_feature (1)..( 8): Matrix.004 file - promoters50/1382505
atatatgt

SEQ ID NO: 67743 - DNA, 9 bp, Unknown
  misc_feature (1)..( 9): Matrix.004 file - promoters50/1382505
attttaaaa

SEQ ID NO: 67744 - DNA, 7 bp, Unknown
  misc_feature (1)..( 7): Matrix.004 file - promoters50/1382505
attattt

SEQ ID NO: 67745 - DNA, 8 bp, Unknown
  misc_feature (1)..( 8): Matrix.004 file - promoters50/1382505
caggaaat

SEQ ID NO: 67746 - DNA, 9 bp, Unknown
  misc_feature (1)..( 9): Matrix.004 file - promoters50/1382505
atgtttata

SEQ ID NO: 67747 - DNA, 8 bp, Unknown
  misc_feature (1)..( 8): Matrix.004 file - promoters50/1382505
ttaattta

SEQ ID NO: 67748 - DNA, 7 bp, Unknown
  misc_feature (1)..( 7): Matrix.004 file - promoters50/1382581
tttcatg

SEQ ID NO: 67749 - DNA, 8 bp, Unknown
  misc_feature (1)..( 8): Matrix.004 file - promoters50/1382581
aagtaaaa

SEQ ID NO: 67750 - DNA, 9 bp, Unknown
  misc_feature (1)..( 9): Matrix.004 file - promoters50/1382581
taacaaaag

SEQ ID NO: 67751 - DNA, 15 bp, Unknown
  misc_feature (1)..( 15): Matrix.004 file - promoters50/1382581
taagaaatatgtttt

SEQ ID NO: 67752 - DNA, 20 bp, Unknown
  misc_feature (1)..( 20): Matrix.004 file - promoters50/1382581
catataatctatataaaccc

SEQ ID NO: 67753 - DNA, 13 bp, Unknown
  misc_feature (1)..( 13): Matrix.004 file - promoters50/1382709
tctatataaaccc

SEQ ID NO: 67754 - DNA, 11 bp, Unknown
  misc_feature (1)..( 11): Matrix.004 file - promoters50/1382709
aatacaataca

SEQ ID NO: 67755 - DNA, 7 bp, Unknown
  misc_feature (1)..( 7): Matrix.004 file - promoters50/1382709
aataaaa

SEQ ID NO: 67756 - DNA, 10 bp, Unknown
  misc_feature (1)..( 10): Matrix.004 file - promoters50/1382713
aaaacaataa

SEQ ID NO: 67757 - DNA, 8 bp, Unknown
  misc_feature (1)..( 8): Matrix.004 file - promoters50/1382713
atgactta

SEQ ID NO: 67758 - DNA, 7 bp, Unknown
  misc_feature (1)..( 7): Matrix.004 file - promoters50/1382713
attgtgt

SEQ ID NO: 67759 - DNA, 8 bp, Unknown
  misc_feature (1)..( 8): Matrix.004 file - promoters50/1382713
tgaagaaa

SEQ ID NO: 67760 - DNA, 8 bp, Unknown
  misc_feature (1)..( 8): Matrix.004 file - promoters50/1382959
attattct

SEQ ID NO: 67761 - DNA, 10 bp, Unknown
  misc_feature (1)..( 10): Matrix.004 file - promoters50/1382959
acaaataaag

SEQ ID NO: 67762 - DNA, 10 bp, Unknown
  misc_feature (1)..( 10): Matrix.004 file - promoters50/1382959
ttaatattta

SEQ ID NO: 67763 - DNA, 9 bp, Unknown
  misc_feature (1)..( 9): Matrix.004 file - promoters50/1383066
caattattt

SEQ ID NO: 67764 - DNA, 8 bp, Unknown
  misc_feature (1)..( 8): Matrix.004 file - promoters50/1383066
attacaga

SEQ ID NO: 67765 - DNA, 7 bp, Unknown
  misc_feature (1)..( 7): Matrix.004 file - promoters50/1383066
aaaaagc

SEQ ID NO: 67766 - DNA, 7 bp, Unknown
  misc_feature (1)..( 7): Matrix.004 file - promoters50/1383074
gaaaaaa

SEQ ID NO: 67767 - DNA, 10 bp, Unknown
  misc_feature (1)..( 10): Matrix.004 file - promoters50/1383074
aaataaaaag

SEQ ID NO: 67768 - DNA, 11 bp, Unknown
  misc_feature (1)..( 11): Matrix.004 file - promoters50/1383074
atacatataat

SEQ ID NO: 67769 - DNA, 15 bp, Unknown
  misc_feature (1)..( 15): Matrix.004 file - promoters50/1383074
aaaaaaaaaaaaaaa

SEQ ID NO: 67770 - DNA, 11 bp, Unknown
  misc_feature (1)..( 11): Matrix.004 file - promoters50/1383102
ctttctaatat

SEQ ID NO: 67771 - DNA, 11 bp, Unknown
  misc_feature (1)..( 11): Matrix.004 file - promoters50/1383102
ataatcataaa

SEQ ID NO: 67772 - DNA, 7 bp, Unknown
  misc_feature (1)..( 7): Matrix.004 file - promoters50/1383144
aattatt

SEQ ID NO: 67773 - DNA, 7 bp, Unknown
  misc_feature (1)..( 7): Matrix.004 file - promoters50/1383144
aaatttt

SEQ ID NO: 67774 - DNA, 13 bp, Unknown
  misc_feature (1)..( 13): Matrix.004 file - promoters50/1383214
tttaataatattc

SEQ ID NO: 67775 - DNA, 9 bp, Unknown
  misc_feature (1)..( 9): Matrix.004 file - promoters50/1383214
tttaagttt

SEQ ID NO: 67776 - DNA, 8 bp, Unknown
  misc_feature (1)..( 8): Matrix.004 file - promoters50/1383214
atggtcat

SEQ ID NO: 67777 - DNA, 9 bp, Unknown
  misc_feature (1)..( 9): Matrix.004 file - promoters50/1383214
ctatatata

SEQ ID NO: 67778 - DNA, 8 bp, Unknown
  misc_feature (1)..( 8): Matrix.004 file - promoters50/1383214
cataatca

SEQ ID NO: 67779 - DNA, 7 bp, Unknown
  misc_feature (1)..( 7): Matrix.004 file - promoters50/1383214
atggttt

SEQ ID NO: 67780 - DNA, 7 bp, Unknown
  misc_feature (1)..( 7): Matrix.004 file - promoters50/1383312
ttaagtt

SEQ ID NO: 67781 - DNA, 10 bp, Unknown
  misc_feature (1)..( 10): Matrix.004 file - promoters50/1383312
tggaaacaat

SEQ ID NO: 67782 - DNA, 10 bp, Unknown
  misc_feature (1)..( 10): Matrix.004 file - promoters50/1383312
taatttcttt

SEQ ID NO: 67783 - DNA, 8 bp, Unknown
  misc_feature (1)..( 8): Matrix.004 file - promoters50/1383322
tcaacttt

SEQ ID NO: 67784 - DNA, 8 bp, Unknown
  misc_feature (1)..( 8): Matrix.004 file - promoters50/1383341
tttgatga

SEQ ID NO: 67785 - DNA, 10 bp, Unknown
  misc_feature (1)..( 10): Matrix.004 file - promoters50/1383356
attttattct

SEQ ID NO: 67786 - DNA, 10 bp, Unknown
  misc_feature (1)..( 10): Matrix.004 file - promoters50/1383386
aattacaaaa

SEQ ID NO: 67787 - DNA, 8 bp, Unknown
  misc_feature (1)..( 8): Matrix.004 file - promoters50/1383386
tttcctta

SEQ ID NO: 67788 - DNA, 8 bp, Unknown
  misc_feature (1)..( 8): Matrix.004 file - promoters50/1383386
aaatctct

SEQ ID NO: 67789 - DNA, 11 bp, Unknown
  misc_feature (1)..( 11): Matrix.004 file - promoters50/1383386
ttatttatatg

SEQ ID NO: 67790 - DNA, 10 bp, Unknown
  misc_feature (1)..( 10): Matrix.004 file - promoters50/1383430
atataatatt

SEQ ID NO: 67791 - DNA, 8 bp, Unknown
  misc_feature (1)..( 8): Matrix.004 file - promoters50/1383485
cttttcta

SEQ ID NO: 67792 - DNA, 5 bp, Unknown
  misc_feature (1)..( 5): Matrix.004 file - promoters50/1383485
ctcaa

SEQ ID NO: 67793 - DNA, 8 bp, Unknown
  misc_feature (1)..( 8): Matrix.004 file - promoters50/1383506
agattata

SEQ ID NO: 67794 - DNA, 7 bp, Unknown
  misc_feature (1)..( 7): Matrix.004 file - promoters50/1383506
atgccag

SEQ ID NO: 67795 - DNA, 13 bp, Unknown
  misc_feature (1)..( 13): Matrix.004 file - promoters50/1383506
tgccttcatccct

SEQ ID NO: 67796 - DNA, 10 bp, Unknown
  misc_feature (1)..( 10): Matrix.004 file - promoters50/1383514
gaagatggga

SEQ ID NO: 67797 - DNA, 9 bp, Unknown
  misc_feature (1)..( 9): Matrix.004 file - promoters50/1383514
cattttaaa

SEQ ID NO: 67798 - DNA, 7 bp, Unknown
  misc_feature (1)..( 7): Matrix.004 file - promoters50/1383514
taataaa

SEQ ID NO: 67799 - DNA, 11 bp, Unknown
  misc_feature (1)..( 11): Matrix.004 file - promoters50/1383514
caataaaatat

SEQ ID NO: 67800 - DNA, 9 bp, Unknown
  misc_feature (1)..( 9): Matrix.004 file - promoters50/1383514
atttgttat

SEQ ID NO: 67801 - DNA, 11 bp, Unknown
  misc_feature (1)..( 11): Matrix.004 file - promoters50/1383518
ctataaataga

SEQ ID NO: 67802 - DNA, 8 bp, Unknown
  misc_feature (1)..( 8): Matrix.004 file - promoters50/1383518
atactaaa

SEQ ID NO: 67803 - DNA, 12 bp, Unknown
  misc_feature (1)..( 12): Matrix.004 file - promoters50/1383518
accaaaaacaaa

SEQ ID NO: 67804 - DNA, 9 bp, Unknown
  misc_feature (1)..( 9): Matrix.004 file - promoters50/1383518
atataaata

SEQ ID NO: 67805 - DNA, 9 bp, Unknown
  misc_feature (1)..( 9): Matrix.004 file - promoters50/1383518
aaataataa

SEQ ID NO: 67806 - DNA, 8 bp, Unknown
  misc_feature (1)..( 8): Matrix.004 file - promoters50/1383518
aataataa

SEQ ID NO: 67807 - DNA, 10 bp, Unknown
  misc_feature (1)..( 10): Matrix.004 file - promoters50/1383552
ttaatgttaa

SEQ ID NO: 67808 - DNA, 11 bp, Unknown
  misc_feature (1)..( 11): Matrix.004 file - promoters50/1383552
aggcccataaa

SEQ ID NO: 67809 - DNA, 12 bp, Unknown
  misc_feature (1)..( 12): Matrix.004 file - promoters50/1383552
aaaagtaaaaac

SEQ ID NO: 67810 - DNA, 10 bp, Unknown
  misc_feature (1)..( 10): Matrix.004 file - promoters50/1383552
ataatttttt

SEQ ID NO: 67811 - DNA, 11 bp, Unknown
  misc_feature (1)..( 11): Matrix.004 file - promoters50/1383569
catatataaat

SEQ ID NO: 67812 - DNA, 8 bp, Unknown
  misc_feature (1)..( 8): Matrix.004 file - promoters50/1383569
attttaaa

SEQ ID NO: 67813 - DNA, 14 bp, Unknown
  misc_feature (1)..( 14): Matrix.004 file - promoters50/1383569
atattagctggtgc

SEQ ID NO: 67814 - DNA, 7 bp, Unknown
  misc_feature (1)..( 7): Matrix.004 file - promoters50/1383569
taagatg

SEQ ID NO: 67815 - DNA, 11 bp, Unknown
  misc_feature (1)..( 11): Matrix.004 file - promoters50/1383569
aatgaaatagt

SEQ ID NO: 67816 - DNA, 7 bp, Unknown
  misc_feature (1)..( 7): Matrix.004 file - promoters50/1383569
atttaaa

SEQ ID NO: 67817 - DNA, 10 bp, Unknown
  misc_feature (1)..( 10): Matrix.004 file - promoters50/1383569
aatttaaact

SEQ ID NO: 67818 - DNA, 13 bp, Unknown
  misc_feature (1)..( 13): Matrix.004 file - promoters50/1383569
aatattaaaataa

SEQ ID NO: 67819 - DNA, 7 bp, Unknown
  misc_feature (1)..( 7): Matrix.004 file - promoters50/1383572
gattgat

SEQ ID NO: 67820 - DNA, 12 bp, Unknown
  misc_feature (1)..( 12): Matrix.004 file - promoters50/1383572
caaagaaaaaat

SEQ ID NO: 67821 - DNA, 8 bp, Unknown
  misc_feature (1)..( 8): Matrix.004 file - promoters50/1383572
gatgtatt

SEQ ID NO: 67822 - DNA, 7 bp, Unknown
  misc_feature (1)..( 7): Matrix.004 file - promoters50/1383572
tttatta

SEQ ID NO: 67823 - DNA, 9 bp, Unknown
  misc_feature (1)..( 9): Matrix.004 file - promoters50/1383572
ttttaaata

SEQ ID NO: 67824 - DNA, 7 bp, Unknown
  misc_feature (1)..( 7): Matrix.004 file - promoters50/1383572
taaataa

SEQ ID NO: 67825 - DNA, 7 bp, Unknown
  misc_feature (1)..( 7): Matrix.004 file - promoters50/1383572
attaaat

SEQ ID NO: 67826 - DNA, 11 bp, Unknown
  misc_feature (1)..( 11): Matrix.004 file - promoters50/1383572
aaagaaaaaat

SEQ ID NO: 67827 - DNA, 8 bp, Unknown
  misc_feature (1)..( 8): Matrix.004 file - promoters50/1383572
acaaattt

SEQ ID NO: 67828 - DNA, 11 bp, Unknown
  misc_feature (1)..( 11): Matrix.004 file - promoters50/1383572
gtatattaata

SEQ ID NO: 67829 - DNA, 10 bp, Unknown
  misc_feature (1)..( 10): Matrix.004 file - promoters50/1383572
aaattcaaaa

SEQ ID NO: 67830 - DNA, 8 bp, Unknown
  misc_feature (1)..( 8): Matrix.004 file - promoters50/1383602
tgaaatca

SEQ ID NO: 67831 - DNA, 7 bp, Unknown
  misc_feature (1)..( 7): Matrix.004 file - promoters50/1383602
caaaaaa

SEQ ID NO: 67832 - DNA, 10 bp, Unknown
  misc_feature (1)..( 10): Matrix.004 file - promoters50/1383602
atattgaccc

SEQ ID NO: 67833 - DNA, 8 bp, Unknown
  misc_feature (1)..( 8): Matrix.004 file - promoters50/1383602
aatcttat

SEQ ID NO: 67834 - DNA, 10 bp, Unknown
  misc_feature (1)..( 10): Matrix.004 file - promoters50/1383602
attaaaagac

SEQ ID NO: 67835 - DNA, 8 bp, Unknown
  misc_feature (1)..( 8): Matrix.004 file - promoters50/1383602
atttacaa

SEQ ID NO: 67836 - DNA, 7 bp, Unknown
  misc_feature (1)..( 7): Matrix.004 file - promoters50/1383624
gcaaaag

SEQ ID NO: 67837 - DNA, 12 bp, Unknown
  misc_feature (1)..( 12): Matrix.004 file - promoters50/1383624
aatttattttta

SEQ ID NO: 67838 - DNA, 10 bp, Unknown
  misc_feature (1)..( 10): Matrix.004 file - promoters50/1383677
tgaaaaaatt

SEQ ID NO: 67839 - DNA, 8 bp, Unknown
  misc_feature (1)..( 8): Matrix.004 file - promoters50/1383677
tagatata

SEQ ID NO: 67840 - DNA, 7 bp, Unknown
  misc_feature (1)..( 7): Matrix.004 file - promoters50/1383677
aatattt

SEQ ID NO: 67841 - DNA, 8 bp, Unknown
  misc_feature (1)..( 8): Matrix.004 file - promoters50/1383919
ttaataac

SEQ ID NO: 67842 - DNA, 7 bp, Unknown
  misc_feature (1)..( 7): Matrix.004 file - promoters50/1383919
catagaa

SEQ ID NO: 67843 - DNA, 11 bp, Unknown
  misc_feature (1)..( 11): Matrix.004 file - promoters50/1383919
aatatacaaaa

SEQ ID NO: 67844 - DNA, 10 bp, Unknown
  misc_feature (1)..( 10): Matrix.004 file - promoters50/1384016
aaaacaaaat

SEQ ID NO: 67845 - DNA, 12 bp, Unknown
  misc_feature (1)..( 12): Matrix.004 file - promoters50/1384016
gttttatcttat

SEQ ID NO: 67846 - DNA, 13 bp, Unknown
  misc_feature (1)..( 13): Matrix.004 file - promoters50/1384016
tttaaaaataaaa

SEQ ID NO: 67847 - DNA, 10 bp, Unknown
  misc_feature (1)..( 10): Matrix.004 file - promoters50/1384016
tattaaatag

SEQ ID NO: 67848 - DNA, 12 bp, Unknown
  misc_feature (1)..( 12): Matrix.004 file - promoters50/1384016
aaaataatttta

SEQ ID NO: 67849 - DNA, 5 bp, Unknown
  misc_feature (1)..( 5): Matrix.004 file - promoters50/1384016
tgaaa

SEQ ID NO: 67850 - DNA, 13 bp, Unknown
  misc_feature (1)..( 13): Matrix.004 file - promoters50/1384016
atatcatgggcca

SEQ ID NO: 67851 - DNA, 7 bp, Unknown
  misc_feature (1)..( 7): Matrix.004 file - promoters50/1384016
ttttctt

SEQ ID NO: 67852 - DNA, 9 bp, Unknown
  misc_feature (1)..( 9): Matrix.004 file - promoters50/1384016
ttataaata

SEQ ID NO: 67853 - DNA, 10 bp, Unknown
  misc_feature (1)..( 10): Matrix.004 file - promoters50/1384016
tatcaaaaat

SEQ ID NO: 67854 - DNA, 14 bp, Unknown
  misc_feature (1)..( 14): Matrix.004 file - promoters50/1384016
aagaaaaaattaaa

SEQ ID NO: 67855 - DNA, 10 bp, Unknown
  misc_feature (1)..( 10): Matrix.004 file - promoters50/1384161
cgtttttggt

SEQ ID NO: 67856 - DNA, 9 bp, Unknown
  misc_feature (1)..( 9): Matrix.004 file - promoters50/1384261
ttttaacta

SEQ ID NO: 67857 - DNA, 7 bp, Unknown
  misc_feature (1)..( 7): Matrix.004 file - promoters50/1384261
caaaaaa

SEQ ID NO: 67858 - DNA, 10 bp, Unknown
  misc_feature (1)..( 10): Matrix.004 file - promoters50/1384261
actaacagat

SEQ ID NO: 67859 - DNA, 11 bp, Unknown
  misc_feature (1)..( 11): Matrix.004 file - promoters50/1384261
tccaaaaaaaa

SEQ ID NO: 67860 - DNA, 8 bp, Unknown
  misc_feature (1)..( 8): Matrix.004 file - promoters50/1384261
aaaaaagt

SEQ ID NO: 67861 - DNA, 10 bp, Unknown
  misc_feature (1)..( 10): Matrix.004 file - promoters50/1384261
aaatttaaaa

SEQ ID NO: 67862 - DNA, 11 bp, Unknown
  misc_feature (1)..( 11): Matrix.004 file - promoters50/1384329
atcaaaattaa

SEQ ID NO: 67863 - DNA, 22 bp, Unknown
  misc_feature (1)..( 22): Matrix.004 file - promoters50/1384329
attatttaaataaaaagaaaaa

SEQ ID NO: 67864 - DNA, 10 bp, Unknown
  misc_feature (1)..( 10): Matrix.004 file - promoters50/1384329
tgaatataat

SEQ ID NO: 67865 - DNA, 8 bp, Unknown
  misc_feature (1)..( 8): Matrix.004 file - promoters50/1384329
atatttaa

SEQ ID NO: 67866 - DNA, 10 bp, Unknown
  misc_feature (1)..( 10): Matrix.004 file - promoters50/1384329
tatataatat

SEQ ID NO: 67867 - DNA, 11 bp, Unknown
  misc_feature (1)..( 11): Matrix.004 file - promoters50/1384329
ctatatataca

SEQ ID NO: 67868 - DNA, 17 bp, Unknown
  misc_feature (1)..( 17): Matrix.004 file - promoters50/1384329
aacaaaattaattaaat

SEQ ID NO: 67869 - DNA, 10 bp, Unknown
  misc_feature (1)..( 10): Matrix.004 file - promoters50/1384329
ttttaatcta

SEQ ID NO: 67870 - DNA, 10 bp, Unknown
  misc_feature (1)..( 10): Matrix.004 file - promoters50/1384732
tttatattat

SEQ ID NO: 67871 - DNA, 10 bp, Unknown
  misc_feature (1)..( 10): Matrix.004 file - promoters50/1384921
ctccaaaata

SEQ ID NO: 67872 - DNA, 8 bp, Unknown
  misc_feature (1)..( 8): Matrix.004 file - promoters50/1385263
aatatata

SEQ ID NO: 67873 - DNA, 7 bp, Unknown
  misc_feature (1)..( 7): Matrix.004 file - promoters50/1385263
gttaaaa

SEQ ID NO: 67874 - DNA, 8 bp, Unknown
  misc_feature (1)..( 8): Matrix.004 file - promoters50/1385263
ttgtgatg

SEQ ID NO: 67875 - DNA, 16 bp, Unknown
  misc_feature (1)..( 16): Matrix.004 file - promoters50/1385263
catttttaactaaaaa

SEQ ID NO: 67876 - DNA, 8 bp, Unknown
  misc_feature (1)..( 8): Matrix.004 file - promoters50/1385263
aaaactaa

SEQ ID NO: 67877 - DNA, 12 bp, Unknown
  misc_feature (1)..( 12): Matrix.004 file - promoters50/1385263
gtccatccaaac

SEQ ID NO: 67878 - DNA, 7 bp, Unknown
  misc_feature (1)..( 7): Matrix.004 file - promoters50/1385263
agattta

SEQ ID NO: 67879 - DNA, 10 bp, Unknown
  misc_feature (1)..( 10): Matrix.004 file - promoters50/1385263
tgttttattt

SEQ ID NO: 67880 - DNA, 9 bp, Unknown
  misc_feature (1)..( 9): Matrix.004 file - promoters50/1385347
ttcacttgt

SEQ ID NO: 67881 - DNA, 10 bp, Unknown
  misc_feature (1)..( 10): Matrix.004 file - promoters50/1385347
ataattttca

SEQ ID NO: 67882 - DNA, 13 bp, Unknown
  misc_feature (1)..( 13): Matrix.004 file - promoters50/1385347
aaactaaattctt

SEQ ID NO: 67883 - DNA, 8 bp, Unknown
  misc_feature (1)..( 8): Matrix.004 file - promoters50/1385376
acaaaaaa

SEQ ID NO: 67884 - DNA, 9 bp, Unknown
  misc_feature (1)..( 9): Matrix.004 file - promoters50/1385376
taaaagatt

SEQ ID NO: 67885 - DNA, 7 bp, Unknown
  misc_feature (1)..( 7): Matrix.004 file - promoters50/1385376
ttggttt

SEQ ID NO: 67886 - DNA, 9 bp, Unknown
  misc_feature (1)..( 9): Matrix.004 file - promoters50/1385655
tttggtttt

SEQ ID NO: 67887 - DNA, 17 bp, Unknown
  misc_feature (1)..( 17): Matrix.004 file - promoters50/1386125
atttttttttctaggtt

SEQ ID NO: 67888 - DNA, 10 bp, Unknown
  misc_feature (1)..( 10): Matrix.004 file - promoters50/1386215
attttcagta

SEQ ID NO: 67889 - DNA, 10 bp, Unknown
  misc_feature (1)..( 10): Matrix.004 file - promoters50/1386215
aaaatgttga

SEQ ID NO: 67890 - DNA, 12 bp, Unknown
  misc_feature (1)..( 12): Matrix.004 file - promoters50/1386387
attcaaaatttg

SEQ ID NO: 67891 - DNA, 8 bp, Unknown
  misc_feature (1)..( 8): Matrix.004 file - promoters50/1386444
cttttccc

SEQ ID NO: 67892 - DNA, 10 bp, Unknown
  misc_feature (1)..( 10): Matrix.004 file - promoters50/1386444
aagttttttt

SEQ ID NO: 67893 - DNA, 7 bp, Unknown
  misc_feature (1)..( 7): Matrix.004 file - promoters50/1386444
aacagat

SEQ ID NO: 67894 - DNA, 8 bp, Unknown
  misc_feature (1)..( 8): Matrix.004 file - promoters50/1386444
taaatttt

SEQ ID NO: 67895 - DNA, 6 bp, Unknown
  misc_feature (1)..( 6): Matrix.004 file - promoters50/1386444
acattt

SEQ ID NO: 67896 - DNA, 8 bp, Unknown
  misc_feature (1)..( 8): Matrix.004 file - promoters50/1386609
aagaggca

SEQ ID NO: 67897 - DNA, 8 bp, Unknown
  misc_feature (1)..( 8): Matrix.004 file - promoters50/1386609
acaagata

SEQ ID NO: 67898 - DNA, 10 bp, Unknown
  misc_feature (1)..( 10): Matrix.004 file - promoters50/1386609
tttgatgatg

SEQ ID NO: 67899 - DNA, 8 bp, Unknown
  misc_feature (1)..( 8): Matrix.004 file - promoters50/1386628
tgttattg

SEQ ID NO: 67900 - DNA, 9 bp, Unknown
  misc_feature (1)..( 9): Matrix.004 file - promoters50/1386749
atttgttac

SEQ ID NO: 67901 - DNA, 9 bp, Unknown
  misc_feature (1)..( 9): Matrix.004 file - promoters50/1386749
atcaaaatt

SEQ ID NO: 67902 - DNA, 10 bp, Unknown
  misc_feature (1)..( 10): Matrix.004 file - promoters50/1386749
caaaacaaaa

SEQ ID NO: 67903 - DNA, 9 bp, Unknown
  misc_feature (1)..( 9): Matrix.004 file - promoters50/1386749
tattagcta

SEQ ID NO: 67904 - DNA, 7 bp, Unknown
  misc_feature (1)..( 7): Matrix.004 file - promoters50/1386778
taaattg

SEQ ID NO: 67905 - DNA, 9 bp, Unknown
  misc_feature (1)..( 9): Matrix.004 file - promoters50/1386778
aaacaaaaa

SEQ ID NO: 67906 - DNA, 10 bp, Unknown
  misc_feature (1)..( 10): Matrix.004 file - promoters50/1386778
agaaaagaaa

SEQ ID NO: 67907 - DNA, 14 bp, Unknown
  misc_feature (1)..( 14): Matrix.004 file - promoters50/1386786
gtatataaaaaaaa

SEQ ID NO: 67908 - DNA, 9 bp, Unknown
  misc_feature (1)..( 9): Matrix.004 file - promoters50/1386861
gttttaatt

SEQ ID NO: 67909 - DNA, 9 bp, Unknown
  misc_feature (1)..( 9): Matrix.004 file - promoters50/1387088
ttaattgat

SEQ ID NO: 67910 - DNA, 11 bp, Unknown
  misc_feature (1)..( 11): Matrix.004 file - promoters50/1387117
agattaagggt

SEQ ID NO: 67911 - DNA, 9 bp, Unknown
  misc_feature (1)..( 9): Matrix.004 file - promoters50/1387117
agaaaattt

SEQ ID NO: 67912 - DNA, 13 bp, Unknown
  misc_feature (1)..( 13): Matrix.004 file - promoters50/1387117
aatccaaaataga

SEQ ID NO: 67913 - DNA, 10 bp, Unknown
  misc_feature (1)..( 10): Matrix.004 file - promoters50/1387117
aaaaagaaaa

SEQ ID NO: 67914 - DNA, 10 bp, Unknown
  misc_feature (1)..( 10): Matrix.004 file - promoters50/1387123
tatataatat

SEQ ID NO: 67915 - DNA, 9 bp, Unknown
  misc_feature (1)..( 9): Matrix.004 file - promoters50/1387123
cataacaaa

SEQ ID NO: 67916 - DNA, 15 bp, Unknown
  misc_feature (1)..( 15): Matrix.004 file - promoters50/1387123
atctaatttcatttt

SEQ ID NO: 67917 - DNA, 9 bp, Unknown
  misc_feature (1)..( 9): Matrix.004 file - promoters50/1387123
acaatcata

SEQ ID NO: 67918 - DNA, 9 bp, Unknown
  misc_feature (1)..( 9): Matrix.004 file - promoters50/1387123
aaattaaaa

SEQ ID NO: 67919 - DNA, 10 bp, Unknown
  misc_feature (1)..( 10): Matrix.004 file - promoters50/1387123
acaaacataa

SEQ ID NO: 67920 - DNA, 11 bp, Unknown
  misc_feature (1)..( 11): Matrix.004 file - promoters50/1387140
tataatttaat

SEQ ID NO: 67921 - DNA, 8 bp, Unknown
  misc_feature (1)..( 8): Matrix.004 file - promoters50/1387140
gagtattt

SEQ ID NO: 67922 - DNA, 7 bp, Unknown
  misc_feature (1)..( 7): Matrix.004 file - promoters50/1387194
ttgaaaa

SEQ ID NO: 67923 - DNA, 9 bp, Unknown
  misc_feature (1)..( 9): Matrix.004 file - promoters50/1387211
attgtaaat

SEQ ID NO: 67924 - DNA, 13 bp, Unknown
  misc_feature (1)..( 13): Matrix.004 file - promoters50/1387211
tattttaaaaaaa

SEQ ID NO: 67925 - DNA, 8 bp, Unknown
  misc_feature (1)..( 8): Matrix.004 file - promoters50/1387265
tatttttg

SEQ ID NO: 67926 - DNA, 7 bp, Unknown
  misc_feature (1)..( 7): Matrix.004 file - promoters50/1387336
ctgatga

SEQ ID NO: 67927 - DNA, 8 bp, Unknown
  misc_feature (1)..( 8): Matrix.004 file - promoters50/1387349
attcaaat

SEQ ID NO: 67928 - DNA, 10 bp, Unknown
  misc_feature (1)..( 10): Matrix.004 file - promoters50/1387349
gacaaaatat

SEQ ID NO: 67929 - DNA, 13 bp, Unknown
  misc_feature (1)..( 13): Matrix.004 file - promoters50/1387352
gtgaaacaaaaac

SEQ ID NO: 67930 - DNA, 9 bp, Unknown
  misc_feature (1)..( 9): Matrix.004 file - promoters50/1387352
ttataaata

SEQ ID NO: 67931 - DNA, 8 bp, Unknown
  misc_feature (1)..( 8): Matrix.004 file - promoters50/1387352
gaaaattg

SEQ ID NO: 67932 - DNA, 13 bp, Unknown
  misc_feature (1)..( 13): Matrix.004 file - promoters50/1387352
ataagaataaagt

SEQ ID NO: 67933 - DNA, 10 bp, Unknown
  misc_feature (1)..( 10): Matrix.004 file - promoters50/1387352
taaaattagg

SEQ ID NO: 67934 - DNA, 7 bp, Unknown
  misc_feature (1)..( 7): Matrix.004 file - promoters50/1387352
cataaaa

SEQ ID NO: 67935 - DNA, 8 bp, Unknown
  misc_feature (1)..( 8): Matrix.004 file - promoters50/1387356
tttattaa

SEQ ID NO: 67936 - DNA, 9 bp, Unknown
  misc_feature (1)..( 9): Matrix.004 file - promoters50/1387356
taagaataa

SEQ ID NO: 67937 - DNA, 6 bp, Unknown
  misc_feature (1)..( 6): Matrix.004 file - promoters50/1387356
ttaaaa

SEQ ID NO: 67938 - DNA, 13 bp, Unknown
  misc_feature (1)..( 13): Matrix.004 file - promoters50/1387356
aaagaaagacaga

SEQ ID NO: 67939 - DNA, 10 bp, Unknown
  misc_feature (1)..( 10): Matrix.004 file - promoters50/1387356
aaaaaaagtt

SEQ ID NO: 67940 - DNA, 7 bp, Unknown
  misc_feature (1)..( 7): Matrix.004 file - promoters50/1387356
caaaaga

SEQ ID NO: 67941 - DNA, 7 bp, Unknown
  misc_feature (1)..( 7): Matrix.004 file - promoters50/1387356
tacacgt

SEQ ID NO: 67942 - DNA, 12 bp, Unknown
  misc_feature (1)..( 12): Matrix.004 file - promoters50/1387368
aaatacaaaata

SEQ ID NO: 67943 - DNA, 9 bp, Unknown
  misc_feature (1)..( 9): Matrix.004 file - promoters50/1387368
aacaaaaga

SEQ ID NO: 67944 - DNA, 10 bp, Unknown
  misc_feature (1)..( 10): Matrix.004 file - promoters50/1387417
agagaagaaa

SEQ ID NO: 67945 - DNA, 7 bp, Unknown
  misc_feature (1)..( 7): Matrix.004 file - promoters50/1387417
ttcttat

SEQ ID NO: 67946 - DNA, 9 bp, Unknown
  misc_feature (1)..( 9): Matrix.004 file - promoters50/1387417
aatgatttc

SEQ ID NO: 67947 - DNA, 8 bp, Unknown
  misc_feature (1)..( 8): Matrix.004 file - promoters50/1387417
tgtgatcg

SEQ ID NO: 67948 - DNA, 8 bp, Unknown
  misc_feature (1)..( 8): Matrix.004 file - promoters50/1387417
attttctg

SEQ ID NO: 67949 - DNA, 9 bp, Unknown
  misc_feature (1)..( 9): Matrix.004 file - promoters50/1387421
ttttgctaa

SEQ ID NO: 67950 - DNA, 12 bp, Unknown
  misc_feature (1)..( 12): Matrix.004 file - promoters50/1387421
aacaaaatgact

SEQ ID NO: 67951 - DNA, 10 bp, Unknown
  misc_feature (1)..( 10): Matrix.004 file - promoters50/1387421
gaaagataaa

SEQ ID NO: 67952 - DNA, 10 bp, Unknown
  misc_feature (1)..( 10): Matrix.004 file - promoters50/1387421
taaattattt

SEQ ID NO: 67953 - DNA, 11 bp, Unknown
  misc_feature (1)..( 11): Matrix.004 file - promoters50/1387429
tgtagttaatg

SEQ ID NO: 67954 - DNA, 5 bp, Unknown
  misc_feature (1)..( 5): Matrix.004 file - promoters50/1387429
aatga

SEQ ID NO: 67955 - DNA, 11 bp, Unknown
  misc_feature (1)..( 11): Matrix.004 file - promoters50/1387429
cgtaaatttct

SEQ ID NO: 67956 - DNA, 8 bp, Unknown
  misc_feature (1)..( 8): Matrix.004 file - promoters50/1387429
caaattat

SEQ ID NO: 67957 - DNA, 7 bp, Unknown
  misc_feature (1)..( 7): Matrix.004 file - promoters50/1387505
caaatta

SEQ ID NO: 67958 - DNA, 8 bp, Unknown
  misc_feature (1)..( 8): Matrix.004 file - promoters50/1387505
aatgcaaa

SEQ ID NO: 67959 - DNA, 9 bp, Unknown
  misc_feature (1)..( 9): Matrix.004 file - promoters50/1387524
aatgaaatc

SEQ ID NO: 67960 - DNA, 13 bp, Unknown
  misc_feature (1)..( 13): Matrix.004 file - promoters50/1387524
tgttatctattgt

SEQ ID NO: 67961 - DNA, 8 bp, Unknown
  misc_feature (1)..( 8): Matrix.004 file - promoters50/1387524
agaaaaaa

SEQ ID NO: 67962 - DNA, 9 bp, Unknown
  misc_feature (1)..( 9): Matrix.004 file - promoters50/1387524
gaaaacact

SEQ ID NO: 67963 - DNA, 10 bp, Unknown
  misc_feature (1)..( 10): Matrix.004 file - promoters50/1387524
aggaataaaa

SEQ ID NO: 67964 - DNA, 7 bp, Unknown
  misc_feature (1)..( 7): Matrix.004 file - promoters50/1387524
aaaaaga

SEQ ID NO: 67965 - DNA, 9 bp, Unknown
  misc_feature (1)..( 9): Matrix.004 file - promoters50/1387524
taattatca

SEQ ID NO: 67966 - DNA, 5 bp, Unknown
  misc_feature (1)..( 5): Matrix.004 file - promoters50/1387524
agtaa

SEQ ID NO: 67967 - DNA, 8 bp, Unknown
  misc_feature (1)..( 8): Matrix.004 file - promoters50/1387524
gaaagaaa

SEQ ID NO: 67968 - DNA, 10 bp, Unknown
  misc_feature (1)..( 10): Matrix.004 file - promoters50/1387524
ggaaaagaaa

SEQ ID NO: 67969 - DNA, 6 bp, Unknown
  misc_feature (1)..( 6): Matrix.004 file - promoters50/1387547
ttgtaa

SEQ ID NO: 67970 - DNA, 9 bp, Unknown
  misc_feature (1)..( 9): Matrix.004 file - promoters50/1387580
ttattgtct

SEQ ID NO: 67971 - DNA, 10 bp, Unknown
  misc_feature (1)..( 10): Matrix.004 file - promoters50/1387587
gtaaaaaaaa

SEQ ID NO: 67972 - DNA, 10 bp, Unknown
  misc_feature (1)..( 10): Matrix.004 file - promoters50/1387587
ttttgaagaa

SEQ ID NO: 67973 - DNA, 7 bp, Unknown
  misc_feature (1)..( 7): Matrix.004 file - promoters50/1387587
agtaaaa

SEQ ID NO: 67974 - DNA, 10 bp, Unknown
  misc_feature (1)..( 10): Matrix.004 file - promoters50/1387590
atggtaaaaa

SEQ ID NO: 67975 - DNA, 9 bp, Unknown
  misc_feature (1)..( 9): Matrix.004 file - promoters50/1387590
ctatttcaa

SEQ ID NO: 67976 - DNA, 11 bp, Unknown
  misc_feature (1)..( 11): Matrix.004 file - promoters50/1387590
tatgacaacac

SEQ ID NO: 67977 - DNA, 8 bp, Unknown
  misc_feature (1)..( 8): Matrix.004 file - promoters50/1387590
ttcaataa

SEQ ID NO: 67978 - DNA, 10 bp, Unknown
  misc_feature (1)..( 10): Matrix.004 file - promoters50/1387605
gattttgagt

SEQ ID NO: 67979 - DNA, 8 bp, Unknown
  misc_feature (1)..( 8): Matrix.004 file - promoters50/1387616
actttaaa

SEQ ID NO: 67980 - DNA, 10 bp, Unknown
  misc_feature (1)..( 10): Matrix.004 file - promoters50/1387616
atagataagc

SEQ ID NO: 67981 - DNA, 11 bp, Unknown
  misc_feature (1)..( 11): Matrix.004 file - promoters50/1387628
tcaaaaaaaga

SEQ ID NO: 67982 - DNA, 7 bp, Unknown
  misc_feature (1)..( 7): Matrix.004 file - promoters50/1387628
tataaag

SEQ ID NO: 67983 - DNA, 9 bp, Unknown
  misc_feature (1)..( 9): Matrix.004 file - promoters50/1387628
taatttgtt

SEQ ID NO: 67984 - DNA, 9 bp, Unknown
  misc_feature (1)..( 9): Matrix.004 file - promoters50/1387665
agataaaaa

SEQ ID NO: 67985 - DNA, 9 bp, Unknown
  misc_feature (1)..( 9): Matrix.004 file - promoters50/1387665
tttttttgt

SEQ ID NO: 67986 - DNA, 7 bp, Unknown
  misc_feature (1)..( 7): Matrix.004 file - promoters50/1387665
aaattaa

SEQ ID NO: 67987 - DNA, 7 bp, Unknown
  misc_feature (1)..( 7): Matrix.004 file - promoters50/1387671
atagtaa

SEQ ID NO: 67988 - DNA, 14 bp, Unknown
  misc_feature (1)..( 14): Matrix.004 file - promoters50/1387793
tactatataaagac

SEQ ID NO: 67989 - DNA, 10 bp, Unknown
  misc_feature (1)..( 10): Matrix.004 file - promoters50/1387793
ttaaaagata

SEQ ID NO: 67990 - DNA, 9 bp, Unknown
  misc_feature (1)..( 9): Matrix.004 file - promoters50/1387793
aaaaccatc

SEQ ID NO: 67991 - DNA, 8 bp, Unknown
  misc_feature (1)..( 8): Matrix.004 file - promoters50/1387818
caaaaaaa

SEQ ID NO: 67992 - DNA, 8 bp, Unknown
  misc_feature (1)..( 8): Matrix.004 file - promoters50/1387818
aaaaacat

SEQ ID NO: 67993 - DNA, 11 bp, Unknown
  misc_feature (1)..( 11): Matrix.004 file - promoters50/1387906
catttttcttt

SEQ ID NO: 67994 - DNA, 11 bp, Unknown
  misc_feature (1)..( 11): Matrix.004 file - promoters50/1387906
ttttaacaaca

SEQ ID NO: 67995 - DNA, 11 bp, Unknown
  misc_feature (1)..( 11): Matrix.004 file - promoters50/1387935
ttaaatttgtt

SEQ ID NO: 67996 - DNA, 4 bp, Unknown
  misc_feature (1)..( 4): Matrix.004 file - promoters50/1387935
tttg

SEQ ID NO: 67997 - DNA, 8 bp, Unknown
  misc_feature (1)..( 8): Matrix.004 file - promoters50/1387935
caaataaa

SEQ ID NO: 67998 - DNA, 9 bp, Unknown
  misc_feature (1)..( 9): Matrix.004 file - promoters50/1387947
aaaagaaga

SEQ ID NO: 67999 - DNA, 12 bp, Unknown
  misc_feature (1)..( 12): Matrix.004 file - promoters50/1387947
caaagaaagtaa

SEQ ID NO: 68000 - DNA, 9 bp, Unknown
  misc_feature (1)..( 9): Matrix.004 file - promoters50/1388009
attaaaaat

SEQ ID NO: 68001 - DNA, 11 bp, Unknown
  misc_feature (1)..( 11): Matrix.004 file - promoters50/1388009
tattaaaatat

SEQ ID NO: 68002 - DNA, 7 bp, Unknown
  misc_feature (1)..( 7): Matrix.004 file - promoters50/1388009
attttac

SEQ ID NO: 68003 - DNA, 10 bp, Unknown
  misc_feature (1)..( 10): Matrix.004 file - promoters50/1388009
cgaaatcata

SEQ ID NO: 68004 - DNA, 9 bp, Unknown
  misc_feature (1)..( 9): Matrix.004 file - promoters50/1388009
aaattataa

SEQ ID NO: 68005 - DNA, 8 bp, Unknown
  misc_feature (1)..( 8): Matrix.004 file - promoters50/1388009
atatttta

SEQ ID NO: 68006 - DNA, 9 bp, Unknown
  misc_feature (1)..( 9): Matrix.004 file - promoters50/1388069
tatatgtaa

SEQ ID NO: 68007 - DNA, 11 bp, Unknown
  misc_feature (1)..( 11): Matrix.004 file - promoters50/1388423
caactaaaaaa

SEQ ID NO: 68008 - DNA, 8 bp, Unknown
  misc_feature (1)..( 8): Matrix.004 file - promoters50/1388423
aaacacaa

SEQ ID NO: 68009 - DNA, 11 bp, Unknown
  misc_feature (1)..( 11): Matrix.004 file - promoters50/1388423
gaagcaaaacc

SEQ ID NO: 68010 - DNA, 8 bp, Unknown
  misc_feature (1)..( 8): Matrix.004 file - promoters50/1388423
attgaatt

SEQ ID NO: 68011 - DNA, 7 bp, Unknown
  misc_feature (1)..( 7): Matrix.004 file - promoters50/1388423
aaacttg

SEQ ID NO: 68012 - DNA, 7 bp, Unknown
  misc_feature (1)..( 7): Matrix.004 file - promoters50/1388438
acacaac

SEQ ID NO: 68013 - DNA, 7 bp, Unknown
  misc_feature (1)..( 7): Matrix.004 file - promoters50/1388444
ccattaa

SEQ ID NO: 68014 - DNA, 8 bp, Unknown
  misc_feature (1)..( 8): Matrix.004 file - promoters50/1388444
ttacatta

SEQ ID NO: 68015 - DNA, 7 bp, Unknown
  misc_feature (1)..( 7): Matrix.004 file - promoters50/1388444
tttataa

SEQ ID NO: 68016 - DNA, 7 bp, Unknown
  misc_feature (1)..( 7): Matrix.004 file - promoters50/1388468
catatat

SEQ ID NO: 68017 - DNA, 11 bp, Unknown
  misc_feature (1)..( 11): Matrix.004 file - promoters50/1388468
atgtttattag

SEQ ID NO: 68018 - DNA, 11 bp, Unknown
  misc_feature (1)..( 11): Matrix.004 file - promoters50/1388468
caaaagaaaaa

SEQ ID NO: 68019 - DNA, 8 bp, Unknown
  misc_feature (1)..( 8): Matrix.004 file - promoters50/1388484
aatttact

SEQ ID NO: 68020 - DNA, 8 bp, Unknown
  misc_feature (1)..( 8): Matrix.004 file - promoters50/1388484
gaatcaat

SEQ ID NO: 68021 - DNA, 7 bp, Unknown
  misc_feature (1)..( 7): Matrix.004 file - promoters50/1388484
tttcaat

SEQ ID NO: 68022 - DNA, 9 bp, Unknown
  misc_feature (1)..( 9): Matrix.004 file - promoters50/1388484
gaattcaga

SEQ ID NO: 68023 - DNA, 8 bp, Unknown
  misc_feature (1)..( 8): Matrix.004 file - promoters50/1388484
agttattt

SEQ ID NO: 68024 - DNA, 10 bp, Unknown
  misc_feature (1)..( 10): Matrix.004 file - promoters50/1388545
tgcttatgat

SEQ ID NO: 68025 - DNA, 10 bp, Unknown
  misc_feature (1)..( 10): Matrix.004 file - promoters50/1388593
atatgaagaa

SEQ ID NO: 68026 - DNA, 8 bp, Unknown
  misc_feature (1)..( 8): Matrix.004 file - promoters50/1388593
attatttt

SEQ ID NO: 68027 - DNA, 8 bp, Unknown
  misc_feature (1)..( 8): Matrix.004 file - promoters50/1388593
gaagtata

SEQ ID NO: 68028 - DNA, 11 bp, Unknown
  misc_feature (1)..( 11): Matrix.004 file - promoters50/1388661
aagaaaaaagt

SEQ ID NO: 68029 - DNA, 9 bp, Unknown
  misc_feature (1)..( 9): Matrix.004 file - promoters50/1388661
ttgttaatt

SEQ ID NO: 68030 - DNA, 7 bp, Unknown
  misc_feature (1)..( 7): Matrix.004 file - promoters50/1388661
taaaaaa

SEQ ID NO: 68031 - DNA, 9 bp, Unknown
  misc_feature (1)..( 9): Matrix.004 file - promoters50/1388661
aaaagtact

SEQ ID NO: 68032 - DNA, 10 bp, Unknown
  misc_feature (1)..( 10): Matrix.004 file - promoters50/1388688
atttattaat

SEQ ID NO: 68033 - DNA, 11 bp, Unknown
  misc_feature (1)..( 11): Matrix.004 file - promoters50/1388688
agatatctatt

SEQ ID NO: 68034 - DNA, 9 bp, Unknown
  misc_feature (1)..( 9): Matrix.004 file - promoters50/1388688
gtttaatag

SEQ ID NO: 68035 - DNA, 9 bp, Unknown
  misc_feature (1)..( 9): Matrix.004 file - promoters50/1388688
tatctattt

SEQ ID NO: 68036 - DNA, 8 bp, Unknown
  misc_feature (1)..( 8): Matrix.004 file - promoters50/1388688
aacaaagt

SEQ ID NO: 68037 - DNA, 7 bp, Unknown
  misc_feature (1)..( 7): Matrix.004 file - promoters50/1388688
taaaaaa

SEQ ID NO: 68038 - DNA, 13 bp, Unknown
  misc_feature (1)..( 13): Matrix.004 file - promoters50/1388688
ataatatttaaat

SEQ ID NO: 68039 - DNA, 7 bp, Unknown
  misc_feature (1)..( 7): Matrix.004 file - promoters50/1388688
aaaaata

SEQ ID NO: 68040 - DNA, 8 bp, Unknown
  misc_feature (1)..( 8): Matrix.004 file - promoters50/1388688
aaaaacaa

SEQ ID NO: 68041 - DNA, 8 bp, Unknown
  misc_feature (1)..( 8): Matrix.004 file - promoters50/1388692
tttaatta

SEQ ID NO: 68042 - DNA, 11 bp, Unknown
  misc_feature (1)..( 11): Matrix.004 file - promoters50/1388692
ttgtcttttaa

SEQ ID NO: 68043 - DNA, 5 bp, Unknown
  misc_feature (1)..( 5): Matrix.004 file - promoters50/1388741
attgt

SEQ ID NO: 68044 - DNA, 8 bp, Unknown
  misc_feature (1)..( 8): Matrix.004 file - promoters50/1388741
aaaatgat

SEQ ID NO: 68045 - DNA, 8 bp, Unknown
  misc_feature (1)..( 8): Matrix.004 file - promoters50/1388775
aaagaaaa

SEQ ID NO: 68046 - DNA, 8 bp, Unknown
  misc_feature (1)..( 8): Matrix.004 file - promoters50/1388775
aatatata

SEQ ID NO: 68047 - DNA, 8 bp, Unknown
  misc_feature (1)..( 8): Matrix.004 file - promoters50/1388793
ataaatgc

SEQ ID NO: 68048 - DNA, 18 bp, Unknown
  misc_feature (1)..( 18): Matrix.004 file - promoters50/1388793
acaaaacagaaaatgttt

SEQ ID NO: 68049 - DNA, 8 bp, Unknown
  misc_feature (1)..( 8): Matrix.004 file - promoters50/1388793
aatgtttt

SEQ ID NO: 68050 - DNA, 6 bp, Unknown
  misc_feature (1)..( 6): Matrix.004 file - promoters50/1388793
ttttac

SEQ ID NO: 68051 - DNA, 9 bp, Unknown
  misc_feature (1)..( 9): Matrix.004 file - promoters50/1388793
acattcaat

SEQ ID NO: 68052 - DNA, 6 bp, Unknown
  misc_feature (1)..( 6): Matrix.004 file - promoters50/1388793
cattat

SEQ ID NO: 68053 - DNA, 7 bp, Unknown
  misc_feature (1)..( 7): Matrix.004 file - promoters50/1388793
acgcaaa

SEQ ID NO: 68054 - DNA, 7 bp, Unknown
  misc_feature (1)..( 7): Matrix.004 file - promoters50/1388852
aattatc

SEQ ID NO: 68055 - DNA, 9 bp, Unknown
  misc_feature (1)..( 9): Matrix.004 file - promoters50/1388852
aaatatgaa

SEQ ID NO: 68056 - DNA, 6 bp, Unknown
  misc_feature (1)..( 6): Matrix.004 file - promoters50/1388852
tttttt

SEQ ID NO: 68057 - DNA, 12 bp, Unknown
  misc_feature (1)..( 12): Matrix.004 file - promoters50/1388864
ctttacaaacac

SEQ ID NO: 68058 - DNA, 7 bp, Unknown
  misc_feature (1)..( 7): Matrix.004 file - promoters50/1388872
ctcagaa

SEQ ID NO: 68059 - DNA, 8 bp, Unknown
  misc_feature (1)..( 8): Matrix.004 file - promoters50/1388872
aatttttt

SEQ ID NO: 68060 - DNA, 11 bp, Unknown
  misc_feature (1)..( 11): Matrix.004 file - promoters50/1388872
aatttggctcc

SEQ ID NO: 68061 - DNA, 11 bp, Unknown
  misc_feature (1)..( 11): Matrix.004 file - promoters50/1388910
ataacattttt

SEQ ID NO: 68062 - DNA, 11 bp, Unknown
  misc_feature (1)..( 11): Matrix.004 file - promoters50/1388910
tatgtttaact

SEQ ID NO: 68063 - DNA, 7 bp, Unknown
  misc_feature (1)..( 7): Matrix.004 file - promoters50/1388910
tttaaaa

SEQ ID NO: 68064 - DNA, 8 bp, Unknown
  misc_feature (1)..( 8): Matrix.004 file - promoters50/1388973
ggaaaaaa

SEQ ID NO: 68065 - DNA, 15 bp, Unknown
  misc_feature (1)..( 15): Matrix.004 file - promoters50/1389231
tgtctaattaaacca

SEQ ID NO: 68066 - DNA, 9 bp, Unknown
  misc_feature (1)..( 9): Matrix.004 file - promoters50/1389231
tttttcttt

SEQ ID NO: 68067 - DNA, 8 bp, Unknown
  misc_feature (1)..( 8): Matrix.004 file - promoters50/1389231
ctttcatt

SEQ ID NO: 68068 - DNA, 8 bp, Unknown
  misc_feature (1)..( 8): Matrix.004 file - promoters50/1389231
attaacaa

SEQ ID NO: 68069 - DNA, 8 bp, Unknown
  misc_feature (1)..( 8): Matrix.004 file - promoters50/1389231
ttttcttt

SEQ ID NO: 68070 - DNA, 9 bp, Unknown
  misc_feature (1)..( 9): Matrix.004 file - promoters50/1389243
aaataaaat

SEQ ID NO: 68071 - DNA, 13 bp, Unknown
  misc_feature (1)..( 13): Matrix.004 file - promoters50/1389243
attaatttaaatt

SEQ ID NO: 68072 - DNA, 10 bp, Unknown
  misc_feature (1)..( 10): Matrix.004 file - promoters50/1389250
atttaagaat

SEQ ID NO: 68073 - DNA, 7 bp, Unknown
  misc_feature (1)..( 7): Matrix.004 file - promoters50/1389250
catctat

SEQ ID NO: 68074 - DNA, 10 bp, Unknown
  misc_feature (1)..( 10): Matrix.004 file - promoters50/1389279
caacttgtca

SEQ ID NO: 68075 - DNA, 7 bp, Unknown
  misc_feature (1)..( 7): Matrix.004 file - promoters50/1389279
caatgtt

SEQ ID NO: 68076 - DNA, 8 bp, Unknown
  misc_feature (1)..( 8): Matrix.004 file - promoters50/1389279
agaaaaaa

SEQ ID NO: 68077 - DNA, 8 bp, Unknown
  misc_feature (1)..( 8): Matrix.004 file - promoters50/1389279
acaaaaat

SEQ ID NO: 68078 - DNA, 8 bp, Unknown
  misc_feature (1)..( 8): Matrix.004 file - promoters50/1389279
tatatata

SEQ ID NO: 68079 - DNA, 9 bp, Unknown
  misc_feature (1)..( 9): Matrix.004 file - promoters50/1389301
aaaacaagt

SEQ ID NO: 68080 - DNA, 11 bp, Unknown
  misc_feature (1)..( 11): Matrix.004 file - promoters50/1389301
taataaactga

SEQ ID NO: 68081 - DNA, 7 bp, Unknown
  misc_feature (1)..( 7): Matrix.004 file - promoters50/1389330
ctcttga

SEQ ID NO: 68082 - DNA, 6 bp, Unknown
  misc_feature (1)..( 6): Matrix.004 file - promoters50/1389330
tttaaa

SEQ ID NO: 68083 - DNA, 10 bp, Unknown
  misc_feature (1)..( 10): Matrix.004 file - promoters50/1389401
ttaacaataa

SEQ ID NO: 68084 - DNA, 11 bp, Unknown
  misc_feature (1)..( 11): Matrix.004 file - promoters50/1389401
catgaaaaatt

SEQ ID NO: 68085 - DNA, 9 bp, Unknown
  misc_feature (1)..( 9): Matrix.004 file - promoters50/1389401
attctgttt

SEQ ID NO: 68086 - DNA, 8 bp, Unknown
  misc_feature (1)..( 8): Matrix.004 file - promoters50/1389401
acagattc

SEQ ID NO: 68087 - DNA, 7 bp, Unknown
  misc_feature (1)..( 7): Matrix.004 file - promoters50/1389401
aacaaaa

SEQ ID NO: 68088 - DNA, 11 bp, Unknown
  misc_feature (1)..( 11): Matrix.004 file - promoters50/1390146
cataattgcat

SEQ ID NO: 68089 - DNA, 6 bp, Unknown
  misc_feature (1)..( 6): Matrix.004 file - promoters50/1390146
agtata

SEQ ID NO: 68090 - DNA, 8 bp, Unknown
  misc_feature (1)..( 8): Matrix.004 file - promoters50/1390240
caatttga

SEQ ID NO: 68091 - DNA, 9 bp, Unknown
  misc_feature (1)..( 9): Matrix.004 file - promoters50/1390240
caaaaagaa

SEQ ID NO: 68092 - DNA, 8 bp, Unknown
  misc_feature (1)..( 8): Matrix.004 file - promoters50/1390240
gaaaatta

SEQ ID NO: 68093 - DNA, 6 bp, Unknown
  misc_feature (1)..( 6): Matrix.004 file - promoters50/1390240
acttgc

SEQ ID NO: 68094 - DNA, 12 bp, Unknown
  misc_feature (1)..( 12): Matrix.004 file - promoters50/1390240
catctttatata

SEQ ID NO: 68095 - DNA, 12 bp, Unknown
  misc_feature (1)..( 12): Matrix.004 file - promoters50/1391338
aatgtttgtgta

SEQ ID NO: 68096 - DNA, 8 bp, Unknown
  misc_feature (1)..( 8): Matrix.004 file - promoters50/1391361
aaaggatt

SEQ ID NO: 68097 - DNA, 8 bp, Unknown
  misc_feature (1)..( 8): Matrix.004 file - promoters50/1391361
tttctttt

SEQ ID NO: 68098 - DNA, 11 bp, Unknown
  misc_feature (1)..( 11): Matrix.004 file - promoters50/1391420
gatattaaaat

SEQ ID NO: 68099 - DNA, 8 bp, Unknown
  misc_feature (1)..( 8): Matrix.004 file - promoters50/1391420
agaagatc

SEQ ID NO: 68100 - DNA, 12 bp, Unknown
  misc_feature (1)..( 12): Matrix.004 file - promoters50/1391420
attaatgggcct

SEQ ID NO: 68101 - DNA, 13 bp, Unknown
  misc_feature (1)..( 13): Matrix.004 file - promoters50/1391535
aaattgggcctaa

SEQ ID NO: 68102 - DNA, 8 bp, Unknown
  misc_feature (1)..( 8): Matrix.004 file - promoters50/1391535
agtaaaac

SEQ ID NO: 68103 - DNA, 9 bp, Unknown
  misc_feature (1)..( 9): Matrix.004 file - promoters50/1391535
aaagaaaac

SEQ ID NO: 68104 - DNA, 9 bp, Unknown
  misc_feature (1)..( 9): Matrix.004 file - promoters50/1391535
attcaaaaa

SEQ ID NO: 68105 - DNA, 8 bp, Unknown
  misc_feature (1)..( 8): Matrix.004 file - promoters50/1391535
aaattggg

SEQ ID NO: 68106 - DNA, 10 bp, Unknown
  misc_feature (1)..( 10): Matrix.004 file - promoters50/1391651
aaatatctta

SEQ ID NO: 68107 - DNA, 8 bp, Unknown
  misc_feature (1)..( 8): Matrix.004 file - promoters50/1391651
agaacaaa

SEQ ID NO: 68108 - DNA, 7 bp, Unknown
  misc_feature (1)..( 7): Matrix.004 file - promoters50/1391765
caaagaa

SEQ ID NO: 68109 - DNA, 8 bp, Unknown
  misc_feature (1)..( 8): Matrix.004 file - promoters50/1391765
tattttac

SEQ ID NO: 68110 - DNA, 8 bp, Unknown
  misc_feature (1)..( 8): Matrix.004 file - promoters50/1392370
tgatcatt

SEQ ID NO: 68111 - DNA, 8 bp, Unknown
  misc_feature (1)..( 8): Matrix.004 file - promoters50/1392370
aattgatt

SEQ ID NO: 68112 - DNA, 9 bp, Unknown
  misc_feature (1)..( 9): Matrix.004 file - promoters50/1392370
atatttttt

SEQ ID NO: 68113 - DNA, 10 bp, Unknown
  misc_feature (1)..( 10): Matrix.004 file - promoters50/1392427
ttctataaat

SEQ ID NO: 68114 - DNA, 8 bp, Unknown
  misc_feature (1)..( 8): Matrix.004 file - promoters50/1392427
aatacaaa

SEQ ID NO: 68115 - DNA, 9 bp, Unknown
  misc_feature (1)..( 9): Matrix.004 file - promoters50/1393104
atcacgcct

SEQ ID NO: 68116 - DNA, 7 bp, Unknown
  misc_feature (1)..( 7): Matrix.004 file - promoters50/1393139
atgtgga

SEQ ID NO: 68117 - DNA, 13 bp, Unknown
  misc_feature (1)..( 13): Matrix.004 file - promoters50/1393139
tcaacttttaagt

SEQ ID NO: 68118 - DNA, 9 bp, Unknown
  misc_feature (1)..( 9): Matrix.004 file - promoters50/1393173
taataaaag

SEQ ID NO: 68119 - DNA, 11 bp, Unknown
  misc_feature (1)..( 11): Matrix.004 file - promoters50/1393173
aaaatgagata

SEQ ID NO: 68120 - DNA, 8 bp, Unknown
  misc_feature (1)..( 8): Matrix.004 file - promoters50/1393173
taaaaaaa

SEQ ID NO: 68121 - DNA, 10 bp, Unknown
  misc_feature (1)..( 10): Matrix.004 file - promoters50/1393181
ttgtgaagta

SEQ ID NO: 68122 - DNA, 9 bp, Unknown
  misc_feature (1)..( 9): Matrix.004 file - promoters50/1393181
ttactaata

SEQ ID NO: 68123 - DNA, 18 bp, Unknown
  misc_feature (1)..( 18): Matrix.004 file - promoters50/1393181
caaaattaaaaaaaaaaa

SEQ ID NO: 68124 - DNA, 8 bp, Unknown
  misc_feature (1)..( 8): Matrix.004 file - promoters50/1393181
taatttta

SEQ ID NO: 68125 - DNA, 8 bp, Unknown
  misc_feature (1)..( 8): Matrix.004 file - promoters50/1393181
tttgtaaa

SEQ ID NO: 68126 - DNA, 11 bp, Unknown
  misc_feature (1)..( 11): Matrix.004 file - promoters50/1393181
atttttgtcgg

SEQ ID NO: 68127 - DNA, 12 bp, Unknown
  misc_feature (1)..( 12): Matrix.004 file - promoters50/1393181
aaattattaaat

SEQ ID NO: 68128 - DNA, 13 bp, Unknown
  misc_feature (1)..( 13): Matrix.004 file - promoters50/1393187
tcattttagtcgt

SEQ ID NO: 68129 - DNA, 8 bp, Unknown
  misc_feature (1)..( 8): Matrix.004 file - promoters50/1393187
aataaatc

SEQ ID NO: 68130 - DNA, 7 bp, Unknown
  misc_feature (1)..( 7): Matrix.004 file - promoters50/1393187
aactaaa

SEQ ID NO: 68131 - DNA, 7 bp, Unknown
  misc_feature (1)..( 7): Matrix.004 file - promoters50/1393187
ataaaag

SEQ ID NO: 68132 - DNA, 9 bp, Unknown
  misc_feature (1)..( 9): Matrix.004 file - promoters50/1393187
aaaaaaaga

SEQ ID NO: 68133 - DNA, 8 bp, Unknown
  misc_feature (1)..( 8): Matrix.004 file - promoters50/1393187
atttgaat

SEQ ID NO: 68134 - DNA, 6 bp, Unknown
  misc_feature (1)..( 6): Matrix.004 file - promoters50/1393187
aaattt

SEQ ID NO: 68135 - DNA, 7 bp, Unknown
  misc_feature (1)..( 7): Matrix.004 file - promoters50/1393226
gactaat

SEQ ID NO: 68136 - DNA, 10 bp, Unknown
  misc_feature (1)..( 10): Matrix.004 file - promoters50/1393226
ttcctattta

SEQ ID NO: 68137 - DNA, 13 bp, Unknown
  misc_feature (1)..( 13): Matrix.004 file - promoters50/1393226
ttctatttaaatt

SEQ ID NO: 68138 - DNA, 16 bp, Unknown
  misc_feature (1)..( 16): Matrix.004 file - promoters50/1393226
ttgacaattatatgtt

SEQ ID NO: 68139 - DNA, 8 bp, Unknown
  misc_feature (1)..( 8): Matrix.004 file - promoters50/1393284
tttgttaa

SEQ ID NO: 68140 - DNA, 12 bp, Unknown
  misc_feature (1)..( 12): Matrix.004 file - promoters50/1393288
aatttaattttt

SEQ ID NO: 68141 - DNA, 8 bp, Unknown
  misc_feature (1)..( 8): Matrix.004 file - promoters50/1393288
caaaatta

SEQ ID NO: 68142 - DNA, 10 bp, Unknown
  misc_feature (1)..( 10): Matrix.004 file - promoters50/1393288
tcttcaaatc

SEQ ID NO: 68143 - DNA, 8 bp, Unknown
  misc_feature (1)..( 8): Matrix.004 file - promoters50/1393288
ttgtttga

SEQ ID NO: 68144 - DNA, 14 bp, Unknown
  misc_feature (1)..( 14): Matrix.004 file - promoters50/1393326
tcaattttgctaaa

SEQ ID NO: 68145 - DNA, 13 bp, Unknown
  misc_feature (1)..( 13): Matrix.004 file - promoters50/1393326
taattttcgttat

SEQ ID NO: 68146 - DNA, 8 bp, Unknown
  misc_feature (1)..( 8): Matrix.004 file - promoters50/1393326
tttttaat

SEQ ID NO: 68147 - DNA, 8 bp, Unknown
  misc_feature (1)..( 8): Matrix.004 file - promoters50/1393342
agaaaaaa

SEQ ID NO: 68148 - DNA, 12 bp, Unknown
  misc_feature (1)..( 12): Matrix.004 file - promoters50/1393342
attatacatatg

SEQ ID NO: 68149 - DNA, 13 bp, Unknown
  misc_feature (1)..( 13): Matrix.004 file - promoters50/1393342
ttatattaaaata

SEQ ID NO: 68150 - DNA, 10 bp, Unknown
  misc_feature (1)..( 10): Matrix.004 file - promoters50/1393342
atatctttca

SEQ ID NO: 68151 - DNA, 7 bp, Unknown
  misc_feature (1)..( 7): Matrix.004 file - promoters50/1393342
ttttttc

SEQ ID NO: 68152 - DNA, 16 bp, Unknown
  misc_feature (1)..( 16): Matrix.004 file - promoters50/1393342
aaacgagataataatt

SEQ ID NO: 68153 - DNA, 7 bp, Unknown
  misc_feature (1)..( 7): Matrix.004 file - promoters50/1393342
aaacaaa

SEQ ID NO: 68154 - DNA, 7 bp, Unknown
  misc_feature (1)..( 7): Matrix.004 file - promoters50/1393367
tttttct

SEQ ID NO: 68155 - DNA, 8 bp, Unknown
  misc_feature (1)..( 8): Matrix.004 file - promoters50/1393367
aatataca

SEQ ID NO: 68156 - DNA, 7 bp, Unknown
  misc_feature (1)..( 7): Matrix.004 file - promoters50/1393367
ttcaaaa

SEQ ID NO: 68157 - DNA, 8 bp, Unknown
  misc_feature (1)..( 8): Matrix.004 file - promoters50/1393367
attgtttg

SEQ ID NO: 68158 - DNA, 7 bp, Unknown
  misc_feature (1)..( 7): Matrix.004 file - promoters50/1393367
tttcaaa

SEQ ID NO: 68159 - DNA, 7 bp, Unknown
  misc_feature (1)..( 7): Matrix.004 file - promoters50/1393371
aaagaag

SEQ ID NO: 68160 - DNA, 12 bp, Unknown
  misc_feature (1)..( 12): Matrix.004 file - promoters50/1393383
tcaatcacatca

SEQ ID NO: 68161 - DNA, 9 bp, Unknown
  misc_feature (1)..( 9): Matrix.004 file - promoters50/1393478
agaaaataa

SEQ ID NO: 68162 - DNA, 12 bp, Unknown
  misc_feature (1)..( 12): Matrix.004 file - promoters50/1393478
gcaattattaaa

SEQ ID NO: 68163 - DNA, 12 bp, Unknown
  misc_feature (1)..( 12): Matrix.004 file - promoters50/1393492
tcttgtaataac

SEQ ID NO: 68164 - DNA, 13 bp, Unknown
  misc_feature (1)..( 13): Matrix.004 file - promoters50/1393492
cttctataaataa

SEQ ID NO: 68165 - DNA, 9 bp, Unknown
  misc_feature (1)..( 9): Matrix.004 file - promoters50/1393498
catttgttt

SEQ ID NO: 68166 - DNA, 13 bp, Unknown
  misc_feature (1)..( 13): Matrix.004 file - promoters50/1393498
ccaatattaaaaa

SEQ ID NO: 68167 - DNA, 9 bp, Unknown
  misc_feature (1)..( 9): Matrix.004 file - promoters50/1393498
aaaaatatg

SEQ ID NO: 68168 - DNA, 10 bp, Unknown
  misc_feature (1)..( 10): Matrix.004 file - promoters50/1393576
atgttgttaa

SEQ ID NO: 68169 - DNA, 10 bp, Unknown
  misc_feature (1)..( 10): Matrix.004 file - promoters50/1393576
aatgatgttg

SEQ ID NO: 68170 - DNA, 11 bp, Unknown
  misc_feature (1)..( 11): Matrix.004 file - promoters50/1393576
ccaaataaatg

SEQ ID NO: 68171 - DNA, 10 bp, Unknown
  misc_feature (1)..( 10): Matrix.004 file - promoters50/1393576
aaacttaaat

SEQ ID NO: 68172 - DNA, 13 bp, Unknown
  misc_feature (1)..( 13): Matrix.004 file - promoters50/1393576
tacatcaataaaa

SEQ ID NO: 68173 - DNA, 8 bp, Unknown
  misc_feature (1)..( 8): Matrix.004 file - promoters50/1393576
acaaaaaa

SEQ ID NO: 68174 - DNA, 8 bp, Unknown
  misc_feature (1)..( 8): Matrix.004 file - promoters50/1393576
gatatgtc

SEQ ID NO: 68175 - DNA, 8 bp, Unknown
  misc_feature (1)..( 8): Matrix.004 file - promoters50/1393576
ttcaaaat

SEQ ID NO: 68176 - DNA, 8 bp, Unknown
  misc_feature (1)..( 8): Matrix.004 file - promoters50/1393576
aaaaaatg

SEQ ID NO: 68177 - DNA, 9 bp, Unknown
  misc_feature (1)..( 9): Matrix.004 file - promoters50/1393576
tttcattac

SEQ ID NO: 68178 - DNA, 10 bp, Unknown
  misc_feature (1)..( 10): Matrix.004 file - promoters50/1393596
aaataaatcc

SEQ ID NO: 68179 - DNA, 12 bp, Unknown
  misc_feature (1)..( 12): Matrix.004 file - promoters50/1393596
ttacaaaatatt

SEQ ID NO: 68180 - DNA, 14 bp, Unknown
  misc_feature (1)..( 14): Matrix.004 file - promoters50/1393599
agtttaaattaaga

SEQ ID NO: 68181 - DNA, 9 bp, Unknown
  misc_feature (1)..( 9): Matrix.004 file - promoters50/1393599
taccaatat

SEQ ID NO: 68182 - DNA, 8 bp, Unknown
  misc_feature (1)..( 8): Matrix.004 file - promoters50/1393599
actgcaca

SEQ ID NO: 68183 - DNA, 6 bp, Unknown
  misc_feature (1)..( 6): Matrix.004 file - promoters50/1393599
aaaaaa

SEQ ID NO: 68184 - DNA, 10 bp, Unknown
  misc_feature (1)..( 10): Matrix.004 file - promoters50/1393599
tggaatagat

SEQ ID NO: 68185 - DNA, 11 bp, Unknown
  misc_feature (1)..( 11): Matrix.004 file - promoters50/1393599
agaaaaacaaa

SEQ ID NO: 68186 - DNA, 13 bp, Unknown
  misc_feature (1)..( 13): Matrix.004 file - promoters50/1393620
caaccaaacccac

SEQ ID NO: 68187 - DNA, 7 bp, Unknown
  misc_feature (1)..( 7): Matrix.004 file - promoters50/1393620
caaatta

SEQ ID NO: 68188 - DNA, 11 bp, Unknown
  misc_feature (1)..( 11): Matrix.004 file - promoters50/1393642
gagttgcggtc

SEQ ID NO: 68189 - DNA, 11 bp, Unknown
  misc_feature (1)..( 11): Matrix.004 file - promoters50/1393651
atcttttgtaa

SEQ ID NO: 68190 - DNA, 8 bp, Unknown
  misc_feature (1)..( 8): Matrix.004 file - promoters50/1393665
aaatcaaa

SEQ ID NO: 68191 - DNA, 9 bp, Unknown
  misc_feature (1)..( 9): Matrix.004 file - promoters50/1393665
ttagaaatg

SEQ ID NO: 68192 - DNA, 10 bp, Unknown
  misc_feature (1)..( 10): Matrix.004 file - promoters50/1393665
accaaatgaa

SEQ ID NO: 68193 - DNA, 9 bp, Unknown
  misc_feature (1)..( 9): Matrix.004 file - promoters50/1393677
aattcgacg

SEQ ID NO: 68194 - DNA, 8 bp, Unknown
  misc_feature (1)..( 8): Matrix.004 file - promoters50/1393677
tttgttat

SEQ ID NO: 68195 - DNA, 12 bp, Unknown
  misc_feature (1)..( 12): Matrix.004 file - promoters50/1393677
gaaacagaaata

SEQ ID NO: 68196 - DNA, 7 bp, Unknown
  misc_feature (1)..( 7): Matrix.004 file - promoters50/1393677
aagaaaa

SEQ ID NO: 68197 - DNA, 9 bp, Unknown
  misc_feature (1)..( 9): Matrix.004 file - promoters50/1393684
aaataaaaa

SEQ ID NO: 68198 - DNA, 12 bp, Unknown
  misc_feature (1)..( 12): Matrix.004 file - promoters50/1393684
acaattttagtc

SEQ ID NO: 68199 - DNA, 9 bp, Unknown
  misc_feature (1)..( 9): Matrix.004 file - promoters50/1393684
atatataaa

SEQ ID NO: 68200 - DNA, 9 bp, Unknown
  misc_feature (1)..( 9): Matrix.004 file - promoters50/1393725
catatatat

SEQ ID NO: 68201 - DNA, 7 bp, Unknown
  misc_feature (1)..( 7): Matrix.004 file - promoters50/1393725
attgtat

SEQ ID NO: 68202 - DNA, 6 bp, Unknown
  misc_feature (1)..( 6): Matrix.004 file - promoters50/1393725
tctctc

SEQ ID NO: 68203 - DNA, 10 bp, Unknown
  misc_feature (1)..( 10): Matrix.004 file - promoters50/1393725
atacaacatt

SEQ ID NO: 68204 - DNA, 8 bp, Unknown
  misc_feature (1)..( 8): Matrix.004 file - promoters50/1393725
aaaacttc

SEQ ID NO: 68205 - DNA, 9 bp, Unknown
  misc_feature (1)..( 9): Matrix.004 file - promoters50/1393725
ttaattttt

SEQ ID NO: 68206 - DNA, 13 bp, Unknown
  misc_feature (1)..( 13): Matrix.004 file - promoters50/1393725
aaaacatttgtaa

SEQ ID NO: 68207 - DNA, 9 bp, Unknown
  misc_feature (1)..( 9): Matrix.004 file - promoters50/1393725
aaaacctct

SEQ ID NO: 68208 - DNA, 12 bp, Unknown
  misc_feature (1)..( 12): Matrix.004 file - promoters50/1393725
ctcttattatca

SEQ ID NO: 68209 - DNA, 9 bp, Unknown
  misc_feature (1)..( 9): Matrix.004 file - promoters50/1393725
ttattctca

SEQ ID NO: 68210 - DNA, 9 bp, Unknown
  misc_feature (1)..( 9): Matrix.004 file - promoters50/1393751
taccaattg

SEQ ID NO: 68211 - DNA, 12 bp, Unknown
  misc_feature (1)..( 12): Matrix.004 file - promoters50/1393761
tactaacataag

SEQ ID NO: 68212 - DNA, 6 bp, Unknown
  misc_feature (1)..( 6): Matrix.004 file - promoters50/1393761
tttttt

SEQ ID NO: 68213 - DNA, 9 bp, Unknown
  misc_feature (1)..( 9): Matrix.004 file - promoters50/1393761
aaatgaaat

SEQ ID NO: 68214 - DNA, 7 bp, Unknown
  misc_feature (1)..( 7): Matrix.004 file - promoters50/1393761
ctgtgtc

SEQ ID NO: 68215 - DNA, 10 bp, Unknown
  misc_feature (1)..( 10): Matrix.004 file - promoters50/1393761
ctatttaaac

SEQ ID NO: 68216 - DNA, 9 bp, Unknown
  misc_feature (1)..( 9): Matrix.004 file - promoters50/1393761
aagttaata

SEQ ID NO: 68217 - DNA, 8 bp, Unknown
  misc_feature (1)..( 8): Matrix.004 file - promoters50/1393777
tttgattg

SEQ ID NO: 68218 - DNA, 8 bp, Unknown
  misc_feature (1)..( 8): Matrix.004 file - promoters50/1393777
taaaaatt

SEQ ID NO: 68219 - DNA, 11 bp, Unknown
  misc_feature (1)..( 11): Matrix.004 file - promoters50/1393777
ctatttttatt

SEQ ID NO: 68220 - DNA, 10 bp, Unknown
  misc_feature (1)..( 10): Matrix.004 file - promoters50/1393777
tttcatttta

SEQ ID NO: 68221 - DNA, 14 bp, Unknown
  misc_feature (1)..( 14): Matrix.004 file - promoters50/1393777
tattttttttggat

SEQ ID NO: 68222 - DNA, 10 bp, Unknown
  misc_feature (1)..( 10): Matrix.004 file - promoters50/1393777
catataatta

SEQ ID NO: 68223 - DNA, 10 bp, Unknown
  misc_feature (1)..( 10): Matrix.004 file - promoters50/1393777
taaattatag

SEQ ID NO: 68224 - DNA, 8 bp, Unknown
  misc_feature (1)..( 8): Matrix.004 file - promoters50/1393777
attttatt

SEQ ID NO: 68225 - DNA, 8 bp, Unknown
  misc_feature (1)..( 8): Matrix.004 file - promoters50/1393777
ttttattt

SEQ ID NO: 68226 - DNA, 9 bp, Unknown
  misc_feature (1)..( 9): Matrix.004 file - promoters50/1393777
tatttattt

SEQ ID NO: 68227 - DNA, 14 bp, Unknown
  misc_feature (1)..( 14): Matrix.004 file - promoters50/1393787
tcatattaattaac

SEQ ID NO: 68228 - DNA, 14 bp, Unknown
  misc_feature (1)..( 14): Matrix.004 file - promoters50/1393787
tgatgaatttctat

SEQ ID NO: 68229 - DNA, 14 bp, Unknown
  misc_feature (1)..( 14): Matrix.004 file - promoters50/1393802
tcaaaaaatttaat

SEQ ID NO: 68230 - DNA, 11 bp, Unknown
  misc_feature (1)..( 11): Matrix.004 file - promoters50/1393802
taacctaaaaa

SEQ ID NO: 68231 - DNA, 9 bp, Unknown
  misc_feature (1)..( 9): Matrix.004 file - promoters50/1393802
agaaatctt

SEQ ID NO: 68232 - DNA, 12 bp, Unknown
  misc_feature (1)..( 12): Matrix.004 file - promoters50/1393802
aaacaaaaaagt

SEQ ID NO: 68233 - DNA, 12 bp, Unknown
  misc_feature (1)..( 12): Matrix.004 file - promoters50/1393802
taaagttcaaca

SEQ ID NO: 68234 - DNA, 8 bp, Unknown
  misc_feature (1)..( 8): Matrix.004 file - promoters50/1393802
attttttt

SEQ ID NO: 68235 - DNA, 10 bp, Unknown
  misc_feature (1)..( 10): Matrix.004 file - promoters50/1393802
agttattcat

SEQ ID NO: 68236 - DNA, 9 bp, Unknown
  misc_feature (1)..( 9): Matrix.004 file - promoters50/1393805
tttattaaa

SEQ ID NO: 68237 - DNA, 9 bp, Unknown
  misc_feature (1)..( 9): Matrix.004 file - promoters50/1393808
atctttttt

SEQ ID NO: 68238 - DNA, 6 bp, Unknown
  misc_feature (1)..( 6): Matrix.004 file - promoters50/1393812
atccat

SEQ ID NO: 68239 - DNA, 11 bp, Unknown
  misc_feature (1)..( 11): Matrix.004 file - promoters50/1393812
tcgttctcaaa

SEQ ID NO: 68240 - DNA, 11 bp, Unknown
  misc_feature (1)..( 11): Matrix.004 file - promoters50/1393812
ttgattataaa

SEQ ID NO: 68241 - DNA, 9 bp, Unknown
  misc_feature (1)..( 9): Matrix.004 file - promoters50/1393812
aaactgaat

SEQ ID NO: 68242 - DNA, 8 bp, Unknown
  misc_feature (1)..( 8): Matrix.004 file - promoters50/1393812
aaataacc

SEQ ID NO: 68243 - DNA, 7 bp, Unknown
  misc_feature (1)..( 7): Matrix.004 file - promoters50/1393812
aacttat

SEQ ID NO: 68244 - DNA, 9 bp, Unknown
  misc_feature (1)..( 9): Matrix.004 file - promoters50/1393812
ttcttttta

SEQ ID NO: 68245 - DNA, 8 bp, Unknown
  misc_feature (1)..( 8): Matrix.004 file - promoters50/1393812
ataaccaa

SEQ ID NO: 68246 - DNA, 12 bp, Unknown
  misc_feature (1)..( 12): Matrix.004 file - promoters50/1393812
tgggcccattaa

SEQ ID NO: 68247 - DNA, 8 bp, Unknown
  misc_feature (1)..( 8): Matrix.004 file - promoters50/1393827
tataacta

SEQ ID NO: 68248 - DNA, 8 bp, Unknown
  misc_feature (1)..( 8): Matrix.004 file - promoters50/1393827
agttatct

SEQ ID NO: 68249 - DNA, 7 bp, Unknown
  misc_feature (1)..( 7): Matrix.004 file - promoters50/1393827
ttgtcta

SEQ ID NO: 68250 - DNA, 11 bp, Unknown
  misc_feature (1)..( 11): Matrix.004 file - promoters50/1393827
tcttattagat

SEQ ID NO: 68251 - DNA, 8 bp, Unknown
  misc_feature (1)..( 8): Matrix.004 file - promoters50/1393827
aatcaaat

SEQ ID NO: 68252 - DNA, 10 bp, Unknown
  misc_feature (1)..( 10): Matrix.004 file - promoters50/1393827
aacctccaca

SEQ ID NO: 68253 - DNA, 9 bp, Unknown
  misc_feature (1)..( 9): Matrix.004 file - promoters50/1393845
taaaataaa

SEQ ID NO: 68254 - DNA, 19 bp, Unknown
  misc_feature (1)..( 19): Matrix.004 file - promoters50/1393845
ttgaaatttagtaataaat

SEQ ID NO: 68255 - DNA, 9 bp, Unknown
  misc_feature (1)..( 9): Matrix.004 file - promoters50/1393845
attcaaaat

SEQ ID NO: 68256 - DNA, 9 bp, Unknown
  misc_feature (1)..( 9): Matrix.004 file - promoters50/1393845
aaattaatt

SEQ ID NO: 68257 - DNA, 11 bp, Unknown
  misc_feature (1)..( 11): Matrix.004 file - promoters50/1393935
aattattaaaa

SEQ ID NO: 68258 - DNA, 9 bp, Unknown
  misc_feature (1)..( 9): Matrix.004 file - promoters50/1393954
aaaagcaaa

SEQ ID NO: 68259 - DNA, 8 bp, Unknown
  misc_feature (1)..( 8): Matrix.004 file - promoters50/1393954
tcaaggtt

SEQ ID NO: 68260 - DNA, 9 bp, Unknown
  misc_feature (1)..( 9): Matrix.004 file - promoters50/1393954
tatctttat

SEQ ID NO: 68261 - DNA, 11 bp, Unknown
  misc_feature (1)..( 11): Matrix.004 file - promoters50/1393954
gttgaattttt

SEQ ID NO: 68262 - DNA, 8 bp, Unknown
  misc_feature (1)..( 8): Matrix.004 file - promoters50/1394008
tgaacaaa

SEQ ID NO: 68263 - DNA, 8 bp, Unknown
  misc_feature (1)..( 8): Matrix.004 file - promoters50/1394034
aaagattt

SEQ ID NO: 68264 - DNA, 7 bp, Unknown
  misc_feature (1)..( 7): Matrix.004 file - promoters50/1394110
taacttt

SEQ ID NO: 68265 - DNA, 9 bp, Unknown
  misc_feature (1)..( 9): Matrix.004 file - promoters50/1394110
taaaaaaaa

SEQ ID NO: 68266 - DNA, 10 bp, Unknown
  misc_feature (1)..( 10): Matrix.004 file - promoters50/1394110
aaacaaaata

SEQ ID NO: 68267 - DNA, 10 bp, Unknown
  misc_feature (1)..( 10): Matrix.004 file - promoters50/1394110
tcttcaaaaa

SEQ ID NO: 68268 - DNA, 8 bp, Unknown
  misc_feature (1)..( 8): Matrix.004 file - promoters50/1394110
atatcaaa

SEQ ID NO: 68269 - DNA, 13 bp, Unknown
  misc_feature (1)..( 13): Matrix.004 file - promoters50/1394110
aaatttcaaaaaa

SEQ ID NO: 68270 - DNA, 9 bp, Unknown
  misc_feature (1)..( 9): Matrix.004 file - promoters50/1394178
aaaaattta

SEQ ID NO: 68271 - DNA, 9 bp, Unknown
  misc_feature (1)..( 9): Matrix.004 file - promoters50/1394178
tttttttct

SEQ ID NO: 68272 - DNA, 9 bp, Unknown
  misc_feature (1)..( 9): Matrix.004 file - promoters50/1394178
tttttctta

SEQ ID NO: 68273 - DNA, 6 bp, Unknown
  misc_feature (1)..( 6): Matrix.004 file - promoters50/1394178
gttttt

SEQ ID NO: 68274 - DNA, 9 bp, Unknown
  misc_feature (1)..( 9): Matrix.004 file - promoters50/1394178
ttttttaaa

SEQ ID NO: 68275 - DNA, 8 bp, Unknown
  misc_feature (1)..( 8): Matrix.004 file - promoters50/1394302
cataaaaa

SEQ ID NO: 68276 - DNA, 17 bp, Unknown
  misc_feature (1)..( 17): Matrix.004 file - promoters50/1394302
actgtttaaaaaaaaaa

SEQ ID NO: 68277 - DNA, 8 bp, Unknown
  misc_feature (1)..( 8): Matrix.004 file - promoters50/1394302
ttgttaat

SEQ ID NO: 68278 - DNA, 8 bp, Unknown
  misc_feature (1)..( 8): Matrix.004 file - promoters50/1394310
aaaacaaa

SEQ ID NO: 68279 - DNA, 12 bp, Unknown
  misc_feature (1)..( 12): Matrix.004 file - promoters50/1394310
ataacatataca

SEQ ID NO: 68280 - DNA, 10 bp, Unknown
  misc_feature (1)..( 10): Matrix.004 file - promoters50/1394310
cttgatatca

SEQ ID NO: 68281 - DNA, 16 bp, Unknown
  misc_feature (1)..( 16): Matrix.004 file - promoters50/1394310
atccttattttaccgt

SEQ ID NO: 68282 - DNA, 8 bp, Unknown
  misc_feature (1)..( 8): Matrix.004 file - promoters50/1394327
tctatata

SEQ ID NO: 68283 - DNA, 7 bp, Unknown
  misc_feature (1)..( 7): Matrix.004 file - promoters50/1394327
gcaaaaa

SEQ ID NO: 68284 - DNA, 10 bp, Unknown
  misc_feature (1)..( 10): Matrix.004 file - promoters50/1394327
atatggaaaa

SEQ ID NO: 68285 - DNA, 9 bp, Unknown
  misc_feature (1)..( 9): Matrix.004 file - promoters50/1394327
caaaacttt

SEQ ID NO: 68286 - DNA, 8 bp, Unknown
  misc_feature (1)..( 8): Matrix.004 file - promoters50/1394447
attgttta

SEQ ID NO: 68287 - DNA, 8 bp, Unknown
  misc_feature (1)..( 8): Matrix.004 file - promoters50/1394447
aggataaa

SEQ ID NO: 68288 - DNA, 10 bp, Unknown
  misc_feature (1)..( 10): Matrix.004 file - promoters50/1394447
tatttttctc

SEQ ID NO: 68289 - DNA, 7 bp, Unknown
  misc_feature (1)..( 7): Matrix.004 file - promoters50/1394447
atgaaaa

SEQ ID NO: 68290 - DNA, 10 bp, Unknown
  misc_feature (1)..( 10): Matrix.004 file - promoters50/1394451
atttaataaa

SEQ ID NO: 68291 - DNA, 8 bp, Unknown
  misc_feature (1)..( 8): Matrix.004 file - promoters50/1394451
taattata

SEQ ID NO: 68292 - DNA, 10 bp, Unknown
  misc_feature (1)..( 10): Matrix.004 file - promoters50/1394473
atcaaggaaa

SEQ ID NO: 68293 - DNA, 12 bp, Unknown
  misc_feature (1)..( 12): Matrix.004 file - promoters50/1394473
aacgacaaaaag

SEQ ID NO: 68294 - DNA, 9 bp, Unknown
  misc_feature (1)..( 9): Matrix.004 file - promoters50/1394473
ttaatatat

SEQ ID NO: 68295 - DNA, 9 bp, Unknown
  misc_feature (1)..( 9): Matrix.004 file - promoters50/1394473
tcaaatcaa

SEQ ID NO: 68296 - DNA, 8 bp, Unknown
  misc_feature (1)..( 8): Matrix.004 file - promoters50/1394473
aataaaga

SEQ ID NO: 68297 - DNA, 12 bp, Unknown
  misc_feature (1)..( 12): Matrix.004 file - promoters50/1394473
aaaaaaagataa

SEQ ID NO: 68298 - DNA, 9 bp, Unknown
  misc_feature (1)..( 9): Matrix.004 file - promoters50/1394480
catatatac

SEQ ID NO: 68299 - DNA, 9 bp, Unknown
  misc_feature (1)..( 9): Matrix.004 file - promoters50/1394480
aaaatttct

SEQ ID NO: 68300 - DNA, 8 bp, Unknown
  misc_feature (1)..( 8): Matrix.004 file - promoters50/1394480
tgtgaaac

SEQ ID NO: 68301 - DNA, 9 bp, Unknown
  misc_feature (1)..( 9): Matrix.004 file - promoters50/1394510
aaaatttct

SEQ ID NO: 68302 - DNA, 12 bp, Unknown
  misc_feature (1)..( 12): Matrix.004 file - promoters50/1394510
taaaatttttgt

SEQ ID NO: 68303 - DNA, 10 bp, Unknown
  misc_feature (1)..( 10): Matrix.004 file - promoters50/1394510
aacatataaa

SEQ ID NO: 68304 - DNA, 10 bp, Unknown
  misc_feature (1)..( 10): Matrix.004 file - promoters50/1394510
aaaattcaca

SEQ ID NO: 68305 - DNA, 13 bp, Unknown
  misc_feature (1)..( 13): Matrix.004 file - promoters50/1394514
tttaatatttctt

SEQ ID NO: 68306 - DNA, 9 bp, Unknown
  misc_feature (1)..( 9): Matrix.004 file - promoters50/1394514
aattttagt

SEQ ID NO: 68307 - DNA, 5 bp, Unknown
  misc_feature (1)..( 5): Matrix.004 file - promoters50/1394514
ttagt

SEQ ID NO: 68308 - DNA, 10 bp, Unknown
  misc_feature (1)..( 10): Matrix.004 file - promoters50/1394514
aaaatgttag

SEQ ID NO: 68309 - DNA, 9 bp, Unknown
  misc_feature (1)..( 9): Matrix.004 file - promoters50/1394545
cattattgt

SEQ ID NO: 68310 - DNA, 8 bp, Unknown
  misc_feature (1)..( 8): Matrix.004 file - promoters50/1394592
catctaac

SEQ ID NO: 68311 - DNA, 12 bp, Unknown
  misc_feature (1)..( 12): Matrix.004 file - promoters50/1394610
tttagaatcaaa

SEQ ID NO: 68312 - DNA, 8 bp, Unknown
  misc_feature (1)..( 8): Matrix.004 file - promoters50/1394610
taaactct

SEQ ID NO: 68313 - DNA, 6 bp, Unknown
  misc_feature (1)..( 6): Matrix.004 file - promoters50/1394610
ctcttt

SEQ ID NO: 68314 - DNA, 11 bp, Unknown
  misc_feature (1)..( 11): Matrix.004 file - promoters50/1394610
tataataactt

SEQ ID NO: 68315 - DNA, 11 bp, Unknown
  misc_feature (1)..( 11): Matrix.004 file - promoters50/1394610
taactttggtt

SEQ ID NO: 68316 - DNA, 8 bp, Unknown
  misc_feature (1)..( 8): Matrix.004 file - promoters50/1394625
ataatttt

SEQ ID NO: 68317 - DNA, 17 bp, Unknown
  misc_feature (1)..( 17): Matrix.004 file - promoters50/1394625
aaaattaaaaaaaaaag

SEQ ID NO: 68318 - DNA, 8 bp, Unknown
  misc_feature (1)..( 8): Matrix.004 file - promoters50/1394625
taatttta

SEQ ID NO: 68319 - DNA, 8 bp, Unknown
  misc_feature (1)..( 8): Matrix.004 file - promoters50/1394625
tttaattt

SEQ ID NO: 68320 - DNA, 7 bp, Unknown
  misc_feature (1)..( 7): Matrix.004 file - promoters50/1394625
aaaatat

SEQ ID NO: 68321 - DNA, 11 bp, Unknown
  misc_feature (1)..( 11): Matrix.004 file - promoters50/1394625
atataataaaa

SEQ ID NO: 68322 - DNA, 12 bp, Unknown
  misc_feature (1)..( 12): Matrix.004 file - promoters50/1394643
aaattattaaac

SEQ ID NO: 68323 - DNA, 10 bp, Unknown
  misc_feature (1)..( 10): Matrix.004 file - promoters50/1394643
gttataatat

SEQ ID NO: 68324 - DNA, 13 bp, Unknown
  misc_feature (1)..( 13): Matrix.004 file - promoters50/1394643
aattaataatttt

SEQ ID NO: 68325 - DNA, 12 bp, Unknown
  misc_feature (1)..( 12): Matrix.004 file - promoters50/1394643
gaatttgagtta

SEQ ID NO: 68326 - DNA, 12 bp, Unknown
  misc_feature (1)..( 12): Matrix.004 file - promoters50/1394643
aatagtacattt

SEQ ID NO: 68327 - DNA, 7 bp, Unknown
  misc_feature (1)..( 7): Matrix.004 file - promoters50/1394643
tttgatt

SEQ ID NO: 68328 - DNA, 11 bp, Unknown
  misc_feature (1)..( 11): Matrix.004 file - promoters50/1394676
cttcttatata

SEQ ID NO: 68329 - DNA, 9 bp, Unknown
  misc_feature (1)..( 9): Matrix.004 file - promoters50/1394697
tttgattga

SEQ ID NO: 68330 - DNA, 9 bp, Unknown
  misc_feature (1)..( 9): Matrix.004 file - promoters50/1394697
aatcatata

SEQ ID NO: 68331 - DNA, 17 bp, Unknown
  misc_feature (1)..( 17): Matrix.004 file - promoters50/1394697
tcttttaaaataaaact

SEQ ID NO: 68332 - DNA, 11 bp, Unknown
  misc_feature (1)..( 11): Matrix.004 file - promoters50/1394767
ttcaaaaatta

SEQ ID NO: 68333 - DNA, 7 bp, Unknown
  misc_feature (1)..( 7): Matrix.004 file - promoters50/1394795
caattaa

SEQ ID NO: 68334 - DNA, 12 bp, Unknown
  misc_feature (1)..( 12): Matrix.004 file - promoters50/1394819
tctatatataca

SEQ ID NO: 68335 - DNA, 19 bp, Unknown
  misc_feature (1)..( 19): Matrix.004 file - promoters50/1394842
acaaaatgtcttatcaact

SEQ ID NO: 68336 - DNA, 12 bp, Unknown
  misc_feature (1)..( 12): Matrix.004 file - promoters50/1394842
taaggattagtt

SEQ ID NO: 68337 - DNA, 8 bp, Unknown
  misc_feature (1)..( 8): Matrix.004 file - promoters50/1394842
attgtgtt

SEQ ID NO: 68338 - DNA, 8 bp, Unknown
  misc_feature (1)..( 8): Matrix.004 file - promoters50/1394842
taaaccgg

SEQ ID NO: 68339 - DNA, 8 bp, Unknown
  misc_feature (1)..( 8): Matrix.004 file - promoters50/1394842
ggttttgt

SEQ ID NO: 68340 - DNA, 8 bp, Unknown
  misc_feature (1)..( 8): Matrix.004 file - promoters50/1394861
gattttgt

SEQ ID NO: 68341 - DNA, 7 bp, Unknown
  misc_feature (1)..( 7): Matrix.004 file - promoters50/1394861
attgaaa

SEQ ID NO: 68342 - DNA, 10 bp, Unknown
  misc_feature (1)..( 10): Matrix.004 file - promoters50/1394861
ggccatttta

SEQ ID NO: 68343 - DNA, 8 bp, Unknown
  misc_feature (1)..( 8): Matrix.004 file - promoters50/1394861
aaacaaaa

SEQ ID NO: 68344 - DNA, 10 bp, Unknown
  misc_feature (1)..( 10): Matrix.004 file - promoters50/1394861
gttcttaaag

SEQ ID NO: 68345 - DNA, 8 bp, Unknown
  misc_feature (1)..( 8): Matrix.004 file - promoters50/1394884
attttatt

SEQ ID NO: 68346 - DNA, 9 bp, Unknown
  misc_feature (1)..( 9): Matrix.004 file - promoters50/1394884
aattttttt

SEQ ID NO: 68347 - DNA, 8 bp, Unknown
  misc_feature (1)..( 8): Matrix.004 file - promoters50/1394884
atttgttt

SEQ ID NO: 68348 - DNA, 9 bp, Unknown
  misc_feature (1)..( 9): Matrix.004 file - promoters50/1394884
atttgtata

SEQ ID NO: 68349 - DNA, 7 bp, Unknown
  misc_feature (1)..( 7): Matrix.004 file - promoters50/1394884
aatttaa

SEQ ID NO: 68350 - DNA, 10 bp, Unknown
  misc_feature (1)..( 10): Matrix.004 file - promoters50/1394884
gaattatatc

SEQ ID NO: 68351 - DNA, 11 bp, Unknown
  misc_feature (1)..( 11): Matrix.004 file - promoters50/1394884
ctgaattatat

SEQ ID NO: 68352 - DNA, 9 bp, Unknown
  misc_feature (1)..( 9): Matrix.004 file - promoters50/1394884
taatcttag

SEQ ID NO: 68353 - DNA, 6 bp, Unknown
  misc_feature (1)..( 6): Matrix.004 file - promoters50/1394884
tataat

SEQ ID NO: 68354 - DNA, 6 bp, Unknown
  misc_feature (1)..( 6): Matrix.004 file - promoters50/1394978
atttaa

SEQ ID NO: 68355 - DNA, 8 bp, Unknown
  misc_feature (1)..( 8): Matrix.004 file - promoters50/1394978
atcaacat

SEQ ID NO: 68356 - DNA, 10 bp, Unknown
  misc_feature (1)..( 10): Matrix.004 file - promoters50/1394978
ataaacatta

SEQ ID NO: 68357 - DNA, 12 bp, Unknown
  misc_feature (1)..( 12): Matrix.004 file - promoters50/1394978
caatttcattta

SEQ ID NO: 68358 - DNA, 8 bp, Unknown
  misc_feature (1)..( 8): Matrix.004 file - promoters50/1394978
cttatatc

SEQ ID NO: 68359 - DNA, 8 bp, Unknown
  misc_feature (1)..( 8): Matrix.004 file - promoters50/1394978
tagaaaaa

SEQ ID NO: 68360 - DNA, 14 bp, Unknown
  misc_feature (1)..( 14): Matrix.004 file - promoters50/1394978
aaaaaccattttaa

SEQ ID NO: 68361 - DNA, 9 bp, Unknown
  misc_feature (1)..( 9): Matrix.004 file - promoters50/1394978
aaaagagaa

SEQ ID NO: 68362 - DNA, 8 bp, Unknown
  misc_feature (1)..( 8): Matrix.004 file - promoters50/1394978
gtaaattc

SEQ ID NO: 68363 - DNA, 10 bp, Unknown
  misc_feature (1)..( 10): Matrix.004 file - promoters50/1394978
aaaattaaaa

SEQ ID NO: 68364 - DNA, 8 bp, Unknown
  misc_feature (1)..( 8): Matrix.004 file - promoters50/1395027
tgtataat

SEQ ID NO: 68365 - DNA, 9 bp, Unknown
  misc_feature (1)..( 9): Matrix.004 file - promoters50/1395027
taaactaat

SEQ ID NO: 68366 - DNA, 10 bp, Unknown
  misc_feature (1)..( 10): Matrix.004 file - promoters50/1395027
ataaataata

SEQ ID NO: 68367 - DNA, 8 bp, Unknown
  misc_feature (1)..( 8): Matrix.004 file - promoters50/1395027
aaaacaaa

SEQ ID NO: 68368 - DNA, 8 bp, Unknown
  misc_feature (1)..( 8): Matrix.004 file - promoters50/1395046
aaaatata

SEQ ID NO: 68369 - DNA, 8 bp, Unknown
  misc_feature (1)..( 8): Matrix.004 file - promoters50/1395066
tctataaa

SEQ ID NO: 68370 - DNA, 14 bp, Unknown
  misc_feature (1)..( 14): Matrix.004 file - promoters50/1395066
tttgaaaatgagta

SEQ ID NO: 68371 - DNA, 10 bp, Unknown
  misc_feature (1)..( 10): Matrix.004 file - promoters50/1395095
agtaactaaa

SEQ ID NO: 68372 - DNA, 8 bp, Unknown
  misc_feature (1)..( 8): Matrix.004 file - promoters50/1395128
atttattt

SEQ ID NO: 68373 - DNA, 7 bp, Unknown
  misc_feature (1)..( 7): Matrix.004 file - promoters50/1395128
atatgta

SEQ ID NO: 68374 - DNA, 10 bp, Unknown
  misc_feature (1)..( 10): Matrix.004 file - promoters50/1395128
ataattaaat

SEQ ID NO: 68375 - DNA, 12 bp, Unknown
  misc_feature (1)..( 12): Matrix.004 file - promoters50/1395128
ttaaaataaaaa

SEQ ID NO: 68376 - DNA, 9 bp, Unknown
  misc_feature (1)..( 9): Matrix.004 file - promoters50/1395128
acagatgaa

SEQ ID NO: 68377 - DNA, 9 bp, Unknown
  misc_feature (1)..( 9): Matrix.004 file - promoters50/1395128
tcaaacaaa

SEQ ID NO: 68378 - DNA, 7 bp, Unknown
  misc_feature (1)..( 7): Matrix.004 file - promoters50/1395128
ccaattt

SEQ ID NO: 68379 - DNA, 9 bp, Unknown
  misc_feature (1)..( 9): Matrix.004 file - promoters50/1395128
tttatcaaa

SEQ ID NO: 68380 - DNA, 10 bp, Unknown
  misc_feature (1)..( 10): Matrix.004 file - promoters50/1395128
taataaaaag

SEQ ID NO: 68381 - DNA, 9 bp, Unknown
  misc_feature (1)..( 9): Matrix.004 file - promoters50/1395128
ctttatcaa

SEQ ID NO: 68382 - DNA, 7 bp, Unknown
  misc_feature (1)..( 7): Matrix.004 file - promoters50/1395128
attttgt

SEQ ID NO: 68383 - DNA, 10 bp, Unknown
  misc_feature (1)..( 10): Matrix.004 file - promoters50/1395142
aaaacaaaaa

SEQ ID NO: 68384 - DNA, 7 bp, Unknown
  misc_feature (1)..( 7): Matrix.004 file - promoters50/1395142
gggttat

SEQ ID NO: 68385 - DNA, 9 bp, Unknown
  misc_feature (1)..( 9): Matrix.004 file - promoters50/1395185
atttacaat

SEQ ID NO: 68386 - DNA, 11 bp, Unknown
  misc_feature (1)..( 11): Matrix.004 file - promoters50/1395185
attatgtttta

SEQ ID NO: 68387 - DNA, 10 bp, Unknown
  misc_feature (1)..( 10): Matrix.004 file - promoters50/1395215
taaagcaaaa

SEQ ID NO: 68388 - DNA, 8 bp, Unknown
  misc_feature (1)..( 8): Matrix.004 file - promoters50/1395215
ttgttagt

SEQ ID NO: 68389 - DNA, 8 bp, Unknown
  misc_feature (1)..( 8): Matrix.004 file - promoters50/1395254
gaaacaaa

SEQ ID NO: 68390 - DNA, 9 bp, Unknown
  misc_feature (1)..( 9): Matrix.004 file - promoters50/1395254
ttttttatt

SEQ ID NO: 68391 - DNA, 8 bp, Unknown
  misc_feature (1)..( 8): Matrix.004 file - promoters50/1395254
attgtttg

SEQ ID NO: 68392 - DNA, 9 bp, Unknown
  misc_feature (1)..( 9): Matrix.004 file - promoters50/1395254
taaaaacag

SEQ ID NO: 68393 - DNA, 8 bp, Unknown
  misc_feature (1)..( 8): Matrix.004 file - promoters50/1395254
attaatga

SEQ ID NO: 68394 - DNA, 8 bp, Unknown
  misc_feature (1)..( 8): Matrix.004 file - promoters50/1395254
aaatctaa

SEQ ID NO: 68395 - DNA, 7 bp, Unknown
  misc_feature (1)..( 7): Matrix.004 file - promoters50/1395270
atttttt

SEQ ID NO: 68396 - DNA, 8 bp, Unknown
  misc_feature (1)..( 8): Matrix.004 file - promoters50/1395390
aattattt

SEQ ID NO: 68397 - DNA, 12 bp, Unknown
  misc_feature (1)..( 12): Matrix.004 file - promoters50/1395390
acaaatatatta

SEQ ID NO: 68398 - DNA, 8 bp, Unknown
  misc_feature (1)..( 8): Matrix.004 file - promoters50/1395390
agaatttt

SEQ ID NO: 68399 - DNA, 10 bp, Unknown
  misc_feature (1)..( 10): Matrix.004 file - promoters50/1395390
agtttttaaa

SEQ ID NO: 68400 - DNA, 9 bp, Unknown
  misc_feature (1)..( 9): Matrix.004 file - promoters50/1395390
attacaaaa

SEQ ID NO: 68401 - DNA, 8 bp, Unknown
  misc_feature (1)..( 8): Matrix.004 file - promoters50/1395390
atttattc

SEQ ID NO: 68402 - DNA, 12 bp, Unknown
  misc_feature (1)..( 12): Matrix.004 file - promoters50/1395390
aaaataaaattt

SEQ ID NO: 68403 - DNA, 10 bp, Unknown
  misc_feature (1)..( 10): Matrix.004 file - promoters50/1395390
aatattttta

SEQ ID NO: 68404 - DNA, 11 bp, Unknown
  misc_feature (1)..( 11): Matrix.004 file - promoters50/1395390
atttatcatta

SEQ ID NO: 68405 - DNA, 7 bp, Unknown
  misc_feature (1)..( 7): Matrix.004 file - promoters50/1395390
attttct

SEQ ID NO: 68406 - DNA, 8 bp, Unknown
  misc_feature (1)..( 8): Matrix.004 file - promoters50/1395390
aattaaat

SEQ ID NO: 68407 - DNA, 7 bp, Unknown
  misc_feature (1)..( 7): Matrix.004 file - promoters50/1395390
aaattaa

SEQ ID NO: 68408 - DNA, 8 bp, Unknown
  misc_feature (1)..( 8): Matrix.004 file - promoters50/1395421
taaaattt

SEQ ID NO: 68409 - DNA, 8 bp, Unknown
  misc_feature (1)..( 8): Matrix.004 file - promoters50/1395421
gaagaaga

SEQ ID NO: 68410 - DNA, 13 bp, Unknown
  misc_feature (1)..( 13): Matrix.004 file - promoters50/1395421
tcaatttttctca

SEQ ID NO: 68411 - DNA, 11 bp, Unknown
  misc_feature (1)..( 11): Matrix.004 file - promoters50/1395481
ttgaatttttg

SEQ ID NO: 68412 - DNA, 11 bp, Unknown
  misc_feature (1)..( 11): Matrix.004 file - promoters50/1395485
aatactaatag

SEQ ID NO: 68413 - DNA, 8 bp, Unknown
  misc_feature (1)..( 8): Matrix.004 file - promoters50/1395534
tctttttg

SEQ ID NO: 68414 - DNA, 13 bp, Unknown
  misc_feature (1)..( 13): Matrix.004 file - promoters50/1395534
actttataataaa

SEQ ID NO: 68415 - DNA, 9 bp, Unknown
  misc_feature (1)..( 9): Matrix.004 file - promoters50/1395534
gcaaagaaa

SEQ ID NO: 68416 - DNA, 6 bp, Unknown
  misc_feature (1)..( 6): Matrix.004 file - promoters50/1395534
ttttca

SEQ ID NO: 68417 - DNA, 8 bp, Unknown
  misc_feature (1)..( 8): Matrix.004 file - promoters50/1395568
actccatt

SEQ ID NO: 68418 - DNA, 10 bp, Unknown
  misc_feature (1)..( 10): Matrix.004 file - promoters50/1395605
aaatgttttt

SEQ ID NO: 68419 - DNA, 7 bp, Unknown
  misc_feature (1)..( 7): Matrix.004 file - promoters50/1395605
gatataa

SEQ ID NO: 68420 - DNA, 8 bp, Unknown
  misc_feature (1)..( 8): Matrix.004 file - promoters50/1395605
tgaaccac

SEQ ID NO: 68421 - DNA, 9 bp, Unknown
  misc_feature (1)..( 9): Matrix.004 file - promoters50/1395605
cataaaatt

SEQ ID NO: 68422 - DNA, 11 bp, Unknown
  misc_feature (1)..( 11): Matrix.004 file - promoters50/1395605
attctcttatt

SEQ ID NO: 68423 - DNA, 7 bp, Unknown
  misc_feature (1)..( 7): Matrix.004 file - promoters50/1395728
aatatat

SEQ ID NO: 68424 - DNA, 10 bp, Unknown
  misc_feature (1)..( 10): Matrix.004 file - promoters50/1395781
cctttgagaa

SEQ ID NO: 68425 - DNA, 12 bp, Unknown
  misc_feature (1)..( 12): Matrix.004 file - promoters50/1395781
taattacaagaa

SEQ ID NO: 68426 - DNA, 9 bp, Unknown
  misc_feature (1)..( 9): Matrix.004 file - promoters50/1395790
catttttgt

SEQ ID NO: 68427 - DNA, 8 bp, Unknown
  misc_feature (1)..( 8): Matrix.004 file - promoters50/1395790
aacaatga

SEQ ID NO: 68428 - DNA, 9 bp, Unknown
  misc_feature (1)..( 9): Matrix.004 file - promoters50/1395806
gtattgttg

SEQ ID NO: 68429 - DNA, 8 bp, Unknown
  misc_feature (1)..( 8): Matrix.004 file - promoters50/1395806
acaaaaga

SEQ ID NO: 68430 - DNA, 12 bp, Unknown
  misc_feature (1)..( 12): Matrix.004 file - promoters50/1395806
atagaaacaaaa

SEQ ID NO: 68431 - DNA, 9 bp, Unknown
  misc_feature (1)..( 9): Matrix.004 file - promoters50/1395806
aaaatgaat

SEQ ID NO: 68432 - DNA, 11 bp, Unknown
  misc_feature (1)..( 11): Matrix.004 file - promoters50/1395824
attttaaaagc

SEQ ID NO: 68433 - DNA, 10 bp, Unknown
  misc_feature (1)..( 10): Matrix.004 file - promoters50/1395824
tacaaacata

SEQ ID NO: 68434 - DNA, 12 bp, Unknown
  misc_feature (1)..( 12): Matrix.004 file - promoters50/1395824
agaataagcaaa

SEQ ID NO: 68435 - DNA, 13 bp, Unknown
  misc_feature (1)..( 13): Matrix.004 file - promoters50/1395824
aattttaaaaatc

SEQ ID NO: 68436 - DNA, 12 bp, Unknown
  misc_feature (1)..( 12): Matrix.004 file - promoters50/1395828
aagcaataaacg

SEQ ID NO: 68437 - DNA, 9 bp, Unknown
  misc_feature (1)..( 9): Matrix.004 file - promoters50/1395828
gaaccaaac

SEQ ID NO: 68438 - DNA, 10 bp, Unknown
  misc_feature (1)..( 10): Matrix.004 file - promoters50/1395836
aaccaacaat

SEQ ID NO: 68439 - DNA, 7 bp, Unknown
  misc_feature (1)..( 7): Matrix.004 file - promoters50/1395836
attacat

SEQ ID NO: 68440 - DNA, 7 bp, Unknown
  misc_feature (1)..( 7): Matrix.004 file - promoters50/1395836
attcgaa

SEQ ID NO: 68441 - DNA, 10 bp, Unknown
  misc_feature (1)..( 10): Matrix.004 file - promoters50/1395836
ttgaagatta

SEQ ID NO: 68442 - DNA, 7 bp, Unknown
  misc_feature (1)..( 7): Matrix.004 file - promoters50/1395836
aaagcgg

SEQ ID NO: 68443 - DNA, 10 bp, Unknown
  misc_feature (1)..( 10): Matrix.004 file - promoters50/1395839
gagaaaatgg

SEQ ID NO: 68444 - DNA, 8 bp, Unknown
  misc_feature (1)..( 8): Matrix.004 file - promoters50/1395972
agttgatt

SEQ ID NO: 68445 - DNA, 10 bp, Unknown
  misc_feature (1)..( 10): Matrix.004 file - promoters50/1395972
ctcaaaaaat

SEQ ID NO: 68446 - DNA, 9 bp, Unknown
  misc_feature (1)..( 9): Matrix.004 file - promoters50/1396022
aacagaaac

SEQ ID NO: 68447 - DNA, 9 bp, Unknown
  misc_feature (1)..( 9): Matrix.004 file - promoters50/1396022
ttgttgttg

SEQ ID NO: 68448 - DNA, 9 bp, Unknown
  misc_feature (1)..( 9): Matrix.004 file - promoters50/1396022
ttaaagtcg

SEQ ID NO: 68449 - DNA, 9 bp, Unknown
  misc_feature (1)..( 9): Matrix.004 file - promoters50/1396022
cttgtttaa

SEQ ID NO: 68450 - DNA, 9 bp, Unknown
  misc_feature (1)..( 9): Matrix.004 file - promoters50/1396057
gaaatcaaa

SEQ ID NO: 68451 - DNA, 9 bp, Unknown
  misc_feature (1)..( 9): Matrix.004 file - promoters50/1396057
tcgaataaa

SEQ ID NO: 68452 - DNA, 10 bp, Unknown
  misc_feature (1)..( 10): Matrix.004 file - promoters50/1396057
gatatttgta

SEQ ID NO: 68453 - DNA, 13 bp, Unknown
  misc_feature (1)..( 13): Matrix.004 file - promoters50/1396057
ataaaattataac

SEQ ID NO: 68454 - DNA, 12 bp, Unknown
  misc_feature (1)..( 12): Matrix.004 file - promoters50/1396085
aatttttttcta

SEQ ID NO: 68455 - DNA, 11 bp, Unknown
  misc_feature (1)..( 11): Matrix.004 file - promoters50/1396085
aaatttattct

SEQ ID NO: 68456 - DNA, 10 bp, Unknown
  misc_feature (1)..( 10): Matrix.004 file - promoters50/1396085
aaaataaact

SEQ ID NO: 68457 - DNA, 10 bp, Unknown
  misc_feature (1)..( 10): Matrix.004 file - promoters50/1396104
atttcttaat

SEQ ID NO: 68458 - DNA, 6 bp, Unknown
  misc_feature (1)..( 6): Matrix.004 file - promoters50/1396123
atcaaa

SEQ ID NO: 68459 - DNA, 7 bp, Unknown
  misc_feature (1)..( 7): Matrix.004 file - promoters50/1396123
ttattat

SEQ ID NO: 68460 - DNA, 7 bp, Unknown
  misc_feature (1)..( 7): Matrix.004 file - promoters50/1396123
tattaaa

SEQ ID NO: 68461 - DNA, 16 bp, Unknown
  misc_feature (1)..( 16): Matrix.004 file - promoters50/1396123
ttatcaaagttatatt

SEQ ID NO: 68462 - DNA, 8 bp, Unknown
  misc_feature (1)..( 8): Matrix.004 file - promoters50/1396123
aattatca

SEQ ID NO: 68463 - DNA, 12 bp, Unknown
  misc_feature (1)..( 12): Matrix.004 file - promoters50/1396123
aaaaatactttg

SEQ ID NO: 68464 - DNA, 9 bp, Unknown
  misc_feature (1)..( 9): Matrix.004 file - promoters50/1396127
attaaaatc

SEQ ID NO: 68465 - DNA, 11 bp, Unknown
  misc_feature (1)..( 11): Matrix.004 file - promoters50/1396127
ttaatattgaa

SEQ ID NO: 68466 - DNA, 7 bp, Unknown
  misc_feature (1)..( 7): Matrix.004 file - promoters50/1396147
agaaaat

SEQ ID NO: 68467 - DNA, 12 bp, Unknown
  misc_feature (1)..( 12): Matrix.004 file - promoters50/1396147
atcctaattaac

SEQ ID NO: 68468 - DNA, 9 bp, Unknown
  misc_feature (1)..( 9): Matrix.004 file - promoters50/1396147
tatattcca

SEQ ID NO: 68469 - DNA, 12 bp, Unknown
  misc_feature (1)..( 12): Matrix.004 file - promoters50/1396147
caaaaaaaaaat

SEQ ID NO: 68470 - DNA, 5 bp, Unknown
  misc_feature (1)..( 5): Matrix.004 file - promoters50/1396147
agtca

SEQ ID NO: 68471 - DNA, 14 bp, Unknown
  misc_feature (1)..( 14): Matrix.004 file - promoters50/1396147
aaactttttttaat

SEQ ID NO: 68472 - DNA, 10 bp, Unknown
  misc_feature (1)..( 10): Matrix.004 file - promoters50/1396147
aattttctag

SEQ ID NO: 68473 - DNA, 8 bp, Unknown
  misc_feature (1)..( 8): Matrix.004 file - promoters50/1396147
tttttcta

SEQ ID NO: 68474 - DNA, 9 bp, Unknown
  misc_feature (1)..( 9): Matrix.004 file - promoters50/1396151
atttttcta

SEQ ID NO: 68475 - DNA, 9 bp, Unknown
  misc_feature (1)..( 9): Matrix.004 file - promoters50/1396151
ttcaaaatt

SEQ ID NO: 68476 - DNA, 7 bp, Unknown
  misc_feature (1)..( 7): Matrix.004 file - promoters50/1396151
tatttct

SEQ ID NO: 68477 - DNA, 13 bp, Unknown
  misc_feature (1)..( 13): Matrix.004 file - promoters50/1396163
ttgaatcaaaatt

SEQ ID NO: 68478 - DNA, 7 bp, Unknown
  misc_feature (1)..( 7): Matrix.004 file - promoters50/1396182
aattaaa

SEQ ID NO: 68479 - DNA, 7 bp, Unknown
  misc_feature (1)..( 7): Matrix.004 file - promoters50/1396238
gatcgaa

SEQ ID NO: 68480 - DNA, 12 bp, Unknown
  misc_feature (1)..( 12): Matrix.004 file - promoters50/1396256
aagtcaaagaag

SEQ ID NO: 68481 - DNA, 10 bp, Unknown
  misc_feature (1)..( 10): Matrix.004 file - promoters50/1396285
aaaaatgtta

SEQ ID NO: 68482 - DNA, 10 bp, Unknown
  misc_feature (1)..( 10): Matrix.004 file - promoters50/1396285
tttttctcaa

SEQ ID NO: 68483 - DNA, 8 bp, Unknown
  misc_feature (1)..( 8): Matrix.004 file - promoters50/1396285
tatttttt

SEQ ID NO: 68484 - DNA, 7 bp, Unknown
  misc_feature (1)..( 7): Matrix.004 file - promoters50/1396285
attaaat

SEQ ID NO: 68485 - DNA, 10 bp, Unknown
  misc_feature (1)..( 10): Matrix.004 file - promoters50/1396296
tataaaatat

SEQ ID NO: 68486 - DNA, 7 bp, Unknown
  misc_feature (1)..( 7): Matrix.004 file - promoters50/1396296
gatgatt

SEQ ID NO: 68487 - DNA, 7 bp, Unknown
  misc_feature (1)..( 7): Matrix.004 file - promoters50/1396296
ttttttt

SEQ ID NO: 68488 - DNA, 7 bp, Unknown
  misc_feature (1)..( 7): Matrix.004 file - promoters50/1396308
tttgaag

SEQ ID NO: 68489 - DNA, 12 bp, Unknown
  misc_feature (1)..( 12): Matrix.004 file - promoters50/1396308
gaccaaaaatcg

SEQ ID NO: 68490 - DNA, 10 bp, Unknown
  misc_feature (1)..( 10): Matrix.004 file - promoters50/1396308
taattttgtt

SEQ ID NO: 68491 - DNA, 10 bp, Unknown
  misc_feature (1)..( 10): Matrix.004 file - promoters50/1396308
aaatttattt

SEQ ID NO: 68492 - DNA, 6 bp, Unknown
  misc_feature (1)..( 6): Matrix.004 file - promoters50/1396308
atataa

SEQ ID NO: 68493 - DNA, 10 bp, Unknown
  misc_feature (1)..( 10): Matrix.004 file - promoters50/1396308
tcaatcaaaa

SEQ ID NO: 68494 - DNA, 8 bp, Unknown
  misc_feature (1)..( 8): Matrix.004 file - promoters50/1396308
tgtgtaaa

SEQ ID NO: 68495 - DNA, 9 bp, Unknown
  misc_feature (1)..( 9): Matrix.004 file - promoters50/1396308
ataaaaaat

SEQ ID NO: 68496 - DNA, 11 bp, Unknown
  misc_feature (1)..( 11): Matrix.004 file - promoters50/1396312
tataatgaaat

SEQ ID NO: 68497 - DNA, 11 bp, Unknown
  misc_feature (1)..( 11): Matrix.004 file - promoters50/1396312
aaaattaaata

SEQ ID NO: 68498 - DNA, 12 bp, Unknown
  misc_feature (1)..( 12): Matrix.004 file - promoters50/1396312
attattaacatt

SEQ ID NO: 68499 - DNA, 10 bp, Unknown
  misc_feature (1)..( 10): Matrix.004 file - promoters50/1396312
aaacaaaaaa

SEQ ID NO: 68500 - DNA, 11 bp, Unknown
  misc_feature (1)..( 11): Matrix.004 file - promoters50/1396320
ttatgaaaaaa

SEQ ID NO: 68501 - DNA, 7 bp, Unknown
  misc_feature (1)..( 7): Matrix.004 file - promoters50/1396354
cttcagt

SEQ ID NO: 68502 - DNA, 9 bp, Unknown
  misc_feature (1)..( 9): Matrix.004 file - promoters50/1396364
aatatatac

SEQ ID NO: 68503 - DNA, 9 bp, Unknown
  misc_feature (1)..( 9): Matrix.004 file - promoters50/1396364
attttagtt

SEQ ID NO: 68504 - DNA, 8 bp, Unknown
  misc_feature (1)..( 8): Matrix.004 file - promoters50/1396364
tattaatg

SEQ ID NO: 68505 - DNA, 7 bp, Unknown
  misc_feature (1)..( 7): Matrix.004 file - promoters50/1396364
aatattt

SEQ ID NO: 68506 - DNA, 8 bp, Unknown
  misc_feature (1)..( 8): Matrix.004 file - promoters50/1396364
tttagttt

SEQ ID NO: 68507 - DNA, 11 bp, Unknown
  misc_feature (1)..( 11): Matrix.004 file - promoters50/1396383
tacgtaacaat

SEQ ID NO: 68508 - DNA, 9 bp, Unknown
  misc_feature (1)..( 9): Matrix.004 file - promoters50/1396399
gttaattta

SEQ ID NO: 68509 - DNA, 8 bp, Unknown
  misc_feature (1)..( 8): Matrix.004 file - promoters50/1396407
taatgaat

SEQ ID NO: 68510 - DNA, 11 bp, Unknown
  misc_feature (1)..( 11): Matrix.004 file - promoters50/1396425
gaaagaaacaa

SEQ ID NO: 68511 - DNA, 10 bp, Unknown
  misc_feature (1)..( 10): Matrix.004 file - promoters50/1396425
ttgaatttga

SEQ ID NO: 68512 - DNA, 7 bp, Unknown
  misc_feature (1)..( 7): Matrix.004 file - promoters50/1396425
agtgact

SEQ ID NO: 68513 - DNA, 7 bp, Unknown
  misc_feature (1)..( 7): Matrix.004 file - promoters50/1396425
ataaaat

SEQ ID NO: 68514 - DNA, 9 bp, Unknown
  misc_feature (1)..( 9): Matrix.004 file - promoters50/1396425
ttgaatttg

SEQ ID NO: 68515 - DNA, 7 bp, Unknown
  misc_feature (1)..( 7): Matrix.004 file - promoters50/1396425
caccatt

SEQ ID NO: 68516 - DNA, 8 bp, Unknown
  misc_feature (1)..( 8): Matrix.004 file - promoters50/1396462
taattctt

SEQ ID NO: 68517 - DNA, 10 bp, Unknown
  misc_feature (1)..( 10): Matrix.004 file - promoters50/1396462
taaaaagtaa

SEQ ID NO: 68518 - DNA, 10 bp, Unknown
  misc_feature (1)..( 10): Matrix.004 file - promoters50/1396462
aaacaaattt

SEQ ID NO: 68519 - DNA, 9 bp, Unknown
  misc_feature (1)..( 9): Matrix.004 file - promoters50/1396462
ttttgaaaa

SEQ ID NO: 68520 - DNA, 10 bp, Unknown
  misc_feature (1)..( 10): Matrix.004 file - promoters50/1396462
ggaaaagaaa

SEQ ID NO: 68521 - DNA, 11 bp, Unknown
  misc_feature (1)..( 11): Matrix.004 file - promoters50/1396462
aaaataaaata

SEQ ID NO: 68522 - DNA, 9 bp, Unknown
  misc_feature (1)..( 9): Matrix.004 file - promoters50/1396469
aaaaggaaa

SEQ ID NO: 68523 - DNA, 14 bp, Unknown
  misc_feature (1)..( 14): Matrix.004 file - promoters50/1396469
ttttatatagatta

SEQ ID NO: 68524 - DNA, 11 bp, Unknown
  misc_feature (1)..( 11): Matrix.004 file - promoters50/1396469
actcatatata

SEQ ID NO: 68525 - DNA, 11 bp, Unknown
  misc_feature (1)..( 11): Matrix.004 file - promoters50/1396469
tcatatatata

SEQ ID NO: 68526 - DNA, 15 bp, Unknown
  misc_feature (1)..( 15): Matrix.004 file - promoters50/1396469
acaaacttttattcc

SEQ ID NO: 68527 - DNA, 9 bp, Unknown
  misc_feature (1)..( 9): Matrix.004 file - promoters50/1396482
ccaactaaa

SEQ ID NO: 68528 - DNA, 9 bp, Unknown
  misc_feature (1)..( 9): Matrix.004 file - promoters50/1396519
aaaacaaaa

SEQ ID NO: 68529 - DNA, 7 bp, Unknown
  misc_feature (1)..( 7): Matrix.004 file - promoters50/1396519
atataaa

SEQ ID NO: 68530 - DNA, 7 bp, Unknown
  misc_feature (1)..( 7): Matrix.004 file - promoters50/1396519
aaaattt

SEQ ID NO: 68531 - DNA, 10 bp, Unknown
  misc_feature (1)..( 10): Matrix.004 file - promoters50/1396519
ctaaaatatc

SEQ ID NO: 68532 - DNA, 13 bp, Unknown
  misc_feature (1)..( 13): Matrix.004 file - promoters50/1396539
acatttttagata

SEQ ID NO: 68533 - DNA, 9 bp, Unknown
  misc_feature (1)..( 9): Matrix.004 file - promoters50/1396665
ttcttcagt

SEQ ID NO: 68534 - DNA, 9 bp, Unknown
  misc_feature (1)..( 9): Matrix.004 file - promoters50/1396665
aattatttt

SEQ ID NO: 68535 - DNA, 7 bp, Unknown
  misc_feature (1)..( 7): Matrix.004 file - promoters50/1396721
aaaaact

SEQ ID NO: 68536 - DNA, 10 bp, Unknown
  misc_feature (1)..( 10): Matrix.004 file - promoters50/1396721
tgagaattga

SEQ ID NO: 68537 - DNA, 11 bp, Unknown
  misc_feature (1)..( 11): Matrix.004 file - promoters50/1396767
catgactacat

SEQ ID NO: 68538 - DNA, 9 bp, Unknown
  misc_feature (1)..( 9): Matrix.004 file - promoters50/1396767
caaactaaa

SEQ ID NO: 68539 - DNA, 8 bp, Unknown
  misc_feature (1)..( 8): Matrix.004 file - promoters50/1396816
cttacaaa

SEQ ID NO: 68540 - DNA, 11 bp, Unknown
  misc_feature (1)..( 11): Matrix.004 file - promoters50/1396816
tatctcacaat

SEQ ID NO: 68541 - DNA, 4 bp, Unknown
  misc_feature (1)..( 4): Matrix.004 file - promoters50/1396816
gata

SEQ ID NO: 68542 - DNA, 11 bp, Unknown
  misc_feature (1)..( 11): Matrix.004 file - promoters50/1396877
aatgaaattta

SEQ ID NO: 68543 - DNA, 15 bp, Unknown
  misc_feature (1)..( 15): Matrix.004 file - promoters50/1396877
tctctctagttaggt

SEQ ID NO: 68544 - DNA, 7 bp, Unknown
  misc_feature (1)..( 7): Matrix.004 file - promoters50/1396877
caaatca

SEQ ID NO: 68545 - DNA, 11 bp, Unknown
  misc_feature (1)..( 11): Matrix.004 file - promoters50/1396877
tctgcagattt

SEQ ID NO: 68546 - DNA, 8 bp, Unknown
  misc_feature (1)..( 8): Matrix.004 file - promoters50/1396885
aatacaat

SEQ ID NO: 68547 - DNA, 9 bp, Unknown
  misc_feature (1)..( 9): Matrix.004 file - promoters50/1396989
atgattcct

SEQ ID NO: 68548 - DNA, 11 bp, Unknown
  misc_feature (1)..( 11): Matrix.004 file - promoters50/1397029
tgcaaaaccaa

SEQ ID NO: 68549 - DNA, 10 bp, Unknown
  misc_feature (1)..( 10): Matrix.004 file - promoters50/1397029
ttttgatttg

SEQ ID NO: 68550 - DNA, 12 bp, Unknown
  misc_feature (1)..( 12): Matrix.004 file - promoters50/1397029
aacttttaagta

SEQ ID NO: 68551 - DNA, 9 bp, Unknown
  misc_feature (1)..( 9): Matrix.004 file - promoters50/1397029
taatcgttt

SEQ ID NO: 68552 - DNA, 7 bp, Unknown
  misc_feature (1)..( 7): Matrix.004 file - promoters50/1397029
ttttagt

SEQ ID NO: 68553 - DNA, 12 bp, Unknown
  misc_feature (1)..( 12): Matrix.004 file - promoters50/1397033
aacctttatgta

SEQ ID NO: 68554 - DNA, 9 bp, Unknown
  misc_feature (1)..( 9): Matrix.004 file - promoters50/1397033
caatagaaa

SEQ ID NO: 68555 - DNA, 9 bp, Unknown
  misc_feature (1)..( 9): Matrix.004 file - promoters50/1397033
tacattttc

SEQ ID NO: 68556 - DNA, 7 bp, Unknown
  misc_feature (1)..( 7): Matrix.004 file - promoters50/1397080
atttttt

SEQ ID NO: 68557 - DNA, 11 bp, Unknown
  misc_feature (1)..( 11): Matrix.004 file - promoters50/1397125
gaaaaacgaat

SEQ ID NO: 68558 - DNA, 12 bp, Unknown
  misc_feature (1)..( 12): Matrix.004 file - promoters50/1397125
cagttaacttta

SEQ ID NO: 68559 - DNA, 9 bp, Unknown
  misc_feature (1)..( 9): Matrix.004 file - promoters50/1397125
gtaaacttt

SEQ ID NO: 68560 - DNA, 9 bp, Unknown
  misc_feature (1)..( 9): Matrix.004 file - promoters50/1397125
taatatttc

SEQ ID NO: 68561 - DNA, 8 bp, Unknown
  misc_feature (1)..( 8): Matrix.004 file - promoters50/1397178
taaaaaaa

SEQ ID NO: 68562 - DNA, 12 bp, Unknown
  misc_feature (1)..( 12): Matrix.004 file - promoters50/1397178
aatttttttcta

SEQ ID NO: 68563 - DNA, 7 bp, Unknown
  misc_feature (1)..( 7): Matrix.004 file - promoters50/1397178
atgtttt

SEQ ID NO: 68564 - DNA, 10 bp, Unknown
  misc_feature (1)..( 10): Matrix.004 file - promoters50/1397178
aaaaatttaa

SEQ ID NO: 68565 - DNA, 8 bp, Unknown
  misc_feature (1)..( 8): Matrix.004 file - promoters50/1397178
caatttaa

SEQ ID NO: 68566 - DNA, 9 bp, Unknown
  misc_feature (1)..( 9): Matrix.004 file - promoters50/1397178
ggtatttga

SEQ ID NO: 68567 - DNA, 10 bp, Unknown
  misc_feature (1)..( 10): Matrix.004 file - promoters50/1397178
ttataattat

SEQ ID NO: 68568 - DNA, 12 bp, Unknown
  misc_feature (1)..( 12): Matrix.004 file - promoters50/1397178
aataaaaatcat

SEQ ID NO: 68569 - DNA, 13 bp, Unknown
  misc_feature (1)..( 13): Matrix.004 file - promoters50/1397178
ataaaattataac

SEQ ID NO: 68570 - DNA, 9 bp, Unknown
  misc_feature (1)..( 9): Matrix.004 file - promoters50/1397178
tcatataaa

SEQ ID NO: 68571 - DNA, 8 bp, Unknown
  misc_feature (1)..( 8): Matrix.004 file - promoters50/1397178
attttttt

SEQ ID NO: 68572 - DNA, 10 bp, Unknown
  misc_feature (1)..( 10): Matrix.004 file - promoters50/1397178
cttaaatatt

SEQ ID NO: 68573 - DNA, 9 bp, Unknown
  misc_feature (1)..( 9): Matrix.004 file - promoters50/1397178
aataattat

SEQ ID NO: 68574 - DNA, 14 bp, Unknown
  misc_feature (1)..( 14): Matrix.004 file - promoters50/1397195
attgattcaatatt

SEQ ID NO: 68575 - DNA, 10 bp, Unknown
  misc_feature (1)..( 10): Matrix.004 file - promoters50/1397195
aattcgaagc

SEQ ID NO: 68576 - DNA, 8 bp, Unknown
  misc_feature (1)..( 8): Matrix.004 file - promoters50/1397203
ttttagta

SEQ ID NO: 68577 - DNA, 12 bp, Unknown
  misc_feature (1)..( 12): Matrix.004 file - promoters50/1397231
aaaaaaaaacta

SEQ ID NO: 68578 - DNA, 11 bp, Unknown
  misc_feature (1)..( 11): Matrix.004 file - promoters50/1397251
aaacaaaatat

SEQ ID NO: 68579 - DNA, 10 bp, Unknown
  misc_feature (1)..( 10): Matrix.004 file - promoters50/1397251
acataagata

SEQ ID NO: 68580 - DNA, 9 bp, Unknown
  misc_feature (1)..( 9): Matrix.004 file - promoters50/1397263
gccaataga

SEQ ID NO: 68581 - DNA, 10 bp, Unknown
  misc_feature (1)..( 10): Matrix.004 file - promoters50/1397263
acaaaccaaa

SEQ ID NO: 68582 - DNA, 8 bp, Unknown
  misc_feature (1)..( 8): Matrix.004 file - promoters50/1397332
ataataaa

SEQ ID NO: 68583 - DNA, 11 bp, Unknown
  misc_feature (1)..( 11): Matrix.004 file - promoters50/1397350
ccctctaaacc

SEQ ID NO: 68584 - DNA, 13 bp, Unknown
  misc_feature (1)..( 13): Matrix.004 file - promoters50/1397350
gtctcatggattc

SEQ ID NO: 68585 - DNA, 11 bp, Unknown
  misc_feature (1)..( 11): Matrix.004 file - promoters50/1397350
aaaattaaaaa

SEQ ID NO: 68586 - DNA, 9 bp, Unknown
  misc_feature (1)..( 9): Matrix.004 file - promoters50/1397425
aataaaata

SEQ ID NO: 68587 - DNA, 8 bp, Unknown
  misc_feature (1)..( 8): Matrix.004 file - promoters50/1397425
tcataatt

SEQ ID NO: 68588 - DNA, 8 bp, Unknown
  misc_feature (1)..( 8): Matrix.004 file - promoters50/1397445
atatgtaa

SEQ ID NO: 68589 - DNA, 7 bp, Unknown
  misc_feature (1)..( 7): Matrix.004 file - promoters50/1397445
tcaaaat

SEQ ID NO: 68590 - DNA, 7 bp, Unknown
  misc_feature (1)..( 7): Matrix.004 file - promoters50/1397461
acaaaac

SEQ ID NO: 68591 - DNA, 11 bp, Unknown
  misc_feature (1)..( 11): Matrix.004 file - promoters50/1397461
atcaaagaata

SEQ ID NO: 68592 - DNA, 11 bp, Unknown
  misc_feature (1)..( 11): Matrix.004 file - promoters50/1397461
cgcaaaacatc

SEQ ID NO: 68593 - DNA, 12 bp, Unknown
  misc_feature (1)..( 12): Matrix.004 file - promoters50/1397461
aaacaaaaaatg

SEQ ID NO: 68594 - DNA, 8 bp, Unknown
  misc_feature (1)..( 8): Matrix.004 file - promoters50/1397461
atattaaa

SEQ ID NO: 68595 - DNA, 18 bp, Unknown
  misc_feature (1)..( 18): Matrix.004 file - promoters50/1397500
aaacaacttattaatata

SEQ ID NO: 68596 - DNA, 13 bp, Unknown
  misc_feature (1)..( 13): Matrix.004 file - promoters50/1397500
agtgctaacctat

SEQ ID NO: 68597 - DNA, 10 bp, Unknown
  misc_feature (1)..( 10): Matrix.004 file - promoters50/1397500
aaccaatctt

SEQ ID NO: 68598 - DNA, 12 bp, Unknown
  misc_feature (1)..( 12): Matrix.004 file - promoters50/1397500
aatagaaaaata

SEQ ID NO: 68599 - DNA, 8 bp, Unknown
  misc_feature (1)..( 8): Matrix.004 file - promoters50/1397500
attattat

SEQ ID NO: 68600 - DNA, 10 bp, Unknown
  misc_feature (1)..( 10): Matrix.004 file - promoters50/1397546
aagatttaca

SEQ ID NO: 68601 - DNA, 8 bp, Unknown
  misc_feature (1)..( 8): Matrix.004 file - promoters50/1397568
agagttaa

SEQ ID NO: 68602 - DNA, 10 bp, Unknown
  misc_feature (1)..( 10): Matrix.004 file - promoters50/1397568
caatttaaga

SEQ ID NO: 68603 - DNA, 9 bp, Unknown
  misc_feature (1)..( 9): Matrix.004 file - promoters50/1397568
attttgacg

SEQ ID NO: 68604 - DNA, 9 bp, Unknown
  misc_feature (1)..( 9): Matrix.004 file - promoters50/1397582
ttttaaaat

SEQ ID NO: 68605 - DNA, 9 bp, Unknown
  misc_feature (1)..( 9): Matrix.004 file - promoters50/1397594
ctaaatttc

SEQ ID NO: 68606 - DNA, 10 bp, Unknown
  misc_feature (1)..( 10): Matrix.004 file - promoters50/1397594
gaataattta

SEQ ID NO: 68607 - DNA, 11 bp, Unknown
  misc_feature (1)..( 11): Matrix.004 file - promoters50/1397594
cctcggtgtag

SEQ ID NO: 68608 - DNA, 8 bp, Unknown
  misc_feature (1)..( 8): Matrix.004 file - promoters50/1397594
atttcttt

SEQ ID NO: 68609 - DNA, 9 bp, Unknown
  misc_feature (1)..( 9): Matrix.004 file - promoters50/1397700
atttttgtt

SEQ ID NO: 68610 - DNA, 9 bp, Unknown
  misc_feature (1)..( 9): Matrix.004 file - promoters50/1397700
atgataaaa

SEQ ID NO: 68611 - DNA, 11 bp, Unknown
  misc_feature (1)..( 11): Matrix.004 file - promoters50/1397700
aaaaacaaaag

SEQ ID NO: 68612 - DNA, 11 bp, Unknown
  misc_feature (1)..( 11): Matrix.004 file - promoters50/1397717
ttaccttatta

SEQ ID NO: 68613 - DNA, 10 bp, Unknown
  misc_feature (1)..( 10): Matrix.004 file - promoters50/1397717
caaaaataag

SEQ ID NO: 68614 - DNA, 8 bp, Unknown
  misc_feature (1)..( 8): Matrix.004 file - promoters50/1397717
aagaaaaa

SEQ ID NO: 68615 - DNA, 8 bp, Unknown
  misc_feature (1)..( 8): Matrix.004 file - promoters50/1397753
aaaaataa

SEQ ID NO: 68616 - DNA, 10 bp, Unknown
  misc_feature (1)..( 10): Matrix.004 file - promoters50/1397753
tctaaaataa

SEQ ID NO: 68617 - DNA, 15 bp, Unknown
  misc_feature (1)..( 15): Matrix.004 file - promoters50/1397753
tatgattttgtggtc

SEQ ID NO: 68618 - DNA, 12 bp, Unknown
  misc_feature (1)..( 12): Matrix.004 file - promoters50/1397821
agttaataaata

SEQ ID NO: 68619 - DNA, 10 bp, Unknown
  misc_feature (1)..( 10): Matrix.004 file - promoters50/1397821
gaattgattt

SEQ ID NO: 68620 - DNA, 11 bp, Unknown
  misc_feature (1)..( 11): Matrix.004 file - promoters50/1397821
tcaagtttgat

SEQ ID NO: 68621 - DNA, 9 bp, Unknown
  misc_feature (1)..( 9): Matrix.004 file - promoters50/1397852
aaaacattt

SEQ ID NO: 68622 - DNA, 13 bp, Unknown
  misc_feature (1)..( 13): Matrix.004 file - promoters50/1397852
aaaaaataaactg

SEQ ID NO: 68623 - DNA, 12 bp, Unknown
  misc_feature (1)..( 12): Matrix.004 file - promoters50/1397867
tacaaaaaaaac

SEQ ID NO: 68624 - DNA, 12 bp, Unknown
  misc_feature (1)..( 12): Matrix.004 file - promoters50/1397898
atgggattcttt

SEQ ID NO: 68625 - DNA, 8 bp, Unknown
  misc_feature (1)..( 8): Matrix.004 file - promoters50/1397898
gaatgata

SEQ ID NO: 68626 - DNA, 13 bp, Unknown
  misc_feature (1)..( 13): Matrix.004 file - promoters50/1397923
aatgattatatga

SEQ ID NO: 68627 - DNA, 10 bp, Unknown
  misc_feature (1)..( 10): Matrix.004 file - promoters50/1397923
tcattttata

SEQ ID NO: 68628 - DNA, 9 bp, Unknown
  misc_feature (1)..( 9): Matrix.004 file - promoters50/1397923
ttagatata

SEQ ID NO: 68629 - DNA, 10 bp, Unknown
  misc_feature (1)..( 10): Matrix.004 file - promoters50/1397923
ttttttgaag

SEQ ID NO: 68630 - DNA, 13 bp, Unknown
  misc_feature (1)..( 13): Matrix.004 file - promoters50/1397923
gaaataaaaaatg

SEQ ID NO: 68631 - DNA, 14 bp, Unknown
  misc_feature (1)..( 14): Matrix.004 file - promoters50/1397923
ataataattttatt

SEQ ID NO: 68632 - DNA, 11 bp, Unknown
  misc_feature (1)..( 11): Matrix.004 file - promoters50/1398069
atatttgtaaa

SEQ ID NO: 68633 - DNA, 8 bp, Unknown
  misc_feature (1)..( 8): Matrix.004 file - promoters50/1398069
caactttt

SEQ ID NO: 68634 - DNA, 8 bp, Unknown
  misc_feature (1)..( 8): Matrix.004 file - promoters50/1398069
atatcaga

SEQ ID NO: 68635 - DNA, 8 bp, Unknown
  misc_feature (1)..( 8): Matrix.004 file - promoters50/1398069
aataattg

SEQ ID NO: 68636 - DNA, 9 bp, Unknown
  misc_feature (1)..( 9): Matrix.004 file - promoters50/1398069
caaaatcca

SEQ ID NO: 68637 - DNA, 8 bp, Unknown
  misc_feature (1)..( 8): Matrix.004 file - promoters50/1398081
aacaaaat

SEQ ID NO: 68638 - DNA, 8 bp, Unknown
  misc_feature (1)..( 8): Matrix.004 file - promoters50/1398081
ttatatca

SEQ ID NO: 68639 - DNA, 8 bp, Unknown
  misc_feature (1)..( 8): Matrix.004 file - promoters50/1398081
agataagt

SEQ ID NO: 68640 - DNA, 6 bp, Unknown
  misc_feature (1)..( 6): Matrix.004 file - promoters50/1398081
agtaaa

SEQ ID NO: 68641 - DNA, 13 bp, Unknown
  misc_feature (1)..( 13): Matrix.004 file - promoters50/1398081
caataaaatttgg

SEQ ID NO: 68642 - DNA, 13 bp, Unknown
  misc_feature (1)..( 13): Matrix.004 file - promoters50/1398081
ataggatatcttt

SEQ ID NO: 68643 - DNA, 9 bp, Unknown
  misc_feature (1)..( 9): Matrix.004 file - promoters50/1398114
ttaaataaa

SEQ ID NO: 68644 - DNA, 9 bp, Unknown
  misc_feature (1)..( 9): Matrix.004 file - promoters50/1398114
aaagagatg

SEQ ID NO: 68645 - DNA, 13 bp, Unknown
  misc_feature (1)..( 13): Matrix.004 file - promoters50/1398124
ttacacaaatata

SEQ ID NO: 68646 - DNA, 7 bp, Unknown
  misc_feature (1)..( 7): Matrix.004 file - promoters50/1398226
atattat

SEQ ID NO: 68647 - DNA, 10 bp, Unknown
  misc_feature (1)..( 10): Matrix.004 file - promoters50/1398337
aaattcttgg

SEQ ID NO: 68648 - DNA, 11 bp, Unknown
  misc_feature (1)..( 11): Matrix.004 file - promoters50/1398337
gaaacaaaaac

SEQ ID NO: 68649 - DNA, 10 bp, Unknown
  misc_feature (1)..( 10): Matrix.004 file - promoters50/1398337
tgtaatcggg

SEQ ID NO: 68650 - DNA, 8 bp, Unknown
  misc_feature (1)..( 8): Matrix.004 file - promoters50/1398345
ggtgttgt

SEQ ID NO: 68651 - DNA, 8 bp, Unknown
  misc_feature (1)..( 8): Matrix.004 file - promoters50/1398345
aaaaatat

SEQ ID NO: 68652 - DNA, 9 bp, Unknown
  misc_feature (1)..( 9): Matrix.004 file - promoters50/1398345
ataaaagta

SEQ ID NO: 68653 - DNA, 9 bp, Unknown
  misc_feature (1)..( 9): Matrix.004 file - promoters50/1398345
agattacaa

SEQ ID NO: 68654 - DNA, 15 bp, Unknown
  misc_feature (1)..( 15): Matrix.004 file - promoters50/1398345
aataagaaaaataaa

SEQ ID NO: 68655 - DNA, 16 bp, Unknown
  misc_feature (1)..( 16): Matrix.004 file - promoters50/1398345
aaaatattataataaa

SEQ ID NO: 68656 - DNA, 13 bp, Unknown
  misc_feature (1)..( 13): Matrix.004 file - promoters50/1398401
attaaaaattaaa

SEQ ID NO: 68657 - DNA, 9 bp, Unknown
  misc_feature (1)..( 9): Matrix.004 file - promoters50/1398401
gaaattgct

SEQ ID NO: 68658 - DNA, 13 bp, Unknown
  misc_feature (1)..( 13): Matrix.004 file - promoters50/1398409
atattatcaaaag

SEQ ID NO: 68659 - DNA, 8 bp, Unknown
  misc_feature (1)..( 8): Matrix.004 file - promoters50/1398409
aaaataat

SEQ ID NO: 68660 - DNA, 9 bp, Unknown
  misc_feature (1)..( 9): Matrix.004 file - promoters50/1398409
aagcttaca

SEQ ID NO: 68661 - DNA, 8 bp, Unknown
  misc_feature (1)..( 8): Matrix.004 file - promoters50/1398409
ctaagaaa

SEQ ID NO: 68662 - DNA, 10 bp, Unknown
  misc_feature (1)..( 10): Matrix.004 file - promoters50/1398409
taaactaaag

SEQ ID NO: 68663 - DNA, 10 bp, Unknown
  misc_feature (1)..( 10): Matrix.004 file - promoters50/1398409
atcacatttt

SEQ ID NO: 68664 - DNA, 9 bp, Unknown
  misc_feature (1)..( 9): Matrix.004 file - promoters50/1398409
agtatatta

SEQ ID NO: 68665 - DNA, 11 bp, Unknown
  misc_feature (1)..( 11): Matrix.004 file - promoters50/1398413
atataaagaaa

SEQ ID NO: 68666 - DNA, 8 bp, Unknown
  misc_feature (1)..( 8): Matrix.004 file - promoters50/1398413
taaaatca

SEQ ID NO: 68667 - DNA, 8 bp, Unknown
  misc_feature (1)..( 8): Matrix.004 file - promoters50/1398431
tcaatatt

SEQ ID NO: 68668 - DNA, 8 bp, Unknown
  misc_feature (1)..( 8): Matrix.004 file - promoters50/1398431
aaattaaa

SEQ ID NO: 68669 - DNA, 7 bp, Unknown
  misc_feature (1)..( 7): Matrix.004 file - promoters50/1398444
aaaatta

SEQ ID NO: 68670 - DNA, 13 bp, Unknown
  misc_feature (1)..( 13): Matrix.004 file - promoters50/1398444
aaaaaaaataact

SEQ ID NO: 68671 - DNA, 9 bp, Unknown
  misc_feature (1)..( 9): Matrix.004 file - promoters50/1398444
attgaagct

SEQ ID NO: 68672 - DNA, 10 bp, Unknown
  misc_feature (1)..( 10): Matrix.004 file - promoters50/1398444
gattaaaatg

SEQ ID NO: 68673 - DNA, 8 bp, Unknown
  misc_feature (1)..( 8): Matrix.004 file - promoters50/1398444
tctaattt

SEQ ID NO: 68674 - DNA, 7 bp, Unknown
  misc_feature (1)..( 7): Matrix.004 file - promoters50/1398444
tatgatt

SEQ ID NO: 68675 - DNA, 9 bp, Unknown
  misc_feature (1)..( 9): Matrix.004 file - promoters50/1398444
gaaacaaag

SEQ ID NO: 68676 - DNA, 11 bp, Unknown
  misc_feature (1)..( 11): Matrix.004 file - promoters50/1398444
aaactataaat

SEQ ID NO: 68677 - DNA, 7 bp, Unknown
  misc_feature (1)..( 7): Matrix.004 file - promoters50/1398451
ggattga

SEQ ID NO: 68678 - DNA, 7 bp, Unknown
  misc_feature (1)..( 7): Matrix.004 file - promoters50/1398451
aactaat

SEQ ID NO: 68679 - DNA, 9 bp, Unknown
  misc_feature (1)..( 9): Matrix.004 file - promoters50/1398451
tcataattt

SEQ ID NO: 68680 - DNA, 8 bp, Unknown
  misc_feature (1)..( 8): Matrix.004 file - promoters50/1398451
taaatata

SEQ ID NO: 68681 - DNA, 9 bp, Unknown
  misc_feature (1)..( 9): Matrix.004 file - promoters50/1398504
tattatttc

SEQ ID NO: 68682 - DNA, 9 bp, Unknown
  misc_feature (1)..( 9): Matrix.004 file - promoters50/1398504
ggaaagaag

SEQ ID NO: 68683 - DNA, 8 bp, Unknown
  misc_feature (1)..( 8): Matrix.004 file - promoters50/1398545
tcgaagaa

SEQ ID NO: 68684 - DNA, 13 bp, Unknown
  misc_feature (1)..( 13): Matrix.004 file - promoters50/1398545
taaaaaagttcaa

SEQ ID NO: 68685 - DNA, 7 bp, Unknown
  misc_feature (1)..( 7): Matrix.004 file - promoters50/1398545
ttaataa

SEQ ID NO: 68686 - DNA, 12 bp, Unknown
  misc_feature (1)..( 12): Matrix.004 file - promoters50/1398545
aaaataaataca

SEQ ID NO: 68687 - DNA, 9 bp, Unknown
  misc_feature (1)..( 9): Matrix.004 file - promoters50/1398545
attttggtt

SEQ ID NO: 68688 - DNA, 14 bp, Unknown
  misc_feature (1)..( 14): Matrix.004 file - promoters50/1398558
ctaaaggcccaata

SEQ ID NO: 68689 - DNA, 11 bp, Unknown
  misc_feature (1)..( 11): Matrix.004 file - promoters50/1398558
tcaaaaagtaa

SEQ ID NO: 68690 - DNA, 9 bp, Unknown
  misc_feature (1)..( 9): Matrix.004 file - promoters50/1398565
aacaatcaa

SEQ ID NO: 68691 - DNA, 11 bp, Unknown
  misc_feature (1)..( 11): Matrix.004 file - promoters50/1398565
atataaaaaat

SEQ ID NO: 68692 - DNA, 11 bp, Unknown
  misc_feature (1)..( 11): Matrix.004 file - promoters50/1398573
tatatataaaa

SEQ ID NO: 68693 - DNA, 16 bp, Unknown
  misc_feature (1)..( 16): Matrix.004 file - promoters50/1398573
gaaaaaaaatcttaaa

SEQ ID NO: 68694 - DNA, 13 bp, Unknown
  misc_feature (1)..( 13): Matrix.004 file - promoters50/1398638
aaatattcttaat

SEQ ID NO: 68695 - DNA, 7 bp, Unknown
  misc_feature (1)..( 7): Matrix.004 file - promoters50/1398638
atgattt

SEQ ID NO: 68696 - DNA, 9 bp, Unknown
  misc_feature (1)..( 9): Matrix.004 file - promoters50/1398638
taaattttc

SEQ ID NO: 68697 - DNA, 7 bp, Unknown
  misc_feature (1)..( 7): Matrix.004 file - promoters50/1398704
catttat

SEQ ID NO: 68698 - DNA, 9 bp, Unknown
  misc_feature (1)..( 9): Matrix.004 file - promoters50/1398704
accgttcat

SEQ ID NO: 68699 - DNA, 9 bp, Unknown
  misc_feature (1)..( 9): Matrix.004 file - promoters50/1398704
aaatatata

SEQ ID NO: 68700 - DNA, 9 bp, Unknown
  misc_feature (1)..( 9): Matrix.004 file - promoters50/1398704
tttttttgt

SEQ ID NO: 68701 - DNA, 14 bp, Unknown
  misc_feature (1)..( 14): Matrix.004 file - promoters50/1398704
attgttttttttgt

SEQ ID NO: 68702 - DNA, 12 bp, Unknown
  misc_feature (1)..( 12): Matrix.004 file - promoters50/1398704
tcaaaaacaaaa

SEQ ID NO: 68703 - DNA, 9 bp, Unknown
  misc_feature (1)..( 9): Matrix.004 file - promoters50/1398704
aatgaactt

SEQ ID NO: 68704 - DNA, 9 bp, Unknown
  misc_feature (1)..( 9): Matrix.004 file - promoters50/1398737
aaattattt

SEQ ID NO: 68705 - DNA, 10 bp, Unknown
  misc_feature (1)..( 10): Matrix.004 file - promoters50/1398737
aattagtttg

SEQ ID NO: 68706 - DNA, 10 bp, Unknown
  misc_feature (1)..( 10): Matrix.004 file - promoters50/1398737
aaagaaatta

SEQ ID NO: 68707 - DNA, 9 bp, Unknown
  misc_feature (1)..( 9): Matrix.004 file - promoters50/1398784
aggataata

SEQ ID NO: 68708 - DNA, 7 bp, Unknown
  misc_feature (1)..( 7): Matrix.004 file - promoters50/1398784
ataaaat

SEQ ID NO: 68709 - DNA, 11 bp, Unknown
  misc_feature (1)..( 11): Matrix.004 file - promoters50/1398784
gaaaacttaaa

SEQ ID NO: 68710 - DNA, 10 bp, Unknown
  misc_feature (1)..( 10): Matrix.004 file - promoters50/1398846
aaagaaaaat

SEQ ID NO: 68711 - DNA, 7 bp, Unknown
  misc_feature (1)..( 7): Matrix.004 file - promoters50/1398846
tttgtta

SEQ ID NO: 68712 - DNA, 9 bp, Unknown
  misc_feature (1)..( 9): Matrix.004 file - promoters50/1398853
ttaattaaa

SEQ ID NO: 68713 - DNA, 13 bp, Unknown
  misc_feature (1)..( 13): Matrix.004 file - promoters50/1398853
caaaaaaaatggt

SEQ ID NO: 68714 - DNA, 7 bp, Unknown
  misc_feature (1)..( 7): Matrix.004 file - promoters50/1398892
ttttatt

SEQ ID NO: 68715 - DNA, 8 bp, Unknown
  misc_feature (1)..( 8): Matrix.004 file - promoters50/1398936
atttaaat

SEQ ID NO: 68716 - DNA, 9 bp, Unknown
  misc_feature (1)..( 9): Matrix.004 file - promoters50/1399037
ttttcttct

SEQ ID NO: 68717 - DNA, 10 bp, Unknown
  misc_feature (1)..( 10): Matrix.004 file - promoters50/1399037
gagaaaaaaa

SEQ ID NO: 68718 - DNA, 6 bp, Unknown
  misc_feature (1)..( 6): Matrix.004 file - promoters50/1399074
tcaaat

SEQ ID NO: 68719 - DNA, 8 bp, Unknown
  misc_feature (1)..( 8): Matrix.004 file - promoters50/1399074
agtaaaga

SEQ ID NO: 68720 - DNA, 10 bp, Unknown
  misc_feature (1)..( 10): Matrix.004 file - promoters50/1399074
gaaagaaagc

SEQ ID NO: 68721 - DNA, 10 bp, Unknown
  misc_feature (1)..( 10): Matrix.004 file - promoters50/1399140
ggaaaagaaa

SEQ ID NO: 68722 - DNA, 9 bp, Unknown
  misc_feature (1)..( 9): Matrix.004 file - promoters50/1399210
gaaaaattt

SEQ ID NO: 68723 - DNA, 11 bp, Unknown
  misc_feature (1)..( 11): Matrix.004 file - promoters50/1399210
aatttaaacaa

SEQ ID NO: 68724 - DNA, 7 bp, Unknown
  misc_feature (1)..( 7): Matrix.004 file - promoters50/1399210
cttttgg

SEQ ID NO: 68725 - DNA, 12 bp, Unknown
  misc_feature (1)..( 12): Matrix.004 file - promoters50/1399210
ttactataaatt

SEQ ID NO: 68726 - DNA, 8 bp, Unknown
  misc_feature (1)..( 8): Matrix.004 file - promoters50/1399265
gttttagt

SEQ ID NO: 68727 - DNA, 13 bp, Unknown
  misc_feature (1)..( 13): Matrix.004 file - promoters50/1399265
gtatttaaaatat

SEQ ID NO: 68728 - DNA, 12 bp, Unknown
  misc_feature (1)..( 12): Matrix.004 file - promoters50/1399265
aaacaattttat

SEQ ID NO: 68729 - DNA, 14 bp, Unknown
  misc_feature (1)..( 14): Matrix.004 file - promoters50/1399265
tttattttataaaa

SEQ ID NO: 68730 - DNA, 9 bp, Unknown
  misc_feature (1)..( 9): Matrix.004 file - promoters50/1399265
tcattttat

SEQ ID NO: 68731 - DNA, 9 bp, Unknown
  misc_feature (1)..( 9): Matrix.004 file - promoters50/1399265
taataaaaa

SEQ ID NO: 68732 - DNA, 10 bp, Unknown
  misc_feature (1)..( 10): Matrix.004 file - promoters50/1399277
gatatttttt

SEQ ID NO: 68733 - DNA, 17 bp, Unknown
  misc_feature (1)..( 17): Matrix.004 file - promoters50/1399277
ttaaacacaaaaatttt

SEQ ID NO: 68734 - DNA, 7 bp, Unknown
  misc_feature (1)..( 7): Matrix.004 file - promoters50/1399277
aagattt

SEQ ID NO: 68735 - DNA, 8 bp, Unknown
  misc_feature (1)..( 8): Matrix.004 file - promoters50/1399277
attttttt

SEQ ID NO: 68736 - DNA, 5 bp, Unknown
  misc_feature (1)..( 5): Matrix.004 file - promoters50/1399277
ataac

SEQ ID NO: 68737 - DNA, 9 bp, Unknown
  misc_feature (1)..( 9): Matrix.004 file - promoters50/1399277
aaaacaatt

SEQ ID NO: 68738 - DNA, 9 bp, Unknown
  misc_feature (1)..( 9): Matrix.004 file - promoters50/1399277
aaaaattta

SEQ ID NO: 68739 - DNA, 8 bp, Unknown
  misc_feature (1)..( 8): Matrix.004 file - promoters50/1399277
ttacaaaa

SEQ ID NO: 68740 - DNA, 7 bp, Unknown
  misc_feature (1)..( 7): Matrix.004 file - promoters50/1399277
gataaag

SEQ ID NO: 68741 - DNA, 8 bp, Unknown
  misc_feature (1)..( 8): Matrix.004 file - promoters50/1399277
aaaccaat

SEQ ID NO: 68742 - DNA, 7 bp, Unknown
  misc_feature (1)..( 7): Matrix.004 file - promoters50/1399277
tatttat

SEQ ID NO: 68743 - DNA, 9 bp, Unknown
  misc_feature (1)..( 9): Matrix.004 file - promoters50/1399325
tttattaaa

SEQ ID NO: 68744 - DNA, 5 bp, Unknown
  misc_feature (1)..( 5): Matrix.004 file - promoters50/1399325
aaaat

SEQ ID NO: 68745 - DNA, 10 bp, Unknown
  misc_feature (1)..( 10): Matrix.004 file - promoters50/1399345
atctgaaatt

SEQ ID NO: 68746 - DNA, 10 bp, Unknown
  misc_feature (1)..( 10): Matrix.004 file - promoters50/1399345
agttttggta

SEQ ID NO: 68747 - DNA, 9 bp, Unknown
  misc_feature (1)..( 9): Matrix.004 file - promoters50/1399345
aaatacaaa

SEQ ID NO: 68748 - DNA, 16 bp, Unknown
  misc_feature (1)..( 16): Matrix.004 file - promoters50/1399345
aacttaattctttttt

SEQ ID NO: 68749 - DNA, 11 bp, Unknown
  misc_feature (1)..( 11): Matrix.004 file - promoters50/1399409
cttttgtataa

SEQ ID NO: 68750 - DNA, 10 bp, Unknown
  misc_feature (1)..( 10): Matrix.004 file - promoters50/1399413
acataattat

SEQ ID NO: 68751 - DNA, 6 bp, Unknown
  misc_feature (1)..( 6): Matrix.004 file - promoters50/1399413
tctttg

SEQ ID NO: 68752 - DNA, 9 bp, Unknown
  misc_feature (1)..( 9): Matrix.004 file - promoters50/1399413
aaaattaaa

SEQ ID NO: 68753 - DNA, 9 bp, Unknown
  misc_feature (1)..( 9): Matrix.004 file - promoters50/1399413
tctatataa

SEQ ID NO: 68754 - DNA, 8 bp, Unknown
  misc_feature (1)..( 8): Matrix.004 file - promoters50/1399413
attaaaaa

SEQ ID NO: 68755 - DNA, 7 bp, Unknown
  misc_feature (1)..( 7): Matrix.004 file - promoters50/1399413
aaaatct

SEQ ID NO: 68756 - DNA, 10 bp, Unknown
  misc_feature (1)..( 10): Matrix.004 file - promoters50/1399417
atcaattaaa

SEQ ID NO: 68757 - DNA, 12 bp, Unknown
  misc_feature (1)..( 12): Matrix.004 file - promoters50/1399469
taaaggcccaat

SEQ ID NO: 68758 - DNA, 10 bp, Unknown
  misc_feature (1)..( 10): Matrix.004 file - promoters50/1399469
tcttgcaagg

SEQ ID NO: 68759 - DNA, 7 bp, Unknown
  misc_feature (1)..( 7): Matrix.004 file - promoters50/1399541
aaaattt

SEQ ID NO: 68760 - DNA, 10 bp, Unknown
  misc_feature (1)..( 10): Matrix.004 file - promoters50/1399541
tactttaaaa

SEQ ID NO: 68761 - DNA, 13 bp, Unknown
  misc_feature (1)..( 13): Matrix.004 file - promoters50/1399541
aaaagattacatt

SEQ ID NO: 68762 - DNA, 8 bp, Unknown
  misc_feature (1)..( 8): Matrix.004 file - promoters50/1399541
tttaaaat

SEQ ID NO: 68763 - DNA, 11 bp, Unknown
  misc_feature (1)..( 11): Matrix.004 file - promoters50/1399541
taagattctat

SEQ ID NO: 68764 - DNA, 13 bp, Unknown
  misc_feature (1)..( 13): Matrix.004 file - promoters50/1399638
taatttaaacata

SEQ ID NO: 68765 - DNA, 11 bp, Unknown
  misc_feature (1)..( 11): Matrix.004 file - promoters50/1399638
tccaaacttaa

SEQ ID NO: 68766 - DNA, 10 bp, Unknown
  misc_feature (1)..( 10): Matrix.004 file - promoters50/1399658
taaacaccat

SEQ ID NO: 68767 - DNA, 11 bp, Unknown
  misc_feature (1)..( 11): Matrix.004 file - promoters50/1399658
aaaaaaatttt

SEQ ID NO: 68768 - DNA, 9 bp, Unknown
  misc_feature (1)..( 9): Matrix.004 file - promoters50/1399658
attcaaatt

SEQ ID NO: 68769 - DNA, 9 bp, Unknown
  misc_feature (1)..( 9): Matrix.004 file - promoters50/1399726
aaaaaaaat

SEQ ID NO: 68770 - DNA, 10 bp, Unknown
  misc_feature (1)..( 10): Matrix.004 file - promoters50/1399726
ccaattaatt

SEQ ID NO: 68771 - DNA, 20 bp, Unknown
  misc_feature (1)..( 20): Matrix.004 file - promoters50/1399726
atgagatattaaaattaaat

SEQ ID NO: 68772 - DNA, 9 bp, Unknown
  misc_feature (1)..( 9): Matrix.004 file - promoters50/1399726
aaaataaaa

SEQ ID NO: 68773 - DNA, 9 bp, Unknown
  misc_feature (1)..( 9): Matrix.004 file - promoters50/1399726
ataaattac

SEQ ID NO: 68774 - DNA, 14 bp, Unknown
  misc_feature (1)..( 14): Matrix.004 file - promoters50/1399726
atgaaaaaagaaaa

SEQ ID NO: 68775 - DNA, 11 bp, Unknown
  misc_feature (1)..( 11): Matrix.004 file - promoters50/1399726
ataaatatata

SEQ ID NO: 68776 - DNA, 12 bp, Unknown
  misc_feature (1)..( 12): Matrix.004 file - promoters50/1399726
tacagtttaaat

SEQ ID NO: 68777 - DNA, 11 bp, Unknown
  misc_feature (1)..( 11): Matrix.004 file - promoters50/1399726
aataactttga

SEQ ID NO: 68778 - DNA, 11 bp, Unknown
  misc_feature (1)..( 11): Matrix.004 file - promoters50/1399760
taatattaaat

SEQ ID NO: 68779 - DNA, 8 bp, Unknown
  misc_feature (1)..( 8): Matrix.004 file - promoters50/1403185
attttact

SEQ ID NO: 68780 - DNA, 9 bp, Unknown
  misc_feature (1)..( 9): Matrix.004 file - promoters50/1403210
catctttta

SEQ ID NO: 68781 - DNA, 7 bp, Unknown
  misc_feature (1)..( 7): Matrix.004 file - promoters50/1411578
ttgaaaa

SEQ ID NO: 68782 - DNA, 9 bp, Unknown
  misc_feature (1)..( 9): Matrix.004 file - promoters50/1411578
gtcaaactt

SEQ ID NO: 68783 - DNA, 9 bp, Unknown
  misc_feature (1)..( 9): Matrix.004 file - promoters50/1411598
ggtagatca

SEQ ID NO: 68784 - DNA, 7 bp, Unknown
  misc_feature (1)..( 7): Matrix.004 file - promoters50/1411616
acataaa

SEQ ID NO: 68785 - DNA, 11 bp, Unknown
  misc_feature (1)..( 11): Matrix.004 file - promoters50/1411628
tattatttttc

SEQ ID NO: 68786 - DNA, 8 bp, Unknown
  misc_feature (1)..( 8): Matrix.004 file - promoters50/1411628
ccttcctt

SEQ ID NO: 68787 - DNA, 10 bp, Unknown
  misc_feature (1)..( 10): Matrix.004 file - promoters50/1411628
ttaaaaattg

SEQ ID NO: 68788 - DNA, 9 bp, Unknown
  misc_feature (1)..( 9): Matrix.004 file - promoters50/1411628
caataaacg

SEQ ID NO: 68789 - DNA, 7 bp, Unknown
  misc_feature (1)..( 7): Matrix.004 file - promoters50/1411703
agtattt

SEQ ID NO: 68790 - DNA, 9 bp, Unknown
  misc_feature (1)..( 9): Matrix.004 file - promoters50/1411722
tataaaaat

SEQ ID NO: 68791 - DNA, 8 bp, Unknown
  misc_feature (1)..( 8): Matrix.004 file - promoters50/1411730
aaaaatat

SEQ ID NO: 68792 - DNA, 7 bp, Unknown
  misc_feature (1)..( 7): Matrix.004 file - promoters50/1411730
caaatct

SEQ ID NO: 68793 - DNA, 7 bp, Unknown
  misc_feature (1)..( 7): Matrix.004 file - promoters50/1411730
ttaattc

SEQ ID NO: 68794 - DNA, 8 bp, Unknown
  misc_feature (1)..( 8): Matrix.004 file - promoters50/1411730
aaaacaaa

SEQ ID NO: 68795 - DNA, 8 bp, Unknown
  misc_feature (1)..( 8): Matrix.004 file - promoters50/1411730
actgaaat

SEQ ID NO: 68796 - DNA, 9 bp, Unknown
  misc_feature (1)..( 9): Matrix.004 file - promoters50/1411730
agtctaaaa

SEQ ID NO: 68797 - DNA, 8 bp, Unknown
  misc_feature (1)..( 8): Matrix.004 file - promoters50/1411730
cccattcc

SEQ ID NO: 68798 - DNA, 9 bp, Unknown
  misc_feature (1)..( 9): Matrix.004 file - promoters50/1411730
taacttgaa

SEQ ID NO: 68799 - DNA, 11 bp, Unknown
  misc_feature (1)..( 11): Matrix.004 file - promoters50/1411762
ctaaaaataaa

SEQ ID NO: 68800 - DNA, 12 bp, Unknown
  misc_feature (1)..( 12): Matrix.004 file - promoters50/1411762
atcttatatata

SEQ ID NO: 68801 - DNA, 9 bp, Unknown
  misc_feature (1)..( 9): Matrix.004 file - promoters50/1411762
acataccaa

SEQ ID NO: 68802 - DNA, 6 bp, Unknown
  misc_feature (1)..( 6): Matrix.004 file - promoters50/1411786
aaaaac

SEQ ID NO: 68803 - DNA, 8 bp, Unknown
  misc_feature (1)..( 8): Matrix.004 file - promoters50/1411786
attatttt

SEQ ID NO: 68804 - DNA, 7 bp, Unknown
  misc_feature (1)..( 7): Matrix.004 file - promoters50/1411786
gatatat

SEQ ID NO: 68805 - DNA, 7 bp, Unknown
  misc_feature (1)..( 7): Matrix.004 file - promoters50/1413159
atatatt

SEQ ID NO: 68806 - DNA, 7 bp, Unknown
  misc_feature (1)..( 7): Matrix.004 file - promoters50/1413191
ttgtgat

SEQ ID NO: 68807 - DNA, 9 bp, Unknown
  misc_feature (1)..( 9): Matrix.004 file - promoters50/1413191
tttaatttt

SEQ ID NO: 68808 - DNA, 8 bp, Unknown
  misc_feature (1)..( 8): Matrix.004 file - promoters50/1413191
atataaat

SEQ ID NO: 68809 - DNA, 11 bp, Unknown
  misc_feature (1)..( 11): Matrix.004 file - promoters50/1413191
atttgttttta

SEQ ID NO: 68810 - DNA, 7 bp, Unknown
  misc_feature (1)..( 7): Matrix.004 file - promoters50/1413191
ttgctct

SEQ ID NO: 68811 - DNA, 12 bp, Unknown
  misc_feature (1)..( 12): Matrix.004 file - promoters50/1413191
agatttaatata

SEQ ID NO: 68812 - DNA, 13 bp, Unknown
  misc_feature (1)..( 13): Matrix.004 file - promoters50/1413191
tttccaaaataat

SEQ ID NO: 68813 - DNA, 10 bp, Unknown
  misc_feature (1)..( 10): Matrix.004 file - promoters50/1413211
aaattatata

SEQ ID NO: 68814 - DNA, 9 bp, Unknown
  misc_feature (1)..( 9): Matrix.004 file - promoters50/1413211
atagtcaac

SEQ ID NO: 68815 - DNA, 9 bp, Unknown
  misc_feature (1)..( 9): Matrix.004 file - promoters50/1413211
aaaatagaa

SEQ ID NO: 68816 - DNA, 13 bp, Unknown
  misc_feature (1)..( 13): Matrix.004 file - promoters50/1413211
tgatgaaaatgat

SEQ ID NO: 68817 - DNA, 7 bp, Unknown
  misc_feature (1)..( 7): Matrix.004 file - promoters50/1413211
agatagt

SEQ ID NO: 68818 - DNA, 9 bp, Unknown
  misc_feature (1)..( 9): Matrix.004 file - promoters50/1413211
atttaatta

SEQ ID NO: 68819 - DNA, 9 bp, Unknown
  misc_feature (1)..( 9): Matrix.004 file - promoters50/1420845
tttgattat

SEQ ID NO: 68820 - DNA, 10 bp, Unknown
  misc_feature (1)..( 10): Matrix.004 file - promoters50/1420853
aaagagtttc

SEQ ID NO: 68821 - DNA, 9 bp, Unknown
  misc_feature (1)..( 9): Matrix.004 file - promoters50/1420853
ttcgacatt

SEQ ID NO: 68822 - DNA, 11 bp, Unknown
  misc_feature (1)..( 11): Matrix.004 file - promoters50/1420853
tattatggttt

SEQ ID NO: 68823 - DNA, 14 bp, Unknown
  misc_feature (1)..( 14): Matrix.004 file - promoters50/1420853
cgtatttaaacccc

SEQ ID NO: 68824 - DNA, 9 bp, Unknown
  misc_feature (1)..( 9): Matrix.004 file - promoters50/1420853
aaggcttta

SEQ ID NO: 68825 - DNA, 7 bp, Unknown
  misc_feature (1)..( 7): Matrix.004 file - promoters50/1420853
atgtctg

SEQ ID NO: 68826 - DNA, 7 bp, Unknown
  misc_feature (1)..( 7): Matrix.004 file - promoters50/1440857
taaatgc

SEQ ID NO: 68827 - DNA, 11 bp, Unknown
  misc_feature (1)..( 11): Matrix.004 file - promoters50/1440857
ttgacataatt

SEQ ID NO: 68828 - DNA, 8 bp, Unknown
  misc_feature (1)..( 8): Matrix.004 file - promoters50/1440865
tttagtca

SEQ ID NO: 68829 - DNA, 10 bp, Unknown
  misc_feature (1)..( 10): Matrix.004 file - promoters50/1440865
acctaaaaat

SEQ ID NO: 68830 - DNA, 7 bp, Unknown
  misc_feature (1)..( 7): Matrix.004 file - promoters50/1440865
agcaagt

SEQ ID NO: 68831 - DNA, 10 bp, Unknown
  misc_feature (1)..( 10): Matrix.004 file - promoters50/1440865
taacattttc

SEQ ID NO: 68832 - DNA, 8 bp, Unknown
  misc_feature (1)..( 8): Matrix.004 file - promoters50/1440865
tcaaaagc

SEQ ID NO: 68833 - DNA, 7 bp, Unknown
  misc_feature (1)..( 7): Matrix.004 file - promoters50/1440865
gacattt

SEQ ID NO: 68834 - DNA, 12 bp, Unknown
  misc_feature (1)..( 12): Matrix.004 file - promoters50/1440865
tttcaataatta

SEQ ID NO: 68835 - DNA, 8 bp, Unknown
  misc_feature (1)..( 8): Matrix.004 file - promoters50/1440865
acctaaat

SEQ ID NO: 68836 - DNA, 10 bp, Unknown
  misc_feature (1)..( 10): Matrix.004 file - promoters50/1440865
tttttaaatt

SEQ ID NO: 68837 - DNA, 8 bp, Unknown
  misc_feature (1)..( 8): Matrix.004 file - promoters50/1440865
tcttgagt

SEQ ID NO: 68838 - DNA, 8 bp, Unknown
  misc_feature (1)..( 8): Matrix.004 file - promoters50/1440865
agcaagta

SEQ ID NO: 68839 - DNA, 8 bp, Unknown
  misc_feature (1)..( 8): Matrix.004 file - promoters50/1440865
ctttttct

SEQ ID NO: 68840 - DNA, 9 bp, Unknown
  misc_feature (1)..( 9): Matrix.004 file - promoters50/1440865
tttcaaaaa

SEQ ID NO: 68841 - DNA, 7 bp, Unknown
  misc_feature (1)..( 7): Matrix.004 file - promoters50/1440865
atttttt

SEQ ID NO: 68842 - DNA, 7 bp, Unknown
  misc_feature (1)..( 7): Matrix.004 file - promoters50/1440873
cctttat

SEQ ID NO: 68843 - DNA, 7 bp, Unknown
  misc_feature (1)..( 7): Matrix.004 file - promoters50/1440967
ataaaaa

SEQ ID NO: 68844 - DNA, 11 bp, Unknown
  misc_feature (1)..( 11): Matrix.004 file - promoters50/1440967
taatttgtttc

SEQ ID NO: 68845 - DNA, 13 bp, Unknown
  misc_feature (1)..( 13): Matrix.004 file - promoters50/1440967
ataacaaaaaaga

SEQ ID NO: 68846 - DNA, 9 bp, Unknown
  misc_feature (1)..( 9): Matrix.004 file - promoters50/1440967
ttatcaaaa

SEQ ID NO: 68847 - DNA, 13 bp, Unknown
  misc_feature (1)..( 13): Matrix.004 file - promoters50/1441020
ctataaaatttta

SEQ ID NO: 68848 - DNA, 10 bp, Unknown
  misc_feature (1)..( 10): Matrix.004 file - promoters50/1441020
attttcaata

SEQ ID NO: 68849 - DNA, 11 bp, Unknown
  misc_feature (1)..( 11): Matrix.004 file - promoters50/1441020
aacattttgaa

SEQ ID NO: 68850 - DNA, 9 bp, Unknown
  misc_feature (1)..( 9): Matrix.004 file - promoters50/1441044
attttgaaa

SEQ ID NO: 68851 - DNA, 9 bp, Unknown
  misc_feature (1)..( 9): Matrix.004 file - promoters50/1441044
aactaaaca

SEQ ID NO: 68852 - DNA, 13 bp, Unknown
  misc_feature (1)..( 13): Matrix.004 file - promoters50/1441044
acaaacttttagt

SEQ ID NO: 68853 - DNA, 12 bp, Unknown
  misc_feature (1)..( 12): Matrix.004 file - promoters50/1441069
actcatatataa

SEQ ID NO: 68854 - DNA, 12 bp, Unknown
  misc_feature (1)..( 12): Matrix.004 file - promoters50/1441069
aaatataattat

SEQ ID NO: 68855 - DNA, 10 bp, Unknown
  misc_feature (1)..( 10): Matrix.004 file - promoters50/1441134
aaagaatcaa

SEQ ID NO: 68856 - DNA, 8 bp, Unknown
  misc_feature (1)..( 8): Matrix.004 file - promoters50/1441145
attaacaa

SEQ ID NO: 68857 - DNA, 10 bp, Unknown
  misc_feature (1)..( 10): Matrix.004 file - promoters50/1441145
aataaataat

SEQ ID NO: 68858 - DNA, 7 bp, Unknown
  misc_feature (1)..( 7): Matrix.004 file - promoters50/1441145
aacaaaa

SEQ ID NO: 68859 - DNA, 9 bp, Unknown
  misc_feature (1)..( 9): Matrix.004 file - promoters50/1441145
gaatttcaa

SEQ ID NO: 68860 - DNA, 7 bp, Unknown
  misc_feature (1)..( 7): Matrix.004 file - promoters50/1441145
attaata

SEQ ID NO: 68861 - DNA, 10 bp, Unknown
  misc_feature (1)..( 10): Matrix.004 file - promoters50/1441145
atatacaaat

SEQ ID NO: 68862 - DNA, 7 bp, Unknown
  misc_feature (1)..( 7): Matrix.004 file - promoters50/1441145
attttaa

SEQ ID NO: 68863 - DNA, 10 bp, Unknown
  misc_feature (1)..( 10): Matrix.004 file - promoters50/1441145
aaattcatat

SEQ ID NO: 68864 - DNA, 9 bp, Unknown
  misc_feature (1)..( 9): Matrix.004 file - promoters50/1441170
ttaataaac

SEQ ID NO: 68865 - DNA, 11 bp, Unknown
  misc_feature (1)..( 11): Matrix.004 file - promoters50/1441170
aaaatcaaaaa

SEQ ID NO: 68866 - DNA, 11 bp, Unknown
  misc_feature (1)..( 11): Matrix.004 file - promoters50/1441174
aaaaccaaaaa

SEQ ID NO: 68867 - DNA, 9 bp, Unknown
  misc_feature (1)..( 9): Matrix.004 file - promoters50/1441174
agttttttt

SEQ ID NO: 68868 - DNA, 9 bp, Unknown
  misc_feature (1)..( 9): Matrix.004 file - promoters50/1441184
agataaaga

SEQ ID NO: 68869 - DNA, 8 bp, Unknown
  misc_feature (1)..( 8): Matrix.004 file - promoters50/1441184
tactataa

SEQ ID NO: 68870 - DNA, 9 bp, Unknown
  misc_feature (1)..( 9): Matrix.004 file - promoters50/1441237
acattttgt

SEQ ID NO: 68871 - DNA, 9 bp, Unknown
  misc_feature (1)..( 9): Matrix.004 file - promoters50/1441237
aagaaattc

SEQ ID NO: 68872 - DNA, 13 bp, Unknown
  misc_feature (1)..( 13): Matrix.004 file - promoters50/1441237
attattttaaatc

SEQ ID NO: 68873 - DNA, 8 bp, Unknown
  misc_feature (1)..( 8): Matrix.004 file - promoters50/1441237
tataaaaa

SEQ ID NO: 68874 - DNA, 8 bp, Unknown
  misc_feature (1)..( 8): Matrix.004 file - promoters50/1441237
atctttat

SEQ ID NO: 68875 - DNA, 10 bp, Unknown
  misc_feature (1)..( 10): Matrix.004 file - promoters50/1441237
tataaataca

SEQ ID NO: 68876 - DNA, 12 bp, Unknown
  misc_feature (1)..( 12): Matrix.004 file - promoters50/1441249
atatttataact

SEQ ID NO: 68877 - DNA, 10 bp, Unknown
  misc_feature (1)..( 10): Matrix.004 file - promoters50/1441249
aatgtttcaa

SEQ ID NO: 68878 - DNA, 13 bp, Unknown
  misc_feature (1)..( 13): Matrix.004 file - promoters50/1441249
aattactaaatat

SEQ ID NO: 68879 - DNA, 3 bp, Unknown
  misc_feature (1)..( 3): Matrix.004 file - promoters50/1441249
att

SEQ ID NO: 68880 - DNA, 10 bp, Unknown
  misc_feature (1)..( 10): Matrix.004 file - promoters50/1441249
attatacata

SEQ ID NO: 68881 - DNA, 7 bp, Unknown
  misc_feature (1)..( 7): Matrix.004 file - promoters50/1441326
ttataat

SEQ ID NO: 68882 - DNA, 9 bp, Unknown
  misc_feature (1)..( 9): Matrix.004 file - promoters50/1441326
aaagtcttg

SEQ ID NO: 68883 - DNA, 9 bp, Unknown
  misc_feature (1)..( 9): Matrix.004 file - promoters50/1441326
aaaaaatta

SEQ ID NO: 68884 - DNA, 7 bp, Unknown
  misc_feature (1)..( 7): Matrix.004 file - promoters50/1441395
caaaaaa

SEQ ID NO: 68885 - DNA, 13 bp, Unknown
  misc_feature (1)..( 13): Matrix.004 file - promoters50/1441460
aaagaatcaaaac

SEQ ID NO: 68886 - DNA, 10 bp, Unknown
  misc_feature (1)..( 10): Matrix.004 file - promoters50/1441465
taatgttttg

SEQ ID NO: 68887 - DNA, 12 bp, Unknown
  misc_feature (1)..( 12): Matrix.004 file - promoters50/1441533
taataattatta

SEQ ID NO: 68888 - DNA, 8 bp, Unknown
  misc_feature (1)..( 8): Matrix.004 file - promoters50/1441539
tcaatttt

SEQ ID NO: 68889 - DNA, 7 bp, Unknown
  misc_feature (1)..( 7): Matrix.004 file - promoters50/1441539
tgaattg

SEQ ID NO: 68890 - DNA, 10 bp, Unknown
  misc_feature (1)..( 10): Matrix.004 file - promoters50/1441548
ggttttgttt

SEQ ID NO: 68891 - DNA, 10 bp, Unknown
  misc_feature (1)..( 10): Matrix.004 file - promoters50/1441548
aaaacaaatt

SEQ ID NO: 68892 - DNA, 10 bp, Unknown
  misc_feature (1)..( 10): Matrix.004 file - promoters50/1441548
acatataaaa

SEQ ID NO: 68893 - DNA, 9 bp, Unknown
  misc_feature (1)..( 9): Matrix.004 file - promoters50/1441548
aaaaattaa

SEQ ID NO: 68894 - DNA, 16 bp, Unknown
  misc_feature (1)..( 16): Matrix.004 file - promoters50/1441569
aaaaataaataaaaga

SEQ ID NO: 68895 - DNA, 8 bp, Unknown
  misc_feature (1)..( 8): Matrix.004 file - promoters50/1441569
aattttgt

SEQ ID NO: 68896 - DNA, 12 bp, Unknown
  misc_feature (1)..( 12): Matrix.004 file - promoters50/1441569
gcattttttttt

SEQ ID NO: 68897 - DNA, 8 bp, Unknown
  misc_feature (1)..( 8): Matrix.004 file - promoters50/1441569
tataaata

SEQ ID NO: 68898 - DNA, 8 bp, Unknown
  misc_feature (1)..( 8): Matrix.004 file - promoters50/1441569
aatatatt

SEQ ID NO: 68899 - DNA, 9 bp, Unknown
  misc_feature (1)..( 9): Matrix.004 file - promoters50/1441569
aaataattt

SEQ ID NO: 68900 - DNA, 12 bp, Unknown
  misc_feature (1)..( 12): Matrix.004 file - promoters50/1441569
aataacaaaaac

SEQ ID NO: 68901 - DNA, 7 bp, Unknown
  misc_feature (1)..( 7): Matrix.004 file - promoters50/1441569
tttctta

SEQ ID NO: 68902 - DNA, 9 bp, Unknown
  misc_feature (1)..( 9): Matrix.004 file - promoters50/1441614
cttgtacaa

SEQ ID NO: 68903 - DNA, 9 bp, Unknown
  misc_feature (1)..( 9): Matrix.004 file - promoters50/1441614
ccattttac

SEQ ID NO: 68904 - DNA, 7 bp, Unknown
  misc_feature (1)..( 7): Matrix.004 file - promoters50/1441614
tgtgttt

SEQ ID NO: 68905 - DNA, 8 bp, Unknown
  misc_feature (1)..( 8): Matrix.004 file - promoters50/1441614
tgtttttt

SEQ ID NO: 68906 - DNA, 13 bp, Unknown
  misc_feature (1)..( 13): Matrix.004 file - promoters50/1441614
ctatatccatttt

SEQ ID NO: 68907 - DNA, 7 bp, Unknown
  misc_feature (1)..( 7): Matrix.004 file - promoters50/1441651
tttttat

SEQ ID NO: 68908 - DNA, 13 bp, Unknown
  misc_feature (1)..( 13): Matrix.004 file - promoters50/1441651
tcttataaatttc

SEQ ID NO: 68909 - DNA, 10 bp, Unknown
  misc_feature (1)..( 10): Matrix.004 file - promoters50/1441651
tgtttaattt

SEQ ID NO: 68910 - DNA, 7 bp, Unknown
  misc_feature (1)..( 7): Matrix.004 file - promoters50/1441657
tgaaaaa

SEQ ID NO: 68911 - DNA, 8 bp, Unknown
  misc_feature (1)..( 8): Matrix.004 file - promoters50/1441722
tttaattt

SEQ ID NO: 68912 - DNA, 9 bp, Unknown
  misc_feature (1)..( 9): Matrix.004 file - promoters50/1441722
tgcgtcagt

SEQ ID NO: 68913 - DNA, 7 bp, Unknown
  misc_feature (1)..( 7): Matrix.004 file - promoters50/1441762
caattta

SEQ ID NO: 68914 - DNA, 9 bp, Unknown
  misc_feature (1)..( 9): Matrix.004 file - promoters50/1441762
aatctcttt

SEQ ID NO: 68915 - DNA, 7 bp, Unknown
  misc_feature (1)..( 7): Matrix.004 file - promoters50/1441814
taattta

SEQ ID NO: 68916 - DNA, 10 bp, Unknown
  misc_feature (1)..( 10): Matrix.004 file - promoters50/1441814
actaaatatt

SEQ ID NO: 68917 - DNA, 11 bp, Unknown
  misc_feature (1)..( 11): Matrix.004 file - promoters50/1441814
ttttacttttt

SEQ ID NO: 68918 - DNA, 10 bp, Unknown
  misc_feature (1)..( 10): Matrix.004 file - promoters50/1441835
caaaaaatgt

SEQ ID NO: 68919 - DNA, 9 bp, Unknown
  misc_feature (1)..( 9): Matrix.004 file - promoters50/1441835
atataaaaa

SEQ ID NO: 68920 - DNA, 14 bp, Unknown
  misc_feature (1)..( 14): Matrix.004 file - promoters50/1441841
attaaaaaatccaa

SEQ ID NO: 68921 - DNA, 12 bp, Unknown
  misc_feature (1)..( 12): Matrix.004 file - promoters50/1441841
atcaattttgca

SEQ ID NO: 68922 - DNA, 13 bp, Unknown
  misc_feature (1)..( 13): Matrix.004 file - promoters50/1441859
tcattttttaaat

SEQ ID NO: 68923 - DNA, 10 bp, Unknown
  misc_feature (1)..( 10): Matrix.004 file - promoters50/1441912
atttatttta

SEQ ID NO: 68924 - DNA, 15 bp, Unknown
  misc_feature (1)..( 15): Matrix.004 file - promoters50/1441937
tattgatttgggaac

SEQ ID NO: 68925 - DNA, 8 bp, Unknown
  misc_feature (1)..( 8): Matrix.004 file - promoters50/1441937
caatttat

SEQ ID NO: 68926 - DNA, 7 bp, Unknown
  misc_feature (1)..( 7): Matrix.004 file - promoters50/1441937
aaaatca

SEQ ID NO: 68927 - DNA, 8 bp, Unknown
  misc_feature (1)..( 8): Matrix.004 file - promoters50/1441937
taaaaatc

SEQ ID NO: 68928 - DNA, 8 bp, Unknown
  misc_feature (1)..( 8): Matrix.004 file - promoters50/1441937
ctgtgttg

SEQ ID NO: 68929 - DNA, 8 bp, Unknown
  misc_feature (1)..( 8): Matrix.004 file - promoters50/1441959
tcttgttt

SEQ ID NO: 68930 - DNA, 8 bp, Unknown
  misc_feature (1)..( 8): Matrix.004 file - promoters50/1441959
tctataca

SEQ ID NO: 68931 - DNA, 7 bp, Unknown
  misc_feature (1)..( 7): Matrix.004 file - promoters50/1441959
aattttt

SEQ ID NO: 68932 - DNA, 7 bp, Unknown
  misc_feature (1)..( 7): Matrix.004 file - promoters50/1441963
ataattt

SEQ ID NO: 68933 - DNA, 7 bp, Unknown
  misc_feature (1)..( 7): Matrix.004 file - promoters50/1441963
aaaaatt

SEQ ID NO: 68934 - DNA, 5 bp, Unknown
  misc_feature (1)..( 5): Matrix.004 file - promoters50/1441963
ataaa

SEQ ID NO: 68935 - DNA, 9 bp, Unknown
  misc_feature (1)..( 9): Matrix.004 file - promoters50/1441963
aaatattat

SEQ ID NO: 68936 - DNA, 10 bp, Unknown
  misc_feature (1)..( 10): Matrix.004 file - promoters50/1441963
aaatataaga

SEQ ID NO: 68937 - DNA, 8 bp, Unknown
  misc_feature (1)..( 8): Matrix.004 file - promoters50/1441970
tataaaag

SEQ ID NO: 68938 - DNA, 8 bp, Unknown
  misc_feature (1)..( 8): Matrix.004 file - promoters50/1441970
ctcttgtt

SEQ ID NO: 68939 - DNA, 7 bp, Unknown
  misc_feature (1)..( 7): Matrix.004 file - promoters50/1441970
gtttttc

SEQ ID NO: 68940 - DNA, 9 bp, Unknown
  misc_feature (1)..( 9): Matrix.004 file - promoters50/1441970
atgttcttg

SEQ ID NO: 68941 - DNA, 9 bp, Unknown
  misc_feature (1)..( 9): Matrix.004 file - promoters50/1441970
acattcatt

SEQ ID NO: 68942 - DNA, 8 bp, Unknown
  misc_feature (1)..( 8): Matrix.004 file - promoters50/1441970
attttttt

SEQ ID NO: 68943 - DNA, 8 bp, Unknown
  misc_feature (1)..( 8): Matrix.004 file - promoters50/1441985
atttttta

SEQ ID NO: 68944 - DNA, 9 bp, Unknown
  misc_feature (1)..( 9): Matrix.004 file - promoters50/1441985
acaattttg

SEQ ID NO: 68945 - DNA, 12 bp, Unknown
  misc_feature (1)..( 12): Matrix.004 file - promoters50/1441985
gcattttttttt

SEQ ID NO: 68946 - DNA, 8 bp, Unknown
  misc_feature (1)..( 8): Matrix.004 file - promoters50/1441985
ttttgtcg

SEQ ID NO: 68947 - DNA, 7 bp, Unknown
  misc_feature (1)..( 7): Matrix.004 file - promoters50/1441985
aaaaaat

SEQ ID NO: 68948 - DNA, 9 bp, Unknown
  misc_feature (1)..( 9): Matrix.004 file - promoters50/1441988
aaacacaaa

SEQ ID NO: 68949 - DNA, 8 bp, Unknown
  misc_feature (1)..( 8): Matrix.004 file - promoters50/1441990
acaaaaaa

SEQ ID NO: 68950 - DNA, 9 bp, Unknown
  misc_feature (1)..( 9): Matrix.004 file - promoters50/1441990
aaatagaaa

SEQ ID NO: 68951 - DNA, 9 bp, Unknown
  misc_feature (1)..( 9): Matrix.004 file - promoters50/1441990
atatataaa

SEQ ID NO: 68952 - DNA, 11 bp, Unknown
  misc_feature (1)..( 11): Matrix.004 file - promoters50/1442015
agttataaaac

SEQ ID NO: 68953 - DNA, 10 bp, Unknown
  misc_feature (1)..( 10): Matrix.004 file - promoters50/1442015
aaagaagaaa

SEQ ID NO: 68954 - DNA, 6 bp, Unknown
  misc_feature (1)..( 6): Matrix.004 file - promoters50/1442015
tttttt

SEQ ID NO: 68955 - DNA, 11 bp, Unknown
  misc_feature (1)..( 11): Matrix.004 file - promoters50/1442015
agaaatgaatt

SEQ ID NO: 68956 - DNA, 10 bp, Unknown
  misc_feature (1)..( 10): Matrix.004 file - promoters50/1442104
attctgttat

SEQ ID NO: 68957 - DNA, 10 bp, Unknown
  misc_feature (1)..( 10): Matrix.004 file - promoters50/1442104
ttttcttatt

SEQ ID NO: 68958 - DNA, 10 bp, Unknown
  misc_feature (1)..( 10): Matrix.004 file - promoters50/1442156
ttggatttta

SEQ ID NO: 68959 - DNA, 10 bp, Unknown
  misc_feature (1)..( 10): Matrix.004 file - promoters50/1442156
aaatagttaa

SEQ ID NO: 68960 - DNA, 10 bp, Unknown
  misc_feature (1)..( 10): Matrix.004 file - promoters50/1442179
taaaaaaaaa

SEQ ID NO: 68961 - DNA, 9 bp, Unknown
  misc_feature (1)..( 9): Matrix.004 file - promoters50/1442189
actaaacaa

SEQ ID NO: 68962 - DNA, 10 bp, Unknown
  misc_feature (1)..( 10): Matrix.004 file - promoters50/1442189
aaaaactaga

SEQ ID NO: 68963 - DNA, 7 bp, Unknown
  misc_feature (1)..( 7): Matrix.004 file - promoters50/1442189
caataaa

SEQ ID NO: 68964 - DNA, 10 bp, Unknown
  misc_feature (1)..( 10): Matrix.004 file - promoters50/1442189
aaatatatca

SEQ ID NO: 68965 - DNA, 9 bp, Unknown
  misc_feature (1)..( 9): Matrix.004 file - promoters50/1442189
caataatat

SEQ ID NO: 68966 - DNA, 6 bp, Unknown
  misc_feature (1)..( 6): Matrix.004 file - promoters50/1442218
aagata

SEQ ID NO: 68967 - DNA, 10 bp, Unknown
  misc_feature (1)..( 10): Matrix.004 file - promoters50/1442218
ataaagaaag

SEQ ID NO: 68968 - DNA, 11 bp, Unknown
  misc_feature (1)..( 11): Matrix.004 file - promoters50/1442218
aaagaaagaag

SEQ ID NO: 68969 - DNA, 10 bp, Unknown
  misc_feature (1)..( 10): Matrix.004 file - promoters50/1442218
gaaaaagtgg

SEQ ID NO: 68970 - DNA, 7 bp, Unknown
  misc_feature (1)..( 7): Matrix.004 file - promoters50/1442218
agaagag

SEQ ID NO: 68971 - DNA, 10 bp, Unknown
  misc_feature (1)..( 10): Matrix.004 file - promoters50/1442218
aagtagagaa

SEQ ID NO: 68972 - DNA, 7 bp, Unknown
  misc_feature (1)..( 7): Matrix.004 file - promoters50/1442233
aagaaga

SEQ ID NO: 68973 - DNA, 10 bp, Unknown
  misc_feature (1)..( 10): Matrix.004 file - promoters50/1442233
attcttatca

SEQ ID NO: 68974 - DNA, 9 bp, Unknown
  misc_feature (1)..( 9): Matrix.004 file - promoters50/1442233
tttggatca

SEQ ID NO: 68975 - DNA, 8 bp, Unknown
  misc_feature (1)..( 8): Matrix.004 file - promoters50/1442240
atttattt

SEQ ID NO: 68976 - DNA, 15 bp, Unknown
  misc_feature (1)..( 15): Matrix.004 file - promoters50/1442240
cttttgatatataaa

SEQ ID NO: 68977 - DNA, 17 bp, Unknown
  misc_feature (1)..( 17): Matrix.004 file - promoters50/1442244
aacattttggctattag

SEQ ID NO: 68978 - DNA, 12 bp, Unknown
  misc_feature (1)..( 12): Matrix.004 file - promoters50/1442244
gcagttacaaaa

SEQ ID NO: 68979 - DNA, 9 bp, Unknown
  misc_feature (1)..( 9): Matrix.004 file - promoters50/1442244
acatcttta

SEQ ID NO: 68980 - DNA, 12 bp, Unknown
  misc_feature (1)..( 12): Matrix.004 file - promoters50/1442244
atgtaatagaac

SEQ ID NO: 68981 - DNA, 7 bp, Unknown
  misc_feature (1)..( 7): Matrix.004 file - promoters50/1442244
taaaaaa

SEQ ID NO: 68982 - DNA, 8 bp, Unknown
  misc_feature (1)..( 8): Matrix.004 file - promoters50/1442316
attaaaaa

SEQ ID NO: 68983 - DNA, 6 bp, Unknown
  misc_feature (1)..( 6): Matrix.004 file - promoters50/1442316
aaagaa

SEQ ID NO: 68984 - DNA, 10 bp, Unknown
  misc_feature (1)..( 10): Matrix.004 file - promoters50/1442316
aaacaaatat

SEQ ID NO: 68985 - DNA, 14 bp, Unknown
  misc_feature (1)..( 14): Matrix.004 file - promoters50/1442316
aattaataaaaaaa

SEQ ID NO: 68986 - DNA, 5 bp, Unknown
  misc_feature (1)..( 5): Matrix.004 file - promoters50/1442326
attat

SEQ ID NO: 68987 - DNA, 8 bp, Unknown
  misc_feature (1)..( 8): Matrix.004 file - promoters50/1442408
ccatggtt

SEQ ID NO: 68988 - DNA, 17 bp, Unknown
  misc_feature (1)..( 17): Matrix.004 file - promoters50/1442408
gatatgaaaaaatcaaa

SEQ ID NO: 68989 - DNA, 12 bp, Unknown
  misc_feature (1)..( 12): Matrix.004 file - promoters50/1442423
gactctttttct

SEQ ID NO: 68990 - DNA, 8 bp, Unknown
  misc_feature (1)..( 8): Matrix.004 file - promoters50/1442423
attctttt

SEQ ID NO: 68991 - DNA, 8 bp, Unknown
  misc_feature (1)..( 8): Matrix.004 file - promoters50/1442423
ataaaatc

SEQ ID NO: 68992 - DNA, 6 bp, Unknown
  misc_feature (1)..( 6): Matrix.004 file - promoters50/1442423
tataaa

SEQ ID NO: 68993 - DNA, 10 bp, Unknown
  misc_feature (1)..( 10): Matrix.004 file - promoters50/1442423
ataaaattta

SEQ ID NO: 68994 - DNA, 8 bp, Unknown
  misc_feature (1)..( 8): Matrix.004 file - promoters50/1442427
tctttaat

SEQ ID NO: 68995 - DNA, 10 bp, Unknown
  misc_feature (1)..( 10): Matrix.004 file - promoters50/1442452
taaatttgct

SEQ ID NO: 68996 - DNA, 17 bp, Unknown
  misc_feature (1)..( 17): Matrix.004 file - promoters50/1442452
tttatattttagaaaaa

SEQ ID NO: 68997 - DNA, 9 bp, Unknown
  misc_feature (1)..( 9): Matrix.004 file - promoters50/1442452
aattttgaa

SEQ ID NO: 68998 - DNA, 10 bp, Unknown
  misc_feature (1)..( 10): Matrix.004 file - promoters50/1442452
aaaatgttag

SEQ ID NO: 68999 - DNA, 6 bp, Unknown
  misc_feature (1)..( 6): Matrix.004 file - promoters50/1442452
tatata

SEQ ID NO: 69000 - DNA, 11 bp, Unknown
  misc_feature (1)..( 11): Matrix.004 file - promoters50/1442468
atccaacggca

SEQ ID NO: 69001 - DNA, 9 bp, Unknown
  misc_feature (1)..( 9): Matrix.004 file - promoters50/1442468
atttttttt

SEQ ID NO: 69002 - DNA, 9 bp, Unknown
  misc_feature (1)..( 9): Matrix.004 file - promoters50/1442468
cctaaacat

SEQ ID NO: 69003 - DNA, 15 bp, Unknown
  misc_feature (1)..( 15): Matrix.004 file - promoters50/1442468
agaatttcgtttttg

SEQ ID NO: 69004 - DNA, 10 bp, Unknown
  misc_feature (1)..( 10): Matrix.004 file - promoters50/1442468
aaattataaa

SEQ ID NO: 69005 - DNA, 9 bp, Unknown
  misc_feature (1)..( 9): Matrix.004 file - promoters50/1442476
aaaacaaaa

SEQ ID NO: 69006 - DNA, 12 bp, Unknown
  misc_feature (1)..( 12): Matrix.004 file - promoters50/1442476
agaatcattaaa

SEQ ID NO: 69007 - DNA, 13 bp, Unknown
  misc_feature (1)..( 13): Matrix.004 file - promoters50/1442476
ctcgtatgattct

SEQ ID NO: 69008 - DNA, 13 bp, Unknown
  misc_feature (1)..( 13): Matrix.004 file - promoters50/1442504
aagaaacaaagaa

SEQ ID NO: 69009 - DNA, 10 bp, Unknown
  misc_feature (1)..( 10): Matrix.004 file - promoters50/1442544
gtgaggatca

SEQ ID NO: 69010 - DNA, 8 bp, Unknown
  misc_feature (1)..( 8): Matrix.004 file - promoters50/1442544
aaagttga

SEQ ID NO: 69011 - DNA, 8 bp, Unknown
  misc_feature (1)..( 8): Matrix.004 file - promoters50/1442548
agaaaact

SEQ ID NO: 69012 - DNA, 12 bp, Unknown
  misc_feature (1)..( 12): Matrix.004 file - promoters50/1442548
taccatatttaa

SEQ ID NO: 69013 - DNA, 9 bp, Unknown
  misc_feature (1)..( 9): Matrix.004 file - promoters50/1442548
aataacaat

SEQ ID NO: 69014 - DNA, 12 bp, Unknown
  misc_feature (1)..( 12): Matrix.004 file - promoters50/1442552
atcttttgtaac

SEQ ID NO: 69015 - DNA, 7 bp, Unknown
  misc_feature (1)..( 7): Matrix.004 file - promoters50/1442592
aaaattc

SEQ ID NO: 69016 - DNA, 17 bp, Unknown
  misc_feature (1)..( 17): Matrix.004 file - promoters50/1442592
tccacgtcattcaatcc

SEQ ID NO: 69017 - DNA, 7 bp, Unknown
  misc_feature (1)..( 7): Matrix.004 file - promoters50/1442592
atatata

SEQ ID NO: 69018 - DNA, 9 bp, Unknown
  misc_feature (1)..( 9): Matrix.004 file - promoters50/1442592
aaaagaaat

SEQ ID NO: 69019 - DNA, 10 bp, Unknown
  misc_feature (1)..( 10): Matrix.004 file - promoters50/1442592
atattttaat

SEQ ID NO: 69020 - DNA, 7 bp, Unknown
  misc_feature (1)..( 7): Matrix.004 file - promoters50/1442592
taaatgt

SEQ ID NO: 69021 - DNA, 11 bp, Unknown
  misc_feature (1)..( 11): Matrix.004 file - promoters50/1442592
ttttgatgaat

SEQ ID NO: 69022 - DNA, 9 bp, Unknown
  misc_feature (1)..( 9): Matrix.004 file - promoters50/1442649
attttgaat

SEQ ID NO: 69023 - DNA, 6 bp, Unknown
  misc_feature (1)..( 6): Matrix.004 file - promoters50/1442649
ttaatt

SEQ ID NO: 69024 - DNA, 10 bp, Unknown
  misc_feature (1)..( 10): Matrix.004 file - promoters50/1442649
aaaatccttt

SEQ ID NO: 69025 - DNA, 9 bp, Unknown
  misc_feature (1)..( 9): Matrix.004 file - promoters50/1442777
aaaaccaat

SEQ ID NO: 69026 - DNA, 13 bp, Unknown
  misc_feature (1)..( 13): Matrix.004 file - promoters50/1442777
atgtataacttca

SEQ ID NO: 69027 - DNA, 11 bp, Unknown
  misc_feature (1)..( 11): Matrix.004 file - promoters50/1442777
tgtatataaaa

SEQ ID NO: 69028 - DNA, 8 bp, Unknown
  misc_feature (1)..( 8): Matrix.004 file - promoters50/1442777
taatgtga

SEQ ID NO: 69029 - DNA, 13 bp, Unknown
  misc_feature (1)..( 13): Matrix.004 file - promoters50/1442777
aaataaatttttt

SEQ ID NO: 69030 - DNA, 17 bp, Unknown
  misc_feature (1)..( 17): Matrix.004 file - promoters50/1442848
aggctaaaatatcgtta

SEQ ID NO: 69031 - DNA, 11 bp, Unknown
  misc_feature (1)..( 11): Matrix.004 file - promoters50/1442887
attaccaaatt

SEQ ID NO: 69032 - DNA, 11 bp, Unknown
  misc_feature (1)..( 11): Matrix.004 file - promoters50/1442887
ttacatgatta

SEQ ID NO: 69033 - DNA, 6 bp, Unknown
  misc_feature (1)..( 6): Matrix.004 file - promoters50/1442887
ttgggt

SEQ ID NO: 69034 - DNA, 7 bp, Unknown
  misc_feature (1)..( 7): Matrix.004 file - promoters50/1442887
aatatca

SEQ ID NO: 69035 - DNA, 8 bp, Unknown
  misc_feature (1)..( 8): Matrix.004 file - promoters50/1442887
tgtttggt

SEQ ID NO: 69036 - DNA, 9 bp, Unknown
  misc_feature (1)..( 9): Matrix.004 file - promoters50/1442887
gaaaaaaag

SEQ ID NO: 69037 - DNA, 9 bp, Unknown
  misc_feature (1)..( 9): Matrix.004 file - promoters50/1442945
aaagtaaag

SEQ ID NO: 69038 - DNA, 8 bp, Unknown
  misc_feature (1)..( 8): Matrix.004 file - promoters50/1442945
attataat

SEQ ID NO: 69039 - DNA, 10 bp, Unknown
  misc_feature (1)..( 10): Matrix.004 file - promoters50/1442967
ttataattaa

SEQ ID NO: 69040 - DNA, 10 bp, Unknown
  misc_feature (1)..( 10): Matrix.004 file - promoters50/1442967
gataaaggtc

SEQ ID NO: 69041 - DNA, 9 bp, Unknown
  misc_feature (1)..( 9): Matrix.004 file - promoters50/1442967
aaagaaaat

SEQ ID NO: 69042 - DNA, 10 bp, Unknown
  misc_feature (1)..( 10): Matrix.004 file - promoters50/1442975
tcagtagtta

SEQ ID NO: 69043 - DNA, 9 bp, Unknown
  misc_feature (1)..( 9): Matrix.004 file - promoters50/1443011
tgaaaacta

SEQ ID NO: 69044 - DNA, 11 bp, Unknown
  misc_feature (1)..( 11): Matrix.004 file - promoters50/1443019
aattataatat

SEQ ID NO: 69045 - DNA, 11 bp, Unknown
  misc_feature (1)..( 11): Matrix.004 file - promoters50/1443021
tcggtttcttg

SEQ ID NO: 69046 - DNA, 12 bp, Unknown
  misc_feature (1)..( 12): Matrix.004 file - promoters50/1443021
tcaaaatttatc

SEQ ID NO: 69047 - DNA, 10 bp, Unknown
  misc_feature (1)..( 10): Matrix.004 file - promoters50/1443021
caataaatat

SEQ ID NO: 69048 - DNA, 8 bp, Unknown
  misc_feature (1)..( 8): Matrix.004 file - promoters50/1443021
atgaaaac

SEQ ID NO: 69049 - DNA, 8 bp, Unknown
  misc_feature (1)..( 8): Matrix.004 file - promoters50/1443029
aaagcttg

SEQ ID NO: 69050 - DNA, 8 bp, Unknown
  misc_feature (1)..( 8): Matrix.004 file - promoters50/1443029
gtttactt

SEQ ID NO: 69051 - DNA, 8 bp, Unknown
  misc_feature (1)..( 8): Matrix.004 file - promoters50/1443029
tcaaaaat

SEQ ID NO: 69052 - DNA, 9 bp, Unknown
  misc_feature (1)..( 9): Matrix.004 file - promoters50/1443067
agatttata

SEQ ID NO: 69053 - DNA, 10 bp, Unknown
  misc_feature (1)..( 10): Matrix.004 file - promoters50/1443067
gataacctta

SEQ ID NO: 69054 - DNA, 9 bp, Unknown
  misc_feature (1)..( 9): Matrix.004 file - promoters50/1443067
aacattttg

SEQ ID NO: 69055 - DNA, 10 bp, Unknown
  misc_feature (1)..( 10): Matrix.004 file - promoters50/1443075
tttaaagctt

SEQ ID NO: 69056 - DNA, 13 bp, Unknown
  misc_feature (1)..( 13): Matrix.004 file - promoters50/1443083
aaatcattttcaa

SEQ ID NO: 69057 - DNA, 9 bp, Unknown
  misc_feature (1)..( 9): Matrix.004 file - promoters50/1443083
tatataaat

SEQ ID NO: 69058 - DNA, 7 bp, Unknown
  misc_feature (1)..( 7): Matrix.004 file - promoters50/1443083
aaacaaa

SEQ ID NO: 69059 - DNA, 18 bp, Unknown
  misc_feature (1)..( 18): Matrix.004 file - promoters50/1443083
aatcaaaaacaaataaga

SEQ ID NO: 69060 - DNA, 8 bp, Unknown
  misc_feature (1)..( 8): Matrix.004 file - promoters50/1443083
aaaataaa

SEQ ID NO: 69061 - DNA, 7 bp, Unknown
  misc_feature (1)..( 7): Matrix.004 file - promoters50/1443083
tatttta

SEQ ID NO: 69062 - DNA, 9 bp, Unknown
  misc_feature (1)..( 9): Matrix.004 file - promoters50/1443114
aatgttctt

SEQ ID NO: 69063 - DNA, 9 bp, Unknown
  misc_feature (1)..( 9): Matrix.004 file - promoters50/1443114
tcaaagaat

SEQ ID NO: 69064 - DNA, 9 bp, Unknown
  misc_feature (1)..( 9): Matrix.004 file - promoters50/1443114
aactaaaaa

SEQ ID NO: 69065 - DNA, 11 bp, Unknown
  misc_feature (1)..( 11): Matrix.004 file - promoters50/1443114
gcaattaaaat

SEQ ID NO: 69066 - DNA, 13 bp, Unknown
  misc_feature (1)..( 13): Matrix.004 file - promoters50/1443178
gagaaaaaagaaa

SEQ ID NO: 69067 - DNA, 11 bp, Unknown
  misc_feature (1)..( 11): Matrix.004 file - promoters50/1443178
aaaaaacaaaa

SEQ ID NO: 69068 - DNA, 8 bp, Unknown
  misc_feature (1)..( 8): Matrix.004 file - promoters50/1443184
aaaaaccg

SEQ ID NO: 69069 - DNA, 11 bp, Unknown
  misc_feature (1)..( 11): Matrix.004 file - promoters50/1443184
ataatttgagt

SEQ ID NO: 69070 - DNA, 10 bp, Unknown
  misc_feature (1)..( 10): Matrix.004 file - promoters50/1443184
aatttattca

SEQ ID NO: 69071 - DNA, 10 bp, Unknown
  misc_feature (1)..( 10): Matrix.004 file - promoters50/1443184
agaaaaaaga

SEQ ID NO: 69072 - DNA, 9 bp, Unknown
  misc_feature (1)..( 9): Matrix.004 file - promoters50/1443184
acttataaa

SEQ ID NO: 69073 - DNA, 8 bp, Unknown
  misc_feature (1)..( 8): Matrix.004 file - promoters50/1443184
aggaggaa

SEQ ID NO: 69074 - DNA, 8 bp, Unknown
  misc_feature (1)..( 8): Matrix.004 file - promoters50/1443192
gttacaac

SEQ ID NO: 69075 - DNA, 15 bp, Unknown
  misc_feature (1)..( 15): Matrix.004 file - promoters50/1443192
aaaaattaattaaag

SEQ ID NO: 69076 - DNA, 11 bp, Unknown
  misc_feature (1)..( 11): Matrix.004 file - promoters50/1443192
atttaactaat

SEQ ID NO: 69077 - DNA, 11 bp, Unknown
  misc_feature (1)..( 11): Matrix.004 file - promoters50/1443192
ataatttttaa

SEQ ID NO: 69078 - DNA, 10 bp, Unknown
  misc_feature (1)..( 10): Matrix.004 file - promoters50/1443256
ctatatatat

SEQ ID NO: 69079 - DNA, 6 bp, Unknown
  misc_feature (1)..( 6): Matrix.004 file - promoters50/1443271
actctt

SEQ ID NO: 69080 - DNA, 8 bp, Unknown
  misc_feature (1)..( 8): Matrix.004 file - promoters50/1443271
cataaaaa

SEQ ID NO: 69081 - DNA, 8 bp, Unknown
  misc_feature (1)..( 8): Matrix.004 file - promoters50/1443271
tgtttttc

SEQ ID NO: 69082 - DNA, 9 bp, Unknown
  misc_feature (1)..( 9): Matrix.004 file - promoters50/1443271
gtttaattt

SEQ ID NO: 69083 - DNA, 8 bp, Unknown
  misc_feature (1)..( 8): Matrix.004 file - promoters50/1443276
aaaaatta

SEQ ID NO: 69084 - DNA, 9 bp, Unknown
  misc_feature (1)..( 9): Matrix.004 file - promoters50/1443276
aatttaata

SEQ ID NO: 69085 - DNA, 8 bp, Unknown
  misc_feature (1)..( 8): Matrix.004 file - promoters50/1443276
aaaaggaa

SEQ ID NO: 69086 - DNA, 10 bp, Unknown
  misc_feature (1)..( 10): Matrix.004 file - promoters50/1443276
aaatattatt

SEQ ID NO: 69087 - DNA, 9 bp, Unknown
  misc_feature (1)..( 9): Matrix.004 file - promoters50/1443276
gactaaaag

SEQ ID NO: 69088 - DNA, 8 bp, Unknown
  misc_feature (1)..( 8): Matrix.004 file - promoters50/1443276
aaagtcta

SEQ ID NO: 69089 - DNA, 8 bp, Unknown
  misc_feature (1)..( 8): Matrix.004 file - promoters50/1443276
tcaataaa

SEQ ID NO: 69090 - DNA, 9 bp, Unknown
  misc_feature (1)..( 9): Matrix.004 file - promoters50/1443276
taacaaaaa

SEQ ID NO: 69091 - DNA, 8 bp, Unknown
  misc_feature (1)..( 8): Matrix.004 file - promoters50/1443276
agaaaaat

SEQ ID NO: 69092 - DNA, 9 bp, Unknown
  misc_feature (1)..( 9): Matrix.004 file - promoters50/1443276
tatataaat

SEQ ID NO: 69093 - DNA, 9 bp, Unknown
  misc_feature (1)..( 9): Matrix.004 file - promoters50/1443283
aaacaaaaa

SEQ ID NO: 69094 - DNA, 8 bp, Unknown
  misc_feature (1)..( 8): Matrix.004 file - promoters50/1443306
taaaaatg

SEQ ID NO: 69095 - DNA, 12 bp, Unknown
  misc_feature (1)..( 12): Matrix.004 file - promoters50/1443306
taaaaaataatt

SEQ ID NO: 69096 - DNA, 13 bp, Unknown
  misc_feature (1)..( 13): Matrix.004 file - promoters50/1443306
tacattttcttac

SEQ ID NO: 69097 - DNA, 12 bp, Unknown
  misc_feature (1)..( 12): Matrix.004 file - promoters50/1443306
taaatataaata

SEQ ID NO: 69098 - DNA, 10 bp, Unknown
  misc_feature (1)..( 10): Matrix.004 file - promoters50/1443306
attattttta

SEQ ID NO: 69099 - DNA, 10 bp, Unknown
  misc_feature (1)..( 10): Matrix.004 file - promoters50/1443306
attttgttaa

SEQ ID NO: 69100 - DNA, 7 bp, Unknown
  misc_feature (1)..( 7): Matrix.004 file - promoters50/1443306
taaaaaa

SEQ ID NO: 69101 - DNA, 10 bp, Unknown
  misc_feature (1)..( 10): Matrix.004 file - promoters50/1443338
ttttgcaaat

SEQ ID NO: 69102 - DNA, 9 bp, Unknown
  misc_feature (1)..( 9): Matrix.004 file - promoters50/1443342
tcttataat

SEQ ID NO: 69103 - DNA, 10 bp, Unknown
  misc_feature (1)..( 10): Matrix.004 file - promoters50/1443342
ataattaacc

SEQ ID NO: 69104 - DNA, 15 bp, Unknown
  misc_feature (1)..( 15): Matrix.004 file - promoters50/1443342
ttcatatatgttaag

SEQ ID NO: 69105 - DNA, 14 bp, Unknown
  misc_feature (1)..( 14): Matrix.004 file - promoters50/1443349
caatttctatttct

SEQ ID NO: 69106 - DNA, 11 bp, Unknown
  misc_feature (1)..( 11): Matrix.004 file - promoters50/1443349
ttttgatgaat

SEQ ID NO: 69107 - DNA, 14 bp, Unknown
  misc_feature (1)..( 14): Matrix.004 file - promoters50/1443349
taaaaaaagagatt

SEQ ID NO: 69108 - DNA, 9 bp, Unknown
  misc_feature (1)..( 9): Matrix.004 file - promoters50/1443349
atatataaa

SEQ ID NO: 69109 - DNA, 13 bp, Unknown
  misc_feature (1)..( 13): Matrix.004 file - promoters50/1443349
aaatctttataac

SEQ ID NO: 69110 - DNA, 15 bp, Unknown
  misc_feature (1)..( 15): Matrix.004 file - promoters50/1443349
ataactttataaaat

SEQ ID NO: 69111 - DNA, 12 bp, Unknown
  misc_feature (1)..( 12): Matrix.004 file - promoters50/1443349
aaaaatatgtac

SEQ ID NO: 69112 - DNA, 15 bp, Unknown
  misc_feature (1)..( 15): Matrix.004 file - promoters50/1443356
aaattttaaaatata

SEQ ID NO: 69113 - DNA, 9 bp, Unknown
  misc_feature (1)..( 9): Matrix.004 file - promoters50/1443356
aaccgattt

SEQ ID NO: 69114 - DNA, 7 bp, Unknown
  misc_feature (1)..( 7): Matrix.004 file - promoters50/1443387
aaacaat

SEQ ID NO: 69115 - DNA, 9 bp, Unknown
  misc_feature (1)..( 9): Matrix.004 file - promoters50/1443387
atcaaccat

SEQ ID NO: 69116 - DNA, 8 bp, Unknown
  misc_feature (1)..( 8): Matrix.004 file - promoters50/1443387
aaaattga

SEQ ID NO: 69117 - DNA, 13 bp, Unknown
  misc_feature (1)..( 13): Matrix.004 file - promoters50/1443418
ttgctcatttact

SEQ ID NO: 69118 - DNA, 8 bp, Unknown
  misc_feature (1)..( 8): Matrix.004 file - promoters50/1443418
atttatta

SEQ ID NO: 69119 - DNA, 10 bp, Unknown
  misc_feature (1)..( 10): Matrix.004 file - promoters50/1443418
atttatttaa

SEQ ID NO: 69120 - DNA, 13 bp, Unknown
  misc_feature (1)..( 13): Matrix.004 file - promoters50/1443418
tgatcaaaataaa

SEQ ID NO: 69121 - DNA, 9 bp, Unknown
  misc_feature (1)..( 9): Matrix.004 file - promoters50/1443418
tatatataa

SEQ ID NO: 69122 - DNA, 11 bp, Unknown
  misc_feature (1)..( 11): Matrix.004 file - promoters50/1443418
ttataatgtta

SEQ ID NO: 69123 - DNA, 13 bp, Unknown
  misc_feature (1)..( 13): Matrix.004 file - promoters50/1443418
ttaaaaagttaga

SEQ ID NO: 69124 - DNA, 10 bp, Unknown
  misc_feature (1)..( 10): Matrix.004 file - promoters50/1443472
aaatttaatt

SEQ ID NO: 69125 - DNA, 7 bp, Unknown
  misc_feature (1)..( 7): Matrix.004 file - promoters50/1443472
atgtatt

SEQ ID NO: 69126 - DNA, 8 bp, Unknown
  misc_feature (1)..( 8): Matrix.004 file - promoters50/1443475
ctgtgttt

SEQ ID NO: 69127 - DNA, 7 bp, Unknown
  misc_feature (1)..( 7): Matrix.004 file - promoters50/1443475
ttttttc

SEQ ID NO: 69128 - DNA, 8 bp, Unknown
  misc_feature (1)..( 8): Matrix.004 file - promoters50/1443479
caagtttt

SEQ ID NO: 69129 - DNA, 9 bp, Unknown
  misc_feature (1)..( 9): Matrix.004 file - promoters50/1443479
caaaaaaag

SEQ ID NO: 69130 - DNA, 11 bp, Unknown
  misc_feature (1)..( 11): Matrix.004 file - promoters50/1443509
tttcaaaaaac

SEQ ID NO: 69131 - DNA, 12 bp, Unknown
  misc_feature (1)..( 12): Matrix.004 file - promoters50/1443509
taatattttttt

SEQ ID NO: 69132 - DNA, 13 bp, Unknown
  misc_feature (1)..( 13): Matrix.004 file - promoters50/1443527
ttatctaatatat

SEQ ID NO: 69133 - DNA, 7 bp, Unknown
  misc_feature (1)..( 7): Matrix.004 file - promoters50/1443683
gtgatat

SEQ ID NO: 69134 - DNA, 9 bp, Unknown
  misc_feature (1)..( 9): Matrix.004 file - promoters50/1443687
atatataaa

SEQ ID NO: 69135 - DNA, 14 bp, Unknown
  misc_feature (1)..( 14): Matrix.004 file - promoters50/1443687
aaatttatcttaaa

SEQ ID NO: 69136 - DNA, 12 bp, Unknown
  misc_feature (1)..( 12): Matrix.004 file - promoters50/1443687
tttcaaagacaa

SEQ ID NO: 69137 - DNA, 7 bp, Unknown
  misc_feature (1)..( 7): Matrix.004 file - promoters50/1443687
aataaca

SEQ ID NO: 69138 - DNA, 9 bp, Unknown
  misc_feature (1)..( 9): Matrix.004 file - promoters50/1443687
tattttgaa

SEQ ID NO: 69139 - DNA, 7 bp, Unknown
  misc_feature (1)..( 7): Matrix.004 file - promoters50/1443687
aaaaaca

SEQ ID NO: 69140 - DNA, 10 bp, Unknown
  misc_feature (1)..( 10): Matrix.004 file - promoters50/1443711
taaaatttta

SEQ ID NO: 69141 - DNA, 7 bp, Unknown
  misc_feature (1)..( 7): Matrix.004 file - promoters50/1443711
aatatag

SEQ ID NO: 69142 - DNA, 10 bp, Unknown
  misc_feature (1)..( 10): Matrix.004 file - promoters50/1444131
attataaaat

SEQ ID NO: 69143 - DNA, 9 bp, Unknown
  misc_feature (1)..( 9): Matrix.004 file - promoters50/1444131
atagttaaa

SEQ ID NO: 69144 - DNA, 7 bp, Unknown
  misc_feature (1)..( 7): Matrix.004 file - promoters50/1444156
ttatttc

SEQ ID NO: 69145 - DNA, 9 bp, Unknown
  misc_feature (1)..( 9): Matrix.004 file - promoters50/1444156
aaaataaaa

SEQ ID NO: 69146 - DNA, 10 bp, Unknown
  misc_feature (1)..( 10): Matrix.004 file - promoters50/1444156
ggaaaagaaa

SEQ ID NO: 69147 - DNA, 7 bp, Unknown
  misc_feature (1)..( 7): Matrix.004 file - promoters50/1444156
tttaata

SEQ ID NO: 69148 - DNA, 11 bp, Unknown
  misc_feature (1)..( 11): Matrix.004 file - promoters50/1444156
cttgaaacaaa

SEQ ID NO: 69149 - DNA, 9 bp, Unknown
  misc_feature (1)..( 9): Matrix.004 file - promoters50/1444180
aaatgaaga

SEQ ID NO: 69150 - DNA, 9 bp, Unknown
  misc_feature (1)..( 9): Matrix.004 file - promoters50/1444180
gaaacaaaa

SEQ ID NO: 69151 - DNA, 7 bp, Unknown
  misc_feature (1)..( 7): Matrix.004 file - promoters50/1444180
tcatatc

SEQ ID NO: 69152 - DNA, 9 bp, Unknown
  misc_feature (1)..( 9): Matrix.004 file - promoters50/1444180
atatctttg

SEQ ID NO: 69153 - DNA, 8 bp, Unknown
  misc_feature (1)..( 8): Matrix.004 file - promoters50/1444196
gtatataa

SEQ ID NO: 69154 - DNA, 11 bp, Unknown
  misc_feature (1)..( 11): Matrix.004 file - promoters50/1444196
tttttgaaatt

SEQ ID NO: 69155 - DNA, 10 bp, Unknown
  misc_feature (1)..( 10): Matrix.004 file - promoters50/1444400
tcttctgttt

SEQ ID NO: 69156 - DNA, 12 bp, Unknown
  misc_feature (1)..( 12): Matrix.004 file - promoters50/1444430
tgtgttcgtctg

SEQ ID NO: 69157 - DNA, 7 bp, Unknown
  misc_feature (1)..( 7): Matrix.004 file - promoters50/1444441
attcttt

SEQ ID NO: 69158 - DNA, 13 bp, Unknown
  misc_feature (1)..( 13): Matrix.004 file - promoters50/1444441
aattatttttaat

SEQ ID NO: 69159 - DNA, 7 bp, Unknown
  misc_feature (1)..( 7): Matrix.004 file - promoters50/1444441
attttta

SEQ ID NO: 69160 - DNA, 12 bp, Unknown
  misc_feature (1)..( 12): Matrix.004 file - promoters50/1444441
tttattaataat

SEQ ID NO: 69161 - DNA, 13 bp, Unknown
  misc_feature (1)..( 13): Matrix.004 file - promoters50/1444441
actattttgatta

SEQ ID NO: 69162 - DNA, 13 bp, Unknown
  misc_feature (1)..( 13): Matrix.004 file - promoters50/1444441
acgttttttgttt

SEQ ID NO: 69163 - DNA, 13 bp, Unknown
  misc_feature (1)..( 13): Matrix.004 file - promoters50/1444441
attatttaatcta

SEQ ID NO: 69164 - DNA, 10 bp, Unknown
  misc_feature (1)..( 10): Matrix.004 file - promoters50/1444441
taatattttt

SEQ ID NO: 69165 - DNA, 10 bp, Unknown
  misc_feature (1)..( 10): Matrix.004 file - promoters50/1444443
aaatcttttc

SEQ ID NO: 69166 - DNA, 16 bp, Unknown
  misc_feature (1)..( 16): Matrix.004 file - promoters50/1444443
aactaaaaagtataaa

SEQ ID NO: 69167 - DNA, 7 bp, Unknown
  misc_feature (1)..( 7): Matrix.004 file - promoters50/1444443
tttattt

SEQ ID NO: 69168 - DNA, 8 bp, Unknown
  misc_feature (1)..( 8): Matrix.004 file - promoters50/1444448
atgttttt

SEQ ID NO: 69169 - DNA, 7 bp, Unknown
  misc_feature (1)..( 7): Matrix.004 file - promoters50/1444448
tgtttta

SEQ ID NO: 69170 - DNA, 8 bp, Unknown
  misc_feature (1)..( 8): Matrix.004 file - promoters50/1444448
ataaataa

SEQ ID NO: 69171 - DNA, 8 bp, Unknown
  misc_feature (1)..( 8): Matrix.004 file - promoters50/1444448
ttaaattc

SEQ ID NO: 69172 - DNA, 7 bp, Unknown
  misc_feature (1)..( 7): Matrix.004 file - promoters50/1444473
tttttga

SEQ ID NO: 69173 - DNA, 11 bp, Unknown
  misc_feature (1)..( 11): Matrix.004 file - promoters50/1444479
taatgttttta

SEQ ID NO: 69174 - DNA, 11 bp, Unknown
  misc_feature (1)..( 11): Matrix.004 file - promoters50/1444479
attattaaaat

SEQ ID NO: 69175 - DNA, 10 bp, Unknown
  misc_feature (1)..( 10): Matrix.004 file - promoters50/1444479
tttactaatc

SEQ ID NO: 69176 - DNA, 11 bp, Unknown
  misc_feature (1)..( 11): Matrix.004 file - promoters50/1444479
ataatttttaa

SEQ ID NO: 69177 - DNA, 10 bp, Unknown
  misc_feature (1)..( 10): Matrix.004 file - promoters50/1444479
atatttttac

SEQ ID NO: 69178 - DNA, 13 bp, Unknown
  misc_feature (1)..( 13): Matrix.004 file - promoters50/1444502
ctatatataaata

SEQ ID NO: 69179 - DNA, 8 bp, Unknown
  misc_feature (1)..( 8): Matrix.004 file - promoters50/1444502
ttgaatat

SEQ ID NO: 69180 - DNA, 10 bp, Unknown
  misc_feature (1)..( 10): Matrix.004 file - promoters50/1444502
cattttttgt

SEQ ID NO: 69181 - DNA, 7 bp, Unknown
  misc_feature (1)..( 7): Matrix.004 file - promoters50/1444502
caaaaaa

SEQ ID NO: 69182 - DNA, 11 bp, Unknown
  misc_feature (1)..( 11): Matrix.004 file - promoters50/1444506
atttgtttgtt

SEQ ID NO: 69183 - DNA, 16 bp, Unknown
  misc_feature (1)..( 16): Matrix.004 file - promoters50/1444506
aaaatatgaatctaaa

SEQ ID NO: 69184 - DNA, 10 bp, Unknown
  misc_feature (1)..( 10): Matrix.004 file - promoters50/1444506
attttaccca

SEQ ID NO: 69185 - DNA, 11 bp, Unknown
  misc_feature (1)..( 11): Matrix.004 file - promoters50/1444506
actatatataa

SEQ ID NO: 69186 - DNA, 10 bp, Unknown
  misc_feature (1)..( 10): Matrix.004 file - promoters50/1444514
atatttgtta

SEQ ID NO: 69187 - DNA, 10 bp, Unknown
  misc_feature (1)..( 10): Matrix.004 file - promoters50/1444514
aaaattaata

SEQ ID NO: 69188 - DNA, 9 bp, Unknown
  misc_feature (1)..( 9): Matrix.004 file - promoters50/1444514
attatacta

SEQ ID NO: 69189 - DNA, 10 bp, Unknown
  misc_feature (1)..( 10): Matrix.004 file - promoters50/1444514
atttatatat

SEQ ID NO: 69190 - DNA, 11 bp, Unknown
  misc_feature (1)..( 11): Matrix.004 file - promoters50/1444514
tcctaaatcat

SEQ ID NO: 69191 - DNA, 9 bp, Unknown
  misc_feature (1)..( 9): Matrix.004 file - promoters50/1444514
taattgtta

SEQ ID NO: 69192 - DNA, 10 bp, Unknown
  misc_feature (1)..( 10): Matrix.004 file - promoters50/1444567
atatttgtta

SEQ ID NO: 69193 - DNA, 7 bp, Unknown
  misc_feature (1)..( 7): Matrix.004 file - promoters50/1444567
atagaat

SEQ ID NO: 69194 - DNA, 10 bp, Unknown
  misc_feature (1)..( 10): Matrix.004 file - promoters50/1444567
aaaaatcaat

SEQ ID NO: 69195 - DNA, 7 bp, Unknown
  misc_feature (1)..( 7): Matrix.004 file - promoters50/1444567
ttaaaat

SEQ ID NO: 69196 - DNA, 7 bp, Unknown
  misc_feature (1)..( 7): Matrix.004 file - promoters50/1444567
aataatc

SEQ ID NO: 69197 - DNA, 11 bp, Unknown
  misc_feature (1)..( 11): Matrix.004 file - promoters50/1444607
aaattcaatca

SEQ ID NO: 69198 - DNA, 7 bp, Unknown
  misc_feature (1)..( 7): Matrix.004 file - promoters50/1444629
aagagaa

SEQ ID NO: 69199 - DNA, 15 bp, Unknown
  misc_feature (1)..( 15): Matrix.004 file - promoters50/1446208
aacatttttacattt

SEQ ID NO: 69200 - DNA, 9 bp, Unknown
  misc_feature (1)..( 9): Matrix.004 file - promoters50/1446208
taaagataa

SEQ ID NO: 69201 - DNA, 6 bp, Unknown
  misc_feature (1)..( 6): Matrix.004 file - promoters50/1446208
tacaaa

SEQ ID NO: 69202 - DNA, 9 bp, Unknown
  misc_feature (1)..( 9): Matrix.004 file - promoters50/1446368
attttaatg

SEQ ID NO: 69203 - DNA, 9 bp, Unknown
  misc_feature (1)..( 9): Matrix.004 file - promoters50/1446368
aaaaaatta

SEQ ID NO: 69204 - DNA, 9 bp, Unknown
  misc_feature (1)..( 9): Matrix.004 file - promoters50/1446456
ataaattaa

SEQ ID NO: 69205 - DNA, 10 bp, Unknown
  misc_feature (1)..( 10): Matrix.004 file - promoters50/1446456
atacattttt

SEQ ID NO: 69206 - DNA, 8 bp, Unknown
  misc_feature (1)..( 8): Matrix.004 file - promoters50/1446584
aaataaat

SEQ ID NO: 69207 - DNA, 10 bp, Unknown
  misc_feature (1)..( 10): Matrix.004 file - promoters50/1446636
ataaatttgt

SEQ ID NO: 69208 - DNA, 9 bp, Unknown
  misc_feature (1)..( 9): Matrix.004 file - promoters50/1446636
aaaaggata

SEQ ID NO: 69209 - DNA, 10 bp, Unknown
  misc_feature (1)..( 10): Matrix.004 file - promoters50/1446636
aattttgata

SEQ ID NO: 69210 - DNA, 8 bp, Unknown
  misc_feature (1)..( 8): Matrix.004 file - promoters50/1446636
aaattttg

SEQ ID NO: 69211 - DNA, 9 bp, Unknown
  misc_feature (1)..( 9): Matrix.004 file - promoters50/1446854
agatttttc

SEQ ID NO: 69212 - DNA, 10 bp, Unknown
  misc_feature (1)..( 10): Matrix.004 file - promoters50/1447035
tataaccaaa

SEQ ID NO: 69213 - DNA, 8 bp, Unknown
  misc_feature (1)..( 8): Matrix.004 file - promoters50/1447035
gttgagag

SEQ ID NO: 69214 - DNA, 6 bp, Unknown
  misc_feature (1)..( 6): Matrix.004 file - promoters50/1447035
gaaaaa

SEQ ID NO: 69215 - DNA, 9 bp, Unknown
  misc_feature (1)..( 9): Matrix.004 file - promoters50/1447035
tatgtataa

SEQ ID NO: 69216 - DNA, 8 bp, Unknown
  misc_feature (1)..( 8): Matrix.004 file - promoters50/1447217
aaaattcg

SEQ ID NO: 69217 - DNA, 11 bp, Unknown
  misc_feature (1)..( 11): Matrix.004 file - promoters50/1447217
aaaaaaaaaaa

SEQ ID NO: 69218 - DNA, 9 bp, Unknown
  misc_feature (1)..( 9): Matrix.004 file - promoters50/1447217
aaaaacaaa

SEQ ID NO: 69219 - DNA, 13 bp, Unknown
  misc_feature (1)..( 13): Matrix.004 file - promoters50/1447217
gaaataatttaaa

SEQ ID NO: 69220 - DNA, 8 bp, Unknown
  misc_feature (1)..( 8): Matrix.004 file - promoters50/1447217
tataatta

SEQ ID NO: 69221 - DNA, 8 bp, Unknown
  misc_feature (1)..( 8): Matrix.004 file - promoters50/1447228
aaaaacaa

SEQ ID NO: 69222 - DNA, 9 bp, Unknown
  misc_feature (1)..( 9): Matrix.004 file - promoters50/1447321
ttggaagaa

SEQ ID NO: 69223 - DNA, 8 bp, Unknown
  misc_feature (1)..( 8): Matrix.004 file - promoters50/1447321
ttttgaat

SEQ ID NO: 69224 - DNA, 11 bp, Unknown
  misc_feature (1)..( 11): Matrix.004 file - promoters50/1447321
aaaaatgtgaa

SEQ ID NO: 69225 - DNA, 14 bp, Unknown
  misc_feature (1)..( 14): Matrix.004 file - promoters50/1447321
aaccaaattctaag

SEQ ID NO: 69226 - DNA, 10 bp, Unknown
  misc_feature (1)..( 10): Matrix.004 file - promoters50/1447321
tgtaataatt

SEQ ID NO: 69227 - DNA, 8 bp, Unknown
  misc_feature (1)..( 8): Matrix.004 file - promoters50/1447352
taattttt

SEQ ID NO: 69228 - DNA, 10 bp, Unknown
  misc_feature (1)..( 10): Matrix.004 file - promoters50/1447379
cttgaattca

SEQ ID NO: 69229 - DNA, 11 bp, Unknown
  misc_feature (1)..( 11): Matrix.004 file - promoters50/1447379
aatgaaataaa

SEQ ID NO: 69230 - DNA, 7 bp, Unknown
  misc_feature (1)..( 7): Matrix.004 file - promoters50/1447425
tttcctc

SEQ ID NO: 69231 - DNA, 10 bp, Unknown
  misc_feature (1)..( 10): Matrix.004 file - promoters50/1447543
ttaaacaatc

SEQ ID NO: 69232 - DNA, 9 bp, Unknown
  misc_feature (1)..( 9): Matrix.004 file - promoters50/1447543
tacaaaaaa

SEQ ID NO: 69233 - DNA, 10 bp, Unknown
  misc_feature (1)..( 10): Matrix.004 file - promoters50/1447543
ataaaaatca

SEQ ID NO: 69234 - DNA, 4 bp, Unknown
  misc_feature (1)..( 4): Matrix.004 file - promoters50/1447543
taat

SEQ ID NO: 69235 - DNA, 11 bp, Unknown
  misc_feature (1)..( 11): Matrix.004 file - promoters50/1447543
atgtaaattaa

SEQ ID NO: 69236 - DNA, 9 bp, Unknown
  misc_feature (1)..( 9): Matrix.004 file - promoters50/1447543
ttaagttag

SEQ ID NO: 69237 - DNA, 9 bp, Unknown
  misc_feature (1)..( 9): Matrix.004 file - promoters50/1447543
ttaattaag

SEQ ID NO: 69238 - DNA, 8 bp, Unknown
  misc_feature (1)..( 8): Matrix.004 file - promoters50/1447543
aaaaataa

SEQ ID NO: 69239 - DNA, 14 bp, Unknown
  misc_feature (1)..( 14): Matrix.004 file - promoters50/1447543
aatatctttttatt

SEQ ID NO: 69240 - DNA, 9 bp, Unknown
  misc_feature (1)..( 9): Matrix.004 file - promoters50/1447543
atttttatc

SEQ ID NO: 69241 - DNA, 8 bp, Unknown
  misc_feature (1)..( 8): Matrix.004 file - promoters50/1447543
gtaaaatt

SEQ ID NO: 69242 - DNA, 7 bp, Unknown
  misc_feature (1)..( 7): Matrix.004 file - promoters50/1447577
tcataat

SEQ ID NO: 69243 - DNA, 8 bp, Unknown
  misc_feature (1)..( 8): Matrix.004 file - promoters50/1447577
tcaaatat

SEQ ID NO: 69244 - DNA, 6 bp, Unknown
  misc_feature (1)..( 6): Matrix.004 file - promoters50/1447577
aataat

SEQ ID NO: 69245 - DNA, 8 bp, Unknown
  misc_feature (1)..( 8): Matrix.004 file - promoters50/1447577
aataataa

SEQ ID NO: 69246 - DNA, 7 bp, Unknown
  misc_feature (1)..( 7): Matrix.004 file - promoters50/1447577
aataata

SEQ ID NO: 69247 - DNA, 8 bp, Unknown
  misc_feature (1)..( 8): Matrix.004 file - promoters50/1447591
aatagtgg

SEQ ID NO: 69248 - DNA, 7 bp, Unknown
  misc_feature (1)..( 7): Matrix.004 file - promoters50/1447591
acaaaaa

SEQ ID NO: 69249 - DNA, 11 bp, Unknown
  misc_feature (1)..( 11): Matrix.004 file - promoters50/1447591
acagacaaaac

SEQ ID NO: 69250 - DNA, 7 bp, Unknown
  misc_feature (1)..( 7): Matrix.004 file - promoters50/1447646
ttttgat

SEQ ID NO: 69251 - DNA, 6 bp, Unknown
  misc_feature (1)..( 6): Matrix.004 file - promoters50/1447646
aagata

SEQ ID NO: 69252 - DNA, 10 bp, Unknown
  misc_feature (1)..( 10): Matrix.004 file - promoters50/1447646
tgaagaagaa

SEQ ID NO: 69253 - DNA, 10 bp, Unknown
  misc_feature (1)..( 10): Matrix.004 file - promoters50/1447646
tgaatttaaa

SEQ ID NO: 69254 - DNA, 10 bp, Unknown
  misc_feature (1)..( 10): Matrix.004 file - promoters50/1447646
gaaagaagat

SEQ ID NO: 69255 - DNA, 9 bp, Unknown
  misc_feature (1)..( 9): Matrix.004 file - promoters50/1447646
attgatttt

SEQ ID NO: 69256 - DNA, 9 bp, Unknown
  misc_feature (1)..( 9): Matrix.004 file - promoters50/1447649
tttttcttt

SEQ ID NO: 69257 - DNA, 7 bp, Unknown
  misc_feature (1)..( 7): Matrix.004 file - promoters50/1447686
tgagtac

SEQ ID NO: 69258 - DNA, 9 bp, Unknown
  misc_feature (1)..( 9): Matrix.004 file - promoters50/1447686
aatatatat

SEQ ID NO: 69259 - DNA, 10 bp, Unknown
  misc_feature (1)..( 10): Matrix.004 file - promoters50/1447686
gaaattaaga

SEQ ID NO: 69260 - DNA, 12 bp, Unknown
  misc_feature (1)..( 12): Matrix.004 file - promoters50/1447943
tattaaactcaa

SEQ ID NO: 69261 - DNA, 8 bp, Unknown
  misc_feature (1)..( 8): Matrix.004 file - promoters50/1447953
ttttaatc

SEQ ID NO: 69262 - DNA, 13 bp, Unknown
  misc_feature (1)..( 13): Matrix.004 file - promoters50/1447953
ctaattttgatta

SEQ ID NO: 69263 - DNA, 13 bp, Unknown
  misc_feature (1)..( 13): Matrix.004 file - promoters50/1447953
aaatctttataag

SEQ ID NO: 69264 - DNA, 6 bp, Unknown
  misc_feature (1)..( 6): Matrix.004 file - promoters50/1447972
tattat

SEQ ID NO: 69265 - DNA, 11 bp, Unknown
  misc_feature (1)..( 11): Matrix.004 file - promoters50/1447972
ttttgctaaaa

SEQ ID NO: 69266 - DNA, 9 bp, Unknown
  misc_feature (1)..( 9): Matrix.004 file - promoters50/1447972
atttctctt

SEQ ID NO: 69267 - DNA, 7 bp, Unknown
  misc_feature (1)..( 7): Matrix.004 file - promoters50/1447972
tttaaca

SEQ ID NO: 69268 - DNA, 10 bp, Unknown
  misc_feature (1)..( 10): Matrix.004 file - promoters50/1448009
ccggttcggt

SEQ ID NO: 69269 - DNA, 9 bp, Unknown
  misc_feature (1)..( 9): Matrix.004 file - promoters50/1448009
caaaattga

SEQ ID NO: 69270 - DNA, 9 bp, Unknown
  misc_feature (1)..( 9): Matrix.004 file - promoters50/1448012
aattaaaaa

SEQ ID NO: 69271 - DNA, 12 bp, Unknown
  misc_feature (1)..( 12): Matrix.004 file - promoters50/1448012
tatttctttgtt

SEQ ID NO: 69272 - DNA, 10 bp, Unknown
  misc_feature (1)..( 10): Matrix.004 file - promoters50/1448022
tttttgtttt

SEQ ID NO: 69273 - DNA, 16 bp, Unknown
  misc_feature (1)..( 16): Matrix.004 file - promoters50/1448022
attaagaaaaaaaaaa

SEQ ID NO: 69274 - DNA, 11 bp, Unknown
  misc_feature (1)..( 11): Matrix.004 file - promoters50/1448022
tactattttgt

SEQ ID NO: 69275 - DNA, 9 bp, Unknown
  misc_feature (1)..( 9): Matrix.004 file - promoters50/1448022
aattttata

SEQ ID NO: 69276 - DNA, 9 bp, Unknown
  misc_feature (1)..( 9): Matrix.004 file - promoters50/1448022
aatatgtaa

SEQ ID NO: 69277 - DNA, 12 bp, Unknown
  misc_feature (1)..( 12): Matrix.004 file - promoters50/1448022
atgtatataaaa

SEQ ID NO: 69278 - DNA, 19 bp, Unknown
  misc_feature (1)..( 19): Matrix.004 file - promoters50/1448022
ataaaaaaaaaaaaaaatc

SEQ ID NO: 69279 - DNA, 10 bp, Unknown
  misc_feature (1)..( 10): Matrix.004 file - promoters50/1448022
attaagaaaa

SEQ ID NO: 69280 - DNA, 12 bp, Unknown
  misc_feature (1)..( 12): Matrix.004 file - promoters50/1448022
aaaagaaattaa

SEQ ID NO: 69281 - DNA, 11 bp, Unknown
  misc_feature (1)..( 11): Matrix.004 file - promoters50/1448022
tatattgtaat

SEQ ID NO: 69282 - DNA, 11 bp, Unknown
  misc_feature (1)..( 11): Matrix.004 file - promoters50/1448022
aatataaaaaa

SEQ ID NO: 69283 - DNA, 13 bp, Unknown
  misc_feature (1)..( 13): Matrix.004 file - promoters50/1448054
cttttgtttttta

SEQ ID NO: 69284 - DNA, 9 bp, Unknown
  misc_feature (1)..( 9): Matrix.004 file - promoters50/1448054
ttttttctt

SEQ ID NO: 69285 - DNA, 10 bp, Unknown
  misc_feature (1)..( 10): Matrix.004 file - promoters50/1448054
tttatttctt

SEQ ID NO: 69286 - DNA, 12 bp, Unknown
  misc_feature (1)..( 12): Matrix.004 file - promoters50/1448078
attgaaaaaaat

SEQ ID NO: 69287 - DNA, 13 bp, Unknown
  misc_feature (1)..( 13): Matrix.004 file - promoters50/1448078
caaactttataaa

SEQ ID NO: 69288 - DNA, 12 bp, Unknown
  misc_feature (1)..( 12): Matrix.004 file - promoters50/1448078
ataaactttaat

SEQ ID NO: 69289 - DNA, 12 bp, Unknown
  misc_feature (1)..( 12): Matrix.004 file - promoters50/1448078
tataaaataatt

SEQ ID NO: 69290 - DNA, 7 bp, Unknown
  misc_feature (1)..( 7): Matrix.004 file - promoters50/1448101
aaaaaat

SEQ ID NO: 69291 - DNA, 9 bp, Unknown
  misc_feature (1)..( 9): Matrix.004 file - promoters50/1448101
ttttctaat

SEQ ID NO: 69292 - DNA, 7 bp, Unknown
  misc_feature (1)..( 7): Matrix.004 file - promoters50/1448101
tttattc

SEQ ID NO: 69293 - DNA, 8 bp, Unknown
  misc_feature (1)..( 8): Matrix.004 file - promoters50/1448105
aatatata

SEQ ID NO: 69294 - DNA, 10 bp, Unknown
  misc_feature (1)..( 10): Matrix.004 file - promoters50/1448105
ctaaaataag

SEQ ID NO: 69295 - DNA, 11 bp, Unknown
  misc_feature (1)..( 11): Matrix.004 file - promoters50/1448105
gataaatactt

SEQ ID NO: 69296 - DNA, 8 bp, Unknown
  misc_feature (1)..( 8): Matrix.004 file - promoters50/1448135
ttttatta

SEQ ID NO: 69297 - DNA, 9 bp, Unknown
  misc_feature (1)..( 9): Matrix.004 file - promoters50/1448135
agatacaga

SEQ ID NO: 69298 - DNA, 11 bp, Unknown
  misc_feature (1)..( 11): Matrix.004 file - promoters50/1448135
aaagaaaattg

SEQ ID NO: 69299 - DNA, 10 bp, Unknown
  misc_feature (1)..( 10): Matrix.004 file - promoters50/1448197
aagaaaaata

SEQ ID NO: 69300 - DNA, 9 bp, Unknown
  misc_feature (1)..( 9): Matrix.004 file - promoters50/1448197
atgaagaat

SEQ ID NO: 69301 - DNA, 8 bp, Unknown
  misc_feature (1)..( 8): Matrix.004 file - promoters50/1448197
tttttttt

SEQ ID NO: 69302 - DNA, 15 bp, Unknown
  misc_feature (1)..( 15): Matrix.004 file - promoters50/1448251
tctttattttattaa

SEQ ID NO: 69303 - DNA, 11 bp, Unknown
  misc_feature (1)..( 11): Matrix.004 file - promoters50/1448251
acataaaaaaa

SEQ ID NO: 69304 - DNA, 9 bp, Unknown
  misc_feature (1)..( 9): Matrix.004 file - promoters50/1448251
gaaaaaaaa

SEQ ID NO: 69305 - DNA, 11 bp, Unknown
  misc_feature (1)..( 11): Matrix.004 file - promoters50/1448251
aaatgaaagaa

SEQ ID NO: 69306 - DNA, 10 bp, Unknown
  misc_feature (1)..( 10): Matrix.004 file - promoters50/1448256
ataattgaat

SEQ ID NO: 69307 - DNA, 10 bp, Unknown
  misc_feature (1)..( 10): Matrix.004 file - promoters50/1450092
aaagatttga

SEQ ID NO: 69308 - DNA, 9 bp, Unknown
  misc_feature (1)..( 9): Matrix.004 file - promoters50/1450099
atatgtaaa

SEQ ID NO: 69309 - DNA, 16 bp, Unknown
  misc_feature (1)..( 16): Matrix.004 file - promoters50/1450099
aaagaatttatattat

SEQ ID NO: 69310 - DNA, 9 bp, Unknown
  misc_feature (1)..( 9): Matrix.004 file - promoters50/1450099
gaattaaaa

SEQ ID NO: 69311 - DNA, 15 bp, Unknown
  misc_feature (1)..( 15): Matrix.004 file - promoters50/1450099
acaaaaatgaaccaa

SEQ ID NO: 69312 - DNA, 13 bp, Unknown
  misc_feature (1)..( 13): Matrix.004 file - promoters50/1450137
aaaaatattttaa

SEQ ID NO: 69313 - DNA, 10 bp, Unknown
  misc_feature (1)..( 10): Matrix.004 file - promoters50/1450137
ctaacttttg

SEQ ID NO: 69314 - DNA, 10 bp, Unknown
  misc_feature (1)..( 10): Matrix.004 file - promoters50/1450224
caatttttaa

SEQ ID NO: 69315 - DNA, 7 bp, Unknown
  misc_feature (1)..( 7): Matrix.004 file - promoters50/1450224
ttttcta

SEQ ID NO: 69316 - DNA, 9 bp, Unknown
  misc_feature (1)..( 9): Matrix.004 file - promoters50/1450224
ttaaatgaa

SEQ ID NO: 69317 - DNA, 8 bp, Unknown
  misc_feature (1)..( 8): Matrix.004 file - promoters50/1450224
tattttat

SEQ ID NO: 69318 - DNA, 8 bp, Unknown
  misc_feature (1)..( 8): Matrix.004 file - promoters50/1450224
tataaaaa

SEQ ID NO: 69319 - DNA, 9 bp, Unknown
  misc_feature (1)..( 9): Matrix.004 file - promoters50/1450224
gaaaacaaa

SEQ ID NO: 69320 - DNA, 12 bp, Unknown
  misc_feature (1)..( 12): Matrix.004 file - promoters50/1450224
aataaattgtat

SEQ ID NO: 69321 - DNA, 7 bp, Unknown
  misc_feature (1)..( 7): Matrix.004 file - promoters50/1450224
aaattat

SEQ ID NO: 69322 - DNA, 9 bp, Unknown
  misc_feature (1)..( 9): Matrix.004 file - promoters50/1450224
aaaataatc

SEQ ID NO: 69323 - DNA, 9 bp, Unknown
  misc_feature (1)..( 9): Matrix.004 file - promoters50/1450224
tcaaaaata

SEQ ID NO: 69324 - DNA, 12 bp, Unknown
  misc_feature (1)..( 12): Matrix.004 file - promoters50/1450290
gaataaaatgta

SEQ ID NO: 69325 - DNA, 9 bp, Unknown
  misc_feature (1)..( 9): Matrix.004 file - promoters50/1450301
aattttaat

SEQ ID NO: 69326 - DNA, 12 bp, Unknown
  misc_feature (1)..( 12): Matrix.004 file - promoters50/1450301
aaataaaaaaaa

SEQ ID NO: 69327 - DNA, 10 bp, Unknown
  misc_feature (1)..( 10): Matrix.004 file - promoters50/1450309
atttgttatc

SEQ ID NO: 69328 - DNA, 10 bp, Unknown
  misc_feature (1)..( 10): Matrix.004 file - promoters50/1450309
aatatatgaa

SEQ ID NO: 69329 - DNA, 9 bp, Unknown
  misc_feature (1)..( 9): Matrix.004 file - promoters50/1450357
aaaaaaaaa

SEQ ID NO: 69330 - DNA, 12 bp, Unknown
  misc_feature (1)..( 12): Matrix.004 file - promoters50/1450357
taaggcaaattt

SEQ ID NO: 69331 - DNA, 9 bp, Unknown
  misc_feature (1)..( 9): Matrix.004 file - promoters50/1450357
gcaatttag

SEQ ID NO: 69332 - DNA, 8 bp, Unknown
  misc_feature (1)..( 8): Matrix.004 file - promoters50/1450365
atatataa

SEQ ID NO: 69333 - DNA, 11 bp, Unknown
  misc_feature (1)..( 11): Matrix.004 file - promoters50/1450369
acaaacatata

SEQ ID NO: 69334 - DNA, 9 bp, Unknown
  misc_feature (1)..( 9): Matrix.004 file - promoters50/1450384
ttactgttg

SEQ ID NO: 69335 - DNA, 8 bp, Unknown
  misc_feature (1)..( 8): Matrix.004 file - promoters50/1450384
tatataga

SEQ ID NO: 69336 - DNA, 8 bp, Unknown
  misc_feature (1)..( 8): Matrix.004 file - promoters50/1450384
atatagat

SEQ ID NO: 69337 - DNA, 12 bp, Unknown
  misc_feature (1)..( 12): Matrix.004 file - promoters50/1450384
tatttgttaata

SEQ ID NO: 69338 - DNA, 10 bp, Unknown
  misc_feature (1)..( 10): Matrix.004 file - promoters50/1450455
attggtttct

SEQ ID NO: 69339 - DNA, 9 bp, Unknown
  misc_feature (1)..( 9): Matrix.004 file - promoters50/1450455
tcatacaaa

SEQ ID NO: 69340 - DNA, 8 bp, Unknown
  misc_feature (1)..( 8): Matrix.004 file - promoters50/1450455
caaataaa

SEQ ID NO: 69341 - DNA, 8 bp, Unknown
  misc_feature (1)..( 8): Matrix.004 file - promoters50/1450459
ttatatat

SEQ ID NO: 69342 - DNA, 19 bp, Unknown
  misc_feature (1)..( 19): Matrix.004 file - promoters50/1450473
gaagtcgtattatgtatta

SEQ ID NO: 69343 - DNA, 9 bp, Unknown
  misc_feature (1)..( 9): Matrix.004 file - promoters50/1450473
taaaaaaaa

SEQ ID NO: 69344 - DNA, 8 bp, Unknown
  misc_feature (1)..( 8): Matrix.004 file - promoters50/1450473
gaataaca

SEQ ID NO: 69345 - DNA, 7 bp, Unknown
  misc_feature (1)..( 7): Matrix.004 file - promoters50/1450473
agaagaa

SEQ ID NO: 69346 - DNA, 8 bp, Unknown
  misc_feature (1)..( 8): Matrix.004 file - promoters50/1450473
agaatttg

SEQ ID NO: 69347 - DNA, 8 bp, Unknown
  misc_feature (1)..( 8): Matrix.004 file - promoters50/1450477
ggagaagg

SEQ ID NO: 69348 - DNA, 9 bp, Unknown
  misc_feature (1)..( 9): Matrix.004 file - promoters50/1450477
taattgaag

SEQ ID NO: 69349 - DNA, 9 bp, Unknown
  misc_feature (1)..( 9): Matrix.004 file - promoters50/1450477
aagcactta

SEQ ID NO: 69350 - DNA, 9 bp, Unknown
  misc_feature (1)..( 9): Matrix.004 file - promoters50/1450526
atctctatt

SEQ ID NO: 69351 - DNA, 8 bp, Unknown
  misc_feature (1)..( 8): Matrix.004 file - promoters50/1450537
ctaaaaat

SEQ ID NO: 69352 - DNA, 7 bp, Unknown
  misc_feature (1)..( 7): Matrix.004 file - promoters50/1450537
catttga

SEQ ID NO: 69353 - DNA, 7 bp, Unknown
  misc_feature (1)..( 7): Matrix.004 file - promoters50/1450537
atttttt

SEQ ID NO: 69354 - DNA, 9 bp, Unknown
  misc_feature (1)..( 9): Matrix.004 file - promoters50/1450537
aaaaaatat

SEQ ID NO: 69355 - DNA, 8 bp, Unknown
  misc_feature (1)..( 8): Matrix.004 file - promoters50/1450537
aaaaaaca

SEQ ID NO: 69356 - DNA, 7 bp, Unknown
  misc_feature (1)..( 7): Matrix.004 file - promoters50/1450549
ggaaaaa

SEQ ID NO: 69357 - DNA, 9 bp, Unknown
  misc_feature (1)..( 9): Matrix.004 file - promoters50/1450549
aacataatt

SEQ ID NO: 69358 - DNA, 8 bp, Unknown
  misc_feature (1)..( 8): Matrix.004 file - promoters50/1450549
aaaactaa

SEQ ID NO: 69359 - DNA, 8 bp, Unknown
  misc_feature (1)..( 8): Matrix.004 file - promoters50/1450549
aacaaaat

SEQ ID NO: 69360 - DNA, 7 bp, Unknown
  misc_feature (1)..( 7): Matrix.004 file - promoters50/1450549
taaataa

SEQ ID NO: 69361 - DNA, 7 bp, Unknown
  misc_feature (1)..( 7): Matrix.004 file - promoters50/1450549
taaagag

SEQ ID NO: 69362 - DNA, 8 bp, Unknown
  misc_feature (1)..( 8): Matrix.004 file - promoters50/1450593
aaaattat

SEQ ID NO: 69363 - DNA, 10 bp, Unknown
  misc_feature (1)..( 10): Matrix.004 file - promoters50/1450593
tcataatatt

SEQ ID NO: 69364 - DNA, 11 bp, Unknown
  misc_feature (1)..( 11): Matrix.004 file - promoters50/1450593
aatactattca

SEQ ID NO: 69365 - DNA, 17 bp, Unknown
  misc_feature (1)..( 17): Matrix.004 file - promoters50/1450593
tcctcacttttcaattc

SEQ ID NO: 69366 - DNA, 6 bp, Unknown
  misc_feature (1)..( 6): Matrix.004 file - promoters50/1450610
taatat

SEQ ID NO: 69367 - DNA, 12 bp, Unknown
  misc_feature (1)..( 12): Matrix.004 file - promoters50/1450637
aagaatctgata

SEQ ID NO: 69368 - DNA, 6 bp, Unknown
  misc_feature (1)..( 6): Matrix.004 file - promoters50/1450662
taattc

SEQ ID NO: 69369 - DNA, 8 bp, Unknown
  misc_feature (1)..( 8): Matrix.004 file - promoters50/1450662
attgtttt

SEQ ID NO: 69370 - DNA, 7 bp, Unknown
  misc_feature (1)..( 7): Matrix.004 file - promoters50/1450662
ggttttg

SEQ ID NO: 69371 - DNA, 8 bp, Unknown
  misc_feature (1)..( 8): Matrix.004 file - promoters50/1450662
gaatattt

SEQ ID NO: 69372 - DNA, 7 bp, Unknown
  misc_feature (1)..( 7): Matrix.004 file - promoters50/1450662
ttaaaat

SEQ ID NO: 69373 - DNA, 7 bp, Unknown
  misc_feature (1)..( 7): Matrix.004 file - promoters50/1450662
gtgtttc

SEQ ID NO: 69374 - DNA, 11 bp, Unknown
  misc_feature (1)..( 11): Matrix.004 file - promoters50/1450678
acaattaagcc

SEQ ID NO: 69375 - DNA, 10 bp, Unknown
  misc_feature (1)..( 10): Matrix.004 file - promoters50/1450678
actttaataa

SEQ ID NO: 69376 - DNA, 11 bp, Unknown
  misc_feature (1)..( 11): Matrix.004 file - promoters50/1450678
aaatatttcaa

SEQ ID NO: 69377 - DNA, 10 bp, Unknown
  misc_feature (1)..( 10): Matrix.004 file - promoters50/1450682
tacaaaaaca

SEQ ID NO: 69378 - DNA, 8 bp, Unknown
  misc_feature (1)..( 8): Matrix.004 file - promoters50/1450770
atatatac

SEQ ID NO: 69379 - DNA, 11 bp, Unknown
  misc_feature (1)..( 11): Matrix.004 file - promoters50/1450770
ttttaaaatta

SEQ ID NO: 69380 - DNA, 9 bp, Unknown
  misc_feature (1)..( 9): Matrix.004 file - promoters50/1450785
tataaaagc

SEQ ID NO: 69381 - DNA, 7 bp, Unknown
  misc_feature (1)..( 7): Matrix.004 file - promoters50/1450785
aaaccaa

SEQ ID NO: 69382 - DNA, 8 bp, Unknown
  misc_feature (1)..( 8): Matrix.004 file - promoters50/1450785
cttcacca

SEQ ID NO: 69383 - DNA, 9 bp, Unknown
  misc_feature (1)..( 9): Matrix.004 file - promoters50/1450785
gattaagct

SEQ ID NO: 69384 - DNA, 8 bp, Unknown
  misc_feature (1)..( 8): Matrix.004 file - promoters50/1450785
tttctttt

SEQ ID NO: 69385 - DNA, 10 bp, Unknown
  misc_feature (1)..( 10): Matrix.004 file - promoters50/1450785
tctaaaaata

SEQ ID NO: 69386 - DNA, 8 bp, Unknown
  misc_feature (1)..( 8): Matrix.004 file - promoters50/1450785
atgtaaaa

SEQ ID NO: 69387 - DNA, 9 bp, Unknown
  misc_feature (1)..( 9): Matrix.004 file - promoters50/1450785
ttaatcaat

SEQ ID NO: 69388 - DNA, 16 bp, Unknown
  misc_feature (1)..( 16): Matrix.004 file - promoters50/1450792
caaaaactcaagattt

SEQ ID NO: 69389 - DNA, 11 bp, Unknown
  misc_feature (1)..( 11): Matrix.004 file - promoters50/1450834
aaatcaaaaaa

SEQ ID NO: 69390 - DNA, 8 bp, Unknown
  misc_feature (1)..( 8): Matrix.004 file - promoters50/1450834
taagtaaa

SEQ ID NO: 69391 - DNA, 8 bp, Unknown
  misc_feature (1)..( 8): Matrix.004 file - promoters50/1450834
ttttatta

SEQ ID NO: 69392 - DNA, 10 bp, Unknown
  misc_feature (1)..( 10): Matrix.004 file - promoters50/1450834
agaactttct

SEQ ID NO: 69393 - DNA, 7 bp, Unknown
  misc_feature (1)..( 7): Matrix.004 file - promoters50/1455879
tttgttt

SEQ ID NO: 69394 - DNA, 8 bp, Unknown
  misc_feature (1)..( 8): Matrix.004 file - promoters50/1455908
gcatatat

SEQ ID NO: 69395 - DNA, 10 bp, Unknown
  misc_feature (1)..( 10): Matrix.004 file - promoters50/1455908
tttaataatg

SEQ ID NO: 69396 - DNA, 11 bp, Unknown
  misc_feature (1)..( 11): Matrix.004 file - promoters50/1455908
tgtatttgtac

SEQ ID NO: 69397 - DNA, 10 bp, Unknown
  misc_feature (1)..( 10): Matrix.004 file - promoters50/1455912
tagatttaaa

SEQ ID NO: 69398 - DNA, 7 bp, Unknown
  misc_feature (1)..( 7): Matrix.004 file - promoters50/1455912
aaacaat

SEQ ID NO: 69399 - DNA, 7 bp, Unknown
  misc_feature (1)..( 7): Matrix.004 file - promoters50/1455916
ttggtta

SEQ ID NO: 69400 - DNA, 8 bp, Unknown
  misc_feature (1)..( 8): Matrix.004 file - promoters50/1455916
catgtttt

SEQ ID NO: 69401 - DNA, 11 bp, Unknown
  misc_feature (1)..( 11): Matrix.004 file - promoters50/1455916
tttatttataa

SEQ ID NO: 69402 - DNA, 8 bp, Unknown
  misc_feature (1)..( 8): Matrix.004 file - promoters50/1455928
ctcttaaa

SEQ ID NO: 69403 - DNA, 8 bp, Unknown
  misc_feature (1)..( 8): Matrix.004 file - promoters50/1455928
atgtattt

SEQ ID NO: 69404 - DNA, 13 bp, Unknown
  misc_feature (1)..( 13): Matrix.004 file - promoters50/1455932
aattaacaaaaaa

SEQ ID NO: 69405 - DNA, 9 bp, Unknown
  misc_feature (1)..( 9): Matrix.004 file - promoters50/1455932
taataaagt

SEQ ID NO: 69406 - DNA, 8 bp, Unknown
  misc_feature (1)..( 8): Matrix.004 file - promoters50/1455932
atttgtat

SEQ ID NO: 69407 - DNA, 9 bp, Unknown
  misc_feature (1)..( 9): Matrix.004 file - promoters50/1455932
atgtttttg

SEQ ID NO: 69408 - DNA, 8 bp, Unknown
  misc_feature (1)..( 8): Matrix.004 file - promoters50/1455932
aaaaacaa

SEQ ID NO: 69409 - DNA, 11 bp, Unknown
  misc_feature (1)..( 11): Matrix.004 file - promoters50/1455932
ccttttgtttt

SEQ ID NO: 69410 - DNA, 11 bp, Unknown
  misc_feature (1)..( 11): Matrix.004 file - promoters50/1455936
aagcctttctt

SEQ ID NO: 69411 - DNA, 7 bp, Unknown
  misc_feature (1)..( 7): Matrix.004 file - promoters50/1455936
ttagtta

SEQ ID NO: 69412 - DNA, 9 bp, Unknown
  misc_feature (1)..( 9): Matrix.004 file - promoters50/1455936
aaaagctaa

SEQ ID NO: 69413 - DNA, 7 bp, Unknown
  misc_feature (1)..( 7): Matrix.004 file - promoters50/1455936
aatttag

SEQ ID NO: 69414 - DNA, 8 bp, Unknown
  misc_feature (1)..( 8): Matrix.004 file - promoters50/1455936
aaaaataa

SEQ ID NO: 69415 - DNA, 8 bp, Unknown
  misc_feature (1)..( 8): Matrix.004 file - promoters50/1455936
aatataaa

SEQ ID NO: 69416 - DNA, 8 bp, Unknown
  misc_feature (1)..( 8): Matrix.004 file - promoters50/1455944
atgaaaag

SEQ ID NO: 69417 - DNA, 11 bp, Unknown
  misc_feature (1)..( 11): Matrix.004 file - promoters50/1455944
aaataaaatgt

SEQ ID NO: 69418 - DNA, 12 bp, Unknown
  misc_feature (1)..( 12): Matrix.004 file - promoters50/1455944
aaaataaagcaa

SEQ ID NO: 69419 - DNA, 11 bp, Unknown
  misc_feature (1)..( 11): Matrix.004 file - promoters50/1455948
ctatataaaca

SEQ ID NO: 69420 - DNA, 9 bp, Unknown
  misc_feature (1)..( 9): Matrix.004 file - promoters50/1455948
tttcttgaa

SEQ ID NO: 69421 - DNA, 9 bp, Unknown
  misc_feature (1)..( 9): Matrix.004 file - promoters50/1455948
caaaaacaa

SEQ ID NO: 69422 - DNA, 7 bp, Unknown
  misc_feature (1)..( 7): Matrix.004 file - promoters50/1455956
tcaaaaa

SEQ ID NO: 69423 - DNA, 10 bp, Unknown
  misc_feature (1)..( 10): Matrix.004 file - promoters50/1455972
taaatttttt

SEQ ID NO: 69424 - DNA, 10 bp, Unknown
  misc_feature (1)..( 10): Matrix.004 file - promoters50/1455972
tacaaacata

SEQ ID NO: 69425 - DNA, 16 bp, Unknown
  misc_feature (1)..( 16): Matrix.004 file - promoters50/1456000
aagaatagcaaaatca

SEQ ID NO: 69426 - DNA, 12 bp, Unknown
  misc_feature (1)..( 12): Matrix.004 file - promoters50/1456000
aacaaaaacaaa

SEQ ID NO: 69427 - DNA, 10 bp, Unknown
  misc_feature (1)..( 10): Matrix.004 file - promoters50/1456000
aaaaaaaaaa

SEQ ID NO: 69428 - DNA, 10 bp, Unknown
  misc_feature (1)..( 10): Matrix.004 file - promoters50/1456000
gagcaacaga

SEQ ID NO: 69429 - DNA, 11 bp, Unknown
  misc_feature (1)..( 11): Matrix.004 file - promoters50/1456000
agaaaaaaatc

SEQ ID NO: 69430 - DNA, 13 bp, Unknown
  misc_feature (1)..( 13): Matrix.004 file - promoters50/1456000
caaaaaaaacaaa

SEQ ID NO: 69431 - DNA, 8 bp, Unknown
  misc_feature (1)..( 8): Matrix.004 file - promoters50/1456000
taaaaaaa

SEQ ID NO: 69432 - DNA, 8 bp, Unknown
  misc_feature (1)..( 8): Matrix.004 file - promoters50/1456000
caacagaa

SEQ ID NO: 69433 - DNA, 7 bp, Unknown
  misc_feature (1)..( 7): Matrix.004 file - promoters50/1456000
aaaacat

SEQ ID NO: 69434 - DNA, 9 bp, Unknown
  misc_feature (1)..( 9): Matrix.004 file - promoters50/1456064
ccaaaatta

SEQ ID NO: 69435 - DNA, 9 bp, Unknown
  misc_feature (1)..( 9): Matrix.004 file - promoters50/1456064
ttcttaaaa

SEQ ID NO: 69436 - DNA, 8 bp, Unknown
  misc_feature (1)..( 8): Matrix.004 file - promoters50/1456083
gaaccttt

SEQ ID NO: 69437 - DNA, 8 bp, Unknown
  misc_feature (1)..( 8): Matrix.004 file - promoters50/1456128
tatatata

SEQ ID NO: 69438 - DNA, 10 bp, Unknown
  misc_feature (1)..( 10): Matrix.004 file - promoters50/1456128
atttttttct

SEQ ID NO: 69439 - DNA, 9 bp, Unknown
  misc_feature (1)..( 9): Matrix.004 file - promoters50/1456128
tttattaaa

SEQ ID NO: 69440 - DNA, 7 bp, Unknown
  misc_feature (1)..( 7): Matrix.004 file - promoters50/1456128
agaaaaa

SEQ ID NO: 69441 - DNA, 8 bp, Unknown
  misc_feature (1)..( 8): Matrix.004 file - promoters50/1456131
gaaaaaaa

SEQ ID NO: 69442 - DNA, 11 bp, Unknown
  misc_feature (1)..( 11): Matrix.004 file - promoters50/1456131
tttcatcaata

SEQ ID NO: 69443 - DNA, 14 bp, Unknown
  misc_feature (1)..( 14): Matrix.004 file - promoters50/1456228
caaaaacaatgatc

SEQ ID NO: 69444 - DNA, 10 bp, Unknown
  misc_feature (1)..( 10): Matrix.004 file - promoters50/1456228
aaagaaaacc

SEQ ID NO: 69445 - DNA, 8 bp, Unknown
  misc_feature (1)..( 8): Matrix.004 file - promoters50/1456228
tatttaaa

SEQ ID NO: 69446 - DNA, 10 bp, Unknown
  misc_feature (1)..( 10): Matrix.004 file - promoters50/1456239
aaatataata

SEQ ID NO: 69447 - DNA, 8 bp, Unknown
  misc_feature (1)..( 8): Matrix.004 file - promoters50/1456622
tacacaaa

SEQ ID NO: 69448 - DNA, 8 bp, Unknown
  misc_feature (1)..( 8): Matrix.004 file - promoters50/1456622
aaatattt

SEQ ID NO: 69449 - DNA, 10 bp, Unknown
  misc_feature (1)..( 10): Matrix.004 file - promoters50/1458991
tataattatt

SEQ ID NO: 69450 - DNA, 9 bp, Unknown
  misc_feature (1)..( 9): Matrix.004 file - promoters50/1459039
gaagttttt

SEQ ID NO: 69451 - DNA, 8 bp, Unknown
  misc_feature (1)..( 8): Matrix.004 file - promoters50/1459199
aatataaa

SEQ ID NO: 69452 - DNA, 13 bp, Unknown
  misc_feature (1)..( 13): Matrix.004 file - promoters50/1459199
taatttatttgtg

SEQ ID NO: 69453 - DNA, 11 bp, Unknown
  misc_feature (1)..( 11): Matrix.004 file - promoters50/1459223
attagattttc

SEQ ID NO: 69454 - DNA, 11 bp, Unknown
  misc_feature (1)..( 11): Matrix.004 file - promoters50/1459223
tttttaaattt

SEQ ID NO: 69455 - DNA, 16 bp, Unknown
  misc_feature (1)..( 16): Matrix.004 file - promoters50/1460386
tatattcaaataaaaa

SEQ ID NO: 69456 - DNA, 9 bp, Unknown
  misc_feature (1)..( 9): Matrix.004 file - promoters50/1461720
gaaaaaatt

SEQ ID NO: 69457 - DNA, 7 bp, Unknown
  misc_feature (1)..( 7): Matrix.004 file - promoters50/1461720
aaatata

SEQ ID NO: 69458 - DNA, 10 bp, Unknown
  misc_feature (1)..( 10): Matrix.004 file - promoters50/1461720
atttatttga

SEQ ID NO: 69459 - DNA, 10 bp, Unknown
  misc_feature (1)..( 10): Matrix.004 file - promoters50/1461756
attagtaatt

SEQ ID NO: 69460 - DNA, 7 bp, Unknown
  misc_feature (1)..( 7): Matrix.004 file - promoters50/1461768
agaagaa

SEQ ID NO: 69461 - DNA, 11 bp, Unknown
  misc_feature (1)..( 11): Matrix.004 file - promoters50/1461768
ttttcaagaag

SEQ ID NO: 69462 - DNA, 8 bp, Unknown
  misc_feature (1)..( 8): Matrix.004 file - promoters50/1461768
tctattat

SEQ ID NO: 69463 - DNA, 12 bp, Unknown
  misc_feature (1)..( 12): Matrix.004 file - promoters50/1461768
atttgagtgtaa

SEQ ID NO: 69464 - DNA, 14 bp, Unknown
  misc_feature (1)..( 14): Matrix.004 file - promoters50/1461768
acatgaaactttat

SEQ ID NO: 69465 - DNA, 11 bp, Unknown
  misc_feature (1)..( 11): Matrix.004 file - promoters50/1461776
attattttaat

SEQ ID NO: 69466 - DNA, 12 bp, Unknown
  misc_feature (1)..( 12): Matrix.004 file - promoters50/1461776
accttggttttt

SEQ ID NO: 69467 - DNA, 11 bp, Unknown
  misc_feature (1)..( 11): Matrix.004 file - promoters50/1461776
aatattttgtt

SEQ ID NO: 69468 - DNA, 9 bp, Unknown
  misc_feature (1)..( 9): Matrix.004 file - promoters50/1461780
aaataattt

SEQ ID NO: 69469 - DNA, 11 bp, Unknown
  misc_feature (1)..( 11): Matrix.004 file - promoters50/1461784
tttactcaatt

SEQ ID NO: 69470 - DNA, 8 bp, Unknown
  misc_feature (1)..( 8): Matrix.004 file - promoters50/1461784
tattaaat

SEQ ID NO: 69471 - DNA, 12 bp, Unknown
  misc_feature (1)..( 12): Matrix.004 file - promoters50/1461784
tttaaaataata

SEQ ID NO: 69472 - DNA, 11 bp, Unknown
  misc_feature (1)..( 11): Matrix.004 file - promoters50/1461784
ttttaatatat

SEQ ID NO: 69473 - DNA, 12 bp, Unknown
  misc_feature (1)..( 12): Matrix.004 file - promoters50/1461784
ttataaaatatt

SEQ ID NO: 69474 - DNA, 11 bp, Unknown
  misc_feature (1)..( 11): Matrix.004 file - promoters50/1461784
ttttaaaatat

SEQ ID NO: 69475 - DNA, 7 bp, Unknown
  misc_feature (1)..( 7): Matrix.004 file - promoters50/1461784
aaaattt

SEQ ID NO: 69476 - DNA, 9 bp, Unknown
  misc_feature (1)..( 9): Matrix.004 file - promoters50/1461784
attttttaa

SEQ ID NO: 69477 - DNA, 17 bp, Unknown
  misc_feature (1)..( 17): Matrix.004 file - promoters50/1461791
gcacaaataataaaaca

SEQ ID NO: 69478 - DNA, 13 bp, Unknown
  misc_feature (1)..( 13): Matrix.004 file - promoters50/1461791
atctttgaaacaa

SEQ ID NO: 69479 - DNA, 9 bp, Unknown
  misc_feature (1)..( 9): Matrix.004 file - promoters50/1461791
tctatatat

SEQ ID NO: 69480 - DNA, 9 bp, Unknown
  misc_feature (1)..( 9): Matrix.004 file - promoters50/1461791
aatataaat

SEQ ID NO: 69481 - DNA, 12 bp, Unknown
  misc_feature (1)..( 12): Matrix.004 file - promoters50/1461791
tttgttttatca

SEQ ID NO: 69482 - DNA, 8 bp, Unknown
  misc_feature (1)..( 8): Matrix.004 file - promoters50/1461803
acaaaaac

SEQ ID NO: 69483 - DNA, 10 bp, Unknown
  misc_feature (1)..( 10): Matrix.004 file - promoters50/1461803
aataatttta

SEQ ID NO: 69484 - DNA, 11 bp, Unknown
  misc_feature (1)..( 11): Matrix.004 file - promoters50/1461837
cctaattttaa

SEQ ID NO: 69485 - DNA, 8 bp, Unknown
  misc_feature (1)..( 8): Matrix.004 file - promoters50/1461837
tggattca

SEQ ID NO: 69486 - DNA, 9 bp, Unknown
  misc_feature (1)..( 9): Matrix.004 file - promoters50/1461839
ttttgttat

SEQ ID NO: 69487 - DNA, 10 bp, Unknown
  misc_feature (1)..( 10): Matrix.004 file - promoters50/1461839
gaaaaagaaa

SEQ ID NO: 69488 - DNA, 12 bp, Unknown
  misc_feature (1)..( 12): Matrix.004 file - promoters50/1461839
aaaagaaaaaaa

SEQ ID NO: 69489 - DNA, 15 bp, Unknown
  misc_feature (1)..( 15): Matrix.004 file - promoters50/1461839
aaagaaaagaaagaa

SEQ ID NO: 69490 - DNA, 12 bp, Unknown
  misc_feature (1)..( 12): Matrix.004 file - promoters50/1461839
aaaagaaaagta

SEQ ID NO: 69491 - DNA, 19 bp, Unknown
  misc_feature (1)..( 19): Matrix.004 file - promoters50/1461848
aaaaaactaattttaaatt

SEQ ID NO: 69492 - DNA, 8 bp, Unknown
  misc_feature (1)..( 8): Matrix.004 file - promoters50/1461857
ctgaaagt

SEQ ID NO: 69493 - DNA, 11 bp, Unknown
  misc_feature (1)..( 11): Matrix.004 file - promoters50/1461857
atttacttaat

SEQ ID NO: 69494 - DNA, 10 bp, Unknown
  misc_feature (1)..( 10): Matrix.004 file - promoters50/1465855
ttttatccaa

SEQ ID NO: 69495 - DNA, 14 bp, Unknown
  misc_feature (1)..( 14): Matrix.004 file - promoters50/1465855
aaggttaacatctt

SEQ ID NO: 69496 - DNA, 8 bp, Unknown
  misc_feature (1)..( 8): Matrix.004 file - promoters50/1465863
aatattta

SEQ ID NO: 69497 - DNA, 7 bp, Unknown
  misc_feature (1)..( 7): Matrix.004 file - promoters50/1465863
tcgcttt

SEQ ID NO: 69498 - DNA, 9 bp, Unknown
  misc_feature (1)..( 9): Matrix.004 file - promoters50/1465863
ttcttagct

SEQ ID NO: 69499 - DNA, 9 bp, Unknown
  misc_feature (1)..( 9): Matrix.004 file - promoters50/1465863
agaaagcaa

SEQ ID NO: 69500 - DNA, 8 bp, Unknown
  misc_feature (1)..( 8): Matrix.004 file - promoters50/1465863
gaaagatt

SEQ ID NO: 69501 - DNA, 8 bp, Unknown
  misc_feature (1)..( 8): Matrix.004 file - promoters50/1465863
tccaaagg

SEQ ID NO: 69502 - DNA, 9 bp, Unknown
  misc_feature (1)..( 9): Matrix.004 file - promoters50/1465863
ctagggttt

SEQ ID NO: 69503 - DNA, 8 bp, Unknown
  misc_feature (1)..( 8): Matrix.004 file - promoters50/1465863
agtttaat

SEQ ID NO: 69504 - DNA, 8 bp, Unknown
  misc_feature (1)..( 8): Matrix.004 file - promoters50/1470567
atattttt

SEQ ID NO: 69505 - DNA, 8 bp, Unknown
  misc_feature (1)..( 8): Matrix.004 file - promoters50/1470567
ctctctta

SEQ ID NO: 69506 - DNA, 17 bp, Unknown
  misc_feature (1)..( 17): Matrix.004 file - promoters50/1470567
tgtaaattttcatttgg

SEQ ID NO: 69507 - DNA, 12 bp, Unknown
  misc_feature (1)..( 12): Matrix.004 file - promoters50/1470582
tttaatcttgta

SEQ ID NO: 69508 - DNA, 13 bp, Unknown
  misc_feature (1)..( 13): Matrix.004 file - promoters50/1470582
ttacacttcttaa

SEQ ID NO: 69509 - DNA, 11 bp, Unknown
  misc_feature (1)..( 11): Matrix.004 file - promoters50/1470903
attcttaatct

SEQ ID NO: 69510 - DNA, 8 bp, Unknown
  misc_feature (1)..( 8): Matrix.004 file - promoters50/1470903
gaaaagaa

SEQ ID NO: 69511 - DNA, 14 bp, Unknown
  misc_feature (1)..( 14): Matrix.004 file - promoters50/1470993
agagagagagagag

SEQ ID NO: 69512 - DNA, 9 bp, Unknown
  misc_feature (1)..( 9): Matrix.004 file - promoters50/1470993
tttgaattt

SEQ ID NO: 69513 - DNA, 9 bp, Unknown
  misc_feature (1)..( 9): Matrix.004 file - promoters50/1471001
tgatgaatg

SEQ ID NO: 69514 - DNA, 8 bp, Unknown
  misc_feature (1)..( 8): Matrix.004 file - promoters50/1471001
atataatt

SEQ ID NO: 69515 - DNA, 7 bp, Unknown
  misc_feature (1)..( 7): Matrix.004 file - promoters50/1471001
ttataaa

SEQ ID NO: 69516 - DNA, 13 bp, Unknown
  misc_feature (1)..( 13): Matrix.004 file - promoters50/1471009
attatcaaattat

SEQ ID NO: 69517 - DNA, 9 bp, Unknown
  misc_feature (1)..( 9): Matrix.004 file - promoters50/1471009
atttaataa

SEQ ID NO: 69518 - DNA, 6 bp, Unknown
  misc_feature (1)..( 6): Matrix.004 file - promoters50/1471009
ataaat

SEQ ID NO: 69519 - DNA, 10 bp, Unknown
  misc_feature (1)..( 10): Matrix.004 file - promoters50/1471009
agaaaatatt

SEQ ID NO: 69520 - DNA, 11 bp, Unknown
  misc_feature (1)..( 11): Matrix.004 file - promoters50/1471009
tcctataaata

SEQ ID NO: 69521 - DNA, 9 bp, Unknown
  misc_feature (1)..( 9): Matrix.004 file - promoters50/1471009
aaaagaatt

SEQ ID NO: 69522 - DNA, 7 bp, Unknown
  misc_feature (1)..( 7): Matrix.004 file - promoters50/1471041
ataaata

SEQ ID NO: 69523 - DNA, 12 bp, Unknown
  misc_feature (1)..( 12): Matrix.004 file - promoters50/1471041
agaattaaatta

SEQ ID NO: 69524 - DNA, 10 bp, Unknown
  misc_feature (1)..( 10): Matrix.004 file - promoters50/1471073
tatttgattt

SEQ ID NO: 69525 - DNA, 8 bp, Unknown
  misc_feature (1)..( 8): Matrix.004 file - promoters50/1471073
aaaaaata

SEQ ID NO: 69526 - DNA, 7 bp, Unknown
  misc_feature (1)..( 7): Matrix.004 file - promoters50/1471073
aataaaa

SEQ ID NO: 69527 - DNA, 8 bp, Unknown
  misc_feature (1)..( 8): Matrix.004 file - promoters50/1471073
ataaaata

SEQ ID NO: 69528 - DNA, 10 bp, Unknown
  misc_feature (1)..( 10): Matrix.004 file - promoters50/1471073
ataaaatcat

SEQ ID NO: 69529 - DNA, 10 bp, Unknown
  misc_feature (1)..( 10): Matrix.004 file - promoters50/1471073
aattatttgc

SEQ ID NO: 69530 - DNA, 9 bp, Unknown
  misc_feature (1)..( 9): Matrix.004 file - promoters50/1471106
attaaaaat

SEQ ID NO: 69531 - DNA, 8 bp, Unknown
  misc_feature (1)..( 8): Matrix.004 file - promoters50/1471114
attattat

SEQ ID NO: 69532 - DNA, 13 bp, Unknown
  misc_feature (1)..( 13): Matrix.004 file - promoters50/1471114
gtcataagtattg

SEQ ID NO: 69533 - DNA, 11 bp, Unknown
  misc_feature (1)..( 11): Matrix.004 file - promoters50/1471114
ggttaaatagt

SEQ ID NO: 69534 - DNA, 10 bp, Unknown
  misc_feature (1)..( 10): Matrix.004 file - promoters50/1471140
aaatcaaaca

SEQ ID NO: 69535 - DNA, 10 bp, Unknown
  misc_feature (1)..( 10): Matrix.004 file - promoters50/1471140
ctaaatctaa

SEQ ID NO: 69536 - DNA, 8 bp, Unknown
  misc_feature (1)..( 8): Matrix.004 file - promoters50/1471140
aaaacaaa

SEQ ID NO: 69537 - DNA, 10 bp, Unknown
  misc_feature (1)..( 10): Matrix.004 file - promoters50/1471140
aatttattaa

SEQ ID NO: 69538 - DNA, 10 bp, Unknown
  misc_feature (1)..( 10): Matrix.004 file - promoters50/1471140
attttatttg

SEQ ID NO: 69539 - DNA, 12 bp, Unknown
  misc_feature (1)..( 12): Matrix.004 file - promoters50/1472766
gatctatatttc

SEQ ID NO: 69540 - DNA, 9 bp, Unknown
  misc_feature (1)..( 9): Matrix.004 file - promoters50/1472766
ttgaagaat

SEQ ID NO: 69541 - DNA, 8 bp, Unknown
  misc_feature (1)..( 8): Matrix.004 file - promoters50/1472778
aaaagaag

SEQ ID NO: 69542 - DNA, 11 bp, Unknown
  misc_feature (1)..( 11): Matrix.004 file - promoters50/1472778
ttttattaatt

SEQ ID NO: 69543 - DNA, 9 bp, Unknown
  misc_feature (1)..( 9): Matrix.004 file - promoters50/1472778
tactttaat

SEQ ID NO: 69544 - DNA, 13 bp, Unknown
  misc_feature (1)..( 13): Matrix.004 file - promoters50/1472778
taattttcattta

SEQ ID NO: 69545 - DNA, 12 bp, Unknown
  misc_feature (1)..( 12): Matrix.004 file - promoters50/1472778
gtataaaacgaa

SEQ ID NO: 69546 - DNA, 11 bp, Unknown
  misc_feature (1)..( 11): Matrix.004 file - promoters50/1472778
ttttatgaatt

SEQ ID NO: 69547 - DNA, 9 bp, Unknown
  misc_feature (1)..( 9): Matrix.004 file - promoters50/1472778
atacagtta

SEQ ID NO: 69548 - DNA, 6 bp, Unknown
  misc_feature (1)..( 6): Matrix.004 file - promoters50/1472778
ataaaa

SEQ ID NO: 69549 - DNA, 9 bp, Unknown
  misc_feature (1)..( 9): Matrix.004 file - promoters50/1472778
gatacagtt

SEQ ID NO: 69550 - DNA, 10 bp, Unknown
  misc_feature (1)..( 10): Matrix.004 file - promoters50/1472778
aaaaaaagaa

SEQ ID NO: 69551 - DNA, 16 bp, Unknown
  misc_feature (1)..( 16): Matrix.004 file - promoters50/1472799
ctaacaattatattaa

SEQ ID NO: 69552 - DNA, 8 bp, Unknown
  misc_feature (1)..( 8): Matrix.004 file - promoters50/1472799
atcatatt

SEQ ID NO: 69553 - DNA, 8 bp, Unknown
  misc_feature (1)..( 8): Matrix.004 file - promoters50/1472799
gatttgtt

SEQ ID NO: 69554 - DNA, 12 bp, Unknown
  misc_feature (1)..( 12): Matrix.004 file - promoters50/1472799
agtttgttcaat

SEQ ID NO: 69555 - DNA, 7 bp, Unknown
  misc_feature (1)..( 7): Matrix.004 file - promoters50/1472799
tgtttgt

SEQ ID NO: 69556 - DNA, 6 bp, Unknown
  misc_feature (1)..( 6): Matrix.004 file - promoters50/1472799
tttgtt

SEQ ID NO: 69557 - DNA, 9 bp, Unknown
  misc_feature (1)..( 9): Matrix.004 file - promoters50/1472799
tttgtagtg

SEQ ID NO: 69558 - DNA, 8 bp, Unknown
  misc_feature (1)..( 8): Matrix.004 file - promoters50/1472908
tgatttgt

SEQ ID NO: 69559 - DNA, 8 bp, Unknown
  misc_feature (1)..( 8): Matrix.004 file - promoters50/1472908
aaaaattt

SEQ ID NO: 69560 - DNA, 8 bp, Unknown
  misc_feature (1)..( 8): Matrix.004 file - promoters50/1472908
gaagaaaa

SEQ ID NO: 69561 - DNA, 9 bp, Unknown
  misc_feature (1)..( 9): Matrix.004 file - promoters50/1472908
tttataaac

SEQ ID NO: 69562 - DNA, 11 bp, Unknown
  misc_feature (1)..( 11): Matrix.004 file - promoters50/1472908
aattaattttt

SEQ ID NO: 69563 - DNA, 9 bp, Unknown
  misc_feature (1)..( 9): Matrix.004 file - promoters50/1472908
attttatgt

SEQ ID NO: 69564 - DNA, 8 bp, Unknown
  misc_feature (1)..( 8): Matrix.004 file - promoters50/1472908
cttgtaga

SEQ ID NO: 69565 - DNA, 8 bp, Unknown
  misc_feature (1)..( 8): Matrix.004 file - promoters50/1472908
aatttaat

SEQ ID NO: 69566 - DNA, 10 bp, Unknown
  misc_feature (1)..( 10): Matrix.004 file - promoters50/1472908
ttttatgttt

SEQ ID NO: 69567 - DNA, 10 bp, Unknown
  misc_feature (1)..( 10): Matrix.004 file - promoters50/1472908
tttatgtttt

SEQ ID NO: 69568 - DNA, 8 bp, Unknown
  misc_feature (1)..( 8): Matrix.004 file - promoters50/1473010
taaaaaaa

SEQ ID NO: 69569 - DNA, 13 bp, Unknown
  misc_feature (1)..( 13): Matrix.004 file - promoters50/1473010
acaaaaatttaat

SEQ ID NO: 69570 - DNA, 8 bp, Unknown
  misc_feature (1)..( 8): Matrix.004 file - promoters50/1473010
aataaaaa

SEQ ID NO: 69571 - DNA, 8 bp, Unknown
  misc_feature (1)..( 8): Matrix.004 file - promoters50/1473010
ttattaaa

SEQ ID NO: 69572 - DNA, 8 bp, Unknown
  misc_feature (1)..( 8): Matrix.004 file - promoters50/1473014
attaaatt

SEQ ID NO: 69573 - DNA, 7 bp, Unknown
  misc_feature (1)..( 7): Matrix.004 file - promoters50/1473014
aagtcat

SEQ ID NO: 69574 - DNA, 13 bp, Unknown
  misc_feature (1)..( 13): Matrix.004 file - promoters50/1473014
gcttattcactct

SEQ ID NO: 69575 - DNA, 13 bp, Unknown
  misc_feature (1)..( 13): Matrix.004 file - promoters50/1473014
acccattttctgc

SEQ ID NO: 69576 - DNA, 9 bp, Unknown
  misc_feature (1)..( 9): Matrix.004 file - promoters50/1473014
cataacaaa

SEQ ID NO: 69577 - DNA, 10 bp, Unknown
  misc_feature (1)..( 10): Matrix.004 file - promoters50/1473014
ttaaaaccct

SEQ ID NO: 69578 - DNA, 7 bp, Unknown
  misc_feature (1)..( 7): Matrix.004 file - promoters50/1473050
cattttt

SEQ ID NO: 69579 - DNA, 7 bp, Unknown
  misc_feature (1)..( 7): Matrix.004 file - promoters50/1473050
atttttt

SEQ ID NO: 69580 - DNA, 7 bp, Unknown
  misc_feature (1)..( 7): Matrix.004 file - promoters50/1473050
gatgaaa

SEQ ID NO: 69581 - DNA, 9 bp, Unknown
  misc_feature (1)..( 9): Matrix.004 file - promoters50/1473050
ttaaattat

SEQ ID NO: 69582 - DNA, 8 bp, Unknown
  misc_feature (1)..( 8): Matrix.004 file - promoters50/1473050
aaaaccaa

SEQ ID NO: 69583 - DNA, 8 bp, Unknown
  misc_feature (1)..( 8): Matrix.004 file - promoters50/1481416
aaatcata

SEQ ID NO: 69584 - DNA, 7 bp, Unknown
  misc_feature (1)..( 7): Matrix.004 file - promoters50/1481416
accaaac

SEQ ID NO: 69585 - DNA, 7 bp, Unknown
  misc_feature (1)..( 7): Matrix.004 file - promoters50/1481416
ttaaaat

SEQ ID NO: 69586 - DNA, 12 bp, Unknown
  misc_feature (1)..( 12): Matrix.004 file - promoters50/1481416
aaggaatcaaac

SEQ ID NO: 69587 - DNA, 9 bp, Unknown
  misc_feature (1)..( 9): Matrix.004 file - promoters50/1481416
ctatataaa

SEQ ID NO: 69588 - DNA, 7 bp, Unknown
  misc_feature (1)..( 7): Matrix.004 file - promoters50/1481416
taaaata

SEQ ID NO: 69589 - DNA, 7 bp, Unknown
  misc_feature (1)..( 7): Matrix.004 file - promoters50/1481516
aaaaaat

SEQ ID NO: 69590 - DNA, 9 bp, Unknown
  misc_feature (1)..( 9): Matrix.004 file - promoters50/1481516
gaggaagaa

SEQ ID NO: 69591 - DNA, 7 bp, Unknown
  misc_feature (1)..( 7): Matrix.004 file - promoters50/1481544
tgttgcc

SEQ ID NO: 69592 - DNA, 9 bp, Unknown
  misc_feature (1)..( 9): Matrix.004 file - promoters50/1481568
aaagtgatt

SEQ ID NO: 69593 - DNA, 9 bp, Unknown
  misc_feature (1)..( 9): Matrix.004 file - promoters50/1481568
aagagtaaa

SEQ ID NO: 69594 - DNA, 10 bp, Unknown
  misc_feature (1)..( 10): Matrix.004 file - promoters50/1481572
ggaaatgaaa

SEQ ID NO: 69595 - DNA, 9 bp, Unknown
  misc_feature (1)..( 9): Matrix.004 file - promoters50/1481572
agaatatgt

SEQ ID NO: 69596 - DNA, 8 bp, Unknown
  misc_feature (1)..( 8): Matrix.004 file - promoters50/1481572
tggatatt

SEQ ID NO: 69597 - DNA, 11 bp, Unknown
  misc_feature (1)..( 11): Matrix.004 file - promoters50/1481576
aaacttcatct

SEQ ID NO: 69598 - DNA, 8 bp, Unknown
  misc_feature (1)..( 8): Matrix.004 file - promoters50/1481576
ttttgttt

SEQ ID NO: 69599 - DNA, 9 bp, Unknown
  misc_feature (1)..( 9): Matrix.004 file - promoters50/1481606
atattagta

SEQ ID NO: 69600 - DNA, 12 bp, Unknown
  misc_feature (1)..( 12): Matrix.004 file - promoters50/1481606
aaacataaataa

SEQ ID NO: 69601 - DNA, 9 bp, Unknown
  misc_feature (1)..( 9): Matrix.004 file - promoters50/1481606
taacaactt

SEQ ID NO: 69602 - DNA, 7 bp, Unknown
  misc_feature (1)..( 7): Matrix.004 file - promoters50/1481606
atgttga

SEQ ID NO: 69603 - DNA, 8 bp, Unknown
  misc_feature (1)..( 8): Matrix.004 file - promoters50/1481606
taatattt

SEQ ID NO: 69604 - DNA, 7 bp, Unknown
  misc_feature (1)..( 7): Matrix.004 file - promoters50/1481606
atgttgc

SEQ ID NO: 69605 - DNA, 8 bp, Unknown
  misc_feature (1)..( 8): Matrix.004 file - promoters50/1481658
ttcttttc

SEQ ID NO: 69606 - DNA, 10 bp, Unknown
  misc_feature (1)..( 10): Matrix.004 file - promoters50/1481658
caaaatcaac

SEQ ID NO: 69607 - DNA, 10 bp, Unknown
  misc_feature (1)..( 10): Matrix.004 file - promoters50/1481696
aaaatcatcc

SEQ ID NO: 69608 - DNA, 12 bp, Unknown
  misc_feature (1)..( 12): Matrix.004 file - promoters50/1481696
acatttaaaaac

SEQ ID NO: 69609 - DNA, 9 bp, Unknown
  misc_feature (1)..( 9): Matrix.004 file - promoters50/1481851
aaaaattta

SEQ ID NO: 69610 - DNA, 10 bp, Unknown
  misc_feature (1)..( 10): Matrix.004 file - promoters50/1481930
gtcctttctg

SEQ ID NO: 69611 - DNA, 9 bp, Unknown
  misc_feature (1)..( 9): Matrix.004 file - promoters50/1481930
atacacata

SEQ ID NO: 69612 - DNA, 7 bp, Unknown
  misc_feature (1)..( 7): Matrix.004 file - promoters50/1481930
aagtgtg

SEQ ID NO: 69613 - DNA, 7 bp, Unknown
  misc_feature (1)..( 7): Matrix.004 file - promoters50/1481961
aatatat

SEQ ID NO: 69614 - DNA, 7 bp, Unknown
  misc_feature (1)..( 7): Matrix.004 file - promoters50/1481961
tcttttt

SEQ ID NO: 69615 - DNA, 8 bp, Unknown
  misc_feature (1)..( 8): Matrix.004 file - promoters50/1481961
atttttta

SEQ ID NO: 69616 - DNA, 9 bp, Unknown
  misc_feature (1)..( 9): Matrix.004 file - promoters50/1482017
attcgtttc

SEQ ID NO: 69617 - DNA, 9 bp, Unknown
  misc_feature (1)..( 9): Matrix.004 file - promoters50/1482017
tttttgttt

SEQ ID NO: 69618 - DNA, 12 bp, Unknown
  misc_feature (1)..( 12): Matrix.004 file - promoters50/1482017
tatttaaataaa

SEQ ID NO: 69619 - DNA, 9 bp, Unknown
  misc_feature (1)..( 9): Matrix.004 file - promoters50/1482017
atttttgta

SEQ ID NO: 69620 - DNA, 11 bp, Unknown
  misc_feature (1)..( 11): Matrix.004 file - promoters50/1482017
caaaataatat

SEQ ID NO: 69621 - DNA, 10 bp, Unknown
  misc_feature (1)..( 10): Matrix.004 file - promoters50/1482017
atttatcaat

SEQ ID NO: 69622 - DNA, 11 bp, Unknown
  misc_feature (1)..( 11): Matrix.004 file - promoters50/1482017
aaatattttta

SEQ ID NO: 69623 - DNA, 9 bp, Unknown
  misc_feature (1)..( 9): Matrix.004 file - promoters50/1482017
aaacagtaa

SEQ ID NO: 69624 - DNA, 7 bp, Unknown
  misc_feature (1)..( 7): Matrix.004 file - promoters50/1482025
gaataaa

SEQ ID NO: 69625 - DNA, 10 bp, Unknown
  misc_feature (1)..( 10): Matrix.004 file - promoters50/1482025
ggtaagaaaa

SEQ ID NO: 69626 - DNA, 8 bp, Unknown
  misc_feature (1)..( 8): Matrix.004 file - promoters50/1482201
aataacta

SEQ ID NO: 69627 - DNA, 9 bp, Unknown
  misc_feature (1)..( 9): Matrix.004 file - promoters50/1482201
agagacagt

SEQ ID NO: 69628 - DNA, 5 bp, Unknown
  misc_feature (1)..( 5): Matrix.004 file - promoters50/1482448
tcaat

SEQ ID NO: 69629 - DNA, 9 bp, Unknown
  misc_feature (1)..( 9): Matrix.004 file - promoters50/1482448
aaatcaaat

SEQ ID NO: 69630 - DNA, 9 bp, Unknown
  misc_feature (1)..( 9): Matrix.004 file - promoters50/1482457
actatataa

SEQ ID NO: 69631 - DNA, 10 bp, Unknown
  misc_feature (1)..( 10): Matrix.004 file - promoters50/1532660
taaaaagttt

SEQ ID NO: 69632 - DNA, 10 bp, Unknown
  misc_feature (1)..( 10): Matrix.004 file - promoters50/1532821
ttaaatttgt

SEQ ID NO: 69633 - DNA, 12 bp, Unknown
  misc_feature (1)..( 12): Matrix.004 file - promoters50/1532821
tactaacatatg

SEQ ID NO: 69634 - DNA, 9 bp, Unknown
  misc_feature (1)..( 9): Matrix.004 file - promoters50/1532821
aaaatattg

SEQ ID NO: 69635 - DNA, 12 bp, Unknown
  misc_feature (1)..( 12): Matrix.004 file - promoters50/1532823
ccaccacttttt

SEQ ID NO: 69636 - DNA, 7 bp, Unknown
  misc_feature (1)..( 7): Matrix.004 file - promoters50/1532925
ttattat

SEQ ID NO: 69637 - DNA, 7 bp, Unknown
  misc_feature (1)..( 7): Matrix.004 file - promoters50/1532937
cgtctga

SEQ ID NO: 69638 - DNA, 11 bp, Unknown
  misc_feature (1)..( 11): Matrix.004 file - promoters50/1532937
tcttttgaatt

SEQ ID NO: 69639 - DNA, 14 bp, Unknown
  misc_feature (1)..( 14): Matrix.004 file - promoters50/1532937
ctttaaaatctaat

SEQ ID NO: 69640 - DNA, 10 bp, Unknown
  misc_feature (1)..( 10): Matrix.004 file - promoters50/1532948
taataaatat

SEQ ID NO: 69641 - DNA, 8 bp, Unknown
  misc_feature (1)..( 8): Matrix.004 file - promoters50/1532948
attccatt

SEQ ID NO: 69642 - DNA, 8 bp, Unknown
  misc_feature (1)..( 8): Matrix.004 file - promoters50/1532948
ttttgtaa

SEQ ID NO: 69643 - DNA, 8 bp, Unknown
  misc_feature (1)..( 8): Matrix.004 file - promoters50/1532948
cccactaa

SEQ ID NO: 69644 - DNA, 7 bp, Unknown
  misc_feature (1)..( 7): Matrix.004 file - promoters50/1532948
ggagaaa

SEQ ID NO: 69645 - DNA, 12 bp, Unknown
  misc_feature (1)..( 12): Matrix.004 file - promoters50/1532948
aaaagaaattaa

SEQ ID NO: 69646 - DNA, 12 bp, Unknown
  misc_feature (1)..( 12): Matrix.004 file - promoters50/1532948
ttgagacaaaaa

SEQ ID NO: 69647 - DNA, 6 bp, Unknown
  misc_feature (1)..( 6): Matrix.004 file - promoters50/1532948
agtaaa

SEQ ID NO: 69648 - DNA, 12 bp, Unknown
  misc_feature (1)..( 12): Matrix.004 file - promoters50/1532948
ttgaaacaaaaa

SEQ ID NO: 69649 - DNA, 11 bp, Unknown
  misc_feature (1)..( 11): Matrix.004 file - promoters50/1532975
ggaaaagaaat

SEQ ID NO: 69650 - DNA, 8 bp, Unknown
  misc_feature (1)..( 8): Matrix.004 file - promoters50/1532975
taacttaa

SEQ ID NO: 69651 - DNA, 10 bp, Unknown
  misc_feature (1)..( 10): Matrix.004 file - promoters50/1532975
tgtaatcggg

SEQ ID NO: 69652 - DNA, 9 bp, Unknown
  misc_feature (1)..( 9): Matrix.004 file - promoters50/1533080
tcggtgttg

SEQ ID NO: 69653 - DNA, 8 bp, Unknown
  misc_feature (1)..( 8): Matrix.004 file - promoters50/1533080
atattata

SEQ ID NO: 69654 - DNA, 9 bp, Unknown
  misc_feature (1)..( 9): Matrix.004 file - promoters50/1533080
gttatcaaa

SEQ ID NO: 69655 - DNA, 8 bp, Unknown
  misc_feature (1)..( 8): Matrix.004 file - promoters50/1533080
ttacatat

SEQ ID NO: 69656 - DNA, 8 bp, Unknown
  misc_feature (1)..( 8): Matrix.004 file - promoters50/1533080
tattaaaa

SEQ ID NO: 69657 - DNA, 9 bp, Unknown
  misc_feature (1)..( 9): Matrix.004 file - promoters50/1533159
tttatgaaa

SEQ ID NO: 69658 - DNA, 8 bp, Unknown
  misc_feature (1)..( 8): Matrix.004 file - promoters50/1533159
atatttaa

SEQ ID NO: 69659 - DNA, 12 bp, Unknown
  misc_feature (1)..( 12): Matrix.004 file - promoters50/1533159
taattttaaata

SEQ ID NO: 69660 - DNA, 10 bp, Unknown
  misc_feature (1)..( 10): Matrix.004 file - promoters50/1533159
agaataatat

SEQ ID NO: 69661 - DNA, 10 bp, Unknown
  misc_feature (1)..( 10): Matrix.004 file - promoters50/1533159
tctaatttct

SEQ ID NO: 69662 - DNA, 10 bp, Unknown
  misc_feature (1)..( 10): Matrix.004 file - promoters50/1533159
attgtaaaaa

SEQ ID NO: 69663 - DNA, 11 bp, Unknown
  misc_feature (1)..( 11): Matrix.004 file - promoters50/1533159
acgaaaatgaa

SEQ ID NO: 69664 - DNA, 9 bp, Unknown
  misc_feature (1)..( 9): Matrix.004 file - promoters50/1533159
atttttaat

SEQ ID NO: 69665 - DNA, 11 bp, Unknown
  misc_feature (1)..( 11): Matrix.004 file - promoters50/1533159
attttataata

SEQ ID NO: 69666 - DNA, 11 bp, Unknown
  misc_feature (1)..( 11): Matrix.004 file - promoters50/1533159
aataataaaga

SEQ ID NO: 69667 - DNA, 11 bp, Unknown
  misc_feature (1)..( 11): Matrix.004 file - promoters50/1533159
aaaaaaaaaat

SEQ ID NO: 69668 - DNA, 12 bp, Unknown
  misc_feature (1)..( 12): Matrix.004 file - promoters50/1533159
attttattaata

SEQ ID NO: 69669 - DNA, 11 bp, Unknown
  misc_feature (1)..( 11): Matrix.004 file - promoters50/1533159
aaaaaaattta

SEQ ID NO: 69670 - DNA, 13 bp, Unknown
  misc_feature (1)..( 13): Matrix.004 file - promoters50/1533201
tttattttttcaa

SEQ ID NO: 69671 - DNA, 8 bp, Unknown
  misc_feature (1)..( 8): Matrix.004 file - promoters50/1533294
cagagaaa

SEQ ID NO: 69672 - DNA, 9 bp, Unknown
  misc_feature (1)..( 9): Matrix.004 file - promoters50/1533294
aaatgaaaa

SEQ ID NO: 69673 - DNA, 9 bp, Unknown
  misc_feature (1)..( 9): Matrix.004 file - promoters50/1533294
tttgatttg

SEQ ID NO: 69674 - DNA, 10 bp, Unknown
  misc_feature (1)..( 10): Matrix.004 file - promoters50/1533294
gcccaaaact

SEQ ID NO: 69675 - DNA, 12 bp, Unknown
  misc_feature (1)..( 12): Matrix.004 file - promoters50/1533294
catttatcttct

SEQ ID NO: 69676 - DNA, 6 bp, Unknown
  misc_feature (1)..( 6): Matrix.004 file - promoters50/1533294
gatttg

SEQ ID NO: 69677 - DNA, 8 bp, Unknown
  misc_feature (1)..( 8): Matrix.004 file - promoters50/1533330
aaatttgt

SEQ ID NO: 69678 - DNA, 12 bp, Unknown
  misc_feature (1)..( 12): Matrix.004 file - promoters50/1533352
tattgaaaacaa

SEQ ID NO: 69679 - DNA, 10 bp, Unknown
  misc_feature (1)..( 10): Matrix.004 file - promoters50/1533352
taaaaaacca

SEQ ID NO: 69680 - DNA, 10 bp, Unknown
  misc_feature (1)..( 10): Matrix.004 file - promoters50/1533352
atttttatat

SEQ ID NO: 69681 - DNA, 9 bp, Unknown
  misc_feature (1)..( 9): Matrix.004 file - promoters50/1533352
aaagaaaaa

SEQ ID NO: 69682 - DNA, 8 bp, Unknown
  misc_feature (1)..( 8): Matrix.004 file - promoters50/1533384
gagaaaga

SEQ ID NO: 69683 - DNA, 7 bp, Unknown
  misc_feature (1)..( 7): Matrix.004 file - promoters50/1533533
catcaaa

SEQ ID NO: 69684 - DNA, 10 bp, Unknown
  misc_feature (1)..( 10): Matrix.004 file - promoters50/1533533
attttagtaa

SEQ ID NO: 69685 - DNA, 10 bp, Unknown
  misc_feature (1)..( 10): Matrix.004 file - promoters50/1533533
taatttttat

SEQ ID NO: 69686 - DNA, 11 bp, Unknown
  misc_feature (1)..( 11): Matrix.004 file - promoters50/1533533
tttatttacaa

SEQ ID NO: 69687 - DNA, 9 bp, Unknown
  misc_feature (1)..( 9): Matrix.004 file - promoters50/1533533
ttattaaaa

SEQ ID NO: 69688 - DNA, 5 bp, Unknown
  misc_feature (1)..( 5): Matrix.004 file - promoters50/1533533
aaaac

SEQ ID NO: 69689 - DNA, 10 bp, Unknown
  misc_feature (1)..( 10): Matrix.004 file - promoters50/1533533
ataaaacaat

SEQ ID NO: 69690 - DNA, 11 bp, Unknown
  misc_feature (1)..( 11): Matrix.004 file - promoters50/1533684
ataataaaaaa

SEQ ID NO: 69691 - DNA, 7 bp, Unknown
  misc_feature (1)..( 7): Matrix.004 file - promoters50/1533684
aaaaaat

SEQ ID NO: 69692 - DNA, 7 bp, Unknown
  misc_feature (1)..( 7): Matrix.004 file - promoters50/1533684
cttatta

SEQ ID NO: 69693 - DNA, 8 bp, Unknown
  misc_feature (1)..( 8): Matrix.004 file - promoters50/1533684
ttttcggt

SEQ ID NO: 69694 - DNA, 11 bp, Unknown
  misc_feature (1)..( 11): Matrix.004 file - promoters50/1533750
ttctttactaa

SEQ ID NO: 69695 - DNA, 13 bp, Unknown
  misc_feature (1)..( 13): Matrix.004 file - promoters50/1533750
cagaagaaaaatt

SEQ ID NO: 69696 - DNA, 12 bp, Unknown
  misc_feature (1)..( 12): Matrix.004 file - promoters50/1533750
caaaacaaaaat

SEQ ID NO: 69697 - DNA, 14 bp, Unknown
  misc_feature (1)..( 14): Matrix.004 file - promoters50/1533750
aagaaataacgaac

SEQ ID NO: 69698 - DNA, 8 bp, Unknown
  misc_feature (1)..( 8): Matrix.004 file - promoters50/1533762
ccaaaaaa

SEQ ID NO: 69699 - DNA, 7 bp, Unknown
  misc_feature (1)..( 7): Matrix.004 file - promoters50/1533762
ggaaaaa

SEQ ID NO: 69700 - DNA, 6 bp, Unknown
  misc_feature (1)..( 6): Matrix.004 file - promoters50/1533878
gaatct

SEQ ID NO: 69701 - DNA, 11 bp, Unknown
  misc_feature (1)..( 11): Matrix.004 file - promoters50/1533878
ttctccttata

SEQ ID NO: 69702 - DNA, 9 bp, Unknown
  misc_feature (1)..( 9): Matrix.004 file - promoters50/1533878
ataatttat

SEQ ID NO: 69703 - DNA, 11 bp, Unknown
  misc_feature (1)..( 11): Matrix.004 file - promoters50/1533882
atacataccca

SEQ ID NO: 69704 - DNA, 8 bp, Unknown
  misc_feature (1)..( 8): Matrix.004 file - promoters50/1533882
gttcaact

SEQ ID NO: 69705 - DNA, 12 bp, Unknown
  misc_feature (1)..( 12): Matrix.004 file - promoters50/1533912
ttaaatccacaa

SEQ ID NO: 69706 - DNA, 11 bp, Unknown
  misc_feature (1)..( 11): Matrix.004 file - promoters50/1533912
ctatataaaca

SEQ ID NO: 69707 - DNA, 8 bp, Unknown
  misc_feature (1)..( 8): Matrix.004 file - promoters50/1533912
tatataaa

SEQ ID NO: 69708 - DNA, 13 bp, Unknown
  misc_feature (1)..( 13): Matrix.004 file - promoters50/1534128
ttttaacagttgt

SEQ ID NO: 69709 - DNA, 13 bp, Unknown
  misc_feature (1)..( 13): Matrix.004 file - promoters50/1534228
attttaaaccttc

SEQ ID NO: 69710 - DNA, 9 bp, Unknown
  misc_feature (1)..( 9): Matrix.004 file - promoters50/1534228
aaaactatt

SEQ ID NO: 69711 - DNA, 7 bp, Unknown
  misc_feature (1)..( 7): Matrix.004 file - promoters50/1534228
taattta

SEQ ID NO: 69712 - DNA, 17 bp, Unknown
  misc_feature (1)..( 17): Matrix.004 file - promoters50/1534228
ctcagtgtatataaatt

SEQ ID NO: 69713 - DNA, 18 bp, Unknown
  misc_feature (1)..( 18): Matrix.004 file - promoters50/1534228
ctctagtctatataaaca

SEQ ID NO: 69714 - DNA, 7 bp, Unknown
  misc_feature (1)..( 7): Matrix.004 file - promoters50/1534269
taatttg

SEQ ID NO: 69715 - DNA, 8 bp, Unknown
  misc_feature (1)..( 8): Matrix.004 file - promoters50/1534269
tatcttct

SEQ ID NO: 69716 - DNA, 10 bp, Unknown
  misc_feature (1)..( 10): Matrix.004 file - promoters50/1534269
agattcttga

SEQ ID NO: 69717 - DNA, 8 bp, Unknown
  misc_feature (1)..( 8): Matrix.004 file - promoters50/1534269
tttcaaat

SEQ ID NO: 69718 - DNA, 11 bp, Unknown
  misc_feature (1)..( 11): Matrix.004 file - promoters50/1534269
ccaaatttttc

SEQ ID NO: 69719 - DNA, 9 bp, Unknown
  misc_feature (1)..( 9): Matrix.004 file - promoters50/1534269
tgaaagaat

SEQ ID NO: 69720 - DNA, 8 bp, Unknown
  misc_feature (1)..( 8): Matrix.004 file - promoters50/1534276
gatgtatt

SEQ ID NO: 69721 - DNA, 10 bp, Unknown
  misc_feature (1)..( 10): Matrix.004 file - promoters50/1534276
atcaaattct

SEQ ID NO: 69722 - DNA, 7 bp, Unknown
  misc_feature (1)..( 7): Matrix.004 file - promoters50/1534276
aagcaac

SEQ ID NO: 69723 - DNA, 8 bp, Unknown
  misc_feature (1)..( 8): Matrix.004 file - promoters50/1534341
aaaataaa

SEQ ID NO: 69724 - DNA, 14 bp, Unknown
  misc_feature (1)..( 14): Matrix.004 file - promoters50/1534341
caaattaaacaaag

SEQ ID NO: 69725 - DNA, 8 bp, Unknown
  misc_feature (1)..( 8): Matrix.004 file - promoters50/1534378
tatataaa

SEQ ID NO: 69726 - DNA, 7 bp, Unknown
  misc_feature (1)..( 7): Matrix.004 file - promoters50/1534390
tgttttc

SEQ ID NO: 69727 - DNA, 9 bp, Unknown
  misc_feature (1)..( 9): Matrix.004 file - promoters50/1534455
cacggaact

SEQ ID NO: 69728 - DNA, 9 bp, Unknown
  misc_feature (1)..( 9): Matrix.004 file - promoters50/1534455
gattttgag

SEQ ID NO: 69729 - DNA, 12 bp, Unknown
  misc_feature (1)..( 12): Matrix.004 file - promoters50/1534455
aatcaaacattt

SEQ ID NO: 69730 - DNA, 8 bp, Unknown
  misc_feature (1)..( 8): Matrix.004 file - promoters50/1534455
tatattat

SEQ ID NO: 69731 - DNA, 8 bp, Unknown
  misc_feature (1)..( 8): Matrix.004 file - promoters50/1534455
ttttttat

SEQ ID NO: 69732 - DNA, 11 bp, Unknown
  misc_feature (1)..( 11): Matrix.004 file - promoters50/1534455
tctttttatga

SEQ ID NO: 69733 - DNA, 9 bp, Unknown
  misc_feature (1)..( 9): Matrix.004 file - promoters50/1534501
tgattattt

SEQ ID NO: 69734 - DNA, 6 bp, Unknown
  misc_feature (1)..( 6): Matrix.004 file - promoters50/1534501
aaaaaa

SEQ ID NO: 69735 - DNA, 11 bp, Unknown
  misc_feature (1)..( 11): Matrix.004 file - promoters50/1534501
aaaattaattg

SEQ ID NO: 69736 - DNA, 9 bp, Unknown
  misc_feature (1)..( 9): Matrix.004 file - promoters50/1534501
aatttattt

SEQ ID NO: 69737 - DNA, 7 bp, Unknown
  misc_feature (1)..( 7): Matrix.004 file - promoters50/1534524
agatcaa

SEQ ID NO: 69738 - DNA, 13 bp, Unknown
  misc_feature (1)..( 13): Matrix.004 file - promoters50/1534524
acttatatatact

SEQ ID NO: 69739 - DNA, 14 bp, Unknown
  misc_feature (1)..( 14): Matrix.004 file - promoters50/1534524
gaatatacagtatg

SEQ ID NO: 69740 - DNA, 9 bp, Unknown
  misc_feature (1)..( 9): Matrix.004 file - promoters50/1534570
caaaaacat

SEQ ID NO: 69741 - DNA, 8 bp, Unknown
  misc_feature (1)..( 8): Matrix.004 file - promoters50/1534570
tcaatttt

SEQ ID NO: 69742 - DNA, 7 bp, Unknown
  misc_feature (1)..( 7): Matrix.004 file - promoters50/1534570
atttaac

SEQ ID NO: 69743 - DNA, 9 bp, Unknown
  misc_feature (1)..( 9): Matrix.004 file - promoters50/1534570
aatttattt

SEQ ID NO: 69744 - DNA, 9 bp, Unknown
  misc_feature (1)..( 9): Matrix.004 file - promoters50/1534570
aattcttac

SEQ ID NO: 69745 - DNA, 8 bp, Unknown
  misc_feature (1)..( 8): Matrix.004 file - promoters50/1534570
attttgtt

SEQ ID NO: 69746 - DNA, 11 bp, Unknown
  misc_feature (1)..( 11): Matrix.004 file - promoters50/1534570
attaaaaaaat

SEQ ID NO: 69747 - DNA, 7 bp, Unknown
  misc_feature (1)..( 7): Matrix.004 file - promoters50/1534591
acagaga

SEQ ID NO: 69748 - DNA, 8 bp, Unknown
  misc_feature (1)..( 8): Matrix.004 file - promoters50/1534591
tatataat

SEQ ID NO: 69749 - DNA, 11 bp, Unknown
  misc_feature (1)..( 11): Matrix.004 file - promoters50/1534591
attattaaaca

SEQ ID NO: 69750 - DNA, 8 bp, Unknown
  misc_feature (1)..( 8): Matrix.004 file - promoters50/1534615
aatagaaa

SEQ ID NO: 69751 - DNA, 9 bp, Unknown
  misc_feature (1)..( 9): Matrix.004 file - promoters50/1534629
tcaaagaaa

SEQ ID NO: 69752 - DNA, 10 bp, Unknown
  misc_feature (1)..( 10): Matrix.004 file - promoters50/1534667
ttttatcaac

SEQ ID NO: 69753 - DNA, 6 bp, Unknown
  misc_feature (1)..( 6): Matrix.004 file - promoters50/1534667
aaaaaa

SEQ ID NO: 69754 - DNA, 11 bp, Unknown
  misc_feature (1)..( 11): Matrix.004 file - promoters50/1534671
caataaataat

SEQ ID NO: 69755 - DNA, 12 bp, Unknown
  misc_feature (1)..( 12): Matrix.004 file - promoters50/1534671
tctttagaattt

SEQ ID NO: 69756 - DNA, 10 bp, Unknown
  misc_feature (1)..( 10): Matrix.004 file - promoters50/1534671
caaaatgaga

SEQ ID NO: 69757 - DNA, 14 bp, Unknown
  misc_feature (1)..( 14): Matrix.004 file - promoters50/1535124
ttttctaaattaat

SEQ ID NO: 69758 - DNA, 7 bp, Unknown
  misc_feature (1)..( 7): Matrix.004 file - promoters50/1535124
tcaaaca

SEQ ID NO: 69759 - DNA, 9 bp, Unknown
  misc_feature (1)..( 9): Matrix.004 file - promoters50/1535124
ttttacaat

SEQ ID NO: 69760 - DNA, 6 bp, Unknown
  misc_feature (1)..( 6): Matrix.004 file - promoters50/1535124
tttatt

SEQ ID NO: 69761 - DNA, 9 bp, Unknown
  misc_feature (1)..( 9): Matrix.004 file - promoters50/1535124
tcaaacaaa

SEQ ID NO: 69762 - DNA, 9 bp, Unknown
  misc_feature (1)..( 9): Matrix.004 file - promoters50/1535124
ttttgcatg

SEQ ID NO: 69763 - DNA, 8 bp, Unknown
  misc_feature (1)..( 8): Matrix.004 file - promoters50/1535124
tttatttt

SEQ ID NO: 69764 - DNA, 8 bp, Unknown
  misc_feature (1)..( 8): Matrix.004 file - promoters50/1535124
tattttgg

SEQ ID NO: 69765 - DNA, 9 bp, Unknown
  misc_feature (1)..( 9): Matrix.004 file - promoters50/1535145
tttcattaa

SEQ ID NO: 69766 - DNA, 8 bp, Unknown
  misc_feature (1)..( 8): Matrix.004 file - promoters50/1537300
tagattca

SEQ ID NO: 69767 - DNA, 9 bp, Unknown
  misc_feature (1)..( 9): Matrix.004 file - promoters50/1537314
agaggcttg

SEQ ID NO: 69768 - DNA, 10 bp, Unknown
  misc_feature (1)..( 10): Matrix.004 file - promoters50/1537314
tgaagaaaaa

SEQ ID NO: 69769 - DNA, 14 bp, Unknown
  misc_feature (1)..( 14): Matrix.004 file - promoters50/1537314
aatataaatttttt

SEQ ID NO: 69770 - DNA, 10 bp, Unknown
  misc_feature (1)..( 10): Matrix.004 file - promoters50/1537314
aaaaaaatgt

SEQ ID NO: 69771 - DNA, 7 bp, Unknown
  misc_feature (1)..( 7): Matrix.004 file - promoters50/1537314
ttttaaa

SEQ ID NO: 69772 - DNA, 11 bp, Unknown
  misc_feature (1)..( 11): Matrix.004 file - promoters50/1537336
gaaaaacatgg

SEQ ID NO: 69773 - DNA, 10 bp, Unknown
  misc_feature (1)..( 10): Matrix.004 file - promoters50/1537336
aaatagatct

SEQ ID NO: 69774 - DNA, 9 bp, Unknown
  misc_feature (1)..( 9): Matrix.004 file - promoters50/1537456
taagaattt

SEQ ID NO: 69775 - DNA, 8 bp, Unknown
  misc_feature (1)..( 8): Matrix.004 file - promoters50/1537605
ctttcttt

SEQ ID NO: 69776 - DNA, 7 bp, Unknown
  misc_feature (1)..( 7): Matrix.004 file - promoters50/1537605
attaaaa

SEQ ID NO: 69777 - DNA, 9 bp, Unknown
  misc_feature (1)..( 9): Matrix.004 file - promoters50/1537605
aaattatta

SEQ ID NO: 69778 - DNA, 7 bp, Unknown
  misc_feature (1)..( 7): Matrix.004 file - promoters50/1537605
cttttgt

SEQ ID NO: 69779 - DNA, 12 bp, Unknown
  misc_feature (1)..( 12): Matrix.004 file - promoters50/1537617
cctagtgatcaa

SEQ ID NO: 69780 - DNA, 9 bp, Unknown
  misc_feature (1)..( 9): Matrix.004 file - promoters50/1537617
tgtatgcat

SEQ ID NO: 69781 - DNA, 10 bp, Unknown
  misc_feature (1)..( 10): Matrix.004 file - promoters50/1537617
tcaattttat

SEQ ID NO: 69782 - DNA, 7 bp, Unknown
  misc_feature (1)..( 7): Matrix.004 file - promoters50/1537617
taaaatt

SEQ ID NO: 69783 - DNA, 8 bp, Unknown
  misc_feature (1)..( 8): Matrix.004 file - promoters50/1537617
ttattaat

SEQ ID NO: 69784 - DNA, 7 bp, Unknown
  misc_feature (1)..( 7): Matrix.004 file - promoters50/1537617
attattt

SEQ ID NO: 69785 - DNA, 8 bp, Unknown
  misc_feature (1)..( 8): Matrix.004 file - promoters50/1537617
tatcttaa

SEQ ID NO: 69786 - DNA, 9 bp, Unknown
  misc_feature (1)..( 9): Matrix.004 file - promoters50/1538641
aataaatag

SEQ ID NO: 69787 - DNA, 7 bp, Unknown
  misc_feature (1)..( 7): Matrix.004 file - promoters50/1538641
ataaaat

SEQ ID NO: 69788 - DNA, 9 bp, Unknown
  misc_feature (1)..( 9): Matrix.004 file - promoters50/1538782
atctatttt

SEQ ID NO: 69789 - DNA, 10 bp, Unknown
  misc_feature (1)..( 10): Matrix.004 file - promoters50/1538804
aatataaaat

SEQ ID NO: 69790 - DNA, 7 bp, Unknown
  misc_feature (1)..( 7): Matrix.004 file - promoters50/1538843
gttagag

SEQ ID NO: 69791 - DNA, 8 bp, Unknown
  misc_feature (1)..( 8): Matrix.004 file - promoters50/1538947
caaaacaa

SEQ ID NO: 69792 - DNA, 11 bp, Unknown
  misc_feature (1)..( 11): Matrix.004 file - promoters50/1538947
aatttaaatag

SEQ ID NO: 69793 - DNA, 8 bp, Unknown
  misc_feature (1)..( 8): Matrix.004 file - promoters50/1538947
gaaaaaga

SEQ ID NO: 69794 - DNA, 12 bp, Unknown
  misc_feature (1)..( 12): Matrix.004 file - promoters50/1557475
caaaatttcttg

SEQ ID NO: 69795 - DNA, 8 bp, Unknown
  misc_feature (1)..( 8): Matrix.004 file - promoters50/1557475
caaatttt

SEQ ID NO: 69796 - DNA, 10 bp, Unknown
  misc_feature (1)..( 10): Matrix.004 file - promoters50/1557475
ttaaaaaata

SEQ ID NO: 69797 - DNA, 8 bp, Unknown
  misc_feature (1)..( 8): Matrix.004 file - promoters50/1557486
cgacaaaa

SEQ ID NO: 69798 - DNA, 9 bp, Unknown
  misc_feature (1)..( 9): Matrix.004 file - promoters50/1557486
aaaaatttc

SEQ ID NO: 69799 - DNA, 9 bp, Unknown
  misc_feature (1)..( 9): Matrix.004 file - promoters50/1557486
atttatatg

SEQ ID NO: 69800 - DNA, 9 bp, Unknown
  misc_feature (1)..( 9): Matrix.004 file - promoters50/1557486
tctaagaaa

SEQ ID NO: 69801 - DNA, 7 bp, Unknown
  misc_feature (1)..( 7): Matrix.004 file - promoters50/1557486
taagaaa

SEQ ID NO: 69802 - DNA, 13 bp, Unknown
  misc_feature (1)..( 13): Matrix.004 file - promoters50/1557486
ttataattttcct

SEQ ID NO: 69803 - DNA, 10 bp, Unknown
  misc_feature (1)..( 10): Matrix.004 file - promoters50/1557486
ttttctgttt

SEQ ID NO: 69804 - DNA, 10 bp, Unknown
  misc_feature (1)..( 10): Matrix.004 file - promoters50/1557486
ttttctgttt

SEQ ID NO: 69805 - DNA, 8 bp, Unknown
  misc_feature (1)..( 8): Matrix.004 file - promoters50/1557486
taacaaaa

SEQ ID NO: 69806 - DNA, 10 bp, Unknown
  misc_feature (1)..( 10): Matrix.004 file - promoters50/1557486
tctcatttat

SEQ ID NO: 69807 - DNA, 8 bp, Unknown
  misc_feature (1)..( 8): Matrix.004 file - promoters50/1557486
tttctgac

SEQ ID NO: 69808 - DNA, 7 bp, Unknown
  misc_feature (1)..( 7): Matrix.004 file - promoters50/1557501
gatttcg

SEQ ID NO: 69809 - DNA, 7 bp, Unknown
  misc_feature (1)..( 7): Matrix.004 file - promoters50/1557501
atctatt

SEQ ID NO: 69810 - DNA, 8 bp, Unknown
  misc_feature (1)..( 8): Matrix.004 file - promoters50/1557501
gaaataaa

SEQ ID NO: 69811 - DNA, 14 bp, Unknown
  misc_feature (1)..( 14): Matrix.004 file - promoters50/1557501
tttatcaaagattt

SEQ ID NO: 69812 - DNA, 11 bp, Unknown
  misc_feature (1)..( 11): Matrix.004 file - promoters50/1557561
gcttttctatc

SEQ ID NO: 69813 - DNA, 9 bp, Unknown
  misc_feature (1)..( 9): Matrix.004 file - promoters50/1557561
ttttaattt

SEQ ID NO: 69814 - DNA, 8 bp, Unknown
  misc_feature (1)..( 8): Matrix.004 file - promoters50/1557561
attgtaaa

SEQ ID NO: 69815 - DNA, 10 bp, Unknown
  misc_feature (1)..( 10): Matrix.004 file - promoters50/1557565
ttttcggtac

SEQ ID NO: 69816 - DNA, 12 bp, Unknown
  misc_feature (1)..( 12): Matrix.004 file - promoters50/1557573
aaattaattata

SEQ ID NO: 69817 - DNA, 7 bp, Unknown
  misc_feature (1)..( 7): Matrix.004 file - promoters50/1557573
ttaaaaa

SEQ ID NO: 69818 - DNA, 9 bp, Unknown
  misc_feature (1)..( 9): Matrix.004 file - promoters50/1557573
attgtagtc

SEQ ID NO: 69819 - DNA, 8 bp, Unknown
  misc_feature (1)..( 8): Matrix.004 file - promoters50/1557573
gtagattt

SEQ ID NO: 69820 - DNA, 8 bp, Unknown
  misc_feature (1)..( 8): Matrix.004 file - promoters50/1557573
atattttc

SEQ ID NO: 69821 - DNA, 7 bp, Unknown
  misc_feature (1)..( 7): Matrix.004 file - promoters50/1557584
taatttt

SEQ ID NO: 69822 - DNA, 14 bp, Unknown
  misc_feature (1)..( 14): Matrix.004 file - promoters50/1557584
ttaaaaatataaat

SEQ ID NO: 69823 - DNA, 7 bp, Unknown
  misc_feature (1)..( 7): Matrix.004 file - promoters50/1557584
aaaataa

SEQ ID NO: 69824 - DNA, 14 bp, Unknown
  misc_feature (1)..( 14): Matrix.004 file - promoters50/1557595
tttaaaatataaat

SEQ ID NO: 69825 - DNA, 11 bp, Unknown
  misc_feature (1)..( 11): Matrix.004 file - promoters50/1557595
aaatattagga

SEQ ID NO: 69826 - DNA, 9 bp, Unknown
  misc_feature (1)..( 9): Matrix.004 file - promoters50/1557606
aagaaaata

SEQ ID NO: 69827 - DNA, 10 bp, Unknown
  misc_feature (1)..( 10): Matrix.004 file - promoters50/1557618
tattgcaaat

SEQ ID NO: 69828 - DNA, 8 bp, Unknown
  misc_feature (1)..( 8): Matrix.004 file - promoters50/1557618
ataagatc

SEQ ID NO: 69829 - DNA, 9 bp, Unknown
  misc_feature (1)..( 9): Matrix.004 file - promoters50/1557618
atttatttt

SEQ ID NO: 69830 - DNA, 6 bp, Unknown
  misc_feature (1)..( 6): Matrix.004 file - promoters50/1557618
tttctt

SEQ ID NO: 69831 - DNA, 9 bp, Unknown
  misc_feature (1)..( 9): Matrix.004 file - promoters50/1557618
aaaatcaat

SEQ ID NO: 69832 - DNA, 8 bp, Unknown
  misc_feature (1)..( 8): Matrix.004 file - promoters50/1557618
gtgtttaa

SEQ ID NO: 69833 - DNA, 7 bp, Unknown
  misc_feature (1)..( 7): Matrix.004 file - promoters50/1557618
tttcttc

SEQ ID NO: 69834 - DNA, 9 bp, Unknown
  misc_feature (1)..( 9): Matrix.004 file - promoters50/1557648
aagattaat

SEQ ID NO: 69835 - DNA, 10 bp, Unknown
  misc_feature (1)..( 10): Matrix.004 file - promoters50/1557648
aaattggtag

SEQ ID NO: 69836 - DNA, 8 bp, Unknown
  misc_feature (1)..( 8): Matrix.004 file - promoters50/1557648
gtacaata

SEQ ID NO: 69837 - DNA, 10 bp, Unknown
  misc_feature (1)..( 10): Matrix.004 file - promoters50/1557648
aatttagaat

SEQ ID NO: 69838 - DNA, 15 bp, Unknown
  misc_feature (1)..( 15): Matrix.004 file - promoters50/1557648
caaagaaagaaaaca

SEQ ID NO: 69839 - DNA, 9 bp, Unknown
  misc_feature (1)..( 9): Matrix.004 file - promoters50/1557648
caatatcac

SEQ ID NO: 69840 - DNA, 8 bp, Unknown
  misc_feature (1)..( 8): Matrix.004 file - promoters50/1557648
aaagaaaa

SEQ ID NO: 69841 - DNA, 7 bp, Unknown
  misc_feature (1)..( 7): Matrix.004 file - promoters50/1557648
aaaatga

SEQ ID NO: 69842 - DNA, 8 bp, Unknown
  misc_feature (1)..( 8): Matrix.004 file - promoters50/1557648
aaatttga

SEQ ID NO: 69843 - DNA, 6 bp, Unknown
  misc_feature (1)..( 6): Matrix.004 file - promoters50/1557648
agaaaa

SEQ ID NO: 69844 - DNA, 10 bp, Unknown
  misc_feature (1)..( 10): Matrix.004 file - promoters50/1557648
caaaaagaaa

SEQ ID NO: 69845 - DNA, 9 bp, Unknown
  misc_feature (1)..( 9): Matrix.004 file - promoters50/1557660
ctttaaata

SEQ ID NO: 69846 - DNA, 10 bp, Unknown
  misc_feature (1)..( 10): Matrix.004 file - promoters50/1557672
ttatttaaca

SEQ ID NO: 69847 - DNA, 9 bp, Unknown
  misc_feature (1)..( 9): Matrix.004 file - promoters50/1557672
aatttcttt

SEQ ID NO: 69848 - DNA, 9 bp, Unknown
  misc_feature (1)..( 9): Matrix.004 file - promoters50/1557672
agattcgtt

SEQ ID NO: 69849 - DNA, 8 bp, Unknown
  misc_feature (1)..( 8): Matrix.004 file - promoters50/1557672
ttgaatta

SEQ ID NO: 69850 - DNA, 11 bp, Unknown
  misc_feature (1)..( 11): Matrix.004 file - promoters50/1557672
ttccaaaaaaa

SEQ ID NO: 69851 - DNA, 8 bp, Unknown
  misc_feature (1)..( 8): Matrix.004 file - promoters50/1557672
gaaaactg

SEQ ID NO: 69852 - DNA, 7 bp, Unknown
  misc_feature (1)..( 7): Matrix.004 file - promoters50/1557672
tcgttat

SEQ ID NO: 69853 - DNA, 8 bp, Unknown
  misc_feature (1)..( 8): Matrix.004 file - promoters50/1557672
tatttcaa

SEQ ID NO: 69854 - DNA, 8 bp, Unknown
  misc_feature (1)..( 8): Matrix.004 file - promoters50/1557712
agagagaa

SEQ ID NO: 69855 - DNA, 11 bp, Unknown
  misc_feature (1)..( 11): Matrix.004 file - promoters50/1557712
atattttaaaa

SEQ ID NO: 69856 - DNA, 9 bp, Unknown
  misc_feature (1)..( 9): Matrix.004 file - promoters50/1557751
tgtttaaac

SEQ ID NO: 69857 - DNA, 8 bp, Unknown
  misc_feature (1)..( 8): Matrix.004 file - promoters50/1557765
aaaacata

SEQ ID NO: 69858 - DNA, 11 bp, Unknown
  misc_feature (1)..( 11): Matrix.004 file - promoters50/1557765
aaattttgaaa

SEQ ID NO: 69859 - DNA, 10 bp, Unknown
  misc_feature (1)..( 10): Matrix.004 file - promoters50/1557765
ttacaaaatt

SEQ ID NO: 69860 - DNA, 11 bp, Unknown
  misc_feature (1)..( 11): Matrix.004 file - promoters50/1557765
tttcttatttt

SEQ ID NO: 69861 - DNA, 9 bp, Unknown
  misc_feature (1)..( 9): Matrix.004 file - promoters50/1557765
aaacaaaat

SEQ ID NO: 69862 - DNA, 8 bp, Unknown
  misc_feature (1)..( 8): Matrix.004 file - promoters50/1557765
tttcaaat

SEQ ID NO: 69863 - DNA, 8 bp, Unknown
  misc_feature (1)..( 8): Matrix.004 file - promoters50/1557765
ttaattat

SEQ ID NO: 69864 - DNA, 11 bp, Unknown
  misc_feature (1)..( 11): Matrix.004 file - promoters50/1557765
aaattttaaaa

SEQ ID NO: 69865 - DNA, 8 bp, Unknown
  misc_feature (1)..( 8): Matrix.004 file - promoters50/1557765
tttgaaaa

SEQ ID NO: 69866 - DNA, 8 bp, Unknown
  misc_feature (1)..( 8): Matrix.004 file - promoters50/1557765
ttttgaaa

SEQ ID NO: 69867 - DNA, 9 bp, Unknown
  misc_feature (1)..( 9): Matrix.004 file - promoters50/1557769
aattttaaa

SEQ ID NO: 69868 - DNA, 11 bp, Unknown
  misc_feature (1)..( 11): Matrix.004 file - promoters50/1557769
acattttcatt

SEQ ID NO: 69869 - DNA, 9 bp, Unknown
  misc_feature (1)..( 9): Matrix.004 file - promoters50/1557769
aattttttt

SEQ ID NO: 69870 - DNA, 10 bp, Unknown
  misc_feature (1)..( 10): Matrix.004 file - promoters50/1557769
tacgatatta

SEQ ID NO: 69871 - DNA, 9 bp, Unknown
  misc_feature (1)..( 9): Matrix.004 file - promoters50/1557769
caaaaaaga

SEQ ID NO: 69872 - DNA, 12 bp, Unknown
  misc_feature (1)..( 12): Matrix.004 file - promoters50/1557783
caataaaaaatg

SEQ ID NO: 69873 - DNA, 9 bp, Unknown
  misc_feature (1)..( 9): Matrix.004 file - promoters50/1557783
tattgtaaa

SEQ ID NO: 69874 - DNA, 7 bp, Unknown
  misc_feature (1)..( 7): Matrix.004 file - promoters50/1557806
tatatga

SEQ ID NO: 69875 - DNA, 10 bp, Unknown
  misc_feature (1)..( 10): Matrix.004 file - promoters50/1565820
gataatttgt

SEQ ID NO: 69876 - DNA, 11 bp, Unknown
  misc_feature (1)..( 11): Matrix.004 file - promoters50/1566423
tagaaaaacaa

SEQ ID NO: 69877 - DNA, 10 bp, Unknown
  misc_feature (1)..( 10): Matrix.004 file - promoters50/1566423
tatattatta

SEQ ID NO: 69878 - DNA, 9 bp, Unknown
  misc_feature (1)..( 9): Matrix.004 file - promoters50/1566423
ttccaaaaa

SEQ ID NO: 69879 - DNA, 9 bp, Unknown
  misc_feature (1)..( 9): Matrix.004 file - promoters50/1566948
atttcttag

SEQ ID NO: 69880 - DNA, 10 bp, Unknown
  misc_feature (1)..( 10): Matrix.004 file - promoters50/1567007
ctaaaaacta

SEQ ID NO: 69881 - DNA, 11 bp, Unknown
  misc_feature (1)..( 11): Matrix.004 file - promoters50/1567092
ctaaaaaaaca

SEQ ID NO: 69882 - DNA, 12 bp, Unknown
  misc_feature (1)..( 12): Matrix.004 file - promoters50/1567092
taaaaaatttac

SEQ ID NO: 69883 - DNA, 7 bp, Unknown
  misc_feature (1)..( 7): Matrix.004 file - promoters50/1567092
ctcatat

SEQ ID NO: 69884 - DNA, 10 bp, Unknown
  misc_feature (1)..( 10): Matrix.004 file - promoters50/1567547
aaacttttta

SEQ ID NO: 69885 - DNA, 13 bp, Unknown
  misc_feature (1)..( 13): Matrix.004 file - promoters50/1567547
ttcttataattca

SEQ ID NO: 69886 - DNA, 13 bp, Unknown
  misc_feature (1)..( 13): Matrix.004 file - promoters50/1567949
aaaatttgttttt

SEQ ID NO: 69887 - DNA, 12 bp, Unknown
  misc_feature (1)..( 12): Matrix.004 file - promoters50/1567957
taacaaaaaaaa

SEQ ID NO: 69888 - DNA, 8 bp, Unknown
  misc_feature (1)..( 8): Matrix.004 file - promoters50/1567957
tttaaaaa

SEQ ID NO: 69889 - DNA, 13 bp, Unknown
  misc_feature (1)..( 13): Matrix.004 file - promoters50/1567957
attttttcaaaaa

SEQ ID NO: 69890 - DNA, 13 bp, Unknown
  misc_feature (1)..( 13): Matrix.004 file - promoters50/1568230
ccaaataaaacat

SEQ ID NO: 69891 - DNA, 10 bp, Unknown
  misc_feature (1)..( 10): Matrix.004 file - promoters50/1568386
ttaatataaa

SEQ ID NO: 69892 - DNA, 10 bp, Unknown
  misc_feature (1)..( 10): Matrix.004 file - promoters50/1568386
aaaataaatt

SEQ ID NO: 69893 - DNA, 10 bp, Unknown
  misc_feature (1)..( 10): Matrix.004 file - promoters50/1568386
ttttaattgt

SEQ ID NO: 69894 - DNA, 8 bp, Unknown
  misc_feature (1)..( 8): Matrix.004 file - promoters50/1568386
gttttatt

SEQ ID NO: 69895 - DNA, 12 bp, Unknown
  misc_feature (1)..( 12): Matrix.004 file - promoters50/1568386
ttatttgaacta

SEQ ID NO: 69896 - DNA, 13 bp, Unknown
  misc_feature (1)..( 13): Matrix.004 file - promoters50/1568386
gattaaatatata

SEQ ID NO: 69897 - DNA, 8 bp, Unknown
  misc_feature (1)..( 8): Matrix.004 file - promoters50/1568405
gaaaattt

SEQ ID NO: 69898 - DNA, 8 bp, Unknown
  misc_feature (1)..( 8): Matrix.004 file - promoters50/1568405
tttaataa

SEQ ID NO: 69899 - DNA, 7 bp, Unknown
  misc_feature (1)..( 7): Matrix.004 file - promoters50/1568405
ataaaaa

SEQ ID NO: 69900 - DNA, 11 bp, Unknown
  misc_feature (1)..( 11): Matrix.004 file - promoters50/1568409
tttatcattgt

SEQ ID NO: 69901 - DNA, 11 bp, Unknown
  misc_feature (1)..( 11): Matrix.004 file - promoters50/1568409
tgtgaatcttg

SEQ ID NO: 69902 - DNA, 9 bp, Unknown
  misc_feature (1)..( 9): Matrix.004 file - promoters50/1568409
caatctttc

SEQ ID NO: 69903 - DNA, 8 bp, Unknown
  misc_feature (1)..( 8): Matrix.004 file - promoters50/1568409
aaagtctt

SEQ ID NO: 69904 - DNA, 9 bp, Unknown
  misc_feature (1)..( 9): Matrix.004 file - promoters50/1568409
ctttatttt

SEQ ID NO: 69905 - DNA, 16 bp, Unknown
  misc_feature (1)..( 16): Matrix.004 file - promoters50/1568409
aattattatcttccta

SEQ ID NO: 69906 - DNA, 9 bp, Unknown
  misc_feature (1)..( 9): Matrix.004 file - promoters50/1568409
ttattttat

SEQ ID NO: 69907 - DNA, 8 bp, Unknown
  misc_feature (1)..( 8): Matrix.004 file - promoters50/1568409
tataaaac

SEQ ID NO: 69908 - DNA, 8 bp, Unknown
  misc_feature (1)..( 8): Matrix.004 file - promoters50/1568508
gaaaagtc

SEQ ID NO: 69909 - DNA, 8 bp, Unknown
  misc_feature (1)..( 8): Matrix.004 file - promoters50/1568924
tcttataa

SEQ ID NO: 69910 - DNA, 9 bp, Unknown
  misc_feature (1)..( 9): Matrix.004 file - promoters50/1568924
aaaaagaaa

SEQ ID NO: 69911 - DNA, 4 bp, Unknown
  misc_feature (1)..( 4): Matrix.004 file - promoters50/1568924
aaaa

SEQ ID NO: 69912 - DNA, 7 bp, Unknown
  misc_feature (1)..( 7): Matrix.004 file - promoters50/1569568
tatataa

SEQ ID NO: 69913 - DNA, 11 bp, Unknown
  misc_feature (1)..( 11): Matrix.004 file - promoters50/1569568
attataaactt

SEQ ID NO: 69914 - DNA, 11 bp, Unknown
  misc_feature (1)..( 11): Matrix.004 file - promoters50/1569568
cctataaatat

SEQ ID NO: 69915 - DNA, 11 bp, Unknown
  misc_feature (1)..( 11): Matrix.004 file - promoters50/1569568
gatttatataa

SEQ ID NO: 69916 - DNA, 11 bp, Unknown
  misc_feature (1)..( 11): Matrix.004 file - promoters50/1569568
ttttatttact

SEQ ID NO: 69917 - DNA, 15 bp, Unknown
  misc_feature (1)..( 15): Matrix.004 file - promoters50/1569568
gtctcctataaataa

SEQ ID NO: 69918 - DNA, 10 bp, Unknown
  misc_feature (1)..( 10): Matrix.004 file - promoters50/1569721
ttttatttat

SEQ ID NO: 69919 - DNA, 23 bp, Unknown
  misc_feature (1)..( 23): Matrix.004 file - promoters50/1569721
tttcatatttcttagtctcttaa

SEQ ID NO: 69920 - DNA, 11 bp, Unknown
  misc_feature (1)..( 11): Matrix.004 file - promoters50/1570085
tattctagatt

SEQ ID NO: 69921 - DNA, 8 bp, Unknown
  misc_feature (1)..( 8): Matrix.004 file - promoters50/1570085
atatatac

SEQ ID NO: 69922 - DNA, 7 bp, Unknown
  misc_feature (1)..( 7): Matrix.004 file - promoters50/1570107
tttattt

SEQ ID NO: 69923 - DNA, 14 bp, Unknown
  misc_feature (1)..( 14): Matrix.004 file - promoters50/1570107
caataaccataata

SEQ ID NO: 69924 - DNA, 8 bp, Unknown
  misc_feature (1)..( 8): Matrix.004 file - promoters50/1570107
aattgttc

SEQ ID NO: 69925 - DNA, 8 bp, Unknown
  misc_feature (1)..( 8): Matrix.004 file - promoters50/1570107
ttttaaaa

SEQ ID NO: 69926 - DNA, 7 bp, Unknown
  misc_feature (1)..( 7): Matrix.004 file - promoters50/1570107
caaaaaa

SEQ ID NO: 69927 - DNA, 8 bp, Unknown
  misc_feature (1)..( 8): Matrix.004 file - promoters50/1570107
cttttttt

SEQ ID NO: 69928 - DNA, 11 bp, Unknown
  misc_feature (1)..( 11): Matrix.004 file - promoters50/1570107
agagattcgta

SEQ ID NO: 69929 - DNA, 8 bp, Unknown
  misc_feature (1)..( 8): Matrix.004 file - promoters50/1570107
tcaataac

SEQ ID NO: 69930 - DNA, 7 bp, Unknown
  misc_feature (1)..( 7): Matrix.004 file - promoters50/1570107
aattaag

SEQ ID NO: 69931 - DNA, 6 bp, Unknown
  misc_feature (1)..( 6): Matrix.004 file - promoters50/1570107
gaaatg

SEQ ID NO: 69932 - DNA, 8 bp, Unknown
  misc_feature (1)..( 8): Matrix.004 file - promoters50/1570116
cataataa

SEQ ID NO: 69933 - DNA, 9 bp, Unknown
  misc_feature (1)..( 9): Matrix.004 file - promoters50/1570116
aaaataatt

SEQ ID NO: 69934 - DNA, 12 bp, Unknown
  misc_feature (1)..( 12): Matrix.004 file - promoters50/1570116
aaaaaaaaatta

SEQ ID NO: 69935 - DNA, 9 bp, Unknown
  misc_feature (1)..( 9): Matrix.004 file - promoters50/1570179
tttaaaaat

SEQ ID NO: 69936 - DNA, 9 bp, Unknown
  misc_feature (1)..( 9): Matrix.004 file - promoters50/1570179
acactacaa

SEQ ID NO: 69937 - DNA, 7 bp, Unknown
  misc_feature (1)..( 7): Matrix.004 file - promoters50/1570293
acaagaa

SEQ ID NO: 69938 - DNA, 14 bp, Unknown
  misc_feature (1)..( 14): Matrix.004 file - promoters50/1570293
aagagaaaagtgtg

SEQ ID NO: 69939 - DNA, 8 bp, Unknown
  misc_feature (1)..( 8): Matrix.004 file - promoters50/1570622
aagatttt

SEQ ID NO: 69940 - DNA, 9 bp, Unknown
  misc_feature (1)..( 9): Matrix.004 file - promoters50/1570622
aaaaataaa

SEQ ID NO: 69941 - DNA, 19 bp, Unknown
  misc_feature (1)..( 19): Matrix.004 file - promoters50/1570622
gtaaaacaaatcaggctaa

SEQ ID NO: 69942 - DNA, 9 bp, Unknown
  misc_feature (1)..( 9): Matrix.004 file - promoters50/1570735
aaatataaa

SEQ ID NO: 69943 - DNA, 9 bp, Unknown
  misc_feature (1)..( 9): Matrix.004 file - promoters50/1570735
tttaaatct

SEQ ID NO: 69944 - DNA, 10 bp, Unknown
  misc_feature (1)..( 10): Matrix.004 file - promoters50/1570735
tctttctttt

SEQ ID NO: 69945 - DNA, 8 bp, Unknown
  misc_feature (1)..( 8): Matrix.004 file - promoters50/1570860
tttgtttt

SEQ ID NO: 69946 - DNA, 6 bp, Unknown
  misc_feature (1)..( 6): Matrix.004 file - promoters50/1570860
caagaa

SEQ ID NO: 69947 - DNA, 13 bp, Unknown
  misc_feature (1)..( 13): Matrix.004 file - promoters50/1570860
aaactaaagatga

SEQ ID NO: 69948 - DNA, 8 bp, Unknown
  misc_feature (1)..( 8): Matrix.004 file - promoters50/1570869
attcgaaa

SEQ ID NO: 69949 - DNA, 14 bp, Unknown
  misc_feature (1)..( 14): Matrix.004 file - promoters50/1570869
aaaactttataatt

SEQ ID NO: 69950 - DNA, 10 bp, Unknown
  misc_feature (1)..( 10): Matrix.004 file - promoters50/1570869
taaatttttt

SEQ ID NO: 69951 - DNA, 11 bp, Unknown
  misc_feature (1)..( 11): Matrix.004 file - promoters50/1570869
ttttaaaaaaa

SEQ ID NO: 69952 - DNA, 12 bp, Unknown
  misc_feature (1)..( 12): Matrix.004 file - promoters50/1570869
tatataaaaaca

SEQ ID NO: 69953 - DNA, 15 bp, Unknown
  misc_feature (1)..( 15): Matrix.004 file - promoters50/1570869
taaatagtaaaaata

SEQ ID NO: 69954 - DNA, 16 bp, Unknown
  misc_feature (1)..( 16): Matrix.004 file - promoters50/1570869
tgataaatatgaaaaa

SEQ ID NO: 69955 - DNA, 8 bp, Unknown
  misc_feature (1)..( 8): Matrix.004 file - promoters50/1570966
ttttgaaa

SEQ ID NO: 69956 - DNA, 9 bp, Unknown
  misc_feature (1)..( 9): Matrix.004 file - promoters50/1570966
aaagtttga

SEQ ID NO: 69957 - DNA, 10 bp, Unknown
  misc_feature (1)..( 10): Matrix.004 file - promoters50/1570966
aattaacttt

SEQ ID NO: 69958 - DNA, 10 bp, Unknown
  misc_feature (1)..( 10): Matrix.004 file - promoters50/1570966
ttaatttttt

SEQ ID NO: 69959 - DNA, 9 bp, Unknown
  misc_feature (1)..( 9): Matrix.004 file - promoters50/1571014
tatataaaa

SEQ ID NO: 69960 - DNA, 11 bp, Unknown
  misc_feature (1)..( 11): Matrix.004 file - promoters50/1571014
gttttaaacaa

SEQ ID NO: 69961 - DNA, 12 bp, Unknown
  misc_feature (1)..( 12): Matrix.004 file - promoters50/1571014
agatgctttata

SEQ ID NO: 69962 - DNA, 10 bp, Unknown
  misc_feature (1)..( 10): Matrix.004 file - promoters50/1571079
agataattaa

SEQ ID NO: 69963 - DNA, 8 bp, Unknown
  misc_feature (1)..( 8): Matrix.004 file - promoters50/1571079
tttttcaa

SEQ ID NO: 69964 - DNA, 9 bp, Unknown
  misc_feature (1)..( 9): Matrix.004 file - promoters50/1571079
agttttaaa

SEQ ID NO: 69965 - DNA, 8 bp, Unknown
  misc_feature (1)..( 8): Matrix.004 file - promoters50/1571079
gcattaaa

SEQ ID NO: 69966 - DNA, 9 bp, Unknown
  misc_feature (1)..( 9): Matrix.004 file - promoters50/1571422
taaacatta

SEQ ID NO: 69967 - DNA, 12 bp, Unknown
  misc_feature (1)..( 12): Matrix.004 file - promoters50/1571422
tatatatgattg

SEQ ID NO: 69968 - DNA, 12 bp, Unknown
  misc_feature (1)..( 12): Matrix.004 file - promoters50/1571422
tttatttgagaa

SEQ ID NO: 69969 - DNA, 9 bp, Unknown
  misc_feature (1)..( 9): Matrix.004 file - promoters50/1571916
attatttta

SEQ ID NO: 69970 - DNA, 7 bp, Unknown
  misc_feature (1)..( 7): Matrix.004 file - promoters50/1571916
aaataaa

SEQ ID NO: 69971 - DNA, 8 bp, Unknown
  misc_feature (1)..( 8): Matrix.004 file - promoters50/1571916
caaagaat

SEQ ID NO: 69972 - DNA, 12 bp, Unknown
  misc_feature (1)..( 12): Matrix.004 file - promoters50/1572143
atatataaaccg

SEQ ID NO: 69973 - DNA, 10 bp, Unknown
  misc_feature (1)..( 10): Matrix.004 file - promoters50/1572151
agatcgaaga

SEQ ID NO: 69974 - DNA, 13 bp, Unknown
  misc_feature (1)..( 13): Matrix.004 file - promoters50/1572151
ttattaattttta

SEQ ID NO: 69975 - DNA, 12 bp, Unknown
  misc_feature (1)..( 12): Matrix.004 file - promoters50/1572151
catgtatatata

SEQ ID NO: 69976 - DNA, 11 bp, Unknown
  misc_feature (1)..( 11): Matrix.004 file - promoters50/1572151
ttaattttgat

SEQ ID NO: 69977 - DNA, 6 bp, Unknown
  misc_feature (1)..( 6): Matrix.004 file - promoters50/1572151
ttgaat

SEQ ID NO: 69978 - DNA, 14 bp, Unknown
  misc_feature (1)..( 14): Matrix.004 file - promoters50/1572151
gtaaacaatttaca

SEQ ID NO: 69979 - DNA, 9 bp, Unknown
  misc_feature (1)..( 9): Matrix.004 file - promoters50/1572151
agtatataa

SEQ ID NO: 69980 - DNA, 10 bp, Unknown
  misc_feature (1)..( 10): Matrix.004 file - promoters50/1572236
ataattttaa

SEQ ID NO: 69981 - DNA, 7 bp, Unknown
  misc_feature (1)..( 7): Matrix.004 file - promoters50/1572796
taaaatt

SEQ ID NO: 69982 - DNA, 7 bp, Unknown
  misc_feature (1)..( 7): Matrix.004 file - promoters50/1572796
aatttca

SEQ ID NO: 69983 - DNA, 8 bp, Unknown
  misc_feature (1)..( 8): Matrix.004 file - promoters50/1573594
tactgtat

SEQ ID NO: 69984 - DNA, 9 bp, Unknown
  misc_feature (1)..( 9): Matrix.004 file - promoters50/1573651
ttaaaacaa

SEQ ID NO: 69985 - DNA, 7 bp, Unknown
  misc_feature (1)..( 7): Matrix.004 file - promoters50/1573651
ctacaaa

SEQ ID NO: 69986 - DNA, 8 bp, Unknown
  misc_feature (1)..( 8): Matrix.004 file - promoters50/1573651
caaactca

SEQ ID NO: 69987 - DNA, 9 bp, Unknown
  misc_feature (1)..( 9): Matrix.004 file - promoters50/1573713
aatcataaa

SEQ ID NO: 69988 - DNA, 8 bp, Unknown
  misc_feature (1)..( 8): Matrix.004 file - promoters50/1573713
taaatata

SEQ ID NO: 69989 - DNA, 10 bp, Unknown
  misc_feature (1)..( 10): Matrix.004 file - promoters50/1573713
ataaacgaca

SEQ ID NO: 69990 - DNA, 9 bp, Unknown
  misc_feature (1)..( 9): Matrix.004 file - promoters50/1573713
tttatatga

SEQ ID NO: 69991 - DNA, 7 bp, Unknown
  misc_feature (1)..( 7): Matrix.004 file - promoters50/1573713
taatctc

SEQ ID NO: 69992 - DNA, 6 bp, Unknown
  misc_feature (1)..( 6): Matrix.004 file - promoters50/1573980
attatt

SEQ ID NO: 69993 - DNA, 14 bp, Unknown
  misc_feature (1)..( 14): Matrix.004 file - promoters50/1573980
tgtaaaattaaaaa

SEQ ID NO: 69994 - DNA, 10 bp, Unknown
  misc_feature (1)..( 10): Matrix.004 file - promoters50/1573980
aaatttattc

SEQ ID NO: 69995 - DNA, 10 bp, Unknown
  misc_feature (1)..( 10): Matrix.004 file - promoters50/1573982
ggaaatgact

SEQ ID NO: 69996 - DNA, 9 bp, Unknown
  misc_feature (1)..( 9): Matrix.004 file - promoters50/1573982
atatttttt

SEQ ID NO: 69997 - DNA, 8 bp, Unknown
  misc_feature (1)..( 8): Matrix.004 file - promoters50/1574021
aattgatt

SEQ ID NO: 69998 - DNA, 9 bp, Unknown
  misc_feature (1)..( 9): Matrix.004 file - promoters50/1574021
gttaaataa

SEQ ID NO: 69999 - DNA, 13 bp, Unknown
  misc_feature (1)..( 13): Matrix.004 file - promoters50/1574029
tgttatcaatttt

SEQ ID NO: 70000 - DNA, 7 bp, Unknown
  misc_feature (1)..( 7): Matrix.004 file - promoters50/1574044
atgtgga

SEQ ID NO: 70001 - DNA, 7 bp, Unknown
  misc_feature (1)..( 7): Matrix.004 file - promoters50/1574044
taaaaca

SEQ ID NO: 70002 - DNA, 10 bp, Unknown
  misc_feature (1)..( 10): Matrix.004 file - promoters50/1574044
ataaataaaa

SEQ ID NO: 70003 - DNA, 12 bp, Unknown
  misc_feature (1)..( 12): Matrix.004 file - promoters50/1574044
tgtctaaaacaa

SEQ ID NO: 70004 - DNA, 11 bp, Unknown
  misc_feature (1)..( 11): Matrix.004 file - promoters50/1574059
atagtaaataa

SEQ ID NO: 70005 - DNA, 7 bp, Unknown
  misc_feature (1)..( 7): Matrix.004 file - promoters50/1580171
gtaaaac

SEQ ID NO: 70006 - DNA, 7 bp, Unknown
  misc_feature (1)..( 7): Matrix.004 file - promoters50/1580171
attaaat

SEQ ID NO: 70007 - DNA, 9 bp, Unknown
  misc_feature (1)..( 9): Matrix.004 file - promoters50/1580171
aattttata

SEQ ID NO: 70008 - DNA, 12 bp, Unknown
  misc_feature (1)..( 12): Matrix.004 file - promoters50/1580263
ttctgttaaaaa

SEQ ID NO: 70009 - DNA, 10 bp, Unknown
  misc_feature (1)..( 10): Matrix.004 file - promoters50/1580298
ctaattaaat

SEQ ID NO: 70010 - DNA, 15 bp, Unknown
  misc_feature (1)..( 15): Matrix.004 file - promoters50/1580481
atgaaatcattacat

SEQ ID NO: 70011 - DNA, 8 bp, Unknown
  misc_feature (1)..( 8): Matrix.004 file - promoters50/1580481
tttataaa

SEQ ID NO: 70012 - DNA, 8 bp, Unknown
  misc_feature (1)..( 8): Matrix.004 file - promoters50/1580481
tttcttta

SEQ ID NO: 70013 - DNA, 9 bp, Unknown
  misc_feature (1)..( 9): Matrix.004 file - promoters50/1580500
ttcatttgt

SEQ ID NO: 70014 - DNA, 17 bp, Unknown
  misc_feature (1)..( 17): Matrix.004 file - promoters50/1580500
ttaaaatcatatacaaa

SEQ ID NO: 70015 - DNA, 11 bp, Unknown
  misc_feature (1)..( 11): Matrix.004 file - promoters50/1580511
atcatcataaa

SEQ ID NO: 70016 - DNA, 11 bp, Unknown
  misc_feature (1)..( 11): Matrix.004 file - promoters50/1580511
tttcattgaaa

SEQ ID NO: 70017 - DNA, 13 bp, Unknown
  misc_feature (1)..( 13): Matrix.004 file - promoters50/1580787
tcaatttgttttt

SEQ ID NO: 70018 - DNA, 9 bp, Unknown
  misc_feature (1)..( 9): Matrix.004 file - promoters50/1580870
catccatct

SEQ ID NO: 70019 - DNA, 9 bp, Unknown
  misc_feature (1)..( 9): Matrix.004 file - promoters50/1580870
tttccaaaa

SEQ ID NO: 70020 - DNA, 7 bp, Unknown
  misc_feature (1)..( 7): Matrix.004 file - promoters50/1580932
aatatat

SEQ ID NO: 70021 - DNA, 11 bp, Unknown
  misc_feature (1)..( 11): Matrix.004 file - promoters50/1580932
aatgaaattaa

SEQ ID NO: 70022 - DNA, 9 bp, Unknown
  misc_feature (1)..( 9): Matrix.004 file - promoters50/1580983
aaactaata

SEQ ID NO: 70023 - DNA, 9 bp, Unknown
  misc_feature (1)..( 9): Matrix.004 file - promoters50/1580983
aattttttt

SEQ ID NO: 70024 - DNA, 12 bp, Unknown
  misc_feature (1)..( 12): Matrix.004 file - promoters50/1581038
ttttcaacattt

SEQ ID NO: 70025 - DNA, 14 bp, Unknown
  misc_feature (1)..( 14): Matrix.004 file - promoters50/1581038
tttaaaatattaca

SEQ ID NO: 70026 - DNA, 5 bp, Unknown
  misc_feature (1)..( 5): Matrix.004 file - promoters50/1581038
taatt

SEQ ID NO: 70027 - DNA, 10 bp, Unknown
  misc_feature (1)..( 10): Matrix.004 file - promoters50/1581038
tatatataaa

SEQ ID NO: 70028 - DNA, 12 bp, Unknown
  misc_feature (1)..( 12): Matrix.004 file - promoters50/1581165
gtgatatttttc

SEQ ID NO: 70029 - DNA, 9 bp, Unknown
  misc_feature (1)..( 9): Matrix.004 file - promoters50/1581165
aaaaataag

SEQ ID NO: 70030 - DNA, 6 bp, Unknown
  misc_feature (1)..( 6): Matrix.004 file - promoters50/1581165
aaataa

SEQ ID NO: 70031 - DNA, 10 bp, Unknown
  misc_feature (1)..( 10): Matrix.004 file - promoters50/1581165
ttatttctct

SEQ ID NO: 70032 - DNA, 9 bp, Unknown
  misc_feature (1)..( 9): Matrix.004 file - promoters50/1581223
aaataaatg

SEQ ID NO: 70033 - DNA, 8 bp, Unknown
  misc_feature (1)..( 8): Matrix.004 file - promoters50/1581223
ttcgaaat

SEQ ID NO: 70034 - DNA, 6 bp, Unknown
  misc_feature (1)..( 6): Matrix.004 file - promoters50/1581454
atctaa

SEQ ID NO: 70035 - DNA, 9 bp, Unknown
  misc_feature (1)..( 9): Matrix.004 file - promoters50/1581987
agttaaaaa

SEQ ID NO: 70036 - DNA, 12 bp, Unknown
  misc_feature (1)..( 12): Matrix.004 file - promoters50/1582293
atgtgtttctca

SEQ ID NO: 70037 - DNA, 10 bp, Unknown
  misc_feature (1)..( 10): Matrix.004 file - promoters50/1582293
atataaatta

SEQ ID NO: 70038 - DNA, 11 bp, Unknown
  misc_feature (1)..( 11): Matrix.004 file - promoters50/1582293
atattacaata

SEQ ID NO: 70039 - DNA, 9 bp, Unknown
  misc_feature (1)..( 9): Matrix.004 file - promoters50/1582322
aataatgat

SEQ ID NO: 70040 - DNA, 10 bp, Unknown
  misc_feature (1)..( 10): Matrix.004 file - promoters50/1582322
aatttttttc

SEQ ID NO: 70041 - DNA, 10 bp, Unknown
  misc_feature (1)..( 10): Matrix.004 file - promoters50/1582322
aatatttata

SEQ ID NO: 70042 - DNA, 8 bp, Unknown
  misc_feature (1)..( 8): Matrix.004 file - promoters50/1582322
attttttt

SEQ ID NO: 70043 - DNA, 10 bp, Unknown
  misc_feature (1)..( 10): Matrix.004 file - promoters50/1582322
ggtatttgtt

SEQ ID NO: 70044 - DNA, 10 bp, Unknown
  misc_feature (1)..( 10): Matrix.004 file - promoters50/1582322
ttataattat

SEQ ID NO: 70045 - DNA, 12 bp, Unknown
  misc_feature (1)..( 12): Matrix.004 file - promoters50/1582322
ataaaattataa

SEQ ID NO: 70046 - DNA, 10 bp, Unknown
  misc_feature (1)..( 10): Matrix.004 file - promoters50/1582322
cttaaataaa

SEQ ID NO: 70047 - DNA, 10 bp, Unknown
  misc_feature (1)..( 10): Matrix.004 file - promoters50/1582339
taaatatttt

SEQ ID NO: 70048 - DNA, 12 bp, Unknown
  misc_feature (1)..( 12): Matrix.004 file - promoters50/1582339
agaaatattatt

SEQ ID NO: 70049 - DNA, 12 bp, Unknown
  misc_feature (1)..( 12): Matrix.004 file - promoters50/1582339
catctaatataa

SEQ ID NO: 70050 - DNA, 12 bp, Unknown
  misc_feature (1)..( 12): Matrix.004 file - promoters50/1582349
ttaaaaaaaact

SEQ ID NO: 70051 - DNA, 9 bp, Unknown
  misc_feature (1)..( 9): Matrix.004 file - promoters50/1582349
atgttttta

SEQ ID NO: 70052 - DNA, 10 bp, Unknown
  misc_feature (1)..( 10): Matrix.004 file - promoters50/1582551
tcaatttttt

SEQ ID NO: 70053 - DNA, 11 bp, Unknown
  misc_feature (1)..( 11): Matrix.004 file - promoters50/1582551
aaaaagaaaag

SEQ ID NO: 70054 - DNA, 9 bp, Unknown
  misc_feature (1)..( 9): Matrix.004 file - promoters50/1582576
cccactaaa

SEQ ID NO: 70055 - DNA, 9 bp, Unknown
  misc_feature (1)..( 9): Matrix.004 file - promoters50/1582576
agagtgaaa

SEQ ID NO: 70056 - DNA, 7 bp, Unknown
  misc_feature (1)..( 7): Matrix.004 file - promoters50/1582576
aaattaa

SEQ ID NO: 70057 - DNA, 8 bp, Unknown
  misc_feature (1)..( 8): Matrix.004 file - promoters50/1582576
aataaaaa

SEQ ID NO: 70058 - DNA, 8 bp, Unknown
  misc_feature (1)..( 8): Matrix.004 file - promoters50/1582576
aaaagaca

SEQ ID NO: 70059 - DNA, 8 bp, Unknown
  misc_feature (1)..( 8): Matrix.004 file - promoters50/1582576
aaaataaa

SEQ ID NO: 70060 - DNA, 7 bp, Unknown
  misc_feature (1)..( 7): Matrix.004 file - promoters50/1582576
tatttag

SEQ ID NO: 70061 - DNA, 11 bp, Unknown
  misc_feature (1)..( 11): Matrix.004 file - promoters50/1582576
ctaaaattata

SEQ ID NO: 70062 - DNA, 8 bp, Unknown
  misc_feature (1)..( 8): Matrix.004 file - promoters50/1582576
taattaat

SEQ ID NO: 70063 - DNA, 7 bp, Unknown
  misc_feature (1)..( 7): Matrix.004 file - promoters50/1582576
ctaaaat

SEQ ID NO: 70064 - DNA, 7 bp, Unknown
  misc_feature (1)..( 7): Matrix.004 file - promoters50/1582654
aaataat

SEQ ID NO: 70065 - DNA, 4 bp, Unknown
  misc_feature (1)..( 4): Matrix.004 file - promoters50/1582654
aaag

SEQ ID NO: 70066 - DNA, 8 bp, Unknown
  misc_feature (1)..( 8): Matrix.004 file - promoters50/1582654
aaaacaaa

SEQ ID NO: 70067 - DNA, 8 bp, Unknown
  misc_feature (1)..( 8): Matrix.004 file - promoters50/1582654
aaaaaaga

SEQ ID NO: 70068 - DNA, 9 bp, Unknown
  misc_feature (1)..( 9): Matrix.004 file - promoters50/1582658
tgtttttgg

SEQ ID NO: 70069 - DNA, 11 bp, Unknown
  misc_feature (1)..( 11): Matrix.004 file - promoters50/1582786
aatacaaatca

SEQ ID NO: 70070 - DNA, 7 bp, Unknown
  misc_feature (1)..( 7): Matrix.004 file - promoters50/1583044
ttctttt

SEQ ID NO: 70071 - DNA, 8 bp, Unknown
  misc_feature (1)..( 8): Matrix.004 file - promoters50/1583350
aagtatat

SEQ ID NO: 70072 - DNA, 9 bp, Unknown
  misc_feature (1)..( 9): Matrix.004 file - promoters50/1595585
tatattttt

SEQ ID NO: 70073 - DNA, 13 bp, Unknown
  misc_feature (1)..( 13): Matrix.004 file - promoters50/1595585
aaaaaaaaatcat

SEQ ID NO: 70074 - DNA, 10 bp, Unknown
  misc_feature (1)..( 10): Matrix.004 file - promoters50/1595635
aaagaaaaat

SEQ ID NO: 70075 - DNA, 9 bp, Unknown
  misc_feature (1)..( 9): Matrix.004 file - promoters50/1595635
acctgaatc

SEQ ID NO: 70076 - DNA, 8 bp, Unknown
  misc_feature (1)..( 8): Matrix.004 file - promoters50/1595635
caaaactg

SEQ ID NO: 70077 - DNA, 8 bp, Unknown
  misc_feature (1)..( 8): Matrix.004 file - promoters50/1595663
aaacatat

SEQ ID NO: 70078 - DNA, 7 bp, Unknown
  misc_feature (1)..( 7): Matrix.004 file - promoters50/1595663
ttctaac

SEQ ID NO: 70079 - DNA, 7 bp, Unknown
  misc_feature (1)..( 7): Matrix.004 file - promoters50/1595663
cttcagt

SEQ ID NO: 70080 - DNA, 7 bp, Unknown
  misc_feature (1)..( 7): Matrix.004 file - promoters50/1595663
caatatt

SEQ ID NO: 70081 - DNA, 9 bp, Unknown
  misc_feature (1)..( 9): Matrix.004 file - promoters50/1595663
caaaattat

SEQ ID NO: 70082 - DNA, 7 bp, Unknown
  misc_feature (1)..( 7): Matrix.004 file - promoters50/1595674
tttaatt

SEQ ID NO: 70083 - DNA, 8 bp, Unknown
  misc_feature (1)..( 8): Matrix.004 file - promoters50/1595678
taaagata

SEQ ID NO: 70084 - DNA, 9 bp, Unknown
  misc_feature (1)..( 9): Matrix.004 file - promoters50/1595678
aatgatttt

SEQ ID NO: 70085 - DNA, 8 bp, Unknown
  misc_feature (1)..( 8): Matrix.004 file - promoters50/1595678
acacaaaa

SEQ ID NO: 70086 - DNA, 8 bp, Unknown
  misc_feature (1)..( 8): Matrix.004 file - promoters50/1595687
ttacaaaa

SEQ ID NO: 70087 - DNA, 9 bp, Unknown
  misc_feature (1)..( 9): Matrix.004 file - promoters50/1595687
tttggaaat

SEQ ID NO: 70088 - DNA, 9 bp, Unknown
  misc_feature (1)..( 9): Matrix.004 file - promoters50/1595703
aaagaaaag

SEQ ID NO: 70089 - DNA, 10 bp, Unknown
  misc_feature (1)..( 10): Matrix.004 file - promoters50/1595707
cttaattcaa

SEQ ID NO: 70090 - DNA, 11 bp, Unknown
  misc_feature (1)..( 11): Matrix.004 file - promoters50/1595707
aatactaatct

SEQ ID NO: 70091 - DNA, 9 bp, Unknown
  misc_feature (1)..( 9): Matrix.004 file - promoters50/1595741
attttaatt

SEQ ID NO: 70092 - DNA, 10 bp, Unknown
  misc_feature (1)..( 10): Matrix.004 file - promoters50/1595741
aatttcaata

SEQ ID NO: 70093 - DNA, 11 bp, Unknown
  misc_feature (1)..( 11): Matrix.004 file - promoters50/1595752
ctatttttagt

SEQ ID NO: 70094 - DNA, 7 bp, Unknown
  misc_feature (1)..( 7): Matrix.004 file - promoters50/1595752
atatttt

SEQ ID NO: 70095 - DNA, 8 bp, Unknown
  misc_feature (1)..( 8): Matrix.004 file - promoters50/1595752
aaatctaa

SEQ ID NO: 70096 - DNA, 9 bp, Unknown
  misc_feature (1)..( 9): Matrix.004 file - promoters50/1595752
acaaccacc

SEQ ID NO: 70097 - DNA, 9 bp, Unknown
  misc_feature (1)..( 9): Matrix.004 file - promoters50/1595752
atatatata

SEQ ID NO: 70098 - DNA, 10 bp, Unknown
  misc_feature (1)..( 10): Matrix.004 file - promoters50/1595772
gaaatttctt

SEQ ID NO: 70099 - DNA, 6 bp, Unknown
  misc_feature (1)..( 6): Matrix.004 file - promoters50/1595772
ataatt

SEQ ID NO: 70100 - DNA, 11 bp, Unknown
  misc_feature (1)..( 11): Matrix.004 file - promoters50/1595772
tatataaataa

SEQ ID NO: 70101 - DNA, 11 bp, Unknown
  misc_feature (1)..( 11): Matrix.004 file - promoters50/1595772
ttataaataaa

SEQ ID NO: 70102 - DNA, 9 bp, Unknown
  misc_feature (1)..( 9): Matrix.004 file - promoters50/1595772
atataaaaa

SEQ ID NO: 70103 - DNA, 12 bp, Unknown
  misc_feature (1)..( 12): Matrix.004 file - promoters50/1595772
gtgtaaaaatta

SEQ ID NO: 70104 - DNA, 9 bp, Unknown
  misc_feature (1)..( 9): Matrix.004 file - promoters50/1595772
ataatatta

SEQ ID NO: 70105 - DNA, 12 bp, Unknown
  misc_feature (1)..( 12): Matrix.004 file - promoters50/1595772
atctttaattat

SEQ ID NO: 70106 - DNA, 10 bp, Unknown
  misc_feature (1)..( 10): Matrix.004 file - promoters50/1595772
taatttttat

SEQ ID NO: 70107 - DNA, 9 bp, Unknown
  misc_feature (1)..( 9): Matrix.004 file - promoters50/1595794
attttttat

SEQ ID NO: 70108 - DNA, 10 bp, Unknown
  misc_feature (1)..( 10): Matrix.004 file - promoters50/1595794
aattaattct

SEQ ID NO: 70109 - DNA, 9 bp, Unknown
  misc_feature (1)..( 9): Matrix.004 file - promoters50/1595794
ttagtcttt

SEQ ID NO: 70110 - DNA, 8 bp, Unknown
  misc_feature (1)..( 8): Matrix.004 file - promoters50/1595794
gtaaaaat

SEQ ID NO: 70111 - DNA, 11 bp, Unknown
  misc_feature (1)..( 11): Matrix.004 file - promoters50/1595794
attttaaaata

SEQ ID NO: 70112 - DNA, 8 bp, Unknown
  misc_feature (1)..( 8): Matrix.004 file - promoters50/1595829
taactaaa

SEQ ID NO: 70113 - DNA, 13 bp, Unknown
  misc_feature (1)..( 13): Matrix.004 file - promoters50/1595829
aaaattttaaaat

SEQ ID NO: 70114 - DNA, 9 bp, Unknown
  misc_feature (1)..( 9): Matrix.004 file - promoters50/1595829
acaataaat

SEQ ID NO: 70115 - DNA, 16 bp, Unknown
  misc_feature (1)..( 16): Matrix.004 file - promoters50/1595829
gttttcttagaaaata

SEQ ID NO: 70116 - DNA, 10 bp, Unknown
  misc_feature (1)..( 10): Matrix.004 file - promoters50/1595829
atataatttt

SEQ ID NO: 70117 - DNA, 17 bp, Unknown
  misc_feature (1)..( 17): Matrix.004 file - promoters50/1662819
aaacgaaaatattgttg

SEQ ID NO: 70118 - DNA, 7 bp, Unknown
  misc_feature (1)..( 7): Matrix.004 file - promoters50/1662819
acttatt

SEQ ID NO: 70119 - DNA, 9 bp, Unknown
  misc_feature (1)..( 9): Matrix.004 file - promoters50/1662827
ttatctaaa

SEQ ID NO: 70120 - DNA, 11 bp, Unknown
  misc_feature (1)..( 11): Matrix.004 file - promoters50/1662827
aaactattcaa

SEQ ID NO: 70121 - DNA, 10 bp, Unknown
  misc_feature (1)..( 10): Matrix.004 file - promoters50/1662827
tttaatttaa

SEQ ID NO: 70122 - DNA, 9 bp, Unknown
  misc_feature (1)..( 9): Matrix.004 file - promoters50/1662827
attttaaca

SEQ ID NO: 70123 - DNA, 7 bp, Unknown
  misc_feature (1)..( 7): Matrix.004 file - promoters50/1662827
tttattt

SEQ ID NO: 70124 - DNA, 12 bp, Unknown
  misc_feature (1)..( 12): Matrix.004 file - promoters50/1662843
gtataccaaaat

SEQ ID NO: 70125 - DNA, 10 bp, Unknown
  misc_feature (1)..( 10): Matrix.004 file - promoters50/1662843
ttcacattat

SEQ ID NO: 70126 - DNA, 9 bp, Unknown
  misc_feature (1)..( 9): Matrix.004 file - promoters50/1662843
taaatagta

SEQ ID NO: 70127 - DNA, 10 bp, Unknown
  misc_feature (1)..( 10): Matrix.004 file - promoters50/1662872
aattcaactc

SEQ ID NO: 70128 - DNA, 7 bp, Unknown
  misc_feature (1)..( 7): Matrix.004 file - promoters50/1662872
tttcctt

SEQ ID NO: 70129 - DNA, 9 bp, Unknown
  misc_feature (1)..( 9): Matrix.004 file - promoters50/1662895
ctagatctt

SEQ ID NO: 70130 - DNA, 9 bp, Unknown
  misc_feature (1)..( 9): Matrix.004 file - promoters50/1662895
tttcataag

SEQ ID NO: 70131 - DNA, 9 bp, Unknown
  misc_feature (1)..( 9): Matrix.004 file - promoters50/1662899
attgagaaa

SEQ ID NO: 70132 - DNA, 9 bp, Unknown
  misc_feature (1)..( 9): Matrix.004 file - promoters50/1662899
aaaattttt

SEQ ID NO: 70133 - DNA, 9 bp, Unknown
  misc_feature (1)..( 9): Matrix.004 file - promoters50/1662917
tatatgtag

SEQ ID NO: 70134 - DNA, 10 bp, Unknown
  misc_feature (1)..( 10): Matrix.004 file - promoters50/1662917
aaatcctcat

SEQ ID NO: 70135 - DNA, 11 bp, Unknown
  misc_feature (1)..( 11): Matrix.004 file - promoters50/1662917
tttataagtat

SEQ ID NO: 70136 - DNA, 10 bp, Unknown
  misc_feature (1)..( 10): Matrix.004 file - promoters50/1662917
taaattttga

SEQ ID NO: 70137 - DNA, 13 bp, Unknown
  misc_feature (1)..( 13): Matrix.004 file - promoters50/1662917
atttgatgaatgt

SEQ ID NO: 70138 - DNA, 17 bp, Unknown
  misc_feature (1)..( 17): Matrix.004 file - promoters50/1662917
taaattttaaaaatatt

SEQ ID NO: 70139 - DNA, 20 bp, Unknown
  misc_feature (1)..( 20): Matrix.004 file - promoters50/1662981
taaattttaaaattattcaa

SEQ ID NO: 70140 - DNA, 8 bp, Unknown
  misc_feature (1)..( 8): Matrix.004 file - promoters50/1662981
aatcttag

SEQ ID NO: 70141 - DNA, 10 bp, Unknown
  misc_feature (1)..( 10): Matrix.004 file - promoters50/1663082
aaaaacagaa

SEQ ID NO: 70142 - DNA, 11 bp, Unknown
  misc_feature (1)..( 11): Matrix.004 file - promoters50/1663127
aaatatttata

SEQ ID NO: 70143 - DNA, 11 bp, Unknown
  misc_feature (1)..( 11): Matrix.004 file - promoters50/1663135
ccaagaataat

SEQ ID NO: 70144 - DNA, 7 bp, Unknown
  misc_feature (1)..( 7): Matrix.004 file - promoters50/1663135
aacatag

SEQ ID NO: 70145 - DNA, 8 bp, Unknown
  misc_feature (1)..( 8): Matrix.004 file - promoters50/1663135
acactttc

SEQ ID NO: 70146 - DNA, 7 bp, Unknown
  misc_feature (1)..( 7): Matrix.004 file - promoters50/1663135
tttttaa

SEQ ID NO: 70147 - DNA, 9 bp, Unknown
  misc_feature (1)..( 9): Matrix.004 file - promoters50/1663135
aataaaatt

SEQ ID NO: 70148 - DNA, 10 bp, Unknown
  misc_feature (1)..( 10): Matrix.004 file - promoters50/1663147
caaaacaaaa

SEQ ID NO: 70149 - DNA, 9 bp, Unknown
  misc_feature (1)..( 9): Matrix.004 file - promoters50/1663147
ccatacact

SEQ ID NO: 70150 - DNA, 12 bp, Unknown
  misc_feature (1)..( 12): Matrix.004 file - promoters50/1663217
taaatccataca

SEQ ID NO: 70151 - DNA, 10 bp, Unknown
  misc_feature (1)..( 10): Matrix.004 file - promoters50/1663217
acatgatata

SEQ ID NO: 70152 - DNA, 9 bp, Unknown
  misc_feature (1)..( 9): Matrix.004 file - promoters50/1663217
accaaacca

SEQ ID NO: 70153 - DNA, 7 bp, Unknown
  misc_feature (1)..( 7): Matrix.004 file - promoters50/1663217
tcataaa

SEQ ID NO: 70154 - DNA, 9 bp, Unknown
  misc_feature (1)..( 9): Matrix.004 file - promoters50/1663221
attaagtaa

SEQ ID NO: 70155 - DNA, 12 bp, Unknown
  misc_feature (1)..( 12): Matrix.004 file - promoters50/1663261
atttttatttac

SEQ ID NO: 70156 - DNA, 8 bp, Unknown
  misc_feature (1)..( 8): Matrix.004 file - promoters50/1663261
attatcta

SEQ ID NO: 70157 - DNA, 8 bp, Unknown
  misc_feature (1)..( 8): Matrix.004 file - promoters50/1663261
aatataaa

SEQ ID NO: 70158 - DNA, 8 bp, Unknown
  misc_feature (1)..( 8): Matrix.004 file - promoters50/1663261
agaaaatt

SEQ ID NO: 70159 - DNA, 11 bp, Unknown
  misc_feature (1)..( 11): Matrix.004 file - promoters50/1663261
taacaaacaaa

SEQ ID NO: 70160 - DNA, 8 bp, Unknown
  misc_feature (1)..( 8): Matrix.004 file - promoters50/1663261
aataaatt

SEQ ID NO: 70161 - DNA, 9 bp, Unknown
  misc_feature (1)..( 9): Matrix.004 file - promoters50/1663261
taaattttc

SEQ ID NO: 70162 - DNA, 8 bp, Unknown
  misc_feature (1)..( 8): Matrix.004 file - promoters50/1663278
aaatatat

SEQ ID NO: 70163 - DNA, 11 bp, Unknown
  misc_feature (1)..( 11): Matrix.004 file - promoters50/1663278
tattgaaaaag

SEQ ID NO: 70164 - DNA, 13 bp, Unknown
  misc_feature (1)..( 13): Matrix.004 file - promoters50/1663332
cgttgagttcaat

SEQ ID NO: 70165 - DNA, 7 bp, Unknown
  misc_feature (1)..( 7): Matrix.004 file - promoters50/1663332
actttta

SEQ ID NO: 70166 - DNA, 10 bp, Unknown
  misc_feature (1)..( 10): Matrix.004 file - promoters50/1663353
ttttgacaaa

SEQ ID NO: 70167 - DNA, 12 bp, Unknown
  misc_feature (1)..( 12): Matrix.004 file - promoters50/1664727
taaactttaatt

SEQ ID NO: 70168 - DNA, 8 bp, Unknown
  misc_feature (1)..( 8): Matrix.004 file - promoters50/1664731
aaagaaaa

SEQ ID NO: 70169 - DNA, 10 bp, Unknown
  misc_feature (1)..( 10): Matrix.004 file - promoters50/1664755
ggcttagatt

SEQ ID NO: 70170 - DNA, 6 bp, Unknown
  misc_feature (1)..( 6): Matrix.004 file - promoters50/1664755
tttatt

SEQ ID NO: 70171 - DNA, 8 bp, Unknown
  misc_feature (1)..( 8): Matrix.004 file - promoters50/1664797
caaaattc

SEQ ID NO: 70172 - DNA, 11 bp, Unknown
  misc_feature (1)..( 11): Matrix.004 file - promoters50/1664797
aatcaaataga

SEQ ID NO: 70173 - DNA, 11 bp, Unknown
  misc_feature (1)..( 11): Matrix.004 file - promoters50/1664797
atttttttttt

SEQ ID NO: 70174 - DNA, 7 bp, Unknown
  misc_feature (1)..( 7): Matrix.004 file - promoters50/1664870
tttctaa

SEQ ID NO: 70175 - DNA, 10 bp, Unknown
  misc_feature (1)..( 10): Matrix.004 file - promoters50/1664870
tattctgtgg

SEQ ID NO: 70176 - DNA, 12 bp, Unknown
  misc_feature (1)..( 12): Matrix.004 file - promoters50/1664870
attctaaaaaaa

SEQ ID NO: 70177 - DNA, 12 bp, Unknown
  misc_feature (1)..( 12): Matrix.004 file - promoters50/1664931
aacaaatatatt

SEQ ID NO: 70178 - DNA, 11 bp, Unknown
  misc_feature (1)..( 11): Matrix.004 file - promoters50/1664931
ataaaaatttt

SEQ ID NO: 70179 - DNA, 15 bp, Unknown
  misc_feature (1)..( 15): Matrix.004 file - promoters50/1664931
ataaaaaatattgtt

SEQ ID NO: 70180 - DNA, 13 bp, Unknown
  misc_feature (1)..( 13): Matrix.004 file - promoters50/1664931
aataacatttgaa

SEQ ID NO: 70181 - DNA, 11 bp, Unknown
  misc_feature (1)..( 11): Matrix.004 file - promoters50/1664931
aaataagttac

SEQ ID NO: 70182 - DNA, 11 bp, Unknown
  misc_feature (1)..( 11): Matrix.004 file - promoters50/1664981
taacactcatc

SEQ ID NO: 70183 - DNA, 15 bp, Unknown
  misc_feature (1)..( 15): Matrix.004 file - promoters50/1664981
ttacaaattgaacca

SEQ ID NO: 70184 - DNA, 15 bp, Unknown
  misc_feature (1)..( 15): Matrix.004 file - promoters50/1664981
aaagtaaattgatag

SEQ ID NO: 70185 - DNA, 12 bp, Unknown
  misc_feature (1)..( 12): Matrix.004 file - promoters50/1664981
gaagtttatgat

SEQ ID NO: 70186 - DNA, 14 bp, Unknown
  misc_feature (1)..( 14): Matrix.004 file - promoters50/1665056
tactataaatataa

SEQ ID NO: 70187 - DNA, 12 bp, Unknown
  misc_feature (1)..( 12): Matrix.004 file - promoters50/1665056
gaaagaaaataa

SEQ ID NO: 70188 - DNA, 10 bp, Unknown
  misc_feature (1)..( 10): Matrix.004 file - promoters50/1665056
taacgaaaaa

SEQ ID NO: 70189 - DNA, 16 bp, Unknown
  misc_feature (1)..( 16): Matrix.004 file - promoters50/1665056
acaaagtttattaaaa

SEQ ID NO: 70190 - DNA, 11 bp, Unknown
  misc_feature (1)..( 11): Matrix.004 file - promoters50/1665080
tatatttttat

SEQ ID NO: 70191 - DNA, 7 bp, Unknown
  misc_feature (1)..( 7): Matrix.004 file - promoters50/1665080
tttgtta

SEQ ID NO: 70192 - DNA, 9 bp, Unknown
  misc_feature (1)..( 9): Matrix.004 file - promoters50/1665080
tcccttttt

SEQ ID NO: 70193 - DNA, 9 bp, Unknown
  misc_feature (1)..( 9): Matrix.004 file - promoters50/1665080
attaaacta

SEQ ID NO: 70194 - DNA, 11 bp, Unknown
  misc_feature (1)..( 11): Matrix.004 file - promoters50/1665080
tttcttccaag

SEQ ID NO: 70195 - DNA, 13 bp, Unknown
  misc_feature (1)..( 13): Matrix.004 file - promoters50/1665080
taaaaatatatat

SEQ ID NO: 70196 - DNA, 8 bp, Unknown
  misc_feature (1)..( 8): Matrix.004 file - promoters50/1665080
atttcttc

SEQ ID NO: 70197 - DNA, 9 bp, Unknown
  misc_feature (1)..( 9): Matrix.004 file - promoters50/1665243
tgtgattta

SEQ ID NO: 70198 - DNA, 6 bp, Unknown
  misc_feature (1)..( 6): Matrix.004 file - promoters50/1665243
atttta

SEQ ID NO: 70199 - DNA, 9 bp, Unknown
  misc_feature (1)..( 9): Matrix.004 file - promoters50/1665272
ataaaaagt

SEQ ID NO: 70200 - DNA, 11 bp, Unknown
  misc_feature (1)..( 11): Matrix.004 file - promoters50/1673798
aatttgattta

SEQ ID NO: 70201 - DNA, 11 bp, Unknown
  misc_feature (1)..( 11): Matrix.004 file - promoters50/1673806
taaaaaataaa

SEQ ID NO: 70202 - DNA, 11 bp, Unknown
  misc_feature (1)..( 11): Matrix.004 file - promoters50/1673826
taaaaaaataa

SEQ ID NO: 70203 - DNA, 10 bp, Unknown
  misc_feature (1)..( 10): Matrix.004 file - promoters50/1673826
ataggttaga

SEQ ID NO: 70204 - DNA, 8 bp, Unknown
  misc_feature (1)..( 8): Matrix.004 file - promoters50/1673830
atctttag

SEQ ID NO: 70205 - DNA, 8 bp, Unknown
  misc_feature (1)..( 8): Matrix.004 file - promoters50/1673830
aacaaaaa

SEQ ID NO: 70206 - DNA, 10 bp, Unknown
  misc_feature (1)..( 10): Matrix.004 file - promoters50/1673830
attaaaggaa

SEQ ID NO: 70207 - DNA, 7 bp, Unknown
  misc_feature (1)..( 7): Matrix.004 file - promoters50/1673830
ttcttct

SEQ ID NO: 70208 - DNA, 10 bp, Unknown
  misc_feature (1)..( 10): Matrix.004 file - promoters50/1673847
aaaacaaaaa

SEQ ID NO: 70209 - DNA, 8 bp, Unknown
  misc_feature (1)..( 8): Matrix.004 file - promoters50/1673847
taatataa

SEQ ID NO: 70210 - DNA, 11 bp, Unknown
  misc_feature (1)..( 11): Matrix.004 file - promoters50/1673847
ataaatcttat

SEQ ID NO: 70211 - DNA, 11 bp, Unknown
  misc_feature (1)..( 11): Matrix.004 file - promoters50/1673849
tttgtatgatt

SEQ ID NO: 70212 - DNA, 14 bp, Unknown
  misc_feature (1)..( 14): Matrix.004 file - promoters50/1673849
aatcaaataataaa

SEQ ID NO: 70213 - DNA, 9 bp, Unknown
  misc_feature (1)..( 9): Matrix.004 file - promoters50/1673853
aaatttatt

SEQ ID NO: 70214 - DNA, 8 bp, Unknown
  misc_feature (1)..( 8): Matrix.004 file - promoters50/1673853
agaatatt

SEQ ID NO: 70215 - DNA, 7 bp, Unknown
  misc_feature (1)..( 7): Matrix.004 file - promoters50/1710026
atttgaa

SEQ ID NO: 70216 - DNA, 9 bp, Unknown
  misc_feature (1)..( 9): Matrix.004 file - promoters50/1710026
atttcaatc

SEQ ID NO: 70217 - DNA, 7 bp, Unknown
  misc_feature (1)..( 7): Matrix.004 file - promoters50/1710051
tttcaat

SEQ ID NO: 70218 - DNA, 7 bp, Unknown
  misc_feature (1)..( 7): Matrix.004 file - promoters50/1710051
tttttca

SEQ ID NO: 70219 - DNA, 8 bp, Unknown
  misc_feature (1)..( 8): Matrix.004 file - promoters50/1710051
cttaaata

SEQ ID NO: 70220 - DNA, 10 bp, Unknown
  misc_feature (1)..( 10): Matrix.004 file - promoters50/1710645
caatttataa

SEQ ID NO: 70221 - DNA, 8 bp, Unknown
  misc_feature (1)..( 8): Matrix.004 file - promoters50/1710645
aatttcgt

SEQ ID NO: 70222 - DNA, 9 bp, Unknown
  misc_feature (1)..( 9): Matrix.004 file - promoters50/1710759
tttgatgaa

SEQ ID NO: 70223 - DNA, 9 bp, Unknown
  misc_feature (1)..( 9): Matrix.004 file - promoters50/1710759
atcctttta

SEQ ID NO: 70224 - DNA, 9 bp, Unknown
  misc_feature (1)..( 9): Matrix.004 file - promoters50/1710759
ttttaacaa

SEQ ID NO: 70225 - DNA, 8 bp, Unknown
  misc_feature (1)..( 8): Matrix.004 file - promoters50/1711228
caatttta

SEQ ID NO: 70226 - DNA, 9 bp, Unknown
  misc_feature (1)..( 9): Matrix.004 file - promoters50/1711228
ttcttaaga

SEQ ID NO: 70227 - DNA, 13 bp, Unknown
  misc_feature (1)..( 13): Matrix.004 file - promoters50/1711318
aaatgggcctaat

SEQ ID NO: 70228 - DNA, 7 bp, Unknown
  misc_feature (1)..( 7): Matrix.004 file - promoters50/1711318
aatatat

SEQ ID NO: 70229 - DNA, 10 bp, Unknown
  misc_feature (1)..( 10): Matrix.004 file - promoters50/1711318
gatttttgtt

SEQ ID NO: 70230 - DNA, 5 bp, Unknown
  misc_feature (1)..( 5): Matrix.004 file - promoters50/1711318
tatta

SEQ ID NO: 70231 - DNA, 9 bp, Unknown
  misc_feature (1)..( 9): Matrix.004 file - promoters50/1711318
aaattgaac

SEQ ID NO: 70232 - DNA, 15 bp, Unknown
  misc_feature (1)..( 15): Matrix.004 file - promoters50/1711318
taaaatgttaagtaa

SEQ ID NO: 70233 - DNA, 10 bp, Unknown
  misc_feature (1)..( 10): Matrix.004 file - promoters50/1711318
tgaattttat

SEQ ID NO: 70234 - DNA, 9 bp, Unknown
  misc_feature (1)..( 9): Matrix.004 file - promoters50/1711318
gattaattt

SEQ ID NO: 70235 - DNA, 8 bp, Unknown
  misc_feature (1)..( 8): Matrix.004 file - promoters50/1711318
ccatcaat

SEQ ID NO: 70236 - DNA, 11 bp, Unknown
  misc_feature (1)..( 11): Matrix.004 file - promoters50/1711318
atctaatttat

SEQ ID NO: 70237 - DNA, 8 bp, Unknown
  misc_feature (1)..( 8): Matrix.004 file - promoters50/1711586
gttattta

SEQ ID NO: 70238 - DNA, 15 bp, Unknown
  misc_feature (1)..( 15): Matrix.004 file - promoters50/1711586
ttatccaaaatataa

SEQ ID NO: 70239 - DNA, 11 bp, Unknown
  misc_feature (1)..( 11): Matrix.004 file - promoters50/1711626
aatatagcaaa

SEQ ID NO: 70240 - DNA, 10 bp, Unknown
  misc_feature (1)..( 10): Matrix.004 file - promoters50/1711626
aattaatctc

SEQ ID NO: 70241 - DNA, 6 bp, Unknown
  misc_feature (1)..( 6): Matrix.004 file - promoters50/1711626
attcga

SEQ ID NO: 70242 - DNA, 8 bp, Unknown
  misc_feature (1)..( 8): Matrix.004 file - promoters50/1711626
aatacaat

SEQ ID NO: 70243 - DNA, 7 bp, Unknown
  misc_feature (1)..( 7): Matrix.004 file - promoters50/1711638
attcgat

SEQ ID NO: 70244 - DNA, 10 bp, Unknown
  misc_feature (1)..( 10): Matrix.004 file - promoters50/1711638
aaatctaatt

SEQ ID NO: 70245 - DNA, 8 bp, Unknown
  misc_feature (1)..( 8): Matrix.004 file - promoters50/1711638
agaaaaag

SEQ ID NO: 70246 - DNA, 10 bp, Unknown
  misc_feature (1)..( 10): Matrix.004 file - promoters50/1711638
tttggattta

SEQ ID NO: 70247 - DNA, 13 bp, Unknown
  misc_feature (1)..( 13): Matrix.004 file - promoters50/1711650
attagatcttttt

SEQ ID NO: 70248 - DNA, 9 bp, Unknown
  misc_feature (1)..( 9): Matrix.004 file - promoters50/1711650
taaactttt

SEQ ID NO: 70249 - DNA, 10 bp, Unknown
  misc_feature (1)..( 10): Matrix.004 file - promoters50/1711650
tgtaataaat

SEQ ID NO: 70250 - DNA, 10 bp, Unknown
  misc_feature (1)..( 10): Matrix.004 file - promoters50/1711650
tgtttatttt

SEQ ID NO: 70251 - DNA, 7 bp, Unknown
  misc_feature (1)..( 7): Matrix.004 file - promoters50/1711662
caatttc

SEQ ID NO: 70252 - DNA, 15 bp, Unknown
  misc_feature (1)..( 15): Matrix.004 file - promoters50/1711666
tcggttaatttgcat

SEQ ID NO: 70253 - DNA, 7 bp, Unknown
  misc_feature (1)..( 7): Matrix.004 file - promoters50/1711666
aattaaa

SEQ ID NO: 70254 - DNA, 7 bp, Unknown
  misc_feature (1)..( 7): Matrix.004 file - promoters50/1711666
attattt

SEQ ID NO: 70255 - DNA, 9 bp, Unknown
  misc_feature (1)..( 9): Matrix.004 file - promoters50/1711666
ttaataaaa

SEQ ID NO: 70256 - DNA, 9 bp, Unknown
  misc_feature (1)..( 9): Matrix.004 file - promoters50/1711691
ttatttttt

SEQ ID NO: 70257 - DNA, 11 bp, Unknown
  misc_feature (1)..( 11): Matrix.004 file - promoters50/1711691
tattgaaccaa

SEQ ID NO: 70258 - DNA, 8 bp, Unknown
  misc_feature (1)..( 8): Matrix.004 file - promoters50/1711691
gtaaattt

SEQ ID NO: 70259 - DNA, 10 bp, Unknown
  misc_feature (1)..( 10): Matrix.004 file - promoters50/1711691
aaaccaaaat

SEQ ID NO: 70260 - DNA, 8 bp, Unknown
  misc_feature (1)..( 8): Matrix.004 file - promoters50/1711691
ttttttta

SEQ ID NO: 70261 - DNA, 8 bp, Unknown
  misc_feature (1)..( 8): Matrix.004 file - promoters50/1711691
tttttttt

SEQ ID NO: 70262 - DNA, 24 bp, Unknown
  misc_feature (1)..( 24): Matrix.004 file - promoters50/1712122
ccgtgcacgtagacacacaccact

SEQ ID NO: 70263 - DNA, 9 bp, Unknown
  misc_feature (1)..( 9): Matrix.004 file - promoters50/1712122
agttataat

SEQ ID NO: 70264 - DNA, 8 bp, Unknown
  misc_feature (1)..( 8): Matrix.004 file - promoters50/1712134
atataaaa

SEQ ID NO: 70265 - DNA, 8 bp, Unknown
  misc_feature (1)..( 8): Matrix.004 file - promoters50/1712134
atttttca

SEQ ID NO: 70266 - DNA, 7 bp, Unknown
  misc_feature (1)..( 7): Matrix.004 file - promoters50/1712134
tttttga

SEQ ID NO: 70267 - DNA, 12 bp, Unknown
  misc_feature (1)..( 12): Matrix.004 file - promoters50/1712134
aagttttttatg

SEQ ID NO: 70268 - DNA, 10 bp, Unknown
  misc_feature (1)..( 10): Matrix.004 file - promoters50/1712150
taatttttga

SEQ ID NO: 70269 - DNA, 11 bp, Unknown
  misc_feature (1)..( 11): Matrix.004 file - promoters50/1712150
cccatataaat

SEQ ID NO: 70270 - DNA, 12 bp, Unknown
  misc_feature (1)..( 12): Matrix.004 file - promoters50/1712174
cccaaatataaa

SEQ ID NO: 70271 - DNA, 7 bp, Unknown
  misc_feature (1)..( 7): Matrix.004 file - promoters50/1712174
ttttatc

SEQ ID NO: 70272 - DNA, 7 bp, Unknown
  misc_feature (1)..( 7): Matrix.004 file - promoters50/1712174
gaatcta

SEQ ID NO: 70273 - DNA, 8 bp, Unknown
  misc_feature (1)..( 8): Matrix.004 file - promoters50/1712174
attatttg

SEQ ID NO: 70274 - DNA, 9 bp, Unknown
  misc_feature (1)..( 9): Matrix.004 file - promoters50/1713776
gtcaaaaaa

SEQ ID NO: 70275 - DNA, 10 bp, Unknown
  misc_feature (1)..( 10): Matrix.004 file - promoters50/1713780
ttttatcttt

SEQ ID NO: 70276 - DNA, 12 bp, Unknown
  misc_feature (1)..( 12): Matrix.004 file - promoters50/1713780
tatccaaaacat

SEQ ID NO: 70277 - DNA, 11 bp, Unknown
  misc_feature (1)..( 11): Matrix.004 file - promoters50/1713780
aataaaatatc

SEQ ID NO: 70278 - DNA, 10 bp, Unknown
  misc_feature (1)..( 10): Matrix.004 file - promoters50/1713780
acgtaaaaaa

SEQ ID NO: 70279 - DNA, 10 bp, Unknown
  misc_feature (1)..( 10): Matrix.004 file - promoters50/1713804
aaaaacaata

SEQ ID NO: 70280 - DNA, 5 bp, Unknown
  misc_feature (1)..( 5): Matrix.004 file - promoters50/1713804
atata

SEQ ID NO: 70281 - DNA, 11 bp, Unknown
  misc_feature (1)..( 11): Matrix.004 file - promoters50/1713804
taaaagaatca

SEQ ID NO: 70282 - DNA, 5 bp, Unknown
  misc_feature (1)..( 5): Matrix.004 file - promoters50/1713804
ttata

SEQ ID NO: 70283 - DNA, 10 bp, Unknown
  misc_feature (1)..( 10): Matrix.004 file - promoters50/1713804
tatcaatttt

SEQ ID NO: 70284 - DNA, 7 bp, Unknown
  misc_feature (1)..( 7): Matrix.004 file - promoters50/1713839
ttatatc

SEQ ID NO: 70285 - DNA, 13 bp, Unknown
  misc_feature (1)..( 13): Matrix.004 file - promoters50/1713839
tattcaaaacata

SEQ ID NO: 70286 - DNA, 7 bp, Unknown
  misc_feature (1)..( 7): Matrix.004 file - promoters50/1713839
aaaataa

SEQ ID NO: 70287 - DNA, 9 bp, Unknown
  misc_feature (1)..( 9): Matrix.004 file - promoters50/1713839
acaaaataa

SEQ ID NO: 70288 - DNA, 11 bp, Unknown
  misc_feature (1)..( 11): Matrix.004 file - promoters50/1713839
aacgaaagatc

SEQ ID NO: 70289 - DNA, 9 bp, Unknown
  misc_feature (1)..( 9): Matrix.004 file - promoters50/1713842
agaaaagaa

SEQ ID NO: 70290 - DNA, 9 bp, Unknown
  misc_feature (1)..( 9): Matrix.004 file - promoters50/1713895
agatacagt

SEQ ID NO: 70291 - DNA, 11 bp, Unknown
  misc_feature (1)..( 11): Matrix.004 file - promoters50/1713895
attttatgcct

SEQ ID NO: 70292 - DNA, 13 bp, Unknown
  misc_feature (1)..( 13): Matrix.004 file - promoters50/1713895
tcatttattcgtg

SEQ ID NO: 70293 - DNA, 9 bp, Unknown
  misc_feature (1)..( 9): Matrix.004 file - promoters50/1713895
tattatttt

SEQ ID NO: 70294 - DNA, 11 bp, Unknown
  misc_feature (1)..( 11): Matrix.004 file - promoters50/1713895
ataagaaataa

SEQ ID NO: 70295 - DNA, 14 bp, Unknown
  misc_feature (1)..( 14): Matrix.004 file - promoters50/1714500
ataaaaaagttaaa

SEQ ID NO: 70296 - DNA, 8 bp, Unknown
  misc_feature (1)..( 8): Matrix.004 file - promoters50/1714500
tatttttt

SEQ ID NO: 70297 - DNA, 10 bp, Unknown
  misc_feature (1)..( 10): Matrix.004 file - promoters50/1714541
ttcaaaaaaa

SEQ ID NO: 70298 - DNA, 10 bp, Unknown
  misc_feature (1)..( 10): Matrix.004 file - promoters50/1714541
tctcattcat

SEQ ID NO: 70299 - DNA, 9 bp, Unknown
  misc_feature (1)..( 9): Matrix.004 file - promoters50/1714639
aatgttaaa

SEQ ID NO: 70300 - DNA, 8 bp, Unknown
  misc_feature (1)..( 8): Matrix.004 file - promoters50/1714682
ataaaacc

SEQ ID NO: 70301 - DNA, 8 bp, Unknown
  misc_feature (1)..( 8): Matrix.004 file - promoters50/1714682
atcagatt

SEQ ID NO: 70302 - DNA, 10 bp, Unknown
  misc_feature (1)..( 10): Matrix.004 file - promoters50/1714682
ccttataacc

SEQ ID NO: 70303 - DNA, 8 bp, Unknown
  misc_feature (1)..( 8): Matrix.004 file - promoters50/1714682
attttctt

SEQ ID NO: 70304 - DNA, 8 bp, Unknown
  misc_feature (1)..( 8): Matrix.004 file - promoters50/1714682
gaaacaat

SEQ ID NO: 70305 - DNA, 10 bp, Unknown
  misc_feature (1)..( 10): Matrix.004 file - promoters50/1714682
tctatatata

SEQ ID NO: 70306 - DNA, 7 bp, Unknown
  misc_feature (1)..( 7): Matrix.004 file - promoters50/1714682
atcaaaa

SEQ ID NO: 70307 - DNA, 8 bp, Unknown
  misc_feature (1)..( 8): Matrix.004 file - promoters50/1714682
aaaacaat

SEQ ID NO: 70308 - DNA, 8 bp, Unknown
  misc_feature (1)..( 8): Matrix.004 file - promoters50/1714682
tatataaa

SEQ ID NO: 70309 - DNA, 9 bp, Unknown
  misc_feature (1)..( 9): Matrix.004 file - promoters50/1714682
tctttaagt

SEQ ID NO: 70310 - DNA, 7 bp, Unknown
  misc_feature (1)..( 7): Matrix.004 file - promoters50/1714694
atataaa

SEQ ID NO: 70311 - DNA, 7 bp, Unknown
  misc_feature (1)..( 7): Matrix.004 file - promoters50/1714694
tttgctt

SEQ ID NO: 70312 - DNA, 8 bp, Unknown
  misc_feature (1)..( 8): Matrix.004 file - promoters50/1714694
ttgtatat

SEQ ID NO: 70313 - DNA, 11 bp, Unknown
  misc_feature (1)..( 11): Matrix.004 file - promoters50/1714772
tatcatttttt

SEQ ID NO: 70314 - DNA, 7 bp, Unknown
  misc_feature (1)..( 7): Matrix.004 file - promoters50/1714772
aaacaaa

SEQ ID NO: 70315 - DNA, 9 bp, Unknown
  misc_feature (1)..( 9): Matrix.004 file - promoters50/1714772
aaagtaaag

SEQ ID NO: 70316 - DNA, 8 bp, Unknown
  misc_feature (1)..( 8): Matrix.004 file - promoters50/1714772
ttttttaa

SEQ ID NO: 70317 - DNA, 8 bp, Unknown
  misc_feature (1)..( 8): Matrix.004 file - promoters50/1714772
aaaaagaa

SEQ ID NO: 70318 - DNA, 9 bp, Unknown
  misc_feature (1)..( 9): Matrix.004 file - promoters50/1714806
aaaataaaa

SEQ ID NO: 70319 - DNA, 6 bp, Unknown
  misc_feature (1)..( 6): Matrix.004 file - promoters50/1714806
atggga

SEQ ID NO: 70320 - DNA, 12 bp, Unknown
  misc_feature (1)..( 12): Matrix.004 file - promoters50/1714831
aaagatgaaaaa

SEQ ID NO: 70321 - DNA, 8 bp, Unknown
  misc_feature (1)..( 8): Matrix.004 file - promoters50/1714837
ataaaaat

SEQ ID NO: 70322 - DNA, 8 bp, Unknown
  misc_feature (1)..( 8): Matrix.004 file - promoters50/1714837
aaaacaaa

SEQ ID NO: 70323 - DNA, 8 bp, Unknown
  misc_feature (1)..( 8): Matrix.004 file - promoters50/1714837
aatttaaa

SEQ ID NO: 70324 - DNA, 9 bp, Unknown
  misc_feature (1)..( 9): Matrix.004 file - promoters50/1714837
caaattagt

SEQ ID NO: 70325 - DNA, 8 bp, Unknown
  misc_feature (1)..( 8): Matrix.004 file - promoters50/1714857
tataatta

SEQ ID NO: 70326 - DNA, 8 bp, Unknown
  misc_feature (1)..( 8): Matrix.004 file - promoters50/1714857
acatgaag

SEQ ID NO: 70327 - DNA, 8 bp, Unknown
  misc_feature (1)..( 8): Matrix.004 file - promoters50/1714865
cttataat

SEQ ID NO: 70328 - DNA, 14 bp, Unknown
  misc_feature (1)..( 14): Matrix.004 file - promoters50/1714865
caaaaaacaaaaca

SEQ ID NO: 70329 - DNA, 11 bp, Unknown
  misc_feature (1)..( 11): Matrix.004 file - promoters50/1714865
ctataaaataa

SEQ ID NO: 70330 - DNA, 11 bp, Unknown
  misc_feature (1)..( 11): Matrix.004 file - promoters50/1714865
ataaaatacaa

SEQ ID NO: 70331 - DNA, 9 bp, Unknown
  misc_feature (1)..( 9): Matrix.004 file - promoters50/1714865
atttataaa

SEQ ID NO: 70332 - DNA, 11 bp, Unknown
  misc_feature (1)..( 11): Matrix.004 file - promoters50/1714865
aaaaataaaaa

SEQ ID NO: 70333 - DNA, 9 bp, Unknown
  misc_feature (1)..( 9): Matrix.004 file - promoters50/1714865
aaaaattta

SEQ ID NO: 70334 - DNA, 12 bp, Unknown
  misc_feature (1)..( 12): Matrix.004 file - promoters50/1714865
gaaaaaaaaaaa

SEQ ID NO: 70335 - DNA, 10 bp, Unknown
  misc_feature (1)..( 10): Matrix.004 file - promoters50/1714865
aaaataaaat

SEQ ID NO: 70336 - DNA, 9 bp, Unknown
  misc_feature (1)..( 9): Matrix.004 file - promoters50/1714877
aaatgatta

SEQ ID NO: 70337 - DNA, 7 bp, Unknown
  misc_feature (1)..( 7): Matrix.004 file - promoters50/1714912
ttaattt

SEQ ID NO: 70338 - DNA, 11 bp, Unknown
  misc_feature (1)..( 11): Matrix.004 file - promoters50/1714942
aaaaagaaaaa

SEQ ID NO: 70339 - DNA, 10 bp, Unknown
  misc_feature (1)..( 10): Matrix.004 file - promoters50/1714974
cattgcttag

SEQ ID NO: 70340 - DNA, 10 bp, Unknown
  misc_feature (1)..( 10): Matrix.004 file - promoters50/1714974
ttgaatttat

SEQ ID NO: 70341 - DNA, 5 bp, Unknown
  misc_feature (1)..( 5): Matrix.004 file - promoters50/1714974
aaacg

SEQ ID NO: 70342 - DNA, 10 bp, Unknown
  misc_feature (1)..( 10): Matrix.004 file - promoters50/1714974
aataaaacga

SEQ ID NO: 70343 - DNA, 11 bp, Unknown
  misc_feature (1)..( 11): Matrix.004 file - promoters50/1714974
aaaaatttatt

SEQ ID NO: 70344 - DNA, 9 bp, Unknown
  misc_feature (1)..( 9): Matrix.004 file - promoters50/1714989
aaaccttat

SEQ ID NO: 70345 - DNA, 12 bp, Unknown
  misc_feature (1)..( 12): Matrix.004 file - promoters50/1714989
aacaaacatatt

SEQ ID NO: 70346 - DNA, 8 bp, Unknown
  misc_feature (1)..( 8): Matrix.004 file - promoters50/1714989
aaaatatt

SEQ ID NO: 70347 - DNA, 10 bp, Unknown
  misc_feature (1)..( 10): Matrix.004 file - promoters50/1714989
taaaaaaatt

SEQ ID NO: 70348 - DNA, 12 bp, Unknown
  misc_feature (1)..( 12): Matrix.004 file - promoters50/1714989
tacaaacaaaaa

SEQ ID NO: 70349 - DNA, 9 bp, Unknown
  misc_feature (1)..( 9): Matrix.004 file - promoters50/1714989
ttaaaaacg

SEQ ID NO: 70350 - DNA, 10 bp, Unknown
  misc_feature (1)..( 10): Matrix.004 file - promoters50/1714989
attacacaaa

SEQ ID NO: 70351 - DNA, 11 bp, Unknown
  misc_feature (1)..( 11): Matrix.004 file - promoters50/1714989
aattatttatc

SEQ ID NO: 70352 - DNA, 12 bp, Unknown
  misc_feature (1)..( 12): Matrix.004 file - promoters50/1714989
tccatataaaat

SEQ ID NO: 70353 - DNA, 13 bp, Unknown
  misc_feature (1)..( 13): Matrix.004 file - promoters50/1714989
acaaaaaaacaat

SEQ ID NO: 70354 - DNA, 10 bp, Unknown
  misc_feature (1)..( 10): Matrix.004 file - promoters50/1715054
ttgattttaa

SEQ ID NO: 70355 - DNA, 10 bp, Unknown
  misc_feature (1)..( 10): Matrix.004 file - promoters50/1715054
aaattgattt

SEQ ID NO: 70356 - DNA, 13 bp, Unknown
  misc_feature (1)..( 13): Matrix.004 file - promoters50/1715054
taattatgttaat

SEQ ID NO: 70357 - DNA, 7 bp, Unknown
  misc_feature (1)..( 7): Matrix.004 file - promoters50/1715054
agcattt

SEQ ID NO: 70358 - DNA, 7 bp, Unknown
  misc_feature (1)..( 7): Matrix.004 file - promoters50/1715054
aaagaac

SEQ ID NO: 70359 - DNA, 8 bp, Unknown
  misc_feature (1)..( 8): Matrix.004 file - promoters50/1715054
tttaatta

SEQ ID NO: 70360 - DNA, 7 bp, Unknown
  misc_feature (1)..( 7): Matrix.004 file - promoters50/1715146
aatgttc

SEQ ID NO: 70361 - DNA, 7 bp, Unknown
  misc_feature (1)..( 7): Matrix.004 file - promoters50/1715146
ttccata

SEQ ID NO: 70362 - DNA, 9 bp, Unknown
  misc_feature (1)..( 9): Matrix.004 file - promoters50/1715146
tataaattc

SEQ ID NO: 70363 - DNA, 7 bp, Unknown
  misc_feature (1)..( 7): Matrix.004 file - promoters50/1715146
atccaat

SEQ ID NO: 70364 - DNA, 8 bp, Unknown
  misc_feature (1)..( 8): Matrix.004 file - promoters50/1715146
gaatttaa

SEQ ID NO: 70365 - DNA, 9 bp, Unknown
  misc_feature (1)..( 9): Matrix.004 file - promoters50/1715146
agataataa

SEQ ID NO: 70366 - DNA, 10 bp, Unknown
  misc_feature (1)..( 10): Matrix.004 file - promoters50/1715146
aaattattaa

SEQ ID NO: 70367 - DNA, 8 bp, Unknown
  misc_feature (1)..( 8): Matrix.004 file - promoters50/1715146
aagaaaaa

SEQ ID NO: 70368 - DNA, 8 bp, Unknown
  misc_feature (1)..( 8): Matrix.004 file - promoters50/1715204
aatttaag

SEQ ID NO: 70369 - DNA, 7 bp, Unknown
  misc_feature (1)..( 7): Matrix.004 file - promoters50/1715204
aaaagtc

SEQ ID NO: 70370 - DNA, 10 bp, Unknown
  misc_feature (1)..( 10): Matrix.004 file - promoters50/1715204
aagtgcttaa

SEQ ID NO: 70371 - DNA, 10 bp, Unknown
  misc_feature (1)..( 10): Matrix.004 file - promoters50/1715220
attcaagatt

SEQ ID NO: 70372 - DNA, 5 bp, Unknown
  misc_feature (1)..( 5): Matrix.004 file - promoters50/1715220
ctgtc

SEQ ID NO: 70373 - DNA, 11 bp, Unknown
  misc_feature (1)..( 11): Matrix.004 file - promoters50/1715220
ccaaaaatgaa

SEQ ID NO: 70374 - DNA, 11 bp, Unknown
  misc_feature (1)..( 11): Matrix.004 file - promoters50/1715224
atcaactttag

SEQ ID NO: 70375 - DNA, 8 bp, Unknown
  misc_feature (1)..( 8): Matrix.004 file - promoters50/1715224
ttataaaa

SEQ ID NO: 70376 - DNA, 10 bp, Unknown
  misc_feature (1)..( 10): Matrix.004 file - promoters50/1715224
aattactaaa

SEQ ID NO: 70377 - DNA, 8 bp, Unknown
  misc_feature (1)..( 8): Matrix.004 file - promoters50/1715329
tatgaaaa

SEQ ID NO: 70378 - DNA, 8 bp, Unknown
  misc_feature (1)..( 8): Matrix.004 file - promoters50/1715329
ttctaaaa

SEQ ID NO: 70379 - DNA, 9 bp, Unknown
  misc_feature (1)..( 9): Matrix.004 file - promoters50/1715329
ccttcttct

SEQ ID NO: 70380 - DNA, 9 bp, Unknown
  misc_feature (1)..( 9): Matrix.004 file - promoters50/1715329
agattttat

SEQ ID NO: 70381 - DNA, 7 bp, Unknown
  misc_feature (1)..( 7): Matrix.004 file - promoters50/1715329
ttttatt

SEQ ID NO: 70382 - DNA, 10 bp, Unknown
  misc_feature (1)..( 10): Matrix.004 file - promoters50/1715347
ttagatcatt

SEQ ID NO: 70383 - DNA, 10 bp, Unknown
  misc_feature (1)..( 10): Matrix.004 file - promoters50/1715347
ttttaaataa

SEQ ID NO: 70384 - DNA, 16 bp, Unknown
  misc_feature (1)..( 16): Matrix.004 file - promoters50/1715400
tagaatcaaaattctt

SEQ ID NO: 70385 - DNA, 11 bp, Unknown
  misc_feature (1)..( 11): Matrix.004 file - promoters50/1715478
aggttctcaga

SEQ ID NO: 70386 - DNA, 8 bp, Unknown
  misc_feature (1)..( 8): Matrix.004 file - promoters50/1715490
ttaaaatc

SEQ ID NO: 70387 - DNA, 7 bp, Unknown
  misc_feature (1)..( 7): Matrix.004 file - promoters50/1715516
agaaact

SEQ ID NO: 70388 - DNA, 9 bp, Unknown
  misc_feature (1)..( 9): Matrix.004 file - promoters50/1715516
ttatatcca

SEQ ID NO: 70389 - DNA, 13 bp, Unknown
  misc_feature (1)..( 13): Matrix.004 file - promoters50/1715516
ctcctataaattg

SEQ ID NO: 70390 - DNA, 10 bp, Unknown
  misc_feature (1)..( 10): Matrix.004 file - promoters50/1715516
taaatttaca

SEQ ID NO: 70391 - DNA, 12 bp, Unknown
  misc_feature (1)..( 12): Matrix.004 file - promoters50/1715516
aaaaatttaaaa

SEQ ID NO: 70392 - DNA, 8 bp, Unknown
  misc_feature (1)..( 8): Matrix.004 file - promoters50/1715516
aactattt

SEQ ID NO: 70393 - DNA, 12 bp, Unknown
  misc_feature (1)..( 12): Matrix.004 file - promoters50/1715535
caaaattttaac

SEQ ID NO: 70394 - DNA, 9 bp, Unknown
  misc_feature (1)..( 9): Matrix.004 file - promoters50/1715535
caaattttc

SEQ ID NO: 70395 - DNA, 9 bp, Unknown
  misc_feature (1)..( 9): Matrix.004 file - promoters50/1715535
caaaatttc

SEQ ID NO: 70396 - DNA, 12 bp, Unknown
  misc_feature (1)..( 12): Matrix.004 file - promoters50/1715595
atatgatttagt

SEQ ID NO: 70397 - DNA, 12 bp, Unknown
  misc_feature (1)..( 12): Matrix.004 file - promoters50/1715615
aaattaaacata

SEQ ID NO: 70398 - DNA, 8 bp, Unknown
  misc_feature (1)..( 8): Matrix.004 file - promoters50/1715810
taaaaaca

SEQ ID NO: 70399 - DNA, 12 bp, Unknown
  misc_feature (1)..( 12): Matrix.004 file - promoters50/1715994
ggaaattaaatt

SEQ ID NO: 70400 - DNA, 8 bp, Unknown
  misc_feature (1)..( 8): Matrix.004 file - promoters50/1716037
aataaaca

SEQ ID NO: 70401 - DNA, 7 bp, Unknown
  misc_feature (1)..( 7): Matrix.004 file - promoters50/1716037
atatatt

SEQ ID NO: 70402 - DNA, 13 bp, Unknown
  misc_feature (1)..( 13): Matrix.004 file - promoters50/1716037
tagattgtttctt

SEQ ID NO: 70403 - DNA, 7 bp, Unknown
  misc_feature (1)..( 7): Matrix.004 file - promoters50/1716037
gaaattt

SEQ ID NO: 70404 - DNA, 9 bp, Unknown
  misc_feature (1)..( 9): Matrix.004 file - promoters50/1716037
tttttgaat

SEQ ID NO: 70405 - DNA, 12 bp, Unknown
  misc_feature (1)..( 12): Matrix.004 file - promoters50/1716037
aaaaattttatt

SEQ ID NO: 70406 - DNA, 12 bp, Unknown
  misc_feature (1)..( 12): Matrix.004 file - promoters50/1716037
ataaaataatta

SEQ ID NO: 70407 - DNA, 9 bp, Unknown
  misc_feature (1)..( 9): Matrix.004 file - promoters50/1716040
aaaaatttt

SEQ ID NO: 70408 - DNA, 11 bp, Unknown
  misc_feature (1)..( 11): Matrix.004 file - promoters50/1806991
attaaatgtta

SEQ ID NO: 70409 - DNA, 11 bp, Unknown
  misc_feature (1)..( 11): Matrix.004 file - promoters50/1806991
ttaacaaaaaa

SEQ ID NO: 70410 - DNA, 9 bp, Unknown
  misc_feature (1)..( 9): Matrix.004 file - promoters50/1806998
catttgtat

SEQ ID NO: 70411 - DNA, 12 bp, Unknown
  misc_feature (1)..( 12): Matrix.004 file - promoters50/1807014
aaaacaaaattt

SEQ ID NO: 70412 - DNA, 10 bp, Unknown
  misc_feature (1)..( 10): Matrix.004 file - promoters50/1807014
aattttttcc

SEQ ID NO: 70413 - DNA, 10 bp, Unknown
  misc_feature (1)..( 10): Matrix.004 file - promoters50/1807067
ttaaaagaaa

SEQ ID NO: 70414 - DNA, 13 bp, Unknown
  misc_feature (1)..( 13): Matrix.004 file - promoters50/1807067
tttaaaacaagga

SEQ ID NO: 70415 - DNA, 14 bp, Unknown
  misc_feature (1)..( 14): Matrix.004 file - promoters50/1807067
atgtattattgtat

SEQ ID NO: 70416 - DNA, 15 bp, Unknown
  misc_feature (1)..( 15): Matrix.004 file - promoters50/1807067
acaactaattatata

SEQ ID NO: 70417 - DNA, 11 bp, Unknown
  misc_feature (1)..( 11): Matrix.004 file - promoters50/1807067
tcgattttaag

SEQ ID NO: 70418 - DNA, 10 bp, Unknown
  misc_feature (1)..( 10): Matrix.004 file - promoters50/1807244
cgtatcattt

SEQ ID NO: 70419 - DNA, 9 bp, Unknown
  misc_feature (1)..( 9): Matrix.004 file - promoters50/1807415
tgtcctaat

SEQ ID NO: 70420 - DNA, 8 bp, Unknown
  misc_feature (1)..( 8): Matrix.004 file - promoters50/1807415
ctttgtct

SEQ ID NO: 70421 - DNA, 7 bp, Unknown
  misc_feature (1)..( 7): Matrix.004 file - promoters50/1807415
atttttt

SEQ ID NO: 70422 - DNA, 8 bp, Unknown
  misc_feature (1)..( 8): Matrix.004 file - promoters50/1807415
tttctctc

SEQ ID NO: 70423 - DNA, 7 bp, Unknown
  misc_feature (1)..( 7): Matrix.004 file - promoters50/1807415
caaataa

SEQ ID NO: 70424 - DNA, 7 bp, Unknown
  misc_feature (1)..( 7): Matrix.004 file - promoters50/1807554
atcttta

SEQ ID NO: 70425 - DNA, 11 bp, Unknown
  misc_feature (1)..( 11): Matrix.004 file - promoters50/1807554
aatatgttttt

SEQ ID NO: 70426 - DNA, 7 bp, Unknown
  misc_feature (1)..( 7): Matrix.004 file - promoters50/1807554
tttcacc

SEQ ID NO: 70427 - DNA, 6 bp, Unknown
  misc_feature (1)..( 6): Matrix.004 file - promoters50/1807554
taaaac

SEQ ID NO: 70428 - DNA, 10 bp, Unknown
  misc_feature (1)..( 10): Matrix.004 file - promoters50/1807736
tccatcccta

SEQ ID NO: 70429 - DNA, 10 bp, Unknown
  misc_feature (1)..( 10): Matrix.004 file - promoters50/1807740
atatgaatac

SEQ ID NO: 70430 - DNA, 8 bp, Unknown
  misc_feature (1)..( 8): Matrix.004 file - promoters50/1807771
aaacttaa

SEQ ID NO: 70431 - DNA, 8 bp, Unknown
  misc_feature (1)..( 8): Matrix.004 file - promoters50/1807771
aaaaacac

SEQ ID NO: 70432 - DNA, 10 bp, Unknown
  misc_feature (1)..( 10): Matrix.004 file - promoters50/1807774
acaaaatata

SEQ ID NO: 70433 - DNA, 10 bp, Unknown
  misc_feature (1)..( 10): Matrix.004 file - promoters50/1807774
taaaaatttt

SEQ ID NO: 70434 - DNA, 10 bp, Unknown
  misc_feature (1)..( 10): Matrix.004 file - promoters50/1807774
ttttggaaat

SEQ ID NO: 70435 - DNA, 7 bp, Unknown
  misc_feature (1)..( 7): Matrix.004 file - promoters50/1807774
aaatttt

SEQ ID NO: 70436 - DNA, 8 bp, Unknown
  misc_feature (1)..( 8): Matrix.004 file - promoters50/1807774
ataccaac

SEQ ID NO: 70437 - DNA, 8 bp, Unknown
  misc_feature (1)..( 8): Matrix.004 file - promoters50/1807774
cactgttt

SEQ ID NO: 70438 - DNA, 8 bp, Unknown
  misc_feature (1)..( 8): Matrix.004 file - promoters50/1807774
tataaata

SEQ ID NO: 70439 - DNA, 8 bp, Unknown
  misc_feature (1)..( 8): Matrix.004 file - promoters50/1808030
atttattt

SEQ ID NO: 70440 - DNA, 7 bp, Unknown
  misc_feature (1)..( 7): Matrix.004 file - promoters50/1808030
ggtccat

SEQ ID NO: 70441 - DNA, 8 bp, Unknown
  misc_feature (1)..( 8): Matrix.004 file - promoters50/1808030
atacaaat

SEQ ID NO: 70442 - DNA, 7 bp, Unknown
  misc_feature (1)..( 7): Matrix.004 file - promoters50/1808072
caaaaac

SEQ ID NO: 70443 - DNA, 12 bp, Unknown
  misc_feature (1)..( 12): Matrix.004 file - promoters50/1808072
taaataattaat

SEQ ID NO: 70444 - DNA, 8 bp, Unknown
  misc_feature (1)..( 8): Matrix.004 file - promoters50/1808072
taatataa

SEQ ID NO: 70445 - DNA, 13 bp, Unknown
  misc_feature (1)..( 13): Matrix.004 file - promoters50/1808072
atacaaaattaaa

SEQ ID NO: 70446 - DNA, 8 bp, Unknown
  misc_feature (1)..( 8): Matrix.004 file - promoters50/1808072
aaaattta

SEQ ID NO: 70447 - DNA, 8 bp, Unknown
  misc_feature (1)..( 8): Matrix.004 file - promoters50/1808072
aaaattat

SEQ ID NO: 70448 - DNA, 14 bp, Unknown
  misc_feature (1)..( 14): Matrix.004 file - promoters50/1808072
tcaaaaattatata

SEQ ID NO: 70449 - DNA, 11 bp, Unknown
  misc_feature (1)..( 11): Matrix.004 file - promoters50/1808072
gataaattaaa

SEQ ID NO: 70450 - DNA, 11 bp, Unknown
  misc_feature (1)..( 11): Matrix.004 file - promoters50/1808072
attattaataa

SEQ ID NO: 70451 - DNA, 12 bp, Unknown
  misc_feature (1)..( 12): Matrix.004 file - promoters50/1808088
atttaaaaacaa

SEQ ID NO: 70452 - DNA, 7 bp, Unknown
  misc_feature (1)..( 7): Matrix.004 file - promoters50/1808088
ttttacc

SEQ ID NO: 70453 - DNA, 8 bp, Unknown
  misc_feature (1)..( 8): Matrix.004 file - promoters50/1808088
acaaaaaa

SEQ ID NO: 70454 - DNA, 11 bp, Unknown
  misc_feature (1)..( 11): Matrix.004 file - promoters50/1808088
aaagaggattg

SEQ ID NO: 70455 - DNA, 7 bp, Unknown
  misc_feature (1)..( 7): Matrix.004 file - promoters50/1808111
taaaaaa

SEQ ID NO: 70456 - DNA, 5 bp, Unknown
  misc_feature (1)..( 5): Matrix.004 file - promoters50/1808111
taaaa

SEQ ID NO: 70457 - DNA, 8 bp, Unknown
  misc_feature (1)..( 8): Matrix.004 file - promoters50/1808111
aaaaatga

SEQ ID NO: 70458 - DNA, 8 bp, Unknown
  misc_feature (1)..( 8): Matrix.004 file - promoters50/1808111
tatataaa

SEQ ID NO: 70459 - DNA, 6 bp, Unknown
  misc_feature (1)..( 6): Matrix.004 file - promoters50/1808145
acaaaa

SEQ ID NO: 70460 - DNA, 8 bp, Unknown
  misc_feature (1)..( 8): Matrix.004 file - promoters50/1808145
agagttta

SEQ ID NO: 70461 - DNA, 8 bp, Unknown
  misc_feature (1)..( 8): Matrix.004 file - promoters50/1808145
atagaaag

SEQ ID NO: 70462 - DNA, 8 bp, Unknown
  misc_feature (1)..( 8): Matrix.004 file - promoters50/1808145
acatggtt

SEQ ID NO: 70463 - DNA, 12 bp, Unknown
  misc_feature (1)..( 12): Matrix.004 file - promoters50/1808156
agcccatttgaa

SEQ ID NO: 70464 - DNA, 9 bp, Unknown
  misc_feature (1)..( 9): Matrix.004 file - promoters50/1808168
aaatttgaa

SEQ ID NO: 70465 - DNA, 10 bp, Unknown
  misc_feature (1)..( 10): Matrix.004 file - promoters50/1808168
taaaataaaa

SEQ ID NO: 70466 - DNA, 8 bp, Unknown
  misc_feature (1)..( 8): Matrix.004 file - promoters50/1808172
tataaaca

SEQ ID NO: 70467 - DNA, 9 bp, Unknown
  misc_feature (1)..( 9): Matrix.004 file - promoters50/1808172
caaatttta

SEQ ID NO: 70468 - DNA, 10 bp, Unknown
  misc_feature (1)..( 10): Matrix.004 file - promoters50/1808172
aattaacttt

SEQ ID NO: 70469 - DNA, 9 bp, Unknown
  misc_feature (1)..( 9): Matrix.004 file - promoters50/1808172
caaattatc

SEQ ID NO: 70470 - DNA, 9 bp, Unknown
  misc_feature (1)..( 9): Matrix.004 file - promoters50/1808172
tatataaaa

SEQ ID NO: 70471 - DNA, 13 bp, Unknown
  misc_feature (1)..( 13): Matrix.004 file - promoters50/1808172
aaataattaaact

SEQ ID NO: 70472 - DNA, 6 bp, Unknown
  misc_feature (1)..( 6): Matrix.004 file - promoters50/1808172
taaaac

SEQ ID NO: 70473 - DNA, 10 bp, Unknown
  misc_feature (1)..( 10): Matrix.004 file - promoters50/1808172
tatataattc

SEQ ID NO: 70474 - DNA, 8 bp, Unknown
  misc_feature (1)..( 8): Matrix.004 file - promoters50/1808172
aaataaag

SEQ ID NO: 70475 - DNA, 11 bp, Unknown
  misc_feature (1)..( 11): Matrix.004 file - promoters50/1808172
ccaaaaaaaaa

SEQ ID NO: 70476 - DNA, 10 bp, Unknown
  misc_feature (1)..( 10): Matrix.004 file - promoters50/1808172
tatataaaaa

SEQ ID NO: 70477 - DNA, 10 bp, Unknown
  misc_feature (1)..( 10): Matrix.004 file - promoters50/1808172
tttatttttg

SEQ ID NO: 70478 - DNA, 12 bp, Unknown
  misc_feature (1)..( 12): Matrix.004 file - promoters50/1808172
gtataaaacaaa

SEQ ID NO: 70479 - DNA, 9 bp, Unknown
  misc_feature (1)..( 9): Matrix.004 file - promoters50/1808184
taaaacaaa

SEQ ID NO: 70480 - DNA, 9 bp, Unknown
  misc_feature (1)..( 9): Matrix.004 file - promoters50/1808490
aatttttca

SEQ ID NO: 70481 - DNA, 11 bp, Unknown
  misc_feature (1)..( 11): Matrix.004 file - promoters50/1808490
agttaaatttg

SEQ ID NO: 70482 - DNA, 10 bp, Unknown
  misc_feature (1)..( 10): Matrix.004 file - promoters50/1808549
aaaaacttag

SEQ ID NO: 70483 - DNA, 7 bp, Unknown
  misc_feature (1)..( 7): Matrix.004 file - promoters50/1808549
atcaaat

SEQ ID NO: 70484 - DNA, 10 bp, Unknown
  misc_feature (1)..( 10): Matrix.004 file - promoters50/1808549
ctaaaatgac

SEQ ID NO: 70485 - DNA, 8 bp, Unknown
  misc_feature (1)..( 8): Matrix.004 file - promoters50/1808549
atttaaaa

SEQ ID NO: 70486 - DNA, 7 bp, Unknown
  misc_feature (1)..( 7): Matrix.004 file - promoters50/1808549
actttta

SEQ ID NO: 70487 - DNA, 10 bp, Unknown
  misc_feature (1)..( 10): Matrix.004 file - promoters50/1808572
aataactaaa

SEQ ID NO: 70488 - DNA, 11 bp, Unknown
  misc_feature (1)..( 11): Matrix.004 file - promoters50/1808572
actaattagta

SEQ ID NO: 70489 - DNA, 8 bp, Unknown
  misc_feature (1)..( 8): Matrix.004 file - promoters50/1808572
gtaaatta

SEQ ID NO: 70490 - DNA, 7 bp, Unknown
  misc_feature (1)..( 7): Matrix.004 file - promoters50/1808572
aaaaaaa

SEQ ID NO: 70491 - DNA, 9 bp, Unknown
  misc_feature (1)..( 9): Matrix.004 file - promoters50/1808572
ttattttat

SEQ ID NO: 70492 - DNA, 8 bp, Unknown
  misc_feature (1)..( 8): Matrix.004 file - promoters50/1808635
atataaag

SEQ ID NO: 70493 - DNA, 8 bp, Unknown
  misc_feature (1)..( 8): Matrix.004 file - promoters50/1808696
tgtcaatt

SEQ ID NO: 70494 - DNA, 9 bp, Unknown
  misc_feature (1)..( 9): Matrix.004 file - promoters50/1808696
aactattat

SEQ ID NO: 70495 - DNA, 11 bp, Unknown
  misc_feature (1)..( 11): Matrix.004 file - promoters50/1808696
ataataaatat

SEQ ID NO: 70496 - DNA, 8 bp, Unknown
  misc_feature (1)..( 8): Matrix.004 file - promoters50/1808753
tataaagt

SEQ ID NO: 70497 - DNA, 9 bp, Unknown
  misc_feature (1)..( 9): Matrix.004 file - promoters50/1808753
tataaacaa

SEQ ID NO: 70498 - DNA, 6 bp, Unknown
  misc_feature (1)..( 6): Matrix.004 file - promoters50/1809003
acatac

SEQ ID NO: 70499 - DNA, 8 bp, Unknown
  misc_feature (1)..( 8): Matrix.004 file - promoters50/1809088
catttttt

SEQ ID NO: 70500 - DNA, 13 bp, Unknown
  misc_feature (1)..( 13): Matrix.004 file - promoters50/1809088
aacaaaattttaa

SEQ ID NO: 70501 - DNA, 14 bp, Unknown
  misc_feature (1)..( 14): Matrix.004 file - promoters50/1809088
tgattttcacatat

SEQ ID NO: 70502 - DNA, 12 bp, Unknown
  misc_feature (1)..( 12): Matrix.004 file - promoters50/1809088
tcatccatacat

SEQ ID NO: 70503 - DNA, 16 bp, Unknown
  misc_feature (1)..( 16): Matrix.004 file - promoters50/1809157
aaagcttttatataaa

SEQ ID NO: 70504 - DNA, 15 bp, Unknown
  misc_feature (1)..( 15): Matrix.004 file - promoters50/1809157
atttctacaaaaaaa

SEQ ID NO: 70505 - DNA, 9 bp, Unknown
  misc_feature (1)..( 9): Matrix.004 file - promoters50/1809233
aagaaaaca

SEQ ID NO: 70506 - DNA, 10 bp, Unknown
  misc_feature (1)..( 10): Matrix.004 file - promoters50/1809233
taaaattaag

SEQ ID NO: 70507 - DNA, 12 bp, Unknown
  misc_feature (1)..( 12): Matrix.004 file - promoters50/1809235
ttacttcttata

SEQ ID NO: 70508 - DNA, 10 bp, Unknown
  misc_feature (1)..( 10): Matrix.004 file - promoters50/1809235
aatgaattta

SEQ ID NO: 70509 - DNA, 11 bp, Unknown
  misc_feature (1)..( 11): Matrix.004 file - promoters50/1809243
ttgaaaaattg

SEQ ID NO: 70510 - DNA, 10 bp, Unknown
  misc_feature (1)..( 10): Matrix.004 file - promoters50/1809243
aaattaattt

SEQ ID NO: 70511 - DNA, 8 bp, Unknown
  misc_feature (1)..( 8): Matrix.004 file - promoters50/1809253
acaaattt

SEQ ID NO: 70512 - DNA, 9 bp, Unknown
  misc_feature (1)..( 9): Matrix.004 file - promoters50/1809253
atttacaat

SEQ ID NO: 70513 - DNA, 12 bp, Unknown
  misc_feature (1)..( 12): Matrix.004 file - promoters50/1809253
aaataaaatcaa

SEQ ID NO: 70514 - DNA, 7 bp, Unknown
  misc_feature (1)..( 7): Matrix.004 file - promoters50/1809253
atatata

SEQ ID NO: 70515 - DNA, 9 bp, Unknown
  misc_feature (1)..( 9): Matrix.004 file - promoters50/1809253
attcgtttc

SEQ ID NO: 70516 - DNA, 9 bp, Unknown
  misc_feature (1)..( 9): Matrix.004 file - promoters50/1820893
attagttta

SEQ ID NO: 70517 - DNA, 8 bp, Unknown
  misc_feature (1)..( 8): Matrix.004 file - promoters50/1820893
ttttgttt

SEQ ID NO: 70518 - DNA, 9 bp, Unknown
  misc_feature (1)..( 9): Matrix.004 file - promoters50/1830195
cttttattc

SEQ ID NO: 70519 - DNA, 7 bp, Unknown
  misc_feature (1)..( 7): Matrix.004 file - promoters50/1830195
aaagaaa

SEQ ID NO: 70520 - DNA, 8 bp, Unknown
  misc_feature (1)..( 8): Matrix.004 file - promoters50/1837627
tctctata

SEQ ID NO: 70521 - DNA, 7 bp, Unknown
  misc_feature (1)..( 7): Matrix.004 file - promoters50/1837627
gattttt

SEQ ID NO: 70522 - DNA, 9 bp, Unknown
  misc_feature (1)..( 9): Matrix.004 file - promoters50/1837627
gattttttt

SEQ ID NO: 70523 - DNA, 10 bp, Unknown
  misc_feature (1)..( 10): Matrix.004 file - promoters50/1837627
aaaataataa

SEQ ID NO: 70524 - DNA, 9 bp, Unknown
  misc_feature (1)..( 9): Matrix.004 file - promoters50/1837627
aaacaaaaa

SEQ ID NO: 70525 - DNA, 8 bp, Unknown
  misc_feature (1)..( 8): Matrix.004 file - promoters50/1920394
ataaaatt

SEQ ID NO: 70526 - DNA, 7 bp, Unknown
  misc_feature (1)..( 7): Matrix.004 file - promoters50/1920394
aatgtta

SEQ ID NO: 70527 - DNA, 10 bp, Unknown
  misc_feature (1)..( 10): Matrix.004 file - promoters50/1920394
ttttaatgtg

SEQ ID NO: 70528 - DNA, 10 bp, Unknown
  misc_feature (1)..( 10): Matrix.004 file - promoters50/1920394
gttttaatgt

SEQ ID NO: 70529 - DNA, 12 bp, Unknown
  misc_feature (1)..( 12): Matrix.004 file - promoters50/1920394
ccaagttttatt

SEQ ID NO: 70530 - DNA, 10 bp, Unknown
  misc_feature (1)..( 10): Matrix.004 file - promoters50/1920394
aattttagaa

SEQ ID NO: 70531 - DNA, 8 bp, Unknown
  misc_feature (1)..( 8): Matrix.004 file - promoters50/1920394
ataattaa

SEQ ID NO: 70532 - DNA, 8 bp, Unknown
  misc_feature (1)..( 8): Matrix.004 file - promoters50/1920394
ttaaaaag

SEQ ID NO: 70533 - DNA, 8 bp, Unknown
  misc_feature (1)..( 8): Matrix.004 file - promoters50/1921363
aaactatt

SEQ ID NO: 70534 - DNA, 9 bp, Unknown
  misc_feature (1)..( 9): Matrix.004 file - promoters50/1921363
caaattttc

SEQ ID NO: 70535 - DNA, 9 bp, Unknown
  misc_feature (1)..( 9): Matrix.004 file - promoters50/1921363
atttaaata

SEQ ID NO: 70536 - DNA, 9 bp, Unknown
  misc_feature (1)..( 9): Matrix.004 file - promoters50/1921363
cagaaaata

SEQ ID NO: 70537 - DNA, 13 bp, Unknown
  misc_feature (1)..( 13): Matrix.004 file - promoters50/1923743
tatatattgaaat

SEQ ID NO: 70538 - DNA, 9 bp, Unknown
  misc_feature (1)..( 9): Matrix.004 file - promoters50/1957018
tttcaaaat

SEQ ID NO: 70539 - DNA, 14 bp, Unknown
  misc_feature (1)..( 14): Matrix.004 file - promoters50/1957094
tacaaagattctta

SEQ ID NO: 70540 - DNA, 8 bp, Unknown
  misc_feature (1)..( 8): Matrix.004 file - promoters50/1957212
cggcaaat

SEQ ID NO: 70541 - DNA, 7 bp, Unknown
  misc_feature (1)..( 7): Matrix.004 file - promoters50/1957212
tagagaa

SEQ ID NO: 70542 - DNA, 10 bp, Unknown
  misc_feature (1)..( 10): Matrix.004 file - promoters50/1957241
gcaaacagac

SEQ ID NO: 70543 - DNA, 9 bp, Unknown
  misc_feature (1)..( 9): Matrix.004 file - promoters50/1957241
caaactaaa

SEQ ID NO: 70544 - DNA, 8 bp, Unknown
  misc_feature (1)..( 8): Matrix.004 file - promoters50/1957245
cttacaaa

SEQ ID NO: 70545 - DNA, 17 bp, Unknown
  misc_feature (1)..( 17): Matrix.004 file - promoters50/1957245
aaaaagtagttatttca

SEQ ID NO: 70546 - DNA, 9 bp, Unknown
  misc_feature (1)..( 9): Matrix.004 file - promoters50/1957245
aaataaaat

SEQ ID NO: 70547 - DNA, 11 bp, Unknown
  misc_feature (1)..( 11): Matrix.004 file - promoters50/1957245
acaaaaacaga

SEQ ID NO: 70548 - DNA, 11 bp, Unknown
  misc_feature (1)..( 11): Matrix.004 file - promoters50/1957245
acaaaaataga

SEQ ID NO: 70549 - DNA, 12 bp, Unknown
  misc_feature (1)..( 12): Matrix.004 file - promoters50/1957296
acgcagatagat

SEQ ID NO: 70550 - DNA, 7 bp, Unknown
  misc_feature (1)..( 7): Matrix.004 file - promoters50/1957303
aaagaaa

SEQ ID NO: 70551 - DNA, 8 bp, Unknown
  misc_feature (1)..( 8): Matrix.004 file - promoters50/1957303
aaacgaaa

SEQ ID NO: 70552 - DNA, 8 bp, Unknown
  misc_feature (1)..( 8): Matrix.004 file - promoters50/1957303
gaagaaag

SEQ ID NO: 70553 - DNA, 14 bp, Unknown
  misc_feature (1)..( 14): Matrix.004 file - promoters50/1957303
agaagaaaatcgaa

SEQ ID NO: 70554 - DNA, 8 bp, Unknown
  misc_feature (1)..( 8): Matrix.004 file - promoters50/1957303
atttaaag

SEQ ID NO: 70555 - DNA, 8 bp, Unknown
  misc_feature (1)..( 8): Matrix.004 file - promoters50/1957303
agcaaatc

SEQ ID NO: 70556 - DNA, 10 bp, Unknown
  misc_feature (1)..( 10): Matrix.004 file - promoters50/1959878
gaaaaaaaaa

SEQ ID NO: 70557 - DNA, 11 bp, Unknown
  misc_feature (1)..( 11): Matrix.004 file - promoters50/1959920
tctaattggac

SEQ ID NO: 70558 - DNA, 9 bp, Unknown
  misc_feature (1)..( 9): Matrix.004 file - promoters50/1959920
gcatctctt

SEQ ID NO: 70559 - DNA, 10 bp, Unknown
  misc_feature (1)..( 10): Matrix.004 file - promoters50/1959927
gatttgggat

SEQ ID NO: 70560 - DNA, 8 bp, Unknown
  misc_feature (1)..( 8): Matrix.004 file - promoters50/1959965
aaatattt

SEQ ID NO: 70561 - DNA, 12 bp, Unknown
  misc_feature (1)..( 12): Matrix.004 file - promoters50/1959965
aaaagttcatct

SEQ ID NO: 70562 - DNA, 9 bp, Unknown
  misc_feature (1)..( 9): Matrix.004 file - promoters50/1959965
tttcatata

SEQ ID NO: 70563 - DNA, 7 bp, Unknown
  misc_feature (1)..( 7): Matrix.004 file - promoters50/1959965
ccatttt

SEQ ID NO: 70564 - DNA, 9 bp, Unknown
  misc_feature (1)..( 9): Matrix.004 file - promoters50/1959965
ttaaatatt

SEQ ID NO: 70565 - DNA, 8 bp, Unknown
  misc_feature (1)..( 8): Matrix.004 file - promoters50/1959965
attttttt

SEQ ID NO: 70566 - DNA, 10 bp, Unknown
  misc_feature (1)..( 10): Matrix.004 file - promoters50/1959965
agttattcat

SEQ ID NO: 70567 - DNA, 9 bp, Unknown
  misc_feature (1)..( 9): Matrix.004 file - promoters50/1974123
tttattaaa

SEQ ID NO: 70568 - DNA, 13 bp, Unknown
  misc_feature (1)..( 13): Matrix.004 file - promoters50/1974123
ttatcaaacaaat

SEQ ID NO: 70569 - DNA, 11 bp, Unknown
  misc_feature (1)..( 11): Matrix.004 file - promoters50/1974123
aattattttgt

SEQ ID NO: 70570 - DNA, 9 bp, Unknown
  misc_feature (1)..( 9): Matrix.004 file - promoters50/1974123
taaaacacc

SEQ ID NO: 70571 - DNA, 12 bp, Unknown
  misc_feature (1)..( 12): Matrix.004 file - promoters50/1974123
aaagaaaataga

SEQ ID NO: 70572 - DNA, 8 bp, Unknown
  misc_feature (1)..( 8): Matrix.004 file - promoters50/1974123
tttataaa

SEQ ID NO: 70573 - DNA, 9 bp, Unknown
  misc_feature (1)..( 9): Matrix.004 file - promoters50/1974282
gaaattaga

SEQ ID NO: 70574 - DNA, 10 bp, Unknown
  misc_feature (1)..( 10): Matrix.004 file - promoters50/1974282
atacttagaa

SEQ ID NO: 70575 - DNA, 14 bp, Unknown
  misc_feature (1)..( 14): Matrix.004 file - promoters50/1974282
cctttttgtaacat

SEQ ID NO: 70576 - DNA, 14 bp, Unknown
  misc_feature (1)..( 14): Matrix.004 file - promoters50/1974501
ctaaaaacttataa

SEQ ID NO: 70577 - DNA, 11 bp, Unknown
  misc_feature (1)..( 11): Matrix.004 file - promoters50/1974501
ttaaatgattt

SEQ ID NO: 70578 - DNA, 16 bp, Unknown
  misc_feature (1)..( 16): Matrix.004 file - promoters50/1974501
aaaaataaaataattt

SEQ ID NO: 70579 - DNA, 11 bp, Unknown
  misc_feature (1)..( 11): Matrix.004 file - promoters50/1974501
taataaaataa

SEQ ID NO: 70580 - DNA, 13 bp, Unknown
  misc_feature (1)..( 13): Matrix.004 file - promoters50/1974737
aataaaaatttat

SEQ ID NO: 70581 - DNA, 8 bp, Unknown
  misc_feature (1)..( 8): Matrix.004 file - promoters50/1974737
tataaaaa

SEQ ID NO: 70582 - DNA, 12 bp, Unknown
  misc_feature (1)..( 12): Matrix.004 file - promoters50/1974761
aaagagaagaaa

SEQ ID NO: 70583 - DNA, 9 bp, Unknown
  misc_feature (1)..( 9): Matrix.004 file - promoters50/1974761
aaatttaac

SEQ ID NO: 70584 - DNA, 6 bp, Unknown
  misc_feature (1)..( 6): Matrix.004 file - promoters50/1974761
atttaa

SEQ ID NO: 70585 - DNA, 8 bp, Unknown
  misc_feature (1)..( 8): Matrix.004 file - promoters50/1974761
aataaatt

SEQ ID NO: 70586 - DNA, 7 bp, Unknown
  misc_feature (1)..( 7): Matrix.004 file - promoters50/1974761
taaattt

SEQ ID NO: 70587 - DNA, 14 bp, Unknown
  misc_feature (1)..( 14): Matrix.004 file - promoters50/1974761
ggagattgtccaca

SEQ ID NO: 70588 - DNA, 8 bp, Unknown
  misc_feature (1)..( 8): Matrix.004 file - promoters50/1974761
aaaaacat

SEQ ID NO: 70589 - DNA, 8 bp, Unknown
  misc_feature (1)..( 8): Matrix.004 file - promoters50/1975887
aacaaaat

SEQ ID NO: 70590 - DNA, 8 bp, Unknown
  misc_feature (1)..( 8): Matrix.004 file - promoters50/1975887
taattgta

SEQ ID NO: 70591 - DNA, 16 bp, Unknown
  misc_feature (1)..( 16): Matrix.004 file - promoters50/1975895
tttgtaaattgtaatc

SEQ ID NO: 70592 - DNA, 8 bp, Unknown
  misc_feature (1)..( 8): Matrix.004 file - promoters50/1975940
aaaaacaa

SEQ ID NO: 70593 - DNA, 12 bp, Unknown
  misc_feature (1)..( 12): Matrix.004 file - promoters50/1975940
catttaaatgaa

SEQ ID NO: 70594 - DNA, 9 bp, Unknown
  misc_feature (1)..( 9): Matrix.004 file - promoters50/1975940
acaaataaa

SEQ ID NO: 70595 - DNA, 11 bp, Unknown
  misc_feature (1)..( 11): Matrix.004 file - promoters50/1975940
tttgatttcta

SEQ ID NO: 70596 - DNA, 12 bp, Unknown
  misc_feature (1)..( 12): Matrix.004 file - promoters50/1975940
taaaattgaaag

SEQ ID NO: 70597 - DNA, 10 bp, Unknown
  misc_feature (1)..( 10): Matrix.004 file - promoters50/1975940
attaaaattt

SEQ ID NO: 70598 - DNA, 9 bp, Unknown
  misc_feature (1)..( 9): Matrix.004 file - promoters50/1975940
gtataattt

SEQ ID NO: 70599 - DNA, 12 bp, Unknown
  misc_feature (1)..( 12): Matrix.004 file - promoters50/1975940
aattttgaattc

SEQ ID NO: 70600 - DNA, 14 bp, Unknown
  misc_feature (1)..( 14): Matrix.004 file - promoters50/1975956
tataaaaattaaga

SEQ ID NO: 70601 - DNA, 7 bp, Unknown
  misc_feature (1)..( 7): Matrix.004 file - promoters50/1975956
taataat

SEQ ID NO: 70602 - DNA, 6 bp, Unknown
  misc_feature (1)..( 6): Matrix.004 file - promoters50/1975956
aatttt

SEQ ID NO: 70603 - DNA, 14 bp, Unknown
  misc_feature (1)..( 14): Matrix.004 file - promoters50/1975956
ttgaatcaatattt

SEQ ID NO: 70604 - DNA, 7 bp, Unknown
  misc_feature (1)..( 7): Matrix.004 file - promoters50/1975956
tgaaaaa

SEQ ID NO: 70605 - DNA, 9 bp, Unknown
  misc_feature (1)..( 9): Matrix.004 file - promoters50/1975956
taaatttct

SEQ ID NO: 70606 - DNA, 8 bp, Unknown
  misc_feature (1)..( 8): Matrix.004 file - promoters50/1975989
aattatat

SEQ ID NO: 70607 - DNA, 9 bp, Unknown
  misc_feature (1)..( 9): Matrix.004 file - promoters50/1975989
tcataattt

SEQ ID NO: 70608 - DNA, 8 bp, Unknown
  misc_feature (1)..( 8): Matrix.004 file - promoters50/1975989
tttaattt

SEQ ID NO: 70609 - DNA, 7 bp, Unknown
  misc_feature (1)..( 7): Matrix.004 file - promoters50/1975989
taaatct

SEQ ID NO: 70610 - DNA, 10 bp, Unknown
  misc_feature (1)..( 10): Matrix.004 file - promoters50/1975989
taaaactgat

SEQ ID NO: 70611 - DNA, 8 bp, Unknown
  misc_feature (1)..( 8): Matrix.004 file - promoters50/1975989
attttttt

SEQ ID NO: 70612 - DNA, 8 bp, Unknown
  misc_feature (1)..( 8): Matrix.004 file - promoters50/1975989
tcattttt

SEQ ID NO: 70613 - DNA, 7 bp, Unknown
  misc_feature (1)..( 7): Matrix.004 file - promoters50/1976000
tataaac

SEQ ID NO: 70614 - DNA, 9 bp, Unknown
  misc_feature (1)..( 9): Matrix.004 file - promoters50/1976004
aaaacaatt

SEQ ID NO: 70615 - DNA, 11 bp, Unknown
  misc_feature (1)..( 11): Matrix.004 file - promoters50/1976004
ttatcccattg

SEQ ID NO: 70616 - DNA, 10 bp, Unknown
  misc_feature (1)..( 10): Matrix.004 file - promoters50/1976004
tattaaatta

SEQ ID NO: 70617 - DNA, 13 bp, Unknown
  misc_feature (1)..( 13): Matrix.004 file - promoters50/1976004
attaaaaaaaatt

SEQ ID NO: 70618 - DNA, 10 bp, Unknown
  misc_feature (1)..( 10): Matrix.004 file - promoters50/1976004
aagaaataaa

SEQ ID NO: 70619 - DNA, 9 bp, Unknown
  misc_feature (1)..( 9): Matrix.004 file - promoters50/1976004
acaaaattt

SEQ ID NO: 70620 - DNA, 14 bp, Unknown
  misc_feature (1)..( 14): Matrix.004 file - promoters50/1976004
tttataaaaaaata

SEQ ID NO: 70621 - DNA, 11 bp, Unknown
  misc_feature (1)..( 11): Matrix.004 file - promoters50/1976004
taacaaaaaaa

SEQ ID NO: 70622 - DNA, 9 bp, Unknown
  misc_feature (1)..( 9): Matrix.004 file - promoters50/1976004
aggcccatt

SEQ ID NO: 70623 - DNA, 10 bp, Unknown
  misc_feature (1)..( 10): Matrix.004 file - promoters50/1976004
tgtaatttgt

SEQ ID NO: 70624 - DNA, 10 bp, Unknown
  misc_feature (1)..( 10): Matrix.004 file - promoters50/1976004
gtaaaaaaat

SEQ ID NO: 70625 - DNA, 10 bp, Unknown
  misc_feature (1)..( 10): Matrix.004 file - promoters50/1976004
atcaaaaaat

SEQ ID NO: 70626 - DNA, 11 bp, Unknown
  misc_feature (1)..( 11): Matrix.004 file - promoters50/1976004
aattaaataaa

SEQ ID NO: 70627 - DNA, 10 bp, Unknown
  misc_feature (1)..( 10): Matrix.004 file - promoters50/1976004
atgttattta

SEQ ID NO: 70628 - DNA, 8 bp, Unknown
  misc_feature (1)..( 8): Matrix.004 file - promoters50/1976011
aataaaat

SEQ ID NO: 70629 - DNA, 8 bp, Unknown
  misc_feature (1)..( 8): Matrix.004 file - promoters50/1976019
cataatta

SEQ ID NO: 70630 - DNA, 10 bp, Unknown
  misc_feature (1)..( 10): Matrix.004 file - promoters50/1976047
aaaaattcta

SEQ ID NO: 70631 - DNA, 12 bp, Unknown
  misc_feature (1)..( 12): Matrix.004 file - promoters50/1976047
atttaaaagatc

SEQ ID NO: 70632 - DNA, 7 bp, Unknown
  misc_feature (1)..( 7): Matrix.004 file - promoters50/1976047
tttctcg

SEQ ID NO: 70633 - DNA, 9 bp, Unknown
  misc_feature (1)..( 9): Matrix.004 file - promoters50/1976047
gatttcaaa

SEQ ID NO: 70634 - DNA, 11 bp, Unknown
  misc_feature (1)..( 11): Matrix.004 file - promoters50/1976047
tcataaaactt

SEQ ID NO: 70635 - DNA, 10 bp, Unknown
  misc_feature (1)..( 10): Matrix.004 file - promoters50/1976047
attacaaaaa

SEQ ID NO: 70636 - DNA, 7 bp, Unknown
  misc_feature (1)..( 7): Matrix.004 file - promoters50/1976063
ttaattt

SEQ ID NO: 70637 - DNA, 9 bp, Unknown
  misc_feature (1)..( 9): Matrix.004 file - promoters50/1976063
aatgaagct

SEQ ID NO: 70638 - DNA, 7 bp, Unknown
  misc_feature (1)..( 7): Matrix.004 file - promoters50/1976078
atttttc

SEQ ID NO: 70639 - DNA, 11 bp, Unknown
  misc_feature (1)..( 11): Matrix.004 file - promoters50/1976078
taaatgaatca

SEQ ID NO: 70640 - DNA, 11 bp, Unknown
  misc_feature (1)..( 11): Matrix.004 file - promoters50/1976102
gaataaaaata

SEQ ID NO: 70641 - DNA, 7 bp, Unknown
  misc_feature (1)..( 7): Matrix.004 file - promoters50/1976102
tttcaaa

SEQ ID NO: 70642 - DNA, 10 bp, Unknown
  misc_feature (1)..( 10): Matrix.004 file - promoters50/1976107
tttttgttcc

SEQ ID NO: 70643 - DNA, 8 bp, Unknown
  misc_feature (1)..( 8): Matrix.004 file - promoters50/1976107
tataattt

SEQ ID NO: 70644 - DNA, 10 bp, Unknown
  misc_feature (1)..( 10): Matrix.004 file - promoters50/1976158
tttaatttcc

SEQ ID NO: 70645 - DNA, 11 bp, Unknown
  misc_feature (1)..( 11): Matrix.004 file - promoters50/1976158
cataactaatt

SEQ ID NO: 70646 - DNA, 9 bp, Unknown
  misc_feature (1)..( 9): Matrix.004 file - promoters50/1976158
catttctac

SEQ ID NO: 70647 - DNA, 12 bp, Unknown
  misc_feature (1)..( 12): Matrix.004 file - promoters50/1976158
atcaattttata

SEQ ID NO: 70648 - DNA, 13 bp, Unknown
  misc_feature (1)..( 13): Matrix.004 file - promoters50/1976158
ttaatcaaaccaa

SEQ ID NO: 70649 - DNA, 9 bp, Unknown
  misc_feature (1)..( 9): Matrix.004 file - promoters50/1976158
aaaaaatta

SEQ ID NO: 70650 - DNA, 9 bp, Unknown
  misc_feature (1)..( 9): Matrix.004 file - promoters50/1976174
attgtaatt

SEQ ID NO: 70651 - DNA, 11 bp, Unknown
  misc_feature (1)..( 11): Matrix.004 file - promoters50/1976174
atacttatatt

SEQ ID NO: 70652 - DNA, 5 bp, Unknown
  misc_feature (1)..( 5): Matrix.004 file - promoters50/1976174
tgatt

SEQ ID NO: 70653 - DNA, 7 bp, Unknown
  misc_feature (1)..( 7): Matrix.004 file - promoters50/1976174
aactatt

SEQ ID NO: 70654 - DNA, 7 bp, Unknown
  misc_feature (1)..( 7): Matrix.004 file - promoters50/1976174
gaaaaaa

SEQ ID NO: 70655 - DNA, 8 bp, Unknown
  misc_feature (1)..( 8): Matrix.004 file - promoters50/1976174
tgcttttg

SEQ ID NO: 70656 - DNA, 10 bp, Unknown
  misc_feature (1)..( 10): Matrix.004 file - promoters50/1976174
atattttaat

SEQ ID NO: 70657 - DNA, 9 bp, Unknown
  misc_feature (1)..( 9): Matrix.004 file - promoters50/1976223
ttatataaa

SEQ ID NO: 70658 - DNA, 8 bp, Unknown
  misc_feature (1)..( 8): Matrix.004 file - promoters50/1976226
ctttcatt

SEQ ID NO: 70659 - DNA, 9 bp, Unknown
  misc_feature (1)..( 9): Matrix.004 file - promoters50/1976236
tgatacaga

SEQ ID NO: 70660 - DNA, 14 bp, Unknown
  misc_feature (1)..( 14): Matrix.004 file - promoters50/1976236
ctatcttaaaaata

SEQ ID NO: 70661 - DNA, 8 bp, Unknown
  misc_feature (1)..( 8): Matrix.004 file - promoters50/1976270
tattagta

SEQ ID NO: 70662 - DNA, 9 bp, Unknown
  misc_feature (1)..( 9): Matrix.004 file - promoters50/1976270
aaatttttt

SEQ ID NO: 70663 - DNA, 7 bp, Unknown
  misc_feature (1)..( 7): Matrix.004 file - promoters50/1976270
aaaataa

SEQ ID NO: 70664 - DNA, 9 bp, Unknown
  misc_feature (1)..( 9): Matrix.004 file - promoters50/1976270
ctaaaaaaa

SEQ ID NO: 70665 - DNA, 7 bp, Unknown
  misc_feature (1)..( 7): Matrix.004 file - promoters50/1976270
aataata

SEQ ID NO: 70666 - DNA, 8 bp, Unknown
  misc_feature (1)..( 8): Matrix.004 file - promoters50/1976270
atttattt

SEQ ID NO: 70667 - DNA, 9 bp, Unknown
  misc_feature (1)..( 9): Matrix.004 file - promoters50/1976270
gataaaaaa

SEQ ID NO: 70668 - DNA, 9 bp, Unknown
  misc_feature (1)..( 9): Matrix.004 file - promoters50/1976286
tcaaaaaaa

SEQ ID NO: 70669 - DNA, 12 bp, Unknown
  misc_feature (1)..( 12): Matrix.004 file - promoters50/1976286
aaattttaacaa

SEQ ID NO: 70670 - DNA, 11 bp, Unknown
  misc_feature (1)..( 11): Matrix.004 file - promoters50/1976286
aattttaacaa

SEQ ID NO: 70671 - DNA, 9 bp, Unknown
  misc_feature (1)..( 9): Matrix.004 file - promoters50/1976286
catttttgt

SEQ ID NO: 70672 - DNA, 6 bp, Unknown
  misc_feature (1)..( 6): Matrix.004 file - promoters50/1976286
aaaaca

SEQ ID NO: 70673 - DNA, 8 bp, Unknown
  misc_feature (1)..( 8): Matrix.004 file - promoters50/1976286
aaataatt

SEQ ID NO: 70674 - DNA, 9 bp, Unknown
  misc_feature (1)..( 9): Matrix.004 file - promoters50/1976286
tcctttttt

SEQ ID NO: 70675 - DNA, 8 bp, Unknown
  misc_feature (1)..( 8): Matrix.004 file - promoters50/1976298
ccgctttt

SEQ ID NO: 70676 - DNA, 11 bp, Unknown
  misc_feature (1)..( 11): Matrix.004 file - promoters50/1976298
caacaaagaaa

SEQ ID NO: 70677 - DNA, 7 bp, Unknown
  misc_feature (1)..( 7): Matrix.004 file - promoters50/1976298
attaaaa

SEQ ID NO: 70678 - DNA, 9 bp, Unknown
  misc_feature (1)..( 9): Matrix.004 file - promoters50/1976298
taattaaat

SEQ ID NO: 70679 - DNA, 7 bp, Unknown
  misc_feature (1)..( 7): Matrix.004 file - promoters50/1976298
tctagac

SEQ ID NO: 70680 - DNA, 7 bp, Unknown
  misc_feature (1)..( 7): Matrix.004 file - promoters50/1976336
atatttt

SEQ ID NO: 70681 - DNA, 9 bp, Unknown
  misc_feature (1)..( 9): Matrix.004 file - promoters50/1976336
aaacaaatc

SEQ ID NO: 70682 - DNA, 9 bp, Unknown
  misc_feature (1)..( 9): Matrix.004 file - promoters50/1976354
agaattttt

SEQ ID NO: 70683 - DNA, 12 bp, Unknown
  misc_feature (1)..( 12): Matrix.004 file - promoters50/1976373
acagtgatcaaa

SEQ ID NO: 70684 - DNA, 11 bp, Unknown
  misc_feature (1)..( 11): Matrix.004 file - promoters50/1976373
tgttaatcaat

SEQ ID NO: 70685 - DNA, 9 bp, Unknown
  misc_feature (1)..( 9): Matrix.004 file - promoters50/1976373
actccacgt

SEQ ID NO: 70686 - DNA, 9 bp, Unknown
  misc_feature (1)..( 9): Matrix.004 file - promoters50/1976381
aatatatac

SEQ ID NO: 70687 - DNA, 13 bp, Unknown
  misc_feature (1)..( 13): Matrix.004 file - promoters50/1976381
actacaagaaaaa

SEQ ID NO: 70688 - DNA, 8 bp, Unknown
  misc_feature (1)..( 8): Matrix.004 file - promoters50/1976387
gtttatga

SEQ ID NO: 70689 - DNA, 13 bp, Unknown
  misc_feature (1)..( 13): Matrix.004 file - promoters50/1976387
gtaaaggcccaat

SEQ ID NO: 70690 - DNA, 15 bp, Unknown
  misc_feature (1)..( 15): Matrix.004 file - promoters50/1976412
aaataagaaaaaaac

SEQ ID NO: 70691 - DNA, 8 bp, Unknown
  misc_feature (1)..( 8): Matrix.004 file - promoters50/1976412
ctaataat

SEQ ID NO: 70692 - DNA, 8 bp, Unknown
  misc_feature (1)..( 8): Matrix.004 file - promoters50/1976412
caaaatta

SEQ ID NO: 70693 - DNA, 8 bp, Unknown
  misc_feature (1)..( 8): Matrix.004 file - promoters50/1976412
ataataac

SEQ ID NO: 70694 - DNA, 8 bp, Unknown
  misc_feature (1)..( 8): Matrix.004 file - promoters50/1976412
ctaattat

SEQ ID NO: 70695 - DNA, 7 bp, Unknown
  misc_feature (1)..( 7): Matrix.004 file - promoters50/1976437
taatttt

SEQ ID NO: 70696 - DNA, 10 bp, Unknown
  misc_feature (1)..( 10): Matrix.004 file - promoters50/1976437
ttcttaattt

SEQ ID NO: 70697 - DNA, 9 bp, Unknown
  misc_feature (1)..( 9): Matrix.004 file - promoters50/1976457
gaacatgac

SEQ ID NO: 70698 - DNA, 14 bp, Unknown
  misc_feature (1)..( 14): Matrix.004 file - promoters50/1976457
tttttaataaatat

SEQ ID NO: 70699 - DNA, 7 bp, Unknown
  misc_feature (1)..( 7): Matrix.004 file - promoters50/1976504
ataataa

SEQ ID NO: 70700 - DNA, 6 bp, Unknown
  misc_feature (1)..( 6): Matrix.004 file - promoters50/1976504
attttg

SEQ ID NO: 70701 - DNA, 10 bp, Unknown
  misc_feature (1)..( 10): Matrix.004 file - promoters50/1976504
gaaaataaaa

SEQ ID NO: 70702 - DNA, 12 bp, Unknown
  misc_feature (1)..( 12): Matrix.004 file - promoters50/1976504
tattaaaaaaaa

SEQ ID NO: 70703 - DNA, 11 bp, Unknown
  misc_feature (1)..( 11): Matrix.004 file - promoters50/1976511
atttaaaaaaa

SEQ ID NO: 70704 - DNA, 10 bp, Unknown
  misc_feature (1)..( 10): Matrix.004 file - promoters50/1976511
cagaaaacta

SEQ ID NO: 70705 - DNA, 6 bp, Unknown
  misc_feature (1)..( 6): Matrix.004 file - promoters50/1976511
agtaat

SEQ ID NO: 70706 - DNA, 9 bp, Unknown
  misc_feature (1)..( 9): Matrix.004 file - promoters50/1976550
gttttttct

SEQ ID NO: 70707 - DNA, 10 bp, Unknown
  misc_feature (1)..( 10): Matrix.004 file - promoters50/1977519
taatctgatc

SEQ ID NO: 70708 - DNA, 12 bp, Unknown
  misc_feature (1)..( 12): Matrix.004 file - promoters50/1977519
ttgaatcaatat

SEQ ID NO: 70709 - DNA, 9 bp, Unknown
  misc_feature (1)..( 9): Matrix.004 file - promoters50/1977529
gatttggtt

SEQ ID NO: 70710 - DNA, 7 bp, Unknown
  misc_feature (1)..( 7): Matrix.004 file - promoters50/1977529
cttcaaa

SEQ ID NO: 70711 - DNA, 7 bp, Unknown
  misc_feature (1)..( 7): Matrix.004 file - promoters50/1977533
ttcaaac

SEQ ID NO: 70712 - DNA, 9 bp, Unknown
  misc_feature (1)..( 9): Matrix.004 file - promoters50/1977533
aaaagtttg

SEQ ID NO: 70713 - DNA, 9 bp, Unknown
  misc_feature (1)..( 9): Matrix.004 file - promoters50/1977533
taaacccta

SEQ ID NO: 70714 - DNA, 11 bp, Unknown
  misc_feature (1)..( 11): Matrix.004 file - promoters50/1977537
ttattaaactt

SEQ ID NO: 70715 - DNA, 10 bp, Unknown
  misc_feature (1)..( 10): Matrix.004 file - promoters50/1977537
tgattttttt

SEQ ID NO: 70716 - DNA, 11 bp, Unknown
  misc_feature (1)..( 11): Matrix.004 file - promoters50/1985373
aaatataagta

SEQ ID NO: 70717 - DNA, 7 bp, Unknown
  misc_feature (1)..( 7): Matrix.004 file - promoters50/1985373
ttttttt

SEQ ID NO: 70718 - DNA, 15 bp, Unknown
  misc_feature (1)..( 15): Matrix.004 file - promoters50/1985373
tatgtttaatttaca

SEQ ID NO: 70719 - DNA, 9 bp, Unknown
  misc_feature (1)..( 9): Matrix.004 file - promoters50/1985373
ataaagtat

SEQ ID NO: 70720 - DNA, 9 bp, Unknown
  misc_feature (1)..( 9): Matrix.004 file - promoters50/1985415
gaaataaaa

SEQ ID NO: 70721 - DNA, 10 bp, Unknown
  misc_feature (1)..( 10): Matrix.004 file - promoters50/1985415
tataaacaat

SEQ ID NO: 70722 - DNA, 7 bp, Unknown
  misc_feature (1)..( 7): Matrix.004 file - promoters50/1985415
aacattt

SEQ ID NO: 70723 - DNA, 8 bp, Unknown
  misc_feature (1)..( 8): Matrix.004 file - promoters50/1985477
cttttaaa

SEQ ID NO: 70724 - DNA, 9 bp, Unknown
  misc_feature (1)..( 9): Matrix.004 file - promoters50/1985588
tattataaa

SEQ ID NO: 70725 - DNA, 8 bp, Unknown
  misc_feature (1)..( 8): Matrix.004 file - promoters50/1985590
aatttata

SEQ ID NO: 70726 - DNA, 9 bp, Unknown
  misc_feature (1)..( 9): Matrix.004 file - promoters50/1985621
caaaactaa

SEQ ID NO: 70727 - DNA, 7 bp, Unknown
  misc_feature (1)..( 7): Matrix.004 file - promoters50/1985854
aaaataa

SEQ ID NO: 70728 - DNA, 6 bp, Unknown
  misc_feature (1)..( 6): Matrix.004 file - promoters50/1985854
ttttct

SEQ ID NO: 70729 - DNA, 13 bp, Unknown
  misc_feature (1)..( 13): Matrix.004 file - promoters50/1985854
aaataaaacaaaa

SEQ ID NO: 70730 - DNA, 8 bp, Unknown
  misc_feature (1)..( 8): Matrix.004 file - promoters50/1985854
caaccaac

SEQ ID NO: 70731 - DNA, 8 bp, Unknown
  misc_feature (1)..( 8): Matrix.004 file - promoters50/2024838
aattttta

SEQ ID NO: 70732 - DNA, 9 bp, Unknown
  misc_feature (1)..( 9): Matrix.004 file - promoters50/2024873
tttgttttg

SEQ ID NO: 70733 - DNA, 5 bp, Unknown
  misc_feature (1)..( 5): Matrix.004 file - promoters50/2024930
aaata

SEQ ID NO: 70734 - DNA, 8 bp, Unknown
  misc_feature (1)..( 8): Matrix.004 file - promoters50/2024930
tattatag

SEQ ID NO: 70735 - DNA, 9 bp, Unknown
  misc_feature (1)..( 9): Matrix.004 file - promoters50/2024930
ataattttt

SEQ ID NO: 70736 - DNA, 8 bp, Unknown
  misc_feature (1)..( 8): Matrix.004 file - promoters50/2024930
ttgagtct

SEQ ID NO: 70737 - DNA, 9 bp, Unknown
  misc_feature (1)..( 9): Matrix.004 file - promoters50/2024930
gaatctagt

SEQ ID NO: 70738 - DNA, 9 bp, Unknown
  misc_feature (1)..( 9): Matrix.004 file - promoters50/2024930
tcaaaaaaa

SEQ ID NO: 70739 - DNA, 9 bp, Unknown
  misc_feature (1)..( 9): Matrix.004 file - promoters50/2025006
gtcaaaaaa

SEQ ID NO: 70740 - DNA, 12 bp, Unknown
  misc_feature (1)..( 12): Matrix.004 file - promoters50/2025006
caataaataaaa

SEQ ID NO: 70741 - DNA, 12 bp, Unknown
  misc_feature (1)..( 12): Matrix.004 file - promoters50/2025006
ataaaagaaaaa

SEQ ID NO: 70742 - DNA, 10 bp, Unknown
  misc_feature (1)..( 10): Matrix.004 file - promoters50/2025006
taataaattt

SEQ ID NO: 70743 - DNA, 10 bp, Unknown
  misc_feature (1)..( 10): Matrix.004 file - promoters50/2025006
caattttttt

SEQ ID NO: 70744 - DNA, 9 bp, Unknown
  misc_feature (1)..( 9): Matrix.004 file - promoters50/2025006
ataaacaat

SEQ ID NO: 70745 - DNA, 9 bp, Unknown
  misc_feature (1)..( 9): Matrix.004 file - promoters50/2025306
aaatttgaa

SEQ ID NO: 70746 - DNA, 3 bp, Unknown
  misc_feature (1)..( 3): Matrix.004 file - promoters50/2025306
aaa

SEQ ID NO: 70747 - DNA, 12 bp, Unknown
  misc_feature (1)..( 12): Matrix.004 file - promoters50/2025306
aagtaataaaac

SEQ ID NO: 70748 - DNA, 7 bp, Unknown
  misc_feature (1)..( 7): Matrix.004 file - promoters50/2025592
aaataag

SEQ ID NO: 70749 - DNA, 12 bp, Unknown
  misc_feature (1)..( 12): Matrix.004 file - promoters50/2025592
caattaatattc

SEQ ID NO: 70750 - DNA, 6 bp, Unknown
  misc_feature (1)..( 6): Matrix.004 file - promoters50/2025592
ttttgt

SEQ ID NO: 70751 - DNA, 9 bp, Unknown
  misc_feature (1)..( 9): Matrix.004 file - promoters50/2025592
acaaacaaa

SEQ ID NO: 70752 - DNA, 7 bp, Unknown
  misc_feature (1)..( 7): Matrix.004 file - promoters50/2025592
ccatttc

SEQ ID NO: 70753 - DNA, 9 bp, Unknown
  misc_feature (1)..( 9): Matrix.004 file - promoters50/2025627
tactatcat

SEQ ID NO: 70754 - DNA, 9 bp, Unknown
  misc_feature (1)..( 9): Matrix.004 file - promoters50/2025627
attttttta

SEQ ID NO: 70755 - DNA, 9 bp, Unknown
  misc_feature (1)..( 9): Matrix.004 file - promoters50/2025627
attaaaaaa

SEQ ID NO: 70756 - DNA, 10 bp, Unknown
  misc_feature (1)..( 10): Matrix.004 file - promoters50/2025627
taatattttt

SEQ ID NO: 70757 - DNA, 8 bp, Unknown
  misc_feature (1)..( 8): Matrix.004 file - promoters50/2026177
ttaaaact

SEQ ID NO: 70758 - DNA, 7 bp, Unknown
  misc_feature (1)..( 7): Matrix.004 file - promoters50/2026177
ttttata

SEQ ID NO: 70759 - DNA, 7 bp, Unknown
  misc_feature (1)..( 7): Matrix.004 file - promoters50/2026177
caaataa

SEQ ID NO: 70760 - DNA, 8 bp, Unknown
  misc_feature (1)..( 8): Matrix.004 file - promoters50/2026177
ttgttttg

SEQ ID NO: 70761 - DNA, 8 bp, Unknown
  misc_feature (1)..( 8): Matrix.004 file - promoters50/2026177
aaaatttc

SEQ ID NO: 70762 - DNA, 8 bp, Unknown
  misc_feature (1)..( 8): Matrix.004 file - promoters50/2026177
aaaatcaa

SEQ ID NO: 70763 - DNA, 7 bp, Unknown
  misc_feature (1)..( 7): Matrix.004 file - promoters50/2026721
ttcatct

SEQ ID NO: 70764 - DNA, 11 bp, Unknown
  misc_feature (1)..( 11): Matrix.004 file - promoters50/2026721
ctgcttttaga

SEQ ID NO: 70765 - DNA, 8 bp, Unknown
  misc_feature (1)..( 8): Matrix.004 file - promoters50/2026757
tttttaac

SEQ ID NO: 70766 - DNA, 10 bp, Unknown
  misc_feature (1)..( 10): Matrix.004 file - promoters50/2026757
aagaggattg

SEQ ID NO: 70767 - DNA, 8 bp, Unknown
  misc_feature (1)..( 8): Matrix.004 file - promoters50/2026771
aaaaagag

SEQ ID NO: 70768 - DNA, 12 bp, Unknown
  misc_feature (1)..( 12): Matrix.004 file - promoters50/2026771
taacattttata

SEQ ID NO: 70769 - DNA, 10 bp, Unknown
  misc_feature (1)..( 10): Matrix.004 file - promoters50/2027233
cgtttataaa

SEQ ID NO: 70770 - DNA, 9 bp, Unknown
  misc_feature (1)..( 9): Matrix.004 file - promoters50/2027242
agtttaagg

SEQ ID NO: 70771 - DNA, 7 bp, Unknown
  misc_feature (1)..( 7): Matrix.004 file - promoters50/2027242
gaatctt

SEQ ID NO: 70772 - DNA, 14 bp, Unknown
  misc_feature (1)..( 14): Matrix.004 file - promoters50/2027253
gaaatggtaaaaag

SEQ ID NO: 70773 - DNA, 8 bp, Unknown
  misc_feature (1)..( 8): Matrix.004 file - promoters50/2027253
tatttaaa

SEQ ID NO: 70774 - DNA, 16 bp, Unknown
  misc_feature (1)..( 16): Matrix.004 file - promoters50/2027268
aaaaataaaaacatta

SEQ ID NO: 70775 - DNA, 11 bp, Unknown
  misc_feature (1)..( 11): Matrix.004 file - promoters50/2028939
ttttgctaaaa

SEQ ID NO: 70776 - DNA, 9 bp, Unknown
  misc_feature (1)..( 9): Matrix.004 file - promoters50/2028939
catctcact

SEQ ID NO: 70777 - DNA, 7 bp, Unknown
  misc_feature (1)..( 7): Matrix.004 file - promoters50/2028939
cttttga

SEQ ID NO: 70778 - DNA, 8 bp, Unknown
  misc_feature (1)..( 8): Matrix.004 file - promoters50/2028939
tgttctat

SEQ ID NO: 70779 - DNA, 8 bp, Unknown
  misc_feature (1)..( 8): Matrix.004 file - promoters50/2028939
acactttt

SEQ ID NO: 70780 - DNA, 8 bp, Unknown
  misc_feature (1)..( 8): Matrix.004 file - promoters50/2028939
atctgtat

SEQ ID NO: 70781 - DNA, 6 bp, Unknown
  misc_feature (1)..( 6): Matrix.004 file - promoters50/2028939
agtttt

SEQ ID NO: 70782 - DNA, 8 bp, Unknown
  misc_feature (1)..( 8): Matrix.004 file - promoters50/2028939
tgtttcaa

SEQ ID NO: 70783 - DNA, 8 bp, Unknown
  misc_feature (1)..( 8): Matrix.004 file - promoters50/2028945
atgtgcta

SEQ ID NO: 70784 - DNA, 7 bp, Unknown
  misc_feature (1)..( 7): Matrix.004 file - promoters50/2028945
ttgaaat

SEQ ID NO: 70785 - DNA, 13 bp, Unknown
  misc_feature (1)..( 13): Matrix.004 file - promoters50/2028945
taaaaatttaaat

SEQ ID NO: 70786 - DNA, 9 bp, Unknown
  misc_feature (1)..( 9): Matrix.004 file - promoters50/2028945
cataaacta

SEQ ID NO: 70787 - DNA, 8 bp, Unknown
  misc_feature (1)..( 8): Matrix.004 file - promoters50/2028945
tttaattt

SEQ ID NO: 70788 - DNA, 7 bp, Unknown
  misc_feature (1)..( 7): Matrix.004 file - promoters50/2028945
ttttaaa

SEQ ID NO: 70789 - DNA, 8 bp, Unknown
  misc_feature (1)..( 8): Matrix.004 file - promoters50/2028945
atcttaat

SEQ ID NO: 70790 - DNA, 9 bp, Unknown
  misc_feature (1)..( 9): Matrix.004 file - promoters50/2028945
tttaattta

SEQ ID NO: 70791 - DNA, 8 bp, Unknown
  misc_feature (1)..( 8): Matrix.004 file - promoters50/2028948
aaacatta

SEQ ID NO: 70792 - DNA, 9 bp, Unknown
  misc_feature (1)..( 9): Matrix.004 file - promoters50/2028948
agtaaaaca

SEQ ID NO: 70793 - DNA, 6 bp, Unknown
  misc_feature (1)..( 6): Matrix.004 file - promoters50/2028948
cataat

SEQ ID NO: 70794 - DNA, 10 bp, Unknown
  misc_feature (1)..( 10): Matrix.004 file - promoters50/2028979
tttatacaaa

SEQ ID NO: 70795 - DNA, 9 bp, Unknown
  misc_feature (1)..( 9): Matrix.004 file - promoters50/2028979
attatataa

SEQ ID NO: 70796 - DNA, 8 bp, Unknown
  misc_feature (1)..( 8): Matrix.004 file - promoters50/2028979
ttaaaaaa

SEQ ID NO: 70797 - DNA, 8 bp, Unknown
  misc_feature (1)..( 8): Matrix.004 file - promoters50/2028993
aactaata

SEQ ID NO: 70798 - DNA, 9 bp, Unknown
  misc_feature (1)..( 9): Matrix.004 file - promoters50/2028993
cataaacca

SEQ ID NO: 70799 - DNA, 9 bp, Unknown
  misc_feature (1)..( 9): Matrix.004 file - promoters50/2028993
attaaccaa

SEQ ID NO: 70800 - DNA, 12 bp, Unknown
  misc_feature (1)..( 12): Matrix.004 file - promoters50/2028997
ttactaaaatta

SEQ ID NO: 70801 - DNA, 9 bp, Unknown
  misc_feature (1)..( 9): Matrix.004 file - promoters50/2028997
cttctatgt

SEQ ID NO: 70802 - DNA, 10 bp, Unknown
  misc_feature (1)..( 10): Matrix.004 file - promoters50/2028997
aactttaatt

SEQ ID NO: 70803 - DNA, 12 bp, Unknown
  misc_feature (1)..( 12): Matrix.004 file - promoters50/2029009
gcttaagttctt

SEQ ID NO: 70804 - DNA, 8 bp, Unknown
  misc_feature (1)..( 8): Matrix.004 file - promoters50/2029016
acttaaaa

SEQ ID NO: 70805 - DNA, 9 bp, Unknown
  misc_feature (1)..( 9): Matrix.004 file - promoters50/2029027
attaaatca

SEQ ID NO: 70806 - DNA, 8 bp, Unknown
  misc_feature (1)..( 8): Matrix.004 file - promoters50/2029027
ccccaatt

SEQ ID NO: 70807 - DNA, 10 bp, Unknown
  misc_feature (1)..( 10): Matrix.004 file - promoters50/2029033
aacatttttt

SEQ ID NO: 70808 - DNA, 13 bp, Unknown
  misc_feature (1)..( 13): Matrix.004 file - promoters50/2029033
atgatttatttcc

SEQ ID NO: 70809 - DNA, 10 bp, Unknown
  misc_feature (1)..( 10): Matrix.004 file - promoters50/2029033
ctttctataa

SEQ ID NO: 70810 - DNA, 8 bp, Unknown
  misc_feature (1)..( 8): Matrix.004 file - promoters50/2029033
aataaata

SEQ ID NO: 70811 - DNA, 9 bp, Unknown
  misc_feature (1)..( 9): Matrix.004 file - promoters50/2029041
catatataa

SEQ ID NO: 70812 - DNA, 10 bp, Unknown
  misc_feature (1)..( 10): Matrix.004 file - promoters50/2029041
gaaattacta

SEQ ID NO: 70813 - DNA, 10 bp, Unknown
  misc_feature (1)..( 10): Matrix.004 file - promoters50/2029041
aaataaccaa

SEQ ID NO: 70814 - DNA, 7 bp, Unknown
  misc_feature (1)..( 7): Matrix.004 file - promoters50/2029054
agttttg

SEQ ID NO: 70815 - DNA, 7 bp, Unknown
  misc_feature (1)..( 7): Matrix.004 file - promoters50/2029075
ataccaa

SEQ ID NO: 70816 - DNA, 6 bp, Unknown
  misc_feature (1)..( 6): Matrix.004 file - promoters50/2029083
aaataa

SEQ ID NO: 70817 - DNA, 10 bp, Unknown
  misc_feature (1)..( 10): Matrix.004 file - promoters50/2029087
ataattgtaa

SEQ ID NO: 70818 - DNA, 10 bp, Unknown
  misc_feature (1)..( 10): Matrix.004 file - promoters50/2029087
gaaaaagttt

SEQ ID NO: 70819 - DNA, 15 bp, Unknown
  misc_feature (1)..( 15): Matrix.004 file - promoters50/2029087
atcactgatccaaca

SEQ ID NO: 70820 - DNA, 7 bp, Unknown
  misc_feature (1)..( 7): Matrix.004 file - promoters50/2033137
aattatc

SEQ ID NO: 70821 - DNA, 10 bp, Unknown
  misc_feature (1)..( 10): Matrix.004 file - promoters50/2033137
aataagttaa

SEQ ID NO: 70822 - DNA, 10 bp, Unknown
  misc_feature (1)..( 10): Matrix.004 file - promoters50/2052918
agatatatta

SEQ ID NO: 70823 - DNA, 6 bp, Unknown
  misc_feature (1)..( 6): Matrix.004 file - promoters50/2056926
aacttt

SEQ ID NO: 70824 - DNA, 10 bp, Unknown
  misc_feature (1)..( 10): Matrix.004 file - promoters50/2104855
agtaaataaa

SEQ ID NO: 70825 - DNA, 8 bp, Unknown
  misc_feature (1)..( 8): Matrix.004 file - promoters50/2104855
aatataat

SEQ ID NO: 70826 - DNA, 7 bp, Unknown
  misc_feature (1)..( 7): Matrix.004 file - promoters50/2104855
aatataa

SEQ ID NO: 70827 - DNA, 7 bp, Unknown
  misc_feature (1)..( 7): Matrix.004 file - promoters50/2104855
ctaaaag

SEQ ID NO: 70828 - DNA, 9 bp, Unknown
  misc_feature (1)..( 9): Matrix.004 file - promoters50/2104855
attcttttc

SEQ ID NO: 70829 - DNA, 9 bp, Unknown
  misc_feature (1)..( 9): Matrix.004 file - promoters50/2104855
ttctacaat

SEQ ID NO: 70830 - DNA, 8 bp, Unknown
  misc_feature (1)..( 8): Matrix.004 file - promoters50/2104855
ataattat

SEQ ID NO: 70831 - DNA, 9 bp, Unknown
  misc_feature (1)..( 9): Matrix.004 file - promoters50/2104855
cgccatgaa

SEQ ID NO: 70832 - DNA, 9 bp, Unknown
  misc_feature (1)..( 9): Matrix.004 file - promoters50/2104874
aggcccaat

SEQ ID NO: 70833 - DNA, 9 bp, Unknown
  misc_feature (1)..( 9): Matrix.004 file - promoters50/2104874
caaaaatta

SEQ ID NO: 70834 - DNA, 13 bp, Unknown
  misc_feature (1)..( 13): Matrix.004 file - promoters50/2105109
tttattggatcta

SEQ ID NO: 70835 - DNA, 10 bp, Unknown
  misc_feature (1)..( 10): Matrix.004 file - promoters50/2105109
ctataaaaac

SEQ ID NO: 70836 - DNA, 9 bp, Unknown
  misc_feature (1)..( 9): Matrix.004 file - promoters50/2105141
cctaaggcc

SEQ ID NO: 70837 - DNA, 8 bp, Unknown
  misc_feature (1)..( 8): Matrix.004 file - promoters50/2105141
gtgctaaa

SEQ ID NO: 70838 - DNA, 10 bp, Unknown
  misc_feature (1)..( 10): Matrix.004 file - promoters50/2105141
aaatcaaatt

SEQ ID NO: 70839 - DNA, 7 bp, Unknown
  misc_feature (1)..( 7): Matrix.004 file - promoters50/2105141
tttttat

SEQ ID NO: 70840 - DNA, 9 bp, Unknown
  misc_feature (1)..( 9): Matrix.004 file - promoters50/2105141
catatttta

SEQ ID NO: 70841 - DNA, 7 bp, Unknown
  misc_feature (1)..( 7): Matrix.004 file - promoters50/2105141
taaataa

SEQ ID NO: 70842 - DNA, 8 bp, Unknown
  misc_feature (1)..( 8): Matrix.004 file - promoters50/2105141
ttttcaat

SEQ ID NO: 70843 - DNA, 11 bp, Unknown
  misc_feature (1)..( 11): Matrix.004 file - promoters50/2105141
cacaaatcatt

SEQ ID NO: 70844 - DNA, 10 bp, Unknown
  misc_feature (1)..( 10): Matrix.004 file - promoters50/2105141
aaaaaaaccc

SEQ ID NO: 70845 - DNA, 14 bp, Unknown
  misc_feature (1)..( 14): Matrix.004 file - promoters50/2105141
atatttataaagta

SEQ ID NO: 70846 - DNA, 10 bp, Unknown
  misc_feature (1)..( 10): Matrix.004 file - promoters50/2105141
ataatatata

SEQ ID NO: 70847 - DNA, 9 bp, Unknown
  misc_feature (1)..( 9): Matrix.004 file - promoters50/2105141
acaatttat

SEQ ID NO: 70848 - DNA, 7 bp, Unknown
  misc_feature (1)..( 7): Matrix.004 file - promoters50/2105141
ttattta

SEQ ID NO: 70849 - DNA, 7 bp, Unknown
  misc_feature (1)..( 7): Matrix.004 file - promoters50/2105250
tttttta

SEQ ID NO: 70850 - DNA, 7 bp, Unknown
  misc_feature (1)..( 7): Matrix.004 file - promoters50/2105394
agtttat

SEQ ID NO: 70851 - DNA, 9 bp, Unknown
  misc_feature (1)..( 9): Matrix.004 file - promoters50/2105398
attattcaa

SEQ ID NO: 70852 - DNA, 9 bp, Unknown
  misc_feature (1)..( 9): Matrix.004 file - promoters50/2105398
taaaaaata

SEQ ID NO: 70853 - DNA, 10 bp, Unknown
  misc_feature (1)..( 10): Matrix.004 file - promoters50/2105398
aaaatgaaac

SEQ ID NO: 70854 - DNA, 10 bp, Unknown
  misc_feature (1)..( 10): Matrix.004 file - promoters50/2105398
aaaacaaact

SEQ ID NO: 70855 - DNA, 13 bp, Unknown
  misc_feature (1)..( 13): Matrix.004 file - promoters50/2105398
agaaaaaaaaatt

SEQ ID NO: 70856 - DNA, 10 bp, Unknown
  misc_feature (1)..( 10): Matrix.004 file - promoters50/2105507
caaaaataaa

SEQ ID NO: 70857 - DNA, 11 bp, Unknown
  misc_feature (1)..( 11): Matrix.004 file - promoters50/2105533
aagagaatttg

SEQ ID NO: 70858 - DNA, 8 bp, Unknown
  misc_feature (1)..( 8): Matrix.004 file - promoters50/2105533
tttggaaa

SEQ ID NO: 70859 - DNA, 9 bp, Unknown
  misc_feature (1)..( 9): Matrix.004 file - promoters50/2105533
aagaagtta

SEQ ID NO: 70860 - DNA, 7 bp, Unknown
  misc_feature (1)..( 7): Matrix.004 file - promoters50/2105535
gattaaa

SEQ ID NO: 70861 - DNA, 11 bp, Unknown
  misc_feature (1)..( 11): Matrix.004 file - promoters50/2105578
gattcaaaatt

SEQ ID NO: 70862 - DNA, 10 bp, Unknown
  misc_feature (1)..( 10): Matrix.004 file - promoters50/2105578
agttagtata

SEQ ID NO: 70863 - DNA, 9 bp, Unknown
  misc_feature (1)..( 9): Matrix.004 file - promoters50/2105578
ttattttct

SEQ ID NO: 70864 - DNA, 7 bp, Unknown
  misc_feature (1)..( 7): Matrix.004 file - promoters50/2105578
attgtat

SEQ ID NO: 70865 - DNA, 10 bp, Unknown
  misc_feature (1)..( 10): Matrix.004 file - promoters50/2105819
ttctcaatcc

SEQ ID NO: 70866 - DNA, 7 bp, Unknown
  misc_feature (1)..( 7): Matrix.004 file - promoters50/2105819
aacatat

SEQ ID NO: 70867 - DNA, 8 bp, Unknown
  misc_feature (1)..( 8): Matrix.004 file - promoters50/2105819
ttaatgat

SEQ ID NO: 70868 - DNA, 10 bp, Unknown
  misc_feature (1)..( 10): Matrix.004 file - promoters50/2105912
aaatgtcaaa

SEQ ID NO: 70869 - DNA, 8 bp, Unknown
  misc_feature (1)..( 8): Matrix.004 file - promoters50/2105912
atttgtta

SEQ ID NO: 70870 - DNA, 11 bp, Unknown
  misc_feature (1)..( 11): Matrix.004 file - promoters50/2106017
aagttaaaagt

SEQ ID NO: 70871 - DNA, 9 bp, Unknown
  misc_feature (1)..( 9): Matrix.004 file - promoters50/2106017
gttcaaatc

SEQ ID NO: 70872 - DNA, 11 bp, Unknown
  misc_feature (1)..( 11): Matrix.004 file - promoters50/2106017
taataaattaa

SEQ ID NO: 70873 - DNA, 11 bp, Unknown
  misc_feature (1)..( 11): Matrix.004 file - promoters50/2106109
gtttgaaatct

SEQ ID NO: 70874 - DNA, 8 bp, Unknown
  misc_feature (1)..( 8): Matrix.004 file - promoters50/2106109
aaatggtt

SEQ ID NO: 70875 - DNA, 8 bp, Unknown
  misc_feature (1)..( 8): Matrix.004 file - promoters50/2106505
attttttt

SEQ ID NO: 70876 - DNA, 9 bp, Unknown
  misc_feature (1)..( 9): Matrix.004 file - promoters50/2106682
aattaattt

SEQ ID NO: 70877 - DNA, 7 bp, Unknown
  misc_feature (1)..( 7): Matrix.004 file - promoters50/2106682
tgtttcg

SEQ ID NO: 70878 - DNA, 7 bp, Unknown
  misc_feature (1)..( 7): Matrix.004 file - promoters50/2106758
attttga

SEQ ID NO: 70879 - DNA, 9 bp, Unknown
  misc_feature (1)..( 9): Matrix.004 file - promoters50/2106789
caaatgaaa

SEQ ID NO: 70880 - DNA, 10 bp, Unknown
  misc_feature (1)..( 10): Matrix.004 file - promoters50/2106908
atttataaag

SEQ ID NO: 70881 - DNA, 10 bp, Unknown
  misc_feature (1)..( 10): Matrix.004 file - promoters50/2106908
agatttttcc

SEQ ID NO: 70882 - DNA, 14 bp, Unknown
  misc_feature (1)..( 14): Matrix.004 file - promoters50/2106908
ataagcctaaacaa

SEQ ID NO: 70883 - DNA, 7 bp, Unknown
  misc_feature (1)..( 7): Matrix.004 file - promoters50/2106908
aaataaa

SEQ ID NO: 70884 - DNA, 10 bp, Unknown
  misc_feature (1)..( 10): Matrix.004 file - promoters50/2106908
aaagaaattg

SEQ ID NO: 70885 - DNA, 9 bp, Unknown
  misc_feature (1)..( 9): Matrix.004 file - promoters50/2106908
atcaaaacc

SEQ ID NO: 70886 - DNA, 7 bp, Unknown
  misc_feature (1)..( 7): Matrix.004 file - promoters50/2106908
aaacaaa

SEQ ID NO: 70887 - DNA, 9 bp, Unknown
  misc_feature (1)..( 9): Matrix.004 file - promoters50/2106908
tatctaaat

SEQ ID NO: 70888 - DNA, 8 bp, Unknown
  misc_feature (1)..( 8): Matrix.004 file - promoters50/2107016
aaaaaaaa

SEQ ID NO: 70889 - DNA, 9 bp, Unknown
  misc_feature (1)..( 9): Matrix.004 file - promoters50/2107016
ctttttatt

SEQ ID NO: 70890 - DNA, 9 bp, Unknown
  misc_feature (1)..( 9): Matrix.004 file - promoters50/2107065
gtcaaaaaa

SEQ ID NO: 70891 - DNA, 13 bp, Unknown
  misc_feature (1)..( 13): Matrix.004 file - promoters50/2107065
tattcaaataaaa

SEQ ID NO: 70892 - DNA, 10 bp, Unknown
  misc_feature (1)..( 10): Matrix.004 file - promoters50/2107069
aaataattta

SEQ ID NO: 70893 - DNA, 8 bp, Unknown
  misc_feature (1)..( 8): Matrix.004 file - promoters50/2107069
gttggaga

SEQ ID NO: 70894 - DNA, 7 bp, Unknown
  misc_feature (1)..( 7): Matrix.004 file - promoters50/2107069
atgttgg

SEQ ID NO: 70895 - DNA, 12 bp, Unknown
  misc_feature (1)..( 12): Matrix.004 file - promoters50/2108834
gtgatttagttt

SEQ ID NO: 70896 - DNA, 9 bp, Unknown
  misc_feature (1)..( 9): Matrix.004 file - promoters50/2108834
aatgaaaaa

SEQ ID NO: 70897 - DNA, 8 bp, Unknown
  misc_feature (1)..( 8): Matrix.004 file - promoters50/2109486
tttcgtgg

SEQ ID NO: 70898 - DNA, 8 bp, Unknown
  misc_feature (1)..( 8): Matrix.004 file - promoters50/2109486
tgaaagat

SEQ ID NO: 70899 - DNA, 8 bp, Unknown
  misc_feature (1)..( 8): Matrix.004 file - promoters50/2109486
gattattt

SEQ ID NO: 70900 - DNA, 7 bp, Unknown
  misc_feature (1)..( 7): Matrix.004 file - promoters50/2113269
catatta

SEQ ID NO: 70901 - DNA, 9 bp, Unknown
  misc_feature (1)..( 9): Matrix.004 file - promoters50/2113269
agtttgata

SEQ ID NO: 70902 - DNA, 7 bp, Unknown
  misc_feature (1)..( 7): Matrix.004 file - promoters50/2113269
ttctata

SEQ ID NO: 70903 - DNA, 12 bp, Unknown
  misc_feature (1)..( 12): Matrix.004 file - promoters50/2113269
ataattttttaa

SEQ ID NO: 70904 - DNA, 18 bp, Unknown
  misc_feature (1)..( 18): Matrix.004 file - promoters50/2113269
atagtaaaaaaaaattag

SEQ ID NO: 70905 - DNA, 12 bp, Unknown
  misc_feature (1)..( 12): Matrix.004 file - promoters50/2113269
aaactttttttt

SEQ ID NO: 70906 - DNA, 13 bp, Unknown
  misc_feature (1)..( 13): Matrix.004 file - promoters50/2113269
ttattataaaaaa

SEQ ID NO: 70907 - DNA, 13 bp, Unknown
  misc_feature (1)..( 13): Matrix.004 file - promoters50/2113269
aaactttttttaa

SEQ ID NO: 70908 - DNA, 10 bp, Unknown
  misc_feature (1)..( 10): Matrix.004 file - promoters50/2113269
actttttaaa

SEQ ID NO: 70909 - DNA, 10 bp, Unknown
  misc_feature (1)..( 10): Matrix.004 file - promoters50/2113269
tataaaaaaa

SEQ ID NO: 70910 - DNA, 9 bp, Unknown
  misc_feature (1)..( 9): Matrix.004 file - promoters50/2113299
tttttaaaa

SEQ ID NO: 70911 - DNA, 7 bp, Unknown
  misc_feature (1)..( 7): Matrix.004 file - promoters50/2113299
catattt

SEQ ID NO: 70912 - DNA, 12 bp, Unknown
  misc_feature (1)..( 12): Matrix.004 file - promoters50/2113299
gtctttataaat

SEQ ID NO: 70913 - DNA, 12 bp, Unknown
  misc_feature (1)..( 12): Matrix.004 file - promoters50/2113315
aacaaaaataat

SEQ ID NO: 70914 - DNA, 9 bp, Unknown
  misc_feature (1)..( 9): Matrix.004 file - promoters50/2113323
taaaataat

SEQ ID NO: 70915 - DNA, 9 bp, Unknown
  misc_feature (1)..( 9): Matrix.004 file - promoters50/2113323
caaatattt

SEQ ID NO: 70916 - DNA, 10 bp, Unknown
  misc_feature (1)..( 10): Matrix.004 file - promoters50/2113323
gattgtttaa

SEQ ID NO: 70917 - DNA, 9 bp, Unknown
  misc_feature (1)..( 9): Matrix.004 file - promoters50/2113323
caaatattt

SEQ ID NO: 70918 - DNA, 7 bp, Unknown
  misc_feature (1)..( 7): Matrix.004 file - promoters50/2113323
atatata

SEQ ID NO: 70919 - DNA, 14 bp, Unknown
  misc_feature (1)..( 14): Matrix.004 file - promoters50/2113323
ctcatataaataca

SEQ ID NO: 70920 - DNA, 9 bp, Unknown
  misc_feature (1)..( 9): Matrix.004 file - promoters50/2113338
gtaaatact

SEQ ID NO: 70921 - DNA, 9 bp, Unknown
  misc_feature (1)..( 9): Matrix.004 file - promoters50/2113338
caaacactt

SEQ ID NO: 70922 - DNA, 7 bp, Unknown
  misc_feature (1)..( 7): Matrix.004 file - promoters50/2113418
gaatcaa

SEQ ID NO: 70923 - DNA, 12 bp, Unknown
  misc_feature (1)..( 12): Matrix.004 file - promoters50/2113418
aacatgtactga

SEQ ID NO: 70924 - DNA, 7 bp, Unknown
  misc_feature (1)..( 7): Matrix.004 file - promoters50/2113434
ggaaaaa

SEQ ID NO: 70925 - DNA, 13 bp, Unknown
  misc_feature (1)..( 13): Matrix.004 file - promoters50/2113434
agagcttgaggaa

SEQ ID NO: 70926 - DNA, 9 bp, Unknown
  misc_feature (1)..( 9): Matrix.004 file - promoters50/2113434
gagcttgag

SEQ ID NO: 70927 - DNA, 8 bp, Unknown
  misc_feature (1)..( 8): Matrix.004 file - promoters50/2113445
tctaaaaa

SEQ ID NO: 70928 - DNA, 10 bp, Unknown
  misc_feature (1)..( 10): Matrix.004 file - promoters50/2113445
ctattgaata

SEQ ID NO: 70929 - DNA, 8 bp, Unknown
  misc_feature (1)..( 8): Matrix.004 file - promoters50/2113445
aagattta

SEQ ID NO: 70930 - DNA, 7 bp, Unknown
  misc_feature (1)..( 7): Matrix.004 file - promoters50/2113445
tactttg

SEQ ID NO: 70931 - DNA, 8 bp, Unknown
  misc_feature (1)..( 8): Matrix.004 file - promoters50/2113445
aacataaa

SEQ ID NO: 70932 - DNA, 10 bp, Unknown
  misc_feature (1)..( 10): Matrix.004 file - promoters50/2113462
ttattattat

SEQ ID NO: 70933 - DNA, 7 bp, Unknown
  misc_feature (1)..( 7): Matrix.004 file - promoters50/2113462
aaaatta

SEQ ID NO: 70934 - DNA, 12 bp, Unknown
  misc_feature (1)..( 12): Matrix.004 file - promoters50/2113462
aaacttaattta

SEQ ID NO: 70935 - DNA, 14 bp, Unknown
  misc_feature (1)..( 14): Matrix.004 file - promoters50/2113462
ttttaaaaaaagat

SEQ ID NO: 70936 - DNA, 9 bp, Unknown
  misc_feature (1)..( 9): Matrix.004 file - promoters50/2113462
aattaaatt

SEQ ID NO: 70937 - DNA, 9 bp, Unknown
  misc_feature (1)..( 9): Matrix.004 file - promoters50/2113462
aacaaatta

SEQ ID NO: 70938 - DNA, 13 bp, Unknown
  misc_feature (1)..( 13): Matrix.004 file - promoters50/2113466
attctcataaaca

SEQ ID NO: 70939 - DNA, 9 bp, Unknown
  misc_feature (1)..( 9): Matrix.004 file - promoters50/2113466
ataatatat

SEQ ID NO: 70940 - DNA, 10 bp, Unknown
  misc_feature (1)..( 10): Matrix.004 file - promoters50/2113466
gattcatgat

SEQ ID NO: 70941 - DNA, 13 bp, Unknown
  misc_feature (1)..( 13): Matrix.004 file - promoters50/2113466
ccttgtaacaaca

SEQ ID NO: 70942 - DNA, 10 bp, Unknown
  misc_feature (1)..( 10): Matrix.004 file - promoters50/2113470
aaataacaat

SEQ ID NO: 70943 - DNA, 8 bp, Unknown
  misc_feature (1)..( 8): Matrix.004 file - promoters50/2113470
tattttaa

SEQ ID NO: 70944 - DNA, 11 bp, Unknown
  misc_feature (1)..( 11): Matrix.004 file - promoters50/2113470
ttatatattta

SEQ ID NO: 70945 - DNA, 7 bp, Unknown
  misc_feature (1)..( 7): Matrix.004 file - promoters50/2113470
tttatct

SEQ ID NO: 70946 - DNA, 11 bp, Unknown
  misc_feature (1)..( 11): Matrix.004 file - promoters50/2113470
atcaaaagaat

SEQ ID NO: 70947 - DNA, 9 bp, Unknown
  misc_feature (1)..( 9): Matrix.004 file - promoters50/2113470
tcactaaac

SEQ ID NO: 70948 - DNA, 8 bp, Unknown
  misc_feature (1)..( 8): Matrix.004 file - promoters50/2113477
aaaattat

SEQ ID NO: 70949 - DNA, 10 bp, Unknown
  misc_feature (1)..( 10): Matrix.004 file - promoters50/2113477
aaagttaaaa

SEQ ID NO: 70950 - DNA, 8 bp, Unknown
  misc_feature (1)..( 8): Matrix.004 file - promoters50/2113477
tatttaaa

SEQ ID NO: 70951 - DNA, 6 bp, Unknown
  misc_feature (1)..( 6): Matrix.004 file - promoters50/2113477
aataat

SEQ ID NO: 70952 - DNA, 10 bp, Unknown
  misc_feature (1)..( 10): Matrix.004 file - promoters50/2113477
ataaatataa

SEQ ID NO: 70953 - DNA, 7 bp, Unknown
  misc_feature (1)..( 7): Matrix.004 file - promoters50/2113481
gataaac

SEQ ID NO: 70954 - DNA, 16 bp, Unknown
  misc_feature (1)..( 16): Matrix.004 file - promoters50/2113481
tacaaaaataaacttg

SEQ ID NO: 70955 - DNA, 12 bp, Unknown
  misc_feature (1)..( 12): Matrix.004 file - promoters50/2113481
ttaaataacata

SEQ ID NO: 70956 - DNA, 11 bp, Unknown
  misc_feature (1)..( 11): Matrix.004 file - promoters50/2113481
taaattttatt

SEQ ID NO: 70957 - DNA, 11 bp, Unknown
  misc_feature (1)..( 11): Matrix.004 file - promoters50/2113481
tataaatagat

SEQ ID NO: 70958 - DNA, 12 bp, Unknown
  misc_feature (1)..( 12): Matrix.004 file - promoters50/2113481
attagttaatat

SEQ ID NO: 70959 - DNA, 5 bp, Unknown
  misc_feature (1)..( 5): Matrix.004 file - promoters50/2113489
ataag

SEQ ID NO: 70960 - DNA, 9 bp, Unknown
  misc_feature (1)..( 9): Matrix.004 file - promoters50/2113489
tacaatttt

SEQ ID NO: 70961 - DNA, 10 bp, Unknown
  misc_feature (1)..( 10): Matrix.004 file - promoters50/2113489
tttaatttta

SEQ ID NO: 70962 - DNA, 9 bp, Unknown
  misc_feature (1)..( 9): Matrix.004 file - promoters50/2113489
tggcagaaa

SEQ ID NO: 70963 - DNA, 8 bp, Unknown
  misc_feature (1)..( 8): Matrix.004 file - promoters50/2113502
aattacta

SEQ ID NO: 70964 - DNA, 11 bp, Unknown
  misc_feature (1)..( 11): Matrix.004 file - promoters50/2113502
atgtcaaaaat

SEQ ID NO: 70965 - DNA, 11 bp, Unknown
  misc_feature (1)..( 11): Matrix.004 file - promoters50/2113502
caacaaaataa

SEQ ID NO: 70966 - DNA, 10 bp, Unknown
  misc_feature (1)..( 10): Matrix.004 file - promoters50/2113592
actataaatc

SEQ ID NO: 70967 - DNA, 11 bp, Unknown
  misc_feature (1)..( 11): Matrix.004 file - promoters50/2113592
tatatagatta

SEQ ID NO: 70968 - DNA, 11 bp, Unknown
  misc_feature (1)..( 11): Matrix.004 file - promoters50/2113592
tataaataata

SEQ ID NO: 70969 - DNA, 10 bp, Unknown
  misc_feature (1)..( 10): Matrix.004 file - promoters50/2113596
tataaataac

SEQ ID NO: 70970 - DNA, 17 bp, Unknown
  misc_feature (1)..( 17): Matrix.004 file - promoters50/2113596
caactactctatcaatt

SEQ ID NO: 70971 - DNA, 36 bp, Unknown
  misc_feature (1)..( 36): Matrix.004 file - promoters50/2113596
tttactctataaattatttccgcaaactcaaattat

SEQ ID NO: 70972 - DNA, 7 bp, Unknown
  misc_feature (1)..( 7): Matrix.004 file - promoters50/2113596
tcaaaat

SEQ ID NO: 70973 - DNA, 8 bp, Unknown
  misc_feature (1)..( 8): Matrix.004 file - promoters50/2113620
aacaacaa

SEQ ID NO: 70974 - DNA, 8 bp, Unknown
  misc_feature (1)..( 8): Matrix.004 file - promoters50/2113624
gaaggaag

SEQ ID NO: 70975 - DNA, 9 bp, Unknown
  misc_feature (1)..( 9): Matrix.004 file - promoters50/2113640
ttcattttt

SEQ ID NO: 70976 - DNA, 9 bp, Unknown
  misc_feature (1)..( 9): Matrix.004 file - promoters50/2113640
taaaaaaat

SEQ ID NO: 70977 - DNA, 10 bp, Unknown
  misc_feature (1)..( 10): Matrix.004 file - promoters50/2113640
atataaacaa

SEQ ID NO: 70978 - DNA, 7 bp, Unknown
  misc_feature (1)..( 7): Matrix.004 file - promoters50/2113675
caaaatt

SEQ ID NO: 70979 - DNA, 8 bp, Unknown
  misc_feature (1)..( 8): Matrix.004 file - promoters50/2113675
gaagaaat

SEQ ID NO: 70980 - DNA, 8 bp, Unknown
  misc_feature (1)..( 8): Matrix.004 file - promoters50/2113675
gtggagaa

SEQ ID NO: 70981 - DNA, 9 bp, Unknown
  misc_feature (1)..( 9): Matrix.004 file - promoters50/2113675
gtagagaac

SEQ ID NO: 70982 - DNA, 8 bp, Unknown
  misc_feature (1)..( 8): Matrix.004 file - promoters50/2113695
ttaaaatc

SEQ ID NO: 70983 - DNA, 8 bp, Unknown
  misc_feature (1)..( 8): Matrix.004 file - promoters50/2113695
gaaaaaaa

SEQ ID NO: 70984 - DNA, 8 bp, Unknown
  misc_feature (1)..( 8): Matrix.004 file - promoters50/2113695
gttaaaaa

SEQ ID NO: 70985 - DNA, 9 bp, Unknown
  misc_feature (1)..( 9): Matrix.004 file - promoters50/2113695
ttttcattt

SEQ ID NO: 70986 - DNA, 9 bp, Unknown
  misc_feature (1)..( 9): Matrix.004 file - promoters50/2113695
atttaattc

SEQ ID NO: 70987 - DNA, 12 bp, Unknown
  misc_feature (1)..( 12): Matrix.004 file - promoters50/2113695
aacatgttttta

SEQ ID NO: 70988 - DNA, 9 bp, Unknown
  misc_feature (1)..( 9): Matrix.004 file - promoters50/2113695
tgttttaaa

SEQ ID NO: 70989 - DNA, 7 bp, Unknown
  misc_feature (1)..( 7): Matrix.004 file - promoters50/2113695
cgaaaaa

SEQ ID NO: 70990 - DNA, 7 bp, Unknown
  misc_feature (1)..( 7): Matrix.004 file - promoters50/2113695
acataag

SEQ ID NO: 70991 - DNA, 10 bp, Unknown
  misc_feature (1)..( 10): Matrix.004 file - promoters50/2113734
tttttcttaa

SEQ ID NO: 70992 - DNA, 9 bp, Unknown
  misc_feature (1)..( 9): Matrix.004 file - promoters50/2113734
aaagtttaa

SEQ ID NO: 70993 - DNA, 9 bp, Unknown
  misc_feature (1)..( 9): Matrix.004 file - promoters50/2113748
aattaaaga

SEQ ID NO: 70994 - DNA, 8 bp, Unknown
  misc_feature (1)..( 8): Matrix.004 file - promoters50/2113748
tatttttt

SEQ ID NO: 70995 - DNA, 10 bp, Unknown
  misc_feature (1)..( 10): Matrix.004 file - promoters50/2113748
tattttactg

SEQ ID NO: 70996 - DNA, 8 bp, Unknown
  misc_feature (1)..( 8): Matrix.004 file - promoters50/2113748
caaatttc

SEQ ID NO: 70997 - DNA, 9 bp, Unknown
  misc_feature (1)..( 9): Matrix.004 file - promoters50/2113772
actcaaaaa

SEQ ID NO: 70998 - DNA, 9 bp, Unknown
  misc_feature (1)..( 9): Matrix.004 file - promoters50/2113817
ttcaaaact

SEQ ID NO: 70999 - DNA, 9 bp, Unknown
  misc_feature (1)..( 9): Matrix.004 file - promoters50/2113817
gaaataaat

SEQ ID NO: 71000 - DNA, 7 bp, Unknown
  misc_feature (1)..( 7): Matrix.004 file - promoters50/2113817
acgttat

SEQ ID NO: 71001 - DNA, 7 bp, Unknown
  misc_feature (1)..( 7): Matrix.004 file - promoters50/2113817
aaaataa

SEQ ID NO: 71002 - DNA, 7 bp, Unknown
  misc_feature (1)..( 7): Matrix.004 file - promoters50/2113839
aaattga

SEQ ID NO: 71003 - DNA, 9 bp, Unknown
  misc_feature (1)..( 9): Matrix.004 file - promoters50/2113839
attaataaa

SEQ ID NO: 71004 - DNA, 10 bp, Unknown
  misc_feature (1)..( 10): Matrix.004 file - promoters50/2113839
aaataacaaa

SEQ ID NO: 71005 - DNA, 9 bp, Unknown
  misc_feature (1)..( 9): Matrix.004 file - promoters50/2113839
aaatatatt

SEQ ID NO: 71006 - DNA, 11 bp, Unknown
  misc_feature (1)..( 11): Matrix.004 file - promoters50/2113842
ataaaaaaata

SEQ ID NO: 71007 - DNA, 7 bp, Unknown
  misc_feature (1)..( 7): Matrix.004 file - promoters50/2113842
ttgtcaa

SEQ ID NO: 71008 - DNA, 7 bp, Unknown
  misc_feature (1)..( 7): Matrix.004 file - promoters50/2113842
aaaataa

SEQ ID NO: 71009 - DNA, 8 bp, Unknown
  misc_feature (1)..( 8): Matrix.004 file - promoters50/2113846
atatatat

SEQ ID NO: 71010 - DNA, 11 bp, Unknown
  misc_feature (1)..( 11): Matrix.004 file - promoters50/2113846
attataattta

SEQ ID NO: 71011 - DNA, 9 bp, Unknown
  misc_feature (1)..( 9): Matrix.004 file - promoters50/2113846
aatttaacg

SEQ ID NO: 71012 - DNA, 11 bp, Unknown
  misc_feature (1)..( 11): Matrix.004 file - promoters50/2113846
taaaattattt

SEQ ID NO: 71013 - DNA, 8 bp, Unknown
  misc_feature (1)..( 8): Matrix.004 file - promoters50/2113889
attagatc

SEQ ID NO: 71014 - DNA, 11 bp, Unknown
  misc_feature (1)..( 11): Matrix.004 file - promoters50/2113889
aatataatctg

SEQ ID NO: 71015 - DNA, 12 bp, Unknown
  misc_feature (1)..( 12): Matrix.004 file - promoters50/2113889
attaactttgat

SEQ ID NO: 71016 - DNA, 13 bp, Unknown
  misc_feature (1)..( 13): Matrix.004 file - promoters50/2113889
gataaattacaaa

SEQ ID NO: 71017 - DNA, 10 bp, Unknown
  misc_feature (1)..( 10): Matrix.004 file - promoters50/2113889
tttaactaaa

SEQ ID NO: 71018 - DNA, 13 bp, Unknown
  misc_feature (1)..( 13): Matrix.004 file - promoters50/2113889
aaagaatataaat

SEQ ID NO: 71019 - DNA, 9 bp, Unknown
  misc_feature (1)..( 9): Matrix.004 file - promoters50/2113889
aaaacaaaa

SEQ ID NO: 71020 - DNA, 10 bp, Unknown
  misc_feature (1)..( 10): Matrix.004 file - promoters50/2113889
ataaaaattg

SEQ ID NO: 71021 - DNA, 8 bp, Unknown
  misc_feature (1)..( 8): Matrix.004 file - promoters50/2113889
tataaatt

SEQ ID NO: 71022 - DNA, 10 bp, Unknown
  misc_feature (1)..( 10): Matrix.004 file - promoters50/2113914
aaataataaa

SEQ ID NO: 71023 - DNA, 9 bp, Unknown
  misc_feature (1)..( 9): Matrix.004 file - promoters50/2113914
taatttaat

SEQ ID NO: 71024 - DNA, 8 bp, Unknown
  misc_feature (1)..( 8): Matrix.004 file - promoters50/2113928
aaacaaaa

SEQ ID NO: 71025 - DNA, 16 bp, Unknown
  misc_feature (1)..( 16): Matrix.004 file - promoters50/2113928
aaaaattattaaatta

SEQ ID NO: 71026 - DNA, 9 bp, Unknown
  misc_feature (1)..( 9): Matrix.004 file - promoters50/2113928
aaaacaaaa

SEQ ID NO: 71027 - DNA, 10 bp, Unknown
  misc_feature (1)..( 10): Matrix.004 file - promoters50/2113928
ctataaatat

SEQ ID NO: 71028 - DNA, 14 bp, Unknown
  misc_feature (1)..( 14): Matrix.004 file - promoters50/2113928
ttattaaagtataa

SEQ ID NO: 71029 - DNA, 11 bp, Unknown
  misc_feature (1)..( 11): Matrix.004 file - promoters50/2113928
ccacttaactt

SEQ ID NO: 71030 - DNA, 8 bp, Unknown
  misc_feature (1)..( 8): Matrix.004 file - promoters50/2113928
taagttta

SEQ ID NO: 71031 - DNA, 10 bp, Unknown
  misc_feature (1)..( 10): Matrix.004 file - promoters50/2113967
aaaataaaaa

SEQ ID NO: 71032 - DNA, 10 bp, Unknown
  misc_feature (1)..( 10): Matrix.004 file - promoters50/2113967
ttattttata

SEQ ID NO: 71033 - DNA, 13 bp, Unknown
  misc_feature (1)..( 13): Matrix.004 file - promoters50/2114005
aaacctattttaa

SEQ ID NO: 71034 - DNA, 11 bp, Unknown
  misc_feature (1)..( 11): Matrix.004 file - promoters50/2114005
aaaattttata

SEQ ID NO: 71035 - DNA, 10 bp, Unknown
  misc_feature (1)..( 10): Matrix.004 file - promoters50/2114005
aatttatata

SEQ ID NO: 71036 - DNA, 11 bp, Unknown
  misc_feature (1)..( 11): Matrix.004 file - promoters50/2114005
aattttcttag

SEQ ID NO: 71037 - DNA, 10 bp, Unknown
  misc_feature (1)..( 10): Matrix.004 file - promoters50/2114026
ataaattttt

SEQ ID NO: 71038 - DNA, 8 bp, Unknown
  misc_feature (1)..( 8): Matrix.004 file - promoters50/2114026
gaagtttt

SEQ ID NO: 71039 - DNA, 15 bp, Unknown
  misc_feature (1)..( 15): Matrix.004 file - promoters50/2114026
tattagtttttcatt

SEQ ID NO: 71040 - DNA, 11 bp, Unknown
  misc_feature (1)..( 11): Matrix.004 file - promoters50/2114026
ttataagtaaa

SEQ ID NO: 71041 - DNA, 10 bp, Unknown
  misc_feature (1)..( 10): Matrix.004 file - promoters50/2114030
ctatataaac

SEQ ID NO: 71042 - DNA, 15 bp, Unknown
  misc_feature (1)..( 15): Matrix.004 file - promoters50/2114030
tcttaccatatatat

SEQ ID NO: 71043 - DNA, 12 bp, Unknown
  misc_feature (1)..( 12): Matrix.004 file - promoters50/2114030
cattcaaaaaaa

SEQ ID NO: 71044 - DNA, 8 bp, Unknown
  misc_feature (1)..( 8): Matrix.004 file - promoters50/2114095
aataaaaa

SEQ ID NO: 71045 - DNA, 11 bp, Unknown
  misc_feature (1)..( 11): Matrix.004 file - promoters50/2114111
ctaaaaaactt

SEQ ID NO: 71046 - DNA, 12 bp, Unknown
  misc_feature (1)..( 12): Matrix.004 file - promoters50/2114111
ataaatgatttg

SEQ ID NO: 71047 - DNA, 9 bp, Unknown
  misc_feature (1)..( 9): Matrix.004 file - promoters50/2114111
aattttcga

SEQ ID NO: 71048 - DNA, 7 bp, Unknown
  misc_feature (1)..( 7): Matrix.004 file - promoters50/2114111
taatatt

SEQ ID NO: 71049 - DNA, 8 bp, Unknown
  misc_feature (1)..( 8): Matrix.004 file - promoters50/2114111
aaaagcct

SEQ ID NO: 71050 - DNA, 8 bp, Unknown
  misc_feature (1)..( 8): Matrix.004 file - promoters50/2114111
aaaaacct

SEQ ID NO: 71051 - DNA, 10 bp, Unknown
  misc_feature (1)..( 10): Matrix.004 file - promoters50/2114111
caacttagaa

SEQ ID NO: 71052 - DNA, 8 bp, Unknown
  misc_feature (1)..( 8): Matrix.004 file - promoters50/2114111
caaattat

SEQ ID NO: 71053 - DNA, 12 bp, Unknown
  misc_feature (1)..( 12): Matrix.004 file - promoters50/2114115
tgaaatagttaa

SEQ ID NO: 71054 - DNA, 9 bp, Unknown
  misc_feature (1)..( 9): Matrix.004 file - promoters50/2114115
agatcattc

SEQ ID NO: 71055 - DNA, 12 bp, Unknown
  misc_feature (1)..( 12): Matrix.004 file - promoters50/2114119
ttaggatttatt

SEQ ID NO: 71056 - DNA, 7 bp, Unknown
  misc_feature (1)..( 7): Matrix.004 file - promoters50/2114138
ttttctt

SEQ ID NO: 71057 - DNA, 12 bp, Unknown
  misc_feature (1)..( 12): Matrix.004 file - promoters50/2114138
aaatagatctac

SEQ ID NO: 71058 - DNA, 9 bp, Unknown
  misc_feature (1)..( 9): Matrix.004 file - promoters50/2114138
aattttgaa

SEQ ID NO: 71059 - DNA, 9 bp, Unknown
  misc_feature (1)..( 9): Matrix.004 file - promoters50/2114141
tttttggta

SEQ ID NO: 71060 - DNA, 7 bp, Unknown
  misc_feature (1)..( 7): Matrix.004 file - promoters50/2114141
ttttata

SEQ ID NO: 71061 - DNA, 9 bp, Unknown
  misc_feature (1)..( 9): Matrix.004 file - promoters50/2114141
aactttaat

SEQ ID NO: 71062 - DNA, 9 bp, Unknown
  misc_feature (1)..( 9): Matrix.004 file - promoters50/2114141
aaatagttt

SEQ ID NO: 71063 - DNA, 8 bp, Unknown
  misc_feature (1)..( 8): Matrix.004 file - promoters50/2114145
ttaatttt

SEQ ID NO: 71064 - DNA, 8 bp, Unknown
  misc_feature (1)..( 8): Matrix.004 file - promoters50/2114145
tatacaaa

SEQ ID NO: 71065 - DNA, 8 bp, Unknown
  misc_feature (1)..( 8): Matrix.004 file - promoters50/2114145
atgattct

SEQ ID NO: 71066 - DNA, 8 bp, Unknown
  misc_feature (1)..( 8): Matrix.004 file - promoters50/2114175
aaaataaa

SEQ ID NO: 71067 - DNA, 11 bp, Unknown
  misc_feature (1)..( 11): Matrix.004 file - promoters50/2114175
ttttattggtt

SEQ ID NO: 71068 - DNA, 9 bp, Unknown
  misc_feature (1)..( 9): Matrix.004 file - promoters50/2114175
aaaaaaaaa

SEQ ID NO: 71069 - DNA, 13 bp, Unknown
  misc_feature (1)..( 13): Matrix.004 file - promoters50/2114178
cataatgggacca

SEQ ID NO: 71070 - DNA, 10 bp, Unknown
  misc_feature (1)..( 10): Matrix.004 file - promoters50/2114178
taaaatatga

SEQ ID NO: 71071 - DNA, 9 bp, Unknown
  misc_feature (1)..( 9): Matrix.004 file - promoters50/2114178
gtttcaaaa

SEQ ID NO: 71072 - DNA, 9 bp, Unknown
  misc_feature (1)..( 9): Matrix.004 file - promoters50/2114178
tgattcaaa

SEQ ID NO: 71073 - DNA, 6 bp, Unknown
  misc_feature (1)..( 6): Matrix.004 file - promoters50/2114178
tgtatt

SEQ ID NO: 71074 - DNA, 14 bp, Unknown
  misc_feature (1)..( 14): Matrix.004 file - promoters50/2114178
tagagaaaaacacc

SEQ ID NO: 71075 - DNA, 8 bp, Unknown
  misc_feature (1)..( 8): Matrix.004 file - promoters50/2114178
aaaataat

SEQ ID NO: 71076 - DNA, 10 bp, Unknown
  misc_feature (1)..( 10): Matrix.004 file - promoters50/2114200
agcaaaggaa

SEQ ID NO: 71077 - DNA, 8 bp, Unknown
  misc_feature (1)..( 8): Matrix.004 file - promoters50/2169576
caatcttc

SEQ ID NO: 71078 - DNA, 14 bp, Unknown
  misc_feature (1)..( 14): Matrix.004 file - promoters50/2169576
actgatataaatga

SEQ ID NO: 71079 - DNA, 12 bp, Unknown
  misc_feature (1)..( 12): Matrix.004 file - promoters50/2169576
aaacttttcttt

SEQ ID NO: 71080 - DNA, 11 bp, Unknown
  misc_feature (1)..( 11): Matrix.004 file - promoters50/2184050
tcatatataaa

SEQ ID NO: 71081 - DNA, 10 bp, Unknown
  misc_feature (1)..( 10): Matrix.004 file - promoters50/2184050
aaattactaa

SEQ ID NO: 71082 - DNA, 9 bp, Unknown
  misc_feature (1)..( 9): Matrix.004 file - promoters50/2185389
aatataaat

SEQ ID NO: 71083 - DNA, 13 bp, Unknown
  misc_feature (1)..( 13): Matrix.004 file - promoters50/2185389
ctgaagaaaaaat

SEQ ID NO: 71084 - DNA, 9 bp, Unknown
  misc_feature (1)..( 9): Matrix.004 file - promoters50/2187156
acaaaagaa

SEQ ID NO: 71085 - DNA, 11 bp, Unknown
  misc_feature (1)..( 11): Matrix.004 file - promoters50/2187156
tcataattaag

SEQ ID NO: 71086 - DNA, 10 bp, Unknown
  misc_feature (1)..( 10): Matrix.004 file - promoters50/2187156
atgtaaaatt

SEQ ID NO: 71087 - DNA, 9 bp, Unknown
  misc_feature (1)..( 9): Matrix.004 file - promoters50/2217752
tcagaattg

SEQ ID NO: 71088 - DNA, 8 bp, Unknown
  misc_feature (1)..( 8): Matrix.004 file - promoters50/2217794
agatggaa

SEQ ID NO: 71089 - DNA, 11 bp, Unknown
  misc_feature (1)..( 11): Matrix.004 file - promoters50/2217996
aaaaaaagaaa

SEQ ID NO: 71090 - DNA, 11 bp, Unknown
  misc_feature (1)..( 11): Matrix.004 file - promoters50/2218016
tcagttttgcg

SEQ ID NO: 71091 - DNA, 8 bp, Unknown
  misc_feature (1)..( 8): Matrix.004 file - promoters50/2218184
taagaaac

SEQ ID NO: 71092 - DNA, 8 bp, Unknown
  misc_feature (1)..( 8): Matrix.004 file - promoters50/2218184
ttaaaatc

SEQ ID NO: 71093 - DNA, 10 bp, Unknown
  misc_feature (1)..( 10): Matrix.004 file - promoters50/2218259
actttataat

SEQ ID NO: 71094 - DNA, 9 bp, Unknown
  misc_feature (1)..( 9): Matrix.004 file - promoters50/2218260
agatatttt

SEQ ID NO: 71095 - DNA, 10 bp, Unknown
  misc_feature (1)..( 10): Matrix.004 file - promoters50/2218271
ctataaatac

SEQ ID NO: 71096 - DNA, 11 bp, Unknown
  misc_feature (1)..( 11): Matrix.004 file - promoters50/2685671
tcaaaactaaa

SEQ ID NO: 71097 - DNA, 11 bp, Unknown
  misc_feature (1)..( 11): Matrix.004 file - promoters50/2685671
gtatatattca

SEQ ID NO: 71098 - DNA, 12 bp, Unknown
  misc_feature (1)..( 12): Matrix.004 file - promoters50/2685671
aaagcccattaa

SEQ ID NO: 71099 - DNA, 9 bp, Unknown
  misc_feature (1)..( 9): Matrix.004 file - promoters50/2685671
agaaaaata

SEQ ID NO: 71100 - DNA, 8 bp, Unknown
  misc_feature (1)..( 8): Matrix.004 file - promoters50/2685712
tttaaaaa

SEQ ID NO: 71101 - DNA, 10 bp, Unknown
  misc_feature (1)..( 10): Matrix.004 file - promoters50/2685712
ggtttaggtg

SEQ ID NO: 71102 - DNA, 8 bp, Unknown
  misc_feature (1)..( 8): Matrix.004 file - promoters50/2685725
tcttataa

SEQ ID NO: 71103 - DNA, 8 bp, Unknown
  misc_feature (1)..( 8): Matrix.004 file - promoters50/2685725
ttataatg

SEQ ID NO: 71104 - DNA, 9 bp, Unknown
  misc_feature (1)..( 9): Matrix.004 file - promoters50/2685725
agaaggttc

SEQ ID NO: 71105 - DNA, 10 bp, Unknown
  misc_feature (1)..( 10): Matrix.004 file - promoters50/2685873
gaaaagttaa

SEQ ID NO: 71106 - DNA, 16 bp, Unknown
  misc_feature (1)..( 16): Matrix.004 file - promoters50/2685873
aaaaaacaatttataa

SEQ ID NO: 71107 - DNA, 10 bp, Unknown
  misc_feature (1)..( 10): Matrix.004 file - promoters50/2685873
aagaactttt

SEQ ID NO: 71108 - DNA, 10 bp, Unknown
  misc_feature (1)..( 10): Matrix.004 file - promoters50/2685877
atataaaaaa

SEQ ID NO: 71109 - DNA, 9 bp, Unknown
  misc_feature (1)..( 9): Matrix.004 file - promoters50/2685877
ctttgatta

SEQ ID NO: 71110 - DNA, 8 bp, Unknown
  misc_feature (1)..( 8): Matrix.004 file - promoters50/2685877
ccatatta

SEQ ID NO: 71111 - DNA, 11 bp, Unknown
  misc_feature (1)..( 11): Matrix.004 file - promoters50/2685931
ttgcactataa

SEQ ID NO: 71112 - DNA, 15 bp, Unknown
  misc_feature (1)..( 15): Matrix.004 file - promoters50/2685931
attaattatttgaac

SEQ ID NO: 71113 - DNA, 9 bp, Unknown
  misc_feature (1)..( 9): Matrix.004 file - promoters50/2685931
aacattaaa

SEQ ID NO: 71114 - DNA, 8 bp, Unknown
  misc_feature (1)..( 8): Matrix.004 file - promoters50/2685951
atttattt

SEQ ID NO: 71115 - DNA, 6 bp, Unknown
  misc_feature (1)..( 6): Matrix.004 file - promoters50/2685951
atctaa

SEQ ID NO: 71116 - DNA, 13 bp, Unknown
  misc_feature (1)..( 13): Matrix.004 file - promoters50/2685968
aaagatcaaaaaa

SEQ ID NO: 71117 - DNA, 8 bp, Unknown
  misc_feature (1)..( 8): Matrix.004 file - promoters50/2685968
tgaaaata

SEQ ID NO: 71118 - DNA, 8 bp, Unknown
  misc_feature (1)..( 8): Matrix.004 file - promoters50/2685968
aaacaaaa

SEQ ID NO: 71119 - DNA, 10 bp, Unknown
  misc_feature (1)..( 10): Matrix.004 file - promoters50/2685968
tattatttta

SEQ ID NO: 71120 - DNA, 11 bp, Unknown
  misc_feature (1)..( 11): Matrix.004 file - promoters50/2685968
tgttaaaaaat

SEQ ID NO: 71121 - DNA, 13 bp, Unknown
  misc_feature (1)..( 13): Matrix.004 file - promoters50/2685968
aaaaacttgtata

SEQ ID NO: 71122 - DNA, 11 bp, Unknown
  misc_feature (1)..( 11): Matrix.004 file - promoters50/2685968
tttgattttaa

SEQ ID NO: 71123 - DNA, 8 bp, Unknown
  misc_feature (1)..( 8): Matrix.004 file - promoters50/2685968
attttaaa

SEQ ID NO: 71124 - DNA, 10 bp, Unknown
  misc_feature (1)..( 10): Matrix.004 file - promoters50/2686138
caaaactata

SEQ ID NO: 71125 - DNA, 10 bp, Unknown
  misc_feature (1)..( 10): Matrix.004 file - promoters50/2686138
aaacaattat

SEQ ID NO: 71126 - DNA, 7 bp, Unknown
  misc_feature (1)..( 7): Matrix.004 file - promoters50/2686138
attttgt

SEQ ID NO: 71127 - DNA, 9 bp, Unknown
  misc_feature (1)..( 9): Matrix.004 file - promoters50/2686138
tataattaa

SEQ ID NO: 71128 - DNA, 7 bp, Unknown
  misc_feature (1)..( 7): Matrix.004 file - promoters50/2686438
aaataat

SEQ ID NO: 71129 - DNA, 9 bp, Unknown
  misc_feature (1)..( 9): Matrix.004 file - promoters50/2686438
tgcatttta

SEQ ID NO: 71130 - DNA, 9 bp, Unknown
  misc_feature (1)..( 9): Matrix.004 file - promoters50/2686438
aaatagtct

SEQ ID NO: 71131 - DNA, 9 bp, Unknown
  misc_feature (1)..( 9): Matrix.004 file - promoters50/2686438
ataaagatt

SEQ ID NO: 71132 - DNA, 10 bp, Unknown
  misc_feature (1)..( 10): Matrix.004 file - promoters50/2686438
taacaaaata

SEQ ID NO: 71133 - DNA, 7 bp, Unknown
  misc_feature (1)..( 7): Matrix.004 file - promoters50/2704717
acacaag

SEQ ID NO: 71134 - DNA, 10 bp, Unknown
  misc_feature (1)..( 10): Matrix.004 file - promoters50/2704717
aaacattcaa

SEQ ID NO: 71135 - DNA, 15 bp, Unknown
  misc_feature (1)..( 15): Matrix.004 file - promoters50/2724399
caccaagaaataaaa

SEQ ID NO: 71136 - DNA, 8 bp, Unknown
  misc_feature (1)..( 8): Matrix.004 file - promoters50/2724473
tcagatat

SEQ ID NO: 71137 - DNA, 12 bp, Unknown
  misc_feature (1)..( 12): Matrix.004 file - promoters50/2724473
tatcattaatgt

SEQ ID NO: 71138 - DNA, 16 bp, Unknown
  misc_feature (1)..( 16): Matrix.004 file - promoters50/2724473
taattctgtctcatca

SEQ ID NO: 71139 - DNA, 8 bp, Unknown
  misc_feature (1)..( 8): Matrix.004 file - promoters50/2724473
gatagtaa

SEQ ID NO: 71140 - DNA, 8 bp, Unknown
  misc_feature (1)..( 8): Matrix.004 file - promoters50/2724699
aatttatt

SEQ ID NO: 71141 - DNA, 18 bp, Unknown
  misc_feature (1)..( 18): Matrix.004 file - promoters50/2724699
aaaagtttagggaaaaag

SEQ ID NO: 71142 - DNA, 7 bp, Unknown
  misc_feature (1)..( 7): Matrix.004 file - promoters50/2724699
aattatc

SEQ ID NO: 71143 - DNA, 7 bp, Unknown
  misc_feature (1)..( 7): Matrix.004 file - promoters50/2724699
gaaaatg

SEQ ID NO: 71144 - DNA, 8 bp, Unknown
  misc_feature (1)..( 8): Matrix.004 file - promoters50/2724699
aatgtttt

SEQ ID NO: 71145 - DNA, 6 bp, Unknown
  misc_feature (1)..( 6): Matrix.004 file - promoters50/2724699
ttttac

SEQ ID NO: 71146 - DNA, 9 bp, Unknown
  misc_feature (1)..( 9): Matrix.004 file - promoters50/2724699
acattcaat

SEQ ID NO: 71147 - DNA, 6 bp, Unknown
  misc_feature (1)..( 6): Matrix.004 file - promoters50/2724699
cattat

SEQ ID NO: 71148 - DNA, 7 bp, Unknown
  misc_feature (1)..( 7): Matrix.004 file - promoters50/2724703
acgcaaa

SEQ ID NO: 71149 - DNA, 8 bp, Unknown
  misc_feature (1)..( 8): Matrix.004 file - promoters50/2724703
tctcagag

SEQ ID NO: 71150 - DNA, 12 bp, Unknown
  misc_feature (1)..( 12): Matrix.004 file - promoters50/2724703
aaaaacaaaaca

SEQ ID NO: 71151 - DNA, 9 bp, Unknown
  misc_feature (1)..( 9): Matrix.004 file - promoters50/2724703
tatttaaaa

SEQ ID NO: 71152 - DNA, 8 bp, Unknown
  misc_feature (1)..( 8): Matrix.004 file - promoters50/2724703
aaaaactg

SEQ ID NO: 71153 - DNA, 7 bp, Unknown
  misc_feature (1)..( 7): Matrix.004 file - promoters50/2724703
ttttggt

SEQ ID NO: 71154 - DNA, 8 bp, Unknown
  misc_feature (1)..( 8): Matrix.004 file - promoters50/2724703
ttaaccca

SEQ ID NO: 71155 - DNA, 7 bp, Unknown
  misc_feature (1)..( 7): Matrix.004 file - promoters50/2724724
agagata

SEQ ID NO: 71156 - DNA, 10 bp, Unknown
  misc_feature (1)..( 10): Matrix.004 file - promoters50/2724724
tataacttga

SEQ ID NO: 71157 - DNA, 8 bp, Unknown
  misc_feature (1)..( 8): Matrix.004 file - promoters50/2724724
aaataaaa

SEQ ID NO: 71158 - DNA, 10 bp, Unknown
  misc_feature (1)..( 10): Matrix.004 file - promoters50/2724724
aaaaaaaata

SEQ ID NO: 71159 - DNA, 8 bp, Unknown
  misc_feature (1)..( 8): Matrix.004 file - promoters50/2724736
cccactaa

SEQ ID NO: 71160 - DNA, 9 bp, Unknown
  misc_feature (1)..( 9): Matrix.004 file - promoters50/2724736
aaatacaaa

SEQ ID NO: 71161 - DNA, 12 bp, Unknown
  misc_feature (1)..( 12): Matrix.004 file - promoters50/2724756
ttccatttaaaa

SEQ ID NO: 71162 - DNA, 7 bp, Unknown
  misc_feature (1)..( 7): Matrix.004 file - promoters50/2724771
tataaag

SEQ ID NO: 71163 - DNA, 14 bp, Unknown
  misc_feature (1)..( 14): Matrix.004 file - promoters50/2724771
aataaaaaccaaaa

SEQ ID NO: 71164 - DNA, 8 bp, Unknown
  misc_feature (1)..( 8): Matrix.004 file - promoters50/2781302
agaaaatt

SEQ ID NO: 71165 - DNA, 8 bp, Unknown
  misc_feature (1)..( 8): Matrix.004 file - promoters50/2781320
tttaagaa

SEQ ID NO: 71166 - DNA, 7 bp, Unknown
  misc_feature (1)..( 7): Matrix.004 file - promoters50/2781320
atattaa

SEQ ID NO: 71167 - DNA, 11 bp, Unknown
  misc_feature (1)..( 11): Matrix.004 file - promoters50/2781320
tagcaatagtg

SEQ ID NO: 71168 - DNA, 7 bp, Unknown
  misc_feature (1)..( 7): Matrix.004 file - promoters50/2781320
aatataa

SEQ ID NO: 71169 - DNA, 10 bp, Unknown
  misc_feature (1)..( 10): Matrix.004 file - promoters50/2781320
attgaataaa

SEQ ID NO: 71170 - DNA, 7 bp, Unknown
  misc_feature (1)..( 7): Matrix.004 file - promoters50/2781320
catttca

SEQ ID NO: 71171 - DNA, 12 bp, Unknown
  misc_feature (1)..( 12): Matrix.004 file - promoters50/2781320
taataaattttg

SEQ ID NO: 71172 - DNA, 7 bp, Unknown
  misc_feature (1)..( 7): Matrix.004 file - promoters50/2781320
tttacca

SEQ ID NO: 71173 - DNA, 8 bp, Unknown
  misc_feature (1)..( 8): Matrix.004 file - promoters50/2781320
ggtttgaa

SEQ ID NO: 71174 - DNA, 8 bp, Unknown
  misc_feature (1)..( 8): Matrix.004 file - promoters50/2781341
ggttagaa

SEQ ID NO: 71175 - DNA, 11 bp, Unknown
  misc_feature (1)..( 11): Matrix.004 file - promoters50/2781341
aaagtttttgt

SEQ ID NO: 71176 - DNA, 9 bp, Unknown
  misc_feature (1)..( 9): Matrix.004 file - promoters50/2781341
aaaaatttt

SEQ ID NO: 71177 - DNA, 11 bp, Unknown
  misc_feature (1)..( 11): Matrix.004 file - promoters50/2781341
attttatgatt

SEQ ID NO: 71178 - DNA, 14 bp, Unknown
  misc_feature (1)..( 14): Matrix.004 file - promoters50/2781341
aacttaattttttc

SEQ ID NO: 71179 - DNA, 11 bp, Unknown
  misc_feature (1)..( 11): Matrix.004 file - promoters50/2781341
acttttaaaaa

SEQ ID NO: 71180 - DNA, 10 bp, Unknown
  misc_feature (1)..( 10): Matrix.004 file - promoters50/2781341
acaaattttt

SEQ ID NO: 71181 - DNA, 13 bp, Unknown
  misc_feature (1)..( 13): Matrix.004 file - promoters50/2781786
taaaattaattct

SEQ ID NO: 71182 - DNA, 13 bp, Unknown
  misc_feature (1)..( 13): Matrix.004 file - promoters50/2781800
aactgaaaattca

SEQ ID NO: 71183 - DNA, 10 bp, Unknown
  misc_feature (1)..( 10): Matrix.004 file - promoters50/2781800
taaattaata

SEQ ID NO: 71184 - DNA, 10 bp, Unknown
  misc_feature (1)..( 10): Matrix.004 file - promoters50/2781800
ttaatttata

SEQ ID NO: 71185 - DNA, 8 bp, Unknown
  misc_feature (1)..( 8): Matrix.004 file - promoters50/2781800
aatttata

SEQ ID NO: 71186 - DNA, 8 bp, Unknown
  misc_feature (1)..( 8): Matrix.004 file - promoters50/2781800
ttttcatg

SEQ ID NO: 71187 - DNA, 6 bp, Unknown
  misc_feature (1)..( 6): Matrix.004 file - promoters50/2781800
tatata

SEQ ID NO: 71188 - DNA, 26 bp, Unknown
  misc_feature (1)..( 26): Matrix.004 file - promoters50/2781800
tttacaaaataataatataaaatata

SEQ ID NO: 71189 - DNA, 35 bp, Unknown
  misc_feature (1)..( 35): Matrix.004 file - promoters50/2781800
aaaaataaagaaaatacatttctatgacccaataa

SEQ ID NO: 71190 - DNA, 8 bp, Unknown
  misc_feature (1)..( 8): Matrix.004 file - promoters50/2781818
ttatcaat

SEQ ID NO: 71191 - DNA, 10 bp, Unknown
  misc_feature (1)..( 10): Matrix.004 file - promoters50/2781818
aagaggattg

SEQ ID NO: 71192 - DNA, 8 bp, Unknown
  misc_feature (1)..( 8): Matrix.004 file - promoters50/2781998
aaaaagag

SEQ ID NO: 71193 - DNA, 15 bp, Unknown
  misc_feature (1)..( 15): Matrix.004 file - promoters50/2785775
agtaggaaaagaaat

SEQ ID NO: 71194 - DNA, 12 bp, Unknown
  misc_feature (1)..( 12): Matrix.004 file - promoters50/2785798
tgggaaacttgt

SEQ ID NO: 71195 - DNA, 11 bp, Unknown
  misc_feature (1)..( 11): Matrix.004 file - promoters50/2785798
aatgacaatta

SEQ ID NO: 71196 - DNA, 7 bp, Unknown
  misc_feature (1)..( 7): Matrix.004 file - promoters50/2785798
aatattt

SEQ ID NO: 71197 - DNA, 10 bp, Unknown
  misc_feature (1)..( 10): Matrix.004 file - promoters50/2918398
tatattttaa

SEQ ID NO: 71198 - DNA, 7 bp, Unknown
  misc_feature (1)..( 7): Matrix.004 file - promoters50/2918607
tataaaa

SEQ ID NO: 71199 - DNA, 7 bp, Unknown
  misc_feature (1)..( 7): Matrix.004 file - promoters50/2918607
tttattt

SEQ ID NO: 71200 - DNA, 8 bp, Unknown
  misc_feature (1)..( 8): Matrix.004 file - promoters50/2918607
tttttgtt

SEQ ID NO: 71201 - DNA, 7 bp, Unknown
  misc_feature (1)..( 7): Matrix.004 file - promoters50/2918607
caaaaaa

SEQ ID NO: 71202 - DNA, 8 bp, Unknown
  misc_feature (1)..( 8): Matrix.004 file - promoters50/2918611
caataact

SEQ ID NO: 71203 - DNA, 8 bp, Unknown
  misc_feature (1)..( 8): Matrix.004 file - promoters50/2918611
aataataa

SEQ ID NO: 71204 - DNA, 7 bp, Unknown
  misc_feature (1)..( 7): Matrix.004 file - promoters50/2918611
aataata

SEQ ID NO: 71205 - DNA, 8 bp, Unknown
  misc_feature (1)..( 8): Matrix.004 file - promoters50/2918619
aatagtgg

SEQ ID NO: 71206 - DNA, 10 bp, Unknown
  misc_feature (1)..( 10): Matrix.004 file - promoters50/2918626
cgttaaataa

SEQ ID NO: 71207 - DNA, 7 bp, Unknown
  misc_feature (1)..( 7): Matrix.004 file - promoters50/2918636
gtttaga

SEQ ID NO: 71208 - DNA, 8 bp, Unknown
  misc_feature (1)..( 8): Matrix.004 file - promoters50/2918636
taattttg

SEQ ID NO: 71209 - DNA, 8 bp, Unknown
  misc_feature (1)..( 8): Matrix.004 file - promoters50/2918640
gattattc

SEQ ID NO: 71210 - DNA, 8 bp, Unknown
  misc_feature (1)..( 8): Matrix.004 file - promoters50/2918658
ctaaaaaa

SEQ ID NO: 71211 - DNA, 11 bp, Unknown
  misc_feature (1)..( 11): Matrix.004 file - promoters50/2918666
actttataaaa

SEQ ID NO: 71212 - DNA, 7 bp, Unknown
  misc_feature (1)..( 7): Matrix.004 file - promoters50/2918666
gtaagaa

SEQ ID NO: 71213 - DNA, 13 bp, Unknown
  misc_feature (1)..( 13): Matrix.004 file - promoters50/2918666
agacataataaaa

SEQ ID NO: 71214 - DNA, 8 bp, Unknown
  misc_feature (1)..( 8): Matrix.004 file - promoters50/2918666
catataac

SEQ ID NO: 71215 - DNA, 13 bp, Unknown
  misc_feature (1)..( 13): Matrix.004 file - promoters50/2918666
gtataaaattaat

SEQ ID NO: 71216 - DNA, 8 bp, Unknown
  misc_feature (1)..( 8): Matrix.004 file - promoters50/2918666
aagagacg

SEQ ID NO: 71217 - DNA, 8 bp, Unknown
  misc_feature (1)..( 8): Matrix.004 file - promoters50/2918666
gctaatga

SEQ ID NO: 71218 - DNA, 8 bp, Unknown
  misc_feature (1)..( 8): Matrix.004 file - promoters50/2918666
tggtaaga

SEQ ID NO: 71219 - DNA, 8 bp, Unknown
  misc_feature (1)..( 8): Matrix.004 file - promoters50/2918666
tattaatt

SEQ ID NO: 71220 - DNA, 7 bp, Unknown
  misc_feature (1)..( 7): Matrix.004 file - promoters50/2918666
tataaat

SEQ ID NO: 71221 - DNA, 9 bp, Unknown
  misc_feature (1)..( 9): Matrix.004 file - promoters50/2918666
tctttttcc

SEQ ID NO: 71222 - DNA, 8 bp, Unknown
  misc_feature (1)..( 8): Matrix.004 file - promoters50/2918666
agtgaaaa

SEQ ID NO: 71223 - DNA, 8 bp, Unknown
  misc_feature (1)..( 8): Matrix.004 file - promoters50/2918666
aaatcttg

SEQ ID NO: 71224 - DNA, 9 bp, Unknown
  misc_feature (1)..( 9): Matrix.004 file - promoters50/2918674
tatcacaat

SEQ ID NO: 71225 - DNA, 11 bp, Unknown
  misc_feature (1)..( 11): Matrix.004 file - promoters50/2918674
gcttcatttca

SEQ ID NO: 71226 - DNA, 9 bp, Unknown
  misc_feature (1)..( 9): Matrix.004 file - promoters50/2918676
atttttgta

SEQ ID NO: 71227 - DNA, 9 bp, Unknown
  misc_feature (1)..( 9): Matrix.004 file - promoters50/2918676
gaaaaaaga

SEQ ID NO: 71228 - DNA, 11 bp, Unknown
  misc_feature (1)..( 11): Matrix.004 file - promoters50/2918676
taaaagtctgt

SEQ ID NO: 71229 - DNA, 7 bp, Unknown
  misc_feature (1)..( 7): Matrix.004 file - promoters50/2918688
gaaagaa

SEQ ID NO: 71230 - DNA, 8 bp, Unknown
  misc_feature (1)..( 8): Matrix.004 file - promoters50/2918688
attggaat

SEQ ID NO: 71231 - DNA, 10 bp, Unknown
  misc_feature (1)..( 10): Matrix.004 file - promoters50/2989987
caaacaacta

SEQ ID NO: 71232 - DNA, 8 bp, Unknown
  misc_feature (1)..( 8): Matrix.004 file - promoters50/2989991
tatcattt

SEQ ID NO: 71233 - DNA, 17 bp, Unknown
  misc_feature (1)..( 17): Matrix.004 file - promoters50/2989991
aaatcatctcaatgcca

SEQ ID NO: 71234 - DNA, 6 bp, Unknown
  misc_feature (1)..( 6): Matrix.004 file - promoters50/2989991
gatgaa

SEQ ID NO: 71235 - DNA, 9 bp, Unknown
  misc_feature (1)..( 9): Matrix.004 file - promoters50/2989991
aagctcgat

SEQ ID NO: 71236 - DNA, 6 bp, Unknown
  misc_feature (1)..( 6): Matrix.004 file - promoters50/2989991
aaaaaa

SEQ ID NO: 71237 - DNA, 6 bp, Unknown
  misc_feature (1)..( 6): Matrix.004 file - promoters50/2989991
aacaag

SEQ ID NO: 71238 - DNA, 6 bp, Unknown
  misc_feature (1)..( 6): Matrix.004 file - promoters50/2989991
ttaaaa

SEQ ID NO: 71239 - DNA, 8 bp, Unknown
  misc_feature (1)..( 8): Matrix.004 file - promoters50/2989991
taatttat

SEQ ID NO: 71240 - DNA, 8 bp, Unknown
  misc_feature (1)..( 8): Matrix.004 file - promoters50/2989991
ttcgaatt

SEQ ID NO: 71241 - DNA, 8 bp, Unknown
  misc_feature (1)..( 8): Matrix.004 file - promoters50/2990064
aagaaaaa

SEQ ID NO: 71242 - DNA, 8 bp, Unknown
  misc_feature (1)..( 8): Matrix.004 file - promoters50/2990064
aatttatt

SEQ ID NO: 71243 - DNA, 10 bp, Unknown
  misc_feature (1)..( 10): Matrix.004 file - promoters50/2990064
agcatcaaca

SEQ ID NO: 71244 - DNA, 11 bp, Unknown
  misc_feature (1)..( 11): Matrix.004 file - promoters50/2990064
taatgtctcag

SEQ ID NO: 71245 - DNA, 9 bp, Unknown
  misc_feature (1)..( 9): Matrix.004 file - promoters50/2990064
ttctatata

SEQ ID NO: 71246 - DNA, 8 bp, Unknown
  misc_feature (1)..( 8): Matrix.004 file - promoters50/2990064
ttcaccag

SEQ ID NO: 71247 - DNA, 10 bp, Unknown
  misc_feature (1)..( 10): Matrix.004 file - promoters50/2990064
cttgtcagat

SEQ ID NO: 71248 - DNA, 27 bp, Unknown
  misc_feature (1)..( 27): Matrix.004 file - promoters50/2990064
tcttgtcatataaacgtccatatagga

SEQ ID NO: 71249 - DNA, 39 bp, Unknown
  misc_feature (1)..( 39): Matrix.004 file - promoters50/2990064
gattcatacccacatgatcatgtcttctcaccacaagtt

SEQ ID NO: 71250 - DNA, 19 bp, Unknown
  misc_feature (1)..( 19): Matrix.004 file - promoters50/2990064
tatagtccacaagttgatt

SEQ ID NO: 71251 - DNA, 14 bp, Unknown
  misc_feature (1)..( 14): Matrix.004 file - promoters50/2990064
tgacataattgatt

SEQ ID NO: 71252 - DNA, 15 bp, Unknown
  misc_feature (1)..( 15): Matrix.004 file - promoters50/2990087
aacttgggaccctta

SEQ ID NO: 71253 - DNA, 10 bp, Unknown
  misc_feature (1)..( 10): Matrix.004 file - promoters50/2990087
aaaactattt

SEQ ID NO: 71254 - DNA, 7 bp, Unknown
  misc_feature (1)..( 7): Matrix.004 file - promoters50/2990087
ttttctt

SEQ ID NO: 71255 - DNA, 9 bp, Unknown
  misc_feature (1)..( 9): Matrix.004 file - promoters50/2990091
actatatat

SEQ ID NO: 71256 - DNA, 10 bp, Unknown
  misc_feature (1)..( 10): Matrix.004 file - promoters50/2990091
cttgttttaa

SEQ ID NO: 71257 - DNA, 13 bp, Unknown
  misc_feature (1)..( 13): Matrix.004 file - promoters50/2990184
aagattctgttgt

SEQ ID NO: 71258 - DNA, 11 bp, Unknown
  misc_feature (1)..( 11): Matrix.004 file - promoters50/2990184
caattatatat

SEQ ID NO: 71259 - DNA, 9 bp, Unknown
  misc_feature (1)..( 9): Matrix.004 file - promoters50/2990184
tagaataaa

SEQ ID NO: 71260 - DNA, 7 bp, Unknown
  misc_feature (1)..( 7): Matrix.004 file - promoters50/2990233
tttccaa

SEQ ID NO: 71261 - DNA, 11 bp, Unknown
  misc_feature (1)..( 11): Matrix.004 file - promoters50/2990233
cgttttggtta

SEQ ID NO: 71262 - DNA, 11 bp, Unknown
  misc_feature (1)..( 11): Matrix.004 file - promoters50/2990233
tattgtatttt

SEQ ID NO: 71263 - DNA, 6 bp, Unknown
  misc_feature (1)..( 6): Matrix.004 file - promoters50/2990233
agagac

SEQ ID NO: 71264 - DNA, 8 bp, Unknown
  misc_feature (1)..( 8): Matrix.004 file - promoters50/2990249
aaacataa

SEQ ID NO: 71265 - DNA, 7 bp, Unknown
  misc_feature (1)..( 7): Matrix.004 file - promoters50/2990249
tcactta

SEQ ID NO: 71266 - DNA, 10 bp, Unknown
  misc_feature (1)..( 10): Matrix.004 file - promoters50/2990249
aaaacaaaac

SEQ ID NO: 71267 - DNA, 7 bp, Unknown
  misc_feature (1)..( 7): Matrix.004 file - promoters50/2990249
aagaaaa

SEQ ID NO: 71268 - DNA, 11 bp, Unknown
  misc_feature (1)..( 11): Matrix.004 file - promoters50/2990253
tgatatacact

SEQ ID NO: 71269 - DNA, 9 bp, Unknown
  misc_feature (1)..( 9): Matrix.004 file - promoters50/2990263
agcatgcgt

SEQ ID NO: 71270 - DNA, 10 bp, Unknown
  misc_feature (1)..( 10): Matrix.004 file - promoters50/2990263
atttgagaaa

SEQ ID NO: 71271 - DNA, 13 bp, Unknown
  misc_feature (1)..( 13): Matrix.004 file - promoters50/2990355
caaattgaaaaaa

SEQ ID NO: 71272 - DNA, 7 bp, Unknown
  misc_feature (1)..( 7): Matrix.004 file - promoters50/2990457
taaatct

SEQ ID NO: 71273 - DNA, 10 bp, Unknown
  misc_feature (1)..( 10): Matrix.004 file - promoters50/2990457
tccaaacttt

SEQ ID NO: 71274 - DNA, 10 bp, Unknown
  misc_feature (1)..( 10): Matrix.004 file - promoters50/2990457
atgtttatta

SEQ ID NO: 71275 - DNA, 8 bp, Unknown
  misc_feature (1)..( 8): Matrix.004 file - promoters50/2990457
ttatataa

SEQ ID NO: 71276 - DNA, 7 bp, Unknown
  misc_feature (1)..( 7): Matrix.004 file - promoters50/2990457
caaattt

SEQ ID NO: 71277 - DNA, 7 bp, Unknown
  misc_feature (1)..( 7): Matrix.004 file - promoters50/2990457
tttattt

SEQ ID NO: 71278 - DNA, 11 bp, Unknown
  misc_feature (1)..( 11): Matrix.004 file - promoters50/2990528
gatttttaaat

SEQ ID NO: 71279 - DNA, 12 bp, Unknown
  misc_feature (1)..( 12): Matrix.004 file - promoters50/2990548
gaaatataaatt

SEQ ID NO: 71280 - DNA, 10 bp, Unknown
  misc_feature (1)..( 10): Matrix.004 file - promoters50/2990611
tctttgtttg

SEQ ID NO: 71281 - DNA, 9 bp, Unknown
  misc_feature (1)..( 9): Matrix.004 file - promoters50/2990611
atttattta

SEQ ID NO: 71282 - DNA, 15 bp, Unknown
  misc_feature (1)..( 15): Matrix.004 file - promoters50/2990611
tcctataaatagaaa

SEQ ID NO: 71283 - DNA, 11 bp, Unknown
  misc_feature (1)..( 11): Matrix.004 file - promoters50/2990611
ataaaaaaaac

SEQ ID NO: 71284 - DNA, 10 bp, Unknown
  misc_feature (1)..( 10): Matrix.004 file - promoters50/2990611
caaacaaaga

SEQ ID NO: 71285 - DNA, 11 bp, Unknown
  misc_feature (1)..( 11): Matrix.004 file - promoters50/2990611
ttaaattaata

SEQ ID NO: 71286 - DNA, 14 bp, Unknown
  misc_feature (1)..( 14): Matrix.004 file - promoters50/2990611
ccttaaaagaaata

SEQ ID NO: 71287 - DNA, 15 bp, Unknown
  misc_feature (1)..( 15): Matrix.004 file - promoters50/2990659
cgaaaaataatttaa

SEQ ID NO: 71288 - DNA, 8 bp, Unknown
  misc_feature (1)..( 8): Matrix.004 file - promoters50/2990659
ttaaaaaa

SEQ ID NO: 71289 - DNA, 8 bp, Unknown
  misc_feature (1)..( 8): Matrix.004 file - promoters50/2990712
aaaatgaa

SEQ ID NO: 71290 - DNA, 7 bp, Unknown
  misc_feature (1)..( 7): Matrix.004 file - promoters50/2990712
tctttag

SEQ ID NO: 71291 - DNA, 9 bp, Unknown
  misc_feature (1)..( 9): Matrix.004 file - promoters50/2990777
ataaataca

SEQ ID NO: 71292 - DNA, 8 bp, Unknown
  misc_feature (1)..( 8): Matrix.004 file - promoters50/2990777
attcaaaa

SEQ ID NO: 71293 - DNA, 9 bp, Unknown
  misc_feature (1)..( 9): Matrix.004 file - promoters50/2990839
aaagtaaag

SEQ ID NO: 71294 - DNA, 9 bp, Unknown
  misc_feature (1)..( 9): Matrix.004 file - promoters50/2990839
taacaaaga

SEQ ID NO: 71295 - DNA, 8 bp, Unknown
  misc_feature (1)..( 8): Matrix.004 file - promoters50/2990839
aaaaaagt

SEQ ID NO: 71296 - DNA, 22 bp, Unknown
  misc_feature (1)..( 22): Matrix.004 file - promoters50/2990839
cccatacacgttaaggcccaat

SEQ ID NO: 71297 - DNA, 27 bp, Unknown
  misc_feature (1)..( 27): Matrix.004 file - promoters50/2990839
ttaaagcccaagaagtaacaataaaga

SEQ ID NO: 71298 - DNA, 10 bp, Unknown
  misc_feature (1)..( 10): Matrix.004 file - promoters50/2990928
tttattaaaa

SEQ ID NO: 71299 - DNA, 8 bp, Unknown
  misc_feature (1)..( 8): Matrix.004 file - promoters50/2991101
caaaatta

SEQ ID NO: 71300 - DNA, 7 bp, Unknown
  misc_feature (1)..( 7): Matrix.004 file - promoters50/2991101
tttattt

SEQ ID NO: 71301 - DNA, 9 bp, Unknown
  misc_feature (1)..( 9): Matrix.004 file - promoters50/2991141
tctttttcc

SEQ ID NO: 71302 - DNA, 10 bp, Unknown
  misc_feature (1)..( 10): Matrix.004 file - promoters50/2991141
aattatttta

SEQ ID NO: 71303 - DNA, 9 bp, Unknown
  misc_feature (1)..( 9): Matrix.004 file - promoters50/2991141
tcaaacaac

SEQ ID NO: 71304 - DNA, 8 bp, Unknown
  misc_feature (1)..( 8): Matrix.004 file - promoters50/2991141
tttatttt

SEQ ID NO: 71305 - DNA, 7 bp, Unknown
  misc_feature (1)..( 7): Matrix.004 file - promoters50/2991141
tttaatg

SEQ ID NO: 71306 - DNA, 8 bp, Unknown
  misc_feature (1)..( 8): Matrix.004 file - promoters50/2991227
gtttttaa

SEQ ID NO: 71307 - DNA, 16 bp, Unknown
  misc_feature (1)..( 16): Matrix.004 file - promoters50/2991227
atttagaacaattgat

SEQ ID NO: 71308 - DNA, 10 bp, Unknown
  misc_feature (1)..( 10): Matrix.004 file - promoters50/2991235
ttgactgctc

SEQ ID NO: 71309 - DNA, 9 bp, Unknown
  misc_feature (1)..( 9): Matrix.004 file - promoters50/2991235
catagagaa

SEQ ID NO: 71310 - DNA, 8 bp, Unknown
  misc_feature (1)..( 8): Matrix.004 file - promoters50/2991235
ggataaca

SEQ ID NO: 71311 - DNA, 9 bp, Unknown
  misc_feature (1)..( 9): Matrix.004 file - promoters50/2991235
tatcaacaa

SEQ ID NO: 71312 - DNA, 8 bp, Unknown
  misc_feature (1)..( 8): Matrix.004 file - promoters50/2991235
aaacacaa

SEQ ID NO: 71313 - DNA, 8 bp, Unknown
  misc_feature (1)..( 8): Matrix.004 file - promoters50/2991235
gaagaaac

SEQ ID NO: 71314 - DNA, 8 bp, Unknown
  misc_feature (1)..( 8): Matrix.004 file - promoters50/2991235
aagaagat

SEQ ID NO: 71315 - DNA, 10 bp, Unknown
  misc_feature (1)..( 10): Matrix.004 file - promoters50/2991235
gaagcattta

SEQ ID NO: 71316 - DNA, 8 bp, Unknown
  misc_feature (1)..( 8): Matrix.004 file - promoters50/2991235
gtagagaa

SEQ ID NO: 71317 - DNA, 8 bp, Unknown
  misc_feature (1)..( 8): Matrix.004 file - promoters50/2991239
tgttttgg

SEQ ID NO: 71318 - DNA, 13 bp, Unknown
  misc_feature (1)..( 13): Matrix.004 file - promoters50/2991239
aatataaaaaaaa

SEQ ID NO: 71319 - DNA, 9 bp, Unknown
  misc_feature (1)..( 9): Matrix.004 file - promoters50/2991239
taaatacaa

SEQ ID NO: 71320 - DNA, 23 bp, Unknown
  misc_feature (1)..( 23): Matrix.004 file - promoters50/2991239
atcatttaaaagatctcacgata

SEQ ID NO: 71321 - DNA, 27 bp, Unknown
  misc_feature (1)..( 27): Matrix.004 file - promoters50/2991239
gagcctaaatataaaggcaataatcat

SEQ ID NO: 71322 - DNA, 13 bp, Unknown
  misc_feature (1)..( 13): Matrix.004 file - promoters50/2991239
tcaataaaaaaaa

SEQ ID NO: 71323 - DNA, 13 bp, Unknown
  misc_feature (1)..( 13): Matrix.004 file - promoters50/2991239
agtaaaataaatg

SEQ ID NO: 71324 - DNA, 10 bp, Unknown
  misc_feature (1)..( 10): Matrix.004 file - promoters50/2991239
ataaaaaaaa

SEQ ID NO: 71325 - DNA, 8 bp, Unknown
  misc_feature (1)..( 8): Matrix.004 file - promoters50/2991239
caaaaaaa

SEQ ID NO: 71326 - DNA, 5 bp, Unknown
  misc_feature (1)..( 5): Matrix.004 file - promoters50/2991333
caaaa

SEQ ID NO: 71327 - DNA, 8 bp, Unknown
  misc_feature (1)..( 8): Matrix.004 file - promoters50/2991333
aaaataaa

SEQ ID NO: 71328 - DNA, 7 bp, Unknown
  misc_feature (1)..( 7): Matrix.004 file - promoters50/2991371
aataaag

SEQ ID NO: 71329 - DNA, 8 bp, Unknown
  misc_feature (1)..( 8): Matrix.004 file - promoters50/2991417
aacatctt

SEQ ID NO: 71330 - DNA, 11 bp, Unknown
  misc_feature (1)..( 11): Matrix.004 file - promoters50/2991417
aaccaaaaagt

SEQ ID NO: 71331 - DNA, 9 bp, Unknown
  misc_feature (1)..( 9): Matrix.004 file - promoters50/2991431
ttatcttac

SEQ ID NO: 71332 - DNA, 9 bp, Unknown
  misc_feature (1)..( 9): Matrix.004 file - promoters50/2991431
caaaattat

SEQ ID NO: 71333 - DNA, 7 bp, Unknown
  misc_feature (1)..( 7): Matrix.004 file - promoters50/2991431
aattaga

SEQ ID NO: 71334 - DNA, 11 bp, Unknown
  misc_feature (1)..( 11): Matrix.004 file - promoters50/2991431
gttttaaactc

SEQ ID NO: 71335 - DNA, 7 bp, Unknown
  misc_feature (1)..( 7): Matrix.004 file - promoters50/2991431
acaactt

SEQ ID NO: 71336 - DNA, 9 bp, Unknown
  misc_feature (1)..( 9): Matrix.004 file - promoters50/2991431
ttatttaaa

SEQ ID NO: 71337 - DNA, 8 bp, Unknown
  misc_feature (1)..( 8): Matrix.004 file - promoters50/2991431
atttagaa

SEQ ID NO: 71338 - DNA, 9 bp, Unknown
  misc_feature (1)..( 9): Matrix.004 file - promoters50/2991431
tgtttaatg

SEQ ID NO: 71339 - DNA, 9 bp, Unknown
  misc_feature (1)..( 9): Matrix.004 file - promoters50/2991431
ttataaaaa

SEQ ID NO: 71340 - DNA, 6 bp, Unknown
  misc_feature (1)..( 6): Matrix.004 file - promoters50/2991466
aaaaaa

SEQ ID NO: 71341 - DNA, 9 bp, Unknown
  misc_feature (1)..( 9): Matrix.004 file - promoters50/2991466
tcattttta

SEQ ID NO: 71342 - DNA, 8 bp, Unknown
  misc_feature (1)..( 8): Matrix.004 file - promoters50/2991466
taactaat

SEQ ID NO: 71343 - DNA, 10 bp, Unknown
  misc_feature (1)..( 10): Matrix.004 file - promoters50/2991466
atttttcaaa

SEQ ID NO: 71344 - DNA, 6 bp, Unknown
  misc_feature (1)..( 6): Matrix.004 file - promoters50/2991489
aaaaat

SEQ ID NO: 71345 - DNA, 7 bp, Unknown
  misc_feature (1)..( 7): Matrix.004 file - promoters50/2991489
ttatatt

SEQ ID NO: 71346 - DNA, 14 bp, Unknown
  misc_feature (1)..( 14): Matrix.004 file - promoters50/2991489
ttactttttatttt

SEQ ID NO: 71347 - DNA, 10 bp, Unknown
  misc_feature (1)..( 10): Matrix.004 file - promoters50/2991507
ctttttactt

SEQ ID NO: 71348 - DNA, 7 bp, Unknown
  misc_feature (1)..( 7): Matrix.004 file - promoters50/2991507
gatcgat

SEQ ID NO: 71349 - DNA, 7 bp, Unknown
  misc_feature (1)..( 7): Matrix.004 file - promoters50/2991507
tttcaca

SEQ ID NO: 71350 - DNA, 9 bp, Unknown
  misc_feature (1)..( 9): Matrix.004 file - promoters50/2991507
tgtttttta

SEQ ID NO: 71351 - DNA, 14 bp, Unknown
  misc_feature (1)..( 14): Matrix.004 file - promoters50/2991507
ttttactaactttc

SEQ ID NO: 71352 - DNA, 7 bp, Unknown
  misc_feature (1)..( 7): Matrix.004 file - promoters50/2991515
taaaatc

SEQ ID NO: 71353 - DNA, 9 bp, Unknown
  misc_feature (1)..( 9): Matrix.004 file - promoters50/2991515
tcatgttct

SEQ ID NO: 71354 - DNA, 8 bp, Unknown
  misc_feature (1)..( 8): Matrix.004 file - promoters50/2991515
tatggttt

SEQ ID NO: 71355 - DNA, 11 bp, Unknown
  misc_feature (1)..( 11): Matrix.004 file - promoters50/2991515
aaattgttttt

SEQ ID NO: 71356 - DNA, 9 bp, Unknown
  misc_feature (1)..( 9): Matrix.004 file - promoters50/2991515
agaaacagt

SEQ ID NO: 71357 - DNA, 11 bp, Unknown
  misc_feature (1)..( 11): Matrix.004 file - promoters50/2991515
aattaaaaact

SEQ ID NO: 71358 - DNA, 7 bp, Unknown
  misc_feature (1)..( 7): Matrix.004 file - promoters50/2991515
tttaata

SEQ ID NO: 71359 - DNA, 11 bp, Unknown
  misc_feature (1)..( 11): Matrix.004 file - promoters50/2991515
tataaattcat

SEQ ID NO: 71360 - DNA, 8 bp, Unknown
  misc_feature (1)..( 8): Matrix.004 file - promoters50/2991515
tgttctat

SEQ ID NO: 71361 - DNA, 11 bp, Unknown
  misc_feature (1)..( 11): Matrix.004 file - promoters50/2991515
ctttttttttg

SEQ ID NO: 71362 - DNA, 8 bp, Unknown
  misc_feature (1)..( 8): Matrix.004 file - promoters50/2991944
gaaacatt

SEQ ID NO: 71363 - DNA, 8 bp, Unknown
  misc_feature (1)..( 8): Matrix.004 file - promoters50/2991944
aataaatt

SEQ ID NO: 71364 - DNA, 11 bp, Unknown
  misc_feature (1)..( 11): Matrix.004 file - promoters50/2991944
acatgataagc

SEQ ID NO: 71365 - DNA, 10 bp, Unknown
  misc_feature (1)..( 10): Matrix.004 file - promoters50/2991944
aaaagtctaa

SEQ ID NO: 71366 - DNA, 8 bp, Unknown
  misc_feature (1)..( 8): Matrix.004 file - promoters50/2991944
ggcccatt

SEQ ID NO: 71367 - DNA, 8 bp, Unknown
  misc_feature (1)..( 8): Matrix.004 file - promoters50/2991944
ttcattac

SEQ ID NO: 71368 - DNA, 9 bp, Unknown
  misc_feature (1)..( 9): Matrix.004 file - promoters50/2991944
tttaatatt

SEQ ID NO: 71369 - DNA, 7 bp, Unknown
  misc_feature (1)..( 7): Matrix.004 file - promoters50/2991944
aaaaatt

SEQ ID NO: 71370 - DNA, 9 bp, Unknown
  misc_feature (1)..( 9): Matrix.004 file - promoters50/2991944
ataattaca

SEQ ID NO: 71371 - DNA, 10 bp, Unknown
  misc_feature (1)..( 10): Matrix.004 file - promoters50/2991955
aataactgat

SEQ ID NO: 71372 - DNA, 7 bp, Unknown
  misc_feature (1)..( 7): Matrix.004 file - promoters50/2991974
attaatt

SEQ ID NO: 71373 - DNA, 11 bp, Unknown
  misc_feature (1)..( 11): Matrix.004 file - promoters50/2992000
agttgtttttt

SEQ ID NO: 71374 - DNA, 11 bp, Unknown
  misc_feature (1)..( 11): Matrix.004 file - promoters50/2992181
attggaaagac

SEQ ID NO: 71375 - DNA, 7 bp, Unknown
  misc_feature (1)..( 7): Matrix.004 file - promoters50/2992181
ttaaaat

SEQ ID NO: 71376 - DNA, 7 bp, Unknown
  misc_feature (1)..( 7): Matrix.004 file - promoters50/2992181
gttatct

SEQ ID NO: 71377 - DNA, 7 bp, Unknown
  misc_feature (1)..( 7): Matrix.004 file - promoters50/2992181
tttacgt

SEQ ID NO: 71378 - DNA, 9 bp, Unknown
  misc_feature (1)..( 9): Matrix.004 file - promoters50/2992181
cataataat

SEQ ID NO: 71379 - DNA, 7 bp, Unknown
  misc_feature (1)..( 7): Matrix.004 file - promoters50/2992181
aacaaat

SEQ ID NO: 71380 - DNA, 8 bp, Unknown
  misc_feature (1)..( 8): Matrix.004 file - promoters50/2992316
aaagacaa

SEQ ID NO: 71381 - DNA, 9 bp, Unknown
  misc_feature (1)..( 9): Matrix.004 file - promoters50/2992316
catatcatc

SEQ ID NO: 71382 - DNA, 11 bp, Unknown
  misc_feature (1)..( 11): Matrix.004 file - promoters50/2992349
tccaaccattc

SEQ ID NO: 71383 - DNA, 11 bp, Unknown
  misc_feature (1)..( 11): Matrix.004 file - promoters50/2992349
atttatttcat

SEQ ID NO: 71384 - DNA, 11 bp, Unknown
  misc_feature (1)..( 11): Matrix.004 file - promoters50/2992349
aaaacaaaaaa

SEQ ID NO: 71385 - DNA, 9 bp, Unknown
  misc_feature (1)..( 9): Matrix.004 file - promoters50/2992349
taacaaata

SEQ ID NO: 71386 - DNA, 10 bp, Unknown
  misc_feature (1)..( 10): Matrix.004 file - promoters50/2992349
aaaaacaaaa

SEQ ID NO: 71387 - DNA, 10 bp, Unknown
  misc_feature (1)..( 10): Matrix.004 file - promoters50/2992349
agaaaataca

SEQ ID NO: 71388 - DNA, 7 bp, Unknown
  misc_feature (1)..( 7): Matrix.004 file - promoters50/2992349
attatat

SEQ ID NO: 71389 - DNA, 14 bp, Unknown
  misc_feature (1)..( 14): Matrix.004 file - promoters50/2992349
ctaaaaactaaatt

SEQ ID NO: 71390 - DNA, 10 bp, Unknown
  misc_feature (1)..( 10): Matrix.004 file - promoters50/2992349
aaaatacaga

SEQ ID NO: 71391 - DNA, 14 bp, Unknown
  misc_feature (1)..( 14): Matrix.004 file - promoters50/2992396
taaaaacaaaaatt

SEQ ID NO: 71392 - DNA, 11 bp, Unknown
  misc_feature (1)..( 11): Matrix.004 file - promoters50/2992722
agccacaagcg

SEQ ID NO: 71393 - DNA, 8 bp, Unknown
  misc_feature (1)..( 8): Matrix.004 file - promoters50/2993154
attgtata

SEQ ID NO: 71394 - DNA, 12 bp, Unknown
  misc_feature (1)..( 12): Matrix.004 file - promoters50/2993154
cattctaaagaa

SEQ ID NO: 71395 - DNA, 11 bp, Unknown
  misc_feature (1)..( 11): Matrix.004 file - promoters50/2993154
ctaaagaactt

SEQ ID NO: 71396 - DNA, 9 bp, Unknown
  misc_feature (1)..( 9): Matrix.004 file - promoters50/2993154
gtttaattt

SEQ ID NO: 71397 - DNA, 9 bp, Unknown
  misc_feature (1)..( 9): Matrix.004 file - promoters50/2993154
ttttcaagt

SEQ ID NO: 71398 - DNA, 9 bp, Unknown
  misc_feature (1)..( 9): Matrix.004 file - promoters50/2993154
aaattagat

SEQ ID NO: 71399 - DNA, 7 bp, Unknown
  misc_feature (1)..( 7): Matrix.004 file - promoters50/2993154
attattt

SEQ ID NO: 71400 - DNA, 13 bp, Unknown
  misc_feature (1)..( 13): Matrix.004 file - promoters50/2993240
aattaaaaataaa

SEQ ID NO: 71401 - DNA, 9 bp, Unknown
  misc_feature (1)..( 9): Matrix.004 file - promoters50/2993240
aatttaaac

SEQ ID NO: 71402 - DNA, 6 bp, Unknown
  misc_feature (1)..( 6): Matrix.004 file - promoters50/2993642
aaccgt

SEQ ID NO: 71403 - DNA, 9 bp, Unknown
  misc_feature (1)..( 9): Matrix.004 file - promoters50/2993642
gattctttt

SEQ ID NO: 71404 - DNA, 14 bp, Unknown
  misc_feature (1)..( 14): Matrix.004 file - promoters50/2994131
aaaaaaatatttaa

SEQ ID NO: 71405 - DNA, 8 bp, Unknown
  misc_feature (1)..( 8): Matrix.004 file - promoters50/2994131
acataaga

SEQ ID NO: 71406 - DNA, 7 bp, Unknown
  misc_feature (1)..( 7): Matrix.004 file - promoters50/2994131
ggcccat

SEQ ID NO: 71407 - DNA, 9 bp, Unknown
  misc_feature (1)..( 9): Matrix.004 file - promoters50/2994131
attttaaaa

SEQ ID NO: 71408 - DNA, 9 bp, Unknown
  misc_feature (1)..( 9): Matrix.004 file - promoters50/2994131
tacaacaac

SEQ ID NO: 71409 - DNA, 9 bp, Unknown
  misc_feature (1)..( 9): Matrix.004 file - promoters50/2994202
taaaactac

SEQ ID NO: 71410 - DNA, 12 bp, Unknown
  misc_feature (1)..( 12): Matrix.004 file - promoters50/2994225
taaacatttgga

SEQ ID NO: 71411 - DNA, 7 bp, Unknown
  misc_feature (1)..( 7): Matrix.004 file - promoters50/2994869
tttttat

SEQ ID NO: 71412 - DNA, 8 bp, Unknown
  misc_feature (1)..( 8): Matrix.004 file - promoters50/2994916
aaagattc

SEQ ID NO: 71413 - DNA, 10 bp, Unknown
  misc_feature (1)..( 10): Matrix.004 file - promoters50/2994916
taaaacaaac

SEQ ID NO: 71414 - DNA, 13 bp, Unknown
  misc_feature (1)..( 13): Matrix.004 file - promoters50/2994916
aaatactaaaaca

SEQ ID NO: 71415 - DNA, 12 bp, Unknown
  misc_feature (1)..( 12): Matrix.004 file - promoters50/2994916
acaccaatctta

SEQ ID NO: 71416 - DNA, 11 bp, Unknown
  misc_feature (1)..( 11): Matrix.004 file - promoters50/2994916
attaaaaaaat

SEQ ID NO: 71417 - DNA, 7 bp, Unknown
  misc_feature (1)..( 7): Matrix.004 file - promoters50/2994916
aaaacaa

SEQ ID NO: 71418 - DNA, 10 bp, Unknown
  misc_feature (1)..( 10): Matrix.004 file - promoters50/2994916
ataaaatttt

SEQ ID NO: 71419 - DNA, 7 bp, Unknown
  misc_feature (1)..( 7): Matrix.004 file - promoters50/2994916
ataattt

SEQ ID NO: 71420 - DNA, 12 bp, Unknown
  misc_feature (1)..( 12): Matrix.004 file - promoters50/2994916
gaatttctcaat

SEQ ID NO: 71421 - DNA, 12 bp, Unknown
  misc_feature (1)..( 12): Matrix.004 file - promoters50/2995201
tttatatataaa

SEQ ID NO: 71422 - DNA, 9 bp, Unknown
  misc_feature (1)..( 9): Matrix.004 file - promoters50/2995201
aatttataa

SEQ ID NO: 71423 - DNA, 7 bp, Unknown
  misc_feature (1)..( 7): Matrix.004 file - promoters50/2995201
aaaatta

SEQ ID NO: 71424 - DNA, 10 bp, Unknown
  misc_feature (1)..( 10): Matrix.004 file - promoters50/2995201
taaattttgg

SEQ ID NO: 71425 - DNA, 8 bp, Unknown
  misc_feature (1)..( 8): Matrix.004 file - promoters50/2995898
aacataag

SEQ ID NO: 71426 - DNA, 7 bp, Unknown
  misc_feature (1)..( 7): Matrix.004 file - promoters50/2995898
agagaaa

SEQ ID NO: 71427 - DNA, 10 bp, Unknown
  misc_feature (1)..( 10): Matrix.004 file - promoters50/2995898
tgacgatgaa

SEQ ID NO: 71428 - DNA, 8 bp, Unknown
  misc_feature (1)..( 8): Matrix.004 file - promoters50/2995898
gataattt

SEQ ID NO: 71429 - DNA, 6 bp, Unknown
  misc_feature (1)..( 6): Matrix.004 file - promoters50/2995898
ataata

SEQ ID NO: 71430 - DNA, 12 bp, Unknown
  misc_feature (1)..( 12): Matrix.004 file - promoters50/2996021
tttaagttttta

SEQ ID NO: 71431 - DNA, 11 bp, Unknown
  misc_feature (1)..( 11): Matrix.004 file - promoters50/2996054
tccgatcacaa

SEQ ID NO: 71432 - DNA, 6 bp, Unknown
  misc_feature (1)..( 6): Matrix.004 file - promoters50/2996054
caaaaa

SEQ ID NO: 71433 - DNA, 10 bp, Unknown
  misc_feature (1)..( 10): Matrix.004 file - promoters50/2996054
tgttttcact

SEQ ID NO: 71434 - DNA, 10 bp, Unknown
  misc_feature (1)..( 10): Matrix.004 file - promoters50/2996054
aactttttat

SEQ ID NO: 71435 - DNA, 9 bp, Unknown
  misc_feature (1)..( 9): Matrix.004 file - promoters50/2996080
ctgtcaaag

SEQ ID NO: 71436 - DNA, 9 bp, Unknown
  misc_feature (1)..( 9): Matrix.004 file - promoters50/2996092
ataaagata

SEQ ID NO: 71437 - DNA, 10 bp, Unknown
  misc_feature (1)..( 10): Matrix.004 file - promoters50/2996109
aagattaata

SEQ ID NO: 71438 - DNA, 8 bp, Unknown
  misc_feature (1)..( 8): Matrix.004 file - promoters50/2996109
attatttt

SEQ ID NO: 71439 - DNA, 13 bp, Unknown
  misc_feature (1)..( 13): Matrix.004 file - promoters50/2996109
taattaaatataa

SEQ ID NO: 71440 - DNA, 13 bp, Unknown
  misc_feature (1)..( 13): Matrix.004 file - promoters50/2996109
taataaaacataa

SEQ ID NO: 71441 - DNA, 7 bp, Unknown
  misc_feature (1)..( 7): Matrix.004 file - promoters50/2996109
aaacatc

SEQ ID NO: 71442 - DNA, 8 bp, Unknown
  misc_feature (1)..( 8): Matrix.004 file - promoters50/2996109
aatatata

SEQ ID NO: 71443 - DNA, 7 bp, Unknown
  misc_feature (1)..( 7): Matrix.004 file - promoters50/2996109
tattata

SEQ ID NO: 71444 - DNA, 13 bp, Unknown
  misc_feature (1)..( 13): Matrix.004 file - promoters50/2996109
aacaagtcaaaaa

SEQ ID NO: 71445 - DNA, 7 bp, Unknown
  misc_feature (1)..( 7): Matrix.004 file - promoters50/2996109
aaaaaag

SEQ ID NO: 71446 - DNA, 8 bp, Unknown
  misc_feature (1)..( 8): Matrix.004 file - promoters50/2996115
ttttgtat

SEQ ID NO: 71447 - DNA, 8 bp, Unknown
  misc_feature (1)..( 8): Matrix.004 file - promoters50/2996115
tttttact

SEQ ID NO: 71448 - DNA, 11 bp, Unknown
  misc_feature (1)..( 11): Matrix.004 file - promoters50/2996115
tttaaaatata

SEQ ID NO: 71449 - DNA, 9 bp, Unknown
  misc_feature (1)..( 9): Matrix.004 file - promoters50/2996115
aattcccac

SEQ ID NO: 71450 - DNA, 10 bp, Unknown
  misc_feature (1)..( 10): Matrix.004 file - promoters50/2996119
caaagttgtt

SEQ ID NO: 71451 - DNA, 9 bp, Unknown
  misc_feature (1)..( 9): Matrix.004 file - promoters50/2996222
aaaaaacga

SEQ ID NO: 71452 - DNA, 16 bp, Unknown
  misc_feature (1)..( 16): Matrix.004 file - promoters50/2996222
aaaatttgaatgtaaa

SEQ ID NO: 71453 - DNA, 10 bp, Unknown
  misc_feature (1)..( 10): Matrix.004 file - promoters50/2996222
tttactaaaa

SEQ ID NO: 71454 - DNA, 11 bp, Unknown
  misc_feature (1)..( 11): Matrix.004 file - promoters50/2996222
ataatttttag

SEQ ID NO: 71455 - DNA, 11 bp, Unknown
  misc_feature (1)..( 11): Matrix.004 file - promoters50/2996222
ataattttact

SEQ ID NO: 71456 - DNA, 11 bp, Unknown
  misc_feature (1)..( 11): Matrix.004 file - promoters50/2996222
actatatataa

SEQ ID NO: 71457 - DNA, 9 bp, Unknown
  misc_feature (1)..( 9): Matrix.004 file - promoters50/2996222
taattatat

SEQ ID NO: 71458 - DNA, 10 bp, Unknown
  misc_feature (1)..( 10): Matrix.004 file - promoters50/2996281
atatttgtta

SEQ ID NO: 71459 - DNA, 8 bp, Unknown
  misc_feature (1)..( 8): Matrix.004 file - promoters50/2996281
atcaaaaa

SEQ ID NO: 71460 - DNA, 8 bp, Unknown
  misc_feature (1)..( 8): Matrix.004 file - promoters50/2996290
taagtttt

SEQ ID NO: 71461 - DNA, 17 bp, Unknown
  misc_feature (1)..( 17): Matrix.004 file - promoters50/2997951
cacaaggacaactttca

SEQ ID NO: 71462 - DNA, 14 bp, Unknown
  misc_feature (1)..( 14): Matrix.004 file - promoters50/2997951
cacttttctcaatc

SEQ ID NO: 71463 - DNA, 10 bp, Unknown
  misc_feature (1)..( 10): Matrix.004 file - promoters50/2997951
ttaaaatatt

SEQ ID NO: 71464 - DNA, 8 bp, Unknown
  misc_feature (1)..( 8): Matrix.004 file - promoters50/2997951
taatcaca

SEQ ID NO: 71465 - DNA, 11 bp, Unknown
  misc_feature (1)..( 11): Matrix.004 file - promoters50/3003006
tacaatactat

SEQ ID NO: 71466 - DNA, 8 bp, Unknown
  misc_feature (1)..( 8): Matrix.004 file - promoters50/3003006
gaaacttc

SEQ ID NO: 71467 - DNA, 10 bp, Unknown
  misc_feature (1)..( 10): Matrix.004 file - promoters50/3003006
gaaattagat

SEQ ID NO: 71468 - DNA, 10 bp, Unknown
  misc_feature (1)..( 10): Matrix.004 file - promoters50/3003010
tagatcgaaa

SEQ ID NO: 71469 - DNA, 9 bp, Unknown
  misc_feature (1)..( 9): Matrix.004 file - promoters50/3003010
atcaatttt

SEQ ID NO: 71470 - DNA, 7 bp, Unknown
  misc_feature (1)..( 7): Matrix.004 file - promoters50/3003010
taataat

SEQ ID NO: 71471 - DNA, 7 bp, Unknown
  misc_feature (1)..( 7): Matrix.004 file - promoters50/3003010
caatatt

SEQ ID NO: 71472 - DNA, 8 bp, Unknown
  misc_feature (1)..( 8): Matrix.004 file - promoters50/3011901
acataaaa

SEQ ID NO: 71473 - DNA, 6 bp, Unknown
  misc_feature (1)..( 6): Matrix.004 file - promoters50/3011901
agaaaa

SEQ ID NO: 71474 - DNA, 8 bp, Unknown
  misc_feature (1)..( 8): Matrix.004 file - promoters50/3011901
gagtgaaa

SEQ ID NO: 71475 - DNA, 9 bp, Unknown
  misc_feature (1)..( 9): Matrix.004 file - promoters50/3011901
taacataaa

SEQ ID NO: 71476 - DNA, 8 bp, Unknown
  misc_feature (1)..( 8): Matrix.004 file - promoters50/3011901
agtgcaac

SEQ ID NO: 71477 - DNA, 10 bp, Unknown
  misc_feature (1)..( 10): Matrix.004 file - promoters50/3011901
tttaaaaaat

SEQ ID NO: 71478 - DNA, 12 bp, Unknown
  misc_feature (1)..( 12): Matrix.004 file - promoters50/3020615
gatgatatatta

SEQ ID NO: 71479 - DNA, 8 bp, Unknown
  misc_feature (1)..( 8): Matrix.004 file - promoters50/3036674
ctttttgc

SEQ ID NO: 71480 - DNA, 9 bp, Unknown
  misc_feature (1)..( 9): Matrix.004 file - promoters50/3043322
caaaacaaa

SEQ ID NO: 71481 - DNA, 11 bp, Unknown
  misc_feature (1)..( 11): Matrix.004 file - promoters50/3043322
aaaaaaaatca

SEQ ID NO: 71482 - DNA, 15 bp, Unknown
  misc_feature (1)..( 15): Matrix.004 file - promoters50/3043322
aattactaaattttt

SEQ ID NO: 71483 - DNA, 9 bp, Unknown
  misc_feature (1)..( 9): Matrix.004 file - promoters50/3043962
aaaacaaat

SEQ ID NO: 71484 - DNA, 10 bp, Unknown
  misc_feature (1)..( 10): Matrix.004 file - promoters50/3043962
aaactattta

SEQ ID NO: 71485 - DNA, 12 bp, Unknown
  misc_feature (1)..( 12): Matrix.004 file - promoters50/3043962
aatacttaataa

SEQ ID NO: 71486 - DNA, 7 bp, Unknown
  misc_feature (1)..( 7): Matrix.004 file - promoters50/3046192
aaactat

SEQ ID NO: 71487 - DNA, 9 bp, Unknown
  misc_feature (1)..( 9): Matrix.004 file - promoters50/3046192
agaaatctg

SEQ ID NO: 71488 - DNA, 10 bp, Unknown
  misc_feature (1)..( 10): Matrix.004 file - promoters50/3062012
agaaatatgt

SEQ ID NO: 71489 - DNA, 11 bp, Unknown
  misc_feature (1)..( 11): Matrix.004 file - promoters50/3062012
atatttataat

SEQ ID NO: 71490 - DNA, 14 bp, Unknown
  misc_feature (1)..( 14): Matrix.004 file - promoters50/3062012
tttcaaaaatatta

SEQ ID NO: 71491 - DNA, 10 bp, Unknown
  misc_feature (1)..( 10): Matrix.004 file - promoters50/3062012
taaataaatt

SEQ ID NO: 71492 - DNA, 12 bp, Unknown
  misc_feature (1)..( 12): Matrix.004 file - promoters50/3062012
ttaaaaaattta

SEQ ID NO: 71493 - DNA, 8 bp, Unknown
  misc_feature (1)..( 8): Matrix.004 file - promoters50/3062012
ttaaaatc

SEQ ID NO: 71494 - DNA, 7 bp, Unknown
  misc_feature (1)..( 7): Matrix.004 file - promoters50/3062012
tgaaata

SEQ ID NO: 71495 - DNA, 9 bp, Unknown
  misc_feature (1)..( 9): Matrix.004 file - promoters50/3062012
attaaaaaa

SEQ ID NO: 71496 - DNA, 12 bp, Unknown
  misc_feature (1)..( 12): Matrix.004 file - promoters50/3062012
tcccaaattttt

SEQ ID NO: 71497 - DNA, 10 bp, Unknown
  misc_feature (1)..( 10): Matrix.004 file - promoters50/3062012
tttatttaaa

SEQ ID NO: 71498 - DNA, 11 bp, Unknown
  misc_feature (1)..( 11): Matrix.004 file - promoters50/3062012
tatttaaaata

SEQ ID NO: 71499 - DNA, 8 bp, Unknown
  misc_feature (1)..( 8): Matrix.004 file - promoters50/3062012
aatcaaaa

SEQ ID NO: 71500 - DNA, 9 bp, Unknown
  misc_feature (1)..( 9): Matrix.004 file - promoters50/3062012
aaaatttat

SEQ ID NO: 71501 - DNA, 14 bp, Unknown
  misc_feature (1)..( 14): Matrix.004 file - promoters50/3062012
ttttaaaaaatata

SEQ ID NO: 71502 - DNA, 14 bp, Unknown
  misc_feature (1)..( 14): Matrix.004 file - promoters50/3238306
ttttaaaaaatatt

SEQ ID NO: 71503 - DNA, 11 bp, Unknown
  misc_feature (1)..( 11): Matrix.004 file - promoters50/3238306
gtttgggcgag

SEQ ID NO: 71504 - DNA, 8 bp, Unknown
  misc_feature (1)..( 8): Matrix.004 file - promoters50/3238306
aaaaatat

SEQ ID NO: 71505 - DNA, 7 bp, Unknown
  misc_feature (1)..( 7): Matrix.004 file - promoters50/3238306
gattaat

SEQ ID NO: 71506 - DNA, 8 bp, Unknown
  misc_feature (1)..( 8): Matrix.004 file - promoters50/3239163
gttggaga

SEQ ID NO: 71507 - DNA, 10 bp, Unknown
  misc_feature (1)..( 10): Matrix.004 file - promoters50/3239163
aagtgtgtga

SEQ ID NO: 71508 - DNA, 7 bp, Unknown
  misc_feature (1)..( 7): Matrix.004 file - promoters50/3239163
aatatat

SEQ ID NO: 71509 - DNA, 9 bp, Unknown
  misc_feature (1)..( 9): Matrix.004 file - promoters50/3239175
atacacata

SEQ ID NO: 71510 - DNA, 8 bp, Unknown
  misc_feature (1)..( 8): Matrix.004 file - promoters50/3239175
gaaagaca

SEQ ID NO: 71511 - DNA, 9 bp, Unknown
  misc_feature (1)..( 9): Matrix.004 file - promoters50/3239175
aaaggaaaa

SEQ ID NO: 71512 - DNA, 9 bp, Unknown
  misc_feature (1)..( 9): Matrix.004 file - promoters50/3245308
gagtatata

SEQ ID NO: 71513 - DNA, 10 bp, Unknown
  misc_feature (1)..( 10): Matrix.004 file - promoters50/3245308
ttcaatttca

SEQ ID NO: 71514 - DNA, 7 bp, Unknown
  misc_feature (1)..( 7): Matrix.004 file - promoters50/3245308
aaattag

SEQ ID NO: 71515 - DNA, 7 bp, Unknown
  misc_feature (1)..( 7): Matrix.004 file - promoters50/3245308
tagtgtt

SEQ ID NO: 71516 - DNA, 7 bp, Unknown
  misc_feature (1)..( 7): Matrix.004 file - promoters50/3245330
ttcaatt

SEQ ID NO: 71517 - DNA, 9 bp, Unknown
  misc_feature (1)..( 9): Matrix.004 file - promoters50/3245330
tggttgatt

SEQ ID NO: 71518 - DNA, 8 bp, Unknown
  misc_feature (1)..( 8): Matrix.004 file - promoters50/3408983
attctttt

SEQ ID NO: 71519 - DNA, 13 bp, Unknown
  misc_feature (1)..( 13): Matrix.004 file - promoters50/3409019
aatgtgaatttac

SEQ ID NO: 71520 - DNA, 11 bp, Unknown
  misc_feature (1)..( 11): Matrix.004 file - promoters50/3409052
tttgaaacata

SEQ ID NO: 71521 - DNA, 8 bp, Unknown
  misc_feature (1)..( 8): Matrix.004 file - promoters50/3409052
tataaaaa

SEQ ID NO: 71522 - DNA, 8 bp, Unknown
  misc_feature (1)..( 8): Matrix.004 file - promoters50/3409075
taaaaagt

SEQ ID NO: 71523 - DNA, 12 bp, Unknown
  misc_feature (1)..( 12): Matrix.004 file - promoters50/3409075
agatttatatgc

SEQ ID NO: 71524 - DNA, 9 bp, Unknown
  misc_feature (1)..( 9): Matrix.004 file - promoters50/3409075
tattttatg

SEQ ID NO: 71525 - DNA, 9 bp, Unknown
  misc_feature (1)..( 9): Matrix.004 file - promoters50/3409075
gaatcgaaa

SEQ ID NO: 71526 - DNA, 13 bp, Unknown
  misc_feature (1)..( 13): Matrix.004 file - promoters50/3409141
aatttaatatttt

SEQ ID NO: 71527 - DNA, 10 bp, Unknown
  misc_feature (1)..( 10): Matrix.004 file - promoters50/3409141
aagcaaaaaa

SEQ ID NO: 71528 - DNA, 9 bp, Unknown
  misc_feature (1)..( 9): Matrix.004 file - promoters50/3409141
ctttataga

SEQ ID NO: 71529 - DNA, 7 bp, Unknown
  misc_feature (1)..( 7): Matrix.004 file - promoters50/3409141
taaatct

SEQ ID NO: 71530 - DNA, 8 bp, Unknown
  misc_feature (1)..( 8): Matrix.004 file - promoters50/3409141
ttttcaaa

SEQ ID NO: 71531 - DNA, 7 bp, Unknown
  misc_feature (1)..( 7): Matrix.004 file - promoters50/3409141
taaaatc

SEQ ID NO: 71532 - DNA, 6 bp, Unknown
  misc_feature (1)..( 6): Matrix.004 file - promoters50/3409141
aaaaaa

SEQ ID NO: 71533 - DNA, 7 bp, Unknown
  misc_feature (1)..( 7): Matrix.004 file - promoters50/3409141
tttttta

SEQ ID NO: 71534 - DNA, 10 bp, Unknown
  misc_feature (1)..( 10): Matrix.004 file - promoters50/3409161
ttttaataac

SEQ ID NO: 71535 - DNA, 10 bp, Unknown
  misc_feature (1)..( 10): Matrix.004 file - promoters50/3409165
ataaattttg

SEQ ID NO: 71536 - DNA, 10 bp, Unknown
  misc_feature (1)..( 10): Matrix.004 file - promoters50/3409165
caaaacaact

SEQ ID NO: 71537 - DNA, 12 bp, Unknown
  misc_feature (1)..( 12): Matrix.004 file - promoters50/3409191
agatttatttca

SEQ ID NO: 71538 - DNA, 12 bp, Unknown
  misc_feature (1)..( 12): Matrix.004 file - promoters50/3409214
gtttgtatgcag

SEQ ID NO: 71539 - DNA, 14 bp, Unknown
  misc_feature (1)..( 14): Matrix.004 file - promoters50/3409390
ctttctacaattaa

SEQ ID NO: 71540 - DNA, 9 bp, Unknown
  misc_feature (1)..( 9): Matrix.004 file - promoters50/3409390
agtatttaa

SEQ ID NO: 71541 - DNA, 9 bp, Unknown
  misc_feature (1)..( 9): Matrix.004 file - promoters50/3409390
gtttttata

SEQ ID NO: 71542 - DNA, 13 bp, Unknown
  misc_feature (1)..( 13): Matrix.004 file - promoters50/3409390
taattatatataa

SEQ ID NO: 71543 - DNA, 11 bp, Unknown
  misc_feature (1)..( 11): Matrix.004 file - promoters50/3409390
tctttatttta

SEQ ID NO: 71544 - DNA, 8 bp, Unknown
  misc_feature (1)..( 8): Matrix.004 file - promoters50/3409390
attttata

SEQ ID NO: 71545 - DNA, 14 bp, Unknown
  misc_feature (1)..( 14): Matrix.004 file - promoters50/3409390
aatattataaacat

SEQ ID NO: 71546 - DNA, 10 bp, Unknown
  misc_feature (1)..( 10): Matrix.004 file - promoters50/3409489
attataaagt

SEQ ID NO: 71547 - DNA, 9 bp, Unknown
  misc_feature (1)..( 9): Matrix.004 file - promoters50/3409631
aaatgatta

SEQ ID NO: 71548 - DNA, 11 bp, Unknown
  misc_feature (1)..( 11): Matrix.004 file - promoters50/3409637
ttttcttataa

SEQ ID NO: 71549 - DNA, 11 bp, Unknown
  misc_feature (1)..( 11): Matrix.004 file - promoters50/3409637
tatggatttaa

SEQ ID NO: 71550 - DNA, 12 bp, Unknown
  misc_feature (1)..( 12): Matrix.004 file - promoters50/3409637
aatgttaatttt

SEQ ID NO: 71551 - DNA, 6 bp, Unknown
  misc_feature (1)..( 6): Matrix.004 file - promoters50/3409637
ataatt

SEQ ID NO: 71552 - DNA, 9 bp, Unknown
  misc_feature (1)..( 9): Matrix.004 file - promoters50/3409637
tttggtttg

SEQ ID NO: 71553 - DNA, 11 bp, Unknown
  misc_feature (1)..( 11): Matrix.004 file - promoters50/3409712
gactaaaaatt

SEQ ID NO: 71554 - DNA, 6 bp, Unknown
  misc_feature (1)..( 6): Matrix.004 file - promoters50/3433703
caaaaa

SEQ ID NO: 71555 - DNA, 13 bp, Unknown
  misc_feature (1)..( 13): Matrix.004 file - promoters50/3433703
ataattttaaaaa

SEQ ID NO: 71556 - DNA, 13 bp, Unknown
  misc_feature (1)..( 13): Matrix.004 file - promoters50/3433703
aaaataaaacaat

SEQ ID NO: 71557 - DNA, 10 bp, Unknown
  misc_feature (1)..( 10): Matrix.004 file - promoters50/3433703
tatataaata

SEQ ID NO: 71558 - DNA, 10 bp, Unknown
  misc_feature (1)..( 10): Matrix.004 file - promoters50/3433703
atttactaaa

SEQ ID NO: 71559 - DNA, 10 bp, Unknown
  misc_feature (1)..( 10): Matrix.004 file - promoters50/3433703
aaatgatttc

SEQ ID NO: 71560 - DNA, 8 bp, Unknown
  misc_feature (1)..( 8): Matrix.004 file - promoters50/3433703
aaattttt

SEQ ID NO: 71561 - DNA, 13 bp, Unknown
  misc_feature (1)..( 13): Matrix.004 file - promoters50/3433743
caaataattctta

SEQ ID NO: 71562 - DNA, 10 bp, Unknown
  misc_feature (1)..( 10): Matrix.004 file - promoters50/3433743
ttgagatttt

SEQ ID NO: 71563 - DNA, 8 bp, Unknown
  misc_feature (1)..( 8): Matrix.004 file - promoters50/3433799
aaatttcg

SEQ ID NO: 71564 - DNA, 12 bp, Unknown
  misc_feature (1)..( 12): Matrix.004 file - promoters50/3433799
gattgataacag

SEQ ID NO: 71565 - DNA, 7 bp, Unknown
  misc_feature (1)..( 7): Matrix.004 file - promoters50/3433799
tggaaaa

SEQ ID NO: 71566 - DNA, 9 bp, Unknown
  misc_feature (1)..( 9): Matrix.004 file - promoters50/3433799
aaaccattt

SEQ ID NO: 71567 - DNA, 10 bp, Unknown
  misc_feature (1)..( 10): Matrix.004 file - promoters50/3433854
actttataat

SEQ ID NO: 71568 - DNA, 7 bp, Unknown
  misc_feature (1)..( 7): Matrix.004 file - promoters50/3433854
gataaac

SEQ ID NO: 71569 - DNA, 8 bp, Unknown
  misc_feature (1)..( 8): Matrix.004 file - promoters50/3433854
tgacaaaa

SEQ ID NO: 71570 - DNA, 7 bp, Unknown
  misc_feature (1)..( 7): Matrix.004 file - promoters50/3433904
attttat

SEQ ID NO: 71571 - DNA, 10 bp, Unknown
  misc_feature (1)..( 10): Matrix.004 file - promoters50/3433926
agtataaatc

SEQ ID NO: 71572 - DNA, 9 bp, Unknown
  misc_feature (1)..( 9): Matrix.004 file - promoters50/3433933
gaacaaaaa

SEQ ID NO: 71573 - DNA, 10 bp, Unknown
  misc_feature (1)..( 10): Matrix.004 file - promoters50/3433944
atgtttcttg

SEQ ID NO: 71574 - DNA, 9 bp, Unknown
  misc_feature (1)..( 9): Matrix.004 file - promoters50/3433944
aaaatatga

SEQ ID NO: 71575 - DNA, 9 bp, Unknown
  misc_feature (1)..( 9): Matrix.004 file - promoters50/3433944
taacaaatt

SEQ ID NO: 71576 - DNA, 9 bp, Unknown
  misc_feature (1)..( 9): Matrix.004 file - promoters50/3433944
gaaaaaaaa

SEQ ID NO: 71577 - DNA, 12 bp, Unknown
  misc_feature (1)..( 12): Matrix.004 file - promoters50/3433958
ataaaaatactt

SEQ ID NO: 71578 - DNA, 7 bp, Unknown
  misc_feature (1)..( 7): Matrix.004 file - promoters50/3433978
agaaaca

SEQ ID NO: 71579 - DNA, 9 bp, Unknown
  misc_feature (1)..( 9): Matrix.004 file - promoters50/3433978
tgaacttaa

SEQ ID NO: 71580 - DNA, 15 bp, Unknown
  misc_feature (1)..( 15): Matrix.004 file - promoters50/3433978
gacataaactttcat

SEQ ID NO: 71581 - DNA, 9 bp, Unknown
  misc_feature (1)..( 9): Matrix.004 file - promoters50/3433978
aaatttatt

SEQ ID NO: 71582 - DNA, 9 bp, Unknown
  misc_feature (1)..( 9): Matrix.004 file - promoters50/3433989
aaaataaaa

SEQ ID NO: 71583 - DNA, 8 bp, Unknown
  misc_feature (1)..( 8): Matrix.004 file - promoters50/3433989
gagatgag

SEQ ID NO: 71584 - DNA, 9 bp, Unknown
  misc_feature (1)..( 9): Matrix.004 file - promoters50/3433989
gtgaagatg

SEQ ID NO: 71585 - DNA, 9 bp, Unknown
  misc_feature (1)..( 9): Matrix.004 file - promoters50/3433998
acgagtttg

SEQ ID NO: 71586 - DNA, 7 bp, Unknown
  misc_feature (1)..( 7): Matrix.004 file - promoters50/3433998
tacatat

SEQ ID NO: 71587 - DNA, 8 bp, Unknown
  misc_feature (1)..( 8): Matrix.004 file - promoters50/3433998
ataaaaag

SEQ ID NO: 71588 - DNA, 12 bp, Unknown
  misc_feature (1)..( 12): Matrix.004 file - promoters50/3433998
gattaaaaaaaa

SEQ ID NO: 71589 - DNA, 14 bp, Unknown
  misc_feature (1)..( 14): Matrix.004 file - promoters50/3433998
taataaaaaaatat

SEQ ID NO: 71590 - DNA, 10 bp, Unknown
  misc_feature (1)..( 10): Matrix.004 file - promoters50/3433998
gattttaaaa

SEQ ID NO: 71591 - DNA, 11 bp, Unknown
  misc_feature (1)..( 11): Matrix.004 file - promoters50/3433998
atcttatctaa

SEQ ID NO: 71592 - DNA, 11 bp, Unknown
  misc_feature (1)..( 11): Matrix.004 file - promoters50/3434028
gattctaataa

SEQ ID NO: 71593 - DNA, 10 bp, Unknown
  misc_feature (1)..( 10): Matrix.004 file - promoters50/3434028
ttaaatcaaa

SEQ ID NO: 71594 - DNA, 11 bp, Unknown
  misc_feature (1)..( 11): Matrix.004 file - promoters50/3434028
aattttgtttt

SEQ ID NO: 71595 - DNA, 9 bp, Unknown
  misc_feature (1)..( 9): Matrix.004 file - promoters50/3434028
tgtaaatca

SEQ ID NO: 71596 - DNA, 9 bp, Unknown
  misc_feature (1)..( 9): Matrix.004 file - promoters50/3434044
atttcaaaa

SEQ ID NO: 71597 - DNA, 15 bp, Unknown
  misc_feature (1)..( 15): Matrix.004 file - promoters50/3434044
gaaaaaaaaaatttg

SEQ ID NO: 71598 - DNA, 11 bp, Unknown
  misc_feature (1)..( 11): Matrix.004 file - promoters50/3434105
taaagcccaat

SEQ ID NO: 71599 - DNA, 11 bp, Unknown
  misc_feature (1)..( 11): Matrix.004 file - promoters50/3434105
gttttgaaaat

SEQ ID NO: 71600 - DNA, 12 bp, Unknown
  misc_feature (1)..( 12): Matrix.004 file - promoters50/3434105
tcagttttcatt

SEQ ID NO: 71601 - DNA, 9 bp, Unknown
  misc_feature (1)..( 9): Matrix.004 file - promoters50/3434105
tgttatatt

SEQ ID NO: 71602 - DNA, 9 bp, Unknown
  misc_feature (1)..( 9): Matrix.004 file - promoters50/3434105
ctatatata

SEQ ID NO: 71603 - DNA, 10 bp, Unknown
  misc_feature (1)..( 10): Matrix.004 file - promoters50/3434108
gttttcttaa

SEQ ID NO: 71604 - DNA, 11 bp, Unknown
  misc_feature (1)..( 11): Matrix.004 file - promoters50/3434108
ttaattttgaa

SEQ ID NO: 71605 - DNA, 11 bp, Unknown
  misc_feature (1)..( 11): Matrix.004 file - promoters50/3434108
ttggtttaatt

SEQ ID NO: 71606 - DNA, 14 bp, Unknown
  misc_feature (1)..( 14): Matrix.004 file - promoters50/3434108
aattaaatgtaatg

SEQ ID NO: 71607 - DNA, 10 bp, Unknown
  misc_feature (1)..( 10): Matrix.004 file - promoters50/3434108
tcaaaaaatt

SEQ ID NO: 71608 - DNA, 8 bp, Unknown
  misc_feature (1)..( 8): Matrix.004 file - promoters50/3434108
tttcaaaa

SEQ ID NO: 71609 - DNA, 9 bp, Unknown
  misc_feature (1)..( 9): Matrix.004 file - promoters50/3434108
acaatttag

SEQ ID NO: 71610 - DNA, 10 bp, Unknown
  misc_feature (1)..( 10): Matrix.004 file - promoters50/3434120
aatttacttt

SEQ ID NO: 71611 - DNA, 10 bp, Unknown
  misc_feature (1)..( 10): Matrix.004 file - promoters50/3434145
caaaatctct

SEQ ID NO: 71612 - DNA, 10 bp, Unknown
  misc_feature (1)..( 10): Matrix.004 file - promoters50/3434145
aaatctaatt

SEQ ID NO: 71613 - DNA, 8 bp, Unknown
  misc_feature (1)..( 8): Matrix.004 file - promoters50/3434147
aatttatt

SEQ ID NO: 71614 - DNA, 7 bp, Unknown
  misc_feature (1)..( 7): Matrix.004 file - promoters50/3434147
attatgt

SEQ ID NO: 71615 - DNA, 11 bp, Unknown
  misc_feature (1)..( 11): Matrix.004 file - promoters50/3434147
acattaaaatt

SEQ ID NO: 71616 - DNA, 9 bp, Unknown
  misc_feature (1)..( 9): Matrix.004 file - promoters50/3434147
ttccataaa

SEQ ID NO: 71617 - DNA, 8 bp, Unknown
  misc_feature (1)..( 8): Matrix.004 file - promoters50/3434147
atttcaca

SEQ ID NO: 71618 - DNA, 9 bp, Unknown
  misc_feature (1)..( 9): Matrix.004 file - promoters50/3434231
cccaatgtc

SEQ ID NO: 71619 - DNA, 7 bp, Unknown
  misc_feature (1)..( 7): Matrix.004 file - promoters50/3434233
tgtatgt

SEQ ID NO: 71620 - DNA, 5 bp, Unknown
  misc_feature (1)..( 5): Matrix.004 file - promoters50/3434233
aaagc

SEQ ID NO: 71621 - DNA, 15 bp, Unknown
  misc_feature (1)..( 15): Matrix.004 file - promoters50/3434233
tagtgaaaaagaaga

SEQ ID NO: 71622 - DNA, 10 bp, Unknown
  misc_feature (1)..( 10): Matrix.004 file - promoters50/3434233
ctcaaagcca

SEQ ID NO: 71623 - DNA, 11 bp, Unknown
  misc_feature (1)..( 11): Matrix.004 file - promoters50/3434256
aaaaagatatt

SEQ ID NO: 71624 - DNA, 14 bp, Unknown
  misc_feature (1)..( 14): Matrix.004 file - promoters50/3434256
ttaatttatttcta

SEQ ID NO: 71625 - DNA, 12 bp, Unknown
  misc_feature (1)..( 12): Matrix.004 file - promoters50/3434256
attaaaaaaaca

SEQ ID NO: 71626 - DNA, 13 bp, Unknown
  misc_feature (1)..( 13): Matrix.004 file - promoters50/3434256
atttcatttctta

SEQ ID NO: 71627 - DNA, 9 bp, Unknown
  misc_feature (1)..( 9): Matrix.004 file - promoters50/3434256
gaaataagt

SEQ ID NO: 71628 - DNA, 11 bp, Unknown
  misc_feature (1)..( 11): Matrix.004 file - promoters50/3434279
aatttaattac

SEQ ID NO: 71629 - DNA, 13 bp, Unknown
  misc_feature (1)..( 13): Matrix.004 file - promoters50/3434279
aataacatatgtt

SEQ ID NO: 71630 - DNA, 10 bp, Unknown
  misc_feature (1)..( 10): Matrix.004 file - promoters50/3434303
acaaacaaaa

SEQ ID NO: 71631 - DNA, 15 bp, Unknown
  misc_feature (1)..( 15): Matrix.004 file - promoters50/3434303
attgaatgtgttttt

SEQ ID NO: 71632 - DNA, 11 bp, Unknown
  misc_feature (1)..( 11): Matrix.004 file - promoters50/3434303
ggaagataacg

SEQ ID NO: 71633 - DNA, 14 bp, Unknown
  misc_feature (1)..( 14): Matrix.004 file - promoters50/3434303
tgaacgaatataat

SEQ ID NO: 71634 - DNA, 9 bp, Unknown
  misc_feature (1)..( 9): Matrix.004 file - promoters50/3434328
aaaaataaa

SEQ ID NO: 71635 - DNA, 8 bp, Unknown
  misc_feature (1)..( 8): Matrix.004 file - promoters50/3434350
tgtttttt

SEQ ID NO: 71636 - DNA, 9 bp, Unknown
  misc_feature (1)..( 9): Matrix.004 file - promoters50/3434350
tatgacaat

SEQ ID NO: 71637 - DNA, 9 bp, Unknown
  misc_feature (1)..( 9): Matrix.004 file - promoters50/3434350
ttatatata

SEQ ID NO: 71638 - DNA, 8 bp, Unknown
  misc_feature (1)..( 8): Matrix.004 file - promoters50/3434355
tatataag

SEQ ID NO: 71639 - DNA, 8 bp, Unknown
  misc_feature (1)..( 8): Matrix.004 file - promoters50/3434355
aatttttg

SEQ ID NO: 71640 - DNA, 11 bp, Unknown
  misc_feature (1)..( 11): Matrix.004 file - promoters50/3434355
atttttaaatg

SEQ ID NO: 71641 - DNA, 8 bp, Unknown
  misc_feature (1)..( 8): Matrix.004 file - promoters50/3434355
taaatttg

SEQ ID NO: 71642 - DNA, 11 bp, Unknown
  misc_feature (1)..( 11): Matrix.004 file - promoters50/3434355
cttttatttat

SEQ ID NO: 71643 - DNA, 10 bp, Unknown
  misc_feature (1)..( 10): Matrix.004 file - promoters50/3434355
gagaaaaaaa

SEQ ID NO: 71644 - DNA, 9 bp, Unknown
  misc_feature (1)..( 9): Matrix.004 file - promoters50/3434381
agagttttg

SEQ ID NO: 71645 - DNA, 11 bp, Unknown
  misc_feature (1)..( 11): Matrix.004 file - promoters50/3434381
ttgaaatgaaa

SEQ ID NO: 71646 - DNA, 7 bp, Unknown
  misc_feature (1)..( 7): Matrix.004 file - promoters50/3434392
aatattg

SEQ ID NO: 71647 - DNA, 7 bp, Unknown
  misc_feature (1)..( 7): Matrix.004 file - promoters50/3434400
ttatatt

SEQ ID NO: 71648 - DNA, 9 bp, Unknown
  misc_feature (1)..( 9): Matrix.004 file - promoters50/3434400
ttgaaaaaa

SEQ ID NO: 71649 - DNA, 9 bp, Unknown
  misc_feature (1)..( 9): Matrix.004 file - promoters50/3434400
aaagaaaat

SEQ ID NO: 71650 - DNA, 11 bp, Unknown
  misc_feature (1)..( 11): Matrix.004 file - promoters50/3434408
attttataatg

SEQ ID NO: 71651 - DNA, 8 bp, Unknown
  misc_feature (1)..( 8): Matrix.004 file - promoters50/3434408
gaagtaag

SEQ ID NO: 71652 - DNA, 7 bp, Unknown
  misc_feature (1)..( 7): Matrix.004 file - promoters50/3434424
tcatttt

SEQ ID NO: 71653 - DNA, 8 bp, Unknown
  misc_feature (1)..( 8): Matrix.004 file - promoters50/3434488
caaaagaa

SEQ ID NO: 71654 - DNA, 9 bp, Unknown
  misc_feature (1)..( 9): Matrix.004 file - promoters50/3434488
aagcaaaaa

SEQ ID NO: 71655 - DNA, 7 bp, Unknown
  misc_feature (1)..( 7): Matrix.004 file - promoters50/3434488
ctttata

SEQ ID NO: 71656 - DNA, 11 bp, Unknown
  misc_feature (1)..( 11): Matrix.004 file - promoters50/3434488
ttattgtaaac

SEQ ID NO: 71657 - DNA, 7 bp, Unknown
  misc_feature (1)..( 7): Matrix.004 file - promoters50/3434488
atttttt

SEQ ID NO: 71658 - DNA, 8 bp, Unknown
  misc_feature (1)..( 8): Matrix.004 file - promoters50/3434488
ctttattt

SEQ ID NO: 71659 - DNA, 10 bp, Unknown
  misc_feature (1)..( 10): Matrix.004 file - promoters50/3434488
taaaaaataa

SEQ ID NO: 71660 - DNA, 10 bp, Unknown
  misc_feature (1)..( 10): Matrix.004 file - promoters50/3434563
atatttagtt

SEQ ID NO: 71661 - DNA, 6 bp, Unknown
  misc_feature (1)..( 6): Matrix.004 file - promoters50/3434563
acaatt

SEQ ID NO: 71662 - DNA, 11 bp, Unknown
  misc_feature (1)..( 11): Matrix.004 file - promoters50/3434648
caaaattttat

SEQ ID NO: 71663 - DNA, 9 bp, Unknown
  misc_feature (1)..( 9): Matrix.004 file - promoters50/3434648
cttgtcata

SEQ ID NO: 71664 - DNA, 8 bp, Unknown
  misc_feature (1)..( 8): Matrix.004 file - promoters50/3434648
tgtatcag

SEQ ID NO: 71665 - DNA, 10 bp, Unknown
  misc_feature (1)..( 10): Matrix.004 file - promoters50/3434652
atatatgttt

SEQ ID NO: 71666 - DNA, 8 bp, Unknown
  misc_feature (1)..( 8): Matrix.004 file - promoters50/3434652
gatcaaaa

SEQ ID NO: 71667 - DNA, 10 bp, Unknown
  misc_feature (1)..( 10): Matrix.004 file - promoters50/3434652
attttttcag

SEQ ID NO: 71668 - DNA, 9 bp, Unknown
  misc_feature (1)..( 9): Matrix.004 file - promoters50/3434652
taaagttgt

SEQ ID NO: 71669 - DNA, 11 bp, Unknown
  misc_feature (1)..( 11): Matrix.004 file - promoters50/3434652
ttgtatctaaa

SEQ ID NO: 71670 - DNA, 8 bp, Unknown
  misc_feature (1)..( 8): Matrix.004 file - promoters50/3434652
tgttttat

SEQ ID NO: 71671 - DNA, 10 bp, Unknown
  misc_feature (1)..( 10): Matrix.004 file - promoters50/3434652
tttaactata

SEQ ID NO: 71672 - DNA, 9 bp, Unknown
  misc_feature (1)..( 9): Matrix.004 file - promoters50/3434652
catagtcaa

SEQ ID NO: 71673 - DNA, 6 bp, Unknown
  misc_feature (1)..( 6): Matrix.004 file - promoters50/3434652
attaaa

SEQ ID NO: 71674 - DNA, 7 bp, Unknown
  misc_feature (1)..( 7): Matrix.004 file - promoters50/3434652
actattc

SEQ ID NO: 71675 - DNA, 8 bp, Unknown
  misc_feature (1)..( 8): Matrix.004 file - promoters50/3434652
ctaaaatt

SEQ ID NO: 71676 - DNA, 9 bp, Unknown
  misc_feature (1)..( 9): Matrix.004 file - promoters50/3434652
ttactatag

SEQ ID NO: 71677 - DNA, 9 bp, Unknown
  misc_feature (1)..( 9): Matrix.004 file - promoters50/3434652
aattttgta

SEQ ID NO: 71678 - DNA, 10 bp, Unknown
  misc_feature (1)..( 10): Matrix.004 file - promoters50/3434652
caggtttcaa

SEQ ID NO: 71679 - DNA, 8 bp, Unknown
  misc_feature (1)..( 8): Matrix.004 file - promoters50/3434765
gaaaaaca

SEQ ID NO: 71680 - DNA, 6 bp, Unknown
  misc_feature (1)..( 6): Matrix.004 file - promoters50/3434796
taatat

SEQ ID NO: 71681 - DNA, 11 bp, Unknown
  misc_feature (1)..( 11): Matrix.004 file - promoters50/3434876
aagactaaaaa

SEQ ID NO: 71682 - DNA, 9 bp, Unknown
  misc_feature (1)..( 9): Matrix.004 file - promoters50/3434880
ttaacaaac

SEQ ID NO: 71683 - DNA, 9 bp, Unknown
  misc_feature (1)..( 9): Matrix.004 file - promoters50/3434880
aagaaacaa

SEQ ID NO: 71684 - DNA, 15 bp, Unknown
  misc_feature (1)..( 15): Matrix.004 file - promoters50/3434912
aagccatattgtcaa

SEQ ID NO: 71685 - DNA, 9 bp, Unknown
  misc_feature (1)..( 9): Matrix.004 file - promoters50/3434936
ggtttcttg

SEQ ID NO: 71686 - DNA, 9 bp, Unknown
  misc_feature (1)..( 9): Matrix.004 file - promoters50/3434952
tataaagaa

SEQ ID NO: 71687 - DNA, 9 bp, Unknown
  misc_feature (1)..( 9): Matrix.004 file - promoters50/3434952
ttttgttga

SEQ ID NO: 71688 - DNA, 9 bp, Unknown
  misc_feature (1)..( 9): Matrix.004 file - promoters50/3435031
aatgttgaa

SEQ ID NO: 71689 - DNA, 8 bp, Unknown
  misc_feature (1)..( 8): Matrix.004 file - promoters50/3435057
aatagttt

SEQ ID NO: 71690 - DNA, 10 bp, Unknown
  misc_feature (1)..( 10): Matrix.004 file - promoters50/3435057
gaaatcataa

SEQ ID NO: 71691 - DNA, 7 bp, Unknown
  misc_feature (1)..( 7): Matrix.004 file - promoters50/3435057
ccataaa

SEQ ID NO: 71692 - DNA, 10 bp, Unknown
  misc_feature (1)..( 10): Matrix.004 file - promoters50/3435091
tttttattga

SEQ ID NO: 71693 - DNA, 9 bp, Unknown
  misc_feature (1)..( 9): Matrix.004 file - promoters50/3435091
ttacaaaaa

SEQ ID NO: 71694 - DNA, 7 bp, Unknown
  misc_feature (1)..( 7): Matrix.004 file - promoters50/3435091
tattttt

SEQ ID NO: 71695 - DNA, 9 bp, Unknown
  misc_feature (1)..( 9): Matrix.004 file - promoters50/3435125
cattataaa

SEQ ID NO: 71696 - DNA, 10 bp, Unknown
  misc_feature (1)..( 10): Matrix.004 file - promoters50/3435133
aaaaatcaaa

SEQ ID NO: 71697 - DNA, 12 bp, Unknown
  misc_feature (1)..( 12): Matrix.004 file - promoters50/3435133
gaaatagattaa

SEQ ID NO: 71698 - DNA, 12 bp, Unknown
  misc_feature (1)..( 12): Matrix.004 file - promoters50/3435133
taaaatattgta

SEQ ID NO: 71699 - DNA, 9 bp, Unknown
  misc_feature (1)..( 9): Matrix.004 file - promoters50/3435151
ttactaaaa

SEQ ID NO: 71700 - DNA, 7 bp, Unknown
  misc_feature (1)..( 7): Matrix.004 file - promoters50/3435151
ataattt

SEQ ID NO: 71701 - DNA, 9 bp, Unknown
  misc_feature (1)..( 9): Matrix.004 file - promoters50/3435151
ctaaaaaaa

SEQ ID NO: 71702 - DNA, 9 bp, Unknown
  misc_feature (1)..( 9): Matrix.004 file - promoters50/3435169
taaaatgtt

SEQ ID NO: 71703 - DNA, 9 bp, Unknown
  misc_feature (1)..( 9): Matrix.004 file - promoters50/3435169
aaaaatttc

SEQ ID NO: 71704 - DNA, 9 bp, Unknown
  misc_feature (1)..( 9): Matrix.004 file - promoters50/3435185
aacatctca

SEQ ID NO: 71705 - DNA, 10 bp, Unknown
  misc_feature (1)..( 10): Matrix.004 file - promoters50/3435185
gagtaaaaaa

SEQ ID NO: 71706 - DNA, 9 bp, Unknown
  misc_feature (1)..( 9): Matrix.004 file - promoters50/3435227
aaaaacaaa

SEQ ID NO: 71707 - DNA, 13 bp, Unknown
  misc_feature (1)..( 13): Matrix.004 file - promoters50/3435239
cttctataaaaca

SEQ ID NO: 71708 - DNA, 8 bp, Unknown
  misc_feature (1)..( 8): Matrix.004 file - promoters50/3435239
tcttgttt

SEQ ID NO: 71709 - DNA, 12 bp, Unknown
  misc_feature (1)..( 12): Matrix.004 file - promoters50/3435239
ttttattgatag

SEQ ID NO: 71710 - DNA, 9 bp, Unknown
  misc_feature (1)..( 9): Matrix.004 file - promoters50/3435239
aaaagtaga

SEQ ID NO: 71711 - DNA, 11 bp, Unknown
  misc_feature (1)..( 11): Matrix.004 file - promoters50/3435239
gacgattttgt

SEQ ID NO: 71712 - DNA, 9 bp, Unknown
  misc_feature (1)..( 9): Matrix.004 file - promoters50/3435239
ttttgtttt

SEQ ID NO: 71713 - DNA, 12 bp, Unknown
  misc_feature (1)..( 12): Matrix.004 file - promoters50/3435239
gctttttactgg

SEQ ID NO: 71714 - DNA, 8 bp, Unknown
  misc_feature (1)..( 8): Matrix.004 file - promoters50/3435239
attcgtat

SEQ ID NO: 71715 - DNA, 6 bp, Unknown
  misc_feature (1)..( 6): Matrix.004 file - promoters50/3435239
ttgttt

SEQ ID NO: 71716 - DNA, 8 bp, Unknown
  misc_feature (1)..( 8): Matrix.004 file - promoters50/3435258
atttgttt

SEQ ID NO: 71717 - DNA, 7 bp, Unknown
  misc_feature (1)..( 7): Matrix.004 file - promoters50/3435258
taaattt

SEQ ID NO: 71718 - DNA, 8 bp, Unknown
  misc_feature (1)..( 8): Matrix.004 file - promoters50/3435258
aaattaaa

SEQ ID NO: 71719 - DNA, 11 bp, Unknown
  misc_feature (1)..( 11): Matrix.004 file - promoters50/3435258
attattaattt

SEQ ID NO: 71720 - DNA, 12 bp, Unknown
  misc_feature (1)..( 12): Matrix.004 file - promoters50/3435258
attattaattta

SEQ ID NO: 71721 - DNA, 8 bp, Unknown
  misc_feature (1)..( 8): Matrix.004 file - promoters50/3435258
tattaaat

SEQ ID NO: 71722 - DNA, 9 bp, Unknown
  misc_feature (1)..( 9): Matrix.004 file - promoters50/3435258
tttatggat

SEQ ID NO: 71723 - DNA, 9 bp, Unknown
  misc_feature (1)..( 9): Matrix.004 file - promoters50/3435258
tattaaatt

SEQ ID NO: 71724 - DNA, 8 bp, Unknown
  misc_feature (1)..( 8): Matrix.004 file - promoters50/3435258
caaattaa

SEQ ID NO: 71725 - DNA, 11 bp, Unknown
  misc_feature (1)..( 11): Matrix.004 file - promoters50/3435258
ttatatataaa

SEQ ID NO: 71726 - DNA, 9 bp, Unknown
  misc_feature (1)..( 9): Matrix.004 file - promoters50/3435274
atttggaat

SEQ ID NO: 71727 - DNA, 12 bp, Unknown
  misc_feature (1)..( 12): Matrix.004 file - promoters50/3435282
caggattgattt

SEQ ID NO: 71728 - DNA, 6 bp, Unknown
  misc_feature (1)..( 6): Matrix.004 file - promoters50/3435282
attatt

SEQ ID NO: 71729 - DNA, 11 bp, Unknown
  misc_feature (1)..( 11): Matrix.004 file - promoters50/3435282
tgaaaatatta

SEQ ID NO: 71730 - DNA, 9 bp, Unknown
  misc_feature (1)..( 9): Matrix.004 file - promoters50/3435282
ataatatca

SEQ ID NO: 71731 - DNA, 11 bp, Unknown
  misc_feature (1)..( 11): Matrix.004 file - promoters50/3435282
aactgtaaaat

SEQ ID NO: 71732 - DNA, 11 bp, Unknown
  misc_feature (1)..( 11): Matrix.004 file - promoters50/3435341
caagaaaataa

SEQ ID NO: 71733 - DNA, 8 bp, Unknown
  misc_feature (1)..( 8): Matrix.004 file - promoters50/3435372
attggttt

SEQ ID NO: 71734 - DNA, 6 bp, Unknown
  misc_feature (1)..( 6): Matrix.004 file - promoters50/3435424
acatac

SEQ ID NO: 71735 - DNA, 7 bp, Unknown
  misc_feature (1)..( 7): Matrix.004 file - promoters50/3435424
tttaaaa

SEQ ID NO: 71736 - DNA, 8 bp, Unknown
  misc_feature (1)..( 8): Matrix.004 file - promoters50/3435424
tacttttt

SEQ ID NO: 71737 - DNA, 8 bp, Unknown
  misc_feature (1)..( 8): Matrix.004 file - promoters50/3435452
ttaattta

SEQ ID NO: 71738 - DNA, 14 bp, Unknown
  misc_feature (1)..( 14): Matrix.004 file - promoters50/3435452
aatttaaccccata

SEQ ID NO: 71739 - DNA, 8 bp, Unknown
  misc_feature (1)..( 8): Matrix.004 file - promoters50/3435463
aaaaacaa

SEQ ID NO: 71740 - DNA, 13 bp, Unknown
  misc_feature (1)..( 13): Matrix.004 file - promoters50/3435463
aatagaaaactaa

SEQ ID NO: 71741 - DNA, 11 bp, Unknown
  misc_feature (1)..( 11): Matrix.004 file - promoters50/3435463
atataaacaac

SEQ ID NO: 71742 - DNA, 10 bp, Unknown
  misc_feature (1)..( 10): Matrix.004 file - promoters50/3435463
aaaaaaaaat

SEQ ID NO: 71743 - DNA, 15 bp, Unknown
  misc_feature (1)..( 15): Matrix.004 file - promoters50/3435463
aaaattaaaataata

SEQ ID NO: 71744 - DNA, 11 bp, Unknown
  misc_feature (1)..( 11): Matrix.004 file - promoters50/3435463
tttgcaaaaat

SEQ ID NO: 71745 - DNA, 14 bp, Unknown
  misc_feature (1)..( 14): Matrix.004 file - promoters50/3435469
aaaatacaaaaatc

SEQ ID NO: 71746 - DNA, 10 bp, Unknown
  misc_feature (1)..( 10): Matrix.004 file - promoters50/3435469
aaacttttaa

SEQ ID NO: 71747 - DNA, 9 bp, Unknown
  misc_feature (1)..( 9): Matrix.004 file - promoters50/3435469
cttttatta

SEQ ID NO: 71748 - DNA, 10 bp, Unknown
  misc_feature (1)..( 10): Matrix.004 file - promoters50/3435469
agatataaaa

SEQ ID NO: 71749 - DNA, 11 bp, Unknown
  misc_feature (1)..( 11): Matrix.004 file - promoters50/3435469
ctagatttttt

SEQ ID NO: 71750 - DNA, 11 bp, Unknown
  misc_feature (1)..( 11): Matrix.004 file - promoters50/3435469
tattgtttaac

SEQ ID NO: 71751 - DNA, 12 bp, Unknown
  misc_feature (1)..( 12): Matrix.004 file - promoters50/3435469
cttatataaaca

SEQ ID NO: 71752 - DNA, 11 bp, Unknown
  misc_feature (1)..( 11): Matrix.004 file - promoters50/3435514
aaacttgtttt

SEQ ID NO: 71753 - DNA, 6 bp, Unknown
  misc_feature (1)..( 6): Matrix.004 file - promoters50/3435514
caaata

SEQ ID NO: 71754 - DNA, 6 bp, Unknown
  misc_feature (1)..( 6): Matrix.004 file - promoters50/3435514
tttgtt

SEQ ID NO: 71755 - DNA, 13 bp, Unknown
  misc_feature (1)..( 13): Matrix.004 file - promoters50/3435518
gacaattttgtca

SEQ ID NO: 71756 - DNA, 9 bp, Unknown
  misc_feature (1)..( 9): Matrix.004 file - promoters50/3435518
aagaggatc

SEQ ID NO: 71757 - DNA, 8 bp, Unknown
  misc_feature (1)..( 8): Matrix.004 file - promoters50/3435518
ttgctgac

SEQ ID NO: 71758 - DNA, 10 bp, Unknown
  misc_feature (1)..( 10): Matrix.004 file - promoters50/3435534
agaggaagta

SEQ ID NO: 71759 - DNA, 9 bp, Unknown
  misc_feature (1)..( 9): Matrix.004 file - promoters50/3435578
ttacttttt

SEQ ID NO: 71760 - DNA, 6 bp, Unknown
  misc_feature (1)..( 6): Matrix.004 file - promoters50/3435578
tatcaa

SEQ ID NO: 71761 - DNA, 12 bp, Unknown
  misc_feature (1)..( 12): Matrix.004 file - promoters50/3435578
aaaacatttgac

SEQ ID NO: 71762 - DNA, 8 bp, Unknown
  misc_feature (1)..( 8): Matrix.004 file - promoters50/3435578
ttcacaaa

SEQ ID NO: 71763 - DNA, 10 bp, Unknown
  misc_feature (1)..( 10): Matrix.004 file - promoters50/3435605
ttcacaaact

SEQ ID NO: 71764 - DNA, 10 bp, Unknown
  misc_feature (1)..( 10): Matrix.004 file - promoters50/3435605
tttattctaa

SEQ ID NO: 71765 - DNA, 8 bp, Unknown
  misc_feature (1)..( 8): Matrix.004 file - promoters50/3435605
atcaaaaa

SEQ ID NO: 71766 - DNA, 12 bp, Unknown
  misc_feature (1)..( 12): Matrix.004 file - promoters50/3435605
aaattattaaaa

SEQ ID NO: 71767 - DNA, 9 bp, Unknown
  misc_feature (1)..( 9): Matrix.004 file - promoters50/3435632
ttataaaaa

SEQ ID NO: 71768 - DNA, 11 bp, Unknown
  misc_feature (1)..( 11): Matrix.004 file - promoters50/3435632
aaaaatacact

SEQ ID NO: 71769 - DNA, 9 bp, Unknown
  misc_feature (1)..( 9): Matrix.004 file - promoters50/3435632
taaaataaa

SEQ ID NO: 71770 - DNA, 12 bp, Unknown
  misc_feature (1)..( 12): Matrix.004 file - promoters50/3435723
atgataaaaaat

SEQ ID NO: 71771 - DNA, 7 bp, Unknown
  misc_feature (1)..( 7): Matrix.004 file - promoters50/3435761
aaacaga

SEQ ID NO: 71772 - DNA, 9 bp, Unknown
  misc_feature (1)..( 9): Matrix.004 file - promoters50/3435761
aatttgagt

SEQ ID NO: 71773 - DNA, 10 bp, Unknown
  misc_feature (1)..( 10): Matrix.004 file - promoters50/3435765
atctttggat

SEQ ID NO: 71774 - DNA, 11 bp, Unknown
  misc_feature (1)..( 11): Matrix.004 file - promoters50/3435765
ccatttaaaat

SEQ ID NO: 71775 - DNA, 9 bp, Unknown
  misc_feature (1)..( 9): Matrix.004 file - promoters50/3435765
gttttatga

SEQ ID NO: 71776 - DNA, 10 bp, Unknown
  misc_feature (1)..( 10): Matrix.004 file - promoters50/3435765
ataaaataaa

SEQ ID NO: 71777 - DNA, 10 bp, Unknown
  misc_feature (1)..( 10): Matrix.004 file - promoters50/3435765
ataaaataaa

SEQ ID NO: 71778 - DNA, 5 bp, Unknown
  misc_feature (1)..( 5): Matrix.004 file - promoters50/3435765
aataa

SEQ ID NO: 71779 - DNA, 9 bp, Unknown
  misc_feature (1)..( 9): Matrix.004 file - promoters50/3435803
ttttatgat

SEQ ID NO: 71780 - DNA, 8 bp, Unknown
  misc_feature (1)..( 8): Matrix.004 file - promoters50/3435833
tttttttc

SEQ ID NO: 71781 - DNA, 8 bp, Unknown
  misc_feature (1)..( 8): Matrix.004 file - promoters50/3435833
agaaaaat

SEQ ID NO: 71782 - DNA, 14 bp, Unknown
  misc_feature (1)..( 14): Matrix.004 file - promoters50/3435833
ttaagaaaagtaac

SEQ ID NO: 71783 - DNA, 18 bp, Unknown
  misc_feature (1)..( 18): Matrix.004 file - promoters50/3435891
tattaatgagcttaaaga

SEQ ID NO: 71784 - DNA, 10 bp, Unknown
  misc_feature (1)..( 10): Matrix.004 file - promoters50/3435891
tgttttcact

SEQ ID NO: 71785 - DNA, 10 bp, Unknown
  misc_feature (1)..( 10): Matrix.004 file - promoters50/3435891
aactctttta

SEQ ID NO: 71786 - DNA, 7 bp, Unknown
  misc_feature (1)..( 7): Matrix.004 file - promoters50/3435891
acaaaaa

SEQ ID NO: 71787 - DNA, 7 bp, Unknown
  misc_feature (1)..( 7): Matrix.004 file - promoters50/3435891
tttatta

SEQ ID NO: 71788 - DNA, 9 bp, Unknown
  misc_feature (1)..( 9): Matrix.004 file - promoters50/3435917
ctgtcaaag

SEQ ID NO: 71789 - DNA, 7 bp, Unknown
  misc_feature (1)..( 7): Matrix.004 file - promoters50/3435917
ataaagt

SEQ ID NO: 71790 - DNA, 7 bp, Unknown
  misc_feature (1)..( 7): Matrix.004 file - promoters50/3435917
tttataa

SEQ ID NO: 71791 - DNA, 8 bp, Unknown
  misc_feature (1)..( 8): Matrix.004 file - promoters50/3435917
ataaaata

SEQ ID NO: 71792 - DNA, 8 bp, Unknown
  misc_feature (1)..( 8): Matrix.004 file - promoters50/3436121
tattttaa

SEQ ID NO: 71793 - DNA, 8 bp, Unknown
  misc_feature (1)..( 8): Matrix.004 file - promoters50/3436121
tttaaaag

SEQ ID NO: 71794 - DNA, 7 bp, Unknown
  misc_feature (1)..( 7): Matrix.004 file - promoters50/3436121
aagaaat

SEQ ID NO: 71795 - DNA, 8 bp, Unknown
  misc_feature (1)..( 8): Matrix.004 file - promoters50/3436121
ttatgtct

SEQ ID NO: 71796 - DNA, 7 bp, Unknown
  misc_feature (1)..( 7): Matrix.004 file - promoters50/3436139
gatcgat

SEQ ID NO: 71797 - DNA, 7 bp, Unknown
  misc_feature (1)..( 7): Matrix.004 file - promoters50/3436222
attaata

SEQ ID NO: 71798 - DNA, 7 bp, Unknown
  misc_feature (1)..( 7): Matrix.004 file - promoters50/3436222
aaaaata

SEQ ID NO: 71799 - DNA, 10 bp, Unknown
  misc_feature (1)..( 10): Matrix.004 file - promoters50/3436222
atcaaaaatg

SEQ ID NO: 71800 - DNA, 7 bp, Unknown
  misc_feature (1)..( 7): Matrix.004 file - promoters50/3436222
gacaaaa

SEQ ID NO: 71801 - DNA, 9 bp, Unknown
  misc_feature (1)..( 9): Matrix.004 file - promoters50/3436265
ataaaaata

SEQ ID NO: 71802 - DNA, 8 bp, Unknown
  misc_feature (1)..( 8): Matrix.004 file - promoters50/3436265
taaacttt

SEQ ID NO: 71803 - DNA, 11 bp, Unknown
  misc_feature (1)..( 11): Matrix.004 file - promoters50/3436265
attaataatat

SEQ ID NO: 71804 - DNA, 9 bp, Unknown
  misc_feature (1)..( 9): Matrix.004 file - promoters50/3436265
cttctttat

SEQ ID NO: 71805 - DNA, 9 bp, Unknown
  misc_feature (1)..( 9): Matrix.004 file - promoters50/3436267
attatgtat

SEQ ID NO: 71806 - DNA, 12 bp, Unknown
  misc_feature (1)..( 12): Matrix.004 file - promoters50/3436312
cattataaaacc

SEQ ID NO: 71807 - DNA, 10 bp, Unknown
  misc_feature (1)..( 10): Matrix.004 file - promoters50/3436319
ttttgctatg

SEQ ID NO: 71808 - DNA, 10 bp, Unknown
  misc_feature (1)..( 10): Matrix.004 file - promoters50/3436319
cctatttata

SEQ ID NO: 71809 - DNA, 8 bp, Unknown
  misc_feature (1)..( 8): Matrix.004 file - promoters50/3436319
acttttaa

SEQ ID NO: 71810 - DNA, 7 bp, Unknown
  misc_feature (1)..( 7): Matrix.004 file - promoters50/3436319
ttaaatt

SEQ ID NO: 71811 - DNA, 10 bp, Unknown
  misc_feature (1)..( 10): Matrix.004 file - promoters50/3436319
taataattaa

SEQ ID NO: 71812 - DNA, 8 bp, Unknown
  misc_feature (1)..( 8): Matrix.004 file - promoters50/3436319
aatgtttg

SEQ ID NO: 71813 - DNA, 8 bp, Unknown
  misc_feature (1)..( 8): Matrix.004 file - promoters50/3436412
catctttt

SEQ ID NO: 71814 - DNA, 9 bp, Unknown
  misc_feature (1)..( 9): Matrix.004 file - promoters50/3436481
tttgtatat

SEQ ID NO: 71815 - DNA, 10 bp, Unknown
  misc_feature (1)..( 10): Matrix.004 file - promoters50/3436481
aaaaatttca

SEQ ID NO: 71816 - DNA, 11 bp, Unknown
  misc_feature (1)..( 11): Matrix.004 file - promoters50/3436481
ataaaaaacaa

SEQ ID NO: 71817 - DNA, 11 bp, Unknown
  misc_feature (1)..( 11): Matrix.004 file - promoters50/3436481
taaacaaaata

SEQ ID NO: 71818 - DNA, 18 bp, Unknown
  misc_feature (1)..( 18): Matrix.004 file - promoters50/3436529
atcattaatttttttttt

SEQ ID NO: 71819 - DNA, 12 bp, Unknown
  misc_feature (1)..( 12): Matrix.004 file - promoters50/3436529
tatatataaaca

SEQ ID NO: 71820 - DNA, 9 bp, Unknown
  misc_feature (1)..( 9): Matrix.004 file - promoters50/3436529
tacttattt

SEQ ID NO: 71821 - DNA, 12 bp, Unknown
  misc_feature (1)..( 12): Matrix.004 file - promoters50/3436529
atttttgaaaaa

SEQ ID NO: 71822 - DNA, 14 bp, Unknown
  misc_feature (1)..( 14): Matrix.004 file - promoters50/3436655
actgatataaatga

SEQ ID NO: 71823 - DNA, 9 bp, Unknown
  misc_feature (1)..( 9): Matrix.004 file - promoters50/3436661
aaatggaat

SEQ ID NO: 71824 - DNA, 8 bp, Unknown
  misc_feature (1)..( 8): Matrix.004 file - promoters50/3436661
tttttttt

SEQ ID NO: 71825 - DNA, 13 bp, Unknown
  misc_feature (1)..( 13): Matrix.004 file - promoters50/3436661
ctttagttcaatg

SEQ ID NO: 71826 - DNA, 7 bp, Unknown
  misc_feature (1)..( 7): Matrix.004 file - promoters50/3436661
atacttt

SEQ ID NO: 71827 - DNA, 15 bp, Unknown
  misc_feature (1)..( 15): Matrix.004 file - promoters50/3436661
tttactgtagaacag

SEQ ID NO: 71828 - DNA, 14 bp, Unknown
  misc_feature (1)..( 14): Matrix.004 file - promoters50/3436661
tctaaaatattatt

SEQ ID NO: 71829 - DNA, 7 bp, Unknown
  misc_feature (1)..( 7): Matrix.004 file - promoters50/3436661
taaatgg

SEQ ID NO: 71830 - DNA, 9 bp, Unknown
  misc_feature (1)..( 9): Matrix.004 file - promoters50/3436661
gttaaatat

SEQ ID NO: 71831 - DNA, 13 bp, Unknown
  misc_feature (1)..( 13): Matrix.004 file - promoters50/3436661
ctaaaattttatt

SEQ ID NO: 71832 - DNA, 7 bp, Unknown
  misc_feature (1)..( 7): Matrix.004 file - promoters50/3436718
aaaatat

SEQ ID NO: 71833 - DNA, 12 bp, Unknown
  misc_feature (1)..( 12): Matrix.004 file - promoters50/3436718
gaaataagtttg

SEQ ID NO: 71834 - DNA, 8 bp, Unknown
  misc_feature (1)..( 8): Matrix.004 file - promoters50/3436718
cttgcttt

SEQ ID NO: 71835 - DNA, 8 bp, Unknown
  misc_feature (1)..( 8): Matrix.004 file - promoters50/3436718
ctaaaaac

SEQ ID NO: 71836 - DNA, 13 bp, Unknown
  misc_feature (1)..( 13): Matrix.004 file - promoters50/3436718
agtaattaatcac

SEQ ID NO: 71837 - DNA, 9 bp, Unknown
  misc_feature (1)..( 9): Matrix.004 file - promoters50/3436718
tttattaaa

SEQ ID NO: 71838 - DNA, 12 bp, Unknown
  misc_feature (1)..( 12): Matrix.004 file - promoters50/3436730
aaaagttcatct

SEQ ID NO: 71839 - DNA, 6 bp, Unknown
  misc_feature (1)..( 6): Matrix.004 file - promoters50/3436799
ttttta

SEQ ID NO: 71840 - DNA, 9 bp, Unknown
  misc_feature (1)..( 9): Matrix.004 file - promoters50/3436799
cttaaatat

SEQ ID NO: 71841 - DNA, 11 bp, Unknown
  misc_feature (1)..( 11): Matrix.004 file - promoters50/3436799
taacagaataa

SEQ ID NO: 71842 - DNA, 10 bp, Unknown
  misc_feature (1)..( 10): Matrix.004 file - promoters50/3436799
aaaaataaaa

SEQ ID NO: 71843 - DNA, 10 bp, Unknown
  misc_feature (1)..( 10): Matrix.004 file - promoters50/3436883
caattttttt

SEQ ID NO: 71844 - DNA, 10 bp, Unknown
  misc_feature (1)..( 10): Matrix.004 file - promoters50/3436943
taaaaaatta

SEQ ID NO: 71845 - DNA, 10 bp, Unknown
  misc_feature (1)..( 10): Matrix.004 file - promoters50/3436943
agatatcaga

SEQ ID NO: 71846 - DNA, 10 bp, Unknown
  misc_feature (1)..( 10): Matrix.004 file - promoters50/3436971
ttttccacaa

SEQ ID NO: 71847 - DNA, 8 bp, Unknown
  misc_feature (1)..( 8): Matrix.004 file - promoters50/3437072
cttacaaa

SEQ ID NO: 71848 - DNA, 12 bp, Unknown
  misc_feature (1)..( 12): Matrix.004 file - promoters50/3437072
atagaatcaata

SEQ ID NO: 71849 - DNA, 6 bp, Unknown
  misc_feature (1)..( 6): Matrix.004 file - promoters50/3437072
aattaa

SEQ ID NO: 71850 - DNA, 10 bp, Unknown
  misc_feature (1)..( 10): Matrix.004 file - promoters50/3437072
ataaaatata

SEQ ID NO: 71851 - DNA, 13 bp, Unknown
  misc_feature (1)..( 13): Matrix.004 file - promoters50/3437150
aattcttttaaat

SEQ ID NO: 71852 - DNA, 7 bp, Unknown
  misc_feature (1)..( 7): Matrix.004 file - promoters50/3437150
aaaaaag

SEQ ID NO: 71853 - DNA, 9 bp, Unknown
  misc_feature (1)..( 9): Matrix.004 file - promoters50/3437150
cttataaaa

SEQ ID NO: 71854 - DNA, 13 bp, Unknown
  misc_feature (1)..( 13): Matrix.004 file - promoters50/3437150
agaatttattatc

SEQ ID NO: 71855 - DNA, 15 bp, Unknown
  misc_feature (1)..( 15): Matrix.004 file - promoters50/3437150
gtgtatttgaattaa

SEQ ID NO: 71856 - DNA, 10 bp, Unknown
  misc_feature (1)..( 10): Matrix.004 file - promoters50/3437193
aaaattatta

SEQ ID NO: 71857 - DNA, 8 bp, Unknown
  misc_feature (1)..( 8): Matrix.004 file - promoters50/3437193
ttaaaaat

SEQ ID NO: 71858 - DNA, 16 bp, Unknown
  misc_feature (1)..( 16): Matrix.004 file - promoters50/3437193
agaaatacatacattt

SEQ ID NO: 71859 - DNA, 15 bp, Unknown
  misc_feature (1)..( 15): Matrix.004 file - promoters50/3437208
atacatattttttat

SEQ ID NO: 71860 - DNA, 11 bp, Unknown
  misc_feature (1)..( 11): Matrix.004 file - promoters50/3437208
aaattttcaga

SEQ ID NO: 71861 - DNA, 11 bp, Unknown
  misc_feature (1)..( 11): Matrix.004 file - promoters50/3437208
attaaataaaa

SEQ ID NO: 71862 - DNA, 8 bp, Unknown
  misc_feature (1)..( 8): Matrix.004 file - promoters50/3437208
aaatcaaa

SEQ ID NO: 71863 - DNA, 7 bp, Unknown
  misc_feature (1)..( 7): Matrix.004 file - promoters50/3437212
aaataag

SEQ ID NO: 71864 - DNA, 8 bp, Unknown
  misc_feature (1)..( 8): Matrix.004 file - promoters50/3437212
taaaagat

SEQ ID NO: 71865 - DNA, 6 bp, Unknown
  misc_feature (1)..( 6): Matrix.004 file - promoters50/3437212
tagata

SEQ ID NO: 71866 - DNA, 7 bp, Unknown
  misc_feature (1)..( 7): Matrix.004 file - promoters50/3437212
ataattt

SEQ ID NO: 71867 - DNA, 10 bp, Unknown
  misc_feature (1)..( 10): Matrix.004 file - promoters50/3437244
gttataaacg

SEQ ID NO: 71868 - DNA, 13 bp, Unknown
  misc_feature (1)..( 13): Matrix.004 file - promoters50/3437244
acgaatcaaacaa

SEQ ID NO: 71869 - DNA, 12 bp, Unknown
  misc_feature (1)..( 12): Matrix.004 file - promoters50/3437244
atgaaacaattc

SEQ ID NO: 71870 - DNA, 10 bp, Unknown
  misc_feature (1)..( 10): Matrix.004 file - promoters50/3437244
aaacaaaaac

SEQ ID NO: 71871 - DNA, 12 bp, Unknown
  misc_feature (1)..( 12): Matrix.004 file - promoters50/3437331
ataataaaataa

SEQ ID NO: 71872 - DNA, 11 bp, Unknown
  misc_feature (1)..( 11): Matrix.004 file - promoters50/3437331
gttttatttgt

SEQ ID NO: 71873 - DNA, 16 bp, Unknown
  misc_feature (1)..( 16): Matrix.004 file - promoters50/3437331
ttaagaaattcccaaa

SEQ ID NO: 71874 - DNA, 12 bp, Unknown
  misc_feature (1)..( 12): Matrix.004 file - promoters50/3437367
taccaaattaaa

SEQ ID NO: 71875 - DNA, 11 bp, Unknown
  misc_feature (1)..( 11): Matrix.004 file - promoters50/3437367
aaatttagaaa

SEQ ID NO: 71876 - DNA, 12 bp, Unknown
  misc_feature (1)..( 12): Matrix.004 file - promoters50/3437367
gtttattttttg

SEQ ID NO: 71877 - DNA, 8 bp, Unknown
  misc_feature (1)..( 8): Matrix.004 file - promoters50/3437367
attattaa

SEQ ID NO: 71878 - DNA, 19 bp, Unknown
  misc_feature (1)..( 19): Matrix.004 file - promoters50/3437575
tcaagttttaattgatatc

SEQ ID NO: 71879 - DNA, 10 bp, Unknown
  misc_feature (1)..( 10): Matrix.004 file - promoters50/3437575
aaaatgaaga

SEQ ID NO: 71880 - DNA, 8 bp, Unknown
  misc_feature (1)..( 8): Matrix.004 file - promoters50/3437652
taagttaa

SEQ ID NO: 71881 - DNA, 8 bp, Unknown
  misc_feature (1)..( 8): Matrix.004 file - promoters50/3437652
attaaaaa

SEQ ID NO: 71882 - DNA, 10 bp, Unknown
  misc_feature (1)..( 10): Matrix.004 file - promoters50/3437652
gaattttatt

SEQ ID NO: 71883 - DNA, 12 bp, Unknown
  misc_feature (1)..( 12): Matrix.004 file - promoters50/3437652
aagatatgacaa

SEQ ID NO: 71884 - DNA, 8 bp, Unknown
  misc_feature (1)..( 8): Matrix.004 file - promoters50/3437652
aaaagttg

SEQ ID NO: 71885 - DNA, 5 bp, Unknown
  misc_feature (1)..( 5): Matrix.004 file - promoters50/3437660
acaaa

SEQ ID NO: 71886 - DNA, 10 bp, Unknown
  misc_feature (1)..( 10): Matrix.004 file - promoters50/3437660
ataaatatag

SEQ ID NO: 71887 - DNA, 10 bp, Unknown
  misc_feature (1)..( 10): Matrix.004 file - promoters50/3437664
ataattcaaa

SEQ ID NO: 71888 - DNA, 7 bp, Unknown
  misc_feature (1)..( 7): Matrix.004 file - promoters50/3437664
atatata

SEQ ID NO: 71889 - DNA, 9 bp, Unknown
  misc_feature (1)..( 9): Matrix.004 file - promoters50/3437664
catttattt

SEQ ID NO: 71890 - DNA, 7 bp, Unknown
  misc_feature (1)..( 7): Matrix.004 file - promoters50/3437671
atttatt

SEQ ID NO: 71891 - DNA, 7 bp, Unknown
  misc_feature (1)..( 7): Matrix.004 file - promoters50/3437683
ttaggtg

SEQ ID NO: 71892 - DNA, 9 bp, Unknown
  misc_feature (1)..( 9): Matrix.004 file - promoters50/3437683
atatttttt

SEQ ID NO: 71893 - DNA, 10 bp, Unknown
  misc_feature (1)..( 10): Matrix.004 file - promoters50/3437683
ttctataaat

SEQ ID NO: 71894 - DNA, 8 bp, Unknown
  misc_feature (1)..( 8): Matrix.004 file - promoters50/3437683
aattgatt

SEQ ID NO: 71895 - DNA, 8 bp, Unknown
  misc_feature (1)..( 8): Matrix.004 file - promoters50/3437710
ttttacta

SEQ ID NO: 71896 - DNA, 11 bp, Unknown
  misc_feature (1)..( 11): Matrix.004 file - promoters50/3437710
cacataatttt

SEQ ID NO: 71897 - DNA, 13 bp, Unknown
  misc_feature (1)..( 13): Matrix.004 file - promoters50/3437710
tatataaatcaat

SEQ ID NO: 71898 - DNA, 9 bp, Unknown
  misc_feature (1)..( 9): Matrix.004 file - promoters50/3437725
aaattcatt

SEQ ID NO: 71899 - DNA, 8 bp, Unknown
  misc_feature (1)..( 8): Matrix.004 file - promoters50/3437725
gagaacaa

SEQ ID NO: 71900 - DNA, 8 bp, Unknown
  misc_feature (1)..( 8): Matrix.004 file - promoters50/3437776
tgaaaata

SEQ ID NO: 71901 - DNA, 7 bp, Unknown
  misc_feature (1)..( 7): Matrix.004 file - promoters50/3437779
atttacc

SEQ ID NO: 71902 - DNA, 9 bp, Unknown
  misc_feature (1)..( 9): Matrix.004 file - promoters50/3437779
agtatattt

SEQ ID NO: 71903 - DNA, 11 bp, Unknown
  misc_feature (1)..( 11): Matrix.004 file - promoters50/3437779
cttatgacaaa

SEQ ID NO: 71904 - DNA, 9 bp, Unknown
  misc_feature (1)..( 9): Matrix.004 file - promoters50/3437779
atttatttt

SEQ ID NO: 71905 - DNA, 12 bp, Unknown
  misc_feature (1)..( 12): Matrix.004 file - promoters50/3437803
aaaattattata

SEQ ID NO: 71906 - DNA, 12 bp, Unknown
  misc_feature (1)..( 12): Matrix.004 file - promoters50/3437803
tcctatttaaag

SEQ ID NO: 71907 - DNA, 8 bp, Unknown
  misc_feature (1)..( 8): Matrix.004 file - promoters50/3437871
ttccaaaa

SEQ ID NO: 71908 - DNA, 11 bp, Unknown
  misc_feature (1)..( 11): Matrix.004 file - promoters50/3437871
gaccaaaacaa

SEQ ID NO: 71909 - DNA, 11 bp, Unknown
  misc_feature (1)..( 11): Matrix.004 file - promoters50/3437871
aaagaaaattt

SEQ ID NO: 71910 - DNA, 10 bp, Unknown
  misc_feature (1)..( 10): Matrix.004 file - promoters50/3437962
cataaaagaa

SEQ ID NO: 71911 - DNA, 8 bp, Unknown
  misc_feature (1)..( 8): Matrix.004 file - promoters50/3437962
atttttta

SEQ ID NO: 71912 - DNA, 8 bp, Unknown
  misc_feature (1)..( 8): Matrix.004 file - promoters50/3438027
atttaaaa

SEQ ID NO: 71913 - DNA, 7 bp, Unknown
  misc_feature (1)..( 7): Matrix.004 file - promoters50/3438046
tttcttt

SEQ ID NO: 71914 - DNA, 9 bp, Unknown
  misc_feature (1)..( 9): Matrix.004 file - promoters50/3438046
taagaaaaa

SEQ ID NO: 71915 - DNA, 11 bp, Unknown
  misc_feature (1)..( 11): Matrix.004 file - promoters50/3438065
cctaaatttat

SEQ ID NO: 71916 - DNA, 8 bp, Unknown
  misc_feature (1)..( 8): Matrix.004 file - promoters50/3438065
agtaaaat

SEQ ID NO: 71917 - DNA, 12 bp, Unknown
  misc_feature (1)..( 12): Matrix.004 file - promoters50/3438065
ttaatcaaaaaa

SEQ ID NO: 71918 - DNA, 9 bp, Unknown
  misc_feature (1)..( 9): Matrix.004 file - promoters50/3438065
gaaaatttg

SEQ ID NO: 71919 - DNA, 13 bp, Unknown
  misc_feature (1)..( 13): Matrix.004 file - promoters50/3438077
aaaacaaaaaaaa

SEQ ID NO: 71920 - DNA, 10 bp, Unknown
  misc_feature (1)..( 10): Matrix.004 file - promoters50/3438077
aaggcccaat

SEQ ID NO: 71921 - DNA, 8 bp, Unknown
  misc_feature (1)..( 8): Matrix.004 file - promoters50/3438171
aggcccaa

SEQ ID NO: 71922 - DNA, 6 bp, Unknown
  misc_feature (1)..( 6): Matrix.004 file - promoters50/3438171
attttt

SEQ ID NO: 71923 - DNA, 12 bp, Unknown
  misc_feature (1)..( 12): Matrix.004 file - promoters50/3438171
catttaaaaaaa

SEQ ID NO: 71924 - DNA, 8 bp, Unknown
  misc_feature (1)..( 8): Matrix.004 file - promoters50/3438171
tatatata

SEQ ID NO: 71925 - DNA, 13 bp, Unknown
  misc_feature (1)..( 13): Matrix.004 file - promoters50/3438171
aaataaatattta

SEQ ID NO: 71926 - DNA, 9 bp, Unknown
  misc_feature (1)..( 9): Matrix.004 file - promoters50/3438171
taattttaa

SEQ ID NO: 71927 - DNA, 12 bp, Unknown
  misc_feature (1)..( 12): Matrix.004 file - promoters50/3438171
aaaaaaatttat

SEQ ID NO: 71928 - DNA, 12 bp, Unknown
  misc_feature (1)..( 12): Matrix.004 file - promoters50/3438194
cttaatatttaa

SEQ ID NO: 71929 - DNA, 13 bp, Unknown
  misc_feature (1)..( 13): Matrix.004 file - promoters50/3438208
acgaagcagagag

SEQ ID NO: 71930 - DNA, 7 bp, Unknown
  misc_feature (1)..( 7): Matrix.004 file - promoters50/3438222
aaacaat

SEQ ID NO: 71931 - DNA, 8 bp, Unknown
  misc_feature (1)..( 8): Matrix.004 file - promoters50/3438222
attactta

SEQ ID NO: 71932 - DNA, 9 bp, Unknown
  misc_feature (1)..( 9): Matrix.004 file - promoters50/3438226
tattaaatt

SEQ ID NO: 71933 - DNA, 13 bp, Unknown
  misc_feature (1)..( 13): Matrix.004 file - promoters50/3438236
tattaattttata

SEQ ID NO: 71934 - DNA, 12 bp, Unknown
  misc_feature (1)..( 12): Matrix.004 file - promoters50/3438236
gttatatataaa

SEQ ID NO: 71935 - DNA, 13 bp, Unknown
  misc_feature (1)..( 13): Matrix.004 file - promoters50/3438236
caaaataattctt

SEQ ID NO: 71936 - DNA, 17 bp, Unknown
  misc_feature (1)..( 17): Matrix.004 file - promoters50/3438291
gtaccaatttcttacac

SEQ ID NO: 71937 - DNA, 10 bp, Unknown
  misc_feature (1)..( 10): Matrix.004 file - promoters50/3438291
aaattgatct

SEQ ID NO: 71938 - DNA, 9 bp, Unknown
  misc_feature (1)..( 9): Matrix.004 file - promoters50/3438312
taaaatcaa

SEQ ID NO: 71939 - DNA, 30 bp, Unknown
  misc_feature (1)..( 30): Matrix.004 file - promoters50/3438312
acgtgtcaatttataattggctattgcttc

SEQ ID NO: 71940 - DNA, 15 bp, Unknown
  misc_feature (1)..( 15): Matrix.004 file - promoters50/3438312
cgccttagctttctc

SEQ ID NO: 71941 - DNA, 22 bp, Unknown
  misc_feature (1)..( 22): Matrix.004 file - promoters50/3438312
gaccgagtcgtcctcgtctttt

SEQ ID NO: 71942 - DNA, 20 bp, Unknown
  misc_feature (1)..( 20): Matrix.004 file - promoters50/3438312
ttcttcttctataaaacaat

SEQ ID NO: 71943 - DNA, 9 bp, Unknown
  misc_feature (1)..( 9): Matrix.004 file - promoters50/3438312
aaaaaaaac

SEQ ID NO: 71944 - DNA, 16 bp, Unknown
  misc_feature (1)..( 16): Matrix.004 file - promoters50/3438312
gaccgagtcgtcctcg

SEQ ID NO: 71945 - DNA, 8 bp, Unknown
  misc_feature (1)..( 8): Matrix.004 file - promoters50/3438369
ttcttgcc

SEQ ID NO: 71946 - DNA, 10 bp, Unknown
  misc_feature (1)..( 10): Matrix.004 file - promoters50/3438369
aagaatgaaa

SEQ ID NO: 71947 - DNA, 10 bp, Unknown
  misc_feature (1)..( 10): Matrix.004 file - promoters50/3438381
aaaatattaa

SEQ ID NO: 71948 - DNA, 11 bp, Unknown
  misc_feature (1)..( 11): Matrix.004 file - promoters50/3438420
ttctaacaccc

SEQ ID NO: 71949 - DNA, 12 bp, Unknown
  misc_feature (1)..( 12): Matrix.004 file - promoters50/3438420
aatgtataataa

SEQ ID NO: 71950 - DNA, 11 bp, Unknown
  misc_feature (1)..( 11): Matrix.004 file - promoters50/3438479
ccaataaaata

SEQ ID NO: 71951 - DNA, 8 bp, Unknown
  misc_feature (1)..( 8): Matrix.004 file - promoters50/3438494
cgttatct

SEQ ID NO: 71952 - DNA, 9 bp, Unknown
  misc_feature (1)..( 9): Matrix.004 file - promoters50/3438494
atatataaa

SEQ ID NO: 71953 - DNA, 10 bp, Unknown
  misc_feature (1)..( 10): Matrix.004 file - promoters50/3438505
aatttgagtt

SEQ ID NO: 71954 - DNA, 8 bp, Unknown
  misc_feature (1)..( 8): Matrix.004 file - promoters50/3438505
tacacata

SEQ ID NO: 71955 - DNA, 6 bp, Unknown
  misc_feature (1)..( 6): Matrix.004 file - promoters50/3438505
cgacat

SEQ ID NO: 71956 - DNA, 7 bp, Unknown
  misc_feature (1)..( 7): Matrix.004 file - promoters50/3438505
gttcctt

SEQ ID NO: 71957 - DNA, 8 bp, Unknown
  misc_feature (1)..( 8): Matrix.004 file - promoters50/3438512
gttgattc

SEQ ID NO: 71958 - DNA, 11 bp, Unknown
  misc_feature (1)..( 11): Matrix.004 file - promoters50/3438512
caaaaatttat

SEQ ID NO: 71959 - DNA, 13 bp, Unknown
  misc_feature (1)..( 13): Matrix.004 file - promoters50/3438512
tgactatatttta

SEQ ID NO: 71960 - DNA, 11 bp, Unknown
  misc_feature (1)..( 11): Matrix.004 file - promoters50/3438512
taaaaaaaata

SEQ ID NO: 71961 - DNA, 9 bp, Unknown
  misc_feature (1)..( 9): Matrix.004 file - promoters50/3438512
atgtttata

SEQ ID NO: 71962 - DNA, 9 bp, Unknown
  misc_feature (1)..( 9): Matrix.004 file - promoters50/3438512
acgttttta

SEQ ID NO: 71963 - DNA, 9 bp, Unknown
  misc_feature (1)..( 9): Matrix.004 file - promoters50/3438518
taaaaaaat

SEQ ID NO: 71964 - DNA, 10 bp, Unknown
  misc_feature (1)..( 10): Matrix.004 file - promoters50/3438594
ttatataaaa

SEQ ID NO: 71965 - DNA, 8 bp, Unknown
  misc_feature (1)..( 8): Matrix.004 file - promoters50/3438594
aattaatt

SEQ ID NO: 71966 - DNA, 10 bp, Unknown
  misc_feature (1)..( 10): Matrix.004 file - promoters50/3438594
taaattaaaa

SEQ ID NO: 71967 - DNA, 10 bp, Unknown
  misc_feature (1)..( 10): Matrix.004 file - promoters50/3438594
aaaagaaaag

SEQ ID NO: 71968 - DNA, 5 bp, Unknown
  misc_feature (1)..( 5): Matrix.004 file - promoters50/3438594
ccaaa

SEQ ID NO: 71969 - DNA, 9 bp, Unknown
  misc_feature (1)..( 9): Matrix.004 file - promoters50/3438594
taaaaaact

SEQ ID NO: 71970 - DNA, 11 bp, Unknown
  misc_feature (1)..( 11): Matrix.004 file - promoters50/3438594
aattattatgt

SEQ ID NO: 71971 - DNA, 8 bp, Unknown
  misc_feature (1)..( 8): Matrix.004 file - promoters50/3438594
ctatttag

SEQ ID NO: 71972 - DNA, 10 bp, Unknown
  misc_feature (1)..( 10): Matrix.004 file - promoters50/3438624
ttaaaaactt

SEQ ID NO: 71973 - DNA, 8 bp, Unknown
  misc_feature (1)..( 8): Matrix.004 file - promoters50/3438624
tgttttgc

SEQ ID NO: 71974 - DNA, 8 bp, Unknown
  misc_feature (1)..( 8): Matrix.004 file - promoters50/3438632
aaaaaatt

SEQ ID NO: 71975 - DNA, 7 bp, Unknown
  misc_feature (1)..( 7): Matrix.004 file - promoters50/3438634
gaaaaag

SEQ ID NO: 71976 - DNA, 10 bp, Unknown
  misc_feature (1)..( 10): Matrix.004 file - promoters50/3438648
tattcaaaac

SEQ ID NO: 71977 - DNA, 12 bp, Unknown
  misc_feature (1)..( 12): Matrix.004 file - promoters50/3438648
aaacagaaaaaa

SEQ ID NO: 71978 - DNA, 10 bp, Unknown
  misc_feature (1)..( 10): Matrix.004 file - promoters50/3438648
gaaaaaaaat

SEQ ID NO: 71979 - DNA, 13 bp, Unknown
  misc_feature (1)..( 13): Matrix.004 file - promoters50/3438771
attgaaaaaatta

SEQ ID NO: 71980 - DNA, 11 bp, Unknown
  misc_feature (1)..( 11): Matrix.004 file - promoters50/3438785
acaaaaataaa

SEQ ID NO: 71981 - DNA, 8 bp, Unknown
  misc_feature (1)..( 8): Matrix.004 file - promoters50/3438919
attagtga

SEQ ID NO: 71982 - DNA, 11 bp, Unknown
  misc_feature (1)..( 11): Matrix.004 file - promoters50/3438919
gtttaaacaaa

SEQ ID NO: 71983 - DNA, 7 bp, Unknown
  misc_feature (1)..( 7): Matrix.004 file - promoters50/3438927
ctttgat

SEQ ID NO: 71984 - DNA, 9 bp, Unknown
  misc_feature (1)..( 9): Matrix.004 file - promoters50/3438927
ataagtaaa

SEQ ID NO: 71985 - DNA, 9 bp, Unknown
  misc_feature (1)..( 9): Matrix.004 file - promoters50/3438927
aaaaaaaat

SEQ ID NO: 71986 - DNA, 9 bp, Unknown
  misc_feature (1)..( 9): Matrix.004 file - promoters50/3438927
aaaaaaaaa

SEQ ID NO: 71987 - DNA, 8 bp, Unknown
  misc_feature (1)..( 8): Matrix.004 file - promoters50/3438927
agtaaaaa

SEQ ID NO: 71988 - DNA, 13 bp, Unknown
  misc_feature (1)..( 13): Matrix.004 file - promoters50/3438944
gaaatatcttaac

SEQ ID NO: 71989 - DNA, 8 bp, Unknown
  misc_feature (1)..( 8): Matrix.004 file - promoters50/3438946
acaaaaag

SEQ ID NO: 71990 - DNA, 8 bp, Unknown
  misc_feature (1)..( 8): Matrix.004 file - promoters50/3438946
tcaaaatc

SEQ ID NO: 71991 - DNA, 7 bp, Unknown
  misc_feature (1)..( 7): Matrix.004 file - promoters50/3438946
agaaagt

SEQ ID NO: 71992 - DNA, 8 bp, Unknown
  misc_feature (1)..( 8): Matrix.004 file - promoters50/3438990
gttaattg

SEQ ID NO: 71993 - DNA, 10 bp, Unknown
  misc_feature (1)..( 10): Matrix.004 file - promoters50/3439000
tataaatata

SEQ ID NO: 71994 - DNA, 7 bp, Unknown
  misc_feature (1)..( 7): Matrix.004 file - promoters50/3439012
aataatt

SEQ ID NO: 71995 - DNA, 7 bp, Unknown
  misc_feature (1)..( 7): Matrix.004 file - promoters50/3439012
tctctat

SEQ ID NO: 71996 - DNA, 12 bp, Unknown
  misc_feature (1)..( 12): Matrix.004 file - promoters50/3439014
attaattacaga

SEQ ID NO: 71997 - DNA, 11 bp, Unknown
  misc_feature (1)..( 11): Matrix.004 file - promoters50/3439026
tttttgctcca

SEQ ID NO: 71998 - DNA, 8 bp, Unknown
  misc_feature (1)..( 8): Matrix.004 file - promoters50/3439026
aaagaata

SEQ ID NO: 71999 - DNA, 9 bp, Unknown
  misc_feature (1)..( 9): Matrix.004 file - promoters50/3439026
aagagtttt

SEQ ID NO: 72000 - DNA, 7 bp, Unknown
  misc_feature (1)..( 7): Matrix.004 file - promoters50/3439026
cgagatc

SEQ ID NO: 72001 - DNA, 8 bp, Unknown
  misc_feature (1)..( 8): Matrix.004 file - promoters50/3439026
aaataatt

SEQ ID NO: 72002 - DNA, 6 bp, Unknown
  misc_feature (1)..( 6): Matrix.004 file - promoters50/3439044
tttata

SEQ ID NO: 72003 - DNA, 9 bp, Unknown
  misc_feature (1)..( 9): Matrix.004 file - promoters50/3439044
aaaaaggtg

SEQ ID NO: 72004 - DNA, 9 bp, Unknown
  misc_feature (1)..( 9): Matrix.004 file - promoters50/3439056
agtttcttg

SEQ ID NO: 72005 - DNA, 14 bp, Unknown
  misc_feature (1)..( 14): Matrix.004 file - promoters50/3439059
aactgaaataatta

SEQ ID NO: 72006 - DNA, 9 bp, Unknown
  misc_feature (1)..( 9): Matrix.004 file - promoters50/3439059
ttataaata

SEQ ID NO: 72007 - DNA, 10 bp, Unknown
  misc_feature (1)..( 10): Matrix.004 file - promoters50/3439063
tataaaaatg

SEQ ID NO: 72008 - DNA, 12 bp, Unknown
  misc_feature (1)..( 12): Matrix.004 file - promoters50/3439063
aacatgtcttaa

SEQ ID NO: 72009 - DNA, 10 bp, Unknown
  misc_feature (1)..( 10): Matrix.004 file - promoters50/3439129
actcaaaatt

SEQ ID NO: 72010 - DNA, 8 bp, Unknown
  misc_feature (1)..( 8): Matrix.004 file - promoters50/3439129
tttaagaa

SEQ ID NO: 72011 - DNA, 7 bp, Unknown
  misc_feature (1)..( 7): Matrix.004 file - promoters50/3439129
taattta

SEQ ID NO: 72012 - DNA, 5 bp, Unknown
  misc_feature (1)..( 5): Matrix.004 file - promoters50/3439129
agaga

SEQ ID NO: 72013 - DNA, 9 bp, Unknown
  misc_feature (1)..( 9): Matrix.004 file - promoters50/3439129
tctatttaa

SEQ ID NO: 72014 - DNA, 7 bp, Unknown
  misc_feature (1)..( 7): Matrix.004 file - promoters50/3439129
aaacaga

SEQ ID NO: 72015 - DNA, 10 bp, Unknown
  misc_feature (1)..( 10): Matrix.004 file - promoters50/3439145
taacagagat

SEQ ID NO: 72016 - DNA, 7 bp, Unknown
  misc_feature (1)..( 7): Matrix.004 file - promoters50/3439145
ataatta

SEQ ID NO: 72017 - DNA, 7 bp, Unknown
  misc_feature (1)..( 7): Matrix.004 file - promoters50/3439175
ttaaaaa

SEQ ID NO: 72018 - DNA, 8 bp, Unknown
  misc_feature (1)..( 8): Matrix.004 file - promoters50/3439206
catgattt

SEQ ID NO: 72019 - DNA, 13 bp, Unknown
  misc_feature (1)..( 13): Matrix.004 file - promoters50/3439206
aagaaaattcttt

SEQ ID NO: 72020 - DNA, 7 bp, Unknown
  misc_feature (1)..( 7): Matrix.004 file - promoters50/3439224
caaaaaa

SEQ ID NO: 72021 - DNA, 12 bp, Unknown
  misc_feature (1)..( 12): Matrix.004 file - promoters50/3439224
attatatgggcc

SEQ ID NO: 72022 - DNA, 8 bp, Unknown
  misc_feature (1)..( 8): Matrix.004 file - promoters50/3439289
tttgttgt

SEQ ID NO: 72023 - DNA, 10 bp, Unknown
  misc_feature (1)..( 10): Matrix.004 file - promoters50/3439289
agttatttta

SEQ ID NO: 72024 - DNA, 10 bp, Unknown
  misc_feature (1)..( 10): Matrix.004 file - promoters50/3439289
actgattttt

SEQ ID NO: 72025 - DNA, 16 bp, Unknown
  misc_feature (1)..( 16): Matrix.004 file - promoters50/3439289
ccataaaaaaaaatat

SEQ ID NO: 72026 - DNA, 10 bp, Unknown
  misc_feature (1)..( 10): Matrix.004 file - promoters50/3439289
caaaaaaaga

SEQ ID NO: 72027 - DNA, 10 bp, Unknown
  misc_feature (1)..( 10): Matrix.004 file - promoters50/3439289
aattgtactt

SEQ ID NO: 72028 - DNA, 13 bp, Unknown
  misc_feature (1)..( 13): Matrix.004 file - promoters50/3439303
tcattaaagaaaa

SEQ ID NO: 72029 - DNA, 10 bp, Unknown
  misc_feature (1)..( 10): Matrix.004 file - promoters50/3439307
gtatggattc

SEQ ID NO: 72030 - DNA, 7 bp, Unknown
  misc_feature (1)..( 7): Matrix.004 file - promoters50/3439307
gaagatc

SEQ ID NO: 72031 - DNA, 8 bp, Unknown
  misc_feature (1)..( 8): Matrix.004 file - promoters50/3439330
tgataaga

SEQ ID NO: 72032 - DNA, 7 bp, Unknown
  misc_feature (1)..( 7): Matrix.004 file - promoters50/3439330
attttaa

SEQ ID NO: 72033 - DNA, 7 bp, Unknown
  misc_feature (1)..( 7): Matrix.004 file - promoters50/3439330
aataaaa

SEQ ID NO: 72034 - DNA, 8 bp, Unknown
  misc_feature (1)..( 8): Matrix.004 file - promoters50/3439334
aaaagaga

SEQ ID NO: 72035 - DNA, 9 bp, Unknown
  misc_feature (1)..( 9): Matrix.004 file - promoters50/3439334
ttttatttg

SEQ ID NO: 72036 - DNA, 7 bp, Unknown
  misc_feature (1)..( 7): Matrix.004 file - promoters50/3439334
ttatatg

SEQ ID NO: 72037 - DNA, 7 bp, Unknown
  misc_feature (1)..( 7): Matrix.004 file - promoters50/3439334
aaaataa

SEQ ID NO: 72038 - DNA, 8 bp, Unknown
  misc_feature (1)..( 8): Matrix.004 file - promoters50/3439334
aaaaataa

SEQ ID NO: 72039 - DNA, 7 bp, Unknown
  misc_feature (1)..( 7): Matrix.004 file - promoters50/3439334
ttaaaat

SEQ ID NO: 72040 - DNA, 6 bp, Unknown
  misc_feature (1)..( 6): Matrix.004 file - promoters50/3439353
aaactt

SEQ ID NO: 72041 - DNA, 8 bp, Unknown
  misc_feature (1)..( 8): Matrix.004 file - promoters50/3439364
aaatcttt

SEQ ID NO: 72042 - DNA, 7 bp, Unknown
  misc_feature (1)..( 7): Matrix.004 file - promoters50/3439364
aaaaaaa

SEQ ID NO: 72043 - DNA, 17 bp, Unknown
  misc_feature (1)..( 17): Matrix.004 file - promoters50/3439364
tagattttaacaaatat

SEQ ID NO: 72044 - DNA, 9 bp, Unknown
  misc_feature (1)..( 9): Matrix.004 file - promoters50/3439364
tctatataa

SEQ ID NO: 72045 - DNA, 9 bp, Unknown
  misc_feature (1)..( 9): Matrix.004 file - promoters50/3439364
aaaaaaaag

SEQ ID NO: 72046 - DNA, 10 bp, Unknown
  misc_feature (1)..( 10): Matrix.004 file - promoters50/3439374
attaaatata

SEQ ID NO: 72047 - DNA, 12 bp, Unknown
  misc_feature (1)..( 12): Matrix.004 file - promoters50/3439392
tcttaattaaaa

SEQ ID NO: 72048 - DNA, 9 bp, Unknown
  misc_feature (1)..( 9): Matrix.004 file - promoters50/3439416
aaaatggtt

SEQ ID NO: 72049 - DNA, 13 bp, Unknown
  misc_feature (1)..( 13): Matrix.004 file - promoters50/3439420
taaaataaaatgt

SEQ ID NO: 72050 - DNA, 11 bp, Unknown
  misc_feature (1)..( 11): Matrix.004 file - promoters50/3439420
tgattttacta

SEQ ID NO: 72051 - DNA, 9 bp, Unknown
  misc_feature (1)..( 9): Matrix.004 file - promoters50/3439457
gcgtcaaaa

SEQ ID NO: 72052 - DNA, 11 bp, Unknown
  misc_feature (1)..( 11): Matrix.004 file - promoters50/3439472
tgaatttttgt

SEQ ID NO: 72053 - DNA, 10 bp, Unknown
  misc_feature (1)..( 10): Matrix.004 file - promoters50/3439482
ccattttcta

SEQ ID NO: 72054 - DNA, 12 bp, Unknown
  misc_feature (1)..( 12): Matrix.004 file - promoters50/3439506
cacaaattatgc

SEQ ID NO: 72055 - DNA, 8 bp, Unknown
  misc_feature (1)..( 8): Matrix.004 file - promoters50/3439506
aaattgaa

SEQ ID NO: 72056 - DNA, 8 bp, Unknown
  misc_feature (1)..( 8): Matrix.004 file - promoters50/3439595
aaaaaaga

SEQ ID NO: 72057 - DNA, 11 bp, Unknown
  misc_feature (1)..( 11): Matrix.004 file - promoters50/3439605
cccttataaaa

SEQ ID NO: 72058 - DNA, 8 bp, Unknown
  misc_feature (1)..( 8): Matrix.004 file - promoters50/3439614
cgattaaa

SEQ ID NO: 72059 - DNA, 9 bp, Unknown
  misc_feature (1)..( 9): Matrix.004 file - promoters50/3439637
caaaaaaag

SEQ ID NO: 72060 - DNA, 9 bp, Unknown
  misc_feature (1)..( 9): Matrix.004 file - promoters50/3439637
aataaaata

SEQ ID NO: 72061 - DNA, 9 bp, Unknown
  misc_feature (1)..( 9): Matrix.004 file - promoters50/3439637
caaatttct

SEQ ID NO: 72062 - DNA, 8 bp, Unknown
  misc_feature (1)..( 8): Matrix.004 file - promoters50/3439662
caaagaaa

SEQ ID NO: 72063 - DNA, 16 bp, Unknown
  misc_feature (1)..( 16): Matrix.004 file - promoters50/3439905
atttgaaatacggaga

SEQ ID NO: 72064 - DNA, 7 bp, Unknown
  misc_feature (1)..( 7): Matrix.004 file - promoters50/3439905
aaataat

SEQ ID NO: 72065 - DNA, 7 bp, Unknown
  misc_feature (1)..( 7): Matrix.004 file - promoters50/3441755
taaaaaa

SEQ ID NO: 72066 - DNA, 8 bp, Unknown
  misc_feature (1)..( 8): Matrix.004 file - promoters50/3441755
tgtttatt

SEQ ID NO: 72067 - DNA, 8 bp, Unknown
  misc_feature (1)..( 8): Matrix.004 file - promoters50/3442171
ctgtgttg

SEQ ID NO: 72068 - DNA, 13 bp, Unknown
  misc_feature (1)..( 13): Matrix.004 file - promoters50/3442171
aatatgtttgatt

SEQ ID NO: 72069 - DNA, 12 bp, Unknown
  misc_feature (1)..( 12): Matrix.004 file - promoters50/3442286
acagatttgtta

SEQ ID NO: 72070 - DNA, 8 bp, Unknown
  misc_feature (1)..( 8): Matrix.004 file - promoters50/3442286
aattaaat

SEQ ID NO: 72071 - DNA, 9 bp, Unknown
  misc_feature (1)..( 9): Matrix.004 file - promoters50/3442286
taaaaaaaa

SEQ ID NO: 72072 - DNA, 11 bp, Unknown
  misc_feature (1)..( 11): Matrix.004 file - promoters50/3442286
cctcttcctag

SEQ ID NO: 72073 - DNA, 7 bp, Unknown
  misc_feature (1)..( 7): Matrix.004 file - promoters50/3442286
ttgtttc

SEQ ID NO: 72074 - DNA, 8 bp, Unknown
  misc_feature (1)..( 8): Matrix.004 file - promoters50/3442286
atatcatt

SEQ ID NO: 72075 - DNA, 10 bp, Unknown
  misc_feature (1)..( 10): Matrix.004 file - promoters50/3442286
taatgttttc

SEQ ID NO: 72076 - DNA, 7 bp, Unknown
  misc_feature (1)..( 7): Matrix.004 file - promoters50/3442286
gtttctc

SEQ ID NO: 72077 - DNA, 9 bp, Unknown
  misc_feature (1)..( 9): Matrix.004 file - promoters50/3442286
catgttttc

SEQ ID NO: 72078 - DNA, 7 bp, Unknown
  misc_feature (1)..( 7): Matrix.004 file - promoters50/3443646
caaaaac

SEQ ID NO: 72079 - DNA, 9 bp, Unknown
  misc_feature (1)..( 9): Matrix.004 file - promoters50/3443646
aattattaa

SEQ ID NO: 72080 - DNA, 7 bp, Unknown
  misc_feature (1)..( 7): Matrix.004 file - promoters50/3443646
atttaag

SEQ ID NO: 72081 - DNA, 12 bp, Unknown
  misc_feature (1)..( 12): Matrix.004 file - promoters50/3443646
gatcaaaaagaa

SEQ ID NO: 72082 - DNA, 9 bp, Unknown
  misc_feature (1)..( 9): Matrix.004 file - promoters50/3445482
aataaagct

SEQ ID NO: 72083 - DNA, 8 bp, Unknown
  misc_feature (1)..( 8): Matrix.004 file - promoters50/3445482
caaagaaa

SEQ ID NO: 72084 - DNA, 10 bp, Unknown
  misc_feature (1)..( 10): Matrix.004 file - promoters50/3445482
tgaaaaaaaa

SEQ ID NO: 72085 - DNA, 13 bp, Unknown
  misc_feature (1)..( 13): Matrix.004 file - promoters50/3447843
ttcgtatgattct

SEQ ID NO: 72086 - DNA, 8 bp, Unknown
  misc_feature (1)..( 8): Matrix.004 file - promoters50/3593205
aagatttt

SEQ ID NO: 72087 - DNA, 15 bp, Unknown
  misc_feature (1)..( 15): Matrix.004 file - promoters50/3593205
caataaattagatat

SEQ ID NO: 72088 - DNA, 13 bp, Unknown
  misc_feature (1)..( 13): Matrix.004 file - promoters50/3593205
aaaaccaaaaaac

SEQ ID NO: 72089 - DNA, 13 bp, Unknown
  misc_feature (1)..( 13): Matrix.004 file - promoters50/3593205
tatgctcagatta

SEQ ID NO: 72090 - DNA, 11 bp, Unknown
  misc_feature (1)..( 11): Matrix.004 file - promoters50/3593230
aactaatttat

SEQ ID NO: 72091 - DNA, 9 bp, Unknown
  misc_feature (1)..( 9): Matrix.004 file - promoters50/3593230
cacattcat

SEQ ID NO: 72092 - DNA, 10 bp, Unknown
  misc_feature (1)..( 10): Matrix.004 file - promoters50/3593243
cagaaaatta

SEQ ID NO: 72093 - DNA, 10 bp, Unknown
  misc_feature (1)..( 10): Matrix.004 file - promoters50/3593243
aaacataatg

SEQ ID NO: 72094 - DNA, 8 bp, Unknown
  misc_feature (1)..( 8): Matrix.004 file - promoters50/3593243
ttgttttc

SEQ ID NO: 72095 - DNA, 9 bp, Unknown
  misc_feature (1)..( 9): Matrix.004 file - promoters50/3593243
taacacata

SEQ ID NO: 72096 - DNA, 8 bp, Unknown
  misc_feature (1)..( 8): Matrix.004 file - promoters50/3593264
ccaatgtc

SEQ ID NO: 72097 - DNA, 7 bp, Unknown
  misc_feature (1)..( 7): Matrix.004 file - promoters50/3593264
aaacaaa

SEQ ID NO: 72098 - DNA, 6 bp, Unknown
  misc_feature (1)..( 6): Matrix.004 file - promoters50/3593264
aaaatt

SEQ ID NO: 72099 - DNA, 9 bp, Unknown
  misc_feature (1)..( 9): Matrix.004 file - promoters50/3593264
aaccaaacc

SEQ ID NO: 72100 - DNA, 11 bp, Unknown
  misc_feature (1)..( 11): Matrix.004 file - promoters50/3593290
tgttttgatta

SEQ ID NO: 72101 - DNA, 8 bp, Unknown
  misc_feature (1)..( 8): Matrix.004 file - promoters50/3593290
ttttgttt

SEQ ID NO: 72102 - DNA, 8 bp, Unknown
  misc_feature (1)..( 8): Matrix.004 file - promoters50/3593290
ctcagaag

SEQ ID NO: 72103 - DNA, 15 bp, Unknown
  misc_feature (1)..( 15): Matrix.004 file - promoters50/3593290
gattgttgtaacgca

SEQ ID NO: 72104 - DNA, 10 bp, Unknown
  misc_feature (1)..( 10): Matrix.004 file - promoters50/3593346
gagcttgaga

SEQ ID NO: 72105 - DNA, 8 bp, Unknown
  misc_feature (1)..( 8): Matrix.004 file - promoters50/3593538
aaacaaat

SEQ ID NO: 72106 - DNA, 8 bp, Unknown
  misc_feature (1)..( 8): Matrix.004 file - promoters50/3593538
aaacaaaa

SEQ ID NO: 72107 - DNA, 10 bp, Unknown
  misc_feature (1)..( 10): Matrix.004 file - promoters50/3593733
aaacaaaaga

SEQ ID NO: 72108 - DNA, 9 bp, Unknown
  misc_feature (1)..( 9): Matrix.004 file - promoters50/3593733
aataagtga

SEQ ID NO: 72109 - DNA, 12 bp, Unknown
  misc_feature (1)..( 12): Matrix.004 file - promoters50/3594312
acgcaaacaatt

SEQ ID NO: 72110 - DNA, 7 bp, Unknown
  misc_feature (1)..( 7): Matrix.004 file - promoters50/3594312
gtttata

SEQ ID NO: 72111 - DNA, 9 bp, Unknown
  misc_feature (1)..( 9): Matrix.004 file - promoters50/3594312
aattaaaaa

SEQ ID NO: 72112 - DNA, 11 bp, Unknown
  misc_feature (1)..( 11): Matrix.004 file - promoters50/3594312
aatgattttta

SEQ ID NO: 72113 - DNA, 9 bp, Unknown
  misc_feature (1)..( 9): Matrix.004 file - promoters50/3594312
aattttgtt

SEQ ID NO: 72114 - DNA, 11 bp, Unknown
  misc_feature (1)..( 11): Matrix.004 file - promoters50/3594312
gaaaaatttaa

SEQ ID NO: 72115 - DNA, 8 bp, Unknown
  misc_feature (1)..( 8): Matrix.004 file - promoters50/3594312
agcaaaaa

SEQ ID NO: 72116 - DNA, 13 bp, Unknown
  misc_feature (1)..( 13): Matrix.004 file - promoters50/3594312
attaaaaatacta

SEQ ID NO: 72117 - DNA, 11 bp, Unknown
  misc_feature (1)..( 11): Matrix.004 file - promoters50/3594312
taaaaaacttt

SEQ ID NO: 72118 - DNA, 7 bp, Unknown
  misc_feature (1)..( 7): Matrix.004 file - promoters50/3597145
aaatact

SEQ ID NO: 72119 - DNA, 9 bp, Unknown
  misc_feature (1)..( 9): Matrix.004 file - promoters50/3597145
cgaagaaaa

SEQ ID NO: 72120 - DNA, 11 bp, Unknown
  misc_feature (1)..( 11): Matrix.004 file - promoters50/3597145
aactaataaca

SEQ ID NO: 72121 - DNA, 13 bp, Unknown
  misc_feature (1)..( 13): Matrix.004 file - promoters50/3597145
taaaaagttcgca

SEQ ID NO: 72122 - DNA, 10 bp, Unknown
  misc_feature (1)..( 10): Matrix.004 file - promoters50/3597158
ttttctttaa

SEQ ID NO: 72123 - DNA, 8 bp, Unknown
  misc_feature (1)..( 8): Matrix.004 file - promoters50/3597158
tcacatag

SEQ ID NO: 72124 - DNA, 10 bp, Unknown
  misc_feature (1)..( 10): Matrix.004 file - promoters50/3597158
tttccaaaga

SEQ ID NO: 72125 - DNA, 12 bp, Unknown
  misc_feature (1)..( 12): Matrix.004 file - promoters50/3597158
attcagtttcac

SEQ ID NO: 72126 - DNA, 10 bp, Unknown
  misc_feature (1)..( 10): Matrix.004 file - promoters50/3597162
caaagcaaaa

SEQ ID NO: 72127 - DNA, 7 bp, Unknown
  misc_feature (1)..( 7): Matrix.004 file - promoters50/3597162
tgacttg

SEQ ID NO: 72128 - DNA, 8 bp, Unknown
  misc_feature (1)..( 8): Matrix.004 file - promoters50/3597162
agataaaa

SEQ ID NO: 72129 - DNA, 7 bp, Unknown
  misc_feature (1)..( 7): Matrix.004 file - promoters50/3597162
aatagat

SEQ ID NO: 72130 - DNA, 13 bp, Unknown
  misc_feature (1)..( 13): Matrix.004 file - promoters50/3597162
tctatataaatcc

SEQ ID NO: 72131 - DNA, 9 bp, Unknown
  misc_feature (1)..( 9): Matrix.004 file - promoters50/3597162
ttaaaattg

SEQ ID NO: 72132 - DNA, 9 bp, Unknown
  misc_feature (1)..( 9): Matrix.004 file - promoters50/3597162
ttcaattta

SEQ ID NO: 72133 - DNA, 9 bp, Unknown
  misc_feature (1)..( 9): Matrix.004 file - promoters50/3597162
ttttatttt

SEQ ID NO: 72134 - DNA, 10 bp, Unknown
  misc_feature (1)..( 10): Matrix.004 file - promoters50/3597162
aatttgaatt

SEQ ID NO: 72135 - DNA, 13 bp, Unknown
  misc_feature (1)..( 13): Matrix.004 file - promoters50/3597162
gtttaaacttaaa

SEQ ID NO: 72136 - DNA, 9 bp, Unknown
  misc_feature (1)..( 9): Matrix.004 file - promoters50/3597162
aaataaaaa

SEQ ID NO: 72137 - DNA, 10 bp, Unknown
  misc_feature (1)..( 10): Matrix.004 file - promoters50/3597175
aaagaaaatt

SEQ ID NO: 72138 - DNA, 13 bp, Unknown
  misc_feature (1)..( 13): Matrix.004 file - promoters50/3597175
aaccaaaaaaaga

SEQ ID NO: 72139 - DNA, 12 bp, Unknown
  misc_feature (1)..( 12): Matrix.004 file - promoters50/3597175
attattttttaa

SEQ ID NO: 72140 - DNA, 11 bp, Unknown
  misc_feature (1)..( 11): Matrix.004 file - promoters50/3597175
tttaattaaca

SEQ ID NO: 72141 - DNA, 8 bp, Unknown
  misc_feature (1)..( 8): Matrix.004 file - promoters50/3597175
tattataa

SEQ ID NO: 72142 - DNA, 10 bp, Unknown
  misc_feature (1)..( 10): Matrix.004 file - promoters50/3597175
aaataaatct

SEQ ID NO: 72143 - DNA, 11 bp, Unknown
  misc_feature (1)..( 11): Matrix.004 file - promoters50/3597175
gtaaaattgat

SEQ ID NO: 72144 - DNA, 11 bp, Unknown
  misc_feature (1)..( 11): Matrix.004 file - promoters50/3598435
ttaataaaata

SEQ ID NO: 72145 - DNA, 8 bp, Unknown
  misc_feature (1)..( 8): Matrix.004 file - promoters50/3598435
cttgctga

SEQ ID NO: 72146 - DNA, 12 bp, Unknown
  misc_feature (1)..( 12): Matrix.004 file - promoters50/3598610
tctttgcttgtg

SEQ ID NO: 72147 - DNA, 8 bp, Unknown
  misc_feature (1)..( 8): Matrix.004 file - promoters50/3600084
attggatt

SEQ ID NO: 72148 - DNA, 7 bp, Unknown
  misc_feature (1)..( 7): Matrix.004 file - promoters50/3600084
tccaaaa

SEQ ID NO: 72149 - DNA, 7 bp, Unknown
  misc_feature (1)..( 7): Matrix.004 file - promoters50/3611292
ttaaaaa

SEQ ID NO: 72150 - DNA, 10 bp, Unknown
  misc_feature (1)..( 10): Matrix.004 file - promoters50/3611292
taactaaaat

SEQ ID NO: 72151 - DNA, 10 bp, Unknown
  misc_feature (1)..( 10): Matrix.004 file - promoters50/3611292
ataaaattaa

SEQ ID NO: 72152 - DNA, 11 bp, Unknown
  misc_feature (1)..( 11): Matrix.004 file - promoters50/3629913
taaaaaaatta

SEQ ID NO: 72153 - DNA, 8 bp, Unknown
  misc_feature (1)..( 8): Matrix.004 file - promoters50/3629913
tactgaat

SEQ ID NO: 72154 - DNA, 7 bp, Unknown
  misc_feature (1)..( 7): Matrix.004 file - promoters50/3631200
caaatgt

SEQ ID NO: 72155 - DNA, 11 bp, Unknown
  misc_feature (1)..( 11): Matrix.004 file - promoters50/3631200
agaatatgata

SEQ ID NO: 72156 - DNA, 8 bp, Unknown
  misc_feature (1)..( 8): Matrix.004 file - promoters50/3631200
aagctata

SEQ ID NO: 72157 - DNA, 9 bp, Unknown
  misc_feature (1)..( 9): Matrix.004 file - promoters50/3659211
cttagattg

SEQ ID NO: 72158 - DNA, 8 bp, Unknown
  misc_feature (1)..( 8): Matrix.004 file - promoters50/4254292
ataaatta

SEQ ID NO: 72159 - DNA, 7 bp, Unknown
  misc_feature (1)..( 7): Matrix.004 file - promoters50/4254292
attaatt

SEQ ID NO: 72160 - DNA, 8 bp, Unknown
  misc_feature (1)..( 8): Matrix.004 file - promoters50/4254292
actttaca

SEQ ID NO: 72161 - DNA, 8 bp, Unknown
  misc_feature (1)..( 8): Matrix.004 file - promoters50/4254299
ctaaaaaa

SEQ ID NO: 72162 - DNA, 11 bp, Unknown
  misc_feature (1)..( 11): Matrix.004 file - promoters50/4254299
atttttctttc

SEQ ID NO: 72163 - DNA, 10 bp, Unknown
  misc_feature (1)..( 10): Matrix.004 file - promoters50/4254299
ttaatttaac

SEQ ID NO: 72164 - DNA, 11 bp, Unknown
  misc_feature (1)..( 11): Matrix.004 file - promoters50/4254299
ataatttaatt

SEQ ID NO: 72165 - DNA, 13 bp, Unknown
  misc_feature (1)..( 13): Matrix.004 file - promoters50/4254307
aaaaatttaacct

SEQ ID NO: 72166 - DNA, 9 bp, Unknown
  misc_feature (1)..( 9): Matrix.004 file - promoters50/4254307
tgattcttt

SEQ ID NO: 72167 - DNA, 8 bp, Unknown
  misc_feature (1)..( 8): Matrix.004 file - promoters50/4254426
ttgatttt

SEQ ID NO: 72168 - DNA, 9 bp, Unknown
  misc_feature (1)..( 9): Matrix.004 file - promoters50/4254505
tccttataa

SEQ ID NO: 72169 - DNA, 11 bp, Unknown
  misc_feature (1)..( 11): Matrix.004 file - promoters50/4254505
tcactctaaac

SEQ ID NO: 72170 - DNA, 7 bp, Unknown
  misc_feature (1)..( 7): Matrix.004 file - promoters50/4254505
acagttt

SEQ ID NO: 72171 - DNA, 9 bp, Unknown
  misc_feature (1)..( 9): Matrix.004 file - promoters50/4254505
atcaaaaaa

SEQ ID NO: 72172 - DNA, 8 bp, Unknown
  misc_feature (1)..( 8): Matrix.004 file - promoters50/4254505
agtgtttc

SEQ ID NO: 72173 - DNA, 8 bp, Unknown
  misc_feature (1)..( 8): Matrix.004 file - promoters50/4254505
aaaatatt

SEQ ID NO: 72174 - DNA, 13 bp, Unknown
  misc_feature (1)..( 13): Matrix.004 file - promoters50/4262398
aaatttataattt

SEQ ID NO: 72175 - DNA, 9 bp, Unknown
  misc_feature (1)..( 9): Matrix.004 file - promoters50/4262420
cttttctcg

SEQ ID NO: 72176 - DNA, 7 bp, Unknown
  misc_feature (1)..( 7): Matrix.004 file - promoters50/4262420
aaaaaca

SEQ ID NO: 72177 - DNA, 10 bp, Unknown
  misc_feature (1)..( 10): Matrix.004 file - promoters50/4262420
cgagaaaaaa

SEQ ID NO: 72178 - DNA, 6 bp, Unknown
  misc_feature (1)..( 6): Matrix.004 file - promoters50/4262422
aatttt

SEQ ID NO: 72179 - DNA, 7 bp, Unknown
  misc_feature (1)..( 7): Matrix.004 file - promoters50/4262422
atgataa

SEQ ID NO: 72180 - DNA, 8 bp, Unknown
  misc_feature (1)..( 8): Matrix.004 file - promoters50/4262428
tgatttga

SEQ ID NO: 72181 - DNA, 10 bp, Unknown
  misc_feature (1)..( 10): Matrix.004 file - promoters50/4262428
attatgtcat

SEQ ID NO: 72182 - DNA, 12 bp, Unknown
  misc_feature (1)..( 12): Matrix.004 file - promoters50/4262428
taaaataaatat

SEQ ID NO: 72183 - DNA, 11 bp, Unknown
  misc_feature (1)..( 11): Matrix.004 file - promoters50/4262446
atgttaaataa

SEQ ID NO: 72184 - DNA, 12 bp, Unknown
  misc_feature (1)..( 12): Matrix.004 file - promoters50/4262446
ctacataaaaaa

SEQ ID NO: 72185 - DNA, 9 bp, Unknown
  misc_feature (1)..( 9): Matrix.004 file - promoters50/4262446
caaaaataa

SEQ ID NO: 72186 - DNA, 12 bp, Unknown
  misc_feature (1)..( 12): Matrix.004 file - promoters50/4262446
actatcaaatca

SEQ ID NO: 72187 - DNA, 14 bp, Unknown
  misc_feature (1)..( 14): Matrix.004 file - promoters50/4262480
aaattttgaaatta

SEQ ID NO: 72188 - DNA, 11 bp, Unknown
  misc_feature (1)..( 11): Matrix.004 file - promoters50/4262480
atggttgaact

SEQ ID NO: 72189 - DNA, 9 bp, Unknown
  misc_feature (1)..( 9): Matrix.004 file - promoters50/4262496
atggctgaa

SEQ ID NO: 72190 - DNA, 13 bp, Unknown
  misc_feature (1)..( 13): Matrix.004 file - promoters50/4262503
actaattaaagat

SEQ ID NO: 72191 - DNA, 8 bp, Unknown
  misc_feature (1)..( 8): Matrix.004 file - promoters50/4262503
aacacaaa

SEQ ID NO: 72192 - DNA, 9 bp, Unknown
  misc_feature (1)..( 9): Matrix.004 file - promoters50/4262562
acatttgtt

SEQ ID NO: 72193 - DNA, 15 bp, Unknown
  misc_feature (1)..( 15): Matrix.004 file - promoters50/4265060
ctaatttaacttttt

SEQ ID NO: 72194 - DNA, 9 bp, Unknown
  misc_feature (1)..( 9): Matrix.004 file - promoters50/4265060
agaagataa

SEQ ID NO: 72195 - DNA, 8 bp, Unknown
  misc_feature (1)..( 8): Matrix.004 file - promoters50/4265060
aatctctc

SEQ ID NO: 72196 - DNA, 7 bp, Unknown
  misc_feature (1)..( 7): Matrix.004 file - promoters50/4265060
agaaatg

SEQ ID NO: 72197 - DNA, 9 bp, Unknown
  misc_feature (1)..( 9): Matrix.004 file - promoters50/4265060
taaacatat

SEQ ID NO: 72198 - DNA, 9 bp, Unknown
  misc_feature (1)..( 9): Matrix.004 file - promoters50/4265699
tcagagaaa

SEQ ID NO: 72199 - DNA, 8 bp, Unknown
  misc_feature (1)..( 8): Matrix.004 file - promoters50/4265699
taaatcaa

SEQ ID NO: 72200 - DNA, 8 bp, Unknown
  misc_feature (1)..( 8): Matrix.004 file - promoters50/4266227
aaagaaaa

SEQ ID NO: 72201 - DNA, 8 bp, Unknown
  misc_feature (1)..( 8): Matrix.004 file - promoters50/4266608
ttggaaga

SEQ ID NO: 72202 - DNA, 8 bp, Unknown
  misc_feature (1)..( 8): Matrix.004 file - promoters50/4266608
aagtaaac

SEQ ID NO: 72203 - DNA, 10 bp, Unknown
  misc_feature (1)..( 10): Matrix.004 file - promoters50/4267125
agataaaaat

SEQ ID NO: 72204 - DNA, 15 bp, Unknown
  misc_feature (1)..( 15): Matrix.004 file - promoters50/4267125
gttttatttgtgtga

SEQ ID NO: 72205 - DNA, 12 bp, Unknown
  misc_feature (1)..( 12): Matrix.004 file - promoters50/4267125
aaagaacatcat

SEQ ID NO: 72206 - DNA, 18 bp, Unknown
  misc_feature (1)..( 18): Matrix.004 file - promoters50/4267125
tcaacaacattttgtttt

SEQ ID NO: 72207 - DNA, 10 bp, Unknown
  misc_feature (1)..( 10): Matrix.004 file - promoters50/4268705
ctttttgttt

SEQ ID NO: 72208 - DNA, 8 bp, Unknown
  misc_feature (1)..( 8): Matrix.004 file - promoters50/4268705
ttgaattt

SEQ ID NO: 72209 - DNA, 12 bp, Unknown
  misc_feature (1)..( 12): Matrix.004 file - promoters50/4270131
ataaatgggcta

SEQ ID NO: 72210 - DNA, 8 bp, Unknown
  misc_feature (1)..( 8): Matrix.004 file - promoters50/4270131
ttaataac

SEQ ID NO: 72211 - DNA, 11 bp, Unknown
  misc_feature (1)..( 11): Matrix.004 file - promoters50/4281568
tttgtttcttt

SEQ ID NO: 72212 - DNA, 8 bp, Unknown
  misc_feature (1)..( 8): Matrix.004 file - promoters50/4281576
taaaaaag

SEQ ID NO: 72213 - DNA, 10 bp, Unknown
  misc_feature (1)..( 10): Matrix.004 file - promoters50/4281645
taataaaaat

SEQ ID NO: 72214 - DNA, 8 bp, Unknown
  misc_feature (1)..( 8): Matrix.004 file - promoters50/4281659
aatatgat

SEQ ID NO: 72215 - DNA, 8 bp, Unknown
  misc_feature (1)..( 8): Matrix.004 file - promoters50/4281659
cttcatta

SEQ ID NO: 72216 - DNA, 8 bp, Unknown
  misc_feature (1)..( 8): Matrix.004 file - promoters50/4281676
aaatatgt

SEQ ID NO: 72217 - DNA, 8 bp, Unknown
  misc_feature (1)..( 8): Matrix.004 file - promoters50/4281690
attctttg

SEQ ID NO: 72218 - DNA, 11 bp, Unknown
  misc_feature (1)..( 11): Matrix.004 file - promoters50/4281690
aacaaacaaac

SEQ ID NO: 72219 - DNA, 13 bp, Unknown
  misc_feature (1)..( 13): Matrix.004 file - promoters50/4281690
taacaaaaaaatc

SEQ ID NO: 72220 - DNA, 12 bp, Unknown
  misc_feature (1)..( 12): Matrix.004 file - promoters50/4281690
agatttatttca

SEQ ID NO: 72221 - DNA, 8 bp, Unknown
  misc_feature (1)..( 8): Matrix.004 file - promoters50/4281698
aaaaaaag

SEQ ID NO: 72222 - DNA, 8 bp, Unknown
  misc_feature (1)..( 8): Matrix.004 file - promoters50/4281698
aaaggctt

SEQ ID NO: 72223 - DNA, 12 bp, Unknown
  misc_feature (1)..( 12): Matrix.004 file - promoters50/4281711
tgtattcgattt

SEQ ID NO: 72224 - DNA, 16 bp, Unknown
  misc_feature (1)..( 16): Matrix.004 file - promoters50/4281711
ctagattaaaaaagta

SEQ ID NO: 72225 - DNA, 6 bp, Unknown
  misc_feature (1)..( 6): Matrix.004 file - promoters50/4281737
taataa

SEQ ID NO: 72226 - DNA, 10 bp, Unknown
  misc_feature (1)..( 10): Matrix.004 file - promoters50/4281744
atataaaaaa

SEQ ID NO: 72227 - DNA, 13 bp, Unknown
  misc_feature (1)..( 13): Matrix.004 file - promoters50/4281773
aatatgatttaac

SEQ ID NO: 72228 - DNA, 11 bp, Unknown
  misc_feature (1)..( 11): Matrix.004 file - promoters50/4281773
atacataggtt

SEQ ID NO: 72229 - DNA, 10 bp, Unknown
  misc_feature (1)..( 10): Matrix.004 file - promoters50/4281830
caagaaaaag

SEQ ID NO: 72230 - DNA, 11 bp, Unknown
  misc_feature (1)..( 11): Matrix.004 file - promoters50/4281830
caaacgtataa

SEQ ID NO: 72231 - DNA, 9 bp, Unknown
  misc_feature (1)..( 9): Matrix.004 file - promoters50/4281845
aaatatata

SEQ ID NO: 72232 - DNA, 8 bp, Unknown
  misc_feature (1)..( 8): Matrix.004 file - promoters50/4281876
taaaaaat

SEQ ID NO: 72233 - DNA, 7 bp, Unknown
  misc_feature (1)..( 7): Matrix.004 file - promoters50/4281876
agtattc

SEQ ID NO: 72234 - DNA, 5 bp, Unknown
  misc_feature (1)..( 5): Matrix.004 file - promoters50/4281880
ttttg

SEQ ID NO: 72235 - DNA, 8 bp, Unknown
  misc_feature (1)..( 8): Matrix.004 file - promoters50/4281880
tattagat

SEQ ID NO: 72236 - DNA, 11 bp, Unknown
  misc_feature (1)..( 11): Matrix.004 file - promoters50/4281896
aatagtaaaat

SEQ ID NO: 72237 - DNA, 8 bp, Unknown
  misc_feature (1)..( 8): Matrix.004 file - promoters50/4281925
tcgatttt

SEQ ID NO: 72238 - DNA, 7 bp, Unknown
  misc_feature (1)..( 7): Matrix.004 file - promoters50/4281925
taaaaat

SEQ ID NO: 72239 - DNA, 13 bp, Unknown
  misc_feature (1)..( 13): Matrix.004 file - promoters50/4281925
atgaattaaaaat

SEQ ID NO: 72240 - DNA, 8 bp, Unknown
  misc_feature (1)..( 8): Matrix.004 file - promoters50/4281961
taaattat

SEQ ID NO: 72241 - DNA, 9 bp, Unknown
  misc_feature (1)..( 9): Matrix.004 file - promoters50/4281994
aaagattga

SEQ ID NO: 72242 - DNA, 7 bp, Unknown
  misc_feature (1)..( 7): Matrix.004 file - promoters50/4281994
aatattt

SEQ ID NO: 72243 - DNA, 9 bp, Unknown
  misc_feature (1)..( 9): Matrix.004 file - promoters50/4281994
ataaaaatt

SEQ ID NO: 72244 - DNA, 9 bp, Unknown
  misc_feature (1)..( 9): Matrix.004 file - promoters50/4281994
ataaaatta

SEQ ID NO: 72245 - DNA, 9 bp, Unknown
  misc_feature (1)..( 9): Matrix.004 file - promoters50/4281994
attttaatt

SEQ ID NO: 72246 - DNA, 9 bp, Unknown
  misc_feature (1)..( 9): Matrix.004 file - promoters50/4281997
tataaatta

SEQ ID NO: 72247 - DNA, 12 bp, Unknown
  misc_feature (1)..( 12): Matrix.004 file - promoters50/4281997
agtttagggaaa

SEQ ID NO: 72248 - DNA, 7 bp, Unknown
  misc_feature (1)..( 7): Matrix.004 file - promoters50/4281997
aattatc

SEQ ID NO: 72249 - DNA, 8 bp, Unknown
  misc_feature (1)..( 8): Matrix.004 file - promoters50/4281997
aatgtttt

SEQ ID NO: 72250 - DNA, 6 bp, Unknown
  misc_feature (1)..( 6): Matrix.004 file - promoters50/4281997
ttttac

SEQ ID NO: 72251 - DNA, 9 bp, Unknown
  misc_feature (1)..( 9): Matrix.004 file - promoters50/4281997
acattcaat

SEQ ID NO: 72252 - DNA, 6 bp, Unknown
  misc_feature (1)..( 6): Matrix.004 file - promoters50/4281997
cattat

SEQ ID NO: 72253 - DNA, 7 bp, Unknown
  misc_feature (1)..( 7): Matrix.004 file - promoters50/4282012
acgcaaa

SEQ ID NO: 72254 - DNA, 7 bp, Unknown
  misc_feature (1)..( 7): Matrix.004 file - promoters50/4282059
aaattat

SEQ ID NO: 72255 - DNA, 9 bp, Unknown
  misc_feature (1)..( 9): Matrix.004 file - promoters50/4282066
aaaaacttt

SEQ ID NO: 72256 - DNA, 8 bp, Unknown
  misc_feature (1)..( 8): Matrix.004 file - promoters50/4282066
gataaaga

SEQ ID NO: 72257 - DNA, 8 bp, Unknown
  misc_feature (1)..( 8): Matrix.004 file - promoters50/4282066
gaagttga

SEQ ID NO: 72258 - DNA, 10 bp, Unknown
  misc_feature (1)..( 10): Matrix.004 file - promoters50/4282066
tgaagttcac

SEQ ID NO: 72259 - DNA, 10 bp, Unknown
  misc_feature (1)..( 10): Matrix.004 file - promoters50/4282066
gagtgttttt

SEQ ID NO: 72260 - DNA, 8 bp, Unknown
  misc_feature (1)..( 8): Matrix.004 file - promoters50/4282066
tggatcgg

SEQ ID NO: 72261 - DNA, 7 bp, Unknown
  misc_feature (1)..( 7): Matrix.004 file - promoters50/4282072
ggtttga

SEQ ID NO: 72262 - DNA, 7 bp, Unknown
  misc_feature (1)..( 7): Matrix.004 file - promoters50/4282072
caaaaac

SEQ ID NO: 72263 - DNA, 9 bp, Unknown
  misc_feature (1)..( 9): Matrix.004 file - promoters50/4282072
ttcaaaaac

SEQ ID NO: 72264 - DNA, 9 bp, Unknown
  misc_feature (1)..( 9): Matrix.004 file - promoters50/4282086
atttgtttt

SEQ ID NO: 72265 - DNA, 10 bp, Unknown
  misc_feature (1)..( 10): Matrix.004 file - promoters50/4282126
aatctgcttt

SEQ ID NO: 72266 - DNA, 11 bp, Unknown
  misc_feature (1)..( 11): Matrix.004 file - promoters50/4282126
aatttatagtt

SEQ ID NO: 72267 - DNA, 8 bp, Unknown
  misc_feature (1)..( 8): Matrix.004 file - promoters50/4282145
tttgtaat

SEQ ID NO: 72268 - DNA, 8 bp, Unknown
  misc_feature (1)..( 8): Matrix.004 file - promoters50/4282145
ttgacaaa

SEQ ID NO: 72269 - DNA, 8 bp, Unknown
  misc_feature (1)..( 8): Matrix.004 file - promoters50/4282145
tataataa

SEQ ID NO: 72270 - DNA, 11 bp, Unknown
  misc_feature (1)..( 11): Matrix.004 file - promoters50/4282145
aataaaagaaa

SEQ ID NO: 72271 - DNA, 10 bp, Unknown
  misc_feature (1)..( 10): Matrix.004 file - promoters50/4282145
gaaaatgatt

SEQ ID NO: 72272 - DNA, 8 bp, Unknown
  misc_feature (1)..( 8): Matrix.004 file - promoters50/4282182
aaattaca

SEQ ID NO: 72273 - DNA, 9 bp, Unknown
  misc_feature (1)..( 9): Matrix.004 file - promoters50/4282182
tgaataaaa

SEQ ID NO: 72274 - DNA, 9 bp, Unknown
  misc_feature (1)..( 9): Matrix.004 file - promoters50/4282182
agaaaatta

SEQ ID NO: 72275 - DNA, 10 bp, Unknown
  misc_feature (1)..( 10): Matrix.004 file - promoters50/4282186
cctttatttt

SEQ ID NO: 72276 - DNA, 10 bp, Unknown
  misc_feature (1)..( 10): Matrix.004 file - promoters50/4282186
tttttgttta

SEQ ID NO: 72277 - DNA, 13 bp, Unknown
  misc_feature (1)..( 13): Matrix.004 file - promoters50/4282198
ctaaaatttataa

SEQ ID NO: 72278 - DNA, 12 bp, Unknown
  misc_feature (1)..( 12): Matrix.004 file - promoters50/4282198
aaataaaacgaa

SEQ ID NO: 72279 - DNA, 14 bp, Unknown
  misc_feature (1)..( 14): Matrix.004 file - promoters50/4282202
ccaataatacaaca

SEQ ID NO: 72280 - DNA, 15 bp, Unknown
  misc_feature (1)..( 15): Matrix.004 file - promoters50/4282202
aaaaagaaaacaata

SEQ ID NO: 72281 - DNA, 8 bp, Unknown
  misc_feature (1)..( 8): Matrix.004 file - promoters50/4282251
caaaacaa

SEQ ID NO: 72282 - DNA, 10 bp, Unknown
  misc_feature (1)..( 10): Matrix.004 file - promoters50/4282251
gttcaaaaaa

SEQ ID NO: 72283 - DNA, 8 bp, Unknown
  misc_feature (1)..( 8): Matrix.004 file - promoters50/4282251
caaataag

SEQ ID NO: 72284 - DNA, 8 bp, Unknown
  misc_feature (1)..( 8): Matrix.004 file - promoters50/4282251
tgaatgat

SEQ ID NO: 72285 - DNA, 12 bp, Unknown
  misc_feature (1)..( 12): Matrix.004 file - promoters50/4282292
gtagatttgtat

SEQ ID NO: 72286 - DNA, 7 bp, Unknown
  misc_feature (1)..( 7): Matrix.004 file - promoters50/4282292
aaattaa

SEQ ID NO: 72287 - DNA, 7 bp, Unknown
  misc_feature (1)..( 7): Matrix.004 file - promoters50/4282308
aaagcaa

SEQ ID NO: 72288 - DNA, 8 bp, Unknown
  misc_feature (1)..( 8): Matrix.004 file - promoters50/4282308
gttacaat

SEQ ID NO: 72289 - DNA, 10 bp, Unknown
  misc_feature (1)..( 10): Matrix.004 file - promoters50/4282308
tgattattac

SEQ ID NO: 72290 - DNA, 13 bp, Unknown
  misc_feature (1)..( 13): Matrix.004 file - promoters50/4282308
aataagttatata

SEQ ID NO: 72291 - DNA, 6 bp, Unknown
  misc_feature (1)..( 6): Matrix.004 file - promoters50/4282316
tcaaaa

SEQ ID NO: 72292 - DNA, 18 bp, Unknown
  misc_feature (1)..( 18): Matrix.004 file - promoters50/4282316
aaaagtttagggaaaatg

SEQ ID NO: 72293 - DNA, 7 bp, Unknown
  misc_feature (1)..( 7): Matrix.004 file - promoters50/4282316
aattatc

SEQ ID NO: 72294 - DNA, 7 bp, Unknown
  misc_feature (1)..( 7): Matrix.004 file - promoters50/4282316
gaaaatg

SEQ ID NO: 72295 - DNA, 8 bp, Unknown
  misc_feature (1)..( 8): Matrix.004 file - promoters50/4282316
aatgtttt

SEQ ID NO: 72296 - DNA, 6 bp, Unknown
  misc_feature (1)..( 6): Matrix.004 file - promoters50/4282316
ttttac

SEQ ID NO: 72297 - DNA, 9 bp, Unknown
  misc_feature (1)..( 9): Matrix.004 file - promoters50/4282316
acattcaat

SEQ ID NO: 72298 - DNA, 6 bp, Unknown
  misc_feature (1)..( 6): Matrix.004 file - promoters50/4282316
cattat

SEQ ID NO: 72299 - DNA, 7 bp, Unknown
  misc_feature (1)..( 7): Matrix.004 file - promoters50/4282320
acgcaaa

SEQ ID NO: 72300 - DNA, 7 bp, Unknown
  misc_feature (1)..( 7): Matrix.004 file - promoters50/4282324
ttgaagt

SEQ ID NO: 72301 - DNA, 10 bp, Unknown
  misc_feature (1)..( 10): Matrix.004 file - promoters50/4282324
aatttaaatt

SEQ ID NO: 72302 - DNA, 17 bp, Unknown
  misc_feature (1)..( 17): Matrix.004 file - promoters50/4282324
aaatttcttgaactaaa

SEQ ID NO: 72303 - DNA, 15 bp, Unknown
  misc_feature (1)..( 15): Matrix.004 file - promoters50/4282324
ttaattttaagaatt

SEQ ID NO: 72304 - DNA, 11 bp, Unknown
  misc_feature (1)..( 11): Matrix.004 file - promoters50/4282327
ttaattataag

SEQ ID NO: 72305 - DNA, 7 bp, Unknown
  misc_feature (1)..( 7): Matrix.004 file - promoters50/4282327
ttaaaac

SEQ ID NO: 72306 - DNA, 9 bp, Unknown
  misc_feature (1)..( 9): Matrix.004 file - promoters50/4282327
ttaattagt

SEQ ID NO: 72307 - DNA, 8 bp, Unknown
  misc_feature (1)..( 8): Matrix.004 file - promoters50/4282327
gaaaagaa

SEQ ID NO: 72308 - DNA, 9 bp, Unknown
  misc_feature (1)..( 9): Matrix.004 file - promoters50/4282329
cttaattag

SEQ ID NO: 72309 - DNA, 12 bp, Unknown
  misc_feature (1)..( 12): Matrix.004 file - promoters50/4282406
aaccttgctgac

SEQ ID NO: 72310 - DNA, 7 bp, Unknown
  misc_feature (1)..( 7): Matrix.004 file - promoters50/4282406
aaaaaaa

SEQ ID NO: 72311 - DNA, 10 bp, Unknown
  misc_feature (1)..( 10): Matrix.004 file - promoters50/4282406
ataatgtaat

SEQ ID NO: 72312 - DNA, 13 bp, Unknown
  misc_feature (1)..( 13): Matrix.004 file - promoters50/4282406
caaaaacaatttt

SEQ ID NO: 72313 - DNA, 8 bp, Unknown
  misc_feature (1)..( 8): Matrix.004 file - promoters50/4282414
tctaaact

SEQ ID NO: 72314 - DNA, 6 bp, Unknown
  misc_feature (1)..( 6): Matrix.004 file - promoters50/4282414
atttct

SEQ ID NO: 72315 - DNA, 5 bp, Unknown
  misc_feature (1)..( 5): Matrix.004 file - promoters50/4282414
caaac

SEQ ID NO: 72316 - DNA, 10 bp, Unknown
  misc_feature (1)..( 10): Matrix.004 file - promoters50/4282414
acaaaatttt

SEQ ID NO: 72317 - DNA, 10 bp, Unknown
  misc_feature (1)..( 10): Matrix.004 file - promoters50/4282418
taaacaaaat

SEQ ID NO: 72318 - DNA, 10 bp, Unknown
  misc_feature (1)..( 10): Matrix.004 file - promoters50/4282418
taaaatataa

SEQ ID NO: 72319 - DNA, 10 bp, Unknown
  misc_feature (1)..( 10): Matrix.004 file - promoters50/4282418
gaaaaaaata

SEQ ID NO: 72320 - DNA, 14 bp, Unknown
  misc_feature (1)..( 14): Matrix.004 file - promoters50/4282421
ttaagaaaattaat

SEQ ID NO: 72321 - DNA, 8 bp, Unknown
  misc_feature (1)..( 8): Matrix.004 file - promoters50/4282421
ttttcatt

SEQ ID NO: 72322 - DNA, 6 bp, Unknown
  misc_feature (1)..( 6): Matrix.004 file - promoters50/4282425
atttgt

SEQ ID NO: 72323 - DNA, 8 bp, Unknown
  misc_feature (1)..( 8): Matrix.004 file - promoters50/4282425
ttaaatta

SEQ ID NO: 72324 - DNA, 8 bp, Unknown
  misc_feature (1)..( 8): Matrix.004 file - promoters50/4282425
atttataa

SEQ ID NO: 72325 - DNA, 13 bp, Unknown
  misc_feature (1)..( 13): Matrix.004 file - promoters50/4282425
gtgacatcaaaaa

SEQ ID NO: 72326 - DNA, 9 bp, Unknown
  misc_feature (1)..( 9): Matrix.004 file - promoters50/4282425
atatataat

SEQ ID NO: 72327 - DNA, 8 bp, Unknown
  misc_feature (1)..( 8): Matrix.004 file - promoters50/4282425
tattaata

SEQ ID NO: 72328 - DNA, 8 bp, Unknown
  misc_feature (1)..( 8): Matrix.004 file - promoters50/4282425
atataaaa

SEQ ID NO: 72329 - DNA, 8 bp, Unknown
  misc_feature (1)..( 8): Matrix.004 file - promoters50/4282428
atcaataa

SEQ ID NO: 72330 - DNA, 8 bp, Unknown
  misc_feature (1)..( 8): Matrix.004 file - promoters50/4282436
attgatgt

SEQ ID NO: 72331 - DNA, 31 bp, Unknown
  misc_feature (1)..( 31): Matrix.004 file - promoters50/4282436
tacgtgtcaatttataattggctattgcttc

SEQ ID NO: 72332 - DNA, 15 bp, Unknown
  misc_feature (1)..( 15): Matrix.004 file - promoters50/4282436
cgccttagctttctc

SEQ ID NO: 72333 - DNA, 22 bp, Unknown
  misc_feature (1)..( 22): Matrix.004 file - promoters50/4282436
gaccgagtcgtcctcgtctttt

SEQ ID NO: 72334 - DNA, 19 bp, Unknown
  misc_feature (1)..( 19): Matrix.004 file - promoters50/4282477
ttcttcttctataaatcaa

SEQ ID NO: 72335 - DNA, 13 bp, Unknown
  misc_feature (1)..( 13): Matrix.004 file - promoters50/4282477
atatttaacaaaa

SEQ ID NO: 72336 - DNA, 10 bp, Unknown
  misc_feature (1)..( 10): Matrix.004 file - promoters50/4282477
taaaatttga

SEQ ID NO: 72337 - DNA, 8 bp, Unknown
  misc_feature (1)..( 8): Matrix.004 file - promoters50/4282477
ataaaatt

SEQ ID NO: 72338 - DNA, 11 bp, Unknown
  misc_feature (1)..( 11): Matrix.004 file - promoters50/4282477
aataaatcgaa

SEQ ID NO: 72339 - DNA, 9 bp, Unknown
  misc_feature (1)..( 9): Matrix.004 file - promoters50/4282487
cataaattt

SEQ ID NO: 72340 - DNA, 11 bp, Unknown
  misc_feature (1)..( 11): Matrix.004 file - promoters50/4282487
tcttttgattt

SEQ ID NO: 72341 - DNA, 9 bp, Unknown
  misc_feature (1)..( 9): Matrix.004 file - promoters50/4282487
ttttagttt

SEQ ID NO: 72342 - DNA, 7 bp, Unknown
  misc_feature (1)..( 7): Matrix.004 file - promoters50/4282487
aatattt

SEQ ID NO: 72343 - DNA, 8 bp, Unknown
  misc_feature (1)..( 8): Matrix.004 file - promoters50/4282487
taataaat

SEQ ID NO: 72344 - DNA, 10 bp, Unknown
  misc_feature (1)..( 10): Matrix.004 file - promoters50/4282487
ttttgatttg

SEQ ID NO: 72345 - DNA, 12 bp, Unknown
  misc_feature (1)..( 12): Matrix.004 file - promoters50/4282503
aacttttaagta

SEQ ID NO: 72346 - DNA, 10 bp, Unknown
  misc_feature (1)..( 10): Matrix.004 file - promoters50/4282503
ttttaataac

SEQ ID NO: 72347 - DNA, 11 bp, Unknown
  misc_feature (1)..( 11): Matrix.004 file - promoters50/4282503
tttattaaatg

SEQ ID NO: 72348 - DNA, 7 bp, Unknown
  misc_feature (1)..( 7): Matrix.004 file - promoters50/4282506
taaaatc

SEQ ID NO: 72349 - DNA, 10 bp, Unknown
  misc_feature (1)..( 10): Matrix.004 file - promoters50/4282510
caataaccaa

SEQ ID NO: 72350 - DNA, 10 bp, Unknown
  misc_feature (1)..( 10): Matrix.004 file - promoters50/4282510
aataaattaa

SEQ ID NO: 72351 - DNA, 7 bp, Unknown
  misc_feature (1)..( 7): Matrix.004 file - promoters50/4282560
aaaaaca

SEQ ID NO: 72352 - DNA, 9 bp, Unknown
  misc_feature (1)..( 9): Matrix.004 file - promoters50/4282560
tataaacaa

SEQ ID NO: 72353 - DNA, 9 bp, Unknown
  misc_feature (1)..( 9): Matrix.004 file - promoters50/4282560
atttcttac

SEQ ID NO: 72354 - DNA, 9 bp, Unknown
  misc_feature (1)..( 9): Matrix.004 file - promoters50/4282560
tttacaaaa

SEQ ID NO: 72355 - DNA, 9 bp, Unknown
  misc_feature (1)..( 9): Matrix.004 file - promoters50/4282560
agcttatta

SEQ ID NO: 72356 - DNA, 11 bp, Unknown
  misc_feature (1)..( 11): Matrix.004 file - promoters50/4282580
agtaaatttga

SEQ ID NO: 72357 - DNA, 9 bp, Unknown
  misc_feature (1)..( 9): Matrix.004 file - promoters50/4282580
aaacaaaaa

SEQ ID NO: 72358 - DNA, 9 bp, Unknown
  misc_feature (1)..( 9): Matrix.004 file - promoters50/4282580
tcaattttg

SEQ ID NO: 72359 - DNA, 14 bp, Unknown
  misc_feature (1)..( 14): Matrix.004 file - promoters50/4282588
atgataataatttt

SEQ ID NO: 72360 - DNA, 8 bp, Unknown
  misc_feature (1)..( 8): Matrix.004 file - promoters50/4282588
tttaaact

SEQ ID NO: 72361 - DNA, 7 bp, Unknown
  misc_feature (1)..( 7): Matrix.004 file - promoters50/4282588
aataata

SEQ ID NO: 72362 - DNA, 11 bp, Unknown
  misc_feature (1)..( 11): Matrix.004 file - promoters50/4282588
caataataaag

SEQ ID NO: 72363 - DNA, 11 bp, Unknown
  misc_feature (1)..( 11): Matrix.004 file - promoters50/4282588
aaaaaatataa

SEQ ID NO: 72364 - DNA, 10 bp, Unknown
  misc_feature (1)..( 10): Matrix.004 file - promoters50/4282588
ttgatttttt

SEQ ID NO: 72365 - DNA, 9 bp, Unknown
  misc_feature (1)..( 9): Matrix.004 file - promoters50/4282588
ctatatata

SEQ ID NO: 72366 - DNA, 11 bp, Unknown
  misc_feature (1)..( 11): Matrix.004 file - promoters50/4282588
gaaatatctaa

SEQ ID NO: 72367 - DNA, 9 bp, Unknown
  misc_feature (1)..( 9): Matrix.004 file - promoters50/4282588
ttatttttt

SEQ ID NO: 72368 - DNA, 7 bp, Unknown
  misc_feature (1)..( 7): Matrix.004 file - promoters50/4282588
tttttaa

SEQ ID NO: 72369 - DNA, 8 bp, Unknown
  misc_feature (1)..( 8): Matrix.004 file - promoters50/4282588
agaaaaac

SEQ ID NO: 72370 - DNA, 10 bp, Unknown
  misc_feature (1)..( 10): Matrix.004 file - promoters50/4282588
ttcaaataaa

SEQ ID NO: 72371 - DNA, 8 bp, Unknown
  misc_feature (1)..( 8): Matrix.004 file - promoters50/4282588
ttttaaaa

SEQ ID NO: 72372 - DNA, 9 bp, Unknown
  misc_feature (1)..( 9): Matrix.004 file - promoters50/4282588
attgtcaaa

SEQ ID NO: 72373 - DNA, 7 bp, Unknown
  misc_feature (1)..( 7): Matrix.004 file - promoters50/4282611
aaaaatc

SEQ ID NO: 72374 - DNA, 9 bp, Unknown
  misc_feature (1)..( 9): Matrix.004 file - promoters50/4282614
ttttggttc

SEQ ID NO: 72375 - DNA, 13 bp, Unknown
  misc_feature (1)..( 13): Matrix.004 file - promoters50/4282614
catataatttcat

SEQ ID NO: 72376 - DNA, 13 bp, Unknown
  misc_feature (1)..( 13): Matrix.004 file - promoters50/4282614
ctaataaatatta

SEQ ID NO: 72377 - DNA, 14 bp, Unknown
  misc_feature (1)..( 14): Matrix.004 file - promoters50/4282614
aaaatattttatat

SEQ ID NO: 72378 - DNA, 12 bp, Unknown
  misc_feature (1)..( 12): Matrix.004 file - promoters50/4282626
aaatatatttta

SEQ ID NO: 72379 - DNA, 7 bp, Unknown
  misc_feature (1)..( 7): Matrix.004 file - promoters50/4282626
aaatttg

SEQ ID NO: 72380 - DNA, 7 bp, Unknown
  misc_feature (1)..( 7): Matrix.004 file - promoters50/4282637
ataaatt

SEQ ID NO: 72381 - DNA, 8 bp, Unknown
  misc_feature (1)..( 8): Matrix.004 file - promoters50/4282647
tttgagag

SEQ ID NO: 72382 - DNA, 9 bp, Unknown
  misc_feature (1)..( 9): Matrix.004 file - promoters50/4282647
tatatataa

SEQ ID NO: 72383 - DNA, 10 bp, Unknown
  misc_feature (1)..( 10): Matrix.004 file - promoters50/4282647
aaggaattaa

SEQ ID NO: 72384 - DNA, 8 bp, Unknown
  misc_feature (1)..( 8): Matrix.004 file - promoters50/4282651
tatataaa

SEQ ID NO: 72385 - DNA, 9 bp, Unknown
  misc_feature (1)..( 9): Matrix.004 file - promoters50/4282667
aaatagaaa

SEQ ID NO: 72386 - DNA, 8 bp, Unknown
  misc_feature (1)..( 8): Matrix.004 file - promoters50/4282681
attattta

SEQ ID NO: 72387 - DNA, 9 bp, Unknown
  misc_feature (1)..( 9): Matrix.004 file - promoters50/4282681
tttaatata

SEQ ID NO: 72388 - DNA, 14 bp, Unknown
  misc_feature (1)..( 14): Matrix.004 file - promoters50/4282681
ttaaaatattaaaa

SEQ ID NO: 72389 - DNA, 7 bp, Unknown
  misc_feature (1)..( 7): Matrix.004 file - promoters50/4282681
ataaatg

SEQ ID NO: 72390 - DNA, 7 bp, Unknown
  misc_feature (1)..( 7): Matrix.004 file - promoters50/4282681
aaaaaaa

SEQ ID NO: 72391 - DNA, 9 bp, Unknown
  misc_feature (1)..( 9): Matrix.004 file - promoters50/4282681
attttaaaa

SEQ ID NO: 72392 - DNA, 7 bp, Unknown
  misc_feature (1)..( 7): Matrix.004 file - promoters50/4282695
tcttata

SEQ ID NO: 72393 - DNA, 9 bp, Unknown
  misc_feature (1)..( 9): Matrix.004 file - promoters50/4282695
tatacttaa

SEQ ID NO: 72394 - DNA, 9 bp, Unknown
  misc_feature (1)..( 9): Matrix.004 file - promoters50/4282717
taacaaaac

SEQ ID NO: 72395 - DNA, 8 bp, Unknown
  misc_feature (1)..( 8): Matrix.004 file - promoters50/4282717
ctgaggct

SEQ ID NO: 72396 - DNA, 8 bp, Unknown
  misc_feature (1)..( 8): Matrix.004 file - promoters50/4282717
taaaatta

SEQ ID NO: 72397 - DNA, 12 bp, Unknown
  misc_feature (1)..( 12): Matrix.004 file - promoters50/4282717
cttaaaataaaa

SEQ ID NO: 72398 - DNA, 8 bp, Unknown
  misc_feature (1)..( 8): Matrix.004 file - promoters50/4282717
caaattga

SEQ ID NO: 72399 - DNA, 12 bp, Unknown
  misc_feature (1)..( 12): Matrix.004 file - promoters50/4282717
ttgataacattt

SEQ ID NO: 72400 - DNA, 10 bp, Unknown
  misc_feature (1)..( 10): Matrix.004 file - promoters50/4282717
ttacattttt

SEQ ID NO: 72401 - DNA, 9 bp, Unknown
  misc_feature (1)..( 9): Matrix.004 file - promoters50/4282744
aaaacattg

SEQ ID NO: 72402 - DNA, 8 bp, Unknown
  misc_feature (1)..( 8): Matrix.004 file - promoters50/4282748
aaacataa

SEQ ID NO: 72403 - DNA, 8 bp, Unknown
  misc_feature (1)..( 8): Matrix.004 file - promoters50/4282760
cataaatt

SEQ ID NO: 72404 - DNA, 9 bp, Unknown
  misc_feature (1)..( 9): Matrix.004 file - promoters50/4282760
taaaaaaaa

SEQ ID NO: 72405 - DNA, 9 bp, Unknown
  misc_feature (1)..( 9): Matrix.004 file - promoters50/4282760
taaaattga

SEQ ID NO: 72406 - DNA, 9 bp, Unknown
  misc_feature (1)..( 9): Matrix.004 file - promoters50/4282760
gttgaataa

SEQ ID NO: 72407 - DNA, 10 bp, Unknown
  misc_feature (1)..( 10): Matrix.004 file - promoters50/4282760
attttatcaa

SEQ ID NO: 72408 - DNA, 12 bp, Unknown
  misc_feature (1)..( 12): Matrix.004 file - promoters50/4282760
accaaaagtcaa

SEQ ID NO: 72409 - DNA, 7 bp, Unknown
  misc_feature (1)..( 7): Matrix.004 file - promoters50/4282776
gttttat

SEQ ID NO: 72410 - DNA, 9 bp, Unknown
  misc_feature (1)..( 9): Matrix.004 file - promoters50/4282776
gataaaaca

SEQ ID NO: 72411 - DNA, 8 bp, Unknown
  misc_feature (1)..( 8): Matrix.004 file - promoters50/4282776
attaaaaa

SEQ ID NO: 72412 - DNA, 6 bp, Unknown
  misc_feature (1)..( 6): Matrix.004 file - promoters50/4282776
aaaatc

SEQ ID NO: 72413 - DNA, 8 bp, Unknown
  misc_feature (1)..( 8): Matrix.004 file - promoters50/4282776
actacttc

SEQ ID NO: 72414 - DNA, 7 bp, Unknown
  misc_feature (1)..( 7): Matrix.004 file - promoters50/4282776
ataaaat

SEQ ID NO: 72415 - DNA, 9 bp, Unknown
  misc_feature (1)..( 9): Matrix.004 file - promoters50/4282776
aaagtagaa

SEQ ID NO: 72416 - DNA, 9 bp, Unknown
  misc_feature (1)..( 9): Matrix.004 file - promoters50/4282776
caattctct

SEQ ID NO: 72417 - DNA, 7 bp, Unknown
  misc_feature (1)..( 7): Matrix.004 file - promoters50/4282788
ttaggtc

SEQ ID NO: 72418 - DNA, 8 bp, Unknown
  misc_feature (1)..( 8): Matrix.004 file - promoters50/4282788
tttgattg

SEQ ID NO: 72419 - DNA, 12 bp, Unknown
  misc_feature (1)..( 12): Matrix.004 file - promoters50/4282795
ctacttctctaa

SEQ ID NO: 72420 - DNA, 10 bp, Unknown
  misc_feature (1)..( 10): Matrix.004 file - promoters50/4282795
cttttgattt

SEQ ID NO: 72421 - DNA, 12 bp, Unknown
  misc_feature (1)..( 12): Matrix.004 file - promoters50/4282795
tttagtttattc

SEQ ID NO: 72422 - DNA, 7 bp, Unknown
  misc_feature (1)..( 7): Matrix.004 file - promoters50/4282795
aatattt

SEQ ID NO: 72423 - DNA, 13 bp, Unknown
  misc_feature (1)..( 13): Matrix.004 file - promoters50/4282795
aagttaatgatct

SEQ ID NO: 72424 - DNA, 9 bp, Unknown
  misc_feature (1)..( 9): Matrix.004 file - promoters50/4282795
ttatataaa

SEQ ID NO: 72425 - DNA, 12 bp, Unknown
  misc_feature (1)..( 12): Matrix.004 file - promoters50/4282877
aacttttaagta

SEQ ID NO: 72426 - DNA, 9 bp, Unknown
  misc_feature (1)..( 9): Matrix.004 file - promoters50/4282877
gaaaagaaa

SEQ ID NO: 72427 - DNA, 10 bp, Unknown
  misc_feature (1)..( 10): Matrix.004 file - promoters50/4282877
atttcttggg

SEQ ID NO: 72428 - DNA, 9 bp, Unknown
  misc_feature (1)..( 9): Matrix.004 file - promoters50/4282915
gagtatttt

SEQ ID NO: 72429 - DNA, 8 bp, Unknown
  misc_feature (1)..( 8): Matrix.004 file - promoters50/4282923
tatcacaa

SEQ ID NO: 72430 - DNA, 10 bp, Unknown
  misc_feature (1)..( 10): Matrix.004 file - promoters50/4282931
aacttataaa

SEQ ID NO: 72431 - DNA, 7 bp, Unknown
  misc_feature (1)..( 7): Matrix.004 file - promoters50/4282931
attaaaa

SEQ ID NO: 72432 - DNA, 8 bp, Unknown
  misc_feature (1)..( 8): Matrix.004 file - promoters50/4282931
aaaatcta

SEQ ID NO: 72433 - DNA, 10 bp, Unknown
  misc_feature (1)..( 10): Matrix.004 file - promoters50/4282931
aaattcaaaa

SEQ ID NO: 72434 - DNA, 9 bp, Unknown
  misc_feature (1)..( 9): Matrix.004 file - promoters50/4282931
aatcataaa

SEQ ID NO: 72435 - DNA, 10 bp, Unknown
  misc_feature (1)..( 10): Matrix.004 file - promoters50/4282931
caataattca

SEQ ID NO: 72436 - DNA, 6 bp, Unknown
  misc_feature (1)..( 6): Matrix.004 file - promoters50/4282939
aaaatc

SEQ ID NO: 72437 - DNA, 8 bp, Unknown
  misc_feature (1)..( 8): Matrix.004 file - promoters50/4282945
tttagaaa

SEQ ID NO: 72438 - DNA, 6 bp, Unknown
  misc_feature (1)..( 6): Matrix.004 file - promoters50/4282945
aatata

SEQ ID NO: 72439 - DNA, 9 bp, Unknown
  misc_feature (1)..( 9): Matrix.004 file - promoters50/4282945
aatgaacat

SEQ ID NO: 72440 - DNA, 8 bp, Unknown
  misc_feature (1)..( 8): Matrix.004 file - promoters50/4282945
tcatcttt

SEQ ID NO: 72441 - DNA, 8 bp, Unknown
  misc_feature (1)..( 8): Matrix.004 file - promoters50/4282957
atttcttt

SEQ ID NO: 72442 - DNA, 7 bp, Unknown
  misc_feature (1)..( 7): Matrix.004 file - promoters50/4282957
gttttaa

SEQ ID NO: 72443 - DNA, 10 bp, Unknown
  misc_feature (1)..( 10): Matrix.004 file - promoters50/4282957
ttactacctt

SEQ ID NO: 72444 - DNA, 12 bp, Unknown
  misc_feature (1)..( 12): Matrix.004 file - promoters50/4282957
aaagaaactatc

SEQ ID NO: 72445 - DNA, 7 bp, Unknown
  misc_feature (1)..( 7): Matrix.004 file - promoters50/4282995
aaaaaac

SEQ ID NO: 72446 - DNA, 10 bp, Unknown
  misc_feature (1)..( 10): Matrix.004 file - promoters50/4282995
gagcttgaga

SEQ ID NO: 72447 - DNA, 7 bp, Unknown
  misc_feature (1)..( 7): Matrix.004 file - promoters50/4282995
aattgaa

SEQ ID NO: 72448 - DNA, 8 bp, Unknown
  misc_feature (1)..( 8): Matrix.004 file - promoters50/4283003
gaaaatca

SEQ ID NO: 72449 - DNA, 11 bp, Unknown
  misc_feature (1)..( 11): Matrix.004 file - promoters50/4283003
aataatttata

SEQ ID NO: 72450 - DNA, 8 bp, Unknown
  misc_feature (1)..( 8): Matrix.004 file - promoters50/4283003
atctcata

SEQ ID NO: 72451 - DNA, 9 bp, Unknown
  misc_feature (1)..( 9): Matrix.004 file - promoters50/4283003
ctatatata

SEQ ID NO: 72452 - DNA, 8 bp, Unknown
  misc_feature (1)..( 8): Matrix.004 file - promoters50/4283003
agaaaaaa

SEQ ID NO: 72453 - DNA, 8 bp, Unknown
  misc_feature (1)..( 8): Matrix.004 file - promoters50/4283005
aaacattg

SEQ ID NO: 72454 - DNA, 11 bp, Unknown
  misc_feature (1)..( 11): Matrix.004 file - promoters50/4283041
tcaaaaaaaag

SEQ ID NO: 72455 - DNA, 11 bp, Unknown
  misc_feature (1)..( 11): Matrix.004 file - promoters50/4283057
aaaaaaagaaa

SEQ ID NO: 72456 - DNA, 7 bp, Unknown
  misc_feature (1)..( 7): Matrix.004 file - promoters50/4283057
gttataa

SEQ ID NO: 72457 - DNA, 14 bp, Unknown
  misc_feature (1)..( 14): Matrix.004 file - promoters50/4283191
ctttggaaaagaaa

SEQ ID NO: 72458 - DNA, 8 bp, Unknown
  misc_feature (1)..( 8): Matrix.004 file - promoters50/4283191
atttttga

SEQ ID NO: 72459 - DNA, 8 bp, Unknown
  misc_feature (1)..( 8): Matrix.004 file - promoters50/4283191
ttaggttg

SEQ ID NO: 72460 - DNA, 8 bp, Unknown
  misc_feature (1)..( 8): Matrix.004 file - promoters50/4283191
aaattaaa

SEQ ID NO: 72461 - DNA, 11 bp, Unknown
  misc_feature (1)..( 11): Matrix.004 file - promoters50/4283218
tcgatttgtga

SEQ ID NO: 72462 - DNA, 9 bp, Unknown
  misc_feature (1)..( 9): Matrix.004 file - promoters50/4283218
gtttcttaa

SEQ ID NO: 72463 - DNA, 16 bp, Unknown
  misc_feature (1)..( 16): Matrix.004 file - promoters50/4283218
tctatataaacgccgc

SEQ ID NO: 72464 - DNA, 7 bp, Unknown
  misc_feature (1)..( 7): Matrix.004 file - promoters50/4283222
aaaaatt

SEQ ID NO: 72465 - DNA, 9 bp, Unknown
  misc_feature (1)..( 9): Matrix.004 file - promoters50/4283222
aaaatattt

SEQ ID NO: 72466 - DNA, 13 bp, Unknown
  misc_feature (1)..( 13): Matrix.004 file - promoters50/4283222
atgaataatatat

SEQ ID NO: 72467 - DNA, 11 bp, Unknown
  misc_feature (1)..( 11): Matrix.004 file - promoters50/4283222
gaaactaattt

SEQ ID NO: 72468 - DNA, 10 bp, Unknown
  misc_feature (1)..( 10): Matrix.004 file - promoters50/4283222
aaatatttta

SEQ ID NO: 72469 - DNA, 8 bp, Unknown
  misc_feature (1)..( 8): Matrix.004 file - promoters50/4283230
aaatatat

SEQ ID NO: 72470 - DNA, 9 bp, Unknown
  misc_feature (1)..( 9): Matrix.004 file - promoters50/4283230
gataaaaat

SEQ ID NO: 72471 - DNA, 15 bp, Unknown
  misc_feature (1)..( 15): Matrix.004 file - promoters50/4283230
aagtaaaaaaatatt

SEQ ID NO: 72472 - DNA, 9 bp, Unknown
  misc_feature (1)..( 9): Matrix.004 file - promoters50/4283240
aaaaataat

SEQ ID NO: 72473 - DNA, 11 bp, Unknown
  misc_feature (1)..( 11): Matrix.004 file - promoters50/4283240
ataaattgata

SEQ ID NO: 72474 - DNA, 7 bp, Unknown
  misc_feature (1)..( 7): Matrix.004 file - promoters50/4283247
taaattt

SEQ ID NO: 72475 - DNA, 6 bp, Unknown
  misc_feature (1)..( 6): Matrix.004 file - promoters50/4283247
aattta

SEQ ID NO: 72476 - DNA, 8 bp, Unknown
  misc_feature (1)..( 8): Matrix.004 file - promoters50/4283278
gatttttg

SEQ ID NO: 72477 - DNA, 14 bp, Unknown
  misc_feature (1)..( 14): Matrix.004 file - promoters50/4283278
acataattttatat

SEQ ID NO: 72478 - DNA, 10 bp, Unknown
  misc_feature (1)..( 10): Matrix.004 file - promoters50/4283282
tttaaaatat

SEQ ID NO: 72479 - DNA, 10 bp, Unknown
  misc_feature (1)..( 10): Matrix.004 file - promoters50/4283293
ctttttaaag

SEQ ID NO: 72480 - DNA, 7 bp, Unknown
  misc_feature (1)..( 7): Matrix.004 file - promoters50/4283293
tatttaa

SEQ ID NO: 72481 - DNA, 9 bp, Unknown
  misc_feature (1)..( 9): Matrix.004 file - promoters50/4283297
aaaaagaac

SEQ ID NO: 72482 - DNA, 9 bp, Unknown
  misc_feature (1)..( 9): Matrix.004 file - promoters50/4283309
aaaaaattt

SEQ ID NO: 72483 - DNA, 12 bp, Unknown
  misc_feature (1)..( 12): Matrix.004 file - promoters50/4283309
aataaaaatata

SEQ ID NO: 72484 - DNA, 8 bp, Unknown
  misc_feature (1)..( 8): Matrix.004 file - promoters50/4283309
aaagcaaa

SEQ ID NO: 72485 - DNA, 7 bp, Unknown
  misc_feature (1)..( 7): Matrix.004 file - promoters50/4283315
atcaaat

SEQ ID NO: 72486 - DNA, 8 bp, Unknown
  misc_feature (1)..( 8): Matrix.004 file - promoters50/4283338
tcacattc

SEQ ID NO: 72487 - DNA, 11 bp, Unknown
  misc_feature (1)..( 11): Matrix.004 file - promoters50/4283347
tagtaaatgtt

SEQ ID NO: 72488 - DNA, 8 bp, Unknown
  misc_feature (1)..( 8): Matrix.004 file - promoters50/4283347
ataaaaat

SEQ ID NO: 72489 - DNA, 8 bp, Unknown
  misc_feature (1)..( 8): Matrix.004 file - promoters50/4283347
tactgtta

SEQ ID NO: 72490 - DNA, 9 bp, Unknown
  misc_feature (1)..( 9): Matrix.004 file - promoters50/4283355
aattcgtac

SEQ ID NO: 72491 - DNA, 8 bp, Unknown
  misc_feature (1)..( 8): Matrix.004 file - promoters50/4283358
aaaacaaa

SEQ ID NO: 72492 - DNA, 14 bp, Unknown
  misc_feature (1)..( 14): Matrix.004 file - promoters50/4283358
ttatattttttata

SEQ ID NO: 72493 - DNA, 11 bp, Unknown
  misc_feature (1)..( 11): Matrix.004 file - promoters50/4283378
ttatatttttt

SEQ ID NO: 72494 - DNA, 7 bp, Unknown
  misc_feature (1)..( 7): Matrix.004 file - promoters50/4283378
aatgtaa

SEQ ID NO: 72495 - DNA, 11 bp, Unknown
  misc_feature (1)..( 11): Matrix.004 file - promoters50/4283378
tttaatttcat

SEQ ID NO: 72496 - DNA, 9 bp, Unknown
  misc_feature (1)..( 9): Matrix.004 file - promoters50/4283378
ctatataaa

SEQ ID NO: 72497 - DNA, 15 bp, Unknown
  misc_feature (1)..( 15): Matrix.004 file - promoters50/4283378
ataactttatattaa

SEQ ID NO: 72498 - DNA, 11 bp, Unknown
  misc_feature (1)..( 11): Matrix.004 file - promoters50/4283378
attttataagt

SEQ ID NO: 72499 - DNA, 9 bp, Unknown
  misc_feature (1)..( 9): Matrix.004 file - promoters50/4283378
atataattt

SEQ ID NO: 72500 - DNA, 8 bp, Unknown
  misc_feature (1)..( 8): Matrix.004 file - promoters50/4283378
ttttgaaa

SEQ ID NO: 72501 - DNA, 9 bp, Unknown
  misc_feature (1)..( 9): Matrix.004 file - promoters50/4283378
aaattctaa

SEQ ID NO: 72502 - DNA, 12 bp, Unknown
  misc_feature (1)..( 12): Matrix.004 file - promoters50/4283378
aatgatttaata

SEQ ID NO: 72503 - DNA, 10 bp, Unknown
  misc_feature (1)..( 10): Matrix.004 file - promoters50/4283378
ttaatttttt

SEQ ID NO: 72504 - DNA, 8 bp, Unknown
  misc_feature (1)..( 8): Matrix.004 file - promoters50/4283378
tgaaaagt

SEQ ID NO: 72505 - DNA, 14 bp, Unknown
  misc_feature (1)..( 14): Matrix.004 file - promoters50/4283378
ataaattttaaaat

SEQ ID NO: 72506 - DNA, 14 bp, Unknown
  misc_feature (1)..( 14): Matrix.004 file - promoters50/4283378
gatataaaacctga

SEQ ID NO: 72507 - DNA, 9 bp, Unknown
  misc_feature (1)..( 9): Matrix.004 file - promoters50/4283390
gtataattt

SEQ ID NO: 72508 - DNA, 8 bp, Unknown
  misc_feature (1)..( 8): Matrix.004 file - promoters50/4283394
aataaatt

SEQ ID NO: 72509 - DNA, 9 bp, Unknown
  misc_feature (1)..( 9): Matrix.004 file - promoters50/4283394
tatgtcttt

SEQ ID NO: 72510 - DNA, 10 bp, Unknown
  misc_feature (1)..( 10): Matrix.004 file - promoters50/4283397
actgattttt

SEQ ID NO: 72511 - DNA, 8 bp, Unknown
  misc_feature (1)..( 8): Matrix.004 file - promoters50/4283397
attttaaa

SEQ ID NO: 72512 - DNA, 8 bp, Unknown
  misc_feature (1)..( 8): Matrix.004 file - promoters50/4283397
aatcaatt

SEQ ID NO: 72513 - DNA, 7 bp, Unknown
  misc_feature (1)..( 7): Matrix.004 file - promoters50/4283397
aaatttt

SEQ ID NO: 72514 - DNA, 9 bp, Unknown
  misc_feature (1)..( 9): Matrix.004 file - promoters50/4283397
aaaaaaaat

SEQ ID NO: 72515 - DNA, 10 bp, Unknown
  misc_feature (1)..( 10): Matrix.004 file - promoters50/4283397
aataaaaaaa

SEQ ID NO: 72516 - DNA, 7 bp, Unknown
  misc_feature (1)..( 7): Matrix.004 file - promoters50/4283397
aattttc

SEQ ID NO: 72517 - DNA, 10 bp, Unknown
  misc_feature (1)..( 10): Matrix.004 file - promoters50/4283397
attttcaaaa

SEQ ID NO: 72518 - DNA, 9 bp, Unknown
  misc_feature (1)..( 9): Matrix.004 file - promoters50/4283397
aacaaaaaa

SEQ ID NO: 72519 - DNA, 8 bp, Unknown
  misc_feature (1)..( 8): Matrix.004 file - promoters50/4283397
aaaaaaga

SEQ ID NO: 72520 - DNA, 10 bp, Unknown
  misc_feature (1)..( 10): Matrix.004 file - promoters50/4283422
aaaaaacaaa

SEQ ID NO: 72521 - DNA, 8 bp, Unknown
  misc_feature (1)..( 8): Matrix.004 file - promoters50/4283422
aatatttt

SEQ ID NO: 72522 - DNA, 10 bp, Unknown
  misc_feature (1)..( 10): Matrix.004 file - promoters50/4283422
aaactataga

SEQ ID NO: 72523 - DNA, 9 bp, Unknown
  misc_feature (1)..( 9): Matrix.004 file - promoters50/4283425
ataaatgat

SEQ ID NO: 72524 - DNA, 8 bp, Unknown
  misc_feature (1)..( 8): Matrix.004 file - promoters50/4283425
ccaaaaaa

SEQ ID NO: 72525 - DNA, 7 bp, Unknown
  misc_feature (1)..( 7): Matrix.004 file - promoters50/4283425
tatatat

SEQ ID NO: 72526 - DNA, 9 bp, Unknown
  misc_feature (1)..( 9): Matrix.004 file - promoters50/4283433
ggtctaaag

SEQ ID NO: 72527 - DNA, 8 bp, Unknown
  misc_feature (1)..( 8): Matrix.004 file - promoters50/4283433
cttcttaa

SEQ ID NO: 72528 - DNA, 12 bp, Unknown
  misc_feature (1)..( 12): Matrix.004 file - promoters50/4283441
attttgaagaac

SEQ ID NO: 72529 - DNA, 9 bp, Unknown
  misc_feature (1)..( 9): Matrix.004 file - promoters50/4283441
tcattatgt

SEQ ID NO: 72530 - DNA, 12 bp, Unknown
  misc_feature (1)..( 12): Matrix.004 file - promoters50/4283441
actttataaaat

SEQ ID NO: 72531 - DNA, 10 bp, Unknown
  misc_feature (1)..( 10): Matrix.004 file - promoters50/4283445
aattatttca

SEQ ID NO: 72532 - DNA, 8 bp, Unknown
  misc_feature (1)..( 8): Matrix.004 file - promoters50/4283453
ataatgtt

SEQ ID NO: 72533 - DNA, 9 bp, Unknown
  misc_feature (1)..( 9): Matrix.004 file - promoters50/4283453
catgttcta

SEQ ID NO: 72534 - DNA, 9 bp, Unknown
  misc_feature (1)..( 9): Matrix.004 file - promoters50/4283453
cgtcaaaaa

SEQ ID NO: 72535 - DNA, 9 bp, Unknown
  misc_feature (1)..( 9): Matrix.004 file - promoters50/4283476
atttccaaa

SEQ ID NO: 72536 - DNA, 10 bp, Unknown
  misc_feature (1)..( 10): Matrix.004 file - promoters50/4283482
gtttgaattt

SEQ ID NO: 72537 - DNA, 8 bp, Unknown
  misc_feature (1)..( 8): Matrix.004 file - promoters50/4283522
ttctcagt

SEQ ID NO: 72538 - DNA, 12 bp, Unknown
  misc_feature (1)..( 12): Matrix.004 file - promoters50/4283522
caaacattttac

SEQ ID NO: 72539 - DNA, 8 bp, Unknown
  misc_feature (1)..( 8): Matrix.004 file - promoters50/4283522
aatgaaaa

SEQ ID NO: 72540 - DNA, 9 bp, Unknown
  misc_feature (1)..( 9): Matrix.004 file - promoters50/4283522
cttttctat

SEQ ID NO: 72541 - DNA, 7 bp, Unknown
  misc_feature (1)..( 7): Matrix.004 file - promoters50/4283550
tttctat

SEQ ID NO: 72542 - DNA, 11 bp, Unknown
  misc_feature (1)..( 11): Matrix.004 file - promoters50/4283550
aatttatttat

SEQ ID NO: 72543 - DNA, 8 bp, Unknown
  misc_feature (1)..( 8): Matrix.004 file - promoters50/4283550
tatgtttt

SEQ ID NO: 72544 - DNA, 12 bp, Unknown
  misc_feature (1)..( 12): Matrix.004 file - promoters50/4283550
ttcggatatttt

SEQ ID NO: 72545 - DNA, 9 bp, Unknown
  misc_feature (1)..( 9): Matrix.004 file - promoters50/4283554
gataatttg

SEQ ID NO: 72546 - DNA, 9 bp, Unknown
  misc_feature (1)..( 9): Matrix.004 file - promoters50/4283554
cattttgta

SEQ ID NO: 72547 - DNA, 7 bp, Unknown
  misc_feature (1)..( 7): Matrix.004 file - promoters50/4283554
ttgtttt

SEQ ID NO: 72548 - DNA, 8 bp, Unknown
  misc_feature (1)..( 8): Matrix.004 file - promoters50/4283564
attattaa

SEQ ID NO: 72549 - DNA, 12 bp, Unknown
  misc_feature (1)..( 12): Matrix.004 file - promoters50/4283573
ccaaaacaaaac

SEQ ID NO: 72550 - DNA, 7 bp, Unknown
  misc_feature (1)..( 7): Matrix.004 file - promoters50/4283573
aaaaatc

SEQ ID NO: 72551 - DNA, 7 bp, Unknown
  misc_feature (1)..( 7): Matrix.004 file - promoters50/4283579
taaaaat

SEQ ID NO: 72552 - DNA, 11 bp, Unknown
  misc_feature (1)..( 11): Matrix.004 file - promoters50/4283591
caaaaatagaa

SEQ ID NO: 72553 - DNA, 9 bp, Unknown
  misc_feature (1)..( 9): Matrix.004 file - promoters50/4283591
caaatatat

SEQ ID NO: 72554 - DNA, 9 bp, Unknown
  misc_feature (1)..( 9): Matrix.004 file - promoters50/4283591
tttttattt

SEQ ID NO: 72555 - DNA, 9 bp, Unknown
  misc_feature (1)..( 9): Matrix.004 file - promoters50/4283591
gaaaaattt

SEQ ID NO: 72556 - DNA, 7 bp, Unknown
  misc_feature (1)..( 7): Matrix.004 file - promoters50/4283591
ttttaaa

SEQ ID NO: 72557 - DNA, 9 bp, Unknown
  misc_feature (1)..( 9): Matrix.004 file - promoters50/4283591
cataaacta

SEQ ID NO: 72558 - DNA, 8 bp, Unknown
  misc_feature (1)..( 8): Matrix.004 file - promoters50/4283591
ttaattta

SEQ ID NO: 72559 - DNA, 11 bp, Unknown
  misc_feature (1)..( 11): Matrix.004 file - promoters50/4283591
caaatatatat

SEQ ID NO: 72560 - DNA, 12 bp, Unknown
  misc_feature (1)..( 12): Matrix.004 file - promoters50/4283591
tttcaaatatat

SEQ ID NO: 72561 - DNA, 10 bp, Unknown
  misc_feature (1)..( 10): Matrix.004 file - promoters50/4283591
aaactatata

SEQ ID NO: 72562 - DNA, 10 bp, Unknown
  misc_feature (1)..( 10): Matrix.004 file - promoters50/4283591
aaactatata

SEQ ID NO: 72563 - DNA, 11 bp, Unknown
  misc_feature (1)..( 11): Matrix.004 file - promoters50/4283591
ccatatatata

SEQ ID NO: 72564 - DNA, 9 bp, Unknown
  misc_feature (1)..( 9): Matrix.004 file - promoters50/4283591
tacaaaacc

SEQ ID NO: 72565 - DNA, 7 bp, Unknown
  misc_feature (1)..( 7): Matrix.004 file - promoters50/4283591
gtttaaa

SEQ ID NO: 72566 - DNA, 8 bp, Unknown
  misc_feature (1)..( 8): Matrix.004 file - promoters50/4283591
tgtttttc

SEQ ID NO: 72567 - DNA, 8 bp, Unknown
  misc_feature (1)..( 8): Matrix.004 file - promoters50/4283607
aaaaatta

SEQ ID NO: 72568 - DNA, 8 bp, Unknown
  misc_feature (1)..( 8): Matrix.004 file - promoters50/4283614
ttcttgcc

SEQ ID NO: 72569 - DNA, 9 bp, Unknown
  misc_feature (1)..( 9): Matrix.004 file - promoters50/4283616
aaccctaaa

SEQ ID NO: 72570 - DNA, 9 bp, Unknown
  misc_feature (1)..( 9): Matrix.004 file - promoters50/4283616
agactacag

SEQ ID NO: 72571 - DNA, 9 bp, Unknown
  misc_feature (1)..( 9): Matrix.004 file - promoters50/4283616
gatgaagaa

SEQ ID NO: 72572 - DNA, 15 bp, Unknown
  misc_feature (1)..( 15): Matrix.004 file - promoters50/4283620
taaccagtaaacttt

SEQ ID NO: 72573 - DNA, 10 bp, Unknown
  misc_feature (1)..( 10): Matrix.004 file - promoters50/4283620
tggttattca

SEQ ID NO: 72574 - DNA, 8 bp, Unknown
  misc_feature (1)..( 8): Matrix.004 file - promoters50/4283620
ttcaacat

SEQ ID NO: 72575 - DNA, 10 bp, Unknown
  misc_feature (1)..( 10): Matrix.004 file - promoters50/4283620
aaataattga

SEQ ID NO: 72576 - DNA, 9 bp, Unknown
  misc_feature (1)..( 9): Matrix.004 file - promoters50/4283626
aattttggt

SEQ ID NO: 72577 - DNA, 8 bp, Unknown
  misc_feature (1)..( 8): Matrix.004 file - promoters50/4283626
tataattt

SEQ ID NO: 72578 - DNA, 10 bp, Unknown
  misc_feature (1)..( 10): Matrix.004 file - promoters50/4283632
tttaatttcc

SEQ ID NO: 72579 - DNA, 8 bp, Unknown
  misc_feature (1)..( 8): Matrix.004 file - promoters50/4304982
tttattat

SEQ ID NO: 72580 - DNA, 4 bp, Unknown
  misc_feature (1)..( 4): Matrix.004 file - promoters50/4304982
aaat

SEQ ID NO: 72581 - DNA, 8 bp, Unknown
  misc_feature (1)..( 8): Matrix.004 file - promoters50/4304982
caaattaa

SEQ ID NO: 72582 - DNA, 10 bp, Unknown
  misc_feature (1)..( 10): Matrix.004 file - promoters50/4305800
aatgataaat

SEQ ID NO: 72583 - DNA, 8 bp, Unknown
  misc_feature (1)..( 8): Matrix.004 file - promoters50/4305800
atattact

SEQ ID NO: 72584 - DNA, 9 bp, Unknown
  misc_feature (1)..( 9): Matrix.004 file - promoters50/4305800
agaatttgt

SEQ ID NO: 72585 - DNA, 8 bp, Unknown
  misc_feature (1)..( 8): Matrix.004 file - promoters50/4305800
tcctgctg

SEQ ID NO: 72586 - DNA, 9 bp, Unknown
  misc_feature (1)..( 9): Matrix.004 file - promoters50/4307922
tccacttgt

SEQ ID NO: 72587 - DNA, 10 bp, Unknown
  misc_feature (1)..( 10): Matrix.004 file - promoters50/4378608
atatagaaat

SEQ ID NO: 72588 - DNA, 11 bp, Unknown
  misc_feature (1)..( 11): Matrix.004 file - promoters50/4577400
aaatttacatc

SEQ ID NO: 72589 - DNA, 11 bp, Unknown
  misc_feature (1)..( 11): Matrix.004 file - promoters50/4577400
aaataattaag

SEQ ID NO: 72590 - DNA, 10 bp, Unknown
  misc_feature (1)..( 10): Matrix.004 file - promoters50/4607469
taataaaaat

SEQ ID NO: 72591 - DNA, 10 bp, Unknown
  misc_feature (1)..( 10): Matrix.004 file - promoters50/4607469
ctctctctct

SEQ ID NO: 72592 - DNA, 8 bp, Unknown
  misc_feature (1)..( 8): Matrix.004 file - promoters50/4607469
aaatcaaa

SEQ ID NO: 72593 - DNA, 8 bp, Unknown
  misc_feature (1)..( 8): Matrix.004 file - promoters50/4607671
aaatcaat

SEQ ID NO: 72594 - DNA, 8 bp, Unknown
  misc_feature (1)..( 8): Matrix.004 file - promoters50/4607671
ttatataa

SEQ ID NO: 72595 - DNA, 9 bp, Unknown
  misc_feature (1)..( 9): Matrix.004 file - promoters50/4607671
aagtttttc

SEQ ID NO: 72596 - DNA, 12 bp, Unknown
  misc_feature (1)..( 12): Matrix.004 file - promoters50/4607671
ttaacaaaaagt

SEQ ID NO: 72597 - DNA, 8 bp, Unknown
  misc_feature (1)..( 8): Matrix.004 file - promoters50/4607671
taagtttt

SEQ ID NO: 72598 - DNA, 7 bp, Unknown
  misc_feature (1)..( 7): Matrix.004 file - promoters50/4607678
acaaaaa

SEQ ID NO: 72599 - DNA, 12 bp, Unknown
  misc_feature (1)..( 12): Matrix.004 file - promoters50/4607692
tctatttaaagt

SEQ ID NO: 72600 - DNA, 8 bp, Unknown
  misc_feature (1)..( 8): Matrix.004 file - promoters50/4607692
aaaaatta

SEQ ID NO: 72601 - DNA, 7 bp, Unknown
  misc_feature (1)..( 7): Matrix.004 file - promoters50/4607692
ataaaat

SEQ ID NO: 72602 - DNA, 11 bp, Unknown
  misc_feature (1)..( 11): Matrix.004 file - promoters50/4607692
aaaaaacgtaa

SEQ ID NO: 72603 - DNA, 11 bp, Unknown
  misc_feature (1)..( 11): Matrix.004 file - promoters50/4607692
tttacttgtaa

SEQ ID NO: 72604 - DNA, 10 bp, Unknown
  misc_feature (1)..( 10): Matrix.004 file - promoters50/4607692
aaaagacaaa

SEQ ID NO: 72605 - DNA, 9 bp, Unknown
  misc_feature (1)..( 9): Matrix.004 file - promoters50/4607692
ggcaaatat

SEQ ID NO: 72606 - DNA, 11 bp, Unknown
  misc_feature (1)..( 11): Matrix.004 file - promoters50/4607692
tttatttttta

SEQ ID NO: 72607 - DNA, 12 bp, Unknown
  misc_feature (1)..( 12): Matrix.004 file - promoters50/4607719
ataaagtttttt

SEQ ID NO: 72608 - DNA, 10 bp, Unknown
  misc_feature (1)..( 10): Matrix.004 file - promoters50/4607719
agtaagattg

SEQ ID NO: 72609 - DNA, 9 bp, Unknown
  misc_feature (1)..( 9): Matrix.004 file - promoters50/4607719
taatttact

SEQ ID NO: 72610 - DNA, 11 bp, Unknown
  misc_feature (1)..( 11): Matrix.004 file - promoters50/4607719
agttacaatat

SEQ ID NO: 72611 - DNA, 10 bp, Unknown
  misc_feature (1)..( 10): Matrix.004 file - promoters50/4607719
attgataaaa

SEQ ID NO: 72612 - DNA, 10 bp, Unknown
  misc_feature (1)..( 10): Matrix.004 file - promoters50/4607719
ctaaaaataa

SEQ ID NO: 72613 - DNA, 9 bp, Unknown
  misc_feature (1)..( 9): Matrix.004 file - promoters50/4608096
attagtaaa

SEQ ID NO: 72614 - DNA, 11 bp, Unknown
  misc_feature (1)..( 11): Matrix.004 file - promoters50/4608140
tttataaatct

SEQ ID NO: 72615 - DNA, 10 bp, Unknown
  misc_feature (1)..( 10): Matrix.004 file - promoters50/4608140
aacatatgat

SEQ ID NO: 72616 - DNA, 8 bp, Unknown
  misc_feature (1)..( 8): Matrix.004 file - promoters50/4608140
aaaaataa

SEQ ID NO: 72617 - DNA, 7 bp, Unknown
  misc_feature (1)..( 7): Matrix.004 file - promoters50/4608140
tttgatt

SEQ ID NO: 72618 - DNA, 8 bp, Unknown
  misc_feature (1)..( 8): Matrix.004 file - promoters50/4608140
attttttt

SEQ ID NO: 72619 - DNA, 17 bp, Unknown
  misc_feature (1)..( 17): Matrix.004 file - promoters50/4608140
attgataaaaaacttaa

SEQ ID NO: 72620 - DNA, 12 bp, Unknown
  misc_feature (1)..( 12): Matrix.004 file - promoters50/4608140
taagaaaaatta

SEQ ID NO: 72621 - DNA, 11 bp, Unknown
  misc_feature (1)..( 11): Matrix.004 file - promoters50/4608140
aaagaaaaacc

SEQ ID NO: 72622 - DNA, 12 bp, Unknown
  misc_feature (1)..( 12): Matrix.004 file - promoters50/4608140
aattactatttt

SEQ ID NO: 72623 - DNA, 7 bp, Unknown
  misc_feature (1)..( 7): Matrix.004 file - promoters50/4608140
aaaatat

SEQ ID NO: 72624 - DNA, 9 bp, Unknown
  misc_feature (1)..( 9): Matrix.004 file - promoters50/4608140
tagaaaaaa

SEQ ID NO: 72625 - DNA, 12 bp, Unknown
  misc_feature (1)..( 12): Matrix.004 file - promoters50/4608143
agttacaaaaca

SEQ ID NO: 72626 - DNA, 7 bp, Unknown
  misc_feature (1)..( 7): Matrix.004 file - promoters50/4608143
ttaattt

SEQ ID NO: 72627 - DNA, 10 bp, Unknown
  misc_feature (1)..( 10): Matrix.004 file - promoters50/4608143
aagtataaca

SEQ ID NO: 72628 - DNA, 8 bp, Unknown
  misc_feature (1)..( 8): Matrix.004 file - promoters50/4608143
attatata

SEQ ID NO: 72629 - DNA, 8 bp, Unknown
  misc_feature (1)..( 8): Matrix.004 file - promoters50/4608143
aaatatgt

SEQ ID NO: 72630 - DNA, 8 bp, Unknown
  misc_feature (1)..( 8): Matrix.004 file - promoters50/4608143
aatatata

SEQ ID NO: 72631 - DNA, 15 bp, Unknown
  misc_feature (1)..( 15): Matrix.004 file - promoters50/4608143
aaggatgatggacca

SEQ ID NO: 72632 - DNA, 21 bp, Unknown
  misc_feature (1)..( 21): Matrix.004 file - promoters50/4608143
tacacattaataacgtggtcc

SEQ ID NO: 72633 - DNA, 9 bp, Unknown
  misc_feature (1)..( 9): Matrix.004 file - promoters50/4608143
taaataaat

SEQ ID NO: 72634 - DNA, 10 bp, Unknown
  misc_feature (1)..( 10): Matrix.004 file - promoters50/4608345
cttaaataaa

SEQ ID NO: 72635 - DNA, 9 bp, Unknown
  misc_feature (1)..( 9): Matrix.004 file - promoters50/4608965
aaaacataa

SEQ ID NO: 72636 - DNA, 11 bp, Unknown
  misc_feature (1)..( 11): Matrix.004 file - promoters50/4608965
gattaaatcaa

SEQ ID NO: 72637 - DNA, 13 bp, Unknown
  misc_feature (1)..( 13): Matrix.004 file - promoters50/4608965
cattagtttcctg

SEQ ID NO: 72638 - DNA, 9 bp, Unknown
  misc_feature (1)..( 9): Matrix.004 file - promoters50/4608983
taacgaaat

SEQ ID NO: 72639 - DNA, 8 bp, Unknown
  misc_feature (1)..( 8): Matrix.004 file - promoters50/4608985
gaagtaag

SEQ ID NO: 72640 - DNA, 10 bp, Unknown
  misc_feature (1)..( 10): Matrix.004 file - promoters50/4608985
aatttaaaaa

SEQ ID NO: 72641 - DNA, 11 bp, Unknown
  misc_feature (1)..( 11): Matrix.004 file - promoters50/4608985
agttaataaaa

SEQ ID NO: 72642 - DNA, 14 bp, Unknown
  misc_feature (1)..( 14): Matrix.004 file - promoters50/4608985
aattttatttttaa

SEQ ID NO: 72643 - DNA, 9 bp, Unknown
  misc_feature (1)..( 9): Matrix.004 file - promoters50/4608985
ttaatatta

SEQ ID NO: 72644 - DNA, 8 bp, Unknown
  misc_feature (1)..( 8): Matrix.004 file - promoters50/4608985
ataaatat

SEQ ID NO: 72645 - DNA, 9 bp, Unknown
  misc_feature (1)..( 9): Matrix.004 file - promoters50/4608985
gtgacaaaa

SEQ ID NO: 72646 - DNA, 10 bp, Unknown
  misc_feature (1)..( 10): Matrix.004 file - promoters50/4608985
ttaaaagaaa

SEQ ID NO: 72647 - DNA, 10 bp, Unknown
  misc_feature (1)..( 10): Matrix.004 file - promoters50/4608985
cctatatata

SEQ ID NO: 72648 - DNA, 10 bp, Unknown
  misc_feature (1)..( 10): Matrix.004 file - promoters50/4608985
ttttcttttc

SEQ ID NO: 72649 - DNA, 8 bp, Unknown
  misc_feature (1)..( 8): Matrix.004 file - promoters50/4608985
tttaaaaa

SEQ ID NO: 72650 - DNA, 8 bp, Unknown
  misc_feature (1)..( 8): Matrix.004 file - promoters50/4608985
taaaatat

SEQ ID NO: 72651 - DNA, 9 bp, Unknown
  misc_feature (1)..( 9): Matrix.004 file - promoters50/4610292
taaaaaaat

SEQ ID NO: 72652 - DNA, 12 bp, Unknown
  misc_feature (1)..( 12): Matrix.004 file - promoters50/4610551
cagtttcaataa

SEQ ID NO: 72653 - DNA, 10 bp, Unknown
  misc_feature (1)..( 10): Matrix.004 file - promoters50/4610551
actgtttgtt

SEQ ID NO: 72654 - DNA, 15 bp, Unknown
  misc_feature (1)..( 15): Matrix.004 file - promoters50/4610628
tacgttttttggttt

SEQ ID NO: 72655 - DNA, 9 bp, Unknown
  misc_feature (1)..( 9): Matrix.004 file - promoters50/4701809
ttctgtttg

SEQ ID NO: 72656 - DNA, 8 bp, Unknown
  misc_feature (1)..( 8): Matrix.004 file - promoters50/4701809
aaaattaa

SEQ ID NO: 72657 - DNA, 8 bp, Unknown
  misc_feature (1)..( 8): Matrix.004 file - promoters50/4701809
taaattta

SEQ ID NO: 72658 - DNA, 7 bp, Unknown
  misc_feature (1)..( 7): Matrix.004 file - promoters50/4701809
ataaagt

SEQ ID NO: 72659 - DNA, 12 bp, Unknown
  misc_feature (1)..( 12): Matrix.004 file - promoters50/4701809
ttaaaaattaaa

SEQ ID NO: 72660 - DNA, 7 bp, Unknown
  misc_feature (1)..( 7): Matrix.004 file - promoters50/4702444
ttggttg

SEQ ID NO: 72661 - DNA, 9 bp, Unknown
  misc_feature (1)..( 9): Matrix.004 file - promoters50/4702444
gaaaatttt

SEQ ID NO: 72662 - DNA, 9 bp, Unknown
  misc_feature (1)..( 9): Matrix.004 file - promoters50/4702444
ttaaaatta

SEQ ID NO: 72663 - DNA, 11 bp, Unknown
  misc_feature (1)..( 11): Matrix.004 file - promoters50/4702444
cggaaagtctt

SEQ ID NO: 72664 - DNA, 10 bp, Unknown
  misc_feature (1)..( 10): Matrix.004 file - promoters50/4702444
attaatcata

SEQ ID NO: 72665 - DNA, 13 bp, Unknown
  misc_feature (1)..( 13): Matrix.004 file - promoters50/4702444
ttttacttttctt

SEQ ID NO: 72666 - DNA, 10 bp, Unknown
  misc_feature (1)..( 10): Matrix.004 file - promoters50/4702444
ttttgcaatt

SEQ ID NO: 72667 - DNA, 8 bp, Unknown
  misc_feature (1)..( 8): Matrix.004 file - promoters50/4702444
tttcgaaa

SEQ ID NO: 72668 - DNA, 11 bp, Unknown
  misc_feature (1)..( 11): Matrix.004 file - promoters50/4766314
gaagaaactaa

SEQ ID NO: 72669 - DNA, 8 bp, Unknown
  misc_feature (1)..( 8): Matrix.004 file - promoters50/4766314
tatgttat

SEQ ID NO: 72670 - DNA, 6 bp, Unknown
  misc_feature (1)..( 6): Matrix.004 file - promoters50/4766314
acgaag

SEQ ID NO: 72671 - DNA, 8 bp, Unknown
  misc_feature (1)..( 8): Matrix.004 file - promoters50/4766314
aacaatga

SEQ ID NO: 72672 - DNA, 10 bp, Unknown
  misc_feature (1)..( 10): Matrix.004 file - promoters50/4766320
aatgagattt

SEQ ID NO: 72673 - DNA, 14 bp, Unknown
  misc_feature (1)..( 14): Matrix.004 file - promoters50/4766320
ttaatttccaaaga

SEQ ID NO: 72674 - DNA, 14 bp, Unknown
  misc_feature (1)..( 14): Matrix.004 file - promoters50/4766324
ttcctatctctata

SEQ ID NO: 72675 - DNA, 13 bp, Unknown
  misc_feature (1)..( 13): Matrix.004 file - promoters50/4766324
atttttcattgaa

SEQ ID NO: 72676 - DNA, 13 bp, Unknown
  misc_feature (1)..( 13): Matrix.004 file - promoters50/4766324
actatataatact

SEQ ID NO: 72677 - DNA, 12 bp, Unknown
  misc_feature (1)..( 12): Matrix.004 file - promoters50/4766335
agaatttctttt

SEQ ID NO: 72678 - DNA, 10 bp, Unknown
  misc_feature (1)..( 10): Matrix.004 file - promoters50/4766335
ttaaatgaag

SEQ ID NO: 72679 - DNA, 11 bp, Unknown
  misc_feature (1)..( 11): Matrix.004 file - promoters50/4766335
cgtctataaat

SEQ ID NO: 72680 - DNA, 12 bp, Unknown
  misc_feature (1)..( 12): Matrix.004 file - promoters50/4766335
aaaatttgaatt

SEQ ID NO: 72681 - DNA, 10 bp, Unknown
  misc_feature (1)..( 10): Matrix.004 file - promoters50/4766350
gattctttca

SEQ ID NO: 72682 - DNA, 5 bp, Unknown
  misc_feature (1)..( 5): Matrix.004 file - promoters50/4766350
atagc

SEQ ID NO: 72683 - DNA, 6 bp, Unknown
  misc_feature (1)..( 6): Matrix.004 file - promoters50/4766350
aaaaga

SEQ ID NO: 72684 - DNA, 8 bp, Unknown
  misc_feature (1)..( 8): Matrix.004 file - promoters50/4766350
ctgagaac

SEQ ID NO: 72685 - DNA, 9 bp, Unknown
  misc_feature (1)..( 9): Matrix.004 file - promoters50/4766350
caaaaaaaa

SEQ ID NO: 72686 - DNA, 9 bp, Unknown
  misc_feature (1)..( 9): Matrix.004 file - promoters50/4766353
ctaatggag

SEQ ID NO: 72687 - DNA, 8 bp, Unknown
  misc_feature (1)..( 8): Matrix.004 file - promoters50/4766353
tatagtaa

SEQ ID NO: 72688 - DNA, 10 bp, Unknown
  misc_feature (1)..( 10): Matrix.004 file - promoters50/4766353
ttgtaataat

SEQ ID NO: 72689 - DNA, 7 bp, Unknown
  misc_feature (1)..( 7): Matrix.004 file - promoters50/4766365
tttataa

SEQ ID NO: 72690 - DNA, 12 bp, Unknown
  misc_feature (1)..( 12): Matrix.004 file - promoters50/4766372
aaagtaaatatt

SEQ ID NO: 72691 - DNA, 10 bp, Unknown
  misc_feature (1)..( 10): Matrix.004 file - promoters50/4766372
gttttcctta

SEQ ID NO: 72692 - DNA, 10 bp, Unknown
  misc_feature (1)..( 10): Matrix.004 file - promoters50/4766372
aaaaaattta

SEQ ID NO: 72693 - DNA, 8 bp, Unknown
  misc_feature (1)..( 8): Matrix.004 file - promoters50/4766376
gaattttt

SEQ ID NO: 72694 - DNA, 11 bp, Unknown
  misc_feature (1)..( 11): Matrix.004 file - promoters50/4766376
agtgaaaacac

SEQ ID NO: 72695 - DNA, 9 bp, Unknown
  misc_feature (1)..( 9): Matrix.004 file - promoters50/4766376
ctataaata

SEQ ID NO: 72696 - DNA, 9 bp, Unknown
  misc_feature (1)..( 9): Matrix.004 file - promoters50/4766391
ctataaata

SEQ ID NO: 72697 - DNA, 13 bp, Unknown
  misc_feature (1)..( 13): Matrix.004 file - promoters50/4766395
aaaaaataaaaaa

SEQ ID NO: 72698 - DNA, 12 bp, Unknown
  misc_feature (1)..( 12): Matrix.004 file - promoters50/4766395
atttaacaaaaa

SEQ ID NO: 72699 - DNA, 14 bp, Unknown
  misc_feature (1)..( 14): Matrix.004 file - promoters50/4766421
caattatttaatat

SEQ ID NO: 72700 - DNA, 8 bp, Unknown
  misc_feature (1)..( 8): Matrix.004 file - promoters50/4766421
aattgatt

SEQ ID NO: 72701 - DNA, 7 bp, Unknown
  misc_feature (1)..( 7): Matrix.004 file - promoters50/4766421
caaaatt

SEQ ID NO: 72702 - DNA, 7 bp, Unknown
  misc_feature (1)..( 7): Matrix.004 file - promoters50/4766421
atgtttt

SEQ ID NO: 72703 - DNA, 8 bp, Unknown
  misc_feature (1)..( 8): Matrix.004 file - promoters50/4766425
ttaaaatt

SEQ ID NO: 72704 - DNA, 8 bp, Unknown
  misc_feature (1)..( 8): Matrix.004 file - promoters50/4766429
gcggtctg

SEQ ID NO: 72705 - DNA, 8 bp, Unknown
  misc_feature (1)..( 8): Matrix.004 file - promoters50/4766458
taagaaac

SEQ ID NO: 72706 - DNA, 9 bp, Unknown
  misc_feature (1)..( 9): Matrix.004 file - promoters50/4766458
aaatttgac

SEQ ID NO: 72707 - DNA, 8 bp, Unknown
  misc_feature (1)..( 8): Matrix.004 file - promoters50/4766458
attataat

SEQ ID NO: 72708 - DNA, 7 bp, Unknown
  misc_feature (1)..( 7): Matrix.004 file - promoters50/4766458
aaaaagt

SEQ ID NO: 72709 - DNA, 12 bp, Unknown
  misc_feature (1)..( 12): Matrix.004 file - promoters50/4766477
accaaattaaaa

SEQ ID NO: 72710 - DNA, 11 bp, Unknown
  misc_feature (1)..( 11): Matrix.004 file - promoters50/4766477
aatttttgggc

SEQ ID NO: 72711 - DNA, 10 bp, Unknown
  misc_feature (1)..( 10): Matrix.004 file - promoters50/4766477
aagtttttac

SEQ ID NO: 72712 - DNA, 10 bp, Unknown
  misc_feature (1)..( 10): Matrix.004 file - promoters50/4766477
aacaaaatta

SEQ ID NO: 72713 - DNA, 10 bp, Unknown
  misc_feature (1)..( 10): Matrix.004 file - promoters50/4766477
tacaaaagtt

SEQ ID NO: 72714 - DNA, 13 bp, Unknown
  misc_feature (1)..( 13): Matrix.004 file - promoters50/4766481
taacaatttacat

SEQ ID NO: 72715 - DNA, 8 bp, Unknown
  misc_feature (1)..( 8): Matrix.004 file - promoters50/4766481
attttgtg

SEQ ID NO: 72716 - DNA, 8 bp, Unknown
  misc_feature (1)..( 8): Matrix.004 file - promoters50/4766490
ctcaattt

SEQ ID NO: 72717 - DNA, 7 bp, Unknown
  misc_feature (1)..( 7): Matrix.004 file - promoters50/4766497
gaaaaaa

SEQ ID NO: 72718 - DNA, 6 bp, Unknown
  misc_feature (1)..( 6): Matrix.004 file - promoters50/4766497
aagctt

SEQ ID NO: 72719 - DNA, 7 bp, Unknown
  misc_feature (1)..( 7): Matrix.004 file - promoters50/4766497
attattt

SEQ ID NO: 72720 - DNA, 10 bp, Unknown
  misc_feature (1)..( 10): Matrix.004 file - promoters50/4766497
ttaatattat

SEQ ID NO: 72721 - DNA, 8 bp, Unknown
  misc_feature (1)..( 8): Matrix.004 file - promoters50/4766497
aaacgaat

SEQ ID NO: 72722 - DNA, 11 bp, Unknown
  misc_feature (1)..( 11): Matrix.004 file - promoters50/4766497
taataacaaat

SEQ ID NO: 72723 - DNA, 7 bp, Unknown
  misc_feature (1)..( 7): Matrix.004 file - promoters50/4766497
aaagaag

SEQ ID NO: 72724 - DNA, 10 bp, Unknown
  misc_feature (1)..( 10): Matrix.004 file - promoters50/4766500
aaaatcaaaa

SEQ ID NO: 72725 - DNA, 8 bp, Unknown
  misc_feature (1)..( 8): Matrix.004 file - promoters50/4766524
atcacatt

SEQ ID NO: 72726 - DNA, 12 bp, Unknown
  misc_feature (1)..( 12): Matrix.004 file - promoters50/4766524
tttgaagatttt

SEQ ID NO: 72727 - DNA, 9 bp, Unknown
  misc_feature (1)..( 9): Matrix.004 file - promoters50/4766524
tttttcaaa

SEQ ID NO: 72728 - DNA, 13 bp, Unknown
  misc_feature (1)..( 13): Matrix.004 file - promoters50/4766524
tttttataccatt

SEQ ID NO: 72729 - DNA, 9 bp, Unknown
  misc_feature (1)..( 9): Matrix.004 file - promoters50/4766524
aaacaaaag

SEQ ID NO: 72730 - DNA, 9 bp, Unknown
  misc_feature (1)..( 9): Matrix.004 file - promoters50/4766524
tttatttat

SEQ ID NO: 72731 - DNA, 8 bp, Unknown
  misc_feature (1)..( 8): Matrix.004 file - promoters50/4766553
attattac

SEQ ID NO: 72732 - DNA, 11 bp, Unknown
  misc_feature (1)..( 11): Matrix.004 file - promoters50/4766553
tctgataacaa

SEQ ID NO: 72733 - DNA, 8 bp, Unknown
  misc_feature (1)..( 8): Matrix.004 file - promoters50/4766553
aacaacac

SEQ ID NO: 72734 - DNA, 8 bp, Unknown
  misc_feature (1)..( 8): Matrix.004 file - promoters50/4766553
gtagagaa

SEQ ID NO: 72735 - DNA, 8 bp, Unknown
  misc_feature (1)..( 8): Matrix.004 file - promoters50/4766578
aagaagaa

SEQ ID NO: 72736 - DNA, 12 bp, Unknown
  misc_feature (1)..( 12): Matrix.004 file - promoters50/4766578
taaataattaag

SEQ ID NO: 72737 - DNA, 7 bp, Unknown
  misc_feature (1)..( 7): Matrix.004 file - promoters50/4766578
taattaa

SEQ ID NO: 72738 - DNA, 9 bp, Unknown
  misc_feature (1)..( 9): Matrix.004 file - promoters50/4766578
aaaaattaa

SEQ ID NO: 72739 - DNA, 7 bp, Unknown
  misc_feature (1)..( 7): Matrix.004 file - promoters50/4766578
aaaaaaa

SEQ ID NO: 72740 - DNA, 16 bp, Unknown
  misc_feature (1)..( 16): Matrix.004 file - promoters50/4766585
tatttctttaattatg

SEQ ID NO: 72741 - DNA, 8 bp, Unknown
  misc_feature (1)..( 8): Matrix.004 file - promoters50/4766585
ttttaatt

SEQ ID NO: 72742 - DNA, 11 bp, Unknown
  misc_feature (1)..( 11): Matrix.004 file - promoters50/4766585
gttgacgtttg

SEQ ID NO: 72743 - DNA, 8 bp, Unknown
  misc_feature (1)..( 8): Matrix.004 file - promoters50/4766602
ccttttat

SEQ ID NO: 72744 - DNA, 8 bp, Unknown
  misc_feature (1)..( 8): Matrix.004 file - promoters50/4766602
actatata

SEQ ID NO: 72745 - DNA, 6 bp, Unknown
  misc_feature (1)..( 6): Matrix.004 file - promoters50/4766602
ttttta

SEQ ID NO: 72746 - DNA, 11 bp, Unknown
  misc_feature (1)..( 11): Matrix.004 file - promoters50/4766654
attttcatttt

SEQ ID NO: 72747 - DNA, 7 bp, Unknown
  misc_feature (1)..( 7): Matrix.004 file - promoters50/4766654
tttatat

SEQ ID NO: 72748 - DNA, 8 bp, Unknown
  misc_feature (1)..( 8): Matrix.004 file - promoters50/4766654
gtttataa

SEQ ID NO: 72749 - DNA, 7 bp, Unknown
  misc_feature (1)..( 7): Matrix.004 file - promoters50/4766654
gataaaa

SEQ ID NO: 72750 - DNA, 8 bp, Unknown
  misc_feature (1)..( 8): Matrix.004 file - promoters50/4766678
aacacttt

SEQ ID NO: 72751 - DNA, 8 bp, Unknown
  misc_feature (1)..( 8): Matrix.004 file - promoters50/4766678
gaaaaaaa

SEQ ID NO: 72752 - DNA, 8 bp, Unknown
  misc_feature (1)..( 8): Matrix.004 file - promoters50/4766678
gttaaaaa

SEQ ID NO: 72753 - DNA, 7 bp, Unknown
  misc_feature (1)..( 7): Matrix.004 file - promoters50/4766678
tttcatt

SEQ ID NO: 72754 - DNA, 8 bp, Unknown
  misc_feature (1)..( 8): Matrix.004 file - promoters50/4766727
aaatttcc

SEQ ID NO: 72755 - DNA, 10 bp, Unknown
  misc_feature (1)..( 10): Matrix.004 file - promoters50/4766727
atataaatta

SEQ ID NO: 72756 - DNA, 9 bp, Unknown
  misc_feature (1)..( 9): Matrix.004 file - promoters50/4766738
taatgatta

SEQ ID NO: 72757 - DNA, 10 bp, Unknown
  misc_feature (1)..( 10): Matrix.004 file - promoters50/4766746
aatactaaaa

SEQ ID NO: 72758 - DNA, 9 bp, Unknown
  misc_feature (1)..( 9): Matrix.004 file - promoters50/4766746
gtatataaa

SEQ ID NO: 72759 - DNA, 8 bp, Unknown
  misc_feature (1)..( 8): Matrix.004 file - promoters50/4766750
aaattggg

SEQ ID NO: 72760 - DNA, 8 bp, Unknown
  misc_feature (1)..( 8): Matrix.004 file - promoters50/4766754
atttctaa

SEQ ID NO: 72761 - DNA, 8 bp, Unknown
  misc_feature (1)..( 8): Matrix.004 file - promoters50/4766776
agtatata

SEQ ID NO: 72762 - DNA, 8 bp, Unknown
  misc_feature (1)..( 8): Matrix.004 file - promoters50/4766776
tatatatc

SEQ ID NO: 72763 - DNA, 8 bp, Unknown
  misc_feature (1)..( 8): Matrix.004 file - promoters50/4766776
aaaaatat

SEQ ID NO: 72764 - DNA, 12 bp, Unknown
  misc_feature (1)..( 12): Matrix.004 file - promoters50/4766776
atcttaaaatat

SEQ ID NO: 72765 - DNA, 8 bp, Unknown
  misc_feature (1)..( 8): Matrix.004 file - promoters50/4766784
aaatcaat

SEQ ID NO: 72766 - DNA, 11 bp, Unknown
  misc_feature (1)..( 11): Matrix.004 file - promoters50/4766788
acaagtttttt

SEQ ID NO: 72767 - DNA, 3 bp, Unknown
  misc_feature (1)..( 3): Matrix.004 file - promoters50/4766788
att

SEQ ID NO: 72768 - DNA, 6 bp, Unknown
  misc_feature (1)..( 6): Matrix.004 file - promoters50/4766792
atttca

SEQ ID NO: 72769 - DNA, 7 bp, Unknown
  misc_feature (1)..( 7): Matrix.004 file - promoters50/4766792
ctttatt

SEQ ID NO: 72770 - DNA, 9 bp, Unknown
  misc_feature (1)..( 9): Matrix.004 file - promoters50/4766792
aaataaaca

SEQ ID NO: 72771 - DNA, 7 bp, Unknown
  misc_feature (1)..( 7): Matrix.004 file - promoters50/4766812
tttattt

SEQ ID NO: 72772 - DNA, 7 bp, Unknown
  misc_feature (1)..( 7): Matrix.004 file - promoters50/4766812
aattttt

SEQ ID NO: 72773 - DNA, 9 bp, Unknown
  misc_feature (1)..( 9): Matrix.004 file - promoters50/4766812
aataaaaat

SEQ ID NO: 72774 - DNA, 9 bp, Unknown
  misc_feature (1)..( 9): Matrix.004 file - promoters50/4766812
agtaattat

SEQ ID NO: 72775 - DNA, 7 bp, Unknown
  misc_feature (1)..( 7): Matrix.004 file - promoters50/4766812
aatcaag

SEQ ID NO: 72776 - DNA, 8 bp, Unknown
  misc_feature (1)..( 8): Matrix.004 file - promoters50/4766816
agaaaacc

SEQ ID NO: 72777 - DNA, 9 bp, Unknown
  misc_feature (1)..( 9): Matrix.004 file - promoters50/4766823
caaatatgg

SEQ ID NO: 72778 - DNA, 8 bp, Unknown
  misc_feature (1)..( 8): Matrix.004 file - promoters50/4766835
ttgttcca

SEQ ID NO: 72779 - DNA, 9 bp, Unknown
  misc_feature (1)..( 9): Matrix.004 file - promoters50/4766835
agataaaat

SEQ ID NO: 72780 - DNA, 7 bp, Unknown
  misc_feature (1)..( 7): Matrix.004 file - promoters50/4766835
ttaattt

SEQ ID NO: 72781 - DNA, 9 bp, Unknown
  misc_feature (1)..( 9): Matrix.004 file - promoters50/4766835
tcataaaaa

SEQ ID NO: 72782 - DNA, 8 bp, Unknown
  misc_feature (1)..( 8): Matrix.004 file - promoters50/4766835
aagttcaa

SEQ ID NO: 72783 - DNA, 7 bp, Unknown
  misc_feature (1)..( 7): Matrix.004 file - promoters50/4766835
atcaaaa

SEQ ID NO: 72784 - DNA, 8 bp, Unknown
  misc_feature (1)..( 8): Matrix.004 file - promoters50/4766835
aaacaaaa

SEQ ID NO: 72785 - DNA, 10 bp, Unknown
  misc_feature (1)..( 10): Matrix.004 file - promoters50/4766835
aaataattga

SEQ ID NO: 72786 - DNA, 8 bp, Unknown
  misc_feature (1)..( 8): Matrix.004 file - promoters50/4766835
acacataa

SEQ ID NO: 72787 - DNA, 7 bp, Unknown
  misc_feature (1)..( 7): Matrix.004 file - promoters50/4766858
ttttcag

SEQ ID NO: 72788 - DNA, 8 bp, Unknown
  misc_feature (1)..( 8): Matrix.004 file - promoters50/4766862
aagatctt

SEQ ID NO: 72789 - DNA, 8 bp, Unknown
  misc_feature (1)..( 8): Matrix.004 file - promoters50/4766862
attgaaat

SEQ ID NO: 72790 - DNA, 10 bp, Unknown
  misc_feature (1)..( 10): Matrix.004 file - promoters50/4766866
aggttaaaga

SEQ ID NO: 72791 - DNA, 13 bp, Unknown
  misc_feature (1)..( 13): Matrix.004 file - promoters50/4766866
aaaagaaatttag

SEQ ID NO: 72792 - DNA, 12 bp, Unknown
  misc_feature (1)..( 12): Matrix.004 file - promoters50/4766866
ttgagacaaaaa

SEQ ID NO: 72793 - DNA, 4 bp, Unknown
  misc_feature (1)..( 4): Matrix.004 file - promoters50/4766870
taaa

SEQ ID NO: 72794 - DNA, 7 bp, Unknown
  misc_feature (1)..( 7): Matrix.004 file - promoters50/4766870
gattttg

SEQ ID NO: 72795 - DNA, 7 bp, Unknown
  misc_feature (1)..( 7): Matrix.004 file - promoters50/4766908
tcttaaa

SEQ ID NO: 72796 - DNA, 9 bp, Unknown
  misc_feature (1)..( 9): Matrix.004 file - promoters50/4766908
ttgctttaa

SEQ ID NO: 72797 - DNA, 9 bp, Unknown
  misc_feature (1)..( 9): Matrix.004 file - promoters50/4766908
aaacaaaaa

SEQ ID NO: 72798 - DNA, 10 bp, Unknown
  misc_feature (1)..( 10): Matrix.004 file - promoters50/4766912
acccactaaa

SEQ ID NO: 72799 - DNA, 9 bp, Unknown
  misc_feature (1)..( 9): Matrix.004 file - promoters50/4766912
gcttattaa

SEQ ID NO: 72800 - DNA, 7 bp, Unknown
  misc_feature (1)..( 7): Matrix.004 file - promoters50/4766912
agtattc

SEQ ID NO: 72801 - DNA, 9 bp, Unknown
  misc_feature (1)..( 9): Matrix.004 file - promoters50/4766912
gtttgtgtt

SEQ ID NO: 72802 - DNA, 7 bp, Unknown
  misc_feature (1)..( 7): Matrix.004 file - promoters50/4766912
gttgtga

SEQ ID NO: 72803 - DNA, 7 bp, Unknown
  misc_feature (1)..( 7): Matrix.004 file - promoters50/4766912
tcttgtc

SEQ ID NO: 72804 - DNA, 9 bp, Unknown
  misc_feature (1)..( 9): Matrix.004 file - promoters50/4766916
cagagatcc

SEQ ID NO: 72805 - DNA, 10 bp, Unknown
  misc_feature (1)..( 10): Matrix.004 file - promoters50/4766916
ttacaaaata

SEQ ID NO: 72806 - DNA, 7 bp, Unknown
  misc_feature (1)..( 7): Matrix.004 file - promoters50/4766916
aatttta

SEQ ID NO: 72807 - DNA, 6 bp, Unknown
  misc_feature (1)..( 6): Matrix.004 file - promoters50/4766916
taaaaa

SEQ ID NO: 72808 - DNA, 8 bp, Unknown
  misc_feature (1)..( 8): Matrix.004 file - promoters50/4766936
aaaacaaa

SEQ ID NO: 72809 - DNA, 12 bp, Unknown
  misc_feature (1)..( 12): Matrix.004 file - promoters50/4766957
atctttataaag

SEQ ID NO: 72810 - DNA, 13 bp, Unknown
  misc_feature (1)..( 13): Matrix.004 file - promoters50/4766957
acgtttttcattc

SEQ ID NO: 72811 - DNA, 12 bp, Unknown
  misc_feature (1)..( 12): Matrix.004 file - promoters50/4766957
ttaaataaaaaa

SEQ ID NO: 72812 - DNA, 13 bp, Unknown
  misc_feature (1)..( 13): Matrix.004 file - promoters50/4766977
ttaaataaaaact

SEQ ID NO: 72813 - DNA, 7 bp, Unknown
  misc_feature (1)..( 7): Matrix.004 file - promoters50/4766977
taaaatt

SEQ ID NO: 72814 - DNA, 11 bp, Unknown
  misc_feature (1)..( 11): Matrix.004 file - promoters50/4766977
atataaataaa

SEQ ID NO: 72815 - DNA, 14 bp, Unknown
  misc_feature (1)..( 14): Matrix.004 file - promoters50/4766977
aagagtataaaatt

SEQ ID NO: 72816 - DNA, 12 bp, Unknown
  misc_feature (1)..( 12): Matrix.004 file - promoters50/4766977
aaaattttcgta

SEQ ID NO: 72817 - DNA, 10 bp, Unknown
  misc_feature (1)..( 10): Matrix.004 file - promoters50/4766977
gaactaaact

SEQ ID NO: 72818 - DNA, 12 bp, Unknown
  misc_feature (1)..( 12): Matrix.004 file - promoters50/4766977
acacattaatat

SEQ ID NO: 72819 - DNA, 11 bp, Unknown
  misc_feature (1)..( 11): Matrix.004 file - promoters50/4766977
aaaaatatttt

SEQ ID NO: 72820 - DNA, 10 bp, Unknown
  misc_feature (1)..( 10): Matrix.004 file - promoters50/4766977
tactttttaa

SEQ ID NO: 72821 - DNA, 12 bp, Unknown
  misc_feature (1)..( 12): Matrix.004 file - promoters50/4766977
accattaaaata

SEQ ID NO: 72822 - DNA, 13 bp, Unknown
  misc_feature (1)..( 13): Matrix.004 file - promoters50/4766977
taaaatatatttt

SEQ ID NO: 72823 - DNA, 16 bp, Unknown
  misc_feature (1)..( 16): Matrix.004 file - promoters50/4766980
aaattaagatattttt

SEQ ID NO: 72824 - DNA, 9 bp, Unknown
  misc_feature (1)..( 9): Matrix.004 file - promoters50/4766980
aatagactg

SEQ ID NO: 72825 - DNA, 8 bp, Unknown
  misc_feature (1)..( 8): Matrix.004 file - promoters50/4766983
ggaagaaa

SEQ ID NO: 72826 - DNA, 8 bp, Unknown
  misc_feature (1)..( 8): Matrix.004 file - promoters50/4766983
aattctat

SEQ ID NO: 72827 - DNA, 8 bp, Unknown
  misc_feature (1)..( 8): Matrix.004 file - promoters50/4766983
attaaact

SEQ ID NO: 72828 - DNA, 12 bp, Unknown
  misc_feature (1)..( 12): Matrix.004 file - promoters50/4766983
aaattgattaaa

SEQ ID NO: 72829 - DNA, 7 bp, Unknown
  misc_feature (1)..( 7): Matrix.004 file - promoters50/4766983
aaaaata

SEQ ID NO: 72830 - DNA, 15 bp, Unknown
  misc_feature (1)..( 15): Matrix.004 file - promoters50/4766983
ataaaattgacatct

SEQ ID NO: 72831 - DNA, 7 bp, Unknown
  misc_feature (1)..( 7): Matrix.004 file - promoters50/4766983
aaatata

SEQ ID NO: 72832 - DNA, 7 bp, Unknown
  misc_feature (1)..( 7): Matrix.004 file - promoters50/4766983
taaaaaa

SEQ ID NO: 72833 - DNA, 8 bp, Unknown
  misc_feature (1)..( 8): Matrix.004 file - promoters50/4766983
ttgttttt

SEQ ID NO: 72834 - DNA, 8 bp, Unknown
  misc_feature (1)..( 8): Matrix.004 file - promoters50/4766983
aatcaaag

SEQ ID NO: 72835 - DNA, 13 bp, Unknown
  misc_feature (1)..( 13): Matrix.004 file - promoters50/4766991
aaattgacttcaa

SEQ ID NO: 72836 - DNA, 11 bp, Unknown
  misc_feature (1)..( 11): Matrix.004 file - promoters50/4766991
ataaaagaaaa

SEQ ID NO: 72837 - DNA, 6 bp, Unknown
  misc_feature (1)..( 6): Matrix.004 file - promoters50/4767003
aaataa

SEQ ID NO: 72838 - DNA, 7 bp, Unknown
  misc_feature (1)..( 7): Matrix.004 file - promoters50/4767024
cattcta

SEQ ID NO: 72839 - DNA, 9 bp, Unknown
  misc_feature (1)..( 9): Matrix.004 file - promoters50/4767038
gaaataaaa

SEQ ID NO: 72840 - DNA, 16 bp, Unknown
  misc_feature (1)..( 16): Matrix.004 file - promoters50/4767050
agttaataaataaaaa

SEQ ID NO: 72841 - DNA, 8 bp, Unknown
  misc_feature (1)..( 8): Matrix.004 file - promoters50/4767054
atataaat

SEQ ID NO: 72842 - DNA, 10 bp, Unknown
  misc_feature (1)..( 10): Matrix.004 file - promoters50/4767054
atttctcaac

SEQ ID NO: 72843 - DNA, 7 bp, Unknown
  misc_feature (1)..( 7): Matrix.004 file - promoters50/4767059
aaacata

SEQ ID NO: 72844 - DNA, 8 bp, Unknown
  misc_feature (1)..( 8): Matrix.004 file - promoters50/4767059
gaactttg

SEQ ID NO: 72845 - DNA, 7 bp, Unknown
  misc_feature (1)..( 7): Matrix.004 file - promoters50/4767063
taaattt

SEQ ID NO: 72846 - DNA, 7 bp, Unknown
  misc_feature (1)..( 7): Matrix.004 file - promoters50/4767063
tttcttt

SEQ ID NO: 72847 - DNA, 7 bp, Unknown
  misc_feature (1)..( 7): Matrix.004 file - promoters50/4767063
aaaatga

SEQ ID NO: 72848 - DNA, 8 bp, Unknown
  misc_feature (1)..( 8): Matrix.004 file - promoters50/4767063
atttaatg

SEQ ID NO: 72849 - DNA, 7 bp, Unknown
  misc_feature (1)..( 7): Matrix.004 file - promoters50/4767066
attaatt

SEQ ID NO: 72850 - DNA, 8 bp, Unknown
  misc_feature (1)..( 8): Matrix.004 file - promoters50/4767066
cttagtca

SEQ ID NO: 72851 - DNA, 9 bp, Unknown
  misc_feature (1)..( 9): Matrix.004 file - promoters50/4767066
tattattca

SEQ ID NO: 72852 - DNA, 8 bp, Unknown
  misc_feature (1)..( 8): Matrix.004 file - promoters50/4767066
cattgatg

SEQ ID NO: 72853 - DNA, 7 bp, Unknown
  misc_feature (1)..( 7): Matrix.004 file - promoters50/4767066
caaaaac

SEQ ID NO: 72854 - DNA, 6 bp, Unknown
  misc_feature (1)..( 6): Matrix.004 file - promoters50/4767066
aagaaa

SEQ ID NO: 72855 - DNA, 9 bp, Unknown
  misc_feature (1)..( 9): Matrix.004 file - promoters50/4767066
aattttttt

SEQ ID NO: 72856 - DNA, 9 bp, Unknown
  misc_feature (1)..( 9): Matrix.004 file - promoters50/4767066
aaaaacaaa

SEQ ID NO: 72857 - DNA, 14 bp, Unknown
  misc_feature (1)..( 14): Matrix.004 file - promoters50/4767085
gtttccaaattctc

SEQ ID NO: 72858 - DNA, 8 bp, Unknown
  misc_feature (1)..( 8): Matrix.004 file - promoters50/4767085
aaaacttt

SEQ ID NO: 72859 - DNA, 14 bp, Unknown
  misc_feature (1)..( 14): Matrix.004 file - promoters50/4767103
tataatttagacat

SEQ ID NO: 72860 - DNA, 11 bp, Unknown
  misc_feature (1)..( 11): Matrix.004 file - promoters50/4767103
tcactggttta

SEQ ID NO: 72861 - DNA, 8 bp, Unknown
  misc_feature (1)..( 8): Matrix.004 file - promoters50/4767109
ggaaattt

SEQ ID NO: 72862 - DNA, 10 bp, Unknown
  misc_feature (1)..( 10): Matrix.004 file - promoters50/4767109
gatacaaaat

SEQ ID NO: 72863 - DNA, 7 bp, Unknown
  misc_feature (1)..( 7): Matrix.004 file - promoters50/4767109
tttaatt

SEQ ID NO: 72864 - DNA, 11 bp, Unknown
  misc_feature (1)..( 11): Matrix.004 file - promoters50/4767109
gataaaaaata

SEQ ID NO: 72865 - DNA, 10 bp, Unknown
  misc_feature (1)..( 10): Matrix.004 file - promoters50/4767109
tctatatata

SEQ ID NO: 72866 - DNA, 7 bp, Unknown
  misc_feature (1)..( 7): Matrix.004 file - promoters50/4767129
caaattt

SEQ ID NO: 72867 - DNA, 8 bp, Unknown
  misc_feature (1)..( 8): Matrix.004 file - promoters50/4767129
ttttgtat

SEQ ID NO: 72868 - DNA, 7 bp, Unknown
  misc_feature (1)..( 7): Matrix.004 file - promoters50/4767129
tttctct

SEQ ID NO: 72869 - DNA, 9 bp, Unknown
  misc_feature (1)..( 9): Matrix.004 file - promoters50/4767133
tcataaact

SEQ ID NO: 72870 - DNA, 9 bp, Unknown
  misc_feature (1)..( 9): Matrix.004 file - promoters50/4767133
aaattattt

SEQ ID NO: 72871 - DNA, 8 bp, Unknown
  misc_feature (1)..( 8): Matrix.004 file - promoters50/4767148
ttaatgta

SEQ ID NO: 72872 - DNA, 8 bp, Unknown
  misc_feature (1)..( 8): Matrix.004 file - promoters50/4767148
atttatat

SEQ ID NO: 72873 - DNA, 9 bp, Unknown
  misc_feature (1)..( 9): Matrix.004 file - promoters50/4767148
atttcttac

SEQ ID NO: 72874 - DNA, 11 bp, Unknown
  misc_feature (1)..( 11): Matrix.004 file - promoters50/4767148
agtaaatttga

SEQ ID NO: 72875 - DNA, 8 bp, Unknown
  misc_feature (1)..( 8): Matrix.004 file - promoters50/4767156
atttatta

SEQ ID NO: 72876 - DNA, 6 bp, Unknown
  misc_feature (1)..( 6): Matrix.004 file - promoters50/4767156
aaaatt

SEQ ID NO: 72877 - DNA, 15 bp, Unknown
  misc_feature (1)..( 15): Matrix.004 file - promoters50/4767169
taaaattaaaaaaca

SEQ ID NO: 72878 - DNA, 8 bp, Unknown
  misc_feature (1)..( 8): Matrix.004 file - promoters50/4767199
gtttattg

SEQ ID NO: 72879 - DNA, 7 bp, Unknown
  misc_feature (1)..( 7): Matrix.004 file - promoters50/4767199
attattt

SEQ ID NO: 72880 - DNA, 7 bp, Unknown
  misc_feature (1)..( 7): Matrix.004 file - promoters50/4767199
ttttttt

SEQ ID NO: 72881 - DNA, 8 bp, Unknown
  misc_feature (1)..( 8): Matrix.004 file - promoters50/4767199
attaaaaa

SEQ ID NO: 72882 - DNA, 10 bp, Unknown
  misc_feature (1)..( 10): Matrix.004 file - promoters50/4767199
taatttattt

SEQ ID NO: 72883 - DNA, 10 bp, Unknown
  misc_feature (1)..( 10): Matrix.004 file - promoters50/4767226
taatcttaga

SEQ ID NO: 72884 - DNA, 9 bp, Unknown
  misc_feature (1)..( 9): Matrix.004 file - promoters50/4767230
aatattctt

SEQ ID NO: 72885 - DNA, 11 bp, Unknown
  misc_feature (1)..( 11): Matrix.004 file - promoters50/4767230
aaaatcttcaa

SEQ ID NO: 72886 - DNA, 15 bp, Unknown
  misc_feature (1)..( 15): Matrix.004 file - promoters50/4767255
atttgactttggcaa

SEQ ID NO: 72887 - DNA, 8 bp, Unknown
  misc_feature (1)..( 8): Matrix.004 file - promoters50/4767267
ccttctct

SEQ ID NO: 72888 - DNA, 7 bp, Unknown
  misc_feature (1)..( 7): Matrix.004 file - promoters50/4767267
atttaat

SEQ ID NO: 72889 - DNA, 10 bp, Unknown
  misc_feature (1)..( 10): Matrix.004 file - promoters50/4767267
aatatattga

SEQ ID NO: 72890 - DNA, 11 bp, Unknown
  misc_feature (1)..( 11): Matrix.004 file - promoters50/4767279
aatttgaaaaa

SEQ ID NO: 72891 - DNA, 9 bp, Unknown
  misc_feature (1)..( 9): Matrix.004 file - promoters50/4767279
ttaacattg

SEQ ID NO: 72892 - DNA, 9 bp, Unknown
  misc_feature (1)..( 9): Matrix.004 file - promoters50/4767283
attaaaagg

SEQ ID NO: 72893 - DNA, 5 bp, Unknown
  misc_feature (1)..( 5): Matrix.004 file - promoters50/4767283
actta

SEQ ID NO: 72894 - DNA, 7 bp, Unknown
  misc_feature (1)..( 7): Matrix.004 file - promoters50/4767294
taaatta

SEQ ID NO: 72895 - DNA, 9 bp, Unknown
  misc_feature (1)..( 9): Matrix.004 file - promoters50/4767298
aaaaaatca

SEQ ID NO: 72896 - DNA, 13 bp, Unknown
  misc_feature (1)..( 13): Matrix.004 file - promoters50/4767298
ttctaaaataaac

SEQ ID NO: 72897 - DNA, 11 bp, Unknown
  misc_feature (1)..( 11): Matrix.004 file - promoters50/4767298
tgacaaataaa

SEQ ID NO: 72898 - DNA, 10 bp, Unknown
  misc_feature (1)..( 10): Matrix.004 file - promoters50/4767298
tatatcaata

SEQ ID NO: 72899 - DNA, 10 bp, Unknown
  misc_feature (1)..( 10): Matrix.004 file - promoters50/4767298
tcaaaaaaga

SEQ ID NO: 72900 - DNA, 11 bp, Unknown
  misc_feature (1)..( 11): Matrix.004 file - promoters50/4767298
aaaatattact

SEQ ID NO: 72901 - DNA, 13 bp, Unknown
  misc_feature (1)..( 13): Matrix.004 file - promoters50/4767314
tgacttttataaa

SEQ ID NO: 72902 - DNA, 8 bp, Unknown
  misc_feature (1)..( 8): Matrix.004 file - promoters50/4767314
aaaacttt

SEQ ID NO: 72903 - DNA, 12 bp, Unknown
  misc_feature (1)..( 12): Matrix.004 file - promoters50/4767318
ttttaagtgata

SEQ ID NO: 72904 - DNA, 9 bp, Unknown
  misc_feature (1)..( 9): Matrix.004 file - promoters50/4767318
tgttatttc

SEQ ID NO: 72905 - DNA, 11 bp, Unknown
  misc_feature (1)..( 11): Matrix.004 file - promoters50/4767318
aaacattaata

SEQ ID NO: 72906 - DNA, 9 bp, Unknown
  misc_feature (1)..( 9): Matrix.004 file - promoters50/4767318
tttacttaa

SEQ ID NO: 72907 - DNA, 10 bp, Unknown
  misc_feature (1)..( 10): Matrix.004 file - promoters50/4767318
aaaaacacac

SEQ ID NO: 72908 - DNA, 7 bp, Unknown
  misc_feature (1)..( 7): Matrix.004 file - promoters50/4767318
aaattat

SEQ ID NO: 72909 - DNA, 9 bp, Unknown
  misc_feature (1)..( 9): Matrix.004 file - promoters50/4767318
aaatactta

SEQ ID NO: 72910 - DNA, 7 bp, Unknown
  misc_feature (1)..( 7): Matrix.004 file - promoters50/4767318
ttcattt

SEQ ID NO: 72911 - DNA, 8 bp, Unknown
  misc_feature (1)..( 8): Matrix.004 file - promoters50/4767318
acaagatt

SEQ ID NO: 72912 - DNA, 10 bp, Unknown
  misc_feature (1)..( 10): Matrix.004 file - promoters50/4767318
gtcttcattt

SEQ ID NO: 72913 - DNA, 9 bp, Unknown
  misc_feature (1)..( 9): Matrix.004 file - promoters50/4767330
aaaattatt

SEQ ID NO: 72914 - DNA, 8 bp, Unknown
  misc_feature (1)..( 8): Matrix.004 file - promoters50/4767330
caatattt

SEQ ID NO: 72915 - DNA, 11 bp, Unknown
  misc_feature (1)..( 11): Matrix.004 file - promoters50/4767335
atttgtgtttg

SEQ ID NO: 72916 - DNA, 13 bp, Unknown
  misc_feature (1)..( 13): Matrix.004 file - promoters50/4767369
atgaattgcttca

SEQ ID NO: 72917 - DNA, 9 bp, Unknown
  misc_feature (1)..( 9): Matrix.004 file - promoters50/4767377
caataaatt

SEQ ID NO: 72918 - DNA, 7 bp, Unknown
  misc_feature (1)..( 7): Matrix.004 file - promoters50/4767377
ttaaaaa

SEQ ID NO: 72919 - DNA, 12 bp, Unknown
  misc_feature (1)..( 12): Matrix.004 file - promoters50/4767377
aaattaaaatag

SEQ ID NO: 72920 - DNA, 8 bp, Unknown
  misc_feature (1)..( 8): Matrix.004 file - promoters50/4767377
ataaacca

SEQ ID NO: 72921 - DNA, 8 bp, Unknown
  misc_feature (1)..( 8): Matrix.004 file - promoters50/4767377
aaaataaa

SEQ ID NO: 72922 - DNA, 7 bp, Unknown
  misc_feature (1)..( 7): Matrix.004 file - promoters50/4767377
gaaataa

SEQ ID NO: 72923 - DNA, 12 bp, Unknown
  misc_feature (1)..( 12): Matrix.004 file - promoters50/4767379
ttaaaaataaat

SEQ ID NO: 72924 - DNA, 14 bp, Unknown
  misc_feature (1)..( 14): Matrix.004 file - promoters50/4767379
taaaaatgatatac

SEQ ID NO: 72925 - DNA, 9 bp, Unknown
  misc_feature (1)..( 9): Matrix.004 file - promoters50/4767379
ataaaaaaa

SEQ ID NO: 72926 - DNA, 10 bp, Unknown
  misc_feature (1)..( 10): Matrix.004 file - promoters50/4767379
aaaatgaatg

SEQ ID NO: 72927 - DNA, 7 bp, Unknown
  misc_feature (1)..( 7): Matrix.004 file - promoters50/4767379
gtaaaga

SEQ ID NO: 72928 - DNA, 11 bp, Unknown
  misc_feature (1)..( 11): Matrix.004 file - promoters50/4767379
ataatgttaac

SEQ ID NO: 72929 - DNA, 11 bp, Unknown
  misc_feature (1)..( 11): Matrix.004 file - promoters50/4767379
tctgtttaaga

SEQ ID NO: 72930 - DNA, 11 bp, Unknown
  misc_feature (1)..( 11): Matrix.004 file - promoters50/4767379
aaaaattaata

SEQ ID NO: 72931 - DNA, 8 bp, Unknown
  misc_feature (1)..( 8): Matrix.004 file - promoters50/4767379
aaaaatta

SEQ ID NO: 72932 - DNA, 10 bp, Unknown
  misc_feature (1)..( 10): Matrix.004 file - promoters50/4767379
aaataaaata

SEQ ID NO: 72933 - DNA, 7 bp, Unknown
  misc_feature (1)..( 7): Matrix.004 file - promoters50/4767379
aaacaaa

SEQ ID NO: 72934 - DNA, 11 bp, Unknown
  misc_feature (1)..( 11): Matrix.004 file - promoters50/4767379
accataaaaaa

SEQ ID NO: 72935 - DNA, 12 bp, Unknown
  misc_feature (1)..( 12): Matrix.004 file - promoters50/4767395
tcaaaaaataaa

SEQ ID NO: 72936 - DNA, 8 bp, Unknown
  misc_feature (1)..( 8): Matrix.004 file - promoters50/4767410
atcaataa

SEQ ID NO: 72937 - DNA, 7 bp, Unknown
  misc_feature (1)..( 7): Matrix.004 file - promoters50/4767410
tatgaaa

SEQ ID NO: 72938 - DNA, 8 bp, Unknown
  misc_feature (1)..( 8): Matrix.004 file - promoters50/4767410
agttaaag

SEQ ID NO: 72939 - DNA, 9 bp, Unknown
  misc_feature (1)..( 9): Matrix.004 file - promoters50/4767452
ggatttgtt

SEQ ID NO: 72940 - DNA, 12 bp, Unknown
  misc_feature (1)..( 12): Matrix.004 file - promoters50/4767487
caaaaagatatg

SEQ ID NO: 72941 - DNA, 9 bp, Unknown
  misc_feature (1)..( 9): Matrix.004 file - promoters50/4767487
ataaattta

SEQ ID NO: 72942 - DNA, 10 bp, Unknown
  misc_feature (1)..( 10): Matrix.004 file - promoters50/4767490
ccattttatt

SEQ ID NO: 72943 - DNA, 10 bp, Unknown
  misc_feature (1)..( 10): Matrix.004 file - promoters50/4767490
taaagtttaa

SEQ ID NO: 72944 - DNA, 13 bp, Unknown
  misc_feature (1)..( 13): Matrix.004 file - promoters50/4767490
agtcatatataaa

SEQ ID NO: 72945 - DNA, 10 bp, Unknown
  misc_feature (1)..( 10): Matrix.004 file - promoters50/4767490
ctggttttta

SEQ ID NO: 72946 - DNA, 10 bp, Unknown
  misc_feature (1)..( 10): Matrix.004 file - promoters50/4767509
ttttgaaact

SEQ ID NO: 72947 - DNA, 6 bp, Unknown
  misc_feature (1)..( 6): Matrix.004 file - promoters50/4767509
atcaac

SEQ ID NO: 72948 - DNA, 11 bp, Unknown
  misc_feature (1)..( 11): Matrix.004 file - promoters50/4767515
tataatataat

SEQ ID NO: 72949 - DNA, 5 bp, Unknown
  misc_feature (1)..( 5): Matrix.004 file - promoters50/4767515
tttga

SEQ ID NO: 72950 - DNA, 11 bp, Unknown
  misc_feature (1)..( 11): Matrix.004 file - promoters50/4767515
ttaacaaaaca

SEQ ID NO: 72951 - DNA, 9 bp, Unknown
  misc_feature (1)..( 9): Matrix.004 file - promoters50/4767519
tattataaa

SEQ ID NO: 72952 - DNA, 7 bp, Unknown
  misc_feature (1)..( 7): Matrix.004 file - promoters50/4767519
aagttat

SEQ ID NO: 72953 - DNA, 11 bp, Unknown
  misc_feature (1)..( 11): Matrix.004 file - promoters50/4767519
ataattatatg

SEQ ID NO: 72954 - DNA, 7 bp, Unknown
  misc_feature (1)..( 7): Matrix.004 file - promoters50/4767519
tagaaac

SEQ ID NO: 72955 - DNA, 7 bp, Unknown
  misc_feature (1)..( 7): Matrix.004 file - promoters50/4767519
aaataaa

SEQ ID NO: 72956 - DNA, 5 bp, Unknown
  misc_feature (1)..( 5): Matrix.004 file - promoters50/4767519
aaata

SEQ ID NO: 72957 - DNA, 7 bp, Unknown
  misc_feature (1)..( 7): Matrix.004 file - promoters50/4767519
agaaact

SEQ ID NO: 72958 - DNA, 11 bp, Unknown
  misc_feature (1)..( 11): Matrix.004 file - promoters50/4767519
aaacactatat

SEQ ID NO: 72959 - DNA, 8 bp, Unknown
  misc_feature (1)..( 8): Matrix.004 file - promoters50/4767519
atttaaat

SEQ ID NO: 72960 - DNA, 10 bp, Unknown
  misc_feature (1)..( 10): Matrix.004 file - promoters50/4767519
atttaagaaa

SEQ ID NO: 72961 - DNA, 8 bp, Unknown
  misc_feature (1)..( 8): Matrix.004 file - promoters50/4767539
aacatttt

SEQ ID NO: 72962 - DNA, 9 bp, Unknown
  misc_feature (1)..( 9): Matrix.004 file - promoters50/4767539
tatctctgc

SEQ ID NO: 72963 - DNA, 10 bp, Unknown
  misc_feature (1)..( 10): Matrix.004 file - promoters50/4767539
tataaaactc

SEQ ID NO: 72964 - DNA, 11 bp, Unknown
  misc_feature (1)..( 11): Matrix.004 file - promoters50/4767545
tagatcttcgt

SEQ ID NO: 72965 - DNA, 11 bp, Unknown
  misc_feature (1)..( 11): Matrix.004 file - promoters50/4767545
ctttctttaaa

SEQ ID NO: 72966 - DNA, 10 bp, Unknown
  misc_feature (1)..( 10): Matrix.004 file - promoters50/4767545
taaaaataaa

SEQ ID NO: 72967 - DNA, 10 bp, Unknown
  misc_feature (1)..( 10): Matrix.004 file - promoters50/4767545
aaataataat

SEQ ID NO: 72968 - DNA, 13 bp, Unknown
  misc_feature (1)..( 13): Matrix.004 file - promoters50/4767552
aaaaataattata

SEQ ID NO: 72969 - DNA, 7 bp, Unknown
  misc_feature (1)..( 7): Matrix.004 file - promoters50/4767574
agaaata

SEQ ID NO: 72970 - DNA, 9 bp, Unknown
  misc_feature (1)..( 9): Matrix.004 file - promoters50/4767574
agaatgatt

SEQ ID NO: 72971 - DNA, 8 bp, Unknown
  misc_feature (1)..( 8): Matrix.004 file - promoters50/4767574
tgatattg

SEQ ID NO: 72972 - DNA, 10 bp, Unknown
  misc_feature (1)..( 10): Matrix.004 file - promoters50/4767574
agacaatctt

SEQ ID NO: 72973 - DNA, 8 bp, Unknown
  misc_feature (1)..( 8): Matrix.004 file - promoters50/4767574
agatataa

SEQ ID NO: 72974 - DNA, 11 bp, Unknown
  misc_feature (1)..( 11): Matrix.004 file - promoters50/4767578
ttgatgtagaa

SEQ ID NO: 72975 - DNA, 10 bp, Unknown
  misc_feature (1)..( 10): Matrix.004 file - promoters50/4767578
taatttatct

SEQ ID NO: 72976 - DNA, 11 bp, Unknown
  misc_feature (1)..( 11): Matrix.004 file - promoters50/4767586
aacaaaatgta

SEQ ID NO: 72977 - DNA, 10 bp, Unknown
  misc_feature (1)..( 10): Matrix.004 file - promoters50/4767586
aaatttaata

SEQ ID NO: 72978 - DNA, 6 bp, Unknown
  misc_feature (1)..( 6): Matrix.004 file - promoters50/4767588
atataa

SEQ ID NO: 72979 - DNA, 7 bp, Unknown
  misc_feature (1)..( 7): Matrix.004 file - promoters50/4767610
ttgtttc

SEQ ID NO: 72980 - DNA, 8 bp, Unknown
  misc_feature (1)..( 8): Matrix.004 file - promoters50/4767610
tattttaa

SEQ ID NO: 72981 - DNA, 8 bp, Unknown
  misc_feature (1)..( 8): Matrix.004 file - promoters50/4767617
cttaatta

SEQ ID NO: 72982 - DNA, 8 bp, Unknown
  misc_feature (1)..( 8): Matrix.004 file - promoters50/4767638
attaaata

SEQ ID NO: 72983 - DNA, 10 bp, Unknown
  misc_feature (1)..( 10): Matrix.004 file - promoters50/4767638
atttttttaa

SEQ ID NO: 72984 - DNA, 11 bp, Unknown
  misc_feature (1)..( 11): Matrix.004 file - promoters50/4767638
attataattaa

SEQ ID NO: 72985 - DNA, 10 bp, Unknown
  misc_feature (1)..( 10): Matrix.004 file - promoters50/4767663
aataaaaaaa

SEQ ID NO: 72986 - DNA, 9 bp, Unknown
  misc_feature (1)..( 9): Matrix.004 file - promoters50/4767663
aataataaa

SEQ ID NO: 72987 - DNA, 6 bp, Unknown
  misc_feature (1)..( 6): Matrix.004 file - promoters50/4767663
aaaatg

SEQ ID NO: 72988 - DNA, 10 bp, Unknown
  misc_feature (1)..( 10): Matrix.004 file - promoters50/4767663
ataaatcaaa

SEQ ID NO: 72989 - DNA, 11 bp, Unknown
  misc_feature (1)..( 11): Matrix.004 file - promoters50/4767663
atatatataaa

SEQ ID NO: 72990 - DNA, 11 bp, Unknown
  misc_feature (1)..( 11): Matrix.004 file - promoters50/4767663
atttaattttc

SEQ ID NO: 72991 - DNA, 10 bp, Unknown
  misc_feature (1)..( 10): Matrix.004 file - promoters50/4767663
agaaatatat

SEQ ID NO: 72992 - DNA, 12 bp, Unknown
  misc_feature (1)..( 12): Matrix.004 file - promoters50/4767663
atcttacttata

SEQ ID NO: 72993 - DNA, 9 bp, Unknown
  misc_feature (1)..( 9): Matrix.004 file - promoters50/4767675
agaaaaata

SEQ ID NO: 72994 - DNA, 9 bp, Unknown
  misc_feature (1)..( 9): Matrix.004 file - promoters50/4767679
aaagcaaaa

SEQ ID NO: 72995 - DNA, 8 bp, Unknown
  misc_feature (1)..( 8): Matrix.004 file - promoters50/4767683
aacaatca

SEQ ID NO: 72996 - DNA, 8 bp, Unknown
  misc_feature (1)..( 8): Matrix.004 file - promoters50/4767683
ttatataa

SEQ ID NO: 72997 - DNA, 20 bp, Unknown
  misc_feature (1)..( 20): Matrix.004 file - promoters50/4767701
tagaaaaaaatattgataat

SEQ ID NO: 72998 - DNA, 7 bp, Unknown
  misc_feature (1)..( 7): Matrix.004 file - promoters50/4767701
cttaatt

SEQ ID NO: 72999 - DNA, 12 bp, Unknown
  misc_feature (1)..( 12): Matrix.004 file - promoters50/4767701
tctatgaatcat

SEQ ID NO: 73000 - DNA, 10 bp, Unknown
  misc_feature (1)..( 10): Matrix.004 file - promoters50/4767701
cttaatgtaa

SEQ ID NO: 73001 - DNA, 12 bp, Unknown
  misc_feature (1)..( 12): Matrix.004 file - promoters50/4767701
ccaattatccaa

SEQ ID NO: 73002 - DNA, 11 bp, Unknown
  misc_feature (1)..( 11): Matrix.004 file - promoters50/4767705
ccaagaaattc

SEQ ID NO: 73003 - DNA, 20 bp, Unknown
  misc_feature (1)..( 20): Matrix.004 file - promoters50/4767705
taagaataatttttaagcta

SEQ ID NO: 73004 - DNA, 14 bp, Unknown
  misc_feature (1)..( 14): Matrix.004 file - promoters50/4767705
ataataatttaatt

SEQ ID NO: 73005 - DNA, 7 bp, Unknown
  misc_feature (1)..( 7): Matrix.004 file - promoters50/4767705
taatttt

SEQ ID NO: 73006 - DNA, 12 bp, Unknown
  misc_feature (1)..( 12): Matrix.004 file - promoters50/4767705
attttaattttt

SEQ ID NO: 73007 - DNA, 9 bp, Unknown
  misc_feature (1)..( 9): Matrix.004 file - promoters50/4767705
ctatatata

SEQ ID NO: 73008 - DNA, 12 bp, Unknown
  misc_feature (1)..( 12): Matrix.004 file - promoters50/4767705
caaaaaattgat

SEQ ID NO: 73009 - DNA, 9 bp, Unknown
  misc_feature (1)..( 9): Matrix.004 file - promoters50/4767705
gaataaaat

SEQ ID NO: 73010 - DNA, 14 bp, Unknown
  misc_feature (1)..( 14): Matrix.004 file - promoters50/4767705
tgacaaaaaattta

SEQ ID NO: 73011 - DNA, 12 bp, Unknown
  misc_feature (1)..( 12): Matrix.004 file - promoters50/4767705
caaattaattaa

SEQ ID NO: 73012 - DNA, 9 bp, Unknown
  misc_feature (1)..( 9): Matrix.004 file - promoters50/4767705
tatatataa

SEQ ID NO: 73013 - DNA, 13 bp, Unknown
  misc_feature (1)..( 13): Matrix.004 file - promoters50/4767709
actaattaaagtg

SEQ ID NO: 73014 - DNA, 11 bp, Unknown
  misc_feature (1)..( 11): Matrix.004 file - promoters50/4767709
caaaaatagac

SEQ ID NO: 73015 - DNA, 7 bp, Unknown
  misc_feature (1)..( 7): Matrix.004 file - promoters50/4767715
attgtga

SEQ ID NO: 73016 - DNA, 9 bp, Unknown
  misc_feature (1)..( 9): Matrix.004 file - promoters50/4767722
atattatac

SEQ ID NO: 73017 - DNA, 14 bp, Unknown
  misc_feature (1)..( 14): Matrix.004 file - promoters50/4767722
attttaattaagaa

SEQ ID NO: 73018 - DNA, 11 bp, Unknown
  misc_feature (1)..( 11): Matrix.004 file - promoters50/4767722
gccttttatgt

SEQ ID NO: 73019 - DNA, 13 bp, Unknown
  misc_feature (1)..( 13): Matrix.004 file - promoters50/4767733
ttgttaaaaaatc

SEQ ID NO: 73020 - DNA, 7 bp, Unknown
  misc_feature (1)..( 7): Matrix.004 file - promoters50/4767733
gagaaag

SEQ ID NO: 73021 - DNA, 7 bp, Unknown
  misc_feature (1)..( 7): Matrix.004 file - promoters50/4767748
tcaaaag

SEQ ID NO: 73022 - DNA, 12 bp, Unknown
  misc_feature (1)..( 12): Matrix.004 file - promoters50/4767748
ttaataaatttt

SEQ ID NO: 73023 - DNA, 7 bp, Unknown
  misc_feature (1)..( 7): Matrix.004 file - promoters50/4767755
tatagta

SEQ ID NO: 73024 - DNA, 9 bp, Unknown
  misc_feature (1)..( 9): Matrix.004 file - promoters50/4767755
ttaatatta

SEQ ID NO: 73025 - DNA, 8 bp, Unknown
  misc_feature (1)..( 8): Matrix.004 file - promoters50/4767755
agattttt

SEQ ID NO: 73026 - DNA, 8 bp, Unknown
  misc_feature (1)..( 8): Matrix.004 file - promoters50/4767755
caaatttt

SEQ ID NO: 73027 - DNA, 8 bp, Unknown
  misc_feature (1)..( 8): Matrix.004 file - promoters50/4767755
ttttttct

SEQ ID NO: 73028 - DNA, 7 bp, Unknown
  misc_feature (1)..( 7): Matrix.004 file - promoters50/4767755
ataaaac

SEQ ID NO: 73029 - DNA, 11 bp, Unknown
  misc_feature (1)..( 11): Matrix.004 file - promoters50/4767764
caaaagaaaaa

SEQ ID NO: 73030 - DNA, 15 bp, Unknown
  misc_feature (1)..( 15): Matrix.004 file - promoters50/4767764
aaattgtatctatat

SEQ ID NO: 73031 - DNA, 11 bp, Unknown
  misc_feature (1)..( 11): Matrix.004 file - promoters50/4767764
ttataatcttt

SEQ ID NO: 73032 - DNA, 11 bp, Unknown
  misc_feature (1)..( 11): Matrix.004 file - promoters50/4767764
tagatctttat

SEQ ID NO: 73033 - DNA, 9 bp, Unknown
  misc_feature (1)..( 9): Matrix.004 file - promoters50/4767767
aaaaataac

SEQ ID NO: 73034 - DNA, 10 bp, Unknown
  misc_feature (1)..( 10): Matrix.004 file - promoters50/4767767
aaccttaaaa

SEQ ID NO: 73035 - DNA, 10 bp, Unknown
  misc_feature (1)..( 10): Matrix.004 file - promoters50/4767767
cgaatccata

SEQ ID NO: 73036 - DNA, 10 bp, Unknown
  misc_feature (1)..( 10): Matrix.004 file - promoters50/4767795
aacattaaaa

SEQ ID NO: 73037 - DNA, 13 bp, Unknown
  misc_feature (1)..( 13): Matrix.004 file - promoters50/4767795
ctcaaaattgatt

SEQ ID NO: 73038 - DNA, 10 bp, Unknown
  misc_feature (1)..( 10): Matrix.004 file - promoters50/4767795
tgattagtta

SEQ ID NO: 73039 - DNA, 8 bp, Unknown
  misc_feature (1)..( 8): Matrix.004 file - promoters50/4767799
tttcttaa

SEQ ID NO: 73040 - DNA, 9 bp, Unknown
  misc_feature (1)..( 9): Matrix.004 file - promoters50/4767799
gagattgag

SEQ ID NO: 73041 - DNA, 10 bp, Unknown
  misc_feature (1)..( 10): Matrix.004 file - promoters50/4767799
tgagcttgag

SEQ ID NO: 73042 - DNA, 8 bp, Unknown
  misc_feature (1)..( 8): Matrix.004 file - promoters50/4767803
ctaaacat

SEQ ID NO: 73043 - DNA, 7 bp, Unknown
  misc_feature (1)..( 7): Matrix.004 file - promoters50/4767803
agagttt

SEQ ID NO: 73044 - DNA, 10 bp, Unknown
  misc_feature (1)..( 10): Matrix.004 file - promoters50/4767803
ataactttct

SEQ ID NO: 73045 - DNA, 10 bp, Unknown
  misc_feature (1)..( 10): Matrix.004 file - promoters50/4767803
ataactttct

SEQ ID NO: 73046 - DNA, 8 bp, Unknown
  misc_feature (1)..( 8): Matrix.004 file - promoters50/4767821
atatcttc

SEQ ID NO: 73047 - DNA, 8 bp, Unknown
  misc_feature (1)..( 8): Matrix.004 file - promoters50/4767821
taaattaa

SEQ ID NO: 73048 - DNA, 10 bp, Unknown
  misc_feature (1)..( 10): Matrix.004 file - promoters50/4767821
taaattgaaa

SEQ ID NO: 73049 - DNA, 9 bp, Unknown
  misc_feature (1)..( 9): Matrix.004 file - promoters50/4767829
ttatatata

SEQ ID NO: 73050 - DNA, 7 bp, Unknown
  misc_feature (1)..( 7): Matrix.004 file - promoters50/4767829
aaaattt

SEQ ID NO: 73051 - DNA, 10 bp, Unknown
  misc_feature (1)..( 10): Matrix.004 file - promoters50/4767829
taaaaatttt

SEQ ID NO: 73052 - DNA, 8 bp, Unknown
  misc_feature (1)..( 8): Matrix.004 file - promoters50/4767829
ataccaac

SEQ ID NO: 73053 - DNA, 9 bp, Unknown
  misc_feature (1)..( 9): Matrix.004 file - promoters50/4767829
aacgaaaga

SEQ ID NO: 73054 - DNA, 9 bp, Unknown
  misc_feature (1)..( 9): Matrix.004 file - promoters50/4767829
catttatta

SEQ ID NO: 73055 - DNA, 10 bp, Unknown
  misc_feature (1)..( 10): Matrix.004 file - promoters50/4767829
ttttggaaat

SEQ ID NO: 73056 - DNA, 8 bp, Unknown
  misc_feature (1)..( 8): Matrix.004 file - promoters50/4767829
ttatcatt

SEQ ID NO: 73057 - DNA, 9 bp, Unknown
  misc_feature (1)..( 9): Matrix.004 file - promoters50/4767829
ataattttc

SEQ ID NO: 73058 - DNA, 9 bp, Unknown
  misc_feature (1)..( 9): Matrix.004 file - promoters50/4767837
aagaaaaga

SEQ ID NO: 73059 - DNA, 9 bp, Unknown
  misc_feature (1)..( 9): Matrix.004 file - promoters50/4767837
ttcttcaat

SEQ ID NO: 73060 - DNA, 12 bp, Unknown
  misc_feature (1)..( 12): Matrix.004 file - promoters50/4767863
acaaaaaacaat

SEQ ID NO: 73061 - DNA, 10 bp, Unknown
  misc_feature (1)..( 10): Matrix.004 file - promoters50/4767863
ataaaacata

SEQ ID NO: 73062 - DNA, 8 bp, Unknown
  misc_feature (1)..( 8): Matrix.004 file - promoters50/4767871
aagaaaaa

SEQ ID NO: 73063 - DNA, 8 bp, Unknown
  misc_feature (1)..( 8): Matrix.004 file - promoters50/4767871
ttagtagc

SEQ ID NO: 73064 - DNA, 11 bp, Unknown
  misc_feature (1)..( 11): Matrix.004 file - promoters50/4767871
tagcaaaagag

SEQ ID NO: 73065 - DNA, 10 bp, Unknown
  misc_feature (1)..( 10): Matrix.004 file - promoters50/4767871
aaatttaatt

SEQ ID NO: 73066 - DNA, 9 bp, Unknown
  misc_feature (1)..( 9): Matrix.004 file - promoters50/4767871
ttatttaaa

SEQ ID NO: 73067 - DNA, 7 bp, Unknown
  misc_feature (1)..( 7): Matrix.004 file - promoters50/4767871
ctttttg

SEQ ID NO: 73068 - DNA, 12 bp, Unknown
  misc_feature (1)..( 12): Matrix.004 file - promoters50/4767877
gaataaacattt

SEQ ID NO: 73069 - DNA, 7 bp, Unknown
  misc_feature (1)..( 7): Matrix.004 file - promoters50/4767884
aatgaaa

SEQ ID NO: 73070 - DNA, 12 bp, Unknown
  misc_feature (1)..( 12): Matrix.004 file - promoters50/4767884
ttaaaatacttt

SEQ ID NO: 73071 - DNA, 12 bp, Unknown
  misc_feature (1)..( 12): Matrix.004 file - promoters50/4767884
taatcaaaaaaa

SEQ ID NO: 73072 - DNA, 8 bp, Unknown
  misc_feature (1)..( 8): Matrix.004 file - promoters50/4767892
aaaataag

SEQ ID NO: 73073 - DNA, 11 bp, Unknown
  misc_feature (1)..( 11): Matrix.004 file - promoters50/4767892
taatacaaaat

SEQ ID NO: 73074 - DNA, 9 bp, Unknown
  misc_feature (1)..( 9): Matrix.004 file - promoters50/4767929
ttgttaaca

SEQ ID NO: 73075 - DNA, 7 bp, Unknown
  misc_feature (1)..( 7): Matrix.004 file - promoters50/4767929
ttgatca

SEQ ID NO: 73076 - DNA, 7 bp, Unknown
  misc_feature (1)..( 7): Matrix.004 file - promoters50/4767929
atttgtt

SEQ ID NO: 73077 - DNA, 9 bp, Unknown
  misc_feature (1)..( 9): Matrix.004 file - promoters50/4767929
ttaataaca

SEQ ID NO: 73078 - DNA, 8 bp, Unknown
  misc_feature (1)..( 8): Matrix.004 file - promoters50/4767929
tctaagtg

SEQ ID NO: 73079 - DNA, 8 bp, Unknown
  misc_feature (1)..( 8): Matrix.004 file - promoters50/4767933
tttcaatt

SEQ ID NO: 73080 - DNA, 8 bp, Unknown
  misc_feature (1)..( 8): Matrix.004 file - promoters50/4767933
atccaaaa

SEQ ID NO: 73081 - DNA, 7 bp, Unknown
  misc_feature (1)..( 7): Matrix.004 file - promoters50/4767933
tccttta

SEQ ID NO: 73082 - DNA, 10 bp, Unknown
  misc_feature (1)..( 10): Matrix.004 file - promoters50/4767933
ttaaaaactc

SEQ ID NO: 73083 - DNA, 10 bp, Unknown
  misc_feature (1)..( 10): Matrix.004 file - promoters50/4767948
aaattgaaac

SEQ ID NO: 73084 - DNA, 10 bp, Unknown
  misc_feature (1)..( 10): Matrix.004 file - promoters50/4767952
gtatacaaaa

SEQ ID NO: 73085 - DNA, 9 bp, Unknown
  misc_feature (1)..( 9): Matrix.004 file - promoters50/4767952
tattaaatg

SEQ ID NO: 73086 - DNA, 9 bp, Unknown
  misc_feature (1)..( 9): Matrix.004 file - promoters50/4767956
agatcaaat

SEQ ID NO: 73087 - DNA, 11 bp, Unknown
  misc_feature (1)..( 11): Matrix.004 file - promoters50/4767956
caaacataatt

SEQ ID NO: 73088 - DNA, 9 bp, Unknown
  misc_feature (1)..( 9): Matrix.004 file - promoters50/4767960
caaacaaat

SEQ ID NO: 73089 - DNA, 7 bp, Unknown
  misc_feature (1)..( 7): Matrix.004 file - promoters50/4767960
tctttga

SEQ ID NO: 73090 - DNA, 8 bp, Unknown
  misc_feature (1)..( 8): Matrix.004 file - promoters50/4767960
tcaacaaa

SEQ ID NO: 73091 - DNA, 7 bp, Unknown
  misc_feature (1)..( 7): Matrix.004 file - promoters50/4767972
gcagaat

SEQ ID NO: 73092 - DNA, 7 bp, Unknown
  misc_feature (1)..( 7): Matrix.004 file - promoters50/4767972
aaaaatc

SEQ ID NO: 73093 - DNA, 9 bp, Unknown
  misc_feature (1)..( 9): Matrix.004 file - promoters50/4767972
gaaaataat

SEQ ID NO: 73094 - DNA, 12 bp, Unknown
  misc_feature (1)..( 12): Matrix.004 file - promoters50/4767972
aaaaaaaaatat

SEQ ID NO: 73095 - DNA, 14 bp, Unknown
  misc_feature (1)..( 14): Matrix.004 file - promoters50/4767972
tatttgaaaaatat

SEQ ID NO: 73096 - DNA, 7 bp, Unknown
  misc_feature (1)..( 7): Matrix.004 file - promoters50/4767972
taatata

SEQ ID NO: 73097 - DNA, 10 bp, Unknown
  misc_feature (1)..( 10): Matrix.004 file - promoters50/4767972
aagaaaaata

SEQ ID NO: 73098 - DNA, 10 bp, Unknown
  misc_feature (1)..( 10): Matrix.004 file - promoters50/4767976
taactaattt

SEQ ID NO: 73099 - DNA, 8 bp, Unknown
  misc_feature (1)..( 8): Matrix.004 file - promoters50/4767976
ttttaatt

SEQ ID NO: 73100 - DNA, 11 bp, Unknown
  misc_feature (1)..( 11): Matrix.004 file - promoters50/4767976
tgtattaactt

SEQ ID NO: 73101 - DNA, 8 bp, Unknown
  misc_feature (1)..( 8): Matrix.004 file - promoters50/4767978
tcaaatca

SEQ ID NO: 73102 - DNA, 9 bp, Unknown
  misc_feature (1)..( 9): Matrix.004 file - promoters50/4767990
ttggaaaaa

SEQ ID NO: 73103 - DNA, 8 bp, Unknown
  misc_feature (1)..( 8): Matrix.004 file - promoters50/4768000
caaatttg

SEQ ID NO: 73104 - DNA, 8 bp, Unknown
  misc_feature (1)..( 8): Matrix.004 file - promoters50/4768000
ctcaattt

SEQ ID NO: 73105 - DNA, 9 bp, Unknown
  misc_feature (1)..( 9): Matrix.004 file - promoters50/4768000
taattgaaa

SEQ ID NO: 73106 - DNA, 7 bp, Unknown
  misc_feature (1)..( 7): Matrix.004 file - promoters50/4768000
ttattta

SEQ ID NO: 73107 - DNA, 7 bp, Unknown
  misc_feature (1)..( 7): Matrix.004 file - promoters50/4768000
ttatttt

SEQ ID NO: 73108 - DNA, 10 bp, Unknown
  misc_feature (1)..( 10): Matrix.004 file - promoters50/4768000
tttttttaaa

SEQ ID NO: 73109 - DNA, 7 bp, Unknown
  misc_feature (1)..( 7): Matrix.004 file - promoters50/4768007
ttacatt

SEQ ID NO: 73110 - DNA, 4 bp, Unknown
  misc_feature (1)..( 4): Matrix.004 file - promoters50/4768007
aaaa

SEQ ID NO: 73111 - DNA, 10 bp, Unknown
  misc_feature (1)..( 10): Matrix.004 file - promoters50/4768007
ctttccattc

SEQ ID NO: 73112 - DNA, 10 bp, Unknown
  misc_feature (1)..( 10): Matrix.004 file - promoters50/4768007
ttatatataa

SEQ ID NO: 73113 - DNA, 14 bp, Unknown
  misc_feature (1)..( 14): Matrix.004 file - promoters50/4768007
atcgtaacaaaaaa

SEQ ID NO: 73114 - DNA, 10 bp, Unknown
  misc_feature (1)..( 10): Matrix.004 file - promoters50/4768011
atataaaact

SEQ ID NO: 73115 - DNA, 8 bp, Unknown
  misc_feature (1)..( 8): Matrix.004 file - promoters50/4768011
taatacaa

SEQ ID NO: 73116 - DNA, 11 bp, Unknown
  misc_feature (1)..( 11): Matrix.004 file - promoters50/4768011
aaaatcagtaa

SEQ ID NO: 73117 - DNA, 8 bp, Unknown
  misc_feature (1)..( 8): Matrix.004 file - promoters50/4768011
tgaatatt

SEQ ID NO: 73118 - DNA, 10 bp, Unknown
  misc_feature (1)..( 10): Matrix.004 file - promoters50/4768011
gtacaaaata

SEQ ID NO: 73119 - DNA, 9 bp, Unknown
  misc_feature (1)..( 9): Matrix.004 file - promoters50/4768011
aatttaaat

SEQ ID NO: 73120 - DNA, 8 bp, Unknown
  misc_feature (1)..( 8): Matrix.004 file - promoters50/4768011
atttccaa

SEQ ID NO: 73121 - DNA, 12 bp, Unknown
  misc_feature (1)..( 12): Matrix.004 file - promoters50/4768011
gtacaaaataaa

SEQ ID NO: 73122 - DNA, 11 bp, Unknown
  misc_feature (1)..( 11): Matrix.004 file - promoters50/4768027
tttagactttt

SEQ ID NO: 73123 - DNA, 11 bp, Unknown
  misc_feature (1)..( 11): Matrix.004 file - promoters50/4768027
aaaagcttagt

SEQ ID NO: 73124 - DNA, 8 bp, Unknown
  misc_feature (1)..( 8): Matrix.004 file - promoters50/4768027
gttaatta

SEQ ID NO: 73125 - DNA, 12 bp, Unknown
  misc_feature (1)..( 12): Matrix.004 file - promoters50/4768027
aggatttgtgat

SEQ ID NO: 73126 - DNA, 13 bp, Unknown
  misc_feature (1)..( 13): Matrix.004 file - promoters50/4768027
gaggatttgtgat

SEQ ID NO: 73127 - DNA, 11 bp, Unknown
  misc_feature (1)..( 11): Matrix.004 file - promoters50/4768027
agataaaacag

SEQ ID NO: 73128 - DNA, 9 bp, Unknown
  misc_feature (1)..( 9): Matrix.004 file - promoters50/4768027
tgacacagg

SEQ ID NO: 73129 - DNA, 8 bp, Unknown
  misc_feature (1)..( 8): Matrix.004 file - promoters50/4768027
gagttaaa

SEQ ID NO: 73130 - DNA, 6 bp, Unknown
  misc_feature (1)..( 6): Matrix.004 file - promoters50/4768035
aaaaca

SEQ ID NO: 73131 - DNA, 11 bp, Unknown
  misc_feature (1)..( 11): Matrix.004 file - promoters50/4768039
gttcatgcctg

SEQ ID NO: 73132 - DNA, 12 bp, Unknown
  misc_feature (1)..( 12): Matrix.004 file - promoters50/4768039
tttattataaat

SEQ ID NO: 73133 - DNA, 11 bp, Unknown
  misc_feature (1)..( 11): Matrix.004 file - promoters50/4768039
aaaaaaaaaaa

SEQ ID NO: 73134 - DNA, 5 bp, Unknown
  misc_feature (1)..( 5): Matrix.004 file - promoters50/4768063
aaata

SEQ ID NO: 73135 - DNA, 8 bp, Unknown
  misc_feature (1)..( 8): Matrix.004 file - promoters50/4768063
caaaacaa

SEQ ID NO: 73136 - DNA, 9 bp, Unknown
  misc_feature (1)..( 9): Matrix.004 file - promoters50/4768066
tatataaat

SEQ ID NO: 73137 - DNA, 6 bp, Unknown
  misc_feature (1)..( 6): Matrix.004 file - promoters50/4768077
gtatat

SEQ ID NO: 73138 - DNA, 7 bp, Unknown
  misc_feature (1)..( 7): Matrix.004 file - promoters50/4768077
catgttt

SEQ ID NO: 73139 - DNA, 8 bp, Unknown
  misc_feature (1)..( 8): Matrix.004 file - promoters50/4768093
tttggaat

SEQ ID NO: 73140 - DNA, 11 bp, Unknown
  misc_feature (1)..( 11): Matrix.004 file - promoters50/4768093
tttttacaacc

SEQ ID NO: 73141 - DNA, 10 bp, Unknown
  misc_feature (1)..( 10): Matrix.004 file - promoters50/4768093
tatattcata

SEQ ID NO: 73142 - DNA, 9 bp, Unknown
  misc_feature (1)..( 9): Matrix.004 file - promoters50/4768093
tatttaatt

SEQ ID NO: 73143 - DNA, 10 bp, Unknown
  misc_feature (1)..( 10): Matrix.004 file - promoters50/4768093
agattttaat

SEQ ID NO: 73144 - DNA, 14 bp, Unknown
  misc_feature (1)..( 14): Matrix.004 file - promoters50/4768093
ttagattttaatat

SEQ ID NO: 73145 - DNA, 7 bp, Unknown
  misc_feature (1)..( 7): Matrix.004 file - promoters50/4768093
ctaatta

SEQ ID NO: 73146 - DNA, 14 bp, Unknown
  misc_feature (1)..( 14): Matrix.004 file - promoters50/4768093
aaaaatatatttaa

SEQ ID NO: 73147 - DNA, 10 bp, Unknown
  misc_feature (1)..( 10): Matrix.004 file - promoters50/4768093
aatcaaattt

SEQ ID NO: 73148 - DNA, 8 bp, Unknown
  misc_feature (1)..( 8): Matrix.004 file - promoters50/4768093
attacata

SEQ ID NO: 73149 - DNA, 10 bp, Unknown
  misc_feature (1)..( 10): Matrix.004 file - promoters50/4768104
tatatacata

SEQ ID NO: 73150 - DNA, 9 bp, Unknown
  misc_feature (1)..( 9): Matrix.004 file - promoters50/4768104
cacgaaaaa

SEQ ID NO: 73151 - DNA, 12 bp, Unknown
  misc_feature (1)..( 12): Matrix.004 file - promoters50/4768104
cccaaaaagatt

SEQ ID NO: 73152 - DNA, 10 bp, Unknown
  misc_feature (1)..( 10): Matrix.004 file - promoters50/4768112
aaacatttaa

SEQ ID NO: 73153 - DNA, 10 bp, Unknown
  misc_feature (1)..( 10): Matrix.004 file - promoters50/4768112
tgtgttttga

SEQ ID NO: 73154 - DNA, 11 bp, Unknown
  misc_feature (1)..( 11): Matrix.004 file - promoters50/4768112
atttataactt

SEQ ID NO: 73155 - DNA, 10 bp, Unknown
  misc_feature (1)..( 10): Matrix.004 file - promoters50/4768143
atatcttcat

SEQ ID NO: 73156 - DNA, 7 bp, Unknown
  misc_feature (1)..( 7): Matrix.004 file - promoters50/4768143
aaagaaa

SEQ ID NO: 73157 - DNA, 10 bp, Unknown
  misc_feature (1)..( 10): Matrix.004 file - promoters50/4768147
atatgacttt

SEQ ID NO: 73158 - DNA, 13 bp, Unknown
  misc_feature (1)..( 13): Matrix.004 file - promoters50/4768147
caataatttttcc

SEQ ID NO: 73159 - DNA, 7 bp, Unknown
  misc_feature (1)..( 7): Matrix.004 file - promoters50/4768147
tattata

SEQ ID NO: 73160 - DNA, 10 bp, Unknown
  misc_feature (1)..( 10): Matrix.004 file - promoters50/4768155
aaaacaataa

SEQ ID NO: 73161 - DNA, 8 bp, Unknown
  misc_feature (1)..( 8): Matrix.004 file - promoters50/4768159
atatataa

SEQ ID NO: 73162 - DNA, 7 bp, Unknown
  misc_feature (1)..( 7): Matrix.004 file - promoters50/4768169
caagggt

SEQ ID NO: 73163 - DNA, 8 bp, Unknown
  misc_feature (1)..( 8): Matrix.004 file - promoters50/4768198
gtttgaaa

SEQ ID NO: 73164 - DNA, 10 bp, Unknown
  misc_feature (1)..( 10): Matrix.004 file - promoters50/4768198
ttaaaattta

SEQ ID NO: 73165 - DNA, 11 bp, Unknown
  misc_feature (1)..( 11): Matrix.004 file - promoters50/4768198
aatcaattgtt

SEQ ID NO: 73166 - DNA, 11 bp, Unknown
  misc_feature (1)..( 11): Matrix.004 file - promoters50/4768198
tatcaaattat

SEQ ID NO: 73167 - DNA, 9 bp, Unknown
  misc_feature (1)..( 9): Matrix.004 file - promoters50/4768209
tgtgtcttc

SEQ ID NO: 73168 - DNA, 8 bp, Unknown
  misc_feature (1)..( 8): Matrix.004 file - promoters50/4768217
gttatttt

SEQ ID NO: 73169 - DNA, 10 bp, Unknown
  misc_feature (1)..( 10): Matrix.004 file - promoters50/4768236
aaagattttg

SEQ ID NO: 73170 - DNA, 9 bp, Unknown
  misc_feature (1)..( 9): Matrix.004 file - promoters50/4768236
tgaaaatat

SEQ ID NO: 73171 - DNA, 13 bp, Unknown
  misc_feature (1)..( 13): Matrix.004 file - promoters50/4768236
ctgaataaaaaaa

SEQ ID NO: 73172 - DNA, 14 bp, Unknown
  misc_feature (1)..( 14): Matrix.004 file - promoters50/4768236
gtacaaaaaaaaat

SEQ ID NO: 73173 - DNA, 9 bp, Unknown
  misc_feature (1)..( 9): Matrix.004 file - promoters50/4768236
aaaaaaatt

SEQ ID NO: 73174 - DNA, 13 bp, Unknown
  misc_feature (1)..( 13): Matrix.004 file - promoters50/4768239
aaaattattttat

SEQ ID NO: 73175 - DNA, 13 bp, Unknown
  misc_feature (1)..( 13): Matrix.004 file - promoters50/4768239
atattacaaaata

SEQ ID NO: 73176 - DNA, 11 bp, Unknown
  misc_feature (1)..( 11): Matrix.004 file - promoters50/4768239
taataattgaa

SEQ ID NO: 73177 - DNA, 10 bp, Unknown
  misc_feature (1)..( 10): Matrix.004 file - promoters50/4768246
ttttaaaact

SEQ ID NO: 73178 - DNA, 9 bp, Unknown
  misc_feature (1)..( 9): Matrix.004 file - promoters50/4768246
tttaagatt

SEQ ID NO: 73179 - DNA, 9 bp, Unknown
  misc_feature (1)..( 9): Matrix.004 file - promoters50/4768246
tatttaaat

SEQ ID NO: 73180 - DNA, 7 bp, Unknown
  misc_feature (1)..( 7): Matrix.004 file - promoters50/4768246
tatatta

SEQ ID NO: 73181 - DNA, 9 bp, Unknown
  misc_feature (1)..( 9): Matrix.004 file - promoters50/4768250
ttttgggtt

SEQ ID NO: 73182 - DNA, 9 bp, Unknown
  misc_feature (1)..( 9): Matrix.004 file - promoters50/4768250
tcttttagt

SEQ ID NO: 73183 - DNA, 11 bp, Unknown
  misc_feature (1)..( 11): Matrix.004 file - promoters50/4768250
gttataaaata

SEQ ID NO: 73184 - DNA, 10 bp, Unknown
  misc_feature (1)..( 10): Matrix.004 file - promoters50/4768250
taaaataata

SEQ ID NO: 73185 - DNA, 14 bp, Unknown
  misc_feature (1)..( 14): Matrix.004 file - promoters50/4768250
caccgacttcatta

SEQ ID NO: 73186 - DNA, 8 bp, Unknown
  misc_feature (1)..( 8): Matrix.004 file - promoters50/4768250
taaaatat

SEQ ID NO: 73187 - DNA, 7 bp, Unknown
  misc_feature (1)..( 7): Matrix.004 file - promoters50/4768253
aaaataa

SEQ ID NO: 73188 - DNA, 11 bp, Unknown
  misc_feature (1)..( 11): Matrix.004 file - promoters50/4768253
aaaaagaaaaa

SEQ ID NO: 73189 - DNA, 9 bp, Unknown
  misc_feature (1)..( 9): Matrix.004 file - promoters50/4768253
aaagaaaaa

SEQ ID NO: 73190 - DNA, 9 bp, Unknown
  misc_feature (1)..( 9): Matrix.004 file - promoters50/4768265
taattgaaa

SEQ ID NO: 73191 - DNA, 5 bp, Unknown
  misc_feature (1)..( 5): Matrix.004 file - promoters50/4768265
cattt

SEQ ID NO: 73192 - DNA, 13 bp, Unknown
  misc_feature (1)..( 13): Matrix.004 file - promoters50/4768265
gtgtattaggatt

SEQ ID NO: 73193 - DNA, 8 bp, Unknown
  misc_feature (1)..( 8): Matrix.004 file - promoters50/4768265
aaaatttg

SEQ ID NO: 73194 - DNA, 12 bp, Unknown
  misc_feature (1)..( 12): Matrix.004 file - promoters50/4768265
atcaagtttgat

SEQ ID NO: 73195 - DNA, 9 bp, Unknown
  misc_feature (1)..( 9): Matrix.004 file - promoters50/4768285
aaaacattg

SEQ ID NO: 73196 - DNA, 9 bp, Unknown
  misc_feature (1)..( 9): Matrix.004 file - promoters50/4768289
ttataaaaa

SEQ ID NO: 73197 - DNA, 9 bp, Unknown
  misc_feature (1)..( 9): Matrix.004 file - promoters50/4768289
gtttattaa

SEQ ID NO: 73198 - DNA, 7 bp, Unknown
  misc_feature (1)..( 7): Matrix.004 file - promoters50/4768293
cgagatt

SEQ ID NO: 73199 - DNA, 8 bp, Unknown
  misc_feature (1)..( 8): Matrix.004 file - promoters50/4768293
cattttca

SEQ ID NO: 73200 - DNA, 10 bp, Unknown
  misc_feature (1)..( 10): Matrix.004 file - promoters50/4768300
attttcacac

SEQ ID NO: 73201 - DNA, 9 bp, Unknown
  misc_feature (1)..( 9): Matrix.004 file - promoters50/4768300
acaagatta

SEQ ID NO: 73202 - DNA, 9 bp, Unknown
  misc_feature (1)..( 9): Matrix.004 file - promoters50/4768319
tttacttaa

SEQ ID NO: 73203 - DNA, 14 bp, Unknown
  misc_feature (1)..( 14): Matrix.004 file - promoters50/4768319
cactttctttgtct

SEQ ID NO: 73204 - DNA, 12 bp, Unknown
  misc_feature (1)..( 12): Matrix.004 file - promoters50/4768319
atagacaattgt

SEQ ID NO: 73205 - DNA, 10 bp, Unknown
  misc_feature (1)..( 10): Matrix.004 file - promoters50/4768319
attaaaaatt

SEQ ID NO: 73206 - DNA, 11 bp, Unknown
  misc_feature (1)..( 11): Matrix.004 file - promoters50/4768319
tttcattttta

SEQ ID NO: 73207 - DNA, 9 bp, Unknown
  misc_feature (1)..( 9): Matrix.004 file - promoters50/4768323
taaacaaat

SEQ ID NO: 73208 - DNA, 7 bp, Unknown
  misc_feature (1)..( 7): Matrix.004 file - promoters50/4768323
ctttttc

SEQ ID NO: 73209 - DNA, 8 bp, Unknown
  misc_feature (1)..( 8): Matrix.004 file - promoters50/4768323
tttcttat

SEQ ID NO: 73210 - DNA, 7 bp, Unknown
  misc_feature (1)..( 7): Matrix.004 file - promoters50/4768323
ttggtca

SEQ ID NO: 73211 - DNA, 7 bp, Unknown
  misc_feature (1)..( 7): Matrix.004 file - promoters50/4768346
ttttctg

SEQ ID NO: 73212 - DNA, 12 bp, Unknown
  misc_feature (1)..( 12): Matrix.004 file - promoters50/4768350
aaaatatctgaa

SEQ ID NO: 73213 - DNA, 9 bp, Unknown
  misc_feature (1)..( 9): Matrix.004 file - promoters50/4768350
gtttttgat

SEQ ID NO: 73214 - DNA, 9 bp, Unknown
  misc_feature (1)..( 9): Matrix.004 file - promoters50/4768350
agtttgtct

SEQ ID NO: 73215 - DNA, 8 bp, Unknown
  misc_feature (1)..( 8): Matrix.004 file - promoters50/4768354
tgagtttt

SEQ ID NO: 73216 - DNA, 8 bp, Unknown
  misc_feature (1)..( 8): Matrix.004 file - promoters50/4768354
aaaatttt

SEQ ID NO: 73217 - DNA, 11 bp, Unknown
  misc_feature (1)..( 11): Matrix.004 file - promoters50/4768354
taacatttttt

SEQ ID NO: 73218 - DNA, 9 bp, Unknown
  misc_feature (1)..( 9): Matrix.004 file - promoters50/4768354
tttaatcaa

SEQ ID NO: 73219 - DNA, 7 bp, Unknown
  misc_feature (1)..( 7): Matrix.004 file - promoters50/4768444
aaatcat

SEQ ID NO: 73220 - DNA, 7 bp, Unknown
  misc_feature (1)..( 7): Matrix.004 file - promoters50/4768444
accttct

SEQ ID NO: 73221 - DNA, 7 bp, Unknown
  misc_feature (1)..( 7): Matrix.004 file - promoters50/4768478
tatctta

SEQ ID NO: 73222 - DNA, 7 bp, Unknown
  misc_feature (1)..( 7): Matrix.004 file - promoters50/4768478
tgagctt

SEQ ID NO: 73223 - DNA, 10 bp, Unknown
  misc_feature (1)..( 10): Matrix.004 file - promoters50/4768499
gaaacaaatt

SEQ ID NO: 73224 - DNA, 7 bp, Unknown
  misc_feature (1)..( 7): Matrix.004 file - promoters50/4768499
atcctct

SEQ ID NO: 73225 - DNA, 11 bp, Unknown
  misc_feature (1)..( 11): Matrix.004 file - promoters50/4768514
aagtttgggtt

SEQ ID NO: 73226 - DNA, 9 bp, Unknown
  misc_feature (1)..( 9): Matrix.004 file - promoters50/4768520
gctttcgtg

SEQ ID NO: 73227 - DNA, 13 bp, Unknown
  misc_feature (1)..( 13): Matrix.004 file - promoters50/4768520
ggtttttattttc

SEQ ID NO: 73228 - DNA, 13 bp, Unknown
  misc_feature (1)..( 13): Matrix.004 file - promoters50/4768528
ggtatttattttc

SEQ ID NO: 73229 - DNA, 9 bp, Unknown
  misc_feature (1)..( 9): Matrix.004 file - promoters50/4768528
aaaatttct

SEQ ID NO: 73230 - DNA, 8 bp, Unknown
  misc_feature (1)..( 8): Matrix.004 file - promoters50/4768528
tgtgaaac

SEQ ID NO: 73231 - DNA, 9 bp, Unknown
  misc_feature (1)..( 9): Matrix.004 file - promoters50/4768528
aaaatttct

SEQ ID NO: 73232 - DNA, 9 bp, Unknown
  misc_feature (1)..( 9): Matrix.004 file - promoters50/4768532
tttcaaaat

SEQ ID NO: 73233 - DNA, 13 bp, Unknown
  misc_feature (1)..( 13): Matrix.004 file - promoters50/4768539
cctaatagataaa

SEQ ID NO: 73234 - DNA, 6 bp, Unknown
  misc_feature (1)..( 6): Matrix.004 file - promoters50/4768539
tgttat

SEQ ID NO: 73235 - DNA, 7 bp, Unknown
  misc_feature (1)..( 7): Matrix.004 file - promoters50/4768539
aaataac

SEQ ID NO: 73236 - DNA, 9 bp, Unknown
  misc_feature (1)..( 9): Matrix.004 file - promoters50/4768539
ggacacaaa

SEQ ID NO: 73237 - DNA, 6 bp, Unknown
  misc_feature (1)..( 6): Matrix.004 file - promoters50/4768539
aaaaca

SEQ ID NO: 73238 - DNA, 22 bp, Unknown
  misc_feature (1)..( 22): Matrix.004 file - promoters50/4768539
gataaaaatcaaacttcaccta

SEQ ID NO: 73239 - DNA, 8 bp, Unknown
  misc_feature (1)..( 8): Matrix.004 file - promoters50/4768539
tttatcac

SEQ ID NO: 73240 - DNA, 9 bp, Unknown
  misc_feature (1)..( 9): Matrix.004 file - promoters50/4768547
aattgtttt

SEQ ID NO: 73241 - DNA, 11 bp, Unknown
  misc_feature (1)..( 11): Matrix.004 file - promoters50/4768547
acttaaatata

SEQ ID NO: 73242 - DNA, 9 bp, Unknown
  misc_feature (1)..( 9): Matrix.004 file - promoters50/4768547
acttttata

SEQ ID NO: 73243 - DNA, 8 bp, Unknown
  misc_feature (1)..( 8): Matrix.004 file - promoters50/4768558
atttggtg

SEQ ID NO: 73244 - DNA, 7 bp, Unknown
  misc_feature (1)..( 7): Matrix.004 file - promoters50/4768558
ttaaaat

SEQ ID NO: 73245 - DNA, 7 bp, Unknown
  misc_feature (1)..( 7): Matrix.004 file - promoters50/4768558
aaaatta

SEQ ID NO: 73246 - DNA, 10 bp, Unknown
  misc_feature (1)..( 10): Matrix.004 file - promoters50/4768558
aaataattaa

SEQ ID NO: 73247 - DNA, 8 bp, Unknown
  misc_feature (1)..( 8): Matrix.004 file - promoters50/4768558
aaatataa

SEQ ID NO: 73248 - DNA, 11 bp, Unknown
  misc_feature (1)..( 11): Matrix.004 file - promoters50/4768568
aaacaaaaatt

SEQ ID NO: 73249 - DNA, 11 bp, Unknown
  misc_feature (1)..( 11): Matrix.004 file - promoters50/4768568
gaggattaatt

SEQ ID NO: 73250 - DNA, 6 bp, Unknown
  misc_feature (1)..( 6): Matrix.004 file - promoters50/4768568
cttttc

SEQ ID NO: 73251 - DNA, 9 bp, Unknown
  misc_feature (1)..( 9): Matrix.004 file - promoters50/4768599
aataaaaaa

SEQ ID NO: 73252 - DNA, 13 bp, Unknown
  misc_feature (1)..( 13): Matrix.004 file - promoters50/4768599
aattaataatttg

SEQ ID NO: 73253 - DNA, 13 bp, Unknown
  misc_feature (1)..( 13): Matrix.004 file - promoters50/4768599
aaatttgattata

SEQ ID NO: 73254 - DNA, 11 bp, Unknown
  misc_feature (1)..( 11): Matrix.004 file - promoters50/4768599
tttgaatttta

SEQ ID NO: 73255 - DNA, 6 bp, Unknown
  misc_feature (1)..( 6): Matrix.004 file - promoters50/4768599
aatatt

SEQ ID NO: 73256 - DNA, 6 bp, Unknown
  misc_feature (1)..( 6): Matrix.004 file - promoters50/4768599
tttaat

SEQ ID NO: 73257 - DNA, 12 bp, Unknown
  misc_feature (1)..( 12): Matrix.004 file - promoters50/4768615
tttgatttccat

SEQ ID NO: 73258 - DNA, 10 bp, Unknown
  misc_feature (1)..( 10): Matrix.004 file - promoters50/4768615
tttacaaaaa

SEQ ID NO: 73259 - DNA, 12 bp, Unknown
  misc_feature (1)..( 12): Matrix.004 file - promoters50/4768615
caaaaaaaatta

SEQ ID NO: 73260 - DNA, 14 bp, Unknown
  misc_feature (1)..( 14): Matrix.004 file - promoters50/4768615
aaaattaatatata

SEQ ID NO: 73261 - DNA, 10 bp, Unknown
  misc_feature (1)..( 10): Matrix.004 file - promoters50/4768615
agtaaaacaa

SEQ ID NO: 73262 - DNA, 9 bp, Unknown
  misc_feature (1)..( 9): Matrix.004 file - promoters50/4768615
acaaaaaca

SEQ ID NO: 73263 - DNA, 11 bp, Unknown
  misc_feature (1)..( 11): Matrix.004 file - promoters50/4768615
gattaacaaaa

SEQ ID NO: 73264 - DNA, 14 bp, Unknown
  misc_feature (1)..( 14): Matrix.004 file - promoters50/4768615
aacaacaaaaataa

SEQ ID NO: 73265 - DNA, 14 bp, Unknown
  misc_feature (1)..( 14): Matrix.004 file - promoters50/4768615
aacaagaaaacaat

SEQ ID NO: 73266 - DNA, 8 bp, Unknown
  misc_feature (1)..( 8): Matrix.004 file - promoters50/4768615
tataaaca

SEQ ID NO: 73267 - DNA, 12 bp, Unknown
  misc_feature (1)..( 12): Matrix.004 file - promoters50/4768615
tagttattataa

SEQ ID NO: 73268 - DNA, 10 bp, Unknown
  misc_feature (1)..( 10): Matrix.004 file - promoters50/4768615
cctatatata

SEQ ID NO: 73269 - DNA, 11 bp, Unknown
  misc_feature (1)..( 11): Matrix.004 file - promoters50/4768615
aacaacaaaaa

SEQ ID NO: 73270 - DNA, 8 bp, Unknown
  misc_feature (1)..( 8): Matrix.004 file - promoters50/4768615
aaaaaatt

SEQ ID NO: 73271 - DNA, 11 bp, Unknown
  misc_feature (1)..( 11): Matrix.004 file - promoters50/4768615
aatactaaata

SEQ ID NO: 73272 - DNA, 9 bp, Unknown
  misc_feature (1)..( 9): Matrix.004 file - promoters50/4768623
taagttaaa

SEQ ID NO: 73273 - DNA, 7 bp, Unknown
  misc_feature (1)..( 7): Matrix.004 file - promoters50/4768623
cttaata

SEQ ID NO: 73274 - DNA, 8 bp, Unknown
  misc_feature (1)..( 8): Matrix.004 file - promoters50/4768631
attattga

SEQ ID NO: 73275 - DNA, 11 bp, Unknown
  misc_feature (1)..( 11): Matrix.004 file - promoters50/4768635
tgataatctca

SEQ ID NO: 73276 - DNA, 11 bp, Unknown
  misc_feature (1)..( 11): Matrix.004 file - promoters50/4768635
tttaatgatta

SEQ ID NO: 73277 - DNA, 10 bp, Unknown
  misc_feature (1)..( 10): Matrix.004 file - promoters50/4768635
tttgatgatt

SEQ ID NO: 73278 - DNA, 10 bp, Unknown
  misc_feature (1)..( 10): Matrix.004 file - promoters50/4768635
tttgttactt

SEQ ID NO: 73279 - DNA, 7 bp, Unknown
  misc_feature (1)..( 7): Matrix.004 file - promoters50/4768635
attttta

SEQ ID NO: 73280 - DNA, 9 bp, Unknown
  misc_feature (1)..( 9): Matrix.004 file - promoters50/4768663
atcaaaatt

SEQ ID NO: 73281 - DNA, 9 bp, Unknown
  misc_feature (1)..( 9): Matrix.004 file - promoters50/4768663
aaattacaa

SEQ ID NO: 73282 - DNA, 14 bp, Unknown
  misc_feature (1)..( 14): Matrix.004 file - promoters50/4768678
atcaaagatttaaa

SEQ ID NO: 73283 - DNA, 7 bp, Unknown
  misc_feature (1)..( 7): Matrix.004 file - promoters50/4768698
caaattc

SEQ ID NO: 73284 - DNA, 15 bp, Unknown
  misc_feature (1)..( 15): Matrix.004 file - promoters50/4768698
ataactttataataa

SEQ ID NO: 73285 - DNA, 15 bp, Unknown
  misc_feature (1)..( 15): Matrix.004 file - promoters50/4768698
attgtgaaataattt

SEQ ID NO: 73286 - DNA, 11 bp, Unknown
  misc_feature (1)..( 11): Matrix.004 file - promoters50/4768698
attaataagtt

SEQ ID NO: 73287 - DNA, 12 bp, Unknown
  misc_feature (1)..( 12): Matrix.004 file - promoters50/4768698
ggccgaaaattt

SEQ ID NO: 73288 - DNA, 10 bp, Unknown
  misc_feature (1)..( 10): Matrix.004 file - promoters50/4768698
gtatataaat

SEQ ID NO: 73289 - DNA, 10 bp, Unknown
  misc_feature (1)..( 10): Matrix.004 file - promoters50/4768698
tttttgatga

SEQ ID NO: 73290 - DNA, 15 bp, Unknown
  misc_feature (1)..( 15): Matrix.004 file - promoters50/4768708
tgttaaatatgaaaa

SEQ ID NO: 73291 - DNA, 10 bp, Unknown
  misc_feature (1)..( 10): Matrix.004 file - promoters50/4768708
taagttgttt

SEQ ID NO: 73292 - DNA, 8 bp, Unknown
  misc_feature (1)..( 8): Matrix.004 file - promoters50/4768708
tttaagat

SEQ ID NO: 73293 - DNA, 10 bp, Unknown
  misc_feature (1)..( 10): Matrix.004 file - promoters50/4768708
gaagaaaaac

SEQ ID NO: 73294 - DNA, 6 bp, Unknown
  misc_feature (1)..( 6): Matrix.004 file - promoters50/4768708
tttttt

SEQ ID NO: 73295 - DNA, 8 bp, Unknown
  misc_feature (1)..( 8): Matrix.004 file - promoters50/4768754
aaagtaaa

SEQ ID NO: 73296 - DNA, 8 bp, Unknown
  misc_feature (1)..( 8): Matrix.004 file - promoters50/4768754
aaaacaat

SEQ ID NO: 73297 - DNA, 10 bp, Unknown
  misc_feature (1)..( 10): Matrix.004 file - promoters50/4768762
tatgttctgt

SEQ ID NO: 73298 - DNA, 10 bp, Unknown
  misc_feature (1)..( 10): Matrix.004 file - promoters50/4768762
tcattctcat

SEQ ID NO: 73299 - DNA, 9 bp, Unknown
  misc_feature (1)..( 9): Matrix.004 file - promoters50/4768778
ttaaattga

SEQ ID NO: 73300 - DNA, 11 bp, Unknown
  misc_feature (1)..( 11): Matrix.004 file - promoters50/4768782
aaaaaatttat

SEQ ID NO: 73301 - DNA, 12 bp, Unknown
  misc_feature (1)..( 12): Matrix.004 file - promoters50/4768782
attattcttaat

SEQ ID NO: 73302 - DNA, 9 bp, Unknown
  misc_feature (1)..( 9): Matrix.004 file - promoters50/4768782
tattgatta

SEQ ID NO: 73303 - DNA, 12 bp, Unknown
  misc_feature (1)..( 12): Matrix.004 file - promoters50/4768782
ctgatctcttct

SEQ ID NO: 73304 - DNA, 11 bp, Unknown
  misc_feature (1)..( 11): Matrix.004 file - promoters50/4768782
tatgacaacat

SEQ ID NO: 73305 - DNA, 9 bp, Unknown
  misc_feature (1)..( 9): Matrix.004 file - promoters50/4768804
cttcttata

SEQ ID NO: 73306 - DNA, 7 bp, Unknown
  misc_feature (1)..( 7): Matrix.004 file - promoters50/4768804
ctaacaa

SEQ ID NO: 73307 - DNA, 7 bp, Unknown
  misc_feature (1)..( 7): Matrix.004 file - promoters50/4768811
aattata

SEQ ID NO: 73308 - DNA, 7 bp, Unknown
  misc_feature (1)..( 7): Matrix.004 file - promoters50/4768829
atatata

SEQ ID NO: 73309 - DNA, 6 bp, Unknown
  misc_feature (1)..( 6): Matrix.004 file - promoters50/4768829
ttattt

SEQ ID NO: 73310 - DNA, 11 bp, Unknown
  misc_feature (1)..( 11): Matrix.004 file - promoters50/4768829
tatagtattaa

SEQ ID NO: 73311 - DNA, 13 bp, Unknown
  misc_feature (1)..( 13): Matrix.004 file - promoters50/4768829
aaataaattttta

SEQ ID NO: 73312 - DNA, 5 bp, Unknown
  misc_feature (1)..( 5): Matrix.004 file - promoters50/4768829
taata

SEQ ID NO: 73313 - DNA, 11 bp, Unknown
  misc_feature (1)..( 11): Matrix.004 file - promoters50/4768833
aatgtattatt

SEQ ID NO: 73314 - DNA, 9 bp, Unknown
  misc_feature (1)..( 9): Matrix.004 file - promoters50/4768833
gcaacaaat

SEQ ID NO: 73315 - DNA, 11 bp, Unknown
  misc_feature (1)..( 11): Matrix.004 file - promoters50/4768833
aaaaaaccaaa

SEQ ID NO: 73316 - DNA, 7 bp, Unknown
  misc_feature (1)..( 7): Matrix.004 file - promoters50/4768848
aaaaaat

SEQ ID NO: 73317 - DNA, 8 bp, Unknown
  misc_feature (1)..( 8): Matrix.004 file - promoters50/4768848
cattaaaa

SEQ ID NO: 73318 - DNA, 9 bp, Unknown
  misc_feature (1)..( 9): Matrix.004 file - promoters50/4768852
tggaaaata

SEQ ID NO: 73319 - DNA, 9 bp, Unknown
  misc_feature (1)..( 9): Matrix.004 file - promoters50/4768852
aaacaaaaa

SEQ ID NO: 73320 - DNA, 7 bp, Unknown
  misc_feature (1)..( 7): Matrix.004 file - promoters50/4768852
gtttaaa

SEQ ID NO: 73321 - DNA, 12 bp, Unknown
  misc_feature (1)..( 12): Matrix.004 file - promoters50/4768852
aaaatttatgca

SEQ ID NO: 73322 - DNA, 14 bp, Unknown
  misc_feature (1)..( 14): Matrix.004 file - promoters50/4768852
acaatttataacca

SEQ ID NO: 73323 - DNA, 10 bp, Unknown
  misc_feature (1)..( 10): Matrix.004 file - promoters50/4768856
actctataaa

SEQ ID NO: 73324 - DNA, 7 bp, Unknown
  misc_feature (1)..( 7): Matrix.004 file - promoters50/4768856
cataaat

SEQ ID NO: 73325 - DNA, 11 bp, Unknown
  misc_feature (1)..( 11): Matrix.004 file - promoters50/4768860
aagtaaaaaaa

SEQ ID NO: 73326 - DNA, 8 bp, Unknown
  misc_feature (1)..( 8): Matrix.004 file - promoters50/4768864
acattgaa

SEQ ID NO: 73327 - DNA, 8 bp, Unknown
  misc_feature (1)..( 8): Matrix.004 file - promoters50/4768864
aaggagaa

SEQ ID NO: 73328 - DNA, 8 bp, Unknown
  misc_feature (1)..( 8): Matrix.004 file - promoters50/4768864
ttaatttg

SEQ ID NO: 73329 - DNA, 16 bp, Unknown
  misc_feature (1)..( 16): Matrix.004 file - promoters50/4768864
aaaagaaaaaaacaaa

SEQ ID NO: 73330 - DNA, 15 bp, Unknown
  misc_feature (1)..( 15): Matrix.004 file - promoters50/4768864
aaataaaaatcacaa

SEQ ID NO: 73331 - DNA, 10 bp, Unknown
  misc_feature (1)..( 10): Matrix.004 file - promoters50/4768864
tgacgatgat

SEQ ID NO: 73332 - DNA, 7 bp, Unknown
  misc_feature (1)..( 7): Matrix.004 file - promoters50/4768864
ttaaaaa

SEQ ID NO: 73333 - DNA, 13 bp, Unknown
  misc_feature (1)..( 13): Matrix.004 file - promoters50/4768864
aaaaaaagaaaaa

SEQ ID NO: 73334 - DNA, 9 bp, Unknown
  misc_feature (1)..( 9): Matrix.004 file - promoters50/4768864
ttgaattct

SEQ ID NO: 73335 - DNA, 13 bp, Unknown
  misc_feature (1)..( 13): Matrix.004 file - promoters50/4768880
caagaaaaaaaca

SEQ ID NO: 73336 - DNA, 7 bp, Unknown
  misc_feature (1)..( 7): Matrix.004 file - promoters50/4768928
cttctct

SEQ ID NO: 73337 - DNA, 8 bp, Unknown
  misc_feature (1)..( 8): Matrix.004 file - promoters50/4769032
aaagaaaa

SEQ ID NO: 73338 - DNA, 7 bp, Unknown
  misc_feature (1)..( 7): Matrix.004 file - promoters50/4769032
tgagagg

SEQ ID NO: 73339 - DNA, 10 bp, Unknown
  misc_feature (1)..( 10): Matrix.004 file - promoters50/4769032
acacctaatt

SEQ ID NO: 73340 - DNA, 13 bp, Unknown
  misc_feature (1)..( 13): Matrix.004 file - promoters50/4769032
aacaaaaaaaaga

SEQ ID NO: 73341 - DNA, 9 bp, Unknown
  misc_feature (1)..( 9): Matrix.004 file - promoters50/4769032
agtcaaaaa

SEQ ID NO: 73342 - DNA, 7 bp, Unknown
  misc_feature (1)..( 7): Matrix.004 file - promoters50/4769048
tgagaga

SEQ ID NO: 73343 - DNA, 8 bp, Unknown
  misc_feature (1)..( 8): Matrix.004 file - promoters50/4769048
aaatttgg

SEQ ID NO: 73344 - DNA, 7 bp, Unknown
  misc_feature (1)..( 7): Matrix.004 file - promoters50/4769055
aatttgg

SEQ ID NO: 73345 - DNA, 6 bp, Unknown
  misc_feature (1)..( 6): Matrix.004 file - promoters50/4769055
aaaatt

SEQ ID NO: 73346 - DNA, 14 bp, Unknown
  misc_feature (1)..( 14): Matrix.004 file - promoters50/4769055
tttaaaattattca

SEQ ID NO: 73347 - DNA, 13 bp, Unknown
  misc_feature (1)..( 13): Matrix.004 file - promoters50/4769059
aagaaaaaacaaa

SEQ ID NO: 73348 - DNA, 12 bp, Unknown
  misc_feature (1)..( 12): Matrix.004 file - promoters50/4769075
ctagatcgttac

SEQ ID NO: 73349 - DNA, 9 bp, Unknown
  misc_feature (1)..( 9): Matrix.004 file - promoters50/4769075
ttttgattt

SEQ ID NO: 73350 - DNA, 11 bp, Unknown
  misc_feature (1)..( 11): Matrix.004 file - promoters50/4769083
acactatactg

SEQ ID NO: 73351 - DNA, 9 bp, Unknown
  misc_feature (1)..( 9): Matrix.004 file - promoters50/4769083
ttaatttat

SEQ ID NO: 73352 - DNA, 7 bp, Unknown
  misc_feature (1)..( 7): Matrix.004 file - promoters50/4769083
aatttat

SEQ ID NO: 73353 - DNA, 7 bp, Unknown
  misc_feature (1)..( 7): Matrix.004 file - promoters50/4769083
taaaata

SEQ ID NO: 73354 - DNA, 9 bp, Unknown
  misc_feature (1)..( 9): Matrix.004 file - promoters50/4769083
taaagaaaa

SEQ ID NO: 73355 - DNA, 8 bp, Unknown
  misc_feature (1)..( 8): Matrix.004 file - promoters50/4769083
aaaataaa

SEQ ID NO: 73356 - DNA, 8 bp, Unknown
  misc_feature (1)..( 8): Matrix.004 file - promoters50/4769087
ctaaaaat

SEQ ID NO: 73357 - DNA, 7 bp, Unknown
  misc_feature (1)..( 7): Matrix.004 file - promoters50/4769087
agaaaat

SEQ ID NO: 73358 - DNA, 7 bp, Unknown
  misc_feature (1)..( 7): Matrix.004 file - promoters50/4769087
tccaaaa

SEQ ID NO: 73359 - DNA, 8 bp, Unknown
  misc_feature (1)..( 8): Matrix.004 file - promoters50/4769087
aaaatttc

SEQ ID NO: 73360 - DNA, 8 bp, Unknown
  misc_feature (1)..( 8): Matrix.004 file - promoters50/4769096
ttttgaac

SEQ ID NO: 73361 - DNA, 9 bp, Unknown
  misc_feature (1)..( 9): Matrix.004 file - promoters50/4769107
tctttcagt

SEQ ID NO: 73362 - DNA, 7 bp, Unknown
  misc_feature (1)..( 7): Matrix.004 file - promoters50/4769107
aaaaaca

SEQ ID NO: 73363 - DNA, 8 bp, Unknown
  misc_feature (1)..( 8): Matrix.004 file - promoters50/4769107
caattaac

SEQ ID NO: 73364 - DNA, 9 bp, Unknown
  misc_feature (1)..( 9): Matrix.004 file - promoters50/4769107
ttctttttt

SEQ ID NO: 73365 - DNA, 11 bp, Unknown
  misc_feature (1)..( 11): Matrix.004 file - promoters50/4769107
ctttttatatt

SEQ ID NO: 73366 - DNA, 9 bp, Unknown
  misc_feature (1)..( 9): Matrix.004 file - promoters50/4769107
ttttaaaaa

SEQ ID NO: 73367 - DNA, 9 bp, Unknown
  misc_feature (1)..( 9): Matrix.004 file - promoters50/4769107
tttattttc

SEQ ID NO: 73368 - DNA, 8 bp, Unknown
  misc_feature (1)..( 8): Matrix.004 file - promoters50/4769107
gaaaatga

SEQ ID NO: 73369 - DNA, 8 bp, Unknown
  misc_feature (1)..( 8): Matrix.004 file - promoters50/4769107
aaatcaat

SEQ ID NO: 73370 - DNA, 9 bp, Unknown
  misc_feature (1)..( 9): Matrix.004 file - promoters50/4769107
ttttttata

SEQ ID NO: 73371 - DNA, 7 bp, Unknown
  misc_feature (1)..( 7): Matrix.004 file - promoters50/4769127
acaaaat

SEQ ID NO: 73372 - DNA, 9 bp, Unknown
  misc_feature (1)..( 9): Matrix.004 file - promoters50/4769127
aaagttttc

SEQ ID NO: 73373 - DNA, 7 bp, Unknown
  misc_feature (1)..( 7): Matrix.004 file - promoters50/4769127
atggaat

SEQ ID NO: 73374 - DNA, 10 bp, Unknown
  misc_feature (1)..( 10): Matrix.004 file - promoters50/4769127
gtcaaaaaaa

SEQ ID NO: 73375 - DNA, 9 bp, Unknown
  misc_feature (1)..( 9): Matrix.004 file - promoters50/4769137
attaaaaaa

SEQ ID NO: 73376 - DNA, 12 bp, Unknown
  misc_feature (1)..( 12): Matrix.004 file - promoters50/4769137
tttactttgtct

SEQ ID NO: 73377 - DNA, 10 bp, Unknown
  misc_feature (1)..( 10): Matrix.004 file - promoters50/4769141
cttcacatgc

SEQ ID NO: 73378 - DNA, 8 bp, Unknown
  misc_feature (1)..( 8): Matrix.004 file - promoters50/4769141
cctatata

SEQ ID NO: 73379 - DNA, 8 bp, Unknown
  misc_feature (1)..( 8): Matrix.004 file - promoters50/4769141
caaaaata

SEQ ID NO: 73380 - DNA, 10 bp, Unknown
  misc_feature (1)..( 10): Matrix.004 file - promoters50/4769141
tttataaaac

SEQ ID NO: 73381 - DNA, 9 bp, Unknown
  misc_feature (1)..( 9): Matrix.004 file - promoters50/4769145
tttctttta

SEQ ID NO: 73382 - DNA, 7 bp, Unknown
  misc_feature (1)..( 7): Matrix.004 file - promoters50/4769149
ttttaac

SEQ ID NO: 73383 - DNA, 12 bp, Unknown
  misc_feature (1)..( 12): Matrix.004 file - promoters50/4769149
aaacataaataa

SEQ ID NO: 73384 - DNA, 8 bp, Unknown
  misc_feature (1)..( 8): Matrix.004 file - promoters50/4769149
tatcattt

SEQ ID NO: 73385 - DNA, 10 bp, Unknown
  misc_feature (1)..( 10): Matrix.004 file - promoters50/4769149
tttcttttct

SEQ ID NO: 73386 - DNA, 8 bp, Unknown
  misc_feature (1)..( 8): Matrix.004 file - promoters50/4769149
tcttattt

SEQ ID NO: 73387 - DNA, 9 bp, Unknown
  misc_feature (1)..( 9): Matrix.004 file - promoters50/4769149
aaaataaaa

SEQ ID NO: 73388 - DNA, 9 bp, Unknown
  misc_feature (1)..( 9): Matrix.004 file - promoters50/4769149
ttttgttga

SEQ ID NO: 73389 - DNA, 6 bp, Unknown
  misc_feature (1)..( 6): Matrix.004 file - promoters50/4769149
aaagaa

SEQ ID NO: 73390 - DNA, 9 bp, Unknown
  misc_feature (1)..( 9): Matrix.004 file - promoters50/4769149
ataatttaa

SEQ ID NO: 73391 - DNA, 8 bp, Unknown
  misc_feature (1)..( 8): Matrix.004 file - promoters50/4769153
caatgatt

SEQ ID NO: 73392 - DNA, 11 bp, Unknown
  misc_feature (1)..( 11): Matrix.004 file - promoters50/4769153
aaaataaaatt

SEQ ID NO: 73393 - DNA, 8 bp, Unknown
  misc_feature (1)..( 8): Matrix.004 file - promoters50/4769153
aaaatata

SEQ ID NO: 73394 - DNA, 9 bp, Unknown
  misc_feature (1)..( 9): Matrix.004 file - promoters50/4769153
aaataaata

SEQ ID NO: 73395 - DNA, 9 bp, Unknown
  misc_feature (1)..( 9): Matrix.004 file - promoters50/4769169
caaaaatat

SEQ ID NO: 73396 - DNA, 14 bp, Unknown
  misc_feature (1)..( 14): Matrix.004 file - promoters50/4769169
ctaataacaaaaac

SEQ ID NO: 73397 - DNA, 8 bp, Unknown
  misc_feature (1)..( 8): Matrix.004 file - promoters50/4769169
aaaaaaca

SEQ ID NO: 73398 - DNA, 11 bp, Unknown
  misc_feature (1)..( 11): Matrix.004 file - promoters50/4769177
aaaaatttaaa

SEQ ID NO: 73399 - DNA, 9 bp, Unknown
  misc_feature (1)..( 9): Matrix.004 file - promoters50/4769177
atatgttca

SEQ ID NO: 73400 - DNA, 9 bp, Unknown
  misc_feature (1)..( 9): Matrix.004 file - promoters50/4769180
caatatttt

SEQ ID NO: 73401 - DNA, 13 bp, Unknown
  misc_feature (1)..( 13): Matrix.004 file - promoters50/4769180
aaaaaatattaaa

SEQ ID NO: 73402 - DNA, 10 bp, Unknown
  misc_feature (1)..( 10): Matrix.004 file - promoters50/4769180
taaattaatc

SEQ ID NO: 73403 - DNA, 12 bp, Unknown
  misc_feature (1)..( 12): Matrix.004 file - promoters50/4769184
taaataaccaat

SEQ ID NO: 73404 - DNA, 10 bp, Unknown
  misc_feature (1)..( 10): Matrix.004 file - promoters50/4769186
ttaaaaattc

SEQ ID NO: 73405 - DNA, 10 bp, Unknown
  misc_feature (1)..( 10): Matrix.004 file - promoters50/4769186
cgaaaagaaa

SEQ ID NO: 73406 - DNA, 7 bp, Unknown
  misc_feature (1)..( 7): Matrix.004 file - promoters50/4769186
aaaatat

SEQ ID NO: 73407 - DNA, 10 bp, Unknown
  misc_feature (1)..( 10): Matrix.004 file - promoters50/4769186
atgtagaaaa

SEQ ID NO: 73408 - DNA, 8 bp, Unknown
  misc_feature (1)..( 8): Matrix.004 file - promoters50/4769201
ggttttgt

SEQ ID NO: 73409 - DNA, 13 bp, Unknown
  misc_feature (1)..( 13): Matrix.004 file - promoters50/4769209
aacaaattattaa

SEQ ID NO: 73410 - DNA, 17 bp, Unknown
  misc_feature (1)..( 17): Matrix.004 file - promoters50/4769217
tatttccttctcaattt

SEQ ID NO: 73411 - DNA, 5 bp, Unknown
  misc_feature (1)..( 5): Matrix.004 file - promoters50/4769217
tttct

SEQ ID NO: 73412 - DNA, 8 bp, Unknown
  misc_feature (1)..( 8): Matrix.004 file - promoters50/4769217
atttatgt

SEQ ID NO: 73413 - DNA, 7 bp, Unknown
  misc_feature (1)..( 7): Matrix.004 file - promoters50/4769217
gttaata

SEQ ID NO: 73414 - DNA, 12 bp, Unknown
  misc_feature (1)..( 12): Matrix.004 file - promoters50/4769217
tctgtcatttta

SEQ ID NO: 73415 - DNA, 9 bp, Unknown
  misc_feature (1)..( 9): Matrix.004 file - promoters50/4769217
ataatttaa

SEQ ID NO: 73416 - DNA, 8 bp, Unknown
  misc_feature (1)..( 8): Matrix.004 file - promoters50/4769217
aatttaaa

SEQ ID NO: 73417 - DNA, 9 bp, Unknown
  misc_feature (1)..( 9): Matrix.004 file - promoters50/4769221
atactaaaa

SEQ ID NO: 73418 - DNA, 9 bp, Unknown
  misc_feature (1)..( 9): Matrix.004 file - promoters50/4769257
taaaaatta

SEQ ID NO: 73419 - DNA, 6 bp, Unknown
  misc_feature (1)..( 6): Matrix.004 file - promoters50/4769257
ttaaac

SEQ ID NO: 73420 - DNA, 10 bp, Unknown
  misc_feature (1)..( 10): Matrix.004 file - promoters50/4769257
ttttattaat

SEQ ID NO: 73421 - DNA, 8 bp, Unknown
  misc_feature (1)..( 8): Matrix.004 file - promoters50/4769257
caaaaaaa

SEQ ID NO: 73422 - DNA, 9 bp, Unknown
  misc_feature (1)..( 9): Matrix.004 file - promoters50/4769257
ttaaaattt

SEQ ID NO: 73423 - DNA, 8 bp, Unknown
  misc_feature (1)..( 8): Matrix.004 file - promoters50/4769260
aatacaaa

SEQ ID NO: 73424 - DNA, 11 bp, Unknown
  misc_feature (1)..( 11): Matrix.004 file - promoters50/4769260
atgattttttt

SEQ ID NO: 73425 - DNA, 9 bp, Unknown
  misc_feature (1)..( 9): Matrix.004 file - promoters50/4769276
ataaaaacc

SEQ ID NO: 73426 - DNA, 7 bp, Unknown
  misc_feature (1)..( 7): Matrix.004 file - promoters50/4769296
gaacatt

SEQ ID NO: 73427 - DNA, 8 bp, Unknown
  misc_feature (1)..( 8): Matrix.004 file - promoters50/4769296
acttcatc

SEQ ID NO: 73428 - DNA, 10 bp, Unknown
  misc_feature (1)..( 10): Matrix.004 file - promoters50/4769296
aaaagaaaca

SEQ ID NO: 73429 - DNA, 8 bp, Unknown
  misc_feature (1)..( 8): Matrix.004 file - promoters50/4769301
ctctatat

SEQ ID NO: 73430 - DNA, 15 bp, Unknown
  misc_feature (1)..( 15): Matrix.004 file - promoters50/4769301
agacatacaattttt

SEQ ID NO: 73431 - DNA, 8 bp, Unknown
  misc_feature (1)..( 8): Matrix.004 file - promoters50/4769301
atttttgg

SEQ ID NO: 73432 - DNA, 10 bp, Unknown
  misc_feature (1)..( 10): Matrix.004 file - promoters50/4769308
tttcaaaaaa

SEQ ID NO: 73433 - DNA, 9 bp, Unknown
  misc_feature (1)..( 9): Matrix.004 file - promoters50/4769312
atgtttgga

SEQ ID NO: 73434 - DNA, 11 bp, Unknown
  misc_feature (1)..( 11): Matrix.004 file - promoters50/4769312
tctatataaac

SEQ ID NO: 73435 - DNA, 11 bp, Unknown
  misc_feature (1)..( 11): Matrix.004 file - promoters50/4769312
caaataaaaaa

SEQ ID NO: 73436 - DNA, 10 bp, Unknown
  misc_feature (1)..( 10): Matrix.004 file - promoters50/4769320
caaatagaaa

SEQ ID NO: 73437 - DNA, 14 bp, Unknown
  misc_feature (1)..( 14): Matrix.004 file - promoters50/4769320
atttaatagtcatt

SEQ ID NO: 73438 - DNA, 8 bp, Unknown
  misc_feature (1)..( 8): Matrix.004 file - promoters50/4769320
aattttgg

SEQ ID NO: 73439 - DNA, 9 bp, Unknown
  misc_feature (1)..( 9): Matrix.004 file - promoters50/4769320
tatatttgt

SEQ ID NO: 73440 - DNA, 8 bp, Unknown
  misc_feature (1)..( 8): Matrix.004 file - promoters50/4769320
attacaca

SEQ ID NO: 73441 - DNA, 8 bp, Unknown
  misc_feature (1)..( 8): Matrix.004 file - promoters50/4769328
tatttttt

SEQ ID NO: 73442 - DNA, 12 bp, Unknown
  misc_feature (1)..( 12): Matrix.004 file - promoters50/4769328
taacaaatttgt

SEQ ID NO: 73443 - DNA, 12 bp, Unknown
  misc_feature (1)..( 12): Matrix.004 file - promoters50/4769366
tataaattttca

SEQ ID NO: 73444 - DNA, 12 bp, Unknown
  misc_feature (1)..( 12): Matrix.004 file - promoters50/4769366
actaaaaatttt

SEQ ID NO: 73445 - DNA, 9 bp, Unknown
  misc_feature (1)..( 9): Matrix.004 file - promoters50/4769366
acaactaag

SEQ ID NO: 73446 - DNA, 13 bp, Unknown
  misc_feature (1)..( 13): Matrix.004 file - promoters50/4769384
ttcttattaaaac

SEQ ID NO: 73447 - DNA, 9 bp, Unknown
  misc_feature (1)..( 9): Matrix.004 file - promoters50/4769407
gtatatata

SEQ ID NO: 73448 - DNA, 9 bp, Unknown
  misc_feature (1)..( 9): Matrix.004 file - promoters50/4769411
atattttca

SEQ ID NO: 73449 - DNA, 11 bp, Unknown
  misc_feature (1)..( 11): Matrix.004 file - promoters50/4769411
ataaaattgat

SEQ ID NO: 73450 - DNA, 7 bp, Unknown
  misc_feature (1)..( 7): Matrix.004 file - promoters50/4769413
tattaaa

SEQ ID NO: 73451 - DNA, 7 bp, Unknown
  misc_feature (1)..( 7): Matrix.004 file - promoters50/4769420
tttgttt

SEQ ID NO: 73452 - DNA, 12 bp, Unknown
  misc_feature (1)..( 12): Matrix.004 file - promoters50/4769741
aaaaagtatttt

SEQ ID NO: 73453 - DNA, 9 bp, Unknown
  misc_feature (1)..( 9): Matrix.004 file - promoters50/4769741
aaaaataaa

SEQ ID NO: 73454 - DNA, 8 bp, Unknown
  misc_feature (1)..( 8): Matrix.004 file - promoters50/4770260
atcaccaa

SEQ ID NO: 73455 - DNA, 12 bp, Unknown
  misc_feature (1)..( 12): Matrix.004 file - promoters50/4770260
ttccctttataa

SEQ ID NO: 73456 - DNA, 13 bp, Unknown
  misc_feature (1)..( 13): Matrix.004 file - promoters50/4770260
atttcaaacaaaa

SEQ ID NO: 73457 - DNA, 14 bp, Unknown
  misc_feature (1)..( 14): Matrix.004 file - promoters50/4770264
cattctaaaatttc

SEQ ID NO: 73458 - DNA, 13 bp, Unknown
  misc_feature (1)..( 13): Matrix.004 file - promoters50/4770264
tttattaaaaaaa

SEQ ID NO: 73459 - DNA, 7 bp, Unknown
  misc_feature (1)..( 7): Matrix.004 file - promoters50/4770264
aaaataa

SEQ ID NO: 73460 - DNA, 11 bp, Unknown
  misc_feature (1)..( 11): Matrix.004 file - promoters50/4770264
tcaaatatttc

SEQ ID NO: 73461 - DNA, 9 bp, Unknown
  misc_feature (1)..( 9): Matrix.004 file - promoters50/4770264
gaaaaaatt

SEQ ID NO: 73462 - DNA, 7 bp, Unknown
  misc_feature (1)..( 7): Matrix.004 file - promoters50/4770264
tttattt

SEQ ID NO: 73463 - DNA, 10 bp, Unknown
  misc_feature (1)..( 10): Matrix.004 file - promoters50/4770264
atttttaaat

SEQ ID NO: 73464 - DNA, 9 bp, Unknown
  misc_feature (1)..( 9): Matrix.004 file - promoters50/4770264
tgaaaaaat

SEQ ID NO: 73465 - DNA, 9 bp, Unknown
  misc_feature (1)..( 9): Matrix.004 file - promoters50/4770264
tgaaagaat

SEQ ID NO: 73466 - DNA, 8 bp, Unknown
  misc_feature (1)..( 8): Matrix.004 file - promoters50/4770268
gatgtatt

SEQ ID NO: 73467 - DNA, 11 bp, Unknown
  misc_feature (1)..( 11): Matrix.004 file - promoters50/4770268
aatgattttgt

SEQ ID NO: 73468 - DNA, 15 bp, Unknown
  misc_feature (1)..( 15): Matrix.004 file - promoters50/4770268
gaaatttattttgaa

SEQ ID NO: 73469 - DNA, 13 bp, Unknown
  misc_feature (1)..( 13): Matrix.004 file - promoters50/4770274
taaatttttgtta

SEQ ID NO: 73470 - DNA, 9 bp, Unknown
  misc_feature (1)..( 9): Matrix.004 file - promoters50/4770274
gattatata

SEQ ID NO: 73471 - DNA, 7 bp, Unknown
  misc_feature (1)..( 7): Matrix.004 file - promoters50/4770274
ataaata

SEQ ID NO: 73472 - DNA, 7 bp, Unknown
  misc_feature (1)..( 7): Matrix.004 file - promoters50/4770278
aaaaata

SEQ ID NO: 73473 - DNA, 11 bp, Unknown
  misc_feature (1)..( 11): Matrix.004 file - promoters50/4770278
aaatgtatttg

SEQ ID NO: 73474 - DNA, 11 bp, Unknown
  misc_feature (1)..( 11): Matrix.004 file - promoters50/4770288
aaatgtattta

SEQ ID NO: 73475 - DNA, 9 bp, Unknown
  misc_feature (1)..( 9): Matrix.004 file - promoters50/4770288
caataaaca

SEQ ID NO: 73476 - DNA, 10 bp, Unknown
  misc_feature (1)..( 10): Matrix.004 file - promoters50/4770288
aaaaaacaaa

SEQ ID NO: 73477 - DNA, 13 bp, Unknown
  misc_feature (1)..( 13): Matrix.004 file - promoters50/4770288
aaccaattaaaat

SEQ ID NO: 73478 - DNA, 9 bp, Unknown
  misc_feature (1)..( 9): Matrix.004 file - promoters50/4770288
taaaaaaat

SEQ ID NO: 73479 - DNA, 9 bp, Unknown
  misc_feature (1)..( 9): Matrix.004 file - promoters50/4770288
acaatgaaa

SEQ ID NO: 73480 - DNA, 11 bp, Unknown
  misc_feature (1)..( 11): Matrix.004 file - promoters50/4770288
ataaataaaaa

SEQ ID NO: 73481 - DNA, 11 bp, Unknown
  misc_feature (1)..( 11): Matrix.004 file - promoters50/4770305
gaaaaaaaaaa

SEQ ID NO: 73482 - DNA, 11 bp, Unknown
  misc_feature (1)..( 11): Matrix.004 file - promoters50/4770333
aaagaactata

SEQ ID NO: 73483 - DNA, 17 bp, Unknown
  misc_feature (1)..( 17): Matrix.004 file - promoters50/4770367
gaataaaagaaacaaat

SEQ ID NO: 73484 - DNA, 11 bp, Unknown
  misc_feature (1)..( 11): Matrix.004 file - promoters50/4770367
ctttgattaaa

SEQ ID NO: 73485 - DNA, 9 bp, Unknown
  misc_feature (1)..( 9): Matrix.004 file - promoters50/4770371
gtaaacagt

SEQ ID NO: 73486 - DNA, 9 bp, Unknown
  misc_feature (1)..( 9): Matrix.004 file - promoters50/4770371
taaaaaata

SEQ ID NO: 73487 - DNA, 10 bp, Unknown
  misc_feature (1)..( 10): Matrix.004 file - promoters50/4770371
taaaaagtaa

SEQ ID NO: 73488 - DNA, 8 bp, Unknown
  misc_feature (1)..( 8): Matrix.004 file - promoters50/4770371
taaaaagt

SEQ ID NO: 73489 - DNA, 13 bp, Unknown
  misc_feature (1)..( 13): Matrix.004 file - promoters50/4770371
aacataataaaaa

SEQ ID NO: 73490 - DNA, 10 bp, Unknown
  misc_feature (1)..( 10): Matrix.004 file - promoters50/4770371
taaaagaaaa

SEQ ID NO: 73491 - DNA, 8 bp, Unknown
  misc_feature (1)..( 8): Matrix.004 file - promoters50/4770371
aaaaaaga

SEQ ID NO: 73492 - DNA, 7 bp, Unknown
  misc_feature (1)..( 7): Matrix.004 file - promoters50/4770371
ccaaaaa

SEQ ID NO: 73493 - DNA, 8 bp, Unknown
  misc_feature (1)..( 8): Matrix.004 file - promoters50/4770371
caaaacaa

SEQ ID NO: 73494 - DNA, 8 bp, Unknown
  misc_feature (1)..( 8): Matrix.004 file - promoters50/4770371
agataata

SEQ ID NO: 73495 - DNA, 9 bp, Unknown
  misc_feature (1)..( 9): Matrix.004 file - promoters50/4770371
atgtatgat

SEQ ID NO: 73496 - DNA, 7 bp, Unknown
  misc_feature (1)..( 7): Matrix.004 file - promoters50/4770371
taataat

SEQ ID NO: 73497 - DNA, 12 bp, Unknown
  misc_feature (1)..( 12): Matrix.004 file - promoters50/4770379
aaagaaaaagat

SEQ ID NO: 73498 - DNA, 8 bp, Unknown
  misc_feature (1)..( 8): Matrix.004 file - promoters50/4770379
tatataaa

SEQ ID NO: 73499 - DNA, 8 bp, Unknown
  misc_feature (1)..( 8): Matrix.004 file - promoters50/4770379
aatttttt

SEQ ID NO: 73500 - DNA, 9 bp, Unknown
  misc_feature (1)..( 9): Matrix.004 file - promoters50/4770398
tttgatata

SEQ ID NO: 73501 - DNA, 9 bp, Unknown
  misc_feature (1)..( 9): Matrix.004 file - promoters50/4770406
cacaatcat

SEQ ID NO: 73502 - DNA, 9 bp, Unknown
  misc_feature (1)..( 9): Matrix.004 file - promoters50/4770406
taataaaca

SEQ ID NO: 73503 - DNA, 8 bp, Unknown
  misc_feature (1)..( 8): Matrix.004 file - promoters50/4770406
aacataaa

SEQ ID NO: 73504 - DNA, 6 bp, Unknown
  misc_feature (1)..( 6): Matrix.004 file - promoters50/4770414
tgtttt

SEQ ID NO: 73505 - DNA, 11 bp, Unknown
  misc_feature (1)..( 11): Matrix.004 file - promoters50/4770414
tcaacacaaaa

SEQ ID NO: 73506 - DNA, 6 bp, Unknown
  misc_feature (1)..( 6): Matrix.004 file - promoters50/4770428
ataaaa

SEQ ID NO: 73507 - DNA, 11 bp, Unknown
  misc_feature (1)..( 11): Matrix.004 file - promoters50/4770439
ggtttgtatga

SEQ ID NO: 73508 - DNA, 10 bp, Unknown
  misc_feature (1)..( 10): Matrix.004 file - promoters50/4770439
atacaataat

SEQ ID NO: 73509 - DNA, 7 bp, Unknown
  misc_feature (1)..( 7): Matrix.004 file - promoters50/4770443
aacaaac

SEQ ID NO: 73510 - DNA, 15 bp, Unknown
  misc_feature (1)..( 15): Matrix.004 file - promoters50/4770447
aaaaattatttattt

SEQ ID NO: 73511 - DNA, 7 bp, Unknown
  misc_feature (1)..( 7): Matrix.004 file - promoters50/4770447
ttgttta

SEQ ID NO: 73512 - DNA, 13 bp, Unknown
  misc_feature (1)..( 13): Matrix.004 file - promoters50/4770466
ttttcttactaag

SEQ ID NO: 73513 - DNA, 14 bp, Unknown
  misc_feature (1)..( 14): Matrix.004 file - promoters50/4770466
gtcttatatttcga

SEQ ID NO: 73514 - DNA, 5 bp, Unknown
  misc_feature (1)..( 5): Matrix.004 file - promoters50/4770466
ttaac

SEQ ID NO: 73515 - DNA, 13 bp, Unknown
  misc_feature (1)..( 13): Matrix.004 file - promoters50/4770481
aaacattaaatat

SEQ ID NO: 73516 - DNA, 14 bp, Unknown
  misc_feature (1)..( 14): Matrix.004 file - promoters50/4770481
ataataagcaaata

SEQ ID NO: 73517 - DNA, 9 bp, Unknown
  misc_feature (1)..( 9): Matrix.004 file - promoters50/4770481
aaaaaacat

SEQ ID NO: 73518 - DNA, 9 bp, Unknown
  misc_feature (1)..( 9): Matrix.004 file - promoters50/4770499
gcaaataaa

SEQ ID NO: 73519 - DNA, 9 bp, Unknown
  misc_feature (1)..( 9): Matrix.004 file - promoters50/4770499
ctttttaat

SEQ ID NO: 73520 - DNA, 10 bp, Unknown
  misc_feature (1)..( 10): Matrix.004 file - promoters50/4770562
aaataaaata

SEQ ID NO: 73521 - DNA, 7 bp, Unknown
  misc_feature (1)..( 7): Matrix.004 file - promoters50/4770562
caacttg

SEQ ID NO: 73522 - DNA, 7 bp, Unknown
  misc_feature (1)..( 7): Matrix.004 file - promoters50/4770562
aaaatat

SEQ ID NO: 73523 - DNA, 12 bp, Unknown
  misc_feature (1)..( 12): Matrix.004 file - promoters50/4770562
aaactgaaatta

SEQ ID NO: 73524 - DNA, 12 bp, Unknown
  misc_feature (1)..( 12): Matrix.004 file - promoters50/4770562
aaaatatgaaaa

SEQ ID NO: 73525 - DNA, 10 bp, Unknown
  misc_feature (1)..( 10): Matrix.004 file - promoters50/4770562
tatatttaaa

SEQ ID NO: 73526 - DNA, 8 bp, Unknown
  misc_feature (1)..( 8): Matrix.004 file - promoters50/4770562
tatataaa

SEQ ID NO: 73527 - DNA, 8 bp, Unknown
  misc_feature (1)..( 8): Matrix.004 file - promoters50/4770594
gaatgtaa

SEQ ID NO: 73528 - DNA, 6 bp, Unknown
  misc_feature (1)..( 6): Matrix.004 file - promoters50/4770594
caaaat

SEQ ID NO: 73529 - DNA, 13 bp, Unknown
  misc_feature (1)..( 13): Matrix.004 file - promoters50/4770594
aaaaccattacaa

SEQ ID NO: 73530 - DNA, 9 bp, Unknown
  misc_feature (1)..( 9): Matrix.004 file - promoters50/4770604
atatattaa

SEQ ID NO: 73531 - DNA, 8 bp, Unknown
  misc_feature (1)..( 8): Matrix.004 file - promoters50/4770604
tatattaa

SEQ ID NO: 73532 - DNA, 9 bp, Unknown
  misc_feature (1)..( 9): Matrix.004 file - promoters50/4770604
aataaattc

SEQ ID NO: 73533 - DNA, 9 bp, Unknown
  misc_feature (1)..( 9): Matrix.004 file - promoters50/4770604
ctattttaa

SEQ ID NO: 73534 - DNA, 9 bp, Unknown
  misc_feature (1)..( 9): Matrix.004 file - promoters50/4770604
gcaaaaaaa

SEQ ID NO: 73535 - DNA, 9 bp, Unknown
  misc_feature (1)..( 9): Matrix.004 file - promoters50/4770604
gaaaataat

SEQ ID NO: 73536 - DNA, 10 bp, Unknown
  misc_feature (1)..( 10): Matrix.004 file - promoters50/4770620
tttataattg

SEQ ID NO: 73537 - DNA, 10 bp, Unknown
  misc_feature (1)..( 10): Matrix.004 file - promoters50/4770620
atcataaatt

SEQ ID NO: 73538 - DNA, 10 bp, Unknown
  misc_feature (1)..( 10): Matrix.004 file - promoters50/4770620
aaaataacaa

SEQ ID NO: 73539 - DNA, 9 bp, Unknown
  misc_feature (1)..( 9): Matrix.004 file - promoters50/4770620
aacttacaa

SEQ ID NO: 73540 - DNA, 16 bp, Unknown
  misc_feature (1)..( 16): Matrix.004 file - promoters50/4770620
atacaaattgtctacg

SEQ ID NO: 73541 - DNA, 10 bp, Unknown
  misc_feature (1)..( 10): Matrix.004 file - promoters50/4770624
attccatttt

SEQ ID NO: 73542 - DNA, 14 bp, Unknown
  misc_feature (1)..( 14): Matrix.004 file - promoters50/4770624
aaacttaaaaaaaa

SEQ ID NO: 73543 - DNA, 13 bp, Unknown
  misc_feature (1)..( 13): Matrix.004 file - promoters50/4770647
atgaaaaaaaaaa

SEQ ID NO: 73544 - DNA, 8 bp, Unknown
  misc_feature (1)..( 8): Matrix.004 file - promoters50/4770651
taaaacgg

SEQ ID NO: 73545 - DNA, 9 bp, Unknown
  misc_feature (1)..( 9): Matrix.004 file - promoters50/4770651
atacaaaac

SEQ ID NO: 73546 - DNA, 9 bp, Unknown
  misc_feature (1)..( 9): Matrix.004 file - promoters50/4770651
caaaatttt

SEQ ID NO: 73547 - DNA, 8 bp, Unknown
  misc_feature (1)..( 8): Matrix.004 file - promoters50/4770651
tgttttgt

SEQ ID NO: 73548 - DNA, 14 bp, Unknown
  misc_feature (1)..( 14): Matrix.004 file - promoters50/4770651
aatcaaaatattat

SEQ ID NO: 73549 - DNA, 8 bp, Unknown
  misc_feature (1)..( 8): Matrix.004 file - promoters50/4770651
atcaaaat

SEQ ID NO: 73550 - DNA, 9 bp, Unknown
  misc_feature (1)..( 9): Matrix.004 file - promoters50/4770651
aattttaac

SEQ ID NO: 73551 - DNA, 14 bp, Unknown
  misc_feature (1)..( 14): Matrix.004 file - promoters50/4770651
aatcaaaattttat

SEQ ID NO: 73552 - DNA, 8 bp, Unknown
  misc_feature (1)..( 8): Matrix.004 file - promoters50/4770651
tctaattt

SEQ ID NO: 73553 - DNA, 10 bp, Unknown
  misc_feature (1)..( 10): Matrix.004 file - promoters50/4770651
atttaatata

SEQ ID NO: 73554 - DNA, 9 bp, Unknown
  misc_feature (1)..( 9): Matrix.004 file - promoters50/4770651
ataatcaaa

SEQ ID NO: 73555 - DNA, 9 bp, Unknown
  misc_feature (1)..( 9): Matrix.004 file - promoters50/4770659
caaaattta

SEQ ID NO: 73556 - DNA, 7 bp, Unknown
  misc_feature (1)..( 7): Matrix.004 file - promoters50/4770659
agtatat

SEQ ID NO: 73557 - DNA, 10 bp, Unknown
  misc_feature (1)..( 10): Matrix.004 file - promoters50/4770659
aaaataaata

SEQ ID NO: 73558 - DNA, 8 bp, Unknown
  misc_feature (1)..( 8): Matrix.004 file - promoters50/4770666
aatagata

SEQ ID NO: 73559 - DNA, 7 bp, Unknown
  misc_feature (1)..( 7): Matrix.004 file - promoters50/4770666
ttggatt

SEQ ID NO: 73560 - DNA, 7 bp, Unknown
  misc_feature (1)..( 7): Matrix.004 file - promoters50/4770880
ataattg

SEQ ID NO: 73561 - DNA, 11 bp, Unknown
  misc_feature (1)..( 11): Matrix.004 file - promoters50/4770880
caaattttaca

SEQ ID NO: 73562 - DNA, 7 bp, Unknown
  misc_feature (1)..( 7): Matrix.004 file - promoters50/4770880
gatttta

SEQ ID NO: 73563 - DNA, 9 bp, Unknown
  misc_feature (1)..( 9): Matrix.004 file - promoters50/4770880
aatgagatt

SEQ ID NO: 73564 - DNA, 8 bp, Unknown
  misc_feature (1)..( 8): Matrix.004 file - promoters50/4770880
atccatct

SEQ ID NO: 73565 - DNA, 9 bp, Unknown
  misc_feature (1)..( 9): Matrix.004 file - promoters50/4770880
aactaaaga

SEQ ID NO: 73566 - DNA, 12 bp, Unknown
  misc_feature (1)..( 12): Matrix.004 file - promoters50/4770880
tgatatgtattt

SEQ ID NO: 73567 - DNA, 8 bp, Unknown
  misc_feature (1)..( 8): Matrix.004 file - promoters50/4770880
ttaacttt

SEQ ID NO: 73568 - DNA, 6 bp, Unknown
  misc_feature (1)..( 6): Matrix.004 file - promoters50/4770880
caaatt

SEQ ID NO: 73569 - DNA, 7 bp, Unknown
  misc_feature (1)..( 7): Matrix.004 file - promoters50/4771231
tcaaatt

SEQ ID NO: 73570 - DNA, 12 bp, Unknown
  misc_feature (1)..( 12): Matrix.004 file - promoters50/4771245
tttatgtttttt

SEQ ID NO: 73571 - DNA, 8 bp, Unknown
  misc_feature (1)..( 8): Matrix.004 file - promoters50/4771245
atatttgt

SEQ ID NO: 73572 - DNA, 8 bp, Unknown
  misc_feature (1)..( 8): Matrix.004 file - promoters50/4771252
tatctgtt

SEQ ID NO: 73573 - DNA, 10 bp, Unknown
  misc_feature (1)..( 10): Matrix.004 file - promoters50/4771255
aaaggataaa

SEQ ID NO: 73574 - DNA, 8 bp, Unknown
  misc_feature (1)..( 8): Matrix.004 file - promoters50/4771255
tttgttga

SEQ ID NO: 73575 - DNA, 14 bp, Unknown
  misc_feature (1)..( 14): Matrix.004 file - promoters50/4771255
attttatctttttc

SEQ ID NO: 73576 - DNA, 12 bp, Unknown
  misc_feature (1)..( 12): Matrix.004 file - promoters50/4771271
tcttatttaaat

SEQ ID NO: 73577 - DNA, 7 bp, Unknown
  misc_feature (1)..( 7): Matrix.004 file - promoters50/4771278
atttatt

SEQ ID NO: 73578 - DNA, 10 bp, Unknown
  misc_feature (1)..( 10): Matrix.004 file - promoters50/4771282
aaaatcgaca

SEQ ID NO: 73579 - DNA, 9 bp, Unknown
  misc_feature (1)..( 9): Matrix.004 file - promoters50/4771286
tattcttac

SEQ ID NO: 73580 - DNA, 6 bp, Unknown
  misc_feature (1)..( 6): Matrix.004 file - promoters50/4771286
tatata

SEQ ID NO: 73581 - DNA, 10 bp, Unknown
  misc_feature (1)..( 10): Matrix.004 file - promoters50/4771286
aattttgaaa

SEQ ID NO: 73582 - DNA, 13 bp, Unknown
  misc_feature (1)..( 13): Matrix.004 file - promoters50/4771286
attaaaaatatta

SEQ ID NO: 73583 - DNA, 15 bp, Unknown
  misc_feature (1)..( 15): Matrix.004 file - promoters50/4771286
acatcgatccgcgtc

SEQ ID NO: 73584 - DNA, 7 bp, Unknown
  misc_feature (1)..( 7): Matrix.004 file - promoters50/4771325
ataaata

SEQ ID NO: 73585 - DNA, 7 bp, Unknown
  misc_feature (1)..( 7): Matrix.004 file - promoters50/4771325
gaaaaaa

SEQ ID NO: 73586 - DNA, 7 bp, Unknown
  misc_feature (1)..( 7): Matrix.004 file - promoters50/4771325
aagaaat

SEQ ID NO: 73587 - DNA, 11 bp, Unknown
  misc_feature (1)..( 11): Matrix.004 file - promoters50/4771325
atatttgcatt

SEQ ID NO: 73588 - DNA, 9 bp, Unknown
  misc_feature (1)..( 9): Matrix.004 file - promoters50/4771330
gtttagttg

SEQ ID NO: 73589 - DNA, 10 bp, Unknown
  misc_feature (1)..( 10): Matrix.004 file - promoters50/4771330
aagaggaaga

SEQ ID NO: 73590 - DNA, 6 bp, Unknown
  misc_feature (1)..( 6): Matrix.004 file - promoters50/4771330
gaagag

SEQ ID NO: 73591 - DNA, 10 bp, Unknown
  misc_feature (1)..( 10): Matrix.004 file - promoters50/4771330
aagaggattg

SEQ ID NO: 73592 - DNA, 8 bp, Unknown
  misc_feature (1)..( 8): Matrix.004 file - promoters50/4771334
aaaaagag

SEQ ID NO: 73593 - DNA, 11 bp, Unknown
  misc_feature (1)..( 11): Matrix.004 file - promoters50/4771334
caaaaaatatt

SEQ ID NO: 73594 - DNA, 17 bp, Unknown
  misc_feature (1)..( 17): Matrix.004 file - promoters50/4771348
gtgcttctaacaaaata

SEQ ID NO: 73595 - DNA, 7 bp, Unknown
  misc_feature (1)..( 7): Matrix.004 file - promoters50/4771348
acactgt

SEQ ID NO: 73596 - DNA, 8 bp, Unknown
  misc_feature (1)..( 8): Matrix.004 file - promoters50/4771348
tgtcttta

SEQ ID NO: 73597 - DNA, 10 bp, Unknown
  misc_feature (1)..( 10): Matrix.004 file - promoters50/4771348
cattagtaaa

SEQ ID NO: 73598 - DNA, 9 bp, Unknown
  misc_feature (1)..( 9): Matrix.004 file - promoters50/4771348
caacaattt

SEQ ID NO: 73599 - DNA, 9 bp, Unknown
  misc_feature (1)..( 9): Matrix.004 file - promoters50/4771348
tttagttat

SEQ ID NO: 73600 - DNA, 10 bp, Unknown
  misc_feature (1)..( 10): Matrix.004 file - promoters50/4771360
tagtaaatgg

SEQ ID NO: 73601 - DNA, 12 bp, Unknown
  misc_feature (1)..( 12): Matrix.004 file - promoters50/4771360
agaaaaaacgat

SEQ ID NO: 73602 - DNA, 14 bp, Unknown
  misc_feature (1)..( 14): Matrix.004 file - promoters50/4771360
aaaaatcttaactt

SEQ ID NO: 73603 - DNA, 12 bp, Unknown
  misc_feature (1)..( 12): Matrix.004 file - promoters50/4771364
caaaatataagt

SEQ ID NO: 73604 - DNA, 9 bp, Unknown
  misc_feature (1)..( 9): Matrix.004 file - promoters50/4771364
actttgaca

SEQ ID NO: 73605 - DNA, 10 bp, Unknown
  misc_feature (1)..( 10): Matrix.004 file - promoters50/4771372
atggaccaaa

SEQ ID NO: 73606 - DNA, 12 bp, Unknown
  misc_feature (1)..( 12): Matrix.004 file - promoters50/4771404
cgatgagatcta

SEQ ID NO: 73607 - DNA, 9 bp, Unknown
  misc_feature (1)..( 9): Matrix.004 file - promoters50/4771407
taatagaat

SEQ ID NO: 73608 - DNA, 13 bp, Unknown
  misc_feature (1)..( 13): Matrix.004 file - promoters50/4771407
tcaaactaattaa

SEQ ID NO: 73609 - DNA, 9 bp, Unknown
  misc_feature (1)..( 9): Matrix.004 file - promoters50/4771410
tattttcaa

SEQ ID NO: 73610 - DNA, 10 bp, Unknown
  misc_feature (1)..( 10): Matrix.004 file - promoters50/4771410
ttacttttta

SEQ ID NO: 73611 - DNA, 13 bp, Unknown
  misc_feature (1)..( 13): Matrix.004 file - promoters50/4771410
atttttactacta

SEQ ID NO: 73612 - DNA, 12 bp, Unknown
  misc_feature (1)..( 12): Matrix.004 file - promoters50/4771410
tatgaaaaatat

SEQ ID NO: 73613 - DNA, 6 bp, Unknown
  misc_feature (1)..( 6): Matrix.004 file - promoters50/4771422
aaccca

SEQ ID NO: 73614 - DNA, 6 bp, Unknown
  misc_feature (1)..( 6): Matrix.004 file - promoters50/4771422
ttttag

SEQ ID NO: 73615 - DNA, 8 bp, Unknown
  misc_feature (1)..( 8): Matrix.004 file - promoters50/4771426
aaatgaaa

SEQ ID NO: 73616 - DNA, 14 bp, Unknown
  misc_feature (1)..( 14): Matrix.004 file - promoters50/4771426
caaattacaaaatt

SEQ ID NO: 73617 - DNA, 21 bp, Unknown
  misc_feature (1)..( 21): Matrix.004 file - promoters50/4771426
aagttgctacttaaattatta

SEQ ID NO: 73618 - DNA, 17 bp, Unknown
  misc_feature (1)..( 17): Matrix.004 file - promoters50/4771426
tctttttgaagatttcg

SEQ ID NO: 73619 - DNA, 7 bp, Unknown
  misc_feature (1)..( 7): Matrix.004 file - promoters50/4771426
aaatata

SEQ ID NO: 73620 - DNA, 11 bp, Unknown
  misc_feature (1)..( 11): Matrix.004 file - promoters50/4771426
gcttattttga

SEQ ID NO: 73621 - DNA, 11 bp, Unknown
  misc_feature (1)..( 11): Matrix.004 file - promoters50/4771426
aaataaaattg

SEQ ID NO: 73622 - DNA, 12 bp, Unknown
  misc_feature (1)..( 12): Matrix.004 file - promoters50/4771426
attaaataaaaa

SEQ ID NO: 73623 - DNA, 11 bp, Unknown
  misc_feature (1)..( 11): Matrix.004 file - promoters50/4771426
aaaaataaaaa

SEQ ID NO: 73624 - DNA, 12 bp, Unknown
  misc_feature (1)..( 12): Matrix.004 file - promoters50/4771426
aaataaaaaaat

SEQ ID NO: 73625 - DNA, 9 bp, Unknown
  misc_feature (1)..( 9): Matrix.004 file - promoters50/4771433
aaaaaatta

SEQ ID NO: 73626 - DNA, 7 bp, Unknown
  misc_feature (1)..( 7): Matrix.004 file - promoters50/4771441
ttgacca

SEQ ID NO: 73627 - DNA, 8 bp, Unknown
  misc_feature (1)..( 8): Matrix.004 file - promoters50/4771441
gttttttt

SEQ ID NO: 73628 - DNA, 10 bp, Unknown
  misc_feature (1)..( 10): Matrix.004 file - promoters50/4771446
tctaatcttt

SEQ ID NO: 73629 - DNA, 8 bp, Unknown
  misc_feature (1)..( 8): Matrix.004 file - promoters50/4771446
gtttcttt

SEQ ID NO: 73630 - DNA, 8 bp, Unknown
  misc_feature (1)..( 8): Matrix.004 file - promoters50/4771446
ataaaaaa

SEQ ID NO: 73631 - DNA, 7 bp, Unknown
  misc_feature (1)..( 7): Matrix.004 file - promoters50/4771446
caaattt

SEQ ID NO: 73632 - DNA, 8 bp, Unknown
  misc_feature (1)..( 8): Matrix.004 file - promoters50/4771446
aaagaaaa

SEQ ID NO: 73633 - DNA, 10 bp, Unknown
  misc_feature (1)..( 10): Matrix.004 file - promoters50/4771457
aatgtttttt

SEQ ID NO: 73634 - DNA, 10 bp, Unknown
  misc_feature (1)..( 10): Matrix.004 file - promoters50/4771457
ggtttatttt

SEQ ID NO: 73635 - DNA, 9 bp, Unknown
  misc_feature (1)..( 9): Matrix.004 file - promoters50/4771457
aaaacctgt

SEQ ID NO: 73636 - DNA, 7 bp, Unknown
  misc_feature (1)..( 7): Matrix.004 file - promoters50/4771464
attcctt

SEQ ID NO: 73637 - DNA, 10 bp, Unknown
  misc_feature (1)..( 10): Matrix.004 file - promoters50/4771467
taaagctttg

SEQ ID NO: 73638 - DNA, 9 bp, Unknown
  misc_feature (1)..( 9): Matrix.004 file - promoters50/4771469
tataatttg

SEQ ID NO: 73639 - DNA, 7 bp, Unknown
  misc_feature (1)..( 7): Matrix.004 file - promoters50/4771469
caaaact

SEQ ID NO: 73640 - DNA, 8 bp, Unknown
  misc_feature (1)..( 8): Matrix.004 file - promoters50/4771469
cataaaat

SEQ ID NO: 73641 - DNA, 8 bp, Unknown
  misc_feature (1)..( 8): Matrix.004 file - promoters50/4771472
gaggctca

SEQ ID NO: 73642 - DNA, 8 bp, Unknown
  misc_feature (1)..( 8): Matrix.004 file - promoters50/4771472
taaacttt

SEQ ID NO: 73643 - DNA, 10 bp, Unknown
  misc_feature (1)..( 10): Matrix.004 file - promoters50/4771472
cttatataaa

SEQ ID NO: 73644 - DNA, 14 bp, Unknown
  misc_feature (1)..( 14): Matrix.004 file - promoters50/4771478
taatattttcaaaa

SEQ ID NO: 73645 - DNA, 10 bp, Unknown
  misc_feature (1)..( 10): Matrix.004 file - promoters50/4771478
gaaaataaaa

SEQ ID NO: 73646 - DNA, 12 bp, Unknown
  misc_feature (1)..( 12): Matrix.004 file - promoters50/4771478
agaaaataaaaa

SEQ ID NO: 73647 - DNA, 12 bp, Unknown
  misc_feature (1)..( 12): Matrix.004 file - promoters50/4771482
ataaaacataaa

SEQ ID NO: 73648 - DNA, 7 bp, Unknown
  misc_feature (1)..( 7): Matrix.004 file - promoters50/4771495
taaagtg

SEQ ID NO: 73649 - DNA, 9 bp, Unknown
  misc_feature (1)..( 9): Matrix.004 file - promoters50/4771495
aaattgtag

SEQ ID NO: 73650 - DNA, 11 bp, Unknown
  misc_feature (1)..( 11): Matrix.004 file - promoters50/4771495
tatttaaaatt

SEQ ID NO: 73651 - DNA, 12 bp, Unknown
  misc_feature (1)..( 12): Matrix.004 file - promoters50/4771502
ttaaattgttct

SEQ ID NO: 73652 - DNA, 7 bp, Unknown
  misc_feature (1)..( 7): Matrix.004 file - promoters50/4771502
caatttt

SEQ ID NO: 73653 - DNA, 13 bp, Unknown
  misc_feature (1)..( 13): Matrix.004 file - promoters50/4771519
atatatttcattt

SEQ ID NO: 73654 - DNA, 13 bp, Unknown
  misc_feature (1)..( 13): Matrix.004 file - promoters50/4771523
gaaatctctatta

SEQ ID NO: 73655 - DNA, 9 bp, Unknown
  misc_feature (1)..( 9): Matrix.004 file - promoters50/4771523
ttaaactaa

SEQ ID NO: 73656 - DNA, 15 bp, Unknown
  misc_feature (1)..( 15): Matrix.004 file - promoters50/4771565
tcagaaaaaatgtga

SEQ ID NO: 73657 - DNA, 10 bp, Unknown
  misc_feature (1)..( 10): Matrix.004 file - promoters50/4771565
catttgggtc

SEQ ID NO: 73658 - DNA, 12 bp, Unknown
  misc_feature (1)..( 12): Matrix.004 file - promoters50/4771565
tatatttatttt

SEQ ID NO: 73659 - DNA, 10 bp, Unknown
  misc_feature (1)..( 10): Matrix.004 file - promoters50/4771579
ttttttactt

SEQ ID NO: 73660 - DNA, 7 bp, Unknown
  misc_feature (1)..( 7): Matrix.004 file - promoters50/4771586
aaacaaa

SEQ ID NO: 73661 - DNA, 13 bp, Unknown
  misc_feature (1)..( 13): Matrix.004 file - promoters50/4771586
ttataaaattgat

SEQ ID NO: 73662 - DNA, 10 bp, Unknown
  misc_feature (1)..( 10): Matrix.004 file - promoters50/4771601
aataaaattt

SEQ ID NO: 73663 - DNA, 8 bp, Unknown
  misc_feature (1)..( 8): Matrix.004 file - promoters50/4771601
aaaaagtt

SEQ ID NO: 73664 - DNA, 11 bp, Unknown
  misc_feature (1)..( 11): Matrix.004 file - promoters50/4771601
aaaacttaaaa

SEQ ID NO: 73665 - DNA, 14 bp, Unknown
  misc_feature (1)..( 14): Matrix.004 file - promoters50/4771601
atatatgtatctct

SEQ ID NO: 73666 - DNA, 7 bp, Unknown
  misc_feature (1)..( 7): Matrix.004 file - promoters50/4771601
atatata

SEQ ID NO: 73667 - DNA, 10 bp, Unknown
  misc_feature (1)..( 10): Matrix.004 file - promoters50/4771612
tatcaaacaa

SEQ ID NO: 73668 - DNA, 8 bp, Unknown
  misc_feature (1)..( 8): Matrix.004 file - promoters50/4771612
cgaatctt

SEQ ID NO: 73669 - DNA, 8 bp, Unknown
  misc_feature (1)..( 8): Matrix.004 file - promoters50/4771612
ttcacaaa

SEQ ID NO: 73670 - DNA, 8 bp, Unknown
  misc_feature (1)..( 8): Matrix.004 file - promoters50/4771616
aaatcaaa

SEQ ID NO: 73671 - DNA, 8 bp, Unknown
  misc_feature (1)..( 8): Matrix.004 file - promoters50/4771616
caataatg

SEQ ID NO: 73672 - DNA, 10 bp, Unknown
  misc_feature (1)..( 10): Matrix.004 file - promoters50/4771616
ttcatagata

SEQ ID NO: 73673 - DNA, 10 bp, Unknown
  misc_feature (1)..( 10): Matrix.004 file - promoters50/4771616
aaaaaaaaat

SEQ ID NO: 73674 - DNA, 7 bp, Unknown
  misc_feature (1)..( 7): Matrix.004 file - promoters50/4771616
ataaata

SEQ ID NO: 73675 - DNA, 8 bp, Unknown
  misc_feature (1)..( 8): Matrix.004 file - promoters50/4771616
aaaatttt

SEQ ID NO: 73676 - DNA, 12 bp, Unknown
  misc_feature (1)..( 12): Matrix.004 file - promoters50/4771616
gttactatcttt

SEQ ID NO: 73677 - DNA, 10 bp, Unknown
  misc_feature (1)..( 10): Matrix.004 file - promoters50/4771616
taaaaaaaat

SEQ ID NO: 73678 - DNA, 8 bp, Unknown
  misc_feature (1)..( 8): Matrix.004 file - promoters50/4771616
taaaaaaa

SEQ ID NO: 73679 - DNA, 6 bp, Unknown
  misc_feature (1)..( 6): Matrix.004 file - promoters50/4771616
acaatt

SEQ ID NO: 73680 - DNA, 8 bp, Unknown
  misc_feature (1)..( 8): Matrix.004 file - promoters50/4771616
ttagaaaa

SEQ ID NO: 73681 - DNA, 8 bp, Unknown
  misc_feature (1)..( 8): Matrix.004 file - promoters50/4771620
taaaaaaa

SEQ ID NO: 73682 - DNA, 7 bp, Unknown
  misc_feature (1)..( 7): Matrix.004 file - promoters50/4771620
ttatatt

SEQ ID NO: 73683 - DNA, 8 bp, Unknown
  misc_feature (1)..( 8): Matrix.004 file - promoters50/4771624
catacatt

SEQ ID NO: 73684 - DNA, 11 bp, Unknown
  misc_feature (1)..( 11): Matrix.004 file - promoters50/4771624
ggattttcaaa

SEQ ID NO: 73685 - DNA, 8 bp, Unknown
  misc_feature (1)..( 8): Matrix.004 file - promoters50/4771624
tttataaa

SEQ ID NO: 73686 - DNA, 12 bp, Unknown
  misc_feature (1)..( 12): Matrix.004 file - promoters50/4771624
tataaaaagaag

SEQ ID NO: 73687 - DNA, 9 bp, Unknown
  misc_feature (1)..( 9): Matrix.004 file - promoters50/4771638
aagaaaatt

SEQ ID NO: 73688 - DNA, 11 bp, Unknown
  misc_feature (1)..( 11): Matrix.004 file - promoters50/4771638
agtgattaatc

SEQ ID NO: 73689 - DNA, 10 bp, Unknown
  misc_feature (1)..( 10): Matrix.004 file - promoters50/4771638
tttattaaag

SEQ ID NO: 73690 - DNA, 9 bp, Unknown
  misc_feature (1)..( 9): Matrix.004 file - promoters50/4771646
ttttataca

SEQ ID NO: 73691 - DNA, 9 bp, Unknown
  misc_feature (1)..( 9): Matrix.004 file - promoters50/4771658
attaatatt

SEQ ID NO: 73692 - DNA, 8 bp, Unknown
  misc_feature (1)..( 8): Matrix.004 file - promoters50/4771658
catgtttt

SEQ ID NO: 73693 - DNA, 7 bp, Unknown
  misc_feature (1)..( 7): Matrix.004 file - promoters50/4771674
gatagaa

SEQ ID NO: 73694 - DNA, 7 bp, Unknown
  misc_feature (1)..( 7): Matrix.004 file - promoters50/4771677
attcaat

SEQ ID NO: 73695 - DNA, 7 bp, Unknown
  misc_feature (1)..( 7): Matrix.004 file - promoters50/4771677
aaaatta

SEQ ID NO: 73696 - DNA, 13 bp, Unknown
  misc_feature (1)..( 13): Matrix.004 file - promoters50/4771677
ccataaaacaaac

SEQ ID NO: 73697 - DNA, 10 bp, Unknown
  misc_feature (1)..( 10): Matrix.004 file - promoters50/4771677
caatgtcaat

SEQ ID NO: 73698 - DNA, 11 bp, Unknown
  misc_feature (1)..( 11): Matrix.004 file - promoters50/4771677
aaaaaccaaaa

SEQ ID NO: 73699 - DNA, 8 bp, Unknown
  misc_feature (1)..( 8): Matrix.004 file - promoters50/4771713
aacaataa

SEQ ID NO: 73700 - DNA, 8 bp, Unknown
  misc_feature (1)..( 8): Matrix.004 file - promoters50/4771713
aaattggg

SEQ ID NO: 73701 - DNA, 8 bp, Unknown
  misc_feature (1)..( 8): Matrix.004 file - promoters50/4771713
ttattaag

SEQ ID NO: 73702 - DNA, 8 bp, Unknown
  misc_feature (1)..( 8): Matrix.004 file - promoters50/4771713
aataaaac

SEQ ID NO: 73703 - DNA, 11 bp, Unknown
  misc_feature (1)..( 11): Matrix.004 file - promoters50/4771713
aaacaattatt

SEQ ID NO: 73704 - DNA, 7 bp, Unknown
  misc_feature (1)..( 7): Matrix.004 file - promoters50/4771713
atttatt

SEQ ID NO: 73705 - DNA, 9 bp, Unknown
  misc_feature (1)..( 9): Matrix.004 file - promoters50/4771713
aaatttgtt

SEQ ID NO: 73706 - DNA, 10 bp, Unknown
  misc_feature (1)..( 10): Matrix.004 file - promoters50/4771725
aaaagaaaag

SEQ ID NO: 73707 - DNA, 13 bp, Unknown
  misc_feature (1)..( 13): Matrix.004 file - promoters50/4771725
cagagtaattaaa

SEQ ID NO: 73708 - DNA, 8 bp, Unknown
  misc_feature (1)..( 8): Matrix.004 file - promoters50/4771737
atcaaata

SEQ ID NO: 73709 - DNA, 10 bp, Unknown
  misc_feature (1)..( 10): Matrix.004 file - promoters50/4771741
atgaaaataa

SEQ ID NO: 73710 - DNA, 8 bp, Unknown
  misc_feature (1)..( 8): Matrix.004 file - promoters50/4771741
taaaagaa

SEQ ID NO: 73711 - DNA, 12 bp, Unknown
  misc_feature (1)..( 12): Matrix.004 file - promoters50/4771741
cactttctctct

SEQ ID NO: 73712 - DNA, 10 bp, Unknown
  misc_feature (1)..( 10): Matrix.004 file - promoters50/4771741
tttaattatt

SEQ ID NO: 73713 - DNA, 8 bp, Unknown
  misc_feature (1)..( 8): Matrix.004 file - promoters50/4771741
aaaaaaaa

SEQ ID NO: 73714 - DNA, 8 bp, Unknown
  misc_feature (1)..( 8): Matrix.004 file - promoters50/4771741
tataaata

SEQ ID NO: 73715 - DNA, 8 bp, Unknown
  misc_feature (1)..( 8): Matrix.004 file - promoters50/4771745
ttttaatt

SEQ ID NO: 73716 - DNA, 8 bp, Unknown
  misc_feature (1)..( 8): Matrix.004 file - promoters50/4771785
ggataatt

SEQ ID NO: 73717 - DNA, 8 bp, Unknown
  misc_feature (1)..( 8): Matrix.004 file - promoters50/4771785
atatttta

SEQ ID NO: 73718 - DNA, 11 bp, Unknown
  misc_feature (1)..( 11): Matrix.004 file - promoters50/4771785
gatattataaa

SEQ ID NO: 73719 - DNA, 7 bp, Unknown
  misc_feature (1)..( 7): Matrix.004 file - promoters50/4771785
atattat

SEQ ID NO: 73720 - DNA, 11 bp, Unknown
  misc_feature (1)..( 11): Matrix.004 file - promoters50/4771785
ataaatgaaga

SEQ ID NO: 73721 - DNA, 9 bp, Unknown
  misc_feature (1)..( 9): Matrix.004 file - promoters50/4771785
tatatttaa

SEQ ID NO: 73722 - DNA, 7 bp, Unknown
  misc_feature (1)..( 7): Matrix.004 file - promoters50/4771785
gatttat

SEQ ID NO: 73723 - DNA, 7 bp, Unknown
  misc_feature (1)..( 7): Matrix.004 file - promoters50/4771785
tattttt

SEQ ID NO: 73724 - DNA, 8 bp, Unknown
  misc_feature (1)..( 8): Matrix.004 file - promoters50/4771785
tattttta

SEQ ID NO: 73725 - DNA, 9 bp, Unknown
  misc_feature (1)..( 9): Matrix.004 file - promoters50/4771785
atggatttt

SEQ ID NO: 73726 - DNA, 9 bp, Unknown
  misc_feature (1)..( 9): Matrix.004 file - promoters50/4771785
agaaatata

SEQ ID NO: 73727 - DNA, 8 bp, Unknown
  misc_feature (1)..( 8): Matrix.004 file - promoters50/4771785
aagtgaat

SEQ ID NO: 73728 - DNA, 14 bp, Unknown
  misc_feature (1)..( 14): Matrix.004 file - promoters50/4771785
ttaacaattttttt

SEQ ID NO: 73729 - DNA, 13 bp, Unknown
  misc_feature (1)..( 13): Matrix.004 file - promoters50/4771785
ttaaaaatttatt

SEQ ID NO: 73730 - DNA, 13 bp, Unknown
  misc_feature (1)..( 13): Matrix.004 file - promoters50/4771785
ttgaatcaatatt

SEQ ID NO: 73731 - DNA, 7 bp, Unknown
  misc_feature (1)..( 7): Matrix.004 file - promoters50/4771785
tgaaaaa

SEQ ID NO: 73732 - DNA, 9 bp, Unknown
  misc_feature (1)..( 9): Matrix.004 file - promoters50/4771789
taaatttct

SEQ ID NO: 73733 - DNA, 14 bp, Unknown
  misc_feature (1)..( 14): Matrix.004 file - promoters50/4771789
gtatttaagttttt

SEQ ID NO: 73734 - DNA, 12 bp, Unknown
  misc_feature (1)..( 12): Matrix.004 file - promoters50/4771789
tttttgtttgtt

SEQ ID NO: 73735 - DNA, 8 bp, Unknown
  misc_feature (1)..( 8): Matrix.004 file - promoters50/4771789
aaataaat

SEQ ID NO: 73736 - DNA, 8 bp, Unknown
  misc_feature (1)..( 8): Matrix.004 file - promoters50/4771793
aaccaaaa

SEQ ID NO: 73737 - DNA, 8 bp, Unknown
  misc_feature (1)..( 8): Matrix.004 file - promoters50/4771793
tacttttt

SEQ ID NO: 73738 - DNA, 9 bp, Unknown
  misc_feature (1)..( 9): Matrix.004 file - promoters50/4771793
ttaaaaaaa

SEQ ID NO: 73739 - DNA, 10 bp, Unknown
  misc_feature (1)..( 10): Matrix.004 file - promoters50/4771808
aattgaaaaa

SEQ ID NO: 73740 - DNA, 9 bp, Unknown
  misc_feature (1)..( 9): Matrix.004 file - promoters50/4771872
gaaactaaa

SEQ ID NO: 73741 - DNA, 12 bp, Unknown
  misc_feature (1)..( 12): Matrix.004 file - promoters50/4771872
aattaaattgtt

SEQ ID NO: 73742 - DNA, 13 bp, Unknown
  misc_feature (1)..( 13): Matrix.004 file - promoters50/4771872
attgtttaaagaa

SEQ ID NO: 73743 - DNA, 8 bp, Unknown
  misc_feature (1)..( 8): Matrix.004 file - promoters50/4771879
ggataagc

SEQ ID NO: 73744 - DNA, 12 bp, Unknown
  misc_feature (1)..( 12): Matrix.004 file - promoters50/4771879
gtcatatctaat

SEQ ID NO: 73745 - DNA, 8 bp, Unknown
  misc_feature (1)..( 8): Matrix.004 file - promoters50/4771883
gtaatttg

SEQ ID NO: 73746 - DNA, 15 bp, Unknown
  misc_feature (1)..( 15): Matrix.004 file - promoters50/4771883
aataacatatatata

SEQ ID NO: 73747 - DNA, 10 bp, Unknown
  misc_feature (1)..( 10): Matrix.004 file - promoters50/4771883
aaatacaaag

SEQ ID NO: 73748 - DNA, 9 bp, Unknown
  misc_feature (1)..( 9): Matrix.004 file - promoters50/4771883
aaataatta

SEQ ID NO: 73749 - DNA, 8 bp, Unknown
  misc_feature (1)..( 8): Matrix.004 file - promoters50/4771895
tcggttta

SEQ ID NO: 73750 - DNA, 12 bp, Unknown
  misc_feature (1)..( 12): Matrix.004 file - promoters50/4771895
aatttagatctt

SEQ ID NO: 73751 - DNA, 16 bp, Unknown
  misc_feature (1)..( 16): Matrix.004 file - promoters50/4771903
tatcaaaaaaactaaa

SEQ ID NO: 73752 - DNA, 5 bp, Unknown
  misc_feature (1)..( 5): Matrix.004 file - promoters50/4771903
gttct

SEQ ID NO: 73753 - DNA, 13 bp, Unknown
  misc_feature (1)..( 13): Matrix.004 file - promoters50/4771903
ttgaataaaaatt

SEQ ID NO: 73754 - DNA, 10 bp, Unknown
  misc_feature (1)..( 10): Matrix.004 file - promoters50/4771903
acttatttga

SEQ ID NO: 73755 - DNA, 11 bp, Unknown
  misc_feature (1)..( 11): Matrix.004 file - promoters50/4771903
gataaaattaa

SEQ ID NO: 73756 - DNA, 7 bp, Unknown
  misc_feature (1)..( 7): Matrix.004 file - promoters50/4771903
atttttt

SEQ ID NO: 73757 - DNA, 10 bp, Unknown
  misc_feature (1)..( 10): Matrix.004 file - promoters50/4771903
aaaattattt

SEQ ID NO: 73758 - DNA, 9 bp, Unknown
  misc_feature (1)..( 9): Matrix.004 file - promoters50/4771911
aaaaattat

SEQ ID NO: 73759 - DNA, 13 bp, Unknown
  misc_feature (1)..( 13): Matrix.004 file - promoters50/4771911
gaaacaaaaacat

SEQ ID NO: 73760 - DNA, 9 bp, Unknown
  misc_feature (1)..( 9): Matrix.004 file - promoters50/4771911
aaaataaaa

SEQ ID NO: 73761 - DNA, 8 bp, Unknown
  misc_feature (1)..( 8): Matrix.004 file - promoters50/4771911
aaaatatc

SEQ ID NO: 73762 - DNA, 8 bp, Unknown
  misc_feature (1)..( 8): Matrix.004 file - promoters50/4771911
aacaaaat

SEQ ID NO: 73763 - DNA, 13 bp, Unknown
  misc_feature (1)..( 13): Matrix.004 file - promoters50/4771911
tttggaaaagaaa

SEQ ID NO: 73764 - DNA, 8 bp, Unknown
  misc_feature (1)..( 8): Matrix.004 file - promoters50/4771911
ttatttat

SEQ ID NO: 73765 - DNA, 11 bp, Unknown
  misc_feature (1)..( 11): Matrix.004 file - promoters50/4771913
aaaaaaagaaa

SEQ ID NO: 73766 - DNA, 9 bp, Unknown
  misc_feature (1)..( 9): Matrix.004 file - promoters50/4771913
caaagatat

SEQ ID NO: 73767 - DNA, 10 bp, Unknown
  misc_feature (1)..( 10): Matrix.004 file - promoters50/4771928
cacaaaaaaa

SEQ ID NO: 73768 - DNA, 9 bp, Unknown
  misc_feature (1)..( 9): Matrix.004 file - promoters50/4771928
agaaattta

SEQ ID NO: 73769 - DNA, 8 bp, Unknown
  misc_feature (1)..( 8): Matrix.004 file - promoters50/4771928
atttttgg

SEQ ID NO: 73770 - DNA, 8 bp, Unknown
  misc_feature (1)..( 8): Matrix.004 file - promoters50/4771928
aataaatc

SEQ ID NO: 73771 - DNA, 10 bp, Unknown
  misc_feature (1)..( 10): Matrix.004 file - promoters50/4771944
tttcaaaaaa

SEQ ID NO: 73772 - DNA, 13 bp, Unknown
  misc_feature (1)..( 13): Matrix.004 file - promoters50/4771944
ttaaataaaaact

SEQ ID NO: 73773 - DNA, 16 bp, Unknown
  misc_feature (1)..( 16): Matrix.004 file - promoters50/4771952
tactgtttttcattct

SEQ ID NO: 73774 - DNA, 8 bp, Unknown
  misc_feature (1)..( 8): Matrix.004 file - promoters50/4771956
ctcaaatt

SEQ ID NO: 73775 - DNA, 11 bp, Unknown
  misc_feature (1)..( 11): Matrix.004 file - promoters50/4771956
aaactatttaa

SEQ ID NO: 73776 - DNA, 10 bp, Unknown
  misc_feature (1)..( 10): Matrix.004 file - promoters50/4771960
taaataagtt

SEQ ID NO: 73777 - DNA, 10 bp, Unknown
  misc_feature (1)..( 10): Matrix.004 file - promoters50/4771960
caaatacttg

SEQ ID NO: 73778 - DNA, 13 bp, Unknown
  misc_feature (1)..( 13): Matrix.004 file - promoters50/4771960
caaaaataaaatc

SEQ ID NO: 73779 - DNA, 9 bp, Unknown
  misc_feature (1)..( 9): Matrix.004 file - promoters50/4771968
aaacattaa

SEQ ID NO: 73780 - DNA, 5 bp, Unknown
  misc_feature (1)..( 5): Matrix.004 file - promoters50/4771968
catat

SEQ ID NO: 73781 - DNA, 11 bp, Unknown
  misc_feature (1)..( 11): Matrix.004 file - promoters50/4771972
tatatataatc

SEQ ID NO: 73782 - DNA, 9 bp, Unknown
  misc_feature (1)..( 9): Matrix.004 file - promoters50/4771972
gaaacaaaa

SEQ ID NO: 73783 - DNA, 8 bp, Unknown
  misc_feature (1)..( 8): Matrix.004 file - promoters50/4771972
ttttgttt

SEQ ID NO: 73784 - DNA, 7 bp, Unknown
  misc_feature (1)..( 7): Matrix.004 file - promoters50/4771972
taaaaat

SEQ ID NO: 73785 - DNA, 10 bp, Unknown
  misc_feature (1)..( 10): Matrix.004 file - promoters50/4771975
taaaataaaa

SEQ ID NO: 73786 - DNA, 7 bp, Unknown
  misc_feature (1)..( 7): Matrix.004 file - promoters50/4771990
acttaat

SEQ ID NO: 73787 - DNA, 8 bp, Unknown
  misc_feature (1)..( 8): Matrix.004 file - promoters50/4772005
aataaaat

SEQ ID NO: 73788 - DNA, 12 bp, Unknown
  misc_feature (1)..( 12): Matrix.004 file - promoters50/4772005
tctttttaaatt

SEQ ID NO: 73789 - DNA, 11 bp, Unknown
  misc_feature (1)..( 11): Matrix.004 file - promoters50/4772005
ataatatacat

SEQ ID NO: 73790 - DNA, 10 bp, Unknown
  misc_feature (1)..( 10): Matrix.004 file - promoters50/4772042
tttgaatatt

SEQ ID NO: 73791 - DNA, 8 bp, Unknown
  misc_feature (1)..( 8): Matrix.004 file - promoters50/4772042
taaaaaca

SEQ ID NO: 73792 - DNA, 8 bp, Unknown
  misc_feature (1)..( 8): Matrix.004 file - promoters50/4772050
ttatcttt

SEQ ID NO: 73793 - DNA, 10 bp, Unknown
  misc_feature (1)..( 10): Matrix.004 file - promoters50/4772062
aacaacatgt

SEQ ID NO: 73794 - DNA, 10 bp, Unknown
  misc_feature (1)..( 10): Matrix.004 file - promoters50/4772062
aataattaat

SEQ ID NO: 73795 - DNA, 9 bp, Unknown
  misc_feature (1)..( 9): Matrix.004 file - promoters50/4772062
tatttggta

SEQ ID NO: 73796 - DNA, 12 bp, Unknown
  misc_feature (1)..( 12): Matrix.004 file - promoters50/4772062
tgaacaaaatta

SEQ ID NO: 73797 - DNA, 7 bp, Unknown
  misc_feature (1)..( 7): Matrix.004 file - promoters50/4772062
aaaaaaa

SEQ ID NO: 73798 - DNA, 16 bp, Unknown
  misc_feature (1)..( 16): Matrix.004 file - promoters50/4772062
ttaaaaaaaattaatg

SEQ ID NO: 73799 - DNA, 11 bp, Unknown
  misc_feature (1)..( 11): Matrix.004 file - promoters50/4772062
ttaaaaaaaat

SEQ ID NO: 73800 - DNA, 11 bp, Unknown
  misc_feature (1)..( 11): Matrix.004 file - promoters50/4772066
aagaaaaatta

SEQ ID NO: 73801 - DNA, 12 bp, Unknown
  misc_feature (1)..( 12): Matrix.004 file - promoters50/4772066
actatagatcaa

SEQ ID NO: 73802 - DNA, 9 bp, Unknown
  misc_feature (1)..( 9): Matrix.004 file - promoters50/4772070
ttggatgat

SEQ ID NO: 73803 - DNA, 9 bp, Unknown
  misc_feature (1)..( 9): Matrix.004 file - promoters50/4772084
tgatggtac

SEQ ID NO: 73804 - DNA, 8 bp, Unknown
  misc_feature (1)..( 8): Matrix.004 file - promoters50/4772084
aacttatt

SEQ ID NO: 73805 - DNA, 10 bp, Unknown
  misc_feature (1)..( 10): Matrix.004 file - promoters50/4772084
aaaaatgata

SEQ ID NO: 73806 - DNA, 14 bp, Unknown
  misc_feature (1)..( 14): Matrix.004 file - promoters50/4772084
tttaaacaattata

SEQ ID NO: 73807 - DNA, 6 bp, Unknown
  misc_feature (1)..( 6): Matrix.004 file - promoters50/4772084
taattt

SEQ ID NO: 73808 - DNA, 9 bp, Unknown
  misc_feature (1)..( 9): Matrix.004 file - promoters50/4772084
gatactttt

SEQ ID NO: 73809 - DNA, 9 bp, Unknown
  misc_feature (1)..( 9): Matrix.004 file - promoters50/4772095
taataaaaa

SEQ ID NO: 73810 - DNA, 14 bp, Unknown
  misc_feature (1)..( 14): Matrix.004 file - promoters50/4772103
tatgtttcaaatat

SEQ ID NO: 73811 - DNA, 15 bp, Unknown
  misc_feature (1)..( 15): Matrix.004 file - promoters50/4772115
aaaaacaaaaaagct

SEQ ID NO: 73812 - DNA, 9 bp, Unknown
  misc_feature (1)..( 9): Matrix.004 file - promoters50/4772115
aaacctact

SEQ ID NO: 73813 - DNA, 7 bp, Unknown
  misc_feature (1)..( 7): Matrix.004 file - promoters50/4772122
ataattt

SEQ ID NO: 73814 - DNA, 9 bp, Unknown
  misc_feature (1)..( 9): Matrix.004 file - promoters50/4772130
ggacaaaat

SEQ ID NO: 73815 - DNA, 9 bp, Unknown
  misc_feature (1)..( 9): Matrix.004 file - promoters50/4772130
gcataaatt

SEQ ID NO: 73816 - DNA, 13 bp, Unknown
  misc_feature (1)..( 13): Matrix.004 file - promoters50/4772133
acatcaaaaattt

SEQ ID NO: 73817 - DNA, 7 bp, Unknown
  misc_feature (1)..( 7): Matrix.004 file - promoters50/4772137
aagaatg

SEQ ID NO: 73818 - DNA, 8 bp, Unknown
  misc_feature (1)..( 8): Matrix.004 file - promoters50/4772137
gtctggat

SEQ ID NO: 73819 - DNA, 10 bp, Unknown
  misc_feature (1)..( 10): Matrix.004 file - promoters50/4772137
gaaaatttat

SEQ ID NO: 73820 - DNA, 14 bp, Unknown
  misc_feature (1)..( 14): Matrix.004 file - promoters50/4772155
ctttctttttttgg

SEQ ID NO: 73821 - DNA, 9 bp, Unknown
  misc_feature (1)..( 9): Matrix.004 file - promoters50/4772155
caaaaaaaa

SEQ ID NO: 73822 - DNA, 8 bp, Unknown
  misc_feature (1)..( 8): Matrix.004 file - promoters50/4772155
atttttta

SEQ ID NO: 73823 - DNA, 10 bp, Unknown
  misc_feature (1)..( 10): Matrix.004 file - promoters50/4772155
gatcataaca

SEQ ID NO: 73824 - DNA, 8 bp, Unknown
  misc_feature (1)..( 8): Matrix.004 file - promoters50/4772155
tctttaga

SEQ ID NO: 73825 - DNA, 8 bp, Unknown
  misc_feature (1)..( 8): Matrix.004 file - promoters50/4772167
tttgttta

SEQ ID NO: 73826 - DNA, 7 bp, Unknown
  misc_feature (1)..( 7): Matrix.004 file - promoters50/4772167
gaagaaa

SEQ ID NO: 73827 - DNA, 8 bp, Unknown
  misc_feature (1)..( 8): Matrix.004 file - promoters50/4772167
aaacaaac

SEQ ID NO: 73828 - DNA, 7 bp, Unknown
  misc_feature (1)..( 7): Matrix.004 file - promoters50/4772167
aaaaccc

SEQ ID NO: 73829 - DNA, 9 bp, Unknown
  misc_feature (1)..( 9): Matrix.004 file - promoters50/4772167
gagaatctt

SEQ ID NO: 73830 - DNA, 8 bp, Unknown
  misc_feature (1)..( 8): Matrix.004 file - promoters50/4772167
tgaatcaa

SEQ ID NO: 73831 - DNA, 9 bp, Unknown
  misc_feature (1)..( 9): Matrix.004 file - promoters50/4772167
tttgaattt

SEQ ID NO: 73832 - DNA, 10 bp, Unknown
  misc_feature (1)..( 10): Matrix.004 file - promoters50/4772167
atgattttac

SEQ ID NO: 73833 - DNA, 8 bp, Unknown
  misc_feature (1)..( 8): Matrix.004 file - promoters50/4772171
aaattttt

SEQ ID NO: 73834 - DNA, 7 bp, Unknown
  misc_feature (1)..( 7): Matrix.004 file - promoters50/4772171
taattta

SEQ ID NO: 73835 - DNA, 9 bp, Unknown
  misc_feature (1)..( 9): Matrix.004 file - promoters50/4772171
ctatatata

SEQ ID NO: 73836 - DNA, 7 bp, Unknown
  misc_feature (1)..( 7): Matrix.004 file - promoters50/4772171
attcaat

SEQ ID NO: 73837 - DNA, 11 bp, Unknown
  misc_feature (1)..( 11): Matrix.004 file - promoters50/4772171
tatagcaaaaa

SEQ ID NO: 73838 - DNA, 7 bp, Unknown
  misc_feature (1)..( 7): Matrix.004 file - promoters50/4772195
cttttct

SEQ ID NO: 73839 - DNA, 7 bp, Unknown
  misc_feature (1)..( 7): Matrix.004 file - promoters50/4772198
ttcattt

SEQ ID NO: 73840 - DNA, 9 bp, Unknown
  misc_feature (1)..( 9): Matrix.004 file - promoters50/4772198
aatttgtat

SEQ ID NO: 73841 - DNA, 7 bp, Unknown
  misc_feature (1)..( 7): Matrix.004 file - promoters50/4772198
gaaaaag

SEQ ID NO: 73842 - DNA, 8 bp, Unknown
  misc_feature (1)..( 8): Matrix.004 file - promoters50/4772208
aaaaaaaa

SEQ ID NO: 73843 - DNA, 14 bp, Unknown
  misc_feature (1)..( 14): Matrix.004 file - promoters50/4772208
atattttgattttt

SEQ ID NO: 73844 - DNA, 9 bp, Unknown
  misc_feature (1)..( 9): Matrix.004 file - promoters50/4772208
attaaatgt

SEQ ID NO: 73845 - DNA, 11 bp, Unknown
  misc_feature (1)..( 11): Matrix.004 file - promoters50/4772208
tattttcaaaa

SEQ ID NO: 73846 - DNA, 10 bp, Unknown
  misc_feature (1)..( 10): Matrix.004 file - promoters50/4772212
ttcaaattat

SEQ ID NO: 73847 - DNA, 8 bp, Unknown
  misc_feature (1)..( 8): Matrix.004 file - promoters50/4772212
tttgttta

SEQ ID NO: 73848 - DNA, 10 bp, Unknown
  misc_feature (1)..( 10): Matrix.004 file - promoters50/4772212
tataatattt

SEQ ID NO: 73849 - DNA, 7 bp, Unknown
  misc_feature (1)..( 7): Matrix.004 file - promoters50/4772212
cttgtaa

SEQ ID NO: 73850 - DNA, 9 bp, Unknown
  misc_feature (1)..( 9): Matrix.004 file - promoters50/4772212
tccaataat

SEQ ID NO: 73851 - DNA, 9 bp, Unknown
  misc_feature (1)..( 9): Matrix.004 file - promoters50/4772212
ttttcatat

SEQ ID NO: 73852 - DNA, 8 bp, Unknown
  misc_feature (1)..( 8): Matrix.004 file - promoters50/4772212
ttttattt

SEQ ID NO: 73853 - DNA, 8 bp, Unknown
  misc_feature (1)..( 8): Matrix.004 file - promoters50/4772212
atactttg

SEQ ID NO: 73854 - DNA, 7 bp, Unknown
  misc_feature (1)..( 7): Matrix.004 file - promoters50/4772219
ctataat

SEQ ID NO: 73855 - DNA, 10 bp, Unknown
  misc_feature (1)..( 10): Matrix.004 file - promoters50/4772223
tataaaaata

SEQ ID NO: 73856 - DNA, 9 bp, Unknown
  misc_feature (1)..( 9): Matrix.004 file - promoters50/4772223
acttatata

SEQ ID NO: 73857 - DNA, 9 bp, Unknown
  misc_feature (1)..( 9): Matrix.004 file - promoters50/4772223
caaacacta

SEQ ID NO: 73858 - DNA, 8 bp, Unknown
  misc_feature (1)..( 8): Matrix.004 file - promoters50/4772223
ataatttt

SEQ ID NO: 73859 - DNA, 9 bp, Unknown
  misc_feature (1)..( 9): Matrix.004 file - promoters50/4772223
acaagaaaa

SEQ ID NO: 73860 - DNA, 9 bp, Unknown
  misc_feature (1)..( 9): Matrix.004 file - promoters50/4772223
tcaaaacaa

SEQ ID NO: 73861 - DNA, 8 bp, Unknown
  misc_feature (1)..( 8): Matrix.004 file - promoters50/4772223
tttagaca

SEQ ID NO: 73862 - DNA, 12 bp, Unknown
  misc_feature (1)..( 12): Matrix.004 file - promoters50/4772223
ttatcaaattga

SEQ ID NO: 73863 - DNA, 8 bp, Unknown
  misc_feature (1)..( 8): Matrix.004 file - promoters50/4772230
atttcaaa

SEQ ID NO: 73864 - DNA, 9 bp, Unknown
  misc_feature (1)..( 9): Matrix.004 file - promoters50/4772230
aatagattt

SEQ ID NO: 73865 - DNA, 10 bp, Unknown
  misc_feature (1)..( 10): Matrix.004 file - promoters50/4772240
aaatattcac

SEQ ID NO: 73866 - DNA, 16 bp, Unknown
  misc_feature (1)..( 16): Matrix.004 file - promoters50/4772240
atttttatgaaaaaaa

SEQ ID NO: 73867 - DNA, 14 bp, Unknown
  misc_feature (1)..( 14): Matrix.004 file - promoters50/4772240
ttaaattgttcctc

SEQ ID NO: 73868 - DNA, 12 bp, Unknown
  misc_feature (1)..( 12): Matrix.004 file - promoters50/4772248
ttactaaaaaaa

SEQ ID NO: 73869 - DNA, 7 bp, Unknown
  misc_feature (1)..( 7): Matrix.004 file - promoters50/4772248
tttttgt

SEQ ID NO: 73870 - DNA, 11 bp, Unknown
  misc_feature (1)..( 11): Matrix.004 file - promoters50/4772248
aatttactata

SEQ ID NO: 73871 - DNA, 15 bp, Unknown
  misc_feature (1)..( 15): Matrix.004 file - promoters50/4772248
actaattttgattaa

SEQ ID NO: 73872 - DNA, 13 bp, Unknown
  misc_feature (1)..( 13): Matrix.004 file - promoters50/4772248
attgtgtttctgt

SEQ ID NO: 73873 - DNA, 10 bp, Unknown
  misc_feature (1)..( 10): Matrix.004 file - promoters50/4772248
tcataaattt

SEQ ID NO: 73874 - DNA, 13 bp, Unknown
  misc_feature (1)..( 13): Matrix.004 file - promoters50/4772248
cataaaacttctc

SEQ ID NO: 73875 - DNA, 14 bp, Unknown
  misc_feature (1)..( 14): Matrix.004 file - promoters50/4772248
atatcttttataat

SEQ ID NO: 73876 - DNA, 10 bp, Unknown
  misc_feature (1)..( 10): Matrix.004 file - promoters50/4772248
ttttataaat

SEQ ID NO: 73877 - DNA, 8 bp, Unknown
  misc_feature (1)..( 8): Matrix.004 file - promoters50/4772248
ttttctaa

SEQ ID NO: 73878 - DNA, 10 bp, Unknown
  misc_feature (1)..( 10): Matrix.004 file - promoters50/4772248
taaatttttc

SEQ ID NO: 73879 - DNA, 11 bp, Unknown
  misc_feature (1)..( 11): Matrix.004 file - promoters50/4772248
cacttataaaa

SEQ ID NO: 73880 - DNA, 9 bp, Unknown
  misc_feature (1)..( 9): Matrix.004 file - promoters50/4772258
aaaacttct

SEQ ID NO: 73881 - DNA, 8 bp, Unknown
  misc_feature (1)..( 8): Matrix.004 file - promoters50/4772258
tgttgttt

SEQ ID NO: 73882 - DNA, 9 bp, Unknown
  misc_feature (1)..( 9): Matrix.004 file - promoters50/4772274
attttttat

SEQ ID NO: 73883 - DNA, 8 bp, Unknown
  misc_feature (1)..( 8): Matrix.004 file - promoters50/4772274
tttctttt

SEQ ID NO: 73884 - DNA, 6 bp, Unknown
  misc_feature (1)..( 6): Matrix.004 file - promoters50/4772274
ttcttt

SEQ ID NO: 73885 - DNA, 15 bp, Unknown
  misc_feature (1)..( 15): Matrix.004 file - promoters50/4772285
ataccaaacttatca

SEQ ID NO: 73886 - DNA, 11 bp, Unknown
  misc_feature (1)..( 11): Matrix.004 file - promoters50/4772285
gataataaaag

SEQ ID NO: 73887 - DNA, 7 bp, Unknown
  misc_feature (1)..( 7): Matrix.004 file - promoters50/4772285
aaaataa

SEQ ID NO: 73888 - DNA, 9 bp, Unknown
  misc_feature (1)..( 9): Matrix.004 file - promoters50/4772285
taatattat

SEQ ID NO: 73889 - DNA, 10 bp, Unknown
  misc_feature (1)..( 10): Matrix.004 file - promoters50/4772289
caaaaatgta

SEQ ID NO: 73890 - DNA, 8 bp, Unknown
  misc_feature (1)..( 8): Matrix.004 file - promoters50/4772289
gaaacaaa

SEQ ID NO: 73891 - DNA, 7 bp, Unknown
  misc_feature (1)..( 7): Matrix.004 file - promoters50/4772311
agatgtg

SEQ ID NO: 73892 - DNA, 9 bp, Unknown
  misc_feature (1)..( 9): Matrix.004 file - promoters50/4772311
aaaaacaaa

SEQ ID NO: 73893 - DNA, 11 bp, Unknown
  misc_feature (1)..( 11): Matrix.004 file - promoters50/4772311
aaatcttcata

SEQ ID NO: 73894 - DNA, 13 bp, Unknown
  misc_feature (1)..( 13): Matrix.004 file - promoters50/4772311
aaaatgttttatc

SEQ ID NO: 73895 - DNA, 14 bp, Unknown
  misc_feature (1)..( 14): Matrix.004 file - promoters50/4772311
attttataaaaaaa

SEQ ID NO: 73896 - DNA, 11 bp, Unknown
  misc_feature (1)..( 11): Matrix.004 file - promoters50/4772311
ttgagaaaaaa

SEQ ID NO: 73897 - DNA, 11 bp, Unknown
  misc_feature (1)..( 11): Matrix.004 file - promoters50/4772311
ataaagaaaaa

SEQ ID NO: 73898 - DNA, 9 bp, Unknown
  misc_feature (1)..( 9): Matrix.004 file - promoters50/4772311
tgtttctaa

SEQ ID NO: 73899 - DNA, 11 bp, Unknown
  misc_feature (1)..( 11): Matrix.004 file - promoters50/4772315
attaaaaaagc

SEQ ID NO: 73900 - DNA, 15 bp, Unknown
  misc_feature (1)..( 15): Matrix.004 file - promoters50/4772323
ttgattttttcgtat

SEQ ID NO: 73901 - DNA, 9 bp, Unknown
  misc_feature (1)..( 9): Matrix.004 file - promoters50/4772329
ttttgtcta

SEQ ID NO: 73902 - DNA, 7 bp, Unknown
  misc_feature (1)..( 7): Matrix.004 file - promoters50/4772329
aaaacat

SEQ ID NO: 73903 - DNA, 8 bp, Unknown
  misc_feature (1)..( 8): Matrix.004 file - promoters50/4772329
tttgttta

SEQ ID NO: 73904 - DNA, 9 bp, Unknown
  misc_feature (1)..( 9): Matrix.004 file - promoters50/4772329
taacttaat

SEQ ID NO: 73905 - DNA, 7 bp, Unknown
  misc_feature (1)..( 7): Matrix.004 file - promoters50/4772329
ttatata

SEQ ID NO: 73906 - DNA, 7 bp, Unknown
  misc_feature (1)..( 7): Matrix.004 file - promoters50/4772329
attatta

SEQ ID NO: 73907 - DNA, 8 bp, Unknown
  misc_feature (1)..( 8): Matrix.004 file - promoters50/4772329
aatattca

SEQ ID NO: 73908 - DNA, 12 bp, Unknown
  misc_feature (1)..( 12): Matrix.004 file - promoters50/4772329
atagtttacata

SEQ ID NO: 73909 - DNA, 8 bp, Unknown
  misc_feature (1)..( 8): Matrix.004 file - promoters50/4772329
aaacatta

SEQ ID NO: 73910 - DNA, 10 bp, Unknown
  misc_feature (1)..( 10): Matrix.004 file - promoters50/4772329
ctttatataa

SEQ ID NO: 73911 - DNA, 8 bp, Unknown
  misc_feature (1)..( 8): Matrix.004 file - promoters50/4772336
ttcttctc

SEQ ID NO: 73912 - DNA, 18 bp, Unknown
  misc_feature (1)..( 18): Matrix.004 file - promoters50/4772336
atcatcaatcaaaattaa

SEQ ID NO: 73913 - DNA, 6 bp, Unknown
  misc_feature (1)..( 6): Matrix.004 file - promoters50/4772336
ttatat

SEQ ID NO: 73914 - DNA, 12 bp, Unknown
  misc_feature (1)..( 12): Matrix.004 file - promoters50/4772340
agttgaatattc

SEQ ID NO: 73915 - DNA, 9 bp, Unknown
  misc_feature (1)..( 9): Matrix.004 file - promoters50/4772340
ctataaaaa

SEQ ID NO: 73916 - DNA, 11 bp, Unknown
  misc_feature (1)..( 11): Matrix.004 file - promoters50/4772346
aattaatcttt

SEQ ID NO: 73917 - DNA, 11 bp, Unknown
  misc_feature (1)..( 11): Matrix.004 file - promoters50/4772370
cagagacatca

SEQ ID NO: 73918 - DNA, 12 bp, Unknown
  misc_feature (1)..( 12): Matrix.004 file - promoters50/4772370
atgtaataacac

SEQ ID NO: 73919 - DNA, 8 bp, Unknown
  misc_feature (1)..( 8): Matrix.004 file - promoters50/4772370
aaaaagag

SEQ ID NO: 73920 - DNA, 8 bp, Unknown
  misc_feature (1)..( 8): Matrix.004 file - promoters50/4772370
attaaaaa

SEQ ID NO: 73921 - DNA, 8 bp, Unknown
  misc_feature (1)..( 8): Matrix.004 file - promoters50/4772378
tataaaaa

SEQ ID NO: 73922 - DNA, 14 bp, Unknown
  misc_feature (1)..( 14): Matrix.004 file - promoters50/4772382
aagtttgaaaagtc

SEQ ID NO: 73923 - DNA, 9 bp, Unknown
  misc_feature (1)..( 9): Matrix.004 file - promoters50/4772382
ctatataaa

SEQ ID NO: 73924 - DNA, 9 bp, Unknown
  misc_feature (1)..( 9): Matrix.004 file - promoters50/4772382
gaaatctaa

SEQ ID NO: 73925 - DNA, 10 bp, Unknown
  misc_feature (1)..( 10): Matrix.004 file - promoters50/4772389
tatataaata

SEQ ID NO: 73926 - DNA, 9 bp, Unknown
  misc_feature (1)..( 9): Matrix.004 file - promoters50/4772389
caaaaaatt

SEQ ID NO: 73927 - DNA, 7 bp, Unknown
  misc_feature (1)..( 7): Matrix.004 file - promoters50/4772389
aaatatt

SEQ ID NO: 73928 - DNA, 12 bp, Unknown
  misc_feature (1)..( 12): Matrix.004 file - promoters50/4772389
taattaaattaa

SEQ ID NO: 73929 - DNA, 11 bp, Unknown
  misc_feature (1)..( 11): Matrix.004 file - promoters50/4772389
acaaaaagtta

SEQ ID NO: 73930 - DNA, 8 bp, Unknown
  misc_feature (1)..( 8): Matrix.004 file - promoters50/4772389
gaaaaaca

SEQ ID NO: 73931 - DNA, 10 bp, Unknown
  misc_feature (1)..( 10): Matrix.004 file - promoters50/4772389
aaaatttatt

SEQ ID NO: 73932 - DNA, 10 bp, Unknown
  misc_feature (1)..( 10): Matrix.004 file - promoters50/4772389
tagtgaactt

SEQ ID NO: 73933 - DNA, 11 bp, Unknown
  misc_feature (1)..( 11): Matrix.004 file - promoters50/4772389
aaattaatatt

SEQ ID NO: 73934 - DNA, 11 bp, Unknown
  misc_feature (1)..( 11): Matrix.004 file - promoters50/4772389
gttaaaaaaat

SEQ ID NO: 73935 - DNA, 7 bp, Unknown
  misc_feature (1)..( 7): Matrix.004 file - promoters50/4772398
aaaaata

SEQ ID NO: 73936 - DNA, 12 bp, Unknown
  misc_feature (1)..( 12): Matrix.004 file - promoters50/4772402
tagaattttatt

SEQ ID NO: 73937 - DNA, 13 bp, Unknown
  misc_feature (1)..( 13): Matrix.004 file - promoters50/4772410
atgtataaacaaa

SEQ ID NO: 73938 - DNA, 12 bp, Unknown
  misc_feature (1)..( 12): Matrix.004 file - promoters50/4772410
tatatttgattc

SEQ ID NO: 73939 - DNA, 10 bp, Unknown
  misc_feature (1)..( 10): Matrix.004 file - promoters50/4772410
tatgtttgat

SEQ ID NO: 73940 - DNA, 9 bp, Unknown
  misc_feature (1)..( 9): Matrix.004 file - promoters50/4772410
taaaacaca

SEQ ID NO: 73941 - DNA, 8 bp, Unknown
  misc_feature (1)..( 8): Matrix.004 file - promoters50/4772413
aaaacaag

SEQ ID NO: 73942 - DNA, 13 bp, Unknown
  misc_feature (1)..( 13): Matrix.004 file - promoters50/4772413
gaaaaatttgtgt

SEQ ID NO: 73943 - DNA, 10 bp, Unknown
  misc_feature (1)..( 10): Matrix.004 file - promoters50/4772420
ttattaaatt

SEQ ID NO: 73944 - DNA, 9 bp, Unknown
  misc_feature (1)..( 9): Matrix.004 file - promoters50/4772472
agaatcaac

SEQ ID NO: 73945 - DNA, 8 bp, Unknown
  misc_feature (1)..( 8): Matrix.004 file - promoters50/4772472
ttagaaaa

SEQ ID NO: 73946 - DNA, 9 bp, Unknown
  misc_feature (1)..( 9): Matrix.004 file - promoters50/4772472
gtacacttt

SEQ ID NO: 73947 - DNA, 10 bp, Unknown
  misc_feature (1)..( 10): Matrix.004 file - promoters50/4772472
cacaagatca

SEQ ID NO: 73948 - DNA, 9 bp, Unknown
  misc_feature (1)..( 9): Matrix.004 file - promoters50/4772472
aaaaacaaa

SEQ ID NO: 73949 - DNA, 8 bp, Unknown
  misc_feature (1)..( 8): Matrix.004 file - promoters50/4772472
aaaataaa

SEQ ID NO: 73950 - DNA, 8 bp, Unknown
  misc_feature (1)..( 8): Matrix.004 file - promoters50/4772472
cacaagat

SEQ ID NO: 73951 - DNA, 7 bp, Unknown
  misc_feature (1)..( 7): Matrix.004 file - promoters50/4772472
caaatta

SEQ ID NO: 73952 - DNA, 9 bp, Unknown
  misc_feature (1)..( 9): Matrix.004 file - promoters50/4772472
attttgtag

SEQ ID NO: 73953 - DNA, 8 bp, Unknown
  misc_feature (1)..( 8): Matrix.004 file - promoters50/4772472
atcttaca

SEQ ID NO: 73954 - DNA, 10 bp, Unknown
  misc_feature (1)..( 10): Matrix.004 file - promoters50/4772700
ttatttaaaa

SEQ ID NO: 73955 - DNA, 13 bp, Unknown
  misc_feature (1)..( 13): Matrix.004 file - promoters50/4772710
ccatctcttattt

SEQ ID NO: 73956 - DNA, 7 bp, Unknown
  misc_feature (1)..( 7): Matrix.004 file - promoters50/4772710
tattttt

SEQ ID NO: 73957 - DNA, 9 bp, Unknown
  misc_feature (1)..( 9): Matrix.004 file - promoters50/4772710
ttattttgc

SEQ ID NO: 73958 - DNA, 8 bp, Unknown
  misc_feature (1)..( 8): Matrix.004 file - promoters50/4772720
gaatcaaa

SEQ ID NO: 73959 - DNA, 8 bp, Unknown
  misc_feature (1)..( 8): Matrix.004 file - promoters50/4772720
aattaatg

SEQ ID NO: 73960 - DNA, 7 bp, Unknown
  misc_feature (1)..( 7): Matrix.004 file - promoters50/4772720
gaatcaa

SEQ ID NO: 73961 - DNA, 7 bp, Unknown
  misc_feature (1)..( 7): Matrix.004 file - promoters50/4772724
gaaacaa

SEQ ID NO: 73962 - DNA, 7 bp, Unknown
  misc_feature (1)..( 7): Matrix.004 file - promoters50/4772735
atgtgga

SEQ ID NO: 73963 - DNA, 10 bp, Unknown
  misc_feature (1)..( 10): Matrix.004 file - promoters50/4772735
tctttgtaat

SEQ ID NO: 73964 - DNA, 8 bp, Unknown
  misc_feature (1)..( 8): Matrix.004 file - promoters50/4772735
aatcataa

SEQ ID NO: 73965 - DNA, 9 bp, Unknown
  misc_feature (1)..( 9): Matrix.004 file - promoters50/4772735
tatttatct

SEQ ID NO: 73966 - DNA, 7 bp, Unknown
  misc_feature (1)..( 7): Matrix.004 file - promoters50/4772743
taaatca

SEQ ID NO: 73967 - DNA, 7 bp, Unknown
  misc_feature (1)..( 7): Matrix.004 file - promoters50/4772743
aattttt

SEQ ID NO: 73968 - DNA, 8 bp, Unknown
  misc_feature (1)..( 8): Matrix.004 file - promoters50/4772751
aaaaaaaa

SEQ ID NO: 73969 - DNA, 10 bp, Unknown
  misc_feature (1)..( 10): Matrix.004 file - promoters50/4772772
ttaaaataaa

SEQ ID NO: 73970 - DNA, 10 bp, Unknown
  misc_feature (1)..( 10): Matrix.004 file - promoters50/4772772
cctatatata

SEQ ID NO: 73971 - DNA, 8 bp, Unknown
  misc_feature (1)..( 8): Matrix.004 file - promoters50/4772772
taacaaaa

SEQ ID NO: 73972 - DNA, 8 bp, Unknown
  misc_feature (1)..( 8): Matrix.004 file - promoters50/4772772
ttcttatt

SEQ ID NO: 73973 - DNA, 12 bp, Unknown
  misc_feature (1)..( 12): Matrix.004 file - promoters50/4772824
aataatataaat

SEQ ID NO: 73974 - DNA, 7 bp, Unknown
  misc_feature (1)..( 7): Matrix.004 file - promoters50/4772824
tattttc

SEQ ID NO: 73975 - DNA, 11 bp, Unknown
  misc_feature (1)..( 11): Matrix.004 file - promoters50/4772835
atatgaagttt

SEQ ID NO: 73976 - DNA, 8 bp, Unknown
  misc_feature (1)..( 8): Matrix.004 file - promoters50/4772843
ataaaaac

SEQ ID NO: 73977 - DNA, 12 bp, Unknown
  misc_feature (1)..( 12): Matrix.004 file - promoters50/4772843
caaaatgtgctt

SEQ ID NO: 73978 - DNA, 7 bp, Unknown
  misc_feature (1)..( 7): Matrix.004 file - promoters50/4772853
aatcatg

SEQ ID NO: 73979 - DNA, 8 bp, Unknown
  misc_feature (1)..( 8): Matrix.004 file - promoters50/4772853
aaattaat

SEQ ID NO: 73980 - DNA, 11 bp, Unknown
  misc_feature (1)..( 11): Matrix.004 file - promoters50/4772853
ttttaacaaat

SEQ ID NO: 73981 - DNA, 10 bp, Unknown
  misc_feature (1)..( 10): Matrix.004 file - promoters50/4772853
taaaatgttt

SEQ ID NO: 73982 - DNA, 13 bp, Unknown
  misc_feature (1)..( 13): Matrix.004 file - promoters50/4772853
ttcatcgaaaaat

SEQ ID NO: 73983 - DNA, 8 bp, Unknown
  misc_feature (1)..( 8): Matrix.004 file - promoters50/4772853
tcaaaatt

SEQ ID NO: 73984 - DNA, 8 bp, Unknown
  misc_feature (1)..( 8): Matrix.004 file - promoters50/4772853
tctatttt

SEQ ID NO: 73985 - DNA, 10 bp, Unknown
  misc_feature (1)..( 10): Matrix.004 file - promoters50/4772853
taatttaaaa

SEQ ID NO: 73986 - DNA, 9 bp, Unknown
  misc_feature (1)..( 9): Matrix.004 file - promoters50/4772855
aatttaaaa

SEQ ID NO: 73987 - DNA, 9 bp, Unknown
  misc_feature (1)..( 9): Matrix.004 file - promoters50/4772855
caatatgtt

SEQ ID NO: 73988 - DNA, 7 bp, Unknown
  misc_feature (1)..( 7): Matrix.004 file - promoters50/4772855
aaattta

SEQ ID NO: 73989 - DNA, 11 bp, Unknown
  misc_feature (1)..( 11): Matrix.004 file - promoters50/4772855
ctaaaaataaa

SEQ ID NO: 73990 - DNA, 8 bp, Unknown
  misc_feature (1)..( 8): Matrix.004 file - promoters50/4772855
cctataaa

SEQ ID NO: 73991 - DNA, 9 bp, Unknown
  misc_feature (1)..( 9): Matrix.004 file - promoters50/4772855
tttaaaaat

SEQ ID NO: 73992 - DNA, 9 bp, Unknown
  misc_feature (1)..( 9): Matrix.004 file - promoters50/4772855
aattcgttt

SEQ ID NO: 73993 - DNA, 9 bp, Unknown
  misc_feature (1)..( 9): Matrix.004 file - promoters50/4772855
atataagat

SEQ ID NO: 73994 - DNA, 12 bp, Unknown
  misc_feature (1)..( 12): Matrix.004 file - promoters50/4772855
aaaaacaaaaca

SEQ ID NO: 73995 - DNA, 7 bp, Unknown
  misc_feature (1)..( 7): Matrix.004 file - promoters50/4772873
aaaaata

SEQ ID NO: 73996 - DNA, 6 bp, Unknown
  misc_feature (1)..( 6): Matrix.004 file - promoters50/4772873
aaaaga

SEQ ID NO: 73997 - DNA, 9 bp, Unknown
  misc_feature (1)..( 9): Matrix.004 file - promoters50/4772879
aaataaaaa

SEQ ID NO: 73998 - DNA, 10 bp, Unknown
  misc_feature (1)..( 10): Matrix.004 file - promoters50/4772879
aattttttta

SEQ ID NO: 73999 - DNA, 7 bp, Unknown
  misc_feature (1)..( 7): Matrix.004 file - promoters50/4772879
ataataa

SEQ ID NO: 74000 - DNA, 9 bp, Unknown
  misc_feature (1)..( 9): Matrix.004 file - promoters50/4772879
tttattgat

SEQ ID NO: 74001 - DNA, 9 bp, Unknown
  misc_feature (1)..( 9): Matrix.004 file - promoters50/4772879
aatttattt

SEQ ID NO: 74002 - DNA, 9 bp, Unknown
  misc_feature (1)..( 9): Matrix.004 file - promoters50/4772879
aatttattt

SEQ ID NO: 74003 - DNA, 12 bp, Unknown
  misc_feature (1)..( 12): Matrix.004 file - promoters50/4772879
atgaatattaga

SEQ ID NO: 74004 - DNA, 12 bp, Unknown
  misc_feature (1)..( 12): Matrix.004 file - promoters50/4772879
tcataaaaaata

SEQ ID NO: 74005 - DNA, 8 bp, Unknown
  misc_feature (1)..( 8): Matrix.004 file - promoters50/4772883
gaaaaaag

SEQ ID NO: 74006 - DNA, 13 bp, Unknown
  misc_feature (1)..( 13): Matrix.004 file - promoters50/4772883
aaaaaaaaaatca

SEQ ID NO: 74007 - DNA, 10 bp, Unknown
  misc_feature (1)..( 10): Matrix.004 file - promoters50/4772883
aaaatttgaa

SEQ ID NO: 74008 - DNA, 8 bp, Unknown
  misc_feature (1)..( 8): Matrix.004 file - promoters50/4772883
ttttttaa

SEQ ID NO: 74009 - DNA, 10 bp, Unknown
  misc_feature (1)..( 10): Matrix.004 file - promoters50/4772883
aaaaacaaaa

SEQ ID NO: 74010 - DNA, 12 bp, Unknown
  misc_feature (1)..( 12): Matrix.004 file - promoters50/4772883
aaaaacaaaaca

SEQ ID NO: 74011 - DNA, 10 bp, Unknown
  misc_feature (1)..( 10): Matrix.004 file - promoters50/4772887
atactaatgt

SEQ ID NO: 74012 - DNA, 10 bp, Unknown
  misc_feature (1)..( 10): Matrix.004 file - promoters50/4772917
ttttctatta

SEQ ID NO: 74013 - DNA, 7 bp, Unknown
  misc_feature (1)..( 7): Matrix.004 file - promoters50/4772917
cataaac

SEQ ID NO: 74014 - DNA, 10 bp, Unknown
  misc_feature (1)..( 10): Matrix.004 file - promoters50/4772925
tctctcttat

SEQ ID NO: 74015 - DNA, 7 bp, Unknown
  misc_feature (1)..( 7): Matrix.004 file - promoters50/4772925
atgtttt

SEQ ID NO: 74016 - DNA, 10 bp, Unknown
  misc_feature (1)..( 10): Matrix.004 file - promoters50/4772925
ttgtaataaa

SEQ ID NO: 74017 - DNA, 9 bp, Unknown
  misc_feature (1)..( 9): Matrix.004 file - promoters50/4772947
gttatatgt

SEQ ID NO: 74018 - DNA, 7 bp, Unknown
  misc_feature (1)..( 7): Matrix.004 file - promoters50/4772947
aaactaa

SEQ ID NO: 74019 - DNA, 9 bp, Unknown
  misc_feature (1)..( 9): Matrix.004 file - promoters50/4772983
agtttttct

SEQ ID NO: 74020 - DNA, 9 bp, Unknown
  misc_feature (1)..( 9): Matrix.004 file - promoters50/4772983
tgcaaagag

SEQ ID NO: 74021 - DNA, 11 bp, Unknown
  misc_feature (1)..( 11): Matrix.004 file - promoters50/4772991
gaagcttgcgg

SEQ ID NO: 74022 - DNA, 7 bp, Unknown
  misc_feature (1)..( 7): Matrix.004 file - promoters50/4772991
cttggat

SEQ ID NO: 74023 - DNA, 10 bp, Unknown
  misc_feature (1)..( 10): Matrix.004 file - promoters50/4772995
ttataaattt

SEQ ID NO: 74024 - DNA, 6 bp, Unknown
  misc_feature (1)..( 6): Matrix.004 file - promoters50/4772995
tttgat

SEQ ID NO: 74025 - DNA, 10 bp, Unknown
  misc_feature (1)..( 10): Matrix.004 file - promoters50/4773015
ccaaattaac

SEQ ID NO: 74026 - DNA, 10 bp, Unknown
  misc_feature (1)..( 10): Matrix.004 file - promoters50/4773035
accaaaaaaa

SEQ ID NO: 74027 - DNA, 10 bp, Unknown
  misc_feature (1)..( 10): Matrix.004 file - promoters50/4773035
ttacaaaaaa

SEQ ID NO: 74028 - DNA, 14 bp, Unknown
  misc_feature (1)..( 14): Matrix.004 file - promoters50/4773046
ttattaaaattatt

SEQ ID NO: 74029 - DNA, 8 bp, Unknown
  misc_feature (1)..( 8): Matrix.004 file - promoters50/4773068
aattgttt

SEQ ID NO: 74030 - DNA, 8 bp, Unknown
  misc_feature (1)..( 8): Matrix.004 file - promoters50/4773068
ttcttgcc

SEQ ID NO: 74031 - DNA, 31 bp, Unknown; identical to SEQ ID NO: 72331
  misc_feature (1)..( 31): Matrix.004 file - promoters50/4773068

SEQ ID NO: 74032 - DNA, 30 bp, Unknown; identical to SEQ ID NO: 71939
  misc_feature (1)..( 30): Matrix.004 file - promoters50/4773068

SEQ ID NO: 74033 - DNA, 15 bp, Unknown
  misc_feature (1)..( 15): Matrix.004 file - promoters50/4773068
cgccttagctttctc

SEQ ID NO: 74034 - DNA, 22 bp, Unknown
  misc_feature (1)..( 22): Matrix.004 file - promoters50/4773068
gaccgagtcgtcctcgtctttt

SEQ ID NO: 74035 - DNA, 19 bp, Unknown
  misc_feature (1)..( 19): Matrix.004 file - promoters50/4773068
ttcttcttctataaaacaa

SEQ ID NO: 74036 - DNA, 9 bp, Unknown
  misc_feature (1)..( 9): Matrix.004 file - promoters50/4773068
caaaaaaac

SEQ ID NO: 74037 - DNA, 6 bp, Unknown
  misc_feature (1)..( 6): Matrix.004 file - promoters50/4773074
aaaaca

SEQ ID NO: 74038 - DNA, 7 bp, Unknown
  misc_feature (1)..( 7): Matrix.004 file - promoters50/4773074
tctataa

SEQ ID NO: 74039 - DNA, 9 bp, Unknown
  misc_feature (1)..( 9): Matrix.004 file - promoters50/4773085
aaaaaccct

SEQ ID NO: 74040 - DNA, 10 bp, Unknown
  misc_feature (1)..( 10): Matrix.004 file - promoters50/4773085
actaaggaaa

SEQ ID NO: 74041 - DNA, 10 bp, Unknown
  misc_feature (1)..( 10): Matrix.004 file - promoters50/4773085
agaaagaaat

SEQ ID NO: 74042 - DNA, 8 bp, Unknown
  misc_feature (1)..( 8): Matrix.004 file - promoters50/4773085
tatataaa

SEQ ID NO: 74043 - DNA, 8 bp, Unknown
  misc_feature (1)..( 8): Matrix.004 file - promoters50/4773085
tctaatct

SEQ ID NO: 74044 - DNA, 8 bp, Unknown
  misc_feature (1)..( 8): Matrix.004 file - promoters50/4773089
actaaata

SEQ ID NO: 74045 - DNA, 10 bp, Unknown
  misc_feature (1)..( 10): Matrix.004 file - promoters50/4773089
aaaaataagc

SEQ ID NO: 74046 - DNA, 8 bp, Unknown
  misc_feature (1)..( 8): Matrix.004 file - promoters50/4773089
taaataat

SEQ ID NO: 74047 - DNA, 17 bp, Unknown
  misc_feature (1)..( 17): Matrix.004 file - promoters50/4773089
tttaaatttatcataca

SEQ ID NO: 74048 - DNA, 8 bp, Unknown
  misc_feature (1)..( 8): Matrix.004 file - promoters50/4773093
aataaatt

SEQ ID NO: 74049 - DNA, 8 bp, Unknown
  misc_feature (1)..( 8): Matrix.004 file - promoters50/4773093
tttgatat

SEQ ID NO: 74050 - DNA, 8 bp, Unknown
  misc_feature (1)..( 8): Matrix.004 file - promoters50/4773093
tttccatc

SEQ ID NO: 74051 - DNA, 9 bp, Unknown
  misc_feature (1)..( 9): Matrix.004 file - promoters50/4773093
gattttttt

SEQ ID NO: 74052 - DNA, 7 bp, Unknown
  misc_feature (1)..( 7): Matrix.004 file - promoters50/4773093
tgatttt

SEQ ID NO: 74053 - DNA, 10 bp, Unknown
  misc_feature (1)..( 10): Matrix.004 file - promoters50/4773093
tttctctctt

SEQ ID NO: 74054 - DNA, 11 bp, Unknown
  misc_feature (1)..( 11): Matrix.004 file - promoters50/4773101
gaaacttcaaa

SEQ ID NO: 74055 - DNA, 8 bp, Unknown
  misc_feature (1)..( 8): Matrix.004 file - promoters50/4773108
taaaattt

SEQ ID NO: 74056 - DNA, 11 bp, Unknown
  misc_feature (1)..( 11): Matrix.004 file - promoters50/4773108
gttgaattttt

SEQ ID NO: 74057 - DNA, 7 bp, Unknown
  misc_feature (1)..( 7): Matrix.004 file - promoters50/4773112
cacagtt

SEQ ID NO: 74058 - DNA, 9 bp, Unknown
  misc_feature (1)..( 9): Matrix.004 file - promoters50/4773112
tgttaattt

SEQ ID NO: 74059 - DNA, 8 bp, Unknown
  misc_feature (1)..( 8): Matrix.004 file - promoters50/4773121
cattcgga

SEQ ID NO: 74060 - DNA, 7 bp, Unknown
  misc_feature (1)..( 7): Matrix.004 file - promoters50/4773124
caaaaac

SEQ ID NO: 74061 - DNA, 8 bp, Unknown
  misc_feature (1)..( 8): Matrix.004 file - promoters50/4773124
tgatcttt

SEQ ID NO: 74062 - DNA, 8 bp, Unknown
  misc_feature (1)..( 8): Matrix.004 file - promoters50/4773124
atctttag

SEQ ID NO: 74063 - DNA, 10 bp, Unknown
  misc_feature (1)..( 10): Matrix.004 file - promoters50/4773124
atatagaaat

SEQ ID NO: 74064 - DNA, 8 bp, Unknown
  misc_feature (1)..( 8): Matrix.004 file - promoters50/4773124
aatatatt

SEQ ID NO: 74065 - DNA, 7 bp, Unknown
  misc_feature (1)..( 7): Matrix.004 file - promoters50/4773127
ttctaat

SEQ ID NO: 74066 - DNA, 11 bp, Unknown
  misc_feature (1)..( 11): Matrix.004 file - promoters50/4773134
atttaaatatt

SEQ ID NO: 74067 - DNA, 14 bp, Unknown
  misc_feature (1)..( 14): Matrix.004 file - promoters50/4773134
atttaatagtcatt

SEQ ID NO: 74068 - DNA, 8 bp, Unknown
  misc_feature (1)..( 8): Matrix.004 file - promoters50/4773134
aattttgg

SEQ ID NO: 74069 - DNA, 9 bp, Unknown
  misc_feature (1)..( 9): Matrix.004 file - promoters50/4773134
tatatttgt

SEQ ID NO: 74070 - DNA, 8 bp, Unknown
  misc_feature (1)..( 8): Matrix.004 file - promoters50/4773134
tatttttt

SEQ ID NO: 74071 - DNA, 8 bp, Unknown
  misc_feature (1)..( 8): Matrix.004 file - promoters50/4773142
attacaca

SEQ ID NO: 74072 - DNA, 9 bp, Unknown
  misc_feature (1)..( 9): Matrix.004 file - promoters50/4773142
ggttataaa

SEQ ID NO: 74073 - DNA, 15 bp, Unknown
  misc_feature (1)..( 15): Matrix.004 file - promoters50/4773182
aaacacataatcttt

SEQ ID NO: 74074 - DNA, 10 bp, Unknown
  misc_feature (1)..( 10): Matrix.004 file - promoters50/4773182
aattttaaaa

SEQ ID NO: 74075 - DNA, 13 bp, Unknown
  misc_feature (1)..( 13): Matrix.004 file - promoters50/4773185
ttttaaaataaaa

SEQ ID NO: 74076 - DNA, 7 bp, Unknown
  misc_feature (1)..( 7): Matrix.004 file - promoters50/4773185
aataatt

SEQ ID NO: 74077 - DNA, 8 bp, Unknown
  misc_feature (1)..( 8): Matrix.004 file - promoters50/4773185
aatcataa

SEQ ID NO: 74078 - DNA, 13 bp, Unknown
  misc_feature (1)..( 13): Matrix.004 file - promoters50/4773185
aacttcttaattt

SEQ ID NO: 74079 - DNA, 12 bp, Unknown
  misc_feature (1)..( 12): Matrix.004 file - promoters50/4773185
aaattattttaa

SEQ ID NO: 74080 - DNA, 10 bp, Unknown
  misc_feature (1)..( 10): Matrix.004 file - promoters50/4773185
acaaaaattg

SEQ ID NO: 74081 - DNA, 11 bp, Unknown
  misc_feature (1)..( 11): Matrix.004 file - promoters50/4773205
attttataata

SEQ ID NO: 74082 - DNA, 8 bp, Unknown
  misc_feature (1)..( 8): Matrix.004 file - promoters50/4773205
gatggtta

SEQ ID NO: 74083 - DNA, 8 bp, Unknown
  misc_feature (1)..( 8): Matrix.004 file - promoters50/4773205
taaaaaga

SEQ ID NO: 74084 - DNA, 8 bp, Unknown
  misc_feature (1)..( 8): Matrix.004 file - promoters50/4773205
ttctctct

SEQ ID NO: 74085 - DNA, 11 bp, Unknown
  misc_feature (1)..( 11): Matrix.004 file - promoters50/4773205
ataaataatta

SEQ ID NO: 74086 - DNA, 10 bp, Unknown
  misc_feature (1)..( 10): Matrix.004 file - promoters50/4773205
aaaacaattt

SEQ ID NO: 74087 - DNA, 7 bp, Unknown
  misc_feature (1)..( 7): Matrix.004 file - promoters50/4773225
gataact

SEQ ID NO: 74088 - DNA, 9 bp, Unknown
  misc_feature (1)..( 9): Matrix.004 file - promoters50/4773225
atttagctt

SEQ ID NO: 74089 - DNA, 7 bp, Unknown
  misc_feature (1)..( 7): Matrix.004 file - promoters50/4773225
ctgaaaa

SEQ ID NO: 74090 - DNA, 9 bp, Unknown
  misc_feature (1)..( 9): Matrix.004 file - promoters50/4773249
aaaaaataa

SEQ ID NO: 74091 - DNA, 8 bp, Unknown
  misc_feature (1)..( 8): Matrix.004 file - promoters50/4773299
tttcaatg

SEQ ID NO: 74092 - DNA, 8 bp, Unknown
  misc_feature (1)..( 8): Matrix.004 file - promoters50/4773299
atcttctt

SEQ ID NO: 74093 - DNA, 16 bp, Unknown
  misc_feature (1)..( 16): Matrix.004 file - promoters50/4773323
gtaagattaaccttga

SEQ ID NO: 74094 - DNA, 7 bp, Unknown
  misc_feature (1)..( 7): Matrix.004 file - promoters50/4773323
tttaata

SEQ ID NO: 74095 - DNA, 7 bp, Unknown
  misc_feature (1)..( 7): Matrix.004 file - promoters50/4773331
attaata

SEQ ID NO: 74096 - DNA, 9 bp, Unknown
  misc_feature (1)..( 9): Matrix.004 file - promoters50/4773331
taatcaaat

SEQ ID NO: 74097 - DNA, 15 bp, Unknown
  misc_feature (1)..( 15): Matrix.004 file - promoters50/4773331
tccagaagaaaattc

SEQ ID NO: 74098 - DNA, 9 bp, Unknown
  misc_feature (1)..( 9): Matrix.004 file - promoters50/4773351
gaaatgaag

SEQ ID NO: 74099 - DNA, 8 bp, Unknown
  misc_feature (1)..( 8): Matrix.004 file - promoters50/4773355
ataaagag

SEQ ID NO: 74100 - DNA, 11 bp, Unknown
  misc_feature (1)..( 11): Matrix.004 file - promoters50/4773384
ttacttttaac

SEQ ID NO: 74101 - DNA, 9 bp, Unknown
  misc_feature (1)..( 9): Matrix.004 file - promoters50/4773384
agaaaaaga

SEQ ID NO: 74102 - DNA, 8 bp, Unknown
  misc_feature (1)..( 8): Matrix.004 file - promoters50/4773384
aaataata

SEQ ID NO: 74103 - DNA, 9 bp, Unknown
  misc_feature (1)..( 9): Matrix.004 file - promoters50/4773384
taatttatt

SEQ ID NO: 74104 - DNA, 7 bp, Unknown
  misc_feature (1)..( 7): Matrix.004 file - promoters50/4773384
tttcaat

SEQ ID NO: 74105 - DNA, 8 bp, Unknown
  misc_feature (1)..( 8): Matrix.004 file - promoters50/4773384
acatatta

SEQ ID NO: 74106 - DNA, 7 bp, Unknown
  misc_feature (1)..( 7): Matrix.004 file - promoters50/4773384
taagaaa

SEQ ID NO: 74107 - DNA, 7 bp, Unknown
  misc_feature (1)..( 7): Matrix.004 file - promoters50/4773384
catatta

SEQ ID NO: 74108 - DNA, 8 bp, Unknown
  misc_feature (1)..( 8): Matrix.004 file - promoters50/4773384
gaacaaaa

SEQ ID NO: 74109 - DNA, 7 bp, Unknown
  misc_feature (1)..( 7): Matrix.004 file - promoters50/4773384
tttatta

SEQ ID NO: 74110 - DNA, 8 bp, Unknown
  misc_feature (1)..( 8): Matrix.004 file - promoters50/4773392
agaaaaaa

SEQ ID NO: 74111 - DNA, 9 bp, Unknown
  misc_feature (1)..( 9): Matrix.004 file - promoters50/4773400
aaaacaaaa

SEQ ID NO: 74112 - DNA, 10 bp, Unknown
  misc_feature (1)..( 10): Matrix.004 file - promoters50/4773400
gaaataaaac

SEQ ID NO: 74113 - DNA, 7 bp, Unknown
  misc_feature (1)..( 7): Matrix.004 file - promoters50/4773793
tatttgc

SEQ ID NO: 74114 - DNA, 8 bp, Unknown
  misc_feature (1)..( 8): Matrix.004 file - promoters50/4773795
aataagat

SEQ ID NO: 74115 - DNA, 9 bp, Unknown
  misc_feature (1)..( 9): Matrix.004 file - promoters50/4773819
atttaattt

SEQ ID NO: 74116 - DNA, 11 bp, Unknown
  misc_feature (1)..( 11): Matrix.004 file - promoters50/4773819
aagataattaa

SEQ ID NO: 74117 - DNA, 11 bp, Unknown
  misc_feature (1)..( 11): Matrix.004 file - promoters50/4773819
tgtttaaaaag

SEQ ID NO: 74118 - DNA, 9 bp, Unknown
  misc_feature (1)..( 9): Matrix.004 file - promoters50/4773823
gatgctttt

SEQ ID NO: 74119 - DNA, 9 bp, Unknown
  misc_feature (1)..( 9): Matrix.004 file - promoters50/4773836
taaaaacaa

SEQ ID NO: 74120 - DNA, 9 bp, Unknown
  misc_feature (1)..( 9): Matrix.004 file - promoters50/4773836
atttatcat

SEQ ID NO: 74121 - DNA, 9 bp, Unknown
  misc_feature (1)..( 9): Matrix.004 file - promoters50/4773846
gtcaaaaaa

SEQ ID NO: 74122 - DNA, 10 bp, Unknown
  misc_feature (1)..( 10): Matrix.004 file - promoters50/4773846
tatgaaaaaa

SEQ ID NO: 74123 - DNA, 9 bp, Unknown
  misc_feature (1)..( 9): Matrix.004 file - promoters50/4773846
atatatttt

SEQ ID NO: 74124 - DNA, 8 bp, Unknown
  misc_feature (1)..( 8): Matrix.004 file - promoters50/4773846
aatacaaa

SEQ ID NO: 74125 - DNA, 9 bp, Unknown
  misc_feature (1)..( 9): Matrix.004 file - promoters50/4773846
attttatct

SEQ ID NO: 74126 - DNA, 7 bp, Unknown
  misc_feature (1)..( 7): Matrix.004 file - promoters50/4773846
acagcaa

SEQ ID NO: 74127 - DNA, 8 bp, Unknown
  misc_feature (1)..( 8): Matrix.004 file - promoters50/4773846
aattaaaa

SEQ ID NO: 74128 - DNA, 13 bp, Unknown
  misc_feature (1)..( 13): Matrix.004 file - promoters50/4773846
attagatacttta

SEQ ID NO: 74129 - DNA, 8 bp, Unknown
  misc_feature (1)..( 8): Matrix.004 file - promoters50/4773846
attcaaat

SEQ ID NO: 74130 - DNA, 9 bp, Unknown
  misc_feature (1)..( 9): Matrix.004 file - promoters50/4773846
aaattcaaa

SEQ ID NO: 74131 - DNA, 9 bp, Unknown
  misc_feature (1)..( 9): Matrix.004 file - promoters50/4773846
aatatttat

SEQ ID NO: 74132 - DNA, 7 bp, Unknown
  misc_feature (1)..( 7): Matrix.004 file - promoters50/4773846
aaagata

SEQ ID NO: 74133 - DNA, 7 bp, Unknown
  misc_feature (1)..( 7): Matrix.004 file - promoters50/4773846
tatctat

SEQ ID NO: 74134 - DNA, 8 bp, Unknown
  misc_feature (1)..( 8): Matrix.004 file - promoters50/4773846
taactata

SEQ ID NO: 74135 - DNA, 10 bp, Unknown
  misc_feature (1)..( 10): Matrix.004 file - promoters50/4773846
atgcatgtaa

SEQ ID NO: 74136 - DNA, 9 bp, Unknown
  misc_feature (1)..( 9): Matrix.004 file - promoters50/4773846
aataaatat

SEQ ID NO: 74137 - DNA, 8 bp, Unknown
  misc_feature (1)..( 8): Matrix.004 file - promoters50/4801635
aattaaaa

SEQ ID NO: 74138 - DNA, 12 bp, Unknown
  misc_feature (1)..( 12): Matrix.004 file - promoters50/4801635
aactgaaatttt

SEQ ID NO: 74139 - DNA, 12 bp, Unknown
  misc_feature (1)..( 12): Matrix.004 file - promoters50/4801635
caactagaaaac

SEQ ID NO: 74140 - DNA, 7 bp, Unknown
  misc_feature (1)..( 7): Matrix.004 file - promoters50/4801635
tgtattt

SEQ ID NO: 74141 - DNA, 9 bp, Unknown
  misc_feature (1)..( 9): Matrix.004 file - promoters50/4801635
tttgaaaca

SEQ ID NO: 74142 - DNA, 9 bp, Unknown
  misc_feature (1)..( 9): Matrix.004 file - promoters50/4801635
ttaagaaaa

SEQ ID NO: 74143 - DNA, 10 bp, Unknown
  misc_feature (1)..( 10): Matrix.004 file - promoters50/4801635
acaactagaa

SEQ ID NO: 74144 - DNA, 13 bp, Unknown
  misc_feature (1)..( 13): Matrix.004 file - promoters50/4801635
ataacaccattat

SEQ ID NO: 74145 - DNA, 14 bp, Unknown
  misc_feature (1)..( 14): Matrix.004 file - promoters50/4801635
ctttatctcatctt

SEQ ID NO: 74146 - DNA, 6 bp, Unknown
  misc_feature (1)..( 6): Matrix.004 file - promoters50/4801635
aaaata

SEQ ID NO: 74147 - DNA, 12 bp, Unknown
  misc_feature (1)..( 12): Matrix.004 file - promoters50/4802537
atttttagttca

SEQ ID NO: 74148 - DNA, 10 bp, Unknown
  misc_feature (1)..( 10): Matrix.004 file - promoters50/4803329
tatattaaag

SEQ ID NO: 74149 - DNA, 8 bp, Unknown
  misc_feature (1)..( 8): Matrix.004 file - promoters50/4803329
aaaaaaca

SEQ ID NO: 74150 - DNA, 10 bp, Unknown
  misc_feature (1)..( 10): Matrix.004 file - promoters50/4803329
caaaaaatat

SEQ ID NO: 74151 - DNA, 11 bp, Unknown
  misc_feature (1)..( 11): Matrix.004 file - promoters50/4803451
gaagacaaaaa

SEQ ID NO: 74152 - DNA, 8 bp, Unknown
  misc_feature (1)..( 8): Matrix.004 file - promoters50/4803451
cttataaa

SEQ ID NO: 74153 - DNA, 8 bp, Unknown
  misc_feature (1)..( 8): Matrix.004 file - promoters50/4806023
tataaatt

SEQ ID NO: 74154 - DNA, 10 bp, Unknown
  misc_feature (1)..( 10): Matrix.004 file - promoters50/4806023
atcttgattt

SEQ ID NO: 74155 - DNA, 7 bp, Unknown
  misc_feature (1)..( 7): Matrix.004 file - promoters50/4806023
gaccgtt

SEQ ID NO: 74156 - DNA, 9 bp, Unknown
  misc_feature (1)..( 9): Matrix.004 file - promoters50/4806023
cagctttag

SEQ ID NO: 74157 - DNA, 6 bp, Unknown
  misc_feature (1)..( 6): Matrix.004 file - promoters50/4807018
ggccca

SEQ ID NO: 74158 - DNA, 11 bp, Unknown
  misc_feature (1)..( 11): Matrix.004 file - promoters50/4807026
tgaaaatttat

SEQ ID NO: 74159 - DNA, 10 bp, Unknown
  misc_feature (1)..( 10): Matrix.004 file - promoters50/4807026
atcaaaaatt

SEQ ID NO: 74160 - DNA, 15 bp, Unknown
  misc_feature (1)..( 15): Matrix.004 file - promoters50/4807026
aaaaaaaaacatatt

SEQ ID NO: 74161 - DNA, 9 bp, Unknown
  misc_feature (1)..( 9): Matrix.004 file - promoters50/4807026
tgtaaaatt

SEQ ID NO: 74162 - DNA, 10 bp, Unknown
  misc_feature (1)..( 10): Matrix.004 file - promoters50/4807026
tctaaaaata

SEQ ID NO: 74163 - DNA, 10 bp, Unknown
  misc_feature (1)..( 10): Matrix.004 file - promoters50/4807026
cttaattaaa

SEQ ID NO: 74164 - DNA, 9 bp, Unknown
  misc_feature (1)..( 9): Matrix.004 file - promoters50/4807054
aattaatat

SEQ ID NO: 74165 - DNA, 9 bp, Unknown
  misc_feature (1)..( 9): Matrix.004 file - promoters50/4807258
atttattaa

SEQ ID NO: 74166 - DNA, 8 bp, Unknown
  misc_feature (1)..( 8): Matrix.004 file - promoters50/4807258
acttgttg

SEQ ID NO: 74167 - DNA, 8 bp, Unknown
  misc_feature (1)..( 8): Matrix.004 file - promoters50/4807258
ttttttgt

SEQ ID NO: 74168 - DNA, 10 bp, Unknown
  misc_feature (1)..( 10): Matrix.004 file - promoters50/4809022
actatttaat

SEQ ID NO: 74169 - DNA, 7 bp, Unknown
  misc_feature (1)..( 7): Matrix.004 file - promoters50/4809022
ttaccat

SEQ ID NO: 74170 - DNA, 6 bp, Unknown
  misc_feature (1)..( 6): Matrix.004 file - promoters50/4809022
aaaaat

SEQ ID NO: 74171 - DNA, 8 bp, Unknown
  misc_feature (1)..( 8): Matrix.004 file - promoters50/4809022
atcaaata

SEQ ID NO: 74172 - DNA, 9 bp, Unknown
  misc_feature (1)..( 9): Matrix.004 file - promoters50/4809022
tatataata

SEQ ID NO: 74173 - DNA, 11 bp, Unknown
  misc_feature (1)..( 11): Matrix.004 file - promoters50/4809801
aaactttgatt

SEQ ID NO: 74174 - DNA, 8 bp, Unknown
  misc_feature (1)..( 8): Matrix.004 file - promoters50/4809801
attgccat

SEQ ID NO: 74175 - DNA, 8 bp, Unknown
  misc_feature (1)..( 8): Matrix.004 file - promoters50/4809801
caaaatga

SEQ ID NO: 74176 - DNA, 8 bp, Unknown
  misc_feature (1)..( 8): Matrix.004 file - promoters50/4809801
ctttttgc

SEQ ID NO: 74177 - DNA, 7 bp, Unknown
  misc_feature (1)..( 7): Matrix.004 file - promoters50/4810509
agatctc

SEQ ID NO: 74178 - DNA, 12 bp, Unknown
  misc_feature (1)..( 12): Matrix.004 file - promoters50/4811341
agaaatttgtca

SEQ ID NO: 74179 - DNA, 9 bp, Unknown
  misc_feature (1)..( 9): Matrix.004 file - promoters50/4811854
atgtacata

SEQ ID NO: 74180 - DNA, 8 bp, Unknown
  misc_feature (1)..( 8): Matrix.004 file - promoters50/4811854
tctatatt

SEQ ID NO: 74181 - DNA, 8 bp, Unknown
  misc_feature (1)..( 8): Matrix.004 file - promoters50/4811854
atttcatt

SEQ ID NO: 74182 - DNA, 13 bp, Unknown
  misc_feature (1)..( 13): Matrix.004 file - promoters50/4811854
tttaaacctaaat

SEQ ID NO: 74183 - DNA, 11 bp, Unknown
  misc_feature (1)..( 11): Matrix.004 file - promoters50/4811854
aataattttta

SEQ ID NO: 74184 - DNA, 9 bp, Unknown
  misc_feature (1)..( 9): Matrix.004 file - promoters50/4811854
aaaagttaa

SEQ ID NO: 74185 - DNA, 10 bp, Unknown
  misc_feature (1)..( 10): Matrix.004 file - promoters50/4811854
ttatacatat

SEQ ID NO: 74186 - DNA, 9 bp, Unknown
  misc_feature (1)..( 9): Matrix.004 file - promoters50/4811975
attatatta

SEQ ID NO: 74187 - DNA, 8 bp, Unknown
  misc_feature (1)..( 8): Matrix.004 file - promoters50/4811975
attttttt

SEQ ID NO: 74188 - DNA, 7 bp, Unknown
  misc_feature (1)..( 7): Matrix.004 file - promoters50/4815093
cttgaaa

SEQ ID NO: 74189 - DNA, 9 bp, Unknown
  misc_feature (1)..( 9): Matrix.004 file - promoters50/4815135
gttgtacaa

SEQ ID NO: 74190 - DNA, 8 bp, Unknown
  misc_feature (1)..( 8): Matrix.004 file - promoters50/4815135
gacgaaaa

SEQ ID NO: 74191 - DNA, 8 bp, Unknown
  misc_feature (1)..( 8): Matrix.004 file - promoters50/4815135
accaaaaa

SEQ ID NO: 74192 - DNA, 7 bp, Unknown
  misc_feature (1)..( 7): Matrix.004 file - promoters50/4815135
ccacaaa

SEQ ID NO: 74193 - DNA, 10 bp, Unknown
  misc_feature (1)..( 10): Matrix.004 file - promoters50/4815135
caaatttgtt

SEQ ID NO: 74194 - DNA, 12 bp, Unknown
  misc_feature (1)..( 12): Matrix.004 file - promoters50/4816112
tttgttgtattc

SEQ ID NO: 74195 - DNA, 9 bp, Unknown
  misc_feature (1)..( 9): Matrix.004 file - promoters50/4816112
tttgatttt

SEQ ID NO: 74196 - DNA, 9 bp, Unknown
  misc_feature (1)..( 9): Matrix.004 file - promoters50/4854186
ttttgattt

SEQ ID NO: 74197 - DNA, 12 bp, Unknown
  misc_feature (1)..( 12): Matrix.004 file - promoters50/4854186
aacgaagaataa

SEQ ID NO: 74198 - DNA, 8 bp, Unknown
  misc_feature (1)..( 8): Matrix.004 file - promoters50/4854186
aaaaaata

SEQ ID NO: 74199 - DNA, 12 bp, Unknown
  misc_feature (1)..( 12): Matrix.004 file - promoters50/4854186
attaaaatataa

SEQ ID NO: 74200 - DNA, 13 bp, Unknown
  misc_feature (1)..( 13): Matrix.004 file - promoters50/4899797
tagtgactaaaaa

SEQ ID NO: 74201 - DNA, 9 bp, Unknown
  misc_feature (1)..( 9): Matrix.004 file - promoters50/4899797
tatttttgc

SEQ ID NO: 74202 - DNA, 8 bp, Unknown
  misc_feature (1)..( 8): Matrix.004 file - promoters50/4899822
taataaat

SEQ ID NO: 74203 - DNA, 11 bp, Unknown
  misc_feature (1)..( 11): Matrix.004 file - promoters50/4899822
agtaaataaaa

SEQ ID NO: 74204 - DNA, 9 bp, Unknown
  misc_feature (1)..( 9): Matrix.004 file - promoters50/4899830
ctattttca

SEQ ID NO: 74205 - DNA, 8 bp, Unknown
  misc_feature (1)..( 8): Matrix.004 file - promoters50/4899830
actatata

SEQ ID NO: 74206 - DNA, 9 bp, Unknown
  misc_feature (1)..( 9): Matrix.004 file - promoters50/4899830
gaaaaaaat

SEQ ID NO: 74207 - DNA, 10 bp, Unknown
  misc_feature (1)..( 10): Matrix.004 file - promoters50/4899830
gaaaaattaa

SEQ ID NO: 74208 - DNA, 8 bp, Unknown
  misc_feature (1)..( 8): Matrix.004 file - promoters50/4899830
tatagtaa

SEQ ID NO: 74209 - DNA, 10 bp, Unknown
  misc_feature (1)..( 10): Matrix.004 file - promoters50/4899830
gaaaaaaaat

SEQ ID NO: 74210 - DNA, 5 bp, Unknown
  misc_feature (1)..( 5): Matrix.004 file - promoters50/4899858
ttctt

SEQ ID NO: 74211 - DNA, 7 bp, Unknown
  misc_feature (1)..( 7): Matrix.004 file - promoters50/4899858
tttttgg

SEQ ID NO: 74212 - DNA, 10 bp, Unknown
  misc_feature (1)..( 10): Matrix.004 file - promoters50/4899858
gcaaagaaca

SEQ ID NO: 74213 - DNA, 8 bp, Unknown
  misc_feature (1)..( 8): Matrix.004 file - promoters50/4899858
ttttcaat

SEQ ID NO: 74214 - DNA, 11 bp, Unknown
  misc_feature (1)..( 11): Matrix.004 file - promoters50/4899880
accactcaatt

SEQ ID NO: 74215 - DNA, 8 bp, Unknown
  misc_feature (1)..( 8): Matrix.004 file - promoters50/4899880
atttttag

SEQ ID NO: 74216 - DNA, 6 bp, Unknown
  misc_feature (1)..( 6): Matrix.004 file - promoters50/4899880
tttgta

SEQ ID NO: 74217 - DNA, 6 bp, Unknown
  misc_feature (1)..( 6): Matrix.004 file - promoters50/4899880
taaaat

SEQ ID NO: 74218 - DNA, 7 bp, Unknown
  misc_feature (1)..( 7): Matrix.004 file - promoters50/4899880
ttaatat

SEQ ID NO: 74219 - DNA, 7 bp, Unknown
  misc_feature (1)..( 7): Matrix.004 file - promoters50/4899880
aattcca

SEQ ID NO: 74220 - DNA, 8 bp, Unknown
  misc_feature (1)..( 8): Matrix.004 file - promoters50/4899880
ctttggaa

SEQ ID NO: 74221 - DNA, 8 bp, Unknown
  misc_feature (1)..( 8): Matrix.004 file - promoters50/4899993
actacgag

SEQ ID NO: 74222 - DNA, 10 bp, Unknown
  misc_feature (1)..( 10): Matrix.004 file - promoters50/4899993
atgaaagagt

SEQ ID NO: 74223 - DNA, 9 bp, Unknown
  misc_feature (1)..( 9): Matrix.004 file - promoters50/4900035
ccgtcaaaa

SEQ ID NO: 74224 - DNA, 8 bp, Unknown
  misc_feature (1)..( 8): Matrix.004 file - promoters50/4900121
cattacaa

SEQ ID NO: 74225 - DNA, 9 bp, Unknown
  misc_feature (1)..( 9): Matrix.004 file - promoters50/4900121
aaagagatt

SEQ ID NO: 74226 - DNA, 7 bp, Unknown
  misc_feature (1)..( 7): Matrix.004 file - promoters50/4900121
aaaaaaa

SEQ ID NO: 74227 - DNA, 8 bp, Unknown
  misc_feature (1)..( 8): Matrix.004 file - promoters50/4900121
atttattt

SEQ ID NO: 74228 - DNA, 10 bp, Unknown
  misc_feature (1)..( 10): Matrix.004 file - promoters50/4900121
atatttataa

SEQ ID NO: 74229 - DNA, 9 bp, Unknown
  misc_feature (1)..( 9): Matrix.004 file - promoters50/4900121
tgttttgta

SEQ ID NO: 74230 - DNA, 9 bp, Unknown
  misc_feature (1)..( 9): Matrix.004 file - promoters50/4900121
tgtatattt

SEQ ID NO: 74231 - DNA, 10 bp, Unknown
  misc_feature (1)..( 10): Matrix.004 file - promoters50/4900121
aaaccttctg

SEQ ID NO: 74232 - DNA, 8 bp, Unknown
  misc_feature (1)..( 8): Matrix.004 file - promoters50/4900121
atttgtac

SEQ ID NO: 74233 - DNA, 9 bp, Unknown
  misc_feature (1)..( 9): Matrix.004 file - promoters50/4900213
caaaaaaca

SEQ ID NO: 74234 - DNA, 8 bp, Unknown
  misc_feature (1)..( 8): Matrix.004 file - promoters50/4900213
acttaagt

SEQ ID NO: 74235 - DNA, 8 bp, Unknown
  misc_feature (1)..( 8): Matrix.004 file - promoters50/4900213
tgattaaa

SEQ ID NO: 74236 - DNA, 7 bp, Unknown
  misc_feature (1)..( 7): Matrix.004 file - promoters50/4900213
taaattt

SEQ ID NO: 74237 - DNA, 8 bp, Unknown
  misc_feature (1)..( 8): Matrix.004 file - promoters50/4900353
accaaaaa

SEQ ID NO: 74238 - DNA, 9 bp, Unknown
  misc_feature (1)..( 9): Matrix.004 file - promoters50/4900353
accattttt

SEQ ID NO: 74239 - DNA, 11 bp, Unknown
  misc_feature (1)..( 11): Matrix.004 file - promoters50/4900353
taatatatata

SEQ ID NO: 74240 - DNA, 14 bp, Unknown
  misc_feature (1)..( 14): Matrix.004 file - promoters50/4900353
agtgattcttatta

SEQ ID NO: 74241 - DNA, 5 bp, Unknown
  misc_feature (1)..( 5): Matrix.004 file - promoters50/4900353
aaaat

SEQ ID NO: 74242 - DNA, 15 bp, Unknown
  misc_feature (1)..( 15): Matrix.004 file - promoters50/4900417
aaatataatttattt

SEQ ID NO: 74243 - DNA, 11 bp, Unknown
  misc_feature (1)..( 11): Matrix.004 file - promoters50/4900417
aattttaatta

SEQ ID NO: 74244 - DNA, 10 bp, Unknown
  misc_feature (1)..( 10): Matrix.004 file - promoters50/4900417
ttgagaaaag

SEQ ID NO: 74245 - DNA, 11 bp, Unknown
  misc_feature (1)..( 11): Matrix.004 file - promoters50/4900417
ataatataaga

SEQ ID NO: 74246 - DNA, 7 bp, Unknown
  misc_feature (1)..( 7): Matrix.004 file - promoters50/4900417
tataaga

SEQ ID NO: 74247 - DNA, 12 bp, Unknown
  misc_feature (1)..( 12): Matrix.004 file - promoters50/4900417
attttcaaattt

SEQ ID NO: 74248 - DNA, 7 bp, Unknown
  misc_feature (1)..( 7): Matrix.004 file - promoters50/4900589
atttctt

SEQ ID NO: 74249 - DNA, 11 bp, Unknown
  misc_feature (1)..( 11): Matrix.004 file - promoters50/4900589
gtataaattga

SEQ ID NO: 74250 - DNA, 9 bp, Unknown
  misc_feature (1)..( 9): Matrix.004 file - promoters50/4900589
caaaaagag

SEQ ID NO: 74251 - DNA, 9 bp, Unknown
  misc_feature (1)..( 9): Matrix.004 file - promoters50/4900589
tttgttttt

SEQ ID NO: 74252 - DNA, 8 bp, Unknown
  misc_feature (1)..( 8): Matrix.004 file - promoters50/4900589
tgaaacaa

SEQ ID NO: 74253 - DNA, 9 bp, Unknown
  misc_feature (1)..( 9): Matrix.004 file - promoters50/4900589
tatttattt

SEQ ID NO: 74254 - DNA, 8 bp, Unknown
  misc_feature (1)..( 8): Matrix.004 file - promoters50/4900589
gtaaatca

SEQ ID NO: 74255 - DNA, 8 bp, Unknown
  misc_feature (1)..( 8): Matrix.004 file - promoters50/4900589
tttgtttt

SEQ ID NO: 74256 - DNA, 13 bp, Unknown
  misc_feature (1)..( 13): Matrix.004 file - promoters50/4900589
aatccaaaatttg

SEQ ID NO: 74257 - DNA, 4 bp, Unknown
  misc_feature (1)..( 4): Matrix.004 file - promoters50/4900589
aaaa

SEQ ID NO: 74258 - DNA, 7 bp, Unknown
  misc_feature (1)..( 7): Matrix.004 file - promoters50/4900589
caaaaag

SEQ ID NO: 74259 - DNA, 8 bp, Unknown
  misc_feature (1)..( 8): Matrix.004 file - promoters50/4900589
tgggtttt

SEQ ID NO: 74260 - DNA, 8 bp, Unknown
  misc_feature (1)..( 8): Matrix.004 file - promoters50/4900643
ttttaatt

SEQ ID NO: 74261 - DNA, 8 bp, Unknown
  misc_feature (1)..( 8): Matrix.004 file - promoters50/4900643
tgtgggtt

SEQ ID NO: 74262 - DNA, 9 bp, Unknown
  misc_feature (1)..( 9): Matrix.004 file - promoters50/4900800
tttatttac

SEQ ID NO: 74263 - DNA, 9 bp, Unknown
  misc_feature (1)..( 9): Matrix.004 file - promoters50/4900800
caagaaaga

SEQ ID NO: 74264 - DNA, 13 bp, Unknown
  misc_feature (1)..( 13): Matrix.004 file - promoters50/4900939
aaatgcacgaaga

SEQ ID NO: 74265 - DNA, 11 bp, Unknown
  misc_feature (1)..( 11): Matrix.004 file - promoters50/4901133
aaaatcaaata

SEQ ID NO: 74266 - DNA, 16 bp, Unknown
  misc_feature (1)..( 16): Matrix.004 file - promoters50/4901133
taatttatgttttaat

SEQ ID NO: 74267 - DNA, 10 bp, Unknown
  misc_feature (1)..( 10): Matrix.004 file - promoters50/4901149
atttcaaaac

SEQ ID NO: 74268 - DNA, 8 bp, Unknown
  misc_feature (1)..( 8): Matrix.004 file - promoters50/4901149
aatttctt

SEQ ID NO: 74269 - DNA, 9 bp, Unknown
  misc_feature (1)..( 9): Matrix.004 file - promoters50/4901149
aatgaaaat

SEQ ID NO: 74270 - DNA, 7 bp, Unknown
  misc_feature (1)..( 7): Matrix.004 file - promoters50/4901149
tctaata

SEQ ID NO: 74271 - DNA, 8 bp, Unknown
  misc_feature (1)..( 8): Matrix.004 file - promoters50/4901149
ctctcctt

SEQ ID NO: 74272 - DNA, 8 bp, Unknown
  misc_feature (1)..( 8): Matrix.004 file - promoters50/4901149
tttaacaa

SEQ ID NO: 74273 - DNA, 8 bp, Unknown
  misc_feature (1)..( 8): Matrix.004 file - promoters50/4901149
ttttcttt

SEQ ID NO: 74274 - DNA, 7 bp, Unknown
  misc_feature (1)..( 7): Matrix.004 file - promoters50/4901149
agatata

SEQ ID NO: 74275 - DNA, 8 bp, Unknown
  misc_feature (1)..( 8): Matrix.004 file - promoters50/4901225
ttactgtc

SEQ ID NO: 74276 - DNA, 10 bp, Unknown
  misc_feature (1)..( 10): Matrix.004 file - promoters50/4901241
acaaaacacg

SEQ ID NO: 74277 - DNA, 11 bp, Unknown
  misc_feature (1)..( 11): Matrix.004 file - promoters50/4901241
aattaaattta

SEQ ID NO: 74278 - DNA, 14 bp, Unknown
  misc_feature (1)..( 14): Matrix.004 file - promoters50/4901241
aaaaaaagatttaa

SEQ ID NO: 74279 - DNA, 12 bp, Unknown
  misc_feature (1)..( 12): Matrix.004 file - promoters50/4901241
agattaattaat

SEQ ID NO: 74280 - DNA, 10 bp, Unknown
  misc_feature (1)..( 10): Matrix.004 file - promoters50/4901241
cataattaaa

SEQ ID NO: 74281 - DNA, 10 bp, Unknown
  misc_feature (1)..( 10): Matrix.004 file - promoters50/4901241
aaatttttaa

SEQ ID NO: 74282 - DNA, 10 bp, Unknown
  misc_feature (1)..( 10): Matrix.004 file - promoters50/4901241
tgataaaaat

SEQ ID NO: 74283 - DNA, 12 bp, Unknown
  misc_feature (1)..( 12): Matrix.004 file - promoters50/4901241
tcaaatttgaaa

SEQ ID NO: 74284 - DNA, 10 bp, Unknown
  misc_feature (1)..( 10): Matrix.004 file - promoters50/4901241
atctgaaaaa

SEQ ID NO: 74285 - DNA, 6 bp, Unknown
  misc_feature (1)..( 6): Matrix.004 file - promoters50/4901241
aaagaa

SEQ ID NO: 74286 - DNA, 13 bp, Unknown
  misc_feature (1)..( 13): Matrix.004 file - promoters50/4901241
ataaaataaaaat

SEQ ID NO: 74287 - DNA, 17 bp, Unknown
  misc_feature (1)..( 17): Matrix.004 file - promoters50/4901241
aataaaaaatattttga

SEQ ID NO: 74288 - DNA, 9 bp, Unknown
  misc_feature (1)..( 9): Matrix.004 file - promoters50/4901241
gaaaaaata

SEQ ID NO: 74289 - DNA, 14 bp, Unknown
  misc_feature (1)..( 14): Matrix.004 file - promoters50/4901241
attaaaatataaat

SEQ ID NO: 74290 - DNA, 13 bp, Unknown
  misc_feature (1)..( 13): Matrix.004 file - promoters50/4901516
ttgaaatatattt

SEQ ID NO: 74291 - DNA, 14 bp, Unknown
  misc_feature (1)..( 14): Matrix.004 file - promoters50/4901516
gaaacaaaaacatt

SEQ ID NO: 74292 - DNA, 9 bp, Unknown
  misc_feature (1)..( 9): Matrix.004 file - promoters50/4901516
cccactaaa

SEQ ID NO: 74293 - DNA, 8 bp, Unknown
  misc_feature (1)..( 8): Matrix.004 file - promoters50/4901516
tatatatt

SEQ ID NO: 74294 - DNA, 10 bp, Unknown
  misc_feature (1)..( 10): Matrix.004 file - promoters50/4901528
aaataaaata

SEQ ID NO: 74295 - DNA, 12 bp, Unknown
  misc_feature (1)..( 12): Matrix.004 file - promoters50/4901564
taaattcaaaat

SEQ ID NO: 74296 - DNA, 16 bp, Unknown
  misc_feature (1)..( 16): Matrix.004 file - promoters50/4901564
atggataagcccatta

SEQ ID NO: 74297 - DNA, 12 bp, Unknown
  misc_feature (1)..( 12): Matrix.004 file - promoters50/4901568
attaagattatg

SEQ ID NO: 74298 - DNA, 9 bp, Unknown
  misc_feature (1)..( 9): Matrix.004 file - promoters50/4901568
gaagatgca

SEQ ID NO: 74299 - DNA, 6 bp, Unknown
  misc_feature (1)..( 6): Matrix.004 file - promoters50/4901568
tttgga

SEQ ID NO: 74300 - DNA, 11 bp, Unknown
  misc_feature (1)..( 11): Matrix.004 file - promoters50/4901592
gaaataaatga

SEQ ID NO: 74301 - DNA, 9 bp, Unknown
  misc_feature (1)..( 9): Matrix.004 file - promoters50/4901592
tttgttttg

SEQ ID NO: 74302 - DNA, 7 bp, Unknown
  misc_feature (1)..( 7): Matrix.004 file - promoters50/4901592
tttgttg

SEQ ID NO: 74303 - DNA, 8 bp, Unknown
  misc_feature (1)..( 8): Matrix.004 file - promoters50/4901673
atttgtaa

SEQ ID NO: 74304 - DNA, 7 bp, Unknown
  misc_feature (1)..( 7): Matrix.004 file - promoters50/4901673
aattcaa

SEQ ID NO: 74305 - DNA, 9 bp, Unknown
  misc_feature (1)..( 9): Matrix.004 file - promoters50/4901673
tatttaagc

SEQ ID NO: 74306 - DNA, 11 bp, Unknown
  misc_feature (1)..( 11): Matrix.004 file - promoters50/4901673
ttcctagctac

SEQ ID NO: 74307 - DNA, 8 bp, Unknown
  misc_feature (1)..( 8): Matrix.004 file - promoters50/4901736
attccata

SEQ ID NO: 74308 - DNA, 10 bp, Unknown
  misc_feature (1)..( 10): Matrix.004 file - promoters50/4901736
aaaattgttt

SEQ ID NO: 74309 - DNA, 13 bp, Unknown
  misc_feature (1)..( 13): Matrix.004 file - promoters50/4901736
taaatttttggtt

SEQ ID NO: 74310 - DNA, 10 bp, Unknown
  misc_feature (1)..( 10): Matrix.004 file - promoters50/4901793
aaggcccaaa

SEQ ID NO: 74311 - DNA, 8 bp, Unknown
  misc_feature (1)..( 8): Matrix.004 file - promoters50/4901822
taacttat

SEQ ID NO: 74312 - DNA, 10 bp, Unknown
  misc_feature (1)..( 10): Matrix.004 file - promoters50/4901822
tgaatcaata

SEQ ID NO: 74313 - DNA, 10 bp, Unknown
  misc_feature (1)..( 10): Matrix.004 file - promoters50/4901822
atggtttttg

SEQ ID NO: 74314 - DNA, 7 bp, Unknown
  misc_feature (1)..( 7): Matrix.004 file - promoters50/4901822
catgtga

SEQ ID NO: 74315 - DNA, 8 bp, Unknown
  misc_feature (1)..( 8): Matrix.004 file - promoters50/4901823
ttaacctt

SEQ ID NO: 74316 - DNA, 11 bp, Unknown
  misc_feature (1)..( 11): Matrix.004 file - promoters50/4901823
atttttttgtc

SEQ ID NO: 74317 - DNA, 10 bp, Unknown
  misc_feature (1)..( 10): Matrix.004 file - promoters50/4901842
ttgaattttt

SEQ ID NO: 74318 - DNA, 8 bp, Unknown
  misc_feature (1)..( 8): Matrix.004 file - promoters50/4901842
ggaagaaa

SEQ ID NO: 74319 - DNA, 7 bp, Unknown
  misc_feature (1)..( 7): Matrix.004 file - promoters50/4901842
caaataa

SEQ ID NO: 74320 - DNA, 8 bp, Unknown
  misc_feature (1)..( 8): Matrix.004 file - promoters50/4901884
taaagcaa

SEQ ID NO: 74321 - DNA, 9 bp, Unknown
  misc_feature (1)..( 9): Matrix.004 file - promoters50/4901884
aaaaaactt

SEQ ID NO: 74322 - DNA, 9 bp, Unknown
  misc_feature (1)..( 9): Matrix.004 file - promoters50/4901884
aaaaataat

SEQ ID NO: 74323 - DNA, 6 bp, Unknown
  misc_feature (1)..( 6): Matrix.004 file - promoters50/4902029
aaacaa

SEQ ID NO: 74324 - DNA, 10 bp, Unknown
  misc_feature (1)..( 10): Matrix.004 file - promoters50/4902029
ctttttattt

SEQ ID NO: 74325 - DNA, 7 bp, Unknown
  misc_feature (1)..( 7): Matrix.004 file - promoters50/4902029
cataaaa

SEQ ID NO: 74326 - DNA, 13 bp, Unknown
  misc_feature (1)..( 13): Matrix.004 file - promoters50/4902038
attaaatcttttt

SEQ ID NO: 74327 - DNA, 8 bp, Unknown
  misc_feature (1)..( 8): Matrix.004 file - promoters50/4902038
tgaaaact

SEQ ID NO: 74328 - DNA, 7 bp, Unknown
  misc_feature (1)..( 7): Matrix.004 file - promoters50/4902082
cacgaaa

SEQ ID NO: 74329 - DNA, 13 bp, Unknown
  misc_feature (1)..( 13): Matrix.004 file - promoters50/4902082
ttccttcacattg

SEQ ID NO: 74330 - DNA, 6 bp, Unknown
  misc_feature (1)..( 6): Matrix.004 file - promoters50/4902143
ataatt

SEQ ID NO: 74331 - DNA, 6 bp, Unknown
  misc_feature (1)..( 6): Matrix.004 file - promoters50/4902387
tggttt

SEQ ID NO: 74332 - DNA, 8 bp, Unknown
  misc_feature (1)..( 8): Matrix.004 file - promoters50/4902387
tataaaca

SEQ ID NO: 74333 - DNA, 9 bp, Unknown
  misc_feature (1)..( 9): Matrix.004 file - promoters50/4902425
aaatgttta

SEQ ID NO: 74334 - DNA, 9 bp, Unknown
  misc_feature (1)..( 9): Matrix.004 file - promoters50/4902456
ccactacat

SEQ ID NO: 74335 - DNA, 9 bp, Unknown
  misc_feature (1)..( 9): Matrix.004 file - promoters50/4902456
caatatctt

SEQ ID NO: 74336 - DNA, 9 bp, Unknown
  misc_feature (1)..( 9): Matrix.004 file - promoters50/4902456
gaaaaaaca

SEQ ID NO: 74337 - DNA, 9 bp, Unknown
  misc_feature (1)..( 9): Matrix.004 file - promoters50/4902456
aaaaataag

SEQ ID NO: 74338 - DNA, 7 bp, Unknown
  misc_feature (1)..( 7): Matrix.004 file - promoters50/4902456
aaaaaag

SEQ ID NO: 74339 - DNA, 8 bp, Unknown
  misc_feature (1)..( 8): Matrix.004 file - promoters50/4902456
agatatta

SEQ ID NO: 74340 - DNA, 8 bp, Unknown
  misc_feature (1)..( 8): Matrix.004 file - promoters50/4902456
aaatagat

SEQ ID NO: 74341 - DNA, 8 bp, Unknown
  misc_feature (1)..( 8): Matrix.004 file - promoters50/4902791
atttttat

SEQ ID NO: 74342 - DNA, 10 bp, Unknown
  misc_feature (1)..( 10): Matrix.004 file - promoters50/4903159
gccattttta

SEQ ID NO: 74343 - DNA, 12 bp, Unknown
  misc_feature (1)..( 12): Matrix.004 file - promoters50/4903171
attggttaaata

SEQ ID NO: 74344 - DNA, 9 bp, Unknown
  misc_feature (1)..( 9): Matrix.004 file - promoters50/4903171
atatgattt

SEQ ID NO: 74345 - DNA, 8 bp, Unknown
  misc_feature (1)..( 8): Matrix.004 file - promoters50/4903171
acttagaa

SEQ ID NO: 74346 - DNA, 8 bp, Unknown
  misc_feature (1)..( 8): Matrix.004 file - promoters50/4903171
gaaaaatc

SEQ ID NO: 74347 - DNA, 7 bp, Unknown
  misc_feature (1)..( 7): Matrix.004 file - promoters50/4903178
gattgga

SEQ ID NO: 74348 - DNA, 6 bp, Unknown
  misc_feature (1)..( 6): Matrix.004 file - promoters50/4903178
aattaa

SEQ ID NO: 74349 - DNA, 11 bp, Unknown
  misc_feature (1)..( 11): Matrix.004 file - promoters50/4903407
actctgtattc

SEQ ID NO: 74350 - DNA, 9 bp, Unknown
  misc_feature (1)..( 9): Matrix.004 file - promoters50/4903407
ctaaaaata

SEQ ID NO: 74351 - DNA, 8 bp, Unknown
  misc_feature (1)..( 8): Matrix.004 file - promoters50/4903407
tttattta

SEQ ID NO: 74352 - DNA, 8 bp, Unknown
  misc_feature (1)..( 8): Matrix.004 file - promoters50/4903407
cattattt

SEQ ID NO: 74353 - DNA, 11 bp, Unknown
  misc_feature (1)..( 11): Matrix.004 file - promoters50/4903407
tttaaaaataa

SEQ ID NO: 74354 - DNA, 12 bp, Unknown
  misc_feature (1)..( 12): Matrix.004 file - promoters50/4903614
ccaaaaataaat

SEQ ID NO: 74355 - DNA, 10 bp, Unknown
  misc_feature (1)..( 10): Matrix.004 file - promoters50/4903653
ttaatataaa

SEQ ID NO: 74356 - DNA, 10 bp, Unknown
  misc_feature (1)..( 10): Matrix.004 file - promoters50/4903653
tttgtatatc

SEQ ID NO: 74357 - DNA, 10 bp, Unknown
  misc_feature (1)..( 10): Matrix.004 file - promoters50/4906473
tcaaaaaaaa

SEQ ID NO: 74358 - DNA, 8 bp, Unknown
  misc_feature (1)..( 8): Matrix.004 file - promoters50/4907396
tttggaag

SEQ ID NO: 74359 - DNA, 10 bp, Unknown
  misc_feature (1)..( 10): Matrix.004 file - promoters50/4909449
atctttagta

SEQ ID NO: 74360 - DNA, 10 bp, Unknown
  misc_feature (1)..( 10): Matrix.004 file - promoters50/4909449
atataaatac

SEQ ID NO: 74361 - DNA, 9 bp, Unknown
  misc_feature (1)..( 9): Matrix.004 file - promoters50/4909449
gaatcaaaa

SEQ ID NO: 74362 - DNA, 10 bp, Unknown
  misc_feature (1)..( 10): Matrix.004 file - promoters50/4910180
taaatattaa

SEQ ID NO: 74363 - DNA, 10 bp, Unknown
  misc_feature (1)..( 10): Matrix.004 file - promoters50/4910180
ttgaatttga

SEQ ID NO: 74364 - DNA, 11 bp, Unknown
  misc_feature (1)..( 11): Matrix.004 file - promoters50/4910287
aaagttactat

SEQ ID NO: 74365 - DNA, 11 bp, Unknown
  misc_feature (1)..( 11): Matrix.004 file - promoters50/4910298
ttatttaatta

SEQ ID NO: 74366 - DNA, 10 bp, Unknown
  misc_feature (1)..( 10): Matrix.004 file - promoters50/4910298
atttttctaa

SEQ ID NO: 74367 - DNA, 9 bp, Unknown
  misc_feature (1)..( 9): Matrix.004 file - promoters50/4910298
ttttttaaa

SEQ ID NO: 74368 - DNA, 7 bp, Unknown
  misc_feature (1)..( 7): Matrix.004 file - promoters50/4910298
acaaaag

SEQ ID NO: 74369 - DNA, 8 bp, Unknown
  misc_feature (1)..( 8): Matrix.004 file - promoters50/4910362
caaaagtt

SEQ ID NO: 74370 - DNA, 8 bp, Unknown
  misc_feature (1)..( 8): Matrix.004 file - promoters50/4910362
atttgtct

SEQ ID NO: 74371 - DNA, 7 bp, Unknown
  misc_feature (1)..( 7): Matrix.004 file - promoters50/4910362
ttctttg

SEQ ID NO: 74372 - DNA, 9 bp, Unknown
  misc_feature (1)..( 9): Matrix.004 file - promoters50/4910362
aatttactt

SEQ ID NO: 74373 - DNA, 7 bp, Unknown
  misc_feature (1)..( 7): Matrix.004 file - promoters50/4910362
ttttgta

SEQ ID NO: 74374 - DNA, 10 bp, Unknown
  misc_feature (1)..( 10): Matrix.004 file - promoters50/4910362
gaaaaaagaa

SEQ ID NO: 74375 - DNA, 7 bp, Unknown
  misc_feature (1)..( 7): Matrix.004 file - promoters50/4910362
gttcttt

SEQ ID NO: 74376 - DNA, 12 bp, Unknown
  misc_feature (1)..( 12): Matrix.004 file - promoters50/4910362
ttgaccttattt

SEQ ID NO: 74377 - DNA, 10 bp, Unknown
  misc_feature (1)..( 10): Matrix.004 file - promoters50/4910366
tttcctaagt

SEQ ID NO: 74378 - DNA, 16 bp, Unknown
  misc_feature (1)..( 16): Matrix.004 file - promoters50/4910366
gtttttaaacaaataa

SEQ ID NO: 74379 - DNA, 11 bp, Unknown
  misc_feature (1)..( 11): Matrix.004 file - promoters50/4910417
gaaagaaagag

SEQ ID NO: 74380 - DNA, 8 bp, Unknown
  misc_feature (1)..( 8): Matrix.004 file - promoters50/4910426
ctacaaaa

SEQ ID NO: 74381 - DNA, 11 bp, Unknown
  misc_feature (1)..( 11): Matrix.004 file - promoters50/4910426
ctatatatata

SEQ ID NO: 74382 - DNA, 12 bp, Unknown
  misc_feature (1)..( 12): Matrix.004 file - promoters50/4910426
ttaattatcgac

SEQ ID NO: 74383 - DNA, 10 bp, Unknown
  misc_feature (1)..( 10): Matrix.004 file - promoters50/4910874
aaaatattga

SEQ ID NO: 74384 - DNA, 12 bp, Unknown
  misc_feature (1)..( 12): Matrix.004 file - promoters50/4910874
attgagttttca

SEQ ID NO: 74385 - DNA, 14 bp, Unknown
  misc_feature (1)..( 14): Matrix.004 file - promoters50/4910874
acaacaaaataaaa

SEQ ID NO: 74386 - DNA, 6 bp, Unknown
  misc_feature (1)..( 6): Matrix.004 file - promoters50/4910902
agtttt

SEQ ID NO: 74387 - DNA, 8 bp, Unknown
  misc_feature (1)..( 8): Matrix.004 file - promoters50/4910902
cttcatga

SEQ ID NO: 74388 - DNA, 9 bp, Unknown
  misc_feature (1)..( 9): Matrix.004 file - promoters50/4910902
ttatattta

SEQ ID NO: 74389 - DNA, 7 bp, Unknown
  misc_feature (1)..( 7): Matrix.004 file - promoters50/4910949
atattta

SEQ ID NO: 74390 - DNA, 8 bp, Unknown
  misc_feature (1)..( 8): Matrix.004 file - promoters50/4910949
tttcttgt

SEQ ID NO: 74391 - DNA, 7 bp, Unknown
  misc_feature (1)..( 7): Matrix.004 file - promoters50/4910949
tatgatt

SEQ ID NO: 74392 - DNA, 8 bp, Unknown
  misc_feature (1)..( 8): Matrix.004 file - promoters50/4910949
cttgtgtt

SEQ ID NO: 74393 - DNA, 15 bp, Unknown
  misc_feature (1)..( 15): Matrix.004 file - promoters50/4910949
tttttttgtttatca

SEQ ID NO: 74394 - DNA, 11 bp, Unknown
  misc_feature (1)..( 11): Matrix.004 file - promoters50/4910949
tagctttctgt

SEQ ID NO: 74395 - DNA, 10 bp, Unknown
  misc_feature (1)..( 10): Matrix.004 file - promoters50/4910949
aacacctttt

SEQ ID NO: 74396 - DNA, 9 bp, Unknown
  misc_feature (1)..( 9): Matrix.004 file - promoters50/4910949
ctacctttt

SEQ ID NO: 74397 - DNA, 9 bp, Unknown
  misc_feature (1)..( 9): Matrix.004 file - promoters50/4910949
tttttttgt

SEQ ID NO: 74398 - DNA, 11 bp, Unknown
  misc_feature (1)..( 11): Matrix.004 file - promoters50/4911303
tacttggtcgt

SEQ ID NO: 74399 - DNA, 8 bp, Unknown
  misc_feature (1)..( 8): Matrix.004 file - promoters50/4911303
tttaagaa

SEQ ID NO: 74400 - DNA, 7 bp, Unknown
  misc_feature (1)..( 7): Matrix.004 file - promoters50/4911303
taattta

SEQ ID NO: 74401 - DNA, 5 bp, Unknown
  misc_feature (1)..( 5): Matrix.004 file - promoters50/4911303
agaga

SEQ ID NO: 74402 - DNA, 9 bp, Unknown
  misc_feature (1)..( 9): Matrix.004 file - promoters50/4911303
tctatttaa

SEQ ID NO: 74403 - DNA, 8 bp, Unknown
  misc_feature (1)..( 8): Matrix.004 file - promoters50/4911303
gttctatt

SEQ ID NO: 74404 - DNA, 10 bp, Unknown
  misc_feature (1)..( 10): Matrix.004 file - promoters50/4911309
taacagagat

SEQ ID NO: 74405 - DNA, 10 bp, Unknown
  misc_feature (1)..( 10): Matrix.004 file - promoters50/4911309
ttcttttgaa

SEQ ID NO: 74406 - DNA, 8 bp, Unknown
  misc_feature (1)..( 8): Matrix.004 file - promoters50/4911309
tcttctta

SEQ ID NO: 74407 - DNA, 11 bp, Unknown
  misc_feature (1)..( 11): Matrix.004 file - promoters50/4911309
caaaatttctt

SEQ ID NO: 74408 - DNA, 6 bp, Unknown
  misc_feature (1)..( 6): Matrix.004 file - promoters50/4911309
ttttct

SEQ ID NO: 74409 - DNA, 8 bp, Unknown
  misc_feature (1)..( 8): Matrix.004 file - promoters50/4911309
atgcttat

SEQ ID NO: 74410 - DNA, 8 bp, Unknown
  misc_feature (1)..( 8): Matrix.004 file - promoters50/4911312
cttattat

SEQ ID NO: 74411 - DNA, 13 bp, Unknown
  misc_feature (1)..( 13): Matrix.004 file - promoters50/4911314
agatcacattaaa

SEQ ID NO: 74412 - DNA, 7 bp, Unknown
  misc_feature (1)..( 7): Matrix.004 file - promoters50/4911314
cagttgt

SEQ ID NO: 74413 - DNA, 9 bp, Unknown
  misc_feature (1)..( 9): Matrix.004 file - promoters50/4911314
ctgatgaaa

SEQ ID NO: 74414 - DNA, 9 bp, Unknown
  misc_feature (1)..( 9): Matrix.004 file - promoters50/4911314
ttgatttaa

SEQ ID NO: 74415 - DNA, 7 bp, Unknown
  misc_feature (1)..( 7): Matrix.004 file - promoters50/4911314
ttggaaa

SEQ ID NO: 74416 - DNA, 16 bp, Unknown
  misc_feature (1)..( 16): Matrix.004 file - promoters50/4911344
aaaaaaaaaacaaatt

SEQ ID NO: 74417 - DNA, 9 bp, Unknown
  misc_feature (1)..( 9): Matrix.004 file - promoters50/4911380
cagtttatg

SEQ ID NO: 74418 - DNA, 7 bp, Unknown
  misc_feature (1)..( 7): Matrix.004 file - promoters50/4911380
aaaaaat

SEQ ID NO: 74419 - DNA, 12 bp, Unknown
  misc_feature (1)..( 12): Matrix.004 file - promoters50/4911457
ttatatatcaaa

SEQ ID NO: 74420 - DNA, 13 bp, Unknown
  misc_feature (1)..( 13): Matrix.004 file - promoters50/4911457
cttgagtcgttta

SEQ ID NO: 74421 - DNA, 10 bp, Unknown
  misc_feature (1)..( 10): Matrix.004 file - promoters50/4911457
tgttggagat

SEQ ID NO: 74422 - DNA, 10 bp, Unknown
  misc_feature (1)..( 10): Matrix.004 file - promoters50/4911485
gaatttgaga

SEQ ID NO: 74423 - DNA, 8 bp, Unknown
  misc_feature (1)..( 8): Matrix.004 file - promoters50/4911485
atttttac

SEQ ID NO: 74424 - DNA, 9 bp, Unknown
  misc_feature (1)..( 9): Matrix.004 file - promoters50/4911485
gagtttgat

SEQ ID NO: 74425 - DNA, 10 bp, Unknown
  misc_feature (1)..( 10): Matrix.004 file - promoters50/4911485
ttatcaatag

SEQ ID NO: 74426 - DNA, 14 bp, Unknown
  misc_feature (1)..( 14): Matrix.004 file - promoters50/4911485
ggagtaaattttat

SEQ ID NO: 74427 - DNA, 10 bp, Unknown
  misc_feature (1)..( 10): Matrix.004 file - promoters50/4911485
ataaaaattt

SEQ ID NO: 74428 - DNA, 15 bp, Unknown
  misc_feature (1)..( 15): Matrix.004 file - promoters50/4911485
ttaatgtttgattgt

SEQ ID NO: 74429 - DNA, 12 bp, Unknown
  misc_feature (1)..( 12): Matrix.004 file - promoters50/4911485
atgtttgtgtcc

SEQ ID NO: 74430 - DNA, 10 bp, Unknown
  misc_feature (1)..( 10): Matrix.004 file - promoters50/4911492
atgtttataa

SEQ ID NO: 74431 - DNA, 11 bp, Unknown
  misc_feature (1)..( 11): Matrix.004 file - promoters50/4911492
tattttgtaat

SEQ ID NO: 74432 - DNA, 9 bp, Unknown
  misc_feature (1)..( 9): Matrix.004 file - promoters50/4911492
ctaaaatat

SEQ ID NO: 74433 - DNA, 11 bp, Unknown
  misc_feature (1)..( 11): Matrix.004 file - promoters50/4911492
gttttatttca

SEQ ID NO: 74434 - DNA, 12 bp, Unknown
  misc_feature (1)..( 12): Matrix.004 file - promoters50/4911492
tgtaataattta

SEQ ID NO: 74435 - DNA, 10 bp, Unknown
  misc_feature (1)..( 10): Matrix.004 file - promoters50/4911492
ttcaattgta

SEQ ID NO: 74436 - DNA, 7 bp, Unknown
  misc_feature (1)..( 7): Matrix.004 file - promoters50/4911582
aaaaata

SEQ ID NO: 74437 - DNA, 7 bp, Unknown
  misc_feature (1)..( 7): Matrix.004 file - promoters50/4911598
ttttctt

SEQ ID NO: 74438 - DNA, 8 bp, Unknown
  misc_feature (1)..( 8): Matrix.004 file - promoters50/4911598
taaaatgt

SEQ ID NO: 74439 - DNA, 9 bp, Unknown
  misc_feature (1)..( 9): Matrix.004 file - promoters50/4911598
aagtataat

SEQ ID NO: 74440 - DNA, 14 bp, Unknown
  misc_feature (1)..( 14): Matrix.004 file - promoters50/4911598
taaacacatattga

SEQ ID NO: 74441 - DNA, 11 bp, Unknown
  misc_feature (1)..( 11): Matrix.004 file - promoters50/4911598
tttatctctaa

SEQ ID NO: 74442 - DNA, 14 bp, Unknown
  misc_feature (1)..( 14): Matrix.004 file - promoters50/4911598
cttacaaaaatatt

SEQ ID NO: 74443 - DNA, 9 bp, Unknown
  misc_feature (1)..( 9): Matrix.004 file - promoters50/4911598
aatgtgtct

SEQ ID NO: 74444 - DNA, 7 bp, Unknown
  misc_feature (1)..( 7): Matrix.004 file - promoters50/4911598
aatttta

SEQ ID NO: 74445 - DNA, 11 bp, Unknown
  misc_feature (1)..( 11): Matrix.004 file - promoters50/4911598
tatattttgaa

SEQ ID NO: 74446 - DNA, 11 bp, Unknown
  misc_feature (1)..( 11): Matrix.004 file - promoters50/4911598
gaagaaaacta

SEQ ID NO: 74447 - DNA, 9 bp, Unknown
  misc_feature (1)..( 9): Matrix.004 file - promoters50/4911946
tatttttct

SEQ ID NO: 74448 - DNA, 8 bp, Unknown
  misc_feature (1)..( 8): Matrix.004 file - promoters50/4911946
tgaaaaaa

SEQ ID NO: 74449 - DNA, 7 bp, Unknown
  misc_feature (1)..( 7): Matrix.004 file - promoters50/4911946
aattgtt

SEQ ID NO: 74450 - DNA, 9 bp, Unknown
  misc_feature (1)..( 9): Matrix.004 file - promoters50/4911950
ttgaattca

SEQ ID NO: 74451 - DNA, 10 bp, Unknown
  misc_feature (1)..( 10): Matrix.004 file - promoters50/4911994
caaaatcgta

SEQ ID NO: 74452 - DNA, 9 bp, Unknown
  misc_feature (1)..( 9): Matrix.004 file - promoters50/4912060
ttctttttt

SEQ ID NO: 74453 - DNA, 8 bp, Unknown
  misc_feature (1)..( 8): Matrix.004 file - promoters50/4912060
taattttt

SEQ ID NO: 74454 - DNA, 7 bp, Unknown
  misc_feature (1)..( 7): Matrix.004 file - promoters50/4912130
tttgttt

SEQ ID NO: 74455 - DNA, 9 bp, Unknown
  misc_feature (1)..( 9): Matrix.004 file - promoters50/4912130
tatatttta

SEQ ID NO: 74456 - DNA, 10 bp, Unknown
  misc_feature (1)..( 10): Matrix.004 file - promoters50/4912130
agtgtataaa

SEQ ID NO: 74457 - DNA, 9 bp, Unknown
  misc_feature (1)..( 9): Matrix.004 file - promoters50/4912137
ttaccaaat

SEQ ID NO: 74458 - DNA, 17 bp, Unknown
  misc_feature (1)..( 17): Matrix.004 file - promoters50/4912137
tgatcaaaattaataaa

SEQ ID NO: 74459 - DNA, 9 bp, Unknown
  misc_feature (1)..( 9): Matrix.004 file - promoters50/4912137
attatataa

SEQ ID NO: 74460 - DNA, 7 bp, Unknown
  misc_feature (1)..( 7): Matrix.004 file - promoters50/4912176
aaaataa

SEQ ID NO: 74461 - DNA, 9 bp, Unknown
  misc_feature (1)..( 9): Matrix.004 file - promoters50/4912240
tatatttga

SEQ ID NO: 74462 - DNA, 9 bp, Unknown
  misc_feature (1)..( 9): Matrix.004 file - promoters50/4912240
gtggattta

SEQ ID NO: 74463 - DNA, 8 bp, Unknown
  misc_feature (1)..( 8): Matrix.004 file - promoters50/4912240
caaaacac

SEQ ID NO: 74464 - DNA, 16 bp, Unknown
  misc_feature (1)..( 16): Matrix.004 file - promoters50/4912541
taagtgattcaaaatt

SEQ ID NO: 74465 - DNA, 8 bp, Unknown
  misc_feature (1)..( 8): Matrix.004 file - promoters50/4912541
gtttaaaa

SEQ ID NO: 74466 - DNA, 9 bp, Unknown
  misc_feature (1)..( 9): Matrix.004 file - promoters50/4912541
agattctaa

SEQ ID NO: 74467 - DNA, 10 bp, Unknown
  misc_feature (1)..( 10): Matrix.004 file - promoters50/4913011
tagggagaga

SEQ ID NO: 74468 - DNA, 8 bp, Unknown
  misc_feature (1)..( 8): Matrix.004 file - promoters50/4913068
ctaattaa

SEQ ID NO: 74469 - DNA, 11 bp, Unknown
  misc_feature (1)..( 11): Matrix.004 file - promoters50/4913068
atgaaaaattt

SEQ ID NO: 74470 - DNA, 11 bp, Unknown
  misc_feature (1)..( 11): Matrix.004 file - promoters50/4913068
gattattttgg

SEQ ID NO: 74471 - DNA, 10 bp, Unknown
  misc_feature (1)..( 10): Matrix.004 file - promoters50/4913068
acaaattaaa

SEQ ID NO: 74472 - DNA, 18 bp, Unknown
  misc_feature (1)..( 18): Matrix.004 file - promoters50/4913068
aaaaaaatagtaaattaa

SEQ ID NO: 74473 - DNA, 15 bp, Unknown
  misc_feature (1)..( 15): Matrix.004 file - promoters50/4913724
ttgtataaaaaaagt

SEQ ID NO: 74474 - DNA, 13 bp, Unknown
  misc_feature (1)..( 13): Matrix.004 file - promoters50/4914111
aacattttggttt

SEQ ID NO: 74475 - DNA, 7 bp, Unknown
  misc_feature (1)..( 7): Matrix.004 file - promoters50/4914111
tgtatat

SEQ ID NO: 74476 - DNA, 9 bp, Unknown
  misc_feature (1)..( 9): Matrix.004 file - promoters50/4914111
ctgtgtctc

SEQ ID NO: 74477 - DNA, 7 bp, Unknown
  misc_feature (1)..( 7): Matrix.004 file - promoters50/4914111
aatttct

SEQ ID NO: 74478 - DNA, 8 bp, Unknown
  misc_feature (1)..( 8): Matrix.004 file - promoters50/4914111
ctgtttat

SEQ ID NO: 74479 - DNA, 7 bp, Unknown
  misc_feature (1)..( 7): Matrix.004 file - promoters50/4914111
tttattg

SEQ ID NO: 74480 - DNA, 7 bp, Unknown
  misc_feature (1)..( 7): Matrix.004 file - promoters50/4914111
gatgcag

SEQ ID NO: 74481 - DNA, 9 bp, Unknown
  misc_feature (1)..( 9): Matrix.004 file - promoters50/4914111
taatggttt

SEQ ID NO: 74482 - DNA, 8 bp, Unknown
  misc_feature (1)..( 8): Matrix.004 file - promoters50/4914111
ttcttgtt

SEQ ID NO: 74483 - DNA, 13 bp, Unknown
  misc_feature (1)..( 13): Matrix.004 file - promoters50/4914228
ttcgatgatgctg

SEQ ID NO: 74484 - DNA, 8 bp, Unknown
  misc_feature (1)..( 8): Matrix.004 file - promoters50/4914228
aagaagaa

SEQ ID NO: 74485 - DNA, 7 bp, Unknown
  misc_feature (1)..( 7): Matrix.004 file - promoters50/4914228
gatggat

SEQ ID NO: 74486 - DNA, 7 bp, Unknown
  misc_feature (1)..( 7): Matrix.004 file - promoters50/4914228
aagaaag

SEQ ID NO: 74487 - DNA, 8 bp, Unknown
  misc_feature (1)..( 8): Matrix.004 file - promoters50/4914438
ttaaaatg

SEQ ID NO: 74488 - DNA, 10 bp, Unknown
  misc_feature (1)..( 10): Matrix.004 file - promoters50/4915127
aaattgattc

SEQ ID NO: 74489 - DNA, 9 bp, Unknown
  misc_feature (1)..( 9): Matrix.004 file - promoters50/4915163
actataaat

SEQ ID NO: 74490 - DNA, 13 bp, Unknown
  misc_feature (1)..( 13): Matrix.004 file - promoters50/4915163
taaattctaaaat

SEQ ID NO: 74491 - DNA, 13 bp, Unknown
  misc_feature (1)..( 13): Matrix.004 file - promoters50/4915163
ctataaaaaccaa

SEQ ID NO: 74492 - DNA, 12 bp, Unknown
  misc_feature (1)..( 12): Matrix.004 file - promoters50/4915163
tttataagtaaa

SEQ ID NO: 74493 - DNA, 14 bp, Unknown
  misc_feature (1)..( 14): Matrix.004 file - promoters50/4915199
aaatttataaataa

SEQ ID NO: 74494 - DNA, 6 bp, Unknown
  misc_feature (1)..( 6): Matrix.004 file - promoters50/4915199
tttctt

SEQ ID NO: 74495 - DNA, 13 bp, Unknown
  misc_feature (1)..( 13): Matrix.004 file - promoters50/4915199
attgtttctctga

SEQ ID NO: 74496 - DNA, 10 bp, Unknown
  misc_feature (1)..( 10): Matrix.004 file - promoters50/4915199
tcactgtttt

SEQ ID NO: 74497 - DNA, 8 bp, Unknown
  misc_feature (1)..( 8): Matrix.004 file - promoters50/4915199
gtttagat

SEQ ID NO: 74498 - DNA, 8 bp, Unknown
  misc_feature (1)..( 8): Matrix.004 file - promoters50/4915199
tgttttgg

SEQ ID NO: 74499 - DNA, 8 bp, Unknown
  misc_feature (1)..( 8): Matrix.004 file - promoters50/4915199
ttttgctt

SEQ ID NO: 74500 - DNA, 7 bp, Unknown
  misc_feature (1)..( 7): Matrix.004 file - promoters50/4915199
tttgttt

SEQ ID NO: 74501 - DNA, 8 bp, Unknown
  misc_feature (1)..( 8): Matrix.004 file - promoters50/4915199
tgtttttg

SEQ ID NO: 74502 - DNA, 9 bp, Unknown
  misc_feature (1)..( 9): Matrix.004 file - promoters50/4915199
tgtttttgg

SEQ ID NO: 74503 - DNA, 9 bp, Unknown
  misc_feature (1)..( 9): Matrix.004 file - promoters50/4915199
aatttggtt

SEQ ID NO: 74504 - DNA, 11 bp, Unknown
  misc_feature (1)..( 11): Matrix.004 file - promoters50/4915199
atagaaaaata

SEQ ID NO: 74505 - DNA, 8 bp, Unknown
  misc_feature (1)..( 8): Matrix.004 file - promoters50/4915244
tgttgttg

SEQ ID NO: 74506 - DNA, 9 bp, Unknown
  misc_feature (1)..( 9): Matrix.004 file - promoters50/4915244
aataaatat

SEQ ID NO: 74507 - DNA, 7 bp, Unknown
  misc_feature (1)..( 7): Matrix.004 file - promoters50/4915244
cttgagt

SEQ ID NO: 74508 - DNA, 8 bp, Unknown
  misc_feature (1)..( 8): Matrix.004 file - promoters50/4915244
accaagta

SEQ ID NO: 74509 - DNA, 11 bp, Unknown
  misc_feature (1)..( 11): Matrix.004 file - promoters50/4915347
atttcaatttt

SEQ ID NO: 74510 - DNA, 9 bp, Unknown
  misc_feature (1)..( 9): Matrix.004 file - promoters50/4915355
attttttta

SEQ ID NO: 74511 - DNA, 12 bp, Unknown
  misc_feature (1)..( 12): Matrix.004 file - promoters50/4915355
aacaaaatctaa

SEQ ID NO: 74512 - DNA, 13 bp, Unknown
  misc_feature (1)..( 13): Matrix.004 file - promoters50/4915355
tattaaaataatt

SEQ ID NO: 74513 - DNA, 9 bp, Unknown
  misc_feature (1)..( 9): Matrix.004 file - promoters50/4915355
attcaaacg

SEQ ID NO: 74514 - DNA, 12 bp, Unknown
  misc_feature (1)..( 12): Matrix.004 file - promoters50/4915384
aaaatatcaatt

SEQ ID NO: 74515 - DNA, 8 bp, Unknown
  misc_feature (1)..( 8): Matrix.004 file - promoters50/4915384
ttttaatt

SEQ ID NO: 74516 - DNA, 10 bp, Unknown
  misc_feature (1)..( 10): Matrix.004 file - promoters50/4915384
gttttatttt

SEQ ID NO: 74517 - DNA, 8 bp, Unknown
  misc_feature (1)..( 8): Matrix.004 file - promoters50/4915384
ttaagaga

SEQ ID NO: 74518 - DNA, 8 bp, Unknown
  misc_feature (1)..( 8): Matrix.004 file - promoters50/4915384
gaaaagta

SEQ ID NO: 74519 - DNA, 7 bp, Unknown
  misc_feature (1)..( 7): Matrix.004 file - promoters50/4915384
taagaga

SEQ ID NO: 74520 - DNA, 9 bp, Unknown
  misc_feature (1)..( 9): Matrix.004 file - promoters50/4915384
tcaaattga

SEQ ID NO: 74521 - DNA, 13 bp, Unknown
  misc_feature (1)..( 13): Matrix.004 file - promoters50/4915384
ttttaaattatta

SEQ ID NO: 74522 - DNA, 8 bp, Unknown
  misc_feature (1)..( 8): Matrix.004 file - promoters50/4915384
aaatttgt

SEQ ID NO: 74523 - DNA, 11 bp, Unknown
  misc_feature (1)..( 11): Matrix.004 file - promoters50/4915395
tgtttaaataa

SEQ ID NO: 74524 - DNA, 9 bp, Unknown
  misc_feature (1)..( 9): Matrix.004 file - promoters50/4915395
tttataaaa

SEQ ID NO: 74525 - DNA, 7 bp, Unknown
  misc_feature (1)..( 7): Matrix.004 file - promoters50/4915395
caaatga

SEQ ID NO: 74526 - DNA, 8 bp, Unknown
  misc_feature (1)..( 8): Matrix.004 file - promoters50/4915420
aaaataaa

SEQ ID NO: 74527 - DNA, 5 bp, Unknown
  misc_feature (1)..( 5): Matrix.004 file - promoters50/4915420
attga

SEQ ID NO: 74528 - DNA, 8 bp, Unknown
  misc_feature (1)..( 8): Matrix.004 file - promoters50/4915420
atattagt

SEQ ID NO: 74529 - DNA, 7 bp, Unknown
  misc_feature (1)..( 7): Matrix.004 file - promoters50/4915511
ttattag

SEQ ID NO: 74530 - DNA, 7 bp, Unknown
  misc_feature (1)..( 7): Matrix.004 file - promoters50/4915511
taaaaca

SEQ ID NO: 74531 - DNA, 8 bp, Unknown
  misc_feature (1)..( 8): Matrix.004 file - promoters50/4915511
ctctgaaa

SEQ ID NO: 74532 - DNA, 8 bp, Unknown
  misc_feature (1)..( 8): Matrix.004 file - promoters50/4915511
cagttata

SEQ ID NO: 74533 - DNA, 6 bp, Unknown
  misc_feature (1)..( 6): Matrix.004 file - promoters50/4915606
aaaacc

SEQ ID NO: 74534 - DNA, 7 bp, Unknown
  misc_feature (1)..( 7): Matrix.004 file - promoters50/4915606
tattaat

SEQ ID NO: 74535 - DNA, 11 bp, Unknown
  misc_feature (1)..( 11): Matrix.004 file - promoters50/4915606
aaaaacaaaga

SEQ ID NO: 74536 - DNA, 14 bp, Unknown
  misc_feature (1)..( 14): Matrix.004 file - promoters50/4915606
aaaacatattaaat

SEQ ID NO: 74537 - DNA, 9 bp, Unknown
  misc_feature (1)..( 9): Matrix.004 file - promoters50/4915606
aaaaaaaaa

SEQ ID NO: 74538 - DNA, 10 bp, Unknown
  misc_feature (1)..( 10): Matrix.004 file - promoters50/4915606
tccatatata

SEQ ID NO: 74539 - DNA, 9 bp, Unknown
  misc_feature (1)..( 9): Matrix.004 file - promoters50/4915606
aaaaagtta

SEQ ID NO: 74540 - DNA, 10 bp, Unknown
  misc_feature (1)..( 10): Matrix.004 file - promoters50/4915606
aaagatttac

SEQ ID NO: 74541 - DNA, 8 bp, Unknown
  misc_feature (1)..( 8): Matrix.004 file - promoters50/4915606
aaaattta

SEQ ID NO: 74542 - DNA, 6 bp, Unknown
  misc_feature (1)..( 6): Matrix.004 file - promoters50/4915606
taaaat

SEQ ID NO: 74543 - DNA, 11 bp, Unknown
  misc_feature (1)..( 11): Matrix.004 file - promoters50/4915668
tatttattttt

SEQ ID NO: 74544 - DNA, 7 bp, Unknown
  misc_feature (1)..( 7): Matrix.004 file - promoters50/4915668
taccaat

SEQ ID NO: 74545 - DNA, 10 bp, Unknown
  misc_feature (1)..( 10): Matrix.004 file - promoters50/4915694
gaatgtgtta

SEQ ID NO: 74546 - DNA, 11 bp, Unknown
  misc_feature (1)..( 11): Matrix.004 file - promoters50/4915694
gattcaaaatc

SEQ ID NO: 74547 - DNA, 9 bp, Unknown
  misc_feature (1)..( 9): Matrix.004 file - promoters50/4915694
tttttcaaa

SEQ ID NO: 74548 - DNA, 9 bp, Unknown
  misc_feature (1)..( 9): Matrix.004 file - promoters50/4915694
ctacaaaaa

SEQ ID NO: 74549 - DNA, 14 bp, Unknown
  misc_feature (1)..( 14): Matrix.004 file - promoters50/4915694
ctaatattttatgt

SEQ ID NO: 74550 - DNA, 13 bp, Unknown
  misc_feature (1)..( 13): Matrix.004 file - promoters50/4915694
ttaatcaatatat

SEQ ID NO: 74551 - DNA, 9 bp, Unknown
  misc_feature (1)..( 9): Matrix.004 file - promoters50/4915694
ctaatttta

SEQ ID NO: 74552 - DNA, 9 bp, Unknown
  misc_feature (1)..( 9): Matrix.004 file - promoters50/4915694
caaattttg

SEQ ID NO: 74553 - DNA, 12 bp, Unknown
  misc_feature (1)..( 12): Matrix.004 file - promoters50/4915701
attttgaataaa

SEQ ID NO: 74554 - DNA, 10 bp, Unknown
  misc_feature (1)..( 10): Matrix.004 file - promoters50/4915701
tgtaatcggg

SEQ ID NO: 74555 - DNA, 9 bp, Unknown
  misc_feature (1)..( 9): Matrix.004 file - promoters50/4915709
tcggtgttg

SEQ ID NO: 74556 - DNA, 8 bp, Unknown
  misc_feature (1)..( 8): Matrix.004 file - promoters50/4915724
attgcttt

SEQ ID NO: 74557 - DNA, 13 bp, Unknown
  misc_feature (1)..( 13): Matrix.004 file - promoters50/4915724
aataaagaagaat

SEQ ID NO: 74558 - DNA, 9 bp, Unknown
  misc_feature (1)..( 9): Matrix.004 file - promoters50/4915724
ataaaaaaa

SEQ ID NO: 74559 - DNA, 14 bp, Unknown
  misc_feature (1)..( 14): Matrix.004 file - promoters50/4915745
actaaaatacaacc

SEQ ID NO: 74560 - DNA, 9 bp, Unknown
  misc_feature (1)..( 9): Matrix.004 file - promoters50/4915745
atatttttt

SEQ ID NO: 74561 - DNA, 8 bp, Unknown
  misc_feature (1)..( 8): Matrix.004 file - promoters50/4915745
aattgatt

SEQ ID NO: 74562 - DNA, 8 bp, Unknown
  misc_feature (1)..( 8): Matrix.004 file - promoters50/4915774
ttttacta

SEQ ID NO: 74563 - DNA, 7 bp, Unknown
  misc_feature (1)..( 7): Matrix.004 file - promoters50/4915774
ctatatt

SEQ ID NO: 74564 - DNA, 8 bp, Unknown
  misc_feature (1)..( 8): Matrix.004 file - promoters50/4915774
taataaag

SEQ ID NO: 74565 - DNA, 9 bp, Unknown
  misc_feature (1)..( 9): Matrix.004 file - promoters50/4915774
ccttggagt

SEQ ID NO: 74566 - DNA, 8 bp, Unknown
  misc_feature (1)..( 8): Matrix.004 file - promoters50/4915804
ctctttca

SEQ ID NO: 74567 - DNA, 11 bp, Unknown
  misc_feature (1)..( 11): Matrix.004 file - promoters50/4915804
attgactattg

SEQ ID NO: 74568 - DNA, 7 bp, Unknown
  misc_feature (1)..( 7): Matrix.004 file - promoters50/4915804
ttataaa

SEQ ID NO: 74569 - DNA, 8 bp, Unknown
  misc_feature (1)..( 8): Matrix.004 file - promoters50/4915816
atatcttt

SEQ ID NO: 74570 - DNA, 11 bp, Unknown
  misc_feature (1)..( 11): Matrix.004 file - promoters50/4915819
caaatttcttt

SEQ ID NO: 74571 - DNA, 9 bp, Unknown
  misc_feature (1)..( 9): Matrix.004 file - promoters50/4921122
aaattcaag

SEQ ID NO: 74572 - DNA, 15 bp, Unknown
  misc_feature (1)..( 15): Matrix.004 file - promoters50/4921373
gtgttacaatttctt

SEQ ID NO: 74573 - DNA, 7 bp, Unknown
  misc_feature (1)..( 7): Matrix.004 file - promoters50/4921373
aattata

SEQ ID NO: 74574 - DNA, 10 bp, Unknown
  misc_feature (1)..( 10): Matrix.004 file - promoters50/4921373
aaagattaga

SEQ ID NO: 74575 - DNA, 10 bp, Unknown
  misc_feature (1)..( 10): Matrix.004 file - promoters50/4921433
gagttaattg

SEQ ID NO: 74576 - DNA, 7 bp, Unknown
  misc_feature (1)..( 7): Matrix.004 file - promoters50/4921433
tttgatt

SEQ ID NO: 74577 - DNA, 9 bp, Unknown
  misc_feature (1)..( 9): Matrix.004 file - promoters50/4921447
gaaaaattt

SEQ ID NO: 74578 - DNA, 13 bp, Unknown
  misc_feature (1)..( 13): Matrix.004 file - promoters50/4921447
tagttttaacagg

SEQ ID NO: 74579 - DNA, 11 bp, Unknown
  misc_feature (1)..( 11): Matrix.004 file - promoters50/4921447
ttgatgaaaga

SEQ ID NO: 74580 - DNA, 14 bp, Unknown
  misc_feature (1)..( 14): Matrix.004 file - promoters50/4921447
tattgatgaaaatg

SEQ ID NO: 74581 - DNA, 9 bp, Unknown
  misc_feature (1)..( 9): Matrix.004 file - promoters50/4922491
atattaaag

SEQ ID NO: 74582 - DNA, 10 bp, Unknown
  misc_feature (1)..( 10): Matrix.004 file - promoters50/4934904
aaaatcttct

SEQ ID NO: 74583 - DNA, 12 bp, Unknown
  misc_feature (1)..( 12): Matrix.004 file - promoters50/4934904
tctgggaaatcg

SEQ ID NO: 74584 - DNA, 6 bp, Unknown
  misc_feature (1)..( 6): Matrix.004 file - promoters50/4934904
tttcaa

SEQ ID NO: 74585 - DNA, 8 bp, Unknown
  misc_feature (1)..( 8): Matrix.004 file - promoters50/4934904
acatctca

SEQ ID NO: 74586 - DNA, 7 bp, Unknown
  misc_feature (1)..( 7): Matrix.004 file - promoters50/4934904
ttctctc

SEQ ID NO: 74587 - DNA, 8 bp, Unknown
  misc_feature (1)..( 8): Matrix.004 file - promoters50/4938731
gagctctc

SEQ ID NO: 74588 - DNA, 14 bp, Unknown
  misc_feature (1)..( 14): Matrix.004 file - promoters50/4938731
tttataaacaaaaa

SEQ ID NO: 74589 - DNA, 10 bp, Unknown
  misc_feature (1)..( 10): Matrix.004 file - promoters50/4938731
taaattaaca

SEQ ID NO: 74590 - DNA, 10 bp, Unknown
  misc_feature (1)..( 10): Matrix.004 file - promoters50/4943425
acttatttca

SEQ ID NO: 74591 - DNA, 11 bp, Unknown
  misc_feature (1)..( 11): Matrix.004 file - promoters50/4943425
agtttattctt

SEQ ID NO: 74592 - DNA, 14 bp, Unknown
  misc_feature (1)..( 14): Matrix.004 file - promoters50/4943425
tgatgtttttattt

SEQ ID NO: 74593 - DNA, 16 bp, Unknown
  misc_feature (1)..( 16): Matrix.004 file - promoters50/4943637
attgtataaagatcct

SEQ ID NO: 74594 - DNA, 14 bp, Unknown
  misc_feature (1)..( 14): Matrix.004 file - promoters50/4943637
tattagtttgttct

SEQ ID NO: 74595 - DNA, 8 bp, Unknown
  misc_feature (1)..( 8): Matrix.004 file - promoters50/4974495
taagaaaa

SEQ ID NO: 74596 - DNA, 11 bp, Unknown
  misc_feature (1)..( 11): Matrix.004 file - promoters50/4978201
ttaggatgcag

SEQ ID NO: 74597 - DNA, 12 bp, Unknown
  misc_feature (1)..( 12): Matrix.004 file - promoters50/4978201
aatgcttgatca

SEQ ID NO: 74598 - DNA, 16 bp, Unknown
  misc_feature (1)..( 16): Matrix.004 file - promoters50/4992383
aattcaaaaaaaaaaa

SEQ ID NO: 74599 - DNA, 6 bp, Unknown
  misc_feature (1)..( 6): Matrix.004 file - promoters50/4992383
tttata

SEQ ID NO: 74600 - DNA, 9 bp, Unknown
  misc_feature (1)..( 9): Matrix.004 file - promoters50/4992383
tttgatttg

SEQ ID NO: 74601 - DNA, 11 bp, Unknown
  misc_feature (1)..( 11): Matrix.004 file - promoters50/4992383
tattttgattt

SEQ ID NO: 74602 - DNA, 7 bp, Unknown
  misc_feature (1)..( 7): Matrix.004 file - promoters50/4992383
ttttcta

SEQ ID NO: 74603 - DNA, 14 bp, Unknown
  misc_feature (1)..( 14): Matrix.004 file - promoters50/4992383
aacttttaagtaga

SEQ ID NO: 74604 - DNA, 12 bp, Unknown
  misc_feature (1)..( 12): Matrix.004 file - promoters50/4992383
ttttaactaaca

SEQ ID NO: 74605 - DNA, 12 bp, Unknown
  misc_feature (1)..( 12): Matrix.004 file - promoters50/4992383
tatatttagttt

SEQ ID NO: 74606 - DNA, 9 bp, Unknown
  misc_feature (1)..( 9): Matrix.004 file - promoters50/4992383
aatttattt

SEQ ID NO: 74607 - DNA, 7 bp, Unknown
  misc_feature (1)..( 7): Matrix.004 file - promoters50/4992383
aatgttt

SEQ ID NO: 74608 - DNA, 9 bp, Unknown
  misc_feature (1)..( 9): Matrix.004 file - promoters50/4992452
atttatttt

SEQ ID NO: 74609 - DNA, 11 bp, Unknown
  misc_feature (1)..( 11): Matrix.004 file - promoters50/4992452
tattataccaa

SEQ ID NO: 74610 - DNA, 10 bp, Unknown
  misc_feature (1)..( 10): Matrix.004 file - promoters50/4992452
gattacaaat

SEQ ID NO: 74611 - DNA, 13 bp, Unknown
  misc_feature (1)..( 13): Matrix.004 file - promoters50/4992452
aaatctgtaattt

SEQ ID NO: 74612 - DNA, 9 bp, Unknown
  misc_feature (1)..( 9): Matrix.004 file - promoters50/4992452
taatattaa

SEQ ID NO: 74613 - DNA, 8 bp, Unknown
  misc_feature (1)..( 8): Matrix.004 file - promoters50/4992452
tattttta

SEQ ID NO: 74614 - DNA, 7 bp, Unknown
  misc_feature (1)..( 7): Matrix.004 file - promoters50/5003710
atttcat

SEQ ID NO: 74615 - DNA, 19 bp, Unknown
  misc_feature (1)..( 19): Matrix.004 file - promoters50/5003710
tatacgaaatataaattta

SEQ ID NO: 74616 - DNA, 11 bp, Unknown
  misc_feature (1)..( 11): Matrix.004 file - promoters50/5003710
taaaatataaa

SEQ ID NO: 74617 - DNA, 12 bp, Unknown
  misc_feature (1)..( 12): Matrix.004 file - promoters50/5003710
gatacaaaataa

SEQ ID NO: 74618 - DNA, 13 bp, Unknown
  misc_feature (1)..( 13): Matrix.004 file - promoters50/5003830
taattttatttca

SEQ ID NO: 74619 - DNA, 9 bp, Unknown
  misc_feature (1)..( 9): Matrix.004 file - promoters50/5003830
aaaagaata

SEQ ID NO: 74620 - DNA, 8 bp, Unknown
  misc_feature (1)..( 8): Matrix.004 file - promoters50/5003830
caattata

SEQ ID NO: 74621 - DNA, 11 bp, Unknown
  misc_feature (1)..( 11): Matrix.004 file - promoters50/5003830
tttcacttttt

SEQ ID NO: 74622 - DNA, 8 bp, Unknown
  misc_feature (1)..( 8): Matrix.004 file - promoters50/5662739
gagaattt

SEQ ID NO: 74623 - DNA, 9 bp, Unknown
  misc_feature (1)..( 9): Matrix.004 file - promoters50/5662739
aaaaaaaaa

SEQ ID NO: 74624 - DNA, 9 bp, Unknown
  misc_feature (1)..( 9): Matrix.004 file - promoters50/5662739
taaaaattt

SEQ ID NO: 74625 - DNA, 8 bp, Unknown
  misc_feature (1)..( 8): Matrix.004 file - promoters50/5662739
ttacaaaa

SEQ ID NO: 74626 - DNA, 10 bp, Unknown
  misc_feature (1)..( 10): Matrix.004 file - promoters50/5662739
attttataaa

SEQ ID NO: 74627 - DNA, 7 bp, Unknown
  misc_feature (1)..( 7): Matrix.004 file - promoters50/5662743
taaaaag

SEQ ID NO: 74628 - DNA, 10 bp, Unknown
  misc_feature (1)..( 10): Matrix.004 file - promoters50/5662743
attaagttag

SEQ ID NO: 74629 - DNA, 8 bp, Unknown
  misc_feature (1)..( 8): Matrix.004 file - promoters50/5662743
atttgata

SEQ ID NO: 74630 - DNA, 10 bp, Unknown
  misc_feature (1)..( 10): Matrix.004 file - promoters50/5662743
tattctttta

SEQ ID NO: 74631 - DNA, 13 bp, Unknown
  misc_feature (1)..( 13): Matrix.004 file - promoters50/5662743
aatttgaattttt

SEQ ID NO: 74632 - DNA, 14 bp, Unknown
  misc_feature (1)..( 14): Matrix.004 file - promoters50/5662743
tttatttgataaaa

SEQ ID NO: 74633 - DNA, 10 bp, Unknown
  misc_feature (1)..( 10): Matrix.004 file - promoters50/5662749
acaagattta

SEQ ID NO: 74634 - DNA, 10 bp, Unknown
  misc_feature (1)..( 10): Matrix.004 file - promoters50/5662749
taaaataatc

SEQ ID NO: 74635 - DNA, 11 bp, Unknown
  misc_feature (1)..( 11): Matrix.004 file - promoters50/5662763
ttgcaaaaatc

SEQ ID NO: 74636 - DNA, 8 bp, Unknown
  misc_feature (1)..( 8): Matrix.004 file - promoters50/5662763
ttttaata

SEQ ID NO: 74637 - DNA, 9 bp, Unknown
  misc_feature (1)..( 9): Matrix.004 file - promoters50/5662763
tttgttttt

SEQ ID NO: 74638 - DNA, 9 bp, Unknown
  misc_feature (1)..( 9): Matrix.004 file - promoters50/5662763
atgattttg

SEQ ID NO: 74639 - DNA, 7 bp, Unknown
  misc_feature (1)..( 7): Matrix.004 file - promoters50/5662763
aatatgt

SEQ ID NO: 74640 - DNA, 8 bp, Unknown
  misc_feature (1)..( 8): Matrix.004 file - promoters50/5662763
ataattta

SEQ ID NO: 74641 - DNA, 10 bp, Unknown
  misc_feature (1)..( 10): Matrix.004 file - promoters50/5662763
atttttctgt

SEQ ID NO: 74642 - DNA, 8 bp, Unknown
  misc_feature (1)..( 8): Matrix.004 file - promoters50/5662763
taacaaaa

SEQ ID NO: 74643 - DNA, 8 bp, Unknown
  misc_feature (1)..( 8): Matrix.004 file - promoters50/5662763
taatataa

SEQ ID NO: 74644 - DNA, 10 bp, Unknown
  misc_feature (1)..( 10): Matrix.004 file - promoters50/5662765
ttttgaattg

SEQ ID NO: 74645 - DNA, 9 bp, Unknown
  misc_feature (1)..( 9): Matrix.004 file - promoters50/5662765
attgttttc

SEQ ID NO: 74646 - DNA, 12 bp, Unknown
  misc_feature (1)..( 12): Matrix.004 file - promoters50/5662765
attttgataatt

SEQ ID NO: 74647 - DNA, 11 bp, Unknown
  misc_feature (1)..( 11): Matrix.004 file - promoters50/5662765
aatatgatcga

SEQ ID NO: 74648 - DNA, 10 bp, Unknown
  misc_feature (1)..( 10): Matrix.004 file - promoters50/5662765
atattttcat

SEQ ID NO: 74649 - DNA, 13 bp, Unknown
  misc_feature (1)..( 13): Matrix.004 file - promoters50/5662765
ttttttaactttt

SEQ ID NO: 74650 - DNA, 14 bp, Unknown
  misc_feature (1)..( 14): Matrix.004 file - promoters50/5662765
tatcaatagaaaca

SEQ ID NO: 74651 - DNA, 10 bp, Unknown
  misc_feature (1)..( 10): Matrix.004 file - promoters50/5662765
taaggcccaa

SEQ ID NO: 74652 - DNA, 9 bp, Unknown
  misc_feature (1)..( 9): Matrix.004 file - promoters50/5662769
tatctaatt

SEQ ID NO: 74653 - DNA, 7 bp, Unknown
  misc_feature (1)..( 7): Matrix.004 file - promoters50/5662769
taataaa

SEQ ID NO: 74654 - DNA, 9 bp, Unknown
  misc_feature (1)..( 9): Matrix.004 file - promoters50/5662779
ttgttttgc

SEQ ID NO: 74655 - DNA, 13 bp, Unknown
  misc_feature (1)..( 13): Matrix.004 file - promoters50/5662779
aaaaaataaatga

SEQ ID NO: 74656 - DNA, 14 bp, Unknown
  misc_feature (1)..( 14): Matrix.004 file - promoters50/5662779
ttgcaaaagaggca

SEQ ID NO: 74657 - DNA, 13 bp, Unknown
  misc_feature (1)..( 13): Matrix.004 file - promoters50/5662779
aaaaaattgatgt

SEQ ID NO: 74658 - DNA, 11 bp, Unknown
  misc_feature (1)..( 11): Matrix.004 file - promoters50/5662779
agttaaataaa

SEQ ID NO: 74659 - DNA, 15 bp, Unknown
  misc_feature (1)..( 15): Matrix.004 file - promoters50/5662779
aaaaaattaatgtaa

SEQ ID NO: 74660 - DNA, 8 bp, Unknown
  misc_feature (1)..( 8): Matrix.004 file - promoters50/5662783
agtgaaca

SEQ ID NO: 74661 - DNA, 10 bp, Unknown
  misc_feature (1)..( 10): Matrix.004 file - promoters50/5662783
aatgaattaa

SEQ ID NO: 74662 - DNA, 10 bp, Unknown
  misc_feature (1)..( 10): Matrix.004 file - promoters50/5662783
ataaaattca

SEQ ID NO: 74663 - DNA, 13 bp, Unknown
  misc_feature (1)..( 13): Matrix.004 file - promoters50/5662785
tatcaaatagttg

SEQ ID NO: 74664 - DNA, 10 bp, Unknown
  misc_feature (1)..( 10): Matrix.004 file - promoters50/5662785
attgtttaat

SEQ ID NO: 74665 - DNA, 8 bp, Unknown
  misc_feature (1)..( 8): Matrix.004 file - promoters50/5662805
atttctta

SEQ ID NO: 74666 - DNA, 7 bp, Unknown
  misc_feature (1)..( 7): Matrix.004 file - promoters50/5662805
tttggtt

SEQ ID NO: 74667 - DNA, 9 bp, Unknown
  misc_feature (1)..( 9): Matrix.004 file - promoters50/5662805
tttttatat

SEQ ID NO: 74668 - DNA, 7 bp, Unknown
  misc_feature (1)..( 7): Matrix.004 file - promoters50/5662805
gttgtgg

SEQ ID NO: 74669 - DNA, 17 bp, Unknown
  misc_feature (1)..( 17): Matrix.004 file - promoters50/5662809
tactatataaacataac

SEQ ID NO: 74670 - DNA, 9 bp, Unknown
  misc_feature (1)..( 9): Matrix.004 file - promoters50/5662809
attttttta

SEQ ID NO: 74671 - DNA, 7 bp, Unknown
  misc_feature (1)..( 7): Matrix.004 file - promoters50/5662828
tttttat

SEQ ID NO: 74672 - DNA, 11 bp, Unknown
  misc_feature (1)..( 11): Matrix.004 file - promoters50/5662828
tttataaatat

SEQ ID NO: 74673 - DNA, 10 bp, Unknown
  misc_feature (1)..( 10): Matrix.004 file - promoters50/5662828
taaattttga

SEQ ID NO: 74674 - DNA, 17 bp, Unknown
  misc_feature (1)..( 17): Matrix.004 file - promoters50/5662832
taaattctaaaataatg

SEQ ID NO: 74675 - DNA, 8 bp, Unknown
  misc_feature (1)..( 8): Matrix.004 file - promoters50/5662832
tttggttc

SEQ ID NO: 74676 - DNA, 8 bp, Unknown
  misc_feature (1)..( 8): Matrix.004 file - promoters50/5662832
attattta

SEQ ID NO: 74677 - DNA, 14 bp, Unknown
  misc_feature (1)..( 14): Matrix.004 file - promoters50/5662835
gattctcgcacgaa

SEQ ID NO: 74678 - DNA, 10 bp, Unknown
  misc_feature (1)..( 10): Matrix.004 file - promoters50/5662843
aaacaaattt

SEQ ID NO: 74679 - DNA, 10 bp, Unknown
  misc_feature (1)..( 10): Matrix.004 file - promoters50/5662846
aatcataaat

SEQ ID NO: 74680 - DNA, 10 bp, Unknown
  misc_feature (1)..( 10): Matrix.004 file - promoters50/5662846
tttcttttta

SEQ ID NO: 74681 - DNA, 12 bp, Unknown
  misc_feature (1)..( 12): Matrix.004 file - promoters50/5662846
ataaaatataaa

SEQ ID NO: 74682 - DNA, 8 bp, Unknown
  misc_feature (1)..( 8): Matrix.004 file - promoters50/5662846
tttcgaaa

SEQ ID NO: 74683 - DNA, 7 bp, Unknown
  misc_feature (1)..( 7): Matrix.004 file - promoters50/5662846
taaaaaa

SEQ ID NO: 74684 - DNA, 16 bp, Unknown
  misc_feature (1)..( 16): Matrix.004 file - promoters50/5662846
aaaataattacctaat

SEQ ID NO: 74685 - DNA, 9 bp, Unknown
  misc_feature (1)..( 9): Matrix.004 file - promoters50/5662846
tcaaaaata

SEQ ID NO: 74686 - DNA, 11 bp, Unknown
  misc_feature (1)..( 11): Matrix.004 file - promoters50/5662850
aaaaatacaaa

SEQ ID NO: 74687 - DNA, 8 bp, Unknown
  misc_feature (1)..( 8): Matrix.004 file - promoters50/5662850
gcaaattt

SEQ ID NO: 74688 - DNA, 9 bp, Unknown
  misc_feature (1)..( 9): Matrix.004 file - promoters50/5662850
aataaagga

SEQ ID NO: 74689 - DNA, 11 bp, Unknown
  misc_feature (1)..( 11): Matrix.004 file - promoters50/5662850
cgtatctaaag

SEQ ID NO: 74690 - DNA, 12 bp, Unknown
  misc_feature (1)..( 12): Matrix.004 file - promoters50/5662850
taatttatatgt

SEQ ID NO: 74691 - DNA, 13 bp, Unknown
  misc_feature (1)..( 13): Matrix.004 file - promoters50/5662850
taaattatatgtt

SEQ ID NO: 74692 - DNA, 9 bp, Unknown
  misc_feature (1)..( 9): Matrix.004 file - promoters50/5662850
tcttcattt

SEQ ID NO: 74693 - DNA, 7 bp, Unknown
  misc_feature (1)..( 7): Matrix.004 file - promoters50/5662850
tttttct

SEQ ID NO: 74694 - DNA, 10 bp, Unknown
  misc_feature (1)..( 10): Matrix.004 file - promoters50/5662850
ctttattctt

SEQ ID NO: 74695 - DNA, 9 bp, Unknown
  misc_feature (1)..( 9): Matrix.004 file - promoters50/5662850
tatataaaa

SEQ ID NO: 74696 - DNA, 9 bp, Unknown
  misc_feature (1)..( 9): Matrix.004 file - promoters50/5662850
ataatactt

SEQ ID NO: 74697 - DNA, 7 bp, Unknown
  misc_feature (1)..( 7): Matrix.004 file - promoters50/5662893
tttcggg

SEQ ID NO: 74698 - DNA, 9 bp, Unknown
  misc_feature (1)..( 9): Matrix.004 file - promoters50/5662893
tttttattg

SEQ ID NO: 74699 - DNA, 11 bp, Unknown
  misc_feature (1)..( 11): Matrix.004 file - promoters50/5662893
agacaaaaaaa

SEQ ID NO: 74700 - DNA, 11 bp, Unknown
  misc_feature (1)..( 11): Matrix.004 file - promoters50/5662895
aaaattataaa

SEQ ID NO: 74701 - DNA, 11 bp, Unknown
  misc_feature (1)..( 11): Matrix.004 file - promoters50/5662895
atattcttaac

SEQ ID NO: 74702 - DNA, 12 bp, Unknown
  misc_feature (1)..( 12): Matrix.004 file - promoters50/5662895
aaaattcttaac

SEQ ID NO: 74703 - DNA, 8 bp, Unknown
  misc_feature (1)..( 8): Matrix.004 file - promoters50/5662902
ataaaaaa

SEQ ID NO: 74704 - DNA, 12 bp, Unknown
  misc_feature (1)..( 12): Matrix.004 file - promoters50/5662906
agaagatggtaa

SEQ ID NO: 74705 - DNA, 9 bp, Unknown
  misc_feature (1)..( 9): Matrix.004 file - promoters50/5662906
acaaaaaaa

SEQ ID NO: 74706 - DNA, 8 bp, Unknown
  misc_feature (1)..( 8): Matrix.004 file - promoters50/5662910
ataaaaaa

SEQ ID NO: 74707 - DNA, 11 bp, Unknown
  misc_feature (1)..( 11): Matrix.004 file - promoters50/5662910
atatgagaaaa

SEQ ID NO: 74708 - DNA, 8 bp, Unknown
  misc_feature (1)..( 8): Matrix.004 file - promoters50/5662910
aaattaaa

SEQ ID NO: 74709 - DNA, 10 bp, Unknown
  misc_feature (1)..( 10): Matrix.004 file - promoters50/5662914
aagaatatat

SEQ ID NO: 74710 - DNA, 9 bp, Unknown
  misc_feature (1)..( 9): Matrix.004 file - promoters50/5662914
aagaagttg

SEQ ID NO: 74711 - DNA, 10 bp, Unknown
  misc_feature (1)..( 10): Matrix.004 file - promoters50/5662921
tttattaaaa

SEQ ID NO: 74712 - DNA, 11 bp, Unknown
  misc_feature (1)..( 11): Matrix.004 file - promoters50/5662945
ctaatttcaaa

SEQ ID NO: 74713 - DNA, 7 bp, Unknown
  misc_feature (1)..( 7): Matrix.004 file - promoters50/5662945
aattgat

SEQ ID NO: 74714 - DNA, 7 bp, Unknown
  misc_feature (1)..( 7): Matrix.004 file - promoters50/5662945
ccaagaa

SEQ ID NO: 74715 - DNA, 8 bp, Unknown
  misc_feature (1)..( 8): Matrix.004 file - promoters50/5662948
attgtttg

SEQ ID NO: 74716 - DNA, 15 bp, Unknown
  misc_feature (1)..( 15): Matrix.004 file - promoters50/5662963
atctgatgttgtttg

SEQ ID NO: 74717 - DNA, 7 bp, Unknown
  misc_feature (1)..( 7): Matrix.004 file - promoters50/5662967
tttgtat

SEQ ID NO: 74718 - DNA, 14 bp, Unknown
  misc_feature (1)..( 14): Matrix.004 file - promoters50/5662967
ttagataagaaaaa

SEQ ID NO: 74719 - DNA, 9 bp, Unknown
  misc_feature (1)..( 9): Matrix.004 file - promoters50/5662967
aataaaata

SEQ ID NO: 74720 - DNA, 12 bp, Unknown
  misc_feature (1)..( 12): Matrix.004 file - promoters50/5662967
caaaaaaaatca

SEQ ID NO: 74721 - DNA, 10 bp, Unknown
  misc_feature (1)..( 10): Matrix.004 file - promoters50/5662967
aaataaacaa

SEQ ID NO: 74722 - DNA, 10 bp, Unknown
  misc_feature (1)..( 10): Matrix.004 file - promoters50/5662967
aaataaaaag

SEQ ID NO: 74723 - DNA, 9 bp, Unknown
  misc_feature (1)..( 9): Matrix.004 file - promoters50/5662992
ttatataga

SEQ ID NO: 74724 - DNA, 8 bp, Unknown
  misc_feature (1)..( 8): Matrix.004 file - promoters50/5662992
aaacaaat

SEQ ID NO: 74725 - DNA, 9 bp, Unknown
  misc_feature (1)..( 9): Matrix.004 file - promoters50/5662992
aaagtaact

SEQ ID NO: 74726 - DNA, 7 bp, Unknown
  misc_feature (1)..( 7): Matrix.004 file - promoters50/5662992
cgaaaat

SEQ ID NO: 74727 - DNA, 8 bp, Unknown
  misc_feature (1)..( 8): Matrix.004 file - promoters50/5662992
gaaaatat

SEQ ID NO: 74728 - DNA, 7 bp, Unknown
  misc_feature (1)..( 7): Matrix.004 file - promoters50/5662992
ttatata

SEQ ID NO: 74729 - DNA, 13 bp, Unknown
  misc_feature (1)..( 13): Matrix.004 file - promoters50/5662992
taattagaaaaaa

SEQ ID NO: 74730 - DNA, 8 bp, Unknown
  misc_feature (1)..( 8): Matrix.004 file - promoters50/5662992
attttaaa

SEQ ID NO: 74731 - DNA, 11 bp, Unknown
  misc_feature (1)..( 11): Matrix.004 file - promoters50/5662992
atattaatatc

SEQ ID NO: 74732 - DNA, 11 bp, Unknown
  misc_feature (1)..( 11): Matrix.004 file - promoters50/5662992
ttagaaaaaat

SEQ ID NO: 74733 - DNA, 10 bp, Unknown
  misc_feature (1)..( 10): Matrix.004 file - promoters50/5663017
ttctttttca

SEQ ID NO: 74734 - DNA, 7 bp, Unknown
  misc_feature (1)..( 7): Matrix.004 file - promoters50/5663017
catgaag

SEQ ID NO: 74735 - DNA, 9 bp, Unknown
  misc_feature (1)..( 9): Matrix.004 file - promoters50/5663017
cagaattta

SEQ ID NO: 74736 - DNA, 10 bp, Unknown
  misc_feature (1)..( 10): Matrix.004 file - promoters50/5663028
gaagatggaa

SEQ ID NO: 74737 - DNA, 7 bp, Unknown
  misc_feature (1)..( 7): Matrix.004 file - promoters50/5663030
acaaaaa

SEQ ID NO: 74738 - DNA, 9 bp, Unknown
  misc_feature (1)..( 9): Matrix.004 file - promoters50/5663030
gcttgcttt

SEQ ID NO: 74739 - DNA, 9 bp, Unknown
  misc_feature (1)..( 9): Matrix.004 file - promoters50/5663034
aagaaaccg

SEQ ID NO: 74740 - DNA, 14 bp, Unknown
  misc_feature (1)..( 14): Matrix.004 file - promoters50/5663034
aactcattttctta

SEQ ID NO: 74741 - DNA, 10 bp, Unknown
  misc_feature (1)..( 10): Matrix.004 file - promoters50/5663034
aattttaggt

SEQ ID NO: 74742 - DNA, 8 bp, Unknown
  misc_feature (1)..( 8): Matrix.004 file - promoters50/5663050
attttgtt

SEQ ID NO: 74743 - DNA, 8 bp, Unknown
  misc_feature (1)..( 8): Matrix.004 file - promoters50/5663050
atcaaatt

SEQ ID NO: 74744 - DNA, 8 bp, Unknown
  misc_feature (1)..( 8): Matrix.004 file - promoters50/5663050
cttattta

SEQ ID NO: 74745 - DNA, 7 bp, Unknown
  misc_feature (1)..( 7): Matrix.004 file - promoters50/5663054
tatttat

SEQ ID NO: 74746 - DNA, 9 bp, Unknown
  misc_feature (1)..( 9): Matrix.004 file - promoters50/5663054
ttcacaaat

SEQ ID NO: 74747 - DNA, 12 bp, Unknown
  misc_feature (1)..( 12): Matrix.004 file - promoters50/5663054
aaattcaaagat

SEQ ID NO: 74748 - DNA, 8 bp, Unknown
  misc_feature (1)..( 8): Matrix.004 file - promoters50/5663054
aaagatga

SEQ ID NO: 74749 - DNA, 7 bp, Unknown
  misc_feature (1)..( 7): Matrix.004 file - promoters50/5663054
ataatta

SEQ ID NO: 74750 - DNA, 10 bp, Unknown
  misc_feature (1)..( 10): Matrix.004 file - promoters50/5663054
gatttatgta

SEQ ID NO: 74751 - DNA, 7 bp, Unknown
  misc_feature (1)..( 7): Matrix.004 file - promoters50/5663054
ccctata

SEQ ID NO: 74752 - DNA, 11 bp, Unknown
  misc_feature (1)..( 11): Matrix.004 file - promoters50/5663054
cattatcaaaa

SEQ ID NO: 74753 - DNA, 8 bp, Unknown
  misc_feature (1)..( 8): Matrix.004 file - promoters50/5663054
ttttacag

SEQ ID NO: 74754 - DNA, 10 bp, Unknown
  misc_feature (1)..( 10): Matrix.004 file - promoters50/5663054
aacattcaaa

SEQ ID NO: 74755 - DNA, 9 bp, Unknown
  misc_feature (1)..( 9): Matrix.004 file - promoters50/5663061
cctataaaa

SEQ ID NO: 74756 - DNA, 12 bp, Unknown
  misc_feature (1)..( 12): Matrix.004 file - promoters50/5663069
gagtttttctca

SEQ ID NO: 74757 - DNA, 11 bp, Unknown
  misc_feature (1)..( 11): Matrix.004 file - promoters50/5663069
ttttcgaaaaa

SEQ ID NO: 74758 - DNA, 10 bp, Unknown
  misc_feature (1)..( 10): Matrix.004 file - promoters50/5663093
gtctaaaaaa

SEQ ID NO: 74759 - DNA, 12 bp, Unknown
  misc_feature (1)..( 12): Matrix.004 file - promoters50/5663093
gttgatctttca

SEQ ID NO: 74760 - DNA, 7 bp, Unknown
  misc_feature (1)..( 7): Matrix.004 file - promoters50/5663093
aaagttg

SEQ ID NO: 74761 - DNA, 8 bp, Unknown
  misc_feature (1)..( 8): Matrix.004 file - promoters50/5663093
attacttg

SEQ ID NO: 74762 - DNA, 10 bp, Unknown
  misc_feature (1)..( 10): Matrix.004 file - promoters50/5663093
atttatgtgt

SEQ ID NO: 74763 - DNA, 7 bp, Unknown
  misc_feature (1)..( 7): Matrix.004 file - promoters50/5663093
tgaaaat

SEQ ID NO: 74764 - DNA, 12 bp, Unknown
  misc_feature (1)..( 12): Matrix.004 file - promoters50/5663093
ttaagtgtaaac

SEQ ID NO: 74765 - DNA, 7 bp, Unknown
  misc_feature (1)..( 7): Matrix.004 file - promoters50/5663093
atgatgt

SEQ ID NO: 74766 - DNA, 8 bp, Unknown
  misc_feature (1)..( 8): Matrix.004 file - promoters50/5663093
tgggattt

SEQ ID NO: 74767 - DNA, 7 bp, Unknown
  misc_feature (1)..( 7): Matrix.004 file - promoters50/5663097
acattgc

SEQ ID NO: 74768 - DNA, 7 bp, Unknown
  misc_feature (1)..( 7): Matrix.004 file - promoters50/5663097
ataaaca

SEQ ID NO: 74769 - DNA, 15 bp, Unknown
  misc_feature (1)..( 15): Matrix.004 file - promoters50/5663116
ctcatatatataaag

SEQ ID NO: 74770 - DNA, 13 bp, Unknown
  misc_feature (1)..( 13): Matrix.004 file - promoters50/5663116
cattaatttcctc

SEQ ID NO: 74771 - DNA, 6 bp, Unknown
  misc_feature (1)..( 6): Matrix.004 file - promoters50/5663116
tttaat

SEQ ID NO: 74772 - DNA, 14 bp, Unknown
  misc_feature (1)..( 14): Matrix.004 file - promoters50/5663134
aaaaatttatgctt

SEQ ID NO: 74773 - DNA, 10 bp, Unknown
  misc_feature (1)..( 10): Matrix.004 file - promoters50/5663138
ttaaaataaa

SEQ ID NO: 74774 - DNA, 14 bp, Unknown
  misc_feature (1)..( 14): Matrix.004 file - promoters50/5663138
actaaacaaaagat

SEQ ID NO: 74775 - DNA, 16 bp, Unknown
  misc_feature (1)..( 16): Matrix.004 file - promoters50/5663142
ttgaagcaaaaatatt

SEQ ID NO: 74776 - DNA, 8 bp, Unknown
  misc_feature (1)..( 8): Matrix.004 file - promoters50/5663142
aaataatg

SEQ ID NO: 74777 - DNA, 10 bp, Unknown
  misc_feature (1)..( 10): Matrix.004 file - promoters50/5663142
tcaaataaaa

SEQ ID NO: 74778 - DNA, 13 bp, Unknown
  misc_feature (1)..( 13): Matrix.004 file - promoters50/5663142
acttataataaat

SEQ ID NO: 74779 - DNA, 6 bp, Unknown
  misc_feature (1)..( 6): Matrix.004 file - promoters50/5663148
aaaata

SEQ ID NO: 74780 - DNA, 10 bp, Unknown
  misc_feature (1)..( 10): Matrix.004 file - promoters50/5663148
tataagtgtt

SEQ ID NO: 74781 - DNA, 9 bp, Unknown
  misc_feature (1)..( 9): Matrix.004 file - promoters50/5663148
tctcttata

SEQ ID NO: 74782 - DNA, 8 bp, Unknown
  misc_feature (1)..( 8): Matrix.004 file - promoters50/5663148
tttatgca

SEQ ID NO: 74783 - DNA, 10 bp, Unknown
  misc_feature (1)..( 10): Matrix.004 file - promoters50/5663151
cagatttatt

SEQ ID NO: 74784 - DNA, 10 bp, Unknown
  misc_feature (1)..( 10): Matrix.004 file - promoters50/5663151
aagaaatgat

SEQ ID NO: 74785 - DNA, 9 bp, Unknown
  misc_feature (1)..( 9): Matrix.004 file - promoters50/5663154
caaacccaa

SEQ ID NO: 74786 - DNA, 5 bp, Unknown
  misc_feature (1)..( 5): Matrix.004 file - promoters50/5663154
aaatt

SEQ ID NO: 74787 - DNA, 10 bp, Unknown
  misc_feature (1)..( 10): Matrix.004 file - promoters50/5663154
aatgataaaa

SEQ ID NO: 74788 - DNA, 12 bp, Unknown
  misc_feature (1)..( 12): Matrix.004 file - promoters50/5663154
aaatgtttaata

SEQ ID NO: 74789 - DNA, 9 bp, Unknown
  misc_feature (1)..( 9): Matrix.004 file - promoters50/5663162
taatttttt

SEQ ID NO: 74790 - DNA, 8 bp, Unknown
  misc_feature (1)..( 8): Matrix.004 file - promoters50/5663162
ctcaatat

SEQ ID NO: 74791 - DNA, 11 bp, Unknown
  misc_feature (1)..( 11): Matrix.004 file - promoters50/5663162
taatcaaaatt

SEQ ID NO: 74792 - DNA, 8 bp, Unknown
  misc_feature (1)..( 8): Matrix.004 file - promoters50/5663162
aaatctat

SEQ ID NO: 74793 - DNA, 10 bp, Unknown
  misc_feature (1)..( 10): Matrix.004 file - promoters50/5663162
ttaaaataac

SEQ ID NO: 74794 - DNA, 7 bp, Unknown
  misc_feature (1)..( 7): Matrix.004 file - promoters50/5663162
ttaaaaa

SEQ ID NO: 74795 - DNA, 7 bp, Unknown
  misc_feature (1)..( 7): Matrix.004 file - promoters50/5663170
aattaaa

SEQ ID NO: 74796 - DNA, 10 bp, Unknown
  misc_feature (1)..( 10): Matrix.004 file - promoters50/5663170
ataagaataa

SEQ ID NO: 74797 - DNA, 7 bp, Unknown
  misc_feature (1)..( 7): Matrix.004 file - promoters50/5663170
taaataa

SEQ ID NO: 74798 - DNA, 9 bp, Unknown
  misc_feature (1)..( 9): Matrix.004 file - promoters50/5663174
aagaattta

SEQ ID NO: 74799 - DNA, 7 bp, Unknown
  misc_feature (1)..( 7): Matrix.004 file - promoters50/5663182
aaaagat

SEQ ID NO: 74800 - DNA, 10 bp, Unknown
  misc_feature (1)..( 10): Matrix.004 file - promoters50/5663182
aaaaatgtaa

SEQ ID NO: 74801 - DNA, 8 bp, Unknown
  misc_feature (1)..( 8): Matrix.004 file - promoters50/5663182
aaataaat

SEQ ID NO: 74802 - DNA, 6 bp, Unknown
  misc_feature (1)..( 6): Matrix.004 file - promoters50/5663182
ataaat

SEQ ID NO: 74803 - DNA, 9 bp, Unknown
  misc_feature (1)..( 9): Matrix.004 file - promoters50/5663186
tttcggttc

SEQ ID NO: 74804 - DNA, 8 bp, Unknown
  misc_feature (1)..( 8): Matrix.004 file - promoters50/5663197
ataaatac

SEQ ID NO: 74805 - DNA, 9 bp, Unknown
  misc_feature (1)..( 9): Matrix.004 file - promoters50/5663197
gaggtgatg

SEQ ID NO: 74806 - DNA, 7 bp, Unknown
  misc_feature (1)..( 7): Matrix.004 file - promoters50/5663197
gaagaag

SEQ ID NO: 74807 - DNA, 10 bp, Unknown
  misc_feature (1)..( 10): Matrix.004 file - promoters50/5663221
ctttccttct

SEQ ID NO: 74808 - DNA, 12 bp, Unknown
  misc_feature (1)..( 12): Matrix.004 file - promoters50/5663224
ttaagacccgaa

SEQ ID NO: 74809 - DNA, 11 bp, Unknown
  misc_feature (1)..( 11): Matrix.004 file - promoters50/5663224
actatttataa

SEQ ID NO: 74810 - DNA, 11 bp, Unknown
  misc_feature (1)..( 11): Matrix.004 file - promoters50/5663224
atcagaatttt

SEQ ID NO: 74811 - DNA, 8 bp, Unknown
  misc_feature (1)..( 8): Matrix.004 file - promoters50/5663224
catttgtt

SEQ ID NO: 74812 - DNA, 10 bp, Unknown
  misc_feature (1)..( 10): Matrix.004 file - promoters50/5663224
aatttttatt

SEQ ID NO: 74813 - DNA, 6 bp, Unknown
  misc_feature (1)..( 6): Matrix.004 file - promoters50/5663234
atcaat

SEQ ID NO: 74814 - DNA, 12 bp, Unknown
  misc_feature (1)..( 12): Matrix.004 file - promoters50/5663234
atcataaaagaa

SEQ ID NO: 74815 - DNA, 11 bp, Unknown
  misc_feature (1)..( 11): Matrix.004 file - promoters50/5663234
attatttttat

SEQ ID NO: 74816 - DNA, 4 bp, Unknown
  misc_feature (1)..( 4): Matrix.004 file - promoters50/5663234
taaa

SEQ ID NO: 74817 - DNA, 10 bp, Unknown
  misc_feature (1)..( 10): Matrix.004 file - promoters50/5663234
catttaaaaa

SEQ ID NO: 74818 - DNA, 12 bp, Unknown
  misc_feature (1)..( 12): Matrix.004 file - promoters50/5663249
tatatataaaaa

SEQ ID NO: 74819 - DNA, 7 bp, Unknown
  misc_feature (1)..( 7): Matrix.004 file - promoters50/5663249
attttct

SEQ ID NO: 74820 - DNA, 8 bp, Unknown
  misc_feature (1)..( 8): Matrix.004 file - promoters50/5663249
taaattaa

SEQ ID NO: 74821 - DNA, 11 bp, Unknown
  misc_feature (1)..( 11): Matrix.004 file - promoters50/5663249
tcaaattaatc

SEQ ID NO: 74822 - DNA, 12 bp, Unknown
  misc_feature (1)..( 12): Matrix.004 file - promoters50/5663253
tatttttcataa

SEQ ID NO: 74823 - DNA, 7 bp, Unknown
  misc_feature (1)..( 7): Matrix.004 file - promoters50/5663264
gaaggaa

SEQ ID NO: 74824 - DNA, 7 bp, Unknown
  misc_feature (1)..( 7): Matrix.004 file - promoters50/5663301
aatgggc

SEQ ID NO: 74825 - DNA, 9 bp, Unknown
  misc_feature (1)..( 9): Matrix.004 file - promoters50/5663301
aaaaaataa

SEQ ID NO: 74826 - DNA, 10 bp, Unknown
  misc_feature (1)..( 10): Matrix.004 file - promoters50/5663301
aaaaacaaaa

SEQ ID NO: 74827 - DNA, 10 bp, Unknown
  misc_feature (1)..( 10): Matrix.004 file - promoters50/5663301
attaaaacaa

SEQ ID NO: 74828 - DNA, 13 bp, Unknown
  misc_feature (1)..( 13): Matrix.004 file - promoters50/5663305
tctaacttgtttt

SEQ ID NO: 74829 - DNA, 10 bp, Unknown
  misc_feature (1)..( 10): Matrix.004 file - promoters50/5663305
gtttaatata

SEQ ID NO: 74830 - DNA, 10 bp, Unknown
  misc_feature (1)..( 10): Matrix.004 file - promoters50/5663305
aacagagata

SEQ ID NO: 74831 - DNA, 10 bp, Unknown
  misc_feature (1)..( 10): Matrix.004 file - promoters50/5663313
aaattgatat

SEQ ID NO: 74832 - DNA, 7 bp, Unknown
  misc_feature (1)..( 7): Matrix.004 file - promoters50/5663313
tgattag

SEQ ID NO: 74833 - DNA, 7 bp, Unknown
  misc_feature (1)..( 7): Matrix.004 file - promoters50/5663313
gaattgc

SEQ ID NO: 74834 - DNA, 7 bp, Unknown
  misc_feature (1)..( 7): Matrix.004 file - promoters50/5663313
attcttc

SEQ ID NO: 74835 - DNA, 8 bp, Unknown
  misc_feature (1)..( 8): Matrix.005 file - promoters50/5663313
ggtgttgt

SEQ ID NO: 74836 - DNA, 10 bp, Unknown
  misc_feature (1)..( 10): Matrix.005 file - promoters50/5663313
tgtaatcggg

SEQ ID NO: 74837 - DNA, 11 bp, Unknown
  misc_feature (1)..( 11): Matrix.005 file - promoters50/5663327
tacattttttc

SEQ ID NO: 74838 - DNA, 12 bp, Unknown
  misc_feature (1)..( 12): Matrix.005 file - promoters50/5663327
tttataatctaa

SEQ ID NO: 74839 - DNA, 8 bp, Unknown
  misc_feature (1)..( 8): Matrix.005 file - promoters50/5663327
aaatctaa

SEQ ID NO: 74840 - DNA, 11 bp, Unknown
  misc_feature (1)..( 11): Matrix.005 file - promoters50/5663327
tacattttttt

SEQ ID NO: 74841 - DNA, 14 bp, Unknown
  misc_feature (1)..( 14): Matrix.005 file - promoters50/5663327
aatattttatcctt

SEQ ID NO: 74842 - DNA, 9 bp, Unknown
  misc_feature (1)..( 9): Matrix.005 file - promoters50/5663329
gttggtttt

SEQ ID NO: 74843 - DNA, 11 bp, Unknown
  misc_feature (1)..( 11): Matrix.005 file - promoters50/5663333
cgatcatgaat

SEQ ID NO: 74844 - DNA, 8 bp, Unknown
  misc_feature (1)..( 8): Matrix.005 file - promoters50/5663333
catgaata

SEQ ID NO: 74845 - DNA, 15 bp, Unknown
  misc_feature (1)..( 15): Matrix.005 file - promoters50/5663336
aaataattaaacatt

SEQ ID NO: 74846 - DNA, 6 bp, Unknown
  misc_feature (1)..( 6): Matrix.005 file - promoters50/5663336
ctaaaa

SEQ ID NO: 74847 - DNA, 13 bp, Unknown
  misc_feature (1)..( 13): Matrix.005 file - promoters50/5663336
ctaatttttttaa

SEQ ID NO: 74848 - DNA, 9 bp, Unknown
  misc_feature (1)..( 9): Matrix.005 file - promoters50/5663336
aatttattg

SEQ ID NO: 74849 - DNA, 8 bp, Unknown
  misc_feature (1)..( 8): Matrix.005 file - promoters50/5663336
tataagta

SEQ ID NO: 74850 - DNA, 8 bp, Unknown
  misc_feature (1)..( 8): Matrix.005 file - promoters50/5663347
gttgtaat

SEQ ID NO: 74851 - DNA, 7 bp, Unknown
  misc_feature (1)..( 7): Matrix.005 file - promoters50/5663347
tcaaaac

SEQ ID NO: 74852 - DNA, 11 bp, Unknown
  misc_feature (1)..( 11): Matrix.005 file - promoters50/5663347
acgaagactat

SEQ ID NO: 74853 - DNA, 8 bp, Unknown
  misc_feature (1)..( 8): Matrix.005 file - promoters50/5663358
aaaaaaaa

SEQ ID NO: 74854 - DNA, 9 bp, Unknown
  misc_feature (1)..( 9): Matrix.005 file - promoters50/5663358
gaaaaaaac

SEQ ID NO: 74855 - DNA, 9 bp, Unknown
  misc_feature (1)..( 9): Matrix.005 file - promoters50/5663370
tggtaatta

SEQ ID NO: 74856 - DNA, 8 bp, Unknown
  misc_feature (1)..( 8): Matrix.005 file - promoters50/5663370
ttcaacat

SEQ ID NO: 74857 - DNA, 16 bp, Unknown
  misc_feature (1)..( 16): Matrix.005 file - promoters50/5663374
aataaattaaatatct

SEQ ID NO: 74858 - DNA, 10 bp, Unknown
  misc_feature (1)..( 10): Matrix.005 file - promoters50/5663374
agacattttc

SEQ ID NO: 74859 - DNA, 9 bp, Unknown
  misc_feature (1)..( 9): Matrix.005 file - promoters50/5663374
ttcccacta

SEQ ID NO: 74860 - DNA, 7 bp, Unknown
  misc_feature (1)..( 7): Matrix.005 file - promoters50/5663374
atttcca

SEQ ID NO: 74861 - DNA, 10 bp, Unknown
  misc_feature (1)..( 10): Matrix.005 file - promoters50/5663374
catcatgttc

SEQ ID NO: 74862 - DNA, 11 bp, Unknown
  misc_feature (1)..( 11): Matrix.005 file - promoters50/5663374
ttaattcaaaa

SEQ ID NO: 74863 - DNA, 7 bp, Unknown
  misc_feature (1)..( 7): Matrix.005 file - promoters50/5663406
attgtga

SEQ ID NO: 74864 - DNA, 11 bp, Unknown
  misc_feature (1)..( 11): Matrix.005 file - promoters50/5663406
cttacctaaat

SEQ ID NO: 74865 - DNA, 12 bp, Unknown
  misc_feature (1)..( 12): Matrix.005 file - promoters50/5663406
tgtcaatcattt

SEQ ID NO: 74866 - DNA, 14 bp, Unknown
  misc_feature (1)..( 14): Matrix.005 file - promoters50/5663418
ggtctattctcaat

SEQ ID NO: 74867 - DNA, 10 bp, Unknown
  misc_feature (1)..( 10): Matrix.005 file - promoters50/5663418
aaattatgat

SEQ ID NO: 74868 - DNA, 10 bp, Unknown
  misc_feature (1)..( 10): Matrix.005 file - promoters50/5663433
ggcttagatt

SEQ ID NO: 74869 - DNA, 8 bp, Unknown
  misc_feature (1)..( 8): Matrix.005 file - promoters50/5663433
tttttaga

SEQ ID NO: 74870 - DNA, 11 bp, Unknown
  misc_feature (1)..( 11): Matrix.005 file - promoters50/5663440
aaaaaaagaaa

SEQ ID NO: 74871 - DNA, 10 bp, Unknown
  misc_feature (1)..( 10): Matrix.005 file - promoters50/5663448
gattgttatg

SEQ ID NO: 74872 - DNA, 12 bp, Unknown
  misc_feature (1)..( 12): Matrix.005 file - promoters50/5663448
aactcaattaac

SEQ ID NO: 74873 - DNA, 9 bp, Unknown
  misc_feature (1)..( 9): Matrix.005 file - promoters50/5663448
tgtattgat

SEQ ID NO: 74874 - DNA, 15 bp, Unknown
  misc_feature (1)..( 15): Matrix.005 file - promoters50/5663448
tgttataattttcaa

SEQ ID NO: 74875 - DNA, 11 bp, Unknown
  misc_feature (1)..( 11): Matrix.005 file - promoters50/5663464
tttaaataatg

SEQ ID NO: 74876 - DNA, 8 bp, Unknown
  misc_feature (1)..( 8): Matrix.005 file - promoters50/5663464
tttttctt

SEQ ID NO: 74877 - DNA, 8 bp, Unknown
  misc_feature (1)..( 8): Matrix.005 file - promoters50/5663464
aatggaaa

SEQ ID NO: 74878 - DNA, 9 bp, Unknown
  misc_feature (1)..( 9): Matrix.005 file - promoters50/5663474
tcacaaaga

SEQ ID NO: 74879 - DNA, 7 bp, Unknown
  misc_feature (1)..( 7): Matrix.005 file - promoters50/5663474
gtttgat

SEQ ID NO: 74880 - DNA, 7 bp, Unknown
  misc_feature (1)..( 7): Matrix.005 file - promoters50/5663474
catataa

SEQ ID NO: 74881 - DNA, 9 bp, Unknown
  misc_feature (1)..( 9): Matrix.005 file - promoters50/5663474
tcaataatt

SEQ ID NO: 74882 - DNA, 8 bp, Unknown
  misc_feature (1)..( 8): Matrix.005 file - promoters50/5663474
aaagaaaa

SEQ ID NO: 74883 - DNA, 7 bp, Unknown
  misc_feature (1)..( 7): Matrix.005 file - promoters50/5663474
ataaatg

SEQ ID NO: 74884 - DNA, 13 bp, Unknown
  misc_feature (1)..( 13): Matrix.005 file - promoters50/5663478
ctcaaaattgaat

SEQ ID NO: 74885 - DNA, 8 bp, Unknown
  misc_feature (1)..( 8): Matrix.005 file - promoters50/5663478
tttattaa

SEQ ID NO: 74886 - DNA, 10 bp, Unknown
  misc_feature (1)..( 10): Matrix.005 file - promoters50/5663478
tgattagtaa

SEQ ID NO: 74887 - DNA, 9 bp, Unknown
  misc_feature (1)..( 9): Matrix.005 file - promoters50/5663482
ttgatagac

SEQ ID NO: 74888 - DNA, 7 bp, Unknown
  misc_feature (1)..( 7): Matrix.005 file - promoters50/5663482
gatagac

SEQ ID NO: 74889 - DNA, 11 bp, Unknown
  misc_feature (1)..( 11): Matrix.005 file - promoters50/5663482
gaacactaaag

SEQ ID NO: 74890 - DNA, 10 bp, Unknown
  misc_feature (1)..( 10): Matrix.005 file - promoters50/5663482
aacacttaag

SEQ ID NO: 74891 - DNA, 11 bp, Unknown
  misc_feature (1)..( 11): Matrix.005 file - promoters50/5663490
agttggagttt

SEQ ID NO: 74892 - DNA, 6 bp, Unknown
  misc_feature (1)..( 6): Matrix.005 file - promoters50/5663490
aaacga

SEQ ID NO: 74893 - DNA, 9 bp, Unknown
  misc_feature (1)..( 9): Matrix.005 file - promoters50/5663502
catttcttt

SEQ ID NO: 74894 - DNA, 11 bp, Unknown
  misc_feature (1)..( 11): Matrix.005 file - promoters50/5663502
atttatcaaat

SEQ ID NO: 74895 - DNA, 7 bp, Unknown
  misc_feature (1)..( 7): Matrix.005 file - promoters50/5663502
ttaaatt

SEQ ID NO: 74896 - DNA, 8 bp, Unknown
  misc_feature (1)..( 8): Matrix.005 file - promoters50/5663502
aattctta

SEQ ID NO: 74897 - DNA, 8 bp, Unknown
  misc_feature (1)..( 8): Matrix.005 file - promoters50/5663502
tttcaaac

SEQ ID NO: 74898 - DNA, 13 bp, Unknown
  misc_feature (1)..( 13): Matrix.005 file - promoters50/5663502
tcatatttttttg

SEQ ID NO: 74899 - DNA, 10 bp, Unknown
  misc_feature (1)..( 10): Matrix.005 file - promoters50/5663502
aaacacatct

SEQ ID NO: 74900 - DNA, 7 bp, Unknown
  misc_feature (1)..( 7): Matrix.005 file - promoters50/5663502
aaaaaat

SEQ ID NO: 74901 - DNA, 7 bp, Unknown
  misc_feature (1)..( 7): Matrix.005 file - promoters50/5663502
actttta

SEQ ID NO: 74902 - DNA, 7 bp, Unknown
  misc_feature (1)..( 7): Matrix.005 file - promoters50/5663502
cttttac

SEQ ID NO: 74903 - DNA, 6 bp, Unknown
  misc_feature (1)..( 6): Matrix.005 file - promoters50/5663535
ttacat

SEQ ID NO: 74904 - DNA, 8 bp, Unknown
  misc_feature (1)..( 8): Matrix.005 file - promoters50/5663535
ccactttt

SEQ ID NO: 74905 - DNA, 10 bp, Unknown
  misc_feature (1)..( 10): Matrix.005 file - promoters50/5663539
ttaataccat

SEQ ID NO: 74906 - DNA, 7 bp, Unknown
  misc_feature (1)..( 7): Matrix.005 file - promoters50/5663539
tattttt

SEQ ID NO: 74907 - DNA, 7 bp, Unknown
  misc_feature (1)..( 7): Matrix.005 file - promoters50/5663539
taatttt

SEQ ID NO: 74908 - DNA, 7 bp, Unknown
  misc_feature (1)..( 7): Matrix.005 file - promoters50/5663539
tttgagt

SEQ ID NO: 74909 - DNA, 7 bp, Unknown
  misc_feature (1)..( 7): Matrix.005 file - promoters50/5663539
tgtgttg

SEQ ID NO: 74910 - DNA, 8 bp, Unknown
  misc_feature (1)..( 8): Matrix.005 file - promoters50/5663539
tatttttt

SEQ ID NO: 74911 - DNA, 8 bp, Unknown
  misc_feature (1)..( 8): Matrix.005 file - promoters50/5663539
taatttaa

SEQ ID NO: 74912 - DNA, 7 bp, Unknown
  misc_feature (1)..( 7): Matrix.005 file - promoters50/5663539
aaataat

SEQ ID NO: 74913 - DNA, 6 bp, Unknown
  misc_feature (1)..( 6): Matrix.005 file - promoters50/5663539
tattgt

SEQ ID NO: 74914 - DNA, 9 bp, Unknown
  misc_feature (1)..( 9): Matrix.005 file - promoters50/5663539
tccatccat

SEQ ID NO: 74915 - DNA, 9 bp, Unknown
  misc_feature (1)..( 9): Matrix.005 file - promoters50/5663589
taggttaag

SEQ ID NO: 74916 - DNA, 8 bp, Unknown
  misc_feature (1)..( 8): Matrix.005 file - promoters50/5663589
ggatttat

SEQ ID NO: 74917 - DNA, 8 bp, Unknown
  misc_feature (1)..( 8): Matrix.005 file - promoters50/5663595
ttttattt

SEQ ID NO: 74918 - DNA, 8 bp, Unknown
  misc_feature (1)..( 8): Matrix.005 file - promoters50/5663607
aataaata

SEQ ID NO: 74919 - DNA, 8 bp, Unknown
  misc_feature (1)..( 8): Matrix.005 file - promoters50/5663614
aaacatta

SEQ ID NO: 74920 - DNA, 10 bp, Unknown
  misc_feature (1)..( 10): Matrix.005 file - promoters50/5663614
agataaatta

SEQ ID NO: 74921 - DNA, 12 bp, Unknown
  misc_feature (1)..( 12): Matrix.005 file - promoters50/5663614
taaacaccattg

SEQ ID NO: 74922 - DNA, 11 bp, Unknown
  misc_feature (1)..( 11): Matrix.005 file - promoters50/5663614
aaaaaattaat

SEQ ID NO: 74923 - DNA, 8 bp, Unknown
  misc_feature (1)..( 8): Matrix.005 file - promoters50/5663614
atttgaaa

SEQ ID NO: 74924 - DNA, 8 bp, Unknown
  misc_feature (1)..( 8): Matrix.005 file - promoters50/5663625
atatgagt

SEQ ID NO: 74925 - DNA, 11 bp, Unknown
  misc_feature (1)..( 11): Matrix.005 file - promoters50/5663625
ataataacttt

SEQ ID NO: 74926 - DNA, 9 bp, Unknown
  misc_feature (1)..( 9): Matrix.005 file - promoters50/5663625
ttaaaataa

SEQ ID NO: 74927 - DNA, 11 bp, Unknown
  misc_feature (1)..( 11): Matrix.005 file - promoters50/5663625
ttcttttattt

SEQ ID NO: 74928 - DNA, 11 bp, Unknown
  misc_feature (1)..( 11): Matrix.005 file - promoters50/5663625
attttactttt

SEQ ID NO: 74929 - DNA, 9 bp, Unknown
  misc_feature (1)..( 9): Matrix.005 file - promoters50/5663644
aaactaaaa

SEQ ID NO: 74930 - DNA, 8 bp, Unknown
  misc_feature (1)..( 8): Matrix.005 file - promoters50/5663644
aaattttt

SEQ ID NO: 74931 - DNA, 8 bp, Unknown
  misc_feature (1)..( 8): Matrix.005 file - promoters50/5663644
attttttt

SEQ ID NO: 74932 - DNA, 12 bp, Unknown
  misc_feature (1)..( 12): Matrix.005 file - promoters50/5663644
gaaaaaatattt

SEQ ID NO: 74933 - DNA, 7 bp, Unknown
  misc_feature (1)..( 7): Matrix.005 file - promoters50/5663644
tattttt

SEQ ID NO: 74934 - DNA, 9 bp, Unknown
  misc_feature (1)..( 9): Matrix.005 file - promoters50/5663688
attatttct

SEQ ID NO: 74935 - DNA, 7 bp, Unknown
  misc_feature (1)..( 7): Matrix.005 file - promoters50/5663688
tgtggat

SEQ ID NO: 74936 - DNA, 9 bp, Unknown
  misc_feature (1)..( 9): Matrix.005 file - promoters50/5663688
tattacttg

SEQ ID NO: 74937 - DNA, 9 bp, Unknown
  misc_feature (1)..( 9): Matrix.005 file - promoters50/5663688
ttaagaaac

SEQ ID NO: 74938 - DNA, 9 bp, Unknown
  misc_feature (1)..( 9): Matrix.005 file - promoters50/5663688
tatttggtg

SEQ ID NO: 74939 - DNA, 8 bp, Unknown
  misc_feature (1)..( 8): Matrix.005 file - promoters50/5663700
taaaatat

SEQ ID NO: 74940 - DNA, 7 bp, Unknown
  misc_feature (1)..( 7): Matrix.005 file - promoters50/5663700
tttatgt

SEQ ID NO: 74941 - DNA, 15 bp, Unknown
  misc_feature (1)..( 15): Matrix.005 file - promoters50/5663706
tgagattctatagtt

SEQ ID NO: 74942 - DNA, 10 bp, Unknown
  misc_feature (1)..( 10): Matrix.005 file - promoters50/5663706
taattaattt

SEQ ID NO: 74943 - DNA, 7 bp, Unknown
  misc_feature (1)..( 7): Matrix.005 file - promoters50/5663706
gtaaaaa

SEQ ID NO: 74944 - DNA, 9 bp, Unknown
  misc_feature (1)..( 9): Matrix.005 file - promoters50/5663706
aaataattc

SEQ ID NO: 74945 - DNA, 11 bp, Unknown
  misc_feature (1)..( 11): Matrix.005 file - promoters50/5663706
aaaaattttat

SEQ ID NO: 74946 - DNA, 10 bp, Unknown
  misc_feature (1)..( 10): Matrix.005 file - promoters50/5663706
cctatataaa

SEQ ID NO: 74947 - DNA, 8 bp, Unknown
  misc_feature (1)..( 8): Matrix.005 file - promoters50/5663710
catgaata

SEQ ID NO: 74948 - DNA, 11 bp, Unknown
  misc_feature (1)..( 11): Matrix.005 file - promoters50/5663710
tctatcaaagt

SEQ ID NO: 74949 - DNA, 7 bp, Unknown
  misc_feature (1)..( 7): Matrix.005 file - promoters50/5663710
tatatat

SEQ ID NO: 74950 - DNA, 7 bp, Unknown
  misc_feature (1)..( 7): Matrix.005 file - promoters50/5663728
gcatata

SEQ ID NO: 74951 - DNA, 9 bp, Unknown
  misc_feature (1)..( 9): Matrix.005 file - promoters50/5663728
ttttaaaaa

SEQ ID NO: 74952 - DNA, 8 bp, Unknown
  misc_feature (1)..( 8): Matrix.005 file - promoters50/5663732
ctaatatt

SEQ ID NO: 74953 - DNA, 12 bp, Unknown
  misc_feature (1)..( 12): Matrix.005 file - promoters50/5663732
ttttgtctaaaa

SEQ ID NO: 74954 - DNA, 7 bp, Unknown
  misc_feature (1)..( 7): Matrix.005 file - promoters50/5663740
tatactt

SEQ ID NO: 74955 - DNA, 9 bp, Unknown
  misc_feature (1)..( 9): Matrix.005 file - promoters50/5663740
gtattatct

SEQ ID NO: 74956 - DNA, 10 bp, Unknown
  misc_feature (1)..( 10): Matrix.005 file - promoters50/5663740
ccattttgca

SEQ ID NO: 74957 - DNA, 8 bp, Unknown
  misc_feature (1)..( 8): Matrix.005 file - promoters50/5663740
tagatact

SEQ ID NO: 74958 - DNA, 6 bp, Unknown
  misc_feature (1)..( 6): Matrix.005 file - promoters50/5663740
ttaaat

SEQ ID NO: 74959 - DNA, 8 bp, Unknown
  misc_feature (1)..( 8): Matrix.005 file - promoters50/5663746
tatctatt

SEQ ID NO: 74960 - DNA, 9 bp, Unknown
  misc_feature (1)..( 9): Matrix.005 file - promoters50/5663748
aaaaaaata

SEQ ID NO: 74961 - DNA, 13 bp, Unknown
  misc_feature (1)..( 13): Matrix.005 file - promoters50/5663748
aaaaaaataaaaa

SEQ ID NO: 74962 - DNA, 8 bp, Unknown
  misc_feature (1)..( 8): Matrix.005 file - promoters50/5663752
aaattaac

SEQ ID NO: 74963 - DNA, 9 bp, Unknown
  misc_feature (1)..( 9): Matrix.005 file - promoters50/5663752
taatttaaa

SEQ ID NO: 74964 - DNA, 11 bp, Unknown
  misc_feature (1)..( 11): Matrix.005 file - promoters50/5663752
aagaaagaaaa

SEQ ID NO: 74965 - DNA, 12 bp, Unknown
  misc_feature (1)..( 12): Matrix.005 file - promoters50/5663752
aaaacaaaatag

SEQ ID NO: 74966 - DNA, 7 bp, Unknown
  misc_feature (1)..( 7): Matrix.005 file - promoters50/5663752
caaaaaa

SEQ ID NO: 74967 - DNA, 7 bp, Unknown
  misc_feature (1)..( 7): Matrix.005 file - promoters50/5663752
tctttta

SEQ ID NO: 74968 - DNA, 11 bp, Unknown
  misc_feature (1)..( 11): Matrix.005 file - promoters50/5663752
ttaataacaga

SEQ ID NO: 74969 - DNA, 12 bp, Unknown
  misc_feature (1)..( 12): Matrix.005 file - promoters50/5663752
aaaatcaatgca

SEQ ID NO: 74970 - DNA, 8 bp, Unknown
  misc_feature (1)..( 8): Matrix.005 file - promoters50/5663752
aaatttat

SEQ ID NO: 74971 - DNA, 8 bp, Unknown
  misc_feature (1)..( 8): Matrix.005 file - promoters50/5663752
tagaatgc

SEQ ID NO: 74972 - DNA, 12 bp, Unknown
  misc_feature (1)..( 12): Matrix.005 file - promoters50/5663752
aaaaacaaaaca

SEQ ID NO: 74973 - DNA, 9 bp, Unknown
  misc_feature (1)..( 9): Matrix.005 file - promoters50/5663752
gaatcttca

SEQ ID NO: 74974 - DNA, 8 bp, Unknown
  misc_feature (1)..( 8): Matrix.005 file - promoters50/5663758
ctaaaatt

SEQ ID NO: 74975 - DNA, 7 bp, Unknown
  misc_feature (1)..( 7): Matrix.005 file - promoters50/5663772
attgaat

SEQ ID NO: 74976 - DNA, 10 bp, Unknown
  misc_feature (1)..( 10): Matrix.005 file - promoters50/5663772
tggctttaag

SEQ ID NO: 74977 - DNA, 7 bp, Unknown
  misc_feature (1)..( 7): Matrix.005 file - promoters50/5663772
aaatcac

SEQ ID NO: 74978 - DNA, 6 bp, Unknown
  misc_feature (1)..( 6): Matrix.005 file - promoters50/5663774
ttttct

SEQ ID NO: 74979 - DNA, 8 bp, Unknown
  misc_feature (1)..( 8): Matrix.005 file - promoters50/5663774
aattttta

SEQ ID NO: 74980 - DNA, 11 bp, Unknown
  misc_feature (1)..( 11): Matrix.005 file - promoters50/5663774
aacaataaata

SEQ ID NO: 74981 - DNA, 15 bp, Unknown
  misc_feature (1)..( 15): Matrix.005 file - promoters50/5663774
agaaataaaacgaaa

SEQ ID NO: 74982 - DNA, 12 bp, Unknown
  misc_feature (1)..( 12): Matrix.005 file - promoters50/5663778
gaaatgtatgga

SEQ ID NO: 74983 - DNA, 11 bp, Unknown
  misc_feature (1)..( 11): Matrix.005 file - promoters50/5663778
tactaatgttt

SEQ ID NO: 74984 - DNA, 9 bp, Unknown
  misc_feature (1)..( 9): Matrix.005 file - promoters50/5663778
tgtttgatt

SEQ ID NO: 74985 - DNA, 10 bp, Unknown
  misc_feature (1)..( 10): Matrix.005 file - promoters50/5663778
atttaacctg

SEQ ID NO: 74986 - DNA, 10 bp, Unknown
  misc_feature (1)..( 10): Matrix.005 file - promoters50/5663785
aaaaataaaa

SEQ ID NO: 74987 - DNA, 10 bp, Unknown
  misc_feature (1)..( 10): Matrix.005 file - promoters50/5663785
attaaaaata

SEQ ID NO: 74988 - DNA, 10 bp, Unknown
  misc_feature (1)..( 10): Matrix.005 file - promoters50/5663785
aaacaaaaat

SEQ ID NO: 74989 - DNA, 12 bp, Unknown
  misc_feature (1)..( 12): Matrix.005 file - promoters50/5663785
tttaaactaaaa

SEQ ID NO: 74990 - DNA, 12 bp, Unknown
  misc_feature (1)..( 12): Matrix.005 file - promoters50/5663805
acttataatgga

SEQ ID NO: 74991 - DNA, 7 bp, Unknown
  misc_feature (1)..( 7): Matrix.005 file - promoters50/5663805
ataaaaa

SEQ ID NO: 74992 - DNA, 3 bp, Unknown
  misc_feature (1)..( 3): Matrix.005 file - promoters50/5663805
ttt

SEQ ID NO: 74993 - DNA, 9 bp, Unknown
  misc_feature (1)..( 9): Matrix.005 file - promoters50/5663805
tttaatgat

SEQ ID NO: 74994 - DNA, 10 bp, Unknown
  misc_feature (1)..( 10): Matrix.005 file - promoters50/5663805
ataaaaaata

SEQ ID NO: 74995 - DNA, 8 bp, Unknown
  misc_feature (1)..( 8): Matrix.005 file - promoters50/5663805
ataaaaaa

SEQ ID NO: 74996 - DNA, 11 bp, Unknown
  misc_feature (1)..( 11): Matrix.005 file - promoters50/5663805
tcaatcaaaag

SEQ ID NO: 74997 - DNA, 11 bp, Unknown
  misc_feature (1)..( 11): Matrix.005 file - promoters50/5663805
cgaatattaaa

SEQ ID NO: 74998 - DNA, 11 bp, Unknown
  misc_feature (1)..( 11): Matrix.005 file - promoters50/5663805
aaatatatatc

SEQ ID NO: 74999 - DNA, 7 bp, Unknown
  misc_feature (1)..( 7): Matrix.005 file - promoters50/5663841
taaaacg

SEQ ID NO: 75000 - DNA, 10 bp, Unknown
  misc_feature (1)..( 10): Matrix.005 file - promoters50/5663841
ttatttactt

SEQ ID NO: 75001 - DNA, 9 bp, Unknown
  misc_feature (1)..( 9): Matrix.005 file - promoters50/5663847
aaatctttt

SEQ ID NO: 75002 - DNA, 9 bp, Unknown
  misc_feature (1)..( 9): Matrix.005 file - promoters50/5663847
ttttaaata

SEQ ID NO: 75003 - DNA, 9 bp, Unknown
  misc_feature (1)..( 9): Matrix.005 file - promoters50/5663847
acattaaca

SEQ ID NO: 75004 - DNA, 6 bp, Unknown
  misc_feature (1)..( 6): Matrix.005 file - promoters50/5663847
atataa

SEQ ID NO: 75005 - DNA, 12 bp, Unknown
  misc_feature (1)..( 12): Matrix.005 file - promoters50/5663847
aaagattctttt

SEQ ID NO: 75006 - DNA, 9 bp, Unknown
  misc_feature (1)..( 9): Matrix.005 file - promoters50/5663847
tttcaaaaa

SEQ ID NO: 75007 - DNA, 8 bp, Unknown
  misc_feature (1)..( 8): Matrix.005 file - promoters50/5663847
aaataaaa

SEQ ID NO: 75008 - DNA, 8 bp, Unknown
  misc_feature (1)..( 8): Matrix.005 file - promoters50/5663847
atcctgta

SEQ ID NO: 75009 - DNA, 9 bp, Unknown
  misc_feature (1)..( 9): Matrix.005 file - promoters50/5663847
tttgtaaaa

SEQ ID NO: 75010 - DNA, 9 bp, Unknown
  misc_feature (1)..( 9): Matrix.005 file - promoters50/5663847
aaatatttt

SEQ ID NO: 75011 - DNA, 8 bp, Unknown
  misc_feature (1)..( 8): Matrix.005 file - promoters50/5663851
aaaatgtg

SEQ ID NO: 75012 - DNA, 12 bp, Unknown
  misc_feature (1)..( 12): Matrix.005 file - promoters50/5663862
aagatttgattg

SEQ ID NO: 75013 - DNA, 10 bp, Unknown
  misc_feature (1)..( 10): Matrix.005 file - promoters50/5663862
aattttttaa

SEQ ID NO: 75014 - DNA, 10 bp, Unknown
  misc_feature (1)..( 10): Matrix.005 file - promoters50/5663865
aaccaaacaa

SEQ ID NO: 75015 - DNA, 9 bp, Unknown
  misc_feature (1)..( 9): Matrix.005 file - promoters50/5663865
aattaacaa

SEQ ID NO: 75016 - DNA, 8 bp, Unknown
  misc_feature (1)..( 8): Matrix.005 file - promoters50/5663873
tttgttta

SEQ ID NO: 75017 - DNA, 7 bp, Unknown
  misc_feature (1)..( 7): Matrix.005 file - promoters50/5663873
gttttgt

SEQ ID NO: 75018 - DNA, 10 bp, Unknown
  misc_feature (1)..( 10): Matrix.005 file - promoters50/5663881
atgatgaatt

SEQ ID NO: 75019 - DNA, 10 bp, Unknown
  misc_feature (1)..( 10): Matrix.005 file - promoters50/5663884
gtatcataat

SEQ ID NO: 75020 - DNA, 7 bp, Unknown
  misc_feature (1)..( 7): Matrix.005 file - promoters50/5663895
taaatat

SEQ ID NO: 75021 - DNA, 7 bp, Unknown
  misc_feature (1)..( 7): Matrix.005 file - promoters50/5663895
attgttc

SEQ ID NO: 75022 - DNA, 9 bp, Unknown
  misc_feature (1)..( 9): Matrix.005 file - promoters50/5663895
tataattca

SEQ ID NO: 75023 - DNA, 15 bp, Unknown
  misc_feature (1)..( 15): Matrix.005 file - promoters50/5663895
gaatttttatttttt

SEQ ID NO: 75024 - DNA, 10 bp, Unknown
  misc_feature (1)..( 10): Matrix.005 file - promoters50/5663895
acaacaaaaa

SEQ ID NO: 75025 - DNA, 9 bp, Unknown
  misc_feature (1)..( 9): Matrix.005 file - promoters50/5663916
ctgatataa

SEQ ID NO: 75026 - DNA, 8 bp, Unknown
  misc_feature (1)..( 8): Matrix.005 file - promoters50/5663916
tttgacat

SEQ ID NO: 75027 - DNA, 12 bp, Unknown
  misc_feature (1)..( 12): Matrix.005 file - promoters50/5663928
aaacataatcgt

SEQ ID NO: 75028 - DNA, 7 bp, Unknown
  misc_feature (1)..( 7): Matrix.005 file - promoters50/5663928
gatgatt

SEQ ID NO: 75029 - DNA, 9 bp, Unknown
  misc_feature (1)..( 9): Matrix.005 file - promoters50/5663934
ataaataaa

SEQ ID NO: 75030 - DNA, 12 bp, Unknown
  misc_feature (1)..( 12): Matrix.005 file - promoters50/5663934
aaaaaaatttat

SEQ ID NO: 75031 - DNA, 11 bp, Unknown
  misc_feature (1)..( 11): Matrix.005 file - promoters50/5663934
ttaaattttgg

SEQ ID NO: 75032 - DNA, 7 bp, Unknown
  misc_feature (1)..( 7): Matrix.005 file - promoters50/5663934
aaaaaac

SEQ ID NO: 75033 - DNA, 10 bp, Unknown
  misc_feature (1)..( 10): Matrix.005 file - promoters50/5663934
attaattaaa

SEQ ID NO: 75034 - DNA, 9 bp, Unknown
  misc_feature (1)..( 9): Matrix.005 file - promoters50/5663934
gaaaaaata

SEQ ID NO: 75035 - DNA, 13 bp, Unknown
  misc_feature (1)..( 13): Matrix.005 file - promoters50/5663934
tgacataaaattt

SEQ ID NO: 75036 - DNA, 8 bp, Unknown
  misc_feature (1)..( 8): Matrix.005 file - promoters50/5663946
taaagaaa

SEQ ID NO: 75037 - DNA, 10 bp, Unknown
  misc_feature (1)..( 10): Matrix.005 file - promoters50/5663946
cttattcttt

SEQ ID NO: 75038 - DNA, 8 bp, Unknown
  misc_feature (1)..( 8): Matrix.005 file - promoters50/5663946
tttctttt

SEQ ID NO: 75039 - DNA, 11 bp, Unknown
  misc_feature (1)..( 11): Matrix.005 file - promoters50/5663946
aatttggtctt

SEQ ID NO: 75040 - DNA, 11 bp, Unknown
  misc_feature (1)..( 11): Matrix.005 file - promoters50/5663950
aaaagattgtt

SEQ ID NO: 75041 - DNA, 10 bp, Unknown
  misc_feature (1)..( 10): Matrix.005 file - promoters50/5663954
aatactgaga

SEQ ID NO: 75042 - DNA, 11 bp, Unknown
  misc_feature (1)..( 11): Matrix.005 file - promoters50/5663954
gatagttttta

SEQ ID NO: 75043 - DNA, 9 bp, Unknown
  misc_feature (1)..( 9): Matrix.005 file - promoters50/5663978
tggtaagat

SEQ ID NO: 75044 - DNA, 8 bp, Unknown
  misc_feature (1)..( 8): Matrix.005 file - promoters50/5663982
agaaaaga

SEQ ID NO: 75045 - DNA, 9 bp, Unknown
  misc_feature (1)..( 9): Matrix.005 file - promoters50/5663982
agaaaagaa

SEQ ID NO: 75046 - DNA, 9 bp, Unknown
  misc_feature (1)..( 9): Matrix.005 file - promoters50/5663982
tatggtgtt

SEQ ID NO: 75047 - DNA, 7 bp, Unknown
  misc_feature (1)..( 7): Matrix.005 file - promoters50/5663982
aaacata

SEQ ID NO: 75048 - DNA, 10 bp, Unknown
  misc_feature (1)..( 10): Matrix.005 file - promoters50/5663985
cattttggtt

SEQ ID NO: 75049 - DNA, 9 bp, Unknown
  misc_feature (1)..( 9): Matrix.005 file - promoters50/5663985
aattttatt

SEQ ID NO: 75050 - DNA, 9 bp, Unknown
  misc_feature (1)..( 9): Matrix.005 file - promoters50/5663985
gatttatta

SEQ ID NO: 75051 - DNA, 14 bp, Unknown
  misc_feature (1)..( 14): Matrix.005 file - promoters50/5663996
atttatgaatcaac

SEQ ID NO: 75052 - DNA, 10 bp, Unknown
  misc_feature (1)..( 10): Matrix.005 file - promoters50/5663996
taacaaatta

SEQ ID NO: 75053 - DNA, 14 bp, Unknown
  misc_feature (1)..( 14): Matrix.005 file - promoters50/5663996
ctgaatcaaaattt

SEQ ID NO: 75054 - DNA, 8 bp, Unknown
  misc_feature (1)..( 8): Matrix.005 file - promoters50/5664022
accaaaaa

SEQ ID NO: 75055 - DNA, 8 bp, Unknown
  misc_feature (1)..( 8): Matrix.005 file - promoters50/5664049
tcttcttc

SEQ ID NO: 75056 - DNA, 7 bp, Unknown
  misc_feature (1)..( 7): Matrix.005 file - promoters50/5664060
aaacaaa

SEQ ID NO: 75057 - DNA, 8 bp, Unknown
  misc_feature (1)..( 8): Matrix.005 file - promoters50/5664072
ctctattt

SEQ ID NO: 75058 - DNA, 8 bp, Unknown
  misc_feature (1)..( 8): Matrix.005 file - promoters50/5664080
tgaagaaa

SEQ ID NO: 75059 - DNA, 13 bp, Unknown
  misc_feature (1)..( 13): Matrix.005 file - promoters50/5664080
gaaactttaagac

SEQ ID NO: 75060 - DNA, 9 bp, Unknown
  misc_feature (1)..( 9): Matrix.005 file - promoters50/5664080
acatcaatt

SEQ ID NO: 75061 - DNA, 11 bp, Unknown
  misc_feature (1)..( 11): Matrix.005 file - promoters50/5664080
agacatctatt

SEQ ID NO: 75062 - DNA, 10 bp, Unknown
  misc_feature (1)..( 10): Matrix.005 file - promoters50/5664080
cttcaaaatt

SEQ ID NO: 75063 - DNA, 8 bp, Unknown
  misc_feature (1)..( 8): Matrix.005 file - promoters50/5664084
aaagttaa

SEQ ID NO: 75064 - DNA, 10 bp, Unknown
  misc_feature (1)..( 10): Matrix.005 file - promoters50/5664084
ttttaatttt

SEQ ID NO: 75065 - DNA, 9 bp, Unknown
  misc_feature (1)..( 9): Matrix.005 file - promoters50/5664084
tccaaaaaa

SEQ ID NO: 75066 - DNA, 10 bp, Unknown
  misc_feature (1)..( 10): Matrix.005 file - promoters50/5664084
atcaaatgga

SEQ ID NO: 75067 - DNA, 6 bp, Unknown
  misc_feature (1)..( 6): Matrix.005 file - promoters50/5664084
atataa

SEQ ID NO: 75068 - DNA, 8 bp, Unknown
  misc_feature (1)..( 8): Matrix.005 file - promoters50/5664084
tgtatctt

SEQ ID NO: 75069 - DNA, 9 bp, Unknown
  misc_feature (1)..( 9): Matrix.005 file - promoters50/5664088
gtagaaaaa

SEQ ID NO: 75070 - DNA, 11 bp, Unknown
  misc_feature (1)..( 11): Matrix.005 file - promoters50/5664088
gcatcaattaa

SEQ ID NO: 75071 - DNA, 11 bp, Unknown
  misc_feature (1)..( 11): Matrix.005 file - promoters50/5664088
gaaaaataata

SEQ ID NO: 75072 - DNA, 7 bp, Unknown
  misc_feature (1)..( 7): Matrix.005 file - promoters50/5664088
gaaatat

SEQ ID NO: 75073 - DNA, 9 bp, Unknown
  misc_feature (1)..( 9): Matrix.005 file - promoters50/5664092
taatttgaa

SEQ ID NO: 75074 - DNA, 8 bp, Unknown
  misc_feature (1)..( 8): Matrix.005 file - promoters50/5664092
gaataaag

SEQ ID NO: 75075 - DNA, 7 bp, Unknown
  misc_feature (1)..( 7): Matrix.005 file - promoters50/5664095
agtaatt

SEQ ID NO: 75076 - DNA, 8 bp, Unknown
  misc_feature (1)..( 8): Matrix.005 file - promoters50/5664115
aaactaaa

SEQ ID NO: 75077 - DNA, 9 bp, Unknown
  misc_feature (1)..( 9): Matrix.005 file - promoters50/5664115
caaaaatta

SEQ ID NO: 75078 - DNA, 9 bp, Unknown
  misc_feature (1)..( 9): Matrix.005 file - promoters50/5664115
tatctcatt

SEQ ID NO: 75079 - DNA, 13 bp, Unknown
  misc_feature (1)..( 13): Matrix.005 file - promoters50/5664115
caaaaaaagaaaa

SEQ ID NO: 75080 - DNA, 11 bp, Unknown
  misc_feature (1)..( 11): Matrix.005 file - promoters50/5664115
ttaataaaacc

SEQ ID NO: 75081 - DNA, 7 bp, Unknown
  misc_feature (1)..( 7): Matrix.005 file - promoters50/5664115
atataaa

SEQ ID NO: 75082 - DNA, 7 bp, Unknown
  misc_feature (1)..( 7): Matrix.005 file - promoters50/5664126
attctac

SEQ ID NO: 75083 - DNA, 7 bp, Unknown
  misc_feature (1)..( 7): Matrix.005 file - promoters50/5664126
gaaaatc

SEQ ID NO: 75084 - DNA, 14 bp, Unknown
  misc_feature (1)..( 14): Matrix.005 file - promoters50/5664126
taattcagaaaaat

SEQ ID NO: 75085 - DNA, 8 bp, Unknown
  misc_feature (1)..( 8): Matrix.005 file - promoters50/5664126
aatataaa

SEQ ID NO: 75086 - DNA, 7 bp, Unknown
  misc_feature (1)..( 7): Matrix.005 file - promoters50/5664126
aaaattc

SEQ ID NO: 75087 - DNA, 8 bp, Unknown
  misc_feature (1)..( 8): Matrix.005 file - promoters50/5664126
aacagaaa

SEQ ID NO: 75088 - DNA, 7 bp, Unknown
  misc_feature (1)..( 7): Matrix.005 file - promoters50/5664126
tttattt

SEQ ID NO: 75089 - DNA, 8 bp, Unknown
  misc_feature (1)..( 8): Matrix.005 file - promoters50/5664126
taatttgt

SEQ ID NO: 75090 - DNA, 16 bp, Unknown
  misc_feature (1)..( 16): Matrix.005 file - promoters50/5664126
gttcggttcggtttac

SEQ ID NO: 75091 - DNA, 9 bp, Unknown
  misc_feature (1)..( 9): Matrix.005 file - promoters50/5664126
aaaatatat

SEQ ID NO: 75092 - DNA, 10 bp, Unknown
  misc_feature (1)..( 10): Matrix.005 file - promoters50/5664133
aaacataatt

SEQ ID NO: 75093 - DNA, 9 bp, Unknown
  misc_feature (1)..( 9): Matrix.005 file - promoters50/5664133
ataaacatg

SEQ ID NO: 75094 - DNA, 8 bp, Unknown
  misc_feature (1)..( 8): Matrix.005 file - promoters50/5664133
caaacaaa

SEQ ID NO: 75095 - DNA, 7 bp, Unknown
  misc_feature (1)..( 7): Matrix.005 file - promoters50/5664133
caaacat

SEQ ID NO: 75096 - DNA, 7 bp, Unknown
  misc_feature (1)..( 7): Matrix.005 file - promoters50/5664133
tcacaaa

SEQ ID NO: 75097 - DNA, 9 bp, Unknown
  misc_feature (1)..( 9): Matrix.005 file - promoters50/5664133
aattaagtt

SEQ ID NO: 75098 - DNA, 8 bp, Unknown
  misc_feature (1)..( 8): Matrix.005 file - promoters50/5664133
cacaaaac

SEQ ID NO: 75099 - DNA, 9 bp, Unknown
  misc_feature (1)..( 9): Matrix.005 file - promoters50/5664141
tgatttgtt

SEQ ID NO: 75100 - DNA, 14 bp, Unknown
  misc_feature (1)..( 14): Matrix.005 file - promoters50/5664141
aagcttttaagaaa

SEQ ID NO: 75101 - DNA, 11 bp, Unknown
  misc_feature (1)..( 11): Matrix.005 file - promoters50/5664141
ttataaaaaca

SEQ ID NO: 75102 - DNA, 9 bp, Unknown
  misc_feature (1)..( 9): Matrix.005 file - promoters50/5664141
tcaaaaaaa

SEQ ID NO: 75103 - DNA, 8 bp, Unknown
  misc_feature (1)..( 8): Matrix.005 file - promoters50/5664149
ttatgtac

SEQ ID NO: 75104 - DNA, 7 bp, Unknown
  misc_feature (1)..( 7): Matrix.005 file - promoters50/5664149
ataatac

SEQ ID NO: 75105 - DNA, 10 bp, Unknown
  misc_feature (1)..( 10): Matrix.005 file - promoters50/5664149
taatacaatc

SEQ ID NO: 75106 - DNA, 10 bp, Unknown
  misc_feature (1)..( 10): Matrix.005 file - promoters50/5664153
atgtttcaaa

SEQ ID NO: 75107 - DNA, 8 bp, Unknown
  misc_feature (1)..( 8): Matrix.005 file - promoters50/5664153
ataataaa

SEQ ID NO: 75108 - DNA, 10 bp, Unknown
  misc_feature (1)..( 10): Matrix.005 file - promoters50/5664174
atccaatgta

SEQ ID NO: 75109 - DNA, 11 bp, Unknown
  misc_feature (1)..( 11): Matrix.005 file - promoters50/5664174
aattaaaaaac

SEQ ID NO: 75110 - DNA, 12 bp, Unknown
  misc_feature (1)..( 12): Matrix.005 file - promoters50/5664174
atcaaatgtaac

SEQ ID NO: 75111 - DNA, 8 bp, Unknown
  misc_feature (1)..( 8): Matrix.005 file - promoters50/5664174
ttttgatt

SEQ ID NO: 75112 - DNA, 9 bp, Unknown
  misc_feature (1)..( 9): Matrix.005 file - promoters50/5664178
tttatatat

SEQ ID NO: 75113 - DNA, 8 bp, Unknown
  misc_feature (1)..( 8): Matrix.005 file - promoters50/5664178
taaaagaa

SEQ ID NO: 75114 - DNA, 10 bp, Unknown
  misc_feature (1)..( 10): Matrix.005 file - promoters50/5664178
aaaaacaaaa

SEQ ID NO: 75115 - DNA, 9 bp, Unknown
  misc_feature (1)..( 9): Matrix.005 file - promoters50/5664178
ttatttata

SEQ ID NO: 75116 - DNA, 10 bp, Unknown
  misc_feature (1)..( 10): Matrix.005 file - promoters50/5664178
aagaggattg

SEQ ID NO: 75117 - DNA, 8 bp, Unknown
  misc_feature (1)..( 8): Matrix.005 file - promoters50/5664178
aaaaagag

SEQ ID NO: 75118 - DNA, 8 bp, Unknown
  misc_feature (1)..( 8): Matrix.005 file - promoters50/5664186
ttcttcgt

SEQ ID NO: 75119 - DNA, 9 bp, Unknown
  misc_feature (1)..( 9): Matrix.005 file - promoters50/5664186
ctctccacc

SEQ ID NO: 75120 - DNA, 6 bp, Unknown
  misc_feature (1)..( 6): Matrix.005 file - promoters50/5664186
attctt

SEQ ID NO: 75121 - DNA, 8 bp, Unknown
  misc_feature (1)..( 8): Matrix.005 file - promoters50/5664186
taaacatt

SEQ ID NO: 75122 - DNA, 7 bp, Unknown
  misc_feature (1)..( 7): Matrix.005 file - promoters50/5664209
aagtaaa

SEQ ID NO: 75123 - DNA, 10 bp, Unknown
  misc_feature (1)..( 10): Matrix.005 file - promoters50/5664209
aaataaaata

SEQ ID NO: 75124 - DNA, 8 bp, Unknown
  misc_feature (1)..( 8): Matrix.005 file - promoters50/5664209
agaataat

SEQ ID NO: 75125 - DNA, 5 bp, Unknown
  misc_feature (1)..( 5): Matrix.005 file - promoters50/5664216
atttg

SEQ ID NO: 75126 - DNA, 10 bp, Unknown
  misc_feature (1)..( 10): Matrix.005 file - promoters50/5664216
atataaatac

SEQ ID NO: 75127 - DNA, 5 bp, Unknown
  misc_feature (1)..( 5): Matrix.005 file - promoters50/5664216
tgttt

SEQ ID NO: 75128 - DNA, 12 bp, Unknown
  misc_feature (1)..( 12): Matrix.005 file - promoters50/5664222
tcaattcatttt

SEQ ID NO: 75129 - DNA, 10 bp, Unknown
  misc_feature (1)..( 10): Matrix.005 file - promoters50/5664263
actagattct

SEQ ID NO: 75130 - DNA, 10 bp, Unknown
  misc_feature (1)..( 10): Matrix.005 file - promoters50/5664263
actagattct

SEQ ID NO: 75131 - DNA, 9 bp, Unknown
  misc_feature (1)..( 9): Matrix.005 file - promoters50/5664263
atgtttaag

SEQ ID NO: 75132 - DNA, 14 bp, Unknown
  misc_feature (1)..( 14): Matrix.005 file - promoters50/5664263
caattgattaaagt

SEQ ID NO: 75133 - DNA, 12 bp, Unknown
  misc_feature (1)..( 12): Matrix.005 file - promoters50/5664265
atggtttgaata

SEQ ID NO: 75134 - DNA, 10 bp, Unknown
  misc_feature (1)..( 10): Matrix.005 file - promoters50/5664265
aaagaaattg

SEQ ID NO: 75135 - DNA, 7 bp, Unknown
  misc_feature (1)..( 7): Matrix.005 file - promoters50/5664265
aaaaagt

SEQ ID NO: 75136 - DNA, 12 bp, Unknown
  misc_feature (1)..( 12): Matrix.005 file - promoters50/5664268
aattttactaac

SEQ ID NO: 75137 - DNA, 8 bp, Unknown
  misc_feature (1)..( 8): Matrix.005 file - promoters50/5664272
ttttgatt

SEQ ID NO: 75138 - DNA, 9 bp, Unknown
  misc_feature (1)..( 9): Matrix.005 file - promoters50/5664274
tttgagctt

SEQ ID NO: 75139 - DNA, 8 bp, Unknown
  misc_feature (1)..( 8): Matrix.005 file - promoters50/5664274
agtttctt

SEQ ID NO: 75140 - DNA, 8 bp, Unknown
  misc_feature (1)..( 8): Matrix.005 file - promoters50/5664274
aaaaaaat

SEQ ID NO: 75141 - DNA, 8 bp, Unknown
  misc_feature (1)..( 8): Matrix.005 file - promoters50/5664294
aaaatcga

SEQ ID NO: 75142 - DNA, 8 bp, Unknown
  misc_feature (1)..( 8): Matrix.005 file - promoters50/5664294
gataaaaa

SEQ ID NO: 75143 - DNA, 10 bp, Unknown
  misc_feature (1)..( 10): Matrix.005 file - promoters50/5664294
actttataat

SEQ ID NO: 75144 - DNA, 7 bp, Unknown
  misc_feature (1)..( 7): Matrix.005 file - promoters50/5664302
attaaaa

SEQ ID NO: 75145 - DNA, 8 bp, Unknown
  misc_feature (1)..( 8): Matrix.005 file - promoters50/5664302
aaaatcta

SEQ ID NO: 75146 - DNA, 10 bp, Unknown
  misc_feature (1)..( 10): Matrix.005 file - promoters50/5664302
aaattcaaaa

SEQ ID NO: 75147 - DNA, 9 bp, Unknown
  misc_feature (1)..( 9): Matrix.005 file - promoters50/5664302
aatcataaa

SEQ ID NO: 75148 - DNA, 10 bp, Unknown
  misc_feature (1)..( 10): Matrix.005 file - promoters50/5664302
caataattca

SEQ ID NO: 75149 - DNA, 6 bp, Unknown
  misc_feature (1)..( 6): Matrix.005 file - promoters50/5664302
aaaatc

SEQ ID NO: 75150 - DNA, 7 bp, Unknown
  misc_feature (1)..( 7): Matrix.005 file - promoters50/5664311
tgctttg

SEQ ID NO: 75151 - DNA, 9 bp, Unknown
  misc_feature (1)..( 9): Matrix.005 file - promoters50/5664318
ataagtaaa

SEQ ID NO: 75152 - DNA, 9 bp, Unknown
  misc_feature (1)..( 9): Matrix.005 file - promoters50/5664318
atttaaatt

SEQ ID NO: 75153 - DNA, 6 bp, Unknown
  misc_feature (1)..( 6): Matrix.005 file - promoters50/5664318
tttgaa

SEQ ID NO: 75154 - DNA, 10 bp, Unknown
  misc_feature (1)..( 10): Matrix.005 file - promoters50/5664318
ttaaattgta

SEQ ID NO: 75155 - DNA, 4 bp, Unknown
  misc_feature (1)..( 4): Matrix.005 file - promoters50/5664318
ttta

SEQ ID NO: 75156 - DNA, 11 bp, Unknown
  misc_feature (1)..( 11): Matrix.005 file - promoters50/5664318
aaaacgtaatg

SEQ ID NO: 75157 - DNA, 14 bp, Unknown
  misc_feature (1)..( 14): Matrix.005 file - promoters50/5664318
aaatcaaaattgaa

SEQ ID NO: 75158 - DNA, 9 bp, Unknown
  misc_feature (1)..( 9): Matrix.005 file - promoters50/5664318
tgtgtttgt

SEQ ID NO: 75159 - DNA, 7 bp, Unknown
  misc_feature (1)..( 7): Matrix.005 file - promoters50/5664329
aaataag

SEQ ID NO: 75160 - DNA, 9 bp, Unknown
  misc_feature (1)..( 9): Matrix.005 file - promoters50/5664337
gatatgttt

SEQ ID NO: 75161 - DNA, 7 bp, Unknown
  misc_feature (1)..( 7): Matrix.005 file - promoters50/5664337
aaatgtc

SEQ ID NO: 75162 - DNA, 7 bp, Unknown
  misc_feature (1)..( 7): Matrix.005 file - promoters50/5664337
aaaatcc

SEQ ID NO: 75163 - DNA, 8 bp, Unknown
  misc_feature (1)..( 8): Matrix.005 file - promoters50/5664341
ttattccc

SEQ ID NO: 75164 - DNA, 8 bp, Unknown
  misc_feature (1)..( 8): Matrix.005 file - promoters50/5664341
tgtttttc

SEQ ID NO: 75165 - DNA, 7 bp, Unknown
  misc_feature (1)..( 7): Matrix.005 file - promoters50/5664345
taaaatg

SEQ ID NO: 75166 - DNA, 11 bp, Unknown
  misc_feature (1)..( 11): Matrix.005 file - promoters50/5664352
taaaatctttt

SEQ ID NO: 75167 - DNA, 12 bp, Unknown
  misc_feature (1)..( 12): Matrix.005 file - promoters50/5664352
aatctctttcta

SEQ ID NO: 75168 - DNA, 7 bp, Unknown
  misc_feature (1)..( 7): Matrix.005 file - promoters50/5664352
gcataga

SEQ ID NO: 75169 - DNA, 4 bp, Unknown
  misc_feature (1)..( 4): Matrix.005 file - promoters50/5664362
ttgt

SEQ ID NO: 75170 - DNA, 10 bp, Unknown
  misc_feature (1)..( 10): Matrix.005 file - promoters50/5664362
aaatatatat

SEQ ID NO: 75171 - DNA, 10 bp, Unknown
  misc_feature (1)..( 10): Matrix.005 file - promoters50/5664362
agaaaaataa

SEQ ID NO: 75172 - DNA, 8 bp, Unknown
  misc_feature (1)..( 8): Matrix.005 file - promoters50/5664369
aataatta

SEQ ID NO: 75173 - DNA, 11 bp, Unknown
  misc_feature (1)..( 11): Matrix.005 file - promoters50/5664369
caaaaaacttg

SEQ ID NO: 75174 - DNA, 7 bp, Unknown
  misc_feature (1)..( 7): Matrix.005 file - promoters50/5664369
aattttt

SEQ ID NO: 75175 - DNA, 7 bp, Unknown
  misc_feature (1)..( 7): Matrix.005 file - promoters50/5664369
tatgaaa

SEQ ID NO: 75176 - DNA, 7 bp, Unknown
  misc_feature (1)..( 7): Matrix.005 file - promoters50/5664390
aattaca

SEQ ID NO: 75177 - DNA, 9 bp, Unknown
  misc_feature (1)..( 9): Matrix.005 file - promoters50/5664390
ttatttact

SEQ ID NO: 75178 - DNA, 13 bp, Unknown
  misc_feature (1)..( 13): Matrix.005 file - promoters50/5664390
acttaattacaaa

SEQ ID NO: 75179 - DNA, 7 bp, Unknown
  misc_feature (1)..( 7): Matrix.005 file - promoters50/5664402
ttatgaa

SEQ ID NO: 75180 - DNA, 10 bp, Unknown
  misc_feature (1)..( 10): Matrix.005 file - promoters50/5664402
ttaatgaaaa

SEQ ID NO: 75181 - DNA, 8 bp, Unknown
  misc_feature (1)..( 8): Matrix.005 file - promoters50/5664435
tttaatta

SEQ ID NO: 75182 - DNA, 12 bp, Unknown
  misc_feature (1)..( 12): Matrix.005 file - promoters50/5664435
acaattttactg

SEQ ID NO: 75183 - DNA, 9 bp, Unknown
  misc_feature (1)..( 9): Matrix.005 file - promoters50/5664435
aattttggt

SEQ ID NO: 75184 - DNA, 12 bp, Unknown
  misc_feature (1)..( 12): Matrix.005 file - promoters50/5664435
tataaagaaaaa

SEQ ID NO: 75185 - DNA, 11 bp, Unknown
  misc_feature (1)..( 11): Matrix.005 file - promoters50/5664435
gtaaatttatt

SEQ ID NO: 75186 - DNA, 8 bp, Unknown
  misc_feature (1)..( 8): Matrix.005 file - promoters50/5664438
ttataata

SEQ ID NO: 75187 - DNA, 8 bp, Unknown
  misc_feature (1)..( 8): Matrix.005 file - promoters50/5664438
aattcttt

SEQ ID NO: 75188 - DNA, 11 bp, Unknown
  misc_feature (1)..( 11): Matrix.005 file - promoters50/5664438
taaaaaatatc

SEQ ID NO: 75189 - DNA, 8 bp, Unknown
  misc_feature (1)..( 8): Matrix.005 file - promoters50/5664457
acaataaa

SEQ ID NO: 75190 - DNA, 9 bp, Unknown
  misc_feature (1)..( 9): Matrix.005 file - promoters50/5664472
tattatttt

SEQ ID NO: 75191 - DNA, 11 bp, Unknown
  misc_feature (1)..( 11): Matrix.005 file - promoters50/5664472
attttgctatt

SEQ ID NO: 75192 - DNA, 11 bp, Unknown
  misc_feature (1)..( 11): Matrix.005 file - promoters50/5664480
tgtttatgtga

SEQ ID NO: 75193 - DNA, 13 bp, Unknown
  misc_feature (1)..( 13): Matrix.005 file - promoters50/5664480
gttaaaatgaaga

SEQ ID NO: 75194 - DNA, 9 bp, Unknown
  misc_feature (1)..( 9): Matrix.005 file - promoters50/5664480
gcttataaa

SEQ ID NO: 75195 - DNA, 14 bp, Unknown
  misc_feature (1)..( 14): Matrix.005 file - promoters50/5664488
ataagtatatgaga

SEQ ID NO: 75196 - DNA, 8 bp, Unknown
  misc_feature (1)..( 8): Matrix.005 file - promoters50/5664505
attatccg

SEQ ID NO: 75197 - DNA, 13 bp, Unknown
  misc_feature (1)..( 13): Matrix.005 file - promoters50/5664535
aaaattgattaat

SEQ ID NO: 75198 - DNA, 9 bp, Unknown
  misc_feature (1)..( 9): Matrix.005 file - promoters50/5664535
taaaaacta

SEQ ID NO: 75199 - DNA, 8 bp, Unknown
  misc_feature (1)..( 8): Matrix.005 file - promoters50/5664535
aataaacc

SEQ ID NO: 75200 - DNA, 9 bp, Unknown
  misc_feature (1)..( 9): Matrix.005 file - promoters50/5664535
ggtttaaac

SEQ ID NO: 75201 - DNA, 8 bp, Unknown
  misc_feature (1)..( 8): Matrix.005 file - promoters50/5664535
tataaata

SEQ ID NO: 75202 - DNA, 7 bp, Unknown
  misc_feature (1)..( 7): Matrix.005 file - promoters50/5664633
tatttta

SEQ ID NO: 75203 - DNA, 10 bp, Unknown
  misc_feature (1)..( 10): Matrix.005 file - promoters50/5664633
tattttttta

SEQ ID NO: 75204 - DNA, 14 bp, Unknown
  misc_feature (1)..( 14): Matrix.005 file - promoters50/5664633
tccgatttcttttt

SEQ ID NO: 75205 - DNA, 8 bp, Unknown
  misc_feature (1)..( 8): Matrix.005 file - promoters50/5664633
aaaattaa

SEQ ID NO: 75206 - DNA, 7 bp, Unknown
  misc_feature (1)..( 7): Matrix.005 file - promoters50/5664633
ttgaatt

SEQ ID NO: 75207 - DNA, 10 bp, Unknown
  misc_feature (1)..( 10): Matrix.005 file - promoters50/5664633
aaaaaaatta

SEQ ID NO: 75208 - DNA, 9 bp, Unknown
  misc_feature (1)..( 9): Matrix.005 file - promoters50/5664633
cgatttctt

SEQ ID NO: 75209 - DNA, 5 bp, Unknown
  misc_feature (1)..( 5): Matrix.005 file - promoters50/5664657
taaaa

SEQ ID NO: 75210 - DNA, 8 bp, Unknown
  misc_feature (1)..( 8): Matrix.005 file - promoters50/5664657
tttttgtt

SEQ ID NO: 75211 - DNA, 8 bp, Unknown
  misc_feature (1)..( 8): Matrix.005 file - promoters50/5664657
ctttaaaa

SEQ ID NO: 75212 - DNA, 9 bp, Unknown
  misc_feature (1)..( 9): Matrix.005 file - promoters50/5664703
tttgtatat

SEQ ID NO: 75213 - DNA, 8 bp, Unknown
  misc_feature (1)..( 8): Matrix.005 file - promoters50/5664703
tctgaatt

SEQ ID NO: 75214 - DNA, 12 bp, Unknown
  misc_feature (1)..( 12): Matrix.005 file - promoters50/5664703
ctttttgtatat

SEQ ID NO: 75215 - DNA, 7 bp, Unknown
  misc_feature (1)..( 7): Matrix.005 file - promoters50/5664721
taataat

SEQ ID NO: 75216 - DNA, 9 bp, Unknown
  misc_feature (1)..( 9): Matrix.005 file - promoters50/5664749
attacttac

SEQ ID NO: 75217 - DNA, 11 bp, Unknown
  misc_feature (1)..( 11): Matrix.005 file - promoters50/5664749
tttactcaatc

SEQ ID NO: 75218 - DNA, 7 bp, Unknown
  misc_feature (1)..( 7): Matrix.005 file - promoters50/5664749
attctct

SEQ ID NO: 75219 - DNA, 11 bp, Unknown
  misc_feature (1)..( 11): Matrix.005 file - promoters50/5664787
atataaattaa

SEQ ID NO: 75220 - DNA, 13 bp, Unknown
  misc_feature (1)..( 13): Matrix.005 file - promoters50/5664787
aaattaaaaaggt

SEQ ID NO: 75221 - DNA, 10 bp, Unknown
  misc_feature (1)..( 10): Matrix.005 file - promoters50/5664806
aaagaaagga

SEQ ID NO: 75222 - DNA, 11 bp, Unknown
  misc_feature (1)..( 11): Matrix.005 file - promoters50/5664806
accaagaaaac

SEQ ID NO: 75223 - DNA, 11 bp, Unknown
  misc_feature (1)..( 11): Matrix.005 file - promoters50/5664806
tcttatttttt

SEQ ID NO: 75224 - DNA, 10 bp, Unknown
  misc_feature (1)..( 10): Matrix.005 file - promoters50/5664806
tataattaat

SEQ ID NO: 75225 - DNA, 8 bp, Unknown
  misc_feature (1)..( 8): Matrix.005 file - promoters50/5664806
tcatgaaa

SEQ ID NO: 75226 - DNA, 7 bp, Unknown
  misc_feature (1)..( 7): Matrix.005 file - promoters50/5664814
aataaaa

SEQ ID NO: 75227 - DNA, 11 bp, Unknown
  misc_feature (1)..( 11): Matrix.005 file - promoters50/5664814
attattttact

SEQ ID NO: 75228 - DNA, 8 bp, Unknown
  misc_feature (1)..( 8): Matrix.005 file - promoters50/5664865
ggattaaa

SEQ ID NO: 75229 - DNA, 7 bp, Unknown
  misc_feature (1)..( 7): Matrix.005 file - promoters50/5664869
aatattt

SEQ ID NO: 75230 - DNA, 8 bp, Unknown
  misc_feature (1)..( 8): Matrix.005 file - promoters50/5664869
aacagaaa

SEQ ID NO: 75231 - DNA, 7 bp, Unknown
  misc_feature (1)..( 7): Matrix.005 file - promoters50/5664873
aaaaata

SEQ ID NO: 75232 - DNA, 12 bp, Unknown
  misc_feature (1)..( 12): Matrix.005 file - promoters50/5664873
tcctatatataa

SEQ ID NO: 75233 - DNA, 15 bp, Unknown
  misc_feature (1)..( 15): Matrix.005 file - promoters50/5664873
tttaaaaaacgtcga

SEQ ID NO: 75234 - DNA, 9 bp, Unknown
  misc_feature (1)..( 9): Matrix.005 file - promoters50/5664893
aattccata

SEQ ID NO: 75235 - DNA, 6 bp, Unknown
  misc_feature (1)..( 6): Matrix.005 file - promoters50/5664942
aaaatc

SEQ ID NO: 75236 - DNA, 9 bp, Unknown
  misc_feature (1)..( 9): Matrix.005 file - promoters50/5664942
ctcaactta

SEQ ID NO: 75237 - DNA, 11 bp, Unknown
  misc_feature (1)..( 11): Matrix.005 file - promoters50/5665027
ctccttataaa

SEQ ID NO: 75238 - DNA, 9 bp, Unknown
  misc_feature (1)..( 9): Matrix.005 file - promoters50/5665027
tttattctt

SEQ ID NO: 75239 - DNA, 8 bp, Unknown
  misc_feature (1)..( 8): Matrix.005 file - promoters50/5665027
ttttctta

SEQ ID NO: 75240 - DNA, 13 bp, Unknown
  misc_feature (1)..( 13): Matrix.005 file - promoters50/5665027
aaaccaaaatttt

SEQ ID NO: 75241 - DNA, 9 bp, Unknown
  misc_feature (1)..( 9): Matrix.005 file - promoters50/5665071
ttaatcaat

SEQ ID NO: 75242 - DNA, 9 bp, Unknown
  misc_feature (1)..( 9): Matrix.005 file - promoters50/5665071
gattaagct

SEQ ID NO: 75243 - DNA, 16 bp, Unknown
  misc_feature (1)..( 16): Matrix.005 file - promoters50/5665071
caaaaactcaagattt

SEQ ID NO: 75244 - DNA, 7 bp, Unknown
  misc_feature (1)..( 7): Matrix.005 file - promoters50/5665083
gttttta

SEQ ID NO: 75245 - DNA, 8 bp, Unknown
  misc_feature (1)..( 8): Matrix.005 file - promoters50/5665087
tcaaaatc

SEQ ID NO: 75246 - DNA, 6 bp, Unknown
  misc_feature (1)..( 6): Matrix.005 file - promoters50/5665087
aaaact

SEQ ID NO: 75247 - DNA, 7 bp, Unknown
  misc_feature (1)..( 7): Matrix.005 file - promoters50/5665087
ttttgtt

SEQ ID NO: 75248 - DNA, 13 bp, Unknown
  misc_feature (1)..( 13): Matrix.005 file - promoters50/5665140
gagtattttcaaa

SEQ ID NO: 75249 - DNA, 14 bp, Unknown
  misc_feature (1)..( 14): Matrix.005 file - promoters50/5665140
gaaactttaattaa

SEQ ID NO: 75250 - DNA, 11 bp, Unknown
  misc_feature (1)..( 11): Matrix.005 file - promoters50/5665140
attaaatgtta

SEQ ID NO: 75251 - DNA, 8 bp, Unknown
  misc_feature (1)..( 8): Matrix.005 file - promoters50/5665199
aaaaaata

SEQ ID NO: 75252 - DNA, 8 bp, Unknown
  misc_feature (1)..( 8): Matrix.005 file - promoters50/5665199
actcaaaa

SEQ ID NO: 75253 - DNA, 9 bp, Unknown
  misc_feature (1)..( 9): Matrix.005 file - promoters50/5665199
aacaaaata

SEQ ID NO: 75254 - DNA, 8 bp, Unknown
  misc_feature (1)..( 8): Matrix.005 file - promoters50/5665199
tggcccaa

SEQ ID NO: 75255 - DNA, 7 bp, Unknown
  misc_feature (1)..( 7): Matrix.005 file - promoters50/5665260
tgaatta

SEQ ID NO: 75256 - DNA, 7 bp, Unknown
  misc_feature (1)..( 7): Matrix.005 file - promoters50/5665260
gaagata

SEQ ID NO: 75257 - DNA, 11 bp, Unknown
  misc_feature (1)..( 11): Matrix.005 file - promoters50/5665279
actatagtttc

SEQ ID NO: 75258 - DNA, 10 bp, Unknown
  misc_feature (1)..( 10): Matrix.005 file - promoters50/5665279
ttattctttg

SEQ ID NO: 75259 - DNA, 4 bp, Unknown
  misc_feature (1)..( 4): Matrix.005 file - promoters50/5665283
attg

SEQ ID NO: 75260 - DNA, 9 bp, Unknown
  misc_feature (1)..( 9): Matrix.005 file - promoters50/5665283
attaatatt

SEQ ID NO: 75261 - DNA, 8 bp, Unknown
  misc_feature (1)..( 8): Matrix.005 file - promoters50/5665306
gaaacgaa

SEQ ID NO: 75262 - DNA, 10 bp, Unknown
  misc_feature (1)..( 10): Matrix.005 file - promoters50/5665306
attcgttttg

SEQ ID NO: 75263 - DNA, 8 bp, Unknown
  misc_feature (1)..( 8): Matrix.005 file - promoters50/5665314
taaaggag

SEQ ID NO: 75264 - DNA, 8 bp, Unknown
  misc_feature (1)..( 8): Matrix.005 file - promoters50/5665314
ttttgagt

SEQ ID NO: 75265 - DNA, 10 bp, Unknown
  misc_feature (1)..( 10): Matrix.005 file - promoters50/5665326
taattattat

SEQ ID NO: 75266 - DNA, 10 bp, Unknown
  misc_feature (1)..( 10): Matrix.005 file - promoters50/5665326
caaaatcata

SEQ ID NO: 75267 - DNA, 11 bp, Unknown
  misc_feature (1)..( 11): Matrix.005 file - promoters50/5665343
tttttttattt

SEQ ID NO: 75268 - DNA, 8 bp, Unknown
  misc_feature (1)..( 8): Matrix.005 file - promoters50/5665343
acttattt

SEQ ID NO: 75269 - DNA, 13 bp, Unknown
  misc_feature (1)..( 13): Matrix.005 file - promoters50/5665343
ctaaaaactatga

SEQ ID NO: 75270 - DNA, 7 bp, Unknown
  misc_feature (1)..( 7): Matrix.005 file - promoters50/5665343
ttgtttc

SEQ ID NO: 75271 - DNA, 7 bp, Unknown
  misc_feature (1)..( 7): Matrix.005 file - promoters50/5665343
gaggaaa

SEQ ID NO: 75272 - DNA, 8 bp, Unknown
  misc_feature (1)..( 8): Matrix.005 file - promoters50/5665343
tttaagtt

SEQ ID NO: 75273 - DNA, 10 bp, Unknown
  misc_feature (1)..( 10): Matrix.005 file - promoters50/5665347
tatataaata

SEQ ID NO: 75274 - DNA, 9 bp, Unknown
  misc_feature (1)..( 9): Matrix.005 file - promoters50/5665347
taattttat

SEQ ID NO: 75275 - DNA, 10 bp, Unknown
  misc_feature (1)..( 10): Matrix.005 file - promoters50/5665351
attgtatcgt

SEQ ID NO: 75276 - DNA, 9 bp, Unknown
  misc_feature (1)..( 9): Matrix.005 file - promoters50/5665367
taaaaatag

SEQ ID NO: 75277 - DNA, 11 bp, Unknown
  misc_feature (1)..( 11): Matrix.005 file - promoters50/5665367
atagaaaataa

SEQ ID NO: 75278 - DNA, 8 bp, Unknown
  misc_feature (1)..( 8): Matrix.005 file - promoters50/5665367
atatataa

SEQ ID NO: 75279 - DNA, 9 bp, Unknown
  misc_feature (1)..( 9): Matrix.005 file - promoters50/5665371
aaaatttct

SEQ ID NO: 75280 - DNA, 8 bp, Unknown
  misc_feature (1)..( 8): Matrix.005 file - promoters50/5665371
tgtgaaac

SEQ ID NO: 75281 - DNA, 9 bp, Unknown
  misc_feature (1)..( 9): Matrix.005 file - promoters50/5665371
aaaatttct

SEQ ID NO: 75282 - DNA, 9 bp, Unknown
  misc_feature (1)..( 9): Matrix.005 file - promoters50/5665371
tttcaaaat

SEQ ID NO: 75283 - DNA, 12 bp, Unknown
  misc_feature (1)..( 12): Matrix.005 file - promoters50/5665374
caaaacaaatat

SEQ ID NO: 75284 - DNA, 11 bp, Unknown
  misc_feature (1)..( 11): Matrix.005 file - promoters50/5665374
cactatctaaa

SEQ ID NO: 75285 - DNA, 12 bp, Unknown
  misc_feature (1)..( 12): Matrix.005 file - promoters50/5665374
ttagaaaaataa

SEQ ID NO: 75286 - DNA, 11 bp, Unknown
  misc_feature (1)..( 11): Matrix.005 file - promoters50/5665374
aaaacaaaaaa

SEQ ID NO: 75287 - DNA, 8 bp, Unknown
  misc_feature (1)..( 8): Matrix.005 file - promoters50/5665374
aatttttg

SEQ ID NO: 75288 - DNA, 7 bp, Unknown
  misc_feature (1)..( 7): Matrix.005 file - promoters50/5665382
gatataa

SEQ ID NO: 75289 - DNA, 10 bp, Unknown
  misc_feature (1)..( 10): Matrix.005 file - promoters50/5665382
ttaatttgat

SEQ ID NO: 75290 - DNA, 11 bp, Unknown
  misc_feature (1)..( 11): Matrix.005 file - promoters50/5665386
aataaagtcct

SEQ ID NO: 75291 - DNA, 9 bp, Unknown
  misc_feature (1)..( 9): Matrix.005 file - promoters50/5665386
cttcttttt

SEQ ID NO: 75292 - DNA, 9 bp, Unknown
  misc_feature (1)..( 9): Matrix.005 file - promoters50/5665386
tttcagtca

SEQ ID NO: 75293 - DNA, 8 bp, Unknown
  misc_feature (1)..( 8): Matrix.005 file - promoters50/5665386
caaaaatc

SEQ ID NO: 75294 - DNA, 9 bp, Unknown
  misc_feature (1)..( 9): Matrix.005 file - promoters50/5665386
agtatctta

SEQ ID NO: 75295 - DNA, 7 bp, Unknown
  misc_feature (1)..( 7): Matrix.005 file - promoters50/5665390
tttaatt

SEQ ID NO: 75296 - DNA, 9 bp, Unknown
  misc_feature (1)..( 9): Matrix.005 file - promoters50/5665390
ataaacaaa

SEQ ID NO: 75297 - DNA, 7 bp, Unknown
  misc_feature (1)..( 7): Matrix.005 file - promoters50/5665390
attttta

SEQ ID NO: 75298 - DNA, 7 bp, Unknown
  misc_feature (1)..( 7): Matrix.005 file - promoters50/5665390
attcact

SEQ ID NO: 75299 - DNA, 6 bp, Unknown
  misc_feature (1)..( 6): Matrix.005 file - promoters50/5665390
tttata

SEQ ID NO: 75300 - DNA, 11 bp, Unknown
  misc_feature (1)..( 11): Matrix.005 file - promoters50/5665390
cataaagaaaa

SEQ ID NO: 75301 - DNA, 11 bp, Unknown
  misc_feature (1)..( 11): Matrix.005 file - promoters50/5665390
aaaaattaaaa

SEQ ID NO: 75302 - DNA, 7 bp, Unknown
  misc_feature (1)..( 7): Matrix.005 file - promoters50/5665404
tttgttt

SEQ ID NO: 75303 - DNA, 10 bp, Unknown
  misc_feature (1)..( 10): Matrix.005 file - promoters50/5665404
aaataaaata

SEQ ID NO: 75304 - DNA, 8 bp, Unknown
  misc_feature (1)..( 8): Matrix.005 file - promoters50/5665412
ttttcttg

SEQ ID NO: 75305 - DNA, 8 bp, Unknown
  misc_feature (1)..( 8): Matrix.005 file - promoters50/5665412
tttcttct

SEQ ID NO: 75306 - DNA, 10 bp, Unknown
  misc_feature (1)..( 10): Matrix.005 file - promoters50/5665420
aacattttac

SEQ ID NO: 75307 - DNA, 11 bp, Unknown
  misc_feature (1)..( 11): Matrix.005 file - promoters50/5665436
tataataatta

SEQ ID NO: 75308 - DNA, 9 bp, Unknown
  misc_feature (1)..( 9): Matrix.005 file - promoters50/5665507
taatatcct

SEQ ID NO: 75309 - DNA, 13 bp, Unknown
  misc_feature (1)..( 13): Matrix.005 file - promoters50/5665507
attttttgatcat

SEQ ID NO: 75310 - DNA, 13 bp, Unknown
  misc_feature (1)..( 13): Matrix.005 file - promoters50/5665507
atcgagaaaacaa

SEQ ID NO: 75311 - DNA, 5 bp, Unknown
  misc_feature (1)..( 5): Matrix.005 file - promoters50/5665507
aaact

SEQ ID NO: 75312 - DNA, 9 bp, Unknown
  misc_feature (1)..( 9): Matrix.005 file - promoters50/5665507
catttaaaa

SEQ ID NO: 75313 - DNA, 11 bp, Unknown
  misc_feature (1)..( 11): Matrix.005 file - promoters50/5665796
tagaatccact

SEQ ID NO: 75314 - DNA, 11 bp, Unknown
  misc_feature (1)..( 11): Matrix.005 file - promoters50/5665796
tagaatccaca

SEQ ID NO: 75315 - DNA, 9 bp, Unknown
  misc_feature (1)..( 9): Matrix.005 file - promoters50/5665796
atataagta

SEQ ID NO: 75316 - DNA, 8 bp, Unknown
  misc_feature (1)..( 8): Matrix.005 file - promoters50/5666614
ttataaaa

SEQ ID NO: 75317 - DNA, 7 bp, Unknown
  misc_feature (1)..( 7): Matrix.005 file - promoters50/5666614
gtttaac

SEQ ID NO: 75318 - DNA, 8 bp, Unknown
  misc_feature (1)..( 8): Matrix.005 file - promoters50/5666614
taacttcg

SEQ ID NO: 75319 - DNA, 9 bp, Unknown
  misc_feature (1)..( 9): Matrix.005 file - promoters50/5666614
gtttacact

SEQ ID NO: 75320 - DNA, 9 bp, Unknown
  misc_feature (1)..( 9): Matrix.005 file - promoters50/5666614
ttgtttaca

SEQ ID NO: 75321 - DNA, 8 bp, Unknown
  misc_feature (1)..( 8): Matrix.005 file - promoters50/5666614
atttcttc

SEQ ID NO: 75322 - DNA, 10 bp, Unknown
  misc_feature (1)..( 10): Matrix.005 file - promoters50/5667083
gaggtattgc

SEQ ID NO: 75323 - DNA, 11 bp, Unknown
  misc_feature (1)..( 11): Matrix.005 file - promoters50/5667083
gctaaaatgtt

SEQ ID NO: 75324 - DNA, 7 bp, Unknown
  misc_feature (1)..( 7): Matrix.005 file - promoters50/5667083
agagtaa

SEQ ID NO: 75325 - DNA, 8 bp, Unknown
  misc_feature (1)..( 8): Matrix.005 file - promoters50/5667083
aatgcgaa

SEQ ID NO: 75326 - DNA, 11 bp, Unknown
  misc_feature (1)..( 11): Matrix.005 file - promoters50/5667152
ttgcttgattt

SEQ ID NO: 75327 - DNA, 12 bp, Unknown
  misc_feature (1)..( 12): Matrix.005 file - promoters50/5667152
tttcttcttctt

SEQ ID NO: 75328 - DNA, 8 bp, Unknown
  misc_feature (1)..( 8): Matrix.005 file - promoters50/5667426
tgtttgta

SEQ ID NO: 75329 - DNA, 8 bp, Unknown
  misc_feature (1)..( 8): Matrix.005 file - promoters50/5667426
aaaactca

SEQ ID NO: 75330 - DNA, 7 bp, Unknown
  misc_feature (1)..( 7): Matrix.005 file - promoters50/5667426
atttgtt

SEQ ID NO: 75331 - DNA, 8 bp, Unknown
  misc_feature (1)..( 8): Matrix.005 file - promoters50/5667426
tttattat

SEQ ID NO: 75332 - DNA, 9 bp, Unknown
  misc_feature (1)..( 9): Matrix.005 file - promoters50/5667570
aaaaagaaa

SEQ ID NO: 75333 - DNA, 11 bp, Unknown
  misc_feature (1)..( 11): Matrix.005 file - promoters50/5667570
gaaaaaactaa

SEQ ID NO: 75334 - DNA, 7 bp, Unknown
  misc_feature (1)..( 7): Matrix.005 file - promoters50/5667570
ctatata

SEQ ID NO: 75335 - DNA, 10 bp, Unknown
  misc_feature (1)..( 10): Matrix.005 file - promoters50/5667588
tatctaagtg

SEQ ID NO: 75336 - DNA, 8 bp, Unknown
  misc_feature (1)..( 8): Matrix.005 file - promoters50/5667588
actatata

SEQ ID NO: 75337 - DNA, 8 bp, Unknown
  misc_feature (1)..( 8): Matrix.005 file - promoters50/5667588
ggtcaaga

SEQ ID NO: 75338 - DNA, 8 bp, Unknown
  misc_feature (1)..( 8): Matrix.005 file - promoters50/5667674
acaaaagt

SEQ ID NO: 75339 - DNA, 9 bp, Unknown
  misc_feature (1)..( 9): Matrix.005 file - promoters50/5667674
acaaaagtt

SEQ ID NO: 75340 - DNA, 8 bp, Unknown
  misc_feature (1)..( 8): Matrix.005 file - promoters50/5667674
agataaaa

SEQ ID NO: 75341 - DNA, 10 bp, Unknown
  misc_feature (1)..( 10): Matrix.005 file - promoters50/5667685
ttgtaaccaa

SEQ ID NO: 75342 - DNA, 7 bp, Unknown
  misc_feature (1)..( 7): Matrix.005 file - promoters50/5667689
taaaacc

SEQ ID NO: 75343 - DNA, 10 bp, Unknown
  misc_feature (1)..( 10): Matrix.005 file - promoters50/5667705
aatagaatca

SEQ ID NO: 75344 - DNA, 9 bp, Unknown
  misc_feature (1)..( 9): Matrix.005 file - promoters50/5667705
tttgttccg

SEQ ID NO: 75345 - DNA, 13 bp, Unknown
  misc_feature (1)..( 13): Matrix.005 file - promoters50/5667705
cgtttagattttt

SEQ ID NO: 75346 - DNA, 8 bp, Unknown
  misc_feature (1)..( 8): Matrix.005 file - promoters50/5667705
attgaaag

SEQ ID NO: 75347 - DNA, 8 bp, Unknown
  misc_feature (1)..( 8): Matrix.005 file - promoters50/5667720
tataaacc

SEQ ID NO: 75348 - DNA, 17 bp, Unknown
  misc_feature (1)..( 17): Matrix.005 file - promoters50/5667720
tataaccaaaaaaataa

SEQ ID NO: 75349 - DNA, 14 bp, Unknown
  misc_feature (1)..( 14): Matrix.005 file - promoters50/5667720
gtttataaaaaata

SEQ ID NO: 75350 - DNA, 8 bp, Unknown
  misc_feature (1)..( 8): Matrix.005 file - promoters50/5667720
ttaaaaaa

SEQ ID NO: 75351 - DNA, 15 bp, Unknown
  misc_feature (1)..( 15): Matrix.005 file - promoters50/5667720
tattaaaaaaagtta

SEQ ID NO: 75352 - DNA, 14 bp, Unknown
  misc_feature (1)..( 14): Matrix.005 file - promoters50/5667720
caaaaatttttaat

SEQ ID NO: 75353 - DNA, 14 bp, Unknown
  misc_feature (1)..( 14): Matrix.005 file - promoters50/5667720
atcaaatttattaa

SEQ ID NO: 75354 - DNA, 7 bp, Unknown
  misc_feature (1)..( 7): Matrix.005 file - promoters50/5667720
gtttttt

SEQ ID NO: 75355 - DNA, 8 bp, Unknown
  misc_feature (1)..( 8): Matrix.005 file - promoters50/5667720
aatgataa

SEQ ID NO: 75356 - DNA, 11 bp, Unknown
  misc_feature (1)..( 11): Matrix.005 file - promoters50/5667720
ggaaactttaa

SEQ ID NO: 75357 - DNA, 8 bp, Unknown
  misc_feature (1)..( 8): Matrix.005 file - promoters50/5667733
tattatta

SEQ ID NO: 75358 - DNA, 7 bp, Unknown
  misc_feature (1)..( 7): Matrix.005 file - promoters50/5667733
ctttttt

SEQ ID NO: 75359 - DNA, 9 bp, Unknown
  misc_feature (1)..( 9): Matrix.005 file - promoters50/5667737
tctaaaaag

SEQ ID NO: 75360 - DNA, 12 bp, Unknown
  misc_feature (1)..( 12): Matrix.005 file - promoters50/5667737
tctaaaaagact

SEQ ID NO: 75361 - DNA, 6 bp, Unknown
  misc_feature (1)..( 6): Matrix.005 file - promoters50/5667741
tatata

SEQ ID NO: 75362 - DNA, 7 bp, Unknown
  misc_feature (1)..( 7): Matrix.005 file - promoters50/5667766
atattca

SEQ ID NO: 75363 - DNA, 10 bp, Unknown
  misc_feature (1)..( 10): Matrix.005 file - promoters50/5667766
atttttgttg

SEQ ID NO: 75364 - DNA, 14 bp, Unknown
  misc_feature (1)..( 14): Matrix.005 file - promoters50/5667766
cattcggaaactgg

SEQ ID NO: 75365 - DNA, 10 bp, Unknown
  misc_feature (1)..( 10): Matrix.005 file - promoters50/5667770
aaatttattt

SEQ ID NO: 75366 - DNA, 8 bp, Unknown
  misc_feature (1)..( 8): Matrix.005 file - promoters50/5667785
gttcgtaa

SEQ ID NO: 75367 - DNA, 12 bp, Unknown
  misc_feature (1)..( 12): Matrix.005 file - promoters50/5667812
aaatagaaatat

SEQ ID NO: 75368 - DNA, 6 bp, Unknown
  misc_feature (1)..( 6): Matrix.005 file - promoters50/5667812
tataat

SEQ ID NO: 75369 - DNA, 12 bp, Unknown
  misc_feature (1)..( 12): Matrix.005 file - promoters50/5667814
taaattgaaaaa

SEQ ID NO: 75370 - DNA, 12 bp, Unknown
  misc_feature (1)..( 12): Matrix.005 file - promoters50/5667822
taaattgaaatt

SEQ ID NO: 75371 - DNA, 8 bp, Unknown
  misc_feature (1)..( 8): Matrix.005 file - promoters50/5667822
gataaaat

SEQ ID NO: 75372 - DNA, 10 bp, Unknown
  misc_feature (1)..( 10): Matrix.005 file - promoters50/5667822
tttataaaaa

SEQ ID NO: 75373 - DNA, 10 bp, Unknown
  misc_feature (1)..( 10): Matrix.005 file - promoters50/5667822
aaaaaaaaaa

SEQ ID NO: 75374 - DNA, 12 bp, Unknown
  misc_feature (1)..( 12): Matrix.005 file - promoters50/5667849
ctacattatgaa

SEQ ID NO: 75375 - DNA, 12 bp, Unknown
  misc_feature (1)..( 12): Matrix.005 file - promoters50/5667849
tctatgaatcat

SEQ ID NO: 75376 - DNA, 8 bp, Unknown
  misc_feature (1)..( 8): Matrix.005 file - promoters50/5668051
aacaatat

SEQ ID NO: 75377 - DNA, 14 bp, Unknown
  misc_feature (1)..( 14): Matrix.005 file - promoters50/5668065
cattttggtcaatt

SEQ ID NO: 75378 - DNA, 11 bp, Unknown
  misc_feature (1)..( 11): Matrix.005 file - promoters50/5668065
ttcgaaacaaa

SEQ ID NO: 75379 - DNA, 7 bp, Unknown
  misc_feature (1)..( 7): Matrix.005 file - promoters50/5668069
ttttatt

SEQ ID NO: 75380 - DNA, 13 bp, Unknown
  misc_feature (1)..( 13): Matrix.005 file - promoters50/5668085
ctcatcttccctt

SEQ ID NO: 75381 - DNA, 7 bp, Unknown
  misc_feature (1)..( 7): Matrix.005 file - promoters50/5668085
gcggaaa

SEQ ID NO: 75382 - DNA, 7 bp, Unknown
  misc_feature (1)..( 7): Matrix.005 file - promoters50/5668085
ctccttg

SEQ ID NO: 75383 - DNA, 12 bp, Unknown
  misc_feature (1)..( 12): Matrix.005 file - promoters50/5668101
agttattgatta

SEQ ID NO: 75384 - DNA, 10 bp, Unknown
  misc_feature (1)..( 10): Matrix.005 file - promoters50/5668101
ggacccgtga

SEQ ID NO: 75385 - DNA, 8 bp, Unknown
  misc_feature (1)..( 8): Matrix.005 file - promoters50/5668101
tttatgtt

SEQ ID NO: 75386 - DNA, 7 bp, Unknown
  misc_feature (1)..( 7): Matrix.005 file - promoters50/5668101
ttaagtt

SEQ ID NO: 75387 - DNA, 12 bp, Unknown
  misc_feature (1)..( 12): Matrix.005 file - promoters50/5668101
cttgtaaccaca

SEQ ID NO: 75388 - DNA, 10 bp, Unknown
  misc_feature (1)..( 10): Matrix.005 file - promoters50/5668111
aattataaag

SEQ ID NO: 75389 - DNA, 10 bp, Unknown
  misc_feature (1)..( 10): Matrix.005 file - promoters50/5668111
ctcgtaaaat

SEQ ID NO: 75390 - DNA, 9 bp, Unknown
  misc_feature (1)..( 9): Matrix.005 file - promoters50/5668111
taaacaaaa

SEQ ID NO: 75391 - DNA, 8 bp, Unknown
  misc_feature (1)..( 8): Matrix.005 file - promoters50/5668162
ttttattt

SEQ ID NO: 75392 - DNA, 6 bp, Unknown
  misc_feature (1)..( 6): Matrix.005 file - promoters50/5668277
tctctc

SEQ ID NO: 75393 - DNA, 9 bp, Unknown
  misc_feature (1)..( 9): Matrix.005 file - promoters50/5668294
catagattc

SEQ ID NO: 75394 - DNA, 12 bp, Unknown
  misc_feature (1)..( 12): Matrix.005 file - promoters50/5668294
gaataaaatgta

SEQ ID NO: 75395 - DNA, 9 bp, Unknown
  misc_feature (1)..( 9): Matrix.005 file - promoters50/5668294
agagataaa

SEQ ID NO: 75396 - DNA, 10 bp, Unknown
  misc_feature (1)..( 10): Matrix.005 file - promoters50/5668306
atccaagaag

SEQ ID NO: 75397 - DNA, 8 bp, Unknown
  misc_feature (1)..( 8): Matrix.005 file - promoters50/5668306
aaacactt

SEQ ID NO: 75398 - DNA, 8 bp, Unknown
  misc_feature (1)..( 8): Matrix.005 file - promoters50/5668310
tgaggaaa

SEQ ID NO: 75399 - DNA, 9 bp, Unknown
  misc_feature (1)..( 9): Matrix.005 file - promoters50/5668310
tggattgtg

SEQ ID NO: 75400 - DNA, 7 bp, Unknown
  misc_feature (1)..( 7): Matrix.005 file - promoters50/5668317
atgaaac

SEQ ID NO: 75401 - DNA, 11 bp, Unknown
  misc_feature (1)..( 11): Matrix.005 file - promoters50/5668317
aaaagtgtgtg

SEQ ID NO: 75402 - DNA, 14 bp, Unknown
  misc_feature (1)..( 14): Matrix.005 file - promoters50/5668317
aaaaagaaaattaa

SEQ ID NO: 75403 - DNA, 9 bp, Unknown
  misc_feature (1)..( 9): Matrix.005 file - promoters50/5668325
tttggattt

SEQ ID NO: 75404 - DNA, 10 bp, Unknown
  misc_feature (1)..( 10): Matrix.005 file - promoters50/5668325
aaacaaagtt

SEQ ID NO: 75405 - DNA, 8 bp, Unknown
  misc_feature (1)..( 8): Matrix.005 file - promoters50/5668348
aatttcga

SEQ ID NO: 75406 - DNA, 9 bp, Unknown
  misc_feature (1)..( 9): Matrix.005 file - promoters50/5668352
gaataaaat

SEQ ID NO: 75407 - DNA, 13 bp, Unknown
  misc_feature (1)..( 13): Matrix.005 file - promoters50/5668352
gtttctttaacta

SEQ ID NO: 75408 - DNA, 14 bp, Unknown
  misc_feature (1)..( 14): Matrix.005 file - promoters50/5668352
gtaaaaaaacataa

SEQ ID NO: 75409 - DNA, 9 bp, Unknown
  misc_feature (1)..( 9): Matrix.005 file - promoters50/5668352
agtaatata

SEQ ID NO: 75410 - DNA, 7 bp, Unknown
  misc_feature (1)..( 7): Matrix.005 file - promoters50/5668356
aaaaatg

SEQ ID NO: 75411 - DNA, 8 bp, Unknown
  misc_feature (1)..( 8): Matrix.005 file - promoters50/5668359
atggattt

SEQ ID NO: 75412 - DNA, 8 bp, Unknown
  misc_feature (1)..( 8): Matrix.005 file - promoters50/5668359
taatctaa

SEQ ID NO: 75413 - DNA, 13 bp, Unknown
  misc_feature (1)..( 13): Matrix.005 file - promoters50/5668367
gagaaccaaatta

SEQ ID NO: 75414 - DNA, 9 bp, Unknown
  misc_feature (1)..( 9): Matrix.005 file - promoters50/5668367
ttttttaaa

SEQ ID NO: 75415 - DNA, 14 bp, Unknown
  misc_feature (1)..( 14): Matrix.005 file - promoters50/5668367
tttttataacattt

SEQ ID NO: 75416 - DNA, 11 bp, Unknown
  misc_feature (1)..( 11): Matrix.005 file - promoters50/5668367
gaaaaacaatt

SEQ ID NO: 75417 - DNA, 9 bp, Unknown
  misc_feature (1)..( 9): Matrix.005 file - promoters50/5668367
aacaattta

SEQ ID NO: 75418 - DNA, 7 bp, Unknown
  misc_feature (1)..( 7): Matrix.005 file - promoters50/5668367
gttttcc

SEQ ID NO: 75419 - DNA, 10 bp, Unknown
  misc_feature (1)..( 10): Matrix.005 file - promoters50/5668367
atttaatttt

SEQ ID NO: 75420 - DNA, 13 bp, Unknown
  misc_feature (1)..( 13): Matrix.005 file - promoters50/5668367
aataaatacatca

SEQ ID NO: 75421 - DNA, 9 bp, Unknown
  misc_feature (1)..( 9): Matrix.005 file - promoters50/5668367
attattttc

SEQ ID NO: 75422 - DNA, 9 bp, Unknown
  misc_feature (1)..( 9): Matrix.005 file - promoters50/5668367
atatagtat

SEQ ID NO: 75423 - DNA, 7 bp, Unknown
  misc_feature (1)..( 7): Matrix.005 file - promoters50/5668367
catgatc

SEQ ID NO: 75424 - DNA, 9 bp, Unknown
  misc_feature (1)..( 9): Matrix.005 file - promoters50/5668367
tttgaatgg

SEQ ID NO: 75425 - DNA, 7 bp, Unknown
  misc_feature (1)..( 7): Matrix.005 file - promoters50/5668371
ttttaat

SEQ ID NO: 75426 - DNA, 8 bp, Unknown
  misc_feature (1)..( 8): Matrix.005 file - promoters50/5668375
tcttttct

SEQ ID NO: 75427 - DNA, 9 bp, Unknown
  misc_feature (1)..( 9): Matrix.005 file - promoters50/5668397
agattcaat

SEQ ID NO: 75428 - DNA, 8 bp, Unknown
  misc_feature (1)..( 8): Matrix.005 file - promoters50/5668397
tcaacttt

SEQ ID NO: 75429 - DNA, 11 bp, Unknown
  misc_feature (1)..( 11): Matrix.005 file - promoters50/5668397
taatttctttt

SEQ ID NO: 75430 - DNA, 10 bp, Unknown
  misc_feature (1)..( 10): Matrix.005 file - promoters50/5668397
tggaaacaat

SEQ ID NO: 75431 - DNA, 9 bp, Unknown
  misc_feature (1)..( 9): Matrix.005 file - promoters50/5668435
acaaacaaa

SEQ ID NO: 75432 - DNA, 11 bp, Unknown
  misc_feature (1)..( 11): Matrix.005 file - promoters50/5668439
tttttagaagt

SEQ ID NO: 75433 - DNA, 12 bp, Unknown
  misc_feature (1)..( 12): Matrix.005 file - promoters50/5668439
cattagataaaa

SEQ ID NO: 75434 - DNA, 7 bp, Unknown
  misc_feature (1)..( 7): Matrix.005 file - promoters50/5668439
aaaagaa

SEQ ID NO: 75435 - DNA, 7 bp, Unknown
  misc_feature (1)..( 7): Matrix.005 file - promoters50/5668439
gatgaca

SEQ ID NO: 75436 - DNA, 9 bp, Unknown
  misc_feature (1)..( 9): Matrix.005 file - promoters50/5668454
taaaataat

SEQ ID NO: 75437 - DNA, 9 bp, Unknown
  misc_feature (1)..( 9): Matrix.005 file - promoters50/5668457
ttgtttcta

SEQ ID NO: 75438 - DNA, 8 bp, Unknown
  misc_feature (1)..( 8): Matrix.005 file - promoters50/5668457
ttttttgg

SEQ ID NO: 75439 - DNA, 8 bp, Unknown
  misc_feature (1)..( 8): Matrix.005 file - promoters50/5668457
tttctata

SEQ ID NO: 75440 - DNA, 7 bp, Unknown
  misc_feature (1)..( 7): Matrix.005 file - promoters50/5668457
aatgcaa

SEQ ID NO: 75441 - DNA, 11 bp, Unknown
  misc_feature (1)..( 11): Matrix.005 file - promoters50/5668457
caatgtttact

SEQ ID NO: 75442 - DNA, 7 bp, Unknown
  misc_feature (1)..( 7): Matrix.005 file - promoters50/5668457
gagtttt

SEQ ID NO: 75443 - DNA, 8 bp, Unknown
  misc_feature (1)..( 8): Matrix.005 file - promoters50/5668457
ggttgatg

SEQ ID NO: 75444 - DNA, 11 bp, Unknown
  misc_feature (1)..( 11): Matrix.005 file - promoters50/5668469
tatttgttaac

SEQ ID NO: 75445 - DNA, 8 bp, Unknown
  misc_feature (1)..( 8): Matrix.005 file - promoters50/5668485
tttcaaat

SEQ ID NO: 75446 - DNA, 11 bp, Unknown
  misc_feature (1)..( 11): Matrix.005 file - promoters50/5668485
taccaaagttg

SEQ ID NO: 75447 - DNA, 10 bp, Unknown
  misc_feature (1)..( 10): Matrix.005 file - promoters50/5668485
atttttaaat

SEQ ID NO: 75448 - DNA, 7 bp, Unknown
  misc_feature (1)..( 7): Matrix.005 file - promoters50/5668485
tgatgca

SEQ ID NO: 75449 - DNA, 11 bp, Unknown
  misc_feature (1)..( 11): Matrix.005 file - promoters50/5668493
gcttgtttttt

SEQ ID NO: 75450 - DNA, 10 bp, Unknown
  misc_feature (1)..( 10): Matrix.005 file - promoters50/5668493
tgcttttatt

SEQ ID NO: 75451 - DNA, 9 bp, Unknown
  misc_feature (1)..( 9): Matrix.005 file - promoters50/5668493
aaaaattaa

SEQ ID NO: 75452 - DNA, 11 bp, Unknown
  misc_feature (1)..( 11): Matrix.005 file - promoters50/5668493
caaataatttt

SEQ ID NO: 75453 - DNA, 12 bp, Unknown
  misc_feature (1)..( 12): Matrix.005 file - promoters50/5668497
aactcaagattt

SEQ ID NO: 75454 - DNA, 7 bp, Unknown
  misc_feature (1)..( 7): Matrix.005 file - promoters50/5668497
ttgtttt

SEQ ID NO: 75455 - DNA, 8 bp, Unknown
  misc_feature (1)..( 8): Matrix.005 file - promoters50/5668497
tttatcta

SEQ ID NO: 75456 - DNA, 9 bp, Unknown
  misc_feature (1)..( 9): Matrix.005 file - promoters50/5668497
gaaacttga

SEQ ID NO: 75457 - DNA, 9 bp, Unknown
  misc_feature (1)..( 9): Matrix.005 file - promoters50/5668509
aaaaaatta

SEQ ID NO: 75458 - DNA, 11 bp, Unknown
  misc_feature (1)..( 11): Matrix.005 file - promoters50/5668509
catataaccaa

SEQ ID NO: 75459 - DNA, 10 bp, Unknown
  misc_feature (1)..( 10): Matrix.005 file - promoters50/5668509
aatcaaaaat

SEQ ID NO: 75460 - DNA, 6 bp, Unknown
  misc_feature (1)..( 6): Matrix.005 file - promoters50/5668509
atataa

SEQ ID NO: 75461 - DNA, 9 bp, Unknown
  misc_feature (1)..( 9): Matrix.005 file - promoters50/5668509
aaacaaatg

SEQ ID NO: 75462 - DNA, 11 bp, Unknown
  misc_feature (1)..( 11): Matrix.005 file - promoters50/5668509
gtaacaaataa

SEQ ID NO: 75463 - DNA, 10 bp, Unknown
  misc_feature (1)..( 10): Matrix.005 file - promoters50/5668529
taaaaaataa

SEQ ID NO: 75464 - DNA, 10 bp, Unknown
  misc_feature (1)..( 10): Matrix.005 file - promoters50/5668533
aaaataaaaa

SEQ ID NO: 75465 - DNA, 9 bp, Unknown
  misc_feature (1)..( 9): Matrix.005 file - promoters50/5668537
tatttttac

SEQ ID NO: 75466 - DNA, 12 bp, Unknown
  misc_feature (1)..( 12): Matrix.005 file - promoters50/5668537
caaatattttct

SEQ ID NO: 75467 - DNA, 9 bp, Unknown
  misc_feature (1)..( 9): Matrix.005 file - promoters50/5668537
ataattcat

SEQ ID NO: 75468 - DNA, 11 bp, Unknown
  misc_feature (1)..( 11): Matrix.005 file - promoters50/5668537
ttttctaaaat

SEQ ID NO: 75469 - DNA, 8 bp, Unknown
  misc_feature (1)..( 8): Matrix.005 file - promoters50/5668537
taaatttc

SEQ ID NO: 75470 - DNA, 13 bp, Unknown
  misc_feature (1)..( 13): Matrix.005 file - promoters50/5668541
aattatttaatat

SEQ ID NO: 75471 - DNA, 10 bp, Unknown
  misc_feature (1)..( 10): Matrix.005 file - promoters50/5668541
gaataaaatc

SEQ ID NO: 75472 - DNA, 13 bp, Unknown
  misc_feature (1)..( 13): Matrix.005 file - promoters50/5668541
tattatatttgaa

SEQ ID NO: 75473 - DNA, 11 bp, Unknown
  misc_feature (1)..( 11): Matrix.005 file - promoters50/5668541
tgaattttttt

SEQ ID NO: 75474 - DNA, 14 bp, Unknown
  misc_feature (1)..( 14): Matrix.005 file - promoters50/5668541
gaatatatttattt

SEQ ID NO: 75475 - DNA, 7 bp, Unknown
  misc_feature (1)..( 7): Matrix.005 file - promoters50/5668547
acgtgga

SEQ ID NO: 75476 - DNA, 7 bp, Unknown
  misc_feature (1)..( 7): Matrix.005 file - promoters50/5668547
gctgaaa

SEQ ID NO: 75477 - DNA, 9 bp, Unknown
  misc_feature (1)..( 9): Matrix.005 file - promoters50/5668547
tttttcttc

SEQ ID NO: 75478 - DNA, 8 bp, Unknown
  misc_feature (1)..( 8): Matrix.005 file - promoters50/5668547
tgtttcta

SEQ ID NO: 75479 - DNA, 9 bp, Unknown
  misc_feature (1)..( 9): Matrix.005 file - promoters50/5668547
gtgtcctct

SEQ ID NO: 75480 - DNA, 10 bp, Unknown
  misc_feature (1)..( 10): Matrix.005 file - promoters50/5668547
atgtggctga

SEQ ID NO: 75481 - DNA, 12 bp, Unknown
  misc_feature (1)..( 12): Matrix.005 file - promoters50/5668566
ttcctttcttaa

SEQ ID NO: 75482 - DNA, 7 bp, Unknown
  misc_feature (1)..( 7): Matrix.005 file - promoters50/5668592
attttga

SEQ ID NO: 75483 - DNA, 7 bp, Unknown
  misc_feature (1)..( 7): Matrix.005 file - promoters50/5668592
tgtttcg

SEQ ID NO: 75484 - DNA, 12 bp, Unknown
  misc_feature (1)..( 12): Matrix.005 file - promoters50/5668629
gaaaatttgaaa

SEQ ID NO: 75485 - DNA, 11 bp, Unknown
  misc_feature (1)..( 11): Matrix.005 file - promoters50/5668629
ttaaattttat

SEQ ID NO: 75486 - DNA, 13 bp, Unknown
  misc_feature (1)..( 13): Matrix.005 file - promoters50/5668629
tttttgtgtttaa

SEQ ID NO: 75487 - DNA, 11 bp, Unknown
  misc_feature (1)..( 11): Matrix.005 file - promoters50/5668629
taaatcttatt

SEQ ID NO: 75488 - DNA, 10 bp, Unknown
  misc_feature (1)..( 10): Matrix.005 file - promoters50/5668629
gacgaaaaag

SEQ ID NO: 75489 - DNA, 10 bp, Unknown
  misc_feature (1)..( 10): Matrix.005 file - promoters50/5668720
ttcaaaaata

SEQ ID NO: 75490 - DNA, 11 bp, Unknown
  misc_feature (1)..( 11): Matrix.005 file - promoters50/5668748
attaaaaatat

SEQ ID NO: 75491 - DNA, 11 bp, Unknown
  misc_feature (1)..( 11): Matrix.005 file - promoters50/5668748
tatttttcttt

SEQ ID NO: 75492 - DNA, 11 bp, Unknown
  misc_feature (1)..( 11): Matrix.005 file - promoters50/5668748
agataaaatat

SEQ ID NO: 75493 - DNA, 13 bp, Unknown
  misc_feature (1)..( 13): Matrix.005 file - promoters50/5668748
actaaaaatatga

SEQ ID NO: 75494 - DNA, 13 bp, Unknown
  misc_feature (1)..( 13): Matrix.005 file - promoters50/5668748
agaaaattacctc

SEQ ID NO: 75495 - DNA, 8 bp, Unknown
  misc_feature (1)..( 8): Matrix.005 file - promoters50/5668748
tataaaac

SEQ ID NO: 75496 - DNA, 16 bp, Unknown
  misc_feature (1)..( 16): Matrix.005 file - promoters50/5668748
ctaaaaaacatatctc

SEQ ID NO: 75497 - DNA, 9 bp, Unknown
  misc_feature (1)..( 9): Matrix.005 file - promoters50/5668748
ctataaata

SEQ ID NO: 75498 - DNA, 14 bp, Unknown
  misc_feature (1)..( 14): Matrix.005 file - promoters50/5668748
cattattaatcaat

SEQ ID NO: 75499 - DNA, 14 bp, Unknown
  misc_feature (1)..( 14): Matrix.005 file - promoters50/5668748
aacagattacatat

SEQ ID NO: 75500 - DNA, 9 bp, Unknown
  misc_feature (1)..( 9): Matrix.005 file - promoters50/5668788
agagaaaaa

SEQ ID NO: 75501 - DNA, 12 bp, Unknown
  misc_feature (1)..( 12): Matrix.005 file - promoters50/5668797
ctatataatgaa

SEQ ID NO: 75502 - DNA, 22 bp, Unknown
  misc_feature (1)..( 22): Matrix.005 file - promoters50/5668797
caaagaaaaaataaattgattt

SEQ ID NO: 75503 - DNA, 9 bp, Unknown
  misc_feature (1)..( 9): Matrix.005 file - promoters50/5668800
taacatttt

SEQ ID NO: 75504 - DNA, 11 bp, Unknown
  misc_feature (1)..( 11): Matrix.005 file - promoters50/5668800
atataaacaaa

SEQ ID NO: 75505 - DNA, 8 bp, Unknown
  misc_feature (1)..( 8): Matrix.005 file - promoters50/5668800
gataaaat

SEQ ID NO: 75506 - DNA, 11 bp, Unknown
  misc_feature (1)..( 11): Matrix.005 file - promoters50/5668800
tcttattttga

SEQ ID NO: 75507 - DNA, 22 bp, Unknown
  misc_feature (1)..( 22): Matrix.005 file - promoters50/5668800
tcttttctgatattgtttctca

SEQ ID NO: 75508 - DNA, 6 bp, Unknown
  misc_feature (1)..( 6): Matrix.005 file - promoters50/5668800
atagga

SEQ ID NO: 75509 - DNA, 8 bp, Unknown
  misc_feature (1)..( 8): Matrix.005 file - promoters50/5668800
ataaaatt

SEQ ID NO: 75510 - DNA, 12 bp, Unknown
  misc_feature (1)..( 12): Matrix.005 file - promoters50/5668800
aaaaaataaaaa

SEQ ID NO: 75511 - DNA, 7 bp, Unknown
  misc_feature (1)..( 7): Matrix.005 file - promoters50/5668800
aaatata

SEQ ID NO: 75512 - DNA, 8 bp, Unknown
  misc_feature (1)..( 8): Matrix.005 file - promoters50/5668800
aaaaaata

SEQ ID NO: 75513 - DNA, 7 bp, Unknown
  misc_feature (1)..( 7): Matrix.005 file - promoters50/5668800
agttgct

SEQ ID NO: 75514 - DNA, 9 bp, Unknown
  misc_feature (1)..( 9): Matrix.005 file - promoters50/5668800
ctcaaatct

SEQ ID NO: 75515 - DNA, 8 bp, Unknown
  misc_feature (1)..( 8): Matrix.005 file - promoters50/5668800
tttcaatg

SEQ ID NO: 75516 - DNA, 11 bp, Unknown
  misc_feature (1)..( 11): Matrix.005 file - promoters50/5668807
taatatttatc

SEQ ID NO: 75517 - DNA, 8 bp, Unknown
  misc_feature (1)..( 8): Matrix.005 file - promoters50/5668807
ctttaaaa

SEQ ID NO: 75518 - DNA, 8 bp, Unknown
  misc_feature (1)..( 8): Matrix.005 file - promoters50/5668807
tttcttaa

SEQ ID NO: 75519 - DNA, 7 bp, Unknown
  misc_feature (1)..( 7): Matrix.005 file - promoters50/5668814
gaacttt

SEQ ID NO: 75520 - DNA, 12 bp, Unknown
  misc_feature (1)..( 12): Matrix.005 file - promoters50/5668814
tattggaaaaat

SEQ ID NO: 75521 - DNA, 5 bp, Unknown
  misc_feature (1)..( 5): Matrix.005 file - promoters50/5668818
attaa

SEQ ID NO: 75522 - DNA, 12 bp, Unknown
  misc_feature (1)..( 12): Matrix.005 file - promoters50/5668818
aattaaaaaaaa

SEQ ID NO: 75523 - DNA, 8 bp, Unknown
  misc_feature (1)..( 8): Matrix.005 file - promoters50/5668818
aaaatatt

SEQ ID NO: 75524 - DNA, 9 bp, Unknown
  misc_feature (1)..( 9): Matrix.005 file - promoters50/5668818
aatttaaaa

SEQ ID NO: 75525 - DNA, 9 bp, Unknown
  misc_feature (1)..( 9): Matrix.005 file - promoters50/5668828
taccttttt

SEQ ID NO: 75526 - DNA, 8 bp, Unknown
  misc_feature (1)..( 8): Matrix.005 file - promoters50/5668828
gaatctat

SEQ ID NO: 75527 - DNA, 9 bp, Unknown
  misc_feature (1)..( 9): Matrix.005 file - promoters50/5668828
tcttgaatc

SEQ ID NO: 75528 - DNA, 7 bp, Unknown
  misc_feature (1)..( 7): Matrix.005 file - promoters50/5668832
attttaa

SEQ ID NO: 75529 - DNA, 8 bp, Unknown
  misc_feature (1)..( 8): Matrix.005 file - promoters50/5668832
ttttactt

SEQ ID NO: 75530 - DNA, 10 bp, Unknown
  misc_feature (1)..( 10): Matrix.005 file - promoters50/5668832
atttagacca

SEQ ID NO: 75531 - DNA, 10 bp, Unknown
  misc_feature (1)..( 10): Matrix.005 file - promoters50/5668832
ttcgtttttc

SEQ ID NO: 75532 - DNA, 12 bp, Unknown
  misc_feature (1)..( 12): Matrix.005 file - promoters50/5668832
attagatttttt

SEQ ID NO: 75533 - DNA, 12 bp, Unknown
  misc_feature (1)..( 12): Matrix.005 file - promoters50/5668832
taaaaatcaata

SEQ ID NO: 75534 - DNA, 6 bp, Unknown
  misc_feature (1)..( 6): Matrix.005 file - promoters50/5668832
attaga

SEQ ID NO: 75535 - DNA, 9 bp, Unknown
  misc_feature (1)..( 9): Matrix.005 file - promoters50/5668832
ttaaaaaaa

SEQ ID NO: 75536 - DNA, 9 bp, Unknown
  misc_feature (1)..( 9): Matrix.005 file - promoters50/5668832
tttcaaact

SEQ ID NO: 75537 - DNA, 7 bp, Unknown
  misc_feature (1)..( 7): Matrix.005 file - promoters50/5668832
aaaacaa

SEQ ID NO: 75538 - DNA, 8 bp, Unknown
  misc_feature (1)..( 8): Matrix.005 file - promoters50/5668832
tcattttg

SEQ ID NO: 75539 - DNA, 9 bp, Unknown
  misc_feature (1)..( 9): Matrix.005 file - promoters50/5668836
aaatttaag

SEQ ID NO: 75540 - DNA, 7 bp, Unknown
  misc_feature (1)..( 7): Matrix.005 file - promoters50/5668836
attttat

SEQ ID NO: 75541 - DNA, 9 bp, Unknown
  misc_feature (1)..( 9): Matrix.005 file - promoters50/5668836
aaaattaaa

SEQ ID NO: 75542 - DNA, 7 bp, Unknown
  misc_feature (1)..( 7): Matrix.005 file - promoters50/5668836
aaattaa

SEQ ID NO: 75543 - DNA, 9 bp, Unknown
  misc_feature (1)..( 9): Matrix.005 file - promoters50/5668836
aagtaacca

SEQ ID NO: 75544 - DNA, 8 bp, Unknown
  misc_feature (1)..( 8): Matrix.005 file - promoters50/5668836
taaaataa

SEQ ID NO: 75545 - DNA, 12 bp, Unknown
  misc_feature (1)..( 12): Matrix.005 file - promoters50/5668836
aaacatattaca

SEQ ID NO: 75546 - DNA, 11 bp, Unknown
  misc_feature (1)..( 11): Matrix.005 file - promoters50/5668836
taataatttaa

SEQ ID NO: 75547 - DNA, 9 bp, Unknown
  misc_feature (1)..( 9): Matrix.005 file - promoters50/5668852
aataaaatg

SEQ ID NO: 75548 - DNA, 14 bp, Unknown
  misc_feature (1)..( 14): Matrix.005 file - promoters50/5668852
aataaaggaaaaat

SEQ ID NO: 75549 - DNA, 8 bp, Unknown
  misc_feature (1)..( 8): Matrix.005 file - promoters50/5668860
catcgatt

SEQ ID NO: 75550 - DNA, 7 bp, Unknown
  misc_feature (1)..( 7): Matrix.005 file - promoters50/5668860
ctaaatt

SEQ ID NO: 75551 - DNA, 6 bp, Unknown
  misc_feature (1)..( 6): Matrix.005 file - promoters50/5668860
aaaaaa

SEQ ID NO: 75552 - DNA, 8 bp, Unknown
  misc_feature (1)..( 8): Matrix.005 file - promoters50/5668872
ttttagtc

SEQ ID NO: 75553 - DNA, 9 bp, Unknown
  misc_feature (1)..( 9): Matrix.005 file - promoters50/5668872
ctaagaaat

SEQ ID NO: 75554 - DNA, 13 bp, Unknown
  misc_feature (1)..( 13): Matrix.005 file - promoters50/5668882
accataagaaata

SEQ ID NO: 75555 - DNA, 10 bp, Unknown
  misc_feature (1)..( 10): Matrix.005 file - promoters50/5668882
tattttttct

SEQ ID NO: 75556 - DNA, 10 bp, Unknown
  misc_feature (1)..( 10): Matrix.005 file - promoters50/5668893
aatcttttat

SEQ ID NO: 75557 - DNA, 8 bp, Unknown
  misc_feature (1)..( 8): Matrix.005 file - promoters50/5668893
tcttttct

SEQ ID NO: 75558 - DNA, 12 bp, Unknown
  misc_feature (1)..( 12): Matrix.005 file - promoters50/5668903
tttgttgatttt

SEQ ID NO: 75559 - DNA, 8 bp, Unknown
  misc_feature (1)..( 8): Matrix.005 file - promoters50/5668903
agaatttg

SEQ ID NO: 75560 - DNA, 11 bp, Unknown
  misc_feature (1)..( 11): Matrix.005 file - promoters50/5668903
ttttattagtc

SEQ ID NO: 75561 - DNA, 11 bp, Unknown
  misc_feature (1)..( 11): Matrix.005 file - promoters50/5668903
tttgtatgatt

SEQ ID NO: 75562 - DNA, 7 bp, Unknown
  misc_feature (1)..( 7): Matrix.005 file - promoters50/5668919
taaattg

SEQ ID NO: 75563 - DNA, 7 bp, Unknown
  misc_feature (1)..( 7): Matrix.005 file - promoters50/5668930
cgagaaa

SEQ ID NO: 75564 - DNA, 10 bp, Unknown
  misc_feature (1)..( 10): Matrix.005 file - promoters50/5668930
taaattttct

SEQ ID NO: 75565 - DNA, 8 bp, Unknown
  misc_feature (1)..( 8): Matrix.005 file - promoters50/5668930
cagatcaa

SEQ ID NO: 75566 - DNA, 9 bp, Unknown
  misc_feature (1)..( 9): Matrix.005 file - promoters50/5668930
ctatctcac

SEQ ID NO: 75567 - DNA, 7 bp, Unknown
  misc_feature (1)..( 7): Matrix.005 file - promoters50/5668930
aaccaat

SEQ ID NO: 75568 - DNA, 8 bp, Unknown
  misc_feature (1)..( 8): Matrix.005 file - promoters50/5668951
attcaatt

SEQ ID NO: 75569 - DNA, 8 bp, Unknown
  misc_feature (1)..( 8): Matrix.005 file - promoters50/5668951
caaaacaa

SEQ ID NO: 75570 - DNA, 7 bp, Unknown
  misc_feature (1)..( 7): Matrix.005 file - promoters50/5668951
cttatct

SEQ ID NO: 75571 - DNA, 9 bp, Unknown
  misc_feature (1)..( 9): Matrix.005 file - promoters50/5668974
caaattaaa

SEQ ID NO: 75572 - DNA, 9 bp, Unknown
  misc_feature (1)..( 9): Matrix.005 file - promoters50/5669002
cataaaacc

SEQ ID NO: 75573 - DNA, 11 bp, Unknown
  misc_feature (1)..( 11): Matrix.005 file - promoters50/5669013
taaatatcttt

SEQ ID NO: 75574 - DNA, 11 bp, Unknown
  misc_feature (1)..( 11): Matrix.005 file - promoters50/5669025
aagttatgtta

SEQ ID NO: 75575 - DNA, 15 bp, Unknown
  misc_feature (1)..( 15): Matrix.005 file - promoters50/5669025
cgttttttagaataa

SEQ ID NO: 75576 - DNA, 7 bp, Unknown
  misc_feature (1)..( 7): Matrix.005 file - promoters50/5669236
gaaaaat

SEQ ID NO: 75577 - DNA, 9 bp, Unknown
  misc_feature (1)..( 9): Matrix.005 file - promoters50/5669236
aattttaaa

SEQ ID NO: 75578 - DNA, 8 bp, Unknown
  misc_feature (1)..( 8): Matrix.005 file - promoters50/5669243
taacttgt

SEQ ID NO: 75579 - DNA, 8 bp, Unknown
  misc_feature (1)..( 8): Matrix.005 file - promoters50/5669243
gcaagagt

SEQ ID NO: 75580 - DNA, 13 bp, Unknown
  misc_feature (1)..( 13): Matrix.005 file - promoters50/5669243
tttgcaaatgaaa

SEQ ID NO: 75581 - DNA, 9 bp, Unknown
  misc_feature (1)..( 9): Matrix.005 file - promoters50/5669243
aatgaaaat

SEQ ID NO: 75582 - DNA, 11 bp, Unknown
  misc_feature (1)..( 11): Matrix.005 file - promoters50/5669243
aatatatgttc

SEQ ID NO: 75583 - DNA, 8 bp, Unknown
  misc_feature (1)..( 8): Matrix.005 file - promoters50/5669243
ggtgttgt

SEQ ID NO: 75584 - DNA, 10 bp, Unknown
  misc_feature (1)..( 10): Matrix.005 file - promoters50/5669243
tgtaatcggg

SEQ ID NO: 75585 - DNA, 8 bp, Unknown
  misc_feature (1)..( 8): Matrix.005 file - promoters50/5669250
gaaaaaaa

SEQ ID NO: 75586 - DNA, 13 bp, Unknown
  misc_feature (1)..( 13): Matrix.005 file - promoters50/5669250
aaatcaaattata

SEQ ID NO: 75587 - DNA, 10 bp, Unknown
  misc_feature (1)..( 10): Matrix.005 file - promoters50/5669508
aatcaaaaat

SEQ ID NO: 75588 - DNA, 9 bp, Unknown
  misc_feature (1)..( 9): Matrix.005 file - promoters50/5669546
tgatatctc

SEQ ID NO: 75589 - DNA, 8 bp, Unknown
  misc_feature (1)..( 8): Matrix.005 file - promoters50/5669546
cgacatgt

SEQ ID NO: 75590 - DNA, 8 bp, Unknown
  misc_feature (1)..( 8): Matrix.005 file - promoters50/5669724
ttaatgtt

SEQ ID NO: 75591 - DNA, 8 bp, Unknown
  misc_feature (1)..( 8): Matrix.005 file - promoters50/5669838
ttatttca

SEQ ID NO: 75592 - DNA, 7 bp, Unknown
  misc_feature (1)..( 7): Matrix.005 file - promoters50/5669838
tttttct

SEQ ID NO: 75593 - DNA, 8 bp, Unknown
  misc_feature (1)..( 8): Matrix.005 file - promoters50/5670300
ttcttgcc

SEQ ID NO: 75594 - DNA, 31 bp, Unknown; identical to SEQ ID NO: 72331
  misc_feature (1)..( 31): Matrix.005 file - promoters50/5670300

SEQ ID NO: 75595 - DNA, 30 bp, Unknown; identical to SEQ ID NO: 71939
  misc_feature (1)..( 30): Matrix.005 file - promoters50/5670300

SEQ ID NO: 75596 - DNA, 15 bp, Unknown
  misc_feature (1)..( 15): Matrix.005 file - promoters50/5670300
cgccttagctttctc

SEQ ID NO: 75597 - DNA, 22 bp, Unknown
  misc_feature (1)..( 22): Matrix.005 file - promoters50/5670300
gaccgagtcgtcctcgtctttt

SEQ ID NO: 75598 - DNA, 19 bp, Unknown
  misc_feature (1)..( 19): Matrix.005 file - promoters50/5670300
ttcttcttctataaaacaa

SEQ ID NO: 75599 - DNA, 9 bp, Unknown
  misc_feature (1)..( 9): Matrix.005 file - promoters50/5670300
caaaaaaac

SEQ ID NO: 75600 - DNA, 6 bp, Unknown
  misc_feature (1)..( 6): Matrix.005 file - promoters50/5670300
aaaaca

SEQ ID NO: 75601 - DNA, 7 bp, Unknown
  misc_feature (1)..( 7): Matrix.005 file - promoters50/5670546
tgttcaa

SEQ ID NO: 75602 - DNA, 8 bp, Unknown
  misc_feature (1)..( 8): Matrix.005 file - promoters50/5670553
atgaacaa

SEQ ID NO: 75603 - DNA, 10 bp, Unknown
  misc_feature (1)..( 10): Matrix.005 file - promoters50/5670553
aaaaacccca

SEQ ID NO: 75604 - DNA, 11 bp, Unknown
  misc_feature (1)..( 11): Matrix.005 file - promoters50/5670592
aatacaaacat

SEQ ID NO: 75605 - DNA, 8 bp, Unknown
  misc_feature (1)..( 8): Matrix.005 file - promoters50/5670680
ataagata

SEQ ID NO: 75606 - DNA, 8 bp, Unknown
  misc_feature (1)..( 8): Matrix.005 file - promoters50/5670784
atttattt

SEQ ID NO: 75607 - DNA, 7 bp, Unknown
  misc_feature (1)..( 7): Matrix.005 file - promoters50/5670784
tgaaagt

SEQ ID NO: 75608 - DNA, 8 bp, Unknown
  misc_feature (1)..( 8): Matrix.005 file - promoters50/5670784
tttgaaaa

SEQ ID NO: 75609 - DNA, 8 bp, Unknown
  misc_feature (1)..( 8): Matrix.005 file - promoters50/5671204
tatcaaaa

SEQ ID NO: 75610 - DNA, 9 bp, Unknown
  misc_feature (1)..( 9): Matrix.005 file - promoters50/5671262
taaaccttg

SEQ ID NO: 75611 - DNA, 12 bp, Unknown
  misc_feature (1)..( 12): Matrix.005 file - promoters50/5671318
atacgtattatt

SEQ ID NO: 75612 - DNA, 8 bp, Unknown
  misc_feature (1)..( 8): Matrix.005 file - promoters50/5671318
ctacgtat

SEQ ID NO: 75613 - DNA, 7 bp, Unknown
  misc_feature (1)..( 7): Matrix.005 file - promoters50/5671338
attttgg

SEQ ID NO: 75614 - DNA, 10 bp, Unknown
  misc_feature (1)..( 10): Matrix.005 file - promoters50/5671338
gtaaatgtaa

SEQ ID NO: 75615 - DNA, 7 bp, Unknown
  misc_feature (1)..( 7): Matrix.005 file - promoters50/5671338
gttaaaa

SEQ ID NO: 75616 - DNA, 9 bp, Unknown
  misc_feature (1)..( 9): Matrix.005 file - promoters50/5671338
tgaaatttt

SEQ ID NO: 75617 - DNA, 10 bp, Unknown
  misc_feature (1)..( 10): Matrix.005 file - promoters50/5671338
tttaatgaat

SEQ ID NO: 75618 - DNA, 10 bp, Unknown
  misc_feature (1)..( 10): Matrix.005 file - promoters50/5671338
tttgattttt

SEQ ID NO: 75619 - DNA, 9 bp, Unknown
  misc_feature (1)..( 9): Matrix.005 file - promoters50/5671338
aataattct

SEQ ID NO: 75620 - DNA, 8 bp, Unknown
  misc_feature (1)..( 8): Matrix.005 file - promoters50/5671338
caaaatta

SEQ ID NO: 75621 - DNA, 8 bp, Unknown
  misc_feature (1)..( 8): Matrix.005 file - promoters50/5671710
gattcttt

SEQ ID NO: 75622 - DNA, 7 bp, Unknown
  misc_feature (1)..( 7): Matrix.005 file - promoters50/5671840
tatgtct

SEQ ID NO: 75623 - DNA, 7 bp, Unknown
  misc_feature (1)..( 7): Matrix.005 file - promoters50/5671840
aattaaa

SEQ ID NO: 75624 - DNA, 9 bp, Unknown
  misc_feature (1)..( 9): Matrix.005 file - promoters50/5671840
tgtttttgt

SEQ ID NO: 75625 - DNA, 8 bp, Unknown
  misc_feature (1)..( 8): Matrix.005 file - promoters50/5671852
ttcttgcc

SEQ ID NO: 75626 - DNA, 9 bp, Unknown
  misc_feature (1)..( 9): Matrix.005 file - promoters50/5671955
taattttac

SEQ ID NO: 75627 - DNA, 10 bp, Unknown
  misc_feature (1)..( 10): Matrix.005 file - promoters50/5671955
caattaaaaa

SEQ ID NO: 75628 - DNA, 11 bp, Unknown
  misc_feature (1)..( 11): Matrix.005 file - promoters50/5672281
gttttaaaagt

SEQ ID NO: 75629 - DNA, 6 bp, Unknown
  misc_feature (1)..( 6): Matrix.005 file - promoters50/5672661
catctc

SEQ ID NO: 75630 - DNA, 7 bp, Unknown
  misc_feature (1)..( 7): Matrix.005 file - promoters50/5672792
aatgtcg

SEQ ID NO: 75631 - DNA, 10 bp, Unknown
  misc_feature (1)..( 10): Matrix.005 file - promoters50/5672792
tgtattttgt

SEQ ID NO: 75632 - DNA, 12 bp, Unknown
  misc_feature (1)..( 12): Matrix.005 file - promoters50/5672792
ttatatctgtat

SEQ ID NO: 75633 - DNA, 11 bp, Unknown
  misc_feature (1)..( 11): Matrix.005 file - promoters50/5672792
atgtatttgtc

SEQ ID NO: 75634 - DNA, 12 bp, Unknown
  misc_feature (1)..( 12): Matrix.005 file - promoters50/5672842
aggcccaataaa

SEQ ID NO: 75635 - DNA, 12 bp, Unknown
  misc_feature (1)..( 12): Matrix.005 file - promoters50/5672842
taaaagaaataa

SEQ ID NO: 75636 - DNA, 10 bp, Unknown
  misc_feature (1)..( 10): Matrix.005 file - promoters50/5672842
taatttgtct

SEQ ID NO: 75637 - DNA, 11 bp, Unknown
  misc_feature (1)..( 11): Matrix.005 file - promoters50/5672842
aaaataaataa

SEQ ID NO: 75638 - DNA, 9 bp, Unknown
  misc_feature (1)..( 9): Matrix.005 file - promoters50/5672842
tacaaaaaa

SEQ ID NO: 75639 - DNA, 10 bp, Unknown
  misc_feature (1)..( 10): Matrix.005 file - promoters50/5672842
acaagaaaaa

SEQ ID NO: 75640 - DNA, 8 bp, Unknown
  misc_feature (1)..( 8): Matrix.005 file - promoters50/5672872
attagaat

SEQ ID NO: 75641 - DNA, 11 bp, Unknown
  misc_feature (1)..( 11): Matrix.005 file - promoters50/5672872
agactcatctc

SEQ ID NO: 75642 - DNA, 10 bp, Unknown
  misc_feature (1)..( 10): Matrix.005 file - promoters50/5672872
ttttattata

SEQ ID NO: 75643 - DNA, 17 bp, Unknown
  misc_feature (1)..( 17): Matrix.005 file - promoters50/5672872
ttttattttagatattt

SEQ ID NO: 75644 - DNA, 9 bp, Unknown
  misc_feature (1)..( 9): Matrix.005 file - promoters50/5672872
acgcataga

SEQ ID NO: 75645 - DNA, 8 bp, Unknown
  misc_feature (1)..( 8): Matrix.005 file - promoters50/5672872
taaattat

SEQ ID NO: 75646 - DNA, 13 bp, Unknown
  misc_feature (1)..( 13): Matrix.005 file - promoters50/5672872
gccgtattaattt

SEQ ID NO: 75647 - DNA, 7 bp, Unknown
  misc_feature (1)..( 7): Matrix.005 file - promoters50/5673089
tttatta

SEQ ID NO: 75648 - DNA, 9 bp, Unknown
  misc_feature (1)..( 9): Matrix.005 file - promoters50/5673089
ccgcacaaa

SEQ ID NO: 75649 - DNA, 11 bp, Unknown
  misc_feature (1)..( 11): Matrix.005 file - promoters50/5673089
tatgattatta

SEQ ID NO: 75650 - DNA, 9 bp, Unknown
  misc_feature (1)..( 9): Matrix.005 file - promoters50/5673348
aatgttatt

SEQ ID NO: 75651 - DNA, 8 bp, Unknown
  misc_feature (1)..( 8): Matrix.005 file - promoters50/5673348
aaatattt

SEQ ID NO: 75652 - DNA, 9 bp, Unknown
  misc_feature (1)..( 9): Matrix.005 file - promoters50/5673348
taaatcaac

SEQ ID NO: 75653 - DNA, 9 bp, Unknown
  misc_feature (1)..( 9): Matrix.005 file - promoters50/5673348
ctatagtat

SEQ ID NO: 75654 - DNA, 9 bp, Unknown
  misc_feature (1)..( 9): Matrix.005 file - promoters50/5673348
caaaacaat

SEQ ID NO: 75655 - DNA, 8 bp, Unknown
  misc_feature (1)..( 8): Matrix.005 file - promoters50/5673348
tttctata

SEQ ID NO: 75656 - DNA, 11 bp, Unknown
  misc_feature (1)..( 11): Matrix.005 file - promoters50/5673514
ataaattaata

SEQ ID NO: 75657 - DNA, 6 bp, Unknown
  misc_feature (1)..( 6): Matrix.005 file - promoters50/5673650
aaaatt

SEQ ID NO: 75658 - DNA, 10 bp, Unknown
  misc_feature (1)..( 10): Matrix.005 file - promoters50/5673674
aacaaacaaa

SEQ ID NO: 75659 - DNA, 10 bp, Unknown
  misc_feature (1)..( 10): Matrix.005 file - promoters50/5673674
ttcaaagaaa

SEQ ID NO: 75660 - DNA, 10 bp, Unknown
  misc_feature (1)..( 10): Matrix.005 file - promoters50/5673674
agaaaaaaaa

SEQ ID NO: 75661 - DNA, 10 bp, Unknown
  misc_feature (1)..( 10): Matrix.005 file - promoters50/5673773
acataaactt

SEQ ID NO: 75662 - DNA, 11 bp, Unknown
  misc_feature (1)..( 11): Matrix.005 file - promoters50/5673796
ttggttagaat

SEQ ID NO: 75663 - DNA, 8 bp, Unknown
  misc_feature (1)..( 8): Matrix.005 file - promoters50/5673796
ttttattt

SEQ ID NO: 75664 - DNA, 7 bp, Unknown
  misc_feature (1)..( 7): Matrix.005 file - promoters50/5674194
aataaaa

SEQ ID NO: 75665 - DNA, 14 bp, Unknown
  misc_feature (1)..( 14): Matrix.005 file - promoters50/5674194
aatcatgaaaggtt

SEQ ID NO: 75666 - DNA, 12 bp, Unknown
  misc_feature (1)..( 12): Matrix.005 file - promoters50/5674530
ataaccaaataa

SEQ ID NO: 75667 - DNA, 9 bp, Unknown
  misc_feature (1)..( 9): Matrix.005 file - promoters50/5674530
agaacaaac

SEQ ID NO: 75668 - DNA, 9 bp, Unknown
  misc_feature (1)..( 9): Matrix.005 file - promoters50/5674626
aaataaatt

SEQ ID NO: 75669 - DNA, 8 bp, Unknown
  misc_feature (1)..( 8): Matrix.005 file - promoters50/5674634
aaaatgtg

SEQ ID NO: 75670 - DNA, 10 bp, Unknown
  misc_feature (1)..( 10): Matrix.005 file - promoters50/5674634
ataaaatttg

SEQ ID NO: 75671 - DNA, 12 bp, Unknown
  misc_feature (1)..( 12): Matrix.005 file - promoters50/5674634
tttacatttatt

SEQ ID NO: 75672 - DNA, 15 bp, Unknown
  misc_feature (1)..( 15): Matrix.005 file - promoters50/5674634
tgatttcctgataaa

SEQ ID NO: 75673 - DNA, 10 bp, Unknown
  misc_feature (1)..( 10): Matrix.005 file - promoters50/5674666
aattaaaaga

SEQ ID NO: 75674 - DNA, 9 bp, Unknown
  misc_feature (1)..( 9): Matrix.005 file - promoters50/5674666
tctaccatt

SEQ ID NO: 75675 - DNA, 8 bp, Unknown
  misc_feature (1)..( 8): Matrix.005 file - promoters50/5674666
atataaat

SEQ ID NO: 75676 - DNA, 10 bp, Unknown
  misc_feature (1)..( 10): Matrix.005 file - promoters50/5675330
tttgtggtaa

SEQ ID NO: 75677 - DNA, 6 bp, Unknown
  misc_feature (1)..( 6): Matrix.005 file - promoters50/5675330
catgtt

SEQ ID NO: 75678 - DNA, 7 bp, Unknown
  misc_feature (1)..( 7): Matrix.005 file - promoters50/5675583
aaaaatt

SEQ ID NO: 75679 - DNA, 8 bp, Unknown
  misc_feature (1)..( 8): Matrix.005 file - promoters50/5675583
caataaac

SEQ ID NO: 75680 - DNA, 9 bp, Unknown
  misc_feature (1)..( 9): Matrix.005 file - promoters50/5675583
atgatttgg

SEQ ID NO: 75681 - DNA, 8 bp, Unknown
  misc_feature (1)..( 8): Matrix.005 file - promoters50/5675583
aaaactgc

SEQ ID NO: 75682 - DNA, 8 bp, Unknown
  misc_feature (1)..( 8): Matrix.005 file - promoters50/5675628
ttctttgt

SEQ ID NO: 75683 - DNA, 11 bp, Unknown
  misc_feature (1)..( 11): Matrix.005 file - promoters50/5675661
ttggatttaga

SEQ ID NO: 75684 - DNA, 9 bp, Unknown
  misc_feature (1)..( 9): Matrix.005 file - promoters50/5675661
agataaaag

SEQ ID NO: 75685 - DNA, 11 bp, Unknown
  misc_feature (1)..( 11): Matrix.005 file - promoters50/5676027
ctaatttcaaa

SEQ ID NO: 75686 - DNA, 11 bp, Unknown
  misc_feature (1)..( 11): Matrix.005 file - promoters50/5676027
aaacttaaatt

SEQ ID NO: 75687 - DNA, 9 bp, Unknown
  misc_feature (1)..( 9): Matrix.005 file - promoters50/5676160
attttgaat

SEQ ID NO: 75688 - DNA, 11 bp, Unknown
  misc_feature (1)..( 11): Matrix.005 file - promoters50/5676160
atgtgatataa

SEQ ID NO: 75689 - DNA, 17 bp, Unknown
  misc_feature (1)..( 17): Matrix.005 file - promoters50/5676160
taaagtaaatttttttt

SEQ ID NO: 75690 - DNA, 14 bp, Unknown
  misc_feature (1)..( 14): Matrix.005 file - promoters50/5676160
aaagtttataaaaa

SEQ ID NO: 75691 - DNA, 12 bp, Unknown
  misc_feature (1)..( 12): Matrix.005 file - promoters50/5676513
attattttattt

SEQ ID NO: 75692 - DNA, 8 bp, Unknown
  misc_feature (1)..( 8): Matrix.005 file - promoters50/5676513
tttgtttt

SEQ ID NO: 75693 - DNA, 11 bp, Unknown
  misc_feature (1)..( 11): Matrix.005 file - promoters50/5676647
gaattatcttt

SEQ ID NO: 75694 - DNA, 9 bp, Unknown
  misc_feature (1)..( 9): Matrix.005 file - promoters50/5676647
aaccaatta

SEQ ID NO: 75695 - DNA, 10 bp, Unknown
  misc_feature (1)..( 10): Matrix.005 file - promoters50/5676647
acaaaacaat

SEQ ID NO: 75696 - DNA, 7 bp, Unknown
  misc_feature (1)..( 7): Matrix.005 file - promoters50/5677230
ttttgaa

SEQ ID NO: 75697 - DNA, 11 bp, Unknown
  misc_feature (1)..( 11): Matrix.005 file - promoters50/5677230
aaaataaatta

SEQ ID NO: 75698 - DNA, 6 bp, Unknown
  misc_feature (1)..( 6): Matrix.005 file - promoters50/5677230
tgtgga

SEQ ID NO: 75699 - DNA, 6 bp, Unknown
  misc_feature (1)..( 6): Matrix.005 file - promoters50/5677230
gacatt

SEQ ID NO: 75700 - DNA, 7 bp, Unknown
  misc_feature (1)..( 7): Matrix.005 file - promoters50/5677230
aagtaaa

SEQ ID NO: 75701 - DNA, 6 bp, Unknown
  misc_feature (1)..( 6): Matrix.005 file - promoters50/5677230
tttgga

SEQ ID NO: 75702 - DNA, 8 bp, Unknown
  misc_feature (1)..( 8): Matrix.005 file - promoters50/5677230
atttgcag

SEQ ID NO: 75703 - DNA, 10 bp, Unknown
  misc_feature (1)..( 10): Matrix.005 file - promoters50/5677230
ggaaatgaaa

SEQ ID NO: 75704 - DNA, 11 bp, Unknown
  misc_feature (1)..( 11): Matrix.005 file - promoters50/5677240
taagttgttgt

SEQ ID NO: 75705 - DNA, 9 bp, Unknown
  misc_feature (1)..( 9): Matrix.005 file - promoters50/5677240
cttcatcta

SEQ ID NO: 75706 - DNA, 11 bp, Unknown
  misc_feature (1)..( 11): Matrix.005 file - promoters50/5677240
atataagtttt

SEQ ID NO: 75707 - DNA, 9 bp, Unknown
  misc_feature (1)..( 9): Matrix.005 file - promoters50/5677240
ttattacta

SEQ ID NO: 75708 - DNA, 6 bp, Unknown
  misc_feature (1)..( 6): Matrix.005 file - promoters50/5677240
agatat

SEQ ID NO: 75709 - DNA, 7 bp, Unknown
  misc_feature (1)..( 7): Matrix.005 file - promoters50/5677240
aaaaata

SEQ ID NO: 75710 - DNA, 10 bp, Unknown
  misc_feature (1)..( 10): Matrix.005 file - promoters50/5677274
acatttataa

SEQ ID NO: 75711 - DNA, 13 bp, Unknown
  misc_feature (1)..( 13): Matrix.005 file - promoters50/5677274
tttaaaatatgaa

SEQ ID NO: 75712 - DNA, 9 bp, Unknown
  misc_feature (1)..( 9): Matrix.005 file - promoters50/5677286
ggagaaaaa

SEQ ID NO: 75713 - DNA, 10 bp, Unknown
  misc_feature (1)..( 10): Matrix.005 file - promoters50/5677286
tttctaaaaa

SEQ ID NO: 75714 - DNA, 14 bp, Unknown
  misc_feature (1)..( 14): Matrix.005 file - promoters50/5677298
tattgatttggtac

SEQ ID NO: 75715 - DNA, 11 bp, Unknown
  misc_feature (1)..( 11): Matrix.005 file - promoters50/5677333
gttggttctcg

SEQ ID NO: 75716 - DNA, 13 bp, Unknown
  misc_feature (1)..( 13): Matrix.005 file - promoters50/5677344
caaaaataaaaca

SEQ ID NO: 75717 - DNA, 8 bp, Unknown
  misc_feature (1)..( 8): Matrix.005 file - promoters50/5677360
acttttaa

SEQ ID NO: 75718 - DNA, 8 bp, Unknown
  misc_feature (1)..( 8): Matrix.005 file - promoters50/5677360
aacatata

SEQ ID NO: 75719 - DNA, 9 bp, Unknown
  misc_feature (1)..( 9): Matrix.005 file - promoters50/5677360
aatatatca

SEQ ID NO: 75720 - DNA, 10 bp, Unknown
  misc_feature (1)..( 10): Matrix.005 file - promoters50/5677360
aaagtataaa

SEQ ID NO: 75721 - DNA, 8 bp, Unknown
  misc_feature (1)..( 8): Matrix.005 file - promoters50/5677360
atacatca

SEQ ID NO: 75722 - DNA, 8 bp, Unknown
  misc_feature (1)..( 8): Matrix.005 file - promoters50/5677360
aaagaaaa

SEQ ID NO: 75723 - DNA, 11 bp, Unknown
  misc_feature (1)..( 11): Matrix.005 file - promoters50/5677360
agagtttaaaa

SEQ ID NO: 75724 - DNA, 8 bp, Unknown
  misc_feature (1)..( 8): Matrix.005 file - promoters50/5677360
aatatata

SEQ ID NO: 75725 - DNA, 7 bp, Unknown
  misc_feature (1)..( 7): Matrix.005 file - promoters50/5677484
ttctttt

SEQ ID NO: 75726 - DNA, 8 bp, Unknown
  misc_feature (1)..( 8): Matrix.005 file - promoters50/5677501
atcagaaa

SEQ ID NO: 75727 - DNA, 11 bp, Unknown
  misc_feature (1)..( 11): Matrix.005 file - promoters50/5680986
attctacatta

SEQ ID NO: 75728 - DNA, 16 bp, Unknown
  misc_feature (1)..( 16): Matrix.005 file - promoters50/5681002
aaaaagttgattaaat

SEQ ID NO: 75729 - DNA, 10 bp, Unknown
  misc_feature (1)..( 10): Matrix.005 file - promoters50/5681002
tatttaaata

SEQ ID NO: 75730 - DNA, 10 bp, Unknown
  misc_feature (1)..( 10): Matrix.005 file - promoters50/5681002
taaaattaat

SEQ ID NO: 75731 - DNA, 7 bp, Unknown
  misc_feature (1)..( 7): Matrix.005 file - promoters50/5681002
gtattgt

SEQ ID NO: 75732 - DNA, 10 bp, Unknown
  misc_feature (1)..( 10): Matrix.005 file - promoters50/5681157
accttaaaaa

SEQ ID NO: 75733 - DNA, 6 bp, Unknown
  misc_feature (1)..( 6): Matrix.005 file - promoters50/5681157
ttaaaa

SEQ ID NO: 75734 - DNA, 10 bp, Unknown
  misc_feature (1)..( 10): Matrix.005 file - promoters50/5681157
acaaaataaa

SEQ ID NO: 75735 - DNA, 11 bp, Unknown
  misc_feature (1)..( 11): Matrix.005 file - promoters50/5681157
ataaaccaaaa

SEQ ID NO: 75736 - DNA, 9 bp, Unknown
  misc_feature (1)..( 9): Matrix.005 file - promoters50/5681157
aaaataaac

SEQ ID NO: 75737 - DNA, 10 bp, Unknown
  misc_feature (1)..( 10): Matrix.005 file - promoters50/5681157
tttgtaatat

SEQ ID NO: 75738 - DNA, 9 bp, Unknown
  misc_feature (1)..( 9): Matrix.005 file - promoters50/5681157
atttaaaaa

SEQ ID NO: 75739 - DNA, 10 bp, Unknown
  misc_feature (1)..( 10): Matrix.005 file - promoters50/5681157
attagcaatg

SEQ ID NO: 75740 - DNA, 8 bp, Unknown
  misc_feature (1)..( 8): Matrix.005 file - promoters50/5753942
caatcaaa

SEQ ID NO: 75741 - DNA, 11 bp, Unknown
  misc_feature (1)..( 11): Matrix.005 file - promoters50/5753942
attttgttttt

SEQ ID NO: 75742 - DNA, 10 bp, Unknown
  misc_feature (1)..( 10): Matrix.005 file - promoters50/5753942
aataataaat

SEQ ID NO: 75743 - DNA, 9 bp, Unknown
  misc_feature (1)..( 9): Matrix.005 file - promoters50/5753942
tacattgtt

SEQ ID NO: 75744 - DNA, 11 bp, Unknown
  misc_feature (1)..( 11): Matrix.005 file - promoters50/5753942
gaatttgggcc

SEQ ID NO: 75745 - DNA, 11 bp, Unknown
  misc_feature (1)..( 11): Matrix.005 file - promoters50/5754265
gatttttgttt

SEQ ID NO: 75746 - DNA, 8 bp, Unknown
  misc_feature (1)..( 8): Matrix.005 file - promoters50/5754269
tattatgg

SEQ ID NO: 75747 - DNA, 10 bp, Unknown
  misc_feature (1)..( 10): Matrix.005 file - promoters50/5754273
aaaaaaatta

SEQ ID NO: 75748 - DNA, 8 bp, Unknown
  misc_feature (1)..( 8): Matrix.005 file - promoters50/5754276
aaatcgat

SEQ ID NO: 75749 - DNA, 9 bp, Unknown
  misc_feature (1)..( 9): Matrix.005 file - promoters50/5754276
tctatttgt

SEQ ID NO: 75750 - DNA, 13 bp, Unknown
  misc_feature (1)..( 13): Matrix.005 file - promoters50/5754280
acaaaagatatga

SEQ ID NO: 75751 - DNA, 8 bp, Unknown
  misc_feature (1)..( 8): Matrix.005 file - promoters50/5754288
tacaaaaa

SEQ ID NO: 75752 - DNA, 10 bp, Unknown
  misc_feature (1)..( 10): Matrix.005 file - promoters50/5754288
ttattatata

SEQ ID NO: 75753 - DNA, 10 bp, Unknown
  misc_feature (1)..( 10): Matrix.005 file - promoters50/5754288
ttgaatgttt

SEQ ID NO: 75754 - DNA, 11 bp, Unknown
  misc_feature (1)..( 11): Matrix.005 file - promoters50/5754419
atataatgata

SEQ ID NO: 75755 - DNA, 14 bp, Unknown
  misc_feature (1)..( 14): Matrix.005 file - promoters50/5754419
aataaagaaaatta

SEQ ID NO: 75756 - DNA, 9 bp, Unknown
  misc_feature (1)..( 9): Matrix.005 file - promoters50/5754419
taataaaac

SEQ ID NO: 75757 - DNA, 8 bp, Unknown
  misc_feature (1)..( 8): Matrix.005 file - promoters50/5754419
taatatat

SEQ ID NO: 75758 - DNA, 14 bp, Unknown
  misc_feature (1)..( 14): Matrix.005 file - promoters50/5754423
ttatcttccaaata

SEQ ID NO: 75759 - DNA, 11 bp, Unknown
  misc_feature (1)..( 11): Matrix.005 file - promoters50/5754461
aataaattaat

SEQ ID NO: 75760 - DNA, 8 bp, Unknown
  misc_feature (1)..( 8): Matrix.005 file - promoters50/5754461
gtaataat

SEQ ID NO: 75761 - DNA, 13 bp, Unknown
  misc_feature (1)..( 13): Matrix.005 file - promoters50/5754461
caataatgtatat

SEQ ID NO: 75762 - DNA, 7 bp, Unknown
  misc_feature (1)..( 7): Matrix.005 file - promoters50/5755107
ggttttg

SEQ ID NO: 75763 - DNA, 7 bp, Unknown
  misc_feature (1)..( 7): Matrix.005 file - promoters50/5755107
gtgtttc

SEQ ID NO: 75764 - DNA, 11 bp, Unknown
  misc_feature (1)..( 11): Matrix.005 file - promoters50/5755107
acaattaagcc

SEQ ID NO: 75765 - DNA, 6 bp, Unknown
  misc_feature (1)..( 6): Matrix.005 file - promoters50/5755107
attgga

SEQ ID NO: 75766 - DNA, 7 bp, Unknown
  misc_feature (1)..( 7): Matrix.005 file - promoters50/5755107
aaacaat

SEQ ID NO: 75767 - DNA, 7 bp, Unknown
  misc_feature (1)..( 7): Matrix.005 file - promoters50/5755107
tttcata

SEQ ID NO: 75768 - DNA, 15 bp, Unknown
  misc_feature (1)..( 15): Matrix.005 file - promoters50/5755846
ctctaaaaacaaaat

SEQ ID NO: 75769 - DNA, 11 bp, Unknown
  misc_feature (1)..( 11): Matrix.005 file - promoters50/5755846
atttgatcaat

SEQ ID NO: 75770 - DNA, 7 bp, Unknown
  misc_feature (1)..( 7): Matrix.005 file - promoters50/5756166
tcttctt

SEQ ID NO: 75771 - DNA, 7 bp, Unknown
  misc_feature (1)..( 7): Matrix.005 file - promoters50/5756166
tttattt

SEQ ID NO: 75772 - DNA, 8 bp, Unknown
  misc_feature (1)..( 8): Matrix.005 file - promoters50/5756489
aaaatcta

SEQ ID NO: 75773 - DNA, 15 bp, Unknown
  misc_feature (1)..( 15): Matrix.005 file - promoters50/5756489
caaaatgaattattc

SEQ ID NO: 75774 - DNA, 9 bp, Unknown
  misc_feature (1)..( 9): Matrix.005 file - promoters50/5756489
actaataaa

SEQ ID NO: 75775 - DNA, 8 bp, Unknown
  misc_feature (1)..( 8): Matrix.005 file - promoters50/5756489
taatttac

SEQ ID NO: 75776 - DNA, 10 bp, Unknown
  misc_feature (1)..( 10): Matrix.005 file - promoters50/5756489
aaataataaa

SEQ ID NO: 75777 - DNA, 9 bp, Unknown
  misc_feature (1)..( 9): Matrix.005 file - promoters50/5756489
atatattct

SEQ ID NO: 75778 - DNA, 8 bp, Unknown
  misc_feature (1)..( 8): Matrix.005 file - promoters50/5756489
taatatta

SEQ ID NO: 75779 - DNA, 8 bp, Unknown
  misc_feature (1)..( 8): Matrix.005 file - promoters50/5756489
ctaacaaa

SEQ ID NO: 75780 - DNA, 9 bp, Unknown
  misc_feature (1)..( 9): Matrix.005 file - promoters50/5758021
ataacgata

SEQ ID NO: 75781 - DNA, 12 bp, Unknown
  misc_feature (1)..( 12): Matrix.005 file - promoters50/5759305
taaggcaaattt

SEQ ID NO: 75782 - DNA, 9 bp, Unknown
  misc_feature (1)..( 9): Matrix.005 file - promoters50/5759305
gcaatttta

SEQ ID NO: 75783 - DNA, 15 bp, Unknown
  misc_feature (1)..( 15): Matrix.005 file - promoters50/5773091
tagattcagactcgt

SEQ ID NO: 75784 - DNA, 8 bp, Unknown
  misc_feature (1)..( 8): Matrix.005 file - promoters50/5773091
attgatta

SEQ ID NO: 75785 - DNA, 10 bp, Unknown
  misc_feature (1)..( 10): Matrix.005 file - promoters50/5773091
taatttatta

SEQ ID NO: 75786 - DNA, 12 bp, Unknown
  misc_feature (1)..( 12): Matrix.005 file - promoters50/5773759
tttagcaataaa

SEQ ID NO: 75787 - DNA, 7 bp, Unknown
  misc_feature (1)..( 7): Matrix.005 file - promoters50/5773759
ttattta

SEQ ID NO: 75788 - DNA, 8 bp, Unknown
  misc_feature (1)..( 8): Matrix.005 file - promoters50/5773759
aatcgcat

SEQ ID NO: 75789 - DNA, 8 bp, Unknown
  misc_feature (1)..( 8): Matrix.005 file - promoters50/5773772
ttaaatta

SEQ ID NO: 75790 - DNA, 7 bp, Unknown
  misc_feature (1)..( 7): Matrix.005 file - promoters50/5773772
tttgatt

SEQ ID NO: 75791 - DNA, 9 bp, Unknown
  misc_feature (1)..( 9): Matrix.005 file - promoters50/5773772
attttttta

SEQ ID NO: 75792 - DNA, 11 bp, Unknown
  misc_feature (1)..( 11): Matrix.005 file - promoters50/5774459
ataaatcaatc

SEQ ID NO: 75793 - DNA, 8 bp, Unknown
  misc_feature (1)..( 8): Matrix.005 file - promoters50/5774459
tgcagtgg

SEQ ID NO: 75794 - DNA, 10 bp, Unknown
  misc_feature (1)..( 10): Matrix.005 file - promoters50/5774459
tgttttgtta

SEQ ID NO: 75795 - DNA, 7 bp, Unknown
  misc_feature (1)..( 7): Matrix.005 file - promoters50/5774545
ttaaata

SEQ ID NO: 75796 - DNA, 8 bp, Unknown
  misc_feature (1)..( 8): Matrix.005 file - promoters50/5774545
tttataaa

SEQ ID NO: 75797 - DNA, 8 bp, Unknown
  misc_feature (1)..( 8): Result.001 file - promoters75/1007152
ccttctct

SEQ ID NO: 75798 - DNA, 8 bp, Unknown
  misc_feature (1)..( 8): Result.001 file - promoters75/1007152
tcttctct

SEQ ID NO: 75799 - DNA, 9 bp, Unknown
  misc_feature (1)..( 9): Result.001 file - promoters75/1007152
tcttcttct

SEQ ID NO: 75800 - DNA, 9 bp, Unknown
  misc_feature (1)..( 9): Result.001 file - promoters75/1007152
attttgatt

SEQ ID NO: 75801 - DNA, 9 bp, Unknown
  misc_feature (1)..( 9): Result.001 file - promoters75/1007152
attttgatt

SEQ ID NO: 75802 - DNA, 9 bp, Unknown
  misc_feature (1)..( 9): Result.001 file - promoters75/1007273
gttttgact

SEQ ID NO: 75803 - DNA, 8 bp, Unknown
  misc_feature (1)..( 8): Result.001 file - promoters75/1007273
aaagaacc

SEQ ID NO: 75804 - DNA, 8 bp, Unknown
  misc_feature (1)..( 8): Result.001 file - promoters75/1007273
aaagaacg

SEQ ID NO: 75805 - DNA, 8 bp, Unknown
  misc_feature (1)..( 8): Result.001 file - promoters75/1007273
aaaaaacc

SEQ ID NO: 75806 - DNA, 7 bp, Unknown
  misc_feature (1)..( 7): Result.001 file - promoters75/1007273
cgattac

SEQ ID NO: 75807 - DNA, 7 bp, Unknown
  misc_feature (1)..( 7): Result.001 file - promoters75/1007273
agattac

SEQ ID NO: 75808 - DNA, 7 bp, Unknown
  misc_feature (1)..( 7): Result.001 file - promoters75/1007370
agattaa

SEQ ID NO: 75809 - DNA, 12 bp, Unknown
  misc_feature (1)..( 12): Result.001 file - promoters75/1007370
caacaatgtaca

SEQ ID NO: 75810 - DNA, 12 bp, Unknown
  misc_feature (1)..( 12): Result.001 file - promoters75/1007370
caataatttaca

SEQ ID NO: 75811 - DNA, 12 bp, Unknown
  misc_feature (1)..( 12): Result.001 file - promoters75/1007967
tgaaaatttata

SEQ ID NO: 75812 - DNA, 8 bp, Unknown
  misc_feature (1)..( 8): Result.001 file - promoters75/1007967
attcttaa

SEQ ID NO: 75813 - DNA, 8 bp, Unknown
  misc_feature (1)..( 8): Result.001 file - promoters75/1007967
attgttat

SEQ ID NO: 75814 - DNA, 8 bp, Unknown
  misc_feature (1)..( 8): Result.001 file - promoters75/1007967
gttcataa

SEQ ID NO: 75815 - DNA, 9 bp, Unknown
  misc_feature (1)..( 9): Result.001 file - promoters75/1007967
aatttcaac

SEQ ID NO: 75816 - DNA, 9 bp, Unknown
  misc_feature (1)..( 9): Result.001 file - promoters75/1007967
aatttgaac

SEQ ID NO: 75817 - DNA, 9 bp, Unknown
  misc_feature (1)..( 9): Result.001 file - promoters75/1008148
aatgtgaaa

SEQ ID NO: 75818 - DNA, 10 bp, Unknown
  misc_feature (1)..( 10): Result.001 file - promoters75/1008148
atatgttaat

SEQ ID NO: 75819 - DNA, 10 bp, Unknown
  misc_feature (1)..( 10): Result.001 file - promoters75/1008148
atatgtggta

SEQ ID NO: 75820 - DNA, 10 bp, Unknown
  misc_feature (1)..( 10): Result.001 file - promoters75/1008148
atatgataat

SEQ ID NO: 75821 - DNA, 10 bp, Unknown
  misc_feature (1)..( 10): Result.001 file - promoters75/1008218
atatgtgcaa

SEQ ID NO: 75822 - DNA, 8 bp, Unknown
  misc_feature (1)..( 8): Result.001 file - promoters75/1008218
atttattt

SEQ ID NO: 75823 - DNA, 8 bp, Unknown
  misc_feature (1)..( 8): Result.001 file - promoters75/1008218
atttattt

SEQ ID NO: 75824 - DNA, 8 bp, Unknown
  misc_feature (1)..( 8): Result.001 file - promoters75/1008218
atttatgt

SEQ ID NO: 75825 - DNA, 9 bp, Unknown
  misc_feature (1)..( 9): Result.001 file - promoters75/1008218
tatttgatt

SEQ ID NO: 75826 - DNA, 9 bp, Unknown
  misc_feature (1)..( 9): Result.001 file - promoters75/1008218
catttaatt

SEQ ID NO: 75827 - DNA, 9 bp, Unknown
  misc_feature (1)..( 9): Result.001 file - promoters75/1008218
catttatgt

SEQ ID NO: 75828 - DNA, 8 bp, Unknown
  misc_feature (1)..( 8): Result.001 file - promoters75/1008218
gtatagtt

SEQ ID NO: 75829 - DNA, 8 bp, Unknown
  misc_feature (1)..( 8): Result.001 file - promoters75/1008218
atatagtc

SEQ ID NO: 75830 - DNA, 8 bp, Unknown
  misc_feature (1)..( 8): Result.001 file - promoters75/1008218
gtatggtt

SEQ ID NO: 75831 - DNA, 10 bp, Unknown
  misc_feature (1)..( 10): Result.001 file - promoters75/1008218
ctttaatcaa

SEQ ID NO: 75832 - DNA, 10 bp, Unknown
  misc_feature (1)..( 10): Result.001 file - promoters75/1008218
aaacaatcaa

SEQ ID NO: 75833 - DNA, 10 bp, Unknown
  misc_feature (1)..( 10): Result.001 file - promoters75/1008218
cttaaatcat

SEQ ID NO: 75834 - DNA, 8 bp, Unknown
  misc_feature (1)..( 8): Result.001 file - promoters75/1008218
gagtatta

SEQ ID NO: 75835 - DNA, 8 bp, Unknown
  misc_feature (1)..( 8): Result.001 file - promoters75/1008218
tagtattt

SEQ ID NO: 75836 - DNA, 8 bp, Unknown
  misc_feature (1)..( 8): Result.001 file - promoters75/1008218
tagcattt

SEQ ID NO: 75837 - DNA, 10 bp, Unknown
  misc_feature (1)..( 10): Result.001 file - promoters75/1008218
atatttcttg

SEQ ID NO: 75838 - DNA, 10 bp, Unknown
  misc_feature (1)..( 10): Result.001 file - promoters75/1008218
ataattctcc

SEQ ID NO: 75839 - DNA, 10 bp, Unknown
  misc_feature (1)..( 10): Result.001 file - promoters75/1008443
gtttttcttg

SEQ ID NO: 75840 - DNA, 12 bp, Unknown
  misc_feature (1)..( 12): Result.001 file - promoters75/1008443
gataaatattca

SEQ ID NO: 75841 - DNA, 12 bp, Unknown
  misc_feature (1)..( 12): Result.001 file - promoters75/1008443
ataaaaaatttt

SEQ ID NO: 75842 - DNA, 12 bp, Unknown
  misc_feature (1)..( 12): Result.001 file - promoters75/1008443
atataaaatggt

SEQ ID NO: 75843 - DNA, 12 bp, Unknown
  misc_feature (1)..( 12): Result.001 file - promoters75/1008443
agaaaaaaaaaa

SEQ ID NO: 75844 - DNA, 12 bp, Unknown
  misc_feature (1)..( 12): Result.001 file - promoters75/1008443
attccaaatttt

SEQ ID NO: 75845 - DNA, 12 bp, Unknown
  misc_feature (1)..( 12): Result.001 file - promoters75/1008443
ccaaacaaaaca

SEQ ID NO: 75846 - DNA, 12 bp, Unknown
  misc_feature (1)..( 12): Result.001 file - promoters75/1008443
agaaacaaagta

SEQ ID NO: 75847 - DNA, 12 bp, Unknown
  misc_feature (1)..( 12): Result.001 file - promoters75/1008443
tcaaagaaattc

SEQ ID NO: 75848 - DNA, 12 bp, Unknown
  misc_feature (1)..( 12): Result.001 file - promoters75/1008443
agaaaaaaaaaa

SEQ ID NO: 75849 - DNA, 12 bp, Unknown
  misc_feature (1)..( 12): Result.001 file - promoters75/1008732
ataaaaaatttt

SEQ ID NO: 75850 - DNA, 9 bp, Unknown
  misc_feature (1)..( 9): Result.001 file - promoters75/1008732
agtaattta

SEQ ID NO: 75851 - DNA, 9 bp, Unknown
  misc_feature (1)..( 9): Result.001 file - promoters75/1008732
agtagtttc

SEQ ID NO: 75852 - DNA, 9 bp, Unknown
  misc_feature (1)..( 9): Result.001 file - promoters75/1008732
ttgagtttc

SEQ ID NO: 75853 - DNA, 9 bp, Unknown
  misc_feature (1)..( 9): Result.001 file - promoters75/1008732
aaattttaa

SEQ ID NO: 75854 - DNA, 9 bp, Unknown
  misc_feature (1)..( 9): Result.001 file - promoters75/1008732
aaatttgtt

SEQ ID NO: 75855 - DNA, 9 bp, Unknown
  misc_feature (1)..( 9): Result.001 file - promoters75/1008732
aaatatgtt

SEQ ID NO: 75856 - DNA, 8 bp, Unknown
  misc_feature (1)..( 8): Result.001 file - promoters75/1008732
acatattt

SEQ ID NO: 75857 - DNA, 8 bp, Unknown
  misc_feature (1)..( 8): Result.001 file - promoters75/1008732
acatatta

SEQ ID NO: 75858 - DNA, 8 bp, Unknown
  misc_feature (1)..( 8): Result.001 file - promoters75/1008732
tcatctta

SEQ ID NO: 75859 - DNA, 11 bp, Unknown
  misc_feature (1)..( 11): Result.001 file - promoters75/1008732
attttaatctc

SEQ ID NO: 75860 - DNA, 11 bp, Unknown
  misc_feature (1)..( 11): Result.001 file - promoters75/1008732
tttttattcta

SEQ ID NO: 75861 - DNA, 11 bp, Unknown
  misc_feature (1)..( 11): Result.001 file - promoters75/1008732
gttgtattcta

SEQ ID NO: 75862 - DNA, 11 bp, Unknown
  misc_feature (1)..( 11): Result.001 file - promoters75/1008732
tttttacggcg

SEQ ID NO: 75863 - DNA, 9 bp, Unknown
  misc_feature (1)..( 9): Result.001 file - promoters75/1008732
aatactttt

SEQ ID NO: 75864 - DNA, 9 bp, Unknown
  misc_feature (1)..( 9): Result.001 file - promoters75/1008732
aattctttt

SEQ ID NO: 75865 - DNA, 9 bp, Unknown
  misc_feature (1)..( 9): Result.001 file - promoters75/1008732
tttacttca

SEQ ID NO: 75866 - DNA, 9 bp, Unknown
  misc_feature (1)..( 9): Result.001 file - promoters75/1008732
atatatctt

SEQ ID NO: 75867 - DNA, 9 bp, Unknown
  misc_feature (1)..( 9): Result.001 file - promoters75/1008732
ataaatctt

SEQ ID NO: 75868 - DNA, 10 bp, Unknown
  misc_feature (1)..( 10): Result.001 file - promoters75/1008732
ttatcatatt

SEQ ID NO: 75869 - DNA, 8 bp, Unknown
  misc_feature (1)..( 8): Result.001 file - promoters75/1008732
atacatca

SEQ ID NO: 75870 - DNA, 8 bp, Unknown
  misc_feature (1)..( 8): Result.001 file - promoters75/1008732
ttacttca

SEQ ID NO: 75871 - DNA, 8 bp, Unknown
  misc_feature (1)..( 8): Result.001 file - promoters75/1008732
ttaattct

SEQ ID NO: 75872 - DNA, 8 bp, Unknown
  misc_feature (1)..( 8): Result.001 file - promoters75/1008732
ttattgaa

SEQ ID NO: 75873 - DNA, 8 bp, Unknown
  misc_feature (1)..( 8): Result.001 file - promoters75/1008732
atatagaa

SEQ ID NO: 75874 - DNA, 8 bp, Unknown
  misc_feature (1)..( 8): Result.001 file - promoters75/1008732
ctatgtag

SEQ ID NO: 75875 - DNA, 13 bp, Unknown
  misc_feature (1)..( 13): Result.001 file - promoters75/1008732
accttcctaaaaa

SEQ ID NO: 75876 - DNA, 13 bp, Unknown
  misc_feature (1)..( 13): Result.001 file - promoters75/1008732
aattaaataaaaa

SEQ ID NO: 75877 - DNA, 13 bp, Unknown
  misc_feature (1)..( 13): Result.001 file - promoters75/1008808
aaagaaataaatc

SEQ ID NO: 75878 - DNA, 7 bp, Unknown
  misc_feature (1)..( 7): Result.001 file - promoters75/1008808
cgaagaa

SEQ ID NO: 75879 - DNA, 7 bp, Unknown
  misc_feature (1)..( 7): Result.001 file - promoters75/1008808
cgatgaa

SEQ ID NO: 75880 - DNA, 7 bp, Unknown
  misc_feature (1)..( 7): Result.001 file - promoters75/1008808
agaagaa

SEQ ID NO: 75881 - DNA, 8 bp, Unknown
  misc_feature (1)..( 8): Result.001 file - promoters75/1008808
acttcctt

SEQ ID NO: 75882 - DNA, 8 bp, Unknown
  misc_feature (1)..( 8): Result.001 file - promoters75/1008808
gcttactt

SEQ ID NO: 75883 - DNA, 8 bp, Unknown
  misc_feature (1)..( 8): Result.001 file - promoters75/1008808
acttccgc

SEQ ID NO: 75884 - DNA, 7 bp, Unknown
  misc_feature (1)..( 7): Result.001 file - promoters75/1008808
ctttgaa

SEQ ID NO: 75885 - DNA, 7 bp, Unknown
  misc_feature (1)..( 7): Result.001 file - promoters75/1008808
gtttgaa

SEQ ID NO: 75886 - DNA, 7 bp, Unknown
  misc_feature (1)..( 7): Result.001 file - promoters75/1008808
gttagaa

SEQ ID NO: 75887 - DNA, 9 bp, Unknown
  misc_feature (1)..( 9): Result.001 file - promoters75/1008808
ctatggtta

SEQ ID NO: 75888 - DNA, 9 bp, Unknown
  misc_feature (1)..( 9): Result.001 file - promoters75/1008808
aaatgatta

SEQ ID NO: 75889 - DNA, 9 bp, Unknown
  misc_feature (1)..( 9): Result.001 file - promoters75/1008808
aaaggatta

SEQ ID NO: 75890 - DNA, 7 bp, Unknown
  misc_feature (1)..( 7): Result.001 file - promoters75/1008808
aatattg

SEQ ID NO: 75891 - DNA, 7 bp, Unknown
  misc_feature (1)..( 7): Result.001 file - promoters75/1008808
aatgttg

SEQ ID NO: 75892 - DNA, 7 bp, Unknown
  misc_feature (1)..( 7): Result.001 file - promoters75/1009030
aatattg

SEQ ID NO: 75893 - DNA, 10 bp, Unknown
  misc_feature (1)..( 10): Result.001 file - promoters75/1009030
tatattacgt

SEQ ID NO: 75894 - DNA, 10 bp, Unknown
  misc_feature (1)..( 10): Result.001 file - promoters75/1009030
tattttatta

SEQ ID NO: 75895 - DNA, 10 bp, Unknown
  misc_feature (1)..( 10): Result.001 file - promoters75/1009030
gatttgattt

SEQ ID NO: 75896 - DNA, 10 bp, Unknown
  misc_feature (1)..( 10): Result.001 file - promoters75/1009030
tgtttgatta

SEQ ID NO: 75897 - DNA, 10 bp, Unknown
  misc_feature (1)..( 10): Result.001 file - promoters75/1009211
ctgatgattt

SEQ ID NO: 75898 - DNA, 8 bp, Unknown
  misc_feature (1)..( 8): Result.001 file - promoters75/1009211
ttcgttac

SEQ ID NO: 75899 - DNA, 8 bp, Unknown
  misc_feature (1)..( 8): Result.001 file - promoters75/1009211
ttcattac

SEQ ID NO: 75900 - DNA, 8 bp, Unknown
  misc_feature (1)..( 8): Result.001 file - promoters75/1009941
ctcattat

SEQ ID NO: 75901 - DNA, 8 bp, Unknown
  misc_feature (1)..( 8): Result.001 file - promoters75/1009941
gttttaaa

SEQ ID NO: 75902 - DNA, 8 bp, Unknown
  misc_feature (1)..( 8): Result.001 file - promoters75/1009941
ttttgaaa

SEQ ID NO: 75903 - DNA, 8 bp, Unknown
  misc_feature (1)..( 8): Result.001 file - promoters75/1009941
ttttgagc

SEQ ID NO: 75904 - DNA, 7 bp, Unknown
  misc_feature (1)..( 7): Result.001 file - promoters75/1009941
cctaaat

SEQ ID NO: 75905 - DNA, 7 bp, Unknown
  misc_feature (1)..( 7): Result.001 file - promoters75/1009941
cctaaag

SEQ ID NO: 75906 - DNA, 7 bp, Unknown
  misc_feature (1)..( 7): Result.001 file - promoters75/1009941
ccttaat

SEQ ID NO: 75907 - DNA, 8 bp, Unknown
  misc_feature (1)..( 8): Result.001 file - promoters75/1009941
tcaatttc

SEQ ID NO: 75908 - DNA, 8 bp, Unknown
  misc_feature (1)..( 8): Result.001 file - promoters75/1009941
aaaatttc

SEQ ID NO: 75909 - DNA, 8 bp, Unknown
  misc_feature (1)..( 8): Result.001 file - promoters75/1009941
tcaattta

SEQ ID NO: 75910 - DNA, 10 bp, Unknown
  misc_feature (1)..( 10): Result.001 file - promoters75/1009941
atttctactc

SEQ ID NO: 75911 - DNA, 10 bp, Unknown
  misc_feature (1)..( 10): Result.001 file - promoters75/1009941
ttttcttctc

SEQ ID NO: 75912 - DNA, 10 bp, Unknown
  misc_feature (1)..( 10): Result.001 file - promoters75/1009941
ttttattcag

SEQ ID NO: 75913 - DNA, 9 bp, Unknown
  misc_feature (1)..( 9): Result.001 file - promoters75/1009941
ttaatcaaa

SEQ ID NO: 75914 - DNA, 9 bp, Unknown
  misc_feature (1)..( 9): Result.001 file - promoters75/1009941
acaataaaa

SEQ ID NO: 75915 - DNA, 9 bp, Unknown
  misc_feature (1)..( 9): Result.001 file - promoters75/1010094
acattaaaa

SEQ ID NO: 75916 - DNA, 11 bp, Unknown
  misc_feature (1)..( 11): Result.001 file - promoters75/1010094
gaaagaaaatc

SEQ ID NO: 75917 - DNA, 11 bp, Unknown
  misc_feature (1)..( 11): Result.001 file - promoters75/1010094
ggtggaaaatg

SEQ ID NO: 75918 - DNA, 11 bp, Unknown
  misc_feature (1)..( 11): Result.001 file - promoters75/1010094
gtaagaaaaaa

SEQ ID NO: 75919 - DNA, 11 bp, Unknown
  misc_feature (1)..( 11): Result.001 file - promoters75/1010094
gggaaaaaatc

SEQ ID NO: 75920 - DNA, 11 bp, Unknown
  misc_feature (1)..( 11): Result.001 file - promoters75/1010094
tataaaaaata

SEQ ID NO: 75921 - DNA, 11 bp, Unknown
  misc_feature (1)..( 11): Result.001 file - promoters75/1010094
agaataaaaac

SEQ ID NO: 75922 - DNA, 9 bp, Unknown
  misc_feature (1)..( 9): Result.001 file - promoters75/1010094
actttaata

SEQ ID NO: 75923 - DNA, 9 bp, Unknown
  misc_feature (1)..( 9): Result.001 file - promoters75/1010094
actataaaa

SEQ ID NO: 75924 - DNA, 9 bp, Unknown
  misc_feature (1)..( 9): Result.001 file - promoters75/1010094
tatataaaa

SEQ ID NO: 75925 - DNA, 9 bp, Unknown
  misc_feature (1)..( 9): Result.001 file - promoters75/1010094
tatttaaag

SEQ ID NO: 75926 - DNA, 9 bp, Unknown
  misc_feature (1)..( 9): Result.001 file - promoters75/1010094
aatataaag

SEQ ID NO: 75927 - DNA, 9 bp, Unknown
  misc_feature (1)..( 9): Result.001 file - promoters75/1010094
tatataagt

SEQ ID NO: 75928 - DNA, 9 bp, Unknown
  misc_feature (1)..( 9): Result.001 file - promoters75/1010094
ttttctacc

SEQ ID NO: 75929 - DNA, 9 bp, Unknown
  misc_feature (1)..( 9): Result.001 file - promoters75/1010094
ttttctact

SEQ ID NO: 75930 - DNA, 9 bp, Unknown
  misc_feature (1)..( 9): Result.001 file - promoters75/1010094
ctttctatt

SEQ ID NO: 75931 - DNA, 9 bp, Unknown
  misc_feature (1)..( 9): Result.001 file - promoters75/1010094
acttcaacc

SEQ ID NO: 75932 - DNA, 9 bp, Unknown
  misc_feature (1)..( 9): Result.001 file - promoters75/1010094
ctttttaca

SEQ ID NO: 75933 - DNA, 9 bp, Unknown
  misc_feature (1)..( 9): Result.001 file - promoters75/1010094
ttttctgga

SEQ ID NO: 75934 - DNA, 10 bp, Unknown
  misc_feature (1)..( 10): Result.001 file - promoters75/1010094
ttaataaaaa

SEQ ID NO: 75935 - DNA, 10 bp, Unknown
  misc_feature (1)..( 10): Result.001 file - promoters75/1010094
ctaatgaaat

SEQ ID NO: 75936 - DNA, 10 bp, Unknown
  misc_feature (1)..( 10): Result.001 file - promoters75/1010094
agaataaaaa

SEQ ID NO: 75937 - DNA, 10 bp, Unknown
  misc_feature (1)..( 10): Result.001 file - promoters75/1010094
atgatgaaat

SEQ ID NO: 75938 - DNA, 10 bp, Unknown
  misc_feature (1)..( 10): Result.001 file - promoters75/1010094
agaaaaaaaa

SEQ ID NO: 75939 - DNA, 10 bp, Unknown
  misc_feature (1)..( 10): Result.001 file - promoters75/1010367
atcaaaaaat

SEQ ID NO: 75940 - DNA, 8 bp, Unknown
  misc_feature (1)..( 8): Result.001 file - promoters75/1010367
ggaaaaaa

SEQ ID NO: 75941 - DNA, 8 bp, Unknown
  misc_feature (1)..( 8): Result.001 file - promoters75/1010367
ttaaaaaa

SEQ ID NO: 75942 - DNA, 8 bp, Unknown
  misc_feature (1)..( 8): Result.001 file - promoters75/1010367
ttaacaaa

SEQ ID NO: 75943 - DNA, 8 bp, Unknown
  misc_feature (1)..( 8): Result.001 file - promoters75/1010367
agaccaat

SEQ ID NO: 75944 - DNA, 8 bp, Unknown
  misc_feature (1)..( 8): Result.001 file - promoters75/1010367
aaaccaat

SEQ ID NO: 75945 - DNA, 8 bp, Unknown
  misc_feature (1)..( 8): Result.001 file - promoters75/1010367
aaaacaag

SEQ ID NO: 75946 - DNA, 8 bp, Unknown
  misc_feature (1)..( 8): Result.001 file - promoters75/1010367
agacaaac

SEQ ID NO: 75947 - DNA, 8 bp, Unknown
  misc_feature (1)..( 8): Result.001 file - promoters75/1010367
taacaaac

SEQ ID NO: 75948 - DNA, 8 bp, Unknown
  misc_feature (1)..( 8): Result.001 file - promoters75/1010367
ttaaaaaa

SEQ ID NO: 75949 - DNA, 7 bp, Unknown
  misc_feature (1)..( 7): Result.001 file - promoters75/1010367
ccttttt

SEQ ID NO: 75950 - DNA, 7 bp, Unknown
  misc_feature (1)..( 7): Result.001 file - promoters75/1010367
tcttttt

SEQ ID NO: 75951 - DNA, 7 bp, Unknown
  misc_feature (1)..( 7): Result.001 file - promoters75/1010385
tctcttt

SEQ ID NO: 75952 - DNA, 8 bp, Unknown
  misc_feature (1)..( 8): Result.001 file - promoters75/1010385
actttttg

SEQ ID NO: 75953 - DNA, 8 bp, Unknown
  misc_feature (1)..( 8): Result.001 file - promoters75/1010385
gctttttg

SEQ ID NO: 75954 - DNA, 8 bp, Unknown
  misc_feature (1)..( 8): Result.001 file - promoters75/1010435
gcttttcc

SEQ ID NO: 75955 - DNA, 10 bp, Unknown
  misc_feature (1)..( 10): Result.001 file - promoters75/1010435
aatctgaatc

SEQ ID NO: 75956 - DNA, 10 bp, Unknown
  misc_feature (1)..( 10): Result.001 file - promoters75/1010435
actctgcatc

SEQ ID NO: 75957 - DNA, 10 bp, Unknown
  misc_feature (1)..( 10): Result.001 file - promoters75/1010819
aatttgattt

SEQ ID NO: 75958 - DNA, 9 bp, Unknown
  misc_feature (1)..( 9): Result.001 file - promoters75/1010819
attgttgct

SEQ ID NO: 75959 - DNA, 9 bp, Unknown
  misc_feature (1)..( 9): Result.001 file - promoters75/1010819
atttttggt

SEQ ID NO: 75960 - DNA, 9 bp, Unknown
  misc_feature (1)..( 9): Result.001 file - promoters75/1011923
agtttaggt

SEQ ID NO: 75961 - DNA, 9 bp, Unknown
  misc_feature (1)..( 9): Result.001 file - promoters75/1011923
ttgttgttt

SEQ ID NO: 75962 - DNA, 9 bp, Unknown
  misc_feature (1)..( 9): Result.001 file - promoters75/1011923
ttgttgttt

SEQ ID NO: 75963 - DNA, 9 bp, Unknown
  misc_feature (1)..( 9): Result.001 file - promoters75/1011923
tttttgttt

SEQ ID NO: 75964 - DNA, 11 bp, Unknown
  misc_feature (1)..( 11): Result.001 file - promoters75/1011923
atcttcatgtt

SEQ ID NO: 75965 - DNA, 11 bp, Unknown
  misc_feature (1)..( 11): Result.001 file - promoters75/1011923
atgttcatgtt

SEQ ID NO: 75966 - DNA, 11 bp, Unknown
  misc_feature (1)..( 11): Result.001 file - promoters75/1011972
atcttcatgac

SEQ ID NO: 75967 - DNA, 7 bp, Unknown
  misc_feature (1)..( 7): Result.001 file - promoters75/1011972
gcataat

SEQ ID NO: 75968 - DNA, 7 bp, Unknown
  misc_feature (1)..( 7): Result.001 file - promoters75/1011972
gcataag

SEQ ID NO: 75969 - DNA, 7 bp, Unknown
  misc_feature (1)..( 7): Result.001 file - promoters75/1011972
ccataat

SEQ ID NO: 75970 - DNA, 7 bp, Unknown
  misc_feature (1)..( 7): Result.001 file - promoters75/1011972
tttaaaa

SEQ ID NO: 75971 - DNA, 7 bp, Unknown
  misc_feature (1)..( 7): Result.001 file - promoters75/1011972
tttaaag

SEQ ID NO: 75972 - DNA, 7 bp, Unknown
  misc_feature (1)..( 7): Result.001 file - promoters75/1011972
attaaag

SEQ ID NO: 75973 - DNA, 9 bp, Unknown
  misc_feature (1)..( 9): Result.001 file - promoters75/1011972
ttctgctaa

SEQ ID NO: 75974 - DNA, 9 bp, Unknown
  misc_feature (1)..( 9): Result.001 file - promoters75/1011972
ttctgcgaa

SEQ ID NO: 75975 - DNA, 9 bp, Unknown
  misc_feature (1)..( 9): Result.001 file - promoters75/1011972
atctcctaa

SEQ ID NO: 75976 - DNA, 9 bp, Unknown
  misc_feature (1)..( 9): Result.001 file - promoters75/1011972
tcatataaa

SEQ ID NO: 75977 - DNA, 9 bp, Unknown
  misc_feature (1)..( 9): Result.001 file - promoters75/1011972
ctatataaa

SEQ ID NO: 75978 - DNA, 9 bp, Unknown
  misc_feature (1)..( 9): Result.001 file - promoters75/1011972
ctacatatc

SEQ ID NO: 75979 - DNA, 10 bp, Unknown
  misc_feature (1)..( 10): Result.001 file - promoters75/1011972
atcttcatat

SEQ ID NO: 75980 - DNA, 10 bp, Unknown
  misc_feature (1)..( 10): Result.001 file - promoters75/1011972
atctacatat

SEQ ID NO: 75981 - DNA, 10 bp, Unknown
  misc_feature (1)..( 10): Result.001 file - promoters75/1012003
tactatataa

SEQ ID NO: 75982 - DNA, 8 bp, Unknown
  misc_feature (1)..( 8): Result.001 file - promoters75/1012003
cagagacg

SEQ ID NO: 75983 - DNA, 8 bp, Unknown
  misc_feature (1)..( 8): Result.001 file - promoters75/1012003
cagagaga

SEQ ID NO: 75984 - DNA, 8 bp, Unknown
  misc_feature (1)..( 8): Result.001 file - promoters75/1012074
tagagaga

SEQ ID NO: 75985 - DNA, 8 bp, Unknown
  misc_feature (1)..( 8): Result.001 file - promoters75/1012074
agtgttca

SEQ ID NO: 75986 - DNA, 8 bp, Unknown
  misc_feature (1)..( 8): Result.001 file - promoters75/1012074
agtcttcc

SEQ ID NO: 75987 - DNA, 8 bp, Unknown
  misc_feature (1)..( 8): Result.001 file - promoters75/1012074
agtgatca

SEQ ID NO: 75988 - DNA, 10 bp, Unknown
  misc_feature (1)..( 10): Result.001 file - promoters75/1012074
ttttaataag

SEQ ID NO: 75989 - DNA, 10 bp, Unknown
  misc_feature (1)..( 10): Result.001 file - promoters75/1012074
tttcaataac

SEQ ID NO: 75990 - DNA, 10 bp, Unknown
  misc_feature (1)..( 10): Result.001 file - promoters75/1012110
gtctaaaaag

SEQ ID NO: 75991 - DNA, 11 bp, Unknown
  misc_feature (1)..( 11): Result.001 file - promoters75/1012110
ccagaattaag

SEQ ID NO: 75992 - DNA, 11 bp, Unknown
  misc_feature (1)..( 11): Result.001 file - promoters75/1012110
ccataattagt

SEQ ID NO: 75993 - DNA, 11 bp, Unknown
  misc_feature (1)..( 11): Result.001 file - promoters75/1012128
atgtaattaag

SEQ ID NO: 75994 - DNA, 15 bp, Unknown
  misc_feature (1)..( 15): Result.001 file - promoters75/1012128
tcaaatcccacagtt

SEQ ID NO: 75995 - DNA, 15 bp, Unknown
  misc_feature (1)..( 15): Result.001 file - promoters75/1012128
tcaaattccacggtt

SEQ ID NO: 75996 - DNA, 15 bp, Unknown
  misc_feature (1)..( 15): Result.001 file - promoters75/1012128
ggccagaacacggta

SEQ ID NO: 75997 - DNA, 15 bp, Unknown
  misc_feature (1)..( 15): Result.001 file - promoters75/1012128
gtctccaagacggta

SEQ ID NO: 75998 - DNA, 12 bp, Unknown
  misc_feature (1)..( 12): Result.001 file - promoters75/1012128
attgaaaaatca

SEQ ID NO: 75999 - DNA, 12 bp, Unknown
  misc_feature (1)..( 12): Result.001 file - promoters75/1012128
gaagaagaattg

SEQ ID NO: 76000 - DNA, 12 bp, Unknown
  misc_feature (1)..( 12): Result.001 file - promoters75/1012128
attcaaaattct

SEQ ID NO: 76001 - DNA, 12 bp, Unknown
  misc_feature (1)..( 12): Result.001 file - promoters75/1012128
cagtaagcagaa

SEQ ID NO: 76002 - DNA, 8 bp, Unknown
  misc_feature (1)..( 8): Result.001 file - promoters75/1012128
aatatgta

SEQ ID NO: 76003 - DNA, 8 bp, Unknown
  misc_feature (1)..( 8): Result.001 file - promoters75/1012128
aatatgtg

SEQ ID NO: 76004 - DNA, 8 bp, Unknown
  misc_feature (1)..( 8): Result.001 file - promoters75/1012128
gatattat

SEQ ID NO: 76005 - DNA, 8 bp, Unknown
  misc_feature (1)..( 8): Result.001 file - promoters75/1012128
cttattat

SEQ ID NO: 76006 - DNA, 10 bp, Unknown
  misc_feature (1)..( 10): Result.001 file - promoters75/1012128
tatttatata

SEQ ID NO: 76007 - DNA, 10 bp, Unknown
  misc_feature (1)..( 10): Result.001 file - promoters75/1012128
tatttaattt

SEQ ID NO: 76008 - DNA, 10 bp, Unknown
  misc_feature (1)..( 10): Result.001 file - promoters75/1012128
catttaagcc

SEQ ID NO: 76009 - DNA, 10 bp, Unknown
  misc_feature (1)..( 10): Result.001 file - promoters75/1012334
catttgattt

SEQ ID NO: 76010 - DNA, 8 bp, Unknown
  misc_feature (1)..( 8): Result.001 file - promoters75/1012334
gttttttc

SEQ ID NO: 76011 - DNA, 8 bp, Unknown
  misc_feature (1)..( 8): Result.001 file - promoters75/1012334
gtttttct

SEQ ID NO: 76012 - DNA, 8 bp, Unknown
  misc_feature (1)..( 8): Result.001 file - promoters75/1012334
cttttttt

SEQ ID NO: 76013 - DNA, 8 bp, Unknown
  misc_feature (1)..( 8): Result.001 file - promoters75/1012334
gtttttgc

SEQ ID NO: 76014 - DNA, 9 bp, Unknown
  misc_feature (1)..( 9): Result.001 file - promoters75/1012334
ctttcttct

SEQ ID NO: 76015 - DNA, 9 bp, Unknown
  misc_feature (1)..( 9): Result.001 file - promoters75/1012349
gttcttgcc

SEQ ID NO: 76016 - DNA, 12 bp, Unknown
  misc_feature (1)..( 12): Result.001 file - promoters75/1012349
caacaatgtaca

SEQ ID NO: 76017 - DNA, 12 bp, Unknown
  misc_feature (1)..( 12): Result.001 file - promoters75/1012349
caataatttaca

SEQ ID NO: 76018 - DNA, 12 bp, Unknown
  misc_feature (1)..( 12): Result.001 file - promoters75/1012673
tgaaaatttata

SEQ ID NO: 76019 - DNA, 9 bp, Unknown
  misc_feature (1)..( 9): Result.001 file - promoters75/1012673
tatcatttt

SEQ ID NO: 76020 - DNA, 9 bp, Unknown
  misc_feature (1)..( 9): Result.001 file - promoters75/1012673
tatcatttt

SEQ ID NO: 76021 - DNA, 9 bp, Unknown
  misc_feature (1)..( 9): Result.001 file - promoters75/1012757
tatgattaa

SEQ ID NO: 76022 - DNA, 11 bp, Unknown
  misc_feature (1)..( 11): Result.001 file - promoters75/1012757
tgtttgaccat

SEQ ID NO: 76023 - DNA, 11 bp, Unknown
  misc_feature (1)..( 11): Result.001 file - promoters75/1012757
tatttgaacat

SEQ ID NO: 76024 - DNA, 11 bp, Unknown
  misc_feature (1)..( 11): Result.001 file - promoters75/1012757
tgtgtgagttc

SEQ ID NO: 76025 - DNA, 8 bp, Unknown
  misc_feature (1)..( 8): Result.001 file - promoters75/1012757
taacgaac

SEQ ID NO: 76026 - DNA, 8 bp, Unknown
  misc_feature (1)..( 8): Result.001 file - promoters75/1012757
caacgaaa

SEQ ID NO: 76027 - DNA, 8 bp, Unknown
  misc_feature (1)..( 8): Result.001 file - promoters75/1013128
caactaaa

SEQ ID NO: 76028 - DNA, 7 bp, Unknown
  misc_feature (1)..( 7): Result.001 file - promoters75/1013128
taaattg

SEQ ID NO: 76029 - DNA, 7 bp, Unknown
  misc_feature (1)..( 7): Result.001 file - promoters75/1013128
gaaattg

SEQ ID NO: 76030 - DNA, 7 bp, Unknown
  misc_feature (1)..( 7): Result.001 file - promoters75/1013128
gaagttg

SEQ ID NO: 76031 - DNA, 9 bp, Unknown
  misc_feature (1)..( 9): Result.001 file - promoters75/1013128
aaaataaag

SEQ ID NO: 76032 - DNA, 9 bp, Unknown
  misc_feature (1)..( 9): Result.001 file - promoters75/1013128
aaaaaaaag

SEQ ID NO: 76033 - DNA, 9 bp, Unknown
  misc_feature (1)..( 9): Result.001 file - promoters75/1013208
aagagaaag

SEQ ID NO: 76034 - DNA, 11 bp, Unknown
  misc_feature (1)..( 11): Result.001 file - promoters75/1013208
aaagtaattta

SEQ ID NO: 76035 - DNA, 11 bp, Unknown
  misc_feature (1)..( 11): Result.001 file - promoters75/1013208
acagtagtttc

SEQ ID NO: 76036 - DNA, 11 bp, Unknown
  misc_feature (1)..( 11): Result.001 file - promoters75/1013208
aaaataaacta

SEQ ID NO: 76037 - DNA, 11 bp, Unknown
  misc_feature (1)..( 11): Result.001 file - promoters75/1013208
tgttgagtttc

SEQ ID NO: 76038 - DNA, 11 bp, Unknown
  misc_feature (1)..( 11): Result.001 file - promoters75/1013208
attttaatctc

SEQ ID NO: 76039 - DNA, 11 bp, Unknown
  misc_feature (1)..( 11): Result.001 file - promoters75/1013208
tttttattcta

SEQ ID NO: 76040 - DNA, 11 bp, Unknown
  misc_feature (1)..( 11): Result.001 file - promoters75/1013208
gttgtattcta

SEQ ID NO: 76041 - DNA, 11 bp, Unknown
  misc_feature (1)..( 11): Result.001 file - promoters75/1013384
tttttacggcg

SEQ ID NO: 76042 - DNA, 8 bp, Unknown
  misc_feature (1)..( 8): Result.001 file - promoters75/1013384
aaaacaga

SEQ ID NO: 76043 - DNA, 8 bp, Unknown
  misc_feature (1)..( 8): Result.001 file - promoters75/1013384
aaaacagt

SEQ ID NO: 76044 - DNA, 8 bp, Unknown
  misc_feature (1)..( 8): Result.001 file - promoters75/1013540
aacacaaa

SEQ ID NO: 76045 - DNA, 15 bp, Unknown
  misc_feature (1)..( 15): Result.001 file - promoters75/1013540
acagagacaatgaaa

SEQ ID NO: 76046 - DNA, 15 bp, Unknown
  misc_feature (1)..( 15): Result.001 file - promoters75/1013540
ggtaagaaaataaaa

SEQ ID NO: 76047 - DNA, 15 bp, Unknown
  misc_feature (1)..( 15): Result.001 file - promoters75/1013893
acagagacattcacg

SEQ ID NO: 76048 - DNA, 12 bp, Unknown
  misc_feature (1)..( 12): Result.001 file - promoters75/1013893
aagaaaattgac

SEQ ID NO: 76049 - DNA, 12 bp, Unknown
  misc_feature (1)..( 12): Result.001 file - promoters75/1013893
aagaaatttgct

SEQ ID NO: 76050 - DNA, 12 bp, Unknown
  misc_feature (1)..( 12): Result.001 file - promoters75/1013893
tatgaatctgct

SEQ ID NO: 76051 - DNA, 11 bp, Unknown
  misc_feature (1)..( 11): Result.001 file - promoters75/1013893
aaatttcactt

SEQ ID NO: 76052 - DNA, 11 bp, Unknown
  misc_feature (1)..( 11): Result.001 file - promoters75/1013893
aaatttctgcc

SEQ ID NO: 76053 - DNA, 11 bp, Unknown
  misc_feature (1)..( 11): Result.001 file - promoters75/1013904
gtatttctctt

SEQ ID NO: 76054 - DNA, 9 bp, Unknown
  misc_feature (1)..( 9): Result.001 file - promoters75/1013904
ttagtaatt

SEQ ID NO: 76055 - DNA, 9 bp, Unknown
  misc_feature (1)..( 9): Result.001 file - promoters75/1013904
ttactaaca

SEQ ID NO: 76056 - DNA, 9 bp, Unknown
  misc_feature (1)..( 9): Result.001 file - promoters75/1013904
ttagtgatt

SEQ ID NO: 76057 - DNA, 8 bp, Unknown
  misc_feature (1)..( 8): Result.001 file - promoters75/1013904
atttatat

SEQ ID NO: 76058 - DNA, 8 bp, Unknown
  misc_feature (1)..( 8): Result.001 file - promoters75/1013904
aattatat

SEQ ID NO: 76059 - DNA, 8 bp, Unknown
  misc_feature (1)..( 8): Result.001 file - promoters75/1013904
aattgtat

SEQ ID NO: 76060 - DNA, 10 bp, Unknown
  misc_feature (1)..( 10): Result.001 file - promoters75/1013904
tgataaaatt

SEQ ID NO: 76061 - DNA, 10 bp, Unknown
  misc_feature (1)..( 10): Result.001 file - promoters75/1013904
tgatcaaatc

SEQ ID NO: 76062 - DNA, 10 bp, Unknown
  misc_feature (1)..( 10): Result.001 file - promoters75/1013904
ttataatatt

SEQ ID NO: 76063 - DNA, 7 bp, Unknown
  misc_feature (1)..( 7): Result.001 file - promoters75/1013904
gataaaa

SEQ ID NO: 76064 - DNA, 7 bp, Unknown
  misc_feature (1)..( 7): Result.001 file - promoters75/1013904
aataaaa

SEQ ID NO: 76065 - DNA, 7 bp, Unknown
  misc_feature (1)..( 7): Result.001 file - promoters75/1013904
aataaac

SEQ ID NO: 76066 - DNA, 8 bp, Unknown
  misc_feature (1)..( 8): Result.001 file - promoters75/1013904
gtttaggc

SEQ ID NO: 76067 - DNA, 8 bp, Unknown
  misc_feature (1)..( 8): Result.001 file - promoters75/1013904
gtttaggt

SEQ ID NO: 76068 - DNA, 8 bp, Unknown
  misc_feature (1)..( 8): Result.001 file - promoters75/1013904
tttttggt

SEQ ID NO: 76069 - DNA, 11 bp, Unknown
  misc_feature (1)..( 11): Result.001 file - promoters75/1013904
aagaaataaat

SEQ ID NO: 76070 - DNA, 11 bp, Unknown
  misc_feature (1)..( 11): Result.001 file - promoters75/1013904
aagaaaaaaat

SEQ ID NO: 76071 - DNA, 11 bp, Unknown
  misc_feature (1)..( 11): Result.001 file - promoters75/1013904
ctaaaataata

SEQ ID NO: 76072 - DNA, 8 bp, Unknown
  misc_feature (1)..( 8): Result.001 file - promoters75/1013904
ttaatata

SEQ ID NO: 76073 - DNA, 8 bp, Unknown
  misc_feature (1)..( 8): Result.001 file - promoters75/1013904
ttaataat

SEQ ID NO: 76074 - DNA, 8 bp, Unknown
  misc_feature (1)..( 8): Result.001 file - promoters75/1013904
ctaaaaat

SEQ ID NO: 76075 - DNA, 7 bp, Unknown
  misc_feature (1)..( 7): Result.001 file - promoters75/1013904
aaataat

SEQ ID NO: 76076 - DNA, 7 bp, Unknown
  misc_feature (1)..( 7): Result.001 file - promoters75/1013904
taataat

SEQ ID NO: 76077 - DNA, 7 bp, Unknown
  misc_feature (1)..( 7): Result.001 file - promoters75/1013904
taaaaat

SEQ ID NO: 76078 - DNA, 8 bp, Unknown
  misc_feature (1)..( 8): Result.001 file - promoters75/1013904
ttatattt

SEQ ID NO: 76079 - DNA, 8 bp, Unknown
  misc_feature (1)..( 8): Result.001 file - promoters75/1013904
caatattt

SEQ ID NO: 76080 - DNA, 8 bp, Unknown
  misc_feature (1)..( 8): Result.001 file - promoters75/1013904
caaaatta

SEQ ID NO: 76081 - DNA, 7 bp, Unknown
  misc_feature (1)..( 7): Result.001 file - promoters75/1013904
tttatat

SEQ ID NO: 76082 - DNA, 7 bp, Unknown
  misc_feature (1)..( 7): Result.001 file - promoters75/1013904
tttatat

SEQ ID NO: 76083 - DNA, 7 bp, Unknown
  misc_feature (1)..( 7): Result.001 file - promoters75/1014125
attatat

SEQ ID NO: 76084 - DNA, 11 bp, Unknown
  misc_feature (1)..( 11): Result.001 file - promoters75/1014125
aaactgtgaaa

SEQ ID NO: 76085 - DNA, 11 bp, Unknown
  misc_feature (1)..( 11): Result.001 file - promoters75/1014125
aaaatgtgaaa

SEQ ID NO: 76086 - DNA, 11 bp, Unknown
  misc_feature (1)..( 11): Result.001 file - promoters75/1014125
aaaataatttt

SEQ ID NO: 76087 - DNA, 11 bp, Unknown
  misc_feature (1)..( 11): Result.001 file - promoters75/1014125
ccaaatttggt

SEQ ID NO: 76088 - DNA, 11 bp, Unknown
  misc_feature (1)..( 11): Result.001 file - promoters75/1014125
ccaattttaag

SEQ ID NO: 76089 - DNA, 11 bp, Unknown
  misc_feature (1)..( 11): Result.001 file - promoters75/1014180
attattctaag

SEQ ID NO: 76090 - DNA, 8 bp, Unknown
  misc_feature (1)..( 8): Result.001 file - promoters75/1014180
tcagtttc

SEQ ID NO: 76091 - DNA, 8 bp, Unknown
  misc_feature (1)..( 8): Result.001 file - promoters75/1014180
tcaatttt

SEQ ID NO: 76092 - DNA, 8 bp, Unknown
  misc_feature (1)..( 8): Result.001 file - promoters75/1014180
ctaatttt

SEQ ID NO: 76093 - DNA, 7 bp, Unknown
  misc_feature (1)..( 7): Result.001 file - promoters75/1014180
caaaatt

SEQ ID NO: 76094 - DNA, 7 bp, Unknown
  misc_feature (1)..( 7): Result.001 file - promoters75/1014180
caatatt

SEQ ID NO: 76095 - DNA, 7 bp, Unknown
  misc_feature (1)..( 7): Result.001 file - promoters75/1014525
caatatg

SEQ ID NO: 76096 - DNA, 7 bp, Unknown
  misc_feature (1)..( 7): Result.001 file - promoters75/1014525
aaaaata

SEQ ID NO: 76097 - DNA, 7 bp, Unknown
  misc_feature (1)..( 7): Result.001 file - promoters75/1014525
aaacata

SEQ ID NO: 76098 - DNA, 7 bp, Unknown
  misc_feature (1)..( 7): Result.001 file - promoters75/1014525
aaaaatt

SEQ ID NO: 76099 - DNA, 8 bp, Unknown
  misc_feature (1)..( 8): Result.001 file - promoters75/1014525
aattaaaa

SEQ ID NO: 76100 - DNA, 8 bp, Unknown
  misc_feature (1)..( 8): Result.001 file - promoters75/1014525
aatgaaaa

SEQ ID NO: 76101 - DNA, 8 bp, Unknown
  misc_feature (1)..( 8): Result.001 file - promoters75/1014525
aatcaaat

SEQ ID NO: 76102 - DNA, 9 bp, Unknown
  misc_feature (1)..( 9): Result.001 file - promoters75/1014525
tatatatag

SEQ ID NO: 76103 - DNA, 9 bp, Unknown
  misc_feature (1)..( 9): Result.001 file - promoters75/1014525
tatatatac

SEQ ID NO: 76104 - DNA, 9 bp, Unknown
  misc_feature (1)..( 9): Result.001 file - promoters75/1014662
tatttatac

SEQ ID NO: 76105 - DNA, 9 bp, Unknown
  misc_feature (1)..( 9): Result.001 file - promoters75/1014662
aaaaatgaa

SEQ ID NO: 76106 - DNA, 9 bp, Unknown
  misc_feature (1)..( 9): Result.001 file - promoters75/1014662
aaaaaagaa

SEQ ID NO: 76107 - DNA, 9 bp, Unknown
  misc_feature (1)..( 9): Result.001 file - promoters75/1014662
gaaaaaggg

SEQ ID NO: 76108 - DNA, 8 bp, Unknown
  misc_feature (1)..( 8): Result.001 file - promoters75/1014662
ttttatca

SEQ ID NO: 76109 - DNA, 8 bp, Unknown
  misc_feature (1)..( 8): Result.001 file - promoters75/1014662
ttttgtca

SEQ ID NO: 76110 - DNA, 8 bp, Unknown
  misc_feature (1)..( 8): Result.001 file - promoters75/1014662
ttttgtat

SEQ ID NO: 76111 - DNA, 8 bp, Unknown
  misc_feature (1)..( 8): Result.001 file - promoters75/1014662
atatatat

SEQ ID NO: 76112 - DNA, 8 bp, Unknown
  misc_feature (1)..( 8): Result.001 file - promoters75/1014662
atatttat

SEQ ID NO: 76113 - DNA, 8 bp, Unknown
  misc_feature (1)..( 8): Result.001 file - promoters75/1014662
taatttat

SEQ ID NO: 76114 - DNA, 7 bp, Unknown
  misc_feature (1)..( 7): Result.001 file - promoters75/1014662
aatcaaa

SEQ ID NO: 76115 - DNA, 7 bp, Unknown
  misc_feature (1)..( 7): Result.001 file - promoters75/1014662
aatcaaa

SEQ ID NO: 76116 - DNA, 8 bp, Unknown
  misc_feature (1)..( 8): Result.001 file - promoters75/1014662
gatccaaa

SEQ ID NO: 76117 - DNA, 7 bp, Unknown
  misc_feature (1)..( 7): Result.001 file - promoters75/1014662
actatac

SEQ ID NO: 76118 - DNA, 7 bp, Unknown
  misc_feature (1)..( 7): Result.001 file - promoters75/1014662
actttac

SEQ ID NO: 76119 - DNA, 7 bp, Unknown
  misc_feature (1)..( 7): Result.001 file - promoters75/1014662
tctttac

SEQ ID NO: 76120 - DNA, 7 bp, Unknown
  misc_feature (1)..( 7): Result.001 file - promoters75/1014662
tataata

SEQ ID NO: 76121 - DNA, 7 bp, Unknown
  misc_feature (1)..( 7): Result.001 file - promoters75/1014662
tattata

SEQ ID NO: 76122 - DNA, 7 bp, Unknown
  misc_feature (1)..( 7): Result.001 file - promoters75/1014991
tataata

SEQ ID NO: 76123 - DNA, 8 bp, Unknown
  misc_feature (1)..( 8): Result.001 file - promoters75/1014991
tacagtaa

SEQ ID NO: 76124 - DNA, 8 bp, Unknown
  misc_feature (1)..( 8): Result.001 file - promoters75/1014991
tacagtaa

SEQ ID NO: 76125 - DNA, 8 bp, Unknown
  misc_feature (1)..( 8): Result.001 file - promoters75/1015214
tactgtat

SEQ ID NO: 76126 - DNA, 8 bp, Unknown
  misc_feature (1)..( 8): Result.001 file - promoters75/1015214
aaaacaaa

SEQ ID NO: 76127 - DNA, 8 bp, Unknown
  misc_feature (1)..( 8): Result.001 file - promoters75/1015214
gaaagaaa

SEQ ID NO: 76128 - DNA, 8 bp, Unknown
  misc_feature (1)..( 8): Result.001 file - promoters75/1015214
gaatgaaa

SEQ ID NO: 76129 - DNA, 9 bp, Unknown
  misc_feature (1)..( 9): Result.001 file - promoters75/1015214
tatgtaaac

SEQ ID NO: 76130 - DNA, 9 bp, Unknown
  misc_feature (1)..( 9): Result.001 file - promoters75/1015214
tatttaaaa

SEQ ID NO: 76131 - DNA, 9 bp, Unknown
  misc_feature (1)..( 9): Result.001 file - promoters75/1015214
tatctaaga

SEQ ID NO: 76132 - DNA, 9 bp, Unknown
  misc_feature (1)..( 9): Result.001 file - promoters75/1015214
gcattaaaa

SEQ ID NO: 76133 - DNA, 7 bp, Unknown
  misc_feature (1)..( 7): Result.001 file - promoters75/1015214
ctaaaaa

SEQ ID NO: 76134 - DNA, 7 bp, Unknown
  misc_feature (1)..( 7): Result.001 file - promoters75/1015214
ttaaaaa

SEQ ID NO: 76135 - DNA, 7 bp, Unknown
  misc_feature (1)..( 7): Result.001 file - promoters75/1015214
ttaaaat

SEQ ID NO: 76136 - DNA, 9 bp, Unknown
  misc_feature (1)..( 9): Result.001 file - promoters75/1015214
aaagtcctc

SEQ ID NO: 76137 - DNA, 9 bp, Unknown
  misc_feature (1)..( 9): Result.001 file - promoters75/1015214
aaattcctt

SEQ ID NO: 76138 - DNA, 9 bp, Unknown
  misc_feature (1)..( 9): Result.001 file - promoters75/1015214
cttttcctt

SEQ ID NO: 76139 - DNA, 9 bp, Unknown
  misc_feature (1)..( 9): Result.001 file - promoters75/1015214
aatttaacc

SEQ ID NO: 76140 - DNA, 9 bp, Unknown
  misc_feature (1)..( 9): Result.001 file - promoters75/1015214
attttgacc

SEQ ID NO: 76141 - DNA, 10 bp, Unknown
  misc_feature (1)..( 10): Result.001 file - promoters75/1015261
aattctgaaa

SEQ ID NO: 76142 - DNA, 11 bp, Unknown
  misc_feature (1)..( 11): Result.001 file - promoters75/1015261
ttggaaaagac

SEQ ID NO: 76143 - DNA, 11 bp, Unknown
  misc_feature (1)..( 11): Result.001 file - promoters75/1015261
ttgtaaatgtt

SEQ ID NO: 76144 - DNA, 11 bp, Unknown
  misc_feature (1)..( 11): Result.001 file - promoters75/1015261
ttgtaaatgtt

SEQ ID NO: 76145 - DNA, 7 bp, Unknown
  misc_feature (1)..( 7): Result.001 file - promoters75/1015261
tttcatt

SEQ ID NO: 76146 - DNA, 7 bp, Unknown
  misc_feature (1)..( 7): Result.001 file - promoters75/1015261
attcatt

SEQ ID NO: 76147 - DNA, 7 bp, Unknown
  misc_feature (1)..( 7): Result.001 file - promoters75/1015261
tttgatt

SEQ ID NO: 76148 - DNA, 12 bp, Unknown
  misc_feature (1)..( 12): Result.001 file - promoters75/1015261
attaataagggt

SEQ ID NO: 76149 - DNA, 12 bp, Unknown
  misc_feature (1)..( 12): Result.001 file - promoters75/1015261
attaatgggctt

SEQ ID NO: 76150 - DNA, 12 bp, Unknown
  misc_feature (1)..( 12): Result.001 file - promoters75/1015261
gttaatgggctt

SEQ ID NO: 76151 - DNA, 8 bp, Unknown
  misc_feature (1)..( 8): Result.001 file - promoters75/1015261
atagagaa

SEQ ID NO: 76152 - DNA, 8 bp, Unknown
  misc_feature (1)..( 8): Result.001 file - promoters75/1015261
ataaagag

SEQ ID NO: 76153 - DNA, 8 bp, Unknown
  misc_feature (1)..( 8): Result.001 file - promoters75/1015261
gcagagaa

SEQ ID NO: 76154 - DNA, 8 bp, Unknown
  misc_feature (1)..( 8): Result.001 file - promoters75/1015261
caagcaaa

SEQ ID NO: 76155 - DNA, 8 bp, Unknown
  misc_feature (1)..( 8): Result.001 file - promoters75/1015261
caatcaat

SEQ ID NO: 76156 - DNA, 8 bp, Unknown
  misc_feature (1)..( 8): Result.001 file - promoters75/1015337
gaagaaaa

SEQ ID NO: 76157 - DNA, 12 bp, Unknown
  misc_feature (1)..( 12): Result.001 file - promoters75/1015337
tactaaatttta

SEQ ID NO: 76158 - DNA, 12 bp, Unknown
  misc_feature (1)..( 12): Result.001 file - promoters75/1015337
cgttgaatctta

SEQ ID NO: 76159 - DNA, 12 bp, Unknown
  misc_feature (1)..( 12): Result.001 file - promoters75/1015337
taccaaatttaa

SEQ ID NO: 76160 - DNA, 6 bp, Unknown
  misc_feature (1)..( 6): Result.001 file - promoters75/1015337
attttt

SEQ ID NO: 76161 - DNA, 6 bp, Unknown
  misc_feature (1)..( 6): Result.001 file - promoters75/1015337
attttt

SEQ ID NO: 76162 - DNA, 6 bp, Unknown
  misc_feature (1)..( 6): Result.001 file - promoters75/1015475
attttt

SEQ ID NO: 76163 - DNA, 9 bp, Unknown
  misc_feature (1)..( 9): Result.001 file - promoters75/1015475
gtttccttt

SEQ ID NO: 76164 - DNA, 9 bp, Unknown
  misc_feature (1)..( 9): Result.001 file - promoters75/1015475
gttaccttt

SEQ ID NO: 76165 - DNA, 9 bp, Unknown
  misc_feature (1)..( 9): Result.001 file - promoters75/1015848
gcttcgttt

SEQ ID NO: 76166 - DNA, 9 bp, Unknown
  misc_feature (1)..( 9): Result.001 file - promoters75/1015848
gtttccttt

SEQ ID NO: 76167 - DNA, 9 bp, Unknown
  misc_feature (1)..( 9): Result.001 file - promoters75/1015848
gttaccttt

SEQ ID NO: 76168 - DNA, 9 bp, Unknown
  misc_feature (1)..( 9): Result.001 file - promoters75/1016250
gcttcgttt

SEQ ID NO: 76169 - DNA, 9 bp, Unknown
  misc_feature (1)..( 9): Result.001 file - promoters75/1016250
gttagattt

SEQ ID NO: 76170 - DNA, 9 bp, Unknown
  misc_feature (1)..( 9): Result.001 file - promoters75/1016250
gttaaattg

SEQ ID NO: 76171 - DNA, 9 bp, Unknown
  misc_feature (1)..( 9): Result.001 file - promoters75/1016250
ccaaaattg

SEQ ID NO: 76172 - DNA, 9 bp, Unknown
  misc_feature (1)..( 9): Result.001 file - promoters75/1016250
taattttgc

SEQ ID NO: 76173 - DNA, 9 bp, Unknown
  misc_feature (1)..( 9): Result.001 file - promoters75/1016250
taattttta

SEQ ID NO: 76174 - DNA, 9 bp, Unknown
  misc_feature (1)..( 9): Result.001 file - promoters75/1016278
tcattttta

SEQ ID NO: 76175 - DNA, 9 bp, Unknown
  misc_feature (1)..( 9): Result.001 file - promoters75/1016278
gggattttt

SEQ ID NO: 76176 - DNA, 9 bp, Unknown
  misc_feature (1)..( 9): Result.001 file - promoters75/1016278
gggttttta

SEQ ID NO: 76177 - DNA, 9 bp, Unknown
  misc_feature (1)..( 9): Result.001 file - promoters75/1016278
ttgattttt

SEQ ID NO: 76178 - DNA, 7 bp, Unknown
  misc_feature (1)..( 7): Result.001 file - promoters75/1016278
taattaa

SEQ ID NO: 76179 - DNA, 7 bp, Unknown
  misc_feature (1)..( 7): Result.001 file - promoters75/1016278
taattat

SEQ ID NO: 76180 - DNA, 7 bp, Unknown
  misc_feature (1)..( 7): Result.001 file - promoters75/1016468
taattat

SEQ ID NO: 76181 - DNA, 9 bp, Unknown
  misc_feature (1)..( 9): Result.001 file - promoters75/1016468
ttgagttta

SEQ ID NO: 76182 - DNA, 9 bp, Unknown
  misc_feature (1)..( 9): Result.001 file - promoters75/1016468
ttgactttt

SEQ ID NO: 76183 - DNA, 9 bp, Unknown
  misc_feature (1)..( 9): Result.001 file - promoters75/1016468
ttgaatttt

SEQ ID NO: 76184 - DNA, 9 bp, Unknown
  misc_feature (1)..( 9): Result.001 file - promoters75/1016468
tctaatttt

SEQ ID NO: 76185 - DNA, 8 bp, Unknown
  misc_feature (1)..( 8): Result.001 file - promoters75/1016468
aaacaaac

SEQ ID NO: 76186 - DNA, 8 bp, Unknown
  misc_feature (1)..( 8): Result.001 file - promoters75/1016468
gaacaaaa

SEQ ID NO: 76187 - DNA, 8 bp, Unknown
  misc_feature (1)..( 8): Result.001 file - promoters75/1016468
taaaaaaa

SEQ ID NO: 76188 - DNA, 8 bp, Unknown
  misc_feature (1)..( 8): Result.001 file - promoters75/1016468
taagaaaa

SEQ ID NO: 76189 - DNA, 8 bp, Unknown
  misc_feature (1)..( 8): Result.001 file - promoters75/1016468
aaataaaa

SEQ ID NO: 76190 - DNA, 8 bp, Unknown
  misc_feature (1)..( 8): Result.001 file - promoters75/1016468
ttataaaa

SEQ ID NO: 76191 - DNA, 8 bp, Unknown
  misc_feature (1)..( 8): Result.001 file - promoters75/1016468
ttagaaaa

SEQ ID NO: 76192 - DNA, 10 bp, Unknown
  misc_feature (1)..( 10): Result.001 file - promoters75/1016468
atgaaaaaca

SEQ ID NO: 76193 - DNA, 10 bp, Unknown
  misc_feature (1)..( 10): Result.001 file - promoters75/1016468
aagaaaaaat

SEQ ID NO: 76194 - DNA, 11 bp, Unknown
  misc_feature (1)..( 11): Result.001 file - promoters75/1016468
cggaacaaaac

SEQ ID NO: 76195 - DNA, 11 bp, Unknown
  misc_feature (1)..( 11): Result.001 file - promoters75/1016468
aagaaaatata

SEQ ID NO: 76196 - DNA, 9 bp, Unknown
  misc_feature (1)..( 9): Result.001 file - promoters75/1016468
atattatta

SEQ ID NO: 76197 - DNA, 9 bp, Unknown
  misc_feature (1)..( 9): Result.001 file - promoters75/1016468
atataatta

SEQ ID NO: 76198 - DNA, 9 bp, Unknown
  misc_feature (1)..( 9): Result.001 file - promoters75/1016468
ccttaatta

SEQ ID NO: 76199 - DNA, 9 bp, Unknown
  misc_feature (1)..( 9): Result.001 file - promoters75/1016468
gagtctaaa

SEQ ID NO: 76200 - DNA, 9 bp, Unknown
  misc_feature (1)..( 9): Result.001 file - promoters75/1016468
tggtcaaaa

SEQ ID NO: 76201 - DNA, 9 bp, Unknown
  misc_feature (1)..( 9): Result.001 file - promoters75/1016468
tggccaact

SEQ ID NO: 76202 - DNA, 7 bp, Unknown
  misc_feature (1)..( 7): Result.001 file - promoters75/1016468
aaatgtc

SEQ ID NO: 76203 - DNA, 7 bp, Unknown
  misc_feature (1)..( 7): Result.001 file - promoters75/1016468
aaatgtt

SEQ ID NO: 76204 - DNA, 8 bp, Unknown
  misc_feature (1)..( 8): Result.001 file - promoters75/1016468
aaattgtt

SEQ ID NO: 76205 - DNA, 8 bp, Unknown
  misc_feature (1)..( 8): Result.001 file - promoters75/1016468
tatatata

SEQ ID NO: 76206 - DNA, 8 bp, Unknown
  misc_feature (1)..( 8): Result.001 file - promoters75/1016468
tatatata

SEQ ID NO: 76207 - DNA, 8 bp, Unknown
  misc_feature (1)..( 8): Result.001 file - promoters75/1016468
catataaa

SEQ ID NO: 76208 - DNA, 8 bp, Unknown
  misc_feature (1)..( 8): Result.001 file - promoters75/1016468
taattttt

SEQ ID NO: 76209 - DNA, 8 bp, Unknown
  misc_feature (1)..( 8): Result.001 file - promoters75/1016468
taattttc

SEQ ID NO: 76210 - DNA, 8 bp, Unknown
  misc_feature (1)..( 8): Result.001 file - promoters75/1016771
gaattttt

SEQ ID NO: 76211 - DNA, 8 bp, Unknown
  misc_feature (1)..( 8): Result.001 file - promoters75/1016771
attaatgt

SEQ ID NO: 76212 - DNA, 8 bp, Unknown
  misc_feature (1)..( 8): Result.001 file - promoters75/1016771
attactgt

SEQ ID NO: 76213 - DNA, 8 bp, Unknown
  misc_feature (1)..( 8): Result.001 file - promoters75/1016771
attattgt

SEQ ID NO: 76214 - DNA, 8 bp, Unknown
  misc_feature (1)..( 8): Result.001 file - promoters75/1016771
tttactaa

SEQ ID NO: 76215 - DNA, 8 bp, Unknown
  misc_feature (1)..( 8): Result.001 file - promoters75/1016771
ttttctac

SEQ ID NO: 76216 - DNA, 8 bp, Unknown
  misc_feature (1)..( 8): Result.001 file - promoters75/1016771
attagtaa

SEQ ID NO: 76217 - DNA, 8 bp, Unknown
  misc_feature (1)..( 8): Result.001 file - promoters75/1016771
tttcactt

SEQ ID NO: 76218 - DNA, 8 bp, Unknown
  misc_feature (1)..( 8): Result.001 file - promoters75/1016771
tttcactc

SEQ ID NO: 76219 - DNA, 8 bp, Unknown
  misc_feature (1)..( 8): Result.001 file - promoters75/1016886
tatcactt

SEQ ID NO: 76220 - DNA, 15 bp, Unknown
  misc_feature (1)..( 15): Result.001 file - promoters75/1016886
ttcatttttaaaaac

SEQ ID NO: 76221 - DNA, 15 bp, Unknown
  misc_feature (1)..( 15): Result.001 file - promoters75/1016886
tctagatctaaaaac

SEQ ID NO: 76222 - DNA, 15 bp, Unknown
  misc_feature (1)..( 15): Result.001 file - promoters75/1017282
ttcacttttaaaaac

SEQ ID NO: 76223 - DNA, 9 bp, Unknown
  misc_feature (1)..( 9): Result.001 file - promoters75/1017282
atttccgaa

SEQ ID NO: 76224 - DNA, 9 bp, Unknown
  misc_feature (1)..( 9): Result.001 file - promoters75/1017282
ttttccgct

SEQ ID NO: 76225 - DNA, 9 bp, Unknown
  misc_feature (1)..( 9): Result.001 file - promoters75/1017618
ttttcagct

SEQ ID NO: 76226 - DNA, 8 bp, Unknown
  misc_feature (1)..( 8): Result.001 file - promoters75/1017618
ttaagaag

SEQ ID NO: 76227 - DNA, 8 bp, Unknown
  misc_feature (1)..( 8): Result.001 file - promoters75/1017618
ttatgaaa

SEQ ID NO: 76228 - DNA, 9 bp, Unknown
  misc_feature (1)..( 9): Result.001 file - promoters75/1018052
ccatgcaaa

SEQ ID NO: 76229 - DNA, 7 bp, Unknown
  misc_feature (1)..( 7): Result.001 file - promoters75/1018052
tcagttt

SEQ ID NO: 76230 - DNA, 7 bp, Unknown
  misc_feature (1)..( 7): Result.001 file - promoters75/1018052
tcagttg

SEQ ID NO: 76231 - DNA, 7 bp, Unknown
  misc_feature (1)..( 7): Result.001 file - promoters75/1018052
tcaattt

SEQ ID NO: 76232 - DNA, 9 bp, Unknown
  misc_feature (1)..( 9): Result.001 file - promoters75/1018052
attccacat

SEQ ID NO: 76233 - DNA, 9 bp, Unknown
  misc_feature (1)..( 9): Result.001 file - promoters75/1018052
cttcaacat

SEQ ID NO: 76234 - DNA, 9 bp, Unknown
  misc_feature (1)..( 9): Result.001 file - promoters75/1018052
cttcaaaat

SEQ ID NO: 76235 - DNA, 8 bp, Unknown
  misc_feature (1)..( 8): Result.001 file - promoters75/1018052
cttgttgt

SEQ ID NO: 76236 - DNA, 8 bp, Unknown
  misc_feature (1)..( 8): Result.001 file - promoters75/1018052
attgatgt

SEQ ID NO: 76237 - DNA, 8 bp, Unknown
  misc_feature (1)..( 8): Result.001 file - promoters75/1018190
gttttttt

SEQ ID NO: 76238 - DNA, 7 bp, Unknown
  misc_feature (1)..( 7): Result.001 file - promoters75/1018190
atttgtt

SEQ ID NO: 76239 - DNA, 7 bp, Unknown
  misc_feature (1)..( 7): Result.001 file - promoters75/1018190
atttgtt

SEQ ID NO: 76240 - DNA, 7 bp, Unknown
  misc_feature (1)..( 7): Result.001 file - promoters75/1018190
atttgta

SEQ ID NO: 76241 - DNA, 7 bp, Unknown
  misc_feature (1)..( 7): Result.001 file - promoters75/1018190
ttgattg

SEQ ID NO: 76242 - DNA, 7 bp, Unknown
  misc_feature (1)..( 7): Result.001 file - promoters75/1018190
ttgattg

SEQ ID NO: 76243 - DNA, 7 bp, Unknown
  misc_feature (1)..( 7): Result.001 file - promoters75/1018190
ttgattt

SEQ ID NO: 76244 - DNA, 9 bp, Unknown
  misc_feature (1)..( 9): Result.001 file - promoters75/1018190
attttttta

SEQ ID NO: 76245 - DNA, 9 bp, Unknown
  misc_feature (1)..( 9): Result.001 file - promoters75/1018190
cttttttta

SEQ ID NO: 76246 - DNA, 9 bp, Unknown
  misc_feature (1)..( 9): Result.001 file - promoters75/1018276
ctttgtttg

SEQ ID NO: 76247 - DNA, 9 bp, Unknown
  misc_feature (1)..( 9): Result.001 file - promoters75/1018276
acttcatat

SEQ ID NO: 76248 - DNA, 9 bp, Unknown
  misc_feature (1)..( 9): Result.001 file - promoters75/1018276
tcttcttat

SEQ ID NO: 76249 - DNA, 9 bp, Unknown
  misc_feature (1)..( 9): Result.001 file - promoters75/1018391
tcttcttca

SEQ ID NO: 76250 - DNA, 13 bp, Unknown
  misc_feature (1)..( 13): Result.001 file - promoters75/1018391
ctagtttattgtt

SEQ ID NO: 76251 - DNA, 13 bp, Unknown
  misc_feature (1)..( 13): Result.001 file - promoters75/1018391
ctagtttagaccc

SEQ ID NO: 76252 - DNA, 13 bp, Unknown
  misc_feature (1)..( 13): Result.001 file - promoters75/1018391
ggggtttgttgtt

SEQ ID NO: 76253 - DNA, 8 bp, Unknown
  misc_feature (1)..( 8): Result.001 file - promoters75/1018391
agagcata

SEQ ID NO: 76254 - DNA, 8 bp, Unknown
  misc_feature (1)..( 8): Result.001 file - promoters75/1018391
agatcatg

SEQ ID NO: 76255 - DNA, 8 bp, Unknown
  misc_feature (1)..( 8): Result.001 file - promoters75/1018523
cgattatg

SEQ ID NO: 76256 - DNA, 8 bp, Unknown
  misc_feature (1)..( 8): Result.001 file - promoters75/1018523
cccaaaaa

SEQ ID NO: 76257 - DNA, 8 bp, Unknown
  misc_feature (1)..( 8): Result.001 file - promoters75/1018523
tacaaaaa

SEQ ID NO: 76258 - DNA, 8 bp, Unknown
  misc_feature (1)..( 8): Result.001 file - promoters75/1018523
tcctaaaa

SEQ ID NO: 76259 - DNA, 8 bp, Unknown
  misc_feature (1)..( 8): Result.001 file - promoters75/1018523
aacaaaaa

SEQ ID NO: 76260 - DNA, 11 bp, Unknown
  misc_feature (1)..( 11): Result.001 file - promoters75/1018523
aaacagtaaaa

SEQ ID NO: 76261 - DNA, 11 bp, Unknown
  misc_feature (1)..( 11): Result.001 file - promoters75/1018523
aaacaataaaa

SEQ ID NO: 76262 - DNA, 11 bp, Unknown
  misc_feature (1)..( 11): Result.001 file - promoters75/1018523
agataatattt

SEQ ID NO: 76263 - DNA, 11 bp, Unknown
  misc_feature (1)..( 11): Result.001 file - promoters75/1018523
cgtcaaaaaac

SEQ ID NO: 76264 - DNA, 10 bp, Unknown
  misc_feature (1)..( 10): Result.001 file - promoters75/1018523
attaataaag

SEQ ID NO: 76265 - DNA, 10 bp, Unknown
  misc_feature (1)..( 10): Result.001 file - promoters75/1018523
attaatattt

SEQ ID NO: 76266 - DNA, 10 bp, Unknown
  misc_feature (1)..( 10): Result.001 file - promoters75/1018523
gataatattt

SEQ ID NO: 76267 - DNA, 10 bp, Unknown
  misc_feature (1)..( 10): Result.001 file - promoters75/1018523
tttattatag

SEQ ID NO: 76268 - DNA, 10 bp, Unknown
  misc_feature (1)..( 10): Result.001 file - promoters75/1018523
tttattttat

SEQ ID NO: 76269 - DNA, 12 bp, Unknown
  misc_feature (1)..( 12): Result.001 file - promoters75/1018523
taagaaatttcc

SEQ ID NO: 76270 - DNA, 12 bp, Unknown
  misc_feature (1)..( 12): Result.001 file - promoters75/1018523
taaaaaaactaa

SEQ ID NO: 76271 - DNA, 12 bp, Unknown
  misc_feature (1)..( 12): Result.001 file - promoters75/1018523
caagaaaactca

SEQ ID NO: 76272 - DNA, 12 bp, Unknown
  misc_feature (1)..( 12): Result.001 file - promoters75/1018523
taaataactaat

SEQ ID NO: 76273 - DNA, 7 bp, Unknown
  misc_feature (1)..( 7): Result.001 file - promoters75/1018523
taagatt

SEQ ID NO: 76274 - DNA, 7 bp, Unknown
  misc_feature (1)..( 7): Result.001 file - promoters75/1018523
taaaatt

SEQ ID NO: 76275 - DNA, 7 bp, Unknown
  misc_feature (1)..( 7): Result.001 file - promoters75/1018523
taagatc

SEQ ID NO: 76276 - DNA, 7 bp, Unknown
  misc_feature (1)..( 7): Result.001 file - promoters75/1018523
aaaaatt

SEQ ID NO: 76277 - DNA, 7 bp, Unknown
  misc_feature (1)..( 7): Result.001 file - promoters75/1018523
taaaaat

SEQ ID NO: 76278 - DNA, 11 bp, Unknown
  misc_feature (1)..( 11): Result.001 file - promoters75/1018523
caaagacaagt

SEQ ID NO: 76279 - DNA, 11 bp, Unknown
  misc_feature (1)..( 11): Result.001 file - promoters75/1018523
gatagataaga

SEQ ID NO: 76280 - DNA, 11 bp, Unknown
  misc_feature (1)..( 11): Result.001 file - promoters75/1018523
caaaaacaata

SEQ ID NO: 76281 - DNA, 11 bp, Unknown
  misc_feature (1)..( 11): Result.001 file - promoters75/1018523
gggttacaaaa

SEQ ID NO: 76282 - DNA, 14 bp, Unknown
  misc_feature (1)..( 14): Result.001 file - promoters75/1018523
taaataaatttttg

SEQ ID NO: 76283 - DNA, 14 bp, Unknown
  misc_feature (1)..( 14): Result.001 file - promoters75/1018523
caaacaaatgtttg

SEQ ID NO: 76284 - DNA, 14 bp, Unknown
  misc_feature (1)..( 14): Result.001 file - promoters75/1018523
taactaatttctta

SEQ ID NO: 76285 - DNA, 15 bp, Unknown
  misc_feature (1)..( 15): Result.001 file - promoters75/1018523
taatataactcttgg

SEQ ID NO: 76286 - DNA, 11 bp, Unknown
  misc_feature (1)..( 11): Result.001 file - promoters75/1018523
agttaaaaaat

SEQ ID NO: 76287 - DNA, 11 bp, Unknown
  misc_feature (1)..( 11): Result.001 file - promoters75/1018523
agttaatatat

SEQ ID NO: 76288 - DNA, 11 bp, Unknown
  misc_feature (1)..( 11): Result.001 file - promoters75/1018523
tgttattatat

SEQ ID NO: 76289 - DNA, 11 bp, Unknown
  misc_feature (1)..( 11): Result.001 file - promoters75/1018536
agttatttaaa

SEQ ID NO: 76290 - DNA, 8 bp, Unknown
  misc_feature (1)..( 8): Result.001 file - promoters75/1018536
attagttc

SEQ ID NO: 76291 - DNA, 8 bp, Unknown
  misc_feature (1)..( 8): Result.001 file - promoters75/1018536
atttgtta

SEQ ID NO: 76292 - DNA, 8 bp, Unknown
  misc_feature (1)..( 8): Result.001 file - promoters75/1018536
aattgtta

SEQ ID NO: 76293 - DNA, 7 bp, Unknown
  misc_feature (1)..( 7): Result.001 file - promoters75/1018536
tttcaat

SEQ ID NO: 76294 - DNA, 7 bp, Unknown
  misc_feature (1)..( 7): Result.001 file - promoters75/1018536
ttttaat

SEQ ID NO: 76295 - DNA, 7 bp, Unknown
  misc_feature (1)..( 7): Result.001 file - promoters75/1018536
ttttaaa

SEQ ID NO: 76296 - DNA, 8 bp, Unknown
  misc_feature (1)..( 8): Result.001 file - promoters75/1018536
aaattcaa

SEQ ID NO: 76297 - DNA, 8 bp, Unknown
  misc_feature (1)..( 8): Result.001 file - promoters75/1018536
aaattctc

SEQ ID NO: 76298 - DNA, 8 bp, Unknown
  misc_feature (1)..( 8): Result.001 file - promoters75/1018536
aaatcctc

SEQ ID NO: 76299 - DNA, 11 bp, Unknown
  misc_feature (1)..( 11): Result.001 file - promoters75/1018536
cttataattat

SEQ ID NO: 76300 - DNA, 11 bp, Unknown
  misc_feature (1)..( 11): Result.001 file - promoters75/1018536
tttataagtat

SEQ ID NO: 76301 - DNA, 11 bp, Unknown
  misc_feature (1)..( 11): Result.001 file - promoters75/1018770
tttgtaacttc

SEQ ID NO: 76302 - DNA, 13 bp, Unknown
  misc_feature (1)..( 13): Result.001 file - promoters75/1018770
tccatcgaattca

SEQ ID NO: 76303 - DNA, 13 bp, Unknown
  misc_feature (1)..( 13): Result.001 file - promoters75/1018770
caaatcaaatcga

SEQ ID NO: 76304 - DNA, 13 bp, Unknown
  misc_feature (1)..( 13): Result.001 file - promoters75/1018770
tccctcgaacccg

SEQ ID NO: 76305 - DNA, 13 bp, Unknown
  misc_feature (1)..( 13): Result.001 file - promoters75/1018770
attatcgaaatta

SEQ ID NO: 76306 - DNA, 13 bp, Unknown
  misc_feature (1)..( 13): Result.001 file - promoters75/1018770
aaaaccaaagaaa

SEQ ID NO: 76307 - DNA, 13 bp, Unknown
  misc_feature (1)..( 13): Result.001 file - promoters75/1018770
cttatcaaaccaa

SEQ ID NO: 76308 - DNA, 13 bp, Unknown
  misc_feature (1)..( 13): Result.001 file - promoters75/1018770
aaaaacgaatggc

SEQ ID NO: 76309 - DNA, 12 bp, Unknown
  misc_feature (1)..( 12): Result.001 file - promoters75/1018770
gaattcaagacc

SEQ ID NO: 76310 - DNA, 12 bp, Unknown
  misc_feature (1)..( 12): Result.001 file - promoters75/1018770
aatggcaaaacc

SEQ ID NO: 76311 - DNA, 12 bp, Unknown
  misc_feature (1)..( 12): Result.001 file - promoters75/1018770
caaatcaaatcg

SEQ ID NO: 76312 - DNA, 12 bp, Unknown
  misc_feature (1)..( 12): Result.001 file - promoters75/1018770
gaaattaaaatg

SEQ ID NO: 76313 - DNA, 12 bp, Unknown
  misc_feature (1)..( 12): Result.001 file - promoters75/1018770
caaaccaatgtg

SEQ ID NO: 76314 - DNA, 12 bp, Unknown
  misc_feature (1)..( 12): Result.001 file - promoters75/1018770
aaaacgaatggc

SEQ ID NO: 76315 - DNA, 12 bp, Unknown
  misc_feature (1)..( 12): Result.001 file - promoters75/1018770
agaatttttgcg

SEQ ID NO: 76316 - DNA, 12 bp, Unknown
  misc_feature (1)..( 12): Result.001 file - promoters75/1018770
actctttttgat

SEQ ID NO: 76317 - DNA, 12 bp, Unknown
  misc_feature (1)..( 12): Result.001 file - promoters75/1018770
ttcctttttgta

SEQ ID NO: 76318 - DNA, 12 bp, Unknown
  misc_feature (1)..( 12): Result.001 file - promoters75/1018770
attctttttgcc

SEQ ID NO: 76319 - DNA, 12 bp, Unknown
  misc_feature (1)..( 12): Result.001 file - promoters75/1018770
taaattttttat

SEQ ID NO: 76320 - DNA, 12 bp, Unknown
  misc_feature (1)..( 12): Result.001 file - promoters75/1018770
cctatttacaat

SEQ ID NO: 76321 - DNA, 12 bp, Unknown
  misc_feature (1)..( 12): Result.001 file - promoters75/1018770
ttactttgtcaa

SEQ ID NO: 76322 - DNA, 14 bp, Unknown
  misc_feature (1)..( 14): Result.001 file - promoters75/1018770
cctatttacaatgt

SEQ ID NO: 76323 - DNA, 14 bp, Unknown
  misc_feature (1)..( 14): Result.001 file - promoters75/1018770
tgtatttactttgt

SEQ ID NO: 76324 - DNA, 14 bp, Unknown
  misc_feature (1)..( 14): Result.001 file - promoters75/1018770
cctttttgtatcaa

SEQ ID NO: 76325 - DNA, 14 bp, Unknown
  misc_feature (1)..( 14): Result.001 file - promoters75/1018770
tgtatttcactctt

SEQ ID NO: 76326 - DNA, 14 bp, Unknown
  misc_feature (1)..( 14): Result.001 file - promoters75/1018770
attatttcaaatga

SEQ ID NO: 76327 - DNA, 14 bp, Unknown
  misc_feature (1)..( 14): Result.001 file - promoters75/1019734
catatttttttaaa

SEQ ID NO: 76328 - DNA, 9 bp, Unknown
  misc_feature (1)..( 9): Result.001 file - promoters75/1019734
actatcata

SEQ ID NO: 76329 - DNA, 9 bp, Unknown
  misc_feature (1)..( 9): Result.001 file - promoters75/1019734
tcaatcata

SEQ ID NO: 76330 - DNA, 9 bp, Unknown
  misc_feature (1)..( 9): Result.001 file - promoters75/1019734
tcaaccata

SEQ ID NO: 76331 - DNA, 9 bp, Unknown
  misc_feature (1)..( 9): Result.001 file - promoters75/1019734
aaatttcat

SEQ ID NO: 76332 - DNA, 9 bp, Unknown
  misc_feature (1)..( 9): Result.001 file - promoters75/1019734
taatttcat

SEQ ID NO: 76333 - DNA, 9 bp, Unknown
  misc_feature (1)..( 9): Result.001 file - promoters75/1019928
taatttatt

SEQ ID NO: 76334 - DNA, 8 bp, Unknown
  misc_feature (1)..( 8): Result.001 file - promoters75/1019928
attagttc

SEQ ID NO: 76335 - DNA, 8 bp, Unknown
  misc_feature (1)..( 8): Result.001 file - promoters75/1019928
atttgtta

SEQ ID NO: 76336 - DNA, 8 bp, Unknown
  misc_feature (1)..( 8): Result.001 file - promoters75/1019928
aattgtta

SEQ ID NO: 76337 - DNA, 7 bp, Unknown
  misc_feature (1)..( 7): Result.001 file - promoters75/1019928
tttcaat

SEQ ID NO: 76338 - DNA, 7 bp, Unknown
  misc_feature (1)..( 7): Result.001 file - promoters75/1019928
ttttaat

SEQ ID NO: 76339 - DNA, 7 bp, Unknown
  misc_feature (1)..( 7): Result.001 file - promoters75/1019928
ttttaaa

SEQ ID NO: 76340 - DNA, 8 bp, Unknown
  misc_feature (1)..( 8): Result.001 file - promoters75/1019928
aaattcaa

SEQ ID NO: 76341 - DNA, 8 bp, Unknown
  misc_feature (1)..( 8): Result.001 file - promoters75/1019928
aaattctc

SEQ ID NO: 76342 - DNA, 8 bp, Unknown
  misc_feature (1)..( 8): Result.001 file - promoters75/1019928
aaatcctc

SEQ ID NO: 76343 - DNA, 11 bp, Unknown
  misc_feature (1)..( 11): Result.001 file - promoters75/1019928
cttataattat

SEQ ID NO: 76344 - DNA, 11 bp, Unknown
  misc_feature (1)..( 11): Result.001 file - promoters75/1019928
tttataagtat

SEQ ID NO: 76345 - DNA, 11 bp, Unknown
  misc_feature (1)..( 11): Result.001 file - promoters75/1020223
tttgtaacttc

SEQ ID NO: 76346 - DNA, 8 bp, Unknown
  misc_feature (1)..( 8): Result.001 file - promoters75/1020223
atcatatt

SEQ ID NO: 76347 - DNA, 8 bp, Unknown
  misc_feature (1)..( 8): Result.001 file - promoters75/1020223
atcatatt

SEQ ID NO: 76348 - DNA, 8 bp, Unknown
  misc_feature (1)..( 8): Result.001 file - promoters75/1020223
atcatatt

SEQ ID NO: 76349 - DNA, 9 bp, Unknown
  misc_feature (1)..( 9): Result.001 file - promoters75/1020223
tttgtagtg

SEQ ID NO: 76350 - DNA, 9 bp, Unknown
  misc_feature (1)..( 9): Result.001 file - promoters75/1020223
attgtagct

SEQ ID NO: 76351 - DNA, 9 bp, Unknown
  misc_feature (1)..( 9): Result.001 file - promoters75/1020223
tttgttgtg

SEQ ID NO: 76352 - DNA, 8 bp, Unknown
  misc_feature (1)..( 8): Result.001 file - promoters75/1020223
tgatttgt

SEQ ID NO: 76353 - DNA, 8 bp, Unknown
  misc_feature (1)..( 8): Result.001 file - promoters75/1020223
agatatgt

SEQ ID NO: 76354 - DNA, 8 bp, Unknown
  misc_feature (1)..( 8): Result.001 file - promoters75/1020223
tgatttgg

SEQ ID NO: 76355 - DNA, 7 bp, Unknown
  misc_feature (1)..( 7): Result.001 file - promoters75/1020223
gtttgtt

SEQ ID NO: 76356 - DNA, 7 bp, Unknown
  misc_feature (1)..( 7): Result.001 file - promoters75/1020223
gtttgtg

SEQ ID NO: 76357 - DNA, 7 bp, Unknown
  misc_feature (1)..( 7): Result.001 file - promoters75/1020223
ttttgtt

SEQ ID NO: 76358 - DNA, 8 bp, Unknown
  misc_feature (1)..( 8): Result.001 file - promoters75/1020223
tgtttgtt

SEQ ID NO: 76359 - DNA, 8 bp, Unknown
  misc_feature (1)..( 8): Result.001 file - promoters75/1020223
gatttgtt

SEQ ID NO: 76360 - DNA, 8 bp, Unknown
  misc_feature (1)..( 8): Result.001 file - promoters75/1020265
gatatgta

SEQ ID NO: 76361 - DNA, 8 bp, Unknown
  misc_feature (1)..( 8): Result.001 file - promoters75/1020265
atgactac

SEQ ID NO: 76362 - DNA, 8 bp, Unknown
  misc_feature (1)..( 8): Result.001 file - promoters75/1020265
atgactta

SEQ ID NO: 76363 - DNA, 8 bp, Unknown
  misc_feature (1)..( 8): Result.001 file - promoters75/1020543
ttgattta

SEQ ID NO: 76364 - DNA, 10 bp, Unknown
  misc_feature (1)..( 10): Result.001 file - promoters75/1020543
tttgaaaaga

SEQ ID NO: 76365 - DNA, 10 bp, Unknown
  misc_feature (1)..( 10): Result.001 file - promoters75/1020543
aaaaaaaaga

SEQ ID NO: 76366 - DNA, 11 bp, Unknown
  misc_feature (1)..( 11): Result.001 file - promoters75/1020543
gaagaaacaga

SEQ ID NO: 76367 - DNA, 12 bp, Unknown
  misc_feature (1)..( 12): Result.001 file - promoters75/1020543
tgaaaagatgaa

SEQ ID NO: 76368 - DNA, 12 bp, Unknown
  misc_feature (1)..( 12): Result.001 file - promoters75/1020543
acacaagaagaa

SEQ ID NO: 76369 - DNA, 12 bp, Unknown
  misc_feature (1)..( 12): Result.001 file - promoters75/1020701
gaaaaaaaagaa

SEQ ID NO: 76370 - DNA, 11 bp, Unknown
  misc_feature (1)..( 11): Result.001 file - promoters75/1020701
tgtttgaccat

SEQ ID NO: 76371 - DNA, 11 bp, Unknown
  misc_feature (1)..( 11): Result.001 file - promoters75/1020701
tatttgaacat

SEQ ID NO: 76372 - DNA, 11 bp, Unknown
  misc_feature (1)..( 11): Result.001 file - promoters75/1020701
tgtgtgagttc

SEQ ID NO: 76373 - DNA, 8 bp, Unknown
  misc_feature (1)..( 8): Result.001 file - promoters75/1020701
taacgaac

SEQ ID NO: 76374 - DNA, 8 bp, Unknown
  misc_feature (1)..( 8): Result.001 file - promoters75/1020701
caacgaaa

SEQ ID NO: 76375 - DNA, 8 bp, Unknown
  misc_feature (1)..( 8): Result.001 file - promoters75/1020786
caactaaa

SEQ ID NO: 76376 - DNA, 6 bp, Unknown
  misc_feature (1)..( 6): Result.001 file - promoters75/1020786
tataaa

SEQ ID NO: 76377 - DNA, 6 bp, Unknown
  misc_feature (1)..( 6): Result.001 file - promoters75/1020786
tataaa

SEQ ID NO: 76378 - DNA, 6 bp, Unknown
  misc_feature (1)..( 6): Result.001 file - promoters75/1020786
tataaa

SEQ ID NO: 76379 - DNA, 6 bp, Unknown
  misc_feature (1)..( 6): Result.001 file - promoters75/1020786
caaaaa

SEQ ID NO: 76380 - DNA, 6 bp, Unknown
  misc_feature (1)..( 6): Result.001 file - promoters75/1020786
caaaaa

SEQ ID NO: 76381 - DNA, 6 bp, Unknown
  misc_feature (1)..( 6): Result.001 file - promoters75/1020786
caaaaa

SEQ ID NO: 76382 - DNA, 14 bp, Unknown
  misc_feature (1)..( 14): Result.001 file - promoters75/1020786
cacaacattgcttc

SEQ ID NO: 76383 - DNA, 14 bp, Unknown
  misc_feature (1)..( 14): Result.001 file - promoters75/1020786
aacaacaaaaaaag

SEQ ID NO: 76384 - DNA, 14 bp, Unknown
  misc_feature (1)..( 14): Result.001 file - promoters75/1020863
aacgacaaaacaag

SEQ ID NO: 76385 - DNA, 9 bp, Unknown
  misc_feature (1)..( 9): Result.001 file - promoters75/1020863
aaatattaa

SEQ ID NO: 76386 - DNA, 9 bp, Unknown
  misc_feature (1)..( 9): Result.001 file - promoters75/1020863
aaaaattaa

SEQ ID NO: 76387 - DNA, 9 bp, Unknown
  misc_feature (1)..( 9): Result.001 file - promoters75/1020863
taaaatttc

SEQ ID NO: 76388 - DNA, 10 bp, Unknown
  misc_feature (1)..( 10): Result.001 file - promoters75/1020863
cgaaaaataa

SEQ ID NO: 76389 - DNA, 10 bp, Unknown
  misc_feature (1)..( 10): Result.001 file - promoters75/1020863
ataaaattaa

SEQ ID NO: 76390 - DNA, 10 bp, Unknown
  misc_feature (1)..( 10): Result.001 file - promoters75/1020863
ataatatttc

SEQ ID NO: 76391 - DNA, 9 bp, Unknown
  misc_feature (1)..( 9): Result.001 file - promoters75/1020863
aataaaagc

SEQ ID NO: 76392 - DNA, 9 bp, Unknown
  misc_feature (1)..( 9): Result.001 file - promoters75/1020863
aataaaatt

SEQ ID NO: 76393 - DNA, 9 bp, Unknown
  misc_feature (1)..( 9): Result.001 file - promoters75/1020863
gataatatt

SEQ ID NO: 76394 - DNA, 7 bp, Unknown
  misc_feature (1)..( 7): Result.001 file - promoters75/1020863
aaacaaa

SEQ ID NO: 76395 - DNA, 7 bp, Unknown
  misc_feature (1)..( 7): Result.001 file - promoters75/1020863
aaataaa

SEQ ID NO: 76396 - DNA, 7 bp, Unknown
  misc_feature (1)..( 7): Result.001 file - promoters75/1020863
aaacaaa

SEQ ID NO: 76397 - DNA, 10 bp, Unknown
  misc_feature (1)..( 10): Result.001 file - promoters75/1020863
atattattag

SEQ ID NO: 76398 - DNA, 10 bp, Unknown
  misc_feature (1)..( 10): Result.001 file - promoters75/1020863
atattattag

SEQ ID NO: 76399 - DNA, 10 bp, Unknown
  misc_feature (1)..( 10): Result.001 file - promoters75/1021549
ttattatatt

SEQ ID NO: 76400 - DNA, 11 bp, Unknown
  misc_feature (1)..( 11): Result.001 file - promoters75/1021549
acatatatact

SEQ ID NO: 76401 - DNA, 11 bp, Unknown
  misc_feature (1)..( 11): Result.001 file - promoters75/1021549
gtatatatata

SEQ ID NO: 76402 - DNA, 11 bp, Unknown
  misc_feature (1)..( 11): Result.001 file - promoters75/1021549
aactatataac

SEQ ID NO: 76403 - DNA, 11 bp, Unknown
  misc_feature (1)..( 11): Result.001 file - promoters75/1021549
tggtatataaa

SEQ ID NO: 76404 - DNA, 11 bp, Unknown
  misc_feature (1)..( 11): Result.001 file - promoters75/1021549
cactatttaaa

SEQ ID NO: 76405 - DNA, 11 bp, Unknown
  misc_feature (1)..( 11): Result.001 file - promoters75/1021549
ggttatttagt

SEQ ID NO: 76406 - DNA, 12 bp, Unknown
  misc_feature (1)..( 12): Result.001 file - promoters75/1021549
agttgtacatat

SEQ ID NO: 76407 - DNA, 12 bp, Unknown
  misc_feature (1)..( 12): Result.001 file - promoters75/1021549
acaaatacataa

SEQ ID NO: 76408 - DNA, 12 bp, Unknown
  misc_feature (1)..( 12): Result.001 file - promoters75/1021549
agttatatatat

SEQ ID NO: 76409 - DNA, 12 bp, Unknown
  misc_feature (1)..( 12): Result.001 file - promoters75/1021549
gagcttagatat

SEQ ID NO: 76410 - DNA, 12 bp, Unknown
  misc_feature (1)..( 12): Result.001 file - promoters75/1021549
acagttgtataa

SEQ ID NO: 76411 - DNA, 12 bp, Unknown
  misc_feature (1)..( 12): Result.001 file - promoters75/1021952
atttttggatat

SEQ ID NO: 76412 - DNA, 7 bp, Unknown
  misc_feature (1)..( 7): Result.001 file - promoters75/1021952
ctaaaat

SEQ ID NO: 76413 - DNA, 7 bp, Unknown
  misc_feature (1)..( 7): Result.001 file - promoters75/1021952
ctaaaaa

SEQ ID NO: 76414 - DNA, 7 bp, Unknown
  misc_feature (1)..( 7): Result.001 file - promoters75/1021968
ctaaaaa

SEQ ID NO: 76415 - DNA, 12 bp, Unknown
  misc_feature (1)..( 12): Result.001 file - promoters75/1021968
caacaatgtaca

SEQ ID NO: 76416 - DNA, 12 bp, Unknown
  misc_feature (1)..( 12): Result.001 file - promoters75/1021968
caataatttaca

SEQ ID NO: 76417 - DNA, 12 bp, Unknown
  misc_feature (1)..( 12): Result.001 file - promoters75/1022324
tgaaaatttata

SEQ ID NO: 76418 - DNA, 14 bp, Unknown
  misc_feature (1)..( 14): Result.001 file - promoters75/1022324
agacccaaatgtgc

SEQ ID NO: 76419 - DNA, 14 bp, Unknown
  misc_feature (1)..( 14): Result.001 file - promoters75/1022324
caaccaaaagaatc

SEQ ID NO: 76420 - DNA, 14 bp, Unknown
  misc_feature (1)..( 14): Result.001 file - promoters75/1022324
agatccaccaccga

SEQ ID NO: 76421 - DNA, 14 bp, Unknown
  misc_feature (1)..( 14): Result.001 file - promoters75/1022324
agatcctccgccat

SEQ ID NO: 76422 - DNA, 14 bp, Unknown
  misc_feature (1)..( 14): Result.001 file - promoters75/1022324
ttaacaaaacaatt

SEQ ID NO: 76423 - DNA, 14 bp, Unknown
  misc_feature (1)..( 14): Result.001 file - promoters75/1022662
ccaacgaaacgatt

SEQ ID NO: 76424 - DNA, 11 bp, Unknown
  misc_feature (1)..( 11): Result.001 file - promoters75/1022662
ccatttgtaaa

SEQ ID NO: 76425 - DNA, 11 bp, Unknown
  misc_feature (1)..( 11): Result.001 file - promoters75/1022662
atctttataaa

SEQ ID NO: 76426 - DNA, 11 bp, Unknown
  misc_feature (1)..( 11): Result.001 file - promoters75/1022662
attcttgtaac

SEQ ID NO: 76427 - DNA, 11 bp, Unknown
  misc_feature (1)..( 11): Result.001 file - promoters75/1022662
atctttattta

SEQ ID NO: 76428 - DNA, 10 bp, Unknown
  misc_feature (1)..( 10): Result.001 file - promoters75/1022662
cataaaaact

SEQ ID NO: 76429 - DNA, 10 bp, Unknown
  misc_feature (1)..( 10): Result.001 file - promoters75/1022662
aataaaaatc

SEQ ID NO: 76430 - DNA, 10 bp, Unknown
  misc_feature (1)..( 10): Result.001 file - promoters75/1022748
aatcaaaatc

SEQ ID NO: 76431 - DNA, 16 bp, Unknown
  misc_feature (1)..( 16): Result.001 file - promoters75/1022748
gttcgtatataataaa

SEQ ID NO: 76432 - DNA, 16 bp, Unknown
  misc_feature (1)..( 16): Result.001 file - promoters75/1022748
aagtttttgtaataat

SEQ ID NO: 76433 - DNA, 16 bp, Unknown
  misc_feature (1)..( 16): Result.001 file - promoters75/1022748
ctatttagttaaaaaa

SEQ ID NO: 76434 - DNA, 16 bp, Unknown
  misc_feature (1)..( 16): Result.001 file - promoters75/1022748
ttttacttttaacaaa

SEQ ID NO: 76435 - DNA, 16 bp, Unknown
  misc_feature (1)..( 16): Result.001 file - promoters75/1022748
ttagatttttaatata

SEQ ID NO: 76436 - DNA, 16 bp, Unknown
  misc_feature (1)..( 16): Result.001 file - promoters75/1022748
ttagttttgtaaaaca

SEQ ID NO: 76437 - DNA, 16 bp, Unknown
  misc_feature (1)..( 16): Result.001 file - promoters75/1022748
tgaagtttgaaacaaa

SEQ ID NO: 76438 - DNA, 16 bp, Unknown
  misc_feature (1)..( 16): Result.001 file - promoters75/1022748
tgctgctgaattggaa

SEQ ID NO: 76439 - DNA, 16 bp, Unknown
  misc_feature (1)..( 16): Result.001 file - promoters75/1022748
ctcttatgatttgctt

SEQ ID NO: 76440 - DNA, 16 bp, Unknown
  misc_feature (1)..( 16): Result.001 file - promoters75/1022748
acagcagtattagctt

SEQ ID NO: 76441 - DNA, 16 bp, Unknown
  misc_feature (1)..( 16): Result.001 file - promoters75/1022748
ctcgtataattctttt

SEQ ID NO: 76442 - DNA, 16 bp, Unknown
  misc_feature (1)..( 16): Result.001 file - promoters75/1022748
cttccatgtttttgct

SEQ ID NO: 76443 - DNA, 16 bp, Unknown
  misc_feature (1)..( 16): Result.001 file - promoters75/1022748
tgagtttgatttgatc

SEQ ID NO: 76444 - DNA, 11 bp, Unknown
  misc_feature (1)..( 11): Result.001 file - promoters75/1022748
agaaaagtaag

SEQ ID NO: 76445 - DNA, 11 bp, Unknown
  misc_feature (1)..( 11): Result.001 file - promoters75/1022748
aataaattaat

SEQ ID NO: 76446 - DNA, 11 bp, Unknown
  misc_feature (1)..( 11): Result.001 file - promoters75/1022748
agaaaaataac

SEQ ID NO: 76447 - DNA, 11 bp, Unknown
  misc_feature (1)..( 11): Result.001 file - promoters75/1022748
gagaaaataaa

SEQ ID NO: 76448 - DNA, 11 bp, Unknown
  misc_feature (1)..( 11): Result.001 file - promoters75/1022748
aactagataat

SEQ ID NO: 76449 - DNA, 11 bp, Unknown
  misc_feature (1)..( 11): Result.001 file - promoters75/1022748
ataaaaatttt

SEQ ID NO: 76450 - DNA, 12 bp, Unknown
  misc_feature (1)..( 12): Result.001 file - promoters75/1022748
aaaagtttttgt

SEQ ID NO: 76451 - DNA, 12 bp, Unknown
  misc_feature (1)..( 12): Result.001 file - promoters75/1022748
tttagttttgta

SEQ ID NO: 76452 - DNA, 12 bp, Unknown
  misc_feature (1)..( 12): Result.001 file - promoters75/1022748
tgaagtttgaaa

SEQ ID NO: 76453 - DNA, 12 bp, Unknown
  misc_feature (1)..( 12): Result.001 file - promoters75/1022748
aaaagtgttgag

SEQ ID NO: 76454 - DNA, 13 bp, Unknown
  misc_feature (1)..( 13): Result.001 file - promoters75/1022748
attagatttttaa

SEQ ID NO: 76455 - DNA, 13 bp, Unknown
  misc_feature (1)..( 13): Result.001 file - promoters75/1022932
tttacttttaaca

SEQ ID NO: 76456 - DNA, 8 bp, Unknown
  misc_feature (1)..( 8): Result.001 file - promoters75/1022932
aatctgct

SEQ ID NO: 76457 - DNA, 8 bp, Unknown
  misc_feature (1)..( 8): Result.001 file - promoters75/1022932
catcagct

SEQ ID NO: 76458 - DNA, 8 bp, Unknown
  misc_feature (1)..( 8): Result.001 file - promoters75/1022932
catcagtt

SEQ ID NO: 76459 - DNA, 8 bp, Unknown
  misc_feature (1)..( 8): Result.001 file - promoters75/1022932
tttatgta

SEQ ID NO: 76460 - DNA, 8 bp, Unknown
  misc_feature (1)..( 8): Result.001 file - promoters75/1022932
gttatgtt

SEQ ID NO: 76461 - DNA, 8 bp, Unknown
  misc_feature (1)..( 8): Result.001 file - promoters75/1022932
gttgtgtt

SEQ ID NO: 76462 - DNA, 8 bp, Unknown
  misc_feature (1)..( 8): Result.001 file - promoters75/1022932
aaactttt

SEQ ID NO: 76463 - DNA, 8 bp, Unknown
  misc_feature (1)..( 8): Result.001 file - promoters75/1022932
ttactttt

SEQ ID NO: 76464 - DNA, 8 bp, Unknown
  misc_feature (1)..( 8): Result.001 file - promoters75/1022932
ttacttta

SEQ ID NO: 76465 - DNA, 7 bp, Unknown
  misc_feature (1)..( 7): Result.001 file - promoters75/1022932
ttaattt

SEQ ID NO: 76466 - DNA, 7 bp, Unknown
  misc_feature (1)..( 7): Result.001 file - promoters75/1022932
ttacttt

SEQ ID NO: 76467 - DNA, 7 bp, Unknown
  misc_feature (1)..( 7): Result.001 file - promoters75/1022932
ttacttt

SEQ ID NO: 76468 - DNA, 9 bp, Unknown
  misc_feature (1)..( 9): Result.001 file - promoters75/1022932
tactatata

SEQ ID NO: 76469 - DNA, 9 bp, Unknown
  misc_feature (1)..( 9): Result.001 file - promoters75/1022932
tacaataaa

SEQ ID NO: 76470 - DNA, 9 bp, Unknown
  misc_feature (1)..( 9): Result.001 file - promoters75/1022983
gtcaagaaa

SEQ ID NO: 76471 - DNA, 8 bp, Unknown
  misc_feature (1)..( 8): Result.001 file - promoters75/1022983
atttctta

SEQ ID NO: 76472 - DNA, 8 bp, Unknown
  misc_feature (1)..( 8): Result.001 file - promoters75/1022983
atttctcc

SEQ ID NO: 76473 - DNA, 8 bp, Unknown
  misc_feature (1)..( 8): Result.001 file - promoters75/1022983
ttttatta

SEQ ID NO: 76474 - DNA, 9 bp, Unknown
  misc_feature (1)..( 9): Result.001 file - promoters75/1022983
ttcttattt

SEQ ID NO: 76475 - DNA, 9 bp, Unknown
  misc_feature (1)..( 9): Result.001 file - promoters75/1022983
attttattt

SEQ ID NO: 76476 - DNA, 9 bp, Unknown
  misc_feature (1)..( 9): Result.001 file - promoters75/1022983
attttatta

SEQ ID NO: 76477 - DNA, 10 bp, Unknown
  misc_feature (1)..( 10): Result.001 file - promoters75/1022983
aattgtataa

SEQ ID NO: 76478 - DNA, 10 bp, Unknown
  misc_feature (1)..( 10): Result.001 file - promoters75/1022983
tattttatta

SEQ ID NO: 76479 - DNA, 10 bp, Unknown
  misc_feature (1)..( 10): Result.001 file - promoters75/1023297
tatattatta

SEQ ID NO: 76480 - DNA, 11 bp, Unknown
  misc_feature (1)..( 11): Result.001 file - promoters75/1023297
ctgaagtttct

SEQ ID NO: 76481 - DNA, 11 bp, Unknown
  misc_feature (1)..( 11): Result.001 file - promoters75/1023297
cctaagtttaa

SEQ ID NO: 76482 - DNA, 11 bp, Unknown
  misc_feature (1)..( 11): Result.001 file - promoters75/1023297
gtgatgttttc

SEQ ID NO: 76483 - DNA, 11 bp, Unknown
  misc_feature (1)..( 11): Result.001 file - promoters75/1023297
ttgaggttcac

SEQ ID NO: 76484 - DNA, 11 bp, Unknown
  misc_feature (1)..( 11): Result.001 file - promoters75/1023297
aaaaagtataa

SEQ ID NO: 76485 - DNA, 11 bp, Unknown
  misc_feature (1)..( 11): Result.001 file - promoters75/1023297
aaaaaatatat

SEQ ID NO: 76486 - DNA, 9 bp, Unknown
  misc_feature (1)..( 9): Result.001 file - promoters75/1023297
cttttgtct

SEQ ID NO: 76487 - DNA, 9 bp, Unknown
  misc_feature (1)..( 9): Result.001 file - promoters75/1023297
tttttgttt

SEQ ID NO: 76488 - DNA, 9 bp, Unknown
  misc_feature (1)..( 9): Result.001 file - promoters75/1023297
tatttctct

SEQ ID NO: 76489 - DNA, 9 bp, Unknown
  misc_feature (1)..( 9): Result.001 file - promoters75/1023297
tttttctcg

SEQ ID NO: 76490 - DNA, 9 bp, Unknown
  misc_feature (1)..( 9): Result.001 file - promoters75/1023297
tttatgtaa

SEQ ID NO: 76491 - DNA, 9 bp, Unknown
  misc_feature (1)..( 9): Result.001 file - promoters75/1023453
tttatgcta

SEQ ID NO: 76492 - DNA, 7 bp, Unknown
  misc_feature (1)..( 7): Result.001 file - promoters75/1023453
ctgggaa

SEQ ID NO: 76493 - DNA, 7 bp, Unknown
  misc_feature (1)..( 7): Result.001 file - promoters75/1023453
ctgagaa

SEQ ID NO: 76494 - DNA, 7 bp, Unknown
  misc_feature (1)..( 7): Result.001 file - promoters75/1023453
ctgggaa

SEQ ID NO: 76495 - DNA, 10 bp, Unknown
  misc_feature (1)..( 10): Result.001 file - promoters75/1023453
aaaagaaaga

SEQ ID NO: 76496 - DNA, 10 bp, Unknown
  misc_feature (1)..( 10): Result.001 file - promoters75/1023453
aaaagaaaaa

SEQ ID NO: 76497 - DNA, 11 bp, Unknown
  misc_feature (1)..( 11): Result.001 file - promoters75/1023453
ataagcaaaaa

SEQ ID NO: 76498 - DNA, 12 bp, Unknown
  misc_feature (1)..( 12): Result.001 file - promoters75/1023453
atcctattggtt

SEQ ID NO: 76499 - DNA, 12 bp, Unknown
  misc_feature (1)..( 12): Result.001 file - promoters75/1023453
aatctaatggtt

SEQ ID NO: 76500 - DNA, 12 bp, Unknown
  misc_feature (1)..( 12): Result.001 file - promoters75/1023634
aatctaatctga

SEQ ID NO: 76501 - DNA, 8 bp, Unknown
  misc_feature (1)..( 8): Result.001 file - promoters75/1023634
ttttgaat

SEQ ID NO: 76502 - DNA, 8 bp, Unknown
  misc_feature (1)..( 8): Result.001 file - promoters75/1023634
atttgaat

SEQ ID NO: 76503 - DNA, 8 bp, Unknown
  misc_feature (1)..( 8): Result.001 file - promoters75/1023634
ttttgaca

SEQ ID NO: 76504 - DNA, 11 bp, Unknown
  misc_feature (1)..( 11): Result.001 file - promoters75/1023634
aaactgtgaaa

SEQ ID NO: 76505 - DNA, 11 bp, Unknown
  misc_feature (1)..( 11): Result.001 file - promoters75/1023634
aaaatgtgaaa

SEQ ID NO: 76506 - DNA, 11 bp, Unknown
  misc_feature (1)..( 11): Result.001 file - promoters75/1023634
gctttgtgaaa

SEQ ID NO: 76507 - DNA, 8 bp, Unknown
  misc_feature (1)..( 8): Result.001 file - promoters75/1023634
aacccaaa

SEQ ID NO: 76508 - DNA, 8 bp, Unknown
  misc_feature (1)..( 8): Result.001 file - promoters75/1023634
agcccaaa

SEQ ID NO: 76509 - DNA, 8 bp, Unknown
  misc_feature (1)..( 8): Result.001 file - promoters75/1024015
agcccaat

SEQ ID NO: 76510 - DNA, 14 bp, Unknown
  misc_feature (1)..( 14): Result.001 file - promoters75/1024015
tccatcgaattcaa

SEQ ID NO: 76511 - DNA, 14 bp, Unknown
  misc_feature (1)..( 14): Result.001 file - promoters75/1024015
caaatcaaatcgaa

SEQ ID NO: 76512 - DNA, 14 bp, Unknown
  misc_feature (1)..( 14): Result.001 file - promoters75/1024015
tccctcgaacccga

SEQ ID NO: 76513 - DNA, 14 bp, Unknown
  misc_feature (1)..( 14): Result.001 file - promoters75/1024015
agatgcaaaccaaa

SEQ ID NO: 76514 - DNA, 14 bp, Unknown
  misc_feature (1)..( 14): Result.001 file - promoters75/1024015
atggcaaaaccaaa

SEQ ID NO: 76515 - DNA, 14 bp, Unknown
  misc_feature (1)..( 14): Result.001 file - promoters75/1024015
gcagtcaaatatag

SEQ ID NO: 76516 - DNA, 9 bp, Unknown
  misc_feature (1)..( 9): Result.001 file - promoters75/1024015
aaatcgtta

SEQ ID NO: 76517 - DNA, 9 bp, Unknown
  misc_feature (1)..( 9): Result.001 file - promoters75/1024015
aaatcgaaa

SEQ ID NO: 76518 - DNA, 9 bp, Unknown
  misc_feature (1)..( 9): Result.001 file - promoters75/1024015
gaatcatta

SEQ ID NO: 76519 - DNA, 9 bp, Unknown
  misc_feature (1)..( 9): Result.001 file - promoters75/1024015
aaaccgtat

SEQ ID NO: 76520 - DNA, 9 bp, Unknown
  misc_feature (1)..( 9): Result.001 file - promoters75/1024015
ccatcctta

SEQ ID NO: 76521 - DNA, 9 bp, Unknown
  misc_feature (1)..( 9): Result.001 file - promoters75/1024126
caatcataa

SEQ ID NO: 76522 - DNA, 6 bp, Unknown
  misc_feature (1)..( 6): Result.001 file - promoters75/1024126
aaaaaa

SEQ ID NO: 76523 - DNA, 6 bp, Unknown
  misc_feature (1)..( 6): Result.001 file - promoters75/1024126
aaaaaa

SEQ ID NO: 76524 - DNA, 6 bp, Unknown
  misc_feature (1)..( 6): Result.001 file - promoters75/1024126
aaaaag

SEQ ID NO: 76525 - DNA, 8 bp, Unknown
  misc_feature (1)..( 8): Result.001 file - promoters75/1024126
gttgaaac

SEQ ID NO: 76526 - DNA, 8 bp, Unknown
  misc_feature (1)..( 8): Result.001 file - promoters75/1024126
attgaaaa

SEQ ID NO: 76527 - DNA, 8 bp, Unknown
  misc_feature (1)..( 8): Result.001 file - promoters75/1024126
attcaaaa

SEQ ID NO: 76528 - DNA, 15 bp, Unknown
  misc_feature (1)..( 15): Result.001 file - promoters75/1024126
tcaaatcccacagtt

SEQ ID NO: 76529 - DNA, 15 bp, Unknown
  misc_feature (1)..( 15): Result.001 file - promoters75/1024126
tcaaattccacggtt

SEQ ID NO: 76530 - DNA, 15 bp, Unknown
  misc_feature (1)..( 15): Result.001 file - promoters75/1024126
ggccagaacacggta

SEQ ID NO: 76531 - DNA, 10 bp, Unknown
  misc_feature (1)..( 10): Result.001 file - promoters75/1024126
attgaaaaat

SEQ ID NO: 76532 - DNA, 10 bp, Unknown
  misc_feature (1)..( 10): Result.001 file - promoters75/1024126
gaagaagaat

SEQ ID NO: 76533 - DNA, 10 bp, Unknown
  misc_feature (1)..( 10): Result.001 file - promoters75/1024126
attcaaaatt

SEQ ID NO: 76534 - DNA, 8 bp, Unknown
  misc_feature (1)..( 8): Result.001 file - promoters75/1024126
atgattaa

SEQ ID NO: 76535 - DNA, 8 bp, Unknown
  misc_feature (1)..( 8): Result.001 file - promoters75/1024126
atgattcc

SEQ ID NO: 76536 - DNA, 8 bp, Unknown
  misc_feature (1)..( 8): Result.001 file - promoters75/1024126
atgcttaa

SEQ ID NO: 76537 - DNA, 7 bp, Unknown
  misc_feature (1)..( 7): Result.001 file - promoters75/1024126
ataatat

SEQ ID NO: 76538 - DNA, 7 bp, Unknown
  misc_feature (1)..( 7): Result.001 file - promoters75/1024126
atattat

SEQ ID NO: 76539 - DNA, 7 bp, Unknown
  misc_feature (1)..( 7): Result.001 file - promoters75/1024126
ttattat

SEQ ID NO: 76540 - DNA, 7 bp, Unknown
  misc_feature (1)..( 7): Result.001 file - promoters75/1024126
tatttat

SEQ ID NO: 76541 - DNA, 7 bp, Unknown
  misc_feature (1)..( 7): Result.001 file - promoters75/1024126
tatttaa

SEQ ID NO: 76542 - DNA, 7 bp, Unknown
  misc_feature (1)..( 7): Result.001 file - promoters75/1024189
catttaa

SEQ ID NO: 76543 - DNA, 9 bp, Unknown
  misc_feature (1)..( 9): Result.001 file - promoters75/1024189
aaaaatgaa

SEQ ID NO: 76544 - DNA, 9 bp, Unknown
  misc_feature (1)..( 9): Result.001 file - promoters75/1024189
aaaaaagaa

SEQ ID NO: 76545 - DNA, 9 bp, Unknown
  misc_feature (1)..( 9): Result.001 file - promoters75/1024189
gaaaaaggg

SEQ ID NO: 76546 - DNA, 8 bp, Unknown
  misc_feature (1)..( 8): Result.001 file - promoters75/1024189
ttttatca

SEQ ID NO: 76547 - DNA, 8 bp, Unknown
  misc_feature (1)..( 8): Result.001 file - promoters75/1024189
ttttgtca

SEQ ID NO: 76548 - DNA, 8 bp, Unknown
  misc_feature (1)..( 8): Result.001 file - promoters75/1024189
ttttgtat

SEQ ID NO: 76549 - DNA, 8 bp, Unknown
  misc_feature (1)..( 8): Result.001 file - promoters75/1024189
atatatat

SEQ ID NO: 76550 - DNA, 8 bp, Unknown
  misc_feature (1)..( 8): Result.001 file - promoters75/1024189
atatttat

SEQ ID NO: 76551 - DNA, 8 bp, Unknown
  misc_feature (1)..( 8): Result.001 file - promoters75/1024189
taatttat

SEQ ID NO: 76552 - DNA, 7 bp, Unknown
  misc_feature (1)..( 7): Result.001 file - promoters75/1024189
aatcaaa

SEQ ID NO: 76553 - DNA, 7 bp, Unknown
  misc_feature (1)..( 7): Result.001 file - promoters75/1024189
aatcaaa

SEQ ID NO: 76554 - DNA, 8 bp, Unknown
  misc_feature (1)..( 8): Result.001 file - promoters75/1024189
gatccaaa

SEQ ID NO: 76555 - DNA, 7 bp, Unknown
  misc_feature (1)..( 7): Result.001 file - promoters75/1024189
actatac

SEQ ID NO: 76556 - DNA, 7 bp, Unknown
  misc_feature (1)..( 7): Result.001 file - promoters75/1024189
actttac

SEQ ID NO: 76557 - DNA, 7 bp, Unknown
  misc_feature (1)..( 7): Result.001 file - promoters75/1024189
tctttac

SEQ ID NO: 76558 - DNA, 7 bp, Unknown
  misc_feature (1)..( 7): Result.001 file - promoters75/1024189
tataata

SEQ ID NO: 76559 - DNA, 7 bp, Unknown
  misc_feature (1)..( 7): Result.001 file - promoters75/1024189
tattata

SEQ ID NO: 76560 - DNA, 7 bp, Unknown
  misc_feature (1)..( 7): Result.001 file - promoters75/1024199
tataata

SEQ ID NO: 76561 - DNA, 9 bp, Unknown
  misc_feature (1)..( 9): Result.001 file - promoters75/1024199
gaactaaat

SEQ ID NO: 76562 - DNA, 9 bp, Unknown
  misc_feature (1)..( 9): Result.001 file - promoters75/1024199
aaacaaaaa

SEQ ID NO: 76563 - DNA, 9 bp, Unknown
  misc_feature (1)..( 9): Result.001 file - promoters75/1024199
aaacaaagt

SEQ ID NO: 76564 - DNA, 9 bp, Unknown
  misc_feature (1)..( 9): Result.001 file - promoters75/1024199
aaacaacat

SEQ ID NO: 76565 - DNA, 9 bp, Unknown
  misc_feature (1)..( 9): Result.001 file - promoters75/1024234
caacaacaa

SEQ ID NO: 76566 - DNA, 13 bp, Unknown
  misc_feature (1)..( 13): Result.001 file - promoters75/1024234
taaatttaaaaat

SEQ ID NO: 76567 - DNA, 13 bp, Unknown
  misc_feature (1)..( 13): Result.001 file - promoters75/1024234
ttgattcaaaatt

SEQ ID NO: 76568 - DNA, 13 bp, Unknown
  misc_feature (1)..( 13): Result.001 file - promoters75/1024236
ttgaatcaatatt

SEQ ID NO: 76569 - DNA, 10 bp, Unknown
  misc_feature (1)..( 10): Result.001 file - promoters75/1024236
tatatatata

SEQ ID NO: 76570 - DNA, 10 bp, Unknown
  misc_feature (1)..( 10): Result.001 file - promoters75/1024236
tatttatata

SEQ ID NO: 76571 - DNA, 10 bp, Unknown
  misc_feature (1)..( 10): Result.001 file - promoters75/1024236
tatttaaagc

SEQ ID NO: 76572 - DNA, 10 bp, Unknown
  misc_feature (1)..( 10): Result.001 file - promoters75/1024236
tatataaaga

SEQ ID NO: 76573 - DNA, 10 bp, Unknown
  misc_feature (1)..( 10): Result.001 file - promoters75/1024236
aatataaagg

SEQ ID NO: 76574 - DNA, 10 bp, Unknown
  misc_feature (1)..( 10): Result.001 file - promoters75/1024367
actataaagg

SEQ ID NO: 76575 - DNA, 9 bp, Unknown
  misc_feature (1)..( 9): Result.001 file - promoters75/1024367
attaacttt

SEQ ID NO: 76576 - DNA, 9 bp, Unknown
  misc_feature (1)..( 9): Result.001 file - promoters75/1024367
cataagttt

SEQ ID NO: 76577 - DNA, 9 bp, Unknown
  misc_feature (1)..( 9): Result.001 file - promoters75/1024367
attaactta

SEQ ID NO: 76578 - DNA, 6 bp, Unknown
  misc_feature (1)..( 6): Result.001 file - promoters75/1024367
tatata

SEQ ID NO: 76579 - DNA, 6 bp, Unknown
  misc_feature (1)..( 6): Result.001 file - promoters75/1024367
tatata

SEQ ID NO: 76580 - DNA, 6 bp, Unknown
  misc_feature (1)..( 6): Result.001 file - promoters75/1024367
tatata

SEQ ID NO: 76581 - DNA, 10 bp, Unknown
  misc_feature (1)..( 10): Result.001 file - promoters75/1024367
ttagaaacta

SEQ ID NO: 76582 - DNA, 10 bp, Unknown
  misc_feature (1)..( 10): Result.001 file - promoters75/1024367
ttaaaaaaaa

SEQ ID NO: 76583 - DNA, 10 bp, Unknown
  misc_feature (1)..( 10): Result.001 file - promoters75/1024367
cgaaaaaaaa

SEQ ID NO: 76584 - DNA, 10 bp, Unknown
  misc_feature (1)..( 10): Result.001 file - promoters75/1024367
attgcatttt

SEQ ID NO: 76585 - DNA, 10 bp, Unknown
  misc_feature (1)..( 10): Result.001 file - promoters75/1024367
tttgaatttt

SEQ ID NO: 76586 - DNA, 10 bp, Unknown
  misc_feature (1)..( 10): Result.001 file - promoters75/1024367
ttttaatttg

SEQ ID NO: 76587 - DNA, 14 bp, Unknown
  misc_feature (1)..( 14): Result.001 file - promoters75/1024367
gatcctcgaaactc

SEQ ID NO: 76588 - DNA, 14 bp, Unknown
  misc_feature (1)..( 14): Result.001 file - promoters75/1024367
cttcctcgcaactc

SEQ ID NO: 76589 - DNA, 14 bp, Unknown
  misc_feature (1)..( 14): Result.001 file - promoters75/1024499
cttcctctctccaa

SEQ ID NO: 76590 - DNA, 10 bp, Unknown
  misc_feature (1)..( 10): Result.001 file - promoters75/1024499
ctataaatag

SEQ ID NO: 76591 - DNA, 10 bp, Unknown
  misc_feature (1)..( 10): Result.001 file - promoters75/1024499
ctataaaaaa

SEQ ID NO: 76592 - DNA, 10 bp, Unknown
  misc_feature (1)..( 10): Result.001 file - promoters75/1024853
atataaatag

SEQ ID NO: 76593 - DNA, 12 bp, Unknown
  misc_feature (1)..( 12): Result.001 file - promoters75/1024853
ccatcttcttta

SEQ ID NO: 76594 - DNA, 12 bp, Unknown
  misc_feature (1)..( 12): Result.001 file - promoters75/1024853
cacccttcttta

SEQ ID NO: 76595 - DNA, 12 bp, Unknown
  misc_feature (1)..( 12): Result.001 file - promoters75/1024853
ctaccttttttt

SEQ ID NO: 76596 - DNA, 12 bp, Unknown
  misc_feature (1)..( 12): Result.001 file - promoters75/1024853
aactcttattta

SEQ ID NO: 76597 - DNA, 12 bp, Unknown
  misc_feature (1)..( 12): Result.001 file - promoters75/1024853
tataattctttt

SEQ ID NO: 76598 - DNA, 12 bp, Unknown
  misc_feature (1)..( 12): Result.001 file - promoters75/1024853
aatccttaatca

SEQ ID NO: 76599 - DNA, 10 bp, Unknown
  misc_feature (1)..( 10): Result.001 file - promoters75/1024853
aaaactaaaa

SEQ ID NO: 76600 - DNA, 10 bp, Unknown
  misc_feature (1)..( 10): Result.001 file - promoters75/1024853
aaaaccaaag

SEQ ID NO: 76601 - DNA, 9 bp, Unknown
  misc_feature (1)..( 9): Result.001 file - promoters75/1024853
gaacaaaaa

SEQ ID NO: 76602 - DNA, 10 bp, Unknown
  misc_feature (1)..( 10): Result.001 file - promoters75/1024853
gtaactaaaa

SEQ ID NO: 76603 - DNA, 10 bp, Unknown
  misc_feature (1)..( 10): Result.001 file - promoters75/1024853
caaatcaaat

SEQ ID NO: 76604 - DNA, 11 bp, Unknown
  misc_feature (1)..( 11): Result.001 file - promoters75/1024853
tcatgtcaaat

SEQ ID NO: 76605 - DNA, 11 bp, Unknown
  misc_feature (1)..( 11): Result.001 file - promoters75/1024853
tacacacaaag

SEQ ID NO: 76606 - DNA, 19 bp, Unknown
  misc_feature (1)..( 19): Result.001 file - promoters75/1024853
tggtggaaaatgttaaacc

SEQ ID NO: 76607 - DNA, 19 bp, Unknown
  misc_feature (1)..( 19): Result.001 file - promoters75/1024853
tatacaaaaatgtaatttt

SEQ ID NO: 76608 - DNA, 19 bp, Unknown
  misc_feature (1)..( 19): Result.001 file - promoters75/1024853
ttttttctaatgaaatttt

SEQ ID NO: 76609 - DNA, 19 bp, Unknown
  misc_feature (1)..( 19): Result.001 file - promoters75/1024853
tttaataaaaaaatataga

SEQ ID NO: 76610 - DNA, 19 bp, Unknown
  misc_feature (1)..( 19): Result.001 file - promoters75/1024853
tttaataaatcaaaggggt

SEQ ID NO: 76611 - DNA, 19 bp, Unknown
  misc_feature (1)..( 19): Result.001 file - promoters75/1024889
gccgtttgaatttgatcgg

SEQ ID NO: 76612 - DNA, 11 bp, Unknown
  misc_feature (1)..( 11): Result.001 file - promoters75/1024889
ttttaaattat

SEQ ID NO: 76613 - DNA, 11 bp, Unknown
  misc_feature (1)..( 11): Result.001 file - promoters75/1024889
tttttaattat

SEQ ID NO: 76614 - DNA, 11 bp, Unknown
  misc_feature (1)..( 11): Result.001 file - promoters75/1024889
actaaaattag

SEQ ID NO: 76615 - DNA, 7 bp, Unknown
  misc_feature (1)..( 7): Result.001 file - promoters75/1024889
tcataat

SEQ ID NO: 76616 - DNA, 7 bp, Unknown
  misc_feature (1)..( 7): Result.001 file - promoters75/1024889
tcataaa

SEQ ID NO: 76617 - DNA, 7 bp, Unknown
  misc_feature (1)..( 7): Result.001 file - promoters75/1024889
tcaaaaa

SEQ ID NO: 76618 - DNA, 9 bp, Unknown
  misc_feature (1)..( 9): Result.001 file - promoters75/1024889
gaaggtttt

SEQ ID NO: 76619 - DNA, 9 bp, Unknown
  misc_feature (1)..( 9): Result.001 file - promoters75/1024889
aaagttttt

SEQ ID NO: 76620 - DNA, 9 bp, Unknown
  misc_feature (1)..( 9): Result.001 file - promoters75/1024993
aaactttag

SEQ ID NO: 76621 - DNA, 9 bp, Unknown
  misc_feature (1)..( 9): Result.001 file - promoters75/1024993
aaaaagctg

SEQ ID NO: 76622 - DNA, 9 bp, Unknown
  misc_feature (1)..( 9): Result.001 file - promoters75/1024993
aaaaaggtt

SEQ ID NO: 76623 - DNA, 9 bp, Unknown
  misc_feature (1)..( 9): Result.001 file - promoters75/1024993
aaataggtg

SEQ ID NO: 76624 - DNA, 9 bp, Unknown
  misc_feature (1)..( 9): Result.001 file - promoters75/1025471
ttttaggtg

SEQ ID NO: 76625 - DNA, 14 bp, Unknown
  misc_feature (1)..( 14): Result.001 file - promoters75/1025471
tatagtaaaaaaaa

SEQ ID NO: 76626 - DNA, 14 bp, Unknown
  misc_feature (1)..( 14): Result.001 file - promoters75/1025471
cactctaaaaaaaa

SEQ ID NO: 76627 - DNA, 14 bp, Unknown
  misc_feature (1)..( 14): Result.001 file - promoters75/1025471
aatagtgaaaattg

SEQ ID NO: 76628 - DNA, 14 bp, Unknown
  misc_feature (1)..( 14): Result.001 file - promoters75/1025471
tatagcaaaaaact

SEQ ID NO: 76629 - DNA, 14 bp, Unknown
  misc_feature (1)..( 14): Result.001 file - promoters75/1025471
aagaagaaaaaaat

SEQ ID NO: 76630 - DNA, 14 bp, Unknown
  misc_feature (1)..( 14): Result.001 file - promoters75/1025471
aatatcaaaggtct

SEQ ID NO: 76631 - DNA, 9 bp, Unknown
  misc_feature (1)..( 9): Result.001 file - promoters75/1025471
caaaaaaga

SEQ ID NO: 76632 - DNA, 9 bp, Unknown
  misc_feature (1)..( 9): Result.001 file - promoters75/1025471
taaaaaagt

SEQ ID NO: 76633 - DNA, 9 bp, Unknown
  misc_feature (1)..( 9): Result.001 file - promoters75/1025471
gaaaatagt

SEQ ID NO: 76634 - DNA, 9 bp, Unknown
  misc_feature (1)..( 9): Result.001 file - promoters75/1025471
taaaaaaaa

SEQ ID NO: 76635 - DNA, 9 bp, Unknown
  misc_feature (1)..( 9): Result.001 file - promoters75/1025471
taataaatt

SEQ ID NO: 76636 - DNA, 9 bp, Unknown
  misc_feature (1)..( 9): Result.001 file - promoters75/1025683
gaataaaaa

SEQ ID NO: 76637 - DNA, 9 bp, Unknown
  misc_feature (1)..( 9): Result.001 file - promoters75/1025683
agagaatac

SEQ ID NO: 76638 - DNA, 9 bp, Unknown
  misc_feature (1)..( 9): Result.001 file - promoters75/1025683
agaaaatta

SEQ ID NO: 76639 - DNA, 9 bp, Unknown
  misc_feature (1)..( 9): Result.001 file - promoters75/1025683
agaacattg

SEQ ID NO: 76640 - DNA, 9 bp, Unknown
  misc_feature (1)..( 9): Result.001 file - promoters75/1025683
tctacattg

SEQ ID NO: 76641 - DNA, 10 bp, Unknown
  misc_feature (1)..( 10): Result.001 file - promoters75/1025683
cctttataaa

SEQ ID NO: 76642 - DNA, 10 bp, Unknown
  misc_feature (1)..( 10): Result.001 file - promoters75/1025683
cctatatata

SEQ ID NO: 76643 - DNA, 10 bp, Unknown
  misc_feature (1)..( 10): Result.001 file - promoters75/1025683
gtcttataaa

SEQ ID NO: 76644 - DNA, 14 bp, Unknown
  misc_feature (1)..( 14): Result.001 file - promoters75/1025683
atcgaatcagctaa

SEQ ID NO: 76645 - DNA, 14 bp, Unknown
  misc_feature (1)..( 14): Result.001 file - promoters75/1025683
tatgaatctgctaa

SEQ ID NO: 76646 - DNA, 14 bp, Unknown
  misc_feature (1)..( 14): Result.001 file - promoters75/1026622
tatgaatcatgtca

SEQ ID NO: 76647 - DNA, 8 bp, Unknown
  misc_feature (1)..( 8): Result.001 file - promoters75/1026622
aaattttc

SEQ ID NO: 76648 - DNA, 8 bp, Unknown
  misc_feature (1)..( 8): Result.001 file - promoters75/1026622
aaattttt

SEQ ID NO: 76649 - DNA, 8 bp, Unknown
  misc_feature (1)..( 8): Result.001 file - promoters75/1026622
cgattttc

SEQ ID NO: 76650 - DNA, 8 bp, Unknown
  misc_feature (1)..( 8): Result.001 file - promoters75/1026622
gcacacaa

SEQ ID NO: 76651 - DNA, 8 bp, Unknown
  misc_feature (1)..( 8): Result.001 file - promoters75/1026622
agacacaa

SEQ ID NO: 76652 - DNA, 8 bp, Unknown
  misc_feature (1)..( 8): Result.001 file - promoters75/1026622
agaaacaa

SEQ ID NO: 76653 - DNA, 8 bp, Unknown
  misc_feature (1)..( 8): Result.001 file - promoters75/1026622
acaattta

SEQ ID NO: 76654 - DNA, 8 bp, Unknown
  misc_feature (1)..( 8): Result.001 file - promoters75/1026622
acattttt

SEQ ID NO: 76655 - DNA, 8 bp, Unknown
  misc_feature (1)..( 8): Result.001 file - promoters75/1026705
tcattttt

SEQ ID NO: 76656 - DNA, 11 bp, Unknown
  misc_feature (1)..( 11): Result.001 file - promoters75/1026705
gaagatgtgaa

SEQ ID NO: 76657 - DNA, 11 bp, Unknown
  misc_feature (1)..( 11): Result.001 file - promoters75/1026705
gaaaatgggga

SEQ ID NO: 76658 - DNA, 11 bp, Unknown
  misc_feature (1)..( 11): Result.001 file - promoters75/1026883
agagatatgaa

SEQ ID NO: 76659 - DNA, 7 bp, Unknown
  misc_feature (1)..( 7): Result.001 file - promoters75/1026883
tgagaac

SEQ ID NO: 76660 - DNA, 7 bp, Unknown
  misc_feature (1)..( 7): Result.001 file - promoters75/1026883
tgaaaac

SEQ ID NO: 76661 - DNA, 7 bp, Unknown
  misc_feature (1)..( 7): Result.001 file - promoters75/1026883
agaaaac

SEQ ID NO: 76662 - DNA, 9 bp, Unknown
  misc_feature (1)..( 9): Result.001 file - promoters75/1026883
attagatta

SEQ ID NO: 76663 - DNA, 9 bp, Unknown
  misc_feature (1)..( 9): Result.001 file - promoters75/1026883
catagttta

SEQ ID NO: 76664 - DNA, 9 bp, Unknown
  misc_feature (1)..( 9): Result.001 file - promoters75/1026883
attggatta

SEQ ID NO: 76665 - DNA, 9 bp, Unknown
  misc_feature (1)..( 9): Result.001 file - promoters75/1026883
tcaaataat

SEQ ID NO: 76666 - DNA, 9 bp, Unknown
  misc_feature (1)..( 9): Result.001 file - promoters75/1026883
gaaaacaat

SEQ ID NO: 76667 - DNA, 9 bp, Unknown
  misc_feature (1)..( 9): Result.001 file - promoters75/1026883
acaaattta

SEQ ID NO: 76668 - DNA, 9 bp, Unknown
  misc_feature (1)..( 9): Result.001 file - promoters75/1026883
atttgtctt

SEQ ID NO: 76669 - DNA, 9 bp, Unknown
  misc_feature (1)..( 9): Result.001 file - promoters75/1026883
atttatcta

SEQ ID NO: 76670 - DNA, 9 bp, Unknown
  misc_feature (1)..( 9): Result.001 file - promoters75/1026983
ttttgttta

SEQ ID NO: 76671 - DNA, 7 bp, Unknown
  misc_feature (1)..( 7): Result.001 file - promoters75/1026983
tttcaac

SEQ ID NO: 76672 - DNA, 7 bp, Unknown
  misc_feature (1)..( 7): Result.001 file - promoters75/1026983
tttcaat

SEQ ID NO: 76673 - DNA, 7 bp, Unknown
  misc_feature (1)..( 7): Result.001 file - promoters75/1026987
attcaac

SEQ ID NO: 76674 - DNA, 11 bp, Unknown
  misc_feature (1)..( 11): Result.001 file - promoters75/1026987
ttgttttcttt

SEQ ID NO: 76675 - DNA, 11 bp, Unknown
  misc_feature (1)..( 11): Result.001 file - promoters75/1026987
tattttacttt

SEQ ID NO: 76676 - DNA, 11 bp, Unknown
  misc_feature (1)..( 11): Result.001 file - promoters75/1026987
tatgttaattt

SEQ ID NO: 76677 - DNA, 11 bp, Unknown
  misc_feature (1)..( 11): Result.001 file - promoters75/1026987
tatgtaaacgt

SEQ ID NO: 76678 - DNA, 11 bp, Unknown
  misc_feature (1)..( 11): Result.001 file - promoters75/1026987
tatttaaaaag

SEQ ID NO: 76679 - DNA, 12 bp, Unknown
  misc_feature (1)..( 12): Result.001 file - promoters75/1026987
attttagaaaga

SEQ ID NO: 76680 - DNA, 8 bp, Unknown
  misc_feature (1)..( 8): Result.001 file - promoters75/1026987
tttgtttt

SEQ ID NO: 76681 - DNA, 8 bp, Unknown
  misc_feature (1)..( 8): Result.001 file - promoters75/1026987
tttgattt

SEQ ID NO: 76682 - DNA, 8 bp, Unknown
  misc_feature (1)..( 8): Result.001 file - promoters75/1026987
tgtatttt

SEQ ID NO: 76683 - DNA, 8 bp, Unknown
  misc_feature (1)..( 8): Result.001 file - promoters75/1026987
aaaacaaa

SEQ ID NO: 76684 - DNA, 8 bp, Unknown
  misc_feature (1)..( 8): Result.001 file - promoters75/1026987
aaaacatt

SEQ ID NO: 76685 - DNA, 8 bp, Unknown
  misc_feature (1)..( 8): Result.001 file - promoters75/1027327
gaaacatt

SEQ ID NO: 76686 - DNA, 11 bp, Unknown
  misc_feature (1)..( 11): Result.001 file - promoters75/1027327
ttggaaaagac

SEQ ID NO: 76687 - DNA, 11 bp, Unknown
  misc_feature (1)..( 11): Result.001 file - promoters75/1027327
ttgtaaatgtt

SEQ ID NO: 76688 - DNA, 11 bp, Unknown
  misc_feature (1)..( 11): Result.001 file - promoters75/1027327
ttgtaaatgtt

SEQ ID NO: 76689 - DNA, 7 bp, Unknown
  misc_feature (1)..( 7): Result.001 file - promoters75/1027327
tttcatt

SEQ ID NO: 76690 - DNA, 7 bp, Unknown
  misc_feature (1)..( 7): Result.001 file - promoters75/1027327
attcatt

SEQ ID NO: 76691 - DNA, 7 bp, Unknown
  misc_feature (1)..( 7): Result.001 file - promoters75/1027327
tttgatt

SEQ ID NO: 76692 - DNA, 12 bp, Unknown
  misc_feature (1)..( 12): Result.001 file - promoters75/1027327
attaataagggt

SEQ ID NO: 76693 - DNA, 12 bp, Unknown
  misc_feature (1)..( 12): Result.001 file - promoters75/1027327
attaatgggctt

SEQ ID NO: 76694 - DNA, 12 bp, Unknown
  misc_feature (1)..( 12): Result.001 file - promoters75/1027327
gttaatgggctt

SEQ ID NO: 76695 - DNA, 8 bp, Unknown
  misc_feature (1)..( 8): Result.001 file - promoters75/1027327
atagagaa

SEQ ID NO: 76696 - DNA, 8 bp, Unknown
  misc_feature (1)..( 8): Result.001 file - promoters75/1027327
ataaagag

SEQ ID NO: 76697 - DNA, 8 bp, Unknown
  misc_feature (1)..( 8): Result.001 file - promoters75/1027327
gcagagaa

SEQ ID NO: 76698 - DNA, 8 bp, Unknown
  misc_feature (1)..( 8): Result.001 file - promoters75/1027327
caagcaaa

SEQ ID NO: 76699 - DNA, 8 bp, Unknown
  misc_feature (1)..( 8): Result.001 file - promoters75/1027327
caatcaat

SEQ ID NO: 76700 - DNA, 8 bp, Unknown
  misc_feature (1)..( 8): Result.001 file - promoters75/1027760
gaagaaaa

SEQ ID NO: 76701 - DNA, 10 bp, Unknown
  misc_feature (1)..( 10): Result.001 file - promoters75/1027760
tataataatt

SEQ ID NO: 76702 - DNA, 10 bp, Unknown
  misc_feature (1)..( 10): Result.001 file - promoters75/1027760
tatattaaat

SEQ ID NO: 76703 - DNA, 10 bp, Unknown
  misc_feature (1)..( 10): Result.001 file - promoters75/1027760
ttaattaaat

SEQ ID NO: 76704 - DNA, 12 bp, Unknown
  misc_feature (1)..( 12): Result.001 file - promoters75/1027760
ataaatgaaatt

SEQ ID NO: 76705 - DNA, 12 bp, Unknown
  misc_feature (1)..( 12): Result.001 file - promoters75/1027760
atacatgaattt

SEQ ID NO: 76706 - DNA, 12 bp, Unknown
  misc_feature (1)..( 12): Result.001 file - promoters75/1027760
ataactgagatt

SEQ ID NO: 76707 - DNA, 12 bp, Unknown
  misc_feature (1)..( 12): Result.001 file - promoters75/1027760
aaacaagaaaaa

SEQ ID NO: 76708 - DNA, 8 bp, Unknown
  misc_feature (1)..( 8): Result.001 file - promoters75/1027760
tcactttt

SEQ ID NO: 76709 - DNA, 8 bp, Unknown
  misc_feature (1)..( 8): Result.001 file - promoters75/1027760
tcattttt

SEQ ID NO: 76710 - DNA, 8 bp, Unknown
  misc_feature (1)..( 8): Result.001 file - promoters75/1027760
ccattttg

SEQ ID NO: 76711 - DNA, 7 bp, Unknown
  misc_feature (1)..( 7): Result.001 file - promoters75/1027760
agacacg

SEQ ID NO: 76712 - DNA, 7 bp, Unknown
  misc_feature (1)..( 7): Result.001 file - promoters75/1027760
agaaacg

SEQ ID NO: 76713 - DNA, 7 bp, Unknown
  misc_feature (1)..( 7): Result.001 file - promoters75/1027760
tgaaacg

SEQ ID NO: 76714 - DNA, 14 bp, Unknown
  misc_feature (1)..( 14): Result.001 file - promoters75/1027760
atatataagatgta

SEQ ID NO: 76715 - DNA, 14 bp, Unknown
  misc_feature (1)..( 14): Result.001 file - promoters75/1027760
ataaatattgttaa

SEQ ID NO: 76716 - DNA, 14 bp, Unknown
  misc_feature (1)..( 14): Result.001 file - promoters75/1027760
ttaaattttggtaa

SEQ ID NO: 76717 - DNA, 12 bp, Unknown
  misc_feature (1)..( 12): Result.001 file - promoters75/1027760
gattattttttt

SEQ ID NO: 76718 - DNA, 12 bp, Unknown
  misc_feature (1)..( 12): Result.001 file - promoters75/1027760
ttgaattttttt

SEQ ID NO: 76719 - DNA, 12 bp, Unknown
  misc_feature (1)..( 12): Result.001 file - promoters75/1027760
aacaattttagt

SEQ ID NO: 76720 - DNA, 12 bp, Unknown
  misc_feature (1)..( 12): Result.001 file - promoters75/1027760
aaccattttatg

SEQ ID NO: 76721 - DNA, 9 bp, Unknown
  misc_feature (1)..( 9): Result.001 file - promoters75/1027760
attagtttt

SEQ ID NO: 76722 - DNA, 9 bp, Unknown
  misc_feature (1)..( 9): Result.001 file - promoters75/1027760
attactttt

SEQ ID NO: 76723 - DNA, 9 bp, Unknown
  misc_feature (1)..( 9): Result.001 file - promoters75/1027760
tttaatttt

SEQ ID NO: 76724 - DNA, 8 bp, Unknown
  misc_feature (1)..( 8): Result.001 file - promoters75/1027760
agaaaaat

SEQ ID NO: 76725 - DNA, 8 bp, Unknown
  misc_feature (1)..( 8): Result.001 file - promoters75/1027760
tgaataat

SEQ ID NO: 76726 - DNA, 8 bp, Unknown
  misc_feature (1)..( 8): Result.001 file - promoters75/1027760
agaaaatc

SEQ ID NO: 76727 - DNA, 8 bp, Unknown
  misc_feature (1)..( 8): Result.001 file - promoters75/1027760
ttttccac

SEQ ID NO: 76728 - DNA, 8 bp, Unknown
  misc_feature (1)..( 8): Result.001 file - promoters75/1027760
tttaccaa

SEQ ID NO: 76729 - DNA, 8 bp, Unknown
  misc_feature (1)..( 8): Result.001 file - promoters75/1027760
gttatcaa

SEQ ID NO: 76730 - DNA, 9 bp, Unknown
  misc_feature (1)..( 9): Result.001 file - promoters75/1027760
ataatttac

SEQ ID NO: 76731 - DNA, 9 bp, Unknown
  misc_feature (1)..( 9): Result.001 file - promoters75/1027760
atattttgt

SEQ ID NO: 76732 - DNA, 9 bp, Unknown
  misc_feature (1)..( 9): Result.001 file - promoters75/1028368
ttaagttac

SEQ ID NO: 76733 - DNA, 9 bp, Unknown
  misc_feature (1)..( 9): Result.001 file - promoters75/1028368
gcgttttct

SEQ ID NO: 76734 - DNA, 9 bp, Unknown
  misc_feature (1)..( 9): Result.001 file - promoters75/1028368
ttgttttct

SEQ ID NO: 76735 - DNA, 9 bp, Unknown
  misc_feature (1)..( 9): Result.001 file - promoters75/1029485
ttgttttga

SEQ ID NO: 76736 - DNA, 9 bp, Unknown
  misc_feature (1)..( 9): Result.001 file - promoters75/1029485
caaacaaaa

SEQ ID NO: 76737 - DNA, 9 bp, Unknown
  misc_feature (1)..( 9): Result.001 file - promoters75/1029485
taaagaaaa

SEQ ID NO: 76738 - DNA, 9 bp, Unknown
  misc_feature (1)..( 9): Result.001 file - promoters75/1029485
gaaacaaag

SEQ ID NO: 76739 - DNA, 9 bp, Unknown
  misc_feature (1)..( 9): Result.001 file - promoters75/1029485
caaagaaat

SEQ ID NO: 76740 - DNA, 9 bp, Unknown
  misc_feature (1)..( 9): Result.001 file - promoters75/1029485
tcgacaaaa

SEQ ID NO: 76741 - DNA, 9 bp, Unknown
  misc_feature (1)..( 9): Result.001 file - promoters75/1029485
gtaagaaaa

SEQ ID NO: 76742 - DNA, 11 bp, Unknown
  misc_feature (1)..( 11): Result.001 file - promoters75/1029485
tttagttttgt

SEQ ID NO: 76743 - DNA, 11 bp, Unknown
  misc_feature (1)..( 11): Result.001 file - promoters75/1029485
aaaagtgttga

SEQ ID NO: 76744 - DNA, 11 bp, Unknown
  misc_feature (1)..( 11): Result.001 file - promoters75/1029485
aaaagtttttg

SEQ ID NO: 76745 - DNA, 11 bp, Unknown
  misc_feature (1)..( 11): Result.001 file - promoters75/1029485
tttacttttaa

SEQ ID NO: 76746 - DNA, 11 bp, Unknown
  misc_feature (1)..( 11): Result.001 file - promoters75/1029485
aacgttgttga

SEQ ID NO: 76747 - DNA, 11 bp, Unknown
  misc_feature (1)..( 11): Result.001 file - promoters75/1029485
gaaaggtttct

SEQ ID NO: 76748 - DNA, 12 bp, Unknown
  misc_feature (1)..( 12): Result.001 file - promoters75/1029485
ttggattattat

SEQ ID NO: 76749 - DNA, 12 bp, Unknown
  misc_feature (1)..( 12): Result.001 file - promoters75/1029485
ctccatttttat

SEQ ID NO: 76750 - DNA, 12 bp, Unknown
  misc_feature (1)..( 12): Result.001 file - promoters75/1029485
aaagtttagtat

SEQ ID NO: 76751 - DNA, 12 bp, Unknown
  misc_feature (1)..( 12): Result.001 file - promoters75/1029485
aatcattttctt

SEQ ID NO: 76752 - DNA, 12 bp, Unknown
  misc_feature (1)..( 12): Result.001 file - promoters75/1029485
cccaatttgtaa

SEQ ID NO: 76753 - DNA, 12 bp, Unknown
  misc_feature (1)..( 12): Result.001 file - promoters75/1029952
cccaataactga

SEQ ID NO: 76754 - DNA, 11 bp, Unknown
  misc_feature (1)..( 11): Result.001 file - promoters75/1029952
aataggcccaa

SEQ ID NO: 76755 - DNA, 11 bp, Unknown
  misc_feature (1)..( 11): Result.001 file - promoters75/1029952
aatgggccttt

SEQ ID NO: 76756 - DNA, 11 bp, Unknown
  misc_feature (1)..( 11): Result.001 file - promoters75/1029952
aatgggctggg

SEQ ID NO: 76757 - DNA, 11 bp, Unknown
  misc_feature (1)..( 11): Result.001 file - promoters75/1029952
aaaaggcccat

SEQ ID NO: 76758 - DNA, 11 bp, Unknown
  misc_feature (1)..( 11): Result.001 file - promoters75/1029952
tatgggcctta

SEQ ID NO: 76759 - DNA, 11 bp, Unknown
  misc_feature (1)..( 11): Result.001 file - promoters75/1029952
ccctggcccat

SEQ ID NO: 76760 - DNA, 9 bp, Unknown
  misc_feature (1)..( 9): Result.001 file - promoters75/1029952
aagaagaag

SEQ ID NO: 76761 - DNA, 9 bp, Unknown
  misc_feature (1)..( 9): Result.001 file - promoters75/1029952
aagaaaaag

SEQ ID NO: 76762 - DNA, 9 bp, Unknown
  misc_feature (1)..( 9): Result.001 file - promoters75/1029952
aaggaaaga

SEQ ID NO: 76763 - DNA, 9 bp, Unknown
  misc_feature (1)..( 9): Result.001 file - promoters75/1029952
gagaaaaaa

SEQ ID NO: 76764 - DNA, 9 bp, Unknown
  misc_feature (1)..( 9): Result.001 file - promoters75/1029952
gagaaaaaa

SEQ ID NO: 76765 - DNA, 9 bp, Unknown
  misc_feature (1)..( 9): Result.001 file - promoters75/1030324
gagaaaaga

SEQ ID NO: 76766 - DNA, 13 bp, Unknown
  misc_feature (1)..( 13): Result.001 file - promoters75/1030324
aattataatattt

SEQ ID NO: 76767 - DNA, 13 bp, Unknown
  misc_feature (1)..( 13): Result.001 file - promoters75/1030324
gattataaatcat

SEQ ID NO: 76768 - DNA, 13 bp, Unknown
  misc_feature (1)..( 13): Result.001 file - promoters75/1030324
gattatccctaac

SEQ ID NO: 76769 - DNA, 13 bp, Unknown
  misc_feature (1)..( 13): Result.001 file - promoters75/1030324
ctctatgaatcat

SEQ ID NO: 76770 - DNA, 13 bp, Unknown
  misc_feature (1)..( 13): Result.001 file - promoters75/1030324
gtctttgaatatt

SEQ ID NO: 76771 - DNA, 13 bp, Unknown
  misc_feature (1)..( 13): Result.001 file - promoters75/1030324
ttctttggattaa

SEQ ID NO: 76772 - DNA, 13 bp, Unknown
  misc_feature (1)..( 13): Result.001 file - promoters75/1030528
tctcttgcataga

SEQ ID NO: 76773 - DNA, 9 bp, Unknown
  misc_feature (1)..( 9): Result.001 file - promoters75/1030528
atactaatt

SEQ ID NO: 76774 - DNA, 9 bp, Unknown
  misc_feature (1)..( 9): Result.001 file - promoters75/1030528
ataataatt

SEQ ID NO: 76775 - DNA, 9 bp, Unknown
  misc_feature (1)..( 9): Result.001 file - promoters75/1030528
agaataatg

SEQ ID NO: 76776 - DNA, 13 bp, Unknown
  misc_feature (1)..( 13): Result.001 file - promoters75/1030528
ttatttttttaaa

SEQ ID NO: 76777 - DNA, 13 bp, Unknown
  misc_feature (1)..( 13): Result.001 file - promoters75/1030528
ttatatttttaat

SEQ ID NO: 76778 - DNA, 13 bp, Unknown
  misc_feature (1)..( 13): Result.001 file - promoters75/1030528
caatgcatttaaa

SEQ ID NO: 76779 - DNA, 7 bp, Unknown
  misc_feature (1)..( 7): Result.001 file - promoters75/1030528
ttaaaaa

SEQ ID NO: 76780 - DNA, 7 bp, Unknown
  misc_feature (1)..( 7): Result.001 file - promoters75/1030528
ctaaaaa

SEQ ID NO: 76781 - DNA, 7 bp, Unknown
  misc_feature (1)..( 7): Result.001 file - promoters75/1030547
ttaaaat

SEQ ID NO: 76782 - DNA, 10 bp, Unknown
  misc_feature (1)..( 10): Result.001 file - promoters75/1030547
catattatac

SEQ ID NO: 76783 - DNA, 10 bp, Unknown
  misc_feature (1)..( 10): Result.001 file - promoters75/1030547
atctttatac

SEQ ID NO: 76784 - DNA, 10 bp, Unknown
  misc_feature (1)..( 10): Result.001 file - promoters75/1030547
atctttataa

SEQ ID NO: 76785 - DNA, 10 bp, Unknown
  misc_feature (1)..( 10): Result.001 file - promoters75/1030547
aaatatgttt

SEQ ID NO: 76786 - DNA, 10 bp, Unknown
  misc_feature (1)..( 10): Result.001 file - promoters75/1030547
taatatattt

SEQ ID NO: 76787 - DNA, 10 bp, Unknown
  misc_feature (1)..( 10): Result.001 file - promoters75/1030547
taacatataa

SEQ ID NO: 76788 - DNA, 9 bp, Unknown
  misc_feature (1)..( 9): Result.001 file - promoters75/1030547
atatataat

SEQ ID NO: 76789 - DNA, 9 bp, Unknown
  misc_feature (1)..( 9): Result.001 file - promoters75/1030547
ataaatatc

SEQ ID NO: 76790 - DNA, 9 bp, Unknown
  misc_feature (1)..( 9): Result.001 file - promoters75/1030547
ataaatatc

SEQ ID NO: 76791 - DNA, 13 bp, Unknown
  misc_feature (1)..( 13): Result.001 file - promoters75/1030547
cgttttaaaagta

SEQ ID NO: 76792 - DNA, 13 bp, Unknown
  misc_feature (1)..( 13): Result.001 file - promoters75/1030547
atctttataagta

SEQ ID NO: 76793 - DNA, 13 bp, Unknown
  misc_feature (1)..( 13): Result.001 file - promoters75/1030821
atctttatacaaa

SEQ ID NO: 76794 - DNA, 8 bp, Unknown
  misc_feature (1)..( 8): Result.001 file - promoters75/1030821
tattttta

SEQ ID NO: 76795 - DNA, 8 bp, Unknown
  misc_feature (1)..( 8): Result.001 file - promoters75/1030821
tattctta

SEQ ID NO: 76796 - DNA, 8 bp, Unknown
  misc_feature (1)..( 8): Result.001 file - promoters75/1030821
tatgtttg

SEQ ID NO: 76797 - DNA, 9 bp, Unknown
  misc_feature (1)..( 9): Result.001 file - promoters75/1030821
tttgataca

SEQ ID NO: 76798 - DNA, 9 bp, Unknown
  misc_feature (1)..( 9): Result.001 file - promoters75/1030821
tttgattcg

SEQ ID NO: 76799 - DNA, 9 bp, Unknown
  misc_feature (1)..( 9): Result.001 file - promoters75/1030821
cttgacaca

SEQ ID NO: 76800 - DNA, 8 bp, Unknown
  misc_feature (1)..( 8): Result.001 file - promoters75/1030821
aaaacata

SEQ ID NO: 76801 - DNA, 8 bp, Unknown
  misc_feature (1)..( 8): Result.001 file - promoters75/1030821
aaatcata

SEQ ID NO: 76802 - DNA, 8 bp, Unknown
  misc_feature (1)..( 8): Result.001 file - promoters75/1030821
aaaatata

SEQ ID NO: 76803 - DNA, 8 bp, Unknown
  misc_feature (1)..( 8): Result.001 file - promoters75/1030821
ataacaaa

SEQ ID NO: 76804 - DNA, 8 bp, Unknown
  misc_feature (1)..( 8): Result.001 file - promoters75/1030821
caaacaaa

SEQ ID NO: 76805 - DNA, 8 bp, Unknown
  misc_feature (1)..( 8): Result.001 file - promoters75/1030821
ataaaaaa

SEQ ID NO: 76806 - DNA, 7 bp, Unknown
  misc_feature (1)..( 7): Result.001 file - promoters75/1030821
acaaact

SEQ ID NO: 76807 - DNA, 7 bp, Unknown
  misc_feature (1)..( 7): Result.001 file - promoters75/1030821
acaaaca

SEQ ID NO: 76808 - DNA, 7 bp, Unknown
  misc_feature (1)..( 7): Result.001 file - promoters75/1030821
ataaaaa

SEQ ID NO: 76809 - DNA, 14 bp, Unknown
  misc_feature (1)..( 14): Result.001 file - promoters75/1030821
aaacaatgtactta

SEQ ID NO: 76810 - DNA, 14 bp, Unknown
  misc_feature (1)..( 14): Result.001 file - promoters75/1030821
aaaaaataatcaga

SEQ ID NO: 76811 - DNA, 14 bp, Unknown
  misc_feature (1)..( 14): Result.001 file - promoters75/1030821
gtacaatctactta

SEQ ID NO: 76812 - DNA, 8 bp, Unknown
  misc_feature (1)..( 8): Result.001 file - promoters75/1030821
acaactta

SEQ ID NO: 76813 - DNA, 8 bp, Unknown
  misc_feature (1)..( 8): Result.001 file - promoters75/1030821
acaccttt

SEQ ID NO: 76814 - DNA, 8 bp, Unknown
  misc_feature (1)..( 8): Result.001 file - promoters75/1030940
aaaccttt

SEQ ID NO: 76815 - DNA, 13 bp, Unknown
  misc_feature (1)..( 13): Result.001 file - promoters75/1030940
gatataaacagta

SEQ ID NO: 76816 - DNA, 13 bp, Unknown
  misc_feature (1)..( 13): Result.001 file - promoters75/1030940
tataaaaagaaat

SEQ ID NO: 76817 - DNA, 13 bp, Unknown
  misc_feature (1)..( 13): Result.001 file - promoters75/1030940
tatataaaaattt

SEQ ID NO: 76818 - DNA, 13 bp, Unknown
  misc_feature (1)..( 13): Result.001 file - promoters75/1030940
tattaaaatagaa

SEQ ID NO: 76819 - DNA, 13 bp, Unknown
  misc_feature (1)..( 13): Result.001 file - promoters75/1030940
aaagaaaagagaa

SEQ ID NO: 76820 - DNA, 10 bp, Unknown
  misc_feature (1)..( 10): Result.001 file - promoters75/1030940
aaacagaaca

SEQ ID NO: 76821 - DNA, 10 bp, Unknown
  misc_feature (1)..( 10): Result.001 file - promoters75/1030940
aaatagaaat

SEQ ID NO: 76822 - DNA, 10 bp, Unknown
  misc_feature (1)..( 10): Result.001 file - promoters75/1030940
aaaaagaaat

SEQ ID NO: 76823 - DNA, 10 bp, Unknown
  misc_feature (1)..( 10): Result.001 file - promoters75/1030940
aaagagaaga

SEQ ID NO: 76824 - DNA, 10 bp, Unknown
  misc_feature (1)..( 10): Result.001 file - promoters75/1030940
atatataaaa

SEQ ID NO: 76825 - DNA, 11 bp, Unknown
  misc_feature (1)..( 11): Result.001 file - promoters75/1030940
caagatatttt

SEQ ID NO: 76826 - DNA, 11 bp, Unknown
  misc_feature (1)..( 11): Result.001 file - promoters75/1030940
caaaatatctt

SEQ ID NO: 76827 - DNA, 11 bp, Unknown
  misc_feature (1)..( 11): Result.001 file - promoters75/1030940
aaagatcctca

SEQ ID NO: 76828 - DNA, 11 bp, Unknown
  misc_feature (1)..( 11): Result.001 file - promoters75/1030940
taaattatgtt

SEQ ID NO: 76829 - DNA, 11 bp, Unknown
  misc_feature (1)..( 11): Result.001 file - promoters75/1030940
tgaattttgtt

SEQ ID NO: 76830 - DNA, 14 bp, Unknown
  misc_feature (1)..( 14): Result.001 file - promoters75/1030940
aaaggcccataaaa

SEQ ID NO: 76831 - DNA, 14 bp, Unknown
  misc_feature (1)..( 14): Result.001 file - promoters75/1030940
atgggcccataaag

SEQ ID NO: 76832 - DNA, 14 bp, Unknown
  misc_feature (1)..( 14): Result.001 file - promoters75/1030940
taaggcccaaagtc

SEQ ID NO: 76833 - DNA, 14 bp, Unknown
  misc_feature (1)..( 14): Result.001 file - promoters75/1030940
cataagatataaaa

SEQ ID NO: 76834 - DNA, 14 bp, Unknown
  misc_feature (1)..( 14): Result.001 file - promoters75/1030940
taaagcccaatcat

SEQ ID NO: 76835 - DNA, 15 bp, Unknown
  misc_feature (1)..( 15): Result.001 file - promoters75/1030940
caaacttttattttt

SEQ ID NO: 76836 - DNA, 15 bp, Unknown
  misc_feature (1)..( 15): Result.001 file - promoters75/1030940
caaatttttactttt

SEQ ID NO: 76837 - DNA, 15 bp, Unknown
  misc_feature (1)..( 15): Result.001 file - promoters75/1030940
atgcttttgatttca

SEQ ID NO: 76838 - DNA, 15 bp, Unknown
  misc_feature (1)..( 15): Result.001 file - promoters75/1030940
tattattatatttga

SEQ ID NO: 76839 - DNA, 15 bp, Unknown
  misc_feature (1)..( 15): Result.001 file - promoters75/1031052
gggttttagattatg

SEQ ID NO: 76840 - DNA, 9 bp, Unknown
  misc_feature (1)..( 9): Result.001 file - promoters75/1031052
gaaaaaaaa

SEQ ID NO: 76841 - DNA, 9 bp, Unknown
  misc_feature (1)..( 9): Result.001 file - promoters75/1031052
gaataaaaa

SEQ ID NO: 76842 - DNA, 9 bp, Unknown
  misc_feature (1)..( 9): Result.001 file - promoters75/1031267
gaaaaaaat

SEQ ID NO: 76843 - DNA, 11 bp, Unknown
  misc_feature (1)..( 11): Result.001 file - promoters75/1031267
tttattgttac

SEQ ID NO: 76844 - DNA, 11 bp, Unknown
  misc_feature (1)..( 11): Result.001 file - promoters75/1031267
gtctttgttag

SEQ ID NO: 76845 - DNA, 11 bp, Unknown
  misc_feature (1)..( 11): Result.001 file - promoters75/1031267
caaatttttac

SEQ ID NO: 76846 - DNA, 11 bp, Unknown
  misc_feature (1)..( 11): Result.001 file - promoters75/1031267
catattcttaa

SEQ ID NO: 76847 - DNA, 11 bp, Unknown
  misc_feature (1)..( 11): Result.001 file - promoters75/1031267
tttagttttgt

SEQ ID NO: 76848 - DNA, 11 bp, Unknown
  misc_feature (1)..( 11): Result.001 file - promoters75/1031267
tttatttttgt

SEQ ID NO: 76849 - DNA, 11 bp, Unknown
  misc_feature (1)..( 11): Result.001 file - promoters75/1031291
tatctttttgt

SEQ ID NO: 76850 - DNA, 13 bp, Unknown
  misc_feature (1)..( 13): Result.001 file - promoters75/1031291
gaataaaaattca

SEQ ID NO: 76851 - DNA, 13 bp, Unknown
  misc_feature (1)..( 13): Result.001 file - promoters75/1031291
taataaaatttca

SEQ ID NO: 76852 - DNA, 13 bp, Unknown
  misc_feature (1)..( 13): Result.001 file - promoters75/1031291
aaatacaatctcc

SEQ ID NO: 76853 - DNA, 13 bp, Unknown
  misc_feature (1)..( 13): Result.001 file - promoters75/1031291
gaacacaaagtca

SEQ ID NO: 76854 - DNA, 7 bp, Unknown
  misc_feature (1)..( 7): Result.001 file - promoters75/1031291
aaacgac

SEQ ID NO: 76855 - DNA, 7 bp, Unknown
  misc_feature (1)..( 7): Result.001 file - promoters75/1031291
aaaggac

SEQ ID NO: 76856 - DNA, 8 bp, Unknown
  misc_feature (1)..( 8): Result.001 file - promoters75/1031799
aaagggac

SEQ ID NO: 76857 - DNA, 19 bp, Unknown
  misc_feature (1)..( 19): Result.001 file - promoters75/1031799
gctctctcgtataattctt

SEQ ID NO: 76858 - DNA, 19 bp, Unknown
  misc_feature (1)..( 19): Result.001 file - promoters75/1031799
ctccactcttatgatttgc

SEQ ID NO: 76859 - DNA, 19 bp, Unknown
  misc_feature (1)..( 19): Result.001 file - promoters75/1031799
tctacttcttattggaaga

SEQ ID NO: 76860 - DNA, 19 bp, Unknown
  misc_feature (1)..( 19): Result.001 file - promoters75/1031799
aagaacttccatgtttttg

SEQ ID NO: 76861 - DNA, 19 bp, Unknown
  misc_feature (1)..( 19): Result.001 file - promoters75/1031799
ctctactcttggaatatcc

SEQ ID NO: 76862 - DNA, 19 bp, Unknown
  misc_feature (1)..( 19): Result.001 file - promoters75/1031799
acgatttctgacgtttttg

SEQ ID NO: 76863 - DNA, 11 bp, Unknown
  misc_feature (1)..( 11): Result.001 file - promoters75/1031799
aagaaaaaaaa

SEQ ID NO: 76864 - DNA, 11 bp, Unknown
  misc_feature (1)..( 11): Result.001 file - promoters75/1031799
aagaaacaaag

SEQ ID NO: 76865 - DNA, 11 bp, Unknown
  misc_feature (1)..( 11): Result.001 file - promoters75/1031799
atcaaaaaatt

SEQ ID NO: 76866 - DNA, 11 bp, Unknown
  misc_feature (1)..( 11): Result.001 file - promoters75/1031799
tccaaacaaaa

SEQ ID NO: 76867 - DNA, 11 bp, Unknown
  misc_feature (1)..( 11): Result.001 file - promoters75/1031799
atgaaatattt

SEQ ID NO: 76868 - DNA, 11 bp, Unknown
  misc_feature (1)..( 11): Result.001 file - promoters75/1032381
ataaaaccaag

SEQ ID NO: 76869 - DNA, 11 bp, Unknown
  misc_feature (1)..( 11): Result.001 file - promoters75/1032381
agagttggata

SEQ ID NO: 76870 - DNA, 11 bp, Unknown
  misc_feature (1)..( 11): Result.001 file - promoters75/1032381
ttctttggatt

SEQ ID NO: 76871 - DNA, 11 bp, Unknown
  misc_feature (1)..( 11): Result.001 file - promoters75/1032381
ttttttgaata

SEQ ID NO: 76872 - DNA, 11 bp, Unknown
  misc_feature (1)..( 11): Result.001 file - promoters75/1032381
tactttggaat

SEQ ID NO: 76873 - DNA, 11 bp, Unknown
  misc_feature (1)..( 11): Result.001 file - promoters75/1032381
tactttgtttt

SEQ ID NO: 76874 - DNA, 14 bp, Unknown
  misc_feature (1)..( 14): Result.001 file - promoters75/1032381
agcccaaattaaaa

SEQ ID NO: 76875 - DNA, 14 bp, Unknown
  misc_feature (1)..( 14): Result.001 file - promoters75/1032381
aagccatatttggg

SEQ ID NO: 76876 - DNA, 14 bp, Unknown
  misc_feature (1)..( 14): Result.001 file - promoters75/1032381
ctttaaaatcaaaa

SEQ ID NO: 76877 - DNA, 14 bp, Unknown
  misc_feature (1)..( 14): Result.001 file - promoters75/1032381
aatccaaagcttac

SEQ ID NO: 76878 - DNA, 9 bp, Unknown
  misc_feature (1)..( 9): Result.001 file - promoters75/1032381
tttactttg

SEQ ID NO: 76879 - DNA, 9 bp, Unknown
  misc_feature (1)..( 9): Result.001 file - promoters75/1032381
tttgcttct

SEQ ID NO: 76880 - DNA, 9 bp, Unknown
  misc_feature (1)..( 9): Result.001 file - promoters75/1032381
attaatttt

SEQ ID NO: 76881 - DNA, 7 bp, Unknown
  misc_feature (1)..( 7): Result.001 file - promoters75/1032498
tactttg

SEQ ID NO: 76882 - DNA, 10 bp, Unknown
  misc_feature (1)..( 10): Result.001 file - promoters75/1032498
ttttctaccc

SEQ ID NO: 76883 - DNA, 10 bp, Unknown
  misc_feature (1)..( 10): Result.001 file - promoters75/1032498
ctttttacag

SEQ ID NO: 76884 - DNA, 10 bp, Unknown
  misc_feature (1)..( 10): Result.001 file - promoters75/1032498
ttttctactt

SEQ ID NO: 76885 - DNA, 10 bp, Unknown
  misc_feature (1)..( 10): Result.001 file - promoters75/1032498
ctttctattt

SEQ ID NO: 76886 - DNA, 10 bp, Unknown
  misc_feature (1)..( 10): Result.001 file - promoters75/1032498
ttttttaaaa

SEQ ID NO: 76887 - DNA, 10 bp, Unknown
  misc_feature (1)..( 10): Result.001 file - promoters75/1032498
acttttatta

SEQ ID NO: 76888 - DNA, 11 bp, Unknown
  misc_feature (1)..( 11): Result.001 file - promoters75/1032498
ataataaactc

SEQ ID NO: 76889 - DNA, 11 bp, Unknown
  misc_feature (1)..( 11): Result.001 file - promoters75/1032498
gtaataataac

SEQ ID NO: 76890 - DNA, 11 bp, Unknown
  misc_feature (1)..( 11): Result.001 file - promoters75/1032498
atactaaaagc

SEQ ID NO: 76891 - DNA, 11 bp, Unknown
  misc_feature (1)..( 11): Result.001 file - promoters75/1032498
ttaacaaaaca

SEQ ID NO: 76892 - DNA, 11 bp, Unknown
  misc_feature (1)..( 11): Result.001 file - promoters75/1032498
ataataatgtt

SEQ ID NO: 76893 - DNA, 11 bp, Unknown
  misc_feature (1)..( 11): Result.001 file - promoters75/1032498
aaaataatcag

SEQ ID NO: 76894 - DNA, 11 bp, Unknown
  misc_feature (1)..( 11): Result.001 file - promoters75/1032498
aaaagaatcag

SEQ ID NO: 76895 - DNA, 11 bp, Unknown
  misc_feature (1)..( 11): Result.001 file - promoters75/1032498
aaaagaatcac

SEQ ID NO: 76896 - DNA, 12 bp, Unknown
  misc_feature (1)..( 12): Result.001 file - promoters75/1032498
tggttttgagaa

SEQ ID NO: 76897 - DNA, 12 bp, Unknown
  misc_feature (1)..( 12): Result.001 file - promoters75/1032498
tctttttgatat

SEQ ID NO: 76898 - DNA, 12 bp, Unknown
  misc_feature (1)..( 12): Result.001 file - promoters75/1032498
taattttatata

SEQ ID NO: 76899 - DNA, 12 bp, Unknown
  misc_feature (1)..( 12): Result.001 file - promoters75/1032498
caaaattatatc

SEQ ID NO: 76900 - DNA, 12 bp, Unknown
  misc_feature (1)..( 12): Result.001 file - promoters75/1032498
acattatatata

SEQ ID NO: 76901 - DNA, 12 bp, Unknown
  misc_feature (1)..( 12): Result.001 file - promoters75/1032498
tctttttgccaa

SEQ ID NO: 76902 - DNA, 12 bp, Unknown
  misc_feature (1)..( 12): Result.001 file - promoters75/1032498
tcatcatatgaa

SEQ ID NO: 76903 - DNA, 11 bp, Unknown
  misc_feature (1)..( 11): Result.001 file - promoters75/1032498
aaaaaaagttt

SEQ ID NO: 76904 - DNA, 11 bp, Unknown
  misc_feature (1)..( 11): Result.001 file - promoters75/1032498
gaaaatagttt

SEQ ID NO: 76905 - DNA, 12 bp, Unknown
  misc_feature (1)..( 12): Result.001 file - promoters75/1032498
caaacaaaaaat

SEQ ID NO: 76906 - DNA, 12 bp, Unknown
  misc_feature (1)..( 12): Result.001 file - promoters75/1032498
caaccaaaagaa

SEQ ID NO: 76907 - DNA, 12 bp, Unknown
  misc_feature (1)..( 12): Result.001 file - promoters75/1032498
caaaacaattca

SEQ ID NO: 76908 - DNA, 12 bp, Unknown
  misc_feature (1)..( 12): Result.001 file - promoters75/1032676
taaaagaatcac

SEQ ID NO: 76909 - DNA, 10 bp, Unknown
  misc_feature (1)..( 10): Result.001 file - promoters75/1032676
aaacttaaga

SEQ ID NO: 76910 - DNA, 10 bp, Unknown
  misc_feature (1)..( 10): Result.001 file - promoters75/1032676
gaacgtaaga

SEQ ID NO: 76911 - DNA, 10 bp, Unknown
  misc_feature (1)..( 10): Result.001 file - promoters75/1032676
aaaattaaat

SEQ ID NO: 76912 - DNA, 8 bp, Unknown
  misc_feature (1)..( 8): Result.001 file - promoters75/1032676
atttttct

SEQ ID NO: 76913 - DNA, 8 bp, Unknown
  misc_feature (1)..( 8): Result.001 file - promoters75/1032676
attttttt

SEQ ID NO: 76914 - DNA, 8 bp, Unknown
  misc_feature (1)..( 8): Result.001 file - promoters75/1032676
cttttttt

SEQ ID NO: 76915 - DNA, 8 bp, Unknown
  misc_feature (1)..( 8): Result.001 file - promoters75/1032676
gatattac

SEQ ID NO: 76916 - DNA, 8 bp, Unknown
  misc_feature (1)..( 8): Result.001 file - promoters75/1032676
gatattaa

SEQ ID NO: 76917 - DNA, 8 bp, Unknown
  misc_feature (1)..( 8): Result.001 file - promoters75/1032897
aataataa

SEQ ID NO: 76918 - DNA, 12 bp, Unknown
  misc_feature (1)..( 12): Result.001 file - promoters75/1032897
tagaaaattata

SEQ ID NO: 76919 - DNA, 12 bp, Unknown
  misc_feature (1)..( 12): Result.001 file - promoters75/1032897
ataaaaattttt

SEQ ID NO: 76920 - DNA, 12 bp, Unknown
  misc_feature (1)..( 12): Result.001 file - promoters75/1032897
gaagaaatttat

SEQ ID NO: 76921 - DNA, 12 bp, Unknown
  misc_feature (1)..( 12): Result.001 file - promoters75/1032897
caagaaatcatt

SEQ ID NO: 76922 - DNA, 12 bp, Unknown
  misc_feature (1)..( 12): Result.001 file - promoters75/1032897
ataaaagtttgt

SEQ ID NO: 76923 - DNA, 12 bp, Unknown
  misc_feature (1)..( 12): Result.001 file - promoters75/1032897
ttcaaactttca

SEQ ID NO: 76924 - DNA, 9 bp, Unknown
  misc_feature (1)..( 9): Result.001 file - promoters75/1032897
gaatcaaac

SEQ ID NO: 76925 - DNA, 9 bp, Unknown
  misc_feature (1)..( 9): Result.001 file - promoters75/1032897
ttatcaaat

SEQ ID NO: 76926 - DNA, 9 bp, Unknown
  misc_feature (1)..( 9): Result.001 file - promoters75/1032897
gaaacaaac

SEQ ID NO: 76927 - DNA, 9 bp, Unknown
  misc_feature (1)..( 9): Result.001 file - promoters75/1032897
gtatcaaga

SEQ ID NO: 76928 - DNA, 9 bp, Unknown
  misc_feature (1)..( 9): Result.001 file - promoters75/1032897
atataaaaa

SEQ ID NO: 76929 - DNA, 9 bp, Unknown
  misc_feature (1)..( 9): Result.001 file - promoters75/1032897
ttacgaaac

SEQ ID NO: 76930 - DNA, 9 bp, Unknown
  misc_feature (1)..( 9): Result.001 file - promoters75/1032897
tatatattc

SEQ ID NO: 76931 - DNA, 9 bp, Unknown
  misc_feature (1)..( 9): Result.001 file - promoters75/1032897
cataaattt

SEQ ID NO: 76932 - DNA, 9 bp, Unknown
  misc_feature (1)..( 9): Result.001 file - promoters75/1032897
tatgtatag

SEQ ID NO: 76933 - DNA, 10 bp, Unknown
  misc_feature (1)..( 10): Result.001 file - promoters75/1032897
ttcaaacttt

SEQ ID NO: 76934 - DNA, 10 bp, Unknown
  misc_feature (1)..( 10): Result.001 file - promoters75/1032897
tctcaacttt

SEQ ID NO: 76935 - DNA, 10 bp, Unknown
  misc_feature (1)..( 10): Result.001 file - promoters75/1032897
ataaaagttt

SEQ ID NO: 76936 - DNA, 9 bp, Unknown
  misc_feature (1)..( 9): Result.001 file - promoters75/1032897
aaaaccaag

SEQ ID NO: 76937 - DNA, 9 bp, Unknown
  misc_feature (1)..( 9): Result.001 file - promoters75/1032897
gaaacaaag

SEQ ID NO: 76938 - DNA, 9 bp, Unknown
  misc_feature (1)..( 9): Result.001 file - promoters75/1032897
caaaccaat

SEQ ID NO: 76939 - DNA, 9 bp, Unknown
  misc_feature (1)..( 9): Result.001 file - promoters75/1032897
aaaatcaaa

SEQ ID NO: 76940 - DNA, 9 bp, Unknown
  misc_feature (1)..( 9): Result.001 file - promoters75/1032897
aaaaacaaa

SEQ ID NO: 76941 - DNA, 9 bp, Unknown
  misc_feature (1)..( 9): Result.001 file - promoters75/1033781
ccaaacaac

SEQ ID NO: 76942 - DNA, 8 bp, Unknown
  misc_feature (1)..( 8): Result.001 file - promoters75/1033781
tcttatta

SEQ ID NO: 76943 - DNA, 8 bp, Unknown
  misc_feature (1)..( 8): Result.001 file - promoters75/1033781
tcttatta

SEQ ID NO: 76944 - DNA, 8 bp, Unknown
  misc_feature (1)..( 8): Result.001 file - promoters75/1033781
agttatta

SEQ ID NO: 76945 - DNA, 10 bp, Unknown
  misc_feature (1)..( 10): Result.001 file - promoters75/1033781
accatttcgt

SEQ ID NO: 76946 - DNA, 10 bp, Unknown
  misc_feature (1)..( 10): Result.001 file - promoters75/1033781
accctttgtt

SEQ ID NO: 76947 - DNA, 10 bp, Unknown
  misc_feature (1)..( 10): Result.001 file - promoters75/1033781
cccattttct

SEQ ID NO: 76948 - DNA, 11 bp, Unknown
  misc_feature (1)..( 11): Result.001 file - promoters75/1033781
gtcatcttcta

SEQ ID NO: 76949 - DNA, 10 bp, Unknown
  misc_feature (1)..( 10): Result.001 file - promoters75/1033781
gcccatttaa

SEQ ID NO: 76950 - DNA, 10 bp, Unknown
  misc_feature (1)..( 10): Result.001 file - promoters75/1033781
ctccatataa

SEQ ID NO: 76951 - DNA, 10 bp, Unknown
  misc_feature (1)..( 10): Result.001 file - promoters75/1033781
gcccatttga

SEQ ID NO: 76952 - DNA, 7 bp, Unknown
  misc_feature (1)..( 7): Result.001 file - promoters75/1033781
taacaaa

SEQ ID NO: 76953 - DNA, 7 bp, Unknown
  misc_feature (1)..( 7): Result.001 file - promoters75/1033781
taaaaaa

SEQ ID NO: 76954 - DNA, 7 bp, Unknown
  misc_feature (1)..( 7): Result.001 file - promoters75/1033781
gaaaaaa

SEQ ID NO: 76955 - DNA, 12 bp, Unknown
  misc_feature (1)..( 12): Result.001 file - promoters75/1033781
tccatataaatt

SEQ ID NO: 76956 - DNA, 12 bp, Unknown
  misc_feature (1)..( 12): Result.001 file - promoters75/1033781
tccatataaatt

SEQ ID NO: 76957 - DNA, 12 bp, Unknown
  misc_feature (1)..( 12): Result.001 file - promoters75/1033781
ttactataaagg

SEQ ID NO: 76958 - DNA, 9 bp, Unknown
  misc_feature (1)..( 9): Result.001 file - promoters75/1033781
catgtattt

SEQ ID NO: 76959 - DNA, 9 bp, Unknown
  misc_feature (1)..( 9): Result.001 file - promoters75/1033781
catgaattg

SEQ ID NO: 76960 - DNA, 9 bp, Unknown
  misc_feature (1)..( 9): Result.001 file - promoters75/1033781
gtggaattg

SEQ ID NO: 76961 - DNA, 9 bp, Unknown
  misc_feature (1)..( 9): Result.001 file - promoters75/1033781
tatgatttg

SEQ ID NO: 76962 - DNA, 8 bp, Unknown
  misc_feature (1)..( 8): Result.001 file - promoters75/1033781
aaacaaat

SEQ ID NO: 76963 - DNA, 8 bp, Unknown
  misc_feature (1)..( 8): Result.001 file - promoters75/1033781
caacaaat

SEQ ID NO: 76964 - DNA, 8 bp, Unknown
  misc_feature (1)..( 8): Result.001 file - promoters75/1033841
aaacgaat

SEQ ID NO: 76965 - DNA, 7 bp, Unknown
  misc_feature (1)..( 7): Result.001 file - promoters75/1033841
tccttcc

SEQ ID NO: 76966 - DNA, 7 bp, Unknown
  misc_feature (1)..( 7): Result.001 file - promoters75/1033841
tccttct

SEQ ID NO: 76967 - DNA, 7 bp, Unknown
  misc_feature (1)..( 7): Result.001 file - promoters75/1033841
tccatcc

SEQ ID NO: 76968 - DNA, 8 bp, Unknown
  misc_feature (1)..( 8): Result.001 file - promoters75/1033841
attagctt

SEQ ID NO: 76969 - DNA, 8 bp, Unknown
  misc_feature (1)..( 8): Result.001 file - promoters75/1033841
atttgctt

SEQ ID NO: 76970 - DNA, 8 bp, Unknown
  misc_feature (1)..( 8): Result.001 file - promoters75/1034137
atttgcgt

SEQ ID NO: 76971 - DNA, 10 bp, Unknown
  misc_feature (1)..( 10): Result.001 file - promoters75/1034137
attatatatg

SEQ ID NO: 76972 - DNA, 10 bp, Unknown
  misc_feature (1)..( 10): Result.001 file - promoters75/1034137
tcaataaatg

SEQ ID NO: 76973 - DNA, 10 bp, Unknown
  misc_feature (1)..( 10): Result.001 file - promoters75/1034137
tcattaaaaa

SEQ ID NO: 76974 - DNA, 10 bp, Unknown
  misc_feature (1)..( 10): Result.001 file - promoters75/1034137
ttaaaaaaaa

SEQ ID NO: 76975 - DNA, 10 bp, Unknown
  misc_feature (1)..( 10): Result.001 file - promoters75/1034137
acaaaaaaaa

SEQ ID NO: 76976 - DNA, 10 bp, Unknown
  misc_feature (1)..( 10): Result.001 file - promoters75/1034137
ttaaaaaagg

SEQ ID NO: 76977 - DNA, 34 bp, Unknown
  misc_feature (1)..( 34): Result.001 file - promoters75/1034137
tagcctatataaaggcataagcatgagtggcact

SEQ ID NO: 76978 - DNA, 34 bp, Unknown
  misc_feature (1)..( 34): Result.001 file - promoters75/1034137
agttttataaaaaaggcttcaaggccgagagttc

SEQ ID NO: 76979 - DNA, 34 bp, Unknown
  misc_feature (1)..( 34): Result.001 file - promoters75/1034137
tagcctatataaatgcataaccatgagtgacact

SEQ ID NO: 76980 - DNA, 34 bp, Unknown; identical to SEQ ID NO: 76977
  misc_feature (1)..( 34): Result.001 file - promoters75/1034137

SEQ ID NO: 76981 - DNA, 34 bp, Unknown
  misc_feature (1)..( 34): Result.001 file - promoters75/1034137
gttttataaaaaaggcttcaaggccgagagttcg

SEQ ID NO: 76982 - DNA, 34 bp, Unknown; identical to SEQ ID NO: 76979
  misc_feature (1)..( 34): Result.001 file - promoters75/1034137

SEQ ID NO: 76983 - DNA, 15 bp, Unknown
  misc_feature (1)..( 15): Result.001 file - promoters75/1034137
attgaagacttttca

SEQ ID NO: 76984 - DNA, 15 bp, Unknown
  misc_feature (1)..( 15): Result.001 file - promoters75/1034137
attgaagacttttca

SEQ ID NO: 76985 - DNA, 15 bp, Unknown
  misc_feature (1)..( 15): Result.001 file - promoters75/1034137
gtagaagaccatata

SEQ ID NO: 76986 - DNA, 13 bp, Unknown
  misc_feature (1)..( 13): Result.001 file - promoters75/1034137
ctataagctttaa

SEQ ID NO: 76987 - DNA, 13 bp, Unknown
  misc_feature (1)..( 13): Result.001 file - promoters75/1034137
ctataagctttta

SEQ ID NO: 76988 - DNA, 14 bp, Unknown
  misc_feature (1)..( 14): Result.001 file - promoters75/1034137
aagacagcatttaa

SEQ ID NO: 76989 - DNA, 29 bp, Unknown
  misc_feature (1)..( 29): Result.001 file - promoters75/1034137
aagctttaagtctatcgctagactgtcca

SEQ ID NO: 76990 - DNA, 29 bp, Unknown
  misc_feature (1)..( 29): Result.001 file - promoters75/1034137
agcttttaagtctctcgctagactgtcca

SEQ ID NO: 76991 - DNA, 29 bp, Unknown
  misc_feature (1)..( 29): Result.001 file - promoters75/1034322
agcatttaatgatgataacgatttggaag

SEQ ID NO: 76992 - DNA, 8 bp, Unknown
  misc_feature (1)..( 8): Result.001 file - promoters75/1034322
atttgaat

SEQ ID NO: 76993 - DNA, 8 bp, Unknown
  misc_feature (1)..( 8): Result.001 file - promoters75/1034322
attttaat

SEQ ID NO: 76994 - DNA, 8 bp, Unknown
  misc_feature (1)..( 8): Result.001 file - promoters75/1034322
aatttaat

SEQ ID NO: 76995 - DNA, 11 bp, Unknown
  misc_feature (1)..( 11): Result.001 file - promoters75/1034322
gtaactaatta

SEQ ID NO: 76996 - DNA, 11 bp, Unknown
  misc_feature (1)..( 11): Result.001 file - promoters75/1034322
ttaacgaataa

SEQ ID NO: 76997 - DNA, 11 bp, Unknown
  misc_feature (1)..( 11): Result.001 file - promoters75/1034322
ttaacgaataa

SEQ ID NO: 76998 - DNA, 9 bp, Unknown
  misc_feature (1)..( 9): Result.001 file - promoters75/1034322
aatttaatt

SEQ ID NO: 76999 - DNA, 9 bp, Unknown
  misc_feature (1)..( 9): Result.001 file - promoters75/1034322
aatttaatt

SEQ ID NO: 77000 - DNA, 9 bp, Unknown
  misc_feature (1)..( 9): Result.001 file - promoters75/1035267
attttaata

SEQ ID NO: 77001 - DNA, 7 bp, Unknown
  misc_feature (1)..( 7): Result.001 file - promoters75/1035267
ccacaga

SEQ ID NO: 77002 - DNA, 7 bp, Unknown
  misc_feature (1)..( 7): Result.001 file - promoters75/1035267
ccacagc

SEQ ID NO: 77003 - DNA, 7 bp, Unknown
  misc_feature (1)..( 7): Result.001 file - promoters75/1375471
tcacaga

SEQ ID NO: 77004 - DNA, 8 bp, Unknown
  misc_feature (1)..( 8): Result.001 file - promoters75/1375471
aaaataaa

SEQ ID NO: 77005 - DNA, 8 bp, Unknown
  misc_feature (1)..( 8): Result.001 file - promoters75/1375471
aaaataat

SEQ ID NO: 77006 - DNA, 8 bp, Unknown
  misc_feature (1)..( 8): Result.001 file - promoters75/1375615
aaaaaaat

SEQ ID NO: 77007 - DNA, 8 bp, Unknown
  misc_feature (1)..( 8): Result.001 file - promoters75/1375615
atcatatt

SEQ ID NO: 77008 - DNA, 8 bp, Unknown
  misc_feature (1)..( 8): Result.001 file - promoters75/1375615
atcatatt

SEQ ID NO: 77009 - DNA, 8 bp, Unknown
  misc_feature (1)..( 8): Result.001 file - promoters75/1375615
atcatatt

SEQ ID NO: 77010 - DNA, 9 bp, Unknown
  misc_feature (1)..( 9): Result.001 file - promoters75/1375615
tttgtagtg

SEQ ID NO: 77011 - DNA, 9 bp, Unknown
  misc_feature (1)..( 9): Result.001 file - promoters75/1375615
attgtagct

SEQ ID NO: 77012 - DNA, 9 bp, Unknown
  misc_feature (1)..( 9): Result.001 file - promoters75/1375615
tttgttgtg

SEQ ID NO: 77013 - DNA, 8 bp, Unknown
  misc_feature (1)..( 8): Result.001 file - promoters75/1375615
tgatttgt

SEQ ID NO: 77014 - DNA, 8 bp, Unknown
  misc_feature (1)..( 8): Result.001 file - promoters75/1375615
agatatgt

SEQ ID NO: 77015 - DNA, 8 bp, Unknown
  misc_feature (1)..( 8): Result.001 file - promoters75/1375615
tgatttgg

SEQ ID NO: 77016 - DNA, 7 bp, Unknown
  misc_feature (1)..( 7): Result.001 file - promoters75/1375615
gtttgtt

SEQ ID NO: 77017 - DNA, 7 bp, Unknown
  misc_feature (1)..( 7): Result.001 file - promoters75/1375615
gtttgtg

SEQ ID NO: 77018 - DNA, 7 bp, Unknown
  misc_feature (1)..( 7): Result.001 file - promoters75/1375615
ttttgtt

SEQ ID NO: 77019 - DNA, 8 bp, Unknown
  misc_feature (1)..( 8): Result.001 file - promoters75/1375615
tgtttgtt

SEQ ID NO: 77020 - DNA, 8 bp, Unknown
  misc_feature (1)..( 8): Result.001 file - promoters75/1375615
gatttgtt

SEQ ID NO: 77021 - DNA, 8 bp, Unknown
  misc_feature (1)..( 8): Result.001 file - promoters75/1376650
gatatgta

SEQ ID NO: 77022 - DNA, 8 bp, Unknown
  misc_feature (1)..( 8): Result.001 file - promoters75/1376650
caaaccaa

SEQ ID NO: 77023 - DNA, 8 bp, Unknown
  misc_feature (1)..( 8): Result.001 file - promoters75/1376650
gaaatcaa

SEQ ID NO: 77024 - DNA, 8 bp, Unknown
  misc_feature (1)..( 8): Result.001 file - promoters75/1376650
gaactcag

SEQ ID NO: 77025 - DNA, 8 bp, Unknown
  misc_feature (1)..( 8): Result.001 file - promoters75/1376650
taacacag

SEQ ID NO: 77026 - DNA, 8 bp, Unknown
  misc_feature (1)..( 8): Result.001 file - promoters75/1376650
gaactcag

SEQ ID NO: 77027 - DNA, 8 bp, Unknown
  misc_feature (1)..( 8): Result.001 file - promoters75/1376650
gaaatcaa

SEQ ID NO: 77028 - DNA, 9 bp, Unknown
  misc_feature (1)..( 9): Result.001 file - promoters75/1376650
ccgaaaaaa

SEQ ID NO: 77029 - DNA, 9 bp, Unknown
  misc_feature (1)..( 9): Result.001 file - promoters75/1376650
aagaaaaaa

SEQ ID NO: 77030 - DNA, 9 bp, Unknown
  misc_feature (1)..( 9): Result.001 file - promoters75/1376881
aagacaaaa

SEQ ID NO: 77031 - DNA, 6 bp, Unknown
  misc_feature (1)..( 6): Result.001 file - promoters75/1376881
agtaaa

SEQ ID NO: 77032 - DNA, 6 bp, Unknown
  misc_feature (1)..( 6): Result.001 file - promoters75/1376881
agtaaa

SEQ ID NO: 77033 - DNA, 6 bp, Unknown
  misc_feature (1)..( 6): Result.001 file - promoters75/1376881
agtaaa

SEQ ID NO: 77034 - DNA, 10 bp, Unknown
  misc_feature (1)..( 10): Result.001 file - promoters75/1376881
tcaacaaaaa

SEQ ID NO: 77035 - DNA, 10 bp, Unknown
  misc_feature (1)..( 10): Result.001 file - promoters75/1376881
gaaacaaaaa

SEQ ID NO: 77036 - DNA, 10 bp, Unknown
  misc_feature (1)..( 10): Result.001 file - promoters75/1377564
gaaagaaagc

SEQ ID NO: 77037 - DNA, 7 bp, Unknown
  misc_feature (1)..( 7): Result.001 file - promoters75/1377564
attttac

SEQ ID NO: 77038 - DNA, 7 bp, Unknown
  misc_feature (1)..( 7): Result.001 file - promoters75/1377564
tttttac

SEQ ID NO: 77039 - DNA, 7 bp, Unknown
  misc_feature (1)..( 7): Result.001 file - promoters75/1377564
attttaa

SEQ ID NO: 77040 - DNA, 7 bp, Unknown
  misc_feature (1)..( 7): Result.001 file - promoters75/1377564
caaaatt

SEQ ID NO: 77041 - DNA, 7 bp, Unknown
  misc_feature (1)..( 7): Result.001 file - promoters75/1377564
caaaatc

SEQ ID NO: 77042 - DNA, 7 bp, Unknown
  misc_feature (1)..( 7): Result.001 file - promoters75/1377642
taaaatc

SEQ ID NO: 77043 - DNA, 7 bp, Unknown
  misc_feature (1)..( 7): Result.001 file - promoters75/1377642
taaaaat

SEQ ID NO: 77044 - DNA, 7 bp, Unknown
  misc_feature (1)..( 7): Result.001 file - promoters75/1377642
taaaaag

SEQ ID NO: 77045 - DNA, 7 bp, Unknown
  misc_feature (1)..( 7): Result.001 file - promoters75/1377642
gaaaaag

SEQ ID NO: 77046 - DNA, 13 bp, Unknown
  misc_feature (1)..( 13): Result.001 file - promoters75/1377642
aatgaatattaga

SEQ ID NO: 77047 - DNA, 13 bp, Unknown
  misc_feature (1)..( 13): Result.001 file - promoters75/1377642
aattaatgacgat

SEQ ID NO: 77048 - DNA, 13 bp, Unknown
  misc_feature (1)..( 13): Result.001 file - promoters75/1377642
tctgaatattaga

SEQ ID NO: 77049 - DNA, 6 bp, Unknown
  misc_feature (1)..( 6): Result.001 file - promoters75/1377642
ataata

SEQ ID NO: 77050 - DNA, 6 bp, Unknown
  misc_feature (1)..( 6): Result.001 file - promoters75/1377642
ataata

SEQ ID NO: 77051 - DNA, 6 bp, Unknown
  misc_feature (1)..( 6): Result.001 file - promoters75/1377642
ataata

SEQ ID NO: 77052 - DNA, 12 bp, Unknown
  misc_feature (1)..( 12): Result.001 file - promoters75/1377642
atataataaata

SEQ ID NO: 77053 - DNA, 12 bp, Unknown
  misc_feature (1)..( 12): Result.001 file - promoters75/1377642
gcataaaaaata

SEQ ID NO: 77054 - DNA, 12 bp, Unknown
  misc_feature (1)..( 12): Result.001 file - promoters75/1377642
ttattatacttc

SEQ ID NO: 77055 - DNA, 12 bp, Unknown
  misc_feature (1)..( 12): Result.001 file - promoters75/1377642
atataattatct

SEQ ID NO: 77056 - DNA, 10 bp, Unknown
  misc_feature (1)..( 10): Result.001 file - promoters75/1377642
gtatatatat

SEQ ID NO: 77057 - DNA, 10 bp, Unknown
  misc_feature (1)..( 10): Result.001 file - promoters75/1377642
aaataaatag

SEQ ID NO: 77058 - DNA, 10 bp, Unknown
  misc_feature (1)..( 10): Result.001 file - promoters75/1377642
aaatatataa

SEQ ID NO: 77059 - DNA, 9 bp, Unknown
  misc_feature (1)..( 9): Result.001 file - promoters75/1377642
aaattaata

SEQ ID NO: 77060 - DNA, 9 bp, Unknown
  misc_feature (1)..( 9): Result.001 file - promoters75/1377642
taattaagt

SEQ ID NO: 77061 - DNA, 9 bp, Unknown
  misc_feature (1)..( 9): Result.001 file - promoters75/1377642
aaatcaata

SEQ ID NO: 77062 - DNA, 9 bp, Unknown
  misc_feature (1)..( 9): Result.001 file - promoters75/1377642
taattatta

SEQ ID NO: 77063 - DNA, 6 bp, Unknown
  misc_feature (1)..( 6): Result.001 file - promoters75/1377642
aaatat

SEQ ID NO: 77064 - DNA, 6 bp, Unknown
  misc_feature (1)..( 6): Result.001 file - promoters75/1377642
aaatat

SEQ ID NO: 77065 - DNA, 6 bp, Unknown
  misc_feature (1)..( 6): Result.001 file - promoters75/1377642
aaatat

SEQ ID NO: 77066 - DNA, 7 bp, Unknown
  misc_feature (1)..( 7): Result.001 file - promoters75/1377642
ttatata

SEQ ID NO: 77067 - DNA, 7 bp, Unknown
  misc_feature (1)..( 7): Result.001 file - promoters75/1377642
ttatata

SEQ ID NO: 77068 - DNA, 7 bp, Unknown
  misc_feature (1)..( 7): Result.001 file - promoters75/1377642
ttatata

SEQ ID NO: 77069 - DNA, 8 bp, Unknown
  misc_feature (1)..( 8): Result.001 file - promoters75/1377642
cgtatctt

SEQ ID NO: 77070 - DNA, 8 bp, Unknown
  misc_feature (1)..( 8): Result.001 file - promoters75/1377642
tgtatcta

SEQ ID NO: 77071 - DNA, 8 bp, Unknown
  misc_feature (1)..( 8): Result.001 file - promoters75/1377642
tgtgtcta

SEQ ID NO: 77072 - DNA, 8 bp, Unknown
  misc_feature (1)..( 8): Result.001 file - promoters75/1377642
atcaaaag

SEQ ID NO: 77073 - DNA, 8 bp, Unknown
  misc_feature (1)..( 8): Result.001 file - promoters75/1377642
atccaaac

SEQ ID NO: 77074 - DNA, 8 bp, Unknown
  misc_feature (1)..( 8): Result.001 file - promoters75/1377642
atcctaac

SEQ ID NO: 77075 - DNA, 9 bp, Unknown
  misc_feature (1)..( 9): Result.001 file - promoters75/1377642
tttgttggt

SEQ ID NO: 77076 - DNA, 9 bp, Unknown
  misc_feature (1)..( 9): Result.001 file - promoters75/1377642
tttattgat

SEQ ID NO: 77077 - DNA, 9 bp, Unknown
  misc_feature (1)..( 9): Result.001 file - promoters75/1377642
gttactgat

SEQ ID NO: 77078 - DNA, 9 bp, Unknown
  misc_feature (1)..( 9): Result.001 file - promoters75/1377642
aatatatat

SEQ ID NO: 77079 - DNA, 9 bp, Unknown
  misc_feature (1)..( 9): Result.001 file - promoters75/1377642
aatttattt

SEQ ID NO: 77080 - DNA, 9 bp, Unknown
  misc_feature (1)..( 9): Result.001 file - promoters75/1377642
gctttgttt

SEQ ID NO: 77081 - DNA, 11 bp, Unknown
  misc_feature (1)..( 11): Result.001 file - promoters75/1377642
aactagacacg

SEQ ID NO: 77082 - DNA, 11 bp, Unknown
  misc_feature (1)..( 11): Result.001 file - promoters75/1377642
aaaaagagacg

SEQ ID NO: 77083 - DNA, 11 bp, Unknown
  misc_feature (1)..( 11): Result.001 file - promoters75/1377642
aaaaagaatac

SEQ ID NO: 77084 - DNA, 9 bp, Unknown
  misc_feature (1)..( 9): Result.001 file - promoters75/1377642
gggattttt

SEQ ID NO: 77085 - DNA, 9 bp, Unknown
  misc_feature (1)..( 9): Result.001 file - promoters75/1377642
gggttttta

SEQ ID NO: 77086 - DNA, 9 bp, Unknown
  misc_feature (1)..( 9): Result.001 file - promoters75/1377680
ttgattttt

SEQ ID NO: 77087 - DNA, 11 bp, Unknown
  misc_feature (1)..( 11): Result.001 file - promoters75/1377680
tgtttgaccat

SEQ ID NO: 77088 - DNA, 11 bp, Unknown
  misc_feature (1)..( 11): Result.001 file - promoters75/1377680
tatttgaacat

SEQ ID NO: 77089 - DNA, 11 bp, Unknown
  misc_feature (1)..( 11): Result.001 file - promoters75/1377680
tgtgtgagttc

SEQ ID NO: 77090 - DNA, 8 bp, Unknown
  misc_feature (1)..( 8): Result.001 file - promoters75/1377680
taacgaac

SEQ ID NO: 77091 - DNA, 8 bp, Unknown
  misc_feature (1)..( 8): Result.001 file - promoters75/1377680
caacgaaa

SEQ ID NO: 77092 - DNA, 8 bp, Unknown
  misc_feature (1)..( 8): Result.001 file - promoters75/1378049
caactaaa

SEQ ID NO: 77093 - DNA, 8 bp, Unknown
  misc_feature (1)..( 8): Result.001 file - promoters75/1378049
tatatata

SEQ ID NO: 77094 - DNA, 8 bp, Unknown
  misc_feature (1)..( 8): Result.001 file - promoters75/1378049
tatatata

SEQ ID NO: 77095 - DNA, 8 bp, Unknown
  misc_feature (1)..( 8): Result.001 file - promoters75/1378393
gatataat

SEQ ID NO: 77096 - DNA, 12 bp, Unknown
  misc_feature (1)..( 12): Result.001 file - promoters75/1378393
gtttgtttatct

SEQ ID NO: 77097 - DNA, 12 bp, Unknown
  misc_feature (1)..( 12): Result.001 file - promoters75/1378393
ttttctttggtg

SEQ ID NO: 77098 - DNA, 12 bp, Unknown
  misc_feature (1)..( 12): Result.001 file - promoters75/1378393
gtttttttttct

SEQ ID NO: 77099 - DNA, 7 bp, Unknown
  misc_feature (1)..( 7): Result.001 file - promoters75/1378393
tttaacc

SEQ ID NO: 77100 - DNA, 7 bp, Unknown
  misc_feature (1)..( 7): Result.001 file - promoters75/1378393
tttaaca

SEQ ID NO: 77101 - DNA, 7 bp, Unknown
  misc_feature (1)..( 7): Result.001 file - promoters75/1380389
ttttaca

SEQ ID NO: 77102 - DNA, 8 bp, Unknown
  misc_feature (1)..( 8): Result.001 file - promoters75/1380389
cttgcttt

SEQ ID NO: 77103 - DNA, 8 bp, Unknown
  misc_feature (1)..( 8): Result.001 file - promoters75/1380389
tttggttt

SEQ ID NO: 77104 - DNA, 9 bp, Unknown
  misc_feature (1)..( 9): Result.001 file - promoters75/1380708
tttaggtct

SEQ ID NO: 77105 - DNA, 11 bp, Unknown
  misc_feature (1)..( 11): Result.001 file - promoters75/1380708
taacatttttt

SEQ ID NO: 77106 - DNA, 11 bp, Unknown
  misc_feature (1)..( 11): Result.001 file - promoters75/1380708
taagatttttg

SEQ ID NO: 77107 - DNA, 11 bp, Unknown
  misc_feature (1)..( 11): Result.001 file - promoters75/1380708
tagaatttttt

SEQ ID NO: 77108 - DNA, 9 bp, Unknown
  misc_feature (1)..( 9): Result.001 file - promoters75/1380708
tttaatcag

SEQ ID NO: 77109 - DNA, 9 bp, Unknown
  misc_feature (1)..( 9): Result.001 file - promoters75/1380708
tttattcag

SEQ ID NO: 77110 - DNA, 9 bp, Unknown
  misc_feature (1)..( 9): Result.001 file - promoters75/1381704
gttattcga

SEQ ID NO: 77111 - DNA, 9 bp, Unknown
  misc_feature (1)..( 9): Result.001 file - promoters75/1381704
gtttccttt

SEQ ID NO: 77112 - DNA, 9 bp, Unknown
  misc_feature (1)..( 9): Result.001 file - promoters75/1381704
gttaccttt

SEQ ID NO: 77113 - DNA, 9 bp, Unknown
  misc_feature (1)..( 9): Result.001 file - promoters75/1383485
gcttcgttt

SEQ ID NO: 77114 - DNA, 11 bp, Unknown
  misc_feature (1)..( 11): Result.001 file - promoters75/1383485
ccagaattaag

SEQ ID NO: 77115 - DNA, 11 bp, Unknown
  misc_feature (1)..( 11): Result.001 file - promoters75/1383485
ccataattagt

SEQ ID NO: 77116 - DNA, 11 bp, Unknown
  misc_feature (1)..( 11): Result.001 file - promoters75/1383552
atgtaattaag

SEQ ID NO: 77117 - DNA, 11 bp, Unknown
  misc_feature (1)..( 11): Result.001 file - promoters75/1383552
ttaaaaataaa

SEQ ID NO: 77118 - DNA, 11 bp, Unknown
  misc_feature (1)..( 11): Result.001 file - promoters75/1383552
gtaaaaattat

SEQ ID NO: 77119 - DNA, 11 bp, Unknown
  misc_feature (1)..( 11): Result.001 file - promoters75/1383552
gcaaaagtaaa

SEQ ID NO: 77120 - DNA, 11 bp, Unknown
  misc_feature (1)..( 11): Result.001 file - promoters75/1383552
ttaaaaacttc

SEQ ID NO: 77121 - DNA, 7 bp, Unknown
  misc_feature (1)..( 7): Result.001 file - promoters75/1383552
ggcccat

SEQ ID NO: 77122 - DNA, 7 bp, Unknown
  misc_feature (1)..( 7): Result.001 file - promoters75/1383552
ggcccat

SEQ ID NO: 77123 - DNA, 7 bp, Unknown
  misc_feature (1)..( 7): Result.001 file - promoters75/1383552
ggcccat

SEQ ID NO: 77124 - DNA, 7 bp, Unknown
  misc_feature (1)..( 7): Result.001 file - promoters75/1383552
ggcccac

SEQ ID NO: 77125 - DNA, 7 bp, Unknown
  misc_feature (1)..( 7): Result.001 file - promoters75/1383552
aaaattt

SEQ ID NO: 77126 - DNA, 7 bp, Unknown
  misc_feature (1)..( 7): Result.001 file - promoters75/1383552
aaaattg

SEQ ID NO: 77127 - DNA, 7 bp, Unknown
  misc_feature (1)..( 7): Result.001 file - promoters75/1383552
gaaattt

SEQ ID NO: 77128 - DNA, 8 bp, Unknown
  misc_feature (1)..( 8): Result.001 file - promoters75/1384016
aaagatta

SEQ ID NO: 77129 - DNA, 12 bp, Unknown
  misc_feature (1)..( 12): Result.001 file - promoters75/1384016
ttgtaataataa

SEQ ID NO: 77130 - DNA, 12 bp, Unknown
  misc_feature (1)..( 12): Result.001 file - promoters75/1384016
acataataatgt

SEQ ID NO: 77131 - DNA, 12 bp, Unknown
  misc_feature (1)..( 12): Result.001 file - promoters75/1384016
ttgtgatattat

SEQ ID NO: 77132 - DNA, 12 bp, Unknown
  misc_feature (1)..( 12): Result.001 file - promoters75/1384016
tattaataaatt

SEQ ID NO: 77133 - DNA, 12 bp, Unknown
  misc_feature (1)..( 12): Result.001 file - promoters75/1384016
cataaattgtgg

SEQ ID NO: 77134 - DNA, 12 bp, Unknown
  misc_feature (1)..( 12): Result.001 file - promoters75/1384016
attttataaata

SEQ ID NO: 77135 - DNA, 15 bp, Unknown
  misc_feature (1)..( 15): Result.001 file - promoters75/1384016
gttttgtattatcaa

SEQ ID NO: 77136 - DNA, 15 bp, Unknown
  misc_feature (1)..( 15): Result.001 file - promoters75/1384016
taaagatattatcaa

SEQ ID NO: 77137 - DNA, 15 bp, Unknown
  misc_feature (1)..( 15): Result.001 file - promoters75/1384016
tacttttattatttc

SEQ ID NO: 77138 - DNA, 15 bp, Unknown
  misc_feature (1)..( 15): Result.001 file - promoters75/1384016
ctattttattatata

SEQ ID NO: 77139 - DNA, 15 bp, Unknown
  misc_feature (1)..( 15): Result.001 file - promoters75/1384016
tacttttaatatttt

SEQ ID NO: 77140 - DNA, 15 bp, Unknown
  misc_feature (1)..( 15): Result.001 file - promoters75/1384016
aacttttaaatagaa

SEQ ID NO: 77141 - DNA, 12 bp, Unknown
  misc_feature (1)..( 12): Result.001 file - promoters75/1384016
aaaaaaaaagga

SEQ ID NO: 77142 - DNA, 12 bp, Unknown
  misc_feature (1)..( 12): Result.001 file - promoters75/1384016
aaacaaacgaca

SEQ ID NO: 77143 - DNA, 12 bp, Unknown
  misc_feature (1)..( 12): Result.001 file - promoters75/1384016
aaagaaataata

SEQ ID NO: 77144 - DNA, 12 bp, Unknown
  misc_feature (1)..( 12): Result.001 file - promoters75/1384016
aaacaaagtaaa

SEQ ID NO: 77145 - DNA, 12 bp, Unknown
  misc_feature (1)..( 12): Result.001 file - promoters75/1384016
aaaaaatttttt

SEQ ID NO: 77146 - DNA, 12 bp, Unknown
  misc_feature (1)..( 12): Result.001 file - promoters75/1384016
aaatattttttt

SEQ ID NO: 77147 - DNA, 12 bp, Unknown
  misc_feature (1)..( 12): Result.001 file - promoters75/1384016
tttcaaaaatac

SEQ ID NO: 77148 - DNA, 12 bp, Unknown
  misc_feature (1)..( 12): Result.001 file - promoters75/1384016
ttttaaaattta

SEQ ID NO: 77149 - DNA, 12 bp, Unknown
  misc_feature (1)..( 12): Result.001 file - promoters75/1384016
cttcaaacaaaa

SEQ ID NO: 77150 - DNA, 12 bp, Unknown
  misc_feature (1)..( 12): Result.001 file - promoters75/1384016
taacaaaaaaga

SEQ ID NO: 77151 - DNA, 12 bp, Unknown
  misc_feature (1)..( 12): Result.001 file - promoters75/1384016
tatgaaaaaaaa

SEQ ID NO: 77152 - DNA, 12 bp, Unknown
  misc_feature (1)..( 12): Result.001 file - promoters75/1384016
atgtaaaaatta

SEQ ID NO: 77153 - DNA, 10 bp, Unknown
  misc_feature (1)..( 10): Result.001 file - promoters75/1384016
ttcaaaaata

SEQ ID NO: 77154 - DNA, 10 bp, Unknown
  misc_feature (1)..( 10): Result.001 file - promoters75/1384016
tgtaaaaatt

SEQ ID NO: 77155 - DNA, 10 bp, Unknown
  misc_feature (1)..( 10): Result.001 file - promoters75/1384016
aacaaaaaag

SEQ ID NO: 77156 - DNA, 10 bp, Unknown
  misc_feature (1)..( 10): Result.001 file - promoters75/1384016
gttaataata

SEQ ID NO: 77157 - DNA, 10 bp, Unknown
  misc_feature (1)..( 10): Result.001 file - promoters75/1384016
atgaaaaaaa

SEQ ID NO: 77158 - DNA, 11 bp, Unknown
  misc_feature (1)..( 11): Result.001 file - promoters75/1384016
ttcaaacaaaa

SEQ ID NO: 77159 - DNA, 11 bp, Unknown
  misc_feature (1)..( 11): Result.001 file - promoters75/1384016
tttaaaattta

SEQ ID NO: 77160 - DNA, 17 bp, Unknown
  misc_feature (1)..( 17): Result.001 file - promoters75/1384016
gtaagaaaaaaaaaaaa

SEQ ID NO: 77161 - DNA, 17 bp, Unknown
  misc_feature (1)..( 17): Result.001 file - promoters75/1384016
agaagaaacaaagtaaa

SEQ ID NO: 77162 - DNA, 17 bp, Unknown
  misc_feature (1)..( 17): Result.001 file - promoters75/1384016
tctataaaaaatttttt

SEQ ID NO: 77163 - DNA, 17 bp, Unknown
  misc_feature (1)..( 17): Result.001 file - promoters75/1384016
tgatgaaatattttttt

SEQ ID NO: 77164 - DNA, 17 bp, Unknown
  misc_feature (1)..( 17): Result.001 file - promoters75/1384016
agatgaaaattgggaaa

SEQ ID NO: 77165 - DNA, 17 bp, Unknown
  misc_feature (1)..( 17): Result.001 file - promoters75/1384016
tgattaaattcaatcaa

SEQ ID NO: 77166 - DNA, 17 bp, Unknown
  misc_feature (1)..( 17): Result.001 file - promoters75/1384016
tttttaattatttaatc

SEQ ID NO: 77167 - DNA, 11 bp, Unknown
  misc_feature (1)..( 11): Result.001 file - promoters75/1384016
ttttttgcatc

SEQ ID NO: 77168 - DNA, 11 bp, Unknown
  misc_feature (1)..( 11): Result.001 file - promoters75/1384016
gttttagcaaa

SEQ ID NO: 77169 - DNA, 12 bp, Unknown
  misc_feature (1)..( 12): Result.001 file - promoters75/1384016
tttttcatcata

SEQ ID NO: 77170 - DNA, 12 bp, Unknown
  misc_feature (1)..( 12): Result.001 file - promoters75/1384016
ttttgttgttac

SEQ ID NO: 77171 - DNA, 12 bp, Unknown
  misc_feature (1)..( 12): Result.001 file - promoters75/1384016
atttttagtaaa

SEQ ID NO: 77172 - DNA, 12 bp, Unknown
  misc_feature (1)..( 12): Result.001 file - promoters75/1384016
ttatatagcaaa

SEQ ID NO: 77173 - DNA, 11 bp, Unknown
  misc_feature (1)..( 11): Result.001 file - promoters75/1384016
ctctaaaaaaa

SEQ ID NO: 77174 - DNA, 11 bp, Unknown
  misc_feature (1)..( 11): Result.001 file - promoters75/1384016
aattaaataaa

SEQ ID NO: 77175 - DNA, 11 bp, Unknown
  misc_feature (1)..( 11): Result.001 file - promoters75/1384016
tcttaaagata

SEQ ID NO: 77176 - DNA, 11 bp, Unknown
  misc_feature (1)..( 11): Result.001 file - promoters75/1384016
tagcaaaaaac

SEQ ID NO: 77177 - DNA, 11 bp, Unknown
  misc_feature (1)..( 11): Result.001 file - promoters75/1384016
acataaatttt

SEQ ID NO: 77178 - DNA, 11 bp, Unknown
  misc_feature (1)..( 11): Result.001 file - promoters75/1384016
ttttaaataga

SEQ ID NO: 77179 - DNA, 12 bp, Unknown
  misc_feature (1)..( 12): Result.001 file - promoters75/1384016
cgtttttgtcta

SEQ ID NO: 77180 - DNA, 12 bp, Unknown
  misc_feature (1)..( 12): Result.001 file - promoters75/1384016
ggtttttcggtt

SEQ ID NO: 77181 - DNA, 12 bp, Unknown
  misc_feature (1)..( 12): Result.001 file - promoters75/1384016
tgtttttgctga

SEQ ID NO: 77182 - DNA, 12 bp, Unknown
  misc_feature (1)..( 12): Result.001 file - promoters75/1384016
tttttttgtttc

SEQ ID NO: 77183 - DNA, 12 bp, Unknown
  misc_feature (1)..( 12): Result.001 file - promoters75/1384016
tgtgtttaatca

SEQ ID NO: 77184 - DNA, 12 bp, Unknown
  misc_feature (1)..( 12): Result.001 file - promoters75/1384016
tgattttggttt

SEQ ID NO: 77185 - DNA, 10 bp, Unknown
  misc_feature (1)..( 10): Result.001 file - promoters75/1384016
tttatacata

SEQ ID NO: 77186 - DNA, 10 bp, Unknown
  misc_feature (1)..( 10): Result.001 file - promoters75/1384016
tttataaata

SEQ ID NO: 77187 - DNA, 10 bp, Unknown
  misc_feature (1)..( 10): Result.001 file - promoters75/1384016
gttattaata

SEQ ID NO: 77188 - DNA, 10 bp, Unknown
  misc_feature (1)..( 10): Result.001 file - promoters75/1384016
ttttttaatt

SEQ ID NO: 77189 - DNA, 10 bp, Unknown
  misc_feature (1)..( 10): Result.001 file - promoters75/1384016
acttttaaca

SEQ ID NO: 77190 - DNA, 10 bp, Unknown
  misc_feature (1)..( 10): Result.001 file - promoters75/1384016
tttaaacatt

SEQ ID NO: 77191 - DNA, 12 bp, Unknown
  misc_feature (1)..( 12): Result.001 file - promoters75/1384016
aataatgttttt

SEQ ID NO: 77192 - DNA, 12 bp, Unknown
  misc_feature (1)..( 12): Result.001 file - promoters75/1384016
ataaatattttc

SEQ ID NO: 77193 - DNA, 12 bp, Unknown
  misc_feature (1)..( 12): Result.001 file - promoters75/1384016
tcacatatatat

SEQ ID NO: 77194 - DNA, 12 bp, Unknown
  misc_feature (1)..( 12): Result.001 file - promoters75/1384016
acaaatagaaga

SEQ ID NO: 77195 - DNA, 12 bp, Unknown
  misc_feature (1)..( 12): Result.001 file - promoters75/1384016
ttaaacattaaa

SEQ ID NO: 77196 - DNA, 12 bp, Unknown
  misc_feature (1)..( 12): Result.001 file - promoters75/1387123
gatattattttt

SEQ ID NO: 77197 - DNA, 11 bp, Unknown
  misc_feature (1)..( 11): Result.001 file - promoters75/1387123
tgtttgaccat

SEQ ID NO: 77198 - DNA, 11 bp, Unknown
  misc_feature (1)..( 11): Result.001 file - promoters75/1387123
tatttgaacat

SEQ ID NO: 77199 - DNA, 11 bp, Unknown
  misc_feature (1)..( 11): Result.001 file - promoters75/1387123
tgtgtgagttc

SEQ ID NO: 77200 - DNA, 8 bp, Unknown
  misc_feature (1)..( 8): Result.001 file - promoters75/1387123
taacgaac

SEQ ID NO: 77201 - DNA, 8 bp, Unknown
  misc_feature (1)..( 8): Result.001 file - promoters75/1387123
caacgaaa

SEQ ID NO: 77202 - DNA, 8 bp, Unknown
  misc_feature (1)..( 8): Result.001 file - promoters75/1387349
caactaaa

SEQ ID NO: 77203 - DNA, 9 bp, Unknown
  misc_feature (1)..( 9): Result.001 file - promoters75/1387349
atagataca

SEQ ID NO: 77204 - DNA, 9 bp, Unknown
  misc_feature (1)..( 9): Result.001 file - promoters75/1387349
tttgataca

SEQ ID NO: 77205 - DNA, 9 bp, Unknown
  misc_feature (1)..( 9): Result.001 file - promoters75/1387671
tttcataca

SEQ ID NO: 77206 - DNA, 12 bp, Unknown
  misc_feature (1)..( 12): Result.001 file - promoters75/1387671
cactatataaag

SEQ ID NO: 77207 - DNA, 12 bp, Unknown
  misc_feature (1)..( 12): Result.001 file - promoters75/1387671
cactatttaaag

SEQ ID NO: 77208 - DNA, 12 bp, Unknown
  misc_feature (1)..( 12): Result.001 file - promoters75/1387671
tactattaaagc

SEQ ID NO: 77209 - DNA, 12 bp, Unknown
  misc_feature (1)..( 12): Result.001 file - promoters75/1387671
tttaattaaaac

SEQ ID NO: 77210 - DNA, 12 bp, Unknown
  misc_feature (1)..( 12): Result.001 file - promoters75/1387671
gcttatttatga

SEQ ID NO: 77211 - DNA, 12 bp, Unknown
  misc_feature (1)..( 12): Result.001 file - promoters75/1387671
tactataaattc

SEQ ID NO: 77212 - DNA, 12 bp, Unknown
  misc_feature (1)..( 12): Result.001 file - promoters75/1387671
ctcttatgattt

SEQ ID NO: 77213 - DNA, 12 bp, Unknown
  misc_feature (1)..( 12): Result.001 file - promoters75/1387671
ctcgtataattc

SEQ ID NO: 77214 - DNA, 12 bp, Unknown
  misc_feature (1)..( 12): Result.001 file - promoters75/1387671
ttcttattggaa

SEQ ID NO: 77215 - DNA, 12 bp, Unknown
  misc_feature (1)..( 12): Result.001 file - promoters75/1387671
cttccatgtttt

SEQ ID NO: 77216 - DNA, 12 bp, Unknown
  misc_feature (1)..( 12): Result.001 file - promoters75/1387671
ttcttaggattc

SEQ ID NO: 77217 - DNA, 12 bp, Unknown
  misc_feature (1)..( 12): Result.001 file - promoters75/1387906
ttcgtttaacag

SEQ ID NO: 77218 - DNA, 11 bp, Unknown
  misc_feature (1)..( 11): Result.001 file - promoters75/1387906
atataacaaca

SEQ ID NO: 77219 - DNA, 11 bp, Unknown
  misc_feature (1)..( 11): Result.001 file - promoters75/1387906
ttttaataaca

SEQ ID NO: 77220 - DNA, 11 bp, Unknown
  misc_feature (1)..( 11): Result.001 file - promoters75/1387906
ttttactaact

SEQ ID NO: 77221 - DNA, 10 bp, Unknown
  misc_feature (1)..( 10): Result.001 file - promoters75/1387906
taaatttgtt

SEQ ID NO: 77222 - DNA, 10 bp, Unknown
  misc_feature (1)..( 10): Result.001 file - promoters75/1387906
aaaatctgtt

SEQ ID NO: 77223 - DNA, 10 bp, Unknown
  misc_feature (1)..( 10): Result.001 file - promoters75/1388973
aaaatcgaac

SEQ ID NO: 77224 - DNA, 9 bp, Unknown
  misc_feature (1)..( 9): Result.001 file - promoters75/1388973
ttttgcata

SEQ ID NO: 77225 - DNA, 9 bp, Unknown
  misc_feature (1)..( 9): Result.001 file - promoters75/1388973
gattgaata

SEQ ID NO: 77226 - DNA, 9 bp, Unknown
  misc_feature (1)..( 9): Result.001 file - promoters75/1390146
ttttccatc

SEQ ID NO: 77227 - DNA, 9 bp, Unknown
  misc_feature (1)..( 9): Result.001 file - promoters75/1390146
aatttcaac

SEQ ID NO: 77228 - DNA, 9 bp, Unknown
  misc_feature (1)..( 9): Result.001 file - promoters75/1390146
aatttgaac

SEQ ID NO: 77229 - DNA, 9 bp, Unknown
  misc_feature (1)..( 9): Result.001 file - promoters75/1390146
aatgtgaaa

SEQ ID NO: 77230 - DNA, 9 bp, Unknown
  misc_feature (1)..( 9): Result.001 file - promoters75/1390240
aatatgatt

SEQ ID NO: 77231 - DNA, 9 bp, Unknown
  misc_feature (1)..( 9): Result.001 file - promoters75/1390240
acttgctga

SEQ ID NO: 77232 - DNA, 9 bp, Unknown
  misc_feature (1)..( 9): Result.001 file - promoters75/1390240
gcttgctta

SEQ ID NO: 77233 - DNA, 9 bp, Unknown
  misc_feature (1)..( 9): Result.001 file - promoters75/1390240
acttgttga

SEQ ID NO: 77234 - DNA, 8 bp, Unknown
  misc_feature (1)..( 8): Result.001 file - promoters75/1390240
aaaataaa

SEQ ID NO: 77235 - DNA, 8 bp, Unknown
  misc_feature (1)..( 8): Result.001 file - promoters75/1390240
aaagtaaa

SEQ ID NO: 77236 - DNA, 8 bp, Unknown
  misc_feature (1)..( 8): Result.001 file - promoters75/1390240
aaaagaaa

SEQ ID NO: 77237 - DNA, 7 bp, Unknown
  misc_feature (1)..( 7): Result.001 file - promoters75/1390240
cggatgg

SEQ ID NO: 77238 - DNA, 7 bp, Unknown
  misc_feature (1)..( 7): Result.001 file - promoters75/1390240
gggatgg

SEQ ID NO: 77239 - DNA, 7 bp, Unknown
  misc_feature (1)..( 7): Result.001 file - promoters75/1393787
gggatgt

SEQ ID NO: 77240 - DNA, 16 bp, Unknown
  misc_feature (1)..( 16): Result.001 file - promoters75/1393787
gattaatttctctact

SEQ ID NO: 77241 - DNA, 16 bp, Unknown
  misc_feature (1)..( 16): Result.001 file - promoters75/1393787
gattaatgtctcttgc

SEQ ID NO: 77242 - DNA, 16 bp, Unknown
  misc_feature (1)..( 16): Result.001 file - promoters75/1393787
aagttagttctcttgc

SEQ ID NO: 77243 - DNA, 16 bp, Unknown
  misc_feature (1)..( 16): Result.001 file - promoters75/1393787
tgctaatgtgaactta

SEQ ID NO: 77244 - DNA, 10 bp, Unknown
  misc_feature (1)..( 10): Result.001 file - promoters75/1393787
ttatgttttt

SEQ ID NO: 77245 - DNA, 10 bp, Unknown
  misc_feature (1)..( 10): Result.001 file - promoters75/1393787
ccatgttttt

SEQ ID NO: 77246 - DNA, 10 bp, Unknown
  misc_feature (1)..( 10): Result.001 file - promoters75/1393787
ttatgttatg

SEQ ID NO: 77247 - DNA, 10 bp, Unknown
  misc_feature (1)..( 10): Result.001 file - promoters75/1393787
ctatgctttg

SEQ ID NO: 77248 - DNA, 11 bp, Unknown
  misc_feature (1)..( 11): Result.001 file - promoters75/1393787
atttaaatttt

SEQ ID NO: 77249 - DNA, 11 bp, Unknown
  misc_feature (1)..( 11): Result.001 file - promoters75/1393787
attaaaatgtc

SEQ ID NO: 77250 - DNA, 11 bp, Unknown
  misc_feature (1)..( 11): Result.001 file - promoters75/1393787
ttttgaatttt

SEQ ID NO: 77251 - DNA, 7 bp, Unknown
  misc_feature (1)..( 7): Result.001 file - promoters75/1393787
taaaaaa

SEQ ID NO: 77252 - DNA, 7 bp, Unknown
  misc_feature (1)..( 7): Result.001 file - promoters75/1393787
taaaaat

SEQ ID NO: 77253 - DNA, 8 bp, Unknown
  misc_feature (1)..( 8): Result.001 file - promoters75/1393787
caaataat

SEQ ID NO: 77254 - DNA, 7 bp, Unknown
  misc_feature (1)..( 7): Result.001 file - promoters75/1393787
ttattct

SEQ ID NO: 77255 - DNA, 7 bp, Unknown
  misc_feature (1)..( 7): Result.001 file - promoters75/1393787
atattct

SEQ ID NO: 77256 - DNA, 7 bp, Unknown
  misc_feature (1)..( 7): Result.001 file - promoters75/1393787
ttattca

SEQ ID NO: 77257 - DNA, 11 bp, Unknown
  misc_feature (1)..( 11): Result.001 file - promoters75/1393787
attttttttaa

SEQ ID NO: 77258 - DNA, 11 bp, Unknown
  misc_feature (1)..( 11): Result.001 file - promoters75/1393787
cattttcttat

SEQ ID NO: 77259 - DNA, 11 bp, Unknown
  misc_feature (1)..( 11): Result.001 file - promoters75/1393787
cccatttataa

SEQ ID NO: 77260 - DNA, 11 bp, Unknown
  misc_feature (1)..( 11): Result.001 file - promoters75/1393787
cattttcaagt

SEQ ID NO: 77261 - DNA, 11 bp, Unknown
  misc_feature (1)..( 11): Result.001 file - promoters75/1393787
taattatttgt

SEQ ID NO: 77262 - DNA, 11 bp, Unknown
  misc_feature (1)..( 11): Result.001 file - promoters75/1393787
taatcattttc

SEQ ID NO: 77263 - DNA, 11 bp, Unknown
  misc_feature (1)..( 11): Result.001 file - promoters75/1393787
tctccattttc

SEQ ID NO: 77264 - DNA, 11 bp, Unknown
  misc_feature (1)..( 11): Result.001 file - promoters75/1393787
ggcccatttat

SEQ ID NO: 77265 - DNA, 9 bp, Unknown
  misc_feature (1)..( 9): Result.001 file - promoters75/1393787
ttatgtttt

SEQ ID NO: 77266 - DNA, 9 bp, Unknown
  misc_feature (1)..( 9): Result.001 file - promoters75/1393787
ttatgtcgt

SEQ ID NO: 77267 - DNA, 9 bp, Unknown
  misc_feature (1)..( 9): Result.001 file - promoters75/1393787
ctatgcttt

SEQ ID NO: 77268 - DNA, 10 bp, Unknown
  misc_feature (1)..( 10): Result.001 file - promoters75/1393787
caagaacttc

SEQ ID NO: 77269 - DNA, 10 bp, Unknown
  misc_feature (1)..( 10): Result.001 file - promoters75/1393787
caagaaattc

SEQ ID NO: 77270 - DNA, 10 bp, Unknown
  misc_feature (1)..( 10): Result.001 file - promoters75/1393787
ttcaaaattc

SEQ ID NO: 77271 - DNA, 6 bp, Unknown
  misc_feature (1)..( 6): Result.001 file - promoters75/1393787
aaatga

SEQ ID NO: 77272 - DNA, 6 bp, Unknown
  misc_feature (1)..( 6): Result.001 file - promoters75/1393787
aaatga

SEQ ID NO: 77273 - DNA, 7 bp, Unknown
  misc_feature (1)..( 7): Result.001 file - promoters75/1394510
aaagtga

SEQ ID NO: 77274 - DNA, 11 bp, Unknown
  misc_feature (1)..( 11): Result.001 file - promoters75/1394510
taacatttttt

SEQ ID NO: 77275 - DNA, 11 bp, Unknown
  misc_feature (1)..( 11): Result.001 file - promoters75/1394510
taagatttttg

SEQ ID NO: 77276 - DNA, 11 bp, Unknown
  misc_feature (1)..( 11): Result.001 file - promoters75/1394510
tagaatttttt

SEQ ID NO: 77277 - DNA, 9 bp, Unknown
  misc_feature (1)..( 9): Result.001 file - promoters75/1394510
tttaatcag

SEQ ID NO: 77278 - DNA, 9 bp, Unknown
  misc_feature (1)..( 9): Result.001 file - promoters75/1394510
tttattcag

SEQ ID NO: 77279 - DNA, 9 bp, Unknown
  misc_feature (1)..( 9): Result.001 file - promoters75/1394592
gttattcga

SEQ ID NO: 77280 - DNA, 9 bp, Unknown
  misc_feature (1)..( 9): Result.001 file - promoters75/1394592
ataattata

SEQ ID NO: 77281 - DNA, 9 bp, Unknown
  misc_feature (1)..( 9): Result.001 file - promoters75/1394592
ccaatcata

SEQ ID NO: 77282 - DNA, 9 bp, Unknown
  misc_feature (1)..( 9): Result.001 file - promoters75/1395095
atatttaat

SEQ ID NO: 77283 - DNA, 9 bp, Unknown
  misc_feature (1)..( 9): Result.001 file - promoters75/1395095
aaaataaga

SEQ ID NO: 77284 - DNA, 9 bp, Unknown
  misc_feature (1)..( 9): Result.001 file - promoters75/1395095
aaaataatc

SEQ ID NO: 77285 - DNA, 9 bp, Unknown
  misc_feature (1)..( 9): Result.001 file - promoters75/1395095
aaaatgatc

SEQ ID NO: 77286 - DNA, 7 bp, Unknown
  misc_feature (1)..( 7): Result.001 file - promoters75/1395095
catagat

SEQ ID NO: 77287 - DNA, 7 bp, Unknown
  misc_feature (1)..( 7): Result.001 file - promoters75/1395095
aatagat

SEQ ID NO: 77288 - DNA, 7 bp, Unknown
  misc_feature (1)..( 7): Result.001 file - promoters75/1395095
aatcgat

SEQ ID NO: 77289 - DNA, 8 bp, Unknown
  misc_feature (1)..( 8): Result.001 file - promoters75/1395095
tttatttc

SEQ ID NO: 77290 - DNA, 8 bp, Unknown
  misc_feature (1)..( 8): Result.001 file - promoters75/1395095
tttctttc

SEQ ID NO: 77291 - DNA, 8 bp, Unknown
  misc_feature (1)..( 8): Result.001 file - promoters75/1395095
tttgtttt

SEQ ID NO: 77292 - DNA, 8 bp, Unknown
  misc_feature (1)..( 8): Result.001 file - promoters75/1395095
aaaaaaag

SEQ ID NO: 77293 - DNA, 8 bp, Unknown
  misc_feature (1)..( 8): Result.001 file - promoters75/1395095
caaagaag

SEQ ID NO: 77294 - DNA, 8 bp, Unknown
  misc_feature (1)..( 8): Result.001 file - promoters75/1395095
gaaaaaaa

SEQ ID NO: 77295 - DNA, 11 bp, Unknown
  misc_feature (1)..( 11): Result.001 file - promoters75/1395095
caacttttttt

SEQ ID NO: 77296 - DNA, 11 bp, Unknown
  misc_feature (1)..( 11): Result.001 file - promoters75/1395095
caaattttttt

SEQ ID NO: 77297 - DNA, 11 bp, Unknown
  misc_feature (1)..( 11): Result.001 file - promoters75/1395095
tacatttttta

SEQ ID NO: 77298 - DNA, 8 bp, Unknown
  misc_feature (1)..( 8): Result.001 file - promoters75/1395095
caagtctt

SEQ ID NO: 77299 - DNA, 8 bp, Unknown
  misc_feature (1)..( 8): Result.001 file - promoters75/1395095
aaagtctt

SEQ ID NO: 77300 - DNA, 8 bp, Unknown
  misc_feature (1)..( 8): Result.001 file - promoters75/1395095
aaattctg

SEQ ID NO: 77301 - DNA, 8 bp, Unknown
  misc_feature (1)..( 8): Result.001 file - promoters75/1395095
catatttt

SEQ ID NO: 77302 - DNA, 8 bp, Unknown
  misc_feature (1)..( 8): Result.001 file - promoters75/1395095
catttttt

SEQ ID NO: 77303 - DNA, 8 bp, Unknown
  misc_feature (1)..( 8): Result.001 file - promoters75/1395095
aatttttt

SEQ ID NO: 77304 - DNA, 8 bp, Unknown
  misc_feature (1)..( 8): Result.001 file - promoters75/1395095
aaaattca

SEQ ID NO: 77305 - DNA, 8 bp, Unknown
  misc_feature (1)..( 8): Result.001 file - promoters75/1395095
aaaattct

SEQ ID NO: 77306 - DNA, 8 bp, Unknown
  misc_feature (1)..( 8): Result.001 file - promoters75/1395095
taaagtct

SEQ ID NO: 77307 - DNA, 8 bp, Unknown
  misc_feature (1)..( 8): Result.001 file - promoters75/1395095
tataaatt

SEQ ID NO: 77308 - DNA, 8 bp, Unknown
  misc_feature (1)..( 8): Result.001 file - promoters75/1395095
tataaacc

SEQ ID NO: 77309 - DNA, 8 bp, Unknown
  misc_feature (1)..( 8): Result.001 file - promoters75/1396182
aataaaaa

SEQ ID NO: 77310 - DNA, 9 bp, Unknown
  misc_feature (1)..( 9): Result.001 file - promoters75/1396182
aagaataag

SEQ ID NO: 77311 - DNA, 9 bp, Unknown
  misc_feature (1)..( 9): Result.001 file - promoters75/1396182
gttaataag

SEQ ID NO: 77312 - DNA, 9 bp, Unknown
  misc_feature (1)..( 9): Result.001 file - promoters75/1396182
aagagtaaa

SEQ ID NO: 77313 - DNA, 7 bp, Unknown
  misc_feature (1)..( 7): Result.001 file - promoters75/1396182
aaaacaa

SEQ ID NO: 77314 - DNA, 7 bp, Unknown
  misc_feature (1)..( 7): Result.001 file - promoters75/1396182
aaagcaa

SEQ ID NO: 77315 - DNA, 7 bp, Unknown
  misc_feature (1)..( 7): Result.001 file - promoters75/1396182
gaaacaa

SEQ ID NO: 77316 - DNA, 11 bp, Unknown
  misc_feature (1)..( 11): Result.001 file - promoters75/1396182
tagtatgcaat

SEQ ID NO: 77317 - DNA, 11 bp, Unknown
  misc_feature (1)..( 11): Result.001 file - promoters75/1396182
ggaaatgaaat

SEQ ID NO: 77318 - DNA, 11 bp, Unknown
  misc_feature (1)..( 11): Result.001 file - promoters75/1396182
ggaaaagaaaa

SEQ ID NO: 77319 - DNA, 7 bp, Unknown
  misc_feature (1)..( 7): Result.001 file - promoters75/1396182
ctatata

SEQ ID NO: 77320 - DNA, 7 bp, Unknown
  misc_feature (1)..( 7): Result.001 file - promoters75/1396182
gtatata

SEQ ID NO: 77321 - DNA, 7 bp, Unknown
  misc_feature (1)..( 7): Result.001 file - promoters75/1396308
gtatata

SEQ ID NO: 77322 - DNA, 9 bp, Unknown
  misc_feature (1)..( 9): Result.001 file - promoters75/1396308
gggattttt

SEQ ID NO: 77323 - DNA, 9 bp, Unknown
  misc_feature (1)..( 9): Result.001 file - promoters75/1396308
gggttttta

SEQ ID NO: 77324 - DNA, 9 bp, Unknown
  misc_feature (1)..( 9): Result.001 file - promoters75/1396308
ttgattttt

SEQ ID NO: 77325 - DNA, 7 bp, Unknown
  misc_feature (1)..( 7): Result.001 file - promoters75/1396308
taattaa

SEQ ID NO: 77326 - DNA, 7 bp, Unknown
  misc_feature (1)..( 7): Result.001 file - promoters75/1396308
taattat

SEQ ID NO: 77327 - DNA, 7 bp, Unknown
  misc_feature (1)..( 7): Result.001 file - promoters75/1396354
taattat

SEQ ID NO: 77328 - DNA, 6 bp, Unknown
  misc_feature (1)..( 6): Result.001 file - promoters75/1396354
tacatt

SEQ ID NO: 77329 - DNA, 6 bp, Unknown
  misc_feature (1)..( 6): Result.001 file - promoters75/1396354
tacatt

SEQ ID NO: 77330 - DNA, 6 bp, Unknown
  misc_feature (1)..( 6): Result.001 file - promoters75/1396354
tacatt

SEQ ID NO: 77331 - DNA, 7 bp, Unknown
  misc_feature (1)..( 7): Result.001 file - promoters75/1396354
cttgatt

SEQ ID NO: 77332 - DNA, 7 bp, Unknown
  misc_feature (1)..( 7): Result.001 file - promoters75/1396354
tttgatt

SEQ ID NO: 77333 - DNA, 7 bp, Unknown
  misc_feature (1)..( 7): Result.001 file - promoters75/1397231
tttgatt

SEQ ID NO: 77334 - DNA, 7 bp, Unknown
  misc_feature (1)..( 7): Result.001 file - promoters75/1397231
ttttctt

SEQ ID NO: 77335 - DNA, 7 bp, Unknown
  misc_feature (1)..( 7): Result.001 file - promoters75/1397231
tttgctt

SEQ ID NO: 77336 - DNA, 7 bp, Unknown
  misc_feature (1)..( 7): Result.001 file - promoters75/1397231
tttgcta

SEQ ID NO: 77337 - DNA, 6 bp, Unknown
  misc_feature (1)..( 6): Result.001 file - promoters75/1397231
ttcttt

SEQ ID NO: 77338 - DNA, 6 bp, Unknown
  misc_feature (1)..( 6): Result.001 file - promoters75/1397231
ttcttt

SEQ ID NO: 77339 - DNA, 7 bp, Unknown
  misc_feature (1)..( 7): Result.001 file - promoters75/1397231
ttcgttt

SEQ ID NO: 77340 - DNA, 9 bp, Unknown
  misc_feature (1)..( 9): Result.001 file - promoters75/1397231
aacaaaatt

SEQ ID NO: 77341 - DNA, 9 bp, Unknown
  misc_feature (1)..( 9): Result.001 file - promoters75/1397231
aacaaaaca

SEQ ID NO: 77342 - DNA, 9 bp, Unknown
  misc_feature (1)..( 9): Result.001 file - promoters75/1397231
cccaagaca

SEQ ID NO: 77343 - DNA, 9 bp, Unknown
  misc_feature (1)..( 9): Result.001 file - promoters75/1397231
aaagttaaa

SEQ ID NO: 77344 - DNA, 9 bp, Unknown
  misc_feature (1)..( 9): Result.001 file - promoters75/1397231
aaaattata

SEQ ID NO: 77345 - DNA, 9 bp, Unknown
  misc_feature (1)..( 9): Result.001 file - promoters75/1397263
aaaattata

SEQ ID NO: 77346 - DNA, 8 bp, Unknown
  misc_feature (1)..( 8): Result.001 file - promoters75/1397263
tttgtaat

SEQ ID NO: 77347 - DNA, 8 bp, Unknown
  misc_feature (1)..( 8): Result.001 file - promoters75/1397263
tttttaaa

SEQ ID NO: 77348 - DNA, 8 bp, Unknown
  misc_feature (1)..( 8): Result.001 file - promoters75/1397263
atttcaaa

SEQ ID NO: 77349 - DNA, 8 bp, Unknown
  misc_feature (1)..( 8): Result.001 file - promoters75/1397263
atttcagt

SEQ ID NO: 77350 - DNA, 8 bp, Unknown
  misc_feature (1)..( 8): Result.001 file - promoters75/1397753
tttacaag

SEQ ID NO: 77351 - DNA, 12 bp, Unknown
  misc_feature (1)..( 12): Result.001 file - promoters75/1397753
ttctcaaattgt

SEQ ID NO: 77352 - DNA, 12 bp, Unknown
  misc_feature (1)..( 12): Result.001 file - promoters75/1397753
ttctaaaataat

SEQ ID NO: 77353 - DNA, 12 bp, Unknown
  misc_feature (1)..( 12): Result.001 file - promoters75/1398337
gaagaaaaaaat

SEQ ID NO: 77354 - DNA, 11 bp, Unknown
  misc_feature (1)..( 11): Result.001 file - promoters75/1398337
taaacacaaac

SEQ ID NO: 77355 - DNA, 11 bp, Unknown
  misc_feature (1)..( 11): Result.001 file - promoters75/1398337
gaaacaaaaac

SEQ ID NO: 77356 - DNA, 11 bp, Unknown
  misc_feature (1)..( 11): Result.001 file - promoters75/1399325
gaaagaaagct

SEQ ID NO: 77357 - DNA, 8 bp, Unknown
  misc_feature (1)..( 8): Result.001 file - promoters75/1399325
ctattttt

SEQ ID NO: 77358 - DNA, 8 bp, Unknown
  misc_feature (1)..( 8): Result.001 file - promoters75/1399325
aaattttt

SEQ ID NO: 77359 - DNA, 8 bp, Unknown
  misc_feature (1)..( 8): Result.001 file - promoters75/1399325
aaacttta

SEQ ID NO: 77360 - DNA, 8 bp, Unknown
  misc_feature (1)..( 8): Result.001 file - promoters75/1399325
aaagtaat

SEQ ID NO: 77361 - DNA, 8 bp, Unknown
  misc_feature (1)..( 8): Result.001 file - promoters75/1399325
aaaataaa

SEQ ID NO: 77362 - DNA, 8 bp, Unknown
  misc_feature (1)..( 8): Result.001 file - promoters75/1441657
caaataaa

SEQ ID NO: 77363 - DNA, 11 bp, Unknown
  misc_feature (1)..( 11): Result.001 file - promoters75/1441657
atcttctgtct

SEQ ID NO: 77364 - DNA, 11 bp, Unknown
  misc_feature (1)..( 11): Result.001 file - promoters75/1441657
cacttgtgttt

SEQ ID NO: 77365 - DNA, 11 bp, Unknown
  misc_feature (1)..( 11): Result.001 file - promoters75/1441657
atcttctaaaa

SEQ ID NO: 77366 - DNA, 11 bp, Unknown
  misc_feature (1)..( 11): Result.001 file - promoters75/1441657
taattgtattt

SEQ ID NO: 77367 - DNA, 7 bp, Unknown
  misc_feature (1)..( 7): Result.001 file - promoters75/1441657
ccaaaca

SEQ ID NO: 77368 - DNA, 7 bp, Unknown
  misc_feature (1)..( 7): Result.001 file - promoters75/1441657
ccaaacc

SEQ ID NO: 77369 - DNA, 7 bp, Unknown
  misc_feature (1)..( 7): Result.001 file - promoters75/1441657
tcaaacc

SEQ ID NO: 77370 - DNA, 9 bp, Unknown
  misc_feature (1)..( 9): Result.001 file - promoters75/1441657
aaattttca

SEQ ID NO: 77371 - DNA, 9 bp, Unknown
  misc_feature (1)..( 9): Result.001 file - promoters75/1441657
taatttttg

SEQ ID NO: 77372 - DNA, 9 bp, Unknown
  misc_feature (1)..( 9): Result.001 file - promoters75/1441657
aaatattca

SEQ ID NO: 77373 - DNA, 7 bp, Unknown
  misc_feature (1)..( 7): Result.001 file - promoters75/1441657
caaaatt

SEQ ID NO: 77374 - DNA, 7 bp, Unknown
  misc_feature (1)..( 7): Result.001 file - promoters75/1441657
caatatt

SEQ ID NO: 77375 - DNA, 7 bp, Unknown
  misc_feature (1)..( 7): Result.001 file - promoters75/1441665
caatatg

SEQ ID NO: 77376 - DNA, 12 bp, Unknown
  misc_feature (1)..( 12): Result.001 file - promoters75/1441665
catataaaacga

SEQ ID NO: 77377 - DNA, 12 bp, Unknown
  misc_feature (1)..( 12): Result.001 file - promoters75/1441665
gatacaaaaccc

SEQ ID NO: 77378 - DNA, 12 bp, Unknown
  misc_feature (1)..( 12): Result.001 file - promoters75/1441665
gagacaaataga

SEQ ID NO: 77379 - DNA, 12 bp, Unknown
  misc_feature (1)..( 12): Result.001 file - promoters75/1441665
tatataaaacca

SEQ ID NO: 77380 - DNA, 12 bp, Unknown
  misc_feature (1)..( 12): Result.001 file - promoters75/1441665
tatgcaaagcca

SEQ ID NO: 77381 - DNA, 12 bp, Unknown
  misc_feature (1)..( 12): Result.001 file - promoters75/1441665
gagtcaaagaaa

SEQ ID NO: 77382 - DNA, 10 bp, Unknown
  misc_feature (1)..( 10): Result.001 file - promoters75/1441665
ccaaacaaaa

SEQ ID NO: 77383 - DNA, 10 bp, Unknown
  misc_feature (1)..( 10): Result.001 file - promoters75/1441665
agaaacaaag

SEQ ID NO: 77384 - DNA, 10 bp, Unknown
  misc_feature (1)..( 10): Result.001 file - promoters75/1441665
tcaaagaaat

SEQ ID NO: 77385 - DNA, 10 bp, Unknown
  misc_feature (1)..( 10): Result.001 file - promoters75/1441665
ccaaacaaca

SEQ ID NO: 77386 - DNA, 10 bp, Unknown
  misc_feature (1)..( 10): Result.001 file - promoters75/1441665
taaaaccaag

SEQ ID NO: 77387 - DNA, 11 bp, Unknown
  misc_feature (1)..( 11): Result.001 file - promoters75/1441835
gcaaagccata

SEQ ID NO: 77388 - DNA, 14 bp, Unknown
  misc_feature (1)..( 14): Result.001 file - promoters75/1441835
tagcattaatgaac

SEQ ID NO: 77389 - DNA, 14 bp, Unknown
  misc_feature (1)..( 14): Result.001 file - promoters75/1441835
atacataaataaat

SEQ ID NO: 77390 - DNA, 14 bp, Unknown
  misc_feature (1)..( 14): Result.001 file - promoters75/1441835
atatataaaaattt

SEQ ID NO: 77391 - DNA, 14 bp, Unknown
  misc_feature (1)..( 14): Result.001 file - promoters75/1441835
atctataaaaagaa

SEQ ID NO: 77392 - DNA, 14 bp, Unknown
  misc_feature (1)..( 14): Result.001 file - promoters75/1441835
tggtattaaaatag

SEQ ID NO: 77393 - DNA, 14 bp, Unknown
  misc_feature (1)..( 14): Result.001 file - promoters75/1441835
agagacaaatagaa

SEQ ID NO: 77394 - DNA, 14 bp, Unknown
  misc_feature (1)..( 14): Result.001 file - promoters75/1441835
ggagtttaaaattt

SEQ ID NO: 77395 - DNA, 11 bp, Unknown
  misc_feature (1)..( 11): Result.001 file - promoters75/1441835
ttcgttttatt

SEQ ID NO: 77396 - DNA, 11 bp, Unknown
  misc_feature (1)..( 11): Result.001 file - promoters75/1441835
ttctttttttt

SEQ ID NO: 77397 - DNA, 11 bp, Unknown
  misc_feature (1)..( 11): Result.001 file - promoters75/1441835
ccagttttaca

SEQ ID NO: 77398 - DNA, 11 bp, Unknown
  misc_feature (1)..( 11): Result.001 file - promoters75/1441835
atcattttctt

SEQ ID NO: 77399 - DNA, 11 bp, Unknown
  misc_feature (1)..( 11): Result.001 file - promoters75/1441835
ttcatatgagc

SEQ ID NO: 77400 - DNA, 11 bp, Unknown
  misc_feature (1)..( 11): Result.001 file - promoters75/1441835
cacatataagc

SEQ ID NO: 77401 - DNA, 12 bp, Unknown
  misc_feature (1)..( 12): Result.001 file - promoters75/1441835
taggctataaat

SEQ ID NO: 77402 - DNA, 12 bp, Unknown
  misc_feature (1)..( 12): Result.001 file - promoters75/1441835
agggccatatta

SEQ ID NO: 77403 - DNA, 12 bp, Unknown
  misc_feature (1)..( 12): Result.001 file - promoters75/1441835
aaagccatattg

SEQ ID NO: 77404 - DNA, 12 bp, Unknown
  misc_feature (1)..( 12): Result.001 file - promoters75/1441835
attcctatattg

SEQ ID NO: 77405 - DNA, 12 bp, Unknown
  misc_feature (1)..( 12): Result.001 file - promoters75/1441835
aaggcccaaaaa

SEQ ID NO: 77406 - DNA, 12 bp, Unknown
  misc_feature (1)..( 12): Result.001 file - promoters75/1441835
tgggccaacttg

SEQ ID NO: 77407 - DNA, 12 bp, Unknown
  misc_feature (1)..( 12): Result.001 file - promoters75/1441835
tagttaaaaaag

SEQ ID NO: 77408 - DNA, 12 bp, Unknown
  misc_feature (1)..( 12): Result.001 file - promoters75/1441835
tagttcaaaaac

SEQ ID NO: 77409 - DNA, 12 bp, Unknown
  misc_feature (1)..( 12): Result.001 file - promoters75/1441835
tgattaagaaaa

SEQ ID NO: 77410 - DNA, 12 bp, Unknown
  misc_feature (1)..( 12): Result.001 file - promoters75/1441835
cttttaacaaaa

SEQ ID NO: 77411 - DNA, 12 bp, Unknown
  misc_feature (1)..( 12): Result.001 file - promoters75/1441835
ttattaataaat

SEQ ID NO: 77412 - DNA, 12 bp, Unknown
  misc_feature (1)..( 12): Result.001 file - promoters75/1442476
tgtttccaaaat

SEQ ID NO: 77413 - DNA, 12 bp, Unknown
  misc_feature (1)..( 12): Result.001 file - promoters75/1442476
cttttttttttt

SEQ ID NO: 77414 - DNA, 12 bp, Unknown
  misc_feature (1)..( 12): Result.001 file - promoters75/1442476
ctttttgttgtt

SEQ ID NO: 77415 - DNA, 12 bp, Unknown
  misc_feature (1)..( 12): Result.001 file - promoters75/1442476
ctttttttgttt

SEQ ID NO: 77416 - DNA, 12 bp, Unknown
  misc_feature (1)..( 12): Result.001 file - promoters75/1442476
gtttttgtctat

SEQ ID NO: 77417 - DNA, 12 bp, Unknown
  misc_feature (1)..( 12): Result.001 file - promoters75/1442476
atttttgttcca

SEQ ID NO: 77418 - DNA, 13 bp, Unknown
  misc_feature (1)..( 13): Result.001 file - promoters75/1442476
attgtttcgaaac

SEQ ID NO: 77419 - DNA, 10 bp, Unknown
  misc_feature (1)..( 10): Result.001 file - promoters75/1442476
gtaagaaaaa

SEQ ID NO: 77420 - DNA, 10 bp, Unknown
  misc_feature (1)..( 10): Result.001 file - promoters75/1442476
taaagaaaag

SEQ ID NO: 77421 - DNA, 10 bp, Unknown
  misc_feature (1)..( 10): Result.001 file - promoters75/1442476
agaataaaaa

SEQ ID NO: 77422 - DNA, 10 bp, Unknown
  misc_feature (1)..( 10): Result.001 file - promoters75/1442476
caaacaaaac

SEQ ID NO: 77423 - DNA, 10 bp, Unknown
  misc_feature (1)..( 10): Result.001 file - promoters75/1442476
tcaatcaaat

SEQ ID NO: 77424 - DNA, 10 bp, Unknown
  misc_feature (1)..( 10): Result.001 file - promoters75/1442880
tttgtcaaat

SEQ ID NO: 77425 - DNA, 9 bp, Unknown
  misc_feature (1)..( 9): Result.001 file - promoters75/1442880
ttctctttt

SEQ ID NO: 77426 - DNA, 9 bp, Unknown
  misc_feature (1)..( 9): Result.001 file - promoters75/1442880
acctctttt

SEQ ID NO: 77427 - DNA, 9 bp, Unknown
  misc_feature (1)..( 9): Result.001 file - promoters75/1442880
accccttag

SEQ ID NO: 77428 - DNA, 7 bp, Unknown
  misc_feature (1)..( 7): Result.001 file - promoters75/1442880
aatttac

SEQ ID NO: 77429 - DNA, 7 bp, Unknown
  misc_feature (1)..( 7): Result.001 file - promoters75/1442880
aatctac

SEQ ID NO: 77430 - DNA, 7 bp, Unknown
  misc_feature (1)..( 7): Result.001 file - promoters75/1442880
aatttat

SEQ ID NO: 77431 - DNA, 11 bp, Unknown
  misc_feature (1)..( 11): Result.001 file - promoters75/1442880
ctaaaatagta

SEQ ID NO: 77432 - DNA, 11 bp, Unknown
  misc_feature (1)..( 11): Result.001 file - promoters75/1442880
aaataattgta

SEQ ID NO: 77433 - DNA, 11 bp, Unknown
  misc_feature (1)..( 11): Result.001 file - promoters75/1442880
aaagaattgaa

SEQ ID NO: 77434 - DNA, 8 bp, Unknown
  misc_feature (1)..( 8): Result.001 file - promoters75/1442880
aaggtata

SEQ ID NO: 77435 - DNA, 8 bp, Unknown
  misc_feature (1)..( 8): Result.001 file - promoters75/1442880
aagctata

SEQ ID NO: 77436 - DNA, 8 bp, Unknown
  misc_feature (1)..( 8): Result.001 file - promoters75/1442880
cagcaata

SEQ ID NO: 77437 - DNA, 10 bp, Unknown
  misc_feature (1)..( 10): Result.001 file - promoters75/1442880
ttactaaaat

SEQ ID NO: 77438 - DNA, 10 bp, Unknown
  misc_feature (1)..( 10): Result.001 file - promoters75/1442880
ttattaattt

SEQ ID NO: 77439 - DNA, 11 bp, Unknown
  misc_feature (1)..( 11): Result.001 file - promoters75/1442880
gaactgaaaga

SEQ ID NO: 77440 - DNA, 11 bp, Unknown
  misc_feature (1)..( 11): Result.001 file - promoters75/1442880
ttgtataaatt

SEQ ID NO: 77441 - DNA, 9 bp, Unknown
  misc_feature (1)..( 9): Result.001 file - promoters75/1442880
aaagaagaa

SEQ ID NO: 77442 - DNA, 9 bp, Unknown
  misc_feature (1)..( 9): Result.001 file - promoters75/1442880
aaagaattg

SEQ ID NO: 77443 - DNA, 9 bp, Unknown
  misc_feature (1)..( 9): Result.001 file - promoters75/1442880
aaataattg

SEQ ID NO: 77444 - DNA, 13 bp, Unknown
  misc_feature (1)..( 13): Result.001 file - promoters75/1442880
aatatcaccgacg

SEQ ID NO: 77445 - DNA, 13 bp, Unknown
  misc_feature (1)..( 13): Result.001 file - promoters75/1442880
aatatcttgtaag

SEQ ID NO: 77446 - DNA, 13 bp, Unknown
  misc_feature (1)..( 13): Result.001 file - promoters75/1442880
aatctcaacgacg

SEQ ID NO: 77447 - DNA, 8 bp, Unknown
  misc_feature (1)..( 8): Result.001 file - promoters75/1442880
taatcata

SEQ ID NO: 77448 - DNA, 8 bp, Unknown
  misc_feature (1)..( 8): Result.001 file - promoters75/1442880
aaataata

SEQ ID NO: 77449 - DNA, 8 bp, Unknown
  misc_feature (1)..( 8): Result.001 file - promoters75/1442975
aaacaatc

SEQ ID NO: 77450 - DNA, 12 bp, Unknown
  misc_feature (1)..( 12): Result.001 file - promoters75/1442975
ctttttgtttat

SEQ ID NO: 77451 - DNA, 12 bp, Unknown
  misc_feature (1)..( 12): Result.001 file - promoters75/1442975
tgatttgtatat

SEQ ID NO: 77452 - DNA, 12 bp, Unknown
  misc_feature (1)..( 12): Result.001 file - promoters75/1442975
cttattgtataa

SEQ ID NO: 77453 - DNA, 8 bp, Unknown
  misc_feature (1)..( 8): Result.001 file - promoters75/1442975
gctggatt

SEQ ID NO: 77454 - DNA, 8 bp, Unknown
  misc_feature (1)..( 8): Result.001 file - promoters75/1442975
tctgaatt

SEQ ID NO: 77455 - DNA, 8 bp, Unknown
  misc_feature (1)..( 8): Result.001 file - promoters75/1442993
tctgaaca

SEQ ID NO: 77456 - DNA, 11 bp, Unknown
  misc_feature (1)..( 11): Result.001 file - promoters75/1442993
aaaatagtaaa

SEQ ID NO: 77457 - DNA, 11 bp, Unknown
  misc_feature (1)..( 11): Result.001 file - promoters75/1442993
ataattgtata

SEQ ID NO: 77458 - DNA, 11 bp, Unknown
  misc_feature (1)..( 11): Result.001 file - promoters75/1442993
atatttgtata

SEQ ID NO: 77459 - DNA, 10 bp, Unknown
  misc_feature (1)..( 10): Result.001 file - promoters75/1442993
gaaaaagata

SEQ ID NO: 77460 - DNA, 10 bp, Unknown
  misc_feature (1)..( 10): Result.001 file - promoters75/1442993
gaaatagatt

SEQ ID NO: 77461 - DNA, 10 bp, Unknown
  misc_feature (1)..( 10): Result.001 file - promoters75/1443306
ttagtagatt

SEQ ID NO: 77462 - DNA, 10 bp, Unknown
  misc_feature (1)..( 10): Result.001 file - promoters75/1443306
ctataaatag

SEQ ID NO: 77463 - DNA, 10 bp, Unknown
  misc_feature (1)..( 10): Result.001 file - promoters75/1443306
ctataaaaaa

SEQ ID NO: 77464 - DNA, 10 bp, Unknown
  misc_feature (1)..( 10): Result.001 file - promoters75/1443683
atataaatag

SEQ ID NO: 77465 - DNA, 9 bp, Unknown
  misc_feature (1)..( 9): Result.001 file - promoters75/1443683
tattagctt

SEQ ID NO: 77466 - DNA, 9 bp, Unknown
  misc_feature (1)..( 9): Result.001 file - promoters75/1443683
gatttgctt

SEQ ID NO: 77467 - DNA, 9 bp, Unknown
  misc_feature (1)..( 9): Result.001 file - promoters75/1444441
tattagaga

SEQ ID NO: 77468 - DNA, 11 bp, Unknown
  misc_feature (1)..( 11): Result.001 file - promoters75/1444441
actcttttgaa

SEQ ID NO: 77469 - DNA, 11 bp, Unknown
  misc_feature (1)..( 11): Result.001 file - promoters75/1444441
actatttatac

SEQ ID NO: 77470 - DNA, 11 bp, Unknown
  misc_feature (1)..( 11): Result.001 file - promoters75/1444441
tttcttttcac

SEQ ID NO: 77471 - DNA, 11 bp, Unknown
  misc_feature (1)..( 11): Result.001 file - promoters75/1444441
aatcttttggg

SEQ ID NO: 77472 - DNA, 11 bp, Unknown
  misc_feature (1)..( 11): Result.001 file - promoters75/1444441
gttattaataa

SEQ ID NO: 77473 - DNA, 11 bp, Unknown
  misc_feature (1)..( 11): Result.001 file - promoters75/1444441
ttgattagtaa

SEQ ID NO: 77474 - DNA, 11 bp, Unknown
  misc_feature (1)..( 11): Result.001 file - promoters75/1444441
aatattttata

SEQ ID NO: 77475 - DNA, 11 bp, Unknown
  misc_feature (1)..( 11): Result.001 file - promoters75/1444441
attattttttg

SEQ ID NO: 77476 - DNA, 12 bp, Unknown
  misc_feature (1)..( 12): Result.001 file - promoters75/1444441
ttgtaataataa

SEQ ID NO: 77477 - DNA, 12 bp, Unknown
  misc_feature (1)..( 12): Result.001 file - promoters75/1444441
acataataatgt

SEQ ID NO: 77478 - DNA, 12 bp, Unknown
  misc_feature (1)..( 12): Result.001 file - promoters75/1444441
ttgtgatattat

SEQ ID NO: 77479 - DNA, 12 bp, Unknown
  misc_feature (1)..( 12): Result.001 file - promoters75/1444441
tattaataaatt

SEQ ID NO: 77480 - DNA, 12 bp, Unknown
  misc_feature (1)..( 12): Result.001 file - promoters75/1444441
attttataaata

SEQ ID NO: 77481 - DNA, 13 bp, Unknown
  misc_feature (1)..( 13): Result.001 file - promoters75/1444441
tttcaattaatct

SEQ ID NO: 77482 - DNA, 12 bp, Unknown
  misc_feature (1)..( 12): Result.001 file - promoters75/1444441
aagtttttgtaa

SEQ ID NO: 77483 - DNA, 12 bp, Unknown
  misc_feature (1)..( 12): Result.001 file - promoters75/1444441
ttgttttttaat

SEQ ID NO: 77484 - DNA, 12 bp, Unknown
  misc_feature (1)..( 12): Result.001 file - promoters75/1444441
ttgtgtttgatt

SEQ ID NO: 77485 - DNA, 12 bp, Unknown
  misc_feature (1)..( 12): Result.001 file - promoters75/1444441
atattttataaa

SEQ ID NO: 77486 - DNA, 12 bp, Unknown
  misc_feature (1)..( 12): Result.001 file - promoters75/1444441
tcgttattaata

SEQ ID NO: 77487 - DNA, 12 bp, Unknown
  misc_feature (1)..( 12): Result.001 file - promoters75/1444441
tttcaattaatc

SEQ ID NO: 77488 - DNA, 14 bp, Unknown
  misc_feature (1)..( 14): Result.001 file - promoters75/1444441
agaaaaaaaaaaaa

SEQ ID NO: 77489 - DNA, 14 bp, Unknown
  misc_feature (1)..( 14): Result.001 file - promoters75/1444441
agaataaaaacagt

SEQ ID NO: 77490 - DNA, 14 bp, Unknown
  misc_feature (1)..( 14): Result.001 file - promoters75/1444441
agaaagaaataata

SEQ ID NO: 77491 - DNA, 14 bp, Unknown
  misc_feature (1)..( 14): Result.001 file - promoters75/1444441
ataaaaaatttttt

SEQ ID NO: 77492 - DNA, 14 bp, Unknown
  misc_feature (1)..( 14): Result.001 file - promoters75/1444441
tgaaatattttttt

SEQ ID NO: 77493 - DNA, 14 bp, Unknown
  misc_feature (1)..( 14): Result.001 file - promoters75/1444441
ataaatattcaact

SEQ ID NO: 77494 - DNA, 10 bp, Unknown
  misc_feature (1)..( 10): Result.001 file - promoters75/1444441
tttatacata

SEQ ID NO: 77495 - DNA, 10 bp, Unknown
  misc_feature (1)..( 10): Result.001 file - promoters75/1444441
tttataaata

SEQ ID NO: 77496 - DNA, 10 bp, Unknown
  misc_feature (1)..( 10): Result.001 file - promoters75/1444441
gttattaata

SEQ ID NO: 77497 - DNA, 10 bp, Unknown
  misc_feature (1)..( 10): Result.001 file - promoters75/1444441
ttttttaatt

SEQ ID NO: 77498 - DNA, 10 bp, Unknown
  misc_feature (1)..( 10): Result.001 file - promoters75/1444441
cttttcaatt

SEQ ID NO: 77499 - DNA, 10 bp, Unknown
  misc_feature (1)..( 10): Result.001 file - promoters75/1444441
attagtaaaa

SEQ ID NO: 77500 - DNA, 11 bp, Unknown
  misc_feature (1)..( 11): Result.001 file - promoters75/1444441
tttctaatttt

SEQ ID NO: 77501 - DNA, 11 bp, Unknown
  misc_feature (1)..( 11): Result.001 file - promoters75/1444441
tttttaattat

SEQ ID NO: 77502 - DNA, 11 bp, Unknown
  misc_feature (1)..( 11): Result.001 file - promoters75/1444441
gttctattttt

SEQ ID NO: 77503 - DNA, 11 bp, Unknown
  misc_feature (1)..( 11): Result.001 file - promoters75/1444441
tttataatcga

SEQ ID NO: 77504 - DNA, 11 bp, Unknown
  misc_feature (1)..( 11): Result.001 file - promoters75/1444441
taaatattcaa

SEQ ID NO: 77505 - DNA, 11 bp, Unknown
  misc_feature (1)..( 11): Result.001 file - promoters75/1444460
ttttgattaaa

SEQ ID NO: 77506 - DNA, 7 bp, Unknown
  misc_feature (1)..( 7): Result.001 file - promoters75/1444460
cgaaaca

SEQ ID NO: 77507 - DNA, 7 bp, Unknown
  misc_feature (1)..( 7): Result.001 file - promoters75/1444460
tgaaaca

SEQ ID NO: 77508 - DNA, 7 bp, Unknown
  misc_feature (1)..( 7): Result.001 file - promoters75/1446636
tgaaacg

SEQ ID NO: 77509 - DNA, 8 bp, Unknown
  misc_feature (1)..( 8): Result.001 file - promoters75/1446636
taaggata

SEQ ID NO: 77510 - DNA, 8 bp, Unknown
  misc_feature (1)..( 8): Result.001 file - promoters75/1446636
aaaggata

SEQ ID NO: 77511 - DNA, 9 bp, Unknown
  misc_feature (1)..( 9): Result.001 file - promoters75/1446636
aaatggaac

SEQ ID NO: 77512 - DNA, 9 bp, Unknown
  misc_feature (1)..( 9): Result.001 file - promoters75/1446636
aagggtaaa

SEQ ID NO: 77513 - DNA, 9 bp, Unknown
  misc_feature (1)..( 9): Result.001 file - promoters75/1446636
gaggttaaa

SEQ ID NO: 77514 - DNA, 9 bp, Unknown
  misc_feature (1)..( 9): Result.001 file - promoters75/1447646
gaggtgaaa

SEQ ID NO: 77515 - DNA, 10 bp, Unknown
  misc_feature (1)..( 10): Result.001 file - promoters75/1447646
ggaaggagag

SEQ ID NO: 77516 - DNA, 10 bp, Unknown
  misc_feature (1)..( 10): Result.001 file - promoters75/1447646
ggaagtagag

SEQ ID NO: 77517 - DNA, 10 bp, Unknown
  misc_feature (1)..( 10): Result.001 file - promoters75/1447646
ggaagtagag

SEQ ID NO: 77518 - DNA, 9 bp, Unknown
  misc_feature (1)..( 9): Result.001 file - promoters75/1447646
gagatgaga

SEQ ID NO: 77519 - DNA, 9 bp, Unknown
  misc_feature (1)..( 9): Result.001 file - promoters75/1447646
aagatgatg

SEQ ID NO: 77520 - DNA, 9 bp, Unknown
  misc_feature (1)..( 9): Result.001 file - promoters75/1447953
aagttgatg

SEQ ID NO: 77521 - DNA, 6 bp, Unknown
  misc_feature (1)..( 6): Result.001 file - promoters75/1447953
cttctt

SEQ ID NO: 77522 - DNA, 6 bp, Unknown
  misc_feature (1)..( 6): Result.001 file - promoters75/1447953
cttctt

SEQ ID NO: 77523 - DNA, 6 bp, Unknown
  misc_feature (1)..( 6): Result.001 file - promoters75/1448231
cttctt

SEQ ID NO: 77524 - DNA, 7 bp, Unknown
  misc_feature (1)..( 7): Result.001 file - promoters75/1448231
cttaact

SEQ ID NO: 77525 - DNA, 7 bp, Unknown
  misc_feature (1)..( 7): Result.001 file - promoters75/1448231
cttaacc

SEQ ID NO: 77526 - DNA, 7 bp, Unknown
  misc_feature (1)..( 7): Result.001 file - promoters75/1450625
tttaacc

SEQ ID NO: 77527 - DNA, 8 bp, Unknown
  misc_feature (1)..( 8): Result.001 file - promoters75/1450625
aattttga

SEQ ID NO: 77528 - DNA, 8 bp, Unknown
  misc_feature (1)..( 8): Result.001 file - promoters75/1450625
aattttaa

SEQ ID NO: 77529 - DNA, 8 bp, Unknown
  misc_feature (1)..( 8): Result.001 file - promoters75/1450625
cattgtaa

SEQ ID NO: 77530 - DNA, 6 bp, Unknown
  misc_feature (1)..( 6): Result.001 file - promoters75/1450625
ttattc

SEQ ID NO: 77531 - DNA, 6 bp, Unknown
  misc_feature (1)..( 6): Result.001 file - promoters75/1450625
ttattc

SEQ ID NO: 77532 - DNA, 6 bp, Unknown
  misc_feature (1)..( 6): Result.001 file - promoters75/1459039
ttattc

SEQ ID NO: 77533 - DNA, 6 bp, Unknown
  misc_feature (1)..( 6): Result.001 file - promoters75/1459039
tataaa

SEQ ID NO: 77534 - DNA, 6 bp, Unknown
  misc_feature (1)..( 6): Result.001 file - promoters75/1459039
tataaa

SEQ ID NO: 77535 - DNA, 6 bp, Unknown
  misc_feature (1)..( 6): Result.001 file - promoters75/1459039
tataaa

SEQ ID NO: 77536 - DNA, 9 bp, Unknown
  misc_feature (1)..( 9): Result.001 file - promoters75/1459039
ggtcaattt

SEQ ID NO: 77537 - DNA, 9 bp, Unknown
  misc_feature (1)..( 9): Result.001 file - promoters75/1459039
catcaattt

SEQ ID NO: 77538 - DNA, 9 bp, Unknown
  misc_feature (1)..( 9): Result.001 file - promoters75/1459039
ggtcaatgc

SEQ ID NO: 77539 - DNA, 7 bp, Unknown
  misc_feature (1)..( 7): Result.001 file - promoters75/1459039
gccaaac

SEQ ID NO: 77540 - DNA, 7 bp, Unknown
  misc_feature (1)..( 7): Result.001 file - promoters75/1459039
tccaaac

SEQ ID NO: 77541 - DNA, 7 bp, Unknown
  misc_feature (1)..( 7): Result.001 file - promoters75/1459223
gccgaac

SEQ ID NO: 77542 - DNA, 10 bp, Unknown
  misc_feature (1)..( 10): Result.001 file - promoters75/1459223
aaaaaaatat

SEQ ID NO: 77543 - DNA, 10 bp, Unknown
  misc_feature (1)..( 10): Result.001 file - promoters75/1459223
aaaaaaggaa

SEQ ID NO: 77544 - DNA, 11 bp, Unknown
  misc_feature (1)..( 11): Result.001 file - promoters75/1459223
aaagaaataat

SEQ ID NO: 77545 - DNA, 11 bp, Unknown
  misc_feature (1)..( 11): Result.001 file - promoters75/1459223
aaaaaaatggt

SEQ ID NO: 77546 - DNA, 11 bp, Unknown
  misc_feature (1)..( 11): Result.001 file - promoters75/1459223
gatgaaatatt

SEQ ID NO: 77547 - DNA, 11 bp, Unknown
  misc_feature (1)..( 11): Result.001 file - promoters75/1459223
tgataaatatt

SEQ ID NO: 77548 - DNA, 10 bp, Unknown
  misc_feature (1)..( 10): Result.001 file - promoters75/1459223
catataaaac

SEQ ID NO: 77549 - DNA, 10 bp, Unknown
  misc_feature (1)..( 10): Result.001 file - promoters75/1459223
tttataaata

SEQ ID NO: 77550 - DNA, 10 bp, Unknown
  misc_feature (1)..( 10): Result.001 file - promoters75/1459223
tttatacata

SEQ ID NO: 77551 - DNA, 10 bp, Unknown
  misc_feature (1)..( 10): Result.001 file - promoters75/1459223
gttattaata

SEQ ID NO: 77552 - DNA, 10 bp, Unknown
  misc_feature (1)..( 10): Result.001 file - promoters75/1459223
aataataact

SEQ ID NO: 77553 - DNA, 10 bp, Unknown
  misc_feature (1)..( 10): Result.001 file - promoters75/1459223
tcaattaatc

SEQ ID NO: 77554 - DNA, 10 bp, Unknown
  misc_feature (1)..( 10): Result.001 file - promoters75/1459223
caaacaaaac

SEQ ID NO: 77555 - DNA, 10 bp, Unknown
  misc_feature (1)..( 10): Result.001 file - promoters75/1459223
caatcaaatc

SEQ ID NO: 77556 - DNA, 10 bp, Unknown
  misc_feature (1)..( 10): Result.001 file - promoters75/1459223
caaagaaatt

SEQ ID NO: 77557 - DNA, 10 bp, Unknown
  misc_feature (1)..( 10): Result.001 file - promoters75/1459223
ttgtcaaatg

SEQ ID NO: 77558 - DNA, 10 bp, Unknown
  misc_feature (1)..( 10): Result.001 file - promoters75/1459223
gtaagaaaaa

SEQ ID NO: 77559 - DNA, 10 bp, Unknown
  misc_feature (1)..( 10): Result.001 file - promoters75/1461791
ttatttaatc

SEQ ID NO: 77560 - DNA, 7 bp, Unknown
  misc_feature (1)..( 7): Result.001 file - promoters75/1461791
gaaatcg

SEQ ID NO: 77561 - DNA, 7 bp, Unknown
  misc_feature (1)..( 7): Result.001 file - promoters75/1461791
gaattcg

SEQ ID NO: 77562 - DNA, 7 bp, Unknown
  misc_feature (1)..( 7): Result.001 file - promoters75/1461839
gaaatcg

SEQ ID NO: 77563 - DNA, 7 bp, Unknown
  misc_feature (1)..( 7): Result.001 file - promoters75/1461839
ataatcc

SEQ ID NO: 77564 - DNA, 7 bp, Unknown
  misc_feature (1)..( 7): Result.001 file - promoters75/1461839
ataatcc

SEQ ID NO: 77565 - DNA, 7 bp, Unknown
  misc_feature (1)..( 7): Result.001 file - promoters75/1461839
ataatcc

SEQ ID NO: 77566 - DNA, 7 bp, Unknown
  misc_feature (1)..( 7): Result.001 file - promoters75/1461839
acacata

SEQ ID NO: 77567 - DNA, 7 bp, Unknown
  misc_feature (1)..( 7): Result.001 file - promoters75/1461839
ccacata

SEQ ID NO: 77568 - DNA, 7 bp, Unknown
  misc_feature (1)..( 7): Result.001 file - promoters75/1461839
acacata

SEQ ID NO: 77569 - DNA, 11 bp, Unknown
  misc_feature (1)..( 11): Result.001 file - promoters75/1461839
aaaaagaaaag

SEQ ID NO: 77570 - DNA, 11 bp, Unknown
  misc_feature (1)..( 11): Result.001 file - promoters75/1461839
atttagataag

SEQ ID NO: 77571 - DNA, 11 bp, Unknown
  misc_feature (1)..( 11): Result.001 file - promoters75/1461839
aaaaagaaaaa

SEQ ID NO: 77572 - DNA, 7 bp, Unknown
  misc_feature (1)..( 7): Result.001 file - promoters75/1461839
ggacgat

SEQ ID NO: 77573 - DNA, 7 bp, Unknown
  misc_feature (1)..( 7): Result.001 file - promoters75/1461839
ggatgat

SEQ ID NO: 77574 - DNA, 7 bp, Unknown
  misc_feature (1)..( 7): Result.001 file - promoters75/1461839
ggatgat

SEQ ID NO: 77575 - DNA, 10 bp, Unknown
  misc_feature (1)..( 10): Result.001 file - promoters75/1461839
aaagaaagaa

SEQ ID NO: 77576 - DNA, 10 bp, Unknown
  misc_feature (1)..( 10): Result.001 file - promoters75/1461839
aaaaaaagaa

SEQ ID NO: 77577 - DNA, 11 bp, Unknown
  misc_feature (1)..( 11): Result.001 file - promoters75/1461839
taagtaaagta

SEQ ID NO: 77578 - DNA, 7 bp, Unknown
  misc_feature (1)..( 7): Result.001 file - promoters75/1461839
ggatgat

SEQ ID NO: 77579 - DNA, 7 bp, Unknown
  misc_feature (1)..( 7): Result.001 file - promoters75/1461839
ggatgat

SEQ ID NO: 77580 - DNA, 7 bp, Unknown
  misc_feature (1)..( 7): Result.001 file - promoters75/1461839
ggatgat

SEQ ID NO: 77581 - DNA, 7 bp, Unknown
  misc_feature (1)..( 7): Result.001 file - promoters75/1461839
ttatcag

SEQ ID NO: 77582 - DNA, 7 bp, Unknown
  misc_feature (1)..( 7): Result.001 file - promoters75/1461839
ttaacag

SEQ ID NO: 77583 - DNA, 7 bp, Unknown
  misc_feature (1)..( 7): Result.001 file - promoters75/1461839
ttatcag

SEQ ID NO: 77584 - DNA, 12 bp, Unknown
  misc_feature (1)..( 12): Result.001 file - promoters75/1461839
ttgatattgaaa

SEQ ID NO: 77585 - DNA, 12 bp, Unknown
  misc_feature (1)..( 12): Result.001 file - promoters75/1461839
ttgagattttca

SEQ ID NO: 77586 - DNA, 12 bp, Unknown
  misc_feature (1)..( 12): Result.001 file - promoters75/1472778
tctagattatca

SEQ ID NO: 77587 - DNA, 10 bp, Unknown
  misc_feature (1)..( 10): Result.001 file - promoters75/1472778
ttttagtttg

SEQ ID NO: 77588 - DNA, 10 bp, Unknown
  misc_feature (1)..( 10): Result.001 file - promoters75/1472778
ttttcgtttc

SEQ ID NO: 77589 - DNA, 10 bp, Unknown
  misc_feature (1)..( 10): Result.001 file - promoters75/1472799
ttttatttta

SEQ ID NO: 77590 - DNA, 8 bp, Unknown
  misc_feature (1)..( 8): Result.001 file - promoters75/1472799
atcatatt

SEQ ID NO: 77591 - DNA, 8 bp, Unknown
  misc_feature (1)..( 8): Result.001 file - promoters75/1472799
atcatatt

SEQ ID NO: 77592 - DNA, 8 bp, Unknown
  misc_feature (1)..( 8): Result.001 file - promoters75/1472799
atcatatt

SEQ ID NO: 77593 - DNA, 9 bp, Unknown
  misc_feature (1)..( 9): Result.001 file - promoters75/1472799
tttgtagtg

SEQ ID NO: 77594 - DNA, 9 bp, Unknown
  misc_feature (1)..( 9): Result.001 file - promoters75/1472799
attgtagct

SEQ ID NO: 77595 - DNA, 9 bp, Unknown
  misc_feature (1)..( 9): Result.001 file - promoters75/1472799
tttgttgtg

SEQ ID NO: 77596 - DNA, 8 bp, Unknown
  misc_feature (1)..( 8): Result.001 file - promoters75/1472799
tgatttgt

SEQ ID NO: 77597 - DNA, 8 bp, Unknown
  misc_feature (1)..( 8): Result.001 file - promoters75/1472799
agatatgt

SEQ ID NO: 77598 - DNA, 8 bp, Unknown
  misc_feature (1)..( 8): Result.001 file - promoters75/1472799
tgatttgg

SEQ ID NO: 77599 - DNA, 7 bp, Unknown
  misc_feature (1)..( 7): Result.001 file - promoters75/1472799
gtttgtt

SEQ ID NO: 77600 - DNA, 7 bp, Unknown
  misc_feature (1)..( 7): Result.001 file - promoters75/1472799
gtttgtg

SEQ ID NO: 77601 - DNA, 7 bp, Unknown
  misc_feature (1)..( 7): Result.001 file - promoters75/1472799
ttttgtt

SEQ ID NO: 77602 - DNA, 8 bp, Unknown
  misc_feature (1)..( 8): Result.001 file - promoters75/1472799
tgtttgtt

SEQ ID NO: 77603 - DNA, 8 bp, Unknown
  misc_feature (1)..( 8): Result.001 file - promoters75/1472799
gatttgtt

SEQ ID NO: 77604 - DNA, 8 bp, Unknown
  misc_feature (1)..( 8): Result.001 file - promoters75/1481696
gatatgta

SEQ ID NO: 77605 - DNA, 7 bp, Unknown
  misc_feature (1)..( 7): Result.001 file - promoters75/1481696
tttactt

SEQ ID NO: 77606 - DNA, 7 bp, Unknown
  misc_feature (1)..( 7): Result.001 file - promoters75/1481696
tttgctt

SEQ ID NO: 77607 - DNA, 7 bp, Unknown
  misc_feature (1)..( 7): Result.001 file - promoters75/1481696
attactt

SEQ ID NO: 77608 - DNA, 7 bp, Unknown
  misc_feature (1)..( 7): Result.001 file - promoters75/1481696
tttgctg

SEQ ID NO: 77609 - DNA, 10 bp, Unknown
  misc_feature (1)..( 10): Result.001 file - promoters75/1481696
caaaagaatc

SEQ ID NO: 77610 - DNA, 10 bp, Unknown
  misc_feature (1)..( 10): Result.001 file - promoters75/1481696
caaaacaatt

SEQ ID NO: 77611 - DNA, 10 bp, Unknown
  misc_feature (1)..( 10): Result.001 file - promoters75/1481696
acaaagaaac

SEQ ID NO: 77612 - DNA, 10 bp, Unknown
  misc_feature (1)..( 10): Result.001 file - promoters75/1481696
attaagaaaa

SEQ ID NO: 77613 - DNA, 12 bp, Unknown
  misc_feature (1)..( 12): Result.001 file - promoters75/1481696
tttattcaatcc

SEQ ID NO: 77614 - DNA, 12 bp, Unknown
  misc_feature (1)..( 12): Result.001 file - promoters75/1481696
cttatgcaaagc

SEQ ID NO: 77615 - DNA, 12 bp, Unknown
  misc_feature (1)..( 12): Result.001 file - promoters75/1481696
tatatttaattt

SEQ ID NO: 77616 - DNA, 12 bp, Unknown
  misc_feature (1)..( 12): Result.001 file - promoters75/1481696
tatatttacttt

SEQ ID NO: 77617 - DNA, 8 bp, Unknown
  misc_feature (1)..( 8): Result.001 file - promoters75/1481696
tttcttac

SEQ ID NO: 77618 - DNA, 8 bp, Unknown
  misc_feature (1)..( 8): Result.001 file - promoters75/1481696
tttattat

SEQ ID NO: 77619 - DNA, 9 bp, Unknown
  misc_feature (1)..( 9): Result.001 file - promoters75/1481696
tttgattaa

SEQ ID NO: 77620 - DNA, 9 bp, Unknown
  misc_feature (1)..( 9): Result.001 file - promoters75/1481696
tctgattaa

SEQ ID NO: 77621 - DNA, 9 bp, Unknown
  misc_feature (1)..( 9): Result.001 file - promoters75/1481696
tgatattat

SEQ ID NO: 77622 - DNA, 15 bp, Unknown
  misc_feature (1)..( 15): Result.001 file - promoters75/1481696
tttgcttctttggat

SEQ ID NO: 77623 - DNA, 15 bp, Unknown
  misc_feature (1)..( 15): Result.001 file - promoters75/1481696
gatggatctttagat

SEQ ID NO: 77624 - DNA, 15 bp, Unknown
  misc_feature (1)..( 15): Result.001 file - promoters75/1481696
tgctgatgtttgatt

SEQ ID NO: 77625 - DNA, 15 bp, Unknown
  misc_feature (1)..( 15): Result.001 file - promoters75/1532660
tgctaatgtgaactt

SEQ ID NO: 77626 - DNA, 7 bp, Unknown
  misc_feature (1)..( 7): Result.001 file - promoters75/1532660
ggagcaa

SEQ ID NO: 77627 - DNA, 7 bp, Unknown
  misc_feature (1)..( 7): Result.001 file - promoters75/1532660
cgagcaa

SEQ ID NO: 77628 - DNA, 7 bp, Unknown
  misc_feature (1)..( 7): Result.001 file - promoters75/1532660
ggatcaa

SEQ ID NO: 77629 - DNA, 7 bp, Unknown
  misc_feature (1)..( 7): Result.001 file - promoters75/1532660
aaaattt

SEQ ID NO: 77630 - DNA, 7 bp, Unknown
  misc_feature (1)..( 7): Result.001 file - promoters75/1532660
taaattt

SEQ ID NO: 77631 - DNA, 7 bp, Unknown
  misc_feature (1)..( 7): Result.001 file - promoters75/1532660
aaaattt

SEQ ID NO: 77632 - DNA, 7 bp, Unknown
  misc_feature (1)..( 7): Result.001 file - promoters75/1532660
aaaaaat

SEQ ID NO: 77633 - DNA, 7 bp, Unknown
  misc_feature (1)..( 7): Result.001 file - promoters75/1532660
aaagaat

SEQ ID NO: 77634 - DNA, 7 bp, Unknown
  misc_feature (1)..( 7): Result.001 file - promoters75/1532660
aaagaaa

SEQ ID NO: 77635 - DNA, 10 bp, Unknown
  misc_feature (1)..( 10): Result.001 file - promoters75/1532660
caaataattt

SEQ ID NO: 77636 - DNA, 10 bp, Unknown
  misc_feature (1)..( 10): Result.001 file - promoters75/1532660
gatttaattt

SEQ ID NO: 77637 - DNA, 10 bp, Unknown
  misc_feature (1)..( 10): Result.001 file - promoters75/1532660
caaaaaattg

SEQ ID NO: 77638 - DNA, 7 bp, Unknown
  misc_feature (1)..( 7): Result.001 file - promoters75/1532660
aagaagg

SEQ ID NO: 77639 - DNA, 7 bp, Unknown
  misc_feature (1)..( 7): Result.001 file - promoters75/1532660
aagaaga

SEQ ID NO: 77640 - DNA, 7 bp, Unknown
  misc_feature (1)..( 7): Result.001 file - promoters75/1532937
aagaagg

SEQ ID NO: 77641 - DNA, 7 bp, Unknown
  misc_feature (1)..( 7): Result.001 file - promoters75/1532937
cttcaaa

SEQ ID NO: 77642 - DNA, 7 bp, Unknown
  misc_feature (1)..( 7): Result.001 file - promoters75/1532937
cttcaaa

SEQ ID NO: 77643 - DNA, 7 bp, Unknown
  misc_feature (1)..( 7): Result.001 file - promoters75/1532937
ctttaaa

SEQ ID NO: 77644 - DNA, 6 bp, Unknown
  misc_feature (1)..( 6): Result.001 file - promoters75/1532937
aataaa

SEQ ID NO: 77645 - DNA, 6 bp, Unknown
  misc_feature (1)..( 6): Result.001 file - promoters75/1532937
aataaa

SEQ ID NO: 77646 - DNA, 6 bp, Unknown
  misc_feature (1)..( 6): Result.001 file - promoters75/1532937
aataaa

SEQ ID NO: 77647 - DNA, 10 bp, Unknown
  misc_feature (1)..( 10): Result.001 file - promoters75/1532937
ttcttcttct

SEQ ID NO: 77648 - DNA, 10 bp, Unknown
  misc_feature (1)..( 10): Result.001 file - promoters75/1532937
ctcttcttct

SEQ ID NO: 77649 - DNA, 10 bp, Unknown
  misc_feature (1)..( 10): Result.001 file - promoters75/1532937
ttcctcttaa

SEQ ID NO: 77650 - DNA, 12 bp, Unknown
  misc_feature (1)..( 12): Result.001 file - promoters75/1532937
aaaaaacttcca

SEQ ID NO: 77651 - DNA, 12 bp, Unknown
  misc_feature (1)..( 12): Result.001 file - promoters75/1532937
aaaaaaattcca

SEQ ID NO: 77652 - DNA, 12 bp, Unknown
  misc_feature (1)..( 12): Result.001 file - promoters75/1532937
agaaaatttcta

SEQ ID NO: 77653 - DNA, 10 bp, Unknown
  misc_feature (1)..( 10): Result.001 file - promoters75/1532937
gagtttaggt

SEQ ID NO: 77654 - DNA, 10 bp, Unknown
  misc_feature (1)..( 10): Result.001 file - promoters75/1532937
aatttttggt

SEQ ID NO: 77655 - DNA, 10 bp, Unknown
  misc_feature (1)..( 10): Result.001 file - promoters75/1532937
ttgttttgtc

SEQ ID NO: 77656 - DNA, 8 bp, Unknown
  misc_feature (1)..( 8): Result.001 file - promoters75/1532937
aatagtta

SEQ ID NO: 77657 - DNA, 8 bp, Unknown
  misc_feature (1)..( 8): Result.001 file - promoters75/1532937
aattgttt

SEQ ID NO: 77658 - DNA, 9 bp, Unknown
  misc_feature (1)..( 9): Result.001 file - promoters75/1532948
ttttggttt

SEQ ID NO: 77659 - DNA, 8 bp, Unknown
  misc_feature (1)..( 8): Result.001 file - promoters75/1532948
ttttgtaa

SEQ ID NO: 77660 - DNA, 8 bp, Unknown
  misc_feature (1)..( 8): Result.001 file - promoters75/1532948
ctttgtaa

SEQ ID NO: 77661 - DNA, 8 bp, Unknown
  misc_feature (1)..( 8): Result.001 file - promoters75/1532948
ttttgttg

SEQ ID NO: 77662 - DNA, 8 bp, Unknown
  misc_feature (1)..( 8): Result.001 file - promoters75/1532948
accaataa

SEQ ID NO: 77663 - DNA, 8 bp, Unknown
  misc_feature (1)..( 8): Result.001 file - promoters75/1532948
cccactaa

SEQ ID NO: 77664 - DNA, 8 bp, Unknown
  misc_feature (1)..( 8): Result.001 file - promoters75/1557606
cccactag

SEQ ID NO: 77665 - DNA, 9 bp, Unknown
  misc_feature (1)..( 9): Result.001 file - promoters75/1557606
ttgacgacg

SEQ ID NO: 77666 - DNA, 9 bp, Unknown
  misc_feature (1)..( 9): Result.001 file - promoters75/1557606
ttggcgaga

SEQ ID NO: 77667 - DNA, 9 bp, Unknown
  misc_feature (1)..( 9): Result.001 file - promoters75/1557769
ccggcaaga

SEQ ID NO: 77668 - DNA, 10 bp, Unknown
  misc_feature (1)..( 10): Result.001 file - promoters75/1557769
aaacttaaga

SEQ ID NO: 77669 - DNA, 10 bp, Unknown
  misc_feature (1)..( 10): Result.001 file - promoters75/1557769
gaacgtaaga

SEQ ID NO: 77670 - DNA, 10 bp, Unknown
  misc_feature (1)..( 10): Result.001 file - promoters75/1557769
aaaattaaat

SEQ ID NO: 77671 - DNA, 8 bp, Unknown
  misc_feature (1)..( 8): Result.001 file - promoters75/1557769
atttttct

SEQ ID NO: 77672 - DNA, 8 bp, Unknown
  misc_feature (1)..( 8): Result.001 file - promoters75/1557769
attttttt

SEQ ID NO: 77673 - DNA, 8 bp, Unknown
  misc_feature (1)..( 8): Result.001 file - promoters75/1557769
cttttttt

SEQ ID NO: 77674 - DNA, 8 bp, Unknown
  misc_feature (1)..( 8): Result.001 file - promoters75/1557769
gatattac

SEQ ID NO: 77675 - DNA, 8 bp, Unknown
  misc_feature (1)..( 8): Result.001 file - promoters75/1557769
gatattaa

SEQ ID NO: 77676 - DNA, 8 bp, Unknown
  misc_feature (1)..( 8): Result.001 file - promoters75/1567092
aataataa

SEQ ID NO: 77677 - DNA, 12 bp, Unknown
  misc_feature (1)..( 12): Result.001 file - promoters75/1567092
caacaatgtaca

SEQ ID NO: 77678 - DNA, 12 bp, Unknown
  misc_feature (1)..( 12): Result.001 file - promoters75/1567092
caataatttaca

SEQ ID NO: 77679 - DNA, 12 bp, Unknown
  misc_feature (1)..( 12): Result.001 file - promoters75/1567092
tgaaaatttata

SEQ ID NO: 77680 - DNA, 9 bp, Unknown
  misc_feature (1)..( 9): Result.001 file - promoters75/1567092
ttgcttaca

SEQ ID NO: 77681 - DNA, 9 bp, Unknown
  misc_feature (1)..( 9): Result.001 file - promoters75/1567092
ttgtttata

SEQ ID NO: 77682 - DNA, 9 bp, Unknown
  misc_feature (1)..( 9): Result.001 file - promoters75/1567092
atgtttaat

SEQ ID NO: 77683 - DNA, 9 bp, Unknown
  misc_feature (1)..( 9): Result.001 file - promoters75/1567092
gagttcata

SEQ ID NO: 77684 - DNA, 10 bp, Unknown
  misc_feature (1)..( 10): Result.001 file - promoters75/1567092
tatctatatg

SEQ ID NO: 77685 - DNA, 10 bp, Unknown
  misc_feature (1)..( 10): Result.001 file - promoters75/1567092
tgattatatg

SEQ ID NO: 77686 - DNA, 10 bp, Unknown
  misc_feature (1)..( 10): Result.001 file - promoters75/1567092
tgagtatatt

SEQ ID NO: 77687 - DNA, 8 bp, Unknown
  misc_feature (1)..( 8): Result.001 file - promoters75/1567092
aaactagc

SEQ ID NO: 77688 - DNA, 8 bp, Unknown
  misc_feature (1)..( 8): Result.001 file - promoters75/1567092
aaactaat

SEQ ID NO: 77689 - DNA, 8 bp, Unknown
  misc_feature (1)..( 8): Result.001 file - promoters75/1567092
caacaaat

SEQ ID NO: 77690 - DNA, 8 bp, Unknown
  misc_feature (1)..( 8): Result.001 file - promoters75/1567092
tttgtttg

SEQ ID NO: 77691 - DNA, 8 bp, Unknown
  misc_feature (1)..( 8): Result.001 file - promoters75/1567092
aatgtttg

SEQ ID NO: 77692 - DNA, 8 bp, Unknown
  misc_feature (1)..( 8): Result.001 file - promoters75/1567092
tttatttt

SEQ ID NO: 77693 - DNA, 8 bp, Unknown
  misc_feature (1)..( 8): Result.001 file - promoters75/1567092
ttttaatt

SEQ ID NO: 77694 - DNA, 8 bp, Unknown
  misc_feature (1)..( 8): Result.001 file - promoters75/1567092
tttgaatt

SEQ ID NO: 77695 - DNA, 8 bp, Unknown
  misc_feature (1)..( 8): Result.001 file - promoters75/1567092
tttggatt

SEQ ID NO: 77696 - DNA, 6 bp, Unknown
  misc_feature (1)..( 6): Result.001 file - promoters75/1567092
attttt

SEQ ID NO: 77697 - DNA, 6 bp, Unknown
  misc_feature (1)..( 6): Result.001 file - promoters75/1567092
attttt

SEQ ID NO: 77698 - DNA, 6 bp, Unknown
  misc_feature (1)..( 6): Result.001 file - promoters75/1567092
attttt

SEQ ID NO: 77699 - DNA, 8 bp, Unknown
  misc_feature (1)..( 8): Result.001 file - promoters75/1567092
atattagt

SEQ ID NO: 77700 - DNA, 8 bp, Unknown
  misc_feature (1)..( 8): Result.001 file - promoters75/1567092
atatgagt

SEQ ID NO: 77701 - DNA, 8 bp, Unknown
  misc_feature (1)..( 8): Result.001 file - promoters75/1567547
atattagt

SEQ ID NO: 77702 - DNA, 8 bp, Unknown
  misc_feature (1)..( 8): Result.001 file - promoters75/1567547
agtattag

SEQ ID NO: 77703 - DNA, 8 bp, Unknown
  misc_feature (1)..( 8): Result.001 file - promoters75/1567547
agttttac

SEQ ID NO: 77704 - DNA, 8 bp, Unknown
  misc_feature (1)..( 8): Result.001 file - promoters75/1567547
actattag

SEQ ID NO: 77705 - DNA, 8 bp, Unknown
  misc_feature (1)..( 8): Result.001 file - promoters75/1567547
actcttat

SEQ ID NO: 77706 - DNA, 8 bp, Unknown
  misc_feature (1)..( 8): Result.001 file - promoters75/1567547
cttcttat

SEQ ID NO: 77707 - DNA, 8 bp, Unknown
  misc_feature (1)..( 8): Result.001 file - promoters75/1567547
tctcttaa

SEQ ID NO: 77708 - DNA, 14 bp, Unknown
  misc_feature (1)..( 14): Result.001 file - promoters75/1567547
atttatatagataa

SEQ ID NO: 77709 - DNA, 14 bp, Unknown
  misc_feature (1)..( 14): Result.001 file - promoters75/1567547
taatatataaagga

SEQ ID NO: 77710 - DNA, 14 bp, Unknown
  misc_feature (1)..( 14): Result.001 file - promoters75/1567547
cactatatattaaa

SEQ ID NO: 77711 - DNA, 14 bp, Unknown
  misc_feature (1)..( 14): Result.001 file - promoters75/1567547
gtatataaagacgc

SEQ ID NO: 77712 - DNA, 14 bp, Unknown
  misc_feature (1)..( 14): Result.001 file - promoters75/1567547
actattaaagccgc

SEQ ID NO: 77713 - DNA, 14 bp, Unknown
  misc_feature (1)..( 14): Result.001 file - promoters75/1570116
cactataaattcaa

SEQ ID NO: 77714 - DNA, 9 bp, Unknown
  misc_feature (1)..( 9): Result.001 file - promoters75/1570116
ttagaaatt

SEQ ID NO: 77715 - DNA, 9 bp, Unknown
  misc_feature (1)..( 9): Result.001 file - promoters75/1570116
ttataaaag

SEQ ID NO: 77716 - DNA, 9 bp, Unknown
  misc_feature (1)..( 9): Result.001 file - promoters75/1570116
cgagacatt

SEQ ID NO: 77717 - DNA, 9 bp, Unknown
  misc_feature (1)..( 9): Result.001 file - promoters75/1570116
aaataaaac

SEQ ID NO: 77718 - DNA, 8 bp, Unknown
  misc_feature (1)..( 8): Result.001 file - promoters75/1570116
tattaaaa

SEQ ID NO: 77719 - DNA, 8 bp, Unknown
  misc_feature (1)..( 8): Result.001 file - promoters75/1570116
tatcaaaa

SEQ ID NO: 77720 - DNA, 8 bp, Unknown
  misc_feature (1)..( 8): Result.001 file - promoters75/1570116
aattaaaa

SEQ ID NO: 77721 - DNA, 8 bp, Unknown
  misc_feature (1)..( 8): Result.001 file - promoters75/1570116
taagaaaa

SEQ ID NO: 77722 - DNA, 7 bp, Unknown
  misc_feature (1)..( 7): Result.001 file - promoters75/1570116
aaatata

SEQ ID NO: 77723 - DNA, 7 bp, Unknown
  misc_feature (1)..( 7): Result.001 file - promoters75/1570116
aaaaata

SEQ ID NO: 77724 - DNA, 7 bp, Unknown
  misc_feature (1)..( 7): Result.001 file - promoters75/1570116
gaaaata

SEQ ID NO: 77725 - DNA, 7 bp, Unknown
  misc_feature (1)..( 7): Result.001 file - promoters75/1570116
caaaata

SEQ ID NO: 77726 - DNA, 7 bp, Unknown
  misc_feature (1)..( 7): Result.001 file - promoters75/1570116
aaaataa

SEQ ID NO: 77727 - DNA, 7 bp, Unknown
  misc_feature (1)..( 7): Result.001 file - promoters75/1570116
aaaataa

SEQ ID NO: 77728 - DNA, 7 bp, Unknown
  misc_feature (1)..( 7): Result.001 file - promoters75/1570116
aaaataa

SEQ ID NO: 77729 - DNA, 7 bp, Unknown
  misc_feature (1)..( 7): Result.001 file - promoters75/1570474
aaaatac

SEQ ID NO: 77730 - DNA, 10 bp, Unknown
  misc_feature (1)..( 10): Result.001 file - promoters75/1570474
aaatctttgt

SEQ ID NO: 77731 - DNA, 10 bp, Unknown
  misc_feature (1)..( 10): Result.001 file - promoters75/1570474
cgttctttgg

SEQ ID NO: 77732 - DNA, 10 bp, Unknown
  misc_feature (1)..( 10): Result.001 file - promoters75/1570474
cattctctgg

SEQ ID NO: 77733 - DNA, 10 bp, Unknown
  misc_feature (1)..( 10): Result.001 file - promoters75/1570474
cattccctga

SEQ ID NO: 77734 - DNA, 10 bp, Unknown
  misc_feature (1)..( 10): Result.001 file - promoters75/1570606
agttccatga

SEQ ID NO: 77735 - DNA, 14 bp, Unknown
  misc_feature (1)..( 14): Result.001 file - promoters75/1570606
gtttcattaacgtt

SEQ ID NO: 77736 - DNA, 14 bp, Unknown
  misc_feature (1)..( 14): Result.001 file - promoters75/1570606
gttacatttaagtt

SEQ ID NO: 77737 - DNA, 14 bp, Unknown
  misc_feature (1)..( 14): Result.001 file - promoters75/1570606
cttttattatttca

SEQ ID NO: 77738 - DNA, 14 bp, Unknown
  misc_feature (1)..( 14): Result.001 file - promoters75/1570606
caaacatttgaacc

SEQ ID NO: 77739 - DNA, 14 bp, Unknown
  misc_feature (1)..( 14): Result.001 file - promoters75/1570606
taaacttttaaata

SEQ ID NO: 77740 - DNA, 15 bp, Unknown
  misc_feature (1)..( 15): Result.001 file - promoters75/1570606
actatgatttaaaat

SEQ ID NO: 77741 - DNA, 15 bp, Unknown
  misc_feature (1)..( 15): Result.001 file - promoters75/1570606
agtgaaattgaaatt

SEQ ID NO: 77742 - DNA, 11 bp, Unknown
  misc_feature (1)..( 11): Result.001 file - promoters75/1570606
gagaaaagtaa

SEQ ID NO: 77743 - DNA, 11 bp, Unknown
  misc_feature (1)..( 11): Result.001 file - promoters75/1570606
aagaaaaataa

SEQ ID NO: 77744 - DNA, 11 bp, Unknown
  misc_feature (1)..( 11): Result.001 file - promoters75/1570606
aataaaagttt

SEQ ID NO: 77745 - DNA, 11 bp, Unknown
  misc_feature (1)..( 11): Result.001 file - promoters75/1570606
gagaaaataaa

SEQ ID NO: 77746 - DNA, 11 bp, Unknown
  misc_feature (1)..( 11): Result.001 file - promoters75/1570606
cttaaagatat

SEQ ID NO: 77747 - DNA, 11 bp, Unknown
  misc_feature (1)..( 11): Result.001 file - promoters75/1570606
tataaaaattt

SEQ ID NO: 77748 - DNA, 8 bp, Unknown
  misc_feature (1)..( 8): Result.001 file - promoters75/1570606
tatatttg

SEQ ID NO: 77749 - DNA, 8 bp, Unknown
  misc_feature (1)..( 8): Result.001 file - promoters75/1570606
tatacttg

SEQ ID NO: 77750 - DNA, 8 bp, Unknown
  misc_feature (1)..( 8): Result.001 file - promoters75/1570606
catatttg

SEQ ID NO: 77751 - DNA, 8 bp, Unknown
  misc_feature (1)..( 8): Result.001 file - promoters75/1570606
aatatttt

SEQ ID NO: 77752 - DNA, 8 bp, Unknown
  misc_feature (1)..( 8): Result.001 file - promoters75/1570606
tatattta

SEQ ID NO: 77753 - DNA, 8 bp, Unknown
  misc_feature (1)..( 8): Result.001 file - promoters75/1570606
aatatttt

SEQ ID NO: 77754 - DNA, 10 bp, Unknown
  misc_feature (1)..( 10): Result.001 file - promoters75/1570606
tttaaagata

SEQ ID NO: 77755 - DNA, 10 bp, Unknown
  misc_feature (1)..( 10): Result.001 file - promoters75/1570606
agtaaaaata

SEQ ID NO: 77756 - DNA, 10 bp, Unknown
  misc_feature (1)..( 10): Result.001 file - promoters75/1570606
tagaaaaatg

SEQ ID NO: 77757 - DNA, 10 bp, Unknown
  misc_feature (1)..( 10): Result.001 file - promoters75/1570606
ttaaaatata

SEQ ID NO: 77758 - DNA, 10 bp, Unknown
  misc_feature (1)..( 10): Result.001 file - promoters75/1570606
ctgaaaaatt

SEQ ID NO: 77759 - DNA, 10 bp, Unknown
  misc_feature (1)..( 10): Result.001 file - promoters75/1570606
agtgaaattg

SEQ ID NO: 77760 - DNA, 9 bp, Unknown
  misc_feature (1)..( 9): Result.001 file - promoters75/1570606
ttaatttat

SEQ ID NO: 77761 - DNA, 9 bp, Unknown
  misc_feature (1)..( 9): Result.001 file - promoters75/1570606
ttactttta

SEQ ID NO: 77762 - DNA, 9 bp, Unknown
  misc_feature (1)..( 9): Result.001 file - promoters75/1570606
aaaatatat

SEQ ID NO: 77763 - DNA, 9 bp, Unknown
  misc_feature (1)..( 9): Result.001 file - promoters75/1570606
taaaaatac

SEQ ID NO: 77764 - DNA, 9 bp, Unknown
  misc_feature (1)..( 9): Result.001 file - promoters75/1570606
gaaaaattc

SEQ ID NO: 77765 - DNA, 9 bp, Unknown
  misc_feature (1)..( 9): Result.001 file - promoters75/1570622
aaactttta

SEQ ID NO: 77766 - DNA, 9 bp, Unknown
  misc_feature (1)..( 9): Result.001 file - promoters75/1570622
tcgtatcat

SEQ ID NO: 77767 - DNA, 9 bp, Unknown
  misc_feature (1)..( 9): Result.001 file - promoters75/1570622
tcgtttcaa

SEQ ID NO: 77768 - DNA, 9 bp, Unknown
  misc_feature (1)..( 9): Result.001 file - promoters75/1570622
ctatttcaa

SEQ ID NO: 77769 - DNA, 8 bp, Unknown
  misc_feature (1)..( 8): Result.001 file - promoters75/1570622
aaacataa

SEQ ID NO: 77770 - DNA, 8 bp, Unknown
  misc_feature (1)..( 8): Result.001 file - promoters75/1570622
aaaaatac

SEQ ID NO: 77771 - DNA, 8 bp, Unknown
  misc_feature (1)..( 8): Result.001 file - promoters75/1570622
caacttaa

SEQ ID NO: 77772 - DNA, 19 bp, Unknown
  misc_feature (1)..( 19): Result.001 file - promoters75/1570622
taatacaattgagagataa

SEQ ID NO: 77773 - DNA, 19 bp, Unknown
  misc_feature (1)..( 19): Result.001 file - promoters75/1570622
taaaacaaaacacaccctt

SEQ ID NO: 77774 - DNA, 19 bp, Unknown
  misc_feature (1)..( 19): Result.001 file - promoters75/1570622
aaaaaaaaaaaaggaaaac

SEQ ID NO: 77775 - DNA, 9 bp, Unknown
  misc_feature (1)..( 9): Result.001 file - promoters75/1570622
tacttttta

SEQ ID NO: 77776 - DNA, 9 bp, Unknown
  misc_feature (1)..( 9): Result.001 file - promoters75/1570622
tactttttt

SEQ ID NO: 77777 - DNA, 10 bp, Unknown
  misc_feature (1)..( 10): Result.001 file - promoters75/1570622
gacttctttt

SEQ ID NO: 77778 - DNA, 9 bp, Unknown
  misc_feature (1)..( 9): Result.001 file - promoters75/1570622
cgggattaa

SEQ ID NO: 77779 - DNA, 9 bp, Unknown
  misc_feature (1)..( 9): Result.001 file - promoters75/1570622
tatgattaa

SEQ ID NO: 77780 - DNA, 9 bp, Unknown
  misc_feature (1)..( 9): Result.001 file - promoters75/1570622
tatgagtaa

SEQ ID NO: 77781 - DNA, 9 bp, Unknown
  misc_feature (1)..( 9): Result.001 file - promoters75/1570622
acttcatat

SEQ ID NO: 77782 - DNA, 9 bp, Unknown
  misc_feature (1)..( 9): Result.001 file - promoters75/1570622
tcttcttat

SEQ ID NO: 77783 - DNA, 9 bp, Unknown
  misc_feature (1)..( 9): Result.001 file - promoters75/1570622
tcttcttca

SEQ ID NO: 77784 - DNA, 9 bp, Unknown
  misc_feature (1)..( 9): Result.001 file - promoters75/1570622
tttgacaac

SEQ ID NO: 77785 - DNA, 9 bp, Unknown
  misc_feature (1)..( 9): Result.001 file - promoters75/1570622
tttaacaat

SEQ ID NO: 77786 - DNA, 9 bp, Unknown
  misc_feature (1)..( 9): Result.001 file - promoters75/1570966
gataagaat

SEQ ID NO: 77787 - DNA, 7 bp, Unknown
  misc_feature (1)..( 7): Result.001 file - promoters75/1570966
attttta

SEQ ID NO: 77788 - DNA, 7 bp, Unknown
  misc_feature (1)..( 7): Result.001 file - promoters75/1570966
atttttt

SEQ ID NO: 77789 - DNA, 7 bp, Unknown
  misc_feature (1)..( 7): Result.001 file - promoters75/1570966
attttta

SEQ ID NO: 77790 - DNA, 9 bp, Unknown
  misc_feature (1)..( 9): Result.001 file - promoters75/1570966
agtcaactt

SEQ ID NO: 77791 - DNA, 9 bp, Unknown
  misc_feature (1)..( 9): Result.001 file - promoters75/1570966
agttaactt

SEQ ID NO: 77792 - DNA, 9 bp, Unknown
  misc_feature (1)..( 9): Result.001 file - promoters75/1580932
aattaactt

SEQ ID NO: 77793 - DNA, 8 bp, Unknown
  misc_feature (1)..( 8): Result.001 file - promoters75/1580932
aataaacg

SEQ ID NO: 77794 - DNA, 8 bp, Unknown
  misc_feature (1)..( 8): Result.001 file - promoters75/1580932
aataaagg

SEQ ID NO: 77795 - DNA, 8 bp, Unknown
  misc_feature (1)..( 8): Result.001 file - promoters75/1580932
aaaaaaaa

SEQ ID NO: 77796 - DNA, 8 bp, Unknown
  misc_feature (1)..( 8): Result.001 file - promoters75/1580932
tcatttaa

SEQ ID NO: 77797 - DNA, 8 bp, Unknown
  misc_feature (1)..( 8): Result.001 file - promoters75/1580932
caatttaa

SEQ ID NO: 77798 - DNA, 8 bp, Unknown
  misc_feature (1)..( 8): Result.001 file - promoters75/1580932
tcatttat

SEQ ID NO: 77799 - DNA, 8 bp, Unknown
  misc_feature (1)..( 8): Result.001 file - promoters75/1580932
gaaaaccc

SEQ ID NO: 77800 - DNA, 8 bp, Unknown
  misc_feature (1)..( 8): Result.001 file - promoters75/1580932
aaaaacca

SEQ ID NO: 77801 - DNA, 8 bp, Unknown
  misc_feature (1)..( 8): Result.001 file - promoters75/1595794
aaaaacct

SEQ ID NO: 77802 - DNA, 8 bp, Unknown
  misc_feature (1)..( 8): Result.001 file - promoters75/1595794
taatgtct

SEQ ID NO: 77803 - DNA, 8 bp, Unknown
  misc_feature (1)..( 8): Result.001 file - promoters75/1595794
aaatgtct

SEQ ID NO: 77804 - DNA, 8 bp, Unknown
  misc_feature (1)..( 8): Result.001 file - promoters75/1595794
aaatgtat

SEQ ID NO: 77805 - DNA, 8 bp, Unknown
  misc_feature (1)..( 8): Result.001 file - promoters75/1595794
aaaagtaa

SEQ ID NO: 77806 - DNA, 10 bp, Unknown
  misc_feature (1)..( 10): Result.001 file - promoters75/1595794
ctaaaataat

SEQ ID NO: 77807 - DNA, 10 bp, Unknown
  misc_feature (1)..( 10): Result.001 file - promoters75/1595794
acaaagtaaa

SEQ ID NO: 77808 - DNA, 10 bp, Unknown
  misc_feature (1)..( 10): Result.001 file - promoters75/1595794
tggtaataat

SEQ ID NO: 77809 - DNA, 10 bp, Unknown
  misc_feature (1)..( 10): Result.001 file - promoters75/1595794
aaaaaataac

SEQ ID NO: 77810 - DNA, 11 bp, Unknown
  misc_feature (1)..( 11): Result.001 file - promoters75/1595794
cagctaaactt

SEQ ID NO: 77811 - DNA, 11 bp, Unknown
  misc_feature (1)..( 11): Result.001 file - promoters75/1595794
taattaatctt

SEQ ID NO: 77812 - DNA, 11 bp, Unknown
  misc_feature (1)..( 11): Result.001 file - promoters75/1595794
aatttattctg

SEQ ID NO: 77813 - DNA, 11 bp, Unknown
  misc_feature (1)..( 11): Result.001 file - promoters75/1595794
aatttatttct

SEQ ID NO: 77814 - DNA, 8 bp, Unknown
  misc_feature (1)..( 8): Result.001 file - promoters75/1595794
agtctttc

SEQ ID NO: 77815 - DNA, 8 bp, Unknown
  misc_feature (1)..( 8): Result.001 file - promoters75/1595794
tgtctttt

SEQ ID NO: 77816 - DNA, 9 bp, Unknown
  misc_feature (1)..( 9): Result.001 file - promoters75/1595794
tgtctcttg

SEQ ID NO: 77817 - DNA, 9 bp, Unknown
  misc_feature (1)..( 9): Result.001 file - promoters75/1595794
agtctttga

SEQ ID NO: 77818 - DNA, 11 bp, Unknown
  misc_feature (1)..( 11): Result.001 file - promoters75/1595794
catttgtttca

SEQ ID NO: 77819 - DNA, 11 bp, Unknown
  misc_feature (1)..( 11): Result.001 file - promoters75/1595794
tctttgtatca

SEQ ID NO: 77820 - DNA, 11 bp, Unknown
  misc_feature (1)..( 11): Result.001 file - promoters75/1595794
tctctgtggac

SEQ ID NO: 77821 - DNA, 11 bp, Unknown
  misc_feature (1)..( 11): Result.001 file - promoters75/1595794
catttctatag

SEQ ID NO: 77822 - DNA, 11 bp, Unknown
  misc_feature (1)..( 11): Result.001 file - promoters75/1595794
catctctgtgg

SEQ ID NO: 77823 - DNA, 11 bp, Unknown
  misc_feature (1)..( 11): Result.001 file - promoters75/1595794
catttctatag

SEQ ID NO: 77824 - DNA, 11 bp, Unknown
  misc_feature (1)..( 11): Result.001 file - promoters75/1595794
tatgtctttgt

SEQ ID NO: 77825 - DNA, 11 bp, Unknown
  misc_feature (1)..( 11): Result.001 file - promoters75/1595794
aatttctctac

SEQ ID NO: 77826 - DNA, 11 bp, Unknown
  misc_feature (1)..( 11): Result.001 file - promoters75/1595794
aaacaattcaa

SEQ ID NO: 77827 - DNA, 11 bp, Unknown
  misc_feature (1)..( 11): Result.001 file - promoters75/1595794
aagtaattcaa

SEQ ID NO: 77828 - DNA, 11 bp, Unknown
  misc_feature (1)..( 11): Result.001 file - promoters75/1595794
aaataattctc

SEQ ID NO: 77829 - DNA, 11 bp, Unknown
  misc_feature (1)..( 11): Result.001 file - promoters75/1595794
aaaaaatcaaa

SEQ ID NO: 77830 - DNA, 9 bp, Unknown
  misc_feature (1)..( 9): Result.001 file - promoters75/1595794
attttctta

SEQ ID NO: 77831 - DNA, 9 bp, Unknown
  misc_feature (1)..( 9): Result.001 file - promoters75/1595794
actttttta

SEQ ID NO: 77832 - DNA, 9 bp, Unknown
  misc_feature (1)..( 9): Result.001 file - promoters75/1595794
attttcttg

SEQ ID NO: 77833 - DNA, 9 bp, Unknown
  misc_feature (1)..( 9): Result.001 file - promoters75/1595794
tggttttta

SEQ ID NO: 77834 - DNA, 9 bp, Unknown
  misc_feature (1)..( 9): Result.001 file - promoters75/1595794
gaaacaaag

SEQ ID NO: 77835 - DNA, 9 bp, Unknown
  misc_feature (1)..( 9): Result.001 file - promoters75/1595794
aaaacaaaa

SEQ ID NO: 77836 - DNA, 9 bp, Unknown
  misc_feature (1)..( 9): Result.001 file - promoters75/1595794
aaaataaaa

SEQ ID NO: 77837 - DNA, 9 bp, Unknown
  misc_feature (1)..( 9): Result.001 file - promoters75/1662827
tcgacaaaa

SEQ ID NO: 77838 - DNA, 10 bp, Unknown
  misc_feature (1)..( 10): Result.001 file - promoters75/1662827
ttttcttaat

SEQ ID NO: 77839 - DNA, 10 bp, Unknown
  misc_feature (1)..( 10): Result.001 file - promoters75/1662827
ttttcataat

SEQ ID NO: 77840 - DNA, 10 bp, Unknown
  misc_feature (1)..( 10): Result.001 file - promoters75/1662827
ctttcattca

SEQ ID NO: 77841 - DNA, 10 bp, Unknown
  misc_feature (1)..( 10): Result.001 file - promoters75/1662827
agttaataaa

SEQ ID NO: 77842 - DNA, 10 bp, Unknown
  misc_feature (1)..( 10): Result.001 file - promoters75/1662827
agttaatatt

SEQ ID NO: 77843 - DNA, 10 bp, Unknown
  misc_feature (1)..( 10): Result.001 file - promoters75/1662827
ttgtaacaaa

SEQ ID NO: 77844 - DNA, 6 bp, Unknown
  misc_feature (1)..( 6): Result.001 file - promoters75/1662827
tacatt

SEQ ID NO: 77845 - DNA, 6 bp, Unknown
  misc_feature (1)..( 6): Result.001 file - promoters75/1662827
tacatt

SEQ ID NO: 77846 - DNA, 6 bp, Unknown
  misc_feature (1)..( 6): Result.001 file - promoters75/1662827
tacatt

SEQ ID NO: 77847 - DNA, 7 bp, Unknown
  misc_feature (1)..( 7): Result.001 file - promoters75/1662827
tttttaa

SEQ ID NO: 77848 - DNA, 7 bp, Unknown
  misc_feature (1)..( 7): Result.001 file - promoters75/1662827
tttttac

SEQ ID NO: 77849 - DNA, 7 bp, Unknown
  misc_feature (1)..( 7): Result.001 file - promoters75/1662827
attttac

SEQ ID NO: 77850 - DNA, 8 bp, Unknown
  misc_feature (1)..( 8): Result.001 file - promoters75/1662827
agacaaaa

SEQ ID NO: 77851 - DNA, 8 bp, Unknown
  misc_feature (1)..( 8): Result.001 file - promoters75/1662827
agaaaaaa

SEQ ID NO: 77852 - DNA, 8 bp, Unknown
  misc_feature (1)..( 8): Result.001 file - promoters75/1662917
aaacgaaa

SEQ ID NO: 77853 - DNA, 8 bp, Unknown
  misc_feature (1)..( 8): Result.001 file - promoters75/1662917
attagttc

SEQ ID NO: 77854 - DNA, 8 bp, Unknown
  misc_feature (1)..( 8): Result.001 file - promoters75/1662917
atttgtta

SEQ ID NO: 77855 - DNA, 8 bp, Unknown
  misc_feature (1)..( 8): Result.001 file - promoters75/1662917
aattgtta

SEQ ID NO: 77856 - DNA, 7 bp, Unknown
  misc_feature (1)..( 7): Result.001 file - promoters75/1662917
tttcaat

SEQ ID NO: 77857 - DNA, 7 bp, Unknown
  misc_feature (1)..( 7): Result.001 file - promoters75/1662917
ttttaat

SEQ ID NO: 77858 - DNA, 7 bp, Unknown
  misc_feature (1)..( 7): Result.001 file - promoters75/1662917
ttttaaa

SEQ ID NO: 77859 - DNA, 8 bp, Unknown
  misc_feature (1)..( 8): Result.001 file - promoters75/1662917
aaattcaa

SEQ ID NO: 77860 - DNA, 8 bp, Unknown
  misc_feature (1)..( 8): Result.001 file - promoters75/1662917
aaattctc

SEQ ID NO: 77861 - DNA, 8 bp, Unknown
  misc_feature (1)..( 8): Result.001 file - promoters75/1662917
aaatcctc

SEQ ID NO: 77862 - DNA, 11 bp, Unknown
  misc_feature (1)..( 11): Result.001 file - promoters75/1662917
cttataattat

SEQ ID NO: 77863 - DNA, 11 bp, Unknown
  misc_feature (1)..( 11): Result.001 file - promoters75/1662917
tttataagtat

SEQ ID NO: 77864 - DNA, 11 bp, Unknown
  misc_feature (1)..( 11): Result.001 file - promoters75/1663221
tttgtaacttc

SEQ ID NO: 77865 - DNA, 8 bp, Unknown
  misc_feature (1)..( 8): Result.001 file - promoters75/1663221
gataattt

SEQ ID NO: 77866 - DNA, 8 bp, Unknown
  misc_feature (1)..( 8): Result.001 file - promoters75/1663221
actaattt

SEQ ID NO: 77867 - DNA, 8 bp, Unknown
  misc_feature (1)..( 8): Result.001 file - promoters75/1663221
gattattt

SEQ ID NO: 77868 - DNA, 8 bp, Unknown
  misc_feature (1)..( 8): Result.001 file - promoters75/1663221
agagaagg

SEQ ID NO: 77869 - DNA, 8 bp, Unknown
  misc_feature (1)..( 8): Result.001 file - promoters75/1663221
tgagaagg

SEQ ID NO: 77870 - DNA, 8 bp, Unknown
  misc_feature (1)..( 8): Result.001 file - promoters75/1663221
agagaatt

SEQ ID NO: 77871 - DNA, 11 bp, Unknown
  misc_feature (1)..( 11): Result.001 file - promoters75/1663221
agtatctcaaa

SEQ ID NO: 77872 - DNA, 11 bp, Unknown
  misc_feature (1)..( 11): Result.001 file - promoters75/1663221
agtatatcatt

SEQ ID NO: 77873 - DNA, 11 bp, Unknown
  misc_feature (1)..( 11): Result.001 file - promoters75/1664931
aacataacatt

SEQ ID NO: 77874 - DNA, 8 bp, Unknown
  misc_feature (1)..( 8): Result.001 file - promoters75/1664931
taagttta

SEQ ID NO: 77875 - DNA, 8 bp, Unknown
  misc_feature (1)..( 8): Result.001 file - promoters75/1664931
gaagtttc

SEQ ID NO: 77876 - DNA, 8 bp, Unknown
  misc_feature (1)..( 8): Result.001 file - promoters75/1664931
taatttta

SEQ ID NO: 77877 - DNA, 8 bp, Unknown
  misc_feature (1)..( 8): Result.001 file - promoters75/1664931
gaattttt

SEQ ID NO: 77878 - DNA, 8 bp, Unknown
  misc_feature (1)..( 8): Result.001 file - promoters75/1664931
gaactttt

SEQ ID NO: 77879 - DNA, 9 bp, Unknown
  misc_feature (1)..( 9): Result.001 file - promoters75/1664981
taacgtttg

SEQ ID NO: 77880 - DNA, 15 bp, Unknown
  misc_feature (1)..( 15): Result.001 file - promoters75/1664981
tatttatatagataa

SEQ ID NO: 77881 - DNA, 15 bp, Unknown
  misc_feature (1)..( 15): Result.001 file - promoters75/1664981
cctatataaagataa

SEQ ID NO: 77882 - DNA, 15 bp, Unknown
  misc_feature (1)..( 15): Result.001 file - promoters75/1664981
ttaatatataaagga

SEQ ID NO: 77883 - DNA, 15 bp, Unknown
  misc_feature (1)..( 15): Result.001 file - promoters75/1664981
gacatatatacttag

SEQ ID NO: 77884 - DNA, 15 bp, Unknown
  misc_feature (1)..( 15): Result.001 file - promoters75/1664981
agagaataaaaggtc

SEQ ID NO: 77885 - DNA, 15 bp, Unknown
  misc_feature (1)..( 15): Result.001 file - promoters75/1664981
gtactataaattctt

SEQ ID NO: 77886 - DNA, 15 bp, Unknown
  misc_feature (1)..( 15): Result.001 file - promoters75/1664981
tatttatgaatccat

SEQ ID NO: 77887 - DNA, 20 bp, Unknown
  misc_feature (1)..( 20): Result.001 file - promoters75/1664981
acatgaacacaaatcttctt

SEQ ID NO: 77888 - DNA, 20 bp, Unknown
  misc_feature (1)..( 20): Result.001 file - promoters75/1664981
aatcgaaaacaaataatcaa

SEQ ID NO: 77889 - DNA, 20 bp, Unknown
  misc_feature (1)..( 20): Result.001 file - promoters75/1664981
tgttcaacacaaatttttac

SEQ ID NO: 77890 - DNA, 20 bp, Unknown
  misc_feature (1)..( 20): Result.001 file - promoters75/1664981
tgtacaaaacatagatggag

SEQ ID NO: 77891 - DNA, 20 bp, Unknown
  misc_feature (1)..( 20): Result.001 file - promoters75/1664981
ttattgttacaaatctatcc

SEQ ID NO: 77892 - DNA, 20 bp, Unknown
  misc_feature (1)..( 20): Result.001 file - promoters75/1665272
agtaaatcatttttttctac

SEQ ID NO: 77893 - DNA, 9 bp, Unknown
  misc_feature (1)..( 9): Result.001 file - promoters75/1665272
gttcaaaat

SEQ ID NO: 77894 - DNA, 9 bp, Unknown
  misc_feature (1)..( 9): Result.001 file - promoters75/1665272
ttccaaaat

SEQ ID NO: 77895 - DNA, 9 bp, Unknown
  misc_feature (1)..( 9): Result.001 file - promoters75/1665272
ttccaaatg

SEQ ID NO: 77896 - DNA, 11 bp, Unknown
  misc_feature (1)..( 11): Result.001 file - promoters75/1665272
tttttgttcgt

SEQ ID NO: 77897 - DNA, 11 bp, Unknown
  misc_feature (1)..( 11): Result.001 file - promoters75/1665272
gtgttgttcgt

SEQ ID NO: 77898 - DNA, 11 bp, Unknown
  misc_feature (1)..( 11): Result.001 file - promoters75/1665272
ttcttgtaaca

SEQ ID NO: 77899 - DNA, 9 bp, Unknown
  misc_feature (1)..( 9): Result.001 file - promoters75/1665272
agatatagt

SEQ ID NO: 77900 - DNA, 9 bp, Unknown
  misc_feature (1)..( 9): Result.001 file - promoters75/1665272
agaaataga

SEQ ID NO: 77901 - DNA, 9 bp, Unknown
  misc_feature (1)..( 9): Result.001 file - promoters75/1711228
agaaaaaga

SEQ ID NO: 77902 - DNA, 7 bp, Unknown
  misc_feature (1)..( 7): Result.001 file - promoters75/1711228
aagattt

SEQ ID NO: 77903 - DNA, 7 bp, Unknown
  misc_feature (1)..( 7): Result.001 file - promoters75/1711228
aagattc

SEQ ID NO: 77904 - DNA, 7 bp, Unknown
  misc_feature (1)..( 7): Result.001 file - promoters75/1711228
aagattt

SEQ ID NO: 77905 - DNA, 12 bp, Unknown
  misc_feature (1)..( 12): Result.001 file - promoters75/1711228
tgtattttatgt

SEQ ID NO: 77906 - DNA, 12 bp, Unknown
  misc_feature (1)..( 12): Result.001 file - promoters75/1711228
tgtgtttgttgt

SEQ ID NO: 77907 - DNA, 12 bp, Unknown
  misc_feature (1)..( 12): Result.001 file - promoters75/1714831
attattatatgt

SEQ ID NO: 77908 - DNA, 9 bp, Unknown
  misc_feature (1)..( 9): Result.001 file - promoters75/1714831
tcaaaatgc

SEQ ID NO: 77909 - DNA, 9 bp, Unknown
  misc_feature (1)..( 9): Result.001 file - promoters75/1714831
agaaattgc

SEQ ID NO: 77910 - DNA, 9 bp, Unknown
  misc_feature (1)..( 9): Result.001 file - promoters75/1714831
tcaaaattc

SEQ ID NO: 77911 - DNA, 10 bp, Unknown
  misc_feature (1)..( 10): Result.001 file - promoters75/1714831
catgtgaaga

SEQ ID NO: 77912 - DNA, 10 bp, Unknown
  misc_feature (1)..( 10): Result.001 file - promoters75/1714831
catttgattt

SEQ ID NO: 77913 - DNA, 10 bp, Unknown
  misc_feature (1)..( 10): Result.001 file - promoters75/1714989
tatttaattt

SEQ ID NO: 77914 - DNA, 9 bp, Unknown
  misc_feature (1)..( 9): Result.001 file - promoters75/1714989
gaaaatatt

SEQ ID NO: 77915 - DNA, 9 bp, Unknown
  misc_feature (1)..( 9): Result.001 file - promoters75/1714989
aaaaataag

SEQ ID NO: 77916 - DNA, 9 bp, Unknown
  misc_feature (1)..( 9): Result.001 file - promoters75/1714989
aaaaattaa

SEQ ID NO: 77917 - DNA, 9 bp, Unknown
  misc_feature (1)..( 9): Result.001 file - promoters75/1714989
aaagattta

SEQ ID NO: 77918 - DNA, 8 bp, Unknown
  misc_feature (1)..( 8): Result.001 file - promoters75/1714989
aaaataaa

SEQ ID NO: 77919 - DNA, 8 bp, Unknown
  misc_feature (1)..( 8): Result.001 file - promoters75/1714989
ttaataaa

SEQ ID NO: 77920 - DNA, 8 bp, Unknown
  misc_feature (1)..( 8): Result.001 file - promoters75/1714989
aaaattaa

SEQ ID NO: 77921 - DNA, 8 bp, Unknown
  misc_feature (1)..( 8): Result.001 file - promoters75/1714989
aaaacaaa

SEQ ID NO: 77922 - DNA, 8 bp, Unknown
  misc_feature (1)..( 8): Result.001 file - promoters75/1714989
aaaaaaaa

SEQ ID NO: 77923 - DNA, 8 bp, Unknown
  misc_feature (1)..( 8): Result.001 file - promoters75/1714989
taaataaa

SEQ ID NO: 77924 - DNA, 8 bp, Unknown
  misc_feature (1)..( 8): Result.001 file - promoters75/1714989
gaaacaaa

SEQ ID NO: 77925 - DNA, 10 bp, Unknown
  misc_feature (1)..( 10): Result.001 file - promoters75/1714989
cacaccaaat

SEQ ID NO: 77926 - DNA, 10 bp, Unknown
  misc_feature (1)..( 10): Result.001 file - promoters75/1714989
aaaaccaaag

SEQ ID NO: 77927 - DNA, 10 bp, Unknown
  misc_feature (1)..( 10): Result.001 file - promoters75/1714989
ccaactaaag

SEQ ID NO: 77928 - DNA, 10 bp, Unknown
  misc_feature (1)..( 10): Result.001 file - promoters75/1714989
taaactatga

SEQ ID NO: 77929 - DNA, 12 bp, Unknown
  misc_feature (1)..( 12): Result.001 file - promoters75/1714989
attgggactaaa

SEQ ID NO: 77930 - DNA, 12 bp, Unknown
  misc_feature (1)..( 12): Result.001 file - promoters75/1714989
atttggataaaa

SEQ ID NO: 77931 - DNA, 12 bp, Unknown
  misc_feature (1)..( 12): Result.001 file - promoters75/1714989
ctttgaataaaa

SEQ ID NO: 77932 - DNA, 12 bp, Unknown
  misc_feature (1)..( 12): Result.001 file - promoters75/1714989
cttcgaaggtaa

SEQ ID NO: 77933 - DNA, 9 bp, Unknown
  misc_feature (1)..( 9): Result.001 file - promoters75/1714989
cctctttcc

SEQ ID NO: 77934 - DNA, 9 bp, Unknown
  misc_feature (1)..( 9): Result.001 file - promoters75/1714989
cctttttat

SEQ ID NO: 77935 - DNA, 9 bp, Unknown
  misc_feature (1)..( 9): Result.001 file - promoters75/1714989
tctctttcc

SEQ ID NO: 77936 - DNA, 10 bp, Unknown
  misc_feature (1)..( 10): Result.001 file - promoters75/1714989
attacaaaac

SEQ ID NO: 77937 - DNA, 10 bp, Unknown
  misc_feature (1)..( 10): Result.001 file - promoters75/1714989
tatacaaaaa

SEQ ID NO: 77938 - DNA, 10 bp, Unknown
  misc_feature (1)..( 10): Result.001 file - promoters75/1714989
ctcccaaaaa

SEQ ID NO: 77939 - DNA, 10 bp, Unknown
  misc_feature (1)..( 10): Result.001 file - promoters75/1714989
tatacaagaa

SEQ ID NO: 77940 - DNA, 11 bp, Unknown
  misc_feature (1)..( 11): Result.001 file - promoters75/1714989
aataaataaaa

SEQ ID NO: 77941 - DNA, 11 bp, Unknown
  misc_feature (1)..( 11): Result.001 file - promoters75/1714989
aaacaataaaa

SEQ ID NO: 77942 - DNA, 11 bp, Unknown
  misc_feature (1)..( 11): Result.001 file - promoters75/1714989
aaacagtaaaa

SEQ ID NO: 77943 - DNA, 10 bp, Unknown
  misc_feature (1)..( 10): Result.001 file - promoters75/1714989
atattattag

SEQ ID NO: 77944 - DNA, 10 bp, Unknown
  misc_feature (1)..( 10): Result.001 file - promoters75/1714989
atattattag

SEQ ID NO: 77945 - DNA, 10 bp, Unknown
  misc_feature (1)..( 10): Result.001 file - promoters75/1714989
aaattattta

SEQ ID NO: 77946 - DNA, 7 bp, Unknown
  misc_feature (1)..( 7): Result.001 file - promoters75/1714989
tttgttt

SEQ ID NO: 77947 - DNA, 7 bp, Unknown
  misc_feature (1)..( 7): Result.001 file - promoters75/1714989
tttattt

SEQ ID NO: 77948 - DNA, 7 bp, Unknown
  misc_feature (1)..( 7): Result.001 file - promoters75/1714989
attattt

SEQ ID NO: 77949 - DNA, 7 bp, Unknown
  misc_feature (1)..( 7): Result.001 file - promoters75/1714989
aaccaac

SEQ ID NO: 77950 - DNA, 7 bp, Unknown
  misc_feature (1)..( 7): Result.001 file - promoters75/1714989
aaccaat

SEQ ID NO: 77951 - DNA, 7 bp, Unknown
  misc_feature (1)..( 7): Result.001 file - promoters75/1714989
gaccaat

SEQ ID NO: 77952 - DNA, 8 bp, Unknown
  misc_feature (1)..( 8): Result.001 file - promoters75/1714989
aacaaaaa

SEQ ID NO: 77953 - DNA, 8 bp, Unknown
  misc_feature (1)..( 8): Result.001 file - promoters75/1714989
aactaaag

SEQ ID NO: 77954 - DNA, 8 bp, Unknown
  misc_feature (1)..( 8): Result.001 file - promoters75/1714989
aaccaaag

SEQ ID NO: 77955 - DNA, 8 bp, Unknown
  misc_feature (1)..( 8): Result.001 file - promoters75/1714989
agacaaac

SEQ ID NO: 77956 - DNA, 8 bp, Unknown
  misc_feature (1)..( 8): Result.001 file - promoters75/1714989
ttacaaac

SEQ ID NO: 77957 - DNA, 8 bp, Unknown
  misc_feature (1)..( 8): Result.001 file - promoters75/1715347
ttaaaaaa

SEQ ID NO: 77958 - DNA, 8 bp, Unknown
  misc_feature (1)..( 8): Result.001 file - promoters75/1715347
tttttgta

SEQ ID NO: 77959 - DNA, 8 bp, Unknown
  misc_feature (1)..( 8): Result.001 file - promoters75/1715347
tttttgtt

SEQ ID NO: 77960 - DNA, 8 bp, Unknown
  misc_feature (1)..( 8): Result.001 file - promoters75/1807771
tatttgtt

SEQ ID NO: 77961 - DNA, 8 bp, Unknown
  misc_feature (1)..( 8): Result.001 file - promoters75/1807771
acttatat

SEQ ID NO: 77962 - DNA, 8 bp, Unknown
  misc_feature (1)..( 8): Result.001 file - promoters75/1807771
acttatcc

SEQ ID NO: 77963 - DNA, 8 bp, Unknown
  misc_feature (1)..( 8): Result.001 file - promoters75/1807771
tcttatat

SEQ ID NO: 77964 - DNA, 12 bp, Unknown
  misc_feature (1)..( 12): Result.001 file - promoters75/1807771
tttgtttgtttt

SEQ ID NO: 77965 - DNA, 12 bp, Unknown
  misc_feature (1)..( 12): Result.001 file - promoters75/1807771
tttgtttttttt

SEQ ID NO: 77966 - DNA, 12 bp, Unknown
  misc_feature (1)..( 12): Result.001 file - promoters75/1808172
atccttttttta

SEQ ID NO: 77967 - DNA, 12 bp, Unknown
  misc_feature (1)..( 12): Result.001 file - promoters75/1808172
tattaaccttga

SEQ ID NO: 77968 - DNA, 12 bp, Unknown
  misc_feature (1)..( 12): Result.001 file - promoters75/1808172
aattgaccctga

SEQ ID NO: 77969 - DNA, 12 bp, Unknown
  misc_feature (1)..( 12): Result.001 file - promoters75/1808172
aaataataaagt

SEQ ID NO: 77970 - DNA, 7 bp, Unknown
  misc_feature (1)..( 7): Result.001 file - promoters75/1808172
tctctct

SEQ ID NO: 77971 - DNA, 7 bp, Unknown
  misc_feature (1)..( 7): Result.001 file - promoters75/1808172
tctttct

SEQ ID NO: 77972 - DNA, 7 bp, Unknown
  misc_feature (1)..( 7): Result.001 file - promoters75/1808172
tctttca

SEQ ID NO: 77973 - DNA, 8 bp, Unknown
  misc_feature (1)..( 8): Result.001 file - promoters75/1808172
acaaaatc

SEQ ID NO: 77974 - DNA, 8 bp, Unknown
  misc_feature (1)..( 8): Result.001 file - promoters75/1808172
acaaaaca

SEQ ID NO: 77975 - DNA, 8 bp, Unknown
  misc_feature (1)..( 8): Result.001 file - promoters75/1808172
acaaaaca

SEQ ID NO: 77976 - DNA, 8 bp, Unknown
  misc_feature (1)..( 8): Result.001 file - promoters75/1808172
caactatc

SEQ ID NO: 77977 - DNA, 8 bp, Unknown
  misc_feature (1)..( 8): Result.001 file - promoters75/1808172
caattata

SEQ ID NO: 77978 - DNA, 8 bp, Unknown
  misc_feature (1)..( 8): Result.001 file - promoters75/1808172
aaatcata

SEQ ID NO: 77979 - DNA, 7 bp, Unknown
  misc_feature (1)..( 7): Result.001 file - promoters75/1808172
ctctttc

SEQ ID NO: 77980 - DNA, 7 bp, Unknown
  misc_feature (1)..( 7): Result.001 file - promoters75/1808172
ctctttc

SEQ ID NO: 77981 - DNA, 7 bp, Unknown
  misc_feature (1)..( 7): Result.001 file - promoters75/1808172
ttctttc

SEQ ID NO: 77982 - DNA, 10 bp, Unknown
  misc_feature (1)..( 10): Result.001 file - promoters75/1808172
tatatataga

SEQ ID NO: 77983 - DNA, 10 bp, Unknown
  misc_feature (1)..( 10): Result.001 file - promoters75/1808172
tatatataac

SEQ ID NO: 77984 - DNA, 11 bp, Unknown
  misc_feature (1)..( 11): Result.001 file - promoters75/1808172
gatataataca

SEQ ID NO: 77985 - DNA, 9 bp, Unknown
  misc_feature (1)..( 9): Result.001 file - promoters75/1808172
atattctga

SEQ ID NO: 77986 - DNA, 9 bp, Unknown
  misc_feature (1)..( 9): Result.001 file - promoters75/1808172
aaattttga

SEQ ID NO: 77987 - DNA, 9 bp, Unknown
  misc_feature (1)..( 9): Result.001 file - promoters75/1808172
aaagtttat

SEQ ID NO: 77988 - DNA, 9 bp, Unknown
  misc_feature (1)..( 9): Result.001 file - promoters75/1808172
aatgaaaaa

SEQ ID NO: 77989 - DNA, 9 bp, Unknown
  misc_feature (1)..( 9): Result.001 file - promoters75/1808172
tatgagaaa

SEQ ID NO: 77990 - DNA, 9 bp, Unknown
  misc_feature (1)..( 9): Result.001 file - promoters75/1808172
tataagaaa

SEQ ID NO: 77991 - DNA, 7 bp, Unknown
  misc_feature (1)..( 7): Result.001 file - promoters75/1808172
atgtttt

SEQ ID NO: 77992 - DNA, 7 bp, Unknown
  misc_feature (1)..( 7): Result.001 file - promoters75/1808172
ttgtttt

SEQ ID NO: 77993 - DNA, 7 bp, Unknown
  misc_feature (1)..( 7): Result.001 file - promoters75/1808172
ttgttta

SEQ ID NO: 77994 - DNA, 7 bp, Unknown
  misc_feature (1)..( 7): Result.001 file - promoters75/1808172
attttta

SEQ ID NO: 77995 - DNA, 7 bp, Unknown
  misc_feature (1)..( 7): Result.001 file - promoters75/1808172
atttttt

SEQ ID NO: 77996 - DNA, 7 bp, Unknown
  misc_feature (1)..( 7): Result.001 file - promoters75/1808172
attttta

SEQ ID NO: 77997 - DNA, 9 bp, Unknown
  misc_feature (1)..( 9): Result.001 file - promoters75/1808172
agtcaactt

SEQ ID NO: 77998 - DNA, 9 bp, Unknown
  misc_feature (1)..( 9): Result.001 file - promoters75/1808172
agttaactt

SEQ ID NO: 77999 - DNA, 9 bp, Unknown
  misc_feature (1)..( 9): Result.001 file - promoters75/1809157
aattaactt

SEQ ID NO: 78000 - DNA, 9 bp, Unknown
  misc_feature (1)..( 9): Result.001 file - promoters75/1809157
caaaacatc

SEQ ID NO: 78001 - DNA, 9 bp, Unknown
  misc_feature (1)..( 9): Result.001 file - promoters75/1809157
taaaacaaa

SEQ ID NO: 78002 - DNA, 9 bp, Unknown
  misc_feature (1)..( 9): Result.001 file - promoters75/1809157
acaaatatc

SEQ ID NO: 78003 - DNA, 9 bp, Unknown
  misc_feature (1)..( 9): Result.001 file - promoters75/1809157
aaaaacata

SEQ ID NO: 78004 - DNA, 9 bp, Unknown
  misc_feature (1)..( 9): Result.001 file - promoters75/1809157
caaaaccgt

SEQ ID NO: 78005 - DNA, 9 bp, Unknown
  misc_feature (1)..( 9): Result.001 file - promoters75/1809157
aaaaactca

SEQ ID NO: 78006 - DNA, 11 bp, Unknown
  misc_feature (1)..( 11): Result.001 file - promoters75/1809157
ctccacaaaac

SEQ ID NO: 78007 - DNA, 11 bp, Unknown
  misc_feature (1)..( 11): Result.001 file - promoters75/1809157
taaaacaaaaa

SEQ ID NO: 78008 - DNA, 11 bp, Unknown
  misc_feature (1)..( 11): Result.001 file - promoters75/1809157
tttatcaaaac

SEQ ID NO: 78009 - DNA, 11 bp, Unknown
  misc_feature (1)..( 11): Result.001 file - promoters75/1809157
tgccacaaagg

SEQ ID NO: 78010 - DNA, 11 bp, Unknown
  misc_feature (1)..( 11): Result.001 file - promoters75/1809157
cgaaacaaaga

SEQ ID NO: 78011 - DNA, 11 bp, Unknown
  misc_feature (1)..( 11): Result.001 file - promoters75/1957212
cgaatcaatct

SEQ ID NO: 78012 - DNA, 9 bp, Unknown
  misc_feature (1)..( 9): Result.001 file - promoters75/1957212
gattcttac

SEQ ID NO: 78013 - DNA, 9 bp, Unknown
  misc_feature (1)..( 9): Result.001 file - promoters75/1957212
gattctttg

SEQ ID NO: 78014 - DNA, 9 bp, Unknown
  misc_feature (1)..( 9): Result.001 file - promoters75/1957212
cattcgtac

SEQ ID NO: 78015 - DNA, 9 bp, Unknown
  misc_feature (1)..( 9): Result.001 file - promoters75/1957212
tatttaaac

SEQ ID NO: 78016 - DNA, 9 bp, Unknown
  misc_feature (1)..( 9): Result.001 file - promoters75/1957212
tatttaaaa

SEQ ID NO: 78017 - DNA, 9 bp, Unknown
  misc_feature (1)..( 9): Result.001 file - promoters75/1957212
aattgaaac

SEQ ID NO: 78018 - DNA, 8 bp, Unknown
  misc_feature (1)..( 8): Result.001 file - promoters75/1957212
cgagaaac

SEQ ID NO: 78019 - DNA, 8 bp, Unknown
  misc_feature (1)..( 8): Result.001 file - promoters75/1957212
ggagaaag

SEQ ID NO: 78020 - DNA, 8 bp, Unknown
  misc_feature (1)..( 8): Result.001 file - promoters75/1975923
agagagat

SEQ ID NO: 78021 - DNA, 10 bp, Unknown
  misc_feature (1)..( 10): Result.001 file - promoters75/1975923
atcaaagtta

SEQ ID NO: 78022 - DNA, 10 bp, Unknown
  misc_feature (1)..( 10): Result.001 file - promoters75/1975923
gataaaatta

SEQ ID NO: 78023 - DNA, 10 bp, Unknown
  misc_feature (1)..( 10): Result.001 file - promoters75/1975923
gatataatct

SEQ ID NO: 78024 - DNA, 8 bp, Unknown
  misc_feature (1)..( 8): Result.001 file - promoters75/1975923
atataaag

SEQ ID NO: 78025 - DNA, 8 bp, Unknown
  misc_feature (1)..( 8): Result.001 file - promoters75/1975923
atataaag

SEQ ID NO: 78026 - DNA, 8 bp, Unknown
  misc_feature (1)..( 8): Result.001 file - promoters75/1975923
ctataaat

SEQ ID NO: 78027 - DNA, 10 bp, Unknown
  misc_feature (1)..( 10): Result.001 file - promoters75/1975923
taaatataaa

SEQ ID NO: 78028 - DNA, 10 bp, Unknown
  misc_feature (1)..( 10): Result.001 file - promoters75/1975923
taaaaataat

SEQ ID NO: 78029 - DNA, 10 bp, Unknown
  misc_feature (1)..( 10): Result.001 file - promoters75/1976019
acataataat

SEQ ID NO: 78030 - DNA, 10 bp, Unknown
  misc_feature (1)..( 10): Result.001 file - promoters75/1976019
gagtttaggt

SEQ ID NO: 78031 - DNA, 10 bp, Unknown
  misc_feature (1)..( 10): Result.001 file - promoters75/1976019
aatttttggt

SEQ ID NO: 78032 - DNA, 10 bp, Unknown
  misc_feature (1)..( 10): Result.001 file - promoters75/1976019
ttgttttgtc

SEQ ID NO: 78033 - DNA, 8 bp, Unknown
  misc_feature (1)..( 8): Result.001 file - promoters75/1976019
aatagtta

SEQ ID NO: 78034 - DNA, 8 bp, Unknown
  misc_feature (1)..( 8): Result.001 file - promoters75/1976019
aattgttt

SEQ ID NO: 78035 - DNA, 9 bp, Unknown
  misc_feature (1)..( 9): Result.001 file - promoters75/1976078
ttttggttt

SEQ ID NO: 78036 - DNA, 10 bp, Unknown
  misc_feature (1)..( 10): Result.001 file - promoters75/1976078
ctagatacaa

SEQ ID NO: 78037 - DNA, 10 bp, Unknown
  misc_feature (1)..( 10): Result.001 file - promoters75/1976078
acagagacat

SEQ ID NO: 78038 - DNA, 10 bp, Unknown
  misc_feature (1)..( 10): Result.001 file - promoters75/1976078
ctagatacag

SEQ ID NO: 78039 - DNA, 10 bp, Unknown
  misc_feature (1)..( 10): Result.001 file - promoters75/1976078
tccgatccag

SEQ ID NO: 78040 - DNA, 13 bp, Unknown
  misc_feature (1)..( 13): Result.001 file - promoters75/1976078
aaatcgaaacaga

SEQ ID NO: 78041 - DNA, 13 bp, Unknown
  misc_feature (1)..( 13): Result.001 file - promoters75/1976078
aaatccaaaccca

SEQ ID NO: 78042 - DNA, 13 bp, Unknown
  misc_feature (1)..( 13): Result.001 file - promoters75/1976078
aaagtcaaacctg

SEQ ID NO: 78043 - DNA, 13 bp, Unknown
  misc_feature (1)..( 13): Result.001 file - promoters75/1976078
attgagaaagctg

SEQ ID NO: 78044 - DNA, 8 bp, Unknown
  misc_feature (1)..( 8): Result.001 file - promoters75/1976078
actttttt

SEQ ID NO: 78045 - DNA, 8 bp, Unknown
  misc_feature (1)..( 8): Result.001 file - promoters75/1976078
actattta

SEQ ID NO: 78046 - DNA, 9 bp, Unknown
  misc_feature (1)..( 9): Result.001 file - promoters75/1976078
gttttgttg

SEQ ID NO: 78047 - DNA, 9 bp, Unknown
  misc_feature (1)..( 9): Result.001 file - promoters75/1976078
attgatttg

SEQ ID NO: 78048 - DNA, 9 bp, Unknown
  misc_feature (1)..( 9): Result.001 file - promoters75/1976078
catgaattg

SEQ ID NO: 78049 - DNA, 9 bp, Unknown
  misc_feature (1)..( 9): Result.001 file - promoters75/1976078
attgattca

SEQ ID NO: 78050 - DNA, 9 bp, Unknown
  misc_feature (1)..( 9): Result.001 file - promoters75/1976078
tttaaagct

SEQ ID NO: 78051 - DNA, 9 bp, Unknown
  misc_feature (1)..( 9): Result.001 file - promoters75/1976078
tttcaagtt

SEQ ID NO: 78052 - DNA, 9 bp, Unknown
  misc_feature (1)..( 9): Result.001 file - promoters75/1976236
tctcacgtt

SEQ ID NO: 78053 - DNA, 8 bp, Unknown
  misc_feature (1)..( 8): Result.001 file - promoters75/1976236
ttcaaaaa

SEQ ID NO: 78054 - DNA, 8 bp, Unknown
  misc_feature (1)..( 8): Result.001 file - promoters75/1976236
ttcaaaat

SEQ ID NO: 78055 - DNA, 9 bp, Unknown
  misc_feature (1)..( 9): Result.001 file - promoters75/1976236
ttctaaaat

SEQ ID NO: 78056 - DNA, 7 bp, Unknown
  misc_feature (1)..( 7): Result.001 file - promoters75/1976236
ttttgaa

SEQ ID NO: 78057 - DNA, 7 bp, Unknown
  misc_feature (1)..( 7): Result.001 file - promoters75/1976236
ttttgac

SEQ ID NO: 78058 - DNA, 7 bp, Unknown
  misc_feature (1)..( 7): Result.001 file - promoters75/1976236
ctttgac

SEQ ID NO: 78059 - DNA, 8 bp, Unknown
  misc_feature (1)..( 8): Result.001 file - promoters75/1976236
caaaccca

SEQ ID NO: 78060 - DNA, 8 bp, Unknown
  misc_feature (1)..( 8): Result.001 file - promoters75/1976236
caaacctg

SEQ ID NO: 78061 - DNA, 8 bp, Unknown
  misc_feature (1)..( 8): Result.001 file - promoters75/1976236
gaaagctg

SEQ ID NO: 78062 - DNA, 8 bp, Unknown
  misc_feature (1)..( 8): Result.001 file - promoters75/1976236
agagacat

SEQ ID NO: 78063 - DNA, 8 bp, Unknown
  misc_feature (1)..( 8): Result.001 file - promoters75/1976236
agatacag

SEQ ID NO: 78064 - DNA, 8 bp, Unknown
  misc_feature (1)..( 8): Result.001 file - promoters75/1976236
cgatccag

SEQ ID NO: 78065 - DNA, 9 bp, Unknown
  misc_feature (1)..( 9): Result.001 file - promoters75/1976236
tttaaagct

SEQ ID NO: 78066 - DNA, 9 bp, Unknown
  misc_feature (1)..( 9): Result.001 file - promoters75/1976236
tttcaagtt

SEQ ID NO: 78067 - DNA, 9 bp, Unknown
  misc_feature (1)..( 9): Result.001 file - promoters75/1976354
tctcacgtt

SEQ ID NO: 78068 - DNA, 9 bp, Unknown
  misc_feature (1)..( 9): Result.001 file - promoters75/1976354
aatataaat

SEQ ID NO: 78069 - DNA, 9 bp, Unknown
  misc_feature (1)..( 9): Result.001 file - promoters75/1976354
gatacaaaa

SEQ ID NO: 78070 - DNA, 9 bp, Unknown
  misc_feature (1)..( 9): Result.001 file - promoters75/1976354
aataaaaat

SEQ ID NO: 78071 - DNA, 9 bp, Unknown
  misc_feature (1)..( 9): Result.001 file - promoters75/1976354
aataaacta

SEQ ID NO: 78072 - DNA, 11 bp, Unknown
  misc_feature (1)..( 11): Result.001 file - promoters75/1976354
tatatgttaat

SEQ ID NO: 78073 - DNA, 11 bp, Unknown
  misc_feature (1)..( 11): Result.001 file - promoters75/1976354
gatatgataat

SEQ ID NO: 78074 - DNA, 11 bp, Unknown
  misc_feature (1)..( 11): Result.001 file - promoters75/1976354
aatatgtgcaa

SEQ ID NO: 78075 - DNA, 11 bp, Unknown
  misc_feature (1)..( 11): Result.001 file - promoters75/1976354
aatatttgtaa

SEQ ID NO: 78076 - DNA, 9 bp, Unknown
  misc_feature (1)..( 9): Result.001 file - promoters75/1976354
atagttatc

SEQ ID NO: 78077 - DNA, 9 bp, Unknown
  misc_feature (1)..( 9): Result.001 file - promoters75/1976354
atagttaaa

SEQ ID NO: 78078 - DNA, 9 bp, Unknown
  misc_feature (1)..( 9): Result.001 file - promoters75/1976354
tcagttatc

SEQ ID NO: 78079 - DNA, 9 bp, Unknown
  misc_feature (1)..( 9): Result.001 file - promoters75/1976354
acagtgatc

SEQ ID NO: 78080 - DNA, 11 bp, Unknown
  misc_feature (1)..( 11): Result.001 file - promoters75/1976354
atcattttgag

SEQ ID NO: 78081 - DNA, 11 bp, Unknown
  misc_feature (1)..( 11): Result.001 file - promoters75/1976354
ttcagtttggg

SEQ ID NO: 78082 - DNA, 11 bp, Unknown
  misc_feature (1)..( 11): Result.001 file - promoters75/1976354
ataatttcgag

SEQ ID NO: 78083 - DNA, 11 bp, Unknown
  misc_feature (1)..( 11): Result.001 file - promoters75/2104991
ttcagtctaga

SEQ ID NO: 78084 - DNA, 8 bp, Unknown
  misc_feature (1)..( 8): Result.001 file - promoters75/2104991
tcatttca

SEQ ID NO: 78085 - DNA, 8 bp, Unknown
  misc_feature (1)..( 8): Result.001 file - promoters75/2104991
aaatttca

SEQ ID NO: 78086 - DNA, 8 bp, Unknown
  misc_feature (1)..( 8): Result.001 file - promoters75/2104991
aaatttcc

SEQ ID NO: 78087 - DNA, 8 bp, Unknown
  misc_feature (1)..( 8): Result.001 file - promoters75/2104991
taaatctc

SEQ ID NO: 78088 - DNA, 8 bp, Unknown
  misc_feature (1)..( 8): Result.001 file - promoters75/2104991
taaatcag

SEQ ID NO: 78089 - DNA, 8 bp, Unknown
  misc_feature (1)..( 8): Result.001 file - promoters75/2104991
caaaacag

SEQ ID NO: 78090 - DNA, 14 bp, Unknown
  misc_feature (1)..( 14): Result.001 file - promoters75/2104991
aaaaagcttggatt

SEQ ID NO: 78091 - DNA, 14 bp, Unknown
  misc_feature (1)..( 14): Result.001 file - promoters75/2104991
taaaagtttgatat

SEQ ID NO: 78092 - DNA, 14 bp, Unknown
  misc_feature (1)..( 14): Result.001 file - promoters75/2104991
taaaagtttgttat

SEQ ID NO: 78093 - DNA, 14 bp, Unknown
  misc_feature (1)..( 14): Result.001 file - promoters75/2104991
ttggattttgattt

SEQ ID NO: 78094 - DNA, 14 bp, Unknown
  misc_feature (1)..( 14): Result.001 file - promoters75/2104991
taaaagtttgatat

SEQ ID NO: 78095 - DNA, 14 bp, Unknown
  misc_feature (1)..( 14): Result.001 file - promoters75/2105514
taaaagtttgttat

SEQ ID NO: 78096 - DNA, 11 bp, Unknown
  misc_feature (1)..( 11): Result.001 file - promoters75/2105514
actattaaagc

SEQ ID NO: 78097 - DNA, 11 bp, Unknown
  misc_feature (1)..( 11): Result.001 file - promoters75/2105514
tatataaaagc

SEQ ID NO: 78098 - DNA, 11 bp, Unknown
  misc_feature (1)..( 11): Result.001 file - promoters75/2105514
tatataaatcc

SEQ ID NO: 78099 - DNA, 11 bp, Unknown
  misc_feature (1)..( 11): Result.001 file - promoters75/2106017
actataaaggc

SEQ ID NO: 78100 - DNA, 9 bp, Unknown
  misc_feature (1)..( 9): Result.001 file - promoters75/2106017
gattaaaaa

SEQ ID NO: 78101 - DNA, 9 bp, Unknown
  misc_feature (1)..( 9): Result.001 file - promoters75/2106017
aaataaaaa

SEQ ID NO: 78102 - DNA, 10 bp, Unknown
  misc_feature (1)..( 10): Result.001 file - promoters75/2106017
aaataataaa

SEQ ID NO: 78103 - DNA, 10 bp, Unknown
  misc_feature (1)..( 10): Result.001 file - promoters75/2106017
ctttaaaaat

SEQ ID NO: 78104 - DNA, 9 bp, Unknown
  misc_feature (1)..( 9): Result.001 file - promoters75/2106017
acataaaca

SEQ ID NO: 78105 - DNA, 9 bp, Unknown
  misc_feature (1)..( 9): Result.001 file - promoters75/2106017
gcattaaca

SEQ ID NO: 78106 - DNA, 9 bp, Unknown
  misc_feature (1)..( 9): Result.001 file - promoters75/2106017
gcagtaacg

SEQ ID NO: 78107 - DNA, 9 bp, Unknown
  misc_feature (1)..( 9): Result.001 file - promoters75/2106017
tcagtaaaa

SEQ ID NO: 78108 - DNA, 12 bp, Unknown
  misc_feature (1)..( 12): Result.001 file - promoters75/2106017
gttttaaagttt

SEQ ID NO: 78109 - DNA, 12 bp, Unknown
  misc_feature (1)..( 12): Result.001 file - promoters75/2106017
gttttagatctg

SEQ ID NO: 78110 - DNA, 12 bp, Unknown
  misc_feature (1)..( 12): Result.001 file - promoters75/2106017
gtttgaaatttt

SEQ ID NO: 78111 - DNA, 12 bp, Unknown
  misc_feature (1)..( 12): Result.001 file - promoters75/2107065
gcttgaaatcag

SEQ ID NO: 78112 - DNA, 9 bp, Unknown
  misc_feature (1)..( 9): Result.001 file - promoters75/2107065
tgaagaaaa

SEQ ID NO: 78113 - DNA, 9 bp, Unknown
  misc_feature (1)..( 9): Result.001 file - promoters75/2107065
tgaataaaa

SEQ ID NO: 78114 - DNA, 9 bp, Unknown
  misc_feature (1)..( 9): Result.001 file - promoters75/2113502
ataagaaat

SEQ ID NO: 78115 - DNA, 12 bp, Unknown
  misc_feature (1)..( 12): Result.001 file - promoters75/2113502
acgttaaaaata

SEQ ID NO: 78116 - DNA, 12 bp, Unknown
  misc_feature (1)..( 12): Result.001 file - promoters75/2113502
atttcaaaaata

SEQ ID NO: 78117 - DNA, 12 bp, Unknown
  misc_feature (1)..( 12): Result.001 file - promoters75/2113502
gatgtaaaaatt

SEQ ID NO: 78118 - DNA, 12 bp, Unknown
  misc_feature (1)..( 12): Result.001 file - promoters75/2113502
acattaaaaatg

SEQ ID NO: 78119 - DNA, 12 bp, Unknown
  misc_feature (1)..( 12): Result.001 file - promoters75/2113502
tctcaaaacatt

SEQ ID NO: 78120 - DNA, 12 bp, Unknown
  misc_feature (1)..( 12): Result.001 file - promoters75/2113502
acaataaaagtt

SEQ ID NO: 78121 - DNA, 16 bp, Unknown
  misc_feature (1)..( 16): Result.001 file - promoters75/2113502
tttccactataaaact

SEQ ID NO: 78122 - DNA, 16 bp, Unknown
  misc_feature (1)..( 16): Result.001 file - promoters75/2113502
gcattactattaaagc

SEQ ID NO: 78123 - DNA, 16 bp, Unknown
  misc_feature (1)..( 16): Result.001 file - promoters75/2113502
gccgttatataaatcc

SEQ ID NO: 78124 - DNA, 16 bp, Unknown
  misc_feature (1)..( 16): Result.001 file - promoters75/2113502
tttgcactataaacaa

SEQ ID NO: 78125 - DNA, 16 bp, Unknown
  misc_feature (1)..( 16): Result.001 file - promoters75/2113502
ctctaactataaatac

SEQ ID NO: 78126 - DNA, 16 bp, Unknown
  misc_feature (1)..( 16): Result.001 file - promoters75/2113502
gcttatttatgaatcc

SEQ ID NO: 78127 - DNA, 15 bp, Unknown
  misc_feature (1)..( 15): Result.001 file - promoters75/2113502
caaaagaatcagtga

SEQ ID NO: 78128 - DNA, 15 bp, Unknown
  misc_feature (1)..( 15): Result.001 file - promoters75/2113502
caaaacaattcaaga

SEQ ID NO: 78129 - DNA, 15 bp, Unknown
  misc_feature (1)..( 15): Result.001 file - promoters75/2113502
tggaagaaacagtga

SEQ ID NO: 78130 - DNA, 15 bp, Unknown
  misc_feature (1)..( 15): Result.001 file - promoters75/2113502
agaacgaaatatctt

SEQ ID NO: 78131 - DNA, 15 bp, Unknown
  misc_feature (1)..( 15): Result.001 file - promoters75/2113502
aaaaagtttttgtaa

SEQ ID NO: 78132 - DNA, 15 bp, Unknown
  misc_feature (1)..( 15): Result.001 file - promoters75/2113846
ccaacgaaacgatta

SEQ ID NO: 78133 - DNA, 8 bp, Unknown
  misc_feature (1)..( 8): Result.001 file - promoters75/2113846
tataattt

SEQ ID NO: 78134 - DNA, 8 bp, Unknown
  misc_feature (1)..( 8): Result.001 file - promoters75/2113846
tatcattt

SEQ ID NO: 78135 - DNA, 8 bp, Unknown
  misc_feature (1)..( 8): Result.001 file - promoters75/2113846
tatgatta

SEQ ID NO: 78136 - DNA, 9 bp, Unknown
  misc_feature (1)..( 9): Result.001 file - promoters75/2113846
aatttaacg

SEQ ID NO: 78137 - DNA, 9 bp, Unknown
  misc_feature (1)..( 9): Result.001 file - promoters75/2113846
tttttgacg

SEQ ID NO: 78138 - DNA, 9 bp, Unknown
  misc_feature (1)..( 9): Result.001 file - promoters75/2113889
aatttaatg

SEQ ID NO: 78139 - DNA, 8 bp, Unknown
  misc_feature (1)..( 8): Result.001 file - promoters75/2113889
gttaactt

SEQ ID NO: 78140 - DNA, 8 bp, Unknown
  misc_feature (1)..( 8): Result.001 file - promoters75/2113889
gttgactg

SEQ ID NO: 78141 - DNA, 8 bp, Unknown
  misc_feature (1)..( 8): Result.001 file - promoters75/2114200
catgactg

SEQ ID NO: 78142 - DNA, 7 bp, Unknown
  misc_feature (1)..( 7): Result.001 file - promoters75/2114200
aattctt

SEQ ID NO: 78143 - DNA, 7 bp, Unknown
  misc_feature (1)..( 7): Result.001 file - promoters75/2114200
aatcctt

SEQ ID NO: 78144 - DNA, 7 bp, Unknown
  misc_feature (1)..( 7): Result.001 file - promoters75/2114200
catcctt

SEQ ID NO: 78145 - DNA, 8 bp, Unknown
  misc_feature (1)..( 8): Result.001 file - promoters75/2114200
gaatgaaa

SEQ ID NO: 78146 - DNA, 8 bp, Unknown
  misc_feature (1)..( 8): Result.001 file - promoters75/2114200
gaataaaa

SEQ ID NO: 78147 - DNA, 8 bp, Unknown
  misc_feature (1)..( 8): Result.001 file - promoters75/2187156
ggataaaa

SEQ ID NO: 78148 - DNA, 11 bp, Unknown
  misc_feature (1)..( 11): Result.001 file - promoters75/2187156
ccagaattaag

SEQ ID NO: 78149 - DNA, 11 bp, Unknown
  misc_feature (1)..( 11): Result.001 file - promoters75/2187156
ccataattagt

SEQ ID NO: 78150 - DNA, 11 bp, Unknown
  misc_feature (1)..( 11): Result.001 file - promoters75/2217732
atgtaattaag

SEQ ID NO: 78151 - DNA, 8 bp, Unknown
  misc_feature (1)..( 8): Result.001 file - promoters75/2217732
aaaaaaaa

SEQ ID NO: 78152 - DNA, 8 bp, Unknown
  misc_feature (1)..( 8): Result.001 file - promoters75/2217732
gaaagaaa

SEQ ID NO: 78153 - DNA, 8 bp, Unknown
  misc_feature (1)..( 8): Result.001 file - promoters75/2217732
gaaagatg

SEQ ID NO: 78154 - DNA, 8 bp, Unknown
  misc_feature (1)..( 8): Result.001 file - promoters75/2217817
gaaagaga

SEQ ID NO: 78155 - DNA, 7 bp, Unknown
  misc_feature (1)..( 7): Result.001 file - promoters75/2217817
gtagatt

SEQ ID NO: 78156 - DNA, 7 bp, Unknown
  misc_feature (1)..( 7): Result.001 file - promoters75/2217817
atagatt

SEQ ID NO: 78157 - DNA, 7 bp, Unknown
  misc_feature (1)..( 7): Result.001 file - promoters75/2218207
ataaatt

SEQ ID NO: 78158 - DNA, 9 bp, Unknown
  misc_feature (1)..( 9): Result.001 file - promoters75/2218207
gcagaaaaa

SEQ ID NO: 78159 - DNA, 9 bp, Unknown
  misc_feature (1)..( 9): Result.001 file - promoters75/2218207
gcagaaaat

SEQ ID NO: 78160 - DNA, 9 bp, Unknown
  misc_feature (1)..( 9): Result.001 file - promoters75/2218207
agagaaaaa

SEQ ID NO: 78161 - DNA, 9 bp, Unknown
  misc_feature (1)..( 9): Result.001 file - promoters75/2218207
gcacaaagt

SEQ ID NO: 78162 - DNA, 10 bp, Unknown
  misc_feature (1)..( 10): Result.001 file - promoters75/2218207
aataaaaagc

SEQ ID NO: 78163 - DNA, 10 bp, Unknown
  misc_feature (1)..( 10): Result.001 file - promoters75/2218207
aatataaagg

SEQ ID NO: 78164 - DNA, 10 bp, Unknown
  misc_feature (1)..( 10): Result.001 file - promoters75/2218207
actataaata

SEQ ID NO: 78165 - DNA, 10 bp, Unknown
  misc_feature (1)..( 10): Result.001 file - promoters75/2218271
actataaagg

SEQ ID NO: 78166 - DNA, 11 bp, Unknown
  misc_feature (1)..( 11): Result.001 file - promoters75/2218271
agaaaaactgg

SEQ ID NO: 78167 - DNA, 11 bp, Unknown
  misc_feature (1)..( 11): Result.001 file - promoters75/2218271
ataaaaattgg

SEQ ID NO: 78168 - DNA, 11 bp, Unknown
  misc_feature (1)..( 11): Result.001 file - promoters75/2218271
agaaaaaaaag

SEQ ID NO: 78169 - DNA, 11 bp, Unknown
  misc_feature (1)..( 11): Result.001 file - promoters75/2218271
gtcaaacctga

SEQ ID NO: 78170 - DNA, 11 bp, Unknown
  misc_feature (1)..( 11): Result.001 file - promoters75/2724699
tccaaacccaa

SEQ ID NO: 78171 - DNA, 7 bp, Unknown
  misc_feature (1)..( 7): Result.001 file - promoters75/2724699
aattatc

SEQ ID NO: 78172 - DNA, 7 bp, Unknown
  misc_feature (1)..( 7): Result.001 file - promoters75/2724699
cattatc

SEQ ID NO: 78173 - DNA, 7 bp, Unknown
  misc_feature (1)..( 7): Result.001 file - promoters75/2724699
cattata

SEQ ID NO: 78174 - DNA, 9 bp, Unknown
  misc_feature (1)..( 9): Result.001 file - promoters75/2724699
aaaagttta

SEQ ID NO: 78175 - DNA, 9 bp, Unknown
  misc_feature (1)..( 9): Result.001 file - promoters75/2724699
aaatgtttt

SEQ ID NO: 78176 - DNA, 9 bp, Unknown
  misc_feature (1)..( 9): Result.001 file - promoters75/2781251
caatatttt

SEQ ID NO: 78177 - DNA, 8 bp, Unknown
  misc_feature (1)..( 8): Result.001 file - promoters75/2781251
ctcttcgc

SEQ ID NO: 78178 - DNA, 8 bp, Unknown
  misc_feature (1)..( 8): Result.001 file - promoters75/2781251
ttctccgc

SEQ ID NO: 78179 - DNA, 8 bp, Unknown
  misc_feature (1)..( 8): Result.001 file - promoters75/2781251
ttctccca

SEQ ID NO: 78180 - DNA, 9 bp, Unknown
  misc_feature (1)..( 9): Result.001 file - promoters75/2781251
aaaacatat

SEQ ID NO: 78181 - DNA, 9 bp, Unknown
  misc_feature (1)..( 9): Result.001 file - promoters75/2781251
taaacatat

SEQ ID NO: 78182 - DNA, 9 bp, Unknown
  misc_feature (1)..( 9): Result.001 file - promoters75/2781341
aaaaaatat

SEQ ID NO: 78183 - DNA, 9 bp, Unknown
  misc_feature (1)..( 9): Result.001 file - promoters75/2781341
aaatcgtta

SEQ ID NO: 78184 - DNA, 9 bp, Unknown
  misc_feature (1)..( 9): Result.001 file - promoters75/2781341
aaatcgaaa

SEQ ID NO: 78185 - DNA, 9 bp, Unknown
  misc_feature (1)..( 9): Result.001 file - promoters75/2781341
gaatcatta

SEQ ID NO: 78186 - DNA, 9 bp, Unknown
  misc_feature (1)..( 9): Result.001 file - promoters75/2781341
aaaccgtat

SEQ ID NO: 78187 - DNA, 9 bp, Unknown
  misc_feature (1)..( 9): Result.001 file - promoters75/2781341
ccatcctta

SEQ ID NO: 78188 - DNA, 9 bp, Unknown
  misc_feature (1)..( 9): Result.001 file - promoters75/2781341
caatcataa

SEQ ID NO: 78189 - DNA, 10 bp, Unknown
  misc_feature (1)..( 10): Result.001 file - promoters75/2781341
aaaactaaaa

SEQ ID NO: 78190 - DNA, 10 bp, Unknown
  misc_feature (1)..( 10): Result.001 file - promoters75/2781341
caaaccaaac

SEQ ID NO: 78191 - DNA, 10 bp, Unknown
  misc_feature (1)..( 10): Result.001 file - promoters75/2781341
gtaactaaaa

SEQ ID NO: 78192 - DNA, 10 bp, Unknown
  misc_feature (1)..( 10): Result.001 file - promoters75/2781341
caaatcaaat

SEQ ID NO: 78193 - DNA, 10 bp, Unknown
  misc_feature (1)..( 10): Result.001 file - promoters75/2781341
aaaaccaaag

SEQ ID NO: 78194 - DNA, 10 bp, Unknown
  misc_feature (1)..( 10): Result.001 file - promoters75/2990611
gaaaacaatg

SEQ ID NO: 78195 - DNA, 7 bp, Unknown
  misc_feature (1)..( 7): Result.001 file - promoters75/2990611
attgttt

SEQ ID NO: 78196 - DNA, 7 bp, Unknown
  misc_feature (1)..( 7): Result.001 file - promoters75/2990611
tttgttt

SEQ ID NO: 78197 - DNA, 7 bp, Unknown
  misc_feature (1)..( 7): Result.001 file - promoters75/2991239
tttattt

SEQ ID NO: 78198 - DNA, 10 bp, Unknown
  misc_feature (1)..( 10): Result.001 file - promoters75/2991239
attatatatg

SEQ ID NO: 78199 - DNA, 10 bp, Unknown
  misc_feature (1)..( 10): Result.001 file - promoters75/2991239
tcaataaatg

SEQ ID NO: 78200 - DNA, 10 bp, Unknown
  misc_feature (1)..( 10): Result.001 file - promoters75/2991239
tcattaaaaa

SEQ ID NO: 78201 - DNA, 10 bp, Unknown
  misc_feature (1)..( 10): Result.001 file - promoters75/2991239
ttaaaaaaaa

SEQ ID NO: 78202 - DNA, 10 bp, Unknown
  misc_feature (1)..( 10): Result.001 file - promoters75/2991239
acaaaaaaaa

SEQ ID NO: 78203 - DNA, 10 bp, Unknown
  misc_feature (1)..( 10): Result.001 file - promoters75/2991239
ttaaaaaagg

SEQ ID NO: 78204 - DNA, 34 bp, Unknown; identical to SEQ ID NO: 76977
  misc_feature (1)..( 34): Result.001 file - promoters75/2991239

SEQ ID NO: 78205 - DNA, 34 bp, Unknown; identical to SEQ ID NO: 76978
  misc_feature (1)..( 34): Result.001 file - promoters75/2991239

SEQ ID NO: 78206 - DNA, 34 bp, Unknown; identical to SEQ ID NO: 76979
  misc_feature (1)..( 34): Result.001 file - promoters75/2991239

SEQ ID NO: 78207 - DNA, 34 bp, Unknown; identical to SEQ ID NO: 76977
  misc_feature (1)..( 34): Result.001 file - promoters75/2991239

SEQ ID NO: 78208 - DNA, 34 bp, Unknown; identical to SEQ ID NO: 76981
  misc_feature (1)..( 34): Result.001 file - promoters75/2991239

SEQ ID NO: 78209 - DNA, 34 bp, Unknown; identical to SEQ ID NO: 76979
  misc_feature (1)..( 34): Result.001 file - promoters75/2991239

SEQ ID NO: 78210 - DNA, 15 bp, Unknown
  misc_feature (1)..( 15): Result.001 file - promoters75/2991239
attgaagacttttca

SEQ ID NO: 78211 - DNA, 15 bp, Unknown
  misc_feature (1)..( 15): Result.001 file - promoters75/2991239
attgaagacttttca

SEQ ID NO: 78212 - DNA, 15 bp, Unknown
  misc_feature (1)..( 15): Result.001 file - promoters75/2991239
gtagaagaccatata

SEQ ID NO: 78213 - DNA, 13 bp, Unknown
  misc_feature (1)..( 13): Result.001 file - promoters75/2991239
ctataagctttaa

SEQ ID NO: 78214 - DNA, 13 bp, Unknown
  misc_feature (1)..( 13): Result.001 file - promoters75/2991239
ctataagctttta

SEQ ID NO: 78215 - DNA, 14 bp, Unknown
  misc_feature (1)..( 14): Result.001 file - promoters75/2991239
aagacagcatttaa

SEQ ID NO: 78216 - DNA, 29 bp, Unknown
  misc_feature (1)..( 29): Result.001 file - promoters75/2991239
aagctttaagtctatcgctagactgtcca

SEQ ID NO: 78217 - DNA, 29 bp, Unknown
  misc_feature (1)..( 29): Result.001 file - promoters75/2991239
agcttttaagtctctcgctagactgtcca

SEQ ID NO: 78218 - DNA, 29 bp, Unknown
  misc_feature (1)..( 29): Result.001 file - promoters75/2991281
agcatttaatgatgataacgatttggaag

SEQ ID NO: 78219 - DNA, 8 bp, Unknown
  misc_feature (1)..( 8): Result.001 file - promoters75/2991281
ttttgaat

SEQ ID NO: 78220 - DNA, 8 bp, Unknown
  misc_feature (1)..( 8): Result.001 file - promoters75/2991281
atttgaat

SEQ ID NO: 78221 - DNA, 8 bp, Unknown
  misc_feature (1)..( 8): Result.001 file - promoters75/2991281
ttttgaca

SEQ ID NO: 78222 - DNA, 11 bp, Unknown
  misc_feature (1)..( 11): Result.001 file - promoters75/2991281
aaactgtgaaa

SEQ ID NO: 78223 - DNA, 11 bp, Unknown
  misc_feature (1)..( 11): Result.001 file - promoters75/2991281
aaaatgtgaaa

SEQ ID NO: 78224 - DNA, 11 bp, Unknown
  misc_feature (1)..( 11): Result.001 file - promoters75/2991281
gctttgtgaaa

SEQ ID NO: 78225 - DNA, 8 bp, Unknown
  misc_feature (1)..( 8): Result.001 file - promoters75/2991281
aacccaaa

SEQ ID NO: 78226 - DNA, 8 bp, Unknown
  misc_feature (1)..( 8): Result.001 file - promoters75/2991281
agcccaaa

SEQ ID NO: 78227 - DNA, 8 bp, Unknown
  misc_feature (1)..( 8): Result.001 file - promoters75/2991281
agcccaat

SEQ ID NO: 78228 - DNA, 8 bp, Unknown
  misc_feature (1)..( 8): Result.001 file - promoters75/2991281
cttttaga

SEQ ID NO: 78229 - DNA, 8 bp, Unknown
  misc_feature (1)..( 8): Result.001 file - promoters75/2991281
tgtttaga

SEQ ID NO: 78230 - DNA, 8 bp, Unknown
  misc_feature (1)..( 8): Result.001 file - promoters75/2991300
tgttgaga

SEQ ID NO: 78231 - DNA, 10 bp, Unknown
  misc_feature (1)..( 10): Result.001 file - promoters75/2991300
ttatattatt

SEQ ID NO: 78232 - DNA, 10 bp, Unknown
  misc_feature (1)..( 10): Result.001 file - promoters75/2991300
tgatactatt

SEQ ID NO: 78233 - DNA, 10 bp, Unknown
  misc_feature (1)..( 10): Result.001 file - promoters75/2991300
ttagattagc

SEQ ID NO: 78234 - DNA, 10 bp, Unknown
  misc_feature (1)..( 10): Result.001 file - promoters75/2991300
attaatatat

SEQ ID NO: 78235 - DNA, 10 bp, Unknown
  misc_feature (1)..( 10): Result.001 file - promoters75/2991300
attgatactt

SEQ ID NO: 78236 - DNA, 10 bp, Unknown
  misc_feature (1)..( 10): Result.001 file - promoters75/2991300
tctaatatat

SEQ ID NO: 78237 - DNA, 11 bp, Unknown
  misc_feature (1)..( 11): Result.001 file - promoters75/2991300
taagtatgtat

SEQ ID NO: 78238 - DNA, 11 bp, Unknown
  misc_feature (1)..( 11): Result.001 file - promoters75/2991300
taattatatat

SEQ ID NO: 78239 - DNA, 11 bp, Unknown
  misc_feature (1)..( 11): Result.001 file - promoters75/2991489
ctaatatatag

SEQ ID NO: 78240 - DNA, 15 bp, Unknown
  misc_feature (1)..( 15): Result.001 file - promoters75/2991489
tttttgtgcaaccaa

SEQ ID NO: 78241 - DNA, 15 bp, Unknown
  misc_feature (1)..( 15): Result.001 file - promoters75/2991489
tttttgtaataataa

SEQ ID NO: 78242 - DNA, 15 bp, Unknown
  misc_feature (1)..( 15): Result.001 file - promoters75/2991489
tttctgttcaacaca

SEQ ID NO: 78243 - DNA, 15 bp, Unknown
  misc_feature (1)..( 15): Result.001 file - promoters75/2991489
attttgtttttgatg

SEQ ID NO: 78244 - DNA, 15 bp, Unknown
  misc_feature (1)..( 15): Result.001 file - promoters75/2991489
catttgtacaaaaca

SEQ ID NO: 78245 - DNA, 15 bp, Unknown
  misc_feature (1)..( 15): Result.001 file - promoters75/2991489
tattgttacaaatct

SEQ ID NO: 78246 - DNA, 12 bp, Unknown
  misc_feature (1)..( 12): Result.001 file - promoters75/2991489
taattttatata

SEQ ID NO: 78247 - DNA, 12 bp, Unknown
  misc_feature (1)..( 12): Result.001 file - promoters75/2991489
aaattttttata

SEQ ID NO: 78248 - DNA, 12 bp, Unknown
  misc_feature (1)..( 12): Result.001 file - promoters75/2991489
cctttttgtatc

SEQ ID NO: 78249 - DNA, 12 bp, Unknown
  misc_feature (1)..( 12): Result.001 file - promoters75/2991489
taagtttaagtt

SEQ ID NO: 78250 - DNA, 12 bp, Unknown
  misc_feature (1)..( 12): Result.001 file - promoters75/2991489
aaactttcatct

SEQ ID NO: 78251 - DNA, 12 bp, Unknown
  misc_feature (1)..( 12): Result.001 file - promoters75/2992722
aaacttaaaagt

SEQ ID NO: 78252 - DNA, 7 bp, Unknown
  misc_feature (1)..( 7): Result.001 file - promoters75/2992722
aatttac

SEQ ID NO: 78253 - DNA, 7 bp, Unknown
  misc_feature (1)..( 7): Result.001 file - promoters75/2992722
aatctac

SEQ ID NO: 78254 - DNA, 7 bp, Unknown
  misc_feature (1)..( 7): Result.001 file - promoters75/2992722
aatttat

SEQ ID NO: 78255 - DNA, 11 bp, Unknown
  misc_feature (1)..( 11): Result.001 file - promoters75/2992722
aaaatagtaaa

SEQ ID NO: 78256 - DNA, 11 bp, Unknown
  misc_feature (1)..( 11): Result.001 file - promoters75/2992722
ataattgtata

SEQ ID NO: 78257 - DNA, 11 bp, Unknown
  misc_feature (1)..( 11): Result.001 file - promoters75/2992722
atatttgtata

SEQ ID NO: 78258 - DNA, 10 bp, Unknown
  misc_feature (1)..( 10): Result.001 file - promoters75/2992722
gaaaaagata

SEQ ID NO: 78259 - DNA, 10 bp, Unknown
  misc_feature (1)..( 10): Result.001 file - promoters75/2992722
gaaatagatt

SEQ ID NO: 78260 - DNA, 10 bp, Unknown
  misc_feature (1)..( 10): Result.001 file - promoters75/2992722
ttagtagatt

SEQ ID NO: 78261 - DNA, 10 bp, Unknown
  misc_feature (1)..( 10): Result.001 file - promoters75/2992722
tatataaatt

SEQ ID NO: 78262 - DNA, 8 bp, Unknown
  misc_feature (1)..( 8): Result.001 file - promoters75/2992722
aaggtata

SEQ ID NO: 78263 - DNA, 8 bp, Unknown
  misc_feature (1)..( 8): Result.001 file - promoters75/2992722
aagctata

SEQ ID NO: 78264 - DNA, 8 bp, Unknown
  misc_feature (1)..( 8): Result.001 file - promoters75/2992722
cagcaata

SEQ ID NO: 78265 - DNA, 9 bp, Unknown
  misc_feature (1)..( 9): Result.001 file - promoters75/2992722
ttactaaaa

SEQ ID NO: 78266 - DNA, 9 bp, Unknown
  misc_feature (1)..( 9): Result.001 file - promoters75/2992722
ttattaatt

SEQ ID NO: 78267 - DNA, 9 bp, Unknown
  misc_feature (1)..( 9): Result.001 file - promoters75/2993642
gtataaatt

SEQ ID NO: 78268 - DNA, 14 bp, Unknown
  misc_feature (1)..( 14): Result.001 file - promoters75/2993642
tttatatattttta

SEQ ID NO: 78269 - DNA, 14 bp, Unknown
  misc_feature (1)..( 14): Result.001 file - promoters75/2993642
aactaggattctta

SEQ ID NO: 78270 - DNA, 14 bp, Unknown
  misc_feature (1)..( 14): Result.001 file - promoters75/2993642
tttatatattttgt

SEQ ID NO: 78271 - DNA, 8 bp, Unknown
  misc_feature (1)..( 8): Result.001 file - promoters75/2993642
aaatgtaa

SEQ ID NO: 78272 - DNA, 8 bp, Unknown
  misc_feature (1)..( 8): Result.001 file - promoters75/2993642
aaatgttt

SEQ ID NO: 78273 - DNA, 8 bp, Unknown
  misc_feature (1)..( 8): Result.001 file - promoters75/3043962
aaatattt

SEQ ID NO: 78274 - DNA, 12 bp, Unknown
  misc_feature (1)..( 12): Result.001 file - promoters75/3043962
atttgaattttt

SEQ ID NO: 78275 - DNA, 12 bp, Unknown
  misc_feature (1)..( 12): Result.001 file - promoters75/3043962
atttgatatgct

SEQ ID NO: 78276 - DNA, 12 bp, Unknown
  misc_feature (1)..( 12): Result.001 file - promoters75/3043962
atttgagttttt

SEQ ID NO: 78277 - DNA, 9 bp, Unknown
  misc_feature (1)..( 9): Result.001 file - promoters75/3043962
actatttaa

SEQ ID NO: 78278 - DNA, 9 bp, Unknown
  misc_feature (1)..( 9): Result.001 file - promoters75/3043962
tctatataa

SEQ ID NO: 78279 - DNA, 9 bp, Unknown
  misc_feature (1)..( 9): Result.001 file - promoters75/3043962
actattatc

SEQ ID NO: 78280 - DNA, 8 bp, Unknown
  misc_feature (1)..( 8): Result.001 file - promoters75/3043962
ttataaaa

SEQ ID NO: 78281 - DNA, 8 bp, Unknown
  misc_feature (1)..( 8): Result.001 file - promoters75/3043962
ttattaaa

SEQ ID NO: 78282 - DNA, 8 bp, Unknown
  misc_feature (1)..( 8): Result.001 file - promoters75/3409165
atataaat

SEQ ID NO: 78283 - DNA, 7 bp, Unknown
  misc_feature (1)..( 7): Result.001 file - promoters75/3409165
ttcatat

SEQ ID NO: 78284 - DNA, 7 bp, Unknown
  misc_feature (1)..( 7): Result.001 file - promoters75/3409165
ttcataa

SEQ ID NO: 78285 - DNA, 7 bp, Unknown
  misc_feature (1)..( 7): Result.001 file - promoters75/3409489
ttcttaa

SEQ ID NO: 78286 - DNA, 7 bp, Unknown
  misc_feature (1)..( 7): Result.001 file - promoters75/3409489
cgaagaa

SEQ ID NO: 78287 - DNA, 7 bp, Unknown
  misc_feature (1)..( 7): Result.001 file - promoters75/3409489
cgatgaa

SEQ ID NO: 78288 - DNA, 7 bp, Unknown
  misc_feature (1)..( 7): Result.001 file - promoters75/3409489
agaagaa

SEQ ID NO: 78289 - DNA, 8 bp, Unknown
  misc_feature (1)..( 8): Result.001 file - promoters75/3409489
acttcctt

SEQ ID NO: 78290 - DNA, 8 bp, Unknown
  misc_feature (1)..( 8): Result.001 file - promoters75/3409489
gcttactt

SEQ ID NO: 78291 - DNA, 8 bp, Unknown
  misc_feature (1)..( 8): Result.001 file - promoters75/3409489
acttccgc

SEQ ID NO: 78292 - DNA, 9 bp, Unknown
  misc_feature (1)..( 9): Result.001 file - promoters75/3409489
ctatggtta

SEQ ID NO: 78293 - DNA, 9 bp, Unknown
  misc_feature (1)..( 9): Result.001 file - promoters75/3409489
aaatgatta

SEQ ID NO: 78294 - DNA, 9 bp, Unknown
  misc_feature (1)..( 9): Result.001 file - promoters75/3433904
aaaggatta

SEQ ID NO: 78295 - DNA, 9 bp, Unknown
  misc_feature (1)..( 9): Result.001 file - promoters75/3433904
ctcttaaaa

SEQ ID NO: 78296 - DNA, 9 bp, Unknown
  misc_feature (1)..( 9): Result.001 file - promoters75/3433904
aaattaaaa

SEQ ID NO: 78297 - DNA, 9 bp, Unknown
  misc_feature (1)..( 9): Result.001 file - promoters75/3433904
gtattaaag

SEQ ID NO: 78298 - DNA, 9 bp, Unknown
  misc_feature (1)..( 9): Result.001 file - promoters75/3433904
atatgaaag

SEQ ID NO: 78299 - DNA, 9 bp, Unknown
  misc_feature (1)..( 9): Result.001 file - promoters75/3433904
atatgattt

SEQ ID NO: 78300 - DNA, 8 bp, Unknown
  misc_feature (1)..( 8): Result.001 file - promoters75/3433904
ggtaaatt

SEQ ID NO: 78301 - DNA, 8 bp, Unknown
  misc_feature (1)..( 8): Result.001 file - promoters75/3433904
tataaatt

SEQ ID NO: 78302 - DNA, 8 bp, Unknown
  misc_feature (1)..( 8): Result.001 file - promoters75/3433904
tatgaatc

SEQ ID NO: 78303 - DNA, 8 bp, Unknown
  misc_feature (1)..( 8): Result.001 file - promoters75/3433904
tataaatg

SEQ ID NO: 78304 - DNA, 8 bp, Unknown
  misc_feature (1)..( 8): Result.001 file - promoters75/3433904
gttggata

SEQ ID NO: 78305 - DNA, 8 bp, Unknown
  misc_feature (1)..( 8): Result.001 file - promoters75/3433904
tttggatt

SEQ ID NO: 78306 - DNA, 8 bp, Unknown
  misc_feature (1)..( 8): Result.001 file - promoters75/3433904
gttggaag

SEQ ID NO: 78307 - DNA, 8 bp, Unknown
  misc_feature (1)..( 8): Result.001 file - promoters75/3433904
tttgtata

SEQ ID NO: 78308 - DNA, 11 bp, Unknown
  misc_feature (1)..( 11): Result.001 file - promoters75/3433904
ttaattctttt

SEQ ID NO: 78309 - DNA, 11 bp, Unknown
  misc_feature (1)..( 11): Result.001 file - promoters75/3433904
gtaatcctttt

SEQ ID NO: 78310 - DNA, 11 bp, Unknown
  misc_feature (1)..( 11): Result.001 file - promoters75/3433904
ttaattgccgt

SEQ ID NO: 78311 - DNA, 11 bp, Unknown
  misc_feature (1)..( 11): Result.001 file - promoters75/3433944
cttcttcttta

SEQ ID NO: 78312 - DNA, 10 bp, Unknown
  misc_feature (1)..( 10): Result.001 file - promoters75/3433944
aaacttaaga

SEQ ID NO: 78313 - DNA, 10 bp, Unknown
  misc_feature (1)..( 10): Result.001 file - promoters75/3433944
gaacgtaaga

SEQ ID NO: 78314 - DNA, 10 bp, Unknown
  misc_feature (1)..( 10): Result.001 file - promoters75/3433944
aaaattaaat

SEQ ID NO: 78315 - DNA, 8 bp, Unknown
  misc_feature (1)..( 8): Result.001 file - promoters75/3433944
atttttct

SEQ ID NO: 78316 - DNA, 8 bp, Unknown
  misc_feature (1)..( 8): Result.001 file - promoters75/3433944
attttttt

SEQ ID NO: 78317 - DNA, 8 bp, Unknown
  misc_feature (1)..( 8): Result.001 file - promoters75/3433944
cttttttt

SEQ ID NO: 78318 - DNA, 8 bp, Unknown
  misc_feature (1)..( 8): Result.001 file - promoters75/3433944
gatattac

SEQ ID NO: 78319 - DNA, 8 bp, Unknown
  misc_feature (1)..( 8): Result.001 file - promoters75/3433944
gatattaa

SEQ ID NO: 78320 - DNA, 8 bp, Unknown
  misc_feature (1)..( 8): Result.001 file - promoters75/3434108
aataataa

SEQ ID NO: 78321 - DNA, 13 bp, Unknown
  misc_feature (1)..( 13): Result.001 file - promoters75/3434108
gattaatttctct

SEQ ID NO: 78322 - DNA, 13 bp, Unknown
  misc_feature (1)..( 13): Result.001 file - promoters75/3434108
gattaatgtctct

SEQ ID NO: 78323 - DNA, 13 bp, Unknown
  misc_feature (1)..( 13): Result.001 file - promoters75/3434108
gatgaatttattt

SEQ ID NO: 78324 - DNA, 9 bp, Unknown
  misc_feature (1)..( 9): Result.001 file - promoters75/3434108
tgttgttac

SEQ ID NO: 78325 - DNA, 9 bp, Unknown
  misc_feature (1)..( 9): Result.001 file - promoters75/3434108
cattgttaa

SEQ ID NO: 78326 - DNA, 9 bp, Unknown
  misc_feature (1)..( 9): Result.001 file - promoters75/3434108
tgtttttac

SEQ ID NO: 78327 - DNA, 10 bp, Unknown
  misc_feature (1)..( 10): Result.001 file - promoters75/3434108
aaataaattg

SEQ ID NO: 78328 - DNA, 10 bp, Unknown
  misc_feature (1)..( 10): Result.001 file - promoters75/3434108
aaaaaaattg

SEQ ID NO: 78329 - DNA, 10 bp, Unknown
  misc_feature (1)..( 10): Result.001 file - promoters75/3434108
atttaaattt

SEQ ID NO: 78330 - DNA, 9 bp, Unknown
  misc_feature (1)..( 9): Result.001 file - promoters75/3434108
tcttaaaaa

SEQ ID NO: 78331 - DNA, 9 bp, Unknown
  misc_feature (1)..( 9): Result.001 file - promoters75/3434108
atataaaaa

SEQ ID NO: 78332 - DNA, 9 bp, Unknown
  misc_feature (1)..( 9): Result.001 file - promoters75/3434108
ttctgaaaa

SEQ ID NO: 78333 - DNA, 8 bp, Unknown
  misc_feature (1)..( 8): Result.001 file - promoters75/3434108
ttttttta

SEQ ID NO: 78334 - DNA, 8 bp, Unknown
  misc_feature (1)..( 8): Result.001 file - promoters75/3434108
ttttctta

SEQ ID NO: 78335 - DNA, 8 bp, Unknown
  misc_feature (1)..( 8): Result.001 file - promoters75/3434108
ttttttag

SEQ ID NO: 78336 - DNA, 7 bp, Unknown
  misc_feature (1)..( 7): Result.001 file - promoters75/3434108
aattttg

SEQ ID NO: 78337 - DNA, 7 bp, Unknown
  misc_feature (1)..( 7): Result.001 file - promoters75/3434108
tattttg

SEQ ID NO: 78338 - DNA, 7 bp, Unknown
  misc_feature (1)..( 7): Result.001 file - promoters75/3434108
aatattg

SEQ ID NO: 78339 - DNA, 9 bp, Unknown
  misc_feature (1)..( 9): Result.001 file - promoters75/3434108
ctaattaat

SEQ ID NO: 78340 - DNA, 9 bp, Unknown
  misc_feature (1)..( 9): Result.001 file - promoters75/3434108
aaaataaat

SEQ ID NO: 78341 - DNA, 9 bp, Unknown
  misc_feature (1)..( 9): Result.001 file - promoters75/3434108
ctaattaga

SEQ ID NO: 78342 - DNA, 7 bp, Unknown
  misc_feature (1)..( 7): Result.001 file - promoters75/3434108
gtataat

SEQ ID NO: 78343 - DNA, 7 bp, Unknown
  misc_feature (1)..( 7): Result.001 file - promoters75/3434108
ttataat

SEQ ID NO: 78344 - DNA, 7 bp, Unknown
  misc_feature (1)..( 7): Result.001 file - promoters75/3434108
ttataac

SEQ ID NO: 78345 - DNA, 11 bp, Unknown
  misc_feature (1)..( 11): Result.001 file - promoters75/3434108
caacatacaaa

SEQ ID NO: 78346 - DNA, 11 bp, Unknown
  misc_feature (1)..( 11): Result.001 file - promoters75/3434108
caaaataaaaa

SEQ ID NO: 78347 - DNA, 11 bp, Unknown
  misc_feature (1)..( 11): Result.001 file - promoters75/3434108
tcaaataattc

SEQ ID NO: 78348 - DNA, 12 bp, Unknown
  misc_feature (1)..( 12): Result.001 file - promoters75/3434108
ttaacaaaacaa

SEQ ID NO: 78349 - DNA, 12 bp, Unknown
  misc_feature (1)..( 12): Result.001 file - promoters75/3434108
ttaaaaaatcaa

SEQ ID NO: 78350 - DNA, 12 bp, Unknown
  misc_feature (1)..( 12): Result.001 file - promoters75/3434108
atttgaaatcaa

SEQ ID NO: 78351 - DNA, 8 bp, Unknown
  misc_feature (1)..( 8): Result.001 file - promoters75/3434108
aattttta

SEQ ID NO: 78352 - DNA, 8 bp, Unknown
  misc_feature (1)..( 8): Result.001 file - promoters75/3434108
tattatta

SEQ ID NO: 78353 - DNA, 8 bp, Unknown
  misc_feature (1)..( 8): Result.001 file - promoters75/3434108
tataattt

SEQ ID NO: 78354 - DNA, 8 bp, Unknown
  misc_feature (1)..( 8): Result.001 file - promoters75/3434108
gaaacaaa

SEQ ID NO: 78355 - DNA, 8 bp, Unknown
  misc_feature (1)..( 8): Result.001 file - promoters75/3434108
aaaacaaa

SEQ ID NO: 78356 - DNA, 8 bp, Unknown
  misc_feature (1)..( 8): Result.001 file - promoters75/3434233
aaaataaa

SEQ ID NO: 78357 - DNA, 8 bp, Unknown
  misc_feature (1)..( 8): Result.001 file - promoters75/3434233
acatatag

SEQ ID NO: 78358 - DNA, 8 bp, Unknown
  misc_feature (1)..( 8): Result.001 file - promoters75/3434233
acacatat

SEQ ID NO: 78359 - DNA, 8 bp, Unknown
  misc_feature (1)..( 8): Result.001 file - promoters75/3434233
agatatag

SEQ ID NO: 78360 - DNA, 13 bp, Unknown
  misc_feature (1)..( 13): Result.001 file - promoters75/3434233
agaaaaagaaaaa

SEQ ID NO: 78361 - DNA, 13 bp, Unknown
  misc_feature (1)..( 13): Result.001 file - promoters75/3434233
tgaaaaagaaaaa

SEQ ID NO: 78362 - DNA, 13 bp, Unknown
  misc_feature (1)..( 13): Result.001 file - promoters75/3434233
agaaaaagattgt

SEQ ID NO: 78363 - DNA, 8 bp, Unknown
  misc_feature (1)..( 8): Result.001 file - promoters75/3434233
aaaagaaa

SEQ ID NO: 78364 - DNA, 8 bp, Unknown
  misc_feature (1)..( 8): Result.001 file - promoters75/3434233
aaaagaaa

SEQ ID NO: 78365 - DNA, 8 bp, Unknown
  misc_feature (1)..( 8): Result.001 file - promoters75/3434233
gaaagaga

SEQ ID NO: 78366 - DNA, 7 bp, Unknown
  misc_feature (1)..( 7): Result.001 file - promoters75/3434233
gaaagaa

SEQ ID NO: 78367 - DNA, 7 bp, Unknown
  misc_feature (1)..( 7): Result.001 file - promoters75/3434233
aaaagaa

SEQ ID NO: 78368 - DNA, 7 bp, Unknown
  misc_feature (1)..( 7): Result.001 file - promoters75/3434233
gaaagag

SEQ ID NO: 78369 - DNA, 7 bp, Unknown
  misc_feature (1)..( 7): Result.001 file - promoters75/3434233
tcaaagc

SEQ ID NO: 78370 - DNA, 7 bp, Unknown
  misc_feature (1)..( 7): Result.001 file - promoters75/3434233
tcacagc

SEQ ID NO: 78371 - DNA, 7 bp, Unknown
  misc_feature (1)..( 7): Result.001 file - promoters75/3434233
tcaaagc

SEQ ID NO: 78372 - DNA, 8 bp, Unknown
  misc_feature (1)..( 8): Result.001 file - promoters75/3434233
aaaaaaga

SEQ ID NO: 78373 - DNA, 8 bp, Unknown
  misc_feature (1)..( 8): Result.001 file - promoters75/3434233
gaaagaga

SEQ ID NO: 78374 - DNA, 8 bp, Unknown
  misc_feature (1)..( 8): Result.001 file - promoters75/3434279
gaaaaaga

SEQ ID NO: 78375 - DNA, 15 bp, Unknown
  misc_feature (1)..( 15): Result.001 file - promoters75/3434279
ttctgaagtttctgg

SEQ ID NO: 78376 - DNA, 15 bp, Unknown
  misc_feature (1)..( 15): Result.001 file - promoters75/3434279
gacctaagtttaagt

SEQ ID NO: 78377 - DNA, 15 bp, Unknown
  misc_feature (1)..( 15): Result.001 file - promoters75/3434279
gacataaatttttta

SEQ ID NO: 78378 - DNA, 16 bp, Unknown
  misc_feature (1)..( 16): Result.001 file - promoters75/3434279
aatgatgaataacata

SEQ ID NO: 78379 - DNA, 15 bp, Unknown
  misc_feature (1)..( 15): Result.001 file - promoters75/3434279
tgtataattttatat

SEQ ID NO: 78380 - DNA, 16 bp, Unknown
  misc_feature (1)..( 16): Result.001 file - promoters75/3434279
ccactaatatatattc

SEQ ID NO: 78381 - DNA, 12 bp, Unknown
  misc_feature (1)..( 12): Result.001 file - promoters75/3434279
ccaaacaaaaca

SEQ ID NO: 78382 - DNA, 12 bp, Unknown
  misc_feature (1)..( 12): Result.001 file - promoters75/3434279
agaaacaaagta

SEQ ID NO: 78383 - DNA, 12 bp, Unknown
  misc_feature (1)..( 12): Result.001 file - promoters75/3434279
tcaaagaaattc

SEQ ID NO: 78384 - DNA, 12 bp, Unknown
  misc_feature (1)..( 12): Result.001 file - promoters75/3434279
agaaaaaaaaaa

SEQ ID NO: 78385 - DNA, 12 bp, Unknown
  misc_feature (1)..( 12): Result.001 file - promoters75/3434279
taaaaccaagac

SEQ ID NO: 78386 - DNA, 12 bp, Unknown
  misc_feature (1)..( 12): Result.001 file - promoters75/3434279
ataaaaaatttt

SEQ ID NO: 78387 - DNA, 12 bp, Unknown
  misc_feature (1)..( 12): Result.001 file - promoters75/3434279
ataaatattcaa

SEQ ID NO: 78388 - DNA, 16 bp, Unknown
  misc_feature (1)..( 16): Result.001 file - promoters75/3434279
acataaattttttata

SEQ ID NO: 78389 - DNA, 16 bp, Unknown
  misc_feature (1)..( 16): Result.001 file - promoters75/3434279
tgtataattttatata

SEQ ID NO: 78390 - DNA, 16 bp, Unknown
  misc_feature (1)..( 16): Result.001 file - promoters75/3434279
cattcctttttgtatc

SEQ ID NO: 78391 - DNA, 16 bp, Unknown
  misc_feature (1)..( 16): Result.001 file - promoters75/3434279
gacctaagtttaagtt

SEQ ID NO: 78392 - DNA, 16 bp, Unknown
  misc_feature (1)..( 16): Result.001 file - promoters75/3434279
caaagaattttttttc

SEQ ID NO: 78393 - DNA, 16 bp, Unknown
  misc_feature (1)..( 16): Result.001 file - promoters75/3434563
tcgtccatttttctga

SEQ ID NO: 78394 - DNA, 10 bp, Unknown
  misc_feature (1)..( 10): Result.001 file - promoters75/3434563
ttaaaaataa

SEQ ID NO: 78395 - DNA, 10 bp, Unknown
  misc_feature (1)..( 10): Result.001 file - promoters75/3434563
gtaaaaatta

SEQ ID NO: 78396 - DNA, 10 bp, Unknown
  misc_feature (1)..( 10): Result.001 file - promoters75/3434563
ttaataattc

SEQ ID NO: 78397 - DNA, 10 bp, Unknown
  misc_feature (1)..( 10): Result.001 file - promoters75/3434563
ctaagaattg

SEQ ID NO: 78398 - DNA, 10 bp, Unknown
  misc_feature (1)..( 10): Result.001 file - promoters75/3434563
acaataaata

SEQ ID NO: 78399 - DNA, 10 bp, Unknown
  misc_feature (1)..( 10): Result.001 file - promoters75/3435133
ctatgaaaag

SEQ ID NO: 78400 - DNA, 7 bp, Unknown
  misc_feature (1)..( 7): Result.001 file - promoters75/3435133
gtagatt

SEQ ID NO: 78401 - DNA, 7 bp, Unknown
  misc_feature (1)..( 7): Result.001 file - promoters75/3435133
atagatt

SEQ ID NO: 78402 - DNA, 7 bp, Unknown
  misc_feature (1)..( 7): Result.001 file - promoters75/3435833
ataaatt

SEQ ID NO: 78403 - DNA, 9 bp, Unknown
  misc_feature (1)..( 9): Result.001 file - promoters75/3435833
ttaagaaaa

SEQ ID NO: 78404 - DNA, 9 bp, Unknown
  misc_feature (1)..( 9): Result.001 file - promoters75/3435833
ttacgaaac

SEQ ID NO: 78405 - DNA, 9 bp, Unknown
  misc_feature (1)..( 9): Result.001 file - promoters75/3435833
ataataaaa

SEQ ID NO: 78406 - DNA, 8 bp, Unknown
  misc_feature (1)..( 8): Result.001 file - promoters75/3435833
tatataaa

SEQ ID NO: 78407 - DNA, 8 bp, Unknown
  misc_feature (1)..( 8): Result.001 file - promoters75/3435833
tatataag

SEQ ID NO: 78408 - DNA, 8 bp, Unknown
  misc_feature (1)..( 8): Result.001 file - promoters75/3436196
actataaa

SEQ ID NO: 78409 - DNA, 7 bp, Unknown
  misc_feature (1)..( 7): Result.001 file - promoters75/3436196
tctaaaa

SEQ ID NO: 78410 - DNA, 7 bp, Unknown
  misc_feature (1)..( 7): Result.001 file - promoters75/3436196
actaaaa

SEQ ID NO: 78411 - DNA, 7 bp, Unknown
  misc_feature (1)..( 7): Result.001 file - promoters75/3436196
actaaat

SEQ ID NO: 78412 - DNA, 10 bp, Unknown
  misc_feature (1)..( 10): Result.001 file - promoters75/3436196
cacataaaat

SEQ ID NO: 78413 - DNA, 10 bp, Unknown
  misc_feature (1)..( 10): Result.001 file - promoters75/3436196
atcataaaat

SEQ ID NO: 78414 - DNA, 10 bp, Unknown
  misc_feature (1)..( 10): Result.001 file - promoters75/3437244
atcgtaacct

SEQ ID NO: 78415 - DNA, 8 bp, Unknown
  misc_feature (1)..( 8): Result.001 file - promoters75/3437244
aaatcaag

SEQ ID NO: 78416 - DNA, 8 bp, Unknown
  misc_feature (1)..( 8): Result.001 file - promoters75/3437244
gaatcaac

SEQ ID NO: 78417 - DNA, 8 bp, Unknown
  misc_feature (1)..( 8): Result.001 file - promoters75/3437244
ccatcaac

SEQ ID NO: 78418 - DNA, 8 bp, Unknown
  misc_feature (1)..( 8): Result.001 file - promoters75/3437244
gaatcaca

SEQ ID NO: 78419 - DNA, 10 bp, Unknown
  misc_feature (1)..( 10): Result.001 file - promoters75/3437244
cacggcgctt

SEQ ID NO: 78420 - DNA, 10 bp, Unknown
  misc_feature (1)..( 10): Result.001 file - promoters75/3437244
cactgcgtgt

SEQ ID NO: 78421 - DNA, 10 bp, Unknown
  misc_feature (1)..( 10): Result.001 file - promoters75/3437710
agctgcgtgt

SEQ ID NO: 78422 - DNA, 8 bp, Unknown
  misc_feature (1)..( 8): Result.001 file - promoters75/3437710
acaaaaaa

SEQ ID NO: 78423 - DNA, 8 bp, Unknown
  misc_feature (1)..( 8): Result.001 file - promoters75/3437710
acacaaaa

SEQ ID NO: 78424 - DNA, 8 bp, Unknown
  misc_feature (1)..( 8): Result.001 file - promoters75/3437710
ataaaaaa

SEQ ID NO: 78425 - DNA, 10 bp, Unknown
  misc_feature (1)..( 10): Result.001 file - promoters75/3437710
aataaaaatc

SEQ ID NO: 78426 - DNA, 10 bp, Unknown
  misc_feature (1)..( 10): Result.001 file - promoters75/3437710
aatcaaaatc

SEQ ID NO: 78427 - DNA, 10 bp, Unknown
  misc_feature (1)..( 10): Result.001 file - promoters75/3437710
cataaaagtc

SEQ ID NO: 78428 - DNA, 8 bp, Unknown
  misc_feature (1)..( 8): Result.001 file - promoters75/3437710
tatccaag

SEQ ID NO: 78429 - DNA, 8 bp, Unknown
  misc_feature (1)..( 8): Result.001 file - promoters75/3437710
aatccaaa

SEQ ID NO: 78430 - DNA, 8 bp, Unknown
  misc_feature (1)..( 8): Result.001 file - promoters75/3437710
tatccaag

SEQ ID NO: 78431 - DNA, 8 bp, Unknown
  misc_feature (1)..( 8): Result.001 file - promoters75/3438077
tatccaac

SEQ ID NO: 78432 - DNA, 11 bp, Unknown
  misc_feature (1)..( 11): Result.001 file - promoters75/3438077
ttgaaccacga

SEQ ID NO: 78433 - DNA, 11 bp, Unknown
  misc_feature (1)..( 11): Result.001 file - promoters75/3438077
ttgaaacacaa

SEQ ID NO: 78434 - DNA, 11 bp, Unknown
  misc_feature (1)..( 11): Result.001 file - promoters75/3438077
aataaaaacag

SEQ ID NO: 78435 - DNA, 11 bp, Unknown
  misc_feature (1)..( 11): Result.001 file - promoters75/3438077
aagaaaaaaaa

SEQ ID NO: 78436 - DNA, 11 bp, Unknown
  misc_feature (1)..( 11): Result.001 file - promoters75/3438077
atcaaaaaatt

SEQ ID NO: 78437 - DNA, 11 bp, Unknown
  misc_feature (1)..( 11): Result.001 file - promoters75/3438194
tccaaacagaa

SEQ ID NO: 78438 - DNA, 11 bp, Unknown
  misc_feature (1)..( 11): Result.001 file - promoters75/3438194
gaagaacaggt

SEQ ID NO: 78439 - DNA, 11 bp, Unknown
  misc_feature (1)..( 11): Result.001 file - promoters75/3438194
atagaacaaac

SEQ ID NO: 78440 - DNA, 11 bp, Unknown
  misc_feature (1)..( 11): Result.001 file - promoters75/3438236
atataacaaac

SEQ ID NO: 78441 - DNA, 14 bp, Unknown
  misc_feature (1)..( 14): Result.001 file - promoters75/3438236
tcaattaatctttt

SEQ ID NO: 78442 - DNA, 14 bp, Unknown
  misc_feature (1)..( 14): Result.001 file - promoters75/3438236
tcaaataattctcc

SEQ ID NO: 78443 - DNA, 14 bp, Unknown
  misc_feature (1)..( 14): Result.001 file - promoters75/3438236
caaaagaatcagtg

SEQ ID NO: 78444 - DNA, 14 bp, Unknown
  misc_feature (1)..( 14): Result.001 file - promoters75/3438236
gattatatttcttg

SEQ ID NO: 78445 - DNA, 14 bp, Unknown
  misc_feature (1)..( 14): Result.001 file - promoters75/3438236
acttgtttttcttg

SEQ ID NO: 78446 - DNA, 14 bp, Unknown
  misc_feature (1)..( 14): Result.001 file - promoters75/3438512
caaaacaattcaag

SEQ ID NO: 78447 - DNA, 12 bp, Unknown
  misc_feature (1)..( 12): Result.001 file - promoters75/3438512
caacaatgtaca

SEQ ID NO: 78448 - DNA, 12 bp, Unknown
  misc_feature (1)..( 12): Result.001 file - promoters75/3438512
caataatttaca

SEQ ID NO: 78449 - DNA, 12 bp, Unknown
  misc_feature (1)..( 12): Result.001 file - promoters75/3438512
tgaaaatttata

SEQ ID NO: 78450 - DNA, 12 bp, Unknown
  misc_feature (1)..( 12): Result.001 file - promoters75/3438512
gtataattttat

SEQ ID NO: 78451 - DNA, 6 bp, Unknown
  misc_feature (1)..( 6): Result.001 file - promoters75/3438512
ataact

SEQ ID NO: 78452 - DNA, 6 bp, Unknown
  misc_feature (1)..( 6): Result.001 file - promoters75/3438512
ataact

SEQ ID NO: 78453 - DNA, 6 bp, Unknown
  misc_feature (1)..( 6): Result.001 file - promoters75/3438512
ataact

SEQ ID NO: 78454 - DNA, 12 bp, Unknown
  misc_feature (1)..( 12): Result.001 file - promoters75/3438512
tacacaagattt

SEQ ID NO: 78455 - DNA, 12 bp, Unknown
  misc_feature (1)..( 12): Result.001 file - promoters75/3438512
tacataagtttt

SEQ ID NO: 78456 - DNA, 12 bp, Unknown
  misc_feature (1)..( 12): Result.001 file - promoters75/3438512
ttttgaagtttg

SEQ ID NO: 78457 - DNA, 7 bp, Unknown
  misc_feature (1)..( 7): Result.001 file - promoters75/3438512
aaactta

SEQ ID NO: 78458 - DNA, 7 bp, Unknown
  misc_feature (1)..( 7): Result.001 file - promoters75/3438512
aaacttt

SEQ ID NO: 78459 - DNA, 7 bp, Unknown
  misc_feature (1)..( 7): Result.001 file - promoters75/3438512
aaagttt

SEQ ID NO: 78460 - DNA, 11 bp, Unknown
  misc_feature (1)..( 11): Result.001 file - promoters75/3438512
ctttgcttaca

SEQ ID NO: 78461 - DNA, 11 bp, Unknown
  misc_feature (1)..( 11): Result.001 file - promoters75/3438512
ttttacttttt

SEQ ID NO: 78462 - DNA, 11 bp, Unknown
  misc_feature (1)..( 11): Result.001 file - promoters75/3438512
ttttaccagtg

SEQ ID NO: 78463 - DNA, 11 bp, Unknown
  misc_feature (1)..( 11): Result.001 file - promoters75/3438512
atatacttttt

SEQ ID NO: 78464 - DNA, 9 bp, Unknown
  misc_feature (1)..( 9): Result.001 file - promoters75/3438512
tcaataaac

SEQ ID NO: 78465 - DNA, 9 bp, Unknown
  misc_feature (1)..( 9): Result.001 file - promoters75/3438512
tcaaaaaaa

SEQ ID NO: 78466 - DNA, 9 bp, Unknown
  misc_feature (1)..( 9): Result.001 file - promoters75/3438632
ggaaaaaaa

SEQ ID NO: 78467 - DNA, 8 bp, Unknown
  misc_feature (1)..( 8): Result.001 file - promoters75/3438632
agatatta

SEQ ID NO: 78468 - DNA, 8 bp, Unknown
  misc_feature (1)..( 8): Result.001 file - promoters75/3438632
cgatatta

SEQ ID NO: 78469 - DNA, 8 bp, Unknown
  misc_feature (1)..( 8): Result.001 file - promoters75/3438632
agacattt

SEQ ID NO: 78470 - DNA, 11 bp, Unknown
  misc_feature (1)..( 11): Result.001 file - promoters75/3438632
gtctgaacgaa

SEQ ID NO: 78471 - DNA, 11 bp, Unknown
  misc_feature (1)..( 11): Result.001 file - promoters75/3438632
aaaagaaagaa

SEQ ID NO: 78472 - DNA, 11 bp, Unknown
  misc_feature (1)..( 11): Result.001 file - promoters75/3439213
aaaaaaaagac

SEQ ID NO: 78473 - DNA, 9 bp, Unknown
  misc_feature (1)..( 9): Result.001 file - promoters75/3439213
attttgatt

SEQ ID NO: 78474 - DNA, 9 bp, Unknown
  misc_feature (1)..( 9): Result.001 file - promoters75/3439213
attttgatt

SEQ ID NO: 78475 - DNA, 9 bp, Unknown
  misc_feature (1)..( 9): Result.001 file - promoters75/3439213
atttttatt

SEQ ID NO: 78476 - DNA, 9 bp, Unknown
  misc_feature (1)..( 9): Result.001 file - promoters75/3439472
cttttgaag

SEQ ID NO: 78477 - DNA, 9 bp, Unknown
  misc_feature (1)..( 9): Result.001 file - promoters75/3439472
gaaacaaag

SEQ ID NO: 78478 - DNA, 9 bp, Unknown
  misc_feature (1)..( 9): Result.001 file - promoters75/3439472
gaaccaatc

SEQ ID NO: 78479 - DNA, 9 bp, Unknown
  misc_feature (1)..( 9): Result.001 file - promoters75/3439472
caaagaaat

SEQ ID NO: 78480 - DNA, 9 bp, Unknown
  misc_feature (1)..( 9): Result.001 file - promoters75/3439472
aaaacaaaa

SEQ ID NO: 78481 - DNA, 9 bp, Unknown
  misc_feature (1)..( 9): Result.001 file - promoters75/3439472
tcgacaaaa

SEQ ID NO: 78482 - DNA, 12 bp, Unknown
  misc_feature (1)..( 12): Result.001 file - promoters75/3439472
gaaaaaaattgt

SEQ ID NO: 78483 - DNA, 12 bp, Unknown
  misc_feature (1)..( 12): Result.001 file - promoters75/3439472
gttgaaacttga

SEQ ID NO: 78484 - DNA, 12 bp, Unknown
  misc_feature (1)..( 12): Result.001 file - promoters75/3439472
gacataacctga

SEQ ID NO: 78485 - DNA, 12 bp, Unknown
  misc_feature (1)..( 12): Result.001 file - promoters75/3439472
accaaaacttct

SEQ ID NO: 78486 - DNA, 12 bp, Unknown
  misc_feature (1)..( 12): Result.001 file - promoters75/3439614
gttggaactata

SEQ ID NO: 78487 - DNA, 10 bp, Unknown
  misc_feature (1)..( 10): Result.001 file - promoters75/3439614
tattagctta

SEQ ID NO: 78488 - DNA, 10 bp, Unknown
  misc_feature (1)..( 10): Result.001 file - promoters75/3439614
gatttgcttc

SEQ ID NO: 78489 - DNA, 10 bp, Unknown
  misc_feature (1)..( 10): Result.001 file - promoters75/3439614
tattagagag

SEQ ID NO: 78490 - DNA, 10 bp, Unknown
  misc_feature (1)..( 10): Result.001 file - promoters75/3439614
tacgtgcttc

SEQ ID NO: 78491 - DNA, 7 bp, Unknown
  misc_feature (1)..( 7): Result.001 file - promoters75/3439614
ttagagt

SEQ ID NO: 78492 - DNA, 7 bp, Unknown
  misc_feature (1)..( 7): Result.001 file - promoters75/3439614
ttagagc

SEQ ID NO: 78493 - DNA, 7 bp, Unknown
  misc_feature (1)..( 7): Result.001 file - promoters75/3439614
ttagaga

SEQ ID NO: 78494 - DNA, 7 bp, Unknown
  misc_feature (1)..( 7): Result.001 file - promoters75/3593205
ttaaaga

SEQ ID NO: 78495 - DNA, 13 bp, Unknown
  misc_feature (1)..( 13): Result.001 file - promoters75/3593205
aattggatccgaa

SEQ ID NO: 78496 - DNA, 13 bp, Unknown
  misc_feature (1)..( 13): Result.001 file - promoters75/3593205
aattagatttttt

SEQ ID NO: 78497 - DNA, 13 bp, Unknown
  misc_feature (1)..( 13): Result.001 file - promoters75/3593205
tattcgatctttt

SEQ ID NO: 78498 - DNA, 8 bp, Unknown
  misc_feature (1)..( 8): Result.001 file - promoters75/3593205
ttatccga

SEQ ID NO: 78499 - DNA, 8 bp, Unknown
  misc_feature (1)..( 8): Result.001 file - promoters75/3593205
ttatcctt

SEQ ID NO: 78500 - DNA, 8 bp, Unknown
  misc_feature (1)..( 8): Result.001 file - promoters75/3593230
ttattctt

SEQ ID NO: 78501 - DNA, 8 bp, Unknown
  misc_feature (1)..( 8): Result.001 file - promoters75/3593230
cacattca

SEQ ID NO: 78502 - DNA, 8 bp, Unknown
  misc_feature (1)..( 8): Result.001 file - promoters75/3593230
gtcattca

SEQ ID NO: 78503 - DNA, 8 bp, Unknown
  misc_feature (1)..( 8): Result.001 file - promoters75/3593230
cacgttct

SEQ ID NO: 78504 - DNA, 8 bp, Unknown
  misc_feature (1)..( 8): Result.001 file - promoters75/3593230
ctttcttg

SEQ ID NO: 78505 - DNA, 8 bp, Unknown
  misc_feature (1)..( 8): Result.001 file - promoters75/3593230
tcttcttg

SEQ ID NO: 78506 - DNA, 8 bp, Unknown
  misc_feature (1)..( 8): Result.001 file - promoters75/4254434
tcttcttt

SEQ ID NO: 78507 - DNA, 8 bp, Unknown
  misc_feature (1)..( 8): Result.001 file - promoters75/4254434
tttagatt

SEQ ID NO: 78508 - DNA, 8 bp, Unknown
  misc_feature (1)..( 8): Result.001 file - promoters75/4254434
tttagaga

SEQ ID NO: 78509 - DNA, 8 bp, Unknown
  misc_feature (1)..( 8): Result.001 file - promoters75/4254434
attaaatt

SEQ ID NO: 78510 - DNA, 11 bp, Unknown
  misc_feature (1)..( 11): Result.001 file - promoters75/4254434
agatttagata

SEQ ID NO: 78511 - DNA, 11 bp, Unknown
  misc_feature (1)..( 11): Result.001 file - promoters75/4254434
agattttgatt

SEQ ID NO: 78512 - DNA, 11 bp, Unknown
  misc_feature (1)..( 11): Result.001 file - promoters75/4262420
ttcattaaatt

SEQ ID NO: 78513 - DNA, 10 bp, Unknown
  misc_feature (1)..( 10): Result.001 file - promoters75/4262420
cctattggtt

SEQ ID NO: 78514 - DNA, 10 bp, Unknown
  misc_feature (1)..( 10): Result.001 file - promoters75/4262420
tctaatggtt

SEQ ID NO: 78515 - DNA, 10 bp, Unknown
  misc_feature (1)..( 10): Result.001 file - promoters75/4262420
cctattgaca

SEQ ID NO: 78516 - DNA, 6 bp, Unknown
  misc_feature (1)..( 6): Result.001 file - promoters75/4262420
tgggat

SEQ ID NO: 78517 - DNA, 6 bp, Unknown
  misc_feature (1)..( 6): Result.001 file - promoters75/4262420
tgggat

SEQ ID NO: 78518 - DNA, 6 bp, Unknown
  misc_feature (1)..( 6): Result.001 file - promoters75/4262428
tgggat

SEQ ID NO: 78519 - DNA, 7 bp, Unknown
  misc_feature (1)..( 7): Result.001 file - promoters75/4262428
attaaat

SEQ ID NO: 78520 - DNA, 7 bp, Unknown
  misc_feature (1)..( 7): Result.001 file - promoters75/4262428
attaaat

SEQ ID NO: 78521 - DNA, 7 bp, Unknown
  misc_feature (1)..( 7): Result.001 file - promoters75/4262428
attaaat

SEQ ID NO: 78522 - DNA, 7 bp, Unknown
  misc_feature (1)..( 7): Result.001 file - promoters75/4262428
tatttaa

SEQ ID NO: 78523 - DNA, 7 bp, Unknown
  misc_feature (1)..( 7): Result.001 file - promoters75/4262428
tatataa

SEQ ID NO: 78524 - DNA, 7 bp, Unknown
  misc_feature (1)..( 7): Result.001 file - promoters75/4262428
aatataa

SEQ ID NO: 78525 - DNA, 9 bp, Unknown
  misc_feature (1)..( 9): Result.001 file - promoters75/4262428
cataaatag

SEQ ID NO: 78526 - DNA, 9 bp, Unknown
  misc_feature (1)..( 9): Result.001 file - promoters75/4262428
tataaatgt

SEQ ID NO: 78527 - DNA, 9 bp, Unknown
  misc_feature (1)..( 9): Result.001 file - promoters75/4281773
aataaaaat

SEQ ID NO: 78528 - DNA, 7 bp, Unknown
  misc_feature (1)..( 7): Result.001 file - promoters75/4281773
ttagggc

SEQ ID NO: 78529 - DNA, 7 bp, Unknown
  misc_feature (1)..( 7): Result.001 file - promoters75/4281773
ttagggt

SEQ ID NO: 78530 - DNA, 7 bp, Unknown
  misc_feature (1)..( 7): Result.001 file - promoters75/4281773
ctagggc

SEQ ID NO: 78531 - DNA, 7 bp, Unknown
  misc_feature (1)..( 7): Result.001 file - promoters75/4281773
cagtatt

SEQ ID NO: 78532 - DNA, 7 bp, Unknown
  misc_feature (1)..( 7): Result.001 file - promoters75/4281773
cagtata

SEQ ID NO: 78533 - DNA, 7 bp, Unknown
  misc_feature (1)..( 7): Result.001 file - promoters75/4281773
aagtatt

SEQ ID NO: 78534 - DNA, 15 bp, Unknown
  misc_feature (1)..( 15): Result.001 file - promoters75/4281773
ttctgaagtttctgg

SEQ ID NO: 78535 - DNA, 15 bp, Unknown
  misc_feature (1)..( 15): Result.001 file - promoters75/4281773
atgcatagtttatgg

SEQ ID NO: 78536 - DNA, 15 bp, Unknown
  misc_feature (1)..( 15): Result.001 file - promoters75/4281773
atgtatagttttgtg

SEQ ID NO: 78537 - DNA, 7 bp, Unknown
  misc_feature (1)..( 7): Result.001 file - promoters75/4281773
aaacaca

SEQ ID NO: 78538 - DNA, 7 bp, Unknown
  misc_feature (1)..( 7): Result.001 file - promoters75/4281773
aaagaca

SEQ ID NO: 78539 - DNA, 7 bp, Unknown
  misc_feature (1)..( 7): Result.001 file - promoters75/4281773
aaagact

SEQ ID NO: 78540 - DNA, 9 bp, Unknown
  misc_feature (1)..( 9): Result.001 file - promoters75/4281773
aagaagaag

SEQ ID NO: 78541 - DNA, 9 bp, Unknown
  misc_feature (1)..( 9): Result.001 file - promoters75/4281773
aagaaaaag

SEQ ID NO: 78542 - DNA, 9 bp, Unknown
  misc_feature (1)..( 9): Result.001 file - promoters75/4281925
aaggaaaga

SEQ ID NO: 78543 - DNA, 11 bp, Unknown
  misc_feature (1)..( 11): Result.001 file - promoters75/4281925
aaattaaaaca

SEQ ID NO: 78544 - DNA, 11 bp, Unknown
  misc_feature (1)..( 11): Result.001 file - promoters75/4281925
aaaataacaca

SEQ ID NO: 78545 - DNA, 11 bp, Unknown
  misc_feature (1)..( 11): Result.001 file - promoters75/4281925
gcaataaaaat

SEQ ID NO: 78546 - DNA, 8 bp, Unknown
  misc_feature (1)..( 8): Result.001 file - promoters75/4281925
taattttt

SEQ ID NO: 78547 - DNA, 8 bp, Unknown
  misc_feature (1)..( 8): Result.001 file - promoters75/4281925
taaatttt

SEQ ID NO: 78548 - DNA, 8 bp, Unknown
  misc_feature (1)..( 8): Result.001 file - promoters75/4281925
aaattttg

SEQ ID NO: 78549 - DNA, 14 bp, Unknown
  misc_feature (1)..( 14): Result.001 file - promoters75/4281925
aatttataaatgta

SEQ ID NO: 78550 - DNA, 14 bp, Unknown
  misc_feature (1)..( 14): Result.001 file - promoters75/4281925
aatttacatatcta

SEQ ID NO: 78551 - DNA, 14 bp, Unknown
  misc_feature (1)..( 14): Result.001 file - promoters75/4282316
attttacttttcat

SEQ ID NO: 78552 - DNA, 7 bp, Unknown
  misc_feature (1)..( 7): Result.001 file - promoters75/4282316
aattatc

SEQ ID NO: 78553 - DNA, 7 bp, Unknown
  misc_feature (1)..( 7): Result.001 file - promoters75/4282316
cattatc

SEQ ID NO: 78554 - DNA, 7 bp, Unknown
  misc_feature (1)..( 7): Result.001 file - promoters75/4282316
cattata

SEQ ID NO: 78555 - DNA, 9 bp, Unknown
  misc_feature (1)..( 9): Result.001 file - promoters75/4282316
aaaagttta

SEQ ID NO: 78556 - DNA, 9 bp, Unknown
  misc_feature (1)..( 9): Result.001 file - promoters75/4282316
aaatgtttt

SEQ ID NO: 78557 - DNA, 9 bp, Unknown
  misc_feature (1)..( 9): Result.001 file - promoters75/4282418
caatatttt

SEQ ID NO: 78558 - DNA, 9 bp, Unknown
  misc_feature (1)..( 9): Result.001 file - promoters75/4282418
aaactaaaa

SEQ ID NO: 78559 - DNA, 9 bp, Unknown
  misc_feature (1)..( 9): Result.001 file - promoters75/4282418
aaaataaaa

SEQ ID NO: 78560 - DNA, 9 bp, Unknown
  misc_feature (1)..( 9): Result.001 file - promoters75/4282503
aaagtaaac

SEQ ID NO: 78561 - DNA, 7 bp, Unknown
  misc_feature (1)..( 7): Result.001 file - promoters75/4282503
taaaatt

SEQ ID NO: 78562 - DNA, 7 bp, Unknown
  misc_feature (1)..( 7): Result.001 file - promoters75/4282503
taaaatc

SEQ ID NO: 78563 - DNA, 7 bp, Unknown
  misc_feature (1)..( 7): Result.001 file - promoters75/4282503
caaaatc

SEQ ID NO: 78564 - DNA, 10 bp, Unknown
  misc_feature (1)..( 10): Result.001 file - promoters75/4282503
tttgaatgcc

SEQ ID NO: 78565 - DNA, 10 bp, Unknown
  misc_feature (1)..( 10): Result.001 file - promoters75/4282503
ttttaataac

SEQ ID NO: 78566 - DNA, 10 bp, Unknown
  misc_feature (1)..( 10): Result.001 file - promoters75/4282503
ttttactaac

SEQ ID NO: 78567 - DNA, 11 bp, Unknown
  misc_feature (1)..( 11): Result.001 file - promoters75/4282503
ccaattatatg

SEQ ID NO: 78568 - DNA, 11 bp, Unknown
  misc_feature (1)..( 11): Result.001 file - promoters75/4282503
tttattaaatg

SEQ ID NO: 78569 - DNA, 11 bp, Unknown
  misc_feature (1)..( 11): Result.001 file - promoters75/4282667
tttactaactt

SEQ ID NO: 78570 - DNA, 8 bp, Unknown
  misc_feature (1)..( 8): Result.001 file - promoters75/4282667
aatgggct

SEQ ID NO: 78571 - DNA, 8 bp, Unknown
  misc_feature (1)..( 8): Result.001 file - promoters75/4282667
aataggcc

SEQ ID NO: 78572 - DNA, 8 bp, Unknown
  misc_feature (1)..( 8): Result.001 file - promoters75/4282667
tatgggcc

SEQ ID NO: 78573 - DNA, 8 bp, Unknown
  misc_feature (1)..( 8): Result.001 file - promoters75/4282667
aatgggcc

SEQ ID NO: 78574 - DNA, 8 bp, Unknown
  misc_feature (1)..( 8): Result.001 file - promoters75/4282667
aatgggtc

SEQ ID NO: 78575 - DNA, 8 bp, Unknown
  misc_feature (1)..( 8): Result.001 file - promoters75/4282667
tttgggcc

SEQ ID NO: 78576 - DNA, 12 bp, Unknown
  misc_feature (1)..( 12): Result.001 file - promoters75/4282667
attgttacaaat

SEQ ID NO: 78577 - DNA, 12 bp, Unknown
  misc_feature (1)..( 12): Result.001 file - promoters75/4282667
atttttactttt

SEQ ID NO: 78578 - DNA, 12 bp, Unknown
  misc_feature (1)..( 12): Result.001 file - promoters75/4282667
tttgttagttca

SEQ ID NO: 78579 - DNA, 12 bp, Unknown
  misc_feature (1)..( 12): Result.001 file - promoters75/4282667
attgataggtgc

SEQ ID NO: 78580 - DNA, 12 bp, Unknown
  misc_feature (1)..( 12): Result.001 file - promoters75/4282667
gactttagtttt

SEQ ID NO: 78581 - DNA, 12 bp, Unknown
  misc_feature (1)..( 12): Result.001 file - promoters75/4282667
tttgtttttgat

SEQ ID NO: 78582 - DNA, 11 bp, Unknown
  misc_feature (1)..( 11): Result.001 file - promoters75/4282667
tattcaactat

SEQ ID NO: 78583 - DNA, 11 bp, Unknown
  misc_feature (1)..( 11): Result.001 file - promoters75/4282667
aattcaaaaag

SEQ ID NO: 78584 - DNA, 11 bp, Unknown
  misc_feature (1)..( 11): Result.001 file - promoters75/4282667
tgttcaaaaaa

SEQ ID NO: 78585 - DNA, 11 bp, Unknown
  misc_feature (1)..( 11): Result.001 file - promoters75/4282667
aaaaaaaaaaa

SEQ ID NO: 78586 - DNA, 11 bp, Unknown
  misc_feature (1)..( 11): Result.001 file - promoters75/4282667
gaaacaaagta

SEQ ID NO: 78587 - DNA, 11 bp, Unknown
  misc_feature (1)..( 11): Result.001 file - promoters75/4282667
aaaccaagacg

SEQ ID NO: 78588 - DNA, 11 bp, Unknown
  misc_feature (1)..( 11): Result.001 file - promoters75/4282667
gatacaaaacc

SEQ ID NO: 78589 - DNA, 12 bp, Unknown
  misc_feature (1)..( 12): Result.001 file - promoters75/4282667
ctcttatgattt

SEQ ID NO: 78590 - DNA, 12 bp, Unknown
  misc_feature (1)..( 12): Result.001 file - promoters75/4282667
cttccatgtttt

SEQ ID NO: 78591 - DNA, 12 bp, Unknown
  misc_feature (1)..( 12): Result.001 file - promoters75/4282667
ttcttaggattc

SEQ ID NO: 78592 - DNA, 12 bp, Unknown
  misc_feature (1)..( 12): Result.001 file - promoters75/4282667
ctcgtataattc

SEQ ID NO: 78593 - DNA, 12 bp, Unknown
  misc_feature (1)..( 12): Result.001 file - promoters75/4282667
ttcgtttaacag

SEQ ID NO: 78594 - DNA, 12 bp, Unknown
  misc_feature (1)..( 12): Result.001 file - promoters75/4282788
ttcttattggaa

SEQ ID NO: 78595 - DNA, 8 bp, Unknown
  misc_feature (1)..( 8): Result.001 file - promoters75/4282788
gttgcttt

SEQ ID NO: 78596 - DNA, 8 bp, Unknown
  misc_feature (1)..( 8): Result.001 file - promoters75/4282788
tttgattt

SEQ ID NO: 78597 - DNA, 8 bp, Unknown
  misc_feature (1)..( 8): Result.001 file - promoters75/4283355
tttgattg

SEQ ID NO: 78598 - DNA, 10 bp, Unknown
  misc_feature (1)..( 10): Result.001 file - promoters75/4283355
gaaagaaaat

SEQ ID NO: 78599 - DNA, 10 bp, Unknown
  misc_feature (1)..( 10): Result.001 file - promoters75/4283355
caaacaaaac

SEQ ID NO: 78600 - DNA, 10 bp, Unknown
  misc_feature (1)..( 10): Result.001 file - promoters75/4283355
gtaagaaaaa

SEQ ID NO: 78601 - DNA, 10 bp, Unknown
  misc_feature (1)..( 10): Result.001 file - promoters75/4283355
gaaacaaagt

SEQ ID NO: 78602 - DNA, 10 bp, Unknown
  misc_feature (1)..( 10): Result.001 file - promoters75/4283355
tatacaaaaa

SEQ ID NO: 78603 - DNA, 10 bp, Unknown
  misc_feature (1)..( 10): Result.001 file - promoters75/4283355
tatataaaac

SEQ ID NO: 78604 - DNA, 10 bp, Unknown
  misc_feature (1)..( 10): Result.001 file - promoters75/4283355
aaatcaaaaa

SEQ ID NO: 78605 - DNA, 17 bp, Unknown
  misc_feature (1)..( 17): Result.001 file - promoters75/4283355
ctccactcttatgattt

SEQ ID NO: 78606 - DNA, 17 bp, Unknown
  misc_feature (1)..( 17): Result.001 file - promoters75/4283355
gctctctcgtataattc

SEQ ID NO: 78607 - DNA, 17 bp, Unknown
  misc_feature (1)..( 17): Result.001 file - promoters75/4283355
tctacttcttattggaa

SEQ ID NO: 78608 - DNA, 17 bp, Unknown
  misc_feature (1)..( 17): Result.001 file - promoters75/4283355
aagaacttccatgtttt

SEQ ID NO: 78609 - DNA, 17 bp, Unknown
  misc_feature (1)..( 17): Result.001 file - promoters75/4283355
ctctactcttggaatat

SEQ ID NO: 78610 - DNA, 17 bp, Unknown
  misc_feature (1)..( 17): Result.001 file - promoters75/4283355
tgacgttcttgccctct

SEQ ID NO: 78611 - DNA, 10 bp, Unknown
  misc_feature (1)..( 10): Result.001 file - promoters75/4283355
tttagttttg

SEQ ID NO: 78612 - DNA, 10 bp, Unknown
  misc_feature (1)..( 10): Result.001 file - promoters75/4283355
aaaagttttt

SEQ ID NO: 78613 - DNA, 10 bp, Unknown
  misc_feature (1)..( 10): Result.001 file - promoters75/4283355
tttactttta

SEQ ID NO: 78614 - DNA, 10 bp, Unknown
  misc_feature (1)..( 10): Result.001 file - promoters75/4283355
tagggttttt

SEQ ID NO: 78615 - DNA, 10 bp, Unknown
  misc_feature (1)..( 10): Result.001 file - promoters75/4283355
ggatgttttt

SEQ ID NO: 78616 - DNA, 10 bp, Unknown
  misc_feature (1)..( 10): Result.001 file - promoters75/4283378
acaagtttcc

SEQ ID NO: 78617 - DNA, 9 bp, Unknown
  misc_feature (1)..( 9): Result.001 file - promoters75/4283378
aatatatac

SEQ ID NO: 78618 - DNA, 9 bp, Unknown
  misc_feature (1)..( 9): Result.001 file - promoters75/4283378
agtatatac

SEQ ID NO: 78619 - DNA, 9 bp, Unknown
  misc_feature (1)..( 9): Result.001 file - promoters75/4283378
aatatgtac

SEQ ID NO: 78620 - DNA, 9 bp, Unknown
  misc_feature (1)..( 9): Result.001 file - promoters75/4283378
tatataata

SEQ ID NO: 78621 - DNA, 9 bp, Unknown
  misc_feature (1)..( 9): Result.001 file - promoters75/4283378
tatataaat

SEQ ID NO: 78622 - DNA, 9 bp, Unknown
  misc_feature (1)..( 9): Result.001 file - promoters75/4283378
cctataaat

SEQ ID NO: 78623 - DNA, 15 bp, Unknown
  misc_feature (1)..( 15): Result.001 file - promoters75/4283378
tacgttttaaaagta

SEQ ID NO: 78624 - DNA, 15 bp, Unknown
  misc_feature (1)..( 15): Result.001 file - promoters75/4283378
atatctttataagta

SEQ ID NO: 78625 - DNA, 15 bp, Unknown
  misc_feature (1)..( 15): Result.001 file - promoters75/4283378
ataactttatgttat

SEQ ID NO: 78626 - DNA, 8 bp, Unknown
  misc_feature (1)..( 8): Result.001 file - promoters75/4283378
aaatatca

SEQ ID NO: 78627 - DNA, 8 bp, Unknown
  misc_feature (1)..( 8): Result.001 file - promoters75/4283378
aaatgtca

SEQ ID NO: 78628 - DNA, 8 bp, Unknown
  misc_feature (1)..( 8): Result.001 file - promoters75/4577400
aaatgtta

SEQ ID NO: 78629 - DNA, 11 bp, Unknown
  misc_feature (1)..( 11): Result.001 file - promoters75/4577400
ccagaattaag

SEQ ID NO: 78630 - DNA, 11 bp, Unknown
  misc_feature (1)..( 11): Result.001 file - promoters75/4577400
ccataattagt

SEQ ID NO: 78631 - DNA, 11 bp, Unknown
  misc_feature (1)..( 11): Result.001 file - promoters75/4608096
atgtaattaag

SEQ ID NO: 78632 - DNA, 11 bp, Unknown
  misc_feature (1)..( 11): Result.001 file - promoters75/4608096
ttgattgatag

SEQ ID NO: 78633 - DNA, 11 bp, Unknown
  misc_feature (1)..( 11): Result.001 file - promoters75/4608096
gtctttgttag

SEQ ID NO: 78634 - DNA, 11 bp, Unknown
  misc_feature (1)..( 11): Result.001 file - promoters75/4608096
ctttttgttct

SEQ ID NO: 78635 - DNA, 11 bp, Unknown
  misc_feature (1)..( 11): Result.001 file - promoters75/4608096
ctttttgtatc

SEQ ID NO: 78636 - DNA, 11 bp, Unknown
  misc_feature (1)..( 11): Result.001 file - promoters75/4608096
ttttctgttca

SEQ ID NO: 78637 - DNA, 11 bp, Unknown
  misc_feature (1)..( 11): Result.001 file - promoters75/4608096
gggtttgttgt

SEQ ID NO: 78638 - DNA, 11 bp, Unknown
  misc_feature (1)..( 11): Result.001 file - promoters75/4608096
tttataaaacc

SEQ ID NO: 78639 - DNA, 11 bp, Unknown
  misc_feature (1)..( 11): Result.001 file - promoters75/4608096
actattaaagc

SEQ ID NO: 78640 - DNA, 11 bp, Unknown
  misc_feature (1)..( 11): Result.001 file - promoters75/4608096
tatataaatcc

SEQ ID NO: 78641 - DNA, 11 bp, Unknown
  misc_feature (1)..( 11): Result.001 file - promoters75/4608096
actataaaact

SEQ ID NO: 78642 - DNA, 11 bp, Unknown
  misc_feature (1)..( 11): Result.001 file - promoters75/4608096
taattaaaacc

SEQ ID NO: 78643 - DNA, 11 bp, Unknown
  misc_feature (1)..( 11): Result.001 file - promoters75/4608965
tttatgaatcc

SEQ ID NO: 78644 - DNA, 12 bp, Unknown
  misc_feature (1)..( 12): Result.001 file - promoters75/4608965
atttactttgga

SEQ ID NO: 78645 - DNA, 12 bp, Unknown
  misc_feature (1)..( 12): Result.001 file - promoters75/4608965
cattagtttcct

SEQ ID NO: 78646 - DNA, 12 bp, Unknown
  misc_feature (1)..( 12): Result.001 file - promoters75/4608965
gtttgcttcttt

SEQ ID NO: 78647 - DNA, 10 bp, Unknown
  misc_feature (1)..( 10): Result.001 file - promoters75/4608965
ttaatttcct

SEQ ID NO: 78648 - DNA, 12 bp, Unknown
  misc_feature (1)..( 12): Result.001 file - promoters75/4608965
cccaagtgtcct

SEQ ID NO: 78649 - DNA, 12 bp, Unknown
  misc_feature (1)..( 12): Result.001 file - promoters75/4608965
cattcgtttagt

SEQ ID NO: 78650 - DNA, 14 bp, Unknown
  misc_feature (1)..( 14): Result.001 file - promoters75/4608965
caaaagaatcagtg

SEQ ID NO: 78651 - DNA, 14 bp, Unknown
  misc_feature (1)..( 14): Result.001 file - promoters75/4608965
caaaacaattcaag

SEQ ID NO: 78652 - DNA, 14 bp, Unknown
  misc_feature (1)..( 14): Result.001 file - promoters75/4608965
agaacgaaatatct

SEQ ID NO: 78653 - DNA, 14 bp, Unknown
  misc_feature (1)..( 14): Result.001 file - promoters75/4608965
tttacgaaattgtg

SEQ ID NO: 78654 - DNA, 14 bp, Unknown
  misc_feature (1)..( 14): Result.001 file - promoters75/4608965
ccaacgaaacgatt

SEQ ID NO: 78655 - DNA, 14 bp, Unknown
  misc_feature (1)..( 14): Result.001 file - promoters75/4608985
ttccacagttctgt

SEQ ID NO: 78656 - DNA, 8 bp, Unknown
  misc_feature (1)..( 8): Result.001 file - promoters75/4608985
taaaaatt

SEQ ID NO: 78657 - DNA, 8 bp, Unknown
  misc_feature (1)..( 8): Result.001 file - promoters75/4608985
gtaaaatt

SEQ ID NO: 78658 - DNA, 8 bp, Unknown
  misc_feature (1)..( 8): Result.001 file - promoters75/4608985
taaaaatc

SEQ ID NO: 78659 - DNA, 9 bp, Unknown
  misc_feature (1)..( 9): Result.001 file - promoters75/4608985
aataaaatt

SEQ ID NO: 78660 - DNA, 9 bp, Unknown
  misc_feature (1)..( 9): Result.001 file - promoters75/4608985
gataatatt

SEQ ID NO: 78661 - DNA, 9 bp, Unknown
  misc_feature (1)..( 9): Result.001 file - promoters75/4608985
caaaaaact

SEQ ID NO: 78662 - DNA, 14 bp, Unknown
  misc_feature (1)..( 14): Result.001 file - promoters75/4608985
taaataaatttttg

SEQ ID NO: 78663 - DNA, 14 bp, Unknown
  misc_feature (1)..( 14): Result.001 file - promoters75/4608985
caaacaaatgtttg

SEQ ID NO: 78664 - DNA, 14 bp, Unknown
  misc_feature (1)..( 14): Result.001 file - promoters75/4608985
taactaatttctta

SEQ ID NO: 78665 - DNA, 15 bp, Unknown
  misc_feature (1)..( 15): Result.001 file - promoters75/4608985
taatataactcttgg

SEQ ID NO: 78666 - DNA, 10 bp, Unknown
  misc_feature (1)..( 10): Result.001 file - promoters75/4608985
aatattatta

SEQ ID NO: 78667 - DNA, 10 bp, Unknown
  misc_feature (1)..( 10): Result.001 file - promoters75/4608985
gttattatat

SEQ ID NO: 78668 - DNA, 10 bp, Unknown
  misc_feature (1)..( 10): Result.001 file - promoters75/4608985
gttaatatat

SEQ ID NO: 78669 - DNA, 10 bp, Unknown
  misc_feature (1)..( 10): Result.001 file - promoters75/4608985
aaaaactaat

SEQ ID NO: 78670 - DNA, 10 bp, Unknown
  misc_feature (1)..( 10): Result.001 file - promoters75/4608985
gaaaactcat

SEQ ID NO: 78671 - DNA, 11 bp, Unknown
  misc_feature (1)..( 11): Result.001 file - promoters75/4608985
aaataactaat

SEQ ID NO: 78672 - DNA, 11 bp, Unknown
  misc_feature (1)..( 11): Result.001 file - promoters75/4608985
agttaaaaaat

SEQ ID NO: 78673 - DNA, 11 bp, Unknown
  misc_feature (1)..( 11): Result.001 file - promoters75/4608985
agttaatatat

SEQ ID NO: 78674 - DNA, 11 bp, Unknown
  misc_feature (1)..( 11): Result.001 file - promoters75/4608985
tgttattatat

SEQ ID NO: 78675 - DNA, 11 bp, Unknown
  misc_feature (1)..( 11): Result.001 file - promoters75/4608985
agttatttaaa

SEQ ID NO: 78676 - DNA, 10 bp, Unknown
  misc_feature (1)..( 10): Result.001 file - promoters75/4608985
caaacaaaaa

SEQ ID NO: 78677 - DNA, 10 bp, Unknown
  misc_feature (1)..( 10): Result.001 file - promoters75/4608985
caaccaagtg

SEQ ID NO: 78678 - DNA, 10 bp, Unknown
  misc_feature (1)..( 10): Result.001 file - promoters75/4608985
caaacaaaaa

SEQ ID NO: 78679 - DNA, 8 bp, Unknown
  misc_feature (1)..( 8): Result.001 file - promoters75/4608985
attaatat

SEQ ID NO: 78680 - DNA, 8 bp, Unknown
  misc_feature (1)..( 8): Result.001 file - promoters75/4608985
tttattat

SEQ ID NO: 78681 - DNA, 8 bp, Unknown
  misc_feature (1)..( 8): Result.001 file - promoters75/4608985
tttatttt

SEQ ID NO: 78682 - DNA, 9 bp, Unknown
  misc_feature (1)..( 9): Result.001 file - promoters75/4608985
aaaaatgac

SEQ ID NO: 78683 - DNA, 9 bp, Unknown
  misc_feature (1)..( 9): Result.001 file - promoters75/4608985
aaaaaagac

SEQ ID NO: 78684 - DNA, 9 bp, Unknown
  misc_feature (1)..( 9): Result.001 file - promoters75/4608985
aaatacaag

SEQ ID NO: 78685 - DNA, 9 bp, Unknown
  misc_feature (1)..( 9): Result.001 file - promoters75/4608985
cttctattt

SEQ ID NO: 78686 - DNA, 9 bp, Unknown
  misc_feature (1)..( 9): Result.001 file - promoters75/4608985
cttttattt

SEQ ID NO: 78687 - DNA, 9 bp, Unknown
  misc_feature (1)..( 9): Result.001 file - promoters75/4608985
actttatta

SEQ ID NO: 78688 - DNA, 9 bp, Unknown
  misc_feature (1)..( 9): Result.001 file - promoters75/4608985
aatgatatt

SEQ ID NO: 78689 - DNA, 9 bp, Unknown
  misc_feature (1)..( 9): Result.001 file - promoters75/4608985
aataatata

SEQ ID NO: 78690 - DNA, 9 bp, Unknown
  misc_feature (1)..( 9): Result.001 file - promoters75/4608985
aatttaact

SEQ ID NO: 78691 - DNA, 8 bp, Unknown
  misc_feature (1)..( 8): Result.001 file - promoters75/4608985
aagtgaag

SEQ ID NO: 78692 - DNA, 8 bp, Unknown
  misc_feature (1)..( 8): Result.001 file - promoters75/4608985
cagtcaag

SEQ ID NO: 78693 - DNA, 8 bp, Unknown
  misc_feature (1)..( 8): Result.001 file - promoters75/4608985
cagccaac

SEQ ID NO: 78694 - DNA, 8 bp, Unknown
  misc_feature (1)..( 8): Result.001 file - promoters75/4608985
cctatata

SEQ ID NO: 78695 - DNA, 8 bp, Unknown
  misc_feature (1)..( 8): Result.001 file - promoters75/4608985
tatatata

SEQ ID NO: 78696 - DNA, 8 bp, Unknown
  misc_feature (1)..( 8): Result.001 file - promoters75/4610551
cctttata

SEQ ID NO: 78697 - DNA, 16 bp, Unknown
  misc_feature (1)..( 16): Result.001 file - promoters75/4610551
atttcacaaattctga

SEQ ID NO: 78698 - DNA, 16 bp, Unknown
  misc_feature (1)..( 16): Result.001 file - promoters75/4610551
atttcaaaaatactta

SEQ ID NO: 78699 - DNA, 16 bp, Unknown
  misc_feature (1)..( 16): Result.001 file - promoters75/4610551
ttccaacaaatgcatg

SEQ ID NO: 78700 - DNA, 16 bp, Unknown
  misc_feature (1)..( 16): Result.001 file - promoters75/4610551
aaaaaaaaaatcattt

SEQ ID NO: 78701 - DNA, 16 bp, Unknown
  misc_feature (1)..( 16): Result.001 file - promoters75/4610551
aaaacaaaaagaagac

SEQ ID NO: 78702 - DNA, 16 bp, Unknown
  misc_feature (1)..( 16): Result.001 file - promoters75/4610551
ttttgacaaataaatc

SEQ ID NO: 78703 - DNA, 10 bp, Unknown
  misc_feature (1)..( 10): Result.001 file - promoters75/4610551
gaaagaaacc

SEQ ID NO: 78704 - DNA, 10 bp, Unknown
  misc_feature (1)..( 10): Result.001 file - promoters75/4610551
caaataaatc

SEQ ID NO: 78705 - DNA, 10 bp, Unknown
  misc_feature (1)..( 10): Result.001 file - promoters75/4610551
caaagaactt

SEQ ID NO: 78706 - DNA, 10 bp, Unknown
  misc_feature (1)..( 10): Result.001 file - promoters75/4610551
gaaagagtga

SEQ ID NO: 78707 - DNA, 10 bp, Unknown
  misc_feature (1)..( 10): Result.001 file - promoters75/4610551
gaaaaaaaaa

SEQ ID NO: 78708 - DNA, 10 bp, Unknown
  misc_feature (1)..( 10): Result.001 file - promoters75/4610551
aaaacaaaaa

SEQ ID NO: 78709 - DNA, 13 bp, Unknown
  misc_feature (1)..( 13): Result.001 file - promoters75/4610551
tcggtgtttttgt

SEQ ID NO: 78710 - DNA, 13 bp, Unknown
  misc_feature (1)..( 13): Result.001 file - promoters75/4610551
gtggtcttttaat

SEQ ID NO: 78711 - DNA, 13 bp, Unknown
  misc_feature (1)..( 13): Result.001 file - promoters75/4610551
tcgctgtgtacca

SEQ ID NO: 78712 - DNA, 13 bp, Unknown
  misc_feature (1)..( 13): Result.001 file - promoters75/4610551
ggctagtttttgt

SEQ ID NO: 78713 - DNA, 13 bp, Unknown
  misc_feature (1)..( 13): Result.001 file - promoters75/4610551
tagctttcactat

SEQ ID NO: 78714 - DNA, 13 bp, Unknown
  misc_feature (1)..( 13): Result.001 file - promoters75/4610551
caaaaatttatgt

SEQ ID NO: 78715 - DNA, 11 bp, Unknown
  misc_feature (1)..( 11): Result.001 file - promoters75/4610551
aaagtctaaag

SEQ ID NO: 78716 - DNA, 11 bp, Unknown
  misc_feature (1)..( 11): Result.001 file - promoters75/4610551
gatatctaaaa

SEQ ID NO: 78717 - DNA, 12 bp, Unknown
  misc_feature (1)..( 12): Result.001 file - promoters75/4610551
gaaaactagaat

SEQ ID NO: 78718 - DNA, 12 bp, Unknown
  misc_feature (1)..( 12): Result.001 file - promoters75/4610551
tttatgtaatta

SEQ ID NO: 78719 - DNA, 12 bp, Unknown
  misc_feature (1)..( 12): Result.001 file - promoters75/4610551
tctatgtacttt

SEQ ID NO: 78720 - DNA, 12 bp, Unknown
  misc_feature (1)..( 12): Result.001 file - promoters75/4610551
tttttgtccacg

SEQ ID NO: 78721 - DNA, 13 bp, Unknown
  misc_feature (1)..( 13): Result.001 file - promoters75/4610551
ggtgtttttgtta

SEQ ID NO: 78722 - DNA, 13 bp, Unknown
  misc_feature (1)..( 13): Result.001 file - promoters75/4610551
aaaatttatgtaa

SEQ ID NO: 78723 - DNA, 13 bp, Unknown
  misc_feature (1)..( 13): Result.001 file - promoters75/4610551
ctagtttttgtcc

SEQ ID NO: 78724 - DNA, 13 bp, Unknown
  misc_feature (1)..( 13): Result.001 file - promoters75/4610551
tagctttcactat

SEQ ID NO: 78725 - DNA, 13 bp, Unknown
  misc_feature (1)..( 13): Result.001 file - promoters75/4610551
gagagatatctaa

SEQ ID NO: 78726 - DNA, 13 bp, Unknown
  misc_feature (1)..( 13): Result.001 file - promoters75/4766490
cacatctatgtac

SEQ ID NO: 78727 - DNA, 10 bp, Unknown
  misc_feature (1)..( 10): Result.001 file - promoters75/4766490
tttgaaaaga

SEQ ID NO: 78728 - DNA, 10 bp, Unknown
  misc_feature (1)..( 10): Result.001 file - promoters75/4766490
aaaaaaaaga

SEQ ID NO: 78729 - DNA, 11 bp, Unknown
  misc_feature (1)..( 11): Result.001 file - promoters75/4766490
gaagaaacaga

SEQ ID NO: 78730 - DNA, 12 bp, Unknown
  misc_feature (1)..( 12): Result.001 file - promoters75/4766490
tgaaaagatgaa

SEQ ID NO: 78731 - DNA, 12 bp, Unknown
  misc_feature (1)..( 12): Result.001 file - promoters75/4766490
acacaagaagaa

SEQ ID NO: 78732 - DNA, 12 bp, Unknown
  misc_feature (1)..( 12): Result.001 file - promoters75/4766977
gaaaaaaaagaa

SEQ ID NO: 78733 - DNA, 10 bp, Unknown
  misc_feature (1)..( 10): Result.001 file - promoters75/4766977
ctataaatag

SEQ ID NO: 78734 - DNA, 10 bp, Unknown
  misc_feature (1)..( 10): Result.001 file - promoters75/4766977
ctataaaaaa

SEQ ID NO: 78735 - DNA, 10 bp, Unknown
  misc_feature (1)..( 10): Result.001 file - promoters75/4767487
atataaatag

SEQ ID NO: 78736 - DNA, 15 bp, Unknown
  misc_feature (1)..( 15): Result.001 file - promoters75/4767487
gtacatctttaaaaa

SEQ ID NO: 78737 - DNA, 15 bp, Unknown
  misc_feature (1)..( 15): Result.001 file - promoters75/4767487
ttaattttttcaaaa

SEQ ID NO: 78738 - DNA, 15 bp, Unknown
  misc_feature (1)..( 15): Result.001 file - promoters75/4767487
ttaattttttcaagt

SEQ ID NO: 78739 - DNA, 10 bp, Unknown
  misc_feature (1)..( 10): Result.001 file - promoters75/4767487
ttatgaatga

SEQ ID NO: 78740 - DNA, 10 bp, Unknown
  misc_feature (1)..( 10): Result.001 file - promoters75/4767487
ttatgattaa

SEQ ID NO: 78741 - DNA, 10 bp, Unknown
  misc_feature (1)..( 10): Result.001 file - promoters75/4767487
atatcattaa

SEQ ID NO: 78742 - DNA, 9 bp, Unknown
  misc_feature (1)..( 9): Result.001 file - promoters75/4767487
tatttaaac

SEQ ID NO: 78743 - DNA, 9 bp, Unknown
  misc_feature (1)..( 9): Result.001 file - promoters75/4767487
tatataaac

SEQ ID NO: 78744 - DNA, 9 bp, Unknown
  misc_feature (1)..( 9): Result.001 file - promoters75/4767701
cctataaac

SEQ ID NO: 78745 - DNA, 12 bp, Unknown
  misc_feature (1)..( 12): Result.001 file - promoters75/4767701
gttataaatcgt

SEQ ID NO: 78746 - DNA, 12 bp, Unknown
  misc_feature (1)..( 12): Result.001 file - promoters75/4767701
tctatgaatcat

SEQ ID NO: 78747 - DNA, 12 bp, Unknown
  misc_feature (1)..( 12): Result.001 file - promoters75/4767701
attataaatcat

SEQ ID NO: 78748 - DNA, 12 bp, Unknown
  misc_feature (1)..( 12): Result.001 file - promoters75/4767701
tctttgaatatt

SEQ ID NO: 78749 - DNA, 12 bp, Unknown
  misc_feature (1)..( 12): Result.001 file - promoters75/4767701
tctttggattaa

SEQ ID NO: 78750 - DNA, 12 bp, Unknown
  misc_feature (1)..( 12): Result.001 file - promoters75/4767701
ctcttgcataga

SEQ ID NO: 78751 - DNA, 12 bp, Unknown
  misc_feature (1)..( 12): Result.001 file - promoters75/4767701
taataaactctt

SEQ ID NO: 78752 - DNA, 12 bp, Unknown
  misc_feature (1)..( 12): Result.001 file - promoters75/4767701
aaataaaaattg

SEQ ID NO: 78753 - DNA, 12 bp, Unknown
  misc_feature (1)..( 12): Result.001 file - promoters75/4767701
taacaaaacaat

SEQ ID NO: 78754 - DNA, 12 bp, Unknown
  misc_feature (1)..( 12): Result.001 file - promoters75/4767701
aaataatgtaat

SEQ ID NO: 78755 - DNA, 13 bp, Unknown
  misc_feature (1)..( 13): Result.001 file - promoters75/4767701
caacgaaacgatt

SEQ ID NO: 78756 - DNA, 13 bp, Unknown
  misc_feature (1)..( 13): Result.001 file - promoters75/4767982
aaattatgttatt

SEQ ID NO: 78757 - DNA, 10 bp, Unknown
  misc_feature (1)..( 10): Result.001 file - promoters75/4767982
ttaaacttgt

SEQ ID NO: 78758 - DNA, 10 bp, Unknown
  misc_feature (1)..( 10): Result.001 file - promoters75/4767982
ttaaacttgc

SEQ ID NO: 78759 - DNA, 10 bp, Unknown
  misc_feature (1)..( 10): Result.001 file - promoters75/4768285
acaaacatgt

SEQ ID NO: 78760 - DNA, 6 bp, Unknown
  misc_feature (1)..( 6): Result.001 file - promoters75/4768285
atgatc

SEQ ID NO: 78761 - DNA, 6 bp, Unknown
  misc_feature (1)..( 6): Result.001 file - promoters75/4768285
atgatc

SEQ ID NO: 78762 - DNA, 6 bp, Unknown
  misc_feature (1)..( 6): Result.001 file - promoters75/4768285
atgatc

SEQ ID NO: 78763 - DNA, 7 bp, Unknown
  misc_feature (1)..( 7): Result.001 file - promoters75/4768285
tttcatt

SEQ ID NO: 78764 - DNA, 7 bp, Unknown
  misc_feature (1)..( 7): Result.001 file - promoters75/4768285
tttgatt

SEQ ID NO: 78765 - DNA, 7 bp, Unknown
  misc_feature (1)..( 7): Result.001 file - promoters75/4768289
tttaatt

SEQ ID NO: 78766 - DNA, 9 bp, Unknown
  misc_feature (1)..( 9): Result.001 file - promoters75/4768289
gtttattaa

SEQ ID NO: 78767 - DNA, 9 bp, Unknown
  misc_feature (1)..( 9): Result.001 file - promoters75/4768289
atttattaa

SEQ ID NO: 78768 - DNA, 9 bp, Unknown
  misc_feature (1)..( 9): Result.001 file - promoters75/4768354
gtttatgaa

SEQ ID NO: 78769 - DNA, 11 bp, Unknown
  misc_feature (1)..( 11): Result.001 file - promoters75/4768354
taacatttttt

SEQ ID NO: 78770 - DNA, 11 bp, Unknown
  misc_feature (1)..( 11): Result.001 file - promoters75/4768354
taagatttttg

SEQ ID NO: 78771 - DNA, 11 bp, Unknown
  misc_feature (1)..( 11): Result.001 file - promoters75/4768354
tagaatttttt

SEQ ID NO: 78772 - DNA, 9 bp, Unknown
  misc_feature (1)..( 9): Result.001 file - promoters75/4768354
tttaatcag

SEQ ID NO: 78773 - DNA, 9 bp, Unknown
  misc_feature (1)..( 9): Result.001 file - promoters75/4768354
tttattcag

SEQ ID NO: 78774 - DNA, 9 bp, Unknown
  misc_feature (1)..( 9): Result.001 file - promoters75/4768615
gttattcga

SEQ ID NO: 78775 - DNA, 8 bp, Unknown
  misc_feature (1)..( 8): Result.001 file - promoters75/4768615
taaaaatt

SEQ ID NO: 78776 - DNA, 8 bp, Unknown
  misc_feature (1)..( 8): Result.001 file - promoters75/4768615
gtaaaatt

SEQ ID NO: 78777 - DNA, 8 bp, Unknown
  misc_feature (1)..( 8): Result.001 file - promoters75/4768615
taaaaatc

SEQ ID NO: 78778 - DNA, 9 bp, Unknown
  misc_feature (1)..( 9): Result.001 file - promoters75/4768615
aataaaatt

SEQ ID NO: 78779 - DNA, 9 bp, Unknown
  misc_feature (1)..( 9): Result.001 file - promoters75/4768615
gataatatt

SEQ ID NO: 78780 - DNA, 9 bp, Unknown
  misc_feature (1)..( 9): Result.001 file - promoters75/4768615
caaaaaact

SEQ ID NO: 78781 - DNA, 14 bp, Unknown
  misc_feature (1)..( 14): Result.001 file - promoters75/4768615
taaataaatttttg

SEQ ID NO: 78782 - DNA, 14 bp, Unknown
  misc_feature (1)..( 14): Result.001 file - promoters75/4768615
caaacaaatgtttg

SEQ ID NO: 78783 - DNA, 14 bp, Unknown
  misc_feature (1)..( 14): Result.001 file - promoters75/4768615
taactaatttctta

SEQ ID NO: 78784 - DNA, 15 bp, Unknown
  misc_feature (1)..( 15): Result.001 file - promoters75/4768615
taatataactcttgg

SEQ ID NO: 78785 - DNA, 10 bp, Unknown
  misc_feature (1)..( 10): Result.001 file - promoters75/4768615
aatattatta

SEQ ID NO: 78786 - DNA, 10 bp, Unknown
  misc_feature (1)..( 10): Result.001 file - promoters75/4768615
gttattatat

SEQ ID NO: 78787 - DNA, 10 bp, Unknown
  misc_feature (1)..( 10): Result.001 file - promoters75/4768615
gttaatatat

SEQ ID NO: 78788 - DNA, 10 bp, Unknown
  misc_feature (1)..( 10): Result.001 file - promoters75/4768615
aaaaactaat

SEQ ID NO: 78789 - DNA, 10 bp, Unknown
  misc_feature (1)..( 10): Result.001 file - promoters75/4768615
gaaaactcat

SEQ ID NO: 78790 - DNA, 11 bp, Unknown
  misc_feature (1)..( 11): Result.001 file - promoters75/4768615
aaataactaat

SEQ ID NO: 78791 - DNA, 11 bp, Unknown
  misc_feature (1)..( 11): Result.001 file - promoters75/4768615
agttaaaaaat

SEQ ID NO: 78792 - DNA, 11 bp, Unknown
  misc_feature (1)..( 11): Result.001 file - promoters75/4768615
agttaatatat

SEQ ID NO: 78793 - DNA, 11 bp, Unknown
  misc_feature (1)..( 11): Result.001 file - promoters75/4768615
tgttattatat

SEQ ID NO: 78794 - DNA, 11 bp, Unknown
  misc_feature (1)..( 11): Result.001 file - promoters75/4768615
agttatttaaa

SEQ ID NO: 78795 - DNA, 10 bp, Unknown
  misc_feature (1)..( 10): Result.001 file - promoters75/4768615
caaacaaaaa

SEQ ID NO: 78796 - DNA, 10 bp, Unknown
  misc_feature (1)..( 10): Result.001 file - promoters75/4768615
caaccaagtg

SEQ ID NO: 78797 - DNA, 10 bp, Unknown
  misc_feature (1)..( 10): Result.001 file - promoters75/4768615
caaacaaaaa

SEQ ID NO: 78798 - DNA, 8 bp, Unknown
  misc_feature (1)..( 8): Result.001 file - promoters75/4768615
attaatat

SEQ ID NO: 78799 - DNA, 8 bp, Unknown
  misc_feature (1)..( 8): Result.001 file - promoters75/4768615
tttattat

SEQ ID NO: 78800 - DNA, 8 bp, Unknown
  misc_feature (1)..( 8): Result.001 file - promoters75/4768615
tttatttt

SEQ ID NO: 78801 - DNA, 9 bp, Unknown
  misc_feature (1)..( 9): Result.001 file - promoters75/4768615
aaaaatgac

SEQ ID NO: 78802 - DNA, 9 bp, Unknown
  misc_feature (1)..( 9): Result.001 file - promoters75/4768615
aaaaaagac

SEQ ID NO: 78803 - DNA, 9 bp, Unknown
  misc_feature (1)..( 9): Result.001 file - promoters75/4768615
aaatacaag

SEQ ID NO: 78804 - DNA, 9 bp, Unknown
  misc_feature (1)..( 9): Result.001 file - promoters75/4768615
cttctattt

SEQ ID NO: 78805 - DNA, 9 bp, Unknown
  misc_feature (1)..( 9): Result.001 file - promoters75/4768615
cttttattt

SEQ ID NO: 78806 - DNA, 9 bp, Unknown
  misc_feature (1)..( 9): Result.001 file - promoters75/4768615
actttatta

SEQ ID NO: 78807 - DNA, 9 bp, Unknown
  misc_feature (1)..( 9): Result.001 file - promoters75/4768615
aatgatatt

SEQ ID NO: 78808 - DNA, 9 bp, Unknown
  misc_feature (1)..( 9): Result.001 file - promoters75/4768615
aataatata

SEQ ID NO: 78809 - DNA, 9 bp, Unknown
  misc_feature (1)..( 9): Result.001 file - promoters75/4768615
aatttaact

SEQ ID NO: 78810 - DNA, 8 bp, Unknown
  misc_feature (1)..( 8): Result.001 file - promoters75/4768615
aagtgaag

SEQ ID NO: 78811 - DNA, 8 bp, Unknown
  misc_feature (1)..( 8): Result.001 file - promoters75/4768615
cagtcaag

SEQ ID NO: 78812 - DNA, 8 bp, Unknown
  misc_feature (1)..( 8): Result.001 file - promoters75/4768615
cagccaac

SEQ ID NO: 78813 - DNA, 8 bp, Unknown
  misc_feature (1)..( 8): Result.001 file - promoters75/4768615
cctatata

SEQ ID NO: 78814 - DNA, 8 bp, Unknown
  misc_feature (1)..( 8): Result.001 file - promoters75/4768615
tatatata

SEQ ID NO: 78815 - DNA, 8 bp, Unknown
  misc_feature (1)..( 8): Result.001 file - promoters75/4768635
cctttata

SEQ ID NO: 78816 - DNA, 18 bp, Unknown
  misc_feature (1)..( 18): Result.001 file - promoters75/4768635
aacttaattctttttaca

SEQ ID NO: 78817 - DNA, 18 bp, Unknown
  misc_feature (1)..( 18): Result.001 file - promoters75/4768635
attgtaatccttttgttg

SEQ ID NO: 78818 - DNA, 18 bp, Unknown
  misc_feature (1)..( 18): Result.001 file - promoters75/4768635
aaatttttacttttaaca

SEQ ID NO: 78819 - DNA, 18 bp, Unknown
  misc_feature (1)..( 18): Result.001 file - promoters75/4768635
aacttaatttttttttgt

SEQ ID NO: 78820 - DNA, 18 bp, Unknown
  misc_feature (1)..( 18): Result.001 file - promoters75/4768635
tataataggtttttattt

SEQ ID NO: 78821 - DNA, 18 bp, Unknown
  misc_feature (1)..( 18): Result.001 file - promoters75/4768635
gatttgattttttctgga

SEQ ID NO: 78822 - DNA, 8 bp, Unknown
  misc_feature (1)..( 8): Result.001 file - promoters75/4768635
gttttgta

SEQ ID NO: 78823 - DNA, 8 bp, Unknown
  misc_feature (1)..( 8): Result.001 file - promoters75/4768635
cttttgtt

SEQ ID NO: 78824 - DNA, 8 bp, Unknown
  misc_feature (1)..( 8): Result.001 file - promoters75/4768635
tttttatt

SEQ ID NO: 78825 - DNA, 8 bp, Unknown
  misc_feature (1)..( 8): Result.001 file - promoters75/4768635
tttttgtt

SEQ ID NO: 78826 - DNA, 8 bp, Unknown
  misc_feature (1)..( 8): Result.001 file - promoters75/4768635
tttttact

SEQ ID NO: 78827 - DNA, 15 bp, Unknown
  misc_feature (1)..( 15): Result.001 file - promoters75/4768635
ttaattctttttaca

SEQ ID NO: 78828 - DNA, 15 bp, Unknown
  misc_feature (1)..( 15): Result.001 file - promoters75/4768635
taataggtttttatt

SEQ ID NO: 78829 - DNA, 15 bp, Unknown
  misc_feature (1)..( 15): Result.001 file - promoters75/4768635
acacaaatttttact

SEQ ID NO: 78830 - DNA, 15 bp, Unknown
  misc_feature (1)..( 15): Result.001 file - promoters75/4768635
aacttaatttttttt

SEQ ID NO: 78831 - DNA, 15 bp, Unknown
  misc_feature (1)..( 15): Result.001 file - promoters75/4768635
ccttttgttgttact

SEQ ID NO: 78832 - DNA, 15 bp, Unknown
  misc_feature (1)..( 15): Result.001 file - promoters75/4768635
gatttgattttttct

SEQ ID NO: 78833 - DNA, 8 bp, Unknown
  misc_feature (1)..( 8): Result.001 file - promoters75/4768635
tttgttag

SEQ ID NO: 78834 - DNA, 8 bp, Unknown
  misc_feature (1)..( 8): Result.001 file - promoters75/4768635
tttgtttt

SEQ ID NO: 78835 - DNA, 8 bp, Unknown
  misc_feature (1)..( 8): Result.001 file - promoters75/4768635
ttttttag

SEQ ID NO: 78836 - DNA, 8 bp, Unknown
  misc_feature (1)..( 8): Result.001 file - promoters75/4768635
tttttggt

SEQ ID NO: 78837 - DNA, 9 bp, Unknown
  misc_feature (1)..( 9): Result.001 file - promoters75/4768635
attgattaa

SEQ ID NO: 78838 - DNA, 9 bp, Unknown
  misc_feature (1)..( 9): Result.001 file - promoters75/4768635
gtttttgta

SEQ ID NO: 78839 - DNA, 9 bp, Unknown
  misc_feature (1)..( 9): Result.001 file - promoters75/4768635
atttttggt

SEQ ID NO: 78840 - DNA, 9 bp, Unknown
  misc_feature (1)..( 9): Result.001 file - promoters75/4768635
atttttctg

SEQ ID NO: 78841 - DNA, 9 bp, Unknown
  misc_feature (1)..( 9): Result.001 file - promoters75/4768635
gtttttgat

SEQ ID NO: 78842 - DNA, 9 bp, Unknown
  misc_feature (1)..( 9): Result.001 file - promoters75/4768635
tttttaggt

SEQ ID NO: 78843 - DNA, 9 bp, Unknown
  misc_feature (1)..( 9): Result.001 file - promoters75/4768635
tatttcaaa

SEQ ID NO: 78844 - DNA, 9 bp, Unknown
  misc_feature (1)..( 9): Result.001 file - promoters75/4768635
tggttcaaa

SEQ ID NO: 78845 - DNA, 9 bp, Unknown
  misc_feature (1)..( 9): Result.001 file - promoters75/4768635
ttgttcaaa

SEQ ID NO: 78846 - DNA, 9 bp, Unknown
  misc_feature (1)..( 9): Result.001 file - promoters75/4768635
aattttaaa

SEQ ID NO: 78847 - DNA, 9 bp, Unknown
  misc_feature (1)..( 9): Result.001 file - promoters75/4769059
aatttttac

SEQ ID NO: 78848 - DNA, 12 bp, Unknown
  misc_feature (1)..( 12): Result.001 file - promoters75/4769059
ctatctctttat

SEQ ID NO: 78849 - DNA, 12 bp, Unknown
  misc_feature (1)..( 12): Result.001 file - promoters75/4769059
ttatatctgtat

SEQ ID NO: 78850 - DNA, 12 bp, Unknown
  misc_feature (1)..( 12): Result.001 file - promoters75/4770305
ttagatcgtacc

SEQ ID NO: 78851 - DNA, 8 bp, Unknown
  misc_feature (1)..( 8): Result.001 file - promoters75/4770305
cttttaga

SEQ ID NO: 78852 - DNA, 8 bp, Unknown
  misc_feature (1)..( 8): Result.001 file - promoters75/4770305
tgtttaga

SEQ ID NO: 78853 - DNA, 8 bp, Unknown
  misc_feature (1)..( 8): Result.001 file - promoters75/4770443
tgttgaga

SEQ ID NO: 78854 - DNA, 10 bp, Unknown
  misc_feature (1)..( 10): Result.001 file - promoters75/4770443
aaaatagttt

SEQ ID NO: 78855 - DNA, 10 bp, Unknown
  misc_feature (1)..( 10): Result.001 file - promoters75/4770443
aaaatagtac

SEQ ID NO: 78856 - DNA, 10 bp, Unknown
  misc_feature (1)..( 10): Result.001 file - promoters75/4770443
caaagaattt

SEQ ID NO: 78857 - DNA, 11 bp, Unknown
  misc_feature (1)..( 11): Result.001 file - promoters75/4770443
tggagaagttt

SEQ ID NO: 78858 - DNA, 13 bp, Unknown
  misc_feature (1)..( 13): Result.001 file - promoters75/4770443
tctaattttgtca

SEQ ID NO: 78859 - DNA, 13 bp, Unknown
  misc_feature (1)..( 13): Result.001 file - promoters75/4770443
ataaattttatca

SEQ ID NO: 78860 - DNA, 13 bp, Unknown
  misc_feature (1)..( 13): Result.001 file - promoters75/4770443
ttctattttttta

SEQ ID NO: 78861 - DNA, 9 bp, Unknown
  misc_feature (1)..( 9): Result.001 file - promoters75/4770443
gtagtcaaa

SEQ ID NO: 78862 - DNA, 9 bp, Unknown
  misc_feature (1)..( 9): Result.001 file - promoters75/4770443
atagacaaa

SEQ ID NO: 78863 - DNA, 9 bp, Unknown
  misc_feature (1)..( 9): Result.001 file - promoters75/4770443
atatacaca

SEQ ID NO: 78864 - DNA, 9 bp, Unknown
  misc_feature (1)..( 9): Result.001 file - promoters75/4770443
aaaaaggat

SEQ ID NO: 78865 - DNA, 9 bp, Unknown
  misc_feature (1)..( 9): Result.001 file - promoters75/4770443
aaaaatgat

SEQ ID NO: 78866 - DNA, 9 bp, Unknown
  misc_feature (1)..( 9): Result.001 file - promoters75/4770443
aaaaatatt

SEQ ID NO: 78867 - DNA, 12 bp, Unknown
  misc_feature (1)..( 12): Result.001 file - promoters75/4770443
aaatattttttt

SEQ ID NO: 78868 - DNA, 12 bp, Unknown
  misc_feature (1)..( 12): Result.001 file - promoters75/4770443
aaaaattttttt

SEQ ID NO: 78869 - DNA, 12 bp, Unknown
  misc_feature (1)..( 12): Result.001 file - promoters75/4770477
atttgtttattt

SEQ ID NO: 78870 - DNA, 11 bp, Unknown
  misc_feature (1)..( 11): Result.001 file - promoters75/4770477
tatagttcagc

SEQ ID NO: 78871 - DNA, 11 bp, Unknown
  misc_feature (1)..( 11): Result.001 file - promoters75/4770477
tatacttcagt

SEQ ID NO: 78872 - DNA, 11 bp, Unknown
  misc_feature (1)..( 11): Result.001 file - promoters75/4771239
ttgatttcagt

SEQ ID NO: 78873 - DNA, 9 bp, Unknown
  misc_feature (1)..( 9): Result.001 file - promoters75/4771239
ttgacgacg

SEQ ID NO: 78874 - DNA, 9 bp, Unknown
  misc_feature (1)..( 9): Result.001 file - promoters75/4771239
ttggcgaga

SEQ ID NO: 78875 - DNA, 9 bp, Unknown
  misc_feature (1)..( 9): Result.001 file - promoters75/4771271
ccggcaaga

SEQ ID NO: 78876 - DNA, 7 bp, Unknown
  misc_feature (1)..( 7): Result.001 file - promoters75/4771271
ttttgct

SEQ ID NO: 78877 - DNA, 7 bp, Unknown
  misc_feature (1)..( 7): Result.001 file - promoters75/4771271
ttttgcc

SEQ ID NO: 78878 - DNA, 7 bp, Unknown
  misc_feature (1)..( 7): Result.001 file - promoters75/4771271
ttttgct

SEQ ID NO: 78879 - DNA, 9 bp, Unknown
  misc_feature (1)..( 9): Result.001 file - promoters75/4771271
aaattaaac

SEQ ID NO: 78880 - DNA, 9 bp, Unknown
  misc_feature (1)..( 9): Result.001 file - promoters75/4771271
aaaataaat

SEQ ID NO: 78881 - DNA, 9 bp, Unknown
  misc_feature (1)..( 9): Result.001 file - promoters75/4771271
attttaaac

SEQ ID NO: 78882 - DNA, 8 bp, Unknown
  misc_feature (1)..( 8): Result.001 file - promoters75/4771271
tattatta

SEQ ID NO: 78883 - DNA, 8 bp, Unknown
  misc_feature (1)..( 8): Result.001 file - promoters75/4771271
tatgattt

SEQ ID NO: 78884 - DNA, 8 bp, Unknown
  misc_feature (1)..( 8): Result.001 file - promoters75/4771271
ttggatta

SEQ ID NO: 78885 - DNA, 10 bp, Unknown
  misc_feature (1)..( 10): Result.001 file - promoters75/4771271
aaccaaattg

SEQ ID NO: 78886 - DNA, 10 bp, Unknown
  misc_feature (1)..( 10): Result.001 file - promoters75/4771271
ataaaaattg

SEQ ID NO: 78887 - DNA, 10 bp, Unknown
  misc_feature (1)..( 10): Result.001 file - promoters75/4771271
aacaaaattt

SEQ ID NO: 78888 - DNA, 13 bp, Unknown
  misc_feature (1)..( 13): Result.001 file - promoters75/4771271
gtttttcatggaa

SEQ ID NO: 78889 - DNA, 13 bp, Unknown
  misc_feature (1)..( 13): Result.001 file - promoters75/4771271
gtttttttaaagc

SEQ ID NO: 78890 - DNA, 13 bp, Unknown
  misc_feature (1)..( 13): Result.001 file - promoters75/4771271
attttgcatagaa

SEQ ID NO: 78891 - DNA, 8 bp, Unknown
  misc_feature (1)..( 8): Result.001 file - promoters75/4771271
gttatata

SEQ ID NO: 78892 - DNA, 8 bp, Unknown
  misc_feature (1)..( 8): Result.001 file - promoters75/4771271
gttaaata

SEQ ID NO: 78893 - DNA, 8 bp, Unknown
  misc_feature (1)..( 8): Result.001 file - promoters75/4771271
tttaaatt

SEQ ID NO: 78894 - DNA, 12 bp, Unknown
  misc_feature (1)..( 12): Result.001 file - promoters75/4771271
aattaaacaagt

SEQ ID NO: 78895 - DNA, 12 bp, Unknown
  misc_feature (1)..( 12): Result.001 file - promoters75/4771271
tgataaaaaagt

SEQ ID NO: 78896 - DNA, 12 bp, Unknown
  misc_feature (1)..( 12): Result.001 file - promoters75/4771271
tgataaaataaa

SEQ ID NO: 78897 - DNA, 9 bp, Unknown
  misc_feature (1)..( 9): Result.001 file - promoters75/4771271
ataaccaaa

SEQ ID NO: 78898 - DNA, 9 bp, Unknown
  misc_feature (1)..( 9): Result.001 file - promoters75/4771271
tgaacaaaa

SEQ ID NO: 78899 - DNA, 9 bp, Unknown
  misc_feature (1)..( 9): Result.001 file - promoters75/4771271
taaacaaga

SEQ ID NO: 78900 - DNA, 9 bp, Unknown
  misc_feature (1)..( 9): Result.001 file - promoters75/4771271
aatgtttta

SEQ ID NO: 78901 - DNA, 9 bp, Unknown
  misc_feature (1)..( 9): Result.001 file - promoters75/4771271
aatattttg

SEQ ID NO: 78902 - DNA, 9 bp, Unknown
  misc_feature (1)..( 9): Result.001 file - promoters75/4771271
aatatgttg

SEQ ID NO: 78903 - DNA, 10 bp, Unknown
  misc_feature (1)..( 10): Result.001 file - promoters75/4771271
gtagggtttt

SEQ ID NO: 78904 - DNA, 10 bp, Unknown
  misc_feature (1)..( 10): Result.001 file - promoters75/4771271
ttaggttttt

SEQ ID NO: 78905 - DNA, 10 bp, Unknown
  misc_feature (1)..( 10): Result.001 file - promoters75/4771271
ttaggtttgg

SEQ ID NO: 78906 - DNA, 8 bp, Unknown
  misc_feature (1)..( 8): Result.001 file - promoters75/4771271
tttatttt

SEQ ID NO: 78907 - DNA, 8 bp, Unknown
  misc_feature (1)..( 8): Result.001 file - promoters75/4771271
attatttt

SEQ ID NO: 78908 - DNA, 8 bp, Unknown
  misc_feature (1)..( 8): Result.001 file - promoters75/4771321
attctttt

SEQ ID NO: 78909 - DNA, 10 bp, Unknown
  misc_feature (1)..( 10): Result.001 file - promoters75/4771321
tgtgacatgg

SEQ ID NO: 78910 - DNA, 10 bp, Unknown
  misc_feature (1)..( 10): Result.001 file - promoters75/4771321
tgtgacgggt

SEQ ID NO: 78911 - DNA, 10 bp, Unknown
  misc_feature (1)..( 10): Result.001 file - promoters75/4771321
agtgtcgggt

SEQ ID NO: 78912 - DNA, 9 bp, Unknown
  misc_feature (1)..( 9): Result.001 file - promoters75/4771321
gaacacata

SEQ ID NO: 78913 - DNA, 9 bp, Unknown
  misc_feature (1)..( 9): Result.001 file - promoters75/4771321
gaaaacaga

SEQ ID NO: 78914 - DNA, 9 bp, Unknown
  misc_feature (1)..( 9): Result.001 file - promoters75/4771334
gaaaccaga

SEQ ID NO: 78915 - DNA, 10 bp, Unknown
  misc_feature (1)..( 10): Result.001 file - promoters75/4771334
taaaacaaaa

SEQ ID NO: 78916 - DNA, 10 bp, Unknown
  misc_feature (1)..( 10): Result.001 file - promoters75/4771334
gaaaataaat

SEQ ID NO: 78917 - DNA, 10 bp, Unknown
  misc_feature (1)..( 10): Result.001 file - promoters75/4771334
taaaacttct

SEQ ID NO: 78918 - DNA, 10 bp, Unknown
  misc_feature (1)..( 10): Result.001 file - promoters75/4771334
attaataaat

SEQ ID NO: 78919 - DNA, 10 bp, Unknown
  misc_feature (1)..( 10): Result.001 file - promoters75/4771334
aagaataaaa

SEQ ID NO: 78920 - DNA, 14 bp, Unknown
  misc_feature (1)..( 14): Result.001 file - promoters75/4771334
ttgcttctcccaag

SEQ ID NO: 78921 - DNA, 14 bp, Unknown
  misc_feature (1)..( 14): Result.001 file - promoters75/4771334
gtgcttccaacaaa

SEQ ID NO: 78922 - DNA, 14 bp, Unknown
  misc_feature (1)..( 14): Result.001 file - promoters75/4771334
gtgcttcaaacaaa

SEQ ID NO: 78923 - DNA, 14 bp, Unknown
  misc_feature (1)..( 14): Result.001 file - promoters75/4771334
catcttcaaaatta

SEQ ID NO: 78924 - DNA, 14 bp, Unknown
  misc_feature (1)..( 14): Result.001 file - promoters75/4771334
ttatttcaaatgac

SEQ ID NO: 78925 - DNA, 10 bp, Unknown
  misc_feature (1)..( 10): Result.001 file - promoters75/4771334
caaaacatat

SEQ ID NO: 78926 - DNA, 10 bp, Unknown
  misc_feature (1)..( 10): Result.001 file - promoters75/4771334
taaaaaatat

SEQ ID NO: 78927 - DNA, 10 bp, Unknown
  misc_feature (1)..( 10): Result.001 file - promoters75/4771334
caagacattt

SEQ ID NO: 78928 - DNA, 10 bp, Unknown
  misc_feature (1)..( 10): Result.001 file - promoters75/4771334
taaaaaagtg

SEQ ID NO: 78929 - DNA, 10 bp, Unknown
  misc_feature (1)..( 10): Result.001 file - promoters75/4771334
taataaattt

SEQ ID NO: 78930 - DNA, 10 bp, Unknown
  misc_feature (1)..( 10): Result.001 file - promoters75/4771334
aagaaaataa

SEQ ID NO: 78931 - DNA, 9 bp, Unknown
  misc_feature (1)..( 9): Result.001 file - promoters75/4771334
gttaaaaaa

SEQ ID NO: 78932 - DNA, 9 bp, Unknown
  misc_feature (1)..( 9): Result.001 file - promoters75/4771334
attaagaaa

SEQ ID NO: 78933 - DNA, 9 bp, Unknown
  misc_feature (1)..( 9): Result.001 file - promoters75/4771334
tctaaaaaa

SEQ ID NO: 78934 - DNA, 9 bp, Unknown
  misc_feature (1)..( 9): Result.001 file - promoters75/4771334
attaataaa

SEQ ID NO: 78935 - DNA, 9 bp, Unknown
  misc_feature (1)..( 9): Result.001 file - promoters75/4771495
aagaataaa

SEQ ID NO: 78936 - DNA, 8 bp, Unknown
  misc_feature (1)..( 8): Result.001 file - promoters75/4771495
aattgtag

SEQ ID NO: 78937 - DNA, 8 bp, Unknown
  misc_feature (1)..( 8): Result.001 file - promoters75/4771495
aattctag

SEQ ID NO: 78938 - DNA, 8 bp, Unknown
  misc_feature (1)..( 8): Result.001 file - promoters75/4771495
aattgttc

SEQ ID NO: 78939 - DNA, 9 bp, Unknown
  misc_feature (1)..( 9): Result.001 file - promoters75/4771495
gcaaaacta

SEQ ID NO: 78940 - DNA, 9 bp, Unknown
  misc_feature (1)..( 9): Result.001 file - promoters75/4771495
gcaaaacat

SEQ ID NO: 78941 - DNA, 9 bp, Unknown
  misc_feature (1)..( 9): Result.001 file - promoters75/4771495
aaaaaacta

SEQ ID NO: 78942 - DNA, 7 bp, Unknown
  misc_feature (1)..( 7): Result.001 file - promoters75/4771495
atgattc

SEQ ID NO: 78943 - DNA, 7 bp, Unknown
  misc_feature (1)..( 7): Result.001 file - promoters75/4771495
atgtttc

SEQ ID NO: 78944 - DNA, 7 bp, Unknown
  misc_feature (1)..( 7): Result.001 file - promoters75/4771495
atgtttc

SEQ ID NO: 78945 - DNA, 8 bp, Unknown
  misc_feature (1)..( 8): Result.001 file - promoters75/4771495
aacaaatt

SEQ ID NO: 78946 - DNA, 8 bp, Unknown
  misc_feature (1)..( 8): Result.001 file - promoters75/4771495
aacatatt

SEQ ID NO: 78947 - DNA, 8 bp, Unknown
  misc_feature (1)..( 8): Result.001 file - promoters75/4771677
tacatata

SEQ ID NO: 78948 - DNA, 9 bp, Unknown
  misc_feature (1)..( 9): Result.001 file - promoters75/4771677
aaagcaaac

SEQ ID NO: 78949 - DNA, 9 bp, Unknown
  misc_feature (1)..( 9): Result.001 file - promoters75/4771677
aaatcaaaa

SEQ ID NO: 78950 - DNA, 10 bp, Unknown
  misc_feature (1)..( 10): Result.001 file - promoters75/4771769
aaactcaaaa

SEQ ID NO: 78951 - DNA, 10 bp, Unknown
  misc_feature (1)..( 10): Result.001 file - promoters75/4771769
tttttgttta

SEQ ID NO: 78952 - DNA, 10 bp, Unknown
  misc_feature (1)..( 10): Result.001 file - promoters75/4771769
attttgtttt

SEQ ID NO: 78953 - DNA, 10 bp, Unknown
  misc_feature (1)..( 10): Result.001 file - promoters75/4771769
tttttggttt

SEQ ID NO: 78954 - DNA, 10 bp, Unknown
  misc_feature (1)..( 10): Result.001 file - promoters75/4771769
tttttattta

SEQ ID NO: 78955 - DNA, 9 bp, Unknown
  misc_feature (1)..( 9): Result.001 file - promoters75/4771769
gttttttag

SEQ ID NO: 78956 - DNA, 9 bp, Unknown
  misc_feature (1)..( 9): Result.001 file - promoters75/4771769
gttttttca

SEQ ID NO: 78957 - DNA, 9 bp, Unknown
  misc_feature (1)..( 9): Result.001 file - promoters75/4771769
gtttttcaa

SEQ ID NO: 78958 - DNA, 9 bp, Unknown
  misc_feature (1)..( 9): Result.001 file - promoters75/4771769
attttttat

SEQ ID NO: 78959 - DNA, 9 bp, Unknown
  misc_feature (1)..( 9): Result.001 file - promoters75/4771769
atttctcaa

SEQ ID NO: 78960 - DNA, 12 bp, Unknown
  misc_feature (1)..( 12): Result.001 file - promoters75/4771769
gacctaagttta

SEQ ID NO: 78961 - DNA, 12 bp, Unknown
  misc_feature (1)..( 12): Result.001 file - promoters75/4771769
atgcatagttta

SEQ ID NO: 78962 - DNA, 12 bp, Unknown
  misc_feature (1)..( 12): Result.001 file - promoters75/4771769
acacattgtttt

SEQ ID NO: 78963 - DNA, 12 bp, Unknown
  misc_feature (1)..( 12): Result.001 file - promoters75/4771853
atgtatagtttt

SEQ ID NO: 78964 - DNA, 9 bp, Unknown
  misc_feature (1)..( 9): Result.001 file - promoters75/4771853
gtttccttt

SEQ ID NO: 78965 - DNA, 9 bp, Unknown
  misc_feature (1)..( 9): Result.001 file - promoters75/4771853
gttaccttt

SEQ ID NO: 78966 - DNA, 9 bp, Unknown
  misc_feature (1)..( 9): Result.001 file - promoters75/4772336
gcttcgttt

SEQ ID NO: 78967 - DNA, 11 bp, Unknown
  misc_feature (1)..( 11): Result.001 file - promoters75/4772336
attaaccttga

SEQ ID NO: 78968 - DNA, 11 bp, Unknown
  misc_feature (1)..( 11): Result.001 file - promoters75/4772336
attgaccctga

SEQ ID NO: 78969 - DNA, 11 bp, Unknown
  misc_feature (1)..( 11): Result.001 file - promoters75/4772336
attgacgacta

SEQ ID NO: 78970 - DNA, 9 bp, Unknown
  misc_feature (1)..( 9): Result.001 file - promoters75/4772336
tgtcttgaa

SEQ ID NO: 78971 - DNA, 9 bp, Unknown
  misc_feature (1)..( 9): Result.001 file - promoters75/4772336
tgtattgac

SEQ ID NO: 78972 - DNA, 9 bp, Unknown
  misc_feature (1)..( 9): Result.001 file - promoters75/4772336
aaaattgac

SEQ ID NO: 78973 - DNA, 9 bp, Unknown
  misc_feature (1)..( 9): Result.001 file - promoters75/4772336
aaaatgaaa

SEQ ID NO: 78974 - DNA, 9 bp, Unknown
  misc_feature (1)..( 9): Result.001 file - promoters75/4772336
aaattgaca

SEQ ID NO: 78975 - DNA, 9 bp, Unknown
  misc_feature (1)..( 9): Result.001 file - promoters75/4772336
tcattaaca

SEQ ID NO: 78976 - DNA, 7 bp, Unknown
  misc_feature (1)..( 7): Result.001 file - promoters75/4772336
tatatat

SEQ ID NO: 78977 - DNA, 7 bp, Unknown
  misc_feature (1)..( 7): Result.001 file - promoters75/4772336
tatataa

SEQ ID NO: 78978 - DNA, 7 bp, Unknown
  misc_feature (1)..( 7): Result.001 file - promoters75/4772346
gatataa

SEQ ID NO: 78979 - DNA, 8 bp, Unknown
  misc_feature (1)..( 8): Result.001 file - promoters75/4772346
agatactt

SEQ ID NO: 78980 - DNA, 8 bp, Unknown
  misc_feature (1)..( 8): Result.001 file - promoters75/4772346
agatacag

SEQ ID NO: 78981 - DNA, 8 bp, Unknown
  misc_feature (1)..( 8): Result.001 file - promoters75/4772346
agagacat

SEQ ID NO: 78982 - DNA, 8 bp, Unknown
  misc_feature (1)..( 8): Result.001 file - promoters75/4772346
cgatccag

SEQ ID NO: 78983 - DNA, 7 bp, Unknown
  misc_feature (1)..( 7): Result.001 file - promoters75/4772346
tttcaat

SEQ ID NO: 78984 - DNA, 7 bp, Unknown
  misc_feature (1)..( 7): Result.001 file - promoters75/4772346
tttcaag

SEQ ID NO: 78985 - DNA, 7 bp, Unknown
  misc_feature (1)..( 7): Result.001 file - promoters75/4772346
tttaaag

SEQ ID NO: 78986 - DNA, 8 bp, Unknown
  misc_feature (1)..( 8): Result.001 file - promoters75/4772346
caaaccca

SEQ ID NO: 78987 - DNA, 8 bp, Unknown
  misc_feature (1)..( 8): Result.001 file - promoters75/4772346
caaacctg

SEQ ID NO: 78988 - DNA, 8 bp, Unknown
  misc_feature (1)..( 8): Result.001 file - promoters75/4772398
gaaagctg

SEQ ID NO: 78989 - DNA, 11 bp, Unknown
  misc_feature (1)..( 11): Result.001 file - promoters75/4772398
cactaatgtga

SEQ ID NO: 78990 - DNA, 11 bp, Unknown
  misc_feature (1)..( 11): Result.001 file - promoters75/4772398
aggcaatttga

SEQ ID NO: 78991 - DNA, 11 bp, Unknown
  misc_feature (1)..( 11): Result.001 file - promoters75/4772398
tttaaatagaa

SEQ ID NO: 78992 - DNA, 11 bp, Unknown
  misc_feature (1)..( 11): Result.001 file - promoters75/4772398
tgatgatttga

SEQ ID NO: 78993 - DNA, 11 bp, Unknown
  misc_feature (1)..( 11): Result.001 file - promoters75/4772398
attaaataaat

SEQ ID NO: 78994 - DNA, 11 bp, Unknown
  misc_feature (1)..( 11): Result.001 file - promoters75/4772398
attatatagca

SEQ ID NO: 78995 - DNA, 12 bp, Unknown
  misc_feature (1)..( 12): Result.001 file - promoters75/4772398
gacctaagttta

SEQ ID NO: 78996 - DNA, 12 bp, Unknown
  misc_feature (1)..( 12): Result.001 file - promoters75/4772398
ttctgaagtttc

SEQ ID NO: 78997 - DNA, 12 bp, Unknown
  misc_feature (1)..( 12): Result.001 file - promoters75/4772398
gacataaatttt

SEQ ID NO: 78998 - DNA, 12 bp, Unknown
  misc_feature (1)..( 12): Result.001 file - promoters75/4772398
tgtataatttta

SEQ ID NO: 78999 - DNA, 12 bp, Unknown
  misc_feature (1)..( 12): Result.001 file - promoters75/4772398
gccttgaggttc

SEQ ID NO: 79000 - DNA, 12 bp, Unknown
  misc_feature (1)..( 12): Result.001 file - promoters75/4772398
ttcataaaatac

SEQ ID NO: 79001 - DNA, 12 bp, Unknown
  misc_feature (1)..( 12): Result.001 file - promoters75/4772398
tgaataacatat

SEQ ID NO: 79002 - DNA, 13 bp, Unknown
  misc_feature (1)..( 13): Result.001 file - promoters75/4772398
tacaatgggctgg

SEQ ID NO: 79003 - DNA, 13 bp, Unknown
  misc_feature (1)..( 13): Result.001 file - promoters75/4772398
ggaaataggccca

SEQ ID NO: 79004 - DNA, 13 bp, Unknown
  misc_feature (1)..( 13): Result.001 file - promoters75/4772398
tgtcataggccca

SEQ ID NO: 79005 - DNA, 13 bp, Unknown
  misc_feature (1)..( 13): Result.001 file - promoters75/4772398
atttgaaggccca

SEQ ID NO: 79006 - DNA, 13 bp, Unknown
  misc_feature (1)..( 13): Result.001 file - promoters75/4772398
acctaaaggccca

SEQ ID NO: 79007 - DNA, 13 bp, Unknown
  misc_feature (1)..( 13): Result.001 file - promoters75/4772398
tgttataggttct

SEQ ID NO: 79008 - DNA, 11 bp, Unknown
  misc_feature (1)..( 11): Result.001 file - promoters75/4772398
attgttacaaa

SEQ ID NO: 79009 - DNA, 11 bp, Unknown
  misc_feature (1)..( 11): Result.001 file - promoters75/4772398
atttttacttt

SEQ ID NO: 79010 - DNA, 11 bp, Unknown
  misc_feature (1)..( 11): Result.001 file - promoters75/4772398
tttgttagttc

SEQ ID NO: 79011 - DNA, 11 bp, Unknown
  misc_feature (1)..( 11): Result.001 file - promoters75/4772398
attgataggtg

SEQ ID NO: 79012 - DNA, 11 bp, Unknown
  misc_feature (1)..( 11): Result.001 file - promoters75/4772398
ttttttaattt

SEQ ID NO: 79013 - DNA, 11 bp, Unknown
  misc_feature (1)..( 11): Result.001 file - promoters75/4772398
aacaataattt

SEQ ID NO: 79014 - DNA, 16 bp, Unknown
  misc_feature (1)..( 16): Result.001 file - promoters75/4772398
ttaatcttttggggtt

SEQ ID NO: 79015 - DNA, 16 bp, Unknown
  misc_feature (1)..( 16): Result.001 file - promoters75/4772398
aatttcttttcacata

SEQ ID NO: 79016 - DNA, 16 bp, Unknown
  misc_feature (1)..( 16): Result.001 file - promoters75/4772398
taactcttttgaagtt

SEQ ID NO: 79017 - DNA, 16 bp, Unknown
  misc_feature (1)..( 16): Result.001 file - promoters75/4772398
ttaacctttgaccagc

SEQ ID NO: 79018 - DNA, 16 bp, Unknown
  misc_feature (1)..( 16): Result.001 file - promoters75/4772398
ttttacttttaacaaa

SEQ ID NO: 79019 - DNA, 16 bp, Unknown
  misc_feature (1)..( 16): Result.001 file - promoters75/4772398
tatcgttattaataaa

SEQ ID NO: 79020 - DNA, 14 bp, Unknown
  misc_feature (1)..( 14): Result.001 file - promoters75/4772398
ggaaataggcccaa

SEQ ID NO: 79021 - DNA, 14 bp, Unknown
  misc_feature (1)..( 14): Result.001 file - promoters75/4772398
acctaaaggcccaa

SEQ ID NO: 79022 - DNA, 14 bp, Unknown
  misc_feature (1)..( 14): Result.001 file - promoters75/4772398
tgtcataggcccat

SEQ ID NO: 79023 - DNA, 14 bp, Unknown
  misc_feature (1)..( 14): Result.001 file - promoters75/4772398
atttgaaggcccaa

SEQ ID NO: 79024 - DNA, 14 bp, Unknown
  misc_feature (1)..( 14): Result.001 file - promoters75/4772398
atttgatggcccat

SEQ ID NO: 79025 - DNA, 14 bp, Unknown
  misc_feature (1)..( 14): Result.001 file - promoters75/4772398
tgttataggttctt

SEQ ID NO: 79026 - DNA, 9 bp, Unknown
  misc_feature (1)..( 9): Result.001 file - promoters75/4772398
aaatttgaa

SEQ ID NO: 79027 - DNA, 9 bp, Unknown
  misc_feature (1)..( 9): Result.001 file - promoters75/4772398
aaatttact

SEQ ID NO: 79028 - DNA, 9 bp, Unknown
  misc_feature (1)..( 9): Result.001 file - promoters75/4772398
aaattttgg

SEQ ID NO: 79029 - DNA, 9 bp, Unknown
  misc_feature (1)..( 9): Result.001 file - promoters75/4772398
taatgtgaa

SEQ ID NO: 79030 - DNA, 9 bp, Unknown
  misc_feature (1)..( 9): Result.001 file - promoters75/4772398
taatgtctc

SEQ ID NO: 79031 - DNA, 9 bp, Unknown
  misc_feature (1)..( 9): Result.001 file - promoters75/4772776
taatttttt

SEQ ID NO: 79032 - DNA, 7 bp, Unknown
  misc_feature (1)..( 7): Result.001 file - promoters75/4772776
ctataaa

SEQ ID NO: 79033 - DNA, 7 bp, Unknown
  misc_feature (1)..( 7): Result.001 file - promoters75/4772776
atataaa

SEQ ID NO: 79034 - DNA, 7 bp, Unknown
  misc_feature (1)..( 7): Result.001 file - promoters75/4772776
atataac

SEQ ID NO: 79035 - DNA, 11 bp, Unknown
  misc_feature (1)..( 11): Result.001 file - promoters75/4772776
tgtctttttac

SEQ ID NO: 79036 - DNA, 11 bp, Unknown
  misc_feature (1)..( 11): Result.001 file - promoters75/4772776
cttcttgttac

SEQ ID NO: 79037 - DNA, 11 bp, Unknown
  misc_feature (1)..( 11): Result.001 file - promoters75/4772776
cttcatgtaca

SEQ ID NO: 79038 - DNA, 11 bp, Unknown
  misc_feature (1)..( 11): Result.001 file - promoters75/4772776
atttgtttttt

SEQ ID NO: 79039 - DNA, 11 bp, Unknown
  misc_feature (1)..( 11): Result.001 file - promoters75/4772776
aagtgtctttt

SEQ ID NO: 79040 - DNA, 11 bp, Unknown
  misc_feature (1)..( 11): Result.001 file - promoters75/4772776
aagtatcttac

SEQ ID NO: 79041 - DNA, 8 bp, Unknown
  misc_feature (1)..( 8): Result.001 file - promoters75/4772776
aatccaaa

SEQ ID NO: 79042 - DNA, 8 bp, Unknown
  misc_feature (1)..( 8): Result.001 file - promoters75/4772776
aatcaaaa

SEQ ID NO: 79043 - DNA, 8 bp, Unknown
  misc_feature (1)..( 8): Result.001 file - promoters75/4772879
tatcaaac

SEQ ID NO: 79044 - DNA, 7 bp, Unknown
  misc_feature (1)..( 7): Result.001 file - promoters75/4772879
taaaaat

SEQ ID NO: 79045 - DNA, 7 bp, Unknown
  misc_feature (1)..( 7): Result.001 file - promoters75/4772879
taaaaag

SEQ ID NO: 79046 - DNA, 7 bp, Unknown
  misc_feature (1)..( 7): Result.001 file - promoters75/4772879
gaaaaag

SEQ ID NO: 79047 - DNA, 13 bp, Unknown
  misc_feature (1)..( 13): Result.001 file - promoters75/4772879
aatgaatattaga

SEQ ID NO: 79048 - DNA, 13 bp, Unknown
  misc_feature (1)..( 13): Result.001 file - promoters75/4772879
aattaatgacgat

SEQ ID NO: 79049 - DNA, 13 bp, Unknown
  misc_feature (1)..( 13): Result.001 file - promoters75/4772879
tctgaatattaga

SEQ ID NO: 79050 - DNA, 6 bp, Unknown
  misc_feature (1)..( 6): Result.001 file - promoters75/4772879
ataata

SEQ ID NO: 79051 - DNA, 6 bp, Unknown
  misc_feature (1)..( 6): Result.001 file - promoters75/4772879
ataata

SEQ ID NO: 79052 - DNA, 6 bp, Unknown
  misc_feature (1)..( 6): Result.001 file - promoters75/4772879
ataata

SEQ ID NO: 79053 - DNA, 12 bp, Unknown
  misc_feature (1)..( 12): Result.001 file - promoters75/4772879
atataataaata

SEQ ID NO: 79054 - DNA, 12 bp, Unknown
  misc_feature (1)..( 12): Result.001 file - promoters75/4772879
gcataaaaaata

SEQ ID NO: 79055 - DNA, 12 bp, Unknown
  misc_feature (1)..( 12): Result.001 file - promoters75/4772879
ttattatacttc

SEQ ID NO: 79056 - DNA, 12 bp, Unknown
  misc_feature (1)..( 12): Result.001 file - promoters75/4772879
atataattatct

SEQ ID NO: 79057 - DNA, 10 bp, Unknown
  misc_feature (1)..( 10): Result.001 file - promoters75/4772879
gtatatatat

SEQ ID NO: 79058 - DNA, 10 bp, Unknown
  misc_feature (1)..( 10): Result.001 file - promoters75/4772879
aaataaatag

SEQ ID NO: 79059 - DNA, 10 bp, Unknown
  misc_feature (1)..( 10): Result.001 file - promoters75/4772879
aaatatataa

SEQ ID NO: 79060 - DNA, 9 bp, Unknown
  misc_feature (1)..( 9): Result.001 file - promoters75/4772879
aaattaata

SEQ ID NO: 79061 - DNA, 9 bp, Unknown
  misc_feature (1)..( 9): Result.001 file - promoters75/4772879
taattaagt

SEQ ID NO: 79062 - DNA, 9 bp, Unknown
  misc_feature (1)..( 9): Result.001 file - promoters75/4772879
aaatcaata

SEQ ID NO: 79063 - DNA, 9 bp, Unknown
  misc_feature (1)..( 9): Result.001 file - promoters75/4772879
taattatta

SEQ ID NO: 79064 - DNA, 6 bp, Unknown
  misc_feature (1)..( 6): Result.001 file - promoters75/4772879
aaatat

SEQ ID NO: 79065 - DNA, 6 bp, Unknown
  misc_feature (1)..( 6): Result.001 file - promoters75/4772879
aaatat

SEQ ID NO: 79066 - DNA, 6 bp, Unknown
  misc_feature (1)..( 6): Result.001 file - promoters75/4772879
aaatat

SEQ ID NO: 79067 - DNA, 7 bp, Unknown
  misc_feature (1)..( 7): Result.001 file - promoters75/4772879
ttatata

SEQ ID NO: 79068 - DNA, 7 bp, Unknown
  misc_feature (1)..( 7): Result.001 file - promoters75/4772879
ttatata

SEQ ID NO: 79069 - DNA, 7 bp, Unknown
  misc_feature (1)..( 7): Result.001 file - promoters75/4772879
ttatata

SEQ ID NO: 79070 - DNA, 8 bp, Unknown
  misc_feature (1)..( 8): Result.001 file - promoters75/4772879
cgtatctt

SEQ ID NO: 79071 - DNA, 8 bp, Unknown
  misc_feature (1)..( 8): Result.001 file - promoters75/4772879
tgtatcta

SEQ ID NO: 79072 - DNA, 8 bp, Unknown
  misc_feature (1)..( 8): Result.001 file - promoters75/4772879
tgtgtcta

SEQ ID NO: 79073 - DNA, 8 bp, Unknown
  misc_feature (1)..( 8): Result.001 file - promoters75/4772879
atcaaaag

SEQ ID NO: 79074 - DNA, 8 bp, Unknown
  misc_feature (1)..( 8): Result.001 file - promoters75/4772879
atccaaac

SEQ ID NO: 79075 - DNA, 8 bp, Unknown
  misc_feature (1)..( 8): Result.001 file - promoters75/4772879
atcctaac

SEQ ID NO: 79076 - DNA, 9 bp, Unknown
  misc_feature (1)..( 9): Result.001 file - promoters75/4772879
tttgttggt

SEQ ID NO: 79077 - DNA, 9 bp, Unknown
  misc_feature (1)..( 9): Result.001 file - promoters75/4772879
tttattgat

SEQ ID NO: 79078 - DNA, 9 bp, Unknown
  misc_feature (1)..( 9): Result.001 file - promoters75/4772879
gttactgat

SEQ ID NO: 79079 - DNA, 9 bp, Unknown
  misc_feature (1)..( 9): Result.001 file - promoters75/4772879
aatatatat

SEQ ID NO: 79080 - DNA, 9 bp, Unknown
  misc_feature (1)..( 9): Result.001 file - promoters75/4772879
aatttattt

SEQ ID NO: 79081 - DNA, 9 bp, Unknown
  misc_feature (1)..( 9): Result.001 file - promoters75/4772879
gctttgttt

SEQ ID NO: 79082 - DNA, 11 bp, Unknown
  misc_feature (1)..( 11): Result.001 file - promoters75/4772879
aactagacacg

SEQ ID NO: 79083 - DNA, 11 bp, Unknown
  misc_feature (1)..( 11): Result.001 file - promoters75/4772879
aaaaagagacg

SEQ ID NO: 79084 - DNA, 11 bp, Unknown
  misc_feature (1)..( 11): Result.001 file - promoters75/4772879
aaaaagaatac

SEQ ID NO: 79085 - DNA, 9 bp, Unknown
  misc_feature (1)..( 9): Result.001 file - promoters75/4772879
gggattttt

SEQ ID NO: 79086 - DNA, 9 bp, Unknown
  misc_feature (1)..( 9): Result.001 file - promoters75/4772879
gggttttta

SEQ ID NO: 79087 - DNA, 9 bp, Unknown
  misc_feature (1)..( 9): Result.001 file - promoters75/4773074
ttgattttt

SEQ ID NO: 79088 - DNA, 19 bp, Unknown
  misc_feature (1)..( 19): Result.001 file - promoters75/4773074
tatataaatcccttaaacc

SEQ ID NO: 79089 - DNA, 19 bp, Unknown
  misc_feature (1)..( 19): Result.001 file - promoters75/4773074
ataaataatctcttaaaac

SEQ ID NO: 79090 - DNA, 19 bp, Unknown
  misc_feature (1)..( 19): Result.001 file - promoters75/4773074
tatataaatccttcactcg

SEQ ID NO: 79091 - DNA, 19 bp, Unknown
  misc_feature (1)..( 19): Result.001 file - promoters75/4773074
tataaacaaaccttaaacc

SEQ ID NO: 79092 - DNA, 19 bp, Unknown
  misc_feature (1)..( 19): Result.001 file - promoters75/4773074
tgtataaaaacacttgcga

SEQ ID NO: 79093 - DNA, 19 bp, Unknown
  misc_feature (1)..( 19): Result.001 file - promoters75/4773074
actataaatactctcggtt

SEQ ID NO: 79094 - DNA, 12 bp, Unknown
  misc_feature (1)..( 12): Result.001 file - promoters75/4773074
gtatataaatcc

SEQ ID NO: 79095 - DNA, 12 bp, Unknown
  misc_feature (1)..( 12): Result.001 file - promoters75/4773074
gtataaaaacac

SEQ ID NO: 79096 - DNA, 12 bp, Unknown
  misc_feature (1)..( 12): Result.001 file - promoters75/4773074
ttatataaatcc

SEQ ID NO: 79097 - DNA, 12 bp, Unknown
  misc_feature (1)..( 12): Result.001 file - promoters75/4773074
cactataaacaa

SEQ ID NO: 79098 - DNA, 12 bp, Unknown
  misc_feature (1)..( 12): Result.001 file - promoters75/4773074
aactataaatac

SEQ ID NO: 79099 - DNA, 12 bp, Unknown
  misc_feature (1)..( 12): Result.001 file - promoters75/4773823
tcttataaataa

SEQ ID NO: 79100 - DNA, 9 bp, Unknown
  misc_feature (1)..( 9): Result.001 file - promoters75/4773823
agataataa

SEQ ID NO: 79101 - DNA, 9 bp, Unknown
  misc_feature (1)..( 9): Result.001 file - promoters75/4773823
agaaaattc

SEQ ID NO: 79102 - DNA, 9 bp, Unknown
  misc_feature (1)..( 9): Result.001 file - promoters75/4899830
tcaaacttc

SEQ ID NO: 79103 - DNA, 13 bp, Unknown
  misc_feature (1)..( 13): Result.001 file - promoters75/4899830
gaaaaaaagttat

SEQ ID NO: 79104 - DNA, 13 bp, Unknown
  misc_feature (1)..( 13): Result.001 file - promoters75/4899830
acgccttagttat

SEQ ID NO: 79105 - DNA, 13 bp, Unknown
  misc_feature (1)..( 13): Result.001 file - promoters75/4899830
gaagaaaaattac

SEQ ID NO: 79106 - DNA, 13 bp, Unknown
  misc_feature (1)..( 13): Result.001 file - promoters75/4899830
aaaccaaagaaag

SEQ ID NO: 79107 - DNA, 13 bp, Unknown
  misc_feature (1)..( 13): Result.001 file - promoters75/4899830
aatgttaaattaa

SEQ ID NO: 79108 - DNA, 10 bp, Unknown
  misc_feature (1)..( 10): Result.001 file - promoters75/4899830
catatatact

SEQ ID NO: 79109 - DNA, 10 bp, Unknown
  misc_feature (1)..( 10): Result.001 file - promoters75/4899830
tatatatata

SEQ ID NO: 79110 - DNA, 10 bp, Unknown
  misc_feature (1)..( 10): Result.001 file - promoters75/4899830
actatataac

SEQ ID NO: 79111 - DNA, 10 bp, Unknown
  misc_feature (1)..( 10): Result.001 file - promoters75/4899830
cttatttatg

SEQ ID NO: 79112 - DNA, 10 bp, Unknown
  misc_feature (1)..( 10): Result.001 file - promoters75/4900353
actataaaac

SEQ ID NO: 79113 - DNA, 11 bp, Unknown
  misc_feature (1)..( 11): Result.001 file - promoters75/4900353
taatatatatt

SEQ ID NO: 79114 - DNA, 11 bp, Unknown
  misc_feature (1)..( 11): Result.001 file - promoters75/4900353
taagataggaa

SEQ ID NO: 79115 - DNA, 11 bp, Unknown
  misc_feature (1)..( 11): Result.001 file - promoters75/4900353
tgatataaatt

SEQ ID NO: 79116 - DNA, 8 bp, Unknown
  misc_feature (1)..( 8): Result.001 file - promoters75/4900353
gggcctaa

SEQ ID NO: 79117 - DNA, 8 bp, Unknown
  misc_feature (1)..( 8): Result.001 file - promoters75/4900353
cggcgtaa

SEQ ID NO: 79118 - DNA, 8 bp, Unknown
  misc_feature (1)..( 8): Result.001 file - promoters75/4901171
gggcctat

SEQ ID NO: 79119 - DNA, 13 bp, Unknown
  misc_feature (1)..( 13): Result.001 file - promoters75/4901171
caaaactattgac

SEQ ID NO: 79120 - DNA, 13 bp, Unknown
  misc_feature (1)..( 13): Result.001 file - promoters75/4901171
aaaaacttccaaa

SEQ ID NO: 79121 - DNA, 13 bp, Unknown
  misc_feature (1)..( 13): Result.001 file - promoters75/4901171
caaaaccctaaca

SEQ ID NO: 79122 - DNA, 13 bp, Unknown
  misc_feature (1)..( 13): Result.001 file - promoters75/4901171
gaaaaaaattcca

SEQ ID NO: 79123 - DNA, 13 bp, Unknown
  misc_feature (1)..( 13): Result.001 file - promoters75/4901171
acacgagattcca

SEQ ID NO: 79124 - DNA, 11 bp, Unknown
  misc_feature (1)..( 11): Result.001 file - promoters75/4901171
acaaatttcag

SEQ ID NO: 79125 - DNA, 11 bp, Unknown
  misc_feature (1)..( 11): Result.001 file - promoters75/4901171
caaaatttctc

SEQ ID NO: 79126 - DNA, 11 bp, Unknown
  misc_feature (1)..( 11): Result.001 file - promoters75/4901171
cgagattccag

SEQ ID NO: 79127 - DNA, 11 bp, Unknown
  misc_feature (1)..( 11): Result.001 file - promoters75/4901171
aaaaattccat

SEQ ID NO: 79128 - DNA, 11 bp, Unknown
  misc_feature (1)..( 11): Result.001 file - promoters75/4901736
gatgataccat

SEQ ID NO: 79129 - DNA, 11 bp, Unknown
  misc_feature (1)..( 11): Result.001 file - promoters75/4901736
aaatattcaac

SEQ ID NO: 79130 - DNA, 11 bp, Unknown
  misc_feature (1)..( 11): Result.001 file - promoters75/4901736
aaagattaaac

SEQ ID NO: 79131 - DNA, 11 bp, Unknown
  misc_feature (1)..( 11): Result.001 file - promoters75/4901736
aaaaatttttt

SEQ ID NO: 79132 - DNA, 15 bp, Unknown
  misc_feature (1)..( 15): Result.001 file - promoters75/4901736
cgttttttagttttc

SEQ ID NO: 79133 - DNA, 15 bp, Unknown
  misc_feature (1)..( 15): Result.001 file - promoters75/4901736
cgttttttaaaagga

SEQ ID NO: 79134 - DNA, 15 bp, Unknown
  misc_feature (1)..( 15): Result.001 file - promoters75/4901736
cttgttttaattttc

SEQ ID NO: 79135 - DNA, 7 bp, Unknown
  misc_feature (1)..( 7): Result.001 file - promoters75/4901736
ttgttta

SEQ ID NO: 79136 - DNA, 7 bp, Unknown
  misc_feature (1)..( 7): Result.001 file - promoters75/4901736
ttgtttt

SEQ ID NO: 79137 - DNA, 7 bp, Unknown
  misc_feature (1)..( 7): Result.001 file - promoters75/4909449
ttggtta

SEQ ID NO: 79138 - DNA, 12 bp, Unknown
  misc_feature (1)..( 12): Result.001 file - promoters75/4909449
atataaagtcat

SEQ ID NO: 79139 - DNA, 12 bp, Unknown
  misc_feature (1)..( 12): Result.001 file - promoters75/4909449
atataaaggtcc

SEQ ID NO: 79140 - DNA, 12 bp, Unknown
  misc_feature (1)..( 12): Result.001 file - promoters75/4909449
ctataaattcaa

SEQ ID NO: 79141 - DNA, 12 bp, Unknown
  misc_feature (1)..( 12): Result.001 file - promoters75/4909449
atataaagacgc

SEQ ID NO: 79142 - DNA, 12 bp, Unknown
  misc_feature (1)..( 12): Result.001 file - promoters75/4909449
tattaaagccgc

SEQ ID NO: 79143 - DNA, 12 bp, Unknown
  misc_feature (1)..( 12): Result.001 file - promoters75/4909449
aaaaaagagagg

SEQ ID NO: 79144 - DNA, 12 bp, Unknown
  misc_feature (1)..( 12): Result.001 file - promoters75/4909449
gtaaaagaatca

SEQ ID NO: 79145 - DNA, 12 bp, Unknown
  misc_feature (1)..( 12): Result.001 file - promoters75/4909449
aaaaaagttttt

SEQ ID NO: 79146 - DNA, 12 bp, Unknown
  misc_feature (1)..( 12): Result.001 file - promoters75/4909449
agaaaatagttt

SEQ ID NO: 79147 - DNA, 12 bp, Unknown
  misc_feature (1)..( 12): Result.001 file - promoters75/4909449
cagaaaggtttc

SEQ ID NO: 79148 - DNA, 9 bp, Unknown
  misc_feature (1)..( 9): Result.001 file - promoters75/4909449
atataaata

SEQ ID NO: 79149 - DNA, 9 bp, Unknown
  misc_feature (1)..( 9): Result.001 file - promoters75/4909449
atacaaaac

SEQ ID NO: 79150 - DNA, 9 bp, Unknown
  misc_feature (1)..( 9): Result.001 file - promoters75/4909449
ttattaata

SEQ ID NO: 79151 - DNA, 9 bp, Unknown
  misc_feature (1)..( 9): Result.001 file - promoters75/4909449
ctatttata

SEQ ID NO: 79152 - DNA, 9 bp, Unknown
  misc_feature (1)..( 9): Result.001 file - promoters75/4911485
ataataact

SEQ ID NO: 79153 - DNA, 7 bp, Unknown
  misc_feature (1)..( 7): Result.001 file - promoters75/4911485
ttgtttg

SEQ ID NO: 79154 - DNA, 7 bp, Unknown
  misc_feature (1)..( 7): Result.001 file - promoters75/4911485
atgtttg

SEQ ID NO: 79155 - DNA, 7 bp, Unknown
  misc_feature (1)..( 7): Result.001 file - promoters75/4911485
atgattg

SEQ ID NO: 79156 - DNA, 12 bp, Unknown
  misc_feature (1)..( 12): Result.001 file - promoters75/4911485
tgagtatatttt

SEQ ID NO: 79157 - DNA, 12 bp, Unknown
  misc_feature (1)..( 12): Result.001 file - promoters75/4911485
tgattatatgta

SEQ ID NO: 79158 - DNA, 12 bp, Unknown
  misc_feature (1)..( 12): Result.001 file - promoters75/4911485
tttgtaaatttt

SEQ ID NO: 79159 - DNA, 8 bp, Unknown
  misc_feature (1)..( 8): Result.001 file - promoters75/4911485
ttttaatt

SEQ ID NO: 79160 - DNA, 8 bp, Unknown
  misc_feature (1)..( 8): Result.001 file - promoters75/4911485
tttgaatt

SEQ ID NO: 79161 - DNA, 8 bp, Unknown
  misc_feature (1)..( 8): Result.001 file - promoters75/4911485
atttaatt

SEQ ID NO: 79162 - DNA, 9 bp, Unknown
  misc_feature (1)..( 9): Result.001 file - promoters75/4911485
aaagcccaa

SEQ ID NO: 79163 - DNA, 9 bp, Unknown
  misc_feature (1)..( 9): Result.001 file - promoters75/4911485
taagcccat

SEQ ID NO: 79164 - DNA, 10 bp, Unknown
  misc_feature (1)..( 10): Result.001 file - promoters75/4911485
taaggcccaa

SEQ ID NO: 79165 - DNA, 7 bp, Unknown
  misc_feature (1)..( 7): Result.001 file - promoters75/4911485
ttgcata

SEQ ID NO: 79166 - DNA, 7 bp, Unknown
  misc_feature (1)..( 7): Result.001 file - promoters75/4911485
ttggata

SEQ ID NO: 79167 - DNA, 7 bp, Unknown
  misc_feature (1)..( 7): Result.001 file - promoters75/4911485
gtggata

SEQ ID NO: 79168 - DNA, 10 bp, Unknown
  misc_feature (1)..( 10): Result.001 file - promoters75/4911485
aaaggtttta

SEQ ID NO: 79169 - DNA, 10 bp, Unknown
  misc_feature (1)..( 10): Result.001 file - promoters75/4911485
aaaagtttta

SEQ ID NO: 79170 - DNA, 10 bp, Unknown
  misc_feature (1)..( 10): Result.001 file - promoters75/4911485
aaaactttgg

SEQ ID NO: 79171 - DNA, 8 bp, Unknown
  misc_feature (1)..( 8): Result.001 file - promoters75/4911485
aataattt

SEQ ID NO: 79172 - DNA, 8 bp, Unknown
  misc_feature (1)..( 8): Result.001 file - promoters75/4911485
tataattt

SEQ ID NO: 79173 - DNA, 8 bp, Unknown
  misc_feature (1)..( 8): Result.001 file - promoters75/4911485
aatcattt

SEQ ID NO: 79174 - DNA, 12 bp, Unknown
  misc_feature (1)..( 12): Result.001 file - promoters75/4911485
aaagaagaaaaa

SEQ ID NO: 79175 - DNA, 12 bp, Unknown
  misc_feature (1)..( 12): Result.001 file - promoters75/4911485
aaaaaaggaaaa

SEQ ID NO: 79176 - DNA, 12 bp, Unknown
  misc_feature (1)..( 12): Result.001 file - promoters75/4911485
caaaaagcaaaa

SEQ ID NO: 79177 - DNA, 8 bp, Unknown
  misc_feature (1)..( 8): Result.001 file - promoters75/4911485
attttgtt

SEQ ID NO: 79178 - DNA, 8 bp, Unknown
  misc_feature (1)..( 8): Result.001 file - promoters75/4911485
attttgtt

SEQ ID NO: 79179 - DNA, 8 bp, Unknown
  misc_feature (1)..( 8): Result.001 file - promoters75/4911485
tctttgtt

SEQ ID NO: 79180 - DNA, 13 bp, Unknown
  misc_feature (1)..( 13): Result.001 file - promoters75/4911485
tataaatgggcct

SEQ ID NO: 79181 - DNA, 13 bp, Unknown
  misc_feature (1)..( 13): Result.001 file - promoters75/4911485
taaaaatgggtct

SEQ ID NO: 79182 - DNA, 13 bp, Unknown
  misc_feature (1)..( 13): Result.001 file - promoters75/4915127
tatatatgggcct

SEQ ID NO: 79183 - DNA, 16 bp, Unknown
  misc_feature (1)..( 16): Result.001 file - promoters75/4915127
tgctgctgaattggaa

SEQ ID NO: 79184 - DNA, 16 bp, Unknown
  misc_feature (1)..( 16): Result.001 file - promoters75/4915127
ctcttatgatttgctt

SEQ ID NO: 79185 - DNA, 16 bp, Unknown
  misc_feature (1)..( 16): Result.001 file - promoters75/4915127
acagcagtattagctt

SEQ ID NO: 79186 - DNA, 16 bp, Unknown
  misc_feature (1)..( 16): Result.001 file - promoters75/4915127
caaaactgatttttaa

SEQ ID NO: 79187 - DNA, 16 bp, Unknown
  misc_feature (1)..( 16): Result.001 file - promoters75/4915127
ctcgtataattctttt

SEQ ID NO: 79188 - DNA, 16 bp, Unknown
  misc_feature (1)..( 16): Result.001 file - promoters75/4915606
ctcttatttattctgt

SEQ ID NO: 79189 - DNA, 13 bp, Unknown
  misc_feature (1)..( 13): Result.001 file - promoters75/4915606
aattatatatata

SEQ ID NO: 79190 - DNA, 13 bp, Unknown
  misc_feature (1)..( 13): Result.001 file - promoters75/4915606
aatcataatagag

SEQ ID NO: 79191 - DNA, 13 bp, Unknown
  misc_feature (1)..( 13): Result.001 file - promoters75/4978201
acttattccatta

SEQ ID NO: 79192 - DNA, 11 bp, Unknown
  misc_feature (1)..( 11): Result.001 file - promoters75/4978201
tttattgttac

SEQ ID NO: 79193 - DNA, 11 bp, Unknown
  misc_feature (1)..( 11): Result.001 file - promoters75/4978201
caaatttttac

SEQ ID NO: 79194 - DNA, 11 bp, Unknown
  misc_feature (1)..( 11): Result.001 file - promoters75/4978201
catattcttaa

SEQ ID NO: 79195 - DNA, 11 bp, Unknown
  misc_feature (1)..( 11): Result.001 file - promoters75/4978201
gtctttgttag

SEQ ID NO: 79196 - DNA, 11 bp, Unknown
  misc_feature (1)..( 11): Result.001 file - promoters75/4978201
tttagttttgt

SEQ ID NO: 79197 - DNA, 11 bp, Unknown
  misc_feature (1)..( 11): Result.001 file - promoters75/4978201
aattttgtttt

SEQ ID NO: 79198 - DNA, 17 bp, Unknown
  misc_feature (1)..( 17): Result.001 file - promoters75/4978201
taaatattcaactatac

SEQ ID NO: 79199 - DNA, 17 bp, Unknown
  misc_feature (1)..( 17): Result.001 file - promoters75/4978201
atttaattcaaaaagca

SEQ ID NO: 79200 - DNA, 17 bp, Unknown
  misc_feature (1)..( 17): Result.001 file - promoters75/4978201
ttcttatgcaaagccat

SEQ ID NO: 79201 - DNA, 17 bp, Unknown
  misc_feature (1)..( 17): Result.001 file - promoters75/4978201
atggtgttcaaaaaaat

SEQ ID NO: 79202 - DNA, 17 bp, Unknown
  misc_feature (1)..( 17): Result.001 file - promoters75/4978201
caaattttgaaaaaaat

SEQ ID NO: 79203 - DNA, 17 bp, Unknown
  misc_feature (1)..( 17): Result.001 file - promoters75/4978201
acgtaagaaaaaaaaaa

SEQ ID NO: 79204 - DNA, 17 bp, Unknown
  misc_feature (1)..( 17): Result.001 file - promoters75/4978201
agaagaaacaaagtaaa

SEQ ID NO: 79205 - DNA, 12 bp, Unknown
  misc_feature (1)..( 12): Result.001 file - promoters75/4978201
ccaaacaaaaca

SEQ ID NO: 79206 - DNA, 12 bp, Unknown
  misc_feature (1)..( 12): Result.001 file - promoters75/4978201
agaaacaaagta

SEQ ID NO: 79207 - DNA, 12 bp, Unknown
  misc_feature (1)..( 12): Result.001 file - promoters75/4978201
tcaaagaaattc

SEQ ID NO: 79208 - DNA, 12 bp, Unknown
  misc_feature (1)..( 12): Result.001 file - promoters75/4978201
taaaaccaagac

SEQ ID NO: 79209 - DNA, 12 bp, Unknown
  misc_feature (1)..( 12): Result.001 file - promoters75/4978201
agaaaaaaaaaa

SEQ ID NO: 79210 - DNA, 12 bp, Unknown
  misc_feature (1)..( 12): Result.001 file - promoters75/5662799
gcaaagccatat

SEQ ID NO: 79211 - DNA, 8 bp, Unknown
  misc_feature (1)..( 8): Result.001 file - promoters75/5662799
gttgtcca

SEQ ID NO: 79212 - DNA, 8 bp, Unknown
  misc_feature (1)..( 8): Result.001 file - promoters75/5662799
tttgacca

SEQ ID NO: 79213 - DNA, 8 bp, Unknown
  misc_feature (1)..( 8): Result.001 file - promoters75/5662893
tttgacta

SEQ ID NO: 79214 - DNA, 8 bp, Unknown
  misc_feature (1)..( 8): Result.001 file - promoters75/5662893
tttgtatt

SEQ ID NO: 79215 - DNA, 8 bp, Unknown
  misc_feature (1)..( 8): Result.001 file - promoters75/5662893
tttttatt

SEQ ID NO: 79216 - DNA, 8 bp, Unknown
  misc_feature (1)..( 8): Result.001 file - promoters75/5662914
tttggatt

SEQ ID NO: 79217 - DNA, 10 bp, Unknown
  misc_feature (1)..( 10): Result.001 file - promoters75/5662914
ggaaggagag

SEQ ID NO: 79218 - DNA, 10 bp, Unknown
  misc_feature (1)..( 10): Result.001 file - promoters75/5662914
ggaagtagag

SEQ ID NO: 79219 - DNA, 10 bp, Unknown
  misc_feature (1)..( 10): Result.001 file - promoters75/5662914
ggaagtagag

SEQ ID NO: 79220 - DNA, 9 bp, Unknown
  misc_feature (1)..( 9): Result.001 file - promoters75/5662914
gagatgaga

SEQ ID NO: 79221 - DNA, 9 bp, Unknown
  misc_feature (1)..( 9): Result.001 file - promoters75/5662914
aagatgatg

SEQ ID NO: 79222 - DNA, 9 bp, Unknown
  misc_feature (1)..( 9): Result.001 file - promoters75/5663003
aagttgatg

SEQ ID NO: 79223 - DNA, 9 bp, Unknown
  misc_feature (1)..( 9): Result.001 file - promoters75/5663003
ttctctttt

SEQ ID NO: 79224 - DNA, 9 bp, Unknown
  misc_feature (1)..( 9): Result.001 file - promoters75/5663003
acctctttt

SEQ ID NO: 79225 - DNA, 9 bp, Unknown
  misc_feature (1)..( 9): Result.001 file - promoters75/5663003
accccttag

SEQ ID NO: 79226 - DNA, 7 bp, Unknown
  misc_feature (1)..( 7): Result.001 file - promoters75/5663003
aatttac

SEQ ID NO: 79227 - DNA, 7 bp, Unknown
  misc_feature (1)..( 7): Result.001 file - promoters75/5663003
aatctac

SEQ ID NO: 79228 - DNA, 7 bp, Unknown
  misc_feature (1)..( 7): Result.001 file - promoters75/5663003
aatttat

SEQ ID NO: 79229 - DNA, 11 bp, Unknown
  misc_feature (1)..( 11): Result.001 file - promoters75/5663003
ctaaaatagta

SEQ ID NO: 79230 - DNA, 11 bp, Unknown
  misc_feature (1)..( 11): Result.001 file - promoters75/5663003
aaataattgta

SEQ ID NO: 79231 - DNA, 11 bp, Unknown
  misc_feature (1)..( 11): Result.001 file - promoters75/5663003
aaagaattgaa

SEQ ID NO: 79232 - DNA, 8 bp, Unknown
  misc_feature (1)..( 8): Result.001 file - promoters75/5663003
aaggtata

SEQ ID NO: 79233 - DNA, 8 bp, Unknown
  misc_feature (1)..( 8): Result.001 file - promoters75/5663003
aagctata

SEQ ID NO: 79234 - DNA, 8 bp, Unknown
  misc_feature (1)..( 8): Result.001 file - promoters75/5663003
cagcaata

SEQ ID NO: 79235 - DNA, 10 bp, Unknown
  misc_feature (1)..( 10): Result.001 file - promoters75/5663003
ttactaaaat

SEQ ID NO: 79236 - DNA, 10 bp, Unknown
  misc_feature (1)..( 10): Result.001 file - promoters75/5663003
ttattaattt

SEQ ID NO: 79237 - DNA, 11 bp, Unknown
  misc_feature (1)..( 11): Result.001 file - promoters75/5663003
gaactgaaaga

SEQ ID NO: 79238 - DNA, 11 bp, Unknown
  misc_feature (1)..( 11): Result.001 file - promoters75/5663003
ttgtataaatt

SEQ ID NO: 79239 - DNA, 9 bp, Unknown
  misc_feature (1)..( 9): Result.001 file - promoters75/5663003
aaagaagaa

SEQ ID NO: 79240 - DNA, 9 bp, Unknown
  misc_feature (1)..( 9): Result.001 file - promoters75/5663003
aaagaattg

SEQ ID NO: 79241 - DNA, 9 bp, Unknown
  misc_feature (1)..( 9): Result.001 file - promoters75/5663003
aaataattg

SEQ ID NO: 79242 - DNA, 13 bp, Unknown
  misc_feature (1)..( 13): Result.001 file - promoters75/5663003
aatatcaccgacg

SEQ ID NO: 79243 - DNA, 13 bp, Unknown
  misc_feature (1)..( 13): Result.001 file - promoters75/5663003
aatatcttgtaag

SEQ ID NO: 79244 - DNA, 13 bp, Unknown
  misc_feature (1)..( 13): Result.001 file - promoters75/5663003
aatctcaacgacg

SEQ ID NO: 79245 - DNA, 8 bp, Unknown
  misc_feature (1)..( 8): Result.001 file - promoters75/5663003
taatcata

SEQ ID NO: 79246 - DNA, 8 bp, Unknown
  misc_feature (1)..( 8): Result.001 file - promoters75/5663003
aaataata

SEQ ID NO: 79247 - DNA, 8 bp, Unknown
  misc_feature (1)..( 8): Result.001 file - promoters75/5663116
aaacaatc

SEQ ID NO: 79248 - DNA, 9 bp, Unknown
  misc_feature (1)..( 9): Result.001 file - promoters75/5663116
cattagttt

SEQ ID NO: 79249 - DNA, 9 bp, Unknown
  misc_feature (1)..( 9): Result.001 file - promoters75/5663116
cattcgttt

SEQ ID NO: 79250 - DNA, 9 bp, Unknown
  misc_feature (1)..( 9): Result.001 file - promoters75/5663862
ttttcattt

SEQ ID NO: 79251 - DNA, 9 bp, Unknown
  misc_feature (1)..( 9): Result.001 file - promoters75/5663862
taactttat

SEQ ID NO: 79252 - DNA, 9 bp, Unknown
  misc_feature (1)..( 9): Result.001 file - promoters75/5663862
caactttag

SEQ ID NO: 79253 - DNA, 9 bp, Unknown
  misc_feature (1)..( 9): Result.001 file - promoters75/5663862
taagtttga

SEQ ID NO: 79254 - DNA, 9 bp, Unknown
  misc_feature (1)..( 9): Result.001 file - promoters75/5663934
cgtctttat

SEQ ID NO: 79255 - DNA, 14 bp, Unknown
  misc_feature (1)..( 14): Result.001 file - promoters75/5663934
tttagttttgtaaa

SEQ ID NO: 79256 - DNA, 14 bp, Unknown
  misc_feature (1)..( 14): Result.001 file - promoters75/5663934
tttacttttaacaa

SEQ ID NO: 79257 - DNA, 14 bp, Unknown
  misc_feature (1)..( 14): Result.001 file - promoters75/5663934
aaaagtttttgtaa

SEQ ID NO: 79258 - DNA, 14 bp, Unknown
  misc_feature (1)..( 14): Result.001 file - promoters75/5663934
tagggttttttctt

SEQ ID NO: 79259 - DNA, 14 bp, Unknown
  misc_feature (1)..( 14): Result.001 file - promoters75/5663934
tttattgttacaaa

SEQ ID NO: 79260 - DNA, 15 bp, Unknown
  misc_feature (1)..( 15): Result.001 file - promoters75/5663970
gtttgttgttgggtc

SEQ ID NO: 79261 - DNA, 9 bp, Unknown
  misc_feature (1)..( 9): Result.001 file - promoters75/5663970
gagtttctc

SEQ ID NO: 79262 - DNA, 9 bp, Unknown
  misc_feature (1)..( 9): Result.001 file - promoters75/5663970
tagtctctt

SEQ ID NO: 79263 - DNA, 9 bp, Unknown
  misc_feature (1)..( 9): Result.001 file - promoters75/5663970
gagattctg

SEQ ID NO: 79264 - DNA, 9 bp, Unknown
  misc_feature (1)..( 9): Result.001 file - promoters75/5664294
tagtttctt

SEQ ID NO: 79265 - DNA, 8 bp, Unknown
  misc_feature (1)..( 8): Result.001 file - promoters75/5664294
caaaccga

SEQ ID NO: 79266 - DNA, 8 bp, Unknown
  misc_feature (1)..( 8): Result.001 file - promoters75/5664294
aaaatcga

SEQ ID NO: 79267 - DNA, 8 bp, Unknown
  misc_feature (1)..( 8): Result.001 file - promoters75/5664294
aaaatctg

SEQ ID NO: 79268 - DNA, 8 bp, Unknown
  misc_feature (1)..( 8): Result.001 file - promoters75/5664294
gataaaaa

SEQ ID NO: 79269 - DNA, 8 bp, Unknown
  misc_feature (1)..( 8): Result.001 file - promoters75/5664294
tatataaa

SEQ ID NO: 79270 - DNA, 8 bp, Unknown
  misc_feature (1)..( 8): Result.001 file - promoters75/5664311
gataaatg

SEQ ID NO: 79271 - DNA, 7 bp, Unknown
  misc_feature (1)..( 7): Result.001 file - promoters75/5664311
tttctca

SEQ ID NO: 79272 - DNA, 7 bp, Unknown
  misc_feature (1)..( 7): Result.001 file - promoters75/5664311
tttgtca

SEQ ID NO: 79273 - DNA, 7 bp, Unknown
  misc_feature (1)..( 7): Result.001 file - promoters75/5664311
tttctct

SEQ ID NO: 79274 - DNA, 10 bp, Unknown
  misc_feature (1)..( 10): Result.001 file - promoters75/5664311
aataaatttt

SEQ ID NO: 79275 - DNA, 10 bp, Unknown
  misc_feature (1)..( 10): Result.001 file - promoters75/5664311
aatatatttt

SEQ ID NO: 79276 - DNA, 10 bp, Unknown
  misc_feature (1)..( 10): Result.001 file - promoters75/5664362
atcaaatttt

SEQ ID NO: 79277 - DNA, 9 bp, Unknown
  misc_feature (1)..( 9): Result.001 file - promoters75/5664362
gcgttttct

SEQ ID NO: 79278 - DNA, 9 bp, Unknown
  misc_feature (1)..( 9): Result.001 file - promoters75/5664362
ttgttttct

SEQ ID NO: 79279 - DNA, 9 bp, Unknown
  misc_feature (1)..( 9): Result.001 file - promoters75/5664465
ttgttttaa

SEQ ID NO: 79280 - DNA, 7 bp, Unknown
  misc_feature (1)..( 7): Result.001 file - promoters75/5664465
ttcacaa

SEQ ID NO: 79281 - DNA, 7 bp, Unknown
  misc_feature (1)..( 7): Result.001 file - promoters75/5664465
gtcacaa

SEQ ID NO: 79282 - DNA, 7 bp, Unknown
  misc_feature (1)..( 7): Result.001 file - promoters75/5664703
ttcacag

SEQ ID NO: 79283 - DNA, 12 bp, Unknown
  misc_feature (1)..( 12): Result.001 file - promoters75/5664703
ctttttgtttat

SEQ ID NO: 79284 - DNA, 12 bp, Unknown
  misc_feature (1)..( 12): Result.001 file - promoters75/5664703
tgatttgtatat

SEQ ID NO: 79285 - DNA, 12 bp, Unknown
  misc_feature (1)..( 12): Result.001 file - promoters75/5664703
cttattgtataa

SEQ ID NO: 79286 - DNA, 8 bp, Unknown
  misc_feature (1)..( 8): Result.001 file - promoters75/5664703
gctggatt

SEQ ID NO: 79287 - DNA, 8 bp, Unknown
  misc_feature (1)..( 8): Result.001 file - promoters75/5664703
tctgaatt

SEQ ID NO: 79288 - DNA, 8 bp, Unknown
  misc_feature (1)..( 8): Result.001 file - promoters75/5664873
tctgaaca

SEQ ID NO: 79289 - DNA, 12 bp, Unknown
  misc_feature (1)..( 12): Result.001 file - promoters75/5664873
aaaataaaataa

SEQ ID NO: 79290 - DNA, 12 bp, Unknown
  misc_feature (1)..( 12): Result.001 file - promoters75/5664873
caaagaaagaca

SEQ ID NO: 79291 - DNA, 12 bp, Unknown
  misc_feature (1)..( 12): Result.001 file - promoters75/5664885
aaaataaactaa

SEQ ID NO: 79292 - DNA, 9 bp, Unknown
  misc_feature (1)..( 9): Result.001 file - promoters75/5664885
aatttaacc

SEQ ID NO: 79293 - DNA, 9 bp, Unknown
  misc_feature (1)..( 9): Result.001 file - promoters75/5664885
attttgacc

SEQ ID NO: 79294 - DNA, 9 bp, Unknown
  misc_feature (1)..( 9): Result.001 file - promoters75/5664885
attttgatt

SEQ ID NO: 79295 - DNA, 8 bp, Unknown
  misc_feature (1)..( 8): Result.001 file - promoters75/5664885
acttcata

SEQ ID NO: 79296 - DNA, 8 bp, Unknown
  misc_feature (1)..( 8): Result.001 file - promoters75/5664885
cattcata

SEQ ID NO: 79297 - DNA, 8 bp, Unknown
  misc_feature (1)..( 8): Result.001 file - promoters75/5665347
cattcatc

SEQ ID NO: 79298 - DNA, 11 bp, Unknown
  misc_feature (1)..( 11): Result.001 file - promoters75/5665347
agttataaatc

SEQ ID NO: 79299 - DNA, 11 bp, Unknown
  misc_feature (1)..( 11): Result.001 file - promoters75/5665347
agttatgaatc

SEQ ID NO: 79300 - DNA, 11 bp, Unknown
  misc_feature (1)..( 11): Result.001 file - promoters75/5665347
tgttatttatt

SEQ ID NO: 79301 - DNA, 11 bp, Unknown
  misc_feature (1)..( 11): Result.001 file - promoters75/5665347
gaaaatgaatt

SEQ ID NO: 79302 - DNA, 11 bp, Unknown
  misc_feature (1)..( 11): Result.001 file - promoters75/5665347
tttaatcaatc

SEQ ID NO: 79303 - DNA, 11 bp, Unknown
  misc_feature (1)..( 11): Result.001 file - promoters75/5667720
gattataaatc

SEQ ID NO: 79304 - DNA, 9 bp, Unknown
  misc_feature (1)..( 9): Result.001 file - promoters75/5667720
taaccaaaa

SEQ ID NO: 79305 - DNA, 9 bp, Unknown
  misc_feature (1)..( 9): Result.001 file - promoters75/5667720
taaccaaaa

SEQ ID NO: 79306 - DNA, 9 bp, Unknown
  misc_feature (1)..( 9): Result.001 file - promoters75/5667720
aaactaaac

SEQ ID NO: 79307 - DNA, 12 bp, Unknown
  misc_feature (1)..( 12): Result.001 file - promoters75/5667720
aaaataaaataa

SEQ ID NO: 79308 - DNA, 12 bp, Unknown
  misc_feature (1)..( 12): Result.001 file - promoters75/5667720
aaaataatagta

SEQ ID NO: 79309 - DNA, 12 bp, Unknown
  misc_feature (1)..( 12): Result.001 file - promoters75/5667812
aaaataaactaa

SEQ ID NO: 79310 - DNA, 10 bp, Unknown
  misc_feature (1)..( 10): Result.001 file - promoters75/5667812
gagttggata

SEQ ID NO: 79311 - DNA, 10 bp, Unknown
  misc_feature (1)..( 10): Result.001 file - promoters75/5667812
tctttggatt

SEQ ID NO: 79312 - DNA, 10 bp, Unknown
  misc_feature (1)..( 10): Result.001 file - promoters75/5667812
ggtttgtata

SEQ ID NO: 79313 - DNA, 10 bp, Unknown
  misc_feature (1)..( 10): Result.001 file - promoters75/5667812
tctttgaata

SEQ ID NO: 79314 - DNA, 10 bp, Unknown
  misc_feature (1)..( 10): Result.001 file - promoters75/5667812
gagatggatc

SEQ ID NO: 79315 - DNA, 10 bp, Unknown
  misc_feature (1)..( 10): Result.001 file - promoters75/5667812
gagctgggtt

SEQ ID NO: 79316 - DNA, 15 bp, Unknown
  misc_feature (1)..( 15): Result.001 file - promoters75/5667812
aaaagtttttgtaat

SEQ ID NO: 79317 - DNA, 15 bp, Unknown
  misc_feature (1)..( 15): Result.001 file - promoters75/5667812
caaacttttattttt

SEQ ID NO: 79318 - DNA, 15 bp, Unknown
  misc_feature (1)..( 15): Result.001 file - promoters75/5667812
gaaaggtttcttctc

SEQ ID NO: 79319 - DNA, 15 bp, Unknown
  misc_feature (1)..( 15): Result.001 file - promoters75/5667812
tgaagtttgaaacaa

SEQ ID NO: 79320 - DNA, 15 bp, Unknown
  misc_feature (1)..( 15): Result.001 file - promoters75/5667812
caaatttttactttt

SEQ ID NO: 79321 - DNA, 15 bp, Unknown
  misc_feature (1)..( 15): Result.001 file - promoters75/5667849
gttattattatattt

SEQ ID NO: 79322 - DNA, 9 bp, Unknown
  misc_feature (1)..( 9): Result.001 file - promoters75/5667849
gtgaaggat

SEQ ID NO: 79323 - DNA, 9 bp, Unknown
  misc_feature (1)..( 9): Result.001 file - promoters75/5667849
gtgaatgat

SEQ ID NO: 79324 - DNA, 9 bp, Unknown
  misc_feature (1)..( 9): Result.001 file - promoters75/5667849
gtgaatgat

SEQ ID NO: 79325 - DNA, 8 bp, Unknown
  misc_feature (1)..( 8): Result.001 file - promoters75/5667849
cattgtgt

SEQ ID NO: 79326 - DNA, 8 bp, Unknown
  misc_feature (1)..( 8): Result.001 file - promoters75/5667849
cattttgt

SEQ ID NO: 79327 - DNA, 8 bp, Unknown
  misc_feature (1)..( 8): Result.001 file - promoters75/5668065
cattttgt

SEQ ID NO: 79328 - DNA, 9 bp, Unknown
  misc_feature (1)..( 9): Result.001 file - promoters75/5668065
aaagaaaat

SEQ ID NO: 79329 - DNA, 9 bp, Unknown
  misc_feature (1)..( 9): Result.001 file - promoters75/5668065
gtggaaaat

SEQ ID NO: 79330 - DNA, 9 bp, Unknown
  misc_feature (1)..( 9): Result.001 file - promoters75/5668065
aaacaaaac

SEQ ID NO: 79331 - DNA, 9 bp, Unknown
  misc_feature (1)..( 9): Result.001 file - promoters75/5668065
aaagaaaag

SEQ ID NO: 79332 - DNA, 9 bp, Unknown
  misc_feature (1)..( 9): Result.001 file - promoters75/5668065
taagaaaaa

SEQ ID NO: 79333 - DNA, 9 bp, Unknown
  misc_feature (1)..( 9): Result.001 file - promoters75/5668065
aaacaaagt

SEQ ID NO: 79334 - DNA, 16 bp, Unknown
  misc_feature (1)..( 16): Result.001 file - promoters75/5668065
tgctgctgaattggaa

SEQ ID NO: 79335 - DNA, 16 bp, Unknown
  misc_feature (1)..( 16): Result.001 file - promoters75/5668065
ctcttatgatttgctt

SEQ ID NO: 79336 - DNA, 16 bp, Unknown
  misc_feature (1)..( 16): Result.001 file - promoters75/5668065
acagcagtattagctt

SEQ ID NO: 79337 - DNA, 16 bp, Unknown
  misc_feature (1)..( 16): Result.001 file - promoters75/5668065
caaaactgatttttaa

SEQ ID NO: 79338 - DNA, 16 bp, Unknown
  misc_feature (1)..( 16): Result.001 file - promoters75/5668065
ctcgtataattctttt

SEQ ID NO: 79339 - DNA, 16 bp, Unknown
  misc_feature (1)..( 16): Result.001 file - promoters75/5668065
cttccatgtttttgct

SEQ ID NO: 79340 - DNA, 17 bp, Unknown
  misc_feature (1)..( 17): Result.001 file - promoters75/5668292
tctttttgttgttgttc

SEQ ID NO: 79341 - DNA, 13 bp, Unknown
  misc_feature (1)..( 13): Result.001 file - promoters75/5668292
ctcgtataattct

SEQ ID NO: 79342 - DNA, 13 bp, Unknown
  misc_feature (1)..( 13): Result.001 file - promoters75/5668292
ctcttatgatttg

SEQ ID NO: 79343 - DNA, 13 bp, Unknown
  misc_feature (1)..( 13): Result.001 file - promoters75/5668292
cttccatgttttt

SEQ ID NO: 79344 - DNA, 13 bp, Unknown
  misc_feature (1)..( 13): Result.001 file - promoters75/5668292
ctctactcttgga

SEQ ID NO: 79345 - DNA, 13 bp, Unknown
  misc_feature (1)..( 13): Result.001 file - promoters75/5668292
ctcttaaaagtct

SEQ ID NO: 79346 - DNA, 13 bp, Unknown
  misc_feature (1)..( 13): Result.001 file - promoters75/5668292
tgagtttgatttg

SEQ ID NO: 79347 - DNA, 10 bp, Unknown
  misc_feature (1)..( 10): Result.001 file - promoters75/5668292
aaaagttttt

SEQ ID NO: 79348 - DNA, 10 bp, Unknown
  misc_feature (1)..( 10): Result.001 file - promoters75/5668292
tttagttttg

SEQ ID NO: 79349 - DNA, 10 bp, Unknown
  misc_feature (1)..( 10): Result.001 file - promoters75/5668292
acaagtttcc

SEQ ID NO: 79350 - DNA, 10 bp, Unknown
  misc_feature (1)..( 10): Result.001 file - promoters75/5668292
tgaagtttga

SEQ ID NO: 79351 - DNA, 10 bp, Unknown
  misc_feature (1)..( 10): Result.001 file - promoters75/5668292
aaaagtgttg

SEQ ID NO: 79352 - DNA, 10 bp, Unknown
  misc_feature (1)..( 10): Result.001 file - promoters75/5668292
tttactttta

SEQ ID NO: 79353 - DNA, 10 bp, Unknown
  misc_feature (1)..( 10): Result.001 file - promoters75/5668292
cggagtttct

SEQ ID NO: 79354 - DNA, 16 bp, Unknown
  misc_feature (1)..( 16): Result.001 file - promoters75/5668292
attaaaaatgggtcta

SEQ ID NO: 79355 - DNA, 16 bp, Unknown
  misc_feature (1)..( 16): Result.001 file - promoters75/5668292
attaaagtttgggcca

SEQ ID NO: 79356 - DNA, 16 bp, Unknown
  misc_feature (1)..( 16): Result.001 file - promoters75/5668292
tttaaaaaagggaagt

SEQ ID NO: 79357 - DNA, 16 bp, Unknown
  misc_feature (1)..( 16): Result.001 file - promoters75/5668292
cttaaagtgtgggcca

SEQ ID NO: 79358 - DNA, 16 bp, Unknown
  misc_feature (1)..( 16): Result.001 file - promoters75/5668292
tttaatgttgggcctt

SEQ ID NO: 79359 - DNA, 16 bp, Unknown
  misc_feature (1)..( 16): Result.001 file - promoters75/5668292
ttgatttgatggccca

SEQ ID NO: 79360 - DNA, 8 bp, Unknown
  misc_feature (1)..( 8): Result.001 file - promoters75/5668292
atgggccg

SEQ ID NO: 79361 - DNA, 8 bp, Unknown
  misc_feature (1)..( 8): Result.001 file - promoters75/5668292
ttgggcca

SEQ ID NO: 79362 - DNA, 8 bp, Unknown
  misc_feature (1)..( 8): Result.001 file - promoters75/5668292
gtgggcca

SEQ ID NO: 79363 - DNA, 8 bp, Unknown
  misc_feature (1)..( 8): Result.001 file - promoters75/5668292
ttgggcct

SEQ ID NO: 79364 - DNA, 8 bp, Unknown
  misc_feature (1)..( 8): Result.001 file - promoters75/5668292
atgggcct

SEQ ID NO: 79365 - DNA, 8 bp, Unknown
  misc_feature (1)..( 8): Result.001 file - promoters75/5668435
atggccca

SEQ ID NO: 79366 - DNA, 13 bp, Unknown
  misc_feature (1)..( 13): Result.001 file - promoters75/5668435
catataaaacgat

SEQ ID NO: 79367 - DNA, 13 bp, Unknown
  misc_feature (1)..( 13): Result.001 file - promoters75/5668435
gatacaaaaccct

SEQ ID NO: 79368 - DNA, 13 bp, Unknown
  misc_feature (1)..( 13): Result.001 file - promoters75/5668435
gagacaaatagaa

SEQ ID NO: 79369 - DNA, 13 bp, Unknown
  misc_feature (1)..( 13): Result.001 file - promoters75/5668435
tatataaaaccaa

SEQ ID NO: 79370 - DNA, 13 bp, Unknown
  misc_feature (1)..( 13): Result.001 file - promoters75/5668435
gggaaaaaatcaa

SEQ ID NO: 79371 - DNA, 13 bp, Unknown
  misc_feature (1)..( 13): Result.001 file - promoters75/5668435
gagtcaaagaaat

SEQ ID NO: 79372 - DNA, 12 bp, Unknown
  misc_feature (1)..( 12): Result.001 file - promoters75/5668435
cactatataaag

SEQ ID NO: 79373 - DNA, 12 bp, Unknown
  misc_feature (1)..( 12): Result.001 file - promoters75/5668435
cactatttaaag

SEQ ID NO: 79374 - DNA, 12 bp, Unknown
  misc_feature (1)..( 12): Result.001 file - promoters75/5668435
tcttatatataa

SEQ ID NO: 79375 - DNA, 12 bp, Unknown
  misc_feature (1)..( 12): Result.001 file - promoters75/5668435
tttaattaaaac

SEQ ID NO: 79376 - DNA, 12 bp, Unknown
  misc_feature (1)..( 12): Result.001 file - promoters75/5668435
gcttatttatga

SEQ ID NO: 79377 - DNA, 12 bp, Unknown
  misc_feature (1)..( 12): Result.001 file - promoters75/5668435
ggtcatttaaag

SEQ ID NO: 79378 - DNA, 8 bp, Unknown
  misc_feature (1)..( 8): Result.001 file - promoters75/5668435
aatgggcc

SEQ ID NO: 79379 - DNA, 8 bp, Unknown
  misc_feature (1)..( 8): Result.001 file - promoters75/5668435
tttgggcc

SEQ ID NO: 79380 - DNA, 8 bp, Unknown
  misc_feature (1)..( 8): Result.001 file - promoters75/5668435
tgtgggcc

SEQ ID NO: 79381 - DNA, 8 bp, Unknown
  misc_feature (1)..( 8): Result.001 file - promoters75/5668435
tatgggcc

SEQ ID NO: 79382 - DNA, 8 bp, Unknown
  misc_feature (1)..( 8): Result.001 file - promoters75/5668435
tttcggcc

SEQ ID NO: 79383 - DNA, 8 bp, Unknown
  misc_feature (1)..( 8): Result.001 file - promoters75/5668493
aatgggct

SEQ ID NO: 79384 - DNA, 9 bp, Unknown
  misc_feature (1)..( 9): Result.001 file - promoters75/5668493
aatcaatca

SEQ ID NO: 79385 - DNA, 9 bp, Unknown
  misc_feature (1)..( 9): Result.001 file - promoters75/5668493
aataaatgt

SEQ ID NO: 79386 - DNA, 9 bp, Unknown
  misc_feature (1)..( 9): Result.001 file - promoters75/5668493
catcaattt

SEQ ID NO: 79387 - DNA, 9 bp, Unknown
  misc_feature (1)..( 9): Result.001 file - promoters75/5668493
attaaatgt

SEQ ID NO: 79388 - DNA, 9 bp, Unknown
  misc_feature (1)..( 9): Result.001 file - promoters75/5668493
gtttgttta

SEQ ID NO: 79389 - DNA, 9 bp, Unknown
  misc_feature (1)..( 9): Result.001 file - promoters75/5668493
ttttatttg

SEQ ID NO: 79390 - DNA, 9 bp, Unknown
  misc_feature (1)..( 9): Result.001 file - promoters75/5668493
gtttgatta

SEQ ID NO: 79391 - DNA, 9 bp, Unknown
  misc_feature (1)..( 9): Result.001 file - promoters75/5668493
atttattta

SEQ ID NO: 79392 - DNA, 9 bp, Unknown
  misc_feature (1)..( 9): Result.001 file - promoters75/5668493
tacaataaa

SEQ ID NO: 79393 - DNA, 9 bp, Unknown
  misc_feature (1)..( 9): Result.001 file - promoters75/5668493
tacaatatt

SEQ ID NO: 79394 - DNA, 9 bp, Unknown
  misc_feature (1)..( 9): Result.001 file - promoters75/5668493
ttcaaaatt

SEQ ID NO: 79395 - DNA, 9 bp, Unknown
  misc_feature (1)..( 9): Result.001 file - promoters75/5668509
atcaatatg

SEQ ID NO: 79396 - DNA, 7 bp, Unknown
  misc_feature (1)..( 7): Result.001 file - promoters75/5668509
agaggag

SEQ ID NO: 79397 - DNA, 7 bp, Unknown
  misc_feature (1)..( 7): Result.001 file - promoters75/5668509
tgaggag

SEQ ID NO: 79398 - DNA, 7 bp, Unknown
  misc_feature (1)..( 7): Result.001 file - promoters75/5668720
agaggat

SEQ ID NO: 79399 - DNA, 13 bp, Unknown
  misc_feature (1)..( 13): Result.001 file - promoters75/5668720
ctaaaggcccaat

SEQ ID NO: 79400 - DNA, 13 bp, Unknown
  misc_feature (1)..( 13): Result.001 file - promoters75/5668720
gtgaaagcccaaa

SEQ ID NO: 79401 - DNA, 13 bp, Unknown
  misc_feature (1)..( 13): Result.001 file - promoters75/5668720
ctaaaggcccaat

SEQ ID NO: 79402 - DNA, 13 bp, Unknown
  misc_feature (1)..( 13): Result.001 file - promoters75/5668720
aattcggcccatc

SEQ ID NO: 79403 - DNA, 11 bp, Unknown
  misc_feature (1)..( 11): Result.001 file - promoters75/5668720
ttcaaaaatac

SEQ ID NO: 79404 - DNA, 11 bp, Unknown
  misc_feature (1)..( 11): Result.001 file - promoters75/5668720
tacaataatac

SEQ ID NO: 79405 - DNA, 11 bp, Unknown
  misc_feature (1)..( 11): Result.001 file - promoters75/5668720
ttctaaaatct

SEQ ID NO: 79406 - DNA, 11 bp, Unknown
  misc_feature (1)..( 11): Result.001 file - promoters75/5668720
tttaaaaactt

SEQ ID NO: 79407 - DNA, 8 bp, Unknown
  misc_feature (1)..( 8): Result.001 file - promoters75/5668720
gaatttga

SEQ ID NO: 79408 - DNA, 8 bp, Unknown
  misc_feature (1)..( 8): Result.001 file - promoters75/5668720
taatttga

SEQ ID NO: 79409 - DNA, 8 bp, Unknown
  misc_feature (1)..( 8): Result.001 file - promoters75/5668720
gaaattgc

SEQ ID NO: 79410 - DNA, 8 bp, Unknown
  misc_feature (1)..( 8): Result.001 file - promoters75/5668720
caatttgt

SEQ ID NO: 79411 - DNA, 8 bp, Unknown
  misc_feature (1)..( 8): Result.001 file - promoters75/5668720
tgaatttg

SEQ ID NO: 79412 - DNA, 8 bp, Unknown
  misc_feature (1)..( 8): Result.001 file - promoters75/5668720
tgaattgg

SEQ ID NO: 79413 - DNA, 8 bp, Unknown
  misc_feature (1)..( 8): Result.001 file - promoters75/5668720
tgatttgt

SEQ ID NO: 79414 - DNA, 8 bp, Unknown
  misc_feature (1)..( 8): Result.001 file - promoters75/5669025
caatttgt

SEQ ID NO: 79415 - DNA, 9 bp, Unknown
  misc_feature (1)..( 9): Result.001 file - promoters75/5669025
tggttttat

SEQ ID NO: 79416 - DNA, 9 bp, Unknown
  misc_feature (1)..( 9): Result.001 file - promoters75/5669025
ttgttctat

SEQ ID NO: 79417 - DNA, 9 bp, Unknown
  misc_feature (1)..( 9): Result.001 file - promoters75/5669025
tggtttttc

SEQ ID NO: 79418 - DNA, 8 bp, Unknown
  misc_feature (1)..( 8): Result.001 file - promoters75/5669025
aaatcatg

SEQ ID NO: 79419 - DNA, 8 bp, Unknown
  misc_feature (1)..( 8): Result.001 file - promoters75/5669025
atatcatg

SEQ ID NO: 79420 - DNA, 8 bp, Unknown
  misc_feature (1)..( 8): Result.001 file - promoters75/5669250
atatcatt

SEQ ID NO: 79421 - DNA, 8 bp, Unknown
  misc_feature (1)..( 8): Result.001 file - promoters75/5669250
agtataaa

SEQ ID NO: 79422 - DNA, 8 bp, Unknown
  misc_feature (1)..( 8): Result.001 file - promoters75/5669250
actataaa

SEQ ID NO: 79423 - DNA, 8 bp, Unknown
  misc_feature (1)..( 8): Result.001 file - promoters75/5670592
tatataaa

SEQ ID NO: 79424 - DNA, 8 bp, Unknown
  misc_feature (1)..( 8): Result.001 file - promoters75/5670592
aaataatt

SEQ ID NO: 79425 - DNA, 8 bp, Unknown
  misc_feature (1)..( 8): Result.001 file - promoters75/5670592
aaacaatt

SEQ ID NO: 79426 - DNA, 8 bp, Unknown
  misc_feature (1)..( 8): Result.001 file - promoters75/5674194
taataatt

SEQ ID NO: 79427 - DNA, 14 bp, Unknown
  misc_feature (1)..( 14): Result.001 file - promoters75/5674194
aatcattaatcctt

SEQ ID NO: 79428 - DNA, 14 bp, Unknown
  misc_feature (1)..( 14): Result.001 file - promoters75/5674194
catccttatacttc

SEQ ID NO: 79429 - DNA, 14 bp, Unknown
  misc_feature (1)..( 14): Result.001 file - promoters75/5674194
aataattaaagttt

SEQ ID NO: 79430 - DNA, 14 bp, Unknown
  misc_feature (1)..( 14): Result.001 file - promoters75/5674194
aatcataaaagttt

SEQ ID NO: 79431 - DNA, 14 bp, Unknown
  misc_feature (1)..( 14): Result.001 file - promoters75/5674194
aatgaaagggattc

SEQ ID NO: 79432 - DNA, 14 bp, Unknown
  misc_feature (1)..( 14): Result.001 file - promoters75/5674194
cttgagagggtttc

SEQ ID NO: 79433 - DNA, 11 bp, Unknown
  misc_feature (1)..( 11): Result.001 file - promoters75/5674194
catataaaatg

SEQ ID NO: 79434 - DNA, 11 bp, Unknown
  misc_feature (1)..( 11): Result.001 file - promoters75/5674194
cataaaaaatt

SEQ ID NO: 79435 - DNA, 11 bp, Unknown
  misc_feature (1)..( 11): Result.001 file - promoters75/5674194
aataaaaacag

SEQ ID NO: 79436 - DNA, 11 bp, Unknown
  misc_feature (1)..( 11): Result.001 file - promoters75/5674194
gatgaaatatt

SEQ ID NO: 79437 - DNA, 11 bp, Unknown
  misc_feature (1)..( 11): Result.001 file - promoters75/5674194
aagaaaaaaaa

SEQ ID NO: 79438 - DNA, 11 bp, Unknown
  misc_feature (1)..( 11): Result.001 file - promoters75/5674634
aattaaagaaa

SEQ ID NO: 79439 - DNA, 15 bp, Unknown
  misc_feature (1)..( 15): Result.001 file - promoters75/5674634
aaaatgaattctttc

SEQ ID NO: 79440 - DNA, 15 bp, Unknown
  misc_feature (1)..( 15): Result.001 file - promoters75/5674634
aaaacgaatggcaag

SEQ ID NO: 79441 - DNA, 15 bp, Unknown
  misc_feature (1)..( 15): Result.001 file - promoters75/5674634
ttattgatttcgtga

SEQ ID NO: 79442 - DNA, 15 bp, Unknown
  misc_feature (1)..( 15): Result.001 file - promoters75/5674634
caaacaaatcaaatc

SEQ ID NO: 79443 - DNA, 15 bp, Unknown
  misc_feature (1)..( 15): Result.001 file - promoters75/5674634
gaaaaaaagttatgc

SEQ ID NO: 79444 - DNA, 12 bp, Unknown
  misc_feature (1)..( 12): Result.001 file - promoters75/5674666
ttaatttcctga

SEQ ID NO: 79445 - DNA, 7 bp, Unknown
  misc_feature (1)..( 7): Result.001 file - promoters75/5674666
taatgaa

SEQ ID NO: 79446 - DNA, 7 bp, Unknown
  misc_feature (1)..( 7): Result.001 file - promoters75/5674666
taacgaa

SEQ ID NO: 79447 - DNA, 7 bp, Unknown
  misc_feature (1)..( 7): Result.001 file - promoters75/5674666
aaatgaa

SEQ ID NO: 79448 - DNA, 6 bp, Unknown
  misc_feature (1)..( 6): Result.001 file - promoters75/5674666
atttgt

SEQ ID NO: 79449 - DNA, 6 bp, Unknown
  misc_feature (1)..( 6): Result.001 file - promoters75/5674666
atttgt

SEQ ID NO: 79450 - DNA, 6 bp, Unknown
  misc_feature (1)..( 6): Result.001 file - promoters75/5674666
atttgt

SEQ ID NO: 79451 - DNA, 7 bp, Unknown
  misc_feature (1)..( 7): Result.001 file - promoters75/5674666
ttttttt

SEQ ID NO: 79452 - DNA, 7 bp, Unknown
  misc_feature (1)..( 7): Result.001 file - promoters75/5674666
tttattt

SEQ ID NO: 79453 - DNA, 7 bp, Unknown
  misc_feature (1)..( 7): Result.001 file - promoters75/5674666
tttattt

SEQ ID NO: 79454 - DNA, 10 bp, Unknown
  misc_feature (1)..( 10): Result.001 file - promoters75/5674666
gtttgtattt

SEQ ID NO: 79455 - DNA, 10 bp, Unknown
  misc_feature (1)..( 10): Result.001 file - promoters75/5674666
gtttgtaaac

SEQ ID NO: 79456 - DNA, 10 bp, Unknown
  misc_feature (1)..( 10): Result.001 file - promoters75/5674666
ttttgtcttt

SEQ ID NO: 79457 - DNA, 9 bp, Unknown
  misc_feature (1)..( 9): Result.001 file - promoters75/5674666
tgtattttt

SEQ ID NO: 79458 - DNA, 9 bp, Unknown
  misc_feature (1)..( 9): Result.001 file - promoters75/5674666
actatgttt

SEQ ID NO: 79459 - DNA, 9 bp, Unknown
  misc_feature (1)..( 9): Result.001 file - promoters75/5675661
tttgtcttt

SEQ ID NO: 79460 - DNA, 7 bp, Unknown
  misc_feature (1)..( 7): Result.001 file - promoters75/5675661
aatttct

SEQ ID NO: 79461 - DNA, 7 bp, Unknown
  misc_feature (1)..( 7): Result.001 file - promoters75/5675661
aatttct

SEQ ID NO: 79462 - DNA, 7 bp, Unknown
  misc_feature (1)..( 7): Result.001 file - promoters75/5675661
tatttct

SEQ ID NO: 79463 - DNA, 8 bp, Unknown
  misc_feature (1)..( 8): Result.001 file - promoters75/5675661
gtggttgg

SEQ ID NO: 79464 - DNA, 8 bp, Unknown
  misc_feature (1)..( 8): Result.001 file - promoters75/5675661
ttggttgg

SEQ ID NO: 79465 - DNA, 8 bp, Unknown
  misc_feature (1)..( 8): Result.001 file - promoters75/5677230
ttggtttt

SEQ ID NO: 79466 - DNA, 7 bp, Unknown
  misc_feature (1)..( 7): Result.001 file - promoters75/5677230
aaggaaa

SEQ ID NO: 79467 - DNA, 7 bp, Unknown
  misc_feature (1)..( 7): Result.001 file - promoters75/5677230
aagtaaa

SEQ ID NO: 79468 - DNA, 7 bp, Unknown
  misc_feature (1)..( 7): Result.001 file - promoters75/5677230
gagtaaa

SEQ ID NO: 79469 - DNA, 7 bp, Unknown
  misc_feature (1)..( 7): Result.001 file - promoters75/5677230
aaaatat

SEQ ID NO: 79470 - DNA, 7 bp, Unknown
  misc_feature (1)..( 7): Result.001 file - promoters75/5677230
aaaataa

SEQ ID NO: 79471 - DNA, 7 bp, Unknown
  misc_feature (1)..( 7): Result.001 file - promoters75/5677309
gaaatat

SEQ ID NO: 79472 - DNA, 10 bp, Unknown
  misc_feature (1)..( 10): Result.001 file - promoters75/5677309
aacaaaaact

SEQ ID NO: 79473 - DNA, 10 bp, Unknown
  misc_feature (1)..( 10): Result.001 file - promoters75/5677309
cacaaagact

SEQ ID NO: 79474 - DNA, 10 bp, Unknown
  misc_feature (1)..( 10): Result.001 file - promoters75/5677309
cacaaacggt

SEQ ID NO: 79475 - DNA, 11 bp, Unknown
  misc_feature (1)..( 11): Result.001 file - promoters75/5677309
taatttagtgg

SEQ ID NO: 79476 - DNA, 11 bp, Unknown
  misc_feature (1)..( 11): Result.001 file - promoters75/5677309
taatttgacaa

SEQ ID NO: 79477 - DNA, 11 bp, Unknown
  misc_feature (1)..( 11): Result.001 file - promoters75/5677309
taattggacaa

SEQ ID NO: 79478 - DNA, 7 bp, Unknown
  misc_feature (1)..( 7): Result.001 file - promoters75/5677309
aaaagtt

SEQ ID NO: 79479 - DNA, 7 bp, Unknown
  misc_feature (1)..( 7): Result.001 file - promoters75/5677309
aaaagtc

SEQ ID NO: 79480 - DNA, 7 bp, Unknown
  misc_feature (1)..( 7): Result.001 file - promoters75/5677344
aaaatca

SEQ ID NO: 79481 - DNA, 7 bp, Unknown
  misc_feature (1)..( 7): Result.001 file - promoters75/5677344
aaaattg

SEQ ID NO: 79482 - DNA, 7 bp, Unknown
  misc_feature (1)..( 7): Result.001 file - promoters75/5677344
aaaattt

SEQ ID NO: 79483 - DNA, 7 bp, Unknown
  misc_feature (1)..( 7): Result.001 file - promoters75/5753942
aaacttt

SEQ ID NO: 79484 - DNA, 9 bp, Unknown
  misc_feature (1)..( 9): Result.001 file - promoters75/5753942
acaattgta

SEQ ID NO: 79485 - DNA, 9 bp, Unknown
  misc_feature (1)..( 9): Result.001 file - promoters75/5753942
tacattgta

SEQ ID NO: 79486 - DNA, 9 bp, Unknown
  misc_feature (1)..( 9): Result.001 file - promoters75/5753942
taccttgtt

SEQ ID NO: 79487 - DNA, 9 bp, Unknown
  misc_feature (1)..( 9): Result.001 file - promoters75/5753942
caaacaaaa

SEQ ID NO: 79488 - DNA, 9 bp, Unknown
  misc_feature (1)..( 9): Result.001 file - promoters75/5753942
gaaacaaag

SEQ ID NO: 79489 - DNA, 9 bp, Unknown
  misc_feature (1)..( 9): Result.001 file - promoters75/5753942
taaagaaaa

SEQ ID NO: 79490 - DNA, 9 bp, Unknown
  misc_feature (1)..( 9): Result.001 file - promoters75/5753942
caatcaaat

SEQ ID NO: 79491 - DNA, 8 bp, Unknown
  misc_feature (1)..( 8): Result.001 file - promoters75/5753942
tgttcaaa

SEQ ID NO: 79492 - DNA, 8 bp, Unknown
  misc_feature (1)..( 8): Result.001 file - promoters75/5753942
tgtccaat

SEQ ID NO: 79493 - DNA, 9 bp, Unknown
  misc_feature (1)..( 9): Result.001 file - promoters75/5753942
cgttcgaaa

SEQ ID NO: 79494 - DNA, 13 bp, Unknown
  misc_feature (1)..( 13): Result.001 file - promoters75/5753942
aaacaaattaggg

SEQ ID NO: 79495 - DNA, 13 bp, Unknown
  misc_feature (1)..( 13): Result.001 file - promoters75/5753942
gcccaaattaaaa

SEQ ID NO: 79496 - DNA, 13 bp, Unknown
  misc_feature (1)..( 13): Result.001 file - promoters75/5753942
gcccatattaaaa

SEQ ID NO: 79497 - DNA, 11 bp, Unknown
  misc_feature (1)..( 11): Result.001 file - promoters75/5753942
tttgtgttttt

SEQ ID NO: 79498 - DNA, 11 bp, Unknown
  misc_feature (1)..( 11): Result.001 file - promoters75/5753942
gatgtcttttt

SEQ ID NO: 79499 - DNA, 11 bp, Unknown
  misc_feature (1)..( 11): Result.001 file - promoters75/5753942
tttgggttcct

SEQ ID NO: 79500 - DNA, 7 bp, Unknown
  misc_feature (1)..( 7): Result.001 file - promoters75/5753942
aatattt

SEQ ID NO: 79501 - DNA, 7 bp, Unknown
  misc_feature (1)..( 7): Result.001 file - promoters75/5753942
catattt

SEQ ID NO: 79502 - DNA, 7 bp, Unknown
  misc_feature (1)..( 7): Result.001 file - promoters75/5753942
catatta

SEQ ID NO: 79503 - DNA, 10 bp, Unknown
  misc_feature (1)..( 10): Result.001 file - promoters75/5753942
attcgtagca

SEQ ID NO: 79504 - DNA, 10 bp, Unknown
  misc_feature (1)..( 10): Result.001 file - promoters75/5753942
tttcgtacat

SEQ ID NO: 79505 - DNA, 10 bp, Unknown
  misc_feature (1)..( 10): Result.001 file - promoters75/5753942
tttggtacat

SEQ ID NO: 79506 - DNA, 8 bp, Unknown
  misc_feature (1)..( 8): Result.001 file - promoters75/5753942
aggctata

SEQ ID NO: 79507 - DNA, 8 bp, Unknown
  misc_feature (1)..( 8): Result.001 file - promoters75/5753942
gggccata

SEQ ID NO: 79508 - DNA, 8 bp, Unknown
  misc_feature (1)..( 8): Result.001 file - promoters75/5754280
gggccaag

SEQ ID NO: 79509 - DNA, 7 bp, Unknown
  misc_feature (1)..( 7): Result.001 file - promoters75/5754280
ggcccag

SEQ ID NO: 79510 - DNA, 7 bp, Unknown
  misc_feature (1)..( 7): Result.001 file - promoters75/5754280
ggcccac

SEQ ID NO: 79511 - DNA, 7 bp, Unknown
  misc_feature (1)..( 7): Result.001 file - promoters75/5754280
ggcccat

SEQ ID NO: 79512 - DNA, 7 bp, Unknown
  misc_feature (1)..( 7): Result.001 file - promoters75/5754280
ggcccaa

SEQ ID NO: 79513 - DNA, 7 bp, Unknown
  misc_feature (1)..( 7): Result.001 file - promoters75/5754280
agcccaa

SEQ ID NO: 79514 - DNA, 11 bp, Unknown
  misc_feature (1)..( 11): Result.001 file - promoters75/5754280
aagcccattaa

SEQ ID NO: 79515 - DNA, 11 bp, Unknown
  misc_feature (1)..( 11): Result.001 file - promoters75/5754280
cggcccaataa

SEQ ID NO: 79516 - DNA, 11 bp, Unknown
  misc_feature (1)..( 11): Result.001 file - promoters75/5754280
aagcccaaata

SEQ ID NO: 79517 - DNA, 11 bp, Unknown
  misc_feature (1)..( 11): Result.001 file - promoters75/5754280
aagcccaaata

SEQ ID NO: 79518 - DNA, 11 bp, Unknown
  misc_feature (1)..( 11): Result.001 file - promoters75/5756166
aggcccaattt

SEQ ID NO: 79519 - DNA, 8 bp, Unknown
  misc_feature (1)..( 8): Result.001 file - promoters75/5756166
ttacaatg

SEQ ID NO: 79520 - DNA, 8 bp, Unknown
  misc_feature (1)..( 8): Result.001 file - promoters75/5756166
atacaatg

SEQ ID NO: 79521 - DNA, 8 bp, Unknown
  misc_feature (1)..( 8): Result.001 file - promoters75/5756166
ttaaaatt

SEQ ID NO: 79522 - DNA, 7 bp, Unknown
  misc_feature (1)..( 7): Result.001 file - promoters75/5756166
tctaaaa

SEQ ID NO: 79523 - DNA, 7 bp, Unknown
  misc_feature (1)..( 7): Result.001 file - promoters75/5756166
tcttaaa

SEQ ID NO: 79524 - DNA, 7 bp, Unknown
  misc_feature (1)..( 7): Result.001 file - promoters75/5758021
tcttaat

SEQ ID NO: 79525 - DNA, 12 bp, Unknown
  misc_feature (1)..( 12): Result.001 file - promoters75/5758021
tcttatgatttg

SEQ ID NO: 79526 - DNA, 12 bp, Unknown
  misc_feature (1)..( 12): Result.001 file - promoters75/5758021
tcttaggattca

SEQ ID NO: 79527 - DNA, 12 bp, Unknown
  misc_feature (1)..( 12): Result.001 file - promoters75/5758021
ttccatgttttt

SEQ ID NO: 79528 - DNA, 12 bp, Unknown
  misc_feature (1)..( 12): Result.001 file - promoters75/5776417
gtctatgctttg

SEQ ID NO: 79529 - DNA, 8 bp, Unknown
  misc_feature (1)..( 8): Result.001 file - promoters75/5776417
caaggaaa

SEQ ID NO: 79530 - DNA, 8 bp, Unknown
  misc_feature (1)..( 8): Result.001 file - promoters75/5776417
caagtaaa

SEQ ID NO: 79531 - DNA, 9 bp, Unknown
  misc_feature (1)..( 9): Result.001 file - promoters75/5776417
gcagtcaaa

SEQ ID NO: 79532 - DNA, 9 bp, Unknown
  misc_feature (1)..( 9): Result.001 file - promoters75/5776417
cgaatcaat

SEQ ID NO: 79533 - DNA, 9 bp, Unknown
  misc_feature (1)..( 9): Result.001 file - promoters75/5776417
cgattcaat

SEQ ID NO: 79534 - DNA, 9 bp, Unknown
  misc_feature (1)..( 9): Result.001 file - promoters75/5776417
tgattcaaa

SEQ ID NO: 79535 - DNA, 7 bp, Unknown
  misc_feature (1)..( 7): Result.001 file - promoters75/5776417
agttttg

SEQ ID NO: 79536 - DNA, 7 bp, Unknown
  misc_feature (1)..( 7): Result.001 file - promoters75/5776417
agttttt

SEQ ID NO: 79537 - DNA, 7 bp, Unknown
  misc_feature (1)..( 7): Result.001 file - promoters70/1007030
ggttttt

SEQ ID NO: 79538 - DNA, 8 bp, Unknown
  misc_feature (1)..( 8): Result.001 file - promoters70/1007030
aaatgaaa

SEQ ID NO: 79539 - DNA, 8 bp, Unknown
  misc_feature (1)..( 8): Result.001 file - promoters70/1007030
aaacgaat

SEQ ID NO: 79540 - DNA, 8 bp, Unknown
  misc_feature (1)..( 8): Result.001 file - promoters70/1007030
gaaccaat

SEQ ID NO: 79541 - DNA, 11 bp, Unknown
  misc_feature (1)..( 11): Result.001 file - promoters70/1007030
gaagataaaca

SEQ ID NO: 79542 - DNA, 11 bp, Unknown
  misc_feature (1)..( 11): Result.001 file - promoters70/1007030
gaaaatataca

SEQ ID NO: 79543 - DNA, 11 bp, Unknown
  misc_feature (1)..( 11): Result.001 file - promoters70/1007030
taaagtattta

SEQ ID NO: 79544 - DNA, 12 bp, Unknown
  misc_feature (1)..( 12): Result.001 file - promoters70/1007030
atccaattcttt

SEQ ID NO: 79545 - DNA, 12 bp, Unknown
  misc_feature (1)..( 12): Result.001 file - promoters70/1007030
atccaaatctaa

SEQ ID NO: 79546 - DNA, 12 bp, Unknown
  misc_feature (1)..( 12): Result.001 file - promoters70/1007030
atgaaaatctaa

SEQ ID NO: 79547 - DNA, 7 bp, Unknown
  misc_feature (1)..( 7): Result.001 file - promoters70/1007030
aatctgc

SEQ ID NO: 79548 - DNA, 7 bp, Unknown
  misc_feature (1)..( 7): Result.001 file - promoters70/1007030
aatctga

SEQ ID NO: 79549 - DNA, 7 bp, Unknown
  misc_feature (1)..( 7): Result.001 file - promoters70/1007030
aatttga

SEQ ID NO: 79550 - DNA, 12 bp, Unknown
  misc_feature (1)..( 12): Result.001 file - promoters70/1007030
tattcacattta

SEQ ID NO: 79551 - DNA, 12 bp, Unknown
  misc_feature (1)..( 12): Result.001 file - promoters70/1007030
ttatcaaattta

SEQ ID NO: 79552 - DNA, 12 bp, Unknown
  misc_feature (1)..( 12): Result.001 file - promoters70/1007030
ttatgaaacaga

SEQ ID NO: 79553 - DNA, 9 bp, Unknown
  misc_feature (1)..( 9): Result.001 file - promoters70/1007030
taaccatgg

SEQ ID NO: 79554 - DNA, 9 bp, Unknown
  misc_feature (1)..( 9): Result.001 file - promoters70/1007030
taaacatat

SEQ ID NO: 79555 - DNA, 9 bp, Unknown
  misc_feature (1)..( 9): Result.001 file - promoters70/1007273
caaacttat

SEQ ID NO: 79556 - DNA, 9 bp, Unknown
  misc_feature (1)..( 9): Result.001 file - promoters70/1007273
aaagaacct

SEQ ID NO: 79557 - DNA, 9 bp, Unknown
  misc_feature (1)..( 9): Result.001 file - promoters70/1007273
ctagatcct

SEQ ID NO: 79558 - DNA, 9 bp, Unknown
  misc_feature (1)..( 9): Result.001 file - promoters70/1007273
aaagaacga

SEQ ID NO: 79559 - DNA, 9 bp, Unknown
  misc_feature (1)..( 9): Result.001 file - promoters70/1007273
aaaaaaccg

SEQ ID NO: 79560 - DNA, 8 bp, Unknown
  misc_feature (1)..( 8): Result.001 file - promoters70/1007273
cttccaaa

SEQ ID NO: 79561 - DNA, 8 bp, Unknown
  misc_feature (1)..( 8): Result.001 file - promoters70/1007273
attctaaa

SEQ ID NO: 79562 - DNA, 8 bp, Unknown
  misc_feature (1)..( 8): Result.001 file - promoters70/1007273
attttaac

SEQ ID NO: 79563 - DNA, 8 bp, Unknown
  misc_feature (1)..( 8): Result.001 file - promoters70/1007273
ctttcacc

SEQ ID NO: 79564 - DNA, 9 bp, Unknown
  misc_feature (1)..( 9): Result.001 file - promoters70/1007273
gaaagaacc

SEQ ID NO: 79565 - DNA, 9 bp, Unknown
  misc_feature (1)..( 9): Result.001 file - promoters70/1007273
gaacgaaat

SEQ ID NO: 79566 - DNA, 9 bp, Unknown
  misc_feature (1)..( 9): Result.001 file - promoters70/1007273
taaaaaacc

SEQ ID NO: 79567 - DNA, 7 bp, Unknown
  misc_feature (1)..( 7): Result.001 file - promoters70/1007273
cgattac

SEQ ID NO: 79568 - DNA, 7 bp, Unknown
  misc_feature (1)..( 7): Result.001 file - promoters70/1007273
agattac

SEQ ID NO: 79569 - DNA, 7 bp, Unknown
  misc_feature (1)..( 7): Result.001 file - promoters70/1007273
agattaa

SEQ ID NO: 79570 - DNA, 8 bp, Unknown
  misc_feature (1)..( 8): Result.001 file - promoters70/1007273
atgaatca

SEQ ID NO: 79571 - DNA, 8 bp, Unknown
  misc_feature (1)..( 8): Result.001 file - promoters70/1007273
atgaatca

SEQ ID NO: 79572 - DNA, 8 bp, Unknown
  misc_feature (1)..( 8): Result.001 file - promoters70/1007273
aggaatca

SEQ ID NO: 79573 - DNA, 10 bp, Unknown
  misc_feature (1)..( 10): Result.001 file - promoters70/1007273
tcggaacaaa

SEQ ID NO: 79574 - DNA, 10 bp, Unknown
  misc_feature (1)..( 10): Result.001 file - promoters70/1007273
agagaagaaa

SEQ ID NO: 79575 - DNA, 10 bp, Unknown
  misc_feature (1)..( 10): Result.001 file - promoters70/1007273
agagaagagc

SEQ ID NO: 79576 - DNA, 8 bp, Unknown
  misc_feature (1)..( 8): Result.001 file - promoters70/1007273
caaacaaa

SEQ ID NO: 79577 - DNA, 8 bp, Unknown
  misc_feature (1)..( 8): Result.001 file - promoters70/1007273
aaaagaaa

SEQ ID NO: 79578 - DNA, 8 bp, Unknown
  misc_feature (1)..( 8): Result.001 file - promoters70/1007273
aaaagatt

SEQ ID NO: 79579 - DNA, 7 bp, Unknown
  misc_feature (1)..( 7): Result.001 file - promoters70/1007273
cttaaaa

SEQ ID NO: 79580 - DNA, 7 bp, Unknown
  misc_feature (1)..( 7): Result.001 file - promoters70/1007273
cttaaat

SEQ ID NO: 79581 - DNA, 7 bp, Unknown
  misc_feature (1)..( 7): Result.001 file - promoters70/1007273
cttgaat

SEQ ID NO: 79582 - DNA, 6 bp, Unknown
  misc_feature (1)..( 6): Result.001 file - promoters70/1007273
caaaac

SEQ ID NO: 79583 - DNA, 6 bp, Unknown
  misc_feature (1)..( 6): Result.001 file - promoters70/1007273
caaaac

SEQ ID NO: 79584 - DNA, 6 bp, Unknown
  misc_feature (1)..( 6): Result.001 file - promoters70/1007639
caaaac

SEQ ID NO: 79585 - DNA, 10 bp, Unknown
  misc_feature (1)..( 10): Result.001 file - promoters70/1007639
atacagactt

SEQ ID NO: 79586 - DNA, 10 bp, Unknown
  misc_feature (1)..( 10): Result.001 file - promoters70/1007639
atacaaactt

SEQ ID NO: 79587 - DNA, 10 bp, Unknown
  misc_feature (1)..( 10): Result.001 file - promoters70/1007639
ataaaaacac

SEQ ID NO: 79588 - DNA, 10 bp, Unknown
  misc_feature (1)..( 10): Result.001 file - promoters70/1007639
ataaaaaagc

SEQ ID NO: 79589 - DNA, 10 bp, Unknown
  misc_feature (1)..( 10): Result.001 file - promoters70/1007639
ctgaaaacaa

SEQ ID NO: 79590 - DNA, 10 bp, Unknown
  misc_feature (1)..( 10): Result.001 file - promoters70/1007639
agaaaaacaa

SEQ ID NO: 79591 - DNA, 13 bp, Unknown
  misc_feature (1)..( 13): Result.001 file - promoters70/1007639
tagaaatataaat

SEQ ID NO: 79592 - DNA, 13 bp, Unknown
  misc_feature (1)..( 13): Result.001 file - promoters70/1007639
aataaatatcttt

SEQ ID NO: 79593 - DNA, 13 bp, Unknown
  misc_feature (1)..( 13): Result.001 file - promoters70/1007639
cagagatataaat

SEQ ID NO: 79594 - DNA, 13 bp, Unknown
  misc_feature (1)..( 13): Result.001 file - promoters70/1007639
cagagaatgtata

SEQ ID NO: 79595 - DNA, 13 bp, Unknown
  misc_feature (1)..( 13): Result.001 file - promoters70/1007639
ggttcatataagt

SEQ ID NO: 79596 - DNA, 13 bp, Unknown
  misc_feature (1)..( 13): Result.001 file - promoters70/1007639
gttttctgtttgg

SEQ ID NO: 79597 - DNA, 13 bp, Unknown
  misc_feature (1)..( 13): Result.001 file - promoters70/1007639
aatttttgtagac

SEQ ID NO: 79598 - DNA, 13 bp, Unknown
  misc_feature (1)..( 13): Result.001 file - promoters70/1007639
gttttctaactag

SEQ ID NO: 79599 - DNA, 13 bp, Unknown
  misc_feature (1)..( 13): Result.001 file - promoters70/1007639
aatatttgagcgg

SEQ ID NO: 79600 - DNA, 13 bp, Unknown
  misc_feature (1)..( 13): Result.001 file - promoters70/1007639
agagtttgtattc

SEQ ID NO: 79601 - DNA, 13 bp, Unknown
  misc_feature (1)..( 13): Result.001 file - promoters70/1007639
aacgagttgtggg

SEQ ID NO: 79602 - DNA, 13 bp, Unknown
  misc_feature (1)..( 13): Result.001 file - promoters70/1007639
gattatttgtggg

SEQ ID NO: 79603 - DNA, 13 bp, Unknown
  misc_feature (1)..( 13): Result.001 file - promoters70/1007639
gattatttttgga

SEQ ID NO: 79604 - DNA, 13 bp, Unknown
  misc_feature (1)..( 13): Result.001 file - promoters70/1007639
acgcccttttgat

SEQ ID NO: 79605 - DNA, 13 bp, Unknown
  misc_feature (1)..( 13): Result.001 file - promoters70/1007639
taatattttatac

SEQ ID NO: 79606 - DNA, 9 bp, Unknown
  misc_feature (1)..( 9): Result.001 file - promoters70/1007639
ataacattg

SEQ ID NO: 79607 - DNA, 9 bp, Unknown
  misc_feature (1)..( 9): Result.001 file - promoters70/1007639
atatcattc

SEQ ID NO: 79608 - DNA, 9 bp, Unknown
  misc_feature (1)..( 9): Result.001 file - promoters70/1007639
gagtcattc

SEQ ID NO: 79609 - DNA, 9 bp, Unknown
  misc_feature (1)..( 9): Result.001 file - promoters70/1007639
ctatgattt

SEQ ID NO: 79610 - DNA, 9 bp, Unknown
  misc_feature (1)..( 9): Result.001 file - promoters70/1007759
tgatgattt

SEQ ID NO: 79611 - DNA, 8 bp, Unknown
  misc_feature (1)..( 8): Result.001 file - promoters70/1007759
aagatgaa

SEQ ID NO: 79612 - DNA, 8 bp, Unknown
  misc_feature (1)..( 8): Result.001 file - promoters70/1007759
tagaagaa

SEQ ID NO: 79613 - DNA, 8 bp, Unknown
  misc_feature (1)..( 8): Result.001 file - promoters70/1007759
aagttgaa

SEQ ID NO: 79614 - DNA, 8 bp, Unknown
  misc_feature (1)..( 8): Result.001 file - promoters70/1007759
gagtagaa

SEQ ID NO: 79615 - DNA, 9 bp, Unknown
  misc_feature (1)..( 9): Result.001 file - promoters70/1007759
agccaaact

SEQ ID NO: 79616 - DNA, 9 bp, Unknown
  misc_feature (1)..( 9): Result.001 file - promoters70/1007759
agctaaaca

SEQ ID NO: 79617 - DNA, 9 bp, Unknown
  misc_feature (1)..( 9): Result.001 file - promoters70/1007759
aactacaca

SEQ ID NO: 79618 - DNA, 14 bp, Unknown
  misc_feature (1)..( 14): Result.001 file - promoters70/1007759
aattctgaggagag

SEQ ID NO: 79619 - DNA, 14 bp, Unknown
  misc_feature (1)..( 14): Result.001 file - promoters70/1007759
gagttggagtagaa

SEQ ID NO: 79620 - DNA, 14 bp, Unknown
  misc_feature (1)..( 14): Result.001 file - promoters70/1007759
gagtttgagtggaa

SEQ ID NO: 79621 - DNA, 13 bp, Unknown
  misc_feature (1)..( 13): Result.001 file - promoters70/1007759
gaggggaggacaa

SEQ ID NO: 79622 - DNA, 13 bp, Unknown
  misc_feature (1)..( 13): Result.001 file - promoters70/1007759
gagtggaaagaag

SEQ ID NO: 79623 - DNA, 14 bp, Unknown
  misc_feature (1)..( 14): Result.001 file - promoters70/1007967
gagttggagtagaa

SEQ ID NO: 79624 - DNA, 8 bp, Unknown
  misc_feature (1)..( 8): Result.001 file - promoters70/1007967
attcttaa

SEQ ID NO: 79625 - DNA, 8 bp, Unknown
  misc_feature (1)..( 8): Result.001 file - promoters70/1007967
attgttat

SEQ ID NO: 79626 - DNA, 8 bp, Unknown
  misc_feature (1)..( 8): Result.001 file - promoters70/1007967
gttcataa

SEQ ID NO: 79627 - DNA, 9 bp, Unknown
  misc_feature (1)..( 9): Result.001 file - promoters70/1007967
aatttcaac

SEQ ID NO: 79628 - DNA, 9 bp, Unknown
  misc_feature (1)..( 9): Result.001 file - promoters70/1007967
aatttgaac

SEQ ID NO: 79629 - DNA, 9 bp, Unknown
  misc_feature (1)..( 9): Result.001 file - promoters70/1008070
aatgtgaaa

SEQ ID NO: 79630 - DNA, 9 bp, Unknown
  misc_feature (1)..( 9): Result.001 file - promoters70/1008070
acaacaaag

SEQ ID NO: 79631 - DNA, 9 bp, Unknown
  misc_feature (1)..( 9): Result.001 file - promoters70/1008070
aaaacaaac

SEQ ID NO: 79632 - DNA, 9 bp, Unknown
  misc_feature (1)..( 9): Result.001 file - promoters70/1008070
aaaacaaac

SEQ ID NO: 79633 - DNA, 9 bp, Unknown
  misc_feature (1)..( 9): Result.001 file - promoters70/1008070
taaacaaac

SEQ ID NO: 79634 - DNA, 9 bp, Unknown
  misc_feature (1)..( 9): Result.001 file - promoters70/1008070
attgcattt

SEQ ID NO: 79635 - DNA, 9 bp, Unknown
  misc_feature (1)..( 9): Result.001 file - promoters70/1008070
atttcatat

SEQ ID NO: 79636 - DNA, 9 bp, Unknown
  misc_feature (1)..( 9): Result.001 file - promoters70/1008070
ccttcataa

SEQ ID NO: 79637 - DNA, 9 bp, Unknown
  misc_feature (1)..( 9): Result.001 file - promoters70/1008070
atttcttaa

SEQ ID NO: 79638 - DNA, 12 bp, Unknown
  misc_feature (1)..( 12): Result.001 file - promoters70/1008070
accactatataa

SEQ ID NO: 79639 - DNA, 12 bp, Unknown
  misc_feature (1)..( 12): Result.001 file - promoters70/1008070
tccattatatat

SEQ ID NO: 79640 - DNA, 12 bp, Unknown
  misc_feature (1)..( 12): Result.001 file - promoters70/1008070
agtgagatataa

SEQ ID NO: 79641 - DNA, 12 bp, Unknown
  misc_feature (1)..( 12): Result.001 file - promoters70/1008070
ttgtttatatca

SEQ ID NO: 79642 - DNA, 12 bp, Unknown
  misc_feature (1)..( 12): Result.001 file - promoters70/1008070
tcctttatattc

SEQ ID NO: 79643 - DNA, 9 bp, Unknown
  misc_feature (1)..( 9): Result.001 file - promoters70/1008070
aaaatgaaa

SEQ ID NO: 79644 - DNA, 9 bp, Unknown
  misc_feature (1)..( 9): Result.001 file - promoters70/1008070
aaactgaac

SEQ ID NO: 79645 - DNA, 9 bp, Unknown
  misc_feature (1)..( 9): Result.001 file - promoters70/1008070
tcaatcaaa

SEQ ID NO: 79646 - DNA, 9 bp, Unknown
  misc_feature (1)..( 9): Result.001 file - promoters70/1008148
taactgatt

SEQ ID NO: 79647 - DNA, 13 bp, Unknown
  misc_feature (1)..( 13): Result.001 file - promoters70/1008148
aaaatatataaag

SEQ ID NO: 79648 - DNA, 13 bp, Unknown
  misc_feature (1)..( 13): Result.001 file - promoters70/1008148
gtttaatacaaaa

SEQ ID NO: 79649 - DNA, 13 bp, Unknown
  misc_feature (1)..( 13): Result.001 file - promoters70/1008148
atttgttataaag

SEQ ID NO: 79650 - DNA, 13 bp, Unknown
  misc_feature (1)..( 13): Result.001 file - promoters70/1008148
caataatacatat

SEQ ID NO: 79651 - DNA, 13 bp, Unknown
  misc_feature (1)..( 13): Result.001 file - promoters70/1008148
caaaaatacttac

SEQ ID NO: 79652 - DNA, 13 bp, Unknown
  misc_feature (1)..( 13): Result.001 file - promoters70/1008148
ttcatcttcaaaa

SEQ ID NO: 79653 - DNA, 11 bp, Unknown
  misc_feature (1)..( 11): Result.001 file - promoters70/1008148
aaatacattta

SEQ ID NO: 79654 - DNA, 11 bp, Unknown
  misc_feature (1)..( 11): Result.001 file - promoters70/1008148
gtatagattag

SEQ ID NO: 79655 - DNA, 11 bp, Unknown
  misc_feature (1)..( 11): Result.001 file - promoters70/1008148
ttatagattta

SEQ ID NO: 79656 - DNA, 11 bp, Unknown
  misc_feature (1)..( 11): Result.001 file - promoters70/1008148
atatagagttg

SEQ ID NO: 79657 - DNA, 11 bp, Unknown
  misc_feature (1)..( 11): Result.001 file - promoters70/1008148
cttgagattac

SEQ ID NO: 79658 - DNA, 11 bp, Unknown
  misc_feature (1)..( 11): Result.001 file - promoters70/1008148
ttagagaaatt

SEQ ID NO: 79659 - DNA, 9 bp, Unknown
  misc_feature (1)..( 9): Result.001 file - promoters70/1008148
ctcaaagat

SEQ ID NO: 79660 - DNA, 9 bp, Unknown
  misc_feature (1)..( 9): Result.001 file - promoters70/1008148
atcatagat

SEQ ID NO: 79661 - DNA, 9 bp, Unknown
  misc_feature (1)..( 9): Result.001 file - promoters70/1008148
gttatagat

SEQ ID NO: 79662 - DNA, 9 bp, Unknown
  misc_feature (1)..( 9): Result.001 file - promoters70/1008148
aacatagaa

SEQ ID NO: 79663 - DNA, 9 bp, Unknown
  misc_feature (1)..( 9): Result.001 file - promoters70/1008148
attagagaa

SEQ ID NO: 79664 - DNA, 9 bp, Unknown
  misc_feature (1)..( 9): Result.001 file - promoters70/1008148
aacagagac

SEQ ID NO: 79665 - DNA, 14 bp, Unknown
  misc_feature (1)..( 14): Result.001 file - promoters70/1008148
gcatataaagtcat

SEQ ID NO: 79666 - DNA, 14 bp, Unknown
  misc_feature (1)..( 14): Result.001 file - promoters70/1008148
ctatataaagataa

SEQ ID NO: 79667 - DNA, 14 bp, Unknown
  misc_feature (1)..( 14): Result.001 file - promoters70/1008148
gtatataaagacgc

SEQ ID NO: 79668 - DNA, 14 bp, Unknown
  misc_feature (1)..( 14): Result.001 file - promoters70/1008148
ctatatattaaacc

SEQ ID NO: 79669 - DNA, 14 bp, Unknown
  misc_feature (1)..( 14): Result.001 file - promoters70/1008148
ccaaataaagagag

SEQ ID NO: 79670 - DNA, 14 bp, Unknown
  misc_feature (1)..( 14): Result.001 file - promoters70/1008148
actattaaagccgc

SEQ ID NO: 79671 - DNA, 13 bp, Unknown
  misc_feature (1)..( 13): Result.001 file - promoters70/1008148
aatataaatacaa

SEQ ID NO: 79672 - DNA, 13 bp, Unknown
  misc_feature (1)..( 13): Result.001 file - promoters70/1008148
gttattaataaat

SEQ ID NO: 79673 - DNA, 13 bp, Unknown
  misc_feature (1)..( 13): Result.001 file - promoters70/1008148
aataaaaattgat

SEQ ID NO: 79674 - DNA, 13 bp, Unknown
  misc_feature (1)..( 13): Result.001 file - promoters70/1008148
tataaaaaaaagt

SEQ ID NO: 79675 - DNA, 13 bp, Unknown
  misc_feature (1)..( 13): Result.001 file - promoters70/1008148
cataaaatgttat

SEQ ID NO: 79676 - DNA, 13 bp, Unknown
  misc_feature (1)..( 13): Result.001 file - promoters70/1008148
ctgattaatgaat

SEQ ID NO: 79677 - DNA, 13 bp, Unknown
  misc_feature (1)..( 13): Result.001 file - promoters70/1008148
aataataactctt

SEQ ID NO: 79678 - DNA, 10 bp, Unknown
  misc_feature (1)..( 10): Result.001 file - promoters70/1008148
tgatgagagt

SEQ ID NO: 79679 - DNA, 10 bp, Unknown
  misc_feature (1)..( 10): Result.001 file - promoters70/1008148
agattagatc

SEQ ID NO: 79680 - DNA, 10 bp, Unknown
  misc_feature (1)..( 10): Result.001 file - promoters70/1008148
atattagaga

SEQ ID NO: 79681 - DNA, 10 bp, Unknown
  misc_feature (1)..( 10): Result.001 file - promoters70/1008148
agattactaa

SEQ ID NO: 79682 - DNA, 10 bp, Unknown
  misc_feature (1)..( 10): Result.001 file - promoters70/1008148
gggttataga

SEQ ID NO: 79683 - DNA, 10 bp, Unknown
  misc_feature (1)..( 10): Result.001 file - promoters70/1008148
aagttataag

SEQ ID NO: 79684 - DNA, 10 bp, Unknown
  misc_feature (1)..( 10): Result.001 file - promoters70/1008148
agtaatgaag

SEQ ID NO: 79685 - DNA, 10 bp, Unknown
  misc_feature (1)..( 10): Result.001 file - promoters70/1008148
attaatgaat

SEQ ID NO: 79686 - DNA, 10 bp, Unknown
  misc_feature (1)..( 10): Result.001 file - promoters70/1008148
attaataaat

SEQ ID NO: 79687 - DNA, 10 bp, Unknown
  misc_feature (1)..( 10): Result.001 file - promoters70/1008148
ccaaatcaat

SEQ ID NO: 79688 - DNA, 10 bp, Unknown
  misc_feature (1)..( 10): Result.001 file - promoters70/1008148
aataataact

SEQ ID NO: 79689 - DNA, 10 bp, Unknown
  misc_feature (1)..( 10): Result.001 file - promoters70/1008218
aagaataaaa

SEQ ID NO: 79690 - DNA, 9 bp, Unknown
  misc_feature (1)..( 9): Result.001 file - promoters70/1008218
tatttgatt

SEQ ID NO: 79691 - DNA, 9 bp, Unknown
  misc_feature (1)..( 9): Result.001 file - promoters70/1008218
catttgagc

SEQ ID NO: 79692 - DNA, 9 bp, Unknown
  misc_feature (1)..( 9): Result.001 file - promoters70/1008218
catttaatt

SEQ ID NO: 79693 - DNA, 9 bp, Unknown
  misc_feature (1)..( 9): Result.001 file - promoters70/1008218
catttatgt

SEQ ID NO: 79694 - DNA, 13 bp, Unknown
  misc_feature (1)..( 13): Result.001 file - promoters70/1008218
gtattttatgtgg

SEQ ID NO: 79695 - DNA, 13 bp, Unknown
  misc_feature (1)..( 13): Result.001 file - promoters70/1008218
ttattatatgtaa

SEQ ID NO: 79696 - DNA, 13 bp, Unknown
  misc_feature (1)..( 13): Result.001 file - promoters70/1008218
catttatgtcttt

SEQ ID NO: 79697 - DNA, 13 bp, Unknown
  misc_feature (1)..( 13): Result.001 file - promoters70/1008218
atatttaatagta

SEQ ID NO: 79698 - DNA, 13 bp, Unknown
  misc_feature (1)..( 13): Result.001 file - promoters70/1008218
aatttattttcca

SEQ ID NO: 79699 - DNA, 7 bp, Unknown
  misc_feature (1)..( 7): Result.001 file - promoters70/1008218
gagtatt

SEQ ID NO: 79700 - DNA, 7 bp, Unknown
  misc_feature (1)..( 7): Result.001 file - promoters70/1008218
tagtatt

SEQ ID NO: 79701 - DNA, 7 bp, Unknown
  misc_feature (1)..( 7): Result.001 file - promoters70/1008218
tagtatt

SEQ ID NO: 79702 - DNA, 7 bp, Unknown
  misc_feature (1)..( 7): Result.001 file - promoters70/1008425
tagcatt

SEQ ID NO: 79703 - DNA, 10 bp, Unknown
  misc_feature (1)..( 10): Result.001 file - promoters70/1008425
caaatacatt

SEQ ID NO: 79704 - DNA, 10 bp, Unknown
  misc_feature (1)..( 10): Result.001 file - promoters70/1008425
caaaaacaac

SEQ ID NO: 79705 - DNA, 10 bp, Unknown
  misc_feature (1)..( 10): Result.001 file - promoters70/1008425
taaatacatt

SEQ ID NO: 79706 - DNA, 8 bp, Unknown
  misc_feature (1)..( 8): Result.001 file - promoters70/1008425
cttctgaa

SEQ ID NO: 79707 - DNA, 8 bp, Unknown
  misc_feature (1)..( 8): Result.001 file - promoters70/1008425
cttttgaa

SEQ ID NO: 79708 - DNA, 8 bp, Unknown
  misc_feature (1)..( 8): Result.001 file - promoters70/1008443
attttgag

SEQ ID NO: 79709 - DNA, 9 bp, Unknown
  misc_feature (1)..( 9): Result.001 file - promoters70/1008443
agaattgac

SEQ ID NO: 79710 - DNA, 9 bp, Unknown
  misc_feature (1)..( 9): Result.001 file - promoters70/1008443
tgaattgga

SEQ ID NO: 79711 - DNA, 9 bp, Unknown
  misc_feature (1)..( 9): Result.001 file - promoters70/1008443
ggaaatgac

SEQ ID NO: 79712 - DNA, 9 bp, Unknown
  misc_feature (1)..( 9): Result.001 file - promoters70/1008443
tgatttgct

SEQ ID NO: 79713 - DNA, 9 bp, Unknown
  misc_feature (1)..( 9): Result.001 file - promoters70/1008443
acaaacgac

SEQ ID NO: 79714 - DNA, 9 bp, Unknown
  misc_feature (1)..( 9): Result.001 file - promoters70/1008443
acaaaagac

SEQ ID NO: 79715 - DNA, 9 bp, Unknown
  misc_feature (1)..( 9): Result.001 file - promoters70/1008443
aaaaaagat

SEQ ID NO: 79716 - DNA, 9 bp, Unknown
  misc_feature (1)..( 9): Result.001 file - promoters70/1008443
tgattttta

SEQ ID NO: 79717 - DNA, 9 bp, Unknown
  misc_feature (1)..( 9): Result.001 file - promoters70/1008443
gaaaaaaag

SEQ ID NO: 79718 - DNA, 9 bp, Unknown
  misc_feature (1)..( 9): Result.001 file - promoters70/1008443
caaagaaag

SEQ ID NO: 79719 - DNA, 9 bp, Unknown
  misc_feature (1)..( 9): Result.001 file - promoters70/1008443
caaaaaaaa

SEQ ID NO: 79720 - DNA, 9 bp, Unknown
  misc_feature (1)..( 9): Result.001 file - promoters70/1008443
aaactaaaa

SEQ ID NO: 79721 - DNA, 9 bp, Unknown
  misc_feature (1)..( 9): Result.001 file - promoters70/1008443
caaggaaag

SEQ ID NO: 79722 - DNA, 9 bp, Unknown
  misc_feature (1)..( 9): Result.001 file - promoters70/1008443
cacacaaag

SEQ ID NO: 79723 - DNA, 14 bp, Unknown
  misc_feature (1)..( 14): Result.001 file - promoters70/1008443
tttggaaaagacca

SEQ ID NO: 79724 - DNA, 14 bp, Unknown
  misc_feature (1)..( 14): Result.001 file - promoters70/1008443
aagacaaaagacac

SEQ ID NO: 79725 - DNA, 14 bp, Unknown
  misc_feature (1)..( 14): Result.001 file - promoters70/1008443
catacaaacgacac

SEQ ID NO: 79726 - DNA, 14 bp, Unknown
  misc_feature (1)..( 14): Result.001 file - promoters70/1008443
actacaaatatcga

SEQ ID NO: 79727 - DNA, 14 bp, Unknown
  misc_feature (1)..( 14): Result.001 file - promoters70/1008443
tgtggaaatgacgt

SEQ ID NO: 79728 - DNA, 14 bp, Unknown
  misc_feature (1)..( 14): Result.001 file - promoters70/1008443
catagaaaaattaa

SEQ ID NO: 79729 - DNA, 14 bp, Unknown
  misc_feature (1)..( 14): Result.001 file - promoters70/1008443
tttacaaaaaaaaa

SEQ ID NO: 79730 - DNA, 17 bp, Unknown
  misc_feature (1)..( 17): Result.001 file - promoters70/1008443
gtggaaaatgttaaacc

SEQ ID NO: 79731 - DNA, 17 bp, Unknown
  misc_feature (1)..( 17): Result.001 file - promoters70/1008443
tacaaaaatgtaatttt

SEQ ID NO: 79732 - DNA, 17 bp, Unknown
  misc_feature (1)..( 17): Result.001 file - promoters70/1008443
ttttctaatgaaatttt

SEQ ID NO: 79733 - DNA, 17 bp, Unknown
  misc_feature (1)..( 17): Result.001 file - promoters70/1008443
taataaaaaaatataga

SEQ ID NO: 79734 - DNA, 17 bp, Unknown
  misc_feature (1)..( 17): Result.001 file - promoters70/1008443
atataaaatggtgttca

SEQ ID NO: 79735 - DNA, 17 bp, Unknown
  misc_feature (1)..( 17): Result.001 file - promoters70/1008732
attctatatttgataca

SEQ ID NO: 79736 - DNA, 11 bp, Unknown
  misc_feature (1)..( 11): Result.001 file - promoters70/1008732
aaagtaattta

SEQ ID NO: 79737 - DNA, 11 bp, Unknown
  misc_feature (1)..( 11): Result.001 file - promoters70/1008732
acagtagtttc

SEQ ID NO: 79738 - DNA, 11 bp, Unknown
  misc_feature (1)..( 11): Result.001 file - promoters70/1008732
aaaataaacta

SEQ ID NO: 79739 - DNA, 11 bp, Unknown
  misc_feature (1)..( 11): Result.001 file - promoters70/1008732
tgttgagtttc

SEQ ID NO: 79740 - DNA, 11 bp, Unknown
  misc_feature (1)..( 11): Result.001 file - promoters70/1008808
ataataaataa

SEQ ID NO: 79741 - DNA, 7 bp, Unknown
  misc_feature (1)..( 7): Result.001 file - promoters70/1008808
cgaagaa

SEQ ID NO: 79742 - DNA, 7 bp, Unknown
  misc_feature (1)..( 7): Result.001 file - promoters70/1008808
cgatgaa

SEQ ID NO: 79743 - DNA, 7 bp, Unknown
  misc_feature (1)..( 7): Result.001 file - promoters70/1008808
agaagaa

SEQ ID NO: 79744 - DNA, 8 bp, Unknown
  misc_feature (1)..( 8): Result.001 file - promoters70/1008808
acttcctt

SEQ ID NO: 79745 - DNA, 8 bp, Unknown
  misc_feature (1)..( 8): Result.001 file - promoters70/1008808
gcttactt

SEQ ID NO: 79746 - DNA, 8 bp, Unknown
  misc_feature (1)..( 8): Result.001 file - promoters70/1008808
acttccgc

SEQ ID NO: 79747 - DNA, 7 bp, Unknown
  misc_feature (1)..( 7): Result.001 file - promoters70/1008808
ctttgaa

SEQ ID NO: 79748 - DNA, 7 bp, Unknown
  misc_feature (1)..( 7): Result.001 file - promoters70/1008808
gtttgaa

SEQ ID NO: 79749 - DNA, 7 bp, Unknown
  misc_feature (1)..( 7): Result.001 file - promoters70/1008808
gttagaa

SEQ ID NO: 79750 - DNA, 9 bp, Unknown
  misc_feature (1)..( 9): Result.001 file - promoters70/1008808
ctatggtta

SEQ ID NO: 79751 - DNA, 9 bp, Unknown
  misc_feature (1)..( 9): Result.001 file - promoters70/1008808
aaatgatta

SEQ ID NO: 79752 - DNA, 9 bp, Unknown
  misc_feature (1)..( 9): Result.001 file - promoters70/1008808
aaaggatta

SEQ ID NO: 79753 - DNA, 7 bp, Unknown
  misc_feature (1)..( 7): Result.001 file - promoters70/1008808
aatattg

SEQ ID NO: 79754 - DNA, 7 bp, Unknown
  misc_feature (1)..( 7): Result.001 file - promoters70/1008808
aatgttg

SEQ ID NO: 79755 - DNA, 7 bp, Unknown
  misc_feature (1)..( 7): Result.001 file - promoters70/1008836
aatattg

SEQ ID NO: 79756 - DNA, 12 bp, Unknown
  misc_feature (1)..( 12): Result.001 file - promoters70/1008836
gaaaatacaaat

SEQ ID NO: 79757 - DNA, 12 bp, Unknown
  misc_feature (1)..( 12): Result.001 file - promoters70/1008836
taaaatataaat

SEQ ID NO: 79758 - DNA, 12 bp, Unknown
  misc_feature (1)..( 12): Result.001 file - promoters70/1008836
taaaatgcacgt

SEQ ID NO: 79759 - DNA, 11 bp, Unknown
  misc_feature (1)..( 11): Result.001 file - promoters70/1008836
atatttttatg

SEQ ID NO: 79760 - DNA, 11 bp, Unknown
  misc_feature (1)..( 11): Result.001 file - promoters70/1008836
gaaattttatg

SEQ ID NO: 79761 - DNA, 11 bp, Unknown
  misc_feature (1)..( 11): Result.001 file - promoters70/1008836
atatttttata

SEQ ID NO: 79762 - DNA, 8 bp, Unknown
  misc_feature (1)..( 8): Result.001 file - promoters70/1008836
tcaaaaga

SEQ ID NO: 79763 - DNA, 8 bp, Unknown
  misc_feature (1)..( 8): Result.001 file - promoters70/1008836
acaaaaga

SEQ ID NO: 79764 - DNA, 8 bp, Unknown
  misc_feature (1)..( 8): Result.001 file - promoters70/1008836
tcaaaaaa

SEQ ID NO: 79765 - DNA, 9 bp, Unknown
  misc_feature (1)..( 9): Result.001 file - promoters70/1008836
taaaatttg

SEQ ID NO: 79766 - DNA, 9 bp, Unknown
  misc_feature (1)..( 9): Result.001 file - promoters70/1008836
aaaacttta

SEQ ID NO: 79767 - DNA, 9 bp, Unknown
  misc_feature (1)..( 9): Result.001 file - promoters70/1008836
aaaacgtta

SEQ ID NO: 79768 - DNA, 9 bp, Unknown
  misc_feature (1)..( 9): Result.001 file - promoters70/1008836
aattaaatg

SEQ ID NO: 79769 - DNA, 9 bp, Unknown
  misc_feature (1)..( 9): Result.001 file - promoters70/1008836
aattaataa

SEQ ID NO: 79770 - DNA, 9 bp, Unknown
  misc_feature (1)..( 9): Result.001 file - promoters70/1008836
gattaaatg

SEQ ID NO: 79771 - DNA, 11 bp, Unknown
  misc_feature (1)..( 11): Result.001 file - promoters70/1008836
aaaagatttat

SEQ ID NO: 79772 - DNA, 11 bp, Unknown
  misc_feature (1)..( 11): Result.001 file - promoters70/1008836
aaagaatttat

SEQ ID NO: 79773 - DNA, 11 bp, Unknown
  misc_feature (1)..( 11): Result.001 file - promoters70/1008836
aaagactttag

SEQ ID NO: 79774 - DNA, 10 bp, Unknown
  misc_feature (1)..( 10): Result.001 file - promoters70/1008836
acattgtcca

SEQ ID NO: 79775 - DNA, 10 bp, Unknown
  misc_feature (1)..( 10): Result.001 file - promoters70/1008836
taattatcca

SEQ ID NO: 79776 - DNA, 10 bp, Unknown
  misc_feature (1)..( 10): Result.001 file - promoters70/1008836
taaatatttt

SEQ ID NO: 79777 - DNA, 8 bp, Unknown
  misc_feature (1)..( 8): Result.001 file - promoters70/1008836
tccaaatt

SEQ ID NO: 79778 - DNA, 8 bp, Unknown
  misc_feature (1)..( 8): Result.001 file - promoters70/1008836
tccaaata

SEQ ID NO: 79779 - DNA, 8 bp, Unknown
  misc_feature (1)..( 8): Result.001 file - promoters70/1009030
gacaaata

SEQ ID NO: 79780 - DNA, 8 bp, Unknown
  misc_feature (1)..( 8): Result.001 file - promoters70/1009030
ctttttaa

SEQ ID NO: 79781 - DNA, 8 bp, Unknown
  misc_feature (1)..( 8): Result.001 file - promoters70/1009030
atttataa

SEQ ID NO: 79782 - DNA, 8 bp, Unknown
  misc_feature (1)..( 8): Result.001 file - promoters70/1009030
ttttttag

SEQ ID NO: 79783 - DNA, 8 bp, Unknown
  misc_feature (1)..( 8): Result.001 file - promoters70/1009030
attgatag

SEQ ID NO: 79784 - DNA, 8 bp, Unknown
  misc_feature (1)..( 8): Result.001 file - promoters70/1009030
tttgttag

SEQ ID NO: 79785 - DNA, 8 bp, Unknown
  misc_feature (1)..( 8): Result.001 file - promoters70/1009030
atttttac

SEQ ID NO: 79786 - DNA, 11 bp, Unknown
  misc_feature (1)..( 11): Result.001 file - promoters70/1009030
tctcgtttcac

SEQ ID NO: 79787 - DNA, 11 bp, Unknown
  misc_feature (1)..( 11): Result.001 file - promoters70/1009030
actcttttctt

SEQ ID NO: 79788 - DNA, 11 bp, Unknown
  misc_feature (1)..( 11): Result.001 file - promoters70/1009030
tctcttttgat

SEQ ID NO: 79789 - DNA, 11 bp, Unknown
  misc_feature (1)..( 11): Result.001 file - promoters70/1009030
ttttttttctc

SEQ ID NO: 79790 - DNA, 11 bp, Unknown
  misc_feature (1)..( 11): Result.001 file - promoters70/1009030
gcgtttttctt

SEQ ID NO: 79791 - DNA, 11 bp, Unknown
  misc_feature (1)..( 11): Result.001 file - promoters70/1009234
actatttcaaa

SEQ ID NO: 79792 - DNA, 11 bp, Unknown
  misc_feature (1)..( 11): Result.001 file - promoters70/1009234
cgatacttgtc

SEQ ID NO: 79793 - DNA, 11 bp, Unknown
  misc_feature (1)..( 11): Result.001 file - promoters70/1009234
tgattcttcga

SEQ ID NO: 79794 - DNA, 11 bp, Unknown
  misc_feature (1)..( 11): Result.001 file - promoters70/1009234
cgaaactggtc

SEQ ID NO: 79795 - DNA, 10 bp, Unknown
  misc_feature (1)..( 10): Result.001 file - promoters70/1009234
aagaactcat

SEQ ID NO: 79796 - DNA, 10 bp, Unknown
  misc_feature (1)..( 10): Result.001 file - promoters70/1009234
aagaactaga

SEQ ID NO: 79797 - DNA, 10 bp, Unknown
  misc_feature (1)..( 10): Result.001 file - promoters70/1009234
atgaagtcat

SEQ ID NO: 79798 - DNA, 12 bp, Unknown
  misc_feature (1)..( 12): Result.001 file - promoters70/1009234
ttaaatgaagat

SEQ ID NO: 79799 - DNA, 12 bp, Unknown
  misc_feature (1)..( 12): Result.001 file - promoters70/1009234
aataatgatgat

SEQ ID NO: 79800 - DNA, 12 bp, Unknown
  misc_feature (1)..( 12): Result.001 file - promoters70/1009234
ttacatgaacag

SEQ ID NO: 79801 - DNA, 10 bp, Unknown
  misc_feature (1)..( 10): Result.001 file - promoters70/1009234
agtgatccaa

SEQ ID NO: 79802 - DNA, 10 bp, Unknown
  misc_feature (1)..( 10): Result.001 file - promoters70/1009234
tgtggtccat

SEQ ID NO: 79803 - DNA, 10 bp, Unknown
  misc_feature (1)..( 10): Result.001 file - promoters70/1009387
tgtggttcat

SEQ ID NO: 79804 - DNA, 8 bp, Unknown
  misc_feature (1)..( 8): Result.001 file - promoters70/1009387
tctttgtc

SEQ ID NO: 79805 - DNA, 8 bp, Unknown
  misc_feature (1)..( 8): Result.001 file - promoters70/1009387
tgtttgtc

SEQ ID NO: 79806 - DNA, 8 bp, Unknown
  misc_feature (1)..( 8): Result.001 file - promoters70/1009387
tctttgtt

SEQ ID NO: 79807 - DNA, 8 bp, Unknown
  misc_feature (1)..( 8): Result.001 file - promoters70/1009387
cttcttca

SEQ ID NO: 79808 - DNA, 8 bp, Unknown
  misc_feature (1)..( 8): Result.001 file - promoters70/1009387
cttcatca

SEQ ID NO: 79809 - DNA, 8 bp, Unknown
  misc_feature (1)..( 8): Result.001 file - promoters70/1009387
ctttttcg

SEQ ID NO: 79810 - DNA, 8 bp, Unknown
  misc_feature (1)..( 8): Result.001 file - promoters70/1009387
ttaaatgg

SEQ ID NO: 79811 - DNA, 8 bp, Unknown
  misc_feature (1)..( 8): Result.001 file - promoters70/1009387
ttatatgg

SEQ ID NO: 79812 - DNA, 8 bp, Unknown
  misc_feature (1)..( 8): Result.001 file - promoters70/1009520
ccatatgg

SEQ ID NO: 79813 - DNA, 7 bp, Unknown
  misc_feature (1)..( 7): Result.001 file - promoters70/1009520
aatatat

SEQ ID NO: 79814 - DNA, 7 bp, Unknown
  misc_feature (1)..( 7): Result.001 file - promoters70/1009520
aatataa

SEQ ID NO: 79815 - DNA, 7 bp, Unknown
  misc_feature (1)..( 7): Result.001 file - promoters70/1009520
catatat

SEQ ID NO: 79816 - DNA, 9 bp, Unknown
  misc_feature (1)..( 9): Result.001 file - promoters70/1009520
ttgtatatt

SEQ ID NO: 79817 - DNA, 9 bp, Unknown
  misc_feature (1)..( 9): Result.001 file - promoters70/1009520
tcgtacatt

SEQ ID NO: 79818 - DNA, 9 bp, Unknown
  misc_feature (1)..( 9): Result.001 file - promoters70/1009520
ttgtatacc

SEQ ID NO: 79819 - DNA, 9 bp, Unknown
  misc_feature (1)..( 9): Result.001 file - promoters70/1009520
taagataaa

SEQ ID NO: 79820 - DNA, 9 bp, Unknown
  misc_feature (1)..( 9): Result.001 file - promoters70/1009520
aaagaaaaa

SEQ ID NO: 79821 - DNA, 9 bp, Unknown
  misc_feature (1)..( 9): Result.001 file - promoters70/1009520
aaagcaaat

SEQ ID NO: 79822 - DNA, 9 bp, Unknown
  misc_feature (1)..( 9): Result.001 file - promoters70/1009520
tttgtctat

SEQ ID NO: 79823 - DNA, 9 bp, Unknown
  misc_feature (1)..( 9): Result.001 file - promoters70/1009520
tttttcttt

SEQ ID NO: 79824 - DNA, 9 bp, Unknown
  misc_feature (1)..( 9): Result.001 file - promoters70/1009520
aatgtctat

SEQ ID NO: 79825 - DNA, 9 bp, Unknown
  misc_feature (1)..( 9): Result.001 file - promoters70/1009520
tcttctttg

SEQ ID NO: 79826 - DNA, 9 bp, Unknown
  misc_feature (1)..( 9): Result.001 file - promoters70/1009520
ttttctttg

SEQ ID NO: 79827 - DNA, 9 bp, Unknown
  misc_feature (1)..( 9): Result.001 file - promoters70/1009941
tcttcttat

SEQ ID NO: 79828 - DNA, 11 bp, Unknown
  misc_feature (1)..( 11): Result.001 file - promoters70/1009941
agtatttatat

SEQ ID NO: 79829 - DNA, 11 bp, Unknown
  misc_feature (1)..( 11): Result.001 file - promoters70/1009941
ggtatatatat

SEQ ID NO: 79830 - DNA, 11 bp, Unknown
  misc_feature (1)..( 11): Result.001 file - promoters70/1009941
tcgatttataa

SEQ ID NO: 79831 - DNA, 11 bp, Unknown
  misc_feature (1)..( 11): Result.001 file - promoters70/1009941
agtatataaat

SEQ ID NO: 79832 - DNA, 11 bp, Unknown
  misc_feature (1)..( 11): Result.001 file - promoters70/1009941
gttatataaat

SEQ ID NO: 79833 - DNA, 11 bp, Unknown
  misc_feature (1)..( 11): Result.001 file - promoters70/1009941
actataaatac

SEQ ID NO: 79834 - DNA, 11 bp, Unknown
  misc_feature (1)..( 11): Result.001 file - promoters70/1009941
actataaacaa

SEQ ID NO: 79835 - DNA, 11 bp, Unknown
  misc_feature (1)..( 11): Result.001 file - promoters70/1009941
gaattggaatt

SEQ ID NO: 79836 - DNA, 11 bp, Unknown
  misc_feature (1)..( 11): Result.001 file - promoters70/1009941
acattggattt

SEQ ID NO: 79837 - DNA, 11 bp, Unknown
  misc_feature (1)..( 11): Result.001 file - promoters70/1009941
ctcttgtaatg

SEQ ID NO: 79838 - DNA, 11 bp, Unknown
  misc_feature (1)..( 11): Result.001 file - promoters70/1009941
gaattgggtaa

SEQ ID NO: 79839 - DNA, 11 bp, Unknown
  misc_feature (1)..( 11): Result.001 file - promoters70/1009941
gttgtgttatg

SEQ ID NO: 79840 - DNA, 11 bp, Unknown
  misc_feature (1)..( 11): Result.001 file - promoters70/1010025
aagttgtgttc

SEQ ID NO: 79841 - DNA, 9 bp, Unknown
  misc_feature (1)..( 9): Result.001 file - promoters70/1010025
agattttct

SEQ ID NO: 79842 - DNA, 9 bp, Unknown
  misc_feature (1)..( 9): Result.001 file - promoters70/1010025
tcattatct

SEQ ID NO: 79843 - DNA, 9 bp, Unknown
  misc_feature (1)..( 9): Result.001 file - promoters70/1010025
agattttaa

SEQ ID NO: 79844 - DNA, 11 bp, Unknown
  misc_feature (1)..( 11): Result.001 file - promoters70/1010025
gtttacttgct

SEQ ID NO: 79845 - DNA, 11 bp, Unknown
  misc_feature (1)..( 11): Result.001 file - promoters70/1010025
atttatttgtg

SEQ ID NO: 79846 - DNA, 11 bp, Unknown
  misc_feature (1)..( 11): Result.001 file - promoters70/1010025
atttattagtg

SEQ ID NO: 79847 - DNA, 8 bp, Unknown
  misc_feature (1)..( 8): Result.001 file - promoters70/1010025
tagtacta

SEQ ID NO: 79848 - DNA, 8 bp, Unknown
  misc_feature (1)..( 8): Result.001 file - promoters70/1010025
atgtacta

SEQ ID NO: 79849 - DNA, 8 bp, Unknown
  misc_feature (1)..( 8): Result.001 file - promoters70/1010055
atgaactc

SEQ ID NO: 79850 - DNA, 6 bp, Unknown
  misc_feature (1)..( 6): Result.001 file - promoters70/1010055
aaaata

SEQ ID NO: 79851 - DNA, 6 bp, Unknown
  misc_feature (1)..( 6): Result.001 file - promoters70/1010055
aaaata

SEQ ID NO: 79852 - DNA, 7 bp, Unknown
  misc_feature (1)..( 7): Result.001 file - promoters70/1010055
aaagatt

SEQ ID NO: 79853 - DNA, 7 bp, Unknown
  misc_feature (1)..( 7): Result.001 file - promoters70/1010055
aaacata

SEQ ID NO: 79854 - DNA, 7 bp, Unknown
  misc_feature (1)..( 7): Result.001 file - promoters70/1010055
aaaaaag

SEQ ID NO: 79855 - DNA, 9 bp, Unknown
  misc_feature (1)..( 9): Result.001 file - promoters70/1010055
aaaacaaac

SEQ ID NO: 79856 - DNA, 9 bp, Unknown
  misc_feature (1)..( 9): Result.001 file - promoters70/1010055
aaaaaaaag

SEQ ID NO: 79857 - DNA, 9 bp, Unknown
  misc_feature (1)..( 9): Result.001 file - promoters70/1010055
caaacaaat

SEQ ID NO: 79858 - DNA, 9 bp, Unknown
  misc_feature (1)..( 9): Result.001 file - promoters70/1010055
taaaaaaag

SEQ ID NO: 79859 - DNA, 9 bp, Unknown
  misc_feature (1)..( 9): Result.001 file - promoters70/1010055
gaaacaaat

SEQ ID NO: 79860 - DNA, 9 bp, Unknown
  misc_feature (1)..( 9): Result.001 file - promoters70/1010055
ttaactaat

SEQ ID NO: 79861 - DNA, 9 bp, Unknown
  misc_feature (1)..( 9): Result.001 file - promoters70/1010055
atattatta

SEQ ID NO: 79862 - DNA, 9 bp, Unknown
  misc_feature (1)..( 9): Result.001 file - promoters70/1010055
ttattatat

SEQ ID NO: 79863 - DNA, 9 bp, Unknown
  misc_feature (1)..( 9): Result.001 file - promoters70/1010055
atataatta

SEQ ID NO: 79864 - DNA, 9 bp, Unknown
  misc_feature (1)..( 9): Result.001 file - promoters70/1010055
aaattattt

SEQ ID NO: 79865 - DNA, 9 bp, Unknown
  misc_feature (1)..( 9): Result.001 file - promoters70/1010055
ttatcattt

SEQ ID NO: 79866 - DNA, 10 bp, Unknown
  misc_feature (1)..( 10): Result.001 file - promoters70/1010055
actacatatt

SEQ ID NO: 79867 - DNA, 10 bp, Unknown
  misc_feature (1)..( 10): Result.001 file - promoters70/1010055
taaacatatt

SEQ ID NO: 79868 - DNA, 10 bp, Unknown
  misc_feature (1)..( 10): Result.001 file - promoters70/1010055
tcaacatata

SEQ ID NO: 79869 - DNA, 10 bp, Unknown
  misc_feature (1)..( 10): Result.001 file - promoters70/1010055
caaaaataag

SEQ ID NO: 79870 - DNA, 10 bp, Unknown
  misc_feature (1)..( 10): Result.001 file - promoters70/1010115
caaaaaaggt

SEQ ID NO: 79871 - DNA, 8 bp, Unknown
  misc_feature (1)..( 8): Result.001 file - promoters70/1010115
caaaccca

SEQ ID NO: 79872 - DNA, 8 bp, Unknown
  misc_feature (1)..( 8): Result.001 file - promoters70/1010115
caaacctg

SEQ ID NO: 79873 - DNA, 8 bp, Unknown
  misc_feature (1)..( 8): Result.001 file - promoters70/1010115
gaaagctg

SEQ ID NO: 79874 - DNA, 8 bp, Unknown
  misc_feature (1)..( 8): Result.001 file - promoters70/1010115
agagacat

SEQ ID NO: 79875 - DNA, 8 bp, Unknown
  misc_feature (1)..( 8): Result.001 file - promoters70/1010115
agatacag

SEQ ID NO: 79876 - DNA, 8 bp, Unknown
  misc_feature (1)..( 8): Result.001 file - promoters70/1010115
cgatccag

SEQ ID NO: 79877 - DNA, 9 bp, Unknown
  misc_feature (1)..( 9): Result.001 file - promoters70/1010115
tttaaagct

SEQ ID NO: 79878 - DNA, 9 bp, Unknown
  misc_feature (1)..( 9): Result.001 file - promoters70/1010115
tttcaagtt

SEQ ID NO: 79879 - DNA, 9 bp, Unknown
  misc_feature (1)..( 9): Result.001 file - promoters70/1010367
tctcacgtt

SEQ ID NO: 79880 - DNA, 9 bp, Unknown
  misc_feature (1)..( 9): Result.001 file - promoters70/1010367
gaaaatatt

SEQ ID NO: 79881 - DNA, 9 bp, Unknown
  misc_feature (1)..( 9): Result.001 file - promoters70/1010367
aaaaataag

SEQ ID NO: 79882 - DNA, 9 bp, Unknown
  misc_feature (1)..( 9): Result.001 file - promoters70/1010367
aaaaattaa

SEQ ID NO: 79883 - DNA, 9 bp, Unknown
  misc_feature (1)..( 9): Result.001 file - promoters70/1010367
taaagtata

SEQ ID NO: 79884 - DNA, 8 bp, Unknown
  misc_feature (1)..( 8): Result.001 file - promoters70/1010367
aaaataaa

SEQ ID NO: 79885 - DNA, 8 bp, Unknown
  misc_feature (1)..( 8): Result.001 file - promoters70/1010367
ttaataaa

SEQ ID NO: 79886 - DNA, 8 bp, Unknown
  misc_feature (1)..( 8): Result.001 file - promoters70/1010367
aaaattaa

SEQ ID NO: 79887 - DNA, 9 bp, Unknown
  misc_feature (1)..( 9): Result.001 file - promoters70/1010367
gaaatataa

SEQ ID NO: 79888 - DNA, 10 bp, Unknown
  misc_feature (1)..( 10): Result.001 file - promoters70/1010367
aaaacaaacg

SEQ ID NO: 79889 - DNA, 10 bp, Unknown
  misc_feature (1)..( 10): Result.001 file - promoters70/1010367
aaaaaaaaga

SEQ ID NO: 79890 - DNA, 10 bp, Unknown
  misc_feature (1)..( 10): Result.001 file - promoters70/1010367
taaataaatt

SEQ ID NO: 79891 - DNA, 10 bp, Unknown
  misc_feature (1)..( 10): Result.001 file - promoters70/1010367
ataatgaatt

SEQ ID NO: 79892 - DNA, 12 bp, Unknown
  misc_feature (1)..( 12): Result.001 file - promoters70/1010367
attgggactaaa

SEQ ID NO: 79893 - DNA, 12 bp, Unknown
  misc_feature (1)..( 12): Result.001 file - promoters70/1010367
atttggataaaa

SEQ ID NO: 79894 - DNA, 12 bp, Unknown
  misc_feature (1)..( 12): Result.001 file - promoters70/1010367
ctttgaataaaa

SEQ ID NO: 79895 - DNA, 9 bp, Unknown
  misc_feature (1)..( 9): Result.001 file - promoters70/1010367
cctctttcc

SEQ ID NO: 79896 - DNA, 9 bp, Unknown
  misc_feature (1)..( 9): Result.001 file - promoters70/1010367
cctttttat

SEQ ID NO: 79897 - DNA, 9 bp, Unknown
  misc_feature (1)..( 9): Result.001 file - promoters70/1010367
tctctttcc

SEQ ID NO: 79898 - DNA, 9 bp, Unknown
  misc_feature (1)..( 9): Result.001 file - promoters70/1010367
tcttttttt

SEQ ID NO: 79899 - DNA, 11 bp, Unknown
  misc_feature (1)..( 11): Result.001 file - promoters70/1010367
aattacaaaac

SEQ ID NO: 79900 - DNA, 11 bp, Unknown
  misc_feature (1)..( 11): Result.001 file - promoters70/1010367
gtatacaaaaa

SEQ ID NO: 79901 - DNA, 11 bp, Unknown
  misc_feature (1)..( 11): Result.001 file - promoters70/1010367
caatactatct

SEQ ID NO: 79902 - DNA, 11 bp, Unknown
  misc_feature (1)..( 11): Result.001 file - promoters70/1010367
actcccaaaaa

SEQ ID NO: 79903 - DNA, 8 bp, Unknown
  misc_feature (1)..( 8): Result.001 file - promoters70/1010367
caaaacta

SEQ ID NO: 79904 - DNA, 8 bp, Unknown
  misc_feature (1)..( 8): Result.001 file - promoters70/1010367
aaaagcta

SEQ ID NO: 79905 - DNA, 8 bp, Unknown
  misc_feature (1)..( 8): Result.001 file - promoters70/1010367
caatacta

SEQ ID NO: 79906 - DNA, 12 bp, Unknown
  misc_feature (1)..( 12): Result.001 file - promoters70/1010367
aataaataaaag

SEQ ID NO: 79907 - DNA, 12 bp, Unknown
  misc_feature (1)..( 12): Result.001 file - promoters70/1010367
aaacaataaaat

SEQ ID NO: 79908 - DNA, 12 bp, Unknown
  misc_feature (1)..( 12): Result.001 file - promoters70/1010367
atgaaatataag

SEQ ID NO: 79909 - DNA, 12 bp, Unknown
  misc_feature (1)..( 12): Result.001 file - promoters70/1010367
aaacagtaaaac

SEQ ID NO: 79910 - DNA, 8 bp, Unknown
  misc_feature (1)..( 8): Result.001 file - promoters70/1010367
caaccaac

SEQ ID NO: 79911 - DNA, 8 bp, Unknown
  misc_feature (1)..( 8): Result.001 file - promoters70/1010367
aaaccaat

SEQ ID NO: 79912 - DNA, 8 bp, Unknown
  misc_feature (1)..( 8): Result.001 file - promoters70/1010367
agaccaat

SEQ ID NO: 79913 - DNA, 8 bp, Unknown
  misc_feature (1)..( 8): Result.001 file - promoters70/1010367
aaaacaag

SEQ ID NO: 79914 - DNA, 8 bp, Unknown
  misc_feature (1)..( 8): Result.001 file - promoters70/1010367
aatgaaaa

SEQ ID NO: 79915 - DNA, 8 bp, Unknown
  misc_feature (1)..( 8): Result.001 file - promoters70/1010367
aatgaatt

SEQ ID NO: 79916 - DNA, 8 bp, Unknown
  misc_feature (1)..( 8): Result.001 file - promoters70/1010367
aataaatt

SEQ ID NO: 79917 - DNA, 8 bp, Unknown
  misc_feature (1)..( 8): Result.001 file - promoters70/1010367
agacaaac

SEQ ID NO: 79918 - DNA, 8 bp, Unknown
  misc_feature (1)..( 8): Result.001 file - promoters70/1010367
taacaaac

SEQ ID NO: 79919 - DNA, 8 bp, Unknown
  misc_feature (1)..( 8): Result.001 file - promoters70/1010385
ttaaaaaa

SEQ ID NO: 79920 - DNA, 8 bp, Unknown
  misc_feature (1)..( 8): Result.001 file - promoters70/1010385
actttttg

SEQ ID NO: 79921 - DNA, 8 bp, Unknown
  misc_feature (1)..( 8): Result.001 file - promoters70/1010385
gctttttg

SEQ ID NO: 79922 - DNA, 8 bp, Unknown
  misc_feature (1)..( 8): Result.001 file - promoters70/1010429
gcttttcc

SEQ ID NO: 79923 - DNA, 7 bp, Unknown
  misc_feature (1)..( 7): Result.001 file - promoters70/1010429
taataat

SEQ ID NO: 79924 - DNA, 7 bp, Unknown
  misc_feature (1)..( 7): Result.001 file - promoters70/1010429
taataat

SEQ ID NO: 79925 - DNA, 7 bp, Unknown
  misc_feature (1)..( 7): Result.001 file - promoters70/1010429
taataag

SEQ ID NO: 79926 - DNA, 7 bp, Unknown
  misc_feature (1)..( 7): Result.001 file - promoters70/1010429
atgatct

SEQ ID NO: 79927 - DNA, 7 bp, Unknown
  misc_feature (1)..( 7): Result.001 file - promoters70/1010429
atgttct

SEQ ID NO: 79928 - DNA, 7 bp, Unknown
  misc_feature (1)..( 7): Result.001 file - promoters70/1010429
ttgttct

SEQ ID NO: 79929 - DNA, 10 bp, Unknown
  misc_feature (1)..( 10): Result.001 file - promoters70/1010429
gcttatacaa

SEQ ID NO: 79930 - DNA, 10 bp, Unknown
  misc_feature (1)..( 10): Result.001 file - promoters70/1010429
aattatacaa

SEQ ID NO: 79931 - DNA, 10 bp, Unknown
  misc_feature (1)..( 10): Result.001 file - promoters70/1010429
aatgatagca

SEQ ID NO: 79932 - DNA, 10 bp, Unknown
  misc_feature (1)..( 10): Result.001 file - promoters70/1010429
gttatttatt

SEQ ID NO: 79933 - DNA, 10 bp, Unknown
  misc_feature (1)..( 10): Result.001 file - promoters70/1010429
gttattaatt

SEQ ID NO: 79934 - DNA, 10 bp, Unknown
  misc_feature (1)..( 10): Result.001 file - promoters70/1010435
tgcattaatg

SEQ ID NO: 79935 - DNA, 8 bp, Unknown
  misc_feature (1)..( 8): Result.001 file - promoters70/1010435
tcttcttc

SEQ ID NO: 79936 - DNA, 8 bp, Unknown
  misc_feature (1)..( 8): Result.001 file - promoters70/1010435
cctttttc

SEQ ID NO: 79937 - DNA, 8 bp, Unknown
  misc_feature (1)..( 8): Result.001 file - promoters70/1010435
tcttctta

SEQ ID NO: 79938 - DNA, 10 bp, Unknown
  misc_feature (1)..( 10): Result.001 file - promoters70/1010435
attttcaaag

SEQ ID NO: 79939 - DNA, 10 bp, Unknown
  misc_feature (1)..( 10): Result.001 file - promoters70/1010435
attatcaaag

SEQ ID NO: 79940 - DNA, 10 bp, Unknown
  misc_feature (1)..( 10): Result.001 file - promoters70/1010435
attatccttg

SEQ ID NO: 79941 - DNA, 10 bp, Unknown
  misc_feature (1)..( 10): Result.001 file - promoters70/1010435
aatctgaatc

SEQ ID NO: 79942 - DNA, 10 bp, Unknown
  misc_feature (1)..( 10): Result.001 file - promoters70/1010435
actctgcatc

SEQ ID NO: 79943 - DNA, 10 bp, Unknown
  misc_feature (1)..( 10): Result.001 file - promoters70/1010449
aatttgattt

SEQ ID NO: 79944 - DNA, 8 bp, Unknown
  misc_feature (1)..( 8): Result.001 file - promoters70/1010449
gagtttat

SEQ ID NO: 79945 - DNA, 8 bp, Unknown
  misc_feature (1)..( 8): Result.001 file - promoters70/1010449
gagcttag

SEQ ID NO: 79946 - DNA, 8 bp, Unknown
  misc_feature (1)..( 8): Result.001 file - promoters70/1010449
aagtatat

SEQ ID NO: 79947 - DNA, 7 bp, Unknown
  misc_feature (1)..( 7): Result.001 file - promoters70/1010449
tgtgttt

SEQ ID NO: 79948 - DNA, 7 bp, Unknown
  misc_feature (1)..( 7): Result.001 file - promoters70/1010449
tgtgttt

SEQ ID NO: 79949 - DNA, 7 bp, Unknown
  misc_feature (1)..( 7): Result.001 file - promoters70/1010636
tgtattt

SEQ ID NO: 79950 - DNA, 8 bp, Unknown
  misc_feature (1)..( 8): Result.001 file - promoters70/1010636
gctttgat

SEQ ID NO: 79951 - DNA, 8 bp, Unknown
  misc_feature (1)..( 8): Result.001 file - promoters70/1010636
gcttggat

SEQ ID NO: 79952 - DNA, 8 bp, Unknown
  misc_feature (1)..( 8): Result.001 file - promoters70/1010636
cattggat

SEQ ID NO: 79953 - DNA, 8 bp, Unknown
  misc_feature (1)..( 8): Result.001 file - promoters70/1010636
tcaaagtt

SEQ ID NO: 79954 - DNA, 8 bp, Unknown
  misc_feature (1)..( 8): Result.001 file - promoters70/1010636
cgaaagtt

SEQ ID NO: 79955 - DNA, 8 bp, Unknown
  misc_feature (1)..( 8): Result.001 file - promoters70/1010636
cgagagta

SEQ ID NO: 79956 - DNA, 10 bp, Unknown
  misc_feature (1)..( 10): Result.001 file - promoters70/1010636
cctaaaccct

SEQ ID NO: 79957 - DNA, 10 bp, Unknown
  misc_feature (1)..( 10): Result.001 file - promoters70/1010636
ttaaaaccct

SEQ ID NO: 79958 - DNA, 10 bp, Unknown
  misc_feature (1)..( 10): Result.001 file - promoters70/1010636
tttaaaccct

SEQ ID NO: 79959 - DNA, 10 bp, Unknown
  misc_feature (1)..( 10): Result.001 file - promoters70/1010636
ttttaacggc

SEQ ID NO: 79960 - DNA, 8 bp, Unknown
  misc_feature (1)..( 8): Result.001 file - promoters70/1010636
atggaatt

SEQ ID NO: 79961 - DNA, 8 bp, Unknown
  misc_feature (1)..( 8): Result.001 file - promoters70/1010636
gtggcatt

SEQ ID NO: 79962 - DNA, 8 bp, Unknown
  misc_feature (1)..( 8): Result.001 file - promoters70/1010636
gtgtcatc

SEQ ID NO: 79963 - DNA, 7 bp, Unknown
  misc_feature (1)..( 7): Result.001 file - promoters70/1010636
ttttctt

SEQ ID NO: 79964 - DNA, 7 bp, Unknown
  misc_feature (1)..( 7): Result.001 file - promoters70/1010636
ttttcta

SEQ ID NO: 79965 - DNA, 7 bp, Unknown
  misc_feature (1)..( 7): Result.001 file - promoters70/1010815
atttcta

SEQ ID NO: 79966 - DNA, 12 bp, Unknown
  misc_feature (1)..( 12): Result.001 file - promoters70/1010815
acattgttagcc

SEQ ID NO: 79967 - DNA, 12 bp, Unknown
  misc_feature (1)..( 12): Result.001 file - promoters70/1010815
aaattgtttcga

SEQ ID NO: 79968 - DNA, 12 bp, Unknown
  misc_feature (1)..( 12): Result.001 file - promoters70/1010815
agattgttggag

SEQ ID NO: 79969 - DNA, 12 bp, Unknown
  misc_feature (1)..( 12): Result.001 file - promoters70/1010815
gaattgttcccc

SEQ ID NO: 79970 - DNA, 12 bp, Unknown
  misc_feature (1)..( 12): Result.001 file - promoters70/1010815
tttttgtttctc

SEQ ID NO: 79971 - DNA, 12 bp, Unknown
  misc_feature (1)..( 12): Result.001 file - promoters70/1010815
acattgatggag

SEQ ID NO: 79972 - DNA, 12 bp, Unknown
  misc_feature (1)..( 12): Result.001 file - promoters70/1010815
agagtgtccata

SEQ ID NO: 79973 - DNA, 12 bp, Unknown
  misc_feature (1)..( 12): Result.001 file - promoters70/1010819
aatttgatttgt

SEQ ID NO: 79974 - DNA, 9 bp, Unknown
  misc_feature (1)..( 9): Result.001 file - promoters70/1010819
attgttgct

SEQ ID NO: 79975 - DNA, 9 bp, Unknown
  misc_feature (1)..( 9): Result.001 file - promoters70/1010819
atttttggt

SEQ ID NO: 79976 - DNA, 9 bp, Unknown
  misc_feature (1)..( 9): Result.001 file - promoters70/1010993
agtttaggt

SEQ ID NO: 79977 - DNA, 11 bp, Unknown
  misc_feature (1)..( 11): Result.001 file - promoters70/1010993
aaactaatttg

SEQ ID NO: 79978 - DNA, 11 bp, Unknown
  misc_feature (1)..( 11): Result.001 file - promoters70/1010993
aaaataaaaaa

SEQ ID NO: 79979 - DNA, 11 bp, Unknown
  misc_feature (1)..( 11): Result.001 file - promoters70/1010993
taaataataaa

SEQ ID NO: 79980 - DNA, 10 bp, Unknown
  misc_feature (1)..( 10): Result.001 file - promoters70/1010993
aaaaaactaa

SEQ ID NO: 79981 - DNA, 10 bp, Unknown
  misc_feature (1)..( 10): Result.001 file - promoters70/1010993
aaaaaaactg

SEQ ID NO: 79982 - DNA, 10 bp, Unknown
  misc_feature (1)..( 10): Result.001 file - promoters70/1010993
aaataataaa

SEQ ID NO: 79983 - DNA, 7 bp, Unknown
  misc_feature (1)..( 7): Result.001 file - promoters70/1010993
taaaaag

SEQ ID NO: 79984 - DNA, 7 bp, Unknown
  misc_feature (1)..( 7): Result.001 file - promoters70/1010993
taaaaaa

SEQ ID NO: 79985 - DNA, 8 bp, Unknown
  misc_feature (1)..( 8): Result.001 file - promoters70/1010993
gaaacaac

SEQ ID NO: 79986 - DNA, 11 bp, Unknown
  misc_feature (1)..( 11): Result.001 file - promoters70/1010993
tatagatttta

SEQ ID NO: 79987 - DNA, 11 bp, Unknown
  misc_feature (1)..( 11): Result.001 file - promoters70/1010993
tatagaatttg

SEQ ID NO: 79988 - DNA, 11 bp, Unknown
  misc_feature (1)..( 11): Result.001 file - promoters70/1011337
atgacaatttg

SEQ ID NO: 79989 - DNA, 9 bp, Unknown
  misc_feature (1)..( 9): Result.001 file - promoters70/1011337
aaaaaaatt

SEQ ID NO: 79990 - DNA, 9 bp, Unknown
  misc_feature (1)..( 9): Result.001 file - promoters70/1011337
aaaacaatt

SEQ ID NO: 79991 - DNA, 9 bp, Unknown
  misc_feature (1)..( 9): Result.001 file - promoters70/1011358
gtaaaaata

SEQ ID NO: 79992 - DNA, 11 bp, Unknown
  misc_feature (1)..( 11): Result.001 file - promoters70/1011358
cgatacttgtc

SEQ ID NO: 79993 - DNA, 11 bp, Unknown
  misc_feature (1)..( 11): Result.001 file - promoters70/1011358
tgattcttcga

SEQ ID NO: 79994 - DNA, 11 bp, Unknown
  misc_feature (1)..( 11): Result.001 file - promoters70/1011358
cgaaactggtc

SEQ ID NO: 79995 - DNA, 10 bp, Unknown
  misc_feature (1)..( 10): Result.001 file - promoters70/1011358
aagaactcat

SEQ ID NO: 79996 - DNA, 10 bp, Unknown
  misc_feature (1)..( 10): Result.001 file - promoters70/1011358
aagaactaga

SEQ ID NO: 79997 - DNA, 10 bp, Unknown
  misc_feature (1)..( 10): Result.001 file - promoters70/1011358
atgaagtcat

SEQ ID NO: 79998 - DNA, 12 bp, Unknown
  misc_feature (1)..( 12): Result.001 file - promoters70/1011358
ttaaatgaagat

SEQ ID NO: 79999 - DNA, 12 bp, Unknown
  misc_feature (1)..( 12): Result.001 file - promoters70/1011358
aataatgatgat

SEQ ID NO: 80000 - DNA, 12 bp, Unknown
  misc_feature (1)..( 12): Result.001 file - promoters70/1011358
ttacatgaacag

SEQ ID NO: 80001 - DNA, 10 bp, Unknown
  misc_feature (1)..( 10): Result.001 file - promoters70/1011358
agtgatccaa

SEQ ID NO: 80002 - DNA, 10 bp, Unknown
  misc_feature (1)..( 10): Result.001 file - promoters70/1011358
tgtggtccat

SEQ ID NO: 80003 - DNA, 10 bp, Unknown
  misc_feature (1)..( 10): Result.001 file - promoters70/1011780
tgtggttcat

SEQ ID NO: 80004 - DNA, 12 bp, Unknown
  misc_feature (1)..( 12): Result.001 file - promoters70/1011780
tgtaaattttgc

SEQ ID NO: 80005 - DNA, 12 bp, Unknown
  misc_feature (1)..( 12): Result.001 file - promoters70/1011780
tttaaatttttt

SEQ ID NO: 80006 - DNA, 12 bp, Unknown
  misc_feature (1)..( 12): Result.001 file - promoters70/1011780
tttgaattttgc

SEQ ID NO: 80007 - DNA, 12 bp, Unknown
  misc_feature (1)..( 12): Result.001 file - promoters70/1011780
ggtgacttttga

SEQ ID NO: 80008 - DNA, 7 bp, Unknown
  misc_feature (1)..( 7): Result.001 file - promoters70/1011780
aaaaata

SEQ ID NO: 80009 - DNA, 7 bp, Unknown
  misc_feature (1)..( 7): Result.001 file - promoters70/1011780
taaaata

SEQ ID NO: 80010 - DNA, 7 bp, Unknown
  misc_feature (1)..( 7): Result.001 file - promoters70/1011780
aaaaatt

SEQ ID NO: 80011 - DNA, 7 bp, Unknown
  misc_feature (1)..( 7): Result.001 file - promoters70/1011780
tttgtta

SEQ ID NO: 80012 - DNA, 7 bp, Unknown
  misc_feature (1)..( 7): Result.001 file - promoters70/1011780
tttctta

SEQ ID NO: 80013 - DNA, 7 bp, Unknown
  misc_feature (1)..( 7): Result.001 file - promoters70/1011780
tttgtta

SEQ ID NO: 80014 - DNA, 8 bp, Unknown
  misc_feature (1)..( 8): Result.001 file - promoters70/1011780
gtaataat

SEQ ID NO: 80015 - DNA, 8 bp, Unknown
  misc_feature (1)..( 8): Result.001 file - promoters70/1011780
gtaataat

SEQ ID NO: 80016 - DNA, 8 bp, Unknown
  misc_feature (1)..( 8): Result.001 file - promoters70/1011780
ttaataat

SEQ ID NO: 80017 - DNA, 12 bp, Unknown
  misc_feature (1)..( 12): Result.001 file - promoters70/1011780
aaaggcccaata

SEQ ID NO: 80018 - DNA, 12 bp, Unknown
  misc_feature (1)..( 12): Result.001 file - promoters70/1011780
aaaggcccatat

SEQ ID NO: 80019 - DNA, 12 bp, Unknown
  misc_feature (1)..( 12): Result.001 file - promoters70/1011780
tgaagcccaata

SEQ ID NO: 80020 - DNA, 7 bp, Unknown
  misc_feature (1)..( 7): Result.001 file - promoters70/1011780
caaaaat

SEQ ID NO: 80021 - DNA, 7 bp, Unknown
  misc_feature (1)..( 7): Result.001 file - promoters70/1011780
caaaaaa

SEQ ID NO: 80022 - DNA, 8 bp, Unknown
  misc_feature (1)..( 8): Result.001 file - promoters70/1011780
aaaataaa

SEQ ID NO: 80023 - DNA, 6 bp, Unknown
  misc_feature (1)..( 6): Result.001 file - promoters70/1011780
tcaaaa

SEQ ID NO: 80024 - DNA, 6 bp, Unknown
  misc_feature (1)..( 6): Result.001 file - promoters70/1011780
tcaaaa

SEQ ID NO: 80025 - DNA, 6 bp, Unknown
  misc_feature (1)..( 6): Result.001 file - promoters70/1011780
tcaaaa

SEQ ID NO: 80026 - DNA, 11 bp, Unknown
  misc_feature (1)..( 11): Result.001 file - promoters70/1011780
catgaatttaa

SEQ ID NO: 80027 - DNA, 11 bp, Unknown
  misc_feature (1)..( 11): Result.001 file - promoters70/1011780
catttatttaa

SEQ ID NO: 80028 - DNA, 11 bp, Unknown
  misc_feature (1)..( 11): Result.001 file - promoters70/1011923
tttgaattttg

SEQ ID NO: 80029 - DNA, 9 bp, Unknown
  misc_feature (1)..( 9): Result.001 file - promoters70/1011923
ttgttgttt

SEQ ID NO: 80030 - DNA, 9 bp, Unknown
  misc_feature (1)..( 9): Result.001 file - promoters70/1011923
ttgttgttt

SEQ ID NO: 80031 - DNA, 9 bp, Unknown
  misc_feature (1)..( 9): Result.001 file - promoters70/1011923
tttttgttt

SEQ ID NO: 80032 - DNA, 11 bp, Unknown
  misc_feature (1)..( 11): Result.001 file - promoters70/1011923
atcttcatgtt

SEQ ID NO: 80033 - DNA, 11 bp, Unknown
  misc_feature (1)..( 11): Result.001 file - promoters70/1011923
atgttcatgtt

SEQ ID NO: 80034 - DNA, 11 bp, Unknown
  misc_feature (1)..( 11): Result.001 file - promoters70/1011972
atcttcatgac

SEQ ID NO: 80035 - DNA, 10 bp, Unknown
  misc_feature (1)..( 10): Result.001 file - promoters70/1011972
aaactttttc

SEQ ID NO: 80036 - DNA, 10 bp, Unknown
  misc_feature (1)..( 10): Result.001 file - promoters70/1011972
aaactttttt

SEQ ID NO: 80037 - DNA, 10 bp, Unknown
  misc_feature (1)..( 10): Result.001 file - promoters70/1011972
catttttttc

SEQ ID NO: 80038 - DNA, 10 bp, Unknown
  misc_feature (1)..( 10): Result.001 file - promoters70/1011972
atataaaaaa

SEQ ID NO: 80039 - DNA, 10 bp, Unknown
  misc_feature (1)..( 10): Result.001 file - promoters70/1011972
ttttaacaaa

SEQ ID NO: 80040 - DNA, 10 bp, Unknown
  misc_feature (1)..( 10): Result.001 file - promoters70/1011972
ttttaacatc

SEQ ID NO: 80041 - DNA, 8 bp, Unknown
  misc_feature (1)..( 8): Result.001 file - promoters70/1011972
tgcataat

SEQ ID NO: 80042 - DNA, 8 bp, Unknown
  misc_feature (1)..( 8): Result.001 file - promoters70/1011972
agcataag

SEQ ID NO: 80043 - DNA, 8 bp, Unknown
  misc_feature (1)..( 8): Result.001 file - promoters70/1011972
tgcatatg

SEQ ID NO: 80044 - DNA, 8 bp, Unknown
  misc_feature (1)..( 8): Result.001 file - promoters70/1011972
tccataat

SEQ ID NO: 80045 - DNA, 9 bp, Unknown
  misc_feature (1)..( 9): Result.001 file - promoters70/1011972
gaatctctt

SEQ ID NO: 80046 - DNA, 9 bp, Unknown
  misc_feature (1)..( 9): Result.001 file - promoters70/1011972
gaatctctt

SEQ ID NO: 80047 - DNA, 9 bp, Unknown
  misc_feature (1)..( 9): Result.001 file - promoters70/1011972
gaatctaag

SEQ ID NO: 80048 - DNA, 7 bp, Unknown
  misc_feature (1)..( 7): Result.001 file - promoters70/1011972
tttaaaa

SEQ ID NO: 80049 - DNA, 7 bp, Unknown
  misc_feature (1)..( 7): Result.001 file - promoters70/1011972
tttaaag

SEQ ID NO: 80050 - DNA, 7 bp, Unknown
  misc_feature (1)..( 7): Result.001 file - promoters70/1011972
attaaag

SEQ ID NO: 80051 - DNA, 11 bp, Unknown
  misc_feature (1)..( 11): Result.001 file - promoters70/1011972
atgtattttat

SEQ ID NO: 80052 - DNA, 11 bp, Unknown
  misc_feature (1)..( 11): Result.001 file - promoters70/1011972
aatctttttat

SEQ ID NO: 80053 - DNA, 11 bp, Unknown
  misc_feature (1)..( 11): Result.001 file - promoters70/1011972
aatctttttac

SEQ ID NO: 80054 - DNA, 9 bp, Unknown
  misc_feature (1)..( 9): Result.001 file - promoters70/1011972
ttctgctaa

SEQ ID NO: 80055 - DNA, 9 bp, Unknown
  misc_feature (1)..( 9): Result.001 file - promoters70/1011972
ttctgcgaa

SEQ ID NO: 80056 - DNA, 9 bp, Unknown
  misc_feature (1)..( 9): Result.001 file - promoters70/1011972
atctcctaa

SEQ ID NO: 80057 - DNA, 9 bp, Unknown
  misc_feature (1)..( 9): Result.001 file - promoters70/1011972
tcatataaa

SEQ ID NO: 80058 - DNA, 9 bp, Unknown
  misc_feature (1)..( 9): Result.001 file - promoters70/1011972
ctatataaa

SEQ ID NO: 80059 - DNA, 9 bp, Unknown
  misc_feature (1)..( 9): Result.001 file - promoters70/1011972
ctacatatc

SEQ ID NO: 80060 - DNA, 12 bp, Unknown
  misc_feature (1)..( 12): Result.001 file - promoters70/1011972
agtgtttcatat

SEQ ID NO: 80061 - DNA, 12 bp, Unknown
  misc_feature (1)..( 12): Result.001 file - promoters70/1011972
agtttttgatat

SEQ ID NO: 80062 - DNA, 12 bp, Unknown
  misc_feature (1)..( 12): Result.001 file - promoters70/1011972
gccgtttgataa

SEQ ID NO: 80063 - DNA, 12 bp, Unknown
  misc_feature (1)..( 12): Result.001 file - promoters70/1011972
tcattttgacat

SEQ ID NO: 80064 - DNA, 7 bp, Unknown
  misc_feature (1)..( 7): Result.001 file - promoters70/1011972
ttttcaa

SEQ ID NO: 80065 - DNA, 7 bp, Unknown
  misc_feature (1)..( 7): Result.001 file - promoters70/1011972
gtttcaa

SEQ ID NO: 80066 - DNA, 8 bp, Unknown
  misc_feature (1)..( 8): Result.001 file - promoters70/1011972
attgtcaa

SEQ ID NO: 80067 - DNA, 9 bp, Unknown
  misc_feature (1)..( 9): Result.001 file - promoters70/1011972
ctaattaac

SEQ ID NO: 80068 - DNA, 9 bp, Unknown
  misc_feature (1)..( 9): Result.001 file - promoters70/1011972
ctaatcaac

SEQ ID NO: 80069 - DNA, 9 bp, Unknown
  misc_feature (1)..( 9): Result.001 file - promoters70/1011972
gtcatcaat

SEQ ID NO: 80070 - DNA, 10 bp, Unknown
  misc_feature (1)..( 10): Result.001 file - promoters70/1011972
atcttcatat

SEQ ID NO: 80071 - DNA, 10 bp, Unknown
  misc_feature (1)..( 10): Result.001 file - promoters70/1011972
atctacatat

SEQ ID NO: 80072 - DNA, 10 bp, Unknown
  misc_feature (1)..( 10): Result.001 file - promoters70/1011972
tactatataa

SEQ ID NO: 80073 - DNA, 8 bp, Unknown
  misc_feature (1)..( 8): Result.001 file - promoters70/1011972
atccatat

SEQ ID NO: 80074 - DNA, 8 bp, Unknown
  misc_feature (1)..( 8): Result.001 file - promoters70/1011972
atcaatat

SEQ ID NO: 80075 - DNA, 8 bp, Unknown
  misc_feature (1)..( 8): Result.001 file - promoters70/1011972
atcaacaa

SEQ ID NO: 80076 - DNA, 7 bp, Unknown
  misc_feature (1)..( 7): Result.001 file - promoters70/1011972
tgacatc

SEQ ID NO: 80077 - DNA, 7 bp, Unknown
  misc_feature (1)..( 7): Result.001 file - promoters70/1011972
tgacatt

SEQ ID NO: 80078 - DNA, 7 bp, Unknown
  misc_feature (1)..( 7): Result.001 file - promoters70/1011972
tgatatt

SEQ ID NO: 80079 - DNA, 6 bp, Unknown
  misc_feature (1)..( 6): Result.001 file - promoters70/1011972
tttgga

SEQ ID NO: 80080 - DNA, 6 bp, Unknown
  misc_feature (1)..( 6): Result.001 file - promoters70/1011972
tttgga

SEQ ID NO: 80081 - DNA, 7 bp, Unknown
  misc_feature (1)..( 7): Result.001 file - promoters70/1012003
tttcgga

SEQ ID NO: 80082 - DNA, 10 bp, Unknown
  misc_feature (1)..( 10): Result.001 file - promoters70/1012003
tagattcttc

SEQ ID NO: 80083 - DNA, 10 bp, Unknown
  misc_feature (1)..( 10): Result.001 file - promoters70/1012003
tagtttctta

SEQ ID NO: 80084 - DNA, 10 bp, Unknown
  misc_feature (1)..( 10): Result.001 file - promoters70/1012003
gaagttctta

SEQ ID NO: 80085 - DNA, 10 bp, Unknown
  misc_feature (1)..( 10): Result.001 file - promoters70/1012003
agttttctta

SEQ ID NO: 80086 - DNA, 10 bp, Unknown
  misc_feature (1)..( 10): Result.001 file - promoters70/1012003
caagtgcttc

SEQ ID NO: 80087 - DNA, 10 bp, Unknown
  misc_feature (1)..( 10): Result.001 file - promoters70/1012003
gaagagctcc

SEQ ID NO: 80088 - DNA, 15 bp, Unknown
  misc_feature (1)..( 15): Result.001 file - promoters70/1012003
gccaaaaatggcaga

SEQ ID NO: 80089 - DNA, 15 bp, Unknown
  misc_feature (1)..( 15): Result.001 file - promoters70/1012003
cccaaaatctcatct

SEQ ID NO: 80090 - DNA, 15 bp, Unknown
  misc_feature (1)..( 15): Result.001 file - promoters70/1012003
agcaaaaaacttcca

SEQ ID NO: 80091 - DNA, 15 bp, Unknown
  misc_feature (1)..( 15): Result.001 file - promoters70/1012003
aggaaacaacactag

SEQ ID NO: 80092 - DNA, 15 bp, Unknown
  misc_feature (1)..( 15): Result.001 file - promoters70/1012003
cgcaaaactattgac

SEQ ID NO: 80093 - DNA, 15 bp, Unknown
  misc_feature (1)..( 15): Result.001 file - promoters70/1012003
aagaaaaaaattcca

SEQ ID NO: 80094 - DNA, 11 bp, Unknown
  misc_feature (1)..( 11): Result.001 file - promoters70/1012003
cgtatatataa

SEQ ID NO: 80095 - DNA, 11 bp, Unknown
  misc_feature (1)..( 11): Result.001 file - promoters70/1012003
catatataaag

SEQ ID NO: 80096 - DNA, 11 bp, Unknown
  misc_feature (1)..( 11): Result.001 file - promoters70/1012003
cgtatataaag

SEQ ID NO: 80097 - DNA, 11 bp, Unknown
  misc_feature (1)..( 11): Result.001 file - promoters70/1012003
actatttaaag

SEQ ID NO: 80098 - DNA, 11 bp, Unknown
  misc_feature (1)..( 11): Result.001 file - promoters70/1012003
tccatataaat

SEQ ID NO: 80099 - DNA, 11 bp, Unknown
  misc_feature (1)..( 11): Result.001 file - promoters70/1012003
ttactataaag

SEQ ID NO: 80100 - DNA, 11 bp, Unknown
  misc_feature (1)..( 11): Result.001 file - promoters70/1012003
gaagaggaaga

SEQ ID NO: 80101 - DNA, 11 bp, Unknown
  misc_feature (1)..( 11): Result.001 file - promoters70/1012003
gaagaagaatt

SEQ ID NO: 80102 - DNA, 11 bp, Unknown
  misc_feature (1)..( 11): Result.001 file - promoters70/1012003
tcagaagaaaa

SEQ ID NO: 80103 - DNA, 11 bp, Unknown
  misc_feature (1)..( 11): Result.001 file - promoters70/1012003
gaagacgaaca

SEQ ID NO: 80104 - DNA, 11 bp, Unknown
  misc_feature (1)..( 11): Result.001 file - promoters70/1012003
taagcagaaat

SEQ ID NO: 80105 - DNA, 11 bp, Unknown
  misc_feature (1)..( 11): Result.001 file - promoters70/1012003
taggaaaaaaa

SEQ ID NO: 80106 - DNA, 11 bp, Unknown
  misc_feature (1)..( 11): Result.001 file - promoters70/1012003
gaataaacgcc

SEQ ID NO: 80107 - DNA, 11 bp, Unknown
  misc_feature (1)..( 11): Result.001 file - promoters70/1012003
gaaaaaacata

SEQ ID NO: 80108 - DNA, 11 bp, Unknown
  misc_feature (1)..( 11): Result.001 file - promoters70/1012003
taaaaaaatcc

SEQ ID NO: 80109 - DNA, 11 bp, Unknown
  misc_feature (1)..( 11): Result.001 file - promoters70/1012003
aatgaaatcat

SEQ ID NO: 80110 - DNA, 11 bp, Unknown
  misc_feature (1)..( 11): Result.001 file - promoters70/1012003
gagcaaacctc

SEQ ID NO: 80111 - DNA, 11 bp, Unknown
  misc_feature (1)..( 11): Result.001 file - promoters70/1012003
aaaaaaatgga

SEQ ID NO: 80112 - DNA, 15 bp, Unknown
  misc_feature (1)..( 15): Result.001 file - promoters70/1012003
ttcggcccaaattta

SEQ ID NO: 80113 - DNA, 15 bp, Unknown
  misc_feature (1)..( 15): Result.001 file - promoters70/1012003
aaaggcccaataaat

SEQ ID NO: 80114 - DNA, 15 bp, Unknown
  misc_feature (1)..( 15): Result.001 file - promoters70/1012003
ttcggcccaccggcc

SEQ ID NO: 80115 - DNA, 15 bp, Unknown
  misc_feature (1)..( 15): Result.001 file - promoters70/1012003
aaaggcccatattaa

SEQ ID NO: 80116 - DNA, 15 bp, Unknown
  misc_feature (1)..( 15): Result.001 file - promoters70/1012003
aaaggcccaatttca

SEQ ID NO: 80117 - DNA, 15 bp, Unknown
  misc_feature (1)..( 15): Result.001 file - promoters70/1012074
taaaacccattttca

SEQ ID NO: 80118 - DNA, 8 bp, Unknown
  misc_feature (1)..( 8): Result.001 file - promoters70/1012074
agtgttca

SEQ ID NO: 80119 - DNA, 8 bp, Unknown
  misc_feature (1)..( 8): Result.001 file - promoters70/1012074
agtcttcc

SEQ ID NO: 80120 - DNA, 8 bp, Unknown
  misc_feature (1)..( 8): Result.001 file - promoters70/1012074
agtgatca

SEQ ID NO: 80121 - DNA, 10 bp, Unknown
  misc_feature (1)..( 10): Result.001 file - promoters70/1012074
ttttaataag

SEQ ID NO: 80122 - DNA, 10 bp, Unknown
  misc_feature (1)..( 10): Result.001 file - promoters70/1012074
tttcaataac

SEQ ID NO: 80123 - DNA, 10 bp, Unknown
  misc_feature (1)..( 10): Result.001 file - promoters70/1012110
gtctaaaaag

SEQ ID NO: 80124 - DNA, 11 bp, Unknown
  misc_feature (1)..( 11): Result.001 file - promoters70/1012110
ccagaattaag

SEQ ID NO: 80125 - DNA, 11 bp, Unknown
  misc_feature (1)..( 11): Result.001 file - promoters70/1012110
ccataattagt

SEQ ID NO: 80126 - DNA, 11 bp, Unknown
  misc_feature (1)..( 11): Result.001 file - promoters70/1012334
atgtaattaag

SEQ ID NO: 80127 - DNA, 11 bp, Unknown
  misc_feature (1)..( 11): Result.001 file - promoters70/1012334
gttgtttagac

SEQ ID NO: 80128 - DNA, 11 bp, Unknown
  misc_feature (1)..( 11): Result.001 file - promoters70/1012334
gttttttctct

SEQ ID NO: 80129 - DNA, 11 bp, Unknown
  misc_feature (1)..( 11): Result.001 file - promoters70/1012334
attgtttcgaa

SEQ ID NO: 80130 - DNA, 11 bp, Unknown
  misc_feature (1)..( 11): Result.001 file - promoters70/1012334
tttttttgttt

SEQ ID NO: 80131 - DNA, 11 bp, Unknown
  misc_feature (1)..( 11): Result.001 file - promoters70/1012334
gtttttctttt

SEQ ID NO: 80132 - DNA, 11 bp, Unknown
  misc_feature (1)..( 11): Result.001 file - promoters70/1012334
tttgttccatt

SEQ ID NO: 80133 - DNA, 11 bp, Unknown
  misc_feature (1)..( 11): Result.001 file - promoters70/1012349
ctttttttttt

SEQ ID NO: 80134 - DNA, 14 bp, Unknown
  misc_feature (1)..( 14): Result.001 file - promoters70/1012349
caaacgtttaggag

SEQ ID NO: 80135 - DNA, 14 bp, Unknown
  misc_feature (1)..( 14): Result.001 file - promoters70/1012349
catacgtttttttt

SEQ ID NO: 80136 - DNA, 14 bp, Unknown
  misc_feature (1)..( 14): Result.001 file - promoters70/1012349
taaaagtttgttat

SEQ ID NO: 80137 - DNA, 14 bp, Unknown
  misc_feature (1)..( 14): Result.001 file - promoters70/1012349
aacacgcttacgaa

SEQ ID NO: 80138 - DNA, 14 bp, Unknown
  misc_feature (1)..( 14): Result.001 file - promoters70/1012349
tttacatttgtctg

SEQ ID NO: 80139 - DNA, 14 bp, Unknown
  misc_feature (1)..( 14): Result.001 file - promoters70/1012349
taaaagtttgatat

SEQ ID NO: 80140 - DNA, 12 bp, Unknown
  misc_feature (1)..( 12): Result.001 file - promoters70/1012349
tttattaaaaaa

SEQ ID NO: 80141 - DNA, 12 bp, Unknown
  misc_feature (1)..( 12): Result.001 file - promoters70/1012349
tttcttaaaagc

SEQ ID NO: 80142 - DNA, 12 bp, Unknown
  misc_feature (1)..( 12): Result.001 file - promoters70/1012349
ggttctaaaaaa

SEQ ID NO: 80143 - DNA, 12 bp, Unknown
  misc_feature (1)..( 12): Result.001 file - promoters70/1012349
tttattgctctt

SEQ ID NO: 80144 - DNA, 12 bp, Unknown
  misc_feature (1)..( 12): Result.001 file - promoters70/1012349
aatctgaaaata

SEQ ID NO: 80145 - DNA, 12 bp, Unknown
  misc_feature (1)..( 12): Result.001 file - promoters70/1012407
gggcttaaacca

SEQ ID NO: 80146 - DNA, 8 bp, Unknown
  misc_feature (1)..( 8): Result.001 file - promoters70/1012407
ccatctga

SEQ ID NO: 80147 - DNA, 8 bp, Unknown
  misc_feature (1)..( 8): Result.001 file - promoters70/1012407
aaatctga

SEQ ID NO: 80148 - DNA, 8 bp, Unknown
  misc_feature (1)..( 8): Result.001 file - promoters70/1012407
ccatttga

SEQ ID NO: 80149 - DNA, 8 bp, Unknown
  misc_feature (1)..( 8): Result.001 file - promoters70/1012407
aattttga

SEQ ID NO: 80150 - DNA, 8 bp, Unknown
  misc_feature (1)..( 8): Result.001 file - promoters70/1012407
aattttaa

SEQ ID NO: 80151 - DNA, 8 bp, Unknown
  misc_feature (1)..( 8): Result.001 file - promoters70/1012407
cattgtaa

SEQ ID NO: 80152 - DNA, 6 bp, Unknown
  misc_feature (1)..( 6): Result.001 file - promoters70/1012407
ttattc

SEQ ID NO: 80153 - DNA, 6 bp, Unknown
  misc_feature (1)..( 6): Result.001 file - promoters70/1012407
ttattc

SEQ ID NO: 80154 - DNA, 6 bp, Unknown
  misc_feature (1)..( 6): Result.001 file - promoters70/1012407
ttattc

SEQ ID NO: 80155 - DNA, 10 bp, Unknown
  misc_feature (1)..( 10): Result.001 file - promoters70/1012407
ccaaataatt

SEQ ID NO: 80156 - DNA, 10 bp, Unknown
  misc_feature (1)..( 10): Result.001 file - promoters70/1012407
tcaagtaatt

SEQ ID NO: 80157 - DNA, 10 bp, Unknown
  misc_feature (1)..( 10): Result.001 file - promoters70/1012580
ccaaatattc

SEQ ID NO: 80158 - DNA, 9 bp, Unknown
  misc_feature (1)..( 9): Result.001 file - promoters70/1012580
aattacaat

SEQ ID NO: 80159 - DNA, 9 bp, Unknown
  misc_feature (1)..( 9): Result.001 file - promoters70/1012580
tcttataat

SEQ ID NO: 80160 - DNA, 9 bp, Unknown
  misc_feature (1)..( 9): Result.001 file - promoters70/1012580
tcttataaa

SEQ ID NO: 80161 - DNA, 8 bp, Unknown
  misc_feature (1)..( 8): Result.001 file - promoters70/1012580
acttatat

SEQ ID NO: 80162 - DNA, 8 bp, Unknown
  misc_feature (1)..( 8): Result.001 file - promoters70/1012580
tcttataa

SEQ ID NO: 80163 - DNA, 8 bp, Unknown
  misc_feature (1)..( 8): Result.001 file - promoters70/1012673
tcttataa

SEQ ID NO: 80164 - DNA, 9 bp, Unknown
  misc_feature (1)..( 9): Result.001 file - promoters70/1012673
tatcatttt

SEQ ID NO: 80165 - DNA, 9 bp, Unknown
  misc_feature (1)..( 9): Result.001 file - promoters70/1012673
tatcatttt

SEQ ID NO: 80166 - DNA, 9 bp, Unknown
  misc_feature (1)..( 9): Result.001 file - promoters70/1012757
tatgattaa

SEQ ID NO: 80167 - DNA, 11 bp, Unknown
  misc_feature (1)..( 11): Result.001 file - promoters70/1012757
tgtttgaccat

SEQ ID NO: 80168 - DNA, 11 bp, Unknown
  misc_feature (1)..( 11): Result.001 file - promoters70/1012757
tatttgaacat

SEQ ID NO: 80169 - DNA, 11 bp, Unknown
  misc_feature (1)..( 11): Result.001 file - promoters70/1012757
tgtgtgagttc

SEQ ID NO: 80170 - DNA, 8 bp, Unknown
  misc_feature (1)..( 8): Result.001 file - promoters70/1012757
taacgaac

SEQ ID NO: 80171 - DNA, 8 bp, Unknown
  misc_feature (1)..( 8): Result.001 file - promoters70/1012757
caacgaaa

SEQ ID NO: 80172 - DNA, 8 bp, Unknown
  misc_feature (1)..( 8): Result.001 file - promoters70/1012883
caactaaa

SEQ ID NO: 80173 - DNA, 8 bp, Unknown
  misc_feature (1)..( 8): Result.001 file - promoters70/1012883
aaagattg

SEQ ID NO: 80174 - DNA, 8 bp, Unknown
  misc_feature (1)..( 8): Result.001 file - promoters70/1012883
aaagcttg

SEQ ID NO: 80175 - DNA, 8 bp, Unknown
  misc_feature (1)..( 8): Result.001 file - promoters70/1012883
aaaaattt

SEQ ID NO: 80176 - DNA, 7 bp, Unknown
  misc_feature (1)..( 7): Result.001 file - promoters70/1012883
ccactaa

SEQ ID NO: 80177 - DNA, 7 bp, Unknown
  misc_feature (1)..( 7): Result.001 file - promoters70/1012883
ccattaa

SEQ ID NO: 80178 - DNA, 7 bp, Unknown
  misc_feature (1)..( 7): Result.001 file - promoters70/1012883
ccattag

SEQ ID NO: 80179 - DNA, 9 bp, Unknown
  misc_feature (1)..( 9): Result.001 file - promoters70/1012883
cttaattta

SEQ ID NO: 80180 - DNA, 9 bp, Unknown
  misc_feature (1)..( 9): Result.001 file - promoters70/1012883
actaaatta

SEQ ID NO: 80181 - DNA, 9 bp, Unknown
  misc_feature (1)..( 9): Result.001 file - promoters70/1013128
actgaattc

SEQ ID NO: 80182 - DNA, 9 bp, Unknown
  misc_feature (1)..( 9): Result.001 file - promoters70/1013128
gtagtgaaa

SEQ ID NO: 80183 - DNA, 9 bp, Unknown
  misc_feature (1)..( 9): Result.001 file - promoters70/1013128
gtagtcaaa

SEQ ID NO: 80184 - DNA, 9 bp, Unknown
  misc_feature (1)..( 9): Result.001 file - promoters70/1013128
ctagagaaa

SEQ ID NO: 80185 - DNA, 13 bp, Unknown
  misc_feature (1)..( 13): Result.001 file - promoters70/1013128
gactaaaataaag

SEQ ID NO: 80186 - DNA, 13 bp, Unknown
  misc_feature (1)..( 13): Result.001 file - promoters70/1013128
tgaaaaaatagtt

SEQ ID NO: 80187 - DNA, 13 bp, Unknown
  misc_feature (1)..( 13): Result.001 file - promoters70/1013128
agagaaaaaaaag

SEQ ID NO: 80188 - DNA, 13 bp, Unknown
  misc_feature (1)..( 13): Result.001 file - promoters70/1013128
agagaaaggaaga

SEQ ID NO: 80189 - DNA, 13 bp, Unknown
  misc_feature (1)..( 13): Result.001 file - promoters70/1013128
attttctcatttt

SEQ ID NO: 80190 - DNA, 13 bp, Unknown
  misc_feature (1)..( 13): Result.001 file - promoters70/1013128
tttttctaatttt

SEQ ID NO: 80191 - DNA, 14 bp, Unknown
  misc_feature (1)..( 14): Result.001 file - promoters70/1013128
gttcttcttctaac

SEQ ID NO: 80192 - DNA, 7 bp, Unknown
  misc_feature (1)..( 7): Result.001 file - promoters70/1013128
taaattg

SEQ ID NO: 80193 - DNA, 7 bp, Unknown
  misc_feature (1)..( 7): Result.001 file - promoters70/1013128
gaaattg

SEQ ID NO: 80194 - DNA, 7 bp, Unknown
  misc_feature (1)..( 7): Result.001 file - promoters70/1013128
gaagttg

SEQ ID NO: 80195 - DNA, 7 bp, Unknown
  misc_feature (1)..( 7): Result.001 file - promoters70/1013128
atataaa

SEQ ID NO: 80196 - DNA, 7 bp, Unknown
  misc_feature (1)..( 7): Result.001 file - promoters70/1013128
atataaa

SEQ ID NO: 80197 - DNA, 7 bp, Unknown
  misc_feature (1)..( 7): Result.001 file - promoters70/1013208
ctataaa

SEQ ID NO: 80198 - DNA, 11 bp, Unknown
  misc_feature (1)..( 11): Result.001 file - promoters70/1013208
attttaatctc

SEQ ID NO: 80199 - DNA, 11 bp, Unknown
  misc_feature (1)..( 11): Result.001 file - promoters70/1013208
tttttattcta

SEQ ID NO: 80200 - DNA, 11 bp, Unknown
  misc_feature (1)..( 11): Result.001 file - promoters70/1013208
attttagaaaa

SEQ ID NO: 80201 - DNA, 11 bp, Unknown
  misc_feature (1)..( 11): Result.001 file - promoters70/1013208
gttgtattcta

SEQ ID NO: 80202 - DNA, 11 bp, Unknown
  misc_feature (1)..( 11): Result.001 file - promoters70/1013208
tttttacggcg

SEQ ID NO: 80203 - DNA, 13 bp, Unknown
  misc_feature (1)..( 13): Result.001 file - promoters70/1013208
cttcttattgaat

SEQ ID NO: 80204 - DNA, 13 bp, Unknown
  misc_feature (1)..( 13): Result.001 file - promoters70/1013208
ttctatatagaac

SEQ ID NO: 80205 - DNA, 13 bp, Unknown
  misc_feature (1)..( 13): Result.001 file - promoters70/1013208
ccccctatgtagt

SEQ ID NO: 80206 - DNA, 13 bp, Unknown
  misc_feature (1)..( 13): Result.001 file - promoters70/1013208
cttcttttgtagt

SEQ ID NO: 80207 - DNA, 13 bp, Unknown
  misc_feature (1)..( 13): Result.001 file - promoters70/1013242
ctttttttttagt

SEQ ID NO: 80208 - DNA, 9 bp, Unknown
  misc_feature (1)..( 9): Result.001 file - promoters70/1013242
tctttgtaa

SEQ ID NO: 80209 - DNA, 9 bp, Unknown
  misc_feature (1)..( 9): Result.001 file - promoters70/1013242
tctttataa

SEQ ID NO: 80210 - DNA, 9 bp, Unknown
  misc_feature (1)..( 9): Result.001 file - promoters70/1013242
acattataa

SEQ ID NO: 80211 - DNA, 9 bp, Unknown
  misc_feature (1)..( 9): Result.001 file - promoters70/1013242
atgcttttt

SEQ ID NO: 80212 - DNA, 9 bp, Unknown
  misc_feature (1)..( 9): Result.001 file - promoters70/1013242
atgatttag

SEQ ID NO: 80213 - DNA, 9 bp, Unknown
  misc_feature (1)..( 9): Result.001 file - promoters70/1013242
tggatatag

SEQ ID NO: 80214 - DNA, 8 bp, Unknown
  misc_feature (1)..( 8): Result.001 file - promoters70/1013242
tctttctc

SEQ ID NO: 80215 - DNA, 8 bp, Unknown
  misc_feature (1)..( 8): Result.001 file - promoters70/1013242
tcttgctc

SEQ ID NO: 80216 - DNA, 8 bp, Unknown
  misc_feature (1)..( 8): Result.001 file - promoters70/1013242
tctgtctc

SEQ ID NO: 80217 - DNA, 9 bp, Unknown
  misc_feature (1)..( 9): Result.001 file - promoters70/1013242
aaaaacata

SEQ ID NO: 80218 - DNA, 9 bp, Unknown
  misc_feature (1)..( 9): Result.001 file - promoters70/1013242
aaaaaaata

SEQ ID NO: 80219 - DNA, 9 bp, Unknown
  misc_feature (1)..( 9): Result.001 file - promoters70/1013314
taaaacatt

SEQ ID NO: 80220 - DNA, 12 bp, Unknown
  misc_feature (1)..( 12): Result.001 file - promoters70/1013314
gaaaatacaaat

SEQ ID NO: 80221 - DNA, 12 bp, Unknown
  misc_feature (1)..( 12): Result.001 file - promoters70/1013314
taaaatataaat

SEQ ID NO: 80222 - DNA, 12 bp, Unknown
  misc_feature (1)..( 12): Result.001 file - promoters70/1013314
taaaatgcacgt

SEQ ID NO: 80223 - DNA, 11 bp, Unknown
  misc_feature (1)..( 11): Result.001 file - promoters70/1013314
atatttttatg

SEQ ID NO: 80224 - DNA, 11 bp, Unknown
  misc_feature (1)..( 11): Result.001 file - promoters70/1013314
gaaattttatg

SEQ ID NO: 80225 - DNA, 11 bp, Unknown
  misc_feature (1)..( 11): Result.001 file - promoters70/1013314
atatttttata

SEQ ID NO: 80226 - DNA, 8 bp, Unknown
  misc_feature (1)..( 8): Result.001 file - promoters70/1013314
tcaaaaga

SEQ ID NO: 80227 - DNA, 8 bp, Unknown
  misc_feature (1)..( 8): Result.001 file - promoters70/1013314
acaaaaga

SEQ ID NO: 80228 - DNA, 8 bp, Unknown
  misc_feature (1)..( 8): Result.001 file - promoters70/1013314
tcaaaaaa

SEQ ID NO: 80229 - DNA, 9 bp, Unknown
  misc_feature (1)..( 9): Result.001 file - promoters70/1013314
taaaatttg

SEQ ID NO: 80230 - DNA, 9 bp, Unknown
  misc_feature (1)..( 9): Result.001 file - promoters70/1013314
aaaacttta

SEQ ID NO: 80231 - DNA, 9 bp, Unknown
  misc_feature (1)..( 9): Result.001 file - promoters70/1013314
aaaacgtta

SEQ ID NO: 80232 - DNA, 9 bp, Unknown
  misc_feature (1)..( 9): Result.001 file - promoters70/1013314
aattaaatg

SEQ ID NO: 80233 - DNA, 9 bp, Unknown
  misc_feature (1)..( 9): Result.001 file - promoters70/1013314
aattaataa

SEQ ID NO: 80234 - DNA, 9 bp, Unknown
  misc_feature (1)..( 9): Result.001 file - promoters70/1013314
gattaaatg

SEQ ID NO: 80235 - DNA, 11 bp, Unknown
  misc_feature (1)..( 11): Result.001 file - promoters70/1013314
aaaagatttat

SEQ ID NO: 80236 - DNA, 11 bp, Unknown
  misc_feature (1)..( 11): Result.001 file - promoters70/1013314
aaagaatttat

SEQ ID NO: 80237 - DNA, 11 bp, Unknown
  misc_feature (1)..( 11): Result.001 file - promoters70/1013314
aaagactttag

SEQ ID NO: 80238 - DNA, 10 bp, Unknown
  misc_feature (1)..( 10): Result.001 file - promoters70/1013314
acattgtcca

SEQ ID NO: 80239 - DNA, 10 bp, Unknown
  misc_feature (1)..( 10): Result.001 file - promoters70/1013314
taattatcca

SEQ ID NO: 80240 - DNA, 10 bp, Unknown
  misc_feature (1)..( 10): Result.001 file - promoters70/1013314
taaatatttt

SEQ ID NO: 80241 - DNA, 8 bp, Unknown
  misc_feature (1)..( 8): Result.001 file - promoters70/1013314
tccaaatt

SEQ ID NO: 80242 - DNA, 8 bp, Unknown
  misc_feature (1)..( 8): Result.001 file - promoters70/1013314
tccaaata

SEQ ID NO: 80243 - DNA, 8 bp, Unknown
  misc_feature (1)..( 8): Result.001 file - promoters70/1013384
gacaaata

SEQ ID NO: 80244 - DNA, 8 bp, Unknown
  misc_feature (1)..( 8): Result.001 file - promoters70/1013384
aaaacaga

SEQ ID NO: 80245 - DNA, 8 bp, Unknown
  misc_feature (1)..( 8): Result.001 file - promoters70/1013384
aaaacagt

SEQ ID NO: 80246 - DNA, 8 bp, Unknown
  misc_feature (1)..( 8): Result.001 file - promoters70/1013540
aacacaaa

SEQ ID NO: 80247 - DNA, 14 bp, Unknown
  misc_feature (1)..( 14): Result.001 file - promoters70/1013540
aatctcgaaaccag

SEQ ID NO: 80248 - DNA, 14 bp, Unknown
  misc_feature (1)..( 14): Result.001 file - promoters70/1013540
aatctcaaaacatt

SEQ ID NO: 80249 - DNA, 14 bp, Unknown
  misc_feature (1)..( 14): Result.001 file - promoters70/1013540
atcttcaaaattat

SEQ ID NO: 80250 - DNA, 14 bp, Unknown
  misc_feature (1)..( 14): Result.001 file - promoters70/1013540
ctccacaaacttat

SEQ ID NO: 80251 - DNA, 8 bp, Unknown
  misc_feature (1)..( 8): Result.001 file - promoters70/1013540
tatcacac

SEQ ID NO: 80252 - DNA, 8 bp, Unknown
  misc_feature (1)..( 8): Result.001 file - promoters70/1013540
gctcacac

SEQ ID NO: 80253 - DNA, 8 bp, Unknown
  misc_feature (1)..( 8): Result.001 file - promoters70/1013540
cctcacac

SEQ ID NO: 80254 - DNA, 8 bp, Unknown
  misc_feature (1)..( 8): Result.001 file - promoters70/1013690
cctaacag

SEQ ID NO: 80255 - DNA, 11 bp, Unknown
  misc_feature (1)..( 11): Result.001 file - promoters70/1013690
taagaggtata

SEQ ID NO: 80256 - DNA, 11 bp, Unknown
  misc_feature (1)..( 11): Result.001 file - promoters70/1013690
taacaggtacg

SEQ ID NO: 80257 - DNA, 11 bp, Unknown
  misc_feature (1)..( 11): Result.001 file - promoters70/1013786
gtggaggtata

SEQ ID NO: 80258 - DNA, 11 bp, Unknown
  misc_feature (1)..( 11): Result.001 file - promoters70/1013786
agtttaggccg

SEQ ID NO: 80259 - DNA, 11 bp, Unknown
  misc_feature (1)..( 11): Result.001 file - promoters70/1013786
agtctagtaac

SEQ ID NO: 80260 - DNA, 11 bp, Unknown
  misc_feature (1)..( 11): Result.001 file - promoters70/1013786
agtttaacgaa

SEQ ID NO: 80261 - DNA, 11 bp, Unknown
  misc_feature (1)..( 11): Result.001 file - promoters70/1013786
tttctaggaac

SEQ ID NO: 80262 - DNA, 8 bp, Unknown
  misc_feature (1)..( 8): Result.001 file - promoters70/1013786
caaaatta

SEQ ID NO: 80263 - DNA, 8 bp, Unknown
  misc_feature (1)..( 8): Result.001 file - promoters70/1013786
aaaaattt

SEQ ID NO: 80264 - DNA, 9 bp, Unknown
  misc_feature (1)..( 9): Result.001 file - promoters70/1013786
aaaaactta

SEQ ID NO: 80265 - DNA, 9 bp, Unknown
  misc_feature (1)..( 9): Result.001 file - promoters70/1013786
ctaaacttc

SEQ ID NO: 80266 - DNA, 9 bp, Unknown
  misc_feature (1)..( 9): Result.001 file - promoters70/1013786
tatatatag

SEQ ID NO: 80267 - DNA, 9 bp, Unknown
  misc_feature (1)..( 9): Result.001 file - promoters70/1013786
tatataaat

SEQ ID NO: 80268 - DNA, 9 bp, Unknown
  misc_feature (1)..( 9): Result.001 file - promoters70/1013786
tataaatat

SEQ ID NO: 80269 - DNA, 9 bp, Unknown
  misc_feature (1)..( 9): Result.001 file - promoters70/1013786
tatacaaat

SEQ ID NO: 80270 - DNA, 12 bp, Unknown
  misc_feature (1)..( 12): Result.001 file - promoters70/1013786
aaaaatttaatt

SEQ ID NO: 80271 - DNA, 12 bp, Unknown
  misc_feature (1)..( 12): Result.001 file - promoters70/1013786
actaatttaatt

SEQ ID NO: 80272 - DNA, 12 bp, Unknown
  misc_feature (1)..( 12): Result.001 file - promoters70/1013786
aaaaacttacca

SEQ ID NO: 80273 - DNA, 12 bp, Unknown
  misc_feature (1)..( 12): Result.001 file - promoters70/1013904
cagattttaata

SEQ ID NO: 80274 - DNA, 9 bp, Unknown
  misc_feature (1)..( 9): Result.001 file - promoters70/1013904
ttagtaatt

SEQ ID NO: 80275 - DNA, 9 bp, Unknown
  misc_feature (1)..( 9): Result.001 file - promoters70/1013904
ttactaaca

SEQ ID NO: 80276 - DNA, 9 bp, Unknown
  misc_feature (1)..( 9): Result.001 file - promoters70/1013904
ttagtgatt

SEQ ID NO: 80277 - DNA, 8 bp, Unknown
  misc_feature (1)..( 8): Result.001 file - promoters70/1013904
atttatat

SEQ ID NO: 80278 - DNA, 8 bp, Unknown
  misc_feature (1)..( 8): Result.001 file - promoters70/1013904
aattatat

SEQ ID NO: 80279 - DNA, 8 bp, Unknown
  misc_feature (1)..( 8): Result.001 file - promoters70/1013904
aattgtat

SEQ ID NO: 80280 - DNA, 10 bp, Unknown
  misc_feature (1)..( 10): Result.001 file - promoters70/1013904
tgataaaatt

SEQ ID NO: 80281 - DNA, 10 bp, Unknown
  misc_feature (1)..( 10): Result.001 file - promoters70/1013904
tgatcaaatc

SEQ ID NO: 80282 - DNA, 10 bp, Unknown
  misc_feature (1)..( 10): Result.001 file - promoters70/1013904
ttataatatt

SEQ ID NO: 80283 - DNA, 7 bp, Unknown
  misc_feature (1)..( 7): Result.001 file - promoters70/1013904
gataaaa

SEQ ID NO: 80284 - DNA, 7 bp, Unknown
  misc_feature (1)..( 7): Result.001 file - promoters70/1013904
aataaaa

SEQ ID NO: 80285 - DNA, 7 bp, Unknown
  misc_feature (1)..( 7): Result.001 file - promoters70/1013904
aataaac

SEQ ID NO: 80286 - DNA, 8 bp, Unknown
  misc_feature (1)..( 8): Result.001 file - promoters70/1013904
gtttaggc

SEQ ID NO: 80287 - DNA, 8 bp, Unknown
  misc_feature (1)..( 8): Result.001 file - promoters70/1013904
gtttaggt

SEQ ID NO: 80288 - DNA, 8 bp, Unknown
  misc_feature (1)..( 8): Result.001 file - promoters70/1013904
tttttggt

SEQ ID NO: 80289 - DNA, 11 bp, Unknown
  misc_feature (1)..( 11): Result.001 file - promoters70/1013904
aagaaataaat

SEQ ID NO: 80290 - DNA, 11 bp, Unknown
  misc_feature (1)..( 11): Result.001 file - promoters70/1013904
aagaaaaaaat

SEQ ID NO: 80291 - DNA, 11 bp, Unknown
  misc_feature (1)..( 11): Result.001 file - promoters70/1013904
ctaaaataata

SEQ ID NO: 80292 - DNA, 8 bp, Unknown
  misc_feature (1)..( 8): Result.001 file - promoters70/1013904
ttaatata

SEQ ID NO: 80293 - DNA, 8 bp, Unknown
  misc_feature (1)..( 8): Result.001 file - promoters70/1013904
ttaataat

SEQ ID NO: 80294 - DNA, 8 bp, Unknown
  misc_feature (1)..( 8): Result.001 file - promoters70/1013904
ctaaaaat

SEQ ID NO: 80295 - DNA, 7 bp, Unknown
  misc_feature (1)..( 7): Result.001 file - promoters70/1013904
aaataat

SEQ ID NO: 80296 - DNA, 7 bp, Unknown
  misc_feature (1)..( 7): Result.001 file - promoters70/1013904
taataat

SEQ ID NO: 80297 - DNA, 7 bp, Unknown
  misc_feature (1)..( 7): Result.001 file - promoters70/1013904
taaaaat

SEQ ID NO: 80298 - DNA, 8 bp, Unknown
  misc_feature (1)..( 8): Result.001 file - promoters70/1013904
ttatattt

SEQ ID NO: 80299 - DNA, 8 bp, Unknown
  misc_feature (1)..( 8): Result.001 file - promoters70/1013904
caatattt

SEQ ID NO: 80300 - DNA, 8 bp, Unknown
  misc_feature (1)..( 8): Result.001 file - promoters70/1013904
caaaatta

SEQ ID NO: 80301 - DNA, 7 bp, Unknown
  misc_feature (1)..( 7): Result.001 file - promoters70/1013904
tttatat

SEQ ID NO: 80302 - DNA, 7 bp, Unknown
  misc_feature (1)..( 7): Result.001 file - promoters70/1013904
tttatat

SEQ ID NO: 80303 - DNA, 7 bp, Unknown
  misc_feature (1)..( 7): Result.001 file - promoters70/1014010
attatat

SEQ ID NO: 80304 - DNA, 7 bp, Unknown
  misc_feature (1)..( 7): Result.001 file - promoters70/1014010
aattaaa

SEQ ID NO: 80305 - DNA, 7 bp, Unknown
  misc_feature (1)..( 7): Result.001 file - promoters70/1014010
tattaaa

SEQ ID NO: 80306 - DNA, 7 bp, Unknown
  misc_feature (1)..( 7): Result.001 file - promoters70/1014050
tataaaa

SEQ ID NO: 80307 - DNA, 12 bp, Unknown
  misc_feature (1)..( 12): Result.001 file - promoters70/1014050
aaaaaagttttt

SEQ ID NO: 80308 - DNA, 12 bp, Unknown
  misc_feature (1)..( 12): Result.001 file - promoters70/1014050
actttagttttg

SEQ ID NO: 80309 - DNA, 12 bp, Unknown
  misc_feature (1)..( 12): Result.001 file - promoters70/1014050
actagggttttt

SEQ ID NO: 80310 - DNA, 12 bp, Unknown
  misc_feature (1)..( 12): Result.001 file - promoters70/1014050
aaaatagtttac

SEQ ID NO: 80311 - DNA, 13 bp, Unknown
  misc_feature (1)..( 13): Result.001 file - promoters70/1014050
ttgaacgttgttg

SEQ ID NO: 80312 - DNA, 13 bp, Unknown
  misc_feature (1)..( 13): Result.001 file - promoters70/1014125
aaaaaagtgttga

SEQ ID NO: 80313 - DNA, 11 bp, Unknown
  misc_feature (1)..( 11): Result.001 file - promoters70/1014125
aaactgtgaaa

SEQ ID NO: 80314 - DNA, 11 bp, Unknown
  misc_feature (1)..( 11): Result.001 file - promoters70/1014125
aaaatgtgaaa

SEQ ID NO: 80315 - DNA, 11 bp, Unknown
  misc_feature (1)..( 11): Result.001 file - promoters70/1014125
aaaataatttt

SEQ ID NO: 80316 - DNA, 11 bp, Unknown
  misc_feature (1)..( 11): Result.001 file - promoters70/1014125
ccaaatttggt

SEQ ID NO: 80317 - DNA, 11 bp, Unknown
  misc_feature (1)..( 11): Result.001 file - promoters70/1014125
ccaattttaag

SEQ ID NO: 80318 - DNA, 11 bp, Unknown
  misc_feature (1)..( 11): Result.001 file - promoters70/1014176
attattctaag

SEQ ID NO: 80319 - DNA, 11 bp, Unknown
  misc_feature (1)..( 11): Result.001 file - promoters70/1014176
attctattttt

SEQ ID NO: 80320 - DNA, 11 bp, Unknown
  misc_feature (1)..( 11): Result.001 file - promoters70/1014176
attctaatttt

SEQ ID NO: 80321 - DNA, 11 bp, Unknown
  misc_feature (1)..( 11): Result.001 file - promoters70/1014180
attctacataa

SEQ ID NO: 80322 - DNA, 8 bp, Unknown
  misc_feature (1)..( 8): Result.001 file - promoters70/1014180
tcagtttc

SEQ ID NO: 80323 - DNA, 8 bp, Unknown
  misc_feature (1)..( 8): Result.001 file - promoters70/1014180
tcaatttt

SEQ ID NO: 80324 - DNA, 8 bp, Unknown
  misc_feature (1)..( 8): Result.001 file - promoters70/1014180
ctaatttt

SEQ ID NO: 80325 - DNA, 7 bp, Unknown
  misc_feature (1)..( 7): Result.001 file - promoters70/1014180
caaaatt

SEQ ID NO: 80326 - DNA, 7 bp, Unknown
  misc_feature (1)..( 7): Result.001 file - promoters70/1014180
caatatt

SEQ ID NO: 80327 - DNA, 7 bp, Unknown
  misc_feature (1)..( 7): Result.001 file - promoters70/1014452
caatatg

SEQ ID NO: 80328 - DNA, 10 bp, Unknown
  misc_feature (1)..( 10): Result.001 file - promoters70/1014452
aacatttcat

SEQ ID NO: 80329 - DNA, 10 bp, Unknown
  misc_feature (1)..( 10): Result.001 file - promoters70/1014452
aacattaata

SEQ ID NO: 80330 - DNA, 10 bp, Unknown
  misc_feature (1)..( 10): Result.001 file - promoters70/1014452
gacaataata

SEQ ID NO: 80331 - DNA, 8 bp, Unknown
  misc_feature (1)..( 8): Result.001 file - promoters70/1014452
tataaata

SEQ ID NO: 80332 - DNA, 8 bp, Unknown
  misc_feature (1)..( 8): Result.001 file - promoters70/1014452
tataaata

SEQ ID NO: 80333 - DNA, 8 bp, Unknown
  misc_feature (1)..( 8): Result.001 file - promoters70/1014525
tataaaaa

SEQ ID NO: 80334 - DNA, 7 bp, Unknown
  misc_feature (1)..( 7): Result.001 file - promoters70/1014525
aaaaata

SEQ ID NO: 80335 - DNA, 7 bp, Unknown
  misc_feature (1)..( 7): Result.001 file - promoters70/1014525
aaacata

SEQ ID NO: 80336 - DNA, 7 bp, Unknown
  misc_feature (1)..( 7): Result.001 file - promoters70/1014525
aaaaatt

SEQ ID NO: 80337 - DNA, 8 bp, Unknown
  misc_feature (1)..( 8): Result.001 file - promoters70/1014525
aattaaaa

SEQ ID NO: 80338 - DNA, 8 bp, Unknown
  misc_feature (1)..( 8): Result.001 file - promoters70/1014525
aatgaaaa

SEQ ID NO: 80339 - DNA, 8 bp, Unknown
  misc_feature (1)..( 8): Result.001 file - promoters70/1014525
aatcaaat

SEQ ID NO: 80340 - DNA, 9 bp, Unknown
  misc_feature (1)..( 9): Result.001 file - promoters70/1014525
tatatatag

SEQ ID NO: 80341 - DNA, 9 bp, Unknown
  misc_feature (1)..( 9): Result.001 file - promoters70/1014525
tatatatac

SEQ ID NO: 80342 - DNA, 9 bp, Unknown
  misc_feature (1)..( 9): Result.001 file - promoters70/1014641
tatttatac

SEQ ID NO: 80343 - DNA, 8 bp, Unknown
  misc_feature (1)..( 8): Result.001 file - promoters70/1014641
ttttgttt

SEQ ID NO: 80344 - DNA, 8 bp, Unknown
  misc_feature (1)..( 8): Result.001 file - promoters70/1014641
ttttattt

SEQ ID NO: 80345 - DNA, 8 bp, Unknown
  misc_feature (1)..( 8): Result.001 file - promoters70/1014641
ttttgtag

SEQ ID NO: 80346 - DNA, 8 bp, Unknown
  misc_feature (1)..( 8): Result.001 file - promoters70/1014641
gtttttca

SEQ ID NO: 80347 - DNA, 8 bp, Unknown
  misc_feature (1)..( 8): Result.001 file - promoters70/1014641
gttcttct

SEQ ID NO: 80348 - DNA, 8 bp, Unknown
  misc_feature (1)..( 8): Result.001 file - promoters70/1014662
tttcttct

SEQ ID NO: 80349 - DNA, 9 bp, Unknown
  misc_feature (1)..( 9): Result.001 file - promoters70/1014662
aaaaatgaa

SEQ ID NO: 80350 - DNA, 9 bp, Unknown
  misc_feature (1)..( 9): Result.001 file - promoters70/1014662
aaaaaagaa

SEQ ID NO: 80351 - DNA, 9 bp, Unknown
  misc_feature (1)..( 9): Result.001 file - promoters70/1014662
gaaaaaggg

SEQ ID NO: 80352 - DNA, 8 bp, Unknown
  misc_feature (1)..( 8): Result.001 file - promoters70/1014662
ttttatca

SEQ ID NO: 80353 - DNA, 8 bp, Unknown
  misc_feature (1)..( 8): Result.001 file - promoters70/1014662
ttttgtca

SEQ ID NO: 80354 - DNA, 8 bp, Unknown
  misc_feature (1)..( 8): Result.001 file - promoters70/1014662
ttttgtat

SEQ ID NO: 80355 - DNA, 8 bp, Unknown
  misc_feature (1)..( 8): Result.001 file - promoters70/1014662
atatatat

SEQ ID NO: 80356 - DNA, 8 bp, Unknown
  misc_feature (1)..( 8): Result.001 file - promoters70/1014662
atatttat

SEQ ID NO: 80357 - DNA, 8 bp, Unknown
  misc_feature (1)..( 8): Result.001 file - promoters70/1014662
caatttat

SEQ ID NO: 80358 - DNA, 8 bp, Unknown
  misc_feature (1)..( 8): Result.001 file - promoters70/1014662
taatttat

SEQ ID NO: 80359 - DNA, 8 bp, Unknown
  misc_feature (1)..( 8): Result.001 file - promoters70/1014662
aatcaaaa

SEQ ID NO: 80360 - DNA, 8 bp, Unknown
  misc_feature (1)..( 8): Result.001 file - promoters70/1014662
aatcaaat

SEQ ID NO: 80361 - DNA, 9 bp, Unknown
  misc_feature (1)..( 9): Result.001 file - promoters70/1014662
gatccaaac

SEQ ID NO: 80362 - DNA, 9 bp, Unknown
  misc_feature (1)..( 9): Result.001 file - promoters70/1014662
tatcctaac

SEQ ID NO: 80363 - DNA, 11 bp, Unknown
  misc_feature (1)..( 11): Result.001 file - promoters70/1014662
ctagacacgta

SEQ ID NO: 80364 - DNA, 11 bp, Unknown
  misc_feature (1)..( 11): Result.001 file - promoters70/1014662
atcaacacgta

SEQ ID NO: 80365 - DNA, 11 bp, Unknown
  misc_feature (1)..( 11): Result.001 file - promoters70/1014662
aaagagacgaa

SEQ ID NO: 80366 - DNA, 11 bp, Unknown
  misc_feature (1)..( 11): Result.001 file - promoters70/1014662
aaaaagaatac

SEQ ID NO: 80367 - DNA, 7 bp, Unknown
  misc_feature (1)..( 7): Result.001 file - promoters70/1014662
actatac

SEQ ID NO: 80368 - DNA, 7 bp, Unknown
  misc_feature (1)..( 7): Result.001 file - promoters70/1014662
actttac

SEQ ID NO: 80369 - DNA, 7 bp, Unknown
  misc_feature (1)..( 7): Result.001 file - promoters70/1014662
tctttac

SEQ ID NO: 80370 - DNA, 8 bp, Unknown
  misc_feature (1)..( 8): Result.001 file - promoters70/1014662
atataata

SEQ ID NO: 80371 - DNA, 8 bp, Unknown
  misc_feature (1)..( 8): Result.001 file - promoters70/1014662
ttattata

SEQ ID NO: 80372 - DNA, 8 bp, Unknown
  misc_feature (1)..( 8): Result.001 file - promoters70/1014662
atataatt

SEQ ID NO: 80373 - DNA, 8 bp, Unknown
  misc_feature (1)..( 8): Result.001 file - promoters70/1014662
atataata

SEQ ID NO: 80374 - DNA, 9 bp, Unknown
  misc_feature (1)..( 9): Result.001 file - promoters70/1014662
tttgttggt

SEQ ID NO: 80375 - DNA, 9 bp, Unknown
  misc_feature (1)..( 9): Result.001 file - promoters70/1014662
tttattgat

SEQ ID NO: 80376 - DNA, 9 bp, Unknown
  misc_feature (1)..( 9): Result.001 file - promoters70/1014662
gttactgat

SEQ ID NO: 80377 - DNA, 11 bp, Unknown
  misc_feature (1)..( 11): Result.001 file - promoters70/1014662
agaaattaata

SEQ ID NO: 80378 - DNA, 11 bp, Unknown
  misc_feature (1)..( 11): Result.001 file - promoters70/1014662
taaaatcaata

SEQ ID NO: 80379 - DNA, 12 bp, Unknown
  misc_feature (1)..( 12): Result.001 file - promoters70/1014662
ataacatcactt

SEQ ID NO: 80380 - DNA, 12 bp, Unknown
  misc_feature (1)..( 12): Result.001 file - promoters70/1014662
ctatcaaaactt

SEQ ID NO: 80381 - DNA, 12 bp, Unknown
  misc_feature (1)..( 12): Result.001 file - promoters70/1014662
ctaacaaacaat

SEQ ID NO: 80382 - DNA, 12 bp, Unknown
  misc_feature (1)..( 12): Result.001 file - promoters70/1014885
ggctcaaagctt

SEQ ID NO: 80383 - DNA, 6 bp, Unknown
  misc_feature (1)..( 6): Result.001 file - promoters70/1014885
ttaaaa

SEQ ID NO: 80384 - DNA, 6 bp, Unknown
  misc_feature (1)..( 6): Result.001 file - promoters70/1014885
ttaaaa

SEQ ID NO: 80385 - DNA, 6 bp, Unknown
  misc_feature (1)..( 6): Result.001 file - promoters70/1014885
ttaaaa

SEQ ID NO: 80386 - DNA, 7 bp, Unknown
  misc_feature (1)..( 7): Result.001 file - promoters70/1014885
taaaagt

SEQ ID NO: 80387 - DNA, 7 bp, Unknown
  misc_feature (1)..( 7): Result.001 file - promoters70/1014885
aaaaagt

SEQ ID NO: 80388 - DNA, 7 bp, Unknown
  misc_feature (1)..( 7): Result.001 file - promoters70/1015030
aaaaagg

SEQ ID NO: 80389 - DNA, 10 bp, Unknown
  misc_feature (1)..( 10): Result.001 file - promoters70/1015030
ttttgagcta

SEQ ID NO: 80390 - DNA, 10 bp, Unknown
  misc_feature (1)..( 10): Result.001 file - promoters70/1015030
ttttgacttg

SEQ ID NO: 80391 - DNA, 10 bp, Unknown
  misc_feature (1)..( 10): Result.001 file - promoters70/1015030
ttttgatcta

SEQ ID NO: 80392 - DNA, 7 bp, Unknown
  misc_feature (1)..( 7): Result.001 file - promoters70/1015030
tctttag

SEQ ID NO: 80393 - DNA, 7 bp, Unknown
  misc_feature (1)..( 7): Result.001 file - promoters70/1015030
tctttag

SEQ ID NO: 80394 - DNA, 7 bp, Unknown
  misc_feature (1)..( 7): Result.001 file - promoters70/1015030
ttttgag

SEQ ID NO: 80395 - DNA, 11 bp, Unknown
  misc_feature (1)..( 11): Result.001 file - promoters70/1015030
tttatatcgtg

SEQ ID NO: 80396 - DNA, 11 bp, Unknown
  misc_feature (1)..( 11): Result.001 file - promoters70/1015030
cttatctcgtg

SEQ ID NO: 80397 - DNA, 11 bp, Unknown
  misc_feature (1)..( 11): Result.001 file - promoters70/1015214
cttttctttct

SEQ ID NO: 80398 - DNA, 8 bp, Unknown
  misc_feature (1)..( 8): Result.001 file - promoters70/1015214
aaaacaaa

SEQ ID NO: 80399 - DNA, 8 bp, Unknown
  misc_feature (1)..( 8): Result.001 file - promoters70/1015214
gaaagaaa

SEQ ID NO: 80400 - DNA, 8 bp, Unknown
  misc_feature (1)..( 8): Result.001 file - promoters70/1015214
aaaacatt

SEQ ID NO: 80401 - DNA, 8 bp, Unknown
  misc_feature (1)..( 8): Result.001 file - promoters70/1015214
gaatgaaa

SEQ ID NO: 80402 - DNA, 11 bp, Unknown
  misc_feature (1)..( 11): Result.001 file - promoters70/1015214
tatgtaaacgt

SEQ ID NO: 80403 - DNA, 11 bp, Unknown
  misc_feature (1)..( 11): Result.001 file - promoters70/1015214
tatttaaaaag

SEQ ID NO: 80404 - DNA, 11 bp, Unknown
  misc_feature (1)..( 11): Result.001 file - promoters70/1015214
tatctaagacc

SEQ ID NO: 80405 - DNA, 11 bp, Unknown
  misc_feature (1)..( 11): Result.001 file - promoters70/1015214
gcattaaaata

SEQ ID NO: 80406 - DNA, 12 bp, Unknown
  misc_feature (1)..( 12): Result.001 file - promoters70/1015214
attttagaaaga

SEQ ID NO: 80407 - DNA, 10 bp, Unknown
  misc_feature (1)..( 10): Result.001 file - promoters70/1015214
cctaaaaaat

SEQ ID NO: 80408 - DNA, 10 bp, Unknown
  misc_feature (1)..( 10): Result.001 file - promoters70/1015214
tttaaaaaga

SEQ ID NO: 80409 - DNA, 10 bp, Unknown
  misc_feature (1)..( 10): Result.001 file - promoters70/1015214
attaaaatat

SEQ ID NO: 80410 - DNA, 10 bp, Unknown
  misc_feature (1)..( 10): Result.001 file - promoters70/1015337
tttagaaaga

SEQ ID NO: 80411 - DNA, 12 bp, Unknown
  misc_feature (1)..( 12): Result.001 file - promoters70/1015337
tactaaatttta

SEQ ID NO: 80412 - DNA, 12 bp, Unknown
  misc_feature (1)..( 12): Result.001 file - promoters70/1015337
cgttgaatctta

SEQ ID NO: 80413 - DNA, 12 bp, Unknown
  misc_feature (1)..( 12): Result.001 file - promoters70/1015337
taccaaatttaa

SEQ ID NO: 80414 - DNA, 8 bp, Unknown
  misc_feature (1)..( 8): Result.001 file - promoters70/1015337
atattagt

SEQ ID NO: 80415 - DNA, 8 bp, Unknown
  misc_feature (1)..( 8): Result.001 file - promoters70/1015337
atatgagt

SEQ ID NO: 80416 - DNA, 8 bp, Unknown
  misc_feature (1)..( 8): Result.001 file - promoters70/1015337
atatgatt

SEQ ID NO: 80417 - DNA, 6 bp, Unknown
  misc_feature (1)..( 6): Result.001 file - promoters70/1015337
attttt

SEQ ID NO: 80418 - DNA, 6 bp, Unknown
  misc_feature (1)..( 6): Result.001 file - promoters70/1015337
attttt

SEQ ID NO: 80419 - DNA, 6 bp, Unknown
  misc_feature (1)..( 6): Result.001 file - promoters70/1015337
attttt

SEQ ID NO: 80420 - DNA, 10 bp, Unknown
  misc_feature (1)..( 10): Result.001 file - promoters70/1015337
attaagattt

SEQ ID NO: 80421 - DNA, 10 bp, Unknown
  misc_feature (1)..( 10): Result.001 file - promoters70/1015337
agtaatattt

SEQ ID NO: 80422 - DNA, 10 bp, Unknown
  misc_feature (1)..( 10): Result.001 file - promoters70/1015475
agtgatatga

SEQ ID NO: 80423 - DNA, 9 bp, Unknown
  misc_feature (1)..( 9): Result.001 file - promoters70/1015475
gtttccttt

SEQ ID NO: 80424 - DNA, 9 bp, Unknown
  misc_feature (1)..( 9): Result.001 file - promoters70/1015475
gttaccttt

SEQ ID NO: 80425 - DNA, 9 bp, Unknown
  misc_feature (1)..( 9): Result.001 file - promoters70/1015524
gcttcgttt

SEQ ID NO: 80426 - DNA, 11 bp, Unknown
  misc_feature (1)..( 11): Result.001 file - promoters70/1015524
aaacgtgaaag

SEQ ID NO: 80427 - DNA, 11 bp, Unknown
  misc_feature (1)..( 11): Result.001 file - promoters70/1015524
tggattgaaag

SEQ ID NO: 80428 - DNA, 11 bp, Unknown
  misc_feature (1)..( 11): Result.001 file - promoters70/1015524
aaacgtaaaac

SEQ ID NO: 80429 - DNA, 8 bp, Unknown
  misc_feature (1)..( 8): Result.001 file - promoters70/1015524
agatatac

SEQ ID NO: 80430 - DNA, 8 bp, Unknown
  misc_feature (1)..( 8): Result.001 file - promoters70/1015524
ggatttac

SEQ ID NO: 80431 - DNA, 8 bp, Unknown
  misc_feature (1)..( 8): Result.001 file - promoters70/1015524
agaaatag

SEQ ID NO: 80432 - DNA, 9 bp, Unknown
  misc_feature (1)..( 9): Result.001 file - promoters70/1015524
ttgttttcg

SEQ ID NO: 80433 - DNA, 9 bp, Unknown
  misc_feature (1)..( 9): Result.001 file - promoters70/1015524
ttgtttctc

SEQ ID NO: 80434 - DNA, 9 bp, Unknown
  misc_feature (1)..( 9): Result.001 file - promoters70/1015848
atgtttctc

SEQ ID NO: 80435 - DNA, 9 bp, Unknown
  misc_feature (1)..( 9): Result.001 file - promoters70/1015848
gtttccttt

SEQ ID NO: 80436 - DNA, 9 bp, Unknown
  misc_feature (1)..( 9): Result.001 file - promoters70/1015848
gttaccttt

SEQ ID NO: 80437 - DNA, 9 bp, Unknown
  misc_feature (1)..( 9): Result.001 file - promoters70/1016056
gcttcgttt

SEQ ID NO: 80438 - DNA, 11 bp, Unknown
  misc_feature (1)..( 11): Result.001 file - promoters70/1016056
tatacaataaa

SEQ ID NO: 80439 - DNA, 11 bp, Unknown
  misc_feature (1)..( 11): Result.001 file - promoters70/1016056
aataaaataaa

SEQ ID NO: 80440 - DNA, 11 bp, Unknown
  misc_feature (1)..( 11): Result.001 file - promoters70/1016056
aatgaaatatc

SEQ ID NO: 80441 - DNA, 11 bp, Unknown
  misc_feature (1)..( 11): Result.001 file - promoters70/1016056
aataaaatctt

SEQ ID NO: 80442 - DNA, 11 bp, Unknown
  misc_feature (1)..( 11): Result.001 file - promoters70/1016056
aataaaggggt

SEQ ID NO: 80443 - DNA, 11 bp, Unknown
  misc_feature (1)..( 11): Result.001 file - promoters70/1016176
aataaaaactt

SEQ ID NO: 80444 - DNA, 13 bp, Unknown
  misc_feature (1)..( 13): Result.001 file - promoters70/1016176
ttagttataaatc

SEQ ID NO: 80445 - DNA, 13 bp, Unknown
  misc_feature (1)..( 13): Result.001 file - promoters70/1016176
aaagttatgaatc

SEQ ID NO: 80446 - DNA, 13 bp, Unknown
  misc_feature (1)..( 13): Result.001 file - promoters70/1016176
tatgttatttatt

SEQ ID NO: 80447 - DNA, 13 bp, Unknown
  misc_feature (1)..( 13): Result.001 file - promoters70/1016176
gggaaaatgaatt

SEQ ID NO: 80448 - DNA, 13 bp, Unknown
  misc_feature (1)..( 13): Result.001 file - promoters70/1016176
aaaattagcagtc

SEQ ID NO: 80449 - DNA, 13 bp, Unknown
  misc_feature (1)..( 13): Result.001 file - promoters70/1016176
aagattataaatc

SEQ ID NO: 80450 - DNA, 13 bp, Unknown
  misc_feature (1)..( 13): Result.001 file - promoters70/1016176
tacattgtaagtg

SEQ ID NO: 80451 - DNA, 13 bp, Unknown
  misc_feature (1)..( 13): Result.001 file - promoters70/1016176
gaatttattttcc

SEQ ID NO: 80452 - DNA, 14 bp, Unknown
  misc_feature (1)..( 14): Result.001 file - promoters70/1016176
gtacataaaacaaa

SEQ ID NO: 80453 - DNA, 14 bp, Unknown
  misc_feature (1)..( 14): Result.001 file - promoters70/1016176
agctataagacagt

SEQ ID NO: 80454 - DNA, 14 bp, Unknown
  misc_feature (1)..( 14): Result.001 file - promoters70/1016176
gttactaaaagttt

SEQ ID NO: 80455 - DNA, 14 bp, Unknown
  misc_feature (1)..( 14): Result.001 file - promoters70/1016176
tttcccaaaagttt

SEQ ID NO: 80456 - DNA, 14 bp, Unknown
  misc_feature (1)..( 14): Result.001 file - promoters70/1016176
agaactaaactctg

SEQ ID NO: 80457 - DNA, 14 bp, Unknown
  misc_feature (1)..( 14): Result.001 file - promoters70/1016250
agatctaagcaact

SEQ ID NO: 80458 - DNA, 9 bp, Unknown
  misc_feature (1)..( 9): Result.001 file - promoters70/1016250
gttagattt

SEQ ID NO: 80459 - DNA, 9 bp, Unknown
  misc_feature (1)..( 9): Result.001 file - promoters70/1016250
gttaaattg

SEQ ID NO: 80460 - DNA, 9 bp, Unknown
  misc_feature (1)..( 9): Result.001 file - promoters70/1016250
ccaaaattg

SEQ ID NO: 80461 - DNA, 9 bp, Unknown
  misc_feature (1)..( 9): Result.001 file - promoters70/1016250
ttttgcata

SEQ ID NO: 80462 - DNA, 9 bp, Unknown
  misc_feature (1)..( 9): Result.001 file - promoters70/1016250
ttttacata

SEQ ID NO: 80463 - DNA, 9 bp, Unknown
  misc_feature (1)..( 9): Result.001 file - promoters70/1016250
tagtacata

SEQ ID NO: 80464 - DNA, 9 bp, Unknown
  misc_feature (1)..( 9): Result.001 file - promoters70/1016250
taattttgc

SEQ ID NO: 80465 - DNA, 9 bp, Unknown
  misc_feature (1)..( 9): Result.001 file - promoters70/1016250
taattttta

SEQ ID NO: 80466 - DNA, 9 bp, Unknown
  misc_feature (1)..( 9): Result.001 file - promoters70/1016250
tcattttta

SEQ ID NO: 80467 - DNA, 9 bp, Unknown
  misc_feature (1)..( 9): Result.001 file - promoters70/1016250
aactttttt

SEQ ID NO: 80468 - DNA, 9 bp, Unknown
  misc_feature (1)..( 9): Result.001 file - promoters70/1016250
atctttttt

SEQ ID NO: 80469 - DNA, 9 bp, Unknown
  misc_feature (1)..( 9): Result.001 file - promoters70/1016250
atctcttta

SEQ ID NO: 80470 - DNA, 11 bp, Unknown
  misc_feature (1)..( 11): Result.001 file - promoters70/1016250
aacagtaaaac

SEQ ID NO: 80471 - DNA, 11 bp, Unknown
  misc_feature (1)..( 11): Result.001 file - promoters70/1016250
aacattaaaaa

SEQ ID NO: 80472 - DNA, 12 bp, Unknown
  misc_feature (1)..( 12): Result.001 file - promoters70/1016250
gtaattagaaaa

SEQ ID NO: 80473 - DNA, 12 bp, Unknown
  misc_feature (1)..( 12): Result.001 file - promoters70/1016250
cattgcttcgta

SEQ ID NO: 80474 - DNA, 12 bp, Unknown
  misc_feature (1)..( 12): Result.001 file - promoters70/1016250
catttctttgta

SEQ ID NO: 80475 - DNA, 12 bp, Unknown
  misc_feature (1)..( 12): Result.001 file - promoters70/1016250
acttttttttta

SEQ ID NO: 80476 - DNA, 10 bp, Unknown
  misc_feature (1)..( 10): Result.001 file - promoters70/1016250
ttttgtaaat

SEQ ID NO: 80477 - DNA, 10 bp, Unknown
  misc_feature (1)..( 10): Result.001 file - promoters70/1016250
ttttataatc

SEQ ID NO: 80478 - DNA, 10 bp, Unknown
  misc_feature (1)..( 10): Result.001 file - promoters70/1016278
aaatgtaaat

SEQ ID NO: 80479 - DNA, 9 bp, Unknown
  misc_feature (1)..( 9): Result.001 file - promoters70/1016278
gggattttt

SEQ ID NO: 80480 - DNA, 9 bp, Unknown
  misc_feature (1)..( 9): Result.001 file - promoters70/1016278
gggttttta

SEQ ID NO: 80481 - DNA, 9 bp, Unknown
  misc_feature (1)..( 9): Result.001 file - promoters70/1016278
ttgattttt

SEQ ID NO: 80482 - DNA, 7 bp, Unknown
  misc_feature (1)..( 7): Result.001 file - promoters70/1016278
taattaa

SEQ ID NO: 80483 - DNA, 7 bp, Unknown
  misc_feature (1)..( 7): Result.001 file - promoters70/1016278
taattat

SEQ ID NO: 80484 - DNA, 7 bp, Unknown
  misc_feature (1)..( 7): Result.001 file - promoters70/1016418
taattat

SEQ ID NO: 80485 - DNA, 8 bp, Unknown
  misc_feature (1)..( 8): Result.001 file - promoters70/1016418
taattaat

SEQ ID NO: 80486 - DNA, 8 bp, Unknown
  misc_feature (1)..( 8): Result.001 file - promoters70/1016418
taatcaat

SEQ ID NO: 80487 - DNA, 8 bp, Unknown
  misc_feature (1)..( 8): Result.001 file - promoters70/1016418
atatcaat

SEQ ID NO: 80488 - DNA, 9 bp, Unknown
  misc_feature (1)..( 9): Result.001 file - promoters70/1016418
ttatttgga

SEQ ID NO: 80489 - DNA, 9 bp, Unknown
  misc_feature (1)..( 9): Result.001 file - promoters70/1016418
atatttgtt

SEQ ID NO: 80490 - DNA, 9 bp, Unknown
  misc_feature (1)..( 9): Result.001 file - promoters70/1016418
ttatgtgga

SEQ ID NO: 80491 - DNA, 7 bp, Unknown
  misc_feature (1)..( 7): Result.001 file - promoters70/1016418
tataaat

SEQ ID NO: 80492 - DNA, 7 bp, Unknown
  misc_feature (1)..( 7): Result.001 file - promoters70/1016418
tataaat

SEQ ID NO: 80493 - DNA, 7 bp, Unknown
  misc_feature (1)..( 7): Result.001 file - promoters70/1016418
tataaaa

SEQ ID NO: 80494 - DNA, 8 bp, Unknown
  misc_feature (1)..( 8): Result.001 file - promoters70/1016418
attgatga

SEQ ID NO: 80495 - DNA, 8 bp, Unknown
  misc_feature (1)..( 8): Result.001 file - promoters70/1016418
tttgttga

SEQ ID NO: 80496 - DNA, 8 bp, Unknown
  misc_feature (1)..( 8): Result.001 file - promoters70/1016418
gtttatgt

SEQ ID NO: 80497 - DNA, 6 bp, Unknown
  misc_feature (1)..( 6): Result.001 file - promoters70/1016418
agcaat

SEQ ID NO: 80498 - DNA, 6 bp, Unknown
  misc_feature (1)..( 6): Result.001 file - promoters70/1016418
agcaat

SEQ ID NO: 80499 - DNA, 6 bp, Unknown
  misc_feature (1)..( 6): Result.001 file - promoters70/1016468
agcaat

SEQ ID NO: 80500 - DNA, 9 bp, Unknown
  misc_feature (1)..( 9): Result.001 file - promoters70/1016468
ttgagttta

SEQ ID NO: 80501 - DNA, 9 bp, Unknown
  misc_feature (1)..( 9): Result.001 file - promoters70/1016468
ttgactttt

SEQ ID NO: 80502 - DNA, 9 bp, Unknown
  misc_feature (1)..( 9): Result.001 file - promoters70/1016468
ttgaatttt

SEQ ID NO: 80503 - DNA, 9 bp, Unknown
  misc_feature (1)..( 9): Result.001 file - promoters70/1016468
tctaatttt

SEQ ID NO: 80504 - DNA, 9 bp, Unknown
  misc_feature (1)..( 9): Result.001 file - promoters70/1016468
ttaactttg

SEQ ID NO: 80505 - DNA, 10 bp, Unknown
  misc_feature (1)..( 10): Result.001 file - promoters70/1016468
aaaaacaaac

SEQ ID NO: 80506 - DNA, 10 bp, Unknown
  misc_feature (1)..( 10): Result.001 file - promoters70/1016468
cggaacaaaa

SEQ ID NO: 80507 - DNA, 10 bp, Unknown
  misc_feature (1)..( 10): Result.001 file - promoters70/1016468
tttaaaaaaa

SEQ ID NO: 80508 - DNA, 10 bp, Unknown
  misc_feature (1)..( 10): Result.001 file - promoters70/1016468
tataagaaaa

SEQ ID NO: 80509 - DNA, 10 bp, Unknown
  misc_feature (1)..( 10): Result.001 file - promoters70/1016468
tatgagaaat

SEQ ID NO: 80510 - DNA, 8 bp, Unknown
  misc_feature (1)..( 8): Result.001 file - promoters70/1016468
aaataaaa

SEQ ID NO: 80511 - DNA, 8 bp, Unknown
  misc_feature (1)..( 8): Result.001 file - promoters70/1016468
ttataaaa

SEQ ID NO: 80512 - DNA, 8 bp, Unknown
  misc_feature (1)..( 8): Result.001 file - promoters70/1016468
aaataaag

SEQ ID NO: 80513 - DNA, 8 bp, Unknown
  misc_feature (1)..( 8): Result.001 file - promoters70/1016468
ttagaaaa

SEQ ID NO: 80514 - DNA, 8 bp, Unknown
  misc_feature (1)..( 8): Result.001 file - promoters70/1016468
aatgaaaa

SEQ ID NO: 80515 - DNA, 8 bp, Unknown
  misc_feature (1)..( 8): Result.001 file - promoters70/1016468
aatgaaat

SEQ ID NO: 80516 - DNA, 9 bp, Unknown
  misc_feature (1)..( 9): Result.001 file - promoters70/1016468
tatgagaaa

SEQ ID NO: 80517 - DNA, 9 bp, Unknown
  misc_feature (1)..( 9): Result.001 file - promoters70/1016468
tataagaaa

SEQ ID NO: 80518 - DNA, 13 bp, Unknown
  misc_feature (1)..( 13): Result.001 file - promoters70/1016468
atgaaaaacaaac

SEQ ID NO: 80519 - DNA, 13 bp, Unknown
  misc_feature (1)..( 13): Result.001 file - promoters70/1016468
aagaaaaaatagt

SEQ ID NO: 80520 - DNA, 13 bp, Unknown
  misc_feature (1)..( 13): Result.001 file - promoters70/1016468
atgagaaatcata

SEQ ID NO: 80521 - DNA, 14 bp, Unknown
  misc_feature (1)..( 14): Result.001 file - promoters70/1016468
cggaacaaaaccgt

SEQ ID NO: 80522 - DNA, 14 bp, Unknown
  misc_feature (1)..( 14): Result.001 file - promoters70/1016468
tataagaaaatata

SEQ ID NO: 80523 - DNA, 14 bp, Unknown
  misc_feature (1)..( 14): Result.001 file - promoters70/1016468
atattattagtagg

SEQ ID NO: 80524 - DNA, 14 bp, Unknown
  misc_feature (1)..( 14): Result.001 file - promoters70/1016468
atataattattttg

SEQ ID NO: 80525 - DNA, 14 bp, Unknown
  misc_feature (1)..( 14): Result.001 file - promoters70/1016468
ccttaattaccgat

SEQ ID NO: 80526 - DNA, 14 bp, Unknown
  misc_feature (1)..( 14): Result.001 file - promoters70/1016468
ttttaatgattttg

SEQ ID NO: 80527 - DNA, 10 bp, Unknown
  misc_feature (1)..( 10): Result.001 file - promoters70/1016468
attaaccttg

SEQ ID NO: 80528 - DNA, 10 bp, Unknown
  misc_feature (1)..( 10): Result.001 file - promoters70/1016468
gttaactttg

SEQ ID NO: 80529 - DNA, 10 bp, Unknown
  misc_feature (1)..( 10): Result.001 file - promoters70/1016468
gttaattttt

SEQ ID NO: 80530 - DNA, 10 bp, Unknown
  misc_feature (1)..( 10): Result.001 file - promoters70/1016468
tctaattttc

SEQ ID NO: 80531 - DNA, 10 bp, Unknown
  misc_feature (1)..( 10): Result.001 file - promoters70/1016468
attaacttat

SEQ ID NO: 80532 - DNA, 10 bp, Unknown
  misc_feature (1)..( 10): Result.001 file - promoters70/1016468
gttaattttt

SEQ ID NO: 80533 - DNA, 10 bp, Unknown
  misc_feature (1)..( 10): Result.001 file - promoters70/1016468
tctaattttc

SEQ ID NO: 80534 - DNA, 10 bp, Unknown
  misc_feature (1)..( 10): Result.001 file - promoters70/1016468
ttgaattttt

SEQ ID NO: 80535 - DNA, 10 bp, Unknown
  misc_feature (1)..( 10): Result.001 file - promoters70/1016771
gttaactttg

SEQ ID NO: 80536 - DNA, 11 bp, Unknown
  misc_feature (1)..( 11): Result.001 file - promoters70/1016771
gtaatcaatcc

SEQ ID NO: 80537 - DNA, 11 bp, Unknown
  misc_feature (1)..( 11): Result.001 file - promoters70/1016771
aaaatgaattc

SEQ ID NO: 80538 - DNA, 11 bp, Unknown
  misc_feature (1)..( 11): Result.001 file - promoters70/1016771
tgcatcaatgc

SEQ ID NO: 80539 - DNA, 11 bp, Unknown
  misc_feature (1)..( 11): Result.001 file - promoters70/1016771
aaaatgcatta

SEQ ID NO: 80540 - DNA, 11 bp, Unknown
  misc_feature (1)..( 11): Result.001 file - promoters70/1016771
cgtatgacttc

SEQ ID NO: 80541 - DNA, 11 bp, Unknown
  misc_feature (1)..( 11): Result.001 file - promoters70/1016771
gccattaatgt

SEQ ID NO: 80542 - DNA, 11 bp, Unknown
  misc_feature (1)..( 11): Result.001 file - promoters70/1016771
aaaatggtatt

SEQ ID NO: 80543 - DNA, 11 bp, Unknown
  misc_feature (1)..( 11): Result.001 file - promoters70/1016771
cttaaggatat

SEQ ID NO: 80544 - DNA, 11 bp, Unknown
  misc_feature (1)..( 11): Result.001 file - promoters70/1016771
tttaaagattt

SEQ ID NO: 80545 - DNA, 11 bp, Unknown
  misc_feature (1)..( 11): Result.001 file - promoters70/1016771
gaaaaggataa

SEQ ID NO: 80546 - DNA, 11 bp, Unknown
  misc_feature (1)..( 11): Result.001 file - promoters70/1016771
aacaaaaatta

SEQ ID NO: 80547 - DNA, 11 bp, Unknown
  misc_feature (1)..( 11): Result.001 file - promoters70/1016771
tagaaaaatta

SEQ ID NO: 80548 - DNA, 11 bp, Unknown
  misc_feature (1)..( 11): Result.001 file - promoters70/1016771
tttcaagccat

SEQ ID NO: 80549 - DNA, 11 bp, Unknown
  misc_feature (1)..( 11): Result.001 file - promoters70/1016771
atgaaagggat

SEQ ID NO: 80550 - DNA, 13 bp, Unknown
  misc_feature (1)..( 13): Result.001 file - promoters70/1016771
tgagagcatcaac

SEQ ID NO: 80551 - DNA, 13 bp, Unknown
  misc_feature (1)..( 13): Result.001 file - promoters70/1016771
aaaatgcattaac

SEQ ID NO: 80552 - DNA, 13 bp, Unknown
  misc_feature (1)..( 13): Result.001 file - promoters70/1016771
aaaatgaattctt

SEQ ID NO: 80553 - DNA, 13 bp, Unknown
  misc_feature (1)..( 13): Result.001 file - promoters70/1016771
cgtatgacttcaa

SEQ ID NO: 80554 - DNA, 13 bp, Unknown
  misc_feature (1)..( 13): Result.001 file - promoters70/1016771
aaaatggtattac

SEQ ID NO: 80555 - DNA, 13 bp, Unknown
  misc_feature (1)..( 13): Result.001 file - promoters70/1016886
caatgccattaat

SEQ ID NO: 80556 - DNA, 15 bp, Unknown
  misc_feature (1)..( 15): Result.001 file - promoters70/1016886
ttcatttttaaaaac

SEQ ID NO: 80557 - DNA, 15 bp, Unknown
  misc_feature (1)..( 15): Result.001 file - promoters70/1016886
tctagatctaaaaac

SEQ ID NO: 80558 - DNA, 15 bp, Unknown
  misc_feature (1)..( 15): Result.001 file - promoters70/1017358
ttcacttttaaaaac

SEQ ID NO: 80559 - DNA, 13 bp, Unknown
  misc_feature (1)..( 13): Result.001 file - promoters70/1017358
aaaaagaagagcg

SEQ ID NO: 80560 - DNA, 13 bp, Unknown
  misc_feature (1)..( 13): Result.001 file - promoters70/1017358
agaaagaaacaag

SEQ ID NO: 80561 - DNA, 14 bp, Unknown
  misc_feature (1)..( 14): Result.001 file - promoters70/1017358
gaaatagataacgt

SEQ ID NO: 80562 - DNA, 14 bp, Unknown
  misc_feature (1)..( 14): Result.001 file - promoters70/1017358
ataccagaaatgaa

SEQ ID NO: 80563 - DNA, 14 bp, Unknown
  misc_feature (1)..( 14): Result.001 file - promoters70/1017358
tcaaaagagtttag

SEQ ID NO: 80564 - DNA, 14 bp, Unknown
  misc_feature (1)..( 14): Result.001 file - promoters70/1017358
aaaatagttaaaaa

SEQ ID NO: 80565 - DNA, 11 bp, Unknown
  misc_feature (1)..( 11): Result.001 file - promoters70/1017358
acatatataaa

SEQ ID NO: 80566 - DNA, 11 bp, Unknown
  misc_feature (1)..( 11): Result.001 file - promoters70/1017358
gcctatatata

SEQ ID NO: 80567 - DNA, 11 bp, Unknown
  misc_feature (1)..( 11): Result.001 file - promoters70/1017358
tgagatataat

SEQ ID NO: 80568 - DNA, 11 bp, Unknown
  misc_feature (1)..( 11): Result.001 file - promoters70/1017358
atctatatata

SEQ ID NO: 80569 - DNA, 11 bp, Unknown
  misc_feature (1)..( 11): Result.001 file - promoters70/1017358
ccttataaata

SEQ ID NO: 80570 - DNA, 11 bp, Unknown
  misc_feature (1)..( 11): Result.001 file - promoters70/1017358
ccttaaaaacc

SEQ ID NO: 80571 - DNA, 13 bp, Unknown
  misc_feature (1)..( 13): Result.001 file - promoters70/1017358
ccaatgatattcg

SEQ ID NO: 80572 - DNA, 13 bp, Unknown
  misc_feature (1)..( 13): Result.001 file - promoters70/1017358
ttaatgaaattca

SEQ ID NO: 80573 - DNA, 13 bp, Unknown
  misc_feature (1)..( 13): Result.001 file - promoters70/1017358
ccattgatgggct

SEQ ID NO: 80574 - DNA, 13 bp, Unknown
  misc_feature (1)..( 13): Result.001 file - promoters70/1017358
cgtttgatatata

SEQ ID NO: 80575 - DNA, 13 bp, Unknown
  misc_feature (1)..( 13): Result.001 file - promoters70/1017358
tgcatcaaactca

SEQ ID NO: 80576 - DNA, 13 bp, Unknown
  misc_feature (1)..( 13): Result.001 file - promoters70/1017434
tatttgctatcta

SEQ ID NO: 80577 - DNA, 8 bp, Unknown
  misc_feature (1)..( 8): Result.001 file - promoters70/1017434
ttgaattc

SEQ ID NO: 80578 - DNA, 8 bp, Unknown
  misc_feature (1)..( 8): Result.001 file - promoters70/1017434
ctgagttc

SEQ ID NO: 80579 - DNA, 8 bp, Unknown
  misc_feature (1)..( 8): Result.001 file - promoters70/1017434
ttgcattt

SEQ ID NO: 80580 - DNA, 8 bp, Unknown
  misc_feature (1)..( 8): Result.001 file - promoters70/1017434
ttgagttg

SEQ ID NO: 80581 - DNA, 10 bp, Unknown
  misc_feature (1)..( 10): Result.001 file - promoters70/1017434
tttctttcat

SEQ ID NO: 80582 - DNA, 10 bp, Unknown
  misc_feature (1)..( 10): Result.001 file - promoters70/1017434
tttttttttt

SEQ ID NO: 80583 - DNA, 10 bp, Unknown
  misc_feature (1)..( 10): Result.001 file - promoters70/1017434
tttattttaa

SEQ ID NO: 80584 - DNA, 10 bp, Unknown
  misc_feature (1)..( 10): Result.001 file - promoters70/1017434
tctattttaa

SEQ ID NO: 80585 - DNA, 9 bp, Unknown
  misc_feature (1)..( 9): Result.001 file - promoters70/1017434
tcttgattc

SEQ ID NO: 80586 - DNA, 9 bp, Unknown
  misc_feature (1)..( 9): Result.001 file - promoters70/1017434
aattgattt

SEQ ID NO: 80587 - DNA, 9 bp, Unknown
  misc_feature (1)..( 9): Result.001 file - promoters70/1017434
aattgatga

SEQ ID NO: 80588 - DNA, 9 bp, Unknown
  misc_feature (1)..( 9): Result.001 file - promoters70/1017618
gattgattt

SEQ ID NO: 80589 - DNA, 8 bp, Unknown
  misc_feature (1)..( 8): Result.001 file - promoters70/1017618
ttaagaag

SEQ ID NO: 80590 - DNA, 8 bp, Unknown
  misc_feature (1)..( 8): Result.001 file - promoters70/1017618
ttatgaaa

SEQ ID NO: 80591 - DNA, 9 bp, Unknown
  misc_feature (1)..( 9): Result.001 file - promoters70/1017770
ccatgcaaa

SEQ ID NO: 80592 - DNA, 7 bp, Unknown
  misc_feature (1)..( 7): Result.001 file - promoters70/1017770
ctttgaa

SEQ ID NO: 80593 - DNA, 7 bp, Unknown
  misc_feature (1)..( 7): Result.001 file - promoters70/1017770
gtttgaa

SEQ ID NO: 80594 - DNA, 7 bp, Unknown
  misc_feature (1)..( 7): Result.001 file - promoters70/1017770
gttagaa

SEQ ID NO: 80595 - DNA, 7 bp, Unknown
  misc_feature (1)..( 7): Result.001 file - promoters70/1017770
aatattg

SEQ ID NO: 80596 - DNA, 7 bp, Unknown
  misc_feature (1)..( 7): Result.001 file - promoters70/1017770
aatgttg

SEQ ID NO: 80597 - DNA, 7 bp, Unknown
  misc_feature (1)..( 7): Result.001 file - promoters70/1017770
aatattg

SEQ ID NO: 80598 - DNA, 7 bp, Unknown
  misc_feature (1)..( 7): Result.001 file - promoters70/1017770
gattatg

SEQ ID NO: 80599 - DNA, 7 bp, Unknown
  misc_feature (1)..( 7): Result.001 file - promoters70/1017770
tattatg

SEQ ID NO: 80600 - DNA, 7 bp, Unknown
  misc_feature (1)..( 7): Result.001 file - promoters70/1018052
gattatt

SEQ ID NO: 80601 - DNA, 7 bp, Unknown
  misc_feature (1)..( 7): Result.001 file - promoters70/1018052
tcagttt

SEQ ID NO: 80602 - DNA, 7 bp, Unknown
  misc_feature (1)..( 7): Result.001 file - promoters70/1018052
tcagttg

SEQ ID NO: 80603 - DNA, 7 bp, Unknown
  misc_feature (1)..( 7): Result.001 file - promoters70/1018052
tcaattt

SEQ ID NO: 80604 - DNA, 9 bp, Unknown
  misc_feature (1)..( 9): Result.001 file - promoters70/1018052
attccacat

SEQ ID NO: 80605 - DNA, 9 bp, Unknown
  misc_feature (1)..( 9): Result.001 file - promoters70/1018052
cttcaacat

SEQ ID NO: 80606 - DNA, 9 bp, Unknown
  misc_feature (1)..( 9): Result.001 file - promoters70/1018052
cttcaaaat

SEQ ID NO: 80607 - DNA, 8 bp, Unknown
  misc_feature (1)..( 8): Result.001 file - promoters70/1018052
cttgttgt

SEQ ID NO: 80608 - DNA, 8 bp, Unknown
  misc_feature (1)..( 8): Result.001 file - promoters70/1018052
attgatgt

SEQ ID NO: 80609 - DNA, 8 bp, Unknown
  misc_feature (1)..( 8): Result.001 file - promoters70/1018159
gttttttt

SEQ ID NO: 80610 - DNA, 9 bp, Unknown
  misc_feature (1)..( 9): Result.001 file - promoters70/1018159
gttaaaaaa

SEQ ID NO: 80611 - DNA, 9 bp, Unknown
  misc_feature (1)..( 9): Result.001 file - promoters70/1018159
agtaagaaa

SEQ ID NO: 80612 - DNA, 9 bp, Unknown
  misc_feature (1)..( 9): Result.001 file - promoters70/1018190
agtaagaat

SEQ ID NO: 80613 - DNA, 7 bp, Unknown
  misc_feature (1)..( 7): Result.001 file - promoters70/1018190
atttgtt

SEQ ID NO: 80614 - DNA, 7 bp, Unknown
  misc_feature (1)..( 7): Result.001 file - promoters70/1018190
atttgtt

SEQ ID NO: 80615 - DNA, 7 bp, Unknown
  misc_feature (1)..( 7): Result.001 file - promoters70/1018190
atttgta

SEQ ID NO: 80616 - DNA, 7 bp, Unknown
  misc_feature (1)..( 7): Result.001 file - promoters70/1018190
ttgattg

SEQ ID NO: 80617 - DNA, 7 bp, Unknown
  misc_feature (1)..( 7): Result.001 file - promoters70/1018190
ttgattg

SEQ ID NO: 80618 - DNA, 7 bp, Unknown
  misc_feature (1)..( 7): Result.001 file - promoters70/1018190
ttgattt

SEQ ID NO: 80619 - DNA, 9 bp, Unknown
  misc_feature (1)..( 9): Result.001 file - promoters70/1018190
attttttta

SEQ ID NO: 80620 - DNA, 9 bp, Unknown
  misc_feature (1)..( 9): Result.001 file - promoters70/1018190
cttttttta

SEQ ID NO: 80621 - DNA, 9 bp, Unknown
  misc_feature (1)..( 9): Result.001 file - promoters70/1018276
ctttgtttg

SEQ ID NO: 80622 - DNA, 9 bp, Unknown
  misc_feature (1)..( 9): Result.001 file - promoters70/1018276
acttcatat

SEQ ID NO: 80623 - DNA, 9 bp, Unknown
  misc_feature (1)..( 9): Result.001 file - promoters70/1018276
tcttcttat

SEQ ID NO: 80624 - DNA, 9 bp, Unknown
  misc_feature (1)..( 9): Result.001 file - promoters70/1018391
tcttcttca

SEQ ID NO: 80625 - DNA, 13 bp, Unknown
  misc_feature (1)..( 13): Result.001 file - promoters70/1018391
ctagtttattgtt

SEQ ID NO: 80626 - DNA, 13 bp, Unknown
  misc_feature (1)..( 13): Result.001 file - promoters70/1018391
ctagtttagaccc

SEQ ID NO: 80627 - DNA, 13 bp, Unknown
  misc_feature (1)..( 13): Result.001 file - promoters70/1018391
ggggtttgttgtt

SEQ ID NO: 80628 - DNA, 8 bp, Unknown
  misc_feature (1)..( 8): Result.001 file - promoters70/1018391
agagcata

SEQ ID NO: 80629 - DNA, 8 bp, Unknown
  misc_feature (1)..( 8): Result.001 file - promoters70/1018391
agatcatg

SEQ ID NO: 80630 - DNA, 8 bp, Unknown
  misc_feature (1)..( 8): Result.001 file - promoters70/1018523
cgattatg

SEQ ID NO: 80631 - DNA, 10 bp, Unknown
  misc_feature (1)..( 10): Result.001 file - promoters70/1018523
cccaaaaata

SEQ ID NO: 80632 - DNA, 10 bp, Unknown
  misc_feature (1)..( 10): Result.001 file - promoters70/1018523
tacaaaaaaa

SEQ ID NO: 80633 - DNA, 10 bp, Unknown
  misc_feature (1)..( 10): Result.001 file - promoters70/1018523
tcctaaaatc

SEQ ID NO: 80634 - DNA, 10 bp, Unknown
  misc_feature (1)..( 10): Result.001 file - promoters70/1018523
aataaacata

SEQ ID NO: 80635 - DNA, 10 bp, Unknown
  misc_feature (1)..( 10): Result.001 file - promoters70/1018523
aacaaaaaag

SEQ ID NO: 80636 - DNA, 12 bp, Unknown
  misc_feature (1)..( 12): Result.001 file - promoters70/1018523
aaacagtaaaac

SEQ ID NO: 80637 - DNA, 12 bp, Unknown
  misc_feature (1)..( 12): Result.001 file - promoters70/1018523
aaacaataaaat

SEQ ID NO: 80638 - DNA, 12 bp, Unknown
  misc_feature (1)..( 12): Result.001 file - promoters70/1018523
agataatatttc

SEQ ID NO: 80639 - DNA, 12 bp, Unknown
  misc_feature (1)..( 12): Result.001 file - promoters70/1018523
acattataaaat

SEQ ID NO: 80640 - DNA, 12 bp, Unknown
  misc_feature (1)..( 12): Result.001 file - promoters70/1018523
cgtcaaaaaact

SEQ ID NO: 80641 - DNA, 10 bp, Unknown
  misc_feature (1)..( 10): Result.001 file - promoters70/1018523
attaataaag

SEQ ID NO: 80642 - DNA, 10 bp, Unknown
  misc_feature (1)..( 10): Result.001 file - promoters70/1018523
attaatattt

SEQ ID NO: 80643 - DNA, 10 bp, Unknown
  misc_feature (1)..( 10): Result.001 file - promoters70/1018523
gataatattt

SEQ ID NO: 80644 - DNA, 10 bp, Unknown
  misc_feature (1)..( 10): Result.001 file - promoters70/1018523
tttattatag

SEQ ID NO: 80645 - DNA, 11 bp, Unknown
  misc_feature (1)..( 11): Result.001 file - promoters70/1018523
agtatatcaca

SEQ ID NO: 80646 - DNA, 11 bp, Unknown
  misc_feature (1)..( 11): Result.001 file - promoters70/1018523
ttttattttat

SEQ ID NO: 80647 - DNA, 14 bp, Unknown
  misc_feature (1)..( 14): Result.001 file - promoters70/1018523
aaaaaaaagacaaa

SEQ ID NO: 80648 - DNA, 14 bp, Unknown
  misc_feature (1)..( 14): Result.001 file - promoters70/1018523
aaaaaatattatta

SEQ ID NO: 80649 - DNA, 14 bp, Unknown
  misc_feature (1)..( 14): Result.001 file - promoters70/1018523
aaaaagaagaaaaa

SEQ ID NO: 80650 - DNA, 14 bp, Unknown
  misc_feature (1)..( 14): Result.001 file - promoters70/1018523
aaacaaatgtttgt

SEQ ID NO: 80651 - DNA, 14 bp, Unknown
  misc_feature (1)..( 14): Result.001 file - promoters70/1018523
taactaatttctta

SEQ ID NO: 80652 - DNA, 7 bp, Unknown
  misc_feature (1)..( 7): Result.001 file - promoters70/1018523
taagatt

SEQ ID NO: 80653 - DNA, 7 bp, Unknown
  misc_feature (1)..( 7): Result.001 file - promoters70/1018523
taaaatt

SEQ ID NO: 80654 - DNA, 7 bp, Unknown
  misc_feature (1)..( 7): Result.001 file - promoters70/1018523
taagatc

SEQ ID NO: 80655 - DNA, 7 bp, Unknown
  misc_feature (1)..( 7): Result.001 file - promoters70/1018523
aaaaatt

SEQ ID NO: 80656 - DNA, 8 bp, Unknown
  misc_feature (1)..( 8): Result.001 file - promoters70/1018523
taacaatt

SEQ ID NO: 80657 - DNA, 8 bp, Unknown
  misc_feature (1)..( 8): Result.001 file - promoters70/1018523
taaaaatc

SEQ ID NO: 80658 - DNA, 11 bp, Unknown
  misc_feature (1)..( 11): Result.001 file - promoters70/1018523
gaaaaaaaaga

SEQ ID NO: 80659 - DNA, 11 bp, Unknown
  misc_feature (1)..( 11): Result.001 file - promoters70/1018523
agttaaaaagt

SEQ ID NO: 80660 - DNA, 11 bp, Unknown
  misc_feature (1)..( 11): Result.001 file - promoters70/1018523
agttaaaaaat

SEQ ID NO: 80661 - DNA, 11 bp, Unknown
  misc_feature (1)..( 11): Result.001 file - promoters70/1018523
agttaatatat

SEQ ID NO: 80662 - DNA, 11 bp, Unknown
  misc_feature (1)..( 11): Result.001 file - promoters70/1018523
atttaaaatcg

SEQ ID NO: 80663 - DNA, 11 bp, Unknown
  misc_feature (1)..( 11): Result.001 file - promoters70/1018523
tgttattatat

SEQ ID NO: 80664 - DNA, 14 bp, Unknown
  misc_feature (1)..( 14): Result.001 file - promoters70/1018523
taaataaatttttg

SEQ ID NO: 80665 - DNA, 14 bp, Unknown
  misc_feature (1)..( 14): Result.001 file - promoters70/1018523
caaacaaatgtttg

SEQ ID NO: 80666 - DNA, 14 bp, Unknown
  misc_feature (1)..( 14): Result.001 file - promoters70/1018523
taaaaaaagaagaa

SEQ ID NO: 80667 - DNA, 14 bp, Unknown
  misc_feature (1)..( 14): Result.001 file - promoters70/1018523
taactaatttctta

SEQ ID NO: 80668 - DNA, 15 bp, Unknown
  misc_feature (1)..( 15): Result.001 file - promoters70/1018523
taatataactcttgg

SEQ ID NO: 80669 - DNA, 13 bp, Unknown
  misc_feature (1)..( 13): Result.001 file - promoters70/1018523
aaaaatattatta

SEQ ID NO: 80670 - DNA, 13 bp, Unknown
  misc_feature (1)..( 13): Result.001 file - promoters70/1018523
tttgttattatat

SEQ ID NO: 80671 - DNA, 13 bp, Unknown
  misc_feature (1)..( 13): Result.001 file - promoters70/1018523
agtgatataatta

SEQ ID NO: 80672 - DNA, 13 bp, Unknown
  misc_feature (1)..( 13): Result.001 file - promoters70/1018523
gttaatatatatt

SEQ ID NO: 80673 - DNA, 13 bp, Unknown
  misc_feature (1)..( 13): Result.001 file - promoters70/1018529
tggattatcattt

SEQ ID NO: 80674 - DNA, 12 bp, Unknown
  misc_feature (1)..( 12): Result.001 file - promoters70/1018529
tcagaattaata

SEQ ID NO: 80675 - DNA, 12 bp, Unknown
  misc_feature (1)..( 12): Result.001 file - promoters70/1018529
tcataattaata

SEQ ID NO: 80676 - DNA, 12 bp, Unknown
  misc_feature (1)..( 12): Result.001 file - promoters70/1018529
acatgatttgaa

SEQ ID NO: 80677 - DNA, 7 bp, Unknown
  misc_feature (1)..( 7): Result.001 file - promoters70/1018529
aattaaa

SEQ ID NO: 80678 - DNA, 7 bp, Unknown
  misc_feature (1)..( 7): Result.001 file - promoters70/1018529
aataaaa

SEQ ID NO: 80679 - DNA, 7 bp, Unknown
  misc_feature (1)..( 7): Result.001 file - promoters70/1018536
aataaac

SEQ ID NO: 80680 - DNA, 11 bp, Unknown
  misc_feature (1)..( 11): Result.001 file - promoters70/1018536
tagagaaattc

SEQ ID NO: 80681 - DNA, 11 bp, Unknown
  misc_feature (1)..( 11): Result.001 file - promoters70/1018536
gtaagaaatcc

SEQ ID NO: 80682 - DNA, 11 bp, Unknown
  misc_feature (1)..( 11): Result.001 file - promoters70/1018536
tttagaaaaat

SEQ ID NO: 80683 - DNA, 8 bp, Unknown
  misc_feature (1)..( 8): Result.001 file - promoters70/1018536
attagttc

SEQ ID NO: 80684 - DNA, 8 bp, Unknown
  misc_feature (1)..( 8): Result.001 file - promoters70/1018536
atttgtta

SEQ ID NO: 80685 - DNA, 8 bp, Unknown
  misc_feature (1)..( 8): Result.001 file - promoters70/1018536
aattgtta

SEQ ID NO: 80686 - DNA, 8 bp, Unknown
  misc_feature (1)..( 8): Result.001 file - promoters70/1018536
ttttcaat

SEQ ID NO: 80687 - DNA, 8 bp, Unknown
  misc_feature (1)..( 8): Result.001 file - promoters70/1018536
attttaat

SEQ ID NO: 80688 - DNA, 8 bp, Unknown
  misc_feature (1)..( 8): Result.001 file - promoters70/1018536
attctaac

SEQ ID NO: 80689 - DNA, 8 bp, Unknown
  misc_feature (1)..( 8): Result.001 file - promoters70/1018536
cttttaaa

SEQ ID NO: 80690 - DNA, 13 bp, Unknown
  misc_feature (1)..( 13): Result.001 file - promoters70/1018536
ttttgaagaattt

SEQ ID NO: 80691 - DNA, 13 bp, Unknown
  misc_feature (1)..( 13): Result.001 file - promoters70/1018536
ttttgatgaatgt

SEQ ID NO: 80692 - DNA, 13 bp, Unknown
  misc_feature (1)..( 13): Result.001 file - promoters70/1018536
atttgctgaataa

SEQ ID NO: 80693 - DNA, 13 bp, Unknown
  misc_feature (1)..( 13): Result.001 file - promoters70/1018536
cccttgtgaatgt

SEQ ID NO: 80694 - DNA, 11 bp, Unknown
  misc_feature (1)..( 11): Result.001 file - promoters70/1018536
atttccataaa

SEQ ID NO: 80695 - DNA, 11 bp, Unknown
  misc_feature (1)..( 11): Result.001 file - promoters70/1018536
attttcataaa

SEQ ID NO: 80696 - DNA, 11 bp, Unknown
  misc_feature (1)..( 11): Result.001 file - promoters70/1018536
aatttcatcct

SEQ ID NO: 80697 - DNA, 17 bp, Unknown
  misc_feature (1)..( 17): Result.001 file - promoters70/1018536
aaaatgttagataggaa

SEQ ID NO: 80698 - DNA, 17 bp, Unknown
  misc_feature (1)..( 17): Result.001 file - promoters70/1018536
taaattttaaaattatt

SEQ ID NO: 80699 - DNA, 17 bp, Unknown
  misc_feature (1)..( 17): Result.001 file - promoters70/1018536
taaattttgaaataatt

SEQ ID NO: 80700 - DNA, 17 bp, Unknown
  misc_feature (1)..( 17): Result.001 file - promoters70/1018536
taattgttaatcttttg

SEQ ID NO: 80701 - DNA, 13 bp, Unknown
  misc_feature (1)..( 13): Result.001 file - promoters70/1018536
tcatcgaacagca

SEQ ID NO: 80702 - DNA, 13 bp, Unknown
  misc_feature (1)..( 13): Result.001 file - promoters70/1018536
taatccaacggca

SEQ ID NO: 80703 - DNA, 13 bp, Unknown
  misc_feature (1)..( 13): Result.001 file - promoters70/1018536
taatccaacggac

SEQ ID NO: 80704 - DNA, 8 bp, Unknown
  misc_feature (1)..( 8): Result.001 file - promoters70/1018536
tatataaa

SEQ ID NO: 80705 - DNA, 8 bp, Unknown
  misc_feature (1)..( 8): Result.001 file - promoters70/1018536
tatataat

SEQ ID NO: 80706 - DNA, 8 bp, Unknown
  misc_feature (1)..( 8): Result.001 file - promoters70/1018536
cctataaa

SEQ ID NO: 80707 - DNA, 10 bp, Unknown
  misc_feature (1)..( 10): Result.001 file - promoters70/1018536
tataaacaaa

SEQ ID NO: 80708 - DNA, 10 bp, Unknown
  misc_feature (1)..( 10): Result.001 file - promoters70/1018536
aataaccaaa

SEQ ID NO: 80709 - DNA, 10 bp, Unknown
  misc_feature (1)..( 10): Result.001 file - promoters70/1018536
tataaatatc

SEQ ID NO: 80710 - DNA, 8 bp, Unknown
  misc_feature (1)..( 8): Result.001 file - promoters70/1018536
aaattcaa

SEQ ID NO: 80711 - DNA, 8 bp, Unknown
  misc_feature (1)..( 8): Result.001 file - promoters70/1018536
aaattctc

SEQ ID NO: 80712 - DNA, 8 bp, Unknown
  misc_feature (1)..( 8): Result.001 file - promoters70/1018536
aaatcctc

SEQ ID NO: 80713 - DNA, 11 bp, Unknown
  misc_feature (1)..( 11): Result.001 file - promoters70/1018536
cttataattat

SEQ ID NO: 80714 - DNA, 11 bp, Unknown
  misc_feature (1)..( 11): Result.001 file - promoters70/1018536
tttataagtat

SEQ ID NO: 80715 - DNA, 11 bp, Unknown
  misc_feature (1)..( 11): Result.001 file - promoters70/1018536
tttgtaacttc

SEQ ID NO: 80716 - DNA, 11 bp, Unknown
  misc_feature (1)..( 11): Result.001 file - promoters70/1018536
tttaaaagtaa

SEQ ID NO: 80717 - DNA, 8 bp, Unknown
  misc_feature (1)..( 8): Result.001 file - promoters70/1018536
gtaatgta

SEQ ID NO: 80718 - DNA, 8 bp, Unknown
  misc_feature (1)..( 8): Result.001 file - promoters70/1018536
tgaatgta

SEQ ID NO: 80719 - DNA, 8 bp, Unknown
  misc_feature (1)..( 8): Result.001 file - promoters70/1018536
tgaatgtc

SEQ ID NO: 80720 - DNA, 10 bp, Unknown
  misc_feature (1)..( 10): Result.001 file - promoters70/1018536
atttaaattg

SEQ ID NO: 80721 - DNA, 10 bp, Unknown
  misc_feature (1)..( 10): Result.001 file - promoters70/1018536
atttaaatca

SEQ ID NO: 80722 - DNA, 10 bp, Unknown
  misc_feature (1)..( 10): Result.001 file - promoters70/1018755
gtgtaagttg

SEQ ID NO: 80723 - DNA, 11 bp, Unknown
  misc_feature (1)..( 11): Result.001 file - promoters70/1018755
actacacatag

SEQ ID NO: 80724 - DNA, 11 bp, Unknown
  misc_feature (1)..( 11): Result.001 file - promoters70/1018755
gctaaacaaaa

SEQ ID NO: 80725 - DNA, 11 bp, Unknown
  misc_feature (1)..( 11): Result.001 file - promoters70/1018755
aacaaaccaaa

SEQ ID NO: 80726 - DNA, 11 bp, Unknown
  misc_feature (1)..( 11): Result.001 file - promoters70/1018755
agaaaacaatg

SEQ ID NO: 80727 - DNA, 11 bp, Unknown
  misc_feature (1)..( 11): Result.001 file - promoters70/1018755
gcttaacactc

SEQ ID NO: 80728 - DNA, 11 bp, Unknown
  misc_feature (1)..( 11): Result.001 file - promoters70/1018755
cattaacaatc

SEQ ID NO: 80729 - DNA, 12 bp, Unknown
  misc_feature (1)..( 12): Result.001 file - promoters70/1018755
acattcacgaaa

SEQ ID NO: 80730 - DNA, 12 bp, Unknown
  misc_feature (1)..( 12): Result.001 file - promoters70/1018755
atattctcgaat

SEQ ID NO: 80731 - DNA, 12 bp, Unknown
  misc_feature (1)..( 12): Result.001 file - promoters70/1018755
acatagacgaaa

SEQ ID NO: 80732 - DNA, 12 bp, Unknown
  misc_feature (1)..( 12): Result.001 file - promoters70/1018755
acaatcagtatc

SEQ ID NO: 80733 - DNA, 12 bp, Unknown
  misc_feature (1)..( 12): Result.001 file - promoters70/1018755
cgaatcagctaa

SEQ ID NO: 80734 - DNA, 12 bp, Unknown
  misc_feature (1)..( 12): Result.001 file - promoters70/1018755
cgaatcaatctc

SEQ ID NO: 80735 - DNA, 12 bp, Unknown
  misc_feature (1)..( 12): Result.001 file - promoters70/1018770
ttattctcaagg

SEQ ID NO: 80736 - DNA, 9 bp, Unknown
  misc_feature (1)..( 9): Result.001 file - promoters70/1018770
gaaaaaaag

SEQ ID NO: 80737 - DNA, 9 bp, Unknown
  misc_feature (1)..( 9): Result.001 file - promoters70/1018770
caaacaaat

SEQ ID NO: 80738 - DNA, 9 bp, Unknown
  misc_feature (1)..( 9): Result.001 file - promoters70/1018770
caaagaaag

SEQ ID NO: 80739 - DNA, 9 bp, Unknown
  misc_feature (1)..( 9): Result.001 file - promoters70/1018770
caaaaaaaa

SEQ ID NO: 80740 - DNA, 9 bp, Unknown
  misc_feature (1)..( 9): Result.001 file - promoters70/1018770
caaacacaa

SEQ ID NO: 80741 - DNA, 9 bp, Unknown
  misc_feature (1)..( 9): Result.001 file - promoters70/1018770
caaggaaag

SEQ ID NO: 80742 - DNA, 9 bp, Unknown
  misc_feature (1)..( 9): Result.001 file - promoters70/1018956
caacgaata

SEQ ID NO: 80743 - DNA, 10 bp, Unknown
  misc_feature (1)..( 10): Result.001 file - promoters70/1018956
ggaaaaagaa

SEQ ID NO: 80744 - DNA, 10 bp, Unknown
  misc_feature (1)..( 10): Result.001 file - promoters70/1018956
ggaaaagaaa

SEQ ID NO: 80745 - DNA, 10 bp, Unknown
  misc_feature (1)..( 10): Result.001 file - promoters70/1018956
ggaaatgaaa

SEQ ID NO: 80746 - DNA, 7 bp, Unknown
  misc_feature (1)..( 7): Result.001 file - promoters70/1018956
aaaagaa

SEQ ID NO: 80747 - DNA, 7 bp, Unknown
  misc_feature (1)..( 7): Result.001 file - promoters70/1018956
aaaagaa

SEQ ID NO: 80748 - DNA, 7 bp, Unknown
  misc_feature (1)..( 7): Result.001 file - promoters70/1018973
aaatgaa

SEQ ID NO: 80749 - DNA, 11 bp, Unknown
  misc_feature (1)..( 11): Result.001 file - promoters70/1018973
ttataattatg

SEQ ID NO: 80750 - DNA, 11 bp, Unknown
  misc_feature (1)..( 11): Result.001 file - promoters70/1018973
atattattatt

SEQ ID NO: 80751 - DNA, 11 bp, Unknown
  misc_feature (1)..( 11): Result.001 file - promoters70/1018973
ttataagtata

SEQ ID NO: 80752 - DNA, 11 bp, Unknown
  misc_feature (1)..( 11): Result.001 file - promoters70/1018973
atataagtaac

SEQ ID NO: 80753 - DNA, 11 bp, Unknown
  misc_feature (1)..( 11): Result.001 file - promoters70/1019257
caatctttata

SEQ ID NO: 80754 - DNA, 7 bp, Unknown
  misc_feature (1)..( 7): Result.001 file - promoters70/1019257
aaagaag

SEQ ID NO: 80755 - DNA, 7 bp, Unknown
  misc_feature (1)..( 7): Result.001 file - promoters70/1019257
aaaaaag

SEQ ID NO: 80756 - DNA, 7 bp, Unknown
  misc_feature (1)..( 7): Result.001 file - promoters70/1019257
aaataag

SEQ ID NO: 80757 - DNA, 9 bp, Unknown
  misc_feature (1)..( 9): Result.001 file - promoters70/1019257
gttataaaa

SEQ ID NO: 80758 - DNA, 9 bp, Unknown
  misc_feature (1)..( 9): Result.001 file - promoters70/1019257
atcataaaa

SEQ ID NO: 80759 - DNA, 9 bp, Unknown
  misc_feature (1)..( 9): Result.001 file - promoters70/1019508
tatataaat

SEQ ID NO: 80760 - DNA, 9 bp, Unknown
  misc_feature (1)..( 9): Result.001 file - promoters70/1019508
agattgaag

SEQ ID NO: 80761 - DNA, 9 bp, Unknown
  misc_feature (1)..( 9): Result.001 file - promoters70/1019508
agatggaaa

SEQ ID NO: 80762 - DNA, 9 bp, Unknown
  misc_feature (1)..( 9): Result.001 file - promoters70/1019537
cactggaaa

SEQ ID NO: 80763 - DNA, 10 bp, Unknown
  misc_feature (1)..( 10): Result.001 file - promoters70/1019537
aaaacaaaac

SEQ ID NO: 80764 - DNA, 10 bp, Unknown
  misc_feature (1)..( 10): Result.001 file - promoters70/1019537
agcacacaac

SEQ ID NO: 80765 - DNA, 10 bp, Unknown
  misc_feature (1)..( 10): Result.001 file - promoters70/1019537
gaaagaaaga

SEQ ID NO: 80766 - DNA, 10 bp, Unknown
  misc_feature (1)..( 10): Result.001 file - promoters70/1019537
gaatgaaaca

SEQ ID NO: 80767 - DNA, 10 bp, Unknown
  misc_feature (1)..( 10): Result.001 file - promoters70/1019537
aagtgaatgt

SEQ ID NO: 80768 - DNA, 11 bp, Unknown
  misc_feature (1)..( 11): Result.001 file - promoters70/1019537
tttgttttcta

SEQ ID NO: 80769 - DNA, 11 bp, Unknown
  misc_feature (1)..( 11): Result.001 file - promoters70/1019537
tttctttacta

SEQ ID NO: 80770 - DNA, 11 bp, Unknown
  misc_feature (1)..( 11): Result.001 file - promoters70/1019537
tttgtgttcgt

SEQ ID NO: 80771 - DNA, 11 bp, Unknown
  misc_feature (1)..( 11): Result.001 file - promoters70/1019537
cttggtttctt

SEQ ID NO: 80772 - DNA, 8 bp, Unknown
  misc_feature (1)..( 8): Result.001 file - promoters70/1019537
tctataaa

SEQ ID NO: 80773 - DNA, 8 bp, Unknown
  misc_feature (1)..( 8): Result.001 file - promoters70/1019537
tatataaa

SEQ ID NO: 80774 - DNA, 8 bp, Unknown
  misc_feature (1)..( 8): Result.001 file - promoters70/1019537
tatttaaa

SEQ ID NO: 80775 - DNA, 8 bp, Unknown
  misc_feature (1)..( 8): Result.001 file - promoters70/1019537
tatataag

SEQ ID NO: 80776 - DNA, 11 bp, Unknown
  misc_feature (1)..( 11): Result.001 file - promoters70/1019537
atatatgtaaa

SEQ ID NO: 80777 - DNA, 11 bp, Unknown
  misc_feature (1)..( 11): Result.001 file - promoters70/1019537
ctttatttaaa

SEQ ID NO: 80778 - DNA, 11 bp, Unknown
  misc_feature (1)..( 11): Result.001 file - promoters70/1019537
atagatgtttc

SEQ ID NO: 80779 - DNA, 11 bp, Unknown
  misc_feature (1)..( 11): Result.001 file - promoters70/1019537
aaagagagaga

SEQ ID NO: 80780 - DNA, 11 bp, Unknown
  misc_feature (1)..( 11): Result.001 file - promoters70/1019734
tcgtatctaag

SEQ ID NO: 80781 - DNA, 9 bp, Unknown
  misc_feature (1)..( 9): Result.001 file - promoters70/1019734
actatcata

SEQ ID NO: 80782 - DNA, 9 bp, Unknown
  misc_feature (1)..( 9): Result.001 file - promoters70/1019734
tcaatcata

SEQ ID NO: 80783 - DNA, 9 bp, Unknown
  misc_feature (1)..( 9): Result.001 file - promoters70/1019734
tcaaccata

SEQ ID NO: 80784 - DNA, 9 bp, Unknown
  misc_feature (1)..( 9): Result.001 file - promoters70/1019734
aaatttcat

SEQ ID NO: 80785 - DNA, 9 bp, Unknown
  misc_feature (1)..( 9): Result.001 file - promoters70/1019734
taatttcat

SEQ ID NO: 80786 - DNA, 9 bp, Unknown
  misc_feature (1)..( 9): Result.001 file - promoters70/1019928
taatttatt

SEQ ID NO: 80787 - DNA, 8 bp, Unknown
  misc_feature (1)..( 8): Result.001 file - promoters70/1019928
attagttc

SEQ ID NO: 80788 - DNA, 8 bp, Unknown
  misc_feature (1)..( 8): Result.001 file - promoters70/1019928
atttgtta

SEQ ID NO: 80789 - DNA, 8 bp, Unknown
  misc_feature (1)..( 8): Result.001 file - promoters70/1019928
aattgtta

SEQ ID NO: 80790 - DNA, 7 bp, Unknown
  misc_feature (1)..( 7): Result.001 file - promoters70/1019928
tttcaat

SEQ ID NO: 80791 - DNA, 7 bp, Unknown
  misc_feature (1)..( 7): Result.001 file - promoters70/1019928
ttttaat

SEQ ID NO: 80792 - DNA, 7 bp, Unknown
  misc_feature (1)..( 7): Result.001 file - promoters70/1019928
ttttaaa

SEQ ID NO: 80793 - DNA, 8 bp, Unknown
  misc_feature (1)..( 8): Result.001 file - promoters70/1019928
aaattcaa

SEQ ID NO: 80794 - DNA, 8 bp, Unknown
  misc_feature (1)..( 8): Result.001 file - promoters70/1019928
aaattctc

SEQ ID NO: 80795 - DNA, 8 bp, Unknown
  misc_feature (1)..( 8): Result.001 file - promoters70/1019928
aaatcctc

SEQ ID NO: 80796 - DNA, 11 bp, Unknown
  misc_feature (1)..( 11): Result.001 file - promoters70/1019928
cttataattat

SEQ ID NO: 80797 - DNA, 11 bp, Unknown
  misc_feature (1)..( 11): Result.001 file - promoters70/1019928
tttataagtat

SEQ ID NO: 80798 - DNA, 11 bp, Unknown
  misc_feature (1)..( 11): Result.001 file - promoters70/1020023
tttgtaacttc

SEQ ID NO: 80799 - DNA, 10 bp, Unknown
  misc_feature (1)..( 10): Result.001 file - promoters70/1020023
tcctatatat

SEQ ID NO: 80800 - DNA, 10 bp, Unknown
  misc_feature (1)..( 10): Result.001 file - promoters70/1020023
ttctatatat

SEQ ID NO: 80801 - DNA, 10 bp, Unknown
  misc_feature (1)..( 10): Result.001 file - promoters70/1020223
tcctataaat

SEQ ID NO: 80802 - DNA, 8 bp, Unknown
  misc_feature (1)..( 8): Result.001 file - promoters70/1020223
atcatatt

SEQ ID NO: 80803 - DNA, 8 bp, Unknown
  misc_feature (1)..( 8): Result.001 file - promoters70/1020223
atcatatt

SEQ ID NO: 80804 - DNA, 8 bp, Unknown
  misc_feature (1)..( 8): Result.001 file - promoters70/1020223
atcatatt

SEQ ID NO: 80805 - DNA, 9 bp, Unknown
  misc_feature (1)..( 9): Result.001 file - promoters70/1020223
tttgtagtg

SEQ ID NO: 80806 - DNA, 9 bp, Unknown
  misc_feature (1)..( 9): Result.001 file - promoters70/1020223
attgtagct

SEQ ID NO: 80807 - DNA, 9 bp, Unknown
  misc_feature (1)..( 9): Result.001 file - promoters70/1020223
tttgttgtg

SEQ ID NO: 80808 - DNA, 8 bp, Unknown
  misc_feature (1)..( 8): Result.001 file - promoters70/1020223
tgatttgt

SEQ ID NO: 80809 - DNA, 8 bp, Unknown
  misc_feature (1)..( 8): Result.001 file - promoters70/1020223
agatatgt

SEQ ID NO: 80810 - DNA, 8 bp, Unknown
  misc_feature (1)..( 8): Result.001 file - promoters70/1020223
tgatttgg

SEQ ID NO: 80811 - DNA, 7 bp, Unknown
  misc_feature (1)..( 7): Result.001 file - promoters70/1020223
gtttgtt

SEQ ID NO: 80812 - DNA, 7 bp, Unknown
  misc_feature (1)..( 7): Result.001 file - promoters70/1020223
gtttgtg

SEQ ID NO: 80813 - DNA, 7 bp, Unknown
  misc_feature (1)..( 7): Result.001 file - promoters70/1020223
ttttgtt

SEQ ID NO: 80814 - DNA, 8 bp, Unknown
  misc_feature (1)..( 8): Result.001 file - promoters70/1020223
tgtttgtt

SEQ ID NO: 80815 - DNA, 8 bp, Unknown
  misc_feature (1)..( 8): Result.001 file - promoters70/1020223
gatttgtt

SEQ ID NO: 80816 - DNA, 8 bp, Unknown
  misc_feature (1)..( 8): Result.001 file - promoters70/1020265
gatatgta

SEQ ID NO: 80817 - DNA, 8 bp, Unknown
  misc_feature (1)..( 8): Result.001 file - promoters70/1020265
atgactac

SEQ ID NO: 80818 - DNA, 8 bp, Unknown
  misc_feature (1)..( 8): Result.001 file - promoters70/1020265
atgactta

SEQ ID NO: 80819 - DNA, 8 bp, Unknown
  misc_feature (1)..( 8): Result.001 file - promoters70/1020313
ttgattta

SEQ ID NO: 80820 - DNA, 11 bp, Unknown
  misc_feature (1)..( 11): Result.001 file - promoters70/1020313
tgtgtatataa

SEQ ID NO: 80821 - DNA, 11 bp, Unknown
  misc_feature (1)..( 11): Result.001 file - promoters70/1020313
gtagtatataa

SEQ ID NO: 80822 - DNA, 11 bp, Unknown
  misc_feature (1)..( 11): Result.001 file - promoters70/1020430
tgtctatataa

SEQ ID NO: 80823 - DNA, 8 bp, Unknown
  misc_feature (1)..( 8): Result.001 file - promoters70/1020430
acaaaaaa

SEQ ID NO: 80824 - DNA, 8 bp, Unknown
  misc_feature (1)..( 8): Result.001 file - promoters70/1020430
tcaagaaa

SEQ ID NO: 80825 - DNA, 8 bp, Unknown
  misc_feature (1)..( 8): Result.001 file - promoters70/1020430
acaacaaa

SEQ ID NO: 80826 - DNA, 11 bp, Unknown
  misc_feature (1)..( 11): Result.001 file - promoters70/1020430
aatgaaaagca

SEQ ID NO: 80827 - DNA, 11 bp, Unknown
  misc_feature (1)..( 11): Result.001 file - promoters70/1020430
aattaaaataa

SEQ ID NO: 80828 - DNA, 11 bp, Unknown
  misc_feature (1)..( 11): Result.001 file - promoters70/1020430
aattataataa

SEQ ID NO: 80829 - DNA, 8 bp, Unknown
  misc_feature (1)..( 8): Result.001 file - promoters70/1020430
aataaata

SEQ ID NO: 80830 - DNA, 8 bp, Unknown
  misc_feature (1)..( 8): Result.001 file - promoters70/1020430
cttaaata

SEQ ID NO: 80831 - DNA, 8 bp, Unknown
  misc_feature (1)..( 8): Result.001 file - promoters70/1020543
cttgaatc

SEQ ID NO: 80832 - DNA, 10 bp, Unknown
  misc_feature (1)..( 10): Result.001 file - promoters70/1020543
tttgaaaaga

SEQ ID NO: 80833 - DNA, 10 bp, Unknown
  misc_feature (1)..( 10): Result.001 file - promoters70/1020543
aaaaaaaaga

SEQ ID NO: 80834 - DNA, 11 bp, Unknown
  misc_feature (1)..( 11): Result.001 file - promoters70/1020543
gaagaaacaga

SEQ ID NO: 80835 - DNA, 12 bp, Unknown
  misc_feature (1)..( 12): Result.001 file - promoters70/1020543
tgaaaagatgaa

SEQ ID NO: 80836 - DNA, 12 bp, Unknown
  misc_feature (1)..( 12): Result.001 file - promoters70/1020543
acacaagaagaa

SEQ ID NO: 80837 - DNA, 12 bp, Unknown
  misc_feature (1)..( 12): Result.001 file - promoters70/1020646
gaaaaaaaagaa

SEQ ID NO: 80838 - DNA, 11 bp, Unknown
  misc_feature (1)..( 11): Result.001 file - promoters70/1020646
aataatttgta

SEQ ID NO: 80839 - DNA, 11 bp, Unknown
  misc_feature (1)..( 11): Result.001 file - promoters70/1020646
aatattttagg

SEQ ID NO: 80840 - DNA, 11 bp, Unknown
  misc_feature (1)..( 11): Result.001 file - promoters70/1020666
aattattggta

SEQ ID NO: 80841 - DNA, 10 bp, Unknown
  misc_feature (1)..( 10): Result.001 file - promoters70/1020666
aggtagataa

SEQ ID NO: 80842 - DNA, 10 bp, Unknown
  misc_feature (1)..( 10): Result.001 file - promoters70/1020666
tggtaaataa

SEQ ID NO: 80843 - DNA, 10 bp, Unknown
  misc_feature (1)..( 10): Result.001 file - promoters70/1020666
tgggaaaaag

SEQ ID NO: 80844 - DNA, 13 bp, Unknown
  misc_feature (1)..( 13): Result.001 file - promoters70/1020666
gaaacaaacctga

SEQ ID NO: 80845 - DNA, 13 bp, Unknown
  misc_feature (1)..( 13): Result.001 file - promoters70/1020666
ttgtcaaaactga

SEQ ID NO: 80846 - DNA, 13 bp, Unknown
  misc_feature (1)..( 13): Result.001 file - promoters70/1020701
gaagcaaacattt

SEQ ID NO: 80847 - DNA, 11 bp, Unknown
  misc_feature (1)..( 11): Result.001 file - promoters70/1020701
tgtttgaccat

SEQ ID NO: 80848 - DNA, 11 bp, Unknown
  misc_feature (1)..( 11): Result.001 file - promoters70/1020701
tatttgaacat

SEQ ID NO: 80849 - DNA, 11 bp, Unknown
  misc_feature (1)..( 11): Result.001 file - promoters70/1020701
tgtgtgagttc

SEQ ID NO: 80850 - DNA, 8 bp, Unknown
  misc_feature (1)..( 8): Result.001 file - promoters70/1020701
taacgaac

SEQ ID NO: 80851 - DNA, 8 bp, Unknown
  misc_feature (1)..( 8): Result.001 file - promoters70/1020701
caacgaaa

SEQ ID NO: 80852 - DNA, 8 bp, Unknown
  misc_feature (1)..( 8): Result.001 file - promoters70/1020701
caactaaa

SEQ ID NO: 80853 - DNA, 10 bp, Unknown
  misc_feature (1)..( 10): Result.001 file - promoters70/1020701
aaatcatttt

SEQ ID NO: 80854 - DNA, 10 bp, Unknown
  misc_feature (1)..( 10): Result.001 file - promoters70/1020701
aaataatttt

SEQ ID NO: 80855 - DNA, 10 bp, Unknown
  misc_feature (1)..( 10): Result.001 file - promoters70/1020701
caatcatatt

SEQ ID NO: 80856 - DNA, 10 bp, Unknown
  misc_feature (1)..( 10): Result.001 file - promoters70/1020701
ctatcataat

SEQ ID NO: 80857 - DNA, 9 bp, Unknown
  misc_feature (1)..( 9): Result.001 file - promoters70/1020701
ataggaaat

SEQ ID NO: 80858 - DNA, 9 bp, Unknown
  misc_feature (1)..( 9): Result.001 file - promoters70/1020701
ataagaaaa

SEQ ID NO: 80859 - DNA, 9 bp, Unknown
  misc_feature (1)..( 9): Result.001 file - promoters70/1020701
ataataaaa

SEQ ID NO: 80860 - DNA, 9 bp, Unknown
  misc_feature (1)..( 9): Result.001 file - promoters70/1020701
tcaaccata

SEQ ID NO: 80861 - DNA, 9 bp, Unknown
  misc_feature (1)..( 9): Result.001 file - promoters70/1020701
tcaatcata

SEQ ID NO: 80862 - DNA, 9 bp, Unknown
  misc_feature (1)..( 9): Result.001 file - promoters70/1020701
actatcata

SEQ ID NO: 80863 - DNA, 9 bp, Unknown
  misc_feature (1)..( 9): Result.001 file - promoters70/1020701
taatttatt

SEQ ID NO: 80864 - DNA, 9 bp, Unknown
  misc_feature (1)..( 9): Result.001 file - promoters70/1020701
taatttcat

SEQ ID NO: 80865 - DNA, 9 bp, Unknown
  misc_feature (1)..( 9): Result.001 file - promoters70/1020701
aaatttcat

SEQ ID NO: 80866 - DNA, 9 bp, Unknown
  misc_feature (1)..( 9): Result.001 file - promoters70/1020701
taattttca

SEQ ID NO: 80867 - DNA, 9 bp, Unknown
  misc_feature (1)..( 9): Result.001 file - promoters70/1020701
ataatatgt

SEQ ID NO: 80868 - DNA, 9 bp, Unknown
  misc_feature (1)..( 9): Result.001 file - promoters70/1020701
ataataaaa

SEQ ID NO: 80869 - DNA, 9 bp, Unknown
  misc_feature (1)..( 9): Result.001 file - promoters70/1020701
ataagaaaa

SEQ ID NO: 80870 - DNA, 8 bp, Unknown
  misc_feature (1)..( 8): Result.001 file - promoters70/1020701
gaatttct

SEQ ID NO: 80871 - DNA, 8 bp, Unknown
  misc_feature (1)..( 8): Result.001 file - promoters70/1020701
aaatatct

SEQ ID NO: 80872 - DNA, 8 bp, Unknown
  misc_feature (1)..( 8): Result.001 file - promoters70/1020701
aaatatcc

SEQ ID NO: 80873 - DNA, 7 bp, Unknown
  misc_feature (1)..( 7): Result.001 file - promoters70/1020701
tatcata

SEQ ID NO: 80874 - DNA, 7 bp, Unknown
  misc_feature (1)..( 7): Result.001 file - promoters70/1020701
tattata

SEQ ID NO: 80875 - DNA, 7 bp, Unknown
  misc_feature (1)..( 7): Result.001 file - promoters70/1020701
aatcata

SEQ ID NO: 80876 - DNA, 8 bp, Unknown
  misc_feature (1)..( 8): Result.001 file - promoters70/1020701
taataaag

SEQ ID NO: 80877 - DNA, 8 bp, Unknown
  misc_feature (1)..( 8): Result.001 file - promoters70/1020701
taatcaag

SEQ ID NO: 80878 - DNA, 8 bp, Unknown
  misc_feature (1)..( 8): Result.001 file - promoters70/1020701
taacaaaa

SEQ ID NO: 80879 - DNA, 12 bp, Unknown
  misc_feature (1)..( 12): Result.001 file - promoters70/1020701
ataaattaatgc

SEQ ID NO: 80880 - DNA, 12 bp, Unknown
  misc_feature (1)..( 12): Result.001 file - promoters70/1020701
atatattaatgt

SEQ ID NO: 80881 - DNA, 12 bp, Unknown
  misc_feature (1)..( 12): Result.001 file - promoters70/1020786
tttggttattgt

SEQ ID NO: 80882 - DNA, 10 bp, Unknown
  misc_feature (1)..( 10): Result.001 file - promoters70/1020786
atttatttcg

SEQ ID NO: 80883 - DNA, 10 bp, Unknown
  misc_feature (1)..( 10): Result.001 file - promoters70/1020786
atttatgtcg

SEQ ID NO: 80884 - DNA, 10 bp, Unknown
  misc_feature (1)..( 10): Result.001 file - promoters70/1020786
ttttatttta

SEQ ID NO: 80885 - DNA, 10 bp, Unknown
  misc_feature (1)..( 10): Result.001 file - promoters70/1020786
acaaacggtc

SEQ ID NO: 80886 - DNA, 10 bp, Unknown
  misc_feature (1)..( 10): Result.001 file - promoters70/1020786
acaaactaat

SEQ ID NO: 80887 - DNA, 10 bp, Unknown
  misc_feature (1)..( 10): Result.001 file - promoters70/1020786
tcaaattaat

SEQ ID NO: 80888 - DNA, 6 bp, Unknown
  misc_feature (1)..( 6): Result.001 file - promoters70/1020786
tataaa

SEQ ID NO: 80889 - DNA, 6 bp, Unknown
  misc_feature (1)..( 6): Result.001 file - promoters70/1020786
tataaa

SEQ ID NO: 80890 - DNA, 6 bp, Unknown
  misc_feature (1)..( 6): Result.001 file - promoters70/1020786
tataaa

SEQ ID NO: 80891 - DNA, 6 bp, Unknown
  misc_feature (1)..( 6): Result.001 file - promoters70/1020786
tataaa

SEQ ID NO: 80892 - DNA, 10 bp, Unknown
  misc_feature (1)..( 10): Result.001 file - promoters70/1020786
ataagattag

SEQ ID NO: 80893 - DNA, 10 bp, Unknown
  misc_feature (1)..( 10): Result.001 file - promoters70/1020786
ttaagatctt

SEQ ID NO: 80894 - DNA, 10 bp, Unknown
  misc_feature (1)..( 10): Result.001 file - promoters70/1020786
ttaagaactt

SEQ ID NO: 80895 - DNA, 10 bp, Unknown
  misc_feature (1)..( 10): Result.001 file - promoters70/1020786
ccaaaaacag

SEQ ID NO: 80896 - DNA, 10 bp, Unknown
  misc_feature (1)..( 10): Result.001 file - promoters70/1020786
tcaaaaaact

SEQ ID NO: 80897 - DNA, 10 bp, Unknown
  misc_feature (1)..( 10): Result.001 file - promoters70/1020786
gcaaaaatta

SEQ ID NO: 80898 - DNA, 10 bp, Unknown
  misc_feature (1)..( 10): Result.001 file - promoters70/1020786
gcaaagatta

SEQ ID NO: 80899 - DNA, 14 bp, Unknown
  misc_feature (1)..( 14): Result.001 file - promoters70/1020786
cacaacattgcttc

SEQ ID NO: 80900 - DNA, 14 bp, Unknown
  misc_feature (1)..( 14): Result.001 file - promoters70/1020786
aacaacaaaaaaag

SEQ ID NO: 80901 - DNA, 14 bp, Unknown
  misc_feature (1)..( 14): Result.001 file - promoters70/1020786
aacgacaaaacaag

SEQ ID NO: 80902 - DNA, 14 bp, Unknown
  misc_feature (1)..( 14): Result.001 file - promoters70/1020786
atcaacaaaaattg

SEQ ID NO: 80903 - DNA, 10 bp, Unknown
  misc_feature (1)..( 10): Result.001 file - promoters70/1020786
gcttcgtaga

SEQ ID NO: 80904 - DNA, 10 bp, Unknown
  misc_feature (1)..( 10): Result.001 file - promoters70/1020786
aaatcgaaga

SEQ ID NO: 80905 - DNA, 10 bp, Unknown
  misc_feature (1)..( 10): Result.001 file - promoters70/1020786
aaattgaaaa

SEQ ID NO: 80906 - DNA, 10 bp, Unknown
  misc_feature (1)..( 10): Result.001 file - promoters70/1020786
atctactcta

SEQ ID NO: 80907 - DNA, 10 bp, Unknown
  misc_feature (1)..( 10): Result.001 file - promoters70/1020786
ttttactctc

SEQ ID NO: 80908 - DNA, 10 bp, Unknown
  misc_feature (1)..( 10): Result.001 file - promoters70/1020786
actttctctc

SEQ ID NO: 80909 - DNA, 8 bp, Unknown
  misc_feature (1)..( 8): Result.001 file - promoters70/1020786
cctctata

SEQ ID NO: 80910 - DNA, 8 bp, Unknown
  misc_feature (1)..( 8): Result.001 file - promoters70/1020786
cctttata

SEQ ID NO: 80911 - DNA, 8 bp, Unknown
  misc_feature (1)..( 8): Result.001 file - promoters70/1020786
cctatata

SEQ ID NO: 80912 - DNA, 9 bp, Unknown
  misc_feature (1)..( 9): Result.001 file - promoters70/1020786
agacaaaac

SEQ ID NO: 80913 - DNA, 9 bp, Unknown
  misc_feature (1)..( 9): Result.001 file - promoters70/1020786
caacaaaaa

SEQ ID NO: 80914 - DNA, 9 bp, Unknown
  misc_feature (1)..( 9): Result.001 file - promoters70/1020786
caacaaaaa

SEQ ID NO: 80915 - DNA, 7 bp, Unknown
  misc_feature (1)..( 7): Result.001 file - promoters70/1020786
agaaatg

SEQ ID NO: 80916 - DNA, 7 bp, Unknown
  misc_feature (1)..( 7): Result.001 file - promoters70/1020786
agaaatg

SEQ ID NO: 80917 - DNA, 7 bp, Unknown
  misc_feature (1)..( 7): Result.001 file - promoters70/1020818
aaaaaaa

SEQ ID NO: 80918 - DNA, 13 bp, Unknown
  misc_feature (1)..( 13): Result.001 file - promoters70/1020818
aactttttttctt

SEQ ID NO: 80919 - DNA, 13 bp, Unknown
  misc_feature (1)..( 13): Result.001 file - promoters70/1020818
ataatttttcctt

SEQ ID NO: 80920 - DNA, 13 bp, Unknown
  misc_feature (1)..( 13): Result.001 file - promoters70/1020818
ataatgtttgagt

SEQ ID NO: 80921 - DNA, 11 bp, Unknown
  misc_feature (1)..( 11): Result.001 file - promoters70/1020818
caaaaattaag

SEQ ID NO: 80922 - DNA, 11 bp, Unknown
  misc_feature (1)..( 11): Result.001 file - promoters70/1020818
caataattttt

SEQ ID NO: 80923 - DNA, 11 bp, Unknown
  misc_feature (1)..( 11): Result.001 file - promoters70/1020818
acataatgttt

SEQ ID NO: 80924 - DNA, 10 bp, Unknown
  misc_feature (1)..( 10): Result.001 file - promoters70/1020818
taaaaaagaa

SEQ ID NO: 80925 - DNA, 10 bp, Unknown
  misc_feature (1)..( 10): Result.001 file - promoters70/1020818
taaaaaaggg

SEQ ID NO: 80926 - DNA, 10 bp, Unknown
  misc_feature (1)..( 10): Result.001 file - promoters70/1020863
tataaaagaa

SEQ ID NO: 80927 - DNA, 11 bp, Unknown
  misc_feature (1)..( 11): Result.001 file - promoters70/1020863
gaaaatattaa

SEQ ID NO: 80928 - DNA, 11 bp, Unknown
  misc_feature (1)..( 11): Result.001 file - promoters70/1020863
ttaaaaattaa

SEQ ID NO: 80929 - DNA, 11 bp, Unknown
  misc_feature (1)..( 11): Result.001 file - promoters70/1020863
ggtaaaatttc

SEQ ID NO: 80930 - DNA, 11 bp, Unknown
  misc_feature (1)..( 11): Result.001 file - promoters70/1020863
gtaacaattct

SEQ ID NO: 80931 - DNA, 11 bp, Unknown
  misc_feature (1)..( 11): Result.001 file - promoters70/1020863
ggaacaagtct

SEQ ID NO: 80932 - DNA, 11 bp, Unknown
  misc_feature (1)..( 11): Result.001 file - promoters70/1020863
ttaacaaaaaa

SEQ ID NO: 80933 - DNA, 11 bp, Unknown
  misc_feature (1)..( 11): Result.001 file - promoters70/1020863
ggagcaataga

SEQ ID NO: 80934 - DNA, 8 bp, Unknown
  misc_feature (1)..( 8): Result.001 file - promoters70/1020863
aaaacaaa

SEQ ID NO: 80935 - DNA, 8 bp, Unknown
  misc_feature (1)..( 8): Result.001 file - promoters70/1020863
taaataaa

SEQ ID NO: 80936 - DNA, 8 bp, Unknown
  misc_feature (1)..( 8): Result.001 file - promoters70/1020863
caaacaaa

SEQ ID NO: 80937 - DNA, 8 bp, Unknown
  misc_feature (1)..( 8): Result.001 file - promoters70/1020863
taaaaaaa

SEQ ID NO: 80938 - DNA, 8 bp, Unknown
  misc_feature (1)..( 8): Result.001 file - promoters70/1020863
catacata

SEQ ID NO: 80939 - DNA, 8 bp, Unknown
  misc_feature (1)..( 8): Result.001 file - promoters70/1020863
taactaat

SEQ ID NO: 80940 - DNA, 12 bp, Unknown
  misc_feature (1)..( 12): Result.001 file - promoters70/1020863
gtttgtttaaca

SEQ ID NO: 80941 - DNA, 12 bp, Unknown
  misc_feature (1)..( 12): Result.001 file - promoters70/1020863
ttttatttcttt

SEQ ID NO: 80942 - DNA, 12 bp, Unknown
  misc_feature (1)..( 12): Result.001 file - promoters70/1020863
ttttgtttctgg

SEQ ID NO: 80943 - DNA, 12 bp, Unknown
  misc_feature (1)..( 12): Result.001 file - promoters70/1020863
ttctgtttcaca

SEQ ID NO: 80944 - DNA, 12 bp, Unknown
  misc_feature (1)..( 12): Result.001 file - promoters70/1020863
atatgtctgcgc

SEQ ID NO: 80945 - DNA, 12 bp, Unknown
  misc_feature (1)..( 12): Result.001 file - promoters70/1020940
ttttataatgat

SEQ ID NO: 80946 - DNA, 8 bp, Unknown
  misc_feature (1)..( 8): Result.001 file - promoters70/1020940
taaaatgt

SEQ ID NO: 80947 - DNA, 8 bp, Unknown
  misc_feature (1)..( 8): Result.001 file - promoters70/1020940
taaaattg

SEQ ID NO: 80948 - DNA, 8 bp, Unknown
  misc_feature (1)..( 8): Result.001 file - promoters70/1020940
taagattg

SEQ ID NO: 80949 - DNA, 8 bp, Unknown
  misc_feature (1)..( 8): Result.001 file - promoters70/1020940
aaaataga

SEQ ID NO: 80950 - DNA, 8 bp, Unknown
  misc_feature (1)..( 8): Result.001 file - promoters70/1020940
aaaaaaga

SEQ ID NO: 80951 - DNA, 8 bp, Unknown
  misc_feature (1)..( 8): Result.001 file - promoters70/1020940
taaataaa

SEQ ID NO: 80952 - DNA, 8 bp, Unknown
  misc_feature (1)..( 8): Result.001 file - promoters70/1020940
caacaaaa

SEQ ID NO: 80953 - DNA, 8 bp, Unknown
  misc_feature (1)..( 8): Result.001 file - promoters70/1020940
aaacaaag

SEQ ID NO: 80954 - DNA, 8 bp, Unknown
  misc_feature (1)..( 8): Result.001 file - promoters70/1020940
aaataaag

SEQ ID NO: 80955 - DNA, 7 bp, Unknown
  misc_feature (1)..( 7): Result.001 file - promoters70/1020940
aaattaa

SEQ ID NO: 80956 - DNA, 7 bp, Unknown
  misc_feature (1)..( 7): Result.001 file - promoters70/1020940
aaattat

SEQ ID NO: 80957 - DNA, 7 bp, Unknown
  misc_feature (1)..( 7): Result.001 file - promoters70/1020940
aaatatt

SEQ ID NO: 80958 - DNA, 10 bp, Unknown
  misc_feature (1)..( 10): Result.001 file - promoters70/1020940
tatatatacc

SEQ ID NO: 80959 - DNA, 10 bp, Unknown
  misc_feature (1)..( 10): Result.001 file - promoters70/1020940
tatataaacc

SEQ ID NO: 80960 - DNA, 10 bp, Unknown
  misc_feature (1)..( 10): Result.001 file - promoters70/1021079
tatttaaaca

SEQ ID NO: 80961 - DNA, 11 bp, Unknown
  misc_feature (1)..( 11): Result.001 file - promoters70/1021079
ttgaaacacca

SEQ ID NO: 80962 - DNA, 11 bp, Unknown
  misc_feature (1)..( 11): Result.001 file - promoters70/1021079
ttgatacacat

SEQ ID NO: 80963 - DNA, 11 bp, Unknown
  misc_feature (1)..( 11): Result.001 file - promoters70/1021079
gttttactcat

SEQ ID NO: 80964 - DNA, 12 bp, Unknown
  misc_feature (1)..( 12): Result.001 file - promoters70/1021079
agggaaacctaa

SEQ ID NO: 80965 - DNA, 12 bp, Unknown
  misc_feature (1)..( 12): Result.001 file - promoters70/1021079
aggaaaacataa

SEQ ID NO: 80966 - DNA, 12 bp, Unknown
  misc_feature (1)..( 12): Result.001 file - promoters70/1021079
aagtaaaaatac

SEQ ID NO: 80967 - DNA, 9 bp, Unknown
  misc_feature (1)..( 9): Result.001 file - promoters70/1021079
aaaattttg

SEQ ID NO: 80968 - DNA, 9 bp, Unknown
  misc_feature (1)..( 9): Result.001 file - promoters70/1021079
aaaatttat

SEQ ID NO: 80969 - DNA, 9 bp, Unknown
  misc_feature (1)..( 9): Result.001 file - promoters70/1021079
aaaattttg

SEQ ID NO: 80970 - DNA, 8 bp, Unknown
  misc_feature (1)..( 8): Result.001 file - promoters70/1021079
agtaaaat

SEQ ID NO: 80971 - DNA, 8 bp, Unknown
  misc_feature (1)..( 8): Result.001 file - promoters70/1021079
agtaaaaa

SEQ ID NO: 80972 - DNA, 8 bp, Unknown
  misc_feature (1)..( 8): Result.001 file - promoters70/1021079
aataaaat

SEQ ID NO: 80973 - DNA, 7 bp, Unknown
  misc_feature (1)..( 7): Result.001 file - promoters70/1021079
taaaata

SEQ ID NO: 80974 - DNA, 7 bp, Unknown
  misc_feature (1)..( 7): Result.001 file - promoters70/1021079
aaaaata

SEQ ID NO: 80975 - DNA, 7 bp, Unknown
  misc_feature (1)..( 7): Result.001 file - promoters70/1021079
taaaatc

SEQ ID NO: 80976 - DNA, 8 bp, Unknown
  misc_feature (1)..( 8): Result.001 file - promoters70/1021079
aaaacata

SEQ ID NO: 80977 - DNA, 9 bp, Unknown
  misc_feature (1)..( 9): Result.001 file - promoters70/1021079
cttaagata

SEQ ID NO: 80978 - DNA, 9 bp, Unknown
  misc_feature (1)..( 9): Result.001 file - promoters70/1021079
tttaatata

SEQ ID NO: 80979 - DNA, 9 bp, Unknown
  misc_feature (1)..( 9): Result.001 file - promoters70/1021079
tttaattca

SEQ ID NO: 80980 - DNA, 8 bp, Unknown
  misc_feature (1)..( 8): Result.001 file - promoters70/1021079
taaaacca

SEQ ID NO: 80981 - DNA, 8 bp, Unknown
  misc_feature (1)..( 8): Result.001 file - promoters70/1021079
taaaacaa

SEQ ID NO: 80982 - DNA, 8 bp, Unknown
  misc_feature (1)..( 8): Result.001 file - promoters70/1021079
taatacaa

SEQ ID NO: 80983 - DNA, 11 bp, Unknown
  misc_feature (1)..( 11): Result.001 file - promoters70/1021079
cttaaatatca

SEQ ID NO: 80984 - DNA, 11 bp, Unknown
  misc_feature (1)..( 11): Result.001 file - promoters70/1021079
cttcaatctca

SEQ ID NO: 80985 - DNA, 11 bp, Unknown
  misc_feature (1)..( 11): Result.001 file - promoters70/1021079
tttaaataaaa

SEQ ID NO: 80986 - DNA, 9 bp, Unknown
  misc_feature (1)..( 9): Result.001 file - promoters70/1021079
tgagtgact

SEQ ID NO: 80987 - DNA, 9 bp, Unknown
  misc_feature (1)..( 9): Result.001 file - promoters70/1021079
tgaatgatt

SEQ ID NO: 80988 - DNA, 9 bp, Unknown
  misc_feature (1)..( 9): Result.001 file - promoters70/1021079
ccaattatt

SEQ ID NO: 80989 - DNA, 7 bp, Unknown
  misc_feature (1)..( 7): Result.001 file - promoters70/1021079
attagtg

SEQ ID NO: 80990 - DNA, 7 bp, Unknown
  misc_feature (1)..( 7): Result.001 file - promoters70/1021079
tttagtg

SEQ ID NO: 80991 - DNA, 8 bp, Unknown
  misc_feature (1)..( 8): Result.001 file - promoters70/1021104
tttaagtt

SEQ ID NO: 80992 - DNA, 9 bp, Unknown
  misc_feature (1)..( 9): Result.001 file - promoters70/1021104
aatttaacc

SEQ ID NO: 80993 - DNA, 9 bp, Unknown
  misc_feature (1)..( 9): Result.001 file - promoters70/1021104
attttgacc

SEQ ID NO: 80994 - DNA, 9 bp, Unknown
  misc_feature (1)..( 9): Result.001 file - promoters70/1021104
attttgatt

SEQ ID NO: 80995 - DNA, 8 bp, Unknown
  misc_feature (1)..( 8): Result.001 file - promoters70/1021104
acttcata

SEQ ID NO: 80996 - DNA, 8 bp, Unknown
  misc_feature (1)..( 8): Result.001 file - promoters70/1021104
cattcata

SEQ ID NO: 80997 - DNA, 8 bp, Unknown
  misc_feature (1)..( 8): Result.001 file - promoters70/1021104
cattcatc

SEQ ID NO: 80998 - DNA, 7 bp, Unknown
  misc_feature (1)..( 7): Result.001 file - promoters70/1021104
ttcttcc

SEQ ID NO: 80999 - DNA, 7 bp, Unknown
  misc_feature (1)..( 7): Result.001 file - promoters70/1021104
ttcttct

SEQ ID NO: 81000 - DNA, 7 bp, Unknown
  misc_feature (1)..( 7): Result.001 file - promoters70/1021104
ttcctct

SEQ ID NO: 81001 - DNA, 10 bp, Unknown
  misc_feature (1)..( 10): Result.001 file - promoters70/1021104
tcttcattta

SEQ ID NO: 81002 - DNA, 10 bp, Unknown
  misc_feature (1)..( 10): Result.001 file - promoters70/1021104
aattcaatta

SEQ ID NO: 81003 - DNA, 10 bp, Unknown
  misc_feature (1)..( 10): Result.001 file - promoters70/1021218
tcttcattgt

SEQ ID NO: 81004 - DNA, 12 bp, Unknown
  misc_feature (1)..( 12): Result.001 file - promoters70/1021218
agagagaaagaa

SEQ ID NO: 81005 - DNA, 12 bp, Unknown
  misc_feature (1)..( 12): Result.001 file - promoters70/1021218
taagaaaaaccc

SEQ ID NO: 81006 - DNA, 12 bp, Unknown
  misc_feature (1)..( 12): Result.001 file - promoters70/1021218
aaagaaaaaatt

SEQ ID NO: 81007 - DNA, 12 bp, Unknown
  misc_feature (1)..( 12): Result.001 file - promoters70/1021218
aaataaaacatt

SEQ ID NO: 81008 - DNA, 8 bp, Unknown
  misc_feature (1)..( 8): Result.001 file - promoters70/1021218
ttgacttt

SEQ ID NO: 81009 - DNA, 8 bp, Unknown
  misc_feature (1)..( 8): Result.001 file - promoters70/1021218
ttgaattt

SEQ ID NO: 81010 - DNA, 8 bp, Unknown
  misc_feature (1)..( 8): Result.001 file - promoters70/1021218
ttgaatga

SEQ ID NO: 81011 - DNA, 10 bp, Unknown
  misc_feature (1)..( 10): Result.001 file - promoters70/1021218
gtatctaaga

SEQ ID NO: 81012 - DNA, 10 bp, Unknown
  misc_feature (1)..( 10): Result.001 file - promoters70/1021218
atttcttaga

SEQ ID NO: 81013 - DNA, 10 bp, Unknown
  misc_feature (1)..( 10): Result.001 file - promoters70/1021218
attttttata

SEQ ID NO: 81014 - DNA, 9 bp, Unknown
  misc_feature (1)..( 9): Result.001 file - promoters70/1021218
gtaagagag

SEQ ID NO: 81015 - DNA, 9 bp, Unknown
  misc_feature (1)..( 9): Result.001 file - promoters70/1021218
gtaagaaaa

SEQ ID NO: 81016 - DNA, 9 bp, Unknown
  misc_feature (1)..( 9): Result.001 file - promoters70/1021218
ttaagaaaa

SEQ ID NO: 81017 - DNA, 8 bp, Unknown
  misc_feature (1)..( 8): Result.001 file - promoters70/1021218
aaagaaag

SEQ ID NO: 81018 - DNA, 8 bp, Unknown
  misc_feature (1)..( 8): Result.001 file - promoters70/1021218
taagaaaa

SEQ ID NO: 81019 - DNA, 8 bp, Unknown
  misc_feature (1)..( 8): Result.001 file - promoters70/1021218
aaataaaa

SEQ ID NO: 81020 - DNA, 8 bp, Unknown
  misc_feature (1)..( 8): Result.001 file - promoters70/1021218
taagaaaa

SEQ ID NO: 81021 - DNA, 9 bp, Unknown
  misc_feature (1)..( 9): Result.001 file - promoters70/1021218
gtttaaacg

SEQ ID NO: 81022 - DNA, 9 bp, Unknown
  misc_feature (1)..( 9): Result.001 file - promoters70/1021218
gttcaaacg

SEQ ID NO: 81023 - DNA, 9 bp, Unknown
  misc_feature (1)..( 9): Result.001 file - promoters70/1021218
tactaaacg

SEQ ID NO: 81024 - DNA, 9 bp, Unknown
  misc_feature (1)..( 9): Result.001 file - promoters70/1021218
attagaaac

SEQ ID NO: 81025 - DNA, 9 bp, Unknown
  misc_feature (1)..( 9): Result.001 file - promoters70/1021218
attcgaaaa

SEQ ID NO: 81026 - DNA, 9 bp, Unknown
  misc_feature (1)..( 9): Result.001 file - promoters70/1021218
tttctaaaa

SEQ ID NO: 81027 - DNA, 8 bp, Unknown
  misc_feature (1)..( 8): Result.001 file - promoters70/1021218
attcttat

SEQ ID NO: 81028 - DNA, 8 bp, Unknown
  misc_feature (1)..( 8): Result.001 file - promoters70/1021218
tttcctat

SEQ ID NO: 81029 - DNA, 8 bp, Unknown
  misc_feature (1)..( 8): Result.001 file - promoters70/1021218
tttactac

SEQ ID NO: 81030 - DNA, 12 bp, Unknown
  misc_feature (1)..( 12): Result.001 file - promoters70/1021218
agtaaataaatg

SEQ ID NO: 81031 - DNA, 12 bp, Unknown
  misc_feature (1)..( 12): Result.001 file - promoters70/1021218
atataatcaatg

SEQ ID NO: 81032 - DNA, 12 bp, Unknown
  misc_feature (1)..( 12): Result.001 file - promoters70/1021218
agtaaataaaac

SEQ ID NO: 81033 - DNA, 12 bp, Unknown
  misc_feature (1)..( 12): Result.001 file - promoters70/1021218
tcaccaaacaat

SEQ ID NO: 81034 - DNA, 12 bp, Unknown
  misc_feature (1)..( 12): Result.001 file - promoters70/1021218
aaaccaaacatg

SEQ ID NO: 81035 - DNA, 12 bp, Unknown
  misc_feature (1)..( 12): Result.001 file - promoters70/1021218
aaactaaagatg

SEQ ID NO: 81036 - DNA, 13 bp, Unknown
  misc_feature (1)..( 13): Result.001 file - promoters70/1021218
taaagaattttct

SEQ ID NO: 81037 - DNA, 13 bp, Unknown
  misc_feature (1)..( 13): Result.001 file - promoters70/1021218
taaagatgacgtc

SEQ ID NO: 81038 - DNA, 13 bp, Unknown
  misc_feature (1)..( 13): Result.001 file - promoters70/1021438
caaaccaaacatg

SEQ ID NO: 81039 - DNA, 7 bp, Unknown
  misc_feature (1)..( 7): Result.001 file - promoters70/1021438
aaaagtt

SEQ ID NO: 81040 - DNA, 7 bp, Unknown
  misc_feature (1)..( 7): Result.001 file - promoters70/1021438
aaaagtc

SEQ ID NO: 81041 - DNA, 7 bp, Unknown
  misc_feature (1)..( 7): Result.001 file - promoters70/1021445
aaaatca

SEQ ID NO: 81042 - DNA, 8 bp, Unknown
  misc_feature (1)..( 8): Result.001 file - promoters70/1021445
gtttctat

SEQ ID NO: 81043 - DNA, 8 bp, Unknown
  misc_feature (1)..( 8): Result.001 file - promoters70/1021445
gttactag

SEQ ID NO: 81044 - DNA, 8 bp, Unknown
  misc_feature (1)..( 8): Result.001 file - promoters70/1021445
ctttttat

SEQ ID NO: 81045 - DNA, 9 bp, Unknown
  misc_feature (1)..( 9): Result.001 file - promoters70/1021445
ttttaaaaa

SEQ ID NO: 81046 - DNA, 9 bp, Unknown
  misc_feature (1)..( 9): Result.001 file - promoters70/1021445
aattaaaaa

SEQ ID NO: 81047 - DNA, 9 bp, Unknown
  misc_feature (1)..( 9): Result.001 file - promoters70/1021445
aatcaaact

SEQ ID NO: 81048 - DNA, 9 bp, Unknown
  misc_feature (1)..( 9): Result.001 file - promoters70/1021445
aatcaaata

SEQ ID NO: 81049 - DNA, 9 bp, Unknown
  misc_feature (1)..( 9): Result.001 file - promoters70/1021445
taaaagaaa

SEQ ID NO: 81050 - DNA, 9 bp, Unknown
  misc_feature (1)..( 9): Result.001 file - promoters70/1021445
aaaaaaaaa

SEQ ID NO: 81051 - DNA, 9 bp, Unknown
  misc_feature (1)..( 9): Result.001 file - promoters70/1021445
taataaatt

SEQ ID NO: 81052 - DNA, 12 bp, Unknown
  misc_feature (1)..( 12): Result.001 file - promoters70/1021445
ttgaaaacaaat

SEQ ID NO: 81053 - DNA, 12 bp, Unknown
  misc_feature (1)..( 12): Result.001 file - promoters70/1021445
taaaaaactaat

SEQ ID NO: 81054 - DNA, 12 bp, Unknown
  misc_feature (1)..( 12): Result.001 file - promoters70/1021445
taataaacatct

SEQ ID NO: 81055 - DNA, 8 bp, Unknown
  misc_feature (1)..( 8): Result.001 file - promoters70/1021445
tggaatat

SEQ ID NO: 81056 - DNA, 8 bp, Unknown
  misc_feature (1)..( 8): Result.001 file - promoters70/1021445
tggtataa

SEQ ID NO: 81057 - DNA, 8 bp, Unknown
  misc_feature (1)..( 8): Result.001 file - promoters70/1021445
atgaatat

SEQ ID NO: 81058 - DNA, 7 bp, Unknown
  misc_feature (1)..( 7): Result.001 file - promoters70/1021445
attaaaa

SEQ ID NO: 81059 - DNA, 7 bp, Unknown
  misc_feature (1)..( 7): Result.001 file - promoters70/1021445
attaaag

SEQ ID NO: 81060 - DNA, 7 bp, Unknown
  misc_feature (1)..( 7): Result.001 file - promoters70/1021445
attgaag

SEQ ID NO: 81061 - DNA, 7 bp, Unknown
  misc_feature (1)..( 7): Result.001 file - promoters70/1021445
agacgat

SEQ ID NO: 81062 - DNA, 7 bp, Unknown
  misc_feature (1)..( 7): Result.001 file - promoters70/1021445
agaagat

SEQ ID NO: 81063 - DNA, 7 bp, Unknown
  misc_feature (1)..( 7): Result.001 file - promoters70/1021445
tgaagat

SEQ ID NO: 81064 - DNA, 17 bp, Unknown
  misc_feature (1)..( 17): Result.001 file - promoters70/1021445
ttatcaaaacgccgcgt

SEQ ID NO: 81065 - DNA, 17 bp, Unknown
  misc_feature (1)..( 17): Result.001 file - promoters70/1021445
ctttataaacgctgcgt

SEQ ID NO: 81066 - DNA, 17 bp, Unknown
  misc_feature (1)..( 17): Result.001 file - promoters70/1021445
ctttataaactctgcat

SEQ ID NO: 81067 - DNA, 8 bp, Unknown
  misc_feature (1)..( 8): Result.001 file - promoters70/1021445
attttgtg

SEQ ID NO: 81068 - DNA, 8 bp, Unknown
  misc_feature (1)..( 8): Result.001 file - promoters70/1021445
attatgtt

SEQ ID NO: 81069 - DNA, 8 bp, Unknown
  misc_feature (1)..( 8): Result.001 file - promoters70/1021445
cttttgtg

SEQ ID NO: 81070 - DNA, 16 bp, Unknown
  misc_feature (1)..( 16): Result.001 file - promoters70/1021445
tctgcatctcccgtct

SEQ ID NO: 81071 - DNA, 16 bp, Unknown
  misc_feature (1)..( 16): Result.001 file - promoters70/1021445
tcttcatcatctcttt

SEQ ID NO: 81072 - DNA, 16 bp, Unknown
  misc_feature (1)..( 16): Result.001 file - promoters70/1021549
tctttataaacgctgc

SEQ ID NO: 81073 - DNA, 11 bp, Unknown
  misc_feature (1)..( 11): Result.001 file - promoters70/1021549
acatatatact

SEQ ID NO: 81074 - DNA, 11 bp, Unknown
  misc_feature (1)..( 11): Result.001 file - promoters70/1021549
gtatatatata

SEQ ID NO: 81075 - DNA, 11 bp, Unknown
  misc_feature (1)..( 11): Result.001 file - promoters70/1021549
tggtatataaa

SEQ ID NO: 81076 - DNA, 11 bp, Unknown
  misc_feature (1)..( 11): Result.001 file - promoters70/1021549
taatataaagg

SEQ ID NO: 81077 - DNA, 11 bp, Unknown
  misc_feature (1)..( 11): Result.001 file - promoters70/1021549
cactatttaaa

SEQ ID NO: 81078 - DNA, 11 bp, Unknown
  misc_feature (1)..( 11): Result.001 file - promoters70/1021549
ggttatttagt

SEQ ID NO: 81079 - DNA, 9 bp, Unknown
  misc_feature (1)..( 9): Result.001 file - promoters70/1021549
tctagttta

SEQ ID NO: 81080 - DNA, 9 bp, Unknown
  misc_feature (1)..( 9): Result.001 file - promoters70/1021549
aatagttta

SEQ ID NO: 81081 - DNA, 9 bp, Unknown
  misc_feature (1)..( 9): Result.001 file - promoters70/1021549
cataatttt

SEQ ID NO: 81082 - DNA, 9 bp, Unknown
  misc_feature (1)..( 9): Result.001 file - promoters70/1021549
tataatttt

SEQ ID NO: 81083 - DNA, 9 bp, Unknown
  misc_feature (1)..( 9): Result.001 file - promoters70/1021549
aatcgttga

SEQ ID NO: 81084 - DNA, 9 bp, Unknown
  misc_feature (1)..( 9): Result.001 file - promoters70/1021549
gatattttc

SEQ ID NO: 81085 - DNA, 12 bp, Unknown
  misc_feature (1)..( 12): Result.001 file - promoters70/1021549
agttgtacatat

SEQ ID NO: 81086 - DNA, 12 bp, Unknown
  misc_feature (1)..( 12): Result.001 file - promoters70/1021549
acaaatacataa

SEQ ID NO: 81087 - DNA, 12 bp, Unknown
  misc_feature (1)..( 12): Result.001 file - promoters70/1021549
agttatatatat

SEQ ID NO: 81088 - DNA, 12 bp, Unknown
  misc_feature (1)..( 12): Result.001 file - promoters70/1021549
gagcttagatat

SEQ ID NO: 81089 - DNA, 12 bp, Unknown
  misc_feature (1)..( 12): Result.001 file - promoters70/1021549
acagttgtataa

SEQ ID NO: 81090 - DNA, 12 bp, Unknown
  misc_feature (1)..( 12): Result.001 file - promoters70/1021862
atttttggatat

SEQ ID NO: 81091 - DNA, 7 bp, Unknown
  misc_feature (1)..( 7): Result.001 file - promoters70/1021862
aaatcgt

SEQ ID NO: 81092 - DNA, 7 bp, Unknown
  misc_feature (1)..( 7): Result.001 file - promoters70/1021862
taatcgt

SEQ ID NO: 81093 - DNA, 7 bp, Unknown
  misc_feature (1)..( 7): Result.001 file - promoters70/1021862
aaatcgt

SEQ ID NO: 81094 - DNA, 10 bp, Unknown
  misc_feature (1)..( 10): Result.001 file - promoters70/1021862
catttaagtt

SEQ ID NO: 81095 - DNA, 10 bp, Unknown
  misc_feature (1)..( 10): Result.001 file - promoters70/1021862
catataaaca

SEQ ID NO: 81096 - DNA, 10 bp, Unknown
  misc_feature (1)..( 10): Result.001 file - promoters70/1021862
tatttgagtt

SEQ ID NO: 81097 - DNA, 9 bp, Unknown
  misc_feature (1)..( 9): Result.001 file - promoters70/1021862
aaattttca

SEQ ID NO: 81098 - DNA, 9 bp, Unknown
  misc_feature (1)..( 9): Result.001 file - promoters70/1021862
taatattca

SEQ ID NO: 81099 - DNA, 9 bp, Unknown
  misc_feature (1)..( 9): Result.001 file - promoters70/1021862
aaatttaaa

SEQ ID NO: 81100 - DNA, 8 bp, Unknown
  misc_feature (1)..( 8): Result.001 file - promoters70/1021862
aaacttcc

SEQ ID NO: 81101 - DNA, 8 bp, Unknown
  misc_feature (1)..( 8): Result.001 file - promoters70/1021862
aaaattcc

SEQ ID NO: 81102 - DNA, 8 bp, Unknown
  misc_feature (1)..( 8): Result.001 file - promoters70/1021862
aaacttta

SEQ ID NO: 81103 - DNA, 6 bp, Unknown
  misc_feature (1)..( 6): Result.001 file - promoters70/1021862
taaaat

SEQ ID NO: 81104 - DNA, 6 bp, Unknown
  misc_feature (1)..( 6): Result.001 file - promoters70/1021862
taaaat

SEQ ID NO: 81105 - DNA, 6 bp, Unknown
  misc_feature (1)..( 6): Result.001 file - promoters70/1021870
taaaat

SEQ ID NO: 81106 - DNA, 9 bp, Unknown
  misc_feature (1)..( 9): Result.001 file - promoters70/1021870
aaaatcgta

SEQ ID NO: 81107 - DNA, 9 bp, Unknown
  misc_feature (1)..( 9): Result.001 file - promoters70/1021870
aaaatctgg

SEQ ID NO: 81108 - DNA, 9 bp, Unknown
  misc_feature (1)..( 9): Result.001 file - promoters70/1021870
taaatttgg

SEQ ID NO: 81109 - DNA, 8 bp, Unknown
  misc_feature (1)..( 8): Result.001 file - promoters70/1021870
ccaaaatc

SEQ ID NO: 81110 - DNA, 8 bp, Unknown
  misc_feature (1)..( 8): Result.001 file - promoters70/1021870
ccataatt

SEQ ID NO: 81111 - DNA, 8 bp, Unknown
  misc_feature (1)..( 8): Result.001 file - promoters70/1021952
aaataatt

SEQ ID NO: 81112 - DNA, 13 bp, Unknown
  misc_feature (1)..( 13): Result.001 file - promoters70/1021952
tcataaatcacaa

SEQ ID NO: 81113 - DNA, 13 bp, Unknown
  misc_feature (1)..( 13): Result.001 file - promoters70/1021952
tcattaatccttg

SEQ ID NO: 81114 - DNA, 13 bp, Unknown
  misc_feature (1)..( 13): Result.001 file - promoters70/1021952
aatgaaatcatgt

SEQ ID NO: 81115 - DNA, 13 bp, Unknown
  misc_feature (1)..( 13): Result.001 file - promoters70/1021952
cattccatcctta

SEQ ID NO: 81116 - DNA, 13 bp, Unknown
  misc_feature (1)..( 13): Result.001 file - promoters70/1021952
ttattaatgaatg

SEQ ID NO: 81117 - DNA, 13 bp, Unknown
  misc_feature (1)..( 13): Result.001 file - promoters70/1021968
ctaaaaatccttg

SEQ ID NO: 81118 - DNA, 13 bp, Unknown
  misc_feature (1)..( 13): Result.001 file - promoters70/1021968
tcaacaatgtaca

SEQ ID NO: 81119 - DNA, 13 bp, Unknown
  misc_feature (1)..( 13): Result.001 file - promoters70/1021968
ccaataatttaca

SEQ ID NO: 81120 - DNA, 13 bp, Unknown
  misc_feature (1)..( 13): Result.001 file - promoters70/1021968
gtaaaaataagaa

SEQ ID NO: 81121 - DNA, 13 bp, Unknown
  misc_feature (1)..( 13): Result.001 file - promoters70/1021968
ttgaaaatttata

SEQ ID NO: 81122 - DNA, 10 bp, Unknown
  misc_feature (1)..( 10): Result.001 file - promoters70/1021968
taataacatc

SEQ ID NO: 81123 - DNA, 10 bp, Unknown
  misc_feature (1)..( 10): Result.001 file - promoters70/1021968
aaataacaaa

SEQ ID NO: 81124 - DNA, 10 bp, Unknown
  misc_feature (1)..( 10): Result.001 file - promoters70/1021968
aaataagaaa

SEQ ID NO: 81125 - DNA, 9 bp, Unknown
  misc_feature (1)..( 9): Result.001 file - promoters70/1021968
aaaaaatta

SEQ ID NO: 81126 - DNA, 9 bp, Unknown
  misc_feature (1)..( 9): Result.001 file - promoters70/1021968
aaataattc

SEQ ID NO: 81127 - DNA, 9 bp, Unknown
  misc_feature (1)..( 9): Result.001 file - promoters70/1021968
acttaattc

SEQ ID NO: 81128 - DNA, 8 bp, Unknown
  misc_feature (1)..( 8): Result.001 file - promoters70/1021968
gtattttt

SEQ ID NO: 81129 - DNA, 8 bp, Unknown
  misc_feature (1)..( 8): Result.001 file - promoters70/1021968
gtatgttt

SEQ ID NO: 81130 - DNA, 8 bp, Unknown
  misc_feature (1)..( 8): Result.001 file - promoters70/1021968
atattttt

SEQ ID NO: 81131 - DNA, 9 bp, Unknown
  misc_feature (1)..( 9): Result.001 file - promoters70/1021968
cttaagtca

SEQ ID NO: 81132 - DNA, 9 bp, Unknown
  misc_feature (1)..( 9): Result.001 file - promoters70/1021968
cttaattca

SEQ ID NO: 81133 - DNA, 9 bp, Unknown
  misc_feature (1)..( 9): Result.001 file - promoters70/1021968
aataattct

SEQ ID NO: 81134 - DNA, 9 bp, Unknown
  misc_feature (1)..( 9): Result.001 file - promoters70/1021968
gaaaaaaat

SEQ ID NO: 81135 - DNA, 9 bp, Unknown
  misc_feature (1)..( 9): Result.001 file - promoters70/1021968
ataaaaaat

SEQ ID NO: 81136 - DNA, 9 bp, Unknown
  misc_feature (1)..( 9): Result.001 file - promoters70/1021987
atacaaact

SEQ ID NO: 81137 - DNA, 9 bp, Unknown
  misc_feature (1)..( 9): Result.001 file - promoters70/1021987
ttttggttt

SEQ ID NO: 81138 - DNA, 9 bp, Unknown
  misc_feature (1)..( 9): Result.001 file - promoters70/1021987
atttgattt

SEQ ID NO: 81139 - DNA, 9 bp, Unknown
  misc_feature (1)..( 9): Result.001 file - promoters70/1022245
atttaattt

SEQ ID NO: 81140 - DNA, 7 bp, Unknown
  misc_feature (1)..( 7): Result.001 file - promoters70/1022245
aaaatca

SEQ ID NO: 81141 - DNA, 7 bp, Unknown
  misc_feature (1)..( 7): Result.001 file - promoters70/1022245
aaaatcc

SEQ ID NO: 81142 - DNA, 7 bp, Unknown
  misc_feature (1)..( 7): Result.001 file - promoters70/1022296
aaagtca

SEQ ID NO: 81143 - DNA, 10 bp, Unknown
  misc_feature (1)..( 10): Result.001 file - promoters70/1022296
cagaaggaaa

SEQ ID NO: 81144 - DNA, 10 bp, Unknown
  misc_feature (1)..( 10): Result.001 file - promoters70/1022296
cagatggaat

SEQ ID NO: 81145 - DNA, 10 bp, Unknown
  misc_feature (1)..( 10): Result.001 file - promoters70/1022296
acaatggaat

SEQ ID NO: 81146 - DNA, 7 bp, Unknown
  misc_feature (1)..( 7): Result.001 file - promoters70/1022296
tatttag

SEQ ID NO: 81147 - DNA, 7 bp, Unknown
  misc_feature (1)..( 7): Result.001 file - promoters70/1022296
tatttat

SEQ ID NO: 81148 - DNA, 7 bp, Unknown
  misc_feature (1)..( 7): Result.001 file - promoters70/1022296
tatatat

SEQ ID NO: 81149 - DNA, 9 bp, Unknown
  misc_feature (1)..( 9): Result.001 file - promoters70/1022296
ttgaaatcg

SEQ ID NO: 81150 - DNA, 9 bp, Unknown
  misc_feature (1)..( 9): Result.001 file - promoters70/1022296
ttgtaattt

SEQ ID NO: 81151 - DNA, 9 bp, Unknown
  misc_feature (1)..( 9): Result.001 file - promoters70/1022324
gtgtcattt

SEQ ID NO: 81152 - DNA, 12 bp, Unknown
  misc_feature (1)..( 12): Result.001 file - promoters70/1022324
aaaaaagttatg

SEQ ID NO: 81153 - DNA, 12 bp, Unknown
  misc_feature (1)..( 12): Result.001 file - promoters70/1022324
tcaaaagttatg

SEQ ID NO: 81154 - DNA, 12 bp, Unknown
  misc_feature (1)..( 12): Result.001 file - promoters70/1022324
accaaagaaagg

SEQ ID NO: 81155 - DNA, 12 bp, Unknown
  misc_feature (1)..( 12): Result.001 file - promoters70/1022324
aaaaaagtataa

SEQ ID NO: 81156 - DNA, 12 bp, Unknown
  misc_feature (1)..( 12): Result.001 file - promoters70/1022324
atcaaacaaatc

SEQ ID NO: 81157 - DNA, 12 bp, Unknown
  misc_feature (1)..( 12): Result.001 file - promoters70/1022364
cacaacgaataa

SEQ ID NO: 81158 - DNA, 12 bp, Unknown
  misc_feature (1)..( 12): Result.001 file - promoters70/1022364
gttgattgatag

SEQ ID NO: 81159 - DNA, 12 bp, Unknown
  misc_feature (1)..( 12): Result.001 file - promoters70/1022364
tgtctttgttag

SEQ ID NO: 81160 - DNA, 12 bp, Unknown
  misc_feature (1)..( 12): Result.001 file - promoters70/1022364
aatcgttgatac

SEQ ID NO: 81161 - DNA, 12 bp, Unknown
  misc_feature (1)..( 12): Result.001 file - promoters70/1022364
tgtgagtgattc

SEQ ID NO: 81162 - DNA, 12 bp, Unknown
  misc_feature (1)..( 12): Result.001 file - promoters70/1022364
gaattttgtttt

SEQ ID NO: 81163 - DNA, 12 bp, Unknown
  misc_feature (1)..( 12): Result.001 file - promoters70/1022662
gaactttggttt

SEQ ID NO: 81164 - DNA, 11 bp, Unknown
  misc_feature (1)..( 11): Result.001 file - promoters70/1022662
ccatttgtaaa

SEQ ID NO: 81165 - DNA, 11 bp, Unknown
  misc_feature (1)..( 11): Result.001 file - promoters70/1022662
ttttttgtatc

SEQ ID NO: 81166 - DNA, 11 bp, Unknown
  misc_feature (1)..( 11): Result.001 file - promoters70/1022662
atctttataaa

SEQ ID NO: 81167 - DNA, 11 bp, Unknown
  misc_feature (1)..( 11): Result.001 file - promoters70/1022662
attcttgtaac

SEQ ID NO: 81168 - DNA, 11 bp, Unknown
  misc_feature (1)..( 11): Result.001 file - promoters70/1022662
atctttattta

SEQ ID NO: 81169 - DNA, 14 bp, Unknown
  misc_feature (1)..( 14): Result.001 file - promoters70/1022662
aaccttatctttat

SEQ ID NO: 81170 - DNA, 14 bp, Unknown
  misc_feature (1)..( 14): Result.001 file - promoters70/1022662
atatgtattttttg

SEQ ID NO: 81171 - DNA, 14 bp, Unknown
  misc_feature (1)..( 14): Result.001 file - promoters70/1022662
gtaaaaatctttat

SEQ ID NO: 81172 - DNA, 14 bp, Unknown
  misc_feature (1)..( 14): Result.001 file - promoters70/1022662
tttcatgtgtttga

SEQ ID NO: 81173 - DNA, 14 bp, Unknown
  misc_feature (1)..( 14): Result.001 file - promoters70/1022748
gtaaaaaacttaaa

SEQ ID NO: 81174 - DNA, 16 bp, Unknown
  misc_feature (1)..( 16): Result.001 file - promoters70/1022748
tcttttgagaaagttc

SEQ ID NO: 81175 - DNA, 16 bp, Unknown
  misc_feature (1)..( 16): Result.001 file - promoters70/1022748
gagatgtgcaaagttg

SEQ ID NO: 81176 - DNA, 16 bp, Unknown
  misc_feature (1)..( 16): Result.001 file - promoters70/1022748
tcaaaaaaaaaagttt

SEQ ID NO: 81177 - DNA, 17 bp, Unknown
  misc_feature (1)..( 17): Result.001 file - promoters70/1022748
tgtgcagaaaatagttt

SEQ ID NO: 81178 - DNA, 17 bp, Unknown
  misc_feature (1)..( 17): Result.001 file - promoters70/1022748
aatctcgactttagttt

SEQ ID NO: 81179 - DNA, 17 bp, Unknown
  misc_feature (1)..( 17): Result.001 file - promoters70/1022764
tgtacagaaaatattga

SEQ ID NO: 81180 - DNA, 7 bp, Unknown
  misc_feature (1)..( 7): Result.001 file - promoters70/1022764
tttatat

SEQ ID NO: 81181 - DNA, 7 bp, Unknown
  misc_feature (1)..( 7): Result.001 file - promoters70/1022764
tttatat

SEQ ID NO: 81182 - DNA, 7 bp, Unknown
  misc_feature (1)..( 7): Result.001 file - promoters70/1022932
tttgtat

SEQ ID NO: 81183 - DNA, 8 bp, Unknown
  misc_feature (1)..( 8): Result.001 file - promoters70/1022932
aatctgct

SEQ ID NO: 81184 - DNA, 8 bp, Unknown
  misc_feature (1)..( 8): Result.001 file - promoters70/1022932
catcagct

SEQ ID NO: 81185 - DNA, 8 bp, Unknown
  misc_feature (1)..( 8): Result.001 file - promoters70/1022932
catcagtt

SEQ ID NO: 81186 - DNA, 8 bp, Unknown
  misc_feature (1)..( 8): Result.001 file - promoters70/1022932
tttatgta

SEQ ID NO: 81187 - DNA, 8 bp, Unknown
  misc_feature (1)..( 8): Result.001 file - promoters70/1022932
gttatgtt

SEQ ID NO: 81188 - DNA, 8 bp, Unknown
  misc_feature (1)..( 8): Result.001 file - promoters70/1022932
gttgtgtt

SEQ ID NO: 81189 - DNA, 8 bp, Unknown
  misc_feature (1)..( 8): Result.001 file - promoters70/1022932
aaactttt

SEQ ID NO: 81190 - DNA, 8 bp, Unknown
  misc_feature (1)..( 8): Result.001 file - promoters70/1022932
ttactttt

SEQ ID NO: 81191 - DNA, 8 bp, Unknown
  misc_feature (1)..( 8): Result.001 file - promoters70/1022932
ttacttta

SEQ ID NO: 81192 - DNA, 7 bp, Unknown
  misc_feature (1)..( 7): Result.001 file - promoters70/1022932
ttaattt

SEQ ID NO: 81193 - DNA, 7 bp, Unknown
  misc_feature (1)..( 7): Result.001 file - promoters70/1022932
ttacttt

SEQ ID NO: 81194 - DNA, 7 bp, Unknown
  misc_feature (1)..( 7): Result.001 file - promoters70/1022932
ttacttt

SEQ ID NO: 81195 - DNA, 9 bp, Unknown
  misc_feature (1)..( 9): Result.001 file - promoters70/1022932
tactatata

SEQ ID NO: 81196 - DNA, 9 bp, Unknown
  misc_feature (1)..( 9): Result.001 file - promoters70/1022932
tacaataaa

SEQ ID NO: 81197 - DNA, 9 bp, Unknown
  misc_feature (1)..( 9): Result.001 file - promoters70/1022983
gtcaagaaa

SEQ ID NO: 81198 - DNA, 7 bp, Unknown
  misc_feature (1)..( 7): Result.001 file - promoters70/1022983
aaatcaa

SEQ ID NO: 81199 - DNA, 7 bp, Unknown
  misc_feature (1)..( 7): Result.001 file - promoters70/1022983
gaatcaa

SEQ ID NO: 81200 - DNA, 7 bp, Unknown
  misc_feature (1)..( 7): Result.001 file - promoters70/1022983
gaatcac

SEQ ID NO: 81201 - DNA, 8 bp, Unknown
  misc_feature (1)..( 8): Result.001 file - promoters70/1022983
atttctta

SEQ ID NO: 81202 - DNA, 8 bp, Unknown
  misc_feature (1)..( 8): Result.001 file - promoters70/1022983
atttctcc

SEQ ID NO: 81203 - DNA, 8 bp, Unknown
  misc_feature (1)..( 8): Result.001 file - promoters70/1022983
ttttatta

SEQ ID NO: 81204 - DNA, 9 bp, Unknown
  misc_feature (1)..( 9): Result.001 file - promoters70/1022983
ttcttattt

SEQ ID NO: 81205 - DNA, 9 bp, Unknown
  misc_feature (1)..( 9): Result.001 file - promoters70/1022983
attttattt

SEQ ID NO: 81206 - DNA, 9 bp, Unknown
  misc_feature (1)..( 9): Result.001 file - promoters70/1022983
attttatta

SEQ ID NO: 81207 - DNA, 10 bp, Unknown
  misc_feature (1)..( 10): Result.001 file - promoters70/1022983
aattgtataa

SEQ ID NO: 81208 - DNA, 10 bp, Unknown
  misc_feature (1)..( 10): Result.001 file - promoters70/1022983
tattttatta

SEQ ID NO: 81209 - DNA, 10 bp, Unknown
  misc_feature (1)..( 10): Result.001 file - promoters70/1023237
tatattatta

SEQ ID NO: 81210 - DNA, 9 bp, Unknown
  misc_feature (1)..( 9): Result.001 file - promoters70/1023237
ttgttgttt

SEQ ID NO: 81211 - DNA, 9 bp, Unknown
  misc_feature (1)..( 9): Result.001 file - promoters70/1023237
ttgttgttt

SEQ ID NO: 81212 - DNA, 9 bp, Unknown
  misc_feature (1)..( 9): Result.001 file - promoters70/1023237
tttttgttt

SEQ ID NO: 81213 - DNA, 11 bp, Unknown
  misc_feature (1)..( 11): Result.001 file - promoters70/1023237
atcttcatgtt

SEQ ID NO: 81214 - DNA, 11 bp, Unknown
  misc_feature (1)..( 11): Result.001 file - promoters70/1023237
atgttcatgtt

SEQ ID NO: 81215 - DNA, 11 bp, Unknown
  misc_feature (1)..( 11): Result.001 file - promoters70/1023453
atcttcatgac

SEQ ID NO: 81216 - DNA, 11 bp, Unknown
  misc_feature (1)..( 11): Result.001 file - promoters70/1023453
tgaagataacg

SEQ ID NO: 81217 - DNA, 11 bp, Unknown
  misc_feature (1)..( 11): Result.001 file - promoters70/1023453
gtcagataata

SEQ ID NO: 81218 - DNA, 11 bp, Unknown
  misc_feature (1)..( 11): Result.001 file - promoters70/1023453
gtcagataata

SEQ ID NO: 81219 - DNA, 11 bp, Unknown
  misc_feature (1)..( 11): Result.001 file - promoters70/1023453
gacagatatag

SEQ ID NO: 81220 - DNA, 11 bp, Unknown
  misc_feature (1)..( 11): Result.001 file - promoters70/1023453
ccaagaaatag

SEQ ID NO: 81221 - DNA, 11 bp, Unknown
  misc_feature (1)..( 11): Result.001 file - promoters70/1023453
aatagacactt

SEQ ID NO: 81222 - DNA, 20 bp, Unknown
  misc_feature (1)..( 20): Result.001 file - promoters70/1023453
aagaaaaaaagaaaagaaag

SEQ ID NO: 81223 - DNA, 20 bp, Unknown
  misc_feature (1)..( 20): Result.001 file - promoters70/1023453
tttagatttagataagtaaa

SEQ ID NO: 81224 - DNA, 20 bp, Unknown
  misc_feature (1)..( 20): Result.001 file - promoters70/1023453
tattgaaaaagaaaaagaaa

SEQ ID NO: 81225 - DNA, 20 bp, Unknown
  misc_feature (1)..( 20): Result.001 file - promoters70/1023453
aaacaaaaaaaataaacaaa

SEQ ID NO: 81226 - DNA, 20 bp, Unknown
  misc_feature (1)..( 20): Result.001 file - promoters70/1023453
agcccaaaatgaaaggtttt

SEQ ID NO: 81227 - DNA, 20 bp, Unknown
  misc_feature (1)..( 20): Result.001 file - promoters70/1023453
gtgtgtggcggataagcaaa

SEQ ID NO: 81228 - DNA, 16 bp, Unknown
  misc_feature (1)..( 16): Result.001 file - promoters70/1023453
aaagaaaagaaagaat

SEQ ID NO: 81229 - DNA, 16 bp, Unknown
  misc_feature (1)..( 16): Result.001 file - promoters70/1023453
aaaagaaaaaaagaaa

SEQ ID NO: 81230 - DNA, 16 bp, Unknown
  misc_feature (1)..( 16): Result.001 file - promoters70/1023453
aaacaaaaaaaataaa

SEQ ID NO: 81231 - DNA, 16 bp, Unknown
  misc_feature (1)..( 16): Result.001 file - promoters70/1023453
ttttgaaagaaaatct

SEQ ID NO: 81232 - DNA, 17 bp, Unknown
  misc_feature (1)..( 17): Result.001 file - promoters70/1023453
ttagataagtaaagtat

SEQ ID NO: 81233 - DNA, 17 bp, Unknown
  misc_feature (1)..( 17): Result.001 file - promoters70/1023490
gcggataagcaaaaaca

SEQ ID NO: 81234 - DNA, 16 bp, Unknown
  misc_feature (1)..( 16): Result.001 file - promoters70/1023490
aaaaaaagtttttgta

SEQ ID NO: 81235 - DNA, 16 bp, Unknown
  misc_feature (1)..( 16): Result.001 file - promoters70/1023490
ttgacaagtttcctct

SEQ ID NO: 81236 - DNA, 16 bp, Unknown
  misc_feature (1)..( 16): Result.001 file - promoters70/1023490
aaaaacagttttcttt

SEQ ID NO: 81237 - DNA, 16 bp, Unknown
  misc_feature (1)..( 16): Result.001 file - promoters70/1023490
ctatttagttaaaaaa

SEQ ID NO: 81238 - DNA, 16 bp, Unknown
  misc_feature (1)..( 16): Result.001 file - promoters70/1023490
catattgattaagaaa

SEQ ID NO: 81239 - DNA, 16 bp, Unknown
  misc_feature (1)..( 16): Result.001 file - promoters70/1023490
caaaacaattcaagag

SEQ ID NO: 81240 - DNA, 11 bp, Unknown
  misc_feature (1)..( 11): Result.001 file - promoters70/1023490
attctaactca

SEQ ID NO: 81241 - DNA, 11 bp, Unknown
  misc_feature (1)..( 11): Result.001 file - promoters70/1023490
gttcaaacttt

SEQ ID NO: 81242 - DNA, 11 bp, Unknown
  misc_feature (1)..( 11): Result.001 file - promoters70/1023490
agtcaaacaaa

SEQ ID NO: 81243 - DNA, 11 bp, Unknown
  misc_feature (1)..( 11): Result.001 file - promoters70/1023490
tgtcaaccaaa

SEQ ID NO: 81244 - DNA, 11 bp, Unknown
  misc_feature (1)..( 11): Result.001 file - promoters70/1023490
acataaatttt

SEQ ID NO: 81245 - DNA, 11 bp, Unknown
  misc_feature (1)..( 11): Result.001 file - promoters70/1023634
tgtcaatttga

SEQ ID NO: 81246 - DNA, 8 bp, Unknown
  misc_feature (1)..( 8): Result.001 file - promoters70/1023634
ttttgaat

SEQ ID NO: 81247 - DNA, 8 bp, Unknown
  misc_feature (1)..( 8): Result.001 file - promoters70/1023634
atttgaat

SEQ ID NO: 81248 - DNA, 8 bp, Unknown
  misc_feature (1)..( 8): Result.001 file - promoters70/1023634
ttttgaca

SEQ ID NO: 81249 - DNA, 11 bp, Unknown
  misc_feature (1)..( 11): Result.001 file - promoters70/1023634
aaactgtgaaa

SEQ ID NO: 81250 - DNA, 11 bp, Unknown
  misc_feature (1)..( 11): Result.001 file - promoters70/1023634
aaaatgtgaaa

SEQ ID NO: 81251 - DNA, 11 bp, Unknown
  misc_feature (1)..( 11): Result.001 file - promoters70/1023634
gctttgtgaaa

SEQ ID NO: 81252 - DNA, 8 bp, Unknown
  misc_feature (1)..( 8): Result.001 file - promoters70/1023634
aacccaaa

SEQ ID NO: 81253 - DNA, 8 bp, Unknown
  misc_feature (1)..( 8): Result.001 file - promoters70/1023634
agcccaaa

SEQ ID NO: 81254 - DNA, 8 bp, Unknown
  misc_feature (1)..( 8): Result.001 file - promoters70/1023634
agcccaat

SEQ ID NO: 81255 - DNA, 8 bp, Unknown
  misc_feature (1)..( 8): Result.001 file - promoters70/1023634
cttttaga

SEQ ID NO: 81256 - DNA, 8 bp, Unknown
  misc_feature (1)..( 8): Result.001 file - promoters70/1023634
tgtttaga

SEQ ID NO: 81257 - DNA, 8 bp, Unknown
  misc_feature (1)..( 8): Result.001 file - promoters70/1023698
tgttgaga

SEQ ID NO: 81258 - DNA, 9 bp, Unknown
  misc_feature (1)..( 9): Result.001 file - promoters70/1023698
aagtaaaaa

SEQ ID NO: 81259 - DNA, 9 bp, Unknown
  misc_feature (1)..( 9): Result.001 file - promoters70/1023698
aagcaaaaa

SEQ ID NO: 81260 - DNA, 9 bp, Unknown
  misc_feature (1)..( 9): Result.001 file - promoters70/1023698
aagcaaaaa

SEQ ID NO: 81261 - DNA, 8 bp, Unknown
  misc_feature (1)..( 8): Result.001 file - promoters70/1023698
ctttattt

SEQ ID NO: 81262 - DNA, 8 bp, Unknown
  misc_feature (1)..( 8): Result.001 file - promoters70/1023698
ctttatag

SEQ ID NO: 81263 - DNA, 8 bp, Unknown
  misc_feature (1)..( 8): Result.001 file - promoters70/1023698
ttttattt

SEQ ID NO: 81264 - DNA, 7 bp, Unknown
  misc_feature (1)..( 7): Result.001 file - promoters70/1023698
atttttt

SEQ ID NO: 81265 - DNA, 7 bp, Unknown
  misc_feature (1)..( 7): Result.001 file - promoters70/1023698
atttttt

SEQ ID NO: 81266 - DNA, 7 bp, Unknown
  misc_feature (1)..( 7): Result.001 file - promoters70/1023698
atttttt

SEQ ID NO: 81267 - DNA, 10 bp, Unknown
  misc_feature (1)..( 10): Result.001 file - promoters70/1023698
aaaaataaaa

SEQ ID NO: 81268 - DNA, 10 bp, Unknown
  misc_feature (1)..( 10): Result.001 file - promoters70/1023698
gaaattaatt

SEQ ID NO: 81269 - DNA, 10 bp, Unknown
  misc_feature (1)..( 10): Result.001 file - promoters70/1023698
taaaatataa

SEQ ID NO: 81270 - DNA, 9 bp, Unknown
  misc_feature (1)..( 9): Result.001 file - promoters70/1023698
tcttaatag

SEQ ID NO: 81271 - DNA, 9 bp, Unknown
  misc_feature (1)..( 9): Result.001 file - promoters70/1023698
tcttaattt

SEQ ID NO: 81272 - DNA, 9 bp, Unknown
  misc_feature (1)..( 9): Result.001 file - promoters70/1023698
ttttaattt

SEQ ID NO: 81273 - DNA, 10 bp, Unknown
  misc_feature (1)..( 10): Result.001 file - promoters70/1023698
atatttagtt

SEQ ID NO: 81274 - DNA, 10 bp, Unknown
  misc_feature (1)..( 10): Result.001 file - promoters70/1023698
taattttgtt

SEQ ID NO: 81275 - DNA, 10 bp, Unknown
  misc_feature (1)..( 10): Result.001 file - promoters70/1023782
atatttagta

SEQ ID NO: 81276 - DNA, 10 bp, Unknown
  misc_feature (1)..( 10): Result.001 file - promoters70/1023782
aaaataatct

SEQ ID NO: 81277 - DNA, 10 bp, Unknown
  misc_feature (1)..( 10): Result.001 file - promoters70/1023782
aaaataaaat

SEQ ID NO: 81278 - DNA, 11 bp, Unknown
  misc_feature (1)..( 11): Result.001 file - promoters70/1023782
gaaatgaaata

SEQ ID NO: 81279 - DNA, 10 bp, Unknown
  misc_feature (1)..( 10): Result.001 file - promoters70/1023782
ataaatcaaa

SEQ ID NO: 81280 - DNA, 10 bp, Unknown
  misc_feature (1)..( 10): Result.001 file - promoters70/1023782
ggaaatgaaa

SEQ ID NO: 81281 - DNA, 10 bp, Unknown
  misc_feature (1)..( 10): Result.001 file - promoters70/1023963
ggaaaagaaa

SEQ ID NO: 81282 - DNA, 10 bp, Unknown
  misc_feature (1)..( 10): Result.001 file - promoters70/1023963
ttctactttt

SEQ ID NO: 81283 - DNA, 10 bp, Unknown
  misc_feature (1)..( 10): Result.001 file - promoters70/1023963
ttctacaaca

SEQ ID NO: 81284 - DNA, 10 bp, Unknown
  misc_feature (1)..( 10): Result.001 file - promoters70/1023963
ttcttctttt

SEQ ID NO: 81285 - DNA, 10 bp, Unknown
  misc_feature (1)..( 10): Result.001 file - promoters70/1023963
ttctttgtaa

SEQ ID NO: 81286 - DNA, 8 bp, Unknown
  misc_feature (1)..( 8): Result.001 file - promoters70/1023963
gttttgta

SEQ ID NO: 81287 - DNA, 8 bp, Unknown
  misc_feature (1)..( 8): Result.001 file - promoters70/1023963
atttcgta

SEQ ID NO: 81288 - DNA, 8 bp, Unknown
  misc_feature (1)..( 8): Result.001 file - promoters70/1023963
attgcgtc

SEQ ID NO: 81289 - DNA, 8 bp, Unknown
  misc_feature (1)..( 8): Result.001 file - promoters70/1023963
aaatgtgt

SEQ ID NO: 81290 - DNA, 8 bp, Unknown
  misc_feature (1)..( 8): Result.001 file - promoters70/1023963
aaatgtag

SEQ ID NO: 81291 - DNA, 8 bp, Unknown
  misc_feature (1)..( 8): Result.001 file - promoters70/1023963
caatttag

SEQ ID NO: 81292 - DNA, 9 bp, Unknown
  misc_feature (1)..( 9): Result.001 file - promoters70/1023963
atgttaatg

SEQ ID NO: 81293 - DNA, 9 bp, Unknown
  misc_feature (1)..( 9): Result.001 file - promoters70/1023963
atgtaaata

SEQ ID NO: 81294 - DNA, 9 bp, Unknown
  misc_feature (1)..( 9): Result.001 file - promoters70/1023963
tgataaata

SEQ ID NO: 81295 - DNA, 7 bp, Unknown
  misc_feature (1)..( 7): Result.001 file - promoters70/1023963
tttagta

SEQ ID NO: 81296 - DNA, 7 bp, Unknown
  misc_feature (1)..( 7): Result.001 file - promoters70/1023963
ttttgta

SEQ ID NO: 81297 - DNA, 7 bp, Unknown
  misc_feature (1)..( 7): Result.001 file - promoters70/1023963
ctttgta

SEQ ID NO: 81298 - DNA, 7 bp, Unknown
  misc_feature (1)..( 7): Result.001 file - promoters70/1023963
aaataat

SEQ ID NO: 81299 - DNA, 7 bp, Unknown
  misc_feature (1)..( 7): Result.001 file - promoters70/1023963
aaaaaat

SEQ ID NO: 81300 - DNA, 7 bp, Unknown
  misc_feature (1)..( 7): Result.001 file - promoters70/1024126
aaagaaa

SEQ ID NO: 81301 - DNA, 9 bp, Unknown
  misc_feature (1)..( 9): Result.001 file - promoters70/1024126
gaagaggaa

SEQ ID NO: 81302 - DNA, 9 bp, Unknown
  misc_feature (1)..( 9): Result.001 file - promoters70/1024126
gaagaagaa

SEQ ID NO: 81303 - DNA, 9 bp, Unknown
  misc_feature (1)..( 9): Result.001 file - promoters70/1024126
gaaaaggat

SEQ ID NO: 81304 - DNA, 9 bp, Unknown
  misc_feature (1)..( 9): Result.001 file - promoters70/1024126
aaagaatac

SEQ ID NO: 81305 - DNA, 9 bp, Unknown
  misc_feature (1)..( 9): Result.001 file - promoters70/1024126
aaaaaaatg

SEQ ID NO: 81306 - DNA, 9 bp, Unknown
  misc_feature (1)..( 9): Result.001 file - promoters70/1024126
gaaaaatca

SEQ ID NO: 81307 - DNA, 12 bp, Unknown
  misc_feature (1)..( 12): Result.001 file - promoters70/1024126
aagccaaaaatg

SEQ ID NO: 81308 - DNA, 12 bp, Unknown
  misc_feature (1)..( 12): Result.001 file - promoters70/1024126
acaccacaaatt

SEQ ID NO: 81309 - DNA, 12 bp, Unknown
  misc_feature (1)..( 12): Result.001 file - promoters70/1024126
atagcaaaaaac

SEQ ID NO: 81310 - DNA, 12 bp, Unknown
  misc_feature (1)..( 12): Result.001 file - promoters70/1024126
tgaggaaacaac

SEQ ID NO: 81311 - DNA, 12 bp, Unknown
  misc_feature (1)..( 12): Result.001 file - promoters70/1024126
ttcgcaaaacta

SEQ ID NO: 81312 - DNA, 12 bp, Unknown
  misc_feature (1)..( 12): Result.001 file - promoters70/1024126
atatcaaaggtc

SEQ ID NO: 81313 - DNA, 11 bp, Unknown
  misc_feature (1)..( 11): Result.001 file - promoters70/1024126
ccattaacgga

SEQ ID NO: 81314 - DNA, 11 bp, Unknown
  misc_feature (1)..( 11): Result.001 file - promoters70/1024126
acattaattat

SEQ ID NO: 81315 - DNA, 11 bp, Unknown
  misc_feature (1)..( 11): Result.001 file - promoters70/1024126
acaataacaaa

SEQ ID NO: 81316 - DNA, 11 bp, Unknown
  misc_feature (1)..( 11): Result.001 file - promoters70/1024126
agaatatcaaa

SEQ ID NO: 81317 - DNA, 11 bp, Unknown
  misc_feature (1)..( 11): Result.001 file - promoters70/1024126
aacatatcact

SEQ ID NO: 81318 - DNA, 11 bp, Unknown
  misc_feature (1)..( 11): Result.001 file - promoters70/1024189
tatatagcaaa

SEQ ID NO: 81319 - DNA, 9 bp, Unknown
  misc_feature (1)..( 9): Result.001 file - promoters70/1024189
aaaaatgaa

SEQ ID NO: 81320 - DNA, 9 bp, Unknown
  misc_feature (1)..( 9): Result.001 file - promoters70/1024189
aaaaaagaa

SEQ ID NO: 81321 - DNA, 9 bp, Unknown
  misc_feature (1)..( 9): Result.001 file - promoters70/1024189
gaaaaaggg

SEQ ID NO: 81322 - DNA, 8 bp, Unknown
  misc_feature (1)..( 8): Result.001 file - promoters70/1024189
ttttatca

SEQ ID NO: 81323 - DNA, 8 bp, Unknown
  misc_feature (1)..( 8): Result.001 file - promoters70/1024189
ttttgtca

SEQ ID NO: 81324 - DNA, 8 bp, Unknown
  misc_feature (1)..( 8): Result.001 file - promoters70/1024189
ttttgtat

SEQ ID NO: 81325 - DNA, 8 bp, Unknown
  misc_feature (1)..( 8): Result.001 file - promoters70/1024189
atatatat

SEQ ID NO: 81326 - DNA, 8 bp, Unknown
  misc_feature (1)..( 8): Result.001 file - promoters70/1024189
atatttat

SEQ ID NO: 81327 - DNA, 8 bp, Unknown
  misc_feature (1)..( 8): Result.001 file - promoters70/1024189
caatttat

SEQ ID NO: 81328 - DNA, 8 bp, Unknown
  misc_feature (1)..( 8): Result.001 file - promoters70/1024189
taatttat

SEQ ID NO: 81329 - DNA, 8 bp, Unknown
  misc_feature (1)..( 8): Result.001 file - promoters70/1024189
aatcaaaa

SEQ ID NO: 81330 - DNA, 8 bp, Unknown
  misc_feature (1)..( 8): Result.001 file - promoters70/1024189
aatcaaat

SEQ ID NO: 81331 - DNA, 9 bp, Unknown
  misc_feature (1)..( 9): Result.001 file - promoters70/1024189
gatccaaac

SEQ ID NO: 81332 - DNA, 9 bp, Unknown
  misc_feature (1)..( 9): Result.001 file - promoters70/1024189
tatcctaac

SEQ ID NO: 81333 - DNA, 11 bp, Unknown
  misc_feature (1)..( 11): Result.001 file - promoters70/1024189
ctagacacgta

SEQ ID NO: 81334 - DNA, 11 bp, Unknown
  misc_feature (1)..( 11): Result.001 file - promoters70/1024189
atcaacacgta

SEQ ID NO: 81335 - DNA, 11 bp, Unknown
  misc_feature (1)..( 11): Result.001 file - promoters70/1024189
aaagagacgaa

SEQ ID NO: 81336 - DNA, 11 bp, Unknown
  misc_feature (1)..( 11): Result.001 file - promoters70/1024189
aaaaagaatac

SEQ ID NO: 81337 - DNA, 7 bp, Unknown
  misc_feature (1)..( 7): Result.001 file - promoters70/1024189
actatac

SEQ ID NO: 81338 - DNA, 7 bp, Unknown
  misc_feature (1)..( 7): Result.001 file - promoters70/1024189
actttac

SEQ ID NO: 81339 - DNA, 7 bp, Unknown
  misc_feature (1)..( 7): Result.001 file - promoters70/1024189
tctttac

SEQ ID NO: 81340 - DNA, 8 bp, Unknown
  misc_feature (1)..( 8): Result.001 file - promoters70/1024189
atataata

SEQ ID NO: 81341 - DNA, 8 bp, Unknown
  misc_feature (1)..( 8): Result.001 file - promoters70/1024189
ttattata

SEQ ID NO: 81342 - DNA, 8 bp, Unknown
  misc_feature (1)..( 8): Result.001 file - promoters70/1024189
atataatt

SEQ ID NO: 81343 - DNA, 8 bp, Unknown
  misc_feature (1)..( 8): Result.001 file - promoters70/1024189
atataata

SEQ ID NO: 81344 - DNA, 9 bp, Unknown
  misc_feature (1)..( 9): Result.001 file - promoters70/1024189
tttgttggt

SEQ ID NO: 81345 - DNA, 9 bp, Unknown
  misc_feature (1)..( 9): Result.001 file - promoters70/1024189
tttattgat

SEQ ID NO: 81346 - DNA, 9 bp, Unknown
  misc_feature (1)..( 9): Result.001 file - promoters70/1024189
gttactgat

SEQ ID NO: 81347 - DNA, 11 bp, Unknown
  misc_feature (1)..( 11): Result.001 file - promoters70/1024189
agaaattaata

SEQ ID NO: 81348 - DNA, 11 bp, Unknown
  misc_feature (1)..( 11): Result.001 file - promoters70/1024189
taaaatcaata

SEQ ID NO: 81349 - DNA, 12 bp, Unknown
  misc_feature (1)..( 12): Result.001 file - promoters70/1024189
ataacatcactt

SEQ ID NO: 81350 - DNA, 12 bp, Unknown
  misc_feature (1)..( 12): Result.001 file - promoters70/1024189
ctatcaaaactt

SEQ ID NO: 81351 - DNA, 12 bp, Unknown
  misc_feature (1)..( 12): Result.001 file - promoters70/1024189
ctaacaaacaat

SEQ ID NO: 81352 - DNA, 12 bp, Unknown
  misc_feature (1)..( 12): Result.001 file - promoters70/1024199
ggctcaaagctt

SEQ ID NO: 81353 - DNA, 11 bp, Unknown
  misc_feature (1)..( 11): Result.001 file - promoters70/1024199
atttgattgaa

SEQ ID NO: 81354 - DNA, 11 bp, Unknown
  misc_feature (1)..( 11): Result.001 file - promoters70/1024199
aggtgaatgat

SEQ ID NO: 81355 - DNA, 11 bp, Unknown
  misc_feature (1)..( 11): Result.001 file - promoters70/1024199
catttaattag

SEQ ID NO: 81356 - DNA, 11 bp, Unknown
  misc_feature (1)..( 11): Result.001 file - promoters70/1024199
tcgtgaaggat

SEQ ID NO: 81357 - DNA, 11 bp, Unknown
  misc_feature (1)..( 11): Result.001 file - promoters70/1024199
catataagtaa

SEQ ID NO: 81358 - DNA, 11 bp, Unknown
  misc_feature (1)..( 11): Result.001 file - promoters70/1024199
catttatgttc

SEQ ID NO: 81359 - DNA, 14 bp, Unknown
  misc_feature (1)..( 14): Result.001 file - promoters70/1024199
taagtcttaagcac

SEQ ID NO: 81360 - DNA, 14 bp, Unknown
  misc_feature (1)..( 14): Result.001 file - promoters70/1024199
aatctcttaaaacc

SEQ ID NO: 81361 - DNA, 14 bp, Unknown
  misc_feature (1)..( 14): Result.001 file - promoters70/1024199
aatcccttaaaccc

SEQ ID NO: 81362 - DNA, 14 bp, Unknown
  misc_feature (1)..( 14): Result.001 file - promoters70/1024199
cgttatataaatcc

SEQ ID NO: 81363 - DNA, 14 bp, Unknown
  misc_feature (1)..( 14): Result.001 file - promoters70/1024199
ttatttatgaatcc

SEQ ID NO: 81364 - DNA, 14 bp, Unknown
  misc_feature (1)..( 14): Result.001 file - promoters70/1024199
gtctttataaactc

SEQ ID NO: 81365 - DNA, 15 bp, Unknown
  misc_feature (1)..( 15): Result.001 file - promoters70/1024199
ggcctatttacaatg

SEQ ID NO: 81366 - DNA, 15 bp, Unknown
  misc_feature (1)..( 15): Result.001 file - promoters70/1024199
ggcctatatactatg

SEQ ID NO: 81367 - DNA, 15 bp, Unknown
  misc_feature (1)..( 15): Result.001 file - promoters70/1024199
atcttatttaatgaa

SEQ ID NO: 81368 - DNA, 15 bp, Unknown
  misc_feature (1)..( 15): Result.001 file - promoters70/1024199
acattatatataaaa

SEQ ID NO: 81369 - DNA, 15 bp, Unknown
  misc_feature (1)..( 15): Result.001 file - promoters70/1024199
gctttaattagctca

SEQ ID NO: 81370 - DNA, 15 bp, Unknown
  misc_feature (1)..( 15): Result.001 file - promoters70/1024203
gtcgaaatcagcagc

SEQ ID NO: 81371 - DNA, 9 bp, Unknown
  misc_feature (1)..( 9): Result.001 file - promoters70/1024203
agaaaagac

SEQ ID NO: 81372 - DNA, 9 bp, Unknown
  misc_feature (1)..( 9): Result.001 file - promoters70/1024203
agacaagcg

SEQ ID NO: 81373 - DNA, 9 bp, Unknown
  misc_feature (1)..( 9): Result.001 file - promoters70/1024203
gaacaggcg

SEQ ID NO: 81374 - DNA, 7 bp, Unknown
  misc_feature (1)..( 7): Result.001 file - promoters70/1024203
acaagcg

SEQ ID NO: 81375 - DNA, 7 bp, Unknown
  misc_feature (1)..( 7): Result.001 file - promoters70/1024203
acaggcg

SEQ ID NO: 81376 - DNA, 7 bp, Unknown
  misc_feature (1)..( 7): Result.001 file - promoters70/1024203
acaagcg

SEQ ID NO: 81377 - DNA, 7 bp, Unknown
  misc_feature (1)..( 7): Result.001 file - promoters70/1024203
tcgatga

SEQ ID NO: 81378 - DNA, 7 bp, Unknown
  misc_feature (1)..( 7): Result.001 file - promoters70/1024203
tcgatga

SEQ ID NO: 81379 - DNA, 7 bp, Unknown
  misc_feature (1)..( 7): Result.001 file - promoters70/1024234
tcgatga

SEQ ID NO: 81380 - DNA, 13 bp, Unknown
  misc_feature (1)..( 13): Result.001 file - promoters70/1024234
taaatttaaaaat

SEQ ID NO: 81381 - DNA, 13 bp, Unknown
  misc_feature (1)..( 13): Result.001 file - promoters70/1024234
ttgattcaaaatt

SEQ ID NO: 81382 - DNA, 13 bp, Unknown
  misc_feature (1)..( 13): Result.001 file - promoters70/1024236
ttgaatcaatatt

SEQ ID NO: 81383 - DNA, 11 bp, Unknown
  misc_feature (1)..( 11): Result.001 file - promoters70/1024236
aacacaaaaat

SEQ ID NO: 81384 - DNA, 11 bp, Unknown
  misc_feature (1)..( 11): Result.001 file - promoters70/1024236
aacacaagaag

SEQ ID NO: 81385 - DNA, 11 bp, Unknown
  misc_feature (1)..( 11): Result.001 file - promoters70/1024236
tgcacaagaat

SEQ ID NO: 81386 - DNA, 11 bp, Unknown
  misc_feature (1)..( 11): Result.001 file - promoters70/1024236
agcacgagatg

SEQ ID NO: 81387 - DNA, 11 bp, Unknown
  misc_feature (1)..( 11): Result.001 file - promoters70/1024236
agcacaattgt

SEQ ID NO: 81388 - DNA, 11 bp, Unknown
  misc_feature (1)..( 11): Result.001 file - promoters70/1024236
cagacttttgt

SEQ ID NO: 81389 - DNA, 12 bp, Unknown
  misc_feature (1)..( 12): Result.001 file - promoters70/1024236
tataaacttttc

SEQ ID NO: 81390 - DNA, 12 bp, Unknown
  misc_feature (1)..( 12): Result.001 file - promoters70/1024236
aaaaaagttttt

SEQ ID NO: 81391 - DNA, 12 bp, Unknown
  misc_feature (1)..( 12): Result.001 file - promoters70/1024236
ccacaacttttc

SEQ ID NO: 81392 - DNA, 12 bp, Unknown
  misc_feature (1)..( 12): Result.001 file - promoters70/1024236
actttagttttg

SEQ ID NO: 81393 - DNA, 12 bp, Unknown
  misc_feature (1)..( 12): Result.001 file - promoters70/1024236
aaaatagtttac

SEQ ID NO: 81394 - DNA, 12 bp, Unknown
  misc_feature (1)..( 12): Result.001 file - promoters70/1024236
gtatttgttttt

SEQ ID NO: 81395 - DNA, 13 bp, Unknown
  misc_feature (1)..( 13): Result.001 file - promoters70/1024236
gtttgctggcaat

SEQ ID NO: 81396 - DNA, 13 bp, Unknown
  misc_feature (1)..( 13): Result.001 file - promoters70/1024236
gtttactgaattg

SEQ ID NO: 81397 - DNA, 13 bp, Unknown
  misc_feature (1)..( 13): Result.001 file - promoters70/1024236
taatacagaattg

SEQ ID NO: 81398 - DNA, 13 bp, Unknown
  misc_feature (1)..( 13): Result.001 file - promoters70/1024236
cattactggtaaa

SEQ ID NO: 81399 - DNA, 13 bp, Unknown
  misc_feature (1)..( 13): Result.001 file - promoters70/1024236
ttttaatgggccg

SEQ ID NO: 81400 - DNA, 13 bp, Unknown
  misc_feature (1)..( 13): Result.001 file - promoters70/1024257
caatagtggaagt

SEQ ID NO: 81401 - DNA, 10 bp, Unknown
  misc_feature (1)..( 10): Result.001 file - promoters70/1024257
atctctcaaa

SEQ ID NO: 81402 - DNA, 10 bp, Unknown
  misc_feature (1)..( 10): Result.001 file - promoters70/1024257
atcgctcaag

SEQ ID NO: 81403 - DNA, 11 bp, Unknown
  misc_feature (1)..( 11): Result.001 file - promoters70/1024367
tatcctccaaa

SEQ ID NO: 81404 - DNA, 9 bp, Unknown
  misc_feature (1)..( 9): Result.001 file - promoters70/1024367
attaacttt

SEQ ID NO: 81405 - DNA, 9 bp, Unknown
  misc_feature (1)..( 9): Result.001 file - promoters70/1024367
cataagttt

SEQ ID NO: 81406 - DNA, 9 bp, Unknown
  misc_feature (1)..( 9): Result.001 file - promoters70/1024367
attaactta

SEQ ID NO: 81407 - DNA, 9 bp, Unknown
  misc_feature (1)..( 9): Result.001 file - promoters70/1024367
ttgaacttt

SEQ ID NO: 81408 - DNA, 8 bp, Unknown
  misc_feature (1)..( 8): Result.001 file - promoters70/1024367
actatata

SEQ ID NO: 81409 - DNA, 8 bp, Unknown
  misc_feature (1)..( 8): Result.001 file - promoters70/1024367
tttatata

SEQ ID NO: 81410 - DNA, 8 bp, Unknown
  misc_feature (1)..( 8): Result.001 file - promoters70/1024367
catatata

SEQ ID NO: 81411 - DNA, 8 bp, Unknown
  misc_feature (1)..( 8): Result.001 file - promoters70/1024367
tgtatata

SEQ ID NO: 81412 - DNA, 8 bp, Unknown
  misc_feature (1)..( 8): Result.001 file - promoters70/1024367
tttatatt

SEQ ID NO: 81413 - DNA, 11 bp, Unknown
  misc_feature (1)..( 11): Result.001 file - promoters70/1024367
ttagaaactat

SEQ ID NO: 81414 - DNA, 11 bp, Unknown
  misc_feature (1)..( 11): Result.001 file - promoters70/1024367
ttaaaaaaaaa

SEQ ID NO: 81415 - DNA, 11 bp, Unknown
  misc_feature (1)..( 11): Result.001 file - promoters70/1024367
cgaaaaaaaac

SEQ ID NO: 81416 - DNA, 11 bp, Unknown
  misc_feature (1)..( 11): Result.001 file - promoters70/1024367
ctaaaaaaaac

SEQ ID NO: 81417 - DNA, 9 bp, Unknown
  misc_feature (1)..( 9): Result.001 file - promoters70/1024367
tttccgaat

SEQ ID NO: 81418 - DNA, 9 bp, Unknown
  misc_feature (1)..( 9): Result.001 file - promoters70/1024367
cttcccaat

SEQ ID NO: 81419 - DNA, 9 bp, Unknown
  misc_feature (1)..( 9): Result.001 file - promoters70/1024367
ttttcgatc

SEQ ID NO: 81420 - DNA, 9 bp, Unknown
  misc_feature (1)..( 9): Result.001 file - promoters70/1024367
tttcccata

SEQ ID NO: 81421 - DNA, 7 bp, Unknown
  misc_feature (1)..( 7): Result.001 file - promoters70/1024367
aattttg

SEQ ID NO: 81422 - DNA, 7 bp, Unknown
  misc_feature (1)..( 7): Result.001 file - promoters70/1024367
aatttta

SEQ ID NO: 81423 - DNA, 7 bp, Unknown
  misc_feature (1)..( 7): Result.001 file - promoters70/1024367
aattttt

SEQ ID NO: 81424 - DNA, 7 bp, Unknown
  misc_feature (1)..( 7): Result.001 file - promoters70/1024367
tatttta

SEQ ID NO: 81425 - DNA, 8 bp, Unknown
  misc_feature (1)..( 8): Result.001 file - promoters70/1024367
agaaaaaa

SEQ ID NO: 81426 - DNA, 8 bp, Unknown
  misc_feature (1)..( 8): Result.001 file - promoters70/1024367
ggaacaaa

SEQ ID NO: 81427 - DNA, 8 bp, Unknown
  misc_feature (1)..( 8): Result.001 file - promoters70/1024367
agacaaaa

SEQ ID NO: 81428 - DNA, 9 bp, Unknown
  misc_feature (1)..( 9): Result.001 file - promoters70/1024499
agatacagt

SEQ ID NO: 81429 - DNA, 8 bp, Unknown
  misc_feature (1)..( 8): Result.001 file - promoters70/1024499
tttttaat

SEQ ID NO: 81430 - DNA, 8 bp, Unknown
  misc_feature (1)..( 8): Result.001 file - promoters70/1024499
tttgtaat

SEQ ID NO: 81431 - DNA, 8 bp, Unknown
  misc_feature (1)..( 8): Result.001 file - promoters70/1024499
tttgtaac

SEQ ID NO: 81432 - DNA, 12 bp, Unknown
  misc_feature (1)..( 12): Result.001 file - promoters70/1024499
taagatattttt

SEQ ID NO: 81433 - DNA, 12 bp, Unknown
  misc_feature (1)..( 12): Result.001 file - promoters70/1024499
aaaaatatattt

SEQ ID NO: 81434 - DNA, 12 bp, Unknown
  misc_feature (1)..( 12): Result.001 file - promoters70/1024499
taaaatacttta

SEQ ID NO: 81435 - DNA, 7 bp, Unknown
  misc_feature (1)..( 7): Result.001 file - promoters70/1024499
tttattt

SEQ ID NO: 81436 - DNA, 7 bp, Unknown
  misc_feature (1)..( 7): Result.001 file - promoters70/1024499
tttcttt

SEQ ID NO: 81437 - DNA, 7 bp, Unknown
  misc_feature (1)..( 7): Result.001 file - promoters70/1024499
ttcattt

SEQ ID NO: 81438 - DNA, 7 bp, Unknown
  misc_feature (1)..( 7): Result.001 file - promoters70/1024499
cataaac

SEQ ID NO: 81439 - DNA, 7 bp, Unknown
  misc_feature (1)..( 7): Result.001 file - promoters70/1024499
cataaat

SEQ ID NO: 81440 - DNA, 7 bp, Unknown
  misc_feature (1)..( 7): Result.001 file - promoters70/1024499
cataaac

SEQ ID NO: 81441 - DNA, 12 bp, Unknown
  misc_feature (1)..( 12): Result.001 file - promoters70/1024499
ttcatataaata

SEQ ID NO: 81442 - DNA, 12 bp, Unknown
  misc_feature (1)..( 12): Result.001 file - promoters70/1024499
taactataaata

SEQ ID NO: 81443 - DNA, 12 bp, Unknown
  misc_feature (1)..( 12): Result.001 file - promoters70/1024499
tatatataaata

SEQ ID NO: 81444 - DNA, 12 bp, Unknown
  misc_feature (1)..( 12): Result.001 file - promoters70/1024499
aatctataaaaa

SEQ ID NO: 81445 - DNA, 11 bp, Unknown
  misc_feature (1)..( 11): Result.001 file - promoters70/1024499
tcaattttttt

SEQ ID NO: 81446 - DNA, 11 bp, Unknown
  misc_feature (1)..( 11): Result.001 file - promoters70/1024499
ctaattttagc

SEQ ID NO: 81447 - DNA, 11 bp, Unknown
  misc_feature (1)..( 11): Result.001 file - promoters70/1024756
attatttttac

SEQ ID NO: 81448 - DNA, 9 bp, Unknown
  misc_feature (1)..( 9): Result.001 file - promoters70/1024756
gggattttt

SEQ ID NO: 81449 - DNA, 9 bp, Unknown
  misc_feature (1)..( 9): Result.001 file - promoters70/1024756
ataattttt

SEQ ID NO: 81450 - DNA, 9 bp, Unknown
  misc_feature (1)..( 9): Result.001 file - promoters70/1024756
ataatgttt

SEQ ID NO: 81451 - DNA, 11 bp, Unknown
  misc_feature (1)..( 11): Result.001 file - promoters70/1024756
taacagtcaaa

SEQ ID NO: 81452 - DNA, 11 bp, Unknown
  misc_feature (1)..( 11): Result.001 file - promoters70/1024756
gtcaggtcaaa

SEQ ID NO: 81453 - DNA, 11 bp, Unknown
  misc_feature (1)..( 11): Result.001 file - promoters70/1024756
taacagtcaaa

SEQ ID NO: 81454 - DNA, 8 bp, Unknown
  misc_feature (1)..( 8): Result.001 file - promoters70/1024756
ttatcaag

SEQ ID NO: 81455 - DNA, 8 bp, Unknown
  misc_feature (1)..( 8): Result.001 file - promoters70/1024756
ttaccaaa

SEQ ID NO: 81456 - DNA, 9 bp, Unknown
  misc_feature (1)..( 9): Result.001 file - promoters70/1024853
acacctaat

SEQ ID NO: 81457 - DNA, 11 bp, Unknown
  misc_feature (1)..( 11): Result.001 file - promoters70/1024853
agaattgacca

SEQ ID NO: 81458 - DNA, 11 bp, Unknown
  misc_feature (1)..( 11): Result.001 file - promoters70/1024853
tgaattggaat

SEQ ID NO: 81459 - DNA, 11 bp, Unknown
  misc_feature (1)..( 11): Result.001 file - promoters70/1024853
ggaaatgacgt

SEQ ID NO: 81460 - DNA, 11 bp, Unknown
  misc_feature (1)..( 11): Result.001 file - promoters70/1024853
tgatttgcttc

SEQ ID NO: 81461 - DNA, 11 bp, Unknown
  misc_feature (1)..( 11): Result.001 file - promoters70/1024853
agtattagctt

SEQ ID NO: 81462 - DNA, 11 bp, Unknown
  misc_feature (1)..( 11): Result.001 file - promoters70/1024853
acaaaagacac

SEQ ID NO: 81463 - DNA, 11 bp, Unknown
  misc_feature (1)..( 11): Result.001 file - promoters70/1024853
tgatttttaat

SEQ ID NO: 81464 - DNA, 9 bp, Unknown
  misc_feature (1)..( 9): Result.001 file - promoters70/1024853
gaaaaaaag

SEQ ID NO: 81465 - DNA, 9 bp, Unknown
  misc_feature (1)..( 9): Result.001 file - promoters70/1024853
caaacaaat

SEQ ID NO: 81466 - DNA, 9 bp, Unknown
  misc_feature (1)..( 9): Result.001 file - promoters70/1024853
caaagaaag

SEQ ID NO: 81467 - DNA, 9 bp, Unknown
  misc_feature (1)..( 9): Result.001 file - promoters70/1024853
caaaaaaaa

SEQ ID NO: 81468 - DNA, 9 bp, Unknown
  misc_feature (1)..( 9): Result.001 file - promoters70/1024853
aaactaaaa

SEQ ID NO: 81469 - DNA, 9 bp, Unknown
  misc_feature (1)..( 9): Result.001 file - promoters70/1024853
caaacacaa

SEQ ID NO: 81470 - DNA, 9 bp, Unknown
  misc_feature (1)..( 9): Result.001 file - promoters70/1024853
caaggaaag

SEQ ID NO: 81471 - DNA, 9 bp, Unknown
  misc_feature (1)..( 9): Result.001 file - promoters70/1024889
cacacaaag

SEQ ID NO: 81472 - DNA, 19 bp, Unknown
  misc_feature (1)..( 19): Result.001 file - promoters70/1024889
aaaatcaattaagggtaac

SEQ ID NO: 81473 - DNA, 19 bp, Unknown
  misc_feature (1)..( 19): Result.001 file - promoters70/1024889
tgtatcgattatgttttta

SEQ ID NO: 81474 - DNA, 19 bp, Unknown
  misc_feature (1)..( 19): Result.001 file - promoters70/1024889
caaaacaattaaataatgt

SEQ ID NO: 81475 - DNA, 19 bp, Unknown
  misc_feature (1)..( 19): Result.001 file - promoters70/1024889
tctttcgattgtgttctta

SEQ ID NO: 81476 - DNA, 19 bp, Unknown
  misc_feature (1)..( 19): Result.001 file - promoters70/1024889
aatatagatagttattcac

SEQ ID NO: 81477 - DNA, 19 bp, Unknown
  misc_feature (1)..( 19): Result.001 file - promoters70/1024889
caaaaccgttactaaaagt

SEQ ID NO: 81478 - DNA, 11 bp, Unknown
  misc_feature (1)..( 11): Result.001 file - promoters70/1024889
atagtttctct

SEQ ID NO: 81479 - DNA, 11 bp, Unknown
  misc_feature (1)..( 11): Result.001 file - promoters70/1024889
ataatttaatg

SEQ ID NO: 81480 - DNA, 11 bp, Unknown
  misc_feature (1)..( 11): Result.001 file - promoters70/1024889
ataattttata

SEQ ID NO: 81481 - DNA, 11 bp, Unknown
  misc_feature (1)..( 11): Result.001 file - promoters70/1024889
agaattttttt

SEQ ID NO: 81482 - DNA, 11 bp, Unknown
  misc_feature (1)..( 11): Result.001 file - promoters70/1024889
atcattttttt

SEQ ID NO: 81483 - DNA, 11 bp, Unknown
  misc_feature (1)..( 11): Result.001 file - promoters70/1024889
tcaatttgagt

SEQ ID NO: 81484 - DNA, 10 bp, Unknown
  misc_feature (1)..( 10): Result.001 file - promoters70/1024889
ttcttttatt

SEQ ID NO: 81485 - DNA, 10 bp, Unknown
  misc_feature (1)..( 10): Result.001 file - promoters70/1024889
atctattagt

SEQ ID NO: 81486 - DNA, 10 bp, Unknown
  misc_feature (1)..( 10): Result.001 file - promoters70/1024889
attttttttc

SEQ ID NO: 81487 - DNA, 10 bp, Unknown
  misc_feature (1)..( 10): Result.001 file - promoters70/1024889
taattttata

SEQ ID NO: 81488 - DNA, 10 bp, Unknown
  misc_feature (1)..( 10): Result.001 file - promoters70/1024889
atctatgatt

SEQ ID NO: 81489 - DNA, 10 bp, Unknown
  misc_feature (1)..( 10): Result.001 file - promoters70/1024889
atttttttct

SEQ ID NO: 81490 - DNA, 10 bp, Unknown
  misc_feature (1)..( 10): Result.001 file - promoters70/1024889
gtcaatttga

SEQ ID NO: 81491 - DNA, 16 bp, Unknown
  misc_feature (1)..( 16): Result.001 file - promoters70/1024889
aatagatttttgttaa

SEQ ID NO: 81492 - DNA, 16 bp, Unknown
  misc_feature (1)..( 16): Result.001 file - promoters70/1024889
ttttttttttttttac

SEQ ID NO: 81493 - DNA, 16 bp, Unknown
  misc_feature (1)..( 16): Result.001 file - promoters70/1024889
tcgattatgtttttac

SEQ ID NO: 81494 - DNA, 16 bp, Unknown
  misc_feature (1)..( 16): Result.001 file - promoters70/1024889
tcgattgtgttcttag

SEQ ID NO: 81495 - DNA, 16 bp, Unknown
  misc_feature (1)..( 16): Result.001 file - promoters70/1024889
ttaatatactttttag

SEQ ID NO: 81496 - DNA, 16 bp, Unknown
  misc_feature (1)..( 16): Result.001 file - promoters70/1024889
aagagtttgtattcaa

SEQ ID NO: 81497 - DNA, 18 bp, Unknown
  misc_feature (1)..( 18): Result.001 file - promoters70/1024889
tcgattatgtttttacgt

SEQ ID NO: 81498 - DNA, 18 bp, Unknown
  misc_feature (1)..( 18): Result.001 file - promoters70/1024889
ttaatatactttttagtg

SEQ ID NO: 81499 - DNA, 18 bp, Unknown
  misc_feature (1)..( 18): Result.001 file - promoters70/1024889
ttttttttttttttacag

SEQ ID NO: 81500 - DNA, 18 bp, Unknown
  misc_feature (1)..( 18): Result.001 file - promoters70/1024889
tcgattgtgttcttagga

SEQ ID NO: 81501 - DNA, 18 bp, Unknown
  misc_feature (1)..( 18): Result.001 file - promoters70/1024889
gggtactaatctttacat

SEQ ID NO: 81502 - DNA, 18 bp, Unknown
  misc_feature (1)..( 18): Result.001 file - promoters70/1024993
catgaagagtttgtattc

SEQ ID NO: 81503 - DNA, 11 bp, Unknown
  misc_feature (1)..( 11): Result.001 file - promoters70/1024993
agacatgatca

SEQ ID NO: 81504 - DNA, 11 bp, Unknown
  misc_feature (1)..( 11): Result.001 file - promoters70/1024993
tgacatgatcg

SEQ ID NO: 81505 - DNA, 11 bp, Unknown
  misc_feature (1)..( 11): Result.001 file - promoters70/1024993
tagtatgatca

SEQ ID NO: 81506 - DNA, 11 bp, Unknown
  misc_feature (1)..( 11): Result.001 file - promoters70/1024993
tgaaatgattc

SEQ ID NO: 81507 - DNA, 11 bp, Unknown
  misc_feature (1)..( 11): Result.001 file - promoters70/1024993
gacaatgattt

SEQ ID NO: 81508 - DNA, 11 bp, Unknown
  misc_feature (1)..( 11): Result.001 file - promoters70/1024993
tcttattatcg

SEQ ID NO: 81509 - DNA, 14 bp, Unknown
  misc_feature (1)..( 14): Result.001 file - promoters70/1024993
tggtctaaggcgcc

SEQ ID NO: 81510 - DNA, 14 bp, Unknown
  misc_feature (1)..( 14): Result.001 file - promoters70/1024993
atgtctaatatcgt

SEQ ID NO: 81511 - DNA, 14 bp, Unknown
  misc_feature (1)..( 14): Result.001 file - promoters70/1024993
tcgtcgaatcctcg

SEQ ID NO: 81512 - DNA, 14 bp, Unknown
  misc_feature (1)..( 14): Result.001 file - promoters70/1024993
ttttctaattttgt

SEQ ID NO: 81513 - DNA, 14 bp, Unknown
  misc_feature (1)..( 14): Result.001 file - promoters70/1024993
atttccaattttgt

SEQ ID NO: 81514 - DNA, 14 bp, Unknown
  misc_feature (1)..( 14): Result.001 file - promoters70/1024993
ttttccaatgattc

SEQ ID NO: 81515 - DNA, 18 bp, Unknown
  misc_feature (1)..( 18): Result.001 file - promoters70/1024993
tcgtcgttacaaagtggg

SEQ ID NO: 81516 - DNA, 18 bp, Unknown
  misc_feature (1)..( 18): Result.001 file - promoters70/1024993
aaattgttccaaatttca

SEQ ID NO: 81517 - DNA, 18 bp, Unknown
  misc_feature (1)..( 18): Result.001 file - promoters70/1024993
atgtccttacacaacgtc

SEQ ID NO: 81518 - DNA, 18 bp, Unknown
  misc_feature (1)..( 18): Result.001 file - promoters70/1024993
atggcctgttactgggct

SEQ ID NO: 81519 - DNA, 18 bp, Unknown
  misc_feature (1)..( 18): Result.001 file - promoters70/1024993
gccttaatccgaatttca

SEQ ID NO: 81520 - DNA, 18 bp, Unknown
  misc_feature (1)..( 18): Result.001 file - promoters70/1025211
atttaagcccaaataata

SEQ ID NO: 81521 - DNA, 7 bp, Unknown
  misc_feature (1)..( 7): Result.001 file - promoters70/1025211
aaacaaa

SEQ ID NO: 81522 - DNA, 7 bp, Unknown
  misc_feature (1)..( 7): Result.001 file - promoters70/1025211
aaacaaa

SEQ ID NO: 81523 - DNA, 7 bp, Unknown
  misc_feature (1)..( 7): Result.001 file - promoters70/1025211
aaaaaaa

SEQ ID NO: 81524 - DNA, 9 bp, Unknown
  misc_feature (1)..( 9): Result.001 file - promoters70/1025211
atattatta

SEQ ID NO: 81525 - DNA, 9 bp, Unknown
  misc_feature (1)..( 9): Result.001 file - promoters70/1025211
ttattatat

SEQ ID NO: 81526 - DNA, 9 bp, Unknown
  misc_feature (1)..( 9): Result.001 file - promoters70/1025211
atataatta

SEQ ID NO: 81527 - DNA, 10 bp, Unknown
  misc_feature (1)..( 10): Result.001 file - promoters70/1025211
gtttccaata

SEQ ID NO: 81528 - DNA, 10 bp, Unknown
  misc_feature (1)..( 10): Result.001 file - promoters70/1025211
gtttcaaata

SEQ ID NO: 81529 - DNA, 10 bp, Unknown
  misc_feature (1)..( 10): Result.001 file - promoters70/1025211
agatcaaata

SEQ ID NO: 81530 - DNA, 8 bp, Unknown
  misc_feature (1)..( 8): Result.001 file - promoters70/1025211
agtctaaa

SEQ ID NO: 81531 - DNA, 8 bp, Unknown
  misc_feature (1)..( 8): Result.001 file - promoters70/1025211
agtccaaa

SEQ ID NO: 81532 - DNA, 8 bp, Unknown
  misc_feature (1)..( 8): Result.001 file - promoters70/1025211
ggtcaaaa

SEQ ID NO: 81533 - DNA, 9 bp, Unknown
  misc_feature (1)..( 9): Result.001 file - promoters70/1025211
aagtaaaca

SEQ ID NO: 81534 - DNA, 9 bp, Unknown
  misc_feature (1)..( 9): Result.001 file - promoters70/1025211
atctaaaca

SEQ ID NO: 81535 - DNA, 9 bp, Unknown
  misc_feature (1)..( 9): Result.001 file - promoters70/1025211
aaataaaac

SEQ ID NO: 81536 - DNA, 10 bp, Unknown
  misc_feature (1)..( 10): Result.001 file - promoters70/1025211
aatgaaaaac

SEQ ID NO: 81537 - DNA, 10 bp, Unknown
  misc_feature (1)..( 10): Result.001 file - promoters70/1025211
aatgaaattc

SEQ ID NO: 81538 - DNA, 10 bp, Unknown
  misc_feature (1)..( 10): Result.001 file - promoters70/1025582
aatgatattc

SEQ ID NO: 81539 - DNA, 10 bp, Unknown
  misc_feature (1)..( 10): Result.001 file - promoters70/1025582
gagacaattg

SEQ ID NO: 81540 - DNA, 10 bp, Unknown
  misc_feature (1)..( 10): Result.001 file - promoters70/1025582
tttacatttg

SEQ ID NO: 81541 - DNA, 10 bp, Unknown
  misc_feature (1)..( 10): Result.001 file - promoters70/1025642
gagataattt

SEQ ID NO: 81542 - DNA, 12 bp, Unknown
  misc_feature (1)..( 12): Result.001 file - promoters70/1025642
tcagaattaata

SEQ ID NO: 81543 - DNA, 12 bp, Unknown
  misc_feature (1)..( 12): Result.001 file - promoters70/1025642
tcataattaata

SEQ ID NO: 81544 - DNA, 12 bp, Unknown
  misc_feature (1)..( 12): Result.001 file - promoters70/1025642
catttattaaca

SEQ ID NO: 81545 - DNA, 12 bp, Unknown
  misc_feature (1)..( 12): Result.001 file - promoters70/1025642
attttattcaaa

SEQ ID NO: 81546 - DNA, 10 bp, Unknown
  misc_feature (1)..( 10): Result.001 file - promoters70/1025642
ccaaatttgg

SEQ ID NO: 81547 - DNA, 10 bp, Unknown
  misc_feature (1)..( 10): Result.001 file - promoters70/1025642
ccaattttaa

SEQ ID NO: 81548 - DNA, 10 bp, Unknown
  misc_feature (1)..( 10): Result.001 file - promoters70/1025642
ataattttgc

SEQ ID NO: 81549 - DNA, 12 bp, Unknown
  misc_feature (1)..( 12): Result.001 file - promoters70/1025642
ctaatgatttag

SEQ ID NO: 81550 - DNA, 12 bp, Unknown
  misc_feature (1)..( 12): Result.001 file - promoters70/1025642
taggagatttag

SEQ ID NO: 81551 - DNA, 9 bp, Unknown
  misc_feature (1)..( 9): Result.001 file - promoters70/1025642
tatataata

SEQ ID NO: 81552 - DNA, 9 bp, Unknown
  misc_feature (1)..( 9): Result.001 file - promoters70/1025642
tataaaata

SEQ ID NO: 81553 - DNA, 9 bp, Unknown
  misc_feature (1)..( 9): Result.001 file - promoters70/1025642
tttataatg

SEQ ID NO: 81554 - DNA, 9 bp, Unknown
  misc_feature (1)..( 9): Result.001 file - promoters70/1025683
tttttaact

SEQ ID NO: 81555 - DNA, 9 bp, Unknown
  misc_feature (1)..( 9): Result.001 file - promoters70/1025683
agagaatac

SEQ ID NO: 81556 - DNA, 9 bp, Unknown
  misc_feature (1)..( 9): Result.001 file - promoters70/1025683
agaaaatta

SEQ ID NO: 81557 - DNA, 9 bp, Unknown
  misc_feature (1)..( 9): Result.001 file - promoters70/1025683
agaacattg

SEQ ID NO: 81558 - DNA, 9 bp, Unknown
  misc_feature (1)..( 9): Result.001 file - promoters70/1025683
tctacattg

SEQ ID NO: 81559 - DNA, 10 bp, Unknown
  misc_feature (1)..( 10): Result.001 file - promoters70/1025683
cctttataaa

SEQ ID NO: 81560 - DNA, 10 bp, Unknown
  misc_feature (1)..( 10): Result.001 file - promoters70/1025683
cctatatata

SEQ ID NO: 81561 - DNA, 10 bp, Unknown
  misc_feature (1)..( 10): Result.001 file - promoters70/1025683
gtcttataaa

SEQ ID NO: 81562 - DNA, 14 bp, Unknown
  misc_feature (1)..( 14): Result.001 file - promoters70/1025683
atcgaatcagctaa

SEQ ID NO: 81563 - DNA, 14 bp, Unknown
  misc_feature (1)..( 14): Result.001 file - promoters70/1025683
tatgaatctgctaa

SEQ ID NO: 81564 - DNA, 14 bp, Unknown
  misc_feature (1)..( 14): Result.001 file - promoters70/1025791
tatgaatcatgtca

SEQ ID NO: 81565 - DNA, 14 bp, Unknown
  misc_feature (1)..( 14): Result.001 file - promoters70/1025791
tgaaagaaccttcc

SEQ ID NO: 81566 - DNA, 14 bp, Unknown
  misc_feature (1)..( 14): Result.001 file - promoters70/1025791
caaaagaatcagtg

SEQ ID NO: 81567 - DNA, 14 bp, Unknown
  misc_feature (1)..( 14): Result.001 file - promoters70/1025791
taaaagaacgaaat

SEQ ID NO: 81568 - DNA, 14 bp, Unknown
  misc_feature (1)..( 14): Result.001 file - promoters70/1025791
caaaacaattcaag

SEQ ID NO: 81569 - DNA, 14 bp, Unknown
  misc_feature (1)..( 14): Result.001 file - promoters70/1025791
ccaacgaaacgatt

SEQ ID NO: 81570 - DNA, 14 bp, Unknown
  misc_feature (1)..( 14): Result.001 file - promoters70/1025791
ccacagttctgtct

SEQ ID NO: 81571 - DNA, 12 bp, Unknown
  misc_feature (1)..( 12): Result.001 file - promoters70/1025791
ttccaaaaatga

SEQ ID NO: 81572 - DNA, 12 bp, Unknown
  misc_feature (1)..( 12): Result.001 file - promoters70/1025791
aaccaaaagaat

SEQ ID NO: 81573 - DNA, 12 bp, Unknown
  misc_feature (1)..( 12): Result.001 file - promoters70/1025791
aacgaaatatct

SEQ ID NO: 81574 - DNA, 12 bp, Unknown
  misc_feature (1)..( 12): Result.001 file - promoters70/1025791
taacaaaacaat

SEQ ID NO: 81575 - DNA, 12 bp, Unknown
  misc_feature (1)..( 12): Result.001 file - promoters70/1025791
aacgaaacgatt

SEQ ID NO: 81576 - DNA, 12 bp, Unknown
  misc_feature (1)..( 12): Result.001 file - promoters70/1026160
ttccacagttct

SEQ ID NO: 81577 - DNA, 15 bp, Unknown
  misc_feature (1)..( 15): Result.001 file - promoters70/1026160
aggataaaccatcgt

SEQ ID NO: 81578 - DNA, 15 bp, Unknown
  misc_feature (1)..( 15): Result.001 file - promoters70/1026160
aaaacaaaacatata

SEQ ID NO: 81579 - DNA, 15 bp, Unknown
  misc_feature (1)..( 15): Result.001 file - promoters70/1026160
ttcctctaccgtcgt

SEQ ID NO: 81580 - DNA, 15 bp, Unknown
  misc_feature (1)..( 15): Result.001 file - promoters70/1026160
ttaacaaaacaattc

SEQ ID NO: 81581 - DNA, 15 bp, Unknown
  misc_feature (1)..( 15): Result.001 file - promoters70/1026160
ttaataaaatttcac

SEQ ID NO: 81582 - DNA, 15 bp, Unknown
  misc_feature (1)..( 15): Result.001 file - promoters70/1026160
ttagtaaaagaatca

SEQ ID NO: 81583 - DNA, 11 bp, Unknown
  misc_feature (1)..( 11): Result.001 file - promoters70/1026160
caccaagacca

SEQ ID NO: 81584 - DNA, 11 bp, Unknown
  misc_feature (1)..( 11): Result.001 file - promoters70/1026160
atacaaaaccc

SEQ ID NO: 81585 - DNA, 11 bp, Unknown
  misc_feature (1)..( 11): Result.001 file - promoters70/1026160
aaacaaaacat

SEQ ID NO: 81586 - DNA, 11 bp, Unknown
  misc_feature (1)..( 11): Result.001 file - promoters70/1026160
aaacaaagtaa

SEQ ID NO: 81587 - DNA, 11 bp, Unknown
  misc_feature (1)..( 11): Result.001 file - promoters70/1026160
taagaaaaaaa

SEQ ID NO: 81588 - DNA, 11 bp, Unknown
  misc_feature (1)..( 11): Result.001 file - promoters70/1026551
aatcaaaaaat

SEQ ID NO: 81589 - DNA, 8 bp, Unknown
  misc_feature (1)..( 8): Result.001 file - promoters70/1026551
aatatata

SEQ ID NO: 81590 - DNA, 8 bp, Unknown
  misc_feature (1)..( 8): Result.001 file - promoters70/1026551
aatttata

SEQ ID NO: 81591 - DNA, 8 bp, Unknown
  misc_feature (1)..( 8): Result.001 file - promoters70/1026551
catatatg

SEQ ID NO: 81592 - DNA, 11 bp, Unknown
  misc_feature (1)..( 11): Result.001 file - promoters70/1026551
gcatatacctt

SEQ ID NO: 81593 - DNA, 11 bp, Unknown
  misc_feature (1)..( 11): Result.001 file - promoters70/1026551
aagtataactt

SEQ ID NO: 81594 - DNA, 11 bp, Unknown
  misc_feature (1)..( 11): Result.001 file - promoters70/1026551
aagtttaaaat

SEQ ID NO: 81595 - DNA, 7 bp, Unknown
  misc_feature (1)..( 7): Result.001 file - promoters70/1026551
aaatatt

SEQ ID NO: 81596 - DNA, 7 bp, Unknown
  misc_feature (1)..( 7): Result.001 file - promoters70/1026551
aaatatg

SEQ ID NO: 81597 - DNA, 7 bp, Unknown
  misc_feature (1)..( 7): Result.001 file - promoters70/1026551
aaaaatg

SEQ ID NO: 81598 - DNA, 15 bp, Unknown
  misc_feature (1)..( 15): Result.001 file - promoters70/1026551
aaggatgatggacca

SEQ ID NO: 81599 - DNA, 15 bp, Unknown
  misc_feature (1)..( 15): Result.001 file - promoters70/1026551
aaggatgatggacca

SEQ ID NO: 81600 - DNA, 15 bp, Unknown
  misc_feature (1)..( 15): Result.001 file - promoters70/1026551
aaggatgctgtgcca

SEQ ID NO: 81601 - DNA, 21 bp, Unknown
  misc_feature (1)..( 21): Result.001 file - promoters70/1026551
tacacattaataacgtggtcc

SEQ ID NO: 81602 - DNA, 21 bp, Unknown
  misc_feature (1)..( 21): Result.001 file - promoters70/1026551
tacacattaataacgtggtcg

SEQ ID NO: 81603 - DNA, 21 bp, Unknown
  misc_feature (1)..( 21): Result.001 file - promoters70/1026551
cccacgtaaataacgtggtcc

SEQ ID NO: 81604 - DNA, 7 bp, Unknown
  misc_feature (1)..( 7): Result.001 file - promoters70/1026551
ttacttt

SEQ ID NO: 81605 - DNA, 7 bp, Unknown
  misc_feature (1)..( 7): Result.001 file - promoters70/1026551
ttagttt

SEQ ID NO: 81606 - DNA, 7 bp, Unknown
  misc_feature (1)..( 7): Result.001 file - promoters70/1026551
ttaattt

SEQ ID NO: 81607 - DNA, 8 bp, Unknown
  misc_feature (1)..( 8): Result.001 file - promoters70/1026551
attttacg

SEQ ID NO: 81608 - DNA, 8 bp, Unknown
  misc_feature (1)..( 8): Result.001 file - promoters70/1026551
attttata

SEQ ID NO: 81609 - DNA, 8 bp, Unknown
  misc_feature (1)..( 8): Result.001 file - promoters70/1026622
attatata

SEQ ID NO: 81610 - DNA, 16 bp, Unknown
  misc_feature (1)..( 16): Result.001 file - promoters70/1026622
ggagttatttaatggg

SEQ ID NO: 81611 - DNA, 16 bp, Unknown
  misc_feature (1)..( 16): Result.001 file - promoters70/1026622
ggagttattacaattt

SEQ ID NO: 81612 - DNA, 16 bp, Unknown
  misc_feature (1)..( 16): Result.001 file - promoters70/1026622
gggattatttttggat

SEQ ID NO: 81613 - DNA, 16 bp, Unknown
  misc_feature (1)..( 16): Result.001 file - promoters70/1026622
agcgttttttaaaagg

SEQ ID NO: 81614 - DNA, 16 bp, Unknown
  misc_feature (1)..( 16): Result.001 file - promoters70/1026622
atccgaatttcaaagc

SEQ ID NO: 81615 - DNA, 16 bp, Unknown
  misc_feature (1)..( 16): Result.001 file - promoters70/1026622
acaaatttttaaaaag

SEQ ID NO: 81616 - DNA, 13 bp, Unknown
  misc_feature (1)..( 13): Result.001 file - promoters70/1026622
gttatttaatggg

SEQ ID NO: 81617 - DNA, 13 bp, Unknown
  misc_feature (1)..( 13): Result.001 file - promoters70/1026622
acaatttaaaaac

SEQ ID NO: 81618 - DNA, 13 bp, Unknown
  misc_feature (1)..( 13): Result.001 file - promoters70/1026622
tggatttaacaaa

SEQ ID NO: 81619 - DNA, 13 bp, Unknown
  misc_feature (1)..( 13): Result.001 file - promoters70/1026622
gttttttaaaagg

SEQ ID NO: 81620 - DNA, 14 bp, Unknown
  misc_feature (1)..( 14): Result.001 file - promoters70/1026622
cgaatttcaaagcc

SEQ ID NO: 81621 - DNA, 14 bp, Unknown
  misc_feature (1)..( 14): Result.001 file - promoters70/1026705
aaatttttaaaaag

SEQ ID NO: 81622 - DNA, 11 bp, Unknown
  misc_feature (1)..( 11): Result.001 file - promoters70/1026705
gaagatgtgaa

SEQ ID NO: 81623 - DNA, 11 bp, Unknown
  misc_feature (1)..( 11): Result.001 file - promoters70/1026705
gaaaatgggga

SEQ ID NO: 81624 - DNA, 11 bp, Unknown
  misc_feature (1)..( 11): Result.001 file - promoters70/1026861
agagatatgaa

SEQ ID NO: 81625 - DNA, 7 bp, Unknown
  misc_feature (1)..( 7): Result.001 file - promoters70/1026861
tataaaa

SEQ ID NO: 81626 - DNA, 7 bp, Unknown
  misc_feature (1)..( 7): Result.001 file - promoters70/1026861
cataaaa

SEQ ID NO: 81627 - DNA, 7 bp, Unknown
  misc_feature (1)..( 7): Result.001 file - promoters70/1026883
tataaaa

SEQ ID NO: 81628 - DNA, 9 bp, Unknown
  misc_feature (1)..( 9): Result.001 file - promoters70/1026883
aaataattt

SEQ ID NO: 81629 - DNA, 9 bp, Unknown
  misc_feature (1)..( 9): Result.001 file - promoters70/1026883
aaaaaattt

SEQ ID NO: 81630 - DNA, 9 bp, Unknown
  misc_feature (1)..( 9): Result.001 file - promoters70/1026883
aaataaaat

SEQ ID NO: 81631 - DNA, 9 bp, Unknown
  misc_feature (1)..( 9): Result.001 file - promoters70/1026883
ttgtaattt

SEQ ID NO: 81632 - DNA, 7 bp, Unknown
  misc_feature (1)..( 7): Result.001 file - promoters70/1026883
tagaact

SEQ ID NO: 81633 - DNA, 7 bp, Unknown
  misc_feature (1)..( 7): Result.001 file - promoters70/1026883
tagaaca

SEQ ID NO: 81634 - DNA, 7 bp, Unknown
  misc_feature (1)..( 7): Result.001 file - promoters70/1026883
aagaaca

SEQ ID NO: 81635 - DNA, 7 bp, Unknown
  misc_feature (1)..( 7): Result.001 file - promoters70/1026883
tgagaac

SEQ ID NO: 81636 - DNA, 7 bp, Unknown
  misc_feature (1)..( 7): Result.001 file - promoters70/1026883
tgaaaac

SEQ ID NO: 81637 - DNA, 7 bp, Unknown
  misc_feature (1)..( 7): Result.001 file - promoters70/1026883
agaaaac

SEQ ID NO: 81638 - DNA, 9 bp, Unknown
  misc_feature (1)..( 9): Result.001 file - promoters70/1026883
attagatta

SEQ ID NO: 81639 - DNA, 9 bp, Unknown
  misc_feature (1)..( 9): Result.001 file - promoters70/1026883
catagttta

SEQ ID NO: 81640 - DNA, 9 bp, Unknown
  misc_feature (1)..( 9): Result.001 file - promoters70/1026883
attggatta

SEQ ID NO: 81641 - DNA, 9 bp, Unknown
  misc_feature (1)..( 9): Result.001 file - promoters70/1026883
tcaaataat

SEQ ID NO: 81642 - DNA, 9 bp, Unknown
  misc_feature (1)..( 9): Result.001 file - promoters70/1026883
gaaaacaat

SEQ ID NO: 81643 - DNA, 9 bp, Unknown
  misc_feature (1)..( 9): Result.001 file - promoters70/1026883
acaaattta

SEQ ID NO: 81644 - DNA, 9 bp, Unknown
  misc_feature (1)..( 9): Result.001 file - promoters70/1026883
atttgtctt

SEQ ID NO: 81645 - DNA, 9 bp, Unknown
  misc_feature (1)..( 9): Result.001 file - promoters70/1026883
atttatcta

SEQ ID NO: 81646 - DNA, 9 bp, Unknown
  misc_feature (1)..( 9): Result.001 file - promoters70/1026883
ttttgttta

SEQ ID NO: 81647 - DNA, 10 bp, Unknown
  misc_feature (1)..( 10): Result.001 file - promoters70/1026883
aattatttat

SEQ ID NO: 81648 - DNA, 10 bp, Unknown
  misc_feature (1)..( 10): Result.001 file - promoters70/1026883
ctttacttac

SEQ ID NO: 81649 - DNA, 10 bp, Unknown
  misc_feature (1)..( 10): Result.001 file - promoters70/1026883
aataatttat

SEQ ID NO: 81650 - DNA, 13 bp, Unknown
  misc_feature (1)..( 13): Result.001 file - promoters70/1026883
aattatttatcgt

SEQ ID NO: 81651 - DNA, 13 bp, Unknown
  misc_feature (1)..( 13): Result.001 file - promoters70/1026883
cttactttctcgt

SEQ ID NO: 81652 - DNA, 13 bp, Unknown
  misc_feature (1)..( 13): Result.001 file - promoters70/1026883
aataatttattta

SEQ ID NO: 81653 - DNA, 8 bp, Unknown
  misc_feature (1)..( 8): Result.001 file - promoters70/1026883
aattataa

SEQ ID NO: 81654 - DNA, 8 bp, Unknown
  misc_feature (1)..( 8): Result.001 file - promoters70/1026883
aatcatag

SEQ ID NO: 81655 - DNA, 8 bp, Unknown
  misc_feature (1)..( 8): Result.001 file - promoters70/1026883
gattataa

SEQ ID NO: 81656 - DNA, 9 bp, Unknown
  misc_feature (1)..( 9): Result.001 file - promoters70/1026883
ggacagcca

SEQ ID NO: 81657 - DNA, 9 bp, Unknown
  misc_feature (1)..( 9): Result.001 file - promoters70/1026883
caacaacca

SEQ ID NO: 81658 - DNA, 9 bp, Unknown
  misc_feature (1)..( 9): Result.001 file - promoters70/1026976
caacaactt

SEQ ID NO: 81659 - DNA, 13 bp, Unknown
  misc_feature (1)..( 13): Result.001 file - promoters70/1026976
ttgaatgtaatct

SEQ ID NO: 81660 - DNA, 13 bp, Unknown
  misc_feature (1)..( 13): Result.001 file - promoters70/1026976
ttgaatcaatatt

SEQ ID NO: 81661 - DNA, 13 bp, Unknown
  misc_feature (1)..( 13): Result.001 file - promoters70/1026976
ttgattcaaaatt

SEQ ID NO: 81662 - DNA, 8 bp, Unknown
  misc_feature (1)..( 8): Result.001 file - promoters70/1026976
attcctgc

SEQ ID NO: 81663 - DNA, 8 bp, Unknown
  misc_feature (1)..( 8): Result.001 file - promoters70/1026976
atttctgc

SEQ ID NO: 81664 - DNA, 8 bp, Unknown
  misc_feature (1)..( 8): Result.001 file - promoters70/1026987
atttctct

SEQ ID NO: 81665 - DNA, 8 bp, Unknown
  misc_feature (1)..( 8): Result.001 file - promoters70/1026987
aaaacaaa

SEQ ID NO: 81666 - DNA, 8 bp, Unknown
  misc_feature (1)..( 8): Result.001 file - promoters70/1026987
gaaagaaa

SEQ ID NO: 81667 - DNA, 8 bp, Unknown
  misc_feature (1)..( 8): Result.001 file - promoters70/1026987
aaaacatt

SEQ ID NO: 81668 - DNA, 8 bp, Unknown
  misc_feature (1)..( 8): Result.001 file - promoters70/1026987
gaatgaaa

SEQ ID NO: 81669 - DNA, 11 bp, Unknown
  misc_feature (1)..( 11): Result.001 file - promoters70/1026987
tatgtaaacgt

SEQ ID NO: 81670 - DNA, 11 bp, Unknown
  misc_feature (1)..( 11): Result.001 file - promoters70/1026987
tatttaaaaag

SEQ ID NO: 81671 - DNA, 11 bp, Unknown
  misc_feature (1)..( 11): Result.001 file - promoters70/1026987
tatctaagacc

SEQ ID NO: 81672 - DNA, 11 bp, Unknown
  misc_feature (1)..( 11): Result.001 file - promoters70/1026987
gcattaaaata

SEQ ID NO: 81673 - DNA, 12 bp, Unknown
  misc_feature (1)..( 12): Result.001 file - promoters70/1026987
attttagaaaga

SEQ ID NO: 81674 - DNA, 10 bp, Unknown
  misc_feature (1)..( 10): Result.001 file - promoters70/1026987
cctaaaaaat

SEQ ID NO: 81675 - DNA, 10 bp, Unknown
  misc_feature (1)..( 10): Result.001 file - promoters70/1026987
tttaaaaaga

SEQ ID NO: 81676 - DNA, 10 bp, Unknown
  misc_feature (1)..( 10): Result.001 file - promoters70/1026987
attaaaatat

SEQ ID NO: 81677 - DNA, 10 bp, Unknown
  misc_feature (1)..( 10): Result.001 file - promoters70/1027189
tttagaaaga

SEQ ID NO: 81678 - DNA, 7 bp, Unknown
  misc_feature (1)..( 7): Result.001 file - promoters70/1027189
aaaaaat

SEQ ID NO: 81679 - DNA, 7 bp, Unknown
  misc_feature (1)..( 7): Result.001 file - promoters70/1027189
aaataat

SEQ ID NO: 81680 - DNA, 7 bp, Unknown
  misc_feature (1)..( 7): Result.001 file - promoters70/1027189
gaaaaat

SEQ ID NO: 81681 - DNA, 10 bp, Unknown
  misc_feature (1)..( 10): Result.001 file - promoters70/1027189
ggtttggttt

SEQ ID NO: 81682 - DNA, 10 bp, Unknown
  misc_feature (1)..( 10): Result.001 file - promoters70/1027189
ggtttgtttt

SEQ ID NO: 81683 - DNA, 10 bp, Unknown
  misc_feature (1)..( 10): Result.001 file - promoters70/1027276
aatttatttg

SEQ ID NO: 81684 - DNA, 9 bp, Unknown
  misc_feature (1)..( 9): Result.001 file - promoters70/1027276
agtaattta

SEQ ID NO: 81685 - DNA, 9 bp, Unknown
  misc_feature (1)..( 9): Result.001 file - promoters70/1027276
agtagtttc

SEQ ID NO: 81686 - DNA, 9 bp, Unknown
  misc_feature (1)..( 9): Result.001 file - promoters70/1027276
ttgagtttc

SEQ ID NO: 81687 - DNA, 9 bp, Unknown
  misc_feature (1)..( 9): Result.001 file - promoters70/1027276
aaattttaa

SEQ ID NO: 81688 - DNA, 9 bp, Unknown
  misc_feature (1)..( 9): Result.001 file - promoters70/1027276
aaatttgtt

SEQ ID NO: 81689 - DNA, 9 bp, Unknown
  misc_feature (1)..( 9): Result.001 file - promoters70/1027276
gaattctaa

SEQ ID NO: 81690 - DNA, 9 bp, Unknown
  misc_feature (1)..( 9): Result.001 file - promoters70/1027276
aaatatgtt

SEQ ID NO: 81691 - DNA, 8 bp, Unknown
  misc_feature (1)..( 8): Result.001 file - promoters70/1027276
acatattt

SEQ ID NO: 81692 - DNA, 8 bp, Unknown
  misc_feature (1)..( 8): Result.001 file - promoters70/1027276
acatatta

SEQ ID NO: 81693 - DNA, 8 bp, Unknown
  misc_feature (1)..( 8): Result.001 file - promoters70/1027276
tcatctta

SEQ ID NO: 81694 - DNA, 10 bp, Unknown
  misc_feature (1)..( 10): Result.001 file - promoters70/1027276
aaatgaaaaa

SEQ ID NO: 81695 - DNA, 10 bp, Unknown
  misc_feature (1)..( 10): Result.001 file - promoters70/1027276
aaaagaaatt

SEQ ID NO: 81696 - DNA, 10 bp, Unknown
  misc_feature (1)..( 10): Result.001 file - promoters70/1027276
tctagaaatt

SEQ ID NO: 81697 - DNA, 7 bp, Unknown
  misc_feature (1)..( 7): Result.001 file - promoters70/1027276
gaaaaaa

SEQ ID NO: 81698 - DNA, 7 bp, Unknown
  misc_feature (1)..( 7): Result.001 file - promoters70/1027276
gaagaaa

SEQ ID NO: 81699 - DNA, 7 bp, Unknown
  misc_feature (1)..( 7): Result.001 file - promoters70/1027276
taaaaaa

SEQ ID NO: 81700 - DNA, 8 bp, Unknown
  misc_feature (1)..( 8): Result.001 file - promoters70/1027276
ttattgaa

SEQ ID NO: 81701 - DNA, 8 bp, Unknown
  misc_feature (1)..( 8): Result.001 file - promoters70/1027276
atatagaa

SEQ ID NO: 81702 - DNA, 8 bp, Unknown
  misc_feature (1)..( 8): Result.001 file - promoters70/1027276
ttattgtt

SEQ ID NO: 81703 - DNA, 8 bp, Unknown
  misc_feature (1)..( 8): Result.001 file - promoters70/1027276
ctatgtag

SEQ ID NO: 81704 - DNA, 12 bp, Unknown
  misc_feature (1)..( 12): Result.001 file - promoters70/1027276
caaaaaaggaag

SEQ ID NO: 81705 - DNA, 12 bp, Unknown
  misc_feature (1)..( 12): Result.001 file - promoters70/1027276
tgaaaaagagaa

SEQ ID NO: 81706 - DNA, 13 bp, Unknown
  misc_feature (1)..( 13): Result.001 file - promoters70/1027276
acaacaaacgaag

SEQ ID NO: 81707 - DNA, 7 bp, Unknown
  misc_feature (1)..( 7): Result.001 file - promoters70/1027276
tcaaaat

SEQ ID NO: 81708 - DNA, 7 bp, Unknown
  misc_feature (1)..( 7): Result.001 file - promoters70/1027276
acaaaat

SEQ ID NO: 81709 - DNA, 7 bp, Unknown
  misc_feature (1)..( 7): Result.001 file - promoters70/1027327
tcaaaac

SEQ ID NO: 81710 - DNA, 11 bp, Unknown
  misc_feature (1)..( 11): Result.001 file - promoters70/1027327
ttggaaaagac

SEQ ID NO: 81711 - DNA, 11 bp, Unknown
  misc_feature (1)..( 11): Result.001 file - promoters70/1027327
ttgtaaatgtt

SEQ ID NO: 81712 - DNA, 11 bp, Unknown
  misc_feature (1)..( 11): Result.001 file - promoters70/1027327
ttgtaaatgtt

SEQ ID NO: 81713 - DNA, 11 bp, Unknown
  misc_feature (1)..( 11): Result.001 file - promoters70/1027327
aagtaaattta

SEQ ID NO: 81714 - DNA, 13 bp, Unknown
  misc_feature (1)..( 13): Result.001 file - promoters70/1027327
gattaataagggt

SEQ ID NO: 81715 - DNA, 13 bp, Unknown
  misc_feature (1)..( 13): Result.001 file - promoters70/1027327
cattaatgggctt

SEQ ID NO: 81716 - DNA, 13 bp, Unknown
  misc_feature (1)..( 13): Result.001 file - promoters70/1027327
tgttaatgggctt

SEQ ID NO: 81717 - DNA, 13 bp, Unknown
  misc_feature (1)..( 13): Result.001 file - promoters70/1027399
cataaataagccc

SEQ ID NO: 81718 - DNA, 10 bp, Unknown
  misc_feature (1)..( 10): Result.001 file - promoters70/1027399
ataactctat

SEQ ID NO: 81719 - DNA, 10 bp, Unknown
  misc_feature (1)..( 10): Result.001 file - promoters70/1027399
ataactttat

SEQ ID NO: 81720 - DNA, 10 bp, Unknown
  misc_feature (1)..( 10): Result.001 file - promoters70/1027406
ataactctgc

SEQ ID NO: 81721 - DNA, 8 bp, Unknown
  misc_feature (1)..( 8): Result.001 file - promoters70/1027406
tataaaat

SEQ ID NO: 81722 - DNA, 8 bp, Unknown
  misc_feature (1)..( 8): Result.001 file - promoters70/1027406
gataaaag

SEQ ID NO: 81723 - DNA, 8 bp, Unknown
  misc_feature (1)..( 8): Result.001 file - promoters70/1027406
tatgaaat

SEQ ID NO: 81724 - DNA, 7 bp, Unknown
  misc_feature (1)..( 7): Result.001 file - promoters70/1027406
atgaaat

SEQ ID NO: 81725 - DNA, 7 bp, Unknown
  misc_feature (1)..( 7): Result.001 file - promoters70/1027406
ctgaaat

SEQ ID NO: 81726 - DNA, 7 bp, Unknown
  misc_feature (1)..( 7): Result.001 file - promoters70/1027406
atgaaat

SEQ ID NO: 81727 - DNA, 17 bp, Unknown
  misc_feature (1)..( 17): Result.001 file - promoters70/1027406
ttttaagaaagtatata

SEQ ID NO: 81728 - DNA, 17 bp, Unknown
  misc_feature (1)..( 17): Result.001 file - promoters70/1027406
ttttaaaaaactatata

SEQ ID NO: 81729 - DNA, 17 bp, Unknown
  misc_feature (1)..( 17): Result.001 file - promoters70/1027590
tcgataaaagctaatgt

SEQ ID NO: 81730 - DNA, 8 bp, Unknown
  misc_feature (1)..( 8): Result.001 file - promoters70/1027590
caatagag

SEQ ID NO: 81731 - DNA, 8 bp, Unknown
  misc_feature (1)..( 8): Result.001 file - promoters70/1027590
ttatagag

SEQ ID NO: 81732 - DNA, 8 bp, Unknown
  misc_feature (1)..( 8): Result.001 file - promoters70/1027590
ttacagat

SEQ ID NO: 81733 - DNA, 12 bp, Unknown
  misc_feature (1)..( 12): Result.001 file - promoters70/1027590
taagaaaataaa

SEQ ID NO: 81734 - DNA, 12 bp, Unknown
  misc_feature (1)..( 12): Result.001 file - promoters70/1027590
taaaaaaataaa

SEQ ID NO: 81735 - DNA, 12 bp, Unknown
  misc_feature (1)..( 12): Result.001 file - promoters70/1027760
taaaaaactatt

SEQ ID NO: 81736 - DNA, 14 bp, Unknown
  misc_feature (1)..( 14): Result.001 file - promoters70/1027760
taagtttaagttgt

SEQ ID NO: 81737 - DNA, 14 bp, Unknown
  misc_feature (1)..( 14): Result.001 file - promoters70/1027760
attgttcaagacga

SEQ ID NO: 81738 - DNA, 14 bp, Unknown
  misc_feature (1)..( 14): Result.001 file - promoters70/1027760
taattttatatatg

SEQ ID NO: 81739 - DNA, 14 bp, Unknown
  misc_feature (1)..( 14): Result.001 file - promoters70/1027760
taagtttagtaaaa

SEQ ID NO: 81740 - DNA, 14 bp, Unknown
  misc_feature (1)..( 14): Result.001 file - promoters70/1027760
aaagtttgatatat

SEQ ID NO: 81741 - DNA, 14 bp, Unknown
  misc_feature (1)..( 14): Result.001 file - promoters70/1027760
gaattttttttcgg

SEQ ID NO: 81742 - DNA, 13 bp, Unknown
  misc_feature (1)..( 13): Result.001 file - promoters70/1027760
ataaatattcaac

SEQ ID NO: 81743 - DNA, 13 bp, Unknown
  misc_feature (1)..( 13): Result.001 file - promoters70/1027760
tgaaatatttttt

SEQ ID NO: 81744 - DNA, 13 bp, Unknown
  misc_feature (1)..( 13): Result.001 file - promoters70/1027760
taaaaaattacgg

SEQ ID NO: 81745 - DNA, 13 bp, Unknown
  misc_feature (1)..( 13): Result.001 file - promoters70/1027760
taaaaaatttttt

SEQ ID NO: 81746 - DNA, 13 bp, Unknown
  misc_feature (1)..( 13): Result.001 file - promoters70/1027760
tgatataataagg

SEQ ID NO: 81747 - DNA, 13 bp, Unknown
  misc_feature (1)..( 13): Result.001 file - promoters70/1027760
ataaaaatgtgaa

SEQ ID NO: 81748 - DNA, 13 bp, Unknown
  misc_feature (1)..( 13): Result.001 file - promoters70/1027760
agaaaaaaaaaaa

SEQ ID NO: 81749 - DNA, 13 bp, Unknown
  misc_feature (1)..( 13): Result.001 file - promoters70/1027760
ccaaaaacaaaaa

SEQ ID NO: 81750 - DNA, 17 bp, Unknown
  misc_feature (1)..( 17): Result.001 file - promoters70/1027760
tatccttttcaattaat

SEQ ID NO: 81751 - DNA, 17 bp, Unknown
  misc_feature (1)..( 17): Result.001 file - promoters70/1027760
ttagatttttaatatat

SEQ ID NO: 81752 - DNA, 17 bp, Unknown
  misc_feature (1)..( 17): Result.001 file - promoters70/1027760
aatagtttactatttat

SEQ ID NO: 81753 - DNA, 17 bp, Unknown
  misc_feature (1)..( 17): Result.001 file - promoters70/1027760
aataatttacgaaattg

SEQ ID NO: 81754 - DNA, 17 bp, Unknown
  misc_feature (1)..( 17): Result.001 file - promoters70/1027760
catcatttttctcctga

SEQ ID NO: 81755 - DNA, 17 bp, Unknown
  misc_feature (1)..( 17): Result.001 file - promoters70/1027760
aagtttttgtaataata

SEQ ID NO: 81756 - DNA, 12 bp, Unknown
  misc_feature (1)..( 12): Result.001 file - promoters70/1027760
agggtttgatta

SEQ ID NO: 81757 - DNA, 12 bp, Unknown
  misc_feature (1)..( 12): Result.001 file - promoters70/1027760
tcacttttatta

SEQ ID NO: 81758 - DNA, 12 bp, Unknown
  misc_feature (1)..( 12): Result.001 file - promoters70/1027760
ttcctttcattc

SEQ ID NO: 81759 - DNA, 12 bp, Unknown
  misc_feature (1)..( 12): Result.001 file - promoters70/1027760
ttcgtttcaagt

SEQ ID NO: 81760 - DNA, 12 bp, Unknown
  misc_feature (1)..( 12): Result.001 file - promoters70/1027760
actatttcaaaa

SEQ ID NO: 81761 - DNA, 12 bp, Unknown
  misc_feature (1)..( 12): Result.001 file - promoters70/1028243
agatgtatatca

SEQ ID NO: 81762 - DNA, 13 bp, Unknown
  misc_feature (1)..( 13): Result.001 file - promoters70/1028243
aacatcaataaac

SEQ ID NO: 81763 - DNA, 13 bp, Unknown
  misc_feature (1)..( 13): Result.001 file - promoters70/1028243
aatcaaaataaaa

SEQ ID NO: 81764 - DNA, 13 bp, Unknown
  misc_feature (1)..( 13): Result.001 file - promoters70/1028243
ttatccaacaaaa

SEQ ID NO: 81765 - DNA, 13 bp, Unknown
  misc_feature (1)..( 13): Result.001 file - promoters70/1028243
aacaacaataatt

SEQ ID NO: 81766 - DNA, 14 bp, Unknown
  misc_feature (1)..( 14): Result.001 file - promoters70/1028243
ttgtgcaaccaaaa

SEQ ID NO: 81767 - DNA, 14 bp, Unknown
  misc_feature (1)..( 14): Result.001 file - promoters70/1028243
aaaaccaaacaaaa

SEQ ID NO: 81768 - DNA, 13 bp, Unknown
  misc_feature (1)..( 13): Result.001 file - promoters70/1028243
cttacaatttcac

SEQ ID NO: 81769 - DNA, 13 bp, Unknown
  misc_feature (1)..( 13): Result.001 file - promoters70/1028243
aaatcaatttaaa

SEQ ID NO: 81770 - DNA, 13 bp, Unknown
  misc_feature (1)..( 13): Result.001 file - promoters70/1028243
ccatgaatttaaa

SEQ ID NO: 81771 - DNA, 13 bp, Unknown
  misc_feature (1)..( 13): Result.001 file - promoters70/1028243
gtatcgattatgt

SEQ ID NO: 81772 - DNA, 13 bp, Unknown
  misc_feature (1)..( 13): Result.001 file - promoters70/1028243
aaaacaattttag

SEQ ID NO: 81773 - DNA, 13 bp, Unknown
  misc_feature (1)..( 13): Result.001 file - promoters70/1028368
atatctattgggc

SEQ ID NO: 81774 - DNA, 12 bp, Unknown
  misc_feature (1)..( 12): Result.001 file - promoters70/1028368
gagacaaagtat

SEQ ID NO: 81775 - DNA, 12 bp, Unknown
  misc_feature (1)..( 12): Result.001 file - promoters70/1028368
ttgacaaaaaca

SEQ ID NO: 81776 - DNA, 12 bp, Unknown
  misc_feature (1)..( 12): Result.001 file - promoters70/1028368
aagaaaaacagt

SEQ ID NO: 81777 - DNA, 12 bp, Unknown
  misc_feature (1)..( 12): Result.001 file - promoters70/1028368
agtaaaaataca

SEQ ID NO: 81778 - DNA, 12 bp, Unknown
  misc_feature (1)..( 12): Result.001 file - promoters70/1028368
aagaaaatctga

SEQ ID NO: 81779 - DNA, 12 bp, Unknown
  misc_feature (1)..( 12): Result.001 file - promoters70/1028368
atttaaaatata

SEQ ID NO: 81780 - DNA, 10 bp, Unknown
  misc_feature (1)..( 10): Result.001 file - promoters70/1028368
ttataaaacc

SEQ ID NO: 81781 - DNA, 10 bp, Unknown
  misc_feature (1)..( 10): Result.001 file - promoters70/1028368
atataaatta

SEQ ID NO: 81782 - DNA, 10 bp, Unknown
  misc_feature (1)..( 10): Result.001 file - promoters70/1028368
atataaagag

SEQ ID NO: 81783 - DNA, 10 bp, Unknown
  misc_feature (1)..( 10): Result.001 file - promoters70/1028368
ctataaatct

SEQ ID NO: 81784 - DNA, 10 bp, Unknown
  misc_feature (1)..( 10): Result.001 file - promoters70/1028368
taataaaacc

SEQ ID NO: 81785 - DNA, 10 bp, Unknown
  misc_feature (1)..( 10): Result.001 file - promoters70/1028368
atataagtaa

SEQ ID NO: 81786 - DNA, 13 bp, Unknown
  misc_feature (1)..( 13): Result.001 file - promoters70/1028368
atctcaaaatacc

SEQ ID NO: 81787 - DNA, 13 bp, Unknown
  misc_feature (1)..( 13): Result.001 file - promoters70/1028368
acttcaaaattta

SEQ ID NO: 81788 - DNA, 13 bp, Unknown
  misc_feature (1)..( 13): Result.001 file - promoters70/1028368
aagtaaaaataca

SEQ ID NO: 81789 - DNA, 13 bp, Unknown
  misc_feature (1)..( 13): Result.001 file - promoters70/1028368
gatttaaaatata

SEQ ID NO: 81790 - DNA, 13 bp, Unknown
  misc_feature (1)..( 13): Result.001 file - promoters70/1028368
atctgaaaaattc

SEQ ID NO: 81791 - DNA, 13 bp, Unknown
  misc_feature (1)..( 13): Result.001 file - promoters70/1028368
aaaacaaattttt

SEQ ID NO: 81792 - DNA, 13 bp, Unknown
  misc_feature (1)..( 13): Result.001 file - promoters70/1028368
aaaagaaaaacag

SEQ ID NO: 81793 - DNA, 13 bp, Unknown
  misc_feature (1)..( 13): Result.001 file - promoters70/1028368
tggtccaaatagt

SEQ ID NO: 81794 - DNA, 7 bp, Unknown
  misc_feature (1)..( 7): Result.001 file - promoters70/1028368
aaagtat

SEQ ID NO: 81795 - DNA, 7 bp, Unknown
  misc_feature (1)..( 7): Result.001 file - promoters70/1028368
aaaatat

SEQ ID NO: 81796 - DNA, 7 bp, Unknown
  misc_feature (1)..( 7): Result.001 file - promoters70/1028368
aaagtat

SEQ ID NO: 81797 - DNA, 8 bp, Unknown
  misc_feature (1)..( 8): Result.001 file - promoters70/1028368
aaatgtat

SEQ ID NO: 81798 - DNA, 8 bp, Unknown
  misc_feature (1)..( 8): Result.001 file - promoters70/1028368
gaaagtat

SEQ ID NO: 81799 - DNA, 8 bp, Unknown
  misc_feature (1)..( 8): Result.001 file - promoters70/1028413
caaaatat

SEQ ID NO: 81800 - DNA, 8 bp, Unknown
  misc_feature (1)..( 8): Result.001 file - promoters70/1028413
aaaagaaa

SEQ ID NO: 81801 - DNA, 8 bp, Unknown
  misc_feature (1)..( 8): Result.001 file - promoters70/1028413
aaatgaaa

SEQ ID NO: 81802 - DNA, 8 bp, Unknown
  misc_feature (1)..( 8): Result.001 file - promoters70/1028413
caaacaaa

SEQ ID NO: 81803 - DNA, 11 bp, Unknown
  misc_feature (1)..( 11): Result.001 file - promoters70/1028413
ccgaaccaaaa

SEQ ID NO: 81804 - DNA, 11 bp, Unknown
  misc_feature (1)..( 11): Result.001 file - promoters70/1028413
gtgaaccagga

SEQ ID NO: 81805 - DNA, 11 bp, Unknown
  misc_feature (1)..( 11): Result.001 file - promoters70/1028413
gtgaaacagga

SEQ ID NO: 81806 - DNA, 10 bp, Unknown
  misc_feature (1)..( 10): Result.001 file - promoters70/1028413
aaaccgaacc

SEQ ID NO: 81807 - DNA, 10 bp, Unknown
  misc_feature (1)..( 10): Result.001 file - promoters70/1028413
aaaacgaaat

SEQ ID NO: 81808 - DNA, 10 bp, Unknown
  misc_feature (1)..( 10): Result.001 file - promoters70/1028413
caaatgaaat

SEQ ID NO: 81809 - DNA, 9 bp, Unknown
  misc_feature (1)..( 9): Result.001 file - promoters70/1028413
tttgaagac

SEQ ID NO: 81810 - DNA, 9 bp, Unknown
  misc_feature (1)..( 9): Result.001 file - promoters70/1028413
tttaaaggg

SEQ ID NO: 81811 - DNA, 9 bp, Unknown
  misc_feature (1)..( 9): Result.001 file - promoters70/1028470
agtaatggg

SEQ ID NO: 81812 - DNA, 10 bp, Unknown
  misc_feature (1)..( 10): Result.001 file - promoters70/1028470
ctaaatactc

SEQ ID NO: 81813 - DNA, 10 bp, Unknown
  misc_feature (1)..( 10): Result.001 file - promoters70/1028470
ctagatatat

SEQ ID NO: 81814 - DNA, 10 bp, Unknown
  misc_feature (1)..( 10): Result.001 file - promoters70/1028470
gcaaatcctc

SEQ ID NO: 81815 - DNA, 10 bp, Unknown
  misc_feature (1)..( 10): Result.001 file - promoters70/1028470
atagatatgc

SEQ ID NO: 81816 - DNA, 9 bp, Unknown
  misc_feature (1)..( 9): Result.001 file - promoters70/1028470
tttaatgaa

SEQ ID NO: 81817 - DNA, 9 bp, Unknown
  misc_feature (1)..( 9): Result.001 file - promoters70/1028470
tttaatata

SEQ ID NO: 81818 - DNA, 9 bp, Unknown
  misc_feature (1)..( 9): Result.001 file - promoters70/1028470
tttgatata

SEQ ID NO: 81819 - DNA, 9 bp, Unknown
  misc_feature (1)..( 9): Result.001 file - promoters70/1028470
tgtgatata

SEQ ID NO: 81820 - DNA, 12 bp, Unknown
  misc_feature (1)..( 12): Result.001 file - promoters70/1028470
gacactttagaa

SEQ ID NO: 81821 - DNA, 12 bp, Unknown
  misc_feature (1)..( 12): Result.001 file - promoters70/1028470
gactctttttct

SEQ ID NO: 81822 - DNA, 12 bp, Unknown
  misc_feature (1)..( 12): Result.001 file - promoters70/1028470
ttctctttttct

SEQ ID NO: 81823 - DNA, 12 bp, Unknown
  misc_feature (1)..( 12): Result.001 file - promoters70/1028682
gtctctttttct

SEQ ID NO: 81824 - DNA, 9 bp, Unknown
  misc_feature (1)..( 9): Result.001 file - promoters70/1028682
ttttcaatt

SEQ ID NO: 81825 - DNA, 9 bp, Unknown
  misc_feature (1)..( 9): Result.001 file - promoters70/1028682
ttttcaaac

SEQ ID NO: 81826 - DNA, 9 bp, Unknown
  misc_feature (1)..( 9): Result.001 file - promoters70/1028682
gtttcaatt

SEQ ID NO: 81827 - DNA, 7 bp, Unknown
  misc_feature (1)..( 7): Result.001 file - promoters70/1028682
catatat

SEQ ID NO: 81828 - DNA, 7 bp, Unknown
  misc_feature (1)..( 7): Result.001 file - promoters70/1028682
tatatat

SEQ ID NO: 81829 - DNA, 7 bp, Unknown
  misc_feature (1)..( 7): Result.001 file - promoters70/1028863
catataa

SEQ ID NO: 81830 - DNA, 10 bp, Unknown
  misc_feature (1)..( 10): Result.001 file - promoters70/1028863
agattttttt

SEQ ID NO: 81831 - DNA, 10 bp, Unknown
  misc_feature (1)..( 10): Result.001 file - promoters70/1028863
ctcttttttt

SEQ ID NO: 81832 - DNA, 10 bp, Unknown
  misc_feature (1)..( 10): Result.001 file - promoters70/1028937
agatgtttgg

SEQ ID NO: 81833 - DNA, 7 bp, Unknown
  misc_feature (1)..( 7): Result.001 file - promoters70/1028937
tattttg

SEQ ID NO: 81834 - DNA, 7 bp, Unknown
  misc_feature (1)..( 7): Result.001 file - promoters70/1028937
tatttta

SEQ ID NO: 81835 - DNA, 7 bp, Unknown
  misc_feature (1)..( 7): Result.001 file - promoters70/1028955
aattttg

SEQ ID NO: 81836 - DNA, 8 bp, Unknown
  misc_feature (1)..( 8): Result.001 file - promoters70/1028955
attatctt

SEQ ID NO: 81837 - DNA, 8 bp, Unknown
  misc_feature (1)..( 8): Result.001 file - promoters70/1028955
attgtctc

SEQ ID NO: 81838 - DNA, 8 bp, Unknown
  misc_feature (1)..( 8): Result.001 file - promoters70/1028955
gatgtctc

SEQ ID NO: 81839 - DNA, 9 bp, Unknown
  misc_feature (1)..( 9): Result.001 file - promoters70/1028955
gatgtttca

SEQ ID NO: 81840 - DNA, 9 bp, Unknown
  misc_feature (1)..( 9): Result.001 file - promoters70/1028955
gatgtctca

SEQ ID NO: 81841 - DNA, 9 bp, Unknown
  misc_feature (1)..( 9): Result.001 file - promoters70/1028963
attgtctcc

SEQ ID NO: 81842 - DNA, 10 bp, Unknown
  misc_feature (1)..( 10): Result.001 file - promoters70/1028963
taatacaatt

SEQ ID NO: 81843 - DNA, 10 bp, Unknown
  misc_feature (1)..( 10): Result.001 file - promoters70/1028963
aaataaaata

SEQ ID NO: 81844 - DNA, 10 bp, Unknown
  misc_feature (1)..( 10): Result.001 file - promoters70/1028963
aaatgaaata

SEQ ID NO: 81845 - DNA, 8 bp, Unknown
  misc_feature (1)..( 8): Result.001 file - promoters70/1028963
tatcttct

SEQ ID NO: 81846 - DNA, 8 bp, Unknown
  misc_feature (1)..( 8): Result.001 file - promoters70/1028963
tattttct

SEQ ID NO: 81847 - DNA, 8 bp, Unknown
  misc_feature (1)..( 8): Result.001 file - promoters70/1029485
tatcttaa

SEQ ID NO: 81848 - DNA, 13 bp, Unknown
  misc_feature (1)..( 13): Result.001 file - promoters70/1029485
atactgcccaaac

SEQ ID NO: 81849 - DNA, 13 bp, Unknown
  misc_feature (1)..( 13): Result.001 file - promoters70/1029485
aataggcccaaca

SEQ ID NO: 81850 - DNA, 13 bp, Unknown
  misc_feature (1)..( 13): Result.001 file - promoters70/1029485
taaaggcccaata

SEQ ID NO: 81851 - DNA, 13 bp, Unknown
  misc_feature (1)..( 13): Result.001 file - promoters70/1029485
aatgggcctaatt

SEQ ID NO: 81852 - DNA, 13 bp, Unknown
  misc_feature (1)..( 13): Result.001 file - promoters70/1029485
aatgggccgaatt

SEQ ID NO: 81853 - DNA, 13 bp, Unknown
  misc_feature (1)..( 13): Result.001 file - promoters70/1029908
tgaaagcccaaaa

SEQ ID NO: 81854 - DNA, 7 bp, Unknown
  misc_feature (1)..( 7): Result.001 file - promoters70/1029908
aagattt

SEQ ID NO: 81855 - DNA, 7 bp, Unknown
  misc_feature (1)..( 7): Result.001 file - promoters70/1029908
aagattc

SEQ ID NO: 81856 - DNA, 7 bp, Unknown
  misc_feature (1)..( 7): Result.001 file - promoters70/1029908
aagattt

SEQ ID NO: 81857 - DNA, 12 bp, Unknown
  misc_feature (1)..( 12): Result.001 file - promoters70/1029908
tgtattttatgt

SEQ ID NO: 81858 - DNA, 12 bp, Unknown
  misc_feature (1)..( 12): Result.001 file - promoters70/1029908
tgtgtttgttgt

SEQ ID NO: 81859 - DNA, 12 bp, Unknown
  misc_feature (1)..( 12): Result.001 file - promoters70/1029952
attattatatgt

SEQ ID NO: 81860 - DNA, 12 bp, Unknown
  misc_feature (1)..( 12): Result.001 file - promoters70/1029952
aatgggctgggc

SEQ ID NO: 81861 - DNA, 12 bp, Unknown
  misc_feature (1)..( 12): Result.001 file - promoters70/1029952
aataggcccaac

SEQ ID NO: 81862 - DNA, 12 bp, Unknown
  misc_feature (1)..( 12): Result.001 file - promoters70/1029952
aatgggccttta

SEQ ID NO: 81863 - DNA, 12 bp, Unknown
  misc_feature (1)..( 12): Result.001 file - promoters70/1029952
tatgggccttat

SEQ ID NO: 81864 - DNA, 12 bp, Unknown
  misc_feature (1)..( 12): Result.001 file - promoters70/1029952
cataggcccata

SEQ ID NO: 81865 - DNA, 12 bp, Unknown
  misc_feature (1)..( 12): Result.001 file - promoters70/1029952
aatgggccgaat

SEQ ID NO: 81866 - DNA, 12 bp, Unknown
  misc_feature (1)..( 12): Result.001 file - promoters70/1029952
aaaaggcccata

SEQ ID NO: 81867 - DNA, 12 bp, Unknown
  misc_feature (1)..( 12): Result.001 file - promoters70/1030231
tttgggccaact

SEQ ID NO: 81868 - DNA, 11 bp, Unknown
  misc_feature (1)..( 11): Result.001 file - promoters70/1030231
atttgaattta

SEQ ID NO: 81869 - DNA, 11 bp, Unknown
  misc_feature (1)..( 11): Result.001 file - promoters70/1030231
atttgaatttt

SEQ ID NO: 81870 - DNA, 11 bp, Unknown
  misc_feature (1)..( 11): Result.001 file - promoters70/1030283
tagtgattttt

SEQ ID NO: 81871 - DNA, 8 bp, Unknown
  misc_feature (1)..( 8): Result.001 file - promoters70/1030283
ggaaaaga

SEQ ID NO: 81872 - DNA, 8 bp, Unknown
  misc_feature (1)..( 8): Result.001 file - promoters70/1030283
aaaaaaga

SEQ ID NO: 81873 - DNA, 8 bp, Unknown
  misc_feature (1)..( 8): Result.001 file - promoters70/1030283
aaaaaaga

SEQ ID NO: 81874 - DNA, 7 bp, Unknown
  misc_feature (1)..( 7): Result.001 file - promoters70/1030283
tcccttg

SEQ ID NO: 81875 - DNA, 7 bp, Unknown
  misc_feature (1)..( 7): Result.001 file - promoters70/1030283
tcctttg

SEQ ID NO: 81876 - DNA, 7 bp, Unknown
  misc_feature (1)..( 7): Result.001 file - promoters70/1030283
tcctttt

SEQ ID NO: 81877 - DNA, 8 bp, Unknown
  misc_feature (1)..( 8): Result.001 file - promoters70/1030283
aaagaaga

SEQ ID NO: 81878 - DNA, 8 bp, Unknown
  misc_feature (1)..( 8): Result.001 file - promoters70/1030283
aaaaaaga

SEQ ID NO: 81879 - DNA, 8 bp, Unknown
  misc_feature (1)..( 8): Result.001 file - promoters70/1030283
aaaaaaga

SEQ ID NO: 81880 - DNA, 7 bp, Unknown
  misc_feature (1)..( 7): Result.001 file - promoters70/1030283
ttccaaa

SEQ ID NO: 81881 - DNA, 7 bp, Unknown
  misc_feature (1)..( 7): Result.001 file - promoters70/1030283
ttccaaa

SEQ ID NO: 81882 - DNA, 7 bp, Unknown
  misc_feature (1)..( 7): Result.001 file - promoters70/1030283
tcccaag

SEQ ID NO: 81883 - DNA, 15 bp, Unknown
  misc_feature (1)..( 15): Result.001 file - promoters70/1030283
aatatctttcacctt

SEQ ID NO: 81884 - DNA, 15 bp, Unknown
  misc_feature (1)..( 15): Result.001 file - promoters70/1030283
tttatttttgttggt

SEQ ID NO: 81885 - DNA, 15 bp, Unknown
  misc_feature (1)..( 15): Result.001 file - promoters70/1030283
caaatttttactttt

SEQ ID NO: 81886 - DNA, 10 bp, Unknown
  misc_feature (1)..( 10): Result.001 file - promoters70/1030283
tttgaataat

SEQ ID NO: 81887 - DNA, 10 bp, Unknown
  misc_feature (1)..( 10): Result.001 file - promoters70/1030283
tttgattaaa

SEQ ID NO: 81888 - DNA, 10 bp, Unknown
  misc_feature (1)..( 10): Result.001 file - promoters70/1030283
aaaaaataat

SEQ ID NO: 81889 - DNA, 10 bp, Unknown
  misc_feature (1)..( 10): Result.001 file - promoters70/1030283
tgtaaaaatt

SEQ ID NO: 81890 - DNA, 10 bp, Unknown
  misc_feature (1)..( 10): Result.001 file - promoters70/1030283
tataaaaatt

SEQ ID NO: 81891 - DNA, 10 bp, Unknown
  misc_feature (1)..( 10): Result.001 file - promoters70/1030283
tataaaaaga

SEQ ID NO: 81892 - DNA, 7 bp, Unknown
  misc_feature (1)..( 7): Result.001 file - promoters70/1030283
aaaacaa

SEQ ID NO: 81893 - DNA, 7 bp, Unknown
  misc_feature (1)..( 7): Result.001 file - promoters70/1030283
gaaacaa

SEQ ID NO: 81894 - DNA, 7 bp, Unknown
  misc_feature (1)..( 7): Result.001 file - promoters70/1030528
gaaccaa

SEQ ID NO: 81895 - DNA, 9 bp, Unknown
  misc_feature (1)..( 9): Result.001 file - promoters70/1030528
atactaatt

SEQ ID NO: 81896 - DNA, 9 bp, Unknown
  misc_feature (1)..( 9): Result.001 file - promoters70/1030528
ataataatt

SEQ ID NO: 81897 - DNA, 9 bp, Unknown
  misc_feature (1)..( 9): Result.001 file - promoters70/1030528
agaataatg

SEQ ID NO: 81898 - DNA, 13 bp, Unknown
  misc_feature (1)..( 13): Result.001 file - promoters70/1030528
ttatttttttaaa

SEQ ID NO: 81899 - DNA, 13 bp, Unknown
  misc_feature (1)..( 13): Result.001 file - promoters70/1030528
ttatatttttaat

SEQ ID NO: 81900 - DNA, 13 bp, Unknown
  misc_feature (1)..( 13): Result.001 file - promoters70/1030528
caatgcatttaaa

SEQ ID NO: 81901 - DNA, 7 bp, Unknown
  misc_feature (1)..( 7): Result.001 file - promoters70/1030528
ttaaaaa

SEQ ID NO: 81902 - DNA, 7 bp, Unknown
  misc_feature (1)..( 7): Result.001 file - promoters70/1030528
ctaaaaa

SEQ ID NO: 81903 - DNA, 7 bp, Unknown
  misc_feature (1)..( 7): Result.001 file - promoters70/1030547
ttaaaat

SEQ ID NO: 81904 - DNA, 9 bp, Unknown
  misc_feature (1)..( 9): Result.001 file - promoters70/1030547
aatgtttgt

SEQ ID NO: 81905 - DNA, 9 bp, Unknown
  misc_feature (1)..( 9): Result.001 file - promoters70/1030547
catgtttag

SEQ ID NO: 81906 - DNA, 9 bp, Unknown
  misc_feature (1)..( 9): Result.001 file - promoters70/1030547
aatctttgt

SEQ ID NO: 81907 - DNA, 13 bp, Unknown
  misc_feature (1)..( 13): Result.001 file - promoters70/1030547
ttttgaagaattt

SEQ ID NO: 81908 - DNA, 13 bp, Unknown
  misc_feature (1)..( 13): Result.001 file - promoters70/1030547
ttttgatgaatgt

SEQ ID NO: 81909 - DNA, 13 bp, Unknown
  misc_feature (1)..( 13): Result.001 file - promoters70/1030547
aaaagatgaagtc

SEQ ID NO: 81910 - DNA, 13 bp, Unknown
  misc_feature (1)..( 13): Result.001 file - promoters70/1030547
cccttgtgaatgt

SEQ ID NO: 81911 - DNA, 14 bp, Unknown
  misc_feature (1)..( 14): Result.001 file - promoters70/1030547
ccataaaaatgtta

SEQ ID NO: 81912 - DNA, 14 bp, Unknown
  misc_feature (1)..( 14): Result.001 file - promoters70/1030547
tttcataaatttta

SEQ ID NO: 81913 - DNA, 14 bp, Unknown
  misc_feature (1)..( 14): Result.001 file - promoters70/1030547
attctaaaatattg

SEQ ID NO: 81914 - DNA, 10 bp, Unknown
  misc_feature (1)..( 10): Result.001 file - promoters70/1030547
tatataaaca

SEQ ID NO: 81915 - DNA, 10 bp, Unknown
  misc_feature (1)..( 10): Result.001 file - promoters70/1030547
tatataataa

SEQ ID NO: 81916 - DNA, 10 bp, Unknown
  misc_feature (1)..( 10): Result.001 file - promoters70/1030547
cctataaata

SEQ ID NO: 81917 - DNA, 10 bp, Unknown
  misc_feature (1)..( 10): Result.001 file - promoters70/1030547
acgataaata

SEQ ID NO: 81918 - DNA, 10 bp, Unknown
  misc_feature (1)..( 10): Result.001 file - promoters70/1030547
tataaacaaa

SEQ ID NO: 81919 - DNA, 10 bp, Unknown
  misc_feature (1)..( 10): Result.001 file - promoters70/1030547
aataaccaaa

SEQ ID NO: 81920 - DNA, 10 bp, Unknown
  misc_feature (1)..( 10): Result.001 file - promoters70/1030547
tataaatatc

SEQ ID NO: 81921 - DNA, 9 bp, Unknown
  misc_feature (1)..( 9): Result.001 file - promoters70/1030547
agttggtta

SEQ ID NO: 81922 - DNA, 9 bp, Unknown
  misc_feature (1)..( 9): Result.001 file - promoters70/1030547
ttttgatta

SEQ ID NO: 81923 - DNA, 9 bp, Unknown
  misc_feature (1)..( 9): Result.001 file - promoters70/1030547
ttttaattc

SEQ ID NO: 81924 - DNA, 14 bp, Unknown
  misc_feature (1)..( 14): Result.001 file - promoters70/1030547
aaacttataattat

SEQ ID NO: 81925 - DNA, 14 bp, Unknown
  misc_feature (1)..( 14): Result.001 file - promoters70/1030547
atctttataagtat

SEQ ID NO: 81926 - DNA, 14 bp, Unknown
  misc_feature (1)..( 14): Result.001 file - promoters70/1030547
cgttttaaaagtaa

SEQ ID NO: 81927 - DNA, 14 bp, Unknown
  misc_feature (1)..( 14): Result.001 file - promoters70/1030547
atctttatacaaaa

SEQ ID NO: 81928 - DNA, 10 bp, Unknown
  misc_feature (1)..( 10): Result.001 file - promoters70/1030547
catattatac

SEQ ID NO: 81929 - DNA, 10 bp, Unknown
  misc_feature (1)..( 10): Result.001 file - promoters70/1030547
atctttatac

SEQ ID NO: 81930 - DNA, 10 bp, Unknown
  misc_feature (1)..( 10): Result.001 file - promoters70/1030547
atctttataa

SEQ ID NO: 81931 - DNA, 10 bp, Unknown
  misc_feature (1)..( 10): Result.001 file - promoters70/1030547
aaatatgttt

SEQ ID NO: 81932 - DNA, 10 bp, Unknown
  misc_feature (1)..( 10): Result.001 file - promoters70/1030547
taatatattt

SEQ ID NO: 81933 - DNA, 10 bp, Unknown
  misc_feature (1)..( 10): Result.001 file - promoters70/1030605
taacatataa

SEQ ID NO: 81934 - DNA, 11 bp, Unknown
  misc_feature (1)..( 11): Result.001 file - promoters70/1030605
aaaataataat

SEQ ID NO: 81935 - DNA, 11 bp, Unknown
  misc_feature (1)..( 11): Result.001 file - promoters70/1030605
aaaaaaataca

SEQ ID NO: 81936 - DNA, 11 bp, Unknown
  misc_feature (1)..( 11): Result.001 file - promoters70/1030605
aaaaaaagaat

SEQ ID NO: 81937 - DNA, 11 bp, Unknown
  misc_feature (1)..( 11): Result.001 file - promoters70/1030605
tgaagaatctg

SEQ ID NO: 81938 - DNA, 11 bp, Unknown
  misc_feature (1)..( 11): Result.001 file - promoters70/1030605
taaattagaat

SEQ ID NO: 81939 - DNA, 11 bp, Unknown
  misc_feature (1)..( 11): Result.001 file - promoters70/1030605
ataaatagaat

SEQ ID NO: 81940 - DNA, 11 bp, Unknown
  misc_feature (1)..( 11): Result.001 file - promoters70/1030605
gttaattgaaa

SEQ ID NO: 81941 - DNA, 11 bp, Unknown
  misc_feature (1)..( 11): Result.001 file - promoters70/1030605
ttacttggaaa

SEQ ID NO: 81942 - DNA, 16 bp, Unknown
  misc_feature (1)..( 16): Result.001 file - promoters70/1030605
ccttctataaaaagga

SEQ ID NO: 81943 - DNA, 16 bp, Unknown
  misc_feature (1)..( 16): Result.001 file - promoters70/1030605
cctactatataaactc

SEQ ID NO: 81944 - DNA, 16 bp, Unknown
  misc_feature (1)..( 16): Result.001 file - promoters70/1030605
ctctctatatataaag

SEQ ID NO: 81945 - DNA, 16 bp, Unknown
  misc_feature (1)..( 16): Result.001 file - promoters70/1030605
ataagtatatatactc

SEQ ID NO: 81946 - DNA, 14 bp, Unknown
  misc_feature (1)..( 14): Result.001 file - promoters70/1030605
ttaaactatagttg

SEQ ID NO: 81947 - DNA, 14 bp, Unknown
  misc_feature (1)..( 14): Result.001 file - promoters70/1030605
tagtactatcgttt

SEQ ID NO: 81948 - DNA, 14 bp, Unknown
  misc_feature (1)..( 14): Result.001 file - promoters70/1030605
ttaaaatatattta

SEQ ID NO: 81949 - DNA, 14 bp, Unknown
  misc_feature (1)..( 14): Result.001 file - promoters70/1030605
ttgacatattttta

SEQ ID NO: 81950 - DNA, 10 bp, Unknown
  misc_feature (1)..( 10): Result.001 file - promoters70/1030605
tatttagaaa

SEQ ID NO: 81951 - DNA, 10 bp, Unknown
  misc_feature (1)..( 10): Result.001 file - promoters70/1030605
tattgagata

SEQ ID NO: 81952 - DNA, 10 bp, Unknown
  misc_feature (1)..( 10): Result.001 file - promoters70/1030605
tatttaatca

SEQ ID NO: 81953 - DNA, 10 bp, Unknown
  misc_feature (1)..( 10): Result.001 file - promoters70/1030757
tttttataaa

SEQ ID NO: 81954 - DNA, 10 bp, Unknown
  misc_feature (1)..( 10): Result.001 file - promoters70/1030757
caaatacatt

SEQ ID NO: 81955 - DNA, 10 bp, Unknown
  misc_feature (1)..( 10): Result.001 file - promoters70/1030757
caaaaacaac

SEQ ID NO: 81956 - DNA, 10 bp, Unknown
  misc_feature (1)..( 10): Result.001 file - promoters70/1030757
taaatacatt

SEQ ID NO: 81957 - DNA, 8 bp, Unknown
  misc_feature (1)..( 8): Result.001 file - promoters70/1030757
cttctgaa

SEQ ID NO: 81958 - DNA, 8 bp, Unknown
  misc_feature (1)..( 8): Result.001 file - promoters70/1030757
cttttgaa

SEQ ID NO: 81959 - DNA, 8 bp, Unknown
  misc_feature (1)..( 8): Result.001 file - promoters70/1030821
attttgag

SEQ ID NO: 81960 - DNA, 9 bp, Unknown
  misc_feature (1)..( 9): Result.001 file - promoters70/1030821
aataacatc

SEQ ID NO: 81961 - DNA, 9 bp, Unknown
  misc_feature (1)..( 9): Result.001 file - promoters70/1030821
aataacaaa

SEQ ID NO: 81962 - DNA, 9 bp, Unknown
  misc_feature (1)..( 9): Result.001 file - promoters70/1030821
tataaaaaa

SEQ ID NO: 81963 - DNA, 9 bp, Unknown
  misc_feature (1)..( 9): Result.001 file - promoters70/1030821
aacaaaaaa

SEQ ID NO: 81964 - DNA, 12 bp, Unknown
  misc_feature (1)..( 12): Result.001 file - promoters70/1030821
tcaataaactta

SEQ ID NO: 81965 - DNA, 12 bp, Unknown
  misc_feature (1)..( 12): Result.001 file - promoters70/1030821
acaaaaaataat

SEQ ID NO: 81966 - DNA, 12 bp, Unknown
  misc_feature (1)..( 12): Result.001 file - promoters70/1030821
agaaacaatgta

SEQ ID NO: 81967 - DNA, 12 bp, Unknown
  misc_feature (1)..( 12): Result.001 file - promoters70/1030821
acaatctactta

SEQ ID NO: 81968 - DNA, 7 bp, Unknown
  misc_feature (1)..( 7): Result.001 file - promoters70/1030821
aaacata

SEQ ID NO: 81969 - DNA, 7 bp, Unknown
  misc_feature (1)..( 7): Result.001 file - promoters70/1030821
aaaaata

SEQ ID NO: 81970 - DNA, 8 bp, Unknown
  misc_feature (1)..( 8): Result.001 file - promoters70/1030821
aaatcata

SEQ ID NO: 81971 - DNA, 8 bp, Unknown
  misc_feature (1)..( 8): Result.001 file - promoters70/1030902
aaaatata

SEQ ID NO: 81972 - DNA, 12 bp, Unknown
  misc_feature (1)..( 12): Result.001 file - promoters70/1030902
gtcttataaata

SEQ ID NO: 81973 - DNA, 12 bp, Unknown
  misc_feature (1)..( 12): Result.001 file - promoters70/1030902
catgtataaaaa

SEQ ID NO: 81974 - DNA, 12 bp, Unknown
  misc_feature (1)..( 12): Result.001 file - promoters70/1030916
gtcatataaata

SEQ ID NO: 81975 - DNA, 10 bp, Unknown
  misc_feature (1)..( 10): Result.001 file - promoters70/1030916
aagtactaaa

SEQ ID NO: 81976 - DNA, 10 bp, Unknown
  misc_feature (1)..( 10): Result.001 file - promoters70/1030916
ttttactaac

SEQ ID NO: 81977 - DNA, 10 bp, Unknown
  misc_feature (1)..( 10): Result.001 file - promoters70/1030916
ttttaataac

SEQ ID NO: 81978 - DNA, 9 bp, Unknown
  misc_feature (1)..( 9): Result.001 file - promoters70/1030916
atttcaaaa

SEQ ID NO: 81979 - DNA, 9 bp, Unknown
  misc_feature (1)..( 9): Result.001 file - promoters70/1030916
atttccaaa

SEQ ID NO: 81980 - DNA, 9 bp, Unknown
  misc_feature (1)..( 9): Result.001 file - promoters70/1030916
gggtcaaaa

SEQ ID NO: 81981 - DNA, 9 bp, Unknown
  misc_feature (1)..( 9): Result.001 file - promoters70/1030916
ctttataat

SEQ ID NO: 81982 - DNA, 9 bp, Unknown
  misc_feature (1)..( 9): Result.001 file - promoters70/1030916
cattaaaat

SEQ ID NO: 81983 - DNA, 10 bp, Unknown
  misc_feature (1)..( 10): Result.001 file - promoters70/1031084
acttcataga

SEQ ID NO: 81984 - DNA, 9 bp, Unknown
  misc_feature (1)..( 9): Result.001 file - promoters70/1031084
tagagaatg

SEQ ID NO: 81985 - DNA, 9 bp, Unknown
  misc_feature (1)..( 9): Result.001 file - promoters70/1031084
tagacaatg

SEQ ID NO: 81986 - DNA, 9 bp, Unknown
  misc_feature (1)..( 9): Result.001 file - promoters70/1031267
tagagaata

SEQ ID NO: 81987 - DNA, 9 bp, Unknown
  misc_feature (1)..( 9): Result.001 file - promoters70/1031267
gaaaaaaag

SEQ ID NO: 81988 - DNA, 9 bp, Unknown
  misc_feature (1)..( 9): Result.001 file - promoters70/1031267
caaacaaat

SEQ ID NO: 81989 - DNA, 9 bp, Unknown
  misc_feature (1)..( 9): Result.001 file - promoters70/1031267
caaagaaag

SEQ ID NO: 81990 - DNA, 9 bp, Unknown
  misc_feature (1)..( 9): Result.001 file - promoters70/1031267
caaaaaaaa

SEQ ID NO: 81991 - DNA, 9 bp, Unknown
  misc_feature (1)..( 9): Result.001 file - promoters70/1031267
aaaagaaag

SEQ ID NO: 81992 - DNA, 9 bp, Unknown
  misc_feature (1)..( 9): Result.001 file - promoters70/1031267
caaggaaag

SEQ ID NO: 81993 - DNA, 9 bp, Unknown
  misc_feature (1)..( 9): Result.001 file - promoters70/1031267
taactaaaa

SEQ ID NO: 81994 - DNA, 12 bp, Unknown
  misc_feature (1)..( 12): Result.001 file - promoters70/1031267
ccatcgaattca

SEQ ID NO: 81995 - DNA, 12 bp, Unknown
  misc_feature (1)..( 12): Result.001 file - promoters70/1031267
aaatcaaatcga

SEQ ID NO: 81996 - DNA, 12 bp, Unknown
  misc_feature (1)..( 12): Result.001 file - promoters70/1031267
aaaccaaagaaa

SEQ ID NO: 81997 - DNA, 12 bp, Unknown
  misc_feature (1)..( 12): Result.001 file - promoters70/1031267
cagtcaaatata

SEQ ID NO: 81998 - DNA, 12 bp, Unknown
  misc_feature (1)..( 12): Result.001 file - promoters70/1031267
aagtaaaaaagt

SEQ ID NO: 81999 - DNA, 12 bp, Unknown
  misc_feature (1)..( 12): Result.001 file - promoters70/1031267
tgtacaaggaaa

SEQ ID NO: 82000 - DNA, 12 bp, Unknown
  misc_feature (1)..( 12): Result.001 file - promoters70/1031267
aattcaagacct

SEQ ID NO: 82001 - DNA, 12 bp, Unknown
  misc_feature (1)..( 12): Result.001 file - promoters70/1031267
atggcaaaacca

SEQ ID NO: 82002 - DNA, 12 bp, Unknown
  misc_feature (1)..( 12): Result.001 file - promoters70/1031267
aaatcaaatcga

SEQ ID NO: 82003 - DNA, 12 bp, Unknown
  misc_feature (1)..( 12): Result.001 file - promoters70/1031267
cagtcaaatata

SEQ ID NO: 82004 - DNA, 12 bp, Unknown
  misc_feature (1)..( 12): Result.001 file - promoters70/1031267
aagtaaaaaagt

SEQ ID NO: 82005 - DNA, 12 bp, Unknown
  misc_feature (1)..( 12): Result.001 file - promoters70/1031291
tgtacaaggaaa

SEQ ID NO: 82006 - DNA, 12 bp, Unknown
  misc_feature (1)..( 12): Result.001 file - promoters70/1031291
aataaaaattca

SEQ ID NO: 82007 - DNA, 12 bp, Unknown
  misc_feature (1)..( 12): Result.001 file - promoters70/1031291
cataaaatacaa

SEQ ID NO: 82008 - DNA, 12 bp, Unknown
  misc_feature (1)..( 12): Result.001 file - promoters70/1031291
aataaaatttca

SEQ ID NO: 82009 - DNA, 12 bp, Unknown
  misc_feature (1)..( 12): Result.001 file - promoters70/1031291
cataaatacaat

SEQ ID NO: 82010 - DNA, 12 bp, Unknown
  misc_feature (1)..( 12): Result.001 file - promoters70/1031291
ataaaaattcaa

SEQ ID NO: 82011 - DNA, 12 bp, Unknown
  misc_feature (1)..( 12): Result.001 file - promoters70/1031291
tcactaattcat

SEQ ID NO: 82012 - DNA, 13 bp, Unknown
  misc_feature (1)..( 13): Result.001 file - promoters70/1031291
aataaaatttcac

SEQ ID NO: 82013 - DNA, 13 bp, Unknown
  misc_feature (1)..( 13): Result.001 file - promoters70/1031291
cacataaatacaa

SEQ ID NO: 82014 - DNA, 13 bp, Unknown
  misc_feature (1)..( 13): Result.001 file - promoters70/1031429
aacacaaagtcac

SEQ ID NO: 82015 - DNA, 9 bp, Unknown
  misc_feature (1)..( 9): Result.001 file - promoters70/1031429
taaccaata

SEQ ID NO: 82016 - DNA, 9 bp, Unknown
  misc_feature (1)..( 9): Result.001 file - promoters70/1031429
taatcaaaa

SEQ ID NO: 82017 - DNA, 9 bp, Unknown
  misc_feature (1)..( 9): Result.001 file - promoters70/1031429
cgaccaata

SEQ ID NO: 82018 - DNA, 10 bp, Unknown
  misc_feature (1)..( 10): Result.001 file - promoters70/1031429
aatacaaatc

SEQ ID NO: 82019 - DNA, 10 bp, Unknown
  misc_feature (1)..( 10): Result.001 file - promoters70/1031429
aataccaatc

SEQ ID NO: 82020 - DNA, 10 bp, Unknown
  misc_feature (1)..( 10): Result.001 file - promoters70/1031429
aatacaaatc

SEQ ID NO: 82021 - DNA, 7 bp, Unknown
  misc_feature (1)..( 7): Result.001 file - promoters70/1031429
taaggca

SEQ ID NO: 82022 - DNA, 7 bp, Unknown
  misc_feature (1)..( 7): Result.001 file - promoters70/1031429
taaagca

SEQ ID NO: 82023 - DNA, 7 bp, Unknown
  misc_feature (1)..( 7): Result.001 file - promoters70/1031429
taaggca

SEQ ID NO: 82024 - DNA, 11 bp, Unknown
  misc_feature (1)..( 11): Result.001 file - promoters70/1031429
aaataaacaaa

SEQ ID NO: 82025 - DNA, 11 bp, Unknown
  misc_feature (1)..( 11): Result.001 file - promoters70/1031429
aaagaaataaa

SEQ ID NO: 82026 - DNA, 11 bp, Unknown
  misc_feature (1)..( 11): Result.001 file - promoters70/1031706
gaagaaaccgg

SEQ ID NO: 82027 - DNA, 8 bp, Unknown
  misc_feature (1)..( 8): Result.001 file - promoters70/1031706
tatatata

SEQ ID NO: 82028 - DNA, 8 bp, Unknown
  misc_feature (1)..( 8): Result.001 file - promoters70/1031706
tatatata

SEQ ID NO: 82029 - DNA, 8 bp, Unknown
  misc_feature (1)..( 8): Result.001 file - promoters70/1031799
tatataaa

SEQ ID NO: 82030 - DNA, 10 bp, Unknown
  misc_feature (1)..( 10): Result.001 file - promoters70/1031799
acaaaacatc

SEQ ID NO: 82031 - DNA, 10 bp, Unknown
  misc_feature (1)..( 10): Result.001 file - promoters70/1031799
ataaaacaaa

SEQ ID NO: 82032 - DNA, 10 bp, Unknown
  misc_feature (1)..( 10): Result.001 file - promoters70/1031799
tcaaaaccgt

SEQ ID NO: 82033 - DNA, 10 bp, Unknown
  misc_feature (1)..( 10): Result.001 file - promoters70/1031799
tacaaatatc

SEQ ID NO: 82034 - DNA, 10 bp, Unknown
  misc_feature (1)..( 10): Result.001 file - promoters70/1031799
ataagacagt

SEQ ID NO: 82035 - DNA, 10 bp, Unknown
  misc_feature (1)..( 10): Result.001 file - promoters70/1031799
tagagatagt

SEQ ID NO: 82036 - DNA, 11 bp, Unknown
  misc_feature (1)..( 11): Result.001 file - promoters70/1031799
gtatatatata

SEQ ID NO: 82037 - DNA, 11 bp, Unknown
  misc_feature (1)..( 11): Result.001 file - promoters70/1031799
atatttatata

SEQ ID NO: 82038 - DNA, 11 bp, Unknown
  misc_feature (1)..( 11): Result.001 file - promoters70/1031799
caataaaaagc

SEQ ID NO: 82039 - DNA, 11 bp, Unknown
  misc_feature (1)..( 11): Result.001 file - promoters70/1031799
atatttgtatc

SEQ ID NO: 82040 - DNA, 11 bp, Unknown
  misc_feature (1)..( 11): Result.001 file - promoters70/1031799
ttataaaaccc

SEQ ID NO: 82041 - DNA, 11 bp, Unknown
  misc_feature (1)..( 11): Result.001 file - promoters70/1031799
ctattaaagcc

SEQ ID NO: 82042 - DNA, 13 bp, Unknown
  misc_feature (1)..( 13): Result.001 file - promoters70/1031799
agttataaatcgt

SEQ ID NO: 82043 - DNA, 13 bp, Unknown
  misc_feature (1)..( 13): Result.001 file - promoters70/1031799
agttatgaatccg

SEQ ID NO: 82044 - DNA, 13 bp, Unknown
  misc_feature (1)..( 13): Result.001 file - promoters70/1031799
caaatcaaatcga

SEQ ID NO: 82045 - DNA, 13 bp, Unknown
  misc_feature (1)..( 13): Result.001 file - promoters70/1031799
aacccgaaaccgt

SEQ ID NO: 82046 - DNA, 13 bp, Unknown
  misc_feature (1)..( 13): Result.001 file - promoters70/1031799
gaaaatgaattct

SEQ ID NO: 82047 - DNA, 13 bp, Unknown
  misc_feature (1)..( 13): Result.001 file - promoters70/1032047
taactaaaattag

SEQ ID NO: 82048 - DNA, 7 bp, Unknown
  misc_feature (1)..( 7): Result.001 file - promoters70/1032047
caatatt

SEQ ID NO: 82049 - DNA, 7 bp, Unknown
  misc_feature (1)..( 7): Result.001 file - promoters70/1032047
caaaatt

SEQ ID NO: 82050 - DNA, 7 bp, Unknown
  misc_feature (1)..( 7): Result.001 file - promoters70/1032047
caatata

SEQ ID NO: 82051 - DNA, 7 bp, Unknown
  misc_feature (1)..( 7): Result.001 file - promoters70/1032047
tttttac

SEQ ID NO: 82052 - DNA, 7 bp, Unknown
  misc_feature (1)..( 7): Result.001 file - promoters70/1032047
gttttac

SEQ ID NO: 82053 - DNA, 7 bp, Unknown
  misc_feature (1)..( 7): Result.001 file - promoters70/1032047
tttttat

SEQ ID NO: 82054 - DNA, 12 bp, Unknown
  misc_feature (1)..( 12): Result.001 file - promoters70/1032047
aaaggaaagaat

SEQ ID NO: 82055 - DNA, 12 bp, Unknown
  misc_feature (1)..( 12): Result.001 file - promoters70/1032047
acaggaaaatgg

SEQ ID NO: 82056 - DNA, 12 bp, Unknown
  misc_feature (1)..( 12): Result.001 file - promoters70/1032047
aaagcaaacaat

SEQ ID NO: 82057 - DNA, 13 bp, Unknown
  misc_feature (1)..( 13): Result.001 file - promoters70/1032047
ctcctataaattg

SEQ ID NO: 82058 - DNA, 13 bp, Unknown
  misc_feature (1)..( 13): Result.001 file - promoters70/1032047
ggtgtataaattg

SEQ ID NO: 82059 - DNA, 13 bp, Unknown
  misc_feature (1)..( 13): Result.001 file - promoters70/1032047
ctcttatatattc

SEQ ID NO: 82060 - DNA, 15 bp, Unknown
  misc_feature (1)..( 15): Result.001 file - promoters70/1032047
tatataagatatatg

SEQ ID NO: 82061 - DNA, 15 bp, Unknown
  misc_feature (1)..( 15): Result.001 file - promoters70/1032047
caaaaaagaaatatg

SEQ ID NO: 82062 - DNA, 16 bp, Unknown
  misc_feature (1)..( 16): Result.001 file - promoters70/1032047
ccataaaggaaaaagc

SEQ ID NO: 82063 - DNA, 9 bp, Unknown
  misc_feature (1)..( 9): Result.001 file - promoters70/1032047
atatgaaat

SEQ ID NO: 82064 - DNA, 9 bp, Unknown
  misc_feature (1)..( 9): Result.001 file - promoters70/1032047
ataggaata

SEQ ID NO: 82065 - DNA, 9 bp, Unknown
  misc_feature (1)..( 9): Result.001 file - promoters70/1032047
atagtaata

SEQ ID NO: 82066 - DNA, 13 bp, Unknown
  misc_feature (1)..( 13): Result.001 file - promoters70/1032047
tgtttatggaaaa

SEQ ID NO: 82067 - DNA, 13 bp, Unknown
  misc_feature (1)..( 13): Result.001 file - promoters70/1032047
ccataaaggaaaa

SEQ ID NO: 82068 - DNA, 13 bp, Unknown
  misc_feature (1)..( 13): Result.001 file - promoters70/1032313
ccaaaaaagaaat

SEQ ID NO: 82069 - DNA, 8 bp, Unknown
  misc_feature (1)..( 8): Result.001 file - promoters70/1032313
ggtttttt

SEQ ID NO: 82070 - DNA, 8 bp, Unknown
  misc_feature (1)..( 8): Result.001 file - promoters70/1032313
actttttt

SEQ ID NO: 82071 - DNA, 8 bp, Unknown
  misc_feature (1)..( 8): Result.001 file - promoters70/1032313
tgtttttc

SEQ ID NO: 82072 - DNA, 8 bp, Unknown
  misc_feature (1)..( 8): Result.001 file - promoters70/1032313
cgtttttg

SEQ ID NO: 82073 - DNA, 8 bp, Unknown
  misc_feature (1)..( 8): Result.001 file - promoters70/1032313
tctttttg

SEQ ID NO: 82074 - DNA, 8 bp, Unknown
  misc_feature (1)..( 8): Result.001 file - promoters70/1032381
cgttttcc

SEQ ID NO: 82075 - DNA, 8 bp, Unknown
  misc_feature (1)..( 8): Result.001 file - promoters70/1032381
cttcttta

SEQ ID NO: 82076 - DNA, 8 bp, Unknown
  misc_feature (1)..( 8): Result.001 file - promoters70/1032381
cttcttta

SEQ ID NO: 82077 - DNA, 8 bp, Unknown
  misc_feature (1)..( 8): Result.001 file - promoters70/1032381
attctttt

SEQ ID NO: 82078 - DNA, 8 bp, Unknown
  misc_feature (1)..( 8): Result.001 file - promoters70/1032381
attatttt

SEQ ID NO: 82079 - DNA, 8 bp, Unknown
  misc_feature (1)..( 8): Result.001 file - promoters70/1032381
tatgtttc

SEQ ID NO: 82080 - DNA, 8 bp, Unknown
  misc_feature (1)..( 8): Result.001 file - promoters70/1032381
gatgtttg

SEQ ID NO: 82081 - DNA, 10 bp, Unknown
  misc_feature (1)..( 10): Result.001 file - promoters70/1032381
tataaatcgt

SEQ ID NO: 82082 - DNA, 10 bp, Unknown
  misc_feature (1)..( 10): Result.001 file - promoters70/1032381
aataaattat

SEQ ID NO: 82083 - DNA, 10 bp, Unknown
  misc_feature (1)..( 10): Result.001 file - promoters70/1032381
tataaatata

SEQ ID NO: 82084 - DNA, 10 bp, Unknown
  misc_feature (1)..( 10): Result.001 file - promoters70/1032381
gctaaacaaa

SEQ ID NO: 82085 - DNA, 10 bp, Unknown
  misc_feature (1)..( 10): Result.001 file - promoters70/1032381
accaaagaaa

SEQ ID NO: 82086 - DNA, 10 bp, Unknown
  misc_feature (1)..( 10): Result.001 file - promoters70/1032381
tatagattag

SEQ ID NO: 82087 - DNA, 12 bp, Unknown
  misc_feature (1)..( 12): Result.001 file - promoters70/1032381
agaaaaaaaaaa

SEQ ID NO: 82088 - DNA, 12 bp, Unknown
  misc_feature (1)..( 12): Result.001 file - promoters70/1032381
agaataaaaata

SEQ ID NO: 82089 - DNA, 12 bp, Unknown
  misc_feature (1)..( 12): Result.001 file - promoters70/1032381
ataaaaaattac

SEQ ID NO: 82090 - DNA, 12 bp, Unknown
  misc_feature (1)..( 12): Result.001 file - promoters70/1032381
taaagaaaagac

SEQ ID NO: 82091 - DNA, 12 bp, Unknown
  misc_feature (1)..( 12): Result.001 file - promoters70/1032381
agaagaaacaaa

SEQ ID NO: 82092 - DNA, 12 bp, Unknown
  misc_feature (1)..( 12): Result.001 file - promoters70/1032400
ctaatgaaattt

SEQ ID NO: 82093 - DNA, 8 bp, Unknown
  misc_feature (1)..( 8): Result.001 file - promoters70/1032400
aattgatt

SEQ ID NO: 82094 - DNA, 8 bp, Unknown
  misc_feature (1)..( 8): Result.001 file - promoters70/1032400
aatttatt

SEQ ID NO: 82095 - DNA, 8 bp, Unknown
  misc_feature (1)..( 8): Result.001 file - promoters70/1032498
ctttgatt

SEQ ID NO: 82096 - DNA, 11 bp, Unknown
  misc_feature (1)..( 11): Result.001 file - promoters70/1032498
taaaactaaaa

SEQ ID NO: 82097 - DNA, 11 bp, Unknown
  misc_feature (1)..( 11): Result.001 file - promoters70/1032498
agtaactaaaa

SEQ ID NO: 82098 - DNA, 11 bp, Unknown
  misc_feature (1)..( 11): Result.001 file - promoters70/1032498
gcaaaccaaac

SEQ ID NO: 82099 - DNA, 11 bp, Unknown
  misc_feature (1)..( 11): Result.001 file - promoters70/1032498
acaaatcaaat

SEQ ID NO: 82100 - DNA, 11 bp, Unknown
  misc_feature (1)..( 11): Result.001 file - promoters70/1032498
caaaaccaaag

SEQ ID NO: 82101 - DNA, 11 bp, Unknown
  misc_feature (1)..( 11): Result.001 file - promoters70/1032498
agaaaacaatg

SEQ ID NO: 82102 - DNA, 11 bp, Unknown
  misc_feature (1)..( 11): Result.001 file - promoters70/1032498
gcaacccattc

SEQ ID NO: 82103 - DNA, 11 bp, Unknown
  misc_feature (1)..( 11): Result.001 file - promoters70/1032498
tacatcaaatg

SEQ ID NO: 82104 - DNA, 11 bp, Unknown
  misc_feature (1)..( 11): Result.001 file - promoters70/1032498
tacttcaaaat

SEQ ID NO: 82105 - DNA, 11 bp, Unknown
  misc_feature (1)..( 11): Result.001 file - promoters70/1032498
aatatcaaagg

SEQ ID NO: 82106 - DNA, 11 bp, Unknown
  misc_feature (1)..( 11): Result.001 file - promoters70/1032498
tatctcaaaat

SEQ ID NO: 82107 - DNA, 12 bp, Unknown
  misc_feature (1)..( 12): Result.001 file - promoters70/1032498
tcactctaaaaa

SEQ ID NO: 82108 - DNA, 12 bp, Unknown
  misc_feature (1)..( 12): Result.001 file - promoters70/1032498
gtattatcaatg

SEQ ID NO: 82109 - DNA, 11 bp, Unknown
  misc_feature (1)..( 11): Result.001 file - promoters70/1032498
tcaaatcgaaa

SEQ ID NO: 82110 - DNA, 11 bp, Unknown
  misc_feature (1)..( 11): Result.001 file - promoters70/1032498
tcaaatataga

SEQ ID NO: 82111 - DNA, 11 bp, Unknown
  misc_feature (1)..( 11): Result.001 file - promoters70/1032498
gcaaaccaaac

SEQ ID NO: 82112 - DNA, 11 bp, Unknown
  misc_feature (1)..( 11): Result.001 file - promoters70/1032498
caaaaccaaag

SEQ ID NO: 82113 - DNA, 11 bp, Unknown
  misc_feature (1)..( 11): Result.001 file - promoters70/1032498
gcaacccattc

SEQ ID NO: 82114 - DNA, 11 bp, Unknown
  misc_feature (1)..( 11): Result.001 file - promoters70/1032676
caccaccgatt

SEQ ID NO: 82115 - DNA, 10 bp, Unknown
  misc_feature (1)..( 10): Result.001 file - promoters70/1032676
aaacttaaga

SEQ ID NO: 82116 - DNA, 10 bp, Unknown
  misc_feature (1)..( 10): Result.001 file - promoters70/1032676
gaacgtaaga

SEQ ID NO: 82117 - DNA, 10 bp, Unknown
  misc_feature (1)..( 10): Result.001 file - promoters70/1032676
aaaattaaat

SEQ ID NO: 82118 - DNA, 8 bp, Unknown
  misc_feature (1)..( 8): Result.001 file - promoters70/1032676
atttttct

SEQ ID NO: 82119 - DNA, 8 bp, Unknown
  misc_feature (1)..( 8): Result.001 file - promoters70/1032676
attttttt

SEQ ID NO: 82120 - DNA, 8 bp, Unknown
  misc_feature (1)..( 8): Result.001 file - promoters70/1032676
cttttttt

SEQ ID NO: 82121 - DNA, 9 bp, Unknown
  misc_feature (1)..( 9): Result.001 file - promoters70/1032676
agatattac

SEQ ID NO: 82122 - DNA, 9 bp, Unknown
  misc_feature (1)..( 9): Result.001 file - promoters70/1032676
cgatattaa

SEQ ID NO: 82123 - DNA, 9 bp, Unknown
  misc_feature (1)..( 9): Result.001 file - promoters70/1032676
agacatttt

SEQ ID NO: 82124 - DNA, 9 bp, Unknown
  misc_feature (1)..( 9): Result.001 file - promoters70/1032676
taataataa

SEQ ID NO: 82125 - DNA, 10 bp, Unknown
  misc_feature (1)..( 10): Result.001 file - promoters70/1032676
ttcatattac

SEQ ID NO: 82126 - DNA, 10 bp, Unknown
  misc_feature (1)..( 10): Result.001 file - promoters70/1032676
ttcaaatttt

SEQ ID NO: 82127 - DNA, 11 bp, Unknown
  misc_feature (1)..( 11): Result.001 file - promoters70/1032676
ataaaagtttt

SEQ ID NO: 82128 - DNA, 11 bp, Unknown
  misc_feature (1)..( 11): Result.001 file - promoters70/1032676
gtctgaacgaa

SEQ ID NO: 82129 - DNA, 11 bp, Unknown
  misc_feature (1)..( 11): Result.001 file - promoters70/1032676
aaaagaaagaa

SEQ ID NO: 82130 - DNA, 11 bp, Unknown
  misc_feature (1)..( 11): Result.001 file - promoters70/1032788
aaaaaaaagac

SEQ ID NO: 82131 - DNA, 7 bp, Unknown
  misc_feature (1)..( 7): Result.001 file - promoters70/1032788
ctacaaa

SEQ ID NO: 82132 - DNA, 7 bp, Unknown
  misc_feature (1)..( 7): Result.001 file - promoters70/1032788
ttacaaa

SEQ ID NO: 82133 - DNA, 7 bp, Unknown
  misc_feature (1)..( 7): Result.001 file - promoters70/1032897
ttataaa

SEQ ID NO: 82134 - DNA, 13 bp, Unknown
  misc_feature (1)..( 13): Result.001 file - promoters70/1032897
aattttggttttg

SEQ ID NO: 82135 - DNA, 13 bp, Unknown
  misc_feature (1)..( 13): Result.001 file - promoters70/1032897
aatcttgtttttg

SEQ ID NO: 82136 - DNA, 13 bp, Unknown
  misc_feature (1)..( 13): Result.001 file - promoters70/1032897
aattttttataac

SEQ ID NO: 82137 - DNA, 13 bp, Unknown
  misc_feature (1)..( 13): Result.001 file - promoters70/1032897
tttcttggttcaa

SEQ ID NO: 82138 - DNA, 13 bp, Unknown
  misc_feature (1)..( 13): Result.001 file - promoters70/1032897
aaatgtgtttttt

SEQ ID NO: 82139 - DNA, 13 bp, Unknown
  misc_feature (1)..( 13): Result.001 file - promoters70/1032897
ctacttgttcaaa

SEQ ID NO: 82140 - DNA, 12 bp, Unknown
  misc_feature (1)..( 12): Result.001 file - promoters70/1032897
cttttatttcct

SEQ ID NO: 82141 - DNA, 12 bp, Unknown
  misc_feature (1)..( 12): Result.001 file - promoters70/1032897
tttttgtttcct

SEQ ID NO: 82142 - DNA, 12 bp, Unknown
  misc_feature (1)..( 12): Result.001 file - promoters70/1032897
cttttacgaaac

SEQ ID NO: 82143 - DNA, 12 bp, Unknown
  misc_feature (1)..( 12): Result.001 file - promoters70/1032897
atttttttctac

SEQ ID NO: 82144 - DNA, 12 bp, Unknown
  misc_feature (1)..( 12): Result.001 file - promoters70/1032897
ctttttgtatca

SEQ ID NO: 82145 - DNA, 12 bp, Unknown
  misc_feature (1)..( 12): Result.001 file - promoters70/1033184
atttttctgttc

SEQ ID NO: 82146 - DNA, 7 bp, Unknown
  misc_feature (1)..( 7): Result.001 file - promoters70/1033184
aatatat

SEQ ID NO: 82147 - DNA, 7 bp, Unknown
  misc_feature (1)..( 7): Result.001 file - promoters70/1033184
aatttat

SEQ ID NO: 82148 - DNA, 7 bp, Unknown
  misc_feature (1)..( 7): Result.001 file - promoters70/1033184
tatatat

SEQ ID NO: 82149 - DNA, 8 bp, Unknown
  misc_feature (1)..( 8): Result.001 file - promoters70/1033184
gcccaaag

SEQ ID NO: 82150 - DNA, 8 bp, Unknown
  misc_feature (1)..( 8): Result.001 file - promoters70/1033184
ccccaaag

SEQ ID NO: 82151 - DNA, 8 bp, Unknown
  misc_feature (1)..( 8): Result.001 file - promoters70/1033184
gcccaata

SEQ ID NO: 82152 - DNA, 12 bp, Unknown
  misc_feature (1)..( 12): Result.001 file - promoters70/1033184
tataaattcttc

SEQ ID NO: 82153 - DNA, 12 bp, Unknown
  misc_feature (1)..( 12): Result.001 file - promoters70/1033184
tataaatccttc

SEQ ID NO: 82154 - DNA, 12 bp, Unknown
  misc_feature (1)..( 12): Result.001 file - promoters70/1033184
tatgaatccata

SEQ ID NO: 82155 - DNA, 8 bp, Unknown
  misc_feature (1)..( 8): Result.001 file - promoters70/1033184
gtttttat

SEQ ID NO: 82156 - DNA, 8 bp, Unknown
  misc_feature (1)..( 8): Result.001 file - promoters70/1033184
gttgttac

SEQ ID NO: 82157 - DNA, 8 bp, Unknown
  misc_feature (1)..( 8): Result.001 file - promoters70/1033184
atttttat

SEQ ID NO: 82158 - DNA, 8 bp, Unknown
  misc_feature (1)..( 8): Result.001 file - promoters70/1033184
attttttt

SEQ ID NO: 82159 - DNA, 8 bp, Unknown
  misc_feature (1)..( 8): Result.001 file - promoters70/1033184
atttttct

SEQ ID NO: 82160 - DNA, 8 bp, Unknown
  misc_feature (1)..( 8): Result.001 file - promoters70/1033184
gttttttt

SEQ ID NO: 82161 - DNA, 8 bp, Unknown
  misc_feature (1)..( 8): Result.001 file - promoters70/1033184
gttaactt

SEQ ID NO: 82162 - DNA, 8 bp, Unknown
  misc_feature (1)..( 8): Result.001 file - promoters70/1033184
gttaacga

SEQ ID NO: 82163 - DNA, 8 bp, Unknown
  misc_feature (1)..( 8): Result.001 file - promoters70/1033184
tttaactt

SEQ ID NO: 82164 - DNA, 8 bp, Unknown
  misc_feature (1)..( 8): Result.001 file - promoters70/1033184
aaaacatt

SEQ ID NO: 82165 - DNA, 8 bp, Unknown
  misc_feature (1)..( 8): Result.001 file - promoters70/1033184
taaaaatt

SEQ ID NO: 82166 - DNA, 8 bp, Unknown
  misc_feature (1)..( 8): Result.001 file - promoters70/1033184
aaaaaatt

SEQ ID NO: 82167 - DNA, 9 bp, Unknown
  misc_feature (1)..( 9): Result.001 file - promoters70/1033184
aatcatatg

SEQ ID NO: 82168 - DNA, 9 bp, Unknown
  misc_feature (1)..( 9): Result.001 file - promoters70/1033184
agtcatatt

SEQ ID NO: 82169 - DNA, 9 bp, Unknown
  misc_feature (1)..( 9): Result.001 file - promoters70/1033262
agttatatt

SEQ ID NO: 82170 - DNA, 8 bp, Unknown
  misc_feature (1)..( 8): Result.001 file - promoters70/1033262
aagttgat

SEQ ID NO: 82171 - DNA, 8 bp, Unknown
  misc_feature (1)..( 8): Result.001 file - promoters70/1033262
aagttgat

SEQ ID NO: 82172 - DNA, 8 bp, Unknown
  misc_feature (1)..( 8): Result.001 file - promoters70/1033262
aagttgat

SEQ ID NO: 82173 - DNA, 10 bp, Unknown
  misc_feature (1)..( 10): Result.001 file - promoters70/1033262
gaatttggac

SEQ ID NO: 82174 - DNA, 10 bp, Unknown
  misc_feature (1)..( 10): Result.001 file - promoters70/1033262
gaagttgact

SEQ ID NO: 82175 - DNA, 10 bp, Unknown
  misc_feature (1)..( 10): Result.001 file - promoters70/1033262
ggagttcact

SEQ ID NO: 82176 - DNA, 7 bp, Unknown
  misc_feature (1)..( 7): Result.001 file - promoters70/1033262
agttttt

SEQ ID NO: 82177 - DNA, 7 bp, Unknown
  misc_feature (1)..( 7): Result.001 file - promoters70/1033262
tgttttt

SEQ ID NO: 82178 - DNA, 7 bp, Unknown
  misc_feature (1)..( 7): Result.001 file - promoters70/1033262
agttttt

SEQ ID NO: 82179 - DNA, 12 bp, Unknown
  misc_feature (1)..( 12): Result.001 file - promoters70/1033262
gttaagaagccc

SEQ ID NO: 82180 - DNA, 12 bp, Unknown
  misc_feature (1)..( 12): Result.001 file - promoters70/1033262
gtttagatgcct

SEQ ID NO: 82181 - DNA, 12 bp, Unknown
  misc_feature (1)..( 12): Result.001 file - promoters70/1033262
tgttgaaagccc

SEQ ID NO: 82182 - DNA, 7 bp, Unknown
  misc_feature (1)..( 7): Result.001 file - promoters70/1033262
gaaagac

SEQ ID NO: 82183 - DNA, 7 bp, Unknown
  misc_feature (1)..( 7): Result.001 file - promoters70/1033262
gaaagaa

SEQ ID NO: 82184 - DNA, 7 bp, Unknown
  misc_feature (1)..( 7): Result.001 file - promoters70/1033262
aaaagaa

SEQ ID NO: 82185 - DNA, 8 bp, Unknown
  misc_feature (1)..( 8): Result.001 file - promoters70/1033262
atttgttg

SEQ ID NO: 82186 - DNA, 8 bp, Unknown
  misc_feature (1)..( 8): Result.001 file - promoters70/1033262
atttcttg

SEQ ID NO: 82187 - DNA, 8 bp, Unknown
  misc_feature (1)..( 8): Result.001 file - promoters70/1033262
ttttcttg

SEQ ID NO: 82188 - DNA, 7 bp, Unknown
  misc_feature (1)..( 7): Result.001 file - promoters70/1033262
ctttatt

SEQ ID NO: 82189 - DNA, 7 bp, Unknown
  misc_feature (1)..( 7): Result.001 file - promoters70/1033262
atttatt

SEQ ID NO: 82190 - DNA, 7 bp, Unknown
  misc_feature (1)..( 7): Result.001 file - promoters70/1033262
ctttatt

SEQ ID NO: 82191 - DNA, 7 bp, Unknown
  misc_feature (1)..( 7): Result.001 file - promoters70/1033262
taagaaa

SEQ ID NO: 82192 - DNA, 7 bp, Unknown
  misc_feature (1)..( 7): Result.001 file - promoters70/1033262
aaagaaa

SEQ ID NO: 82193 - DNA, 7 bp, Unknown
  misc_feature (1)..( 7): Result.001 file - promoters70/1033262
aaagaag

SEQ ID NO: 82194 - DNA, 8 bp, Unknown
  misc_feature (1)..( 8): Result.001 file - promoters70/1033262
tgatctgc

SEQ ID NO: 82195 - DNA, 8 bp, Unknown
  misc_feature (1)..( 8): Result.001 file - promoters70/1033262
tgatttgc

SEQ ID NO: 82196 - DNA, 8 bp, Unknown
  misc_feature (1)..( 8): Result.001 file - promoters70/1033262
tgacttgt

SEQ ID NO: 82197 - DNA, 9 bp, Unknown
  misc_feature (1)..( 9): Result.001 file - promoters70/1033262
agataaaga

SEQ ID NO: 82198 - DNA, 9 bp, Unknown
  misc_feature (1)..( 9): Result.001 file - promoters70/1033262
ggataaaga

SEQ ID NO: 82199 - DNA, 9 bp, Unknown
  misc_feature (1)..( 9): Result.001 file - promoters70/1033262
agaaaaaga

SEQ ID NO: 82200 - DNA, 8 bp, Unknown
  misc_feature (1)..( 8): Result.001 file - promoters70/1033262
gaagttga

SEQ ID NO: 82201 - DNA, 8 bp, Unknown
  misc_feature (1)..( 8): Result.001 file - promoters70/1033262
gaagttga

SEQ ID NO: 82202 - DNA, 8 bp, Unknown
  misc_feature (1)..( 8): Result.001 file - promoters70/1033262
caagtagt

SEQ ID NO: 82203 - DNA, 9 bp, Unknown
  misc_feature (1)..( 9): Result.001 file - promoters70/1033262
agttttttt

SEQ ID NO: 82204 - DNA, 9 bp, Unknown
  misc_feature (1)..( 9): Result.001 file - promoters70/1033262
agtgttttt

SEQ ID NO: 82205 - DNA, 9 bp, Unknown
  misc_feature (1)..( 9): Result.001 file - promoters70/1033262
actttcttt

SEQ ID NO: 82206 - DNA, 7 bp, Unknown
  misc_feature (1)..( 7): Result.001 file - promoters70/1033262
aaagaag

SEQ ID NO: 82207 - DNA, 7 bp, Unknown
  misc_feature (1)..( 7): Result.001 file - promoters70/1033262
aaagaag

SEQ ID NO: 82208 - DNA, 7 bp, Unknown
  misc_feature (1)..( 7): Result.001 file - promoters70/1033781
aaagaag

SEQ ID NO: 82209 - DNA, 9 bp, Unknown
  misc_feature (1)..( 9): Result.001 file - promoters70/1033781
aataacaaa

SEQ ID NO: 82210 - DNA, 9 bp, Unknown
  misc_feature (1)..( 9): Result.001 file - promoters70/1033781
aatatcaaa

SEQ ID NO: 82211 - DNA, 9 bp, Unknown
  misc_feature (1)..( 9): Result.001 file - promoters70/1033781
tttaaaaaa

SEQ ID NO: 82212 - DNA, 9 bp, Unknown
  misc_feature (1)..( 9): Result.001 file - promoters70/1033781
aagaaaaaa

SEQ ID NO: 82213 - DNA, 14 bp, Unknown
  misc_feature (1)..( 14): Result.001 file - promoters70/1033781
tcttattaggtgaa

SEQ ID NO: 82214 - DNA, 14 bp, Unknown
  misc_feature (1)..( 14): Result.001 file - promoters70/1033781
tcttattatcgatg

SEQ ID NO: 82215 - DNA, 14 bp, Unknown
  misc_feature (1)..( 14): Result.001 file - promoters70/1033781
agttattaatgaat

SEQ ID NO: 82216 - DNA, 14 bp, Unknown
  misc_feature (1)..( 14): Result.001 file - promoters70/1033781
agctatcatccatg

SEQ ID NO: 82217 - DNA, 10 bp, Unknown
  misc_feature (1)..( 10): Result.001 file - promoters70/1033781
accatttcgt

SEQ ID NO: 82218 - DNA, 10 bp, Unknown
  misc_feature (1)..( 10): Result.001 file - promoters70/1033781
accctttgtt

SEQ ID NO: 82219 - DNA, 10 bp, Unknown
  misc_feature (1)..( 10): Result.001 file - promoters70/1033781
cccattttct

SEQ ID NO: 82220 - DNA, 11 bp, Unknown
  misc_feature (1)..( 11): Result.001 file - promoters70/1033781
gtcatcttcta

SEQ ID NO: 82221 - DNA, 9 bp, Unknown
  misc_feature (1)..( 9): Result.001 file - promoters70/1033781
catgtattt

SEQ ID NO: 82222 - DNA, 9 bp, Unknown
  misc_feature (1)..( 9): Result.001 file - promoters70/1033781
catgaattg

SEQ ID NO: 82223 - DNA, 9 bp, Unknown
  misc_feature (1)..( 9): Result.001 file - promoters70/1033781
cctgaattt

SEQ ID NO: 82224 - DNA, 9 bp, Unknown
  misc_feature (1)..( 9): Result.001 file - promoters70/1033781
gtggaattg

SEQ ID NO: 82225 - DNA, 9 bp, Unknown
  misc_feature (1)..( 9): Result.001 file - promoters70/1033781
tatgatttg

SEQ ID NO: 82226 - DNA, 14 bp, Unknown
  misc_feature (1)..( 14): Result.001 file - promoters70/1033781
tccatttttatttt

SEQ ID NO: 82227 - DNA, 14 bp, Unknown
  misc_feature (1)..( 14): Result.001 file - promoters70/1033781
tagggttttagttt

SEQ ID NO: 82228 - DNA, 14 bp, Unknown
  misc_feature (1)..( 14): Result.001 file - promoters70/1033781
gtattttttaataa

SEQ ID NO: 82229 - DNA, 14 bp, Unknown
  misc_feature (1)..( 14): Result.001 file - promoters70/1033841
gtaatttttggttt

SEQ ID NO: 82230 - DNA, 12 bp, Unknown
  misc_feature (1)..( 12): Result.001 file - promoters70/1033841
ttcttccttccg

SEQ ID NO: 82231 - DNA, 12 bp, Unknown
  misc_feature (1)..( 12): Result.001 file - promoters70/1033841
atcctccttctg

SEQ ID NO: 82232 - DNA, 12 bp, Unknown
  misc_feature (1)..( 12): Result.001 file - promoters70/1033841
gttctccatccc

SEQ ID NO: 82233 - DNA, 12 bp, Unknown
  misc_feature (1)..( 12): Result.001 file - promoters70/1033841
ccattccttttt

SEQ ID NO: 82234 - DNA, 12 bp, Unknown
  misc_feature (1)..( 12): Result.001 file - promoters70/1033841
atcgtccatttt

SEQ ID NO: 82235 - DNA, 12 bp, Unknown
  misc_feature (1)..( 12): Result.001 file - promoters70/1034137
atttttctgttc

SEQ ID NO: 82236 - DNA, 10 bp, Unknown
  misc_feature (1)..( 10): Result.001 file - promoters70/1034137
attatatatg

SEQ ID NO: 82237 - DNA, 10 bp, Unknown
  misc_feature (1)..( 10): Result.001 file - promoters70/1034137
tcaataaatg

SEQ ID NO: 82238 - DNA, 10 bp, Unknown
  misc_feature (1)..( 10): Result.001 file - promoters70/1034137
tcattaaaaa

SEQ ID NO: 82239 - DNA, 10 bp, Unknown
  misc_feature (1)..( 10): Result.001 file - promoters70/1034137
ttaaaaaaaa

SEQ ID NO: 82240 - DNA, 10 bp, Unknown
  misc_feature (1)..( 10): Result.001 file - promoters70/1034137
acaaaaaaaa

SEQ ID NO: 82241 - DNA, 10 bp, Unknown
  misc_feature (1)..( 10): Result.001 file - promoters70/1034137
ttaaaaaagg

SEQ ID NO: 82242 - DNA, 34 bp, Unknown; identical to SEQ ID NO: 76977
  misc_feature (1)..( 34): Result.001 file - promoters70/1034137

SEQ ID NO: 82243 - DNA, 34 bp, Unknown; identical to SEQ ID NO: 76978
  misc_feature (1)..( 34): Result.001 file - promoters70/1034137

SEQ ID NO: 82244 - DNA, 34 bp, Unknown; identical to SEQ ID NO: 76979
  misc_feature (1)..( 34): Result.001 file - promoters70/1034137

SEQ ID NO: 82245 - DNA, 34 bp, Unknown; identical to SEQ ID NO: 76977
  misc_feature (1)..( 34): Result.001 file - promoters70/1034137

SEQ ID NO: 82246 - DNA, 34 bp, Unknown; identical to SEQ ID NO: 76981
  misc_feature (1)..( 34): Result.001 file - promoters70/1034137

SEQ ID NO: 82247 - DNA, 34 bp, Unknown; identical to SEQ ID NO: 76979
  misc_feature (1)..( 34): Result.001 file - promoters70/1034137

SEQ ID NO: 82248 - DNA, 15 bp, Unknown
  misc_feature (1)..( 15): Result.001 file - promoters70/1034137
attgaagacttttca

SEQ ID NO: 82249 - DNA, 15 bp, Unknown
  misc_feature (1)..( 15): Result.001 file - promoters70/1034137
attgaagacttttca

SEQ ID NO: 82250 - DNA, 15 bp, Unknown
  misc_feature (1)..( 15): Result.001 file - promoters70/1034137
gtagaagaccatata

SEQ ID NO: 82251 - DNA, 13 bp, Unknown
  misc_feature (1)..( 13): Result.001 file - promoters70/1034137
ctataagctttaa

SEQ ID NO: 82252 - DNA, 13 bp, Unknown
  misc_feature (1)..( 13): Result.001 file - promoters70/1034137
ctataagctttta

SEQ ID NO: 82253 - DNA, 14 bp, Unknown
  misc_feature (1)..( 14): Result.001 file - promoters70/1034137
aagacagcatttaa

SEQ ID NO: 82254 - DNA, 29 bp, Unknown
  misc_feature (1)..( 29): Result.001 file - promoters70/1034137
aagctttaagtctatcgctagactgtcca

SEQ ID NO: 82255 - DNA, 29 bp, Unknown
  misc_feature (1)..( 29): Result.001 file - promoters70/1034137
agcttttaagtctctcgctagactgtcca

SEQ ID NO: 82256 - DNA, 29 bp, Unknown
  misc_feature (1)..( 29): Result.001 file - promoters70/1034322
agcatttaatgatgataacgatttggaag

SEQ ID NO: 82257 - DNA, 10 bp, Unknown
  misc_feature (1)..( 10): Result.001 file - promoters70/1034322
tatatataga

SEQ ID NO: 82258 - DNA, 10 bp, Unknown
  misc_feature (1)..( 10): Result.001 file - promoters70/1034322
tatataaata

SEQ ID NO: 82259 - DNA, 10 bp, Unknown
  misc_feature (1)..( 10): Result.001 file - promoters70/1034322
tataaatatg

SEQ ID NO: 82260 - DNA, 10 bp, Unknown
  misc_feature (1)..( 10): Result.001 file - promoters70/1034322
tatacaaatc

SEQ ID NO: 82261 - DNA, 10 bp, Unknown
  misc_feature (1)..( 10): Result.001 file - promoters70/1034322
taaacaaatc

SEQ ID NO: 82262 - DNA, 13 bp, Unknown
  misc_feature (1)..( 13): Result.001 file - promoters70/1034322
atttgaatgaaaa

SEQ ID NO: 82263 - DNA, 13 bp, Unknown
  misc_feature (1)..( 13): Result.001 file - promoters70/1034322
attttaataactt

SEQ ID NO: 82264 - DNA, 13 bp, Unknown
  misc_feature (1)..( 13): Result.001 file - promoters70/1034322
aatttaatttgtt

SEQ ID NO: 82265 - DNA, 13 bp, Unknown
  misc_feature (1)..( 13): Result.001 file - promoters70/1034322
cgtttagtaactt

SEQ ID NO: 82266 - DNA, 13 bp, Unknown
  misc_feature (1)..( 13): Result.001 file - promoters70/1034322
aatttaattaacc

SEQ ID NO: 82267 - DNA, 13 bp, Unknown
  misc_feature (1)..( 13): Result.001 file - promoters70/1034322
aatttaatttgtt

SEQ ID NO: 82268 - DNA, 13 bp, Unknown
  misc_feature (1)..( 13): Result.001 file - promoters70/1034322
attttaataactt

SEQ ID NO: 82269 - DNA, 13 bp, Unknown
  misc_feature (1)..( 13): Result.001 file - promoters70/1034652
cgtttagtaactt

SEQ ID NO: 82270 - DNA, 9 bp, Unknown
  misc_feature (1)..( 9): Result.001 file - promoters70/1034652
caaaacatc

SEQ ID NO: 82271 - DNA, 9 bp, Unknown
  misc_feature (1)..( 9): Result.001 file - promoters70/1034652
taaaacaaa

SEQ ID NO: 82272 - DNA, 9 bp, Unknown
  misc_feature (1)..( 9): Result.001 file - promoters70/1034652
acaaatatc

SEQ ID NO: 82273 - DNA, 9 bp, Unknown
  misc_feature (1)..( 9): Result.001 file - promoters70/1034652
aaaaacata

SEQ ID NO: 82274 - DNA, 9 bp, Unknown
  misc_feature (1)..( 9): Result.001 file - promoters70/1034652
caaaaccgt

SEQ ID NO: 82275 - DNA, 9 bp, Unknown
  misc_feature (1)..( 9): Result.001 file - promoters70/1034652
aaaaactca

SEQ ID NO: 82276 - DNA, 11 bp, Unknown
  misc_feature (1)..( 11): Result.001 file - promoters70/1034652
ctccacaaaac

SEQ ID NO: 82277 - DNA, 11 bp, Unknown
  misc_feature (1)..( 11): Result.001 file - promoters70/1034652
taaaacaaaaa

SEQ ID NO: 82278 - DNA, 11 bp, Unknown
  misc_feature (1)..( 11): Result.001 file - promoters70/1034652
tttatcaaaac

SEQ ID NO: 82279 - DNA, 11 bp, Unknown
  misc_feature (1)..( 11): Result.001 file - promoters70/1034652
atcgccaaaaa

SEQ ID NO: 82280 - DNA, 11 bp, Unknown
  misc_feature (1)..( 11): Result.001 file - promoters70/1034652
cgaaacaaaga

SEQ ID NO: 82281 - DNA, 11 bp, Unknown
  misc_feature (1)..( 11): Result.001 file - promoters70/1034652
cgaatcaatct

SEQ ID NO: 82282 - DNA, 9 bp, Unknown
  misc_feature (1)..( 9): Result.001 file - promoters70/1034652
ccatcgaat

SEQ ID NO: 82283 - DNA, 9 bp, Unknown
  misc_feature (1)..( 9): Result.001 file - promoters70/1034652
aaatcaaat

SEQ ID NO: 82284 - DNA, 9 bp, Unknown
  misc_feature (1)..( 9): Result.001 file - promoters70/1034652
ccaccgatt

SEQ ID NO: 82285 - DNA, 9 bp, Unknown
  misc_feature (1)..( 9): Result.001 file - promoters70/1034652
caatcaatg

SEQ ID NO: 82286 - DNA, 9 bp, Unknown
  misc_feature (1)..( 9): Result.001 file - promoters70/1034652
cagtcaaat

SEQ ID NO: 82287 - DNA, 9 bp, Unknown
  misc_feature (1)..( 9): Result.001 file - promoters70/1034652
aagtaaaaa

SEQ ID NO: 82288 - DNA, 11 bp, Unknown
  misc_feature (1)..( 11): Result.001 file - promoters70/1034652
cacccttcttt

SEQ ID NO: 82289 - DNA, 11 bp, Unknown
  misc_feature (1)..( 11): Result.001 file - promoters70/1034652
ctacctttttt

SEQ ID NO: 82290 - DNA, 11 bp, Unknown
  misc_feature (1)..( 11): Result.001 file - promoters70/1034652
ttttcttcttc

SEQ ID NO: 82291 - DNA, 11 bp, Unknown
  misc_feature (1)..( 11): Result.001 file - promoters70/1034652
tataattcttt

SEQ ID NO: 82292 - DNA, 11 bp, Unknown
  misc_feature (1)..( 11): Result.001 file - promoters70/1034652
tttgcttctcc

SEQ ID NO: 82293 - DNA, 11 bp, Unknown
  misc_feature (1)..( 11): Result.001 file - promoters70/1035083
aatccttgaga

SEQ ID NO: 82294 - DNA, 10 bp, Unknown
  misc_feature (1)..( 10): Result.001 file - promoters70/1035083
cattagttct

SEQ ID NO: 82295 - DNA, 10 bp, Unknown
  misc_feature (1)..( 10): Result.001 file - promoters70/1035083
aatttgttat

SEQ ID NO: 82296 - DNA, 10 bp, Unknown
  misc_feature (1)..( 10): Result.001 file - promoters70/1035083
tattatttct

SEQ ID NO: 82297 - DNA, 10 bp, Unknown
  misc_feature (1)..( 10): Result.001 file - promoters70/1035083
tattatacgt

SEQ ID NO: 82298 - DNA, 11 bp, Unknown
  misc_feature (1)..( 11): Result.001 file - promoters70/1035083
aatgtttgtat

SEQ ID NO: 82299 - DNA, 11 bp, Unknown
  misc_feature (1)..( 11): Result.001 file - promoters70/1035083
catgtttagaa

SEQ ID NO: 82300 - DNA, 11 bp, Unknown
  misc_feature (1)..( 11): Result.001 file - promoters70/1035083
aatctttgttt

SEQ ID NO: 82301 - DNA, 11 bp, Unknown
  misc_feature (1)..( 11): Result.001 file - promoters70/1035083
aatctttgtat

SEQ ID NO: 82302 - DNA, 11 bp, Unknown
  misc_feature (1)..( 11): Result.001 file - promoters70/1035083
ttttgaagaat

SEQ ID NO: 82303 - DNA, 11 bp, Unknown
  misc_feature (1)..( 11): Result.001 file - promoters70/1035083
ttttgatgaat

SEQ ID NO: 82304 - DNA, 11 bp, Unknown
  misc_feature (1)..( 11): Result.001 file - promoters70/1035083
atttgctgaat

SEQ ID NO: 82305 - DNA, 11 bp, Unknown
  misc_feature (1)..( 11): Result.001 file - promoters70/1035083
aaaagatgaag

SEQ ID NO: 82306 - DNA, 9 bp, Unknown
  misc_feature (1)..( 9): Result.001 file - promoters70/1035083
tatataaac

SEQ ID NO: 82307 - DNA, 9 bp, Unknown
  misc_feature (1)..( 9): Result.001 file - promoters70/1035083
tatataata

SEQ ID NO: 82308 - DNA, 9 bp, Unknown
  misc_feature (1)..( 9): Result.001 file - promoters70/1035083
tataaaaac

SEQ ID NO: 82309 - DNA, 9 bp, Unknown
  misc_feature (1)..( 9): Result.001 file - promoters70/1035083
cataaaagc

SEQ ID NO: 82310 - DNA, 9 bp, Unknown
  misc_feature (1)..( 9): Result.001 file - promoters70/1035083
gataaatat

SEQ ID NO: 82311 - DNA, 10 bp, Unknown
  misc_feature (1)..( 10): Result.001 file - promoters70/1035083
tataaacaaa

SEQ ID NO: 82312 - DNA, 10 bp, Unknown
  misc_feature (1)..( 10): Result.001 file - promoters70/1035083
aataaccaaa

SEQ ID NO: 82313 - DNA, 10 bp, Unknown
  misc_feature (1)..( 10): Result.001 file - promoters70/1035083
tataaaaacc

SEQ ID NO: 82314 - DNA, 10 bp, Unknown
  misc_feature (1)..( 10): Result.001 file - promoters70/1035083
cataaaagca

SEQ ID NO: 82315 - DNA, 11 bp, Unknown
  misc_feature (1)..( 11): Result.001 file - promoters70/1035083
caaaatttgta

SEQ ID NO: 82316 - DNA, 11 bp, Unknown
  misc_feature (1)..( 11): Result.001 file - promoters70/1035083
caatattttaa

SEQ ID NO: 82317 - DNA, 11 bp, Unknown
  misc_feature (1)..( 11): Result.001 file - promoters70/1035083
aattattttac

SEQ ID NO: 82318 - DNA, 11 bp, Unknown
  misc_feature (1)..( 11): Result.001 file - promoters70/1035172
gctgattttac

SEQ ID NO: 82319 - DNA, 8 bp, Unknown
  misc_feature (1)..( 8): Result.001 file - promoters70/1035172
tttaaccc

SEQ ID NO: 82320 - DNA, 8 bp, Unknown
  misc_feature (1)..( 8): Result.001 file - promoters70/1035172
tttgacca

SEQ ID NO: 82321 - DNA, 8 bp, Unknown
  misc_feature (1)..( 8): Result.001 file - promoters70/1035172
cctaaccc

SEQ ID NO: 82322 - DNA, 7 bp, Unknown
  misc_feature (1)..( 7): Result.001 file - promoters70/1035172
gttgact

SEQ ID NO: 82323 - DNA, 7 bp, Unknown
  misc_feature (1)..( 7): Result.001 file - promoters70/1035172
gttgact

SEQ ID NO: 82324 - DNA, 7 bp, Unknown
  misc_feature (1)..( 7): Result.001 file - promoters70/1035172
attgact

SEQ ID NO: 82325 - DNA, 7 bp, Unknown
  misc_feature (1)..( 7): Result.001 file - promoters70/1035172
gctattt

SEQ ID NO: 82326 - DNA, 7 bp, Unknown
  misc_feature (1)..( 7): Result.001 file - promoters70/1035172
actattt

SEQ ID NO: 82327 - DNA, 7 bp, Unknown
  misc_feature (1)..( 7): Result.001 file - promoters70/1035172
actgttt

SEQ ID NO: 82328 - DNA, 12 bp, Unknown
  misc_feature (1)..( 12): Result.001 file - promoters70/1035172
gaagaagcatcc

SEQ ID NO: 82329 - DNA, 12 bp, Unknown
  misc_feature (1)..( 12): Result.001 file - promoters70/1035172
gaaaaagtaatt

SEQ ID NO: 82330 - DNA, 12 bp, Unknown
  misc_feature (1)..( 12): Result.001 file - promoters70/1035172
caaaaacaaaaa

SEQ ID NO: 82331 - DNA, 8 bp, Unknown
  misc_feature (1)..( 8): Result.001 file - promoters70/1035172
caaaaaac

SEQ ID NO: 82332 - DNA, 8 bp, Unknown
  misc_feature (1)..( 8): Result.001 file - promoters70/1035172
taaaaaat

SEQ ID NO: 82333 - DNA, 8 bp, Unknown
  misc_feature (1)..( 8): Result.001 file - promoters70/1035172
taaacaat

SEQ ID NO: 82334 - DNA, 16 bp, Unknown
  misc_feature (1)..( 16): Result.001 file - promoters70/1035172
tctcttcttcattgaa

SEQ ID NO: 82335 - DNA, 16 bp, Unknown
  misc_feature (1)..( 16): Result.001 file - promoters70/1035172
tcttttctctctataa

SEQ ID NO: 82336 - DNA, 16 bp, Unknown
  misc_feature (1)..( 16): Result.001 file - promoters70/1035172
acttttgtctatataa

SEQ ID NO: 82337 - DNA, 8 bp, Unknown
  misc_feature (1)..( 8): Result.001 file - promoters70/1035172
taaatatt

SEQ ID NO: 82338 - DNA, 8 bp, Unknown
  misc_feature (1)..( 8): Result.001 file - promoters70/1035172
taaatagg

SEQ ID NO: 82339 - DNA, 8 bp, Unknown
  misc_feature (1)..( 8): Result.001 file - promoters70/1035267
caaatatt

SEQ ID NO: 82340 - DNA, 7 bp, Unknown
  misc_feature (1)..( 7): Result.001 file - promoters70/1035267
ccacaga

SEQ ID NO: 82341 - DNA, 7 bp, Unknown
  misc_feature (1)..( 7): Result.001 file - promoters70/1035267
ccacagc

SEQ ID NO: 82342 - DNA, 7 bp, Unknown
  misc_feature (1)..( 7): Result.001 file - promoters70/1035312
tcacaga

SEQ ID NO: 82343 - DNA, 8 bp, Unknown
  misc_feature (1)..( 8): Result.001 file - promoters70/1035312
atcaaaac

SEQ ID NO: 82344 - DNA, 8 bp, Unknown
  misc_feature (1)..( 8): Result.001 file - promoters70/1035312
atcaaaaa

SEQ ID NO: 82345 - DNA, 8 bp, Unknown
  misc_feature (1)..( 8): Result.001 file - promoters70/1035312
accaaaac

SEQ ID NO: 82346 - DNA, 9 bp, Unknown
  misc_feature (1)..( 9): Result.001 file - promoters70/1035312
aaaccaaaa

SEQ ID NO: 82347 - DNA, 9 bp, Unknown
  misc_feature (1)..( 9): Result.001 file - promoters70/1035312
aaaacaatc

SEQ ID NO: 82348 - DNA, 9 bp, Unknown
  misc_feature (1)..( 9): Result.001 file - promoters70/1035312
aaaccaaaa

SEQ ID NO: 82349 - DNA, 8 bp, Unknown
  misc_feature (1)..( 8): Result.001 file - promoters70/1035312
aaatcgaa

SEQ ID NO: 82350 - DNA, 8 bp, Unknown
  misc_feature (1)..( 8): Result.001 file - promoters70/1035312
caatcgaa

SEQ ID NO: 82351 - DNA, 8 bp, Unknown
  misc_feature (1)..( 8): Result.001 file - promoters70/1035312
caaacgaa

SEQ ID NO: 82352 - DNA, 10 bp, Unknown
  misc_feature (1)..( 10): Result.001 file - promoters70/1035312
cgattacaca

SEQ ID NO: 82353 - DNA, 10 bp, Unknown
  misc_feature (1)..( 10): Result.001 file - promoters70/1035312
cgatttcaca

SEQ ID NO: 82354 - DNA, 10 bp, Unknown
  misc_feature (1)..( 10): Result.001 file - promoters70/1035312
agatttcggt

SEQ ID NO: 82355 - DNA, 10 bp, Unknown
  misc_feature (1)..( 10): Result.001 file - promoters70/1035312
attgggccca

SEQ ID NO: 82356 - DNA, 10 bp, Unknown
  misc_feature (1)..( 10): Result.001 file - promoters70/1035312
attcggccca

SEQ ID NO: 82357 - DNA, 10 bp, Unknown
  misc_feature (1)..( 10): Result.001 file - promoters70/1035632
tatgggcctt

SEQ ID NO: 82358 - DNA, 12 bp, Unknown
  misc_feature (1)..( 12): Result.001 file - promoters70/1035632
ttacaaagaaga

SEQ ID NO: 82359 - DNA, 12 bp, Unknown
  misc_feature (1)..( 12): Result.001 file - promoters70/1035632
ttataaatgtat

SEQ ID NO: 82360 - DNA, 12 bp, Unknown
  misc_feature (1)..( 12): Result.001 file - promoters70/1035632
taataaaagtat

SEQ ID NO: 82361 - DNA, 12 bp, Unknown
  misc_feature (1)..( 12): Result.001 file - promoters70/1035632
taccaaaatatt

SEQ ID NO: 82362 - DNA, 10 bp, Unknown
  misc_feature (1)..( 10): Result.001 file - promoters70/1035632
acaaaagata

SEQ ID NO: 82363 - DNA, 10 bp, Unknown
  misc_feature (1)..( 10): Result.001 file - promoters70/1035632
ataaaaaata

SEQ ID NO: 82364 - DNA, 10 bp, Unknown
  misc_feature (1)..( 10): Result.001 file - promoters70/1035632
acaaaagaat

SEQ ID NO: 82365 - DNA, 10 bp, Unknown
  misc_feature (1)..( 10): Result.001 file - promoters70/1035632
acaaaaagta

SEQ ID NO: 82366 - DNA, 8 bp, Unknown
  misc_feature (1)..( 8): Result.001 file - promoters70/1035632
gataaaac

SEQ ID NO: 82367 - DNA, 8 bp, Unknown
  misc_feature (1)..( 8): Result.001 file - promoters70/1035632
aataaaaa

SEQ ID NO: 82368 - DNA, 8 bp, Unknown
  misc_feature (1)..( 8): Result.001 file - promoters70/1035632
agtaaaac

SEQ ID NO: 82369 - DNA, 8 bp, Unknown
  misc_feature (1)..( 8): Result.001 file - promoters70/1375217
aataaata

SEQ ID NO: 82370 - DNA, 10 bp, Unknown
  misc_feature (1)..( 10): Result.001 file - promoters70/1375217
aaaaacaaac

SEQ ID NO: 82371 - DNA, 10 bp, Unknown
  misc_feature (1)..( 10): Result.001 file - promoters70/1375217
ttaaaaaaag

SEQ ID NO: 82372 - DNA, 10 bp, Unknown
  misc_feature (1)..( 10): Result.001 file - promoters70/1375217
ttaagaaaag

SEQ ID NO: 82373 - DNA, 8 bp, Unknown
  misc_feature (1)..( 8): Result.001 file - promoters70/1375217
atgaaaaa

SEQ ID NO: 82374 - DNA, 8 bp, Unknown
  misc_feature (1)..( 8): Result.001 file - promoters70/1375217
aagaaaaa

SEQ ID NO: 82375 - DNA, 8 bp, Unknown
  misc_feature (1)..( 8): Result.001 file - promoters70/1375217
aagaaaag

SEQ ID NO: 82376 - DNA, 13 bp, Unknown
  misc_feature (1)..( 13): Result.001 file - promoters70/1375217
tgtttgtttaaca

SEQ ID NO: 82377 - DNA, 13 bp, Unknown
  misc_feature (1)..( 13): Result.001 file - promoters70/1375217
cttttgtttctgg

SEQ ID NO: 82378 - DNA, 13 bp, Unknown
  misc_feature (1)..( 13): Result.001 file - promoters70/1375217
tgtttttttcagg

SEQ ID NO: 82379 - DNA, 13 bp, Unknown
  misc_feature (1)..( 13): Result.001 file - promoters70/1375217
tttctgtttcaca

SEQ ID NO: 82380 - DNA, 8 bp, Unknown
  misc_feature (1)..( 8): Result.001 file - promoters70/1375217
aatcaaga

SEQ ID NO: 82381 - DNA, 8 bp, Unknown
  misc_feature (1)..( 8): Result.001 file - promoters70/1375217
aatcaatg

SEQ ID NO: 82382 - DNA, 8 bp, Unknown
  misc_feature (1)..( 8): Result.001 file - promoters70/1375217
aataaaga

SEQ ID NO: 82383 - DNA, 9 bp, Unknown
  misc_feature (1)..( 9): Result.001 file - promoters70/1375217
tttccatct

SEQ ID NO: 82384 - DNA, 9 bp, Unknown
  misc_feature (1)..( 9): Result.001 file - promoters70/1375217
gttccttct

SEQ ID NO: 82385 - DNA, 9 bp, Unknown
  misc_feature (1)..( 9): Result.001 file - promoters70/1375471
gttcctttg

SEQ ID NO: 82386 - DNA, 8 bp, Unknown
  misc_feature (1)..( 8): Result.001 file - promoters70/1375471
aaaataaa

SEQ ID NO: 82387 - DNA, 8 bp, Unknown
  misc_feature (1)..( 8): Result.001 file - promoters70/1375471
aaaataat

SEQ ID NO: 82388 - DNA, 8 bp, Unknown
  misc_feature (1)..( 8): Result.001 file - promoters70/1375615
aaaaaaat

SEQ ID NO: 82389 - DNA, 8 bp, Unknown
  misc_feature (1)..( 8): Result.001 file - promoters70/1375615
atcatatt

SEQ ID NO: 82390 - DNA, 8 bp, Unknown
  misc_feature (1)..( 8): Result.001 file - promoters70/1375615
atcatatt

SEQ ID NO: 82391 - DNA, 8 bp, Unknown
  misc_feature (1)..( 8): Result.001 file - promoters70/1375615
atcatatt

SEQ ID NO: 82392 - DNA, 9 bp, Unknown
  misc_feature (1)..( 9): Result.001 file - promoters70/1375615
tttgtagtg

SEQ ID NO: 82393 - DNA, 9 bp, Unknown
  misc_feature (1)..( 9): Result.001 file - promoters70/1375615
attgtagct

SEQ ID NO: 82394 - DNA, 9 bp, Unknown
  misc_feature (1)..( 9): Result.001 file - promoters70/1375615
tttgttgtg

SEQ ID NO: 82395 - DNA, 8 bp, Unknown
  misc_feature (1)..( 8): Result.001 file - promoters70/1375615
tgatttgt

SEQ ID NO: 82396 - DNA, 8 bp, Unknown
  misc_feature (1)..( 8): Result.001 file - promoters70/1375615
agatatgt

SEQ ID NO: 82397 - DNA, 8 bp, Unknown
  misc_feature (1)..( 8): Result.001 file - promoters70/1375615
tgatttgg

SEQ ID NO: 82398 - DNA, 7 bp, Unknown
  misc_feature (1)..( 7): Result.001 file - promoters70/1375615
gtttgtt

SEQ ID NO: 82399 - DNA, 7 bp, Unknown
  misc_feature (1)..( 7): Result.001 file - promoters70/1375615
gtttgtg

SEQ ID NO: 82400 - DNA, 7 bp, Unknown
  misc_feature (1)..( 7): Result.001 file - promoters70/1375615
ttttgtt

SEQ ID NO: 82401 - DNA, 8 bp, Unknown
  misc_feature (1)..( 8): Result.001 file - promoters70/1375615
tgtttgtt

SEQ ID NO: 82402 - DNA, 8 bp, Unknown
  misc_feature (1)..( 8): Result.001 file - promoters70/1375615
gatttgtt

SEQ ID NO: 82403 - DNA, 8 bp, Unknown
  misc_feature (1)..( 8): Result.001 file - promoters70/1375634
gatatgta

SEQ ID NO: 82404 - DNA, 9 bp, Unknown
  misc_feature (1)..( 9): Result.001 file - promoters70/1375634
tgtatggtg

SEQ ID NO: 82405 - DNA, 9 bp, Unknown
  misc_feature (1)..( 9): Result.001 file - promoters70/1375634
tgtatgcat

SEQ ID NO: 82406 - DNA, 9 bp, Unknown
  misc_feature (1)..( 9): Result.001 file - promoters70/1375634
agtaagcat

SEQ ID NO: 82407 - DNA, 10 bp, Unknown
  misc_feature (1)..( 10): Result.001 file - promoters70/1375634
ttaattttta

SEQ ID NO: 82408 - DNA, 10 bp, Unknown
  misc_feature (1)..( 10): Result.001 file - promoters70/1375634
tcaattttat

SEQ ID NO: 82409 - DNA, 10 bp, Unknown
  misc_feature (1)..( 10): Result.001 file - promoters70/1375634
tcaatcttat

SEQ ID NO: 82410 - DNA, 10 bp, Unknown
  misc_feature (1)..( 10): Result.001 file - promoters70/1375634
taatttttat

SEQ ID NO: 82411 - DNA, 10 bp, Unknown
  misc_feature (1)..( 10): Result.001 file - promoters70/1375634
tcaattttat

SEQ ID NO: 82412 - DNA, 10 bp, Unknown
  misc_feature (1)..( 10): Result.001 file - promoters70/1376361
tcaatcttat

SEQ ID NO: 82413 - DNA, 7 bp, Unknown
  misc_feature (1)..( 7): Result.001 file - promoters70/1376361
aatttag

SEQ ID NO: 82414 - DNA, 7 bp, Unknown
  misc_feature (1)..( 7): Result.001 file - promoters70/1376361
aatttag

SEQ ID NO: 82415 - DNA, 7 bp, Unknown
  misc_feature (1)..( 7): Result.001 file - promoters70/1376650
gatttag

SEQ ID NO: 82416 - DNA, 8 bp, Unknown
  misc_feature (1)..( 8): Result.001 file - promoters70/1376650
caaaccaa

SEQ ID NO: 82417 - DNA, 8 bp, Unknown
  misc_feature (1)..( 8): Result.001 file - promoters70/1376650
gaaatcaa

SEQ ID NO: 82418 - DNA, 8 bp, Unknown
  misc_feature (1)..( 8): Result.001 file - promoters70/1376650
gaactcag

SEQ ID NO: 82419 - DNA, 8 bp, Unknown
  misc_feature (1)..( 8): Result.001 file - promoters70/1376650
taacacag

SEQ ID NO: 82420 - DNA, 8 bp, Unknown
  misc_feature (1)..( 8): Result.001 file - promoters70/1376650
gaactcag

SEQ ID NO: 82421 - DNA, 8 bp, Unknown
  misc_feature (1)..( 8): Result.001 file - promoters70/1376650
gaaatcaa

SEQ ID NO: 82422 - DNA, 9 bp, Unknown
  misc_feature (1)..( 9): Result.001 file - promoters70/1376650
ccgaaaaaa

SEQ ID NO: 82423 - DNA, 9 bp, Unknown
  misc_feature (1)..( 9): Result.001 file - promoters70/1376650
aagaaaaaa

SEQ ID NO: 82424 - DNA, 9 bp, Unknown
  misc_feature (1)..( 9): Result.001 file - promoters70/1376881
aagacaaaa

SEQ ID NO: 82425 - DNA, 6 bp, Unknown
  misc_feature (1)..( 6): Result.001 file - promoters70/1376881
agtaaa

SEQ ID NO: 82426 - DNA, 6 bp, Unknown
  misc_feature (1)..( 6): Result.001 file - promoters70/1376881
agtaaa

SEQ ID NO: 82427 - DNA, 6 bp, Unknown
  misc_feature (1)..( 6): Result.001 file - promoters70/1376881
agtaaa

SEQ ID NO: 82428 - DNA, 10 bp, Unknown
  misc_feature (1)..( 10): Result.001 file - promoters70/1376881
tcaacaaaaa

SEQ ID NO: 82429 - DNA, 10 bp, Unknown
  misc_feature (1)..( 10): Result.001 file - promoters70/1376881
gaaacaaaaa

SEQ ID NO: 82430 - DNA, 10 bp, Unknown
  misc_feature (1)..( 10): Result.001 file - promoters70/1377139
gaaagaaagc

SEQ ID NO: 82431 - DNA, 8 bp, Unknown
  misc_feature (1)..( 8): Result.001 file - promoters70/1377139
tttgagaa

SEQ ID NO: 82432 - DNA, 8 bp, Unknown
  misc_feature (1)..( 8): Result.001 file - promoters70/1377139
tttgagag

SEQ ID NO: 82433 - DNA, 8 bp, Unknown
  misc_feature (1)..( 8): Result.001 file - promoters70/1377412
actgagag

SEQ ID NO: 82434 - DNA, 7 bp, Unknown
  misc_feature (1)..( 7): Result.001 file - promoters70/1377412
ttgtgat

SEQ ID NO: 82435 - DNA, 7 bp, Unknown
  misc_feature (1)..( 7): Result.001 file - promoters70/1377412
ttgtgaa

SEQ ID NO: 82436 - DNA, 7 bp, Unknown
  misc_feature (1)..( 7): Result.001 file - promoters70/1377412
ctgtgaa

SEQ ID NO: 82437 - DNA, 11 bp, Unknown
  misc_feature (1)..( 11): Result.001 file - promoters70/1377412
aaatcaaagat

SEQ ID NO: 82438 - DNA, 11 bp, Unknown
  misc_feature (1)..( 11): Result.001 file - promoters70/1377412
aaattaaaccc

SEQ ID NO: 82439 - DNA, 11 bp, Unknown
  misc_feature (1)..( 11): Result.001 file - promoters70/1377412
ggatcacagat

SEQ ID NO: 82440 - DNA, 8 bp, Unknown
  misc_feature (1)..( 8): Result.001 file - promoters70/1377412
ttctccaa

SEQ ID NO: 82441 - DNA, 8 bp, Unknown
  misc_feature (1)..( 8): Result.001 file - promoters70/1377412
ttcttcaa

SEQ ID NO: 82442 - DNA, 8 bp, Unknown
  misc_feature (1)..( 8): Result.001 file - promoters70/1377472
ttcttctt

SEQ ID NO: 82443 - DNA, 7 bp, Unknown
  misc_feature (1)..( 7): Result.001 file - promoters70/1377472
aaaacaa

SEQ ID NO: 82444 - DNA, 7 bp, Unknown
  misc_feature (1)..( 7): Result.001 file - promoters70/1377472
aaaacat

SEQ ID NO: 82445 - DNA, 7 bp, Unknown
  misc_feature (1)..( 7): Result.001 file - promoters70/1377472
aaatcaa

SEQ ID NO: 82446 - DNA, 8 bp, Unknown
  misc_feature (1)..( 8): Result.001 file - promoters70/1377472
aatctttt

SEQ ID NO: 82447 - DNA, 8 bp, Unknown
  misc_feature (1)..( 8): Result.001 file - promoters70/1377472
catcgttt

SEQ ID NO: 82448 - DNA, 8 bp, Unknown
  misc_feature (1)..( 8): Result.001 file - promoters70/1377472
catcgtcg

SEQ ID NO: 82449 - DNA, 8 bp, Unknown
  misc_feature (1)..( 8): Result.001 file - promoters70/1377472
tattattt

SEQ ID NO: 82450 - DNA, 8 bp, Unknown
  misc_feature (1)..( 8): Result.001 file - promoters70/1377472
gattcttt

SEQ ID NO: 82451 - DNA, 8 bp, Unknown
  misc_feature (1)..( 8): Result.001 file - promoters70/1377564
gattctct

SEQ ID NO: 82452 - DNA, 7 bp, Unknown
  misc_feature (1)..( 7): Result.001 file - promoters70/1377564
attttac

SEQ ID NO: 82453 - DNA, 7 bp, Unknown
  misc_feature (1)..( 7): Result.001 file - promoters70/1377564
tttttac

SEQ ID NO: 82454 - DNA, 7 bp, Unknown
  misc_feature (1)..( 7): Result.001 file - promoters70/1377564
attttaa

SEQ ID NO: 82455 - DNA, 7 bp, Unknown
  misc_feature (1)..( 7): Result.001 file - promoters70/1377564
caaaatt

SEQ ID NO: 82456 - DNA, 7 bp, Unknown
  misc_feature (1)..( 7): Result.001 file - promoters70/1377564
caaaatc

SEQ ID NO: 82457 - DNA, 7 bp, Unknown
  misc_feature (1)..( 7): Result.001 file - promoters70/1377642
taaaatc

SEQ ID NO: 82458 - DNA, 10 bp, Unknown
  misc_feature (1)..( 10): Result.001 file - promoters70/1377642
taaaaatgaa

SEQ ID NO: 82459 - DNA, 10 bp, Unknown
  misc_feature (1)..( 10): Result.001 file - promoters70/1377642
taaaaagtct

SEQ ID NO: 82460 - DNA, 10 bp, Unknown
  misc_feature (1)..( 10): Result.001 file - promoters70/1377642
aaaaaaagaa

SEQ ID NO: 82461 - DNA, 10 bp, Unknown
  misc_feature (1)..( 10): Result.001 file - promoters70/1377642
gaaaaagggt

SEQ ID NO: 82462 - DNA, 12 bp, Unknown
  misc_feature (1)..( 12): Result.001 file - promoters70/1377642
atataataaata

SEQ ID NO: 82463 - DNA, 12 bp, Unknown
  misc_feature (1)..( 12): Result.001 file - promoters70/1377642
gcataaaaaata

SEQ ID NO: 82464 - DNA, 12 bp, Unknown
  misc_feature (1)..( 12): Result.001 file - promoters70/1377642
ttattatacttc

SEQ ID NO: 82465 - DNA, 12 bp, Unknown
  misc_feature (1)..( 12): Result.001 file - promoters70/1377642
atataattatct

SEQ ID NO: 82466 - DNA, 12 bp, Unknown
  misc_feature (1)..( 12): Result.001 file - promoters70/1377642
ctaaaatataat

SEQ ID NO: 82467 - DNA, 10 bp, Unknown
  misc_feature (1)..( 10): Result.001 file - promoters70/1377642
gtatatatat

SEQ ID NO: 82468 - DNA, 10 bp, Unknown
  misc_feature (1)..( 10): Result.001 file - promoters70/1377642
aaataaatag

SEQ ID NO: 82469 - DNA, 10 bp, Unknown
  misc_feature (1)..( 10): Result.001 file - promoters70/1377642
aaatatataa

SEQ ID NO: 82470 - DNA, 10 bp, Unknown
  misc_feature (1)..( 10): Result.001 file - promoters70/1377642
taaaatataa

SEQ ID NO: 82471 - DNA, 12 bp, Unknown
  misc_feature (1)..( 12): Result.001 file - promoters70/1377642
tagaaattaata

SEQ ID NO: 82472 - DNA, 12 bp, Unknown
  misc_feature (1)..( 12): Result.001 file - promoters70/1377642
agataattaagt

SEQ ID NO: 82473 - DNA, 11 bp, Unknown
  misc_feature (1)..( 11): Result.001 file - promoters70/1377642
taaaatcaata

SEQ ID NO: 82474 - DNA, 11 bp, Unknown
  misc_feature (1)..( 11): Result.001 file - promoters70/1377642
tttaattatta

SEQ ID NO: 82475 - DNA, 12 bp, Unknown
  misc_feature (1)..( 12): Result.001 file - promoters70/1377642
ataacatcactt

SEQ ID NO: 82476 - DNA, 12 bp, Unknown
  misc_feature (1)..( 12): Result.001 file - promoters70/1377642
ttttatcacaag

SEQ ID NO: 82477 - DNA, 12 bp, Unknown
  misc_feature (1)..( 12): Result.001 file - promoters70/1377642
ttttgtcaacga

SEQ ID NO: 82478 - DNA, 12 bp, Unknown
  misc_feature (1)..( 12): Result.001 file - promoters70/1377642
cggtgtaaacga

SEQ ID NO: 82479 - DNA, 12 bp, Unknown
  misc_feature (1)..( 12): Result.001 file - promoters70/1377642
ttttgtatctaa

SEQ ID NO: 82480 - DNA, 8 bp, Unknown
  misc_feature (1)..( 8): Result.001 file - promoters70/1377642
atatatat

SEQ ID NO: 82481 - DNA, 8 bp, Unknown
  misc_feature (1)..( 8): Result.001 file - promoters70/1377642
atatttat

SEQ ID NO: 82482 - DNA, 8 bp, Unknown
  misc_feature (1)..( 8): Result.001 file - promoters70/1377642
caatttat

SEQ ID NO: 82483 - DNA, 8 bp, Unknown
  misc_feature (1)..( 8): Result.001 file - promoters70/1377642
taatttat

SEQ ID NO: 82484 - DNA, 8 bp, Unknown
  misc_feature (1)..( 8): Result.001 file - promoters70/1377642
aatcaaaa

SEQ ID NO: 82485 - DNA, 8 bp, Unknown
  misc_feature (1)..( 8): Result.001 file - promoters70/1377642
aatcaaat

SEQ ID NO: 82486 - DNA, 9 bp, Unknown
  misc_feature (1)..( 9): Result.001 file - promoters70/1377642
gatccaaac

SEQ ID NO: 82487 - DNA, 9 bp, Unknown
  misc_feature (1)..( 9): Result.001 file - promoters70/1377642
tatcctaac

SEQ ID NO: 82488 - DNA, 11 bp, Unknown
  misc_feature (1)..( 11): Result.001 file - promoters70/1377642
ctagacacgta

SEQ ID NO: 82489 - DNA, 11 bp, Unknown
  misc_feature (1)..( 11): Result.001 file - promoters70/1377642
atcaacacgta

SEQ ID NO: 82490 - DNA, 11 bp, Unknown
  misc_feature (1)..( 11): Result.001 file - promoters70/1377642
aaagagacgaa

SEQ ID NO: 82491 - DNA, 11 bp, Unknown
  misc_feature (1)..( 11): Result.001 file - promoters70/1377642
aaaaagaatac

SEQ ID NO: 82492 - DNA, 8 bp, Unknown
  misc_feature (1)..( 8): Result.001 file - promoters70/1377642
ttataatg

SEQ ID NO: 82493 - DNA, 8 bp, Unknown
  misc_feature (1)..( 8): Result.001 file - promoters70/1377642
atataata

SEQ ID NO: 82494 - DNA, 8 bp, Unknown
  misc_feature (1)..( 8): Result.001 file - promoters70/1377642
ttattata

SEQ ID NO: 82495 - DNA, 8 bp, Unknown
  misc_feature (1)..( 8): Result.001 file - promoters70/1377680
ataaaatc

SEQ ID NO: 82496 - DNA, 11 bp, Unknown
  misc_feature (1)..( 11): Result.001 file - promoters70/1377680
tgtttgaccat

SEQ ID NO: 82497 - DNA, 11 bp, Unknown
  misc_feature (1)..( 11): Result.001 file - promoters70/1377680
tatttgaacat

SEQ ID NO: 82498 - DNA, 11 bp, Unknown
  misc_feature (1)..( 11): Result.001 file - promoters70/1377680
tgtgtgagttc

SEQ ID NO: 82499 - DNA, 8 bp, Unknown
  misc_feature (1)..( 8): Result.001 file - promoters70/1377680
taacgaac

SEQ ID NO: 82500 - DNA, 8 bp, Unknown
  misc_feature (1)..( 8): Result.001 file - promoters70/1377680
caacgaaa

SEQ ID NO: 82501 - DNA, 8 bp, Unknown
  misc_feature (1)..( 8): Result.001 file - promoters70/1377680
caactaaa

SEQ ID NO: 82502 - DNA, 10 bp, Unknown
  misc_feature (1)..( 10): Result.001 file - promoters70/1377680
aaatcatttt

SEQ ID NO: 82503 - DNA, 10 bp, Unknown
  misc_feature (1)..( 10): Result.001 file - promoters70/1377680
aaataatttt

SEQ ID NO: 82504 - DNA, 10 bp, Unknown
  misc_feature (1)..( 10): Result.001 file - promoters70/1377680
caatcatatt

SEQ ID NO: 82505 - DNA, 10 bp, Unknown
  misc_feature (1)..( 10): Result.001 file - promoters70/1377680
ctatcataat

SEQ ID NO: 82506 - DNA, 9 bp, Unknown
  misc_feature (1)..( 9): Result.001 file - promoters70/1377680
ataggaaat

SEQ ID NO: 82507 - DNA, 9 bp, Unknown
  misc_feature (1)..( 9): Result.001 file - promoters70/1377680
ataagaaaa

SEQ ID NO: 82508 - DNA, 9 bp, Unknown
  misc_feature (1)..( 9): Result.001 file - promoters70/1377680
ataataaaa

SEQ ID NO: 82509 - DNA, 9 bp, Unknown
  misc_feature (1)..( 9): Result.001 file - promoters70/1377680
tcaaccata

SEQ ID NO: 82510 - DNA, 9 bp, Unknown
  misc_feature (1)..( 9): Result.001 file - promoters70/1377680
tcaatcata

SEQ ID NO: 82511 - DNA, 9 bp, Unknown
  misc_feature (1)..( 9): Result.001 file - promoters70/1377680
actatcata

SEQ ID NO: 82512 - DNA, 9 bp, Unknown
  misc_feature (1)..( 9): Result.001 file - promoters70/1377680
taatttatt

SEQ ID NO: 82513 - DNA, 9 bp, Unknown
  misc_feature (1)..( 9): Result.001 file - promoters70/1377680
taatttcat

SEQ ID NO: 82514 - DNA, 9 bp, Unknown
  misc_feature (1)..( 9): Result.001 file - promoters70/1377680
aaatttcat

SEQ ID NO: 82515 - DNA, 9 bp, Unknown
  misc_feature (1)..( 9): Result.001 file - promoters70/1377680
taattttca

SEQ ID NO: 82516 - DNA, 9 bp, Unknown
  misc_feature (1)..( 9): Result.001 file - promoters70/1377680
ataatatgt

SEQ ID NO: 82517 - DNA, 9 bp, Unknown
  misc_feature (1)..( 9): Result.001 file - promoters70/1377680
ataataaaa

SEQ ID NO: 82518 - DNA, 9 bp, Unknown
  misc_feature (1)..( 9): Result.001 file - promoters70/1377680
ataagaaaa

SEQ ID NO: 82519 - DNA, 8 bp, Unknown
  misc_feature (1)..( 8): Result.001 file - promoters70/1377680
gaatttct

SEQ ID NO: 82520 - DNA, 8 bp, Unknown
  misc_feature (1)..( 8): Result.001 file - promoters70/1377680
aaatatct

SEQ ID NO: 82521 - DNA, 8 bp, Unknown
  misc_feature (1)..( 8): Result.001 file - promoters70/1377680
aaatatcc

SEQ ID NO: 82522 - DNA, 7 bp, Unknown
  misc_feature (1)..( 7): Result.001 file - promoters70/1377680
tatcata

SEQ ID NO: 82523 - DNA, 7 bp, Unknown
  misc_feature (1)..( 7): Result.001 file - promoters70/1377680
tattata

SEQ ID NO: 82524 - DNA, 7 bp, Unknown
  misc_feature (1)..( 7): Result.001 file - promoters70/1377680
aatcata

SEQ ID NO: 82525 - DNA, 8 bp, Unknown
  misc_feature (1)..( 8): Result.001 file - promoters70/1377680
taataaag

SEQ ID NO: 82526 - DNA, 8 bp, Unknown
  misc_feature (1)..( 8): Result.001 file - promoters70/1377680
taatcaag

SEQ ID NO: 82527 - DNA, 8 bp, Unknown
  misc_feature (1)..( 8): Result.001 file - promoters70/1377680
taacaaaa

SEQ ID NO: 82528 - DNA, 12 bp, Unknown
  misc_feature (1)..( 12): Result.001 file - promoters70/1377680
ataaattaatgc

SEQ ID NO: 82529 - DNA, 12 bp, Unknown
  misc_feature (1)..( 12): Result.001 file - promoters70/1377680
atatattaatgt

SEQ ID NO: 82530 - DNA, 12 bp, Unknown
  misc_feature (1)..( 12): Result.001 file - promoters70/1377718
tttggttattgt

SEQ ID NO: 82531 - DNA, 10 bp, Unknown
  misc_feature (1)..( 10): Result.001 file - promoters70/1377718
taaatttgct

SEQ ID NO: 82532 - DNA, 10 bp, Unknown
  misc_feature (1)..( 10): Result.001 file - promoters70/1377718
taaatttaaa

SEQ ID NO: 82533 - DNA, 10 bp, Unknown
  misc_feature (1)..( 10): Result.001 file - promoters70/1377847
tgaatctgct

SEQ ID NO: 82534 - DNA, 6 bp, Unknown
  misc_feature (1)..( 6): Result.001 file - promoters70/1377847
accaaa

SEQ ID NO: 82535 - DNA, 6 bp, Unknown
  misc_feature (1)..( 6): Result.001 file - promoters70/1377847
accaaa

SEQ ID NO: 82536 - DNA, 6 bp, Unknown
  misc_feature (1)..( 6): Result.001 file - promoters70/1377847
accaaa

SEQ ID NO: 82537 - DNA, 9 bp, Unknown
  misc_feature (1)..( 9): Result.001 file - promoters70/1377847
tgtttgttt

SEQ ID NO: 82538 - DNA, 9 bp, Unknown
  misc_feature (1)..( 9): Result.001 file - promoters70/1377847
tgttttttt

SEQ ID NO: 82539 - DNA, 9 bp, Unknown
  misc_feature (1)..( 9): Result.001 file - promoters70/1377847
tgtttcaca

SEQ ID NO: 82540 - DNA, 8 bp, Unknown
  misc_feature (1)..( 8): Result.001 file - promoters70/1377847
aatcaaga

SEQ ID NO: 82541 - DNA, 8 bp, Unknown
  misc_feature (1)..( 8): Result.001 file - promoters70/1377847
aatcaatg

SEQ ID NO: 82542 - DNA, 8 bp, Unknown
  misc_feature (1)..( 8): Result.001 file - promoters70/1377847
aataaaga

SEQ ID NO: 82543 - DNA, 9 bp, Unknown
  misc_feature (1)..( 9): Result.001 file - promoters70/1377847
tttccatct

SEQ ID NO: 82544 - DNA, 9 bp, Unknown
  misc_feature (1)..( 9): Result.001 file - promoters70/1377847
gttccttct

SEQ ID NO: 82545 - DNA, 9 bp, Unknown
  misc_feature (1)..( 9): Result.001 file - promoters70/1377847
gttcctttg

SEQ ID NO: 82546 - DNA, 13 bp, Unknown
  misc_feature (1)..( 13): Result.001 file - promoters70/1377847
ctagtttcctctt

SEQ ID NO: 82547 - DNA, 13 bp, Unknown
  misc_feature (1)..( 13): Result.001 file - promoters70/1377847
ctctttttctctt

SEQ ID NO: 82548 - DNA, 13 bp, Unknown
  misc_feature (1)..( 13): Result.001 file - promoters70/1377847
ccataattctctt

SEQ ID NO: 82549 - DNA, 13 bp, Unknown
  misc_feature (1)..( 13): Result.001 file - promoters70/1378049
ctctttttctaat

SEQ ID NO: 82550 - DNA, 15 bp, Unknown
  misc_feature (1)..( 15): Result.001 file - promoters70/1378049
aaatattaaccttga

SEQ ID NO: 82551 - DNA, 15 bp, Unknown
  misc_feature (1)..( 15): Result.001 file - promoters70/1378049
aaaaattaaatgcta

SEQ ID NO: 82552 - DNA, 15 bp, Unknown
  misc_feature (1)..( 15): Result.001 file - promoters70/1378049
caaaattgaccctga

SEQ ID NO: 82553 - DNA, 15 bp, Unknown
  misc_feature (1)..( 15): Result.001 file - promoters70/1378049
taaaatttcataacc

SEQ ID NO: 82554 - DNA, 7 bp, Unknown
  misc_feature (1)..( 7): Result.001 file - promoters70/1378049
aaacaaa

SEQ ID NO: 82555 - DNA, 7 bp, Unknown
  misc_feature (1)..( 7): Result.001 file - promoters70/1378049
aaataaa

SEQ ID NO: 82556 - DNA, 7 bp, Unknown
  misc_feature (1)..( 7): Result.001 file - promoters70/1378049
aaacaaa

SEQ ID NO: 82557 - DNA, 7 bp, Unknown
  misc_feature (1)..( 7): Result.001 file - promoters70/1378049
atacata

SEQ ID NO: 82558 - DNA, 11 bp, Unknown
  misc_feature (1)..( 11): Result.001 file - promoters70/1378049
tttgtttaaca

SEQ ID NO: 82559 - DNA, 11 bp, Unknown
  misc_feature (1)..( 11): Result.001 file - promoters70/1378049
tttatttcttt

SEQ ID NO: 82560 - DNA, 11 bp, Unknown
  misc_feature (1)..( 11): Result.001 file - promoters70/1378049
tctgtttcaca

SEQ ID NO: 82561 - DNA, 11 bp, Unknown
  misc_feature (1)..( 11): Result.001 file - promoters70/1378049
attaattcttt

SEQ ID NO: 82562 - DNA, 8 bp, Unknown
  misc_feature (1)..( 8): Result.001 file - promoters70/1378049
gaataaaa

SEQ ID NO: 82563 - DNA, 8 bp, Unknown
  misc_feature (1)..( 8): Result.001 file - promoters70/1378049
caattaaa

SEQ ID NO: 82564 - DNA, 8 bp, Unknown
  misc_feature (1)..( 8): Result.001 file - promoters70/1378049
caataaat

SEQ ID NO: 82565 - DNA, 8 bp, Unknown
  misc_feature (1)..( 8): Result.001 file - promoters70/1378088
caaaaaag

SEQ ID NO: 82566 - DNA, 11 bp, Unknown
  misc_feature (1)..( 11): Result.001 file - promoters70/1378088
aaatattttat

SEQ ID NO: 82567 - DNA, 11 bp, Unknown
  misc_feature (1)..( 11): Result.001 file - promoters70/1378088
acttattttat

SEQ ID NO: 82568 - DNA, 11 bp, Unknown
  misc_feature (1)..( 11): Result.001 file - promoters70/1378088
aattattttaa

SEQ ID NO: 82569 - DNA, 11 bp, Unknown
  misc_feature (1)..( 11): Result.001 file - promoters70/1378088
aactaatttag

SEQ ID NO: 82570 - DNA, 7 bp, Unknown
  misc_feature (1)..( 7): Result.001 file - promoters70/1378088
aagattt

SEQ ID NO: 82571 - DNA, 7 bp, Unknown
  misc_feature (1)..( 7): Result.001 file - promoters70/1378088
tagattt

SEQ ID NO: 82572 - DNA, 7 bp, Unknown
  misc_feature (1)..( 7): Result.001 file - promoters70/1378088
cagattt

SEQ ID NO: 82573 - DNA, 7 bp, Unknown
  misc_feature (1)..( 7): Result.001 file - promoters70/1378088
tagattt

SEQ ID NO: 82574 - DNA, 11 bp, Unknown
  misc_feature (1)..( 11): Result.001 file - promoters70/1378088
tctaaatttta

SEQ ID NO: 82575 - DNA, 11 bp, Unknown
  misc_feature (1)..( 11): Result.001 file - promoters70/1378088
aaattatttta

SEQ ID NO: 82576 - DNA, 11 bp, Unknown
  misc_feature (1)..( 11): Result.001 file - promoters70/1378088
aacttatttta

SEQ ID NO: 82577 - DNA, 11 bp, Unknown
  misc_feature (1)..( 11): Result.001 file - promoters70/1378088
aactaatttag

SEQ ID NO: 82578 - DNA, 13 bp, Unknown
  misc_feature (1)..( 13): Result.001 file - promoters70/1378088
aattggatccgaa

SEQ ID NO: 82579 - DNA, 13 bp, Unknown
  misc_feature (1)..( 13): Result.001 file - promoters70/1378088
aattagatttttt

SEQ ID NO: 82580 - DNA, 13 bp, Unknown
  misc_feature (1)..( 13): Result.001 file - promoters70/1378088
atctagatttgtg

SEQ ID NO: 82581 - DNA, 13 bp, Unknown
  misc_feature (1)..( 13): Result.001 file - promoters70/1378088
tattcgatctttt

SEQ ID NO: 82582 - DNA, 9 bp, Unknown
  misc_feature (1)..( 9): Result.001 file - promoters70/1378088
aaaatctgg

SEQ ID NO: 82583 - DNA, 9 bp, Unknown
  misc_feature (1)..( 9): Result.001 file - promoters70/1378088
aaaatcatt

SEQ ID NO: 82584 - DNA, 9 bp, Unknown
  misc_feature (1)..( 9): Result.001 file - promoters70/1378088
aaaaacatt

SEQ ID NO: 82585 - DNA, 9 bp, Unknown
  misc_feature (1)..( 9): Result.001 file - promoters70/1378088
taaaacaat

SEQ ID NO: 82586 - DNA, 9 bp, Unknown
  misc_feature (1)..( 9): Result.001 file - promoters70/1378088
taaaaatct

SEQ ID NO: 82587 - DNA, 9 bp, Unknown
  misc_feature (1)..( 9): Result.001 file - promoters70/1378088
taaaaatta

SEQ ID NO: 82588 - DNA, 9 bp, Unknown
  misc_feature (1)..( 9): Result.001 file - promoters70/1378088
acaaaatta

SEQ ID NO: 82589 - DNA, 9 bp, Unknown
  misc_feature (1)..( 9): Result.001 file - promoters70/1378088
actaaatta

SEQ ID NO: 82590 - DNA, 11 bp, Unknown
  misc_feature (1)..( 11): Result.001 file - promoters70/1378088
ttactttttta

SEQ ID NO: 82591 - DNA, 11 bp, Unknown
  misc_feature (1)..( 11): Result.001 file - promoters70/1378088
ccaatttgtta

SEQ ID NO: 82592 - DNA, 11 bp, Unknown
  misc_feature (1)..( 11): Result.001 file - promoters70/1378088
ttcgttttttt

SEQ ID NO: 82593 - DNA, 11 bp, Unknown
  misc_feature (1)..( 11): Result.001 file - promoters70/1378088
tacattttatc

SEQ ID NO: 82594 - DNA, 10 bp, Unknown
  misc_feature (1)..( 10): Result.001 file - promoters70/1378088
attttataat

SEQ ID NO: 82595 - DNA, 10 bp, Unknown
  misc_feature (1)..( 10): Result.001 file - promoters70/1378088
attttatagg

SEQ ID NO: 82596 - DNA, 10 bp, Unknown
  misc_feature (1)..( 10): Result.001 file - promoters70/1378088
tttttaattc

SEQ ID NO: 82597 - DNA, 10 bp, Unknown
  misc_feature (1)..( 10): Result.001 file - promoters70/1378088
actttaaaat

SEQ ID NO: 82598 - DNA, 13 bp, Unknown
  misc_feature (1)..( 13): Result.001 file - promoters70/1378088
ttagaagaagtta

SEQ ID NO: 82599 - DNA, 13 bp, Unknown
  misc_feature (1)..( 13): Result.001 file - promoters70/1378088
ttataagaagaaa

SEQ ID NO: 82600 - DNA, 13 bp, Unknown
  misc_feature (1)..( 13): Result.001 file - promoters70/1378088
taaaaagagaaaa

SEQ ID NO: 82601 - DNA, 13 bp, Unknown
  misc_feature (1)..( 13): Result.001 file - promoters70/1378088
ttataaaacaatt

SEQ ID NO: 82602 - DNA, 8 bp, Unknown
  misc_feature (1)..( 8): Result.001 file - promoters70/1378088
gttagaaa

SEQ ID NO: 82603 - DNA, 8 bp, Unknown
  misc_feature (1)..( 8): Result.001 file - promoters70/1378088
gttaaaaa

SEQ ID NO: 82604 - DNA, 8 bp, Unknown
  misc_feature (1)..( 8): Result.001 file - promoters70/1378088
cttataaa

SEQ ID NO: 82605 - DNA, 8 bp, Unknown
  misc_feature (1)..( 8): Result.001 file - promoters70/1378088
attataag

SEQ ID NO: 82606 - DNA, 13 bp, Unknown
  misc_feature (1)..( 13): Result.001 file - promoters70/1378088
taaaaattgggtt

SEQ ID NO: 82607 - DNA, 13 bp, Unknown
  misc_feature (1)..( 13): Result.001 file - promoters70/1378088
taaaaagagaaaa

SEQ ID NO: 82608 - DNA, 13 bp, Unknown
  misc_feature (1)..( 13): Result.001 file - promoters70/1378088
taataatccttat

SEQ ID NO: 82609 - DNA, 13 bp, Unknown
  misc_feature (1)..( 13): Result.001 file - promoters70/1378333
taagaagaaaaaa

SEQ ID NO: 82610 - DNA, 7 bp, Unknown
  misc_feature (1)..( 7): Result.001 file - promoters70/1378333
gctaaaa

SEQ ID NO: 82611 - DNA, 7 bp, Unknown
  misc_feature (1)..( 7): Result.001 file - promoters70/1378333
gctgaaa

SEQ ID NO: 82612 - DNA, 7 bp, Unknown
  misc_feature (1)..( 7): Result.001 file - promoters70/1378393
tctgaaa

SEQ ID NO: 82613 - DNA, 13 bp, Unknown
  misc_feature (1)..( 13): Result.001 file - promoters70/1378393
ggtttgtttatct

SEQ ID NO: 82614 - DNA, 13 bp, Unknown
  misc_feature (1)..( 13): Result.001 file - promoters70/1378393
ggtttgaaaaaat

SEQ ID NO: 82615 - DNA, 13 bp, Unknown
  misc_feature (1)..( 13): Result.001 file - promoters70/1378393
tgtttttttttct

SEQ ID NO: 82616 - DNA, 13 bp, Unknown
  misc_feature (1)..( 13): Result.001 file - promoters70/1380389
ggtgtatttgaca

SEQ ID NO: 82617 - DNA, 8 bp, Unknown
  misc_feature (1)..( 8): Result.001 file - promoters70/1380389
cttgcttt

SEQ ID NO: 82618 - DNA, 8 bp, Unknown
  misc_feature (1)..( 8): Result.001 file - promoters70/1380389
tttggttt

SEQ ID NO: 82619 - DNA, 9 bp, Unknown
  misc_feature (1)..( 9): Result.001 file - promoters70/1380519
tttaggtct

SEQ ID NO: 82620 - DNA, 8 bp, Unknown
  misc_feature (1)..( 8): Result.001 file - promoters70/1380519
gagcaaaa

SEQ ID NO: 82621 - DNA, 8 bp, Unknown
  misc_feature (1)..( 8): Result.001 file - promoters70/1380519
gagaaaaa

SEQ ID NO: 82622 - DNA, 8 bp, Unknown
  misc_feature (1)..( 8): Result.001 file - promoters70/1380708
gagcaatg

SEQ ID NO: 82623 - DNA, 11 bp, Unknown
  misc_feature (1)..( 11): Result.001 file - promoters70/1380708
taacatttttt

SEQ ID NO: 82624 - DNA, 11 bp, Unknown
  misc_feature (1)..( 11): Result.001 file - promoters70/1380708
taagatttttg

SEQ ID NO: 82625 - DNA, 11 bp, Unknown
  misc_feature (1)..( 11): Result.001 file - promoters70/1380708
tagaatttttt

SEQ ID NO: 82626 - DNA, 9 bp, Unknown
  misc_feature (1)..( 9): Result.001 file - promoters70/1380708
tttaatcag

SEQ ID NO: 82627 - DNA, 9 bp, Unknown
  misc_feature (1)..( 9): Result.001 file - promoters70/1380708
tttattcag

SEQ ID NO: 82628 - DNA, 9 bp, Unknown
  misc_feature (1)..( 9): Result.001 file - promoters70/1381002
gttattcga

SEQ ID NO: 82629 - DNA, 16 bp, Unknown
  misc_feature (1)..( 16): Result.001 file - promoters70/1381002
tcaaaaactttcataa

SEQ ID NO: 82630 - DNA, 16 bp, Unknown
  misc_feature (1)..( 16): Result.001 file - promoters70/1381002
tattaaattttaattg

SEQ ID NO: 82631 - DNA, 16 bp, Unknown
  misc_feature (1)..( 16): Result.001 file - promoters70/1381002
catgttactttcttaa

SEQ ID NO: 82632 - DNA, 16 bp, Unknown
  misc_feature (1)..( 16): Result.001 file - promoters70/1381002
tatcaaattgacttgt

SEQ ID NO: 82633 - DNA, 7 bp, Unknown
  misc_feature (1)..( 7): Result.001 file - promoters70/1381002
ttaaaat

SEQ ID NO: 82634 - DNA, 7 bp, Unknown
  misc_feature (1)..( 7): Result.001 file - promoters70/1381002
ttaaaaa

SEQ ID NO: 82635 - DNA, 7 bp, Unknown
  misc_feature (1)..( 7): Result.001 file - promoters70/1381002
gtaaaat

SEQ ID NO: 82636 - DNA, 7 bp, Unknown
  misc_feature (1)..( 7): Result.001 file - promoters70/1381002
tcaacta

SEQ ID NO: 82637 - DNA, 7 bp, Unknown
  misc_feature (1)..( 7): Result.001 file - promoters70/1381002
tcaccta

SEQ ID NO: 82638 - DNA, 7 bp, Unknown
  misc_feature (1)..( 7): Result.001 file - promoters70/1381002
acaccta

SEQ ID NO: 82639 - DNA, 8 bp, Unknown
  misc_feature (1)..( 8): Result.001 file - promoters70/1381002
tatcattt

SEQ ID NO: 82640 - DNA, 8 bp, Unknown
  misc_feature (1)..( 8): Result.001 file - promoters70/1381002
tataattt

SEQ ID NO: 82641 - DNA, 8 bp, Unknown
  misc_feature (1)..( 8): Result.001 file - promoters70/1381002
cataattg

SEQ ID NO: 82642 - DNA, 9 bp, Unknown
  misc_feature (1)..( 9): Result.001 file - promoters70/1381002
tctcaaata

SEQ ID NO: 82643 - DNA, 9 bp, Unknown
  misc_feature (1)..( 9): Result.001 file - promoters70/1381002
tatcaaatt

SEQ ID NO: 82644 - DNA, 9 bp, Unknown
  misc_feature (1)..( 9): Result.001 file - promoters70/1381002
tattaaatt

SEQ ID NO: 82645 - DNA, 8 bp, Unknown
  misc_feature (1)..( 8): Result.001 file - promoters70/1381002
aaaacaca

SEQ ID NO: 82646 - DNA, 8 bp, Unknown
  misc_feature (1)..( 8): Result.001 file - promoters70/1381002
caaacact

SEQ ID NO: 82647 - DNA, 8 bp, Unknown
  misc_feature (1)..( 8): Result.001 file - promoters70/1381457
caatcact

SEQ ID NO: 82648 - DNA, 8 bp, Unknown
  misc_feature (1)..( 8): Result.001 file - promoters70/1381457
ttttgacc

SEQ ID NO: 82649 - DNA, 8 bp, Unknown
  misc_feature (1)..( 8): Result.001 file - promoters70/1381457
ttttgatt

SEQ ID NO: 82650 - DNA, 8 bp, Unknown
  misc_feature (1)..( 8): Result.001 file - promoters70/1381563
gtttcatt

SEQ ID NO: 82651 - DNA, 10 bp, Unknown
  misc_feature (1)..( 10): Result.001 file - promoters70/1381563
cgtacacgtg

SEQ ID NO: 82652 - DNA, 10 bp, Unknown
  misc_feature (1)..( 10): Result.001 file - promoters70/1381563
ggtacacgtg

SEQ ID NO: 82653 - DNA, 10 bp, Unknown
  misc_feature (1)..( 10): Result.001 file - promoters70/1381704
ggttcacgtc

SEQ ID NO: 82654 - DNA, 9 bp, Unknown
  misc_feature (1)..( 9): Result.001 file - promoters70/1381704
gtttccttt

SEQ ID NO: 82655 - DNA, 9 bp, Unknown
  misc_feature (1)..( 9): Result.001 file - promoters70/1381704
gttaccttt

SEQ ID NO: 82656 - DNA, 9 bp, Unknown
  misc_feature (1)..( 9): Result.001 file - promoters70/1381818
gcttcgttt

SEQ ID NO: 82657 - DNA, 8 bp, Unknown
  misc_feature (1)..( 8): Result.001 file - promoters70/1381818
aaataaaa

SEQ ID NO: 82658 - DNA, 8 bp, Unknown
  misc_feature (1)..( 8): Result.001 file - promoters70/1381818
ttataaaa

SEQ ID NO: 82659 - DNA, 8 bp, Unknown
  misc_feature (1)..( 8): Result.001 file - promoters70/1381818
aaataaag

SEQ ID NO: 82660 - DNA, 8 bp, Unknown
  misc_feature (1)..( 8): Result.001 file - promoters70/1381818
ttagaaaa

SEQ ID NO: 82661 - DNA, 8 bp, Unknown
  misc_feature (1)..( 8): Result.001 file - promoters70/1381818
aatgaaaa

SEQ ID NO: 82662 - DNA, 8 bp, Unknown
  misc_feature (1)..( 8): Result.001 file - promoters70/1381818
aatgaaat

SEQ ID NO: 82663 - DNA, 9 bp, Unknown
  misc_feature (1)..( 9): Result.001 file - promoters70/1381818
tatgagaaa

SEQ ID NO: 82664 - DNA, 9 bp, Unknown
  misc_feature (1)..( 9): Result.001 file - promoters70/1381818
tataagaaa

SEQ ID NO: 82665 - DNA, 9 bp, Unknown
  misc_feature (1)..( 9): Result.001 file - promoters70/1381818
aaaaacaaa

SEQ ID NO: 82666 - DNA, 9 bp, Unknown
  misc_feature (1)..( 9): Result.001 file - promoters70/1381818
ttaaaaaaa

SEQ ID NO: 82667 - DNA, 9 bp, Unknown
  misc_feature (1)..( 9): Result.001 file - promoters70/1381818
caaaacatc

SEQ ID NO: 82668 - DNA, 9 bp, Unknown
  misc_feature (1)..( 9): Result.001 file - promoters70/1381818
taagaaaat

SEQ ID NO: 82669 - DNA, 9 bp, Unknown
  misc_feature (1)..( 9): Result.001 file - promoters70/1381818
gaaatcata

SEQ ID NO: 82670 - DNA, 11 bp, Unknown
  misc_feature (1)..( 11): Result.001 file - promoters70/1381818
atgaaaaacaa

SEQ ID NO: 82671 - DNA, 11 bp, Unknown
  misc_feature (1)..( 11): Result.001 file - promoters70/1381818
aagaaaaaata

SEQ ID NO: 82672 - DNA, 11 bp, Unknown
  misc_feature (1)..( 11): Result.001 file - promoters70/1381818
atgagaaatca

SEQ ID NO: 82673 - DNA, 11 bp, Unknown
  misc_feature (1)..( 11): Result.001 file - promoters70/1381818
aagaaaatata

SEQ ID NO: 82674 - DNA, 11 bp, Unknown
  misc_feature (1)..( 11): Result.001 file - promoters70/1381818
atattattagt

SEQ ID NO: 82675 - DNA, 11 bp, Unknown
  misc_feature (1)..( 11): Result.001 file - promoters70/1381818
atataattatt

SEQ ID NO: 82676 - DNA, 11 bp, Unknown
  misc_feature (1)..( 11): Result.001 file - promoters70/1381818
taatgattttg

SEQ ID NO: 82677 - DNA, 11 bp, Unknown
  misc_feature (1)..( 11): Result.001 file - promoters70/1381818
caatgataata

SEQ ID NO: 82678 - DNA, 11 bp, Unknown
  misc_feature (1)..( 11): Result.001 file - promoters70/1381818
ccttgagttta

SEQ ID NO: 82679 - DNA, 11 bp, Unknown
  misc_feature (1)..( 11): Result.001 file - promoters70/1381818
tgttgaatttt

SEQ ID NO: 82680 - DNA, 11 bp, Unknown
  misc_feature (1)..( 11): Result.001 file - promoters70/1381818
attctaatttt

SEQ ID NO: 82681 - DNA, 11 bp, Unknown
  misc_feature (1)..( 11): Result.001 file - promoters70/1381818
agttaactttg

SEQ ID NO: 82682 - DNA, 11 bp, Unknown
  misc_feature (1)..( 11): Result.001 file - promoters70/1381818
agttaactata

SEQ ID NO: 82683 - DNA, 11 bp, Unknown
  misc_feature (1)..( 11): Result.001 file - promoters70/1381818
tattaaccttg

SEQ ID NO: 82684 - DNA, 11 bp, Unknown
  misc_feature (1)..( 11): Result.001 file - promoters70/1381818
agttaactttg

SEQ ID NO: 82685 - DNA, 11 bp, Unknown
  misc_feature (1)..( 11): Result.001 file - promoters70/1381818
ttctaattttc

SEQ ID NO: 82686 - DNA, 11 bp, Unknown
  misc_feature (1)..( 11): Result.001 file - promoters70/1381818
agttaactata

SEQ ID NO: 82687 - DNA, 11 bp, Unknown
  misc_feature (1)..( 11): Result.001 file - promoters70/1381926
aattaacttat

SEQ ID NO: 82688 - DNA, 10 bp, Unknown
  misc_feature (1)..( 10): Result.001 file - promoters70/1381926
gaaaaagata

SEQ ID NO: 82689 - DNA, 10 bp, Unknown
  misc_feature (1)..( 10): Result.001 file - promoters70/1381926
gaaatagatt

SEQ ID NO: 82690 - DNA, 10 bp, Unknown
  misc_feature (1)..( 10): Result.001 file - promoters70/1382713
tatataaatt

SEQ ID NO: 82691 - DNA, 7 bp, Unknown
  misc_feature (1)..( 7): Result.001 file - promoters70/1382713
attgtgt

SEQ ID NO: 82692 - DNA, 7 bp, Unknown
  misc_feature (1)..( 7): Result.001 file - promoters70/1382713
attctgt

SEQ ID NO: 82693 - DNA, 7 bp, Unknown
  misc_feature (1)..( 7): Result.001 file - promoters70/1382713
tttgtgt

SEQ ID NO: 82694 - DNA, 8 bp, Unknown
  misc_feature (1)..( 8): Result.001 file - promoters70/1382713
atttttca

SEQ ID NO: 82695 - DNA, 8 bp, Unknown
  misc_feature (1)..( 8): Result.001 file - promoters70/1382713
attattct

SEQ ID NO: 82696 - DNA, 8 bp, Unknown
  misc_feature (1)..( 8): Result.001 file - promoters70/1383341
cttattct

SEQ ID NO: 82697 - DNA, 13 bp, Unknown
  misc_feature (1)..( 13): Result.001 file - promoters70/1383341
ccccctatgtagt

SEQ ID NO: 82698 - DNA, 13 bp, Unknown
  misc_feature (1)..( 13): Result.001 file - promoters70/1383341
ttttctatataga

SEQ ID NO: 82699 - DNA, 13 bp, Unknown
  misc_feature (1)..( 13): Result.001 file - promoters70/1383341
cttcttttgtagt

SEQ ID NO: 82700 - DNA, 13 bp, Unknown
  misc_feature (1)..( 13): Result.001 file - promoters70/1383341
ctttttttttagt

SEQ ID NO: 82701 - DNA, 13 bp, Unknown
  misc_feature (1)..( 13): Result.001 file - promoters70/1383341
aatactatataaa

SEQ ID NO: 82702 - DNA, 15 bp, Unknown
  misc_feature (1)..( 15): Result.001 file - promoters70/1383341
accttcctaaaaagt

SEQ ID NO: 82703 - DNA, 15 bp, Unknown
  misc_feature (1)..( 15): Result.001 file - promoters70/1383341
aattaaataaaaaaa

SEQ ID NO: 82704 - DNA, 15 bp, Unknown
  misc_feature (1)..( 15): Result.001 file - promoters70/1383341
aaagaaataaatctt

SEQ ID NO: 82705 - DNA, 15 bp, Unknown
  misc_feature (1)..( 15): Result.001 file - promoters70/1383341
aaagaatcaaagaat

SEQ ID NO: 82706 - DNA, 15 bp, Unknown
  misc_feature (1)..( 15): Result.001 file - promoters70/1383485
aattaacgaaacaaa

SEQ ID NO: 82707 - DNA, 11 bp, Unknown
  misc_feature (1)..( 11): Result.001 file - promoters70/1383485
ccagaattaag

SEQ ID NO: 82708 - DNA, 11 bp, Unknown
  misc_feature (1)..( 11): Result.001 file - promoters70/1383485
ccataattagt

SEQ ID NO: 82709 - DNA, 11 bp, Unknown
  misc_feature (1)..( 11): Result.001 file - promoters70/1383552
atgtaattaag

SEQ ID NO: 82710 - DNA, 11 bp, Unknown
  misc_feature (1)..( 11): Result.001 file - promoters70/1383552
ttaaaaataaa

SEQ ID NO: 82711 - DNA, 11 bp, Unknown
  misc_feature (1)..( 11): Result.001 file - promoters70/1383552
gtaaaaattat

SEQ ID NO: 82712 - DNA, 11 bp, Unknown
  misc_feature (1)..( 11): Result.001 file - promoters70/1383552
gcaaaagtaaa

SEQ ID NO: 82713 - DNA, 11 bp, Unknown
  misc_feature (1)..( 11): Result.001 file - promoters70/1383552
ttaaaaacttc

SEQ ID NO: 82714 - DNA, 11 bp, Unknown
  misc_feature (1)..( 11): Result.001 file - promoters70/1383552
tttaaattaat

SEQ ID NO: 82715 - DNA, 11 bp, Unknown
  misc_feature (1)..( 11): Result.001 file - promoters70/1383552
cataaattttt

SEQ ID NO: 82716 - DNA, 9 bp, Unknown
  misc_feature (1)..( 9): Result.001 file - promoters70/1383552
aaaggtcat

SEQ ID NO: 82717 - DNA, 9 bp, Unknown
  misc_feature (1)..( 9): Result.001 file - promoters70/1383552
aaatgtctt

SEQ ID NO: 82718 - DNA, 9 bp, Unknown
  misc_feature (1)..( 9): Result.001 file - promoters70/1383552
taatgtctc

SEQ ID NO: 82719 - DNA, 9 bp, Unknown
  misc_feature (1)..( 9): Result.001 file - promoters70/1383552
taatgttaa

SEQ ID NO: 82720 - DNA, 9 bp, Unknown
  misc_feature (1)..( 9): Result.001 file - promoters70/1383552
ttatgtctt

SEQ ID NO: 82721 - DNA, 9 bp, Unknown
  misc_feature (1)..( 9): Result.001 file - promoters70/1383552
atttgtctt

SEQ ID NO: 82722 - DNA, 14 bp, Unknown
  misc_feature (1)..( 14): Result.001 file - promoters70/1383552
ttaaatttacgctc

SEQ ID NO: 82723 - DNA, 14 bp, Unknown
  misc_feature (1)..( 14): Result.001 file - promoters70/1383552
aaaaatttttctgt

SEQ ID NO: 82724 - DNA, 14 bp, Unknown
  misc_feature (1)..( 14): Result.001 file - promoters70/1383552
atcaatttataata

SEQ ID NO: 82725 - DNA, 14 bp, Unknown
  misc_feature (1)..( 14): Result.001 file - promoters70/1383552
aaaaattgtaatcc

SEQ ID NO: 82726 - DNA, 14 bp, Unknown
  misc_feature (1)..( 14): Result.001 file - promoters70/1383552
aaaaataaaagttc

SEQ ID NO: 82727 - DNA, 14 bp, Unknown
  misc_feature (1)..( 14): Result.001 file - promoters70/1384016
tctcattaataata

SEQ ID NO: 82728 - DNA, 18 bp, Unknown
  misc_feature (1)..( 18): Result.001 file - promoters70/1384016
cataacactttttgttta

SEQ ID NO: 82729 - DNA, 18 bp, Unknown
  misc_feature (1)..( 18): Result.001 file - promoters70/1384016
gaaatatttttttgtact

SEQ ID NO: 82730 - DNA, 18 bp, Unknown
  misc_feature (1)..( 18): Result.001 file - promoters70/1384016
aaataatatttttgaaaa

SEQ ID NO: 82731 - DNA, 18 bp, Unknown
  misc_feature (1)..( 18): Result.001 file - promoters70/1384016
aaaaaatattttcgaatt

SEQ ID NO: 82732 - DNA, 18 bp, Unknown
  misc_feature (1)..( 18): Result.001 file - promoters70/1384016
acattctatatttgatac

SEQ ID NO: 82733 - DNA, 18 bp, Unknown
  misc_feature (1)..( 18): Result.001 file - promoters70/1384016
cgacagcgttttttaaaa

SEQ ID NO: 82734 - DNA, 9 bp, Unknown
  misc_feature (1)..( 9): Result.001 file - promoters70/1384016
ttactaaaa

SEQ ID NO: 82735 - DNA, 9 bp, Unknown
  misc_feature (1)..( 9): Result.001 file - promoters70/1384016
ttacaaaaa

SEQ ID NO: 82736 - DNA, 9 bp, Unknown
  misc_feature (1)..( 9): Result.001 file - promoters70/1384016
ttactaagg

SEQ ID NO: 82737 - DNA, 9 bp, Unknown
  misc_feature (1)..( 9): Result.001 file - promoters70/1384016
gaactaaac

SEQ ID NO: 82738 - DNA, 9 bp, Unknown
  misc_feature (1)..( 9): Result.001 file - promoters70/1384016
ctacaaata

SEQ ID NO: 82739 - DNA, 9 bp, Unknown
  misc_feature (1)..( 9): Result.001 file - promoters70/1385376
ttataaagt

SEQ ID NO: 82740 - DNA, 9 bp, Unknown
  misc_feature (1)..( 9): Result.001 file - promoters70/1385376
taaaaaatt

SEQ ID NO: 82741 - DNA, 9 bp, Unknown
  misc_feature (1)..( 9): Result.001 file - promoters70/1385376
taaaagatt

SEQ ID NO: 82742 - DNA, 9 bp, Unknown
  misc_feature (1)..( 9): Result.001 file - promoters70/1385376
gataagatt

SEQ ID NO: 82743 - DNA, 7 bp, Unknown
  misc_feature (1)..( 7): Result.001 file - promoters70/1385376
ttggttt

SEQ ID NO: 82744 - DNA, 7 bp, Unknown
  misc_feature (1)..( 7): Result.001 file - promoters70/1385376
ttgattt

SEQ ID NO: 82745 - DNA, 7 bp, Unknown
  misc_feature (1)..( 7): Result.001 file - promoters70/1385376
ttggttg

SEQ ID NO: 82746 - DNA, 9 bp, Unknown
  misc_feature (1)..( 9): Result.001 file - promoters70/1385376
tttgatttt

SEQ ID NO: 82747 - DNA, 9 bp, Unknown
  misc_feature (1)..( 9): Result.001 file - promoters70/1385376
tttggtttt

SEQ ID NO: 82748 - DNA, 9 bp, Unknown
  misc_feature (1)..( 9): Result.001 file - promoters70/1387072
cttggttgg

SEQ ID NO: 82749 - DNA, 9 bp, Unknown
  misc_feature (1)..( 9): Result.001 file - promoters70/1387072
aaacaaaaa

SEQ ID NO: 82750 - DNA, 9 bp, Unknown
  misc_feature (1)..( 9): Result.001 file - promoters70/1387072
aaagaaaca

SEQ ID NO: 82751 - DNA, 9 bp, Unknown
  misc_feature (1)..( 9): Result.001 file - promoters70/1387123
aaagaaaaa

SEQ ID NO: 82752 - DNA, 11 bp, Unknown
  misc_feature (1)..( 11): Result.001 file - promoters70/1387123
tgtttgaccat

SEQ ID NO: 82753 - DNA, 11 bp, Unknown
  misc_feature (1)..( 11): Result.001 file - promoters70/1387123
tatttgaacat

SEQ ID NO: 82754 - DNA, 11 bp, Unknown
  misc_feature (1)..( 11): Result.001 file - promoters70/1387123
tgtgtgagttc

SEQ ID NO: 82755 - DNA, 8 bp, Unknown
  misc_feature (1)..( 8): Result.001 file - promoters70/1387123
taacgaac

SEQ ID NO: 82756 - DNA, 8 bp, Unknown
  misc_feature (1)..( 8): Result.001 file - promoters70/1387123
caacgaaa

SEQ ID NO: 82757 - DNA, 8 bp, Unknown
  misc_feature (1)..( 8): Result.001 file - promoters70/1387349
caactaaa

SEQ ID NO: 82758 - DNA, 13 bp, Unknown
  misc_feature (1)..( 13): Result.001 file - promoters70/1387349
atttccatcgaat

SEQ ID NO: 82759 - DNA, 13 bp, Unknown
  misc_feature (1)..( 13): Result.001 file - promoters70/1387349
aaacaaatcaaat

SEQ ID NO: 82760 - DNA, 13 bp, Unknown
  misc_feature (1)..( 13): Result.001 file - promoters70/1387349
aaagaaaccaatt

SEQ ID NO: 82761 - DNA, 13 bp, Unknown
  misc_feature (1)..( 13): Result.001 file - promoters70/1387349
tatcaaaccaatg

SEQ ID NO: 82762 - DNA, 13 bp, Unknown
  misc_feature (1)..( 13): Result.001 file - promoters70/1387349
tcagaaacagtaa

SEQ ID NO: 82763 - DNA, 13 bp, Unknown
  misc_feature (1)..( 13): Result.001 file - promoters70/1387349
tcacaaagactaa

SEQ ID NO: 82764 - DNA, 10 bp, Unknown
  misc_feature (1)..( 10): Result.001 file - promoters70/1387349
ccacaaaaca

SEQ ID NO: 82765 - DNA, 10 bp, Unknown
  misc_feature (1)..( 10): Result.001 file - promoters70/1387349
acacaaagta

SEQ ID NO: 82766 - DNA, 10 bp, Unknown
  misc_feature (1)..( 10): Result.001 file - promoters70/1387349
tcacaaagac

SEQ ID NO: 82767 - DNA, 10 bp, Unknown
  misc_feature (1)..( 10): Result.001 file - promoters70/1387349
aaacaaaaac

SEQ ID NO: 82768 - DNA, 10 bp, Unknown
  misc_feature (1)..( 10): Result.001 file - promoters70/1387349
ctaaaaactc

SEQ ID NO: 82769 - DNA, 10 bp, Unknown
  misc_feature (1)..( 10): Result.001 file - promoters70/1387349
ctagaaaccg

SEQ ID NO: 82770 - DNA, 9 bp, Unknown
  misc_feature (1)..( 9): Result.001 file - promoters70/1387349
tcatagata

SEQ ID NO: 82771 - DNA, 9 bp, Unknown
  misc_feature (1)..( 9): Result.001 file - promoters70/1387349
tcaaagaat

SEQ ID NO: 82772 - DNA, 9 bp, Unknown
  misc_feature (1)..( 9): Result.001 file - promoters70/1387349
acaaagact

SEQ ID NO: 82773 - DNA, 9 bp, Unknown
  misc_feature (1)..( 9): Result.001 file - promoters70/1387349
tcaaaggtc

SEQ ID NO: 82774 - DNA, 9 bp, Unknown
  misc_feature (1)..( 9): Result.001 file - promoters70/1387349
taaaataat

SEQ ID NO: 82775 - DNA, 9 bp, Unknown
  misc_feature (1)..( 9): Result.001 file - promoters70/1387349
gcaatggtt

SEQ ID NO: 82776 - DNA, 12 bp, Unknown
  misc_feature (1)..( 12): Result.001 file - promoters70/1387349
tatgtaatgaat

SEQ ID NO: 82777 - DNA, 12 bp, Unknown
  misc_feature (1)..( 12): Result.001 file - promoters70/1387349
aatgtactgaaa

SEQ ID NO: 82778 - DNA, 13 bp, Unknown
  misc_feature (1)..( 13): Result.001 file - promoters70/1387349
gaagaaactgaaa

SEQ ID NO: 82779 - DNA, 12 bp, Unknown
  misc_feature (1)..( 12): Result.001 file - promoters70/1387349
aatgtacttatc

SEQ ID NO: 82780 - DNA, 12 bp, Unknown
  misc_feature (1)..( 12): Result.001 file - promoters70/1387349
attaaattgaac

SEQ ID NO: 82781 - DNA, 13 bp, Unknown
  misc_feature (1)..( 13): Result.001 file - promoters70/1387356
tcagaatctgatg

SEQ ID NO: 82782 - DNA, 6 bp, Unknown
  misc_feature (1)..( 6): Result.001 file - promoters70/1387356
ttaaaa

SEQ ID NO: 82783 - DNA, 6 bp, Unknown
  misc_feature (1)..( 6): Result.001 file - promoters70/1387356
ttaaaa

SEQ ID NO: 82784 - DNA, 6 bp, Unknown
  misc_feature (1)..( 6): Result.001 file - promoters70/1387356
ttaaaa

SEQ ID NO: 82785 - DNA, 11 bp, Unknown
  misc_feature (1)..( 11): Result.001 file - promoters70/1387356
catgtaaaaat

SEQ ID NO: 82786 - DNA, 11 bp, Unknown
  misc_feature (1)..( 11): Result.001 file - promoters70/1387356
aaactaagaat

SEQ ID NO: 82787 - DNA, 11 bp, Unknown
  misc_feature (1)..( 11): Result.001 file - promoters70/1387417
agagtaaaaaa

SEQ ID NO: 82788 - DNA, 8 bp, Unknown
  misc_feature (1)..( 8): Result.001 file - promoters70/1387417
ctttactg

SEQ ID NO: 82789 - DNA, 8 bp, Unknown
  misc_feature (1)..( 8): Result.001 file - promoters70/1387417
attttctg

SEQ ID NO: 82790 - DNA, 8 bp, Unknown
  misc_feature (1)..( 8): Result.001 file - promoters70/1387417
attttcaa

SEQ ID NO: 82791 - DNA, 9 bp, Unknown
  misc_feature (1)..( 9): Result.001 file - promoters70/1387417
catgatttc

SEQ ID NO: 82792 - DNA, 9 bp, Unknown
  misc_feature (1)..( 9): Result.001 file - promoters70/1387417
aatgttttc

SEQ ID NO: 82793 - DNA, 9 bp, Unknown
  misc_feature (1)..( 9): Result.001 file - promoters70/1387449
aatgctttg

SEQ ID NO: 82794 - DNA, 11 bp, Unknown
  misc_feature (1)..( 11): Result.001 file - promoters70/1387449
cagattttcag

SEQ ID NO: 82795 - DNA, 11 bp, Unknown
  misc_feature (1)..( 11): Result.001 file - promoters70/1387449
caaattttcac

SEQ ID NO: 82796 - DNA, 11 bp, Unknown
  misc_feature (1)..( 11): Result.001 file - promoters70/1387449
caaaatttcac

SEQ ID NO: 82797 - DNA, 8 bp, Unknown
  misc_feature (1)..( 8): Result.001 file - promoters70/1387449
aattatat

SEQ ID NO: 82798 - DNA, 8 bp, Unknown
  misc_feature (1)..( 8): Result.001 file - promoters70/1387449
aattatat

SEQ ID NO: 82799 - DNA, 8 bp, Unknown
  misc_feature (1)..( 8): Result.001 file - promoters70/1387449
aataataa

SEQ ID NO: 82800 - DNA, 7 bp, Unknown
  misc_feature (1)..( 7): Result.001 file - promoters70/1387449
tggtttt

SEQ ID NO: 82801 - DNA, 7 bp, Unknown
  misc_feature (1)..( 7): Result.001 file - promoters70/1387449
gggtttt

SEQ ID NO: 82802 - DNA, 7 bp, Unknown
  misc_feature (1)..( 7): Result.001 file - promoters70/1387616
tggtttg

SEQ ID NO: 82803 - DNA, 9 bp, Unknown
  misc_feature (1)..( 9): Result.001 file - promoters70/1387616
aataaaatt

SEQ ID NO: 82804 - DNA, 9 bp, Unknown
  misc_feature (1)..( 9): Result.001 file - promoters70/1387616
gataatatt

SEQ ID NO: 82805 - DNA, 9 bp, Unknown
  misc_feature (1)..( 9): Result.001 file - promoters70/1387616
tataaaata

SEQ ID NO: 82806 - DNA, 9 bp, Unknown
  misc_feature (1)..( 9): Result.001 file - promoters70/1387616
aataaatct

SEQ ID NO: 82807 - DNA, 9 bp, Unknown
  misc_feature (1)..( 9): Result.001 file - promoters70/1387616
aatattatt

SEQ ID NO: 82808 - DNA, 14 bp, Unknown
  misc_feature (1)..( 14): Result.001 file - promoters70/1387616
taaataaatttttg

SEQ ID NO: 82809 - DNA, 14 bp, Unknown
  misc_feature (1)..( 14): Result.001 file - promoters70/1387616
caaacaaatgtttg

SEQ ID NO: 82810 - DNA, 14 bp, Unknown
  misc_feature (1)..( 14): Result.001 file - promoters70/1387616
taaaaaaagaagaa

SEQ ID NO: 82811 - DNA, 14 bp, Unknown
  misc_feature (1)..( 14): Result.001 file - promoters70/1387616
gtcataaatgtatc

SEQ ID NO: 82812 - DNA, 14 bp, Unknown
  misc_feature (1)..( 14): Result.001 file - promoters70/1387616
tacatacatatact

SEQ ID NO: 82813 - DNA, 8 bp, Unknown
  misc_feature (1)..( 8): Result.001 file - promoters70/1387616
tttcttta

SEQ ID NO: 82814 - DNA, 8 bp, Unknown
  misc_feature (1)..( 8): Result.001 file - promoters70/1387616
tttgtttc

SEQ ID NO: 82815 - DNA, 8 bp, Unknown
  misc_feature (1)..( 8): Result.001 file - promoters70/1387616
tttttttg

SEQ ID NO: 82816 - DNA, 8 bp, Unknown
  misc_feature (1)..( 8): Result.001 file - promoters70/1387616
aatcttta

SEQ ID NO: 82817 - DNA, 8 bp, Unknown
  misc_feature (1)..( 8): Result.001 file - promoters70/1387671
tctgtttc

SEQ ID NO: 82818 - DNA, 13 bp, Unknown
  misc_feature (1)..( 13): Result.001 file - promoters70/1387671
ggttgattgatag

SEQ ID NO: 82819 - DNA, 13 bp, Unknown
  misc_feature (1)..( 13): Result.001 file - promoters70/1387671
atgtctttgttag

SEQ ID NO: 82820 - DNA, 13 bp, Unknown
  misc_feature (1)..( 13): Result.001 file - promoters70/1387671
ttctttttgttct

SEQ ID NO: 82821 - DNA, 13 bp, Unknown
  misc_feature (1)..( 13): Result.001 file - promoters70/1387671
tgaattttgtttt

SEQ ID NO: 82822 - DNA, 13 bp, Unknown
  misc_feature (1)..( 13): Result.001 file - promoters70/1387671
acctttttgtgca

SEQ ID NO: 82823 - DNA, 13 bp, Unknown
  misc_feature (1)..( 13): Result.001 file - promoters70/1387671
ttgtgtttgatta

SEQ ID NO: 82824 - DNA, 13 bp, Unknown
  misc_feature (1)..( 13): Result.001 file - promoters70/1387671
aatgaattctttc

SEQ ID NO: 82825 - DNA, 13 bp, Unknown
  misc_feature (1)..( 13): Result.001 file - promoters70/1387671
catcaatgcttat

SEQ ID NO: 82826 - DNA, 13 bp, Unknown
  misc_feature (1)..( 13): Result.001 file - promoters70/1387671
cattaatccttgt

SEQ ID NO: 82827 - DNA, 13 bp, Unknown
  misc_feature (1)..( 13): Result.001 file - promoters70/1387671
attccatccttat

SEQ ID NO: 82828 - DNA, 13 bp, Unknown
  misc_feature (1)..( 13): Result.001 file - promoters70/1387671
atataataattaa

SEQ ID NO: 82829 - DNA, 13 bp, Unknown
  misc_feature (1)..( 13): Result.001 file - promoters70/1387671
aatatatgcttgc

SEQ ID NO: 82830 - DNA, 13 bp, Unknown
  misc_feature (1)..( 13): Result.001 file - promoters70/1387671
aaacaatgaaagg

SEQ ID NO: 82831 - DNA, 13 bp, Unknown
  misc_feature (1)..( 13): Result.001 file - promoters70/1387671
tctcgtataattc

SEQ ID NO: 82832 - DNA, 13 bp, Unknown
  misc_feature (1)..( 13): Result.001 file - promoters70/1387671
actcttatgattt

SEQ ID NO: 82833 - DNA, 13 bp, Unknown
  misc_feature (1)..( 13): Result.001 file - promoters70/1387671
tttcgtttaacag

SEQ ID NO: 82834 - DNA, 13 bp, Unknown
  misc_feature (1)..( 13): Result.001 file - promoters70/1387671
tcaaaactgattt

SEQ ID NO: 82835 - DNA, 13 bp, Unknown
  misc_feature (1)..( 13): Result.001 file - promoters70/1387671
actcttaaaattg

SEQ ID NO: 82836 - DNA, 13 bp, Unknown
  misc_feature (1)..( 13): Result.001 file - promoters70/1387671
gttcttaggattc

SEQ ID NO: 82837 - DNA, 13 bp, Unknown
  misc_feature (1)..( 13): Result.001 file - promoters70/1387671
aaaaaaaaggaaa

SEQ ID NO: 82838 - DNA, 13 bp, Unknown
  misc_feature (1)..( 13): Result.001 file - promoters70/1387671
tcaaaaaaatatt

SEQ ID NO: 82839 - DNA, 13 bp, Unknown
  misc_feature (1)..( 13): Result.001 file - promoters70/1387671
ataaaaaaatata

SEQ ID NO: 82840 - DNA, 13 bp, Unknown
  misc_feature (1)..( 13): Result.001 file - promoters70/1387671
ataaaaaattacg

SEQ ID NO: 82841 - DNA, 13 bp, Unknown
  misc_feature (1)..( 13): Result.001 file - promoters70/1387671
tcaaaaagcaaaa

SEQ ID NO: 82842 - DNA, 13 bp, Unknown
  misc_feature (1)..( 13): Result.001 file - promoters70/1387671
tgaaatatttttt

SEQ ID NO: 82843 - DNA, 13 bp, Unknown
  misc_feature (1)..( 13): Result.001 file - promoters70/1387671
ataaaaacagtga

SEQ ID NO: 82844 - DNA, 14 bp, Unknown
  misc_feature (1)..( 14): Result.001 file - promoters70/1387671
gtaagaaaaaaaaa

SEQ ID NO: 82845 - DNA, 14 bp, Unknown
  misc_feature (1)..( 14): Result.001 file - promoters70/1387671
tctataaaaaatat

SEQ ID NO: 82846 - DNA, 14 bp, Unknown
  misc_feature (1)..( 14): Result.001 file - promoters70/1387671
cccataaaaaatta

SEQ ID NO: 82847 - DNA, 14 bp, Unknown
  misc_feature (1)..( 14): Result.001 file - promoters70/1387671
agaataaaaacagt

SEQ ID NO: 82848 - DNA, 14 bp, Unknown
  misc_feature (1)..( 14): Result.001 file - promoters70/1387671
caaacaaaacatat

SEQ ID NO: 82849 - DNA, 14 bp, Unknown
  misc_feature (1)..( 14): Result.001 file - promoters70/1387906
atgatgaaatattt

SEQ ID NO: 82850 - DNA, 10 bp, Unknown
  misc_feature (1)..( 10): Result.001 file - promoters70/1387906
tttgaaggtt

SEQ ID NO: 82851 - DNA, 10 bp, Unknown
  misc_feature (1)..( 10): Result.001 file - promoters70/1387906
gaggaaggtg

SEQ ID NO: 82852 - DNA, 10 bp, Unknown
  misc_feature (1)..( 10): Result.001 file - promoters70/1387906
ttttaaggtt

SEQ ID NO: 82853 - DNA, 7 bp, Unknown
  misc_feature (1)..( 7): Result.001 file - promoters70/1387906
gaaaata

SEQ ID NO: 82854 - DNA, 7 bp, Unknown
  misc_feature (1)..( 7): Result.001 file - promoters70/1387906
gaaaatg

SEQ ID NO: 82855 - DNA, 7 bp, Unknown
  misc_feature (1)..( 7): Result.001 file - promoters70/1387906
taaaata

SEQ ID NO: 82856 - DNA, 11 bp, Unknown
  misc_feature (1)..( 11): Result.001 file - promoters70/1387906
atataacaaca

SEQ ID NO: 82857 - DNA, 11 bp, Unknown
  misc_feature (1)..( 11): Result.001 file - promoters70/1387906
ttttaataaca

SEQ ID NO: 82858 - DNA, 11 bp, Unknown
  misc_feature (1)..( 11): Result.001 file - promoters70/1387906
ttttactaact

SEQ ID NO: 82859 - DNA, 10 bp, Unknown
  misc_feature (1)..( 10): Result.001 file - promoters70/1387906
taaatttgtt

SEQ ID NO: 82860 - DNA, 10 bp, Unknown
  misc_feature (1)..( 10): Result.001 file - promoters70/1387906
aaaatctgtt

SEQ ID NO: 82861 - DNA, 10 bp, Unknown
  misc_feature (1)..( 10): Result.001 file - promoters70/1387906
aaaatcgaac

SEQ ID NO: 82862 - DNA, 9 bp, Unknown
  misc_feature (1)..( 9): Result.001 file - promoters70/1387906
ctttataat

SEQ ID NO: 82863 - DNA, 9 bp, Unknown
  misc_feature (1)..( 9): Result.001 file - promoters70/1387906
cattaaaat

SEQ ID NO: 82864 - DNA, 10 bp, Unknown
  misc_feature (1)..( 10): Result.001 file - promoters70/1388009
acttcataga

SEQ ID NO: 82865 - DNA, 11 bp, Unknown
  misc_feature (1)..( 11): Result.001 file - promoters70/1388009
tatgaaaatat

SEQ ID NO: 82866 - DNA, 11 bp, Unknown
  misc_feature (1)..( 11): Result.001 file - promoters70/1388009
tattaaagtat

SEQ ID NO: 82867 - DNA, 11 bp, Unknown
  misc_feature (1)..( 11): Result.001 file - promoters70/1388009
tattaaattat

SEQ ID NO: 82868 - DNA, 7 bp, Unknown
  misc_feature (1)..( 7): Result.001 file - promoters70/1388009
atatttt

SEQ ID NO: 82869 - DNA, 7 bp, Unknown
  misc_feature (1)..( 7): Result.001 file - promoters70/1388009
atatttt

SEQ ID NO: 82870 - DNA, 7 bp, Unknown
  misc_feature (1)..( 7): Result.001 file - promoters70/1388009
atatttt

SEQ ID NO: 82871 - DNA, 7 bp, Unknown
  misc_feature (1)..( 7): Result.001 file - promoters70/1388009
tttttac

SEQ ID NO: 82872 - DNA, 7 bp, Unknown
  misc_feature (1)..( 7): Result.001 file - promoters70/1388009
attttac

SEQ ID NO: 82873 - DNA, 7 bp, Unknown
  misc_feature (1)..( 7): Result.001 file - promoters70/1388009
attttag

SEQ ID NO: 82874 - DNA, 10 bp, Unknown
  misc_feature (1)..( 10): Result.001 file - promoters70/1388009
cgaaatcata

SEQ ID NO: 82875 - DNA, 10 bp, Unknown
  misc_feature (1)..( 10): Result.001 file - promoters70/1388009
acaaataata

SEQ ID NO: 82876 - DNA, 10 bp, Unknown
  misc_feature (1)..( 10): Result.001 file - promoters70/1388009
cgaattcaaa

SEQ ID NO: 82877 - DNA, 7 bp, Unknown
  misc_feature (1)..( 7): Result.001 file - promoters70/1388009
ctatatg

SEQ ID NO: 82878 - DNA, 7 bp, Unknown
  misc_feature (1)..( 7): Result.001 file - promoters70/1388009
ctatata

SEQ ID NO: 82879 - DNA, 7 bp, Unknown
  misc_feature (1)..( 7): Result.001 file - promoters70/1388009
ttatatg

SEQ ID NO: 82880 - DNA, 9 bp, Unknown
  misc_feature (1)..( 9): Result.001 file - promoters70/1388009
acattataa

SEQ ID NO: 82881 - DNA, 9 bp, Unknown
  misc_feature (1)..( 9): Result.001 file - promoters70/1388009
aaattataa

SEQ ID NO: 82882 - DNA, 9 bp, Unknown
  misc_feature (1)..( 9): Result.001 file - promoters70/1389279
aaattatta

SEQ ID NO: 82883 - DNA, 7 bp, Unknown
  misc_feature (1)..( 7): Result.001 file - promoters70/1389279
caatgta

SEQ ID NO: 82884 - DNA, 7 bp, Unknown
  misc_feature (1)..( 7): Result.001 file - promoters70/1389279
caatgtt

SEQ ID NO: 82885 - DNA, 7 bp, Unknown
  misc_feature (1)..( 7): Result.001 file - promoters70/1389279
gaatgtt

SEQ ID NO: 82886 - DNA, 7 bp, Unknown
  misc_feature (1)..( 7): Result.001 file - promoters70/1389279
ggaaaaa

SEQ ID NO: 82887 - DNA, 7 bp, Unknown
  misc_feature (1)..( 7): Result.001 file - promoters70/1389279
agaaaaa

SEQ ID NO: 82888 - DNA, 8 bp, Unknown
  misc_feature (1)..( 8): Result.001 file - promoters70/1389279
agacaaaa

SEQ ID NO: 82889 - DNA, 7 bp, Unknown
  misc_feature (1)..( 7): Result.001 file - promoters70/1389279
acaaaaa

SEQ ID NO: 82890 - DNA, 7 bp, Unknown
  misc_feature (1)..( 7): Result.001 file - promoters70/1389279
acaaaaa

SEQ ID NO: 82891 - DNA, 7 bp, Unknown
  misc_feature (1)..( 7): Result.001 file - promoters70/1389279
gcaaaaa

SEQ ID NO: 82892 - DNA, 8 bp, Unknown
  misc_feature (1)..( 8): Result.001 file - promoters70/1389279
tatatata

SEQ ID NO: 82893 - DNA, 8 bp, Unknown
  misc_feature (1)..( 8): Result.001 file - promoters70/1389279
tatatata

SEQ ID NO: 82894 - DNA, 8 bp, Unknown
  misc_feature (1)..( 8): Result.001 file - promoters70/1389279
tatatata

SEQ ID NO: 82895 - DNA, 9 bp, Unknown
  misc_feature (1)..( 9): Result.001 file - promoters70/1389279
aatacaagt

SEQ ID NO: 82896 - DNA, 9 bp, Unknown
  misc_feature (1)..( 9): Result.001 file - promoters70/1389279
aaaacaagt

SEQ ID NO: 82897 - DNA, 9 bp, Unknown
  misc_feature (1)..( 9): Result.001 file - promoters70/1390146
aaaataagc

SEQ ID NO: 82898 - DNA, 9 bp, Unknown
  misc_feature (1)..( 9): Result.001 file - promoters70/1390146
aatttcaac

SEQ ID NO: 82899 - DNA, 9 bp, Unknown
  misc_feature (1)..( 9): Result.001 file - promoters70/1390146
aatttgaac

SEQ ID NO: 82900 - DNA, 9 bp, Unknown
  misc_feature (1)..( 9): Result.001 file - promoters70/1390146
aatgtgaaa

SEQ ID NO: 82901 - DNA, 9 bp, Unknown
  misc_feature (1)..( 9): Result.001 file - promoters70/1390240
aatatgatt

SEQ ID NO: 82902 - DNA, 11 bp, Unknown
  misc_feature (1)..( 11): Result.001 file - promoters70/1390240
caataatttac

SEQ ID NO: 82903 - DNA, 11 bp, Unknown
  misc_feature (1)..( 11): Result.001 file - promoters70/1390240
aaatcatttgt

SEQ ID NO: 82904 - DNA, 12 bp, Unknown
  misc_feature (1)..( 12): Result.001 file - promoters70/1390240
tgtataatttta

SEQ ID NO: 82905 - DNA, 11 bp, Unknown
  misc_feature (1)..( 11): Result.001 file - promoters70/1390240
aaatcattttt

SEQ ID NO: 82906 - DNA, 12 bp, Unknown
  misc_feature (1)..( 12): Result.001 file - promoters70/1390240
tctctcaattgc

SEQ ID NO: 82907 - DNA, 12 bp, Unknown
  misc_feature (1)..( 12): Result.001 file - promoters70/1390240
gaagtcatattc

SEQ ID NO: 82908 - DNA, 12 bp, Unknown
  misc_feature (1)..( 12): Result.001 file - promoters70/1391420
tcgtccattttt

SEQ ID NO: 82909 - DNA, 7 bp, Unknown
  misc_feature (1)..( 7): Result.001 file - promoters70/1391420
agatttt

SEQ ID NO: 82910 - DNA, 7 bp, Unknown
  misc_feature (1)..( 7): Result.001 file - promoters70/1391420
agatttg

SEQ ID NO: 82911 - DNA, 7 bp, Unknown
  misc_feature (1)..( 7): Result.001 file - promoters70/1393104
agatttt

SEQ ID NO: 82912 - DNA, 7 bp, Unknown
  misc_feature (1)..( 7): Result.001 file - promoters70/1393104
atgtggt

SEQ ID NO: 82913 - DNA, 7 bp, Unknown
  misc_feature (1)..( 7): Result.001 file - promoters70/1393104
atgtgga

SEQ ID NO: 82914 - DNA, 7 bp, Unknown
  misc_feature (1)..( 7): Result.001 file - promoters70/1393139
atgagga

SEQ ID NO: 82915 - DNA, 8 bp, Unknown
  misc_feature (1)..( 8): Result.001 file - promoters70/1393139
tagattac

SEQ ID NO: 82916 - DNA, 8 bp, Unknown
  misc_feature (1)..( 8): Result.001 file - promoters70/1393139
tagatttg

SEQ ID NO: 82917 - DNA, 8 bp, Unknown
  misc_feature (1)..( 8): Result.001 file - promoters70/1393139
aagatttg

SEQ ID NO: 82918 - DNA, 7 bp, Unknown
  misc_feature (1)..( 7): Result.001 file - promoters70/1393139
cttcatt

SEQ ID NO: 82919 - DNA, 7 bp, Unknown
  misc_feature (1)..( 7): Result.001 file - promoters70/1393139
cttcatc

SEQ ID NO: 82920 - DNA, 7 bp, Unknown
  misc_feature (1)..( 7): Result.001 file - promoters70/1393139
ctttatt

SEQ ID NO: 82921 - DNA, 13 bp, Unknown
  misc_feature (1)..( 13): Result.001 file - promoters70/1393139
tctacttttggta

SEQ ID NO: 82922 - DNA, 13 bp, Unknown
  misc_feature (1)..( 13): Result.001 file - promoters70/1393139
tcttcttttgtca

SEQ ID NO: 82923 - DNA, 13 bp, Unknown
  misc_feature (1)..( 13): Result.001 file - promoters70/1393139
ttaactttttagt

SEQ ID NO: 82924 - DNA, 13 bp, Unknown
  misc_feature (1)..( 13): Result.001 file - promoters70/1393139
ataacttttgagt

SEQ ID NO: 82925 - DNA, 10 bp, Unknown
  misc_feature (1)..( 10): Result.001 file - promoters70/1393139
gatacaatac

SEQ ID NO: 82926 - DNA, 10 bp, Unknown
  misc_feature (1)..( 10): Result.001 file - promoters70/1393139
aataaaatac

SEQ ID NO: 82927 - DNA, 10 bp, Unknown
  misc_feature (1)..( 10): Result.001 file - promoters70/1393139
aataaaagcc

SEQ ID NO: 82928 - DNA, 10 bp, Unknown
  misc_feature (1)..( 10): Result.001 file - promoters70/1393139
aatacaagtt

SEQ ID NO: 82929 - DNA, 11 bp, Unknown
  misc_feature (1)..( 11): Result.001 file - promoters70/1393139
taccaaaagta

SEQ ID NO: 82930 - DNA, 11 bp, Unknown
  misc_feature (1)..( 11): Result.001 file - promoters70/1393139
tacgaaatcat

SEQ ID NO: 82931 - DNA, 11 bp, Unknown
  misc_feature (1)..( 11): Result.001 file - promoters70/1393139
agccaacagta

SEQ ID NO: 82932 - DNA, 11 bp, Unknown
  misc_feature (1)..( 11): Result.001 file - promoters70/1393139
acgcgtctaca

SEQ ID NO: 82933 - DNA, 11 bp, Unknown
  misc_feature (1)..( 11): Result.001 file - promoters70/1393139
acgtgtctaga

SEQ ID NO: 82934 - DNA, 11 bp, Unknown
  misc_feature (1)..( 11): Result.001 file - promoters70/1393139
atgagtcaaga

SEQ ID NO: 82935 - DNA, 7 bp, Unknown
  misc_feature (1)..( 7): Result.001 file - promoters70/1393139
ccgaaaa

SEQ ID NO: 82936 - DNA, 7 bp, Unknown
  misc_feature (1)..( 7): Result.001 file - promoters70/1393139
acgaaaa

SEQ ID NO: 82937 - DNA, 7 bp, Unknown
  misc_feature (1)..( 7): Result.001 file - promoters70/1393326
acgaaat

SEQ ID NO: 82938 - DNA, 9 bp, Unknown
  misc_feature (1)..( 9): Result.001 file - promoters70/1393326
ctttatttg

SEQ ID NO: 82939 - DNA, 9 bp, Unknown
  misc_feature (1)..( 9): Result.001 file - promoters70/1393326
atttgtttg

SEQ ID NO: 82940 - DNA, 9 bp, Unknown
  misc_feature (1)..( 9): Result.001 file - promoters70/1393326
atttgttag

SEQ ID NO: 82941 - DNA, 10 bp, Unknown
  misc_feature (1)..( 10): Result.001 file - promoters70/1393326
aaataaagtt

SEQ ID NO: 82942 - DNA, 10 bp, Unknown
  misc_feature (1)..( 10): Result.001 file - promoters70/1393326
gcttaaagtg

SEQ ID NO: 82943 - DNA, 10 bp, Unknown
  misc_feature (1)..( 10): Result.001 file - promoters70/1393326
aaataaggtt

SEQ ID NO: 82944 - DNA, 7 bp, Unknown
  misc_feature (1)..( 7): Result.001 file - promoters70/1393326
cagaaaa

SEQ ID NO: 82945 - DNA, 7 bp, Unknown
  misc_feature (1)..( 7): Result.001 file - promoters70/1393326
aagaaaa

SEQ ID NO: 82946 - DNA, 7 bp, Unknown
  misc_feature (1)..( 7): Result.001 file - promoters70/1393492
aagaaac

SEQ ID NO: 82947 - DNA, 11 bp, Unknown
  misc_feature (1)..( 11): Result.001 file - promoters70/1393492
tttaataccct

SEQ ID NO: 82948 - DNA, 11 bp, Unknown
  misc_feature (1)..( 11): Result.001 file - promoters70/1393492
tttcataacaa

SEQ ID NO: 82949 - DNA, 11 bp, Unknown
  misc_feature (1)..( 11): Result.001 file - promoters70/1393787
gttaatagcct

SEQ ID NO: 82950 - DNA, 13 bp, Unknown
  misc_feature (1)..( 13): Result.001 file - promoters70/1393787
cctttaggtctct

SEQ ID NO: 82951 - DNA, 13 bp, Unknown
  misc_feature (1)..( 13): Result.001 file - promoters70/1393787
gattaatgtctct

SEQ ID NO: 82952 - DNA, 13 bp, Unknown
  misc_feature (1)..( 13): Result.001 file - promoters70/1393787
aagttagttctct

SEQ ID NO: 82953 - DNA, 13 bp, Unknown
  misc_feature (1)..( 13): Result.001 file - promoters70/1393787
gattaatttctct

SEQ ID NO: 82954 - DNA, 9 bp, Unknown
  misc_feature (1)..( 9): Result.001 file - promoters70/1393787
ataaaaatt

SEQ ID NO: 82955 - DNA, 9 bp, Unknown
  misc_feature (1)..( 9): Result.001 file - promoters70/1393787
ataaaaatt

SEQ ID NO: 82956 - DNA, 9 bp, Unknown
  misc_feature (1)..( 9): Result.001 file - promoters70/1393787
ttaaaaaat

SEQ ID NO: 82957 - DNA, 10 bp, Unknown
  misc_feature (1)..( 10): Result.001 file - promoters70/1393787
tcaaataatg

SEQ ID NO: 82958 - DNA, 12 bp, Unknown
  misc_feature (1)..( 12): Result.001 file - promoters70/1393787
acacaattagtt

SEQ ID NO: 82959 - DNA, 12 bp, Unknown
  misc_feature (1)..( 12): Result.001 file - promoters70/1393787
aagaaattcgtt

SEQ ID NO: 82960 - DNA, 13 bp, Unknown
  misc_feature (1)..( 13): Result.001 file - promoters70/1393787
caagaacttccat

SEQ ID NO: 82961 - DNA, 13 bp, Unknown
  misc_feature (1)..( 13): Result.001 file - promoters70/1393787
ttcaaaattctct

SEQ ID NO: 82962 - DNA, 10 bp, Unknown
  misc_feature (1)..( 10): Result.001 file - promoters70/1393787
ttatgttttt

SEQ ID NO: 82963 - DNA, 10 bp, Unknown
  misc_feature (1)..( 10): Result.001 file - promoters70/1393787
ccatgttttt

SEQ ID NO: 82964 - DNA, 10 bp, Unknown
  misc_feature (1)..( 10): Result.001 file - promoters70/1393787
ttatgttatg

SEQ ID NO: 82965 - DNA, 10 bp, Unknown
  misc_feature (1)..( 10): Result.001 file - promoters70/1393787
ctatgctttg

SEQ ID NO: 82966 - DNA, 11 bp, Unknown
  misc_feature (1)..( 11): Result.001 file - promoters70/1393787
attttttttaa

SEQ ID NO: 82967 - DNA, 11 bp, Unknown
  misc_feature (1)..( 11): Result.001 file - promoters70/1393787
cattttcttat

SEQ ID NO: 82968 - DNA, 11 bp, Unknown
  misc_feature (1)..( 11): Result.001 file - promoters70/1393787
cccatttataa

SEQ ID NO: 82969 - DNA, 11 bp, Unknown
  misc_feature (1)..( 11): Result.001 file - promoters70/1393787
cattttcaagt

SEQ ID NO: 82970 - DNA, 11 bp, Unknown
  misc_feature (1)..( 11): Result.001 file - promoters70/1393787
taattatttgt

SEQ ID NO: 82971 - DNA, 11 bp, Unknown
  misc_feature (1)..( 11): Result.001 file - promoters70/1393787
taatcattttc

SEQ ID NO: 82972 - DNA, 11 bp, Unknown
  misc_feature (1)..( 11): Result.001 file - promoters70/1393787
tctccattttc

SEQ ID NO: 82973 - DNA, 11 bp, Unknown
  misc_feature (1)..( 11): Result.001 file - promoters70/1393805
ggcccatttat

SEQ ID NO: 82974 - DNA, 14 bp, Unknown
  misc_feature (1)..( 14): Result.001 file - promoters70/1393805
atagttaagtccaa

SEQ ID NO: 82975 - DNA, 14 bp, Unknown
  misc_feature (1)..( 14): Result.001 file - promoters70/1393805
ataattaaactcta

SEQ ID NO: 82976 - DNA, 14 bp, Unknown
  misc_feature (1)..( 14): Result.001 file - promoters70/1393805
cgggttacgtcatc

SEQ ID NO: 82977 - DNA, 14 bp, Unknown
  misc_feature (1)..( 14): Result.001 file - promoters70/1393805
ccatccacgacatc

SEQ ID NO: 82978 - DNA, 14 bp, Unknown
  misc_feature (1)..( 14): Result.001 file - promoters70/1393805
gtaataaaaaactc

SEQ ID NO: 82979 - DNA, 14 bp, Unknown
  misc_feature (1)..( 14): Result.001 file - promoters70/1393805
aaaattaaatcatc

SEQ ID NO: 82980 - DNA, 9 bp, Unknown
  misc_feature (1)..( 9): Result.001 file - promoters70/1393805
ttaattctt

SEQ ID NO: 82981 - DNA, 9 bp, Unknown
  misc_feature (1)..( 9): Result.001 file - promoters70/1393805
ttacttcaa

SEQ ID NO: 82982 - DNA, 9 bp, Unknown
  misc_feature (1)..( 9): Result.001 file - promoters70/1393805
ttactttat

SEQ ID NO: 82983 - DNA, 9 bp, Unknown
  misc_feature (1)..( 9): Result.001 file - promoters70/1393805
aaacttcac

SEQ ID NO: 82984 - DNA, 9 bp, Unknown
  misc_feature (1)..( 9): Result.001 file - promoters70/1393805
attcttcac

SEQ ID NO: 82985 - DNA, 9 bp, Unknown
  misc_feature (1)..( 9): Result.001 file - promoters70/1394480
tatctccac

SEQ ID NO: 82986 - DNA, 9 bp, Unknown
  misc_feature (1)..( 9): Result.001 file - promoters70/1394480
aaactttaa

SEQ ID NO: 82987 - DNA, 9 bp, Unknown
  misc_feature (1)..( 9): Result.001 file - promoters70/1394480
aaaatttct

SEQ ID NO: 82988 - DNA, 9 bp, Unknown
  misc_feature (1)..( 9): Result.001 file - promoters70/1394480
aaaatctct

SEQ ID NO: 82989 - DNA, 8 bp, Unknown
  misc_feature (1)..( 8): Result.001 file - promoters70/1394480
tttgaaac

SEQ ID NO: 82990 - DNA, 8 bp, Unknown
  misc_feature (1)..( 8): Result.001 file - promoters70/1394480
tgtgaaac

SEQ ID NO: 82991 - DNA, 8 bp, Unknown
  misc_feature (1)..( 8): Result.001 file - promoters70/1394480
tgtgaaaa

SEQ ID NO: 82992 - DNA, 9 bp, Unknown
  misc_feature (1)..( 9): Result.001 file - promoters70/1394480
gatatttct

SEQ ID NO: 82993 - DNA, 9 bp, Unknown
  misc_feature (1)..( 9): Result.001 file - promoters70/1394480
aaaatttct

SEQ ID NO: 82994 - DNA, 9 bp, Unknown
  misc_feature (1)..( 9): Result.001 file - promoters70/1394480
aaaatctct

SEQ ID NO: 82995 - DNA, 9 bp, Unknown
  misc_feature (1)..( 9): Result.001 file - promoters70/1394480
tttcaaaat

SEQ ID NO: 82996 - DNA, 9 bp, Unknown
  misc_feature (1)..( 9): Result.001 file - promoters70/1394480
tatcaaaat

SEQ ID NO: 82997 - DNA, 9 bp, Unknown
  misc_feature (1)..( 9): Result.001 file - promoters70/1394510
ttttaaaat

SEQ ID NO: 82998 - DNA, 11 bp, Unknown
  misc_feature (1)..( 11): Result.001 file - promoters70/1394510
taacatttttt

SEQ ID NO: 82999 - DNA, 11 bp, Unknown
  misc_feature (1)..( 11): Result.001 file - promoters70/1394510
taagatttttg

SEQ ID NO: 83000 - DNA, 11 bp, Unknown
  misc_feature (1)..( 11): Result.001 file - promoters70/1394510
tagaatttttt

SEQ ID NO: 83001 - DNA, 9 bp, Unknown
  misc_feature (1)..( 9): Result.001 file - promoters70/1394510
tttaatcag

SEQ ID NO: 83002 - DNA, 9 bp, Unknown
  misc_feature (1)..( 9): Result.001 file - promoters70/1394510
tttattcag

SEQ ID NO: 83003 - DNA, 9 bp, Unknown
  misc_feature (1)..( 9): Result.001 file - promoters70/1394592
gttattcga

SEQ ID NO: 83004 - DNA, 9 bp, Unknown
  misc_feature (1)..( 9): Result.001 file - promoters70/1394592
ataattata

SEQ ID NO: 83005 - DNA, 9 bp, Unknown
  misc_feature (1)..( 9): Result.001 file - promoters70/1394592
ccaatcata

SEQ ID NO: 83006 - DNA, 9 bp, Unknown
  misc_feature (1)..( 9): Result.001 file - promoters70/1395095
atatttaat

SEQ ID NO: 83007 - DNA, 9 bp, Unknown
  misc_feature (1)..( 9): Result.001 file - promoters70/1395095
aaaataaga

SEQ ID NO: 83008 - DNA, 9 bp, Unknown
  misc_feature (1)..( 9): Result.001 file - promoters70/1395095
aaaataatc

SEQ ID NO: 83009 - DNA, 9 bp, Unknown
  misc_feature (1)..( 9): Result.001 file - promoters70/1395095
aaaatgatc

SEQ ID NO: 83010 - DNA, 7 bp, Unknown
  misc_feature (1)..( 7): Result.001 file - promoters70/1395095
catagat

SEQ ID NO: 83011 - DNA, 7 bp, Unknown
  misc_feature (1)..( 7): Result.001 file - promoters70/1395095
aatagat

SEQ ID NO: 83012 - DNA, 7 bp, Unknown
  misc_feature (1)..( 7): Result.001 file - promoters70/1395095
aatcgat

SEQ ID NO: 83013 - DNA, 8 bp, Unknown
  misc_feature (1)..( 8): Result.001 file - promoters70/1395095
tttatttc

SEQ ID NO: 83014 - DNA, 8 bp, Unknown
  misc_feature (1)..( 8): Result.001 file - promoters70/1395095
tttctttc

SEQ ID NO: 83015 - DNA, 8 bp, Unknown
  misc_feature (1)..( 8): Result.001 file - promoters70/1395095
tttgtttt

SEQ ID NO: 83016 - DNA, 8 bp, Unknown
  misc_feature (1)..( 8): Result.001 file - promoters70/1395095
aaaaaaag

SEQ ID NO: 83017 - DNA, 8 bp, Unknown
  misc_feature (1)..( 8): Result.001 file - promoters70/1395095
caaagaag

SEQ ID NO: 83018 - DNA, 8 bp, Unknown
  misc_feature (1)..( 8): Result.001 file - promoters70/1395095
gaaaaaaa

SEQ ID NO: 83019 - DNA, 11 bp, Unknown
  misc_feature (1)..( 11): Result.001 file - promoters70/1395095
caacttttttt

SEQ ID NO: 83020 - DNA, 11 bp, Unknown
  misc_feature (1)..( 11): Result.001 file - promoters70/1395095
caaattttttt

SEQ ID NO: 83021 - DNA, 11 bp, Unknown
  misc_feature (1)..( 11): Result.001 file - promoters70/1395095
tacatttttta

SEQ ID NO: 83022 - DNA, 8 bp, Unknown
  misc_feature (1)..( 8): Result.001 file - promoters70/1395095
caagtctt

SEQ ID NO: 83023 - DNA, 8 bp, Unknown
  misc_feature (1)..( 8): Result.001 file - promoters70/1395095
aaagtctt

SEQ ID NO: 83024 - DNA, 8 bp, Unknown
  misc_feature (1)..( 8): Result.001 file - promoters70/1395095
aaattctg

SEQ ID NO: 83025 - DNA, 8 bp, Unknown
  misc_feature (1)..( 8): Result.001 file - promoters70/1395095
catatttt

SEQ ID NO: 83026 - DNA, 8 bp, Unknown
  misc_feature (1)..( 8): Result.001 file - promoters70/1395095
catttttt

SEQ ID NO: 83027 - DNA, 8 bp, Unknown
  misc_feature (1)..( 8): Result.001 file - promoters70/1395095
aatttttt

SEQ ID NO: 83028 - DNA, 8 bp, Unknown
  misc_feature (1)..( 8): Result.001 file - promoters70/1395095
aaaattca

SEQ ID NO: 83029 - DNA, 8 bp, Unknown
  misc_feature (1)..( 8): Result.001 file - promoters70/1395095
aaaattct

SEQ ID NO: 83030 - DNA, 8 bp, Unknown
  misc_feature (1)..( 8): Result.001 file - promoters70/1395095
taaagtct

SEQ ID NO: 83031 - DNA, 8 bp, Unknown
  misc_feature (1)..( 8): Result.001 file - promoters70/1395095
tataaatt

SEQ ID NO: 83032 - DNA, 8 bp, Unknown
  misc_feature (1)..( 8): Result.001 file - promoters70/1395095
tataaacc

SEQ ID NO: 83033 - DNA, 8 bp, Unknown
  misc_feature (1)..( 8): Result.001 file - promoters70/1395636
aataaaaa

SEQ ID NO: 83034 - DNA, 7 bp, Unknown
  misc_feature (1)..( 7): Result.001 file - promoters70/1395636
caatatt

SEQ ID NO: 83035 - DNA, 7 bp, Unknown
  misc_feature (1)..( 7): Result.001 file - promoters70/1395636
caaaatt

SEQ ID NO: 83036 - DNA, 7 bp, Unknown
  misc_feature (1)..( 7): Result.001 file - promoters70/1395636
caatata

SEQ ID NO: 83037 - DNA, 7 bp, Unknown
  misc_feature (1)..( 7): Result.001 file - promoters70/1395636
tttttac

SEQ ID NO: 83038 - DNA, 7 bp, Unknown
  misc_feature (1)..( 7): Result.001 file - promoters70/1395636
gttttac

SEQ ID NO: 83039 - DNA, 7 bp, Unknown
  misc_feature (1)..( 7): Result.001 file - promoters70/1395636
tttttat

SEQ ID NO: 83040 - DNA, 12 bp, Unknown
  misc_feature (1)..( 12): Result.001 file - promoters70/1395636
aaaggaaagaat

SEQ ID NO: 83041 - DNA, 12 bp, Unknown
  misc_feature (1)..( 12): Result.001 file - promoters70/1395636
acaggaaaatgg

SEQ ID NO: 83042 - DNA, 12 bp, Unknown
  misc_feature (1)..( 12): Result.001 file - promoters70/1395636
aaagcaaacaat

SEQ ID NO: 83043 - DNA, 9 bp, Unknown
  misc_feature (1)..( 9): Result.001 file - promoters70/1395636
tataaattg

SEQ ID NO: 83044 - DNA, 9 bp, Unknown
  misc_feature (1)..( 9): Result.001 file - promoters70/1395636
tataaattg

SEQ ID NO: 83045 - DNA, 9 bp, Unknown
  misc_feature (1)..( 9): Result.001 file - promoters70/1395636
tataaataa

SEQ ID NO: 83046 - DNA, 7 bp, Unknown
  misc_feature (1)..( 7): Result.001 file - promoters70/1395636
attgttt

SEQ ID NO: 83047 - DNA, 7 bp, Unknown
  misc_feature (1)..( 7): Result.001 file - promoters70/1395636
tttgttt

SEQ ID NO: 83048 - DNA, 7 bp, Unknown
  misc_feature (1)..( 7): Result.001 file - promoters70/1395824
tttattt

SEQ ID NO: 83049 - DNA, 10 bp, Unknown
  misc_feature (1)..( 10): Result.001 file - promoters70/1395824
ttcaaatata

SEQ ID NO: 83050 - DNA, 10 bp, Unknown
  misc_feature (1)..( 10): Result.001 file - promoters70/1395824
cacaaacata

SEQ ID NO: 83051 - DNA, 10 bp, Unknown
  misc_feature (1)..( 10): Result.001 file - promoters70/1396085
ttcagataaa

SEQ ID NO: 83052 - DNA, 10 bp, Unknown
  misc_feature (1)..( 10): Result.001 file - promoters70/1396085
attttaatct

SEQ ID NO: 83053 - DNA, 10 bp, Unknown
  misc_feature (1)..( 10): Result.001 file - promoters70/1396085
tttttattct

SEQ ID NO: 83054 - DNA, 10 bp, Unknown
  misc_feature (1)..( 10): Result.001 file - promoters70/1396085
tctttgttca

SEQ ID NO: 83055 - DNA, 10 bp, Unknown
  misc_feature (1)..( 10): Result.001 file - promoters70/1396085
tttttacggc

SEQ ID NO: 83056 - DNA, 9 bp, Unknown
  misc_feature (1)..( 9): Result.001 file - promoters70/1396085
atatatctt

SEQ ID NO: 83057 - DNA, 9 bp, Unknown
  misc_feature (1)..( 9): Result.001 file - promoters70/1396085
ataaatctt

SEQ ID NO: 83058 - DNA, 10 bp, Unknown
  misc_feature (1)..( 10): Result.001 file - promoters70/1396085
ttatcatatt

SEQ ID NO: 83059 - DNA, 10 bp, Unknown
  misc_feature (1)..( 10): Result.001 file - promoters70/1396085
ataaattaat

SEQ ID NO: 83060 - DNA, 8 bp, Unknown
  misc_feature (1)..( 8): Result.001 file - promoters70/1396085
aaagtaat

SEQ ID NO: 83061 - DNA, 8 bp, Unknown
  misc_feature (1)..( 8): Result.001 file - promoters70/1396085
aaaataaa

SEQ ID NO: 83062 - DNA, 8 bp, Unknown
  misc_feature (1)..( 8): Result.001 file - promoters70/1396085
aaaatagc

SEQ ID NO: 83063 - DNA, 8 bp, Unknown
  misc_feature (1)..( 8): Result.001 file - promoters70/1396182
caaataaa

SEQ ID NO: 83064 - DNA, 9 bp, Unknown
  misc_feature (1)..( 9): Result.001 file - promoters70/1396182
aagaataag

SEQ ID NO: 83065 - DNA, 9 bp, Unknown
  misc_feature (1)..( 9): Result.001 file - promoters70/1396182
gttaataag

SEQ ID NO: 83066 - DNA, 9 bp, Unknown
  misc_feature (1)..( 9): Result.001 file - promoters70/1396182
aagagtaaa

SEQ ID NO: 83067 - DNA, 7 bp, Unknown
  misc_feature (1)..( 7): Result.001 file - promoters70/1396182
aaaacaa

SEQ ID NO: 83068 - DNA, 7 bp, Unknown
  misc_feature (1)..( 7): Result.001 file - promoters70/1396182
aaagcaa

SEQ ID NO: 83069 - DNA, 7 bp, Unknown
  misc_feature (1)..( 7): Result.001 file - promoters70/1396182
gaaacaa

SEQ ID NO: 83070 - DNA, 11 bp, Unknown
  misc_feature (1)..( 11): Result.001 file - promoters70/1396182
tagtatgcaat

SEQ ID NO: 83071 - DNA, 11 bp, Unknown
  misc_feature (1)..( 11): Result.001 file - promoters70/1396182
ggaaatgaaat

SEQ ID NO: 83072 - DNA, 11 bp, Unknown
  misc_feature (1)..( 11): Result.001 file - promoters70/1396182
ggaaaagaaaa

SEQ ID NO: 83073 - DNA, 7 bp, Unknown
  misc_feature (1)..( 7): Result.001 file - promoters70/1396182
ctatata

SEQ ID NO: 83074 - DNA, 7 bp, Unknown
  misc_feature (1)..( 7): Result.001 file - promoters70/1396182
gtatata

SEQ ID NO: 83075 - DNA, 7 bp, Unknown
  misc_feature (1)..( 7): Result.001 file - promoters70/1396238
gtatata

SEQ ID NO: 83076 - DNA, 7 bp, Unknown
  misc_feature (1)..( 7): Result.001 file - promoters70/1396238
taatggg

SEQ ID NO: 83077 - DNA, 7 bp, Unknown
  misc_feature (1)..( 7): Result.001 file - promoters70/1396238
taaaggg

SEQ ID NO: 83078 - DNA, 7 bp, Unknown
  misc_feature (1)..( 7): Result.001 file - promoters70/1396308
taaaggc

SEQ ID NO: 83079 - DNA, 10 bp, Unknown
  misc_feature (1)..( 10): Result.001 file - promoters70/1396308
taaaaatgaa

SEQ ID NO: 83080 - DNA, 10 bp, Unknown
  misc_feature (1)..( 10): Result.001 file - promoters70/1396308
taaaaagtct

SEQ ID NO: 83081 - DNA, 10 bp, Unknown
  misc_feature (1)..( 10): Result.001 file - promoters70/1396308
aaaaaaagaa

SEQ ID NO: 83082 - DNA, 10 bp, Unknown
  misc_feature (1)..( 10): Result.001 file - promoters70/1396308
gaaaaagggt

SEQ ID NO: 83083 - DNA, 12 bp, Unknown
  misc_feature (1)..( 12): Result.001 file - promoters70/1396308
atataataaata

SEQ ID NO: 83084 - DNA, 12 bp, Unknown
  misc_feature (1)..( 12): Result.001 file - promoters70/1396308
gcataaaaaata

SEQ ID NO: 83085 - DNA, 12 bp, Unknown
  misc_feature (1)..( 12): Result.001 file - promoters70/1396308
ttattatacttc

SEQ ID NO: 83086 - DNA, 12 bp, Unknown
  misc_feature (1)..( 12): Result.001 file - promoters70/1396308
atataattatct

SEQ ID NO: 83087 - DNA, 12 bp, Unknown
  misc_feature (1)..( 12): Result.001 file - promoters70/1396308
ctaaaatataat

SEQ ID NO: 83088 - DNA, 10 bp, Unknown
  misc_feature (1)..( 10): Result.001 file - promoters70/1396308
gtatatatat

SEQ ID NO: 83089 - DNA, 10 bp, Unknown
  misc_feature (1)..( 10): Result.001 file - promoters70/1396308
aaataaatag

SEQ ID NO: 83090 - DNA, 10 bp, Unknown
  misc_feature (1)..( 10): Result.001 file - promoters70/1396308
aaatatataa

SEQ ID NO: 83091 - DNA, 10 bp, Unknown
  misc_feature (1)..( 10): Result.001 file - promoters70/1396308
taaaatataa

SEQ ID NO: 83092 - DNA, 12 bp, Unknown
  misc_feature (1)..( 12): Result.001 file - promoters70/1396308
tagaaattaata

SEQ ID NO: 83093 - DNA, 12 bp, Unknown
  misc_feature (1)..( 12): Result.001 file - promoters70/1396308
agataattaagt

SEQ ID NO: 83094 - DNA, 11 bp, Unknown
  misc_feature (1)..( 11): Result.001 file - promoters70/1396308
taaaatcaata

SEQ ID NO: 83095 - DNA, 11 bp, Unknown
  misc_feature (1)..( 11): Result.001 file - promoters70/1396308
tttaattatta

SEQ ID NO: 83096 - DNA, 12 bp, Unknown
  misc_feature (1)..( 12): Result.001 file - promoters70/1396308
ataacatcactt

SEQ ID NO: 83097 - DNA, 12 bp, Unknown
  misc_feature (1)..( 12): Result.001 file - promoters70/1396308
ttttatcacaag

SEQ ID NO: 83098 - DNA, 12 bp, Unknown
  misc_feature (1)..( 12): Result.001 file - promoters70/1396308
ttttgtcaacga

SEQ ID NO: 83099 - DNA, 12 bp, Unknown
  misc_feature (1)..( 12): Result.001 file - promoters70/1396308
cggtgtaaacga

SEQ ID NO: 83100 - DNA, 12 bp, Unknown
  misc_feature (1)..( 12): Result.001 file - promoters70/1396308
ttttgtatctaa

SEQ ID NO: 83101 - DNA, 8 bp, Unknown
  misc_feature (1)..( 8): Result.001 file - promoters70/1396308
atatatat

SEQ ID NO: 83102 - DNA, 8 bp, Unknown
  misc_feature (1)..( 8): Result.001 file - promoters70/1396308
atatttat

SEQ ID NO: 83103 - DNA, 8 bp, Unknown
  misc_feature (1)..( 8): Result.001 file - promoters70/1396308
caatttat

SEQ ID NO: 83104 - DNA, 8 bp, Unknown
  misc_feature (1)..( 8): Result.001 file - promoters70/1396308
taatttat

SEQ ID NO: 83105 - DNA, 8 bp, Unknown
  misc_feature (1)..( 8): Result.001 file - promoters70/1396308
aatcaaaa

SEQ ID NO: 83106 - DNA, 8 bp, Unknown
  misc_feature (1)..( 8): Result.001 file - promoters70/1396308
aatcaaat

SEQ ID NO: 83107 - DNA, 9 bp, Unknown
  misc_feature (1)..( 9): Result.001 file - promoters70/1396308
gatccaaac

SEQ ID NO: 83108 - DNA, 9 bp, Unknown
  misc_feature (1)..( 9): Result.001 file - promoters70/1396308
tatcctaac

SEQ ID NO: 83109 - DNA, 11 bp, Unknown
  misc_feature (1)..( 11): Result.001 file - promoters70/1396308
ctagacacgta

SEQ ID NO: 83110 - DNA, 11 bp, Unknown
  misc_feature (1)..( 11): Result.001 file - promoters70/1396308
atcaacacgta

SEQ ID NO: 83111 - DNA, 11 bp, Unknown
  misc_feature (1)..( 11): Result.001 file - promoters70/1396308
aaagagacgaa

SEQ ID NO: 83112 - DNA, 11 bp, Unknown
  misc_feature (1)..( 11): Result.001 file - promoters70/1396308
aaaaagaatac

SEQ ID NO: 83113 - DNA, 8 bp, Unknown
  misc_feature (1)..( 8): Result.001 file - promoters70/1396308
ttataatg

SEQ ID NO: 83114 - DNA, 8 bp, Unknown
  misc_feature (1)..( 8): Result.001 file - promoters70/1396308
atataata

SEQ ID NO: 83115 - DNA, 8 bp, Unknown
  misc_feature (1)..( 8): Result.001 file - promoters70/1396308
ttattata

SEQ ID NO: 83116 - DNA, 8 bp, Unknown
  misc_feature (1)..( 8): Result.001 file - promoters70/1396354
ataaaatc

SEQ ID NO: 83117 - DNA, 6 bp, Unknown
  misc_feature (1)..( 6): Result.001 file - promoters70/1396354
tacatt

SEQ ID NO: 83118 - DNA, 6 bp, Unknown
  misc_feature (1)..( 6): Result.001 file - promoters70/1396354
tacatt

SEQ ID NO: 83119 - DNA, 6 bp, Unknown
  misc_feature (1)..( 6): Result.001 file - promoters70/1396354
tacatt

SEQ ID NO: 83120 - DNA, 7 bp, Unknown
  misc_feature (1)..( 7): Result.001 file - promoters70/1396354
cttgatt

SEQ ID NO: 83121 - DNA, 7 bp, Unknown
  misc_feature (1)..( 7): Result.001 file - promoters70/1396354
tttgatt

SEQ ID NO: 83122 - DNA, 7 bp, Unknown
  misc_feature (1)..( 7): Result.001 file - promoters70/1396469
tttgatt

SEQ ID NO: 83123 - DNA, 9 bp, Unknown
  misc_feature (1)..( 9): Result.001 file - promoters70/1396469
ttttcttat

SEQ ID NO: 83124 - DNA, 9 bp, Unknown
  misc_feature (1)..( 9): Result.001 file - promoters70/1396469
cattcttat

SEQ ID NO: 83125 - DNA, 9 bp, Unknown
  misc_feature (1)..( 9): Result.001 file - promoters70/1396469
catgctttc

SEQ ID NO: 83126 - DNA, 9 bp, Unknown
  misc_feature (1)..( 9): Result.001 file - promoters70/1396469
acttacaaa

SEQ ID NO: 83127 - DNA, 9 bp, Unknown
  misc_feature (1)..( 9): Result.001 file - promoters70/1396469
acttactta

SEQ ID NO: 83128 - DNA, 9 bp, Unknown
  misc_feature (1)..( 9): Result.001 file - promoters70/1396469
ccttccaaa

SEQ ID NO: 83129 - DNA, 9 bp, Unknown
  misc_feature (1)..( 9): Result.001 file - promoters70/1396469
atataaaca

SEQ ID NO: 83130 - DNA, 9 bp, Unknown
  misc_feature (1)..( 9): Result.001 file - promoters70/1396469
atattaaca

SEQ ID NO: 83131 - DNA, 9 bp, Unknown
  misc_feature (1)..( 9): Result.001 file - promoters70/1396469
atatataca

SEQ ID NO: 83132 - DNA, 11 bp, Unknown
  misc_feature (1)..( 11): Result.001 file - promoters70/1396469
aagtaaacaaa

SEQ ID NO: 83133 - DNA, 11 bp, Unknown
  misc_feature (1)..( 11): Result.001 file - promoters70/1396469
aagaaaacaaa

SEQ ID NO: 83134 - DNA, 12 bp, Unknown
  misc_feature (1)..( 12): Result.001 file - promoters70/1396469
ttcataacgaaa

SEQ ID NO: 83135 - DNA, 14 bp, Unknown
  misc_feature (1)..( 14): Result.001 file - promoters70/1396469
tcagatatacattg

SEQ ID NO: 83136 - DNA, 14 bp, Unknown
  misc_feature (1)..( 14): Result.001 file - promoters70/1396469
ttttctataaatta

SEQ ID NO: 83137 - DNA, 14 bp, Unknown
  misc_feature (1)..( 14): Result.001 file - promoters70/1396469
ttttttatagatta

SEQ ID NO: 83138 - DNA, 14 bp, Unknown
  misc_feature (1)..( 14): Result.001 file - promoters70/1396469
agagctaaaaacgg

SEQ ID NO: 83139 - DNA, 7 bp, Unknown
  misc_feature (1)..( 7): Result.001 file - promoters70/1396469
caacaac

SEQ ID NO: 83140 - DNA, 7 bp, Unknown
  misc_feature (1)..( 7): Result.001 file - promoters70/1396469
caacaaa

SEQ ID NO: 83141 - DNA, 7 bp, Unknown
  misc_feature (1)..( 7): Result.001 file - promoters70/1396482
aaacaaa

SEQ ID NO: 83142 - DNA, 9 bp, Unknown
  misc_feature (1)..( 9): Result.001 file - promoters70/1396482
aaaaaaata

SEQ ID NO: 83143 - DNA, 9 bp, Unknown
  misc_feature (1)..( 9): Result.001 file - promoters70/1396482
aaaaaaagt

SEQ ID NO: 83144 - DNA, 9 bp, Unknown
  misc_feature (1)..( 9): Result.001 file - promoters70/1397080
aaatagtga

SEQ ID NO: 83145 - DNA, 9 bp, Unknown
  misc_feature (1)..( 9): Result.001 file - promoters70/1397080
ccatcgaat

SEQ ID NO: 83146 - DNA, 9 bp, Unknown
  misc_feature (1)..( 9): Result.001 file - promoters70/1397080
aaatcaaat

SEQ ID NO: 83147 - DNA, 9 bp, Unknown
  misc_feature (1)..( 9): Result.001 file - promoters70/1397080
aaaacaaaa

SEQ ID NO: 83148 - DNA, 10 bp, Unknown
  misc_feature (1)..( 10): Result.001 file - promoters70/1397080
ctacacatag

SEQ ID NO: 83149 - DNA, 10 bp, Unknown
  misc_feature (1)..( 10): Result.001 file - promoters70/1397080
ctaaacaaaa

SEQ ID NO: 83150 - DNA, 10 bp, Unknown
  misc_feature (1)..( 10): Result.001 file - promoters70/1397125
aaaaacaaaa

SEQ ID NO: 83151 - DNA, 8 bp, Unknown
  misc_feature (1)..( 8): Result.001 file - promoters70/1397125
tcccaaaa

SEQ ID NO: 83152 - DNA, 8 bp, Unknown
  misc_feature (1)..( 8): Result.001 file - promoters70/1397125
tcctaaaa

SEQ ID NO: 83153 - DNA, 8 bp, Unknown
  misc_feature (1)..( 8): Result.001 file - promoters70/1397125
acccaaaa

SEQ ID NO: 83154 - DNA, 8 bp, Unknown
  misc_feature (1)..( 8): Result.001 file - promoters70/1397125
tactaaaa

SEQ ID NO: 83155 - DNA, 8 bp, Unknown
  misc_feature (1)..( 8): Result.001 file - promoters70/1397125
taagatta

SEQ ID NO: 83156 - DNA, 8 bp, Unknown
  misc_feature (1)..( 8): Result.001 file - promoters70/1397125
taaaattt

SEQ ID NO: 83157 - DNA, 8 bp, Unknown
  misc_feature (1)..( 8): Result.001 file - promoters70/1397125
caaaattg

SEQ ID NO: 83158 - DNA, 8 bp, Unknown
  misc_feature (1)..( 8): Result.001 file - promoters70/1397203
gaaacttt

SEQ ID NO: 83159 - DNA, 8 bp, Unknown
  misc_feature (1)..( 8): Result.001 file - promoters70/1397203
gtattcta

SEQ ID NO: 83160 - DNA, 8 bp, Unknown
  misc_feature (1)..( 8): Result.001 file - promoters70/1397203
ttattcta

SEQ ID NO: 83161 - DNA, 8 bp, Unknown
  misc_feature (1)..( 8): Result.001 file - promoters70/1397203
ttaatctc

SEQ ID NO: 83162 - DNA, 9 bp, Unknown
  misc_feature (1)..( 9): Result.001 file - promoters70/1397203
aaaaaagaa

SEQ ID NO: 83163 - DNA, 9 bp, Unknown
  misc_feature (1)..( 9): Result.001 file - promoters70/1397203
aaaaaactc

SEQ ID NO: 83164 - DNA, 9 bp, Unknown
  misc_feature (1)..( 9): Result.001 file - promoters70/1397203
aaaaagaaa

SEQ ID NO: 83165 - DNA, 9 bp, Unknown
  misc_feature (1)..( 9): Result.001 file - promoters70/1397203
aaacactta

SEQ ID NO: 83166 - DNA, 10 bp, Unknown
  misc_feature (1)..( 10): Result.001 file - promoters70/1397203
aaattataaa

SEQ ID NO: 83167 - DNA, 10 bp, Unknown
  misc_feature (1)..( 10): Result.001 file - promoters70/1397203
aatttaaaaa

SEQ ID NO: 83168 - DNA, 10 bp, Unknown
  misc_feature (1)..( 10): Result.001 file - promoters70/1397231
aaataataat

SEQ ID NO: 83169 - DNA, 9 bp, Unknown
  misc_feature (1)..( 9): Result.001 file - promoters70/1397231
caagttaat

SEQ ID NO: 83170 - DNA, 9 bp, Unknown
  misc_feature (1)..( 9): Result.001 file - promoters70/1397231
tatgttaat

SEQ ID NO: 83171 - DNA, 9 bp, Unknown
  misc_feature (1)..( 9): Result.001 file - promoters70/1397231
caatttaaa

SEQ ID NO: 83172 - DNA, 9 bp, Unknown
  misc_feature (1)..( 9): Result.001 file - promoters70/1397231
attgttaac

SEQ ID NO: 83173 - DNA, 9 bp, Unknown
  misc_feature (1)..( 9): Result.001 file - promoters70/1397231
tttgtaaat

SEQ ID NO: 83174 - DNA, 9 bp, Unknown
  misc_feature (1)..( 9): Result.001 file - promoters70/1397231
tatttcaaa

SEQ ID NO: 83175 - DNA, 9 bp, Unknown
  misc_feature (1)..( 9): Result.001 file - promoters70/1397231
atcttcaaa

SEQ ID NO: 83176 - DNA, 12 bp, Unknown
  misc_feature (1)..( 12): Result.001 file - promoters70/1397231
tttattttccca

SEQ ID NO: 83177 - DNA, 12 bp, Unknown
  misc_feature (1)..( 12): Result.001 file - promoters70/1397231
attattttcttg

SEQ ID NO: 83178 - DNA, 12 bp, Unknown
  misc_feature (1)..( 12): Result.001 file - promoters70/1397231
atcattttctta

SEQ ID NO: 83179 - DNA, 12 bp, Unknown
  misc_feature (1)..( 12): Result.001 file - promoters70/1397231
aatattttgcaa

SEQ ID NO: 83180 - DNA, 12 bp, Unknown
  misc_feature (1)..( 12): Result.001 file - promoters70/1397231
tttaattgacaa

SEQ ID NO: 83181 - DNA, 12 bp, Unknown
  misc_feature (1)..( 12): Result.001 file - promoters70/1397231
agagttttgttg

SEQ ID NO: 83182 - DNA, 13 bp, Unknown
  misc_feature (1)..( 13): Result.001 file - promoters70/1397231
attagttctaatc

SEQ ID NO: 83183 - DNA, 13 bp, Unknown
  misc_feature (1)..( 13): Result.001 file - promoters70/1397231
attatttcaaatg

SEQ ID NO: 83184 - DNA, 13 bp, Unknown
  misc_feature (1)..( 13): Result.001 file - promoters70/1397231
tcaatttaaaaag

SEQ ID NO: 83185 - DNA, 13 bp, Unknown
  misc_feature (1)..( 13): Result.001 file - promoters70/1397231
ctctcgtataatt

SEQ ID NO: 83186 - DNA, 13 bp, Unknown
  misc_feature (1)..( 13): Result.001 file - promoters70/1397231
attttttttcatc

SEQ ID NO: 83187 - DNA, 13 bp, Unknown
  misc_feature (1)..( 13): Result.001 file - promoters70/1397231
tcatcttcaaaat

SEQ ID NO: 83188 - DNA, 16 bp, Unknown
  misc_feature (1)..( 16): Result.001 file - promoters70/1397231
ataaatgtatttcact

SEQ ID NO: 83189 - DNA, 16 bp, Unknown
  misc_feature (1)..( 16): Result.001 file - promoters70/1397231
aattatgtatattgtt

SEQ ID NO: 83190 - DNA, 16 bp, Unknown
  misc_feature (1)..( 16): Result.001 file - promoters70/1397231
agttttgtattatcaa

SEQ ID NO: 83191 - DNA, 16 bp, Unknown
  misc_feature (1)..( 16): Result.001 file - promoters70/1397231
ataaaagtataaaaaa

SEQ ID NO: 83192 - DNA, 16 bp, Unknown
  misc_feature (1)..( 16): Result.001 file - promoters70/1397231
ttacttttaacaaaac

SEQ ID NO: 83193 - DNA, 16 bp, Unknown
  misc_feature (1)..( 16): Result.001 file - promoters70/1397231
aggctagatacaaaac

SEQ ID NO: 83194 - DNA, 8 bp, Unknown
  misc_feature (1)..( 8): Result.001 file - promoters70/1397231
ataaaaaa

SEQ ID NO: 83195 - DNA, 8 bp, Unknown
  misc_feature (1)..( 8): Result.001 file - promoters70/1397231
tcaaaaaa

SEQ ID NO: 83196 - DNA, 8 bp, Unknown
  misc_feature (1)..( 8): Result.001 file - promoters70/1397231
agaaaaaa

SEQ ID NO: 83197 - DNA, 8 bp, Unknown
  misc_feature (1)..( 8): Result.001 file - promoters70/1397231
ataaaaat

SEQ ID NO: 83198 - DNA, 9 bp, Unknown
  misc_feature (1)..( 9): Result.001 file - promoters70/1397231
agaaacaaa

SEQ ID NO: 83199 - DNA, 9 bp, Unknown
  misc_feature (1)..( 9): Result.001 file - promoters70/1397231
aaaataaat

SEQ ID NO: 83200 - DNA, 10 bp, Unknown
  misc_feature (1)..( 10): Result.001 file - promoters70/1397231
ctatatgctt

SEQ ID NO: 83201 - DNA, 10 bp, Unknown
  misc_feature (1)..( 10): Result.001 file - promoters70/1397231
atatatgtct

SEQ ID NO: 83202 - DNA, 10 bp, Unknown
  misc_feature (1)..( 10): Result.001 file - promoters70/1397231
tcatattctt

SEQ ID NO: 83203 - DNA, 10 bp, Unknown
  misc_feature (1)..( 10): Result.001 file - promoters70/1397231
ttatatataa

SEQ ID NO: 83204 - DNA, 10 bp, Unknown
  misc_feature (1)..( 10): Result.001 file - promoters70/1397231
ttaaatataa

SEQ ID NO: 83205 - DNA, 10 bp, Unknown
  misc_feature (1)..( 10): Result.001 file - promoters70/1397263
gcatattttg

SEQ ID NO: 83206 - DNA, 11 bp, Unknown
  misc_feature (1)..( 11): Result.001 file - promoters70/1397263
aaaaatcaaag

SEQ ID NO: 83207 - DNA, 11 bp, Unknown
  misc_feature (1)..( 11): Result.001 file - promoters70/1397263
atacatcaaat

SEQ ID NO: 83208 - DNA, 11 bp, Unknown
  misc_feature (1)..( 11): Result.001 file - promoters70/1397263
gaatatcaaag

SEQ ID NO: 83209 - DNA, 11 bp, Unknown
  misc_feature (1)..( 11): Result.001 file - promoters70/1397263
atacaccaata

SEQ ID NO: 83210 - DNA, 11 bp, Unknown
  misc_feature (1)..( 11): Result.001 file - promoters70/1397263
atttatgaaaa

SEQ ID NO: 83211 - DNA, 11 bp, Unknown
  misc_feature (1)..( 11): Result.001 file - promoters70/1397263
tattatcaatg

SEQ ID NO: 83212 - DNA, 10 bp, Unknown
  misc_feature (1)..( 10): Result.001 file - promoters70/1397263
ttaaacgtat

SEQ ID NO: 83213 - DNA, 10 bp, Unknown
  misc_feature (1)..( 10): Result.001 file - promoters70/1397263
agaaaagtaa

SEQ ID NO: 83214 - DNA, 10 bp, Unknown
  misc_feature (1)..( 10): Result.001 file - promoters70/1397263
aataaattaa

SEQ ID NO: 83215 - DNA, 10 bp, Unknown
  misc_feature (1)..( 10): Result.001 file - promoters70/1397263
agaaaaataa

SEQ ID NO: 83216 - DNA, 10 bp, Unknown
  misc_feature (1)..( 10): Result.001 file - promoters70/1397263
tgaaaaaata

SEQ ID NO: 83217 - DNA, 10 bp, Unknown
  misc_feature (1)..( 10): Result.001 file - promoters70/1397263
ttaaagatat

SEQ ID NO: 83218 - DNA, 10 bp, Unknown
  misc_feature (1)..( 10): Result.001 file - promoters70/1397263
tcaaaattat

SEQ ID NO: 83219 - DNA, 17 bp, Unknown
  misc_feature (1)..( 17): Result.001 file - promoters70/1397263
ggaaattattttaacaa

SEQ ID NO: 83220 - DNA, 17 bp, Unknown
  misc_feature (1)..( 17): Result.001 file - promoters70/1397263
gttatttattttagatt

SEQ ID NO: 83221 - DNA, 17 bp, Unknown
  misc_feature (1)..( 17): Result.001 file - promoters70/1397263
ggaaattgtttcgaaac

SEQ ID NO: 83222 - DNA, 17 bp, Unknown
  misc_feature (1)..( 17): Result.001 file - promoters70/1397263
tttttttttttttacag

SEQ ID NO: 83223 - DNA, 17 bp, Unknown
  misc_feature (1)..( 17): Result.001 file - promoters70/1397263
ggaatttggaaaagacc

SEQ ID NO: 83224 - DNA, 17 bp, Unknown
  misc_feature (1)..( 17): Result.001 file - promoters70/1397263
ccattttcgtttaacag

SEQ ID NO: 83225 - DNA, 11 bp, Unknown
  misc_feature (1)..( 11): Result.001 file - promoters70/1397263
ttcaaaaaaga

SEQ ID NO: 83226 - DNA, 11 bp, Unknown
  misc_feature (1)..( 11): Result.001 file - promoters70/1397263
gttaaaaaagt

SEQ ID NO: 83227 - DNA, 11 bp, Unknown
  misc_feature (1)..( 11): Result.001 file - promoters70/1397263
ttagtaaaaga

SEQ ID NO: 83228 - DNA, 11 bp, Unknown
  misc_feature (1)..( 11): Result.001 file - promoters70/1397263
ttcaaaaaaaa

SEQ ID NO: 83229 - DNA, 11 bp, Unknown
  misc_feature (1)..( 11): Result.001 file - promoters70/1397263
tataataaact

SEQ ID NO: 83230 - DNA, 11 bp, Unknown
  misc_feature (1)..( 11): Result.001 file - promoters70/1397263
cagaaaatagt

SEQ ID NO: 83231 - DNA, 10 bp, Unknown
  misc_feature (1)..( 10): Result.001 file - promoters70/1397263
tgcccaaact

SEQ ID NO: 83232 - DNA, 10 bp, Unknown
  misc_feature (1)..( 10): Result.001 file - promoters70/1397263
ggcccaataa

SEQ ID NO: 83233 - DNA, 10 bp, Unknown
  misc_feature (1)..( 10): Result.001 file - promoters70/1397263
ggcccaataa

SEQ ID NO: 83234 - DNA, 10 bp, Unknown
  misc_feature (1)..( 10): Result.001 file - promoters70/1397263
ggcccagtaa

SEQ ID NO: 83235 - DNA, 10 bp, Unknown
  misc_feature (1)..( 10): Result.001 file - promoters70/1397263
agcccaaaac

SEQ ID NO: 83236 - DNA, 10 bp, Unknown
  misc_feature (1)..( 10): Result.001 file - promoters70/1397263
ggcccaccgg

SEQ ID NO: 83237 - DNA, 12 bp, Unknown
  misc_feature (1)..( 12): Result.001 file - promoters70/1397263
gtaaaactaaaa

SEQ ID NO: 83238 - DNA, 12 bp, Unknown
  misc_feature (1)..( 12): Result.001 file - promoters70/1397263
tgcaaaccaaac

SEQ ID NO: 83239 - DNA, 12 bp, Unknown
  misc_feature (1)..( 12): Result.001 file - promoters70/1397263
gagtaactaaaa

SEQ ID NO: 83240 - DNA, 12 bp, Unknown
  misc_feature (1)..( 12): Result.001 file - promoters70/1397263
ggcaacccattc

SEQ ID NO: 83241 - DNA, 12 bp, Unknown
  misc_feature (1)..( 12): Result.001 file - promoters70/1397263
caccaccgattt

SEQ ID NO: 83242 - DNA, 12 bp, Unknown
  misc_feature (1)..( 12): Result.001 file - promoters70/1397350
ggcaacataaaa

SEQ ID NO: 83243 - DNA, 13 bp, Unknown
  misc_feature (1)..( 13): Result.001 file - promoters70/1397350
gtctcatggattc

SEQ ID NO: 83244 - DNA, 13 bp, Unknown
  misc_feature (1)..( 13): Result.001 file - promoters70/1397350
gtttcaaggattc

SEQ ID NO: 83245 - DNA, 13 bp, Unknown
  misc_feature (1)..( 13): Result.001 file - promoters70/1397461
gtctgatggataa

SEQ ID NO: 83246 - DNA, 12 bp, Unknown
  misc_feature (1)..( 12): Result.001 file - promoters70/1397461
catacaaattgc

SEQ ID NO: 83247 - DNA, 12 bp, Unknown
  misc_feature (1)..( 12): Result.001 file - promoters70/1397461
tttacaaattta

SEQ ID NO: 83248 - DNA, 12 bp, Unknown
  misc_feature (1)..( 12): Result.001 file - promoters70/1397461
tacacaaattaa

SEQ ID NO: 83249 - DNA, 12 bp, Unknown
  misc_feature (1)..( 12): Result.001 file - promoters70/1397461
aagaaaaaatgc

SEQ ID NO: 83250 - DNA, 12 bp, Unknown
  misc_feature (1)..( 12): Result.001 file - promoters70/1397461
aataaaaaaggg

SEQ ID NO: 83251 - DNA, 12 bp, Unknown
  misc_feature (1)..( 12): Result.001 file - promoters70/1397461
aataaaatgaat

SEQ ID NO: 83252 - DNA, 10 bp, Unknown
  misc_feature (1)..( 10): Result.001 file - promoters70/1397461
ctttttgttt

SEQ ID NO: 83253 - DNA, 10 bp, Unknown
  misc_feature (1)..( 10): Result.001 file - promoters70/1397461
tattttgttt

SEQ ID NO: 83254 - DNA, 10 bp, Unknown
  misc_feature (1)..( 10): Result.001 file - promoters70/1397461
ctttttgatg

SEQ ID NO: 83255 - DNA, 10 bp, Unknown
  misc_feature (1)..( 10): Result.001 file - promoters70/1397461
atttatgtaa

SEQ ID NO: 83256 - DNA, 10 bp, Unknown
  misc_feature (1)..( 10): Result.001 file - promoters70/1397461
gtgtttcttt

SEQ ID NO: 83257 - DNA, 10 bp, Unknown
  misc_feature (1)..( 10): Result.001 file - promoters70/1397461
cttattgggc

SEQ ID NO: 83258 - DNA, 8 bp, Unknown
  misc_feature (1)..( 8): Result.001 file - promoters70/1397461
tcaaaaat

SEQ ID NO: 83259 - DNA, 8 bp, Unknown
  misc_feature (1)..( 8): Result.001 file - promoters70/1397461
tcagaaag

SEQ ID NO: 83260 - DNA, 8 bp, Unknown
  misc_feature (1)..( 8): Result.001 file - promoters70/1397461
caaaaaat

SEQ ID NO: 83261 - DNA, 8 bp, Unknown
  misc_feature (1)..( 8): Result.001 file - promoters70/1397461
tcaaaaca

SEQ ID NO: 83262 - DNA, 8 bp, Unknown
  misc_feature (1)..( 8): Result.001 file - promoters70/1397461
cgaaaatc

SEQ ID NO: 83263 - DNA, 9 bp, Unknown
  misc_feature (1)..( 9): Result.001 file - promoters70/1397500
ccaacaaat

SEQ ID NO: 83264 - DNA, 8 bp, Unknown
  misc_feature (1)..( 8): Result.001 file - promoters70/1397500
aattatat

SEQ ID NO: 83265 - DNA, 8 bp, Unknown
  misc_feature (1)..( 8): Result.001 file - promoters70/1397500
aatcataa

SEQ ID NO: 83266 - DNA, 8 bp, Unknown
  misc_feature (1)..( 8): Result.001 file - promoters70/1397500
aatgatat

SEQ ID NO: 83267 - DNA, 8 bp, Unknown
  misc_feature (1)..( 8): Result.001 file - promoters70/1397500
aaatggag

SEQ ID NO: 83268 - DNA, 8 bp, Unknown
  misc_feature (1)..( 8): Result.001 file - promoters70/1397500
aaatggtt

SEQ ID NO: 83269 - DNA, 8 bp, Unknown
  misc_feature (1)..( 8): Result.001 file - promoters70/1397500
caatagag

SEQ ID NO: 83270 - DNA, 10 bp, Unknown
  misc_feature (1)..( 10): Result.001 file - promoters70/1397500
cacttgaatt

SEQ ID NO: 83271 - DNA, 10 bp, Unknown
  misc_feature (1)..( 10): Result.001 file - promoters70/1397500
aaattgaatc

SEQ ID NO: 83272 - DNA, 10 bp, Unknown
  misc_feature (1)..( 10): Result.001 file - promoters70/1397500
aaattaaatc

SEQ ID NO: 83273 - DNA, 9 bp, Unknown
  misc_feature (1)..( 9): Result.001 file - promoters70/1397500
ttataatga

SEQ ID NO: 83274 - DNA, 9 bp, Unknown
  misc_feature (1)..( 9): Result.001 file - promoters70/1397500
ttaaaatat

SEQ ID NO: 83275 - DNA, 9 bp, Unknown
  misc_feature (1)..( 9): Result.001 file - promoters70/1397500
atataaaaa

SEQ ID NO: 83276 - DNA, 9 bp, Unknown
  misc_feature (1)..( 9): Result.001 file - promoters70/1397500
gctgctaat

SEQ ID NO: 83277 - DNA, 9 bp, Unknown
  misc_feature (1)..( 9): Result.001 file - promoters70/1397500
agtgccaat

SEQ ID NO: 83278 - DNA, 9 bp, Unknown
  misc_feature (1)..( 9): Result.001 file - promoters70/1397500
agttccaac

SEQ ID NO: 83279 - DNA, 10 bp, Unknown
  misc_feature (1)..( 10): Result.001 file - promoters70/1397500
tcattattat

SEQ ID NO: 83280 - DNA, 10 bp, Unknown
  misc_feature (1)..( 10): Result.001 file - promoters70/1397500
cgcttagtat

SEQ ID NO: 83281 - DNA, 10 bp, Unknown
  misc_feature (1)..( 10): Result.001 file - promoters70/1397500
tcactattag

SEQ ID NO: 83282 - DNA, 9 bp, Unknown
  misc_feature (1)..( 9): Result.001 file - promoters70/1397500
attattatt

SEQ ID NO: 83283 - DNA, 9 bp, Unknown
  misc_feature (1)..( 9): Result.001 file - promoters70/1397500
ataattatt

SEQ ID NO: 83284 - DNA, 9 bp, Unknown
  misc_feature (1)..( 9): Result.001 file - promoters70/1397500
ataaatata

SEQ ID NO: 83285 - DNA, 10 bp, Unknown
  misc_feature (1)..( 10): Result.001 file - promoters70/1397500
ttttttataa

SEQ ID NO: 83286 - DNA, 10 bp, Unknown
  misc_feature (1)..( 10): Result.001 file - promoters70/1397500
ggaattataa

SEQ ID NO: 83287 - DNA, 10 bp, Unknown
  misc_feature (1)..( 10): Result.001 file - promoters70/1397500
taaatcatat

SEQ ID NO: 83288 - DNA, 10 bp, Unknown
  misc_feature (1)..( 10): Result.001 file - promoters70/1397500
taaatcaaat

SEQ ID NO: 83289 - DNA, 7 bp, Unknown
  misc_feature (1)..( 7): Result.001 file - promoters70/1397500
atttttg

SEQ ID NO: 83290 - DNA, 7 bp, Unknown
  misc_feature (1)..( 7): Result.001 file - promoters70/1397500
atttttt

SEQ ID NO: 83291 - DNA, 7 bp, Unknown
  misc_feature (1)..( 7): Result.001 file - promoters70/1397500
ctttttt

SEQ ID NO: 83292 - DNA, 9 bp, Unknown
  misc_feature (1)..( 9): Result.001 file - promoters70/1397500
ttcgacaaa

SEQ ID NO: 83293 - DNA, 9 bp, Unknown
  misc_feature (1)..( 9): Result.001 file - promoters70/1397500
ttcaacaat

SEQ ID NO: 83294 - DNA, 9 bp, Unknown
  misc_feature (1)..( 9): Result.001 file - promoters70/1397500
gaaaacaat

SEQ ID NO: 83295 - DNA, 8 bp, Unknown
  misc_feature (1)..( 8): Result.001 file - promoters70/1397500
caaccaat

SEQ ID NO: 83296 - DNA, 8 bp, Unknown
  misc_feature (1)..( 8): Result.001 file - promoters70/1397500
caaccaaa

SEQ ID NO: 83297 - DNA, 8 bp, Unknown
  misc_feature (1)..( 8): Result.001 file - promoters70/1397500
aaactaaa

SEQ ID NO: 83298 - DNA, 8 bp, Unknown
  misc_feature (1)..( 8): Result.001 file - promoters70/1397500
aaacaatt

SEQ ID NO: 83299 - DNA, 8 bp, Unknown
  misc_feature (1)..( 8): Result.001 file - promoters70/1397500
aaataatt

SEQ ID NO: 83300 - DNA, 8 bp, Unknown
  misc_feature (1)..( 8): Result.001 file - promoters70/1397500
caacaata

SEQ ID NO: 83301 - DNA, 10 bp, Unknown
  misc_feature (1)..( 10): Result.001 file - promoters70/1397500
attttatgaa

SEQ ID NO: 83302 - DNA, 10 bp, Unknown
  misc_feature (1)..( 10): Result.001 file - promoters70/1397500
tttttgtgac

SEQ ID NO: 83303 - DNA, 10 bp, Unknown
  misc_feature (1)..( 10): Result.001 file - promoters70/1397500
tttttgtgac

SEQ ID NO: 83304 - DNA, 9 bp, Unknown
  misc_feature (1)..( 9): Result.001 file - promoters70/1397500
tcatattac

SEQ ID NO: 83305 - DNA, 9 bp, Unknown
  misc_feature (1)..( 9): Result.001 file - promoters70/1397500
acatatttt

SEQ ID NO: 83306 - DNA, 9 bp, Unknown
  misc_feature (1)..( 9): Result.001 file - promoters70/1397700
atatattca

SEQ ID NO: 83307 - DNA, 7 bp, Unknown
  misc_feature (1)..( 7): Result.001 file - promoters70/1397700
atgtttg

SEQ ID NO: 83308 - DNA, 7 bp, Unknown
  misc_feature (1)..( 7): Result.001 file - promoters70/1397700
gtgtttg

SEQ ID NO: 83309 - DNA, 7 bp, Unknown
  misc_feature (1)..( 7): Result.001 file - promoters70/1397700
gtgattg

SEQ ID NO: 83310 - DNA, 8 bp, Unknown
  misc_feature (1)..( 8): Result.001 file - promoters70/1397700
atttcaaa

SEQ ID NO: 83311 - DNA, 8 bp, Unknown
  misc_feature (1)..( 8): Result.001 file - promoters70/1397700
attacaaa

SEQ ID NO: 83312 - DNA, 8 bp, Unknown
  misc_feature (1)..( 8): Result.001 file - promoters70/1397700
ctttaaaa

SEQ ID NO: 83313 - DNA, 11 bp, Unknown
  misc_feature (1)..( 11): Result.001 file - promoters70/1397700
taaagtgaagt

SEQ ID NO: 83314 - DNA, 11 bp, Unknown
  misc_feature (1)..( 11): Result.001 file - promoters70/1397700
taaagtcaaaa

SEQ ID NO: 83315 - DNA, 11 bp, Unknown
  misc_feature (1)..( 11): Result.001 file - promoters70/1397700
aaaaatcaaaa

SEQ ID NO: 83316 - DNA, 10 bp, Unknown
  misc_feature (1)..( 10): Result.001 file - promoters70/1397700
gaagtcatat

SEQ ID NO: 83317 - DNA, 10 bp, Unknown
  misc_feature (1)..( 10): Result.001 file - promoters70/1397700
aaagtcaaaa

SEQ ID NO: 83318 - DNA, 10 bp, Unknown
  misc_feature (1)..( 10): Result.001 file - promoters70/1397753
aaaatcaaaa

SEQ ID NO: 83319 - DNA, 12 bp, Unknown
  misc_feature (1)..( 12): Result.001 file - promoters70/1397753
ttctcaaattgt

SEQ ID NO: 83320 - DNA, 12 bp, Unknown
  misc_feature (1)..( 12): Result.001 file - promoters70/1397753
ttctaaaataat

SEQ ID NO: 83321 - DNA, 12 bp, Unknown
  misc_feature (1)..( 12): Result.001 file - promoters70/1397821
gaagaaaaaaat

SEQ ID NO: 83322 - DNA, 10 bp, Unknown
  misc_feature (1)..( 10): Result.001 file - promoters70/1397821
gaattgatgt

SEQ ID NO: 83323 - DNA, 10 bp, Unknown
  misc_feature (1)..( 10): Result.001 file - promoters70/1397821
gaattgatta

SEQ ID NO: 83324 - DNA, 10 bp, Unknown
  misc_feature (1)..( 10): Result.001 file - promoters70/1397821
tctttggtta

SEQ ID NO: 83325 - DNA, 10 bp, Unknown
  misc_feature (1)..( 10): Result.001 file - promoters70/1397821
taattcattg

SEQ ID NO: 83326 - DNA, 11 bp, Unknown
  misc_feature (1)..( 11): Result.001 file - promoters70/1397821
gtcttttcaaa

SEQ ID NO: 83327 - DNA, 11 bp, Unknown
  misc_feature (1)..( 11): Result.001 file - promoters70/1397821
gtccttttacc

SEQ ID NO: 83328 - DNA, 11 bp, Unknown
  misc_feature (1)..( 11): Result.001 file - promoters70/1397821
atcttttcaat

SEQ ID NO: 83329 - DNA, 11 bp, Unknown
  misc_feature (1)..( 11): Result.001 file - promoters70/1398124
ctattttaata

SEQ ID NO: 83330 - DNA, 7 bp, Unknown
  misc_feature (1)..( 7): Result.001 file - promoters70/1398124
aatgttg

SEQ ID NO: 83331 - DNA, 7 bp, Unknown
  misc_feature (1)..( 7): Result.001 file - promoters70/1398124
aatattg

SEQ ID NO: 83332 - DNA, 7 bp, Unknown
  misc_feature (1)..( 7): Result.001 file - promoters70/1398124
aattttg

SEQ ID NO: 83333 - DNA, 8 bp, Unknown
  misc_feature (1)..( 8): Result.001 file - promoters70/1398124
ttatgtat

SEQ ID NO: 83334 - DNA, 8 bp, Unknown
  misc_feature (1)..( 8): Result.001 file - promoters70/1398124
ttaagtag

SEQ ID NO: 83335 - DNA, 8 bp, Unknown
  misc_feature (1)..( 8): Result.001 file - promoters70/1398337
ataattag

SEQ ID NO: 83336 - DNA, 11 bp, Unknown
  misc_feature (1)..( 11): Result.001 file - promoters70/1398337
taaacacaaac

SEQ ID NO: 83337 - DNA, 11 bp, Unknown
  misc_feature (1)..( 11): Result.001 file - promoters70/1398337
gaaacaaaaac

SEQ ID NO: 83338 - DNA, 11 bp, Unknown
  misc_feature (1)..( 11): Result.001 file - promoters70/1398545
gaaagaaagct

SEQ ID NO: 83339 - DNA, 10 bp, Unknown
  misc_feature (1)..( 10): Result.001 file - promoters70/1398545
tataataaac

SEQ ID NO: 83340 - DNA, 10 bp, Unknown
  misc_feature (1)..( 10): Result.001 file - promoters70/1398545
tgtaataata

SEQ ID NO: 83341 - DNA, 10 bp, Unknown
  misc_feature (1)..( 10): Result.001 file - promoters70/1398545
gttaaaaaag

SEQ ID NO: 83342 - DNA, 10 bp, Unknown
  misc_feature (1)..( 10): Result.001 file - promoters70/1398545
cataataatg

SEQ ID NO: 83343 - DNA, 10 bp, Unknown
  misc_feature (1)..( 10): Result.001 file - promoters70/1398545
attaataaaa

SEQ ID NO: 83344 - DNA, 10 bp, Unknown
  misc_feature (1)..( 10): Result.001 file - promoters70/1398545
tataaaaaaa

SEQ ID NO: 83345 - DNA, 10 bp, Unknown
  misc_feature (1)..( 10): Result.001 file - promoters70/1398545
attagtaaaa

SEQ ID NO: 83346 - DNA, 14 bp, Unknown
  misc_feature (1)..( 14): Result.001 file - promoters70/1398545
aactcttttgagaa

SEQ ID NO: 83347 - DNA, 14 bp, Unknown
  misc_feature (1)..( 14): Result.001 file - promoters70/1398545
aactcttttgaagt

SEQ ID NO: 83348 - DNA, 14 bp, Unknown
  misc_feature (1)..( 14): Result.001 file - promoters70/1398545
tactatttatacat

SEQ ID NO: 83349 - DNA, 14 bp, Unknown
  misc_feature (1)..( 14): Result.001 file - promoters70/1398545
atttcttttcacat

SEQ ID NO: 83350 - DNA, 14 bp, Unknown
  misc_feature (1)..( 14): Result.001 file - promoters70/1398545
gcctattaataaaa

SEQ ID NO: 83351 - DNA, 14 bp, Unknown
  misc_feature (1)..( 14): Result.001 file - promoters70/1398545
ttcttataaaaaaa

SEQ ID NO: 83352 - DNA, 14 bp, Unknown
  misc_feature (1)..( 14): Result.001 file - promoters70/1398545
tttgattagtaaaa

SEQ ID NO: 83353 - DNA, 11 bp, Unknown
  misc_feature (1)..( 11): Result.001 file - promoters70/1398545
ttgagaaaagt

SEQ ID NO: 83354 - DNA, 11 bp, Unknown
  misc_feature (1)..( 11): Result.001 file - promoters70/1398545
atgaaaaaata

SEQ ID NO: 83355 - DNA, 11 bp, Unknown
  misc_feature (1)..( 11): Result.001 file - promoters70/1398545
ttcaaaaaaat

SEQ ID NO: 83356 - DNA, 11 bp, Unknown
  misc_feature (1)..( 11): Result.001 file - promoters70/1398545
cttaaagatat

SEQ ID NO: 83357 - DNA, 11 bp, Unknown
  misc_feature (1)..( 11): Result.001 file - promoters70/1398545
ttcataaaata

SEQ ID NO: 83358 - DNA, 11 bp, Unknown
  misc_feature (1)..( 11): Result.001 file - promoters70/1398545
gtcaaacaaat

SEQ ID NO: 83359 - DNA, 12 bp, Unknown
  misc_feature (1)..( 12): Result.001 file - promoters70/1398545
aaggcccaataa

SEQ ID NO: 83360 - DNA, 12 bp, Unknown
  misc_feature (1)..( 12): Result.001 file - promoters70/1398545
aaagcccattaa

SEQ ID NO: 83361 - DNA, 12 bp, Unknown
  misc_feature (1)..( 12): Result.001 file - promoters70/1398545
aaggcccaaaac

SEQ ID NO: 83362 - DNA, 12 bp, Unknown
  misc_feature (1)..( 12): Result.001 file - promoters70/1398545
atggcccagtaa

SEQ ID NO: 83363 - DNA, 12 bp, Unknown
  misc_feature (1)..( 12): Result.001 file - promoters70/1398545
aaagcccaaaac

SEQ ID NO: 83364 - DNA, 12 bp, Unknown
  misc_feature (1)..( 12): Result.001 file - promoters70/1398545
tcggcccaccgg

SEQ ID NO: 83365 - DNA, 15 bp, Unknown
  misc_feature (1)..( 15): Result.001 file - promoters70/1398545
tctctcgtataattc

SEQ ID NO: 83366 - DNA, 15 bp, Unknown
  misc_feature (1)..( 15): Result.001 file - promoters70/1398545
aaattaaactaattc

SEQ ID NO: 83367 - DNA, 15 bp, Unknown
  misc_feature (1)..( 15): Result.001 file - promoters70/1398545
agtaacaactaattt

SEQ ID NO: 83368 - DNA, 15 bp, Unknown
  misc_feature (1)..( 15): Result.001 file - promoters70/1398545
cacaagaactaaact

SEQ ID NO: 83369 - DNA, 15 bp, Unknown
  misc_feature (1)..( 15): Result.001 file - promoters70/1398545
agagagatctagggt

SEQ ID NO: 83370 - DNA, 15 bp, Unknown
  misc_feature (1)..( 15): Result.001 file - promoters70/1398573
agagacatcaatttt

SEQ ID NO: 83371 - DNA, 9 bp, Unknown
  misc_feature (1)..( 9): Result.001 file - promoters70/1398573
atttagaaa

SEQ ID NO: 83372 - DNA, 9 bp, Unknown
  misc_feature (1)..( 9): Result.001 file - promoters70/1398573
caatagaaa

SEQ ID NO: 83373 - DNA, 9 bp, Unknown
  misc_feature (1)..( 9): Result.001 file - promoters70/1398573
attttgaaa

SEQ ID NO: 83374 - DNA, 8 bp, Unknown
  misc_feature (1)..( 8): Result.001 file - promoters70/1398573
aacagcat

SEQ ID NO: 83375 - DNA, 8 bp, Unknown
  misc_feature (1)..( 8): Result.001 file - promoters70/1398573
aacaacat

SEQ ID NO: 83376 - DNA, 8 bp, Unknown
  misc_feature (1)..( 8): Result.001 file - promoters70/1399325
aacgtatg

SEQ ID NO: 83377 - DNA, 11 bp, Unknown
  misc_feature (1)..( 11): Result.001 file - promoters70/1399325
aaagtaattta

SEQ ID NO: 83378 - DNA, 11 bp, Unknown
  misc_feature (1)..( 11): Result.001 file - promoters70/1399325
acagtagtttc

SEQ ID NO: 83379 - DNA, 11 bp, Unknown
  misc_feature (1)..( 11): Result.001 file - promoters70/1399325
aaattaaatca

SEQ ID NO: 83380 - DNA, 11 bp, Unknown
  misc_feature (1)..( 11): Result.001 file - promoters70/1399325
aaaataaacta

SEQ ID NO: 83381 - DNA, 11 bp, Unknown
  misc_feature (1)..( 11): Result.001 file - promoters70/1399325
tgttgagtttc

SEQ ID NO: 83382 - DNA, 10 bp, Unknown
  misc_feature (1)..( 10): Result.001 file - promoters70/1399325
taaattttaa

SEQ ID NO: 83383 - DNA, 10 bp, Unknown
  misc_feature (1)..( 10): Result.001 file - promoters70/1399325
caaatttgtt

SEQ ID NO: 83384 - DNA, 10 bp, Unknown
  misc_feature (1)..( 10): Result.001 file - promoters70/1399325
taaatatgtt

SEQ ID NO: 83385 - DNA, 10 bp, Unknown
  misc_feature (1)..( 10): Result.001 file - promoters70/1399325
taaataacat

SEQ ID NO: 83386 - DNA, 11 bp, Unknown
  misc_feature (1)..( 11): Result.001 file - promoters70/1399325
atagttaagtc

SEQ ID NO: 83387 - DNA, 11 bp, Unknown
  misc_feature (1)..( 11): Result.001 file - promoters70/1399325
ataattaaact

SEQ ID NO: 83388 - DNA, 11 bp, Unknown
  misc_feature (1)..( 11): Result.001 file - promoters70/1399325
cgggttacgtc

SEQ ID NO: 83389 - DNA, 11 bp, Unknown
  misc_feature (1)..( 11): Result.001 file - promoters70/1399345
aaaattaaatc

SEQ ID NO: 83390 - DNA, 12 bp, Unknown
  misc_feature (1)..( 12): Result.001 file - promoters70/1399345
tataaacttttc

SEQ ID NO: 83391 - DNA, 12 bp, Unknown
  misc_feature (1)..( 12): Result.001 file - promoters70/1399345
aaaaaagttttt

SEQ ID NO: 83392 - DNA, 12 bp, Unknown
  misc_feature (1)..( 12): Result.001 file - promoters70/1399345
actttagttttg

SEQ ID NO: 83393 - DNA, 12 bp, Unknown
  misc_feature (1)..( 12): Result.001 file - promoters70/1399345
actagggttttt

SEQ ID NO: 83394 - DNA, 13 bp, Unknown
  misc_feature (1)..( 13): Result.001 file - promoters70/1399345
ttgaacgttgttg

SEQ ID NO: 83395 - DNA, 13 bp, Unknown
  misc_feature (1)..( 13): Result.001 file - promoters70/1399726
aaaaaagtgttga

SEQ ID NO: 83396 - DNA, 11 bp, Unknown
  misc_feature (1)..( 11): Result.001 file - promoters70/1399726
ccaattcattt

SEQ ID NO: 83397 - DNA, 11 bp, Unknown
  misc_feature (1)..( 11): Result.001 file - promoters70/1399726
ccaattaattt

SEQ ID NO: 83398 - DNA, 11 bp, Unknown
  misc_feature (1)..( 11): Result.001 file - promoters70/1399726
gtaataaatga

SEQ ID NO: 83399 - DNA, 8 bp, Unknown
  misc_feature (1)..( 8): Result.001 file - promoters70/1399726
agtaataa

SEQ ID NO: 83400 - DNA, 8 bp, Unknown
  misc_feature (1)..( 8): Result.001 file - promoters70/1399726
agtgataa

SEQ ID NO: 83401 - DNA, 8 bp, Unknown
  misc_feature (1)..( 8): Result.001 file - promoters70/1399726
aatgataa

SEQ ID NO: 83402 - DNA, 8 bp, Unknown
  misc_feature (1)..( 8): Result.001 file - promoters70/1399726
caaattct

SEQ ID NO: 83403 - DNA, 8 bp, Unknown
  misc_feature (1)..( 8): Result.001 file - promoters70/1399726
caaattaa

SEQ ID NO: 83404 - DNA, 8 bp, Unknown
  misc_feature (1)..( 8): Result.001 file - promoters70/1399726
caaactct

SEQ ID NO: 83405 - DNA, 13 bp, Unknown
  misc_feature (1)..( 13): Result.001 file - promoters70/1399726
gtcttacacaaat

SEQ ID NO: 83406 - DNA, 13 bp, Unknown
  misc_feature (1)..( 13): Result.001 file - promoters70/1399726
gatcaacaaaaat

SEQ ID NO: 83407 - DNA, 13 bp, Unknown
  misc_feature (1)..( 13): Result.001 file - promoters70/1399726
ctttcacaccaaa

SEQ ID NO: 83408 - DNA, 8 bp, Unknown
  misc_feature (1)..( 8): Result.001 file - promoters70/1399726
aagcaaaa

SEQ ID NO: 83409 - DNA, 8 bp, Unknown
  misc_feature (1)..( 8): Result.001 file - promoters70/1399726
aagaaaaa

SEQ ID NO: 83410 - DNA, 8 bp, Unknown
  misc_feature (1)..( 8): Result.001 file - promoters70/1399726
aaacaaag

SEQ ID NO: 83411 - DNA, 11 bp, Unknown
  misc_feature (1)..( 11): Result.001 file - promoters70/1399726
aaaatgaaaaa

SEQ ID NO: 83412 - DNA, 11 bp, Unknown
  misc_feature (1)..( 11): Result.001 file - promoters70/1399726
aaaaagaaaac

SEQ ID NO: 83413 - DNA, 11 bp, Unknown
  misc_feature (1)..( 11): Result.001 file - promoters70/1399726
ataataaaaaa

SEQ ID NO: 83414 - DNA, 8 bp, Unknown
  misc_feature (1)..( 8): Result.001 file - promoters70/1399726
taaagtac

SEQ ID NO: 83415 - DNA, 8 bp, Unknown
  misc_feature (1)..( 8): Result.001 file - promoters70/1399726
caaaatac

SEQ ID NO: 83416 - DNA, 8 bp, Unknown
  misc_feature (1)..( 8): Result.001 file - promoters70/1399726
caaaattt

SEQ ID NO: 83417 - DNA, 8 bp, Unknown
  misc_feature (1)..( 8): Result.001 file - promoters70/1399726
aaaacatc

SEQ ID NO: 83418 - DNA, 8 bp, Unknown
  misc_feature (1)..( 8): Result.001 file - promoters70/1399726
aaaacaaa

SEQ ID NO: 83419 - DNA, 8 bp, Unknown
  misc_feature (1)..( 8): Result.001 file - promoters70/1399726
gaaagaaa

SEQ ID NO: 83420 - DNA, 11 bp, Unknown
  misc_feature (1)..( 11): Result.001 file - promoters70/1399726
aaaaacgaaaa

SEQ ID NO: 83421 - DNA, 11 bp, Unknown
  misc_feature (1)..( 11): Result.001 file - promoters70/1399726
aaaaaagaaga

SEQ ID NO: 83422 - DNA, 11 bp, Unknown
  misc_feature (1)..( 11): Result.001 file - promoters70/1411616
aaaaaagaaaa

SEQ ID NO: 83423 - DNA, 8 bp, Unknown
  misc_feature (1)..( 8): Result.001 file - promoters70/1411616
taaaacag

SEQ ID NO: 83424 - DNA, 8 bp, Unknown
  misc_feature (1)..( 8): Result.001 file - promoters70/1411616
aaaatcag

SEQ ID NO: 83425 - DNA, 8 bp, Unknown
  misc_feature (1)..( 8): Result.001 file - promoters70/1413191
aaaatcct

SEQ ID NO: 83426 - DNA, 10 bp, Unknown
  misc_feature (1)..( 10): Result.001 file - promoters70/1413191
gtttcttaag

SEQ ID NO: 83427 - DNA, 10 bp, Unknown
  misc_feature (1)..( 10): Result.001 file - promoters70/1413191
cttttttatc

SEQ ID NO: 83428 - DNA, 10 bp, Unknown
  misc_feature (1)..( 10): Result.001 file - promoters70/1413191
aaatcttaat

SEQ ID NO: 83429 - DNA, 10 bp, Unknown
  misc_feature (1)..( 10): Result.001 file - promoters70/1413191
ttgtcttttt

SEQ ID NO: 83430 - DNA, 14 bp, Unknown
  misc_feature (1)..( 14): Result.001 file - promoters70/1413191
tgaggaaaaaaaac

SEQ ID NO: 83431 - DNA, 14 bp, Unknown
  misc_feature (1)..( 14): Result.001 file - promoters70/1413191
caaccaaaagaaat

SEQ ID NO: 83432 - DNA, 14 bp, Unknown
  misc_feature (1)..( 14): Result.001 file - promoters70/1413191
caatcaaaagccct

SEQ ID NO: 83433 - DNA, 14 bp, Unknown
  misc_feature (1)..( 14): Result.001 file - promoters70/1413191
atctctaaaggccc

SEQ ID NO: 83434 - DNA, 10 bp, Unknown
  misc_feature (1)..( 10): Result.001 file - promoters70/1413191
taaatgttgc

SEQ ID NO: 83435 - DNA, 10 bp, Unknown
  misc_feature (1)..( 10): Result.001 file - promoters70/1413191
tttatgttgt

SEQ ID NO: 83436 - DNA, 10 bp, Unknown
  misc_feature (1)..( 10): Result.001 file - promoters70/1413191
tttttgttga

SEQ ID NO: 83437 - DNA, 10 bp, Unknown
  misc_feature (1)..( 10): Result.001 file - promoters70/1413191
tgtctgttga

SEQ ID NO: 83438 - DNA, 7 bp, Unknown
  misc_feature (1)..( 7): Result.001 file - promoters70/1413191
atataaa

SEQ ID NO: 83439 - DNA, 7 bp, Unknown
  misc_feature (1)..( 7): Result.001 file - promoters70/1413191
atataaa

SEQ ID NO: 83440 - DNA, 7 bp, Unknown
  misc_feature (1)..( 7): Result.001 file - promoters70/1413191
atataag

SEQ ID NO: 83441 - DNA, 7 bp, Unknown
  misc_feature (1)..( 7): Result.001 file - promoters70/1441044
ctataaa

SEQ ID NO: 83442 - DNA, 13 bp, Unknown
  misc_feature (1)..( 13): Result.001 file - promoters70/1441044
tcaaatttttttt

SEQ ID NO: 83443 - DNA, 13 bp, Unknown
  misc_feature (1)..( 13): Result.001 file - promoters70/1441044
acaaacttttttt

SEQ ID NO: 83444 - DNA, 13 bp, Unknown
  misc_feature (1)..( 13): Result.001 file - promoters70/1441044
acaaacattaaga

SEQ ID NO: 83445 - DNA, 9 bp, Unknown
  misc_feature (1)..( 9): Result.001 file - promoters70/1441044
aactaaacc

SEQ ID NO: 83446 - DNA, 9 bp, Unknown
  misc_feature (1)..( 9): Result.001 file - promoters70/1441044
aactaaacc

SEQ ID NO: 83447 - DNA, 9 bp, Unknown
  misc_feature (1)..( 9): Result.001 file - promoters70/1441044
aactaatca

SEQ ID NO: 83448 - DNA, 7 bp, Unknown
  misc_feature (1)..( 7): Result.001 file - promoters70/1441044
aaataat

SEQ ID NO: 83449 - DNA, 7 bp, Unknown
  misc_feature (1)..( 7): Result.001 file - promoters70/1441044
aaacaat

SEQ ID NO: 83450 - DNA, 7 bp, Unknown
  misc_feature (1)..( 7): Result.001 file - promoters70/1441184
aaacaaa

SEQ ID NO: 83451 - DNA, 19 bp, Unknown
  misc_feature (1)..( 19): Result.001 file - promoters70/1441184
tatataaatcccttaaacc

SEQ ID NO: 83452 - DNA, 19 bp, Unknown
  misc_feature (1)..( 19): Result.001 file - promoters70/1441184
ataaataatctcttaaaac

SEQ ID NO: 83453 - DNA, 19 bp, Unknown
  misc_feature (1)..( 19): Result.001 file - promoters70/1441184
tatataaatccttcactcg

SEQ ID NO: 83454 - DNA, 19 bp, Unknown
  misc_feature (1)..( 19): Result.001 file - promoters70/1441184
tataaacaaaccttaaacc

SEQ ID NO: 83455 - DNA, 19 bp, Unknown
  misc_feature (1)..( 19): Result.001 file - promoters70/1441184
tgtataaaaacacttgcga

SEQ ID NO: 83456 - DNA, 19 bp, Unknown
  misc_feature (1)..( 19): Result.001 file - promoters70/1441184
actataaatactctcggtt

SEQ ID NO: 83457 - DNA, 12 bp, Unknown
  misc_feature (1)..( 12): Result.001 file - promoters70/1441184
gtatataaatcc

SEQ ID NO: 83458 - DNA, 12 bp, Unknown
  misc_feature (1)..( 12): Result.001 file - promoters70/1441184
gtataaaaacac

SEQ ID NO: 83459 - DNA, 12 bp, Unknown
  misc_feature (1)..( 12): Result.001 file - promoters70/1441184
ttatataaatcc

SEQ ID NO: 83460 - DNA, 12 bp, Unknown
  misc_feature (1)..( 12): Result.001 file - promoters70/1441184
cactataaacaa

SEQ ID NO: 83461 - DNA, 12 bp, Unknown
  misc_feature (1)..( 12): Result.001 file - promoters70/1441184
aactataaatac

SEQ ID NO: 83462 - DNA, 12 bp, Unknown
  misc_feature (1)..( 12): Result.001 file - promoters70/1441657
tcttataaataa

SEQ ID NO: 83463 - DNA, 11 bp, Unknown
  misc_feature (1)..( 11): Result.001 file - promoters70/1441657
atcttctgtct

SEQ ID NO: 83464 - DNA, 11 bp, Unknown
  misc_feature (1)..( 11): Result.001 file - promoters70/1441657
cacttgtgttt

SEQ ID NO: 83465 - DNA, 11 bp, Unknown
  misc_feature (1)..( 11): Result.001 file - promoters70/1441657
atcttctaaaa

SEQ ID NO: 83466 - DNA, 11 bp, Unknown
  misc_feature (1)..( 11): Result.001 file - promoters70/1441657
taattgtattt

SEQ ID NO: 83467 - DNA, 7 bp, Unknown
  misc_feature (1)..( 7): Result.001 file - promoters70/1441657
ccaaaca

SEQ ID NO: 83468 - DNA, 7 bp, Unknown
  misc_feature (1)..( 7): Result.001 file - promoters70/1441657
ccaaacc

SEQ ID NO: 83469 - DNA, 7 bp, Unknown
  misc_feature (1)..( 7): Result.001 file - promoters70/1441657
tcaaacc

SEQ ID NO: 83470 - DNA, 9 bp, Unknown
  misc_feature (1)..( 9): Result.001 file - promoters70/1441657
aaattttca

SEQ ID NO: 83471 - DNA, 9 bp, Unknown
  misc_feature (1)..( 9): Result.001 file - promoters70/1441657
taatttttg

SEQ ID NO: 83472 - DNA, 9 bp, Unknown
  misc_feature (1)..( 9): Result.001 file - promoters70/1441657
aaatattca

SEQ ID NO: 83473 - DNA, 7 bp, Unknown
  misc_feature (1)..( 7): Result.001 file - promoters70/1441657
caaaatt

SEQ ID NO: 83474 - DNA, 7 bp, Unknown
  misc_feature (1)..( 7): Result.001 file - promoters70/1441657
caatatt

SEQ ID NO: 83475 - DNA, 7 bp, Unknown
  misc_feature (1)..( 7): Result.001 file - promoters70/1441665
caatatg

SEQ ID NO: 83476 - DNA, 13 bp, Unknown
  misc_feature (1)..( 13): Result.001 file - promoters70/1441665
catataaaacgat

SEQ ID NO: 83477 - DNA, 13 bp, Unknown
  misc_feature (1)..( 13): Result.001 file - promoters70/1441665
gatacaaaaccct

SEQ ID NO: 83478 - DNA, 13 bp, Unknown
  misc_feature (1)..( 13): Result.001 file - promoters70/1441665
gagacaaatagaa

SEQ ID NO: 83479 - DNA, 13 bp, Unknown
  misc_feature (1)..( 13): Result.001 file - promoters70/1441665
tatataaaaccaa

SEQ ID NO: 83480 - DNA, 13 bp, Unknown
  misc_feature (1)..( 13): Result.001 file - promoters70/1441665
gggaaaaaatcaa

SEQ ID NO: 83481 - DNA, 13 bp, Unknown
  misc_feature (1)..( 13): Result.001 file - promoters70/1441665
gagtcaaagaaat

SEQ ID NO: 83482 - DNA, 10 bp, Unknown
  misc_feature (1)..( 10): Result.001 file - promoters70/1441665
ataaaatggt

SEQ ID NO: 83483 - DNA, 10 bp, Unknown
  misc_feature (1)..( 10): Result.001 file - promoters70/1441665
ataaaaacag

SEQ ID NO: 83484 - DNA, 10 bp, Unknown
  misc_feature (1)..( 10): Result.001 file - promoters70/1441665
agaaaaaaaa

SEQ ID NO: 83485 - DNA, 10 bp, Unknown
  misc_feature (1)..( 10): Result.001 file - promoters70/1441665
agaagaaaca

SEQ ID NO: 83486 - DNA, 10 bp, Unknown
  misc_feature (1)..( 10): Result.001 file - promoters70/1441665
tcaaaaaatt

SEQ ID NO: 83487 - DNA, 10 bp, Unknown
  misc_feature (1)..( 10): Result.001 file - promoters70/1441665
caaagaaatt

SEQ ID NO: 83488 - DNA, 17 bp, Unknown
  misc_feature (1)..( 17): Result.001 file - promoters70/1441665
gtgttcaaaaaaatatt

SEQ ID NO: 83489 - DNA, 17 bp, Unknown
  misc_feature (1)..( 17): Result.001 file - promoters70/1441665
gtgatcaaatccgagcc

SEQ ID NO: 83490 - DNA, 17 bp, Unknown
  misc_feature (1)..( 17): Result.001 file - promoters70/1441665
taattcaaaaagcaaaa

SEQ ID NO: 83491 - DNA, 17 bp, Unknown
  misc_feature (1)..( 17): Result.001 file - promoters70/1441665
aaaaaaaaaaaggaaaa

SEQ ID NO: 83492 - DNA, 17 bp, Unknown
  misc_feature (1)..( 17): Result.001 file - promoters70/1441665
aaattccaaattttgaa

SEQ ID NO: 83493 - DNA, 17 bp, Unknown
  misc_feature (1)..( 17): Result.001 file - promoters70/1441665
aaaatcaaaaaattatt

SEQ ID NO: 83494 - DNA, 12 bp, Unknown
  misc_feature (1)..( 12): Result.001 file - promoters70/1441665
cactatataaag

SEQ ID NO: 83495 - DNA, 12 bp, Unknown
  misc_feature (1)..( 12): Result.001 file - promoters70/1441665
cactatttaaag

SEQ ID NO: 83496 - DNA, 12 bp, Unknown
  misc_feature (1)..( 12): Result.001 file - promoters70/1441665
tcttatatataa

SEQ ID NO: 83497 - DNA, 12 bp, Unknown
  misc_feature (1)..( 12): Result.001 file - promoters70/1441665
tactattaaagc

SEQ ID NO: 83498 - DNA, 12 bp, Unknown
  misc_feature (1)..( 12): Result.001 file - promoters70/1441665
tttaattaaaac

SEQ ID NO: 83499 - DNA, 12 bp, Unknown
  misc_feature (1)..( 12): Result.001 file - promoters70/1441665
gcttatttatga

SEQ ID NO: 83500 - DNA, 12 bp, Unknown
  misc_feature (1)..( 12): Result.001 file - promoters70/1441665
ggtcatttaaag

SEQ ID NO: 83501 - DNA, 12 bp, Unknown
  misc_feature (1)..( 12): Result.001 file - promoters70/1441665
ctcttatgattt

SEQ ID NO: 83502 - DNA, 12 bp, Unknown
  misc_feature (1)..( 12): Result.001 file - promoters70/1441665
ttcttaggattc

SEQ ID NO: 83503 - DNA, 12 bp, Unknown
  misc_feature (1)..( 12): Result.001 file - promoters70/1441665
ctcgtataattc

SEQ ID NO: 83504 - DNA, 12 bp, Unknown
  misc_feature (1)..( 12): Result.001 file - promoters70/1441665
ttcttattggaa

SEQ ID NO: 83505 - DNA, 12 bp, Unknown
  misc_feature (1)..( 12): Result.001 file - promoters70/1441665
cttccatgtttt

SEQ ID NO: 83506 - DNA, 12 bp, Unknown
  misc_feature (1)..( 12): Result.001 file - promoters70/1441665
ttcgtttaacag

SEQ ID NO: 83507 - DNA, 8 bp, Unknown
  misc_feature (1)..( 8): Result.001 file - promoters70/1441665
aatgggcc

SEQ ID NO: 83508 - DNA, 8 bp, Unknown
  misc_feature (1)..( 8): Result.001 file - promoters70/1441665
tatgggcc

SEQ ID NO: 83509 - DNA, 8 bp, Unknown
  misc_feature (1)..( 8): Result.001 file - promoters70/1441665
aatgggtc

SEQ ID NO: 83510 - DNA, 8 bp, Unknown
  misc_feature (1)..( 8): Result.001 file - promoters70/1441665
tttgggcc

SEQ ID NO: 83511 - DNA, 8 bp, Unknown
  misc_feature (1)..( 8): Result.001 file - promoters70/1441665
tgtgggcc

SEQ ID NO: 83512 - DNA, 8 bp, Unknown
  misc_feature (1)..( 8): Result.001 file - promoters70/1441665
tttcggcc

SEQ ID NO: 83513 - DNA, 9 bp, Unknown
  misc_feature (1)..( 9): Result.001 file - promoters70/1441665
caaacaaaa

SEQ ID NO: 83514 - DNA, 9 bp, Unknown
  misc_feature (1)..( 9): Result.001 file - promoters70/1441665
gaaacaaag

SEQ ID NO: 83515 - DNA, 9 bp, Unknown
  misc_feature (1)..( 9): Result.001 file - promoters70/1441665
caaagaaat

SEQ ID NO: 83516 - DNA, 9 bp, Unknown
  misc_feature (1)..( 9): Result.001 file - promoters70/1441665
aaaaaaaaa

SEQ ID NO: 83517 - DNA, 9 bp, Unknown
  misc_feature (1)..( 9): Result.001 file - promoters70/1441665
caaaaaatt

SEQ ID NO: 83518 - DNA, 9 bp, Unknown
  misc_feature (1)..( 9): Result.001 file - promoters70/1441814
aaaaccaag

SEQ ID NO: 83519 - DNA, 12 bp, Unknown
  misc_feature (1)..( 12): Result.001 file - promoters70/1441814
caacaatgtaca

SEQ ID NO: 83520 - DNA, 12 bp, Unknown
  misc_feature (1)..( 12): Result.001 file - promoters70/1441814
caataatttaca

SEQ ID NO: 83521 - DNA, 12 bp, Unknown
  misc_feature (1)..( 12): Result.001 file - promoters70/1441814
tgaaaatttata

SEQ ID NO: 83522 - DNA, 12 bp, Unknown
  misc_feature (1)..( 12): Result.001 file - promoters70/1441814
gtataattttat

SEQ ID NO: 83523 - DNA, 12 bp, Unknown
  misc_feature (1)..( 12): Result.001 file - promoters70/1441814
tgaaaattactc

SEQ ID NO: 83524 - DNA, 8 bp, Unknown
  misc_feature (1)..( 8): Result.001 file - promoters70/1441814
ataacttt

SEQ ID NO: 83525 - DNA, 8 bp, Unknown
  misc_feature (1)..( 8): Result.001 file - promoters70/1441814
ataactgt

SEQ ID NO: 83526 - DNA, 8 bp, Unknown
  misc_feature (1)..( 8): Result.001 file - promoters70/1441814
ataactct

SEQ ID NO: 83527 - DNA, 8 bp, Unknown
  misc_feature (1)..( 8): Result.001 file - promoters70/1441814
ataaaaac

SEQ ID NO: 83528 - DNA, 12 bp, Unknown
  misc_feature (1)..( 12): Result.001 file - promoters70/1441814
tacacaagattt

SEQ ID NO: 83529 - DNA, 12 bp, Unknown
  misc_feature (1)..( 12): Result.001 file - promoters70/1441814
tacataagtttt

SEQ ID NO: 83530 - DNA, 12 bp, Unknown
  misc_feature (1)..( 12): Result.001 file - promoters70/1441814
aacacaaaccca

SEQ ID NO: 83531 - DNA, 12 bp, Unknown
  misc_feature (1)..( 12): Result.001 file - promoters70/1441814
ttttgaagtttg

SEQ ID NO: 83532 - DNA, 11 bp, Unknown
  misc_feature (1)..( 11): Result.001 file - promoters70/1441814
ctttgcttaca

SEQ ID NO: 83533 - DNA, 11 bp, Unknown
  misc_feature (1)..( 11): Result.001 file - promoters70/1441814
ttttacttttt

SEQ ID NO: 83534 - DNA, 11 bp, Unknown
  misc_feature (1)..( 11): Result.001 file - promoters70/1441814
ttttaccagtg

SEQ ID NO: 83535 - DNA, 11 bp, Unknown
  misc_feature (1)..( 11): Result.001 file - promoters70/1441835
atatacttttt

SEQ ID NO: 83536 - DNA, 12 bp, Unknown
  misc_feature (1)..( 12): Result.001 file - promoters70/1441835
tttccatcgaat

SEQ ID NO: 83537 - DNA, 12 bp, Unknown
  misc_feature (1)..( 12): Result.001 file - promoters70/1441835
aacaaatcaaat

SEQ ID NO: 83538 - DNA, 12 bp, Unknown
  misc_feature (1)..( 12): Result.001 file - promoters70/1441835
gcaaaaccaaag

SEQ ID NO: 83539 - DNA, 12 bp, Unknown
  misc_feature (1)..( 12): Result.001 file - promoters70/1441835
tagcagtcaaat

SEQ ID NO: 83540 - DNA, 12 bp, Unknown
  misc_feature (1)..( 12): Result.001 file - promoters70/1441835
aaaacaccaaag

SEQ ID NO: 83541 - DNA, 12 bp, Unknown
  misc_feature (1)..( 12): Result.001 file - promoters70/1441835
tggcaagtaaaa

SEQ ID NO: 83542 - DNA, 12 bp, Unknown
  misc_feature (1)..( 12): Result.001 file - promoters70/1441835
aaaactccaaat

SEQ ID NO: 83543 - DNA, 11 bp, Unknown
  misc_feature (1)..( 11): Result.001 file - promoters70/1441835
aattcaagacc

SEQ ID NO: 83544 - DNA, 11 bp, Unknown
  misc_feature (1)..( 11): Result.001 file - promoters70/1441835
atggcaaaacc

SEQ ID NO: 83545 - DNA, 11 bp, Unknown
  misc_feature (1)..( 11): Result.001 file - promoters70/1441835
aaatcaaatcg

SEQ ID NO: 83546 - DNA, 11 bp, Unknown
  misc_feature (1)..( 11): Result.001 file - promoters70/1441835
cagtcaaatat

SEQ ID NO: 83547 - DNA, 11 bp, Unknown
  misc_feature (1)..( 11): Result.001 file - promoters70/1441835
aacacaactca

SEQ ID NO: 83548 - DNA, 11 bp, Unknown
  misc_feature (1)..( 11): Result.001 file - promoters70/1441835
aagtaaaaaag

SEQ ID NO: 83549 - DNA, 11 bp, Unknown
  misc_feature (1)..( 11): Result.001 file - promoters70/1441859
gtgtaaaacac

SEQ ID NO: 83550 - DNA, 9 bp, Unknown
  misc_feature (1)..( 9): Result.001 file - promoters70/1441859
ataaaaata

SEQ ID NO: 83551 - DNA, 9 bp, Unknown
  misc_feature (1)..( 9): Result.001 file - promoters70/1441859
ctaaaaact

SEQ ID NO: 83552 - DNA, 9 bp, Unknown
  misc_feature (1)..( 9): Result.001 file - promoters70/1441859
ataataata

SEQ ID NO: 83553 - DNA, 9 bp, Unknown
  misc_feature (1)..( 9): Result.001 file - promoters70/1441859
ctaaaaaaa

SEQ ID NO: 83554 - DNA, 8 bp, Unknown
  misc_feature (1)..( 8): Result.001 file - promoters70/1441859
ttaattta

SEQ ID NO: 83555 - DNA, 8 bp, Unknown
  misc_feature (1)..( 8): Result.001 file - promoters70/1441859
ttattttg

SEQ ID NO: 83556 - DNA, 8 bp, Unknown
  misc_feature (1)..( 8): Result.001 file - promoters70/1441859
atatttta

SEQ ID NO: 83557 - DNA, 8 bp, Unknown
  misc_feature (1)..( 8): Result.001 file - promoters70/1441912
atatcttg

SEQ ID NO: 83558 - DNA, 10 bp, Unknown
  misc_feature (1)..( 10): Result.001 file - promoters70/1441912
gtttggtttt

SEQ ID NO: 83559 - DNA, 10 bp, Unknown
  misc_feature (1)..( 10): Result.001 file - promoters70/1441912
atttgatttt

SEQ ID NO: 83560 - DNA, 10 bp, Unknown
  misc_feature (1)..( 10): Result.001 file - promoters70/1441912
gttgggttta

SEQ ID NO: 83561 - DNA, 6 bp, Unknown
  misc_feature (1)..( 6): Result.001 file - promoters70/1441912
tatata

SEQ ID NO: 83562 - DNA, 6 bp, Unknown
  misc_feature (1)..( 6): Result.001 file - promoters70/1441912
tatata

SEQ ID NO: 83563 - DNA, 6 bp, Unknown
  misc_feature (1)..( 6): Result.001 file - promoters70/1441912
tatata

SEQ ID NO: 83564 - DNA, 10 bp, Unknown
  misc_feature (1)..( 10): Result.001 file - promoters70/1441912
tgagaaagtt

SEQ ID NO: 83565 - DNA, 10 bp, Unknown
  misc_feature (1)..( 10): Result.001 file - promoters70/1441912
aacaaaagtt

SEQ ID NO: 83566 - DNA, 10 bp, Unknown
  misc_feature (1)..( 10): Result.001 file - promoters70/1442156
aacacaagtt

SEQ ID NO: 83567 - DNA, 7 bp, Unknown
  misc_feature (1)..( 7): Result.001 file - promoters70/1442156
attttaa

SEQ ID NO: 83568 - DNA, 7 bp, Unknown
  misc_feature (1)..( 7): Result.001 file - promoters70/1442156
attttag

SEQ ID NO: 83569 - DNA, 7 bp, Unknown
  misc_feature (1)..( 7): Result.001 file - promoters70/1442156
attctag

SEQ ID NO: 83570 - DNA, 9 bp, Unknown
  misc_feature (1)..( 9): Result.001 file - promoters70/1442156
atatagtta

SEQ ID NO: 83571 - DNA, 9 bp, Unknown
  misc_feature (1)..( 9): Result.001 file - promoters70/1442156
aaataatta

SEQ ID NO: 83572 - DNA, 9 bp, Unknown
  misc_feature (1)..( 9): Result.001 file - promoters70/1442156
aaagaatca

SEQ ID NO: 83573 - DNA, 7 bp, Unknown
  misc_feature (1)..( 7): Result.001 file - promoters70/1442156
aatatac

SEQ ID NO: 83574 - DNA, 7 bp, Unknown
  misc_feature (1)..( 7): Result.001 file - promoters70/1442156
aatatat

SEQ ID NO: 83575 - DNA, 7 bp, Unknown
  misc_feature (1)..( 7): Result.001 file - promoters70/1442156
catatac

SEQ ID NO: 83576 - DNA, 7 bp, Unknown
  misc_feature (1)..( 7): Result.001 file - promoters70/1442156
aaaaaat

SEQ ID NO: 83577 - DNA, 7 bp, Unknown
  misc_feature (1)..( 7): Result.001 file - promoters70/1442156
aaaaaaa

SEQ ID NO: 83578 - DNA, 7 bp, Unknown
  misc_feature (1)..( 7): Result.001 file - promoters70/1442156
aaaaaag

SEQ ID NO: 83579 - DNA, 8 bp, Unknown
  misc_feature (1)..( 8): Result.001 file - promoters70/1442156
aaacaaaa

SEQ ID NO: 83580 - DNA, 7 bp, Unknown
  misc_feature (1)..( 7): Result.001 file - promoters70/1442156
tttattt

SEQ ID NO: 83581 - DNA, 7 bp, Unknown
  misc_feature (1)..( 7): Result.001 file - promoters70/1442156
tttattt

SEQ ID NO: 83582 - DNA, 7 bp, Unknown
  misc_feature (1)..( 7): Result.001 file - promoters70/1442156
tttatta

SEQ ID NO: 83583 - DNA, 10 bp, Unknown
  misc_feature (1)..( 10): Result.001 file - promoters70/1442156
ttagtcaaaa

SEQ ID NO: 83584 - DNA, 10 bp, Unknown
  misc_feature (1)..( 10): Result.001 file - promoters70/1442156
aaaatcaaaa

SEQ ID NO: 83585 - DNA, 10 bp, Unknown
  misc_feature (1)..( 10): Result.001 file - promoters70/1442156
aaaataaaaa

SEQ ID NO: 83586 - DNA, 7 bp, Unknown
  misc_feature (1)..( 7): Result.001 file - promoters70/1442156
aaaataa

SEQ ID NO: 83587 - DNA, 7 bp, Unknown
  misc_feature (1)..( 7): Result.001 file - promoters70/1442156
aaaatag

SEQ ID NO: 83588 - DNA, 7 bp, Unknown
  misc_feature (1)..( 7): Result.001 file - promoters70/1442156
aaaataa

SEQ ID NO: 83589 - DNA, 8 bp, Unknown
  misc_feature (1)..( 8): Result.001 file - promoters70/1442156
cgtcttct

SEQ ID NO: 83590 - DNA, 8 bp, Unknown
  misc_feature (1)..( 8): Result.001 file - promoters70/1442156
cttcttct

SEQ ID NO: 83591 - DNA, 8 bp, Unknown
  misc_feature (1)..( 8): Result.001 file - promoters70/1442156
cttcttca

SEQ ID NO: 83592 - DNA, 6 bp, Unknown
  misc_feature (1)..( 6): Result.001 file - promoters70/1442156
cacgtg

SEQ ID NO: 83593 - DNA, 6 bp, Unknown
  misc_feature (1)..( 6): Result.001 file - promoters70/1442156
cacgtg

SEQ ID NO: 83594 - DNA, 6 bp, Unknown
  misc_feature (1)..( 6): Result.001 file - promoters70/1442156
cacgtg

SEQ ID NO: 83595 - DNA, 9 bp, Unknown
  misc_feature (1)..( 9): Result.001 file - promoters70/1442156
attaatatc

SEQ ID NO: 83596 - DNA, 9 bp, Unknown
  misc_feature (1)..( 9): Result.001 file - promoters70/1442156
attaattta

SEQ ID NO: 83597 - DNA, 9 bp, Unknown
  misc_feature (1)..( 9): Result.001 file - promoters70/1442156
tttatttta

SEQ ID NO: 83598 - DNA, 7 bp, Unknown
  misc_feature (1)..( 7): Result.001 file - promoters70/1442156
taattac

SEQ ID NO: 83599 - DNA, 7 bp, Unknown
  misc_feature (1)..( 7): Result.001 file - promoters70/1442156
aaattac

SEQ ID NO: 83600 - DNA, 7 bp, Unknown
  misc_feature (1)..( 7): Result.001 file - promoters70/1442408
aaattat

SEQ ID NO: 83601 - DNA, 8 bp, Unknown
  misc_feature (1)..( 8): Result.001 file - promoters70/1442408
cttccttt

SEQ ID NO: 83602 - DNA, 8 bp, Unknown
  misc_feature (1)..( 8): Result.001 file - promoters70/1442408
cttctttt

SEQ ID NO: 83603 - DNA, 8 bp, Unknown
  misc_feature (1)..( 8): Result.001 file - promoters70/1442427
actctttt

SEQ ID NO: 83604 - DNA, 10 bp, Unknown
  misc_feature (1)..( 10): Result.001 file - promoters70/1442427
taaatttgct

SEQ ID NO: 83605 - DNA, 10 bp, Unknown
  misc_feature (1)..( 10): Result.001 file - promoters70/1442427
taaatttaaa

SEQ ID NO: 83606 - DNA, 10 bp, Unknown
  misc_feature (1)..( 10): Result.001 file - promoters70/1442476
tgaatctgct

SEQ ID NO: 83607 - DNA, 16 bp, Unknown
  misc_feature (1)..( 16): Result.001 file - promoters70/1442476
agcaaagaattgacca

SEQ ID NO: 83608 - DNA, 16 bp, Unknown
  misc_feature (1)..( 16): Result.001 file - promoters70/1442476
gctgctgaattggaat

SEQ ID NO: 83609 - DNA, 16 bp, Unknown
  misc_feature (1)..( 16): Result.001 file - promoters70/1442476
cttgtggaaatgacgt

SEQ ID NO: 83610 - DNA, 16 bp, Unknown
  misc_feature (1)..( 16): Result.001 file - promoters70/1442476
tcttatgatttgcttc

SEQ ID NO: 83611 - DNA, 16 bp, Unknown
  misc_feature (1)..( 16): Result.001 file - promoters70/1442476
acagcagtattagctt

SEQ ID NO: 83612 - DNA, 16 bp, Unknown
  misc_feature (1)..( 16): Result.001 file - promoters70/1442476
ctcgtataattctttt

SEQ ID NO: 83613 - DNA, 16 bp, Unknown
  misc_feature (1)..( 16): Result.001 file - promoters70/1442476
ttacgccaaaagacac

SEQ ID NO: 83614 - DNA, 8 bp, Unknown
  misc_feature (1)..( 8): Result.001 file - promoters70/1442476
gaaaaaaa

SEQ ID NO: 83615 - DNA, 8 bp, Unknown
  misc_feature (1)..( 8): Result.001 file - promoters70/1442476
caaaaaaa

SEQ ID NO: 83616 - DNA, 9 bp, Unknown
  misc_feature (1)..( 9): Result.001 file - promoters70/1442476
aaactaaaa

SEQ ID NO: 83617 - DNA, 9 bp, Unknown
  misc_feature (1)..( 9): Result.001 file - promoters70/1442476
aaaccaaac

SEQ ID NO: 83618 - DNA, 9 bp, Unknown
  misc_feature (1)..( 9): Result.001 file - promoters70/1442476
tgaccaaac

SEQ ID NO: 83619 - DNA, 9 bp, Unknown
  misc_feature (1)..( 9): Result.001 file - promoters70/1442504
taactaaaa

SEQ ID NO: 83620 - DNA, 11 bp, Unknown
  misc_feature (1)..( 11): Result.001 file - promoters70/1442504
attatctctct

SEQ ID NO: 83621 - DNA, 11 bp, Unknown
  misc_feature (1)..( 11): Result.001 file - promoters70/1442504
tgagtctctct

SEQ ID NO: 83622 - DNA, 11 bp, Unknown
  misc_feature (1)..( 11): Result.001 file - promoters70/1442504
attatctctca

SEQ ID NO: 83623 - DNA, 11 bp, Unknown
  misc_feature (1)..( 11): Result.001 file - promoters70/1442504
ttgttctattt

SEQ ID NO: 83624 - DNA, 11 bp, Unknown
  misc_feature (1)..( 11): Result.001 file - promoters70/1442504
taattatattt

SEQ ID NO: 83625 - DNA, 11 bp, Unknown
  misc_feature (1)..( 11): Result.001 file - promoters70/1442649
aaaatctctgt

SEQ ID NO: 83626 - DNA, 8 bp, Unknown
  misc_feature (1)..( 8): Result.001 file - promoters70/1442649
aaatagtt

SEQ ID NO: 83627 - DNA, 8 bp, Unknown
  misc_feature (1)..( 8): Result.001 file - promoters70/1442649
gaatagta

SEQ ID NO: 83628 - DNA, 9 bp, Unknown
  misc_feature (1)..( 9): Result.001 file - promoters70/1442649
taactagtt

SEQ ID NO: 83629 - DNA, 7 bp, Unknown
  misc_feature (1)..( 7): Result.001 file - promoters70/1442649
atatcat

SEQ ID NO: 83630 - DNA, 7 bp, Unknown
  misc_feature (1)..( 7): Result.001 file - promoters70/1442649
atatcaa

SEQ ID NO: 83631 - DNA, 7 bp, Unknown
  misc_feature (1)..( 7): Result.001 file - promoters70/1442649
ttatcat

SEQ ID NO: 83632 - DNA, 6 bp, Unknown
  misc_feature (1)..( 6): Result.001 file - promoters70/1442649
tattta

SEQ ID NO: 83633 - DNA, 6 bp, Unknown
  misc_feature (1)..( 6): Result.001 file - promoters70/1442649
tattta

SEQ ID NO: 83634 - DNA, 6 bp, Unknown
  misc_feature (1)..( 6): Result.001 file - promoters70/1442880
tattta

SEQ ID NO: 83635 - DNA, 9 bp, Unknown
  misc_feature (1)..( 9): Result.001 file - promoters70/1442880
ttctctttt

SEQ ID NO: 83636 - DNA, 9 bp, Unknown
  misc_feature (1)..( 9): Result.001 file - promoters70/1442880
acctctttt

SEQ ID NO: 83637 - DNA, 9 bp, Unknown
  misc_feature (1)..( 9): Result.001 file - promoters70/1442880
accccttag

SEQ ID NO: 83638 - DNA, 7 bp, Unknown
  misc_feature (1)..( 7): Result.001 file - promoters70/1442880
aatttac

SEQ ID NO: 83639 - DNA, 7 bp, Unknown
  misc_feature (1)..( 7): Result.001 file - promoters70/1442880
aatctac

SEQ ID NO: 83640 - DNA, 7 bp, Unknown
  misc_feature (1)..( 7): Result.001 file - promoters70/1442880
aatttat

SEQ ID NO: 83641 - DNA, 11 bp, Unknown
  misc_feature (1)..( 11): Result.001 file - promoters70/1442880
ctaaaatagta

SEQ ID NO: 83642 - DNA, 11 bp, Unknown
  misc_feature (1)..( 11): Result.001 file - promoters70/1442880
aaataattgta

SEQ ID NO: 83643 - DNA, 11 bp, Unknown
  misc_feature (1)..( 11): Result.001 file - promoters70/1442880
aaagaattgaa

SEQ ID NO: 83644 - DNA, 8 bp, Unknown
  misc_feature (1)..( 8): Result.001 file - promoters70/1442880
aaggtata

SEQ ID NO: 83645 - DNA, 8 bp, Unknown
  misc_feature (1)..( 8): Result.001 file - promoters70/1442880
aagctata

SEQ ID NO: 83646 - DNA, 8 bp, Unknown
  misc_feature (1)..( 8): Result.001 file - promoters70/1442880
cagcaata

SEQ ID NO: 83647 - DNA, 10 bp, Unknown
  misc_feature (1)..( 10): Result.001 file - promoters70/1442880
ttactaaaat

SEQ ID NO: 83648 - DNA, 10 bp, Unknown
  misc_feature (1)..( 10): Result.001 file - promoters70/1442880
ttattaattt

SEQ ID NO: 83649 - DNA, 11 bp, Unknown
  misc_feature (1)..( 11): Result.001 file - promoters70/1442880
gaactgaaaga

SEQ ID NO: 83650 - DNA, 11 bp, Unknown
  misc_feature (1)..( 11): Result.001 file - promoters70/1442880
ttgtataaatt

SEQ ID NO: 83651 - DNA, 9 bp, Unknown
  misc_feature (1)..( 9): Result.001 file - promoters70/1442880
aaagaagaa

SEQ ID NO: 83652 - DNA, 9 bp, Unknown
  misc_feature (1)..( 9): Result.001 file - promoters70/1442880
aaagaattg

SEQ ID NO: 83653 - DNA, 9 bp, Unknown
  misc_feature (1)..( 9): Result.001 file - promoters70/1442880
aaataattg

SEQ ID NO: 83654 - DNA, 13 bp, Unknown
  misc_feature (1)..( 13): Result.001 file - promoters70/1442880
aatatcaccgacg

SEQ ID NO: 83655 - DNA, 13 bp, Unknown
  misc_feature (1)..( 13): Result.001 file - promoters70/1442880
aatatcttgtaag

SEQ ID NO: 83656 - DNA, 13 bp, Unknown
  misc_feature (1)..( 13): Result.001 file - promoters70/1442880
aatctcaacgacg

SEQ ID NO: 83657 - DNA, 8 bp, Unknown
  misc_feature (1)..( 8): Result.001 file - promoters70/1442880
taatcata

SEQ ID NO: 83658 - DNA, 8 bp, Unknown
  misc_feature (1)..( 8): Result.001 file - promoters70/1442880
aaataata

SEQ ID NO: 83659 - DNA, 8 bp, Unknown
  misc_feature (1)..( 8): Result.001 file - promoters70/1442975
aaacaatc

SEQ ID NO: 83660 - DNA, 12 bp, Unknown
  misc_feature (1)..( 12): Result.001 file - promoters70/1442975
ctttttgtttat

SEQ ID NO: 83661 - DNA, 12 bp, Unknown
  misc_feature (1)..( 12): Result.001 file - promoters70/1442975
tgatttgtatat

SEQ ID NO: 83662 - DNA, 12 bp, Unknown
  misc_feature (1)..( 12): Result.001 file - promoters70/1442975
cttattgtataa

SEQ ID NO: 83663 - DNA, 8 bp, Unknown
  misc_feature (1)..( 8): Result.001 file - promoters70/1442975
gctggatt

SEQ ID NO: 83664 - DNA, 8 bp, Unknown
  misc_feature (1)..( 8): Result.001 file - promoters70/1442975
tctgaatt

SEQ ID NO: 83665 - DNA, 8 bp, Unknown
  misc_feature (1)..( 8): Result.001 file - promoters70/1442993
tctgaaca

SEQ ID NO: 83666 - DNA, 13 bp, Unknown
  misc_feature (1)..( 13): Result.001 file - promoters70/1442993
ctaaaatagtaaa

SEQ ID NO: 83667 - DNA, 13 bp, Unknown
  misc_feature (1)..( 13): Result.001 file - promoters70/1442993
aaataattgtata

SEQ ID NO: 83668 - DNA, 13 bp, Unknown
  misc_feature (1)..( 13): Result.001 file - promoters70/1442993
tcatatttgtata

SEQ ID NO: 83669 - DNA, 13 bp, Unknown
  misc_feature (1)..( 13): Result.001 file - promoters70/1442993
aaagaattgaaca

SEQ ID NO: 83670 - DNA, 10 bp, Unknown
  misc_feature (1)..( 10): Result.001 file - promoters70/1442993
gaaaaagata

SEQ ID NO: 83671 - DNA, 10 bp, Unknown
  misc_feature (1)..( 10): Result.001 file - promoters70/1442993
gaaatagatt

SEQ ID NO: 83672 - DNA, 10 bp, Unknown
  misc_feature (1)..( 10): Result.001 file - promoters70/1442993
ttagtagatt

SEQ ID NO: 83673 - DNA, 10 bp, Unknown
  misc_feature (1)..( 10): Result.001 file - promoters70/1442993
tatataaatt

SEQ ID NO: 83674 - DNA, 10 bp, Unknown
  misc_feature (1)..( 10): Result.001 file - promoters70/1442993
ttactaaaat

SEQ ID NO: 83675 - DNA, 10 bp, Unknown
  misc_feature (1)..( 10): Result.001 file - promoters70/1442993
ttattaattt

SEQ ID NO: 83676 - DNA, 11 bp, Unknown
  misc_feature (1)..( 11): Result.001 file - promoters70/1442993
gaactgaaaga

SEQ ID NO: 83677 - DNA, 11 bp, Unknown
  misc_feature (1)..( 11): Result.001 file - promoters70/1443021
ttgtataaatt

SEQ ID NO: 83678 - DNA, 12 bp, Unknown
  misc_feature (1)..( 12): Result.001 file - promoters70/1443021
atacaatatatc

SEQ ID NO: 83679 - DNA, 12 bp, Unknown
  misc_feature (1)..( 12): Result.001 file - promoters70/1443021
tcaaaatttatc

SEQ ID NO: 83680 - DNA, 12 bp, Unknown
  misc_feature (1)..( 12): Result.001 file - promoters70/1443192
tcagaatttgga

SEQ ID NO: 83681 - DNA, 18 bp, Unknown
  misc_feature (1)..( 18): Result.001 file - promoters70/1443192
aaaaattattaaagtata

SEQ ID NO: 83682 - DNA, 18 bp, Unknown
  misc_feature (1)..( 18): Result.001 file - promoters70/1443192
aaagattattaaattata

SEQ ID NO: 83683 - DNA, 18 bp, Unknown
  misc_feature (1)..( 18): Result.001 file - promoters70/1443192
aaaatttatctgtaaatg

SEQ ID NO: 83684 - DNA, 9 bp, Unknown
  misc_feature (1)..( 9): Result.001 file - promoters70/1443192
ttactaata

SEQ ID NO: 83685 - DNA, 9 bp, Unknown
  misc_feature (1)..( 9): Result.001 file - promoters70/1443192
ttattaaag

SEQ ID NO: 83686 - DNA, 9 bp, Unknown
  misc_feature (1)..( 9): Result.001 file - promoters70/1443192
ataataatt

SEQ ID NO: 83687 - DNA, 9 bp, Unknown
  misc_feature (1)..( 9): Result.001 file - promoters70/1443192
ataatttta

SEQ ID NO: 83688 - DNA, 9 bp, Unknown
  misc_feature (1)..( 9): Result.001 file - promoters70/1443192
ctaatttta

SEQ ID NO: 83689 - DNA, 9 bp, Unknown
  misc_feature (1)..( 9): Result.001 file - promoters70/1443192
ataattatt

SEQ ID NO: 83690 - DNA, 10 bp, Unknown
  misc_feature (1)..( 10): Result.001 file - promoters70/1443192
ctatatatat

SEQ ID NO: 83691 - DNA, 10 bp, Unknown
  misc_feature (1)..( 10): Result.001 file - promoters70/1443192
ttatttatat

SEQ ID NO: 83692 - DNA, 10 bp, Unknown
  misc_feature (1)..( 10): Result.001 file - promoters70/1443192
ctatataaac

SEQ ID NO: 83693 - DNA, 8 bp, Unknown
  misc_feature (1)..( 8): Result.001 file - promoters70/1443192
taatagaa

SEQ ID NO: 83694 - DNA, 8 bp, Unknown
  misc_feature (1)..( 8): Result.001 file - promoters70/1443192
taattgaa

SEQ ID NO: 83695 - DNA, 8 bp, Unknown
  misc_feature (1)..( 8): Result.001 file - promoters70/1443306
aaattatt

SEQ ID NO: 83696 - DNA, 8 bp, Unknown
  misc_feature (1)..( 8): Result.001 file - promoters70/1443306
tttttaat

SEQ ID NO: 83697 - DNA, 8 bp, Unknown
  misc_feature (1)..( 8): Result.001 file - promoters70/1443306
tttgtaat

SEQ ID NO: 83698 - DNA, 8 bp, Unknown
  misc_feature (1)..( 8): Result.001 file - promoters70/1443306
tttgtaac

SEQ ID NO: 83699 - DNA, 12 bp, Unknown
  misc_feature (1)..( 12): Result.001 file - promoters70/1443306
taagatattttt

SEQ ID NO: 83700 - DNA, 12 bp, Unknown
  misc_feature (1)..( 12): Result.001 file - promoters70/1443306
aaaaatatattt

SEQ ID NO: 83701 - DNA, 12 bp, Unknown
  misc_feature (1)..( 12): Result.001 file - promoters70/1443306
taaaatacttta

SEQ ID NO: 83702 - DNA, 7 bp, Unknown
  misc_feature (1)..( 7): Result.001 file - promoters70/1443306
tttattt

SEQ ID NO: 83703 - DNA, 7 bp, Unknown
  misc_feature (1)..( 7): Result.001 file - promoters70/1443306
tttcttt

SEQ ID NO: 83704 - DNA, 7 bp, Unknown
  misc_feature (1)..( 7): Result.001 file - promoters70/1443306
ttcattt

SEQ ID NO: 83705 - DNA, 7 bp, Unknown
  misc_feature (1)..( 7): Result.001 file - promoters70/1443306
cataaac

SEQ ID NO: 83706 - DNA, 7 bp, Unknown
  misc_feature (1)..( 7): Result.001 file - promoters70/1443306
cataaat

SEQ ID NO: 83707 - DNA, 7 bp, Unknown
  misc_feature (1)..( 7): Result.001 file - promoters70/1443306
cataaac

SEQ ID NO: 83708 - DNA, 12 bp, Unknown
  misc_feature (1)..( 12): Result.001 file - promoters70/1443306
ttcatataaata

SEQ ID NO: 83709 - DNA, 12 bp, Unknown
  misc_feature (1)..( 12): Result.001 file - promoters70/1443306
taactataaata

SEQ ID NO: 83710 - DNA, 12 bp, Unknown
  misc_feature (1)..( 12): Result.001 file - promoters70/1443306
tatatataaata

SEQ ID NO: 83711 - DNA, 12 bp, Unknown
  misc_feature (1)..( 12): Result.001 file - promoters70/1443306
aatctataaaaa

SEQ ID NO: 83712 - DNA, 11 bp, Unknown
  misc_feature (1)..( 11): Result.001 file - promoters70/1443306
tcaattttttt

SEQ ID NO: 83713 - DNA, 11 bp, Unknown
  misc_feature (1)..( 11): Result.001 file - promoters70/1443306
ctaattttagc

SEQ ID NO: 83714 - DNA, 11 bp, Unknown
  misc_feature (1)..( 11): Result.001 file - promoters70/1443338
attatttttac

SEQ ID NO: 83715 - DNA, 9 bp, Unknown
  misc_feature (1)..( 9): Result.001 file - promoters70/1443338
aattacaat

SEQ ID NO: 83716 - DNA, 9 bp, Unknown
  misc_feature (1)..( 9): Result.001 file - promoters70/1443338
tcttataat

SEQ ID NO: 83717 - DNA, 9 bp, Unknown
  misc_feature (1)..( 9): Result.001 file - promoters70/1443338
tcttataaa

SEQ ID NO: 83718 - DNA, 8 bp, Unknown
  misc_feature (1)..( 8): Result.001 file - promoters70/1443338
acttatat

SEQ ID NO: 83719 - DNA, 8 bp, Unknown
  misc_feature (1)..( 8): Result.001 file - promoters70/1443338
tcttataa

SEQ ID NO: 83720 - DNA, 8 bp, Unknown
  misc_feature (1)..( 8): Result.001 file - promoters70/1443349
tcttataa

SEQ ID NO: 83721 - DNA, 11 bp, Unknown
  misc_feature (1)..( 11): Result.001 file - promoters70/1443349
ttttgaagaat

SEQ ID NO: 83722 - DNA, 11 bp, Unknown
  misc_feature (1)..( 11): Result.001 file - promoters70/1443349
ttttgatgaat

SEQ ID NO: 83723 - DNA, 11 bp, Unknown
  misc_feature (1)..( 11): Result.001 file - promoters70/1443349
gtttgaatcgt

SEQ ID NO: 83724 - DNA, 11 bp, Unknown
  misc_feature (1)..( 11): Result.001 file - promoters70/1443349
ttgtgaatgtc

SEQ ID NO: 83725 - DNA, 16 bp, Unknown
  misc_feature (1)..( 16): Result.001 file - promoters70/1443349
aaaaatgttagatagg

SEQ ID NO: 83726 - DNA, 16 bp, Unknown
  misc_feature (1)..( 16): Result.001 file - promoters70/1443349
ataaattttaaaatta

SEQ ID NO: 83727 - DNA, 16 bp, Unknown
  misc_feature (1)..( 16): Result.001 file - promoters70/1443349
atagatttgaaaaaca

SEQ ID NO: 83728 - DNA, 16 bp, Unknown
  misc_feature (1)..( 16): Result.001 file - promoters70/1443349
tttgattctaaaatat

SEQ ID NO: 83729 - DNA, 16 bp, Unknown
  misc_feature (1)..( 16): Result.001 file - promoters70/1443349
ggatagtaaaaaaaga

SEQ ID NO: 83730 - DNA, 8 bp, Unknown
  misc_feature (1)..( 8): Result.001 file - promoters70/1443349
cattaaag

SEQ ID NO: 83731 - DNA, 8 bp, Unknown
  misc_feature (1)..( 8): Result.001 file - promoters70/1443349
aattcaag

SEQ ID NO: 83732 - DNA, 8 bp, Unknown
  misc_feature (1)..( 8): Result.001 file - promoters70/1443349
cattaata

SEQ ID NO: 83733 - DNA, 8 bp, Unknown
  misc_feature (1)..( 8): Result.001 file - promoters70/1443349
aattcact

SEQ ID NO: 83734 - DNA, 11 bp, Unknown
  misc_feature (1)..( 11): Result.001 file - promoters70/1443349
cttatataaac

SEQ ID NO: 83735 - DNA, 11 bp, Unknown
  misc_feature (1)..( 11): Result.001 file - promoters70/1443349
tatatataata

SEQ ID NO: 83736 - DNA, 11 bp, Unknown
  misc_feature (1)..( 11): Result.001 file - promoters70/1443349
agtatataaac

SEQ ID NO: 83737 - DNA, 11 bp, Unknown
  misc_feature (1)..( 11): Result.001 file - promoters70/1443349
tataaataaaa

SEQ ID NO: 83738 - DNA, 11 bp, Unknown
  misc_feature (1)..( 11): Result.001 file - promoters70/1443349
tacctataaat

SEQ ID NO: 83739 - DNA, 12 bp, Unknown
  misc_feature (1)..( 12): Result.001 file - promoters70/1443349
tatataaacaaa

SEQ ID NO: 83740 - DNA, 12 bp, Unknown
  misc_feature (1)..( 12): Result.001 file - promoters70/1443349
ataataaccaaa

SEQ ID NO: 83741 - DNA, 12 bp, Unknown
  misc_feature (1)..( 12): Result.001 file - promoters70/1443349
tatataaactct

SEQ ID NO: 83742 - DNA, 12 bp, Unknown
  misc_feature (1)..( 12): Result.001 file - promoters70/1443349
tttataaataaa

SEQ ID NO: 83743 - DNA, 12 bp, Unknown
  misc_feature (1)..( 12): Result.001 file - promoters70/1443349
cctataaatatc

SEQ ID NO: 83744 - DNA, 8 bp, Unknown
  misc_feature (1)..( 8): Result.001 file - promoters70/1443349
cttcattt

SEQ ID NO: 83745 - DNA, 8 bp, Unknown
  misc_feature (1)..( 8): Result.001 file - promoters70/1443349
cttcataa

SEQ ID NO: 83746 - DNA, 8 bp, Unknown
  misc_feature (1)..( 8): Result.001 file - promoters70/1443349
ctttataa

SEQ ID NO: 83747 - DNA, 8 bp, Unknown
  misc_feature (1)..( 8): Result.001 file - promoters70/1443349
atttttaa

SEQ ID NO: 83748 - DNA, 14 bp, Unknown
  misc_feature (1)..( 14): Result.001 file - promoters70/1443349
ttagataggaaaaa

SEQ ID NO: 83749 - DNA, 14 bp, Unknown
  misc_feature (1)..( 14): Result.001 file - promoters70/1443349
atagatttgaaaaa

SEQ ID NO: 83750 - DNA, 14 bp, Unknown
  misc_feature (1)..( 14): Result.001 file - promoters70/1443349
atggatagtaaaaa

SEQ ID NO: 83751 - DNA, 14 bp, Unknown
  misc_feature (1)..( 14): Result.001 file - promoters70/1443349
ataaattttaaaat

SEQ ID NO: 83752 - DNA, 14 bp, Unknown
  misc_feature (1)..( 14): Result.001 file - promoters70/1443349
tttgattctaaaat

SEQ ID NO: 83753 - DNA, 13 bp, Unknown
  misc_feature (1)..( 13): Result.001 file - promoters70/1443349
acttataattatg

SEQ ID NO: 83754 - DNA, 13 bp, Unknown
  misc_feature (1)..( 13): Result.001 file - promoters70/1443349
aataataataatg

SEQ ID NO: 83755 - DNA, 13 bp, Unknown
  misc_feature (1)..( 13): Result.001 file - promoters70/1443349
ctttataagtata

SEQ ID NO: 83756 - DNA, 13 bp, Unknown
  misc_feature (1)..( 13): Result.001 file - promoters70/1443349
ttttaaaagtaag

SEQ ID NO: 83757 - DNA, 13 bp, Unknown
  misc_feature (1)..( 13): Result.001 file - promoters70/1443349
cttcataacaaaa

SEQ ID NO: 83758 - DNA, 11 bp, Unknown
  misc_feature (1)..( 11): Result.001 file - promoters70/1443349
cgttttaaaag

SEQ ID NO: 83759 - DNA, 11 bp, Unknown
  misc_feature (1)..( 11): Result.001 file - promoters70/1443349
atttttaaatt

SEQ ID NO: 83760 - DNA, 11 bp, Unknown
  misc_feature (1)..( 11): Result.001 file - promoters70/1443349
ctttataagta

SEQ ID NO: 83761 - DNA, 11 bp, Unknown
  misc_feature (1)..( 11): Result.001 file - promoters70/1443356
cttcataacaa

SEQ ID NO: 83762 - DNA, 10 bp, Unknown
  misc_feature (1)..( 10): Result.001 file - promoters70/1443356
aacaaatttc

SEQ ID NO: 83763 - DNA, 10 bp, Unknown
  misc_feature (1)..( 10): Result.001 file - promoters70/1443356
tacaattttc

SEQ ID NO: 83764 - DNA, 10 bp, Unknown
  misc_feature (1)..( 10): Result.001 file - promoters70/1443356
tacaatattt

SEQ ID NO: 83765 - DNA, 8 bp, Unknown
  misc_feature (1)..( 8): Result.001 file - promoters70/1443356
tttgtttg

SEQ ID NO: 83766 - DNA, 8 bp, Unknown
  misc_feature (1)..( 8): Result.001 file - promoters70/1443356
tttctttg

SEQ ID NO: 83767 - DNA, 8 bp, Unknown
  misc_feature (1)..( 8): Result.001 file - promoters70/1443356
tttattta

SEQ ID NO: 83768 - DNA, 7 bp, Unknown
  misc_feature (1)..( 7): Result.001 file - promoters70/1443356
gacaata

SEQ ID NO: 83769 - DNA, 7 bp, Unknown
  misc_feature (1)..( 7): Result.001 file - promoters70/1443356
tacaata

SEQ ID NO: 83770 - DNA, 7 bp, Unknown
  misc_feature (1)..( 7): Result.001 file - promoters70/1443418
tacaatt

SEQ ID NO: 83771 - DNA, 8 bp, Unknown
  misc_feature (1)..( 8): Result.001 file - promoters70/1443418
aattttat

SEQ ID NO: 83772 - DNA, 8 bp, Unknown
  misc_feature (1)..( 8): Result.001 file - promoters70/1443418
aattttta

SEQ ID NO: 83773 - DNA, 8 bp, Unknown
  misc_feature (1)..( 8): Result.001 file - promoters70/1443418
tattttta

SEQ ID NO: 83774 - DNA, 8 bp, Unknown
  misc_feature (1)..( 8): Result.001 file - promoters70/1443418
ttttatta

SEQ ID NO: 83775 - DNA, 8 bp, Unknown
  misc_feature (1)..( 8): Result.001 file - promoters70/1443418
ttttattg

SEQ ID NO: 83776 - DNA, 8 bp, Unknown
  misc_feature (1)..( 8): Result.001 file - promoters70/1443418
atttctta

SEQ ID NO: 83777 - DNA, 9 bp, Unknown
  misc_feature (1)..( 9): Result.001 file - promoters70/1443418
gatttaaag

SEQ ID NO: 83778 - DNA, 9 bp, Unknown
  misc_feature (1)..( 9): Result.001 file - promoters70/1443418
tgtttaaaa

SEQ ID NO: 83779 - DNA, 9 bp, Unknown
  misc_feature (1)..( 9): Result.001 file - promoters70/1443418
tgttcaaaa

SEQ ID NO: 83780 - DNA, 9 bp, Unknown
  misc_feature (1)..( 9): Result.001 file - promoters70/1443418
aaaatataa

SEQ ID NO: 83781 - DNA, 9 bp, Unknown
  misc_feature (1)..( 9): Result.001 file - promoters70/1443418
tttatataa

SEQ ID NO: 83782 - DNA, 9 bp, Unknown
  misc_feature (1)..( 9): Result.001 file - promoters70/1443633
tatatataa

SEQ ID NO: 83783 - DNA, 9 bp, Unknown
  misc_feature (1)..( 9): Result.001 file - promoters70/1443633
acaatacat

SEQ ID NO: 83784 - DNA, 9 bp, Unknown
  misc_feature (1)..( 9): Result.001 file - promoters70/1443633
gagatacat

SEQ ID NO: 83785 - DNA, 9 bp, Unknown
  misc_feature (1)..( 9): Result.001 file - promoters70/1443633
agaatacac

SEQ ID NO: 83786 - DNA, 9 bp, Unknown
  misc_feature (1)..( 9): Result.001 file - promoters70/1443633
agactacag

SEQ ID NO: 83787 - DNA, 8 bp, Unknown
  misc_feature (1)..( 8): Result.001 file - promoters70/1443633
acgaaatc

SEQ ID NO: 83788 - DNA, 8 bp, Unknown
  misc_feature (1)..( 8): Result.001 file - promoters70/1443633
acgaaatt

SEQ ID NO: 83789 - DNA, 8 bp, Unknown
  misc_feature (1)..( 8): Result.001 file - promoters70/1443683
cagaaatt

SEQ ID NO: 83790 - DNA, 17 bp, Unknown
  misc_feature (1)..( 17): Result.001 file - promoters70/1443683
tattagcttagactata

SEQ ID NO: 83791 - DNA, 17 bp, Unknown
  misc_feature (1)..( 17): Result.001 file - promoters70/1443683
gatttgcttctcccaag

SEQ ID NO: 83792 - DNA, 17 bp, Unknown
  misc_feature (1)..( 17): Result.001 file - promoters70/1443683
tattagagagatagaga

SEQ ID NO: 83793 - DNA, 17 bp, Unknown
  misc_feature (1)..( 17): Result.001 file - promoters70/1443683
tacgtgcttccaacaaa

SEQ ID NO: 83794 - DNA, 17 bp, Unknown
  misc_feature (1)..( 17): Result.001 file - promoters70/1443683
caagtgcttcaaacaaa

SEQ ID NO: 83795 - DNA, 17 bp, Unknown
  misc_feature (1)..( 17): Result.001 file - promoters70/1444131
gaagagctccagaagca

SEQ ID NO: 83796 - DNA, 13 bp, Unknown
  misc_feature (1)..( 13): Result.001 file - promoters70/1444131
ggatatatcaaac

SEQ ID NO: 83797 - DNA, 13 bp, Unknown
  misc_feature (1)..( 13): Result.001 file - promoters70/1444131
gacattataaaat

SEQ ID NO: 83798 - DNA, 13 bp, Unknown
  misc_feature (1)..( 13): Result.001 file - promoters70/1444131
gaccttaaaaaat

SEQ ID NO: 83799 - DNA, 13 bp, Unknown
  misc_feature (1)..( 13): Result.001 file - promoters70/1444131
caaacaataaaat

SEQ ID NO: 83800 - DNA, 13 bp, Unknown
  misc_feature (1)..( 13): Result.001 file - promoters70/1444131
taaaaaatcaaaa

SEQ ID NO: 83801 - DNA, 13 bp, Unknown
  misc_feature (1)..( 13): Result.001 file - promoters70/1444441
gacattataaaat

SEQ ID NO: 83802 - DNA, 11 bp, Unknown
  misc_feature (1)..( 11): Result.001 file - promoters70/1444441
aactcttttga

SEQ ID NO: 83803 - DNA, 11 bp, Unknown
  misc_feature (1)..( 11): Result.001 file - promoters70/1444441
aactcttttga

SEQ ID NO: 83804 - DNA, 11 bp, Unknown
  misc_feature (1)..( 11): Result.001 file - promoters70/1444441
tactatttata

SEQ ID NO: 83805 - DNA, 11 bp, Unknown
  misc_feature (1)..( 11): Result.001 file - promoters70/1444441
gtatctttttg

SEQ ID NO: 83806 - DNA, 11 bp, Unknown
  misc_feature (1)..( 11): Result.001 file - promoters70/1444441
atttcttttca

SEQ ID NO: 83807 - DNA, 12 bp, Unknown
  misc_feature (1)..( 12): Result.001 file - promoters70/1444460
aaatcttcttga

SEQ ID NO: 83808 - DNA, 9 bp, Unknown
  misc_feature (1)..( 9): Result.001 file - promoters70/1444460
cgaaacaca

SEQ ID NO: 83809 - DNA, 9 bp, Unknown
  misc_feature (1)..( 9): Result.001 file - promoters70/1444460
tgaaacagg

SEQ ID NO: 83810 - DNA, 9 bp, Unknown
  misc_feature (1)..( 9): Result.001 file - promoters70/1444460
ttaaacaca

SEQ ID NO: 83811 - DNA, 9 bp, Unknown
  misc_feature (1)..( 9): Result.001 file - promoters70/1444460
tgaaacgaa

SEQ ID NO: 83812 - DNA, 7 bp, Unknown
  misc_feature (1)..( 7): Result.001 file - promoters70/1444460
tttcttc

SEQ ID NO: 83813 - DNA, 7 bp, Unknown
  misc_feature (1)..( 7): Result.001 file - promoters70/1444460
tttcttc

SEQ ID NO: 83814 - DNA, 7 bp, Unknown
  misc_feature (1)..( 7): Result.001 file - promoters70/1444479
tttcttc

SEQ ID NO: 83815 - DNA, 18 bp, Unknown
  misc_feature (1)..( 18): Result.001 file - promoters70/1444479
aaaaattattaaagtata

SEQ ID NO: 83816 - DNA, 18 bp, Unknown
  misc_feature (1)..( 18): Result.001 file - promoters70/1444479
aaagattattaaattata

SEQ ID NO: 83817 - DNA, 18 bp, Unknown
  misc_feature (1)..( 18): Result.001 file - promoters70/1444479
aaaatttatctgtaaatg

SEQ ID NO: 83818 - DNA, 10 bp, Unknown
  misc_feature (1)..( 10): Result.001 file - promoters70/1444479
tttactaata

SEQ ID NO: 83819 - DNA, 10 bp, Unknown
  misc_feature (1)..( 10): Result.001 file - promoters70/1444479
attattaaag

SEQ ID NO: 83820 - DNA, 10 bp, Unknown
  misc_feature (1)..( 10): Result.001 file - promoters70/1444479
tttgctatac

SEQ ID NO: 83821 - DNA, 10 bp, Unknown
  misc_feature (1)..( 10): Result.001 file - promoters70/1444479
tataataatt

SEQ ID NO: 83822 - DNA, 9 bp, Unknown
  misc_feature (1)..( 9): Result.001 file - promoters70/1444479
ataatttta

SEQ ID NO: 83823 - DNA, 9 bp, Unknown
  misc_feature (1)..( 9): Result.001 file - promoters70/1444479
ctaatttta

SEQ ID NO: 83824 - DNA, 9 bp, Unknown
  misc_feature (1)..( 9): Result.001 file - promoters70/1444479
ataattatt

SEQ ID NO: 83825 - DNA, 7 bp, Unknown
  misc_feature (1)..( 7): Result.001 file - promoters70/1444479
catttta

SEQ ID NO: 83826 - DNA, 7 bp, Unknown
  misc_feature (1)..( 7): Result.001 file - promoters70/1444479
tatttta

SEQ ID NO: 83827 - DNA, 7 bp, Unknown
  misc_feature (1)..( 7): Result.001 file - promoters70/1444479
tattttt

SEQ ID NO: 83828 - DNA, 10 bp, Unknown
  misc_feature (1)..( 10): Result.001 file - promoters70/1444479
ctatatatat

SEQ ID NO: 83829 - DNA, 10 bp, Unknown
  misc_feature (1)..( 10): Result.001 file - promoters70/1444479
ttatttatat

SEQ ID NO: 83830 - DNA, 10 bp, Unknown
  misc_feature (1)..( 10): Result.001 file - promoters70/1444479
gtatatataa

SEQ ID NO: 83831 - DNA, 10 bp, Unknown
  misc_feature (1)..( 10): Result.001 file - promoters70/1444479
ctatataaac

SEQ ID NO: 83832 - DNA, 9 bp, Unknown
  misc_feature (1)..( 9): Result.001 file - promoters70/1444479
ctaatttta

SEQ ID NO: 83833 - DNA, 9 bp, Unknown
  misc_feature (1)..( 9): Result.001 file - promoters70/1444479
ctaatttta

SEQ ID NO: 83834 - DNA, 9 bp, Unknown
  misc_feature (1)..( 9): Result.001 file - promoters70/1444479
aaaatgtta

SEQ ID NO: 83835 - DNA, 8 bp, Unknown
  misc_feature (1)..( 8): Result.001 file - promoters70/1444479
ttttgtta

SEQ ID NO: 83836 - DNA, 8 bp, Unknown
  misc_feature (1)..( 8): Result.001 file - promoters70/1444479
atttgtta

SEQ ID NO: 83837 - DNA, 8 bp, Unknown
  misc_feature (1)..( 8): Result.001 file - promoters70/1444479
ttttgttt

SEQ ID NO: 83838 - DNA, 8 bp, Unknown
  misc_feature (1)..( 8): Result.001 file - promoters70/1444479
tcaaaaaa

SEQ ID NO: 83839 - DNA, 8 bp, Unknown
  misc_feature (1)..( 8): Result.001 file - promoters70/1444479
acaaaaaa

SEQ ID NO: 83840 - DNA, 8 bp, Unknown
  misc_feature (1)..( 8): Result.001 file - promoters70/1444479
acaaaact

SEQ ID NO: 83841 - DNA, 11 bp, Unknown
  misc_feature (1)..( 11): Result.001 file - promoters70/1444479
aaacaatcatt

SEQ ID NO: 83842 - DNA, 11 bp, Unknown
  misc_feature (1)..( 11): Result.001 file - promoters70/1444479
aaaaaataatt

SEQ ID NO: 83843 - DNA, 11 bp, Unknown
  misc_feature (1)..( 11): Result.001 file - promoters70/1444479
aaaaaattgat

SEQ ID NO: 83844 - DNA, 8 bp, Unknown
  misc_feature (1)..( 8): Result.001 file - promoters70/1444479
taatagaa

SEQ ID NO: 83845 - DNA, 8 bp, Unknown
  misc_feature (1)..( 8): Result.001 file - promoters70/1444479
taattgaa

SEQ ID NO: 83846 - DNA, 8 bp, Unknown
  misc_feature (1)..( 8): Result.001 file - promoters70/1444479
aaattatt

SEQ ID NO: 83847 - DNA, 9 bp, Unknown
  misc_feature (1)..( 9): Result.001 file - promoters70/1444479
aacatattt

SEQ ID NO: 83848 - DNA, 9 bp, Unknown
  misc_feature (1)..( 9): Result.001 file - promoters70/1444479
aaaatattt

SEQ ID NO: 83849 - DNA, 9 bp, Unknown
  misc_feature (1)..( 9): Result.001 file - promoters70/1444479
aaaacattt

SEQ ID NO: 83850 - DNA, 7 bp, Unknown
  misc_feature (1)..( 7): Result.001 file - promoters70/1444479
attttgt

SEQ ID NO: 83851 - DNA, 7 bp, Unknown
  misc_feature (1)..( 7): Result.001 file - promoters70/1444479
attttgt

SEQ ID NO: 83852 - DNA, 7 bp, Unknown
  misc_feature (1)..( 7): Result.001 file - promoters70/1444479
tttttgt

SEQ ID NO: 83853 - DNA, 8 bp, Unknown
  misc_feature (1)..( 8): Result.001 file - promoters70/1444479
aaaaaaat

SEQ ID NO: 83854 - DNA, 8 bp, Unknown
  misc_feature (1)..( 8): Result.001 file - promoters70/1444479
aaaaaaaa

SEQ ID NO: 83855 - DNA, 8 bp, Unknown
  misc_feature (1)..( 8): Result.001 file - promoters70/1444506
aaaaaaat

SEQ ID NO: 83856 - DNA, 18 bp, Unknown
  misc_feature (1)..( 18): Result.001 file - promoters70/1444506
aaaaattattaaagtata

SEQ ID NO: 83857 - DNA, 18 bp, Unknown
  misc_feature (1)..( 18): Result.001 file - promoters70/1444506
aaagattattaaattata

SEQ ID NO: 83858 - DNA, 18 bp, Unknown
  misc_feature (1)..( 18): Result.001 file - promoters70/1444506
aaaatttatctgtaaatg

SEQ ID NO: 83859 - DNA, 10 bp, Unknown
  misc_feature (1)..( 10): Result.001 file - promoters70/1444506
tttactaata

SEQ ID NO: 83860 - DNA, 10 bp, Unknown
  misc_feature (1)..( 10): Result.001 file - promoters70/1444506
attattaaag

SEQ ID NO: 83861 - DNA, 10 bp, Unknown
  misc_feature (1)..( 10): Result.001 file - promoters70/1444506
tttgctatac

SEQ ID NO: 83862 - DNA, 10 bp, Unknown
  misc_feature (1)..( 10): Result.001 file - promoters70/1444506
tataataatt

SEQ ID NO: 83863 - DNA, 9 bp, Unknown
  misc_feature (1)..( 9): Result.001 file - promoters70/1444506
ataatttta

SEQ ID NO: 83864 - DNA, 9 bp, Unknown
  misc_feature (1)..( 9): Result.001 file - promoters70/1444506
ctaatttta

SEQ ID NO: 83865 - DNA, 9 bp, Unknown
  misc_feature (1)..( 9): Result.001 file - promoters70/1444506
ataattatt

SEQ ID NO: 83866 - DNA, 7 bp, Unknown
  misc_feature (1)..( 7): Result.001 file - promoters70/1444506
catttta

SEQ ID NO: 83867 - DNA, 7 bp, Unknown
  misc_feature (1)..( 7): Result.001 file - promoters70/1444506
tatttta

SEQ ID NO: 83868 - DNA, 7 bp, Unknown
  misc_feature (1)..( 7): Result.001 file - promoters70/1444506
tattttt

SEQ ID NO: 83869 - DNA, 10 bp, Unknown
  misc_feature (1)..( 10): Result.001 file - promoters70/1444506
ctatatatat

SEQ ID NO: 83870 - DNA, 10 bp, Unknown
  misc_feature (1)..( 10): Result.001 file - promoters70/1444506
ttatttatat

SEQ ID NO: 83871 - DNA, 10 bp, Unknown
  misc_feature (1)..( 10): Result.001 file - promoters70/1444506
gtatatataa

SEQ ID NO: 83872 - DNA, 10 bp, Unknown
  misc_feature (1)..( 10): Result.001 file - promoters70/1444506
ctatataaac

SEQ ID NO: 83873 - DNA, 9 bp, Unknown
  misc_feature (1)..( 9): Result.001 file - promoters70/1444506
ctaatttta

SEQ ID NO: 83874 - DNA, 9 bp, Unknown
  misc_feature (1)..( 9): Result.001 file - promoters70/1444506
ctaatttta

SEQ ID NO: 83875 - DNA, 9 bp, Unknown
  misc_feature (1)..( 9): Result.001 file - promoters70/1444506
aaaatgtta

SEQ ID NO: 83876 - DNA, 8 bp, Unknown
  misc_feature (1)..( 8): Result.001 file - promoters70/1444506
ttttgtta

SEQ ID NO: 83877 - DNA, 8 bp, Unknown
  misc_feature (1)..( 8): Result.001 file - promoters70/1444506
atttgtta

SEQ ID NO: 83878 - DNA, 8 bp, Unknown
  misc_feature (1)..( 8): Result.001 file - promoters70/1444506
ttttgttt

SEQ ID NO: 83879 - DNA, 8 bp, Unknown
  misc_feature (1)..( 8): Result.001 file - promoters70/1444506
tcaaaaaa

SEQ ID NO: 83880 - DNA, 8 bp, Unknown
  misc_feature (1)..( 8): Result.001 file - promoters70/1444506
acaaaaaa

SEQ ID NO: 83881 - DNA, 8 bp, Unknown
  misc_feature (1)..( 8): Result.001 file - promoters70/1444506
acaaaact

SEQ ID NO: 83882 - DNA, 11 bp, Unknown
  misc_feature (1)..( 11): Result.001 file - promoters70/1444506
aaacaatcatt

SEQ ID NO: 83883 - DNA, 11 bp, Unknown
  misc_feature (1)..( 11): Result.001 file - promoters70/1444506
aaaaaataatt

SEQ ID NO: 83884 - DNA, 11 bp, Unknown
  misc_feature (1)..( 11): Result.001 file - promoters70/1444506
aaaaaattgat

SEQ ID NO: 83885 - DNA, 8 bp, Unknown
  misc_feature (1)..( 8): Result.001 file - promoters70/1444506
taatagaa

SEQ ID NO: 83886 - DNA, 8 bp, Unknown
  misc_feature (1)..( 8): Result.001 file - promoters70/1444506
taattgaa

SEQ ID NO: 83887 - DNA, 8 bp, Unknown
  misc_feature (1)..( 8): Result.001 file - promoters70/1444506
aaattatt

SEQ ID NO: 83888 - DNA, 9 bp, Unknown
  misc_feature (1)..( 9): Result.001 file - promoters70/1444506
aacatattt

SEQ ID NO: 83889 - DNA, 9 bp, Unknown
  misc_feature (1)..( 9): Result.001 file - promoters70/1444506
aaaatattt

SEQ ID NO: 83890 - DNA, 9 bp, Unknown
  misc_feature (1)..( 9): Result.001 file - promoters70/1444506
aaaacattt

SEQ ID NO: 83891 - DNA, 7 bp, Unknown
  misc_feature (1)..( 7): Result.001 file - promoters70/1444506
attttgt

SEQ ID NO: 83892 - DNA, 7 bp, Unknown
  misc_feature (1)..( 7): Result.001 file - promoters70/1444506
attttgt

SEQ ID NO: 83893 - DNA, 7 bp, Unknown
  misc_feature (1)..( 7): Result.001 file - promoters70/1444506
tttttgt

SEQ ID NO: 83894 - DNA, 8 bp, Unknown
  misc_feature (1)..( 8): Result.001 file - promoters70/1444506
aaaaaaat

SEQ ID NO: 83895 - DNA, 8 bp, Unknown
  misc_feature (1)..( 8): Result.001 file - promoters70/1444506
aaaaaaaa

SEQ ID NO: 83896 - DNA, 8 bp, Unknown
  misc_feature (1)..( 8): Result.001 file - promoters70/1444514
aaaaaaat

SEQ ID NO: 83897 - DNA, 18 bp, Unknown
  misc_feature (1)..( 18): Result.001 file - promoters70/1444514
aaaaattattaaagtata

SEQ ID NO: 83898 - DNA, 18 bp, Unknown
  misc_feature (1)..( 18): Result.001 file - promoters70/1444514
aaagattattaaattata

SEQ ID NO: 83899 - DNA, 18 bp, Unknown
  misc_feature (1)..( 18): Result.001 file - promoters70/1444514
aaaatttatctgtaaatg

SEQ ID NO: 83900 - DNA, 9 bp, Unknown
  misc_feature (1)..( 9): Result.001 file - promoters70/1444514
ttactaata

SEQ ID NO: 83901 - DNA, 9 bp, Unknown
  misc_feature (1)..( 9): Result.001 file - promoters70/1444514
ttattaaag

SEQ ID NO: 83902 - DNA, 9 bp, Unknown
  misc_feature (1)..( 9): Result.001 file - promoters70/1444514
ataataatt

SEQ ID NO: 83903 - DNA, 9 bp, Unknown
  misc_feature (1)..( 9): Result.001 file - promoters70/1444514
ataatttta

SEQ ID NO: 83904 - DNA, 9 bp, Unknown
  misc_feature (1)..( 9): Result.001 file - promoters70/1444514
ctaatttta

SEQ ID NO: 83905 - DNA, 9 bp, Unknown
  misc_feature (1)..( 9): Result.001 file - promoters70/1444514
ataattatt

SEQ ID NO: 83906 - DNA, 10 bp, Unknown
  misc_feature (1)..( 10): Result.001 file - promoters70/1444514
ctatatatat

SEQ ID NO: 83907 - DNA, 10 bp, Unknown
  misc_feature (1)..( 10): Result.001 file - promoters70/1444514
ttatttatat

SEQ ID NO: 83908 - DNA, 10 bp, Unknown
  misc_feature (1)..( 10): Result.001 file - promoters70/1444514
ctatataaac

SEQ ID NO: 83909 - DNA, 8 bp, Unknown
  misc_feature (1)..( 8): Result.001 file - promoters70/1444514
taatagaa

SEQ ID NO: 83910 - DNA, 8 bp, Unknown
  misc_feature (1)..( 8): Result.001 file - promoters70/1444514
taattgaa

SEQ ID NO: 83911 - DNA, 8 bp, Unknown
  misc_feature (1)..( 8): Result.001 file - promoters70/1446636
aaattatt

SEQ ID NO: 83912 - DNA, 9 bp, Unknown
  misc_feature (1)..( 9): Result.001 file - promoters70/1446636
aagggtaaa

SEQ ID NO: 83913 - DNA, 9 bp, Unknown
  misc_feature (1)..( 9): Result.001 file - promoters70/1446636
gaggttaaa

SEQ ID NO: 83914 - DNA, 9 bp, Unknown
  misc_feature (1)..( 9): Result.001 file - promoters70/1446636
gaggtgaaa

SEQ ID NO: 83915 - DNA, 8 bp, Unknown
  misc_feature (1)..( 8): Result.001 file - promoters70/1446636
taaggata

SEQ ID NO: 83916 - DNA, 8 bp, Unknown
  misc_feature (1)..( 8): Result.001 file - promoters70/1446636
aaaggata

SEQ ID NO: 83917 - DNA, 9 bp, Unknown
  misc_feature (1)..( 9): Result.001 file - promoters70/1447425
aaatggaac

SEQ ID NO: 83918 - DNA, 10 bp, Unknown
  misc_feature (1)..( 10): Result.001 file - promoters70/1447425
aatttggcgg

SEQ ID NO: 83919 - DNA, 10 bp, Unknown
  misc_feature (1)..( 10): Result.001 file - promoters70/1447425
aatttgatag

SEQ ID NO: 83920 - DNA, 10 bp, Unknown
  misc_feature (1)..( 10): Result.001 file - promoters70/1447646
catttgattt

SEQ ID NO: 83921 - DNA, 10 bp, Unknown
  misc_feature (1)..( 10): Result.001 file - promoters70/1447646
ggaaggagag

SEQ ID NO: 83922 - DNA, 10 bp, Unknown
  misc_feature (1)..( 10): Result.001 file - promoters70/1447646
ggaagtagag

SEQ ID NO: 83923 - DNA, 10 bp, Unknown
  misc_feature (1)..( 10): Result.001 file - promoters70/1447646
ggaagtagag

SEQ ID NO: 83924 - DNA, 10 bp, Unknown
  misc_feature (1)..( 10): Result.001 file - promoters70/1447646
gaagaaagga

SEQ ID NO: 83925 - DNA, 10 bp, Unknown
  misc_feature (1)..( 10): Result.001 file - promoters70/1447646
gaaggaagga

SEQ ID NO: 83926 - DNA, 10 bp, Unknown
  misc_feature (1)..( 10): Result.001 file - promoters70/1447646
taagaaaaaa

SEQ ID NO: 83927 - DNA, 9 bp, Unknown
  misc_feature (1)..( 9): Result.001 file - promoters70/1447646
gagatgaga

SEQ ID NO: 83928 - DNA, 9 bp, Unknown
  misc_feature (1)..( 9): Result.001 file - promoters70/1447646
aagatgatg

SEQ ID NO: 83929 - DNA, 9 bp, Unknown
  misc_feature (1)..( 9): Result.001 file - promoters70/1447646
aagttgatg

SEQ ID NO: 83930 - DNA, 8 bp, Unknown
  misc_feature (1)..( 8): Result.001 file - promoters70/1447646
gataaaga

SEQ ID NO: 83931 - DNA, 8 bp, Unknown
  misc_feature (1)..( 8): Result.001 file - promoters70/1447646
gataaaat

SEQ ID NO: 83932 - DNA, 8 bp, Unknown
  misc_feature (1)..( 8): Result.001 file - promoters70/1447646
gataaaga

SEQ ID NO: 83933 - DNA, 8 bp, Unknown
  misc_feature (1)..( 8): Result.001 file - promoters70/1447646
agtggaaa

SEQ ID NO: 83934 - DNA, 8 bp, Unknown
  misc_feature (1)..( 8): Result.001 file - promoters70/1447646
tgtgaaaa

SEQ ID NO: 83935 - DNA, 8 bp, Unknown
  misc_feature (1)..( 8): Result.001 file - promoters70/1447646
agttgaag

SEQ ID NO: 83936 - DNA, 8 bp, Unknown
  misc_feature (1)..( 8): Result.001 file - promoters70/1447646
gaagttga

SEQ ID NO: 83937 - DNA, 8 bp, Unknown
  misc_feature (1)..( 8): Result.001 file - promoters70/1447646
gaatttgt

SEQ ID NO: 83938 - DNA, 8 bp, Unknown
  misc_feature (1)..( 8): Result.001 file - promoters70/1447953
gaagttga

SEQ ID NO: 83939 - DNA, 11 bp, Unknown
  misc_feature (1)..( 11): Result.001 file - promoters70/1447953
ttataattatg

SEQ ID NO: 83940 - DNA, 11 bp, Unknown
  misc_feature (1)..( 11): Result.001 file - promoters70/1447953
atattattatt

SEQ ID NO: 83941 - DNA, 11 bp, Unknown
  misc_feature (1)..( 11): Result.001 file - promoters70/1447953
ttataagtata

SEQ ID NO: 83942 - DNA, 11 bp, Unknown
  misc_feature (1)..( 11): Result.001 file - promoters70/1447953
atataagtaac

SEQ ID NO: 83943 - DNA, 11 bp, Unknown
  misc_feature (1)..( 11): Result.001 file - promoters70/1448231
caatctttata

SEQ ID NO: 83944 - DNA, 7 bp, Unknown
  misc_feature (1)..( 7): Result.001 file - promoters70/1448231
cttaact

SEQ ID NO: 83945 - DNA, 7 bp, Unknown
  misc_feature (1)..( 7): Result.001 file - promoters70/1448231
cttaacc

SEQ ID NO: 83946 - DNA, 7 bp, Unknown
  misc_feature (1)..( 7): Result.001 file - promoters70/1450625
tttaacc

SEQ ID NO: 83947 - DNA, 8 bp, Unknown
  misc_feature (1)..( 8): Result.001 file - promoters70/1450625
aattttga

SEQ ID NO: 83948 - DNA, 8 bp, Unknown
  misc_feature (1)..( 8): Result.001 file - promoters70/1450625
aattttaa

SEQ ID NO: 83949 - DNA, 8 bp, Unknown
  misc_feature (1)..( 8): Result.001 file - promoters70/1450625
cattgtaa

SEQ ID NO: 83950 - DNA, 6 bp, Unknown
  misc_feature (1)..( 6): Result.001 file - promoters70/1450625
ttattc

SEQ ID NO: 83951 - DNA, 6 bp, Unknown
  misc_feature (1)..( 6): Result.001 file - promoters70/1450625
ttattc

SEQ ID NO: 83952 - DNA, 6 bp, Unknown
  misc_feature (1)..( 6): Result.001 file - promoters70/1450696
ttattc

SEQ ID NO: 83953 - DNA, 9 bp, Unknown
  misc_feature (1)..( 9): Result.001 file - promoters70/1450696
aaaaataat

SEQ ID NO: 83954 - DNA, 9 bp, Unknown
  misc_feature (1)..( 9): Result.001 file - promoters70/1450696
aaaactaaa

SEQ ID NO: 83955 - DNA, 9 bp, Unknown
  misc_feature (1)..( 9): Result.001 file - promoters70/1450696
caaaccaaa

SEQ ID NO: 83956 - DNA, 9 bp, Unknown
  misc_feature (1)..( 9): Result.001 file - promoters70/1450696
aaaaccacc

SEQ ID NO: 83957 - DNA, 8 bp, Unknown
  misc_feature (1)..( 8): Result.001 file - promoters70/1450696
aatatata

SEQ ID NO: 83958 - DNA, 8 bp, Unknown
  misc_feature (1)..( 8): Result.001 file - promoters70/1450696
tatatata

SEQ ID NO: 83959 - DNA, 8 bp, Unknown
  misc_feature (1)..( 8): Result.001 file - promoters70/1450696
aatataaa

SEQ ID NO: 83960 - DNA, 8 bp, Unknown
  misc_feature (1)..( 8): Result.001 file - promoters70/1450696
catatatt

SEQ ID NO: 83961 - DNA, 8 bp, Unknown
  misc_feature (1)..( 8): Result.001 file - promoters70/1450696
ttttttct

SEQ ID NO: 83962 - DNA, 8 bp, Unknown
  misc_feature (1)..( 8): Result.001 file - promoters70/1450696
tttttttg

SEQ ID NO: 83963 - DNA, 8 bp, Unknown
  misc_feature (1)..( 8): Result.001 file - promoters70/1450696
ttttttta

SEQ ID NO: 83964 - DNA, 9 bp, Unknown
  misc_feature (1)..( 9): Result.001 file - promoters70/1450811
ttttattag

SEQ ID NO: 83965 - DNA, 9 bp, Unknown
  misc_feature (1)..( 9): Result.001 file - promoters70/1450811
agatattta

SEQ ID NO: 83966 - DNA, 9 bp, Unknown
  misc_feature (1)..( 9): Result.001 file - promoters70/1450811
agatactta

SEQ ID NO: 83967 - DNA, 9 bp, Unknown
  misc_feature (1)..( 9): Result.001 file - promoters70/1455944
ggctactta

SEQ ID NO: 83968 - DNA, 11 bp, Unknown
  misc_feature (1)..( 11): Result.001 file - promoters70/1455944
aaataaaatgt

SEQ ID NO: 83969 - DNA, 11 bp, Unknown
  misc_feature (1)..( 11): Result.001 file - promoters70/1455944
tgctaaaattg

SEQ ID NO: 83970 - DNA, 11 bp, Unknown
  misc_feature (1)..( 11): Result.001 file - promoters70/1455944
aaagaaaacat

SEQ ID NO: 83971 - DNA, 11 bp, Unknown
  misc_feature (1)..( 11): Result.001 file - promoters70/1455944
acgtaagattg

SEQ ID NO: 83972 - DNA, 11 bp, Unknown
  misc_feature (1)..( 11): Result.001 file - promoters70/1455944
caaaatagatt

SEQ ID NO: 83973 - DNA, 11 bp, Unknown
  misc_feature (1)..( 11): Result.001 file - promoters70/1455944
aaaaaaagaaa

SEQ ID NO: 83974 - DNA, 11 bp, Unknown
  misc_feature (1)..( 11): Result.001 file - promoters70/1455944
caataaagtag

SEQ ID NO: 83975 - DNA, 11 bp, Unknown
  misc_feature (1)..( 11): Result.001 file - promoters70/1455944
aaataaagctt

SEQ ID NO: 83976 - DNA, 11 bp, Unknown
  misc_feature (1)..( 11): Result.001 file - promoters70/1455944
caacaaaatag

SEQ ID NO: 83977 - DNA, 11 bp, Unknown
  misc_feature (1)..( 11): Result.001 file - promoters70/1455944
aaacaaagaaa

SEQ ID NO: 83978 - DNA, 11 bp, Unknown
  misc_feature (1)..( 11): Result.001 file - promoters70/1455944
caataaagtag

SEQ ID NO: 83979 - DNA, 11 bp, Unknown
  misc_feature (1)..( 11): Result.001 file - promoters70/1455944
aaataaagctt

SEQ ID NO: 83980 - DNA, 7 bp, Unknown
  misc_feature (1)..( 7): Result.001 file - promoters70/1455944
aaattaa

SEQ ID NO: 83981 - DNA, 7 bp, Unknown
  misc_feature (1)..( 7): Result.001 file - promoters70/1455944
aaattat

SEQ ID NO: 83982 - DNA, 7 bp, Unknown
  misc_feature (1)..( 7): Result.001 file - promoters70/1455944
aaagtaa

SEQ ID NO: 83983 - DNA, 7 bp, Unknown
  misc_feature (1)..( 7): Result.001 file - promoters70/1455944
aaatatt

SEQ ID NO: 83984 - DNA, 8 bp, Unknown
  misc_feature (1)..( 8): Result.001 file - promoters70/1455944
ggaaaaaa

SEQ ID NO: 83985 - DNA, 8 bp, Unknown
  misc_feature (1)..( 8): Result.001 file - promoters70/1455944
tgaacaaa

SEQ ID NO: 83986 - DNA, 8 bp, Unknown
  misc_feature (1)..( 8): Result.001 file - promoters70/1455944
tgaccaaa

SEQ ID NO: 83987 - DNA, 11 bp, Unknown
  misc_feature (1)..( 11): Result.001 file - promoters70/1455944
gaatctctctg

SEQ ID NO: 83988 - DNA, 11 bp, Unknown
  misc_feature (1)..( 11): Result.001 file - promoters70/1455944
caatcactctc

SEQ ID NO: 83989 - DNA, 11 bp, Unknown
  misc_feature (1)..( 11): Result.001 file - promoters70/1455944
caatccctctc

SEQ ID NO: 83990 - DNA, 10 bp, Unknown
  misc_feature (1)..( 10): Result.001 file - promoters70/1455944
tatatatacc

SEQ ID NO: 83991 - DNA, 10 bp, Unknown
  misc_feature (1)..( 10): Result.001 file - promoters70/1455944
tatataatag

SEQ ID NO: 83992 - DNA, 10 bp, Unknown
  misc_feature (1)..( 10): Result.001 file - promoters70/1455944
tatataaacc

SEQ ID NO: 83993 - DNA, 10 bp, Unknown
  misc_feature (1)..( 10): Result.001 file - promoters70/1455944
tatttaaaca

SEQ ID NO: 83994 - DNA, 9 bp, Unknown
  misc_feature (1)..( 9): Result.001 file - promoters70/1455944
ttgaccagg

SEQ ID NO: 83995 - DNA, 9 bp, Unknown
  misc_feature (1)..( 9): Result.001 file - promoters70/1455944
ttgaccaaa

SEQ ID NO: 83996 - DNA, 9 bp, Unknown
  misc_feature (1)..( 9): Result.001 file - promoters70/1455956
atgaacaaa

SEQ ID NO: 83997 - DNA, 9 bp, Unknown
  misc_feature (1)..( 9): Result.001 file - promoters70/1455956
tgttaattt

SEQ ID NO: 83998 - DNA, 9 bp, Unknown
  misc_feature (1)..( 9): Result.001 file - promoters70/1455956
tgttaattg

SEQ ID NO: 83999 - DNA, 9 bp, Unknown
  misc_feature (1)..( 9): Result.001 file - promoters70/1455956
agttgattt

SEQ ID NO: 84000 - DNA, 8 bp, Unknown
  misc_feature (1)..( 8): Result.001 file - promoters70/1455956
ttgatttg

SEQ ID NO: 84001 - DNA, 8 bp, Unknown
  misc_feature (1)..( 8): Result.001 file - promoters70/1455956
ttgttttg

SEQ ID NO: 84002 - DNA, 8 bp, Unknown
  misc_feature (1)..( 8): Result.001 file - promoters70/1455956
ttgattct

SEQ ID NO: 84003 - DNA, 8 bp, Unknown
  misc_feature (1)..( 8): Result.001 file - promoters70/1455956
taacttcc

SEQ ID NO: 84004 - DNA, 8 bp, Unknown
  misc_feature (1)..( 8): Result.001 file - promoters70/1455956
taatttca

SEQ ID NO: 84005 - DNA, 8 bp, Unknown
  misc_feature (1)..( 8): Result.001 file - promoters70/1455956
aaacctcc

SEQ ID NO: 84006 - DNA, 8 bp, Unknown
  misc_feature (1)..( 8): Result.001 file - promoters70/1455956
ataaattt

SEQ ID NO: 84007 - DNA, 8 bp, Unknown
  misc_feature (1)..( 8): Result.001 file - promoters70/1455956
ttaatttt

SEQ ID NO: 84008 - DNA, 8 bp, Unknown
  misc_feature (1)..( 8): Result.001 file - promoters70/1455972
ttaattgt

SEQ ID NO: 84009 - DNA, 10 bp, Unknown
  misc_feature (1)..( 10): Result.001 file - promoters70/1455972
ttcaaatata

SEQ ID NO: 84010 - DNA, 10 bp, Unknown
  misc_feature (1)..( 10): Result.001 file - promoters70/1455972
cacaaacata

SEQ ID NO: 84011 - DNA, 10 bp, Unknown
  misc_feature (1)..( 10): Result.001 file - promoters70/1459039
ttcagataaa

SEQ ID NO: 84012 - DNA, 9 bp, Unknown
  misc_feature (1)..( 9): Result.001 file - promoters70/1459039
atataaagg

SEQ ID NO: 84013 - DNA, 9 bp, Unknown
  misc_feature (1)..( 9): Result.001 file - promoters70/1459039
atataaatt

SEQ ID NO: 84014 - DNA, 9 bp, Unknown
  misc_feature (1)..( 9): Result.001 file - promoters70/1459039
ctataaaac

SEQ ID NO: 84015 - DNA, 9 bp, Unknown
  misc_feature (1)..( 9): Result.001 file - promoters70/1459039
ctataaatt

SEQ ID NO: 84016 - DNA, 9 bp, Unknown
  misc_feature (1)..( 9): Result.001 file - promoters70/1459039
atataaaga

SEQ ID NO: 84017 - DNA, 9 bp, Unknown
  misc_feature (1)..( 9): Result.001 file - promoters70/1459223
ctataaagg

SEQ ID NO: 84018 - DNA, 10 bp, Unknown
  misc_feature (1)..( 10): Result.001 file - promoters70/1459223
aaaaaaatat

SEQ ID NO: 84019 - DNA, 10 bp, Unknown
  misc_feature (1)..( 10): Result.001 file - promoters70/1459223
aaaaaaggaa

SEQ ID NO: 84020 - DNA, 11 bp, Unknown
  misc_feature (1)..( 11): Result.001 file - promoters70/1459223
aaagaaataat

SEQ ID NO: 84021 - DNA, 11 bp, Unknown
  misc_feature (1)..( 11): Result.001 file - promoters70/1459223
aaaaaaatggt

SEQ ID NO: 84022 - DNA, 11 bp, Unknown
  misc_feature (1)..( 11): Result.001 file - promoters70/1459223
gatgaaatatt

SEQ ID NO: 84023 - DNA, 11 bp, Unknown
  misc_feature (1)..( 11): Result.001 file - promoters70/1459223
tgataaatatt

SEQ ID NO: 84024 - DNA, 10 bp, Unknown
  misc_feature (1)..( 10): Result.001 file - promoters70/1459223
catataaaac

SEQ ID NO: 84025 - DNA, 10 bp, Unknown
  misc_feature (1)..( 10): Result.001 file - promoters70/1459223
tttataaata

SEQ ID NO: 84026 - DNA, 10 bp, Unknown
  misc_feature (1)..( 10): Result.001 file - promoters70/1459223
tttatacata

SEQ ID NO: 84027 - DNA, 10 bp, Unknown
  misc_feature (1)..( 10): Result.001 file - promoters70/1459223
gttattaata

SEQ ID NO: 84028 - DNA, 10 bp, Unknown
  misc_feature (1)..( 10): Result.001 file - promoters70/1459223
aataataact

SEQ ID NO: 84029 - DNA, 10 bp, Unknown
  misc_feature (1)..( 10): Result.001 file - promoters70/1459223
tcaattaatc

SEQ ID NO: 84030 - DNA, 10 bp, Unknown
  misc_feature (1)..( 10): Result.001 file - promoters70/1459223
caaacaaaac

SEQ ID NO: 84031 - DNA, 10 bp, Unknown
  misc_feature (1)..( 10): Result.001 file - promoters70/1459223
caatcaaatc

SEQ ID NO: 84032 - DNA, 10 bp, Unknown
  misc_feature (1)..( 10): Result.001 file - promoters70/1459223
caaagaaatt

SEQ ID NO: 84033 - DNA, 10 bp, Unknown
  misc_feature (1)..( 10): Result.001 file - promoters70/1459223
ttgtcaaatg

SEQ ID NO: 84034 - DNA, 10 bp, Unknown
  misc_feature (1)..( 10): Result.001 file - promoters70/1459223
gtaagaaaaa

SEQ ID NO: 84035 - DNA, 10 bp, Unknown
  misc_feature (1)..( 10): Result.001 file - promoters70/1461780
ttatttaatc

SEQ ID NO: 84036 - DNA, 11 bp, Unknown
  misc_feature (1)..( 11): Result.001 file - promoters70/1461780
ttttctcttcc

SEQ ID NO: 84037 - DNA, 11 bp, Unknown
  misc_feature (1)..( 11): Result.001 file - promoters70/1461780
tttactccatt

SEQ ID NO: 84038 - DNA, 11 bp, Unknown
  misc_feature (1)..( 11): Result.001 file - promoters70/1461791
aatactcaatt

SEQ ID NO: 84039 - DNA, 11 bp, Unknown
  misc_feature (1)..( 11): Result.001 file - promoters70/1461791
taaggtgtgtt

SEQ ID NO: 84040 - DNA, 11 bp, Unknown
  misc_feature (1)..( 11): Result.001 file - promoters70/1461791
gaagttgtgtt

SEQ ID NO: 84041 - DNA, 11 bp, Unknown
  misc_feature (1)..( 11): Result.001 file - promoters70/1461791
gaaattgaaac

SEQ ID NO: 84042 - DNA, 6 bp, Unknown
  misc_feature (1)..( 6): Result.001 file - promoters70/1461791
caattt

SEQ ID NO: 84043 - DNA, 6 bp, Unknown
  misc_feature (1)..( 6): Result.001 file - promoters70/1461791
caattt

SEQ ID NO: 84044 - DNA, 6 bp, Unknown
  misc_feature (1)..( 6): Result.001 file - promoters70/1461791
caattt

SEQ ID NO: 84045 - DNA, 9 bp, Unknown
  misc_feature (1)..( 9): Result.001 file - promoters70/1461791
actttaaat

SEQ ID NO: 84046 - DNA, 9 bp, Unknown
  misc_feature (1)..( 9): Result.001 file - promoters70/1461791
actataaat

SEQ ID NO: 84047 - DNA, 9 bp, Unknown
  misc_feature (1)..( 9): Result.001 file - promoters70/1461791
tatataaaa

SEQ ID NO: 84048 - DNA, 7 bp, Unknown
  misc_feature (1)..( 7): Result.001 file - promoters70/1461791
gttaaac

SEQ ID NO: 84049 - DNA, 7 bp, Unknown
  misc_feature (1)..( 7): Result.001 file - promoters70/1461791
gttgaac

SEQ ID NO: 84050 - DNA, 7 bp, Unknown
  misc_feature (1)..( 7): Result.001 file - promoters70/1461791
gttgaaa

SEQ ID NO: 84051 - DNA, 9 bp, Unknown
  misc_feature (1)..( 9): Result.001 file - promoters70/1461791
ttaaataaa

SEQ ID NO: 84052 - DNA, 9 bp, Unknown
  misc_feature (1)..( 9): Result.001 file - promoters70/1461791
tgaaacaaa

SEQ ID NO: 84053 - DNA, 9 bp, Unknown
  misc_feature (1)..( 9): Result.001 file - promoters70/1461791
tgaaacaca

SEQ ID NO: 84054 - DNA, 9 bp, Unknown
  misc_feature (1)..( 9): Result.001 file - promoters70/1461791
gacaataac

SEQ ID NO: 84055 - DNA, 7 bp, Unknown
  misc_feature (1)..( 7): Result.001 file - promoters70/1461791
gaaatcg

SEQ ID NO: 84056 - DNA, 7 bp, Unknown
  misc_feature (1)..( 7): Result.001 file - promoters70/1461791
gaattcg

SEQ ID NO: 84057 - DNA, 7 bp, Unknown
  misc_feature (1)..( 7): Result.001 file - promoters70/1461803
gaaatcg

SEQ ID NO: 84058 - DNA, 15 bp, Unknown
  misc_feature (1)..( 15): Result.001 file - promoters70/1461803
atggcatataattaa

SEQ ID NO: 84059 - DNA, 15 bp, Unknown
  misc_feature (1)..( 15): Result.001 file - promoters70/1461803
actccatttaatttt

SEQ ID NO: 84060 - DNA, 15 bp, Unknown
  misc_feature (1)..( 15): Result.001 file - promoters70/1461803
ttaaattatgattaa

SEQ ID NO: 84061 - DNA, 15 bp, Unknown
  misc_feature (1)..( 15): Result.001 file - promoters70/1461803
actacatttggagat

SEQ ID NO: 84062 - DNA, 8 bp, Unknown
  misc_feature (1)..( 8): Result.001 file - promoters70/1461803
caacatga

SEQ ID NO: 84063 - DNA, 8 bp, Unknown
  misc_feature (1)..( 8): Result.001 file - promoters70/1461803
caaaatgc

SEQ ID NO: 84064 - DNA, 8 bp, Unknown
  misc_feature (1)..( 8): Result.001 file - promoters70/1461803
aaacctga

SEQ ID NO: 84065 - DNA, 12 bp, Unknown
  misc_feature (1)..( 12): Result.001 file - promoters70/1461803
accaataaaaga

SEQ ID NO: 84066 - DNA, 12 bp, Unknown
  misc_feature (1)..( 12): Result.001 file - promoters70/1461803
tctcataaaaga

SEQ ID NO: 84067 - DNA, 12 bp, Unknown
  misc_feature (1)..( 12): Result.001 file - promoters70/1461803
accaagaaaacc

SEQ ID NO: 84068 - DNA, 11 bp, Unknown
  misc_feature (1)..( 11): Result.001 file - promoters70/1461803
agaagatgagt

SEQ ID NO: 84069 - DNA, 11 bp, Unknown
  misc_feature (1)..( 11): Result.001 file - promoters70/1461803
agaagagaaaa

SEQ ID NO: 84070 - DNA, 11 bp, Unknown
  misc_feature (1)..( 11): Result.001 file - promoters70/1461803
agacgattagt

SEQ ID NO: 84071 - DNA, 11 bp, Unknown
  misc_feature (1)..( 11): Result.001 file - promoters70/1461803
agaagatgagt

SEQ ID NO: 84072 - DNA, 11 bp, Unknown
  misc_feature (1)..( 11): Result.001 file - promoters70/1461803
aaacaatgagt

SEQ ID NO: 84073 - DNA, 11 bp, Unknown
  misc_feature (1)..( 11): Result.001 file - promoters70/1461803
agacgattagt

SEQ ID NO: 84074 - DNA, 8 bp, Unknown
  misc_feature (1)..( 8): Result.001 file - promoters70/1461803
aattttca

SEQ ID NO: 84075 - DNA, 8 bp, Unknown
  misc_feature (1)..( 8): Result.001 file - promoters70/1461803
aatcttcc

SEQ ID NO: 84076 - DNA, 8 bp, Unknown
  misc_feature (1)..( 8): Result.001 file - promoters70/1461803
tcttttca

SEQ ID NO: 84077 - DNA, 8 bp, Unknown
  misc_feature (1)..( 8): Result.001 file - promoters70/1461803
aataattt

SEQ ID NO: 84078 - DNA, 8 bp, Unknown
  misc_feature (1)..( 8): Result.001 file - promoters70/1461803
aataatta

SEQ ID NO: 84079 - DNA, 8 bp, Unknown
  misc_feature (1)..( 8): Result.001 file - promoters70/1461803
tatactta

SEQ ID NO: 84080 - DNA, 10 bp, Unknown
  misc_feature (1)..( 10): Result.001 file - promoters70/1461803
accaataaaa

SEQ ID NO: 84081 - DNA, 10 bp, Unknown
  misc_feature (1)..( 10): Result.001 file - promoters70/1461803
gccaatataa

SEQ ID NO: 84082 - DNA, 10 bp, Unknown
  misc_feature (1)..( 10): Result.001 file - promoters70/1461803
accaagaaaa

SEQ ID NO: 84083 - DNA, 10 bp, Unknown
  misc_feature (1)..( 10): Result.001 file - promoters70/1461803
taaaagaaag

SEQ ID NO: 84084 - DNA, 11 bp, Unknown
  misc_feature (1)..( 11): Result.001 file - promoters70/1461803
cacaatataaa

SEQ ID NO: 84085 - DNA, 11 bp, Unknown
  misc_feature (1)..( 11): Result.001 file - promoters70/1461803
gtcaatataaa

SEQ ID NO: 84086 - DNA, 11 bp, Unknown
  misc_feature (1)..( 11): Result.001 file - promoters70/1461803
gtcaataaata

SEQ ID NO: 84087 - DNA, 8 bp, Unknown
  misc_feature (1)..( 8): Result.001 file - promoters70/1461803
aaggaaat

SEQ ID NO: 84088 - DNA, 8 bp, Unknown
  misc_feature (1)..( 8): Result.001 file - promoters70/1461803
aagcaaaa

SEQ ID NO: 84089 - DNA, 9 bp, Unknown
  misc_feature (1)..( 9): Result.001 file - promoters70/1461839
ccgcacaac

SEQ ID NO: 84090 - DNA, 14 bp, Unknown
  misc_feature (1)..( 14): Result.001 file - promoters70/1461839
aaaaagaaaagaaa

SEQ ID NO: 84091 - DNA, 14 bp, Unknown
  misc_feature (1)..( 14): Result.001 file - promoters70/1461839
atttagataagtaa

SEQ ID NO: 84092 - DNA, 14 bp, Unknown
  misc_feature (1)..( 14): Result.001 file - promoters70/1461839
aaaaagaaaaagaa

SEQ ID NO: 84093 - DNA, 14 bp, Unknown
  misc_feature (1)..( 14): Result.001 file - promoters70/1461839
aaccagaaaagaaa

SEQ ID NO: 84094 - DNA, 11 bp, Unknown
  misc_feature (1)..( 11): Result.001 file - promoters70/1461839
aaagaaagaat

SEQ ID NO: 84095 - DNA, 11 bp, Unknown
  misc_feature (1)..( 11): Result.001 file - promoters70/1461839
aaaaaaagaaa

SEQ ID NO: 84096 - DNA, 11 bp, Unknown
  misc_feature (1)..( 11): Result.001 file - promoters70/1461839
cagaaaagaaa

SEQ ID NO: 84097 - DNA, 11 bp, Unknown
  misc_feature (1)..( 11): Result.001 file - promoters70/1461839
aagtaaagtat

SEQ ID NO: 84098 - DNA, 8 bp, Unknown
  misc_feature (1)..( 8): Result.001 file - promoters70/1461839
caatcttc

SEQ ID NO: 84099 - DNA, 8 bp, Unknown
  misc_feature (1)..( 8): Result.001 file - promoters70/1461839
caatctaa

SEQ ID NO: 84100 - DNA, 8 bp, Unknown
  misc_feature (1)..( 8): Result.001 file - promoters70/1461839
taatctaa

SEQ ID NO: 84101 - DNA, 8 bp, Unknown
  misc_feature (1)..( 8): Result.001 file - promoters70/1461839
caatcttc

SEQ ID NO: 84102 - DNA, 9 bp, Unknown
  misc_feature (1)..( 9): Result.001 file - promoters70/1461839
caaaggagg

SEQ ID NO: 84103 - DNA, 9 bp, Unknown
  misc_feature (1)..( 9): Result.001 file - promoters70/1461839
aaaaagaga

SEQ ID NO: 84104 - DNA, 9 bp, Unknown
  misc_feature (1)..( 9): Result.001 file - promoters70/1461839
caaaggagg

SEQ ID NO: 84105 - DNA, 9 bp, Unknown
  misc_feature (1)..( 9): Result.001 file - promoters70/1470993
aaaaggaga

SEQ ID NO: 84106 - DNA, 8 bp, Unknown
  misc_feature (1)..( 8): Result.001 file - promoters70/1470993
aaagattg

SEQ ID NO: 84107 - DNA, 8 bp, Unknown
  misc_feature (1)..( 8): Result.001 file - promoters70/1470993
aaagcttg

SEQ ID NO: 84108 - DNA, 8 bp, Unknown
  misc_feature (1)..( 8): Result.001 file - promoters70/1470993
aaaaattt

SEQ ID NO: 84109 - DNA, 7 bp, Unknown
  misc_feature (1)..( 7): Result.001 file - promoters70/1470993
ccactaa

SEQ ID NO: 84110 - DNA, 7 bp, Unknown
  misc_feature (1)..( 7): Result.001 file - promoters70/1470993
ccattaa

SEQ ID NO: 84111 - DNA, 7 bp, Unknown
  misc_feature (1)..( 7): Result.001 file - promoters70/1470993
ccattag

SEQ ID NO: 84112 - DNA, 9 bp, Unknown
  misc_feature (1)..( 9): Result.001 file - promoters70/1470993
cttaattta

SEQ ID NO: 84113 - DNA, 9 bp, Unknown
  misc_feature (1)..( 9): Result.001 file - promoters70/1470993
actaaatta

SEQ ID NO: 84114 - DNA, 9 bp, Unknown
  misc_feature (1)..( 9): Result.001 file - promoters70/1470993
actgaattc

SEQ ID NO: 84115 - DNA, 8 bp, Unknown
  misc_feature (1)..( 8): Result.001 file - promoters70/1470993
cagttttc

SEQ ID NO: 84116 - DNA, 8 bp, Unknown
  misc_feature (1)..( 8): Result.001 file - promoters70/1470993
tagttttg

SEQ ID NO: 84117 - DNA, 8 bp, Unknown
  misc_feature (1)..( 8): Result.001 file - promoters70/1471041
tagctttg

SEQ ID NO: 84118 - DNA, 6 bp, Unknown
  misc_feature (1)..( 6): Result.001 file - promoters70/1471041
ataaat

SEQ ID NO: 84119 - DNA, 7 bp, Unknown
  misc_feature (1)..( 7): Result.001 file - promoters70/1471041
aataaat

SEQ ID NO: 84120 - DNA, 7 bp, Unknown
  misc_feature (1)..( 7): Result.001 file - promoters70/1471041
caaaaaa

SEQ ID NO: 84121 - DNA, 7 bp, Unknown
  misc_feature (1)..( 7): Result.001 file - promoters70/1471041
aaacatg

SEQ ID NO: 84122 - DNA, 7 bp, Unknown
  misc_feature (1)..( 7): Result.001 file - promoters70/1471041
aaaaatg

SEQ ID NO: 84123 - DNA, 7 bp, Unknown
  misc_feature (1)..( 7): Result.001 file - promoters70/1472778
aaaaata

SEQ ID NO: 84124 - DNA, 13 bp, Unknown
  misc_feature (1)..( 13): Result.001 file - promoters70/1472778
gtttaaaacaaag

SEQ ID NO: 84125 - DNA, 13 bp, Unknown
  misc_feature (1)..( 13): Result.001 file - promoters70/1472778
cagcaaaacgaag

SEQ ID NO: 84126 - DNA, 13 bp, Unknown
  misc_feature (1)..( 13): Result.001 file - promoters70/1472778
ctataaaacgtgt

SEQ ID NO: 84127 - DNA, 13 bp, Unknown
  misc_feature (1)..( 13): Result.001 file - promoters70/1472778
gtatataacccaa

SEQ ID NO: 84128 - DNA, 13 bp, Unknown
  misc_feature (1)..( 13): Result.001 file - promoters70/1472778
gtatattattaat

SEQ ID NO: 84129 - DNA, 12 bp, Unknown
  misc_feature (1)..( 12): Result.001 file - promoters70/1472778
gatataatacag

SEQ ID NO: 84130 - DNA, 12 bp, Unknown
  misc_feature (1)..( 12): Result.001 file - promoters70/1472778
taaataacacag

SEQ ID NO: 84131 - DNA, 12 bp, Unknown
  misc_feature (1)..( 12): Result.001 file - promoters70/1472778
tatataacacaa

SEQ ID NO: 84132 - DNA, 12 bp, Unknown
  misc_feature (1)..( 12): Result.001 file - promoters70/1472778
tatttaagtaaa

SEQ ID NO: 84133 - DNA, 9 bp, Unknown
  misc_feature (1)..( 9): Result.001 file - promoters70/1472778
ttacttttt

SEQ ID NO: 84134 - DNA, 9 bp, Unknown
  misc_feature (1)..( 9): Result.001 file - promoters70/1472778
ttaattttc

SEQ ID NO: 84135 - DNA, 9 bp, Unknown
  misc_feature (1)..( 9): Result.001 file - promoters70/1472778
gtaatgttc

SEQ ID NO: 84136 - DNA, 9 bp, Unknown
  misc_feature (1)..( 9): Result.001 file - promoters70/1472778
tgaattttc

SEQ ID NO: 84137 - DNA, 10 bp, Unknown
  misc_feature (1)..( 10): Result.001 file - promoters70/1472778
ttttagtttg

SEQ ID NO: 84138 - DNA, 10 bp, Unknown
  misc_feature (1)..( 10): Result.001 file - promoters70/1472778
ttttcgtttc

SEQ ID NO: 84139 - DNA, 10 bp, Unknown
  misc_feature (1)..( 10): Result.001 file - promoters70/1472778
ttttatttta

SEQ ID NO: 84140 - DNA, 10 bp, Unknown
  misc_feature (1)..( 10): Result.001 file - promoters70/1472778
tgtaatgttc

SEQ ID NO: 84141 - DNA, 10 bp, Unknown
  misc_feature (1)..( 10): Result.001 file - promoters70/1472778
ttgaattttc

SEQ ID NO: 84142 - DNA, 10 bp, Unknown
  misc_feature (1)..( 10): Result.001 file - promoters70/1472778
gaaacactta

SEQ ID NO: 84143 - DNA, 10 bp, Unknown
  misc_feature (1)..( 10): Result.001 file - promoters70/1472778
gatacagtta

SEQ ID NO: 84144 - DNA, 10 bp, Unknown
  misc_feature (1)..( 10): Result.001 file - promoters70/1472778
gaatcacttc

SEQ ID NO: 84145 - DNA, 10 bp, Unknown
  misc_feature (1)..( 10): Result.001 file - promoters70/1472778
tataaagtta

SEQ ID NO: 84146 - DNA, 10 bp, Unknown
  misc_feature (1)..( 10): Result.001 file - promoters70/1472799
tctacagttc

SEQ ID NO: 84147 - DNA, 8 bp, Unknown
  misc_feature (1)..( 8): Result.001 file - promoters70/1472799
atcatatt

SEQ ID NO: 84148 - DNA, 8 bp, Unknown
  misc_feature (1)..( 8): Result.001 file - promoters70/1472799
atcatatt

SEQ ID NO: 84149 - DNA, 8 bp, Unknown
  misc_feature (1)..( 8): Result.001 file - promoters70/1472799
atcatatt

SEQ ID NO: 84150 - DNA, 9 bp, Unknown
  misc_feature (1)..( 9): Result.001 file - promoters70/1472799
tttgtagtg

SEQ ID NO: 84151 - DNA, 9 bp, Unknown
  misc_feature (1)..( 9): Result.001 file - promoters70/1472799
attgtagct

SEQ ID NO: 84152 - DNA, 9 bp, Unknown
  misc_feature (1)..( 9): Result.001 file - promoters70/1472799
tttgttgtg

SEQ ID NO: 84153 - DNA, 8 bp, Unknown
  misc_feature (1)..( 8): Result.001 file - promoters70/1472799
tgatttgt

SEQ ID NO: 84154 - DNA, 8 bp, Unknown
  misc_feature (1)..( 8): Result.001 file - promoters70/1472799
agatatgt

SEQ ID NO: 84155 - DNA, 8 bp, Unknown
  misc_feature (1)..( 8): Result.001 file - promoters70/1472799
tgatttgg

SEQ ID NO: 84156 - DNA, 7 bp, Unknown
  misc_feature (1)..( 7): Result.001 file - promoters70/1472799
gtttgtt

SEQ ID NO: 84157 - DNA, 7 bp, Unknown
  misc_feature (1)..( 7): Result.001 file - promoters70/1472799
gtttgtg

SEQ ID NO: 84158 - DNA, 7 bp, Unknown
  misc_feature (1)..( 7): Result.001 file - promoters70/1472799
ttttgtt

SEQ ID NO: 84159 - DNA, 8 bp, Unknown
  misc_feature (1)..( 8): Result.001 file - promoters70/1472799
tgtttgtt

SEQ ID NO: 84160 - DNA, 8 bp, Unknown
  misc_feature (1)..( 8): Result.001 file - promoters70/1472799
gatttgtt

SEQ ID NO: 84161 - DNA, 8 bp, Unknown
  misc_feature (1)..( 8): Result.001 file - promoters70/1481696
gatatgta

SEQ ID NO: 84162 - DNA, 7 bp, Unknown
  misc_feature (1)..( 7): Result.001 file - promoters70/1481696
tttactt

SEQ ID NO: 84163 - DNA, 7 bp, Unknown
  misc_feature (1)..( 7): Result.001 file - promoters70/1481696
tttgctt

SEQ ID NO: 84164 - DNA, 7 bp, Unknown
  misc_feature (1)..( 7): Result.001 file - promoters70/1481696
attactt

SEQ ID NO: 84165 - DNA, 7 bp, Unknown
  misc_feature (1)..( 7): Result.001 file - promoters70/1481696
tttgctg

SEQ ID NO: 84166 - DNA, 10 bp, Unknown
  misc_feature (1)..( 10): Result.001 file - promoters70/1481696
caaaagaatc

SEQ ID NO: 84167 - DNA, 10 bp, Unknown
  misc_feature (1)..( 10): Result.001 file - promoters70/1481696
caaaacaatt

SEQ ID NO: 84168 - DNA, 10 bp, Unknown
  misc_feature (1)..( 10): Result.001 file - promoters70/1481696
acaaagaaac

SEQ ID NO: 84169 - DNA, 10 bp, Unknown
  misc_feature (1)..( 10): Result.001 file - promoters70/1481696
attaagaaaa

SEQ ID NO: 84170 - DNA, 12 bp, Unknown
  misc_feature (1)..( 12): Result.001 file - promoters70/1481696
tttattcaatcc

SEQ ID NO: 84171 - DNA, 12 bp, Unknown
  misc_feature (1)..( 12): Result.001 file - promoters70/1481696
cttatgcaaagc

SEQ ID NO: 84172 - DNA, 12 bp, Unknown
  misc_feature (1)..( 12): Result.001 file - promoters70/1481696
tatatttaattt

SEQ ID NO: 84173 - DNA, 12 bp, Unknown
  misc_feature (1)..( 12): Result.001 file - promoters70/1481696
tatatttacttt

SEQ ID NO: 84174 - DNA, 8 bp, Unknown
  misc_feature (1)..( 8): Result.001 file - promoters70/1481696
tttcttac

SEQ ID NO: 84175 - DNA, 8 bp, Unknown
  misc_feature (1)..( 8): Result.001 file - promoters70/1481696
tttattat

SEQ ID NO: 84176 - DNA, 9 bp, Unknown
  misc_feature (1)..( 9): Result.001 file - promoters70/1481696
tttgattaa

SEQ ID NO: 84177 - DNA, 9 bp, Unknown
  misc_feature (1)..( 9): Result.001 file - promoters70/1481696
tctgattaa

SEQ ID NO: 84178 - DNA, 9 bp, Unknown
  misc_feature (1)..( 9): Result.001 file - promoters70/1481696
tgatattat

SEQ ID NO: 84179 - DNA, 15 bp, Unknown
  misc_feature (1)..( 15): Result.001 file - promoters70/1481696
tttgcttctttggat

SEQ ID NO: 84180 - DNA, 15 bp, Unknown
  misc_feature (1)..( 15): Result.001 file - promoters70/1481696
gatggatctttagat

SEQ ID NO: 84181 - DNA, 15 bp, Unknown
  misc_feature (1)..( 15): Result.001 file - promoters70/1481696
tgctgatgtttgatt

SEQ ID NO: 84182 - DNA, 15 bp, Unknown
  misc_feature (1)..( 15): Result.001 file - promoters70/1482448
tgctaatgtgaactt

SEQ ID NO: 84183 - DNA, 9 bp, Unknown
  misc_feature (1)..( 9): Result.001 file - promoters70/1482448
actatatat

SEQ ID NO: 84184 - DNA, 9 bp, Unknown
  misc_feature (1)..( 9): Result.001 file - promoters70/1482448
actatataa

SEQ ID NO: 84185 - DNA, 9 bp, Unknown
  misc_feature (1)..( 9): Result.001 file - promoters70/1482448
ctaatataa

SEQ ID NO: 84186 - DNA, 8 bp, Unknown
  misc_feature (1)..( 8): Result.001 file - promoters70/1482448
cattttta

SEQ ID NO: 84187 - DNA, 8 bp, Unknown
  misc_feature (1)..( 8): Result.001 file - promoters70/1482448
catttttt

SEQ ID NO: 84188 - DNA, 8 bp, Unknown
  misc_feature (1)..( 8): Result.001 file - promoters70/1482448
tttttttt

SEQ ID NO: 84189 - DNA, 8 bp, Unknown
  misc_feature (1)..( 8): Result.001 file - promoters70/1482448
attgtaag

SEQ ID NO: 84190 - DNA, 8 bp, Unknown
  misc_feature (1)..( 8): Result.001 file - promoters70/1482448
attttaaa

SEQ ID NO: 84191 - DNA, 8 bp, Unknown
  misc_feature (1)..( 8): Result.001 file - promoters70/1532660
cgtttaaa

SEQ ID NO: 84192 - DNA, 10 bp, Unknown
  misc_feature (1)..( 10): Result.001 file - promoters70/1532660
caaaatttac

SEQ ID NO: 84193 - DNA, 10 bp, Unknown
  misc_feature (1)..( 10): Result.001 file - promoters70/1532660
ttaaatttgt

SEQ ID NO: 84194 - DNA, 10 bp, Unknown
  misc_feature (1)..( 10): Result.001 file - promoters70/1532660
taaaatttgt

SEQ ID NO: 84195 - DNA, 10 bp, Unknown
  misc_feature (1)..( 10): Result.001 file - promoters70/1532660
aaaagtttgt

SEQ ID NO: 84196 - DNA, 10 bp, Unknown
  misc_feature (1)..( 10): Result.001 file - promoters70/1532660
ttaactttaa

SEQ ID NO: 84197 - DNA, 10 bp, Unknown
  misc_feature (1)..( 10): Result.001 file - promoters70/1532660
gtaaatttgt

SEQ ID NO: 84198 - DNA, 12 bp, Unknown
  misc_feature (1)..( 12): Result.001 file - promoters70/1532660
aaaaaatcaaag

SEQ ID NO: 84199 - DNA, 12 bp, Unknown
  misc_feature (1)..( 12): Result.001 file - promoters70/1532660
aaagaatagttc

SEQ ID NO: 84200 - DNA, 12 bp, Unknown
  misc_feature (1)..( 12): Result.001 file - promoters70/1532660
aaaaaacttcca

SEQ ID NO: 84201 - DNA, 12 bp, Unknown
  misc_feature (1)..( 12): Result.001 file - promoters70/1532660
taaacatctctg

SEQ ID NO: 84202 - DNA, 12 bp, Unknown
  misc_feature (1)..( 12): Result.001 file - promoters70/1532660
gaaaaattcatc

SEQ ID NO: 84203 - DNA, 12 bp, Unknown
  misc_feature (1)..( 12): Result.001 file - promoters70/1532660
aaagaaatctgc

SEQ ID NO: 84204 - DNA, 12 bp, Unknown
  misc_feature (1)..( 12): Result.001 file - promoters70/1532937
gccctatttatc

SEQ ID NO: 84205 - DNA, 10 bp, Unknown
  misc_feature (1)..( 10): Result.001 file - promoters70/1532937
ttttgtaaat

SEQ ID NO: 84206 - DNA, 10 bp, Unknown
  misc_feature (1)..( 10): Result.001 file - promoters70/1532937
ttttgttttt

SEQ ID NO: 84207 - DNA, 10 bp, Unknown
  misc_feature (1)..( 10): Result.001 file - promoters70/1532937
ttttgttgtt

SEQ ID NO: 84208 - DNA, 11 bp, Unknown
  misc_feature (1)..( 11): Result.001 file - promoters70/1532937
gtttgatttga

SEQ ID NO: 84209 - DNA, 11 bp, Unknown
  misc_feature (1)..( 11): Result.001 file - promoters70/1532937
cataggttgtt

SEQ ID NO: 84210 - DNA, 11 bp, Unknown
  misc_feature (1)..( 11): Result.001 file - promoters70/1532937
tttttgtttct

SEQ ID NO: 84211 - DNA, 11 bp, Unknown
  misc_feature (1)..( 11): Result.001 file - promoters70/1532937
gtttgattaaa

SEQ ID NO: 84212 - DNA, 14 bp, Unknown
  misc_feature (1)..( 14): Result.001 file - promoters70/1532937
ttgtaataataact

SEQ ID NO: 84213 - DNA, 14 bp, Unknown
  misc_feature (1)..( 14): Result.001 file - promoters70/1532937
tattaataaaattt

SEQ ID NO: 84214 - DNA, 14 bp, Unknown
  misc_feature (1)..( 14): Result.001 file - promoters70/1532937
tattaataaatttt

SEQ ID NO: 84215 - DNA, 14 bp, Unknown
  misc_feature (1)..( 14): Result.001 file - promoters70/1532937
ttttaacaaaacaa

SEQ ID NO: 84216 - DNA, 14 bp, Unknown
  misc_feature (1)..( 14): Result.001 file - promoters70/1532937
gattaagaaaataa

SEQ ID NO: 84217 - DNA, 14 bp, Unknown
  misc_feature (1)..( 14): Result.001 file - promoters70/1532937
aaagaataaaaatt

SEQ ID NO: 84218 - DNA, 14 bp, Unknown
  misc_feature (1)..( 14): Result.001 file - promoters70/1532937
ttgaaacaaagaaa

SEQ ID NO: 84219 - DNA, 13 bp, Unknown
  misc_feature (1)..( 13): Result.001 file - promoters70/1532937
ctttttttttttt

SEQ ID NO: 84220 - DNA, 13 bp, Unknown
  misc_feature (1)..( 13): Result.001 file - promoters70/1532937
ctttttttgtttc

SEQ ID NO: 84221 - DNA, 13 bp, Unknown
  misc_feature (1)..( 13): Result.001 file - promoters70/1532937
gttgttttgtttg

SEQ ID NO: 84222 - DNA, 13 bp, Unknown
  misc_feature (1)..( 13): Result.001 file - promoters70/1532937
cataggttgtttt

SEQ ID NO: 84223 - DNA, 13 bp, Unknown
  misc_feature (1)..( 13): Result.001 file - promoters70/1532937
acttccatgtttt

SEQ ID NO: 84224 - DNA, 13 bp, Unknown
  misc_feature (1)..( 13): Result.001 file - promoters70/1532937
cttttgttgttac

SEQ ID NO: 84225 - DNA, 14 bp, Unknown
  misc_feature (1)..( 14): Result.001 file - promoters70/1532937
taataataactctt

SEQ ID NO: 84226 - DNA, 14 bp, Unknown
  misc_feature (1)..( 14): Result.001 file - promoters70/1532937
tattaataaatttt

SEQ ID NO: 84227 - DNA, 14 bp, Unknown
  misc_feature (1)..( 14): Result.001 file - promoters70/1532937
tattaataaaattt

SEQ ID NO: 84228 - DNA, 14 bp, Unknown
  misc_feature (1)..( 14): Result.001 file - promoters70/1532937
ttttaacaaaacaa

SEQ ID NO: 84229 - DNA, 14 bp, Unknown
  misc_feature (1)..( 14): Result.001 file - promoters70/1532937
gattaagaaaataa

SEQ ID NO: 84230 - DNA, 14 bp, Unknown
  misc_feature (1)..( 14): Result.001 file - promoters70/1532937
aaagaataaaaatt

SEQ ID NO: 84231 - DNA, 14 bp, Unknown
  misc_feature (1)..( 14): Result.001 file - promoters70/1532937
ttgaaacaaagaaa

SEQ ID NO: 84232 - DNA, 10 bp, Unknown
  misc_feature (1)..( 10): Result.001 file - promoters70/1532937
cgttcttgcc

SEQ ID NO: 84233 - DNA, 10 bp, Unknown
  misc_feature (1)..( 10): Result.001 file - promoters70/1532937
tgtttttgct

SEQ ID NO: 84234 - DNA, 10 bp, Unknown
  misc_feature (1)..( 10): Result.001 file - promoters70/1532937
tgttttaaga

SEQ ID NO: 84235 - DNA, 10 bp, Unknown
  misc_feature (1)..( 10): Result.001 file - promoters70/1532937
tttttttgtt

SEQ ID NO: 84236 - DNA, 10 bp, Unknown
  misc_feature (1)..( 10): Result.001 file - promoters70/1532937
tccttttgtt

SEQ ID NO: 84237 - DNA, 10 bp, Unknown
  misc_feature (1)..( 10): Result.001 file - promoters70/1532948
tgttttgttt

SEQ ID NO: 84238 - DNA, 8 bp, Unknown
  misc_feature (1)..( 8): Result.001 file - promoters70/1532948
attccatt

SEQ ID NO: 84239 - DNA, 8 bp, Unknown
  misc_feature (1)..( 8): Result.001 file - promoters70/1532948
tttccatt

SEQ ID NO: 84240 - DNA, 8 bp, Unknown
  misc_feature (1)..( 8): Result.001 file - promoters70/1532948
attccaaa

SEQ ID NO: 84241 - DNA, 8 bp, Unknown
  misc_feature (1)..( 8): Result.001 file - promoters70/1532948
tttgtaat

SEQ ID NO: 84242 - DNA, 8 bp, Unknown
  misc_feature (1)..( 8): Result.001 file - promoters70/1532948
attgtaat

SEQ ID NO: 84243 - DNA, 8 bp, Unknown
  misc_feature (1)..( 8): Result.001 file - promoters70/1532948
tttgtaac

SEQ ID NO: 84244 - DNA, 12 bp, Unknown
  misc_feature (1)..( 12): Result.001 file - promoters70/1532948
gttggaatttag

SEQ ID NO: 84245 - DNA, 12 bp, Unknown
  misc_feature (1)..( 12): Result.001 file - promoters70/1532948
aaaagaaattaa

SEQ ID NO: 84246 - DNA, 12 bp, Unknown
  misc_feature (1)..( 12): Result.001 file - promoters70/1532948
aaaagaaaataa

SEQ ID NO: 84247 - DNA, 12 bp, Unknown
  misc_feature (1)..( 12): Result.001 file - promoters70/1532948
aaatgaaatatc

SEQ ID NO: 84248 - DNA, 12 bp, Unknown
  misc_feature (1)..( 12): Result.001 file - promoters70/1532948
ataagacaacac

SEQ ID NO: 84249 - DNA, 12 bp, Unknown
  misc_feature (1)..( 12): Result.001 file - promoters70/1532948
ttgagacaaaaa

SEQ ID NO: 84250 - DNA, 12 bp, Unknown
  misc_feature (1)..( 12): Result.001 file - promoters70/1532948
ttgaaacaaaaa

SEQ ID NO: 84251 - DNA, 12 bp, Unknown
  misc_feature (1)..( 12): Result.001 file - promoters70/1532948
gagaaagaaagc

SEQ ID NO: 84252 - DNA, 9 bp, Unknown
  misc_feature (1)..( 9): Result.001 file - promoters70/1532948
ggagaaaaa

SEQ ID NO: 84253 - DNA, 9 bp, Unknown
  misc_feature (1)..( 9): Result.001 file - promoters70/1532948
atggaaaaa

SEQ ID NO: 84254 - DNA, 9 bp, Unknown
  misc_feature (1)..( 9): Result.001 file - promoters70/1532948
ggagaaaac

SEQ ID NO: 84255 - DNA, 8 bp, Unknown
  misc_feature (1)..( 8): Result.001 file - promoters70/1532948
accaataa

SEQ ID NO: 84256 - DNA, 8 bp, Unknown
  misc_feature (1)..( 8): Result.001 file - promoters70/1532948
cccactaa

SEQ ID NO: 84257 - DNA, 8 bp, Unknown
  misc_feature (1)..( 8): Result.001 file - promoters70/1532948
cccactag

SEQ ID NO: 84258 - DNA, 11 bp, Unknown
  misc_feature (1)..( 11): Result.001 file - promoters70/1532948
taacaagtaaa

SEQ ID NO: 84259 - DNA, 11 bp, Unknown
  misc_feature (1)..( 11): Result.001 file - promoters70/1532948
taataagtaaa

SEQ ID NO: 84260 - DNA, 11 bp, Unknown
  misc_feature (1)..( 11): Result.001 file - promoters70/1534378
gcaagagtaaa

SEQ ID NO: 84261 - DNA, 9 bp, Unknown
  misc_feature (1)..( 9): Result.001 file - promoters70/1534378
gaaattctt

SEQ ID NO: 84262 - DNA, 9 bp, Unknown
  misc_feature (1)..( 9): Result.001 file - promoters70/1534378
tcaatcctt

SEQ ID NO: 84263 - DNA, 9 bp, Unknown
  misc_feature (1)..( 9): Result.001 file - promoters70/1534378
gaaattctg

SEQ ID NO: 84264 - DNA, 7 bp, Unknown
  misc_feature (1)..( 7): Result.001 file - promoters70/1534378
aatggat

SEQ ID NO: 84265 - DNA, 7 bp, Unknown
  misc_feature (1)..( 7): Result.001 file - promoters70/1534378
aattgat

SEQ ID NO: 84266 - DNA, 7 bp, Unknown
  misc_feature (1)..( 7): Result.001 file - promoters70/1534378
aatggac

SEQ ID NO: 84267 - DNA, 7 bp, Unknown
  misc_feature (1)..( 7): Result.001 file - promoters70/1534378
gaccaac

SEQ ID NO: 84268 - DNA, 7 bp, Unknown
  misc_feature (1)..( 7): Result.001 file - promoters70/1534378
taccaac

SEQ ID NO: 84269 - DNA, 7 bp, Unknown
  misc_feature (1)..( 7): Result.001 file - promoters70/1534528
gacaaac

SEQ ID NO: 84270 - DNA, 7 bp, Unknown
  misc_feature (1)..( 7): Result.001 file - promoters70/1534528
ctatata

SEQ ID NO: 84271 - DNA, 7 bp, Unknown
  misc_feature (1)..( 7): Result.001 file - promoters70/1534528
gtatata

SEQ ID NO: 84272 - DNA, 7 bp, Unknown
  misc_feature (1)..( 7): Result.001 file - promoters70/1537456
gtatata

SEQ ID NO: 84273 - DNA, 8 bp, Unknown
  misc_feature (1)..( 8): Result.001 file - promoters70/1537456
cttccttt

SEQ ID NO: 84274 - DNA, 8 bp, Unknown
  misc_feature (1)..( 8): Result.001 file - promoters70/1537456
ctttcttt

SEQ ID NO: 84275 - DNA, 8 bp, Unknown
  misc_feature (1)..( 8): Result.001 file - promoters70/1537617
ctttcttc

SEQ ID NO: 84276 - DNA, 9 bp, Unknown
  misc_feature (1)..( 9): Result.001 file - promoters70/1537617
tgtatggtg

SEQ ID NO: 84277 - DNA, 9 bp, Unknown
  misc_feature (1)..( 9): Result.001 file - promoters70/1537617
tgtatgcat

SEQ ID NO: 84278 - DNA, 9 bp, Unknown
  misc_feature (1)..( 9): Result.001 file - promoters70/1537617
agtaagcat

SEQ ID NO: 84279 - DNA, 10 bp, Unknown
  misc_feature (1)..( 10): Result.001 file - promoters70/1537617
ttaattttta

SEQ ID NO: 84280 - DNA, 10 bp, Unknown
  misc_feature (1)..( 10): Result.001 file - promoters70/1537617
tcaattttat

SEQ ID NO: 84281 - DNA, 10 bp, Unknown
  misc_feature (1)..( 10): Result.001 file - promoters70/1537617
tcaatcttat

SEQ ID NO: 84282 - DNA, 10 bp, Unknown
  misc_feature (1)..( 10): Result.001 file - promoters70/1537617
taatttttat

SEQ ID NO: 84283 - DNA, 10 bp, Unknown
  misc_feature (1)..( 10): Result.001 file - promoters70/1537617
tcaattttat

SEQ ID NO: 84284 - DNA, 10 bp, Unknown
  misc_feature (1)..( 10): Result.001 file - promoters70/1557606
tcaatcttat

SEQ ID NO: 84285 - DNA, 9 bp, Unknown
  misc_feature (1)..( 9): Result.001 file - promoters70/1557606
ttgacgacg

SEQ ID NO: 84286 - DNA, 9 bp, Unknown
  misc_feature (1)..( 9): Result.001 file - promoters70/1557606
ttggcgaga

SEQ ID NO: 84287 - DNA, 9 bp, Unknown
  misc_feature (1)..( 9): Result.001 file - promoters70/1557769
ccggcaaga

SEQ ID NO: 84288 - DNA, 12 bp, Unknown
  misc_feature (1)..( 12): Result.001 file - promoters70/1557769
atttttgtctaa

SEQ ID NO: 84289 - DNA, 12 bp, Unknown
  misc_feature (1)..( 12): Result.001 file - promoters70/1557769
atttttgttcca

SEQ ID NO: 84290 - DNA, 12 bp, Unknown
  misc_feature (1)..( 12): Result.001 file - promoters70/1557769
atttttcatttt

SEQ ID NO: 84291 - DNA, 12 bp, Unknown
  misc_feature (1)..( 12): Result.001 file - promoters70/1557769
ttttttgtttct

SEQ ID NO: 84292 - DNA, 12 bp, Unknown
  misc_feature (1)..( 12): Result.001 file - promoters70/1557769
cttttttttttt

SEQ ID NO: 84293 - DNA, 17 bp, Unknown
  misc_feature (1)..( 17): Result.001 file - promoters70/1557769
gatattactaatagatt

SEQ ID NO: 84294 - DNA, 17 bp, Unknown
  misc_feature (1)..( 17): Result.001 file - promoters70/1557769
ttgattagtaaaagaat

SEQ ID NO: 84295 - DNA, 17 bp, Unknown
  misc_feature (1)..( 17): Result.001 file - promoters70/1557769
atcgttattaataaatt

SEQ ID NO: 84296 - DNA, 17 bp, Unknown
  misc_feature (1)..( 17): Result.001 file - promoters70/1557769
ttttgtaataataactc

SEQ ID NO: 84297 - DNA, 17 bp, Unknown
  misc_feature (1)..( 17): Result.001 file - promoters70/1557769
aacgatattaatcattg

SEQ ID NO: 84298 - DNA, 17 bp, Unknown
  misc_feature (1)..( 17): Result.001 file - promoters70/1557769
gatattattttttgttc

SEQ ID NO: 84299 - DNA, 9 bp, Unknown
  misc_feature (1)..( 9): Result.001 file - promoters70/1557769
aatttttct

SEQ ID NO: 84300 - DNA, 9 bp, Unknown
  misc_feature (1)..( 9): Result.001 file - promoters70/1557769
cattttttt

SEQ ID NO: 84301 - DNA, 9 bp, Unknown
  misc_feature (1)..( 9): Result.001 file - promoters70/1557769
tgtttctct

SEQ ID NO: 84302 - DNA, 9 bp, Unknown
  misc_feature (1)..( 9): Result.001 file - promoters70/1557769
aatctttac

SEQ ID NO: 84303 - DNA, 9 bp, Unknown
  misc_feature (1)..( 9): Result.001 file - promoters70/1557769
catttttgt

SEQ ID NO: 84304 - DNA, 9 bp, Unknown
  misc_feature (1)..( 9): Result.001 file - promoters70/1557769
acttttttt

SEQ ID NO: 84305 - DNA, 8 bp, Unknown
  misc_feature (1)..( 8): Result.001 file - promoters70/1557769
gatattac

SEQ ID NO: 84306 - DNA, 8 bp, Unknown
  misc_feature (1)..( 8): Result.001 file - promoters70/1557769
gatattaa

SEQ ID NO: 84307 - DNA, 8 bp, Unknown
  misc_feature (1)..( 8): Result.001 file - promoters70/1557769
gatattat

SEQ ID NO: 84308 - DNA, 8 bp, Unknown
  misc_feature (1)..( 8): Result.001 file - promoters70/1557769
aataataa

SEQ ID NO: 84309 - DNA, 8 bp, Unknown
  misc_feature (1)..( 8): Result.001 file - promoters70/1557769
attaataa

SEQ ID NO: 84310 - DNA, 15 bp, Unknown
  misc_feature (1)..( 15): Result.001 file - promoters70/1557769
ttgctaaaaatcctt

SEQ ID NO: 84311 - DNA, 15 bp, Unknown
  misc_feature (1)..( 15): Result.001 file - promoters70/1557769
atttcaaaaatactt

SEQ ID NO: 84312 - DNA, 15 bp, Unknown
  misc_feature (1)..( 15): Result.001 file - promoters70/1557769
gtaacaaaaaagatg

SEQ ID NO: 84313 - DNA, 15 bp, Unknown
  misc_feature (1)..( 15): Result.001 file - promoters70/1557769
aacacaaaagccgaa

SEQ ID NO: 84314 - DNA, 15 bp, Unknown
  misc_feature (1)..( 15): Result.001 file - promoters70/1557769
caaacaaaactaatt

SEQ ID NO: 84315 - DNA, 10 bp, Unknown
  misc_feature (1)..( 10): Result.001 file - promoters70/1557769
agaataaaaa

SEQ ID NO: 84316 - DNA, 10 bp, Unknown
  misc_feature (1)..( 10): Result.001 file - promoters70/1557769
agaaaaaaaa

SEQ ID NO: 84317 - DNA, 10 bp, Unknown
  misc_feature (1)..( 10): Result.001 file - promoters70/1557769
gcaataaaat

SEQ ID NO: 84318 - DNA, 10 bp, Unknown
  misc_feature (1)..( 10): Result.001 file - promoters70/1557769
tctataaaaa

SEQ ID NO: 84319 - DNA, 10 bp, Unknown
  misc_feature (1)..( 10): Result.001 file - promoters70/1567007
tcaatcaaat

SEQ ID NO: 84320 - DNA, 8 bp, Unknown
  misc_feature (1)..( 8): Result.001 file - promoters70/1567007
ctaaaaga

SEQ ID NO: 84321 - DNA, 8 bp, Unknown
  misc_feature (1)..( 8): Result.001 file - promoters70/1567007
ctaaaaaa

SEQ ID NO: 84322 - DNA, 8 bp, Unknown
  misc_feature (1)..( 8): Result.001 file - promoters70/1567007
ttaaaaaa

SEQ ID NO: 84323 - DNA, 8 bp, Unknown
  misc_feature (1)..( 8): Result.001 file - promoters70/1567007
aaaagaac

SEQ ID NO: 84324 - DNA, 8 bp, Unknown
  misc_feature (1)..( 8): Result.001 file - promoters70/1567007
taaaaaac

SEQ ID NO: 84325 - DNA, 8 bp, Unknown
  misc_feature (1)..( 8): Result.001 file - promoters70/1567092
taaaaaaa

SEQ ID NO: 84326 - DNA, 13 bp, Unknown
  misc_feature (1)..( 13): Result.001 file - promoters70/1567092
caacaatgtacaa

SEQ ID NO: 84327 - DNA, 13 bp, Unknown
  misc_feature (1)..( 13): Result.001 file - promoters70/1567092
caataatttacat

SEQ ID NO: 84328 - DNA, 13 bp, Unknown
  misc_feature (1)..( 13): Result.001 file - promoters70/1567092
ttacaatttacaa

SEQ ID NO: 84329 - DNA, 13 bp, Unknown
  misc_feature (1)..( 13): Result.001 file - promoters70/1567092
tgaaaatttatac

SEQ ID NO: 84330 - DNA, 13 bp, Unknown
  misc_feature (1)..( 13): Result.001 file - promoters70/1567092
gtataattttata

SEQ ID NO: 84331 - DNA, 10 bp, Unknown
  misc_feature (1)..( 10): Result.001 file - promoters70/1567092
tttgcttaca

SEQ ID NO: 84332 - DNA, 10 bp, Unknown
  misc_feature (1)..( 10): Result.001 file - promoters70/1567092
gttgtttata

SEQ ID NO: 84333 - DNA, 10 bp, Unknown
  misc_feature (1)..( 10): Result.001 file - promoters70/1567092
tttacttttt

SEQ ID NO: 84334 - DNA, 10 bp, Unknown
  misc_feature (1)..( 10): Result.001 file - promoters70/1567092
catgtttaat

SEQ ID NO: 84335 - DNA, 10 bp, Unknown
  misc_feature (1)..( 10): Result.001 file - promoters70/1567092
catatttagc

SEQ ID NO: 84336 - DNA, 10 bp, Unknown
  misc_feature (1)..( 10): Result.001 file - promoters70/1567535
tgagttcata

SEQ ID NO: 84337 - DNA, 9 bp, Unknown
  misc_feature (1)..( 9): Result.001 file - promoters70/1567535
aaatcttct

SEQ ID NO: 84338 - DNA, 9 bp, Unknown
  misc_feature (1)..( 9): Result.001 file - promoters70/1567535
gtttcttct

SEQ ID NO: 84339 - DNA, 9 bp, Unknown
  misc_feature (1)..( 9): Result.001 file - promoters70/1567535
ggttcttca

SEQ ID NO: 84340 - DNA, 9 bp, Unknown
  misc_feature (1)..( 9): Result.001 file - promoters70/1567547
gtttcctct

SEQ ID NO: 84341 - DNA, 11 bp, Unknown
  misc_feature (1)..( 11): Result.001 file - promoters70/1567547
caacacaaaaa

SEQ ID NO: 84342 - DNA, 11 bp, Unknown
  misc_feature (1)..( 11): Result.001 file - promoters70/1567547
aaacacaagaa

SEQ ID NO: 84343 - DNA, 11 bp, Unknown
  misc_feature (1)..( 11): Result.001 file - promoters70/1567547
gaacaaaaaaa

SEQ ID NO: 84344 - DNA, 11 bp, Unknown
  misc_feature (1)..( 11): Result.001 file - promoters70/1567547
acacacaaagt

SEQ ID NO: 84345 - DNA, 9 bp, Unknown
  misc_feature (1)..( 9): Result.001 file - promoters70/1567547
ccacaagat

SEQ ID NO: 84346 - DNA, 11 bp, Unknown
  misc_feature (1)..( 11): Result.001 file - promoters70/1568230
aaacaaatcaa

SEQ ID NO: 84347 - DNA, 10 bp, Unknown
  misc_feature (1)..( 10): Result.001 file - promoters70/1568230
ttaatataaa

SEQ ID NO: 84348 - DNA, 10 bp, Unknown
  misc_feature (1)..( 10): Result.001 file - promoters70/1568230
acaatttaaa

SEQ ID NO: 84349 - DNA, 10 bp, Unknown
  misc_feature (1)..( 10): Result.001 file - promoters70/1568508
ttattataaa

SEQ ID NO: 84350 - DNA, 9 bp, Unknown
  misc_feature (1)..( 9): Result.001 file - promoters70/1568508
aattacaat

SEQ ID NO: 84351 - DNA, 9 bp, Unknown
  misc_feature (1)..( 9): Result.001 file - promoters70/1568508
tcttataat

SEQ ID NO: 84352 - DNA, 9 bp, Unknown
  misc_feature (1)..( 9): Result.001 file - promoters70/1568508
tcttataaa

SEQ ID NO: 84353 - DNA, 8 bp, Unknown
  misc_feature (1)..( 8): Result.001 file - promoters70/1568508
acttatat

SEQ ID NO: 84354 - DNA, 8 bp, Unknown
  misc_feature (1)..( 8): Result.001 file - promoters70/1568508
tcttataa

SEQ ID NO: 84355 - DNA, 8 bp, Unknown
  misc_feature (1)..( 8): Result.001 file - promoters70/1569568
tcttataa

SEQ ID NO: 84356 - DNA, 8 bp, Unknown
  misc_feature (1)..( 8): Result.001 file - promoters70/1569568
caaataaa

SEQ ID NO: 84357 - DNA, 8 bp, Unknown
  misc_feature (1)..( 8): Result.001 file - promoters70/1569568
aaaataaa

SEQ ID NO: 84358 - DNA, 8 bp, Unknown
  misc_feature (1)..( 8): Result.001 file - promoters70/1569568
aaaataaa

SEQ ID NO: 84359 - DNA, 8 bp, Unknown
  misc_feature (1)..( 8): Result.001 file - promoters70/1569568
caaagaaa

SEQ ID NO: 84360 - DNA, 8 bp, Unknown
  misc_feature (1)..( 8): Result.001 file - promoters70/1569568
aaaataat

SEQ ID NO: 84361 - DNA, 8 bp, Unknown
  misc_feature (1)..( 8): Result.001 file - promoters70/1569568
taaaattt

SEQ ID NO: 84362 - DNA, 8 bp, Unknown
  misc_feature (1)..( 8): Result.001 file - promoters70/1569568
taaaataa

SEQ ID NO: 84363 - DNA, 8 bp, Unknown
  misc_feature (1)..( 8): Result.001 file - promoters70/1569568
gaaacttt

SEQ ID NO: 84364 - DNA, 8 bp, Unknown
  misc_feature (1)..( 8): Result.001 file - promoters70/1569568
aaaaataa

SEQ ID NO: 84365 - DNA, 7 bp, Unknown
  misc_feature (1)..( 7): Result.001 file - promoters70/1569568
aaataaa

SEQ ID NO: 84366 - DNA, 7 bp, Unknown
  misc_feature (1)..( 7): Result.001 file - promoters70/1569568
aaataac

SEQ ID NO: 84367 - DNA, 7 bp, Unknown
  misc_feature (1)..( 7): Result.001 file - promoters70/1569568
aaagaaa

SEQ ID NO: 84368 - DNA, 7 bp, Unknown
  misc_feature (1)..( 7): Result.001 file - promoters70/1569568
aaataat

SEQ ID NO: 84369 - DNA, 10 bp, Unknown
  misc_feature (1)..( 10): Result.001 file - promoters70/1569568
tttatttact

SEQ ID NO: 84370 - DNA, 10 bp, Unknown
  misc_feature (1)..( 10): Result.001 file - promoters70/1569568
ggtatttact

SEQ ID NO: 84371 - DNA, 10 bp, Unknown
  misc_feature (1)..( 10): Result.001 file - promoters70/1569568
tttatttcat

SEQ ID NO: 84372 - DNA, 10 bp, Unknown
  misc_feature (1)..( 10): Result.001 file - promoters70/1569568
aatatctcat

SEQ ID NO: 84373 - DNA, 9 bp, Unknown
  misc_feature (1)..( 9): Result.001 file - promoters70/1569568
aaaattaaa

SEQ ID NO: 84374 - DNA, 9 bp, Unknown
  misc_feature (1)..( 9): Result.001 file - promoters70/1569568
aaacttaat

SEQ ID NO: 84375 - DNA, 9 bp, Unknown
  misc_feature (1)..( 9): Result.001 file - promoters70/1569568
tagattaaa

SEQ ID NO: 84376 - DNA, 9 bp, Unknown
  misc_feature (1)..( 9): Result.001 file - promoters70/1569568
tgccttaat

SEQ ID NO: 84377 - DNA, 15 bp, Unknown
  misc_feature (1)..( 15): Result.001 file - promoters70/1569568
ttttactaaaaaaga

SEQ ID NO: 84378 - DNA, 15 bp, Unknown
  misc_feature (1)..( 15): Result.001 file - promoters70/1569568
ctttaataagaaata

SEQ ID NO: 84379 - DNA, 15 bp, Unknown
  misc_feature (1)..( 15): Result.001 file - promoters70/1569568
ttttacttgatctaa

SEQ ID NO: 84380 - DNA, 15 bp, Unknown
  misc_feature (1)..( 15): Result.001 file - promoters70/1569568
accaaaaaagaaata

SEQ ID NO: 84381 - DNA, 11 bp, Unknown
  misc_feature (1)..( 11): Result.001 file - promoters70/1569568
taatgtctcgt

SEQ ID NO: 84382 - DNA, 11 bp, Unknown
  misc_feature (1)..( 11): Result.001 file - promoters70/1569568
taatatctcat

SEQ ID NO: 84383 - DNA, 11 bp, Unknown
  misc_feature (1)..( 11): Result.001 file - promoters70/1569568
tgatggctcgg

SEQ ID NO: 84384 - DNA, 11 bp, Unknown
  misc_feature (1)..( 11): Result.001 file - promoters70/1569568
ttttatttcat

SEQ ID NO: 84385 - DNA, 14 bp, Unknown
  misc_feature (1)..( 14): Result.001 file - promoters70/1569568
ctcttttatttatt

SEQ ID NO: 84386 - DNA, 14 bp, Unknown
  misc_feature (1)..( 14): Result.001 file - promoters70/1569568
aaattttataatca

SEQ ID NO: 84387 - DNA, 14 bp, Unknown
  misc_feature (1)..( 14): Result.001 file - promoters70/1569568
tctctttatttatt

SEQ ID NO: 84388 - DNA, 14 bp, Unknown
  misc_feature (1)..( 14): Result.001 file - promoters70/1569721
aaaatttacctaac

SEQ ID NO: 84389 - DNA, 9 bp, Unknown
  misc_feature (1)..( 9): Result.001 file - promoters70/1569721
aaaagaaga

SEQ ID NO: 84390 - DNA, 9 bp, Unknown
  misc_feature (1)..( 9): Result.001 file - promoters70/1569721
tatagaaga

SEQ ID NO: 84391 - DNA, 9 bp, Unknown
  misc_feature (1)..( 9): Result.001 file - promoters70/1569721
tagagaaga

SEQ ID NO: 84392 - DNA, 9 bp, Unknown
  misc_feature (1)..( 9): Result.001 file - promoters70/1570606
tagacaaga

SEQ ID NO: 84393 - DNA, 10 bp, Unknown
  misc_feature (1)..( 10): Result.001 file - promoters70/1570606
atataataaa

SEQ ID NO: 84394 - DNA, 10 bp, Unknown
  misc_feature (1)..( 10): Result.001 file - promoters70/1570606
ttgtaataat

SEQ ID NO: 84395 - DNA, 10 bp, Unknown
  misc_feature (1)..( 10): Result.001 file - promoters70/1570606
ttttaacaaa

SEQ ID NO: 84396 - DNA, 10 bp, Unknown
  misc_feature (1)..( 10): Result.001 file - promoters70/1570606
gtataaaaaa

SEQ ID NO: 84397 - DNA, 10 bp, Unknown
  misc_feature (1)..( 10): Result.001 file - promoters70/1570606
tattaataaa

SEQ ID NO: 84398 - DNA, 10 bp, Unknown
  misc_feature (1)..( 10): Result.001 file - promoters70/1570606
ttttaatata

SEQ ID NO: 84399 - DNA, 10 bp, Unknown
  misc_feature (1)..( 10): Result.001 file - promoters70/1570606
ttgtgatatt

SEQ ID NO: 84400 - DNA, 15 bp, Unknown
  misc_feature (1)..( 15): Result.001 file - promoters70/1570606
agtttcattaacgtt

SEQ ID NO: 84401 - DNA, 15 bp, Unknown
  misc_feature (1)..( 15): Result.001 file - promoters70/1570606
tgttacatttaagtt

SEQ ID NO: 84402 - DNA, 15 bp, Unknown
  misc_feature (1)..( 15): Result.001 file - promoters70/1570606
acttttattatttca

SEQ ID NO: 84403 - DNA, 15 bp, Unknown
  misc_feature (1)..( 15): Result.001 file - promoters70/1570606
ttttgtattatcaat

SEQ ID NO: 84404 - DNA, 15 bp, Unknown
  misc_feature (1)..( 15): Result.001 file - promoters70/1570606
acttttaaatagaaa

SEQ ID NO: 84405 - DNA, 15 bp, Unknown
  misc_feature (1)..( 15): Result.001 file - promoters70/1570606
actatgatttaaaat

SEQ ID NO: 84406 - DNA, 11 bp, Unknown
  misc_feature (1)..( 11): Result.001 file - promoters70/1570606
tattaataaaa

SEQ ID NO: 84407 - DNA, 11 bp, Unknown
  misc_feature (1)..( 11): Result.001 file - promoters70/1570606
gattagtaaaa

SEQ ID NO: 84408 - DNA, 11 bp, Unknown
  misc_feature (1)..( 11): Result.001 file - promoters70/1570606
ttgtaataata

SEQ ID NO: 84409 - DNA, 11 bp, Unknown
  misc_feature (1)..( 11): Result.001 file - promoters70/1570606
ttttaatatat

SEQ ID NO: 84410 - DNA, 11 bp, Unknown
  misc_feature (1)..( 11): Result.001 file - promoters70/1570606
gcttagtacaa

SEQ ID NO: 84411 - DNA, 11 bp, Unknown
  misc_feature (1)..( 11): Result.001 file - promoters70/1570606
ttgtgatatta

SEQ ID NO: 84412 - DNA, 14 bp, Unknown
  misc_feature (1)..( 14): Result.001 file - promoters70/1570606
ggacaacataaatt

SEQ ID NO: 84413 - DNA, 14 bp, Unknown
  misc_feature (1)..( 14): Result.001 file - promoters70/1570606
caaaaacaaaaagt

SEQ ID NO: 84414 - DNA, 14 bp, Unknown
  misc_feature (1)..( 14): Result.001 file - promoters70/1570606
taaaaacagtgatc

SEQ ID NO: 84415 - DNA, 14 bp, Unknown
  misc_feature (1)..( 14): Result.001 file - promoters70/1570606
aagaaaaaaaaaaa

SEQ ID NO: 84416 - DNA, 14 bp, Unknown
  misc_feature (1)..( 14): Result.001 file - promoters70/1570606
aagaaacaaagtaa

SEQ ID NO: 84417 - DNA, 14 bp, Unknown
  misc_feature (1)..( 14): Result.001 file - promoters70/1570606
ctataaaaaatttt

SEQ ID NO: 84418 - DNA, 14 bp, Unknown
  misc_feature (1)..( 14): Result.001 file - promoters70/1570622
gttaaacaagtttt

SEQ ID NO: 84419 - DNA, 9 bp, Unknown
  misc_feature (1)..( 9): Result.001 file - promoters70/1570622
tcgtatcat

SEQ ID NO: 84420 - DNA, 9 bp, Unknown
  misc_feature (1)..( 9): Result.001 file - promoters70/1570622
tcgtttcaa

SEQ ID NO: 84421 - DNA, 9 bp, Unknown
  misc_feature (1)..( 9): Result.001 file - promoters70/1570622
ctatttcaa

SEQ ID NO: 84422 - DNA, 8 bp, Unknown
  misc_feature (1)..( 8): Result.001 file - promoters70/1570622
aaacataa

SEQ ID NO: 84423 - DNA, 8 bp, Unknown
  misc_feature (1)..( 8): Result.001 file - promoters70/1570622
aaaaatac

SEQ ID NO: 84424 - DNA, 8 bp, Unknown
  misc_feature (1)..( 8): Result.001 file - promoters70/1570622
caacttaa

SEQ ID NO: 84425 - DNA, 19 bp, Unknown
  misc_feature (1)..( 19): Result.001 file - promoters70/1570622
taatacaattgagagataa

SEQ ID NO: 84426 - DNA, 19 bp, Unknown
  misc_feature (1)..( 19): Result.001 file - promoters70/1570622
taaaacaaaacacaccctt

SEQ ID NO: 84427 - DNA, 19 bp, Unknown
  misc_feature (1)..( 19): Result.001 file - promoters70/1570622
aaaaaaaaaaaaggaaaac

SEQ ID NO: 84428 - DNA, 9 bp, Unknown
  misc_feature (1)..( 9): Result.001 file - promoters70/1570622
tacttttta

SEQ ID NO: 84429 - DNA, 9 bp, Unknown
  misc_feature (1)..( 9): Result.001 file - promoters70/1570622
tactttttt

SEQ ID NO: 84430 - DNA, 10 bp, Unknown
  misc_feature (1)..( 10): Result.001 file - promoters70/1570622
gacttctttt

SEQ ID NO: 84431 - DNA, 9 bp, Unknown
  misc_feature (1)..( 9): Result.001 file - promoters70/1570622
cgggattaa

SEQ ID NO: 84432 - DNA, 9 bp, Unknown
  misc_feature (1)..( 9): Result.001 file - promoters70/1570622
tatgattaa

SEQ ID NO: 84433 - DNA, 9 bp, Unknown
  misc_feature (1)..( 9): Result.001 file - promoters70/1570622
tatgagtaa

SEQ ID NO: 84434 - DNA, 9 bp, Unknown
  misc_feature (1)..( 9): Result.001 file - promoters70/1570622
acttcatat

SEQ ID NO: 84435 - DNA, 9 bp, Unknown
  misc_feature (1)..( 9): Result.001 file - promoters70/1570622
tcttcttat

SEQ ID NO: 84436 - DNA, 9 bp, Unknown
  misc_feature (1)..( 9): Result.001 file - promoters70/1570622
tcttcttca

SEQ ID NO: 84437 - DNA, 9 bp, Unknown
  misc_feature (1)..( 9): Result.001 file - promoters70/1570622
tttgacaac

SEQ ID NO: 84438 - DNA, 9 bp, Unknown
  misc_feature (1)..( 9): Result.001 file - promoters70/1570622
tttaacaat

SEQ ID NO: 84439 - DNA, 9 bp, Unknown
  misc_feature (1)..( 9): Result.001 file - promoters70/1570860
gataagaat

SEQ ID NO: 84440 - DNA, 12 bp, Unknown
  misc_feature (1)..( 12): Result.001 file - promoters70/1570860
gagaaatatact

SEQ ID NO: 84441 - DNA, 12 bp, Unknown
  misc_feature (1)..( 12): Result.001 file - promoters70/1570860
gagacatagtcc

SEQ ID NO: 84442 - DNA, 12 bp, Unknown
  misc_feature (1)..( 12): Result.001 file - promoters70/1570869
gaaaaatattta

SEQ ID NO: 84443 - DNA, 11 bp, Unknown
  misc_feature (1)..( 11): Result.001 file - promoters70/1570869
ttttgaagaat

SEQ ID NO: 84444 - DNA, 11 bp, Unknown
  misc_feature (1)..( 11): Result.001 file - promoters70/1570869
ttttgatgaat

SEQ ID NO: 84445 - DNA, 11 bp, Unknown
  misc_feature (1)..( 11): Result.001 file - promoters70/1570869
gtttgaatcgt

SEQ ID NO: 84446 - DNA, 11 bp, Unknown
  misc_feature (1)..( 11): Result.001 file - promoters70/1570869
tttcgatgtat

SEQ ID NO: 84447 - DNA, 11 bp, Unknown
  misc_feature (1)..( 11): Result.001 file - promoters70/1570869
ttgtgaatgtc

SEQ ID NO: 84448 - DNA, 16 bp, Unknown
  misc_feature (1)..( 16): Result.001 file - promoters70/1570869
ataaaaatgttagata

SEQ ID NO: 84449 - DNA, 16 bp, Unknown
  misc_feature (1)..( 16): Result.001 file - promoters70/1570869
tcataaattttaaaat

SEQ ID NO: 84450 - DNA, 16 bp, Unknown
  misc_feature (1)..( 16): Result.001 file - promoters70/1570869
tgttaaatatgaatat

SEQ ID NO: 84451 - DNA, 16 bp, Unknown
  misc_feature (1)..( 16): Result.001 file - promoters70/1570869
aaatagatttgaaaaa

SEQ ID NO: 84452 - DNA, 16 bp, Unknown
  misc_feature (1)..( 16): Result.001 file - promoters70/1570869
cttttgattctaaaat

SEQ ID NO: 84453 - DNA, 16 bp, Unknown
  misc_feature (1)..( 16): Result.001 file - promoters70/1570869
gtaaaaaaagagatct

SEQ ID NO: 84454 - DNA, 11 bp, Unknown
  misc_feature (1)..( 11): Result.001 file - promoters70/1570869
cttatataaac

SEQ ID NO: 84455 - DNA, 11 bp, Unknown
  misc_feature (1)..( 11): Result.001 file - promoters70/1570869
tatatataata

SEQ ID NO: 84456 - DNA, 11 bp, Unknown
  misc_feature (1)..( 11): Result.001 file - promoters70/1570869
agtatataaac

SEQ ID NO: 84457 - DNA, 11 bp, Unknown
  misc_feature (1)..( 11): Result.001 file - promoters70/1570869
tataaataaaa

SEQ ID NO: 84458 - DNA, 11 bp, Unknown
  misc_feature (1)..( 11): Result.001 file - promoters70/1570869
tgtatataaat

SEQ ID NO: 84459 - DNA, 11 bp, Unknown
  misc_feature (1)..( 11): Result.001 file - promoters70/1570869
tacctataaat

SEQ ID NO: 84460 - DNA, 12 bp, Unknown
  misc_feature (1)..( 12): Result.001 file - promoters70/1570869
tatataaacaaa

SEQ ID NO: 84461 - DNA, 12 bp, Unknown
  misc_feature (1)..( 12): Result.001 file - promoters70/1570869
ataataaccaaa

SEQ ID NO: 84462 - DNA, 12 bp, Unknown
  misc_feature (1)..( 12): Result.001 file - promoters70/1570869
tatataaactct

SEQ ID NO: 84463 - DNA, 12 bp, Unknown
  misc_feature (1)..( 12): Result.001 file - promoters70/1570869
tttataaataaa

SEQ ID NO: 84464 - DNA, 12 bp, Unknown
  misc_feature (1)..( 12): Result.001 file - promoters70/1570869
tatataaatgac

SEQ ID NO: 84465 - DNA, 12 bp, Unknown
  misc_feature (1)..( 12): Result.001 file - promoters70/1570869
cctataaatatc

SEQ ID NO: 84466 - DNA, 12 bp, Unknown
  misc_feature (1)..( 12): Result.001 file - promoters70/1570869
agttcttcattt

SEQ ID NO: 84467 - DNA, 12 bp, Unknown
  misc_feature (1)..( 12): Result.001 file - promoters70/1570869
ctcgcttcataa

SEQ ID NO: 84468 - DNA, 12 bp, Unknown
  misc_feature (1)..( 12): Result.001 file - promoters70/1570869
atatctttataa

SEQ ID NO: 84469 - DNA, 12 bp, Unknown
  misc_feature (1)..( 12): Result.001 file - promoters70/1570869
aacaatttttaa

SEQ ID NO: 84470 - DNA, 12 bp, Unknown
  misc_feature (1)..( 12): Result.001 file - promoters70/1570869
ataactttatgt

SEQ ID NO: 84471 - DNA, 14 bp, Unknown
  misc_feature (1)..( 14): Result.001 file - promoters70/1570869
ttagataggaaaaa

SEQ ID NO: 84472 - DNA, 14 bp, Unknown
  misc_feature (1)..( 14): Result.001 file - promoters70/1570869
atagatttgaaaaa

SEQ ID NO: 84473 - DNA, 14 bp, Unknown
  misc_feature (1)..( 14): Result.001 file - promoters70/1570869
atggatagtaaaaa

SEQ ID NO: 84474 - DNA, 14 bp, Unknown
  misc_feature (1)..( 14): Result.001 file - promoters70/1570869
ataaattttaaaat

SEQ ID NO: 84475 - DNA, 14 bp, Unknown
  misc_feature (1)..( 14): Result.001 file - promoters70/1570869
tttgattctaaaat

SEQ ID NO: 84476 - DNA, 13 bp, Unknown
  misc_feature (1)..( 13): Result.001 file - promoters70/1570869
acttataattatg

SEQ ID NO: 84477 - DNA, 13 bp, Unknown
  misc_feature (1)..( 13): Result.001 file - promoters70/1570869
aataataataatg

SEQ ID NO: 84478 - DNA, 13 bp, Unknown
  misc_feature (1)..( 13): Result.001 file - promoters70/1570869
ctttataagtata

SEQ ID NO: 84479 - DNA, 13 bp, Unknown
  misc_feature (1)..( 13): Result.001 file - promoters70/1570869
ttttaaaagtaag

SEQ ID NO: 84480 - DNA, 13 bp, Unknown
  misc_feature (1)..( 13): Result.001 file - promoters70/1570869
cttcataacaaaa

SEQ ID NO: 84481 - DNA, 13 bp, Unknown
  misc_feature (1)..( 13): Result.001 file - promoters70/1570869
tgttattagttaa

SEQ ID NO: 84482 - DNA, 15 bp, Unknown
  misc_feature (1)..( 15): Result.001 file - promoters70/1570869
tatacgttttaaaag

SEQ ID NO: 84483 - DNA, 15 bp, Unknown
  misc_feature (1)..( 15): Result.001 file - promoters70/1570869
aacaatttttaaatt

SEQ ID NO: 84484 - DNA, 15 bp, Unknown
  misc_feature (1)..( 15): Result.001 file - promoters70/1570869
atatctttataagta

SEQ ID NO: 84485 - DNA, 15 bp, Unknown
  misc_feature (1)..( 15): Result.001 file - promoters70/1570869
ctcgcttcataacaa

SEQ ID NO: 84486 - DNA, 15 bp, Unknown
  misc_feature (1)..( 15): Result.001 file - promoters70/1570869
ataactttatgttat

SEQ ID NO: 84487 - DNA, 11 bp, Unknown
  misc_feature (1)..( 11): Result.001 file - promoters70/1570869
ttattttgcga

SEQ ID NO: 84488 - DNA, 11 bp, Unknown
  misc_feature (1)..( 11): Result.001 file - promoters70/1570869
ttaatttcgtt

SEQ ID NO: 84489 - DNA, 11 bp, Unknown
  misc_feature (1)..( 11): Result.001 file - promoters70/1570869
caaatttcaca

SEQ ID NO: 84490 - DNA, 11 bp, Unknown
  misc_feature (1)..( 11): Result.001 file - promoters70/1570869
tacatttaaca

SEQ ID NO: 84491 - DNA, 11 bp, Unknown
  misc_feature (1)..( 11): Result.001 file - promoters70/1570966
gtaatttagta

SEQ ID NO: 84492 - DNA, 11 bp, Unknown
  misc_feature (1)..( 11): Result.001 file - promoters70/1570966
attaactttga

SEQ ID NO: 84493 - DNA, 11 bp, Unknown
  misc_feature (1)..( 11): Result.001 file - promoters70/1570966
cataagtttca

SEQ ID NO: 84494 - DNA, 11 bp, Unknown
  misc_feature (1)..( 11): Result.001 file - promoters70/1570966
attaacttata

SEQ ID NO: 84495 - DNA, 11 bp, Unknown
  misc_feature (1)..( 11): Result.001 file - promoters70/1570966
gataaattttg

SEQ ID NO: 84496 - DNA, 11 bp, Unknown
  misc_feature (1)..( 11): Result.001 file - promoters70/1570966
gtgaagtatca

SEQ ID NO: 84497 - DNA, 12 bp, Unknown
  misc_feature (1)..( 12): Result.001 file - promoters70/1570966
agacaaaataaa

SEQ ID NO: 84498 - DNA, 12 bp, Unknown
  misc_feature (1)..( 12): Result.001 file - promoters70/1570966
tcttaaaataat

SEQ ID NO: 84499 - DNA, 12 bp, Unknown
  misc_feature (1)..( 12): Result.001 file - promoters70/1570966
cattaaaataaa

SEQ ID NO: 84500 - DNA, 12 bp, Unknown
  misc_feature (1)..( 12): Result.001 file - promoters70/1570966
aaaagaaataaa

SEQ ID NO: 84501 - DNA, 12 bp, Unknown
  misc_feature (1)..( 12): Result.001 file - promoters70/1570966
aaagcaaacaat

SEQ ID NO: 84502 - DNA, 8 bp, Unknown
  misc_feature (1)..( 8): Result.001 file - promoters70/1570966
ctatataa

SEQ ID NO: 84503 - DNA, 8 bp, Unknown
  misc_feature (1)..( 8): Result.001 file - promoters70/1570966
ttatatat

SEQ ID NO: 84504 - DNA, 8 bp, Unknown
  misc_feature (1)..( 8): Result.001 file - promoters70/1570966
ctatatat

SEQ ID NO: 84505 - DNA, 8 bp, Unknown
  misc_feature (1)..( 8): Result.001 file - promoters70/1570966
agatataa

SEQ ID NO: 84506 - DNA, 8 bp, Unknown
  misc_feature (1)..( 8): Result.001 file - promoters70/1570966
atatatat

SEQ ID NO: 84507 - DNA, 9 bp, Unknown
  misc_feature (1)..( 9): Result.001 file - promoters70/1570966
tgtttgatt

SEQ ID NO: 84508 - DNA, 9 bp, Unknown
  misc_feature (1)..( 9): Result.001 file - promoters70/1570966
tatttcatt

SEQ ID NO: 84509 - DNA, 9 bp, Unknown
  misc_feature (1)..( 9): Result.001 file - promoters70/1570966
atttttatt

SEQ ID NO: 84510 - DNA, 9 bp, Unknown
  misc_feature (1)..( 9): Result.001 file - promoters70/1570966
ttttttaca

SEQ ID NO: 84511 - DNA, 9 bp, Unknown
  misc_feature (1)..( 9): Result.001 file - promoters70/1570966
atttttagt

SEQ ID NO: 84512 - DNA, 8 bp, Unknown
  misc_feature (1)..( 8): Result.001 file - promoters70/1570966
aatattcc

SEQ ID NO: 84513 - DNA, 8 bp, Unknown
  misc_feature (1)..( 8): Result.001 file - promoters70/1570966
aatatttc

SEQ ID NO: 84514 - DNA, 8 bp, Unknown
  misc_feature (1)..( 8): Result.001 file - promoters70/1570966
aattttta

SEQ ID NO: 84515 - DNA, 8 bp, Unknown
  misc_feature (1)..( 8): Result.001 file - promoters70/1570966
cattttta

SEQ ID NO: 84516 - DNA, 8 bp, Unknown
  misc_feature (1)..( 8): Result.001 file - promoters70/1570966
tatttttt

SEQ ID NO: 84517 - DNA, 10 bp, Unknown
  misc_feature (1)..( 10): Result.001 file - promoters70/1570966
gaaaaagaca

SEQ ID NO: 84518 - DNA, 10 bp, Unknown
  misc_feature (1)..( 10): Result.001 file - promoters70/1570966
taaaaaggaa

SEQ ID NO: 84519 - DNA, 10 bp, Unknown
  misc_feature (1)..( 10): Result.001 file - promoters70/1570966
aaaatagaaa

SEQ ID NO: 84520 - DNA, 10 bp, Unknown
  misc_feature (1)..( 10): Result.001 file - promoters70/1570966
gaaaaagccc

SEQ ID NO: 84521 - DNA, 10 bp, Unknown
  misc_feature (1)..( 10): Result.001 file - promoters70/1571014
taaatataaa

SEQ ID NO: 84522 - DNA, 12 bp, Unknown
  misc_feature (1)..( 12): Result.001 file - promoters70/1571014
gtttgtttatct

SEQ ID NO: 84523 - DNA, 12 bp, Unknown
  misc_feature (1)..( 12): Result.001 file - promoters70/1571014
ttttctttggtg

SEQ ID NO: 84524 - DNA, 12 bp, Unknown
  misc_feature (1)..( 12): Result.001 file - promoters70/1571014
gtttttttttct

SEQ ID NO: 84525 - DNA, 7 bp, Unknown
  misc_feature (1)..( 7): Result.001 file - promoters70/1571014
tttaacc

SEQ ID NO: 84526 - DNA, 7 bp, Unknown
  misc_feature (1)..( 7): Result.001 file - promoters70/1571014
tttaaca

SEQ ID NO: 84527 - DNA, 7 bp, Unknown
  misc_feature (1)..( 7): Result.001 file - promoters70/1571014
ttttaca

SEQ ID NO: 84528 - DNA, 9 bp, Unknown
  misc_feature (1)..( 9): Result.001 file - promoters70/1571014
aattttcaa

SEQ ID NO: 84529 - DNA, 9 bp, Unknown
  misc_feature (1)..( 9): Result.001 file - promoters70/1571014
aattttttt

SEQ ID NO: 84530 - DNA, 9 bp, Unknown
  misc_feature (1)..( 9): Result.001 file - promoters70/1571014
gatttacaa

SEQ ID NO: 84531 - DNA, 9 bp, Unknown
  misc_feature (1)..( 9): Result.001 file - promoters70/1571014
attttacat

SEQ ID NO: 84532 - DNA, 7 bp, Unknown
  misc_feature (1)..( 7): Result.001 file - promoters70/1571014
tccaata

SEQ ID NO: 84533 - DNA, 7 bp, Unknown
  misc_feature (1)..( 7): Result.001 file - promoters70/1571014
tccaatt

SEQ ID NO: 84534 - DNA, 7 bp, Unknown
  misc_feature (1)..( 7): Result.001 file - promoters70/1571014
tccaata

SEQ ID NO: 84535 - DNA, 10 bp, Unknown
  misc_feature (1)..( 10): Result.001 file - promoters70/1571014
tttgacagac

SEQ ID NO: 84536 - DNA, 10 bp, Unknown
  misc_feature (1)..( 10): Result.001 file - promoters70/1571014
tttaacaaga

SEQ ID NO: 84537 - DNA, 10 bp, Unknown
  misc_feature (1)..( 10): Result.001 file - promoters70/1571014
actaacaaga

SEQ ID NO: 84538 - DNA, 9 bp, Unknown
  misc_feature (1)..( 9): Result.001 file - promoters70/1571014
ggatgcttt

SEQ ID NO: 84539 - DNA, 9 bp, Unknown
  misc_feature (1)..( 9): Result.001 file - promoters70/1571014
tgattcttt

SEQ ID NO: 84540 - DNA, 9 bp, Unknown
  misc_feature (1)..( 9): Result.001 file - promoters70/1573945
tgattcatg

SEQ ID NO: 84541 - DNA, 7 bp, Unknown
  misc_feature (1)..( 7): Result.001 file - promoters70/1573945
cagaagt

SEQ ID NO: 84542 - DNA, 7 bp, Unknown
  misc_feature (1)..( 7): Result.001 file - promoters70/1573945
cagaaga

SEQ ID NO: 84543 - DNA, 7 bp, Unknown
  misc_feature (1)..( 7): Result.001 file - promoters70/1573945
gagaaga

SEQ ID NO: 84544 - DNA, 10 bp, Unknown
  misc_feature (1)..( 10): Result.001 file - promoters70/1573945
tttaaagttt

SEQ ID NO: 84545 - DNA, 10 bp, Unknown
  misc_feature (1)..( 10): Result.001 file - promoters70/1573945
tgtaaaattt

SEQ ID NO: 84546 - DNA, 10 bp, Unknown
  misc_feature (1)..( 10): Result.001 file - promoters70/1573980
tttaaaagag

SEQ ID NO: 84547 - DNA, 9 bp, Unknown
  misc_feature (1)..( 9): Result.001 file - promoters70/1573980
agtacgatt

SEQ ID NO: 84548 - DNA, 9 bp, Unknown
  misc_feature (1)..( 9): Result.001 file - promoters70/1573980
agtaagata

SEQ ID NO: 84549 - DNA, 9 bp, Unknown
  misc_feature (1)..( 9): Result.001 file - promoters70/1573980
gttaaaata

SEQ ID NO: 84550 - DNA, 9 bp, Unknown
  misc_feature (1)..( 9): Result.001 file - promoters70/1573980
gaagggtta

SEQ ID NO: 84551 - DNA, 9 bp, Unknown
  misc_feature (1)..( 9): Result.001 file - promoters70/1573980
taagagtta

SEQ ID NO: 84552 - DNA, 9 bp, Unknown
  misc_feature (1)..( 9): Result.001 file - promoters70/1573980
taaaagttg

SEQ ID NO: 84553 - DNA, 10 bp, Unknown
  misc_feature (1)..( 10): Result.001 file - promoters70/1573980
catatatact

SEQ ID NO: 84554 - DNA, 10 bp, Unknown
  misc_feature (1)..( 10): Result.001 file - promoters70/1573980
tataaatact

SEQ ID NO: 84555 - DNA, 10 bp, Unknown
  misc_feature (1)..( 10): Result.001 file - promoters70/1573980
tataaatccc

SEQ ID NO: 84556 - DNA, 10 bp, Unknown
  misc_feature (1)..( 10): Result.001 file - promoters70/1573980
tataaaaaca

SEQ ID NO: 84557 - DNA, 10 bp, Unknown
  misc_feature (1)..( 10): Result.001 file - promoters70/1573980
gtatataaat

SEQ ID NO: 84558 - DNA, 10 bp, Unknown
  misc_feature (1)..( 10): Result.001 file - promoters70/1573980
gtatataaaa

SEQ ID NO: 84559 - DNA, 10 bp, Unknown
  misc_feature (1)..( 10): Result.001 file - promoters70/1573980
aactataaat

SEQ ID NO: 84560 - DNA, 8 bp, Unknown
  misc_feature (1)..( 8): Result.001 file - promoters70/1573980
atactata

SEQ ID NO: 84561 - DNA, 8 bp, Unknown
  misc_feature (1)..( 8): Result.001 file - promoters70/1573980
ttacaata

SEQ ID NO: 84562 - DNA, 8 bp, Unknown
  misc_feature (1)..( 8): Result.001 file - promoters70/1574029
ttacaata

SEQ ID NO: 84563 - DNA, 7 bp, Unknown
  misc_feature (1)..( 7): Result.001 file - promoters70/1574029
atgtggt

SEQ ID NO: 84564 - DNA, 7 bp, Unknown
  misc_feature (1)..( 7): Result.001 file - promoters70/1574029
atgtgga

SEQ ID NO: 84565 - DNA, 7 bp, Unknown
  misc_feature (1)..( 7): Result.001 file - promoters70/1580500
atgagga

SEQ ID NO: 84566 - DNA, 8 bp, Unknown
  misc_feature (1)..( 8): Result.001 file - promoters70/1580500
catatagg

SEQ ID NO: 84567 - DNA, 8 bp, Unknown
  misc_feature (1)..( 8): Result.001 file - promoters70/1580500
catataaa

SEQ ID NO: 84568 - DNA, 8 bp, Unknown
  misc_feature (1)..( 8): Result.001 file - promoters70/1580500
tatagaaa

SEQ ID NO: 84569 - DNA, 8 bp, Unknown
  misc_feature (1)..( 8): Result.001 file - promoters70/1580500
aagataat

SEQ ID NO: 84570 - DNA, 9 bp, Unknown
  misc_feature (1)..( 9): Result.001 file - promoters70/1580500
gaaaaaaaa

SEQ ID NO: 84571 - DNA, 9 bp, Unknown
  misc_feature (1)..( 9): Result.001 file - promoters70/1580500
taaataaaa

SEQ ID NO: 84572 - DNA, 9 bp, Unknown
  misc_feature (1)..( 9): Result.001 file - promoters70/1580500
taaataagg

SEQ ID NO: 84573 - DNA, 9 bp, Unknown
  misc_feature (1)..( 9): Result.001 file - promoters70/1580500
taacaaata

SEQ ID NO: 84574 - DNA, 9 bp, Unknown
  misc_feature (1)..( 9): Result.001 file - promoters70/1580500
taataaata

SEQ ID NO: 84575 - DNA, 9 bp, Unknown
  misc_feature (1)..( 9): Result.001 file - promoters70/1580932
atataaatt

SEQ ID NO: 84576 - DNA, 13 bp, Unknown
  misc_feature (1)..( 13): Result.001 file - promoters70/1580932
gagatgcggaagc

SEQ ID NO: 84577 - DNA, 13 bp, Unknown
  misc_feature (1)..( 13): Result.001 file - promoters70/1580932
cagattcggctta

SEQ ID NO: 84578 - DNA, 13 bp, Unknown
  misc_feature (1)..( 13): Result.001 file - promoters70/1580932
tagattcatattc

SEQ ID NO: 84579 - DNA, 8 bp, Unknown
  misc_feature (1)..( 8): Result.001 file - promoters70/1580932
gaagagga

SEQ ID NO: 84580 - DNA, 8 bp, Unknown
  misc_feature (1)..( 8): Result.001 file - promoters70/1580932
gaaaagga

SEQ ID NO: 84581 - DNA, 8 bp, Unknown
  misc_feature (1)..( 8): Result.001 file - promoters70/1580932
taaaggga

SEQ ID NO: 84582 - DNA, 8 bp, Unknown
  misc_feature (1)..( 8): Result.001 file - promoters70/1580932
taaaaaaa

SEQ ID NO: 84583 - DNA, 9 bp, Unknown
  misc_feature (1)..( 9): Result.001 file - promoters70/1580932
gccaaaaat

SEQ ID NO: 84584 - DNA, 9 bp, Unknown
  misc_feature (1)..( 9): Result.001 file - promoters70/1580932
accacaaat

SEQ ID NO: 84585 - DNA, 9 bp, Unknown
  misc_feature (1)..( 9): Result.001 file - promoters70/1580932
accacacaa

SEQ ID NO: 84586 - DNA, 10 bp, Unknown
  misc_feature (1)..( 10): Result.001 file - promoters70/1580932
gaataaacgc

SEQ ID NO: 84587 - DNA, 10 bp, Unknown
  misc_feature (1)..( 10): Result.001 file - promoters70/1580932
aaataaaggg

SEQ ID NO: 84588 - DNA, 10 bp, Unknown
  misc_feature (1)..( 10): Result.001 file - promoters70/1580932
taaaaaaaaa

SEQ ID NO: 84589 - DNA, 10 bp, Unknown
  misc_feature (1)..( 10): Result.001 file - promoters70/1580932
aaaaaaaaaa

SEQ ID NO: 84590 - DNA, 8 bp, Unknown
  misc_feature (1)..( 8): Result.001 file - promoters70/1580932
tcatttaa

SEQ ID NO: 84591 - DNA, 8 bp, Unknown
  misc_feature (1)..( 8): Result.001 file - promoters70/1580932
caatttaa

SEQ ID NO: 84592 - DNA, 8 bp, Unknown
  misc_feature (1)..( 8): Result.001 file - promoters70/1580932
tcatttat

SEQ ID NO: 84593 - DNA, 8 bp, Unknown
  misc_feature (1)..( 8): Result.001 file - promoters70/1580932
gaaaaccc

SEQ ID NO: 84594 - DNA, 8 bp, Unknown
  misc_feature (1)..( 8): Result.001 file - promoters70/1580932
aaaaacca

SEQ ID NO: 84595 - DNA, 8 bp, Unknown
  misc_feature (1)..( 8): Result.001 file - promoters70/1580932
aaaaacct

SEQ ID NO: 84596 - DNA, 9 bp, Unknown
  misc_feature (1)..( 9): Result.001 file - promoters70/1580932
aaagaactg

SEQ ID NO: 84597 - DNA, 8 bp, Unknown
  misc_feature (1)..( 8): Result.001 file - promoters70/1580932
cttcaatg

SEQ ID NO: 84598 - DNA, 8 bp, Unknown
  misc_feature (1)..( 8): Result.001 file - promoters70/1580932
tttcaata

SEQ ID NO: 84599 - DNA, 8 bp, Unknown
  misc_feature (1)..( 8): Result.001 file - promoters70/1580932
tttctata

SEQ ID NO: 84600 - DNA, 10 bp, Unknown
  misc_feature (1)..( 10): Result.001 file - promoters70/1580932
aaatttatta

SEQ ID NO: 84601 - DNA, 10 bp, Unknown
  misc_feature (1)..( 10): Result.001 file - promoters70/1580932
aaatttttta

SEQ ID NO: 84602 - DNA, 10 bp, Unknown
  misc_feature (1)..( 10): Result.001 file - promoters70/1581987
aaatttctga

SEQ ID NO: 84603 - DNA, 7 bp, Unknown
  misc_feature (1)..( 7): Result.001 file - promoters70/1581987
gattatg

SEQ ID NO: 84604 - DNA, 7 bp, Unknown
  misc_feature (1)..( 7): Result.001 file - promoters70/1581987
gataatg

SEQ ID NO: 84605 - DNA, 7 bp, Unknown
  misc_feature (1)..( 7): Result.001 file - promoters70/1582576
aataatg

SEQ ID NO: 84606 - DNA, 7 bp, Unknown
  misc_feature (1)..( 7): Result.001 file - promoters70/1582576
taaataa

SEQ ID NO: 84607 - DNA, 7 bp, Unknown
  misc_feature (1)..( 7): Result.001 file - promoters70/1582576
aaaataa

SEQ ID NO: 84608 - DNA, 8 bp, Unknown
  misc_feature (1)..( 8): Result.001 file - promoters70/1582576
taaagtaa

SEQ ID NO: 84609 - DNA, 7 bp, Unknown
  misc_feature (1)..( 7): Result.001 file - promoters70/1582576
aataaat

SEQ ID NO: 84610 - DNA, 7 bp, Unknown
  misc_feature (1)..( 7): Result.001 file - promoters70/1582576
aataaaa

SEQ ID NO: 84611 - DNA, 7 bp, Unknown
  misc_feature (1)..( 7): Result.001 file - promoters70/1595707
aataaaa

SEQ ID NO: 84612 - DNA, 11 bp, Unknown
  misc_feature (1)..( 11): Result.001 file - promoters70/1595707
cagcccagtca

SEQ ID NO: 84613 - DNA, 11 bp, Unknown
  misc_feature (1)..( 11): Result.001 file - promoters70/1595707
aataccaatca

SEQ ID NO: 84614 - DNA, 11 bp, Unknown
  misc_feature (1)..( 11): Result.001 file - promoters70/1595707
aatacaaatct

SEQ ID NO: 84615 - DNA, 7 bp, Unknown
  misc_feature (1)..( 7): Result.001 file - promoters70/1595707
gacaaac

SEQ ID NO: 84616 - DNA, 7 bp, Unknown
  misc_feature (1)..( 7): Result.001 file - promoters70/1595707
gacaaaa

SEQ ID NO: 84617 - DNA, 7 bp, Unknown
  misc_feature (1)..( 7): Result.001 file - promoters70/1595707
aacaaaa

SEQ ID NO: 84618 - DNA, 9 bp, Unknown
  misc_feature (1)..( 9): Result.001 file - promoters70/1595707
tcaagaaaa

SEQ ID NO: 84619 - DNA, 9 bp, Unknown
  misc_feature (1)..( 9): Result.001 file - promoters70/1595707
acaaaaaaa

SEQ ID NO: 84620 - DNA, 9 bp, Unknown
  misc_feature (1)..( 9): Result.001 file - promoters70/1595741
acaaaagag

SEQ ID NO: 84621 - DNA, 13 bp, Unknown
  misc_feature (1)..( 13): Result.001 file - promoters70/1595741
ctaagaaattctt

SEQ ID NO: 84622 - DNA, 13 bp, Unknown
  misc_feature (1)..( 13): Result.001 file - promoters70/1595741
gtcgtcaatcctt

SEQ ID NO: 84623 - DNA, 13 bp, Unknown
  misc_feature (1)..( 13): Result.001 file - promoters70/1595741
cttggaaattctg

SEQ ID NO: 84624 - DNA, 13 bp, Unknown
  misc_feature (1)..( 13): Result.001 file - promoters70/1595772
cttagaaatcaat

SEQ ID NO: 84625 - DNA, 7 bp, Unknown
  misc_feature (1)..( 7): Result.001 file - promoters70/1595772
atttaaa

SEQ ID NO: 84626 - DNA, 7 bp, Unknown
  misc_feature (1)..( 7): Result.001 file - promoters70/1595772
atttaaa

SEQ ID NO: 84627 - DNA, 7 bp, Unknown
  misc_feature (1)..( 7): Result.001 file - promoters70/1595772
gtttaaa

SEQ ID NO: 84628 - DNA, 7 bp, Unknown
  misc_feature (1)..( 7): Result.001 file - promoters70/1595772
aaaacaa

SEQ ID NO: 84629 - DNA, 7 bp, Unknown
  misc_feature (1)..( 7): Result.001 file - promoters70/1595772
taaacaa

SEQ ID NO: 84630 - DNA, 7 bp, Unknown
  misc_feature (1)..( 7): Result.001 file - promoters70/1595772
aaaacaa

SEQ ID NO: 84631 - DNA, 9 bp, Unknown
  misc_feature (1)..( 9): Result.001 file - promoters70/1595772
atataaata

SEQ ID NO: 84632 - DNA, 9 bp, Unknown
  misc_feature (1)..( 9): Result.001 file - promoters70/1595772
ttataaata

SEQ ID NO: 84633 - DNA, 9 bp, Unknown
  misc_feature (1)..( 9): Result.001 file - promoters70/1595794
atataagtg

SEQ ID NO: 84634 - DNA, 11 bp, Unknown
  misc_feature (1)..( 11): Result.001 file - promoters70/1595794
aacaaattaaa

SEQ ID NO: 84635 - DNA, 11 bp, Unknown
  misc_feature (1)..( 11): Result.001 file - promoters70/1595794
aacatatttta

SEQ ID NO: 84636 - DNA, 11 bp, Unknown
  misc_feature (1)..( 11): Result.001 file - promoters70/1595794
taaaaattata

SEQ ID NO: 84637 - DNA, 11 bp, Unknown
  misc_feature (1)..( 11): Result.001 file - promoters70/1595794
aacaaagtatc

SEQ ID NO: 84638 - DNA, 11 bp, Unknown
  misc_feature (1)..( 11): Result.001 file - promoters70/1595794
taaatatttca

SEQ ID NO: 84639 - DNA, 11 bp, Unknown
  misc_feature (1)..( 11): Result.001 file - promoters70/1662827
tttaaattttt

SEQ ID NO: 84640 - DNA, 10 bp, Unknown
  misc_feature (1)..( 10): Result.001 file - promoters70/1662827
ttttcttaat

SEQ ID NO: 84641 - DNA, 10 bp, Unknown
  misc_feature (1)..( 10): Result.001 file - promoters70/1662827
ttttcataat

SEQ ID NO: 84642 - DNA, 10 bp, Unknown
  misc_feature (1)..( 10): Result.001 file - promoters70/1662827
ctttcattca

SEQ ID NO: 84643 - DNA, 10 bp, Unknown
  misc_feature (1)..( 10): Result.001 file - promoters70/1662827
agttaataaa

SEQ ID NO: 84644 - DNA, 10 bp, Unknown
  misc_feature (1)..( 10): Result.001 file - promoters70/1662827
agttaatatt

SEQ ID NO: 84645 - DNA, 10 bp, Unknown
  misc_feature (1)..( 10): Result.001 file - promoters70/1662827
ttgtaacaaa

SEQ ID NO: 84646 - DNA, 6 bp, Unknown
  misc_feature (1)..( 6): Result.001 file - promoters70/1662827
tacatt

SEQ ID NO: 84647 - DNA, 6 bp, Unknown
  misc_feature (1)..( 6): Result.001 file - promoters70/1662827
tacatt

SEQ ID NO: 84648 - DNA, 6 bp, Unknown
  misc_feature (1)..( 6): Result.001 file - promoters70/1662827
tacatt

SEQ ID NO: 84649 - DNA, 7 bp, Unknown
  misc_feature (1)..( 7): Result.001 file - promoters70/1662827
tttttaa

SEQ ID NO: 84650 - DNA, 7 bp, Unknown
  misc_feature (1)..( 7): Result.001 file - promoters70/1662827
tttttac

SEQ ID NO: 84651 - DNA, 7 bp, Unknown
  misc_feature (1)..( 7): Result.001 file - promoters70/1662827
attttac

SEQ ID NO: 84652 - DNA, 8 bp, Unknown
  misc_feature (1)..( 8): Result.001 file - promoters70/1662827
agacaaaa

SEQ ID NO: 84653 - DNA, 8 bp, Unknown
  misc_feature (1)..( 8): Result.001 file - promoters70/1662827
agaaaaaa

SEQ ID NO: 84654 - DNA, 8 bp, Unknown
  misc_feature (1)..( 8): Result.001 file - promoters70/1662917
aaacgaaa

SEQ ID NO: 84655 - DNA, 11 bp, Unknown
  misc_feature (1)..( 11): Result.001 file - promoters70/1662917
tagagaaattc

SEQ ID NO: 84656 - DNA, 11 bp, Unknown
  misc_feature (1)..( 11): Result.001 file - promoters70/1662917
gtaagaaatcc

SEQ ID NO: 84657 - DNA, 11 bp, Unknown
  misc_feature (1)..( 11): Result.001 file - promoters70/1662917
tttagaaaaat

SEQ ID NO: 84658 - DNA, 8 bp, Unknown
  misc_feature (1)..( 8): Result.001 file - promoters70/1662917
attagttc

SEQ ID NO: 84659 - DNA, 8 bp, Unknown
  misc_feature (1)..( 8): Result.001 file - promoters70/1662917
atttgtta

SEQ ID NO: 84660 - DNA, 8 bp, Unknown
  misc_feature (1)..( 8): Result.001 file - promoters70/1662917
aattgtta

SEQ ID NO: 84661 - DNA, 8 bp, Unknown
  misc_feature (1)..( 8): Result.001 file - promoters70/1662917
ttttcaat

SEQ ID NO: 84662 - DNA, 8 bp, Unknown
  misc_feature (1)..( 8): Result.001 file - promoters70/1662917
attttaat

SEQ ID NO: 84663 - DNA, 8 bp, Unknown
  misc_feature (1)..( 8): Result.001 file - promoters70/1662917
attctaac

SEQ ID NO: 84664 - DNA, 8 bp, Unknown
  misc_feature (1)..( 8): Result.001 file - promoters70/1662917
cttttaaa

SEQ ID NO: 84665 - DNA, 13 bp, Unknown
  misc_feature (1)..( 13): Result.001 file - promoters70/1662917
ttttgaagaattt

SEQ ID NO: 84666 - DNA, 13 bp, Unknown
  misc_feature (1)..( 13): Result.001 file - promoters70/1662917
ttttgatgaatgt

SEQ ID NO: 84667 - DNA, 13 bp, Unknown
  misc_feature (1)..( 13): Result.001 file - promoters70/1662917
atttgctgaataa

SEQ ID NO: 84668 - DNA, 13 bp, Unknown
  misc_feature (1)..( 13): Result.001 file - promoters70/1662917
cccttgtgaatgt

SEQ ID NO: 84669 - DNA, 11 bp, Unknown
  misc_feature (1)..( 11): Result.001 file - promoters70/1662917
atttccataaa

SEQ ID NO: 84670 - DNA, 11 bp, Unknown
  misc_feature (1)..( 11): Result.001 file - promoters70/1662917
attttcataaa

SEQ ID NO: 84671 - DNA, 11 bp, Unknown
  misc_feature (1)..( 11): Result.001 file - promoters70/1662917
aatttcatcct

SEQ ID NO: 84672 - DNA, 17 bp, Unknown
  misc_feature (1)..( 17): Result.001 file - promoters70/1662917
aaaatgttagataggaa

SEQ ID NO: 84673 - DNA, 17 bp, Unknown
  misc_feature (1)..( 17): Result.001 file - promoters70/1662917
taaattttaaaattatt

SEQ ID NO: 84674 - DNA, 17 bp, Unknown
  misc_feature (1)..( 17): Result.001 file - promoters70/1662917
taaattttgaaataatt

SEQ ID NO: 84675 - DNA, 17 bp, Unknown
  misc_feature (1)..( 17): Result.001 file - promoters70/1662917
taattgttaatcttttg

SEQ ID NO: 84676 - DNA, 13 bp, Unknown
  misc_feature (1)..( 13): Result.001 file - promoters70/1662917
tcatcgaacagca

SEQ ID NO: 84677 - DNA, 13 bp, Unknown
  misc_feature (1)..( 13): Result.001 file - promoters70/1662917
taatccaacggca

SEQ ID NO: 84678 - DNA, 13 bp, Unknown
  misc_feature (1)..( 13): Result.001 file - promoters70/1662917
taatccaacggac

SEQ ID NO: 84679 - DNA, 8 bp, Unknown
  misc_feature (1)..( 8): Result.001 file - promoters70/1662917
tatataaa

SEQ ID NO: 84680 - DNA, 8 bp, Unknown
  misc_feature (1)..( 8): Result.001 file - promoters70/1662917
tatataat

SEQ ID NO: 84681 - DNA, 8 bp, Unknown
  misc_feature (1)..( 8): Result.001 file - promoters70/1662917
cctataaa

SEQ ID NO: 84682 - DNA, 10 bp, Unknown
  misc_feature (1)..( 10): Result.001 file - promoters70/1662917
tataaacaaa

SEQ ID NO: 84683 - DNA, 10 bp, Unknown
  misc_feature (1)..( 10): Result.001 file - promoters70/1662917
aataaccaaa

SEQ ID NO: 84684 - DNA, 10 bp, Unknown
  misc_feature (1)..( 10): Result.001 file - promoters70/1662917
tataaatatc

SEQ ID NO: 84685 - DNA, 8 bp, Unknown
  misc_feature (1)..( 8): Result.001 file - promoters70/1662917
aaattcaa

SEQ ID NO: 84686 - DNA, 8 bp, Unknown
  misc_feature (1)..( 8): Result.001 file - promoters70/1662917
aaattctc

SEQ ID NO: 84687 - DNA, 8 bp, Unknown
  misc_feature (1)..( 8): Result.001 file - promoters70/1662917
aaatcctc

SEQ ID NO: 84688 - DNA, 11 bp, Unknown
  misc_feature (1)..( 11): Result.001 file - promoters70/1662917
cttataattat

SEQ ID NO: 84689 - DNA, 11 bp, Unknown
  misc_feature (1)..( 11): Result.001 file - promoters70/1662917
tttataagtat

SEQ ID NO: 84690 - DNA, 11 bp, Unknown
  misc_feature (1)..( 11): Result.001 file - promoters70/1662917
tttgtaacttc

SEQ ID NO: 84691 - DNA, 11 bp, Unknown
  misc_feature (1)..( 11): Result.001 file - promoters70/1662917
tttaaaagtaa

SEQ ID NO: 84692 - DNA, 8 bp, Unknown
  misc_feature (1)..( 8): Result.001 file - promoters70/1662917
gtaatgta

SEQ ID NO: 84693 - DNA, 8 bp, Unknown
  misc_feature (1)..( 8): Result.001 file - promoters70/1662917
tgaatgta

SEQ ID NO: 84694 - DNA, 8 bp, Unknown
  misc_feature (1)..( 8): Result.001 file - promoters70/1662917
tgaatgtc

SEQ ID NO: 84695 - DNA, 10 bp, Unknown
  misc_feature (1)..( 10): Result.001 file - promoters70/1662917
atttaaattg

SEQ ID NO: 84696 - DNA, 10 bp, Unknown
  misc_feature (1)..( 10): Result.001 file - promoters70/1662917
atttaaatca

SEQ ID NO: 84697 - DNA, 10 bp, Unknown
  misc_feature (1)..( 10): Result.001 file - promoters70/1663278
gtgtaagttg

SEQ ID NO: 84698 - DNA, 9 bp, Unknown
  misc_feature (1)..( 9): Result.001 file - promoters70/1663278
gtttttttt

SEQ ID NO: 84699 - DNA, 9 bp, Unknown
  misc_feature (1)..( 9): Result.001 file - promoters70/1663278
gttcttttt

SEQ ID NO: 84700 - DNA, 9 bp, Unknown
  misc_feature (1)..( 9): Result.001 file - promoters70/1663278
attctttgg

SEQ ID NO: 84701 - DNA, 6 bp, Unknown
  misc_feature (1)..( 6): Result.001 file - promoters70/1663278
tagctt

SEQ ID NO: 84702 - DNA, 6 bp, Unknown
  misc_feature (1)..( 6): Result.001 file - promoters70/1663278
tagctt

SEQ ID NO: 84703 - DNA, 6 bp, Unknown
  misc_feature (1)..( 6): Result.001 file - promoters70/1663353
tagctt

SEQ ID NO: 84704 - DNA, 7 bp, Unknown
  misc_feature (1)..( 7): Result.001 file - promoters70/1663353
aaaacaa

SEQ ID NO: 84705 - DNA, 7 bp, Unknown
  misc_feature (1)..( 7): Result.001 file - promoters70/1663353
aaaacat

SEQ ID NO: 84706 - DNA, 7 bp, Unknown
  misc_feature (1)..( 7): Result.001 file - promoters70/1663353
aaatcaa

SEQ ID NO: 84707 - DNA, 8 bp, Unknown
  misc_feature (1)..( 8): Result.001 file - promoters70/1663353
aatctttt

SEQ ID NO: 84708 - DNA, 8 bp, Unknown
  misc_feature (1)..( 8): Result.001 file - promoters70/1663353
catcgttt

SEQ ID NO: 84709 - DNA, 8 bp, Unknown
  misc_feature (1)..( 8): Result.001 file - promoters70/1663353
catcgtcg

SEQ ID NO: 84710 - DNA, 8 bp, Unknown
  misc_feature (1)..( 8): Result.001 file - promoters70/1663353
tattattt

SEQ ID NO: 84711 - DNA, 8 bp, Unknown
  misc_feature (1)..( 8): Result.001 file - promoters70/1663353
gattcttt

SEQ ID NO: 84712 - DNA, 8 bp, Unknown
  misc_feature (1)..( 8): Result.001 file - promoters70/1673798
gattctct

SEQ ID NO: 84713 - DNA, 9 bp, Unknown
  misc_feature (1)..( 9): Result.001 file - promoters70/1673798
aaactaaaa

SEQ ID NO: 84714 - DNA, 9 bp, Unknown
  misc_feature (1)..( 9): Result.001 file - promoters70/1673798
aaaataaaa

SEQ ID NO: 84715 - DNA, 9 bp, Unknown
  misc_feature (1)..( 9): Result.001 file - promoters70/1673798
aaacaaaat

SEQ ID NO: 84716 - DNA, 10 bp, Unknown
  misc_feature (1)..( 10): Result.001 file - promoters70/1673798
taaaataaaa

SEQ ID NO: 84717 - DNA, 10 bp, Unknown
  misc_feature (1)..( 10): Result.001 file - promoters70/1673798
aaaaataaaa

SEQ ID NO: 84718 - DNA, 10 bp, Unknown
  misc_feature (1)..( 10): Result.001 file - promoters70/1711228
taatatatta

SEQ ID NO: 84719 - DNA, 7 bp, Unknown
  misc_feature (1)..( 7): Result.001 file - promoters70/1711228
aagattt

SEQ ID NO: 84720 - DNA, 7 bp, Unknown
  misc_feature (1)..( 7): Result.001 file - promoters70/1711228
aagattc

SEQ ID NO: 84721 - DNA, 7 bp, Unknown
  misc_feature (1)..( 7): Result.001 file - promoters70/1711228
aagattt

SEQ ID NO: 84722 - DNA, 12 bp, Unknown
  misc_feature (1)..( 12): Result.001 file - promoters70/1711228
tgtattttatgt

SEQ ID NO: 84723 - DNA, 12 bp, Unknown
  misc_feature (1)..( 12): Result.001 file - promoters70/1711228
tgtgtttgttgt

SEQ ID NO: 84724 - DNA, 12 bp, Unknown
  misc_feature (1)..( 12): Result.001 file - promoters70/1711228
attattatatgt

SEQ ID NO: 84725 - DNA, 12 bp, Unknown
  misc_feature (1)..( 12): Result.001 file - promoters70/1711228
catatttaatag

SEQ ID NO: 84726 - DNA, 7 bp, Unknown
  misc_feature (1)..( 7): Result.001 file - promoters70/1711228
gagtatt

SEQ ID NO: 84727 - DNA, 7 bp, Unknown
  misc_feature (1)..( 7): Result.001 file - promoters70/1711228
tagtatt

SEQ ID NO: 84728 - DNA, 7 bp, Unknown
  misc_feature (1)..( 7): Result.001 file - promoters70/1711228
tagcatt

SEQ ID NO: 84729 - DNA, 8 bp, Unknown
  misc_feature (1)..( 8): Result.001 file - promoters70/1711228
caacaata

SEQ ID NO: 84730 - DNA, 8 bp, Unknown
  misc_feature (1)..( 8): Result.001 file - promoters70/1711228
caataatg

SEQ ID NO: 84731 - DNA, 8 bp, Unknown
  misc_feature (1)..( 8): Result.001 file - promoters70/1711228
gaattatg

SEQ ID NO: 84732 - DNA, 7 bp, Unknown
  misc_feature (1)..( 7): Result.001 file - promoters70/1711228
tgtattt

SEQ ID NO: 84733 - DNA, 7 bp, Unknown
  misc_feature (1)..( 7): Result.001 file - promoters70/1711228
tgttttt

SEQ ID NO: 84734 - DNA, 8 bp, Unknown
  misc_feature (1)..( 8): Result.001 file - promoters70/1711228
tttatctt

SEQ ID NO: 84735 - DNA, 8 bp, Unknown
  misc_feature (1)..( 8): Result.001 file - promoters70/1711228
atttgttt

SEQ ID NO: 84736 - DNA, 11 bp, Unknown
  misc_feature (1)..( 11): Result.001 file - promoters70/1711228
acacgaaaaaa

SEQ ID NO: 84737 - DNA, 11 bp, Unknown
  misc_feature (1)..( 11): Result.001 file - promoters70/1711228
acaccaaaaaa

SEQ ID NO: 84738 - DNA, 11 bp, Unknown
  misc_feature (1)..( 11): Result.001 file - promoters70/1711318
tgcagaaaaag

SEQ ID NO: 84739 - DNA, 9 bp, Unknown
  misc_feature (1)..( 9): Result.001 file - promoters70/1711318
attaatttc

SEQ ID NO: 84740 - DNA, 9 bp, Unknown
  misc_feature (1)..( 9): Result.001 file - promoters70/1711318
atttatttt

SEQ ID NO: 84741 - DNA, 9 bp, Unknown
  misc_feature (1)..( 9): Result.001 file - promoters70/1711318
tctaacttc

SEQ ID NO: 84742 - DNA, 12 bp, Unknown
  misc_feature (1)..( 12): Result.001 file - promoters70/1711318
aaaggcccatat

SEQ ID NO: 84743 - DNA, 12 bp, Unknown
  misc_feature (1)..( 12): Result.001 file - promoters70/1711318
aaaagccctagt

SEQ ID NO: 84744 - DNA, 12 bp, Unknown
  misc_feature (1)..( 12): Result.001 file - promoters70/1711318
ttcggcccatat

SEQ ID NO: 84745 - DNA, 9 bp, Unknown
  misc_feature (1)..( 9): Result.001 file - promoters70/1711318
aaattgaat

SEQ ID NO: 84746 - DNA, 9 bp, Unknown
  misc_feature (1)..( 9): Result.001 file - promoters70/1711318
aaattgaga

SEQ ID NO: 84747 - DNA, 9 bp, Unknown
  misc_feature (1)..( 9): Result.001 file - promoters70/1711318
acattgaga

SEQ ID NO: 84748 - DNA, 9 bp, Unknown
  misc_feature (1)..( 9): Result.001 file - promoters70/1711318
taaaataaa

SEQ ID NO: 84749 - DNA, 9 bp, Unknown
  misc_feature (1)..( 9): Result.001 file - promoters70/1711318
gaaaacaaa

SEQ ID NO: 84750 - DNA, 9 bp, Unknown
  misc_feature (1)..( 9): Result.001 file - promoters70/1711318
gaaagcaat

SEQ ID NO: 84751 - DNA, 11 bp, Unknown
  misc_feature (1)..( 11): Result.001 file - promoters70/1711318
agtttaggttt

SEQ ID NO: 84752 - DNA, 11 bp, Unknown
  misc_feature (1)..( 11): Result.001 file - promoters70/1711318
tttttaggccc

SEQ ID NO: 84753 - DNA, 12 bp, Unknown
  misc_feature (1)..( 12): Result.001 file - promoters70/1711318
atttataggccc

SEQ ID NO: 84754 - DNA, 8 bp, Unknown
  misc_feature (1)..( 8): Result.001 file - promoters70/1711318
gattgaaa

SEQ ID NO: 84755 - DNA, 8 bp, Unknown
  misc_feature (1)..( 8): Result.001 file - promoters70/1711318
gattgaag

SEQ ID NO: 84756 - DNA, 9 bp, Unknown
  misc_feature (1)..( 9): Result.001 file - promoters70/1711318
atttgcaat

SEQ ID NO: 84757 - DNA, 12 bp, Unknown
  misc_feature (1)..( 12): Result.001 file - promoters70/1711318
aaccctagcccc

SEQ ID NO: 84758 - DNA, 12 bp, Unknown
  misc_feature (1)..( 12): Result.001 file - promoters70/1711318
atttataggccc

SEQ ID NO: 84759 - DNA, 12 bp, Unknown
  misc_feature (1)..( 12): Result.001 file - promoters70/1713842
atttttaggccc

SEQ ID NO: 84760 - DNA, 7 bp, Unknown
  misc_feature (1)..( 7): Result.001 file - promoters70/1713842
tatttat

SEQ ID NO: 84761 - DNA, 7 bp, Unknown
  misc_feature (1)..( 7): Result.001 file - promoters70/1713842
tatttaa

SEQ ID NO: 84762 - DNA, 7 bp, Unknown
  misc_feature (1)..( 7): Result.001 file - promoters70/1713842
aattttt

SEQ ID NO: 84763 - DNA, 8 bp, Unknown
  misc_feature (1)..( 8): Result.001 file - promoters70/1713842
caaaccca

SEQ ID NO: 84764 - DNA, 8 bp, Unknown
  misc_feature (1)..( 8): Result.001 file - promoters70/1713842
caaacctg

SEQ ID NO: 84765 - DNA, 8 bp, Unknown
  misc_feature (1)..( 8): Result.001 file - promoters70/1713842
gaaagctg

SEQ ID NO: 84766 - DNA, 8 bp, Unknown
  misc_feature (1)..( 8): Result.001 file - promoters70/1713842
agagacat

SEQ ID NO: 84767 - DNA, 8 bp, Unknown
  misc_feature (1)..( 8): Result.001 file - promoters70/1713842
agatacag

SEQ ID NO: 84768 - DNA, 8 bp, Unknown
  misc_feature (1)..( 8): Result.001 file - promoters70/1713842
cgatccag

SEQ ID NO: 84769 - DNA, 9 bp, Unknown
  misc_feature (1)..( 9): Result.001 file - promoters70/1713842
tttaaagct

SEQ ID NO: 84770 - DNA, 9 bp, Unknown
  misc_feature (1)..( 9): Result.001 file - promoters70/1713842
tttcaagtt

SEQ ID NO: 84771 - DNA, 9 bp, Unknown
  misc_feature (1)..( 9): Result.001 file - promoters70/1714694
tctcacgtt

SEQ ID NO: 84772 - DNA, 8 bp, Unknown
  misc_feature (1)..( 8): Result.001 file - promoters70/1714694
ttgtattt

SEQ ID NO: 84773 - DNA, 8 bp, Unknown
  misc_feature (1)..( 8): Result.001 file - promoters70/1714694
ttgtatat

SEQ ID NO: 84774 - DNA, 8 bp, Unknown
  misc_feature (1)..( 8): Result.001 file - promoters70/1714694
atgtctat

SEQ ID NO: 84775 - DNA, 7 bp, Unknown
  misc_feature (1)..( 7): Result.001 file - promoters70/1714694
attgctt

SEQ ID NO: 84776 - DNA, 7 bp, Unknown
  misc_feature (1)..( 7): Result.001 file - promoters70/1714694
tttgctt

SEQ ID NO: 84777 - DNA, 7 bp, Unknown
  misc_feature (1)..( 7): Result.001 file - promoters70/1714831
tttactt

SEQ ID NO: 84778 - DNA, 7 bp, Unknown
  misc_feature (1)..( 7): Result.001 file - promoters70/1714831
aaatgca

SEQ ID NO: 84779 - DNA, 7 bp, Unknown
  misc_feature (1)..( 7): Result.001 file - promoters70/1714831
aaatgca

SEQ ID NO: 84780 - DNA, 8 bp, Unknown
  misc_feature (1)..( 8): Result.001 file - promoters70/1714831
aaattgcg

SEQ ID NO: 84781 - DNA, 10 bp, Unknown
  misc_feature (1)..( 10): Result.001 file - promoters70/1714831
aagccgaatt

SEQ ID NO: 84782 - DNA, 10 bp, Unknown
  misc_feature (1)..( 10): Result.001 file - promoters70/1714831
aagacgattc

SEQ ID NO: 84783 - DNA, 10 bp, Unknown
  misc_feature (1)..( 10): Result.001 file - promoters70/1714831
aggcccaatt

SEQ ID NO: 84784 - DNA, 10 bp, Unknown
  misc_feature (1)..( 10): Result.001 file - promoters70/1714831
catgtgaaga

SEQ ID NO: 84785 - DNA, 10 bp, Unknown
  misc_feature (1)..( 10): Result.001 file - promoters70/1714831
catttgattt

SEQ ID NO: 84786 - DNA, 10 bp, Unknown
  misc_feature (1)..( 10): Result.001 file - promoters70/1714831
tatttaattt

SEQ ID NO: 84787 - DNA, 8 bp, Unknown
  misc_feature (1)..( 8): Result.001 file - promoters70/1714831
caaaccca

SEQ ID NO: 84788 - DNA, 8 bp, Unknown
  misc_feature (1)..( 8): Result.001 file - promoters70/1714831
caaacctg

SEQ ID NO: 84789 - DNA, 8 bp, Unknown
  misc_feature (1)..( 8): Result.001 file - promoters70/1714831
gaaagctg

SEQ ID NO: 84790 - DNA, 8 bp, Unknown
  misc_feature (1)..( 8): Result.001 file - promoters70/1714831
agagacat

SEQ ID NO: 84791 - DNA, 8 bp, Unknown
  misc_feature (1)..( 8): Result.001 file - promoters70/1714831
agatacag

SEQ ID NO: 84792 - DNA, 8 bp, Unknown
  misc_feature (1)..( 8): Result.001 file - promoters70/1714831
cgatccag

SEQ ID NO: 84793 - DNA, 9 bp, Unknown
  misc_feature (1)..( 9): Result.001 file - promoters70/1714831
tttaaagct

SEQ ID NO: 84794 - DNA, 9 bp, Unknown
  misc_feature (1)..( 9): Result.001 file - promoters70/1714831
tttcaagtt

SEQ ID NO: 84795 - DNA, 9 bp, Unknown
  misc_feature (1)..( 9): Result.001 file - promoters70/1714989
tctcacgtt

SEQ ID NO: 84796 - DNA, 10 bp, Unknown
  misc_feature (1)..( 10): Result.001 file - promoters70/1714989
tgaaaatatt

SEQ ID NO: 84797 - DNA, 10 bp, Unknown
  misc_feature (1)..( 10): Result.001 file - promoters70/1714989
caaaaataag

SEQ ID NO: 84798 - DNA, 10 bp, Unknown
  misc_feature (1)..( 10): Result.001 file - promoters70/1714989
taaaaattaa

SEQ ID NO: 84799 - DNA, 10 bp, Unknown
  misc_feature (1)..( 10): Result.001 file - promoters70/1714989
caaagattta

SEQ ID NO: 84800 - DNA, 10 bp, Unknown
  misc_feature (1)..( 10): Result.001 file - promoters70/1714989
taaacatatt

SEQ ID NO: 84801 - DNA, 10 bp, Unknown
  misc_feature (1)..( 10): Result.001 file - promoters70/1714989
caaaaaaggt

SEQ ID NO: 84802 - DNA, 10 bp, Unknown
  misc_feature (1)..( 10): Result.001 file - promoters70/1714989
gtaaaatttc

SEQ ID NO: 84803 - DNA, 10 bp, Unknown
  misc_feature (1)..( 10): Result.001 file - promoters70/1714989
taaaaatctc

SEQ ID NO: 84804 - DNA, 10 bp, Unknown
  misc_feature (1)..( 10): Result.001 file - promoters70/1714989
aaaacaaacg

SEQ ID NO: 84805 - DNA, 10 bp, Unknown
  misc_feature (1)..( 10): Result.001 file - promoters70/1714989
aaaaaaaaga

SEQ ID NO: 84806 - DNA, 10 bp, Unknown
  misc_feature (1)..( 10): Result.001 file - promoters70/1714989
taaataaatt

SEQ ID NO: 84807 - DNA, 10 bp, Unknown
  misc_feature (1)..( 10): Result.001 file - promoters70/1714989
taaaaaaaga

SEQ ID NO: 84808 - DNA, 10 bp, Unknown
  misc_feature (1)..( 10): Result.001 file - promoters70/1714989
caaacaaatg

SEQ ID NO: 84809 - DNA, 10 bp, Unknown
  misc_feature (1)..( 10): Result.001 file - promoters70/1714989
gaaacaaatt

SEQ ID NO: 84810 - DNA, 10 bp, Unknown
  misc_feature (1)..( 10): Result.001 file - promoters70/1714989
ttaactaatt

SEQ ID NO: 84811 - DNA, 10 bp, Unknown
  misc_feature (1)..( 10): Result.001 file - promoters70/1714989
taatataact

SEQ ID NO: 84812 - DNA, 10 bp, Unknown
  misc_feature (1)..( 10): Result.001 file - promoters70/1714989
cacaccaaat

SEQ ID NO: 84813 - DNA, 10 bp, Unknown
  misc_feature (1)..( 10): Result.001 file - promoters70/1714989
aaaaccaaag

SEQ ID NO: 84814 - DNA, 10 bp, Unknown
  misc_feature (1)..( 10): Result.001 file - promoters70/1714989
ccaactaaag

SEQ ID NO: 84815 - DNA, 10 bp, Unknown
  misc_feature (1)..( 10): Result.001 file - promoters70/1714989
ataaccaaga

SEQ ID NO: 84816 - DNA, 10 bp, Unknown
  misc_feature (1)..( 10): Result.001 file - promoters70/1714989
taaactatga

SEQ ID NO: 84817 - DNA, 10 bp, Unknown
  misc_feature (1)..( 10): Result.001 file - promoters70/1714989
caaaatatca

SEQ ID NO: 84818 - DNA, 12 bp, Unknown
  misc_feature (1)..( 12): Result.001 file - promoters70/1714989
attacaaaacta

SEQ ID NO: 84819 - DNA, 12 bp, Unknown
  misc_feature (1)..( 12): Result.001 file - promoters70/1714989
tatacaaaaaaa

SEQ ID NO: 84820 - DNA, 12 bp, Unknown
  misc_feature (1)..( 12): Result.001 file - promoters70/1714989
ttaacaaaaaag

SEQ ID NO: 84821 - DNA, 12 bp, Unknown
  misc_feature (1)..( 12): Result.001 file - promoters70/1714989
ctcccaaaaata

SEQ ID NO: 84822 - DNA, 12 bp, Unknown
  misc_feature (1)..( 12): Result.001 file - promoters70/1714989
caaataaacata

SEQ ID NO: 84823 - DNA, 12 bp, Unknown
  misc_feature (1)..( 12): Result.001 file - promoters70/1714989
attcctaaaatc

SEQ ID NO: 84824 - DNA, 12 bp, Unknown
  misc_feature (1)..( 12): Result.001 file - promoters70/1714989
tatacaagaaca

SEQ ID NO: 84825 - DNA, 13 bp, Unknown
  misc_feature (1)..( 13): Result.001 file - promoters70/1714989
aataaataaaagc

SEQ ID NO: 84826 - DNA, 13 bp, Unknown
  misc_feature (1)..( 13): Result.001 file - promoters70/1714989
aaacaataaaatt

SEQ ID NO: 84827 - DNA, 13 bp, Unknown
  misc_feature (1)..( 13): Result.001 file - promoters70/1714989
acattataaaata

SEQ ID NO: 84828 - DNA, 13 bp, Unknown
  misc_feature (1)..( 13): Result.001 file - promoters70/1714989
aaacagtaaaacc

SEQ ID NO: 84829 - DNA, 13 bp, Unknown
  misc_feature (1)..( 13): Result.001 file - promoters70/1714989
aggagataatatt

SEQ ID NO: 84830 - DNA, 13 bp, Unknown
  misc_feature (1)..( 13): Result.001 file - promoters70/1714989
cgtcaaaaaactt

SEQ ID NO: 84831 - DNA, 14 bp, Unknown
  misc_feature (1)..( 14): Result.001 file - promoters70/1714989
cgtcatattattag

SEQ ID NO: 84832 - DNA, 14 bp, Unknown
  misc_feature (1)..( 14): Result.001 file - promoters70/1714989
aaaaatattattag

SEQ ID NO: 84833 - DNA, 14 bp, Unknown
  misc_feature (1)..( 14): Result.001 file - promoters70/1714989
agtgatataattat

SEQ ID NO: 84834 - DNA, 14 bp, Unknown
  misc_feature (1)..( 14): Result.001 file - promoters70/1714989
tttgttattatatt

SEQ ID NO: 84835 - DNA, 14 bp, Unknown
  misc_feature (1)..( 14): Result.001 file - promoters70/1714989
aaacaaattattta

SEQ ID NO: 84836 - DNA, 14 bp, Unknown
  misc_feature (1)..( 14): Result.001 file - promoters70/1714989
tggattatcatttt

SEQ ID NO: 84837 - DNA, 14 bp, Unknown
  misc_feature (1)..( 14): Result.001 file - promoters70/1714989
gttaatatatattt

SEQ ID NO: 84838 - DNA, 11 bp, Unknown
  misc_feature (1)..( 11): Result.001 file - promoters70/1714989
gtttgtttaac

SEQ ID NO: 84839 - DNA, 11 bp, Unknown
  misc_feature (1)..( 11): Result.001 file - promoters70/1714989
ttttatttctt

SEQ ID NO: 84840 - DNA, 11 bp, Unknown
  misc_feature (1)..( 11): Result.001 file - promoters70/1714989
ttttgtttctg

SEQ ID NO: 84841 - DNA, 11 bp, Unknown
  misc_feature (1)..( 11): Result.001 file - promoters70/1714989
aattattttgt

SEQ ID NO: 84842 - DNA, 11 bp, Unknown
  misc_feature (1)..( 11): Result.001 file - promoters70/1714989
acttatatctt

SEQ ID NO: 84843 - DNA, 11 bp, Unknown
  misc_feature (1)..( 11): Result.001 file - promoters70/1714989
ttttataatga

SEQ ID NO: 84844 - DNA, 9 bp, Unknown
  misc_feature (1)..( 9): Result.001 file - promoters70/1714989
ctacatatt

SEQ ID NO: 84845 - DNA, 9 bp, Unknown
  misc_feature (1)..( 9): Result.001 file - promoters70/1714989
aaacatatt

SEQ ID NO: 84846 - DNA, 9 bp, Unknown
  misc_feature (1)..( 9): Result.001 file - promoters70/1714989
caacatata

SEQ ID NO: 84847 - DNA, 9 bp, Unknown
  misc_feature (1)..( 9): Result.001 file - promoters70/1714989
aaaaataag

SEQ ID NO: 84848 - DNA, 9 bp, Unknown
  misc_feature (1)..( 9): Result.001 file - promoters70/1714989
caaaaaagg

SEQ ID NO: 84849 - DNA, 9 bp, Unknown
  misc_feature (1)..( 9): Result.001 file - promoters70/1714989
aaaaaaagc

SEQ ID NO: 84850 - DNA, 11 bp, Unknown
  misc_feature (1)..( 11): Result.001 file - promoters70/1714989
aaaaaataaga

SEQ ID NO: 84851 - DNA, 11 bp, Unknown
  misc_feature (1)..( 11): Result.001 file - promoters70/1714989
gatagataaga

SEQ ID NO: 84852 - DNA, 11 bp, Unknown
  misc_feature (1)..( 11): Result.001 file - promoters70/1714989
caaagacaagt

SEQ ID NO: 84853 - DNA, 11 bp, Unknown
  misc_feature (1)..( 11): Result.001 file - promoters70/1714989
caaaaacaata

SEQ ID NO: 84854 - DNA, 11 bp, Unknown
  misc_feature (1)..( 11): Result.001 file - promoters70/1714989
accccacaaaa

SEQ ID NO: 84855 - DNA, 11 bp, Unknown
  misc_feature (1)..( 11): Result.001 file - promoters70/1714989
gggttacaaaa

SEQ ID NO: 84856 - DNA, 7 bp, Unknown
  misc_feature (1)..( 7): Result.001 file - promoters70/1714989
taagatt

SEQ ID NO: 84857 - DNA, 7 bp, Unknown
  misc_feature (1)..( 7): Result.001 file - promoters70/1714989
taaaatt

SEQ ID NO: 84858 - DNA, 7 bp, Unknown
  misc_feature (1)..( 7): Result.001 file - promoters70/1714989
taagatc

SEQ ID NO: 84859 - DNA, 7 bp, Unknown
  misc_feature (1)..( 7): Result.001 file - promoters70/1714989
aaaaatt

SEQ ID NO: 84860 - DNA, 7 bp, Unknown
  misc_feature (1)..( 7): Result.001 file - promoters70/1714989
caaaatt

SEQ ID NO: 84861 - DNA, 7 bp, Unknown
  misc_feature (1)..( 7): Result.001 file - promoters70/1714989
taaaaat

SEQ ID NO: 84862 - DNA, 7 bp, Unknown
  misc_feature (1)..( 7): Result.001 file - promoters70/1714989
taacaat

SEQ ID NO: 84863 - DNA, 12 bp, Unknown
  misc_feature (1)..( 12): Result.001 file - promoters70/1714989
gagttaaaaaat

SEQ ID NO: 84864 - DNA, 12 bp, Unknown
  misc_feature (1)..( 12): Result.001 file - promoters70/1714989
tagttaatatat

SEQ ID NO: 84865 - DNA, 12 bp, Unknown
  misc_feature (1)..( 12): Result.001 file - promoters70/1714989
tagttaaaaagt

SEQ ID NO: 84866 - DNA, 12 bp, Unknown
  misc_feature (1)..( 12): Result.001 file - promoters70/1714989
ttgttattatat

SEQ ID NO: 84867 - DNA, 12 bp, Unknown
  misc_feature (1)..( 12): Result.001 file - promoters70/1714989
cagttatttaaa

SEQ ID NO: 84868 - DNA, 12 bp, Unknown
  misc_feature (1)..( 12): Result.001 file - promoters70/1715347
aaattatttaca

SEQ ID NO: 84869 - DNA, 11 bp, Unknown
  misc_feature (1)..( 11): Result.001 file - promoters70/1715347
cattagtttcc

SEQ ID NO: 84870 - DNA, 11 bp, Unknown
  misc_feature (1)..( 11): Result.001 file - promoters70/1715347
atttattttcc

SEQ ID NO: 84871 - DNA, 11 bp, Unknown
  misc_feature (1)..( 11): Result.001 file - promoters70/1715347
agttagttctc

SEQ ID NO: 84872 - DNA, 11 bp, Unknown
  misc_feature (1)..( 11): Result.001 file - promoters70/1715347
atacagtgtcc

SEQ ID NO: 84873 - DNA, 11 bp, Unknown
  misc_feature (1)..( 11): Result.001 file - promoters70/1715347
aaatatcttca

SEQ ID NO: 84874 - DNA, 11 bp, Unknown
  misc_feature (1)..( 11): Result.001 file - promoters70/1715347
atttattaaca

SEQ ID NO: 84875 - DNA, 12 bp, Unknown
  misc_feature (1)..( 12): Result.001 file - promoters70/1715347
tcttaaatgctt

SEQ ID NO: 84876 - DNA, 12 bp, Unknown
  misc_feature (1)..( 12): Result.001 file - promoters70/1715347
ctctaattgctt

SEQ ID NO: 84877 - DNA, 12 bp, Unknown
  misc_feature (1)..( 12): Result.001 file - promoters70/1715347
tcttaaataact

SEQ ID NO: 84878 - DNA, 12 bp, Unknown
  misc_feature (1)..( 12): Result.001 file - promoters70/1715347
gcttgaatcaat

SEQ ID NO: 84879 - DNA, 12 bp, Unknown
  misc_feature (1)..( 12): Result.001 file - promoters70/1715347
cgataattgatt

SEQ ID NO: 84880 - DNA, 12 bp, Unknown
  misc_feature (1)..( 12): Result.001 file - promoters70/1715347
ttttaattaaaa

SEQ ID NO: 84881 - DNA, 12 bp, Unknown
  misc_feature (1)..( 12): Result.001 file - promoters70/1715347
tctaaaacgttt

SEQ ID NO: 84882 - DNA, 11 bp, Unknown
  misc_feature (1)..( 11): Result.001 file - promoters70/1715347
gaaatatcttt

SEQ ID NO: 84883 - DNA, 11 bp, Unknown
  misc_feature (1)..( 11): Result.001 file - promoters70/1715347
tatatatattt

SEQ ID NO: 84884 - DNA, 11 bp, Unknown
  misc_feature (1)..( 11): Result.001 file - promoters70/1715347
aaaatatcttg

SEQ ID NO: 84885 - DNA, 11 bp, Unknown
  misc_feature (1)..( 11): Result.001 file - promoters70/1715347
aaaaaatcaaa

SEQ ID NO: 84886 - DNA, 11 bp, Unknown
  misc_feature (1)..( 11): Result.001 file - promoters70/1715347
cccataatttt

SEQ ID NO: 84887 - DNA, 11 bp, Unknown
  misc_feature (1)..( 11): Result.001 file - promoters70/1715347
ccggaatttta

SEQ ID NO: 84888 - DNA, 13 bp, Unknown
  misc_feature (1)..( 13): Result.001 file - promoters70/1715347
aggatcttaaatg

SEQ ID NO: 84889 - DNA, 13 bp, Unknown
  misc_feature (1)..( 13): Result.001 file - promoters70/1715347
aacatctaaaacg

SEQ ID NO: 84890 - DNA, 13 bp, Unknown
  misc_feature (1)..( 13): Result.001 file - promoters70/1715347
aatagcttgaatc

SEQ ID NO: 84891 - DNA, 13 bp, Unknown
  misc_feature (1)..( 13): Result.001 file - promoters70/1715347
tttaattaaaaca

SEQ ID NO: 84892 - DNA, 13 bp, Unknown
  misc_feature (1)..( 13): Result.001 file - promoters70/1715347
accttcttaaata

SEQ ID NO: 84893 - DNA, 13 bp, Unknown
  misc_feature (1)..( 13): Result.001 file - promoters70/1715347
ttgattcaaaatt

SEQ ID NO: 84894 - DNA, 12 bp, Unknown
  misc_feature (1)..( 12): Result.001 file - promoters70/1715347
tcgattatgttt

SEQ ID NO: 84895 - DNA, 12 bp, Unknown
  misc_feature (1)..( 12): Result.001 file - promoters70/1715347
tgtgttatgtta

SEQ ID NO: 84896 - DNA, 13 bp, Unknown
  misc_feature (1)..( 13): Result.001 file - promoters70/1715347
ttgtctatgcttt

SEQ ID NO: 84897 - DNA, 13 bp, Unknown
  misc_feature (1)..( 13): Result.001 file - promoters70/1715347
tattttatcacga

SEQ ID NO: 84898 - DNA, 13 bp, Unknown
  misc_feature (1)..( 13): Result.001 file - promoters70/1715347
tctattatatctg

SEQ ID NO: 84899 - DNA, 13 bp, Unknown
  misc_feature (1)..( 13): Result.001 file - promoters70/1715482
aaaattattttta

SEQ ID NO: 84900 - DNA, 8 bp, Unknown
  misc_feature (1)..( 8): Result.001 file - promoters70/1715482
aattcaca

SEQ ID NO: 84901 - DNA, 8 bp, Unknown
  misc_feature (1)..( 8): Result.001 file - promoters70/1715482
aattcaaa

SEQ ID NO: 84902 - DNA, 8 bp, Unknown
  misc_feature (1)..( 8): Result.001 file - promoters70/1715482
aattaaaa

SEQ ID NO: 84903 - DNA, 9 bp, Unknown
  misc_feature (1)..( 9): Result.001 file - promoters70/1715482
aaaacaact

SEQ ID NO: 84904 - DNA, 9 bp, Unknown
  misc_feature (1)..( 9): Result.001 file - promoters70/1715482
caaataact

SEQ ID NO: 84905 - DNA, 9 bp, Unknown
  misc_feature (1)..( 9): Result.001 file - promoters70/1715535
aaaacagta

SEQ ID NO: 84906 - DNA, 11 bp, Unknown
  misc_feature (1)..( 11): Result.001 file - promoters70/1715535
cagattttcag

SEQ ID NO: 84907 - DNA, 11 bp, Unknown
  misc_feature (1)..( 11): Result.001 file - promoters70/1715535
caaattttcac

SEQ ID NO: 84908 - DNA, 11 bp, Unknown
  misc_feature (1)..( 11): Result.001 file - promoters70/1715535
tggattttctt

SEQ ID NO: 84909 - DNA, 11 bp, Unknown
  misc_feature (1)..( 11): Result.001 file - promoters70/1715535
caaaatttcac

SEQ ID NO: 84910 - DNA, 11 bp, Unknown
  misc_feature (1)..( 11): Result.001 file - promoters70/1715535
ctcttaacaat

SEQ ID NO: 84911 - DNA, 11 bp, Unknown
  misc_feature (1)..( 11): Result.001 file - promoters70/1715535
ctcttagcaaa

SEQ ID NO: 84912 - DNA, 11 bp, Unknown
  misc_feature (1)..( 11): Result.001 file - promoters70/1715535
cccagaacaat

SEQ ID NO: 84913 - DNA, 11 bp, Unknown
  misc_feature (1)..( 11): Result.001 file - promoters70/1807771
atctgaaaaat

SEQ ID NO: 84914 - DNA, 9 bp, Unknown
  misc_feature (1)..( 9): Result.001 file - promoters70/1807771
gaaagtatt

SEQ ID NO: 84915 - DNA, 9 bp, Unknown
  misc_feature (1)..( 9): Result.001 file - promoters70/1807771
caaaatatt

SEQ ID NO: 84916 - DNA, 9 bp, Unknown
  misc_feature (1)..( 9): Result.001 file - promoters70/1807771
caaaatctc

SEQ ID NO: 84917 - DNA, 9 bp, Unknown
  misc_feature (1)..( 9): Result.001 file - promoters70/1807771
gtcatttaa

SEQ ID NO: 84918 - DNA, 9 bp, Unknown
  misc_feature (1)..( 9): Result.001 file - promoters70/1807771
actatttaa

SEQ ID NO: 84919 - DNA, 9 bp, Unknown
  misc_feature (1)..( 9): Result.001 file - promoters70/1807771
gtcttttac

SEQ ID NO: 84920 - DNA, 10 bp, Unknown
  misc_feature (1)..( 10): Result.001 file - promoters70/1807771
atacttatat

SEQ ID NO: 84921 - DNA, 10 bp, Unknown
  misc_feature (1)..( 10): Result.001 file - promoters70/1807771
aaacttatcc

SEQ ID NO: 84922 - DNA, 10 bp, Unknown
  misc_feature (1)..( 10): Result.001 file - promoters70/1807771
gatcttatat

SEQ ID NO: 84923 - DNA, 10 bp, Unknown
  misc_feature (1)..( 10): Result.001 file - promoters70/1807771
aaacttaaac

SEQ ID NO: 84924 - DNA, 9 bp, Unknown
  misc_feature (1)..( 9): Result.001 file - promoters70/1807771
atttaattt

SEQ ID NO: 84925 - DNA, 9 bp, Unknown
  misc_feature (1)..( 9): Result.001 file - promoters70/1807771
atttaattc

SEQ ID NO: 84926 - DNA, 9 bp, Unknown
  misc_feature (1)..( 9): Result.001 file - promoters70/1807771
aattatttc

SEQ ID NO: 84927 - DNA, 10 bp, Unknown
  misc_feature (1)..( 10): Result.001 file - promoters70/1807771
gaaaagaaaa

SEQ ID NO: 84928 - DNA, 10 bp, Unknown
  misc_feature (1)..( 10): Result.001 file - promoters70/1807771
tcgaagcaaa

SEQ ID NO: 84929 - DNA, 10 bp, Unknown
  misc_feature (1)..( 10): Result.001 file - promoters70/1807771
tccaagtaaa

SEQ ID NO: 84930 - DNA, 10 bp, Unknown
  misc_feature (1)..( 10): Result.001 file - promoters70/1807771
tccaggtaca

SEQ ID NO: 84931 - DNA, 12 bp, Unknown
  misc_feature (1)..( 12): Result.001 file - promoters70/1807771
tttgtttgtttt

SEQ ID NO: 84932 - DNA, 12 bp, Unknown
  misc_feature (1)..( 12): Result.001 file - promoters70/1807771
tttgtttttttt

SEQ ID NO: 84933 - DNA, 12 bp, Unknown
  misc_feature (1)..( 12): Result.001 file - promoters70/1807774
atccttttttta

SEQ ID NO: 84934 - DNA, 7 bp, Unknown
  misc_feature (1)..( 7): Result.001 file - promoters70/1807774
aaagttt

SEQ ID NO: 84935 - DNA, 7 bp, Unknown
  misc_feature (1)..( 7): Result.001 file - promoters70/1807774
aaatttt

SEQ ID NO: 84936 - DNA, 7 bp, Unknown
  misc_feature (1)..( 7): Result.001 file - promoters70/1807774
aaattta

SEQ ID NO: 84937 - DNA, 8 bp, Unknown
  misc_feature (1)..( 8): Result.001 file - promoters70/1807774
atatcaac

SEQ ID NO: 84938 - DNA, 8 bp, Unknown
  misc_feature (1)..( 8): Result.001 file - promoters70/1807774
ataccaac

SEQ ID NO: 84939 - DNA, 8 bp, Unknown
  misc_feature (1)..( 8): Result.001 file - promoters70/1807774
ttacaaac

SEQ ID NO: 84940 - DNA, 10 bp, Unknown
  misc_feature (1)..( 10): Result.001 file - promoters70/1807774
ttttggaaat

SEQ ID NO: 84941 - DNA, 10 bp, Unknown
  misc_feature (1)..( 10): Result.001 file - promoters70/1807774
ttttcgaaag

SEQ ID NO: 84942 - DNA, 10 bp, Unknown
  misc_feature (1)..( 10): Result.001 file - promoters70/1807774
ccaaggaaat

SEQ ID NO: 84943 - DNA, 10 bp, Unknown
  misc_feature (1)..( 10): Result.001 file - promoters70/1807774
taaaaagctc

SEQ ID NO: 84944 - DNA, 10 bp, Unknown
  misc_feature (1)..( 10): Result.001 file - promoters70/1807774
taaaaatttt

SEQ ID NO: 84945 - DNA, 10 bp, Unknown
  misc_feature (1)..( 10): Result.001 file - promoters70/1808137
taacaatttt

SEQ ID NO: 84946 - DNA, 10 bp, Unknown
  misc_feature (1)..( 10): Result.001 file - promoters70/1808137
ggtttatttt

SEQ ID NO: 84947 - DNA, 10 bp, Unknown
  misc_feature (1)..( 10): Result.001 file - promoters70/1808137
ggtttattca

SEQ ID NO: 84948 - DNA, 10 bp, Unknown
  misc_feature (1)..( 10): Result.001 file - promoters70/1808156
attttatttt

SEQ ID NO: 84949 - DNA, 12 bp, Unknown
  misc_feature (1)..( 12): Result.001 file - promoters70/1808156
gtttgtttatct

SEQ ID NO: 84950 - DNA, 12 bp, Unknown
  misc_feature (1)..( 12): Result.001 file - promoters70/1808156
ttttctttggtg

SEQ ID NO: 84951 - DNA, 12 bp, Unknown
  misc_feature (1)..( 12): Result.001 file - promoters70/1808156
gtttttttttct

SEQ ID NO: 84952 - DNA, 10 bp, Unknown
  misc_feature (1)..( 10): Result.001 file - promoters70/1808156
ggtataaaaa

SEQ ID NO: 84953 - DNA, 10 bp, Unknown
  misc_feature (1)..( 10): Result.001 file - promoters70/1808156
tatatcaaaa

SEQ ID NO: 84954 - DNA, 10 bp, Unknown
  misc_feature (1)..( 10): Result.001 file - promoters70/1808156
ggtgtaatga

SEQ ID NO: 84955 - DNA, 7 bp, Unknown
  misc_feature (1)..( 7): Result.001 file - promoters70/1808156
tttaacc

SEQ ID NO: 84956 - DNA, 7 bp, Unknown
  misc_feature (1)..( 7): Result.001 file - promoters70/1808156
tttaaca

SEQ ID NO: 84957 - DNA, 7 bp, Unknown
  misc_feature (1)..( 7): Result.001 file - promoters70/1808156
ttttaca

SEQ ID NO: 84958 - DNA, 11 bp, Unknown
  misc_feature (1)..( 11): Result.001 file - promoters70/1808156
agattttttgt

SEQ ID NO: 84959 - DNA, 11 bp, Unknown
  misc_feature (1)..( 11): Result.001 file - promoters70/1808156
gtattttttgt

SEQ ID NO: 84960 - DNA, 11 bp, Unknown
  misc_feature (1)..( 11): Result.001 file - promoters70/1808156
agattttcatg

SEQ ID NO: 84961 - DNA, 8 bp, Unknown
  misc_feature (1)..( 8): Result.001 file - promoters70/1808156
aatttgaa

SEQ ID NO: 84962 - DNA, 8 bp, Unknown
  misc_feature (1)..( 8): Result.001 file - promoters70/1808156
aatgtgaa

SEQ ID NO: 84963 - DNA, 8 bp, Unknown
  misc_feature (1)..( 8): Result.001 file - promoters70/1808172
aatatgat

SEQ ID NO: 84964 - DNA, 12 bp, Unknown
  misc_feature (1)..( 12): Result.001 file - promoters70/1808172
tattaaccttga

SEQ ID NO: 84965 - DNA, 12 bp, Unknown
  misc_feature (1)..( 12): Result.001 file - promoters70/1808172
aattgaccctga

SEQ ID NO: 84966 - DNA, 12 bp, Unknown
  misc_feature (1)..( 12): Result.001 file - promoters70/1808172
aaataataaagt

SEQ ID NO: 84967 - DNA, 7 bp, Unknown
  misc_feature (1)..( 7): Result.001 file - promoters70/1808172
tctctct

SEQ ID NO: 84968 - DNA, 7 bp, Unknown
  misc_feature (1)..( 7): Result.001 file - promoters70/1808172
tctttct

SEQ ID NO: 84969 - DNA, 7 bp, Unknown
  misc_feature (1)..( 7): Result.001 file - promoters70/1808172
tctttca

SEQ ID NO: 84970 - DNA, 8 bp, Unknown
  misc_feature (1)..( 8): Result.001 file - promoters70/1808172
acaaaatc

SEQ ID NO: 84971 - DNA, 8 bp, Unknown
  misc_feature (1)..( 8): Result.001 file - promoters70/1808172
acaaaaca

SEQ ID NO: 84972 - DNA, 8 bp, Unknown
  misc_feature (1)..( 8): Result.001 file - promoters70/1808172
acaaaaca

SEQ ID NO: 84973 - DNA, 8 bp, Unknown
  misc_feature (1)..( 8): Result.001 file - promoters70/1808172
caactatc

SEQ ID NO: 84974 - DNA, 8 bp, Unknown
  misc_feature (1)..( 8): Result.001 file - promoters70/1808172
caattata

SEQ ID NO: 84975 - DNA, 8 bp, Unknown
  misc_feature (1)..( 8): Result.001 file - promoters70/1808172
aaatcata

SEQ ID NO: 84976 - DNA, 7 bp, Unknown
  misc_feature (1)..( 7): Result.001 file - promoters70/1808172
ctctttc

SEQ ID NO: 84977 - DNA, 7 bp, Unknown
  misc_feature (1)..( 7): Result.001 file - promoters70/1808172
ctctttc

SEQ ID NO: 84978 - DNA, 7 bp, Unknown
  misc_feature (1)..( 7): Result.001 file - promoters70/1808172
ttctttc

SEQ ID NO: 84979 - DNA, 10 bp, Unknown
  misc_feature (1)..( 10): Result.001 file - promoters70/1808172
tatatataga

SEQ ID NO: 84980 - DNA, 10 bp, Unknown
  misc_feature (1)..( 10): Result.001 file - promoters70/1808172
tatatataac

SEQ ID NO: 84981 - DNA, 11 bp, Unknown
  misc_feature (1)..( 11): Result.001 file - promoters70/1808172
gatataataca

SEQ ID NO: 84982 - DNA, 9 bp, Unknown
  misc_feature (1)..( 9): Result.001 file - promoters70/1808172
atattctga

SEQ ID NO: 84983 - DNA, 9 bp, Unknown
  misc_feature (1)..( 9): Result.001 file - promoters70/1808172
aaattttga

SEQ ID NO: 84984 - DNA, 9 bp, Unknown
  misc_feature (1)..( 9): Result.001 file - promoters70/1808172
aaagtttat

SEQ ID NO: 84985 - DNA, 9 bp, Unknown
  misc_feature (1)..( 9): Result.001 file - promoters70/1808172
aatgaaaaa

SEQ ID NO: 84986 - DNA, 9 bp, Unknown
  misc_feature (1)..( 9): Result.001 file - promoters70/1808172
tatgagaaa

SEQ ID NO: 84987 - DNA, 9 bp, Unknown
  misc_feature (1)..( 9): Result.001 file - promoters70/1808172
tataagaaa

SEQ ID NO: 84988 - DNA, 7 bp, Unknown
  misc_feature (1)..( 7): Result.001 file - promoters70/1808172
atgtttt

SEQ ID NO: 84989 - DNA, 7 bp, Unknown
  misc_feature (1)..( 7): Result.001 file - promoters70/1808172
ttgtttt

SEQ ID NO: 84990 - DNA, 7 bp, Unknown
  misc_feature (1)..( 7): Result.001 file - promoters70/1808172
ttgttta

SEQ ID NO: 84991 - DNA, 7 bp, Unknown
  misc_feature (1)..( 7): Result.001 file - promoters70/1808172
attttta

SEQ ID NO: 84992 - DNA, 7 bp, Unknown
  misc_feature (1)..( 7): Result.001 file - promoters70/1808172
atttttt

SEQ ID NO: 84993 - DNA, 7 bp, Unknown
  misc_feature (1)..( 7): Result.001 file - promoters70/1808172
attttta

SEQ ID NO: 84994 - DNA, 9 bp, Unknown
  misc_feature (1)..( 9): Result.001 file - promoters70/1808172
agtcaactt

SEQ ID NO: 84995 - DNA, 9 bp, Unknown
  misc_feature (1)..( 9): Result.001 file - promoters70/1808172
agttaactt

SEQ ID NO: 84996 - DNA, 9 bp, Unknown
  misc_feature (1)..( 9): Result.001 file - promoters70/1808184
aattaactt

SEQ ID NO: 84997 - DNA, 9 bp, Unknown
  misc_feature (1)..( 9): Result.001 file - promoters70/1808184
tctttgtaa

SEQ ID NO: 84998 - DNA, 9 bp, Unknown
  misc_feature (1)..( 9): Result.001 file - promoters70/1808184
tctttataa

SEQ ID NO: 84999 - DNA, 9 bp, Unknown
  misc_feature (1)..( 9): Result.001 file - promoters70/1808184
acattataa

SEQ ID NO: 85000 - DNA, 10 bp, Unknown
  misc_feature (1)..( 10): Result.001 file - promoters70/1808184
tttgacagac

SEQ ID NO: 85001 - DNA, 10 bp, Unknown
  misc_feature (1)..( 10): Result.001 file - promoters70/1808184
tttaacaaga

SEQ ID NO: 85002 - DNA, 10 bp, Unknown
  misc_feature (1)..( 10): Result.001 file - promoters70/1808184
actaacaaga

SEQ ID NO: 85003 - DNA, 8 bp, Unknown
  misc_feature (1)..( 8): Result.001 file - promoters70/1808184
attttcaa

SEQ ID NO: 85004 - DNA, 8 bp, Unknown
  misc_feature (1)..( 8): Result.001 file - promoters70/1808184
atttacaa

SEQ ID NO: 85005 - DNA, 8 bp, Unknown
  misc_feature (1)..( 8): Result.001 file - promoters70/1808184
ttttacat

SEQ ID NO: 85006 - DNA, 10 bp, Unknown
  misc_feature (1)..( 10): Result.001 file - promoters70/1808184
agatatttaa

SEQ ID NO: 85007 - DNA, 10 bp, Unknown
  misc_feature (1)..( 10): Result.001 file - promoters70/1808184
agataattaa

SEQ ID NO: 85008 - DNA, 10 bp, Unknown
  misc_feature (1)..( 10): Result.001 file - promoters70/1809222
agagaatttt

SEQ ID NO: 85009 - DNA, 10 bp, Unknown
  misc_feature (1)..( 10): Result.001 file - promoters70/1809222
tgaaatatat

SEQ ID NO: 85010 - DNA, 10 bp, Unknown
  misc_feature (1)..( 10): Result.001 file - promoters70/1809222
attaatttat

SEQ ID NO: 85011 - DNA, 10 bp, Unknown
  misc_feature (1)..( 10): Result.001 file - promoters70/1957018
attactttgg

SEQ ID NO: 85012 - DNA, 8 bp, Unknown
  misc_feature (1)..( 8): Result.001 file - promoters70/1957018
atttttaa

SEQ ID NO: 85013 - DNA, 8 bp, Unknown
  misc_feature (1)..( 8): Result.001 file - promoters70/1957018
ctttttaa

SEQ ID NO: 85014 - DNA, 8 bp, Unknown
  misc_feature (1)..( 8): Result.001 file - promoters70/1957018
ctttttga

SEQ ID NO: 85015 - DNA, 9 bp, Unknown
  misc_feature (1)..( 9): Result.001 file - promoters70/1957018
gtttttttt

SEQ ID NO: 85016 - DNA, 9 bp, Unknown
  misc_feature (1)..( 9): Result.001 file - promoters70/1957018
gttcttttt

SEQ ID NO: 85017 - DNA, 9 bp, Unknown
  misc_feature (1)..( 9): Result.001 file - promoters70/1957018
atgcttttt

SEQ ID NO: 85018 - DNA, 9 bp, Unknown
  misc_feature (1)..( 9): Result.001 file - promoters70/1957018
aaagatttt

SEQ ID NO: 85019 - DNA, 9 bp, Unknown
  misc_feature (1)..( 9): Result.001 file - promoters70/1957018
tgagatttt

SEQ ID NO: 85020 - DNA, 9 bp, Unknown
  misc_feature (1)..( 9): Result.001 file - promoters70/1957018
aaagattgt

SEQ ID NO: 85021 - DNA, 9 bp, Unknown
  misc_feature (1)..( 9): Result.001 file - promoters70/1957018
ttgtaaaga

SEQ ID NO: 85022 - DNA, 9 bp, Unknown
  misc_feature (1)..( 9): Result.001 file - promoters70/1957018
cagtagaga

SEQ ID NO: 85023 - DNA, 9 bp, Unknown
  misc_feature (1)..( 9): Result.001 file - promoters70/1957018
cagttgaga

SEQ ID NO: 85024 - DNA, 10 bp, Unknown
  misc_feature (1)..( 10): Result.001 file - promoters70/1957018
cgtggacaga

SEQ ID NO: 85025 - DNA, 10 bp, Unknown
  misc_feature (1)..( 10): Result.001 file - promoters70/1957018
tatggataga

SEQ ID NO: 85026 - DNA, 10 bp, Unknown
  misc_feature (1)..( 10): Result.001 file - promoters70/1957212
tatggataaa

SEQ ID NO: 85027 - DNA, 9 bp, Unknown
  misc_feature (1)..( 9): Result.001 file - promoters70/1957212
gattcttac

SEQ ID NO: 85028 - DNA, 9 bp, Unknown
  misc_feature (1)..( 9): Result.001 file - promoters70/1957212
gattctttg

SEQ ID NO: 85029 - DNA, 9 bp, Unknown
  misc_feature (1)..( 9): Result.001 file - promoters70/1957212
cattcgtac

SEQ ID NO: 85030 - DNA, 9 bp, Unknown
  misc_feature (1)..( 9): Result.001 file - promoters70/1957212
tatttaaac

SEQ ID NO: 85031 - DNA, 9 bp, Unknown
  misc_feature (1)..( 9): Result.001 file - promoters70/1957212
tatttaaaa

SEQ ID NO: 85032 - DNA, 9 bp, Unknown
  misc_feature (1)..( 9): Result.001 file - promoters70/1957212
aattgaaac

SEQ ID NO: 85033 - DNA, 8 bp, Unknown
  misc_feature (1)..( 8): Result.001 file - promoters70/1957212
cgagaaac

SEQ ID NO: 85034 - DNA, 8 bp, Unknown
  misc_feature (1)..( 8): Result.001 file - promoters70/1957212
ggagaaag

SEQ ID NO: 85035 - DNA, 8 bp, Unknown
  misc_feature (1)..( 8): Result.001 file - promoters70/1975923
agagagat

SEQ ID NO: 85036 - DNA, 9 bp, Unknown
  misc_feature (1)..( 9): Result.001 file - promoters70/1975923
aaaatatat

SEQ ID NO: 85037 - DNA, 9 bp, Unknown
  misc_feature (1)..( 9): Result.001 file - promoters70/1975923
taaatatca

SEQ ID NO: 85038 - DNA, 9 bp, Unknown
  misc_feature (1)..( 9): Result.001 file - promoters70/1975923
aaaatattg

SEQ ID NO: 85039 - DNA, 9 bp, Unknown
  misc_feature (1)..( 9): Result.001 file - promoters70/1975923
caaatctca

SEQ ID NO: 85040 - DNA, 9 bp, Unknown
  misc_feature (1)..( 9): Result.001 file - promoters70/1975923
agcatctca

SEQ ID NO: 85041 - DNA, 10 bp, Unknown
  misc_feature (1)..( 10): Result.001 file - promoters70/1975923
ttaataaaat

SEQ ID NO: 85042 - DNA, 10 bp, Unknown
  misc_feature (1)..( 10): Result.001 file - promoters70/1975923
ttaatacaat

SEQ ID NO: 85043 - DNA, 10 bp, Unknown
  misc_feature (1)..( 10): Result.001 file - promoters70/1975923
aaaataaatt

SEQ ID NO: 85044 - DNA, 10 bp, Unknown
  misc_feature (1)..( 10): Result.001 file - promoters70/1975923
ataaaaaatt

SEQ ID NO: 85045 - DNA, 10 bp, Unknown
  misc_feature (1)..( 10): Result.001 file - promoters70/1975923
tcaatacaag

SEQ ID NO: 85046 - DNA, 11 bp, Unknown
  misc_feature (1)..( 11): Result.001 file - promoters70/1975923
aaaagaaatta

SEQ ID NO: 85047 - DNA, 11 bp, Unknown
  misc_feature (1)..( 11): Result.001 file - promoters70/1975923
taaataaacct

SEQ ID NO: 85048 - DNA, 11 bp, Unknown
  misc_feature (1)..( 11): Result.001 file - promoters70/1975923
attataaacta

SEQ ID NO: 85049 - DNA, 11 bp, Unknown
  misc_feature (1)..( 11): Result.001 file - promoters70/1975923
aatataaagcc

SEQ ID NO: 85050 - DNA, 11 bp, Unknown
  misc_feature (1)..( 11): Result.001 file - promoters70/1976000
taaacaaattt

SEQ ID NO: 85051 - DNA, 9 bp, Unknown
  misc_feature (1)..( 9): Result.001 file - promoters70/1976000
aaaacacga

SEQ ID NO: 85052 - DNA, 9 bp, Unknown
  misc_feature (1)..( 9): Result.001 file - promoters70/1976000
aaaacaatt

SEQ ID NO: 85053 - DNA, 9 bp, Unknown
  misc_feature (1)..( 9): Result.001 file - promoters70/1976019
caaacgatt

SEQ ID NO: 85054 - DNA, 11 bp, Unknown
  misc_feature (1)..( 11): Result.001 file - promoters70/1976019
aatcactcctt

SEQ ID NO: 85055 - DNA, 11 bp, Unknown
  misc_feature (1)..( 11): Result.001 file - promoters70/1976019
tttcattcctt

SEQ ID NO: 85056 - DNA, 11 bp, Unknown
  misc_feature (1)..( 11): Result.001 file - promoters70/1976019
aaaaacttctt

SEQ ID NO: 85057 - DNA, 11 bp, Unknown
  misc_feature (1)..( 11): Result.001 file - promoters70/1976019
tttgattagta

SEQ ID NO: 85058 - DNA, 7 bp, Unknown
  misc_feature (1)..( 7): Result.001 file - promoters70/1976019
ataaaaa

SEQ ID NO: 85059 - DNA, 7 bp, Unknown
  misc_feature (1)..( 7): Result.001 file - promoters70/1976019
ataaaat

SEQ ID NO: 85060 - DNA, 7 bp, Unknown
  misc_feature (1)..( 7): Result.001 file - promoters70/1976019
ataaaaa

SEQ ID NO: 85061 - DNA, 7 bp, Unknown
  misc_feature (1)..( 7): Result.001 file - promoters70/1976019
ataaaaa

SEQ ID NO: 85062 - DNA, 8 bp, Unknown
  misc_feature (1)..( 8): Result.001 file - promoters70/1976019
taaaaaaa

SEQ ID NO: 85063 - DNA, 8 bp, Unknown
  misc_feature (1)..( 8): Result.001 file - promoters70/1976019
gaaaaaaa

SEQ ID NO: 85064 - DNA, 9 bp, Unknown
  misc_feature (1)..( 9): Result.001 file - promoters70/1976019
aaaagaaaa

SEQ ID NO: 85065 - DNA, 9 bp, Unknown
  misc_feature (1)..( 9): Result.001 file - promoters70/1976078
taacagaat

SEQ ID NO: 85066 - DNA, 10 bp, Unknown
  misc_feature (1)..( 10): Result.001 file - promoters70/1976078
ctagatacaa

SEQ ID NO: 85067 - DNA, 10 bp, Unknown
  misc_feature (1)..( 10): Result.001 file - promoters70/1976078
acagagacat

SEQ ID NO: 85068 - DNA, 10 bp, Unknown
  misc_feature (1)..( 10): Result.001 file - promoters70/1976078
ctagatacag

SEQ ID NO: 85069 - DNA, 10 bp, Unknown
  misc_feature (1)..( 10): Result.001 file - promoters70/1976078
tccgatccag

SEQ ID NO: 85070 - DNA, 13 bp, Unknown
  misc_feature (1)..( 13): Result.001 file - promoters70/1976078
aaatcgaaacaga

SEQ ID NO: 85071 - DNA, 13 bp, Unknown
  misc_feature (1)..( 13): Result.001 file - promoters70/1976078
aaatccaaaccca

SEQ ID NO: 85072 - DNA, 13 bp, Unknown
  misc_feature (1)..( 13): Result.001 file - promoters70/1976078
aaagtcaaacctg

SEQ ID NO: 85073 - DNA, 13 bp, Unknown
  misc_feature (1)..( 13): Result.001 file - promoters70/1976078
attgagaaagctg

SEQ ID NO: 85074 - DNA, 8 bp, Unknown
  misc_feature (1)..( 8): Result.001 file - promoters70/1976078
actttttt

SEQ ID NO: 85075 - DNA, 8 bp, Unknown
  misc_feature (1)..( 8): Result.001 file - promoters70/1976078
actattta

SEQ ID NO: 85076 - DNA, 9 bp, Unknown
  misc_feature (1)..( 9): Result.001 file - promoters70/1976078
gttttgttg

SEQ ID NO: 85077 - DNA, 9 bp, Unknown
  misc_feature (1)..( 9): Result.001 file - promoters70/1976078
attgatttg

SEQ ID NO: 85078 - DNA, 9 bp, Unknown
  misc_feature (1)..( 9): Result.001 file - promoters70/1976078
catgaattg

SEQ ID NO: 85079 - DNA, 9 bp, Unknown
  misc_feature (1)..( 9): Result.001 file - promoters70/1976078
attgattca

SEQ ID NO: 85080 - DNA, 9 bp, Unknown
  misc_feature (1)..( 9): Result.001 file - promoters70/1976078
tttaaagct

SEQ ID NO: 85081 - DNA, 9 bp, Unknown
  misc_feature (1)..( 9): Result.001 file - promoters70/1976078
tttcaagtt

SEQ ID NO: 85082 - DNA, 9 bp, Unknown
  misc_feature (1)..( 9): Result.001 file - promoters70/1976333
tctcacgtt

SEQ ID NO: 85083 - DNA, 18 bp, Unknown
  misc_feature (1)..( 18): Result.001 file - promoters70/1976333
gatcaagattcaatattt

SEQ ID NO: 85084 - DNA, 18 bp, Unknown
  misc_feature (1)..( 18): Result.001 file - promoters70/1976333
acgttagactcaattaaa

SEQ ID NO: 85085 - DNA, 18 bp, Unknown
  misc_feature (1)..( 18): Result.001 file - promoters70/1976387
gataaagagtcaaaattt

SEQ ID NO: 85086 - DNA, 15 bp, Unknown
  misc_feature (1)..( 15): Result.001 file - promoters70/1976387
ctaaaggcccaataa

SEQ ID NO: 85087 - DNA, 15 bp, Unknown
  misc_feature (1)..( 15): Result.001 file - promoters70/1976387
ggaatggcccagtaa

SEQ ID NO: 85088 - DNA, 15 bp, Unknown
  misc_feature (1)..( 15): Result.001 file - promoters70/1976387
gtgaaagcccaaaac

SEQ ID NO: 85089 - DNA, 15 bp, Unknown
  misc_feature (1)..( 15): Result.001 file - promoters70/1976387
ctaaaggcccaattt

SEQ ID NO: 85090 - DNA, 7 bp, Unknown
  misc_feature (1)..( 7): Result.001 file - promoters70/1976387
tatcaat

SEQ ID NO: 85091 - DNA, 7 bp, Unknown
  misc_feature (1)..( 7): Result.001 file - promoters70/1976387
tatcaaa

SEQ ID NO: 85092 - DNA, 7 bp, Unknown
  misc_feature (1)..( 7): Result.001 file - promoters70/1976387
tatgaaa

SEQ ID NO: 85093 - DNA, 12 bp, Unknown
  misc_feature (1)..( 12): Result.001 file - promoters70/1976387
tttattttagat

SEQ ID NO: 85094 - DNA, 12 bp, Unknown
  misc_feature (1)..( 12): Result.001 file - promoters70/1976387
tgaatttgagat

SEQ ID NO: 85095 - DNA, 12 bp, Unknown
  misc_feature (1)..( 12): Result.001 file - promoters70/1976457
gaaattgcgcca

SEQ ID NO: 85096 - DNA, 11 bp, Unknown
  misc_feature (1)..( 11): Result.001 file - promoters70/1976457
tatataataaa

SEQ ID NO: 85097 - DNA, 11 bp, Unknown
  misc_feature (1)..( 11): Result.001 file - promoters70/1976457
tttgtaataat

SEQ ID NO: 85098 - DNA, 11 bp, Unknown
  misc_feature (1)..( 11): Result.001 file - promoters70/1976457
tgaatactaaa

SEQ ID NO: 85099 - DNA, 11 bp, Unknown
  misc_feature (1)..( 11): Result.001 file - promoters70/1976457
tacataataat

SEQ ID NO: 85100 - DNA, 11 bp, Unknown
  misc_feature (1)..( 11): Result.001 file - promoters70/1976457
ctattaataaa

SEQ ID NO: 85101 - DNA, 11 bp, Unknown
  misc_feature (1)..( 11): Result.001 file - promoters70/1976457
tttttaatata

SEQ ID NO: 85102 - DNA, 11 bp, Unknown
  misc_feature (1)..( 11): Result.001 file - promoters70/1976457
agaataaaaat

SEQ ID NO: 85103 - DNA, 16 bp, Unknown
  misc_feature (1)..( 16): Result.001 file - promoters70/1976457
gtaagaaaaaaaaaaa

SEQ ID NO: 85104 - DNA, 16 bp, Unknown
  misc_feature (1)..( 16): Result.001 file - promoters70/1976457
tctataaaaaatatcg

SEQ ID NO: 85105 - DNA, 16 bp, Unknown
  misc_feature (1)..( 16): Result.001 file - promoters70/1976457
gttccaaaaacaaaaa

SEQ ID NO: 85106 - DNA, 16 bp, Unknown
  misc_feature (1)..( 16): Result.001 file - promoters70/1976457
agaataaaaattgatt

SEQ ID NO: 85107 - DNA, 16 bp, Unknown
  misc_feature (1)..( 16): Result.001 file - promoters70/1976457
tacataataatgtttt

SEQ ID NO: 85108 - DNA, 16 bp, Unknown
  misc_feature (1)..( 16): Result.001 file - promoters70/1976496
aacataaattgtggat

SEQ ID NO: 85109 - DNA, 12 bp, Unknown
  misc_feature (1)..( 12): Result.001 file - promoters70/1976496
agcaaagaattg

SEQ ID NO: 85110 - DNA, 12 bp, Unknown
  misc_feature (1)..( 12): Result.001 file - promoters70/1976496
gctgctgaattg

SEQ ID NO: 85111 - DNA, 12 bp, Unknown
  misc_feature (1)..( 12): Result.001 file - promoters70/1976496
tcttatgatttg

SEQ ID NO: 85112 - DNA, 12 bp, Unknown
  misc_feature (1)..( 12): Result.001 file - promoters70/1976496
ctcgtataattc

SEQ ID NO: 85113 - DNA, 12 bp, Unknown
  misc_feature (1)..( 12): Result.001 file - promoters70/1976496
gtctatgctttg

SEQ ID NO: 85114 - DNA, 12 bp, Unknown
  misc_feature (1)..( 12): Result.001 file - promoters70/1976496
ttaaactaattc

SEQ ID NO: 85115 - DNA, 12 bp, Unknown
  misc_feature (1)..( 12): Result.001 file - promoters70/1976496
ttaatcttttgg

SEQ ID NO: 85116 - DNA, 12 bp, Unknown
  misc_feature (1)..( 12): Result.001 file - promoters70/1976496
aatttcttttca

SEQ ID NO: 85117 - DNA, 12 bp, Unknown
  misc_feature (1)..( 12): Result.001 file - promoters70/1976496
taactcttttga

SEQ ID NO: 85118 - DNA, 12 bp, Unknown
  misc_feature (1)..( 12): Result.001 file - promoters70/1976496
ttaacctttgac

SEQ ID NO: 85119 - DNA, 12 bp, Unknown
  misc_feature (1)..( 12): Result.001 file - promoters70/1976496
aaactcttttga

SEQ ID NO: 85120 - DNA, 12 bp, Unknown
  misc_feature (1)..( 12): Result.001 file - promoters70/2026771
gagtggttttga

SEQ ID NO: 85121 - DNA, 7 bp, Unknown
  misc_feature (1)..( 7): Result.001 file - promoters70/2026771
aaataaa

SEQ ID NO: 85122 - DNA, 7 bp, Unknown
  misc_feature (1)..( 7): Result.001 file - promoters70/2026771
aaataaa

SEQ ID NO: 85123 - DNA, 8 bp, Unknown
  misc_feature (1)..( 8): Result.001 file - promoters70/2029031
aaattaaa

SEQ ID NO: 85124 - DNA, 9 bp, Unknown
  misc_feature (1)..( 9): Result.001 file - promoters70/2029031
ataataaac

SEQ ID NO: 85125 - DNA, 9 bp, Unknown
  misc_feature (1)..( 9): Result.001 file - promoters70/2029031
gtaataata

SEQ ID NO: 85126 - DNA, 9 bp, Unknown
  misc_feature (1)..( 9): Result.001 file - promoters70/2029031
taaataaaa

SEQ ID NO: 85127 - DNA, 9 bp, Unknown
  misc_feature (1)..( 9): Result.001 file - promoters70/2029031
ttaaaaaag

SEQ ID NO: 85128 - DNA, 9 bp, Unknown
  misc_feature (1)..( 9): Result.001 file - promoters70/2029031
ataataatg

SEQ ID NO: 85129 - DNA, 9 bp, Unknown
  misc_feature (1)..( 9): Result.001 file - promoters70/2029031
ttaataaaa

SEQ ID NO: 85130 - DNA, 9 bp, Unknown
  misc_feature (1)..( 9): Result.001 file - promoters70/2029031
ttaacaaaa

SEQ ID NO: 85131 - DNA, 14 bp, Unknown
  misc_feature (1)..( 14): Result.001 file - promoters70/2029031
aactcttttgagaa

SEQ ID NO: 85132 - DNA, 14 bp, Unknown
  misc_feature (1)..( 14): Result.001 file - promoters70/2029031
aactcttttgaagt

SEQ ID NO: 85133 - DNA, 14 bp, Unknown
  misc_feature (1)..( 14): Result.001 file - promoters70/2029031
tactatttatacat

SEQ ID NO: 85134 - DNA, 14 bp, Unknown
  misc_feature (1)..( 14): Result.001 file - promoters70/2029031
gcctattaataaaa

SEQ ID NO: 85135 - DNA, 14 bp, Unknown
  misc_feature (1)..( 14): Result.001 file - promoters70/2029031
taaaattaataacc

SEQ ID NO: 85136 - DNA, 14 bp, Unknown
  misc_feature (1)..( 14): Result.001 file - promoters70/2029033
tacttttaacaaaa

SEQ ID NO: 85137 - DNA, 12 bp, Unknown
  misc_feature (1)..( 12): Result.001 file - promoters70/2029033
gattctttccta

SEQ ID NO: 85138 - DNA, 12 bp, Unknown
  misc_feature (1)..( 12): Result.001 file - promoters70/2029033
atttatttcctt

SEQ ID NO: 85139 - DNA, 12 bp, Unknown
  misc_feature (1)..( 12): Result.001 file - promoters70/2029033
atttatttactt

SEQ ID NO: 85140 - DNA, 8 bp, Unknown
  misc_feature (1)..( 8): Result.001 file - promoters70/2029033
tattctaa

SEQ ID NO: 85141 - DNA, 8 bp, Unknown
  misc_feature (1)..( 8): Result.001 file - promoters70/2029033
tattctat

SEQ ID NO: 85142 - DNA, 8 bp, Unknown
  misc_feature (1)..( 8): Result.001 file - promoters70/2029033
ctttctat

SEQ ID NO: 85143 - DNA, 7 bp, Unknown
  misc_feature (1)..( 7): Result.001 file - promoters70/2029033
attctat

SEQ ID NO: 85144 - DNA, 7 bp, Unknown
  misc_feature (1)..( 7): Result.001 file - promoters70/2029033
tttctat

SEQ ID NO: 85145 - DNA, 7 bp, Unknown
  misc_feature (1)..( 7): Result.001 file - promoters70/2029079
tttttat

SEQ ID NO: 85146 - DNA, 12 bp, Unknown
  misc_feature (1)..( 12): Result.001 file - promoters70/2029079
tcagaattaata

SEQ ID NO: 85147 - DNA, 12 bp, Unknown
  misc_feature (1)..( 12): Result.001 file - promoters70/2029079
tcataattaata

SEQ ID NO: 85148 - DNA, 12 bp, Unknown
  misc_feature (1)..( 12): Result.001 file - promoters70/2029079
catttattaaca

SEQ ID NO: 85149 - DNA, 8 bp, Unknown
  misc_feature (1)..( 8): Result.001 file - promoters70/2029079
ccaaattt

SEQ ID NO: 85150 - DNA, 8 bp, Unknown
  misc_feature (1)..( 8): Result.001 file - promoters70/2029079
ccaatttt

SEQ ID NO: 85151 - DNA, 8 bp, Unknown
  misc_feature (1)..( 8): Result.001 file - promoters70/2104991
ataatttt

SEQ ID NO: 85152 - DNA, 8 bp, Unknown
  misc_feature (1)..( 8): Result.001 file - promoters70/2104991
tcatttca

SEQ ID NO: 85153 - DNA, 8 bp, Unknown
  misc_feature (1)..( 8): Result.001 file - promoters70/2104991
aaatttca

SEQ ID NO: 85154 - DNA, 8 bp, Unknown
  misc_feature (1)..( 8): Result.001 file - promoters70/2104991
aaatttcc

SEQ ID NO: 85155 - DNA, 8 bp, Unknown
  misc_feature (1)..( 8): Result.001 file - promoters70/2104991
taaatctc

SEQ ID NO: 85156 - DNA, 8 bp, Unknown
  misc_feature (1)..( 8): Result.001 file - promoters70/2104991
taaatcag

SEQ ID NO: 85157 - DNA, 8 bp, Unknown
  misc_feature (1)..( 8): Result.001 file - promoters70/2104991
caaaacag

SEQ ID NO: 85158 - DNA, 14 bp, Unknown
  misc_feature (1)..( 14): Result.001 file - promoters70/2104991
aaaaagcttggatt

SEQ ID NO: 85159 - DNA, 14 bp, Unknown
  misc_feature (1)..( 14): Result.001 file - promoters70/2104991
taaaagtttgatat

SEQ ID NO: 85160 - DNA, 14 bp, Unknown
  misc_feature (1)..( 14): Result.001 file - promoters70/2104991
taaaagtttgttat

SEQ ID NO: 85161 - DNA, 14 bp, Unknown
  misc_feature (1)..( 14): Result.001 file - promoters70/2104991
ttggattttgattt

SEQ ID NO: 85162 - DNA, 14 bp, Unknown
  misc_feature (1)..( 14): Result.001 file - promoters70/2104991
taaaagtttgatat

SEQ ID NO: 85163 - DNA, 14 bp, Unknown
  misc_feature (1)..( 14): Result.001 file - promoters70/2105398
taaaagtttgttat

SEQ ID NO: 85164 - DNA, 10 bp, Unknown
  misc_feature (1)..( 10): Result.001 file - promoters70/2105398
taatacatct

SEQ ID NO: 85165 - DNA, 10 bp, Unknown
  misc_feature (1)..( 10): Result.001 file - promoters70/2105398
aaatacattt

SEQ ID NO: 85166 - DNA, 10 bp, Unknown
  misc_feature (1)..( 10): Result.001 file - promoters70/2105398
aaagacaagt

SEQ ID NO: 85167 - DNA, 10 bp, Unknown
  misc_feature (1)..( 10): Result.001 file - promoters70/2105514
gtgtaccttt

SEQ ID NO: 85168 - DNA, 13 bp, Unknown
  misc_feature (1)..( 13): Result.001 file - promoters70/2105514
tctcgtataattc

SEQ ID NO: 85169 - DNA, 13 bp, Unknown
  misc_feature (1)..( 13): Result.001 file - promoters70/2105514
actcttatgattt

SEQ ID NO: 85170 - DNA, 13 bp, Unknown
  misc_feature (1)..( 13): Result.001 file - promoters70/2105514
tctcttgtaatga

SEQ ID NO: 85171 - DNA, 13 bp, Unknown
  misc_feature (1)..( 13): Result.001 file - promoters70/2105514
acttccatgtttt

SEQ ID NO: 85172 - DNA, 13 bp, Unknown
  misc_feature (1)..( 13): Result.001 file - promoters70/2105514
tctctactcttgg

SEQ ID NO: 85173 - DNA, 13 bp, Unknown
  misc_feature (1)..( 13): Result.001 file - promoters70/2105514
tctcttaaaagtc

SEQ ID NO: 85174 - DNA, 10 bp, Unknown
  misc_feature (1)..( 10): Result.001 file - promoters70/2105514
aaaagttttt

SEQ ID NO: 85175 - DNA, 10 bp, Unknown
  misc_feature (1)..( 10): Result.001 file - promoters70/2105514
tttagttttg

SEQ ID NO: 85176 - DNA, 10 bp, Unknown
  misc_feature (1)..( 10): Result.001 file - promoters70/2105514
gaaaatttca

SEQ ID NO: 85177 - DNA, 11 bp, Unknown
  misc_feature (1)..( 11): Result.001 file - promoters70/2105514
gtttgttgttg

SEQ ID NO: 85178 - DNA, 11 bp, Unknown
  misc_feature (1)..( 11): Result.001 file - promoters70/2105514
acaagtttcct

SEQ ID NO: 85179 - DNA, 11 bp, Unknown
  misc_feature (1)..( 11): Result.001 file - promoters70/2105514
aaaagtgttga

SEQ ID NO: 85180 - DNA, 11 bp, Unknown
  misc_feature (1)..( 11): Result.001 file - promoters70/2105514
tttacttttaa

SEQ ID NO: 85181 - DNA, 12 bp, Unknown
  misc_feature (1)..( 12): Result.001 file - promoters70/2105514
tattaaagccgc

SEQ ID NO: 85182 - DNA, 12 bp, Unknown
  misc_feature (1)..( 12): Result.001 file - promoters70/2105514
tataaaagcaat

SEQ ID NO: 85183 - DNA, 13 bp, Unknown
  misc_feature (1)..( 13): Result.001 file - promoters70/2105514
tatataaagacgc

SEQ ID NO: 85184 - DNA, 13 bp, Unknown
  misc_feature (1)..( 13): Result.001 file - promoters70/2105514
tatataaatcctt

SEQ ID NO: 85185 - DNA, 13 bp, Unknown
  misc_feature (1)..( 13): Result.001 file - promoters70/2105514
tatataagtatcg

SEQ ID NO: 85186 - DNA, 13 bp, Unknown
  misc_feature (1)..( 13): Result.001 file - promoters70/2105535
tttatgaatccat

SEQ ID NO: 85187 - DNA, 11 bp, Unknown
  misc_feature (1)..( 11): Result.001 file - promoters70/2105535
tatcaaacaaa

SEQ ID NO: 85188 - DNA, 11 bp, Unknown
  misc_feature (1)..( 11): Result.001 file - promoters70/2105535
aaccaaagaaa

SEQ ID NO: 85189 - DNA, 11 bp, Unknown
  misc_feature (1)..( 11): Result.001 file - promoters70/2105535
caccaaagcac

SEQ ID NO: 85190 - DNA, 11 bp, Unknown
  misc_feature (1)..( 11): Result.001 file - promoters70/2105535
tgtcaaataaa

SEQ ID NO: 85191 - DNA, 11 bp, Unknown
  misc_feature (1)..( 11): Result.001 file - promoters70/2105535
tgtcaaatttg

SEQ ID NO: 85192 - DNA, 11 bp, Unknown
  misc_feature (1)..( 11): Result.001 file - promoters70/2105535
ggttatagatt

SEQ ID NO: 85193 - DNA, 9 bp, Unknown
  misc_feature (1)..( 9): Result.001 file - promoters70/2105535
taaacaaaa

SEQ ID NO: 85194 - DNA, 9 bp, Unknown
  misc_feature (1)..( 9): Result.001 file - promoters70/2105535
aaaataaaa

SEQ ID NO: 85195 - DNA, 9 bp, Unknown
  misc_feature (1)..( 9): Result.001 file - promoters70/2105535
caaataaat

SEQ ID NO: 85196 - DNA, 9 bp, Unknown
  misc_feature (1)..( 9): Result.001 file - promoters70/2105535
caaagaaag

SEQ ID NO: 85197 - DNA, 9 bp, Unknown
  misc_feature (1)..( 9): Result.001 file - promoters70/2105535
gatacaatg

SEQ ID NO: 85198 - DNA, 9 bp, Unknown
  misc_feature (1)..( 9): Result.001 file - promoters70/2105535
tatagattt

SEQ ID NO: 85199 - DNA, 11 bp, Unknown
  misc_feature (1)..( 11): Result.001 file - promoters70/2105535
cttttaagtat

SEQ ID NO: 85200 - DNA, 11 bp, Unknown
  misc_feature (1)..( 11): Result.001 file - promoters70/2105535
gtgttatgtac

SEQ ID NO: 85201 - DNA, 11 bp, Unknown
  misc_feature (1)..( 11): Result.001 file - promoters70/2105535
gtaatatgtat

SEQ ID NO: 85202 - DNA, 11 bp, Unknown
  misc_feature (1)..( 11): Result.001 file - promoters70/2105535
tctatatatac

SEQ ID NO: 85203 - DNA, 11 bp, Unknown
  misc_feature (1)..( 11): Result.001 file - promoters70/2105535
aatttgttctt

SEQ ID NO: 85204 - DNA, 11 bp, Unknown
  misc_feature (1)..( 11): Result.001 file - promoters70/2106017
ccattaacttt

SEQ ID NO: 85205 - DNA, 7 bp, Unknown
  misc_feature (1)..( 7): Result.001 file - promoters70/2106017
gaactaa

SEQ ID NO: 85206 - DNA, 7 bp, Unknown
  misc_feature (1)..( 7): Result.001 file - promoters70/2106017
caactaa

SEQ ID NO: 85207 - DNA, 7 bp, Unknown
  misc_feature (1)..( 7): Result.001 file - promoters70/2106017
caactac

SEQ ID NO: 85208 - DNA, 8 bp, Unknown
  misc_feature (1)..( 8): Result.001 file - promoters70/2106017
taaagttt

SEQ ID NO: 85209 - DNA, 8 bp, Unknown
  misc_feature (1)..( 8): Result.001 file - promoters70/2106017
aaaacttt

SEQ ID NO: 85210 - DNA, 8 bp, Unknown
  misc_feature (1)..( 8): Result.001 file - promoters70/2113502
aaaacttt

SEQ ID NO: 85211 - DNA, 11 bp, Unknown
  misc_feature (1)..( 11): Result.001 file - promoters70/2113502
ccaataaaaag

SEQ ID NO: 85212 - DNA, 11 bp, Unknown
  misc_feature (1)..( 11): Result.001 file - promoters70/2113502
actataaaact

SEQ ID NO: 85213 - DNA, 11 bp, Unknown
  misc_feature (1)..( 11): Result.001 file - promoters70/2113502
tatataaatcc

SEQ ID NO: 85214 - DNA, 11 bp, Unknown
  misc_feature (1)..( 11): Result.001 file - promoters70/2113502
actattaaagc

SEQ ID NO: 85215 - DNA, 11 bp, Unknown
  misc_feature (1)..( 11): Result.001 file - promoters70/2113502
tttataaactc

SEQ ID NO: 85216 - DNA, 11 bp, Unknown
  misc_feature (1)..( 11): Result.001 file - promoters70/2113502
tttatgaatcc

SEQ ID NO: 85217 - DNA, 10 bp, Unknown
  misc_feature (1)..( 10): Result.001 file - promoters70/2113502
tattaagaaa

SEQ ID NO: 85218 - DNA, 10 bp, Unknown
  misc_feature (1)..( 10): Result.001 file - promoters70/2113502
cattaataaa

SEQ ID NO: 85219 - DNA, 10 bp, Unknown
  misc_feature (1)..( 10): Result.001 file - promoters70/2113502
tattaaagtt

SEQ ID NO: 85220 - DNA, 10 bp, Unknown
  misc_feature (1)..( 10): Result.001 file - promoters70/2113502
aattaaagac

SEQ ID NO: 85221 - DNA, 10 bp, Unknown
  misc_feature (1)..( 10): Result.001 file - promoters70/2113502
tataactaaa

SEQ ID NO: 85222 - DNA, 10 bp, Unknown
  misc_feature (1)..( 10): Result.001 file - promoters70/2113502
aattaaaaat

SEQ ID NO: 85223 - DNA, 11 bp, Unknown
  misc_feature (1)..( 11): Result.001 file - promoters70/2113502
ataaagcccat

SEQ ID NO: 85224 - DNA, 11 bp, Unknown
  misc_feature (1)..( 11): Result.001 file - promoters70/2113502
aaaaggcccat

SEQ ID NO: 85225 - DNA, 11 bp, Unknown
  misc_feature (1)..( 11): Result.001 file - promoters70/2113502
aaatagcccaa

SEQ ID NO: 85226 - DNA, 11 bp, Unknown
  misc_feature (1)..( 11): Result.001 file - promoters70/2113502
aaaaggcccat

SEQ ID NO: 85227 - DNA, 11 bp, Unknown
  misc_feature (1)..( 11): Result.001 file - promoters70/2113502
taaaggcccaa

SEQ ID NO: 85228 - DNA, 11 bp, Unknown
  misc_feature (1)..( 11): Result.001 file - promoters70/2113502
caaaagcccta

SEQ ID NO: 85229 - DNA, 16 bp, Unknown
  misc_feature (1)..( 16): Result.001 file - promoters70/2113502
ggcctatttacaatgt

SEQ ID NO: 85230 - DNA, 16 bp, Unknown
  misc_feature (1)..( 16): Result.001 file - promoters70/2113502
ggcctatatactatga

SEQ ID NO: 85231 - DNA, 16 bp, Unknown
  misc_feature (1)..( 16): Result.001 file - promoters70/2113502
tcacacgaaccaatgt

SEQ ID NO: 85232 - DNA, 16 bp, Unknown
  misc_feature (1)..( 16): Result.001 file - promoters70/2113502
tttaatgcatctatga

SEQ ID NO: 85233 - DNA, 16 bp, Unknown
  misc_feature (1)..( 16): Result.001 file - promoters70/2113502
acattatatataaaaa

SEQ ID NO: 85234 - DNA, 16 bp, Unknown
  misc_feature (1)..( 16): Result.001 file - promoters70/2113502
aacagttgtataattt

SEQ ID NO: 85235 - DNA, 12 bp, Unknown
  misc_feature (1)..( 12): Result.001 file - promoters70/2113502
gttccaatcttg

SEQ ID NO: 85236 - DNA, 12 bp, Unknown
  misc_feature (1)..( 12): Result.001 file - promoters70/2113502
ttgtaaattttg

SEQ ID NO: 85237 - DNA, 12 bp, Unknown
  misc_feature (1)..( 12): Result.001 file - promoters70/2113502
aaagcaatctca

SEQ ID NO: 85238 - DNA, 12 bp, Unknown
  misc_feature (1)..( 12): Result.001 file - promoters70/2113502
gcttcaagcttt

SEQ ID NO: 85239 - DNA, 12 bp, Unknown
  misc_feature (1)..( 12): Result.001 file - promoters70/2113502
atttaaattttt

SEQ ID NO: 85240 - DNA, 12 bp, Unknown
  misc_feature (1)..( 12): Result.001 file - promoters70/2113620
attaaaatgtct

SEQ ID NO: 85241 - DNA, 8 bp, Unknown
  misc_feature (1)..( 8): Result.001 file - promoters70/2113620
gaaggaag

SEQ ID NO: 85242 - DNA, 8 bp, Unknown
  misc_feature (1)..( 8): Result.001 file - promoters70/2113620
aaagaaag

SEQ ID NO: 85243 - DNA, 8 bp, Unknown
  misc_feature (1)..( 8): Result.001 file - promoters70/2113734
gaatgaat

SEQ ID NO: 85244 - DNA, 9 bp, Unknown
  misc_feature (1)..( 9): Result.001 file - promoters70/2113734
tgttagaga

SEQ ID NO: 85245 - DNA, 9 bp, Unknown
  misc_feature (1)..( 9): Result.001 file - promoters70/2113734
aattaaaga

SEQ ID NO: 85246 - DNA, 9 bp, Unknown
  misc_feature (1)..( 9): Result.001 file - promoters70/2113734
aattaaaaa

SEQ ID NO: 85247 - DNA, 11 bp, Unknown
  misc_feature (1)..( 11): Result.001 file - promoters70/2113734
tgctaagataa

SEQ ID NO: 85248 - DNA, 11 bp, Unknown
  misc_feature (1)..( 11): Result.001 file - promoters70/2113734
aattaaaataa

SEQ ID NO: 85249 - DNA, 11 bp, Unknown
  misc_feature (1)..( 11): Result.001 file - promoters70/2113846
aattaaaaaat

SEQ ID NO: 85250 - DNA, 8 bp, Unknown
  misc_feature (1)..( 8): Result.001 file - promoters70/2113846
tataattt

SEQ ID NO: 85251 - DNA, 8 bp, Unknown
  misc_feature (1)..( 8): Result.001 file - promoters70/2113846
tatcattt

SEQ ID NO: 85252 - DNA, 8 bp, Unknown
  misc_feature (1)..( 8): Result.001 file - promoters70/2113846
tatgatta

SEQ ID NO: 85253 - DNA, 9 bp, Unknown
  misc_feature (1)..( 9): Result.001 file - promoters70/2113846
aatttaacg

SEQ ID NO: 85254 - DNA, 9 bp, Unknown
  misc_feature (1)..( 9): Result.001 file - promoters70/2113846
tttttgacg

SEQ ID NO: 85255 - DNA, 9 bp, Unknown
  misc_feature (1)..( 9): Result.001 file - promoters70/2113889
aatttaatg

SEQ ID NO: 85256 - DNA, 13 bp, Unknown
  misc_feature (1)..( 13): Result.001 file - promoters70/2113889
catattctgaaaa

SEQ ID NO: 85257 - DNA, 13 bp, Unknown
  misc_feature (1)..( 13): Result.001 file - promoters70/2113889
taaattttgagta

SEQ ID NO: 85258 - DNA, 13 bp, Unknown
  misc_feature (1)..( 13): Result.001 file - promoters70/2113889
aaaatttatcctt

SEQ ID NO: 85259 - DNA, 13 bp, Unknown
  misc_feature (1)..( 13): Result.001 file - promoters70/2113889
agcatttaaaaat

SEQ ID NO: 85260 - DNA, 13 bp, Unknown
  misc_feature (1)..( 13): Result.001 file - promoters70/2113889
caaattgatctct

SEQ ID NO: 85261 - DNA, 10 bp, Unknown
  misc_feature (1)..( 10): Result.001 file - promoters70/2113889
attaaccttg

SEQ ID NO: 85262 - DNA, 10 bp, Unknown
  misc_feature (1)..( 10): Result.001 file - promoters70/2113889
gttaactttg

SEQ ID NO: 85263 - DNA, 10 bp, Unknown
  misc_feature (1)..( 10): Result.001 file - promoters70/2113889
gttgactggt

SEQ ID NO: 85264 - DNA, 10 bp, Unknown
  misc_feature (1)..( 10): Result.001 file - promoters70/2113889
aagaacttta

SEQ ID NO: 85265 - DNA, 10 bp, Unknown
  misc_feature (1)..( 10): Result.001 file - promoters70/2113889
catgactgtg

SEQ ID NO: 85266 - DNA, 8 bp, Unknown
  misc_feature (1)..( 8): Result.001 file - promoters70/2113889
aaaataaa

SEQ ID NO: 85267 - DNA, 8 bp, Unknown
  misc_feature (1)..( 8): Result.001 file - promoters70/2113889
aaaataaa

SEQ ID NO: 85268 - DNA, 10 bp, Unknown
  misc_feature (1)..( 10): Result.001 file - promoters70/2113889
aataattaaa

SEQ ID NO: 85269 - DNA, 10 bp, Unknown
  misc_feature (1)..( 10): Result.001 file - promoters70/2113889
tttaattaga

SEQ ID NO: 85270 - DNA, 11 bp, Unknown
  misc_feature (1)..( 11): Result.001 file - promoters70/2113889
aaaatgaaaaa

SEQ ID NO: 85271 - DNA, 11 bp, Unknown
  misc_feature (1)..( 11): Result.001 file - promoters70/2113889
actatgagaaa

SEQ ID NO: 85272 - DNA, 11 bp, Unknown
  misc_feature (1)..( 11): Result.001 file - promoters70/2113889
aaaattaaagt

SEQ ID NO: 85273 - DNA, 11 bp, Unknown
  misc_feature (1)..( 11): Result.001 file - promoters70/2113889
tccattaaacg

SEQ ID NO: 85274 - DNA, 10 bp, Unknown
  misc_feature (1)..( 10): Result.001 file - promoters70/2113889
tatatataga

SEQ ID NO: 85275 - DNA, 10 bp, Unknown
  misc_feature (1)..( 10): Result.001 file - promoters70/2113889
tatttattaa

SEQ ID NO: 85276 - DNA, 10 bp, Unknown
  misc_feature (1)..( 10): Result.001 file - promoters70/2113889
tatatataaa

SEQ ID NO: 85277 - DNA, 10 bp, Unknown
  misc_feature (1)..( 10): Result.001 file - promoters70/2113889
tataaataga

SEQ ID NO: 85278 - DNA, 7 bp, Unknown
  misc_feature (1)..( 7): Result.001 file - promoters70/2113889
caaaaaa

SEQ ID NO: 85279 - DNA, 7 bp, Unknown
  misc_feature (1)..( 7): Result.001 file - promoters70/2113889
caataaa

SEQ ID NO: 85280 - DNA, 7 bp, Unknown
  misc_feature (1)..( 7): Result.001 file - promoters70/2113889
taataaa

SEQ ID NO: 85281 - DNA, 7 bp, Unknown
  misc_feature (1)..( 7): Result.001 file - promoters70/2113889
taacaaa

SEQ ID NO: 85282 - DNA, 7 bp, Unknown
  misc_feature (1)..( 7): Result.001 file - promoters70/2113889
tttaatg

SEQ ID NO: 85283 - DNA, 7 bp, Unknown
  misc_feature (1)..( 7): Result.001 file - promoters70/2113889
attaatg

SEQ ID NO: 85284 - DNA, 7 bp, Unknown
  misc_feature (1)..( 7): Result.001 file - promoters70/2113889
tttaaat

SEQ ID NO: 85285 - DNA, 7 bp, Unknown
  misc_feature (1)..( 7): Result.001 file - promoters70/2114095
attaatt

SEQ ID NO: 85286 - DNA, 7 bp, Unknown
  misc_feature (1)..( 7): Result.001 file - promoters70/2114095
aatcttt

SEQ ID NO: 85287 - DNA, 7 bp, Unknown
  misc_feature (1)..( 7): Result.001 file - promoters70/2114095
aatcttt

SEQ ID NO: 85288 - DNA, 7 bp, Unknown
  misc_feature (1)..( 7): Result.001 file - promoters70/2114095
aaactct

SEQ ID NO: 85289 - DNA, 9 bp, Unknown
  misc_feature (1)..( 9): Result.001 file - promoters70/2114095
aaaaaatct

SEQ ID NO: 85290 - DNA, 9 bp, Unknown
  misc_feature (1)..( 9): Result.001 file - promoters70/2114095
aaaatatca

SEQ ID NO: 85291 - DNA, 9 bp, Unknown
  misc_feature (1)..( 9): Result.001 file - promoters70/2114200
agaaactct

SEQ ID NO: 85292 - DNA, 12 bp, Unknown
  misc_feature (1)..( 12): Result.001 file - promoters70/2114200
aatgaattcttt

SEQ ID NO: 85293 - DNA, 12 bp, Unknown
  misc_feature (1)..( 12): Result.001 file - promoters70/2114200
catcaatgctta

SEQ ID NO: 85294 - DNA, 12 bp, Unknown
  misc_feature (1)..( 12): Result.001 file - promoters70/2114200
taaaaatccttg

SEQ ID NO: 85295 - DNA, 12 bp, Unknown
  misc_feature (1)..( 12): Result.001 file - promoters70/2114200
cattaatccttg

SEQ ID NO: 85296 - DNA, 12 bp, Unknown
  misc_feature (1)..( 12): Result.001 file - promoters70/2114200
attccatcctta

SEQ ID NO: 85297 - DNA, 12 bp, Unknown
  misc_feature (1)..( 12): Result.001 file - promoters70/2114200
ctctcattcatc

SEQ ID NO: 85298 - DNA, 16 bp, Unknown
  misc_feature (1)..( 16): Result.001 file - promoters70/2114200
ccaaacaaaacatata

SEQ ID NO: 85299 - DNA, 16 bp, Unknown
  misc_feature (1)..( 16): Result.001 file - promoters70/2114200
ttctataaaaaatatc

SEQ ID NO: 85300 - DNA, 16 bp, Unknown
  misc_feature (1)..( 16): Result.001 file - promoters70/2114200
ctatataaaaccaaga

SEQ ID NO: 85301 - DNA, 16 bp, Unknown
  misc_feature (1)..( 16): Result.001 file - promoters70/2114200
aatggtgataaatatt

SEQ ID NO: 85302 - DNA, 16 bp, Unknown
  misc_feature (1)..( 16): Result.001 file - promoters70/2114200
aagaataaaaattgat

SEQ ID NO: 85303 - DNA, 16 bp, Unknown
  misc_feature (1)..( 16): Result.001 file - promoters70/2187156
caaatgatgaaatatt

SEQ ID NO: 85304 - DNA, 11 bp, Unknown
  misc_feature (1)..( 11): Result.001 file - promoters70/2187156
ccagaattaag

SEQ ID NO: 85305 - DNA, 11 bp, Unknown
  misc_feature (1)..( 11): Result.001 file - promoters70/2187156
ccataattagt

SEQ ID NO: 85306 - DNA, 11 bp, Unknown
  misc_feature (1)..( 11): Result.001 file - promoters70/2217732
atgtaattaag

SEQ ID NO: 85307 - DNA, 16 bp, Unknown
  misc_feature (1)..( 16): Result.001 file - promoters70/2217732
atatttatatagataa

SEQ ID NO: 85308 - DNA, 16 bp, Unknown
  misc_feature (1)..( 16): Result.001 file - promoters70/2217732
ccctatataaagataa

SEQ ID NO: 85309 - DNA, 16 bp, Unknown
  misc_feature (1)..( 16): Result.001 file - promoters70/2217732
taggttatttagttaa

SEQ ID NO: 85310 - DNA, 16 bp, Unknown
  misc_feature (1)..( 16): Result.001 file - promoters70/2217732
cccaataaaaagcaaa

SEQ ID NO: 85311 - DNA, 16 bp, Unknown
  misc_feature (1)..( 16): Result.001 file - promoters70/2217732
tataatataaaggtcc

SEQ ID NO: 85312 - DNA, 16 bp, Unknown
  misc_feature (1)..( 16): Result.001 file - promoters70/2217817
tccactataaaacttg

SEQ ID NO: 85313 - DNA, 7 bp, Unknown
  misc_feature (1)..( 7): Result.001 file - promoters70/2217817
gtagatt

SEQ ID NO: 85314 - DNA, 7 bp, Unknown
  misc_feature (1)..( 7): Result.001 file - promoters70/2217817
atagatt

SEQ ID NO: 85315 - DNA, 7 bp, Unknown
  misc_feature (1)..( 7): Result.001 file - promoters70/2217996
ataaatt

SEQ ID NO: 85316 - DNA, 8 bp, Unknown
  misc_feature (1)..( 8): Result.001 file - promoters70/2217996
caaaccca

SEQ ID NO: 85317 - DNA, 8 bp, Unknown
  misc_feature (1)..( 8): Result.001 file - promoters70/2217996
caaacctg

SEQ ID NO: 85318 - DNA, 8 bp, Unknown
  misc_feature (1)..( 8): Result.001 file - promoters70/2217996
gaaagctg

SEQ ID NO: 85319 - DNA, 8 bp, Unknown
  misc_feature (1)..( 8): Result.001 file - promoters70/2217996
agagacat

SEQ ID NO: 85320 - DNA, 8 bp, Unknown
  misc_feature (1)..( 8): Result.001 file - promoters70/2217996
agatacag

SEQ ID NO: 85321 - DNA, 8 bp, Unknown
  misc_feature (1)..( 8): Result.001 file - promoters70/2217996
cgatccag

SEQ ID NO: 85322 - DNA, 9 bp, Unknown
  misc_feature (1)..( 9): Result.001 file - promoters70/2217996
tttaaagct

SEQ ID NO: 85323 - DNA, 9 bp, Unknown
  misc_feature (1)..( 9): Result.001 file - promoters70/2217996
tttcaagtt

SEQ ID NO: 85324 - DNA, 9 bp, Unknown
  misc_feature (1)..( 9): Result.001 file - promoters70/2218260
tctcacgtt

SEQ ID NO: 85325 - DNA, 9 bp, Unknown
  misc_feature (1)..( 9): Result.001 file - promoters70/2218260
aaaaattct

SEQ ID NO: 85326 - DNA, 9 bp, Unknown
  misc_feature (1)..( 9): Result.001 file - promoters70/2218260
gaaagttca

SEQ ID NO: 85327 - DNA, 10 bp, Unknown
  misc_feature (1)..( 10): Result.001 file - promoters70/2218260
taataataac

SEQ ID NO: 85328 - DNA, 10 bp, Unknown
  misc_feature (1)..( 10): Result.001 file - promoters70/2218260
ccaaaattga

SEQ ID NO: 85329 - DNA, 10 bp, Unknown
  misc_feature (1)..( 10): Result.001 file - promoters70/2218260
gcaaagttgt

SEQ ID NO: 85330 - DNA, 10 bp, Unknown
  misc_feature (1)..( 10): Result.001 file - promoters70/2218260
atcaaattga

SEQ ID NO: 85331 - DNA, 10 bp, Unknown
  misc_feature (1)..( 10): Result.001 file - promoters70/2218260
gtatttatat

SEQ ID NO: 85332 - DNA, 10 bp, Unknown
  misc_feature (1)..( 10): Result.001 file - promoters70/2218260
gtatatatat

SEQ ID NO: 85333 - DNA, 10 bp, Unknown
  misc_feature (1)..( 10): Result.001 file - promoters70/2218260
cgatttataa

SEQ ID NO: 85334 - DNA, 10 bp, Unknown
  misc_feature (1)..( 10): Result.001 file - promoters70/2218260
cgttatataa

SEQ ID NO: 85335 - DNA, 10 bp, Unknown
  misc_feature (1)..( 10): Result.001 file - promoters70/2218260
ctataaatac

SEQ ID NO: 85336 - DNA, 10 bp, Unknown
  misc_feature (1)..( 10): Result.001 file - promoters70/2218260
caataaaaag

SEQ ID NO: 85337 - DNA, 16 bp, Unknown
  misc_feature (1)..( 16): Result.001 file - promoters70/2218260
caaactcaaaaacttt

SEQ ID NO: 85338 - DNA, 16 bp, Unknown
  misc_feature (1)..( 16): Result.001 file - promoters70/2218260
tcaaaaaaaaaagttt

SEQ ID NO: 85339 - DNA, 16 bp, Unknown
  misc_feature (1)..( 16): Result.001 file - promoters70/2218260
gagatgtgcaaagttg

SEQ ID NO: 85340 - DNA, 16 bp, Unknown
  misc_feature (1)..( 16): Result.001 file - promoters70/2218260
tataaataaaattaat

SEQ ID NO: 85341 - DNA, 16 bp, Unknown
  misc_feature (1)..( 16): Result.001 file - promoters70/2218260
agagaaaaaaaagttg

SEQ ID NO: 85342 - DNA, 16 bp, Unknown
  misc_feature (1)..( 16): Result.001 file - promoters70/2218260
tgtatatatatttttt

SEQ ID NO: 85343 - DNA, 15 bp, Unknown
  misc_feature (1)..( 15): Result.001 file - promoters70/2218260
tagttataaatcgtt

SEQ ID NO: 85344 - DNA, 15 bp, Unknown
  misc_feature (1)..( 15): Result.001 file - promoters70/2218260
aagttatgaatccga

SEQ ID NO: 85345 - DNA, 15 bp, Unknown
  misc_feature (1)..( 15): Result.001 file - promoters70/2218260
gtcaaataaattatt

SEQ ID NO: 85346 - DNA, 15 bp, Unknown
  misc_feature (1)..( 15): Result.001 file - promoters70/2218260
agtaactaaaattag

SEQ ID NO: 85347 - DNA, 15 bp, Unknown
  misc_feature (1)..( 15): Result.001 file - promoters70/2218260
agattataaatcatc

SEQ ID NO: 85348 - DNA, 15 bp, Unknown
  misc_feature (1)..( 15): Result.001 file - promoters70/2218260
aagttagttctcttg

SEQ ID NO: 85349 - DNA, 15 bp, Unknown
  misc_feature (1)..( 15): Result.001 file - promoters70/2218271
ttcaatttaatcaat

SEQ ID NO: 85350 - DNA, 12 bp, Unknown
  misc_feature (1)..( 12): Result.001 file - promoters70/2218271
ggtatatatata

SEQ ID NO: 85351 - DNA, 12 bp, Unknown
  misc_feature (1)..( 12): Result.001 file - promoters70/2218271
tatatttatata

SEQ ID NO: 85352 - DNA, 12 bp, Unknown
  misc_feature (1)..( 12): Result.001 file - promoters70/2218271
ccaataaaaagc

SEQ ID NO: 85353 - DNA, 12 bp, Unknown
  misc_feature (1)..( 12): Result.001 file - promoters70/2218271
cttatataaaga

SEQ ID NO: 85354 - DNA, 12 bp, Unknown
  misc_feature (1)..( 12): Result.001 file - promoters70/2218271
cgtctttataaa

SEQ ID NO: 85355 - DNA, 12 bp, Unknown
  misc_feature (1)..( 12): Result.001 file - promoters70/2218271
cttatattcttc

SEQ ID NO: 85356 - DNA, 14 bp, Unknown
  misc_feature (1)..( 14): Result.001 file - promoters70/2218271
cttagttataaatc

SEQ ID NO: 85357 - DNA, 14 bp, Unknown
  misc_feature (1)..( 14): Result.001 file - promoters70/2218271
aaaagttatgaatc

SEQ ID NO: 85358 - DNA, 14 bp, Unknown
  misc_feature (1)..( 14): Result.001 file - promoters70/2218271
ttatgttatttatt

SEQ ID NO: 85359 - DNA, 14 bp, Unknown
  misc_feature (1)..( 14): Result.001 file - promoters70/2218271
agggaaaatgaatt

SEQ ID NO: 85360 - DNA, 14 bp, Unknown
  misc_feature (1)..( 14): Result.001 file - promoters70/2218271
taaaattagcagtc

SEQ ID NO: 85361 - DNA, 14 bp, Unknown
  misc_feature (1)..( 14): Result.001 file - promoters70/2218271
aaaagttacatggc

SEQ ID NO: 85362 - DNA, 14 bp, Unknown
  misc_feature (1)..( 14): Result.001 file - promoters70/2218271
tgaatttattttcc

SEQ ID NO: 85363 - DNA, 11 bp, Unknown
  misc_feature (1)..( 11): Result.001 file - promoters70/2218271
agaaaagtaag

SEQ ID NO: 85364 - DNA, 11 bp, Unknown
  misc_feature (1)..( 11): Result.001 file - promoters70/2218271
agaaaaataac

SEQ ID NO: 85365 - DNA, 11 bp, Unknown
  misc_feature (1)..( 11): Result.001 file - promoters70/2218271
accaaaataaa

SEQ ID NO: 85366 - DNA, 11 bp, Unknown
  misc_feature (1)..( 11): Result.001 file - promoters70/2218271
ataaaaattca

SEQ ID NO: 85367 - DNA, 11 bp, Unknown
  misc_feature (1)..( 11): Result.001 file - promoters70/2218271
ctattaataaa

SEQ ID NO: 85368 - DNA, 11 bp, Unknown
  misc_feature (1)..( 11): Result.001 file - promoters70/2218271
taaaaaatcaa

SEQ ID NO: 85369 - DNA, 8 bp, Unknown
  misc_feature (1)..( 8): Result.001 file - promoters70/2218271
aggcccaa

SEQ ID NO: 85370 - DNA, 8 bp, Unknown
  misc_feature (1)..( 8): Result.001 file - promoters70/2218271
aggcccaa

SEQ ID NO: 85371 - DNA, 8 bp, Unknown
  misc_feature (1)..( 8): Result.001 file - promoters70/2218271
aggcccat

SEQ ID NO: 85372 - DNA, 8 bp, Unknown
  misc_feature (1)..( 8): Result.001 file - promoters70/2218271
aggcccaa

SEQ ID NO: 85373 - DNA, 8 bp, Unknown
  misc_feature (1)..( 8): Result.001 file - promoters70/2218271
aagcccat

SEQ ID NO: 85374 - DNA, 8 bp, Unknown
  misc_feature (1)..( 8): Result.001 file - promoters70/2685931
agcccaaa

SEQ ID NO: 85375 - DNA, 11 bp, Unknown
  misc_feature (1)..( 11): Result.001 file - promoters70/2685931
taactgatttt

SEQ ID NO: 85376 - DNA, 11 bp, Unknown
  misc_feature (1)..( 11): Result.001 file - promoters70/2685931
taaatgataac

SEQ ID NO: 85377 - DNA, 11 bp, Unknown
  misc_feature (1)..( 11): Result.001 file - promoters70/2685931
aatatgaaaat

SEQ ID NO: 85378 - DNA, 8 bp, Unknown
  misc_feature (1)..( 8): Result.001 file - promoters70/2685931
tctttgaa

SEQ ID NO: 85379 - DNA, 8 bp, Unknown
  misc_feature (1)..( 8): Result.001 file - promoters70/2685931
tctttgat

SEQ ID NO: 85380 - DNA, 8 bp, Unknown
  misc_feature (1)..( 8): Result.001 file - promoters70/2685931
tcttggaa

SEQ ID NO: 85381 - DNA, 8 bp, Unknown
  misc_feature (1)..( 8): Result.001 file - promoters70/2685931
acattaaa

SEQ ID NO: 85382 - DNA, 8 bp, Unknown
  misc_feature (1)..( 8): Result.001 file - promoters70/2685931
acatcaaa

SEQ ID NO: 85383 - DNA, 8 bp, Unknown
  misc_feature (1)..( 8): Result.001 file - promoters70/2685951
acattatc

SEQ ID NO: 85384 - DNA, 7 bp, Unknown
  misc_feature (1)..( 7): Result.001 file - promoters70/2685951
aaataaa

SEQ ID NO: 85385 - DNA, 7 bp, Unknown
  misc_feature (1)..( 7): Result.001 file - promoters70/2685951
aaataag

SEQ ID NO: 85386 - DNA, 7 bp, Unknown
  misc_feature (1)..( 7): Result.001 file - promoters70/2724699
aaaaaag

SEQ ID NO: 85387 - DNA, 7 bp, Unknown
  misc_feature (1)..( 7): Result.001 file - promoters70/2724699
aattatc

SEQ ID NO: 85388 - DNA, 7 bp, Unknown
  misc_feature (1)..( 7): Result.001 file - promoters70/2724699
cattatc

SEQ ID NO: 85389 - DNA, 7 bp, Unknown
  misc_feature (1)..( 7): Result.001 file - promoters70/2724699
cattata

SEQ ID NO: 85390 - DNA, 9 bp, Unknown
  misc_feature (1)..( 9): Result.001 file - promoters70/2724699
aaaagttta

SEQ ID NO: 85391 - DNA, 9 bp, Unknown
  misc_feature (1)..( 9): Result.001 file - promoters70/2724699
aaatgtttt

SEQ ID NO: 85392 - DNA, 9 bp, Unknown
  misc_feature (1)..( 9): Result.001 file - promoters70/2918658
caatatttt

SEQ ID NO: 85393 - DNA, 12 bp, Unknown
  misc_feature (1)..( 12): Result.001 file - promoters70/2918658
acattataaaat

SEQ ID NO: 85394 - DNA, 12 bp, Unknown
  misc_feature (1)..( 12): Result.001 file - promoters70/2918658
tttttataatca

SEQ ID NO: 85395 - DNA, 13 bp, Unknown
  misc_feature (1)..( 13): Result.001 file - promoters70/2918658
aaggtatcaaaca

SEQ ID NO: 85396 - DNA, 13 bp, Unknown
  misc_feature (1)..( 13): Result.001 file - promoters70/2918658
acattaaaaaaat

SEQ ID NO: 85397 - DNA, 13 bp, Unknown
  misc_feature (1)..( 13): Result.001 file - promoters70/2918658
attttagaaaagt

SEQ ID NO: 85398 - DNA, 13 bp, Unknown
  misc_feature (1)..( 13): Result.001 file - promoters70/2918680
tgcacagggatca

SEQ ID NO: 85399 - DNA, 9 bp, Unknown
  misc_feature (1)..( 9): Result.001 file - promoters70/2918680
gaaaaaaag

SEQ ID NO: 85400 - DNA, 9 bp, Unknown
  misc_feature (1)..( 9): Result.001 file - promoters70/2918680
caaacaaat

SEQ ID NO: 85401 - DNA, 9 bp, Unknown
  misc_feature (1)..( 9): Result.001 file - promoters70/2918680
caaaaaaaa

SEQ ID NO: 85402 - DNA, 10 bp, Unknown
  misc_feature (1)..( 10): Result.001 file - promoters70/2918680
aaaactaaaa

SEQ ID NO: 85403 - DNA, 10 bp, Unknown
  misc_feature (1)..( 10): Result.001 file - promoters70/2918680
caaacacaag

SEQ ID NO: 85404 - DNA, 10 bp, Unknown
  misc_feature (1)..( 10): Result.001 file - promoters70/2990263
caaagaaagg

SEQ ID NO: 85405 - DNA, 10 bp, Unknown
  misc_feature (1)..( 10): Result.001 file - promoters70/2990263
tttaagaaag

SEQ ID NO: 85406 - DNA, 10 bp, Unknown
  misc_feature (1)..( 10): Result.001 file - promoters70/2990263
tcgaagaaag

SEQ ID NO: 85407 - DNA, 10 bp, Unknown
  misc_feature (1)..( 10): Result.001 file - promoters70/2990263
tcgaagaagg

SEQ ID NO: 85408 - DNA, 9 bp, Unknown
  misc_feature (1)..( 9): Result.001 file - promoters70/2990263
aaaggagaa

SEQ ID NO: 85409 - DNA, 9 bp, Unknown
  misc_feature (1)..( 9): Result.001 file - promoters70/2990263
caagaagaa

SEQ ID NO: 85410 - DNA, 9 bp, Unknown
  misc_feature (1)..( 9): Result.001 file - promoters70/2990611
aaagcagag

SEQ ID NO: 85411 - DNA, 7 bp, Unknown
  misc_feature (1)..( 7): Result.001 file - promoters70/2990611
attgttt

SEQ ID NO: 85412 - DNA, 7 bp, Unknown
  misc_feature (1)..( 7): Result.001 file - promoters70/2990611
tttgttt

SEQ ID NO: 85413 - DNA, 7 bp, Unknown
  misc_feature (1)..( 7): Result.001 file - promoters70/2990611
tttattt

SEQ ID NO: 85414 - DNA, 13 bp, Unknown
  misc_feature (1)..( 13): Result.001 file - promoters70/2990611
tgtttatggaaaa

SEQ ID NO: 85415 - DNA, 13 bp, Unknown
  misc_feature (1)..( 13): Result.001 file - promoters70/2990611
ccataaaggaaaa

SEQ ID NO: 85416 - DNA, 13 bp, Unknown
  misc_feature (1)..( 13): Result.001 file - promoters70/2990611
ccaaaaaagaaat

SEQ ID NO: 85417 - DNA, 8 bp, Unknown
  misc_feature (1)..( 8): Result.001 file - promoters70/2990611
tttcttta

SEQ ID NO: 85418 - DNA, 8 bp, Unknown
  misc_feature (1)..( 8): Result.001 file - promoters70/2990611
tttcttat

SEQ ID NO: 85419 - DNA, 8 bp, Unknown
  misc_feature (1)..( 8): Result.001 file - promoters70/2990611
tttattta

SEQ ID NO: 85420 - DNA, 8 bp, Unknown
  misc_feature (1)..( 8): Result.001 file - promoters70/2990611
tttctttt

SEQ ID NO: 85421 - DNA, 8 bp, Unknown
  misc_feature (1)..( 8): Result.001 file - promoters70/2990611
tttattta

SEQ ID NO: 85422 - DNA, 8 bp, Unknown
  misc_feature (1)..( 8): Result.001 file - promoters70/2990611
tttatttt

SEQ ID NO: 85423 - DNA, 9 bp, Unknown
  misc_feature (1)..( 9): Result.001 file - promoters70/2990611
ataataaag

SEQ ID NO: 85424 - DNA, 9 bp, Unknown
  misc_feature (1)..( 9): Result.001 file - promoters70/2990611
ataataagt

SEQ ID NO: 85425 - DNA, 9 bp, Unknown
  misc_feature (1)..( 9): Result.001 file - promoters70/2990611
ccaatcagt

SEQ ID NO: 85426 - DNA, 9 bp, Unknown
  misc_feature (1)..( 9): Result.001 file - promoters70/2990611
gttaacttt

SEQ ID NO: 85427 - DNA, 9 bp, Unknown
  misc_feature (1)..( 9): Result.001 file - promoters70/2990611
aataagttt

SEQ ID NO: 85428 - DNA, 9 bp, Unknown
  misc_feature (1)..( 9): Result.001 file - promoters70/2991239
aatcagtgt

SEQ ID NO: 85429 - DNA, 10 bp, Unknown
  misc_feature (1)..( 10): Result.001 file - promoters70/2991239
attatatatg

SEQ ID NO: 85430 - DNA, 10 bp, Unknown
  misc_feature (1)..( 10): Result.001 file - promoters70/2991239
tcaataaatg

SEQ ID NO: 85431 - DNA, 10 bp, Unknown
  misc_feature (1)..( 10): Result.001 file - promoters70/2991239
tcattaaaaa

SEQ ID NO: 85432 - DNA, 10 bp, Unknown
  misc_feature (1)..( 10): Result.001 file - promoters70/2991239
ttaaaaaaaa

SEQ ID NO: 85433 - DNA, 10 bp, Unknown
  misc_feature (1)..( 10): Result.001 file - promoters70/2991239
acaaaaaaaa

SEQ ID NO: 85434 - DNA, 10 bp, Unknown
  misc_feature (1)..( 10): Result.001 file - promoters70/2991239
ttaaaaaagg

SEQ ID NO: 85435 - DNA, 34 bp, Unknown; identical to SEQ ID NO: 76977
  misc_feature (1)..( 34): Result.001 file - promoters70/2991239

SEQ ID NO: 85436 - DNA, 34 bp, Unknown; identical to SEQ ID NO: 76978
  misc_feature (1)..( 34): Result.001 file - promoters70/2991239

SEQ ID NO: 85437 - DNA, 34 bp, Unknown; identical to SEQ ID NO: 76979
  misc_feature (1)..( 34): Result.001 file - promoters70/2991239

SEQ ID NO: 85438 - DNA, 34 bp, Unknown; identical to SEQ ID NO: 76977
  misc_feature (1)..( 34): Result.001 file - promoters70/2991239

SEQ ID NO: 85439 - DNA, 34 bp, Unknown; identical to SEQ ID NO: 76981
  misc_feature (1)..( 34): Result.001 file - promoters70/2991239

SEQ ID NO: 85440 - DNA, 34 bp, Unknown; identical to SEQ ID NO: 76979
  misc_feature (1)..( 34): Result.001 file - promoters70/2991239

SEQ ID NO: 85441 - DNA, 15 bp, Unknown
  misc_feature (1)..( 15): Result.001 file - promoters70/2991239
attgaagacttttca

SEQ ID NO: 85442 - DNA, 15 bp, Unknown
  misc_feature (1)..( 15): Result.001 file - promoters70/2991239
attgaagacttttca

SEQ ID NO: 85443 - DNA, 15 bp, Unknown
  misc_feature (1)..( 15): Result.001 file - promoters70/2991239
gtagaagaccatata

SEQ ID NO: 85444 - DNA, 13 bp, Unknown
  misc_feature (1)..( 13): Result.001 file - promoters70/2991239
ctataagctttaa

SEQ ID NO: 85445 - DNA, 13 bp, Unknown
  misc_feature (1)..( 13): Result.001 file - promoters70/2991239
ctataagctttta

SEQ ID NO: 85446 - DNA, 14 bp, Unknown
  misc_feature (1)..( 14): Result.001 file - promoters70/2991239
aagacagcatttaa

SEQ ID NO: 85447 - DNA, 29 bp, Unknown
  misc_feature (1)..( 29): Result.001 file - promoters70/2991239
aagctttaagtctatcgctagactgtcca

SEQ ID NO: 85448 - DNA, 29 bp, Unknown
  misc_feature (1)..( 29): Result.001 file - promoters70/2991239
agcttttaagtctctcgctagactgtcca

SEQ ID NO: 85449 - DNA, 29 bp, Unknown
  misc_feature (1)..( 29): Result.001 file - promoters70/2991489
agcatttaatgatgataacgatttggaag

SEQ ID NO: 85450 - DNA, 13 bp, Unknown
  misc_feature (1)..( 13): Result.001 file - promoters70/2991489
gaaataggcccaa

SEQ ID NO: 85451 - DNA, 13 bp, Unknown
  misc_feature (1)..( 13): Result.001 file - promoters70/2991489
taaaaaggcccat

SEQ ID NO: 85452 - DNA, 13 bp, Unknown
  misc_feature (1)..( 13): Result.001 file - promoters70/2991489
cctaaaggcccaa

SEQ ID NO: 85453 - DNA, 13 bp, Unknown
  misc_feature (1)..( 13): Result.001 file - promoters70/2991489
agaaaaggcccat

SEQ ID NO: 85454 - DNA, 13 bp, Unknown
  misc_feature (1)..( 13): Result.001 file - promoters70/2991489
taaaaaatatctg

SEQ ID NO: 85455 - DNA, 13 bp, Unknown
  misc_feature (1)..( 13): Result.001 file - promoters70/2992101
ccaaacggctagg

SEQ ID NO: 85456 - DNA, 9 bp, Unknown
  misc_feature (1)..( 9): Result.001 file - promoters70/2992101
cttcatatg

SEQ ID NO: 85457 - DNA, 9 bp, Unknown
  misc_feature (1)..( 9): Result.001 file - promoters70/2992101
tttcttatg

SEQ ID NO: 85458 - DNA, 10 bp, Unknown
  misc_feature (1)..( 10): Result.001 file - promoters70/2992101
tttacttctg

SEQ ID NO: 85459 - DNA, 8 bp, Unknown
  misc_feature (1)..( 8): Result.001 file - promoters70/2992101
tctcttct

SEQ ID NO: 85460 - DNA, 8 bp, Unknown
  misc_feature (1)..( 8): Result.001 file - promoters70/2992101
tcttttct

SEQ ID NO: 85461 - DNA, 8 bp, Unknown
  misc_feature (1)..( 8): Result.001 file - promoters70/2992247
gcttatct

SEQ ID NO: 85462 - DNA, 9 bp, Unknown
  misc_feature (1)..( 9): Result.001 file - promoters70/2992247
caaagatat

SEQ ID NO: 85463 - DNA, 9 bp, Unknown
  misc_feature (1)..( 9): Result.001 file - promoters70/2992247
cttagatat

SEQ ID NO: 85464 - DNA, 9 bp, Unknown
  misc_feature (1)..( 9): Result.001 file - promoters70/2992247
cttaaatat

SEQ ID NO: 85465 - DNA, 6 bp, Unknown
  misc_feature (1)..( 6): Result.001 file - promoters70/2992247
atcttc

SEQ ID NO: 85466 - DNA, 6 bp, Unknown
  misc_feature (1)..( 6): Result.001 file - promoters70/2992247
atcttc

SEQ ID NO: 85467 - DNA, 6 bp, Unknown
  misc_feature (1)..( 6): Result.001 file - promoters70/2992247
atcttc

SEQ ID NO: 85468 - DNA, 9 bp, Unknown
  misc_feature (1)..( 9): Result.001 file - promoters70/2992247
tgagttttt

SEQ ID NO: 85469 - DNA, 9 bp, Unknown
  misc_feature (1)..( 9): Result.001 file - promoters70/2992247
tgatttttt

SEQ ID NO: 85470 - DNA, 9 bp, Unknown
  misc_feature (1)..( 9): Result.001 file - promoters70/2992247
tatgttttt

SEQ ID NO: 85471 - DNA, 10 bp, Unknown
  misc_feature (1)..( 10): Result.001 file - promoters70/2992247
aaatccaaaa

SEQ ID NO: 85472 - DNA, 10 bp, Unknown
  misc_feature (1)..( 10): Result.001 file - promoters70/2992247
aaatcaaaaa

SEQ ID NO: 85473 - DNA, 11 bp, Unknown
  misc_feature (1)..( 11): Result.001 file - promoters70/2992247
gtgatcaaatc

SEQ ID NO: 85474 - DNA, 11 bp, Unknown
  misc_feature (1)..( 11): Result.001 file - promoters70/2992247
aaagtcacaag

SEQ ID NO: 85475 - DNA, 10 bp, Unknown
  misc_feature (1)..( 10): Result.001 file - promoters70/2992247
gagtttaggt

SEQ ID NO: 85476 - DNA, 10 bp, Unknown
  misc_feature (1)..( 10): Result.001 file - promoters70/2992247
aatttttggt

SEQ ID NO: 85477 - DNA, 10 bp, Unknown
  misc_feature (1)..( 10): Result.001 file - promoters70/2992247
ttgttttgtc

SEQ ID NO: 85478 - DNA, 8 bp, Unknown
  misc_feature (1)..( 8): Result.001 file - promoters70/2992247
aatagtta

SEQ ID NO: 85479 - DNA, 8 bp, Unknown
  misc_feature (1)..( 8): Result.001 file - promoters70/2992247
aattgttt

SEQ ID NO: 85480 - DNA, 9 bp, Unknown
  misc_feature (1)..( 9): Result.001 file - promoters70/2992281
ttttggttt

SEQ ID NO: 85481 - DNA, 11 bp, Unknown
  misc_feature (1)..( 11): Result.001 file - promoters70/2992281
gaatcattaat

SEQ ID NO: 85482 - DNA, 11 bp, Unknown
  misc_feature (1)..( 11): Result.001 file - promoters70/2992281
aaatcatcaat

SEQ ID NO: 85483 - DNA, 11 bp, Unknown
  misc_feature (1)..( 11): Result.001 file - promoters70/2992281
aagttattaat

SEQ ID NO: 85484 - DNA, 11 bp, Unknown
  misc_feature (1)..( 11): Result.001 file - promoters70/2992281
aaagcatgttc

SEQ ID NO: 85485 - DNA, 11 bp, Unknown
  misc_feature (1)..( 11): Result.001 file - promoters70/2992281
tccaatgttaa

SEQ ID NO: 85486 - DNA, 11 bp, Unknown
  misc_feature (1)..( 11): Result.001 file - promoters70/2992281
tttaattttaa

SEQ ID NO: 85487 - DNA, 11 bp, Unknown
  misc_feature (1)..( 11): Result.001 file - promoters70/2992722
tttcatttggt

SEQ ID NO: 85488 - DNA, 7 bp, Unknown
  misc_feature (1)..( 7): Result.001 file - promoters70/2992722
aatttac

SEQ ID NO: 85489 - DNA, 7 bp, Unknown
  misc_feature (1)..( 7): Result.001 file - promoters70/2992722
aatctac

SEQ ID NO: 85490 - DNA, 7 bp, Unknown
  misc_feature (1)..( 7): Result.001 file - promoters70/2992722
aatttat

SEQ ID NO: 85491 - DNA, 11 bp, Unknown
  misc_feature (1)..( 11): Result.001 file - promoters70/2992722
aaaatagtaaa

SEQ ID NO: 85492 - DNA, 11 bp, Unknown
  misc_feature (1)..( 11): Result.001 file - promoters70/2992722
ataattgtata

SEQ ID NO: 85493 - DNA, 11 bp, Unknown
  misc_feature (1)..( 11): Result.001 file - promoters70/2992722
atatttgtata

SEQ ID NO: 85494 - DNA, 10 bp, Unknown
  misc_feature (1)..( 10): Result.001 file - promoters70/2992722
gaaaaagata

SEQ ID NO: 85495 - DNA, 10 bp, Unknown
  misc_feature (1)..( 10): Result.001 file - promoters70/2992722
gaaatagatt

SEQ ID NO: 85496 - DNA, 10 bp, Unknown
  misc_feature (1)..( 10): Result.001 file - promoters70/2992722
ttagtagatt

SEQ ID NO: 85497 - DNA, 10 bp, Unknown
  misc_feature (1)..( 10): Result.001 file - promoters70/2992722
tatataaatt

SEQ ID NO: 85498 - DNA, 8 bp, Unknown
  misc_feature (1)..( 8): Result.001 file - promoters70/2992722
aaggtata

SEQ ID NO: 85499 - DNA, 8 bp, Unknown
  misc_feature (1)..( 8): Result.001 file - promoters70/2992722
aagctata

SEQ ID NO: 85500 - DNA, 8 bp, Unknown
  misc_feature (1)..( 8): Result.001 file - promoters70/2992722
cagcaata

SEQ ID NO: 85501 - DNA, 9 bp, Unknown
  misc_feature (1)..( 9): Result.001 file - promoters70/2992722
ttactaaaa

SEQ ID NO: 85502 - DNA, 9 bp, Unknown
  misc_feature (1)..( 9): Result.001 file - promoters70/2992722
ttattaatt

SEQ ID NO: 85503 - DNA, 9 bp, Unknown
  misc_feature (1)..( 9): Result.001 file - promoters70/2993642
gtataaatt

SEQ ID NO: 85504 - DNA, 7 bp, Unknown
  misc_feature (1)..( 7): Result.001 file - promoters70/2993642
cttcttc

SEQ ID NO: 85505 - DNA, 7 bp, Unknown
  misc_feature (1)..( 7): Result.001 file - promoters70/2993642
ctttttc

SEQ ID NO: 85506 - DNA, 7 bp, Unknown
  misc_feature (1)..( 7): Result.001 file - promoters70/2993642
ttttttc

SEQ ID NO: 85507 - DNA, 7 bp, Unknown
  misc_feature (1)..( 7): Result.001 file - promoters70/2993642
tatttag

SEQ ID NO: 85508 - DNA, 7 bp, Unknown
  misc_feature (1)..( 7): Result.001 file - promoters70/2993642
tatttat

SEQ ID NO: 85509 - DNA, 7 bp, Unknown
  misc_feature (1)..( 7): Result.001 file - promoters70/2993642
tatatat

SEQ ID NO: 85510 - DNA, 8 bp, Unknown
  misc_feature (1)..( 8): Result.001 file - promoters70/2993642
ccacgtca

SEQ ID NO: 85511 - DNA, 8 bp, Unknown
  misc_feature (1)..( 8): Result.001 file - promoters70/2993642
ccacgtgg

SEQ ID NO: 85512 - DNA, 8 bp, Unknown
  misc_feature (1)..( 8): Result.001 file - promoters70/2993642
acacgtgg

SEQ ID NO: 85513 - DNA, 14 bp, Unknown
  misc_feature (1)..( 14): Result.001 file - promoters70/2993642
tttatatattttta

SEQ ID NO: 85514 - DNA, 14 bp, Unknown
  misc_feature (1)..( 14): Result.001 file - promoters70/2993642
aactaggattctta

SEQ ID NO: 85515 - DNA, 14 bp, Unknown
  misc_feature (1)..( 14): Result.001 file - promoters70/2993642
tttatatattttgt

SEQ ID NO: 85516 - DNA, 8 bp, Unknown
  misc_feature (1)..( 8): Result.001 file - promoters70/2993642
aaatgtaa

SEQ ID NO: 85517 - DNA, 8 bp, Unknown
  misc_feature (1)..( 8): Result.001 file - promoters70/2993642
aaatgttt

SEQ ID NO: 85518 - DNA, 8 bp, Unknown
  misc_feature (1)..( 8): Result.001 file - promoters70/2996222
aaatattt

SEQ ID NO: 85519 - DNA, 18 bp, Unknown
  misc_feature (1)..( 18): Result.001 file - promoters70/2996222
aaaaattattaaagtata

SEQ ID NO: 85520 - DNA, 18 bp, Unknown
  misc_feature (1)..( 18): Result.001 file - promoters70/2996222
aaagattattaaattata

SEQ ID NO: 85521 - DNA, 18 bp, Unknown
  misc_feature (1)..( 18): Result.001 file - promoters70/2996222
aaaatttatctgtaaatg

SEQ ID NO: 85522 - DNA, 10 bp, Unknown
  misc_feature (1)..( 10): Result.001 file - promoters70/2996222
tttactaata

SEQ ID NO: 85523 - DNA, 10 bp, Unknown
  misc_feature (1)..( 10): Result.001 file - promoters70/2996222
attattaaag

SEQ ID NO: 85524 - DNA, 10 bp, Unknown
  misc_feature (1)..( 10): Result.001 file - promoters70/2996222
tttgctatac

SEQ ID NO: 85525 - DNA, 10 bp, Unknown
  misc_feature (1)..( 10): Result.001 file - promoters70/2996222
tataataatt

SEQ ID NO: 85526 - DNA, 9 bp, Unknown
  misc_feature (1)..( 9): Result.001 file - promoters70/2996222
ataatttta

SEQ ID NO: 85527 - DNA, 9 bp, Unknown
  misc_feature (1)..( 9): Result.001 file - promoters70/2996222
ctaatttta

SEQ ID NO: 85528 - DNA, 9 bp, Unknown
  misc_feature (1)..( 9): Result.001 file - promoters70/2996222
ataattatt

SEQ ID NO: 85529 - DNA, 7 bp, Unknown
  misc_feature (1)..( 7): Result.001 file - promoters70/2996222
catttta

SEQ ID NO: 85530 - DNA, 7 bp, Unknown
  misc_feature (1)..( 7): Result.001 file - promoters70/2996222
tatttta

SEQ ID NO: 85531 - DNA, 7 bp, Unknown
  misc_feature (1)..( 7): Result.001 file - promoters70/2996222
tattttt

SEQ ID NO: 85532 - DNA, 10 bp, Unknown
  misc_feature (1)..( 10): Result.001 file - promoters70/2996222
ctatatatat

SEQ ID NO: 85533 - DNA, 10 bp, Unknown
  misc_feature (1)..( 10): Result.001 file - promoters70/2996222
ttatttatat

SEQ ID NO: 85534 - DNA, 10 bp, Unknown
  misc_feature (1)..( 10): Result.001 file - promoters70/2996222
gtatatataa

SEQ ID NO: 85535 - DNA, 10 bp, Unknown
  misc_feature (1)..( 10): Result.001 file - promoters70/2996222
ctatataaac

SEQ ID NO: 85536 - DNA, 9 bp, Unknown
  misc_feature (1)..( 9): Result.001 file - promoters70/2996222
ctaatttta

SEQ ID NO: 85537 - DNA, 9 bp, Unknown
  misc_feature (1)..( 9): Result.001 file - promoters70/2996222
ctaatttta

SEQ ID NO: 85538 - DNA, 9 bp, Unknown
  misc_feature (1)..( 9): Result.001 file - promoters70/2996222
aaaatgtta

SEQ ID NO: 85539 - DNA, 8 bp, Unknown
  misc_feature (1)..( 8): Result.001 file - promoters70/2996222
ttttgtta

SEQ ID NO: 85540 - DNA, 8 bp, Unknown
  misc_feature (1)..( 8): Result.001 file - promoters70/2996222
atttgtta

SEQ ID NO: 85541 - DNA, 8 bp, Unknown
  misc_feature (1)..( 8): Result.001 file - promoters70/2996222
ttttgttt

SEQ ID NO: 85542 - DNA, 8 bp, Unknown
  misc_feature (1)..( 8): Result.001 file - promoters70/2996222
tcaaaaaa

SEQ ID NO: 85543 - DNA, 8 bp, Unknown
  misc_feature (1)..( 8): Result.001 file - promoters70/2996222
acaaaaaa

SEQ ID NO: 85544 - DNA, 8 bp, Unknown
  misc_feature (1)..( 8): Result.001 file - promoters70/2996222
acaaaact

SEQ ID NO: 85545 - DNA, 11 bp, Unknown
  misc_feature (1)..( 11): Result.001 file - promoters70/2996222
aaacaatcatt

SEQ ID NO: 85546 - DNA, 11 bp, Unknown
  misc_feature (1)..( 11): Result.001 file - promoters70/2996222
aaaaaataatt

SEQ ID NO: 85547 - DNA, 11 bp, Unknown
  misc_feature (1)..( 11): Result.001 file - promoters70/2996222
aaaaaattgat

SEQ ID NO: 85548 - DNA, 8 bp, Unknown
  misc_feature (1)..( 8): Result.001 file - promoters70/2996222
taatagaa

SEQ ID NO: 85549 - DNA, 8 bp, Unknown
  misc_feature (1)..( 8): Result.001 file - promoters70/2996222
taattgaa

SEQ ID NO: 85550 - DNA, 8 bp, Unknown
  misc_feature (1)..( 8): Result.001 file - promoters70/2996222
aaattatt

SEQ ID NO: 85551 - DNA, 9 bp, Unknown
  misc_feature (1)..( 9): Result.001 file - promoters70/2996222
aacatattt

SEQ ID NO: 85552 - DNA, 9 bp, Unknown
  misc_feature (1)..( 9): Result.001 file - promoters70/2996222
aaaatattt

SEQ ID NO: 85553 - DNA, 9 bp, Unknown
  misc_feature (1)..( 9): Result.001 file - promoters70/2996222
aaaacattt

SEQ ID NO: 85554 - DNA, 7 bp, Unknown
  misc_feature (1)..( 7): Result.001 file - promoters70/2996222
attttgt

SEQ ID NO: 85555 - DNA, 7 bp, Unknown
  misc_feature (1)..( 7): Result.001 file - promoters70/2996222
attttgt

SEQ ID NO: 85556 - DNA, 7 bp, Unknown
  misc_feature (1)..( 7): Result.001 file - promoters70/2996222
tttttgt

SEQ ID NO: 85557 - DNA, 8 bp, Unknown
  misc_feature (1)..( 8): Result.001 file - promoters70/2996222
aaaaaaat

SEQ ID NO: 85558 - DNA, 8 bp, Unknown
  misc_feature (1)..( 8): Result.001 file - promoters70/2996222
aaaaaaaa

SEQ ID NO: 85559 - DNA, 8 bp, Unknown
  misc_feature (1)..( 8): Result.001 file - promoters70/3003010
aaaaaaat

SEQ ID NO: 85560 - DNA, 7 bp, Unknown
  misc_feature (1)..( 7): Result.001 file - promoters70/3003010
caaaatt

SEQ ID NO: 85561 - DNA, 7 bp, Unknown
  misc_feature (1)..( 7): Result.001 file - promoters70/3003010
caatatt

SEQ ID NO: 85562 - DNA, 7 bp, Unknown
  misc_feature (1)..( 7): Result.001 file - promoters70/3043962
caatatg

SEQ ID NO: 85563 - DNA, 12 bp, Unknown
  misc_feature (1)..( 12): Result.001 file - promoters70/3043962
atttgaattttt

SEQ ID NO: 85564 - DNA, 12 bp, Unknown
  misc_feature (1)..( 12): Result.001 file - promoters70/3043962
atttgatatgct

SEQ ID NO: 85565 - DNA, 12 bp, Unknown
  misc_feature (1)..( 12): Result.001 file - promoters70/3043962
atttgagttttt

SEQ ID NO: 85566 - DNA, 9 bp, Unknown
  misc_feature (1)..( 9): Result.001 file - promoters70/3043962
actatttaa

SEQ ID NO: 85567 - DNA, 9 bp, Unknown
  misc_feature (1)..( 9): Result.001 file - promoters70/3043962
tctatataa

SEQ ID NO: 85568 - DNA, 9 bp, Unknown
  misc_feature (1)..( 9): Result.001 file - promoters70/3043962
actattatc

SEQ ID NO: 85569 - DNA, 8 bp, Unknown
  misc_feature (1)..( 8): Result.001 file - promoters70/3043962
ttataaaa

SEQ ID NO: 85570 - DNA, 8 bp, Unknown
  misc_feature (1)..( 8): Result.001 file - promoters70/3043962
ttattaaa

SEQ ID NO: 85571 - DNA, 8 bp, Unknown
  misc_feature (1)..( 8): Result.001 file - promoters70/3408983
atataaat

SEQ ID NO: 85572 - DNA, 8 bp, Unknown
  misc_feature (1)..( 8): Result.001 file - promoters70/3408983
aaatatga

SEQ ID NO: 85573 - DNA, 8 bp, Unknown
  misc_feature (1)..( 8): Result.001 file - promoters70/3408983
gaatgtga

SEQ ID NO: 85574 - DNA, 8 bp, Unknown
  misc_feature (1)..( 8): Result.001 file - promoters70/3409165
aaatattc

SEQ ID NO: 85575 - DNA, 7 bp, Unknown
  misc_feature (1)..( 7): Result.001 file - promoters70/3409165
ttcatat

SEQ ID NO: 85576 - DNA, 7 bp, Unknown
  misc_feature (1)..( 7): Result.001 file - promoters70/3409165
ttcataa

SEQ ID NO: 85577 - DNA, 7 bp, Unknown
  misc_feature (1)..( 7): Result.001 file - promoters70/3409489
ttcttaa

SEQ ID NO: 85578 - DNA, 7 bp, Unknown
  misc_feature (1)..( 7): Result.001 file - promoters70/3409489
cgaagaa

SEQ ID NO: 85579 - DNA, 7 bp, Unknown
  misc_feature (1)..( 7): Result.001 file - promoters70/3409489
cgatgaa

SEQ ID NO: 85580 - DNA, 7 bp, Unknown
  misc_feature (1)..( 7): Result.001 file - promoters70/3409489
agaagaa

SEQ ID NO: 85581 - DNA, 8 bp, Unknown
  misc_feature (1)..( 8): Result.001 file - promoters70/3409489
acttcctt

SEQ ID NO: 85582 - DNA, 8 bp, Unknown
  misc_feature (1)..( 8): Result.001 file - promoters70/3409489
gcttactt

SEQ ID NO: 85583 - DNA, 8 bp, Unknown
  misc_feature (1)..( 8): Result.001 file - promoters70/3409489
acttccgc

SEQ ID NO: 85584 - DNA, 9 bp, Unknown
  misc_feature (1)..( 9): Result.001 file - promoters70/3409489
ctatggtta

SEQ ID NO: 85585 - DNA, 9 bp, Unknown
  misc_feature (1)..( 9): Result.001 file - promoters70/3409489
aaatgatta

SEQ ID NO: 85586 - DNA, 9 bp, Unknown
  misc_feature (1)..( 9): Result.001 file - promoters70/3433799
aaaggatta

SEQ ID NO: 85587 - DNA, 12 bp, Unknown
  misc_feature (1)..( 12): Result.001 file - promoters70/3433799
gattgataacag

SEQ ID NO: 85588 - DNA, 12 bp, Unknown
  misc_feature (1)..( 12): Result.001 file - promoters70/3433799
gattgttaacag

SEQ ID NO: 85589 - DNA, 12 bp, Unknown
  misc_feature (1)..( 12): Result.001 file - promoters70/3433799
tattaataatcg

SEQ ID NO: 85590 - DNA, 7 bp, Unknown
  misc_feature (1)..( 7): Result.001 file - promoters70/3433799
tggcaaa

SEQ ID NO: 85591 - DNA, 7 bp, Unknown
  misc_feature (1)..( 7): Result.001 file - promoters70/3433799
tggaaaa

SEQ ID NO: 85592 - DNA, 7 bp, Unknown
  misc_feature (1)..( 7): Result.001 file - promoters70/3433799
tggaaac

SEQ ID NO: 85593 - DNA, 9 bp, Unknown
  misc_feature (1)..( 9): Result.001 file - promoters70/3433799
aaatcattg

SEQ ID NO: 85594 - DNA, 9 bp, Unknown
  misc_feature (1)..( 9): Result.001 file - promoters70/3433799
aaaccattt

SEQ ID NO: 85595 - DNA, 9 bp, Unknown
  misc_feature (1)..( 9): Result.001 file - promoters70/3433799
tatccattt

SEQ ID NO: 85596 - DNA, 9 bp, Unknown
  misc_feature (1)..( 9): Result.001 file - promoters70/3433799
ctttataat

SEQ ID NO: 85597 - DNA, 9 bp, Unknown
  misc_feature (1)..( 9): Result.001 file - promoters70/3433799
cattaaaat

SEQ ID NO: 85598 - DNA, 10 bp, Unknown
  misc_feature (1)..( 10): Result.001 file - promoters70/3433904
acttcataga

SEQ ID NO: 85599 - DNA, 11 bp, Unknown
  misc_feature (1)..( 11): Result.001 file - promoters70/3433904
acattttaaat

SEQ ID NO: 85600 - DNA, 11 bp, Unknown
  misc_feature (1)..( 11): Result.001 file - promoters70/3433904
ccattctaaac

SEQ ID NO: 85601 - DNA, 11 bp, Unknown
  misc_feature (1)..( 11): Result.001 file - promoters70/3433904
tacttttaaca

SEQ ID NO: 85602 - DNA, 11 bp, Unknown
  misc_feature (1)..( 11): Result.001 file - promoters70/3433904
ccaatcttctt

SEQ ID NO: 85603 - DNA, 11 bp, Unknown
  misc_feature (1)..( 11): Result.001 file - promoters70/3433904
tcaatgttctt

SEQ ID NO: 85604 - DNA, 11 bp, Unknown
  misc_feature (1)..( 11): Result.001 file - promoters70/3433904
ggtttcttctc

SEQ ID NO: 85605 - DNA, 8 bp, Unknown
  misc_feature (1)..( 8): Result.001 file - promoters70/3433904
cattaaag

SEQ ID NO: 85606 - DNA, 8 bp, Unknown
  misc_feature (1)..( 8): Result.001 file - promoters70/3433904
tattaaag

SEQ ID NO: 85607 - DNA, 8 bp, Unknown
  misc_feature (1)..( 8): Result.001 file - promoters70/3433904
tataaaac

SEQ ID NO: 85608 - DNA, 8 bp, Unknown
  misc_feature (1)..( 8): Result.001 file - promoters70/3433904
tataaatg

SEQ ID NO: 85609 - DNA, 8 bp, Unknown
  misc_feature (1)..( 8): Result.001 file - promoters70/3433904
tataaaga

SEQ ID NO: 85610 - DNA, 8 bp, Unknown
  misc_feature (1)..( 8): Result.001 file - promoters70/3433904
tataaatt

SEQ ID NO: 85611 - DNA, 8 bp, Unknown
  misc_feature (1)..( 8): Result.001 file - promoters70/3433944
tatgaatc

SEQ ID NO: 85612 - DNA, 10 bp, Unknown
  misc_feature (1)..( 10): Result.001 file - promoters70/3433944
aaacttaaga

SEQ ID NO: 85613 - DNA, 10 bp, Unknown
  misc_feature (1)..( 10): Result.001 file - promoters70/3433944
gaacgtaaga

SEQ ID NO: 85614 - DNA, 10 bp, Unknown
  misc_feature (1)..( 10): Result.001 file - promoters70/3433944
aaaattaaat

SEQ ID NO: 85615 - DNA, 8 bp, Unknown
  misc_feature (1)..( 8): Result.001 file - promoters70/3433944
atttttct

SEQ ID NO: 85616 - DNA, 8 bp, Unknown
  misc_feature (1)..( 8): Result.001 file - promoters70/3433944
attttttt

SEQ ID NO: 85617 - DNA, 8 bp, Unknown
  misc_feature (1)..( 8): Result.001 file - promoters70/3433944
cttttttt

SEQ ID NO: 85618 - DNA, 9 bp, Unknown
  misc_feature (1)..( 9): Result.001 file - promoters70/3433944
agatattac

SEQ ID NO: 85619 - DNA, 9 bp, Unknown
  misc_feature (1)..( 9): Result.001 file - promoters70/3433944
cgatattaa

SEQ ID NO: 85620 - DNA, 9 bp, Unknown
  misc_feature (1)..( 9): Result.001 file - promoters70/3433944
agacatttt

SEQ ID NO: 85621 - DNA, 9 bp, Unknown
  misc_feature (1)..( 9): Result.001 file - promoters70/3433944
taataataa

SEQ ID NO: 85622 - DNA, 10 bp, Unknown
  misc_feature (1)..( 10): Result.001 file - promoters70/3433944
ttcatattac

SEQ ID NO: 85623 - DNA, 10 bp, Unknown
  misc_feature (1)..( 10): Result.001 file - promoters70/3433944
ttcaaatttt

SEQ ID NO: 85624 - DNA, 11 bp, Unknown
  misc_feature (1)..( 11): Result.001 file - promoters70/3433944
ataaaagtttt

SEQ ID NO: 85625 - DNA, 11 bp, Unknown
  misc_feature (1)..( 11): Result.001 file - promoters70/3433944
gtctgaacgaa

SEQ ID NO: 85626 - DNA, 11 bp, Unknown
  misc_feature (1)..( 11): Result.001 file - promoters70/3433944
aaaagaaagaa

SEQ ID NO: 85627 - DNA, 11 bp, Unknown
  misc_feature (1)..( 11): Result.001 file - promoters70/3434108
aaaaaaaagac

SEQ ID NO: 85628 - DNA, 12 bp, Unknown
  misc_feature (1)..( 12): Result.001 file - promoters70/3434108
ataatttacttt

SEQ ID NO: 85629 - DNA, 12 bp, Unknown
  misc_feature (1)..( 12): Result.001 file - promoters70/3434108
tgaatttatttt

SEQ ID NO: 85630 - DNA, 12 bp, Unknown
  misc_feature (1)..( 12): Result.001 file - promoters70/3434108
aatgtttgcttc

SEQ ID NO: 85631 - DNA, 12 bp, Unknown
  misc_feature (1)..( 12): Result.001 file - promoters70/3434108
ttaatttcctga

SEQ ID NO: 85632 - DNA, 12 bp, Unknown
  misc_feature (1)..( 12): Result.001 file - promoters70/3434108
ataatttagtct

SEQ ID NO: 85633 - DNA, 10 bp, Unknown
  misc_feature (1)..( 10): Result.001 file - promoters70/3434108
tttttacttt

SEQ ID NO: 85634 - DNA, 12 bp, Unknown
  misc_feature (1)..( 12): Result.001 file - promoters70/3434108
tcaatttaatca

SEQ ID NO: 85635 - DNA, 13 bp, Unknown
  misc_feature (1)..( 13): Result.001 file - promoters70/3434108
acttaaatttacg

SEQ ID NO: 85636 - DNA, 13 bp, Unknown
  misc_feature (1)..( 13): Result.001 file - promoters70/3434108
aaataaattgaat

SEQ ID NO: 85637 - DNA, 13 bp, Unknown
  misc_feature (1)..( 13): Result.001 file - promoters70/3434108
atttaaatttttt

SEQ ID NO: 85638 - DNA, 13 bp, Unknown
  misc_feature (1)..( 13): Result.001 file - promoters70/3434108
actttaattgaac

SEQ ID NO: 85639 - DNA, 13 bp, Unknown
  misc_feature (1)..( 13): Result.001 file - promoters70/3434108
aaaaaaattgtaa

SEQ ID NO: 85640 - DNA, 13 bp, Unknown
  misc_feature (1)..( 13): Result.001 file - promoters70/3434108
tcccaaattgaat

SEQ ID NO: 85641 - DNA, 13 bp, Unknown
  misc_feature (1)..( 13): Result.001 file - promoters70/3434108
caccagattttta

SEQ ID NO: 85642 - DNA, 13 bp, Unknown
  misc_feature (1)..( 13): Result.001 file - promoters70/3434108
tctttaaccaaaa

SEQ ID NO: 85643 - DNA, 13 bp, Unknown
  misc_feature (1)..( 13): Result.001 file - promoters70/3434108
tcttaaaaaatca

SEQ ID NO: 85644 - DNA, 13 bp, Unknown
  misc_feature (1)..( 13): Result.001 file - promoters70/3434108
atataaaaatttt

SEQ ID NO: 85645 - DNA, 14 bp, Unknown
  misc_feature (1)..( 14): Result.001 file - promoters70/3434108
ccacaaagaatttt

SEQ ID NO: 85646 - DNA, 14 bp, Unknown
  misc_feature (1)..( 14): Result.001 file - promoters70/3434108
ttctgaaaagctaa

SEQ ID NO: 85647 - DNA, 14 bp, Unknown
  misc_feature (1)..( 14): Result.001 file - promoters70/3434108
agagaaaaaaaagt

SEQ ID NO: 85648 - DNA, 14 bp, Unknown
  misc_feature (1)..( 14): Result.001 file - promoters70/3434233
tatcaataaacatt

SEQ ID NO: 85649 - DNA, 11 bp, Unknown
  misc_feature (1)..( 11): Result.001 file - promoters70/3434233
aaagcccaaca

SEQ ID NO: 85650 - DNA, 11 bp, Unknown
  misc_feature (1)..( 11): Result.001 file - promoters70/3434233
taagctcaaag

SEQ ID NO: 85651 - DNA, 11 bp, Unknown
  misc_feature (1)..( 11): Result.001 file - promoters70/3434233
aaagccattat

SEQ ID NO: 85652 - DNA, 11 bp, Unknown
  misc_feature (1)..( 11): Result.001 file - promoters70/3434233
taagccacata

SEQ ID NO: 85653 - DNA, 11 bp, Unknown
  misc_feature (1)..( 11): Result.001 file - promoters70/3434233
acagcaacata

SEQ ID NO: 85654 - DNA, 8 bp, Unknown
  misc_feature (1)..( 8): Result.001 file - promoters70/3434233
atatagat

SEQ ID NO: 85655 - DNA, 8 bp, Unknown
  misc_feature (1)..( 8): Result.001 file - promoters70/3434233
ttattgat

SEQ ID NO: 85656 - DNA, 8 bp, Unknown
  misc_feature (1)..( 8): Result.001 file - promoters70/3434233
atatagtt

SEQ ID NO: 85657 - DNA, 8 bp, Unknown
  misc_feature (1)..( 8): Result.001 file - promoters70/3434233
atatagat

SEQ ID NO: 85658 - DNA, 8 bp, Unknown
  misc_feature (1)..( 8): Result.001 file - promoters70/3434279
ttactgaa

SEQ ID NO: 85659 - DNA, 11 bp, Unknown
  misc_feature (1)..( 11): Result.001 file - promoters70/3434279
aaatattcaac

SEQ ID NO: 85660 - DNA, 11 bp, Unknown
  misc_feature (1)..( 11): Result.001 file - promoters70/3434279
atatatacaaa

SEQ ID NO: 85661 - DNA, 11 bp, Unknown
  misc_feature (1)..( 11): Result.001 file - promoters70/3434279
aaatatttttt

SEQ ID NO: 85662 - DNA, 11 bp, Unknown
  misc_feature (1)..( 11): Result.001 file - promoters70/3434279
acatataaaat

SEQ ID NO: 85663 - DNA, 11 bp, Unknown
  misc_feature (1)..( 11): Result.001 file - promoters70/3434279
ctataaaaaat

SEQ ID NO: 85664 - DNA, 11 bp, Unknown
  misc_feature (1)..( 11): Result.001 file - promoters70/3434279
cagaataaaaa

SEQ ID NO: 85665 - DNA, 11 bp, Unknown
  misc_feature (1)..( 11): Result.001 file - promoters70/3434279
atagaagaaac

SEQ ID NO: 85666 - DNA, 13 bp, Unknown
  misc_feature (1)..( 13): Result.001 file - promoters70/3434279
ggtgataaatatt

SEQ ID NO: 85667 - DNA, 13 bp, Unknown
  misc_feature (1)..( 13): Result.001 file - promoters70/3434279
tataaaaaatatc

SEQ ID NO: 85668 - DNA, 13 bp, Unknown
  misc_feature (1)..( 13): Result.001 file - promoters70/3434279
atgatgaaatatt

SEQ ID NO: 85669 - DNA, 14 bp, Unknown
  misc_feature (1)..( 14): Result.001 file - promoters70/3434279
aaacaaaacatata

SEQ ID NO: 85670 - DNA, 14 bp, Unknown
  misc_feature (1)..( 14): Result.001 file - promoters70/3434279
agatacaaaaccct

SEQ ID NO: 85671 - DNA, 14 bp, Unknown
  misc_feature (1)..( 14): Result.001 file - promoters70/3434311
agagacaaatagaa

SEQ ID NO: 85672 - DNA, 7 bp, Unknown
  misc_feature (1)..( 7): Result.001 file - promoters70/3434311
catcaga

SEQ ID NO: 85673 - DNA, 7 bp, Unknown
  misc_feature (1)..( 7): Result.001 file - promoters70/3434311
catcagg

SEQ ID NO: 85674 - DNA, 7 bp, Unknown
  misc_feature (1)..( 7): Result.001 file - promoters70/3434311
aatcaga

SEQ ID NO: 85675 - DNA, 9 bp, Unknown
  misc_feature (1)..( 9): Result.001 file - promoters70/3434311
taatgttac

SEQ ID NO: 85676 - DNA, 9 bp, Unknown
  misc_feature (1)..( 9): Result.001 file - promoters70/3434311
aaatgtttc

SEQ ID NO: 85677 - DNA, 9 bp, Unknown
  misc_feature (1)..( 9): Result.001 file - promoters70/3434311
taattttac

SEQ ID NO: 85678 - DNA, 11 bp, Unknown
  misc_feature (1)..( 11): Result.001 file - promoters70/3434311
atactttaagt

SEQ ID NO: 85679 - DNA, 11 bp, Unknown
  misc_feature (1)..( 11): Result.001 file - promoters70/3434311
ccgcttgaagt

SEQ ID NO: 85680 - DNA, 11 bp, Unknown
  misc_feature (1)..( 11): Result.001 file - promoters70/3434400
ataatttaact

SEQ ID NO: 85681 - DNA, 11 bp, Unknown
  misc_feature (1)..( 11): Result.001 file - promoters70/3434400
aaaatgtctac

SEQ ID NO: 85682 - DNA, 11 bp, Unknown
  misc_feature (1)..( 11): Result.001 file - promoters70/3434400
caaatgtgttt

SEQ ID NO: 85683 - DNA, 11 bp, Unknown
  misc_feature (1)..( 11): Result.001 file - promoters70/3434400
aaaatctgttt

SEQ ID NO: 85684 - DNA, 11 bp, Unknown
  misc_feature (1)..( 11): Result.001 file - promoters70/3434400
aaaatcgaacc

SEQ ID NO: 85685 - DNA, 12 bp, Unknown
  misc_feature (1)..( 12): Result.001 file - promoters70/3434400
aatgaacataca

SEQ ID NO: 85686 - DNA, 12 bp, Unknown
  misc_feature (1)..( 12): Result.001 file - promoters70/3434400
aatgaagatagt

SEQ ID NO: 85687 - DNA, 12 bp, Unknown
  misc_feature (1)..( 12): Result.001 file - promoters70/3434400
ggagaacattgt

SEQ ID NO: 85688 - DNA, 12 bp, Unknown
  misc_feature (1)..( 12): Result.001 file - promoters70/3434400
tgcaaagaaagt

SEQ ID NO: 85689 - DNA, 10 bp, Unknown
  misc_feature (1)..( 10): Result.001 file - promoters70/3434400
gttttttaat

SEQ ID NO: 85690 - DNA, 10 bp, Unknown
  misc_feature (1)..( 10): Result.001 file - promoters70/3434400
actttataat

SEQ ID NO: 85691 - DNA, 10 bp, Unknown
  misc_feature (1)..( 10): Result.001 file - promoters70/3434400
acattaaaat

SEQ ID NO: 85692 - DNA, 10 bp, Unknown
  misc_feature (1)..( 10): Result.001 file - promoters70/3434563
acttcataga

SEQ ID NO: 85693 - DNA, 14 bp, Unknown
  misc_feature (1)..( 14): Result.001 file - promoters70/3434563
tctttttgtgcaac

SEQ ID NO: 85694 - DNA, 14 bp, Unknown
  misc_feature (1)..( 14): Result.001 file - promoters70/3434563
agtttttgtaataa

SEQ ID NO: 85695 - DNA, 14 bp, Unknown
  misc_feature (1)..( 14): Result.001 file - promoters70/3434563
tttttctgttcaac

SEQ ID NO: 85696 - DNA, 14 bp, Unknown
  misc_feature (1)..( 14): Result.001 file - promoters70/3434563
tatttttgttggtt

SEQ ID NO: 85697 - DNA, 14 bp, Unknown
  misc_feature (1)..( 14): Result.001 file - promoters70/3434563
tatctttcaccttt

SEQ ID NO: 85698 - DNA, 14 bp, Unknown
  misc_feature (1)..( 14): Result.001 file - promoters70/3434563
catttttctgatga

SEQ ID NO: 85699 - DNA, 13 bp, Unknown
  misc_feature (1)..( 13): Result.001 file - promoters70/3434563
acaagagaagaag

SEQ ID NO: 85700 - DNA, 13 bp, Unknown
  misc_feature (1)..( 13): Result.001 file - promoters70/3434563
aaaagagaaaggt

SEQ ID NO: 85701 - DNA, 13 bp, Unknown
  misc_feature (1)..( 13): Result.001 file - promoters70/3434563
agaaaagaaagaa

SEQ ID NO: 85702 - DNA, 13 bp, Unknown
  misc_feature (1)..( 13): Result.001 file - promoters70/3434563
ggaaaagaaagaa

SEQ ID NO: 85703 - DNA, 13 bp, Unknown
  misc_feature (1)..( 13): Result.001 file - promoters70/3434563
aaaaaagataata

SEQ ID NO: 85704 - DNA, 13 bp, Unknown
  misc_feature (1)..( 13): Result.001 file - promoters70/3434563
gaaaaagaggttt

SEQ ID NO: 85705 - DNA, 9 bp, Unknown
  misc_feature (1)..( 9): Result.001 file - promoters70/3434563
gattttggt

SEQ ID NO: 85706 - DNA, 9 bp, Unknown
  misc_feature (1)..( 9): Result.001 file - promoters70/3434563
cattttgtc

SEQ ID NO: 85707 - DNA, 9 bp, Unknown
  misc_feature (1)..( 9): Result.001 file - promoters70/3434563
agttttgta

SEQ ID NO: 85708 - DNA, 9 bp, Unknown
  misc_feature (1)..( 9): Result.001 file - promoters70/3434563
ccttttgtt

SEQ ID NO: 85709 - DNA, 9 bp, Unknown
  misc_feature (1)..( 9): Result.001 file - promoters70/3434563
gatttagta

SEQ ID NO: 85710 - DNA, 9 bp, Unknown
  misc_feature (1)..( 9): Result.001 file - promoters70/3435133
cattgtgtg

SEQ ID NO: 85711 - DNA, 7 bp, Unknown
  misc_feature (1)..( 7): Result.001 file - promoters70/3435133
gtagatt

SEQ ID NO: 85712 - DNA, 7 bp, Unknown
  misc_feature (1)..( 7): Result.001 file - promoters70/3435133
atagatt

SEQ ID NO: 85713 - DNA, 7 bp, Unknown
  misc_feature (1)..( 7): Result.001 file - promoters70/3435452
ataaatt

SEQ ID NO: 85714 - DNA, 9 bp, Unknown
  misc_feature (1)..( 9): Result.001 file - promoters70/3435452
agaaatata

SEQ ID NO: 85715 - DNA, 9 bp, Unknown
  misc_feature (1)..( 9): Result.001 file - promoters70/3435452
aataatata

SEQ ID NO: 85716 - DNA, 9 bp, Unknown
  misc_feature (1)..( 9): Result.001 file - promoters70/3435452
agaaaaata

SEQ ID NO: 85717 - DNA, 7 bp, Unknown
  misc_feature (1)..( 7): Result.001 file - promoters70/3435452
ctaaaaa

SEQ ID NO: 85718 - DNA, 7 bp, Unknown
  misc_feature (1)..( 7): Result.001 file - promoters70/3435452
ctaaaat

SEQ ID NO: 85719 - DNA, 7 bp, Unknown
  misc_feature (1)..( 7): Result.001 file - promoters70/3435452
ttaaaat

SEQ ID NO: 85720 - DNA, 9 bp, Unknown
  misc_feature (1)..( 9): Result.001 file - promoters70/3435452
agaaattat

SEQ ID NO: 85721 - DNA, 9 bp, Unknown
  misc_feature (1)..( 9): Result.001 file - promoters70/3435452
agaaattct

SEQ ID NO: 85722 - DNA, 9 bp, Unknown
  misc_feature (1)..( 9): Result.001 file - promoters70/3435452
tcaaagtat

SEQ ID NO: 85723 - DNA, 9 bp, Unknown
  misc_feature (1)..( 9): Result.001 file - promoters70/3435452
tattctatt

SEQ ID NO: 85724 - DNA, 9 bp, Unknown
  misc_feature (1)..( 9): Result.001 file - promoters70/3435452
tatgctaaa

SEQ ID NO: 85725 - DNA, 9 bp, Unknown
  misc_feature (1)..( 9): Result.001 file - promoters70/3435452
aatgttaaa

SEQ ID NO: 85726 - DNA, 12 bp, Unknown
  misc_feature (1)..( 12): Result.001 file - promoters70/3435452
aggaagtcatca

SEQ ID NO: 85727 - DNA, 12 bp, Unknown
  misc_feature (1)..( 12): Result.001 file - promoters70/3435452
ttaacttcatca

SEQ ID NO: 85728 - DNA, 12 bp, Unknown
  misc_feature (1)..( 12): Result.001 file - promoters70/3435469
ttaactttatca

SEQ ID NO: 85729 - DNA, 10 bp, Unknown
  misc_feature (1)..( 10): Result.001 file - promoters70/3435469
tttttaaaaa

SEQ ID NO: 85730 - DNA, 10 bp, Unknown
  misc_feature (1)..( 10): Result.001 file - promoters70/3435469
ttttgaaaaa

SEQ ID NO: 85731 - DNA, 10 bp, Unknown
  misc_feature (1)..( 10): Result.001 file - promoters70/3435469
tttcgaatct

SEQ ID NO: 85732 - DNA, 7 bp, Unknown
  misc_feature (1)..( 7): Result.001 file - promoters70/3435469
cacaaaa

SEQ ID NO: 85733 - DNA, 7 bp, Unknown
  misc_feature (1)..( 7): Result.001 file - promoters70/3435469
aacaaaa

SEQ ID NO: 85734 - DNA, 7 bp, Unknown
  misc_feature (1)..( 7): Result.001 file - promoters70/3435469
aacgaaa

SEQ ID NO: 85735 - DNA, 10 bp, Unknown
  misc_feature (1)..( 10): Result.001 file - promoters70/3435469
ttttgagcta

SEQ ID NO: 85736 - DNA, 10 bp, Unknown
  misc_feature (1)..( 10): Result.001 file - promoters70/3435469
ttttgacttg

SEQ ID NO: 85737 - DNA, 10 bp, Unknown
  misc_feature (1)..( 10): Result.001 file - promoters70/3435469
ttttgatcta

SEQ ID NO: 85738 - DNA, 7 bp, Unknown
  misc_feature (1)..( 7): Result.001 file - promoters70/3435469
tctttag

SEQ ID NO: 85739 - DNA, 7 bp, Unknown
  misc_feature (1)..( 7): Result.001 file - promoters70/3435469
tctttag

SEQ ID NO: 85740 - DNA, 7 bp, Unknown
  misc_feature (1)..( 7): Result.001 file - promoters70/3435469
ttttgag

SEQ ID NO: 85741 - DNA, 11 bp, Unknown
  misc_feature (1)..( 11): Result.001 file - promoters70/3435469
tttatatcgtg

SEQ ID NO: 85742 - DNA, 11 bp, Unknown
  misc_feature (1)..( 11): Result.001 file - promoters70/3435469
cttatctcgtg

SEQ ID NO: 85743 - DNA, 11 bp, Unknown
  misc_feature (1)..( 11): Result.001 file - promoters70/3435469
cttttctttct

SEQ ID NO: 85744 - DNA, 8 bp, Unknown
  misc_feature (1)..( 8): Result.001 file - promoters70/3435469
aatatata

SEQ ID NO: 85745 - DNA, 8 bp, Unknown
  misc_feature (1)..( 8): Result.001 file - promoters70/3435469
aatttata

SEQ ID NO: 85746 - DNA, 8 bp, Unknown
  misc_feature (1)..( 8): Result.001 file - promoters70/3435534
gatttatc

SEQ ID NO: 85747 - DNA, 11 bp, Unknown
  misc_feature (1)..( 11): Result.001 file - promoters70/3435534
tggcagaataa

SEQ ID NO: 85748 - DNA, 11 bp, Unknown
  misc_feature (1)..( 11): Result.001 file - promoters70/3435534
aaacagagtaa

SEQ ID NO: 85749 - DNA, 11 bp, Unknown
  misc_feature (1)..( 11): Result.001 file - promoters70/3435534
aaacagaggat

SEQ ID NO: 85750 - DNA, 11 bp, Unknown
  misc_feature (1)..( 11): Result.001 file - promoters70/3435534
gtctatatgaa

SEQ ID NO: 85751 - DNA, 11 bp, Unknown
  misc_feature (1)..( 11): Result.001 file - promoters70/3435534
gtctatgtgaa

SEQ ID NO: 85752 - DNA, 11 bp, Unknown
  misc_feature (1)..( 11): Result.001 file - promoters70/3435632
atctttgttct

SEQ ID NO: 85753 - DNA, 9 bp, Unknown
  misc_feature (1)..( 9): Result.001 file - promoters70/3435632
ttttctttg

SEQ ID NO: 85754 - DNA, 9 bp, Unknown
  misc_feature (1)..( 9): Result.001 file - promoters70/3435632
ttttgtttc

SEQ ID NO: 85755 - DNA, 9 bp, Unknown
  misc_feature (1)..( 9): Result.001 file - promoters70/3435632
atgtctttg

SEQ ID NO: 85756 - DNA, 7 bp, Unknown
  misc_feature (1)..( 7): Result.001 file - promoters70/3435632
cttttta

SEQ ID NO: 85757 - DNA, 7 bp, Unknown
  misc_feature (1)..( 7): Result.001 file - promoters70/3435632
cttttta

SEQ ID NO: 85758 - DNA, 7 bp, Unknown
  misc_feature (1)..( 7): Result.001 file - promoters70/3435632
attttta

SEQ ID NO: 85759 - DNA, 9 bp, Unknown
  misc_feature (1)..( 9): Result.001 file - promoters70/3435632
cttaagtca

SEQ ID NO: 85760 - DNA, 9 bp, Unknown
  misc_feature (1)..( 9): Result.001 file - promoters70/3435632
cttaattca

SEQ ID NO: 85761 - DNA, 9 bp, Unknown
  misc_feature (1)..( 9): Result.001 file - promoters70/3435632
tttatgtct

SEQ ID NO: 85762 - DNA, 8 bp, Unknown
  misc_feature (1)..( 8): Result.001 file - promoters70/3435632
aaaaaata

SEQ ID NO: 85763 - DNA, 8 bp, Unknown
  misc_feature (1)..( 8): Result.001 file - promoters70/3435632
aaaaaatt

SEQ ID NO: 85764 - DNA, 8 bp, Unknown
  misc_feature (1)..( 8): Result.001 file - promoters70/3435632
aaataatt

SEQ ID NO: 85765 - DNA, 8 bp, Unknown
  misc_feature (1)..( 8): Result.001 file - promoters70/3435632
aaataact

SEQ ID NO: 85766 - DNA, 8 bp, Unknown
  misc_feature (1)..( 8): Result.001 file - promoters70/3435632
aaataatt

SEQ ID NO: 85767 - DNA, 8 bp, Unknown
  misc_feature (1)..( 8): Result.001 file - promoters70/3435761
aaaaaatt

SEQ ID NO: 85768 - DNA, 8 bp, Unknown
  misc_feature (1)..( 8): Result.001 file - promoters70/3435761
gaaaaaaa

SEQ ID NO: 85769 - DNA, 8 bp, Unknown
  misc_feature (1)..( 8): Result.001 file - promoters70/3435761
gaaaaaag

SEQ ID NO: 85770 - DNA, 9 bp, Unknown
  misc_feature (1)..( 9): Result.001 file - promoters70/3435761
caaagaaag

SEQ ID NO: 85771 - DNA, 9 bp, Unknown
  misc_feature (1)..( 9): Result.001 file - promoters70/3435761
caaaaaaaa

SEQ ID NO: 85772 - DNA, 9 bp, Unknown
  misc_feature (1)..( 9): Result.001 file - promoters70/3435761
aaactaaaa

SEQ ID NO: 85773 - DNA, 9 bp, Unknown
  misc_feature (1)..( 9): Result.001 file - promoters70/3435829
taactaaaa

SEQ ID NO: 85774 - DNA, 8 bp, Unknown
  misc_feature (1)..( 8): Result.001 file - promoters70/3435829
ataagata

SEQ ID NO: 85775 - DNA, 8 bp, Unknown
  misc_feature (1)..( 8): Result.001 file - promoters70/3435829
ctaaaata

SEQ ID NO: 85776 - DNA, 8 bp, Unknown
  misc_feature (1)..( 8): Result.001 file - promoters70/3435829
ctacaatt

SEQ ID NO: 85777 - DNA, 8 bp, Unknown
  misc_feature (1)..( 8): Result.001 file - promoters70/3435829
attaacta

SEQ ID NO: 85778 - DNA, 8 bp, Unknown
  misc_feature (1)..( 8): Result.001 file - promoters70/3435829
tctaacta

SEQ ID NO: 85779 - DNA, 8 bp, Unknown
  misc_feature (1)..( 8): Result.001 file - promoters70/3436196
attgactc

SEQ ID NO: 85780 - DNA, 8 bp, Unknown
  misc_feature (1)..( 8): Result.001 file - promoters70/3436196
aaaccttt

SEQ ID NO: 85781 - DNA, 8 bp, Unknown
  misc_feature (1)..( 8): Result.001 file - promoters70/3436196
aaatcttc

SEQ ID NO: 85782 - DNA, 8 bp, Unknown
  misc_feature (1)..( 8): Result.001 file - promoters70/3436196
aaatcttt

SEQ ID NO: 85783 - DNA, 7 bp, Unknown
  misc_feature (1)..( 7): Result.001 file - promoters70/3436196
tctaaaa

SEQ ID NO: 85784 - DNA, 7 bp, Unknown
  misc_feature (1)..( 7): Result.001 file - promoters70/3436196
actaaaa

SEQ ID NO: 85785 - DNA, 7 bp, Unknown
  misc_feature (1)..( 7): Result.001 file - promoters70/3436196
actaaat

SEQ ID NO: 85786 - DNA, 10 bp, Unknown
  misc_feature (1)..( 10): Result.001 file - promoters70/3436196
cacataaaat

SEQ ID NO: 85787 - DNA, 10 bp, Unknown
  misc_feature (1)..( 10): Result.001 file - promoters70/3436196
atcataaaat

SEQ ID NO: 85788 - DNA, 10 bp, Unknown
  misc_feature (1)..( 10): Result.001 file - promoters70/3437193
atcgtaacct

SEQ ID NO: 85789 - DNA, 10 bp, Unknown
  misc_feature (1)..( 10): Result.001 file - promoters70/3437193
attaatgata

SEQ ID NO: 85790 - DNA, 10 bp, Unknown
  misc_feature (1)..( 10): Result.001 file - promoters70/3437193
attgatgaga

SEQ ID NO: 85791 - DNA, 10 bp, Unknown
  misc_feature (1)..( 10): Result.001 file - promoters70/3437244
acagatcaga

SEQ ID NO: 85792 - DNA, 8 bp, Unknown
  misc_feature (1)..( 8): Result.001 file - promoters70/3437244
aaatcaag

SEQ ID NO: 85793 - DNA, 8 bp, Unknown
  misc_feature (1)..( 8): Result.001 file - promoters70/3437244
gaatcaac

SEQ ID NO: 85794 - DNA, 8 bp, Unknown
  misc_feature (1)..( 8): Result.001 file - promoters70/3437244
ccatcaac

SEQ ID NO: 85795 - DNA, 8 bp, Unknown
  misc_feature (1)..( 8): Result.001 file - promoters70/3437244
gaatcaca

SEQ ID NO: 85796 - DNA, 10 bp, Unknown
  misc_feature (1)..( 10): Result.001 file - promoters70/3437244
cgtttagtgt

SEQ ID NO: 85797 - DNA, 10 bp, Unknown
  misc_feature (1)..( 10): Result.001 file - promoters70/3437244
tttttagttt

SEQ ID NO: 85798 - DNA, 10 bp, Unknown
  misc_feature (1)..( 10): Result.001 file - promoters70/3437244
attttatttt

SEQ ID NO: 85799 - DNA, 10 bp, Unknown
  misc_feature (1)..( 10): Result.001 file - promoters70/3437331
attttattac

SEQ ID NO: 85800 - DNA, 11 bp, Unknown
  misc_feature (1)..( 11): Result.001 file - promoters70/3437331
cattgtgtggc

SEQ ID NO: 85801 - DNA, 11 bp, Unknown
  misc_feature (1)..( 11): Result.001 file - promoters70/3437331
cattttgtttt

SEQ ID NO: 85802 - DNA, 11 bp, Unknown
  misc_feature (1)..( 11): Result.001 file - promoters70/3437710
atatttgtttt

SEQ ID NO: 85803 - DNA, 8 bp, Unknown
  misc_feature (1)..( 8): Result.001 file - promoters70/3437710
tatccaag

SEQ ID NO: 85804 - DNA, 8 bp, Unknown
  misc_feature (1)..( 8): Result.001 file - promoters70/3437710
aatccaaa

SEQ ID NO: 85805 - DNA, 8 bp, Unknown
  misc_feature (1)..( 8): Result.001 file - promoters70/3437710
tatccaag

SEQ ID NO: 85806 - DNA, 8 bp, Unknown
  misc_feature (1)..( 8): Result.001 file - promoters70/3438069
tatccaac

SEQ ID NO: 85807 - DNA, 7 bp, Unknown
  misc_feature (1)..( 7): Result.001 file - promoters70/3438069
agaaagg

SEQ ID NO: 85808 - DNA, 7 bp, Unknown
  misc_feature (1)..( 7): Result.001 file - promoters70/3438069
agaaagt

SEQ ID NO: 85809 - DNA, 7 bp, Unknown
  misc_feature (1)..( 7): Result.001 file - promoters70/3438069
agatagt

SEQ ID NO: 85810 - DNA, 8 bp, Unknown
  misc_feature (1)..( 8): Result.001 file - promoters70/3438069
gcataatg

SEQ ID NO: 85811 - DNA, 8 bp, Unknown
  misc_feature (1)..( 8): Result.001 file - promoters70/3438069
ttataatg

SEQ ID NO: 85812 - DNA, 8 bp, Unknown
  misc_feature (1)..( 8): Result.001 file - promoters70/3438069
ttaaaatc

SEQ ID NO: 85813 - DNA, 8 bp, Unknown
  misc_feature (1)..( 8): Result.001 file - promoters70/3438069
tcaaaatc

SEQ ID NO: 85814 - DNA, 8 bp, Unknown
  misc_feature (1)..( 8): Result.001 file - promoters70/3438069
gttaattg

SEQ ID NO: 85815 - DNA, 8 bp, Unknown
  misc_feature (1)..( 8): Result.001 file - promoters70/3438069
gttaattg

SEQ ID NO: 85816 - DNA, 8 bp, Unknown
  misc_feature (1)..( 8): Result.001 file - promoters70/3438171
attacttg

SEQ ID NO: 85817 - DNA, 9 bp, Unknown
  misc_feature (1)..( 9): Result.001 file - promoters70/3438171
agaatgttg

SEQ ID NO: 85818 - DNA, 9 bp, Unknown
  misc_feature (1)..( 9): Result.001 file - promoters70/3438171
agaatgtat

SEQ ID NO: 85819 - DNA, 9 bp, Unknown
  misc_feature (1)..( 9): Result.001 file - promoters70/3438171
ttaatatat

SEQ ID NO: 85820 - DNA, 8 bp, Unknown
  misc_feature (1)..( 8): Result.001 file - promoters70/3438171
atatatca

SEQ ID NO: 85821 - DNA, 8 bp, Unknown
  misc_feature (1)..( 8): Result.001 file - promoters70/3438171
gtatgtca

SEQ ID NO: 85822 - DNA, 8 bp, Unknown
  misc_feature (1)..( 8): Result.001 file - promoters70/3438171
atatatac

SEQ ID NO: 85823 - DNA, 8 bp, Unknown
  misc_feature (1)..( 8): Result.001 file - promoters70/3438171
taatattt

SEQ ID NO: 85824 - DNA, 8 bp, Unknown
  misc_feature (1)..( 8): Result.001 file - promoters70/3438171
taatgttt

SEQ ID NO: 85825 - DNA, 8 bp, Unknown
  misc_feature (1)..( 8): Result.001 file - promoters70/3438171
taaaatta

SEQ ID NO: 85826 - DNA, 6 bp, Unknown
  misc_feature (1)..( 6): Result.001 file - promoters70/3438171
aaatat

SEQ ID NO: 85827 - DNA, 6 bp, Unknown
  misc_feature (1)..( 6): Result.001 file - promoters70/3438171
aaatat

SEQ ID NO: 85828 - DNA, 7 bp, Unknown
  misc_feature (1)..( 7): Result.001 file - promoters70/3438171
aaattat

SEQ ID NO: 85829 - DNA, 9 bp, Unknown
  misc_feature (1)..( 9): Result.001 file - promoters70/3438171
taaaaaata

SEQ ID NO: 85830 - DNA, 9 bp, Unknown
  misc_feature (1)..( 9): Result.001 file - promoters70/3438171
gaaaaaata

SEQ ID NO: 85831 - DNA, 9 bp, Unknown
  misc_feature (1)..( 9): Result.001 file - promoters70/3438171
taaaaaaaa

SEQ ID NO: 85832 - DNA, 8 bp, Unknown
  misc_feature (1)..( 8): Result.001 file - promoters70/3438171
tttttatt

SEQ ID NO: 85833 - DNA, 8 bp, Unknown
  misc_feature (1)..( 8): Result.001 file - promoters70/3438171
attttatt

SEQ ID NO: 85834 - DNA, 8 bp, Unknown
  misc_feature (1)..( 8): Result.001 file - promoters70/3438171
tttttatt

SEQ ID NO: 85835 - DNA, 7 bp, Unknown
  misc_feature (1)..( 7): Result.001 file - promoters70/3438171
atatttt

SEQ ID NO: 85836 - DNA, 7 bp, Unknown
  misc_feature (1)..( 7): Result.001 file - promoters70/3438171
atattta

SEQ ID NO: 85837 - DNA, 7 bp, Unknown
  misc_feature (1)..( 7): Result.001 file - promoters70/3438171
ttattta

SEQ ID NO: 85838 - DNA, 19 bp, Unknown
  misc_feature (1)..( 19): Result.001 file - promoters70/3438171
aaattattcacacatgttg

SEQ ID NO: 85839 - DNA, 19 bp, Unknown
  misc_feature (1)..( 19): Result.001 file - promoters70/3438171
taattattcatacaagttg

SEQ ID NO: 85840 - DNA, 19 bp, Unknown
  misc_feature (1)..( 19): Result.001 file - promoters70/3438171
aaattagcgagtaggataa

SEQ ID NO: 85841 - DNA, 11 bp, Unknown
  misc_feature (1)..( 11): Result.001 file - promoters70/3438171
gtttaaaaatt

SEQ ID NO: 85842 - DNA, 11 bp, Unknown
  misc_feature (1)..( 11): Result.001 file - promoters70/3438171
gtttaatttat

SEQ ID NO: 85843 - DNA, 11 bp, Unknown
  misc_feature (1)..( 11): Result.001 file - promoters70/3438171
gttaaaaaatt

SEQ ID NO: 85844 - DNA, 8 bp, Unknown
  misc_feature (1)..( 8): Result.001 file - promoters70/3438171
atagttta

SEQ ID NO: 85845 - DNA, 8 bp, Unknown
  misc_feature (1)..( 8): Result.001 file - promoters70/3438171
ataatttc

SEQ ID NO: 85846 - DNA, 8 bp, Unknown
  misc_feature (1)..( 8): Result.001 file - promoters70/3438171
gaaatttc

SEQ ID NO: 85847 - DNA, 9 bp, Unknown
  misc_feature (1)..( 9): Result.001 file - promoters70/3438171
aataaattt

SEQ ID NO: 85848 - DNA, 9 bp, Unknown
  misc_feature (1)..( 9): Result.001 file - promoters70/3438171
tatatattc

SEQ ID NO: 85849 - DNA, 9 bp, Unknown
  misc_feature (1)..( 9): Result.001 file - promoters70/3438171
aataaaaaa

SEQ ID NO: 85850 - DNA, 9 bp, Unknown
  misc_feature (1)..( 9): Result.001 file - promoters70/3438171
aatacaaaa

SEQ ID NO: 85851 - DNA, 11 bp, Unknown
  misc_feature (1)..( 11): Result.001 file - promoters70/3438171
ctttgaataaa

SEQ ID NO: 85852 - DNA, 11 bp, Unknown
  misc_feature (1)..( 11): Result.001 file - promoters70/3438171
atttaaataaa

SEQ ID NO: 85853 - DNA, 11 bp, Unknown
  misc_feature (1)..( 11): Result.001 file - promoters70/3438171
atttaaagaca

SEQ ID NO: 85854 - DNA, 11 bp, Unknown
  misc_feature (1)..( 11): Result.001 file - promoters70/3438171
gtttaaaacaa

SEQ ID NO: 85855 - DNA, 7 bp, Unknown
  misc_feature (1)..( 7): Result.001 file - promoters70/3438171
aaaacaa

SEQ ID NO: 85856 - DNA, 7 bp, Unknown
  misc_feature (1)..( 7): Result.001 file - promoters70/3438171
taaacaa

SEQ ID NO: 85857 - DNA, 7 bp, Unknown
  misc_feature (1)..( 7): Result.001 file - promoters70/3438171
aaaacaa

SEQ ID NO: 85858 - DNA, 9 bp, Unknown
  misc_feature (1)..( 9): Result.001 file - promoters70/3438171
atataaata

SEQ ID NO: 85859 - DNA, 9 bp, Unknown
  misc_feature (1)..( 9): Result.001 file - promoters70/3438171
ttataaata

SEQ ID NO: 85860 - DNA, 9 bp, Unknown
  misc_feature (1)..( 9): Result.001 file - promoters70/3438194
atataagtg

SEQ ID NO: 85861 - DNA, 9 bp, Unknown
  misc_feature (1)..( 9): Result.001 file - promoters70/3438194
aaaatagag

SEQ ID NO: 85862 - DNA, 9 bp, Unknown
  misc_feature (1)..( 9): Result.001 file - promoters70/3438194
caaatagtc

SEQ ID NO: 85863 - DNA, 9 bp, Unknown
  misc_feature (1)..( 9): Result.001 file - promoters70/3438194
gaaacagag

SEQ ID NO: 85864 - DNA, 9 bp, Unknown
  misc_feature (1)..( 9): Result.001 file - promoters70/3438194
gaagcagag

SEQ ID NO: 85865 - DNA, 9 bp, Unknown
  misc_feature (1)..( 9): Result.001 file - promoters70/3438236
gaagcaact

SEQ ID NO: 85866 - DNA, 12 bp, Unknown
  misc_feature (1)..( 12): Result.001 file - promoters70/3438236
tatttgattgaa

SEQ ID NO: 85867 - DNA, 12 bp, Unknown
  misc_feature (1)..( 12): Result.001 file - promoters70/3438236
aaggtgaatgat

SEQ ID NO: 85868 - DNA, 12 bp, Unknown
  misc_feature (1)..( 12): Result.001 file - promoters70/3438236
taattgcttgca

SEQ ID NO: 85869 - DNA, 12 bp, Unknown
  misc_feature (1)..( 12): Result.001 file - promoters70/3438236
catttaattaga

SEQ ID NO: 85870 - DNA, 12 bp, Unknown
  misc_feature (1)..( 12): Result.001 file - promoters70/3438236
catataagtaag

SEQ ID NO: 85871 - DNA, 12 bp, Unknown
  misc_feature (1)..( 12): Result.001 file - promoters70/3438236
gctgctattgct

SEQ ID NO: 85872 - DNA, 14 bp, Unknown
  misc_feature (1)..( 14): Result.001 file - promoters70/3438236
taagtcttaagcac

SEQ ID NO: 85873 - DNA, 14 bp, Unknown
  misc_feature (1)..( 14): Result.001 file - promoters70/3438236
aatctcttaaaacc

SEQ ID NO: 85874 - DNA, 14 bp, Unknown
  misc_feature (1)..( 14): Result.001 file - promoters70/3438236
aatcccttaaaccc

SEQ ID NO: 85875 - DNA, 14 bp, Unknown
  misc_feature (1)..( 14): Result.001 file - promoters70/3438236
cgttatataaatcc

SEQ ID NO: 85876 - DNA, 14 bp, Unknown
  misc_feature (1)..( 14): Result.001 file - promoters70/3438236
ttatttatgaatcc

SEQ ID NO: 85877 - DNA, 14 bp, Unknown
  misc_feature (1)..( 14): Result.001 file - promoters70/3438236
acccttatattctt

SEQ ID NO: 85878 - DNA, 13 bp, Unknown
  misc_feature (1)..( 13): Result.001 file - promoters70/3438236
acactttttgttt

SEQ ID NO: 85879 - DNA, 13 bp, Unknown
  misc_feature (1)..( 13): Result.001 file - promoters70/3438236
gagcattttgttt

SEQ ID NO: 85880 - DNA, 13 bp, Unknown
  misc_feature (1)..( 13): Result.001 file - promoters70/3438236
gggctttttgatg

SEQ ID NO: 85881 - DNA, 13 bp, Unknown
  misc_feature (1)..( 13): Result.001 file - promoters70/3438236
gcgcttttccagt

SEQ ID NO: 85882 - DNA, 13 bp, Unknown
  misc_feature (1)..( 13): Result.001 file - promoters70/3438236
ttggtttttacaa

SEQ ID NO: 85883 - DNA, 13 bp, Unknown
  misc_feature (1)..( 13): Result.001 file - promoters70/3438512
agccatattgatt

SEQ ID NO: 85884 - DNA, 12 bp, Unknown
  misc_feature (1)..( 12): Result.001 file - promoters70/3438512
tttgcttacaat

SEQ ID NO: 85885 - DNA, 12 bp, Unknown
  misc_feature (1)..( 12): Result.001 file - promoters70/3438512
gttgtttatata

SEQ ID NO: 85886 - DNA, 12 bp, Unknown
  misc_feature (1)..( 12): Result.001 file - promoters70/3438512
tttgctgatgtt

SEQ ID NO: 85887 - DNA, 12 bp, Unknown
  misc_feature (1)..( 12): Result.001 file - promoters70/3438512
catgtttaatct

SEQ ID NO: 85888 - DNA, 12 bp, Unknown
  misc_feature (1)..( 12): Result.001 file - promoters70/3438512
gtagtttactct

SEQ ID NO: 85889 - DNA, 12 bp, Unknown
  misc_feature (1)..( 12): Result.001 file - promoters70/3438512
tgagttcataat

SEQ ID NO: 85890 - DNA, 8 bp, Unknown
  misc_feature (1)..( 8): Result.001 file - promoters70/3438512
caataaac

SEQ ID NO: 85891 - DNA, 8 bp, Unknown
  misc_feature (1)..( 8): Result.001 file - promoters70/3438512
aaataaaa

SEQ ID NO: 85892 - DNA, 8 bp, Unknown
  misc_feature (1)..( 8): Result.001 file - promoters70/3438512
caaaaaat

SEQ ID NO: 85893 - DNA, 8 bp, Unknown
  misc_feature (1)..( 8): Result.001 file - promoters70/3438512
gaaaaaaa

SEQ ID NO: 85894 - DNA, 9 bp, Unknown
  misc_feature (1)..( 9): Result.001 file - promoters70/3438512
caaaacaat

SEQ ID NO: 85895 - DNA, 9 bp, Unknown
  misc_feature (1)..( 9): Result.001 file - promoters70/3438512
caaataaca

SEQ ID NO: 85896 - DNA, 10 bp, Unknown
  misc_feature (1)..( 10): Result.001 file - promoters70/3438512
tttgtttgtt

SEQ ID NO: 85897 - DNA, 10 bp, Unknown
  misc_feature (1)..( 10): Result.001 file - promoters70/3438512
aatgtttgag

SEQ ID NO: 85898 - DNA, 10 bp, Unknown
  misc_feature (1)..( 10): Result.001 file - promoters70/3438512
tttattttcc

SEQ ID NO: 85899 - DNA, 10 bp, Unknown
  misc_feature (1)..( 10): Result.001 file - promoters70/3438512
tttattttta

SEQ ID NO: 85900 - DNA, 10 bp, Unknown
  misc_feature (1)..( 10): Result.001 file - promoters70/3438512
aatgtttgct

SEQ ID NO: 85901 - DNA, 10 bp, Unknown
  misc_feature (1)..( 10): Result.001 file - promoters70/3438512
aatgtgtgag

SEQ ID NO: 85902 - DNA, 13 bp, Unknown
  misc_feature (1)..( 13): Result.001 file - promoters70/3438512
atcggagaatatc

SEQ ID NO: 85903 - DNA, 13 bp, Unknown
  misc_feature (1)..( 13): Result.001 file - promoters70/3438512
tgacttaaatatc

SEQ ID NO: 85904 - DNA, 13 bp, Unknown
  misc_feature (1)..( 13): Result.001 file - promoters70/3438512
ttgttagaaaatc

SEQ ID NO: 85905 - DNA, 13 bp, Unknown
  misc_feature (1)..( 13): Result.001 file - promoters70/3438512
ctagaagaaaaaa

SEQ ID NO: 85906 - DNA, 13 bp, Unknown
  misc_feature (1)..( 13): Result.001 file - promoters70/3438512
gaagaagaaagac

SEQ ID NO: 85907 - DNA, 13 bp, Unknown
  misc_feature (1)..( 13): Result.001 file - promoters70/3438632
caagaagaaaaaa

SEQ ID NO: 85908 - DNA, 13 bp, Unknown
  misc_feature (1)..( 13): Result.001 file - promoters70/3438632
ataggcccaacaa

SEQ ID NO: 85909 - DNA, 13 bp, Unknown
  misc_feature (1)..( 13): Result.001 file - promoters70/3438632
aaaggcccaataa

SEQ ID NO: 85910 - DNA, 13 bp, Unknown
  misc_feature (1)..( 13): Result.001 file - promoters70/3438632
agaggcccatata

SEQ ID NO: 85911 - DNA, 13 bp, Unknown
  misc_feature (1)..( 13): Result.001 file - promoters70/3438632
taaagcccaataa

SEQ ID NO: 85912 - DNA, 13 bp, Unknown
  misc_feature (1)..( 13): Result.001 file - promoters70/3438632
agaggcccattta

SEQ ID NO: 85913 - DNA, 13 bp, Unknown
  misc_feature (1)..( 13): Result.001 file - promoters70/3438632
ggcaatttgaatg

SEQ ID NO: 85914 - DNA, 13 bp, Unknown
  misc_feature (1)..( 13): Result.001 file - promoters70/3438632
ataaatatgaatc

SEQ ID NO: 85915 - DNA, 13 bp, Unknown
  misc_feature (1)..( 13): Result.001 file - promoters70/3438632
tgtattatcaatg

SEQ ID NO: 85916 - DNA, 13 bp, Unknown
  misc_feature (1)..( 13): Result.001 file - promoters70/3438632
ttctttatcatca

SEQ ID NO: 85917 - DNA, 13 bp, Unknown
  misc_feature (1)..( 13): Result.001 file - promoters70/3438648
ttctttatcataa

SEQ ID NO: 85918 - DNA, 9 bp, Unknown
  misc_feature (1)..( 9): Result.001 file - promoters70/3438648
aaaaaatta

SEQ ID NO: 85919 - DNA, 9 bp, Unknown
  misc_feature (1)..( 9): Result.001 file - promoters70/3438648
aaataattc

SEQ ID NO: 85920 - DNA, 9 bp, Unknown
  misc_feature (1)..( 9): Result.001 file - promoters70/3438648
agaaaattc

SEQ ID NO: 85921 - DNA, 9 bp, Unknown
  misc_feature (1)..( 9): Result.001 file - promoters70/3438648
acttaattc

SEQ ID NO: 85922 - DNA, 9 bp, Unknown
  misc_feature (1)..( 9): Result.001 file - promoters70/3438648
tatattagt

SEQ ID NO: 85923 - DNA, 9 bp, Unknown
  misc_feature (1)..( 9): Result.001 file - promoters70/3438648
catatgagt

SEQ ID NO: 85924 - DNA, 9 bp, Unknown
  misc_feature (1)..( 9): Result.001 file - promoters70/3438648
aatatgatt

SEQ ID NO: 85925 - DNA, 9 bp, Unknown
  misc_feature (1)..( 9): Result.001 file - promoters70/3438648
aataggatt

SEQ ID NO: 85926 - DNA, 8 bp, Unknown
  misc_feature (1)..( 8): Result.001 file - promoters70/3438648
taatttac

SEQ ID NO: 85927 - DNA, 8 bp, Unknown
  misc_feature (1)..( 8): Result.001 file - promoters70/3438648
aaatttat

SEQ ID NO: 85928 - DNA, 8 bp, Unknown
  misc_feature (1)..( 8): Result.001 file - promoters70/3438648
aaaattac

SEQ ID NO: 85929 - DNA, 8 bp, Unknown
  misc_feature (1)..( 8): Result.001 file - promoters70/3438648
aaaaatac

SEQ ID NO: 85930 - DNA, 9 bp, Unknown
  misc_feature (1)..( 9): Result.001 file - promoters70/3438648
gaaaaaaat

SEQ ID NO: 85931 - DNA, 9 bp, Unknown
  misc_feature (1)..( 9): Result.001 file - promoters70/3438648
gaagaaaac

SEQ ID NO: 85932 - DNA, 9 bp, Unknown
  misc_feature (1)..( 9): Result.001 file - promoters70/3438648
taaaaaatt

SEQ ID NO: 85933 - DNA, 9 bp, Unknown
  misc_feature (1)..( 9): Result.001 file - promoters70/3438648
aatacaaac

SEQ ID NO: 85934 - DNA, 9 bp, Unknown
  misc_feature (1)..( 9): Result.001 file - promoters70/3438648
tataaaaac

SEQ ID NO: 85935 - DNA, 9 bp, Unknown
  misc_feature (1)..( 9): Result.001 file - promoters70/3438648
taaaaaaaa

SEQ ID NO: 85936 - DNA, 9 bp, Unknown
  misc_feature (1)..( 9): Result.001 file - promoters70/3438648
gaaaataaa

SEQ ID NO: 85937 - DNA, 9 bp, Unknown
  misc_feature (1)..( 9): Result.001 file - promoters70/3438648
taaaaaaca

SEQ ID NO: 85938 - DNA, 9 bp, Unknown
  misc_feature (1)..( 9): Result.001 file - promoters70/3438648
gaaaataca

SEQ ID NO: 85939 - DNA, 11 bp, Unknown
  misc_feature (1)..( 11): Result.001 file - promoters70/3438648
ttgaaaattta

SEQ ID NO: 85940 - DNA, 11 bp, Unknown
  misc_feature (1)..( 11): Result.001 file - promoters70/3438648
ttggaaagagc

SEQ ID NO: 85941 - DNA, 11 bp, Unknown
  misc_feature (1)..( 11): Result.001 file - promoters70/3438648
atgaaaattac

SEQ ID NO: 85942 - DNA, 11 bp, Unknown
  misc_feature (1)..( 11): Result.001 file - promoters70/3438648
ggaaaaaatac

SEQ ID NO: 85943 - DNA, 10 bp, Unknown
  misc_feature (1)..( 10): Result.001 file - promoters70/3438648
aaatacaaac

SEQ ID NO: 85944 - DNA, 10 bp, Unknown
  misc_feature (1)..( 10): Result.001 file - promoters70/3438648
aaacacaaac

SEQ ID NO: 85945 - DNA, 10 bp, Unknown
  misc_feature (1)..( 10): Result.001 file - promoters70/3438648
ttataaaaaa

SEQ ID NO: 85946 - DNA, 10 bp, Unknown
  misc_feature (1)..( 10): Result.001 file - promoters70/3438734
ttataaaaac

SEQ ID NO: 85947 - DNA, 11 bp, Unknown
  misc_feature (1)..( 11): Result.001 file - promoters70/3438734
gttagattttg

SEQ ID NO: 85948 - DNA, 11 bp, Unknown
  misc_feature (1)..( 11): Result.001 file - promoters70/3438734
gtttgatcatg

SEQ ID NO: 85949 - DNA, 11 bp, Unknown
  misc_feature (1)..( 11): Result.001 file - promoters70/3438946
tgttgatgatg

SEQ ID NO: 85950 - DNA, 9 bp, Unknown
  misc_feature (1)..( 9): Result.001 file - promoters70/3438946
ctttataat

SEQ ID NO: 85951 - DNA, 9 bp, Unknown
  misc_feature (1)..( 9): Result.001 file - promoters70/3438946
cattaaaat

SEQ ID NO: 85952 - DNA, 10 bp, Unknown
  misc_feature (1)..( 10): Result.001 file - promoters70/3439364
acttcataga

SEQ ID NO: 85953 - DNA, 14 bp, Unknown
  misc_feature (1)..( 14): Result.001 file - promoters70/3439364
ttttttttaacaaa

SEQ ID NO: 85954 - DNA, 14 bp, Unknown
  misc_feature (1)..( 14): Result.001 file - promoters70/3439364
gtgattttaaaaaa

SEQ ID NO: 85955 - DNA, 14 bp, Unknown
  misc_feature (1)..( 14): Result.001 file - promoters70/3439364
atatttttataaat

SEQ ID NO: 85956 - DNA, 14 bp, Unknown
  misc_feature (1)..( 14): Result.001 file - promoters70/3439364
atatatttaatcag

SEQ ID NO: 85957 - DNA, 7 bp, Unknown
  misc_feature (1)..( 7): Result.001 file - promoters70/3439364
ttaaatt

SEQ ID NO: 85958 - DNA, 7 bp, Unknown
  misc_feature (1)..( 7): Result.001 file - promoters70/3439364
ttatatt

SEQ ID NO: 85959 - DNA, 7 bp, Unknown
  misc_feature (1)..( 7): Result.001 file - promoters70/3439364
ttaaatg

SEQ ID NO: 85960 - DNA, 13 bp, Unknown
  misc_feature (1)..( 13): Result.001 file - promoters70/3439364
atctgtttttctt

SEQ ID NO: 85961 - DNA, 13 bp, Unknown
  misc_feature (1)..( 13): Result.001 file - promoters70/3439364
ttttgtatttatt

SEQ ID NO: 85962 - DNA, 13 bp, Unknown
  misc_feature (1)..( 13): Result.001 file - promoters70/3439364
ttttgaattcatt

SEQ ID NO: 85963 - DNA, 12 bp, Unknown
  misc_feature (1)..( 12): Result.001 file - promoters70/3439364
aatagtattttt

SEQ ID NO: 85964 - DNA, 12 bp, Unknown
  misc_feature (1)..( 12): Result.001 file - promoters70/3439364
acacatatattt

SEQ ID NO: 85965 - DNA, 12 bp, Unknown
  misc_feature (1)..( 12): Result.001 file - promoters70/3439364
acacagatatta

SEQ ID NO: 85966 - DNA, 11 bp, Unknown
  misc_feature (1)..( 11): Result.001 file - promoters70/3439364
tatataaactc

SEQ ID NO: 85967 - DNA, 11 bp, Unknown
  misc_feature (1)..( 11): Result.001 file - promoters70/3439364
tatatataagt

SEQ ID NO: 85968 - DNA, 11 bp, Unknown
  misc_feature (1)..( 11): Result.001 file - promoters70/3439364
tatatatactc

SEQ ID NO: 85969 - DNA, 9 bp, Unknown
  misc_feature (1)..( 9): Result.001 file - promoters70/3439364
gtatttaga

SEQ ID NO: 85970 - DNA, 9 bp, Unknown
  misc_feature (1)..( 9): Result.001 file - promoters70/3439364
atatttaat

SEQ ID NO: 85971 - DNA, 9 bp, Unknown
  misc_feature (1)..( 9): Result.001 file - promoters70/3439364
atattttta

SEQ ID NO: 85972 - DNA, 8 bp, Unknown
  misc_feature (1)..( 8): Result.001 file - promoters70/3439364
cacagttt

SEQ ID NO: 85973 - DNA, 8 bp, Unknown
  misc_feature (1)..( 8): Result.001 file - promoters70/3439364
aacagttt

SEQ ID NO: 85974 - DNA, 8 bp, Unknown
  misc_feature (1)..( 8): Result.001 file - promoters70/3439364
aacagtaa

SEQ ID NO: 85975 - DNA, 11 bp, Unknown
  misc_feature (1)..( 11): Result.001 file - promoters70/3439364
aaaaaaaaaat

SEQ ID NO: 85976 - DNA, 11 bp, Unknown
  misc_feature (1)..( 11): Result.001 file - promoters70/3439364
aaaaaaagaat

SEQ ID NO: 85977 - DNA, 11 bp, Unknown
  misc_feature (1)..( 11): Result.001 file - promoters70/3439364
gaatgaagaat

SEQ ID NO: 85978 - DNA, 13 bp, Unknown
  misc_feature (1)..( 13): Result.001 file - promoters70/3439364
aatagaatagtat

SEQ ID NO: 85979 - DNA, 13 bp, Unknown
  misc_feature (1)..( 13): Result.001 file - promoters70/3439364
acacagatattat

SEQ ID NO: 85980 - DNA, 13 bp, Unknown
  misc_feature (1)..( 13): Result.001 file - promoters70/3439364
acacatatatttc

SEQ ID NO: 85981 - DNA, 8 bp, Unknown
  misc_feature (1)..( 8): Result.001 file - promoters70/3439364
aataaaaa

SEQ ID NO: 85982 - DNA, 8 bp, Unknown
  misc_feature (1)..( 8): Result.001 file - promoters70/3439364
aattaaaa

SEQ ID NO: 85983 - DNA, 8 bp, Unknown
  misc_feature (1)..( 8): Result.001 file - promoters70/3439416
tataaaat

SEQ ID NO: 85984 - DNA, 15 bp, Unknown
  misc_feature (1)..( 15): Result.001 file - promoters70/3439416
gtagaagaaagaaac

SEQ ID NO: 85985 - DNA, 15 bp, Unknown
  misc_feature (1)..( 15): Result.001 file - promoters70/3439416
gagggagagagagag

SEQ ID NO: 85986 - DNA, 15 bp, Unknown
  misc_feature (1)..( 15): Result.001 file - promoters70/3439416
gattttgaaagaagg

SEQ ID NO: 85987 - DNA, 15 bp, Unknown
  misc_feature (1)..( 15): Result.001 file - promoters70/3439416
caagaagaaaaaaat

SEQ ID NO: 85988 - DNA, 15 bp, Unknown
  misc_feature (1)..( 15): Result.001 file - promoters70/3439416
cttagagacaaagta

SEQ ID NO: 85989 - DNA, 15 bp, Unknown
  misc_feature (1)..( 15): Result.001 file - promoters70/3439472
aaatggtaaataatt

SEQ ID NO: 85990 - DNA, 14 bp, Unknown
  misc_feature (1)..( 14): Result.001 file - promoters70/3439472
aaccctaattatct

SEQ ID NO: 85991 - DNA, 14 bp, Unknown
  misc_feature (1)..( 14): Result.001 file - promoters70/3439472
gtgattaattaatc

SEQ ID NO: 85992 - DNA, 14 bp, Unknown
  misc_feature (1)..( 14): Result.001 file - promoters70/3439472
ttttataaatattt

SEQ ID NO: 85993 - DNA, 14 bp, Unknown
  misc_feature (1)..( 14): Result.001 file - promoters70/3439472
attaataaattttg

SEQ ID NO: 85994 - DNA, 14 bp, Unknown
  misc_feature (1)..( 14): Result.001 file - promoters70/3439472
aataataactcttt

SEQ ID NO: 85995 - DNA, 14 bp, Unknown
  misc_feature (1)..( 14): Result.001 file - promoters70/3439472
tcaattaatctttt

SEQ ID NO: 85996 - DNA, 16 bp, Unknown
  misc_feature (1)..( 16): Result.001 file - promoters70/3439472
acaaatttttactttt

SEQ ID NO: 85997 - DNA, 16 bp, Unknown
  misc_feature (1)..( 16): Result.001 file - promoters70/3439472
tcaaacttttattttt

SEQ ID NO: 85998 - DNA, 16 bp, Unknown
  misc_feature (1)..( 16): Result.001 file - promoters70/3439472
ttaaatattttataaa

SEQ ID NO: 85999 - DNA, 16 bp, Unknown
  misc_feature (1)..( 16): Result.001 file - promoters70/3439472
gtttattgttacaaat

SEQ ID NO: 86000 - DNA, 16 bp, Unknown
  misc_feature (1)..( 16): Result.001 file - promoters70/3439472
acaagtttcctctacc

SEQ ID NO: 86001 - DNA, 16 bp, Unknown
  misc_feature (1)..( 16): Result.001 file - promoters70/3439472
aaaaagtttttgtaat

SEQ ID NO: 86002 - DNA, 12 bp, Unknown
  misc_feature (1)..( 12): Result.001 file - promoters70/3439472
agaaacaaagta

SEQ ID NO: 86003 - DNA, 12 bp, Unknown
  misc_feature (1)..( 12): Result.001 file - promoters70/3439472
cgaaccaatcag

SEQ ID NO: 86004 - DNA, 12 bp, Unknown
  misc_feature (1)..( 12): Result.001 file - promoters70/3439472
agaaaaaaaaaa

SEQ ID NO: 86005 - DNA, 12 bp, Unknown
  misc_feature (1)..( 12): Result.001 file - promoters70/3439472
agaaagaaataa

SEQ ID NO: 86006 - DNA, 12 bp, Unknown
  misc_feature (1)..( 12): Result.001 file - promoters70/3439472
tcaaaaaattat

SEQ ID NO: 86007 - DNA, 12 bp, Unknown
  misc_feature (1)..( 12): Result.001 file - promoters70/3439472
ataaatattcaa

SEQ ID NO: 86008 - DNA, 16 bp, Unknown
  misc_feature (1)..( 16): Result.001 file - promoters70/3439472
acataaattttttata

SEQ ID NO: 86009 - DNA, 16 bp, Unknown
  misc_feature (1)..( 16): Result.001 file - promoters70/3439472
tgtataattttatata

SEQ ID NO: 86010 - DNA, 16 bp, Unknown
  misc_feature (1)..( 16): Result.001 file - promoters70/3439472
tcggtcatttttggat

SEQ ID NO: 86011 - DNA, 16 bp, Unknown
  misc_feature (1)..( 16): Result.001 file - promoters70/3439472
gacctaagtttaagtt

SEQ ID NO: 86012 - DNA, 16 bp, Unknown
  misc_feature (1)..( 16): Result.001 file - promoters70/3439472
gttcaaactttcatct

SEQ ID NO: 86013 - DNA, 16 bp, Unknown
  misc_feature (1)..( 16): Result.001 file - promoters70/3439641
tacatcagttttaaag

SEQ ID NO: 86014 - DNA, 12 bp, Unknown
  misc_feature (1)..( 12): Result.001 file - promoters70/3439641
tgcatacgtttt

SEQ ID NO: 86015 - DNA, 12 bp, Unknown
  misc_feature (1)..( 12): Result.001 file - promoters70/3439641
aatcgtcgtttt

SEQ ID NO: 86016 - DNA, 12 bp, Unknown
  misc_feature (1)..( 12): Result.001 file - promoters70/3439641
gaaatatgtttc

SEQ ID NO: 86017 - DNA, 12 bp, Unknown
  misc_feature (1)..( 12): Result.001 file - promoters70/3439641
gaagtatgtgtt

SEQ ID NO: 86018 - DNA, 10 bp, Unknown
  misc_feature (1)..( 10): Result.001 file - promoters70/3439641
aaaaacatta

SEQ ID NO: 86019 - DNA, 10 bp, Unknown
  misc_feature (1)..( 10): Result.001 file - promoters70/3439641
aaagacaaag

SEQ ID NO: 86020 - DNA, 10 bp, Unknown
  misc_feature (1)..( 10): Result.001 file - promoters70/3439641
gaagacgaag

SEQ ID NO: 86021 - DNA, 9 bp, Unknown
  misc_feature (1)..( 9): Result.001 file - promoters70/3439641
gtccaaatt

SEQ ID NO: 86022 - DNA, 9 bp, Unknown
  misc_feature (1)..( 9): Result.001 file - promoters70/3439641
tggcaaatt

SEQ ID NO: 86023 - DNA, 9 bp, Unknown
  misc_feature (1)..( 9): Result.001 file - promoters70/3439641
gtccatatt

SEQ ID NO: 86024 - DNA, 10 bp, Unknown
  misc_feature (1)..( 10): Result.001 file - promoters70/3439641
gcccatattg

SEQ ID NO: 86025 - DNA, 10 bp, Unknown
  misc_feature (1)..( 10): Result.001 file - promoters70/3439641
gcccattaag

SEQ ID NO: 86026 - DNA, 10 bp, Unknown
  misc_feature (1)..( 10): Result.001 file - promoters70/3439641
gcccataaag

SEQ ID NO: 86027 - DNA, 11 bp, Unknown
  misc_feature (1)..( 11): Result.001 file - promoters70/3439641
ttttgtttcgt

SEQ ID NO: 86028 - DNA, 11 bp, Unknown
  misc_feature (1)..( 11): Result.001 file - promoters70/3439641
ttttgattcgt

SEQ ID NO: 86029 - DNA, 11 bp, Unknown
  misc_feature (1)..( 11): Result.001 file - promoters70/3439641
gtttgcttcga

SEQ ID NO: 86030 - DNA, 8 bp, Unknown
  misc_feature (1)..( 8): Result.001 file - promoters70/3439641
tatttcat

SEQ ID NO: 86031 - DNA, 8 bp, Unknown
  misc_feature (1)..( 8): Result.001 file - promoters70/3439641
tatttcat

SEQ ID NO: 86032 - DNA, 8 bp, Unknown
  misc_feature (1)..( 8): Result.001 file - promoters70/3439641
tatatcag

SEQ ID NO: 86033 - DNA, 7 bp, Unknown
  misc_feature (1)..( 7): Result.001 file - promoters70/3439641
aaatttt

SEQ ID NO: 86034 - DNA, 7 bp, Unknown
  misc_feature (1)..( 7): Result.001 file - promoters70/3439641
taatttt

SEQ ID NO: 86035 - DNA, 8 bp, Unknown
  misc_feature (1)..( 8): Result.001 file - promoters70/3593205
taatgttt

SEQ ID NO: 86036 - DNA, 11 bp, Unknown
  misc_feature (1)..( 11): Result.001 file - promoters70/3593205
aaatattttat

SEQ ID NO: 86037 - DNA, 11 bp, Unknown
  misc_feature (1)..( 11): Result.001 file - promoters70/3593205
acttattttat

SEQ ID NO: 86038 - DNA, 11 bp, Unknown
  misc_feature (1)..( 11): Result.001 file - promoters70/3593205
aactaatttag

SEQ ID NO: 86039 - DNA, 8 bp, Unknown
  misc_feature (1)..( 8): Result.001 file - promoters70/3593205
cctgaaac

SEQ ID NO: 86040 - DNA, 8 bp, Unknown
  misc_feature (1)..( 8): Result.001 file - promoters70/3593205
tatgaaac

SEQ ID NO: 86041 - DNA, 8 bp, Unknown
  misc_feature (1)..( 8): Result.001 file - promoters70/3593205
tatcaaac

SEQ ID NO: 86042 - DNA, 7 bp, Unknown
  misc_feature (1)..( 7): Result.001 file - promoters70/3593205
caaaatt

SEQ ID NO: 86043 - DNA, 7 bp, Unknown
  misc_feature (1)..( 7): Result.001 file - promoters70/3593205
aaaaatt

SEQ ID NO: 86044 - DNA, 8 bp, Unknown
  misc_feature (1)..( 8): Result.001 file - promoters70/3593205
taataatc

SEQ ID NO: 86045 - DNA, 7 bp, Unknown
  misc_feature (1)..( 7): Result.001 file - promoters70/3593205
aaaattc

SEQ ID NO: 86046 - DNA, 7 bp, Unknown
  misc_feature (1)..( 7): Result.001 file - promoters70/3593205
aaaattg

SEQ ID NO: 86047 - DNA, 7 bp, Unknown
  misc_feature (1)..( 7): Result.001 file - promoters70/3593205
caaattg

SEQ ID NO: 86048 - DNA, 7 bp, Unknown
  misc_feature (1)..( 7): Result.001 file - promoters70/3593205
aaacttc

SEQ ID NO: 86049 - DNA, 7 bp, Unknown
  misc_feature (1)..( 7): Result.001 file - promoters70/3593205
aaactta

SEQ ID NO: 86050 - DNA, 7 bp, Unknown
  misc_feature (1)..( 7): Result.001 file - promoters70/3593205
aaatttc

SEQ ID NO: 86051 - DNA, 13 bp, Unknown
  misc_feature (1)..( 13): Result.001 file - promoters70/3593205
aattggatccgaa

SEQ ID NO: 86052 - DNA, 13 bp, Unknown
  misc_feature (1)..( 13): Result.001 file - promoters70/3593205
aattagatttttt

SEQ ID NO: 86053 - DNA, 13 bp, Unknown
  misc_feature (1)..( 13): Result.001 file - promoters70/3593205
tattcgatctttt

SEQ ID NO: 86054 - DNA, 8 bp, Unknown
  misc_feature (1)..( 8): Result.001 file - promoters70/3593205
ttatccga

SEQ ID NO: 86055 - DNA, 8 bp, Unknown
  misc_feature (1)..( 8): Result.001 file - promoters70/3593205
ttatcctt

SEQ ID NO: 86056 - DNA, 8 bp, Unknown
  misc_feature (1)..( 8): Result.001 file - promoters70/3593205
ttattctt

SEQ ID NO: 86057 - DNA, 10 bp, Unknown
  misc_feature (1)..( 10): Result.001 file - promoters70/3593205
ttactttttt

SEQ ID NO: 86058 - DNA, 10 bp, Unknown
  misc_feature (1)..( 10): Result.001 file - promoters70/3593205
ttcgtttttt

SEQ ID NO: 86059 - DNA, 10 bp, Unknown
  misc_feature (1)..( 10): Result.001 file - promoters70/3593205
tacattttat

SEQ ID NO: 86060 - DNA, 8 bp, Unknown
  misc_feature (1)..( 8): Result.001 file - promoters70/3593205
tttataat

SEQ ID NO: 86061 - DNA, 8 bp, Unknown
  misc_feature (1)..( 8): Result.001 file - promoters70/3593205
tttttaat

SEQ ID NO: 86062 - DNA, 8 bp, Unknown
  misc_feature (1)..( 8): Result.001 file - promoters70/3593205
tttaaaat

SEQ ID NO: 86063 - DNA, 8 bp, Unknown
  misc_feature (1)..( 8): Result.001 file - promoters70/3593205
gttagaaa

SEQ ID NO: 86064 - DNA, 8 bp, Unknown
  misc_feature (1)..( 8): Result.001 file - promoters70/3593205
gttaaaaa

SEQ ID NO: 86065 - DNA, 8 bp, Unknown
  misc_feature (1)..( 8): Result.001 file - promoters70/3593205
cttataaa

SEQ ID NO: 86066 - DNA, 7 bp, Unknown
  misc_feature (1)..( 7): Result.001 file - promoters70/3593205
taaaaat

SEQ ID NO: 86067 - DNA, 7 bp, Unknown
  misc_feature (1)..( 7): Result.001 file - promoters70/3593205
taaaaag

SEQ ID NO: 86068 - DNA, 7 bp, Unknown
  misc_feature (1)..( 7): Result.001 file - promoters70/3593230
taataat

SEQ ID NO: 86069 - DNA, 8 bp, Unknown
  misc_feature (1)..( 8): Result.001 file - promoters70/3593230
cacattca

SEQ ID NO: 86070 - DNA, 8 bp, Unknown
  misc_feature (1)..( 8): Result.001 file - promoters70/3593230
gtcattca

SEQ ID NO: 86071 - DNA, 8 bp, Unknown
  misc_feature (1)..( 8): Result.001 file - promoters70/3593230
cacgttct

SEQ ID NO: 86072 - DNA, 8 bp, Unknown
  misc_feature (1)..( 8): Result.001 file - promoters70/3593230
tacatgtt

SEQ ID NO: 86073 - DNA, 8 bp, Unknown
  misc_feature (1)..( 8): Result.001 file - promoters70/3593230
ctttcttg

SEQ ID NO: 86074 - DNA, 8 bp, Unknown
  misc_feature (1)..( 8): Result.001 file - promoters70/3593230
tcttcttg

SEQ ID NO: 86075 - DNA, 8 bp, Unknown
  misc_feature (1)..( 8): Result.001 file - promoters70/3593230
tcttcttt

SEQ ID NO: 86076 - DNA, 7 bp, Unknown
  misc_feature (1)..( 7): Result.001 file - promoters70/3593230
catcaca

SEQ ID NO: 86077 - DNA, 7 bp, Unknown
  misc_feature (1)..( 7): Result.001 file - promoters70/3593230
gatcaca

SEQ ID NO: 86078 - DNA, 7 bp, Unknown
  misc_feature (1)..( 7): Result.001 file - promoters70/3597145
gattaca

SEQ ID NO: 86079 - DNA, 11 bp, Unknown
  misc_feature (1)..( 11): Result.001 file - promoters70/3597145
gaagaggaaga

SEQ ID NO: 86080 - DNA, 11 bp, Unknown
  misc_feature (1)..( 11): Result.001 file - promoters70/3597145
gaagaagaatt

SEQ ID NO: 86081 - DNA, 11 bp, Unknown
  misc_feature (1)..( 11): Result.001 file - promoters70/3597145
tcagaagaaaa

SEQ ID NO: 86082 - DNA, 11 bp, Unknown
  misc_feature (1)..( 11): Result.001 file - promoters70/3597145
gaagacgaaca

SEQ ID NO: 86083 - DNA, 11 bp, Unknown
  misc_feature (1)..( 11): Result.001 file - promoters70/3597145
taagaataaaa

SEQ ID NO: 86084 - DNA, 11 bp, Unknown
  misc_feature (1)..( 11): Result.001 file - promoters70/3597145
cgcgaggacca

SEQ ID NO: 86085 - DNA, 12 bp, Unknown
  misc_feature (1)..( 12): Result.001 file - promoters70/3597145
ctctgagatcgg

SEQ ID NO: 86086 - DNA, 12 bp, Unknown
  misc_feature (1)..( 12): Result.001 file - promoters70/3597145
aaatgaaatcat

SEQ ID NO: 86087 - DNA, 12 bp, Unknown
  misc_feature (1)..( 12): Result.001 file - promoters70/3597145
aaatgaaatttc

SEQ ID NO: 86088 - DNA, 12 bp, Unknown
  misc_feature (1)..( 12): Result.001 file - promoters70/3597145
gagaaaaaacat

SEQ ID NO: 86089 - DNA, 12 bp, Unknown
  misc_feature (1)..( 12): Result.001 file - promoters70/3597145
caattaaaataa

SEQ ID NO: 86090 - DNA, 12 bp, Unknown
  misc_feature (1)..( 12): Result.001 file - promoters70/3597145
gtatgaaacgaa

SEQ ID NO: 86091 - DNA, 12 bp, Unknown
  misc_feature (1)..( 12): Result.001 file - promoters70/3597145
aaatgaatggag

SEQ ID NO: 86092 - DNA, 12 bp, Unknown
  misc_feature (1)..( 12): Result.001 file - promoters70/3597175
tggtgatatttt

SEQ ID NO: 86093 - DNA, 8 bp, Unknown
  misc_feature (1)..( 8): Result.001 file - promoters70/3597175
gctctata

SEQ ID NO: 86094 - DNA, 8 bp, Unknown
  misc_feature (1)..( 8): Result.001 file - promoters70/3597175
gctatata

SEQ ID NO: 86095 - DNA, 8 bp, Unknown
  misc_feature (1)..( 8): Result.001 file - promoters70/4254434
actctatg

SEQ ID NO: 86096 - DNA, 8 bp, Unknown
  misc_feature (1)..( 8): Result.001 file - promoters70/4254434
tttagatt

SEQ ID NO: 86097 - DNA, 8 bp, Unknown
  misc_feature (1)..( 8): Result.001 file - promoters70/4254434
tttagaga

SEQ ID NO: 86098 - DNA, 8 bp, Unknown
  misc_feature (1)..( 8): Result.001 file - promoters70/4254434
attaaatt

SEQ ID NO: 86099 - DNA, 11 bp, Unknown
  misc_feature (1)..( 11): Result.001 file - promoters70/4254434
agatttagata

SEQ ID NO: 86100 - DNA, 11 bp, Unknown
  misc_feature (1)..( 11): Result.001 file - promoters70/4254434
agattttgatt

SEQ ID NO: 86101 - DNA, 11 bp, Unknown
  misc_feature (1)..( 11): Result.001 file - promoters70/4262420
ttcattaaatt

SEQ ID NO: 86102 - DNA, 10 bp, Unknown
  misc_feature (1)..( 10): Result.001 file - promoters70/4262420
cctattggtt

SEQ ID NO: 86103 - DNA, 10 bp, Unknown
  misc_feature (1)..( 10): Result.001 file - promoters70/4262420
tctaatggtt

SEQ ID NO: 86104 - DNA, 10 bp, Unknown
  misc_feature (1)..( 10): Result.001 file - promoters70/4262420
cctattgaca

SEQ ID NO: 86105 - DNA, 6 bp, Unknown
  misc_feature (1)..( 6): Result.001 file - promoters70/4262420
tgggat

SEQ ID NO: 86106 - DNA, 6 bp, Unknown
  misc_feature (1)..( 6): Result.001 file - promoters70/4262420
tgggat

SEQ ID NO: 86107 - DNA, 6 bp, Unknown
  misc_feature (1)..( 6): Result.001 file - promoters70/4262422
tgggat

SEQ ID NO: 86108 - DNA, 9 bp, Unknown
  misc_feature (1)..( 9): Result.001 file - promoters70/4262422
ttgtaattt

SEQ ID NO: 86109 - DNA, 9 bp, Unknown
  misc_feature (1)..( 9): Result.001 file - promoters70/4262422
ttgtagttt

SEQ ID NO: 86110 - DNA, 9 bp, Unknown
  misc_feature (1)..( 9): Result.001 file - promoters70/4262422
ttgtatttt

SEQ ID NO: 86111 - DNA, 7 bp, Unknown
  misc_feature (1)..( 7): Result.001 file - promoters70/4262422
accaaat

SEQ ID NO: 86112 - DNA, 7 bp, Unknown
  misc_feature (1)..( 7): Result.001 file - promoters70/4262422
accaaag

SEQ ID NO: 86113 - DNA, 7 bp, Unknown
  misc_feature (1)..( 7): Result.001 file - promoters70/4262422
gccaaag

SEQ ID NO: 86114 - DNA, 8 bp, Unknown
  misc_feature (1)..( 8): Result.001 file - promoters70/4262422
tagtgtta

SEQ ID NO: 86115 - DNA, 8 bp, Unknown
  misc_feature (1)..( 8): Result.001 file - promoters70/4262422
tagagttc

SEQ ID NO: 86116 - DNA, 8 bp, Unknown
  misc_feature (1)..( 8): Result.001 file - promoters70/4262422
tagtttta

SEQ ID NO: 86117 - DNA, 7 bp, Unknown
  misc_feature (1)..( 7): Result.001 file - promoters70/4262422
gattaga

SEQ ID NO: 86118 - DNA, 7 bp, Unknown
  misc_feature (1)..( 7): Result.001 file - promoters70/4262422
gataaga

SEQ ID NO: 86119 - DNA, 7 bp, Unknown
  misc_feature (1)..( 7): Result.001 file - promoters70/4262422
gataagt

SEQ ID NO: 86120 - DNA, 12 bp, Unknown
  misc_feature (1)..( 12): Result.001 file - promoters70/4262422
taatttcatttg

SEQ ID NO: 86121 - DNA, 12 bp, Unknown
  misc_feature (1)..( 12): Result.001 file - promoters70/4262422
taatttaatttg

SEQ ID NO: 86122 - DNA, 12 bp, Unknown
  misc_feature (1)..( 12): Result.001 file - promoters70/4262428
tggtttaatcat

SEQ ID NO: 86123 - DNA, 8 bp, Unknown
  misc_feature (1)..( 8): Result.001 file - promoters70/4262428
atgttaac

SEQ ID NO: 86124 - DNA, 8 bp, Unknown
  misc_feature (1)..( 8): Result.001 file - promoters70/4262428
atgttaaa

SEQ ID NO: 86125 - DNA, 8 bp, Unknown
  misc_feature (1)..( 8): Result.001 file - promoters70/4262428
ttgttaac

SEQ ID NO: 86126 - DNA, 7 bp, Unknown
  misc_feature (1)..( 7): Result.001 file - promoters70/4262428
attaaat

SEQ ID NO: 86127 - DNA, 7 bp, Unknown
  misc_feature (1)..( 7): Result.001 file - promoters70/4262428
attaaat

SEQ ID NO: 86128 - DNA, 7 bp, Unknown
  misc_feature (1)..( 7): Result.001 file - promoters70/4262428
attaaat

SEQ ID NO: 86129 - DNA, 9 bp, Unknown
  misc_feature (1)..( 9): Result.001 file - promoters70/4262428
ccattaaag

SEQ ID NO: 86130 - DNA, 9 bp, Unknown
  misc_feature (1)..( 9): Result.001 file - promoters70/4262428
ccaataaag

SEQ ID NO: 86131 - DNA, 9 bp, Unknown
  misc_feature (1)..( 9): Result.001 file - promoters70/4262428
taattgaag

SEQ ID NO: 86132 - DNA, 9 bp, Unknown
  misc_feature (1)..( 9): Result.001 file - promoters70/4262428
ttctttctt

SEQ ID NO: 86133 - DNA, 9 bp, Unknown
  misc_feature (1)..( 9): Result.001 file - promoters70/4262428
ttctctctt

SEQ ID NO: 86134 - DNA, 9 bp, Unknown
  misc_feature (1)..( 9): Result.001 file - promoters70/4262428
ttctttgtg

SEQ ID NO: 86135 - DNA, 7 bp, Unknown
  misc_feature (1)..( 7): Result.001 file - promoters70/4262428
tatttaa

SEQ ID NO: 86136 - DNA, 7 bp, Unknown
  misc_feature (1)..( 7): Result.001 file - promoters70/4262428
tatataa

SEQ ID NO: 86137 - DNA, 7 bp, Unknown
  misc_feature (1)..( 7): Result.001 file - promoters70/4262428
aatataa

SEQ ID NO: 86138 - DNA, 9 bp, Unknown
  misc_feature (1)..( 9): Result.001 file - promoters70/4262428
cataaatag

SEQ ID NO: 86139 - DNA, 9 bp, Unknown
  misc_feature (1)..( 9): Result.001 file - promoters70/4262428
tataaatgt

SEQ ID NO: 86140 - DNA, 9 bp, Unknown
  misc_feature (1)..( 9): Result.001 file - promoters70/4267125
aataaaaat

SEQ ID NO: 86141 - DNA, 8 bp, Unknown
  misc_feature (1)..( 8): Result.001 file - promoters70/4267125
cgatttgt

SEQ ID NO: 86142 - DNA, 8 bp, Unknown
  misc_feature (1)..( 8): Result.001 file - promoters70/4267125
ttatttgt

SEQ ID NO: 86143 - DNA, 8 bp, Unknown
  misc_feature (1)..( 8): Result.001 file - promoters70/4270131
ttacttga

SEQ ID NO: 86144 - DNA, 8 bp, Unknown
  misc_feature (1)..( 8): Result.001 file - promoters70/4270131
ttaataac

SEQ ID NO: 86145 - DNA, 8 bp, Unknown
  misc_feature (1)..( 8): Result.001 file - promoters70/4270131
ttaataac

SEQ ID NO: 86146 - DNA, 8 bp, Unknown
  misc_feature (1)..( 8): Result.001 file - promoters70/4281662
ataataat

SEQ ID NO: 86147 - DNA, 10 bp, Unknown
  misc_feature (1)..( 10): Result.001 file - promoters70/4281662
actttttaaa

SEQ ID NO: 86148 - DNA, 10 bp, Unknown
  misc_feature (1)..( 10): Result.001 file - promoters70/4281662
actttataat

SEQ ID NO: 86149 - DNA, 10 bp, Unknown
  misc_feature (1)..( 10): Result.001 file - promoters70/4281662
acattaaaat

SEQ ID NO: 86150 - DNA, 10 bp, Unknown
  misc_feature (1)..( 10): Result.001 file - promoters70/4281662
acttcataga

SEQ ID NO: 86151 - DNA, 8 bp, Unknown
  misc_feature (1)..( 8): Result.001 file - promoters70/4281662
aagataat

SEQ ID NO: 86152 - DNA, 8 bp, Unknown
  misc_feature (1)..( 8): Result.001 file - promoters70/4281662
aagatagt

SEQ ID NO: 86153 - DNA, 8 bp, Unknown
  misc_feature (1)..( 8): Result.001 file - promoters70/4281662
aagaaagt

SEQ ID NO: 86154 - DNA, 8 bp, Unknown
  misc_feature (1)..( 8): Result.001 file - promoters70/4281662
attttgtg

SEQ ID NO: 86155 - DNA, 8 bp, Unknown
  misc_feature (1)..( 8): Result.001 file - promoters70/4281662
attatgtc

SEQ ID NO: 86156 - DNA, 8 bp, Unknown
  misc_feature (1)..( 8): Result.001 file - promoters70/4281662
cttatgtc

SEQ ID NO: 86157 - DNA, 9 bp, Unknown
  misc_feature (1)..( 9): Result.001 file - promoters70/4281662
ttttaaaat

SEQ ID NO: 86158 - DNA, 9 bp, Unknown
  misc_feature (1)..( 9): Result.001 file - promoters70/4281662
cattaaaat

SEQ ID NO: 86159 - DNA, 9 bp, Unknown
  misc_feature (1)..( 9): Result.001 file - promoters70/4281662
ctttataat

SEQ ID NO: 86160 - DNA, 10 bp, Unknown
  misc_feature (1)..( 10): Result.001 file - promoters70/4281662
acttcataga

SEQ ID NO: 86161 - DNA, 7 bp, Unknown
  misc_feature (1)..( 7): Result.001 file - promoters70/4281662
tccattg

SEQ ID NO: 86162 - DNA, 7 bp, Unknown
  misc_feature (1)..( 7): Result.001 file - promoters70/4281662
tccattt

SEQ ID NO: 86163 - DNA, 7 bp, Unknown
  misc_feature (1)..( 7): Result.001 file - promoters70/4281711
accattt

SEQ ID NO: 86164 - DNA, 7 bp, Unknown
  misc_feature (1)..( 7): Result.001 file - promoters70/4281711
taataaa

SEQ ID NO: 86165 - DNA, 7 bp, Unknown
  misc_feature (1)..( 7): Result.001 file - promoters70/4281711
gaataaa

SEQ ID NO: 86166 - DNA, 7 bp, Unknown
  misc_feature (1)..( 7): Result.001 file - promoters70/4281744
gaagaaa

SEQ ID NO: 86167 - DNA, 7 bp, Unknown
  misc_feature (1)..( 7): Result.001 file - promoters70/4281744
aatttac

SEQ ID NO: 86168 - DNA, 7 bp, Unknown
  misc_feature (1)..( 7): Result.001 file - promoters70/4281744
aatctac

SEQ ID NO: 86169 - DNA, 7 bp, Unknown
  misc_feature (1)..( 7): Result.001 file - promoters70/4281744
aatttat

SEQ ID NO: 86170 - DNA, 11 bp, Unknown
  misc_feature (1)..( 11): Result.001 file - promoters70/4281744
aaaatagtaaa

SEQ ID NO: 86171 - DNA, 11 bp, Unknown
  misc_feature (1)..( 11): Result.001 file - promoters70/4281744
ataattgtata

SEQ ID NO: 86172 - DNA, 11 bp, Unknown
  misc_feature (1)..( 11): Result.001 file - promoters70/4281744
atatttgtata

SEQ ID NO: 86173 - DNA, 10 bp, Unknown
  misc_feature (1)..( 10): Result.001 file - promoters70/4281744
gaaaaagata

SEQ ID NO: 86174 - DNA, 10 bp, Unknown
  misc_feature (1)..( 10): Result.001 file - promoters70/4281744
gaaatagatt

SEQ ID NO: 86175 - DNA, 10 bp, Unknown
  misc_feature (1)..( 10): Result.001 file - promoters70/4281744
ttagtagatt

SEQ ID NO: 86176 - DNA, 10 bp, Unknown
  misc_feature (1)..( 10): Result.001 file - promoters70/4281744
tatataaatt

SEQ ID NO: 86177 - DNA, 8 bp, Unknown
  misc_feature (1)..( 8): Result.001 file - promoters70/4281744
aaggtata

SEQ ID NO: 86178 - DNA, 8 bp, Unknown
  misc_feature (1)..( 8): Result.001 file - promoters70/4281744
aagctata

SEQ ID NO: 86179 - DNA, 8 bp, Unknown
  misc_feature (1)..( 8): Result.001 file - promoters70/4281744
cagcaata

SEQ ID NO: 86180 - DNA, 9 bp, Unknown
  misc_feature (1)..( 9): Result.001 file - promoters70/4281744
ttactaaaa

SEQ ID NO: 86181 - DNA, 9 bp, Unknown
  misc_feature (1)..( 9): Result.001 file - promoters70/4281744
ttattaatt

SEQ ID NO: 86182 - DNA, 9 bp, Unknown
  misc_feature (1)..( 9): Result.001 file - promoters70/4281773
gtataaatt

SEQ ID NO: 86183 - DNA, 11 bp, Unknown
  misc_feature (1)..( 11): Result.001 file - promoters70/4281773
ctgaattggaa

SEQ ID NO: 86184 - DNA, 11 bp, Unknown
  misc_feature (1)..( 11): Result.001 file - promoters70/4281773
atgatttgctt

SEQ ID NO: 86185 - DNA, 11 bp, Unknown
  misc_feature (1)..( 11): Result.001 file - promoters70/4281773
aagaattgacc

SEQ ID NO: 86186 - DNA, 11 bp, Unknown
  misc_feature (1)..( 11): Result.001 file - promoters70/4281773
agtattagctt

SEQ ID NO: 86187 - DNA, 11 bp, Unknown
  misc_feature (1)..( 11): Result.001 file - promoters70/4281925
aagtattgtgg

SEQ ID NO: 86188 - DNA, 11 bp, Unknown
  misc_feature (1)..( 11): Result.001 file - promoters70/4281925
aaattaaaaca

SEQ ID NO: 86189 - DNA, 11 bp, Unknown
  misc_feature (1)..( 11): Result.001 file - promoters70/4281925
aaaataacaca

SEQ ID NO: 86190 - DNA, 11 bp, Unknown
  misc_feature (1)..( 11): Result.001 file - promoters70/4281925
gcaataaaaat

SEQ ID NO: 86191 - DNA, 8 bp, Unknown
  misc_feature (1)..( 8): Result.001 file - promoters70/4281925
taattttt

SEQ ID NO: 86192 - DNA, 8 bp, Unknown
  misc_feature (1)..( 8): Result.001 file - promoters70/4281925
taaatttt

SEQ ID NO: 86193 - DNA, 8 bp, Unknown
  misc_feature (1)..( 8): Result.001 file - promoters70/4281925
aaattttg

SEQ ID NO: 86194 - DNA, 14 bp, Unknown
  misc_feature (1)..( 14): Result.001 file - promoters70/4281925
aatttataaatgta

SEQ ID NO: 86195 - DNA, 14 bp, Unknown
  misc_feature (1)..( 14): Result.001 file - promoters70/4281925
aatttacatatcta

SEQ ID NO: 86196 - DNA, 14 bp, Unknown
  misc_feature (1)..( 14): Result.001 file - promoters70/4281997
attttacttttcat

SEQ ID NO: 86197 - DNA, 6 bp, Unknown
  misc_feature (1)..( 6): Result.001 file - promoters70/4281997
attatc

SEQ ID NO: 86198 - DNA, 6 bp, Unknown
  misc_feature (1)..( 6): Result.001 file - promoters70/4281997
attatc

SEQ ID NO: 86199 - DNA, 6 bp, Unknown
  misc_feature (1)..( 6): Result.001 file - promoters70/4282316
attatc

SEQ ID NO: 86200 - DNA, 7 bp, Unknown
  misc_feature (1)..( 7): Result.001 file - promoters70/4282316
aattatc

SEQ ID NO: 86201 - DNA, 7 bp, Unknown
  misc_feature (1)..( 7): Result.001 file - promoters70/4282316
cattatc

SEQ ID NO: 86202 - DNA, 7 bp, Unknown
  misc_feature (1)..( 7): Result.001 file - promoters70/4282316
cattata

SEQ ID NO: 86203 - DNA, 9 bp, Unknown
  misc_feature (1)..( 9): Result.001 file - promoters70/4282316
aaaagttta

SEQ ID NO: 86204 - DNA, 9 bp, Unknown
  misc_feature (1)..( 9): Result.001 file - promoters70/4282316
aaatgtttt

SEQ ID NO: 86205 - DNA, 9 bp, Unknown
  misc_feature (1)..( 9): Result.001 file - promoters70/4282418
caatatttt

SEQ ID NO: 86206 - DNA, 9 bp, Unknown
  misc_feature (1)..( 9): Result.001 file - promoters70/4282418
aaactaaaa

SEQ ID NO: 86207 - DNA, 9 bp, Unknown
  misc_feature (1)..( 9): Result.001 file - promoters70/4282418
aaaataaaa

SEQ ID NO: 86208 - DNA, 9 bp, Unknown
  misc_feature (1)..( 9): Result.001 file - promoters70/4282503
aaagtaaac

SEQ ID NO: 86209 - DNA, 7 bp, Unknown
  misc_feature (1)..( 7): Result.001 file - promoters70/4282503
taaaatt

SEQ ID NO: 86210 - DNA, 7 bp, Unknown
  misc_feature (1)..( 7): Result.001 file - promoters70/4282503
taaaatc

SEQ ID NO: 86211 - DNA, 7 bp, Unknown
  misc_feature (1)..( 7): Result.001 file - promoters70/4282503
caaaatc

SEQ ID NO: 86212 - DNA, 10 bp, Unknown
  misc_feature (1)..( 10): Result.001 file - promoters70/4282503
tttgaatgcc

SEQ ID NO: 86213 - DNA, 10 bp, Unknown
  misc_feature (1)..( 10): Result.001 file - promoters70/4282503
ttttaataac

SEQ ID NO: 86214 - DNA, 10 bp, Unknown
  misc_feature (1)..( 10): Result.001 file - promoters70/4282503
ttttactaac

SEQ ID NO: 86215 - DNA, 11 bp, Unknown
  misc_feature (1)..( 11): Result.001 file - promoters70/4282503
ccaattatatg

SEQ ID NO: 86216 - DNA, 11 bp, Unknown
  misc_feature (1)..( 11): Result.001 file - promoters70/4282503
tttattaaatg

SEQ ID NO: 86217 - DNA, 11 bp, Unknown
  misc_feature (1)..( 11): Result.001 file - promoters70/4282667
tttactaactt

SEQ ID NO: 86218 - DNA, 8 bp, Unknown
  misc_feature (1)..( 8): Result.001 file - promoters70/4282667
aatgggct

SEQ ID NO: 86219 - DNA, 8 bp, Unknown
  misc_feature (1)..( 8): Result.001 file - promoters70/4282667
aataggcc

SEQ ID NO: 86220 - DNA, 8 bp, Unknown
  misc_feature (1)..( 8): Result.001 file - promoters70/4282667
tatgggcc

SEQ ID NO: 86221 - DNA, 8 bp, Unknown
  misc_feature (1)..( 8): Result.001 file - promoters70/4282667
aatgggcc

SEQ ID NO: 86222 - DNA, 8 bp, Unknown
  misc_feature (1)..( 8): Result.001 file - promoters70/4282667
aatgggtc

SEQ ID NO: 86223 - DNA, 8 bp, Unknown
  misc_feature (1)..( 8): Result.001 file - promoters70/4282667
tttgggcc

SEQ ID NO: 86224 - DNA, 12 bp, Unknown
  misc_feature (1)..( 12): Result.001 file - promoters70/4282667
attgttacaaat

SEQ ID NO: 86225 - DNA, 12 bp, Unknown
  misc_feature (1)..( 12): Result.001 file - promoters70/4282667
atttttactttt

SEQ ID NO: 86226 - DNA, 12 bp, Unknown
  misc_feature (1)..( 12): Result.001 file - promoters70/4282667
tttgttagttca

SEQ ID NO: 86227 - DNA, 12 bp, Unknown
  misc_feature (1)..( 12): Result.001 file - promoters70/4282667
attgataggtgc

SEQ ID NO: 86228 - DNA, 12 bp, Unknown
  misc_feature (1)..( 12): Result.001 file - promoters70/4282667
gactttagtttt

SEQ ID NO: 86229 - DNA, 12 bp, Unknown
  misc_feature (1)..( 12): Result.001 file - promoters70/4282667
tttgtttttgat

SEQ ID NO: 86230 - DNA, 10 bp, Unknown
  misc_feature (1)..( 10): Result.001 file - promoters70/4282667
attcaactat

SEQ ID NO: 86231 - DNA, 10 bp, Unknown
  misc_feature (1)..( 10): Result.001 file - promoters70/4282667
attcaaaaag

SEQ ID NO: 86232 - DNA, 10 bp, Unknown
  misc_feature (1)..( 10): Result.001 file - promoters70/4282667
gttcaaaaaa

SEQ ID NO: 86233 - DNA, 10 bp, Unknown
  misc_feature (1)..( 10): Result.001 file - promoters70/4282667
aaaaaaaaaa

SEQ ID NO: 86234 - DNA, 10 bp, Unknown
  misc_feature (1)..( 10): Result.001 file - promoters70/4282667
gttcgaaaga

SEQ ID NO: 86235 - DNA, 10 bp, Unknown
  misc_feature (1)..( 10): Result.001 file - promoters70/4282788
aaacaaagta

SEQ ID NO: 86236 - DNA, 8 bp, Unknown
  misc_feature (1)..( 8): Result.001 file - promoters70/4282788
gttgcttt

SEQ ID NO: 86237 - DNA, 8 bp, Unknown
  misc_feature (1)..( 8): Result.001 file - promoters70/4282788
tttgattt

SEQ ID NO: 86238 - DNA, 8 bp, Unknown
  misc_feature (1)..( 8): Result.001 file - promoters70/4283003
tttgattg

SEQ ID NO: 86239 - DNA, 11 bp, Unknown
  misc_feature (1)..( 11): Result.001 file - promoters70/4283003
aataatttgta

SEQ ID NO: 86240 - DNA, 11 bp, Unknown
  misc_feature (1)..( 11): Result.001 file - promoters70/4283003
aatattttagg

SEQ ID NO: 86241 - DNA, 11 bp, Unknown
  misc_feature (1)..( 11): Result.001 file - promoters70/4283240
aattattggta

SEQ ID NO: 86242 - DNA, 8 bp, Unknown
  misc_feature (1)..( 8): Result.001 file - promoters70/4283240
tcaagatt

SEQ ID NO: 86243 - DNA, 8 bp, Unknown
  misc_feature (1)..( 8): Result.001 file - promoters70/4283240
tcatgatg

SEQ ID NO: 86244 - DNA, 8 bp, Unknown
  misc_feature (1)..( 8): Result.001 file - promoters70/4283240
acaaaatt

SEQ ID NO: 86245 - DNA, 10 bp, Unknown
  misc_feature (1)..( 10): Result.001 file - promoters70/4283240
gaattgatat

SEQ ID NO: 86246 - DNA, 10 bp, Unknown
  misc_feature (1)..( 10): Result.001 file - promoters70/4283240
aaattgatat

SEQ ID NO: 86247 - DNA, 10 bp, Unknown
  misc_feature (1)..( 10): Result.001 file - promoters70/4283293
aaattgtagg

SEQ ID NO: 86248 - DNA, 8 bp, Unknown
  misc_feature (1)..( 8): Result.001 file - promoters70/4283293
tttctttc

SEQ ID NO: 86249 - DNA, 8 bp, Unknown
  misc_feature (1)..( 8): Result.001 file - promoters70/4283293
tttatttc

SEQ ID NO: 86250 - DNA, 8 bp, Unknown
  misc_feature (1)..( 8): Result.001 file - promoters70/4283293
cttatttt

SEQ ID NO: 86251 - DNA, 7 bp, Unknown
  misc_feature (1)..( 7): Result.001 file - promoters70/4283293
aatttaa

SEQ ID NO: 86252 - DNA, 7 bp, Unknown
  misc_feature (1)..( 7): Result.001 file - promoters70/4283293
tatttaa

SEQ ID NO: 86253 - DNA, 7 bp, Unknown
  misc_feature (1)..( 7): Result.001 file - promoters70/4283297
tatttaa

SEQ ID NO: 86254 - DNA, 13 bp, Unknown
  misc_feature (1)..( 13): Result.001 file - promoters70/4283297
aattaaataaata

SEQ ID NO: 86255 - DNA, 13 bp, Unknown
  misc_feature (1)..( 13): Result.001 file - promoters70/4283297
aataaaaatggaa

SEQ ID NO: 86256 - DNA, 13 bp, Unknown
  misc_feature (1)..( 13): Result.001 file - promoters70/4283338
cataaacatggaa

SEQ ID NO: 86257 - DNA, 7 bp, Unknown
  misc_feature (1)..( 7): Result.001 file - promoters70/4283338
taagcca

SEQ ID NO: 86258 - DNA, 7 bp, Unknown
  misc_feature (1)..( 7): Result.001 file - promoters70/4283338
aaagcca

SEQ ID NO: 86259 - DNA, 7 bp, Unknown
  misc_feature (1)..( 7): Result.001 file - promoters70/4283355
aaagccc

SEQ ID NO: 86260 - DNA, 12 bp, Unknown
  misc_feature (1)..( 12): Result.001 file - promoters70/4283355
ccatcgaattca

SEQ ID NO: 86261 - DNA, 12 bp, Unknown
  misc_feature (1)..( 12): Result.001 file - promoters70/4283355
aaatcaaatcga

SEQ ID NO: 86262 - DNA, 12 bp, Unknown
  misc_feature (1)..( 12): Result.001 file - promoters70/4283355
cagtcaaatata

SEQ ID NO: 86263 - DNA, 12 bp, Unknown
  misc_feature (1)..( 12): Result.001 file - promoters70/4283355
aaaccaaagaaa

SEQ ID NO: 86264 - DNA, 12 bp, Unknown
  misc_feature (1)..( 12): Result.001 file - promoters70/4283355
aagtaaaaaagt

SEQ ID NO: 86265 - DNA, 12 bp, Unknown
  misc_feature (1)..( 12): Result.001 file - promoters70/4283378
tgtacaaggaaa

SEQ ID NO: 86266 - DNA, 8 bp, Unknown
  misc_feature (1)..( 8): Result.001 file - promoters70/4283378
tatataat

SEQ ID NO: 86267 - DNA, 8 bp, Unknown
  misc_feature (1)..( 8): Result.001 file - promoters70/4283378
tatataaa

SEQ ID NO: 86268 - DNA, 8 bp, Unknown
  misc_feature (1)..( 8): Result.001 file - promoters70/4283378
tatataaa

SEQ ID NO: 86269 - DNA, 8 bp, Unknown
  misc_feature (1)..( 8): Result.001 file - promoters70/4283378
tttataaa

SEQ ID NO: 86270 - DNA, 8 bp, Unknown
  misc_feature (1)..( 8): Result.001 file - promoters70/4283378
cctataaa

SEQ ID NO: 86271 - DNA, 10 bp, Unknown
  misc_feature (1)..( 10): Result.001 file - promoters70/4283378
tgaatgtata

SEQ ID NO: 86272 - DNA, 10 bp, Unknown
  misc_feature (1)..( 10): Result.001 file - promoters70/4283378
ataatgtaaa

SEQ ID NO: 86273 - DNA, 10 bp, Unknown
  misc_feature (1)..( 10): Result.001 file - promoters70/4283378
tcgatgtata

SEQ ID NO: 86274 - DNA, 10 bp, Unknown
  misc_feature (1)..( 10): Result.001 file - promoters70/4283378
tgaatgtcaa

SEQ ID NO: 86275 - DNA, 15 bp, Unknown
  misc_feature (1)..( 15): Result.001 file - promoters70/4283378
tatacgttttaaaag

SEQ ID NO: 86276 - DNA, 15 bp, Unknown
  misc_feature (1)..( 15): Result.001 file - promoters70/4283378
aacaatttttaaatt

SEQ ID NO: 86277 - DNA, 15 bp, Unknown
  misc_feature (1)..( 15): Result.001 file - promoters70/4283378
atatctttataagta

SEQ ID NO: 86278 - DNA, 15 bp, Unknown
  misc_feature (1)..( 15): Result.001 file - promoters70/4283378
ctcgcttcataacaa

SEQ ID NO: 86279 - DNA, 15 bp, Unknown
  misc_feature (1)..( 15): Result.001 file - promoters70/4283378
ataactttatgttat

SEQ ID NO: 86280 - DNA, 8 bp, Unknown
  misc_feature (1)..( 8): Result.001 file - promoters70/4283378
aaaaatat

SEQ ID NO: 86281 - DNA, 8 bp, Unknown
  misc_feature (1)..( 8): Result.001 file - promoters70/4283378
aaatatac

SEQ ID NO: 86282 - DNA, 8 bp, Unknown
  misc_feature (1)..( 8): Result.001 file - promoters70/4283378
aaatgtca

SEQ ID NO: 86283 - DNA, 8 bp, Unknown
  misc_feature (1)..( 8): Result.001 file - promoters70/4283378
aaatgtta

SEQ ID NO: 86284 - DNA, 12 bp, Unknown
  misc_feature (1)..( 12): Result.001 file - promoters70/4283378
aaaaatatatac

SEQ ID NO: 86285 - DNA, 12 bp, Unknown
  misc_feature (1)..( 12): Result.001 file - promoters70/4283378
gatagtatatac

SEQ ID NO: 86286 - DNA, 12 bp, Unknown
  misc_feature (1)..( 12): Result.001 file - promoters70/4283378
tttaatatgtac

SEQ ID NO: 86287 - DNA, 12 bp, Unknown
  misc_feature (1)..( 12): Result.001 file - promoters70/4283378
tagaatatgttt

SEQ ID NO: 86288 - DNA, 11 bp, Unknown
  misc_feature (1)..( 11): Result.001 file - promoters70/4283378
ttattttgcga

SEQ ID NO: 86289 - DNA, 11 bp, Unknown
  misc_feature (1)..( 11): Result.001 file - promoters70/4283378
ttaatttcgtt

SEQ ID NO: 86290 - DNA, 11 bp, Unknown
  misc_feature (1)..( 11): Result.001 file - promoters70/4283378
caaatttcaca

SEQ ID NO: 86291 - DNA, 11 bp, Unknown
  misc_feature (1)..( 11): Result.001 file - promoters70/4283378
tacatttaaca

SEQ ID NO: 86292 - DNA, 11 bp, Unknown
  misc_feature (1)..( 11): Result.001 file - promoters70/4283378
gtaatttagta

SEQ ID NO: 86293 - DNA, 8 bp, Unknown
  misc_feature (1)..( 8): Result.001 file - promoters70/4283378
aaatttcc

SEQ ID NO: 86294 - DNA, 8 bp, Unknown
  misc_feature (1)..( 8): Result.001 file - promoters70/4283378
aaattttt

SEQ ID NO: 86295 - DNA, 8 bp, Unknown
  misc_feature (1)..( 8): Result.001 file - promoters70/4283378
taattttg

SEQ ID NO: 86296 - DNA, 9 bp, Unknown
  misc_feature (1)..( 9): Result.001 file - promoters70/4283386
taatctttt

SEQ ID NO: 86297 - DNA, 8 bp, Unknown
  misc_feature (1)..( 8): Result.001 file - promoters70/4283386
gttctatc

SEQ ID NO: 86298 - DNA, 8 bp, Unknown
  misc_feature (1)..( 8): Result.001 file - promoters70/4283386
gttttatt

SEQ ID NO: 86299 - DNA, 8 bp, Unknown
  misc_feature (1)..( 8): Result.001 file - promoters70/4283386
catttatt

SEQ ID NO: 86300 - DNA, 9 bp, Unknown
  misc_feature (1)..( 9): Result.001 file - promoters70/4283386
tttatttta

SEQ ID NO: 86301 - DNA, 9 bp, Unknown
  misc_feature (1)..( 9): Result.001 file - promoters70/4283386
tttctttta

SEQ ID NO: 86302 - DNA, 9 bp, Unknown
  misc_feature (1)..( 9): Result.001 file - promoters70/4577400
cttctctta

SEQ ID NO: 86303 - DNA, 11 bp, Unknown
  misc_feature (1)..( 11): Result.001 file - promoters70/4577400
ccagaattaag

SEQ ID NO: 86304 - DNA, 11 bp, Unknown
  misc_feature (1)..( 11): Result.001 file - promoters70/4577400
ccataattagt

SEQ ID NO: 86305 - DNA, 11 bp, Unknown
  misc_feature (1)..( 11): Result.001 file - promoters70/4608096
atgtaattaag

SEQ ID NO: 86306 - DNA, 10 bp, Unknown
  misc_feature (1)..( 10): Result.001 file - promoters70/4608096
tatatatata

SEQ ID NO: 86307 - DNA, 10 bp, Unknown
  misc_feature (1)..( 10): Result.001 file - promoters70/4608096
tatttatata

SEQ ID NO: 86308 - DNA, 10 bp, Unknown
  misc_feature (1)..( 10): Result.001 file - promoters70/4608096
aataaaaagc

SEQ ID NO: 86309 - DNA, 10 bp, Unknown
  misc_feature (1)..( 10): Result.001 file - promoters70/4608096
tataaaaccc

SEQ ID NO: 86310 - DNA, 10 bp, Unknown
  misc_feature (1)..( 10): Result.001 file - promoters70/4608096
tataaattag

SEQ ID NO: 86311 - DNA, 10 bp, Unknown
  misc_feature (1)..( 10): Result.001 file - promoters70/4608096
tataaaactt

SEQ ID NO: 86312 - DNA, 10 bp, Unknown
  misc_feature (1)..( 10): Result.001 file - promoters70/4608104
tataaagaca

SEQ ID NO: 86313 - DNA, 9 bp, Unknown
  misc_feature (1)..( 9): Result.001 file - promoters70/4608104
actaatagc

SEQ ID NO: 86314 - DNA, 9 bp, Unknown
  misc_feature (1)..( 9): Result.001 file - promoters70/4608104
tttaataga

SEQ ID NO: 86315 - DNA, 9 bp, Unknown
  misc_feature (1)..( 9): Result.001 file - promoters70/4608104
ttttataga

SEQ ID NO: 86316 - DNA, 9 bp, Unknown
  misc_feature (1)..( 9): Result.001 file - promoters70/4608965
cctaacaga

SEQ ID NO: 86317 - DNA, 12 bp, Unknown
  misc_feature (1)..( 12): Result.001 file - promoters70/4608965
ctttataaaacc

SEQ ID NO: 86318 - DNA, 12 bp, Unknown
  misc_feature (1)..( 12): Result.001 file - promoters70/4608965
tcttataaataa

SEQ ID NO: 86319 - DNA, 12 bp, Unknown
  misc_feature (1)..( 12): Result.001 file - promoters70/4608965
ttatataaatcc

SEQ ID NO: 86320 - DNA, 12 bp, Unknown
  misc_feature (1)..( 12): Result.001 file - promoters70/4608965
cactataaaact

SEQ ID NO: 86321 - DNA, 12 bp, Unknown
  misc_feature (1)..( 12): Result.001 file - promoters70/4608965
tcttatatataa

SEQ ID NO: 86322 - DNA, 12 bp, Unknown
  misc_feature (1)..( 12): Result.001 file - promoters70/4608985
atttatgaatcc

SEQ ID NO: 86323 - DNA, 8 bp, Unknown
  misc_feature (1)..( 8): Result.001 file - promoters70/4608985
cccaaaaa

SEQ ID NO: 86324 - DNA, 8 bp, Unknown
  misc_feature (1)..( 8): Result.001 file - promoters70/4608985
tacaaaaa

SEQ ID NO: 86325 - DNA, 8 bp, Unknown
  misc_feature (1)..( 8): Result.001 file - promoters70/4608985
tcctaaaa

SEQ ID NO: 86326 - DNA, 8 bp, Unknown
  misc_feature (1)..( 8): Result.001 file - promoters70/4608985
aacaaaaa

SEQ ID NO: 86327 - DNA, 11 bp, Unknown
  misc_feature (1)..( 11): Result.001 file - promoters70/4608985
aaacagtaaaa

SEQ ID NO: 86328 - DNA, 11 bp, Unknown
  misc_feature (1)..( 11): Result.001 file - promoters70/4608985
aaacaataaaa

SEQ ID NO: 86329 - DNA, 11 bp, Unknown
  misc_feature (1)..( 11): Result.001 file - promoters70/4608985
agataatattt

SEQ ID NO: 86330 - DNA, 11 bp, Unknown
  misc_feature (1)..( 11): Result.001 file - promoters70/4608985
cgtcaaaaaac

SEQ ID NO: 86331 - DNA, 10 bp, Unknown
  misc_feature (1)..( 10): Result.001 file - promoters70/4608985
attaataaag

SEQ ID NO: 86332 - DNA, 10 bp, Unknown
  misc_feature (1)..( 10): Result.001 file - promoters70/4608985
attaatattt

SEQ ID NO: 86333 - DNA, 10 bp, Unknown
  misc_feature (1)..( 10): Result.001 file - promoters70/4608985
gataatattt

SEQ ID NO: 86334 - DNA, 10 bp, Unknown
  misc_feature (1)..( 10): Result.001 file - promoters70/4608985
tttattatag

SEQ ID NO: 86335 - DNA, 10 bp, Unknown
  misc_feature (1)..( 10): Result.001 file - promoters70/4608985
tttattttat

SEQ ID NO: 86336 - DNA, 12 bp, Unknown
  misc_feature (1)..( 12): Result.001 file - promoters70/4608985
taagaaatttcc

SEQ ID NO: 86337 - DNA, 12 bp, Unknown
  misc_feature (1)..( 12): Result.001 file - promoters70/4608985
taaaaaaactaa

SEQ ID NO: 86338 - DNA, 12 bp, Unknown
  misc_feature (1)..( 12): Result.001 file - promoters70/4608985
caagaaaactca

SEQ ID NO: 86339 - DNA, 12 bp, Unknown
  misc_feature (1)..( 12): Result.001 file - promoters70/4608985
taaataactaat

SEQ ID NO: 86340 - DNA, 7 bp, Unknown
  misc_feature (1)..( 7): Result.001 file - promoters70/4608985
taagatt

SEQ ID NO: 86341 - DNA, 7 bp, Unknown
  misc_feature (1)..( 7): Result.001 file - promoters70/4608985
taaaatt

SEQ ID NO: 86342 - DNA, 7 bp, Unknown
  misc_feature (1)..( 7): Result.001 file - promoters70/4608985
taagatc

SEQ ID NO: 86343 - DNA, 7 bp, Unknown
  misc_feature (1)..( 7): Result.001 file - promoters70/4608985
aaaaatt

SEQ ID NO: 86344 - DNA, 7 bp, Unknown
  misc_feature (1)..( 7): Result.001 file - promoters70/4608985
taaaaat

SEQ ID NO: 86345 - DNA, 11 bp, Unknown
  misc_feature (1)..( 11): Result.001 file - promoters70/4608985
caaagacaagt

SEQ ID NO: 86346 - DNA, 11 bp, Unknown
  misc_feature (1)..( 11): Result.001 file - promoters70/4608985
gatagataaga

SEQ ID NO: 86347 - DNA, 11 bp, Unknown
  misc_feature (1)..( 11): Result.001 file - promoters70/4608985
caaaaacaata

SEQ ID NO: 86348 - DNA, 11 bp, Unknown
  misc_feature (1)..( 11): Result.001 file - promoters70/4608985
gggttacaaaa

SEQ ID NO: 86349 - DNA, 14 bp, Unknown
  misc_feature (1)..( 14): Result.001 file - promoters70/4608985
taaataaatttttg

SEQ ID NO: 86350 - DNA, 14 bp, Unknown
  misc_feature (1)..( 14): Result.001 file - promoters70/4608985
caaacaaatgtttg

SEQ ID NO: 86351 - DNA, 14 bp, Unknown
  misc_feature (1)..( 14): Result.001 file - promoters70/4608985
taactaatttctta

SEQ ID NO: 86352 - DNA, 15 bp, Unknown
  misc_feature (1)..( 15): Result.001 file - promoters70/4608985
taatataactcttgg

SEQ ID NO: 86353 - DNA, 11 bp, Unknown
  misc_feature (1)..( 11): Result.001 file - promoters70/4608985
agttaaaaaat

SEQ ID NO: 86354 - DNA, 11 bp, Unknown
  misc_feature (1)..( 11): Result.001 file - promoters70/4608985
agttaatatat

SEQ ID NO: 86355 - DNA, 11 bp, Unknown
  misc_feature (1)..( 11): Result.001 file - promoters70/4608985
tgttattatat

SEQ ID NO: 86356 - DNA, 11 bp, Unknown
  misc_feature (1)..( 11): Result.001 file - promoters70/4610551
agttatttaaa

SEQ ID NO: 86357 - DNA, 11 bp, Unknown
  misc_feature (1)..( 11): Result.001 file - promoters70/4610551
aagaaaatcta

SEQ ID NO: 86358 - DNA, 11 bp, Unknown
  misc_feature (1)..( 11): Result.001 file - promoters70/4610551
tggaaaatgtt

SEQ ID NO: 86359 - DNA, 11 bp, Unknown
  misc_feature (1)..( 11): Result.001 file - promoters70/4610551
aagaaaaaaaa

SEQ ID NO: 86360 - DNA, 11 bp, Unknown
  misc_feature (1)..( 11): Result.001 file - promoters70/4610551
accaaaatcta

SEQ ID NO: 86361 - DNA, 11 bp, Unknown
  misc_feature (1)..( 11): Result.001 file - promoters70/4610551
ataaaaatgtg

SEQ ID NO: 86362 - DNA, 11 bp, Unknown
  misc_feature (1)..( 11): Result.001 file - promoters70/4701809
ctgaaaacaaa

SEQ ID NO: 86363 - DNA, 12 bp, Unknown
  misc_feature (1)..( 12): Result.001 file - promoters70/4701809
ataatgttattt

SEQ ID NO: 86364 - DNA, 12 bp, Unknown
  misc_feature (1)..( 12): Result.001 file - promoters70/4701809
aaaatgtttttt

SEQ ID NO: 86365 - DNA, 12 bp, Unknown
  misc_feature (1)..( 12): Result.001 file - promoters70/4701809
ataacgttttta

SEQ ID NO: 86366 - DNA, 7 bp, Unknown
  misc_feature (1)..( 7): Result.001 file - promoters70/4701809
aaagtcc

SEQ ID NO: 86367 - DNA, 7 bp, Unknown
  misc_feature (1)..( 7): Result.001 file - promoters70/4701809
aaagtca

SEQ ID NO: 86368 - DNA, 7 bp, Unknown
  misc_feature (1)..( 7): Result.001 file - promoters70/4701809
aaactca

SEQ ID NO: 86369 - DNA, 8 bp, Unknown
  misc_feature (1)..( 8): Result.001 file - promoters70/4701809
atttttct

SEQ ID NO: 86370 - DNA, 8 bp, Unknown
  misc_feature (1)..( 8): Result.001 file - promoters70/4701809
atttttta

SEQ ID NO: 86371 - DNA, 8 bp, Unknown
  misc_feature (1)..( 8): Result.001 file - promoters70/4701809
gtttctct

SEQ ID NO: 86372 - DNA, 10 bp, Unknown
  misc_feature (1)..( 10): Result.001 file - promoters70/4701809
ttcaaaattt

SEQ ID NO: 86373 - DNA, 10 bp, Unknown
  misc_feature (1)..( 10): Result.001 file - promoters70/4701809
tacaagatta

SEQ ID NO: 86374 - DNA, 10 bp, Unknown
  misc_feature (1)..( 10): Result.001 file - promoters70/4701809
ttctaaattg

SEQ ID NO: 86375 - DNA, 10 bp, Unknown
  misc_feature (1)..( 10): Result.001 file - promoters70/4701809
taataagttg

SEQ ID NO: 86376 - DNA, 8 bp, Unknown
  misc_feature (1)..( 8): Result.001 file - promoters70/4701809
ttataaat

SEQ ID NO: 86377 - DNA, 8 bp, Unknown
  misc_feature (1)..( 8): Result.001 file - promoters70/4701809
ttataaaa

SEQ ID NO: 86378 - DNA, 8 bp, Unknown
  misc_feature (1)..( 8): Result.001 file - promoters70/4701809
aaataaaa

SEQ ID NO: 86379 - DNA, 9 bp, Unknown
  misc_feature (1)..( 9): Result.001 file - promoters70/4701809
atttttttc

SEQ ID NO: 86380 - DNA, 9 bp, Unknown
  misc_feature (1)..( 9): Result.001 file - promoters70/4701809
atttttttt

SEQ ID NO: 86381 - DNA, 10 bp, Unknown
  misc_feature (1)..( 10): Result.001 file - promoters70/4701809
ttttgttttt

SEQ ID NO: 86382 - DNA, 10 bp, Unknown
  misc_feature (1)..( 10): Result.001 file - promoters70/4701809
tatgttaata

SEQ ID NO: 86383 - DNA, 10 bp, Unknown
  misc_feature (1)..( 10): Result.001 file - promoters70/4701809
taaattaata

SEQ ID NO: 86384 - DNA, 10 bp, Unknown
  misc_feature (1)..( 10): Result.001 file - promoters70/4701809
atgattaatc

SEQ ID NO: 86385 - DNA, 10 bp, Unknown
  misc_feature (1)..( 10): Result.001 file - promoters70/4701809
taaagtaatg

SEQ ID NO: 86386 - DNA, 12 bp, Unknown
  misc_feature (1)..( 12): Result.001 file - promoters70/4701809
tcgttgtgtaat

SEQ ID NO: 86387 - DNA, 12 bp, Unknown
  misc_feature (1)..( 12): Result.001 file - promoters70/4701809
tcgttttgtttt

SEQ ID NO: 86388 - DNA, 12 bp, Unknown
  misc_feature (1)..( 12): Result.001 file - promoters70/4701809
ttattttttttt

SEQ ID NO: 86389 - DNA, 13 bp, Unknown
  misc_feature (1)..( 13): Result.001 file - promoters70/4701809
tgagattccaaac

SEQ ID NO: 86390 - DNA, 13 bp, Unknown
  misc_feature (1)..( 13): Result.001 file - promoters70/4701809
ttagattcatatt

SEQ ID NO: 86391 - DNA, 13 bp, Unknown
  misc_feature (1)..( 13): Result.001 file - promoters70/4701809
ttaaattaatatt

SEQ ID NO: 86392 - DNA, 7 bp, Unknown
  misc_feature (1)..( 7): Result.001 file - promoters70/4701809
aaattaa

SEQ ID NO: 86393 - DNA, 7 bp, Unknown
  misc_feature (1)..( 7): Result.001 file - promoters70/4701809
caattaa

SEQ ID NO: 86394 - DNA, 7 bp, Unknown
  misc_feature (1)..( 7): Result.001 file - promoters70/4701809
aaattaa

SEQ ID NO: 86395 - DNA, 10 bp, Unknown
  misc_feature (1)..( 10): Result.001 file - promoters70/4701809
tgggtttttg

SEQ ID NO: 86396 - DNA, 10 bp, Unknown
  misc_feature (1)..( 10): Result.001 file - promoters70/4701809
tttttttttg

SEQ ID NO: 86397 - DNA, 10 bp, Unknown
  misc_feature (1)..( 10): Result.001 file - promoters70/4701809
tttgttttta

SEQ ID NO: 86398 - DNA, 7 bp, Unknown
  misc_feature (1)..( 7): Result.001 file - promoters70/4701809
ataaaat

SEQ ID NO: 86399 - DNA, 7 bp, Unknown
  misc_feature (1)..( 7): Result.001 file - promoters70/4701809
ataaaaa

SEQ ID NO: 86400 - DNA, 7 bp, Unknown
  misc_feature (1)..( 7): Result.001 file - promoters70/4766447
ttaaaaa

SEQ ID NO: 86401 - DNA, 8 bp, Unknown
  misc_feature (1)..( 8): Result.001 file - promoters70/4766447
tcaatcaa

SEQ ID NO: 86402 - DNA, 8 bp, Unknown
  misc_feature (1)..( 8): Result.001 file - promoters70/4766447
ccaagcaa

SEQ ID NO: 86403 - DNA, 8 bp, Unknown
  misc_feature (1)..( 8): Result.001 file - promoters70/4766447
tcaaacaa

SEQ ID NO: 86404 - DNA, 7 bp, Unknown
  misc_feature (1)..( 7): Result.001 file - promoters70/4766447
tttgttt

SEQ ID NO: 86405 - DNA, 7 bp, Unknown
  misc_feature (1)..( 7): Result.001 file - promoters70/4766447
tttattt

SEQ ID NO: 86406 - DNA, 7 bp, Unknown
  misc_feature (1)..( 7): Result.001 file - promoters70/4766447
attattt

SEQ ID NO: 86407 - DNA, 11 bp, Unknown
  misc_feature (1)..( 11): Result.001 file - promoters70/4766447
attccactttt

SEQ ID NO: 86408 - DNA, 11 bp, Unknown
  misc_feature (1)..( 11): Result.001 file - promoters70/4766447
aatccaatttt

SEQ ID NO: 86409 - DNA, 11 bp, Unknown
  misc_feature (1)..( 11): Result.001 file - promoters70/4766490
aatacaaaaaa

SEQ ID NO: 86410 - DNA, 10 bp, Unknown
  misc_feature (1)..( 10): Result.001 file - promoters70/4766490
tttgaaaaga

SEQ ID NO: 86411 - DNA, 10 bp, Unknown
  misc_feature (1)..( 10): Result.001 file - promoters70/4766490
aaaaaaaaga

SEQ ID NO: 86412 - DNA, 11 bp, Unknown
  misc_feature (1)..( 11): Result.001 file - promoters70/4766490
gaagaaacaga

SEQ ID NO: 86413 - DNA, 12 bp, Unknown
  misc_feature (1)..( 12): Result.001 file - promoters70/4766490
tgaaaagatgaa

SEQ ID NO: 86414 - DNA, 12 bp, Unknown
  misc_feature (1)..( 12): Result.001 file - promoters70/4766490
acacaagaagaa

SEQ ID NO: 86415 - DNA, 12 bp, Unknown
  misc_feature (1)..( 12): Result.001 file - promoters70/4766602
gaaaaaaaagaa

SEQ ID NO: 86416 - DNA, 9 bp, Unknown
  misc_feature (1)..( 9): Result.001 file - promoters70/4766602
actatatat

SEQ ID NO: 86417 - DNA, 9 bp, Unknown
  misc_feature (1)..( 9): Result.001 file - promoters70/4766602
actatataa

SEQ ID NO: 86418 - DNA, 9 bp, Unknown
  misc_feature (1)..( 9): Result.001 file - promoters70/4766602
ctaatataa

SEQ ID NO: 86419 - DNA, 8 bp, Unknown
  misc_feature (1)..( 8): Result.001 file - promoters70/4766602
cattttta

SEQ ID NO: 86420 - DNA, 8 bp, Unknown
  misc_feature (1)..( 8): Result.001 file - promoters70/4766602
catttttt

SEQ ID NO: 86421 - DNA, 8 bp, Unknown
  misc_feature (1)..( 8): Result.001 file - promoters70/4766602
tttttttt

SEQ ID NO: 86422 - DNA, 8 bp, Unknown
  misc_feature (1)..( 8): Result.001 file - promoters70/4766602
attgtaag

SEQ ID NO: 86423 - DNA, 8 bp, Unknown
  misc_feature (1)..( 8): Result.001 file - promoters70/4766602
attttaaa

SEQ ID NO: 86424 - DNA, 8 bp, Unknown
  misc_feature (1)..( 8): Result.001 file - promoters70/4766712
cgtttaaa

SEQ ID NO: 86425 - DNA, 9 bp, Unknown
  misc_feature (1)..( 9): Result.001 file - promoters70/4766712
ttataaata

SEQ ID NO: 86426 - DNA, 9 bp, Unknown
  misc_feature (1)..( 9): Result.001 file - promoters70/4766712
gtataaaaa

SEQ ID NO: 86427 - DNA, 9 bp, Unknown
  misc_feature (1)..( 9): Result.001 file - promoters70/4766712
ttataaata

SEQ ID NO: 86428 - DNA, 11 bp, Unknown
  misc_feature (1)..( 11): Result.001 file - promoters70/4766712
aagaccctaac

SEQ ID NO: 86429 - DNA, 11 bp, Unknown
  misc_feature (1)..( 11): Result.001 file - promoters70/4766712
aagacccgttg

SEQ ID NO: 86430 - DNA, 11 bp, Unknown
  misc_feature (1)..( 11): Result.001 file - promoters70/4766712
cagaaccgttg

SEQ ID NO: 86431 - DNA, 6 bp, Unknown
  misc_feature (1)..( 6): Result.001 file - promoters70/4766712
attaaa

SEQ ID NO: 86432 - DNA, 6 bp, Unknown
  misc_feature (1)..( 6): Result.001 file - promoters70/4766712
attaaa

SEQ ID NO: 86433 - DNA, 6 bp, Unknown
  misc_feature (1)..( 6): Result.001 file - promoters70/4766712
attaaa

SEQ ID NO: 86434 - DNA, 9 bp, Unknown
  misc_feature (1)..( 9): Result.001 file - promoters70/4766712
gaaatgatg

SEQ ID NO: 86435 - DNA, 9 bp, Unknown
  misc_feature (1)..( 9): Result.001 file - promoters70/4766712
gaaatgaga

SEQ ID NO: 86436 - DNA, 9 bp, Unknown
  misc_feature (1)..( 9): Result.001 file - promoters70/4766866
ttaataaga

SEQ ID NO: 86437 - DNA, 8 bp, Unknown
  misc_feature (1)..( 8): Result.001 file - promoters70/4766866
attccatt

SEQ ID NO: 86438 - DNA, 8 bp, Unknown
  misc_feature (1)..( 8): Result.001 file - promoters70/4766866
tttccatt

SEQ ID NO: 86439 - DNA, 8 bp, Unknown
  misc_feature (1)..( 8): Result.001 file - promoters70/4766866
attccaaa

SEQ ID NO: 86440 - DNA, 8 bp, Unknown
  misc_feature (1)..( 8): Result.001 file - promoters70/4766866
tttgtaat

SEQ ID NO: 86441 - DNA, 8 bp, Unknown
  misc_feature (1)..( 8): Result.001 file - promoters70/4766866
attgtaat

SEQ ID NO: 86442 - DNA, 8 bp, Unknown
  misc_feature (1)..( 8): Result.001 file - promoters70/4766866
tttgtaac

SEQ ID NO: 86443 - DNA, 12 bp, Unknown
  misc_feature (1)..( 12): Result.001 file - promoters70/4766866
gttggaatttag

SEQ ID NO: 86444 - DNA, 12 bp, Unknown
  misc_feature (1)..( 12): Result.001 file - promoters70/4766866
aaaagaaattaa

SEQ ID NO: 86445 - DNA, 12 bp, Unknown
  misc_feature (1)..( 12): Result.001 file - promoters70/4766866
aaaagaaaataa

SEQ ID NO: 86446 - DNA, 12 bp, Unknown
  misc_feature (1)..( 12): Result.001 file - promoters70/4766866
aaatgaaatatc

SEQ ID NO: 86447 - DNA, 12 bp, Unknown
  misc_feature (1)..( 12): Result.001 file - promoters70/4766866
ataagacaacac

SEQ ID NO: 86448 - DNA, 12 bp, Unknown
  misc_feature (1)..( 12): Result.001 file - promoters70/4766866
ttgagacaaaaa

SEQ ID NO: 86449 - DNA, 12 bp, Unknown
  misc_feature (1)..( 12): Result.001 file - promoters70/4766866
ttgaaacaaaaa

SEQ ID NO: 86450 - DNA, 12 bp, Unknown
  misc_feature (1)..( 12): Result.001 file - promoters70/4766866
gagaaagaaagc

SEQ ID NO: 86451 - DNA, 9 bp, Unknown
  misc_feature (1)..( 9): Result.001 file - promoters70/4766866
ggagaaaaa

SEQ ID NO: 86452 - DNA, 9 bp, Unknown
  misc_feature (1)..( 9): Result.001 file - promoters70/4766866
atggaaaaa

SEQ ID NO: 86453 - DNA, 9 bp, Unknown
  misc_feature (1)..( 9): Result.001 file - promoters70/4766866
ggagaaaac

SEQ ID NO: 86454 - DNA, 8 bp, Unknown
  misc_feature (1)..( 8): Result.001 file - promoters70/4766866
accaataa

SEQ ID NO: 86455 - DNA, 8 bp, Unknown
  misc_feature (1)..( 8): Result.001 file - promoters70/4766866
cccactaa

SEQ ID NO: 86456 - DNA, 8 bp, Unknown
  misc_feature (1)..( 8): Result.001 file - promoters70/4766866
cccactag

SEQ ID NO: 86457 - DNA, 11 bp, Unknown
  misc_feature (1)..( 11): Result.001 file - promoters70/4766866
taacaagtaaa

SEQ ID NO: 86458 - DNA, 11 bp, Unknown
  misc_feature (1)..( 11): Result.001 file - promoters70/4766866
taataagtaaa

SEQ ID NO: 86459 - DNA, 11 bp, Unknown
  misc_feature (1)..( 11): Result.001 file - promoters70/4766936
gcaagagtaaa

SEQ ID NO: 86460 - DNA, 8 bp, Unknown
  misc_feature (1)..( 8): Result.001 file - promoters70/4766936
tttatttg

SEQ ID NO: 86461 - DNA, 8 bp, Unknown
  misc_feature (1)..( 8): Result.001 file - promoters70/4766936
tttgttta

SEQ ID NO: 86462 - DNA, 8 bp, Unknown
  misc_feature (1)..( 8): Result.001 file - promoters70/4766936
tttctttg

SEQ ID NO: 86463 - DNA, 8 bp, Unknown
  misc_feature (1)..( 8): Result.001 file - promoters70/4766936
atttgtta

SEQ ID NO: 86464 - DNA, 8 bp, Unknown
  misc_feature (1)..( 8): Result.001 file - promoters70/4766936
aattgtta

SEQ ID NO: 86465 - DNA, 8 bp, Unknown
  misc_feature (1)..( 8): Result.001 file - promoters70/4766936
aatggttt

SEQ ID NO: 86466 - DNA, 16 bp, Unknown
  misc_feature (1)..( 16): Result.001 file - promoters70/4766936
tttttacaacacaagt

SEQ ID NO: 86467 - DNA, 16 bp, Unknown
  misc_feature (1)..( 16): Result.001 file - promoters70/4766936
tttctaccacacaagt

SEQ ID NO: 86468 - DNA, 16 bp, Unknown
  misc_feature (1)..( 16): Result.001 file - promoters70/4766936
tttttaaccgtatcag

SEQ ID NO: 86469 - DNA, 10 bp, Unknown
  misc_feature (1)..( 10): Result.001 file - promoters70/4766936
atcttttaaa

SEQ ID NO: 86470 - DNA, 10 bp, Unknown
  misc_feature (1)..( 10): Result.001 file - promoters70/4766936
atctttgtaa

SEQ ID NO: 86471 - DNA, 10 bp, Unknown
  misc_feature (1)..( 10): Result.001 file - promoters70/4766936
ttctttataa

SEQ ID NO: 86472 - DNA, 10 bp, Unknown
  misc_feature (1)..( 10): Result.001 file - promoters70/4766936
atctatataa

SEQ ID NO: 86473 - DNA, 10 bp, Unknown
  misc_feature (1)..( 10): Result.001 file - promoters70/4766936
atgccacatc

SEQ ID NO: 86474 - DNA, 10 bp, Unknown
  misc_feature (1)..( 10): Result.001 file - promoters70/4766936
ttgccacgtg

SEQ ID NO: 86475 - DNA, 10 bp, Unknown
  misc_feature (1)..( 10): Result.001 file - promoters70/4766936
ttgccacgtg

SEQ ID NO: 86476 - DNA, 8 bp, Unknown
  misc_feature (1)..( 8): Result.001 file - promoters70/4766936
aatttttt

SEQ ID NO: 86477 - DNA, 8 bp, Unknown
  misc_feature (1)..( 8): Result.001 file - promoters70/4766936
aatgtttt

SEQ ID NO: 86478 - DNA, 8 bp, Unknown
  misc_feature (1)..( 8): Result.001 file - promoters70/4766936
aatgttaa

SEQ ID NO: 86479 - DNA, 9 bp, Unknown
  misc_feature (1)..( 9): Result.001 file - promoters70/4766936
attttttgt

SEQ ID NO: 86480 - DNA, 9 bp, Unknown
  misc_feature (1)..( 9): Result.001 file - promoters70/4766936
attttttgt

SEQ ID NO: 86481 - DNA, 9 bp, Unknown
  misc_feature (1)..( 9): Result.001 file - promoters70/4766936
attctttat

SEQ ID NO: 86482 - DNA, 9 bp, Unknown
  misc_feature (1)..( 9): Result.001 file - promoters70/4766936
ttaacaaat

SEQ ID NO: 86483 - DNA, 9 bp, Unknown
  misc_feature (1)..( 9): Result.001 file - promoters70/4766936
ttatcaaat

SEQ ID NO: 86484 - DNA, 9 bp, Unknown
  misc_feature (1)..( 9): Result.001 file - promoters70/4766977
gtataaaaa

SEQ ID NO: 86485 - DNA, 10 bp, Unknown
  misc_feature (1)..( 10): Result.001 file - promoters70/4766977
ctataaatag

SEQ ID NO: 86486 - DNA, 10 bp, Unknown
  misc_feature (1)..( 10): Result.001 file - promoters70/4766977
ctataaaaaa

SEQ ID NO: 86487 - DNA, 10 bp, Unknown
  misc_feature (1)..( 10): Result.001 file - promoters70/4767298
atataaatag

SEQ ID NO: 86488 - DNA, 7 bp, Unknown
  misc_feature (1)..( 7): Result.001 file - promoters70/4767298
tatttca

SEQ ID NO: 86489 - DNA, 7 bp, Unknown
  misc_feature (1)..( 7): Result.001 file - promoters70/4767298
tatttcc

SEQ ID NO: 86490 - DNA, 7 bp, Unknown
  misc_feature (1)..( 7): Result.001 file - promoters70/4767298
tatgtca

SEQ ID NO: 86491 - DNA, 7 bp, Unknown
  misc_feature (1)..( 7): Result.001 file - promoters70/4767298
ttcattt

SEQ ID NO: 86492 - DNA, 7 bp, Unknown
  misc_feature (1)..( 7): Result.001 file - promoters70/4767298
ttcattt

SEQ ID NO: 86493 - DNA, 7 bp, Unknown
  misc_feature (1)..( 7): Result.001 file - promoters70/4767298
ttcgttt

SEQ ID NO: 86494 - DNA, 9 bp, Unknown
  misc_feature (1)..( 9): Result.001 file - promoters70/4767298
taatttgat

SEQ ID NO: 86495 - DNA, 9 bp, Unknown
  misc_feature (1)..( 9): Result.001 file - promoters70/4767298
aaatatgat

SEQ ID NO: 86496 - DNA, 9 bp, Unknown
  misc_feature (1)..( 9): Result.001 file - promoters70/4767379
aaatataaa

SEQ ID NO: 86497 - DNA, 10 bp, Unknown
  misc_feature (1)..( 10): Result.001 file - promoters70/4767379
aaaatattaa

SEQ ID NO: 86498 - DNA, 10 bp, Unknown
  misc_feature (1)..( 10): Result.001 file - promoters70/4767379
taaaaattaa

SEQ ID NO: 86499 - DNA, 10 bp, Unknown
  misc_feature (1)..( 10): Result.001 file - promoters70/4767379
gtaaaatttc

SEQ ID NO: 86500 - DNA, 10 bp, Unknown
  misc_feature (1)..( 10): Result.001 file - promoters70/4767379
taacaattct

SEQ ID NO: 86501 - DNA, 10 bp, Unknown
  misc_feature (1)..( 10): Result.001 file - promoters70/4767379
ctaaaatttc

SEQ ID NO: 86502 - DNA, 9 bp, Unknown
  misc_feature (1)..( 9): Result.001 file - promoters70/4767379
aaaaataaa

SEQ ID NO: 86503 - DNA, 9 bp, Unknown
  misc_feature (1)..( 9): Result.001 file - promoters70/4767379
aaaattaat

SEQ ID NO: 86504 - DNA, 9 bp, Unknown
  misc_feature (1)..( 9): Result.001 file - promoters70/4767379
taaaataca

SEQ ID NO: 86505 - DNA, 9 bp, Unknown
  misc_feature (1)..( 9): Result.001 file - promoters70/4767379
aaacatata

SEQ ID NO: 86506 - DNA, 9 bp, Unknown
  misc_feature (1)..( 9): Result.001 file - promoters70/4767379
gataatatt

SEQ ID NO: 86507 - DNA, 10 bp, Unknown
  misc_feature (1)..( 10): Result.001 file - promoters70/4767379
aaataaaagc

SEQ ID NO: 86508 - DNA, 10 bp, Unknown
  misc_feature (1)..( 10): Result.001 file - promoters70/4767379
caataaaatt

SEQ ID NO: 86509 - DNA, 10 bp, Unknown
  misc_feature (1)..( 10): Result.001 file - promoters70/4767379
ttataaaata

SEQ ID NO: 86510 - DNA, 10 bp, Unknown
  misc_feature (1)..( 10): Result.001 file - promoters70/4767379
aaagaaaatt

SEQ ID NO: 86511 - DNA, 10 bp, Unknown
  misc_feature (1)..( 10): Result.001 file - promoters70/4767379
agataatatt

SEQ ID NO: 86512 - DNA, 7 bp, Unknown
  misc_feature (1)..( 7): Result.001 file - promoters70/4767379
aaacaaa

SEQ ID NO: 86513 - DNA, 7 bp, Unknown
  misc_feature (1)..( 7): Result.001 file - promoters70/4767379
aaataaa

SEQ ID NO: 86514 - DNA, 7 bp, Unknown
  misc_feature (1)..( 7): Result.001 file - promoters70/4767379
aaacaaa

SEQ ID NO: 86515 - DNA, 7 bp, Unknown
  misc_feature (1)..( 7): Result.001 file - promoters70/4767379
aaaaaaa

SEQ ID NO: 86516 - DNA, 7 bp, Unknown
  misc_feature (1)..( 7): Result.001 file - promoters70/4767379
atacata

SEQ ID NO: 86517 - DNA, 10 bp, Unknown
  misc_feature (1)..( 10): Result.001 file - promoters70/4767379
aatgaaaaac

SEQ ID NO: 86518 - DNA, 10 bp, Unknown
  misc_feature (1)..( 10): Result.001 file - promoters70/4767379
aatgaaattc

SEQ ID NO: 86519 - DNA, 10 bp, Unknown
  misc_feature (1)..( 10): Result.001 file - promoters70/4767379
aatgatattc

SEQ ID NO: 86520 - DNA, 10 bp, Unknown
  misc_feature (1)..( 10): Result.001 file - promoters70/4767379
tttgatatat

SEQ ID NO: 86521 - DNA, 10 bp, Unknown
  misc_feature (1)..( 10): Result.001 file - promoters70/4767379
aatgattact

SEQ ID NO: 86522 - DNA, 11 bp, Unknown
  misc_feature (1)..( 11): Result.001 file - promoters70/4767379
atgaaaaacaa

SEQ ID NO: 86523 - DNA, 11 bp, Unknown
  misc_feature (1)..( 11): Result.001 file - promoters70/4767379
aagaaaaaata

SEQ ID NO: 86524 - DNA, 11 bp, Unknown
  misc_feature (1)..( 11): Result.001 file - promoters70/4767379
gttaaaaaata

SEQ ID NO: 86525 - DNA, 11 bp, Unknown
  misc_feature (1)..( 11): Result.001 file - promoters70/4767379
aagaaaagcgc

SEQ ID NO: 86526 - DNA, 11 bp, Unknown
  misc_feature (1)..( 11): Result.001 file - promoters70/4767487
tagagaagata

SEQ ID NO: 86527 - DNA, 11 bp, Unknown
  misc_feature (1)..( 11): Result.001 file - promoters70/4767487
tatgtaaacgt

SEQ ID NO: 86528 - DNA, 11 bp, Unknown
  misc_feature (1)..( 11): Result.001 file - promoters70/4767487
tatttaaaaag

SEQ ID NO: 86529 - DNA, 11 bp, Unknown
  misc_feature (1)..( 11): Result.001 file - promoters70/4767487
ctagtaaacat

SEQ ID NO: 86530 - DNA, 11 bp, Unknown
  misc_feature (1)..( 11): Result.001 file - promoters70/4767487
gcattaaaata

SEQ ID NO: 86531 - DNA, 12 bp, Unknown
  misc_feature (1)..( 12): Result.001 file - promoters70/4767487
attttagaaaga

SEQ ID NO: 86532 - DNA, 9 bp, Unknown
  misc_feature (1)..( 9): Result.001 file - promoters70/4767487
tttgttttt

SEQ ID NO: 86533 - DNA, 9 bp, Unknown
  misc_feature (1)..( 9): Result.001 file - promoters70/4767487
tttgatttc

SEQ ID NO: 86534 - DNA, 9 bp, Unknown
  misc_feature (1)..( 9): Result.001 file - promoters70/4767487
tgtattttg

SEQ ID NO: 86535 - DNA, 9 bp, Unknown
  misc_feature (1)..( 9): Result.001 file - promoters70/4767487
cttatcttg

SEQ ID NO: 86536 - DNA, 10 bp, Unknown
  misc_feature (1)..( 10): Result.001 file - promoters70/4767487
cgattttctt

SEQ ID NO: 86537 - DNA, 10 bp, Unknown
  misc_feature (1)..( 10): Result.001 file - promoters70/4767487
attttttctt

SEQ ID NO: 86538 - DNA, 10 bp, Unknown
  misc_feature (1)..( 10): Result.001 file - promoters70/4767487
taattgtctc

SEQ ID NO: 86539 - DNA, 10 bp, Unknown
  misc_feature (1)..( 10): Result.001 file - promoters70/4767487
taattttttc

SEQ ID NO: 86540 - DNA, 10 bp, Unknown
  misc_feature (1)..( 10): Result.001 file - promoters70/4767487
ttatgaatga

SEQ ID NO: 86541 - DNA, 10 bp, Unknown
  misc_feature (1)..( 10): Result.001 file - promoters70/4767487
ctatgaattc

SEQ ID NO: 86542 - DNA, 10 bp, Unknown
  misc_feature (1)..( 10): Result.001 file - promoters70/4767487
ttatgattaa

SEQ ID NO: 86543 - DNA, 10 bp, Unknown
  misc_feature (1)..( 10): Result.001 file - promoters70/4767515
atatcattaa

SEQ ID NO: 86544 - DNA, 11 bp, Unknown
  misc_feature (1)..( 11): Result.001 file - promoters70/4767515
ctcaaaatacc

SEQ ID NO: 86545 - DNA, 11 bp, Unknown
  misc_feature (1)..( 11): Result.001 file - promoters70/4767515
tttaaaacacc

SEQ ID NO: 86546 - DNA, 11 bp, Unknown
  misc_feature (1)..( 11): Result.001 file - promoters70/4767515
aggaaaacata

SEQ ID NO: 86547 - DNA, 11 bp, Unknown
  misc_feature (1)..( 11): Result.001 file - promoters70/4767515
aacaaaacaat

SEQ ID NO: 86548 - DNA, 11 bp, Unknown
  misc_feature (1)..( 11): Result.001 file - promoters70/4767515
aactaaacaag

SEQ ID NO: 86549 - DNA, 11 bp, Unknown
  misc_feature (1)..( 11): Result.001 file - promoters70/4767701
aacgaaaccaa

SEQ ID NO: 86550 - DNA, 9 bp, Unknown
  misc_feature (1)..( 9): Result.001 file - promoters70/4767701
aattctgag

SEQ ID NO: 86551 - DNA, 9 bp, Unknown
  misc_feature (1)..( 9): Result.001 file - promoters70/4767701
gattttgaa

SEQ ID NO: 86552 - DNA, 9 bp, Unknown
  misc_feature (1)..( 9): Result.001 file - promoters70/4767701
aattttaaa

SEQ ID NO: 86553 - DNA, 9 bp, Unknown
  misc_feature (1)..( 9): Result.001 file - promoters70/4767701
aattttgtg

SEQ ID NO: 86554 - DNA, 9 bp, Unknown
  misc_feature (1)..( 9): Result.001 file - promoters70/4767701
ttttttgtt

SEQ ID NO: 86555 - DNA, 9 bp, Unknown
  misc_feature (1)..( 9): Result.001 file - promoters70/4767701
aattgtaat

SEQ ID NO: 86556 - DNA, 13 bp, Unknown
  misc_feature (1)..( 13): Result.001 file - promoters70/4767701
aagcaatttcaca

SEQ ID NO: 86557 - DNA, 13 bp, Unknown
  misc_feature (1)..( 13): Result.001 file - promoters70/4767701
aatcaatttaaaa

SEQ ID NO: 86558 - DNA, 13 bp, Unknown
  misc_feature (1)..( 13): Result.001 file - promoters70/4767701
aagcaatctcaaa

SEQ ID NO: 86559 - DNA, 13 bp, Unknown
  misc_feature (1)..( 13): Result.001 file - promoters70/4767701
atccaattttgtg

SEQ ID NO: 86560 - DNA, 13 bp, Unknown
  misc_feature (1)..( 13): Result.001 file - promoters70/4767701
catgaatttaaat

SEQ ID NO: 86561 - DNA, 13 bp, Unknown
  misc_feature (1)..( 13): Result.001 file - promoters70/4767701
gtttgattaaaat

SEQ ID NO: 86562 - DNA, 10 bp, Unknown
  misc_feature (1)..( 10): Result.001 file - promoters70/4767701
ggtatatata

SEQ ID NO: 86563 - DNA, 10 bp, Unknown
  misc_feature (1)..( 10): Result.001 file - promoters70/4767701
gttatataaa

SEQ ID NO: 86564 - DNA, 10 bp, Unknown
  misc_feature (1)..( 10): Result.001 file - promoters70/4767701
cttatttatg

SEQ ID NO: 86565 - DNA, 10 bp, Unknown
  misc_feature (1)..( 10): Result.001 file - promoters70/4767701
cttatattct

SEQ ID NO: 86566 - DNA, 10 bp, Unknown
  misc_feature (1)..( 10): Result.001 file - promoters70/4767701
cttatatata

SEQ ID NO: 86567 - DNA, 10 bp, Unknown
  misc_feature (1)..( 10): Result.001 file - promoters70/4767701
gctatataaa

SEQ ID NO: 86568 - DNA, 11 bp, Unknown
  misc_feature (1)..( 11): Result.001 file - promoters70/4767701
aatcaaatagt

SEQ ID NO: 86569 - DNA, 11 bp, Unknown
  misc_feature (1)..( 11): Result.001 file - promoters70/4767701
attcaaatcaa

SEQ ID NO: 86570 - DNA, 11 bp, Unknown
  misc_feature (1)..( 11): Result.001 file - promoters70/4767701
catcaaatagt

SEQ ID NO: 86571 - DNA, 11 bp, Unknown
  misc_feature (1)..( 11): Result.001 file - promoters70/4767701
aatccaatttt

SEQ ID NO: 86572 - DNA, 11 bp, Unknown
  misc_feature (1)..( 11): Result.001 file - promoters70/4767701
atttaaatttt

SEQ ID NO: 86573 - DNA, 11 bp, Unknown
  misc_feature (1)..( 11): Result.001 file - promoters70/4767952
attaaaatgtc

SEQ ID NO: 86574 - DNA, 8 bp, Unknown
  misc_feature (1)..( 8): Result.001 file - promoters70/4767952
caaactaa

SEQ ID NO: 86575 - DNA, 8 bp, Unknown
  misc_feature (1)..( 8): Result.001 file - promoters70/4767952
aaaattaa

SEQ ID NO: 86576 - DNA, 8 bp, Unknown
  misc_feature (1)..( 8): Result.001 file - promoters70/4767952
aaaattta

SEQ ID NO: 86577 - DNA, 8 bp, Unknown
  misc_feature (1)..( 8): Result.001 file - promoters70/4767952
tataaatt

SEQ ID NO: 86578 - DNA, 8 bp, Unknown
  misc_feature (1)..( 8): Result.001 file - promoters70/4767952
attaaatt

SEQ ID NO: 86579 - DNA, 8 bp, Unknown
  misc_feature (1)..( 8): Result.001 file - promoters70/4767952
attaaatg

SEQ ID NO: 86580 - DNA, 8 bp, Unknown
  misc_feature (1)..( 8): Result.001 file - promoters70/4767952
attaaatt

SEQ ID NO: 86581 - DNA, 8 bp, Unknown
  misc_feature (1)..( 8): Result.001 file - promoters70/4767952
tttacatt

SEQ ID NO: 86582 - DNA, 8 bp, Unknown
  misc_feature (1)..( 8): Result.001 file - promoters70/4767952
attaaatg

SEQ ID NO: 86583 - DNA, 7 bp, Unknown
  misc_feature (1)..( 7): Result.001 file - promoters70/4767952
gtagaca

SEQ ID NO: 86584 - DNA, 7 bp, Unknown
  misc_feature (1)..( 7): Result.001 file - promoters70/4767952
gtataca

SEQ ID NO: 86585 - DNA, 7 bp, Unknown
  misc_feature (1)..( 7): Result.001 file - promoters70/4767952
ttataca

SEQ ID NO: 86586 - DNA, 7 bp, Unknown
  misc_feature (1)..( 7): Result.001 file - promoters70/4767952
agaccaa

SEQ ID NO: 86587 - DNA, 7 bp, Unknown
  misc_feature (1)..( 7): Result.001 file - promoters70/4767952
agatcaa

SEQ ID NO: 86588 - DNA, 7 bp, Unknown
  misc_feature (1)..( 7): Result.001 file - promoters70/4767976
ggatcaa

SEQ ID NO: 86589 - DNA, 7 bp, Unknown
  misc_feature (1)..( 7): Result.001 file - promoters70/4767976
ctatata

SEQ ID NO: 86590 - DNA, 7 bp, Unknown
  misc_feature (1)..( 7): Result.001 file - promoters70/4767976
gtatata

SEQ ID NO: 86591 - DNA, 7 bp, Unknown
  misc_feature (1)..( 7): Result.001 file - promoters70/4767982
gtatata

SEQ ID NO: 86592 - DNA, 10 bp, Unknown
  misc_feature (1)..( 10): Result.001 file - promoters70/4767982
ttaaacttgt

SEQ ID NO: 86593 - DNA, 10 bp, Unknown
  misc_feature (1)..( 10): Result.001 file - promoters70/4767982
ttaaacttgc

SEQ ID NO: 86594 - DNA, 10 bp, Unknown
  misc_feature (1)..( 10): Result.001 file - promoters70/4767982
acaaacatgt

SEQ ID NO: 86595 - DNA, 7 bp, Unknown
  misc_feature (1)..( 7): Result.001 file - promoters70/4767982
attctaa

SEQ ID NO: 86596 - DNA, 7 bp, Unknown
  misc_feature (1)..( 7): Result.001 file - promoters70/4767982
attttaa

SEQ ID NO: 86597 - DNA, 7 bp, Unknown
  misc_feature (1)..( 7): Result.001 file - promoters70/4767994
tttttaa

SEQ ID NO: 86598 - DNA, 6 bp, Unknown
  misc_feature (1)..( 6): Result.001 file - promoters70/4767994
aaatga

SEQ ID NO: 86599 - DNA, 6 bp, Unknown
  misc_feature (1)..( 6): Result.001 file - promoters70/4767994
aaatga

SEQ ID NO: 86600 - DNA, 6 bp, Unknown
  misc_feature (1)..( 6): Result.001 file - promoters70/4767994
aaatga

SEQ ID NO: 86601 - DNA, 7 bp, Unknown
  misc_feature (1)..( 7): Result.001 file - promoters70/4767994
tggccct

SEQ ID NO: 86602 - DNA, 7 bp, Unknown
  misc_feature (1)..( 7): Result.001 file - promoters70/4767994
tgggcct

SEQ ID NO: 86603 - DNA, 7 bp, Unknown
  misc_feature (1)..( 7): Result.001 file - promoters70/4767994
tggccct

SEQ ID NO: 86604 - DNA, 11 bp, Unknown
  misc_feature (1)..( 11): Result.001 file - promoters70/4767994
atttgtttatt

SEQ ID NO: 86605 - DNA, 11 bp, Unknown
  misc_feature (1)..( 11): Result.001 file - promoters70/4767994
attagtttatc

SEQ ID NO: 86606 - DNA, 11 bp, Unknown
  misc_feature (1)..( 11): Result.001 file - promoters70/4767994
aactttttatt

SEQ ID NO: 86607 - DNA, 9 bp, Unknown
  misc_feature (1)..( 9): Result.001 file - promoters70/4767994
taaccaata

SEQ ID NO: 86608 - DNA, 9 bp, Unknown
  misc_feature (1)..( 9): Result.001 file - promoters70/4767994
taatcaaaa

SEQ ID NO: 86609 - DNA, 9 bp, Unknown
  misc_feature (1)..( 9): Result.001 file - promoters70/4767994
cgaccaata

SEQ ID NO: 86610 - DNA, 10 bp, Unknown
  misc_feature (1)..( 10): Result.001 file - promoters70/4767994
aatacaaatc

SEQ ID NO: 86611 - DNA, 10 bp, Unknown
  misc_feature (1)..( 10): Result.001 file - promoters70/4767994
aataccaatc

SEQ ID NO: 86612 - DNA, 10 bp, Unknown
  misc_feature (1)..( 10): Result.001 file - promoters70/4767994
aatacaaatc

SEQ ID NO: 86613 - DNA, 7 bp, Unknown
  misc_feature (1)..( 7): Result.001 file - promoters70/4767994
taaggca

SEQ ID NO: 86614 - DNA, 7 bp, Unknown
  misc_feature (1)..( 7): Result.001 file - promoters70/4767994
taaagca

SEQ ID NO: 86615 - DNA, 7 bp, Unknown
  misc_feature (1)..( 7): Result.001 file - promoters70/4767994
taaggca

SEQ ID NO: 86616 - DNA, 11 bp, Unknown
  misc_feature (1)..( 11): Result.001 file - promoters70/4767994
aaataaacaaa

SEQ ID NO: 86617 - DNA, 11 bp, Unknown
  misc_feature (1)..( 11): Result.001 file - promoters70/4767994
aaagaaataaa

SEQ ID NO: 86618 - DNA, 11 bp, Unknown
  misc_feature (1)..( 11): Result.001 file - promoters70/4767994
gaagaaaccgg

SEQ ID NO: 86619 - DNA, 10 bp, Unknown
  misc_feature (1)..( 10): Result.001 file - promoters70/4767994
caccattgtt

SEQ ID NO: 86620 - DNA, 10 bp, Unknown
  misc_feature (1)..( 10): Result.001 file - promoters70/4767994
caccattgtc

SEQ ID NO: 86621 - DNA, 10 bp, Unknown
  misc_feature (1)..( 10): Result.001 file - promoters70/4768007
tttcatcgtc

SEQ ID NO: 86622 - DNA, 15 bp, Unknown
  misc_feature (1)..( 15): Result.001 file - promoters70/4768007
taagaatgtcaacca

SEQ ID NO: 86623 - DNA, 15 bp, Unknown
  misc_feature (1)..( 15): Result.001 file - promoters70/4768007
caagaataggtttaa

SEQ ID NO: 86624 - DNA, 15 bp, Unknown
  misc_feature (1)..( 15): Result.001 file - promoters70/4768007
aaagaaaataataat

SEQ ID NO: 86625 - DNA, 9 bp, Unknown
  misc_feature (1)..( 9): Result.001 file - promoters70/4768007
tatatatag

SEQ ID NO: 86626 - DNA, 9 bp, Unknown
  misc_feature (1)..( 9): Result.001 file - promoters70/4768007
tatataaat

SEQ ID NO: 86627 - DNA, 9 bp, Unknown
  misc_feature (1)..( 9): Result.001 file - promoters70/4768007
tatatatag

SEQ ID NO: 86628 - DNA, 12 bp, Unknown
  misc_feature (1)..( 12): Result.001 file - promoters70/4768007
ttgagtttaggc

SEQ ID NO: 86629 - DNA, 12 bp, Unknown
  misc_feature (1)..( 12): Result.001 file - promoters70/4768007
ttgattttaaac

SEQ ID NO: 86630 - DNA, 12 bp, Unknown
  misc_feature (1)..( 12): Result.001 file - promoters70/4768007
atttttttcaaa

SEQ ID NO: 86631 - DNA, 10 bp, Unknown
  misc_feature (1)..( 10): Result.001 file - promoters70/4768007
ccaaatgttt

SEQ ID NO: 86632 - DNA, 10 bp, Unknown
  misc_feature (1)..( 10): Result.001 file - promoters70/4768007
ccaaataaaa

SEQ ID NO: 86633 - DNA, 10 bp, Unknown
  misc_feature (1)..( 10): Result.001 file - promoters70/4768039
acaaaaaaaa

SEQ ID NO: 86634 - DNA, 9 bp, Unknown
  misc_feature (1)..( 9): Result.001 file - promoters70/4768039
attcctaaa

SEQ ID NO: 86635 - DNA, 9 bp, Unknown
  misc_feature (1)..( 9): Result.001 file - promoters70/4768039
atttctaaa

SEQ ID NO: 86636 - DNA, 9 bp, Unknown
  misc_feature (1)..( 9): Result.001 file - promoters70/4768039
ttttttaac

SEQ ID NO: 86637 - DNA, 8 bp, Unknown
  misc_feature (1)..( 8): Result.001 file - promoters70/4768039
gataatat

SEQ ID NO: 86638 - DNA, 8 bp, Unknown
  misc_feature (1)..( 8): Result.001 file - promoters70/4768039
tataatat

SEQ ID NO: 86639 - DNA, 8 bp, Unknown
  misc_feature (1)..( 8): Result.001 file - promoters70/4768039
tattatag

SEQ ID NO: 86640 - DNA, 11 bp, Unknown
  misc_feature (1)..( 11): Result.001 file - promoters70/4768039
ggaagaaaaag

SEQ ID NO: 86641 - DNA, 11 bp, Unknown
  misc_feature (1)..( 11): Result.001 file - promoters70/4768039
caaaaaaaaag

SEQ ID NO: 86642 - DNA, 11 bp, Unknown
  misc_feature (1)..( 11): Result.001 file - promoters70/4768066
caaacaaaaat

SEQ ID NO: 86643 - DNA, 6 bp, Unknown
  misc_feature (1)..( 6): Result.001 file - promoters70/4768066
gtatat

SEQ ID NO: 86644 - DNA, 6 bp, Unknown
  misc_feature (1)..( 6): Result.001 file - promoters70/4768066
gtatat

SEQ ID NO: 86645 - DNA, 6 bp, Unknown
  misc_feature (1)..( 6): Result.001 file - promoters70/4768147
gtatat

SEQ ID NO: 86646 - DNA, 13 bp, Unknown
  misc_feature (1)..( 13): Result.001 file - promoters70/4768147
ctctactttctcc

SEQ ID NO: 86647 - DNA, 13 bp, Unknown
  misc_feature (1)..( 13): Result.001 file - promoters70/4768147
caataatttttcc

SEQ ID NO: 86648 - DNA, 13 bp, Unknown
  misc_feature (1)..( 13): Result.001 file - promoters70/4768147
ataatgtttgagt

SEQ ID NO: 86649 - DNA, 7 bp, Unknown
  misc_feature (1)..( 7): Result.001 file - promoters70/4768147
tattata

SEQ ID NO: 86650 - DNA, 7 bp, Unknown
  misc_feature (1)..( 7): Result.001 file - promoters70/4768147
tattatg

SEQ ID NO: 86651 - DNA, 7 bp, Unknown
  misc_feature (1)..( 7): Result.001 file - promoters70/4768147
tattata

SEQ ID NO: 86652 - DNA, 10 bp, Unknown
  misc_feature (1)..( 10): Result.001 file - promoters70/4768147
aaaacaataa

SEQ ID NO: 86653 - DNA, 10 bp, Unknown
  misc_feature (1)..( 10): Result.001 file - promoters70/4768147
taaataataa

SEQ ID NO: 86654 - DNA, 10 bp, Unknown
  misc_feature (1)..( 10): Result.001 file - promoters70/4768217
aaaacacaaa

SEQ ID NO: 86655 - DNA, 13 bp, Unknown
  misc_feature (1)..( 13): Result.001 file - promoters70/4768217
aaagaaaagaaag

SEQ ID NO: 86656 - DNA, 13 bp, Unknown
  misc_feature (1)..( 13): Result.001 file - promoters70/4768217
ttagataagtaaa

SEQ ID NO: 86657 - DNA, 13 bp, Unknown
  misc_feature (1)..( 13): Result.001 file - promoters70/4768217
gcccaaaatgaaa

SEQ ID NO: 86658 - DNA, 13 bp, Unknown
  misc_feature (1)..( 13): Result.001 file - promoters70/4768217
gcggataagcaaa

SEQ ID NO: 86659 - DNA, 13 bp, Unknown
  misc_feature (1)..( 13): Result.001 file - promoters70/4768217
ttatatattgcaa

SEQ ID NO: 86660 - DNA, 13 bp, Unknown
  misc_feature (1)..( 13): Result.001 file - promoters70/4768217
taatataagtata

SEQ ID NO: 86661 - DNA, 13 bp, Unknown
  misc_feature (1)..( 13): Result.001 file - promoters70/4768236
aaaaaaattgaaa

SEQ ID NO: 86662 - DNA, 9 bp, Unknown
  misc_feature (1)..( 9): Result.001 file - promoters70/4768236
aaagaaatt

SEQ ID NO: 86663 - DNA, 9 bp, Unknown
  misc_feature (1)..( 9): Result.001 file - promoters70/4768236
ctagaaatt

SEQ ID NO: 86664 - DNA, 9 bp, Unknown
  misc_feature (1)..( 9): Result.001 file - promoters70/4768236
aaaaaaata

SEQ ID NO: 86665 - DNA, 9 bp, Unknown
  misc_feature (1)..( 9): Result.001 file - promoters70/4768236
aagtcaaaa

SEQ ID NO: 86666 - DNA, 9 bp, Unknown
  misc_feature (1)..( 9): Result.001 file - promoters70/4768236
atttcaaaa

SEQ ID NO: 86667 - DNA, 9 bp, Unknown
  misc_feature (1)..( 9): Result.001 file - promoters70/4768236
aagacaaaa

SEQ ID NO: 86668 - DNA, 7 bp, Unknown
  misc_feature (1)..( 7): Result.001 file - promoters70/4768236
aaaaaag

SEQ ID NO: 86669 - DNA, 7 bp, Unknown
  misc_feature (1)..( 7): Result.001 file - promoters70/4768236
aaaaaaa

SEQ ID NO: 86670 - DNA, 7 bp, Unknown
  misc_feature (1)..( 7): Result.001 file - promoters70/4768236
aaacaat

SEQ ID NO: 86671 - DNA, 7 bp, Unknown
  misc_feature (1)..( 7): Result.001 file - promoters70/4768236
aaaatat

SEQ ID NO: 86672 - DNA, 7 bp, Unknown
  misc_feature (1)..( 7): Result.001 file - promoters70/4768236
aaaataa

SEQ ID NO: 86673 - DNA, 8 bp, Unknown
  misc_feature (1)..( 8): Result.001 file - promoters70/4768250
aaaactaa

SEQ ID NO: 86674 - DNA, 9 bp, Unknown
  misc_feature (1)..( 9): Result.001 file - promoters70/4768250
aataatatt

SEQ ID NO: 86675 - DNA, 9 bp, Unknown
  misc_feature (1)..( 9): Result.001 file - promoters70/4768250
aattatatc

SEQ ID NO: 86676 - DNA, 9 bp, Unknown
  misc_feature (1)..( 9): Result.001 file - promoters70/4768250
tacaatatt

SEQ ID NO: 86677 - DNA, 9 bp, Unknown
  misc_feature (1)..( 9): Result.001 file - promoters70/4768250
atcaatatg

SEQ ID NO: 86678 - DNA, 7 bp, Unknown
  misc_feature (1)..( 7): Result.001 file - promoters70/4768250
caagatt

SEQ ID NO: 86679 - DNA, 7 bp, Unknown
  misc_feature (1)..( 7): Result.001 file - promoters70/4768250
caaaatt

SEQ ID NO: 86680 - DNA, 7 bp, Unknown
  misc_feature (1)..( 7): Result.001 file - promoters70/4768250
caatatt

SEQ ID NO: 86681 - DNA, 7 bp, Unknown
  misc_feature (1)..( 7): Result.001 file - promoters70/4768250
caatatg

SEQ ID NO: 86682 - DNA, 10 bp, Unknown
  misc_feature (1)..( 10): Result.001 file - promoters70/4768250
agaaaaacct

SEQ ID NO: 86683 - DNA, 10 bp, Unknown
  misc_feature (1)..( 10): Result.001 file - promoters70/4768250
acaaaaccct

SEQ ID NO: 86684 - DNA, 10 bp, Unknown
  misc_feature (1)..( 10): Result.001 file - promoters70/4768250
agaaaaaaat

SEQ ID NO: 86685 - DNA, 10 bp, Unknown
  misc_feature (1)..( 10): Result.001 file - promoters70/4768250
ctaaaataat

SEQ ID NO: 86686 - DNA, 6 bp, Unknown
  misc_feature (1)..( 6): Result.001 file - promoters70/4768250
aataaa

SEQ ID NO: 86687 - DNA, 6 bp, Unknown
  misc_feature (1)..( 6): Result.001 file - promoters70/4768250
aataaa

SEQ ID NO: 86688 - DNA, 6 bp, Unknown
  misc_feature (1)..( 6): Result.001 file - promoters70/4768250
aataaa

SEQ ID NO: 86689 - DNA, 10 bp, Unknown
  misc_feature (1)..( 10): Result.001 file - promoters70/4768250
cttttagtta

SEQ ID NO: 86690 - DNA, 10 bp, Unknown
  misc_feature (1)..( 10): Result.001 file - promoters70/4768250
cttgtagtac

SEQ ID NO: 86691 - DNA, 10 bp, Unknown
  misc_feature (1)..( 10): Result.001 file - promoters70/4768250
aatttattta

SEQ ID NO: 86692 - DNA, 8 bp, Unknown
  misc_feature (1)..( 8): Result.001 file - promoters70/4768250
aaataata

SEQ ID NO: 86693 - DNA, 8 bp, Unknown
  misc_feature (1)..( 8): Result.001 file - promoters70/4768250
aaaaaatt

SEQ ID NO: 86694 - DNA, 8 bp, Unknown
  misc_feature (1)..( 8): Result.001 file - promoters70/4768250
aaataata

SEQ ID NO: 86695 - DNA, 13 bp, Unknown
  misc_feature (1)..( 13): Result.001 file - promoters70/4768250
agtaatttttgaa

SEQ ID NO: 86696 - DNA, 13 bp, Unknown
  misc_feature (1)..( 13): Result.001 file - promoters70/4768250
agtaatttttggt

SEQ ID NO: 86697 - DNA, 13 bp, Unknown
  misc_feature (1)..( 13): Result.001 file - promoters70/4768250
actgagtttaggt

SEQ ID NO: 86698 - DNA, 8 bp, Unknown
  misc_feature (1)..( 8): Result.001 file - promoters70/4768250
taagttta

SEQ ID NO: 86699 - DNA, 8 bp, Unknown
  misc_feature (1)..( 8): Result.001 file - promoters70/4768250
taatttta

SEQ ID NO: 86700 - DNA, 8 bp, Unknown
  misc_feature (1)..( 8): Result.001 file - promoters70/4768265
caattttg

SEQ ID NO: 86701 - DNA, 8 bp, Unknown
  misc_feature (1)..( 8): Result.001 file - promoters70/4768265
aaaacatt

SEQ ID NO: 86702 - DNA, 8 bp, Unknown
  misc_feature (1)..( 8): Result.001 file - promoters70/4768265
aaaacagt

SEQ ID NO: 86703 - DNA, 8 bp, Unknown
  misc_feature (1)..( 8): Result.001 file - promoters70/4768265
aaaaaatt

SEQ ID NO: 86704 - DNA, 8 bp, Unknown
  misc_feature (1)..( 8): Result.001 file - promoters70/4768285
aaaataat

SEQ ID NO: 86705 - DNA, 7 bp, Unknown
  misc_feature (1)..( 7): Result.001 file - promoters70/4768285
tttcatt

SEQ ID NO: 86706 - DNA, 7 bp, Unknown
  misc_feature (1)..( 7): Result.001 file - promoters70/4768285
tttgatt

SEQ ID NO: 86707 - DNA, 7 bp, Unknown
  misc_feature (1)..( 7): Result.001 file - promoters70/4768285
tttaatt

SEQ ID NO: 86708 - DNA, 7 bp, Unknown
  misc_feature (1)..( 7): Result.001 file - promoters70/4768289
tttgatt

SEQ ID NO: 86709 - DNA, 9 bp, Unknown
  misc_feature (1)..( 9): Result.001 file - promoters70/4768289
gtttattaa

SEQ ID NO: 86710 - DNA, 9 bp, Unknown
  misc_feature (1)..( 9): Result.001 file - promoters70/4768289
atttattaa

SEQ ID NO: 86711 - DNA, 9 bp, Unknown
  misc_feature (1)..( 9): Result.001 file - promoters70/4768319
gtttatgaa

SEQ ID NO: 86712 - DNA, 13 bp, Unknown
  misc_feature (1)..( 13): Result.001 file - promoters70/4768319
catcttcctttgt

SEQ ID NO: 86713 - DNA, 13 bp, Unknown
  misc_feature (1)..( 13): Result.001 file - promoters70/4768319
attcttcgtttgt

SEQ ID NO: 86714 - DNA, 13 bp, Unknown
  misc_feature (1)..( 13): Result.001 file - promoters70/4768319
cattttctttttg

SEQ ID NO: 86715 - DNA, 11 bp, Unknown
  misc_feature (1)..( 11): Result.001 file - promoters70/4768319
tagataattgt

SEQ ID NO: 86716 - DNA, 11 bp, Unknown
  misc_feature (1)..( 11): Result.001 file - promoters70/4768319
cagataagtct

SEQ ID NO: 86717 - DNA, 11 bp, Unknown
  misc_feature (1)..( 11): Result.001 file - promoters70/4768354
tagacaattgt

SEQ ID NO: 86718 - DNA, 11 bp, Unknown
  misc_feature (1)..( 11): Result.001 file - promoters70/4768354
taacatttttt

SEQ ID NO: 86719 - DNA, 11 bp, Unknown
  misc_feature (1)..( 11): Result.001 file - promoters70/4768354
taagatttttg

SEQ ID NO: 86720 - DNA, 11 bp, Unknown
  misc_feature (1)..( 11): Result.001 file - promoters70/4768354
tagaatttttt

SEQ ID NO: 86721 - DNA, 9 bp, Unknown
  misc_feature (1)..( 9): Result.001 file - promoters70/4768354
tttaatcag

SEQ ID NO: 86722 - DNA, 9 bp, Unknown
  misc_feature (1)..( 9): Result.001 file - promoters70/4768354
tttattcag

SEQ ID NO: 86723 - DNA, 9 bp, Unknown
  misc_feature (1)..( 9): Result.001 file - promoters70/4768528
gttattcga

SEQ ID NO: 86724 - DNA, 9 bp, Unknown
  misc_feature (1)..( 9): Result.001 file - promoters70/4768528
aaactttaa

SEQ ID NO: 86725 - DNA, 9 bp, Unknown
  misc_feature (1)..( 9): Result.001 file - promoters70/4768528
aaaatttct

SEQ ID NO: 86726 - DNA, 9 bp, Unknown
  misc_feature (1)..( 9): Result.001 file - promoters70/4768528
aaaatctct

SEQ ID NO: 86727 - DNA, 8 bp, Unknown
  misc_feature (1)..( 8): Result.001 file - promoters70/4768528
tttgaaac

SEQ ID NO: 86728 - DNA, 8 bp, Unknown
  misc_feature (1)..( 8): Result.001 file - promoters70/4768528
tgtgaaac

SEQ ID NO: 86729 - DNA, 8 bp, Unknown
  misc_feature (1)..( 8): Result.001 file - promoters70/4768528
tgtgaaaa

SEQ ID NO: 86730 - DNA, 9 bp, Unknown
  misc_feature (1)..( 9): Result.001 file - promoters70/4768528
gatatttct

SEQ ID NO: 86731 - DNA, 9 bp, Unknown
  misc_feature (1)..( 9): Result.001 file - promoters70/4768528
aaaatttct

SEQ ID NO: 86732 - DNA, 9 bp, Unknown
  misc_feature (1)..( 9): Result.001 file - promoters70/4768528
aaaatctct

SEQ ID NO: 86733 - DNA, 9 bp, Unknown
  misc_feature (1)..( 9): Result.001 file - promoters70/4768528
tttcaaaat

SEQ ID NO: 86734 - DNA, 9 bp, Unknown
  misc_feature (1)..( 9): Result.001 file - promoters70/4768528
tatcaaaat

SEQ ID NO: 86735 - DNA, 9 bp, Unknown
  misc_feature (1)..( 9): Result.001 file - promoters70/4768532
ttttaaaat

SEQ ID NO: 86736 - DNA, 7 bp, Unknown
  misc_feature (1)..( 7): Result.001 file - promoters70/4768532
tttttgt

SEQ ID NO: 86737 - DNA, 7 bp, Unknown
  misc_feature (1)..( 7): Result.001 file - promoters70/4768532
gttttgt

SEQ ID NO: 86738 - DNA, 8 bp, Unknown
  misc_feature (1)..( 8): Result.001 file - promoters70/4768532
attattgg

SEQ ID NO: 86739 - DNA, 9 bp, Unknown
  misc_feature (1)..( 9): Result.001 file - promoters70/4768532
tgtcctaat

SEQ ID NO: 86740 - DNA, 9 bp, Unknown
  misc_feature (1)..( 9): Result.001 file - promoters70/4768532
tgtcttaac

SEQ ID NO: 86741 - DNA, 9 bp, Unknown
  misc_feature (1)..( 9): Result.001 file - promoters70/4768615
cgtccgaat

SEQ ID NO: 86742 - DNA, 10 bp, Unknown
  misc_feature (1)..( 10): Result.001 file - promoters70/4768615
tgaaaatatt

SEQ ID NO: 86743 - DNA, 10 bp, Unknown
  misc_feature (1)..( 10): Result.001 file - promoters70/4768615
caaaaataag

SEQ ID NO: 86744 - DNA, 10 bp, Unknown
  misc_feature (1)..( 10): Result.001 file - promoters70/4768615
taaaaattaa

SEQ ID NO: 86745 - DNA, 10 bp, Unknown
  misc_feature (1)..( 10): Result.001 file - promoters70/4768615
ataaagtata

SEQ ID NO: 86746 - DNA, 10 bp, Unknown
  misc_feature (1)..( 10): Result.001 file - promoters70/4768615
caaaaaaggt

SEQ ID NO: 86747 - DNA, 10 bp, Unknown
  misc_feature (1)..( 10): Result.001 file - promoters70/4768615
gtaaaatttc

SEQ ID NO: 86748 - DNA, 10 bp, Unknown
  misc_feature (1)..( 10): Result.001 file - promoters70/4768615
taaaaatctc

SEQ ID NO: 86749 - DNA, 10 bp, Unknown
  misc_feature (1)..( 10): Result.001 file - promoters70/4768615
aaaacaaacg

SEQ ID NO: 86750 - DNA, 10 bp, Unknown
  misc_feature (1)..( 10): Result.001 file - promoters70/4768615
aaaaaaaaga

SEQ ID NO: 86751 - DNA, 10 bp, Unknown
  misc_feature (1)..( 10): Result.001 file - promoters70/4768615
taaataaatt

SEQ ID NO: 86752 - DNA, 10 bp, Unknown
  misc_feature (1)..( 10): Result.001 file - promoters70/4768615
caaacaaatg

SEQ ID NO: 86753 - DNA, 10 bp, Unknown
  misc_feature (1)..( 10): Result.001 file - promoters70/4768615
ataatgaatt

SEQ ID NO: 86754 - DNA, 10 bp, Unknown
  misc_feature (1)..( 10): Result.001 file - promoters70/4768615
ttaactaatt

SEQ ID NO: 86755 - DNA, 11 bp, Unknown
  misc_feature (1)..( 11): Result.001 file - promoters70/4768615
ataatataact

SEQ ID NO: 86756 - DNA, 11 bp, Unknown
  misc_feature (1)..( 11): Result.001 file - promoters70/4768615
aattacaaaac

SEQ ID NO: 86757 - DNA, 11 bp, Unknown
  misc_feature (1)..( 11): Result.001 file - promoters70/4768615
gtatacaaaaa

SEQ ID NO: 86758 - DNA, 11 bp, Unknown
  misc_feature (1)..( 11): Result.001 file - promoters70/4768615
caatactatct

SEQ ID NO: 86759 - DNA, 11 bp, Unknown
  misc_feature (1)..( 11): Result.001 file - promoters70/4768615
tttaacaaaaa

SEQ ID NO: 86760 - DNA, 11 bp, Unknown
  misc_feature (1)..( 11): Result.001 file - promoters70/4768615
actcccaaaaa

SEQ ID NO: 86761 - DNA, 11 bp, Unknown
  misc_feature (1)..( 11): Result.001 file - promoters70/4768615
aattcctaaaa

SEQ ID NO: 86762 - DNA, 11 bp, Unknown
  misc_feature (1)..( 11): Result.001 file - promoters70/4768615
gaatactaaaa

SEQ ID NO: 86763 - DNA, 13 bp, Unknown
  misc_feature (1)..( 13): Result.001 file - promoters70/4768615
aataaataaaagc

SEQ ID NO: 86764 - DNA, 13 bp, Unknown
  misc_feature (1)..( 13): Result.001 file - promoters70/4768615
aaacaataaaatt

SEQ ID NO: 86765 - DNA, 13 bp, Unknown
  misc_feature (1)..( 13): Result.001 file - promoters70/4768615
atgaaatataagt

SEQ ID NO: 86766 - DNA, 13 bp, Unknown
  misc_feature (1)..( 13): Result.001 file - promoters70/4768615
aaacagtaaaacc

SEQ ID NO: 86767 - DNA, 13 bp, Unknown
  misc_feature (1)..( 13): Result.001 file - promoters70/4768615
aggagataatatt

SEQ ID NO: 86768 - DNA, 13 bp, Unknown
  misc_feature (1)..( 13): Result.001 file - promoters70/4768615
cgtcaaaaaactt

SEQ ID NO: 86769 - DNA, 14 bp, Unknown
  misc_feature (1)..( 14): Result.001 file - promoters70/4768615
gaatgtcaaccaac

SEQ ID NO: 86770 - DNA, 14 bp, Unknown
  misc_feature (1)..( 14): Result.001 file - promoters70/4768615
tttaataaaccaat

SEQ ID NO: 86771 - DNA, 14 bp, Unknown
  misc_feature (1)..( 14): Result.001 file - promoters70/4768615
gagacgagaccaat

SEQ ID NO: 86772 - DNA, 14 bp, Unknown
  misc_feature (1)..( 14): Result.001 file - promoters70/4768615
aacgacaaaacaag

SEQ ID NO: 86773 - DNA, 14 bp, Unknown
  misc_feature (1)..( 14): Result.001 file - promoters70/4768615
aagtacaaaacgaa

SEQ ID NO: 86774 - DNA, 14 bp, Unknown
  misc_feature (1)..( 14): Result.001 file - promoters70/4768615
aacaacaaaaaaag

SEQ ID NO: 86775 - DNA, 7 bp, Unknown
  misc_feature (1)..( 7): Result.001 file - promoters70/4768615
taagatt

SEQ ID NO: 86776 - DNA, 7 bp, Unknown
  misc_feature (1)..( 7): Result.001 file - promoters70/4768615
taaaatt

SEQ ID NO: 86777 - DNA, 7 bp, Unknown
  misc_feature (1)..( 7): Result.001 file - promoters70/4768615
taagatc

SEQ ID NO: 86778 - DNA, 7 bp, Unknown
  misc_feature (1)..( 7): Result.001 file - promoters70/4768615
aaaaatt

SEQ ID NO: 86779 - DNA, 7 bp, Unknown
  misc_feature (1)..( 7): Result.001 file - promoters70/4768615
taaaaat

SEQ ID NO: 86780 - DNA, 7 bp, Unknown
  misc_feature (1)..( 7): Result.001 file - promoters70/4768635
caaaaat

SEQ ID NO: 86781 - DNA, 10 bp, Unknown
  misc_feature (1)..( 10): Result.001 file - promoters70/4768635
aaacaaaaca

SEQ ID NO: 86782 - DNA, 10 bp, Unknown
  misc_feature (1)..( 10): Result.001 file - promoters70/4768635
aaacaaaaac

SEQ ID NO: 86783 - DNA, 10 bp, Unknown
  misc_feature (1)..( 10): Result.001 file - promoters70/4768635
taacataaca

SEQ ID NO: 86784 - DNA, 10 bp, Unknown
  misc_feature (1)..( 10): Result.001 file - promoters70/4768635
ctacaaaaat

SEQ ID NO: 86785 - DNA, 11 bp, Unknown
  misc_feature (1)..( 11): Result.001 file - promoters70/4768635
acccaataact

SEQ ID NO: 86786 - DNA, 11 bp, Unknown
  misc_feature (1)..( 11): Result.001 file - promoters70/4768698
aggctataaat

SEQ ID NO: 86787 - DNA, 8 bp, Unknown
  misc_feature (1)..( 8): Result.001 file - promoters70/4768698
attagttc

SEQ ID NO: 86788 - DNA, 8 bp, Unknown
  misc_feature (1)..( 8): Result.001 file - promoters70/4768698
atttgtta

SEQ ID NO: 86789 - DNA, 8 bp, Unknown
  misc_feature (1)..( 8): Result.001 file - promoters70/4768698
attagtta

SEQ ID NO: 86790 - DNA, 8 bp, Unknown
  misc_feature (1)..( 8): Result.001 file - promoters70/4768698
attagtta

SEQ ID NO: 86791 - DNA, 8 bp, Unknown
  misc_feature (1)..( 8): Result.001 file - promoters70/4768698
aattgtta

SEQ ID NO: 86792 - DNA, 14 bp, Unknown
  misc_feature (1)..( 14): Result.001 file - promoters70/4768698
aattcgaatttttc

SEQ ID NO: 86793 - DNA, 14 bp, Unknown
  misc_feature (1)..( 14): Result.001 file - promoters70/4768698
ggccggaattttag

SEQ ID NO: 86794 - DNA, 14 bp, Unknown
  misc_feature (1)..( 14): Result.001 file - promoters70/4768698
atttgaaattttca

SEQ ID NO: 86795 - DNA, 14 bp, Unknown
  misc_feature (1)..( 14): Result.001 file - promoters70/4768698
tttgaaaatttcat

SEQ ID NO: 86796 - DNA, 14 bp, Unknown
  misc_feature (1)..( 14): Result.001 file - promoters70/4768698
gcgctaaactttta

SEQ ID NO: 86797 - DNA, 16 bp, Unknown
  misc_feature (1)..( 16): Result.001 file - promoters70/4768698
attcgaatttttcaat

SEQ ID NO: 86798 - DNA, 16 bp, Unknown
  misc_feature (1)..( 16): Result.001 file - promoters70/4768698
tttagtctattttaat

SEQ ID NO: 86799 - DNA, 16 bp, Unknown
  misc_feature (1)..( 16): Result.001 file - promoters70/4768698
atttgaaattttcata

SEQ ID NO: 86800 - DNA, 16 bp, Unknown
  misc_feature (1)..( 16): Result.001 file - promoters70/4768698
gcgctaaacttttaaa

SEQ ID NO: 86801 - DNA, 16 bp, Unknown
  misc_feature (1)..( 16): Result.001 file - promoters70/4768698
tttgaaaatttcataa

SEQ ID NO: 86802 - DNA, 14 bp, Unknown
  misc_feature (1)..( 14): Result.001 file - promoters70/4768698
atgttagataggaa

SEQ ID NO: 86803 - DNA, 14 bp, Unknown
  misc_feature (1)..( 14): Result.001 file - promoters70/4768698
gtgttaaatatgaa

SEQ ID NO: 86804 - DNA, 14 bp, Unknown
  misc_feature (1)..( 14): Result.001 file - promoters70/4768698
ttgttttatttact

SEQ ID NO: 86805 - DNA, 14 bp, Unknown
  misc_feature (1)..( 14): Result.001 file - promoters70/4768698
ttctaaaatattgt

SEQ ID NO: 86806 - DNA, 8 bp, Unknown
  misc_feature (1)..( 8): Result.001 file - promoters70/4768698
tatataaa

SEQ ID NO: 86807 - DNA, 8 bp, Unknown
  misc_feature (1)..( 8): Result.001 file - promoters70/4768698
tatataaa

SEQ ID NO: 86808 - DNA, 8 bp, Unknown
  misc_feature (1)..( 8): Result.001 file - promoters70/4768698
tatataaa

SEQ ID NO: 86809 - DNA, 8 bp, Unknown
  misc_feature (1)..( 8): Result.001 file - promoters70/4768698
cctataaa

SEQ ID NO: 86810 - DNA, 8 bp, Unknown
  misc_feature (1)..( 8): Result.001 file - promoters70/4768698
gaaaattc

SEQ ID NO: 86811 - DNA, 8 bp, Unknown
  misc_feature (1)..( 8): Result.001 file - promoters70/4768698
gaaaattt

SEQ ID NO: 86812 - DNA, 8 bp, Unknown
  misc_feature (1)..( 8): Result.001 file - promoters70/4768698
tgaaattt

SEQ ID NO: 86813 - DNA, 8 bp, Unknown
  misc_feature (1)..( 8): Result.001 file - promoters70/4768698
taaacttt

SEQ ID NO: 86814 - DNA, 11 bp, Unknown
  misc_feature (1)..( 11): Result.001 file - promoters70/4768698
cttataattat

SEQ ID NO: 86815 - DNA, 11 bp, Unknown
  misc_feature (1)..( 11): Result.001 file - promoters70/4768698
tttataagtat

SEQ ID NO: 86816 - DNA, 11 bp, Unknown
  misc_feature (1)..( 11): Result.001 file - promoters70/4768698
tttgtaacttc

SEQ ID NO: 86817 - DNA, 11 bp, Unknown
  misc_feature (1)..( 11): Result.001 file - promoters70/4768698
gttattagtta

SEQ ID NO: 86818 - DNA, 11 bp, Unknown
  misc_feature (1)..( 11): Result.001 file - promoters70/4768698
gttattagtta

SEQ ID NO: 86819 - DNA, 10 bp, Unknown
  misc_feature (1)..( 10): Result.001 file - promoters70/4768698
gtaacttcag

SEQ ID NO: 86820 - DNA, 10 bp, Unknown
  misc_feature (1)..( 10): Result.001 file - promoters70/4768698
ataactttat

SEQ ID NO: 86821 - DNA, 10 bp, Unknown
  misc_feature (1)..( 10): Result.001 file - promoters70/4768698
ataactttat

SEQ ID NO: 86822 - DNA, 10 bp, Unknown
  misc_feature (1)..( 10): Result.001 file - promoters70/4768698
atatctttat

SEQ ID NO: 86823 - DNA, 18 bp, Unknown
  misc_feature (1)..( 18): Result.001 file - promoters70/4768698
ttgttatgtaaattttga

SEQ ID NO: 86824 - DNA, 18 bp, Unknown
  misc_feature (1)..( 18): Result.001 file - promoters70/4768698
attgtgaaataattttgt

SEQ ID NO: 86825 - DNA, 18 bp, Unknown
  misc_feature (1)..( 18): Result.001 file - promoters70/4768698
attgtgaaataattttgt

SEQ ID NO: 86826 - DNA, 18 bp, Unknown
  misc_feature (1)..( 18): Result.001 file - promoters70/4768829
taattgttaatcttttga

SEQ ID NO: 86827 - DNA, 8 bp, Unknown
  misc_feature (1)..( 8): Result.001 file - promoters70/4768829
caaattat

SEQ ID NO: 86828 - DNA, 8 bp, Unknown
  misc_feature (1)..( 8): Result.001 file - promoters70/4768829
caaaatat

SEQ ID NO: 86829 - DNA, 8 bp, Unknown
  misc_feature (1)..( 8): Result.001 file - promoters70/4768829
caaattat

SEQ ID NO: 86830 - DNA, 7 bp, Unknown
  misc_feature (1)..( 7): Result.001 file - promoters70/4768829
tatttct

SEQ ID NO: 86831 - DNA, 7 bp, Unknown
  misc_feature (1)..( 7): Result.001 file - promoters70/4768829
tatgtct

SEQ ID NO: 86832 - DNA, 7 bp, Unknown
  misc_feature (1)..( 7): Result.001 file - promoters70/4768829
aatgtct

SEQ ID NO: 86833 - DNA, 7 bp, Unknown
  misc_feature (1)..( 7): Result.001 file - promoters70/4768829
tttattt

SEQ ID NO: 86834 - DNA, 7 bp, Unknown
  misc_feature (1)..( 7): Result.001 file - promoters70/4768829
tttattt

SEQ ID NO: 86835 - DNA, 7 bp, Unknown
  misc_feature (1)..( 7): Result.001 file - promoters70/4768829
tttatta

SEQ ID NO: 86836 - DNA, 8 bp, Unknown
  misc_feature (1)..( 8): Result.001 file - promoters70/4768829
taaaaaaa

SEQ ID NO: 86837 - DNA, 8 bp, Unknown
  misc_feature (1)..( 8): Result.001 file - promoters70/4768829
taaaaaag

SEQ ID NO: 86838 - DNA, 9 bp, Unknown
  misc_feature (1)..( 9): Result.001 file - promoters70/4768829
taaacaaaa

SEQ ID NO: 86839 - DNA, 7 bp, Unknown
  misc_feature (1)..( 7): Result.001 file - promoters70/4768829
aaatcaa

SEQ ID NO: 86840 - DNA, 7 bp, Unknown
  misc_feature (1)..( 7): Result.001 file - promoters70/4768829
gaatcaa

SEQ ID NO: 86841 - DNA, 7 bp, Unknown
  misc_feature (1)..( 7): Result.001 file - promoters70/4768848
gaatcac

SEQ ID NO: 86842 - DNA, 9 bp, Unknown
  misc_feature (1)..( 9): Result.001 file - promoters70/4768848
atctccatc

SEQ ID NO: 86843 - DNA, 9 bp, Unknown
  misc_feature (1)..( 9): Result.001 file - promoters70/4768848
tactccatt

SEQ ID NO: 86844 - DNA, 9 bp, Unknown
  misc_feature (1)..( 9): Result.001 file - promoters70/4768848
tactcaatt

SEQ ID NO: 86845 - DNA, 7 bp, Unknown
  misc_feature (1)..( 7): Result.001 file - promoters70/4768848
attaaat

SEQ ID NO: 86846 - DNA, 7 bp, Unknown
  misc_feature (1)..( 7): Result.001 file - promoters70/4768848
attaaaa

SEQ ID NO: 86847 - DNA, 8 bp, Unknown
  misc_feature (1)..( 8): Result.001 file - promoters70/4769059
tttataat

SEQ ID NO: 86848 - DNA, 12 bp, Unknown
  misc_feature (1)..( 12): Result.001 file - promoters70/4769059
ctatctctttat

SEQ ID NO: 86849 - DNA, 12 bp, Unknown
  misc_feature (1)..( 12): Result.001 file - promoters70/4769059
ttatatctgtat

SEQ ID NO: 86850 - DNA, 12 bp, Unknown
  misc_feature (1)..( 12): Result.001 file - promoters70/4769137
ttagatcgtacc

SEQ ID NO: 86851 - DNA, 9 bp, Unknown
  misc_feature (1)..( 9): Result.001 file - promoters70/4769137
tttgtctat

SEQ ID NO: 86852 - DNA, 9 bp, Unknown
  misc_feature (1)..( 9): Result.001 file - promoters70/4769137
tttttcttt

SEQ ID NO: 86853 - DNA, 9 bp, Unknown
  misc_feature (1)..( 9): Result.001 file - promoters70/4769137
gttgtcttt

SEQ ID NO: 86854 - DNA, 9 bp, Unknown
  misc_feature (1)..( 9): Result.001 file - promoters70/4769137
atttacttt

SEQ ID NO: 86855 - DNA, 8 bp, Unknown
  misc_feature (1)..( 8): Result.001 file - promoters70/4769137
taaaaaaa

SEQ ID NO: 86856 - DNA, 8 bp, Unknown
  misc_feature (1)..( 8): Result.001 file - promoters70/4769137
taacaaat

SEQ ID NO: 86857 - DNA, 8 bp, Unknown
  misc_feature (1)..( 8): Result.001 file - promoters70/4769137
taacaaaa

SEQ ID NO: 86858 - DNA, 8 bp, Unknown
  misc_feature (1)..( 8): Result.001 file - promoters70/4769137
tttttgtg

SEQ ID NO: 86859 - DNA, 8 bp, Unknown
  misc_feature (1)..( 8): Result.001 file - promoters70/4769137
ttttggtg

SEQ ID NO: 86860 - DNA, 8 bp, Unknown
  misc_feature (1)..( 8): Result.001 file - promoters70/4769137
atttggta

SEQ ID NO: 86861 - DNA, 6 bp, Unknown
  misc_feature (1)..( 6): Result.001 file - promoters70/4769137
tataaa

SEQ ID NO: 86862 - DNA, 6 bp, Unknown
  misc_feature (1)..( 6): Result.001 file - promoters70/4769137
tataaa

SEQ ID NO: 86863 - DNA, 6 bp, Unknown
  misc_feature (1)..( 6): Result.001 file - promoters70/4769137
tataaa

SEQ ID NO: 86864 - DNA, 8 bp, Unknown
  misc_feature (1)..( 8): Result.001 file - promoters70/4769137
tttttttg

SEQ ID NO: 86865 - DNA, 8 bp, Unknown
  misc_feature (1)..( 8): Result.001 file - promoters70/4769137
ttttttag

SEQ ID NO: 86866 - DNA, 9 bp, Unknown
  misc_feature (1)..( 9): Result.001 file - promoters70/4769137
ttttattag

SEQ ID NO: 86867 - DNA, 9 bp, Unknown
  misc_feature (1)..( 9): Result.001 file - promoters70/4769137
attactttg

SEQ ID NO: 86868 - DNA, 9 bp, Unknown
  misc_feature (1)..( 9): Result.001 file - promoters70/4769137
tttactttg

SEQ ID NO: 86869 - DNA, 9 bp, Unknown
  misc_feature (1)..( 9): Result.001 file - promoters70/4769137
ttttctttt

SEQ ID NO: 86870 - DNA, 9 bp, Unknown
  misc_feature (1)..( 9): Result.001 file - promoters70/4769137
ccactagtt

SEQ ID NO: 86871 - DNA, 9 bp, Unknown
  misc_feature (1)..( 9): Result.001 file - promoters70/4769137
ttactggtt

SEQ ID NO: 86872 - DNA, 9 bp, Unknown
  misc_feature (1)..( 9): Result.001 file - promoters70/4769153
ccaccagtt

SEQ ID NO: 86873 - DNA, 13 bp, Unknown
  misc_feature (1)..( 13): Result.001 file - promoters70/4769153
acattataaaata

SEQ ID NO: 86874 - DNA, 13 bp, Unknown
  misc_feature (1)..( 13): Result.001 file - promoters70/4769153
acattaaaaaaat

SEQ ID NO: 86875 - DNA, 13 bp, Unknown
  misc_feature (1)..( 13): Result.001 file - promoters70/4769153
tatatatataata

SEQ ID NO: 86876 - DNA, 10 bp, Unknown
  misc_feature (1)..( 10): Result.001 file - promoters70/4769153
aaattgttta

SEQ ID NO: 86877 - DNA, 10 bp, Unknown
  misc_feature (1)..( 10): Result.001 file - promoters70/4769153
aaaatgtagt

SEQ ID NO: 86878 - DNA, 10 bp, Unknown
  misc_feature (1)..( 10): Result.001 file - promoters70/4769180
atatttttta

SEQ ID NO: 86879 - DNA, 9 bp, Unknown
  misc_feature (1)..( 9): Result.001 file - promoters70/4769180
aaaaacatt

SEQ ID NO: 86880 - DNA, 9 bp, Unknown
  misc_feature (1)..( 9): Result.001 file - promoters70/4769180
gaaaaaatt

SEQ ID NO: 86881 - DNA, 9 bp, Unknown
  misc_feature (1)..( 9): Result.001 file - promoters70/4769180
acaataatc

SEQ ID NO: 86882 - DNA, 10 bp, Unknown
  misc_feature (1)..( 10): Result.001 file - promoters70/4769180
caaaaaaaag

SEQ ID NO: 86883 - DNA, 10 bp, Unknown
  misc_feature (1)..( 10): Result.001 file - promoters70/4769180
atggaaaaag

SEQ ID NO: 86884 - DNA, 10 bp, Unknown
  misc_feature (1)..( 10): Result.001 file - promoters70/4769180
aaataaaata

SEQ ID NO: 86885 - DNA, 9 bp, Unknown
  misc_feature (1)..( 9): Result.001 file - promoters70/4769180
tgtttacag

SEQ ID NO: 86886 - DNA, 9 bp, Unknown
  misc_feature (1)..( 9): Result.001 file - promoters70/4769180
tagttacag

SEQ ID NO: 86887 - DNA, 9 bp, Unknown
  misc_feature (1)..( 9): Result.001 file - promoters70/4769180
taggtacat

SEQ ID NO: 86888 - DNA, 7 bp, Unknown
  misc_feature (1)..( 7): Result.001 file - promoters70/4769180
agaaaat

SEQ ID NO: 86889 - DNA, 7 bp, Unknown
  misc_feature (1)..( 7): Result.001 file - promoters70/4769180
agaaaag

SEQ ID NO: 86890 - DNA, 7 bp, Unknown
  misc_feature (1)..( 7): Result.001 file - promoters70/4769180
tgaaaag

SEQ ID NO: 86891 - DNA, 8 bp, Unknown
  misc_feature (1)..( 8): Result.001 file - promoters70/4769180
aagaaaaa

SEQ ID NO: 86892 - DNA, 8 bp, Unknown
  misc_feature (1)..( 8): Result.001 file - promoters70/4769180
aagaaaaa

SEQ ID NO: 86893 - DNA, 8 bp, Unknown
  misc_feature (1)..( 8): Result.001 file - promoters70/4769180
gagagaaa

SEQ ID NO: 86894 - DNA, 8 bp, Unknown
  misc_feature (1)..( 8): Result.001 file - promoters70/4769180
ttcctctt

SEQ ID NO: 86895 - DNA, 8 bp, Unknown
  misc_feature (1)..( 8): Result.001 file - promoters70/4769180
ttcttctt

SEQ ID NO: 86896 - DNA, 8 bp, Unknown
  misc_feature (1)..( 8): Result.001 file - promoters70/4769180
ttctgctt

SEQ ID NO: 86897 - DNA, 9 bp, Unknown
  misc_feature (1)..( 9): Result.001 file - promoters70/4769180
gtaacaaat

SEQ ID NO: 86898 - DNA, 9 bp, Unknown
  misc_feature (1)..( 9): Result.001 file - promoters70/4769180
ataataaat

SEQ ID NO: 86899 - DNA, 9 bp, Unknown
  misc_feature (1)..( 9): Result.001 file - promoters70/4769180
ataatagta

SEQ ID NO: 86900 - DNA, 7 bp, Unknown
  misc_feature (1)..( 7): Result.001 file - promoters70/4769180
ctaaaat

SEQ ID NO: 86901 - DNA, 7 bp, Unknown
  misc_feature (1)..( 7): Result.001 file - promoters70/4769180
ctataat

SEQ ID NO: 86902 - DNA, 7 bp, Unknown
  misc_feature (1)..( 7): Result.001 file - promoters70/4769180
atataat

SEQ ID NO: 86903 - DNA, 9 bp, Unknown
  misc_feature (1)..( 9): Result.001 file - promoters70/4769180
aaatcaatc

SEQ ID NO: 86904 - DNA, 9 bp, Unknown
  misc_feature (1)..( 9): Result.001 file - promoters70/4769180
aaattaatc

SEQ ID NO: 86905 - DNA, 9 bp, Unknown
  misc_feature (1)..( 9): Result.001 file - promoters70/4769180
tgatttatc

SEQ ID NO: 86906 - DNA, 11 bp, Unknown
  misc_feature (1)..( 11): Result.001 file - promoters70/4769180
taattaccaaa

SEQ ID NO: 86907 - DNA, 11 bp, Unknown
  misc_feature (1)..( 11): Result.001 file - promoters70/4769180
gaataaccaaa

SEQ ID NO: 86908 - DNA, 11 bp, Unknown
  misc_feature (1)..( 11): Result.001 file - promoters70/4769180
gaataatattt

SEQ ID NO: 86909 - DNA, 8 bp, Unknown
  misc_feature (1)..( 8): Result.001 file - promoters70/4769180
aaaacatt

SEQ ID NO: 86910 - DNA, 8 bp, Unknown
  misc_feature (1)..( 8): Result.001 file - promoters70/4769180
aaaatatt

SEQ ID NO: 86911 - DNA, 8 bp, Unknown
  misc_feature (1)..( 8): Result.001 file - promoters70/4769301
ttaatatt

SEQ ID NO: 86912 - DNA, 14 bp, Unknown
  misc_feature (1)..( 14): Result.001 file - promoters70/4769301
ggtcttacaatttt

SEQ ID NO: 86913 - DNA, 14 bp, Unknown
  misc_feature (1)..( 14): Result.001 file - promoters70/4769301
agaaatacaatttt

SEQ ID NO: 86914 - DNA, 14 bp, Unknown
  misc_feature (1)..( 14): Result.001 file - promoters70/4769301
agaactactattcg

SEQ ID NO: 86915 - DNA, 8 bp, Unknown
  misc_feature (1)..( 8): Result.001 file - promoters70/4769301
ctaaaata

SEQ ID NO: 86916 - DNA, 8 bp, Unknown
  misc_feature (1)..( 8): Result.001 file - promoters70/4769301
ctaaaaaa

SEQ ID NO: 86917 - DNA, 8 bp, Unknown
  misc_feature (1)..( 8): Result.001 file - promoters70/4769301
ttaaaaaa

SEQ ID NO: 86918 - DNA, 7 bp, Unknown
  misc_feature (1)..( 7): Result.001 file - promoters70/4769301
cttttgg

SEQ ID NO: 86919 - DNA, 7 bp, Unknown
  misc_feature (1)..( 7): Result.001 file - promoters70/4769301
tttttgg

SEQ ID NO: 86920 - DNA, 7 bp, Unknown
  misc_feature (1)..( 7): Result.001 file - promoters70/4769301
tttttgt

SEQ ID NO: 86921 - DNA, 10 bp, Unknown
  misc_feature (1)..( 10): Result.001 file - promoters70/4769301
ttttaaaaga

SEQ ID NO: 86922 - DNA, 10 bp, Unknown
  misc_feature (1)..( 10): Result.001 file - promoters70/4769301
tttcaaaaaa

SEQ ID NO: 86923 - DNA, 10 bp, Unknown
  misc_feature (1)..( 10): Result.001 file - promoters70/4769312
ttgcaaaaaa

SEQ ID NO: 86924 - DNA, 11 bp, Unknown
  misc_feature (1)..( 11): Result.001 file - promoters70/4769312
aaataaaatgt

SEQ ID NO: 86925 - DNA, 11 bp, Unknown
  misc_feature (1)..( 11): Result.001 file - promoters70/4769312
tgctaaaattg

SEQ ID NO: 86926 - DNA, 11 bp, Unknown
  misc_feature (1)..( 11): Result.001 file - promoters70/4769312
aaagaaaacat

SEQ ID NO: 86927 - DNA, 11 bp, Unknown
  misc_feature (1)..( 11): Result.001 file - promoters70/4769312
acgtaagattg

SEQ ID NO: 86928 - DNA, 11 bp, Unknown
  misc_feature (1)..( 11): Result.001 file - promoters70/4769312
caaaatagatt

SEQ ID NO: 86929 - DNA, 11 bp, Unknown
  misc_feature (1)..( 11): Result.001 file - promoters70/4769312
aaaaaaagaaa

SEQ ID NO: 86930 - DNA, 11 bp, Unknown
  misc_feature (1)..( 11): Result.001 file - promoters70/4769312
caataaagtag

SEQ ID NO: 86931 - DNA, 11 bp, Unknown
  misc_feature (1)..( 11): Result.001 file - promoters70/4769312
aaataaagctt

SEQ ID NO: 86932 - DNA, 11 bp, Unknown
  misc_feature (1)..( 11): Result.001 file - promoters70/4769312
caacaaaatag

SEQ ID NO: 86933 - DNA, 11 bp, Unknown
  misc_feature (1)..( 11): Result.001 file - promoters70/4769312
aaacaaagaaa

SEQ ID NO: 86934 - DNA, 11 bp, Unknown
  misc_feature (1)..( 11): Result.001 file - promoters70/4769312
caataaagtag

SEQ ID NO: 86935 - DNA, 11 bp, Unknown
  misc_feature (1)..( 11): Result.001 file - promoters70/4769312
aaataaagctt

SEQ ID NO: 86936 - DNA, 7 bp, Unknown
  misc_feature (1)..( 7): Result.001 file - promoters70/4769312
aaattaa

SEQ ID NO: 86937 - DNA, 7 bp, Unknown
  misc_feature (1)..( 7): Result.001 file - promoters70/4769312
aaattat

SEQ ID NO: 86938 - DNA, 7 bp, Unknown
  misc_feature (1)..( 7): Result.001 file - promoters70/4769312
aaagtaa

SEQ ID NO: 86939 - DNA, 7 bp, Unknown
  misc_feature (1)..( 7): Result.001 file - promoters70/4769312
aaatatt

SEQ ID NO: 86940 - DNA, 8 bp, Unknown
  misc_feature (1)..( 8): Result.001 file - promoters70/4769312
ggaaaaaa

SEQ ID NO: 86941 - DNA, 8 bp, Unknown
  misc_feature (1)..( 8): Result.001 file - promoters70/4769312
tgaacaaa

SEQ ID NO: 86942 - DNA, 8 bp, Unknown
  misc_feature (1)..( 8): Result.001 file - promoters70/4769312
tgaccaaa

SEQ ID NO: 86943 - DNA, 11 bp, Unknown
  misc_feature (1)..( 11): Result.001 file - promoters70/4769312
gaatctctctg

SEQ ID NO: 86944 - DNA, 11 bp, Unknown
  misc_feature (1)..( 11): Result.001 file - promoters70/4769312
caatcactctc

SEQ ID NO: 86945 - DNA, 11 bp, Unknown
  misc_feature (1)..( 11): Result.001 file - promoters70/4769312
caatccctctc

SEQ ID NO: 86946 - DNA, 10 bp, Unknown
  misc_feature (1)..( 10): Result.001 file - promoters70/4769312
tatatatacc

SEQ ID NO: 86947 - DNA, 10 bp, Unknown
  misc_feature (1)..( 10): Result.001 file - promoters70/4769312
tatataatag

SEQ ID NO: 86948 - DNA, 10 bp, Unknown
  misc_feature (1)..( 10): Result.001 file - promoters70/4769312
tatataaacc

SEQ ID NO: 86949 - DNA, 10 bp, Unknown
  misc_feature (1)..( 10): Result.001 file - promoters70/4769312
tatttaaaca

SEQ ID NO: 86950 - DNA, 9 bp, Unknown
  misc_feature (1)..( 9): Result.001 file - promoters70/4769312
ttgaccagg

SEQ ID NO: 86951 - DNA, 9 bp, Unknown
  misc_feature (1)..( 9): Result.001 file - promoters70/4769312
ttgaccaaa

SEQ ID NO: 86952 - DNA, 9 bp, Unknown
  misc_feature (1)..( 9): Result.001 file - promoters70/4769328
atgaacaaa

SEQ ID NO: 86953 - DNA, 12 bp, Unknown
  misc_feature (1)..( 12): Result.001 file - promoters70/4769328
aagaaaattgac

SEQ ID NO: 86954 - DNA, 12 bp, Unknown
  misc_feature (1)..( 12): Result.001 file - promoters70/4769328
gtcaaatttgtc

SEQ ID NO: 86955 - DNA, 12 bp, Unknown
  misc_feature (1)..( 12): Result.001 file - promoters70/4769328
aagaaatttgct

SEQ ID NO: 86956 - DNA, 12 bp, Unknown
  misc_feature (1)..( 12): Result.001 file - promoters70/4769328
taacaatttttt

SEQ ID NO: 86957 - DNA, 12 bp, Unknown
  misc_feature (1)..( 12): Result.001 file - promoters70/4769328
tatgaatctgct

SEQ ID NO: 86958 - DNA, 10 bp, Unknown
  misc_feature (1)..( 10): Result.001 file - promoters70/4769328
ttcatcgttt

SEQ ID NO: 86959 - DNA, 10 bp, Unknown
  misc_feature (1)..( 10): Result.001 file - promoters70/4769328
ttcttcgaca

SEQ ID NO: 86960 - DNA, 10 bp, Unknown
  misc_feature (1)..( 10): Result.001 file - promoters70/4769328
agcttcgacg

SEQ ID NO: 86961 - DNA, 10 bp, Unknown
  misc_feature (1)..( 10): Result.001 file - promoters70/4769328
acctttgacc

SEQ ID NO: 86962 - DNA, 10 bp, Unknown
  misc_feature (1)..( 10): Result.001 file - promoters70/4769328
ttcttctttg

SEQ ID NO: 86963 - DNA, 10 bp, Unknown
  misc_feature (1)..( 10): Result.001 file - promoters70/4770260
aattttaacc

SEQ ID NO: 86964 - DNA, 8 bp, Unknown
  misc_feature (1)..( 8): Result.001 file - promoters70/4770260
cttcatat

SEQ ID NO: 86965 - DNA, 8 bp, Unknown
  misc_feature (1)..( 8): Result.001 file - promoters70/4770260
attcatat

SEQ ID NO: 86966 - DNA, 8 bp, Unknown
  misc_feature (1)..( 8): Result.001 file - promoters70/4770260
atttatat

SEQ ID NO: 86967 - DNA, 6 bp, Unknown
  misc_feature (1)..( 6): Result.001 file - promoters70/4770260
ccattt

SEQ ID NO: 86968 - DNA, 8 bp, Unknown
  misc_feature (1)..( 8): Result.001 file - promoters70/4770260
ttccattt

SEQ ID NO: 86969 - DNA, 8 bp, Unknown
  misc_feature (1)..( 8): Result.001 file - promoters70/4770260
ttcccttt

SEQ ID NO: 86970 - DNA, 8 bp, Unknown
  misc_feature (1)..( 8): Result.001 file - promoters70/4770260
tttgaaat

SEQ ID NO: 86971 - DNA, 8 bp, Unknown
  misc_feature (1)..( 8): Result.001 file - promoters70/4770260
tttcaaat

SEQ ID NO: 86972 - DNA, 8 bp, Unknown
  misc_feature (1)..( 8): Result.001 file - promoters70/4770278
cttcaaag

SEQ ID NO: 86973 - DNA, 8 bp, Unknown
  misc_feature (1)..( 8): Result.001 file - promoters70/4770278
caaaaatc

SEQ ID NO: 86974 - DNA, 8 bp, Unknown
  misc_feature (1)..( 8): Result.001 file - promoters70/4770278
taaatatc

SEQ ID NO: 86975 - DNA, 8 bp, Unknown
  misc_feature (1)..( 8): Result.001 file - promoters70/4770278
caaaaaaa

SEQ ID NO: 86976 - DNA, 6 bp, Unknown
  misc_feature (1)..( 6): Result.001 file - promoters70/4770278
tttgtc

SEQ ID NO: 86977 - DNA, 6 bp, Unknown
  misc_feature (1)..( 6): Result.001 file - promoters70/4770278
tttgtc

SEQ ID NO: 86978 - DNA, 7 bp, Unknown
  misc_feature (1)..( 7): Result.001 file - promoters70/4770278
tttagtc

SEQ ID NO: 86979 - DNA, 8 bp, Unknown
  misc_feature (1)..( 8): Result.001 file - promoters70/4770278
aaagaaaa

SEQ ID NO: 86980 - DNA, 8 bp, Unknown
  misc_feature (1)..( 8): Result.001 file - promoters70/4770278
aaataaat

SEQ ID NO: 86981 - DNA, 8 bp, Unknown
  misc_feature (1)..( 8): Result.001 file - promoters70/4770305
aaagaaaa

SEQ ID NO: 86982 - DNA, 8 bp, Unknown
  misc_feature (1)..( 8): Result.001 file - promoters70/4770305
cttttaga

SEQ ID NO: 86983 - DNA, 8 bp, Unknown
  misc_feature (1)..( 8): Result.001 file - promoters70/4770305
tgtttaga

SEQ ID NO: 86984 - DNA, 8 bp, Unknown
  misc_feature (1)..( 8): Result.001 file - promoters70/4770379
tgttgaga

SEQ ID NO: 86985 - DNA, 11 bp, Unknown
  misc_feature (1)..( 11): Result.001 file - promoters70/4770379
aagtaaacaaa

SEQ ID NO: 86986 - DNA, 11 bp, Unknown
  misc_feature (1)..( 11): Result.001 file - promoters70/4770379
aagaaaacaaa

SEQ ID NO: 86987 - DNA, 12 bp, Unknown
  misc_feature (1)..( 12): Result.001 file - promoters70/4770379
ttcataacgaaa

SEQ ID NO: 86988 - DNA, 7 bp, Unknown
  misc_feature (1)..( 7): Result.001 file - promoters70/4770379
tttcttt

SEQ ID NO: 86989 - DNA, 7 bp, Unknown
  misc_feature (1)..( 7): Result.001 file - promoters70/4770379
ttttttt

SEQ ID NO: 86990 - DNA, 7 bp, Unknown
  misc_feature (1)..( 7): Result.001 file - promoters70/4770379
tttttag

SEQ ID NO: 86991 - DNA, 9 bp, Unknown
  misc_feature (1)..( 9): Result.001 file - promoters70/4770379
atatacatt

SEQ ID NO: 86992 - DNA, 9 bp, Unknown
  misc_feature (1)..( 9): Result.001 file - promoters70/4770379
ctataaatt

SEQ ID NO: 86993 - DNA, 9 bp, Unknown
  misc_feature (1)..( 9): Result.001 file - promoters70/4770379
ctaaaaacg

SEQ ID NO: 86994 - DNA, 9 bp, Unknown
  misc_feature (1)..( 9): Result.001 file - promoters70/4770379
atataaaca

SEQ ID NO: 86995 - DNA, 9 bp, Unknown
  misc_feature (1)..( 9): Result.001 file - promoters70/4770379
atatataca

SEQ ID NO: 86996 - DNA, 9 bp, Unknown
  misc_feature (1)..( 9): Result.001 file - promoters70/4770379
atataaaga

SEQ ID NO: 86997 - DNA, 7 bp, Unknown
  misc_feature (1)..( 7): Result.001 file - promoters70/4770379
tacgaaa

SEQ ID NO: 86998 - DNA, 7 bp, Unknown
  misc_feature (1)..( 7): Result.001 file - promoters70/4770379
tactaaa

SEQ ID NO: 86999 - DNA, 7 bp, Unknown
  misc_feature (1)..( 7): Result.001 file - promoters70/4770379
aactaaa

SEQ ID NO: 87000 - DNA, 9 bp, Unknown
  misc_feature (1)..( 9): Result.001 file - promoters70/4770379
cgaactaaa

SEQ ID NO: 87001 - DNA, 9 bp, Unknown
  misc_feature (1)..( 9): Result.001 file - promoters70/4770379
cgaactaat

SEQ ID NO: 87002 - DNA, 9 bp, Unknown
  misc_feature (1)..( 9): Result.001 file - promoters70/4770379
cctactaaa

SEQ ID NO: 87003 - DNA, 7 bp, Unknown
  misc_feature (1)..( 7): Result.001 file - promoters70/4770379
cttttct

SEQ ID NO: 87004 - DNA, 7 bp, Unknown
  misc_feature (1)..( 7): Result.001 file - promoters70/4770379
gttttct

SEQ ID NO: 87005 - DNA, 7 bp, Unknown
  misc_feature (1)..( 7): Result.001 file - promoters70/4770443
gttttcg

SEQ ID NO: 87006 - DNA, 17 bp, Unknown
  misc_feature (1)..( 17): Result.001 file - promoters70/4770443
tttaatgttactaatta

SEQ ID NO: 87007 - DNA, 17 bp, Unknown
  misc_feature (1)..( 17): Result.001 file - promoters70/4770443
tttttgaatactaaaag

SEQ ID NO: 87008 - DNA, 17 bp, Unknown
  misc_feature (1)..( 17): Result.001 file - promoters70/4770443
aaatagtttactattta

SEQ ID NO: 87009 - DNA, 17 bp, Unknown
  misc_feature (1)..( 17): Result.001 file - promoters70/4770443
tttattgttacaaatct

SEQ ID NO: 87010 - DNA, 17 bp, Unknown
  misc_feature (1)..( 17): Result.001 file - promoters70/4770443
caataatttacgaaatt

SEQ ID NO: 87011 - DNA, 17 bp, Unknown
  misc_feature (1)..( 17): Result.001 file - promoters70/4770443
gtttcatttatttactt

SEQ ID NO: 87012 - DNA, 17 bp, Unknown
  misc_feature (1)..( 17): Result.001 file - promoters70/4770443
caaattacaattcattc

SEQ ID NO: 87013 - DNA, 13 bp, Unknown
  misc_feature (1)..( 13): Result.001 file - promoters70/4770443
actgatataataa

SEQ ID NO: 87014 - DNA, 13 bp, Unknown
  misc_feature (1)..( 13): Result.001 file - promoters70/4770443
gttgatttaataa

SEQ ID NO: 87015 - DNA, 13 bp, Unknown
  misc_feature (1)..( 13): Result.001 file - promoters70/4770443
gatgaaatatttt

SEQ ID NO: 87016 - DNA, 13 bp, Unknown
  misc_feature (1)..( 13): Result.001 file - promoters70/4770443
gtttatttccaat

SEQ ID NO: 87017 - DNA, 13 bp, Unknown
  misc_feature (1)..( 13): Result.001 file - promoters70/4770443
ctataaaaaattt

SEQ ID NO: 87018 - DNA, 13 bp, Unknown
  misc_feature (1)..( 13): Result.001 file - promoters70/4770443
cataaaaaattac

SEQ ID NO: 87019 - DNA, 13 bp, Unknown
  misc_feature (1)..( 13): Result.001 file - promoters70/4770443
tgataaatattca

SEQ ID NO: 87020 - DNA, 13 bp, Unknown
  misc_feature (1)..( 13): Result.001 file - promoters70/4770443
caacaaaactttc

SEQ ID NO: 87021 - DNA, 9 bp, Unknown
  misc_feature (1)..( 9): Result.001 file - promoters70/4770443
gtttgatta

SEQ ID NO: 87022 - DNA, 9 bp, Unknown
  misc_feature (1)..( 9): Result.001 file - promoters70/4770443
cttttatta

SEQ ID NO: 87023 - DNA, 9 bp, Unknown
  misc_feature (1)..( 9): Result.001 file - promoters70/4770443
gtttgaaat

SEQ ID NO: 87024 - DNA, 9 bp, Unknown
  misc_feature (1)..( 9): Result.001 file - promoters70/4770443
agtttattc

SEQ ID NO: 87025 - DNA, 9 bp, Unknown
  misc_feature (1)..( 9): Result.001 file - promoters70/4770443
ctttcattc

SEQ ID NO: 87026 - DNA, 9 bp, Unknown
  misc_feature (1)..( 9): Result.001 file - promoters70/4770443
cttttaaat

SEQ ID NO: 87027 - DNA, 11 bp, Unknown
  misc_feature (1)..( 11): Result.001 file - promoters70/4770443
ccaaaaatggc

SEQ ID NO: 87028 - DNA, 11 bp, Unknown
  misc_feature (1)..( 11): Result.001 file - promoters70/4770443
tcaaaaatatt

SEQ ID NO: 87029 - DNA, 11 bp, Unknown
  misc_feature (1)..( 11): Result.001 file - promoters70/4770443
agaaaaatgat

SEQ ID NO: 87030 - DNA, 11 bp, Unknown
  misc_feature (1)..( 11): Result.001 file - promoters70/4770443
tcaaaatttat

SEQ ID NO: 87031 - DNA, 11 bp, Unknown
  misc_feature (1)..( 11): Result.001 file - promoters70/4770443
acaagattata

SEQ ID NO: 87032 - DNA, 11 bp, Unknown
  misc_feature (1)..( 11): Result.001 file - promoters70/4770443
aaaaaaaggat

SEQ ID NO: 87033 - DNA, 13 bp, Unknown
  misc_feature (1)..( 13): Result.001 file - promoters70/4770443
taatttttttcta

SEQ ID NO: 87034 - DNA, 13 bp, Unknown
  misc_feature (1)..( 13): Result.001 file - promoters70/4770443
taatgtttttcta

SEQ ID NO: 87035 - DNA, 13 bp, Unknown
  misc_feature (1)..( 13): Result.001 file - promoters70/4770443
tcatttttctcct

SEQ ID NO: 87036 - DNA, 13 bp, Unknown
  misc_feature (1)..( 13): Result.001 file - promoters70/4770443
taatcttttgggg

SEQ ID NO: 87037 - DNA, 13 bp, Unknown
  misc_feature (1)..( 13): Result.001 file - promoters70/4770443
taaattttatcat

SEQ ID NO: 87038 - DNA, 13 bp, Unknown
  misc_feature (1)..( 13): Result.001 file - promoters70/4770443
ttatttttttttg

SEQ ID NO: 87039 - DNA, 13 bp, Unknown
  misc_feature (1)..( 13): Result.001 file - promoters70/4770443
ttattttttgttc

SEQ ID NO: 87040 - DNA, 19 bp, Unknown
  misc_feature (1)..( 19): Result.001 file - promoters70/4770443
tttttttctataaaaaata

SEQ ID NO: 87041 - DNA, 19 bp, Unknown
  misc_feature (1)..( 19): Result.001 file - promoters70/4770443
acatgtcccataaaaaatt

SEQ ID NO: 87042 - DNA, 19 bp, Unknown
  misc_feature (1)..( 19): Result.001 file - promoters70/4770443
tttttatctataaaaaatt

SEQ ID NO: 87043 - DNA, 19 bp, Unknown
  misc_feature (1)..( 19): Result.001 file - promoters70/4770443
tgtcaaatgatgaaatatt

SEQ ID NO: 87044 - DNA, 19 bp, Unknown
  misc_feature (1)..( 19): Result.001 file - promoters70/4770443
gttaatggtgataaatatt

SEQ ID NO: 87045 - DNA, 19 bp, Unknown
  misc_feature (1)..( 19): Result.001 file - promoters70/4770443
attttatcattaatttgtt

SEQ ID NO: 87046 - DNA, 19 bp, Unknown
  misc_feature (1)..( 19): Result.001 file - promoters70/4770443
tttttttgtaaattaggaa

SEQ ID NO: 87047 - DNA, 13 bp, Unknown
  misc_feature (1)..( 13): Result.001 file - promoters70/4770443
aaaatatcgttga

SEQ ID NO: 87048 - DNA, 13 bp, Unknown
  misc_feature (1)..( 13): Result.001 file - promoters70/4770443
taaatattcaact

SEQ ID NO: 87049 - DNA, 13 bp, Unknown
  misc_feature (1)..( 13): Result.001 file - promoters70/4770443
gaaatattttttt

SEQ ID NO: 87050 - DNA, 13 bp, Unknown
  misc_feature (1)..( 13): Result.001 file - promoters70/4770443
aaaattttttttt

SEQ ID NO: 87051 - DNA, 13 bp, Unknown
  misc_feature (1)..( 13): Result.001 file - promoters70/4770443
tgtttatttccaa

SEQ ID NO: 87052 - DNA, 13 bp, Unknown
  misc_feature (1)..( 13): Result.001 file - promoters70/4770477
aaaactttctctc

SEQ ID NO: 87053 - DNA, 11 bp, Unknown
  misc_feature (1)..( 11): Result.001 file - promoters70/4770477
tatagttcagc

SEQ ID NO: 87054 - DNA, 11 bp, Unknown
  misc_feature (1)..( 11): Result.001 file - promoters70/4770477
tatacttcagt

SEQ ID NO: 87055 - DNA, 11 bp, Unknown
  misc_feature (1)..( 11): Result.001 file - promoters70/4770594
ttgatttcagt

SEQ ID NO: 87056 - DNA, 8 bp, Unknown
  misc_feature (1)..( 8): Result.001 file - promoters70/4770594
ttaatata

SEQ ID NO: 87057 - DNA, 8 bp, Unknown
  misc_feature (1)..( 8): Result.001 file - promoters70/4770594
ataagata

SEQ ID NO: 87058 - DNA, 8 bp, Unknown
  misc_feature (1)..( 8): Result.001 file - promoters70/4770594
ttaataat

SEQ ID NO: 87059 - DNA, 10 bp, Unknown
  misc_feature (1)..( 10): Result.001 file - promoters70/4770594
tttcctttta

SEQ ID NO: 87060 - DNA, 10 bp, Unknown
  misc_feature (1)..( 10): Result.001 file - promoters70/4770594
cttcccttta

SEQ ID NO: 87061 - DNA, 10 bp, Unknown
  misc_feature (1)..( 10): Result.001 file - promoters70/4770594
cttcactttc

SEQ ID NO: 87062 - DNA, 9 bp, Unknown
  misc_feature (1)..( 9): Result.001 file - promoters70/4770594
ttttaatac

SEQ ID NO: 87063 - DNA, 9 bp, Unknown
  misc_feature (1)..( 9): Result.001 file - promoters70/4770594
tttttatat

SEQ ID NO: 87064 - DNA, 9 bp, Unknown
  misc_feature (1)..( 9): Result.001 file - promoters70/4770594
tagttatat

SEQ ID NO: 87065 - DNA, 13 bp, Unknown
  misc_feature (1)..( 13): Result.001 file - promoters70/4770594
aaatcattacaat

SEQ ID NO: 87066 - DNA, 13 bp, Unknown
  misc_feature (1)..( 13): Result.001 file - promoters70/4770594
taatgattctttt

SEQ ID NO: 87067 - DNA, 13 bp, Unknown
  misc_feature (1)..( 13): Result.001 file - promoters70/4770594
aaaacattaaaat

SEQ ID NO: 87068 - DNA, 13 bp, Unknown
  misc_feature (1)..( 13): Result.001 file - promoters70/4770594
aaatcattacaat

SEQ ID NO: 87069 - DNA, 13 bp, Unknown
  misc_feature (1)..( 13): Result.001 file - promoters70/4770594
cttactttataat

SEQ ID NO: 87070 - DNA, 13 bp, Unknown
  misc_feature (1)..( 13): Result.001 file - promoters70/4771239
aaaacattaaaat

SEQ ID NO: 87071 - DNA, 9 bp, Unknown
  misc_feature (1)..( 9): Result.001 file - promoters70/4771239
ttgacgacg

SEQ ID NO: 87072 - DNA, 9 bp, Unknown
  misc_feature (1)..( 9): Result.001 file - promoters70/4771239
ttggcgaga

SEQ ID NO: 87073 - DNA, 9 bp, Unknown
  misc_feature (1)..( 9): Result.001 file - promoters70/4771271
ccggcaaga

SEQ ID NO: 87074 - DNA, 7 bp, Unknown
  misc_feature (1)..( 7): Result.001 file - promoters70/4771271
ttttgct

SEQ ID NO: 87075 - DNA, 7 bp, Unknown
  misc_feature (1)..( 7): Result.001 file - promoters70/4771271
ttttgcc

SEQ ID NO: 87076 - DNA, 7 bp, Unknown
  misc_feature (1)..( 7): Result.001 file - promoters70/4771271
ttttgct

SEQ ID NO: 87077 - DNA, 9 bp, Unknown
  misc_feature (1)..( 9): Result.001 file - promoters70/4771271
aaattaaac

SEQ ID NO: 87078 - DNA, 9 bp, Unknown
  misc_feature (1)..( 9): Result.001 file - promoters70/4771271
aaaataaat

SEQ ID NO: 87079 - DNA, 9 bp, Unknown
  misc_feature (1)..( 9): Result.001 file - promoters70/4771271
attttaaac

SEQ ID NO: 87080 - DNA, 8 bp, Unknown
  misc_feature (1)..( 8): Result.001 file - promoters70/4771271
tattatta

SEQ ID NO: 87081 - DNA, 8 bp, Unknown
  misc_feature (1)..( 8): Result.001 file - promoters70/4771271
tatgattt

SEQ ID NO: 87082 - DNA, 8 bp, Unknown
  misc_feature (1)..( 8): Result.001 file - promoters70/4771271
ttggatta

SEQ ID NO: 87083 - DNA, 10 bp, Unknown
  misc_feature (1)..( 10): Result.001 file - promoters70/4771271
aaccaaattg

SEQ ID NO: 87084 - DNA, 10 bp, Unknown
  misc_feature (1)..( 10): Result.001 file - promoters70/4771271
ataaaaattg

SEQ ID NO: 87085 - DNA, 10 bp, Unknown
  misc_feature (1)..( 10): Result.001 file - promoters70/4771271
aacaaaattt

SEQ ID NO: 87086 - DNA, 13 bp, Unknown
  misc_feature (1)..( 13): Result.001 file - promoters70/4771271
gtttttcatggaa

SEQ ID NO: 87087 - DNA, 13 bp, Unknown
  misc_feature (1)..( 13): Result.001 file - promoters70/4771271
gtttttttaaagc

SEQ ID NO: 87088 - DNA, 13 bp, Unknown
  misc_feature (1)..( 13): Result.001 file - promoters70/4771271
attttgcatagaa

SEQ ID NO: 87089 - DNA, 8 bp, Unknown
  misc_feature (1)..( 8): Result.001 file - promoters70/4771271
gttatata

SEQ ID NO: 87090 - DNA, 8 bp, Unknown
  misc_feature (1)..( 8): Result.001 file - promoters70/4771271
gttaaata

SEQ ID NO: 87091 - DNA, 8 bp, Unknown
  misc_feature (1)..( 8): Result.001 file - promoters70/4771271
tttaaatt

SEQ ID NO: 87092 - DNA, 12 bp, Unknown
  misc_feature (1)..( 12): Result.001 file - promoters70/4771271
aattaaacaagt

SEQ ID NO: 87093 - DNA, 12 bp, Unknown
  misc_feature (1)..( 12): Result.001 file - promoters70/4771271
tgataaaaaagt

SEQ ID NO: 87094 - DNA, 12 bp, Unknown
  misc_feature (1)..( 12): Result.001 file - promoters70/4771271
tgataaaataaa

SEQ ID NO: 87095 - DNA, 9 bp, Unknown
  misc_feature (1)..( 9): Result.001 file - promoters70/4771271
ataaccaaa

SEQ ID NO: 87096 - DNA, 9 bp, Unknown
  misc_feature (1)..( 9): Result.001 file - promoters70/4771271
tgaacaaaa

SEQ ID NO: 87097 - DNA, 9 bp, Unknown
  misc_feature (1)..( 9): Result.001 file - promoters70/4771271
taaacaaga

SEQ ID NO: 87098 - DNA, 9 bp, Unknown
  misc_feature (1)..( 9): Result.001 file - promoters70/4771271
aatgtttta

SEQ ID NO: 87099 - DNA, 9 bp, Unknown
  misc_feature (1)..( 9): Result.001 file - promoters70/4771271
aatattttg

SEQ ID NO: 87100 - DNA, 9 bp, Unknown
  misc_feature (1)..( 9): Result.001 file - promoters70/4771271
aatatgttg

SEQ ID NO: 87101 - DNA, 10 bp, Unknown
  misc_feature (1)..( 10): Result.001 file - promoters70/4771271
gtagggtttt

SEQ ID NO: 87102 - DNA, 10 bp, Unknown
  misc_feature (1)..( 10): Result.001 file - promoters70/4771271
ttaggttttt

SEQ ID NO: 87103 - DNA, 10 bp, Unknown
  misc_feature (1)..( 10): Result.001 file - promoters70/4771271
ttaggtttgg

SEQ ID NO: 87104 - DNA, 8 bp, Unknown
  misc_feature (1)..( 8): Result.001 file - promoters70/4771271
tttatttt

SEQ ID NO: 87105 - DNA, 8 bp, Unknown
  misc_feature (1)..( 8): Result.001 file - promoters70/4771271
attatttt

SEQ ID NO: 87106 - DNA, 8 bp, Unknown
  misc_feature (1)..( 8): Result.001 file - promoters70/4771321
attctttt

SEQ ID NO: 87107 - DNA, 9 bp, Unknown
  misc_feature (1)..( 9): Result.001 file - promoters70/4771321
caaaaaaag

SEQ ID NO: 87108 - DNA, 9 bp, Unknown
  misc_feature (1)..( 9): Result.001 file - promoters70/4771321
gaaataaat

SEQ ID NO: 87109 - DNA, 9 bp, Unknown
  misc_feature (1)..( 9): Result.001 file - promoters70/4771321
gaaaacaga

SEQ ID NO: 87110 - DNA, 9 bp, Unknown
  misc_feature (1)..( 9): Result.001 file - promoters70/4771321
taaataagg

SEQ ID NO: 87111 - DNA, 9 bp, Unknown
  misc_feature (1)..( 9): Result.001 file - promoters70/4771321
ccaataaga

SEQ ID NO: 87112 - DNA, 9 bp, Unknown
  misc_feature (1)..( 9): Result.001 file - promoters70/4771334
gaaaccaga

SEQ ID NO: 87113 - DNA, 9 bp, Unknown
  misc_feature (1)..( 9): Result.001 file - promoters70/4771334
agttttgta

SEQ ID NO: 87114 - DNA, 9 bp, Unknown
  misc_feature (1)..( 9): Result.001 file - promoters70/4771334
tgttatgta

SEQ ID NO: 87115 - DNA, 9 bp, Unknown
  misc_feature (1)..( 9): Result.001 file - promoters70/4771334
agtgttgag

SEQ ID NO: 87116 - DNA, 9 bp, Unknown
  misc_feature (1)..( 9): Result.001 file - promoters70/4771334
agtttttgt

SEQ ID NO: 87117 - DNA, 9 bp, Unknown
  misc_feature (1)..( 9): Result.001 file - promoters70/4771334
ggttttttc

SEQ ID NO: 87118 - DNA, 9 bp, Unknown
  misc_feature (1)..( 9): Result.001 file - promoters70/4771348
gttgttgaa

SEQ ID NO: 87119 - DNA, 8 bp, Unknown
  misc_feature (1)..( 8): Result.001 file - promoters70/4771348
tgtcttta

SEQ ID NO: 87120 - DNA, 8 bp, Unknown
  misc_feature (1)..( 8): Result.001 file - promoters70/4771348
cgtcatta

SEQ ID NO: 87121 - DNA, 8 bp, Unknown
  misc_feature (1)..( 8): Result.001 file - promoters70/4771348
tgtctttc

SEQ ID NO: 87122 - DNA, 8 bp, Unknown
  misc_feature (1)..( 8): Result.001 file - promoters70/4771348
catttgta

SEQ ID NO: 87123 - DNA, 8 bp, Unknown
  misc_feature (1)..( 8): Result.001 file - promoters70/4771348
cattggta

SEQ ID NO: 87124 - DNA, 8 bp, Unknown
  misc_feature (1)..( 8): Result.001 file - promoters70/4771360
gattagta

SEQ ID NO: 87125 - DNA, 15 bp, Unknown
  misc_feature (1)..( 15): Result.001 file - promoters70/4771360
agaaaaatggatttc

SEQ ID NO: 87126 - DNA, 15 bp, Unknown
  misc_feature (1)..( 15): Result.001 file - promoters70/4771360
agagaaattgatttc

SEQ ID NO: 87127 - DNA, 15 bp, Unknown
  misc_feature (1)..( 15): Result.001 file - promoters70/4771360
ggaaaaaacatatat

SEQ ID NO: 87128 - DNA, 10 bp, Unknown
  misc_feature (1)..( 10): Result.001 file - promoters70/4771360
ttgtatttta

SEQ ID NO: 87129 - DNA, 10 bp, Unknown
  misc_feature (1)..( 10): Result.001 file - promoters70/4771360
cgccatttta

SEQ ID NO: 87130 - DNA, 10 bp, Unknown
  misc_feature (1)..( 10): Result.001 file - promoters70/4771360
ttggatttta

SEQ ID NO: 87131 - DNA, 8 bp, Unknown
  misc_feature (1)..( 8): Result.001 file - promoters70/4771360
aaatgtta

SEQ ID NO: 87132 - DNA, 8 bp, Unknown
  misc_feature (1)..( 8): Result.001 file - promoters70/4771360
gaatttta

SEQ ID NO: 87133 - DNA, 8 bp, Unknown
  misc_feature (1)..( 8): Result.001 file - promoters70/4771360
aaatgttc

SEQ ID NO: 87134 - DNA, 8 bp, Unknown
  misc_feature (1)..( 8): Result.001 file - promoters70/4771360
aaaaattc

SEQ ID NO: 87135 - DNA, 8 bp, Unknown
  misc_feature (1)..( 8): Result.001 file - promoters70/4771360
aaaagttc

SEQ ID NO: 87136 - DNA, 8 bp, Unknown
  misc_feature (1)..( 8): Result.001 file - promoters70/4771360
taaaattt

SEQ ID NO: 87137 - DNA, 9 bp, Unknown
  misc_feature (1)..( 9): Result.001 file - promoters70/4771360
taaaatgtt

SEQ ID NO: 87138 - DNA, 9 bp, Unknown
  misc_feature (1)..( 9): Result.001 file - promoters70/4771360
gaaaatgtt

SEQ ID NO: 87139 - DNA, 9 bp, Unknown
  misc_feature (1)..( 9): Result.001 file - promoters70/4771360
gaaaattct

SEQ ID NO: 87140 - DNA, 10 bp, Unknown
  misc_feature (1)..( 10): Result.001 file - promoters70/4771360
taaaaattaa

SEQ ID NO: 87141 - DNA, 10 bp, Unknown
  misc_feature (1)..( 10): Result.001 file - promoters70/4771360
aaaaaatgtt

SEQ ID NO: 87142 - DNA, 10 bp, Unknown
  misc_feature (1)..( 10): Result.001 file - promoters70/4771360
taaaaaccag

SEQ ID NO: 87143 - DNA, 10 bp, Unknown
  misc_feature (1)..( 10): Result.001 file - promoters70/4771360
caaacatgtt

SEQ ID NO: 87144 - DNA, 10 bp, Unknown
  misc_feature (1)..( 10): Result.001 file - promoters70/4771360
aaataagagt

SEQ ID NO: 87145 - DNA, 10 bp, Unknown
  misc_feature (1)..( 10): Result.001 file - promoters70/4771360
taattagagt

SEQ ID NO: 87146 - DNA, 10 bp, Unknown
  misc_feature (1)..( 10): Result.001 file - promoters70/4771360
taattaatta

SEQ ID NO: 87147 - DNA, 7 bp, Unknown
  misc_feature (1)..( 7): Result.001 file - promoters70/4771360
gaatatt

SEQ ID NO: 87148 - DNA, 7 bp, Unknown
  misc_feature (1)..( 7): Result.001 file - promoters70/4771360
gaaaatt

SEQ ID NO: 87149 - DNA, 7 bp, Unknown
  misc_feature (1)..( 7): Result.001 file - promoters70/4771407
gaaaatg

SEQ ID NO: 87150 - DNA, 8 bp, Unknown
  misc_feature (1)..( 8): Result.001 file - promoters70/4771407
tagaatat

SEQ ID NO: 87151 - DNA, 8 bp, Unknown
  misc_feature (1)..( 8): Result.001 file - promoters70/4771407
cagattat

SEQ ID NO: 87152 - DNA, 8 bp, Unknown
  misc_feature (1)..( 8): Result.001 file - promoters70/4771407
cagtttat

SEQ ID NO: 87153 - DNA, 12 bp, Unknown
  misc_feature (1)..( 12): Result.001 file - promoters70/4771407
atcagtcaattt

SEQ ID NO: 87154 - DNA, 12 bp, Unknown
  misc_feature (1)..( 12): Result.001 file - promoters70/4771407
aaatgtcatttt

SEQ ID NO: 87155 - DNA, 12 bp, Unknown
  misc_feature (1)..( 12): Result.001 file - promoters70/4771407
aaatgttatttg

SEQ ID NO: 87156 - DNA, 7 bp, Unknown
  misc_feature (1)..( 7): Result.001 file - promoters70/4771407
attgtgt

SEQ ID NO: 87157 - DNA, 7 bp, Unknown
  misc_feature (1)..( 7): Result.001 file - promoters70/4771407
attttgt

SEQ ID NO: 87158 - DNA, 7 bp, Unknown
  misc_feature (1)..( 7): Result.001 file - promoters70/4771407
attttga

SEQ ID NO: 87159 - DNA, 9 bp, Unknown
  misc_feature (1)..( 9): Result.001 file - promoters70/4771407
aaaggaaga

SEQ ID NO: 87160 - DNA, 9 bp, Unknown
  misc_feature (1)..( 9): Result.001 file - promoters70/4771407
aatggaaga

SEQ ID NO: 87161 - DNA, 9 bp, Unknown
  misc_feature (1)..( 9): Result.001 file - promoters70/4771407
aattgaaga

SEQ ID NO: 87162 - DNA, 11 bp, Unknown
  misc_feature (1)..( 11): Result.001 file - promoters70/4771407
gatttttgtta

SEQ ID NO: 87163 - DNA, 11 bp, Unknown
  misc_feature (1)..( 11): Result.001 file - promoters70/4771407
gatttttgtta

SEQ ID NO: 87164 - DNA, 11 bp, Unknown
  misc_feature (1)..( 11): Result.001 file - promoters70/4771414
gattttgaatt

SEQ ID NO: 87165 - DNA, 12 bp, Unknown
  misc_feature (1)..( 12): Result.001 file - promoters70/4771414
gaaagttttccc

SEQ ID NO: 87166 - DNA, 12 bp, Unknown
  misc_feature (1)..( 12): Result.001 file - promoters70/4771414
agattttttcca

SEQ ID NO: 87167 - DNA, 12 bp, Unknown
  misc_feature (1)..( 12): Result.001 file - promoters70/4771414
aaaatttttctg

SEQ ID NO: 87168 - DNA, 12 bp, Unknown
  misc_feature (1)..( 12): Result.001 file - promoters70/4771414
aaaaattgtaat

SEQ ID NO: 87169 - DNA, 12 bp, Unknown
  misc_feature (1)..( 12): Result.001 file - promoters70/4771414
acaaattgctca

SEQ ID NO: 87170 - DNA, 12 bp, Unknown
  misc_feature (1)..( 12): Result.001 file - promoters70/4771478
tgtgatttgcaa

SEQ ID NO: 87171 - DNA, 7 bp, Unknown
  misc_feature (1)..( 7): Result.001 file - promoters70/4771478
ttgcaaa

SEQ ID NO: 87172 - DNA, 7 bp, Unknown
  misc_feature (1)..( 7): Result.001 file - promoters70/4771478
atgcaaa

SEQ ID NO: 87173 - DNA, 7 bp, Unknown
  misc_feature (1)..( 7): Result.001 file - promoters70/4771478
ttgcaat

SEQ ID NO: 87174 - DNA, 9 bp, Unknown
  misc_feature (1)..( 9): Result.001 file - promoters70/4771478
taactaatt

SEQ ID NO: 87175 - DNA, 9 bp, Unknown
  misc_feature (1)..( 9): Result.001 file - promoters70/4771478
taattaaaa

SEQ ID NO: 87176 - DNA, 9 bp, Unknown
  misc_feature (1)..( 9): Result.001 file - promoters70/4771478
gaataaaaa

SEQ ID NO: 87177 - DNA, 9 bp, Unknown
  misc_feature (1)..( 9): Result.001 file - promoters70/4771478
ttaaaataa

SEQ ID NO: 87178 - DNA, 9 bp, Unknown
  misc_feature (1)..( 9): Result.001 file - promoters70/4771478
ttaaaagaa

SEQ ID NO: 87179 - DNA, 9 bp, Unknown
  misc_feature (1)..( 9): Result.001 file - promoters70/4771495
ctaacagaa

SEQ ID NO: 87180 - DNA, 16 bp, Unknown
  misc_feature (1)..( 16): Result.001 file - promoters70/4771495
aaactactaaaatcaa

SEQ ID NO: 87181 - DNA, 16 bp, Unknown
  misc_feature (1)..( 16): Result.001 file - promoters70/4771495
aaactattaaaatagt

SEQ ID NO: 87182 - DNA, 16 bp, Unknown
  misc_feature (1)..( 16): Result.001 file - promoters70/4771495
ttaaaaaaaaaatctc

SEQ ID NO: 87183 - DNA, 16 bp, Unknown
  misc_feature (1)..( 16): Result.001 file - promoters70/4771495
aaaaaacacaaattag

SEQ ID NO: 87184 - DNA, 16 bp, Unknown
  misc_feature (1)..( 16): Result.001 file - promoters70/4771495
aagttattaatgaatg

SEQ ID NO: 87185 - DNA, 16 bp, Unknown
  misc_feature (1)..( 16): Result.001 file - promoters70/4771523
atcttattaggtgaag

SEQ ID NO: 87186 - DNA, 9 bp, Unknown
  misc_feature (1)..( 9): Result.001 file - promoters70/4771523
attcatgaa

SEQ ID NO: 87187 - DNA, 9 bp, Unknown
  misc_feature (1)..( 9): Result.001 file - promoters70/4771523
gctcatgaa

SEQ ID NO: 87188 - DNA, 9 bp, Unknown
  misc_feature (1)..( 9): Result.001 file - promoters70/4771674
attaatggg

SEQ ID NO: 87189 - DNA, 10 bp, Unknown
  misc_feature (1)..( 10): Result.001 file - promoters70/4771674
ttctcgtttc

SEQ ID NO: 87190 - DNA, 10 bp, Unknown
  misc_feature (1)..( 10): Result.001 file - promoters70/4771674
ctctcttttg

SEQ ID NO: 87191 - DNA, 10 bp, Unknown
  misc_feature (1)..( 10): Result.001 file - promoters70/4771674
ctctcccttg

SEQ ID NO: 87192 - DNA, 10 bp, Unknown
  misc_feature (1)..( 10): Result.001 file - promoters70/4771674
ccttccattg

SEQ ID NO: 87193 - DNA, 16 bp, Unknown
  misc_feature (1)..( 16): Result.001 file - promoters70/4771674
ctcggttccaatcttg

SEQ ID NO: 87194 - DNA, 16 bp, Unknown
  misc_feature (1)..( 16): Result.001 file - promoters70/4771674
attcaatccaattttg

SEQ ID NO: 87195 - DNA, 16 bp, Unknown
  misc_feature (1)..( 16): Result.001 file - promoters70/4771674
attctatccaaattca

SEQ ID NO: 87196 - DNA, 16 bp, Unknown
  misc_feature (1)..( 16): Result.001 file - promoters70/4771677
cttctttcctcgctac

SEQ ID NO: 87197 - DNA, 8 bp, Unknown
  misc_feature (1)..( 8): Result.001 file - promoters70/4771677
aatgaaaa

SEQ ID NO: 87198 - DNA, 8 bp, Unknown
  misc_feature (1)..( 8): Result.001 file - promoters70/4771677
aatgaaat

SEQ ID NO: 87199 - DNA, 9 bp, Unknown
  misc_feature (1)..( 9): Result.001 file - promoters70/4771677
tatgagaaa

SEQ ID NO: 87200 - DNA, 9 bp, Unknown
  misc_feature (1)..( 9): Result.001 file - promoters70/4771677
aatcaaaaa

SEQ ID NO: 87201 - DNA, 9 bp, Unknown
  misc_feature (1)..( 9): Result.001 file - promoters70/4771677
tataagaaa

SEQ ID NO: 87202 - DNA, 10 bp, Unknown
  misc_feature (1)..( 10): Result.001 file - promoters70/4771677
gaaaaacaaa

SEQ ID NO: 87203 - DNA, 10 bp, Unknown
  misc_feature (1)..( 10): Result.001 file - promoters70/4771677
tttaaaaaaa

SEQ ID NO: 87204 - DNA, 10 bp, Unknown
  misc_feature (1)..( 10): Result.001 file - promoters70/4771677
tataagaaaa

SEQ ID NO: 87205 - DNA, 10 bp, Unknown
  misc_feature (1)..( 10): Result.001 file - promoters70/4771677
aataataaaa

SEQ ID NO: 87206 - DNA, 10 bp, Unknown
  misc_feature (1)..( 10): Result.001 file - promoters70/4771677
tatgagaaat

SEQ ID NO: 87207 - DNA, 12 bp, Unknown
  misc_feature (1)..( 12): Result.001 file - promoters70/4771677
aatgaaaaacaa

SEQ ID NO: 87208 - DNA, 12 bp, Unknown
  misc_feature (1)..( 12): Result.001 file - promoters70/4771677
gaagaaaaaata

SEQ ID NO: 87209 - DNA, 12 bp, Unknown
  misc_feature (1)..( 12): Result.001 file - promoters70/4771677
tatgagaaatca

SEQ ID NO: 87210 - DNA, 12 bp, Unknown
  misc_feature (1)..( 12): Result.001 file - promoters70/4771677
aatcaaaaataa

SEQ ID NO: 87211 - DNA, 12 bp, Unknown
  misc_feature (1)..( 12): Result.001 file - promoters70/4771677
taagaaaatata

SEQ ID NO: 87212 - DNA, 8 bp, Unknown
  misc_feature (1)..( 8): Result.001 file - promoters70/4771677
aaatgtca

SEQ ID NO: 87213 - DNA, 8 bp, Unknown
  misc_feature (1)..( 8): Result.001 file - promoters70/4771677
aaatgtta

SEQ ID NO: 87214 - DNA, 8 bp, Unknown
  misc_feature (1)..( 8): Result.001 file - promoters70/4771677
caatctca

SEQ ID NO: 87215 - DNA, 9 bp, Unknown
  misc_feature (1)..( 9): Result.001 file - promoters70/4771677
aaattgttt

SEQ ID NO: 87216 - DNA, 9 bp, Unknown
  misc_feature (1)..( 9): Result.001 file - promoters70/4771725
cccatctca

SEQ ID NO: 87217 - DNA, 11 bp, Unknown
  misc_feature (1)..( 11): Result.001 file - promoters70/4771725
ctgcagagtaa

SEQ ID NO: 87218 - DNA, 11 bp, Unknown
  misc_feature (1)..( 11): Result.001 file - promoters70/4771725
taacagaataa

SEQ ID NO: 87219 - DNA, 11 bp, Unknown
  misc_feature (1)..( 11): Result.001 file - promoters70/4771725
taaaagaaaat

SEQ ID NO: 87220 - DNA, 13 bp, Unknown
  misc_feature (1)..( 13): Result.001 file - promoters70/4771725
aaataataataat

SEQ ID NO: 87221 - DNA, 13 bp, Unknown
  misc_feature (1)..( 13): Result.001 file - promoters70/4771725
aaagaataaaaat

SEQ ID NO: 87222 - DNA, 13 bp, Unknown
  misc_feature (1)..( 13): Result.001 file - promoters70/4771725
cgttaatcaaata

SEQ ID NO: 87223 - DNA, 8 bp, Unknown
  misc_feature (1)..( 8): Result.001 file - promoters70/4771725
tttaaaat

SEQ ID NO: 87224 - DNA, 8 bp, Unknown
  misc_feature (1)..( 8): Result.001 file - promoters70/4771725
aataaaat

SEQ ID NO: 87225 - DNA, 8 bp, Unknown
  misc_feature (1)..( 8): Result.001 file - promoters70/4771853
aataaaaa

SEQ ID NO: 87226 - DNA, 9 bp, Unknown
  misc_feature (1)..( 9): Result.001 file - promoters70/4771853
gtttccttt

SEQ ID NO: 87227 - DNA, 9 bp, Unknown
  misc_feature (1)..( 9): Result.001 file - promoters70/4771853
gttaccttt

SEQ ID NO: 87228 - DNA, 9 bp, Unknown
  misc_feature (1)..( 9): Result.001 file - promoters70/4771928
gcttcgttt

SEQ ID NO: 87229 - DNA, 14 bp, Unknown
  misc_feature (1)..( 14): Result.001 file - promoters70/4771928
ggtcttacaatttt

SEQ ID NO: 87230 - DNA, 14 bp, Unknown
  misc_feature (1)..( 14): Result.001 file - promoters70/4771928
agaaatacaatttt

SEQ ID NO: 87231 - DNA, 14 bp, Unknown
  misc_feature (1)..( 14): Result.001 file - promoters70/4771928
agaactactattcg

SEQ ID NO: 87232 - DNA, 8 bp, Unknown
  misc_feature (1)..( 8): Result.001 file - promoters70/4771928
ctaaaata

SEQ ID NO: 87233 - DNA, 8 bp, Unknown
  misc_feature (1)..( 8): Result.001 file - promoters70/4771928
ctaaaaaa

SEQ ID NO: 87234 - DNA, 8 bp, Unknown
  misc_feature (1)..( 8): Result.001 file - promoters70/4771928
ttaaaaaa

SEQ ID NO: 87235 - DNA, 7 bp, Unknown
  misc_feature (1)..( 7): Result.001 file - promoters70/4771928
cttttgg

SEQ ID NO: 87236 - DNA, 7 bp, Unknown
  misc_feature (1)..( 7): Result.001 file - promoters70/4771928
tttttgg

SEQ ID NO: 87237 - DNA, 7 bp, Unknown
  misc_feature (1)..( 7): Result.001 file - promoters70/4771928
tttttgt

SEQ ID NO: 87238 - DNA, 10 bp, Unknown
  misc_feature (1)..( 10): Result.001 file - promoters70/4771928
ttttaaaaga

SEQ ID NO: 87239 - DNA, 10 bp, Unknown
  misc_feature (1)..( 10): Result.001 file - promoters70/4771928
tttcaaaaaa

SEQ ID NO: 87240 - DNA, 10 bp, Unknown
  misc_feature (1)..( 10): Result.001 file - promoters70/4772130
ttgcaaaaaa

SEQ ID NO: 87241 - DNA, 11 bp, Unknown
  misc_feature (1)..( 11): Result.001 file - promoters70/4772130
cgattgcacaa

SEQ ID NO: 87242 - DNA, 11 bp, Unknown
  misc_feature (1)..( 11): Result.001 file - promoters70/4772130
cgaatgcagcg

SEQ ID NO: 87243 - DNA, 11 bp, Unknown
  misc_feature (1)..( 11): Result.001 file - promoters70/4772130
aaatttcacaa

SEQ ID NO: 87244 - DNA, 7 bp, Unknown
  misc_feature (1)..( 7): Result.001 file - promoters70/4772130
tttcttc

SEQ ID NO: 87245 - DNA, 7 bp, Unknown
  misc_feature (1)..( 7): Result.001 file - promoters70/4772130
attcttc

SEQ ID NO: 87246 - DNA, 7 bp, Unknown
  misc_feature (1)..( 7): Result.001 file - promoters70/4772130
attctta

SEQ ID NO: 87247 - DNA, 12 bp, Unknown
  misc_feature (1)..( 12): Result.001 file - promoters70/4772130
gaccttgtgaaa

SEQ ID NO: 87248 - DNA, 12 bp, Unknown
  misc_feature (1)..( 12): Result.001 file - promoters70/4772130
gacattgttatt

SEQ ID NO: 87249 - DNA, 12 bp, Unknown
  misc_feature (1)..( 12): Result.001 file - promoters70/4772130
attcttttgaaa

SEQ ID NO: 87250 - DNA, 7 bp, Unknown
  misc_feature (1)..( 7): Result.001 file - promoters70/4772130
gatcatt

SEQ ID NO: 87251 - DNA, 7 bp, Unknown
  misc_feature (1)..( 7): Result.001 file - promoters70/4772130
tatcatt

SEQ ID NO: 87252 - DNA, 7 bp, Unknown
  misc_feature (1)..( 7): Result.001 file - promoters70/4772130
gatcata

SEQ ID NO: 87253 - DNA, 8 bp, Unknown
  misc_feature (1)..( 8): Result.001 file - promoters70/4772130
ataaataa

SEQ ID NO: 87254 - DNA, 8 bp, Unknown
  misc_feature (1)..( 8): Result.001 file - promoters70/4772130
ataaattc

SEQ ID NO: 87255 - DNA, 8 bp, Unknown
  misc_feature (1)..( 8): Result.001 file - promoters70/4772336
ttaacttc

SEQ ID NO: 87256 - DNA, 12 bp, Unknown
  misc_feature (1)..( 12): Result.001 file - promoters70/4772336
cattatatatag

SEQ ID NO: 87257 - DNA, 12 bp, Unknown
  misc_feature (1)..( 12): Result.001 file - promoters70/4772336
gcctatatataa

SEQ ID NO: 87258 - DNA, 12 bp, Unknown
  misc_feature (1)..( 12): Result.001 file - promoters70/4772336
tcctttatattc

SEQ ID NO: 87259 - DNA, 12 bp, Unknown
  misc_feature (1)..( 12): Result.001 file - promoters70/4772336
atctctatataa

SEQ ID NO: 87260 - DNA, 12 bp, Unknown
  misc_feature (1)..( 12): Result.001 file - promoters70/4772336
agtgagatataa

SEQ ID NO: 87261 - DNA, 16 bp, Unknown
  misc_feature (1)..( 16): Result.001 file - promoters70/4772336
tgtttgtttaacaaaa

SEQ ID NO: 87262 - DNA, 16 bp, Unknown
  misc_feature (1)..( 16): Result.001 file - promoters70/4772336
gattttcataacaaaa

SEQ ID NO: 87263 - DNA, 16 bp, Unknown
  misc_feature (1)..( 16): Result.001 file - promoters70/4772336
ccataaataaacaaag

SEQ ID NO: 87264 - DNA, 16 bp, Unknown
  misc_feature (1)..( 16): Result.001 file - promoters70/4772336
tgtttaataaacaaaa

SEQ ID NO: 87265 - DNA, 16 bp, Unknown
  misc_feature (1)..( 16): Result.001 file - promoters70/4772346
ctcctaattaacctta

SEQ ID NO: 87266 - DNA, 8 bp, Unknown
  misc_feature (1)..( 8): Result.001 file - promoters70/4772346
agatactt

SEQ ID NO: 87267 - DNA, 8 bp, Unknown
  misc_feature (1)..( 8): Result.001 file - promoters70/4772346
agatacag

SEQ ID NO: 87268 - DNA, 8 bp, Unknown
  misc_feature (1)..( 8): Result.001 file - promoters70/4772346
agagacat

SEQ ID NO: 87269 - DNA, 8 bp, Unknown
  misc_feature (1)..( 8): Result.001 file - promoters70/4772346
cgatccag

SEQ ID NO: 87270 - DNA, 7 bp, Unknown
  misc_feature (1)..( 7): Result.001 file - promoters70/4772346
tttcaat

SEQ ID NO: 87271 - DNA, 7 bp, Unknown
  misc_feature (1)..( 7): Result.001 file - promoters70/4772346
tttcaag

SEQ ID NO: 87272 - DNA, 7 bp, Unknown
  misc_feature (1)..( 7): Result.001 file - promoters70/4772346
tttaaag

SEQ ID NO: 87273 - DNA, 8 bp, Unknown
  misc_feature (1)..( 8): Result.001 file - promoters70/4772346
caaaccca

SEQ ID NO: 87274 - DNA, 8 bp, Unknown
  misc_feature (1)..( 8): Result.001 file - promoters70/4772346
caaacctg

SEQ ID NO: 87275 - DNA, 8 bp, Unknown
  misc_feature (1)..( 8): Result.001 file - promoters70/4772398
gaaagctg

SEQ ID NO: 87276 - DNA, 16 bp, Unknown
  misc_feature (1)..( 16): Result.001 file - promoters70/4772398
gacctaagtttaagtt

SEQ ID NO: 87277 - DNA, 16 bp, Unknown
  misc_feature (1)..( 16): Result.001 file - promoters70/4772398
ttctgaagtttctggt

SEQ ID NO: 87278 - DNA, 16 bp, Unknown
  misc_feature (1)..( 16): Result.001 file - promoters70/4772398
gacataaattttttat

SEQ ID NO: 87279 - DNA, 16 bp, Unknown
  misc_feature (1)..( 16): Result.001 file - promoters70/4772398
tgtataattttatata

SEQ ID NO: 87280 - DNA, 16 bp, Unknown
  misc_feature (1)..( 16): Result.001 file - promoters70/4772398
tcactctttttgatat

SEQ ID NO: 87281 - DNA, 16 bp, Unknown
  misc_feature (1)..( 16): Result.001 file - promoters70/4772398
taataaaatttcacaa

SEQ ID NO: 87282 - DNA, 16 bp, Unknown
  misc_feature (1)..( 16): Result.001 file - promoters70/4772398
ttcataaaatacaact

SEQ ID NO: 87283 - DNA, 13 bp, Unknown
  misc_feature (1)..( 13): Result.001 file - promoters70/4772398
taatcttttgggg

SEQ ID NO: 87284 - DNA, 13 bp, Unknown
  misc_feature (1)..( 13): Result.001 file - promoters70/4772398
taatttttttcta

SEQ ID NO: 87285 - DNA, 13 bp, Unknown
  misc_feature (1)..( 13): Result.001 file - promoters70/4772398
atttcttttcaca

SEQ ID NO: 87286 - DNA, 13 bp, Unknown
  misc_feature (1)..( 13): Result.001 file - promoters70/4772398
aactcttttgaag

SEQ ID NO: 87287 - DNA, 13 bp, Unknown
  misc_feature (1)..( 13): Result.001 file - promoters70/4772398
aactcttttgaga

SEQ ID NO: 87288 - DNA, 13 bp, Unknown
  misc_feature (1)..( 13): Result.001 file - promoters70/4772398
tttacttttaaca

SEQ ID NO: 87289 - DNA, 11 bp, Unknown
  misc_feature (1)..( 11): Result.001 file - promoters70/4772398
attgttacaaa

SEQ ID NO: 87290 - DNA, 11 bp, Unknown
  misc_feature (1)..( 11): Result.001 file - promoters70/4772398
atttttacttt

SEQ ID NO: 87291 - DNA, 11 bp, Unknown
  misc_feature (1)..( 11): Result.001 file - promoters70/4772398
tttgttagttc

SEQ ID NO: 87292 - DNA, 11 bp, Unknown
  misc_feature (1)..( 11): Result.001 file - promoters70/4772398
attgataggtg

SEQ ID NO: 87293 - DNA, 11 bp, Unknown
  misc_feature (1)..( 11): Result.001 file - promoters70/4772398
tttgttctata

SEQ ID NO: 87294 - DNA, 11 bp, Unknown
  misc_feature (1)..( 11): Result.001 file - promoters70/4772398
ttttttaattt

SEQ ID NO: 87295 - DNA, 9 bp, Unknown
  misc_feature (1)..( 9): Result.001 file - promoters70/4772398
tttcattaa

SEQ ID NO: 87296 - DNA, 9 bp, Unknown
  misc_feature (1)..( 9): Result.001 file - promoters70/4772398
ttttattat

SEQ ID NO: 87297 - DNA, 9 bp, Unknown
  misc_feature (1)..( 9): Result.001 file - promoters70/4772398
tttcactaa

SEQ ID NO: 87298 - DNA, 9 bp, Unknown
  misc_feature (1)..( 9): Result.001 file - promoters70/4772398
tttcactct

SEQ ID NO: 87299 - DNA, 9 bp, Unknown
  misc_feature (1)..( 9): Result.001 file - promoters70/4772398
agatattat

SEQ ID NO: 87300 - DNA, 9 bp, Unknown
  misc_feature (1)..( 9): Result.001 file - promoters70/4772398
ttgtattat

SEQ ID NO: 87301 - DNA, 11 bp, Unknown
  misc_feature (1)..( 11): Result.001 file - promoters70/4772398
gagtgacaaag

SEQ ID NO: 87302 - DNA, 11 bp, Unknown
  misc_feature (1)..( 11): Result.001 file - promoters70/4772398
ttatgaaaaaa

SEQ ID NO: 87303 - DNA, 11 bp, Unknown
  misc_feature (1)..( 11): Result.001 file - promoters70/4772398
ttaggaaagcc

SEQ ID NO: 87304 - DNA, 12 bp, Unknown
  misc_feature (1)..( 12): Result.001 file - promoters70/4772398
cgatgtaaaaat

SEQ ID NO: 87305 - DNA, 12 bp, Unknown
  misc_feature (1)..( 12): Result.001 file - promoters70/4772398
aacgttaataat

SEQ ID NO: 87306 - DNA, 12 bp, Unknown
  misc_feature (1)..( 12): Result.001 file - promoters70/4772402
tatttcaaaaat

SEQ ID NO: 87307 - DNA, 12 bp, Unknown
  misc_feature (1)..( 12): Result.001 file - promoters70/4772402
agagcataagac

SEQ ID NO: 87308 - DNA, 12 bp, Unknown
  misc_feature (1)..( 12): Result.001 file - promoters70/4772402
agaacattggat

SEQ ID NO: 87309 - DNA, 12 bp, Unknown
  misc_feature (1)..( 12): Result.001 file - promoters70/4772402
agagcatcgcca

SEQ ID NO: 87310 - DNA, 12 bp, Unknown
  misc_feature (1)..( 12): Result.001 file - promoters70/4772402
agaaaatttgat

SEQ ID NO: 87311 - DNA, 10 bp, Unknown
  misc_feature (1)..( 10): Result.001 file - promoters70/4772402
ctaataaaac

SEQ ID NO: 87312 - DNA, 10 bp, Unknown
  misc_feature (1)..( 10): Result.001 file - promoters70/4772402
ttaatcaaat

SEQ ID NO: 87313 - DNA, 10 bp, Unknown
  misc_feature (1)..( 10): Result.001 file - promoters70/4772402
ctaatgaaac

SEQ ID NO: 87314 - DNA, 8 bp, Unknown
  misc_feature (1)..( 8): Result.001 file - promoters70/4772402
caagttta

SEQ ID NO: 87315 - DNA, 8 bp, Unknown
  misc_feature (1)..( 8): Result.001 file - promoters70/4772402
taagtttg

SEQ ID NO: 87316 - DNA, 8 bp, Unknown
  misc_feature (1)..( 8): Result.001 file - promoters70/4772402
caaattta

SEQ ID NO: 87317 - DNA, 8 bp, Unknown
  misc_feature (1)..( 8): Result.001 file - promoters70/4772402
taaaatta

SEQ ID NO: 87318 - DNA, 8 bp, Unknown
  misc_feature (1)..( 8): Result.001 file - promoters70/4772402
gtaaatta

SEQ ID NO: 87319 - DNA, 8 bp, Unknown
  misc_feature (1)..( 8): Result.001 file - promoters70/4772402
taaaattg

SEQ ID NO: 87320 - DNA, 9 bp, Unknown
  misc_feature (1)..( 9): Result.001 file - promoters70/4772402
aaacccttt

SEQ ID NO: 87321 - DNA, 9 bp, Unknown
  misc_feature (1)..( 9): Result.001 file - promoters70/4772402
aaaccctaa

SEQ ID NO: 87322 - DNA, 9 bp, Unknown
  misc_feature (1)..( 9): Result.001 file - promoters70/4772402
aaaccttaa

SEQ ID NO: 87323 - DNA, 7 bp, Unknown
  misc_feature (1)..( 7): Result.001 file - promoters70/4772402
attttga

SEQ ID NO: 87324 - DNA, 7 bp, Unknown
  misc_feature (1)..( 7): Result.001 file - promoters70/4772402
tttttga

SEQ ID NO: 87325 - DNA, 7 bp, Unknown
  misc_feature (1)..( 7): Result.001 file - promoters70/4772724
tttttgt

SEQ ID NO: 87326 - DNA, 7 bp, Unknown
  misc_feature (1)..( 7): Result.001 file - promoters70/4772724
atgtggt

SEQ ID NO: 87327 - DNA, 7 bp, Unknown
  misc_feature (1)..( 7): Result.001 file - promoters70/4772724
atgtgga

SEQ ID NO: 87328 - DNA, 7 bp, Unknown
  misc_feature (1)..( 7): Result.001 file - promoters70/4772772
atgagga

SEQ ID NO: 87329 - DNA, 6 bp, Unknown
  misc_feature (1)..( 6): Result.001 file - promoters70/4772772
aaacaa

SEQ ID NO: 87330 - DNA, 6 bp, Unknown
  misc_feature (1)..( 6): Result.001 file - promoters70/4772772
aaacaa

SEQ ID NO: 87331 - DNA, 7 bp, Unknown
  misc_feature (1)..( 7): Result.001 file - promoters70/4772772
aaaccaa

SEQ ID NO: 87332 - DNA, 8 bp, Unknown
  misc_feature (1)..( 8): Result.001 file - promoters70/4772772
cctatata

SEQ ID NO: 87333 - DNA, 8 bp, Unknown
  misc_feature (1)..( 8): Result.001 file - promoters70/4772772
tatatata

SEQ ID NO: 87334 - DNA, 8 bp, Unknown
  misc_feature (1)..( 8): Result.001 file - promoters70/4772772
cctttata

SEQ ID NO: 87335 - DNA, 8 bp, Unknown
  misc_feature (1)..( 8): Result.001 file - promoters70/4772772
taatattt

SEQ ID NO: 87336 - DNA, 8 bp, Unknown
  misc_feature (1)..( 8): Result.001 file - promoters70/4772772
taaaattt

SEQ ID NO: 87337 - DNA, 8 bp, Unknown
  misc_feature (1)..( 8): Result.001 file - promoters70/4772772
gaaacttt

SEQ ID NO: 87338 - DNA, 8 bp, Unknown
  misc_feature (1)..( 8): Result.001 file - promoters70/4772772
aaaatctc

SEQ ID NO: 87339 - DNA, 8 bp, Unknown
  misc_feature (1)..( 8): Result.001 file - promoters70/4772772
aaaatctc

SEQ ID NO: 87340 - DNA, 8 bp, Unknown
  misc_feature (1)..( 8): Result.001 file - promoters70/4772776
aaaatcaa

SEQ ID NO: 87341 - DNA, 10 bp, Unknown
  misc_feature (1)..( 10): Result.001 file - promoters70/4772776
atttagaata

SEQ ID NO: 87342 - DNA, 10 bp, Unknown
  misc_feature (1)..( 10): Result.001 file - promoters70/4772776
gattaaaata

SEQ ID NO: 87343 - DNA, 10 bp, Unknown
  misc_feature (1)..( 10): Result.001 file - promoters70/4772776
atttaaacgg

SEQ ID NO: 87344 - DNA, 10 bp, Unknown
  misc_feature (1)..( 10): Result.001 file - promoters70/4772776
gcttacacgg

SEQ ID NO: 87345 - DNA, 10 bp, Unknown
  misc_feature (1)..( 10): Result.001 file - promoters70/4772776
aaatctcgtc

SEQ ID NO: 87346 - DNA, 10 bp, Unknown
  misc_feature (1)..( 10): Result.001 file - promoters70/4772776
acatctcgtt

SEQ ID NO: 87347 - DNA, 10 bp, Unknown
  misc_feature (1)..( 10): Result.001 file - promoters70/4772776
acctcttgtc

SEQ ID NO: 87348 - DNA, 10 bp, Unknown
  misc_feature (1)..( 10): Result.001 file - promoters70/4772776
aaaactctaa

SEQ ID NO: 87349 - DNA, 11 bp, Unknown
  misc_feature (1)..( 11): Result.001 file - promoters70/4772776
ttgttaatgat

SEQ ID NO: 87350 - DNA, 11 bp, Unknown
  misc_feature (1)..( 11): Result.001 file - promoters70/4772776
tttttagtgat

SEQ ID NO: 87351 - DNA, 11 bp, Unknown
  misc_feature (1)..( 11): Result.001 file - promoters70/4772776
ttgtaaattag

SEQ ID NO: 87352 - DNA, 9 bp, Unknown
  misc_feature (1)..( 9): Result.001 file - promoters70/4772776
tttatcata

SEQ ID NO: 87353 - DNA, 9 bp, Unknown
  misc_feature (1)..( 9): Result.001 file - promoters70/4772776
cgtatcata

SEQ ID NO: 87354 - DNA, 9 bp, Unknown
  misc_feature (1)..( 9): Result.001 file - promoters70/4772776
tttttcact

SEQ ID NO: 87355 - DNA, 13 bp, Unknown
  misc_feature (1)..( 13): Result.001 file - promoters70/4772776
tcagtgattaatt

SEQ ID NO: 87356 - DNA, 13 bp, Unknown
  misc_feature (1)..( 13): Result.001 file - promoters70/4772776
tcattgatctcaa

SEQ ID NO: 87357 - DNA, 13 bp, Unknown
  misc_feature (1)..( 13): Result.001 file - promoters70/4772776
tttttgatctcaa

SEQ ID NO: 87358 - DNA, 8 bp, Unknown
  misc_feature (1)..( 8): Result.001 file - promoters70/4772776
aattgaaa

SEQ ID NO: 87359 - DNA, 8 bp, Unknown
  misc_feature (1)..( 8): Result.001 file - promoters70/4772776
cattgaaa

SEQ ID NO: 87360 - DNA, 8 bp, Unknown
  misc_feature (1)..( 8): Result.001 file - promoters70/4772776
aatttaaa

SEQ ID NO: 87361 - DNA, 10 bp, Unknown
  misc_feature (1)..( 10): Result.001 file - promoters70/4772776
attgataaat

SEQ ID NO: 87362 - DNA, 10 bp, Unknown
  misc_feature (1)..( 10): Result.001 file - promoters70/4772776
attaatacaa

SEQ ID NO: 87363 - DNA, 10 bp, Unknown
  misc_feature (1)..( 10): Result.001 file - promoters70/4772776
tttggtaaat

SEQ ID NO: 87364 - DNA, 13 bp, Unknown
  misc_feature (1)..( 13): Result.001 file - promoters70/4772776
aacataaaagcat

SEQ ID NO: 87365 - DNA, 13 bp, Unknown
  misc_feature (1)..( 13): Result.001 file - promoters70/4772776
aacttaaaaacat

SEQ ID NO: 87366 - DNA, 13 bp, Unknown
  misc_feature (1)..( 13): Result.001 file - promoters70/4772776
catctaaaaataa

SEQ ID NO: 87367 - DNA, 9 bp, Unknown
  misc_feature (1)..( 9): Result.001 file - promoters70/4772776
taaaatgca

SEQ ID NO: 87368 - DNA, 9 bp, Unknown
  misc_feature (1)..( 9): Result.001 file - promoters70/4772776
taaaataat

SEQ ID NO: 87369 - DNA, 9 bp, Unknown
  misc_feature (1)..( 9): Result.001 file - promoters70/4772776
taaaaagca

SEQ ID NO: 87370 - DNA, 11 bp, Unknown
  misc_feature (1)..( 11): Result.001 file - promoters70/4772776
ttttatcgtaa

SEQ ID NO: 87371 - DNA, 11 bp, Unknown
  misc_feature (1)..( 11): Result.001 file - promoters70/4772776
tttgatctcaa

SEQ ID NO: 87372 - DNA, 11 bp, Unknown
  misc_feature (1)..( 11): Result.001 file - promoters70/4772776
attgatctcaa

SEQ ID NO: 87373 - DNA, 7 bp, Unknown
  misc_feature (1)..( 7): Result.001 file - promoters70/4772776
ctataaa

SEQ ID NO: 87374 - DNA, 7 bp, Unknown
  misc_feature (1)..( 7): Result.001 file - promoters70/4772776
atataaa

SEQ ID NO: 87375 - DNA, 7 bp, Unknown
  misc_feature (1)..( 7): Result.001 file - promoters70/4772776
atataac

SEQ ID NO: 87376 - DNA, 11 bp, Unknown
  misc_feature (1)..( 11): Result.001 file - promoters70/4772776
tgtctttttac

SEQ ID NO: 87377 - DNA, 11 bp, Unknown
  misc_feature (1)..( 11): Result.001 file - promoters70/4772776
cttcttgttac

SEQ ID NO: 87378 - DNA, 11 bp, Unknown
  misc_feature (1)..( 11): Result.001 file - promoters70/4772776
cttcatgtaca

SEQ ID NO: 87379 - DNA, 11 bp, Unknown
  misc_feature (1)..( 11): Result.001 file - promoters70/4772776
atttgtttttt

SEQ ID NO: 87380 - DNA, 11 bp, Unknown
  misc_feature (1)..( 11): Result.001 file - promoters70/4772776
aagtgtctttt

SEQ ID NO: 87381 - DNA, 11 bp, Unknown
  misc_feature (1)..( 11): Result.001 file - promoters70/4772776
aagtatcttac

SEQ ID NO: 87382 - DNA, 8 bp, Unknown
  misc_feature (1)..( 8): Result.001 file - promoters70/4772776
aatccaaa

SEQ ID NO: 87383 - DNA, 8 bp, Unknown
  misc_feature (1)..( 8): Result.001 file - promoters70/4772776
aatcaaaa

SEQ ID NO: 87384 - DNA, 8 bp, Unknown
  misc_feature (1)..( 8): Result.001 file - promoters70/4772879
tatcaaac

SEQ ID NO: 87385 - DNA, 10 bp, Unknown
  misc_feature (1)..( 10): Result.001 file - promoters70/4772879
taaaaatgaa

SEQ ID NO: 87386 - DNA, 10 bp, Unknown
  misc_feature (1)..( 10): Result.001 file - promoters70/4772879
taaaaagtct

SEQ ID NO: 87387 - DNA, 10 bp, Unknown
  misc_feature (1)..( 10): Result.001 file - promoters70/4772879
aaaaaaagaa

SEQ ID NO: 87388 - DNA, 10 bp, Unknown
  misc_feature (1)..( 10): Result.001 file - promoters70/4772879
gaaaaagggt

SEQ ID NO: 87389 - DNA, 12 bp, Unknown
  misc_feature (1)..( 12): Result.001 file - promoters70/4772879
atataataaata

SEQ ID NO: 87390 - DNA, 12 bp, Unknown
  misc_feature (1)..( 12): Result.001 file - promoters70/4772879
gcataaaaaata

SEQ ID NO: 87391 - DNA, 12 bp, Unknown
  misc_feature (1)..( 12): Result.001 file - promoters70/4772879
ttattatacttc

SEQ ID NO: 87392 - DNA, 12 bp, Unknown
  misc_feature (1)..( 12): Result.001 file - promoters70/4772879
atataattatct

SEQ ID NO: 87393 - DNA, 12 bp, Unknown
  misc_feature (1)..( 12): Result.001 file - promoters70/4772879
ctaaaatataat

SEQ ID NO: 87394 - DNA, 10 bp, Unknown
  misc_feature (1)..( 10): Result.001 file - promoters70/4772879
gtatatatat

SEQ ID NO: 87395 - DNA, 10 bp, Unknown
  misc_feature (1)..( 10): Result.001 file - promoters70/4772879
aaataaatag

SEQ ID NO: 87396 - DNA, 10 bp, Unknown
  misc_feature (1)..( 10): Result.001 file - promoters70/4772879
aaatatataa

SEQ ID NO: 87397 - DNA, 10 bp, Unknown
  misc_feature (1)..( 10): Result.001 file - promoters70/4772879
taaaatataa

SEQ ID NO: 87398 - DNA, 12 bp, Unknown
  misc_feature (1)..( 12): Result.001 file - promoters70/4772879
tagaaattaata

SEQ ID NO: 87399 - DNA, 12 bp, Unknown
  misc_feature (1)..( 12): Result.001 file - promoters70/4772879
agataattaagt

SEQ ID NO: 87400 - DNA, 11 bp, Unknown
  misc_feature (1)..( 11): Result.001 file - promoters70/4772879
taaaatcaata

SEQ ID NO: 87401 - DNA, 11 bp, Unknown
  misc_feature (1)..( 11): Result.001 file - promoters70/4772879
tttaattatta

SEQ ID NO: 87402 - DNA, 12 bp, Unknown
  misc_feature (1)..( 12): Result.001 file - promoters70/4772879
ataacatcactt

SEQ ID NO: 87403 - DNA, 12 bp, Unknown
  misc_feature (1)..( 12): Result.001 file - promoters70/4772879
ttttatcacaag

SEQ ID NO: 87404 - DNA, 12 bp, Unknown
  misc_feature (1)..( 12): Result.001 file - promoters70/4772879
ttttgtcaacga

SEQ ID NO: 87405 - DNA, 12 bp, Unknown
  misc_feature (1)..( 12): Result.001 file - promoters70/4772879
cggtgtaaacga

SEQ ID NO: 87406 - DNA, 12 bp, Unknown
  misc_feature (1)..( 12): Result.001 file - promoters70/4772879
ttttgtatctaa

SEQ ID NO: 87407 - DNA, 8 bp, Unknown
  misc_feature (1)..( 8): Result.001 file - promoters70/4772879
atatatat

SEQ ID NO: 87408 - DNA, 8 bp, Unknown
  misc_feature (1)..( 8): Result.001 file - promoters70/4772879
atatttat

SEQ ID NO: 87409 - DNA, 8 bp, Unknown
  misc_feature (1)..( 8): Result.001 file - promoters70/4772879
caatttat

SEQ ID NO: 87410 - DNA, 8 bp, Unknown
  misc_feature (1)..( 8): Result.001 file - promoters70/4772879
taatttat

SEQ ID NO: 87411 - DNA, 8 bp, Unknown
  misc_feature (1)..( 8): Result.001 file - promoters70/4772879
aatcaaaa

SEQ ID NO: 87412 - DNA, 8 bp, Unknown
  misc_feature (1)..( 8): Result.001 file - promoters70/4772879
aatcaaat

SEQ ID NO: 87413 - DNA, 9 bp, Unknown
  misc_feature (1)..( 9): Result.001 file - promoters70/4772879
gatccaaac

SEQ ID NO: 87414 - DNA, 9 bp, Unknown
  misc_feature (1)..( 9): Result.001 file - promoters70/4772879
tatcctaac

SEQ ID NO: 87415 - DNA, 11 bp, Unknown
  misc_feature (1)..( 11): Result.001 file - promoters70/4772879
ctagacacgta

SEQ ID NO: 87416 - DNA, 11 bp, Unknown
  misc_feature (1)..( 11): Result.001 file - promoters70/4772879
atcaacacgta

SEQ ID NO: 87417 - DNA, 11 bp, Unknown
  misc_feature (1)..( 11): Result.001 file - promoters70/4772879
aaagagacgaa

SEQ ID NO: 87418 - DNA, 11 bp, Unknown
  misc_feature (1)..( 11): Result.001 file - promoters70/4772879
aaaaagaatac

SEQ ID NO: 87419 - DNA, 8 bp, Unknown
  misc_feature (1)..( 8): Result.001 file - promoters70/4772879
ttataatg

SEQ ID NO: 87420 - DNA, 8 bp, Unknown
  misc_feature (1)..( 8): Result.001 file - promoters70/4772879
atataata

SEQ ID NO: 87421 - DNA, 8 bp, Unknown
  misc_feature (1)..( 8): Result.001 file - promoters70/4772879
ttattata

SEQ ID NO: 87422 - DNA, 8 bp, Unknown
  misc_feature (1)..( 8): Result.001 file - promoters70/4773035
ataaaatc

SEQ ID NO: 87423 - DNA, 13 bp, Unknown
  misc_feature (1)..( 13): Result.001 file - promoters70/4773035
aatatttttcata

SEQ ID NO: 87424 - DNA, 13 bp, Unknown
  misc_feature (1)..( 13): Result.001 file - promoters70/4773035
tatacttttaata

SEQ ID NO: 87425 - DNA, 13 bp, Unknown
  misc_feature (1)..( 13): Result.001 file - promoters70/4773035
aatgtttatgttg

SEQ ID NO: 87426 - DNA, 9 bp, Unknown
  misc_feature (1)..( 9): Result.001 file - promoters70/4773035
aaatttttt

SEQ ID NO: 87427 - DNA, 9 bp, Unknown
  misc_feature (1)..( 9): Result.001 file - promoters70/4773035
taatatttt

SEQ ID NO: 87428 - DNA, 9 bp, Unknown
  misc_feature (1)..( 9): Result.001 file - promoters70/4773035
aaatgttta

SEQ ID NO: 87429 - DNA, 7 bp, Unknown
  misc_feature (1)..( 7): Result.001 file - promoters70/4773035
tttctaa

SEQ ID NO: 87430 - DNA, 7 bp, Unknown
  misc_feature (1)..( 7): Result.001 file - promoters70/4773035
tttttaa

SEQ ID NO: 87431 - DNA, 7 bp, Unknown
  misc_feature (1)..( 7): Result.001 file - promoters70/4773035
tttttac

SEQ ID NO: 87432 - DNA, 9 bp, Unknown
  misc_feature (1)..( 9): Result.001 file - promoters70/4773035
ataagagtc

SEQ ID NO: 87433 - DNA, 9 bp, Unknown
  misc_feature (1)..( 9): Result.001 file - promoters70/4773035
atatgagtc

SEQ ID NO: 87434 - DNA, 9 bp, Unknown
  misc_feature (1)..( 9): Result.001 file - promoters70/4773035
atatgaata

SEQ ID NO: 87435 - DNA, 8 bp, Unknown
  misc_feature (1)..( 8): Result.001 file - promoters70/4773035
tattttca

SEQ ID NO: 87436 - DNA, 8 bp, Unknown
  misc_feature (1)..( 8): Result.001 file - promoters70/4773035
cgttttca

SEQ ID NO: 87437 - DNA, 8 bp, Unknown
  misc_feature (1)..( 8): Result.001 file - promoters70/4773035
tattgtca

SEQ ID NO: 87438 - DNA, 7 bp, Unknown
  misc_feature (1)..( 7): Result.001 file - promoters70/4773035
cggatag

SEQ ID NO: 87439 - DNA, 7 bp, Unknown
  misc_feature (1)..( 7): Result.001 file - promoters70/4773035
cggttag

SEQ ID NO: 87440 - DNA, 7 bp, Unknown
  misc_feature (1)..( 7): Result.001 file - promoters70/4773035
cggttaa

SEQ ID NO: 87441 - DNA, 12 bp, Unknown
  misc_feature (1)..( 12): Result.001 file - promoters70/4773035
gaaagaaataat

SEQ ID NO: 87442 - DNA, 12 bp, Unknown
  misc_feature (1)..( 12): Result.001 file - promoters70/4773035
aaccaaaacaat

SEQ ID NO: 87443 - DNA, 12 bp, Unknown
  misc_feature (1)..( 12): Result.001 file - promoters70/4773068
aaccagaacaga

SEQ ID NO: 87444 - DNA, 10 bp, Unknown
  misc_feature (1)..( 10): Result.001 file - promoters70/4773068
tacgtgtcaa

SEQ ID NO: 87445 - DNA, 10 bp, Unknown
  misc_feature (1)..( 10): Result.001 file - promoters70/4773068
cacgtgtcat

SEQ ID NO: 87446 - DNA, 10 bp, Unknown
  misc_feature (1)..( 10): Result.001 file - promoters70/4773068
tacgtgtcaa

SEQ ID NO: 87447 - DNA, 20 bp, Unknown
  misc_feature (1)..( 20): Result.001 file - promoters70/4773068
ttggttattgcttcaccgcc

SEQ ID NO: 87448 - DNA, 20 bp, Unknown
  misc_feature (1)..( 20): Result.001 file - promoters70/4773068
ttagctattgcttcaccgcc

SEQ ID NO: 87449 - DNA, 20 bp, Unknown
  misc_feature (1)..( 20): Result.001 file - promoters70/4773068
ttggctattgcttccacgcc

SEQ ID NO: 87450 - DNA, 22 bp, Unknown
  misc_feature (1)..( 22): Result.001 file - promoters70/4773068
tctcgtgaccgactcgtcctcg

SEQ ID NO: 87451 - DNA, 22 bp, Unknown
  misc_feature (1)..( 22): Result.001 file - promoters70/4773068
gacctagtcgtcctcgtctttt

SEQ ID NO: 87452 - DNA, 22 bp, Unknown
  misc_feature (1)..( 22): Result.001 file - promoters70/4773068
gaccgagtcgtcctcgtctttt

SEQ ID NO: 87453 - DNA, 19 bp, Unknown
  misc_feature (1)..( 19): Result.001 file - promoters70/4773068
ttcttcttctataaattaa

SEQ ID NO: 87454 - DNA, 19 bp, Unknown
  misc_feature (1)..( 19): Result.001 file - promoters70/4773068
ttcttcttctataaaacaa

SEQ ID NO: 87455 - DNA, 19 bp, Unknown
  misc_feature (1)..( 19): Result.001 file - promoters70/4773068
ttttgcttctataaatcaa

SEQ ID NO: 87456 - DNA, 15 bp, Unknown
  misc_feature (1)..( 15): Result.001 file - promoters70/4773068
cgccttagctttctc

SEQ ID NO: 87457 - DNA, 15 bp, Unknown
  misc_feature (1)..( 15): Result.001 file - promoters70/4773068
cgccttagctttctc

SEQ ID NO: 87458 - DNA, 15 bp, Unknown
  misc_feature (1)..( 15): Result.001 file - promoters70/4773074
cgccttagctttctc

SEQ ID NO: 87459 - DNA, 13 bp, Unknown
  misc_feature (1)..( 13): Result.001 file - promoters70/4773074
ttataaaacccta

SEQ ID NO: 87460 - DNA, 13 bp, Unknown
  misc_feature (1)..( 13): Result.001 file - promoters70/4773074
atataaatccctt

SEQ ID NO: 87461 - DNA, 13 bp, Unknown
  misc_feature (1)..( 13): Result.001 file - promoters70/4773074
ttataaataatct

SEQ ID NO: 87462 - DNA, 13 bp, Unknown
  misc_feature (1)..( 13): Result.001 file - promoters70/4773074
gtataaaaacact

SEQ ID NO: 87463 - DNA, 13 bp, Unknown
  misc_feature (1)..( 13): Result.001 file - promoters70/4773074
atataaatccttc

SEQ ID NO: 87464 - DNA, 13 bp, Unknown
  misc_feature (1)..( 13): Result.001 file - promoters70/4773182
ctcaaaagcccta

SEQ ID NO: 87465 - DNA, 10 bp, Unknown
  misc_feature (1)..( 10): Result.001 file - promoters70/4773182
ttgtaattta

SEQ ID NO: 87466 - DNA, 10 bp, Unknown
  misc_feature (1)..( 10): Result.001 file - promoters70/4773182
ttgtagtttt

SEQ ID NO: 87467 - DNA, 11 bp, Unknown
  misc_feature (1)..( 11): Result.001 file - promoters70/4773355
tctaagtcttg

SEQ ID NO: 87468 - DNA, 11 bp, Unknown
  misc_feature (1)..( 11): Result.001 file - promoters70/4773355
ttacttttatt

SEQ ID NO: 87469 - DNA, 11 bp, Unknown
  misc_feature (1)..( 11): Result.001 file - promoters70/4773355
ttacttttaac

SEQ ID NO: 87470 - DNA, 11 bp, Unknown
  misc_feature (1)..( 11): Result.001 file - promoters70/4773355
ctaatttgaac

SEQ ID NO: 87471 - DNA, 9 bp, Unknown
  misc_feature (1)..( 9): Result.001 file - promoters70/4773355
ttaacaaaa

SEQ ID NO: 87472 - DNA, 9 bp, Unknown
  misc_feature (1)..( 9): Result.001 file - promoters70/4773355
ttaagaaaa

SEQ ID NO: 87473 - DNA, 9 bp, Unknown
  misc_feature (1)..( 9): Result.001 file - promoters70/4773355
ttatcaaat

SEQ ID NO: 87474 - DNA, 8 bp, Unknown
  misc_feature (1)..( 8): Result.001 file - promoters70/4773355
aaacaatt

SEQ ID NO: 87475 - DNA, 8 bp, Unknown
  misc_feature (1)..( 8): Result.001 file - promoters70/4773355
aaataatc

SEQ ID NO: 87476 - DNA, 8 bp, Unknown
  misc_feature (1)..( 8): Result.001 file - promoters70/4773823
caactatt

SEQ ID NO: 87477 - DNA, 9 bp, Unknown
  misc_feature (1)..( 9): Result.001 file - promoters70/4773823
agataataa

SEQ ID NO: 87478 - DNA, 9 bp, Unknown
  misc_feature (1)..( 9): Result.001 file - promoters70/4773823
agaaaattc

SEQ ID NO: 87479 - DNA, 9 bp, Unknown
  misc_feature (1)..( 9): Result.001 file - promoters70/4803329
tcaaacttc

SEQ ID NO: 87480 - DNA, 9 bp, Unknown
  misc_feature (1)..( 9): Result.001 file - promoters70/4803329
aaaactgaa

SEQ ID NO: 87481 - DNA, 9 bp, Unknown
  misc_feature (1)..( 9): Result.001 file - promoters70/4803329
aaaattgaa

SEQ ID NO: 87482 - DNA, 9 bp, Unknown
  misc_feature (1)..( 9): Result.001 file - promoters70/4806023
tatattgaa

SEQ ID NO: 87483 - DNA, 7 bp, Unknown
  misc_feature (1)..( 7): Result.001 file - promoters70/4806023
aaccgtt

SEQ ID NO: 87484 - DNA, 7 bp, Unknown
  misc_feature (1)..( 7): Result.001 file - promoters70/4806023
gaccgtt

SEQ ID NO: 87485 - DNA, 7 bp, Unknown
  misc_feature (1)..( 7): Result.001 file - promoters70/4806023
gaccgtg

SEQ ID NO: 87486 - DNA, 10 bp, Unknown
  misc_feature (1)..( 10): Result.001 file - promoters70/4806023
ctctttattt

SEQ ID NO: 87487 - DNA, 10 bp, Unknown
  misc_feature (1)..( 10): Result.001 file - promoters70/4806023
atcttgattt

SEQ ID NO: 87488 - DNA, 10 bp, Unknown
  misc_feature (1)..( 10): Result.001 file - promoters70/4807026
atcttgaata

SEQ ID NO: 87489 - DNA, 14 bp, Unknown
  misc_feature (1)..( 14): Result.001 file - promoters70/4807026
tatattaactttga

SEQ ID NO: 87490 - DNA, 14 bp, Unknown
  misc_feature (1)..( 14): Result.001 file - promoters70/4807026
tatgttaattttag

SEQ ID NO: 87491 - DNA, 9 bp, Unknown
  misc_feature (1)..( 9): Result.001 file - promoters70/4807026
taactttat

SEQ ID NO: 87492 - DNA, 9 bp, Unknown
  misc_feature (1)..( 9): Result.001 file - promoters70/4807026
cttagaaac

SEQ ID NO: 87493 - DNA, 9 bp, Unknown
  misc_feature (1)..( 9): Result.001 file - promoters70/4807026
tttagaaag

SEQ ID NO: 87494 - DNA, 9 bp, Unknown
  misc_feature (1)..( 9): Result.001 file - promoters70/4807026
cttagaaga

SEQ ID NO: 87495 - DNA, 6 bp, Unknown
  misc_feature (1)..( 6): Result.001 file - promoters70/4807026
agaaac

SEQ ID NO: 87496 - DNA, 9 bp, Unknown
  misc_feature (1)..( 9): Result.001 file - promoters70/4807026
ttgagttgt

SEQ ID NO: 87497 - DNA, 9 bp, Unknown
  misc_feature (1)..( 9): Result.001 file - promoters70/4807026
ttgatttgg

SEQ ID NO: 87498 - DNA, 9 bp, Unknown
  misc_feature (1)..( 9): Result.001 file - promoters70/4807026
ggaatttgg

SEQ ID NO: 87499 - DNA, 9 bp, Unknown
  misc_feature (1)..( 9): Result.001 file - promoters70/4807026
ttgttttca

SEQ ID NO: 87500 - DNA, 10 bp, Unknown
  misc_feature (1)..( 10): Result.001 file - promoters70/4807026
aaaatcccta

SEQ ID NO: 87501 - DNA, 10 bp, Unknown
  misc_feature (1)..( 10): Result.001 file - promoters70/4807026
cagatcgcta

SEQ ID NO: 87502 - DNA, 10 bp, Unknown
  misc_feature (1)..( 10): Result.001 file - promoters70/4807026
aaaagcccat

SEQ ID NO: 87503 - DNA, 9 bp, Unknown
  misc_feature (1)..( 9): Result.001 file - promoters70/4807026
aaacattat

SEQ ID NO: 87504 - DNA, 9 bp, Unknown
  misc_feature (1)..( 9): Result.001 file - promoters70/4807026
aaacatata

SEQ ID NO: 87505 - DNA, 9 bp, Unknown
  misc_feature (1)..( 9): Result.001 file - promoters70/4807236
aaacttata

SEQ ID NO: 87506 - DNA, 12 bp, Unknown
  misc_feature (1)..( 12): Result.001 file - promoters70/4807236
tttaacaataag

SEQ ID NO: 87507 - DNA, 12 bp, Unknown
  misc_feature (1)..( 12): Result.001 file - promoters70/4807236
cttagcaataaa

SEQ ID NO: 87508 - DNA, 12 bp, Unknown
  misc_feature (1)..( 12): Result.001 file - promoters70/4808052
tttagcaaaaag

SEQ ID NO: 87509 - DNA, 7 bp, Unknown
  misc_feature (1)..( 7): Result.001 file - promoters70/4808052
gaaccat

SEQ ID NO: 87510 - DNA, 7 bp, Unknown
  misc_feature (1)..( 7): Result.001 file - promoters70/4808052
aaaccat

SEQ ID NO: 87511 - DNA, 7 bp, Unknown
  misc_feature (1)..( 7): Result.001 file - promoters70/4808052
aaaccaa

SEQ ID NO: 87512 - DNA, 10 bp, Unknown
  misc_feature (1)..( 10): Result.001 file - promoters70/4808052
ggtcaaaaac

SEQ ID NO: 87513 - DNA, 10 bp, Unknown
  misc_feature (1)..( 10): Result.001 file - promoters70/4808052
ggacaaaaac

SEQ ID NO: 87514 - DNA, 10 bp, Unknown
  misc_feature (1)..( 10): Result.001 file - promoters70/4808052
gaccaaaaga

SEQ ID NO: 87515 - DNA, 7 bp, Unknown
  misc_feature (1)..( 7): Result.001 file - promoters70/4808052
ttacaaa

SEQ ID NO: 87516 - DNA, 7 bp, Unknown
  misc_feature (1)..( 7): Result.001 file - promoters70/4808052
ttaaaaa

SEQ ID NO: 87517 - DNA, 7 bp, Unknown
  misc_feature (1)..( 7): Result.001 file - promoters70/4808052
ttaaaat

SEQ ID NO: 87518 - DNA, 7 bp, Unknown
  misc_feature (1)..( 7): Result.001 file - promoters70/4808052
caaatta

SEQ ID NO: 87519 - DNA, 7 bp, Unknown
  misc_feature (1)..( 7): Result.001 file - promoters70/4808052
aaaatta

SEQ ID NO: 87520 - DNA, 7 bp, Unknown
  misc_feature (1)..( 7): Result.001 file - promoters70/4808052
aaaattt

SEQ ID NO: 87521 - DNA, 7 bp, Unknown
  misc_feature (1)..( 7): Result.001 file - promoters70/4808052
agaccaa

SEQ ID NO: 87522 - DNA, 7 bp, Unknown
  misc_feature (1)..( 7): Result.001 file - promoters70/4808052
agatcaa

SEQ ID NO: 87523 - DNA, 7 bp, Unknown
  misc_feature (1)..( 7): Result.001 file - promoters70/4811047
ggatcaa

SEQ ID NO: 87524 - DNA, 9 bp, Unknown
  misc_feature (1)..( 9): Result.001 file - promoters70/4811047
aaaaataaa

SEQ ID NO: 87525 - DNA, 9 bp, Unknown
  misc_feature (1)..( 9): Result.001 file - promoters70/4811047
aaacatata

SEQ ID NO: 87526 - DNA, 9 bp, Unknown
  misc_feature (1)..( 9): Result.001 file - promoters70/4811047
taaaataca

SEQ ID NO: 87527 - DNA, 9 bp, Unknown
  misc_feature (1)..( 9): Result.001 file - promoters70/4811047
caaaataaa

SEQ ID NO: 87528 - DNA, 9 bp, Unknown
  misc_feature (1)..( 9): Result.001 file - promoters70/4811047
taaataaaa

SEQ ID NO: 87529 - DNA, 9 bp, Unknown
  misc_feature (1)..( 9): Result.001 file - promoters70/4811047
taattaaac

SEQ ID NO: 87530 - DNA, 9 bp, Unknown
  misc_feature (1)..( 9): Result.001 file - promoters70/4811047
attataaaa

SEQ ID NO: 87531 - DNA, 9 bp, Unknown
  misc_feature (1)..( 9): Result.001 file - promoters70/4811047
aaaataaag

SEQ ID NO: 87532 - DNA, 10 bp, Unknown
  misc_feature (1)..( 10): Result.001 file - promoters70/4811047
tcatattatt

SEQ ID NO: 87533 - DNA, 10 bp, Unknown
  misc_feature (1)..( 10): Result.001 file - promoters70/4811047
atatattaat

SEQ ID NO: 87534 - DNA, 11 bp, Unknown
  misc_feature (1)..( 11): Result.001 file - promoters70/4811047
atataattatt

SEQ ID NO: 87535 - DNA, 12 bp, Unknown
  misc_feature (1)..( 12): Result.001 file - promoters70/4811047
ttaatgattttg

SEQ ID NO: 87536 - DNA, 11 bp, Unknown
  misc_feature (1)..( 11): Result.001 file - promoters70/4811047
atattattagt

SEQ ID NO: 87537 - DNA, 11 bp, Unknown
  misc_feature (1)..( 11): Result.001 file - promoters70/4811047
taattattttg

SEQ ID NO: 87538 - DNA, 11 bp, Unknown
  misc_feature (1)..( 11): Result.001 file - promoters70/4811047
ccattgttaac

SEQ ID NO: 87539 - DNA, 11 bp, Unknown
  misc_feature (1)..( 11): Result.001 file - promoters70/4811047
taatgattttg

SEQ ID NO: 87540 - DNA, 8 bp, Unknown
  misc_feature (1)..( 8): Result.001 file - promoters70/4811047
ttcatatg

SEQ ID NO: 87541 - DNA, 8 bp, Unknown
  misc_feature (1)..( 8): Result.001 file - promoters70/4811047
gtcatata

SEQ ID NO: 87542 - DNA, 8 bp, Unknown
  misc_feature (1)..( 8): Result.001 file - promoters70/4811047
gtcataaa

SEQ ID NO: 87543 - DNA, 8 bp, Unknown
  misc_feature (1)..( 8): Result.001 file - promoters70/4899830
atcaaata

SEQ ID NO: 87544 - DNA, 9 bp, Unknown
  misc_feature (1)..( 9): Result.001 file - promoters70/4899830
tatatactt

SEQ ID NO: 87545 - DNA, 9 bp, Unknown
  misc_feature (1)..( 9): Result.001 file - promoters70/4899830
aatacacta

SEQ ID NO: 87546 - DNA, 9 bp, Unknown
  misc_feature (1)..( 9): Result.001 file - promoters70/4899830
tatatatat

SEQ ID NO: 87547 - DNA, 9 bp, Unknown
  misc_feature (1)..( 9): Result.001 file - promoters70/4899830
tatataaag

SEQ ID NO: 87548 - DNA, 9 bp, Unknown
  misc_feature (1)..( 9): Result.001 file - promoters70/4899830
tatttatga

SEQ ID NO: 87549 - DNA, 9 bp, Unknown
  misc_feature (1)..( 9): Result.001 file - promoters70/4899830
aatataaag

SEQ ID NO: 87550 - DNA, 13 bp, Unknown
  misc_feature (1)..( 13): Result.001 file - promoters70/4899830
gaatttttgcgag

SEQ ID NO: 87551 - DNA, 13 bp, Unknown
  misc_feature (1)..( 13): Result.001 file - promoters70/4899830
gaacttttaatcg

SEQ ID NO: 87552 - DNA, 13 bp, Unknown
  misc_feature (1)..( 13): Result.001 file - promoters70/4899830
aaattttttataa

SEQ ID NO: 87553 - DNA, 13 bp, Unknown
  misc_feature (1)..( 13): Result.001 file - promoters70/4899830
taacgtttggttt

SEQ ID NO: 87554 - DNA, 13 bp, Unknown
  misc_feature (1)..( 13): Result.001 file - promoters70/4899830
taaagttgattaa

SEQ ID NO: 87555 - DNA, 13 bp, Unknown
  misc_feature (1)..( 13): Result.001 file - promoters70/4899873
aaacgtttgcttt

SEQ ID NO: 87556 - DNA, 11 bp, Unknown
  misc_feature (1)..( 11): Result.001 file - promoters70/4899873
catatatactt

SEQ ID NO: 87557 - DNA, 11 bp, Unknown
  misc_feature (1)..( 11): Result.001 file - promoters70/4899873
aatatataaag

SEQ ID NO: 87558 - DNA, 11 bp, Unknown
  misc_feature (1)..( 11): Result.001 file - promoters70/4899873
catatatatgc

SEQ ID NO: 87559 - DNA, 11 bp, Unknown
  misc_feature (1)..( 11): Result.001 file - promoters70/4899873
catataaatta

SEQ ID NO: 87560 - DNA, 11 bp, Unknown
  misc_feature (1)..( 11): Result.001 file - promoters70/4899873
tatatatatta

SEQ ID NO: 87561 - DNA, 11 bp, Unknown
  misc_feature (1)..( 11): Result.001 file - promoters70/4899873
cgtatataaag

SEQ ID NO: 87562 - DNA, 10 bp, Unknown
  misc_feature (1)..( 10): Result.001 file - promoters70/4899873
taataataac

SEQ ID NO: 87563 - DNA, 10 bp, Unknown
  misc_feature (1)..( 10): Result.001 file - promoters70/4899873
tattaataaa

SEQ ID NO: 87564 - DNA, 10 bp, Unknown
  misc_feature (1)..( 10): Result.001 file - promoters70/4899873
aaatattaat

SEQ ID NO: 87565 - DNA, 10 bp, Unknown
  misc_feature (1)..( 10): Result.001 file - promoters70/4899873
aaaacatata

SEQ ID NO: 87566 - DNA, 10 bp, Unknown
  misc_feature (1)..( 10): Result.001 file - promoters70/4899873
gaaaaacaaa

SEQ ID NO: 87567 - DNA, 10 bp, Unknown
  misc_feature (1)..( 10): Result.001 file - promoters70/4900353
attaattaat

SEQ ID NO: 87568 - DNA, 11 bp, Unknown
  misc_feature (1)..( 11): Result.001 file - promoters70/4900353
taatatatatt

SEQ ID NO: 87569 - DNA, 11 bp, Unknown
  misc_feature (1)..( 11): Result.001 file - promoters70/4900353
taagataggaa

SEQ ID NO: 87570 - DNA, 11 bp, Unknown
  misc_feature (1)..( 11): Result.001 file - promoters70/4900353
tgatataaatt

SEQ ID NO: 87571 - DNA, 8 bp, Unknown
  misc_feature (1)..( 8): Result.001 file - promoters70/4900353
gggcctaa

SEQ ID NO: 87572 - DNA, 8 bp, Unknown
  misc_feature (1)..( 8): Result.001 file - promoters70/4900353
cggcgtaa

SEQ ID NO: 87573 - DNA, 8 bp, Unknown
  misc_feature (1)..( 8): Result.001 file - promoters70/4901133
gggcctat

SEQ ID NO: 87574 - DNA, 10 bp, Unknown
  misc_feature (1)..( 10): Result.001 file - promoters70/4901133
atgatactag

SEQ ID NO: 87575 - DNA, 10 bp, Unknown
  misc_feature (1)..( 10): Result.001 file - promoters70/4901133
atgatagtct

SEQ ID NO: 87576 - DNA, 10 bp, Unknown
  misc_feature (1)..( 10): Result.001 file - promoters70/4901133
ttgaaagttt

SEQ ID NO: 87577 - DNA, 10 bp, Unknown
  misc_feature (1)..( 10): Result.001 file - promoters70/4901133
agtaaaattt

SEQ ID NO: 87578 - DNA, 10 bp, Unknown
  misc_feature (1)..( 10): Result.001 file - promoters70/4901133
aaaaaaattg

SEQ ID NO: 87579 - DNA, 10 bp, Unknown
  misc_feature (1)..( 10): Result.001 file - promoters70/4901133
tttaaatttt

SEQ ID NO: 87580 - DNA, 10 bp, Unknown
  misc_feature (1)..( 10): Result.001 file - promoters70/4901133
gagaaattga

SEQ ID NO: 87581 - DNA, 10 bp, Unknown
  misc_feature (1)..( 10): Result.001 file - promoters70/4901133
acaaataaag

SEQ ID NO: 87582 - DNA, 10 bp, Unknown
  misc_feature (1)..( 10): Result.001 file - promoters70/4901133
ccaaatatca

SEQ ID NO: 87583 - DNA, 10 bp, Unknown
  misc_feature (1)..( 10): Result.001 file - promoters70/4901133
agaaaaaaaa

SEQ ID NO: 87584 - DNA, 10 bp, Unknown
  misc_feature (1)..( 10): Result.001 file - promoters70/4901133
tcaagtaaaa

SEQ ID NO: 87585 - DNA, 10 bp, Unknown
  misc_feature (1)..( 10): Result.001 file - promoters70/4901133
gtaaatgtat

SEQ ID NO: 87586 - DNA, 10 bp, Unknown
  misc_feature (1)..( 10): Result.001 file - promoters70/4901133
tgagaagaaa

SEQ ID NO: 87587 - DNA, 10 bp, Unknown
  misc_feature (1)..( 10): Result.001 file - promoters70/4901171
taaaatgtct

SEQ ID NO: 87588 - DNA, 10 bp, Unknown
  misc_feature (1)..( 10): Result.001 file - promoters70/4901171
gaacaaaaaa

SEQ ID NO: 87589 - DNA, 12 bp, Unknown
  misc_feature (1)..( 12): Result.001 file - promoters70/4901171
gcaaaccaaact

SEQ ID NO: 87590 - DNA, 12 bp, Unknown
  misc_feature (1)..( 12): Result.001 file - promoters70/4901171
agtaactaaaat

SEQ ID NO: 87591 - DNA, 12 bp, Unknown
  misc_feature (1)..( 12): Result.001 file - promoters70/4901171
aattacaaaata

SEQ ID NO: 87592 - DNA, 12 bp, Unknown
  misc_feature (1)..( 12): Result.001 file - promoters70/4901171
atgcacctaacc

SEQ ID NO: 87593 - DNA, 12 bp, Unknown
  misc_feature (1)..( 12): Result.001 file - promoters70/4901171
agtcactaaaaa

SEQ ID NO: 87594 - DNA, 12 bp, Unknown
  misc_feature (1)..( 12): Result.001 file - promoters70/4901171
ttttgctaaaaa

SEQ ID NO: 87595 - DNA, 12 bp, Unknown
  misc_feature (1)..( 12): Result.001 file - promoters70/4901171
agtaaaaaagta

SEQ ID NO: 87596 - DNA, 12 bp, Unknown
  misc_feature (1)..( 12): Result.001 file - promoters70/4901171
actaaaaaggtt

SEQ ID NO: 87597 - DNA, 12 bp, Unknown
  misc_feature (1)..( 12): Result.001 file - promoters70/4901171
agtcaaatatag

SEQ ID NO: 87598 - DNA, 12 bp, Unknown
  misc_feature (1)..( 12): Result.001 file - promoters70/4901171
gctaaaaatcct

SEQ ID NO: 87599 - DNA, 12 bp, Unknown
  misc_feature (1)..( 12): Result.001 file - promoters70/4901171
tacaaaataggt

SEQ ID NO: 87600 - DNA, 12 bp, Unknown
  misc_feature (1)..( 12): Result.001 file - promoters70/4901783
tttaggtgctta

SEQ ID NO: 87601 - DNA, 7 bp, Unknown
  misc_feature (1)..( 7): Result.001 file - promoters70/4901783
ccacaga

SEQ ID NO: 87602 - DNA, 7 bp, Unknown
  misc_feature (1)..( 7): Result.001 file - promoters70/4901783
ccacagc

SEQ ID NO: 87603 - DNA, 7 bp, Unknown
  misc_feature (1)..( 7): Result.001 file - promoters70/4901839
tcacaga

SEQ ID NO: 87604 - DNA, 10 bp, Unknown
  misc_feature (1)..( 10): Result.001 file - promoters70/4901839
ttaaacttgt

SEQ ID NO: 87605 - DNA, 10 bp, Unknown
  misc_feature (1)..( 10): Result.001 file - promoters70/4901839
ttaaacttgc

SEQ ID NO: 87606 - DNA, 10 bp, Unknown
  misc_feature (1)..( 10): Result.001 file - promoters70/4901839
acaaacatgt

SEQ ID NO: 87607 - DNA, 7 bp, Unknown
  misc_feature (1)..( 7): Result.001 file - promoters70/4901839
attctaa

SEQ ID NO: 87608 - DNA, 7 bp, Unknown
  misc_feature (1)..( 7): Result.001 file - promoters70/4901839
attttaa

SEQ ID NO: 87609 - DNA, 7 bp, Unknown
  misc_feature (1)..( 7): Result.001 file - promoters70/4902387
tttttaa

SEQ ID NO: 87610 - DNA, 10 bp, Unknown
  misc_feature (1)..( 10): Result.001 file - promoters70/4902387
tgatgttata

SEQ ID NO: 87611 - DNA, 10 bp, Unknown
  misc_feature (1)..( 10): Result.001 file - promoters70/4902387
tgatcttata

SEQ ID NO: 87612 - DNA, 10 bp, Unknown
  misc_feature (1)..( 10): Result.001 file - promoters70/4902387
atttctgata

SEQ ID NO: 87613 - DNA, 9 bp, Unknown
  misc_feature (1)..( 9): Result.001 file - promoters70/4902387
ccgattaat

SEQ ID NO: 87614 - DNA, 9 bp, Unknown
  misc_feature (1)..( 9): Result.001 file - promoters70/4902387
ccgaataaa

SEQ ID NO: 87615 - DNA, 9 bp, Unknown
  misc_feature (1)..( 9): Result.001 file - promoters70/4903614
gtaaataaa

SEQ ID NO: 87616 - DNA, 10 bp, Unknown
  misc_feature (1)..( 10): Result.001 file - promoters70/4903614
ttaatataaa

SEQ ID NO: 87617 - DNA, 10 bp, Unknown
  misc_feature (1)..( 10): Result.001 file - promoters70/4903614
acaatttaaa

SEQ ID NO: 87618 - DNA, 10 bp, Unknown
  misc_feature (1)..( 10): Result.001 file - promoters70/4909449
ttattataaa

SEQ ID NO: 87619 - DNA, 12 bp, Unknown
  misc_feature (1)..( 12): Result.001 file - promoters70/4909449
ttcaaaaaagag

SEQ ID NO: 87620 - DNA, 12 bp, Unknown
  misc_feature (1)..( 12): Result.001 file - promoters70/4909449
gttaaaaaagtg

SEQ ID NO: 87621 - DNA, 12 bp, Unknown
  misc_feature (1)..( 12): Result.001 file - promoters70/4909449
ttagtaaaagaa

SEQ ID NO: 87622 - DNA, 12 bp, Unknown
  misc_feature (1)..( 12): Result.001 file - promoters70/4909449
ttcaaaaaaaaa

SEQ ID NO: 87623 - DNA, 12 bp, Unknown
  misc_feature (1)..( 12): Result.001 file - promoters70/4909449
cagaaaatagtt

SEQ ID NO: 87624 - DNA, 12 bp, Unknown
  misc_feature (1)..( 12): Result.001 file - promoters70/4911380
tttcggatagtt

SEQ ID NO: 87625 - DNA, 15 bp, Unknown
  misc_feature (1)..( 15): Result.001 file - promoters70/4911380
cagttttgtattatc

SEQ ID NO: 87626 - DNA, 15 bp, Unknown
  misc_feature (1)..( 15): Result.001 file - promoters70/4911380
tagccttgtatttac

SEQ ID NO: 87627 - DNA, 15 bp, Unknown
  misc_feature (1)..( 15): Result.001 file - promoters70/4911380
gtttcttgtatcatt

SEQ ID NO: 87628 - DNA, 15 bp, Unknown
  misc_feature (1)..( 15): Result.001 file - promoters70/4911380
catttctgtgtttaa

SEQ ID NO: 87629 - DNA, 15 bp, Unknown
  misc_feature (1)..( 15): Result.001 file - promoters70/4911380
gttacttttattatt

SEQ ID NO: 87630 - DNA, 15 bp, Unknown
  misc_feature (1)..( 15): Result.001 file - promoters70/4911380
tttctctgggttgac

SEQ ID NO: 87631 - DNA, 17 bp, Unknown
  misc_feature (1)..( 17): Result.001 file - promoters70/4911380
aaaaaagtttttgtaat

SEQ ID NO: 87632 - DNA, 17 bp, Unknown
  misc_feature (1)..( 17): Result.001 file - promoters70/4911380
actagggttttttcttg

SEQ ID NO: 87633 - DNA, 17 bp, Unknown
  misc_feature (1)..( 17): Result.001 file - promoters70/4911380
ctcaaacttttattttt

SEQ ID NO: 87634 - DNA, 17 bp, Unknown
  misc_feature (1)..( 17): Result.001 file - promoters70/4911380
caagatatttttggtta

SEQ ID NO: 87635 - DNA, 17 bp, Unknown
  misc_feature (1)..( 17): Result.001 file - promoters70/4911380
cacaaatttttactttt

SEQ ID NO: 87636 - DNA, 17 bp, Unknown
  misc_feature (1)..( 17): Result.001 file - promoters70/4911485
cacaaataacggagttt

SEQ ID NO: 87637 - DNA, 8 bp, Unknown
  misc_feature (1)..( 8): Result.001 file - promoters70/4911485
tttgtttg

SEQ ID NO: 87638 - DNA, 8 bp, Unknown
  misc_feature (1)..( 8): Result.001 file - promoters70/4911485
aatgtttg

SEQ ID NO: 87639 - DNA, 8 bp, Unknown
  misc_feature (1)..( 8): Result.001 file - promoters70/4911485
tttatttt

SEQ ID NO: 87640 - DNA, 8 bp, Unknown
  misc_feature (1)..( 8): Result.001 file - promoters70/4911485
aatgtttg

SEQ ID NO: 87641 - DNA, 8 bp, Unknown
  misc_feature (1)..( 8): Result.001 file - promoters70/4911485
aatgttta

SEQ ID NO: 87642 - DNA, 8 bp, Unknown
  misc_feature (1)..( 8): Result.001 file - promoters70/4911485
catgtttt

SEQ ID NO: 87643 - DNA, 12 bp, Unknown
  misc_feature (1)..( 12): Result.001 file - promoters70/4911485
tgagtatatttt

SEQ ID NO: 87644 - DNA, 12 bp, Unknown
  misc_feature (1)..( 12): Result.001 file - promoters70/4911485
tgattatatgta

SEQ ID NO: 87645 - DNA, 12 bp, Unknown
  misc_feature (1)..( 12): Result.001 file - promoters70/4911485
tttgtaaatttt

SEQ ID NO: 87646 - DNA, 12 bp, Unknown
  misc_feature (1)..( 12): Result.001 file - promoters70/4911485
agattatcaata

SEQ ID NO: 87647 - DNA, 12 bp, Unknown
  misc_feature (1)..( 12): Result.001 file - promoters70/4911485
gatgtaaaaatt

SEQ ID NO: 87648 - DNA, 12 bp, Unknown
  misc_feature (1)..( 12): Result.001 file - promoters70/4911485
gacataaatttt

SEQ ID NO: 87649 - DNA, 9 bp, Unknown
  misc_feature (1)..( 9): Result.001 file - promoters70/4911485
acttgcata

SEQ ID NO: 87650 - DNA, 9 bp, Unknown
  misc_feature (1)..( 9): Result.001 file - promoters70/4911485
agttggata

SEQ ID NO: 87651 - DNA, 9 bp, Unknown
  misc_feature (1)..( 9): Result.001 file - promoters70/4911485
acttccatg

SEQ ID NO: 87652 - DNA, 9 bp, Unknown
  misc_feature (1)..( 9): Result.001 file - promoters70/4911485
gagtggata

SEQ ID NO: 87653 - DNA, 9 bp, Unknown
  misc_feature (1)..( 9): Result.001 file - promoters70/4911485
ctttggatt

SEQ ID NO: 87654 - DNA, 9 bp, Unknown
  misc_feature (1)..( 9): Result.001 file - promoters70/4911485
cgtttgatt

SEQ ID NO: 87655 - DNA, 10 bp, Unknown
  misc_feature (1)..( 10): Result.001 file - promoters70/4911485
caataattta

SEQ ID NO: 87656 - DNA, 10 bp, Unknown
  misc_feature (1)..( 10): Result.001 file - promoters70/4911485
gtataatttt

SEQ ID NO: 87657 - DNA, 10 bp, Unknown
  misc_feature (1)..( 10): Result.001 file - promoters70/4911485
tgaaaattta

SEQ ID NO: 87658 - DNA, 10 bp, Unknown
  misc_feature (1)..( 10): Result.001 file - promoters70/4911485
taaaaatttt

SEQ ID NO: 87659 - DNA, 10 bp, Unknown
  misc_feature (1)..( 10): Result.001 file - promoters70/4911485
gataaatttg

SEQ ID NO: 87660 - DNA, 11 bp, Unknown
  misc_feature (1)..( 11): Result.001 file - promoters70/4911485
acctaagttta

SEQ ID NO: 87661 - DNA, 11 bp, Unknown
  misc_feature (1)..( 11): Result.001 file - promoters70/4911485
agacaaataga

SEQ ID NO: 87662 - DNA, 10 bp, Unknown
  misc_feature (1)..( 10): Result.001 file - promoters70/4911485
tgtctgttag

SEQ ID NO: 87663 - DNA, 10 bp, Unknown
  misc_feature (1)..( 10): Result.001 file - promoters70/4911485
tctttgttag

SEQ ID NO: 87664 - DNA, 10 bp, Unknown
  misc_feature (1)..( 10): Result.001 file - promoters70/4911485
ttattgttac

SEQ ID NO: 87665 - DNA, 10 bp, Unknown
  misc_feature (1)..( 10): Result.001 file - promoters70/4911485
aaatttttac

SEQ ID NO: 87666 - DNA, 10 bp, Unknown
  misc_feature (1)..( 10): Result.001 file - promoters70/4911485
atattcttaa

SEQ ID NO: 87667 - DNA, 10 bp, Unknown
  misc_feature (1)..( 10): Result.001 file - promoters70/4911485
ttatggtttg

SEQ ID NO: 87668 - DNA, 11 bp, Unknown
  misc_feature (1)..( 11): Result.001 file - promoters70/4911485
attattattag

SEQ ID NO: 87669 - DNA, 11 bp, Unknown
  misc_feature (1)..( 11): Result.001 file - promoters70/4911485
acttttattat

SEQ ID NO: 87670 - DNA, 11 bp, Unknown
  misc_feature (1)..( 11): Result.001 file - promoters70/4911485
caaatttttac

SEQ ID NO: 87671 - DNA, 11 bp, Unknown
  misc_feature (1)..( 11): Result.001 file - promoters70/4911485
aaaatttaaat

SEQ ID NO: 87672 - DNA, 11 bp, Unknown
  misc_feature (1)..( 11): Result.001 file - promoters70/4911485
ttttgtattat

SEQ ID NO: 87673 - DNA, 11 bp, Unknown
  misc_feature (1)..( 11): Result.001 file - promoters70/4911485
taaattttagt

SEQ ID NO: 87674 - DNA, 17 bp, Unknown
  misc_feature (1)..( 17): Result.001 file - promoters70/4911485
atttacatttgtctgtt

SEQ ID NO: 87675 - DNA, 17 bp, Unknown
  misc_feature (1)..( 17): Result.001 file - promoters70/4911485
ataaaaatttttctgtt

SEQ ID NO: 87676 - DNA, 17 bp, Unknown
  misc_feature (1)..( 17): Result.001 file - promoters70/4911485
tgtataattttatatat

SEQ ID NO: 87677 - DNA, 17 bp, Unknown
  misc_feature (1)..( 17): Result.001 file - promoters70/4911485
agataaatttgtggatt

SEQ ID NO: 87678 - DNA, 17 bp, Unknown
  misc_feature (1)..( 17): Result.001 file - promoters70/4911485
acctaagtttaagttgt

SEQ ID NO: 87679 - DNA, 17 bp, Unknown
  misc_feature (1)..( 17): Result.001 file - promoters70/4911485
agacaaatagaagaaac

SEQ ID NO: 87680 - DNA, 11 bp, Unknown
  misc_feature (1)..( 11): Result.001 file - promoters70/4911485
agtataaatat

SEQ ID NO: 87681 - DNA, 11 bp, Unknown
  misc_feature (1)..( 11): Result.001 file - promoters70/4911485
attatcaatgg

SEQ ID NO: 87682 - DNA, 11 bp, Unknown
  misc_feature (1)..( 11): Result.001 file - promoters70/4911485
gacataaattt

SEQ ID NO: 87683 - DNA, 11 bp, Unknown
  misc_feature (1)..( 11): Result.001 file - promoters70/4911485
agtttaagttg

SEQ ID NO: 87684 - DNA, 11 bp, Unknown
  misc_feature (1)..( 11): Result.001 file - promoters70/4911485
cttttaacaaa

SEQ ID NO: 87685 - DNA, 11 bp, Unknown
  misc_feature (1)..( 11): Result.001 file - promoters70/4911485
tagataaattt

SEQ ID NO: 87686 - DNA, 10 bp, Unknown
  misc_feature (1)..( 10): Result.001 file - promoters70/4911485
attcataata

SEQ ID NO: 87687 - DNA, 10 bp, Unknown
  misc_feature (1)..( 10): Result.001 file - promoters70/4911485
tatcataaag

SEQ ID NO: 87688 - DNA, 10 bp, Unknown
  misc_feature (1)..( 10): Result.001 file - promoters70/4911485
cattatatat

SEQ ID NO: 87689 - DNA, 10 bp, Unknown
  misc_feature (1)..( 10): Result.001 file - promoters70/4911485
tttcaaaaat

SEQ ID NO: 87690 - DNA, 10 bp, Unknown
  misc_feature (1)..( 10): Result.001 file - promoters70/4911485
atgtaaaaat

SEQ ID NO: 87691 - DNA, 10 bp, Unknown
  misc_feature (1)..( 10): Result.001 file - promoters70/4911485
tatcaataat

SEQ ID NO: 87692 - DNA, 13 bp, Unknown
  misc_feature (1)..( 13): Result.001 file - promoters70/4911485
agaaaataaatag

SEQ ID NO: 87693 - DNA, 13 bp, Unknown
  misc_feature (1)..( 13): Result.001 file - promoters70/4911485
acattatatataa

SEQ ID NO: 87694 - DNA, 13 bp, Unknown
  misc_feature (1)..( 13): Result.001 file - promoters70/4911485
aagaaacaaagta

SEQ ID NO: 87695 - DNA, 13 bp, Unknown
  misc_feature (1)..( 13): Result.001 file - promoters70/4911485
attttatatatgt

SEQ ID NO: 87696 - DNA, 13 bp, Unknown
  misc_feature (1)..( 13): Result.001 file - promoters70/4911485
tttagataaattt

SEQ ID NO: 87697 - DNA, 13 bp, Unknown
  misc_feature (1)..( 13): Result.001 file - promoters70/4911485
tctcaagaagcaa

SEQ ID NO: 87698 - DNA, 13 bp, Unknown
  misc_feature (1)..( 13): Result.001 file - promoters70/4911492
gagacctaagttt

SEQ ID NO: 87699 - DNA, 10 bp, Unknown
  misc_feature (1)..( 10): Result.001 file - promoters70/4911492
aataaactta

SEQ ID NO: 87700 - DNA, 10 bp, Unknown
  misc_feature (1)..( 10): Result.001 file - promoters70/4911492
aataaaatta

SEQ ID NO: 87701 - DNA, 10 bp, Unknown
  misc_feature (1)..( 10): Result.001 file - promoters70/4911492
taaaaacttt

SEQ ID NO: 87702 - DNA, 8 bp, Unknown
  misc_feature (1)..( 8): Result.001 file - promoters70/4911492
aagaaata

SEQ ID NO: 87703 - DNA, 8 bp, Unknown
  misc_feature (1)..( 8): Result.001 file - promoters70/4911492
aagaaaag

SEQ ID NO: 87704 - DNA, 8 bp, Unknown
  misc_feature (1)..( 8): Result.001 file - promoters70/4911492
aagaaata

SEQ ID NO: 87705 - DNA, 9 bp, Unknown
  misc_feature (1)..( 9): Result.001 file - promoters70/4911492
tatatatat

SEQ ID NO: 87706 - DNA, 9 bp, Unknown
  misc_feature (1)..( 9): Result.001 file - promoters70/4911492
tataaatat

SEQ ID NO: 87707 - DNA, 9 bp, Unknown
  misc_feature (1)..( 9): Result.001 file - promoters70/4911492
tatatattc

SEQ ID NO: 87708 - DNA, 9 bp, Unknown
  misc_feature (1)..( 9): Result.001 file - promoters70/4911492
taaccaaaa

SEQ ID NO: 87709 - DNA, 9 bp, Unknown
  misc_feature (1)..( 9): Result.001 file - promoters70/4911492
taaccaaaa

SEQ ID NO: 87710 - DNA, 9 bp, Unknown
  misc_feature (1)..( 9): Result.001 file - promoters70/4911492
aaactaaac

SEQ ID NO: 87711 - DNA, 12 bp, Unknown
  misc_feature (1)..( 12): Result.001 file - promoters70/4911492
aaaataaaataa

SEQ ID NO: 87712 - DNA, 12 bp, Unknown
  misc_feature (1)..( 12): Result.001 file - promoters70/4911492
aaaataatagta

SEQ ID NO: 87713 - DNA, 12 bp, Unknown
  misc_feature (1)..( 12): Result.001 file - promoters70/4911492
aaaataaactaa

SEQ ID NO: 87714 - DNA, 8 bp, Unknown
  misc_feature (1)..( 8): Result.001 file - promoters70/4911492
aatagata

SEQ ID NO: 87715 - DNA, 8 bp, Unknown
  misc_feature (1)..( 8): Result.001 file - promoters70/4911492
aataaata

SEQ ID NO: 87716 - DNA, 8 bp, Unknown
  misc_feature (1)..( 8): Result.001 file - promoters70/4911492
aataaaat

SEQ ID NO: 87717 - DNA, 10 bp, Unknown
  misc_feature (1)..( 10): Result.001 file - promoters70/4911492
tggaaagttt

SEQ ID NO: 87718 - DNA, 10 bp, Unknown
  misc_feature (1)..( 10): Result.001 file - promoters70/4911492
taataagttt

SEQ ID NO: 87719 - DNA, 10 bp, Unknown
  misc_feature (1)..( 10): Result.001 file - promoters70/4914438
tggaaacttt

SEQ ID NO: 87720 - DNA, 8 bp, Unknown
  misc_feature (1)..( 8): Result.001 file - promoters70/4914438
tttaccag

SEQ ID NO: 87721 - DNA, 8 bp, Unknown
  misc_feature (1)..( 8): Result.001 file - promoters70/4914438
tttgccag

SEQ ID NO: 87722 - DNA, 8 bp, Unknown
  misc_feature (1)..( 8): Result.001 file - promoters70/4914438
tttgtacg

SEQ ID NO: 87723 - DNA, 10 bp, Unknown
  misc_feature (1)..( 10): Result.001 file - promoters70/4914438
ggaaaaaaat

SEQ ID NO: 87724 - DNA, 10 bp, Unknown
  misc_feature (1)..( 10): Result.001 file - promoters70/4914438
tataaaaaat

SEQ ID NO: 87725 - DNA, 10 bp, Unknown
  misc_feature (1)..( 10): Result.001 file - promoters70/4914438
tatacaaaag

SEQ ID NO: 87726 - DNA, 7 bp, Unknown
  misc_feature (1)..( 7): Result.001 file - promoters70/4914438
cataaaa

SEQ ID NO: 87727 - DNA, 7 bp, Unknown
  misc_feature (1)..( 7): Result.001 file - promoters70/4914438
tataaaa

SEQ ID NO: 87728 - DNA, 7 bp, Unknown
  misc_feature (1)..( 7): Result.001 file - promoters70/4915384
tatcaaa

SEQ ID NO: 87729 - DNA, 10 bp, Unknown
  misc_feature (1)..( 10): Result.001 file - promoters70/4915384
ggtttatttt

SEQ ID NO: 87730 - DNA, 10 bp, Unknown
  misc_feature (1)..( 10): Result.001 file - promoters70/4915384
ggtttattca

SEQ ID NO: 87731 - DNA, 10 bp, Unknown
  misc_feature (1)..( 10): Result.001 file - promoters70/4915420
attttatttt

SEQ ID NO: 87732 - DNA, 10 bp, Unknown
  misc_feature (1)..( 10): Result.001 file - promoters70/4915420
aagatttttt

SEQ ID NO: 87733 - DNA, 10 bp, Unknown
  misc_feature (1)..( 10): Result.001 file - promoters70/4915420
gagaattttt

SEQ ID NO: 87734 - DNA, 10 bp, Unknown
  misc_feature (1)..( 10): Result.001 file - promoters70/4915420
agtaatattt

SEQ ID NO: 87735 - DNA, 10 bp, Unknown
  misc_feature (1)..( 10): Result.001 file - promoters70/4915420
agtgatatga

SEQ ID NO: 87736 - DNA, 10 bp, Unknown
  misc_feature (1)..( 10): Result.001 file - promoters70/4915420
taatattagt

SEQ ID NO: 87737 - DNA, 10 bp, Unknown
  misc_feature (1)..( 10): Result.001 file - promoters70/4915420
taatattagt

SEQ ID NO: 87738 - DNA, 10 bp, Unknown
  misc_feature (1)..( 10): Result.001 file - promoters70/4915420
tcatatgagt

SEQ ID NO: 87739 - DNA, 10 bp, Unknown
  misc_feature (1)..( 10): Result.001 file - promoters70/4915420
taatatgatt

SEQ ID NO: 87740 - DNA, 9 bp, Unknown
  misc_feature (1)..( 9): Result.001 file - promoters70/4915420
tatatttga

SEQ ID NO: 87741 - DNA, 9 bp, Unknown
  misc_feature (1)..( 9): Result.001 file - promoters70/4915420
tatatatga

SEQ ID NO: 87742 - DNA, 9 bp, Unknown
  misc_feature (1)..( 9): Result.001 file - promoters70/4915420
ttcatatga

SEQ ID NO: 87743 - DNA, 9 bp, Unknown
  misc_feature (1)..( 9): Result.001 file - promoters70/4915420
ctaatatga

SEQ ID NO: 87744 - DNA, 13 bp, Unknown
  misc_feature (1)..( 13): Result.001 file - promoters70/4915420
attctaatttaaa

SEQ ID NO: 87745 - DNA, 13 bp, Unknown
  misc_feature (1)..( 13): Result.001 file - promoters70/4915420
aaaaaaatttaaa

SEQ ID NO: 87746 - DNA, 13 bp, Unknown
  misc_feature (1)..( 13): Result.001 file - promoters70/4915420
aaacaaatttttg

SEQ ID NO: 87747 - DNA, 13 bp, Unknown
  misc_feature (1)..( 13): Result.001 file - promoters70/4915420
gaggaaaacataa

SEQ ID NO: 87748 - DNA, 9 bp, Unknown
  misc_feature (1)..( 9): Result.001 file - promoters70/4915420
tattttaat

SEQ ID NO: 87749 - DNA, 9 bp, Unknown
  misc_feature (1)..( 9): Result.001 file - promoters70/4915420
ggttttaac

SEQ ID NO: 87750 - DNA, 9 bp, Unknown
  misc_feature (1)..( 9): Result.001 file - promoters70/4915420
ggttataaa

SEQ ID NO: 87751 - DNA, 9 bp, Unknown
  misc_feature (1)..( 9): Result.001 file - promoters70/4915420
ctttagaaa

SEQ ID NO: 87752 - DNA, 12 bp, Unknown
  misc_feature (1)..( 12): Result.001 file - promoters70/4915420
agaaatataaat

SEQ ID NO: 87753 - DNA, 12 bp, Unknown
  misc_feature (1)..( 12): Result.001 file - promoters70/4915420
ataaatatcttt

SEQ ID NO: 87754 - DNA, 12 bp, Unknown
  misc_feature (1)..( 12): Result.001 file - promoters70/4915420
agagatataaat

SEQ ID NO: 87755 - DNA, 12 bp, Unknown
  misc_feature (1)..( 12): Result.001 file - promoters70/4915606
gggtatataaat

SEQ ID NO: 87756 - DNA, 15 bp, Unknown
  misc_feature (1)..( 15): Result.001 file - promoters70/4915606
ggaaccgttaattcc

SEQ ID NO: 87757 - DNA, 15 bp, Unknown
  misc_feature (1)..( 15): Result.001 file - promoters70/4915606
aaaaaagtttattga

SEQ ID NO: 87758 - DNA, 13 bp, Unknown
  misc_feature (1)..( 13): Result.001 file - promoters70/4915606
atcagttaatctg

SEQ ID NO: 87759 - DNA, 15 bp, Unknown
  misc_feature (1)..( 15): Result.001 file - promoters70/4915606
atttatccttatttc

SEQ ID NO: 87760 - DNA, 15 bp, Unknown
  misc_feature (1)..( 15): Result.001 file - promoters70/4915606
gaaagagtttaggct

SEQ ID NO: 87761 - DNA, 15 bp, Unknown
  misc_feature (1)..( 15): Result.001 file - promoters70/4915606
gaaagacaaattgat

SEQ ID NO: 87762 - DNA, 17 bp, Unknown
  misc_feature (1)..( 17): Result.001 file - promoters70/4915606
gttaatttttgactttt

SEQ ID NO: 87763 - DNA, 17 bp, Unknown
  misc_feature (1)..( 17): Result.001 file - promoters70/4915606
ttgaatttttttttatt

SEQ ID NO: 87764 - DNA, 17 bp, Unknown
  misc_feature (1)..( 17): Result.001 file - promoters70/4915606
gttaactttgtacttac

SEQ ID NO: 87765 - DNA, 17 bp, Unknown
  misc_feature (1)..( 17): Result.001 file - promoters70/4915606
gtttctttttgtctttt

SEQ ID NO: 87766 - DNA, 17 bp, Unknown
  misc_feature (1)..( 17): Result.001 file - promoters70/4915606
attaattttctcattgc

SEQ ID NO: 87767 - DNA, 17 bp, Unknown
  misc_feature (1)..( 17): Result.001 file - promoters70/4915606
gttgactggttctaacg

SEQ ID NO: 87768 - DNA, 17 bp, Unknown
  misc_feature (1)..( 17): Result.001 file - promoters70/4915606
catgactgtgaaggcca

SEQ ID NO: 87769 - DNA, 10 bp, Unknown
  misc_feature (1)..( 10): Result.001 file - promoters70/4915606
aaaaagttta

SEQ ID NO: 87770 - DNA, 10 bp, Unknown
  misc_feature (1)..( 10): Result.001 file - promoters70/4915606
ataaattttg

SEQ ID NO: 87771 - DNA, 11 bp, Unknown
  misc_feature (1)..( 11): Result.001 file - promoters70/4915606
gaaagagttta

SEQ ID NO: 87772 - DNA, 11 bp, Unknown
  misc_feature (1)..( 11): Result.001 file - promoters70/4915606
tcaaaatttat

SEQ ID NO: 87773 - DNA, 11 bp, Unknown
  misc_feature (1)..( 11): Result.001 file - promoters70/4915606
gaaagacaaat

SEQ ID NO: 87774 - DNA, 11 bp, Unknown
  misc_feature (1)..( 11): Result.001 file - promoters70/4921433
ctaatatatat

SEQ ID NO: 87775 - DNA, 9 bp, Unknown
  misc_feature (1)..( 9): Result.001 file - promoters70/4921433
cgaatggag

SEQ ID NO: 87776 - DNA, 9 bp, Unknown
  misc_feature (1)..( 9): Result.001 file - promoters70/4921433
cgagtggct

SEQ ID NO: 87777 - DNA, 9 bp, Unknown
  misc_feature (1)..( 9): Result.001 file - promoters70/4921433
agaggggct

SEQ ID NO: 87778 - DNA, 12 bp, Unknown
  misc_feature (1)..( 12): Result.001 file - promoters70/4921433
atggagaggaag

SEQ ID NO: 87779 - DNA, 12 bp, Unknown
  misc_feature (1)..( 12): Result.001 file - promoters70/4921433
gcacagatgaat

SEQ ID NO: 87780 - DNA, 12 bp, Unknown
  misc_feature (1)..( 12): Result.001 file - promoters70/4921433
atgtagaggggc

SEQ ID NO: 87781 - DNA, 12 bp, Unknown
  misc_feature (1)..( 12): Result.001 file - promoters70/4934904
gaagtcatgaat

SEQ ID NO: 87782 - DNA, 13 bp, Unknown
  misc_feature (1)..( 13): Result.001 file - promoters70/4934904
tctggggaatcgg

SEQ ID NO: 87783 - DNA, 13 bp, Unknown
  misc_feature (1)..( 13): Result.001 file - promoters70/4934904
tctgggaaatcgg

SEQ ID NO: 87784 - DNA, 13 bp, Unknown
  misc_feature (1)..( 13): Result.001 file - promoters70/4934904
atgcggaaattaa

SEQ ID NO: 87785 - DNA, 6 bp, Unknown
  misc_feature (1)..( 6): Result.001 file - promoters70/4934904
tttcaa

SEQ ID NO: 87786 - DNA, 6 bp, Unknown
  misc_feature (1)..( 6): Result.001 file - promoters70/4934904
tttcaa

SEQ ID NO: 87787 - DNA, 6 bp, Unknown
  misc_feature (1)..( 6): Result.001 file - promoters70/4934904
tttcaa

SEQ ID NO: 87788 - DNA, 6 bp, Unknown
  misc_feature (1)..( 6): Result.001 file - promoters70/4934904
ggaaat

SEQ ID NO: 87789 - DNA, 6 bp, Unknown
  misc_feature (1)..( 6): Result.001 file - promoters70/4934904
ggaaat

SEQ ID NO: 87790 - DNA, 6 bp, Unknown
  misc_feature (1)..( 6): Result.001 file - promoters70/4949707
ggaaat

SEQ ID NO: 87791 - DNA, 10 bp, Unknown
  misc_feature (1)..( 10): Result.001 file - promoters70/4949707
aaataattga

SEQ ID NO: 87792 - DNA, 10 bp, Unknown
  misc_feature (1)..( 10): Result.001 file - promoters70/4949707
aaaaaatggt

SEQ ID NO: 87793 - DNA, 10 bp, Unknown
  misc_feature (1)..( 10): Result.001 file - promoters70/4949707
aaataaatga

SEQ ID NO: 87794 - DNA, 7 bp, Unknown
  misc_feature (1)..( 7): Result.001 file - promoters70/4949707
atatttt

SEQ ID NO: 87795 - DNA, 7 bp, Unknown
  misc_feature (1)..( 7): Result.001 file - promoters70/4949707
atattta

SEQ ID NO: 87796 - DNA, 7 bp, Unknown
  misc_feature (1)..( 7): Result.001 file - promoters70/4978201
ataatta

SEQ ID NO: 87797 - DNA, 11 bp, Unknown
  misc_feature (1)..( 11): Result.001 file - promoters70/4978201
catatatactt

SEQ ID NO: 87798 - DNA, 11 bp, Unknown
  misc_feature (1)..( 11): Result.001 file - promoters70/4978201
tttatatagat

SEQ ID NO: 87799 - DNA, 11 bp, Unknown
  misc_feature (1)..( 11): Result.001 file - promoters70/4978201
tatatattaaa

SEQ ID NO: 87800 - DNA, 11 bp, Unknown
  misc_feature (1)..( 11): Result.001 file - promoters70/4978201
cttatttatga

SEQ ID NO: 87801 - DNA, 11 bp, Unknown
  misc_feature (1)..( 11): Result.001 file - promoters70/4978201
actataaattc

SEQ ID NO: 87802 - DNA, 11 bp, Unknown
  misc_feature (1)..( 11): Result.001 file - promoters70/4992383
actataaattc

SEQ ID NO: 87803 - DNA, 10 bp, Unknown
  misc_feature (1)..( 10): Result.001 file - promoters70/4992383
tttcgatgta

SEQ ID NO: 87804 - DNA, 10 bp, Unknown
  misc_feature (1)..( 10): Result.001 file - promoters70/4992383
ttttgatttg

SEQ ID NO: 87805 - DNA, 10 bp, Unknown
  misc_feature (1)..( 10): Result.001 file - promoters70/4992383
ctttgctttg

SEQ ID NO: 87806 - DNA, 12 bp, Unknown
  misc_feature (1)..( 12): Result.001 file - promoters70/4992383
ttattttcagta

SEQ ID NO: 87807 - DNA, 12 bp, Unknown
  misc_feature (1)..( 12): Result.001 file - promoters70/4992383
aacttttaagta

SEQ ID NO: 87808 - DNA, 12 bp, Unknown
  misc_feature (1)..( 12): Result.001 file - promoters70/5662743
aacctttatgta

SEQ ID NO: 87809 - DNA, 7 bp, Unknown
  misc_feature (1)..( 7): Result.001 file - promoters70/5662743
attagat

SEQ ID NO: 87810 - DNA, 7 bp, Unknown
  misc_feature (1)..( 7): Result.001 file - promoters70/5662743
atttgat

SEQ ID NO: 87811 - DNA, 7 bp, Unknown
  misc_feature (1)..( 7): Result.001 file - promoters70/5662799
atttgag

SEQ ID NO: 87812 - DNA, 10 bp, Unknown
  misc_feature (1)..( 10): Result.001 file - promoters70/5662799
aggcccaatt

SEQ ID NO: 87813 - DNA, 10 bp, Unknown
  misc_feature (1)..( 10): Result.001 file - promoters70/5662799
aggcccatga

SEQ ID NO: 87814 - DNA, 10 bp, Unknown
  misc_feature (1)..( 10): Result.001 file - promoters70/5662799
aggcccaatt

SEQ ID NO: 87815 - DNA, 8 bp, Unknown
  misc_feature (1)..( 8): Result.001 file - promoters70/5662799
aattggat

SEQ ID NO: 87816 - DNA, 8 bp, Unknown
  misc_feature (1)..( 8): Result.001 file - promoters70/5662799
catttgat

SEQ ID NO: 87817 - DNA, 8 bp, Unknown
  misc_feature (1)..( 8): Result.001 file - promoters70/5662799
aatttgat

SEQ ID NO: 87818 - DNA, 8 bp, Unknown
  misc_feature (1)..( 8): Result.001 file - promoters70/5662799
gttgtcca

SEQ ID NO: 87819 - DNA, 8 bp, Unknown
  misc_feature (1)..( 8): Result.001 file - promoters70/5662799
tttgacca

SEQ ID NO: 87820 - DNA, 8 bp, Unknown
  misc_feature (1)..( 8): Result.001 file - promoters70/5662893
tttgacta

SEQ ID NO: 87821 - DNA, 13 bp, Unknown
  misc_feature (1)..( 13): Result.001 file - promoters70/5662893
accaagaccaatt

SEQ ID NO: 87822 - DNA, 13 bp, Unknown
  misc_feature (1)..( 13): Result.001 file - promoters70/5662893
tacaaaaccctaa

SEQ ID NO: 87823 - DNA, 13 bp, Unknown
  misc_feature (1)..( 13): Result.001 file - promoters70/5662893
accaagacgtaca

SEQ ID NO: 87824 - DNA, 13 bp, Unknown
  misc_feature (1)..( 13): Result.001 file - promoters70/5662893
gaagaaacaaagt

SEQ ID NO: 87825 - DNA, 13 bp, Unknown
  misc_feature (1)..( 13): Result.001 file - promoters70/5662893
tgacaaaccaatg

SEQ ID NO: 87826 - DNA, 13 bp, Unknown
  misc_feature (1)..( 13): Result.001 file - promoters70/5662893
tggcagaaaaaaa

SEQ ID NO: 87827 - DNA, 13 bp, Unknown
  misc_feature (1)..( 13): Result.001 file - promoters70/5662893
aaaaaaatcaaat

SEQ ID NO: 87828 - DNA, 11 bp, Unknown
  misc_feature (1)..( 11): Result.001 file - promoters70/5662893
cctaggctaga

SEQ ID NO: 87829 - DNA, 11 bp, Unknown
  misc_feature (1)..( 11): Result.001 file - promoters70/5662893
ccttggcaaac

SEQ ID NO: 87830 - DNA, 11 bp, Unknown
  misc_feature (1)..( 11): Result.001 file - promoters70/5662893
gtttgacaaac

SEQ ID NO: 87831 - DNA, 11 bp, Unknown
  misc_feature (1)..( 11): Result.001 file - promoters70/5662893
agttggcagaa

SEQ ID NO: 87832 - DNA, 11 bp, Unknown
  misc_feature (1)..( 11): Result.001 file - promoters70/5662893
aagagacaaat

SEQ ID NO: 87833 - DNA, 11 bp, Unknown
  misc_feature (1)..( 11): Result.001 file - promoters70/5662893
ttgtgacaaaa

SEQ ID NO: 87834 - DNA, 11 bp, Unknown
  misc_feature (1)..( 11): Result.001 file - promoters70/5662893
ctagatacaaa

SEQ ID NO: 87835 - DNA, 11 bp, Unknown
  misc_feature (1)..( 11): Result.001 file - promoters70/5662893
ctatataaaac

SEQ ID NO: 87836 - DNA, 11 bp, Unknown
  misc_feature (1)..( 11): Result.001 file - promoters70/5662893
caagagacaaa

SEQ ID NO: 87837 - DNA, 11 bp, Unknown
  misc_feature (1)..( 11): Result.001 file - promoters70/5662893
tgtttgacaaa

SEQ ID NO: 87838 - DNA, 11 bp, Unknown
  misc_feature (1)..( 11): Result.001 file - promoters70/5662893
tggcagaaaaa

SEQ ID NO: 87839 - DNA, 11 bp, Unknown
  misc_feature (1)..( 11): Result.001 file - promoters70/5662902
cttgtgacaaa

SEQ ID NO: 87840 - DNA, 11 bp, Unknown
  misc_feature (1)..( 11): Result.001 file - promoters70/5662902
taagaaaatgt

SEQ ID NO: 87841 - DNA, 11 bp, Unknown
  misc_feature (1)..( 11): Result.001 file - promoters70/5662902
gaagataataa

SEQ ID NO: 87842 - DNA, 11 bp, Unknown
  misc_feature (1)..( 11): Result.001 file - promoters70/5662902
gaagatggacg

SEQ ID NO: 87843 - DNA, 11 bp, Unknown
  misc_feature (1)..( 11): Result.001 file - promoters70/5662902
ttagatggatt

SEQ ID NO: 87844 - DNA, 11 bp, Unknown
  misc_feature (1)..( 11): Result.001 file - promoters70/5662914
tttgatactaa

SEQ ID NO: 87845 - DNA, 10 bp, Unknown
  misc_feature (1)..( 10): Result.001 file - promoters70/5662914
ggaaggagag

SEQ ID NO: 87846 - DNA, 10 bp, Unknown
  misc_feature (1)..( 10): Result.001 file - promoters70/5662914
ggaagtagag

SEQ ID NO: 87847 - DNA, 10 bp, Unknown
  misc_feature (1)..( 10): Result.001 file - promoters70/5662914
ggaagtagag

SEQ ID NO: 87848 - DNA, 9 bp, Unknown
  misc_feature (1)..( 9): Result.001 file - promoters70/5662914
gagatgaga

SEQ ID NO: 87849 - DNA, 9 bp, Unknown
  misc_feature (1)..( 9): Result.001 file - promoters70/5662914
aagatgatg

SEQ ID NO: 87850 - DNA, 9 bp, Unknown
  misc_feature (1)..( 9): Result.001 file - promoters70/5662921
aagttgatg

SEQ ID NO: 87851 - DNA, 9 bp, Unknown
  misc_feature (1)..( 9): Result.001 file - promoters70/5662921
taatttcaa

SEQ ID NO: 87852 - DNA, 9 bp, Unknown
  misc_feature (1)..( 9): Result.001 file - promoters70/5662921
aaatttcaa

SEQ ID NO: 87853 - DNA, 9 bp, Unknown
  misc_feature (1)..( 9): Result.001 file - promoters70/5662921
taatttcca

SEQ ID NO: 87854 - DNA, 8 bp, Unknown
  misc_feature (1)..( 8): Result.001 file - promoters70/5662921
caatctta

SEQ ID NO: 87855 - DNA, 8 bp, Unknown
  misc_feature (1)..( 8): Result.001 file - promoters70/5662921
aaatttta

SEQ ID NO: 87856 - DNA, 8 bp, Unknown
  misc_feature (1)..( 8): Result.001 file - promoters70/5662967
aaatttgt

SEQ ID NO: 87857 - DNA, 8 bp, Unknown
  misc_feature (1)..( 8): Result.001 file - promoters70/5662967
tatattat

SEQ ID NO: 87858 - DNA, 8 bp, Unknown
  misc_feature (1)..( 8): Result.001 file - promoters70/5662967
tataatat

SEQ ID NO: 87859 - DNA, 8 bp, Unknown
  misc_feature (1)..( 8): Result.001 file - promoters70/5662977
tatattga

SEQ ID NO: 87860 - DNA, 7 bp, Unknown
  misc_feature (1)..( 7): Result.001 file - promoters70/5662977
gttcctt

SEQ ID NO: 87861 - DNA, 7 bp, Unknown
  misc_feature (1)..( 7): Result.001 file - promoters70/5662977
gtttctt

SEQ ID NO: 87862 - DNA, 7 bp, Unknown
  misc_feature (1)..( 7): Result.001 file - promoters70/5662977
gttcctc

SEQ ID NO: 87863 - DNA, 8 bp, Unknown
  misc_feature (1)..( 8): Result.001 file - promoters70/5662977
aaatgtta

SEQ ID NO: 87864 - DNA, 8 bp, Unknown
  misc_feature (1)..( 8): Result.001 file - promoters70/5662977
aaaagttt

SEQ ID NO: 87865 - DNA, 8 bp, Unknown
  misc_feature (1)..( 8): Result.001 file - promoters70/5662977
caatttta

SEQ ID NO: 87866 - DNA, 7 bp, Unknown
  misc_feature (1)..( 7): Result.001 file - promoters70/5662977
gttgatt

SEQ ID NO: 87867 - DNA, 7 bp, Unknown
  misc_feature (1)..( 7): Result.001 file - promoters70/5662977
gttgatg

SEQ ID NO: 87868 - DNA, 7 bp, Unknown
  misc_feature (1)..( 7): Result.001 file - promoters70/5662977
gttaatt

SEQ ID NO: 87869 - DNA, 8 bp, Unknown
  misc_feature (1)..( 8): Result.001 file - promoters70/5662977
cgacatgt

SEQ ID NO: 87870 - DNA, 8 bp, Unknown
  misc_feature (1)..( 8): Result.001 file - promoters70/5662977
cgacatta

SEQ ID NO: 87871 - DNA, 8 bp, Unknown
  misc_feature (1)..( 8): Result.001 file - promoters70/5662977
cgacatgt

SEQ ID NO: 87872 - DNA, 8 bp, Unknown
  misc_feature (1)..( 8): Result.001 file - promoters70/5662977
acacatgt

SEQ ID NO: 87873 - DNA, 6 bp, Unknown
  misc_feature (1)..( 6): Result.001 file - promoters70/5662977
acatgt

SEQ ID NO: 87874 - DNA, 6 bp, Unknown
  misc_feature (1)..( 6): Result.001 file - promoters70/5662977
acatgt

SEQ ID NO: 87875 - DNA, 6 bp, Unknown
  misc_feature (1)..( 6): Result.001 file - promoters70/5663003
acatgt

SEQ ID NO: 87876 - DNA, 13 bp, Unknown
  misc_feature (1)..( 13): Result.001 file - promoters70/5663003
ctaaaatagtaaa

SEQ ID NO: 87877 - DNA, 13 bp, Unknown
  misc_feature (1)..( 13): Result.001 file - promoters70/5663003
aaataattgtata

SEQ ID NO: 87878 - DNA, 13 bp, Unknown
  misc_feature (1)..( 13): Result.001 file - promoters70/5663003
tcatatttgtata

SEQ ID NO: 87879 - DNA, 13 bp, Unknown
  misc_feature (1)..( 13): Result.001 file - promoters70/5663003
aaagaattgaaca

SEQ ID NO: 87880 - DNA, 10 bp, Unknown
  misc_feature (1)..( 10): Result.001 file - promoters70/5663003
gaaaaagata

SEQ ID NO: 87881 - DNA, 10 bp, Unknown
  misc_feature (1)..( 10): Result.001 file - promoters70/5663003
gaaatagatt

SEQ ID NO: 87882 - DNA, 10 bp, Unknown
  misc_feature (1)..( 10): Result.001 file - promoters70/5663003
ttagtagatt

SEQ ID NO: 87883 - DNA, 10 bp, Unknown
  misc_feature (1)..( 10): Result.001 file - promoters70/5663003
tatataaatt

SEQ ID NO: 87884 - DNA, 10 bp, Unknown
  misc_feature (1)..( 10): Result.001 file - promoters70/5663003
ttactaaaat

SEQ ID NO: 87885 - DNA, 10 bp, Unknown
  misc_feature (1)..( 10): Result.001 file - promoters70/5663003
ttattaattt

SEQ ID NO: 87886 - DNA, 11 bp, Unknown
  misc_feature (1)..( 11): Result.001 file - promoters70/5663003
gaactgaaaga

SEQ ID NO: 87887 - DNA, 11 bp, Unknown
  misc_feature (1)..( 11): Result.001 file - promoters70/5663116
ttgtataaatt

SEQ ID NO: 87888 - DNA, 16 bp, Unknown
  misc_feature (1)..( 16): Result.001 file - promoters70/5663116
cattagtttcctggaa

SEQ ID NO: 87889 - DNA, 16 bp, Unknown
  misc_feature (1)..( 16): Result.001 file - promoters70/5663116
cccaagtgtcctatgt

SEQ ID NO: 87890 - DNA, 16 bp, Unknown
  misc_feature (1)..( 16): Result.001 file - promoters70/5663116
cattcgtttagtcagg

SEQ ID NO: 87891 - DNA, 14 bp, Unknown
  misc_feature (1)..( 14): Result.001 file - promoters70/5663116
ttaatttcctgaac

SEQ ID NO: 87892 - DNA, 16 bp, Unknown
  misc_feature (1)..( 16): Result.001 file - promoters70/5663116
ttttcattttatcaag

SEQ ID NO: 87893 - DNA, 16 bp, Unknown
  misc_feature (1)..( 16): Result.001 file - promoters70/5663116
gatcgatttcaattta

SEQ ID NO: 87894 - DNA, 14 bp, Unknown
  misc_feature (1)..( 14): Result.001 file - promoters70/5663116
attaaatgaatagt

SEQ ID NO: 87895 - DNA, 14 bp, Unknown
  misc_feature (1)..( 14): Result.001 file - promoters70/5663116
aatacatgaattta

SEQ ID NO: 87896 - DNA, 14 bp, Unknown
  misc_feature (1)..( 14): Result.001 file - promoters70/5663116
ctttaattaattaa

SEQ ID NO: 87897 - DNA, 14 bp, Unknown
  misc_feature (1)..( 14): Result.001 file - promoters70/5663116
atttaatcaatcac

SEQ ID NO: 87898 - DNA, 14 bp, Unknown
  misc_feature (1)..( 14): Result.001 file - promoters70/5663116
aactaattatgtgg

SEQ ID NO: 87899 - DNA, 14 bp, Unknown
  misc_feature (1)..( 14): Result.001 file - promoters70/5663116
atgtaatttatttt

SEQ ID NO: 87900 - DNA, 14 bp, Unknown
  misc_feature (1)..( 14): Result.001 file - promoters70/5663116
aaatcatcaatgct

SEQ ID NO: 87901 - DNA, 14 bp, Unknown
  misc_feature (1)..( 14): Result.001 file - promoters70/5663116
cataattttattca

SEQ ID NO: 87902 - DNA, 13 bp, Unknown
  misc_feature (1)..( 13): Result.001 file - promoters70/5663116
acgaaatatcttt

SEQ ID NO: 87903 - DNA, 13 bp, Unknown
  misc_feature (1)..( 13): Result.001 file - promoters70/5663116
acgaaattgtgat

SEQ ID NO: 87904 - DNA, 13 bp, Unknown
  misc_feature (1)..( 13): Result.001 file - promoters70/5663116
acgaaacgattat

SEQ ID NO: 87905 - DNA, 13 bp, Unknown
  misc_feature (1)..( 13): Result.001 file - promoters70/5663116
ttgaagttggaag

SEQ ID NO: 87906 - DNA, 13 bp, Unknown
  misc_feature (1)..( 13): Result.001 file - promoters70/5663116
tcttaattaaagt

SEQ ID NO: 87907 - DNA, 13 bp, Unknown
  misc_feature (1)..( 13): Result.001 file - promoters70/5663116
aaaaagttgtcat

SEQ ID NO: 87908 - DNA, 11 bp, Unknown
  misc_feature (1)..( 11): Result.001 file - promoters70/5663116
attaaatgaat

SEQ ID NO: 87909 - DNA, 11 bp, Unknown
  misc_feature (1)..( 11): Result.001 file - promoters70/5663116
attaaaaatca

SEQ ID NO: 87910 - DNA, 11 bp, Unknown
  misc_feature (1)..( 11): Result.001 file - promoters70/5663116
atttaatcaat

SEQ ID NO: 87911 - DNA, 11 bp, Unknown
  misc_feature (1)..( 11): Result.001 file - promoters70/5663116
atcaatgctac

SEQ ID NO: 87912 - DNA, 11 bp, Unknown
  misc_feature (1)..( 11): Result.001 file - promoters70/5663116
attaaattttg

SEQ ID NO: 87913 - DNA, 11 bp, Unknown
  misc_feature (1)..( 11): Result.001 file - promoters70/5663138
ttttattcagg

SEQ ID NO: 87914 - DNA, 9 bp, Unknown
  misc_feature (1)..( 9): Result.001 file - promoters70/5663138
taataacaa

SEQ ID NO: 87915 - DNA, 9 bp, Unknown
  misc_feature (1)..( 9): Result.001 file - promoters70/5663138
aaatgacag

SEQ ID NO: 87916 - DNA, 9 bp, Unknown
  misc_feature (1)..( 9): Result.001 file - promoters70/5663138
taataatgt

SEQ ID NO: 87917 - DNA, 9 bp, Unknown
  misc_feature (1)..( 9): Result.001 file - promoters70/5663142
gaatcatgt

SEQ ID NO: 87918 - DNA, 13 bp, Unknown
  misc_feature (1)..( 13): Result.001 file - promoters70/5663142
aatgaatattaga

SEQ ID NO: 87919 - DNA, 13 bp, Unknown
  misc_feature (1)..( 13): Result.001 file - promoters70/5663142
aattaatgacgat

SEQ ID NO: 87920 - DNA, 13 bp, Unknown
  misc_feature (1)..( 13): Result.001 file - promoters70/5663142
tctgaatattaga

SEQ ID NO: 87921 - DNA, 8 bp, Unknown
  misc_feature (1)..( 8): Result.001 file - promoters70/5663142
gctaatga

SEQ ID NO: 87922 - DNA, 8 bp, Unknown
  misc_feature (1)..( 8): Result.001 file - promoters70/5663142
attaatga

SEQ ID NO: 87923 - DNA, 8 bp, Unknown
  misc_feature (1)..( 8): Result.001 file - promoters70/5663142
aataatga

SEQ ID NO: 87924 - DNA, 8 bp, Unknown
  misc_feature (1)..( 8): Result.001 file - promoters70/5663142
tattaatt

SEQ ID NO: 87925 - DNA, 8 bp, Unknown
  misc_feature (1)..( 8): Result.001 file - promoters70/5663142
tattaacc

SEQ ID NO: 87926 - DNA, 8 bp, Unknown
  misc_feature (1)..( 8): Result.001 file - promoters70/5663142
tataaatt

SEQ ID NO: 87927 - DNA, 6 bp, Unknown
  misc_feature (1)..( 6): Result.001 file - promoters70/5663142
ataata

SEQ ID NO: 87928 - DNA, 6 bp, Unknown
  misc_feature (1)..( 6): Result.001 file - promoters70/5663142
ataata

SEQ ID NO: 87929 - DNA, 6 bp, Unknown
  misc_feature (1)..( 6): Result.001 file - promoters70/5663142
ataata

SEQ ID NO: 87930 - DNA, 14 bp, Unknown
  misc_feature (1)..( 14): Result.001 file - promoters70/5663142
atatataataaata

SEQ ID NO: 87931 - DNA, 14 bp, Unknown
  misc_feature (1)..( 14): Result.001 file - promoters70/5663142
aagcataaaaaata

SEQ ID NO: 87932 - DNA, 14 bp, Unknown
  misc_feature (1)..( 14): Result.001 file - promoters70/5663142
tcatataattatct

SEQ ID NO: 87933 - DNA, 14 bp, Unknown
  misc_feature (1)..( 14): Result.001 file - promoters70/5663142
tcatataacaattt

SEQ ID NO: 87934 - DNA, 10 bp, Unknown
  misc_feature (1)..( 10): Result.001 file - promoters70/5663142
gtatatatat

SEQ ID NO: 87935 - DNA, 10 bp, Unknown
  misc_feature (1)..( 10): Result.001 file - promoters70/5663142
aaataaatag

SEQ ID NO: 87936 - DNA, 10 bp, Unknown
  misc_feature (1)..( 10): Result.001 file - promoters70/5663142
aaatatataa

SEQ ID NO: 87937 - DNA, 9 bp, Unknown
  misc_feature (1)..( 9): Result.001 file - promoters70/5663142
aaattaata

SEQ ID NO: 87938 - DNA, 9 bp, Unknown
  misc_feature (1)..( 9): Result.001 file - promoters70/5663142
taattaagt

SEQ ID NO: 87939 - DNA, 9 bp, Unknown
  misc_feature (1)..( 9): Result.001 file - promoters70/5663142
aaatcaata

SEQ ID NO: 87940 - DNA, 6 bp, Unknown
  misc_feature (1)..( 6): Result.001 file - promoters70/5663142
aaatat

SEQ ID NO: 87941 - DNA, 6 bp, Unknown
  misc_feature (1)..( 6): Result.001 file - promoters70/5663142
aaatat

SEQ ID NO: 87942 - DNA, 6 bp, Unknown
  misc_feature (1)..( 6): Result.001 file - promoters70/5663142
aaatat

SEQ ID NO: 87943 - DNA, 12 bp, Unknown
  misc_feature (1)..( 12): Result.001 file - promoters70/5663142
agacataataaa

SEQ ID NO: 87944 - DNA, 12 bp, Unknown
  misc_feature (1)..( 12): Result.001 file - promoters70/5663142
atttataataaa

SEQ ID NO: 87945 - DNA, 12 bp, Unknown
  misc_feature (1)..( 12): Result.001 file - promoters70/5663142
agacaaaataaa

SEQ ID NO: 87946 - DNA, 8 bp, Unknown
  misc_feature (1)..( 8): Result.001 file - promoters70/5663142
agtgaaac

SEQ ID NO: 87947 - DNA, 8 bp, Unknown
  misc_feature (1)..( 8): Result.001 file - promoters70/5663142
agtgaaaa

SEQ ID NO: 87948 - DNA, 8 bp, Unknown
  misc_feature (1)..( 8): Result.001 file - promoters70/5663142
tctgaaaa

SEQ ID NO: 87949 - DNA, 8 bp, Unknown
  misc_feature (1)..( 8): Result.001 file - promoters70/5663142
atatataa

SEQ ID NO: 87950 - DNA, 8 bp, Unknown
  misc_feature (1)..( 8): Result.001 file - promoters70/5663142
tcatataa

SEQ ID NO: 87951 - DNA, 8 bp, Unknown
  misc_feature (1)..( 8): Result.001 file - promoters70/5663142
tcatataa

SEQ ID NO: 87952 - DNA, 8 bp, Unknown
  misc_feature (1)..( 8): Result.001 file - promoters70/5663142
caatcttg

SEQ ID NO: 87953 - DNA, 8 bp, Unknown
  misc_feature (1)..( 8): Result.001 file - promoters70/5663142
aaatcttg

SEQ ID NO: 87954 - DNA, 8 bp, Unknown
  misc_feature (1)..( 8): Result.001 file - promoters70/5663151
aaagcttc

SEQ ID NO: 87955 - DNA, 10 bp, Unknown
  misc_feature (1)..( 10): Result.001 file - promoters70/5663151
aagaaatgat

SEQ ID NO: 87956 - DNA, 10 bp, Unknown
  misc_feature (1)..( 10): Result.001 file - promoters70/5663151
tagatatgat

SEQ ID NO: 87957 - DNA, 10 bp, Unknown
  misc_feature (1)..( 10): Result.001 file - promoters70/5663151
aagaaacgaa

SEQ ID NO: 87958 - DNA, 9 bp, Unknown
  misc_feature (1)..( 9): Result.001 file - promoters70/5663151
aaaacgcaa

SEQ ID NO: 87959 - DNA, 9 bp, Unknown
  misc_feature (1)..( 9): Result.001 file - promoters70/5663151
caaacccaa

SEQ ID NO: 87960 - DNA, 9 bp, Unknown
  misc_feature (1)..( 9): Result.001 file - promoters70/5663224
caaacctga

SEQ ID NO: 87961 - DNA, 10 bp, Unknown
  misc_feature (1)..( 10): Result.001 file - promoters70/5663224
cttttaaatt

SEQ ID NO: 87962 - DNA, 10 bp, Unknown
  misc_feature (1)..( 10): Result.001 file - promoters70/5663224
cttgtaatgt

SEQ ID NO: 87963 - DNA, 11 bp, Unknown
  misc_feature (1)..( 11): Result.001 file - promoters70/5663224
gttttgaatta

SEQ ID NO: 87964 - DNA, 7 bp, Unknown
  misc_feature (1)..( 7): Result.001 file - promoters70/5663224
gaattaa

SEQ ID NO: 87965 - DNA, 7 bp, Unknown
  misc_feature (1)..( 7): Result.001 file - promoters70/5663224
gaattat

SEQ ID NO: 87966 - DNA, 7 bp, Unknown
  misc_feature (1)..( 7): Result.001 file - promoters70/5663374
aaattat

SEQ ID NO: 87967 - DNA, 13 bp, Unknown
  misc_feature (1)..( 13): Result.001 file - promoters70/5663374
caataaattaaat

SEQ ID NO: 87968 - DNA, 13 bp, Unknown
  misc_feature (1)..( 13): Result.001 file - promoters70/5663374
aaataaaataaat

SEQ ID NO: 87969 - DNA, 13 bp, Unknown
  misc_feature (1)..( 13): Result.001 file - promoters70/5663374
aaatgaaatatct

SEQ ID NO: 87970 - DNA, 9 bp, Unknown
  misc_feature (1)..( 9): Result.001 file - promoters70/5663374
ttctcacat

SEQ ID NO: 87971 - DNA, 9 bp, Unknown
  misc_feature (1)..( 9): Result.001 file - promoters70/5663374
ttcccacta

SEQ ID NO: 87972 - DNA, 9 bp, Unknown
  misc_feature (1)..( 9): Result.001 file - promoters70/5663625
aacccacta

SEQ ID NO: 87973 - DNA, 9 bp, Unknown
  misc_feature (1)..( 9): Result.001 file - promoters70/5663625
aagtcacta

SEQ ID NO: 87974 - DNA, 9 bp, Unknown
  misc_feature (1)..( 9): Result.001 file - promoters70/5663625
aagtcagta

SEQ ID NO: 87975 - DNA, 9 bp, Unknown
  misc_feature (1)..( 9): Result.001 file - promoters70/5663625
tagttacta

SEQ ID NO: 87976 - DNA, 7 bp, Unknown
  misc_feature (1)..( 7): Result.001 file - promoters70/5663625
aagaaaa

SEQ ID NO: 87977 - DNA, 7 bp, Unknown
  misc_feature (1)..( 7): Result.001 file - promoters70/5663625
aagaaag

SEQ ID NO: 87978 - DNA, 8 bp, Unknown
  misc_feature (1)..( 8): Result.001 file - promoters70/5663625
gagataag

SEQ ID NO: 87979 - DNA, 12 bp, Unknown
  misc_feature (1)..( 12): Result.001 file - promoters70/5663625
ttgtaataatta

SEQ ID NO: 87980 - DNA, 12 bp, Unknown
  misc_feature (1)..( 12): Result.001 file - promoters70/5663625
ttaaaataattc

SEQ ID NO: 87981 - DNA, 12 bp, Unknown
  misc_feature (1)..( 12): Result.001 file - promoters70/5663625
ttgtcatagtta

SEQ ID NO: 87982 - DNA, 12 bp, Unknown
  misc_feature (1)..( 12): Result.001 file - promoters70/5663625
aacaaaaaatta

SEQ ID NO: 87983 - DNA, 9 bp, Unknown
  misc_feature (1)..( 9): Result.001 file - promoters70/5663625
tagtaatat

SEQ ID NO: 87984 - DNA, 9 bp, Unknown
  misc_feature (1)..( 9): Result.001 file - promoters70/5663625
tagtgatat

SEQ ID NO: 87985 - DNA, 9 bp, Unknown
  misc_feature (1)..( 9): Result.001 file - promoters70/5663625
aagtaatat

SEQ ID NO: 87986 - DNA, 9 bp, Unknown
  misc_feature (1)..( 9): Result.001 file - promoters70/5663625
ttgtaaatc

SEQ ID NO: 87987 - DNA, 9 bp, Unknown
  misc_feature (1)..( 9): Result.001 file - promoters70/5663625
ttgaaaatt

SEQ ID NO: 87988 - DNA, 9 bp, Unknown
  misc_feature (1)..( 9): Result.001 file - promoters70/5663625
atgaaaatt

SEQ ID NO: 87989 - DNA, 7 bp, Unknown
  misc_feature (1)..( 7): Result.001 file - promoters70/5663625
tcagtct

SEQ ID NO: 87990 - DNA, 7 bp, Unknown
  misc_feature (1)..( 7): Result.001 file - promoters70/5663625
tcagtct

SEQ ID NO: 87991 - DNA, 7 bp, Unknown
  misc_feature (1)..( 7): Result.001 file - promoters70/5663625
tcactct

SEQ ID NO: 87992 - DNA, 7 bp, Unknown
  misc_feature (1)..( 7): Result.001 file - promoters70/5663625
gtatgat

SEQ ID NO: 87993 - DNA, 7 bp, Unknown
  misc_feature (1)..( 7): Result.001 file - promoters70/5663625
atatgat

SEQ ID NO: 87994 - DNA, 7 bp, Unknown
  misc_feature (1)..( 7): Result.001 file - promoters70/5663625
atatgag

SEQ ID NO: 87995 - DNA, 8 bp, Unknown
  misc_feature (1)..( 8): Result.001 file - promoters70/5663625
atattagt

SEQ ID NO: 87996 - DNA, 8 bp, Unknown
  misc_feature (1)..( 8): Result.001 file - promoters70/5663625
atatgagt

SEQ ID NO: 87997 - DNA, 8 bp, Unknown
  misc_feature (1)..( 8): Result.001 file - promoters70/5663625
atatgatt

SEQ ID NO: 87998 - DNA, 7 bp, Unknown
  misc_feature (1)..( 7): Result.001 file - promoters70/5663625
taattta

SEQ ID NO: 87999 - DNA, 7 bp, Unknown
  misc_feature (1)..( 7): Result.001 file - promoters70/5663625
aaattta

SEQ ID NO: 88000 - DNA, 7 bp, Unknown
  misc_feature (1)..( 7): Result.001 file - promoters70/5663805
aaaatta

SEQ ID NO: 88001 - DNA, 9 bp, Unknown
  misc_feature (1)..( 9): Result.001 file - promoters70/5663805
aaactatac

SEQ ID NO: 88002 - DNA, 9 bp, Unknown
  misc_feature (1)..( 9): Result.001 file - promoters70/5663805
ttactttac

SEQ ID NO: 88003 - DNA, 9 bp, Unknown
  misc_feature (1)..( 9): Result.001 file - promoters70/5663805
ttaattttt

SEQ ID NO: 88004 - DNA, 9 bp, Unknown
  misc_feature (1)..( 9): Result.001 file - promoters70/5663805
atataataa

SEQ ID NO: 88005 - DNA, 9 bp, Unknown
  misc_feature (1)..( 9): Result.001 file - promoters70/5663805
ttattatac

SEQ ID NO: 88006 - DNA, 9 bp, Unknown
  misc_feature (1)..( 9): Result.001 file - promoters70/5663805
atataatta

SEQ ID NO: 88007 - DNA, 9 bp, Unknown
  misc_feature (1)..( 9): Result.001 file - promoters70/5663805
gtttaataa

SEQ ID NO: 88008 - DNA, 8 bp, Unknown
  misc_feature (1)..( 8): Result.001 file - promoters70/5663805
atcaaaag

SEQ ID NO: 88009 - DNA, 8 bp, Unknown
  misc_feature (1)..( 8): Result.001 file - promoters70/5663805
atccaaac

SEQ ID NO: 88010 - DNA, 8 bp, Unknown
  misc_feature (1)..( 8): Result.001 file - promoters70/5663805
atcctaac

SEQ ID NO: 88011 - DNA, 7 bp, Unknown
  misc_feature (1)..( 7): Result.001 file - promoters70/5663805
gtaagaa

SEQ ID NO: 88012 - DNA, 7 bp, Unknown
  misc_feature (1)..( 7): Result.001 file - promoters70/5663805
gtaagaa

SEQ ID NO: 88013 - DNA, 7 bp, Unknown
  misc_feature (1)..( 7): Result.001 file - promoters70/5663805
ataagaa

SEQ ID NO: 88014 - DNA, 10 bp, Unknown
  misc_feature (1)..( 10): Result.001 file - promoters70/5663805
ctttgttggt

SEQ ID NO: 88015 - DNA, 10 bp, Unknown
  misc_feature (1)..( 10): Result.001 file - promoters70/5663805
ttttattgat

SEQ ID NO: 88016 - DNA, 10 bp, Unknown
  misc_feature (1)..( 10): Result.001 file - promoters70/5663805
cgttactgat

SEQ ID NO: 88017 - DNA, 10 bp, Unknown
  misc_feature (1)..( 10): Result.001 file - promoters70/5663805
ttttatcgag

SEQ ID NO: 88018 - DNA, 8 bp, Unknown
  misc_feature (1)..( 8): Result.001 file - promoters70/5663805
ataataaa

SEQ ID NO: 88019 - DNA, 8 bp, Unknown
  misc_feature (1)..( 8): Result.001 file - promoters70/5663805
ataataaa

SEQ ID NO: 88020 - DNA, 8 bp, Unknown
  misc_feature (1)..( 8): Result.001 file - promoters70/5663805
acaataaa

SEQ ID NO: 88021 - DNA, 9 bp, Unknown
  misc_feature (1)..( 9): Result.001 file - promoters70/5663805
aatatatat

SEQ ID NO: 88022 - DNA, 9 bp, Unknown
  misc_feature (1)..( 9): Result.001 file - promoters70/5663805
aatttattt

SEQ ID NO: 88023 - DNA, 9 bp, Unknown
  misc_feature (1)..( 9): Result.001 file - promoters70/5663805
gctttgttt

SEQ ID NO: 88024 - DNA, 13 bp, Unknown
  misc_feature (1)..( 13): Result.001 file - promoters70/5663805
actcataataaat

SEQ ID NO: 88025 - DNA, 13 bp, Unknown
  misc_feature (1)..( 13): Result.001 file - promoters70/5663805
atttataatataa

SEQ ID NO: 88026 - DNA, 13 bp, Unknown
  misc_feature (1)..( 13): Result.001 file - promoters70/5663805
acttataatgaat

SEQ ID NO: 88027 - DNA, 11 bp, Unknown
  misc_feature (1)..( 11): Result.001 file - promoters70/5663805
aactagacacg

SEQ ID NO: 88028 - DNA, 11 bp, Unknown
  misc_feature (1)..( 11): Result.001 file - promoters70/5663805
aaaaagagacg

SEQ ID NO: 88029 - DNA, 11 bp, Unknown
  misc_feature (1)..( 11): Result.001 file - promoters70/5663805
aaaaagaatac

SEQ ID NO: 88030 - DNA, 7 bp, Unknown
  misc_feature (1)..( 7): Result.001 file - promoters70/5663805
taataaa

SEQ ID NO: 88031 - DNA, 7 bp, Unknown
  misc_feature (1)..( 7): Result.001 file - promoters70/5663805
gaataaa

SEQ ID NO: 88032 - DNA, 7 bp, Unknown
  misc_feature (1)..( 7): Result.001 file - promoters70/5663805
atataaa

SEQ ID NO: 88033 - DNA, 8 bp, Unknown
  misc_feature (1)..( 8): Result.001 file - promoters70/5663805
aatatgag

SEQ ID NO: 88034 - DNA, 8 bp, Unknown
  misc_feature (1)..( 8): Result.001 file - promoters70/5663805
aatttgaa

SEQ ID NO: 88035 - DNA, 8 bp, Unknown
  misc_feature (1)..( 8): Result.001 file - promoters70/5663805
aatatgaa

SEQ ID NO: 88036 - DNA, 8 bp, Unknown
  misc_feature (1)..( 8): Result.001 file - promoters70/5663805
tttaaaac

SEQ ID NO: 88037 - DNA, 8 bp, Unknown
  misc_feature (1)..( 8): Result.001 file - promoters70/5663805
tttcaaat

SEQ ID NO: 88038 - DNA, 8 bp, Unknown
  misc_feature (1)..( 8): Result.001 file - promoters70/5663805
tttgaaat

SEQ ID NO: 88039 - DNA, 8 bp, Unknown
  misc_feature (1)..( 8): Result.001 file - promoters70/5663805
tttatttc

SEQ ID NO: 88040 - DNA, 8 bp, Unknown
  misc_feature (1)..( 8): Result.001 file - promoters70/5663805
tttctttg

SEQ ID NO: 88041 - DNA, 8 bp, Unknown
  misc_feature (1)..( 8): Result.001 file - promoters70/5663862
tttagttc

SEQ ID NO: 88042 - DNA, 8 bp, Unknown
  misc_feature (1)..( 8): Result.001 file - promoters70/5663862
tgtgattt

SEQ ID NO: 88043 - DNA, 8 bp, Unknown
  misc_feature (1)..( 8): Result.001 file - promoters70/5663862
tgtcattt

SEQ ID NO: 88044 - DNA, 8 bp, Unknown
  misc_feature (1)..( 8): Result.001 file - promoters70/5663862
ggtgattg

SEQ ID NO: 88045 - DNA, 8 bp, Unknown
  misc_feature (1)..( 8): Result.001 file - promoters70/5663862
attgattt

SEQ ID NO: 88046 - DNA, 8 bp, Unknown
  misc_feature (1)..( 8): Result.001 file - promoters70/5663862
tttcattt

SEQ ID NO: 88047 - DNA, 8 bp, Unknown
  misc_feature (1)..( 8): Result.001 file - promoters70/5663907
tgtcatga

SEQ ID NO: 88048 - DNA, 8 bp, Unknown
  misc_feature (1)..( 8): Result.001 file - promoters70/5663907
taattaat

SEQ ID NO: 88049 - DNA, 8 bp, Unknown
  misc_feature (1)..( 8): Result.001 file - promoters70/5663907
taatcaat

SEQ ID NO: 88050 - DNA, 8 bp, Unknown
  misc_feature (1)..( 8): Result.001 file - promoters70/5663907
atatcaat

SEQ ID NO: 88051 - DNA, 9 bp, Unknown
  misc_feature (1)..( 9): Result.001 file - promoters70/5663907
ttatttgga

SEQ ID NO: 88052 - DNA, 9 bp, Unknown
  misc_feature (1)..( 9): Result.001 file - promoters70/5663907
atatttgtt

SEQ ID NO: 88053 - DNA, 9 bp, Unknown
  misc_feature (1)..( 9): Result.001 file - promoters70/5663907
ttatgtgga

SEQ ID NO: 88054 - DNA, 7 bp, Unknown
  misc_feature (1)..( 7): Result.001 file - promoters70/5663907
tataaat

SEQ ID NO: 88055 - DNA, 7 bp, Unknown
  misc_feature (1)..( 7): Result.001 file - promoters70/5663907
tataaat

SEQ ID NO: 88056 - DNA, 7 bp, Unknown
  misc_feature (1)..( 7): Result.001 file - promoters70/5663907
tataaaa

SEQ ID NO: 88057 - DNA, 8 bp, Unknown
  misc_feature (1)..( 8): Result.001 file - promoters70/5663907
attgatga

SEQ ID NO: 88058 - DNA, 8 bp, Unknown
  misc_feature (1)..( 8): Result.001 file - promoters70/5663907
tttgttga

SEQ ID NO: 88059 - DNA, 8 bp, Unknown
  misc_feature (1)..( 8): Result.001 file - promoters70/5663907
gtttatgt

SEQ ID NO: 88060 - DNA, 6 bp, Unknown
  misc_feature (1)..( 6): Result.001 file - promoters70/5663907
agcaat

SEQ ID NO: 88061 - DNA, 6 bp, Unknown
  misc_feature (1)..( 6): Result.001 file - promoters70/5663907
agcaat

SEQ ID NO: 88062 - DNA, 6 bp, Unknown
  misc_feature (1)..( 6): Result.001 file - promoters70/5663934
agcaat

SEQ ID NO: 88063 - DNA, 11 bp, Unknown
  misc_feature (1)..( 11): Result.001 file - promoters70/5663934
ctactacacat

SEQ ID NO: 88064 - DNA, 11 bp, Unknown
  misc_feature (1)..( 11): Result.001 file - promoters70/5663934
atactagacag

SEQ ID NO: 88065 - DNA, 11 bp, Unknown
  misc_feature (1)..( 11): Result.001 file - promoters70/5663934
aatctacgcat

SEQ ID NO: 88066 - DNA, 11 bp, Unknown
  misc_feature (1)..( 11): Result.001 file - promoters70/5663934
caactacaaat

SEQ ID NO: 88067 - DNA, 11 bp, Unknown
  misc_feature (1)..( 11): Result.001 file - promoters70/5663934
atactaaaaac

SEQ ID NO: 88068 - DNA, 11 bp, Unknown
  misc_feature (1)..( 11): Result.001 file - promoters70/5663934
ttactaaaagt

SEQ ID NO: 88069 - DNA, 13 bp, Unknown
  misc_feature (1)..( 13): Result.001 file - promoters70/5663934
aaaacgccttagt

SEQ ID NO: 88070 - DNA, 13 bp, Unknown
  misc_feature (1)..( 13): Result.001 file - promoters70/5663934
aaaacgaatggca

SEQ ID NO: 88071 - DNA, 13 bp, Unknown
  misc_feature (1)..( 13): Result.001 file - promoters70/5663934
aaaatgaattctt

SEQ ID NO: 88072 - DNA, 13 bp, Unknown
  misc_feature (1)..( 13): Result.001 file - promoters70/5663934
caaacaaatcaaa

SEQ ID NO: 88073 - DNA, 13 bp, Unknown
  misc_feature (1)..( 13): Result.001 file - promoters70/5663934
caaagaaaggtca

SEQ ID NO: 88074 - DNA, 13 bp, Unknown
  misc_feature (1)..( 13): Result.001 file - promoters70/5663934
aaaagaaaccaat

SEQ ID NO: 88075 - DNA, 13 bp, Unknown
  misc_feature (1)..( 13): Result.001 file - promoters70/5663934
caaggaaagactt

SEQ ID NO: 88076 - DNA, 12 bp, Unknown
  misc_feature (1)..( 12): Result.001 file - promoters70/5663934
gaccaaacacaa

SEQ ID NO: 88077 - DNA, 12 bp, Unknown
  misc_feature (1)..( 12): Result.001 file - promoters70/5663934
tatcaaacaaat

SEQ ID NO: 88078 - DNA, 12 bp, Unknown
  misc_feature (1)..( 12): Result.001 file - promoters70/5663934
aaagaaaccaat

SEQ ID NO: 88079 - DNA, 12 bp, Unknown
  misc_feature (1)..( 12): Result.001 file - promoters70/5663934
aacaaaaaaaaa

SEQ ID NO: 88080 - DNA, 12 bp, Unknown
  misc_feature (1)..( 12): Result.001 file - promoters70/5663934
aaccaaagaaag

SEQ ID NO: 88081 - DNA, 12 bp, Unknown
  misc_feature (1)..( 12): Result.001 file - promoters70/5663934
gtacaaggaaag

SEQ ID NO: 88082 - DNA, 12 bp, Unknown
  misc_feature (1)..( 12): Result.001 file - promoters70/5663934
gattaaaaaaag

SEQ ID NO: 88083 - DNA, 12 bp, Unknown
  misc_feature (1)..( 12): Result.001 file - promoters70/5663934
acttaaaatcta

SEQ ID NO: 88084 - DNA, 12 bp, Unknown
  misc_feature (1)..( 12): Result.001 file - promoters70/5663934
tactaaaaacag

SEQ ID NO: 88085 - DNA, 12 bp, Unknown
  misc_feature (1)..( 12): Result.001 file - promoters70/5663934
tactaaaagttt

SEQ ID NO: 88086 - DNA, 13 bp, Unknown
  misc_feature (1)..( 13): Result.001 file - promoters70/5663934
aactacaaatatc

SEQ ID NO: 88087 - DNA, 13 bp, Unknown
  misc_feature (1)..( 13): Result.001 file - promoters70/5663934
acgccaaaagaca

SEQ ID NO: 88088 - DNA, 13 bp, Unknown
  misc_feature (1)..( 13): Result.001 file - promoters70/5663934
ttgtggaaatgac

SEQ ID NO: 88089 - DNA, 12 bp, Unknown
  misc_feature (1)..( 12): Result.001 file - promoters70/5663934
aaaatgaattct

SEQ ID NO: 88090 - DNA, 12 bp, Unknown
  misc_feature (1)..( 12): Result.001 file - promoters70/5663934
taaaagaaacca

SEQ ID NO: 88091 - DNA, 12 bp, Unknown
  misc_feature (1)..( 12): Result.001 file - promoters70/5663934
aaaacgaatggc

SEQ ID NO: 88092 - DNA, 12 bp, Unknown
  misc_feature (1)..( 12): Result.001 file - promoters70/5663934
caaacaaatcaa

SEQ ID NO: 88093 - DNA, 12 bp, Unknown
  misc_feature (1)..( 12): Result.001 file - promoters70/5663934
ccaaagaaaggt

SEQ ID NO: 88094 - DNA, 12 bp, Unknown
  misc_feature (1)..( 12): Result.001 file - promoters70/5663934
acaaggaaagac

SEQ ID NO: 88095 - DNA, 10 bp, Unknown
  misc_feature (1)..( 10): Result.001 file - promoters70/5663934
caaatcaaat

SEQ ID NO: 88096 - DNA, 10 bp, Unknown
  misc_feature (1)..( 10): Result.001 file - promoters70/5663934
gcagtcaaat

SEQ ID NO: 88097 - DNA, 10 bp, Unknown
  misc_feature (1)..( 10): Result.001 file - promoters70/5663934
aaaaccaaag

SEQ ID NO: 88098 - DNA, 10 bp, Unknown
  misc_feature (1)..( 10): Result.001 file - promoters70/5663934
gaaaccaatt

SEQ ID NO: 88099 - DNA, 10 bp, Unknown
  misc_feature (1)..( 10): Result.001 file - promoters70/5663934
caagtaaaaa

SEQ ID NO: 88100 - DNA, 10 bp, Unknown
  misc_feature (1)..( 10): Result.001 file - promoters70/5663950
caaggaaaga

SEQ ID NO: 88101 - DNA, 7 bp, Unknown
  misc_feature (1)..( 7): Result.001 file - promoters70/5663950
agatttt

SEQ ID NO: 88102 - DNA, 7 bp, Unknown
  misc_feature (1)..( 7): Result.001 file - promoters70/5663950
ggatttt

SEQ ID NO: 88103 - DNA, 7 bp, Unknown
  misc_feature (1)..( 7): Result.001 file - promoters70/5663950
ggattta

SEQ ID NO: 88104 - DNA, 9 bp, Unknown
  misc_feature (1)..( 9): Result.001 file - promoters70/5663950
agatttatt

SEQ ID NO: 88105 - DNA, 9 bp, Unknown
  misc_feature (1)..( 9): Result.001 file - promoters70/5663950
ggatttatt

SEQ ID NO: 88106 - DNA, 9 bp, Unknown
  misc_feature (1)..( 9): Result.001 file - promoters70/5663950
ggattttca

SEQ ID NO: 88107 - DNA, 8 bp, Unknown
  misc_feature (1)..( 8): Result.001 file - promoters70/5663950
ttcaaata

SEQ ID NO: 88108 - DNA, 8 bp, Unknown
  misc_feature (1)..( 8): Result.001 file - promoters70/5663950
ctcatata

SEQ ID NO: 88109 - DNA, 8 bp, Unknown
  misc_feature (1)..( 8): Result.001 file - promoters70/5663950
ctcataca

SEQ ID NO: 88110 - DNA, 8 bp, Unknown
  misc_feature (1)..( 8): Result.001 file - promoters70/5663950
aaaaattt

SEQ ID NO: 88111 - DNA, 8 bp, Unknown
  misc_feature (1)..( 8): Result.001 file - promoters70/5663950
aaagattt

SEQ ID NO: 88112 - DNA, 8 bp, Unknown
  misc_feature (1)..( 8): Result.001 file - promoters70/5663970
taagattg

SEQ ID NO: 88113 - DNA, 9 bp, Unknown
  misc_feature (1)..( 9): Result.001 file - promoters70/5663970
gagtttctc

SEQ ID NO: 88114 - DNA, 9 bp, Unknown
  misc_feature (1)..( 9): Result.001 file - promoters70/5663970
tagtctctt

SEQ ID NO: 88115 - DNA, 9 bp, Unknown
  misc_feature (1)..( 9): Result.001 file - promoters70/5663970
gagattctg

SEQ ID NO: 88116 - DNA, 9 bp, Unknown
  misc_feature (1)..( 9): Result.001 file - promoters70/5663996
tagtttctt

SEQ ID NO: 88117 - DNA, 12 bp, Unknown
  misc_feature (1)..( 12): Result.001 file - promoters70/5663996
tatgaatcatgt

SEQ ID NO: 88118 - DNA, 12 bp, Unknown
  misc_feature (1)..( 12): Result.001 file - promoters70/5663996
ctggaatcaaca

SEQ ID NO: 88119 - DNA, 12 bp, Unknown
  misc_feature (1)..( 12): Result.001 file - promoters70/5663996
tggtaataatgt

SEQ ID NO: 88120 - DNA, 12 bp, Unknown
  misc_feature (1)..( 12): Result.001 file - promoters70/5663996
tatgaatctgct

SEQ ID NO: 88121 - DNA, 13 bp, Unknown
  misc_feature (1)..( 13): Result.001 file - promoters70/5663996
atcaaatagtccg

SEQ ID NO: 88122 - DNA, 13 bp, Unknown
  misc_feature (1)..( 13): Result.001 file - promoters70/5663996
atcaaatccacaa

SEQ ID NO: 88123 - DNA, 13 bp, Unknown
  misc_feature (1)..( 13): Result.001 file - promoters70/5663996
tccaaattcacaa

SEQ ID NO: 88124 - DNA, 9 bp, Unknown
  misc_feature (1)..( 9): Result.001 file - promoters70/5663996
gtcaaattt

SEQ ID NO: 88125 - DNA, 9 bp, Unknown
  misc_feature (1)..( 9): Result.001 file - promoters70/5663996
aacaatttt

SEQ ID NO: 88126 - DNA, 9 bp, Unknown
  misc_feature (1)..( 9): Result.001 file - promoters70/5663996
aacaattag

SEQ ID NO: 88127 - DNA, 9 bp, Unknown
  misc_feature (1)..( 9): Result.001 file - promoters70/5663996
ttggattta

SEQ ID NO: 88128 - DNA, 9 bp, Unknown
  misc_feature (1)..( 9): Result.001 file - promoters70/5663996
atggattta

SEQ ID NO: 88129 - DNA, 9 bp, Unknown
  misc_feature (1)..( 9): Result.001 file - promoters70/5663996
ttggatttt

SEQ ID NO: 88130 - DNA, 7 bp, Unknown
  misc_feature (1)..( 7): Result.001 file - promoters70/5663996
gagagta

SEQ ID NO: 88131 - DNA, 7 bp, Unknown
  misc_feature (1)..( 7): Result.001 file - promoters70/5663996
cagagta

SEQ ID NO: 88132 - DNA, 7 bp, Unknown
  misc_feature (1)..( 7): Result.001 file - promoters70/5663996
gagggta

SEQ ID NO: 88133 - DNA, 8 bp, Unknown
  misc_feature (1)..( 8): Result.001 file - promoters70/5663996
cttcgacg

SEQ ID NO: 88134 - DNA, 8 bp, Unknown
  misc_feature (1)..( 8): Result.001 file - promoters70/5663996
ctttgacc

SEQ ID NO: 88135 - DNA, 8 bp, Unknown
  misc_feature (1)..( 8): Result.001 file - promoters70/5663996
ttttaacc

SEQ ID NO: 88136 - DNA, 13 bp, Unknown
  misc_feature (1)..( 13): Result.001 file - promoters70/5663996
ctgaatcgagaat

SEQ ID NO: 88137 - DNA, 13 bp, Unknown
  misc_feature (1)..( 13): Result.001 file - promoters70/5663996
ttgaatcaatatt

SEQ ID NO: 88138 - DNA, 13 bp, Unknown
  misc_feature (1)..( 13): Result.001 file - promoters70/5663996
ttgattcaaaatt

SEQ ID NO: 88139 - DNA, 10 bp, Unknown
  misc_feature (1)..( 10): Result.001 file - promoters70/5663996
agctagctct

SEQ ID NO: 88140 - DNA, 10 bp, Unknown
  misc_feature (1)..( 10): Result.001 file - promoters70/5663996
agctcgctct

SEQ ID NO: 88141 - DNA, 10 bp, Unknown
  misc_feature (1)..( 10): Result.001 file - promoters70/5664060
tcctcactca

SEQ ID NO: 88142 - DNA, 9 bp, Unknown
  misc_feature (1)..( 9): Result.001 file - promoters70/5664060
tcaaataat

SEQ ID NO: 88143 - DNA, 9 bp, Unknown
  misc_feature (1)..( 9): Result.001 file - promoters70/5664060
gaaaacaat

SEQ ID NO: 88144 - DNA, 9 bp, Unknown
  misc_feature (1)..( 9): Result.001 file - promoters70/5664060
acaaattta

SEQ ID NO: 88145 - DNA, 9 bp, Unknown
  misc_feature (1)..( 9): Result.001 file - promoters70/5664060
attagatta

SEQ ID NO: 88146 - DNA, 9 bp, Unknown
  misc_feature (1)..( 9): Result.001 file - promoters70/5664060
attggatta

SEQ ID NO: 88147 - DNA, 9 bp, Unknown
  misc_feature (1)..( 9): Result.001 file - promoters70/5664060
catagttta

SEQ ID NO: 88148 - DNA, 9 bp, Unknown
  misc_feature (1)..( 9): Result.001 file - promoters70/5664060
atttgtctt

SEQ ID NO: 88149 - DNA, 9 bp, Unknown
  misc_feature (1)..( 9): Result.001 file - promoters70/5664060
atttatcta

SEQ ID NO: 88150 - DNA, 9 bp, Unknown
  misc_feature (1)..( 9): Result.001 file - promoters70/5664060
ttttgttta

SEQ ID NO: 88151 - DNA, 7 bp, Unknown
  misc_feature (1)..( 7): Result.001 file - promoters70/5664060
tgagaac

SEQ ID NO: 88152 - DNA, 7 bp, Unknown
  misc_feature (1)..( 7): Result.001 file - promoters70/5664060
tgaaaac

SEQ ID NO: 88153 - DNA, 7 bp, Unknown
  misc_feature (1)..( 7): Result.001 file - promoters70/5664141
agaaaac

SEQ ID NO: 88154 - DNA, 7 bp, Unknown
  misc_feature (1)..( 7): Result.001 file - promoters70/5664141
atttatg

SEQ ID NO: 88155 - DNA, 7 bp, Unknown
  misc_feature (1)..( 7): Result.001 file - promoters70/5664141
ctttatg

SEQ ID NO: 88156 - DNA, 7 bp, Unknown
  misc_feature (1)..( 7): Result.001 file - promoters70/5664141
atttatg

SEQ ID NO: 88157 - DNA, 9 bp, Unknown
  misc_feature (1)..( 9): Result.001 file - promoters70/5664141
atttgtttt

SEQ ID NO: 88158 - DNA, 9 bp, Unknown
  misc_feature (1)..( 9): Result.001 file - promoters70/5664141
atttttttt

SEQ ID NO: 88159 - DNA, 9 bp, Unknown
  misc_feature (1)..( 9): Result.001 file - promoters70/5664170
attatttac

SEQ ID NO: 88160 - DNA, 7 bp, Unknown
  misc_feature (1)..( 7): Result.001 file - promoters70/5664170
cataatt

SEQ ID NO: 88161 - DNA, 7 bp, Unknown
  misc_feature (1)..( 7): Result.001 file - promoters70/5664170
cataatc

SEQ ID NO: 88162 - DNA, 7 bp, Unknown
  misc_feature (1)..( 7): Result.001 file - promoters70/5664182
cataatt

SEQ ID NO: 88163 - DNA, 8 bp, Unknown
  misc_feature (1)..( 8): Result.001 file - promoters70/5664182
cacaaatt

SEQ ID NO: 88164 - DNA, 8 bp, Unknown
  misc_feature (1)..( 8): Result.001 file - promoters70/5664182
tacaaatt

SEQ ID NO: 88165 - DNA, 8 bp, Unknown
  misc_feature (1)..( 8): Result.001 file - promoters70/5664182
tacaaaag

SEQ ID NO: 88166 - DNA, 11 bp, Unknown
  misc_feature (1)..( 11): Result.001 file - promoters70/5664182
tcagaattttt

SEQ ID NO: 88167 - DNA, 11 bp, Unknown
  misc_feature (1)..( 11): Result.001 file - promoters70/5664182
gattaatttta

SEQ ID NO: 88168 - DNA, 11 bp, Unknown
  misc_feature (1)..( 11): Result.001 file - promoters70/5664182
acctaagttta

SEQ ID NO: 88169 - DNA, 11 bp, Unknown
  misc_feature (1)..( 11): Result.001 file - promoters70/5664182
gttaaagtcaa

SEQ ID NO: 88170 - DNA, 8 bp, Unknown
  misc_feature (1)..( 8): Result.001 file - promoters70/5664182
cgtaaagt

SEQ ID NO: 88171 - DNA, 8 bp, Unknown
  misc_feature (1)..( 8): Result.001 file - promoters70/5664182
gttaaagt

SEQ ID NO: 88172 - DNA, 8 bp, Unknown
  misc_feature (1)..( 8): Result.001 file - promoters70/5664294
gtttaagt

SEQ ID NO: 88173 - DNA, 8 bp, Unknown
  misc_feature (1)..( 8): Result.001 file - promoters70/5664294
caaaccga

SEQ ID NO: 88174 - DNA, 8 bp, Unknown
  misc_feature (1)..( 8): Result.001 file - promoters70/5664294
aaaatcga

SEQ ID NO: 88175 - DNA, 8 bp, Unknown
  misc_feature (1)..( 8): Result.001 file - promoters70/5664294
aaaatctg

SEQ ID NO: 88176 - DNA, 8 bp, Unknown
  misc_feature (1)..( 8): Result.001 file - promoters70/5664294
gataaaaa

SEQ ID NO: 88177 - DNA, 8 bp, Unknown
  misc_feature (1)..( 8): Result.001 file - promoters70/5664294
tatataaa

SEQ ID NO: 88178 - DNA, 8 bp, Unknown
  misc_feature (1)..( 8): Result.001 file - promoters70/5664294
gataaatg

SEQ ID NO: 88179 - DNA, 9 bp, Unknown
  misc_feature (1)..( 9): Result.001 file - promoters70/5664294
ctttataat

SEQ ID NO: 88180 - DNA, 9 bp, Unknown
  misc_feature (1)..( 9): Result.001 file - promoters70/5664294
cattaaaat

SEQ ID NO: 88181 - DNA, 10 bp, Unknown
  misc_feature (1)..( 10): Result.001 file - promoters70/5664298
acttcataga

SEQ ID NO: 88182 - DNA, 10 bp, Unknown
  misc_feature (1)..( 10): Result.001 file - promoters70/5664298
catgatttaa

SEQ ID NO: 88183 - DNA, 10 bp, Unknown
  misc_feature (1)..( 10): Result.001 file - promoters70/5664298
catgatctta

SEQ ID NO: 88184 - DNA, 10 bp, Unknown
  misc_feature (1)..( 10): Result.001 file - promoters70/5664298
gatgagctta

SEQ ID NO: 88185 - DNA, 10 bp, Unknown
  misc_feature (1)..( 10): Result.001 file - promoters70/5664311
gttgagctta

SEQ ID NO: 88186 - DNA, 11 bp, Unknown
  misc_feature (1)..( 11): Result.001 file - promoters70/5664311
catggtaacat

SEQ ID NO: 88187 - DNA, 11 bp, Unknown
  misc_feature (1)..( 11): Result.001 file - promoters70/5664311
tatgttaattt

SEQ ID NO: 88188 - DNA, 11 bp, Unknown
  misc_feature (1)..( 11): Result.001 file - promoters70/5664311
catagtagact

SEQ ID NO: 88189 - DNA, 11 bp, Unknown
  misc_feature (1)..( 11): Result.001 file - promoters70/5664311
catagtaacaa

SEQ ID NO: 88190 - DNA, 11 bp, Unknown
  misc_feature (1)..( 11): Result.001 file - promoters70/5664311
tttgtaaattt

SEQ ID NO: 88191 - DNA, 11 bp, Unknown
  misc_feature (1)..( 11): Result.001 file - promoters70/5664311
attgttaacga

SEQ ID NO: 88192 - DNA, 11 bp, Unknown
  misc_feature (1)..( 11): Result.001 file - promoters70/5664311
aatgttgtttc

SEQ ID NO: 88193 - DNA, 11 bp, Unknown
  misc_feature (1)..( 11): Result.001 file - promoters70/5664311
tattaaatata

SEQ ID NO: 88194 - DNA, 11 bp, Unknown
  misc_feature (1)..( 11): Result.001 file - promoters70/5664311
aaagaaatatt

SEQ ID NO: 88195 - DNA, 11 bp, Unknown
  misc_feature (1)..( 11): Result.001 file - promoters70/5664311
aaaaaaatatt

SEQ ID NO: 88196 - DNA, 11 bp, Unknown
  misc_feature (1)..( 11): Result.001 file - promoters70/5664311
aaaaaaaggaa

SEQ ID NO: 88197 - DNA, 11 bp, Unknown
  misc_feature (1)..( 11): Result.001 file - promoters70/5664311
cataaaataaa

SEQ ID NO: 88198 - DNA, 11 bp, Unknown
  misc_feature (1)..( 11): Result.001 file - promoters70/5664311
aacaaagtaaa

SEQ ID NO: 88199 - DNA, 9 bp, Unknown
  misc_feature (1)..( 9): Result.001 file - promoters70/5664311
aaacttttc

SEQ ID NO: 88200 - DNA, 9 bp, Unknown
  misc_feature (1)..( 9): Result.001 file - promoters70/5664311
aaagttttt

SEQ ID NO: 88201 - DNA, 9 bp, Unknown
  misc_feature (1)..( 9): Result.001 file - promoters70/5664311
aaattttta

SEQ ID NO: 88202 - DNA, 9 bp, Unknown
  misc_feature (1)..( 9): Result.001 file - promoters70/5664311
ttagttttg

SEQ ID NO: 88203 - DNA, 9 bp, Unknown
  misc_feature (1)..( 9): Result.001 file - promoters70/5664311
tttgttttt

SEQ ID NO: 88204 - DNA, 9 bp, Unknown
  misc_feature (1)..( 9): Result.001 file - promoters70/5664457
tctgttttc

SEQ ID NO: 88205 - DNA, 9 bp, Unknown
  misc_feature (1)..( 9): Result.001 file - promoters70/5664457
tctttctat

SEQ ID NO: 88206 - DNA, 9 bp, Unknown
  misc_feature (1)..( 9): Result.001 file - promoters70/5664457
tctctctga

SEQ ID NO: 88207 - DNA, 9 bp, Unknown
  misc_feature (1)..( 9): Result.001 file - promoters70/5664457
ccttactat

SEQ ID NO: 88208 - DNA, 7 bp, Unknown
  misc_feature (1)..( 7): Result.001 file - promoters70/5664457
tcaaact

SEQ ID NO: 88209 - DNA, 7 bp, Unknown
  misc_feature (1)..( 7): Result.001 file - promoters70/5664457
tcaaacc

SEQ ID NO: 88210 - DNA, 7 bp, Unknown
  misc_feature (1)..( 7): Result.001 file - promoters70/5664465
ccaaacc

SEQ ID NO: 88211 - DNA, 7 bp, Unknown
  misc_feature (1)..( 7): Result.001 file - promoters70/5664465
ttcacaa

SEQ ID NO: 88212 - DNA, 7 bp, Unknown
  misc_feature (1)..( 7): Result.001 file - promoters70/5664465
gtcacaa

SEQ ID NO: 88213 - DNA, 7 bp, Unknown
  misc_feature (1)..( 7): Result.001 file - promoters70/5664703
ttcacag

SEQ ID NO: 88214 - DNA, 12 bp, Unknown
  misc_feature (1)..( 12): Result.001 file - promoters70/5664703
ctttttgtttat

SEQ ID NO: 88215 - DNA, 12 bp, Unknown
  misc_feature (1)..( 12): Result.001 file - promoters70/5664703
tgatttgtatat

SEQ ID NO: 88216 - DNA, 12 bp, Unknown
  misc_feature (1)..( 12): Result.001 file - promoters70/5664703
cttattgtataa

SEQ ID NO: 88217 - DNA, 8 bp, Unknown
  misc_feature (1)..( 8): Result.001 file - promoters70/5664703
gctggatt

SEQ ID NO: 88218 - DNA, 8 bp, Unknown
  misc_feature (1)..( 8): Result.001 file - promoters70/5664703
tctgaatt

SEQ ID NO: 88219 - DNA, 8 bp, Unknown
  misc_feature (1)..( 8): Result.001 file - promoters70/5664873
tctgaaca

SEQ ID NO: 88220 - DNA, 7 bp, Unknown
  misc_feature (1)..( 7): Result.001 file - promoters70/5664873
aaataaa

SEQ ID NO: 88221 - DNA, 7 bp, Unknown
  misc_feature (1)..( 7): Result.001 file - promoters70/5664873
aaataaa

SEQ ID NO: 88222 - DNA, 7 bp, Unknown
  misc_feature (1)..( 7): Result.001 file - promoters70/5664873
aaataaa

SEQ ID NO: 88223 - DNA, 7 bp, Unknown
  misc_feature (1)..( 7): Result.001 file - promoters70/5664873
aaagaaa

SEQ ID NO: 88224 - DNA, 8 bp, Unknown
  misc_feature (1)..( 8): Result.001 file - promoters70/5664873
taaaattt

SEQ ID NO: 88225 - DNA, 8 bp, Unknown
  misc_feature (1)..( 8): Result.001 file - promoters70/5664873
taaaataa

SEQ ID NO: 88226 - DNA, 8 bp, Unknown
  misc_feature (1)..( 8): Result.001 file - promoters70/5664873
gaaacttt

SEQ ID NO: 88227 - DNA, 7 bp, Unknown
  misc_feature (1)..( 7): Result.001 file - promoters70/5664873
aaataaa

SEQ ID NO: 88228 - DNA, 7 bp, Unknown
  misc_feature (1)..( 7): Result.001 file - promoters70/5664873
aaataac

SEQ ID NO: 88229 - DNA, 7 bp, Unknown
  misc_feature (1)..( 7): Result.001 file - promoters70/5664873
aaagaaa

SEQ ID NO: 88230 - DNA, 7 bp, Unknown
  misc_feature (1)..( 7): Result.001 file - promoters70/5664873
aaattta

SEQ ID NO: 88231 - DNA, 7 bp, Unknown
  misc_feature (1)..( 7): Result.001 file - promoters70/5664873
caattta

SEQ ID NO: 88232 - DNA, 7 bp, Unknown
  misc_feature (1)..( 7): Result.001 file - promoters70/5664873
aaatttc

SEQ ID NO: 88233 - DNA, 9 bp, Unknown
  misc_feature (1)..( 9): Result.001 file - promoters70/5664873
aaaattaaa

SEQ ID NO: 88234 - DNA, 9 bp, Unknown
  misc_feature (1)..( 9): Result.001 file - promoters70/5664873
aaacttaat

SEQ ID NO: 88235 - DNA, 9 bp, Unknown
  misc_feature (1)..( 9): Result.001 file - promoters70/5664873
tgccttaat

SEQ ID NO: 88236 - DNA, 11 bp, Unknown
  misc_feature (1)..( 11): Result.001 file - promoters70/5664873
gtagtgacttt

SEQ ID NO: 88237 - DNA, 11 bp, Unknown
  misc_feature (1)..( 11): Result.001 file - promoters70/5664873
tttttgacttt

SEQ ID NO: 88238 - DNA, 11 bp, Unknown
  misc_feature (1)..( 11): Result.001 file - promoters70/5664873
ttttttacttg

SEQ ID NO: 88239 - DNA, 13 bp, Unknown
  misc_feature (1)..( 13): Result.001 file - promoters70/5664873
ttttactaaaaaa

SEQ ID NO: 88240 - DNA, 13 bp, Unknown
  misc_feature (1)..( 13): Result.001 file - promoters70/5664873
ctttaataagaaa

SEQ ID NO: 88241 - DNA, 13 bp, Unknown
  misc_feature (1)..( 13): Result.001 file - promoters70/5664873
ttttacttgatct

SEQ ID NO: 88242 - DNA, 10 bp, Unknown
  misc_feature (1)..( 10): Result.001 file - promoters70/5664873
taatgtctcg

SEQ ID NO: 88243 - DNA, 10 bp, Unknown
  misc_feature (1)..( 10): Result.001 file - promoters70/5664873
taatatctca

SEQ ID NO: 88244 - DNA, 10 bp, Unknown
  misc_feature (1)..( 10): Result.001 file - promoters70/5664873
tgatggctcg

SEQ ID NO: 88245 - DNA, 9 bp, Unknown
  misc_feature (1)..( 9): Result.001 file - promoters70/5664873
ctcttttat

SEQ ID NO: 88246 - DNA, 9 bp, Unknown
  misc_feature (1)..( 9): Result.001 file - promoters70/5664873
aaattttat

SEQ ID NO: 88247 - DNA, 9 bp, Unknown
  misc_feature (1)..( 9): Result.001 file - promoters70/5664885
aaaatttac

SEQ ID NO: 88248 - DNA, 12 bp, Unknown
  misc_feature (1)..( 12): Result.001 file - promoters70/5664885
aaagaaattata

SEQ ID NO: 88249 - DNA, 12 bp, Unknown
  misc_feature (1)..( 12): Result.001 file - promoters70/5664885
taaaaaataata

SEQ ID NO: 88250 - DNA, 12 bp, Unknown
  misc_feature (1)..( 12): Result.001 file - promoters70/5664885
atcaaaattaga

SEQ ID NO: 88251 - DNA, 12 bp, Unknown
  misc_feature (1)..( 12): Result.001 file - promoters70/5664885
ctagaaattcta

SEQ ID NO: 88252 - DNA, 12 bp, Unknown
  misc_feature (1)..( 12): Result.001 file - promoters70/5665140
ctacaaagacca

SEQ ID NO: 88253 - DNA, 7 bp, Unknown
  misc_feature (1)..( 7): Result.001 file - promoters70/5665140
aaaacaa

SEQ ID NO: 88254 - DNA, 7 bp, Unknown
  misc_feature (1)..( 7): Result.001 file - promoters70/5665140
aaaacat

SEQ ID NO: 88255 - DNA, 7 bp, Unknown
  misc_feature (1)..( 7): Result.001 file - promoters70/5665140
aaatcaa

SEQ ID NO: 88256 - DNA, 8 bp, Unknown
  misc_feature (1)..( 8): Result.001 file - promoters70/5665140
aatctttt

SEQ ID NO: 88257 - DNA, 8 bp, Unknown
  misc_feature (1)..( 8): Result.001 file - promoters70/5665140
catcgttt

SEQ ID NO: 88258 - DNA, 8 bp, Unknown
  misc_feature (1)..( 8): Result.001 file - promoters70/5665140
catcgtcg

SEQ ID NO: 88259 - DNA, 8 bp, Unknown
  misc_feature (1)..( 8): Result.001 file - promoters70/5665140
tattattt

SEQ ID NO: 88260 - DNA, 8 bp, Unknown
  misc_feature (1)..( 8): Result.001 file - promoters70/5665140
gattcttt

SEQ ID NO: 88261 - DNA, 8 bp, Unknown
  misc_feature (1)..( 8): Result.001 file - promoters70/5665347
gattctct

SEQ ID NO: 88262 - DNA, 11 bp, Unknown
  misc_feature (1)..( 11): Result.001 file - promoters70/5665347
agttataaatc

SEQ ID NO: 88263 - DNA, 11 bp, Unknown
  misc_feature (1)..( 11): Result.001 file - promoters70/5665347
agttatgaatc

SEQ ID NO: 88264 - DNA, 11 bp, Unknown
  misc_feature (1)..( 11): Result.001 file - promoters70/5665347
tgttatttatt

SEQ ID NO: 88265 - DNA, 11 bp, Unknown
  misc_feature (1)..( 11): Result.001 file - promoters70/5665347
gaaaatgaatt

SEQ ID NO: 88266 - DNA, 11 bp, Unknown
  misc_feature (1)..( 11): Result.001 file - promoters70/5665347
gattataaatc

SEQ ID NO: 88267 - DNA, 12 bp, Unknown
  misc_feature (1)..( 12): Result.001 file - promoters70/5665351
taaaatggtatt

SEQ ID NO: 88268 - DNA, 7 bp, Unknown
  misc_feature (1)..( 7): Result.001 file - promoters70/5665351
ccatttc

SEQ ID NO: 88269 - DNA, 7 bp, Unknown
  misc_feature (1)..( 7): Result.001 file - promoters70/5665351
gcatttc

SEQ ID NO: 88270 - DNA, 7 bp, Unknown
  misc_feature (1)..( 7): Result.001 file - promoters70/5665351
gcatttg

SEQ ID NO: 88271 - DNA, 8 bp, Unknown
  misc_feature (1)..( 8): Result.001 file - promoters70/5665351
caaatgaa

SEQ ID NO: 88272 - DNA, 8 bp, Unknown
  misc_feature (1)..( 8): Result.001 file - promoters70/5665351
caaatggt

SEQ ID NO: 88273 - DNA, 8 bp, Unknown
  misc_feature (1)..( 8): Result.001 file - promoters70/5665351
aaaaggaa

SEQ ID NO: 88274 - DNA, 9 bp, Unknown
  misc_feature (1)..( 9): Result.001 file - promoters70/5665351
cttcttctc

SEQ ID NO: 88275 - DNA, 9 bp, Unknown
  misc_feature (1)..( 9): Result.001 file - promoters70/5665351
tttcttctt

SEQ ID NO: 88276 - DNA, 9 bp, Unknown
  misc_feature (1)..( 9): Result.001 file - promoters70/5665359
cttattctc

SEQ ID NO: 88277 - DNA, 7 bp, Unknown
  misc_feature (1)..( 7): Result.001 file - promoters70/5665359
aaaaatt

SEQ ID NO: 88278 - DNA, 7 bp, Unknown
  misc_feature (1)..( 7): Result.001 file - promoters70/5665359
caaaatt

SEQ ID NO: 88279 - DNA, 7 bp, Unknown
  misc_feature (1)..( 7): Result.001 file - promoters70/5665359
aaaaata

SEQ ID NO: 88280 - DNA, 7 bp, Unknown
  misc_feature (1)..( 7): Result.001 file - promoters70/5665359
gttattt

SEQ ID NO: 88281 - DNA, 7 bp, Unknown
  misc_feature (1)..( 7): Result.001 file - promoters70/5665359
gttgttt

SEQ ID NO: 88282 - DNA, 8 bp, Unknown
  misc_feature (1)..( 8): Result.001 file - promoters70/5665359
tttaattt

SEQ ID NO: 88283 - DNA, 6 bp, Unknown
  misc_feature (1)..( 6): Result.001 file - promoters70/5665359
tattgt

SEQ ID NO: 88284 - DNA, 6 bp, Unknown
  misc_feature (1)..( 6): Result.001 file - promoters70/5665359
tattgt

SEQ ID NO: 88285 - DNA, 6 bp, Unknown
  misc_feature (1)..( 6): Result.001 file - promoters70/5665359
tattgt

SEQ ID NO: 88286 - DNA, 9 bp, Unknown
  misc_feature (1)..( 9): Result.001 file - promoters70/5665359
attgttttg

SEQ ID NO: 88287 - DNA, 9 bp, Unknown
  misc_feature (1)..( 9): Result.001 file - promoters70/5665359
aaagttttg

SEQ ID NO: 88288 - DNA, 9 bp, Unknown
  misc_feature (1)..( 9): Result.001 file - promoters70/5665404
ttggtttat

SEQ ID NO: 88289 - DNA, 9 bp, Unknown
  misc_feature (1)..( 9): Result.001 file - promoters70/5665404
ttcgtcctt

SEQ ID NO: 88290 - DNA, 9 bp, Unknown
  misc_feature (1)..( 9): Result.001 file - promoters70/5665404
aacgttctt

SEQ ID NO: 88291 - DNA, 9 bp, Unknown
  misc_feature (1)..( 9): Result.001 file - promoters70/5665404
ttcgtccaa

SEQ ID NO: 88292 - DNA, 7 bp, Unknown
  misc_feature (1)..( 7): Result.001 file - promoters70/5665404
ttgcttt

SEQ ID NO: 88293 - DNA, 7 bp, Unknown
  misc_feature (1)..( 7): Result.001 file - promoters70/5665404
atgcttt

SEQ ID NO: 88294 - DNA, 7 bp, Unknown
  misc_feature (1)..( 7): Result.001 file - promoters70/5665404
ttgtttt

SEQ ID NO: 88295 - DNA, 10 bp, Unknown
  misc_feature (1)..( 10): Result.001 file - promoters70/5665404
ttttaaaatt

SEQ ID NO: 88296 - DNA, 10 bp, Unknown
  misc_feature (1)..( 10): Result.001 file - promoters70/5665404
aaataaaata

SEQ ID NO: 88297 - DNA, 10 bp, Unknown
  misc_feature (1)..( 10): Result.001 file - promoters70/5665507
aaatgaaata

SEQ ID NO: 88298 - DNA, 10 bp, Unknown
  misc_feature (1)..( 10): Result.001 file - promoters70/5665507
atttttcttt

SEQ ID NO: 88299 - DNA, 10 bp, Unknown
  misc_feature (1)..( 10): Result.001 file - promoters70/5665507
attttttttt

SEQ ID NO: 88300 - DNA, 10 bp, Unknown
  misc_feature (1)..( 10): Result.001 file - promoters70/5665507
ctttctctga

SEQ ID NO: 88301 - DNA, 7 bp, Unknown
  misc_feature (1)..( 7): Result.001 file - promoters70/5665507
atgtttg

SEQ ID NO: 88302 - DNA, 7 bp, Unknown
  misc_feature (1)..( 7): Result.001 file - promoters70/5665507
atgtttc

SEQ ID NO: 88303 - DNA, 7 bp, Unknown
  misc_feature (1)..( 7): Result.001 file - promoters70/5665507
atggttg

SEQ ID NO: 88304 - DNA, 7 bp, Unknown
  misc_feature (1)..( 7): Result.001 file - promoters70/5665507
aaaaatt

SEQ ID NO: 88305 - DNA, 7 bp, Unknown
  misc_feature (1)..( 7): Result.001 file - promoters70/5665507
gaaaatt

SEQ ID NO: 88306 - DNA, 8 bp, Unknown
  misc_feature (1)..( 8): Result.001 file - promoters70/5665507
aaaacatt

SEQ ID NO: 88307 - DNA, 7 bp, Unknown
  misc_feature (1)..( 7): Result.001 file - promoters70/5665507
aattttc

SEQ ID NO: 88308 - DNA, 7 bp, Unknown
  misc_feature (1)..( 7): Result.001 file - promoters70/5665507
tattttc

SEQ ID NO: 88309 - DNA, 7 bp, Unknown
  misc_feature (1)..( 7): Result.001 file - promoters70/5665507
tatttta

SEQ ID NO: 88310 - DNA, 8 bp, Unknown
  misc_feature (1)..( 8): Result.001 file - promoters70/5665507
tttcgtac

SEQ ID NO: 88311 - DNA, 8 bp, Unknown
  misc_feature (1)..( 8): Result.001 file - promoters70/5665507
ttttgtac

SEQ ID NO: 88312 - DNA, 8 bp, Unknown
  misc_feature (1)..( 8): Result.001 file - promoters70/5665507
ttttgttg

SEQ ID NO: 88313 - DNA, 7 bp, Unknown
  misc_feature (1)..( 7): Result.001 file - promoters70/5665507
aaatatt

SEQ ID NO: 88314 - DNA, 7 bp, Unknown
  misc_feature (1)..( 7): Result.001 file - promoters70/5665507
aaatatc

SEQ ID NO: 88315 - DNA, 7 bp, Unknown
  misc_feature (1)..( 7): Result.001 file - promoters70/5665507
caatatc

SEQ ID NO: 88316 - DNA, 8 bp, Unknown
  misc_feature (1)..( 8): Result.001 file - promoters70/5665507
tatatctt

SEQ ID NO: 88317 - DNA, 8 bp, Unknown
  misc_feature (1)..( 8): Result.001 file - promoters70/5665507
aatatctt

SEQ ID NO: 88318 - DNA, 8 bp, Unknown
  misc_feature (1)..( 8): Result.001 file - promoters70/5665796
aatatccc

SEQ ID NO: 88319 - DNA, 10 bp, Unknown
  misc_feature (1)..( 10): Result.001 file - promoters70/5665796
agcatccaca

SEQ ID NO: 88320 - DNA, 10 bp, Unknown
  misc_feature (1)..( 10): Result.001 file - promoters70/5665796
tttatccacc

SEQ ID NO: 88321 - DNA, 10 bp, Unknown
  misc_feature (1)..( 10): Result.001 file - promoters70/5665796
agcaaccaca

SEQ ID NO: 88322 - DNA, 10 bp, Unknown
  misc_feature (1)..( 10): Result.001 file - promoters70/5665796
acaatgtgaa

SEQ ID NO: 88323 - DNA, 10 bp, Unknown
  misc_feature (1)..( 10): Result.001 file - promoters70/5665796
aaaatgtgaa

SEQ ID NO: 88324 - DNA, 10 bp, Unknown
  misc_feature (1)..( 10): Result.001 file - promoters70/5667720
aaaatgttat

SEQ ID NO: 88325 - DNA, 7 bp, Unknown
  misc_feature (1)..( 7): Result.001 file - promoters70/5667720
aatgata

SEQ ID NO: 88326 - DNA, 7 bp, Unknown
  misc_feature (1)..( 7): Result.001 file - promoters70/5667720
aatcata

SEQ ID NO: 88327 - DNA, 7 bp, Unknown
  misc_feature (1)..( 7): Result.001 file - promoters70/5667720
aatgatg

SEQ ID NO: 88328 - DNA, 7 bp, Unknown
  misc_feature (1)..( 7): Result.001 file - promoters70/5667720
aaaaatt

SEQ ID NO: 88329 - DNA, 7 bp, Unknown
  misc_feature (1)..( 7): Result.001 file - promoters70/5667720
aaacatt

SEQ ID NO: 88330 - DNA, 7 bp, Unknown
  misc_feature (1)..( 7): Result.001 file - promoters70/5667720
aaaaaag

SEQ ID NO: 88331 - DNA, 9 bp, Unknown
  misc_feature (1)..( 9): Result.001 file - promoters70/5667720
aaacaaaaa

SEQ ID NO: 88332 - DNA, 9 bp, Unknown
  misc_feature (1)..( 9): Result.001 file - promoters70/5667720
aaagaaata

SEQ ID NO: 88333 - DNA, 9 bp, Unknown
  misc_feature (1)..( 9): Result.001 file - promoters70/5667720
taagaaata

SEQ ID NO: 88334 - DNA, 9 bp, Unknown
  misc_feature (1)..( 9): Result.001 file - promoters70/5667720
ggaacaaat

SEQ ID NO: 88335 - DNA, 9 bp, Unknown
  misc_feature (1)..( 9): Result.001 file - promoters70/5667720
aaaacaaat

SEQ ID NO: 88336 - DNA, 9 bp, Unknown
  misc_feature (1)..( 9): Result.001 file - promoters70/5667720
aaaacaaga

SEQ ID NO: 88337 - DNA, 9 bp, Unknown
  misc_feature (1)..( 9): Result.001 file - promoters70/5667720
taaccaaaa

SEQ ID NO: 88338 - DNA, 9 bp, Unknown
  misc_feature (1)..( 9): Result.001 file - promoters70/5667720
taaccaaaa

SEQ ID NO: 88339 - DNA, 9 bp, Unknown
  misc_feature (1)..( 9): Result.001 file - promoters70/5667720
aaactaaac

SEQ ID NO: 88340 - DNA, 12 bp, Unknown
  misc_feature (1)..( 12): Result.001 file - promoters70/5667720
aaaataaaataa

SEQ ID NO: 88341 - DNA, 12 bp, Unknown
  misc_feature (1)..( 12): Result.001 file - promoters70/5667720
aaaataatagta

SEQ ID NO: 88342 - DNA, 12 bp, Unknown
  misc_feature (1)..( 12): Result.001 file - promoters70/5667737
aaaataaactaa

SEQ ID NO: 88343 - DNA, 8 bp, Unknown
  misc_feature (1)..( 8): Result.001 file - promoters70/5667737
ctacaaca

SEQ ID NO: 88344 - DNA, 8 bp, Unknown
  misc_feature (1)..( 8): Result.001 file - promoters70/5667737
ctacaaag

SEQ ID NO: 88345 - DNA, 8 bp, Unknown
  misc_feature (1)..( 8): Result.001 file - promoters70/5667737
ctagaaat

SEQ ID NO: 88346 - DNA, 8 bp, Unknown
  misc_feature (1)..( 8): Result.001 file - promoters70/5667737
ctaaaaag

SEQ ID NO: 88347 - DNA, 14 bp, Unknown
  misc_feature (1)..( 14): Result.001 file - promoters70/5667737
caacaaaaaccaaa

SEQ ID NO: 88348 - DNA, 14 bp, Unknown
  misc_feature (1)..( 14): Result.001 file - promoters70/5667737
ctacaaagaccaaa

SEQ ID NO: 88349 - DNA, 14 bp, Unknown
  misc_feature (1)..( 14): Result.001 file - promoters70/5667737
ctagaaattctatt

SEQ ID NO: 88350 - DNA, 14 bp, Unknown
  misc_feature (1)..( 14): Result.001 file - promoters70/5667812
ctaaaaagtatttt

SEQ ID NO: 88351 - DNA, 15 bp, Unknown
  misc_feature (1)..( 15): Result.001 file - promoters70/5667812
gattgttttttttcc

SEQ ID NO: 88352 - DNA, 15 bp, Unknown
  misc_feature (1)..( 15): Result.001 file - promoters70/5667812
aaaagtttttgtaat

SEQ ID NO: 88353 - DNA, 15 bp, Unknown
  misc_feature (1)..( 15): Result.001 file - promoters70/5667812
tagggttttttcttg

SEQ ID NO: 88354 - DNA, 15 bp, Unknown
  misc_feature (1)..( 15): Result.001 file - promoters70/5667812
ggatgtttttgttaa

SEQ ID NO: 88355 - DNA, 15 bp, Unknown
  misc_feature (1)..( 15): Result.001 file - promoters70/5667812
caaacttttattttt

SEQ ID NO: 88356 - DNA, 15 bp, Unknown
  misc_feature (1)..( 15): Result.001 file - promoters70/5667812
gaaaggtttcttctc

SEQ ID NO: 88357 - DNA, 15 bp, Unknown
  misc_feature (1)..( 15): Result.001 file - promoters70/5667812
caaatttttactttt

SEQ ID NO: 88358 - DNA, 10 bp, Unknown
  misc_feature (1)..( 10): Result.001 file - promoters70/5667812
aaaggaattc

SEQ ID NO: 88359 - DNA, 10 bp, Unknown
  misc_feature (1)..( 10): Result.001 file - promoters70/5667812
aaagaaattc

SEQ ID NO: 88360 - DNA, 10 bp, Unknown
  misc_feature (1)..( 10): Result.001 file - promoters70/5667812
aaagaaaatc

SEQ ID NO: 88361 - DNA, 10 bp, Unknown
  misc_feature (1)..( 10): Result.001 file - promoters70/5667812
taagaaaaaa

SEQ ID NO: 88362 - DNA, 10 bp, Unknown
  misc_feature (1)..( 10): Result.001 file - promoters70/5667812
gaagaaacaa

SEQ ID NO: 88363 - DNA, 10 bp, Unknown
  misc_feature (1)..( 10): Result.001 file - promoters70/5667812
gtttaaattc

SEQ ID NO: 88364 - DNA, 9 bp, Unknown
  misc_feature (1)..( 9): Result.001 file - promoters70/5667812
gaaagaaaa

SEQ ID NO: 88365 - DNA, 9 bp, Unknown
  misc_feature (1)..( 9): Result.001 file - promoters70/5667812
gtaagaaaa

SEQ ID NO: 88366 - DNA, 9 bp, Unknown
  misc_feature (1)..( 9): Result.001 file - promoters70/5667812
gaaacaaag

SEQ ID NO: 88367 - DNA, 9 bp, Unknown
  misc_feature (1)..( 9): Result.001 file - promoters70/5667812
caaagaaat

SEQ ID NO: 88368 - DNA, 9 bp, Unknown
  misc_feature (1)..( 9): Result.001 file - promoters70/5667812
aaaaccaag

SEQ ID NO: 88369 - DNA, 9 bp, Unknown
  misc_feature (1)..( 9): Result.001 file - promoters70/5667812
cgaaccaat

SEQ ID NO: 88370 - DNA, 14 bp, Unknown
  misc_feature (1)..( 14): Result.001 file - promoters70/5667812
acaagtagaagaaa

SEQ ID NO: 88371 - DNA, 14 bp, Unknown
  misc_feature (1)..( 14): Result.001 file - promoters70/5667812
ccaagaagaaaaaa

SEQ ID NO: 88372 - DNA, 14 bp, Unknown
  misc_feature (1)..( 14): Result.001 file - promoters70/5667812
acaagtcttcttct

SEQ ID NO: 88373 - DNA, 14 bp, Unknown
  misc_feature (1)..( 14): Result.001 file - promoters70/5667812
gtaaataattaatc

SEQ ID NO: 88374 - DNA, 14 bp, Unknown
  misc_feature (1)..( 14): Result.001 file - promoters70/5667812
cctgatacttaaca

SEQ ID NO: 88375 - DNA, 14 bp, Unknown
  misc_feature (1)..( 14): Result.001 file - promoters70/5667822
aaaaatacttacaa

SEQ ID NO: 88376 - DNA, 8 bp, Unknown
  misc_feature (1)..( 8): Result.001 file - promoters70/5667822
tttaccag

SEQ ID NO: 88377 - DNA, 8 bp, Unknown
  misc_feature (1)..( 8): Result.001 file - promoters70/5667822
tttgccag

SEQ ID NO: 88378 - DNA, 8 bp, Unknown
  misc_feature (1)..( 8): Result.001 file - promoters70/5667822
tttgtacg

SEQ ID NO: 88379 - DNA, 10 bp, Unknown
  misc_feature (1)..( 10): Result.001 file - promoters70/5667822
ggaaaaaaat

SEQ ID NO: 88380 - DNA, 10 bp, Unknown
  misc_feature (1)..( 10): Result.001 file - promoters70/5667822
tataaaaaat

SEQ ID NO: 88381 - DNA, 10 bp, Unknown
  misc_feature (1)..( 10): Result.001 file - promoters70/5667822
tatacaaaag

SEQ ID NO: 88382 - DNA, 7 bp, Unknown
  misc_feature (1)..( 7): Result.001 file - promoters70/5667822
cataaaa

SEQ ID NO: 88383 - DNA, 7 bp, Unknown
  misc_feature (1)..( 7): Result.001 file - promoters70/5667822
tataaaa

SEQ ID NO: 88384 - DNA, 7 bp, Unknown
  misc_feature (1)..( 7): Result.001 file - promoters70/5667849
tatcaaa

SEQ ID NO: 88385 - DNA, 9 bp, Unknown
  misc_feature (1)..( 9): Result.001 file - promoters70/5667849
gtgaaggat

SEQ ID NO: 88386 - DNA, 9 bp, Unknown
  misc_feature (1)..( 9): Result.001 file - promoters70/5667849
gtgaatgat

SEQ ID NO: 88387 - DNA, 9 bp, Unknown
  misc_feature (1)..( 9): Result.001 file - promoters70/5667849
gtgaatgat

SEQ ID NO: 88388 - DNA, 8 bp, Unknown
  misc_feature (1)..( 8): Result.001 file - promoters70/5667849
cattgtgt

SEQ ID NO: 88389 - DNA, 8 bp, Unknown
  misc_feature (1)..( 8): Result.001 file - promoters70/5667849
cattttgt

SEQ ID NO: 88390 - DNA, 8 bp, Unknown
  misc_feature (1)..( 8): Result.001 file - promoters70/5668294
cattttgt

SEQ ID NO: 88391 - DNA, 8 bp, Unknown
  misc_feature (1)..( 8): Result.001 file - promoters70/5668294
attctttt

SEQ ID NO: 88392 - DNA, 8 bp, Unknown
  misc_feature (1)..( 8): Result.001 file - promoters70/5668294
tttctttc

SEQ ID NO: 88393 - DNA, 8 bp, Unknown
  misc_feature (1)..( 8): Result.001 file - promoters70/5668294
attatttt

SEQ ID NO: 88394 - DNA, 9 bp, Unknown
  misc_feature (1)..( 9): Result.001 file - promoters70/5668294
attaatttt

SEQ ID NO: 88395 - DNA, 9 bp, Unknown
  misc_feature (1)..( 9): Result.001 file - promoters70/5668359
ttgaatttt

SEQ ID NO: 88396 - DNA, 8 bp, Unknown
  misc_feature (1)..( 8): Result.001 file - promoters70/5668359
atggatgt

SEQ ID NO: 88397 - DNA, 8 bp, Unknown
  misc_feature (1)..( 8): Result.001 file - promoters70/5668359
atggattt

SEQ ID NO: 88398 - DNA, 8 bp, Unknown
  misc_feature (1)..( 8): Result.001 file - promoters70/5668435
ttggattt

SEQ ID NO: 88399 - DNA, 12 bp, Unknown
  misc_feature (1)..( 12): Result.001 file - promoters70/5668435
ggtgataaatat

SEQ ID NO: 88400 - DNA, 12 bp, Unknown
  misc_feature (1)..( 12): Result.001 file - promoters70/5668435
tataaaaaatat

SEQ ID NO: 88401 - DNA, 13 bp, Unknown
  misc_feature (1)..( 13): Result.001 file - promoters70/5668435
aaacaaaacatat

SEQ ID NO: 88402 - DNA, 13 bp, Unknown
  misc_feature (1)..( 13): Result.001 file - promoters70/5668435
agatacaaaaccc

SEQ ID NO: 88403 - DNA, 13 bp, Unknown
  misc_feature (1)..( 13): Result.001 file - promoters70/5668435
ctatataaaacca

SEQ ID NO: 88404 - DNA, 13 bp, Unknown
  misc_feature (1)..( 13): Result.001 file - promoters70/5668435
agagacaaataga

SEQ ID NO: 88405 - DNA, 12 bp, Unknown
  misc_feature (1)..( 12): Result.001 file - promoters70/5668435
attgttacaaat

SEQ ID NO: 88406 - DNA, 12 bp, Unknown
  misc_feature (1)..( 12): Result.001 file - promoters70/5668435
tttgttagttca

SEQ ID NO: 88407 - DNA, 12 bp, Unknown
  misc_feature (1)..( 12): Result.001 file - promoters70/5668435
atttttactttt

SEQ ID NO: 88408 - DNA, 12 bp, Unknown
  misc_feature (1)..( 12): Result.001 file - promoters70/5668435
gactttagtttt

SEQ ID NO: 88409 - DNA, 12 bp, Unknown
  misc_feature (1)..( 12): Result.001 file - promoters70/5668435
tttgttctatat

SEQ ID NO: 88410 - DNA, 12 bp, Unknown
  misc_feature (1)..( 12): Result.001 file - promoters70/5668435
ctttttgtatca

SEQ ID NO: 88411 - DNA, 11 bp, Unknown
  misc_feature (1)..( 11): Result.001 file - promoters70/5668435
acatataaaat

SEQ ID NO: 88412 - DNA, 11 bp, Unknown
  misc_feature (1)..( 11): Result.001 file - promoters70/5668435
ctataaaaaat

SEQ ID NO: 88413 - DNA, 11 bp, Unknown
  misc_feature (1)..( 11): Result.001 file - promoters70/5668435
gaataaaaaca

SEQ ID NO: 88414 - DNA, 11 bp, Unknown
  misc_feature (1)..( 11): Result.001 file - promoters70/5668435
taagaaaaaaa

SEQ ID NO: 88415 - DNA, 11 bp, Unknown
  misc_feature (1)..( 11): Result.001 file - promoters70/5668435
ctatataaaac

SEQ ID NO: 88416 - DNA, 11 bp, Unknown
  misc_feature (1)..( 11): Result.001 file - promoters70/5668435
atagaagaaac

SEQ ID NO: 88417 - DNA, 12 bp, Unknown
  misc_feature (1)..( 12): Result.001 file - promoters70/5668435
cactatataaag

SEQ ID NO: 88418 - DNA, 12 bp, Unknown
  misc_feature (1)..( 12): Result.001 file - promoters70/5668435
tgtcttataaat

SEQ ID NO: 88419 - DNA, 12 bp, Unknown
  misc_feature (1)..( 12): Result.001 file - promoters70/5668435
cactatttaaag

SEQ ID NO: 88420 - DNA, 12 bp, Unknown
  misc_feature (1)..( 12): Result.001 file - promoters70/5668435
tactattaaagc

SEQ ID NO: 88421 - DNA, 12 bp, Unknown
  misc_feature (1)..( 12): Result.001 file - promoters70/5668435
tttaattaaaac

SEQ ID NO: 88422 - DNA, 12 bp, Unknown
  misc_feature (1)..( 12): Result.001 file - promoters70/5668454
gcttatttatga

SEQ ID NO: 88423 - DNA, 9 bp, Unknown
  misc_feature (1)..( 9): Result.001 file - promoters70/5668454
tcttaatta

SEQ ID NO: 88424 - DNA, 9 bp, Unknown
  misc_feature (1)..( 9): Result.001 file - promoters70/5668454
tcttaatct

SEQ ID NO: 88425 - DNA, 9 bp, Unknown
  misc_feature (1)..( 9): Result.001 file - promoters70/5668454
atttattta

SEQ ID NO: 88426 - DNA, 6 bp, Unknown
  misc_feature (1)..( 6): Result.001 file - promoters70/5668454
tctaaa

SEQ ID NO: 88427 - DNA, 6 bp, Unknown
  misc_feature (1)..( 6): Result.001 file - promoters70/5668454
tctaaa

SEQ ID NO: 88428 - DNA, 6 bp, Unknown
  misc_feature (1)..( 6): Result.001 file - promoters70/5668454
tctaaa

SEQ ID NO: 88429 - DNA, 8 bp, Unknown
  misc_feature (1)..( 8): Result.001 file - promoters70/5668454
aaaaataa

SEQ ID NO: 88430 - DNA, 8 bp, Unknown
  misc_feature (1)..( 8): Result.001 file - promoters70/5668454
aaaaattc

SEQ ID NO: 88431 - DNA, 8 bp, Unknown
  misc_feature (1)..( 8): Result.001 file - promoters70/5668469
taaaataa

SEQ ID NO: 88432 - DNA, 8 bp, Unknown
  misc_feature (1)..( 8): Result.001 file - promoters70/5668469
ataaaata

SEQ ID NO: 88433 - DNA, 8 bp, Unknown
  misc_feature (1)..( 8): Result.001 file - promoters70/5668469
atacaatt

SEQ ID NO: 88434 - DNA, 8 bp, Unknown
  misc_feature (1)..( 8): Result.001 file - promoters70/5668469
gtaaaata

SEQ ID NO: 88435 - DNA, 7 bp, Unknown
  misc_feature (1)..( 7): Result.001 file - promoters70/5668469
tttctta

SEQ ID NO: 88436 - DNA, 7 bp, Unknown
  misc_feature (1)..( 7): Result.001 file - promoters70/5668469
tttgtta

SEQ ID NO: 88437 - DNA, 7 bp, Unknown
  misc_feature (1)..( 7): Result.001 file - promoters70/5668493
tttatta

SEQ ID NO: 88438 - DNA, 9 bp, Unknown
  misc_feature (1)..( 9): Result.001 file - promoters70/5668493
aatcaatca

SEQ ID NO: 88439 - DNA, 9 bp, Unknown
  misc_feature (1)..( 9): Result.001 file - promoters70/5668493
aataaatgt

SEQ ID NO: 88440 - DNA, 9 bp, Unknown
  misc_feature (1)..( 9): Result.001 file - promoters70/5668493
catcaattt

SEQ ID NO: 88441 - DNA, 9 bp, Unknown
  misc_feature (1)..( 9): Result.001 file - promoters70/5668493
attaaatgt

SEQ ID NO: 88442 - DNA, 9 bp, Unknown
  misc_feature (1)..( 9): Result.001 file - promoters70/5668493
gtttgttta

SEQ ID NO: 88443 - DNA, 9 bp, Unknown
  misc_feature (1)..( 9): Result.001 file - promoters70/5668493
ttttatttg

SEQ ID NO: 88444 - DNA, 9 bp, Unknown
  misc_feature (1)..( 9): Result.001 file - promoters70/5668493
gtttgatta

SEQ ID NO: 88445 - DNA, 9 bp, Unknown
  misc_feature (1)..( 9): Result.001 file - promoters70/5668493
atttattta

SEQ ID NO: 88446 - DNA, 9 bp, Unknown
  misc_feature (1)..( 9): Result.001 file - promoters70/5668493
tacaataaa

SEQ ID NO: 88447 - DNA, 9 bp, Unknown
  misc_feature (1)..( 9): Result.001 file - promoters70/5668493
tacaatatt

SEQ ID NO: 88448 - DNA, 9 bp, Unknown
  misc_feature (1)..( 9): Result.001 file - promoters70/5668493
ttcaaaatt

SEQ ID NO: 88449 - DNA, 9 bp, Unknown
  misc_feature (1)..( 9): Result.001 file - promoters70/5668509
atcaatatg

SEQ ID NO: 88450 - DNA, 10 bp, Unknown
  misc_feature (1)..( 10): Result.001 file - promoters70/5668509
ttaaaaaaag

SEQ ID NO: 88451 - DNA, 10 bp, Unknown
  misc_feature (1)..( 10): Result.001 file - promoters70/5668509
ttaagaaaag

SEQ ID NO: 88452 - DNA, 10 bp, Unknown
  misc_feature (1)..( 10): Result.001 file - promoters70/5668509
agtagagaag

SEQ ID NO: 88453 - DNA, 8 bp, Unknown
  misc_feature (1)..( 8): Result.001 file - promoters70/5668509
ccacaaac

SEQ ID NO: 88454 - DNA, 8 bp, Unknown
  misc_feature (1)..( 8): Result.001 file - promoters70/5668509
ccaaaaaa

SEQ ID NO: 88455 - DNA, 9 bp, Unknown
  misc_feature (1)..( 9): Result.001 file - promoters70/5668509
gaaaataag

SEQ ID NO: 88456 - DNA, 7 bp, Unknown
  misc_feature (1)..( 7): Result.001 file - promoters70/5668509
agaagaa

SEQ ID NO: 88457 - DNA, 7 bp, Unknown
  misc_feature (1)..( 7): Result.001 file - promoters70/5668509
agaagat

SEQ ID NO: 88458 - DNA, 7 bp, Unknown
  misc_feature (1)..( 7): Result.001 file - promoters70/5668509
agaaaag

SEQ ID NO: 88459 - DNA, 7 bp, Unknown
  misc_feature (1)..( 7): Result.001 file - promoters70/5668509
agaggag

SEQ ID NO: 88460 - DNA, 7 bp, Unknown
  misc_feature (1)..( 7): Result.001 file - promoters70/5668509
tgaggag

SEQ ID NO: 88461 - DNA, 7 bp, Unknown
  misc_feature (1)..( 7): Result.001 file - promoters70/5668529
agaggat

SEQ ID NO: 88462 - DNA, 7 bp, Unknown
  misc_feature (1)..( 7): Result.001 file - promoters70/5668529
gttgact

SEQ ID NO: 88463 - DNA, 7 bp, Unknown
  misc_feature (1)..( 7): Result.001 file - promoters70/5668529
gttgact

SEQ ID NO: 88464 - DNA, 7 bp, Unknown
  misc_feature (1)..( 7): Result.001 file - promoters70/5668547
attgact

SEQ ID NO: 88465 - DNA, 7 bp, Unknown
  misc_feature (1)..( 7): Result.001 file - promoters70/5668547
gctaaaa

SEQ ID NO: 88466 - DNA, 7 bp, Unknown
  misc_feature (1)..( 7): Result.001 file - promoters70/5668547
gctgaaa

SEQ ID NO: 88467 - DNA, 7 bp, Unknown
  misc_feature (1)..( 7): Result.001 file - promoters70/5668720
tctgaaa

SEQ ID NO: 88468 - DNA, 11 bp, Unknown
  misc_feature (1)..( 11): Result.001 file - promoters70/5668720
acagacaccaa

SEQ ID NO: 88469 - DNA, 11 bp, Unknown
  misc_feature (1)..( 11): Result.001 file - promoters70/5668720
aaagaaacctg

SEQ ID NO: 88470 - DNA, 11 bp, Unknown
  misc_feature (1)..( 11): Result.001 file - promoters70/5668720
taagaaaaaaa

SEQ ID NO: 88471 - DNA, 11 bp, Unknown
  misc_feature (1)..( 11): Result.001 file - promoters70/5668720
gaagaaacaaa

SEQ ID NO: 88472 - DNA, 11 bp, Unknown
  misc_feature (1)..( 11): Result.001 file - promoters70/5668720
taagataaaat

SEQ ID NO: 88473 - DNA, 11 bp, Unknown
  misc_feature (1)..( 11): Result.001 file - promoters70/5668720
gatgaaatatt

SEQ ID NO: 88474 - DNA, 9 bp, Unknown
  misc_feature (1)..( 9): Result.001 file - promoters70/5668720
gcaaagttg

SEQ ID NO: 88475 - DNA, 9 bp, Unknown
  misc_feature (1)..( 9): Result.001 file - promoters70/5668720
aaaaagttt

SEQ ID NO: 88476 - DNA, 10 bp, Unknown
  misc_feature (1)..( 10): Result.001 file - promoters70/5668720
aaaatagttt

SEQ ID NO: 88477 - DNA, 10 bp, Unknown
  misc_feature (1)..( 10): Result.001 file - promoters70/5668720
aaaaaagtgt

SEQ ID NO: 88478 - DNA, 10 bp, Unknown
  misc_feature (1)..( 10): Result.001 file - promoters70/5668720
tgaaatgttt

SEQ ID NO: 88479 - DNA, 10 bp, Unknown
  misc_feature (1)..( 10): Result.001 file - promoters70/5668720
acaaattttt

SEQ ID NO: 88480 - DNA, 13 bp, Unknown
  misc_feature (1)..( 13): Result.001 file - promoters70/5668720
acttttgtttttg

SEQ ID NO: 88481 - DNA, 13 bp, Unknown
  misc_feature (1)..( 13): Result.001 file - promoters70/5668720
acttttttttttt

SEQ ID NO: 88482 - DNA, 13 bp, Unknown
  misc_feature (1)..( 13): Result.001 file - promoters70/5668720
gtttttgtctatc

SEQ ID NO: 88483 - DNA, 13 bp, Unknown
  misc_feature (1)..( 13): Result.001 file - promoters70/5668720
gaaattgtttcga

SEQ ID NO: 88484 - DNA, 13 bp, Unknown
  misc_feature (1)..( 13): Result.001 file - promoters70/5668720
ttccatgtttttg

SEQ ID NO: 88485 - DNA, 13 bp, Unknown
  misc_feature (1)..( 13): Result.001 file - promoters70/5668897
tgatttgtatttg

SEQ ID NO: 88486 - DNA, 9 bp, Unknown
  misc_feature (1)..( 9): Result.001 file - promoters70/5668897
ctgtgtttt

SEQ ID NO: 88487 - DNA, 9 bp, Unknown
  misc_feature (1)..( 9): Result.001 file - promoters70/5668897
atgtttttt

SEQ ID NO: 88488 - DNA, 9 bp, Unknown
  misc_feature (1)..( 9): Result.001 file - promoters70/5668903
atgttttag

SEQ ID NO: 88489 - DNA, 8 bp, Unknown
  misc_feature (1)..( 8): Result.001 file - promoters70/5668903
agacttta

SEQ ID NO: 88490 - DNA, 8 bp, Unknown
  misc_feature (1)..( 8): Result.001 file - promoters70/5668903
agaatttg

SEQ ID NO: 88491 - DNA, 8 bp, Unknown
  misc_feature (1)..( 8): Result.001 file - promoters70/5668903
cgaatttg

SEQ ID NO: 88492 - DNA, 9 bp, Unknown
  misc_feature (1)..( 9): Result.001 file - promoters70/5668903
tttaatttg

SEQ ID NO: 88493 - DNA, 9 bp, Unknown
  misc_feature (1)..( 9): Result.001 file - promoters70/5668903
tttgattgt

SEQ ID NO: 88494 - DNA, 9 bp, Unknown
  misc_feature (1)..( 9): Result.001 file - promoters70/5668926
tttcatttg

SEQ ID NO: 88495 - DNA, 8 bp, Unknown
  misc_feature (1)..( 8): Result.001 file - promoters70/5668926
catttaaa

SEQ ID NO: 88496 - DNA, 8 bp, Unknown
  misc_feature (1)..( 8): Result.001 file - promoters70/5668926
gatttaat

SEQ ID NO: 88497 - DNA, 8 bp, Unknown
  misc_feature (1)..( 8): Result.001 file - promoters70/5668926
cattaaaa

SEQ ID NO: 88498 - DNA, 12 bp, Unknown
  misc_feature (1)..( 12): Result.001 file - promoters70/5668926
caaactgtgaaa

SEQ ID NO: 88499 - DNA, 12 bp, Unknown
  misc_feature (1)..( 12): Result.001 file - promoters70/5668926
aaaaatgtgaaa

SEQ ID NO: 88500 - DNA, 12 bp, Unknown
  misc_feature (1)..( 12): Result.001 file - promoters70/5668926
aaaaataatttt

SEQ ID NO: 88501 - DNA, 11 bp, Unknown
  misc_feature (1)..( 11): Result.001 file - promoters70/5668926
ccaaatttggt

SEQ ID NO: 88502 - DNA, 11 bp, Unknown
  misc_feature (1)..( 11): Result.001 file - promoters70/5668926
ccaattttaag

SEQ ID NO: 88503 - DNA, 11 bp, Unknown
  misc_feature (1)..( 11): Result.001 file - promoters70/5668974
attattctaag

SEQ ID NO: 88504 - DNA, 8 bp, Unknown
  misc_feature (1)..( 8): Result.001 file - promoters70/5668974
aaaactaa

SEQ ID NO: 88505 - DNA, 8 bp, Unknown
  misc_feature (1)..( 8): Result.001 file - promoters70/5668974
aaaattaa

SEQ ID NO: 88506 - DNA, 9 bp, Unknown
  misc_feature (1)..( 9): Result.001 file - promoters70/5668974
aaaacctac

SEQ ID NO: 88507 - DNA, 10 bp, Unknown
  misc_feature (1)..( 10): Result.001 file - promoters70/5668974
caatattttg

SEQ ID NO: 88508 - DNA, 10 bp, Unknown
  misc_feature (1)..( 10): Result.001 file - promoters70/5668974
caattttttt

SEQ ID NO: 88509 - DNA, 10 bp, Unknown
  misc_feature (1)..( 10): Result.001 file - promoters70/5668974
tgtttttttt

SEQ ID NO: 88510 - DNA, 9 bp, Unknown
  misc_feature (1)..( 9): Result.001 file - promoters70/5668974
gatatatta

SEQ ID NO: 88511 - DNA, 9 bp, Unknown
  misc_feature (1)..( 9): Result.001 file - promoters70/5668974
aatatttta

SEQ ID NO: 88512 - DNA, 9 bp, Unknown
  misc_feature (1)..( 9): Result.001 file - promoters70/5668974
aatattttc

SEQ ID NO: 88513 - DNA, 11 bp, Unknown
  misc_feature (1)..( 11): Result.001 file - promoters70/5668974
aactaaaccag

SEQ ID NO: 88514 - DNA, 11 bp, Unknown
  misc_feature (1)..( 11): Result.001 file - promoters70/5668974
cactaaaacag

SEQ ID NO: 88515 - DNA, 11 bp, Unknown
  misc_feature (1)..( 11): Result.001 file - promoters70/5668990
cacaaaaaaga

SEQ ID NO: 88516 - DNA, 8 bp, Unknown
  misc_feature (1)..( 8): Result.001 file - promoters70/5668990
cgtagtat

SEQ ID NO: 88517 - DNA, 8 bp, Unknown
  misc_feature (1)..( 8): Result.001 file - promoters70/5668990
tgtagtat

SEQ ID NO: 88518 - DNA, 8 bp, Unknown
  misc_feature (1)..( 8): Result.001 file - promoters70/5669025
cgtggtag

SEQ ID NO: 88519 - DNA, 8 bp, Unknown
  misc_feature (1)..( 8): Result.001 file - promoters70/5669025
taagttta

SEQ ID NO: 88520 - DNA, 8 bp, Unknown
  misc_feature (1)..( 8): Result.001 file - promoters70/5669025
gaagtttc

SEQ ID NO: 88521 - DNA, 8 bp, Unknown
  misc_feature (1)..( 8): Result.001 file - promoters70/5669025
taatttta

SEQ ID NO: 88522 - DNA, 8 bp, Unknown
  misc_feature (1)..( 8): Result.001 file - promoters70/5669025
atagttta

SEQ ID NO: 88523 - DNA, 8 bp, Unknown
  misc_feature (1)..( 8): Result.001 file - promoters70/5669025
aaaggttc

SEQ ID NO: 88524 - DNA, 8 bp, Unknown
  misc_feature (1)..( 8): Result.001 file - promoters70/5669025
atattttt

SEQ ID NO: 88525 - DNA, 16 bp, Unknown
  misc_feature (1)..( 16): Result.001 file - promoters70/5669025
gtacataaaacaaaaa

SEQ ID NO: 88526 - DNA, 16 bp, Unknown
  misc_feature (1)..( 16): Result.001 file - promoters70/5669025
ttacaaaaaaaaaaaa

SEQ ID NO: 88527 - DNA, 16 bp, Unknown
  misc_feature (1)..( 16): Result.001 file - promoters70/5669025
atcacaagaactaaac

SEQ ID NO: 88528 - DNA, 16 bp, Unknown
  misc_feature (1)..( 16): Result.001 file - promoters70/5669025
aatggtaacacacaag

SEQ ID NO: 88529 - DNA, 16 bp, Unknown
  misc_feature (1)..( 16): Result.001 file - promoters70/5669025
tgacataaagatgaca

SEQ ID NO: 88530 - DNA, 16 bp, Unknown
  misc_feature (1)..( 16): Result.001 file - promoters70/5669025
ttactaaaagttttac

SEQ ID NO: 88531 - DNA, 16 bp, Unknown
  misc_feature (1)..( 16): Result.001 file - promoters70/5669250
ttactaaggtgtgttt

SEQ ID NO: 88532 - DNA, 12 bp, Unknown
  misc_feature (1)..( 12): Result.001 file - promoters70/5669250
aaataaatatct

SEQ ID NO: 88533 - DNA, 12 bp, Unknown
  misc_feature (1)..( 12): Result.001 file - promoters70/5669250
aaaaaaattcca

SEQ ID NO: 88534 - DNA, 12 bp, Unknown
  misc_feature (1)..( 12): Result.001 file - promoters70/5669250
aattaaattaat

SEQ ID NO: 88535 - DNA, 11 bp, Unknown
  misc_feature (1)..( 11): Result.001 file - promoters70/5669250
aaatatctata

SEQ ID NO: 88536 - DNA, 11 bp, Unknown
  misc_feature (1)..( 11): Result.001 file - promoters70/5669250
ccatagctaga

SEQ ID NO: 88537 - DNA, 11 bp, Unknown
  misc_feature (1)..( 11): Result.001 file - promoters70/5669250
aaatttctaga

SEQ ID NO: 88538 - DNA, 11 bp, Unknown
  misc_feature (1)..( 11): Result.001 file - promoters70/5669250
gattttataga

SEQ ID NO: 88539 - DNA, 9 bp, Unknown
  misc_feature (1)..( 9): Result.001 file - promoters70/5669250
aaggcccaa

SEQ ID NO: 88540 - DNA, 9 bp, Unknown
  misc_feature (1)..( 9): Result.001 file - promoters70/5669250
aaggcccaa

SEQ ID NO: 88541 - DNA, 9 bp, Unknown
  misc_feature (1)..( 9): Result.001 file - promoters70/5669250
tcggcccat

SEQ ID NO: 88542 - DNA, 8 bp, Unknown
  misc_feature (1)..( 8): Result.001 file - promoters70/5669250
agtataaa

SEQ ID NO: 88543 - DNA, 8 bp, Unknown
  misc_feature (1)..( 8): Result.001 file - promoters70/5669250
actataaa

SEQ ID NO: 88544 - DNA, 8 bp, Unknown
  misc_feature (1)..( 8): Result.001 file - promoters70/5669508
tatataaa

SEQ ID NO: 88545 - DNA, 8 bp, Unknown
  misc_feature (1)..( 8): Result.001 file - promoters70/5669508
gaaagaaa

SEQ ID NO: 88546 - DNA, 8 bp, Unknown
  misc_feature (1)..( 8): Result.001 file - promoters70/5669508
aaaacaaa

SEQ ID NO: 88547 - DNA, 8 bp, Unknown
  misc_feature (1)..( 8): Result.001 file - promoters70/5669508
gagagaga

SEQ ID NO: 88548 - DNA, 8 bp, Unknown
  misc_feature (1)..( 8): Result.001 file - promoters70/5669508
taaataaa

SEQ ID NO: 88549 - DNA, 8 bp, Unknown
  misc_feature (1)..( 8): Result.001 file - promoters70/5669508
ttaacaaa

SEQ ID NO: 88550 - DNA, 8 bp, Unknown
  misc_feature (1)..( 8): Result.001 file - promoters70/5669508
ctaacaac

SEQ ID NO: 88551 - DNA, 8 bp, Unknown
  misc_feature (1)..( 8): Result.001 file - promoters70/5669546
taaataat

SEQ ID NO: 88552 - DNA, 8 bp, Unknown
  misc_feature (1)..( 8): Result.001 file - promoters70/5669546
cgacatgt

SEQ ID NO: 88553 - DNA, 8 bp, Unknown
  misc_feature (1)..( 8): Result.001 file - promoters70/5669546
cgacatgt

SEQ ID NO: 88554 - DNA, 8 bp, Unknown
  misc_feature (1)..( 8): Result.001 file - promoters70/5670592
acacatgt

SEQ ID NO: 88555 - DNA, 11 bp, Unknown
  misc_feature (1)..( 11): Result.001 file - promoters70/5670592
tatacagactt

SEQ ID NO: 88556 - DNA, 11 bp, Unknown
  misc_feature (1)..( 11): Result.001 file - promoters70/5670592
aatacaaactt

SEQ ID NO: 88557 - DNA, 11 bp, Unknown
  misc_feature (1)..( 11): Result.001 file - promoters70/5670592
aatagagaact

SEQ ID NO: 88558 - DNA, 11 bp, Unknown
  misc_feature (1)..( 11): Result.001 file - promoters70/5670592
gttacaaatct

SEQ ID NO: 88559 - DNA, 11 bp, Unknown
  misc_feature (1)..( 11): Result.001 file - promoters70/5670592
tataaaaacac

SEQ ID NO: 88560 - DNA, 11 bp, Unknown
  misc_feature (1)..( 11): Result.001 file - promoters70/5670592
ctaccaaactg

SEQ ID NO: 88561 - DNA, 11 bp, Unknown
  misc_feature (1)..( 11): Result.001 file - promoters70/5670592
aatagtgaaat

SEQ ID NO: 88562 - DNA, 12 bp, Unknown
  misc_feature (1)..( 12): Result.001 file - promoters70/5670592
agaaatataaat

SEQ ID NO: 88563 - DNA, 12 bp, Unknown
  misc_feature (1)..( 12): Result.001 file - promoters70/5670592
ataaatatcttt

SEQ ID NO: 88564 - DNA, 12 bp, Unknown
  misc_feature (1)..( 12): Result.001 file - promoters70/5670592
agagatataaat

SEQ ID NO: 88565 - DNA, 12 bp, Unknown
  misc_feature (1)..( 12): Result.001 file - promoters70/5670592
tttgatatacag

SEQ ID NO: 88566 - DNA, 12 bp, Unknown
  misc_feature (1)..( 12): Result.001 file - promoters70/5670592
agacatatatac

SEQ ID NO: 88567 - DNA, 12 bp, Unknown
  misc_feature (1)..( 12): Result.001 file - promoters70/5670592
gctactataaat

SEQ ID NO: 88568 - DNA, 10 bp, Unknown
  misc_feature (1)..( 10): Result.001 file - promoters70/5670592
tgacaaaaac

SEQ ID NO: 88569 - DNA, 10 bp, Unknown
  misc_feature (1)..( 10): Result.001 file - promoters70/5670592
tgacataaag

SEQ ID NO: 88570 - DNA, 10 bp, Unknown
  misc_feature (1)..( 10): Result.001 file - promoters70/5670592
aaacataaca

SEQ ID NO: 88571 - DNA, 10 bp, Unknown
  misc_feature (1)..( 10): Result.001 file - promoters70/5670592
tcgaataaag

SEQ ID NO: 88572 - DNA, 10 bp, Unknown
  misc_feature (1)..( 10): Result.001 file - promoters70/5670592
atccatgaag

SEQ ID NO: 88573 - DNA, 10 bp, Unknown
  misc_feature (1)..( 10): Result.001 file - promoters70/5671204
atatatgaag

SEQ ID NO: 88574 - DNA, 11 bp, Unknown
  misc_feature (1)..( 11): Result.001 file - promoters70/5671204
gtatatatata

SEQ ID NO: 88575 - DNA, 11 bp, Unknown
  misc_feature (1)..( 11): Result.001 file - promoters70/5671204
atatttatata

SEQ ID NO: 88576 - DNA, 11 bp, Unknown
  misc_feature (1)..( 11): Result.001 file - promoters70/5671204
gaccctatata

SEQ ID NO: 88577 - DNA, 11 bp, Unknown
  misc_feature (1)..( 11): Result.001 file - promoters70/5671204
ctatttaaagc

SEQ ID NO: 88578 - DNA, 11 bp, Unknown
  misc_feature (1)..( 11): Result.001 file - promoters70/5671204
atatttgtatc

SEQ ID NO: 88579 - DNA, 11 bp, Unknown
  misc_feature (1)..( 11): Result.001 file - promoters70/5671204
taatataaagg

SEQ ID NO: 88580 - DNA, 11 bp, Unknown
  misc_feature (1)..( 11): Result.001 file - promoters70/5671204
ccatataaatt

SEQ ID NO: 88581 - DNA, 10 bp, Unknown
  misc_feature (1)..( 10): Result.001 file - promoters70/5671204
aaactaaaac

SEQ ID NO: 88582 - DNA, 10 bp, Unknown
  misc_feature (1)..( 10): Result.001 file - promoters70/5671204
gaacaaaaaa

SEQ ID NO: 88583 - DNA, 10 bp, Unknown
  misc_feature (1)..( 10): Result.001 file - promoters70/5671204
aaaccaaact

SEQ ID NO: 88584 - DNA, 10 bp, Unknown
  misc_feature (1)..( 10): Result.001 file - promoters70/5671204
tcactaaaaa

SEQ ID NO: 88585 - DNA, 10 bp, Unknown
  misc_feature (1)..( 10): Result.001 file - promoters70/5671204
tgaccaaaca

SEQ ID NO: 88586 - DNA, 10 bp, Unknown
  misc_feature (1)..( 10): Result.001 file - promoters70/5671204
acacacaaag

SEQ ID NO: 88587 - DNA, 9 bp, Unknown
  misc_feature (1)..( 9): Result.001 file - promoters70/5671318
tctcaaacc

SEQ ID NO: 88588 - DNA, 11 bp, Unknown
  misc_feature (1)..( 11): Result.001 file - promoters70/5671318
ttttaaattat

SEQ ID NO: 88589 - DNA, 11 bp, Unknown
  misc_feature (1)..( 11): Result.001 file - promoters70/5671318
ccttatatttc

SEQ ID NO: 88590 - DNA, 11 bp, Unknown
  misc_feature (1)..( 11): Result.001 file - promoters70/5671318
aattaaataaa

SEQ ID NO: 88591 - DNA, 11 bp, Unknown
  misc_feature (1)..( 11): Result.001 file - promoters70/5671318
ctttaaaatag

SEQ ID NO: 88592 - DNA, 11 bp, Unknown
  misc_feature (1)..( 11): Result.001 file - promoters70/5671318
ttataaaattg

SEQ ID NO: 88593 - DNA, 11 bp, Unknown
  misc_feature (1)..( 11): Result.001 file - promoters70/5671318
gactaaagaaa

SEQ ID NO: 88594 - DNA, 11 bp, Unknown
  misc_feature (1)..( 11): Result.001 file - promoters70/5671318
acggataattc

SEQ ID NO: 88595 - DNA, 11 bp, Unknown
  misc_feature (1)..( 11): Result.001 file - promoters70/5671318
acgtataattt

SEQ ID NO: 88596 - DNA, 11 bp, Unknown
  misc_feature (1)..( 11): Result.001 file - promoters70/5671318
ttggaaaattt

SEQ ID NO: 88597 - DNA, 11 bp, Unknown
  misc_feature (1)..( 11): Result.001 file - promoters70/5671318
ctgcatatttt

SEQ ID NO: 88598 - DNA, 11 bp, Unknown
  misc_feature (1)..( 11): Result.001 file - promoters70/5671318
caaaaaaattc

SEQ ID NO: 88599 - DNA, 11 bp, Unknown
  misc_feature (1)..( 11): Result.001 file - promoters70/5671318
aaacaaaaaat

SEQ ID NO: 88600 - DNA, 11 bp, Unknown
  misc_feature (1)..( 11): Result.001 file - promoters70/5671318
gaattaaaatc

SEQ ID NO: 88601 - DNA, 11 bp, Unknown
  misc_feature (1)..( 11): Result.001 file - promoters70/5671318
gagttataatg

SEQ ID NO: 88602 - DNA, 11 bp, Unknown
  misc_feature (1)..( 11): Result.001 file - promoters70/5671318
tgattaaattt

SEQ ID NO: 88603 - DNA, 11 bp, Unknown
  misc_feature (1)..( 11): Result.001 file - promoters70/5671318
ttgttacaatg

SEQ ID NO: 88604 - DNA, 11 bp, Unknown
  misc_feature (1)..( 11): Result.001 file - promoters70/5671318
tgattaatttc

SEQ ID NO: 88605 - DNA, 11 bp, Unknown
  misc_feature (1)..( 11): Result.001 file - promoters70/5671318
ttattaatacc

SEQ ID NO: 88606 - DNA, 11 bp, Unknown
  misc_feature (1)..( 11): Result.001 file - promoters70/5671318
aaaatttaaat

SEQ ID NO: 88607 - DNA, 11 bp, Unknown
  misc_feature (1)..( 11): Result.001 file - promoters70/5671318
ataatctaata

SEQ ID NO: 88608 - DNA, 11 bp, Unknown
  misc_feature (1)..( 11): Result.001 file - promoters70/5671318
ggaatttatgt

SEQ ID NO: 88609 - DNA, 11 bp, Unknown
  misc_feature (1)..( 11): Result.001 file - promoters70/5671318
cgaatttaata

SEQ ID NO: 88610 - DNA, 11 bp, Unknown
  misc_feature (1)..( 11): Result.001 file - promoters70/5671318
atagtcttaaa

SEQ ID NO: 88611 - DNA, 11 bp, Unknown
  misc_feature (1)..( 11): Result.001 file - promoters70/5671318
actatttgata

SEQ ID NO: 88612 - DNA, 11 bp, Unknown
  misc_feature (1)..( 11): Result.001 file - promoters70/5672093
ttcatttatcc

SEQ ID NO: 88613 - DNA, 10 bp, Unknown
  misc_feature (1)..( 10): Result.001 file - promoters70/5672093
ttttcttcac

SEQ ID NO: 88614 - DNA, 10 bp, Unknown
  misc_feature (1)..( 10): Result.001 file - promoters70/5672093
tttgcttctt

SEQ ID NO: 88615 - DNA, 10 bp, Unknown
  misc_feature (1)..( 10): Result.001 file - promoters70/5672093
tttgctgatg

SEQ ID NO: 88616 - DNA, 10 bp, Unknown
  misc_feature (1)..( 10): Result.001 file - promoters70/5672093
tttgatgatt

SEQ ID NO: 88617 - DNA, 10 bp, Unknown
  misc_feature (1)..( 10): Result.001 file - promoters70/5672842
atggattatt

SEQ ID NO: 88618 - DNA, 12 bp, Unknown
  misc_feature (1)..( 12): Result.001 file - promoters70/5672842
ctaaattacttt

SEQ ID NO: 88619 - DNA, 12 bp, Unknown
  misc_feature (1)..( 12): Result.001 file - promoters70/5672842
atcaaatacttt

SEQ ID NO: 88620 - DNA, 12 bp, Unknown
  misc_feature (1)..( 12): Result.001 file - promoters70/5672842
aaaaaaaacttt

SEQ ID NO: 88621 - DNA, 12 bp, Unknown
  misc_feature (1)..( 12): Result.001 file - promoters70/5672842
aaaagaaacgaa

SEQ ID NO: 88622 - DNA, 11 bp, Unknown
  misc_feature (1)..( 11): Result.001 file - promoters70/5672842
tttgccactct

SEQ ID NO: 88623 - DNA, 11 bp, Unknown
  misc_feature (1)..( 11): Result.001 file - promoters70/5672842
tttaccacacg

SEQ ID NO: 88624 - DNA, 11 bp, Unknown
  misc_feature (1)..( 11): Result.001 file - promoters70/5672842
attggcactct

SEQ ID NO: 88625 - DNA, 11 bp, Unknown
  misc_feature (1)..( 11): Result.001 file - promoters70/5672842
aactagtgacg

SEQ ID NO: 88626 - DNA, 11 bp, Unknown
  misc_feature (1)..( 11): Result.001 file - promoters70/5672842
gcctaatgaat

SEQ ID NO: 88627 - DNA, 11 bp, Unknown
  misc_feature (1)..( 11): Result.001 file - promoters70/5672842
gcccaataaat

SEQ ID NO: 88628 - DNA, 11 bp, Unknown
  misc_feature (1)..( 11): Result.001 file - promoters70/5673124
gcccaatttca

SEQ ID NO: 88629 - DNA, 10 bp, Unknown
  misc_feature (1)..( 10): Result.001 file - promoters70/5673124
ggtttatttt

SEQ ID NO: 88630 - DNA, 10 bp, Unknown
  misc_feature (1)..( 10): Result.001 file - promoters70/5673124
ggtttattca

SEQ ID NO: 88631 - DNA, 10 bp, Unknown
  misc_feature (1)..( 10): Result.001 file - promoters70/5674194
attttatttt

SEQ ID NO: 88632 - DNA, 12 bp, Unknown
  misc_feature (1)..( 12): Result.001 file - promoters70/5674194
taagtttaagtt

SEQ ID NO: 88633 - DNA, 12 bp, Unknown
  misc_feature (1)..( 12): Result.001 file - promoters70/5674194
gaagtttctggt

SEQ ID NO: 88634 - DNA, 12 bp, Unknown
  misc_feature (1)..( 12): Result.001 file - promoters70/5674194
aaagtttgatat

SEQ ID NO: 88635 - DNA, 12 bp, Unknown
  misc_feature (1)..( 12): Result.001 file - promoters70/5674194
taattttatata

SEQ ID NO: 88636 - DNA, 12 bp, Unknown
  misc_feature (1)..( 12): Result.001 file - promoters70/5674194
tctttttgatat

SEQ ID NO: 88637 - DNA, 12 bp, Unknown
  misc_feature (1)..( 12): Result.001 file - promoters70/5674194
aaagttgattaa

SEQ ID NO: 88638 - DNA, 12 bp, Unknown
  misc_feature (1)..( 12): Result.001 file - promoters70/5674194
cctttttgtatc

SEQ ID NO: 88639 - DNA, 12 bp, Unknown
  misc_feature (1)..( 12): Result.001 file - promoters70/5674194
catattgagagg

SEQ ID NO: 88640 - DNA, 12 bp, Unknown
  misc_feature (1)..( 12): Result.001 file - promoters70/5674194
ttgattgatagg

SEQ ID NO: 88641 - DNA, 12 bp, Unknown
  misc_feature (1)..( 12): Result.001 file - promoters70/5674194
gtctttgttagt

SEQ ID NO: 88642 - DNA, 12 bp, Unknown
  misc_feature (1)..( 12): Result.001 file - promoters70/5674194
ctttttgttcta

SEQ ID NO: 88643 - DNA, 12 bp, Unknown
  misc_feature (1)..( 12): Result.001 file - promoters70/5674194
ctttttgtatca

SEQ ID NO: 88644 - DNA, 12 bp, Unknown
  misc_feature (1)..( 12): Result.001 file - promoters70/5674194
acatttggtaca

SEQ ID NO: 88645 - DNA, 17 bp, Unknown
  misc_feature (1)..( 17): Result.001 file - promoters70/5674194
cagacatatatacttag

SEQ ID NO: 88646 - DNA, 17 bp, Unknown
  misc_feature (1)..( 17): Result.001 file - promoters70/5674194
tatatttatatagataa

SEQ ID NO: 88647 - DNA, 17 bp, Unknown
  misc_feature (1)..( 17): Result.001 file - promoters70/5674194
aaaaaaaatatttgtat

SEQ ID NO: 88648 - DNA, 17 bp, Unknown
  misc_feature (1)..( 17): Result.001 file - promoters70/5674194
accctatataaagataa

SEQ ID NO: 88649 - DNA, 17 bp, Unknown
  misc_feature (1)..( 17): Result.001 file - promoters70/5674194
gtataatataaaggtcc

SEQ ID NO: 88650 - DNA, 17 bp, Unknown
  misc_feature (1)..( 17): Result.001 file - promoters70/5674194
agagaataaaaggtctt

SEQ ID NO: 88651 - DNA, 10 bp, Unknown
  misc_feature (1)..( 10): Result.001 file - promoters70/5674194
taatcttttg

SEQ ID NO: 88652 - DNA, 10 bp, Unknown
  misc_feature (1)..( 10): Result.001 file - promoters70/5674194
taattttttt

SEQ ID NO: 88653 - DNA, 10 bp, Unknown
  misc_feature (1)..( 10): Result.001 file - promoters70/5674194
taatgttttt

SEQ ID NO: 88654 - DNA, 10 bp, Unknown
  misc_feature (1)..( 10): Result.001 file - promoters70/5674194
aactcttttg

SEQ ID NO: 88655 - DNA, 10 bp, Unknown
  misc_feature (1)..( 10): Result.001 file - promoters70/5674194
tcatttttct

SEQ ID NO: 88656 - DNA, 10 bp, Unknown
  misc_feature (1)..( 10): Result.001 file - promoters70/5674194
ggatgttttt

SEQ ID NO: 88657 - DNA, 8 bp, Unknown
  misc_feature (1)..( 8): Result.001 file - promoters70/5674194
aaatattc

SEQ ID NO: 88658 - DNA, 8 bp, Unknown
  misc_feature (1)..( 8): Result.001 file - promoters70/5674194
aaatatcg

SEQ ID NO: 88659 - DNA, 8 bp, Unknown
  misc_feature (1)..( 8): Result.001 file - promoters70/5674194
aaatattt

SEQ ID NO: 88660 - DNA, 8 bp, Unknown
  misc_feature (1)..( 8): Result.001 file - promoters70/5674194
aaaaatta

SEQ ID NO: 88661 - DNA, 8 bp, Unknown
  misc_feature (1)..( 8): Result.001 file - promoters70/5674194
aaaaaaaa

SEQ ID NO: 88662 - DNA, 8 bp, Unknown
  misc_feature (1)..( 8): Result.001 file - promoters70/5674194
aaagaaaa

SEQ ID NO: 88663 - DNA, 11 bp, Unknown
  misc_feature (1)..( 11): Result.001 file - promoters70/5674194
cgatttgttag

SEQ ID NO: 88664 - DNA, 11 bp, Unknown
  misc_feature (1)..( 11): Result.001 file - promoters70/5674194
agtttttttag

SEQ ID NO: 88665 - DNA, 11 bp, Unknown
  misc_feature (1)..( 11): Result.001 file - promoters70/5674194
ctttttgttgt

SEQ ID NO: 88666 - DNA, 11 bp, Unknown
  misc_feature (1)..( 11): Result.001 file - promoters70/5674194
gtttttgtcta

SEQ ID NO: 88667 - DNA, 11 bp, Unknown
  misc_feature (1)..( 11): Result.001 file - promoters70/5674194
ttttatgtttc

SEQ ID NO: 88668 - DNA, 12 bp, Unknown
  misc_feature (1)..( 12): Result.001 file - promoters70/5674194
ttttactttttt

SEQ ID NO: 88669 - DNA, 11 bp, Unknown
  misc_feature (1)..( 11): Result.001 file - promoters70/5674194
tttattgttac

SEQ ID NO: 88670 - DNA, 11 bp, Unknown
  misc_feature (1)..( 11): Result.001 file - promoters70/5674194
gtctttgttag

SEQ ID NO: 88671 - DNA, 11 bp, Unknown
  misc_feature (1)..( 11): Result.001 file - promoters70/5674194
ttgattgatag

SEQ ID NO: 88672 - DNA, 11 bp, Unknown
  misc_feature (1)..( 11): Result.001 file - promoters70/5674194
ctttttgttct

SEQ ID NO: 88673 - DNA, 11 bp, Unknown
  misc_feature (1)..( 11): Result.001 file - promoters70/5674194
ctttttgtatc

SEQ ID NO: 88674 - DNA, 11 bp, Unknown
  misc_feature (1)..( 11): Result.001 file - promoters70/5674634
acatttggtac

SEQ ID NO: 88675 - DNA, 12 bp, Unknown
  misc_feature (1)..( 12): Result.001 file - promoters70/5674634
gggaaaatgaat

SEQ ID NO: 88676 - DNA, 12 bp, Unknown
  misc_feature (1)..( 12): Result.001 file - promoters70/5674634
aaaaaaacgaat

SEQ ID NO: 88677 - DNA, 12 bp, Unknown
  misc_feature (1)..( 12): Result.001 file - promoters70/5674634
attaaaatggta

SEQ ID NO: 88678 - DNA, 12 bp, Unknown
  misc_feature (1)..( 12): Result.001 file - promoters70/5674634
tatcaaacaaat

SEQ ID NO: 88679 - DNA, 12 bp, Unknown
  misc_feature (1)..( 12): Result.001 file - promoters70/5674634
gagaaaaaaagt

SEQ ID NO: 88680 - DNA, 12 bp, Unknown
  misc_feature (1)..( 12): Result.001 file - promoters70/5674666
gagaaaaagagg

SEQ ID NO: 88681 - DNA, 9 bp, Unknown
  misc_feature (1)..( 9): Result.001 file - promoters70/5674666
aaaaattat

SEQ ID NO: 88682 - DNA, 9 bp, Unknown
  misc_feature (1)..( 9): Result.001 file - promoters70/5674666
aaagattgt

SEQ ID NO: 88683 - DNA, 9 bp, Unknown
  misc_feature (1)..( 9): Result.001 file - promoters70/5674666
gtaaattag

SEQ ID NO: 88684 - DNA, 9 bp, Unknown
  misc_feature (1)..( 9): Result.001 file - promoters70/5674666
ggagagtgt

SEQ ID NO: 88685 - DNA, 9 bp, Unknown
  misc_feature (1)..( 9): Result.001 file - promoters70/5674666
aaaaattca

SEQ ID NO: 88686 - DNA, 9 bp, Unknown
  misc_feature (1)..( 9): Result.001 file - promoters70/5674666
aaatatttt

SEQ ID NO: 88687 - DNA, 10 bp, Unknown
  misc_feature (1)..( 10): Result.001 file - promoters70/5674666
attctttcaa

SEQ ID NO: 88688 - DNA, 10 bp, Unknown
  misc_feature (1)..( 10): Result.001 file - promoters70/5674666
attcttacaa

SEQ ID NO: 88689 - DNA, 10 bp, Unknown
  misc_feature (1)..( 10): Result.001 file - promoters70/5674666
attgttttgg

SEQ ID NO: 88690 - DNA, 10 bp, Unknown
  misc_feature (1)..( 10): Result.001 file - promoters70/5674666
agttttacaa

SEQ ID NO: 88691 - DNA, 10 bp, Unknown
  misc_feature (1)..( 10): Result.001 file - promoters70/5674666
gattttacat

SEQ ID NO: 88692 - DNA, 10 bp, Unknown
  misc_feature (1)..( 10): Result.001 file - promoters70/5674666
aagcttacac

SEQ ID NO: 88693 - DNA, 10 bp, Unknown
  misc_feature (1)..( 10): Result.001 file - promoters70/5675661
attttaaata

SEQ ID NO: 88694 - DNA, 9 bp, Unknown
  misc_feature (1)..( 9): Result.001 file - promoters70/5675661
ggttaattc

SEQ ID NO: 88695 - DNA, 9 bp, Unknown
  misc_feature (1)..( 9): Result.001 file - promoters70/5675661
ggttgattt

SEQ ID NO: 88696 - DNA, 9 bp, Unknown
  misc_feature (1)..( 9): Result.001 file - promoters70/5675661
atttgattt

SEQ ID NO: 88697 - DNA, 9 bp, Unknown
  misc_feature (1)..( 9): Result.001 file - promoters70/5675661
ttttgatgg

SEQ ID NO: 88698 - DNA, 8 bp, Unknown
  misc_feature (1)..( 8): Result.001 file - promoters70/5675661
aaaagttt

SEQ ID NO: 88699 - DNA, 8 bp, Unknown
  misc_feature (1)..( 8): Result.001 file - promoters70/5675661
caaagttg

SEQ ID NO: 88700 - DNA, 8 bp, Unknown
  misc_feature (1)..( 8): Result.001 file - promoters70/5675661
caaatttg

SEQ ID NO: 88701 - DNA, 8 bp, Unknown
  misc_feature (1)..( 8): Result.001 file - promoters70/5675661
caattttt

SEQ ID NO: 88702 - DNA, 8 bp, Unknown
  misc_feature (1)..( 8): Result.001 file - promoters70/5675661
gaaagatt

SEQ ID NO: 88703 - DNA, 8 bp, Unknown
  misc_feature (1)..( 8): Result.001 file - promoters70/5675661
aaaagatt

SEQ ID NO: 88704 - DNA, 8 bp, Unknown
  misc_feature (1)..( 8): Result.001 file - promoters70/5675661
aaaagaga

SEQ ID NO: 88705 - DNA, 8 bp, Unknown
  misc_feature (1)..( 8): Result.001 file - promoters70/5675661
aaaagaaa

SEQ ID NO: 88706 - DNA, 8 bp, Unknown
  misc_feature (1)..( 8): Result.001 file - promoters70/5675661
tagaataa

SEQ ID NO: 88707 - DNA, 8 bp, Unknown
  misc_feature (1)..( 8): Result.001 file - promoters70/5675661
cagagtaa

SEQ ID NO: 88708 - DNA, 8 bp, Unknown
  misc_feature (1)..( 8): Result.001 file - promoters70/5675661
gagagtat

SEQ ID NO: 88709 - DNA, 8 bp, Unknown
  misc_feature (1)..( 8): Result.001 file - promoters70/5677230
gagggtac

SEQ ID NO: 88710 - DNA, 7 bp, Unknown
  misc_feature (1)..( 7): Result.001 file - promoters70/5677230
aaggaaa

SEQ ID NO: 88711 - DNA, 7 bp, Unknown
  misc_feature (1)..( 7): Result.001 file - promoters70/5677230
aagtaaa

SEQ ID NO: 88712 - DNA, 7 bp, Unknown
  misc_feature (1)..( 7): Result.001 file - promoters70/5677230
gagtaaa

SEQ ID NO: 88713 - DNA, 7 bp, Unknown
  misc_feature (1)..( 7): Result.001 file - promoters70/5677230
aaaatat

SEQ ID NO: 88714 - DNA, 7 bp, Unknown
  misc_feature (1)..( 7): Result.001 file - promoters70/5677230
aaaataa

SEQ ID NO: 88715 - DNA, 7 bp, Unknown
  misc_feature (1)..( 7): Result.001 file - promoters70/5677274
gaaatat

SEQ ID NO: 88716 - DNA, 8 bp, Unknown
  misc_feature (1)..( 8): Result.001 file - promoters70/5677274
tcatatag

SEQ ID NO: 88717 - DNA, 8 bp, Unknown
  misc_feature (1)..( 8): Result.001 file - promoters70/5677274
acatttag

SEQ ID NO: 88718 - DNA, 8 bp, Unknown
  misc_feature (1)..( 8): Result.001 file - promoters70/5677274
acagttac

SEQ ID NO: 88719 - DNA, 11 bp, Unknown
  misc_feature (1)..( 11): Result.001 file - promoters70/5677274
atggtaatctc

SEQ ID NO: 88720 - DNA, 11 bp, Unknown
  misc_feature (1)..( 11): Result.001 file - promoters70/5677274
atgataataat

SEQ ID NO: 88721 - DNA, 11 bp, Unknown
  misc_feature (1)..( 11): Result.001 file - promoters70/5677298
atgttaaaaat

SEQ ID NO: 88722 - DNA, 8 bp, Unknown
  misc_feature (1)..( 8): Result.001 file - promoters70/5677298
taagtaaa

SEQ ID NO: 88723 - DNA, 8 bp, Unknown
  misc_feature (1)..( 8): Result.001 file - promoters70/5677298
taagaaaa

SEQ ID NO: 88724 - DNA, 8 bp, Unknown
  misc_feature (1)..( 8): Result.001 file - promoters70/5677298
gtagaaaa

SEQ ID NO: 88725 - DNA, 8 bp, Unknown
  misc_feature (1)..( 8): Result.001 file - promoters70/5677298
cttcgatg

SEQ ID NO: 88726 - DNA, 8 bp, Unknown
  misc_feature (1)..( 8): Result.001 file - promoters70/5677298
cttcaatg

SEQ ID NO: 88727 - DNA, 8 bp, Unknown
  misc_feature (1)..( 8): Result.001 file - promoters70/5677298
cttcaatg

SEQ ID NO: 88728 - DNA, 8 bp, Unknown
  misc_feature (1)..( 8): Result.001 file - promoters70/5677298
agagaact

SEQ ID NO: 88729 - DNA, 8 bp, Unknown
  misc_feature (1)..( 8): Result.001 file - promoters70/5677298
agaaaacc

SEQ ID NO: 88730 - DNA, 8 bp, Unknown
  misc_feature (1)..( 8): Result.001 file - promoters70/5681068
ataaaaaa

SEQ ID NO: 88731 - DNA, 7 bp, Unknown
  misc_feature (1)..( 7): Result.001 file - promoters70/5681068
gctaaaa

SEQ ID NO: 88732 - DNA, 7 bp, Unknown
  misc_feature (1)..( 7): Result.001 file - promoters70/5681068
gctgaaa

SEQ ID NO: 88733 - DNA, 7 bp, Unknown
  misc_feature (1)..( 7): Result.001 file - promoters70/5681157
tctgaaa

SEQ ID NO: 88734 - DNA, 10 bp, Unknown
  misc_feature (1)..( 10): Result.001 file - promoters70/5681157
accttaaaaa

SEQ ID NO: 88735 - DNA, 10 bp, Unknown
  misc_feature (1)..( 10): Result.001 file - promoters70/5681157
catttaaaat

SEQ ID NO: 88736 - DNA, 10 bp, Unknown
  misc_feature (1)..( 10): Result.001 file - promoters70/5681157
accttaaaaa

SEQ ID NO: 88737 - DNA, 7 bp, Unknown
  misc_feature (1)..( 7): Result.001 file - promoters70/5681157
aaataaa

SEQ ID NO: 88738 - DNA, 7 bp, Unknown
  misc_feature (1)..( 7): Result.001 file - promoters70/5681157
aaataac

SEQ ID NO: 88739 - DNA, 8 bp, Unknown
  misc_feature (1)..( 8): Result.001 file - promoters70/5681157
aaattaaa

SEQ ID NO: 88740 - DNA, 6 bp, Unknown
  misc_feature (1)..( 6): Result.001 file - promoters70/5681157
ttaaaa

SEQ ID NO: 88741 - DNA, 6 bp, Unknown
  misc_feature (1)..( 6): Result.001 file - promoters70/5681157
ttaaaa

SEQ ID NO: 88742 - DNA, 6 bp, Unknown
  misc_feature (1)..( 6): Result.001 file - promoters70/5681157
ttaaaa

SEQ ID NO: 88743 - DNA, 8 bp, Unknown
  misc_feature (1)..( 8): Result.001 file - promoters70/5681157
aaaaccat

SEQ ID NO: 88744 - DNA, 8 bp, Unknown
  misc_feature (1)..( 8): Result.001 file - promoters70/5681157
taaaccat

SEQ ID NO: 88745 - DNA, 8 bp, Unknown
  misc_feature (1)..( 8): Result.001 file - promoters70/5681157
taaaccta

SEQ ID NO: 88746 - DNA, 12 bp, Unknown
  misc_feature (1)..( 12): Result.001 file - promoters70/5681157
ataaaccaaaaa

SEQ ID NO: 88747 - DNA, 12 bp, Unknown
  misc_feature (1)..( 12): Result.001 file - promoters70/5681157
accattcaaaaa

SEQ ID NO: 88748 - DNA, 12 bp, Unknown
  misc_feature (1)..( 12): Result.001 file - promoters70/5681157
ataaacctaaat

SEQ ID NO: 88749 - DNA, 6 bp, Unknown
  misc_feature (1)..( 6): Result.001 file - promoters70/5681157
ttaaaa

SEQ ID NO: 88750 - DNA, 6 bp, Unknown
  misc_feature (1)..( 6): Result.001 file - promoters70/5681157
ttaaaa

SEQ ID NO: 88751 - DNA, 6 bp, Unknown
  misc_feature (1)..( 6): Result.001 file - promoters70/5681157
ttaaaa

SEQ ID NO: 88752 - DNA, 9 bp, Unknown
  misc_feature (1)..( 9): Result.001 file - promoters70/5681157
aaaatatga

SEQ ID NO: 88753 - DNA, 9 bp, Unknown
  misc_feature (1)..( 9): Result.001 file - promoters70/5681157
aaaataaac

SEQ ID NO: 88754 - DNA, 9 bp, Unknown
  misc_feature (1)..( 9): Result.001 file - promoters70/5681157
aaattaaac

SEQ ID NO: 88755 - DNA, 10 bp, Unknown
  misc_feature (1)..( 10): Result.001 file - promoters70/5681157
aatgtattat

SEQ ID NO: 88756 - DNA, 10 bp, Unknown
  misc_feature (1)..( 10): Result.001 file - promoters70/5681157
tttgtaatat

SEQ ID NO: 88757 - DNA, 10 bp, Unknown
  misc_feature (1)..( 10): Result.001 file - promoters70/5753942
tttttaaaaa

SEQ ID NO: 88758 - DNA, 9 bp, Unknown
  misc_feature (1)..( 9): Result.001 file - promoters70/5753942
acaattgta

SEQ ID NO: 88759 - DNA, 9 bp, Unknown
  misc_feature (1)..( 9): Result.001 file - promoters70/5753942
tacattgta

SEQ ID NO: 88760 - DNA, 9 bp, Unknown
  misc_feature (1)..( 9): Result.001 file - promoters70/5753942
taccttgtt

SEQ ID NO: 88761 - DNA, 9 bp, Unknown
  misc_feature (1)..( 9): Result.001 file - promoters70/5753942
caaacaaaa

SEQ ID NO: 88762 - DNA, 9 bp, Unknown
  misc_feature (1)..( 9): Result.001 file - promoters70/5753942
gaaacaaag

SEQ ID NO: 88763 - DNA, 9 bp, Unknown
  misc_feature (1)..( 9): Result.001 file - promoters70/5753942
taaagaaaa

SEQ ID NO: 88764 - DNA, 9 bp, Unknown
  misc_feature (1)..( 9): Result.001 file - promoters70/5753942
caatcaaat

SEQ ID NO: 88765 - DNA, 8 bp, Unknown
  misc_feature (1)..( 8): Result.001 file - promoters70/5753942
tgttcaaa

SEQ ID NO: 88766 - DNA, 8 bp, Unknown
  misc_feature (1)..( 8): Result.001 file - promoters70/5753942
tgtccaat

SEQ ID NO: 88767 - DNA, 9 bp, Unknown
  misc_feature (1)..( 9): Result.001 file - promoters70/5753942
cgttcgaaa

SEQ ID NO: 88768 - DNA, 13 bp, Unknown
  misc_feature (1)..( 13): Result.001 file - promoters70/5753942
aaacaaattaggg

SEQ ID NO: 88769 - DNA, 13 bp, Unknown
  misc_feature (1)..( 13): Result.001 file - promoters70/5753942
gcccaaattaaaa

SEQ ID NO: 88770 - DNA, 13 bp, Unknown
  misc_feature (1)..( 13): Result.001 file - promoters70/5753942
gcccatattaaaa

SEQ ID NO: 88771 - DNA, 11 bp, Unknown
  misc_feature (1)..( 11): Result.001 file - promoters70/5753942
tttgtgttttt

SEQ ID NO: 88772 - DNA, 11 bp, Unknown
  misc_feature (1)..( 11): Result.001 file - promoters70/5753942
gatgtcttttt

SEQ ID NO: 88773 - DNA, 11 bp, Unknown
  misc_feature (1)..( 11): Result.001 file - promoters70/5753942
tttgggttcct

SEQ ID NO: 88774 - DNA, 7 bp, Unknown
  misc_feature (1)..( 7): Result.001 file - promoters70/5753942
aatattt

SEQ ID NO: 88775 - DNA, 7 bp, Unknown
  misc_feature (1)..( 7): Result.001 file - promoters70/5753942
catattt

SEQ ID NO: 88776 - DNA, 7 bp, Unknown
  misc_feature (1)..( 7): Result.001 file - promoters70/5753942
catatta

SEQ ID NO: 88777 - DNA, 10 bp, Unknown
  misc_feature (1)..( 10): Result.001 file - promoters70/5753942
attcgtagca

SEQ ID NO: 88778 - DNA, 10 bp, Unknown
  misc_feature (1)..( 10): Result.001 file - promoters70/5753942
tttcgtacat

SEQ ID NO: 88779 - DNA, 10 bp, Unknown
  misc_feature (1)..( 10): Result.001 file - promoters70/5753942
tttggtacat

SEQ ID NO: 88780 - DNA, 8 bp, Unknown
  misc_feature (1)..( 8): Result.001 file - promoters70/5753942
aggctata

SEQ ID NO: 88781 - DNA, 8 bp, Unknown
  misc_feature (1)..( 8): Result.001 file - promoters70/5753942
gggccata

SEQ ID NO: 88782 - DNA, 8 bp, Unknown
  misc_feature (1)..( 8): Result.001 file - promoters70/5754134
gggccaag

SEQ ID NO: 88783 - DNA, 12 bp, Unknown
  misc_feature (1)..( 12): Result.001 file - promoters70/5754134
gcaatctggatg

SEQ ID NO: 88784 - DNA, 12 bp, Unknown
  misc_feature (1)..( 12): Result.001 file - promoters70/5754134
tgggcctgcatg

SEQ ID NO: 88785 - DNA, 12 bp, Unknown
  misc_feature (1)..( 12): Result.001 file - promoters70/5754134
gaaatatggata

SEQ ID NO: 88786 - DNA, 12 bp, Unknown
  misc_feature (1)..( 12): Result.001 file - promoters70/5754134
gaggtcttgatt

SEQ ID NO: 88787 - DNA, 12 bp, Unknown
  misc_feature (1)..( 12): Result.001 file - promoters70/5756166
gaaatatgacac

SEQ ID NO: 88788 - DNA, 8 bp, Unknown
  misc_feature (1)..( 8): Result.001 file - promoters70/5756166
ttacaatg

SEQ ID NO: 88789 - DNA, 8 bp, Unknown
  misc_feature (1)..( 8): Result.001 file - promoters70/5756166
atacaatg

SEQ ID NO: 88790 - DNA, 8 bp, Unknown
  misc_feature (1)..( 8): Result.001 file - promoters70/5756166
ttaaaatt

SEQ ID NO: 88791 - DNA, 7 bp, Unknown
  misc_feature (1)..( 7): Result.001 file - promoters70/5756166
tctaaaa

SEQ ID NO: 88792 - DNA, 7 bp, Unknown
  misc_feature (1)..( 7): Result.001 file - promoters70/5756166
tcttaaa

SEQ ID NO: 88793 - DNA, 7 bp, Unknown
  misc_feature (1)..( 7): Result.001 file - promoters70/5759467
tcttaat

SEQ ID NO: 88794 - DNA, 8 bp, Unknown
  misc_feature (1)..( 8): Result.001 file - promoters70/5759467
gcaataag

SEQ ID NO: 88795 - DNA, 8 bp, Unknown
  misc_feature (1)..( 8): Result.001 file - promoters70/5759467
acaataag

SEQ ID NO: 88796 - DNA, 8 bp, Unknown
  misc_feature (1)..( 8): Result.001 file - promoters70/5759467
gcaataaa

SEQ ID NO: 88797 - DNA, 7 bp, Unknown
  misc_feature (1)..( 7): Result.001 file - promoters70/5759467
catttac

SEQ ID NO: 88798 - DNA, 7 bp, Unknown
  misc_feature (1)..( 7): Result.001 file - promoters70/5759467
gatttac

SEQ ID NO: 88799 - DNA, 7 bp, Unknown
  misc_feature (1)..( 7): Result.001 file - promoters70/5773091
gatttaa

SEQ ID NO: 88800 - DNA, 9 bp, Unknown
  misc_feature (1)..( 9): Result.001 file - promoters70/5773091
ccaaagtaa

SEQ ID NO: 88801 - DNA, 9 bp, Unknown
  misc_feature (1)..( 9): Result.001 file - promoters70/5773091
acaaaataa

SEQ ID NO: 88802 - DNA, 9 bp, Unknown
  misc_feature (1)..( 9): Result.001 file - promoters70/5776417
acaaaaata

SEQ ID NO: 88803 - DNA, 8 bp, Unknown
  misc_feature (1)..( 8): Result.001 file - promoters70/5776417
agttttgt

SEQ ID NO: 88804 - DNA, 8 bp, Unknown
  misc_feature (1)..( 8): Result.001 file - promoters70/5776417
agtttttg

SEQ ID NO: 88805 - DNA, 8 bp, Unknown
  misc_feature (1)..( 8): Result.001 file - promoters70/5776417
ggtttttt

SEQ ID NO: 88806 - DNA, 8 bp, Unknown
  misc_feature (1)..( 8): Result.001 file - promoters60/1006957
tgttgttg

SEQ ID NO: 88807 - DNA, 8 bp, Unknown
  misc_feature (1)..( 8): Result.001 file - promoters60/1006957
aaaaggaa

SEQ ID NO: 88808 - DNA, 8 bp, Unknown
  misc_feature (1)..( 8): Result.001 file - promoters60/1006957
gaaaggag

SEQ ID NO: 88809 - DNA, 8 bp, Unknown
  misc_feature (1)..( 8): Result.001 file - promoters60/1006957
gaaaagag

SEQ ID NO: 88810 - DNA, 7 bp, Unknown
  misc_feature (1)..( 7): Result.001 file - promoters60/1006957
gatcaat

SEQ ID NO: 88811 - DNA, 7 bp, Unknown
  misc_feature (1)..( 7): Result.001 file - promoters60/1006957
gataaat

SEQ ID NO: 88812 - DNA, 6 bp, Unknown
  misc_feature (1)..( 6): Result.001 file - promoters60/1006957
atcata

SEQ ID NO: 88813 - DNA, 6 bp, Unknown
  misc_feature (1)..( 6): Result.001 file - promoters60/1006957
atcata

SEQ ID NO: 88814 - DNA, 6 bp, Unknown
  misc_feature (1)..( 6): Result.001 file - promoters60/1006957
aaaaat

SEQ ID NO: 88815 - DNA, 6 bp, Unknown
  misc_feature (1)..( 6): Result.001 file - promoters60/1006957
aaaaat

SEQ ID NO: 88816 - DNA, 7 bp, Unknown
  misc_feature (1)..( 7): Result.001 file - promoters60/1006957
attcaaa

SEQ ID NO: 88817 - DNA, 7 bp, Unknown
  misc_feature (1)..( 7): Result.001 file - promoters60/1006957
attgaaa

SEQ ID NO: 88818 - DNA, 10 bp, Unknown
  misc_feature (1)..( 10): Result.001 file - promoters60/1006957
caaagtagag

SEQ ID NO: 88819 - DNA, 10 bp, Unknown
  misc_feature (1)..( 10): Result.001 file - promoters60/1006957
caaactaggc

SEQ ID NO: 88820 - DNA, 10 bp, Unknown
  misc_feature (1)..( 10): Result.001 file - promoters60/1006957
aaaacaaggc

SEQ ID NO: 88821 - DNA, 10 bp, Unknown
  misc_feature (1)..( 10): Result.001 file - promoters60/1006957
tgagtgtttt

SEQ ID NO: 88822 - DNA, 10 bp, Unknown
  misc_feature (1)..( 10): Result.001 file - promoters60/1006957
tgagggtttt

SEQ ID NO: 88823 - DNA, 7 bp, Unknown
  misc_feature (1)..( 7): Result.001 file - promoters60/1006957
tggcttc

SEQ ID NO: 88824 - DNA, 7 bp, Unknown
  misc_feature (1)..( 7): Result.001 file - promoters60/1006957
tgggttc

SEQ ID NO: 88825 - DNA, 6 bp, Unknown
  misc_feature (1)..( 6): Result.001 file - promoters60/1006957
gagtga

SEQ ID NO: 88826 - DNA, 6 bp, Unknown
  misc_feature (1)..( 6): Result.001 file - promoters60/1006957
gagtga

SEQ ID NO: 88827 - DNA, 9 bp, Unknown
  misc_feature (1)..( 9): Result.001 file - promoters60/1006957
ggagagaaa

SEQ ID NO: 88828 - DNA, 9 bp, Unknown
  misc_feature (1)..( 9): Result.001 file - promoters60/1006957
ggagtgaaa

SEQ ID NO: 88829 - DNA, 9 bp, Unknown
  misc_feature (1)..( 9): Result.001 file - promoters60/1006957
agaaaaagt

SEQ ID NO: 88830 - DNA, 9 bp, Unknown
  misc_feature (1)..( 9): Result.001 file - promoters60/1006957
agagaaagt

SEQ ID NO: 88831 - DNA, 8 bp, Unknown
  misc_feature (1)..( 8): Result.001 file - promoters60/1006957
tttcgctt

SEQ ID NO: 88832 - DNA, 8 bp, Unknown
  misc_feature (1)..( 8): Result.001 file - promoters60/1007030
tttagctt

SEQ ID NO: 88833 - DNA, 10 bp, Unknown
  misc_feature (1)..( 10): Result.001 file - promoters60/1007030
aaataataaa

SEQ ID NO: 88834 - DNA, 10 bp, Unknown
  misc_feature (1)..( 10): Result.001 file - promoters60/1007030
ttataatata

SEQ ID NO: 88835 - DNA, 10 bp, Unknown
  misc_feature (1)..( 10): Result.001 file - promoters60/1007030
aaatagtaaa

SEQ ID NO: 88836 - DNA, 10 bp, Unknown
  misc_feature (1)..( 10): Result.001 file - promoters60/1007030
ggataaaata

SEQ ID NO: 88837 - DNA, 10 bp, Unknown
  misc_feature (1)..( 10): Result.001 file - promoters60/1007030
agatagtact

SEQ ID NO: 88838 - DNA, 12 bp, Unknown
  misc_feature (1)..( 12): Result.001 file - promoters60/1007030
ataaatagcggg

SEQ ID NO: 88839 - DNA, 12 bp, Unknown
  misc_feature (1)..( 12): Result.001 file - promoters60/1007030
ataaataattat

SEQ ID NO: 88840 - DNA, 12 bp, Unknown
  misc_feature (1)..( 12): Result.001 file - promoters60/1007030
ataaatagtaaa

SEQ ID NO: 88841 - DNA, 12 bp, Unknown
  misc_feature (1)..( 12): Result.001 file - promoters60/1007030
tgagatagtact

SEQ ID NO: 88842 - DNA, 8 bp, Unknown
  misc_feature (1)..( 8): Result.001 file - promoters60/1007030
aaaacaat

SEQ ID NO: 88843 - DNA, 8 bp, Unknown
  misc_feature (1)..( 8): Result.001 file - promoters60/1007030
aaaacaat

SEQ ID NO: 88844 - DNA, 8 bp, Unknown
  misc_feature (1)..( 8): Result.001 file - promoters60/1007030
aaaagaat

SEQ ID NO: 88845 - DNA, 8 bp, Unknown
  misc_feature (1)..( 8): Result.001 file - promoters60/1007030
tgaagaat

SEQ ID NO: 88846 - DNA, 8 bp, Unknown
  misc_feature (1)..( 8): Result.001 file - promoters60/1007030
aaatgaaa

SEQ ID NO: 88847 - DNA, 8 bp, Unknown
  misc_feature (1)..( 8): Result.001 file - promoters60/1007030
aaacgaat

SEQ ID NO: 88848 - DNA, 8 bp, Unknown
  misc_feature (1)..( 8): Result.001 file - promoters60/1007030
gaaccaat

SEQ ID NO: 88849 - DNA, 8 bp, Unknown
  misc_feature (1)..( 8): Result.001 file - promoters60/1007030
aaacgatt

SEQ ID NO: 88850 - DNA, 13 bp, Unknown
  misc_feature (1)..( 13): Result.001 file - promoters60/1007030
gggaagataaaca

SEQ ID NO: 88851 - DNA, 13 bp, Unknown
  misc_feature (1)..( 13): Result.001 file - promoters60/1007030
tcgaaaatataca

SEQ ID NO: 88852 - DNA, 13 bp, Unknown
  misc_feature (1)..( 13): Result.001 file - promoters60/1007030
tataaagtattta

SEQ ID NO: 88853 - DNA, 13 bp, Unknown
  misc_feature (1)..( 13): Result.001 file - promoters60/1007030
tcgataatgaaga

SEQ ID NO: 88854 - DNA, 11 bp, Unknown
  misc_feature (1)..( 11): Result.001 file - promoters60/1007030
aattaacccaa

SEQ ID NO: 88855 - DNA, 11 bp, Unknown
  misc_feature (1)..( 11): Result.001 file - promoters60/1007030
tattaacctac

SEQ ID NO: 88856 - DNA, 11 bp, Unknown
  misc_feature (1)..( 11): Result.001 file - promoters60/1007030
aattaaaaaag

SEQ ID NO: 88857 - DNA, 11 bp, Unknown
  misc_feature (1)..( 11): Result.001 file - promoters60/1007030
cagtaatccaa

SEQ ID NO: 88858 - DNA, 10 bp, Unknown
  misc_feature (1)..( 10): Result.001 file - promoters60/1007030
aatctgcttc

SEQ ID NO: 88859 - DNA, 10 bp, Unknown
  misc_feature (1)..( 10): Result.001 file - promoters60/1007030
aatcttcttc

SEQ ID NO: 88860 - DNA, 10 bp, Unknown
  misc_feature (1)..( 10): Result.001 file - promoters60/1007030
aatctgatgt

SEQ ID NO: 88861 - DNA, 10 bp, Unknown
  misc_feature (1)..( 10): Result.001 file - promoters60/1007030
aatttgaaaa

SEQ ID NO: 88862 - DNA, 7 bp, Unknown
  misc_feature (1)..( 7): Result.001 file - promoters60/1007030
gaaataa

SEQ ID NO: 88863 - DNA, 7 bp, Unknown
  misc_feature (1)..( 7): Result.001 file - promoters60/1007030
aaaataa

SEQ ID NO: 88864 - DNA, 7 bp, Unknown
  misc_feature (1)..( 7): Result.001 file - promoters60/1007030
aaaatac

SEQ ID NO: 88865 - DNA, 7 bp, Unknown
  misc_feature (1)..( 7): Result.001 file - promoters60/1007030
aaagtaa

SEQ ID NO: 88866 - DNA, 13 bp, Unknown
  misc_feature (1)..( 13): Result.001 file - promoters60/1007030
cataaaaaaagat

SEQ ID NO: 88867 - DNA, 13 bp, Unknown
  misc_feature (1)..( 13): Result.001 file - promoters60/1007030
atatgaaaaggat

SEQ ID NO: 88868 - DNA, 13 bp, Unknown
  misc_feature (1)..( 13): Result.001 file - promoters60/1007030
tgaagaaaaagca

SEQ ID NO: 88869 - DNA, 13 bp, Unknown
  misc_feature (1)..( 13): Result.001 file - promoters60/1007030
tgatgaaaaatta

SEQ ID NO: 88870 - DNA, 7 bp, Unknown
  misc_feature (1)..( 7): Result.001 file - promoters60/1007030
taaaaat

SEQ ID NO: 88871 - DNA, 7 bp, Unknown
  misc_feature (1)..( 7): Result.001 file - promoters60/1007030
taaaaaa

SEQ ID NO: 88872 - DNA, 7 bp, Unknown
  misc_feature (1)..( 7): Result.001 file - promoters60/1007030
taaaaaa

SEQ ID NO: 88873 - DNA, 7 bp, Unknown
  misc_feature (1)..( 7): Result.001 file - promoters60/1007030
caaaaaa

SEQ ID NO: 88874 - DNA, 10 bp, Unknown
  misc_feature (1)..( 10): Result.001 file - promoters60/1007030
attgagatag

SEQ ID NO: 88875 - DNA, 10 bp, Unknown
  misc_feature (1)..( 10): Result.001 file - promoters60/1007030
actgaaatat

SEQ ID NO: 88876 - DNA, 10 bp, Unknown
  misc_feature (1)..( 10): Result.001 file - promoters60/1007030
attgacatat

SEQ ID NO: 88877 - DNA, 10 bp, Unknown
  misc_feature (1)..( 10): Result.001 file - promoters60/1007056
attaaaatat

SEQ ID NO: 88878 - DNA, 8 bp, Unknown
  misc_feature (1)..( 8): Result.001 file - promoters60/1007056
aaggctga

SEQ ID NO: 88879 - DNA, 8 bp, Unknown
  misc_feature (1)..( 8): Result.001 file - promoters60/1007056
aaggatga

SEQ ID NO: 88880 - DNA, 7 bp, Unknown
  misc_feature (1)..( 7): Result.001 file - promoters60/1007056
gttttgg

SEQ ID NO: 88881 - DNA, 7 bp, Unknown
  misc_feature (1)..( 7): Result.001 file - promoters60/1007056
gttctgg

SEQ ID NO: 88882 - DNA, 7 bp, Unknown
  misc_feature (1)..( 7): Result.001 file - promoters60/1007056
gttttgt

SEQ ID NO: 88883 - DNA, 6 bp, Unknown
  misc_feature (1)..( 6): Result.001 file - promoters60/1007056
ggtgat

SEQ ID NO: 88884 - DNA, 6 bp, Unknown
  misc_feature (1)..( 6): Result.001 file - promoters60/1007056
ggtgat

SEQ ID NO: 88885 - DNA, 11 bp, Unknown
  misc_feature (1)..( 11): Result.001 file - promoters60/1007056
accttctgtga

SEQ ID NO: 88886 - DNA, 11 bp, Unknown
  misc_feature (1)..( 11): Result.001 file - promoters60/1007056
accttctctga

SEQ ID NO: 88887 - DNA, 6 bp, Unknown
  misc_feature (1)..( 6): Result.001 file - promoters60/1007056
aaggct

SEQ ID NO: 88888 - DNA, 6 bp, Unknown
  misc_feature (1)..( 6): Result.001 file - promoters60/1007056
aaggct

SEQ ID NO: 88889 - DNA, 6 bp, Unknown
  misc_feature (1)..( 6): Result.001 file - promoters60/1007056
gatgca

SEQ ID NO: 88890 - DNA, 6 bp, Unknown
  misc_feature (1)..( 6): Result.001 file - promoters60/1007056
gatgca

SEQ ID NO: 88891 - DNA, 7 bp, Unknown
  misc_feature (1)..( 7): Result.001 file - promoters60/1007056
aacatct

SEQ ID NO: 88892 - DNA, 7 bp, Unknown
  misc_feature (1)..( 7): Result.001 file - promoters60/1007056
aacttct

SEQ ID NO: 88893 - DNA, 10 bp, Unknown
  misc_feature (1)..( 10): Result.001 file - promoters60/1007056
atcttttcta

SEQ ID NO: 88894 - DNA, 10 bp, Unknown
  misc_feature (1)..( 10): Result.001 file - promoters60/1007056
aagttttcta

SEQ ID NO: 88895 - DNA, 10 bp, Unknown
  misc_feature (1)..( 10): Result.001 file - promoters60/1007056
aagttctctg

SEQ ID NO: 88896 - DNA, 7 bp, Unknown
  misc_feature (1)..( 7): Result.001 file - promoters60/1007056
ctattca

SEQ ID NO: 88897 - DNA, 7 bp, Unknown
  misc_feature (1)..( 7): Result.001 file - promoters60/1007056
ctaatca

SEQ ID NO: 88898 - DNA, 6 bp, Unknown
  misc_feature (1)..( 6): Result.001 file - promoters60/1007056
ggtttt

SEQ ID NO: 88899 - DNA, 6 bp, Unknown
  misc_feature (1)..( 6): Result.001 file - promoters60/1007056
ggtttt

SEQ ID NO: 88900 - DNA, 6 bp, Unknown
  misc_feature (1)..( 6): Result.001 file - promoters60/1007056
ttttgt

SEQ ID NO: 88901 - DNA, 6 bp, Unknown
  misc_feature (1)..( 6): Result.001 file - promoters60/1007056
ttttgt

SEQ ID NO: 88902 - DNA, 6 bp, Unknown
  misc_feature (1)..( 6): Result.001 file - promoters60/1007056
ttgttt

SEQ ID NO: 88903 - DNA, 6 bp, Unknown
  misc_feature (1)..( 6): Result.001 file - promoters60/1007056
ttgttt

SEQ ID NO: 88904 - DNA, 6 bp, Unknown
  misc_feature (1)..( 6): Result.001 file - promoters60/1007056
atccaa

SEQ ID NO: 88905 - DNA, 6 bp, Unknown
  misc_feature (1)..( 6): Result.001 file - promoters60/1007056
atccaa

SEQ ID NO: 88906 - DNA, 7 bp, Unknown
  misc_feature (1)..( 7): Result.001 file - promoters60/1007056
tgccaag

SEQ ID NO: 88907 - DNA, 7 bp, Unknown
  misc_feature (1)..( 7): Result.001 file - promoters60/1007056
tgctaag

SEQ ID NO: 88908 - DNA, 7 bp, Unknown
  misc_feature (1)..( 7): Result.001 file - promoters60/1007056
tcatgaa

SEQ ID NO: 88909 - DNA, 7 bp, Unknown
  misc_feature (1)..( 7): Result.001 file - promoters60/1007056
tcaagaa

SEQ ID NO: 88910 - DNA, 6 bp, Unknown
  misc_feature (1)..( 6): Result.001 file - promoters60/1007056
agtcct

SEQ ID NO: 88911 - DNA, 6 bp, Unknown
  misc_feature (1)..( 6): Result.001 file - promoters60/1007056
agtcct

SEQ ID NO: 88912 - DNA, 6 bp, Unknown
  misc_feature (1)..( 6): Result.001 file - promoters60/1007056
gaggca

SEQ ID NO: 88913 - DNA, 6 bp, Unknown
  misc_feature (1)..( 6): Result.001 file - promoters60/1007056
gaggca

SEQ ID NO: 88914 - DNA, 7 bp, Unknown
  misc_feature (1)..( 7): Result.001 file - promoters60/1007056
tcaagaa

SEQ ID NO: 88915 - DNA, 7 bp, Unknown
  misc_feature (1)..( 7): Result.001 file - promoters60/1007139
tcatgaa

SEQ ID NO: 88916 - DNA, 11 bp, Unknown
  misc_feature (1)..( 11): Result.001 file - promoters60/1007139
cccccacaaaa

SEQ ID NO: 88917 - DNA, 11 bp, Unknown
  misc_feature (1)..( 11): Result.001 file - promoters60/1007139
ttttaacaaaa

SEQ ID NO: 88918 - DNA, 11 bp, Unknown
  misc_feature (1)..( 11): Result.001 file - promoters60/1007139
gtataataaag

SEQ ID NO: 88919 - DNA, 12 bp, Unknown
  misc_feature (1)..( 12): Result.001 file - promoters60/1007139
tttcaaccaaaa

SEQ ID NO: 88920 - DNA, 9 bp, Unknown
  misc_feature (1)..( 9): Result.001 file - promoters60/1007139
aaagttttg

SEQ ID NO: 88921 - DNA, 9 bp, Unknown
  misc_feature (1)..( 9): Result.001 file - promoters60/1007139
aaagttcaa

SEQ ID NO: 88922 - DNA, 9 bp, Unknown
  misc_feature (1)..( 9): Result.001 file - promoters60/1007139
caagttttg

SEQ ID NO: 88923 - DNA, 9 bp, Unknown
  misc_feature (1)..( 9): Result.001 file - promoters60/1007139
caagatcat

SEQ ID NO: 88924 - DNA, 10 bp, Unknown
  misc_feature (1)..( 10): Result.001 file - promoters60/1007139
aaatatatgt

SEQ ID NO: 88925 - DNA, 10 bp, Unknown
  misc_feature (1)..( 10): Result.001 file - promoters60/1007139
taatttatca

SEQ ID NO: 88926 - DNA, 11 bp, Unknown
  misc_feature (1)..( 11): Result.001 file - promoters60/1007139
ttgatatatac

SEQ ID NO: 88927 - DNA, 11 bp, Unknown
  misc_feature (1)..( 11): Result.001 file - promoters60/1007187
gaattatatgt

SEQ ID NO: 88928 - DNA, 9 bp, Unknown
  misc_feature (1)..( 9): Result.001 file - promoters60/1007187
aatttattt

SEQ ID NO: 88929 - DNA, 9 bp, Unknown
  misc_feature (1)..( 9): Result.001 file - promoters60/1007187
gatttatta

SEQ ID NO: 88930 - DNA, 9 bp, Unknown
  misc_feature (1)..( 9): Result.001 file - promoters60/1007187
aatttattt

SEQ ID NO: 88931 - DNA, 9 bp, Unknown
  misc_feature (1)..( 9): Result.001 file - promoters60/1007187
aaaatatta

SEQ ID NO: 88932 - DNA, 9 bp, Unknown
  misc_feature (1)..( 9): Result.001 file - promoters60/1007187
aaaagatta

SEQ ID NO: 88933 - DNA, 9 bp, Unknown
  misc_feature (1)..( 9): Result.001 file - promoters60/1007187
ttaatattt

SEQ ID NO: 88934 - DNA, 9 bp, Unknown
  misc_feature (1)..( 9): Result.001 file - promoters60/1007187
tgttaatct

SEQ ID NO: 88935 - DNA, 9 bp, Unknown
  misc_feature (1)..( 9): Result.001 file - promoters60/1007187
tgttaatag

SEQ ID NO: 88936 - DNA, 9 bp, Unknown
  misc_feature (1)..( 9): Result.001 file - promoters60/1007187
acttaatct

SEQ ID NO: 88937 - DNA, 7 bp, Unknown
  misc_feature (1)..( 7): Result.001 file - promoters60/1007187
aaatgat

SEQ ID NO: 88938 - DNA, 7 bp, Unknown
  misc_feature (1)..( 7): Result.001 file - promoters60/1007187
aaaagat

SEQ ID NO: 88939 - DNA, 9 bp, Unknown
  misc_feature (1)..( 9): Result.001 file - promoters60/1007187
ttttgtttt

SEQ ID NO: 88940 - DNA, 9 bp, Unknown
  misc_feature (1)..( 9): Result.001 file - promoters60/1007187
tttggtttt

SEQ ID NO: 88941 - DNA, 12 bp, Unknown
  misc_feature (1)..( 12): Result.001 file - promoters60/1007187
tttttaacaatt

SEQ ID NO: 88942 - DNA, 12 bp, Unknown
  misc_feature (1)..( 12): Result.001 file - promoters60/1007187
ttttctacaatt

SEQ ID NO: 88943 - DNA, 12 bp, Unknown
  misc_feature (1)..( 12): Result.001 file - promoters60/1007187
ttttctaaaata

SEQ ID NO: 88944 - DNA, 7 bp, Unknown
  misc_feature (1)..( 7): Result.001 file - promoters60/1007187
tttttct

SEQ ID NO: 88945 - DNA, 7 bp, Unknown
  misc_feature (1)..( 7): Result.001 file - promoters60/1007187
gttttct

SEQ ID NO: 88946 - DNA, 7 bp, Unknown
  misc_feature (1)..( 7): Result.001 file - promoters60/1007187
tttttct

SEQ ID NO: 88947 - DNA, 8 bp, Unknown
  misc_feature (1)..( 8): Result.001 file - promoters60/1007187
tgaggaat

SEQ ID NO: 88948 - DNA, 8 bp, Unknown
  misc_feature (1)..( 8): Result.001 file - promoters60/1007187
tgatgaat

SEQ ID NO: 88949 - DNA, 7 bp, Unknown
  misc_feature (1)..( 7): Result.001 file - promoters60/1007187
caaacgc

SEQ ID NO: 88950 - DNA, 7 bp, Unknown
  misc_feature (1)..( 7): Result.001 file - promoters60/1007187
caatcgc

SEQ ID NO: 88951 - DNA, 6 bp, Unknown
  misc_feature (1)..( 6): Result.001 file - promoters60/1007187
aatttt

SEQ ID NO: 88952 - DNA, 6 bp, Unknown
  misc_feature (1)..( 6): Result.001 file - promoters60/1007187
aatttt

SEQ ID NO: 88953 - DNA, 6 bp, Unknown
  misc_feature (1)..( 6): Result.001 file - promoters60/1007187
aatttt

SEQ ID NO: 88954 - DNA, 9 bp, Unknown
  misc_feature (1)..( 9): Result.001 file - promoters60/1007187
tattttgga

SEQ ID NO: 88955 - DNA, 9 bp, Unknown
  misc_feature (1)..( 9): Result.001 file - promoters60/1007187
tatttttac

SEQ ID NO: 88956 - DNA, 9 bp, Unknown
  misc_feature (1)..( 9): Result.001 file - promoters60/1007187
aattttttt

SEQ ID NO: 88957 - DNA, 9 bp, Unknown
  misc_feature (1)..( 9): Result.001 file - promoters60/1007187
aatattgca

SEQ ID NO: 88958 - DNA, 9 bp, Unknown
  misc_feature (1)..( 9): Result.001 file - promoters60/1007187
aatattttt

SEQ ID NO: 88959 - DNA, 9 bp, Unknown
  misc_feature (1)..( 9): Result.001 file - promoters60/1007187
aattttttt

SEQ ID NO: 88960 - DNA, 8 bp, Unknown
  misc_feature (1)..( 8): Result.001 file - promoters60/1007187
ttttaaat

SEQ ID NO: 88961 - DNA, 8 bp, Unknown
  misc_feature (1)..( 8): Result.001 file - promoters60/1007187
atttaaaa

SEQ ID NO: 88962 - DNA, 7 bp, Unknown
  misc_feature (1)..( 7): Result.001 file - promoters60/1007187
taaataa

SEQ ID NO: 88963 - DNA, 7 bp, Unknown
  misc_feature (1)..( 7): Result.001 file - promoters60/1007187
taattaa

SEQ ID NO: 88964 - DNA, 7 bp, Unknown
  misc_feature (1)..( 7): Result.001 file - promoters60/1007187
ttgtttt

SEQ ID NO: 88965 - DNA, 7 bp, Unknown
  misc_feature (1)..( 7): Result.001 file - promoters60/1007187
ttgtttt

SEQ ID NO: 88966 - DNA, 8 bp, Unknown
  misc_feature (1)..( 8): Result.001 file - promoters60/1007187
attggatg

SEQ ID NO: 88967 - DNA, 8 bp, Unknown
  misc_feature (1)..( 8): Result.001 file - promoters60/1007187
attgtatg

SEQ ID NO: 88968 - DNA, 6 bp, Unknown
  misc_feature (1)..( 6): Result.001 file - promoters60/1007187
tccaaa

SEQ ID NO: 88969 - DNA, 6 bp, Unknown
  misc_feature (1)..( 6): Result.001 file - promoters60/1007187
tccaaa

SEQ ID NO: 88970 - DNA, 6 bp, Unknown
  misc_feature (1)..( 6): Result.001 file - promoters60/1007187
tatttt

SEQ ID NO: 88971 - DNA, 6 bp, Unknown
  misc_feature (1)..( 6): Result.001 file - promoters60/1007187
tatttt

SEQ ID NO: 88972 - DNA, 6 bp, Unknown
  misc_feature (1)..( 6): Result.001 file - promoters60/1007187
ttaaaa

SEQ ID NO: 88973 - DNA, 6 bp, Unknown
  misc_feature (1)..( 6): Result.001 file - promoters60/1007187
ttaaaa

SEQ ID NO: 88974 - DNA, 9 bp, Unknown
  misc_feature (1)..( 9): Result.001 file - promoters60/1007187
ataagaaaa

SEQ ID NO: 88975 - DNA, 9 bp, Unknown
  misc_feature (1)..( 9): Result.001 file - promoters60/1007187
ataacaaaa

SEQ ID NO: 88976 - DNA, 7 bp, Unknown
  misc_feature (1)..( 7): Result.001 file - promoters60/1007187
taataat

SEQ ID NO: 88977 - DNA, 7 bp, Unknown
  misc_feature (1)..( 7): Result.001 file - promoters60/1007187
taataat

SEQ ID NO: 88978 - DNA, 6 bp, Unknown
  misc_feature (1)..( 6): Result.001 file - promoters60/1007187
atattt

SEQ ID NO: 88979 - DNA, 6 bp, Unknown
  misc_feature (1)..( 6): Result.001 file - promoters60/1007187
atattt

SEQ ID NO: 88980 - DNA, 7 bp, Unknown
  misc_feature (1)..( 7): Result.001 file - promoters60/1007187
tatccaa

SEQ ID NO: 88981 - DNA, 7 bp, Unknown
  misc_feature (1)..( 7): Result.001 file - promoters60/1007187
tatacaa

SEQ ID NO: 88982 - DNA, 7 bp, Unknown
  misc_feature (1)..( 7): Result.001 file - promoters60/1007187
tataatt

SEQ ID NO: 88983 - DNA, 7 bp, Unknown
  misc_feature (1)..( 7): Result.001 file - promoters60/1007187
tatgatt

SEQ ID NO: 88984 - DNA, 6 bp, Unknown
  misc_feature (1)..( 6): Result.001 file - promoters60/1007187
aaaaaa

SEQ ID NO: 88985 - DNA, 6 bp, Unknown
  misc_feature (1)..( 6): Result.001 file - promoters60/1007187
aaaaaa

SEQ ID NO: 88986 - DNA, 8 bp, Unknown
  misc_feature (1)..( 8): Result.001 file - promoters60/1007187
taaatttc

SEQ ID NO: 88987 - DNA, 8 bp, Unknown
  misc_feature (1)..( 8): Result.001 file - promoters60/1007187
taactttc

SEQ ID NO: 88988 - DNA, 7 bp, Unknown
  misc_feature (1)..( 7): Result.001 file - promoters60/1007187
aagagaa

SEQ ID NO: 88989 - DNA, 7 bp, Unknown
  misc_feature (1)..( 7): Result.001 file - promoters60/1007187
aagtgaa

SEQ ID NO: 88990 - DNA, 8 bp, Unknown
  misc_feature (1)..( 8): Result.001 file - promoters60/1007187
atggcttg

SEQ ID NO: 88991 - DNA, 8 bp, Unknown
  misc_feature (1)..( 8): Result.001 file - promoters60/1007269
atgggttg

SEQ ID NO: 88992 - DNA, 12 bp, Unknown
  misc_feature (1)..( 12): Result.001 file - promoters60/1007269
cccaaacaaatt

SEQ ID NO: 88993 - DNA, 12 bp, Unknown
  misc_feature (1)..( 12): Result.001 file - promoters60/1007269
tggaaacgaatt

SEQ ID NO: 88994 - DNA, 12 bp, Unknown
  misc_feature (1)..( 12): Result.001 file - promoters60/1007269
tggaaacggtga

SEQ ID NO: 88995 - DNA, 10 bp, Unknown
  misc_feature (1)..( 10): Result.001 file - promoters60/1007269
gaaacgtttt

SEQ ID NO: 88996 - DNA, 10 bp, Unknown
  misc_feature (1)..( 10): Result.001 file - promoters60/1007269
tattcgtttt

SEQ ID NO: 88997 - DNA, 10 bp, Unknown
  misc_feature (1)..( 10): Result.001 file - promoters60/1007269
tatttgtttt

SEQ ID NO: 88998 - DNA, 10 bp, Unknown
  misc_feature (1)..( 10): Result.001 file - promoters60/1007269
taaaaaagat

SEQ ID NO: 88999 - DNA, 10 bp, Unknown
  misc_feature (1)..( 10): Result.001 file - promoters60/1007269
taaaatagat

SEQ ID NO: 89000 - DNA, 10 bp, Unknown
  misc_feature (1)..( 10): Result.001 file - promoters60/1007269
gttaatagac

SEQ ID NO: 89001 - DNA, 9 bp, Unknown
  misc_feature (1)..( 9): Result.001 file - promoters60/1007269
ttaaaacaa

SEQ ID NO: 89002 - DNA, 9 bp, Unknown
  misc_feature (1)..( 9): Result.001 file - promoters60/1007269
ataaaacct

SEQ ID NO: 89003 - DNA, 9 bp, Unknown
  misc_feature (1)..( 9): Result.001 file - promoters60/1007289
ataaaccct

SEQ ID NO: 89004 - DNA, 8 bp, Unknown
  misc_feature (1)..( 8): Result.001 file - promoters60/1007289
ttttctta

SEQ ID NO: 89005 - DNA, 8 bp, Unknown
  misc_feature (1)..( 8): Result.001 file - promoters60/1007289
tttacttt

SEQ ID NO: 89006 - DNA, 8 bp, Unknown
  misc_feature (1)..( 8): Result.001 file - promoters60/1007289
atttgtta

SEQ ID NO: 89007 - DNA, 8 bp, Unknown
  misc_feature (1)..( 8): Result.001 file - promoters60/1007289
atttgtat

SEQ ID NO: 89008 - DNA, 11 bp, Unknown
  misc_feature (1)..( 11): Result.001 file - promoters60/1007289
ttcaatgataa

SEQ ID NO: 89009 - DNA, 11 bp, Unknown
  misc_feature (1)..( 11): Result.001 file - promoters60/1007289
aataattataa

SEQ ID NO: 89010 - DNA, 11 bp, Unknown
  misc_feature (1)..( 11): Result.001 file - promoters60/1007289
ttcaatgactc

SEQ ID NO: 89011 - DNA, 11 bp, Unknown
  misc_feature (1)..( 11): Result.001 file - promoters60/1007289
gtgaattattc

SEQ ID NO: 89012 - DNA, 12 bp, Unknown
  misc_feature (1)..( 12): Result.001 file - promoters60/1007289
taaacagaagat

SEQ ID NO: 89013 - DNA, 12 bp, Unknown
  misc_feature (1)..( 12): Result.001 file - promoters60/1007289
ggtttagaagaa

SEQ ID NO: 89014 - DNA, 12 bp, Unknown
  misc_feature (1)..( 12): Result.001 file - promoters60/1007289
gacgaagaagat

SEQ ID NO: 89015 - DNA, 12 bp, Unknown
  misc_feature (1)..( 12): Result.001 file - promoters60/1007289
ttataagaagaa

SEQ ID NO: 89016 - DNA, 7 bp, Unknown
  misc_feature (1)..( 7): Result.001 file - promoters60/1007289
ataaagc

SEQ ID NO: 89017 - DNA, 7 bp, Unknown
  misc_feature (1)..( 7): Result.001 file - promoters60/1007289
ataaagt

SEQ ID NO: 89018 - DNA, 7 bp, Unknown
  misc_feature (1)..( 7): Result.001 file - promoters60/1007289
aaaaaaa

SEQ ID NO: 89019 - DNA, 7 bp, Unknown
  misc_feature (1)..( 7): Result.001 file - promoters60/1007348
aaaaaaa

SEQ ID NO: 89020 - DNA, 7 bp, Unknown
  misc_feature (1)..( 7): Result.001 file - promoters60/1007348
tgtaatt

SEQ ID NO: 89021 - DNA, 7 bp, Unknown
  misc_feature (1)..( 7): Result.001 file - promoters60/1007348
tgttatt

SEQ ID NO: 89022 - DNA, 6 bp, Unknown
  misc_feature (1)..( 6): Result.001 file - promoters60/1007348
gatctt

SEQ ID NO: 89023 - DNA, 6 bp, Unknown
  misc_feature (1)..( 6): Result.001 file - promoters60/1007348
gatctt

SEQ ID NO: 89024 - DNA, 8 bp, Unknown
  misc_feature (1)..( 8): Result.001 file - promoters60/1007348
tatgtttt

SEQ ID NO: 89025 - DNA, 8 bp, Unknown
  misc_feature (1)..( 8): Result.001 file - promoters60/1007348
tatgtttt

SEQ ID NO: 89026 - DNA, 7 bp, Unknown
  misc_feature (1)..( 7): Result.001 file - promoters60/1007348
ttataac

SEQ ID NO: 89027 - DNA, 7 bp, Unknown
  misc_feature (1)..( 7): Result.001 file - promoters60/1007348
ttaaaac

SEQ ID NO: 89028 - DNA, 7 bp, Unknown
  misc_feature (1)..( 7): Result.001 file - promoters60/1007348
attgttt

SEQ ID NO: 89029 - DNA, 7 bp, Unknown
  misc_feature (1)..( 7): Result.001 file - promoters60/1007348
attgttt

SEQ ID NO: 89030 - DNA, 7 bp, Unknown
  misc_feature (1)..( 7): Result.001 file - promoters60/1007348
atccaca

SEQ ID NO: 89031 - DNA, 7 bp, Unknown
  misc_feature (1)..( 7): Result.001 file - promoters60/1007348
atccaca

SEQ ID NO: 89032 - DNA, 8 bp, Unknown
  misc_feature (1)..( 8): Result.001 file - promoters60/1007348
tatttttc

SEQ ID NO: 89033 - DNA, 8 bp, Unknown
  misc_feature (1)..( 8): Result.001 file - promoters60/1007348
tatttttc

SEQ ID NO: 89034 - DNA, 8 bp, Unknown
  misc_feature (1)..( 8): Result.001 file - promoters60/1007348
atatttaa

SEQ ID NO: 89035 - DNA, 8 bp, Unknown
  misc_feature (1)..( 8): Result.001 file - promoters60/1007348
atatgtaa

SEQ ID NO: 89036 - DNA, 6 bp, Unknown
  misc_feature (1)..( 6): Result.001 file - promoters60/1007348
gtttaa

SEQ ID NO: 89037 - DNA, 6 bp, Unknown
  misc_feature (1)..( 6): Result.001 file - promoters60/1007348
gtttaa

SEQ ID NO: 89038 - DNA, 7 bp, Unknown
  misc_feature (1)..( 7): Result.001 file - promoters60/1007348
ctctttt

SEQ ID NO: 89039 - DNA, 7 bp, Unknown
  misc_feature (1)..( 7): Result.001 file - promoters60/1007348
ctctttt

SEQ ID NO: 89040 - DNA, 8 bp, Unknown
  misc_feature (1)..( 8): Result.001 file - promoters60/1007348
ataacatc

SEQ ID NO: 89041 - DNA, 8 bp, Unknown
  misc_feature (1)..( 8): Result.001 file - promoters60/1007348
atatcatc

SEQ ID NO: 89042 - DNA, 8 bp, Unknown
  misc_feature (1)..( 8): Result.001 file - promoters60/1007348
cacataga

SEQ ID NO: 89043 - DNA, 8 bp, Unknown
  misc_feature (1)..( 8): Result.001 file - promoters60/1007348
cacaaaga

SEQ ID NO: 89044 - DNA, 11 bp, Unknown
  misc_feature (1)..( 11): Result.001 file - promoters60/1007348
accaataagaa

SEQ ID NO: 89045 - DNA, 11 bp, Unknown
  misc_feature (1)..( 11): Result.001 file - promoters60/1007348
accaatcagaa

SEQ ID NO: 89046 - DNA, 8 bp, Unknown
  misc_feature (1)..( 8): Result.001 file - promoters60/1007348
aaaataag

SEQ ID NO: 89047 - DNA, 8 bp, Unknown
  misc_feature (1)..( 8): Result.001 file - promoters60/1007348
aaactaag

SEQ ID NO: 89048 - DNA, 8 bp, Unknown
  misc_feature (1)..( 8): Result.001 file - promoters60/1007348
taagttgt

SEQ ID NO: 89049 - DNA, 8 bp, Unknown
  misc_feature (1)..( 8): Result.001 file - promoters60/1007348
taaattgt

SEQ ID NO: 89050 - DNA, 6 bp, Unknown
  misc_feature (1)..( 6): Result.001 file - promoters60/1007348
atagat

SEQ ID NO: 89051 - DNA, 6 bp, Unknown
  misc_feature (1)..( 6): Result.001 file - promoters60/1007348
atagat

SEQ ID NO: 89052 - DNA, 7 bp, Unknown
  misc_feature (1)..( 7): Result.001 file - promoters60/1007348
agatata

SEQ ID NO: 89053 - DNA, 7 bp, Unknown
  misc_feature (1)..( 7): Result.001 file - promoters60/1007348
agagata

SEQ ID NO: 89054 - DNA, 6 bp, Unknown
  misc_feature (1)..( 6): Result.001 file - promoters60/1007348
ttttgg

SEQ ID NO: 89055 - DNA, 6 bp, Unknown
  misc_feature (1)..( 6): Result.001 file - promoters60/1007348
ttttgg

SEQ ID NO: 89056 - DNA, 6 bp, Unknown
  misc_feature (1)..( 6): Result.001 file - promoters60/1007348
taagat

SEQ ID NO: 89057 - DNA, 6 bp, Unknown
  misc_feature (1)..( 6): Result.001 file - promoters60/1007348
taagat

SEQ ID NO: 89058 - DNA, 6 bp, Unknown
  misc_feature (1)..( 6): Result.001 file - promoters60/1007348
aaagaa

SEQ ID NO: 89059 - DNA, 6 bp, Unknown
  misc_feature (1)..( 6): Result.001 file - promoters60/1007348
aaagaa

SEQ ID NO: 89060 - DNA, 12 bp, Unknown
  misc_feature (1)..( 12): Result.001 file - promoters60/1007348
aaaaacaaaaca

SEQ ID NO: 89061 - DNA, 12 bp, Unknown
  misc_feature (1)..( 12): Result.001 file - promoters60/1007348
aaacacaataca

SEQ ID NO: 89062 - DNA, 6 bp, Unknown
  misc_feature (1)..( 6): Result.001 file - promoters60/1007348
aaaaat

SEQ ID NO: 89063 - DNA, 6 bp, Unknown
  misc_feature (1)..( 6): Result.001 file - promoters60/1007348
aaaaat

SEQ ID NO: 89064 - DNA, 6 bp, Unknown
  misc_feature (1)..( 6): Result.001 file - promoters60/1007348
taaccc

SEQ ID NO: 89065 - DNA, 6 bp, Unknown
  misc_feature (1)..( 6): Result.001 file - promoters60/1007370
taaccc

SEQ ID NO: 89066 - DNA, 13 bp, Unknown
  misc_feature (1)..( 13): Result.001 file - promoters60/1007370
caacaatgtacaa

SEQ ID NO: 89067 - DNA, 13 bp, Unknown
  misc_feature (1)..( 13): Result.001 file - promoters60/1007370
caataatttacat

SEQ ID NO: 89068 - DNA, 13 bp, Unknown
  misc_feature (1)..( 13): Result.001 file - promoters60/1007370
ttacaatttacaa

SEQ ID NO: 89069 - DNA, 13 bp, Unknown
  misc_feature (1)..( 13): Result.001 file - promoters60/1007370
gaataataaaatg

SEQ ID NO: 89070 - DNA, 13 bp, Unknown
  misc_feature (1)..( 13): Result.001 file - promoters60/1007370
attttattaaaat

SEQ ID NO: 89071 - DNA, 13 bp, Unknown
  misc_feature (1)..( 13): Result.001 file - promoters60/1007370
gtataatttaatg

SEQ ID NO: 89072 - DNA, 11 bp, Unknown
  misc_feature (1)..( 11): Result.001 file - promoters60/1007370
aatttatctca

SEQ ID NO: 89073 - DNA, 11 bp, Unknown
  misc_feature (1)..( 11): Result.001 file - promoters60/1007370
attttttcttt

SEQ ID NO: 89074 - DNA, 11 bp, Unknown
  misc_feature (1)..( 11): Result.001 file - promoters60/1007370
aatttctctac

SEQ ID NO: 89075 - DNA, 11 bp, Unknown
  misc_feature (1)..( 11): Result.001 file - promoters60/1007370
tatttatgaaa

SEQ ID NO: 89076 - DNA, 11 bp, Unknown
  misc_feature (1)..( 11): Result.001 file - promoters60/1007370
tcattttgttt

SEQ ID NO: 89077 - DNA, 11 bp, Unknown
  misc_feature (1)..( 11): Result.001 file - promoters60/1007370
gattttgatgg

SEQ ID NO: 89078 - DNA, 12 bp, Unknown
  misc_feature (1)..( 12): Result.001 file - promoters60/1007370
agaatttttgta

SEQ ID NO: 89079 - DNA, 12 bp, Unknown
  misc_feature (1)..( 12): Result.001 file - promoters60/1007370
tgcatttttatt

SEQ ID NO: 89080 - DNA, 12 bp, Unknown
  misc_feature (1)..( 12): Result.001 file - promoters60/1007370
agaattttctgg

SEQ ID NO: 89081 - DNA, 12 bp, Unknown
  misc_feature (1)..( 12): Result.001 file - promoters60/1007370
atattttatatt

SEQ ID NO: 89082 - DNA, 12 bp, Unknown
  misc_feature (1)..( 12): Result.001 file - promoters60/1007370
actatttgataa

SEQ ID NO: 89083 - DNA, 12 bp, Unknown
  misc_feature (1)..( 12): Result.001 file - promoters60/1007524
tctaattgaaga

SEQ ID NO: 89084 - DNA, 9 bp, Unknown
  misc_feature (1)..( 9): Result.001 file - promoters60/1007524
tcttgtaaa

SEQ ID NO: 89085 - DNA, 9 bp, Unknown
  misc_feature (1)..( 9): Result.001 file - promoters60/1007524
tcttttaac

SEQ ID NO: 89086 - DNA, 10 bp, Unknown
  misc_feature (1)..( 10): Result.001 file - promoters60/1007524
cgatgtgaaa

SEQ ID NO: 89087 - DNA, 10 bp, Unknown
  misc_feature (1)..( 10): Result.001 file - promoters60/1007554
ggggtttaac

SEQ ID NO: 89088 - DNA, 9 bp, Unknown
  misc_feature (1)..( 9): Result.001 file - promoters60/1007554
atttgttag

SEQ ID NO: 89089 - DNA, 9 bp, Unknown
  misc_feature (1)..( 9): Result.001 file - promoters60/1007554
atttgtgta

SEQ ID NO: 89090 - DNA, 9 bp, Unknown
  misc_feature (1)..( 9): Result.001 file - promoters60/1007554
atttatgta

SEQ ID NO: 89091 - DNA, 9 bp, Unknown
  misc_feature (1)..( 9): Result.001 file - promoters60/1007554
atttattta

SEQ ID NO: 89092 - DNA, 8 bp, Unknown
  misc_feature (1)..( 8): Result.001 file - promoters60/1007554
aaaaataa

SEQ ID NO: 89093 - DNA, 8 bp, Unknown
  misc_feature (1)..( 8): Result.001 file - promoters60/1007554
taaagtaa

SEQ ID NO: 89094 - DNA, 8 bp, Unknown
  misc_feature (1)..( 8): Result.001 file - promoters60/1007554
aaaaattg

SEQ ID NO: 89095 - DNA, 8 bp, Unknown
  misc_feature (1)..( 8): Result.001 file - promoters60/1007554
caaaatat

SEQ ID NO: 89096 - DNA, 11 bp, Unknown
  misc_feature (1)..( 11): Result.001 file - promoters60/1007554
tataattttaa

SEQ ID NO: 89097 - DNA, 11 bp, Unknown
  misc_feature (1)..( 11): Result.001 file - promoters60/1007554
tttaattttat

SEQ ID NO: 89098 - DNA, 11 bp, Unknown
  misc_feature (1)..( 11): Result.001 file - promoters60/1007554
tttgattgaat

SEQ ID NO: 89099 - DNA, 11 bp, Unknown
  misc_feature (1)..( 11): Result.001 file - promoters60/1007576
tggctttttat

SEQ ID NO: 89100 - DNA, 7 bp, Unknown
  misc_feature (1)..( 7): Result.001 file - promoters60/1007576
aaacaaa

SEQ ID NO: 89101 - DNA, 7 bp, Unknown
  misc_feature (1)..( 7): Result.001 file - promoters60/1007576
aaagaaa

SEQ ID NO: 89102 - DNA, 10 bp, Unknown
  misc_feature (1)..( 10): Result.001 file - promoters60/1007576
ctggaatatg

SEQ ID NO: 89103 - DNA, 10 bp, Unknown
  misc_feature (1)..( 10): Result.001 file - promoters60/1007576
ctggaaaatg

SEQ ID NO: 89104 - DNA, 10 bp, Unknown
  misc_feature (1)..( 10): Result.001 file - promoters60/1007576
agggaaaagg

SEQ ID NO: 89105 - DNA, 6 bp, Unknown
  misc_feature (1)..( 6): Result.001 file - promoters60/1007576
aatgat

SEQ ID NO: 89106 - DNA, 6 bp, Unknown
  misc_feature (1)..( 6): Result.001 file - promoters60/1007576
aatgat

SEQ ID NO: 89107 - DNA, 8 bp, Unknown
  misc_feature (1)..( 8): Result.001 file - promoters60/1007576
cttctata

SEQ ID NO: 89108 - DNA, 8 bp, Unknown
  misc_feature (1)..( 8): Result.001 file - promoters60/1007576
cttcgata

SEQ ID NO: 89109 - DNA, 7 bp, Unknown
  misc_feature (1)..( 7): Result.001 file - promoters60/1007576
tcaggaa

SEQ ID NO: 89110 - DNA, 7 bp, Unknown
  misc_feature (1)..( 7): Result.001 file - promoters60/1007576
tcaggaa

SEQ ID NO: 89111 - DNA, 6 bp, Unknown
  misc_feature (1)..( 6): Result.001 file - promoters60/1007576
ttttct

SEQ ID NO: 89112 - DNA, 6 bp, Unknown
  misc_feature (1)..( 6): Result.001 file - promoters60/1007576
ttttct

SEQ ID NO: 89113 - DNA, 6 bp, Unknown
  misc_feature (1)..( 6): Result.001 file - promoters60/1007576
tgaaat

SEQ ID NO: 89114 - DNA, 6 bp, Unknown
  misc_feature (1)..( 6): Result.001 file - promoters60/1007576
tgaaat

SEQ ID NO: 89115 - DNA, 8 bp, Unknown
  misc_feature (1)..( 8): Result.001 file - promoters60/1007576
gtttctca

SEQ ID NO: 89116 - DNA, 8 bp, Unknown
  misc_feature (1)..( 8): Result.001 file - promoters60/1007576
gtttctca

SEQ ID NO: 89117 - DNA, 6 bp, Unknown
  misc_feature (1)..( 6): Result.001 file - promoters60/1007576
tatatt

SEQ ID NO: 89118 - DNA, 6 bp, Unknown
  misc_feature (1)..( 6): Result.001 file - promoters60/1007576
tatatt

SEQ ID NO: 89119 - DNA, 6 bp, Unknown
  misc_feature (1)..( 6): Result.001 file - promoters60/1007576
gatggt

SEQ ID NO: 89120 - DNA, 6 bp, Unknown
  misc_feature (1)..( 6): Result.001 file - promoters60/1007576
gatggt

SEQ ID NO: 89121 - DNA, 7 bp, Unknown
  misc_feature (1)..( 7): Result.001 file - promoters60/1007576
tctgttg

SEQ ID NO: 89122 - DNA, 7 bp, Unknown
  misc_feature (1)..( 7): Result.001 file - promoters60/1007576
tctcttg

SEQ ID NO: 89123 - DNA, 7 bp, Unknown
  misc_feature (1)..( 7): Result.001 file - promoters60/1007576
tttactc

SEQ ID NO: 89124 - DNA, 7 bp, Unknown
  misc_feature (1)..( 7): Result.001 file - promoters60/1007576
tttgctc

SEQ ID NO: 89125 - DNA, 7 bp, Unknown
  misc_feature (1)..( 7): Result.001 file - promoters60/1007576
ctgaaac

SEQ ID NO: 89126 - DNA, 7 bp, Unknown
  misc_feature (1)..( 7): Result.001 file - promoters60/1007639
ctgcaac

SEQ ID NO: 89127 - DNA, 10 bp, Unknown
  misc_feature (1)..( 10): Result.001 file - promoters60/1007639
cacaaaacat

SEQ ID NO: 89128 - DNA, 10 bp, Unknown
  misc_feature (1)..( 10): Result.001 file - promoters60/1007639
cacaaagact

SEQ ID NO: 89129 - DNA, 10 bp, Unknown
  misc_feature (1)..( 10): Result.001 file - promoters60/1007639
tacaaaaact

SEQ ID NO: 89130 - DNA, 10 bp, Unknown
  misc_feature (1)..( 10): Result.001 file - promoters60/1007639
tacaaatttg

SEQ ID NO: 89131 - DNA, 10 bp, Unknown
  misc_feature (1)..( 10): Result.001 file - promoters60/1007639
ccgaaaacta

SEQ ID NO: 89132 - DNA, 10 bp, Unknown
  misc_feature (1)..( 10): Result.001 file - promoters60/1007639
actaaaaact

SEQ ID NO: 89133 - DNA, 12 bp, Unknown
  misc_feature (1)..( 12): Result.001 file - promoters60/1007639
tataatatttcc

SEQ ID NO: 89134 - DNA, 12 bp, Unknown
  misc_feature (1)..( 12): Result.001 file - promoters60/1007639
tataatctttta

SEQ ID NO: 89135 - DNA, 12 bp, Unknown
  misc_feature (1)..( 12): Result.001 file - promoters60/1007639
tcgaaattttaa

SEQ ID NO: 89136 - DNA, 12 bp, Unknown
  misc_feature (1)..( 12): Result.001 file - promoters60/1007639
atgggtcttttt

SEQ ID NO: 89137 - DNA, 11 bp, Unknown
  misc_feature (1)..( 11): Result.001 file - promoters60/1007639
ccgaagtttct

SEQ ID NO: 89138 - DNA, 9 bp, Unknown
  misc_feature (1)..( 9): Result.001 file - promoters60/1007639
taaatttct

SEQ ID NO: 89139 - DNA, 16 bp, Unknown
  misc_feature (1)..( 16): Result.001 file - promoters60/1007639
tagaagaaagaaacct

SEQ ID NO: 89140 - DNA, 16 bp, Unknown
  misc_feature (1)..( 16): Result.001 file - promoters60/1007639
tagaagaaaaaaattt

SEQ ID NO: 89141 - DNA, 16 bp, Unknown
  misc_feature (1)..( 16): Result.001 file - promoters60/1007639
aatacaaaacaaaata

SEQ ID NO: 89142 - DNA, 16 bp, Unknown
  misc_feature (1)..( 16): Result.001 file - promoters60/1007639
tgacaaaaacaaattt

SEQ ID NO: 89143 - DNA, 16 bp, Unknown
  misc_feature (1)..( 16): Result.001 file - promoters60/1007639
tgacaaaaacaaattt

SEQ ID NO: 89144 - DNA, 16 bp, Unknown
  misc_feature (1)..( 16): Result.001 file - promoters60/1007639
caaattaaacaagtaa

SEQ ID NO: 89145 - DNA, 17 bp, Unknown
  misc_feature (1)..( 17): Result.001 file - promoters60/1007639
ttgatcaaatcaaatct

SEQ ID NO: 89146 - DNA, 9 bp, Unknown
  misc_feature (1)..( 9): Result.001 file - promoters60/1007639
atacattca

SEQ ID NO: 89147 - DNA, 9 bp, Unknown
  misc_feature (1)..( 9): Result.001 file - promoters60/1007639
ataaattta

SEQ ID NO: 89148 - DNA, 9 bp, Unknown
  misc_feature (1)..( 9): Result.001 file - promoters60/1007639
gaaaattta

SEQ ID NO: 89149 - DNA, 9 bp, Unknown
  misc_feature (1)..( 9): Result.001 file - promoters60/1007639
acaaatttg

SEQ ID NO: 89150 - DNA, 9 bp, Unknown
  misc_feature (1)..( 9): Result.001 file - promoters60/1007639
aaaaacttg

SEQ ID NO: 89151 - DNA, 9 bp, Unknown
  misc_feature (1)..( 9): Result.001 file - promoters60/1007639
gaaaactac

SEQ ID NO: 89152 - DNA, 9 bp, Unknown
  misc_feature (1)..( 9): Result.001 file - promoters60/1007639
aaaaactct

SEQ ID NO: 89153 - DNA, 9 bp, Unknown
  misc_feature (1)..( 9): Result.001 file - promoters60/1007639
ataacttta

SEQ ID NO: 89154 - DNA, 10 bp, Unknown
  misc_feature (1)..( 10): Result.001 file - promoters60/1007639
gaaaatttat

SEQ ID NO: 89155 - DNA, 10 bp, Unknown
  misc_feature (1)..( 10): Result.001 file - promoters60/1007639
acaaatttgt

SEQ ID NO: 89156 - DNA, 10 bp, Unknown
  misc_feature (1)..( 10): Result.001 file - promoters60/1007639
ataaatttag

SEQ ID NO: 89157 - DNA, 10 bp, Unknown
  misc_feature (1)..( 10): Result.001 file - promoters60/1007639
aaaaacttgg

SEQ ID NO: 89158 - DNA, 10 bp, Unknown
  misc_feature (1)..( 10): Result.001 file - promoters60/1007639
gaaaactact

SEQ ID NO: 89159 - DNA, 10 bp, Unknown
  misc_feature (1)..( 10): Result.001 file - promoters60/1007639
aaaaactcta

SEQ ID NO: 89160 - DNA, 10 bp, Unknown
  misc_feature (1)..( 10): Result.001 file - promoters60/1007639
aataacttta

SEQ ID NO: 89161 - DNA, 12 bp, Unknown
  misc_feature (1)..( 12): Result.001 file - promoters60/1007639
gttttctgtttg

SEQ ID NO: 89162 - DNA, 12 bp, Unknown
  misc_feature (1)..( 12): Result.001 file - promoters60/1007639
aatttttgtaga

SEQ ID NO: 89163 - DNA, 12 bp, Unknown
  misc_feature (1)..( 12): Result.001 file - promoters60/1007639
tttttctatcca

SEQ ID NO: 89164 - DNA, 12 bp, Unknown
  misc_feature (1)..( 12): Result.001 file - promoters60/1007639
tctttttacatt

SEQ ID NO: 89165 - DNA, 12 bp, Unknown
  misc_feature (1)..( 12): Result.001 file - promoters60/1007639
tgtttatataaa

SEQ ID NO: 89166 - DNA, 12 bp, Unknown
  misc_feature (1)..( 12): Result.001 file - promoters60/1007639
tggttatatagt

SEQ ID NO: 89167 - DNA, 12 bp, Unknown
  misc_feature (1)..( 12): Result.001 file - promoters60/1007675
atattacatagt

SEQ ID NO: 89168 - DNA, 8 bp, Unknown
  misc_feature (1)..( 8): Result.001 file - promoters60/1007675
ctataaag

SEQ ID NO: 89169 - DNA, 8 bp, Unknown
  misc_feature (1)..( 8): Result.001 file - promoters60/1007675
ctagaaag

SEQ ID NO: 89170 - DNA, 6 bp, Unknown
  misc_feature (1)..( 6): Result.001 file - promoters60/1007675
gagata

SEQ ID NO: 89171 - DNA, 6 bp, Unknown
  misc_feature (1)..( 6): Result.001 file - promoters60/1007675
gagata

SEQ ID NO: 89172 - DNA, 6 bp, Unknown
  misc_feature (1)..( 6): Result.001 file - promoters60/1007675
caagac

SEQ ID NO: 89173 - DNA, 6 bp, Unknown
  misc_feature (1)..( 6): Result.001 file - promoters60/1007675
caagac

SEQ ID NO: 89174 - DNA, 7 bp, Unknown
  misc_feature (1)..( 7): Result.001 file - promoters60/1007675
taatatt

SEQ ID NO: 89175 - DNA, 7 bp, Unknown
  misc_feature (1)..( 7): Result.001 file - promoters60/1007675
taatatt

SEQ ID NO: 89176 - DNA, 7 bp, Unknown
  misc_feature (1)..( 7): Result.001 file - promoters60/1007675
aaaggga

SEQ ID NO: 89177 - DNA, 7 bp, Unknown
  misc_feature (1)..( 7): Result.001 file - promoters60/1007675
aaatgga

SEQ ID NO: 89178 - DNA, 6 bp, Unknown
  misc_feature (1)..( 6): Result.001 file - promoters60/1007675
tacaaa

SEQ ID NO: 89179 - DNA, 6 bp, Unknown
  misc_feature (1)..( 6): Result.001 file - promoters60/1007675
tacaaa

SEQ ID NO: 89180 - DNA, 7 bp, Unknown
  misc_feature (1)..( 7): Result.001 file - promoters60/1007675
aaagaaa

SEQ ID NO: 89181 - DNA, 7 bp, Unknown
  misc_feature (1)..( 7): Result.001 file - promoters60/1007675
aaaaaaa

SEQ ID NO: 89182 - DNA, 8 bp, Unknown
  misc_feature (1)..( 8): Result.001 file - promoters60/1007675
aaatcaac

SEQ ID NO: 89183 - DNA, 8 bp, Unknown
  misc_feature (1)..( 8): Result.001 file - promoters60/1007675
aaatcaac

SEQ ID NO: 89184 - DNA, 6 bp, Unknown
  misc_feature (1)..( 6): Result.001 file - promoters60/1007675
aagtcc

SEQ ID NO: 89185 - DNA, 6 bp, Unknown
  misc_feature (1)..( 6): Result.001 file - promoters60/1007675
aagtcc

SEQ ID NO: 89186 - DNA, 7 bp, Unknown
  misc_feature (1)..( 7): Result.001 file - promoters60/1007675
tcacttg

SEQ ID NO: 89187 - DNA, 7 bp, Unknown
  misc_feature (1)..( 7): Result.001 file - promoters60/1007675
tcaattg

SEQ ID NO: 89188 - DNA, 7 bp, Unknown
  misc_feature (1)..( 7): Result.001 file - promoters60/1007675
tatgatt

SEQ ID NO: 89189 - DNA, 7 bp, Unknown
  misc_feature (1)..( 7): Result.001 file - promoters60/1007675
tattatt

SEQ ID NO: 89190 - DNA, 6 bp, Unknown
  misc_feature (1)..( 6): Result.001 file - promoters60/1007675
atatat

SEQ ID NO: 89191 - DNA, 6 bp, Unknown
  misc_feature (1)..( 6): Result.001 file - promoters60/1007675
atatat

SEQ ID NO: 89192 - DNA, 6 bp, Unknown
  misc_feature (1)..( 6): Result.001 file - promoters60/1007675
gaagac

SEQ ID NO: 89193 - DNA, 6 bp, Unknown
  misc_feature (1)..( 6): Result.001 file - promoters60/1007675
gaagac

SEQ ID NO: 89194 - DNA, 10 bp, Unknown
  misc_feature (1)..( 10): Result.001 file - promoters60/1007675
tattattgaa

SEQ ID NO: 89195 - DNA, 10 bp, Unknown
  misc_feature (1)..( 10): Result.001 file - promoters60/1007675
tattaatgaa

SEQ ID NO: 89196 - DNA, 7 bp, Unknown
  misc_feature (1)..( 7): Result.001 file - promoters60/1007675
tttagaa

SEQ ID NO: 89197 - DNA, 7 bp, Unknown
  misc_feature (1)..( 7): Result.001 file - promoters60/1007675
tttggaa

SEQ ID NO: 89198 - DNA, 6 bp, Unknown
  misc_feature (1)..( 6): Result.001 file - promoters60/1007675
aaataa

SEQ ID NO: 89199 - DNA, 6 bp, Unknown
  misc_feature (1)..( 6): Result.001 file - promoters60/1007675
aaataa

SEQ ID NO: 89200 - DNA, 9 bp, Unknown
  misc_feature (1)..( 9): Result.001 file - promoters60/1007675
tcccaaagt

SEQ ID NO: 89201 - DNA, 9 bp, Unknown
  misc_feature (1)..( 9): Result.001 file - promoters60/1007675
tccaaaagt

SEQ ID NO: 89202 - DNA, 8 bp, Unknown
  misc_feature (1)..( 8): Result.001 file - promoters60/1007675
tccatatg

SEQ ID NO: 89203 - DNA, 8 bp, Unknown
  misc_feature (1)..( 8): Result.001 file - promoters60/1007675
tccaaatg

SEQ ID NO: 89204 - DNA, 7 bp, Unknown
  misc_feature (1)..( 7): Result.001 file - promoters60/1007675
aaagaaa

SEQ ID NO: 89205 - DNA, 7 bp, Unknown
  misc_feature (1)..( 7): Result.001 file - promoters60/1007675
aaataaa

SEQ ID NO: 89206 - DNA, 6 bp, Unknown
  misc_feature (1)..( 6): Result.001 file - promoters60/1007675
ggaaat

SEQ ID NO: 89207 - DNA, 6 bp, Unknown
  misc_feature (1)..( 6): Result.001 file - promoters60/1007675
ggaaat

SEQ ID NO: 89208 - DNA, 7 bp, Unknown
  misc_feature (1)..( 7): Result.001 file - promoters60/1007675
atataaa

SEQ ID NO: 89209 - DNA, 7 bp, Unknown
  misc_feature (1)..( 7): Result.001 file - promoters60/1007731
ataaaaa

SEQ ID NO: 89210 - DNA, 6 bp, Unknown
  misc_feature (1)..( 6): Result.001 file - promoters60/1007731
ttttta

SEQ ID NO: 89211 - DNA, 6 bp, Unknown
  misc_feature (1)..( 6): Result.001 file - promoters60/1007731
ttttta

SEQ ID NO: 89212 - DNA, 6 bp, Unknown
  misc_feature (1)..( 6): Result.001 file - promoters60/1007731
atttac

SEQ ID NO: 89213 - DNA, 6 bp, Unknown
  misc_feature (1)..( 6): Result.001 file - promoters60/1007731
atttac

SEQ ID NO: 89214 - DNA, 6 bp, Unknown
  misc_feature (1)..( 6): Result.001 file - promoters60/1007731
atttac

SEQ ID NO: 89215 - DNA, 6 bp, Unknown
  misc_feature (1)..( 6): Result.001 file - promoters60/1007731
ctgttg

SEQ ID NO: 89216 - DNA, 6 bp, Unknown
  misc_feature (1)..( 6): Result.001 file - promoters60/1007731
ctgttg

SEQ ID NO: 89217 - DNA, 6 bp, Unknown
  misc_feature (1)..( 6): Result.001 file - promoters60/1007731
aaacta

SEQ ID NO: 89218 - DNA, 6 bp, Unknown
  misc_feature (1)..( 6): Result.001 file - promoters60/1007731
aaacta

SEQ ID NO: 89219 - DNA, 7 bp, Unknown
  misc_feature (1)..( 7): Result.001 file - promoters60/1007731
atttgag

SEQ ID NO: 89220 - DNA, 7 bp, Unknown
  misc_feature (1)..( 7): Result.001 file - promoters60/1007731
attcgag

SEQ ID NO: 89221 - DNA, 7 bp, Unknown
  misc_feature (1)..( 7): Result.001 file - promoters60/1007731
tttcctt

SEQ ID NO: 89222 - DNA, 7 bp, Unknown
  misc_feature (1)..( 7): Result.001 file - promoters60/1007731
ttttctt

SEQ ID NO: 89223 - DNA, 6 bp, Unknown
  misc_feature (1)..( 6): Result.001 file - promoters60/1007731
tatttt

SEQ ID NO: 89224 - DNA, 6 bp, Unknown
  misc_feature (1)..( 6): Result.001 file - promoters60/1007731
tatttt

SEQ ID NO: 89225 - DNA, 6 bp, Unknown
  misc_feature (1)..( 6): Result.001 file - promoters60/1007731
ttgaat

SEQ ID NO: 89226 - DNA, 6 bp, Unknown
  misc_feature (1)..( 6): Result.001 file - promoters60/1007731
ttgaat

SEQ ID NO: 89227 - DNA, 6 bp, Unknown
  misc_feature (1)..( 6): Result.001 file - promoters60/1007731
attgaa

SEQ ID NO: 89228 - DNA, 6 bp, Unknown
  misc_feature (1)..( 6): Result.001 file - promoters60/1007731
attgaa

SEQ ID NO: 89229 - DNA, 7 bp, Unknown
  misc_feature (1)..( 7): Result.001 file - promoters60/1007731
tgagatt

SEQ ID NO: 89230 - DNA, 7 bp, Unknown
  misc_feature (1)..( 7): Result.001 file - promoters60/1007731
tgacatt

SEQ ID NO: 89231 - DNA, 10 bp, Unknown
  misc_feature (1)..( 10): Result.001 file - promoters60/1007731
aaattagttg

SEQ ID NO: 89232 - DNA, 10 bp, Unknown
  misc_feature (1)..( 10): Result.001 file - promoters60/1007731
aaattacttg

SEQ ID NO: 89233 - DNA, 7 bp, Unknown
  misc_feature (1)..( 7): Result.001 file - promoters60/1007731
atgtgac

SEQ ID NO: 89234 - DNA, 7 bp, Unknown
  misc_feature (1)..( 7): Result.001 file - promoters60/1007731
atgtgac

SEQ ID NO: 89235 - DNA, 9 bp, Unknown
  misc_feature (1)..( 9): Result.001 file - promoters60/1007731
tgactccat

SEQ ID NO: 89236 - DNA, 9 bp, Unknown
  misc_feature (1)..( 9): Result.001 file - promoters60/1007731
tgacttcat

SEQ ID NO: 89237 - DNA, 7 bp, Unknown
  misc_feature (1)..( 7): Result.001 file - promoters60/1007731
acgttta

SEQ ID NO: 89238 - DNA, 7 bp, Unknown
  misc_feature (1)..( 7): Result.001 file - promoters60/1007731
acgatta

SEQ ID NO: 89239 - DNA, 8 bp, Unknown
  misc_feature (1)..( 8): Result.001 file - promoters60/1007731
agaaaatt

SEQ ID NO: 89240 - DNA, 8 bp, Unknown
  misc_feature (1)..( 8): Result.001 file - promoters60/1007731
agaatatt

SEQ ID NO: 89241 - DNA, 6 bp, Unknown
  misc_feature (1)..( 6): Result.001 file - promoters60/1007731
aaaatt

SEQ ID NO: 89242 - DNA, 6 bp, Unknown
  misc_feature (1)..( 6): Result.001 file - promoters60/1007731
aaaatt

SEQ ID NO: 89243 - DNA, 7 bp, Unknown
  misc_feature (1)..( 7): Result.001 file - promoters60/1007731
caaaatg

SEQ ID NO: 89244 - DNA, 7 bp, Unknown
  misc_feature (1)..( 7): Result.001 file - promoters60/1007731
caacatg

SEQ ID NO: 89245 - DNA, 6 bp, Unknown
  misc_feature (1)..( 6): Result.001 file - promoters60/1007731
gtttac

SEQ ID NO: 89246 - DNA, 6 bp, Unknown
  misc_feature (1)..( 6): Result.001 file - promoters60/1007731
gtttac

SEQ ID NO: 89247 - DNA, 6 bp, Unknown
  misc_feature (1)..( 6): Result.001 file - promoters60/1007731
ccaaat

SEQ ID NO: 89248 - DNA, 6 bp, Unknown
  misc_feature (1)..( 6): Result.001 file - promoters60/1007756
ccaaat

SEQ ID NO: 89249 - DNA, 7 bp, Unknown
  misc_feature (1)..( 7): Result.001 file - promoters60/1007756
cttctag

SEQ ID NO: 89250 - DNA, 7 bp, Unknown
  misc_feature (1)..( 7): Result.001 file - promoters60/1007756
cttgtag

SEQ ID NO: 89251 - DNA, 6 bp, Unknown
  misc_feature (1)..( 6): Result.001 file - promoters60/1007756
attcac

SEQ ID NO: 89252 - DNA, 6 bp, Unknown
  misc_feature (1)..( 6): Result.001 file - promoters60/1007756
attcac

SEQ ID NO: 89253 - DNA, 8 bp, Unknown
  misc_feature (1)..( 8): Result.001 file - promoters60/1007756
tcacgtta

SEQ ID NO: 89254 - DNA, 8 bp, Unknown
  misc_feature (1)..( 8): Result.001 file - promoters60/1007756
tcacatta

SEQ ID NO: 89255 - DNA, 13 bp, Unknown
  misc_feature (1)..( 13): Result.001 file - promoters60/1007756
aaccggttaaatc

SEQ ID NO: 89256 - DNA, 13 bp, Unknown
  misc_feature (1)..( 13): Result.001 file - promoters60/1007756
aacctgtttgttg

SEQ ID NO: 89257 - DNA, 13 bp, Unknown
  misc_feature (1)..( 13): Result.001 file - promoters60/1007756
actctgtttcttg

SEQ ID NO: 89258 - DNA, 6 bp, Unknown
  misc_feature (1)..( 6): Result.001 file - promoters60/1007756
tattta

SEQ ID NO: 89259 - DNA, 6 bp, Unknown
  misc_feature (1)..( 6): Result.001 file - promoters60/1007756
tattta

SEQ ID NO: 89260 - DNA, 9 bp, Unknown
  misc_feature (1)..( 9): Result.001 file - promoters60/1007756
cggtttata

SEQ ID NO: 89261 - DNA, 9 bp, Unknown
  misc_feature (1)..( 9): Result.001 file - promoters60/1007756
cggtttata

SEQ ID NO: 89262 - DNA, 6 bp, Unknown
  misc_feature (1)..( 6): Result.001 file - promoters60/1007756
gatgat

SEQ ID NO: 89263 - DNA, 6 bp, Unknown
  misc_feature (1)..( 6): Result.001 file - promoters60/1007756
gatgat

SEQ ID NO: 89264 - DNA, 6 bp, Unknown
  misc_feature (1)..( 6): Result.001 file - promoters60/1007756
acccgg

SEQ ID NO: 89265 - DNA, 6 bp, Unknown
  misc_feature (1)..( 6): Result.001 file - promoters60/1007756
acccgg

SEQ ID NO: 89266 - DNA, 8 bp, Unknown
  misc_feature (1)..( 8): Result.001 file - promoters60/1007756
aatggtaa

SEQ ID NO: 89267 - DNA, 8 bp, Unknown
  misc_feature (1)..( 8): Result.001 file - promoters60/1007756
aatagtaa

SEQ ID NO: 89268 - DNA, 9 bp, Unknown
  misc_feature (1)..( 9): Result.001 file - promoters60/1007756
attctgaaa

SEQ ID NO: 89269 - DNA, 9 bp, Unknown
  misc_feature (1)..( 9): Result.001 file - promoters60/1007759
attttgaaa

SEQ ID NO: 89270 - DNA, 12 bp, Unknown
  misc_feature (1)..( 12): Result.001 file - promoters60/1007759
aaactacgtcaa

SEQ ID NO: 89271 - DNA, 12 bp, Unknown
  misc_feature (1)..( 12): Result.001 file - promoters60/1007759
aaactacacata

SEQ ID NO: 89272 - DNA, 12 bp, Unknown
  misc_feature (1)..( 12): Result.001 file - promoters60/1007759
aaattactctta

SEQ ID NO: 89273 - DNA, 12 bp, Unknown
  misc_feature (1)..( 12): Result.001 file - promoters60/1007759
aaacaacatata

SEQ ID NO: 89274 - DNA, 12 bp, Unknown
  misc_feature (1)..( 12): Result.001 file - promoters60/1007759
aaacaaatcaaa

SEQ ID NO: 89275 - DNA, 12 bp, Unknown
  misc_feature (1)..( 12): Result.001 file - promoters60/1007759
aaaaaaagttat

SEQ ID NO: 89276 - DNA, 12 bp, Unknown
  misc_feature (1)..( 12): Result.001 file - promoters60/1007795
agataaagaagt

SEQ ID NO: 89277 - DNA, 10 bp, Unknown
  misc_feature (1)..( 10): Result.001 file - promoters60/1007795
actatttaaa

SEQ ID NO: 89278 - DNA, 10 bp, Unknown
  misc_feature (1)..( 10): Result.001 file - promoters60/1007795
actttttttt

SEQ ID NO: 89279 - DNA, 10 bp, Unknown
  misc_feature (1)..( 10): Result.001 file - promoters60/1007795
catatataaa

SEQ ID NO: 89280 - DNA, 10 bp, Unknown
  misc_feature (1)..( 10): Result.001 file - promoters60/1007795
tctttttgtt

SEQ ID NO: 89281 - DNA, 10 bp, Unknown
  misc_feature (1)..( 10): Result.001 file - promoters60/1007795
catttttttc

SEQ ID NO: 89282 - DNA, 15 bp, Unknown
  misc_feature (1)..( 15): Result.001 file - promoters60/1007795
aatttatattgattt

SEQ ID NO: 89283 - DNA, 15 bp, Unknown
  misc_feature (1)..( 15): Result.001 file - promoters60/1007795
gttttgtattatcaa

SEQ ID NO: 89284 - DNA, 15 bp, Unknown
  misc_feature (1)..( 15): Result.001 file - promoters60/1007795
atactatatttattt

SEQ ID NO: 89285 - DNA, 16 bp, Unknown
  misc_feature (1)..( 16): Result.001 file - promoters60/1007795
agtttggtatttgatt

SEQ ID NO: 89286 - DNA, 9 bp, Unknown
  misc_feature (1)..( 9): Result.001 file - promoters60/1007795
ttagttttg

SEQ ID NO: 89287 - DNA, 9 bp, Unknown
  misc_feature (1)..( 9): Result.001 file - promoters60/1007795
aaagttttt

SEQ ID NO: 89288 - DNA, 10 bp, Unknown
  misc_feature (1)..( 10): Result.001 file - promoters60/1007795
aacgttgttg

SEQ ID NO: 89289 - DNA, 10 bp, Unknown
  misc_feature (1)..( 10): Result.001 file - promoters60/1007802
aaaatttcag

SEQ ID NO: 89290 - DNA, 9 bp, Unknown
  misc_feature (1)..( 9): Result.001 file - promoters60/1007802
agattttct

SEQ ID NO: 89291 - DNA, 9 bp, Unknown
  misc_feature (1)..( 9): Result.001 file - promoters60/1007802
tcattatct

SEQ ID NO: 89292 - DNA, 9 bp, Unknown
  misc_feature (1)..( 9): Result.001 file - promoters60/1007802
agattttaa

SEQ ID NO: 89293 - DNA, 6 bp, Unknown
  misc_feature (1)..( 6): Result.001 file - promoters60/1007802
aaaaac

SEQ ID NO: 89294 - DNA, 6 bp, Unknown
  misc_feature (1)..( 6): Result.001 file - promoters60/1007802
aaaaac

SEQ ID NO: 89295 - DNA, 6 bp, Unknown
  misc_feature (1)..( 6): Result.001 file - promoters60/1007802
aaaaac

SEQ ID NO: 89296 - DNA, 9 bp, Unknown
  misc_feature (1)..( 9): Result.001 file - promoters60/1007802
tgaaaaagt

SEQ ID NO: 89297 - DNA, 9 bp, Unknown
  misc_feature (1)..( 9): Result.001 file - promoters60/1007802
tgaaaaaaa

SEQ ID NO: 89298 - DNA, 9 bp, Unknown
  misc_feature (1)..( 9): Result.001 file - promoters60/1007802
ttaaaaaaa

SEQ ID NO: 89299 - DNA, 11 bp, Unknown
  misc_feature (1)..( 11): Result.001 file - promoters60/1007802
gtttacttgct

SEQ ID NO: 89300 - DNA, 11 bp, Unknown
  misc_feature (1)..( 11): Result.001 file - promoters60/1007802
atttatttgtg

SEQ ID NO: 89301 - DNA, 11 bp, Unknown
  misc_feature (1)..( 11): Result.001 file - promoters60/1007802
atttattagtg

SEQ ID NO: 89302 - DNA, 8 bp, Unknown
  misc_feature (1)..( 8): Result.001 file - promoters60/1007802
tagtacta

SEQ ID NO: 89303 - DNA, 8 bp, Unknown
  misc_feature (1)..( 8): Result.001 file - promoters60/1007802
atgtacta

SEQ ID NO: 89304 - DNA, 8 bp, Unknown
  misc_feature (1)..( 8): Result.001 file - promoters60/1007802
atgaactc

SEQ ID NO: 89305 - DNA, 9 bp, Unknown
  misc_feature (1)..( 9): Result.001 file - promoters60/1007802
aaaatttgt

SEQ ID NO: 89306 - DNA, 9 bp, Unknown
  misc_feature (1)..( 9): Result.001 file - promoters60/1007802
aaaatgtgt

SEQ ID NO: 89307 - DNA, 9 bp, Unknown
  misc_feature (1)..( 9): Result.001 file - promoters60/1007967
aaaatttga

SEQ ID NO: 89308 - DNA, 6 bp, Unknown
  misc_feature (1)..( 6): Result.001 file - promoters60/1007967
gtttta

SEQ ID NO: 89309 - DNA, 6 bp, Unknown
  misc_feature (1)..( 6): Result.001 file - promoters60/1007967
gtttta

SEQ ID NO: 89310 - DNA, 8 bp, Unknown
  misc_feature (1)..( 8): Result.001 file - promoters60/1007967
attcttaa

SEQ ID NO: 89311 - DNA, 8 bp, Unknown
  misc_feature (1)..( 8): Result.001 file - promoters60/1007967
attgttat

SEQ ID NO: 89312 - DNA, 8 bp, Unknown
  misc_feature (1)..( 8): Result.001 file - promoters60/1007967
gttcataa

SEQ ID NO: 89313 - DNA, 9 bp, Unknown
  misc_feature (1)..( 9): Result.001 file - promoters60/1007967
aatttcaac

SEQ ID NO: 89314 - DNA, 9 bp, Unknown
  misc_feature (1)..( 9): Result.001 file - promoters60/1007967
aatttgaac

SEQ ID NO: 89315 - DNA, 9 bp, Unknown
  misc_feature (1)..( 9): Result.001 file - promoters60/1007967
aatgtgaaa

SEQ ID NO: 89316 - DNA, 6 bp, Unknown
  misc_feature (1)..( 6): Result.001 file - promoters60/1007967
attcat

SEQ ID NO: 89317 - DNA, 6 bp, Unknown
  misc_feature (1)..( 6): Result.001 file - promoters60/1007967
attcat

SEQ ID NO: 89318 - DNA, 6 bp, Unknown
  misc_feature (1)..( 6): Result.001 file - promoters60/1007967
ttttaa

SEQ ID NO: 89319 - DNA, 6 bp, Unknown
  misc_feature (1)..( 6): Result.001 file - promoters60/1007967
ttttaa

SEQ ID NO: 89320 - DNA, 6 bp, Unknown
  misc_feature (1)..( 6): Result.001 file - promoters60/1007967
gtgtaa

SEQ ID NO: 89321 - DNA, 6 bp, Unknown
  misc_feature (1)..( 6): Result.001 file - promoters60/1007967
gtgtaa

SEQ ID NO: 89322 - DNA, 9 bp, Unknown
  misc_feature (1)..( 9): Result.001 file - promoters60/1007967
cataagtgt

SEQ ID NO: 89323 - DNA, 9 bp, Unknown
  misc_feature (1)..( 9): Result.001 file - promoters60/1007967
cataactgt

SEQ ID NO: 89324 - DNA, 7 bp, Unknown
  misc_feature (1)..( 7): Result.001 file - promoters60/1007967
ttattga

SEQ ID NO: 89325 - DNA, 7 bp, Unknown
  misc_feature (1)..( 7): Result.001 file - promoters60/1007967
ttactga

SEQ ID NO: 89326 - DNA, 6 bp, Unknown
  misc_feature (1)..( 6): Result.001 file - promoters60/1007967
aaccaa

SEQ ID NO: 89327 - DNA, 6 bp, Unknown
  misc_feature (1)..( 6): Result.001 file - promoters60/1007967
aaccaa

SEQ ID NO: 89328 - DNA, 6 bp, Unknown
  misc_feature (1)..( 6): Result.001 file - promoters60/1007967
tttcac

SEQ ID NO: 89329 - DNA, 6 bp, Unknown
  misc_feature (1)..( 6): Result.001 file - promoters60/1007967
tttcac

SEQ ID NO: 89330 - DNA, 6 bp, Unknown
  misc_feature (1)..( 6): Result.001 file - promoters60/1007967
aaactc

SEQ ID NO: 89331 - DNA, 6 bp, Unknown
  misc_feature (1)..( 6): Result.001 file - promoters60/1007967
aaactc

SEQ ID NO: 89332 - DNA, 8 bp, Unknown
  misc_feature (1)..( 8): Result.001 file - promoters60/1007967
tcatatgt

SEQ ID NO: 89333 - DNA, 8 bp, Unknown
  misc_feature (1)..( 8): Result.001 file - promoters60/1007967
tcatgtgt

SEQ ID NO: 89334 - DNA, 7 bp, Unknown
  misc_feature (1)..( 7): Result.001 file - promoters60/1007967
aaacaga

SEQ ID NO: 89335 - DNA, 7 bp, Unknown
  misc_feature (1)..( 7): Result.001 file - promoters60/1007967
aaacaga

SEQ ID NO: 89336 - DNA, 9 bp, Unknown
  misc_feature (1)..( 9): Result.001 file - promoters60/1007967
ataacataa

SEQ ID NO: 89337 - DNA, 9 bp, Unknown
  misc_feature (1)..( 9): Result.001 file - promoters60/1007967
ataaaataa

SEQ ID NO: 89338 - DNA, 9 bp, Unknown
  misc_feature (1)..( 9): Result.001 file - promoters60/1007967
ttatccaac

SEQ ID NO: 89339 - DNA, 9 bp, Unknown
  misc_feature (1)..( 9): Result.001 file - promoters60/1008070
ttatccaac

SEQ ID NO: 89340 - DNA, 9 bp, Unknown
  misc_feature (1)..( 9): Result.001 file - promoters60/1008070
caacaaagt

SEQ ID NO: 89341 - DNA, 9 bp, Unknown
  misc_feature (1)..( 9): Result.001 file - promoters60/1008070
aaacaaacg

SEQ ID NO: 89342 - DNA, 9 bp, Unknown
  misc_feature (1)..( 9): Result.001 file - promoters60/1008070
gaaaaaaaa

SEQ ID NO: 89343 - DNA, 9 bp, Unknown
  misc_feature (1)..( 9): Result.001 file - promoters60/1008070
taaaaaaag

SEQ ID NO: 89344 - DNA, 9 bp, Unknown
  misc_feature (1)..( 9): Result.001 file - promoters60/1008070
aaacaaatg

SEQ ID NO: 89345 - DNA, 9 bp, Unknown
  misc_feature (1)..( 9): Result.001 file - promoters60/1008070
taaaaaata

SEQ ID NO: 89346 - DNA, 11 bp, Unknown
  misc_feature (1)..( 11): Result.001 file - promoters60/1008070
ccactatataa

SEQ ID NO: 89347 - DNA, 11 bp, Unknown
  misc_feature (1)..( 11): Result.001 file - promoters60/1008070
ccattatatat

SEQ ID NO: 89348 - DNA, 11 bp, Unknown
  misc_feature (1)..( 11): Result.001 file - promoters60/1008070
cttttatatat

SEQ ID NO: 89349 - DNA, 11 bp, Unknown
  misc_feature (1)..( 11): Result.001 file - promoters60/1008070
cgcctatatat

SEQ ID NO: 89350 - DNA, 11 bp, Unknown
  misc_feature (1)..( 11): Result.001 file - promoters60/1008070
gtgagatataa

SEQ ID NO: 89351 - DNA, 11 bp, Unknown
  misc_feature (1)..( 11): Result.001 file - promoters60/1008070
tccctataaat

SEQ ID NO: 89352 - DNA, 9 bp, Unknown
  misc_feature (1)..( 9): Result.001 file - promoters60/1008070
ggaataaga

SEQ ID NO: 89353 - DNA, 9 bp, Unknown
  misc_feature (1)..( 9): Result.001 file - promoters60/1008070
gcaataaga

SEQ ID NO: 89354 - DNA, 9 bp, Unknown
  misc_feature (1)..( 9): Result.001 file - promoters60/1008070
gcaaaaagt

SEQ ID NO: 89355 - DNA, 9 bp, Unknown
  misc_feature (1)..( 9): Result.001 file - promoters60/1008070
ttaaaaaag

SEQ ID NO: 89356 - DNA, 9 bp, Unknown
  misc_feature (1)..( 9): Result.001 file - promoters60/1008070
ttaaaataa

SEQ ID NO: 89357 - DNA, 9 bp, Unknown
  misc_feature (1)..( 9): Result.001 file - promoters60/1008070
ttaaaataa

SEQ ID NO: 89358 - DNA, 10 bp, Unknown
  misc_feature (1)..( 10): Result.001 file - promoters60/1008070
tgtttgattg

SEQ ID NO: 89359 - DNA, 10 bp, Unknown
  misc_feature (1)..( 10): Result.001 file - promoters60/1008070
tatttcattt

SEQ ID NO: 89360 - DNA, 10 bp, Unknown
  misc_feature (1)..( 10): Result.001 file - promoters60/1008070
atttttattc

SEQ ID NO: 89361 - DNA, 10 bp, Unknown
  misc_feature (1)..( 10): Result.001 file - promoters60/1008070
agatttattt

SEQ ID NO: 89362 - DNA, 10 bp, Unknown
  misc_feature (1)..( 10): Result.001 file - promoters60/1008070
atttttacca

SEQ ID NO: 89363 - DNA, 10 bp, Unknown
  misc_feature (1)..( 10): Result.001 file - promoters60/1008148
tagtatatca

SEQ ID NO: 89364 - DNA, 19 bp, Unknown
  misc_feature (1)..( 19): Result.001 file - promoters60/1008148
tacatttatctctcaaaga

SEQ ID NO: 89365 - DNA, 19 bp, Unknown
  misc_feature (1)..( 19): Result.001 file - promoters60/1008148
aaatgaattctttcaaaat

SEQ ID NO: 89366 - DNA, 19 bp, Unknown
  misc_feature (1)..( 19): Result.001 file - promoters60/1008148
caaaccaaactctcattcc

SEQ ID NO: 89367 - DNA, 19 bp, Unknown
  misc_feature (1)..( 19): Result.001 file - promoters60/1008148
aaataaattattttctttt

SEQ ID NO: 89368 - DNA, 19 bp, Unknown
  misc_feature (1)..( 19): Result.001 file - promoters60/1008148
taaaattagcagtcaaata

SEQ ID NO: 89369 - DNA, 19 bp, Unknown
  misc_feature (1)..( 19): Result.001 file - promoters60/1008218
ggtgagaatcattaatcct

SEQ ID NO: 89370 - DNA, 13 bp, Unknown
  misc_feature (1)..( 13): Result.001 file - promoters60/1008218
tgattgaaataaa

SEQ ID NO: 89371 - DNA, 13 bp, Unknown
  misc_feature (1)..( 13): Result.001 file - promoters60/1008218
agattaaaaaaag

SEQ ID NO: 89372 - DNA, 13 bp, Unknown
  misc_feature (1)..( 13): Result.001 file - promoters60/1008218
tgaatgatgttcc

SEQ ID NO: 89373 - DNA, 13 bp, Unknown
  misc_feature (1)..( 13): Result.001 file - promoters60/1008218
gacttaaaatcta

SEQ ID NO: 89374 - DNA, 13 bp, Unknown
  misc_feature (1)..( 13): Result.001 file - promoters60/1008218
atcttaaatgctt

SEQ ID NO: 89375 - DNA, 13 bp, Unknown
  misc_feature (1)..( 13): Result.001 file - promoters60/1008218
gctctaaaatcta

SEQ ID NO: 89376 - DNA, 16 bp, Unknown
  misc_feature (1)..( 16): Result.001 file - promoters60/1008218
ttttggtgagaagatt

SEQ ID NO: 89377 - DNA, 16 bp, Unknown
  misc_feature (1)..( 16): Result.001 file - promoters60/1008218
gacacaagagaagaag

SEQ ID NO: 89378 - DNA, 16 bp, Unknown
  misc_feature (1)..( 16): Result.001 file - promoters60/1008218
tttgggtgagaatcat

SEQ ID NO: 89379 - DNA, 16 bp, Unknown
  misc_feature (1)..( 16): Result.001 file - promoters60/1008218
gaaaagaaagaagaac

SEQ ID NO: 89380 - DNA, 16 bp, Unknown
  misc_feature (1)..( 16): Result.001 file - promoters60/1008218
ccaaattctgaacatt

SEQ ID NO: 89381 - DNA, 16 bp, Unknown
  misc_feature (1)..( 16): Result.001 file - promoters60/1008218
ctcaaaagagaaaggt

SEQ ID NO: 89382 - DNA, 9 bp, Unknown
  misc_feature (1)..( 9): Result.001 file - promoters60/1008218
caaacacaa

SEQ ID NO: 89383 - DNA, 9 bp, Unknown
  misc_feature (1)..( 9): Result.001 file - promoters60/1008218
caaacaaat

SEQ ID NO: 89384 - DNA, 9 bp, Unknown
  misc_feature (1)..( 9): Result.001 file - promoters60/1008218
gaaacacaa

SEQ ID NO: 89385 - DNA, 9 bp, Unknown
  misc_feature (1)..( 9): Result.001 file - promoters60/1008218
caaagaaag

SEQ ID NO: 89386 - DNA, 9 bp, Unknown
  misc_feature (1)..( 9): Result.001 file - promoters60/1008218
aaaagaaag

SEQ ID NO: 89387 - DNA, 9 bp, Unknown
  misc_feature (1)..( 9): Result.001 file - promoters60/1008319
caaggaaag

SEQ ID NO: 89388 - DNA, 9 bp, Unknown
  misc_feature (1)..( 9): Result.001 file - promoters60/1008319
ggacaaggc

SEQ ID NO: 89389 - DNA, 9 bp, Unknown
  misc_feature (1)..( 9): Result.001 file - promoters60/1008319
ggacaacag

SEQ ID NO: 89390 - DNA, 9 bp, Unknown
  misc_feature (1)..( 9): Result.001 file - promoters60/1008319
agacaagta

SEQ ID NO: 89391 - DNA, 9 bp, Unknown
  misc_feature (1)..( 9): Result.001 file - promoters60/1008319
tgaaaacaa

SEQ ID NO: 89392 - DNA, 14 bp, Unknown
  misc_feature (1)..( 14): Result.001 file - promoters60/1008319
tttattttaacaga

SEQ ID NO: 89393 - DNA, 14 bp, Unknown
  misc_feature (1)..( 14): Result.001 file - promoters60/1008319
tttcttttccggtt

SEQ ID NO: 89394 - DNA, 14 bp, Unknown
  misc_feature (1)..( 14): Result.001 file - promoters60/1008319
tctattttaagcaa

SEQ ID NO: 89395 - DNA, 14 bp, Unknown
  misc_feature (1)..( 14): Result.001 file - promoters60/1008319
tttctttcttctcc

SEQ ID NO: 89396 - DNA, 15 bp, Unknown
  misc_feature (1)..( 15): Result.001 file - promoters60/1008319
gatcttctttctctc

SEQ ID NO: 89397 - DNA, 10 bp, Unknown
  misc_feature (1)..( 10): Result.001 file - promoters60/1008319
aaaaacatta

SEQ ID NO: 89398 - DNA, 10 bp, Unknown
  misc_feature (1)..( 10): Result.001 file - promoters60/1008319
aaagacaaag

SEQ ID NO: 89399 - DNA, 10 bp, Unknown
  misc_feature (1)..( 10): Result.001 file - promoters60/1008319
aaaaaccgtt

SEQ ID NO: 89400 - DNA, 10 bp, Unknown
  misc_feature (1)..( 10): Result.001 file - promoters60/1008319
aagaacaaat

SEQ ID NO: 89401 - DNA, 10 bp, Unknown
  misc_feature (1)..( 10): Result.001 file - promoters60/1008319
gaagacgaag

SEQ ID NO: 89402 - DNA, 8 bp, Unknown
  misc_feature (1)..( 8): Result.001 file - promoters60/1008319
tttttatt

SEQ ID NO: 89403 - DNA, 8 bp, Unknown
  misc_feature (1)..( 8): Result.001 file - promoters60/1008319
tttatatt

SEQ ID NO: 89404 - DNA, 8 bp, Unknown
  misc_feature (1)..( 8): Result.001 file - promoters60/1008319
attacttt

SEQ ID NO: 89405 - DNA, 8 bp, Unknown
  misc_feature (1)..( 8): Result.001 file - promoters60/1008324
cttaaatt

SEQ ID NO: 89406 - DNA, 11 bp, Unknown
  misc_feature (1)..( 11): Result.001 file - promoters60/1008324
gatatgttcgc

SEQ ID NO: 89407 - DNA, 11 bp, Unknown
  misc_feature (1)..( 11): Result.001 file - promoters60/1008324
gatatgttttg

SEQ ID NO: 89408 - DNA, 12 bp, Unknown
  misc_feature (1)..( 12): Result.001 file - promoters60/1008324
tctatgctttgg

SEQ ID NO: 89409 - DNA, 11 bp, Unknown
  misc_feature (1)..( 11): Result.001 file - promoters60/1008324
gagcattggtc

SEQ ID NO: 89410 - DNA, 11 bp, Unknown
  misc_feature (1)..( 11): Result.001 file - promoters60/1008324
gataatttgtc

SEQ ID NO: 89411 - DNA, 11 bp, Unknown
  misc_feature (1)..( 11): Result.001 file - promoters60/1008324
gatgatttgag

SEQ ID NO: 89412 - DNA, 9 bp, Unknown
  misc_feature (1)..( 9): Result.001 file - promoters60/1008324
tggctcaac

SEQ ID NO: 89413 - DNA, 9 bp, Unknown
  misc_feature (1)..( 9): Result.001 file - promoters60/1008324
aggcccaat

SEQ ID NO: 89414 - DNA, 9 bp, Unknown
  misc_feature (1)..( 9): Result.001 file - promoters60/1008324
aggcccaat

SEQ ID NO: 89415 - DNA, 10 bp, Unknown
  misc_feature (1)..( 10): Result.001 file - promoters60/1008324
acacgatatt

SEQ ID NO: 89416 - DNA, 10 bp, Unknown
  misc_feature (1)..( 10): Result.001 file - promoters60/1008324
acacggtatt

SEQ ID NO: 89417 - DNA, 10 bp, Unknown
  misc_feature (1)..( 10): Result.001 file - promoters60/1008400
agacggtagt

SEQ ID NO: 89418 - DNA, 8 bp, Unknown
  misc_feature (1)..( 8): Result.001 file - promoters60/1008400
gaaggtga

SEQ ID NO: 89419 - DNA, 8 bp, Unknown
  misc_feature (1)..( 8): Result.001 file - promoters60/1008400
gaacgtga

SEQ ID NO: 89420 - DNA, 7 bp, Unknown
  misc_feature (1)..( 7): Result.001 file - promoters60/1008400
gtaagaa

SEQ ID NO: 89421 - DNA, 7 bp, Unknown
  misc_feature (1)..( 7): Result.001 file - promoters60/1008400
gtacgaa

SEQ ID NO: 89422 - DNA, 8 bp, Unknown
  misc_feature (1)..( 8): Result.001 file - promoters60/1008400
aaaaaaat

SEQ ID NO: 89423 - DNA, 8 bp, Unknown
  misc_feature (1)..( 8): Result.001 file - promoters60/1008400
aaaaaaat

SEQ ID NO: 89424 - DNA, 6 bp, Unknown
  misc_feature (1)..( 6): Result.001 file - promoters60/1008400
ttgatt

SEQ ID NO: 89425 - DNA, 6 bp, Unknown
  misc_feature (1)..( 6): Result.001 file - promoters60/1008400
ttgatt

SEQ ID NO: 89426 - DNA, 6 bp, Unknown
  misc_feature (1)..( 6): Result.001 file - promoters60/1008400
aattgt

SEQ ID NO: 89427 - DNA, 6 bp, Unknown
  misc_feature (1)..( 6): Result.001 file - promoters60/1008400
aattgt

SEQ ID NO: 89428 - DNA, 7 bp, Unknown
  misc_feature (1)..( 7): Result.001 file - promoters60/1008400
ctttgag

SEQ ID NO: 89429 - DNA, 7 bp, Unknown
  misc_feature (1)..( 7): Result.001 file - promoters60/1008400
ctttgag

SEQ ID NO: 89430 - DNA, 7 bp, Unknown
  misc_feature (1)..( 7): Result.001 file - promoters60/1008400
tatcatt

SEQ ID NO: 89431 - DNA, 7 bp, Unknown
  misc_feature (1)..( 7): Result.001 file - promoters60/1008400
tatgatt

SEQ ID NO: 89432 - DNA, 7 bp, Unknown
  misc_feature (1)..( 7): Result.001 file - promoters60/1008400
gaatttg

SEQ ID NO: 89433 - DNA, 7 bp, Unknown
  misc_feature (1)..( 7): Result.001 file - promoters60/1008400
gaatttg

SEQ ID NO: 89434 - DNA, 7 bp, Unknown
  misc_feature (1)..( 7): Result.001 file - promoters60/1008400
tttgatt

SEQ ID NO: 89435 - DNA, 7 bp, Unknown
  misc_feature (1)..( 7): Result.001 file - promoters60/1008400
tttgatt

SEQ ID NO: 89436 - DNA, 7 bp, Unknown
  misc_feature (1)..( 7): Result.001 file - promoters60/1008400
ttagatc

SEQ ID NO: 89437 - DNA, 7 bp, Unknown
  misc_feature (1)..( 7): Result.001 file - promoters60/1008400
ttatatc

SEQ ID NO: 89438 - DNA, 6 bp, Unknown
  misc_feature (1)..( 6): Result.001 file - promoters60/1008400
catttg

SEQ ID NO: 89439 - DNA, 6 bp, Unknown
  misc_feature (1)..( 6): Result.001 file - promoters60/1008425
catttg

SEQ ID NO: 89440 - DNA, 7 bp, Unknown
  misc_feature (1)..( 7): Result.001 file - promoters60/1008425
tttggaa

SEQ ID NO: 89441 - DNA, 7 bp, Unknown
  misc_feature (1)..( 7): Result.001 file - promoters60/1008425
ttttgaa

SEQ ID NO: 89442 - DNA, 6 bp, Unknown
  misc_feature (1)..( 6): Result.001 file - promoters60/1008425
agaaaa

SEQ ID NO: 89443 - DNA, 6 bp, Unknown
  misc_feature (1)..( 6): Result.001 file - promoters60/1008425
agaaaa

SEQ ID NO: 89444 - DNA, 10 bp, Unknown
  misc_feature (1)..( 10): Result.001 file - promoters60/1008425
caaatacatt

SEQ ID NO: 89445 - DNA, 10 bp, Unknown
  misc_feature (1)..( 10): Result.001 file - promoters60/1008425
caaaaacaac

SEQ ID NO: 89446 - DNA, 10 bp, Unknown
  misc_feature (1)..( 10): Result.001 file - promoters60/1008425
taaatacatt

SEQ ID NO: 89447 - DNA, 8 bp, Unknown
  misc_feature (1)..( 8): Result.001 file - promoters60/1008425
tgtaaatt

SEQ ID NO: 89448 - DNA, 8 bp, Unknown
  misc_feature (1)..( 8): Result.001 file - promoters60/1008425
tgtatatt

SEQ ID NO: 89449 - DNA, 7 bp, Unknown
  misc_feature (1)..( 7): Result.001 file - promoters60/1008425
caaataa

SEQ ID NO: 89450 - DNA, 7 bp, Unknown
  misc_feature (1)..( 7): Result.001 file - promoters60/1008425
caaataa

SEQ ID NO: 89451 - DNA, 7 bp, Unknown
  misc_feature (1)..( 7): Result.001 file - promoters60/1008425
ttttttt

SEQ ID NO: 89452 - DNA, 7 bp, Unknown
  misc_feature (1)..( 7): Result.001 file - promoters60/1008425
ttttttt

SEQ ID NO: 89453 - DNA, 6 bp, Unknown
  misc_feature (1)..( 6): Result.001 file - promoters60/1008425
aatatt

SEQ ID NO: 89454 - DNA, 6 bp, Unknown
  misc_feature (1)..( 6): Result.001 file - promoters60/1008425
aatatt

SEQ ID NO: 89455 - DNA, 8 bp, Unknown
  misc_feature (1)..( 8): Result.001 file - promoters60/1008425
cttctgaa

SEQ ID NO: 89456 - DNA, 8 bp, Unknown
  misc_feature (1)..( 8): Result.001 file - promoters60/1008425
cttttgaa

SEQ ID NO: 89457 - DNA, 8 bp, Unknown
  misc_feature (1)..( 8): Result.001 file - promoters60/1008425
attttgag

SEQ ID NO: 89458 - DNA, 6 bp, Unknown
  misc_feature (1)..( 6): Result.001 file - promoters60/1008425
tttttt

SEQ ID NO: 89459 - DNA, 6 bp, Unknown
  misc_feature (1)..( 6): Result.001 file - promoters60/1008425
tttttt

SEQ ID NO: 89460 - DNA, 9 bp, Unknown
  misc_feature (1)..( 9): Result.001 file - promoters60/1008425
aatatatta

SEQ ID NO: 89461 - DNA, 9 bp, Unknown
  misc_feature (1)..( 9): Result.001 file - promoters60/1008425
aatttatta

SEQ ID NO: 89462 - DNA, 8 bp, Unknown
  misc_feature (1)..( 8): Result.001 file - promoters60/1008425
gaaaactt

SEQ ID NO: 89463 - DNA, 8 bp, Unknown
  misc_feature (1)..( 8): Result.001 file - promoters60/1008425
gaatactt

SEQ ID NO: 89464 - DNA, 8 bp, Unknown
  misc_feature (1)..( 8): Result.001 file - promoters60/1008425
acttttat

SEQ ID NO: 89465 - DNA, 8 bp, Unknown
  misc_feature (1)..( 8): Result.001 file - promoters60/1008425
acttttat

SEQ ID NO: 89466 - DNA, 7 bp, Unknown
  misc_feature (1)..( 7): Result.001 file - promoters60/1008425
tttatta

SEQ ID NO: 89467 - DNA, 7 bp, Unknown
  misc_feature (1)..( 7): Result.001 file - promoters60/1008425
tttgtta

SEQ ID NO: 89468 - DNA, 8 bp, Unknown
  misc_feature (1)..( 8): Result.001 file - promoters60/1008425
tttcaatt

SEQ ID NO: 89469 - DNA, 8 bp, Unknown
  misc_feature (1)..( 8): Result.001 file - promoters60/1008425
tttctatt

SEQ ID NO: 89470 - DNA, 7 bp, Unknown
  misc_feature (1)..( 7): Result.001 file - promoters60/1008425
cataaaa

SEQ ID NO: 89471 - DNA, 7 bp, Unknown
  misc_feature (1)..( 7): Result.001 file - promoters60/1008425
cataaaa

SEQ ID NO: 89472 - DNA, 7 bp, Unknown
  misc_feature (1)..( 7): Result.001 file - promoters60/1008425
aaattga

SEQ ID NO: 89473 - DNA, 7 bp, Unknown
  misc_feature (1)..( 7): Result.001 file - promoters60/1008425
aaaatga

SEQ ID NO: 89474 - DNA, 6 bp, Unknown
  misc_feature (1)..( 6): Result.001 file - promoters60/1008425
acttgt

SEQ ID NO: 89475 - DNA, 6 bp, Unknown
  misc_feature (1)..( 6): Result.001 file - promoters60/1008425
acttgt

SEQ ID NO: 89476 - DNA, 7 bp, Unknown
  misc_feature (1)..( 7): Result.001 file - promoters60/1008425
tcacgtt

SEQ ID NO: 89477 - DNA, 7 bp, Unknown
  misc_feature (1)..( 7): Result.001 file - promoters60/1008425
tcaagtt

SEQ ID NO: 89478 - DNA, 6 bp, Unknown
  misc_feature (1)..( 6): Result.001 file - promoters60/1008425
attaaa

SEQ ID NO: 89479 - DNA, 6 bp, Unknown
  misc_feature (1)..( 6): Result.001 file - promoters60/1008425
attaaa

SEQ ID NO: 89480 - DNA, 6 bp, Unknown
  misc_feature (1)..( 6): Result.001 file - promoters60/1008425
tcaaca

SEQ ID NO: 89481 - DNA, 6 bp, Unknown
  misc_feature (1)..( 6): Result.001 file - promoters60/1008425
tcaaca

SEQ ID NO: 89482 - DNA, 9 bp, Unknown
  misc_feature (1)..( 9): Result.001 file - promoters60/1008425
aactattta

SEQ ID NO: 89483 - DNA, 9 bp, Unknown
  misc_feature (1)..( 9): Result.001 file - promoters60/1008432
aaccattta

SEQ ID NO: 89484 - DNA, 6 bp, Unknown
  misc_feature (1)..( 6): Result.001 file - promoters60/1008432
tataat

SEQ ID NO: 89485 - DNA, 6 bp, Unknown
  misc_feature (1)..( 6): Result.001 file - promoters60/1008432
tataat

SEQ ID NO: 89486 - DNA, 6 bp, Unknown
  misc_feature (1)..( 6): Result.001 file - promoters60/1008432
ccacca

SEQ ID NO: 89487 - DNA, 6 bp, Unknown
  misc_feature (1)..( 6): Result.001 file - promoters60/1008432
ccacca

SEQ ID NO: 89488 - DNA, 9 bp, Unknown
  misc_feature (1)..( 9): Result.001 file - promoters60/1008432
gtatatatt

SEQ ID NO: 89489 - DNA, 9 bp, Unknown
  misc_feature (1)..( 9): Result.001 file - promoters60/1008432
gtagatatt

SEQ ID NO: 89490 - DNA, 6 bp, Unknown
  misc_feature (1)..( 6): Result.001 file - promoters60/1008432
aacatt

SEQ ID NO: 89491 - DNA, 6 bp, Unknown
  misc_feature (1)..( 6): Result.001 file - promoters60/1008432
aacatt

SEQ ID NO: 89492 - DNA, 7 bp, Unknown
  misc_feature (1)..( 7): Result.001 file - promoters60/1008432
ttgatga

SEQ ID NO: 89493 - DNA, 7 bp, Unknown
  misc_feature (1)..( 7): Result.001 file - promoters60/1008432
ttgatga

SEQ ID NO: 89494 - DNA, 8 bp, Unknown
  misc_feature (1)..( 8): Result.001 file - promoters60/1008432
ttagtcaa

SEQ ID NO: 89495 - DNA, 8 bp, Unknown
  misc_feature (1)..( 8): Result.001 file - promoters60/1008432
ttaatcaa

SEQ ID NO: 89496 - DNA, 8 bp, Unknown
  misc_feature (1)..( 8): Result.001 file - promoters60/1008432
aaaaggta

SEQ ID NO: 89497 - DNA, 8 bp, Unknown
  misc_feature (1)..( 8): Result.001 file - promoters60/1008432
aaatggtt

SEQ ID NO: 89498 - DNA, 8 bp, Unknown
  misc_feature (1)..( 8): Result.001 file - promoters60/1008432
taattgtt

SEQ ID NO: 89499 - DNA, 7 bp, Unknown
  misc_feature (1)..( 7): Result.001 file - promoters60/1008432
aatctct

SEQ ID NO: 89500 - DNA, 7 bp, Unknown
  misc_feature (1)..( 7): Result.001 file - promoters60/1008432
aatctct

SEQ ID NO: 89501 - DNA, 6 bp, Unknown
  misc_feature (1)..( 6): Result.001 file - promoters60/1008432
caaatt

SEQ ID NO: 89502 - DNA, 6 bp, Unknown
  misc_feature (1)..( 6): Result.001 file - promoters60/1008432
caaatt

SEQ ID NO: 89503 - DNA, 9 bp, Unknown
  misc_feature (1)..( 9): Result.001 file - promoters60/1008432
aatcataaa

SEQ ID NO: 89504 - DNA, 9 bp, Unknown
  misc_feature (1)..( 9): Result.001 file - promoters60/1008432
aatcaaaaa

SEQ ID NO: 89505 - DNA, 8 bp, Unknown
  misc_feature (1)..( 8): Result.001 file - promoters60/1008432
tatagtaa

SEQ ID NO: 89506 - DNA, 8 bp, Unknown
  misc_feature (1)..( 8): Result.001 file - promoters60/1008432
tattgtaa

SEQ ID NO: 89507 - DNA, 8 bp, Unknown
  misc_feature (1)..( 8): Result.001 file - promoters60/1008432
attgtttt

SEQ ID NO: 89508 - DNA, 8 bp, Unknown
  misc_feature (1)..( 8): Result.001 file - promoters60/1008432
attttttt

SEQ ID NO: 89509 - DNA, 8 bp, Unknown
  misc_feature (1)..( 8): Result.001 file - promoters60/1008432
atttttat

SEQ ID NO: 89510 - DNA, 6 bp, Unknown
  misc_feature (1)..( 6): Result.001 file - promoters60/1008432
tttgtt

SEQ ID NO: 89511 - DNA, 6 bp, Unknown
  misc_feature (1)..( 6): Result.001 file - promoters60/1008432
tttgtt

SEQ ID NO: 89512 - DNA, 6 bp, Unknown
  misc_feature (1)..( 6): Result.001 file - promoters60/1008432
tataac

SEQ ID NO: 89513 - DNA, 6 bp, Unknown
  misc_feature (1)..( 6): Result.001 file - promoters60/1008432
tataac

SEQ ID NO: 89514 - DNA, 8 bp, Unknown
  misc_feature (1)..( 8): Result.001 file - promoters60/1008432
gaagaaag

SEQ ID NO: 89515 - DNA, 8 bp, Unknown
  misc_feature (1)..( 8): Result.001 file - promoters60/1008432
gaacaaag

SEQ ID NO: 89516 - DNA, 8 bp, Unknown
  misc_feature (1)..( 8): Result.001 file - promoters60/1008432
tttaaatg

SEQ ID NO: 89517 - DNA, 8 bp, Unknown
  misc_feature (1)..( 8): Result.001 file - promoters60/1008432
tttatatg

SEQ ID NO: 89518 - DNA, 7 bp, Unknown
  misc_feature (1)..( 7): Result.001 file - promoters60/1008432
ccaaaca

SEQ ID NO: 89519 - DNA, 7 bp, Unknown
  misc_feature (1)..( 7): Result.001 file - promoters60/1008432
ccataca

SEQ ID NO: 89520 - DNA, 8 bp, Unknown
  misc_feature (1)..( 8): Result.001 file - promoters60/1008432
tacaaaaa

SEQ ID NO: 89521 - DNA, 8 bp, Unknown
  misc_feature (1)..( 8): Result.001 file - promoters60/1008432
tacaaaaa

SEQ ID NO: 89522 - DNA, 8 bp, Unknown
  misc_feature (1)..( 8): Result.001 file - promoters60/1008432
aaaaaaag

SEQ ID NO: 89523 - DNA, 8 bp, Unknown
  misc_feature (1)..( 8): Result.001 file - promoters60/1008432
aaacaaag

SEQ ID NO: 89524 - DNA, 8 bp, Unknown
  misc_feature (1)..( 8): Result.001 file - promoters60/1008432
aaccacct

SEQ ID NO: 89525 - DNA, 8 bp, Unknown
  misc_feature (1)..( 8): Result.001 file - promoters60/1008443
aacaacct

SEQ ID NO: 89526 - DNA, 17 bp, Unknown
  misc_feature (1)..( 17): Result.001 file - promoters60/1008443
acaatgggctgggccta

SEQ ID NO: 89527 - DNA, 17 bp, Unknown
  misc_feature (1)..( 17): Result.001 file - promoters60/1008443
gaaataggcccaacaaa

SEQ ID NO: 89528 - DNA, 17 bp, Unknown
  misc_feature (1)..( 17): Result.001 file - promoters60/1008443
ctgttgggcttttaatg

SEQ ID NO: 89529 - DNA, 17 bp, Unknown
  misc_feature (1)..( 17): Result.001 file - promoters60/1008443
taattgggctttttaag

SEQ ID NO: 89530 - DNA, 17 bp, Unknown
  misc_feature (1)..( 17): Result.001 file - promoters60/1008443
taaaaaggcccattata

SEQ ID NO: 89531 - DNA, 17 bp, Unknown
  misc_feature (1)..( 17): Result.001 file - promoters60/1008443
aaataaagcccattata

SEQ ID NO: 89532 - DNA, 17 bp, Unknown
  misc_feature (1)..( 17): Result.001 file - promoters60/1008534
taaaaaatatctgaaac

SEQ ID NO: 89533 - DNA, 12 bp, Unknown
  misc_feature (1)..( 12): Result.001 file - promoters60/1008534
attaacataaat

SEQ ID NO: 89534 - DNA, 12 bp, Unknown
  misc_feature (1)..( 12): Result.001 file - promoters60/1008534
tataatataaag

SEQ ID NO: 89535 - DNA, 12 bp, Unknown
  misc_feature (1)..( 12): Result.001 file - promoters60/1008534
cagtatataaat

SEQ ID NO: 89536 - DNA, 12 bp, Unknown
  misc_feature (1)..( 12): Result.001 file - promoters60/1008534
ccctttataaaa

SEQ ID NO: 89537 - DNA, 12 bp, Unknown
  misc_feature (1)..( 12): Result.001 file - promoters60/1008534
ccctatataaag

SEQ ID NO: 89538 - DNA, 12 bp, Unknown
  misc_feature (1)..( 12): Result.001 file - promoters60/1008534
ttatatattatt

SEQ ID NO: 89539 - DNA, 11 bp, Unknown
  misc_feature (1)..( 11): Result.001 file - promoters60/1008534
ctttctgtctc

SEQ ID NO: 89540 - DNA, 11 bp, Unknown
  misc_feature (1)..( 11): Result.001 file - promoters60/1008534
atttttgttaa

SEQ ID NO: 89541 - DNA, 11 bp, Unknown
  misc_feature (1)..( 11): Result.001 file - promoters60/1008534
cttcctgagaa

SEQ ID NO: 89542 - DNA, 11 bp, Unknown
  misc_feature (1)..( 11): Result.001 file - promoters60/1008534
aatccagagaa

SEQ ID NO: 89543 - DNA, 11 bp, Unknown
  misc_feature (1)..( 11): Result.001 file - promoters60/1008534
tttttttttac

SEQ ID NO: 89544 - DNA, 11 bp, Unknown
  misc_feature (1)..( 11): Result.001 file - promoters60/1008534
gtttttgtcta

SEQ ID NO: 89545 - DNA, 13 bp, Unknown
  misc_feature (1)..( 13): Result.001 file - promoters60/1008534
ccctttataaaac

SEQ ID NO: 89546 - DNA, 13 bp, Unknown
  misc_feature (1)..( 13): Result.001 file - promoters60/1008534
attactattaaag

SEQ ID NO: 89547 - DNA, 13 bp, Unknown
  misc_feature (1)..( 13): Result.001 file - promoters60/1008534
tataatataaagg

SEQ ID NO: 89548 - DNA, 13 bp, Unknown
  misc_feature (1)..( 13): Result.001 file - promoters60/1008534
ccctatataaaga

SEQ ID NO: 89549 - DNA, 13 bp, Unknown
  misc_feature (1)..( 13): Result.001 file - promoters60/1008534
tatattatttaag

SEQ ID NO: 89550 - DNA, 13 bp, Unknown
  misc_feature (1)..( 13): Result.001 file - promoters60/1008573
ctcagtatataaa

SEQ ID NO: 89551 - DNA, 15 bp, Unknown
  misc_feature (1)..( 15): Result.001 file - promoters60/1008573
ttagcatatcctttc

SEQ ID NO: 89552 - DNA, 15 bp, Unknown
  misc_feature (1)..( 15): Result.001 file - promoters60/1008573
agaatgtattcttca

SEQ ID NO: 89553 - DNA, 15 bp, Unknown
  misc_feature (1)..( 15): Result.001 file - promoters60/1008573
atgaaatatccggta

SEQ ID NO: 89554 - DNA, 15 bp, Unknown
  misc_feature (1)..( 15): Result.001 file - promoters60/1008573
aaaaattattctgat

SEQ ID NO: 89555 - DNA, 15 bp, Unknown
  misc_feature (1)..( 15): Result.001 file - promoters60/1008573
gtatatcattctttt

SEQ ID NO: 89556 - DNA, 15 bp, Unknown
  misc_feature (1)..( 15): Result.001 file - promoters60/1008573
aaggtttactctata

SEQ ID NO: 89557 - DNA, 15 bp, Unknown
  misc_feature (1)..( 15): Result.001 file - promoters60/1008573
gtatttcactctttt

SEQ ID NO: 89558 - DNA, 13 bp, Unknown
  misc_feature (1)..( 13): Result.001 file - promoters60/1008573
ttacaatttcact

SEQ ID NO: 89559 - DNA, 13 bp, Unknown
  misc_feature (1)..( 13): Result.001 file - promoters60/1008573
tttttttttcact

SEQ ID NO: 89560 - DNA, 13 bp, Unknown
  misc_feature (1)..( 13): Result.001 file - promoters60/1008573
ttttcttttcata

SEQ ID NO: 89561 - DNA, 13 bp, Unknown
  misc_feature (1)..( 13): Result.001 file - promoters60/1008573
ctgatttttaata

SEQ ID NO: 89562 - DNA, 13 bp, Unknown
  misc_feature (1)..( 13): Result.001 file - promoters60/1008573
ttcatgtttaatc

SEQ ID NO: 89563 - DNA, 13 bp, Unknown
  misc_feature (1)..( 13): Result.001 file - promoters60/1008573
taaaaagttaaat

SEQ ID NO: 89564 - DNA, 13 bp, Unknown
  misc_feature (1)..( 13): Result.001 file - promoters60/1008573
tatactttttagt

SEQ ID NO: 89565 - DNA, 14 bp, Unknown
  misc_feature (1)..( 14): Result.001 file - promoters60/1008573
gattaaaaatccaa

SEQ ID NO: 89566 - DNA, 14 bp, Unknown
  misc_feature (1)..( 14): Result.001 file - promoters60/1008573
gaataaatatcctc

SEQ ID NO: 89567 - DNA, 14 bp, Unknown
  misc_feature (1)..( 14): Result.001 file - promoters60/1008573
gaaacaaaatccaa

SEQ ID NO: 89568 - DNA, 14 bp, Unknown
  misc_feature (1)..( 14): Result.001 file - promoters60/1008573
atttaaagcccaat

SEQ ID NO: 89569 - DNA, 14 bp, Unknown
  misc_feature (1)..( 14): Result.001 file - promoters60/1008573
acttaaaaacattt

SEQ ID NO: 89570 - DNA, 14 bp, Unknown
  misc_feature (1)..( 14): Result.001 file - promoters60/1008573
tcatgaatatataa

SEQ ID NO: 89571 - DNA, 12 bp, Unknown
  misc_feature (1)..( 12): Result.001 file - promoters60/1008573
caacaatgtaca

SEQ ID NO: 89572 - DNA, 12 bp, Unknown
  misc_feature (1)..( 12): Result.001 file - promoters60/1008573
caataatttaca

SEQ ID NO: 89573 - DNA, 12 bp, Unknown
  misc_feature (1)..( 12): Result.001 file - promoters60/1008573
gaataataaaat

SEQ ID NO: 89574 - DNA, 12 bp, Unknown
  misc_feature (1)..( 12): Result.001 file - promoters60/1008573
atttaatttaat

SEQ ID NO: 89575 - DNA, 12 bp, Unknown
  misc_feature (1)..( 12): Result.001 file - promoters60/1008573
gattaaatataa

SEQ ID NO: 89576 - DNA, 12 bp, Unknown
  misc_feature (1)..( 12): Result.001 file - promoters60/1008573
tgaaaatttata

SEQ ID NO: 89577 - DNA, 10 bp, Unknown
  misc_feature (1)..( 10): Result.001 file - promoters60/1008573
agaatgtatt

SEQ ID NO: 89578 - DNA, 10 bp, Unknown
  misc_feature (1)..( 10): Result.001 file - promoters60/1008573
aaaatatatt

SEQ ID NO: 89579 - DNA, 10 bp, Unknown
  misc_feature (1)..( 10): Result.001 file - promoters60/1008573
agagtgtaca

SEQ ID NO: 89580 - DNA, 10 bp, Unknown
  misc_feature (1)..( 10): Result.001 file - promoters60/1008573
aaaatttata

SEQ ID NO: 89581 - DNA, 10 bp, Unknown
  misc_feature (1)..( 10): Result.001 file - promoters60/1008573
attatgtata

SEQ ID NO: 89582 - DNA, 10 bp, Unknown
  misc_feature (1)..( 10): Result.001 file - promoters60/1008573
aaaacataac

SEQ ID NO: 89583 - DNA, 10 bp, Unknown
  misc_feature (1)..( 10): Result.001 file - promoters60/1008573
caaatttttg

SEQ ID NO: 89584 - DNA, 7 bp, Unknown
  misc_feature (1)..( 7): Result.001 file - promoters60/1008573
gataaaa

SEQ ID NO: 89585 - DNA, 7 bp, Unknown
  misc_feature (1)..( 7): Result.001 file - promoters60/1008573
tataaaa

SEQ ID NO: 89586 - DNA, 7 bp, Unknown
  misc_feature (1)..( 7): Result.001 file - promoters60/1008573
gattaaa

SEQ ID NO: 89587 - DNA, 7 bp, Unknown
  misc_feature (1)..( 7): Result.001 file - promoters60/1008573
gatgaaa

SEQ ID NO: 89588 - DNA, 7 bp, Unknown
  misc_feature (1)..( 7): Result.001 file - promoters60/1008573
aataaaa

SEQ ID NO: 89589 - DNA, 7 bp, Unknown
  misc_feature (1)..( 7): Result.001 file - promoters60/1008573
gattaat

SEQ ID NO: 89590 - DNA, 12 bp, Unknown
  misc_feature (1)..( 12): Result.001 file - promoters60/1008573
agattttttatt

SEQ ID NO: 89591 - DNA, 12 bp, Unknown
  misc_feature (1)..( 12): Result.001 file - promoters60/1008573
agaatttttgta

SEQ ID NO: 89592 - DNA, 12 bp, Unknown
  misc_feature (1)..( 12): Result.001 file - promoters60/1008573
atattttatatt

SEQ ID NO: 89593 - DNA, 12 bp, Unknown
  misc_feature (1)..( 12): Result.001 file - promoters60/1008573
ctgtttcttagg

SEQ ID NO: 89594 - DNA, 12 bp, Unknown
  misc_feature (1)..( 12): Result.001 file - promoters60/1008573
ataattttaaac

SEQ ID NO: 89595 - DNA, 12 bp, Unknown
  misc_feature (1)..( 12): Result.001 file - promoters60/1008573
tcatatgagtga

SEQ ID NO: 89596 - DNA, 9 bp, Unknown
  misc_feature (1)..( 9): Result.001 file - promoters60/1008573
tatttataa

SEQ ID NO: 89597 - DNA, 9 bp, Unknown
  misc_feature (1)..( 9): Result.001 file - promoters60/1008573
tttttttaa

SEQ ID NO: 89598 - DNA, 9 bp, Unknown
  misc_feature (1)..( 9): Result.001 file - promoters60/1008573
gattaatac

SEQ ID NO: 89599 - DNA, 9 bp, Unknown
  misc_feature (1)..( 9): Result.001 file - promoters60/1008573
gattaaatt

SEQ ID NO: 89600 - DNA, 9 bp, Unknown
  misc_feature (1)..( 9): Result.001 file - promoters60/1008573
atttaataa

SEQ ID NO: 89601 - DNA, 9 bp, Unknown
  misc_feature (1)..( 9): Result.001 file - promoters60/1008673
catttttat

SEQ ID NO: 89602 - DNA, 6 bp, Unknown
  misc_feature (1)..( 6): Result.001 file - promoters60/1008673
atagat

SEQ ID NO: 89603 - DNA, 6 bp, Unknown
  misc_feature (1)..( 6): Result.001 file - promoters60/1008673
atagat

SEQ ID NO: 89604 - DNA, 9 bp, Unknown
  misc_feature (1)..( 9): Result.001 file - promoters60/1008673
tatgtaatt

SEQ ID NO: 89605 - DNA, 9 bp, Unknown
  misc_feature (1)..( 9): Result.001 file - promoters60/1008673
tatgtaatt

SEQ ID NO: 89606 - DNA, 7 bp, Unknown
  misc_feature (1)..( 7): Result.001 file - promoters60/1008673
attgaaa

SEQ ID NO: 89607 - DNA, 7 bp, Unknown
  misc_feature (1)..( 7): Result.001 file - promoters60/1008673
atttaaa

SEQ ID NO: 89608 - DNA, 12 bp, Unknown
  misc_feature (1)..( 12): Result.001 file - promoters60/1008673
aactcaattgtt

SEQ ID NO: 89609 - DNA, 12 bp, Unknown
  misc_feature (1)..( 12): Result.001 file - promoters60/1008673
aacttaatagtt

SEQ ID NO: 89610 - DNA, 6 bp, Unknown
  misc_feature (1)..( 6): Result.001 file - promoters60/1008673
gtttgt

SEQ ID NO: 89611 - DNA, 6 bp, Unknown
  misc_feature (1)..( 6): Result.001 file - promoters60/1008673
gtttgt

SEQ ID NO: 89612 - DNA, 7 bp, Unknown
  misc_feature (1)..( 7): Result.001 file - promoters60/1008673
attcatt

SEQ ID NO: 89613 - DNA, 7 bp, Unknown
  misc_feature (1)..( 7): Result.001 file - promoters60/1008673
attgatt

SEQ ID NO: 89614 - DNA, 6 bp, Unknown
  misc_feature (1)..( 6): Result.001 file - promoters60/1008673
tgtttg

SEQ ID NO: 89615 - DNA, 6 bp, Unknown
  misc_feature (1)..( 6): Result.001 file - promoters60/1008673
tgtttg

SEQ ID NO: 89616 - DNA, 8 bp, Unknown
  misc_feature (1)..( 8): Result.001 file - promoters60/1008673
cgttacca

SEQ ID NO: 89617 - DNA, 8 bp, Unknown
  misc_feature (1)..( 8): Result.001 file - promoters60/1008673
cgttacca

SEQ ID NO: 89618 - DNA, 7 bp, Unknown
  misc_feature (1)..( 7): Result.001 file - promoters60/1008673
aaacgaa

SEQ ID NO: 89619 - DNA, 7 bp, Unknown
  misc_feature (1)..( 7): Result.001 file - promoters60/1008673
aaaagaa

SEQ ID NO: 89620 - DNA, 6 bp, Unknown
  misc_feature (1)..( 6): Result.001 file - promoters60/1008673
actgaa

SEQ ID NO: 89621 - DNA, 6 bp, Unknown
  misc_feature (1)..( 6): Result.001 file - promoters60/1008673
actgaa

SEQ ID NO: 89622 - DNA, 6 bp, Unknown
  misc_feature (1)..( 6): Result.001 file - promoters60/1008673
tagata

SEQ ID NO: 89623 - DNA, 6 bp, Unknown
  misc_feature (1)..( 6): Result.001 file - promoters60/1008673
tagata

SEQ ID NO: 89624 - DNA, 8 bp, Unknown
  misc_feature (1)..( 8): Result.001 file - promoters60/1008673
atgaaatg

SEQ ID NO: 89625 - DNA, 8 bp, Unknown
  misc_feature (1)..( 8): Result.001 file - promoters60/1008673
atgaaatg

SEQ ID NO: 89626 - DNA, 8 bp, Unknown
  misc_feature (1)..( 8): Result.001 file - promoters60/1008673
tttttaat

SEQ ID NO: 89627 - DNA, 8 bp, Unknown
  misc_feature (1)..( 8): Result.001 file - promoters60/1008673
tttttaat

SEQ ID NO: 89628 - DNA, 7 bp, Unknown
  misc_feature (1)..( 7): Result.001 file - promoters60/1008673
aaatctt

SEQ ID NO: 89629 - DNA, 7 bp, Unknown
  misc_feature (1)..( 7): Result.001 file - promoters60/1008732
aaatctt

SEQ ID NO: 89630 - DNA, 10 bp, Unknown
  misc_feature (1)..( 10): Result.001 file - promoters60/1008732
taaattttaa

SEQ ID NO: 89631 - DNA, 10 bp, Unknown
  misc_feature (1)..( 10): Result.001 file - promoters60/1008732
caaatttgtt

SEQ ID NO: 89632 - DNA, 10 bp, Unknown
  misc_feature (1)..( 10): Result.001 file - promoters60/1008732
ataattttgt

SEQ ID NO: 89633 - DNA, 10 bp, Unknown
  misc_feature (1)..( 10): Result.001 file - promoters60/1008732
tgaattctaa

SEQ ID NO: 89634 - DNA, 10 bp, Unknown
  misc_feature (1)..( 10): Result.001 file - promoters60/1008732
taaatatgtt

SEQ ID NO: 89635 - DNA, 10 bp, Unknown
  misc_feature (1)..( 10): Result.001 file - promoters60/1008732
taaataacat

SEQ ID NO: 89636 - DNA, 14 bp, Unknown
  misc_feature (1)..( 14): Result.001 file - promoters60/1008732
tcaattgtacttat

SEQ ID NO: 89637 - DNA, 14 bp, Unknown
  misc_feature (1)..( 14): Result.001 file - promoters60/1008732
caacttgtacacgc

SEQ ID NO: 89638 - DNA, 14 bp, Unknown
  misc_feature (1)..( 14): Result.001 file - promoters60/1008732
ttaattgtataatt

SEQ ID NO: 89639 - DNA, 14 bp, Unknown
  misc_feature (1)..( 14): Result.001 file - promoters60/1008732
ttctttgaacttat

SEQ ID NO: 89640 - DNA, 14 bp, Unknown
  misc_feature (1)..( 14): Result.001 file - promoters60/1008732
ttatttgagttatg

SEQ ID NO: 89641 - DNA, 14 bp, Unknown
  misc_feature (1)..( 14): Result.001 file - promoters60/1008732
ttaattgtctccgg

SEQ ID NO: 89642 - DNA, 12 bp, Unknown
  misc_feature (1)..( 12): Result.001 file - promoters60/1008732
aattttaatctc

SEQ ID NO: 89643 - DNA, 12 bp, Unknown
  misc_feature (1)..( 12): Result.001 file - promoters60/1008732
atttttattcta

SEQ ID NO: 89644 - DNA, 12 bp, Unknown
  misc_feature (1)..( 12): Result.001 file - promoters60/1008732
aattctaaaatc

SEQ ID NO: 89645 - DNA, 12 bp, Unknown
  misc_feature (1)..( 12): Result.001 file - promoters60/1008732
tgttgtattcta

SEQ ID NO: 89646 - DNA, 12 bp, Unknown
  misc_feature (1)..( 12): Result.001 file - promoters60/1008732
ctttttacggcg

SEQ ID NO: 89647 - DNA, 12 bp, Unknown
  misc_feature (1)..( 12): Result.001 file - promoters60/1008732
ggttttatttat

SEQ ID NO: 89648 - DNA, 10 bp, Unknown
  misc_feature (1)..( 10): Result.001 file - promoters60/1008732
atatatctta

SEQ ID NO: 89649 - DNA, 10 bp, Unknown
  misc_feature (1)..( 10): Result.001 file - promoters60/1008732
ataaatcttt

SEQ ID NO: 89650 - DNA, 11 bp, Unknown
  misc_feature (1)..( 11): Result.001 file - promoters60/1008732
ttatcatatta

SEQ ID NO: 89651 - DNA, 11 bp, Unknown
  misc_feature (1)..( 11): Result.001 file - promoters60/1008732
ataaaacttga

SEQ ID NO: 89652 - DNA, 11 bp, Unknown
  misc_feature (1)..( 11): Result.001 file - promoters60/1008732
ttgaaatttga

SEQ ID NO: 89653 - DNA, 11 bp, Unknown
  misc_feature (1)..( 11): Result.001 file - promoters60/1008787
aacaaagttgt

SEQ ID NO: 89654 - DNA, 7 bp, Unknown
  misc_feature (1)..( 7): Result.001 file - promoters60/1008787
taacgtt

SEQ ID NO: 89655 - DNA, 7 bp, Unknown
  misc_feature (1)..( 7): Result.001 file - promoters60/1008787
taaggtt

SEQ ID NO: 89656 - DNA, 15 bp, Unknown
  misc_feature (1)..( 15): Result.001 file - promoters60/1008787
aaaagcatacaaata

SEQ ID NO: 89657 - DNA, 15 bp, Unknown
  misc_feature (1)..( 15): Result.001 file - promoters60/1008787
aaaagaatagcttct

SEQ ID NO: 89658 - DNA, 15 bp, Unknown
  misc_feature (1)..( 15): Result.001 file - promoters60/1008787
gaaggcatacagata

SEQ ID NO: 89659 - DNA, 6 bp, Unknown
  misc_feature (1)..( 6): Result.001 file - promoters60/1008787
tcaact

SEQ ID NO: 89660 - DNA, 6 bp, Unknown
  misc_feature (1)..( 6): Result.001 file - promoters60/1008787
tcaact

SEQ ID NO: 89661 - DNA, 7 bp, Unknown
  misc_feature (1)..( 7): Result.001 file - promoters60/1008787
aacttcg

SEQ ID NO: 89662 - DNA, 7 bp, Unknown
  misc_feature (1)..( 7): Result.001 file - promoters60/1008787
aacgtcg

SEQ ID NO: 89663 - DNA, 7 bp, Unknown
  misc_feature (1)..( 7): Result.001 file - promoters60/1008787
ctattat

SEQ ID NO: 89664 - DNA, 7 bp, Unknown
  misc_feature (1)..( 7): Result.001 file - promoters60/1008787
ctagtat

SEQ ID NO: 89665 - DNA, 7 bp, Unknown
  misc_feature (1)..( 7): Result.001 file - promoters60/1008787
ctattac

SEQ ID NO: 89666 - DNA, 8 bp, Unknown
  misc_feature (1)..( 8): Result.001 file - promoters60/1008787
attgtatt

SEQ ID NO: 89667 - DNA, 8 bp, Unknown
  misc_feature (1)..( 8): Result.001 file - promoters60/1008787
attatatt

SEQ ID NO: 89668 - DNA, 9 bp, Unknown
  misc_feature (1)..( 9): Result.001 file - promoters60/1008787
aaatatcaa

SEQ ID NO: 89669 - DNA, 9 bp, Unknown
  misc_feature (1)..( 9): Result.001 file - promoters60/1008787
aaataacaa

SEQ ID NO: 89670 - DNA, 7 bp, Unknown
  misc_feature (1)..( 7): Result.001 file - promoters60/1008787
ttaatca

SEQ ID NO: 89671 - DNA, 7 bp, Unknown
  misc_feature (1)..( 7): Result.001 file - promoters60/1008787
ttattca

SEQ ID NO: 89672 - DNA, 6 bp, Unknown
  misc_feature (1)..( 6): Result.001 file - promoters60/1008787
tttctt

SEQ ID NO: 89673 - DNA, 6 bp, Unknown
  misc_feature (1)..( 6): Result.001 file - promoters60/1008787
tttctt

SEQ ID NO: 89674 - DNA, 6 bp, Unknown
  misc_feature (1)..( 6): Result.001 file - promoters60/1008787
caagaa

SEQ ID NO: 89675 - DNA, 6 bp, Unknown
  misc_feature (1)..( 6): Result.001 file - promoters60/1008787
caagaa

SEQ ID NO: 89676 - DNA, 8 bp, Unknown
  misc_feature (1)..( 8): Result.001 file - promoters60/1008787
acgttatt

SEQ ID NO: 89677 - DNA, 8 bp, Unknown
  misc_feature (1)..( 8): Result.001 file - promoters60/1008787
tggttatt

SEQ ID NO: 89678 - DNA, 8 bp, Unknown
  misc_feature (1)..( 8): Result.001 file - promoters60/1008787
tgggtata

SEQ ID NO: 89679 - DNA, 6 bp, Unknown
  misc_feature (1)..( 6): Result.001 file - promoters60/1008787
ctttgt

SEQ ID NO: 89680 - DNA, 6 bp, Unknown
  misc_feature (1)..( 6): Result.001 file - promoters60/1008787
ctttgt

SEQ ID NO: 89681 - DNA, 7 bp, Unknown
  misc_feature (1)..( 7): Result.001 file - promoters60/1008787
tttcaac

SEQ ID NO: 89682 - DNA, 7 bp, Unknown
  misc_feature (1)..( 7): Result.001 file - promoters60/1008787
ttttaac

SEQ ID NO: 89683 - DNA, 6 bp, Unknown
  misc_feature (1)..( 6): Result.001 file - promoters60/1008787
attaaa

SEQ ID NO: 89684 - DNA, 6 bp, Unknown
  misc_feature (1)..( 6): Result.001 file - promoters60/1008787
attaaa

SEQ ID NO: 89685 - DNA, 7 bp, Unknown
  misc_feature (1)..( 7): Result.001 file - promoters60/1008787
tacgtaa

SEQ ID NO: 89686 - DNA, 7 bp, Unknown
  misc_feature (1)..( 7): Result.001 file - promoters60/1008787
tacataa

SEQ ID NO: 89687 - DNA, 6 bp, Unknown
  misc_feature (1)..( 6): Result.001 file - promoters60/1008787
gtaaaa

SEQ ID NO: 89688 - DNA, 6 bp, Unknown
  misc_feature (1)..( 6): Result.001 file - promoters60/1008787
gtaaaa

SEQ ID NO: 89689 - DNA, 9 bp, Unknown
  misc_feature (1)..( 9): Result.001 file - promoters60/1008787
aaatagtta

SEQ ID NO: 89690 - DNA, 9 bp, Unknown
  misc_feature (1)..( 9): Result.001 file - promoters60/1008787
aaatattta

SEQ ID NO: 89691 - DNA, 8 bp, Unknown
  misc_feature (1)..( 8): Result.001 file - promoters60/1008787
caatactt

SEQ ID NO: 89692 - DNA, 8 bp, Unknown
  misc_feature (1)..( 8): Result.001 file - promoters60/1008787
caaaactt

SEQ ID NO: 89693 - DNA, 6 bp, Unknown
  misc_feature (1)..( 6): Result.001 file - promoters60/1008787
gttcta

SEQ ID NO: 89694 - DNA, 6 bp, Unknown
  misc_feature (1)..( 6): Result.001 file - promoters60/1008787
gttcta

SEQ ID NO: 89695 - DNA, 7 bp, Unknown
  misc_feature (1)..( 7): Result.001 file - promoters60/1008787
atatttt

SEQ ID NO: 89696 - DNA, 7 bp, Unknown
  misc_feature (1)..( 7): Result.001 file - promoters60/1008808
atacttt

SEQ ID NO: 89697 - DNA, 9 bp, Unknown
  misc_feature (1)..( 9): Result.001 file - promoters60/1008808
tacttcctt

SEQ ID NO: 89698 - DNA, 9 bp, Unknown
  misc_feature (1)..( 9): Result.001 file - promoters60/1008808
agcttactt

SEQ ID NO: 89699 - DNA, 9 bp, Unknown
  misc_feature (1)..( 9): Result.001 file - promoters60/1008808
gacttccgc

SEQ ID NO: 89700 - DNA, 9 bp, Unknown
  misc_feature (1)..( 9): Result.001 file - promoters60/1008808
tctttactt

SEQ ID NO: 89701 - DNA, 9 bp, Unknown
  misc_feature (1)..( 9): Result.001 file - promoters60/1008808
tcttttctt

SEQ ID NO: 89702 - DNA, 11 bp, Unknown
  misc_feature (1)..( 11): Result.001 file - promoters60/1008808
gcctatggtta

SEQ ID NO: 89703 - DNA, 11 bp, Unknown
  misc_feature (1)..( 11): Result.001 file - promoters60/1008808
agaaatgatta

SEQ ID NO: 89704 - DNA, 11 bp, Unknown
  misc_feature (1)..( 11): Result.001 file - promoters60/1008808
ttaaaggatta

SEQ ID NO: 89705 - DNA, 11 bp, Unknown
  misc_feature (1)..( 11): Result.001 file - promoters60/1008808
gaaaaagatgg

SEQ ID NO: 89706 - DNA, 11 bp, Unknown
  misc_feature (1)..( 11): Result.001 file - promoters60/1008808
aaaaatgtgaa

SEQ ID NO: 89707 - DNA, 11 bp, Unknown
  misc_feature (1)..( 11): Result.001 file - promoters60/1008808
caaaatgttat

SEQ ID NO: 89708 - DNA, 9 bp, Unknown
  misc_feature (1)..( 9): Result.001 file - promoters60/1008808
ataagtttg

SEQ ID NO: 89709 - DNA, 9 bp, Unknown
  misc_feature (1)..( 9): Result.001 file - promoters60/1008808
ataagtctg

SEQ ID NO: 89710 - DNA, 9 bp, Unknown
  misc_feature (1)..( 9): Result.001 file - promoters60/1008808
ttaagttct

SEQ ID NO: 89711 - DNA, 9 bp, Unknown
  misc_feature (1)..( 9): Result.001 file - promoters60/1008808
ttatgtttc

SEQ ID NO: 89712 - DNA, 9 bp, Unknown
  misc_feature (1)..( 9): Result.001 file - promoters60/1008816
aaaagttct

SEQ ID NO: 89713 - DNA, 9 bp, Unknown
  misc_feature (1)..( 9): Result.001 file - promoters60/1008816
tcataacac

SEQ ID NO: 89714 - DNA, 9 bp, Unknown
  misc_feature (1)..( 9): Result.001 file - promoters60/1008816
tcatatcac

SEQ ID NO: 89715 - DNA, 7 bp, Unknown
  misc_feature (1)..( 7): Result.001 file - promoters60/1008816
gataaaa

SEQ ID NO: 89716 - DNA, 7 bp, Unknown
  misc_feature (1)..( 7): Result.001 file - promoters60/1008816
gattaaa

SEQ ID NO: 89717 - DNA, 6 bp, Unknown
  misc_feature (1)..( 6): Result.001 file - promoters60/1008816
ttcaac

SEQ ID NO: 89718 - DNA, 6 bp, Unknown
  misc_feature (1)..( 6): Result.001 file - promoters60/1008816
ttcaac

SEQ ID NO: 89719 - DNA, 6 bp, Unknown
  misc_feature (1)..( 6): Result.001 file - promoters60/1008816
taaaac

SEQ ID NO: 89720 - DNA, 6 bp, Unknown
  misc_feature (1)..( 6): Result.001 file - promoters60/1008816
taaaac

SEQ ID NO: 89721 - DNA, 6 bp, Unknown
  misc_feature (1)..( 6): Result.001 file - promoters60/1008816
aaagtt

SEQ ID NO: 89722 - DNA, 6 bp, Unknown
  misc_feature (1)..( 6): Result.001 file - promoters60/1008816
aaagtt

SEQ ID NO: 89723 - DNA, 6 bp, Unknown
  misc_feature (1)..( 6): Result.001 file - promoters60/1008816
atattt

SEQ ID NO: 89724 - DNA, 6 bp, Unknown
  misc_feature (1)..( 6): Result.001 file - promoters60/1008816
atattt

SEQ ID NO: 89725 - DNA, 6 bp, Unknown
  misc_feature (1)..( 6): Result.001 file - promoters60/1008816
gaaaaa

SEQ ID NO: 89726 - DNA, 6 bp, Unknown
  misc_feature (1)..( 6): Result.001 file - promoters60/1008816
gaaaaa

SEQ ID NO: 89727 - DNA, 8 bp, Unknown
  misc_feature (1)..( 8): Result.001 file - promoters60/1008816
aggataaa

SEQ ID NO: 89728 - DNA, 8 bp, Unknown
  misc_feature (1)..( 8): Result.001 file - promoters60/1008816
aggagaaa

SEQ ID NO: 89729 - DNA, 6 bp, Unknown
  misc_feature (1)..( 6): Result.001 file - promoters60/1008816
tctaaa

SEQ ID NO: 89730 - DNA, 6 bp, Unknown
  misc_feature (1)..( 6): Result.001 file - promoters60/1008816
tctaaa

SEQ ID NO: 89731 - DNA, 9 bp, Unknown
  misc_feature (1)..( 9): Result.001 file - promoters60/1008816
atcataact

SEQ ID NO: 89732 - DNA, 9 bp, Unknown
  misc_feature (1)..( 9): Result.001 file - promoters60/1008816
atcttaact

SEQ ID NO: 89733 - DNA, 6 bp, Unknown
  misc_feature (1)..( 6): Result.001 file - promoters60/1008816
ctctac

SEQ ID NO: 89734 - DNA, 6 bp, Unknown
  misc_feature (1)..( 6): Result.001 file - promoters60/1008816
ctctac

SEQ ID NO: 89735 - DNA, 8 bp, Unknown
  misc_feature (1)..( 8): Result.001 file - promoters60/1008816
taaagcaa

SEQ ID NO: 89736 - DNA, 8 bp, Unknown
  misc_feature (1)..( 8): Result.001 file - promoters60/1008816
taaaccaa

SEQ ID NO: 89737 - DNA, 13 bp, Unknown
  misc_feature (1)..( 13): Result.001 file - promoters60/1008816
cgaataaaaaaaa

SEQ ID NO: 89738 - DNA, 13 bp, Unknown
  misc_feature (1)..( 13): Result.001 file - promoters60/1008816
cgattaataaaaa

SEQ ID NO: 89739 - DNA, 6 bp, Unknown
  misc_feature (1)..( 6): Result.001 file - promoters60/1008816
agtaaa

SEQ ID NO: 89740 - DNA, 6 bp, Unknown
  misc_feature (1)..( 6): Result.001 file - promoters60/1008816
agtaaa

SEQ ID NO: 89741 - DNA, 7 bp, Unknown
  misc_feature (1)..( 7): Result.001 file - promoters60/1008816
aatcggg

SEQ ID NO: 89742 - DNA, 7 bp, Unknown
  misc_feature (1)..( 7): Result.001 file - promoters60/1008816
aattggg

SEQ ID NO: 89743 - DNA, 8 bp, Unknown
  misc_feature (1)..( 8): Result.001 file - promoters60/1008816
gaaagaaa

SEQ ID NO: 89744 - DNA, 8 bp, Unknown
  misc_feature (1)..( 8): Result.001 file - promoters60/1008816
gaaacaaa

SEQ ID NO: 89745 - DNA, 10 bp, Unknown
  misc_feature (1)..( 10): Result.001 file - promoters60/1008816
ggaaaagaaa

SEQ ID NO: 89746 - DNA, 10 bp, Unknown
  misc_feature (1)..( 10): Result.001 file - promoters60/1008816
ggaaatgaaa

SEQ ID NO: 89747 - DNA, 7 bp, Unknown
  misc_feature (1)..( 7): Result.001 file - promoters60/1008816
cccacta

SEQ ID NO: 89748 - DNA, 7 bp, Unknown
  misc_feature (1)..( 7): Result.001 file - promoters60/1008816
cccacta

SEQ ID NO: 89749 - DNA, 9 bp, Unknown
  misc_feature (1)..( 9): Result.001 file - promoters60/1008816
aaagaaaag

SEQ ID NO: 89750 - DNA, 9 bp, Unknown
  misc_feature (1)..( 9): Result.001 file - promoters60/1008816
aaagtaaag

SEQ ID NO: 89751 - DNA, 7 bp, Unknown
  misc_feature (1)..( 7): Result.001 file - promoters60/1008816
gtatata

SEQ ID NO: 89752 - DNA, 7 bp, Unknown
  misc_feature (1)..( 7): Result.001 file - promoters60/1008836
gtatata

SEQ ID NO: 89753 - DNA, 11 bp, Unknown
  misc_feature (1)..( 11): Result.001 file - promoters60/1008836
atatttttatg

SEQ ID NO: 89754 - DNA, 11 bp, Unknown
  misc_feature (1)..( 11): Result.001 file - promoters60/1008836
gaaattttatg

SEQ ID NO: 89755 - DNA, 11 bp, Unknown
  misc_feature (1)..( 11): Result.001 file - promoters60/1008836
ttttttttaac

SEQ ID NO: 89756 - DNA, 11 bp, Unknown
  misc_feature (1)..( 11): Result.001 file - promoters60/1008836
atatttttata

SEQ ID NO: 89757 - DNA, 11 bp, Unknown
  misc_feature (1)..( 11): Result.001 file - promoters60/1008836
caaattttatt

SEQ ID NO: 89758 - DNA, 11 bp, Unknown
  misc_feature (1)..( 11): Result.001 file - promoters60/1008836
acatttttttc

SEQ ID NO: 89759 - DNA, 10 bp, Unknown
  misc_feature (1)..( 10): Result.001 file - promoters60/1008836
atttatatga

SEQ ID NO: 89760 - DNA, 10 bp, Unknown
  misc_feature (1)..( 10): Result.001 file - promoters60/1008836
atttttattt

SEQ ID NO: 89761 - DNA, 10 bp, Unknown
  misc_feature (1)..( 10): Result.001 file - promoters60/1008836
cttttttttt

SEQ ID NO: 89762 - DNA, 10 bp, Unknown
  misc_feature (1)..( 10): Result.001 file - promoters60/1008836
atttttttca

SEQ ID NO: 89763 - DNA, 10 bp, Unknown
  misc_feature (1)..( 10): Result.001 file - promoters60/1008836
cgtttcattg

SEQ ID NO: 89764 - DNA, 12 bp, Unknown
  misc_feature (1)..( 12): Result.001 file - promoters60/1008836
tcaaaagattta

SEQ ID NO: 89765 - DNA, 12 bp, Unknown
  misc_feature (1)..( 12): Result.001 file - promoters60/1008836
acaaaagaaaaa

SEQ ID NO: 89766 - DNA, 12 bp, Unknown
  misc_feature (1)..( 12): Result.001 file - promoters60/1008836
tcaaaaaaagaa

SEQ ID NO: 89767 - DNA, 12 bp, Unknown
  misc_feature (1)..( 12): Result.001 file - promoters60/1008836
ggaaaaaaaaaa

SEQ ID NO: 89768 - DNA, 9 bp, Unknown
  misc_feature (1)..( 9): Result.001 file - promoters60/1008836
taaaatttg

SEQ ID NO: 89769 - DNA, 9 bp, Unknown
  misc_feature (1)..( 9): Result.001 file - promoters60/1008836
aaaacttta

SEQ ID NO: 89770 - DNA, 9 bp, Unknown
  misc_feature (1)..( 9): Result.001 file - promoters60/1008836
gttaatttg

SEQ ID NO: 89771 - DNA, 9 bp, Unknown
  misc_feature (1)..( 9): Result.001 file - promoters60/1008836
aaaacgtta

SEQ ID NO: 89772 - DNA, 13 bp, Unknown
  misc_feature (1)..( 13): Result.001 file - promoters60/1008836
gactaattaaatg

SEQ ID NO: 89773 - DNA, 13 bp, Unknown
  misc_feature (1)..( 13): Result.001 file - promoters60/1008836
taaaaattaataa

SEQ ID NO: 89774 - DNA, 13 bp, Unknown
  misc_feature (1)..( 13): Result.001 file - promoters60/1008836
ttgtaaataattg

SEQ ID NO: 89775 - DNA, 13 bp, Unknown
  misc_feature (1)..( 13): Result.001 file - promoters60/1008836
aaacgattaaatg

SEQ ID NO: 89776 - DNA, 13 bp, Unknown
  misc_feature (1)..( 13): Result.001 file - promoters60/1008836
cttaaatttagat

SEQ ID NO: 89777 - DNA, 13 bp, Unknown
  misc_feature (1)..( 13): Result.001 file - promoters60/1008836
tgtgaatctaaga

SEQ ID NO: 89778 - DNA, 12 bp, Unknown
  misc_feature (1)..( 12): Result.001 file - promoters60/1008836
aacattgtccat

SEQ ID NO: 89779 - DNA, 12 bp, Unknown
  misc_feature (1)..( 12): Result.001 file - promoters60/1008836
catattatccat

SEQ ID NO: 89780 - DNA, 12 bp, Unknown
  misc_feature (1)..( 12): Result.001 file - promoters60/1008836
ataattatccaa

SEQ ID NO: 89781 - DNA, 12 bp, Unknown
  misc_feature (1)..( 12): Result.001 file - promoters60/1008836
ttaaatattttt

SEQ ID NO: 89782 - DNA, 12 bp, Unknown
  misc_feature (1)..( 12): Result.001 file - promoters60/1008836
atcaatattctt

SEQ ID NO: 89783 - DNA, 6 bp, Unknown
  misc_feature (1)..( 6): Result.001 file - promoters60/1008836
tataaa

SEQ ID NO: 89784 - DNA, 6 bp, Unknown
  misc_feature (1)..( 6): Result.001 file - promoters60/1008836
tataaa

SEQ ID NO: 89785 - DNA, 6 bp, Unknown
  misc_feature (1)..( 6): Result.001 file - promoters60/1008836
tataaa

SEQ ID NO: 89786 - DNA, 6 bp, Unknown
  misc_feature (1)..( 6): Result.001 file - promoters60/1008836
tataaa

SEQ ID NO: 89787 - DNA, 13 bp, Unknown
  misc_feature (1)..( 13): Result.001 file - promoters60/1008836
atatttttatgtg

SEQ ID NO: 89788 - DNA, 13 bp, Unknown
  misc_feature (1)..( 13): Result.001 file - promoters60/1008836
acatttttttcac

SEQ ID NO: 89789 - DNA, 13 bp, Unknown
  misc_feature (1)..( 13): Result.001 file - promoters60/1008836
atatttttataaa

SEQ ID NO: 89790 - DNA, 13 bp, Unknown
  misc_feature (1)..( 13): Result.001 file - promoters60/1008836
atatttttatttt

SEQ ID NO: 89791 - DNA, 13 bp, Unknown
  misc_feature (1)..( 13): Result.001 file - promoters60/1008836
atgtatttagaaa

SEQ ID NO: 89792 - DNA, 11 bp, Unknown
  misc_feature (1)..( 11): Result.001 file - promoters60/1008836
gttttgaaatt

SEQ ID NO: 89793 - DNA, 11 bp, Unknown
  misc_feature (1)..( 11): Result.001 file - promoters60/1008836
attttgacatc

SEQ ID NO: 89794 - DNA, 11 bp, Unknown
  misc_feature (1)..( 11): Result.001 file - promoters60/1008836
tttttgatatt

SEQ ID NO: 89795 - DNA, 12 bp, Unknown
  misc_feature (1)..( 12): Result.001 file - promoters60/1008836
gttgttgcttct

SEQ ID NO: 89796 - DNA, 10 bp, Unknown
  misc_feature (1)..( 10): Result.001 file - promoters60/1008836
ttttaaagtt

SEQ ID NO: 89797 - DNA, 10 bp, Unknown
  misc_feature (1)..( 10): Result.001 file - promoters60/1008836
ttttaacatc

SEQ ID NO: 89798 - DNA, 10 bp, Unknown
  misc_feature (1)..( 10): Result.001 file - promoters60/1008836
ttttaacaaa

SEQ ID NO: 89799 - DNA, 10 bp, Unknown
  misc_feature (1)..( 10): Result.001 file - promoters60/1008836
tagtaaaaaa

SEQ ID NO: 89800 - DNA, 8 bp, Unknown
  misc_feature (1)..( 8): Result.001 file - promoters60/1008836
taaatatt

SEQ ID NO: 89801 - DNA, 8 bp, Unknown
  misc_feature (1)..( 8): Result.001 file - promoters60/1008836
tcaatatt

SEQ ID NO: 89802 - DNA, 9 bp, Unknown
  misc_feature (1)..( 9): Result.001 file - promoters60/1008836
ataattatc

SEQ ID NO: 89803 - DNA, 9 bp, Unknown
  misc_feature (1)..( 9): Result.001 file - promoters60/1008836
atccatata

SEQ ID NO: 89804 - DNA, 12 bp, Unknown
  misc_feature (1)..( 12): Result.001 file - promoters60/1008836
ttgattaaaaaa

SEQ ID NO: 89805 - DNA, 12 bp, Unknown
  misc_feature (1)..( 12): Result.001 file - promoters60/1008836
ttgaataaaaaa

SEQ ID NO: 89806 - DNA, 12 bp, Unknown
  misc_feature (1)..( 12): Result.001 file - promoters60/1008836
caaagtaaaaaa

SEQ ID NO: 89807 - DNA, 12 bp, Unknown
  misc_feature (1)..( 12): Result.001 file - promoters60/1008889
ctagataaaagt

SEQ ID NO: 89808 - DNA, 8 bp, Unknown
  misc_feature (1)..( 8): Result.001 file - promoters60/1008889
attcattg

SEQ ID NO: 89809 - DNA, 8 bp, Unknown
  misc_feature (1)..( 8): Result.001 file - promoters60/1008889
atttattg

SEQ ID NO: 89810 - DNA, 8 bp, Unknown
  misc_feature (1)..( 8): Result.001 file - promoters60/1008889
ctgatatt

SEQ ID NO: 89811 - DNA, 8 bp, Unknown
  misc_feature (1)..( 8): Result.001 file - promoters60/1008889
ctgatatt

SEQ ID NO: 89812 - DNA, 10 bp, Unknown
  misc_feature (1)..( 10): Result.001 file - promoters60/1008889
atttataaat

SEQ ID NO: 89813 - DNA, 10 bp, Unknown
  misc_feature (1)..( 10): Result.001 file - promoters60/1008889
atttataaat

SEQ ID NO: 89814 - DNA, 7 bp, Unknown
  misc_feature (1)..( 7): Result.001 file - promoters60/1008889
gttgttt

SEQ ID NO: 89815 - DNA, 7 bp, Unknown
  misc_feature (1)..( 7): Result.001 file - promoters60/1008889
gttattt

SEQ ID NO: 89816 - DNA, 8 bp, Unknown
  misc_feature (1)..( 8): Result.001 file - promoters60/1008889
aaaattaa

SEQ ID NO: 89817 - DNA, 8 bp, Unknown
  misc_feature (1)..( 8): Result.001 file - promoters60/1008889
taaattat

SEQ ID NO: 89818 - DNA, 8 bp, Unknown
  misc_feature (1)..( 8): Result.001 file - promoters60/1008889
taaaatat

SEQ ID NO: 89819 - DNA, 8 bp, Unknown
  misc_feature (1)..( 8): Result.001 file - promoters60/1008889
gtcaaaaa

SEQ ID NO: 89820 - DNA, 8 bp, Unknown
  misc_feature (1)..( 8): Result.001 file - promoters60/1008889
gtcaaaaa

SEQ ID NO: 89821 - DNA, 6 bp, Unknown
  misc_feature (1)..( 6): Result.001 file - promoters60/1008889
agtttg

SEQ ID NO: 89822 - DNA, 6 bp, Unknown
  misc_feature (1)..( 6): Result.001 file - promoters60/1008889
agtttg

SEQ ID NO: 89823 - DNA, 8 bp, Unknown
  misc_feature (1)..( 8): Result.001 file - promoters60/1008889
aaagacat

SEQ ID NO: 89824 - DNA, 8 bp, Unknown
  misc_feature (1)..( 8): Result.001 file - promoters60/1008889
aaagccat

SEQ ID NO: 89825 - DNA, 6 bp, Unknown
  misc_feature (1)..( 6): Result.001 file - promoters60/1008889
ctctcc

SEQ ID NO: 89826 - DNA, 6 bp, Unknown
  misc_feature (1)..( 6): Result.001 file - promoters60/1008889
ctctcc

SEQ ID NO: 89827 - DNA, 7 bp, Unknown
  misc_feature (1)..( 7): Result.001 file - promoters60/1008889
caatctt

SEQ ID NO: 89828 - DNA, 7 bp, Unknown
  misc_feature (1)..( 7): Result.001 file - promoters60/1008889
caacctt

SEQ ID NO: 89829 - DNA, 8 bp, Unknown
  misc_feature (1)..( 8): Result.001 file - promoters60/1008889
aagaagat

SEQ ID NO: 89830 - DNA, 8 bp, Unknown
  misc_feature (1)..( 8): Result.001 file - promoters60/1008889
aagaggat

SEQ ID NO: 89831 - DNA, 8 bp, Unknown
  misc_feature (1)..( 8): Result.001 file - promoters60/1008889
caataaga

SEQ ID NO: 89832 - DNA, 8 bp, Unknown
  misc_feature (1)..( 8): Result.001 file - promoters60/1008889
caatcaga

SEQ ID NO: 89833 - DNA, 6 bp, Unknown
  misc_feature (1)..( 6): Result.001 file - promoters60/1008889
aaaaaa

SEQ ID NO: 89834 - DNA, 6 bp, Unknown
  misc_feature (1)..( 6): Result.001 file - promoters60/1008889
aaaaaa

SEQ ID NO: 89835 - DNA, 13 bp, Unknown
  misc_feature (1)..( 13): Result.001 file - promoters60/1008889
aaataaaaaaatt

SEQ ID NO: 89836 - DNA, 13 bp, Unknown
  misc_feature (1)..( 13): Result.001 file - promoters60/1008889
aaagaaaataatt

SEQ ID NO: 89837 - DNA, 8 bp, Unknown
  misc_feature (1)..( 8): Result.001 file - promoters60/1008889
atttgttt

SEQ ID NO: 89838 - DNA, 8 bp, Unknown
  misc_feature (1)..( 8): Result.001 file - promoters60/1008889
attttttt

SEQ ID NO: 89839 - DNA, 8 bp, Unknown
  misc_feature (1)..( 8): Result.001 file - promoters60/1008889
atttttag

SEQ ID NO: 89840 - DNA, 6 bp, Unknown
  misc_feature (1)..( 6): Result.001 file - promoters60/1008889
caatat

SEQ ID NO: 89841 - DNA, 6 bp, Unknown
  misc_feature (1)..( 6): Result.001 file - promoters60/1008889
caatat

SEQ ID NO: 89842 - DNA, 6 bp, Unknown
  misc_feature (1)..( 6): Result.001 file - promoters60/1008889
aataaa

SEQ ID NO: 89843 - DNA, 6 bp, Unknown
  misc_feature (1)..( 6): Result.001 file - promoters60/1008983
aataaa

SEQ ID NO: 89844 - DNA, 7 bp, Unknown
  misc_feature (1)..( 7): Result.001 file - promoters60/1008983
ttaattg

SEQ ID NO: 89845 - DNA, 7 bp, Unknown
  misc_feature (1)..( 7): Result.001 file - promoters60/1008983
ttatttg

SEQ ID NO: 89846 - DNA, 7 bp, Unknown
  misc_feature (1)..( 7): Result.001 file - promoters60/1008983
gtccaga

SEQ ID NO: 89847 - DNA, 7 bp, Unknown
  misc_feature (1)..( 7): Result.001 file - promoters60/1008983
gtctaga

SEQ ID NO: 89848 - DNA, 6 bp, Unknown
  misc_feature (1)..( 6): Result.001 file - promoters60/1008983
tgaaaa

SEQ ID NO: 89849 - DNA, 6 bp, Unknown
  misc_feature (1)..( 6): Result.001 file - promoters60/1008983
tgaaaa

SEQ ID NO: 89850 - DNA, 6 bp, Unknown
  misc_feature (1)..( 6): Result.001 file - promoters60/1008983
atttgg

SEQ ID NO: 89851 - DNA, 6 bp, Unknown
  misc_feature (1)..( 6): Result.001 file - promoters60/1008983
atttgg

SEQ ID NO: 89852 - DNA, 9 bp, Unknown
  misc_feature (1)..( 9): Result.001 file - promoters60/1008983
ggttttggt

SEQ ID NO: 89853 - DNA, 9 bp, Unknown
  misc_feature (1)..( 9): Result.001 file - promoters60/1008983
ggtgttggt

SEQ ID NO: 89854 - DNA, 7 bp, Unknown
  misc_feature (1)..( 7): Result.001 file - promoters60/1008983
atttttg

SEQ ID NO: 89855 - DNA, 7 bp, Unknown
  misc_feature (1)..( 7): Result.001 file - promoters60/1008983
atttttg

SEQ ID NO: 89856 - DNA, 6 bp, Unknown
  misc_feature (1)..( 6): Result.001 file - promoters60/1008983
gctttt

SEQ ID NO: 89857 - DNA, 6 bp, Unknown
  misc_feature (1)..( 6): Result.001 file - promoters60/1008983
gctttt

SEQ ID NO: 89858 - DNA, 7 bp, Unknown
  misc_feature (1)..( 7): Result.001 file - promoters60/1008983
tcttgtg

SEQ ID NO: 89859 - DNA, 7 bp, Unknown
  misc_feature (1)..( 7): Result.001 file - promoters60/1008983
tctggtg

SEQ ID NO: 89860 - DNA, 6 bp, Unknown
  misc_feature (1)..( 6): Result.001 file - promoters60/1008983
tcttgt

SEQ ID NO: 89861 - DNA, 6 bp, Unknown
  misc_feature (1)..( 6): Result.001 file - promoters60/1008983
tcttgt

SEQ ID NO: 89862 - DNA, 6 bp, Unknown
  misc_feature (1)..( 6): Result.001 file - promoters60/1008983
tctatc

SEQ ID NO: 89863 - DNA, 6 bp, Unknown
  misc_feature (1)..( 6): Result.001 file - promoters60/1008983
tctatc

SEQ ID NO: 89864 - DNA, 7 bp, Unknown
  misc_feature (1)..( 7): Result.001 file - promoters60/1008983
aatatct

SEQ ID NO: 89865 - DNA, 7 bp, Unknown
  misc_feature (1)..( 7): Result.001 file - promoters60/1008983
aatatct

SEQ ID NO: 89866 - DNA, 7 bp, Unknown
  misc_feature (1)..( 7): Result.001 file - promoters60/1008983
ttagccc

SEQ ID NO: 89867 - DNA, 7 bp, Unknown
  misc_feature (1)..( 7): Result.001 file - promoters60/1008983
ttaaccc

SEQ ID NO: 89868 - DNA, 6 bp, Unknown
  misc_feature (1)..( 6): Result.001 file - promoters60/1008983
ttctta

SEQ ID NO: 89869 - DNA, 6 bp, Unknown
  misc_feature (1)..( 6): Result.001 file - promoters60/1008983
ttctta

SEQ ID NO: 89870 - DNA, 8 bp, Unknown
  misc_feature (1)..( 8): Result.001 file - promoters60/1008983
atgatttc

SEQ ID NO: 89871 - DNA, 8 bp, Unknown
  misc_feature (1)..( 8): Result.001 file - promoters60/1008983
atgttttc

SEQ ID NO: 89872 - DNA, 7 bp, Unknown
  misc_feature (1)..( 7): Result.001 file - promoters60/1008983
atttttc

SEQ ID NO: 89873 - DNA, 7 bp, Unknown
  misc_feature (1)..( 7): Result.001 file - promoters60/1008983
atttttc

SEQ ID NO: 89874 - DNA, 8 bp, Unknown
  misc_feature (1)..( 8): Result.001 file - promoters60/1008983
agaagagg

SEQ ID NO: 89875 - DNA, 8 bp, Unknown
  misc_feature (1)..( 8): Result.001 file - promoters60/1008983
agaacagg

SEQ ID NO: 89876 - DNA, 6 bp, Unknown
  misc_feature (1)..( 6): Result.001 file - promoters60/1008983
tgatcg

SEQ ID NO: 89877 - DNA, 6 bp, Unknown
  misc_feature (1)..( 6): Result.001 file - promoters60/1008983
tgatcg

SEQ ID NO: 89878 - DNA, 6 bp, Unknown
  misc_feature (1)..( 6): Result.001 file - promoters60/1008983
aatgcc

SEQ ID NO: 89879 - DNA, 6 bp, Unknown
  misc_feature (1)..( 6): Result.001 file - promoters60/1008983
aatgcc

SEQ ID NO: 89880 - DNA, 6 bp, Unknown
  misc_feature (1)..( 6): Result.001 file - promoters60/1008983
tgctga

SEQ ID NO: 89881 - DNA, 6 bp, Unknown
  misc_feature (1)..( 6): Result.001 file - promoters60/1008983
tgctga

SEQ ID NO: 89882 - DNA, 7 bp, Unknown
  misc_feature (1)..( 7): Result.001 file - promoters60/1008983
ccgtgtt

SEQ ID NO: 89883 - DNA, 7 bp, Unknown
  misc_feature (1)..( 7): Result.001 file - promoters60/1009030
ccgagtt

SEQ ID NO: 89884 - DNA, 11 bp, Unknown
  misc_feature (1)..( 11): Result.001 file - promoters60/1009030
ttaaagcaaaa

SEQ ID NO: 89885 - DNA, 11 bp, Unknown
  misc_feature (1)..( 11): Result.001 file - promoters60/1009030
atggagcaaat

SEQ ID NO: 89886 - DNA, 11 bp, Unknown
  misc_feature (1)..( 11): Result.001 file - promoters60/1009030
ataaaacaaaa

SEQ ID NO: 89887 - DNA, 11 bp, Unknown
  misc_feature (1)..( 11): Result.001 file - promoters60/1009030
ttgaaataaaa

SEQ ID NO: 89888 - DNA, 11 bp, Unknown
  misc_feature (1)..( 11): Result.001 file - promoters60/1009030
acaaaacatcc

SEQ ID NO: 89889 - DNA, 11 bp, Unknown
  misc_feature (1)..( 11): Result.001 file - promoters60/1009030
ataagacagta

SEQ ID NO: 89890 - DNA, 11 bp, Unknown
  misc_feature (1)..( 11): Result.001 file - promoters60/1009030
gcaatcatggt

SEQ ID NO: 89891 - DNA, 11 bp, Unknown
  misc_feature (1)..( 11): Result.001 file - promoters60/1009030
ataataatgtc

SEQ ID NO: 89892 - DNA, 11 bp, Unknown
  misc_feature (1)..( 11): Result.001 file - promoters60/1009030
gcagtcaaaag

SEQ ID NO: 89893 - DNA, 11 bp, Unknown
  misc_feature (1)..( 11): Result.001 file - promoters60/1009030
ataatcatagc

SEQ ID NO: 89894 - DNA, 11 bp, Unknown
  misc_feature (1)..( 11): Result.001 file - promoters60/1009030
ttaataaaaat

SEQ ID NO: 89895 - DNA, 11 bp, Unknown
  misc_feature (1)..( 11): Result.001 file - promoters60/1009030
atattaatcga

SEQ ID NO: 89896 - DNA, 11 bp, Unknown
  misc_feature (1)..( 11): Result.001 file - promoters60/1009030
gcaaaacacat

SEQ ID NO: 89897 - DNA, 11 bp, Unknown
  misc_feature (1)..( 11): Result.001 file - promoters60/1009030
acaaaacatcc

SEQ ID NO: 89898 - DNA, 11 bp, Unknown
  misc_feature (1)..( 11): Result.001 file - promoters60/1009030
ataaaacaaaa

SEQ ID NO: 89899 - DNA, 11 bp, Unknown
  misc_feature (1)..( 11): Result.001 file - promoters60/1009030
agcaaataaat

SEQ ID NO: 89900 - DNA, 11 bp, Unknown
  misc_feature (1)..( 11): Result.001 file - promoters60/1009030
ataaaattaat

SEQ ID NO: 89901 - DNA, 11 bp, Unknown
  misc_feature (1)..( 11): Result.001 file - promoters60/1009053
ataagacagta

SEQ ID NO: 89902 - DNA, 8 bp, Unknown
  misc_feature (1)..( 8): Result.001 file - promoters60/1009053
atattact

SEQ ID NO: 89903 - DNA, 8 bp, Unknown
  misc_feature (1)..( 8): Result.001 file - promoters60/1009053
atactact

SEQ ID NO: 89904 - DNA, 7 bp, Unknown
  misc_feature (1)..( 7): Result.001 file - promoters60/1009053
caaatac

SEQ ID NO: 89905 - DNA, 7 bp, Unknown
  misc_feature (1)..( 7): Result.001 file - promoters60/1009053
caattac

SEQ ID NO: 89906 - DNA, 11 bp, Unknown
  misc_feature (1)..( 11): Result.001 file - promoters60/1009053
tatattaaata

SEQ ID NO: 89907 - DNA, 11 bp, Unknown
  misc_feature (1)..( 11): Result.001 file - promoters60/1009053
tatattttttt

SEQ ID NO: 89908 - DNA, 11 bp, Unknown
  misc_feature (1)..( 11): Result.001 file - promoters60/1009053
gatattttttt

SEQ ID NO: 89909 - DNA, 6 bp, Unknown
  misc_feature (1)..( 6): Result.001 file - promoters60/1009053
tatatg

SEQ ID NO: 89910 - DNA, 6 bp, Unknown
  misc_feature (1)..( 6): Result.001 file - promoters60/1009053
tatatg

SEQ ID NO: 89911 - DNA, 6 bp, Unknown
  misc_feature (1)..( 6): Result.001 file - promoters60/1009053
ttcaaa

SEQ ID NO: 89912 - DNA, 6 bp, Unknown
  misc_feature (1)..( 6): Result.001 file - promoters60/1009053
ttcaaa

SEQ ID NO: 89913 - DNA, 9 bp, Unknown
  misc_feature (1)..( 9): Result.001 file - promoters60/1009053
atactctca

SEQ ID NO: 89914 - DNA, 9 bp, Unknown
  misc_feature (1)..( 9): Result.001 file - promoters60/1009053
atattctca

SEQ ID NO: 89915 - DNA, 6 bp, Unknown
  misc_feature (1)..( 6): Result.001 file - promoters60/1009053
tcaaac

SEQ ID NO: 89916 - DNA, 6 bp, Unknown
  misc_feature (1)..( 6): Result.001 file - promoters60/1009053
tcaaac

SEQ ID NO: 89917 - DNA, 6 bp, Unknown
  misc_feature (1)..( 6): Result.001 file - promoters60/1009053
ttttct

SEQ ID NO: 89918 - DNA, 6 bp, Unknown
  misc_feature (1)..( 6): Result.001 file - promoters60/1009053
ttttct

SEQ ID NO: 89919 - DNA, 7 bp, Unknown
  misc_feature (1)..( 7): Result.001 file - promoters60/1009053
gaattca

SEQ ID NO: 89920 - DNA, 7 bp, Unknown
  misc_feature (1)..( 7): Result.001 file - promoters60/1009053
gaaatca

SEQ ID NO: 89921 - DNA, 6 bp, Unknown
  misc_feature (1)..( 6): Result.001 file - promoters60/1009053
atcttg

SEQ ID NO: 89922 - DNA, 6 bp, Unknown
  misc_feature (1)..( 6): Result.001 file - promoters60/1009053
atcttg

SEQ ID NO: 89923 - DNA, 6 bp, Unknown
  misc_feature (1)..( 6): Result.001 file - promoters60/1009053
acacaa

SEQ ID NO: 89924 - DNA, 6 bp, Unknown
  misc_feature (1)..( 6): Result.001 file - promoters60/1009053
acacaa

SEQ ID NO: 89925 - DNA, 12 bp, Unknown
  misc_feature (1)..( 12): Result.001 file - promoters60/1009053
atgttttcaata

SEQ ID NO: 89926 - DNA, 12 bp, Unknown
  misc_feature (1)..( 12): Result.001 file - promoters60/1009053
atttttttaata

SEQ ID NO: 89927 - DNA, 12 bp, Unknown
  misc_feature (1)..( 12): Result.001 file - promoters60/1009053
atattttttttt

SEQ ID NO: 89928 - DNA, 7 bp, Unknown
  misc_feature (1)..( 7): Result.001 file - promoters60/1009053
actattc

SEQ ID NO: 89929 - DNA, 7 bp, Unknown
  misc_feature (1)..( 7): Result.001 file - promoters60/1009053
actcttc

SEQ ID NO: 89930 - DNA, 11 bp, Unknown
  misc_feature (1)..( 11): Result.001 file - promoters60/1009053
accggttatta

SEQ ID NO: 89931 - DNA, 11 bp, Unknown
  misc_feature (1)..( 11): Result.001 file - promoters60/1009053
accggatatta

SEQ ID NO: 89932 - DNA, 6 bp, Unknown
  misc_feature (1)..( 6): Result.001 file - promoters60/1009053
tactgt

SEQ ID NO: 89933 - DNA, 6 bp, Unknown
  misc_feature (1)..( 6): Result.001 file - promoters60/1009053
tactgt

SEQ ID NO: 89934 - DNA, 9 bp, Unknown
  misc_feature (1)..( 9): Result.001 file - promoters60/1009053
tcaaaattt

SEQ ID NO: 89935 - DNA, 9 bp, Unknown
  misc_feature (1)..( 9): Result.001 file - promoters60/1009053
tcagaattt

SEQ ID NO: 89936 - DNA, 6 bp, Unknown
  misc_feature (1)..( 6): Result.001 file - promoters60/1009053
ttgaaa

SEQ ID NO: 89937 - DNA, 6 bp, Unknown
  misc_feature (1)..( 6): Result.001 file - promoters60/1009053
ttgaaa

SEQ ID NO: 89938 - DNA, 7 bp, Unknown
  misc_feature (1)..( 7): Result.001 file - promoters60/1009053
cttctcc

SEQ ID NO: 89939 - DNA, 7 bp, Unknown
  misc_feature (1)..( 7): Result.001 file - promoters60/1009053
cttgtcc

SEQ ID NO: 89940 - DNA, 7 bp, Unknown
  misc_feature (1)..( 7): Result.001 file - promoters60/1009053
ttcatgt

SEQ ID NO: 89941 - DNA, 7 bp, Unknown
  misc_feature (1)..( 7): Result.001 file - promoters60/1009053
ttcatgt

SEQ ID NO: 89942 - DNA, 7 bp, Unknown
  misc_feature (1)..( 7): Result.001 file - promoters60/1009053
aagcttt

SEQ ID NO: 89943 - DNA, 7 bp, Unknown
  misc_feature (1)..( 7): Result.001 file - promoters60/1009053
aagattt

SEQ ID NO: 89944 - DNA, 7 bp, Unknown
  misc_feature (1)..( 7): Result.001 file - promoters60/1009053
tacctca

SEQ ID NO: 89945 - DNA, 7 bp, Unknown
  misc_feature (1)..( 7): Result.001 file - promoters60/1009053
tacctca

SEQ ID NO: 89946 - DNA, 7 bp, Unknown
  misc_feature (1)..( 7): Result.001 file - promoters60/1009053
ttttata

SEQ ID NO: 89947 - DNA, 7 bp, Unknown
  misc_feature (1)..( 7): Result.001 file - promoters60/1009053
tttgata

SEQ ID NO: 89948 - DNA, 9 bp, Unknown
  misc_feature (1)..( 9): Result.001 file - promoters60/1009053
catccttat

SEQ ID NO: 89949 - DNA, 9 bp, Unknown
  misc_feature (1)..( 9): Result.001 file - promoters60/1009086
catcattat

SEQ ID NO: 89950 - DNA, 8 bp, Unknown
  misc_feature (1)..( 8): Result.001 file - promoters60/1009086
ataaataa

SEQ ID NO: 89951 - DNA, 8 bp, Unknown
  misc_feature (1)..( 8): Result.001 file - promoters60/1009086
atatataa

SEQ ID NO: 89952 - DNA, 6 bp, Unknown
  misc_feature (1)..( 6): Result.001 file - promoters60/1009086
aattat

SEQ ID NO: 89953 - DNA, 6 bp, Unknown
  misc_feature (1)..( 6): Result.001 file - promoters60/1009086
aattat

SEQ ID NO: 89954 - DNA, 6 bp, Unknown
  misc_feature (1)..( 6): Result.001 file - promoters60/1009086
tttgtt

SEQ ID NO: 89955 - DNA, 6 bp, Unknown
  misc_feature (1)..( 6): Result.001 file - promoters60/1009086
tttgtt

SEQ ID NO: 89956 - DNA, 6 bp, Unknown
  misc_feature (1)..( 6): Result.001 file - promoters60/1009086
aaattg

SEQ ID NO: 89957 - DNA, 6 bp, Unknown
  misc_feature (1)..( 6): Result.001 file - promoters60/1009086
aaattg

SEQ ID NO: 89958 - DNA, 7 bp, Unknown
  misc_feature (1)..( 7): Result.001 file - promoters60/1009086
aaaaatt

SEQ ID NO: 89959 - DNA, 7 bp, Unknown
  misc_feature (1)..( 7): Result.001 file - promoters60/1009086
aaaaatt

SEQ ID NO: 89960 - DNA, 6 bp, Unknown
  misc_feature (1)..( 6): Result.001 file - promoters60/1009086
tttgat

SEQ ID NO: 89961 - DNA, 6 bp, Unknown
  misc_feature (1)..( 6): Result.001 file - promoters60/1009086
tttgat

SEQ ID NO: 89962 - DNA, 6 bp, Unknown
  misc_feature (1)..( 6): Result.001 file - promoters60/1009086
tcaaat

SEQ ID NO: 89963 - DNA, 6 bp, Unknown
  misc_feature (1)..( 6): Result.001 file - promoters60/1009086
tcaaat

SEQ ID NO: 89964 - DNA, 9 bp, Unknown
  misc_feature (1)..( 9): Result.001 file - promoters60/1009086
taaatatga

SEQ ID NO: 89965 - DNA, 9 bp, Unknown
  misc_feature (1)..( 9): Result.001 file - promoters60/1009086
caaagatga

SEQ ID NO: 89966 - DNA, 9 bp, Unknown
  misc_feature (1)..( 9): Result.001 file - promoters60/1009086
taaataagt

SEQ ID NO: 89967 - DNA, 7 bp, Unknown
  misc_feature (1)..( 7): Result.001 file - promoters60/1009086
aatactt

SEQ ID NO: 89968 - DNA, 7 bp, Unknown
  misc_feature (1)..( 7): Result.001 file - promoters60/1009086
aatactt

SEQ ID NO: 89969 - DNA, 7 bp, Unknown
  misc_feature (1)..( 7): Result.001 file - promoters60/1009086
aaactct

SEQ ID NO: 89970 - DNA, 7 bp, Unknown
  misc_feature (1)..( 7): Result.001 file - promoters60/1009086
aaagtct

SEQ ID NO: 89971 - DNA, 6 bp, Unknown
  misc_feature (1)..( 6): Result.001 file - promoters60/1009086
gttttt

SEQ ID NO: 89972 - DNA, 6 bp, Unknown
  misc_feature (1)..( 6): Result.001 file - promoters60/1009086
gttttt

SEQ ID NO: 89973 - DNA, 8 bp, Unknown
  misc_feature (1)..( 8): Result.001 file - promoters60/1009086
gaaacaga

SEQ ID NO: 89974 - DNA, 8 bp, Unknown
  misc_feature (1)..( 8): Result.001 file - promoters60/1009086
gaaacaga

SEQ ID NO: 89975 - DNA, 7 bp, Unknown
  misc_feature (1)..( 7): Result.001 file - promoters60/1009086
aaagctt

SEQ ID NO: 89976 - DNA, 7 bp, Unknown
  misc_feature (1)..( 7): Result.001 file - promoters60/1009086
aaagctt

SEQ ID NO: 89977 - DNA, 8 bp, Unknown
  misc_feature (1)..( 8): Result.001 file - promoters60/1009086
aatttgat

SEQ ID NO: 89978 - DNA, 8 bp, Unknown
  misc_feature (1)..( 8): Result.001 file - promoters60/1009086
aatatgat

SEQ ID NO: 89979 - DNA, 7 bp, Unknown
  misc_feature (1)..( 7): Result.001 file - promoters60/1009086
ctcaaca

SEQ ID NO: 89980 - DNA, 7 bp, Unknown
  misc_feature (1)..( 7): Result.001 file - promoters60/1009086
ctccaca

SEQ ID NO: 89981 - DNA, 8 bp, Unknown
  misc_feature (1)..( 8): Result.001 file - promoters60/1009086
ataaaaca

SEQ ID NO: 89982 - DNA, 8 bp, Unknown
  misc_feature (1)..( 8): Result.001 file - promoters60/1009086
ataagaca

SEQ ID NO: 89983 - DNA, 8 bp, Unknown
  misc_feature (1)..( 8): Result.001 file - promoters60/1009086
tatatttt

SEQ ID NO: 89984 - DNA, 8 bp, Unknown
  misc_feature (1)..( 8): Result.001 file - promoters60/1009086
tatttttt

SEQ ID NO: 89985 - DNA, 6 bp, Unknown
  misc_feature (1)..( 6): Result.001 file - promoters60/1009086
tatttc

SEQ ID NO: 89986 - DNA, 6 bp, Unknown
  misc_feature (1)..( 6): Result.001 file - promoters60/1009086
tatttc

SEQ ID NO: 89987 - DNA, 8 bp, Unknown
  misc_feature (1)..( 8): Result.001 file - promoters60/1009086
atcatgaa

SEQ ID NO: 89988 - DNA, 8 bp, Unknown
  misc_feature (1)..( 8): Result.001 file - promoters60/1009086
atcaggaa

SEQ ID NO: 89989 - DNA, 8 bp, Unknown
  misc_feature (1)..( 8): Result.001 file - promoters60/1009086
tttaaaag

SEQ ID NO: 89990 - DNA, 8 bp, Unknown
  misc_feature (1)..( 8): Result.001 file - promoters60/1009086
tttaaaag

SEQ ID NO: 89991 - DNA, 6 bp, Unknown
  misc_feature (1)..( 6): Result.001 file - promoters60/1009086
aggttt

SEQ ID NO: 89992 - DNA, 6 bp, Unknown
  misc_feature (1)..( 6): Result.001 file - promoters60/1009136
aggttt

SEQ ID NO: 89993 - DNA, 8 bp, Unknown
  misc_feature (1)..( 8): Result.001 file - promoters60/1009136
caaaccaa

SEQ ID NO: 89994 - DNA, 8 bp, Unknown
  misc_feature (1)..( 8): Result.001 file - promoters60/1009136
caaaacaa

SEQ ID NO: 89995 - DNA, 8 bp, Unknown
  misc_feature (1)..( 8): Result.001 file - promoters60/1009136
aaaaacaa

SEQ ID NO: 89996 - DNA, 8 bp, Unknown
  misc_feature (1)..( 8): Result.001 file - promoters60/1009136
taaaccaa

SEQ ID NO: 89997 - DNA, 8 bp, Unknown
  misc_feature (1)..( 8): Result.001 file - promoters60/1009136
tttcaatt

SEQ ID NO: 89998 - DNA, 8 bp, Unknown
  misc_feature (1)..( 8): Result.001 file - promoters60/1009136
attcaatg

SEQ ID NO: 89999 - DNA, 8 bp, Unknown
  misc_feature (1)..( 8): Result.001 file - promoters60/1009136
ttttaatt

SEQ ID NO: 90000 - DNA, 8 bp, Unknown
  misc_feature (1)..( 8): Result.001 file - promoters60/1009136
attcaact

SEQ ID NO: 90001 - DNA, 11 bp, Unknown
  misc_feature (1)..( 11): Result.001 file - promoters60/1009136
taggaaataaa

SEQ ID NO: 90002 - DNA, 11 bp, Unknown
  misc_feature (1)..( 11): Result.001 file - promoters60/1009136
actaaaataac

SEQ ID NO: 90003 - DNA, 11 bp, Unknown
  misc_feature (1)..( 11): Result.001 file - promoters60/1009136
acagaaataaa

SEQ ID NO: 90004 - DNA, 11 bp, Unknown
  misc_feature (1)..( 11): Result.001 file - promoters60/1009146
acacaaatatg

SEQ ID NO: 90005 - DNA, 8 bp, Unknown
  misc_feature (1)..( 8): Result.001 file - promoters60/1009146
caaatttt

SEQ ID NO: 90006 - DNA, 8 bp, Unknown
  misc_feature (1)..( 8): Result.001 file - promoters60/1009146
caattttt

SEQ ID NO: 90007 - DNA, 7 bp, Unknown
  misc_feature (1)..( 7): Result.001 file - promoters60/1009146
agacaag

SEQ ID NO: 90008 - DNA, 7 bp, Unknown
  misc_feature (1)..( 7): Result.001 file - promoters60/1009146
agagaag

SEQ ID NO: 90009 - DNA, 8 bp, Unknown
  misc_feature (1)..( 8): Result.001 file - promoters60/1009146
aaagcgac

SEQ ID NO: 90010 - DNA, 8 bp, Unknown
  misc_feature (1)..( 8): Result.001 file - promoters60/1009146
aaagtgac

SEQ ID NO: 90011 - DNA, 8 bp, Unknown
  misc_feature (1)..( 8): Result.001 file - promoters60/1009146
aggggaat

SEQ ID NO: 90012 - DNA, 8 bp, Unknown
  misc_feature (1)..( 8): Result.001 file - promoters60/1009146
aggtgaat

SEQ ID NO: 90013 - DNA, 7 bp, Unknown
  misc_feature (1)..( 7): Result.001 file - promoters60/1009146
gtttttg

SEQ ID NO: 90014 - DNA, 7 bp, Unknown
  misc_feature (1)..( 7): Result.001 file - promoters60/1009146
gttcttg

SEQ ID NO: 90015 - DNA, 13 bp, Unknown
  misc_feature (1)..( 13): Result.001 file - promoters60/1009146
ttgaatcaatatt

SEQ ID NO: 90016 - DNA, 13 bp, Unknown
  misc_feature (1)..( 13): Result.001 file - promoters60/1009146
ttgattcaaaatt

SEQ ID NO: 90017 - DNA, 7 bp, Unknown
  misc_feature (1)..( 7): Result.001 file - promoters60/1009146
tggattt

SEQ ID NO: 90018 - DNA, 7 bp, Unknown
  misc_feature (1)..( 7): Result.001 file - promoters60/1009146
tggattt

SEQ ID NO: 90019 - DNA, 6 bp, Unknown
  misc_feature (1)..( 6): Result.001 file - promoters60/1009146
aagatt

SEQ ID NO: 90020 - DNA, 6 bp, Unknown
  misc_feature (1)..( 6): Result.001 file - promoters60/1009146
aagatt

SEQ ID NO: 90021 - DNA, 6 bp, Unknown
  misc_feature (1)..( 6): Result.001 file - promoters60/1009146
ttggtt

SEQ ID NO: 90022 - DNA, 6 bp, Unknown
  misc_feature (1)..( 6): Result.001 file - promoters60/1009146
ttggtt

SEQ ID NO: 90023 - DNA, 6 bp, Unknown
  misc_feature (1)..( 6): Result.001 file - promoters60/1009146
ttaacc

SEQ ID NO: 90024 - DNA, 6 bp, Unknown
  misc_feature (1)..( 6): Result.001 file - promoters60/1009146
ttaacc

SEQ ID NO: 90025 - DNA, 7 bp, Unknown
  misc_feature (1)..( 7): Result.001 file - promoters60/1009146
ctcactc

SEQ ID NO: 90026 - DNA, 7 bp, Unknown
  misc_feature (1)..( 7): Result.001 file - promoters60/1009146
ctcgctc

SEQ ID NO: 90027 - DNA, 6 bp, Unknown
  misc_feature (1)..( 6): Result.001 file - promoters60/1009146
atttct

SEQ ID NO: 90028 - DNA, 6 bp, Unknown
  misc_feature (1)..( 6): Result.001 file - promoters60/1009211
atttct

SEQ ID NO: 90029 - DNA, 15 bp, Unknown
  misc_feature (1)..( 15): Result.001 file - promoters60/1009211
acaatgggctgggcc

SEQ ID NO: 90030 - DNA, 15 bp, Unknown
  misc_feature (1)..( 15): Result.001 file - promoters60/1009211
attttgggcttctta

SEQ ID NO: 90031 - DNA, 15 bp, Unknown
  misc_feature (1)..( 15): Result.001 file - promoters60/1009211
taattgggcttttta

SEQ ID NO: 90032 - DNA, 15 bp, Unknown
  misc_feature (1)..( 15): Result.001 file - promoters60/1009211
tgattggggttacaa

SEQ ID NO: 90033 - DNA, 15 bp, Unknown
  misc_feature (1)..( 15): Result.001 file - promoters60/1009211
caattgggattattt

SEQ ID NO: 90034 - DNA, 16 bp, Unknown
  misc_feature (1)..( 16): Result.001 file - promoters60/1009234
tgattgtggtaaaaag

SEQ ID NO: 90035 - DNA, 12 bp, Unknown
  misc_feature (1)..( 12): Result.001 file - promoters60/1009234
ttaaatgaagat

SEQ ID NO: 90036 - DNA, 12 bp, Unknown
  misc_feature (1)..( 12): Result.001 file - promoters60/1009234
aataatgatgat

SEQ ID NO: 90037 - DNA, 12 bp, Unknown
  misc_feature (1)..( 12): Result.001 file - promoters60/1009234
gacaatgaattg

SEQ ID NO: 90038 - DNA, 12 bp, Unknown
  misc_feature (1)..( 12): Result.001 file - promoters60/1009234
ttacatgaacag

SEQ ID NO: 90039 - DNA, 7 bp, Unknown
  misc_feature (1)..( 7): Result.001 file - promoters60/1009234
caagtat

SEQ ID NO: 90040 - DNA, 7 bp, Unknown
  misc_feature (1)..( 7): Result.001 file - promoters60/1009234
caaatat

SEQ ID NO: 90041 - DNA, 7 bp, Unknown
  misc_feature (1)..( 7): Result.001 file - promoters60/1009234
caaatag

SEQ ID NO: 90042 - DNA, 7 bp, Unknown
  misc_feature (1)..( 7): Result.001 file - promoters60/1009354
caattag

SEQ ID NO: 90043 - DNA, 9 bp, Unknown
  misc_feature (1)..( 9): Result.001 file - promoters60/1009354
attgaaata

SEQ ID NO: 90044 - DNA, 9 bp, Unknown
  misc_feature (1)..( 9): Result.001 file - promoters60/1009354
atttaaata

SEQ ID NO: 90045 - DNA, 6 bp, Unknown
  misc_feature (1)..( 6): Result.001 file - promoters60/1009354
ttattt

SEQ ID NO: 90046 - DNA, 6 bp, Unknown
  misc_feature (1)..( 6): Result.001 file - promoters60/1009354
ttattt

SEQ ID NO: 90047 - DNA, 6 bp, Unknown
  misc_feature (1)..( 6): Result.001 file - promoters60/1009354
ataatt

SEQ ID NO: 90048 - DNA, 6 bp, Unknown
  misc_feature (1)..( 6): Result.001 file - promoters60/1009354
ataatt

SEQ ID NO: 90049 - DNA, 8 bp, Unknown
  misc_feature (1)..( 8): Result.001 file - promoters60/1009354
taagaact

SEQ ID NO: 90050 - DNA, 8 bp, Unknown
  misc_feature (1)..( 8): Result.001 file - promoters60/1009354
taagaaat

SEQ ID NO: 90051 - DNA, 8 bp, Unknown
  misc_feature (1)..( 8): Result.001 file - promoters60/1009354
gaagaact

SEQ ID NO: 90052 - DNA, 7 bp, Unknown
  misc_feature (1)..( 7): Result.001 file - promoters60/1009354
accgtct

SEQ ID NO: 90053 - DNA, 7 bp, Unknown
  misc_feature (1)..( 7): Result.001 file - promoters60/1009354
accctct

SEQ ID NO: 90054 - DNA, 6 bp, Unknown
  misc_feature (1)..( 6): Result.001 file - promoters60/1009354
ttaaat

SEQ ID NO: 90055 - DNA, 6 bp, Unknown
  misc_feature (1)..( 6): Result.001 file - promoters60/1009354
ttaaat

SEQ ID NO: 90056 - DNA, 6 bp, Unknown
  misc_feature (1)..( 6): Result.001 file - promoters60/1009354
ttttgt

SEQ ID NO: 90057 - DNA, 6 bp, Unknown
  misc_feature (1)..( 6): Result.001 file - promoters60/1009354
ttttgt

SEQ ID NO: 90058 - DNA, 6 bp, Unknown
  misc_feature (1)..( 6): Result.001 file - promoters60/1009354
agtaat

SEQ ID NO: 90059 - DNA, 6 bp, Unknown
  misc_feature (1)..( 6): Result.001 file - promoters60/1009354
agtaat

SEQ ID NO: 90060 - DNA, 6 bp, Unknown
  misc_feature (1)..( 6): Result.001 file - promoters60/1009354
atagag

SEQ ID NO: 90061 - DNA, 6 bp, Unknown
  misc_feature (1)..( 6): Result.001 file - promoters60/1009354
atagag

SEQ ID NO: 90062 - DNA, 7 bp, Unknown
  misc_feature (1)..( 7): Result.001 file - promoters60/1009354
atgtggc

SEQ ID NO: 90063 - DNA, 7 bp, Unknown
  misc_feature (1)..( 7): Result.001 file - promoters60/1009354
atgtggc

SEQ ID NO: 90064 - DNA, 7 bp, Unknown
  misc_feature (1)..( 7): Result.001 file - promoters60/1009354
gatactt

SEQ ID NO: 90065 - DNA, 7 bp, Unknown
  misc_feature (1)..( 7): Result.001 file - promoters60/1009354
gattctt

SEQ ID NO: 90066 - DNA, 7 bp, Unknown
  misc_feature (1)..( 7): Result.001 file - promoters60/1009354
gattcta

SEQ ID NO: 90067 - DNA, 9 bp, Unknown
  misc_feature (1)..( 9): Result.001 file - promoters60/1009354
aatgaagat

SEQ ID NO: 90068 - DNA, 9 bp, Unknown
  misc_feature (1)..( 9): Result.001 file - promoters60/1009354
aatgatgat

SEQ ID NO: 90069 - DNA, 7 bp, Unknown
  misc_feature (1)..( 7): Result.001 file - promoters60/1009354
acacgtc

SEQ ID NO: 90070 - DNA, 7 bp, Unknown
  misc_feature (1)..( 7): Result.001 file - promoters60/1009354
acatgtc

SEQ ID NO: 90071 - DNA, 8 bp, Unknown
  misc_feature (1)..( 8): Result.001 file - promoters60/1009354
gtgatcca

SEQ ID NO: 90072 - DNA, 8 bp, Unknown
  misc_feature (1)..( 8): Result.001 file - promoters60/1009354
gtggtcca

SEQ ID NO: 90073 - DNA, 6 bp, Unknown
  misc_feature (1)..( 6): Result.001 file - promoters60/1009354
aaactt

SEQ ID NO: 90074 - DNA, 6 bp, Unknown
  misc_feature (1)..( 6): Result.001 file - promoters60/1009354
aaactt

SEQ ID NO: 90075 - DNA, 7 bp, Unknown
  misc_feature (1)..( 7): Result.001 file - promoters60/1009354
ttctaaa

SEQ ID NO: 90076 - DNA, 7 bp, Unknown
  misc_feature (1)..( 7): Result.001 file - promoters60/1009354
ttcaaaa

SEQ ID NO: 90077 - DNA, 6 bp, Unknown
  misc_feature (1)..( 6): Result.001 file - promoters60/1009354
taagaa

SEQ ID NO: 90078 - DNA, 6 bp, Unknown
  misc_feature (1)..( 6): Result.001 file - promoters60/1009354
taagaa

SEQ ID NO: 90079 - DNA, 8 bp, Unknown
  misc_feature (1)..( 8): Result.001 file - promoters60/1009354
gaaaatct

SEQ ID NO: 90080 - DNA, 8 bp, Unknown
  misc_feature (1)..( 8): Result.001 file - promoters60/1009354
gaagatct

SEQ ID NO: 90081 - DNA, 6 bp, Unknown
  misc_feature (1)..( 6): Result.001 file - promoters60/1009354
ttgtca

SEQ ID NO: 90082 - DNA, 6 bp, Unknown
  misc_feature (1)..( 6): Result.001 file - promoters60/1009354
ttgtca

SEQ ID NO: 90083 - DNA, 8 bp, Unknown
  misc_feature (1)..( 8): Result.001 file - promoters60/1009354
cataagta

SEQ ID NO: 90084 - DNA, 8 bp, Unknown
  misc_feature (1)..( 8): Result.001 file - promoters60/1009354
cattagta

SEQ ID NO: 90085 - DNA, 8 bp, Unknown
  misc_feature (1)..( 8): Result.001 file - promoters60/1009354
ggtgtata

SEQ ID NO: 90086 - DNA, 8 bp, Unknown
  misc_feature (1)..( 8): Result.001 file - promoters60/1009354
ggtggata

SEQ ID NO: 90087 - DNA, 7 bp, Unknown
  misc_feature (1)..( 7): Result.001 file - promoters60/1009354
cacacgt

SEQ ID NO: 90088 - DNA, 7 bp, Unknown
  misc_feature (1)..( 7): Result.001 file - promoters60/1009354
cacacgt

SEQ ID NO: 90089 - DNA, 13 bp, Unknown
  misc_feature (1)..( 13): Result.001 file - promoters60/1009354
taaccaaagattc

SEQ ID NO: 90090 - DNA, 13 bp, Unknown
  misc_feature (1)..( 13): Result.001 file - promoters60/1009430
taatcaaaaattc

SEQ ID NO: 90091 - DNA, 10 bp, Unknown
  misc_feature (1)..( 10): Result.001 file - promoters60/1009430
attttatata

SEQ ID NO: 90092 - DNA, 10 bp, Unknown
  misc_feature (1)..( 10): Result.001 file - promoters60/1009430
ctcttaaata

SEQ ID NO: 90093 - DNA, 10 bp, Unknown
  misc_feature (1)..( 10): Result.001 file - promoters60/1009430
ctctgaaaca

SEQ ID NO: 90094 - DNA, 10 bp, Unknown
  misc_feature (1)..( 10): Result.001 file - promoters60/1009430
agacaatttt

SEQ ID NO: 90095 - DNA, 10 bp, Unknown
  misc_feature (1)..( 10): Result.001 file - promoters60/1009430
agaaaatttc

SEQ ID NO: 90096 - DNA, 10 bp, Unknown
  misc_feature (1)..( 10): Result.001 file - promoters60/1009430
aaaaaaattc

SEQ ID NO: 90097 - DNA, 10 bp, Unknown
  misc_feature (1)..( 10): Result.001 file - promoters60/1009430
ttcaaagttc

SEQ ID NO: 90098 - DNA, 8 bp, Unknown
  misc_feature (1)..( 8): Result.001 file - promoters60/1009430
cttcttct

SEQ ID NO: 90099 - DNA, 8 bp, Unknown
  misc_feature (1)..( 8): Result.001 file - promoters60/1009430
cttcctct

SEQ ID NO: 90100 - DNA, 8 bp, Unknown
  misc_feature (1)..( 8): Result.001 file - promoters60/1009616
attcatct

SEQ ID NO: 90101 - DNA, 10 bp, Unknown
  misc_feature (1)..( 10): Result.001 file - promoters60/1009616
ttaaacaaaa

SEQ ID NO: 90102 - DNA, 10 bp, Unknown
  misc_feature (1)..( 10): Result.001 file - promoters60/1009616
ctaaacaaaa

SEQ ID NO: 90103 - DNA, 10 bp, Unknown
  misc_feature (1)..( 10): Result.001 file - promoters60/1009616
gtaaccaaat

SEQ ID NO: 90104 - DNA, 10 bp, Unknown
  misc_feature (1)..( 10): Result.001 file - promoters60/1009616
tcaaacacta

SEQ ID NO: 90105 - DNA, 10 bp, Unknown
  misc_feature (1)..( 10): Result.001 file - promoters60/1009616
ctagacagag

SEQ ID NO: 90106 - DNA, 9 bp, Unknown
  misc_feature (1)..( 9): Result.001 file - promoters60/1009616
gaaaacaat

SEQ ID NO: 90107 - DNA, 9 bp, Unknown
  misc_feature (1)..( 9): Result.001 file - promoters60/1009616
gaatacaat

SEQ ID NO: 90108 - DNA, 9 bp, Unknown
  misc_feature (1)..( 9): Result.001 file - promoters60/1009616
taatacaaa

SEQ ID NO: 90109 - DNA, 9 bp, Unknown
  misc_feature (1)..( 9): Result.001 file - promoters60/1009616
taacacaga

SEQ ID NO: 90110 - DNA, 14 bp, Unknown
  misc_feature (1)..( 14): Result.001 file - promoters60/1009616
aaagtataaacaca

SEQ ID NO: 90111 - DNA, 14 bp, Unknown
  misc_feature (1)..( 14): Result.001 file - promoters60/1009616
tatatattaacaca

SEQ ID NO: 90112 - DNA, 14 bp, Unknown
  misc_feature (1)..( 14): Result.001 file - promoters60/1009616
aaagtctaatacaa

SEQ ID NO: 90113 - DNA, 14 bp, Unknown
  misc_feature (1)..( 14): Result.001 file - promoters60/1009616
accaaatatacaaa

SEQ ID NO: 90114 - DNA, 14 bp, Unknown
  misc_feature (1)..( 14): Result.001 file - promoters60/1009616
aaaatctacgcata

SEQ ID NO: 90115 - DNA, 13 bp, Unknown
  misc_feature (1)..( 13): Result.001 file - promoters60/1009616
attattatgcatg

SEQ ID NO: 90116 - DNA, 13 bp, Unknown
  misc_feature (1)..( 13): Result.001 file - promoters60/1009616
tttataatgcaaa

SEQ ID NO: 90117 - DNA, 13 bp, Unknown
  misc_feature (1)..( 13): Result.001 file - promoters60/1009616
attactatttcaa

SEQ ID NO: 90118 - DNA, 13 bp, Unknown
  misc_feature (1)..( 13): Result.001 file - promoters60/1009616
atagaaatgaaaa

SEQ ID NO: 90119 - DNA, 20 bp, Unknown
  misc_feature (1)..( 20): Result.001 file - promoters60/1009616
acactaaaatagtttttttt

SEQ ID NO: 90120 - DNA, 20 bp, Unknown
  misc_feature (1)..( 20): Result.001 file - promoters60/1009616
acacttaaaaagtctttttt

SEQ ID NO: 90121 - DNA, 20 bp, Unknown
  misc_feature (1)..( 20): Result.001 file - promoters60/1009616
tgagatcaaaagtgaaaaca

SEQ ID NO: 90122 - DNA, 20 bp, Unknown
  misc_feature (1)..( 20): Result.001 file - promoters60/1009686
aaaattaaaaagaatacaaa

SEQ ID NO: 90123 - DNA, 7 bp, Unknown
  misc_feature (1)..( 7): Result.001 file - promoters60/1009686
tatgttt

SEQ ID NO: 90124 - DNA, 7 bp, Unknown
  misc_feature (1)..( 7): Result.001 file - promoters60/1009686
tattttt

SEQ ID NO: 90125 - DNA, 7 bp, Unknown
  misc_feature (1)..( 7): Result.001 file - promoters60/1009686
aaagttg

SEQ ID NO: 90126 - DNA, 7 bp, Unknown
  misc_feature (1)..( 7): Result.001 file - promoters60/1009686
aaatttg

SEQ ID NO: 90127 - DNA, 7 bp, Unknown
  misc_feature (1)..( 7): Result.001 file - promoters60/1009686
ttacata

SEQ ID NO: 90128 - DNA, 7 bp, Unknown
  misc_feature (1)..( 7): Result.001 file - promoters60/1009686
ttatata

SEQ ID NO: 90129 - DNA, 7 bp, Unknown
  misc_feature (1)..( 7): Result.001 file - promoters60/1009686
tagttaa

SEQ ID NO: 90130 - DNA, 7 bp, Unknown
  misc_feature (1)..( 7): Result.001 file - promoters60/1009686
tagttaa

SEQ ID NO: 90131 - DNA, 6 bp, Unknown
  misc_feature (1)..( 6): Result.001 file - promoters60/1009686
tgaaaa

SEQ ID NO: 90132 - DNA, 6 bp, Unknown
  misc_feature (1)..( 6): Result.001 file - promoters60/1009686
tgaaaa

SEQ ID NO: 90133 - DNA, 6 bp, Unknown
  misc_feature (1)..( 6): Result.001 file - promoters60/1009686
taaagt

SEQ ID NO: 90134 - DNA, 6 bp, Unknown
  misc_feature (1)..( 6): Result.001 file - promoters60/1009686
taaagt

SEQ ID NO: 90135 - DNA, 6 bp, Unknown
  misc_feature (1)..( 6): Result.001 file - promoters60/1009686
taattt

SEQ ID NO: 90136 - DNA, 6 bp, Unknown
  misc_feature (1)..( 6): Result.001 file - promoters60/1009686
taattt

SEQ ID NO: 90137 - DNA, 7 bp, Unknown
  misc_feature (1)..( 7): Result.001 file - promoters60/1009686
ttatgaa

SEQ ID NO: 90138 - DNA, 7 bp, Unknown
  misc_feature (1)..( 7): Result.001 file - promoters60/1009686
ttacgaa

SEQ ID NO: 90139 - DNA, 8 bp, Unknown
  misc_feature (1)..( 8): Result.001 file - promoters60/1009686
attcagtt

SEQ ID NO: 90140 - DNA, 8 bp, Unknown
  misc_feature (1)..( 8): Result.001 file - promoters60/1009686
attaagtc

SEQ ID NO: 90141 - DNA, 8 bp, Unknown
  misc_feature (1)..( 8): Result.001 file - promoters60/1009686
gttaagtc

SEQ ID NO: 90142 - DNA, 9 bp, Unknown
  misc_feature (1)..( 9): Result.001 file - promoters60/1009686
aattaaaaa

SEQ ID NO: 90143 - DNA, 9 bp, Unknown
  misc_feature (1)..( 9): Result.001 file - promoters60/1009686
aatcaaaaa

SEQ ID NO: 90144 - DNA, 9 bp, Unknown
  misc_feature (1)..( 9): Result.001 file - promoters60/1009686
aaacaatta

SEQ ID NO: 90145 - DNA, 9 bp, Unknown
  misc_feature (1)..( 9): Result.001 file - promoters60/1009686
aaataatta

SEQ ID NO: 90146 - DNA, 7 bp, Unknown
  misc_feature (1)..( 7): Result.001 file - promoters60/1009686
agtagtt

SEQ ID NO: 90147 - DNA, 7 bp, Unknown
  misc_feature (1)..( 7): Result.001 file - promoters60/1009686
agtggtt

SEQ ID NO: 90148 - DNA, 7 bp, Unknown
  misc_feature (1)..( 7): Result.001 file - promoters60/1009686
ctttctt

SEQ ID NO: 90149 - DNA, 7 bp, Unknown
  misc_feature (1)..( 7): Result.001 file - promoters60/1009686
cttcctt

SEQ ID NO: 90150 - DNA, 6 bp, Unknown
  misc_feature (1)..( 6): Result.001 file - promoters60/1009686
tttaca

SEQ ID NO: 90151 - DNA, 6 bp, Unknown
  misc_feature (1)..( 6): Result.001 file - promoters60/1009686
tttaca

SEQ ID NO: 90152 - DNA, 7 bp, Unknown
  misc_feature (1)..( 7): Result.001 file - promoters60/1009686
aataagg

SEQ ID NO: 90153 - DNA, 7 bp, Unknown
  misc_feature (1)..( 7): Result.001 file - promoters60/1009686
aattagg

SEQ ID NO: 90154 - DNA, 11 bp, Unknown
  misc_feature (1)..( 11): Result.001 file - promoters60/1009686
acagagaaata

SEQ ID NO: 90155 - DNA, 11 bp, Unknown
  misc_feature (1)..( 11): Result.001 file - promoters60/1009686
acaaagagata

SEQ ID NO: 90156 - DNA, 6 bp, Unknown
  misc_feature (1)..( 6): Result.001 file - promoters60/1009686
tcaaaa

SEQ ID NO: 90157 - DNA, 6 bp, Unknown
  misc_feature (1)..( 6): Result.001 file - promoters60/1009686
tcaaaa

SEQ ID NO: 90158 - DNA, 8 bp, Unknown
  misc_feature (1)..( 8): Result.001 file - promoters60/1009686
aagaggaa

SEQ ID NO: 90159 - DNA, 8 bp, Unknown
  misc_feature (1)..( 8): Result.001 file - promoters60/1009686
aagaagaa

SEQ ID NO: 90160 - DNA, 8 bp, Unknown
  misc_feature (1)..( 8): Result.001 file - promoters60/1009686
aagaggag

SEQ ID NO: 90161 - DNA, 8 bp, Unknown
  misc_feature (1)..( 8): Result.001 file - promoters60/1009752
aagcggag

SEQ ID NO: 90162 - DNA, 8 bp, Unknown
  misc_feature (1)..( 8): Result.001 file - promoters60/1009752
atttgaat

SEQ ID NO: 90163 - DNA, 8 bp, Unknown
  misc_feature (1)..( 8): Result.001 file - promoters60/1009752
atttcaat

SEQ ID NO: 90164 - DNA, 8 bp, Unknown
  misc_feature (1)..( 8): Result.001 file - promoters60/1009752
ttatttta

SEQ ID NO: 90165 - DNA, 8 bp, Unknown
  misc_feature (1)..( 8): Result.001 file - promoters60/1009752
atatttta

SEQ ID NO: 90166 - DNA, 8 bp, Unknown
  misc_feature (1)..( 8): Result.001 file - promoters60/1009752
ttaattta

SEQ ID NO: 90167 - DNA, 7 bp, Unknown
  misc_feature (1)..( 7): Result.001 file - promoters60/1009752
aaaaaat

SEQ ID NO: 90168 - DNA, 7 bp, Unknown
  misc_feature (1)..( 7): Result.001 file - promoters60/1009752
aaagaat

SEQ ID NO: 90169 - DNA, 6 bp, Unknown
  misc_feature (1)..( 6): Result.001 file - promoters60/1009752
aattag

SEQ ID NO: 90170 - DNA, 6 bp, Unknown
  misc_feature (1)..( 6): Result.001 file - promoters60/1009752
aattag

SEQ ID NO: 90171 - DNA, 8 bp, Unknown
  misc_feature (1)..( 8): Result.001 file - promoters60/1009752
aggatgtt

SEQ ID NO: 90172 - DNA, 8 bp, Unknown
  misc_feature (1)..( 8): Result.001 file - promoters60/1009752
aggttgtt

SEQ ID NO: 90173 - DNA, 6 bp, Unknown
  misc_feature (1)..( 6): Result.001 file - promoters60/1009752
taaacg

SEQ ID NO: 90174 - DNA, 6 bp, Unknown
  misc_feature (1)..( 6): Result.001 file - promoters60/1009752
taaacg

SEQ ID NO: 90175 - DNA, 6 bp, Unknown
  misc_feature (1)..( 6): Result.001 file - promoters60/1009752
ttaatt

SEQ ID NO: 90176 - DNA, 6 bp, Unknown
  misc_feature (1)..( 6): Result.001 file - promoters60/1009752
ttaatt

SEQ ID NO: 90177 - DNA, 7 bp, Unknown
  misc_feature (1)..( 7): Result.001 file - promoters60/1009752
taaaaat

SEQ ID NO: 90178 - DNA, 7 bp, Unknown
  misc_feature (1)..( 7): Result.001 file - promoters60/1009752
taacaat

SEQ ID NO: 90179 - DNA, 7 bp, Unknown
  misc_feature (1)..( 7): Result.001 file - promoters60/1009752
taacaac

SEQ ID NO: 90180 - DNA, 6 bp, Unknown
  misc_feature (1)..( 6): Result.001 file - promoters60/1009752
aaataa

SEQ ID NO: 90181 - DNA, 6 bp, Unknown
  misc_feature (1)..( 6): Result.001 file - promoters60/1009752
aaataa

SEQ ID NO: 90182 - DNA, 7 bp, Unknown
  misc_feature (1)..( 7): Result.001 file - promoters60/1009752
tttccct

SEQ ID NO: 90183 - DNA, 7 bp, Unknown
  misc_feature (1)..( 7): Result.001 file - promoters60/1009752
ttttcct

SEQ ID NO: 90184 - DNA, 6 bp, Unknown
  misc_feature (1)..( 6): Result.001 file - promoters60/1009752
tatttt

SEQ ID NO: 90185 - DNA, 6 bp, Unknown
  misc_feature (1)..( 6): Result.001 file - promoters60/1009752
tatttt

SEQ ID NO: 90186 - DNA, 6 bp, Unknown
  misc_feature (1)..( 6): Result.001 file - promoters60/1009752
atttaa

SEQ ID NO: 90187 - DNA, 6 bp, Unknown
  misc_feature (1)..( 6): Result.001 file - promoters60/1009752
atttaa

SEQ ID NO: 90188 - DNA, 6 bp, Unknown
  misc_feature (1)..( 6): Result.001 file - promoters60/1009752
taatta

SEQ ID NO: 90189 - DNA, 6 bp, Unknown
  misc_feature (1)..( 6): Result.001 file - promoters60/1009752
taatta

SEQ ID NO: 90190 - DNA, 7 bp, Unknown
  misc_feature (1)..( 7): Result.001 file - promoters60/1009752
gatgata

SEQ ID NO: 90191 - DNA, 7 bp, Unknown
  misc_feature (1)..( 7): Result.001 file - promoters60/1009752
gataata

SEQ ID NO: 90192 - DNA, 7 bp, Unknown
  misc_feature (1)..( 7): Result.001 file - promoters60/1009752
ttaaaaa

SEQ ID NO: 90193 - DNA, 7 bp, Unknown
  misc_feature (1)..( 7): Result.001 file - promoters60/1009752
ttacaaa

SEQ ID NO: 90194 - DNA, 6 bp, Unknown
  misc_feature (1)..( 6): Result.001 file - promoters60/1009752
aataaa

SEQ ID NO: 90195 - DNA, 6 bp, Unknown
  misc_feature (1)..( 6): Result.001 file - promoters60/1009752
aataaa

SEQ ID NO: 90196 - DNA, 7 bp, Unknown
  misc_feature (1)..( 7): Result.001 file - promoters60/1009752
tcctata

SEQ ID NO: 90197 - DNA, 7 bp, Unknown
  misc_feature (1)..( 7): Result.001 file - promoters60/1009834
tcctata

SEQ ID NO: 90198 - DNA, 9 bp, Unknown
  misc_feature (1)..( 9): Result.001 file - promoters60/1009834
aaggaaaga

SEQ ID NO: 90199 - DNA, 9 bp, Unknown
  misc_feature (1)..( 9): Result.001 file - promoters60/1009834
aagaaaaga

SEQ ID NO: 90200 - DNA, 7 bp, Unknown
  misc_feature (1)..( 7): Result.001 file - promoters60/1009834
ttttttc

SEQ ID NO: 90201 - DNA, 7 bp, Unknown
  misc_feature (1)..( 7): Result.001 file - promoters60/1009834
tttattc

SEQ ID NO: 90202 - DNA, 11 bp, Unknown
  misc_feature (1)..( 11): Result.001 file - promoters60/1009834
atattttggag

SEQ ID NO: 90203 - DNA, 11 bp, Unknown
  misc_feature (1)..( 11): Result.001 file - promoters60/1009834
atatttttgag

SEQ ID NO: 90204 - DNA, 7 bp, Unknown
  misc_feature (1)..( 7): Result.001 file - promoters60/1009834
ttcatta

SEQ ID NO: 90205 - DNA, 7 bp, Unknown
  misc_feature (1)..( 7): Result.001 file - promoters60/1009834
ttcttta

SEQ ID NO: 90206 - DNA, 7 bp, Unknown
  misc_feature (1)..( 7): Result.001 file - promoters60/1009834
aaacatt

SEQ ID NO: 90207 - DNA, 7 bp, Unknown
  misc_feature (1)..( 7): Result.001 file - promoters60/1009834
aaaaatt

SEQ ID NO: 90208 - DNA, 7 bp, Unknown
  misc_feature (1)..( 7): Result.001 file - promoters60/1009834
aaaaatt

SEQ ID NO: 90209 - DNA, 9 bp, Unknown
  misc_feature (1)..( 9): Result.001 file - promoters60/1009834
aaaaagagt

SEQ ID NO: 90210 - DNA, 9 bp, Unknown
  misc_feature (1)..( 9): Result.001 file - promoters60/1009834
aaaaaaagt

SEQ ID NO: 90211 - DNA, 7 bp, Unknown
  misc_feature (1)..( 7): Result.001 file - promoters60/1009834
gaaacaa

SEQ ID NO: 90212 - DNA, 7 bp, Unknown
  misc_feature (1)..( 7): Result.001 file - promoters60/1009834
gaaacaa

SEQ ID NO: 90213 - DNA, 8 bp, Unknown
  misc_feature (1)..( 8): Result.001 file - promoters60/1009834
ttacaata

SEQ ID NO: 90214 - DNA, 8 bp, Unknown
  misc_feature (1)..( 8): Result.001 file - promoters60/1009834
ttagaata

SEQ ID NO: 90215 - DNA, 9 bp, Unknown
  misc_feature (1)..( 9): Result.001 file - promoters60/1009834
atttgtttt

SEQ ID NO: 90216 - DNA, 9 bp, Unknown
  misc_feature (1)..( 9): Result.001 file - promoters60/1009834
attcgtttt

SEQ ID NO: 90217 - DNA, 7 bp, Unknown
  misc_feature (1)..( 7): Result.001 file - promoters60/1009834
tccgatt

SEQ ID NO: 90218 - DNA, 7 bp, Unknown
  misc_feature (1)..( 7): Result.001 file - promoters60/1009834
tcccatt

SEQ ID NO: 90219 - DNA, 7 bp, Unknown
  misc_feature (1)..( 7): Result.001 file - promoters60/1009834
attgttt

SEQ ID NO: 90220 - DNA, 7 bp, Unknown
  misc_feature (1)..( 7): Result.001 file - promoters60/1009834
atttttt

SEQ ID NO: 90221 - DNA, 6 bp, Unknown
  misc_feature (1)..( 6): Result.001 file - promoters60/1009834
tattaa

SEQ ID NO: 90222 - DNA, 6 bp, Unknown
  misc_feature (1)..( 6): Result.001 file - promoters60/1009834
tattaa

SEQ ID NO: 90223 - DNA, 6 bp, Unknown
  misc_feature (1)..( 6): Result.001 file - promoters60/1009834
taatat

SEQ ID NO: 90224 - DNA, 6 bp, Unknown
  misc_feature (1)..( 6): Result.001 file - promoters60/1009854
taatat

SEQ ID NO: 90225 - DNA, 13 bp, Unknown
  misc_feature (1)..( 13): Result.001 file - promoters60/1009854
attcattaacaaa

SEQ ID NO: 90226 - DNA, 13 bp, Unknown
  misc_feature (1)..( 13): Result.001 file - promoters60/1009854
attcataaaaaaa

SEQ ID NO: 90227 - DNA, 13 bp, Unknown
  misc_feature (1)..( 13): Result.001 file - promoters60/1009854
atttataaagaaa

SEQ ID NO: 90228 - DNA, 13 bp, Unknown
  misc_feature (1)..( 13): Result.001 file - promoters60/1009854
cagaaaaaagaaa

SEQ ID NO: 90229 - DNA, 8 bp, Unknown
  misc_feature (1)..( 8): Result.001 file - promoters60/1009854
taacaaat

SEQ ID NO: 90230 - DNA, 8 bp, Unknown
  misc_feature (1)..( 8): Result.001 file - promoters60/1009854
taaaaaaa

SEQ ID NO: 90231 - DNA, 8 bp, Unknown
  misc_feature (1)..( 8): Result.001 file - promoters60/1009854
gaaccaat

SEQ ID NO: 90232 - DNA, 8 bp, Unknown
  misc_feature (1)..( 8): Result.001 file - promoters60/1009854
gaaaaaag

SEQ ID NO: 90233 - DNA, 12 bp, Unknown
  misc_feature (1)..( 12): Result.001 file - promoters60/1009854
aactaattcaat

SEQ ID NO: 90234 - DNA, 12 bp, Unknown
  misc_feature (1)..( 12): Result.001 file - promoters60/1009854
gactaatgcaat

SEQ ID NO: 90235 - DNA, 12 bp, Unknown
  misc_feature (1)..( 12): Result.001 file - promoters60/1009854
aaccaatggttg

SEQ ID NO: 90236 - DNA, 13 bp, Unknown
  misc_feature (1)..( 13): Result.001 file - promoters60/1009854
atttctacaaaac

SEQ ID NO: 90237 - DNA, 13 bp, Unknown
  misc_feature (1)..( 13): Result.001 file - promoters60/1009854
attcctaaaaaat

SEQ ID NO: 90238 - DNA, 13 bp, Unknown
  misc_feature (1)..( 13): Result.001 file - promoters60/1009854
atggtcaaaaaag

SEQ ID NO: 90239 - DNA, 13 bp, Unknown
  misc_feature (1)..( 13): Result.001 file - promoters60/1009854
taaaataaatata

SEQ ID NO: 90240 - DNA, 10 bp, Unknown
  misc_feature (1)..( 10): Result.001 file - promoters60/1009854
aaataaaaca

SEQ ID NO: 90241 - DNA, 10 bp, Unknown
  misc_feature (1)..( 10): Result.001 file - promoters60/1009854
aaagaaaaca

SEQ ID NO: 90242 - DNA, 10 bp, Unknown
  misc_feature (1)..( 10): Result.001 file - promoters60/1009854
aaagaaagaa

SEQ ID NO: 90243 - DNA, 10 bp, Unknown
  misc_feature (1)..( 10): Result.001 file - promoters60/1009854
aaaaaaatct

SEQ ID NO: 90244 - DNA, 9 bp, Unknown
  misc_feature (1)..( 9): Result.001 file - promoters60/1009854
caaaacaaa

SEQ ID NO: 90245 - DNA, 9 bp, Unknown
  misc_feature (1)..( 9): Result.001 file - promoters60/1009854
caaatcaaa

SEQ ID NO: 90246 - DNA, 9 bp, Unknown
  misc_feature (1)..( 9): Result.001 file - promoters60/1009854
taaaacaat

SEQ ID NO: 90247 - DNA, 7 bp, Unknown
  misc_feature (1)..( 7): Result.001 file - promoters60/1009854
tattttg

SEQ ID NO: 90248 - DNA, 7 bp, Unknown
  misc_feature (1)..( 7): Result.001 file - promoters60/1009854
aattttg

SEQ ID NO: 90249 - DNA, 7 bp, Unknown
  misc_feature (1)..( 7): Result.001 file - promoters60/1009854
aatcttg

SEQ ID NO: 90250 - DNA, 9 bp, Unknown
  misc_feature (1)..( 9): Result.001 file - promoters60/1009854
tcatgttta

SEQ ID NO: 90251 - DNA, 9 bp, Unknown
  misc_feature (1)..( 9): Result.001 file - promoters60/1009854
ttttgttta

SEQ ID NO: 90252 - DNA, 9 bp, Unknown
  misc_feature (1)..( 9): Result.001 file - promoters60/1009854
ttttgtttc

SEQ ID NO: 90253 - DNA, 9 bp, Unknown
  misc_feature (1)..( 9): Result.001 file - promoters60/1009854
ctttgatta

SEQ ID NO: 90254 - DNA, 8 bp, Unknown
  misc_feature (1)..( 8): Result.001 file - promoters60/1009854
ttgaaatc

SEQ ID NO: 90255 - DNA, 8 bp, Unknown
  misc_feature (1)..( 8): Result.001 file - promoters60/1009854
ttgagatc

SEQ ID NO: 90256 - DNA, 8 bp, Unknown
  misc_feature (1)..( 8): Result.001 file - promoters60/1009854
atgagatg

SEQ ID NO: 90257 - DNA, 9 bp, Unknown
  misc_feature (1)..( 9): Result.001 file - promoters60/1009854
gaaatgatg

SEQ ID NO: 90258 - DNA, 9 bp, Unknown
  misc_feature (1)..( 9): Result.001 file - promoters60/1009854
gaaatgaag

SEQ ID NO: 90259 - DNA, 9 bp, Unknown
  misc_feature (1)..( 9): Result.001 file - promoters60/1009854
ctaatcaag

SEQ ID NO: 90260 - DNA, 8 bp, Unknown
  misc_feature (1)..( 8): Result.001 file - promoters60/1009854
aaacatat

SEQ ID NO: 90261 - DNA, 8 bp, Unknown
  misc_feature (1)..( 8): Result.001 file - promoters60/1009854
aaatatat

SEQ ID NO: 90262 - DNA, 8 bp, Unknown
  misc_feature (1)..( 8): Result.001 file - promoters60/1009854
aaaaatag

SEQ ID NO: 90263 - DNA, 12 bp, Unknown
  misc_feature (1)..( 12): Result.001 file - promoters60/1009854
tcatattacaat

SEQ ID NO: 90264 - DNA, 12 bp, Unknown
  misc_feature (1)..( 12): Result.001 file - promoters60/1009854
ttttattaaaat

SEQ ID NO: 90265 - DNA, 12 bp, Unknown
  misc_feature (1)..( 12): Result.001 file - promoters60/1009854
ttttcttaagtc

SEQ ID NO: 90266 - DNA, 9 bp, Unknown
  misc_feature (1)..( 9): Result.001 file - promoters60/1009854
ctttcacaa

SEQ ID NO: 90267 - DNA, 9 bp, Unknown
  misc_feature (1)..( 9): Result.001 file - promoters60/1009854
ttttgacaa

SEQ ID NO: 90268 - DNA, 9 bp, Unknown
  misc_feature (1)..( 9): Result.001 file - promoters60/1009854
ctttcataa

SEQ ID NO: 90269 - DNA, 9 bp, Unknown
  misc_feature (1)..( 9): Result.001 file - promoters60/1009854
aaataaatt

SEQ ID NO: 90270 - DNA, 9 bp, Unknown
  misc_feature (1)..( 9): Result.001 file - promoters60/1009854
aaaaaaaag

SEQ ID NO: 90271 - DNA, 10 bp, Unknown
  misc_feature (1)..( 10): Result.001 file - promoters60/1009854
aaattaaatt

SEQ ID NO: 90272 - DNA, 7 bp, Unknown
  misc_feature (1)..( 7): Result.001 file - promoters60/1009854
atataaa

SEQ ID NO: 90273 - DNA, 7 bp, Unknown
  misc_feature (1)..( 7): Result.001 file - promoters60/1009854
ctataaa

SEQ ID NO: 90274 - DNA, 7 bp, Unknown
  misc_feature (1)..( 7): Result.001 file - promoters60/1009861
ctataag

SEQ ID NO: 90275 - DNA, 6 bp, Unknown
  misc_feature (1)..( 6): Result.001 file - promoters60/1009861
aaagaa

SEQ ID NO: 90276 - DNA, 6 bp, Unknown
  misc_feature (1)..( 6): Result.001 file - promoters60/1009861
aaagaa

SEQ ID NO: 90277 - DNA, 8 bp, Unknown
  misc_feature (1)..( 8): Result.001 file - promoters60/1009861
attttaat

SEQ ID NO: 90278 - DNA, 8 bp, Unknown
  misc_feature (1)..( 8): Result.001 file - promoters60/1009861
attataat

SEQ ID NO: 90279 - DNA, 8 bp, Unknown
  misc_feature (1)..( 8): Result.001 file - promoters60/1009861
cttttaat

SEQ ID NO: 90280 - DNA, 6 bp, Unknown
  misc_feature (1)..( 6): Result.001 file - promoters60/1009861
aaccaa

SEQ ID NO: 90281 - DNA, 6 bp, Unknown
  misc_feature (1)..( 6): Result.001 file - promoters60/1009861
aaccaa

SEQ ID NO: 90282 - DNA, 6 bp, Unknown
  misc_feature (1)..( 6): Result.001 file - promoters60/1009861
aaaatt

SEQ ID NO: 90283 - DNA, 6 bp, Unknown
  misc_feature (1)..( 6): Result.001 file - promoters60/1009861
aaaatt

SEQ ID NO: 90284 - DNA, 6 bp, Unknown
  misc_feature (1)..( 6): Result.001 file - promoters60/1009861
aaaatt

SEQ ID NO: 90285 - DNA, 9 bp, Unknown
  misc_feature (1)..( 9): Result.001 file - promoters60/1009861
ttcaaattc

SEQ ID NO: 90286 - DNA, 9 bp, Unknown
  misc_feature (1)..( 9): Result.001 file - promoters60/1009861
ttcaaattt

SEQ ID NO: 90287 - DNA, 9 bp, Unknown
  misc_feature (1)..( 9): Result.001 file - promoters60/1009861
ttcaatttc

SEQ ID NO: 90288 - DNA, 8 bp, Unknown
  misc_feature (1)..( 8): Result.001 file - promoters60/1009861
ttagttgg

SEQ ID NO: 90289 - DNA, 8 bp, Unknown
  misc_feature (1)..( 8): Result.001 file - promoters60/1009861
ttagctgg

SEQ ID NO: 90290 - DNA, 9 bp, Unknown
  misc_feature (1)..( 9): Result.001 file - promoters60/1009861
agtaaaatg

SEQ ID NO: 90291 - DNA, 9 bp, Unknown
  misc_feature (1)..( 9): Result.001 file - promoters60/1009861
agtacaatg

SEQ ID NO: 90292 - DNA, 9 bp, Unknown
  misc_feature (1)..( 9): Result.001 file - promoters60/1009861
agtccaacc

SEQ ID NO: 90293 - DNA, 6 bp, Unknown
  misc_feature (1)..( 6): Result.001 file - promoters60/1009861
gaacat

SEQ ID NO: 90294 - DNA, 6 bp, Unknown
  misc_feature (1)..( 6): Result.001 file - promoters60/1009861
gaacat

SEQ ID NO: 90295 - DNA, 6 bp, Unknown
  misc_feature (1)..( 6): Result.001 file - promoters60/1009861
ttattt

SEQ ID NO: 90296 - DNA, 6 bp, Unknown
  misc_feature (1)..( 6): Result.001 file - promoters60/1009861
ttattt

SEQ ID NO: 90297 - DNA, 6 bp, Unknown
  misc_feature (1)..( 6): Result.001 file - promoters60/1009861
tctttt

SEQ ID NO: 90298 - DNA, 6 bp, Unknown
  misc_feature (1)..( 6): Result.001 file - promoters60/1009861
tctttt

SEQ ID NO: 90299 - DNA, 10 bp, Unknown
  misc_feature (1)..( 10): Result.001 file - promoters60/1009861
ttttcattca

SEQ ID NO: 90300 - DNA, 10 bp, Unknown
  misc_feature (1)..( 10): Result.001 file - promoters60/1009861
ttttaattaa

SEQ ID NO: 90301 - DNA, 10 bp, Unknown
  misc_feature (1)..( 10): Result.001 file - promoters60/1009861
acataattaa

SEQ ID NO: 90302 - DNA, 6 bp, Unknown
  misc_feature (1)..( 6): Result.001 file - promoters60/1009861
aatttc

SEQ ID NO: 90303 - DNA, 6 bp, Unknown
  misc_feature (1)..( 6): Result.001 file - promoters60/1009861
aatttc

SEQ ID NO: 90304 - DNA, 8 bp, Unknown
  misc_feature (1)..( 8): Result.001 file - promoters60/1009861
aaaatttc

SEQ ID NO: 90305 - DNA, 8 bp, Unknown
  misc_feature (1)..( 8): Result.001 file - promoters60/1009861
caaatttt

SEQ ID NO: 90306 - DNA, 7 bp, Unknown
  misc_feature (1)..( 7): Result.001 file - promoters60/1009861
tttaata

SEQ ID NO: 90307 - DNA, 7 bp, Unknown
  misc_feature (1)..( 7): Result.001 file - promoters60/1009861
tttaata

SEQ ID NO: 90308 - DNA, 7 bp, Unknown
  misc_feature (1)..( 7): Result.001 file - promoters60/1009861
caaaaac

SEQ ID NO: 90309 - DNA, 7 bp, Unknown
  misc_feature (1)..( 7): Result.001 file - promoters60/1009861
caaaaac

SEQ ID NO: 90310 - DNA, 8 bp, Unknown
  misc_feature (1)..( 8): Result.001 file - promoters60/1009861
aaaagcgc

SEQ ID NO: 90311 - DNA, 8 bp, Unknown
  misc_feature (1)..( 8): Result.001 file - promoters60/1009861
aaacgcgc

SEQ ID NO: 90312 - DNA, 8 bp, Unknown
  misc_feature (1)..( 8): Result.001 file - promoters60/1009861
tatacata

SEQ ID NO: 90313 - DNA, 8 bp, Unknown
  misc_feature (1)..( 8): Result.001 file - promoters60/1009861
tatatata

SEQ ID NO: 90314 - DNA, 7 bp, Unknown
  misc_feature (1)..( 7): Result.001 file - promoters60/1009861
aactgaa

SEQ ID NO: 90315 - DNA, 7 bp, Unknown
  misc_feature (1)..( 7): Result.001 file - promoters60/1009861
aaccgaa

SEQ ID NO: 90316 - DNA, 6 bp, Unknown
  misc_feature (1)..( 6): Result.001 file - promoters60/1009861
aatttt

SEQ ID NO: 90317 - DNA, 6 bp, Unknown
  misc_feature (1)..( 6): Result.001 file - promoters60/1009861
aatttt

SEQ ID NO: 90318 - DNA, 7 bp, Unknown
  misc_feature (1)..( 7): Result.001 file - promoters60/1009861
cataaac

SEQ ID NO: 90319 - DNA, 7 bp, Unknown
  misc_feature (1)..( 7): Result.001 file - promoters60/1009861
cataaac

SEQ ID NO: 90320 - DNA, 6 bp, Unknown
  misc_feature (1)..( 6): Result.001 file - promoters60/1009861
ctcctt

SEQ ID NO: 90321 - DNA, 6 bp, Unknown
  misc_feature (1)..( 6): Result.001 file - promoters60/1009861
ctcctt

SEQ ID NO: 90322 - DNA, 9 bp, Unknown
  misc_feature (1)..( 9): Result.001 file - promoters60/1009861
tttcaattt

SEQ ID NO: 90323 - DNA, 9 bp, Unknown
  misc_feature (1)..( 9): Result.001 file - promoters60/1009861
tttcatttt

SEQ ID NO: 90324 - DNA, 7 bp, Unknown
  misc_feature (1)..( 7): Result.001 file - promoters60/1009861
tttctct

SEQ ID NO: 90325 - DNA, 7 bp, Unknown
  misc_feature (1)..( 7): Result.001 file - promoters60/1009861
tttgtct

SEQ ID NO: 90326 - DNA, 6 bp, Unknown
  misc_feature (1)..( 6): Result.001 file - promoters60/1009861
taacat

SEQ ID NO: 90327 - DNA, 6 bp, Unknown
  misc_feature (1)..( 6): Result.001 file - promoters60/1009861
taacat

SEQ ID NO: 90328 - DNA, 6 bp, Unknown
  misc_feature (1)..( 6): Result.001 file - promoters60/1009861
ttttta

SEQ ID NO: 90329 - DNA, 6 bp, Unknown
  misc_feature (1)..( 6): Result.001 file - promoters60/1009861
ttttta

SEQ ID NO: 90330 - DNA, 6 bp, Unknown
  misc_feature (1)..( 6): Result.001 file - promoters60/1009861
ataata

SEQ ID NO: 90331 - DNA, 6 bp, Unknown
  misc_feature (1)..( 6): Result.001 file - promoters60/1009861
ataata

SEQ ID NO: 90332 - DNA, 8 bp, Unknown
  misc_feature (1)..( 8): Result.001 file - promoters60/1009861
catatata

SEQ ID NO: 90333 - DNA, 8 bp, Unknown
  misc_feature (1)..( 8): Result.001 file - promoters60/1009930
catatata

SEQ ID NO: 90334 - DNA, 9 bp, Unknown
  misc_feature (1)..( 9): Result.001 file - promoters60/1009930
ccatttctg

SEQ ID NO: 90335 - DNA, 9 bp, Unknown
  misc_feature (1)..( 9): Result.001 file - promoters60/1009930
tcatatctg

SEQ ID NO: 90336 - DNA, 9 bp, Unknown
  misc_feature (1)..( 9): Result.001 file - promoters60/1009930
tcatattta

SEQ ID NO: 90337 - DNA, 8 bp, Unknown
  misc_feature (1)..( 8): Result.001 file - promoters60/1009930
tttaaatt

SEQ ID NO: 90338 - DNA, 8 bp, Unknown
  misc_feature (1)..( 8): Result.001 file - promoters60/1009930
tttacatt

SEQ ID NO: 90339 - DNA, 8 bp, Unknown
  misc_feature (1)..( 8): Result.001 file - promoters60/1009930
tttcaatc

SEQ ID NO: 90340 - DNA, 9 bp, Unknown
  misc_feature (1)..( 9): Result.001 file - promoters60/1009930
aatttattt

SEQ ID NO: 90341 - DNA, 9 bp, Unknown
  misc_feature (1)..( 9): Result.001 file - promoters60/1009930
aatctattg

SEQ ID NO: 90342 - DNA, 9 bp, Unknown
  misc_feature (1)..( 9): Result.001 file - promoters60/1009930
ttcttattt

SEQ ID NO: 90343 - DNA, 9 bp, Unknown
  misc_feature (1)..( 9): Result.001 file - promoters60/1009930
ttacattag

SEQ ID NO: 90344 - DNA, 9 bp, Unknown
  misc_feature (1)..( 9): Result.001 file - promoters60/1009930
ttatatttt

SEQ ID NO: 90345 - DNA, 9 bp, Unknown
  misc_feature (1)..( 9): Result.001 file - promoters60/1009930
taacattag

SEQ ID NO: 90346 - DNA, 8 bp, Unknown
  misc_feature (1)..( 8): Result.001 file - promoters60/1009930
ttatgatc

SEQ ID NO: 90347 - DNA, 8 bp, Unknown
  misc_feature (1)..( 8): Result.001 file - promoters60/1009930
atatcatc

SEQ ID NO: 90348 - DNA, 8 bp, Unknown
  misc_feature (1)..( 8): Result.001 file - promoters60/1009930
ttatgaac

SEQ ID NO: 90349 - DNA, 7 bp, Unknown
  misc_feature (1)..( 7): Result.001 file - promoters60/1009930
taacact

SEQ ID NO: 90350 - DNA, 7 bp, Unknown
  misc_feature (1)..( 7): Result.001 file - promoters60/1009930
aaacact

SEQ ID NO: 90351 - DNA, 7 bp, Unknown
  misc_feature (1)..( 7): Result.001 file - promoters60/1009930
aaacact

SEQ ID NO: 90352 - DNA, 9 bp, Unknown
  misc_feature (1)..( 9): Result.001 file - promoters60/1009930
caaataatt

SEQ ID NO: 90353 - DNA, 9 bp, Unknown
  misc_feature (1)..( 9): Result.001 file - promoters60/1009930
tcaataata

SEQ ID NO: 90354 - DNA, 9 bp, Unknown
  misc_feature (1)..( 9): Result.001 file - promoters60/1009941
caaataatt

SEQ ID NO: 90355 - DNA, 10 bp, Unknown
  misc_feature (1)..( 10): Result.001 file - promoters60/1009941
ttcttttttc

SEQ ID NO: 90356 - DNA, 10 bp, Unknown
  misc_feature (1)..( 10): Result.001 file - promoters60/1009941
atcttcttta

SEQ ID NO: 90357 - DNA, 10 bp, Unknown
  misc_feature (1)..( 10): Result.001 file - promoters60/1009941
gtcttctttg

SEQ ID NO: 90358 - DNA, 10 bp, Unknown
  misc_feature (1)..( 10): Result.001 file - promoters60/1009941
ttcttttttt

SEQ ID NO: 90359 - DNA, 10 bp, Unknown
  misc_feature (1)..( 10): Result.001 file - promoters60/1009941
atctttttga

SEQ ID NO: 90360 - DNA, 10 bp, Unknown
  misc_feature (1)..( 10): Result.001 file - promoters60/1009941
ttcatcttca

SEQ ID NO: 90361 - DNA, 10 bp, Unknown
  misc_feature (1)..( 10): Result.001 file - promoters60/1009941
ctcttattta

SEQ ID NO: 90362 - DNA, 14 bp, Unknown
  misc_feature (1)..( 14): Result.001 file - promoters60/1009941
aaaagtatttatat

SEQ ID NO: 90363 - DNA, 14 bp, Unknown
  misc_feature (1)..( 14): Result.001 file - promoters60/1009941
catggtatatatat

SEQ ID NO: 90364 - DNA, 14 bp, Unknown
  misc_feature (1)..( 14): Result.001 file - promoters60/1009941
aaaaatatttgtat

SEQ ID NO: 90365 - DNA, 14 bp, Unknown
  misc_feature (1)..( 14): Result.001 file - promoters60/1009941
cgacctatatataa

SEQ ID NO: 90366 - DNA, 14 bp, Unknown
  misc_feature (1)..( 14): Result.001 file - promoters60/1009941
ctcagtatataaat

SEQ ID NO: 90367 - DNA, 14 bp, Unknown
  misc_feature (1)..( 14): Result.001 file - promoters60/1009941
cgtataatataaag

SEQ ID NO: 90368 - DNA, 10 bp, Unknown
  misc_feature (1)..( 10): Result.001 file - promoters60/1009941
acatatatat

SEQ ID NO: 90369 - DNA, 10 bp, Unknown
  misc_feature (1)..( 10): Result.001 file - promoters60/1009941
cagtatataa

SEQ ID NO: 90370 - DNA, 10 bp, Unknown
  misc_feature (1)..( 10): Result.001 file - promoters60/1009941
tcttatttat

SEQ ID NO: 90371 - DNA, 10 bp, Unknown
  misc_feature (1)..( 10): Result.001 file - promoters60/1009941
tagtatttat

SEQ ID NO: 90372 - DNA, 10 bp, Unknown
  misc_feature (1)..( 10): Result.001 file - promoters60/1009941
tactatatac

SEQ ID NO: 90373 - DNA, 10 bp, Unknown
  misc_feature (1)..( 10): Result.001 file - promoters60/1009941
tcttctttag

SEQ ID NO: 90374 - DNA, 10 bp, Unknown
  misc_feature (1)..( 10): Result.001 file - promoters60/1009941
taaagtgtat

SEQ ID NO: 90375 - DNA, 10 bp, Unknown
  misc_feature (1)..( 10): Result.001 file - promoters60/1009941
agtttttcgt

SEQ ID NO: 90376 - DNA, 10 bp, Unknown
  misc_feature (1)..( 10): Result.001 file - promoters60/1009941
gttttctcgt

SEQ ID NO: 90377 - DNA, 10 bp, Unknown
  misc_feature (1)..( 10): Result.001 file - promoters60/1009941
catttttcta

SEQ ID NO: 90378 - DNA, 10 bp, Unknown
  misc_feature (1)..( 10): Result.001 file - promoters60/1009941
ttgttttcta

SEQ ID NO: 90379 - DNA, 10 bp, Unknown
  misc_feature (1)..( 10): Result.001 file - promoters60/1009941
gattttttgc

SEQ ID NO: 90380 - DNA, 10 bp, Unknown
  misc_feature (1)..( 10): Result.001 file - promoters60/1009941
aattgttcta

SEQ ID NO: 90381 - DNA, 12 bp, Unknown
  misc_feature (1)..( 12): Result.001 file - promoters60/1009941
taaaataatttt

SEQ ID NO: 90382 - DNA, 12 bp, Unknown
  misc_feature (1)..( 12): Result.001 file - promoters60/1009941
agaaataacaaa

SEQ ID NO: 90383 - DNA, 12 bp, Unknown
  misc_feature (1)..( 12): Result.001 file - promoters60/1009941
aaaaattatttt

SEQ ID NO: 90384 - DNA, 12 bp, Unknown
  misc_feature (1)..( 12): Result.001 file - promoters60/1009941
agaaattaaagg

SEQ ID NO: 90385 - DNA, 13 bp, Unknown
  misc_feature (1)..( 13): Result.001 file - promoters60/1009941
gaaagattaataa

SEQ ID NO: 90386 - DNA, 13 bp, Unknown
  misc_feature (1)..( 13): Result.001 file - promoters60/1009941
caaaaatttataa

SEQ ID NO: 90387 - DNA, 16 bp, Unknown
  misc_feature (1)..( 16): Result.001 file - promoters60/1009941
agtaaagattattgat

SEQ ID NO: 90388 - DNA, 16 bp, Unknown
  misc_feature (1)..( 16): Result.001 file - promoters60/1009941
atgaaagactatttgc

SEQ ID NO: 90389 - DNA, 16 bp, Unknown
  misc_feature (1)..( 16): Result.001 file - promoters60/1009941
ttaaaagtttaaaatg

SEQ ID NO: 90390 - DNA, 16 bp, Unknown
  misc_feature (1)..( 16): Result.001 file - promoters60/1009941
tttaatgaagcagctg

SEQ ID NO: 90391 - DNA, 16 bp, Unknown
  misc_feature (1)..( 16): Result.001 file - promoters60/1009941
aagtaagactttggct

SEQ ID NO: 90392 - DNA, 16 bp, Unknown
  misc_feature (1)..( 16): Result.001 file - promoters60/1009941
tttttgttctatatgc

SEQ ID NO: 90393 - DNA, 16 bp, Unknown
  misc_feature (1)..( 16): Result.001 file - promoters60/1009999
tttaatcgatcatcat

SEQ ID NO: 90394 - DNA, 6 bp, Unknown
  misc_feature (1)..( 6): Result.001 file - promoters60/1009999
ttgttt

SEQ ID NO: 90395 - DNA, 6 bp, Unknown
  misc_feature (1)..( 6): Result.001 file - promoters60/1009999
ttgttt

SEQ ID NO: 90396 - DNA, 6 bp, Unknown
  misc_feature (1)..( 6): Result.001 file - promoters60/1009999
tatttt

SEQ ID NO: 90397 - DNA, 6 bp, Unknown
  misc_feature (1)..( 6): Result.001 file - promoters60/1009999
tatttt

SEQ ID NO: 90398 - DNA, 7 bp, Unknown
  misc_feature (1)..( 7): Result.001 file - promoters60/1009999
tttgctt

SEQ ID NO: 90399 - DNA, 7 bp, Unknown
  misc_feature (1)..( 7): Result.001 file - promoters60/1009999
tttactt

SEQ ID NO: 90400 - DNA, 6 bp, Unknown
  misc_feature (1)..( 6): Result.001 file - promoters60/1009999
aaaaga

SEQ ID NO: 90401 - DNA, 6 bp, Unknown
  misc_feature (1)..( 6): Result.001 file - promoters60/1009999
aaaaga

SEQ ID NO: 90402 - DNA, 6 bp, Unknown
  misc_feature (1)..( 6): Result.001 file - promoters60/1009999
aataaa

SEQ ID NO: 90403 - DNA, 6 bp, Unknown
  misc_feature (1)..( 6): Result.001 file - promoters60/1009999
aataaa

SEQ ID NO: 90404 - DNA, 7 bp, Unknown
  misc_feature (1)..( 7): Result.001 file - promoters60/1009999
ttcttcc

SEQ ID NO: 90405 - DNA, 7 bp, Unknown
  misc_feature (1)..( 7): Result.001 file - promoters60/1009999
ttcctcc

SEQ ID NO: 90406 - DNA, 10 bp, Unknown
  misc_feature (1)..( 10): Result.001 file - promoters60/1009999
gtacaaagta

SEQ ID NO: 90407 - DNA, 10 bp, Unknown
  misc_feature (1)..( 10): Result.001 file - promoters60/1009999
gtaaaaattt

SEQ ID NO: 90408 - DNA, 10 bp, Unknown
  misc_feature (1)..( 10): Result.001 file - promoters60/1009999
ctaaatattt

SEQ ID NO: 90409 - DNA, 7 bp, Unknown
  misc_feature (1)..( 7): Result.001 file - promoters60/1009999
ttggtca

SEQ ID NO: 90410 - DNA, 7 bp, Unknown
  misc_feature (1)..( 7): Result.001 file - promoters60/1009999
ttgctca

SEQ ID NO: 90411 - DNA, 7 bp, Unknown
  misc_feature (1)..( 7): Result.001 file - promoters60/1009999
ccactaa

SEQ ID NO: 90412 - DNA, 7 bp, Unknown
  misc_feature (1)..( 7): Result.001 file - promoters60/1009999
ccattaa

SEQ ID NO: 90413 - DNA, 6 bp, Unknown
  misc_feature (1)..( 6): Result.001 file - promoters60/1009999
ataaaa

SEQ ID NO: 90414 - DNA, 6 bp, Unknown
  misc_feature (1)..( 6): Result.001 file - promoters60/1009999
ataaaa

SEQ ID NO: 90415 - DNA, 8 bp, Unknown
  misc_feature (1)..( 8): Result.001 file - promoters60/1009999
tttatttt

SEQ ID NO: 90416 - DNA, 8 bp, Unknown
  misc_feature (1)..( 8): Result.001 file - promoters60/1009999
tttctttt

SEQ ID NO: 90417 - DNA, 6 bp, Unknown
  misc_feature (1)..( 6): Result.001 file - promoters60/1009999
tttact

SEQ ID NO: 90418 - DNA, 6 bp, Unknown
  misc_feature (1)..( 6): Result.001 file - promoters60/1009999
tttact

SEQ ID NO: 90419 - DNA, 9 bp, Unknown
  misc_feature (1)..( 9): Result.001 file - promoters60/1009999
cttattttt

SEQ ID NO: 90420 - DNA, 9 bp, Unknown
  misc_feature (1)..( 9): Result.001 file - promoters60/1009999
cttagtttt

SEQ ID NO: 90421 - DNA, 8 bp, Unknown
  misc_feature (1)..( 8): Result.001 file - promoters60/1009999
tttgtttg

SEQ ID NO: 90422 - DNA, 8 bp, Unknown
  misc_feature (1)..( 8): Result.001 file - promoters60/1009999
tttgtttg

SEQ ID NO: 90423 - DNA, 6 bp, Unknown
  misc_feature (1)..( 6): Result.001 file - promoters60/1009999
aagttt

SEQ ID NO: 90424 - DNA, 6 bp, Unknown
  misc_feature (1)..( 6): Result.001 file - promoters60/1009999
aagttt

SEQ ID NO: 90425 - DNA, 10 bp, Unknown
  misc_feature (1)..( 10): Result.001 file - promoters60/1009999
caaagtaatt

SEQ ID NO: 90426 - DNA, 10 bp, Unknown
  misc_feature (1)..( 10): Result.001 file - promoters60/1009999
caaactaatt

SEQ ID NO: 90427 - DNA, 7 bp, Unknown
  misc_feature (1)..( 7): Result.001 file - promoters60/1009999
attggaa

SEQ ID NO: 90428 - DNA, 7 bp, Unknown
  misc_feature (1)..( 7): Result.001 file - promoters60/1009999
attagaa

SEQ ID NO: 90429 - DNA, 8 bp, Unknown
  misc_feature (1)..( 8): Result.001 file - promoters60/1009999
aacaaaat

SEQ ID NO: 90430 - DNA, 8 bp, Unknown
  misc_feature (1)..( 8): Result.001 file - promoters60/1010019
aactaaat

SEQ ID NO: 90431 - DNA, 7 bp, Unknown
  misc_feature (1)..( 7): Result.001 file - promoters60/1010019
caagaac

SEQ ID NO: 90432 - DNA, 7 bp, Unknown
  misc_feature (1)..( 7): Result.001 file - promoters60/1010019
caaaaac

SEQ ID NO: 90433 - DNA, 7 bp, Unknown
  misc_feature (1)..( 7): Result.001 file - promoters60/1010025
caaaaag

SEQ ID NO: 90434 - DNA, 9 bp, Unknown
  misc_feature (1)..( 9): Result.001 file - promoters60/1010025
agattttct

SEQ ID NO: 90435 - DNA, 9 bp, Unknown
  misc_feature (1)..( 9): Result.001 file - promoters60/1010025
tcattatct

SEQ ID NO: 90436 - DNA, 9 bp, Unknown
  misc_feature (1)..( 9): Result.001 file - promoters60/1010025
agattttaa

SEQ ID NO: 90437 - DNA, 6 bp, Unknown
  misc_feature (1)..( 6): Result.001 file - promoters60/1010025
aaaaac

SEQ ID NO: 90438 - DNA, 6 bp, Unknown
  misc_feature (1)..( 6): Result.001 file - promoters60/1010025
aaaaac

SEQ ID NO: 90439 - DNA, 6 bp, Unknown
  misc_feature (1)..( 6): Result.001 file - promoters60/1010025
aaaaac

SEQ ID NO: 90440 - DNA, 9 bp, Unknown
  misc_feature (1)..( 9): Result.001 file - promoters60/1010025
tgaaaaagt

SEQ ID NO: 90441 - DNA, 9 bp, Unknown
  misc_feature (1)..( 9): Result.001 file - promoters60/1010025
tgaaaaaaa

SEQ ID NO: 90442 - DNA, 9 bp, Unknown
  misc_feature (1)..( 9): Result.001 file - promoters60/1010025
ttaaaaaaa

SEQ ID NO: 90443 - DNA, 11 bp, Unknown
  misc_feature (1)..( 11): Result.001 file - promoters60/1010025
gtttacttgct

SEQ ID NO: 90444 - DNA, 11 bp, Unknown
  misc_feature (1)..( 11): Result.001 file - promoters60/1010025
atttatttgtg

SEQ ID NO: 90445 - DNA, 11 bp, Unknown
  misc_feature (1)..( 11): Result.001 file - promoters60/1010025
atttattagtg

SEQ ID NO: 90446 - DNA, 8 bp, Unknown
  misc_feature (1)..( 8): Result.001 file - promoters60/1010025
tagtacta

SEQ ID NO: 90447 - DNA, 8 bp, Unknown
  misc_feature (1)..( 8): Result.001 file - promoters60/1010025
atgtacta

SEQ ID NO: 90448 - DNA, 8 bp, Unknown
  misc_feature (1)..( 8): Result.001 file - promoters60/1010025
atgaactc

SEQ ID NO: 90449 - DNA, 9 bp, Unknown
  misc_feature (1)..( 9): Result.001 file - promoters60/1010025
aaaatttgt

SEQ ID NO: 90450 - DNA, 9 bp, Unknown
  misc_feature (1)..( 9): Result.001 file - promoters60/1010025
aaaatgtgt

SEQ ID NO: 90451 - DNA, 9 bp, Unknown
  misc_feature (1)..( 9): Result.001 file - promoters60/1010055
aaaatttga

SEQ ID NO: 90452 - DNA, 10 bp, Unknown
  misc_feature (1)..( 10): Result.001 file - promoters60/1010055
gaaaaacaaa

SEQ ID NO: 90453 - DNA, 10 bp, Unknown
  misc_feature (1)..( 10): Result.001 file - promoters60/1010055
ggaaaaaaaa

SEQ ID NO: 90454 - DNA, 10 bp, Unknown
  misc_feature (1)..( 10): Result.001 file - promoters60/1010055
gtcaaacaaa

SEQ ID NO: 90455 - DNA, 10 bp, Unknown
  misc_feature (1)..( 10): Result.001 file - promoters60/1010055
tttaaaaaaa

SEQ ID NO: 90456 - DNA, 10 bp, Unknown
  misc_feature (1)..( 10): Result.001 file - promoters60/1010055
gtgaaacaaa

SEQ ID NO: 90457 - DNA, 10 bp, Unknown
  misc_feature (1)..( 10): Result.001 file - promoters60/1010055
tataagaaaa

SEQ ID NO: 90458 - DNA, 10 bp, Unknown
  misc_feature (1)..( 10): Result.001 file - promoters60/1010055
tatgagaaat

SEQ ID NO: 90459 - DNA, 14 bp, Unknown
  misc_feature (1)..( 14): Result.001 file - promoters60/1010055
atattattagtagg

SEQ ID NO: 90460 - DNA, 14 bp, Unknown
  misc_feature (1)..( 14): Result.001 file - promoters60/1010055
ttattatattgaga

SEQ ID NO: 90461 - DNA, 14 bp, Unknown
  misc_feature (1)..( 14): Result.001 file - promoters60/1010055
atataattattttg

SEQ ID NO: 90462 - DNA, 14 bp, Unknown
  misc_feature (1)..( 14): Result.001 file - promoters60/1010055
aaattatttacaaa

SEQ ID NO: 90463 - DNA, 14 bp, Unknown
  misc_feature (1)..( 14): Result.001 file - promoters60/1010055
gattaattcttttc

SEQ ID NO: 90464 - DNA, 14 bp, Unknown
  misc_feature (1)..( 14): Result.001 file - promoters60/1010055
ttttaatgattttg

SEQ ID NO: 90465 - DNA, 14 bp, Unknown
  misc_feature (1)..( 14): Result.001 file - promoters60/1010055
agaaaatatacatt

SEQ ID NO: 90466 - DNA, 9 bp, Unknown
  misc_feature (1)..( 9): Result.001 file - promoters60/1010055
aatgaaaaa

SEQ ID NO: 90467 - DNA, 9 bp, Unknown
  misc_feature (1)..( 9): Result.001 file - promoters60/1010055
aatgaaatt

SEQ ID NO: 90468 - DNA, 10 bp, Unknown
  misc_feature (1)..( 10): Result.001 file - promoters60/1010055
tatgagaaat

SEQ ID NO: 90469 - DNA, 10 bp, Unknown
  misc_feature (1)..( 10): Result.001 file - promoters60/1010055
aatgatattc

SEQ ID NO: 90470 - DNA, 10 bp, Unknown
  misc_feature (1)..( 10): Result.001 file - promoters60/1010055
aatgttattt

SEQ ID NO: 90471 - DNA, 10 bp, Unknown
  misc_feature (1)..( 10): Result.001 file - promoters60/1010055
ctatttattt

SEQ ID NO: 90472 - DNA, 11 bp, Unknown
  misc_feature (1)..( 11): Result.001 file - promoters60/1010055
atgaaaaacaa

SEQ ID NO: 90473 - DNA, 11 bp, Unknown
  misc_feature (1)..( 11): Result.001 file - promoters60/1010055
aagaaaaaata

SEQ ID NO: 90474 - DNA, 11 bp, Unknown
  misc_feature (1)..( 11): Result.001 file - promoters60/1010055
atgagaaatca

SEQ ID NO: 90475 - DNA, 11 bp, Unknown
  misc_feature (1)..( 11): Result.001 file - promoters60/1010055
gggaaaaaaaa

SEQ ID NO: 90476 - DNA, 11 bp, Unknown
  misc_feature (1)..( 11): Result.001 file - promoters60/1010055
aagaaaatata

SEQ ID NO: 90477 - DNA, 11 bp, Unknown
  misc_feature (1)..( 11): Result.001 file - promoters60/1010055
aacaaattatt

SEQ ID NO: 90478 - DNA, 8 bp, Unknown
  misc_feature (1)..( 8): Result.001 file - promoters60/1010055
atttattt

SEQ ID NO: 90479 - DNA, 8 bp, Unknown
  misc_feature (1)..( 8): Result.001 file - promoters60/1010055
attcattt

SEQ ID NO: 90480 - DNA, 8 bp, Unknown
  misc_feature (1)..( 8): Result.001 file - promoters60/1010055
ttttattc

SEQ ID NO: 90481 - DNA, 8 bp, Unknown
  misc_feature (1)..( 8): Result.001 file - promoters60/1010055
attttttt

SEQ ID NO: 90482 - DNA, 8 bp, Unknown
  misc_feature (1)..( 8): Result.001 file - promoters60/1010055
ttttcttt

SEQ ID NO: 90483 - DNA, 8 bp, Unknown
  misc_feature (1)..( 8): Result.001 file - promoters60/1010055
tttcattt

SEQ ID NO: 90484 - DNA, 8 bp, Unknown
  misc_feature (1)..( 8): Result.001 file - promoters60/1010065
atttttag

SEQ ID NO: 90485 - DNA, 8 bp, Unknown
  misc_feature (1)..( 8): Result.001 file - promoters60/1010065
tatacata

SEQ ID NO: 90486 - DNA, 8 bp, Unknown
  misc_feature (1)..( 8): Result.001 file - promoters60/1010065
tattcata

SEQ ID NO: 90487 - DNA, 9 bp, Unknown
  misc_feature (1)..( 9): Result.001 file - promoters60/1010065
tcgaagtag

SEQ ID NO: 90488 - DNA, 9 bp, Unknown
  misc_feature (1)..( 9): Result.001 file - promoters60/1010065
tcgaaatag

SEQ ID NO: 90489 - DNA, 9 bp, Unknown
  misc_feature (1)..( 9): Result.001 file - promoters60/1010065
gcgcaatta

SEQ ID NO: 90490 - DNA, 9 bp, Unknown
  misc_feature (1)..( 9): Result.001 file - promoters60/1010065
gcgcaatta

SEQ ID NO: 90491 - DNA, 6 bp, Unknown
  misc_feature (1)..( 6): Result.001 file - promoters60/1010065
taaaca

SEQ ID NO: 90492 - DNA, 6 bp, Unknown
  misc_feature (1)..( 6): Result.001 file - promoters60/1010065
taaaca

SEQ ID NO: 90493 - DNA, 8 bp, Unknown
  misc_feature (1)..( 8): Result.001 file - promoters60/1010065
attattta

SEQ ID NO: 90494 - DNA, 8 bp, Unknown
  misc_feature (1)..( 8): Result.001 file - promoters60/1010065
atttttta

SEQ ID NO: 90495 - DNA, 6 bp, Unknown
  misc_feature (1)..( 6): Result.001 file - promoters60/1010065
tttctc

SEQ ID NO: 90496 - DNA, 6 bp, Unknown
  misc_feature (1)..( 6): Result.001 file - promoters60/1010065
tttctc

SEQ ID NO: 90497 - DNA, 6 bp, Unknown
  misc_feature (1)..( 6): Result.001 file - promoters60/1010065
aatttt

SEQ ID NO: 90498 - DNA, 6 bp, Unknown
  misc_feature (1)..( 6): Result.001 file - promoters60/1010065
aatttt

SEQ ID NO: 90499 - DNA, 7 bp, Unknown
  misc_feature (1)..( 7): Result.001 file - promoters60/1010065
atatata

SEQ ID NO: 90500 - DNA, 7 bp, Unknown
  misc_feature (1)..( 7): Result.001 file - promoters60/1010065
atacata

SEQ ID NO: 90501 - DNA, 8 bp, Unknown
  misc_feature (1)..( 8): Result.001 file - promoters60/1010065
acatgcat

SEQ ID NO: 90502 - DNA, 8 bp, Unknown
  misc_feature (1)..( 8): Result.001 file - promoters60/1010065
acatacat

SEQ ID NO: 90503 - DNA, 7 bp, Unknown
  misc_feature (1)..( 7): Result.001 file - promoters60/1010065
atagtag
